United States Patent 7,655,785 (BIOINFORMATICALLY DETECTABLE GROUP OF NOVEL REGULATORY OLIGONUCLEOTIDES AND USES THEREOF) - sequence listing, part 31

SEQ ID NO: 1267345 - RNA, 18 nt, Homo sapiens
ugguguuuacccaguauu

SEQ ID NO: 1267346 - RNA, 15 nt, Homo sapiens
ugguuaacaucucag

SEQ ID NO: 1267347 - RNA, 17 nt, Homo sapiens
ugguuaagacuacugaa

SEQ ID NO: 1267348 - RNA, 20 nt, Homo sapiens
ugguuacuaaaaaguaccag

SEQ ID NO: 1267349 - RNA, 13 nt, Homo sapiens
ugguuaugaaaga

SEQ ID NO: 1267350 - RNA, 13 nt, Homo sapiens
ugguuaugaacuu

SEQ ID NO: 1267351 - RNA, 22 nt, Homo sapiens
ugguucaauuucagaaguaaug

SEQ ID NO: 1267352 - RNA, 19 nt, Homo sapiens
ugguucacauccuaccccu

SEQ ID NO: 1267353 - RNA, 17 nt, Homo sapiens
ugguuccaagcccugga

SEQ ID NO: 1267354 - RNA, 19 nt, Homo sapiens
ugguuccaugccugagggu

SEQ ID NO: 1267355 - RNA, 17 nt, Homo sapiens
ugguuccucucuuggca

SEQ ID NO: 1267356 - RNA, 17 nt, Homo sapiens
ugguucuuaguucucac

SEQ ID NO: 1267357 - RNA, 22 nt, Homo sapiens
ugguugaauaguucuauacaaa

SEQ ID NO: 1267358 - RNA, 12 nt, Homo sapiens
ugguuguagaag

SEQ ID NO: 1267359 - RNA, 16 nt, Homo sapiens
ugguuguuguauugau

SEQ ID NO: 1267360 - RNA, 15 nt, Homo sapiens
ugguuuccacauuua

SEQ ID NO: 1267361 - RNA, 18 nt, Homo sapiens
uuggcaacaggacagagu

SEQ ID NO: 1267362 - RNA, 19 nt, Homo sapiens
uuggcaauaccuaguucug

SEQ ID NO: 1267363 - RNA, 14 nt, Homo sapiens
uuggcacauuucau

SEQ ID NO: 1267364 - RNA, 15 nt, Homo sapiens
uuggcacugagauau

SEQ ID NO: 1267365 - RNA, 16 nt, Homo sapiens
uuggcacuguggagcu

SEQ ID NO: 1267366 - RNA, 15 nt, Homo sapiens
uuggccaaugugcau

SEQ ID NO: 1267367 - RNA, 15 nt, Homo sapiens
uuggccagugugaca

SEQ ID NO: 1267368 - RNA, 23 nt, Homo sapiens
uuggccaugggucccauucuugg

SEQ ID NO: 1267369 - RNA, 16 nt, Homo sapiens
uuggccauguucucca

SEQ ID NO: 1267370 - RNA, 12 nt, Homo sapiens
uuggcccaggau

SEQ ID NO: 1267371 - RNA, 19 nt, Homo sapiens
uuggccuagcccacccugc

SEQ ID NO: 1267372 - RNA, 22 nt, Homo sapiens
uuggccucagaauucacaaaau

SEQ ID NO: 1267373 - RNA, 15 nt, Homo sapiens
uuggccugcugugau

SEQ ID NO: 1267374 - RNA, 20 nt, Homo sapiens
uuggccuguagaguugcuga

SEQ ID NO: 1267375 - RNA, 15 nt, Homo sapiens
uuggcuacacacaaa

SEQ ID NO: 1267376 - RNA, 22 nt, Homo sapiens
uuggcuacacacaaaccaguau

SEQ ID NO: 1267377 - RNA, 18 nt, Homo sapiens
uuggcuccagucuuccga

SEQ ID NO: 1267378 - RNA, 13 nt, Homo sapiens
uuggcucuaguca

SEQ ID NO: 1267379 - RNA, 16 nt, Homo sapiens
uuggcucuagucacug

SEQ ID NO: 1267380 - RNA, 11 nt, Homo sapiens
uuggcugugag

SEQ ID NO: 1267381 - RNA, 18 nt, Homo sapiens
uugggaaaaaaacuuggc

SEQ ID NO: 1267382 - RNA, 14 nt, Homo sapiens
uugggaaagcccag

SEQ ID NO: 1267383 - RNA, 17 nt, Homo sapiens
uugggaacaggcugugu

SEQ ID NO: 1267384 - RNA, 12 nt, Homo sapiens
uugggaagacca

SEQ ID NO: 1267385 - RNA, 17 nt, Homo sapiens
uugggaagggcagggaa

SEQ ID NO: 1267386 - RNA, 13 nt, Homo sapiens
uugggaccugcuu

SEQ ID NO: 1267387 - RNA, 14 nt, Homo sapiens
uugggagcugccaa

SEQ ID NO: 1267388 - RNA, 22 nt, Homo sapiens
uugggaggcugaggcaagagaa

SEQ ID NO: 1267389 - RNA, 22 nt, Homo sapiens
uugggaggcugaggcaggagaa

SEQ ID NO: 1267390 - RNA, 16 nt, Homo sapiens
uugggauauucugaaa

SEQ ID NO: 1267391 - RNA, 13 nt, Homo sapiens
uugggcaugccau

SEQ ID NO: 1267392 - RNA, 16 nt, Homo sapiens
uugggccuugcugcug

SEQ ID NO: 1267393 - RNA, 15 nt, Homo sapiens
uuggggaaaaaagca

SEQ ID NO: 1267394 - RNA, 20 nt, Homo sapiens
uuggggaagccaggugagcu

SEQ ID NO: 1267395 - RNA, 22 nt, Homo sapiens
uuggggaggacaaaacuucuug

SEQ ID NO: 1267396 - RNA, 15 nt, Homo sapiens
uuggggccaccaaag

SEQ ID NO: 1267397 - RNA, 19 nt, Homo sapiens
uugggguauaggucucauc

SEQ ID NO: 1267398 - RNA, 18 nt, Homo sapiens
uuggguacugggugcugu

SEQ ID NO: 1267399 - RNA, 18 nt, Homo sapiens
uugguaaaaaugcugcuc

SEQ ID NO: 1267400 - RNA, 21 nt, Homo sapiens
uugguaauauuaauuuccacu

SEQ ID NO: 1267401 - RNA, 12 nt, Homo sapiens
uugguaccaugg

SEQ ID NO: 1267402 - RNA, 14 nt, Homo sapiens
uugguacuuuuaug

SEQ ID NO: 1267403 - RNA, 20 nt, Homo sapiens
uugguauacuuuugcuucag

SEQ ID NO: 1267404 - RNA, 14 nt, Homo sapiens
uuggucacauauca

SEQ ID NO: 1267405 - RNA, 13 nt, Homo sapiens
uuggucaguuaca

SEQ ID NO: 1267406 - RNA, 16 nt, Homo sapiens
uugguccaagauuccg

SEQ ID NO: 1267407 - RNA, 16 nt, Homo sapiens
uugguccuggggacca

SEQ ID NO: 1267408 - RNA, 15 nt, Homo sapiens
uugguccuugucugc

SEQ ID NO: 1267409 - RNA, 11 nt, Homo sapiens
uuggugaauga

SEQ ID NO: 1267410 - RNA, 14 nt, Homo sapiens
uuggugaauuucac

SEQ ID NO: 1267411 - RNA, 14 nt, Homo sapiens
uuggugcauagaac

SEQ ID NO: 1267412 - RNA, 15 nt, Homo sapiens
uugguucaacaucua

SEQ ID NO: 1267413 - RNA, 19 nt, Homo sapiens
uuguaaaaagaaaaaccac

SEQ ID NO: 1267414 - RNA, 12 nt, Homo sapiens
uuguaacaagaa

SEQ ID NO: 1267415 - RNA, 13 nt, Homo sapiens
uuguaaccugcau

SEQ ID NO: 1267416 - RNA, 18 nt, Homo sapiens
uuguaaccugcugugaua

SEQ ID NO: 1267417 - RNA, 21 nt, Homo sapiens
uuguaagaaaaugagacaaaa

SEQ ID NO: 1267418 - RNA, 15 nt, Homo sapiens
uuguaagaguguaga

SEQ ID NO: 1267419 - RNA, 16 nt, Homo sapiens
uuguaagaguguagaa

SEQ ID NO: 1267420 - RNA, 17 nt, Homo sapiens
uuguaaguaaauugccu

SEQ ID NO: 1267421 - RNA, 20 nt, Homo sapiens
uuguaaguuuuugauucuac

SEQ ID NO: 1267422 - RNA, 14 nt, Homo sapiens
uuguaauaaauacu

SEQ ID NO: 1267423 - RNA, 15 nt, Homo sapiens
uuguaaucacuccca

SEQ ID NO: 1267424 - RNA, 19 nt, Homo sapiens
uuguaaugacagugcuaaa

SEQ ID NO: 1267425 - RNA, 19 nt, Homo sapiens
uuguaauuuugcaaaacau

SEQ ID NO: 1267426 - RNA, 22 nt, Homo sapiens
uuguacacugcuguacccagau

SEQ ID NO: 1267427 - RNA, 20 nt, Homo sapiens
uuguacagugucugugccau

SEQ ID NO: 1267428 - RNA, 17 nt, Homo sapiens
uuguaccauuuucuauc

SEQ ID NO: 1267429 - RNA, 19 nt, Homo sapiens
uuguacccccagguggaag

SEQ ID NO: 1267430 - RNA, 17 nt, Homo sapiens
uuguacuucuguguuca

SEQ ID NO: 1267431 - RNA, 18 nt, Homo sapiens
uuguacuuuuuuuuacuu

SEQ ID NO: 1267432 - RNA, 16 nt, Homo sapiens
uuguagcacugagggu

SEQ ID NO: 1267433 - RNA, 14 nt, Homo sapiens
uuguagccagguac

SEQ ID NO: 1267434 - RNA, 21 nt, Homo sapiens
uuguaggagaaacucccaugu

SEQ ID NO: 1267435 - RNA, 24 nt, Homo sapiens
uuguauaaagcauuuguagcaauu

SEQ ID NO: 1267436 - RNA, 19 nt, Homo sapiens
uuguauaaucccacccacc

SEQ ID NO: 1267437 - RNA, 19 nt, Homo sapiens
uuguauauugucagauauu

SEQ ID NO: 1267438 - RNA, 16 nt, Homo sapiens
uuguaucaaaguguga

SEQ ID NO: 1267439 - RNA, 15 nt, Homo sapiens
uuguaucaacacugu

SEQ ID NO: 1267440 - RNA, 21 nt, Homo sapiens
uuguauggagccucuucugcc

SEQ ID NO: 1267441 - RNA, 14 nt, Homo sapiens
uuguauugacuauu

SEQ ID NO: 1267442 - RNA, 19 nt, Homo sapiens
uugucagaguucugcucua

SEQ ID NO: 1267443 - RNA, 13 nt, Homo sapiens
uugucauuuauaa

SEQ ID NO: 1267444 - RNA, 22 nt, Homo sapiens
uuguccguguucauacauuuga

SEQ ID NO: 1267445 - RNA, 17 nt, Homo sapiens
uuguccugccagcugcc

SEQ ID NO: 1267446 - RNA, 13 nt, Homo sapiens
uugucuacacucu

SEQ ID NO: 1267447 - RNA, 20 nt, Homo sapiens
uugucucuagagcagggauu

SEQ ID NO: 1267448 - RNA, 13 nt, Homo sapiens
uugucuguguugc

SEQ ID NO: 1267449 - RNA, 21 nt, Homo sapiens
uugucuguuaaaugaacuuga

SEQ ID NO: 1267450 - RNA, 21 nt, Homo sapiens
uugugaacuuuuuguagggga

SEQ ID NO: 1267451 - RNA, 16 nt, Homo sapiens
uugugagccuaugaua

SEQ ID NO: 1267452 - RNA, 20 nt, Homo sapiens
uugugaguuuaccuuguaua

SEQ ID NO: 1267453 - RNA, 15 nt, Homo sapiens
uugugaugaugcugu

SEQ ID NO: 1267454 - RNA, 18 nt, Homo sapiens
uugugauguuuugagagu

SEQ ID NO: 1267455 - RNA, 18 nt, Homo sapiens
uugugcaaaauauuugac

SEQ ID NO: 1267456 - RNA, 18 nt, Homo sapiens
uugugcauaaaaacaaga

SEQ ID NO: 1267457 - RNA, 16 nt, Homo sapiens
uugugcuccaaacaaa

SEQ ID NO: 1267458 - RNA, 21 nt, Homo sapiens
uugugcuggauggagcccagg

SEQ ID NO: 1267459 - RNA, 23 nt, Homo sapiens
uugugcuuaguccaauuccuugc

SEQ ID NO: 1267460 - RNA, 21 nt, Homo sapiens
uugugcuucacaguagagcca

SEQ ID NO: 1267461 - RNA, 16 nt, Homo sapiens
uuguggaugucuuccu

SEQ ID NO: 1267462 - RNA, 18 nt, Homo sapiens
uuguggcuuuuaugcuuu

SEQ ID NO: 1267463 - RNA, 14 nt, Homo sapiens
uugugguuaaucug

SEQ ID NO: 1267464 - RNA, 20 nt, Homo sapiens
uugugguuuauugaauguga

SEQ ID NO: 1267465 - RNA, 14 nt, Homo sapiens
uuguguaacauauu

SEQ ID NO: 1267466 - RNA, 17 nt, Homo sapiens
uugugugcucauguaug

SEQ ID NO: 1267467 - RNA, 20 nt, Homo sapiens
uuguguguuccaaguuucca

SEQ ID NO: 1267468 - RNA, 21 nt, Homo sapiens
uuguguguuuauuucacuuga

SEQ ID NO: 1267469 - RNA, 14 nt, Homo sapiens
uuguguuugugcca

SEQ ID NO: 1267470 - RNA, 15 nt, Homo sapiens
uuguuaauucuuccu

SEQ ID NO: 1267471 - RNA, 22 nt, Homo sapiens
uuguuacuguucuugcugcuag

SEQ ID NO: 1267472 - RNA, 15 nt, Homo sapiens
uuguuaucagucaau

SEQ ID NO: 1267473 - RNA, 18 nt, Homo sapiens
uuguuauucuguaguuuc

SEQ ID NO: 1267474 - RNA, 14 nt, Homo sapiens
uuguucauguuugg

SEQ ID NO: 1267475 - RNA, 12 nt, Homo sapiens
uuguuccaaaug

SEQ ID NO: 1267476 - RNA, 17 nt, Homo sapiens
uuguuccagauggggcc

SEQ ID NO: 1267477 - RNA, 17 nt, Homo sapiens
uuguuccaguacuaugg

SEQ ID NO: 1267478 - RNA, 16 nt, Homo sapiens
uuguuccccacugaca

SEQ ID NO: 1267479 - RNA, 16 nt, Homo sapiens
uuguugaaauugucaa

SEQ ID NO: 1267480 - RNA, 18 nt, Homo sapiens
uuguugccuucaucuuca

SEQ ID NO: 1267481 - RNA, 20 nt, Homo sapiens
uuguugccuucaucuucacu

SEQ ID NO: 1267482 - RNA, 17 nt, Homo sapiens
uuguuggaaaguaacug

SEQ ID NO: 1267483 - RNA, 20 nt, Homo sapiens
uuguuggaucuucaauggcu

SEQ ID NO: 1267484 - RNA, 18 nt, Homo sapiens
uuguuuacagucauugga

SEQ ID NO: 1267485 - RNA, 14 nt, Homo sapiens
uuguuuauauugca

SEQ ID NO: 1267486 - RNA, 22 nt, Homo sapiens
uuguuuccucuuccaaaguaaa

SEQ ID NO: 1267487 - RNA, 15 nt, Homo sapiens
uuucuuuuccauuua

SEQ ID NO: 1267488 - RNA, 17 nt, Homo sapiens
uuucuuuuuuauacuca

SEQ ID NO: 1267489 - RNA, 15 nt, Homo sapiens
uuugaaacugaaugu

SEQ ID NO: 1267490 - RNA, 12 nt, Homo sapiens
uuugaaauccaa

SEQ ID NO: 1267491 - RNA, 14 nt, Homo sapiens
uuugaaauccaaag

SEQ ID NO: 1267492 - RNA, 12 nt, Homo sapiens
uuugaaggcaaa

SEQ ID NO: 1267493 - RNA, 20 nt, Homo sapiens
uuugaaggcaaaauugcaaa

SEQ ID NO: 1267494 - RNA, 19 nt, Homo sapiens
uuugaauggaaaacacaug

SEQ ID NO: 1267495 - RNA, 23 nt, Homo sapiens
uuugaauuucaguaaacaaugaa

SEQ ID NO: 1267496 - RNA, 21 nt, Homo sapiens
uuugacgacagugcauuugcc

SEQ ID NO: 1267497 - RNA, 14 nt, Homo sapiens
uuugagacaggaga

SEQ ID NO: 1267498 - RNA, 19 nt, Homo sapiens
uuugagacggagucucuca

SEQ ID NO: 1267499 - RNA, 21 nt, Homo sapiens
uuugagcaagccgagcucucc

SEQ ID NO: 1267500 - RNA, 23 nt, Homo sapiens
uuugagcuaaucuucauuucuaa

SEQ ID NO: 1267501 - RNA, 22 nt, Homo sapiens
uuugaggauauauuuucacuuu

SEQ ID NO: 1267502 - RNA, 21 nt, Homo sapiens
uuugaguagauauuacuuuau

SEQ ID NO: 1267503 - RNA, 15 nt, Homo sapiens
uuugauaccauggca

SEQ ID NO: 1267504 - RNA, 19 nt, Homo sapiens
uuugauaccauggcacuga

SEQ ID NO: 1267505 - RNA, 24 nt, Homo sapiens
uuugauaccauggcacugacaaug

SEQ ID NO: 1267506 - RNA, 20 nt, Homo sapiens
uuugauauaccaaauuaaaa

SEQ ID NO: 1267507 - RNA, 22 nt, Homo sapiens
uuugaugccaagaaaguauuug

SEQ ID NO: 1267508 - RNA, 15 nt, Homo sapiens
uuugauucagcaaaa

SEQ ID NO: 1267509 - RNA, 16 nt, Homo sapiens
uuugauucagcaaaaa

SEQ ID NO: 1267510 - RNA, 16 nt, Homo sapiens
uuugauucuacucuua

SEQ ID NO: 1267511 - RNA, 14 nt, Homo sapiens
uuugauucuccagc

SEQ ID NO: 1267512 - RNA, 22 nt, Homo sapiens
uuugauugaggagcugcacuga

SEQ ID NO: 1267513 - RNA, 14 nt, Homo sapiens
uuugauugauuuga

SEQ ID NO: 1267514 - RNA, 18 nt, Homo sapiens
uuugcacacugcacuguu

SEQ ID NO: 1267515 - RNA, 21 nt, Homo sapiens
uuugcacccuguagauguucu

SEQ ID NO: 1267516 - RNA, 12 nt, Homo sapiens
uuugcacugagg

SEQ ID NO: 1267517 - RNA, 14 nt, Homo sapiens
uuugcagacaggca

SEQ ID NO: 1267518 - RNA, 21 nt, Homo sapiens
uuugcaugaugucuaccucag

SEQ ID NO: 1267519 - RNA, 15 nt, Homo sapiens
uuugcaugcaugcaa

SEQ ID NO: 1267520 - RNA, 20 nt, Homo sapiens
uuugcaugcuucgugccaca

SEQ ID NO: 1267521 - RNA, 15 nt, Homo sapiens
uuugcauguuuugua

SEQ ID NO: 1267522 - RNA, 19 nt, Homo sapiens
uuugcauuaaauucacaaa

SEQ ID NO: 1267523 - RNA, 21 nt, Homo sapiens
uuugccaacagaaacaugcca

SEQ ID NO: 1267524 - RNA, 22 nt, Homo sapiens
uuugccaaggcuaauccaauua

SEQ ID NO: 1267525 - RNA, 18 nt, Homo sapiens
uuugccaggacaugcaau

SEQ ID NO: 1267526 - RNA, 13 nt, Homo sapiens
uuugccagugccu

SEQ ID NO: 1267527 - RNA, 17 nt, Homo sapiens
uuugccagugccucuca

SEQ ID NO: 1267528 - RNA, 16 nt, Homo sapiens
uuugcuauuagacugu

SEQ ID NO: 1267529 - RNA, 19 nt, Homo sapiens
uuugcuauuagagcauuga

SEQ ID NO: 1267530 - RNA, 13 nt, Homo sapiens
uuugcucauggca

SEQ ID NO: 1267531 - RNA, 22 nt, Homo sapiens
uuugcuccuaaaccauugagcu

SEQ ID NO: 1267532 - RNA, 22 nt, Homo sapiens
uuugcucuuagcugucugcuca

SEQ ID NO: 1267533 - RNA, 17 nt, Homo sapiens
uuugcucuugccaaaaa

SEQ ID NO: 1267534 - RNA, 18 nt, Homo sapiens
uuugcuguauacuuuuaa

SEQ ID NO: 1267535 - RNA, 23 nt, Homo sapiens
uuugcugugaugauguguucuug

SEQ ID NO: 1267536 - RNA, 17 nt, Homo sapiens
uuugcuuaaaauuguga

SEQ ID NO: 1267537 - RNA, 16 nt, Homo sapiens
uuugcuugcaauguag

SEQ ID NO: 1267538 - RNA, 18 nt, Homo sapiens
uuuggaaauccucuagga

SEQ ID NO: 1267539 - RNA, 19 nt, Homo sapiens
uuuggagacacaacuauuu

SEQ ID NO: 1267540 - RNA, 16 nt, Homo sapiens
uuuggagucacuguag

SEQ ID NO: 1267541 - RNA, 15 nt, Homo sapiens
uuuggauuguaucaa

SEQ ID NO: 1267542 - RNA, 12 nt, Homo sapiens
uuuggcaauuuc

SEQ ID NO: 1267543 - RNA, 14 nt, Homo sapiens
uuuggccauuccaa

SEQ ID NO: 1267544 - RNA, 23 nt, Homo sapiens
uuuggcgaccuccuuucaucaca

SEQ ID NO: 1267545 - RNA, 18 nt, Homo sapiens
uuuggcuagguaucauuc

SEQ ID NO: 1267546 - RNA, 10 nt, Homo sapiens
uuugggacca

SEQ ID NO: 1267547 - RNA, 14 nt, Homo sapiens
uuugggaccugcuu

SEQ ID NO: 1267548 - RNA, 11 nt, Homo sapiens
uuugggagaca

SEQ ID NO: 1267549 - RNA, 19 nt, Homo sapiens
uuugggccccucagagccc

SEQ ID NO: 1267550 - RNA, 23 nt, Homo sapiens
uuuggggaaaaaagcacauacau

SEQ ID NO: 1267551 - RNA, 21 nt, Homo sapiens
uuuggggaaaggcuuggcaca

SEQ ID NO: 1267552 - RNA, 17 nt, Homo sapiens
uuuggggacucauuuca

SEQ ID NO: 1267553 - RNA, 19 nt, Homo sapiens
uuuggggagcaggaggcca

SEQ ID NO: 1267554 - RNA, 20 nt, Homo sapiens
uuugggggaacuggacacaa

SEQ ID NO: 1267555 - RNA, 11 nt, Homo sapiens
uuugggguccu

SEQ ID NO: 1267556 - RNA, 15 nt, Homo sapiens
uuugggguguauacu

SEQ ID NO: 1267557 - RNA, 19 nt, Homo sapiens
uuugguagaugcaugacuu

SEQ ID NO: 1267558 - RNA, 23 nt, Homo sapiens
uuugguaguggaauagugaauac

SEQ ID NO: 1267559 - RNA, 22 nt, Homo sapiens
uuuggucuauuuucugcagaaa

SEQ ID NO: 1267560 - RNA, 10 nt, Homo sapiens
uuugguucua

SEQ ID NO: 1267561 - RNA, 16 nt, Homo sapiens
uuuguaaaguuagccu

SEQ ID NO: 1267562 - RNA, 20 nt, Homo sapiens
uuuguaaauuaauacuucau

SEQ ID NO: 1267563 - RNA, 17 nt, Homo sapiens
uuuguaagacuuacaaa

SEQ ID NO: 1267564 - RNA, 18 nt, Homo sapiens
uuuguaagugcugcuaua

SEQ ID NO: 1267565 - RNA, 23 nt, Homo sapiens
uuuguacagaagaggauucaaaa

SEQ ID NO: 1267566 - RNA, 11 nt, Homo sapiens
uuuguaccauu

SEQ ID NO: 1267567 - RNA, 18 nt, Homo sapiens
uuuguagagacaggguuu

SEQ ID NO: 1267568 - RNA, 14 nt, Homo sapiens
uuuguagcacugag

SEQ ID NO: 1267569 - RNA, 21 nt, Homo sapiens
uuuguagguaauguuccugaa

SEQ ID NO: 1267570 - RNA, 15 nt, Homo sapiens
uuugucuuauauaua

SEQ ID NO: 1267571 - RNA, 22 nt, Homo sapiens
uuugugcagagauaaagaccuu

SEQ ID NO: 1267572 - RNA, 14 nt, Homo sapiens
uuugugguuguaga

SEQ ID NO: 1267573 - RNA, 18 nt, Homo sapiens
uuugugucaaaaggacau

SEQ ID NO: 1267574 - RNA, 18 nt, Homo sapiens
uuuguuaugacagugaau

SEQ ID NO: 1267575 - RNA, 22 nt, Homo sapiens
uuuguucaaugcuagaacaacg

SEQ ID NO: 1267576 - RNA, 15 nt, Homo sapiens
uuuguugcagccaaa

SEQ ID NO: 1267577 - RNA, 16 nt, Homo sapiens
uuuguuucauauauac

SEQ ID NO: 1267578 - RNA, 14 nt, Homo sapiens
uuuguuuuaaauac

SEQ ID NO: 1267579 - RNA, 21 nt, Homo sapiens
uuuuaaaaguuucaaugugau

SEQ ID NO: 1267580 - RNA, 19 nt, Homo sapiens
uuuuaaauaaaagcacaag

SEQ ID NO: 1267581 - RNA, 13 nt, Homo sapiens
uuuuaacauucca

SEQ ID NO: 1267582 - RNA, 17 nt, Homo sapiens
uuuuaacggaugguuga

SEQ ID NO: 1267583 - RNA, 13 nt, Homo sapiens
uuuuaacuuucua

SEQ ID NO: 1267584 - RNA, 12 nt, Homo sapiens
uuuuaauggugu

SEQ ID NO: 1267585 - RNA, 12 nt, Homo sapiens
uuuuaauugauu

SEQ ID NO: 1267586 - RNA, 21 nt, Homo sapiens
uuuuaauuuaaacaccuccuc

SEQ ID NO: 1267587 - RNA, 13 nt, Homo sapiens
uuuuaauuuaaca

SEQ ID NO: 1267588 - RNA, 14 nt, Homo sapiens
uuuuacacauuaga

SEQ ID NO: 1267589 - RNA, 21 nt, Homo sapiens
uuuuacauuucauacaacaga

SEQ ID NO: 1267590 - RNA, 20 nt, Homo sapiens
uuuuacccuauacauccaca

SEQ ID NO: 1267591 - RNA, 20 nt, Homo sapiens
uuuuacugugaaacuggcac

SEQ ID NO: 1267592 - RNA, 11 nt, Homo sapiens
uuuuacuucca

SEQ ID NO: 1267593 - RNA, 13 nt, Homo sapiens
uuuuagacagagu

SEQ ID NO: 1267594 - RNA, 12 nt, Homo sapiens
uuuuagcuguga

SEQ ID NO: 1267595 - RNA, 22 nt, Homo sapiens
uuuuaguauaaguacauuauug

SEQ ID NO: 1267596 - RNA, 16 nt, Homo sapiens
uuuuaguugacucaca

SEQ ID NO: 1267597 - RNA, 20 nt, Homo sapiens
uuuuauacaaaccuaccaaa

SEQ ID NO: 1267598 - RNA, 12 nt, Homo sapiens
uuuuauauccac

SEQ ID NO: 1267599 - RNA, 21 nt, Homo sapiens
uuuuauaugcuuacugauaua

SEQ ID NO: 1267600 - RNA, 13 nt, Homo sapiens
uuuuauauguugc

SEQ ID NO: 1267601 - RNA, 19 nt, Homo sapiens
uuuuauauucuaagccagu

SEQ ID NO: 1267602 - RNA, 15 nt, Homo sapiens
uuuuaugaucuuggc

SEQ ID NO: 1267603 - RNA, 21 nt, Homo sapiens
uuuuaugccuucacuuuacaa

SEQ ID NO: 1267604 - RNA, 23 nt, Homo sapiens
uuuuauguguggcccaagacaau

SEQ ID NO: 1267605 - RNA, 17 nt, Homo sapiens
uuuuauuagcauucuga

SEQ ID NO: 1267606 - RNA, 15 nt, Homo sapiens
uuuuauuaugcauua

SEQ ID NO: 1267607 - RNA, 14 nt, Homo sapiens
uuuuauucuauauu

SEQ ID NO: 1267608 - RNA, 21 nt, Homo sapiens
uuuuauuuuuaugugcucuca

SEQ ID NO: 1267609 - RNA, 14 nt, Homo sapiens
uuuucaacauaacu

SEQ ID NO: 1267610 - RNA, 15 nt, Homo sapiens
uuuucaagacuuccu

SEQ ID NO: 1267611 - RNA, 22 nt, Homo sapiens
uuuucaaggaaaaaugcugcuu

SEQ ID NO: 1267612 - RNA, 19 nt, Homo sapiens
uuuucaauuugagauucua

SEQ ID NO: 1267613 - RNA, 21 nt, Homo sapiens
ucuaugaagcccacccagaaa

SEQ ID NO: 1267614 - RNA, 18 nt, Homo sapiens
ucuaugaguuggacuuca

SEQ ID NO: 1267615 - RNA, 18 nt, Homo sapiens
ucuaugauuguacuuuga

SEQ ID NO: 1267616 - RNA, 13 nt, Homo sapiens
ucuaugccuuuag

SEQ ID NO: 1267617 - RNA, 18 nt, Homo sapiens
ucuauguuuguauuugga

SEQ ID NO: 1267618 - RNA, 12 nt, Homo sapiens
ucuauucuagcc

SEQ ID NO: 1267619 - RNA, 14 nt, Homo sapiens
ucuauucucaaagu

SEQ ID NO: 1267620 - RNA, 20 nt, Homo sapiens
ucuauugagugaacagaauu

SEQ ID NO: 1267621 - RNA, 23 nt, Homo sapiens
ucuauugcuucaccauggccuua

SEQ ID NO: 1267622 - RNA, 14 nt, Homo sapiens
ucuauuguuaccuc

SEQ ID NO: 1267623 - RNA, 15 nt, Homo sapiens
ucuauuuuacuuugu

SEQ ID NO: 1267624 - RNA, 20 nt, Homo sapiens
ucucaaaauggaagcccuua

SEQ ID NO: 1267625 - RNA, 16 nt, Homo sapiens
ucucaaagaaggcauu

SEQ ID NO: 1267626 - RNA, 19 nt, Homo sapiens
ucucaaaguacugggauua

SEQ ID NO: 1267627 - RNA, 21 nt, Homo sapiens
ucucaauaugcuuacaaaguc

SEQ ID NO: 1267628 - RNA, 16 nt, Homo sapiens
ucucaaucuugaacuc

SEQ ID NO: 1267629 - RNA, 14 nt, Homo sapiens
ucucacaagaugga

SEQ ID NO: 1267630 - RNA, 22 nt, Homo sapiens
ucucacaagauggaaaucacau

SEQ ID NO: 1267631 - RNA, 19 nt, Homo sapiens
ucucacaaggaaaaggcca

SEQ ID NO: 1267632 - RNA, 14 nt, Homo sapiens
ucucacaugcacag

SEQ ID NO: 1267633 - RNA, 21 nt, Homo sapiens
ucucacccgaccggugcauga

SEQ ID NO: 1267634 - RNA, 16 nt, Homo sapiens
ucucaccuggacucca

SEQ ID NO: 1267635 - RNA, 20 nt, Homo sapiens
ucucacuauguugcccaggc

SEQ ID NO: 1267636 - RNA, 17 nt, Homo sapiens
ucucacugaaacauuua

SEQ ID NO: 1267637 - RNA, 14 nt, Homo sapiens
ucucacuugucuca

SEQ ID NO: 1267638 - RNA, 18 nt, Homo sapiens
ucucacuugugcaguguu

SEQ ID NO: 1267639 - RNA, 14 nt, Homo sapiens
ucucagaagguauu

SEQ ID NO: 1267640 - RNA, 19 nt, Homo sapiens
ucucagacccuuuagccaa

SEQ ID NO: 1267641 - RNA, 13 nt, Homo sapiens
ucucagaguccac

SEQ ID NO: 1267642 - RNA, 13 nt, Homo sapiens
ucucagcacuuug

SEQ ID NO: 1267643 - RNA, 21 nt, Homo sapiens
ucucagccuaccaugagaaua

SEQ ID NO: 1267644 - RNA, 18 nt, Homo sapiens
ucucagcuaccuaagaaa

SEQ ID NO: 1267645 - RNA, 17 nt, Homo sapiens
ucucagcuccaauuuca

SEQ ID NO: 1267646 - RNA, 21 nt, Homo sapiens
ucucaggcucuugacuacuug

SEQ ID NO: 1267647 - RNA, 20 nt, Homo sapiens
ucucaggggccaacuaggca

SEQ ID NO: 1267648 - RNA, 21 nt, Homo sapiens
ucucaggggccagaggaacug

SEQ ID NO: 1267649 - RNA, 21 nt, Homo sapiens
ucucagguagaagguugacac

SEQ ID NO: 1267650 - RNA, 18 nt, Homo sapiens
ucucagguguugccaaau

SEQ ID NO: 1267651 - RNA, 20 nt, Homo sapiens
ucucagucaguaauugccaa

SEQ ID NO: 1267652 - RNA, 21 nt, Homo sapiens
ucucagucauuuuuaaccucu

SEQ ID NO: 1267653 - RNA, 16 nt, Homo sapiens
ucucaguggagccuua

SEQ ID NO: 1267654 - RNA, 16 nt, Homo sapiens
ucucagugugcccuuc

SEQ ID NO: 1267655 - RNA, 14 nt, Homo sapiens
ucucaguucagagu

SEQ ID NO: 1267656 - RNA, 21 nt, Homo sapiens
ucucauaaugcuuuguuaaau

SEQ ID NO: 1267657 - RNA, 16 nt, Homo sapiens
ucucaucaguccauug

SEQ ID NO: 1267658 - RNA, 23 nt, Homo sapiens
ucucaucaguguccucuugcuca

SEQ ID NO: 1267659 - RNA, 19 nt, Homo sapiens
ucucaucccacgcacucca

SEQ ID NO: 1267660 - RNA, 23 nt, Homo sapiens
ucucaugauccaacuaaugccuu

SEQ ID NO: 1267661 - RNA, 15 nt, Homo sapiens
ucucauguccugcug

SEQ ID NO: 1267662 - RNA, 17 nt, Homo sapiens
ucucauuacuuauacug

SEQ ID NO: 1267663 - RNA, 18 nt, Homo sapiens
ucucauuguuuucuuuga

SEQ ID NO: 1267664 - RNA, 15 nt, Homo sapiens
ucucauuucuagaga

SEQ ID NO: 1267665 - RNA, 13 nt, Homo sapiens
ucuccaaacaguc

SEQ ID NO: 1267666 - RNA, 13 nt, Homo sapiens
ucuccaauacuca

SEQ ID NO: 1267667 - RNA, 18 nt, Homo sapiens
ucuccacacccacuuugu

SEQ ID NO: 1267668 - RNA, 22 nt, Homo sapiens
ucuccaccaacuggagcacuga

SEQ ID NO: 1267669 - RNA, 17 nt, Homo sapiens
ucuccagaaagcuaaaa

SEQ ID NO: 1267670 - RNA, 17 nt, Homo sapiens
ucuccagacccaccaca

SEQ ID NO: 1267671 - RNA, 18 nt, Homo sapiens
ucuccagacuuuuaccua

SEQ ID NO: 1267672 - RNA, 17 nt, Homo sapiens
ucuccagcccugcagcu

SEQ ID NO: 1267673 - RNA, 15 nt, Homo sapiens
ucuccaggcccuugu

SEQ ID NO: 1267674 - RNA, 14 nt, Homo sapiens
ucuccaggggccug

SEQ ID NO: 1267675 - RNA, 18 nt, Homo sapiens
ucuccaguugggacucag

SEQ ID NO: 1267676 - RNA, 13 nt, Homo sapiens
ucuccaucuucca

SEQ ID NO: 1267677 - RNA, 19 nt, Homo sapiens
ucucccaacucaagguucu

SEQ ID NO: 1267678 - RNA, 15 nt, Homo sapiens
ucucccagccaaguc

SEQ ID NO: 1267679 - RNA, 18 nt, Homo sapiens
ucucccauuuuggaauuu

SEQ ID NO: 1267680 - RNA, 20 nt, Homo sapiens
ucuccccacagccucuggcu

SEQ ID NO: 1267681 - RNA, 16 nt, Homo sapiens
ucuccccaggccucca

SEQ ID NO: 1267682 - RNA, 13 nt, Homo sapiens
ucuccccaugugc

SEQ ID NO: 1267683 - RNA, 20 nt, Homo sapiens
ucucccgaauucgcuguuac

SEQ ID NO: 1267684 - RNA, 16 nt, Homo sapiens
ucucccuccaguccuc

SEQ ID NO: 1267685 - RNA, 19 nt, Homo sapiens
ucucccuccccugccauuu

SEQ ID NO: 1267686 - RNA, 14 nt, Homo sapiens
ucucccugccaagu

SEQ ID NO: 1267687 - RNA, 22 nt, Homo sapiens
ucucccuguacaguguuaccau

SEQ ID NO: 1267688 - RNA, 23 nt, Homo sapiens
ucucccuguuggucgguggguug

SEQ ID NO: 1267689 - RNA, 23 nt, Homo sapiens
ucucccuuccuaugcuguucacu

SEQ ID NO: 1267690 - RNA, 22 nt, Homo sapiens
ucuccggaggagacacaguuac

SEQ ID NO: 1267691 - RNA, 18 nt, Homo sapiens
ucuccuaaugcuuuaucc

SEQ ID NO: 1267692 - RNA, 20 nt, Homo sapiens
ucuccucacucugucccugu

SEQ ID NO: 1267693 - RNA, 23 nt, Homo sapiens
ucuccuccagcccagacccagug

SEQ ID NO: 1267694 - RNA, 14 nt, Homo sapiens
ucuccuccauuccc

SEQ ID NO: 1267695 - RNA, 19 nt, Homo sapiens
ucuccucccagcgugugua

SEQ ID NO: 1267696 - RNA, 18 nt, Homo sapiens
ucuccugaaacccaaagc

SEQ ID NO: 1267697 - RNA, 13 nt, Homo sapiens
ucuccugcugauu

SEQ ID NO: 1267698 - RNA, 18 nt, Homo sapiens
ucuccuguaagccaaaga

SEQ ID NO: 1267699 - RNA, 14 nt, Homo sapiens
ucuccuuacugugu

SEQ ID NO: 1267700 - RNA, 18 nt, Homo sapiens
ucuccuuccacaaugacu

SEQ ID NO: 1267701 - RNA, 21 nt, Homo sapiens
ucuccuuucucuuaugcuuaa

SEQ ID NO: 1267702 - RNA, 20 nt, Homo sapiens
ucuccuuugcucuugccaaa

SEQ ID NO: 1267703 - RNA, 15 nt, Homo sapiens
ucuccuuuuacuuca

SEQ ID NO: 1267704 - RNA, 18 nt, Homo sapiens
ucucgcuuuguugcccag

SEQ ID NO: 1267705 - RNA, 14 nt, Homo sapiens
ucucggcacuccca

SEQ ID NO: 1267706 - RNA, 20 nt, Homo sapiens
ucucggcucaggcucugcug

SEQ ID NO: 1267707 - RNA, 16 nt, Homo sapiens
ucucuaaaucaaguau

SEQ ID NO: 1267708 - RNA, 15 nt, Homo sapiens
ucucuaaugcuugau

SEQ ID NO: 1267709 - RNA, 23 nt, Homo sapiens
ucucuacaaacucccacuuguca

SEQ ID NO: 1267710 - RNA, 17 nt, Homo sapiens
ucucuacuaaaaauaca

SEQ ID NO: 1267711 - RNA, 13 nt, Homo sapiens
ucucuagcacaau

SEQ ID NO: 1267712 - RNA, 22 nt, Homo sapiens
ucucuagcacaauuugcacuaa

SEQ ID NO: 1267713 - RNA, 16 nt, Homo sapiens
ucucuaggccucucca

SEQ ID NO: 1267714 - RNA, 11 nt, Homo sapiens
ucucuaguucc

SEQ ID NO: 1267715 - RNA, 15 nt, Homo sapiens
ucucuauugcugcuc

SEQ ID NO: 1267716 - RNA, 16 nt, Homo sapiens
gcaggaguauaugagc

SEQ ID NO: 1267717 - RNA, 16 nt, Homo sapiens
gcaggaguggugcaga

SEQ ID NO: 1267718 - RNA, 20 nt, Homo sapiens
gcaggauauuugcacuauuu

SEQ ID NO: 1267719 - RNA, 14 nt, Homo sapiens
gcaggccacugggg

SEQ ID NO: 1267720 - RNA, 15 nt, Homo sapiens
gcaggccacugggga

SEQ ID NO: 1267721 - RNA, 18 nt, Homo sapiens
gcaggcccccgggguccu

SEQ ID NO: 1267722 - RNA, 15 nt, Homo sapiens
gcaggcccugcagug

SEQ ID NO: 1267723 - RNA, 19 nt, Homo sapiens
gcaggccggaaccacaggg

SEQ ID NO: 1267724 - RNA, 23 nt, Homo sapiens
gcaggccuccaacgccccugugg

SEQ ID NO: 1267725 - RNA, 16 nt, Homo sapiens
gcaggcgcugugcuau

SEQ ID NO: 1267726 - RNA, 16 nt, Homo sapiens
gcaggcgguggggaga

SEQ ID NO: 1267727 - RNA, 15 nt, Homo sapiens
gcaggcguacagguu

SEQ ID NO: 1267728 - RNA, 15 nt, Homo sapiens
gcagggacuccaugc

SEQ ID NO: 1267729 - RNA, 16 nt, Homo sapiens
gcagggacugccaguc

SEQ ID NO: 1267730 - RNA, 20 nt, Homo sapiens
gcagggcagcagggaacaaa

SEQ ID NO: 1267731 - RNA, 15 nt, Homo sapiens
gcagggcugcccuga

SEQ ID NO: 1267732 - RNA, 15 nt, Homo sapiens
gcaggggaagccuug

SEQ ID NO: 1267733 - RNA, 16 nt, Homo sapiens
gcagggguugcaguga

SEQ ID NO: 1267734 - RNA, 18 nt, Homo sapiens
gcaggucuagaagaacaa

SEQ ID NO: 1267735 - RNA, 19 nt, Homo sapiens
gcaggucuagaagaacaac

SEQ ID NO: 1267736 - RNA, 21 nt, Homo sapiens
gcagguuccuuaucugucaca

SEQ ID NO: 1267737 - RNA, 17 nt, Homo sapiens
gcaguacuuuaccuccu

SEQ ID NO: 1267738 - RNA, 19 nt, Homo sapiens
gcaguagaaauaauaugca

SEQ ID NO: 1267739 - RNA, 20 nt, Homo sapiens
gcaguagaaauaauaugcau

SEQ ID NO: 1267740 - RNA, 12 nt, Homo sapiens
gcagucacugga

SEQ ID NO: 1267741 - RNA, 14 nt, Homo sapiens
gcagucacuuccac

SEQ ID NO: 1267742 - RNA, 22 nt, Homo sapiens
gcagucagggugggaagaaaga

SEQ ID NO: 1267743 - RNA, 13 nt, Homo sapiens
gcagucauaucaa

SEQ ID NO: 1267744 - RNA, 16 nt, Homo sapiens
gcaguccacaaagcau

SEQ ID NO: 1267745 - RNA, 19 nt, Homo sapiens
gcagucccaguauucucag

SEQ ID NO: 1267746 - RNA, 19 nt, Homo sapiens
gcaguccugccucagccuc

SEQ ID NO: 1267747 - RNA, 12 nt, Homo sapiens
gcaguccuuugu

SEQ ID NO: 1267748 - RNA, 14 nt, Homo sapiens
gcagucuaauuaca

SEQ ID NO: 1267749 - RNA, 15 nt, Homo sapiens
gcagucuaauuacau

SEQ ID NO: 1267750 - RNA, 23 nt, Homo sapiens
gcagugacgugcaccuguacuca

SEQ ID NO: 1267751 - RNA, 15 nt, Homo sapiens
gcagugagcugagau

SEQ ID NO: 1267752 - RNA, 21 nt, Homo sapiens
gcagugagcuguguucuugcc

SEQ ID NO: 1267753 - RNA, 16 nt, Homo sapiens
gcagugauuagcacuu

SEQ ID NO: 1267754 - RNA, 16 nt, Homo sapiens
gcaguggaagcaguuu

SEQ ID NO: 1267755 - RNA, 17 nt, Homo sapiens
gcaguggcgugaucucg

SEQ ID NO: 1267756 - RNA, 14 nt, Homo sapiens
gcaguggugcaauc

SEQ ID NO: 1267757 - RNA, 23 nt, Homo sapiens
gcaguuacucccuacacugaugc

SEQ ID NO: 1267758 - RNA, 18 nt, Homo sapiens
gcaguugaucagacugaa

SEQ ID NO: 1267759 - RNA, 19 nt, Homo sapiens
gcaguuuaugagacagcug

SEQ ID NO: 1267760 - RNA, 18 nt, Homo sapiens
gcaguuuggagucacugu

SEQ ID NO: 1267761 - RNA, 21 nt, Homo sapiens
gcaguuugguccuggggacca

SEQ ID NO: 1267762 - RNA, 21 nt, Homo sapiens
gcaguuuugcuaucugggcug

SEQ ID NO: 1267763 - RNA, 14 nt, Homo sapiens
gcauaaaagacuuu

SEQ ID NO: 1267764 - RNA, 15 nt, Homo sapiens
gcauaaaagacuuuu

SEQ ID NO: 1267765 - RNA, 22 nt, Homo sapiens
gcauaaaauguaugaccacugg

SEQ ID NO: 1267766 - RNA, 20 nt, Homo sapiens
gcauaaauaugcagugauau

SEQ ID NO: 1267767 - RNA, 16 nt, Homo sapiens
gcauaacuguucucau

SEQ ID NO: 1267768 - RNA, 19 nt, Homo sapiens
gcauaagaaaacuaagaaa

SEQ ID NO: 1267769 - RNA, 21 nt, Homo sapiens
gcauaauguuucuggauuuca

SEQ ID NO: 1267770 - RNA, 16 nt, Homo sapiens
gcauacacacaugccc

SEQ ID NO: 1267771 - RNA, 16 nt, Homo sapiens
gcauacccuuacucug

SEQ ID NO: 1267772 - RNA, 15 nt, Homo sapiens
gcauaggaauugcac

SEQ ID NO: 1267773 - RNA, 18 nt, Homo sapiens
gcauaugauagaugacaa

SEQ ID NO: 1267774 - RNA, 16 nt, Homo sapiens
gcauaugcacagucaa

SEQ ID NO: 1267775 - RNA, 12 nt, Homo sapiens
gcauauggugcu

SEQ ID NO: 1267776 - RNA, 16 nt, Homo sapiens
gcauauggugcuuaaa

SEQ ID NO: 1267777 - RNA, 17 nt, Homo sapiens
gcaucaaacagggcaaa

SEQ ID NO: 1267778 - RNA, 15 nt, Homo sapiens
gcaucaaauauuugu

SEQ ID NO: 1267779 - RNA, 18 nt, Homo sapiens
gcaucaauacaaccagcc

SEQ ID NO: 1267780 - RNA, 12 nt, Homo sapiens
gcaucacugggg

SEQ ID NO: 1267781 - RNA, 16 nt, Homo sapiens
gcaucagguccuuugg

SEQ ID NO: 1267782 - RNA, 15 nt, Homo sapiens
gcaucauuaguacau

SEQ ID NO: 1267783 - RNA, 14 nt, Homo sapiens
gcauccacuagcuu

SEQ ID NO: 1267784 - RNA, 14 nt, Homo sapiens
gcaucccaggggac

SEQ ID NO: 1267785 - RNA, 19 nt, Homo sapiens
gcauccccuuggcugugag

SEQ ID NO: 1267786 - RNA, 14 nt, Homo sapiens
gcccuggccaggac

SEQ ID NO: 1267787 - RNA, 16 nt, Homo sapiens
gcccuggcuggguuca

SEQ ID NO: 1267788 - RNA, 18 nt, Homo sapiens
gcccuggugcauggccuu

SEQ ID NO: 1267789 - RNA, 15 nt, Homo sapiens
gcccuggugcugcca

SEQ ID NO: 1267790 - RNA, 18 nt, Homo sapiens
gcccuuaaggacaaaaau

SEQ ID NO: 1267791 - RNA, 20 nt, Homo sapiens
gcccuugagugcuuguuaga

SEQ ID NO: 1267792 - RNA, 17 nt, Homo sapiens
gcccuugucugagaugc

SEQ ID NO: 1267793 - RNA, 20 nt, Homo sapiens
gcccuuucauggucugcuga

SEQ ID NO: 1267794 - RNA, 18 nt, Homo sapiens
gccgaaaaggauaugcag

SEQ ID NO: 1267795 - RNA, 18 nt, Homo sapiens
gccgacuuggagacuccu

SEQ ID NO: 1267796 - RNA, 21 nt, Homo sapiens
gccgagauugcgccacugcag

SEQ ID NO: 1267797 - RNA, 14 nt, Homo sapiens
gccgauggagacac

SEQ ID NO: 1267798 - RNA, 23 nt, Homo sapiens
gccgcaggugggugcugcccugu

SEQ ID NO: 1267799 - RNA, 21 nt, Homo sapiens
gccgcaguuuggagucacugu

SEQ ID NO: 1267800 - RNA, 22 nt, Homo sapiens
gccgcauuggugacucacuuca

SEQ ID NO: 1267801 - RNA, 12 nt, Homo sapiens
gccgccaccagc

SEQ ID NO: 1267802 - RNA, 20 nt, Homo sapiens
gccgcugccgccuuccccau

SEQ ID NO: 1267803 - RNA, 18 nt, Homo sapiens
gccggaggucaugaugau

SEQ ID NO: 1267804 - RNA, 19 nt, Homo sapiens
gccggaucucgaggcuugc

SEQ ID NO: 1267805 - RNA, 18 nt, Homo sapiens
gccggcucuuuccuugcu

SEQ ID NO: 1267806 - RNA, 14 nt, Homo sapiens
gccgggcaggcgug

SEQ ID NO: 1267807 - RNA, 16 nt, Homo sapiens
gccgucuccauggcau

SEQ ID NO: 1267808 - RNA, 18 nt, Homo sapiens
gccguguuacuguugcac

SEQ ID NO: 1267809 - RNA, 23 nt, Homo sapiens
gccuaaaaguuacuuaccacaga

SEQ ID NO: 1267810 - RNA, 17 nt, Homo sapiens
gccuaauacaacaugua

SEQ ID NO: 1267811 - RNA, 20 nt, Homo sapiens
gccuacaaccaucccugcca

SEQ ID NO: 1267812 - RNA, 21 nt, Homo sapiens
gccuacuuucacacuaagaaa

SEQ ID NO: 1267813 - RNA, 22 nt, Homo sapiens
gccuagcgaucucuccuggccu

SEQ ID NO: 1267814 - RNA, 21 nt, Homo sapiens
gccuagcuccugccacaugga

SEQ ID NO: 1267815 - RNA, 21 nt, Homo sapiens
gccuaggaguugaguacagug

SEQ ID NO: 1267816 - RNA, 20 nt, Homo sapiens
gccuauagucgcagcuacua

SEQ ID NO: 1267817 - RNA, 15 nt, Homo sapiens
gccucaaugccagua

SEQ ID NO: 1267818 - RNA, 20 nt, Homo sapiens
gccucaccguccucacccau

SEQ ID NO: 1267819 - RNA, 14 nt, Homo sapiens
gccucagcuaccca

SEQ ID NO: 1267820 - RNA, 14 nt, Homo sapiens
gccucagcuucuca

SEQ ID NO: 1267821 - RNA, 15 nt, Homo sapiens
gccucagcuucucaa

SEQ ID NO: 1267822 - RNA, 13 nt, Homo sapiens
gccucagggccag

SEQ ID NO: 1267823 - RNA, 14 nt, Homo sapiens
gccucagggccagg

SEQ ID NO: 1267824 - RNA, 11 nt, Homo sapiens
gccucagugac

SEQ ID NO: 1267825 - RNA, 15 nt, Homo sapiens
gccucagugacccau

SEQ ID NO: 1267826 - RNA, 23 nt, Homo sapiens
gccucauauuuaaagacagggaa

SEQ ID NO: 1267827 - RNA, 16 nt, Homo sapiens
gccuccaaacacagau

SEQ ID NO: 1267828 - RNA, 21 nt, Homo sapiens
gccuccacagcgagggcagcu

SEQ ID NO: 1267829 - RNA, 20 nt, Homo sapiens
gccuccaugaccugcgcucu

SEQ ID NO: 1267830 - RNA, 17 nt, Homo sapiens
gccucccaaagugcugg

SEQ ID NO: 1267831 - RNA, 19 nt, Homo sapiens
gccucccacccgaugcugc

SEQ ID NO: 1267832 - RNA, 22 nt, Homo sapiens
gccuccccauuucccaucugca

SEQ ID NO: 1267833 - RNA, 21 nt, Homo sapiens
gccucccccucagaugaucuc

SEQ ID NO: 1267834 - RNA, 19 nt, Homo sapiens
gccuccccgugccaaaaau

SEQ ID NO: 1267835 - RNA, 16 nt, Homo sapiens
gccuccccuccauggg

SEQ ID NO: 1267836 - RNA, 11 nt, Homo sapiens
gccuccucacc

SEQ ID NO: 1267837 - RNA, 23 nt, Homo sapiens
gccuccugugacgugaggcccau

SEQ ID NO: 1267838 - RNA, 17 nt, Homo sapiens
gccucgcagccuccgga

SEQ ID NO: 1267839 - RNA, 18 nt, Homo sapiens
gccucgcagccuccggaa

SEQ ID NO: 1267840 - RNA, 15 nt, Homo sapiens
gccucucccaucacu

SEQ ID NO: 1267841 - RNA, 23 nt, Homo sapiens
gccucugcggggcagggccuucc

SEQ ID NO: 1267842 - RNA, 18 nt, Homo sapiens
gccucuggcucucauggg

SEQ ID NO: 1267843 - RNA, 20 nt, Homo sapiens
gccucuucccacaccuguca

SEQ ID NO: 1267844 - RNA, 22 nt, Homo sapiens
gccucuuccgugacgucacugg

SEQ ID NO: 1267845 - RNA, 13 nt, Homo sapiens
gccucuuggcagu

SEQ ID NO: 1267846 - RNA, 21 nt, Homo sapiens
guaguaaauuuugugaugaau

SEQ ID NO: 1267847 - RNA, 13 nt, Homo sapiens
guaguacuugaaa

SEQ ID NO: 1267848 - RNA, 15 nt, Homo sapiens
guagucucauuacuu

SEQ ID NO: 1267849 - RNA, 21 nt, Homo sapiens
guagucucuccccuggccaca

SEQ ID NO: 1267850 - RNA, 22 nt, Homo sapiens
guaguuaggaaauaaaaccuuu

SEQ ID NO: 1267851 - RNA, 18 nt, Homo sapiens
guaguuugggguguauac

SEQ ID NO: 1267852 - RNA, 13 nt, Homo sapiens
guaguuuguuuua

SEQ ID NO: 1267853 - RNA, 13 nt, Homo sapiens
guauaaacaaaag

SEQ ID NO: 1267854 - RNA, 16 nt, Homo sapiens
guauaaauauacagua

SEQ ID NO: 1267855 - RNA, 23 nt, Homo sapiens
guauaacuggauugcagacuguu

SEQ ID NO: 1267856 - RNA, 14 nt, Homo sapiens
guauaagcacugaa

SEQ ID NO: 1267857 - RNA, 16 nt, Homo sapiens
guauaagcacugaaaa

SEQ ID NO: 1267858 - RNA, 22 nt, Homo sapiens
guauaagcacugaaaaacaaca

SEQ ID NO: 1267859 - RNA, 15 nt, Homo sapiens
guauaaucccaccca

SEQ ID NO: 1267860 - RNA, 17 nt, Homo sapiens
guauacccucuguuucc

SEQ ID NO: 1267861 - RNA, 22 nt, Homo sapiens
guauacuuuaguagacauuuau

SEQ ID NO: 1267862 - RNA, 16 nt, Homo sapiens
guauagaguacugcag

SEQ ID NO: 1267863 - RNA, 17 nt, Homo sapiens
guauauaguaugaaugc

SEQ ID NO: 1267864 - RNA, 14 nt, Homo sapiens
guauaucauucuac

SEQ ID NO: 1267865 - RNA, 13 nt, Homo sapiens
guauauccaaaag

SEQ ID NO: 1267866 - RNA, 13 nt, Homo sapiens
guauaugcugaug

SEQ ID NO: 1267867 - RNA, 17 nt, Homo sapiens
guauauuugguacugua

SEQ ID NO: 1267868 - RNA, 23 nt, Homo sapiens
guauauuugugauagcacuuucu

SEQ ID NO: 1267869 - RNA, 13 nt, Homo sapiens
guaucaacacugu

SEQ ID NO: 1267870 - RNA, 23 nt, Homo sapiens
guaucaaguggcaugugcuguga

SEQ ID NO: 1267871 - RNA, 16 nt, Homo sapiens
guaucagaaguguuaa

SEQ ID NO: 1267872 - RNA, 16 nt, Homo sapiens
guaucaucagugccuc

SEQ ID NO: 1267873 - RNA, 19 nt, Homo sapiens
guaucauucuuuacauauu

SEQ ID NO: 1267874 - RNA, 11 nt, Homo sapiens
guauccaaaaa

SEQ ID NO: 1267875 - RNA, 23 nt, Homo sapiens
guauccagagauacuacaauauu

SEQ ID NO: 1267876 - RNA, 17 nt, Homo sapiens
guauccgacucuaagcu

SEQ ID NO: 1267877 - RNA, 21 nt, Homo sapiens
guauccgacucuaagcugugu

SEQ ID NO: 1267878 - RNA, 13 nt, Homo sapiens
guauccugcagcg

SEQ ID NO: 1267879 - RNA, 22 nt, Homo sapiens
guaucgcauauuaguuaaucuc

SEQ ID NO: 1267880 - RNA, 20 nt, Homo sapiens
guaucugacaaugcugaggu

SEQ ID NO: 1267881 - RNA, 17 nt, Homo sapiens
guaucuucaaacuuuca

SEQ ID NO: 1267882 - RNA, 17 nt, Homo sapiens
guaucuuccauauuugg

SEQ ID NO: 1267883 - RNA, 19 nt, Homo sapiens
guaucuuccuuucuugucu

SEQ ID NO: 1267884 - RNA, 15 nt, Homo sapiens
guaucuugauaucuc

SEQ ID NO: 1267885 - RNA, 21 nt, Homo sapiens
guaucuuucauccuugacuaa

SEQ ID NO: 1267886 - RNA, 19 nt, Homo sapiens
guaucuuuugaacuggcaa

SEQ ID NO: 1267887 - RNA, 18 nt, Homo sapiens
guaugaaagagcaaguga

SEQ ID NO: 1267888 - RNA, 18 nt, Homo sapiens
guaugaaggaaucauucc

SEQ ID NO: 1267889 - RNA, 15 nt, Homo sapiens
guaugaaugcagugg

SEQ ID NO: 1267890 - RNA, 22 nt, Homo sapiens
guaugagaaaccuauauuucaa

SEQ ID NO: 1267891 - RNA, 19 nt, Homo sapiens
guaugaguggcuucuggga

SEQ ID NO: 1267892 - RNA, 18 nt, Homo sapiens
guaugauuuauccucaca

SEQ ID NO: 1267893 - RNA, 16 nt, Homo sapiens
guaugcagaauguuuu

SEQ ID NO: 1267894 - RNA, 18 nt, Homo sapiens
guaugcauucacauuuag

SEQ ID NO: 1267895 - RNA, 20 nt, Homo sapiens
guauggaaaaaccauuugaa

SEQ ID NO: 1267896 - RNA, 18 nt, Homo sapiens
guauggcaugaacaucuu

SEQ ID NO: 1267897 - RNA, 20 nt, Homo sapiens
guauguauuuucaguuacaa

SEQ ID NO: 1267898 - RNA, 20 nt, Homo sapiens
guaugucagugucacuggau

SEQ ID NO: 1267899 - RNA, 19 nt, Homo sapiens
guaugugacaccaaagcca

SEQ ID NO: 1267900 - RNA, 16 nt, Homo sapiens
guaugugacuuuucug

SEQ ID NO: 1267901 - RNA, 10 nt, Homo sapiens
guaugugcac

SEQ ID NO: 1267902 - RNA, 15 nt, Homo sapiens
guauguuauugcaua

SEQ ID NO: 1267903 - RNA, 15 nt, Homo sapiens
guauguuuguuucau

SEQ ID NO: 1267904 - RNA, 13 nt, Homo sapiens
guauuaaugcuau

SEQ ID NO: 1267905 - RNA, 21 nt, Homo sapiens
guauuaccuccccuacucccu

SEQ ID NO: 1267906 - RNA, 19 nt, Homo sapiens
guauuaggugucauuucca

SEQ ID NO: 1267907 - RNA, 22 nt, Homo sapiens
guauucccaaaaauuacuuugg

SEQ ID NO: 1267908 - RNA, 19 nt, Homo sapiens
guauucccaccccuggacu

SEQ ID NO: 1267909 - RNA, 19 nt, Homo sapiens
guauuccgauacaaagugu

SEQ ID NO: 1267910 - RNA, 18 nt, Homo sapiens
guauucuuuuccaagcuc

SEQ ID NO: 1267911 - RNA, 21 nt, Homo sapiens
guauucuuuuccaagcuccuu

SEQ ID NO: 1267912 - RNA, 18 nt, Homo sapiens
guauugaaauguuugcau

SEQ ID NO: 1267913 - RNA, 22 nt, Homo sapiens
guauugaaggaauuagaaauga

SEQ ID NO: 1267914 - RNA, 18 nt, Homo sapiens
guauugacaggaauacuu

SEQ ID NO: 1267915 - RNA, 19 nt, Homo sapiens
guauugaucaaugcauguu

SEQ ID NO: 1267916 - RNA, 12 nt, Homo sapiens
guauugguggcu

SEQ ID NO: 1267917 - RNA, 16 nt, Homo sapiens
guauuuaauucuucac

SEQ ID NO: 1267918 - RNA, 13 nt, Homo sapiens
guauuuagaucuc

SEQ ID NO: 1267919 - RNA, 17 nt, Homo sapiens
guauuucaagucucuca

SEQ ID NO: 1267920 - RNA, 19 nt, Homo sapiens
guauuuuaacucauaccuu

SEQ ID NO: 1267921 - RNA, 15 nt, Homo sapiens
guauuuuaugaucuu

SEQ ID NO: 1267922 - RNA, 15 nt, Homo sapiens
guauuuucagcucaa

SEQ ID NO: 1267923 - RNA, 23 nt, Homo sapiens
guauuuucuuacacugugucauu

SEQ ID NO: 1267924 - RNA, 15 nt, Homo sapiens
guauuuuguaauauu

SEQ ID NO: 1267925 - RNA, 19 nt, Homo sapiens
guauuuuuaguaaagacag

SEQ ID NO: 1267926 - RNA, 17 nt, Homo sapiens
guauuuuuauccaugac

SEQ ID NO: 1267927 - RNA, 15 nt, Homo sapiens
gucaaaaaguuccau

SEQ ID NO: 1267928 - RNA, 13 nt, Homo sapiens
gucaaacaguaau

SEQ ID NO: 1267929 - RNA, 11 nt, Homo sapiens
gucaaacugua

SEQ ID NO: 1267930 - RNA, 12 nt, Homo sapiens
gucaaagcagua

SEQ ID NO: 1267931 - RNA, 16 nt, Homo sapiens
gucaacagcgugcagg

SEQ ID NO: 1267932 - RNA, 18 nt, Homo sapiens
gucaagaaacagccagca

SEQ ID NO: 1267933 - RNA, 23 nt, Homo sapiens
gucaagaagaaaaagguuugcau

SEQ ID NO: 1267934 - RNA, 22 nt, Homo sapiens
gucaagaagcguuaugugcagu

SEQ ID NO: 1267935 - RNA, 23 nt, Homo sapiens
gucaagaagcguuaugugcagua

SEQ ID NO: 1267936 - RNA, 21 nt, Homo sapiens
gucaagcaccugcaugugcug

SEQ ID NO: 1267937 - RNA, 13 nt, Homo sapiens
gucaaggacaaaa

SEQ ID NO: 1267938 - RNA, 22 nt, Homo sapiens
gucaaggacaaaaaaccucagg

SEQ ID NO: 1267939 - RNA, 18 nt, Homo sapiens
gucaagucaccaugcuga

SEQ ID NO: 1267940 - RNA, 20 nt, Homo sapiens
gucaaucccaaaagucacca

SEQ ID NO: 1267941 - RNA, 18 nt, Homo sapiens
gucaauccgaaguaugag

SEQ ID NO: 1267942 - RNA, 15 nt, Homo sapiens
gucaauguguucuua

SEQ ID NO: 1267943 - RNA, 14 nt, Homo sapiens
gucacaauccuaac

SEQ ID NO: 1267944 - RNA, 12 nt, Homo sapiens
gucacacacuga

SEQ ID NO: 1267945 - RNA, 18 nt, Homo sapiens
gucacacacuuuggcuau

SEQ ID NO: 1267946 - RNA, 17 nt, Homo sapiens
gucacacucuucaguga

SEQ ID NO: 1267947 - RNA, 21 nt, Homo sapiens
gucacauaaugcucauacuua

SEQ ID NO: 1267948 - RNA, 18 nt, Homo sapiens
gucacauuguaacugaac

SEQ ID NO: 1267949 - RNA, 19 nt, Homo sapiens
gucaccaggugaccagugg

SEQ ID NO: 1267950 - RNA, 17 nt, Homo sapiens
gucaccauacacacugu

SEQ ID NO: 1267951 - RNA, 18 nt, Homo sapiens
gucaccauacacacuguu

SEQ ID NO: 1267952 - RNA, 18 nt, Homo sapiens
gucaccggucagugccuu

SEQ ID NO: 1267953 - RNA, 20 nt, Homo sapiens
gucacgggaggaacaugaca

SEQ ID NO: 1267954 - RNA, 16 nt, Homo sapiens
gucacguacugucuga

SEQ ID NO: 1267955 - RNA, 20 nt, Homo sapiens
gucacuacacacuaaaacuu

SEQ ID NO: 1267956 - RNA, 11 nt, Homo sapiens
gucacuccugg

SEQ ID NO: 1267957 - RNA, 17 nt, Homo sapiens
gucacugacacaaagga

SEQ ID NO: 1267958 - RNA, 16 nt, Homo sapiens
gucacugccacuuugc

SEQ ID NO: 1267959 - RNA, 17 nt, Homo sapiens
gucacugccacuuugca

SEQ ID NO: 1267960 - RNA, 21 nt, Homo sapiens
gucacugugcacugcccuguu

SEQ ID NO: 1267961 - RNA, 21 nt, Homo sapiens
gucagaaaaagcuagcacuaa

SEQ ID NO: 1267962 - RNA, 14 nt, Homo sapiens
gucagaaguucaag

SEQ ID NO: 1267963 - RNA, 13 nt, Homo sapiens
gucagaguagaag

SEQ ID NO: 1267964 - RNA, 13 nt, Homo sapiens
gucagaguucugc

SEQ ID NO: 1267965 - RNA, 15 nt, Homo sapiens
gucagaguucugcuc

SEQ ID NO: 1267966 - RNA, 20 nt, Homo sapiens
gucagauuugaacucuucaa

SEQ ID NO: 1267967 - RNA, 15 nt, Homo sapiens
gucagcauccagguu

SEQ ID NO: 1267968 - RNA, 11 nt, Homo sapiens
gucagccagcu

SEQ ID NO: 1267969 - RNA, 14 nt, Homo sapiens
gucagcccaugugc

SEQ ID NO: 1267970 - RNA, 21 nt, Homo sapiens
gucagcuacuaaugauguuuu

SEQ ID NO: 1267971 - RNA, 12 nt, Homo sapiens
gucagcucucuc

SEQ ID NO: 1267972 - RNA, 21 nt, Homo sapiens
gucaggacaagggcucagagg

SEQ ID NO: 1267973 - RNA, 15 nt, Homo sapiens
gucaggaugcacauu

SEQ ID NO: 1267974 - RNA, 22 nt, Homo sapiens
gucaggauucuucaaggagaau

SEQ ID NO: 1267975 - RNA, 19 nt, Homo sapiens
gucagggcccaagucccug

SEQ ID NO: 1267976 - RNA, 16 nt, Homo sapiens
gucagguaguugcaau

SEQ ID NO: 1267977 - RNA, 21 nt, Homo sapiens
gucaguauuucaguguaguua

SEQ ID NO: 1267978 - RNA, 14 nt, Homo sapiens
gucagucagggaca

SEQ ID NO: 1267979 - RNA, 20 nt, Homo sapiens
gucaguccaggaugcuaaca

SEQ ID NO: 1267980 - RNA, 14 nt, Homo sapiens
gucauaugacugau

SEQ ID NO: 1267981 - RNA, 20 nt, Homo sapiens
gucaucaaauauuaccaaaa

SEQ ID NO: 1267982 - RNA, 22 nt, Homo sapiens
gucaucaaauauuaccaaaaaa

SEQ ID NO: 1267983 - RNA, 14 nt, Homo sapiens
gucaucacuuugac

SEQ ID NO: 1267984 - RNA, 14 nt, Homo sapiens
gucaucaucacauu

SEQ ID NO: 1267985 - RNA, 21 nt, Homo sapiens
gucaucccagugcacauggca

SEQ ID NO: 1267986 - RNA, 16 nt, Homo sapiens
gucaucuucaauuuau

SEQ ID NO: 1267987 - RNA, 20 nt, Homo sapiens
gucaugcauaaauaugcagu

SEQ ID NO: 1267988 - RNA, 21 nt, Homo sapiens
gucaugcauaaauaugcagug

SEQ ID NO: 1267989 - RNA, 17 nt, Homo sapiens
gucaugucugugauugc

SEQ ID NO: 1267990 - RNA, 18 nt, Homo sapiens
gucauuaaacaugacauu

SEQ ID NO: 1267991 - RNA, 16 nt, Homo sapiens
gucauuauuuuuguua

SEQ ID NO: 1267992 - RNA, 13 nt, Homo sapiens
gucauugaccucu

SEQ ID NO: 1267993 - RNA, 14 nt, Homo sapiens
gucauuguauguua

SEQ ID NO: 1267994 - RNA, 14 nt, Homo sapiens
gucauuguauucag

SEQ ID NO: 1267995 - RNA, 13 nt, Homo sapiens
gucauuuauucaa

SEQ ID NO: 1267996 - RNA, 17 nt, Homo sapiens
gucauuuuuaacagcau

SEQ ID NO: 1267997 - RNA, 23 nt, Homo sapiens
gucauuuuuaacagcaugcugcu

SEQ ID NO: 1267998 - RNA, 12 nt, Homo sapiens
guccaacaaacc

SEQ ID NO: 1267999 - RNA, 19 nt, Homo sapiens
guccaauuccaaagccaga

SEQ ID NO: 1268000 - RNA, 21 nt, Homo sapiens
guccacccaggcugcacugca

SEQ ID NO: 1268001 - RNA, 17 nt, Homo sapiens
guccacgauucacucau

SEQ ID NO: 1268002 - RNA, 20 nt, Homo sapiens
guccacuccuccuacuguau

SEQ ID NO: 1268003 - RNA, 15 nt, Homo sapiens
guccacugcuccauu

SEQ ID NO: 1268004 - RNA, 21 nt, Homo sapiens
guccagagcggaggcugugug

SEQ ID NO: 1268005 - RNA, 22 nt, Homo sapiens
guccagccacuugacuggcaca

SEQ ID NO: 1268006 - RNA, 17 nt, Homo sapiens
guccagcccugccuugc

SEQ ID NO: 1268007 - RNA, 23 nt, Homo sapiens
guccagccgccauugccaccagg

SEQ ID NO: 1268008 - RNA, 15 nt, Homo sapiens
guccagcucugacau

SEQ ID NO: 1268009 - RNA, 19 nt, Homo sapiens
guccaggaaggcagcugcu

SEQ ID NO: 1268010 - RNA, 15 nt, Homo sapiens
guccaguugcagcug

SEQ ID NO: 1268011 - RNA, 17 nt, Homo sapiens
guccauccgacugcccc

SEQ ID NO: 1268012 - RNA, 21 nt, Homo sapiens
guccaugcugaugauuuugca

SEQ ID NO: 1268013 - RNA, 14 nt, Homo sapiens
guccaugcuucuag

SEQ ID NO: 1268014 - RNA, 19 nt, Homo sapiens
guccauuuugcccuuccau

SEQ ID NO: 1268015 - RNA, 14 nt, Homo sapiens
gucccaaccccagu

SEQ ID NO: 1268016 - RNA, 16 nt, Homo sapiens
gucccaaccccagugg

SEQ ID NO: 1268017 - RNA, 15 nt, Homo sapiens
gucccaaucuuacca

SEQ ID NO: 1268018 - RNA, 19 nt, Homo sapiens
gucccagagguuaucugcc

SEQ ID NO: 1268019 - RNA, 17 nt, Homo sapiens
gucccaggcugucaggg

SEQ ID NO: 1268020 - RNA, 22 nt, Homo sapiens
gucccagggaagguggggcccu

SEQ ID NO: 1268021 - RNA, 22 nt, Homo sapiens
gucccaucaggacccuccugcc

SEQ ID NO: 1268022 - RNA, 14 nt, Homo sapiens
gucccauuccucag

SEQ ID NO: 1268023 - RNA, 13 nt, Homo sapiens
guccccagacuca

SEQ ID NO: 1268024 - RNA, 22 nt, Homo sapiens
guccccagccugcucccuagcc

SEQ ID NO: 1268025 - RNA, 14 nt, Homo sapiens
gucccccccagugc

SEQ ID NO: 1268026 - RNA, 21 nt, Homo sapiens
guccccccucaagaguacaga

SEQ ID NO: 1268027 - RNA, 18 nt, Homo sapiens
guccccgagacacaggca

SEQ ID NO: 1268028 - RNA, 16 nt, Homo sapiens
guccccuacucccucu

SEQ ID NO: 1268029 - RNA, 16 nt, Homo sapiens
guccccuccacuguca

SEQ ID NO: 1268030 - RNA, 13 nt, Homo sapiens
gucccgguuuguc

SEQ ID NO: 1268031 - RNA, 22 nt, Homo sapiens
gucccuguuuucccacgaggaa

SEQ ID NO: 1268032 - RNA, 21 nt, Homo sapiens
gucccuucagcaccugacccu

SEQ ID NO: 1268033 - RNA, 19 nt, Homo sapiens
gucccuugcuguaugcuga

SEQ ID NO: 1268034 - RNA, 22 nt, Homo sapiens
gucccuuugagcagaaauuuau

SEQ ID NO: 1268035 - RNA, 16 nt, Homo sapiens
guccgguguucuaaga

SEQ ID NO: 1268036 - RNA, 16 nt, Homo sapiens
guccuaaagaugcuga

SEQ ID NO: 1268037 - RNA, 14 nt, Homo sapiens
guccuaagcacuuu

SEQ ID NO: 1268038 - RNA, 15 nt, Homo sapiens
guccuacuccuugca

SEQ ID NO: 1268039 - RNA, 12 nt, Homo sapiens
guccucacccau

SEQ ID NO: 1268040 - RNA, 21 nt, Homo sapiens
guccucauuauaaaaugggaa

SEQ ID NO: 1268041 - RNA, 19 nt, Homo sapiens
guccuccacacaagggaag

SEQ ID NO: 1268042 - RNA, 18 nt, Homo sapiens
guccucccucugauuuuu

SEQ ID NO: 1268043 - RNA, 21 nt, Homo sapiens
guccucguucaaaacauucca

SEQ ID NO: 1268044 - RNA, 19 nt, Homo sapiens
guccucuuaccaacaucug

SEQ ID NO: 1268045 - RNA, 15 nt, Homo sapiens
guccucuugcucaaa

SEQ ID NO: 1268046 - RNA, 22 nt, Homo sapiens
guccugaauguuucagaccaca

SEQ ID NO: 1268047 - RNA, 15 nt, Homo sapiens
guccugacacuauuc

SEQ ID NO: 1268048 - RNA, 16 nt, Homo sapiens
guccugacacuauuca

SEQ ID NO: 1268049 - RNA, 20 nt, Homo sapiens
guccugcagcaaacacucca

SEQ ID NO: 1268050 - RNA, 17 nt, Homo sapiens
guccuuauucuucucau

SEQ ID NO: 1268051 - RNA, 15 nt, Homo sapiens
guccuugcauggccu

SEQ ID NO: 1268052 - RNA, 17 nt, Homo sapiens
guccuuggaaguuucau

SEQ ID NO: 1268053 - RNA, 21 nt, Homo sapiens
guccuuuaauuaagacugaaa

SEQ ID NO: 1268054 - RNA, 11 nt, Homo sapiens
guccuuuaugu

SEQ ID NO: 1268055 - RNA, 21 nt, Homo sapiens
guccuuuugacacugcucuaa

SEQ ID NO: 1268056 - RNA, 16 nt, Homo sapiens
gucgaggggcucucag

SEQ ID NO: 1268057 - RNA, 18 nt, Homo sapiens
gucgcaucucagugcagg

SEQ ID NO: 1268058 - RNA, 15 nt, Homo sapiens
gucgcccuacucacc

SEQ ID NO: 1268059 - RNA, 14 nt, Homo sapiens
gucguaagucacug

SEQ ID NO: 1268060 - RNA, 22 nt, Homo sapiens
gucuaaauaaaugaaguauuuc

SEQ ID NO: 1268061 - RNA, 19 nt, Homo sapiens
gucuacagggaggggcccu

SEQ ID NO: 1268062 - RNA, 21 nt, Homo sapiens
gucuacauagugacaugcaca

SEQ ID NO: 1268063 - RNA, 17 nt, Homo sapiens
gucuacaugccaugacc

SEQ ID NO: 1268064 - RNA, 12 nt, Homo sapiens
gucuacauuucu

SEQ ID NO: 1268065 - RNA, 22 nt, Homo sapiens
gucuaccugcuggacagccucc

SEQ ID NO: 1268066 - RNA, 17 nt, Homo sapiens
gucuagguacuucaggg

SEQ ID NO: 1268067 - RNA, 23 nt, Homo sapiens
gucuaguucuuuucauuuggaau

SEQ ID NO: 1268068 - RNA, 20 nt, Homo sapiens
gucuaguuucccacauucca

SEQ ID NO: 1268069 - RNA, 16 nt, Homo sapiens
gucuauauguuuauuu

SEQ ID NO: 1268070 - RNA, 12 nt, Homo sapiens
gucuaugcugcu

SEQ ID NO: 1268071 - RNA, 18 nt, Homo sapiens
gucuauuuucucagucau

SEQ ID NO: 1268072 - RNA, 19 nt, Homo sapiens
gucucaaacuccugaccuc

SEQ ID NO: 1268073 - RNA, 19 nt, Homo sapiens
gucucaagagggcacuggu

SEQ ID NO: 1268074 - RNA, 23 nt, Homo sapiens
gucucacgggcaugggcacuccc

SEQ ID NO: 1268075 - RNA, 19 nt, Homo sapiens
gucucacuguucugcaaag

SEQ ID NO: 1268076 - RNA, 15 nt, Homo sapiens
gucucaguuucacuu

SEQ ID NO: 1268077 - RNA, 20 nt, Homo sapiens
gucucaugcggacccucaca

SEQ ID NO: 1268078 - RNA, 12 nt, Homo sapiens
gucuccaagacc

SEQ ID NO: 1268079 - RNA, 16 nt, Homo sapiens
gucuccaccugagacc

SEQ ID NO: 1268080 - RNA, 16 nt, Homo sapiens
gucuccucugcagcuc

SEQ ID NO: 1268081 - RNA, 21 nt, Homo sapiens
gucuccucugcagcucaggga

SEQ ID NO: 1268082 - RNA, 14 nt, Homo sapiens
gucuccuugcacuu

SEQ ID NO: 1268083 - RNA, 20 nt, Homo sapiens
gucucgauuagacuccaugu

SEQ ID NO: 1268084 - RNA, 13 nt, Homo sapiens
gucucgcuuuguu

SEQ ID NO: 1268085 - RNA, 17 nt, Homo sapiens
gucucgcuuuguugccc

SEQ ID NO: 1268086 - RNA, 21 nt, Homo sapiens
gucucuauaccaaccaaacca

SEQ ID NO: 1268087 - RNA, 13 nt, Homo sapiens
gucucucccucag

SEQ ID NO: 1268088 - RNA, 18 nt, Homo sapiens
gucucugcuaaaccacca

SEQ ID NO: 1268089 - RNA, 21 nt, Homo sapiens
gucucuuuaaugucacaggca

SEQ ID NO: 1268090 - RNA, 14 nt, Homo sapiens
gucugagaccacuu

SEQ ID NO: 1268091 - RNA, 16 nt, Homo sapiens
gucugagacuccucau

SEQ ID NO: 1268092 - RNA, 14 nt, Homo sapiens
gucugagccaaaga

SEQ ID NO: 1268093 - RNA, 15 nt, Homo sapiens
gucugagucuugggu

SEQ ID NO: 1268094 - RNA, 14 nt, Homo sapiens
gucugccaugcucu

SEQ ID NO: 1268095 - RNA, 16 nt, Homo sapiens
gucugcccuagggaga

SEQ ID NO: 1268096 - RNA, 14 nt, Homo sapiens
gucugcccuuguca

SEQ ID NO: 1268097 - RNA, 16 nt, Homo sapiens
gucugcugcugugcag

SEQ ID NO: 1268098 - RNA, 19 nt, Homo sapiens
gucugcuuauccuuggaag

SEQ ID NO: 1268099 - RNA, 22 nt, Homo sapiens
gucuggagaagguauuagcaaa

SEQ ID NO: 1268100 - RNA, 20 nt, Homo sapiens
gucuggagugguaacagcuc

SEQ ID NO: 1268101 - RNA, 23 nt, Homo sapiens
gucuggggucuccuauacucuau

SEQ ID NO: 1268102 - RNA, 15 nt, Homo sapiens
uaauugaacuaacaa

SEQ ID NO: 1268103 - RNA, 14 nt, Homo sapiens
uaauugauuucaag

SEQ ID NO: 1268104 - RNA, 13 nt, Homo sapiens
uaauugcuuugcc

SEQ ID NO: 1268105 - RNA, 14 nt, Homo sapiens
uaauugcuuugcca

SEQ ID NO: 1268106 - RNA, 19 nt, Homo sapiens
uaauuggauauugaugaaa

SEQ ID NO: 1268107 - RNA, 15 nt, Homo sapiens
uaauuggucauguga

SEQ ID NO: 1268108 - RNA, 15 nt, Homo sapiens
uaauuguguggauuc

SEQ ID NO: 1268109 - RNA, 13 nt, Homo sapiens
uaauuguguguca

SEQ ID NO: 1268110 - RNA, 19 nt, Homo sapiens
uaauugugugucacaagaa

SEQ ID NO: 1268111 - RNA, 19 nt, Homo sapiens
uaauuguuuaaaaugccuc

SEQ ID NO: 1268112 - RNA, 19 nt, Homo sapiens
uaauuuaaaaaauaacuac

SEQ ID NO: 1268113 - RNA, 16 nt, Homo sapiens
uaauuuaaaagcacac

SEQ ID NO: 1268114 - RNA, 17 nt, Homo sapiens
uaauuuaaacaccuccu

SEQ ID NO: 1268115 - RNA, 16 nt, Homo sapiens
uaauuuacagcuuuca

SEQ ID NO: 1268116 - RNA, 16 nt, Homo sapiens
uaauuuauuucaucca

SEQ ID NO: 1268117 - RNA, 18 nt, Homo sapiens
uaauuucaugggacuaaa

SEQ ID NO: 1268118 - RNA, 17 nt, Homo sapiens
uaauuuccauaguguga

SEQ ID NO: 1268119 - RNA, 17 nt, Homo sapiens
uaauuucuuacuaaaca

SEQ ID NO: 1268120 - RNA, 18 nt, Homo sapiens
uaauuugaaaacauaauc

SEQ ID NO: 1268121 - RNA, 20 nt, Homo sapiens
uaauuugagagaaauaugaa

SEQ ID NO: 1268122 - RNA, 13 nt, Homo sapiens
uaauuugaugaaa

SEQ ID NO: 1268123 - RNA, 12 nt, Homo sapiens
uaauuugugugg

SEQ ID NO: 1268124 - RNA, 20 nt, Homo sapiens
uaauuuuaaccaguucuguc

SEQ ID NO: 1268125 - RNA, 15 nt, Homo sapiens
uaauuuuccaaugca

SEQ ID NO: 1268126 - RNA, 18 nt, Homo sapiens
uaauuuuccaaugcacag

SEQ ID NO: 1268127 - RNA, 20 nt, Homo sapiens
uaauuuuuaaggauguugcc

SEQ ID NO: 1268128 - RNA, 22 nt, Homo sapiens
uaauuuuuccuauauugcauua

SEQ ID NO: 1268129 - RNA, 13 nt, Homo sapiens
uaauuuuugcaaa

SEQ ID NO: 1268130 - RNA, 17 nt, Homo sapiens
uaauuuuuuacuuucag

SEQ ID NO: 1268131 - RNA, 20 nt, Homo sapiens
uaauuuuuuugagacagagu

SEQ ID NO: 1268132 - RNA, 16 nt, Homo sapiens
uacaaaaaaauacaaa

SEQ ID NO: 1268133 - RNA, 16 nt, Homo sapiens
uacaaaaauaccuacu

SEQ ID NO: 1268134 - RNA, 20 nt, Homo sapiens
uacaaaauccagcuaugaau

SEQ ID NO: 1268135 - RNA, 16 nt, Homo sapiens
uacaaagauuaguuuc

SEQ ID NO: 1268136 - RNA, 20 nt, Homo sapiens
uacaaagggccaucguucau

SEQ ID NO: 1268137 - RNA, 16 nt, Homo sapiens
uacaaaguaagccaug

SEQ ID NO: 1268138 - RNA, 14 nt, Homo sapiens
uacaaaguauuugc

SEQ ID NO: 1268139 - RNA, 12 nt, Homo sapiens
uacaaaugguau

SEQ ID NO: 1268140 - RNA, 12 nt, Homo sapiens
uacaacauguag

SEQ ID NO: 1268141 - RNA, 12 nt, Homo sapiens
uacaacauguga

SEQ ID NO: 1268142 - RNA, 14 nt, Homo sapiens
uacaaccuacaugu

SEQ ID NO: 1268143 - RNA, 16 nt, Homo sapiens
uacaaccucccucuug

SEQ ID NO: 1268144 - RNA, 19 nt, Homo sapiens
uacaacucuauuuaauuaa

SEQ ID NO: 1268145 - RNA, 18 nt, Homo sapiens
uacaacugccucgaaaca

SEQ ID NO: 1268146 - RNA, 14 nt, Homo sapiens
uacaagaaagcaau

SEQ ID NO: 1268147 - RNA, 23 nt, Homo sapiens
uacaagacuguugugaucuugca

SEQ ID NO: 1268148 - RNA, 22 nt, Homo sapiens
uacaagaugcuaguucauuuga

SEQ ID NO: 1268149 - RNA, 23 nt, Homo sapiens
gccaggucacccuuugcugugag

SEQ ID NO: 1268150 - RNA, 14 nt, Homo sapiens
gccaggugagcucu

SEQ ID NO: 1268151 - RNA, 12 nt, Homo sapiens
gccagguggcca

SEQ ID NO: 1268152 - RNA, 20 nt, Homo sapiens
gccaguaaucuuuauacugg

SEQ ID NO: 1268153 - RNA, 15 nt, Homo sapiens
gccaguauuaugcau

SEQ ID NO: 1268154 - RNA, 16 nt, Homo sapiens
gccagucuugccuagg

SEQ ID NO: 1268155 - RNA, 12 nt, Homo sapiens
gccagugacaga

SEQ ID NO: 1268156 - RNA, 18 nt, Homo sapiens
gccagugccucucacccc

SEQ ID NO: 1268157 - RNA, 22 nt, Homo sapiens
gccagugguguuacacauugag

SEQ ID NO: 1268158 - RNA, 14 nt, Homo sapiens
gccagugucauccg

SEQ ID NO: 1268159 - RNA, 18 nt, Homo sapiens
gccagugucuuucuuugg

SEQ ID NO: 1268160 - RNA, 18 nt, Homo sapiens
gccaguugguggggccag

SEQ ID NO: 1268161 - RNA, 16 nt, Homo sapiens
gccaguuucagcucac

SEQ ID NO: 1268162 - RNA, 21 nt, Homo sapiens
gccauaaacgguuccugguga

SEQ ID NO: 1268163 - RNA, 17 nt, Homo sapiens
gccauaagaaagcacua

SEQ ID NO: 1268164 - RNA, 16 nt, Homo sapiens
gccauaaugacucaga

SEQ ID NO: 1268165 - RNA, 19 nt, Homo sapiens
gccauaauucuaaguuauu

SEQ ID NO: 1268166 - RNA, 14 nt, Homo sapiens
gccauacuuuacaa

SEQ ID NO: 1268167 - RNA, 13 nt, Homo sapiens
gccauagaacaag

SEQ ID NO: 1268168 - RNA, 14 nt, Homo sapiens
gccauaggguccug

SEQ ID NO: 1268169 - RNA, 21 nt, Homo sapiens
gccauauaaguuugaaggaaa

SEQ ID NO: 1268170 - RNA, 14 nt, Homo sapiens
gccauauauauuuc

SEQ ID NO: 1268171 - RNA, 14 nt, Homo sapiens
gccauauuaccccu

SEQ ID NO: 1268172 - RNA, 18 nt, Homo sapiens
gccaucacuagaagaaaa

SEQ ID NO: 1268173 - RNA, 17 nt, Homo sapiens
gccaucaugccugacua

SEQ ID NO: 1268174 - RNA, 16 nt, Homo sapiens
gccauccaauuucucu

SEQ ID NO: 1268175 - RNA, 20 nt, Homo sapiens
gccaucggugaaacuaacag

SEQ ID NO: 1268176 - RNA, 17 nt, Homo sapiens
gccaucuugaucugugu

SEQ ID NO: 1268177 - RNA, 23 nt, Homo sapiens
gccaucuuuaucaugaagcacau

SEQ ID NO: 1268178 - RNA, 16 nt, Homo sapiens
gccaugauggccuuac

SEQ ID NO: 1268179 - RNA, 22 nt, Homo sapiens
gccaugauggccuuacacugaa

SEQ ID NO: 1268180 - RNA, 13 nt, Homo sapiens
gccaugccaggaa

SEQ ID NO: 1268181 - RNA, 15 nt, Homo sapiens
gccaugcugggccac

SEQ ID NO: 1268182 - RNA, 22 nt, Homo sapiens
gccauggcagacaguagacaga

SEQ ID NO: 1268183 - RNA, 16 nt, Homo sapiens
gccauggcuccccuuu

SEQ ID NO: 1268184 - RNA, 18 nt, Homo sapiens
gccaugggccuccugugu

SEQ ID NO: 1268185 - RNA, 19 nt, Homo sapiens
gccauuccacuccacucag

SEQ ID NO: 1268186 - RNA, 22 nt, Homo sapiens
gccauugagaaugugcuuugua

SEQ ID NO: 1268187 - RNA, 14 nt, Homo sapiens
gcccaaacccuuaa

SEQ ID NO: 1268188 - RNA, 17 nt, Homo sapiens
gcccaacuccaccagau

SEQ ID NO: 1268189 - RNA, 17 nt, Homo sapiens
gcccaaggacggcacca

SEQ ID NO: 1268190 - RNA, 13 nt, Homo sapiens
gcccacacccagg

SEQ ID NO: 1268191 - RNA, 22 nt, Homo sapiens
gcccacagcugagaauguggaa

SEQ ID NO: 1268192 - RNA, 17 nt, Homo sapiens
gcccagacacagacugg

SEQ ID NO: 1268193 - RNA, 14 nt, Homo sapiens
gcccagacccagug

SEQ ID NO: 1268194 - RNA, 12 nt, Homo sapiens
gcccagacuuua

SEQ ID NO: 1268195 - RNA, 13 nt, Homo sapiens
gcccagacuuuag

SEQ ID NO: 1268196 - RNA, 22 nt, Homo sapiens
gcccagagaagcaaguggcuuu

SEQ ID NO: 1268197 - RNA, 18 nt, Homo sapiens
gcccagcaaucugcauuu

SEQ ID NO: 1268198 - RNA, 23 nt, Homo sapiens
gcccagccuuguaaauaaccaca

SEQ ID NO: 1268199 - RNA, 15 nt, Homo sapiens
gcccaggcaggccac

SEQ ID NO: 1268200 - RNA, 16 nt, Homo sapiens
gcccaggccagcacuu

SEQ ID NO: 1268201 - RNA, 17 nt, Homo sapiens
gcccaggccuaccucac

SEQ ID NO: 1268202 - RNA, 19 nt, Homo sapiens
gcccaggcuggagugcagu

SEQ ID NO: 1268203 - RNA, 20 nt, Homo sapiens
gcccaggcuggaguggagug

SEQ ID NO: 1268204 - RNA, 16 nt, Homo sapiens
gcccaggguuuugccc

SEQ ID NO: 1268205 - RNA, 19 nt, Homo sapiens
gcccagugacaaagacucc

SEQ ID NO: 1268206 - RNA, 21 nt, Homo sapiens
gcccaguguuguuuguaaaua

SEQ ID NO: 1268207 - RNA, 18 nt, Homo sapiens
gcccauccccaggcaccu

SEQ ID NO: 1268208 - RNA, 19 nt, Homo sapiens
gcccaugaugagaagcaga

SEQ ID NO: 1268209 - RNA, 19 nt, Homo sapiens
uacaugcagcccaugccca

SEQ ID NO: 1268210 - RNA, 16 nt, Homo sapiens
uacauguaauccauca

SEQ ID NO: 1268211 - RNA, 19 nt, Homo sapiens
uacaugucuacaugccaug

SEQ ID NO: 1268212 - RNA, 20 nt, Homo sapiens
uacaugucuacaugccauga

SEQ ID NO: 1268213 - RNA, 23 nt, Homo sapiens
uacaugugauugugauucaucau

SEQ ID NO: 1268214 - RNA, 21 nt, Homo sapiens
uacauguuuauaaaucuuaug

SEQ ID NO: 1268215 - RNA, 16 nt, Homo sapiens
uacauuaacuugaaaa

SEQ ID NO: 1268216 - RNA, 16 nt, Homo sapiens
uacauuaucucacuua

SEQ ID NO: 1268217 - RNA, 23 nt, Homo sapiens
uacauuguuugucugucuucaua

SEQ ID NO: 1268218 - RNA, 21 nt, Homo sapiens
uacauuuaaaaauacuucucu

SEQ ID NO: 1268219 - RNA, 15 nt, Homo sapiens
uacauuuaucacuga

SEQ ID NO: 1268220 - RNA, 13 nt, Homo sapiens
uacauuucauuaa

SEQ ID NO: 1268221 - RNA, 15 nt, Homo sapiens
uacauuuucagugag

SEQ ID NO: 1268222 - RNA, 15 nt, Homo sapiens
uaccaaauaccaugu

SEQ ID NO: 1268223 - RNA, 17 nt, Homo sapiens
uaccaacauaaguguug

SEQ ID NO: 1268224 - RNA, 15 nt, Homo sapiens
uaccaagcagcucac

SEQ ID NO: 1268225 - RNA, 17 nt, Homo sapiens
uaccacaagccugagaa

SEQ ID NO: 1268226 - RNA, 21 nt, Homo sapiens
uaccacaaggaaaauaguuua

SEQ ID NO: 1268227 - RNA, 13 nt, Homo sapiens
uaccacacugagu

SEQ ID NO: 1268228 - RNA, 22 nt, Homo sapiens
uaccacacugaguucuaucagu

SEQ ID NO: 1268229 - RNA, 15 nt, Homo sapiens
uaccacagacuguac

SEQ ID NO: 1268230 - RNA, 22 nt, Homo sapiens
uaccacagcucagccacuguga

SEQ ID NO: 1268231 - RNA, 12 nt, Homo sapiens
uaccacaguguc

SEQ ID NO: 1268232 - RNA, 19 nt, Homo sapiens
uaccacaucugcucuaggg

SEQ ID NO: 1268233 - RNA, 20 nt, Homo sapiens
uaccaccaagggaucugcca

SEQ ID NO: 1268234 - RNA, 22 nt, Homo sapiens
uaccaccaagggaucugccauu

SEQ ID NO: 1268235 - RNA, 23 nt, Homo sapiens
uaccaccaagggaucugccauug

SEQ ID NO: 1268236 - RNA, 16 nt, Homo sapiens
uaccacucuaccaaau

SEQ ID NO: 1268237 - RNA, 13 nt, Homo sapiens
uaccacuuaacag

SEQ ID NO: 1268238 - RNA, 14 nt, Homo sapiens
uaccacuuaccuca

SEQ ID NO: 1268239 - RNA, 11 nt, Homo sapiens
uaccacuugaa

SEQ ID NO: 1268240 - RNA, 22 nt, Homo sapiens
uaccagagccuucaagugccaa

SEQ ID NO: 1268241 - RNA, 12 nt, Homo sapiens
uaccagcagcug

SEQ ID NO: 1268242 - RNA, 16 nt, Homo sapiens
uaccagcgcucuaaaa

SEQ ID NO: 1268243 - RNA, 13 nt, Homo sapiens
uaccaguugccuu

SEQ ID NO: 1268244 - RNA, 15 nt, Homo sapiens
uaccauauuuaauaa

SEQ ID NO: 1268245 - RNA, 17 nt, Homo sapiens
uaccaucuuguauacac

SEQ ID NO: 1268246 - RNA, 16 nt, Homo sapiens
uaccaugagugaauuu

SEQ ID NO: 1268247 - RNA, 16 nt, Homo sapiens
uaccauggcacugaca

SEQ ID NO: 1268248 - RNA, 18 nt, Homo sapiens
uaccauuuaguaagaaua

SEQ ID NO: 1268249 - RNA, 17 nt, Homo sapiens
uaccauuuuucauucac

SEQ ID NO: 1268250 - RNA, 13 nt, Homo sapiens
uacccacauguac

SEQ ID NO: 1268251 - RNA, 14 nt, Homo sapiens
uacccacauguaca

SEQ ID NO: 1268252 - RNA, 11 nt, Homo sapiens
uacccacuucc

SEQ ID NO: 1268253 - RNA, 20 nt, Homo sapiens
uacccagagaauauauacau

SEQ ID NO: 1268254 - RNA, 19 nt, Homo sapiens
uccgcaggcagacuacaca

SEQ ID NO: 1268255 - RNA, 14 nt, Homo sapiens
uccgccagauccug

SEQ ID NO: 1268256 - RNA, 14 nt, Homo sapiens
uccgcccugccacu

SEQ ID NO: 1268257 - RNA, 14 nt, Homo sapiens
uccgcgcaggugcc

SEQ ID NO: 1268258 - RNA, 17 nt, Homo sapiens
uccgcuuucucuugcug

SEQ ID NO: 1268259 - RNA, 14 nt, Homo sapiens
uccggaggagacac

SEQ ID NO: 1268260 - RNA, 21 nt, Homo sapiens
uccggcaaugcccugugcaug

SEQ ID NO: 1268261 - RNA, 16 nt, Homo sapiens
uccggcgggauguuga

SEQ ID NO: 1268262 - RNA, 22 nt, Homo sapiens
uccguggccccgcccucaggcu

SEQ ID NO: 1268263 - RNA, 15 nt, Homo sapiens
uccuaaaaaguucca

SEQ ID NO: 1268264 - RNA, 18 nt, Homo sapiens
uccuaaaaguguaagaaa

SEQ ID NO: 1268265 - RNA, 13 nt, Homo sapiens
uccuaaaaucaca

SEQ ID NO: 1268266 - RNA, 22 nt, Homo sapiens
uccuaaacccaaugacuucccu

SEQ ID NO: 1268267 - RNA, 14 nt, Homo sapiens
uccuaacaaaagau

SEQ ID NO: 1268268 - RNA, 23 nt, Homo sapiens
uccuaacaggaugaaaguucccc

SEQ ID NO: 1268269 - RNA, 14 nt, Homo sapiens
uccuaacuagaauu

SEQ ID NO: 1268270 - RNA, 17 nt, Homo sapiens
uccuaagacacaaaugc

SEQ ID NO: 1268271 - RNA, 12 nt, Homo sapiens
uccuaagcacuu

SEQ ID NO: 1268272 - RNA, 18 nt, Homo sapiens
uccuaaguauauuaauau

SEQ ID NO: 1268273 - RNA, 14 nt, Homo sapiens
uccuaauacguauu

SEQ ID NO: 1268274 - RNA, 12 nt, Homo sapiens
uccuacacuuga

SEQ ID NO: 1268275 - RNA, 17 nt, Homo sapiens
uccuacagccagcagca

SEQ ID NO: 1268276 - RNA, 17 nt, Homo sapiens
uccuaccaguugcccua

SEQ ID NO: 1268277 - RNA, 17 nt, Homo sapiens
uccuaccccuuugcacu

SEQ ID NO: 1268278 - RNA, 16 nt, Homo sapiens
uccuacuaaaucccuc

SEQ ID NO: 1268279 - RNA, 15 nt, Homo sapiens
uccuacucacuuaaa

SEQ ID NO: 1268280 - RNA, 21 nt, Homo sapiens
uccuacugagcauuugcaccu

SEQ ID NO: 1268281 - RNA, 19 nt, Homo sapiens
uccuagaggugggcagcug

SEQ ID NO: 1268282 - RNA, 18 nt, Homo sapiens
uccuagauguaacauucc

SEQ ID NO: 1268283 - RNA, 19 nt, Homo sapiens
uacuuauauccacacugca

SEQ ID NO: 1268284 - RNA, 20 nt, Homo sapiens
uacuuauauguaaaguauua

SEQ ID NO: 1268285 - RNA, 15 nt, Homo sapiens
uacuuaucuuaugcc

SEQ ID NO: 1268286 - RNA, 20 nt, Homo sapiens
uacuuaugaaaagaauuuga

SEQ ID NO: 1268287 - RNA, 15 nt, Homo sapiens
uacuuaugccauaga

SEQ ID NO: 1268288 - RNA, 21 nt, Homo sapiens
uacuucaaccagccuacaagc

SEQ ID NO: 1268289 - RNA, 17 nt, Homo sapiens
uacuucagugcaccuac

SEQ ID NO: 1268290 - RNA, 22 nt, Homo sapiens
uacuucagugcaccuacugcuu

SEQ ID NO: 1268291 - RNA, 11 nt, Homo sapiens
uacuucauuaa

SEQ ID NO: 1268292 - RNA, 22 nt, Homo sapiens
uacuugaaauuuggcuaauaac

SEQ ID NO: 1268293 - RNA, 23 nt, Homo sapiens
uacuugagugguguguguuauca

SEQ ID NO: 1268294 - RNA, 21 nt, Homo sapiens
uacuugauaauauuagugauu

SEQ ID NO: 1268295 - RNA, 20 nt, Homo sapiens
uacuugcuuauuacauuuaa

SEQ ID NO: 1268296 - RNA, 19 nt, Homo sapiens
uacuugggagaccuguaau

SEQ ID NO: 1268297 - RNA, 18 nt, Homo sapiens
uacuugugaaacacagcu

SEQ ID NO: 1268298 - RNA, 14 nt, Homo sapiens
uacuuguggacaca

SEQ ID NO: 1268299 - RNA, 17 nt, Homo sapiens
uacuuguggacacagcu

SEQ ID NO: 1268300 - RNA, 18 nt, Homo sapiens
uacuuguuuucacuuuau

SEQ ID NO: 1268301 - RNA, 16 nt, Homo sapiens
uacuuuaucaaugugu

SEQ ID NO: 1268302 - RNA, 15 nt, Homo sapiens
uacuuuauuguacag

SEQ ID NO: 1268303 - RNA, 22 nt, Homo sapiens
uacuuuauuucugaucuauaca

SEQ ID NO: 1268304 - RNA, 22 nt, Homo sapiens
uacuuuccacauauagagcucc

SEQ ID NO: 1268305 - RNA, 16 nt, Homo sapiens
uacuuucccucaucca

SEQ ID NO: 1268306 - RNA, 23 nt, Homo sapiens
uacuuucccugcacccaucugcu

SEQ ID NO: 1268307 - RNA, 20 nt, Homo sapiens
uacuuucuuauaaauuugga

SEQ ID NO: 1268308 - RNA, 14 nt, Homo sapiens
uacuuugacagugu

SEQ ID NO: 1268309 - RNA, 17 nt, Homo sapiens
uacuuugacuuuuugca

SEQ ID NO: 1268310 - RNA, 19 nt, Homo sapiens
uacuuugaguuagugccau

SEQ ID NO: 1268311 - RNA, 16 nt, Homo sapiens
uacuuugauaucugau

SEQ ID NO: 1268312 - RNA, 15 nt, Homo sapiens
uacuuugugcauucu

SEQ ID NO: 1268313 - RNA, 18 nt, Homo sapiens
uacuuuuaaacuguguac

SEQ ID NO: 1268314 - RNA, 21 nt, Homo sapiens
uacuuuuaaaugcaaucucuu

SEQ ID NO: 1268315 - RNA, 14 nt, Homo sapiens
uacuuuuacagguu

SEQ ID NO: 1268316 - RNA, 23 nt, Homo sapiens
uacuuuucaguuuuuaacauaau

SEQ ID NO: 1268317 - RNA, 15 nt, Homo sapiens
uacuuuuguuguaug

SEQ ID NO: 1268318 - RNA, 15 nt, Homo sapiens
uacuuuuuaguaauu

SEQ ID NO: 1268319 - RNA, 20 nt, Homo sapiens
uacuuuuuuuuaguucaaua

SEQ ID NO: 1268320 - RNA, 14 nt, Homo sapiens
uagaaaaccucacc

SEQ ID NO: 1268321 - RNA, 16 nt, Homo sapiens
uagaaaagaaagcaaa

SEQ ID NO: 1268322 - RNA, 20 nt, Homo sapiens
uagaaaauaaaacugagcua

SEQ ID NO: 1268323 - RNA, 23 nt, Homo sapiens
uagaaaaugacuuauuucugcuc

SEQ ID NO: 1268324 - RNA, 14 nt, Homo sapiens
uagaaaaugcaguc

SEQ ID NO: 1268325 - RNA, 15 nt, Homo sapiens
uagaaaaugguccaa

SEQ ID NO: 1268326 - RNA, 11 nt, Homo sapiens
uccuuccucuc

SEQ ID NO: 1268327 - RNA, 23 nt, Homo sapiens
uccuuccugcuugaguucccaga

SEQ ID NO: 1268328 - RNA, 15 nt, Homo sapiens
uccuuccuucagggu

SEQ ID NO: 1268329 - RNA, 18 nt, Homo sapiens
uccuucuauucuagccug

SEQ ID NO: 1268330 - RNA, 22 nt, Homo sapiens
uccuucugggacuggacagcuu

SEQ ID NO: 1268331 - RNA, 14 nt, Homo sapiens
uccuucugugaaag

SEQ ID NO: 1268332 - RNA, 11 nt, Homo sapiens
uccuucuugcu

SEQ ID NO: 1268333 - RNA, 20 nt, Homo sapiens
uccuugcccagacuacaggg

SEQ ID NO: 1268334 - RNA, 15 nt, Homo sapiens
uccuuggaaauugga

SEQ ID NO: 1268335 - RNA, 21 nt, Homo sapiens
uccuuggcgcugccaccugcc

SEQ ID NO: 1268336 - RNA, 18 nt, Homo sapiens
uccuugggaugaucuuga

SEQ ID NO: 1268337 - RNA, 16 nt, Homo sapiens
uccuuggggagcacuu

SEQ ID NO: 1268338 - RNA, 16 nt, Homo sapiens
uccuuguaaauuacau

SEQ ID NO: 1268339 - RNA, 22 nt, Homo sapiens
uccuugugcaaaauauuugacu

SEQ ID NO: 1268340 - RNA, 23 nt, Homo sapiens
uccuuuaaaaaacuuagugacaa

SEQ ID NO: 1268341 - RNA, 15 nt, Homo sapiens
uccuuuaaaccauca

SEQ ID NO: 1268342 - RNA, 15 nt, Homo sapiens
uccuuuaaucacugc

SEQ ID NO: 1268343 - RNA, 23 nt, Homo sapiens
uccuuuaggucugguuguugcac

SEQ ID NO: 1268344 - RNA, 20 nt, Homo sapiens
uccuuuauacacaguggauu

SEQ ID NO: 1268345 - RNA, 21 nt, Homo sapiens
uccuuuauuauaaucaaagcu

SEQ ID NO: 1268346 - RNA, 18 nt, Homo sapiens
uccuuucacccgcuccua

SEQ ID NO: 1268347 - RNA, 23 nt, Homo sapiens
uccuuuccaagcuccucgugaua

SEQ ID NO: 1268348 - RNA, 18 nt, Homo sapiens
uccuuucuaaauugcaug

SEQ ID NO: 1268349 - RNA, 22 nt, Homo sapiens
uccuuugaccacugucuuuuuc

SEQ ID NO: 1268350 - RNA, 15 nt, Homo sapiens
uccuuugcagggcag

SEQ ID NO: 1268351 - RNA, 20 nt, Homo sapiens
uccuuuuaaaaaccuagguc

SEQ ID NO: 1268352 - RNA, 16 nt, Homo sapiens
uccuuuuaauuuuccu

SEQ ID NO: 1268353 - RNA, 18 nt, Homo sapiens
uccuuuucuacaugaugc

SEQ ID NO: 1268354 - RNA, 22 nt, Homo sapiens
uccuuuuuucaauaugcaagca

SEQ ID NO: 1268355 - RNA, 15 nt, Homo sapiens
ucgaaagcucuagaa

SEQ ID NO: 1268356 - RNA, 15 nt, Homo sapiens
ucgaacuucacaacu

SEQ ID NO: 1268357 - RNA, 20 nt, Homo sapiens
ucgaagaaacccuugcugcu

SEQ ID NO: 1268358 - RNA, 14 nt, Homo sapiens
ucgaagcuccguga

SEQ ID NO: 1268359 - RNA, 17 nt, Homo sapiens
ucgaaugagucuaagaa

SEQ ID NO: 1268360 - RNA, 20 nt, Homo sapiens
ucgaucuccugaccucguga

SEQ ID NO: 1268361 - RNA, 16 nt, Homo sapiens
ucgauuucuaccucag

SEQ ID NO: 1268362 - RNA, 18 nt, Homo sapiens
ucgauuuucuauuaugga

SEQ ID NO: 1268363 - RNA, 15 nt, Homo sapiens
ucgcaccacugcacu

SEQ ID NO: 1268364 - RNA, 18 nt, Homo sapiens
ucgcaccacugcacucca

SEQ ID NO: 1268365 - RNA, 20 nt, Homo sapiens
ucgcaccuaccaucagggac

SEQ ID NO: 1268366 - RNA, 13 nt, Homo sapiens
ucgcaugacuguu

SEQ ID NO: 1268367 - RNA, 22 nt, Homo sapiens
ucgcauggccugcagucuggca

SEQ ID NO: 1268368 - RNA, 15 nt, Homo sapiens
ucgcccaacuccacc

SEQ ID NO: 1268369 - RNA, 20 nt, Homo sapiens
ucgcccaggcuggagugcaa

SEQ ID NO: 1268370 - RNA, 21 nt, Homo sapiens
ucgcccaggcuggagugcaau

SEQ ID NO: 1268371 - RNA, 22 nt, Homo sapiens
ucgccccaccuccaccugugag

SEQ ID NO: 1268372 - RNA, 20 nt, Homo sapiens
ucgcccuccucccugucaua

SEQ ID NO: 1268373 - RNA, 14 nt, Homo sapiens
ucgcugccagauga

SEQ ID NO: 1268374 - RNA, 15 nt, Homo sapiens
ucgcugccagaugau

SEQ ID NO: 1268375 - RNA, 22 nt, Homo sapiens
ucgcuguuggagcaaaccauua

SEQ ID NO: 1268376 - RNA, 23 nt, Homo sapiens
ucggacaagacccccagcacuug

SEQ ID NO: 1268377 - RNA, 22 nt, Homo sapiens
ucggaggccauccugccagggg

SEQ ID NO: 1268378 - RNA, 15 nt, Homo sapiens
ucggauacuugccaa

SEQ ID NO: 1268379 - RNA, 17 nt, Homo sapiens
ucggaugaccaaaccag

SEQ ID NO: 1268380 - RNA, 15 nt, Homo sapiens
ucggccuccaugacc

SEQ ID NO: 1268381 - RNA, 16 nt, Homo sapiens
ucggccuccaugaccu

SEQ ID NO: 1268382 - RNA, 13 nt, Homo sapiens
ucggcucacugca

SEQ ID NO: 1268383 - RNA, 20 nt, Homo sapiens
ucggcuccccauguguccug

SEQ ID NO: 1268384 - RNA, 14 nt, Homo sapiens
ucgggaacaguguu

SEQ ID NO: 1268385 - RNA, 14 nt, Homo sapiens
ucgggccacagggc

SEQ ID NO: 1268386 - RNA, 10 nt, Homo sapiens
ucggggagcu

SEQ ID NO: 1268387 - RNA, 23 nt, Homo sapiens
ucgguguucugucccagugcggu

SEQ ID NO: 1268388 - RNA, 13 nt, Homo sapiens
ucguagccaucuc

SEQ ID NO: 1268389 - RNA, 14 nt, Homo sapiens
ucguagccaucucu

SEQ ID NO: 1268390 - RNA, 14 nt, Homo sapiens
ucguauacccugga

SEQ ID NO: 1268391 - RNA, 18 nt, Homo sapiens
ucguaugaucaguacuga

SEQ ID NO: 1268392 - RNA, 13 nt, Homo sapiens
ucgugcacucugc

SEQ ID NO: 1268393 - RNA, 19 nt, Homo sapiens
ucgugggucagcucugagg

SEQ ID NO: 1268394 - RNA, 20 nt, Homo sapiens
ucguggguguguguagccaa

SEQ ID NO: 1268395 - RNA, 21 nt, Homo sapiens
ucguguaauuggcccaaguca

SEQ ID NO: 1268396 - RNA, 18 nt, Homo sapiens
ucguucaaaacauuccaa

SEQ ID NO: 1268397 - RNA, 23 nt, Homo sapiens
ucguuuucgcuggggauggaauu

SEQ ID NO: 1268398 - RNA, 22 nt, Homo sapiens
ucuaaaaauucuuaacuuuuaa

SEQ ID NO: 1268399 - RNA, 17 nt, Homo sapiens
ucuaaaacugccuucca

SEQ ID NO: 1268400 - RNA, 17 nt, Homo sapiens
ucuaaaauacaaaccca

SEQ ID NO: 1268401 - RNA, 16 nt, Homo sapiens
ucuaaaauucuauuau

SEQ ID NO: 1268402 - RNA, 12 nt, Homo sapiens
ucuaaacauuuc

SEQ ID NO: 1268403 - RNA, 13 nt, Homo sapiens
ucuaaacuacaac

SEQ ID NO: 1268404 - RNA, 14 nt, Homo sapiens
ucuaaagauucuau

SEQ ID NO: 1268405 - RNA, 21 nt, Homo sapiens
ucuaaagcaguuuauuauaau

SEQ ID NO: 1268406 - RNA, 23 nt, Homo sapiens
ucuaaagcuuuggacaaguccuu

SEQ ID NO: 1268407 - RNA, 20 nt, Homo sapiens
ucuaaagggaucugcuuaaa

SEQ ID NO: 1268408 - RNA, 22 nt, Homo sapiens
ucuaaaguguuggucuuucuaa

SEQ ID NO: 1268409 - RNA, 13 nt, Homo sapiens
ucuaaaguucuaa

SEQ ID NO: 1268410 - RNA, 20 nt, Homo sapiens
ucuaaauggugcugcagauu

SEQ ID NO: 1268411 - RNA, 16 nt, Homo sapiens
ucuaacaaaaacuaca

SEQ ID NO: 1268412 - RNA, 23 nt, Homo sapiens
ucuaacaauggaagauuugccca

SEQ ID NO: 1268413 - RNA, 15 nt, Homo sapiens
ucuaacaggcacuuu

SEQ ID NO: 1268414 - RNA, 16 nt, Homo sapiens
ucuaacaggcacuuug

SEQ ID NO: 1268415 - RNA, 17 nt, Homo sapiens
ucuaacaggcacuuuga

SEQ ID NO: 1268416 - RNA, 14 nt, Homo sapiens
ucuaacgggcauuu

SEQ ID NO: 1268417 - RNA, 20 nt, Homo sapiens
ucuaacuagaaaucugccaa

SEQ ID NO: 1268418 - RNA, 16 nt, Homo sapiens
ucuaacucagaauuau

SEQ ID NO: 1268419 - RNA, 15 nt, Homo sapiens
ucuaagccaacuuua

SEQ ID NO: 1268420 - RNA, 14 nt, Homo sapiens
ucuaaggagagcuc

SEQ ID NO: 1268421 - RNA, 21 nt, Homo sapiens
ucuaaggccuaggauucuaaa

SEQ ID NO: 1268422 - RNA, 13 nt, Homo sapiens
ucuaagugauaua

SEQ ID NO: 1268423 - RNA, 17 nt, Homo sapiens
ucuaaguucauguuugu

SEQ ID NO: 1268424 - RNA, 13 nt, Homo sapiens
ucuaauacuuugu

SEQ ID NO: 1268425 - RNA, 18 nt, Homo sapiens
ucuaauauuuuuagcucu

SEQ ID NO: 1268426 - RNA, 21 nt, Homo sapiens
ucuaaucaaaagggaaaagaa

SEQ ID NO: 1268427 - RNA, 14 nt, Homo sapiens
ucuaauguacaaua

SEQ ID NO: 1268428 - RNA, 12 nt, Homo sapiens
ucuaaugugcau

SEQ ID NO: 1268429 - RNA, 14 nt, Homo sapiens
ucuaaugugcauua

SEQ ID NO: 1268430 - RNA, 18 nt, Homo sapiens
ucuaauuaaaauugugca

SEQ ID NO: 1268431 - RNA, 18 nt, Homo sapiens
ucuaauucggauuugcca

SEQ ID NO: 1268432 - RNA, 22 nt, Homo sapiens
ucuaauuuuggauggaguccag

SEQ ID NO: 1268433 - RNA, 20 nt, Homo sapiens
ucuacacagauggaaucucu

SEQ ID NO: 1268434 - RNA, 21 nt, Homo sapiens
ucuacacagauggaaucucuu

SEQ ID NO: 1268435 - RNA, 23 nt, Homo sapiens
ucuacacagugggaacucugaca

SEQ ID NO: 1268436 - RNA, 16 nt, Homo sapiens
ucuacagaauaaucca

SEQ ID NO: 1268437 - RNA, 20 nt, Homo sapiens
ucuacagagaagauucuugu

SEQ ID NO: 1268438 - RNA, 23 nt, Homo sapiens
ucuacagauccuuuuuccaucau

SEQ ID NO: 1268439 - RNA, 16 nt, Homo sapiens
ucuacagcagcacugu

SEQ ID NO: 1268440 - RNA, 23 nt, Homo sapiens
ucuacagcagcacuguucugucc

SEQ ID NO: 1268441 - RNA, 20 nt, Homo sapiens
ucuacagugccaacuccuca

SEQ ID NO: 1268442 - RNA, 19 nt, Homo sapiens
ucuacauagugacaugcac

SEQ ID NO: 1268443 - RNA, 20 nt, Homo sapiens
ucuacauagugacaugcaca

SEQ ID NO: 1268444 - RNA, 23 nt, Homo sapiens
ucuaccaaauaauuucauauuca

SEQ ID NO: 1268445 - RNA, 16 nt, Homo sapiens
ucuaccaggcaaauuc

SEQ ID NO: 1268446 - RNA, 22 nt, Homo sapiens
ucuacccacccccaucaccuac

SEQ ID NO: 1268447 - RNA, 19 nt, Homo sapiens
ucuacuaaaaacacaaaaa

SEQ ID NO: 1268448 - RNA, 15 nt, Homo sapiens
ucuacuaauuccaca

SEQ ID NO: 1268449 - RNA, 20 nt, Homo sapiens
ucuacuacaaacuucaaaga

SEQ ID NO: 1268450 - RNA, 21 nt, Homo sapiens
ucuacuacaaacuucaaagag

SEQ ID NO: 1268451 - RNA, 20 nt, Homo sapiens
ucuacuacaugugacuggca

SEQ ID NO: 1268452 - RNA, 17 nt, Homo sapiens
ucuacuccuaccucagc

SEQ ID NO: 1268453 - RNA, 22 nt, Homo sapiens
ucuacugcuuuggauccugggu

SEQ ID NO: 1268454 - RNA, 16 nt, Homo sapiens
ucuacuuaaugagaua

SEQ ID NO: 1268455 - RNA, 22 nt, Homo sapiens
ucuacuucuggaagucaucuca

SEQ ID NO: 1268456 - RNA, 20 nt, Homo sapiens
ucuagaaccuucuagaaccu

SEQ ID NO: 1268457 - RNA, 13 nt, Homo sapiens
ucuagaacuugac

SEQ ID NO: 1268458 - RNA, 13 nt, Homo sapiens
ucuagaagccaag

SEQ ID NO: 1268459 - RNA, 19 nt, Homo sapiens
ucuagaauuauaagucaca

SEQ ID NO: 1268460 - RNA, 20 nt, Homo sapiens
ucuagaauuauaagucacaa

SEQ ID NO: 1268461 - RNA, 21 nt, Homo sapiens
ucuagaauuauaagucacaaa

SEQ ID NO: 1268462 - RNA, 20 nt, Homo sapiens
ucuagacugccagggagacc

SEQ ID NO: 1268463 - RNA, 19 nt, Homo sapiens
ucuagccuauuuaccugca

SEQ ID NO: 1268464 - RNA, 18 nt, Homo sapiens
ucuagggaaucuggauua

SEQ ID NO: 1268465 - RNA, 13 nt, Homo sapiens
ucuaggguccagu

SEQ ID NO: 1268466 - RNA, 22 nt, Homo sapiens
ucuagguaggggcccacuucac

SEQ ID NO: 1268467 - RNA, 16 nt, Homo sapiens
ucuaggucacuucuca

SEQ ID NO: 1268468 - RNA, 17 nt, Homo sapiens
ucuaguaagaugcacug

SEQ ID NO: 1268469 - RNA, 15 nt, Homo sapiens
ucuauaaacuucaga

SEQ ID NO: 1268470 - RNA, 20 nt, Homo sapiens
ucuauacaaauuuucagaag

SEQ ID NO: 1268471 - RNA, 13 nt, Homo sapiens
ucuauacaacagg

SEQ ID NO: 1268472 - RNA, 20 nt, Homo sapiens
ucuauaccaaccaaaccaau

SEQ ID NO: 1268473 - RNA, 19 nt, Homo sapiens
ucuauauaugaagugaaaa

SEQ ID NO: 1268474 - RNA, 24 nt, Homo sapiens
ucuauauuuuuuguaacauaaugc

SEQ ID NO: 1268475 - RNA, 14 nt, Homo sapiens
ucuaucauggaaua

SEQ ID NO: 1268476 - RNA, 19 nt, Homo sapiens
ucuaugaaacugcacauug

SEQ ID NO: 1268477 - RNA, 11 nt, Homo sapiens
ucuaugaagcc

SEQ ID NO: 1268478 - RNA, 20 nt, Homo sapiens
cuccagaagggcagcuccac

SEQ ID NO: 1268479 - RNA, 23 nt, Homo sapiens
cuccagaauggucuuucuaaugu

SEQ ID NO: 1268480 - RNA, 14 nt, Homo sapiens
cuccagacaccagu

SEQ ID NO: 1268481 - RNA, 16 nt, Homo sapiens
cuccagccagcaauga

SEQ ID NO: 1268482 - RNA, 20 nt, Homo sapiens
cuccagcccagacccagugg

SEQ ID NO: 1268483 - RNA, 17 nt, Homo sapiens
cuccagcgguccaaagu

SEQ ID NO: 1268484 - RNA, 18 nt, Homo sapiens
cuccaggacuccacugga

SEQ ID NO: 1268485 - RNA, 23 nt, Homo sapiens
cuccagggaauccaagccuccac

SEQ ID NO: 1268486 - RNA, 17 nt, Homo sapiens
cuccagguucacuuugg

SEQ ID NO: 1268487 - RNA, 19 nt, Homo sapiens
cuccagucuggcaacagag

SEQ ID NO: 1268488 - RNA, 13 nt, Homo sapiens
cuccagucuuccg

SEQ ID NO: 1268489 - RNA, 12 nt, Homo sapiens
cuccagugcagg

SEQ ID NO: 1268490 - RNA, 12 nt, Homo sapiens
cuccagugccag

SEQ ID NO: 1268491 - RNA, 18 nt, Homo sapiens
cuccagugcuguccaugc

SEQ ID NO: 1268492 - RNA, 22 nt, Homo sapiens
cuccaguuuacccuucagguug

SEQ ID NO: 1268493 - RNA, 20 nt, Homo sapiens
cuccauaaacagacuguuaa

SEQ ID NO: 1268494 - RNA, 14 nt, Homo sapiens
cuccauacaaugac

SEQ ID NO: 1268495 - RNA, 18 nt, Homo sapiens
cuccaucccaaccaggca

SEQ ID NO: 1268496 - RNA, 15 nt, Homo sapiens
cuccaucucaaaaag

SEQ ID NO: 1268497 - RNA, 17 nt, Homo sapiens
cuccaucuccacuccag

SEQ ID NO: 1268498 - RNA, 17 nt, Homo sapiens
cuccaucucucauccuc

SEQ ID NO: 1268499 - RNA, 20 nt, Homo sapiens
cuccaucuuucuacagagau

SEQ ID NO: 1268500 - RNA, 21 nt, Homo sapiens
cuccaugcuccucaccugucu

SEQ ID NO: 1268501 - RNA, 19 nt, Homo sapiens
cuccaugcugccuccagaa

SEQ ID NO: 1268502 - RNA, 14 nt, Homo sapiens
cuccauggcaucuu

SEQ ID NO: 1268503 - RNA, 14 nt, Homo sapiens
cuccauguuugaug

SEQ ID NO: 1268504 - RNA, 15 nt, Homo sapiens
cuccauuuaccagua

SEQ ID NO: 1268505 - RNA, 20 nt, Homo sapiens
cucccaaagugcugggauua

SEQ ID NO: 1268506 - RNA, 19 nt, Homo sapiens
cucccaaauugcugggauu

SEQ ID NO: 1268507 - RNA, 16 nt, Homo sapiens
cucccaacacugucac

SEQ ID NO: 1268508 - RNA, 16 nt, Homo sapiens
cucccaacccauucac

SEQ ID NO: 1268509 - RNA, 19 nt, Homo sapiens
cucccaaggcucugagcaa

SEQ ID NO: 1268510 - RNA, 23 nt, Homo sapiens
cucccaagguccucucaguucuc

SEQ ID NO: 1268511 - RNA, 20 nt, Homo sapiens
cucccacacugaaaccaaaa

SEQ ID NO: 1268512 - RNA, 21 nt, Homo sapiens
cucccacaugaggccaucuca

SEQ ID NO: 1268513 - RNA, 18 nt, Homo sapiens
cucccaccagagacuggg

SEQ ID NO: 1268514 - RNA, 22 nt, Homo sapiens
cucccaccccggccuccacucc

SEQ ID NO: 1268515 - RNA, 19 nt, Homo sapiens
cucccacccuguaccucau

SEQ ID NO: 1268516 - RNA, 20 nt, Homo sapiens
cucccaccucugugaccuca

SEQ ID NO: 1268517 - RNA, 18 nt, Homo sapiens
cucccacuucacugcgaa

SEQ ID NO: 1268518 - RNA, 22 nt, Homo sapiens
cucccagaggagccaccaguuc

SEQ ID NO: 1268519 - RNA, 15 nt, Homo sapiens
cucccagcccuaugg

SEQ ID NO: 1268520 - RNA, 16 nt, Homo sapiens
cucccagcguguguau

SEQ ID NO: 1268521 - RNA, 13 nt, Homo sapiens
cucccagcuccuu

SEQ ID NO: 1268522 - RNA, 14 nt, Homo sapiens
cucccagcuccuuu

SEQ ID NO: 1268523 - RNA, 20 nt, Homo sapiens
cucccaggcccgagauguga

SEQ ID NO: 1268524 - RNA, 20 nt, Homo sapiens
cucccagguucccccagcaa

SEQ ID NO: 1268525 - RNA, 22 nt, Homo sapiens
cucccaguccaaauguccucca

SEQ ID NO: 1268526 - RNA, 23 nt, Homo sapiens
cucccauaauugcuuugccaaaa

SEQ ID NO: 1268527 - RNA, 15 nt, Homo sapiens
cucccaugggcugag

SEQ ID NO: 1268528 - RNA, 16 nt, Homo sapiens
cuccccacacuaaccu

SEQ ID NO: 1268529 - RNA, 20 nt, Homo sapiens
cuccccacuuguccgcuggg

SEQ ID NO: 1268530 - RNA, 20 nt, Homo sapiens
caccucccauuacuuugaua

SEQ ID NO: 1268531 - RNA, 22 nt, Homo sapiens
caccuccuagaggugggcagcu

SEQ ID NO: 1268532 - RNA, 16 nt, Homo sapiens
caccuccucauguaca

SEQ ID NO: 1268533 - RNA, 17 nt, Homo sapiens
caccuccucugugauuu

SEQ ID NO: 1268534 - RNA, 14 nt, Homo sapiens
caccucugccuugg

SEQ ID NO: 1268535 - RNA, 20 nt, Homo sapiens
caccucugugaccucaggca

SEQ ID NO: 1268536 - RNA, 14 nt, Homo sapiens
caccucuguucauu

SEQ ID NO: 1268537 - RNA, 15 nt, Homo sapiens
caccugcaugugcug

SEQ ID NO: 1268538 - RNA, 21 nt, Homo sapiens
caccugccuccucguuccuuu

SEQ ID NO: 1268539 - RNA, 22 nt, Homo sapiens
caccugcguguccccgugcagu

SEQ ID NO: 1268540 - RNA, 23 nt, Homo sapiens
caccugcuccaggagguuugcag

SEQ ID NO: 1268541 - RNA, 17 nt, Homo sapiens
caccuggcccuugcaau

SEQ ID NO: 1268542 - RNA, 15 nt, Homo sapiens
caccuggggauuuua

SEQ ID NO: 1268543 - RNA, 20 nt, Homo sapiens
caccuggguccaucagagaa

SEQ ID NO: 1268544 - RNA, 15 nt, Homo sapiens
caccugucaucucac

SEQ ID NO: 1268545 - RNA, 12 nt, Homo sapiens
caccuguuggcu

SEQ ID NO: 1268546 - RNA, 17 nt, Homo sapiens
caccuucaaaagcacug

SEQ ID NO: 1268547 - RNA, 17 nt, Homo sapiens
auggaaguggcagugaa

SEQ ID NO: 1268548 - RNA, 18 nt, Homo sapiens
auggaaguggcagugaaa

SEQ ID NO: 1268549 - RNA, 16 nt, Homo sapiens
auggaaguuggcugca

SEQ ID NO: 1268550 - RNA, 15 nt, Homo sapiens
auggacaagauuacc

SEQ ID NO: 1268551 - RNA, 21 nt, Homo sapiens
auggacacuccagugccagca

SEQ ID NO: 1268552 - RNA, 18 nt, Homo sapiens
auggaccagugguuucca

SEQ ID NO: 1268553 - RNA, 13 nt, Homo sapiens
auggagaggacag

SEQ ID NO: 1268554 - RNA, 17 nt, Homo sapiens
auggagcagccuggaga

SEQ ID NO: 1268555 - RNA, 18 nt, Homo sapiens
auggagccagcucugcau

SEQ ID NO: 1268556 - RNA, 17 nt, Homo sapiens
auggaggcaugccaaau

SEQ ID NO: 1268557 - RNA, 14 nt, Homo sapiens
auggaggcccuccu

SEQ ID NO: 1268558 - RNA, 15 nt, Homo sapiens
auggaggcccuccug

SEQ ID NO: 1268559 - RNA, 16 nt, Homo sapiens
auggagggagaagcua

SEQ ID NO: 1268560 - RNA, 16 nt, Homo sapiens
auggaguauaugucaa

SEQ ID NO: 1268561 - RNA, 16 nt, Homo sapiens
auggagugcucacaaa

SEQ ID NO: 1268562 - RNA, 15 nt, Homo sapiens
auggauauuauuaga

SEQ ID NO: 1268563 - RNA, 15 nt, Homo sapiens
auggaugucuucuag

SEQ ID NO: 1268564 - RNA, 22 nt, Homo sapiens
auggauuuugggagugacucaa

SEQ ID NO: 1268565 - RNA, 20 nt, Homo sapiens
auggauuuuucuuuaacugc

SEQ ID NO: 1268566 - RNA, 17 nt, Homo sapiens
auggcaaaauuagucuu

SEQ ID NO: 1268567 - RNA, 18 nt, Homo sapiens
auggcaauuuagcucucu

SEQ ID NO: 1268568 - RNA, 15 nt, Homo sapiens
auggcacugacaaug

SEQ ID NO: 1268569 - RNA, 17 nt, Homo sapiens
auggcacugacaauggg

SEQ ID NO: 1268570 - RNA, 20 nt, Homo sapiens
auggcacugacaaugggcac

SEQ ID NO: 1268571 - RNA, 15 nt, Homo sapiens
auggcagaagacacc

SEQ ID NO: 1268572 - RNA, 12 nt, Homo sapiens
auggcagacucu

SEQ ID NO: 1268573 - RNA, 19 nt, Homo sapiens
auggcagcugguugcucca

SEQ ID NO: 1268574 - RNA, 14 nt, Homo sapiens
auggcaugcugaaa

SEQ ID NO: 1268575 - RNA, 23 nt, Homo sapiens
auggcauugaacugguucaugaa

SEQ ID NO: 1268576 - RNA, 16 nt, Homo sapiens
auggccaaacccucac

SEQ ID NO: 1268577 - RNA, 13 nt, Homo sapiens
auggccacuguga

SEQ ID NO: 1268578 - RNA, 18 nt, Homo sapiens
auggccagugugauccca

SEQ ID NO: 1268579 - RNA, 20 nt, Homo sapiens
auggccagugugaucccaag

SEQ ID NO: 1268580 - RNA, 22 nt, Homo sapiens
auggccccuccacuggggaaug

SEQ ID NO: 1268581 - RNA, 18 nt, Homo sapiens
auggccuccauccagaaa

SEQ ID NO: 1268582 - RNA, 23 nt, Homo sapiens
auggccuggcugcugcugugcag

SEQ ID NO: 1268583 - RNA, 23 nt, Homo sapiens
auggccuugaaacaguuccauuu

SEQ ID NO: 1268584 - RNA, 20 nt, Homo sapiens
auggcgaccgggcaagcuuu

SEQ ID NO: 1268585 - RNA, 21 nt, Homo sapiens
auggcuacuuugguuucuguc

SEQ ID NO: 1268586 - RNA, 16 nt, Homo sapiens
auggcuaguacuguau

SEQ ID NO: 1268587 - RNA, 15 nt, Homo sapiens
auggcuauauggcaa

SEQ ID NO: 1268588 - RNA, 16 nt, Homo sapiens
auggcuaucaucaaaa

SEQ ID NO: 1268589 - RNA, 14 nt, Homo sapiens
auggcuccagaaau

SEQ ID NO: 1268590 - RNA, 19 nt, Homo sapiens
auggcugcccaggagacag

SEQ ID NO: 1268591 - RNA, 23 nt, Homo sapiens
augggacagggaggacgcucucu

SEQ ID NO: 1268592 - RNA, 22 nt, Homo sapiens
augggaccugcucuuaaccuca

SEQ ID NO: 1268593 - RNA, 15 nt, Homo sapiens
augggacuuaacucc

SEQ ID NO: 1268594 - RNA, 19 nt, Homo sapiens
augggagaauugcacacag

SEQ ID NO: 1268595 - RNA, 14 nt, Homo sapiens
augggcacuugaga

SEQ ID NO: 1268596 - RNA, 19 nt, Homo sapiens
augggcgcaggcccaguga

SEQ ID NO: 1268597 - RNA, 14 nt, Homo sapiens
augggcucuuccaa

SEQ ID NO: 1268598 - RNA, 20 nt, Homo sapiens
augggcucuuccaacaagga

SEQ ID NO: 1268599 - RNA, 16 nt, Homo sapiens
auggggacacagauca

SEQ ID NO: 1268600 - RNA, 15 nt, Homo sapiens
auggggggugggggg

SEQ ID NO: 1268601 - RNA, 16 nt, Homo sapiens
augguaaaaguuacuu

SEQ ID NO: 1268602 - RNA, 17 nt, Homo sapiens
augguaaguugagaugu

SEQ ID NO: 1268603 - RNA, 18 nt, Homo sapiens
augguacuauguuagccc

SEQ ID NO: 1268604 - RNA, 14 nt, Homo sapiens
augguagcauuuua

SEQ ID NO: 1268605 - RNA, 14 nt, Homo sapiens
augguagccuuagg

SEQ ID NO: 1268606 - RNA, 14 nt, Homo sapiens
auucaaaauucaga

SEQ ID NO: 1268607 - RNA, 17 nt, Homo sapiens
auucaaagagacauaua

SEQ ID NO: 1268608 - RNA, 16 nt, Homo sapiens
auucaaaucacaugga

SEQ ID NO: 1268609 - RNA, 20 nt, Homo sapiens
auucaacagagacugaauag

SEQ ID NO: 1268610 - RNA, 18 nt, Homo sapiens
auucaaugugaacacugg

SEQ ID NO: 1268611 - RNA, 21 nt, Homo sapiens
auucaauuacggacucuggau

SEQ ID NO: 1268612 - RNA, 17 nt, Homo sapiens
auucacaaaauuuccac

SEQ ID NO: 1268613 - RNA, 19 nt, Homo sapiens
auucacaaagguuaaguua

SEQ ID NO: 1268614 - RNA, 21 nt, Homo sapiens
auucacaauagaaacucacca

SEQ ID NO: 1268615 - RNA, 20 nt, Homo sapiens
auucacagaaccuacuguuc

SEQ ID NO: 1268616 - RNA, 20 nt, Homo sapiens
auucacgugcagcagcaaca

SEQ ID NO: 1268617 - RNA, 16 nt, Homo sapiens
auucacuucauaaucc

SEQ ID NO: 1268618 - RNA, 23 nt, Homo sapiens
auucagaauuucuaaaaguuuaa

SEQ ID NO: 1268619 - RNA, 17 nt, Homo sapiens
auucagaguccuugcaa

SEQ ID NO: 1268620 - RNA, 18 nt, Homo sapiens
auucagcaaaaaucuccc

SEQ ID NO: 1268621 - RNA, 22 nt, Homo sapiens
auucagcaaaaaucucccagug

SEQ ID NO: 1268622 - RNA, 12 nt, Homo sapiens
auucagcacuua

SEQ ID NO: 1268623 - RNA, 22 nt, Homo sapiens
auucagccaugaaacugacuca

SEQ ID NO: 1268624 - RNA, 10 nt, Homo sapiens
auucagcgaa

SEQ ID NO: 1268625 - RNA, 21 nt, Homo sapiens
auucaggacuuaacggcucca

SEQ ID NO: 1268626 - RNA, 22 nt, Homo sapiens
auucaggggcugggggugcugg

SEQ ID NO: 1268627 - RNA, 16 nt, Homo sapiens
auucagguauguugcc

SEQ ID NO: 1268628 - RNA, 23 nt, Homo sapiens
auucagguauguugccuuuaugg

SEQ ID NO: 1268629 - RNA, 22 nt, Homo sapiens
auucagucucuucuaagcaaaa

SEQ ID NO: 1268630 - RNA, 20 nt, Homo sapiens
auucagugacuuaauaucua

SEQ ID NO: 1268631 - RNA, 16 nt, Homo sapiens
auucaguuuucaggau

SEQ ID NO: 1268632 - RNA, 17 nt, Homo sapiens
auucaguuuucauuugg

SEQ ID NO: 1268633 - RNA, 15 nt, Homo sapiens
auucauauaggccag

SEQ ID NO: 1268634 - RNA, 21 nt, Homo sapiens
auucauauuaagacaguguac

SEQ ID NO: 1268635 - RNA, 17 nt, Homo sapiens
auucauauuuacuucuu

SEQ ID NO: 1268636 - RNA, 18 nt, Homo sapiens
auucaucugggaggcaga

SEQ ID NO: 1268637 - RNA, 23 nt, Homo sapiens
auucaugaaaacuguuuuuacua

SEQ ID NO: 1268638 - RNA, 22 nt, Homo sapiens
auucauggggagccucacagca

SEQ ID NO: 1268639 - RNA, 14 nt, Homo sapiens
auucauugugauuu

SEQ ID NO: 1268640 - RNA, 13 nt, Homo sapiens
auucauuuaguga

SEQ ID NO: 1268641 - RNA, 23 nt, Homo sapiens
auucauuucauugugaucagcua

SEQ ID NO: 1268642 - RNA, 20 nt, Homo sapiens
auucauuuuuuucacuggag

SEQ ID NO: 1268643 - RNA, 14 nt, Homo sapiens
auuccaacuucaau

SEQ ID NO: 1268644 - RNA, 23 nt, Homo sapiens
auuccaccccagcaggacaguga

SEQ ID NO: 1268645 - RNA, 17 nt, Homo sapiens
auuccaccugcaaucaa

SEQ ID NO: 1268646 - RNA, 12 nt, Homo sapiens
auuccacuccac

SEQ ID NO: 1268647 - RNA, 14 nt, Homo sapiens
auuccacuccacuc

SEQ ID NO: 1268648 - RNA, 15 nt, Homo sapiens
auuccacuccacuca

SEQ ID NO: 1268649 - RNA, 17 nt, Homo sapiens
auuccacuccacucagg

SEQ ID NO: 1268650 - RNA, 23 nt, Homo sapiens
auuccacuuaggaagaaaugccc

SEQ ID NO: 1268651 - RNA, 20 nt, Homo sapiens
auuccaggggucguuugcuu

SEQ ID NO: 1268652 - RNA, 19 nt, Homo sapiens
auucccaagccaaaaaccu

SEQ ID NO: 1268653 - RNA, 15 nt, Homo sapiens
auucccacaccucca

SEQ ID NO: 1268654 - RNA, 23 nt, Homo sapiens
auucccaucuuuacucccaagac

SEQ ID NO: 1268655 - RNA, 18 nt, Homo sapiens
auucccugucacuacaca

SEQ ID NO: 1268656 - RNA, 12 nt, Homo sapiens
auucccuuguau

SEQ ID NO: 1268657 - RNA, 20 nt, Homo sapiens
auuccgucaccacgacuggc

SEQ ID NO: 1268658 - RNA, 14 nt, Homo sapiens
auuccucacagccu

SEQ ID NO: 1268659 - RNA, 12 nt, Homo sapiens
auuccucuugcc

SEQ ID NO: 1268660 - RNA, 15 nt, Homo sapiens
auuccucuugccucu

SEQ ID NO: 1268661 - RNA, 15 nt, Homo sapiens
auuccugaugaccaa

SEQ ID NO: 1268662 - RNA, 13 nt, Homo sapiens
auuccuguguaau

SEQ ID NO: 1268663 - RNA, 16 nt, Homo sapiens
auuccuguuacuuuac

SEQ ID NO: 1268664 - RNA, 18 nt, Homo sapiens
auuccuguuacuuuacag

SEQ ID NO: 1268665 - RNA, 14 nt, Homo sapiens
auuccuuacuguaa

SEQ ID NO: 1268666 - RNA, 18 nt, Homo sapiens
auuccuucacucauccag

SEQ ID NO: 1268667 - RNA, 21 nt, Homo sapiens
auucgaccuauaagaagccuu

SEQ ID NO: 1268668 - RNA, 21 nt, Homo sapiens
auucgcccuccucccugucau

SEQ ID NO: 1268669 - RNA, 13 nt, Homo sapiens
auucgcuguuacc

SEQ ID NO: 1268670 - RNA, 17 nt, Homo sapiens
auucgggccacagggcg

SEQ ID NO: 1268671 - RNA, 17 nt, Homo sapiens
auucgugacaacaugcg

SEQ ID NO: 1268672 - RNA, 12 nt, Homo sapiens
auucuaagccag

SEQ ID NO: 1268673 - RNA, 18 nt, Homo sapiens
auucuaaguuauuuacuu

SEQ ID NO: 1268674 - RNA, 20 nt, Homo sapiens
auucuaaugucuucauuuca

SEQ ID NO: 1268675 - RNA, 20 nt, Homo sapiens
auucuaccgugguacacagu

SEQ ID NO: 1268676 - RNA, 13 nt, Homo sapiens
auucuaguacuug

SEQ ID NO: 1268677 - RNA, 20 nt, Homo sapiens
auucuagugaaugaaucuca

SEQ ID NO: 1268678 - RNA, 16 nt, Homo sapiens
auucuaguuuugucaa

SEQ ID NO: 1268679 - RNA, 15 nt, Homo sapiens
auucuaucaagccca

SEQ ID NO: 1268680 - RNA, 17 nt, Homo sapiens
auucuauuauacuacaa

SEQ ID NO: 1268681 - RNA, 16 nt, Homo sapiens
cuacccuaaagggaga

SEQ ID NO: 1268682 - RNA, 16 nt, Homo sapiens
cuacccuggcacuaua

SEQ ID NO: 1268683 - RNA, 17 nt, Homo sapiens
cuaccuagggcacuuua

SEQ ID NO: 1268684 - RNA, 17 nt, Homo sapiens
cuaccuauaacacucua

SEQ ID NO: 1268685 - RNA, 16 nt, Homo sapiens
cuaccucaagacucac

SEQ ID NO: 1268686 - RNA, 22 nt, Homo sapiens
cuaccucaagacucaccucauc

SEQ ID NO: 1268687 - RNA, 12 nt, Homo sapiens
cuaccucaaggg

SEQ ID NO: 1268688 - RNA, 10 nt, Homo sapiens
cuaccucagc

SEQ ID NO: 1268689 - RNA, 14 nt, Homo sapiens
cuaccucagccucc

SEQ ID NO: 1268690 - RNA, 18 nt, Homo sapiens
cuaccucaggcagcucaa

SEQ ID NO: 1268691 - RNA, 12 nt, Homo sapiens
cuaccucagguu

SEQ ID NO: 1268692 - RNA, 13 nt, Homo sapiens
cuaccucagguug

SEQ ID NO: 1268693 - RNA, 23 nt, Homo sapiens
cuaccucugagaagacacaaggu

SEQ ID NO: 1268694 - RNA, 22 nt, Homo sapiens
cuaccugauggaaguaaagccu

SEQ ID NO: 1268695 - RNA, 16 nt, Homo sapiens
cuaccugggauuccag

SEQ ID NO: 1268696 - RNA, 16 nt, Homo sapiens
cuaccuuaaacuuaag

SEQ ID NO: 1268697 - RNA, 15 nt, Homo sapiens
cuaccuuuugucucu

SEQ ID NO: 1268698 - RNA, 17 nt, Homo sapiens
cuacgaauauagagggu

SEQ ID NO: 1268699 - RNA, 14 nt, Homo sapiens
cuacgaaucuuccg

SEQ ID NO: 1268700 - RNA, 15 nt, Homo sapiens
cuacuaaaaaugcaa

SEQ ID NO: 1268701 - RNA, 18 nt, Homo sapiens
cuacuaauccucucugca

SEQ ID NO: 1268702 - RNA, 12 nt, Homo sapiens
cuacuaccucuu

SEQ ID NO: 1268703 - RNA, 22 nt, Homo sapiens
cuacuaugugcugggugccucc

SEQ ID NO: 1268704 - RNA, 19 nt, Homo sapiens
cuacucaauacuaccucug

SEQ ID NO: 1268705 - RNA, 16 nt, Homo sapiens
cuacucccucuuccaa

SEQ ID NO: 1268706 - RNA, 21 nt, Homo sapiens
cuacuccucugcagugccuug

SEQ ID NO: 1268707 - RNA, 14 nt, Homo sapiens
cuacucugugccag

SEQ ID NO: 1268708 - RNA, 17 nt, Homo sapiens
cuacugagcauuugcac

SEQ ID NO: 1268709 - RNA, 19 nt, Homo sapiens
cuacugagcauuugcaccu

SEQ ID NO: 1268710 - RNA, 17 nt, Homo sapiens
cuacugcagcaccucca

SEQ ID NO: 1268711 - RNA, 19 nt, Homo sapiens
cuacugcuggaaaaagccc

SEQ ID NO: 1268712 - RNA, 20 nt, Homo sapiens
cuacuguguagacucagcuu

SEQ ID NO: 1268713 - RNA, 23 nt, Homo sapiens
cuacugugucuuggaaucuagcc

SEQ ID NO: 1268714 - RNA, 23 nt, Homo sapiens
cuacuucugaaacugcagcagug

SEQ ID NO: 1268715 - RNA, 14 nt, Homo sapiens
cuacuugcaauuca

SEQ ID NO: 1268716 - RNA, 15 nt, Homo sapiens
cuacuuuguggcaau

SEQ ID NO: 1268717 - RNA, 19 nt, Homo sapiens
cuacuuuuaguugacucac

SEQ ID NO: 1268718 - RNA, 18 nt, Homo sapiens
cuacuuuuggugcuuaaa

SEQ ID NO: 1268719 - RNA, 21 nt, Homo sapiens
cuagaaaauuagacugugauu

SEQ ID NO: 1268720 - RNA, 13 nt, Homo sapiens
cuagaaacaaaca

SEQ ID NO: 1268721 - RNA, 22 nt, Homo sapiens
cuagaaagcugcacuggugcua

SEQ ID NO: 1268722 - RNA, 15 nt, Homo sapiens
cuagaaaucugccaa

SEQ ID NO: 1268723 - RNA, 15 nt, Homo sapiens
cuagaaauucuuaag

SEQ ID NO: 1268724 - RNA, 22 nt, Homo sapiens
cuagaaccugggcugugcugcu

SEQ ID NO: 1268725 - RNA, 23 nt, Homo sapiens
cuagaagaaaagcccauuuucaa

SEQ ID NO: 1268726 - RNA, 12 nt, Homo sapiens
cucacaugacac

SEQ ID NO: 1268727 - RNA, 21 nt, Homo sapiens
cucacaugcacaggggcccau

SEQ ID NO: 1268728 - RNA, 16 nt, Homo sapiens
cucacaugugacaaag

SEQ ID NO: 1268729 - RNA, 12 nt, Homo sapiens
cucaccaaaacg

SEQ ID NO: 1268730 - RNA, 20 nt, Homo sapiens
cucaccaacugcaccaguga

SEQ ID NO: 1268731 - RNA, 15 nt, Homo sapiens
cucaccagccccacu

SEQ ID NO: 1268732 - RNA, 19 nt, Homo sapiens
cucacccaccccugcacag

SEQ ID NO: 1268733 - RNA, 17 nt, Homo sapiens
cucacccagucuucuac

SEQ ID NO: 1268734 - RNA, 20 nt, Homo sapiens
cucacccagucuucuacaca

SEQ ID NO: 1268735 - RNA, 16 nt, Homo sapiens
cucacccuacucugga

SEQ ID NO: 1268736 - RNA, 19 nt, Homo sapiens
cucaccuagccugaugaga

SEQ ID NO: 1268737 - RNA, 23 nt, Homo sapiens
cucaccucuacccaaacccuagg

SEQ ID NO: 1268738 - RNA, 18 nt, Homo sapiens
cucaccuggacuccagua

SEQ ID NO: 1268739 - RNA, 23 nt, Homo sapiens
cucaccugucuaggucuccucag

SEQ ID NO: 1268740 - RNA, 22 nt, Homo sapiens
cucaccuuguaaccagugcaga

SEQ ID NO: 1268741 - RNA, 14 nt, Homo sapiens
cucacgcagacaca

SEQ ID NO: 1268742 - RNA, 19 nt, Homo sapiens
cucacgcccuaagcgcaca

SEQ ID NO: 1268743 - RNA, 13 nt, Homo sapiens
cucacgccuguaa

SEQ ID NO: 1268744 - RNA, 17 nt, Homo sapiens
cucacgccuguaauccc

SEQ ID NO: 1268745 - RNA, 20 nt, Homo sapiens
cucacgccuguaaucccagc

SEQ ID NO: 1268746 - RNA, 14 nt, Homo sapiens
cucacuaugcugcu

SEQ ID NO: 1268747 - RNA, 15 nt, Homo sapiens
cucacucaccaucug

SEQ ID NO: 1268748 - RNA, 15 nt, Homo sapiens
cucacucccagucca

SEQ ID NO: 1268749 - RNA, 13 nt, Homo sapiens
cucacuccuagga

SEQ ID NO: 1268750 - RNA, 11 nt, Homo sapiens
cucacuccugc

SEQ ID NO: 1268751 - RNA, 14 nt, Homo sapiens
cucacuccuguuac

SEQ ID NO: 1268752 - RNA, 18 nt, Homo sapiens
cucacugaggguaucuga

SEQ ID NO: 1268753 - RNA, 21 nt, Homo sapiens
cucacugaggguaucugacaa

SEQ ID NO: 1268754 - RNA, 16 nt, Homo sapiens
cucacuguucugcaaa

SEQ ID NO: 1268755 - RNA, 14 nt, Homo sapiens
cucacuuaucccaa

SEQ ID NO: 1268756 - RNA, 14 nt, Homo sapiens
cucagaaaagugac

SEQ ID NO: 1268757 - RNA, 18 nt, Homo sapiens
cucagaaaagugacagug

SEQ ID NO: 1268758 - RNA, 13 nt, Homo sapiens
cucagaacccagg

SEQ ID NO: 1268759 - RNA, 20 nt, Homo sapiens
cucagaauaaggcaggcauu

SEQ ID NO: 1268760 - RNA, 15 nt, Homo sapiens
cucagaauauaccca

SEQ ID NO: 1268761 - RNA, 20 nt, Homo sapiens
cucagaauugaucauuuucc

SEQ ID NO: 1268762 - RNA, 20 nt, Homo sapiens
cucagagaccugaagugugc

SEQ ID NO: 1268763 - RNA, 18 nt, Homo sapiens
cucagagguagggcugcc

SEQ ID NO: 1268764 - RNA, 13 nt, Homo sapiens
cucagcaacaagg

SEQ ID NO: 1268765 - RNA, 17 nt, Homo sapiens
cucagcaacaguggaau

SEQ ID NO: 1268766 - RNA, 13 nt, Homo sapiens
cucagcaacccag

SEQ ID NO: 1268767 - RNA, 15 nt, Homo sapiens
cucagcacagagaug

SEQ ID NO: 1268768 - RNA, 15 nt, Homo sapiens
cucagcagaaacaca

SEQ ID NO: 1268769 - RNA, 20 nt, Homo sapiens
cucagcaguccacaaagcau

SEQ ID NO: 1268770 - RNA, 20 nt, Homo sapiens
cucagccacacccaggcacu

SEQ ID NO: 1268771 - RNA, 21 nt, Homo sapiens
cucagccacacccaggcacuu

SEQ ID NO: 1268772 - RNA, 18 nt, Homo sapiens
cucagccccuaggaguau

SEQ ID NO: 1268773 - RNA, 18 nt, Homo sapiens
cucagccucccaaagugc

SEQ ID NO: 1268774 - RNA, 20 nt, Homo sapiens
cucagccucucaaguagcug

SEQ ID NO: 1268775 - RNA, 16 nt, Homo sapiens
cucagccugagccucu

SEQ ID NO: 1268776 - RNA, 20 nt, Homo sapiens
cucagcgccagcucuaccag

SEQ ID NO: 1268777 - RNA, 23 nt, Homo sapiens
cacuggaugucaaacaguaauaa

SEQ ID NO: 1268778 - RNA, 18 nt, Homo sapiens
cacuggcacacugcucuu

SEQ ID NO: 1268779 - RNA, 18 nt, Homo sapiens
cacuggcagcaucuucac

SEQ ID NO: 1268780 - RNA, 23 nt, Homo sapiens
cacuggccaagaaaauugccuuu

SEQ ID NO: 1268781 - RNA, 13 nt, Homo sapiens
cacuggcuuccau

SEQ ID NO: 1268782 - RNA, 17 nt, Homo sapiens
cacugggaggagucuau

SEQ ID NO: 1268783 - RNA, 22 nt, Homo sapiens
cacugggaugagccgcugugag

SEQ ID NO: 1268784 - RNA, 17 nt, Homo sapiens
cacugggccagcccugc

SEQ ID NO: 1268785 - RNA, 17 nt, Homo sapiens
cacuguagcagguucua

SEQ ID NO: 1268786 - RNA, 14 nt, Homo sapiens
cacuguaguucuaa

SEQ ID NO: 1268787 - RNA, 16 nt, Homo sapiens
cacugucacccuccac

SEQ ID NO: 1268788 - RNA, 19 nt, Homo sapiens
cacugucccccguuugccu

SEQ ID NO: 1268789 - RNA, 22 nt, Homo sapiens
ccagcauacccuuacucugcca

SEQ ID NO: 1268790 - RNA, 13 nt, Homo sapiens
ccagcaucuccca

SEQ ID NO: 1268791 - RNA, 22 nt, Homo sapiens
ccagcauggccacccucaagag

SEQ ID NO: 1268792 - RNA, 22 nt, Homo sapiens
ccagccaaccucauugcagcua

SEQ ID NO: 1268793 - RNA, 19 nt, Homo sapiens
ccagccagauggacuccag

SEQ ID NO: 1268794 - RNA, 15 nt, Homo sapiens
ccagccagugccauu

SEQ ID NO: 1268795 - RNA, 10 nt, Homo sapiens
ccagcccaga

SEQ ID NO: 1268796 - RNA, 15 nt, Homo sapiens
ccagcccagagccac

SEQ ID NO: 1268797 - RNA, 19 nt, Homo sapiens
ccagccccugccuggguug

SEQ ID NO: 1268798 - RNA, 18 nt, Homo sapiens
ccagccccuuccugggua

SEQ ID NO: 1268799 - RNA, 17 nt, Homo sapiens
ccagccguauuuuacau

SEQ ID NO: 1268800 - RNA, 14 nt, Homo sapiens
ccagccucccacaa

SEQ ID NO: 1268801 - RNA, 19 nt, Homo sapiens
ccagccuccccgugccaaa

SEQ ID NO: 1268802 - RNA, 15 nt, Homo sapiens
ccagccuccugcuaa

SEQ ID NO: 1268803 - RNA, 20 nt, Homo sapiens
ccagccugcucccuagccag

SEQ ID NO: 1268804 - RNA, 15 nt, Homo sapiens
ccagccugggcaaca

SEQ ID NO: 1268805 - RNA, 20 nt, Homo sapiens
ccagccugggcaacauagua

SEQ ID NO: 1268806 - RNA, 20 nt, Homo sapiens
ccagccugggugacagagca

SEQ ID NO: 1268807 - RNA, 16 nt, Homo sapiens
ccagcgggcacagggc

SEQ ID NO: 1268808 - RNA, 17 nt, Homo sapiens
ccagcguccucguucaa

SEQ ID NO: 1268809 - RNA, 19 nt, Homo sapiens
ccagcuaacaggucuagaa

SEQ ID NO: 1268810 - RNA, 21 nt, Homo sapiens
ccagcuacucgggaggcugag

SEQ ID NO: 1268811 - RNA, 20 nt, Homo sapiens
ccagcuagggggcguuauuu

SEQ ID NO: 1268812 - RNA, 15 nt, Homo sapiens
ccagcuauuuacaca

SEQ ID NO: 1268813 - RNA, 18 nt, Homo sapiens
ccagcucauacaaaauaa

SEQ ID NO: 1268814 - RNA, 15 nt, Homo sapiens
ccauauuuuuugcac

SEQ ID NO: 1268815 - RNA, 21 nt, Homo sapiens
ccaucaaacauaauucucuca

SEQ ID NO: 1268816 - RNA, 14 nt, Homo sapiens
ccaucaacuguauu

SEQ ID NO: 1268817 - RNA, 21 nt, Homo sapiens
ccaucaauaaauguugcaaug

SEQ ID NO: 1268818 - RNA, 12 nt, Homo sapiens
ccaucacacugu

SEQ ID NO: 1268819 - RNA, 20 nt, Homo sapiens
ccaucagcaaauauuauucu

SEQ ID NO: 1268820 - RNA, 13 nt, Homo sapiens
ccaucaggguucu

SEQ ID NO: 1268821 - RNA, 19 nt, Homo sapiens
ccaucauccuuuguucuga

SEQ ID NO: 1268822 - RNA, 16 nt, Homo sapiens
ccauccccacccaguc

SEQ ID NO: 1268823 - RNA, 17 nt, Homo sapiens
ccaucccucggacccac

SEQ ID NO: 1268824 - RNA, 10 nt, Homo sapiens
ccauccucac

SEQ ID NO: 1268825 - RNA, 16 nt, Homo sapiens
ccauccucacauguga

SEQ ID NO: 1268826 - RNA, 18 nt, Homo sapiens
ccauccuucccuuuggag

SEQ ID NO: 1268827 - RNA, 19 nt, Homo sapiens
ccaucggugaaacuaacag

SEQ ID NO: 1268828 - RNA, 15 nt, Homo sapiens
ccaucugauguuuca

SEQ ID NO: 1268829 - RNA, 16 nt, Homo sapiens
ccaucugcagcaagac

SEQ ID NO: 1268830 - RNA, 17 nt, Homo sapiens
ccaucugcucaccagau

SEQ ID NO: 1268831 - RNA, 22 nt, Homo sapiens
ccaucuucuaaacccaauccaa

SEQ ID NO: 1268832 - RNA, 12 nt, Homo sapiens
ccaucuuuacaa

SEQ ID NO: 1268833 - RNA, 10 nt, Homo sapiens
ccaugaauua

SEQ ID NO: 1268834 - RNA, 21 nt, Homo sapiens
ccaugacccaccccugugcuc

SEQ ID NO: 1268835 - RNA, 18 nt, Homo sapiens
ccaugaccugcgcucuca

SEQ ID NO: 1268836 - RNA, 22 nt, Homo sapiens
ccaugagagaaggaggggagca

SEQ ID NO: 1268837 - RNA, 21 nt, Homo sapiens
ccaugagcaccccaaggcugc

SEQ ID NO: 1268838 - RNA, 19 nt, Homo sapiens
ccaugaguuaucaugaauu

SEQ ID NO: 1268839 - RNA, 20 nt, Homo sapiens
ccaugauggccuuacacuga

SEQ ID NO: 1268840 - RNA, 22 nt, Homo sapiens
ccaugauggccuuacacugaaa

SEQ ID NO: 1268841 - RNA, 19 nt, Homo sapiens
cccagagguaacagaacag

SEQ ID NO: 1268842 - RNA, 15 nt, Homo sapiens
cccagauacauggug

SEQ ID NO: 1268843 - RNA, 17 nt, Homo sapiens
cccagaucaaauucuau

SEQ ID NO: 1268844 - RNA, 20 nt, Homo sapiens
cccagaucaaauucuauuaa

SEQ ID NO: 1268845 - RNA, 15 nt, Homo sapiens
cccagaucugguccc

SEQ ID NO: 1268846 - RNA, 13 nt, Homo sapiens
cccagauuucagg

SEQ ID NO: 1268847 - RNA, 22 nt, Homo sapiens
cccagcagugccuugugcaaug

SEQ ID NO: 1268848 - RNA, 13 nt, Homo sapiens
cccagcaguucug

SEQ ID NO: 1268849 - RNA, 20 nt, Homo sapiens
cccagccaaacccugucuga

SEQ ID NO: 1268850 - RNA, 14 nt, Homo sapiens
cccagccaccgaag

SEQ ID NO: 1268851 - RNA, 20 nt, Homo sapiens
cccagcccagauggcacuca

SEQ ID NO: 1268852 - RNA, 20 nt, Homo sapiens
cccagcccugggaaccacuc

SEQ ID NO: 1268853 - RNA, 17 nt, Homo sapiens
cccagccgucgucuccc

SEQ ID NO: 1268854 - RNA, 19 nt, Homo sapiens
cccagccuccccgugccaa

SEQ ID NO: 1268855 - RNA, 22 nt, Homo sapiens
cccagccugcucccuagccaga

SEQ ID NO: 1268856 - RNA, 21 nt, Homo sapiens
cccagccuggaaaccuacaga

SEQ ID NO: 1268857 - RNA, 17 nt, Homo sapiens
cccagccuucuccagga

SEQ ID NO: 1268858 - RNA, 13 nt, Homo sapiens
cccagcuacuuga

SEQ ID NO: 1268859 - RNA, 20 nt, Homo sapiens
cccagcucaggggcagcuca

SEQ ID NO: 1268860 - RNA, 17 nt, Homo sapiens
cccagcuguagccaugg

SEQ ID NO: 1268861 - RNA, 21 nt, Homo sapiens
cccaggaaagguuuuccuuau

SEQ ID NO: 1268862 - RNA, 15 nt, Homo sapiens
cccaggaaguggcca

SEQ ID NO: 1268863 - RNA, 16 nt, Homo sapiens
cccaggacgcuucuga

SEQ ID NO: 1268864 - RNA, 16 nt, Homo sapiens
cccaggacggggcaca

SEQ ID NO: 1268865 - RNA, 19 nt, Homo sapiens
cccaggagaacaucuuuga

SEQ ID NO: 1268866 - RNA, 21 nt, Homo sapiens
cccaggagagagaaagccagg

SEQ ID NO: 1268867 - RNA, 15 nt, Homo sapiens
cccaggagcagcauc

SEQ ID NO: 1268868 - RNA, 14 nt, Homo sapiens
cccaggaguuugag

SEQ ID NO: 1268869 - RNA, 17 nt, Homo sapiens
cccaggauacuggcaca

SEQ ID NO: 1268870 - RNA, 17 nt, Homo sapiens
augccacugcuuuccag

SEQ ID NO: 1268871 - RNA, 14 nt, Homo sapiens
augccacuucccag

SEQ ID NO: 1268872 - RNA, 16 nt, Homo sapiens
augccaggaaccuguc

SEQ ID NO: 1268873 - RNA, 17 nt, Homo sapiens
augccagugaaacuuca

SEQ ID NO: 1268874 - RNA, 19 nt, Homo sapiens
augccagugacacuuccag

SEQ ID NO: 1268875 - RNA, 14 nt, Homo sapiens
augccauaugccuu

SEQ ID NO: 1268876 - RNA, 16 nt, Homo sapiens
augccaucuguguccu

SEQ ID NO: 1268877 - RNA, 17 nt, Homo sapiens
augccaugaccuuccuc

SEQ ID NO: 1268878 - RNA, 11 nt, Homo sapiens
augcccagaag

SEQ ID NO: 1268879 - RNA, 14 nt, Homo sapiens
augcccagcagggg

SEQ ID NO: 1268880 - RNA, 21 nt, Homo sapiens
augccccccucaaaccuccuc

SEQ ID NO: 1268881 - RNA, 17 nt, Homo sapiens
augcccucaucauccca

SEQ ID NO: 1268882 - RNA, 16 nt, Homo sapiens
augccucaauucacau

SEQ ID NO: 1268883 - RNA, 20 nt, Homo sapiens
augccucacgagauuugcca

SEQ ID NO: 1268884 - RNA, 23 nt, Homo sapiens
augccucgcucccuucaagacga

SEQ ID NO: 1268885 - RNA, 17 nt, Homo sapiens
augccugguggcagcug

SEQ ID NO: 1268886 - RNA, 17 nt, Homo sapiens
augccuguaaucucagc

SEQ ID NO: 1268887 - RNA, 14 nt, Homo sapiens
augccugucuuaga

SEQ ID NO: 1268888 - RNA, 22 nt, Homo sapiens
augccuuagaaauguaaacugc

SEQ ID NO: 1268889 - RNA, 18 nt, Homo sapiens
augccuuuaaaucuguga

SEQ ID NO: 1268890 - RNA, 22 nt, Homo sapiens
augccuuucuaguccuauucua

SEQ ID NO: 1268891 - RNA, 20 nt, Homo sapiens
augccuuuucucaccuguca

SEQ ID NO: 1268892 - RNA, 14 nt, Homo sapiens
augcgcaaaacugc

SEQ ID NO: 1268893 - RNA, 20 nt, Homo sapiens
augcuaaauaguucuaucag

SEQ ID NO: 1268894 - RNA, 14 nt, Homo sapiens
augcuaacaaagac

SEQ ID NO: 1268895 - RNA, 16 nt, Homo sapiens
augcuagcagcuguga

SEQ ID NO: 1268896 - RNA, 12 nt, Homo sapiens
augcuaguucau

SEQ ID NO: 1268897 - RNA, 15 nt, Homo sapiens
augcuaucucugugu

SEQ ID NO: 1268898 - RNA, 14 nt, Homo sapiens
augcuauugaaaau

SEQ ID NO: 1268899 - RNA, 19 nt, Homo sapiens
augcuauugaaaaugugaa

SEQ ID NO: 1268900 - RNA, 22 nt, Homo sapiens
augcucuauguuuguauuugga

SEQ ID NO: 1268901 - RNA, 17 nt, Homo sapiens
augcucugcauguuaca

SEQ ID NO: 1268902 - RNA, 15 nt, Homo sapiens
augcucugugccaga

SEQ ID NO: 1268903 - RNA, 22 nt, Homo sapiens
augcugaaaaaucauccaagac

SEQ ID NO: 1268904 - RNA, 14 nt, Homo sapiens
augcugacagcucu

SEQ ID NO: 1268905 - RNA, 20 nt, Homo sapiens
augcugacagcucuucacag

SEQ ID NO: 1268906 - RNA, 19 nt, Homo sapiens
augcugagguacagaagcc

SEQ ID NO: 1268907 - RNA, 13 nt, Homo sapiens
augcugccagccu

SEQ ID NO: 1268908 - RNA, 13 nt, Homo sapiens
augcugccuggug

SEQ ID NO: 1268909 - RNA, 10 nt, Homo sapiens
augcugcuau

SEQ ID NO: 1268910 - RNA, 15 nt, Homo sapiens
augcugcuauggaag

SEQ ID NO: 1268911 - RNA, 20 nt, Homo sapiens
augcugcugggccucugccu

SEQ ID NO: 1268912 - RNA, 15 nt, Homo sapiens
augcugcuguuuaca

SEQ ID NO: 1268913 - RNA, 19 nt, Homo sapiens
augcugcuuuccccugugg

SEQ ID NO: 1268914 - RNA, 16 nt, Homo sapiens
augcuggcuguuggcu

SEQ ID NO: 1268915 - RNA, 20 nt, Homo sapiens
augcugggcucaucuucuag

SEQ ID NO: 1268916 - RNA, 18 nt, Homo sapiens
augcuguaguaacugccu

SEQ ID NO: 1268917 - RNA, 16 nt, Homo sapiens
augcugucaugguccu

SEQ ID NO: 1268918 - RNA, 14 nt, Homo sapiens
augcugugacaggu

SEQ ID NO: 1268919 - RNA, 23 nt, Homo sapiens
augcuguucucuucuucauucua

SEQ ID NO: 1268920 - RNA, 18 nt, Homo sapiens
augcuguuugacaaaguu

SEQ ID NO: 1268921 - RNA, 17 nt, Homo sapiens
augcuuaaacuaaauaa

SEQ ID NO: 1268922 - RNA, 24 nt, Homo sapiens
augcuuaugacaaugacugugcua

SEQ ID NO: 1268923 - RNA, 15 nt, Homo sapiens
augcuucagauauua

SEQ ID NO: 1268924 - RNA, 20 nt, Homo sapiens
augcuugacaaauauuuuca

SEQ ID NO: 1268925 - RNA, 15 nt, Homo sapiens
augcuugauuccagu

SEQ ID NO: 1268926 - RNA, 17 nt, Homo sapiens
augcuuggcuaacuaua

SEQ ID NO: 1268927 - RNA, 18 nt, Homo sapiens
augcuuuugcuugcaaug

SEQ ID NO: 1268928 - RNA, 23 nt, Homo sapiens
augcuuuugguccagguacugag

SEQ ID NO: 1268929 - RNA, 17 nt, Homo sapiens
auggaaaaacugaggcu

SEQ ID NO: 1268930 - RNA, 22 nt, Homo sapiens
auggaaaaucagcugcucagca

SEQ ID NO: 1268931 - RNA, 18 nt, Homo sapiens
auggaaacauuacaguuc

SEQ ID NO: 1268932 - RNA, 20 nt, Homo sapiens
auggaaagaaucuaauagag

SEQ ID NO: 1268933 - RNA, 20 nt, Homo sapiens
auggaacagcauuacccucc

SEQ ID NO: 1268934 - RNA, 18 nt, Homo sapiens
auggaaguaaagccucaa

SEQ ID NO: 1268935 - RNA, 13 nt, Homo sapiens
aaaaaaaccacag

SEQ ID NO: 1268936 - RNA, 12 nt, Homo sapiens
aaaaaacccagc

SEQ ID NO: 1268937 - RNA, 18 nt, Homo sapiens
aaaaaaccuucagugaaa

SEQ ID NO: 1268938 - RNA, 13 nt, Homo sapiens
aaaaaacugggau

SEQ ID NO: 1268939 - RNA, 13 nt, Homo sapiens
aaaaaacuuggca

SEQ ID NO: 1268940 - RNA, 20 nt, Homo sapiens
aaaaaaguaaguaccacuca

SEQ ID NO: 1268941 - RNA, 15 nt, Homo sapiens
aaaaaauacaguauu

SEQ ID NO: 1268942 - RNA, 13 nt, Homo sapiens
aaaaaauagcaca

SEQ ID NO: 1268943 - RNA, 12 nt, Homo sapiens
aaaaaaucugac

SEQ ID NO: 1268944 - RNA, 21 nt, Homo sapiens
aaaaacagguauauacuuuga

SEQ ID NO: 1268945 - RNA, 21 nt, Homo sapiens
aaaaacauagaaaaauucagc

SEQ ID NO: 1268946 - RNA, 12 nt, Homo sapiens
aaaaaccacagc

SEQ ID NO: 1268947 - RNA, 17 nt, Homo sapiens
aaaaaccacagccacua

SEQ ID NO: 1268948 - RNA, 22 nt, Homo sapiens
aaaaaccucuaugcaaucugag

SEQ ID NO: 1268949 - RNA, 15 nt, Homo sapiens
aaaaaccugauggaa

SEQ ID NO: 1268950 - RNA, 17 nt, Homo sapiens
aaaaacguaucuccuaa

SEQ ID NO: 1268951 - RNA, 18 nt, Homo sapiens
aaaaacuccccuuccuca

SEQ ID NO: 1268952 - RNA, 11 nt, Homo sapiens
aaaaacuggaa

SEQ ID NO: 1268953 - RNA, 12 nt, Homo sapiens
aaaaacuuccau

SEQ ID NO: 1268954 - RNA, 22 nt, Homo sapiens
aaaaacuuccuucaaucuucau

SEQ ID NO: 1268955 - RNA, 15 nt, Homo sapiens
aaaaagaaucugcau

SEQ ID NO: 1268956 - RNA, 21 nt, Homo sapiens
aaaaagaugaccuuugucuca

SEQ ID NO: 1268957 - RNA, 17 nt, Homo sapiens
aaaaagcccuaauagca

SEQ ID NO: 1268958 - RNA, 15 nt, Homo sapiens
aaaaaggacucugcu

SEQ ID NO: 1268959 - RNA, 14 nt, Homo sapiens
aaaaaguauugcau

SEQ ID NO: 1268960 - RNA, 13 nt, Homo sapiens
aaaaagucacaaa

SEQ ID NO: 1268961 - RNA, 16 nt, Homo sapiens
aaaaauaaaacuucac

SEQ ID NO: 1268962 - RNA, 22 nt, Homo sapiens
aaaaauaaaagucgcauuccau

SEQ ID NO: 1268963 - RNA, 23 nt, Homo sapiens
aaaaauaaaguaccacacauauu

SEQ ID NO: 1268964 - RNA, 18 nt, Homo sapiens
aaaaauacucugcuauuu

SEQ ID NO: 1268965 - RNA, 19 nt, Homo sapiens
aaaaauagacuuaaaucuc

SEQ ID NO: 1268966 - RNA, 20 nt, Homo sapiens
aaaaauauauauagugcuau

SEQ ID NO: 1268967 - RNA, 21 nt, Homo sapiens
aaaaauauccuugauguacag

SEQ ID NO: 1268968 - RNA, 18 nt, Homo sapiens
aaaaauauguauccucua

SEQ ID NO: 1268969 - RNA, 19 nt, Homo sapiens
aaaaauauuguuucugcau

SEQ ID NO: 1268970 - RNA, 15 nt, Homo sapiens
aaaagaguauguagu

SEQ ID NO: 1268971 - RNA, 16 nt, Homo sapiens
aaaagauaacaagauc

SEQ ID NO: 1268972 - RNA, 17 nt, Homo sapiens
aaaagcaaaaaugacaa

SEQ ID NO: 1268973 - RNA, 18 nt, Homo sapiens
aaaagcaagggaccuuca

SEQ ID NO: 1268974 - RNA, 13 nt, Homo sapiens
aaaagcauuuucu

SEQ ID NO: 1268975 - RNA, 14 nt, Homo sapiens
aaaagccacauaga

SEQ ID NO: 1268976 - RNA, 14 nt, Homo sapiens
aaaagccucaguga

SEQ ID NO: 1268977 - RNA, 14 nt, Homo sapiens
aaaagccuugugua

SEQ ID NO: 1268978 - RNA, 15 nt, Homo sapiens
aaaagcuagacagau

SEQ ID NO: 1268979 - RNA, 15 nt, Homo sapiens
aaaagcugcauuuaa

SEQ ID NO: 1268980 - RNA, 20 nt, Homo sapiens
aaaagcuucuuaauuaauuu

SEQ ID NO: 1268981 - RNA, 10 nt, Homo sapiens
aaaagcuuuc

SEQ ID NO: 1268982 - RNA, 19 nt, Homo sapiens
aaaaggaacaaaaauuaca

SEQ ID NO: 1268983 - RNA, 20 nt, Homo sapiens
aaaaggacucugcuucaguc

SEQ ID NO: 1268984 - RNA, 20 nt, Homo sapiens
aaaaggaguagggaguucau

SEQ ID NO: 1268985 - RNA, 16 nt, Homo sapiens
aaaaggauaugcagua

SEQ ID NO: 1268986 - RNA, 23 nt, Homo sapiens
aaaaggauucuauaucaugacca

SEQ ID NO: 1268987 - RNA, 18 nt, Homo sapiens
aaaagggaaguaagcaaa

SEQ ID NO: 1268988 - RNA, 11 nt, Homo sapiens
aaaaggguuca

SEQ ID NO: 1268989 - RNA, 18 nt, Homo sapiens
aaaaguaaauucauguaa

SEQ ID NO: 1268990 - RNA, 18 nt, Homo sapiens
aaaaguaaugaagaaaau

SEQ ID NO: 1268991 - RNA, 14 nt, Homo sapiens
aaaaguacauguau

SEQ ID NO: 1268992 - RNA, 22 nt, Homo sapiens
aaaaguggcauuuccuggucag

SEQ ID NO: 1268993 - RNA, 19 nt, Homo sapiens
aaaaguuaauaacagcucc

SEQ ID NO: 1268994 - RNA, 15 nt, Homo sapiens
aaaaguuaugguacu

SEQ ID NO: 1268995 - RNA, 22 nt, Homo sapiens
aaaaguucauaacagugccauu

SEQ ID NO: 1268996 - RNA, 19 nt, Homo sapiens
aaaaguuccaagagucuaa

SEQ ID NO: 1268997 - RNA, 21 nt, Homo sapiens
aaaaguugaaccauuauacuu

SEQ ID NO: 1268998 - RNA, 14 nt, Homo sapiens
aaaaguuguuuguu

SEQ ID NO: 1268999 - RNA, 17 nt, Homo sapiens
aaaaguuuaaagacacu

SEQ ID NO: 1269000 - RNA, 14 nt, Homo sapiens
aaaaguuucacagg

SEQ ID NO: 1269001 - RNA, 14 nt, Homo sapiens
aaaauaaaccaaau

SEQ ID NO: 1269002 - RNA, 22 nt, Homo sapiens
aaaauaaaguaccacacauauu

SEQ ID NO: 1269003 - RNA, 15 nt, Homo sapiens
aaaauaaauguacau

SEQ ID NO: 1269004 - RNA, 15 nt, Homo sapiens
aaaauaagcacugug

SEQ ID NO: 1269005 - RNA, 12 nt, Homo sapiens
aaaauaauucua

SEQ ID NO: 1269006 - RNA, 18 nt, Homo sapiens
aaaauacagcacuuugac

SEQ ID NO: 1269007 - RNA, 20 nt, Homo sapiens
aaaauaccuuuguaacggcu

SEQ ID NO: 1269008 - RNA, 19 nt, Homo sapiens
aaaauacuuuuacucugcc

SEQ ID NO: 1269009 - RNA, 22 nt, Homo sapiens
aaaauagauccaaucaguuuau

SEQ ID NO: 1269010 - RNA, 13 nt, Homo sapiens
aaaauaguaaugu

SEQ ID NO: 1269011 - RNA, 13 nt, Homo sapiens
aaaauauaaucua

SEQ ID NO: 1269012 - RNA, 20 nt, Homo sapiens
aaaauauauaauauacuaaa

SEQ ID NO: 1269013 - RNA, 19 nt, Homo sapiens
aaaauauuauguguuucca

SEQ ID NO: 1269014 - RNA, 19 nt, Homo sapiens
aaaaucagagaacuuuccc

SEQ ID NO: 1269015 - RNA, 13 nt, Homo sapiens
aaaauccaaggca

SEQ ID NO: 1269016 - RNA, 19 nt, Homo sapiens
aaaauccaugaacaauuua

SEQ ID NO: 1269017 - RNA, 16 nt, Homo sapiens
aaaauccuaacauuca

SEQ ID NO: 1269018 - RNA, 15 nt, Homo sapiens
aaaaucuccaucuca

SEQ ID NO: 1269019 - RNA, 21 nt, Homo sapiens
aaaaucucuacugcuuuggau

SEQ ID NO: 1269020 - RNA, 20 nt, Homo sapiens
aaaaucugaaaaugugaaua

SEQ ID NO: 1269021 - RNA, 14 nt, Homo sapiens
aaaaugaauaucua

SEQ ID NO: 1269022 - RNA, 16 nt, Homo sapiens
aaaaugacaccaucuu

SEQ ID NO: 1269023 - RNA, 16 nt, Homo sapiens
aaaaugauggaaugac

SEQ ID NO: 1269024 - RNA, 19 nt, Homo sapiens
aaaaugauuggccccaguc

SEQ ID NO: 1269025 - RNA, 12 nt, Homo sapiens
aaaaugcaauug

SEQ ID NO: 1269026 - RNA, 18 nt, Homo sapiens
aaaaugccucaauucaca

SEQ ID NO: 1269027 - RNA, 15 nt, Homo sapiens
aaaaugccuuugaga

SEQ ID NO: 1269028 - RNA, 11 nt, Homo sapiens
aaaaugcugcu

SEQ ID NO: 1269029 - RNA, 21 nt, Homo sapiens
aaaaugcugcuucuccuccca

SEQ ID NO: 1269030 - RNA, 16 nt, Homo sapiens
uuacuaucauucucag

SEQ ID NO: 1269031 - RNA, 15 nt, Homo sapiens
uuacuauucacugau

SEQ ID NO: 1269032 - RNA, 17 nt, Homo sapiens
uuacucagagcagauga

SEQ ID NO: 1269033 - RNA, 20 nt, Homo sapiens
uuacucauugcccccaccuc

SEQ ID NO: 1269034 - RNA, 16 nt, Homo sapiens
uuacuccccuaagucu

SEQ ID NO: 1269035 - RNA, 23 nt, Homo sapiens
uuacugaacaaucaaagcacuug

SEQ ID NO: 1269036 - RNA, 14 nt, Homo sapiens
uuacugaccagcaa

SEQ ID NO: 1269037 - RNA, 20 nt, Homo sapiens
uuacugagcuucucugugaa

SEQ ID NO: 1269038 - RNA, 12 nt, Homo sapiens
uuacugcuugac

SEQ ID NO: 1269039 - RNA, 23 nt, Homo sapiens
uuacuguacccucgcaugacugu

SEQ ID NO: 1269040 - RNA, 21 nt, Homo sapiens
uuacuguauauaaacuccuua

SEQ ID NO: 1269041 - RNA, 11 nt, Homo sapiens
uuacugugauc

SEQ ID NO: 1269042 - RNA, 20 nt, Homo sapiens
uuacuguugcuuuagucacu

SEQ ID NO: 1269043 - RNA, 24 nt, Homo sapiens
uuacuguuuauuucuguuucucau

SEQ ID NO: 1269044 - RNA, 15 nt, Homo sapiens
uuacuguuucuguca

SEQ ID NO: 1269045 - RNA, 18 nt, Homo sapiens
uuacuuagcaugcacaaa

SEQ ID NO: 1269046 - RNA, 18 nt, Homo sapiens
uuacuugaagacugugaa

SEQ ID NO: 1269047 - RNA, 13 nt, Homo sapiens
uuacuuucucugu

SEQ ID NO: 1269048 - RNA, 16 nt, Homo sapiens
uuacuuuguguucacc

SEQ ID NO: 1269049 - RNA, 17 nt, Homo sapiens
uuagaaaaaaguuuaca

SEQ ID NO: 1269050 - RNA, 18 nt, Homo sapiens
uuagaaaaauagcuguga

SEQ ID NO: 1269051 - RNA, 14 nt, Homo sapiens
uuagaaaaugcagu

SEQ ID NO: 1269052 - RNA, 21 nt, Homo sapiens
uuagaaacugauuucuucaga

SEQ ID NO: 1269053 - RNA, 13 nt, Homo sapiens
uuagaaaugcaaa

SEQ ID NO: 1269054 - RNA, 12 nt, Homo sapiens
uuagaaauggau

SEQ ID NO: 1269055 - RNA, 15 nt, Homo sapiens
uuagaaauugcauuu

SEQ ID NO: 1269056 - RNA, 22 nt, Homo sapiens
uuagaacccauaaccauacaca

SEQ ID NO: 1269057 - RNA, 21 nt, Homo sapiens
uuagaacuucuacagaagcca

SEQ ID NO: 1269058 - RNA, 21 nt, Homo sapiens
uuagaauagaaccaacccaaa

SEQ ID NO: 1269059 - RNA, 13 nt, Homo sapiens
uucagagcacuca

SEQ ID NO: 1269060 - RNA, 17 nt, Homo sapiens
uucagauacaaacugca

SEQ ID NO: 1269061 - RNA, 19 nt, Homo sapiens
uucagaugcuucugggaga

SEQ ID NO: 1269062 - RNA, 18 nt, Homo sapiens
uucagauggcaauuucac

SEQ ID NO: 1269063 - RNA, 19 nt, Homo sapiens
uucagcacaaagacacaga

SEQ ID NO: 1269064 - RNA, 19 nt, Homo sapiens
uucagcacccccacccacc

SEQ ID NO: 1269065 - RNA, 20 nt, Homo sapiens
uucagcacccugggugccau

SEQ ID NO: 1269066 - RNA, 22 nt, Homo sapiens
uucagcaguaacaggaaaccac

SEQ ID NO: 1269067 - RNA, 14 nt, Homo sapiens
uucagcaguaccua

SEQ ID NO: 1269068 - RNA, 21 nt, Homo sapiens
uucagcauccgcaggugcugg

SEQ ID NO: 1269069 - RNA, 13 nt, Homo sapiens
uucagcaugucca

SEQ ID NO: 1269070 - RNA, 22 nt, Homo sapiens
uucagcauuauugaaauuguaa

SEQ ID NO: 1269071 - RNA, 14 nt, Homo sapiens
uucagcauugccua

SEQ ID NO: 1269072 - RNA, 18 nt, Homo sapiens
uucagcauuguacuugaa

SEQ ID NO: 1269073 - RNA, 17 nt, Homo sapiens
uucagcgaagucucaug

SEQ ID NO: 1269074 - RNA, 20 nt, Homo sapiens
uucagcuccagcucaccagc

SEQ ID NO: 1269075 - RNA, 22 nt, Homo sapiens
uucagcuguacauacucaguaa

SEQ ID NO: 1269076 - RNA, 19 nt, Homo sapiens
uucagcuucuaugcauuaa

SEQ ID NO: 1269077 - RNA, 19 nt, Homo sapiens
uucaggaagauaaaaauca

SEQ ID NO: 1269078 - RNA, 16 nt, Homo sapiens
uucaggacaacacuuc

SEQ ID NO: 1269079 - RNA, 18 nt, Homo sapiens
uucaggaguuggagacca

SEQ ID NO: 1269080 - RNA, 14 nt, Homo sapiens
uucaggauacaugu

SEQ ID NO: 1269081 - RNA, 21 nt, Homo sapiens
uucaggcccauuaccuagaaa

SEQ ID NO: 1269082 - RNA, 22 nt, Homo sapiens
uucaggccgagccagguucaca

SEQ ID NO: 1269083 - RNA, 23 nt, Homo sapiens
uucaggcgauucuccugccucag

SEQ ID NO: 1269084 - RNA, 13 nt, Homo sapiens
uucaguaauaacu

SEQ ID NO: 1269085 - RNA, 15 nt, Homo sapiens
uucaguauacugugu

SEQ ID NO: 1269086 - RNA, 20 nt, Homo sapiens
uucagucacacacacauaca

SEQ ID NO: 1269087 - RNA, 15 nt, Homo sapiens
uucagucauaaagag

SEQ ID NO: 1269088 - RNA, 22 nt, Homo sapiens
uucagugcaccuacugcuuacu

SEQ ID NO: 1269089 - RNA, 13 nt, Homo sapiens
uucagugcaucau

SEQ ID NO: 1269090 - RNA, 14 nt, Homo sapiens
uucaguggcagcug

SEQ ID NO: 1269091 - RNA, 22 nt, Homo sapiens
uucaguguacauggaauaacau

SEQ ID NO: 1269092 - RNA, 16 nt, Homo sapiens
uucauaagguaauuca

SEQ ID NO: 1269093 - RNA, 21 nt, Homo sapiens
uucauaagguaauucauggca

SEQ ID NO: 1269094 - RNA, 18 nt, Homo sapiens
uucauaccuaaguacugu

SEQ ID NO: 1269095 - RNA, 12 nt, Homo sapiens
uucauacuguaa

SEQ ID NO: 1269096 - RNA, 17 nt, Homo sapiens
uucauauaccagcaaua

SEQ ID NO: 1269097 - RNA, 16 nt, Homo sapiens
uucauauuguugcauu

SEQ ID NO: 1269098 - RNA, 20 nt, Homo sapiens
uucauccuaaaaaguuccau

SEQ ID NO: 1269099 - RNA, 17 nt, Homo sapiens
uucaugaaacuguccac

SEQ ID NO: 1269100 - RNA, 17 nt, Homo sapiens
uucaugagcuugaacaa

SEQ ID NO: 1269101 - RNA, 19 nt, Homo sapiens
uucaugggacuaaaugaac

SEQ ID NO: 1269102 - RNA, 21 nt, Homo sapiens
uucauggguuuaccacuaacu

SEQ ID NO: 1269103 - RNA, 19 nt, Homo sapiens
uucauguauuuuacacaaa

SEQ ID NO: 1269104 - RNA, 14 nt, Homo sapiens
uucauguggcugua

SEQ ID NO: 1269105 - RNA, 19 nt, Homo sapiens
uucauguuaguuaccuuau

SEQ ID NO: 1269106 - RNA, 15 nt, Homo sapiens
uucauuacagcuuaa

SEQ ID NO: 1269107 - RNA, 14 nt, Homo sapiens
uucauuauguauga

SEQ ID NO: 1269108 - RNA, 17 nt, Homo sapiens
uucauucccccuuccua

SEQ ID NO: 1269109 - RNA, 23 nt, Homo sapiens
uucauuccuaaagaaaaauaucu

SEQ ID NO: 1269110 - RNA, 19 nt, Homo sapiens
uucauugauggaugucuuc

SEQ ID NO: 1269111 - RNA, 19 nt, Homo sapiens
uucauuguuuccuucugac

SEQ ID NO: 1269112 - RNA, 18 nt, Homo sapiens
uucauuuagucaugugac

SEQ ID NO: 1269113 - RNA, 14 nt, Homo sapiens
uucauuuaucuaua

SEQ ID NO: 1269114 - RNA, 13 nt, Homo sapiens
uucauuucacaca

SEQ ID NO: 1269115 - RNA, 19 nt, Homo sapiens
uucauuucagauaaacaac

SEQ ID NO: 1269116 - RNA, 17 nt, Homo sapiens
uucauuugugugcucau

SEQ ID NO: 1269117 - RNA, 21 nt, Homo sapiens
uuccaaaccugacagauguca

SEQ ID NO: 1269118 - RNA, 20 nt, Homo sapiens
uuccaaagcagccugugaag

SEQ ID NO: 1269119 - RNA, 16 nt, Homo sapiens
uuccaaagccagugaa

SEQ ID NO: 1269120 - RNA, 16 nt, Homo sapiens
uuccaaauguguauaa

SEQ ID NO: 1269121 - RNA, 14 nt, Homo sapiens
uuccaacaccacag

SEQ ID NO: 1269122 - RNA, 21 nt, Homo sapiens
uuccaacaccacagacacaca

SEQ ID NO: 1269123 - RNA, 20 nt, Homo sapiens
uuccaacauuucucacugaa

SEQ ID NO: 1269124 - RNA, 15 nt, Homo sapiens
uuccaagcuccuuau

SEQ ID NO: 1269125 - RNA, 19 nt, Homo sapiens
uuccaaggguacuaaggaa

SEQ ID NO: 1269126 - RNA, 18 nt, Homo sapiens
uuccaaguuuccaaacaa

SEQ ID NO: 1269127 - RNA, 23 nt, Homo sapiens
uuccaauguagcucaguaauucc

SEQ ID NO: 1269128 - RNA, 14 nt, Homo sapiens
uuccaauuuacaua

SEQ ID NO: 1269129 - RNA, 20 nt, Homo sapiens
uuccaauuuacauacucugc

SEQ ID NO: 1269130 - RNA, 17 nt, Homo sapiens
uuccacaaguuaaauaa

SEQ ID NO: 1269131 - RNA, 14 nt, Homo sapiens
uuccacacugcacu

SEQ ID NO: 1269132 - RNA, 16 nt, Homo sapiens
uuccacacugcacugu

SEQ ID NO: 1269133 - RNA, 17 nt, Homo sapiens
uuccaccuccaccacau

SEQ ID NO: 1269134 - RNA, 19 nt, Homo sapiens
uuccacuaguuuuuggacu

SEQ ID NO: 1269135 - RNA, 18 nt, Homo sapiens
uuccacucccuuugccag

SEQ ID NO: 1269136 - RNA, 23 nt, Homo sapiens
uuccacucccuuugccagugccu

SEQ ID NO: 1269137 - RNA, 20 nt, Homo sapiens
uuccacuggaaaaguguaau

SEQ ID NO: 1269138 - RNA, 14 nt, Homo sapiens
uuccacuuugcaua

SEQ ID NO: 1269139 - RNA, 18 nt, Homo sapiens
uuccagauccuucaaaga

SEQ ID NO: 1269140 - RNA, 15 nt, Homo sapiens
uuccagaucuuucag

SEQ ID NO: 1269141 - RNA, 14 nt, Homo sapiens
uuccaggguugcuu

SEQ ID NO: 1269142 - RNA, 14 nt, Homo sapiens
uuccaguacuuccu

SEQ ID NO: 1269143 - RNA, 18 nt, Homo sapiens
uuccaguaguuagcuuuc

SEQ ID NO: 1269144 - RNA, 22 nt, Homo sapiens
uuccaguguccuuagaacauuu

SEQ ID NO: 1269145 - RNA, 12 nt, Homo sapiens
uuccaguguuug

SEQ ID NO: 1269146 - RNA, 23 nt, Homo sapiens
uuccauaugugggugucagucag

SEQ ID NO: 1269147 - RNA, 20 nt, Homo sapiens
uuccaucccaaccagugcca

SEQ ID NO: 1269148 - RNA, 18 nt, Homo sapiens
uuccaugaauucuugauu

SEQ ID NO: 1269149 - RNA, 22 nt, Homo sapiens
uuccaugagaacagcaggguag

SEQ ID NO: 1269150 - RNA, 22 nt, Homo sapiens
uuccauguaucuuuugaacugg

SEQ ID NO: 1269151 - RNA, 15 nt, Homo sapiens
uuccauuccaagccu

SEQ ID NO: 1269152 - RNA, 23 nt, Homo sapiens
uuccauugaagccgacucuggcc

SEQ ID NO: 1269153 - RNA, 13 nt, Homo sapiens
uuccauuuaguaa

SEQ ID NO: 1269154 - RNA, 23 nt, Homo sapiens
uuccauuuugugaauugugacau

SEQ ID NO: 1269155 - RNA, 23 nt, Homo sapiens
uuccauuuuuauuucaaaauaua

SEQ ID NO: 1269156 - RNA, 14 nt, Homo sapiens
uucccaacaugccu

SEQ ID NO: 1269157 - RNA, 20 nt, Homo sapiens
uucccaagcucuagugggaa

SEQ ID NO: 1269158 - RNA, 20 nt, Homo sapiens
uucccaaucagcacugaaaa

SEQ ID NO: 1269159 - RNA, 23 nt, Homo sapiens
uucccaauuaggaaguguaacag

SEQ ID NO: 1269160 - RNA, 17 nt, Homo sapiens
uucccagagucaucuga

SEQ ID NO: 1269161 - RNA, 16 nt, Homo sapiens
uucccaguucuugacc

SEQ ID NO: 1269162 - RNA, 17 nt, Homo sapiens
uucccauaguggggccu

SEQ ID NO: 1269163 - RNA, 20 nt, Homo sapiens
uucccaucuuccaaggguac

SEQ ID NO: 1269164 - RNA, 21 nt, Homo sapiens
ugccauaaugacucagaauau

SEQ ID NO: 1269165 - RNA, 14 nt, Homo sapiens
ugccauaugccuug

SEQ ID NO: 1269166 - RNA, 13 nt, Homo sapiens
ugccaucuuuauc

SEQ ID NO: 1269167 - RNA, 20 nt, Homo sapiens
ugccaugccaggaaccuguc

SEQ ID NO: 1269168 - RNA, 15 nt, Homo sapiens
ugccaugcucagaaa

SEQ ID NO: 1269169 - RNA, 12 nt, Homo sapiens
ugccaugugaag

SEQ ID NO: 1269170 - RNA, 23 nt, Homo sapiens
ugccauuauuuaauaaaugacaa

SEQ ID NO: 1269171 - RNA, 18 nt, Homo sapiens
ugccauuauuuucuguca

SEQ ID NO: 1269172 - RNA, 11 nt, Homo sapiens
ugccauuccac

SEQ ID NO: 1269173 - RNA, 13 nt, Homo sapiens
ugccauuugauac

SEQ ID NO: 1269174 - RNA, 21 nt, Homo sapiens
ugcccaaccugcucuccucuu

SEQ ID NO: 1269175 - RNA, 21 nt, Homo sapiens
ugcccaagagaucugugccau

SEQ ID NO: 1269176 - RNA, 21 nt, Homo sapiens
ugcccacccugggagacagac

SEQ ID NO: 1269177 - RNA, 15 nt, Homo sapiens
ugcccacgcagagga

SEQ ID NO: 1269178 - RNA, 18 nt, Homo sapiens
ugcccacucgggucugca

SEQ ID NO: 1269179 - RNA, 22 nt, Homo sapiens
ugcccagacacagacuggcaau

SEQ ID NO: 1269180 - RNA, 15 nt, Homo sapiens
ugcccagaucaacag

SEQ ID NO: 1269181 - RNA, 23 nt, Homo sapiens
ugcccaggagaaaagaagacauu

SEQ ID NO: 1269182 - RNA, 20 nt, Homo sapiens
ugcccaggcuggagugcagu

SEQ ID NO: 1269183 - RNA, 17 nt, Homo sapiens
ugcccaggcuggucuca

SEQ ID NO: 1269184 - RNA, 19 nt, Homo sapiens
ugcccagugagacuguguu

SEQ ID NO: 1269185 - RNA, 18 nt, Homo sapiens
ugccccaggccugaaaga

SEQ ID NO: 1269186 - RNA, 17 nt, Homo sapiens
ugccccaugccugucca

SEQ ID NO: 1269187 - RNA, 19 nt, Homo sapiens
ugccccccagccucuggca

SEQ ID NO: 1269188 - RNA, 14 nt, Homo sapiens
ugccccccaugagg

SEQ ID NO: 1269189 - RNA, 17 nt, Homo sapiens
ugccccccaugaggaag

SEQ ID NO: 1269190 - RNA, 13 nt, Homo sapiens
ugcccccuuucag

SEQ ID NO: 1269191 - RNA, 16 nt, Homo sapiens
ugccccguuucuugcc

SEQ ID NO: 1269192 - RNA, 21 nt, Homo sapiens
ugccccucggccccagcacau

SEQ ID NO: 1269193 - RNA, 14 nt, Homo sapiens
ugccccucucacca

SEQ ID NO: 1269194 - RNA, 16 nt, Homo sapiens
ugcccgcacacccuca

SEQ ID NO: 1269195 - RNA, 20 nt, Homo sapiens
ugcccggugguuugccaugu

SEQ ID NO: 1269196 - RNA, 15 nt, Homo sapiens
ugcccguuuccauac

SEQ ID NO: 1269197 - RNA, 16 nt, Homo sapiens
ugcccucaccaccaca

SEQ ID NO: 1269198 - RNA, 13 nt, Homo sapiens
ugcccucauggcc

SEQ ID NO: 1269199 - RNA, 17 nt, Homo sapiens
ugcccucggagugccac

SEQ ID NO: 1269200 - RNA, 15 nt, Homo sapiens
ugcccugagacagac

SEQ ID NO: 1269201 - RNA, 17 nt, Homo sapiens
ugcccugcccaugggag

SEQ ID NO: 1269202 - RNA, 22 nt, Homo sapiens
ugcccugcuaaagacagugcgg

SEQ ID NO: 1269203 - RNA, 17 nt, Homo sapiens
ugcccuggauccaucag

SEQ ID NO: 1269204 - RNA, 22 nt, Homo sapiens
ugcccuggugcauggccuuagc

SEQ ID NO: 1269205 - RNA, 17 nt, Homo sapiens
ugcccugugcaugccau

SEQ ID NO: 1269206 - RNA, 18 nt, Homo sapiens
ugcccuguguacauauaa

SEQ ID NO: 1269207 - RNA, 21 nt, Homo sapiens
ugcccuguucaugugccucug

SEQ ID NO: 1269208 - RNA, 14 nt, Homo sapiens
ugcccuuugggguc

SEQ ID NO: 1269209 - RNA, 22 nt, Homo sapiens
ugccgaaccaaaagaauuugca

SEQ ID NO: 1269210 - RNA, 14 nt, Homo sapiens
ugccgaaugugcag

SEQ ID NO: 1269211 - RNA, 21 nt, Homo sapiens
ugccgccaugggaugucaaca

SEQ ID NO: 1269212 - RNA, 19 nt, Homo sapiens
ugccggcucuuuccuugcu

SEQ ID NO: 1269213 - RNA, 22 nt, Homo sapiens
ugccgguguugaccuuccuuca

SEQ ID NO: 1269214 - RNA, 16 nt, Homo sapiens
ugccgucuucacuucc

SEQ ID NO: 1269215 - RNA, 17 nt, Homo sapiens
ugccuaaaauuguauga

SEQ ID NO: 1269216 - RNA, 16 nt, Homo sapiens
ugccuaaauauaauua

SEQ ID NO: 1269217 - RNA, 22 nt, Homo sapiens
ugccuaaggugucugaguuucu

SEQ ID NO: 1269218 - RNA, 14 nt, Homo sapiens
ugccuacuccaaaa

SEQ ID NO: 1269219 - RNA, 17 nt, Homo sapiens
ugccuauagucgcagcu

SEQ ID NO: 1269220 - RNA, 23 nt, Homo sapiens
ugccucaccuaauaggcugggag

SEQ ID NO: 1269221 - RNA, 22 nt, Homo sapiens
ugccucagccucccaauuagcu

SEQ ID NO: 1269222 - RNA, 21 nt, Homo sapiens
ugccucaucacgccacuggag

SEQ ID NO: 1269223 - RNA, 14 nt, Homo sapiens
ugccucccaugccu

SEQ ID NO: 1269224 - RNA, 20 nt, Homo sapiens
ugccucccuuaaucugccag

SEQ ID NO: 1269225 - RNA, 23 nt, Homo sapiens
ugccuccucccugggcagaaagu

SEQ ID NO: 1269226 - RNA, 22 nt, Homo sapiens
ugccuccuggacuguucacggc

SEQ ID NO: 1269227 - RNA, 18 nt, Homo sapiens
ugccucgaacuggcugca

SEQ ID NO: 1269228 - RNA, 13 nt, Homo sapiens
ugccucuggaugc

SEQ ID NO: 1269229 - RNA, 13 nt, Homo sapiens
ugccugauuagau

SEQ ID NO: 1269230 - RNA, 19 nt, Homo sapiens
ugccugcaaaaaugaaauc

SEQ ID NO: 1269231 - RNA, 23 nt, Homo sapiens
ugccuggagacagauacguaguu

SEQ ID NO: 1269232 - RNA, 16 nt, Homo sapiens
ugccugguggcagcug

SEQ ID NO: 1269233 - RNA, 14 nt, Homo sapiens
ugccuguaaucuca

SEQ ID NO: 1269234 - RNA, 22 nt, Homo sapiens
ugccuguaaucucagcacuuug

SEQ ID NO: 1269235 - RNA, 23 nt, Homo sapiens
ugccuguagagacaauacaguaa

SEQ ID NO: 1269236 - RNA, 18 nt, Homo sapiens
ugccuguucuaugccuuu

SEQ ID NO: 1269237 - RNA, 18 nt, Homo sapiens
ugccuuagggacagaauu

SEQ ID NO: 1269238 - RNA, 15 nt, Homo sapiens
ugccuuagucucagu

SEQ ID NO: 1269239 - RNA, 17 nt, Homo sapiens
ugccuucaacaacguga

SEQ ID NO: 1269240 - RNA, 18 nt, Homo sapiens
ugccuucuaggucacuuc

SEQ ID NO: 1269241 - RNA, 18 nt, Homo sapiens
ugccuucucaugauccaa

SEQ ID NO: 1269242 - RNA, 13 nt, Homo sapiens
ugccuucuccuau

SEQ ID NO: 1269243 - RNA, 15 nt, Homo sapiens
ugccuucucuauggc

SEQ ID NO: 1269244 - RNA, 14 nt, Homo sapiens
ugccuucuggccuu

SEQ ID NO: 1269245 - RNA, 21 nt, Homo sapiens
ugccuugaaggggcagcugug

SEQ ID NO: 1269246 - RNA, 17 nt, Homo sapiens
ugccuuucuucugcccu

SEQ ID NO: 1269247 - RNA, 21 nt, Homo sapiens
ugccuuuuaucuauuugagau

SEQ ID NO: 1269248 - RNA, 20 nt, Homo sapiens
ugccuuuucaucuaauguga

SEQ ID NO: 1269249 - RNA, 13 nt, Homo sapiens
ugcgacugaugaa

SEQ ID NO: 1269250 - RNA, 22 nt, Homo sapiens
ugcgagagaaagggagugcaug

SEQ ID NO: 1269251 - RNA, 17 nt, Homo sapiens
ugcgaggaccacuuugg

SEQ ID NO: 1269252 - RNA, 15 nt, Homo sapiens
ugcgauagagucuca

SEQ ID NO: 1269253 - RNA, 21 nt, Homo sapiens
ugcgaucuggguucacugcaa

SEQ ID NO: 1269254 - RNA, 22 nt, Homo sapiens
ugcgcagacccugccacucuca

SEQ ID NO: 1269255 - RNA, 16 nt, Homo sapiens
ugcgccaaucccgcca

SEQ ID NO: 1269256 - RNA, 20 nt, Homo sapiens
ugcgcccuucauugccacac

SEQ ID NO: 1269257 - RNA, 15 nt, Homo sapiens
ugcgcucccaccuca

SEQ ID NO: 1269258 - RNA, 21 nt, Homo sapiens
ugcggcugccauuggagccaa

SEQ ID NO: 1269259 - RNA, 12 nt, Homo sapiens
ugcggugcauac

SEQ ID NO: 1269260 - RNA, 16 nt, Homo sapiens
ugcgguggcucaugcc

SEQ ID NO: 1269261 - RNA, 11 nt, Homo sapiens
ugcgucacugu

SEQ ID NO: 1269262 - RNA, 13 nt, Homo sapiens
ugcgucacuguga

SEQ ID NO: 1269263 - RNA, 18 nt, Homo sapiens
ugcgugcgagcacacaca

SEQ ID NO: 1269264 - RNA, 22 nt, Homo sapiens
ugcuaaagcacuuugcacuuaa

SEQ ID NO: 1269265 - RNA, 15 nt, Homo sapiens
ugcuaaagccaggau

SEQ ID NO: 1269266 - RNA, 22 nt, Homo sapiens
ugcuaaauaguucuaucaggaa

SEQ ID NO: 1269267 - RNA, 17 nt, Homo sapiens
ugcuaacaaagacaaaa

SEQ ID NO: 1269268 - RNA, 21 nt, Homo sapiens
ugcuaaccuuguagcauguga

SEQ ID NO: 1269269 - RNA, 19 nt, Homo sapiens
ugcuaaccuuuucaccucc

SEQ ID NO: 1269270 - RNA, 22 nt, Homo sapiens
ugcuaagaagcgagcacugacc

SEQ ID NO: 1269271 - RNA, 16 nt, Homo sapiens
ugcuaauaaacacugg

SEQ ID NO: 1269272 - RNA, 21 nt, Homo sapiens
ugcuaauaacagugcauauuc

SEQ ID NO: 1269273 - RNA, 20 nt, Homo sapiens
ugcuaauaugacauaugaca

SEQ ID NO: 1269274 - RNA, 14 nt, Homo sapiens
ugcuaaucuugucc

SEQ ID NO: 1269275 - RNA, 22 nt, Homo sapiens
ugcuaaugcaaauuaaaacaua

SEQ ID NO: 1269276 - RNA, 17 nt, Homo sapiens
ugcuaauucaaagcucu

SEQ ID NO: 1269277 - RNA, 20 nt, Homo sapiens
ugcuacaaauacucuuagga

SEQ ID NO: 1269278 - RNA, 21 nt, Homo sapiens
ugcuacagcaauuucuaauuu

SEQ ID NO: 1269279 - RNA, 20 nt, Homo sapiens
ugcuacaguuauuaaucugg

SEQ ID NO: 1269280 - RNA, 12 nt, Homo sapiens
ugcuacugcacu

SEQ ID NO: 1269281 - RNA, 17 nt, Homo sapiens
ugcuagaaaggaagaca

SEQ ID NO: 1269282 - RNA, 12 nt, Homo sapiens
ugcuagaacuuu

SEQ ID NO: 1269283 - RNA, 18 nt, Homo sapiens
ugcuagaggaagucccag

SEQ ID NO: 1269284 - RNA, 20 nt, Homo sapiens
ugcuagaugugcaaaugcaa

SEQ ID NO: 1269285 - RNA, 13 nt, Homo sapiens
ugcuagugcauuu

SEQ ID NO: 1269286 - RNA, 23 nt, Homo sapiens
ugcuagugggcccucucucuggg

SEQ ID NO: 1269287 - RNA, 18 nt, Homo sapiens
ugcuaguguucugucuaa

SEQ ID NO: 1269288 - RNA, 17 nt, Homo sapiens
ugcuauacacacacaca

SEQ ID NO: 1269289 - RNA, 16 nt, Homo sapiens
ugcuauccccaucucc

SEQ ID NO: 1269290 - RNA, 13 nt, Homo sapiens
ugauauacauugu

SEQ ID NO: 1269291 - RNA, 13 nt, Homo sapiens
ugauauaccaaau

SEQ ID NO: 1269292 - RNA, 12 nt, Homo sapiens
ugauaucugauc

SEQ ID NO: 1269293 - RNA, 15 nt, Homo sapiens
ugauaugauccagag

SEQ ID NO: 1269294 - RNA, 16 nt, Homo sapiens
ugauauguaaguacuu

SEQ ID NO: 1269295 - RNA, 18 nt, Homo sapiens
ugauauuccccauuuccu

SEQ ID NO: 1269296 - RNA, 15 nt, Homo sapiens
ugauauuucuugcuu

SEQ ID NO: 1269297 - RNA, 15 nt, Homo sapiens
ugaucaaaaacuauu

SEQ ID NO: 1269298 - RNA, 21 nt, Homo sapiens
ugaucaauauuuuuauaucau

SEQ ID NO: 1269299 - RNA, 14 nt, Homo sapiens
ugaucaaugaauaa

SEQ ID NO: 1269300 - RNA, 20 nt, Homo sapiens
ugaucacauucuuuccaaaa

SEQ ID NO: 1269301 - RNA, 15 nt, Homo sapiens
ugaucacuagccugu

SEQ ID NO: 1269302 - RNA, 13 nt, Homo sapiens
ugaucacucccag

SEQ ID NO: 1269303 - RNA, 14 nt, Homo sapiens
ugaucagaccuugg

SEQ ID NO: 1269304 - RNA, 21 nt, Homo sapiens
ugaucaggcuauguauggaau

SEQ ID NO: 1269305 - RNA, 15 nt, Homo sapiens
ugaucauaaugaggu

SEQ ID NO: 1269306 - RNA, 20 nt, Homo sapiens
ugaucauuauaucauuggaa

SEQ ID NO: 1269307 - RNA, 16 nt, Homo sapiens
ugauccccaaguggug

SEQ ID NO: 1269308 - RNA, 22 nt, Homo sapiens
ugauccccaaguggugaaugac

SEQ ID NO: 1269309 - RNA, 13 nt, Homo sapiens
ugauccgccuacc

SEQ ID NO: 1269310 - RNA, 22 nt, Homo sapiens
ugauccguguguaccaucuuug

SEQ ID NO: 1269311 - RNA, 16 nt, Homo sapiens
ugauccucuacugugc

SEQ ID NO: 1269312 - RNA, 15 nt, Homo sapiens
ugauccugggggacc

SEQ ID NO: 1269313 - RNA, 23 nt, Homo sapiens
ugaucggagccuccucucucaaa

SEQ ID NO: 1269314 - RNA, 19 nt, Homo sapiens
ugaucucggcucacugcaa

SEQ ID NO: 1269315 - RNA, 13 nt, Homo sapiens
ugaucuuacucac

SEQ ID NO: 1269316 - RNA, 17 nt, Homo sapiens
ugaucuugauugugggu

SEQ ID NO: 1269317 - RNA, 21 nt, Homo sapiens
ugaugaaaacuaaggauuuuu

SEQ ID NO: 1269318 - RNA, 14 nt, Homo sapiens
ugaugaaucacugu

SEQ ID NO: 1269319 - RNA, 15 nt, Homo sapiens
ugaugacccucugac

SEQ ID NO: 1269320 - RNA, 15 nt, Homo sapiens
ugaugacgacgacaa

SEQ ID NO: 1269321 - RNA, 19 nt, Homo sapiens
ugaugagaauuguauguca

SEQ ID NO: 1269322 - RNA, 18 nt, Homo sapiens
ugaugagcauuuguuuga

SEQ ID NO: 1269323 - RNA, 16 nt, Homo sapiens
ugaugcaggcacuuau

SEQ ID NO: 1269324 - RNA, 22 nt, Homo sapiens
ugaugcauauugcccuggagaa

SEQ ID NO: 1269325 - RNA, 19 nt, Homo sapiens
ugaugccaauacuagucac

SEQ ID NO: 1269326 - RNA, 14 nt, Homo sapiens
ugaugccauaugcc

SEQ ID NO: 1269327 - RNA, 15 nt, Homo sapiens
ugaugccauaugccu

SEQ ID NO: 1269328 - RNA, 16 nt, Homo sapiens
ugaugcuaaucuuguc

SEQ ID NO: 1269329 - RNA, 13 nt, Homo sapiens
ugaugcuaugguu

SEQ ID NO: 1269330 - RNA, 21 nt, Homo sapiens
ugauggcuuaaaaauacuuaa

SEQ ID NO: 1269331 - RNA, 21 nt, Homo sapiens
ugauggggaguaaacccugga

SEQ ID NO: 1269332 - RNA, 16 nt, Homo sapiens
ugaugggucccaaaag

SEQ ID NO: 1269333 - RNA, 20 nt, Homo sapiens
ugauguacagauucuuucag

SEQ ID NO: 1269334 - RNA, 13 nt, Homo sapiens
ugauguccagaag

SEQ ID NO: 1269335 - RNA, 19 nt, Homo sapiens
ugaugugaaacacuuugcc

SEQ ID NO: 1269336 - RNA, 15 nt, Homo sapiens
ugaugugaaacauua

SEQ ID NO: 1269337 - RNA, 16 nt, Homo sapiens
ugauguguccucaggg

SEQ ID NO: 1269338 - RNA, 14 nt, Homo sapiens
ugauguucuaaggc

SEQ ID NO: 1269339 - RNA, 20 nt, Homo sapiens
ugauguuuguggccucagaa

SEQ ID NO: 1269340 - RNA, 13 nt, Homo sapiens
ugauguuuuagug

SEQ ID NO: 1269341 - RNA, 21 nt, Homo sapiens
ugauguuuugguguauuguca

SEQ ID NO: 1269342 - RNA, 19 nt, Homo sapiens
ugauuacuaucauggcaua

SEQ ID NO: 1269343 - RNA, 24 nt, Homo sapiens
ugauuagaaauuaccuguggauau

SEQ ID NO: 1269344 - RNA, 22 nt, Homo sapiens
ugauuaugccacugcuuuccag

SEQ ID NO: 1269345 - RNA, 18 nt, Homo sapiens
ugauucaaauugcugcuu

SEQ ID NO: 1269346 - RNA, 16 nt, Homo sapiens
ugauugaaccagcuca

SEQ ID NO: 1269347 - RNA, 20 nt, Homo sapiens
ugauugaaguauucaaucaa

SEQ ID NO: 1269348 - RNA, 23 nt, Homo sapiens
ugauuggaccaggccauucugcc

SEQ ID NO: 1269349 - RNA, 17 nt, Homo sapiens
ugauuguggaauggaga

SEQ ID NO: 1269350 - RNA, 17 nt, Homo sapiens
ugauuguuauguaaaac

SEQ ID NO: 1269351 - RNA, 19 nt, Homo sapiens
ugauuuaccuauacauuau

SEQ ID NO: 1269352 - RNA, 15 nt, Homo sapiens
ugauuuagguagccu

SEQ ID NO: 1269353 - RNA, 16 nt, Homo sapiens
ugauuuagugaucaaa

SEQ ID NO: 1269354 - RNA, 17 nt, Homo sapiens
ugauuucauauugaucu

SEQ ID NO: 1269355 - RNA, 23 nt, Homo sapiens
ugauuugauaccauggcacugac

SEQ ID NO: 1269356 - RNA, 15 nt, Homo sapiens
ugauuuguagcacug

SEQ ID NO: 1269357 - RNA, 16 nt, Homo sapiens
ugauuuuauaugcuau

SEQ ID NO: 1269358 - RNA, 14 nt, Homo sapiens
ugauuuuguaaaag

SEQ ID NO: 1269359 - RNA, 19 nt, Homo sapiens
ugcaaaaaugaaauccagu

SEQ ID NO: 1269360 - RNA, 14 nt, Homo sapiens
ugcaaaacauaucu

SEQ ID NO: 1269361 - RNA, 22 nt, Homo sapiens
ugcaaaauuguuuucacuugua

SEQ ID NO: 1269362 - RNA, 16 nt, Homo sapiens
ugcagugagcccagau

SEQ ID NO: 1269363 - RNA, 15 nt, Homo sapiens
ugcagugagcugugu

SEQ ID NO: 1269364 - RNA, 13 nt, Homo sapiens
ugcagugcuucca

SEQ ID NO: 1269365 - RNA, 21 nt, Homo sapiens
ugcaguggcgugaucuuggcu

SEQ ID NO: 1269366 - RNA, 15 nt, Homo sapiens
ugcaguuucuucauc

SEQ ID NO: 1269367 - RNA, 23 nt, Homo sapiens
ugcaguuuuagacucagcauugu

SEQ ID NO: 1269368 - RNA, 21 nt, Homo sapiens
ugcauaaaagacaagcacuuu

SEQ ID NO: 1269369 - RNA, 19 nt, Homo sapiens
ugcauaaauaugcagugau

SEQ ID NO: 1269370 - RNA, 20 nt, Homo sapiens
ugcauagagcccuggccagc

SEQ ID NO: 1269371 - RNA, 17 nt, Homo sapiens
ugcauagcaagugaaag

SEQ ID NO: 1269372 - RNA, 22 nt, Homo sapiens
ugcauagcgaagaccaguaugg

SEQ ID NO: 1269373 - RNA, 13 nt, Homo sapiens
ugcauaugaaauc

SEQ ID NO: 1269374 - RNA, 18 nt, Homo sapiens
ugcauauguaaagcacau

SEQ ID NO: 1269375 - RNA, 17 nt, Homo sapiens
ugcaucaauauguauua

SEQ ID NO: 1269376 - RNA, 21 nt, Homo sapiens
ugcaucaauauguauuacaaa

SEQ ID NO: 1269377 - RNA, 15 nt, Homo sapiens
ugcaucaguacuuca

SEQ ID NO: 1269378 - RNA, 16 nt, Homo sapiens
ugcaucccugcagcuc

SEQ ID NO: 1269379 - RNA, 17 nt, Homo sapiens
ugcaucccugcagcuca

SEQ ID NO: 1269380 - RNA, 14 nt, Homo sapiens
ugcaugaccuacca

SEQ ID NO: 1269381 - RNA, 19 nt, Homo sapiens
ugcaugacuuguagcauau

SEQ ID NO: 1269382 - RNA, 19 nt, Homo sapiens
ugcaugaugucuaccucag

SEQ ID NO: 1269383 - RNA, 20 nt, Homo sapiens
ugcaugaugucuaccucaga

SEQ ID NO: 1269384 - RNA, 21 nt, Homo sapiens
ugcauggauucagcaugucca

SEQ ID NO: 1269385 - RNA, 14 nt, Homo sapiens
ugcauguaucuucu

SEQ ID NO: 1269386 - RNA, 15 nt, Homo sapiens
ugcauguguguauaa

SEQ ID NO: 1269387 - RNA, 16 nt, Homo sapiens
ugcauugaaagaauua

SEQ ID NO: 1269388 - RNA, 19 nt, Homo sapiens
ugcauugaaagaauuagau

SEQ ID NO: 1269389 - RNA, 20 nt, Homo sapiens
ugcauuuaaaacagacacug

SEQ ID NO: 1269390 - RNA, 20 nt, Homo sapiens
ugcauuuauggucaacacuu

SEQ ID NO: 1269391 - RNA, 22 nt, Homo sapiens
ugcauuuauggucaacacuuaa

SEQ ID NO: 1269392 - RNA, 17 nt, Homo sapiens
ugcauuuuuaaauacaa

SEQ ID NO: 1269393 - RNA, 15 nt, Homo sapiens
ugccaaaaaucuuuu

SEQ ID NO: 1269394 - RNA, 20 nt, Homo sapiens
ugccaaaauccaaggcaauu

SEQ ID NO: 1269395 - RNA, 22 nt, Homo sapiens
ugccaaaccuguguaggcauuu

SEQ ID NO: 1269396 - RNA, 16 nt, Homo sapiens
ugccaaauauguccug

SEQ ID NO: 1269397 - RNA, 20 nt, Homo sapiens
ugccaaaucuggcuccuuua

SEQ ID NO: 1269398 - RNA, 14 nt, Homo sapiens
ugccaacuccucac

SEQ ID NO: 1269399 - RNA, 18 nt, Homo sapiens
ugccaagaauaaagaagu

SEQ ID NO: 1269400 - RNA, 13 nt, Homo sapiens
ugccaagacuccu

SEQ ID NO: 1269401 - RNA, 12 nt, Homo sapiens
ugccaagccaga

SEQ ID NO: 1269402 - RNA, 20 nt, Homo sapiens
ugccaagccauacuuauuaa

SEQ ID NO: 1269403 - RNA, 15 nt, Homo sapiens
ugccaauuagcaauu

SEQ ID NO: 1269404 - RNA, 23 nt, Homo sapiens
ugccaauuauuguuacacauuaa

SEQ ID NO: 1269405 - RNA, 21 nt, Homo sapiens
ugccacaccagucacaugacc

SEQ ID NO: 1269406 - RNA, 23 nt, Homo sapiens
ugccacaccagucacaugaccug

SEQ ID NO: 1269407 - RNA, 13 nt, Homo sapiens
ugccacacucuga

SEQ ID NO: 1269408 - RNA, 17 nt, Homo sapiens
ugccaccagcauccaca

SEQ ID NO: 1269409 - RNA, 20 nt, Homo sapiens
ugccaccauggccagccaac

SEQ ID NO: 1269410 - RNA, 23 nt, Homo sapiens
ugccacccaggcuggagugcagu

SEQ ID NO: 1269411 - RNA, 14 nt, Homo sapiens
ugccacgcuuugau

SEQ ID NO: 1269412 - RNA, 21 nt, Homo sapiens
ugccacguggucacugugcac

SEQ ID NO: 1269413 - RNA, 14 nt, Homo sapiens
ugccacugccucuu

SEQ ID NO: 1269414 - RNA, 17 nt, Homo sapiens
ugccacuuuacccaccu

SEQ ID NO: 1269415 - RNA, 21 nt, Homo sapiens
ugccagaaggauaauauugau

SEQ ID NO: 1269416 - RNA, 15 nt, Homo sapiens
ugccagagauguacu

SEQ ID NO: 1269417 - RNA, 20 nt, Homo sapiens
ugccagaguagugaagcuaa

SEQ ID NO: 1269418 - RNA, 19 nt, Homo sapiens
ugccagccccacacagcua

SEQ ID NO: 1269419 - RNA, 15 nt, Homo sapiens
ugccaggcugcuaaa

SEQ ID NO: 1269420 - RNA, 15 nt, Homo sapiens
ugccagugucauccg

SEQ ID NO: 1269421 - RNA, 21 nt, Homo sapiens
ucagucaacaacuuacacuua

SEQ ID NO: 1269422 - RNA, 20 nt, Homo sapiens
ucagucacacacacauacaa

SEQ ID NO: 1269423 - RNA, 16 nt, Homo sapiens
ucaguccaagucuucu

SEQ ID NO: 1269424 - RNA, 16 nt, Homo sapiens
ucaguccccauggcac

SEQ ID NO: 1269425 - RNA, 23 nt, Homo sapiens
ucagucccuauguauuugcaguu

SEQ ID NO: 1269426 - RNA, 17 nt, Homo sapiens
ucagucuaguugccaaa

SEQ ID NO: 1269427 - RNA, 21 nt, Homo sapiens
ucagugaauccugaaacuggu

SEQ ID NO: 1269428 - RNA, 22 nt, Homo sapiens
ucagugacagaguucacuauaa

SEQ ID NO: 1269429 - RNA, 18 nt, Homo sapiens
ucagugagauauuuggua

SEQ ID NO: 1269430 - RNA, 21 nt, Homo sapiens
ucagugagauauuugguacca

SEQ ID NO: 1269431 - RNA, 23 nt, Homo sapiens
ucagugaguaauuuuggauuuug

SEQ ID NO: 1269432 - RNA, 17 nt, Homo sapiens
ucagugauuacugucaa

SEQ ID NO: 1269433 - RNA, 20 nt, Homo sapiens
ucagugccgaccugcgccaa

SEQ ID NO: 1269434 - RNA, 20 nt, Homo sapiens
ucagugccuucaacaacgug

SEQ ID NO: 1269435 - RNA, 15 nt, Homo sapiens
ucaguggaucuucag

SEQ ID NO: 1269436 - RNA, 19 nt, Homo sapiens
ucagugguggucuucaaga

SEQ ID NO: 1269437 - RNA, 19 nt, Homo sapiens
ucaguguuuuaaauucuga

SEQ ID NO: 1269438 - RNA, 21 nt, Homo sapiens
ucaguucccccaguaccucca

SEQ ID NO: 1269439 - RNA, 20 nt, Homo sapiens
ucaguucccuuggccucaga

SEQ ID NO: 1269440 - RNA, 21 nt, Homo sapiens
ucaguugccaaggaucccuga

SEQ ID NO: 1269441 - RNA, 16 nt, Homo sapiens
ucaguuuacuaaaggu

SEQ ID NO: 1269442 - RNA, 16 nt, Homo sapiens
ucaguuuuuuguuuua

SEQ ID NO: 1269443 - RNA, 17 nt, Homo sapiens
ucauaaacuucagggau

SEQ ID NO: 1269444 - RNA, 23 nt, Homo sapiens
ucauaaagagguaaaaaacuguc

SEQ ID NO: 1269445 - RNA, 20 nt, Homo sapiens
ucauaaaugaagcagcuuua

SEQ ID NO: 1269446 - RNA, 15 nt, Homo sapiens
ucauaagaauucugu

SEQ ID NO: 1269447 - RNA, 23 nt, Homo sapiens
ucauaagccuaccaauguagaca

SEQ ID NO: 1269448 - RNA, 17 nt, Homo sapiens
ucauaagcugauuugau

SEQ ID NO: 1269449 - RNA, 21 nt, Homo sapiens
ucauaaucacucuaauuaauu

SEQ ID NO: 1269450 - RNA, 20 nt, Homo sapiens
ucauaauucagcacuuaacu

SEQ ID NO: 1269451 - RNA, 20 nt, Homo sapiens
ucauaauucuaaucuaacaa

SEQ ID NO: 1269452 - RNA, 14 nt, Homo sapiens
ucauacaugcauac

SEQ ID NO: 1269453 - RNA, 20 nt, Homo sapiens
ucauacaugcauacaaagag

SEQ ID NO: 1269454 - RNA, 16 nt, Homo sapiens
ucauaccucugaccaa

SEQ ID NO: 1269455 - RNA, 18 nt, Homo sapiens
ucauacuaaacuucaccu

SEQ ID NO: 1269456 - RNA, 13 nt, Homo sapiens
ucauagcauuaac

SEQ ID NO: 1269457 - RNA, 12 nt, Homo sapiens
ucauaggcagua

SEQ ID NO: 1269458 - RNA, 14 nt, Homo sapiens
ucauaguaacuucu

SEQ ID NO: 1269459 - RNA, 22 nt, Homo sapiens
ucauaguggcuuaaaacaacac

SEQ ID NO: 1269460 - RNA, 19 nt, Homo sapiens
ucauaugacugauuacuca

SEQ ID NO: 1269461 - RNA, 18 nt, Homo sapiens
ucauauucaagcuucaga

SEQ ID NO: 1269462 - RNA, 15 nt, Homo sapiens
ucauauugaauguuu

SEQ ID NO: 1269463 - RNA, 20 nt, Homo sapiens
ucauauuuauacuuugcaau

SEQ ID NO: 1269464 - RNA, 14 nt, Homo sapiens
ucauauuuuguaua

SEQ ID NO: 1269465 - RNA, 20 nt, Homo sapiens
ucauauuuuguauauaucug

SEQ ID NO: 1269466 - RNA, 17 nt, Homo sapiens
ucaucaaaaacuuugga

SEQ ID NO: 1269467 - RNA, 14 nt, Homo sapiens
ucaucaaacauugg

SEQ ID NO: 1269468 - RNA, 21 nt, Homo sapiens
ucaucaagaaauacuuucgaa

SEQ ID NO: 1269469 - RNA, 19 nt, Homo sapiens
ucaucacuggaugaagauu

SEQ ID NO: 1269470 - RNA, 13 nt, Homo sapiens
ucaucacuuugac

SEQ ID NO: 1269471 - RNA, 22 nt, Homo sapiens
ucaucagaagauaacuugagca

SEQ ID NO: 1269472 - RNA, 14 nt, Homo sapiens
ucaucagagcagcu

SEQ ID NO: 1269473 - RNA, 19 nt, Homo sapiens
ucaucagcauuuggaccaa

SEQ ID NO: 1269474 - RNA, 13 nt, Homo sapiens
ucaucaggaugaa

SEQ ID NO: 1269475 - RNA, 20 nt, Homo sapiens
ucaucaucccaggggagaac

SEQ ID NO: 1269476 - RNA, 13 nt, Homo sapiens
ucauccaccccau

SEQ ID NO: 1269477 - RNA, 20 nt, Homo sapiens
ucauccaggcccaacuguga

SEQ ID NO: 1269478 - RNA, 17 nt, Homo sapiens
ucauccccacaaucugg

SEQ ID NO: 1269479 - RNA, 15 nt, Homo sapiens
ucaucccuaugggau

SEQ ID NO: 1269480 - RNA, 22 nt, Homo sapiens
ucauccuggcacgcccuacucc

SEQ ID NO: 1269481 - RNA, 23 nt, Homo sapiens
ucauccuggcacgcccuacucca

SEQ ID NO: 1269482 - RNA, 23 nt, Homo sapiens
ucauccuuaaaacaauucuguga

SEQ ID NO: 1269483 - RNA, 16 nt, Homo sapiens
ucaucucacauuuucc

SEQ ID NO: 1269484 - RNA, 22 nt, Homo sapiens
ucaucuggggaugacaauggac

SEQ ID NO: 1269485 - RNA, 13 nt, Homo sapiens
ucaucuguagaua

SEQ ID NO: 1269486 - RNA, 17 nt, Homo sapiens
ucaucuguggagcugcc

SEQ ID NO: 1269487 - RNA, 20 nt, Homo sapiens
ucaucuguggagcugccaca

SEQ ID NO: 1269488 - RNA, 14 nt, Homo sapiens
ucaucuugccaaga

SEQ ID NO: 1269489 - RNA, 15 nt, Homo sapiens
ucaucuugcuaccag

SEQ ID NO: 1269490 - RNA, 16 nt, Homo sapiens
ucaucuuguucuuccc

SEQ ID NO: 1269491 - RNA, 13 nt, Homo sapiens
ucaugaagcacau

SEQ ID NO: 1269492 - RNA, 14 nt, Homo sapiens
ucaugaaugucucg

SEQ ID NO: 1269493 - RNA, 19 nt, Homo sapiens
ucaugagcguuagacugac

SEQ ID NO: 1269494 - RNA, 21 nt, Homo sapiens
ucaugaguagugggcuaugca

SEQ ID NO: 1269495 - RNA, 23 nt, Homo sapiens
ucaugcccugccuugucccucuc

SEQ ID NO: 1269496 - RNA, 16 nt, Homo sapiens
ucaugccuggagaaac

SEQ ID NO: 1269497 - RNA, 17 nt, Homo sapiens
ucaugcuuuugcuugca

SEQ ID NO: 1269498 - RNA, 20 nt, Homo sapiens
ucaugcuuuugcuugcaaug

SEQ ID NO: 1269499 - RNA, 22 nt, Homo sapiens
ucauggcacccaggcaguccac

SEQ ID NO: 1269500 - RNA, 17 nt, Homo sapiens
ucauggcagcuaagcca

SEQ ID NO: 1269501 - RNA, 20 nt, Homo sapiens
ucauggcagcuaagccacau

SEQ ID NO: 1269502 - RNA, 21 nt, Homo sapiens
ucaugggacuaaaugaacuaa

SEQ ID NO: 1269503 - RNA, 19 nt, Homo sapiens
ucaugggagggggcuugaa

SEQ ID NO: 1269504 - RNA, 22 nt, Homo sapiens
ucaugguacauuuaucacugaa

SEQ ID NO: 1269505 - RNA, 18 nt, Homo sapiens
ucaugguggguucagggg

SEQ ID NO: 1269506 - RNA, 15 nt, Homo sapiens
ucauguaacacgaca

SEQ ID NO: 1269507 - RNA, 14 nt, Homo sapiens
ucauguauauaccu

SEQ ID NO: 1269508 - RNA, 17 nt, Homo sapiens
ucaugucccagaacuua

SEQ ID NO: 1269509 - RNA, 18 nt, Homo sapiens
ucaugucuaauugcuuaa

SEQ ID NO: 1269510 - RNA, 23 nt, Homo sapiens
ucaugucuauaaucccagcacuu

SEQ ID NO: 1269511 - RNA, 18 nt, Homo sapiens
ucaugugaccacucuguc

SEQ ID NO: 1269512 - RNA, 17 nt, Homo sapiens
ucauguggcuguagauc

SEQ ID NO: 1269513 - RNA, 11 nt, Homo sapiens
ucauguuauau

SEQ ID NO: 1269514 - RNA, 15 nt, Homo sapiens
ucauguucacuguga

SEQ ID NO: 1269515 - RNA, 15 nt, Homo sapiens
ucauguuccucaaaa

SEQ ID NO: 1269516 - RNA, 10 nt, Homo sapiens
ucauguuugu

SEQ ID NO: 1269517 - RNA, 17 nt, Homo sapiens
ucauuaaauguuugaca

SEQ ID NO: 1269518 - RNA, 21 nt, Homo sapiens
ucauuacccuucccugcacua

SEQ ID NO: 1269519 - RNA, 22 nt, Homo sapiens
ucauuauucuuuuucaguuuua

SEQ ID NO: 1269520 - RNA, 13 nt, Homo sapiens
ucauuauuggaau

SEQ ID NO: 1269521 - RNA, 17 nt, Homo sapiens
ucauuauuggaauuaac

SEQ ID NO: 1269522 - RNA, 17 nt, Homo sapiens
ucauucauuucauugug

SEQ ID NO: 1269523 - RNA, 21 nt, Homo sapiens
ucauuccaaucuauugcuuca

SEQ ID NO: 1269524 - RNA, 13 nt, Homo sapiens
ucauuccaccuuc

SEQ ID NO: 1269525 - RNA, 20 nt, Homo sapiens
ucauuccuaacacagcaugu

SEQ ID NO: 1269526 - RNA, 21 nt, Homo sapiens
ucauucucagugggacucuga

SEQ ID NO: 1269527 - RNA, 16 nt, Homo sapiens
ucauucugcuacuuca

SEQ ID NO: 1269528 - RNA, 22 nt, Homo sapiens
ucauucuucuugggcuuugcua

SEQ ID NO: 1269529 - RNA, 19 nt, Homo sapiens
ucauucuuuuuauggcuga

SEQ ID NO: 1269530 - RNA, 14 nt, Homo sapiens
ucauugacuucauu

SEQ ID NO: 1269531 - RNA, 23 nt, Homo sapiens
ucauugaugagcaagacauacuu

SEQ ID NO: 1269532 - RNA, 16 nt, Homo sapiens
ucauugcuguaccaca

SEQ ID NO: 1269533 - RNA, 13 nt, Homo sapiens
uaccacacauauu

SEQ ID NO: 1269534 - RNA, 15 nt, Homo sapiens
uaccacacauauugc

SEQ ID NO: 1269535 - RNA, 17 nt, Homo sapiens
uaccacacauauugcac

SEQ ID NO: 1269536 - RNA, 20 nt, Homo sapiens
uaccaccuuuacugugcuua

SEQ ID NO: 1269537 - RNA, 16 nt, Homo sapiens
uaccacuaacuccuga

SEQ ID NO: 1269538 - RNA, 18 nt, Homo sapiens
uaccacuaacuccugaga

SEQ ID NO: 1269539 - RNA, 16 nt, Homo sapiens
uaccacucacaugaca

SEQ ID NO: 1269540 - RNA, 15 nt, Homo sapiens
uaccacuuaccucaa

SEQ ID NO: 1269541 - RNA, 21 nt, Homo sapiens
uaccagagccuucaagugcca

SEQ ID NO: 1269542 - RNA, 23 nt, Homo sapiens
uaccagagccuucaagugccaaa

SEQ ID NO: 1269543 - RNA, 14 nt, Homo sapiens
uaccagaugcugac

SEQ ID NO: 1269544 - RNA, 22 nt, Homo sapiens
uaccaguauaagcaucugccau

SEQ ID NO: 1269545 - RNA, 24 nt, Homo sapiens
uaccauaauuuauuuuguccauug

SEQ ID NO: 1269546 - RNA, 22 nt, Homo sapiens
uaccauagcuacaucaguuuga

SEQ ID NO: 1269547 - RNA, 16 nt, Homo sapiens
uaccauccccacccau

SEQ ID NO: 1269548 - RNA, 22 nt, Homo sapiens
uaccauccccgaccaucugauu

SEQ ID NO: 1269549 - RNA, 15 nt, Homo sapiens
uaccauggcacugac

SEQ ID NO: 1269550 - RNA, 17 nt, Homo sapiens
uaccauggcacugacaa

SEQ ID NO: 1269551 - RNA, 18 nt, Homo sapiens
uaccauggcacugacaau

SEQ ID NO: 1269552 - RNA, 23 nt, Homo sapiens
uaccauggcacugacaaugggca

SEQ ID NO: 1269553 - RNA, 18 nt, Homo sapiens
uaaggugugaaaucauca

SEQ ID NO: 1269554 - RNA, 21 nt, Homo sapiens
uaagguuguuccccuaguucu

SEQ ID NO: 1269555 - RNA, 14 nt, Homo sapiens
uaaguaaaccaaaa

SEQ ID NO: 1269556 - RNA, 15 nt, Homo sapiens
uaaguaaaccaaaaa

SEQ ID NO: 1269557 - RNA, 17 nt, Homo sapiens
uaaguaacuucacauua

SEQ ID NO: 1269558 - RNA, 18 nt, Homo sapiens
uaaguaaguuugauuuca

SEQ ID NO: 1269559 - RNA, 13 nt, Homo sapiens
uaaguacuaugua

SEQ ID NO: 1269560 - RNA, 20 nt, Homo sapiens
uaaguacuauguaucaauga

SEQ ID NO: 1269561 - RNA, 22 nt, Homo sapiens
uaaguacuauguaucaaugagu

SEQ ID NO: 1269562 - RNA, 23 nt, Homo sapiens
uaaguacuauguaucaaugagua

SEQ ID NO: 1269563 - RNA, 13 nt, Homo sapiens
uaaguacuguaau

SEQ ID NO: 1269564 - RNA, 22 nt, Homo sapiens
uaaguaguugguuuccuucaca

SEQ ID NO: 1269565 - RNA, 13 nt, Homo sapiens
uaaguaucagagg

SEQ ID NO: 1269566 - RNA, 14 nt, Homo sapiens
uaagucaagcacau

SEQ ID NO: 1269567 - RNA, 23 nt, Homo sapiens
uaagucacuuugaggugucucaa

SEQ ID NO: 1269568 - RNA, 15 nt, Homo sapiens
uaagucuuacauaaa

SEQ ID NO: 1269569 - RNA, 12 nt, Homo sapiens
uaagucuuucau

SEQ ID NO: 1269570 - RNA, 11 nt, Homo sapiens
uaagugauaua

SEQ ID NO: 1269571 - RNA, 14 nt, Homo sapiens
uaagugccugagac

SEQ ID NO: 1269572 - RNA, 16 nt, Homo sapiens
uaagugccugagacac

SEQ ID NO: 1269573 - RNA, 11 nt, Homo sapiens
uaagugcugcu

SEQ ID NO: 1269574 - RNA, 12 nt, Homo sapiens
uaagugcugcua

SEQ ID NO: 1269575 - RNA, 13 nt, Homo sapiens
uaagugcugcuau

SEQ ID NO: 1269576 - RNA, 14 nt, Homo sapiens
uaaguggcuuccca

SEQ ID NO: 1269577 - RNA, 18 nt, Homo sapiens
uaaguuaauguauauaaa

SEQ ID NO: 1269578 - RNA, 20 nt, Homo sapiens
uaaguuauuuacuuuuacca

SEQ ID NO: 1269579 - RNA, 16 nt, Homo sapiens
gggggccaaaccuggg

SEQ ID NO: 1269580 - RNA, 23 nt, Homo sapiens
gggggucccagugggaggggcag

SEQ ID NO: 1269581 - RNA, 17 nt, Homo sapiens
ggggguuuuuaaucuuu

SEQ ID NO: 1269582 - RNA, 23 nt, Homo sapiens
gggguaagggauuucuuagggga

SEQ ID NO: 1269583 - RNA, 20 nt, Homo sapiens
ggggucgucaccaccucucc

SEQ ID NO: 1269584 - RNA, 19 nt, Homo sapiens
ggggucuccucugcagcuc

SEQ ID NO: 1269585 - RNA, 15 nt, Homo sapiens
gggguggaggggugu

SEQ ID NO: 1269586 - RNA, 22 nt, Homo sapiens
ggguacucaauggaguaugucu

SEQ ID NO: 1269587 - RNA, 13 nt, Homo sapiens
ggguagaucucaa

SEQ ID NO: 1269588 - RNA, 16 nt, Homo sapiens
ggguaugucaguguca

SEQ ID NO: 1269589 - RNA, 19 nt, Homo sapiens
gggucauugaccucucagg

SEQ ID NO: 1269590 - RNA, 23 nt, Homo sapiens
ggguccacugaagggacccuggg

SEQ ID NO: 1269591 - RNA, 18 nt, Homo sapiens
ggguccucaguccacugc

SEQ ID NO: 1269592 - RNA, 17 nt, Homo sapiens
ggguccugccgguggga

SEQ ID NO: 1269593 - RNA, 12 nt, Homo sapiens
gggucgucugcc

SEQ ID NO: 1269594 - RNA, 19 nt, Homo sapiens
gggucucgcuuuguugccc

SEQ ID NO: 1269595 - RNA, 20 nt, Homo sapiens
gggucucgcuuuguugccca

SEQ ID NO: 1269596 - RNA, 16 nt, Homo sapiens
gggucugggccagugc

SEQ ID NO: 1269597 - RNA, 18 nt, Homo sapiens
gggucugugugaaugugg

SEQ ID NO: 1269598 - RNA, 23 nt, Homo sapiens
gggucuugcggcugaagugucac

SEQ ID NO: 1269599 - RNA, 11 nt, Homo sapiens
gggugcagcug

SEQ ID NO: 1269600 - RNA, 20 nt, Homo sapiens
gggugccgaagcuacuggac

SEQ ID NO: 1269601 - RNA, 13 nt, Homo sapiens
gggugggggugga

SEQ ID NO: 1269602 - RNA, 18 nt, Homo sapiens
ggguggugagaaccggag

SEQ ID NO: 1269603 - RNA, 17 nt, Homo sapiens
gggugguggaaggcagc

SEQ ID NO: 1269604 - RNA, 11 nt, Homo sapiens
gggugugcuau

SEQ ID NO: 1269605 - RNA, 14 nt, Homo sapiens
gggugugucugcuc

SEQ ID NO: 1269606 - RNA, 22 nt, Homo sapiens
ggguuaaagcagacagucacac

SEQ ID NO: 1269607 - RNA, 14 nt, Homo sapiens
ggguuacuuucaca

SEQ ID NO: 1269608 - RNA, 23 nt, Homo sapiens
ggguucauuauuggaauuaaccu

SEQ ID NO: 1269609 - RNA, 21 nt, Homo sapiens
ggguucuuggugaugcuggca

SEQ ID NO: 1269610 - RNA, 22 nt, Homo sapiens
ggguuucccuugcccuuuccau

SEQ ID NO: 1269611 - RNA, 22 nt, Homo sapiens
ggguuuuguggucaucuauucu

SEQ ID NO: 1269612 - RNA, 23 nt, Homo sapiens
ggguuuuuaaucuuugugacagg

SEQ ID NO: 1269613 - RNA, 13 nt, Homo sapiens
gguaaaacagggc

SEQ ID NO: 1269614 - RNA, 16 nt, Homo sapiens
gguaaaugauguggug

SEQ ID NO: 1269615 - RNA, 18 nt, Homo sapiens
gguaagaagaaagcaaaa

SEQ ID NO: 1269616 - RNA, 14 nt, Homo sapiens
gguaagaaguuuua

SEQ ID NO: 1269617 - RNA, 20 nt, Homo sapiens
gguaauauaaaguguaauag

SEQ ID NO: 1269618 - RNA, 15 nt, Homo sapiens
gguaaugugaauaaa

SEQ ID NO: 1269619 - RNA, 14 nt, Homo sapiens
gguaauuguugcua

SEQ ID NO: 1269620 - RNA, 16 nt, Homo sapiens
gguacccagccaucug

SEQ ID NO: 1269621 - RNA, 21 nt, Homo sapiens
gguaccugcccucuauuuauu

SEQ ID NO: 1269622 - RNA, 16 nt, Homo sapiens
gguacugaaagccuua

SEQ ID NO: 1269623 - RNA, 20 nt, Homo sapiens
gguagaaaaggcuagguaca

SEQ ID NO: 1269624 - RNA, 20 nt, Homo sapiens
gguaguacuccugcaaaauu

SEQ ID NO: 1269625 - RNA, 19 nt, Homo sapiens
ggcuggaguggaguggcgu

SEQ ID NO: 1269626 - RNA, 13 nt, Homo sapiens
ggcuggauccuau

SEQ ID NO: 1269627 - RNA, 16 nt, Homo sapiens
ggcuggcagcucucca

SEQ ID NO: 1269628 - RNA, 19 nt, Homo sapiens
ggcuggccugcaggcugca

SEQ ID NO: 1269629 - RNA, 18 nt, Homo sapiens
ggcuggcugaguggaaug

SEQ ID NO: 1269630 - RNA, 22 nt, Homo sapiens
ggcugggaacaacuucagucca

SEQ ID NO: 1269631 - RNA, 19 nt, Homo sapiens
ggcugggagacagagucag

SEQ ID NO: 1269632 - RNA, 17 nt, Homo sapiens
ggcuggggcuugcccuu

SEQ ID NO: 1269633 - RNA, 16 nt, Homo sapiens
ggcuggguaccaaugc

SEQ ID NO: 1269634 - RNA, 22 nt, Homo sapiens
ggcuguaaauccuagacuugaa

SEQ ID NO: 1269635 - RNA, 23 nt, Homo sapiens
ggcuguaaauccuagacuugaaa

SEQ ID NO: 1269636 - RNA, 13 nt, Homo sapiens
ggcugucagccca

SEQ ID NO: 1269637 - RNA, 23 nt, Homo sapiens
ggcugucaggacaccagccuggu

SEQ ID NO: 1269638 - RNA, 20 nt, Homo sapiens
ggcugugcucucaccagcug

SEQ ID NO: 1269639 - RNA, 16 nt, Homo sapiens
ggcuguguuuccaucu

SEQ ID NO: 1269640 - RNA, 20 nt, Homo sapiens
ggcuuaacacuaucauggac

SEQ ID NO: 1269641 - RNA, 21 nt, Homo sapiens
ggcuuagaaaguccaauucca

SEQ ID NO: 1269642 - RNA, 16 nt, Homo sapiens
ggcuuauccacuuuga

SEQ ID NO: 1269643 - RNA, 20 nt, Homo sapiens
ggcuucaggccgagccaggu

SEQ ID NO: 1269644 - RNA, 16 nt, Homo sapiens
ggcuucaguggcagcu

SEQ ID NO: 1269645 - RNA, 22 nt, Homo sapiens
ggcuucggacagugcccaugca

SEQ ID NO: 1269646 - RNA, 13 nt, Homo sapiens
ggcuucuccugac

SEQ ID NO: 1269647 - RNA, 23 nt, Homo sapiens
ggcuucucucucuagcagcaccu

SEQ ID NO: 1269648 - RNA, 13 nt, Homo sapiens
ggcuucugugaug

SEQ ID NO: 1269649 - RNA, 13 nt, Homo sapiens
ggcuugaagccaa

SEQ ID NO: 1269650 - RNA, 17 nt, Homo sapiens
ggcuugaagccaaagaa

SEQ ID NO: 1269651 - RNA, 16 nt, Homo sapiens
ggcuugauauuuucca

SEQ ID NO: 1269652 - RNA, 14 nt, Homo sapiens
ggcuugcagugcgc

SEQ ID NO: 1269653 - RNA, 20 nt, Homo sapiens
ggcuuuacaguguaaacugu

SEQ ID NO: 1269654 - RNA, 12 nt, Homo sapiens
ggcuuuugccac

SEQ ID NO: 1269655 - RNA, 13 nt, Homo sapiens
gggaaaaccagac

SEQ ID NO: 1269656 - RNA, 18 nt, Homo sapiens
gggaaagcuucauucucc

SEQ ID NO: 1269657 - RNA, 16 nt, Homo sapiens
gggaaaggcugccgag

SEQ ID NO: 1269658 - RNA, 15 nt, Homo sapiens
gggaacagaccagug

SEQ ID NO: 1269659 - RNA, 12 nt, Homo sapiens
gggaacaugccc

SEQ ID NO: 1269660 - RNA, 14 nt, Homo sapiens
gggaaccacuccca

SEQ ID NO: 1269661 - RNA, 20 nt, Homo sapiens
gggaacgaugugucuguauu

SEQ ID NO: 1269662 - RNA, 15 nt, Homo sapiens
gggaagaaggggcca

SEQ ID NO: 1269663 - RNA, 13 nt, Homo sapiens
gggaagaccagcu

SEQ ID NO: 1269664 - RNA, 18 nt, Homo sapiens
gggaagagacagcccagg

SEQ ID NO: 1269665 - RNA, 14 nt, Homo sapiens
gggaagagggcagu

SEQ ID NO: 1269666 - RNA, 17 nt, Homo sapiens
gggaagccccacuugaa

SEQ ID NO: 1269667 - RNA, 22 nt, Homo sapiens
gggaagcgaugaauuuggagac

SEQ ID NO: 1269668 - RNA, 14 nt, Homo sapiens
gggaagcucagggg

SEQ ID NO: 1269669 - RNA, 22 nt, Homo sapiens
gggaagcugcagcuugggagag

SEQ ID NO: 1269670 - RNA, 23 nt, Homo sapiens
gggaagcuggcuuucuggcugcu

SEQ ID NO: 1269671 - RNA, 18 nt, Homo sapiens
gggaaguaacauuugccu

SEQ ID NO: 1269672 - RNA, 20 nt, Homo sapiens
gggaaguccucccugguguc

SEQ ID NO: 1269673 - RNA, 22 nt, Homo sapiens
ggaugauuucaucuucuggaau

SEQ ID NO: 1269674 - RNA, 14 nt, Homo sapiens
ggaugcacauuucu

SEQ ID NO: 1269675 - RNA, 15 nt, Homo sapiens
ggaugccuguggaag

SEQ ID NO: 1269676 - RNA, 15 nt, Homo sapiens
ggauggguccucacg

SEQ ID NO: 1269677 - RNA, 17 nt, Homo sapiens
ggauggguccucacgca

SEQ ID NO: 1269678 - RNA, 15 nt, Homo sapiens
ggaugguucugugac

SEQ ID NO: 1269679 - RNA, 14 nt, Homo sapiens
ggaugguugaauga

SEQ ID NO: 1269680 - RNA, 13 nt, Homo sapiens
ggauguaucucac

SEQ ID NO: 1269681 - RNA, 17 nt, Homo sapiens
ggaugucacagggccaa

SEQ ID NO: 1269682 - RNA, 17 nt, Homo sapiens
ggaugucccugggccag

SEQ ID NO: 1269683 - RNA, 18 nt, Homo sapiens
ggaugucccugggccagg

SEQ ID NO: 1269684 - RNA, 18 nt, Homo sapiens
ggauguccuacuaucacu

SEQ ID NO: 1269685 - RNA, 19 nt, Homo sapiens
ggauguccuacuaucacug

SEQ ID NO: 1269686 - RNA, 10 nt, Homo sapiens
ggauguugcc

SEQ ID NO: 1269687 - RNA, 21 nt, Homo sapiens
ggauuaugaagugacucucac

SEQ ID NO: 1269688 - RNA, 17 nt, Homo sapiens
ggauucaucagcauuug

SEQ ID NO: 1269689 - RNA, 17 nt, Homo sapiens
ggauugaagcccuccaa

SEQ ID NO: 1269690 - RNA, 19 nt, Homo sapiens
ggauuggcuauaacauguc

SEQ ID NO: 1269691 - RNA, 14 nt, Homo sapiens
ggauuuaauuucca

SEQ ID NO: 1269692 - RNA, 20 nt, Homo sapiens
ggauuuaauuuccaggguug

SEQ ID NO: 1269693 - RNA, 14 nt, Homo sapiens
ggauuuccagggau

SEQ ID NO: 1269694 - RNA, 13 nt, Homo sapiens
ggauuuguugcca

SEQ ID NO: 1269695 - RNA, 23 nt, Homo sapiens
ggauuuuaaguuugggccaguga

SEQ ID NO: 1269696 - RNA, 15 nt, Homo sapiens
ggauuuucacauucu

SEQ ID NO: 1269697 - RNA, 14 nt, Homo sapiens
ggcaaacaggcagu

SEQ ID NO: 1269698 - RNA, 17 nt, Homo sapiens
ggcaaagaccgauugca

SEQ ID NO: 1269699 - RNA, 13 nt, Homo sapiens
ggcaaaguguuuu

SEQ ID NO: 1269700 - RNA, 18 nt, Homo sapiens
ggcaaaucagaugcagcu

SEQ ID NO: 1269701 - RNA, 22 nt, Homo sapiens
ggcaaaugacaugcacugaccc

SEQ ID NO: 1269702 - RNA, 23 nt, Homo sapiens
ggcaacaauacaugcugcuaauu

SEQ ID NO: 1269703 - RNA, 18 nt, Homo sapiens
ggcaacagaugaagaccc

SEQ ID NO: 1269704 - RNA, 18 nt, Homo sapiens
ggcaacauaguaagaccc

SEQ ID NO: 1269705 - RNA, 16 nt, Homo sapiens
ggcaacgcacaaaaca

SEQ ID NO: 1269706 - RNA, 14 nt, Homo sapiens
ggcaacuguaugaa

SEQ ID NO: 1269707 - RNA, 19 nt, Homo sapiens
ggcaagaacuuguuuacaa

SEQ ID NO: 1269708 - RNA, 22 nt, Homo sapiens
ggcaagcagcgggcuaacggga

SEQ ID NO: 1269709 - RNA, 21 nt, Homo sapiens
ggcaagcugugacuucuccag

SEQ ID NO: 1269710 - RNA, 22 nt, Homo sapiens
ggcaagucaccugcagcccaug

SEQ ID NO: 1269711 - RNA, 13 nt, Homo sapiens
ggcaagucuucca

SEQ ID NO: 1269712 - RNA, 19 nt, Homo sapiens
ggcaaucaugagcaaguga

SEQ ID NO: 1269713 - RNA, 13 nt, Homo sapiens
ggcaaucuuugcc

SEQ ID NO: 1269714 - RNA, 15 nt, Homo sapiens
ggcacaacugcaaua

SEQ ID NO: 1269715 - RNA, 11 nt, Homo sapiens
ggcacauuccc

SEQ ID NO: 1269716 - RNA, 17 nt, Homo sapiens
ggcacauuccccuugcc

SEQ ID NO: 1269717 - RNA, 22 nt, Homo sapiens
ggcacccacaaauaaaugacaa

SEQ ID NO: 1269718 - RNA, 19 nt, Homo sapiens
ggcacccggccccugcugg

SEQ ID NO: 1269719 - RNA, 14 nt, Homo sapiens
ggcaccuucaccug

SEQ ID NO: 1269720 - RNA, 20 nt, Homo sapiens
ggcaccuuccgacaucccag

SEQ ID NO: 1269721 - RNA, 15 nt, Homo sapiens
ggcacgcccuacucc

SEQ ID NO: 1269722 - RNA, 21 nt, Homo sapiens
ggcacgucgcccgcugagcug

SEQ ID NO: 1269723 - RNA, 20 nt, Homo sapiens
ggcacucagaagacacugau

SEQ ID NO: 1269724 - RNA, 18 nt, Homo sapiens
ggcacucagggagcauuu

SEQ ID NO: 1269725 - RNA, 24 nt, Homo sapiens
ggcacuccuccuacucuguggaug

SEQ ID NO: 1269726 - RNA, 20 nt, Homo sapiens
ggcacuuaagugcacuuuuu

SEQ ID NO: 1269727 - RNA, 15 nt, Homo sapiens
ggcacuucauugaga

SEQ ID NO: 1269728 - RNA, 15 nt, Homo sapiens
ggcagaaccaaagcu

SEQ ID NO: 1269729 - RNA, 17 nt, Homo sapiens
ggcagacuacacaggau

SEQ ID NO: 1269730 - RNA, 13 nt, Homo sapiens
ggcagacuuucuu

SEQ ID NO: 1269731 - RNA, 23 nt, Homo sapiens
ggcagaguacaaaguaagccaug

SEQ ID NO: 1269732 - RNA, 18 nt, Homo sapiens
ggcagauuaaaagcacaa

SEQ ID NO: 1269733 - RNA, 14 nt, Homo sapiens
ggcagauugaaaag

SEQ ID NO: 1269734 - RNA, 16 nt, Homo sapiens
ggcagcacagcccagg

SEQ ID NO: 1269735 - RNA, 14 nt, Homo sapiens
ggcagcaucuucac

SEQ ID NO: 1269736 - RNA, 10 nt, Homo sapiens
ggcagccacc

SEQ ID NO: 1269737 - RNA, 22 nt, Homo sapiens
ggcagcggguggcauccaggcu

SEQ ID NO: 1269738 - RNA, 16 nt, Homo sapiens
ggcagcuccacagggc

SEQ ID NO: 1269739 - RNA, 13 nt, Homo sapiens
ggcagcucuccag

SEQ ID NO: 1269740 - RNA, 16 nt, Homo sapiens
ggcaggagaauggugu

SEQ ID NO: 1269741 - RNA, 11 nt, Homo sapiens
ggcagggccag

SEQ ID NO: 1269742 - RNA, 23 nt, Homo sapiens
ggcagguaggucggcacuuggac

SEQ ID NO: 1269743 - RNA, 17 nt, Homo sapiens
ggcaggugccuguugaa

SEQ ID NO: 1269744 - RNA, 15 nt, Homo sapiens
ggcaguauuaagugu

SEQ ID NO: 1269745 - RNA, 19 nt, Homo sapiens
ggcaguccuggaaucacau

SEQ ID NO: 1269746 - RNA, 17 nt, Homo sapiens
ggcaguggaugggugcu

SEQ ID NO: 1269747 - RNA, 13 nt, Homo sapiens
ggcaguggcagag

SEQ ID NO: 1269748 - RNA, 15 nt, Homo sapiens
ggcaguggcagggga

SEQ ID NO: 1269749 - RNA, 16 nt, Homo sapiens
gaucaucagugauacu

SEQ ID NO: 1269750 - RNA, 22 nt, Homo sapiens
gaucaucgccagaggugcuuca

SEQ ID NO: 1269751 - RNA, 18 nt, Homo sapiens
gaucaugauguagagugu

SEQ ID NO: 1269752 - RNA, 23 nt, Homo sapiens
gaucauuugcccuuaaggacaaa

SEQ ID NO: 1269753 - RNA, 23 nt, Homo sapiens
gauccaagaaggccuucauggcc

SEQ ID NO: 1269754 - RNA, 20 nt, Homo sapiens
gauccaagcagccugagcaa

SEQ ID NO: 1269755 - RNA, 14 nt, Homo sapiens
gauccaagcugguc

SEQ ID NO: 1269756 - RNA, 16 nt, Homo sapiens
gauccacccaccucag

SEQ ID NO: 1269757 - RNA, 21 nt, Homo sapiens
gauccaccugucucagccucc

SEQ ID NO: 1269758 - RNA, 15 nt, Homo sapiens
gauccagaacugcac

SEQ ID NO: 1269759 - RNA, 15 nt, Homo sapiens
gauccagccaugccu

SEQ ID NO: 1269760 - RNA, 14 nt, Homo sapiens
gaucccaggccagg

SEQ ID NO: 1269761 - RNA, 23 nt, Homo sapiens
gauccccaaguggugaaugacac

SEQ ID NO: 1269762 - RNA, 18 nt, Homo sapiens
gaucccgaagaauggaga

SEQ ID NO: 1269763 - RNA, 15 nt, Homo sapiens
gaucccguguugcca

SEQ ID NO: 1269764 - RNA, 20 nt, Homo sapiens
gauccucacccgaaucuccu

SEQ ID NO: 1269765 - RNA, 17 nt, Homo sapiens
gauccuguugggaaaga

SEQ ID NO: 1269766 - RNA, 18 nt, Homo sapiens
gauccuuagagguccucu

SEQ ID NO: 1269767 - RNA, 20 nt, Homo sapiens
gaucgcaccacugcacucca

SEQ ID NO: 1269768 - RNA, 20 nt, Homo sapiens
gaucgcaccauugcacucca

SEQ ID NO: 1269769 - RNA, 13 nt, Homo sapiens
gaucuaccagcau

SEQ ID NO: 1269770 - RNA, 19 nt, Homo sapiens
gaucuauagcagaguccuu

SEQ ID NO: 1269771 - RNA, 20 nt, Homo sapiens
gaucucagcagugaaguaua

SEQ ID NO: 1269772 - RNA, 15 nt, Homo sapiens
gaucuccagcucuaa

SEQ ID NO: 1269773 - RNA, 14 nt, Homo sapiens
gaucuccuguccau

SEQ ID NO: 1269774 - RNA, 16 nt, Homo sapiens
gaucucgguuugccaa

SEQ ID NO: 1269775 - RNA, 18 nt, Homo sapiens
gaucucugggaguuauag

SEQ ID NO: 1269776 - RNA, 16 nt, Homo sapiens
gaucugauaagcaaga

SEQ ID NO: 1269777 - RNA, 20 nt, Homo sapiens
gaucugauaaggaucuagga

SEQ ID NO: 1269778 - RNA, 14 nt, Homo sapiens
gaucugcaguuuuu

SEQ ID NO: 1269779 - RNA, 18 nt, Homo sapiens
gaucugcaguuuuugccu

SEQ ID NO: 1269780 - RNA, 19 nt, Homo sapiens
gaucuguguuuuauugaca

SEQ ID NO: 1269781 - RNA, 22 nt, Homo sapiens
gaucuguuuuucaccacuucac

SEQ ID NO: 1269782 - RNA, 16 nt, Homo sapiens
gaucuuaaagcauucc

SEQ ID NO: 1269783 - RNA, 22 nt, Homo sapiens
gaucuucuucauccaacuucca

SEQ ID NO: 1269784 - RNA, 17 nt, Homo sapiens
gaucuuucuuuccaaaa

SEQ ID NO: 1269785 - RNA, 15 nt, Homo sapiens
gaucuuugacucuuu

SEQ ID NO: 1269786 - RNA, 23 nt, Homo sapiens
gaugaaaacauagcaucucagga

SEQ ID NO: 1269787 - RNA, 20 nt, Homo sapiens
gaugaaaaugaaucuucaca

SEQ ID NO: 1269788 - RNA, 18 nt, Homo sapiens
gaugaaaguacauuggga

SEQ ID NO: 1269789 - RNA, 17 nt, Homo sapiens
gaugaaauuaaccauuu

SEQ ID NO: 1269790 - RNA, 14 nt, Homo sapiens
gaugaacaucuaac

SEQ ID NO: 1269791 - RNA, 22 nt, Homo sapiens
gaugaagaacacagcaugugcc

SEQ ID NO: 1269792 - RNA, 21 nt, Homo sapiens
gaugaagauucuccugugcua

SEQ ID NO: 1269793 - RNA, 21 nt, Homo sapiens
gaugaaguuuuacauuguuga

SEQ ID NO: 1269794 - RNA, 14 nt, Homo sapiens
gaugaaucacuguu

SEQ ID NO: 1269795 - RNA, 15 nt, Homo sapiens
gaugacccucugacc

SEQ ID NO: 1269796 - RNA, 18 nt, Homo sapiens
gaugacgacgacaacgau

SEQ ID NO: 1269797 - RNA, 15 nt, Homo sapiens
gaugagcccacagag

SEQ ID NO: 1269798 - RNA, 14 nt, Homo sapiens
gaugaggggugcug

SEQ ID NO: 1269799 - RNA, 15 nt, Homo sapiens
gaugaggguggcaug

SEQ ID NO: 1269800 - RNA, 17 nt, Homo sapiens
gaugaguuaacugugaa

SEQ ID NO: 1269801 - RNA, 18 nt, Homo sapiens
gaugaguuaacugugaaa

SEQ ID NO: 1269802 - RNA, 16 nt, Homo sapiens
gaugauacacuaugaa

SEQ ID NO: 1269803 - RNA, 17 nt, Homo sapiens
gaugauauaauuuaacu

SEQ ID NO: 1269804 - RNA, 21 nt, Homo sapiens
gaugaucaaaaccugugccag

SEQ ID NO: 1269805 - RNA, 12 nt, Homo sapiens
gaugaucuucag

SEQ ID NO: 1269806 - RNA, 16 nt, Homo sapiens
gaugcagaaagacguu

SEQ ID NO: 1269807 - RNA, 23 nt, Homo sapiens
gaugcagguuggaaggggccuug

SEQ ID NO: 1269808 - RNA, 13 nt, Homo sapiens
gaugcauuucaaa

SEQ ID NO: 1269809 - RNA, 20 nt, Homo sapiens
gaugccaaggggcugaguga

SEQ ID NO: 1269810 - RNA, 16 nt, Homo sapiens
gaugccagggcuggaa

SEQ ID NO: 1269811 - RNA, 16 nt, Homo sapiens
gaugcuauuuaugcaa

SEQ ID NO: 1269812 - RNA, 23 nt, Homo sapiens
gaugcuccuaguuugaccucaca

SEQ ID NO: 1269813 - RNA, 20 nt, Homo sapiens
gaugcuggcagccauggcca

SEQ ID NO: 1269814 - RNA, 14 nt, Homo sapiens
gaugcuguuugaca

SEQ ID NO: 1269815 - RNA, 21 nt, Homo sapiens
gaugcuucuauaauuuugccu

SEQ ID NO: 1269816 - RNA, 19 nt, Homo sapiens
gauggaaguaaagccucaa

SEQ ID NO: 1269817 - RNA, 17 nt, Homo sapiens
gauggaauaacucugug

SEQ ID NO: 1269818 - RNA, 22 nt, Homo sapiens
gauggacaagauuaccccaccu

SEQ ID NO: 1269819 - RNA, 22 nt, Homo sapiens
gauggaccuccuucgcuggaag

SEQ ID NO: 1269820 - RNA, 22 nt, Homo sapiens
gauggacucugaaaaacauucc

SEQ ID NO: 1269821 - RNA, 19 nt, Homo sapiens
gauggagauauuuacauga

SEQ ID NO: 1269822 - RNA, 18 nt, Homo sapiens
gauggagguucucagagc

SEQ ID NO: 1269823 - RNA, 19 nt, Homo sapiens
gauggccaagcaauuccuc

SEQ ID NO: 1269824 - RNA, 19 nt, Homo sapiens
gcaaaucuacagauccuuu

SEQ ID NO: 1269825 - RNA, 16 nt, Homo sapiens
gcaaaugacaaaaagc

SEQ ID NO: 1269826 - RNA, 15 nt, Homo sapiens
gcaaauggugcugaa

SEQ ID NO: 1269827 - RNA, 15 nt, Homo sapiens
gcaaauguacuucuc

SEQ ID NO: 1269828 - RNA, 13 nt, Homo sapiens
gcaaauguuaaaa

SEQ ID NO: 1269829 - RNA, 17 nt, Homo sapiens
gcaaauuaacuuuacau

SEQ ID NO: 1269830 - RNA, 21 nt, Homo sapiens
gcaacagauaaguuugcaguu

SEQ ID NO: 1269831 - RNA, 18 nt, Homo sapiens
gcaacagcaaacaggugc

SEQ ID NO: 1269832 - RNA, 13 nt, Homo sapiens
gcaacagcacugg

SEQ ID NO: 1269833 - RNA, 19 nt, Homo sapiens
gcaacaggaggcauucugu

SEQ ID NO: 1269834 - RNA, 22 nt, Homo sapiens
gcaacaguacuucaaacagaac

SEQ ID NO: 1269835 - RNA, 16 nt, Homo sapiens
gcaacaucucugggaa

SEQ ID NO: 1269836 - RNA, 20 nt, Homo sapiens
gcaaccuccgccucccaggu

SEQ ID NO: 1269837 - RNA, 16 nt, Homo sapiens
gcaaccugauuguaaa

SEQ ID NO: 1269838 - RNA, 21 nt, Homo sapiens
gcaacucacugauucucuaca

SEQ ID NO: 1269839 - RNA, 15 nt, Homo sapiens
gcaacuccauuuacc

SEQ ID NO: 1269840 - RNA, 14 nt, Homo sapiens
gcaacucuguaaau

SEQ ID NO: 1269841 - RNA, 15 nt, Homo sapiens
gcaacuguaugaaaa

SEQ ID NO: 1269842 - RNA, 23 nt, Homo sapiens
gcaacuuaagcugggauaaucac

SEQ ID NO: 1269843 - RNA, 18 nt, Homo sapiens
gcaacuucuucuccaucc

SEQ ID NO: 1269844 - RNA, 21 nt, Homo sapiens
gcaagaaguagcagugucugu

SEQ ID NO: 1269845 - RNA, 17 nt, Homo sapiens
gcaagaauauugucccu

SEQ ID NO: 1269846 - RNA, 21 nt, Homo sapiens
gcaagaccaaaaugacaauga

SEQ ID NO: 1269847 - RNA, 16 nt, Homo sapiens
gcaagaccagucacuc

SEQ ID NO: 1269848 - RNA, 16 nt, Homo sapiens
gcaagagaauuacuug

SEQ ID NO: 1269849 - RNA, 17 nt, Homo sapiens
gcaagagaauuacuuga

SEQ ID NO: 1269850 - RNA, 12 nt, Homo sapiens
gcaagagacugg

SEQ ID NO: 1269851 - RNA, 18 nt, Homo sapiens
gcaagcaggaccuggcau

SEQ ID NO: 1269852 - RNA, 12 nt, Homo sapiens
gcaagccagcuu

SEQ ID NO: 1269853 - RNA, 18 nt, Homo sapiens
gcaagccugucugagacu

SEQ ID NO: 1269854 - RNA, 14 nt, Homo sapiens
gcaagcuccaucuc

SEQ ID NO: 1269855 - RNA, 15 nt, Homo sapiens
gcaagcuccaucucu

SEQ ID NO: 1269856 - RNA, 15 nt, Homo sapiens
gcaagcucugccucc

SEQ ID NO: 1269857 - RNA, 16 nt, Homo sapiens
gcaaggauuacagaaa

SEQ ID NO: 1269858 - RNA, 16 nt, Homo sapiens
gcaaggcccugcugcc

SEQ ID NO: 1269859 - RNA, 11 nt, Homo sapiens
gcaaggugcau

SEQ ID NO: 1269860 - RNA, 22 nt, Homo sapiens
gcaagugauugaaaauaguaaa

SEQ ID NO: 1269861 - RNA, 20 nt, Homo sapiens
gcaaguggccauuaccaucu

SEQ ID NO: 1269862 - RNA, 13 nt, Homo sapiens
gcaaguuacucug

SEQ ID NO: 1269863 - RNA, 14 nt, Homo sapiens
gcaaguuucaguga

SEQ ID NO: 1269864 - RNA, 15 nt, Homo sapiens
gcaaguuucagugaa

SEQ ID NO: 1269865 - RNA, 18 nt, Homo sapiens
gcaauaaaaaucauagua

SEQ ID NO: 1269866 - RNA, 17 nt, Homo sapiens
gcaauaaacuccuacua

SEQ ID NO: 1269867 - RNA, 17 nt, Homo sapiens
gcaauaaauaccagaca

SEQ ID NO: 1269868 - RNA, 20 nt, Homo sapiens
gcaauaaauuuauauacuuu

SEQ ID NO: 1269869 - RNA, 12 nt, Homo sapiens
gcaauacaaaga

SEQ ID NO: 1269870 - RNA, 15 nt, Homo sapiens
gcaauaguguguucu

SEQ ID NO: 1269871 - RNA, 21 nt, Homo sapiens
gcaaucaaaaauauguguuuu

SEQ ID NO: 1269872 - RNA, 18 nt, Homo sapiens
gcaaucaugagcaaguga

SEQ ID NO: 1269873 - RNA, 18 nt, Homo sapiens
gcaaucccagcaccuuag

SEQ ID NO: 1269874 - RNA, 22 nt, Homo sapiens
gcaaucuguguucgauggcuca

SEQ ID NO: 1269875 - RNA, 16 nt, Homo sapiens
gcaaugcaugauacua

SEQ ID NO: 1269876 - RNA, 22 nt, Homo sapiens
gcaaugccaaucuucaguauuu

SEQ ID NO: 1269877 - RNA, 18 nt, Homo sapiens
cuucauuugaugcuaaau

SEQ ID NO: 1269878 - RNA, 17 nt, Homo sapiens
cuuccaaauuuggcuca

SEQ ID NO: 1269879 - RNA, 11 nt, Homo sapiens
cuuccaaggau

SEQ ID NO: 1269880 - RNA, 20 nt, Homo sapiens
cuuccacaacugcugcaugu

SEQ ID NO: 1269881 - RNA, 18 nt, Homo sapiens
cuuccacaauggucucag

SEQ ID NO: 1269882 - RNA, 22 nt, Homo sapiens
cuuccacaauggucucagccua

SEQ ID NO: 1269883 - RNA, 20 nt, Homo sapiens
cuuccacaugggugcauuug

SEQ ID NO: 1269884 - RNA, 15 nt, Homo sapiens
cuuccacccgucucu

SEQ ID NO: 1269885 - RNA, 17 nt, Homo sapiens
cuuccacuucuaugcaa

SEQ ID NO: 1269886 - RNA, 19 nt, Homo sapiens
cuuccagaccugcuuccug

SEQ ID NO: 1269887 - RNA, 17 nt, Homo sapiens
cuuccagaucacugcca

SEQ ID NO: 1269888 - RNA, 18 nt, Homo sapiens
cuuccagaucacugccac

SEQ ID NO: 1269889 - RNA, 16 nt, Homo sapiens
cuuccaggcacucaaa

SEQ ID NO: 1269890 - RNA, 18 nt, Homo sapiens
cuuccaggggaaccugcc

SEQ ID NO: 1269891 - RNA, 14 nt, Homo sapiens
cuuccagugcucag

SEQ ID NO: 1269892 - RNA, 16 nt, Homo sapiens
cuuccauaauguauaa

SEQ ID NO: 1269893 - RNA, 22 nt, Homo sapiens
cuuccauaauuaugacaguuau

SEQ ID NO: 1269894 - RNA, 14 nt, Homo sapiens
cuuccaucuaguca

SEQ ID NO: 1269895 - RNA, 23 nt, Homo sapiens
cuuccaugacauaagugcuauug

SEQ ID NO: 1269896 - RNA, 17 nt, Homo sapiens
cuuccaugacccuuugc

SEQ ID NO: 1269897 - RNA, 19 nt, Homo sapiens
cuuccauucacaccagcua

SEQ ID NO: 1269898 - RNA, 11 nt, Homo sapiens
cuuccauuugc

SEQ ID NO: 1269899 - RNA, 22 nt, Homo sapiens
cuuccauuuucccccacuacug

SEQ ID NO: 1269900 - RNA, 20 nt, Homo sapiens
cuucccaaucagcacugaaa

SEQ ID NO: 1269901 - RNA, 17 nt, Homo sapiens
cuucccagagggagcag

SEQ ID NO: 1269902 - RNA, 12 nt, Homo sapiens
cuucccauuucu

SEQ ID NO: 1269903 - RNA, 15 nt, Homo sapiens
cuucccccacuuccc

SEQ ID NO: 1269904 - RNA, 23 nt, Homo sapiens
cuuccccggggucuucuaccuca

SEQ ID NO: 1269905 - RNA, 19 nt, Homo sapiens
cuuccccuugcccuugccc

SEQ ID NO: 1269906 - RNA, 18 nt, Homo sapiens
cuucccgaguaacugaga

SEQ ID NO: 1269907 - RNA, 22 nt, Homo sapiens
cuucccgccagagggcuuguga

SEQ ID NO: 1269908 - RNA, 15 nt, Homo sapiens
cuucccuacauggag

SEQ ID NO: 1269909 - RNA, 23 nt, Homo sapiens
cuucccugcauuaacugcacaaa

SEQ ID NO: 1269910 - RNA, 13 nt, Homo sapiens
cuucccugcauuu

SEQ ID NO: 1269911 - RNA, 15 nt, Homo sapiens
cuucccuguucuccc

SEQ ID NO: 1269912 - RNA, 20 nt, Homo sapiens
cuucccuuucugcuuguguu

SEQ ID NO: 1269913 - RNA, 17 nt, Homo sapiens
cuuccgauggaugaauc

SEQ ID NO: 1269914 - RNA, 17 nt, Homo sapiens
cuuccggcuuauggucu

SEQ ID NO: 1269915 - RNA, 15 nt, Homo sapiens
cuuccuaaacccaau

SEQ ID NO: 1269916 - RNA, 13 nt, Homo sapiens
cuuccuacuguag

SEQ ID NO: 1269917 - RNA, 22 nt, Homo sapiens
cuuccucggcagucacuuccac

SEQ ID NO: 1269918 - RNA, 23 nt, Homo sapiens
cuuccucgguagcagaggcccug

SEQ ID NO: 1269919 - RNA, 16 nt, Homo sapiens
cuuccucuagaagcca

SEQ ID NO: 1269920 - RNA, 18 nt, Homo sapiens
cuuccucuagaagccaag

SEQ ID NO: 1269921 - RNA, 23 nt, Homo sapiens
cuuccugaaauaaacacuggugc

SEQ ID NO: 1269922 - RNA, 19 nt, Homo sapiens
cuuccugaacaaccagcug

SEQ ID NO: 1269923 - RNA, 22 nt, Homo sapiens
cuuccugacagguucugagaua

SEQ ID NO: 1269924 - RNA, 16 nt, Homo sapiens
cacaguagucuugaug

SEQ ID NO: 1269925 - RNA, 23 nt, Homo sapiens
cacaguauuacuucugcuacaua

SEQ ID NO: 1269926 - RNA, 17 nt, Homo sapiens
cacaguccccagacuca

SEQ ID NO: 1269927 - RNA, 22 nt, Homo sapiens
cacagucucuuuaaucuucagu

SEQ ID NO: 1269928 - RNA, 22 nt, Homo sapiens
cacagugagucgaggacaggga

SEQ ID NO: 1269929 - RNA, 11 nt, Homo sapiens
cacagugcaag

SEQ ID NO: 1269930 - RNA, 15 nt, Homo sapiens
cacagugcaucucag

SEQ ID NO: 1269931 - RNA, 17 nt, Homo sapiens
cacagugcugaccagac

SEQ ID NO: 1269932 - RNA, 15 nt, Homo sapiens
cacaguggccaaaga

SEQ ID NO: 1269933 - RNA, 18 nt, Homo sapiens
cacaguuagguagcuuua

SEQ ID NO: 1269934 - RNA, 22 nt, Homo sapiens
cacaguuaucuuagcuggauau

SEQ ID NO: 1269935 - RNA, 23 nt, Homo sapiens
cacaguuuauuuuuauacuuuca

SEQ ID NO: 1269936 - RNA, 20 nt, Homo sapiens
cacauaaaagacacagaaca

SEQ ID NO: 1269937 - RNA, 17 nt, Homo sapiens
cacauacaggugcucaa

SEQ ID NO: 1269938 - RNA, 20 nt, Homo sapiens
cacauagcaggggcaccuuc

SEQ ID NO: 1269939 - RNA, 20 nt, Homo sapiens
cacauagcgccgugcuguaa

SEQ ID NO: 1269940 - RNA, 23 nt, Homo sapiens
cacauaguagguacccaauucaa

SEQ ID NO: 1269941 - RNA, 17 nt, Homo sapiens
cacauauaucaaaguga

SEQ ID NO: 1269942 - RNA, 13 nt, Homo sapiens
cacauauggacuc

SEQ ID NO: 1269943 - RNA, 18 nt, Homo sapiens
cacauccccagaauccau

SEQ ID NO: 1269944 - RNA, 22 nt, Homo sapiens
cacauccgccuuuuguauacau

SEQ ID NO: 1269945 - RNA, 17 nt, Homo sapiens
cacaucucugccuggaa

SEQ ID NO: 1269946 - RNA, 18 nt, Homo sapiens
cacaucugccagaccuua

SEQ ID NO: 1269947 - RNA, 14 nt, Homo sapiens
cacaucuugcucug

SEQ ID NO: 1269948 - RNA, 19 nt, Homo sapiens
cacaugaaaccuacacacu

SEQ ID NO: 1269949 - RNA, 23 nt, Homo sapiens
cacaugaaucccacccacaugug

SEQ ID NO: 1269950 - RNA, 17 nt, Homo sapiens
cacaugaccugaucacu

SEQ ID NO: 1269951 - RNA, 13 nt, Homo sapiens
cacaugcccauga

SEQ ID NO: 1269952 - RNA, 12 nt, Homo sapiens
cacaugccuuaa

SEQ ID NO: 1269953 - RNA, 9 nt, Homo sapiens
cacaugcua

SEQ ID NO: 1269954 - RNA, 20 nt, Homo sapiens
cacaugcugagucucccaag

SEQ ID NO: 1269955 - RNA, 12 nt, Homo sapiens
cacaugcuggug

SEQ ID NO: 1269956 - RNA, 11 nt, Homo sapiens
cacaugcuuuu

SEQ ID NO: 1269957 - RNA, 15 nt, Homo sapiens
cacauggcaugaaau

SEQ ID NO: 1269958 - RNA, 21 nt, Homo sapiens
cacauggccuaugcacauaug

SEQ ID NO: 1269959 - RNA, 22 nt, Homo sapiens
cacaugggcagaaaaauggugg

SEQ ID NO: 1269960 - RNA, 17 nt, Homo sapiens
cacaugugcacaugcac

SEQ ID NO: 1269961 - RNA, 20 nt, Homo sapiens
cacauuagaauaaaagguag

SEQ ID NO: 1269962 - RNA, 23 nt, Homo sapiens
cacauuaucgggagcagugucuu

SEQ ID NO: 1269963 - RNA, 18 nt, Homo sapiens
cacauucccaucugucac

SEQ ID NO: 1269964 - RNA, 19 nt, Homo sapiens
cacauucuaaaggcuugau

SEQ ID NO: 1269965 - RNA, 20 nt, Homo sapiens
cacauuggucauugugaaua

SEQ ID NO: 1269966 - RNA, 20 nt, Homo sapiens
cacauuuagaaaagugaauu

SEQ ID NO: 1269967 - RNA, 21 nt, Homo sapiens
cacauuuagauccugguuuca

SEQ ID NO: 1269968 - RNA, 16 nt, Homo sapiens
cacauuucacauugaa

SEQ ID NO: 1269969 - RNA, 15 nt, Homo sapiens
cacauuucuaugcca

SEQ ID NO: 1269970 - RNA, 14 nt, Homo sapiens
cacauuugauucug

SEQ ID NO: 1269971 - RNA, 23 nt, Homo sapiens
cacauuugucaguauuuuugccg

SEQ ID NO: 1269972 - RNA, 23 nt, Homo sapiens
cacauuuuuauaaaaaugagugc

SEQ ID NO: 1269973 - RNA, 15 nt, Homo sapiens
caccaaccugcauuu

SEQ ID NO: 1269974 - RNA, 19 nt, Homo sapiens
caccaagaucaagcagaga

SEQ ID NO: 1269975 - RNA, 22 nt, Homo sapiens
caccaaggaaacgcuaccucuc

SEQ ID NO: 1269976 - RNA, 15 nt, Homo sapiens
caccaaguaccagua

SEQ ID NO: 1269977 - RNA, 12 nt, Homo sapiens
caccacaaacuu

SEQ ID NO: 1269978 - RNA, 16 nt, Homo sapiens
caccacaccaucaggc

SEQ ID NO: 1269979 - RNA, 12 nt, Homo sapiens
caccacagcaga

SEQ ID NO: 1269980 - RNA, 23 nt, Homo sapiens
caccacagcagagaccaccacau

SEQ ID NO: 1269981 - RNA, 14 nt, Homo sapiens
caccacaugugcac

SEQ ID NO: 1269982 - RNA, 15 nt, Homo sapiens
caccacaugugcaca

SEQ ID NO: 1269983 - RNA, 16 nt, Homo sapiens
caccacauugagauca

SEQ ID NO: 1269984 - RNA, 13 nt, Homo sapiens
caccaccacuuac

SEQ ID NO: 1269985 - RNA, 16 nt, Homo sapiens
caccacccucccgcug

SEQ ID NO: 1269986 - RNA, 11 nt, Homo sapiens
caccacuccac

SEQ ID NO: 1269987 - RNA, 17 nt, Homo sapiens
caccacuccacuccucc

SEQ ID NO: 1269988 - RNA, 20 nt, Homo sapiens
caccacuuuuaacagaacag

SEQ ID NO: 1269989 - RNA, 16 nt, Homo sapiens
cuugacauuuaucacc

SEQ ID NO: 1269990 - RNA, 20 nt, Homo sapiens
cuugaccuaagggacuccca

SEQ ID NO: 1269991 - RNA, 19 nt, Homo sapiens
cuugaccucaggugaucca

SEQ ID NO: 1269992 - RNA, 19 nt, Homo sapiens
cuugacuuccccacugcuc

SEQ ID NO: 1269993 - RNA, 21 nt, Homo sapiens
cuugagagaaaaagugccccu

SEQ ID NO: 1269994 - RNA, 15 nt, Homo sapiens
cuugagccaguaauu

SEQ ID NO: 1269995 - RNA, 20 nt, Homo sapiens
cuugagccaguaauuggucc

SEQ ID NO: 1269996 - RNA, 15 nt, Homo sapiens
cuugagcuacuucaa

SEQ ID NO: 1269997 - RNA, 18 nt, Homo sapiens
cuugagcuuggcagcuga

SEQ ID NO: 1269998 - RNA, 21 nt, Homo sapiens
cuugaggaauaaaugccuuua

SEQ ID NO: 1269999 - RNA, 17 nt, Homo sapiens
cuugagguggugccuuc

SEQ ID NO: 1270000 - RNA, 12 nt, Homo sapiens
cuugagugcucu

SEQ ID NO: 1270001 - RNA, 14 nt, Homo sapiens
cuugaguucccaga

SEQ ID NO: 1270002 - RNA, 14 nt, Homo sapiens
cuugaguuggagua

SEQ ID NO: 1270003 - RNA, 20 nt, Homo sapiens
cuugaguuggaguacuauau

SEQ ID NO: 1270004 - RNA, 14 nt, Homo sapiens
cuugauaaccauau

SEQ ID NO: 1270005 - RNA, 21 nt, Homo sapiens
cuugauauguaaguacuucca

SEQ ID NO: 1270006 - RNA, 14 nt, Homo sapiens
cuugaucaauuccc

SEQ ID NO: 1270007 - RNA, 18 nt, Homo sapiens
cuugaucaauucccuuga

SEQ ID NO: 1270008 - RNA, 20 nt, Homo sapiens
cuugaucauuauaucauugg

SEQ ID NO: 1270009 - RNA, 20 nt, Homo sapiens
cuugauguuuguuugcauga

SEQ ID NO: 1270010 - RNA, 22 nt, Homo sapiens
cuugauuuugcccccugaggga

SEQ ID NO: 1270011 - RNA, 18 nt, Homo sapiens
cuugcaauguagucaaua

SEQ ID NO: 1270012 - RNA, 20 nt, Homo sapiens
cuugcaccccaaagcuuucc

SEQ ID NO: 1270013 - RNA, 15 nt, Homo sapiens
cuugcagaacuguag

SEQ ID NO: 1270014 - RNA, 17 nt, Homo sapiens
cuugcagcuaguuuucu

SEQ ID NO: 1270015 - RNA, 18 nt, Homo sapiens
cuugcagcugauguugga

SEQ ID NO: 1270016 - RNA, 14 nt, Homo sapiens
cuugcagcuguaaa

SEQ ID NO: 1270017 - RNA, 14 nt, Homo sapiens
cuugcagggccguu

SEQ ID NO: 1270018 - RNA, 15 nt, Homo sapiens
cuugcaguacaucaa

SEQ ID NO: 1270019 - RNA, 17 nt, Homo sapiens
cuugcaguuaaggguua

SEQ ID NO: 1270020 - RNA, 20 nt, Homo sapiens
cuugcaugcuugcauaagag

SEQ ID NO: 1270021 - RNA, 19 nt, Homo sapiens
cuugcccagacuacagggc

SEQ ID NO: 1270022 - RNA, 15 nt, Homo sapiens
cuugcccgcgcucuu

SEQ ID NO: 1270023 - RNA, 13 nt, Homo sapiens
cuugcccuuuacg

SEQ ID NO: 1270024 - RNA, 15 nt, Homo sapiens
cuugccuaggccaaa

SEQ ID NO: 1270025 - RNA, 16 nt, Homo sapiens
cuugccucucucagga

SEQ ID NO: 1270026 - RNA, 23 nt, Homo sapiens
cuugcgaacuagagaugugcaau

SEQ ID NO: 1270027 - RNA, 15 nt, Homo sapiens
cuugcuaaagcacuu

SEQ ID NO: 1270028 - RNA, 18 nt, Homo sapiens
cuugcuagcuaugugacc

SEQ ID NO: 1270029 - RNA, 17 nt, Homo sapiens
cuugcucuguuacccag

SEQ ID NO: 1270030 - RNA, 19 nt, Homo sapiens
cuugcugccacauucuaaa

SEQ ID NO: 1270031 - RNA, 21 nt, Homo sapiens
cuugcugcugcugcacccaac

SEQ ID NO: 1270032 - RNA, 22 nt, Homo sapiens
cuugcuuaugacaucacuugua

SEQ ID NO: 1270033 - RNA, 23 nt, Homo sapiens
cuugcuuuccugggccuuugcaa

SEQ ID NO: 1270034 - RNA, 19 nt, Homo sapiens
cuugcuuugggcuuugcag

SEQ ID NO: 1270035 - RNA, 12 nt, Homo sapiens
cgcccucaggcu

SEQ ID NO: 1270036 - RNA, 19 nt, Homo sapiens
cgcccuccucccugucaua

SEQ ID NO: 1270037 - RNA, 18 nt, Homo sapiens
cgcccuggacuugguaca

SEQ ID NO: 1270038 - RNA, 19 nt, Homo sapiens
cgcccugggcugucuguca

SEQ ID NO: 1270039 - RNA, 19 nt, Homo sapiens
cgcccuugagcuacuucaa

SEQ ID NO: 1270040 - RNA, 13 nt, Homo sapiens
cgccugagcucac

SEQ ID NO: 1270041 - RNA, 20 nt, Homo sapiens
cgccuuaugccucagucuau

SEQ ID NO: 1270042 - RNA, 22 nt, Homo sapiens
cgccuuaugccucagucuauuc

SEQ ID NO: 1270043 - RNA, 21 nt, Homo sapiens
cgccuugccuccucacccacc

SEQ ID NO: 1270044 - RNA, 19 nt, Homo sapiens
cgcgcucgcccagcaggag

SEQ ID NO: 1270045 - RNA, 11 nt, Homo sapiens
cgcgugcacac

SEQ ID NO: 1270046 - RNA, 17 nt, Homo sapiens
cgcuaauucaaggaauu

SEQ ID NO: 1270047 - RNA, 13 nt, Homo sapiens
cgcuaucuagcaa

SEQ ID NO: 1270048 - RNA, 10 nt, Homo sapiens
cgcuaugugc

SEQ ID NO: 1270049 - RNA, 12 nt, Homo sapiens
cgcuaugugcac

SEQ ID NO: 1270050 - RNA, 13 nt, Homo sapiens
cgcuccucgggaa

SEQ ID NO: 1270051 - RNA, 17 nt, Homo sapiens
cgcucucagcugaccau

SEQ ID NO: 1270052 - RNA, 13 nt, Homo sapiens
cgcugacucuggg

SEQ ID NO: 1270053 - RNA, 21 nt, Homo sapiens
cgcugagugggagaaggcagu

SEQ ID NO: 1270054 - RNA, 18 nt, Homo sapiens
cgcugcucuuaugccauu

SEQ ID NO: 1270055 - RNA, 21 nt, Homo sapiens
cgcuucgacuuuucuuaacaa

SEQ ID NO: 1270056 - RNA, 12 nt, Homo sapiens
cgcuucuugccu

SEQ ID NO: 1270057 - RNA, 18 nt, Homo sapiens
cggaagcucacagugaca

SEQ ID NO: 1270058 - RNA, 18 nt, Homo sapiens
cggaagcugucgacuuca

SEQ ID NO: 1270059 - RNA, 18 nt, Homo sapiens
cggaaggucccucagaca

SEQ ID NO: 1270060 - RNA, 20 nt, Homo sapiens
cggaagucaucccagugcac

SEQ ID NO: 1270061 - RNA, 21 nt, Homo sapiens
cggaagucaucccagugcaca

SEQ ID NO: 1270062 - RNA, 18 nt, Homo sapiens
cggaagugaccacagaag

SEQ ID NO: 1270063 - RNA, 12 nt, Homo sapiens
cggaaucucagc

SEQ ID NO: 1270064 - RNA, 22 nt, Homo sapiens
cggacaagacccccagcacuug

SEQ ID NO: 1270065 - RNA, 14 nt, Homo sapiens
cggacaagcagcug

SEQ ID NO: 1270066 - RNA, 14 nt, Homo sapiens
cggacaaguuuuaa

SEQ ID NO: 1270067 - RNA, 16 nt, Homo sapiens
cggagaucuccuugcc

SEQ ID NO: 1270068 - RNA, 16 nt, Homo sapiens
cggagcuugcagugag

SEQ ID NO: 1270069 - RNA, 13 nt, Homo sapiens
cggaggcaccugg

SEQ ID NO: 1270070 - RNA, 17 nt, Homo sapiens
cggaggccccacugaug

SEQ ID NO: 1270071 - RNA, 22 nt, Homo sapiens
cggagggccccugcgugggggc

SEQ ID NO: 1270072 - RNA, 17 nt, Homo sapiens
cggagguccuuuggaca

SEQ ID NO: 1270073 - RNA, 18 nt, Homo sapiens
cggaguucagacucucag

SEQ ID NO: 1270074 - RNA, 21 nt, Homo sapiens
cggaguucugcccaugggaag

SEQ ID NO: 1270075 - RNA, 12 nt, Homo sapiens
cggauccugcug

SEQ ID NO: 1270076 - RNA, 16 nt, Homo sapiens
cggaugaccaaaccag

SEQ ID NO: 1270077 - RNA, 19 nt, Homo sapiens
cggcaaugcccugugcaug

SEQ ID NO: 1270078 - RNA, 12 nt, Homo sapiens
cggcacacugcc

SEQ ID NO: 1270079 - RNA, 15 nt, Homo sapiens
cggcacacugccaaa

SEQ ID NO: 1270080 - RNA, 14 nt, Homo sapiens
cggcagcuacucag

SEQ ID NO: 1270081 - RNA, 15 nt, Homo sapiens
cggcagucacuucca

SEQ ID NO: 1270082 - RNA, 18 nt, Homo sapiens
cggccaccagaugcugaa

SEQ ID NO: 1270083 - RNA, 16 nt, Homo sapiens
cggccuccaugaccug

SEQ ID NO: 1270084 - RNA, 14 nt, Homo sapiens
cggccucccaaagu

SEQ ID NO: 1270085 - RNA, 14 nt, Homo sapiens
cggcgccaccaucc

SEQ ID NO: 1270086 - RNA, 18 nt, Homo sapiens
cggcugaggccugagcga

SEQ ID NO: 1270087 - RNA, 16 nt, Homo sapiens
cggcugcccgacucag

SEQ ID NO: 1270088 - RNA, 18 nt, Homo sapiens
cggcugcggggggcacca

SEQ ID NO: 1270089 - RNA, 14 nt, Homo sapiens
cggcugcucgccca

SEQ ID NO: 1270090 - RNA, 20 nt, Homo sapiens
cggcugucuccuugaagguu

SEQ ID NO: 1270091 - RNA, 19 nt, Homo sapiens
cggcuugugggcuggugcc

SEQ ID NO: 1270092 - RNA, 17 nt, Homo sapiens
cgggaaacacacaagca

SEQ ID NO: 1270093 - RNA, 12 nt, Homo sapiens
cgggaaugagcu

SEQ ID NO: 1270094 - RNA, 16 nt, Homo sapiens
cgggagaccugugcua

SEQ ID NO: 1270095 - RNA, 13 nt, Homo sapiens
cgggagcacagcu

SEQ ID NO: 1270096 - RNA, 16 nt, Homo sapiens
cgggaggcugggcaca

SEQ ID NO: 1270097 - RNA, 22 nt, Homo sapiens
cgggcaggggucagagcacucc

SEQ ID NO: 1270098 - RNA, 15 nt, Homo sapiens
cggggagcaaaccag

SEQ ID NO: 1270099 - RNA, 14 nt, Homo sapiens
cggggcaggugcag

SEQ ID NO: 1270100 - RNA, 18 nt, Homo sapiens
cgggugauuggugcugag

SEQ ID NO: 1270101 - RNA, 19 nt, Homo sapiens
cgggugggcggcuggagac

SEQ ID NO: 1270102 - RNA, 14 nt, Homo sapiens
cggucaccuguugg

SEQ ID NO: 1270103 - RNA, 16 nt, Homo sapiens
cggucccugucccucu

SEQ ID NO: 1270104 - RNA, 12 nt, Homo sapiens
cggucucaggcu

SEQ ID NO: 1270105 - RNA, 15 nt, Homo sapiens
cggugcaugaugcug

SEQ ID NO: 1270106 - RNA, 22 nt, Homo sapiens
cggugcuagcuugacacaguca

SEQ ID NO: 1270107 - RNA, 14 nt, Homo sapiens
cggugcucuggaag

SEQ ID NO: 1270108 - RNA, 15 nt, Homo sapiens
cggugcuugugucac

SEQ ID NO: 1270109 - RNA, 22 nt, Homo sapiens
cgguggacucucauguggccaa

SEQ ID NO: 1270110 - RNA, 18 nt, Homo sapiens
cgguggcggcagggccag

SEQ ID NO: 1270111 - RNA, 14 nt, Homo sapiens
cgguguuuugccau

SEQ ID NO: 1270112 - RNA, 14 nt, Homo sapiens
cgguuaaauacugu

SEQ ID NO: 1270113 - RNA, 22 nt, Homo sapiens
cgguuuccauauuuuuugcaca

SEQ ID NO: 1270114 - RNA, 22 nt, Homo sapiens
cgguuuuuuauuuucuuuacaa

SEQ ID NO: 1270115 - RNA, 19 nt, Homo sapiens
cguagcuucuaccaugaac

SEQ ID NO: 1270116 - RNA, 18 nt, Homo sapiens
cguagcuuucccaaauaa

SEQ ID NO: 1270117 - RNA, 18 nt, Homo sapiens
cguaguauuaugauugca

SEQ ID NO: 1270118 - RNA, 21 nt, Homo sapiens
cguaucugcucuuaggugcuu

SEQ ID NO: 1270119 - RNA, 20 nt, Homo sapiens
cguaugguggcucaugucua

SEQ ID NO: 1270120 - RNA, 18 nt, Homo sapiens
cguauuuauacucacuga

SEQ ID NO: 1270121 - RNA, 15 nt, Homo sapiens
cgucacccaacauca

SEQ ID NO: 1270122 - RNA, 23 nt, Homo sapiens
cgucagccagcucccagccacau

SEQ ID NO: 1270123 - RNA, 11 nt, Homo sapiens
cguccacaggg

SEQ ID NO: 1270124 - RNA, 14 nt, Homo sapiens
cguccccaguugcc

SEQ ID NO: 1270125 - RNA, 12 nt, Homo sapiens
cgucccuaagca

SEQ ID NO: 1270126 - RNA, 13 nt, Homo sapiens
cgucccuaccucc

SEQ ID NO: 1270127 - RNA, 19 nt, Homo sapiens
cguccucagcaguccacaa

SEQ ID NO: 1270128 - RNA, 14 nt, Homo sapiens
cgucuaugcugcuu

SEQ ID NO: 1270129 - RNA, 17 nt, Homo sapiens
cgucuccggaauccuug

SEQ ID NO: 1270130 - RNA, 15 nt, Homo sapiens
cgucuccucccucag

SEQ ID NO: 1270131 - RNA, 14 nt, Homo sapiens
cgucucugcuaaac

SEQ ID NO: 1270132 - RNA, 22 nt, Homo sapiens
cgucuguugugcgaaugacuga

SEQ ID NO: 1270133 - RNA, 17 nt, Homo sapiens
cgugagcgccugugcac

SEQ ID NO: 1270134 - RNA, 15 nt, Homo sapiens
cgugaggucccagga

SEQ ID NO: 1270135 - RNA, 12 nt, Homo sapiens
cgugaguggucu

SEQ ID NO: 1270136 - RNA, 16 nt, Homo sapiens
cgugauuuccagugag

SEQ ID NO: 1270137 - RNA, 14 nt, Homo sapiens
cgugccaugaucug

SEQ ID NO: 1270138 - RNA, 20 nt, Homo sapiens
cgugccccgccuccccgaaa

SEQ ID NO: 1270139 - RNA, 18 nt, Homo sapiens
cgugcccgugugcauguc

SEQ ID NO: 1270140 - RNA, 17 nt, Homo sapiens
cgugccuguuugcuuag

SEQ ID NO: 1270141 - RNA, 20 nt, Homo sapiens
cgugcucccgaugcugcuau

SEQ ID NO: 1270142 - RNA, 23 nt, Homo sapiens
cgugcugguccccuccucaguga

SEQ ID NO: 1270143 - RNA, 12 nt, Homo sapiens
cgugcuguaaau

SEQ ID NO: 1270144 - RNA, 22 nt, Homo sapiens
cgugcuuuucugcggcugugua

SEQ ID NO: 1270145 - RNA, 17 nt, Homo sapiens
cguggacucugcacaug

SEQ ID NO: 1270146 - RNA, 12 nt, Homo sapiens
cguggacuuggc

SEQ ID NO: 1270147 - RNA, 15 nt, Homo sapiens
cguggagacuggcag

SEQ ID NO: 1270148 - RNA, 22 nt, Homo sapiens
cgugggucacuacagggagaaa

SEQ ID NO: 1270149 - RNA, 15 nt, Homo sapiens
cguggguucugucau

SEQ ID NO: 1270150 - RNA, 19 nt, Homo sapiens
cguggucuccuugcacuuu

SEQ ID NO: 1270151 - RNA, 17 nt, Homo sapiens
cguguaccucacuuuac

SEQ ID NO: 1270152 - RNA, 20 nt, Homo sapiens
cguguaccucacuuuacaua

SEQ ID NO: 1270153 - RNA, 19 nt, Homo sapiens
cgugugacucgccagcuca

SEQ ID NO: 1270154 - RNA, 19 nt, Homo sapiens
cguguggacacagauccca

SEQ ID NO: 1270155 - RNA, 16 nt, Homo sapiens
cguguggaucuugcca

SEQ ID NO: 1270156 - RNA, 18 nt, Homo sapiens
cguguguguucacguguu

SEQ ID NO: 1270157 - RNA, 21 nt, Homo sapiens
cguguguguugucugaacaug

SEQ ID NO: 1270158 - RNA, 21 nt, Homo sapiens
cguguguugcaccaggcacug

SEQ ID NO: 1270159 - RNA, 18 nt, Homo sapiens
cguguuacuguugcacug

SEQ ID NO: 1270160 - RNA, 18 nt, Homo sapiens
cguguuucugacucugag

SEQ ID NO: 1270161 - RNA, 15 nt, Homo sapiens
cguucucacacccac

SEQ ID NO: 1270162 - RNA, 17 nt, Homo sapiens
cguugcccccagacuuc

SEQ ID NO: 1270163 - RNA, 14 nt, Homo sapiens
cguuggagacugaa

SEQ ID NO: 1270164 - RNA, 18 nt, Homo sapiens
cauggcccugugcuaauc

SEQ ID NO: 1270165 - RNA, 14 nt, Homo sapiens
cauggccuaugcac

SEQ ID NO: 1270166 - RNA, 16 nt, Homo sapiens
cauggccuaugcacau

SEQ ID NO: 1270167 - RNA, 17 nt, Homo sapiens
cauggcgaggcugaggu

SEQ ID NO: 1270168 - RNA, 21 nt, Homo sapiens
cauggcucacaaacaguuguu

SEQ ID NO: 1270169 - RNA, 19 nt, Homo sapiens
cauggcucuggacucuaaa

SEQ ID NO: 1270170 - RNA, 19 nt, Homo sapiens
caugggacuaaaugaacua

SEQ ID NO: 1270171 - RNA, 20 nt, Homo sapiens
caugggauugcacagagcug

SEQ ID NO: 1270172 - RNA, 21 nt, Homo sapiens
caugggcaccaaccugcauuu

SEQ ID NO: 1270173 - RNA, 20 nt, Homo sapiens
cauggggacauuugccaacu

SEQ ID NO: 1270174 - RNA, 18 nt, Homo sapiens
cauggguaaaaauauuuc

SEQ ID NO: 1270175 - RNA, 22 nt, Homo sapiens
cauugucuguuuggaagaccag

SEQ ID NO: 1270176 - RNA, 20 nt, Homo sapiens
cauugugaagcaccuacuau

SEQ ID NO: 1270177 - RNA, 19 nt, Homo sapiens
cauuguugagguggucuga

SEQ ID NO: 1270178 - RNA, 19 nt, Homo sapiens
cauuguuucguaacacagc

SEQ ID NO: 1270179 - RNA, 20 nt, Homo sapiens
cauuuaaaaaaaucacaaaa

SEQ ID NO: 1270180 - RNA, 20 nt, Homo sapiens
cauuuaaaaggacugcugau

SEQ ID NO: 1270181 - RNA, 13 nt, Homo sapiens
cauuuaaccccuu

SEQ ID NO: 1270182 - RNA, 23 nt, Homo sapiens
cauuuaaccccuugguacugaaa

SEQ ID NO: 1270183 - RNA, 17 nt, Homo sapiens
cauuuaauaaagaugag

SEQ ID NO: 1270184 - RNA, 15 nt, Homo sapiens
cauuuaauuuaguga

SEQ ID NO: 1270185 - RNA, 20 nt, Homo sapiens
cauuuacacauauccacaaa

SEQ ID NO: 1270186 - RNA, 13 nt, Homo sapiens
cauuuacauugcc

SEQ ID NO: 1270187 - RNA, 11 nt, Homo sapiens
cauuuacuuuu

SEQ ID NO: 1270188 - RNA, 13 nt, Homo sapiens
cauuuagaacuug

SEQ ID NO: 1270189 - RNA, 15 nt, Homo sapiens
cauuuagaacuugca

SEQ ID NO: 1270190 - RNA, 22 nt, Homo sapiens
cauuuagcuuguuccacugcaa

SEQ ID NO: 1270191 - RNA, 22 nt, Homo sapiens
cauuuaggaaaaauaauucuau

SEQ ID NO: 1270192 - RNA, 15 nt, Homo sapiens
cauuuagucauguga

SEQ ID NO: 1270193 - RNA, 15 nt, Homo sapiens
cauuuaguccuguac

SEQ ID NO: 1270194 - RNA, 15 nt, Homo sapiens
cauuuauauauugaa

SEQ ID NO: 1270195 - RNA, 17 nt, Homo sapiens
cauuuauuuacauguga

SEQ ID NO: 1270196 - RNA, 17 nt, Homo sapiens
cauuuauuuuaagcacu

SEQ ID NO: 1270197 - RNA, 15 nt, Homo sapiens
cauuucaaaguuugg

SEQ ID NO: 1270198 - RNA, 11 nt, Homo sapiens
cauuucaggga

SEQ ID NO: 1270199 - RNA, 17 nt, Homo sapiens
cauuucaggggucguca

SEQ ID NO: 1270200 - RNA, 20 nt, Homo sapiens
cauuucaucagcaaguuugg

SEQ ID NO: 1270201 - RNA, 22 nt, Homo sapiens
cauuucauuaagguuccaguua

SEQ ID NO: 1270202 - RNA, 22 nt, Homo sapiens
cauuucauuguaugauguguug

SEQ ID NO: 1270203 - RNA, 20 nt, Homo sapiens
cauuucauugucuuagucaa

SEQ ID NO: 1270204 - RNA, 15 nt, Homo sapiens
cauuuccaagcacuu

SEQ ID NO: 1270205 - RNA, 18 nt, Homo sapiens
cauuucuagcagugauga

SEQ ID NO: 1270206 - RNA, 14 nt, Homo sapiens
cauuucuaucacau

SEQ ID NO: 1270207 - RNA, 19 nt, Homo sapiens
cauuucucaaaugcacauc

SEQ ID NO: 1270208 - RNA, 20 nt, Homo sapiens
cauuucucuacacuaagggg

SEQ ID NO: 1270209 - RNA, 20 nt, Homo sapiens
cauuucuggacaguaccuga

SEQ ID NO: 1270210 - RNA, 18 nt, Homo sapiens
cauuucuguaaauaccau

SEQ ID NO: 1270211 - RNA, 17 nt, Homo sapiens
cauuucuugauguugcu

SEQ ID NO: 1270212 - RNA, 13 nt, Homo sapiens
cauuugcaccuac

SEQ ID NO: 1270213 - RNA, 12 nt, Homo sapiens
cauuugccuugu

SEQ ID NO: 1270214 - RNA, 14 nt, Homo sapiens
cauuugcugccauu

SEQ ID NO: 1270215 - RNA, 21 nt, Homo sapiens
cauuuggaccaauagcccaca

SEQ ID NO: 1270216 - RNA, 22 nt, Homo sapiens
cauuuggugggcuuuggagcug

SEQ ID NO: 1270217 - RNA, 19 nt, Homo sapiens
cauuugguguggauuuucu

SEQ ID NO: 1270218 - RNA, 16 nt, Homo sapiens
cauuugguugcuacug

SEQ ID NO: 1270219 - RNA, 16 nt, Homo sapiens
cauuuguaaugaauuu

SEQ ID NO: 1270220 - RNA, 12 nt, Homo sapiens
cauuuguagcaa

SEQ ID NO: 1270221 - RNA, 21 nt, Homo sapiens
cauuuguaugucaaagcuuug

SEQ ID NO: 1270222 - RNA, 22 nt, Homo sapiens
cauuuguguuauuauuuugcac

SEQ ID NO: 1270223 - RNA, 13 nt, Homo sapiens
cauuuuaaaaaca

SEQ ID NO: 1270224 - RNA, 15 nt, Homo sapiens
cauuuuagugacugu

SEQ ID NO: 1270225 - RNA, 14 nt, Homo sapiens
cauuuuaugcagaa

SEQ ID NO: 1270226 - RNA, 17 nt, Homo sapiens
cauuuuauuaagcuuuu

SEQ ID NO: 1270227 - RNA, 14 nt, Homo sapiens
cauuuucaccccac

SEQ ID NO: 1270228 - RNA, 18 nt, Homo sapiens
cauuuucugacaugcauu

SEQ ID NO: 1270229 - RNA, 13 nt, Homo sapiens
cauuuugcaaaau

SEQ ID NO: 1270230 - RNA, 22 nt, Homo sapiens
cauuuuggaaguuuucaggacu

SEQ ID NO: 1270231 - RNA, 19 nt, Homo sapiens
cauuuuggcgcuauuacaa

SEQ ID NO: 1270232 - RNA, 21 nt, Homo sapiens
cauuuuuaacagcaugcugcu

SEQ ID NO: 1270233 - RNA, 22 nt, Homo sapiens
cauuuuucacuuugcucucaau

SEQ ID NO: 1270234 - RNA, 18 nt, Homo sapiens
cauuuuugcucuauggga

SEQ ID NO: 1270235 - RNA, 17 nt, Homo sapiens
cauuuuuuucacuggag

SEQ ID NO: 1270236 - RNA, 18 nt, Homo sapiens
cauuuuuuugcaugcaug

SEQ ID NO: 1270237 - RNA, 18 nt, Homo sapiens
cauuuuuuuuucaaucaa

SEQ ID NO: 1270238 - RNA, 15 nt, Homo sapiens
ccaaaaauuacugau

SEQ ID NO: 1270239 - RNA, 13 nt, Homo sapiens
ccaaaacauuucu

SEQ ID NO: 1270240 - RNA, 17 nt, Homo sapiens
ccaaaacuuagacccau

SEQ ID NO: 1270241 - RNA, 16 nt, Homo sapiens
ccaaaacuuuaaugaa

SEQ ID NO: 1270242 - RNA, 24 nt, Homo sapiens
ccaaaacuuuaaugaacuaacuga

SEQ ID NO: 1270243 - RNA, 21 nt, Homo sapiens
ccaaaauaaugcaccacuuuu

SEQ ID NO: 1270244 - RNA, 18 nt, Homo sapiens
ccaaaauauuuuuugcaa

SEQ ID NO: 1270245 - RNA, 18 nt, Homo sapiens
ccaaaaucggaucugggg

SEQ ID NO: 1270246 - RNA, 18 nt, Homo sapiens
ccaaacacauacaggaag

SEQ ID NO: 1270247 - RNA, 17 nt, Homo sapiens
ccaaacccuugucagug

SEQ ID NO: 1270248 - RNA, 17 nt, Homo sapiens
ccaaacucaaacuugag

SEQ ID NO: 1270249 - RNA, 15 nt, Homo sapiens
ccaaacucugccagc

SEQ ID NO: 1270250 - RNA, 19 nt, Homo sapiens
ccaaacugauccaguauaa

SEQ ID NO: 1270251 - RNA, 22 nt, Homo sapiens
ccaaagagauauugauauugaa

SEQ ID NO: 1270252 - RNA, 22 nt, Homo sapiens
ccaaagaguagaauugcauuga

SEQ ID NO: 1270253 - RNA, 13 nt, Homo sapiens
ccaaagcaucaau

SEQ ID NO: 1270254 - RNA, 13 nt, Homo sapiens
ccaaagcauugcc

SEQ ID NO: 1270255 - RNA, 22 nt, Homo sapiens
ccaaagcccugguaaaagggau

SEQ ID NO: 1270256 - RNA, 17 nt, Homo sapiens
ccaaagcuuaugugaca

SEQ ID NO: 1270257 - RNA, 18 nt, Homo sapiens
ccaaaggaaaaagcacaa

SEQ ID NO: 1270258 - RNA, 18 nt, Homo sapiens
ccaaaggauaaguguccc

SEQ ID NO: 1270259 - RNA, 18 nt, Homo sapiens
ccaaagggugacuuuuca

SEQ ID NO: 1270260 - RNA, 22 nt, Homo sapiens
ccaaagguaagucugagaccca

SEQ ID NO: 1270261 - RNA, 22 nt, Homo sapiens
ccaaaggugugcccuguacaca

SEQ ID NO: 1270262 - RNA, 20 nt, Homo sapiens
ccaaaguaaauguccugcua

SEQ ID NO: 1270263 - RNA, 16 nt, Homo sapiens
ccaaaguacagaauuu

SEQ ID NO: 1270264 - RNA, 14 nt, Homo sapiens
ccaaaguagggaug

SEQ ID NO: 1270265 - RNA, 20 nt, Homo sapiens
ccaaaguccuuuuuuuccau

SEQ ID NO: 1270266 - RNA, 18 nt, Homo sapiens
ccaaagucucuaauucua

SEQ ID NO: 1270267 - RNA, 15 nt, Homo sapiens
ccaaagugcugcgau

SEQ ID NO: 1270268 - RNA, 17 nt, Homo sapiens
ccaaagugcugggauua

SEQ ID NO: 1270269 - RNA, 19 nt, Homo sapiens
ccaaaguucccacuccuuc

SEQ ID NO: 1270270 - RNA, 13 nt, Homo sapiens
ccaaaguuugcuc

SEQ ID NO: 1270271 - RNA, 18 nt, Homo sapiens
ccaaaguuugcucaagga

SEQ ID NO: 1270272 - RNA, 14 nt, Homo sapiens
ccaaauaacuucag

SEQ ID NO: 1270273 - RNA, 16 nt, Homo sapiens
ccaaaucccagggaag

SEQ ID NO: 1270274 - RNA, 22 nt, Homo sapiens
ccaaaugcagggaggggaggca

SEQ ID NO: 1270275 - RNA, 16 nt, Homo sapiens
ccaaauggcagggaua

SEQ ID NO: 1270276 - RNA, 23 nt, Homo sapiens
ccaaauuagggcaauuggaacaa

SEQ ID NO: 1270277 - RNA, 12 nt, Homo sapiens
ccaaauugcagc

SEQ ID NO: 1270278 - RNA, 13 nt, Homo sapiens
ccaacacccaaag

SEQ ID NO: 1270279 - RNA, 21 nt, Homo sapiens
ccaacacugcucacagccuuu

SEQ ID NO: 1270280 - RNA, 21 nt, Homo sapiens
ccaacacugcugcuccagugc

SEQ ID NO: 1270281 - RNA, 12 nt, Homo sapiens
ccaacacuuugg

SEQ ID NO: 1270282 - RNA, 21 nt, Homo sapiens
ccaacagaagcuuccauucca

SEQ ID NO: 1270283 - RNA, 18 nt, Homo sapiens
ccaacagucaaaacagag

SEQ ID NO: 1270284 - RNA, 16 nt, Homo sapiens
ccaacauuucucacug

SEQ ID NO: 1270285 - RNA, 18 nt, Homo sapiens
ccaacccacgaggaccau

SEQ ID NO: 1270286 - RNA, 14 nt, Homo sapiens
ccaacccacuggcc

SEQ ID NO: 1270287 - RNA, 14 nt, Homo sapiens
ccaaccuccugacc

SEQ ID NO: 1270288 - RNA, 15 nt, Homo sapiens
ccaacgacaaagcca

SEQ ID NO: 1270289 - RNA, 18 nt, Homo sapiens
ccaacgaggugaucuagc

SEQ ID NO: 1270290 - RNA, 15 nt, Homo sapiens
ccaacggcaacagca

SEQ ID NO: 1270291 - RNA, 18 nt, Homo sapiens
ccaacuagacauucuguc

SEQ ID NO: 1270292 - RNA, 13 nt, Homo sapiens
ccaacuauaauua

SEQ ID NO: 1270293 - RNA, 20 nt, Homo sapiens
ccaacugaguguuauuugca

SEQ ID NO: 1270294 - RNA, 22 nt, Homo sapiens
ccaacugaguguuauuugcaca

SEQ ID NO: 1270295 - RNA, 19 nt, Homo sapiens
ccaacugcaaaaaaagccu

SEQ ID NO: 1270296 - RNA, 14 nt, Homo sapiens
acucuuccaccucc

SEQ ID NO: 1270297 - RNA, 17 nt, Homo sapiens
acucuuccaccucccaa

SEQ ID NO: 1270298 - RNA, 17 nt, Homo sapiens
acucuucuaacacaaaa

SEQ ID NO: 1270299 - RNA, 20 nt, Homo sapiens
acucuugugaauuauucuga

SEQ ID NO: 1270300 - RNA, 21 nt, Homo sapiens
acucuugugaauuauucugau

SEQ ID NO: 1270301 - RNA, 18 nt, Homo sapiens
acugaaaacuuagccaga

SEQ ID NO: 1270302 - RNA, 13 nt, Homo sapiens
acugaaacaaaug

SEQ ID NO: 1270303 - RNA, 15 nt, Homo sapiens
acugaaagacaccau

SEQ ID NO: 1270304 - RNA, 15 nt, Homo sapiens
acugaaccauuccaa

SEQ ID NO: 1270305 - RNA, 20 nt, Homo sapiens
acugaaccauuccaacuuca

SEQ ID NO: 1270306 - RNA, 19 nt, Homo sapiens
acugaacgacaaagcaugg

SEQ ID NO: 1270307 - RNA, 16 nt, Homo sapiens
acugaacuucagagca

SEQ ID NO: 1270308 - RNA, 21 nt, Homo sapiens
acugaagccugcguuggucca

SEQ ID NO: 1270309 - RNA, 13 nt, Homo sapiens
acugaaggacaca

SEQ ID NO: 1270310 - RNA, 19 nt, Homo sapiens
acugaaggacacagcagug

SEQ ID NO: 1270311 - RNA, 16 nt, Homo sapiens
acugaaggcauaugca

SEQ ID NO: 1270312 - RNA, 18 nt, Homo sapiens
acugaaggcauaugcaca

SEQ ID NO: 1270313 - RNA, 14 nt, Homo sapiens
acugaaguuucaca

SEQ ID NO: 1270314 - RNA, 22 nt, Homo sapiens
acugaaucuucaagaccaaagc

SEQ ID NO: 1270315 - RNA, 17 nt, Homo sapiens
acugacaaccucaucca

SEQ ID NO: 1270316 - RNA, 19 nt, Homo sapiens
acugacaaccucauccagg

SEQ ID NO: 1270317 - RNA, 12 nt, Homo sapiens
acugacacagga

SEQ ID NO: 1270318 - RNA, 19 nt, Homo sapiens
acugacacuuugccagaaa

SEQ ID NO: 1270319 - RNA, 18 nt, Homo sapiens
acugacaguaaaucucac

SEQ ID NO: 1270320 - RNA, 16 nt, Homo sapiens
acugacauuguuggcc

SEQ ID NO: 1270321 - RNA, 15 nt, Homo sapiens
acugaccagccucca

SEQ ID NO: 1270322 - RNA, 19 nt, Homo sapiens
acugaccagccuccaugcu

SEQ ID NO: 1270323 - RNA, 17 nt, Homo sapiens
acugaccauauugugcu

SEQ ID NO: 1270324 - RNA, 16 nt, Homo sapiens
acugacuccuguggag

SEQ ID NO: 1270325 - RNA, 17 nt, Homo sapiens
acugacugcaagcccca

SEQ ID NO: 1270326 - RNA, 19 nt, Homo sapiens
acugagaagugcacuuuaa

SEQ ID NO: 1270327 - RNA, 13 nt, Homo sapiens
acugagauuacag

SEQ ID NO: 1270328 - RNA, 14 nt, Homo sapiens
acugaggaccagcc

SEQ ID NO: 1270329 - RNA, 12 nt, Homo sapiens
acugagggccac

SEQ ID NO: 1270330 - RNA, 19 nt, Homo sapiens
acugagguugggguguacu

SEQ ID NO: 1270331 - RNA, 18 nt, Homo sapiens
acugaguccucguagcca

SEQ ID NO: 1270332 - RNA, 18 nt, Homo sapiens
acugaguguuauuugcac

SEQ ID NO: 1270333 - RNA, 21 nt, Homo sapiens
acugauagaugucuauucuug

SEQ ID NO: 1270334 - RNA, 13 nt, Homo sapiens
acugaucacccaa

SEQ ID NO: 1270335 - RNA, 20 nt, Homo sapiens
acugaucacccaaugcauca

SEQ ID NO: 1270336 - RNA, 12 nt, Homo sapiens
acugaugaaggc

SEQ ID NO: 1270337 - RNA, 15 nt, Homo sapiens
acugaugcuguucuc

SEQ ID NO: 1270338 - RNA, 16 nt, Homo sapiens
acugauguuacuagcc

SEQ ID NO: 1270339 - RNA, 18 nt, Homo sapiens
acugauguuacuagccuc

SEQ ID NO: 1270340 - RNA, 19 nt, Homo sapiens
acugauguuacuagccucu

SEQ ID NO: 1270341 - RNA, 24 nt, Homo sapiens
acugauuccuuuaugaugacugcu

SEQ ID NO: 1270342 - RNA, 15 nt, Homo sapiens
acugauucucuacau

SEQ ID NO: 1270343 - RNA, 19 nt, Homo sapiens
acugauuucacaacagauc

SEQ ID NO: 1270344 - RNA, 16 nt, Homo sapiens
acugauuugauaccau

SEQ ID NO: 1270345 - RNA, 15 nt, Homo sapiens
acugcacacugccug

SEQ ID NO: 1270346 - RNA, 19 nt, Homo sapiens
acugcacagugcaucucag

SEQ ID NO: 1270347 - RNA, 21 nt, Homo sapiens
acugcaccuggcccagaugau

SEQ ID NO: 1270348 - RNA, 20 nt, Homo sapiens
acugcacuccagccugggug

SEQ ID NO: 1270349 - RNA, 22 nt, Homo sapiens
acugcagaacagcaucauguca

SEQ ID NO: 1270350 - RNA, 21 nt, Homo sapiens
acugcauaugaaaggacacua

SEQ ID NO: 1270351 - RNA, 19 nt, Homo sapiens
acugcauucacacauggca

SEQ ID NO: 1270352 - RNA, 18 nt, Homo sapiens
acugccaaauaaacagcu

SEQ ID NO: 1270353 - RNA, 13 nt, Homo sapiens
acugccagcagca

SEQ ID NO: 1270354 - RNA, 13 nt, Homo sapiens
acugccaucuuag

SEQ ID NO: 1270355 - RNA, 19 nt, Homo sapiens
acugccccagacacagugc

SEQ ID NO: 1270356 - RNA, 21 nt, Homo sapiens
acugccccccgaggcugcuag

SEQ ID NO: 1270357 - RNA, 17 nt, Homo sapiens
acugcccccuccacugg

SEQ ID NO: 1270358 - RNA, 19 nt, Homo sapiens
acugcccgcacacccucac

SEQ ID NO: 1270359 - RNA, 12 nt, Homo sapiens
acugcccuggca

SEQ ID NO: 1270360 - RNA, 19 nt, Homo sapiens
acugccucgaaacacagaa

SEQ ID NO: 1270361 - RNA, 14 nt, Homo sapiens
acugccucugccac

SEQ ID NO: 1270362 - RNA, 13 nt, Homo sapiens
acugccucuggaa

SEQ ID NO: 1270363 - RNA, 19 nt, Homo sapiens
acugccuguagagacaaua

SEQ ID NO: 1270364 - RNA, 15 nt, Homo sapiens
acugcuaaauccuca

SEQ ID NO: 1270365 - RNA, 17 nt, Homo sapiens
acugcuacaaucaaggc

SEQ ID NO: 1270366 - RNA, 22 nt, Homo sapiens
acugcugcccagccuccaagcu

SEQ ID NO: 1270367 - RNA, 19 nt, Homo sapiens
acugcugcuccagugcagg

SEQ ID NO: 1270368 - RNA, 19 nt, Homo sapiens
acugcuggaaaaagcccua

SEQ ID NO: 1270369 - RNA, 18 nt, Homo sapiens
acugcuggacgucuuucu

SEQ ID NO: 1270370 - RNA, 20 nt, Homo sapiens
acugcuggagucuggcuuua

SEQ ID NO: 1270371 - RNA, 15 nt, Homo sapiens
acugcuguaaacaca

SEQ ID NO: 1270372 - RNA, 15 nt, Homo sapiens
acugcugucuuccaa

SEQ ID NO: 1270373 - RNA, 12 nt, Homo sapiens
acugcugugaau

SEQ ID NO: 1270374 - RNA, 20 nt, Homo sapiens
acugcuuuccagccugggca

SEQ ID NO: 1270375 - RNA, 18 nt, Homo sapiens
acugcuuucuguuccaaa

SEQ ID NO: 1270376 - RNA, 17 nt, Homo sapiens
acuggaagaaagcaaca

SEQ ID NO: 1270377 - RNA, 15 nt, Homo sapiens
acuggaagacacuuc

SEQ ID NO: 1270378 - RNA, 21 nt, Homo sapiens
acuggaagagaguuccgggaa

SEQ ID NO: 1270379 - RNA, 23 nt, Homo sapiens
acuggaauauaauuucaaaccac

SEQ ID NO: 1270380 - RNA, 18 nt, Homo sapiens
acuggacauuuaacuuuu

SEQ ID NO: 1270381 - RNA, 12 nt, Homo sapiens
acuggacuaugc

SEQ ID NO: 1270382 - RNA, 16 nt, Homo sapiens
acuggacucauuauca

SEQ ID NO: 1270383 - RNA, 13 nt, Homo sapiens
acuggacugugug

SEQ ID NO: 1270384 - RNA, 15 nt, Homo sapiens
agcuauccacagcuu

SEQ ID NO: 1270385 - RNA, 21 nt, Homo sapiens
agcuaugaucagaagacuuua

SEQ ID NO: 1270386 - RNA, 20 nt, Homo sapiens
agcuaugaucgcgccacuac

SEQ ID NO: 1270387 - RNA, 22 nt, Homo sapiens
agcuauuuucaacauaacugaa

SEQ ID NO: 1270388 - RNA, 19 nt, Homo sapiens
agcucaagucuucccugau

SEQ ID NO: 1270389 - RNA, 18 nt, Homo sapiens
agcucacagugacauuac

SEQ ID NO: 1270390 - RNA, 20 nt, Homo sapiens
agcucacucuggauuccaca

SEQ ID NO: 1270391 - RNA, 14 nt, Homo sapiens
agcucacugcugau

SEQ ID NO: 1270392 - RNA, 16 nt, Homo sapiens
agcucagacuugccag

SEQ ID NO: 1270393 - RNA, 20 nt, Homo sapiens
agcucagcaacaaggcugca

SEQ ID NO: 1270394 - RNA, 18 nt, Homo sapiens
agcucagcauuuccacac

SEQ ID NO: 1270395 - RNA, 19 nt, Homo sapiens
agcucagcauuuccacacc

SEQ ID NO: 1270396 - RNA, 16 nt, Homo sapiens
agcucagcgccagccu

SEQ ID NO: 1270397 - RNA, 11 nt, Homo sapiens
agcucagggac

SEQ ID NO: 1270398 - RNA, 18 nt, Homo sapiens
agcucagguagcacuuua

SEQ ID NO: 1270399 - RNA, 12 nt, Homo sapiens
agcucagguguc

SEQ ID NO: 1270400 - RNA, 16 nt, Homo sapiens
agcucaucugcaaaag

SEQ ID NO: 1270401 - RNA, 13 nt, Homo sapiens
agcuccagugcca

SEQ ID NO: 1270402 - RNA, 18 nt, Homo sapiens
agcuccgcuuucuaccca

SEQ ID NO: 1270403 - RNA, 23 nt, Homo sapiens
agcuccucagcggcuccagcuca

SEQ ID NO: 1270404 - RNA, 13 nt, Homo sapiens
agcuccugccucu

SEQ ID NO: 1270405 - RNA, 22 nt, Homo sapiens
agcuccuggccaggauaauaua

SEQ ID NO: 1270406 - RNA, 17 nt, Homo sapiens
agcuccuguugucauga

SEQ ID NO: 1270407 - RNA, 13 nt, Homo sapiens
agcucgagaucau

SEQ ID NO: 1270408 - RNA, 13 nt, Homo sapiens
agcucgugugccu

SEQ ID NO: 1270409 - RNA, 15 nt, Homo sapiens
agcucuaaguuuuga

SEQ ID NO: 1270410 - RNA, 14 nt, Homo sapiens
agcucuacugaggu

SEQ ID NO: 1270411 - RNA, 18 nt, Homo sapiens
agcucucacaugcacagg

SEQ ID NO: 1270412 - RNA, 15 nt, Homo sapiens
agcucuccaccagcu

SEQ ID NO: 1270413 - RNA, 18 nt, Homo sapiens
agcucugauugcagcaca

SEQ ID NO: 1270414 - RNA, 18 nt, Homo sapiens
agcucuggagaacagugg

SEQ ID NO: 1270415 - RNA, 15 nt, Homo sapiens
agcucuggggggcag

SEQ ID NO: 1270416 - RNA, 14 nt, Homo sapiens
agcucuggugaccu

SEQ ID NO: 1270417 - RNA, 14 nt, Homo sapiens
agcucuuacuuuua

SEQ ID NO: 1270418 - RNA, 22 nt, Homo sapiens
agcugaagaacuuggcacacuc

SEQ ID NO: 1270419 - RNA, 19 nt, Homo sapiens
agcugacaauuuccaaagc

SEQ ID NO: 1270420 - RNA, 14 nt, Homo sapiens
agcugacaucucag

SEQ ID NO: 1270421 - RNA, 17 nt, Homo sapiens
agcugaccagacacugc

SEQ ID NO: 1270422 - RNA, 13 nt, Homo sapiens
agcugacccaucu

SEQ ID NO: 1270423 - RNA, 13 nt, Homo sapiens
agcugacuguucu

SEQ ID NO: 1270424 - RNA, 14 nt, Homo sapiens
agcugagacaggcc

SEQ ID NO: 1270425 - RNA, 22 nt, Homo sapiens
agcugagacuacaagugugugc

SEQ ID NO: 1270426 - RNA, 20 nt, Homo sapiens
agcugagaucacaccacugu

SEQ ID NO: 1270427 - RNA, 20 nt, Homo sapiens
agcugagaucgugcuacugc

SEQ ID NO: 1270428 - RNA, 15 nt, Homo sapiens
agcugagauuccugg

SEQ ID NO: 1270429 - RNA, 20 nt, Homo sapiens
agcugagauugcacuauugc

SEQ ID NO: 1270430 - RNA, 15 nt, Homo sapiens
agcugaggccuugcc

SEQ ID NO: 1270431 - RNA, 18 nt, Homo sapiens
agcugaguuuaacaugug

SEQ ID NO: 1270432 - RNA, 21 nt, Homo sapiens
agcugauugggcaccugacca

SEQ ID NO: 1270433 - RNA, 16 nt, Homo sapiens
agcugauuugauacca

SEQ ID NO: 1270434 - RNA, 17 nt, Homo sapiens
agcugauuugauaccau

SEQ ID NO: 1270435 - RNA, 18 nt, Homo sapiens
agcugauuuuaacaauaa

SEQ ID NO: 1270436 - RNA, 13 nt, Homo sapiens
agcugcaccugcc

SEQ ID NO: 1270437 - RNA, 19 nt, Homo sapiens
agcugcagaugccacaccu

SEQ ID NO: 1270438 - RNA, 21 nt, Homo sapiens
agcugcagcucuccaccagcu

SEQ ID NO: 1270439 - RNA, 12 nt, Homo sapiens
agcugcauauga

SEQ ID NO: 1270440 - RNA, 12 nt, Homo sapiens
agcugcaucauc

SEQ ID NO: 1270441 - RNA, 19 nt, Homo sapiens
agcugccaucgaccuggag

SEQ ID NO: 1270442 - RNA, 11 nt, Homo sapiens
agcugccauuu

SEQ ID NO: 1270443 - RNA, 16 nt, Homo sapiens
agcugccucacuuccu

SEQ ID NO: 1270444 - RNA, 15 nt, Homo sapiens
agcugccucugcucc

SEQ ID NO: 1270445 - RNA, 19 nt, Homo sapiens
agcugccugcugccauagc

SEQ ID NO: 1270446 - RNA, 19 nt, Homo sapiens
agcugccuucccuagcuuu

SEQ ID NO: 1270447 - RNA, 19 nt, Homo sapiens
agcugcuauccccaucucc

SEQ ID NO: 1270448 - RNA, 20 nt, Homo sapiens
agcugcucugaaaucuccuu

SEQ ID NO: 1270449 - RNA, 22 nt, Homo sapiens
agcuggaagggucaacaucuuu

SEQ ID NO: 1270450 - RNA, 18 nt, Homo sapiens
agcuggaccaguggugcc

SEQ ID NO: 1270451 - RNA, 14 nt, Homo sapiens
agcuggcaccagaa

SEQ ID NO: 1270452 - RNA, 16 nt, Homo sapiens
agcuggccucucuagc

SEQ ID NO: 1270453 - RNA, 16 nt, Homo sapiens
agcuggcucugugagg

SEQ ID NO: 1270454 - RNA, 14 nt, Homo sapiens
agcugggagcacug

SEQ ID NO: 1270455 - RNA, 22 nt, Homo sapiens
agcugggcaaagccacaaggcu

SEQ ID NO: 1270456 - RNA, 22 nt, Homo sapiens
agcuggggaccugguacccucc

SEQ ID NO: 1270457 - RNA, 17 nt, Homo sapiens
agcugggguugugcaag

SEQ ID NO: 1270458 - RNA, 21 nt, Homo sapiens
agcuggugcuccaagcacagg

SEQ ID NO: 1270459 - RNA, 15 nt, Homo sapiens
agcugguggcaauaa

SEQ ID NO: 1270460 - RNA, 19 nt, Homo sapiens
agcuguaaaacgcugucaa

SEQ ID NO: 1270461 - RNA, 15 nt, Homo sapiens
agcuguaaacauauu

SEQ ID NO: 1270462 - RNA, 15 nt, Homo sapiens
acccuggaaauggac

SEQ ID NO: 1270463 - RNA, 19 nt, Homo sapiens
acccuggucucaucagucc

SEQ ID NO: 1270464 - RNA, 18 nt, Homo sapiens
acccuguagcgccagugu

SEQ ID NO: 1270465 - RNA, 18 nt, Homo sapiens
acccugucaccuagcuca

SEQ ID NO: 1270466 - RNA, 19 nt, Homo sapiens
acccugucaccuagcucaa

SEQ ID NO: 1270467 - RNA, 14 nt, Homo sapiens
acccuguuuuacaa

SEQ ID NO: 1270468 - RNA, 13 nt, Homo sapiens
acccuucaacgcu

SEQ ID NO: 1270469 - RNA, 20 nt, Homo sapiens
acccuucccgccucccucuc

SEQ ID NO: 1270470 - RNA, 23 nt, Homo sapiens
acccuugaaccaauaaaggaaca

SEQ ID NO: 1270471 - RNA, 17 nt, Homo sapiens
acccuugacaccugcug

SEQ ID NO: 1270472 - RNA, 15 nt, Homo sapiens
acccuugauuauacu

SEQ ID NO: 1270473 - RNA, 16 nt, Homo sapiens
acccuuggacaagaca

SEQ ID NO: 1270474 - RNA, 22 nt, Homo sapiens
acccuugugagagcccauuccc

SEQ ID NO: 1270475 - RNA, 20 nt, Homo sapiens
acccuuuagacuguagccug

SEQ ID NO: 1270476 - RNA, 22 nt, Homo sapiens
acccuuugccuuucuucugccc

SEQ ID NO: 1270477 - RNA, 12 nt, Homo sapiens
acccuuuuccau

SEQ ID NO: 1270478 - RNA, 15 nt, Homo sapiens
accgaaaucccucag

SEQ ID NO: 1270479 - RNA, 16 nt, Homo sapiens
accgacagcucuuacu

SEQ ID NO: 1270480 - RNA, 16 nt, Homo sapiens
accgagucucuucucc

SEQ ID NO: 1270481 - RNA, 13 nt, Homo sapiens
accgagugcaaug

SEQ ID NO: 1270482 - RNA, 12 nt, Homo sapiens
accgcagggaca

SEQ ID NO: 1270483 - RNA, 22 nt, Homo sapiens
accgcagucgucgcacagucuc

SEQ ID NO: 1270484 - RNA, 17 nt, Homo sapiens
accgcccaucaggguuc

SEQ ID NO: 1270485 - RNA, 14 nt, Homo sapiens
accgcccuccucac

SEQ ID NO: 1270486 - RNA, 18 nt, Homo sapiens
accgcugauaagcauuga

SEQ ID NO: 1270487 - RNA, 21 nt, Homo sapiens
accgcugggugguuuuuuccc

SEQ ID NO: 1270488 - RNA, 18 nt, Homo sapiens
accggcugguggagcugc

SEQ ID NO: 1270489 - RNA, 18 nt, Homo sapiens
accgggacuucaaagccg

SEQ ID NO: 1270490 - RNA, 21 nt, Homo sapiens
accgggacuucaaagccguga

SEQ ID NO: 1270491 - RNA, 21 nt, Homo sapiens
accggggccagcaccacuucc

SEQ ID NO: 1270492 - RNA, 19 nt, Homo sapiens
accggugcaugaugcugcc

SEQ ID NO: 1270493 - RNA, 16 nt, Homo sapiens
accguacaucugcaau

SEQ ID NO: 1270494 - RNA, 17 nt, Homo sapiens
accgucacccaacauca

SEQ ID NO: 1270495 - RNA, 20 nt, Homo sapiens
accguccucagcaguccaca

SEQ ID NO: 1270496 - RNA, 14 nt, Homo sapiens
accguccuggagcu

SEQ ID NO: 1270497 - RNA, 22 nt, Homo sapiens
accgugauggagaggacagagc

SEQ ID NO: 1270498 - RNA, 19 nt, Homo sapiens
accgugcagugugcauuuu

SEQ ID NO: 1270499 - RNA, 16 nt, Homo sapiens
accuaaccacuuagca

SEQ ID NO: 1270500 - RNA, 19 nt, Homo sapiens
accuaaccacuuagcaugu

SEQ ID NO: 1270501 - RNA, 19 nt, Homo sapiens
accuaauucgaugaaggcu

SEQ ID NO: 1270502 - RNA, 15 nt, Homo sapiens
accuacaagauuucc

SEQ ID NO: 1270503 - RNA, 22 nt, Homo sapiens
accuacaauuuucccuugauaa

SEQ ID NO: 1270504 - RNA, 15 nt, Homo sapiens
accuacacacuguca

SEQ ID NO: 1270505 - RNA, 14 nt, Homo sapiens
accuacagagcagc

SEQ ID NO: 1270506 - RNA, 19 nt, Homo sapiens
accuacagagcagccaggu

SEQ ID NO: 1270507 - RNA, 14 nt, Homo sapiens
accuacaugucuuu

SEQ ID NO: 1270508 - RNA, 16 nt, Homo sapiens
accuacauuaucucac

SEQ ID NO: 1270509 - RNA, 14 nt, Homo sapiens
accuacgugccacu

SEQ ID NO: 1270510 - RNA, 12 nt, Homo sapiens
accuacugcuga

SEQ ID NO: 1270511 - RNA, 19 nt, Homo sapiens
accuacugcuuacuguugc

SEQ ID NO: 1270512 - RNA, 16 nt, Homo sapiens
accuagaacacuaacu

SEQ ID NO: 1270513 - RNA, 16 nt, Homo sapiens
accuagaauagucuca

SEQ ID NO: 1270514 - RNA, 20 nt, Homo sapiens
accuagcaaagcuccugccu

SEQ ID NO: 1270515 - RNA, 17 nt, Homo sapiens
accuagcaauuccauca

SEQ ID NO: 1270516 - RNA, 11 nt, Homo sapiens
accuagcuuua

SEQ ID NO: 1270517 - RNA, 14 nt, Homo sapiens
accuagggcacuuu

SEQ ID NO: 1270518 - RNA, 22 nt, Homo sapiens
accuagggcacuuuaagucagu

SEQ ID NO: 1270519 - RNA, 23 nt, Homo sapiens
accuagucagguuagcugaaccg

SEQ ID NO: 1270520 - RNA, 19 nt, Homo sapiens
accuaguccccagccugcu

SEQ ID NO: 1270521 - RNA, 14 nt, Homo sapiens
accuauacauuaua

SEQ ID NO: 1270522 - RNA, 21 nt, Homo sapiens
accuauguguccucuaaguca

SEQ ID NO: 1270523 - RNA, 16 nt, Homo sapiens
accucaaaaugucuaa

SEQ ID NO: 1270524 - RNA, 20 nt, Homo sapiens
accucacaggccccaggaaa

SEQ ID NO: 1270525 - RNA, 13 nt, Homo sapiens
accucacagugac

SEQ ID NO: 1270526 - RNA, 12 nt, Homo sapiens
accucaccaaaa

SEQ ID NO: 1270527 - RNA, 22 nt, Homo sapiens
accucacuuuaggcagcuguaa

SEQ ID NO: 1270528 - RNA, 16 nt, Homo sapiens
accucaggcagcucaa

SEQ ID NO: 1270529 - RNA, 23 nt, Homo sapiens
accucagguugcugguugcugug

SEQ ID NO: 1270530 - RNA, 17 nt, Homo sapiens
accucagugucauuuau

SEQ ID NO: 1270531 - RNA, 22 nt, Homo sapiens
accucagugucauuuaugaaaa

SEQ ID NO: 1270532 - RNA, 21 nt, Homo sapiens
accucaguucccucuugcuca

SEQ ID NO: 1270533 - RNA, 15 nt, Homo sapiens
accucaucccaugag

SEQ ID NO: 1270534 - RNA, 21 nt, Homo sapiens
accucaucuguggagcugcca

SEQ ID NO: 1270535 - RNA, 14 nt, Homo sapiens
accuccaacuggau

SEQ ID NO: 1270536 - RNA, 14 nt, Homo sapiens
accucccacugccc

SEQ ID NO: 1270537 - RNA, 16 nt, Homo sapiens
accucccauuacuuug

SEQ ID NO: 1270538 - RNA, 18 nt, Homo sapiens
accucccauuacuuugau

SEQ ID NO: 1270539 - RNA, 20 nt, Homo sapiens
accuccccagccccuagccc

SEQ ID NO: 1270540 - RNA, 23 nt, Homo sapiens
accuccccagccccuagcccagg

SEQ ID NO: 1270541 - RNA, 16 nt, Homo sapiens
accucccgaagccacc

SEQ ID NO: 1270542 - RNA, 20 nt, Homo sapiens
accuccgagacaguccagug

SEQ ID NO: 1270543 - RNA, 20 nt, Homo sapiens
accuccuccucuggacaaag

SEQ ID NO: 1270544 - RNA, 18 nt, Homo sapiens
accuccuuggguagugag

SEQ ID NO: 1270545 - RNA, 20 nt, Homo sapiens
accucggccucccaaagugc

SEQ ID NO: 1270546 - RNA, 22 nt, Homo sapiens
accucgggaaacuuagaucauc

SEQ ID NO: 1270547 - RNA, 22 nt, Homo sapiens
accucuccuucaugacagccuc

SEQ ID NO: 1270548 - RNA, 10 nt, Homo sapiens
accucugcau

SEQ ID NO: 1270549 - RNA, 17 nt, Homo sapiens
accucuggacuggcuag

SEQ ID NO: 1270550 - RNA, 22 nt, Homo sapiens
accucuggggaccccaaccuca

SEQ ID NO: 1270551 - RNA, 20 nt, Homo sapiens
accucugguccacacuagaa

SEQ ID NO: 1270552 - RNA, 22 nt, Homo sapiens
accucugucauuuguugugaug

SEQ ID NO: 1270553 - RNA, 14 nt, Homo sapiens
accucuguggugug

SEQ ID NO: 1270554 - RNA, 16 nt, Homo sapiens
accucuguucauuuca

SEQ ID NO: 1270555 - RNA, 12 nt, Homo sapiens
accucuucacuc

SEQ ID NO: 1270556 - RNA, 15 nt, Homo sapiens
accucuucuaugcaa

SEQ ID NO: 1270557 - RNA, 20 nt, Homo sapiens
accucuucuaugcaagccuu

SEQ ID NO: 1270558 - RNA, 20 nt, Homo sapiens
accugaaauuuauucacaua

SEQ ID NO: 1270559 - RNA, 14 nt, Homo sapiens
accugaagugugca

SEQ ID NO: 1270560 - RNA, 16 nt, Homo sapiens
accugacucaggccag

SEQ ID NO: 1270561 - RNA, 13 nt, Homo sapiens
accugacucuugc

SEQ ID NO: 1270562 - RNA, 17 nt, Homo sapiens
accugagaaauggccaa

SEQ ID NO: 1270563 - RNA, 21 nt, Homo sapiens
accugagggugcuuuguguaa

SEQ ID NO: 1270564 - RNA, 22 nt, Homo sapiens
accugaucacuagccugucauc

SEQ ID NO: 1270565 - RNA, 17 nt, Homo sapiens
accugaugcagagccuu

SEQ ID NO: 1270566 - RNA, 22 nt, Homo sapiens
accugauggaaguaaagccuca

SEQ ID NO: 1270567 - RNA, 15 nt, Homo sapiens
accugcacaccuacg

SEQ ID NO: 1270568 - RNA, 17 nt, Homo sapiens
accugcacuuacaggcc

SEQ ID NO: 1270569 - RNA, 21 nt, Homo sapiens
accugcagcccauggugagcu

SEQ ID NO: 1270570 - RNA, 13 nt, Homo sapiens
accugcaggccaa

SEQ ID NO: 1270571 - RNA, 12 nt, Homo sapiens
accugcaggcug

SEQ ID NO: 1270572 - RNA, 13 nt, Homo sapiens
accugccaugcca

SEQ ID NO: 1270573 - RNA, 21 nt, Homo sapiens
accugcccaaggaugcuguca

SEQ ID NO: 1270574 - RNA, 20 nt, Homo sapiens
accugccugcaucugugaaa

SEQ ID NO: 1270575 - RNA, 19 nt, Homo sapiens
accugcucuccucuugcca

SEQ ID NO: 1270576 - RNA, 16 nt, Homo sapiens
accugcuuugugagcc

SEQ ID NO: 1270577 - RNA, 19 nt, Homo sapiens
accuggaggacagcuggac

SEQ ID NO: 1270578 - RNA, 17 nt, Homo sapiens
accuggauccagcacug

SEQ ID NO: 1270579 - RNA, 22 nt, Homo sapiens
accuggaugaucacuaauacua

SEQ ID NO: 1270580 - RNA, 16 nt, Homo sapiens
accuggggagagccug

SEQ ID NO: 1270581 - RNA, 23 nt, Homo sapiens
accugguggcuacgaaucuuccg

SEQ ID NO: 1270582 - RNA, 16 nt, Homo sapiens
accuguaaucauauaa

SEQ ID NO: 1270583 - RNA, 15 nt, Homo sapiens
accuguaaucccagc

SEQ ID NO: 1270584 - RNA, 19 nt, Homo sapiens
accuguagccaucugcaca

SEQ ID NO: 1270585 - RNA, 13 nt, Homo sapiens
accuguaguccca

SEQ ID NO: 1270586 - RNA, 18 nt, Homo sapiens
accugucuaggucuccuc

SEQ ID NO: 1270587 - RNA, 12 nt, Homo sapiens
acuaagcacaaa

SEQ ID NO: 1270588 - RNA, 19 nt, Homo sapiens
acuaagcauagcaaacaga

SEQ ID NO: 1270589 - RNA, 16 nt, Homo sapiens
acuaaggaaucuuucu

SEQ ID NO: 1270590 - RNA, 22 nt, Homo sapiens
acuaaggugugcucugaucauc

SEQ ID NO: 1270591 - RNA, 16 nt, Homo sapiens
acuaauccucucugca

SEQ ID NO: 1270592 - RNA, 17 nt, Homo sapiens
acuaaucgaaugaacaa

SEQ ID NO: 1270593 - RNA, 17 nt, Homo sapiens
acuaauggaaauauuau

SEQ ID NO: 1270594 - RNA, 15 nt, Homo sapiens
acuaauuuuacaugu

SEQ ID NO: 1270595 - RNA, 15 nt, Homo sapiens
acuacaaacuucaaa

SEQ ID NO: 1270596 - RNA, 17 nt, Homo sapiens
acuacaacgaacacaag

SEQ ID NO: 1270597 - RNA, 13 nt, Homo sapiens
acuacaccagggu

SEQ ID NO: 1270598 - RNA, 21 nt, Homo sapiens
acuacaccuggcugagguucc

SEQ ID NO: 1270599 - RNA, 21 nt, Homo sapiens
acuacagaauaauguguuaaa

SEQ ID NO: 1270600 - RNA, 20 nt, Homo sapiens
acuacaggcgccugccagca

SEQ ID NO: 1270601 - RNA, 14 nt, Homo sapiens
acuacagggagaaa

SEQ ID NO: 1270602 - RNA, 22 nt, Homo sapiens
acuacagggagaaaauccaggu

SEQ ID NO: 1270603 - RNA, 16 nt, Homo sapiens
acuacauaacuuccua

SEQ ID NO: 1270604 - RNA, 17 nt, Homo sapiens
acuacaugcaaggcacu

SEQ ID NO: 1270605 - RNA, 20 nt, Homo sapiens
acuacaugcaaggcacugua

SEQ ID NO: 1270606 - RNA, 21 nt, Homo sapiens
acuacaugugacuggcaguau

SEQ ID NO: 1270607 - RNA, 18 nt, Homo sapiens
acuaccauucuauuccau

SEQ ID NO: 1270608 - RNA, 20 nt, Homo sapiens
acuaccuaacauuauuuauu

SEQ ID NO: 1270609 - RNA, 17 nt, Homo sapiens
acuaccucccacugagg

SEQ ID NO: 1270610 - RNA, 19 nt, Homo sapiens
acuacgguugaucuugcaa

SEQ ID NO: 1270611 - RNA, 13 nt, Homo sapiens
acuacuaccucuu

SEQ ID NO: 1270612 - RNA, 14 nt, Homo sapiens
acuacuauauugau

SEQ ID NO: 1270613 - RNA, 15 nt, Homo sapiens
acuacucagugcaua

SEQ ID NO: 1270614 - RNA, 21 nt, Homo sapiens
acuacuccucugcagugccuu

SEQ ID NO: 1270615 - RNA, 22 nt, Homo sapiens
acuacuccucugcagugccuug

SEQ ID NO: 1270616 - RNA, 15 nt, Homo sapiens
acuacucugugccag

SEQ ID NO: 1270617 - RNA, 15 nt, Homo sapiens
acuacugacaugugg

SEQ ID NO: 1270618 - RNA, 14 nt, Homo sapiens
acuacugugaucag

SEQ ID NO: 1270619 - RNA, 21 nt, Homo sapiens
acuacuuuaauaaagaauuaa

SEQ ID NO: 1270620 - RNA, 17 nt, Homo sapiens
acuagaagcaacuagga

SEQ ID NO: 1270621 - RNA, 18 nt, Homo sapiens
acuagaaugcuuuuguua

SEQ ID NO: 1270622 - RNA, 16 nt, Homo sapiens
acuagagucugaacag

SEQ ID NO: 1270623 - RNA, 18 nt, Homo sapiens
acuagccaaaccaggacc

SEQ ID NO: 1270624 - RNA, 16 nt, Homo sapiens
acuagccacugagaag

SEQ ID NO: 1270625 - RNA, 22 nt, Homo sapiens
acuagccaggaaguacuuccac

SEQ ID NO: 1270626 - RNA, 16 nt, Homo sapiens
acuagccugugcacgc

SEQ ID NO: 1270627 - RNA, 21 nt, Homo sapiens
acuagcuuuugccaguauuau

SEQ ID NO: 1270628 - RNA, 15 nt, Homo sapiens
augcuucgugccaca

SEQ ID NO: 1270629 - RNA, 12 nt, Homo sapiens
augcuucuagcc

SEQ ID NO: 1270630 - RNA, 23 nt, Homo sapiens
augcuugauuuagguagccuugu

SEQ ID NO: 1270631 - RNA, 20 nt, Homo sapiens
augcuuuucugccacuccau

SEQ ID NO: 1270632 - RNA, 13 nt, Homo sapiens
auggaaaaaccau

SEQ ID NO: 1270633 - RNA, 15 nt, Homo sapiens
auggaaaacuguguu

SEQ ID NO: 1270634 - RNA, 15 nt, Homo sapiens
auggaacucagagau

SEQ ID NO: 1270635 - RNA, 14 nt, Homo sapiens
auggaacuguuggc

SEQ ID NO: 1270636 - RNA, 18 nt, Homo sapiens
auggaagcaauugcucau

SEQ ID NO: 1270637 - RNA, 21 nt, Homo sapiens
auggaaggaagaaaagcugcc

SEQ ID NO: 1270638 - RNA, 14 nt, Homo sapiens
auggaaggugcuac

SEQ ID NO: 1270639 - RNA, 20 nt, Homo sapiens
auggaaguuuuccuacacuu

SEQ ID NO: 1270640 - RNA, 14 nt, Homo sapiens
auggaaucaauuca

SEQ ID NO: 1270641 - RNA, 17 nt, Homo sapiens
auggaaugcuguguuaa

SEQ ID NO: 1270642 - RNA, 14 nt, Homo sapiens
auggaauuacaugu

SEQ ID NO: 1270643 - RNA, 15 nt, Homo sapiens
auggaauuacaugua

SEQ ID NO: 1270644 - RNA, 12 nt, Homo sapiens
auggacacucca

SEQ ID NO: 1270645 - RNA, 18 nt, Homo sapiens
auggacaugaucuucuuu

SEQ ID NO: 1270646 - RNA, 16 nt, Homo sapiens
auggaccagaagccaa

SEQ ID NO: 1270647 - RNA, 23 nt, Homo sapiens
auggaccagugguuuccagucau

SEQ ID NO: 1270648 - RNA, 22 nt, Homo sapiens
auggacguuauccucucagauu

SEQ ID NO: 1270649 - RNA, 20 nt, Homo sapiens
auggacuuccacugccaucc

SEQ ID NO: 1270650 - RNA, 15 nt, Homo sapiens
auggacuuguauauu

SEQ ID NO: 1270651 - RNA, 16 nt, Homo sapiens
auggagaggacagagc

SEQ ID NO: 1270652 - RNA, 21 nt, Homo sapiens
auggagcagccuggagaccca

SEQ ID NO: 1270653 - RNA, 17 nt, Homo sapiens
auggagcaggacucuau

SEQ ID NO: 1270654 - RNA, 19 nt, Homo sapiens
auggaggucauacaugcau

SEQ ID NO: 1270655 - RNA, 20 nt, Homo sapiens
auggagguuuccuuuuggaa

SEQ ID NO: 1270656 - RNA, 14 nt, Homo sapiens
auggauauuucuca

SEQ ID NO: 1270657 - RNA, 22 nt, Homo sapiens
auggauccagaacugcacucuu

SEQ ID NO: 1270658 - RNA, 18 nt, Homo sapiens
auggaucccuggggccaa

SEQ ID NO: 1270659 - RNA, 18 nt, Homo sapiens
auggaucuuaaagcauuc

SEQ ID NO: 1270660 - RNA, 17 nt, Homo sapiens
auggaugauucagaaau

SEQ ID NO: 1270661 - RNA, 14 nt, Homo sapiens
auggaugcauuuca

SEQ ID NO: 1270662 - RNA, 13 nt, Homo sapiens
auggauuuaaucc

SEQ ID NO: 1270663 - RNA, 13 nt, Homo sapiens
auggcaaaauuag

SEQ ID NO: 1270664 - RNA, 20 nt, Homo sapiens
auggcaaaggaagguggaug

SEQ ID NO: 1270665 - RNA, 17 nt, Homo sapiens
auggcaauuuagcucuc

SEQ ID NO: 1270666 - RNA, 18 nt, Homo sapiens
auggcacugacaaugggc

SEQ ID NO: 1270667 - RNA, 11 nt, Homo sapiens
auggcacuggc

SEQ ID NO: 1270668 - RNA, 12 nt, Homo sapiens
auggcacuggca

SEQ ID NO: 1270669 - RNA, 17 nt, Homo sapiens
auggcagcugguugcuc

SEQ ID NO: 1270670 - RNA, 18 nt, Homo sapiens
auggcaggugucauauga

SEQ ID NO: 1270671 - RNA, 18 nt, Homo sapiens
auggcauaaccugucuca

SEQ ID NO: 1270672 - RNA, 21 nt, Homo sapiens
auggcauaggccuuagcagua

SEQ ID NO: 1270673 - RNA, 11 nt, Homo sapiens
auggcaucuuc

SEQ ID NO: 1270674 - RNA, 23 nt, Homo sapiens
auggcccccaauaaaggcagcug

SEQ ID NO: 1270675 - RNA, 13 nt, Homo sapiens
auggccucauggg

SEQ ID NO: 1270676 - RNA, 18 nt, Homo sapiens
auggccucuggccaggca

SEQ ID NO: 1270677 - RNA, 16 nt, Homo sapiens
auggccuuugcuuaug

SEQ ID NO: 1270678 - RNA, 24 nt, Homo sapiens
augcaaaauuguuuucacuuguau

SEQ ID NO: 1270679 - RNA, 16 nt, Homo sapiens
augcaaaguagcaauu

SEQ ID NO: 1270680 - RNA, 19 nt, Homo sapiens
augcaaaugagcucugaaa

SEQ ID NO: 1270681 - RNA, 20 nt, Homo sapiens
augcaagugguuuccuggug

SEQ ID NO: 1270682 - RNA, 14 nt, Homo sapiens
augcaaguguuccu

SEQ ID NO: 1270683 - RNA, 22 nt, Homo sapiens
augcaauuuuauuaaaugcauc

SEQ ID NO: 1270684 - RNA, 16 nt, Homo sapiens
augcacaguugccaca

SEQ ID NO: 1270685 - RNA, 17 nt, Homo sapiens
augcacauagcuaucaa

SEQ ID NO: 1270686 - RNA, 20 nt, Homo sapiens
augcacauauggacucugca

SEQ ID NO: 1270687 - RNA, 12 nt, Homo sapiens
augcacauuucu

SEQ ID NO: 1270688 - RNA, 22 nt, Homo sapiens
augcacuauauguuuacacaau

SEQ ID NO: 1270689 - RNA, 20 nt, Homo sapiens
augcacugugggauguguuc

SEQ ID NO: 1270690 - RNA, 20 nt, Homo sapiens
augcagaagcauauuuugcu

SEQ ID NO: 1270691 - RNA, 21 nt, Homo sapiens
augcagcaaggggacaucuua

SEQ ID NO: 1270692 - RNA, 15 nt, Homo sapiens
augcagcccaugccc

SEQ ID NO: 1270693 - RNA, 23 nt, Homo sapiens
augcagcuguggcagaguuacag

SEQ ID NO: 1270694 - RNA, 18 nt, Homo sapiens
augcagugauauggcaga

SEQ ID NO: 1270695 - RNA, 21 nt, Homo sapiens
augcauaaauaugcagugaua

SEQ ID NO: 1270696 - RNA, 17 nt, Homo sapiens
augcauacaaguuucau

SEQ ID NO: 1270697 - RNA, 20 nt, Homo sapiens
augcauaggaaguauggcau

SEQ ID NO: 1270698 - RNA, 17 nt, Homo sapiens
augcaucaaaagacuua

SEQ ID NO: 1270699 - RNA, 12 nt, Homo sapiens
augcaugaacaa

SEQ ID NO: 1270700 - RNA, 23 nt, Homo sapiens
augcauuauuuauugcuguguaa

SEQ ID NO: 1270701 - RNA, 15 nt, Homo sapiens
augcauugcuaaaau

SEQ ID NO: 1270702 - RNA, 22 nt, Homo sapiens
augcauuugauggccaccagcu

SEQ ID NO: 1270703 - RNA, 21 nt, Homo sapiens
augccaaacaggaacaaucca

SEQ ID NO: 1270704 - RNA, 15 nt, Homo sapiens
augccaaauguucca

SEQ ID NO: 1270705 - RNA, 16 nt, Homo sapiens
augccacaaaacugac

SEQ ID NO: 1270706 - RNA, 19 nt, Homo sapiens
augccaccaacacugcuca

SEQ ID NO: 1270707 - RNA, 13 nt, Homo sapiens
augccacccucac

SEQ ID NO: 1270708 - RNA, 22 nt, Homo sapiens
augccagggcuggaagcuuuca

SEQ ID NO: 1270709 - RNA, 17 nt, Homo sapiens
augcccccuccugcaag

SEQ ID NO: 1270710 - RNA, 16 nt, Homo sapiens
augccccggccaccuc

SEQ ID NO: 1270711 - RNA, 20 nt, Homo sapiens
augcccucaggggacuugaa

SEQ ID NO: 1270712 - RNA, 17 nt, Homo sapiens
augcccugugcaugcca

SEQ ID NO: 1270713 - RNA, 22 nt, Homo sapiens
augccgauauacucuagaugaa

SEQ ID NO: 1270714 - RNA, 16 nt, Homo sapiens
augccggggacagaga

SEQ ID NO: 1270715 - RNA, 18 nt, Homo sapiens
augccgguuaaauuccau

SEQ ID NO: 1270716 - RNA, 18 nt, Homo sapiens
augccuccaagccauuca

SEQ ID NO: 1270717 - RNA, 22 nt, Homo sapiens
augccucuggaggccucuggcc

SEQ ID NO: 1270718 - RNA, 23 nt, Homo sapiens
augccuggucccaagacagugag

SEQ ID NO: 1270719 - RNA, 15 nt, Homo sapiens
augccuguaauccca

SEQ ID NO: 1270720 - RNA, 19 nt, Homo sapiens
augccuguguacugccuua

SEQ ID NO: 1270721 - RNA, 12 nt, Homo sapiens
augccuuacucu

SEQ ID NO: 1270722 - RNA, 18 nt, Homo sapiens
augccuugugcuguuaau

SEQ ID NO: 1270723 - RNA, 16 nt, Homo sapiens
augcgaggaccacuuu

SEQ ID NO: 1270724 - RNA, 18 nt, Homo sapiens
augcguaaacgacacucu

SEQ ID NO: 1270725 - RNA, 17 nt, Homo sapiens
augcgucccuguacaga

SEQ ID NO: 1270726 - RNA, 15 nt, Homo sapiens
augcguucacuccaa

SEQ ID NO: 1270727 - RNA, 20 nt, Homo sapiens
augcuaacaaagacaaaagu

SEQ ID NO: 1270728 - RNA, 15 nt, Homo sapiens
augcuaaucuugucc

SEQ ID NO: 1270729 - RNA, 17 nt, Homo sapiens
augcuaauuuggggaaa

SEQ ID NO: 1270730 - RNA, 13 nt, Homo sapiens
augcuagcagcug

SEQ ID NO: 1270731 - RNA, 13 nt, Homo sapiens
augcuaguucauu

SEQ ID NO: 1270732 - RNA, 22 nt, Homo sapiens
augcuaguuugaccucauuugu

SEQ ID NO: 1270733 - RNA, 20 nt, Homo sapiens
augcucaggagccaccagca

SEQ ID NO: 1270734 - RNA, 12 nt, Homo sapiens
augcucccucag

SEQ ID NO: 1270735 - RNA, 22 nt, Homo sapiens
augcuccuccuccaugcucccu

SEQ ID NO: 1270736 - RNA, 16 nt, Homo sapiens
augcucugcauguuac

SEQ ID NO: 1270737 - RNA, 16 nt, Homo sapiens
augcucuuuacuucau

SEQ ID NO: 1270738 - RNA, 18 nt, Homo sapiens
augcugaauaucuguuca

SEQ ID NO: 1270739 - RNA, 23 nt, Homo sapiens
augcugacacuuuuucagggcug

SEQ ID NO: 1270740 - RNA, 18 nt, Homo sapiens
augcugacagcucuucac

SEQ ID NO: 1270741 - RNA, 22 nt, Homo sapiens
augcugagguuaugaacaaagu

SEQ ID NO: 1270742 - RNA, 19 nt, Homo sapiens
augcugaugaaucacuguu

SEQ ID NO: 1270743 - RNA, 16 nt, Homo sapiens
augcugccuggugggg

SEQ ID NO: 1270744 - RNA, 15 nt, Homo sapiens
augcugcuaauucaa

SEQ ID NO: 1270745 - RNA, 11 nt, Homo sapiens
augcugcuaug

SEQ ID NO: 1270746 - RNA, 18 nt, Homo sapiens
augcugcucaauuccuuc

SEQ ID NO: 1270747 - RNA, 18 nt, Homo sapiens
augcugcucauccaaagu

SEQ ID NO: 1270748 - RNA, 23 nt, Homo sapiens
augcugcugagguuuugaaagaa

SEQ ID NO: 1270749 - RNA, 15 nt, Homo sapiens
augcuggacuugccu

SEQ ID NO: 1270750 - RNA, 23 nt, Homo sapiens
augcuggcauuugcaccuaccuc

SEQ ID NO: 1270751 - RNA, 18 nt, Homo sapiens
augcugggaaugagacau

SEQ ID NO: 1270752 - RNA, 19 nt, Homo sapiens
augcugguuuucuacccaa

SEQ ID NO: 1270753 - RNA, 13 nt, Homo sapiens
augcugugcucaa

SEQ ID NO: 1270754 - RNA, 15 nt, Homo sapiens
augcuucaugugcug

SEQ ID NO: 1270755 - RNA, 20 nt, Homo sapiens
augcuuccagcuaacagguc

SEQ ID NO: 1270756 - RNA, 19 nt, Homo sapiens
acucuaccaaauaauuuca

SEQ ID NO: 1270757 - RNA, 13 nt, Homo sapiens
acucuagauucca

SEQ ID NO: 1270758 - RNA, 21 nt, Homo sapiens
acucuagccugggccagagaa

SEQ ID NO: 1270759 - RNA, 15 nt, Homo sapiens
acucuaggguccagu

SEQ ID NO: 1270760 - RNA, 18 nt, Homo sapiens
acucuaggguccagugga

SEQ ID NO: 1270761 - RNA, 17 nt, Homo sapiens
acucuaggucaguauua

SEQ ID NO: 1270762 - RNA, 18 nt, Homo sapiens
acucuagugcuacaugau

SEQ ID NO: 1270763 - RNA, 21 nt, Homo sapiens
acucuaugaguuggacuucag

SEQ ID NO: 1270764 - RNA, 15 nt, Homo sapiens
acucuauuguuaccu

SEQ ID NO: 1270765 - RNA, 23 nt, Homo sapiens
acucucacccgaccggugcauga

SEQ ID NO: 1270766 - RNA, 17 nt, Homo sapiens
acucuccaaacagucac

SEQ ID NO: 1270767 - RNA, 13 nt, Homo sapiens
acucuccaaauag

SEQ ID NO: 1270768 - RNA, 19 nt, Homo sapiens
acucuccaaauagcauuag

SEQ ID NO: 1270769 - RNA, 20 nt, Homo sapiens
acucuccaauguucuauuaa

SEQ ID NO: 1270770 - RNA, 14 nt, Homo sapiens
acucuccuagucaa

SEQ ID NO: 1270771 - RNA, 14 nt, Homo sapiens
acucucugaagaug

SEQ ID NO: 1270772 - RNA, 19 nt, Homo sapiens
acucucuucccuuucccca

SEQ ID NO: 1270773 - RNA, 23 nt, Homo sapiens
acucucuuuuuuuuuaaggugaa

SEQ ID NO: 1270774 - RNA, 14 nt, Homo sapiens
acucugaaagaccu

SEQ ID NO: 1270775 - RNA, 16 nt, Homo sapiens
acucugaauccucaug

SEQ ID NO: 1270776 - RNA, 14 nt, Homo sapiens
acucugagcccaua

SEQ ID NO: 1270777 - RNA, 14 nt, Homo sapiens
acucugaguccacu

SEQ ID NO: 1270778 - RNA, 23 nt, Homo sapiens
acucugagucucugaaugaagcu

SEQ ID NO: 1270779 - RNA, 14 nt, Homo sapiens
acucugcacauguc

SEQ ID NO: 1270780 - RNA, 15 nt, Homo sapiens
acucugcacaugucu

SEQ ID NO: 1270781 - RNA, 20 nt, Homo sapiens
acucugcacaugucuuguac

SEQ ID NO: 1270782 - RNA, 16 nt, Homo sapiens
acucugcacuacuccu

SEQ ID NO: 1270783 - RNA, 16 nt, Homo sapiens
acucugcagacugcua

SEQ ID NO: 1270784 - RNA, 22 nt, Homo sapiens
acucugcugcuuagacauaaca

SEQ ID NO: 1270785 - RNA, 22 nt, Homo sapiens
acucugcuugauuuuugccucu

SEQ ID NO: 1270786 - RNA, 23 nt, Homo sapiens
acucuggcuccuucuccauaaag

SEQ ID NO: 1270787 - RNA, 20 nt, Homo sapiens
acucugggaauacaggggug

SEQ ID NO: 1270788 - RNA, 18 nt, Homo sapiens
acucuguaaaaacacuga

SEQ ID NO: 1270789 - RNA, 19 nt, Homo sapiens
acucuguaaaaacacugaa

SEQ ID NO: 1270790 - RNA, 16 nt, Homo sapiens
acucugucacccaggc

SEQ ID NO: 1270791 - RNA, 18 nt, Homo sapiens
acucugucacccuagcua

SEQ ID NO: 1270792 - RNA, 14 nt, Homo sapiens
acucugugugugua

SEQ ID NO: 1270793 - RNA, 23 nt, Homo sapiens
acucuguuugaagaaaauaguca

SEQ ID NO: 1270794 - RNA, 20 nt, Homo sapiens
acucuuagcuaaaucccucc

SEQ ID NO: 1270795 - RNA, 21 nt, Homo sapiens
acucuuauucccaaacuacag

SEQ ID NO: 1270796 - RNA, 20 nt, Homo sapiens
augaaaaaaaguacauguau

SEQ ID NO: 1270797 - RNA, 23 nt, Homo sapiens
augaaaaauguguuccauugcca

SEQ ID NO: 1270798 - RNA, 22 nt, Homo sapiens
augaaaacauagcaucucagga

SEQ ID NO: 1270799 - RNA, 17 nt, Homo sapiens
augaaaacuaaggauuu

SEQ ID NO: 1270800 - RNA, 17 nt, Homo sapiens
augaaaaugaaccauuc

SEQ ID NO: 1270801 - RNA, 13 nt, Homo sapiens
augaaaaugcagu

SEQ ID NO: 1270802 - RNA, 17 nt, Homo sapiens
augaaaaugucaauacu

SEQ ID NO: 1270803 - RNA, 21 nt, Homo sapiens
augaaaauuuauuuuuaguga

SEQ ID NO: 1270804 - RNA, 18 nt, Homo sapiens
augaaacaaauaaucaca

SEQ ID NO: 1270805 - RNA, 17 nt, Homo sapiens
augaaacugcacauugg

SEQ ID NO: 1270806 - RNA, 18 nt, Homo sapiens
augaaagaacccaagaca

SEQ ID NO: 1270807 - RNA, 14 nt, Homo sapiens
augaaaguggacaa

SEQ ID NO: 1270808 - RNA, 20 nt, Homo sapiens
augaaauccagugagcacua

SEQ ID NO: 1270809 - RNA, 22 nt, Homo sapiens
augaaauccugcuucaguguau

SEQ ID NO: 1270810 - RNA, 18 nt, Homo sapiens
augaaauguaugugcucu

SEQ ID NO: 1270811 - RNA, 14 nt, Homo sapiens
augaaauuaacaca

SEQ ID NO: 1270812 - RNA, 16 nt, Homo sapiens
augaacacuacagaua

SEQ ID NO: 1270813 - RNA, 13 nt, Homo sapiens
augaacacuuuuu

SEQ ID NO: 1270814 - RNA, 13 nt, Homo sapiens
augaacagcauua

SEQ ID NO: 1270815 - RNA, 13 nt, Homo sapiens
augaaccacauua

SEQ ID NO: 1270816 - RNA, 20 nt, Homo sapiens
augaaccugcccugcuccca

SEQ ID NO: 1270817 - RNA, 22 nt, Homo sapiens
augaacgaauuaauuaccuggc

SEQ ID NO: 1270818 - RNA, 18 nt, Homo sapiens
augaagaaaaucacuuag

SEQ ID NO: 1270819 - RNA, 22 nt, Homo sapiens
augaagaacacagcaugugcca

SEQ ID NO: 1270820 - RNA, 17 nt, Homo sapiens
augaagaaugcauucaa

SEQ ID NO: 1270821 - RNA, 16 nt, Homo sapiens
augaagauaaacuguu

SEQ ID NO: 1270822 - RNA, 20 nt, Homo sapiens
augaagccaagugggauuug

SEQ ID NO: 1270823 - RNA, 18 nt, Homo sapiens
augaagcccacccagaaa

SEQ ID NO: 1270824 - RNA, 20 nt, Homo sapiens
augaagcgaaacacagagaa

SEQ ID NO: 1270825 - RNA, 16 nt, Homo sapiens
augaagcuuuauacgu

SEQ ID NO: 1270826 - RNA, 21 nt, Homo sapiens
augaagcuuuauacguguagc

SEQ ID NO: 1270827 - RNA, 13 nt, Homo sapiens
augaaggaaucau

SEQ ID NO: 1270828 - RNA, 22 nt, Homo sapiens
augaagguuuguuccuuuguua

SEQ ID NO: 1270829 - RNA, 17 nt, Homo sapiens
augaagugacucucaca

SEQ ID NO: 1270830 - RNA, 12 nt, Homo sapiens
augaagugcaau

SEQ ID NO: 1270831 - RNA, 18 nt, Homo sapiens
augaaguuaugcugucau

SEQ ID NO: 1270832 - RNA, 17 nt, Homo sapiens
augaauaaacugaauau

SEQ ID NO: 1270833 - RNA, 19 nt, Homo sapiens
augaauaagcuuucucuca

SEQ ID NO: 1270834 - RNA, 18 nt, Homo sapiens
augaaucaacaaaccaca

SEQ ID NO: 1270835 - RNA, 18 nt, Homo sapiens
augaaucucccacuccag

SEQ ID NO: 1270836 - RNA, 20 nt, Homo sapiens
augaaucucguucccaaaga

SEQ ID NO: 1270837 - RNA, 21 nt, Homo sapiens
augaaucuucacaaaacacuu

SEQ ID NO: 1270838 - RNA, 22 nt, Homo sapiens
augaaugacaguagucacacau

SEQ ID NO: 1270839 - RNA, 14 nt, Homo sapiens
augaaugcccagug

SEQ ID NO: 1270840 - RNA, 20 nt, Homo sapiens
augaaugccuaaauauaauu

SEQ ID NO: 1270841 - RNA, 24 nt, Homo sapiens
augaaugcuuuuagugugugcaua

SEQ ID NO: 1270842 - RNA, 23 nt, Homo sapiens
augaauguuuacacucuuuguaa

SEQ ID NO: 1270843 - RNA, 18 nt, Homo sapiens
augaauucaagaaaggaa

SEQ ID NO: 1270844 - RNA, 12 nt, Homo sapiens
augaauucuuga

SEQ ID NO: 1270845 - RNA, 19 nt, Homo sapiens
augaauugcauuuuacuuu

SEQ ID NO: 1270846 - RNA, 15 nt, Homo sapiens
augaauuuggccaga

SEQ ID NO: 1270847 - RNA, 18 nt, Homo sapiens
augacaaugaugaugaua

SEQ ID NO: 1270848 - RNA, 18 nt, Homo sapiens
augacaauggaccucuca

SEQ ID NO: 1270849 - RNA, 13 nt, Homo sapiens
augacacaguugg

SEQ ID NO: 1270850 - RNA, 15 nt, Homo sapiens
augacaguagucaca

SEQ ID NO: 1270851 - RNA, 12 nt, Homo sapiens
augacagugaau

SEQ ID NO: 1270852 - RNA, 13 nt, Homo sapiens
augacaucacuug

SEQ ID NO: 1270853 - RNA, 15 nt, Homo sapiens
augacaucucagggg

SEQ ID NO: 1270854 - RNA, 14 nt, Homo sapiens
augacaucuucaaa

SEQ ID NO: 1270855 - RNA, 23 nt, Homo sapiens
augacauuuuuuuuaacuacuau

SEQ ID NO: 1270856 - RNA, 17 nt, Homo sapiens
augaccauuugacuguu

SEQ ID NO: 1270857 - RNA, 13 nt, Homo sapiens
augacccacuguc

SEQ ID NO: 1270858 - RNA, 19 nt, Homo sapiens
augacccaggccuggccag

SEQ ID NO: 1270859 - RNA, 18 nt, Homo sapiens
augacgacauacaugcua

SEQ ID NO: 1270860 - RNA, 22 nt, Homo sapiens
augacguuaugggcacaugccu

SEQ ID NO: 1270861 - RNA, 13 nt, Homo sapiens
augacucacauga

SEQ ID NO: 1270862 - RNA, 15 nt, Homo sapiens
augacuccuuucucu

SEQ ID NO: 1270863 - RNA, 16 nt, Homo sapiens
augacugaugacauau

SEQ ID NO: 1270864 - RNA, 19 nt, Homo sapiens
augacugcuguacugcaau

SEQ ID NO: 1270865 - RNA, 17 nt, Homo sapiens
augacuguaucuugaua

SEQ ID NO: 1270866 - RNA, 19 nt, Homo sapiens
augacuucccugcuccaac

SEQ ID NO: 1270867 - RNA, 13 nt, Homo sapiens
augacuugcuacu

SEQ ID NO: 1270868 - RNA, 17 nt, Homo sapiens
augagaaaagaaauuag

SEQ ID NO: 1270869 - RNA, 20 nt, Homo sapiens
augagaaaguucucauuuaa

SEQ ID NO: 1270870 - RNA, 15 nt, Homo sapiens
augagaaaugaugaa

SEQ ID NO: 1270871 - RNA, 17 nt, Homo sapiens
augagaaguacuugguu

SEQ ID NO: 1270872 - RNA, 20 nt, Homo sapiens
augagaaugaugcacacuga

SEQ ID NO: 1270873 - RNA, 17 nt, Homo sapiens
augagaauuguauguca

SEQ ID NO: 1270874 - RNA, 12 nt, Homo sapiens
agcuuucugucc

SEQ ID NO: 1270875 - RNA, 19 nt, Homo sapiens
agcuuuggaccuaauccaa

SEQ ID NO: 1270876 - RNA, 21 nt, Homo sapiens
agcuuuucuccucaugagcug

SEQ ID NO: 1270877 - RNA, 23 nt, Homo sapiens
agcuuuuuaauuaaaugaagcca

SEQ ID NO: 1270878 - RNA, 19 nt, Homo sapiens
aggaaaaaaacugggauaa

SEQ ID NO: 1270879 - RNA, 15 nt, Homo sapiens
aggaaaaacaaacua

SEQ ID NO: 1270880 - RNA, 14 nt, Homo sapiens
aggaaaaaugcugc

SEQ ID NO: 1270881 - RNA, 19 nt, Homo sapiens
aggaaaaaugcugcuucuc

SEQ ID NO: 1270882 - RNA, 16 nt, Homo sapiens
aggaaaagacaccugu

SEQ ID NO: 1270883 - RNA, 19 nt, Homo sapiens
aggaaaaguuauugugaua

SEQ ID NO: 1270884 - RNA, 18 nt, Homo sapiens
aggaaaaucacaucucca

SEQ ID NO: 1270885 - RNA, 16 nt, Homo sapiens
aggaaaaugauacgca

SEQ ID NO: 1270886 - RNA, 16 nt, Homo sapiens
aggaaacgcuaccucu

SEQ ID NO: 1270887 - RNA, 17 nt, Homo sapiens
aggaaacucacacuccc

SEQ ID NO: 1270888 - RNA, 16 nt, Homo sapiens
aggaaacuucaguuga

SEQ ID NO: 1270889 - RNA, 17 nt, Homo sapiens
aggaaagcacacaguca

SEQ ID NO: 1270890 - RNA, 14 nt, Homo sapiens
aggaaagcccuccc

SEQ ID NO: 1270891 - RNA, 12 nt, Homo sapiens
aggaaagggauu

SEQ ID NO: 1270892 - RNA, 15 nt, Homo sapiens
aggaaauaaaguaua

SEQ ID NO: 1270893 - RNA, 15 nt, Homo sapiens
aggaacaaacagggc

SEQ ID NO: 1270894 - RNA, 18 nt, Homo sapiens
aggaacaaauaaacucau

SEQ ID NO: 1270895 - RNA, 15 nt, Homo sapiens
aggaacagcacuggg

SEQ ID NO: 1270896 - RNA, 22 nt, Homo sapiens
aggaacagugugguuugggaaa

SEQ ID NO: 1270897 - RNA, 17 nt, Homo sapiens
aggaaccaggaggacaa

SEQ ID NO: 1270898 - RNA, 12 nt, Homo sapiens
aggaaccuacca

SEQ ID NO: 1270899 - RNA, 14 nt, Homo sapiens
aggaagacuugaag

SEQ ID NO: 1270900 - RNA, 16 nt, Homo sapiens
aggaagagcaggacuc

SEQ ID NO: 1270901 - RNA, 14 nt, Homo sapiens
aggaagauauacau

SEQ ID NO: 1270902 - RNA, 22 nt, Homo sapiens
aggaagcuccacugucacccuc

SEQ ID NO: 1270903 - RNA, 16 nt, Homo sapiens
aggaaggaaagcacag

SEQ ID NO: 1270904 - RNA, 16 nt, Homo sapiens
aggaaggagauuccac

SEQ ID NO: 1270905 - RNA, 17 nt, Homo sapiens
aggaaggcuucuguguc

SEQ ID NO: 1270906 - RNA, 21 nt, Homo sapiens
aggaaggcuucugugucaaug

SEQ ID NO: 1270907 - RNA, 14 nt, Homo sapiens
aggaagggccacca

SEQ ID NO: 1270908 - RNA, 22 nt, Homo sapiens
aggaagguggugcuuacauccu

SEQ ID NO: 1270909 - RNA, 14 nt, Homo sapiens
aggaaguacuucca

SEQ ID NO: 1270910 - RNA, 16 nt, Homo sapiens
aggaaguagaagucau

SEQ ID NO: 1270911 - RNA, 19 nt, Homo sapiens
aggaagucccagagccugu

SEQ ID NO: 1270912 - RNA, 17 nt, Homo sapiens
aggaaguucaacuucca

SEQ ID NO: 1270913 - RNA, 18 nt, Homo sapiens
aggaauaagaauggagca

SEQ ID NO: 1270914 - RNA, 12 nt, Homo sapiens
aggaaucauucc

SEQ ID NO: 1270915 - RNA, 21 nt, Homo sapiens
aggaauccuggcagcccagag

SEQ ID NO: 1270916 - RNA, 22 nt, Homo sapiens
aggaauuaugucguaagucacu

SEQ ID NO: 1270917 - RNA, 13 nt, Homo sapiens
aggaauucugcaa

SEQ ID NO: 1270918 - RNA, 17 nt, Homo sapiens
aggaauuucugcucugg

SEQ ID NO: 1270919 - RNA, 16 nt, Homo sapiens
aggaauuugcauuuag

SEQ ID NO: 1270920 - RNA, 17 nt, Homo sapiens
aggaauuugcauuuagu

SEQ ID NO: 1270921 - RNA, 17 nt, Homo sapiens
aggaauuuguacuucuu

SEQ ID NO: 1270922 - RNA, 19 nt, Homo sapiens
aggacaaaacuucuuguca

SEQ ID NO: 1270923 - RNA, 13 nt, Homo sapiens
aggacaacacuuc

SEQ ID NO: 1270924 - RNA, 17 nt, Homo sapiens
aggacaaggauguucac

SEQ ID NO: 1270925 - RNA, 23 nt, Homo sapiens
aggacacacauagauaccuucaa

SEQ ID NO: 1270926 - RNA, 14 nt, Homo sapiens
aggacacagcagug

SEQ ID NO: 1270927 - RNA, 13 nt, Homo sapiens
aggacaccaguga

SEQ ID NO: 1270928 - RNA, 23 nt, Homo sapiens
aggacagaaaggagaguggccau

SEQ ID NO: 1270929 - RNA, 12 nt, Homo sapiens
aggacagccaca

SEQ ID NO: 1270930 - RNA, 18 nt, Homo sapiens
aggacaggacccucagga

SEQ ID NO: 1270931 - RNA, 16 nt, Homo sapiens
aggacaggaggcggcc

SEQ ID NO: 1270932 - RNA, 17 nt, Homo sapiens
aggacaguggaugcugc

SEQ ID NO: 1270933 - RNA, 22 nt, Homo sapiens
aggacauucuggaaaagcaaaa

SEQ ID NO: 1270934 - RNA, 20 nt, Homo sapiens
aggacauugcggacagccac

SEQ ID NO: 1270935 - RNA, 14 nt, Homo sapiens
aggaccaagcaucu

SEQ ID NO: 1270936 - RNA, 11 nt, Homo sapiens
aggaccacaga

SEQ ID NO: 1270937 - RNA, 13 nt, Homo sapiens
aggaccacagugg

SEQ ID NO: 1270938 - RNA, 18 nt, Homo sapiens
aggaccacucagccccua

SEQ ID NO: 1270939 - RNA, 19 nt, Homo sapiens
aggaccagcccuugaggga

SEQ ID NO: 1270940 - RNA, 21 nt, Homo sapiens
aggacccgcacgccucuuccc

SEQ ID NO: 1270941 - RNA, 15 nt, Homo sapiens
aggacccgugugacu

SEQ ID NO: 1270942 - RNA, 23 nt, Homo sapiens
aggacggaguggggggacagaga

SEQ ID NO: 1270943 - RNA, 21 nt, Homo sapiens
aggacuacaaccaauuuacac

SEQ ID NO: 1270944 - RNA, 19 nt, Homo sapiens
aggacucagugaucccugg

SEQ ID NO: 1270945 - RNA, 19 nt, Homo sapiens
aggacucccuccucaccuc

SEQ ID NO: 1270946 - RNA, 11 nt, Homo sapiens
aggacucuucc

SEQ ID NO: 1270947 - RNA, 14 nt, Homo sapiens
aggggcuggcacug

SEQ ID NO: 1270948 - RNA, 17 nt, Homo sapiens
agggggaagaagaagag

SEQ ID NO: 1270949 - RNA, 20 nt, Homo sapiens
agggggagcccuggugcuac

SEQ ID NO: 1270950 - RNA, 20 nt, Homo sapiens
agggggcgcucaggacccag

SEQ ID NO: 1270951 - RNA, 14 nt, Homo sapiens
agggguccagccuc

SEQ ID NO: 1270952 - RNA, 19 nt, Homo sapiens
agggguggaaacauaggga

SEQ ID NO: 1270953 - RNA, 23 nt, Homo sapiens
agggguuaaagcagacagucaca

SEQ ID NO: 1270954 - RNA, 22 nt, Homo sapiens
agggguucuucuggggugcuaa

SEQ ID NO: 1270955 - RNA, 21 nt, Homo sapiens
aggguaaauaggaaucauuca

SEQ ID NO: 1270956 - RNA, 20 nt, Homo sapiens
aggguacuuuaagacauacu

SEQ ID NO: 1270957 - RNA, 16 nt, Homo sapiens
aggguagggcacaaag

SEQ ID NO: 1270958 - RNA, 20 nt, Homo sapiens
aggguaucaggugcugccau

SEQ ID NO: 1270959 - RNA, 12 nt, Homo sapiens
agggucaaggac

SEQ ID NO: 1270960 - RNA, 18 nt, Homo sapiens
aggguccuccuccaucuu

SEQ ID NO: 1270961 - RNA, 21 nt, Homo sapiens
aggguccugggccuccugaca

SEQ ID NO: 1270962 - RNA, 16 nt, Homo sapiens
agggucuaagcaccuu

SEQ ID NO: 1270963 - RNA, 14 nt, Homo sapiens
agggucucuucagg

SEQ ID NO: 1270964 - RNA, 22 nt, Homo sapiens
agggucucuugcccaucucucc

SEQ ID NO: 1270965 - RNA, 19 nt, Homo sapiens
agggucugagacucccuuu

SEQ ID NO: 1270966 - RNA, 17 nt, Homo sapiens
agggucugugugaaugu

SEQ ID NO: 1270967 - RNA, 22 nt, Homo sapiens
agggugaagcuauuuaucugua

SEQ ID NO: 1270968 - RNA, 18 nt, Homo sapiens
agggugacugaugauaca

SEQ ID NO: 1270969 - RNA, 15 nt, Homo sapiens
aggguucaucugucc

SEQ ID NO: 1270970 - RNA, 19 nt, Homo sapiens
aggguuccccuggccuuaa

SEQ ID NO: 1270971 - RNA, 19 nt, Homo sapiens
aggguugggcuggugucac

SEQ ID NO: 1270972 - RNA, 13 nt, Homo sapiens
aggguuuugcccc

SEQ ID NO: 1270973 - RNA, 19 nt, Homo sapiens
agguaauuuuuacccuaau

SEQ ID NO: 1270974 - RNA, 15 nt, Homo sapiens
agguacaaguggcug

SEQ ID NO: 1270975 - RNA, 19 nt, Homo sapiens
agguaccaguuguauuuaa

SEQ ID NO: 1270976 - RNA, 19 nt, Homo sapiens
agguacuucaggggcacuu

SEQ ID NO: 1270977 - RNA, 19 nt, Homo sapiens
agguagaaauaucugaaaa

SEQ ID NO: 1270978 - RNA, 12 nt, Homo sapiens
agguagcacuac

SEQ ID NO: 1270979 - RNA, 21 nt, Homo sapiens
agguagcauucuuuggaguua

SEQ ID NO: 1270980 - RNA, 14 nt, Homo sapiens
agguagcuuaccug

SEQ ID NO: 1270981 - RNA, 23 nt, Homo sapiens
agguauccaaaaauguguaagaa

SEQ ID NO: 1270982 - RNA, 19 nt, Homo sapiens
agguaucuguuuaacauuu

SEQ ID NO: 1270983 - RNA, 18 nt, Homo sapiens
agguaugcaaucaaaucu

SEQ ID NO: 1270984 - RNA, 16 nt, Homo sapiens
agguaugccaccaaca

SEQ ID NO: 1270985 - RNA, 18 nt, Homo sapiens
agguaugccaccaacacu

SEQ ID NO: 1270986 - RNA, 16 nt, Homo sapiens
agguauggcucugcac

SEQ ID NO: 1270987 - RNA, 18 nt, Homo sapiens
aggucaauuuccugaugc

SEQ ID NO: 1270988 - RNA, 18 nt, Homo sapiens
aggucacauugugccuuu

SEQ ID NO: 1270989 - RNA, 20 nt, Homo sapiens
aggucagcagccucccugaa

SEQ ID NO: 1270990 - RNA, 19 nt, Homo sapiens
aggucauacaugcauacaa

SEQ ID NO: 1270991 - RNA, 17 nt, Homo sapiens
aggucauuaaaauuaca

SEQ ID NO: 1270992 - RNA, 22 nt, Homo sapiens
aggucccgaaaggggcacuggu

SEQ ID NO: 1270993 - RNA, 15 nt, Homo sapiens
aggucccuguauguc

SEQ ID NO: 1270994 - RNA, 20 nt, Homo sapiens
agguccuccaucccaacagc

SEQ ID NO: 1270995 - RNA, 14 nt, Homo sapiens
agguccuuuggaca

SEQ ID NO: 1270996 - RNA, 20 nt, Homo sapiens
aggucucaggagaagggaua

SEQ ID NO: 1270997 - RNA, 23 nt, Homo sapiens
aggucucuuucuuuacucugggu

SEQ ID NO: 1270998 - RNA, 17 nt, Homo sapiens
aggugaacacuuaguga

SEQ ID NO: 1270999 - RNA, 13 nt, Homo sapiens
aggugaaccaaag

SEQ ID NO: 1271000 - RNA, 14 nt, Homo sapiens
aggugaaccaaaga

SEQ ID NO: 1271001 - RNA, 15 nt, Homo sapiens
aggugaagaugaaga

SEQ ID NO: 1271002 - RNA, 16 nt, Homo sapiens
aggugagauaaauuaa

SEQ ID NO: 1271003 - RNA, 17 nt, Homo sapiens
aggugaucuaccugccu

SEQ ID NO: 1271004 - RNA, 20 nt, Homo sapiens
aggugaucuaccugccucag

SEQ ID NO: 1271005 - RNA, 11 nt, Homo sapiens
aggugcacagg

SEQ ID NO: 1271006 - RNA, 14 nt, Homo sapiens
aggugcacugcuuu

SEQ ID NO: 1271007 - RNA, 19 nt, Homo sapiens
aggugcauagcaagugaaa

SEQ ID NO: 1271008 - RNA, 17 nt, Homo sapiens
aggugcuacaacaugug

SEQ ID NO: 1271009 - RNA, 15 nt, Homo sapiens
aggugcuauccugcc

SEQ ID NO: 1271010 - RNA, 13 nt, Homo sapiens
aggugcucugugg

SEQ ID NO: 1271011 - RNA, 19 nt, Homo sapiens
aggugcuucugccugugca

SEQ ID NO: 1271012 - RNA, 16 nt, Homo sapiens
ugggcaccccacugca

SEQ ID NO: 1271013 - RNA, 21 nt, Homo sapiens
ugggcacugauuugauaccau

SEQ ID NO: 1271014 - RNA, 23 nt, Homo sapiens
ugggcacuggagcaugcagagga

SEQ ID NO: 1271015 - RNA, 13 nt, Homo sapiens
ugggcacuggccc

SEQ ID NO: 1271016 - RNA, 14 nt, Homo sapiens
ugggcagaaagugg

SEQ ID NO: 1271017 - RNA, 15 nt, Homo sapiens
ugggcagagcugcau

SEQ ID NO: 1271018 - RNA, 18 nt, Homo sapiens
ugggcagagcugcaucau

SEQ ID NO: 1271019 - RNA, 12 nt, Homo sapiens
ugggcaugugau

SEQ ID NO: 1271020 - RNA, 19 nt, Homo sapiens
ugggcauuuuucuuacuuu

SEQ ID NO: 1271021 - RNA, 15 nt, Homo sapiens
ugggccauguccaaa

SEQ ID NO: 1271022 - RNA, 18 nt, Homo sapiens
ugggccauguccaaagag

SEQ ID NO: 1271023 - RNA, 18 nt, Homo sapiens
ugggccccucaacagcca

SEQ ID NO: 1271024 - RNA, 18 nt, Homo sapiens
ugggcuacccuaaaggga

SEQ ID NO: 1271025 - RNA, 13 nt, Homo sapiens
ugggcuacuggca

SEQ ID NO: 1271026 - RNA, 19 nt, Homo sapiens
ugggcuauuuggacucagg

SEQ ID NO: 1271027 - RNA, 15 nt, Homo sapiens
ugggcucacaggccu

SEQ ID NO: 1271028 - RNA, 19 nt, Homo sapiens
ugggcugaugcugggaccc

SEQ ID NO: 1271029 - RNA, 23 nt, Homo sapiens
ugggcuucaguaaguccccggcg

SEQ ID NO: 1271030 - RNA, 21 nt, Homo sapiens
uggggaaggcgacugagccau

SEQ ID NO: 1271031 - RNA, 16 nt, Homo sapiens
uggggaaggguuugaa

SEQ ID NO: 1271032 - RNA, 20 nt, Homo sapiens
uggggaaguguuccagauag

SEQ ID NO: 1271033 - RNA, 16 nt, Homo sapiens
uggggacauugcucuc

SEQ ID NO: 1271034 - RNA, 17 nt, Homo sapiens
uggggagcccgucucag

SEQ ID NO: 1271035 - RNA, 19 nt, Homo sapiens
uggggauuccacuaucuca

SEQ ID NO: 1271036 - RNA, 16 nt, Homo sapiens
uggggauuuucacuga

SEQ ID NO: 1271037 - RNA, 20 nt, Homo sapiens
uggggcagcuugaggguugg

SEQ ID NO: 1271038 - RNA, 24 nt, Homo sapiens
uggggcaggcugggccauguccaa

SEQ ID NO: 1271039 - RNA, 15 nt, Homo sapiens
uggggcaugugccau

SEQ ID NO: 1271040 - RNA, 13 nt, Homo sapiens
uggggcauuaucc

SEQ ID NO: 1271041 - RNA, 13 nt, Homo sapiens
uggggccauaaac

SEQ ID NO: 1271042 - RNA, 15 nt, Homo sapiens
uggggccucagacga

SEQ ID NO: 1271043 - RNA, 12 nt, Homo sapiens
uggggcuuccau

SEQ ID NO: 1271044 - RNA, 19 nt, Homo sapiens
ugggggacgugggcauuuu

SEQ ID NO: 1271045 - RNA, 17 nt, Homo sapiens
ugggggccacauuucac

SEQ ID NO: 1271046 - RNA, 16 nt, Homo sapiens
ugggggcugugauauu

SEQ ID NO: 1271047 - RNA, 17 nt, Homo sapiens
ugggguauaggucucau

SEQ ID NO: 1271048 - RNA, 16 nt, Homo sapiens
uggggucuccuauacu

SEQ ID NO: 1271049 - RNA, 15 nt, Homo sapiens
uggggucuuuuuaug

SEQ ID NO: 1271050 - RNA, 15 nt, Homo sapiens
ugggguuauguauca

SEQ ID NO: 1271051 - RNA, 21 nt, Homo sapiens
uggguaaugugaaggcccaag

SEQ ID NO: 1271052 - RNA, 14 nt, Homo sapiens
uggguacaaaaagu

SEQ ID NO: 1271053 - RNA, 16 nt, Homo sapiens
uggguacaaaaaguca

SEQ ID NO: 1271054 - RNA, 19 nt, Homo sapiens
uggguacugaaagccuuag

SEQ ID NO: 1271055 - RNA, 18 nt, Homo sapiens
uggguagucauucuuaca

SEQ ID NO: 1271056 - RNA, 22 nt, Homo sapiens
uggguccucgcugcuggcugcu

SEQ ID NO: 1271057 - RNA, 22 nt, Homo sapiens
ugggugcuuaguaaguacuuaa

SEQ ID NO: 1271058 - RNA, 23 nt, Homo sapiens
uggguguagccagguauggcucu

SEQ ID NO: 1271059 - RNA, 20 nt, Homo sapiens
ugggugucaagagggucuga

SEQ ID NO: 1271060 - RNA, 18 nt, Homo sapiens
ugggugucagucagggac

SEQ ID NO: 1271061 - RNA, 22 nt, Homo sapiens
uggguuccaauccuggcucugu

SEQ ID NO: 1271062 - RNA, 21 nt, Homo sapiens
uggguuggugcacagugauuu

SEQ ID NO: 1271063 - RNA, 18 nt, Homo sapiens
ugguaaaaccccaucucu

SEQ ID NO: 1271064 - RNA, 20 nt, Homo sapiens
ugguaaaacucacugugauc

SEQ ID NO: 1271065 - RNA, 15 nt, Homo sapiens
ugguaaaaguauuug

SEQ ID NO: 1271066 - RNA, 14 nt, Homo sapiens
ugguaaaauacuuc

SEQ ID NO: 1271067 - RNA, 15 nt, Homo sapiens
ugguaaauuaguauu

SEQ ID NO: 1271068 - RNA, 16 nt, Homo sapiens
ugguaaauuaguauuu

SEQ ID NO: 1271069 - RNA, 23 nt, Homo sapiens
ugguaacuuuuuuuuaaagcuca

SEQ ID NO: 1271070 - RNA, 19 nt, Homo sapiens
ugguaaucauaugugucuu

SEQ ID NO: 1271071 - RNA, 15 nt, Homo sapiens
ugguaccauggugua

SEQ ID NO: 1271072 - RNA, 16 nt, Homo sapiens
ugguacuauugugacc

SEQ ID NO: 1271073 - RNA, 21 nt, Homo sapiens
ugguacugacuuugcuugcuu

SEQ ID NO: 1271074 - RNA, 17 nt, Homo sapiens
ugguacuuguaccuccg

SEQ ID NO: 1271075 - RNA, 19 nt, Homo sapiens
ugguagaaaggcaguucag

SEQ ID NO: 1271076 - RNA, 23 nt, Homo sapiens
ugguagaaauacccaacgcacaa

SEQ ID NO: 1271077 - RNA, 14 nt, Homo sapiens
ugguagcucaggug

SEQ ID NO: 1271078 - RNA, 15 nt, Homo sapiens
ugguaggcauuuccu

SEQ ID NO: 1271079 - RNA, 19 nt, Homo sapiens
ugguauguaauuuaugcaa

SEQ ID NO: 1271080 - RNA, 18 nt, Homo sapiens
ugguauuauauaauucaa

SEQ ID NO: 1271081 - RNA, 16 nt, Homo sapiens
uggucaaucaguguua

SEQ ID NO: 1271082 - RNA, 15 nt, Homo sapiens
uggucacacacugau

SEQ ID NO: 1271083 - RNA, 20 nt, Homo sapiens
uggucacccuucaacgcucc

SEQ ID NO: 1271084 - RNA, 15 nt, Homo sapiens
uggucacugugcacu

SEQ ID NO: 1271085 - RNA, 14 nt, Homo sapiens
uggucagagugcca

SEQ ID NO: 1271086 - RNA, 14 nt, Homo sapiens
uggucagauuugaa

SEQ ID NO: 1271087 - RNA, 16 nt, Homo sapiens
uggucagcguugcaug

SEQ ID NO: 1271088 - RNA, 15 nt, Homo sapiens
uggucaggagccucu

SEQ ID NO: 1271089 - RNA, 18 nt, Homo sapiens
uggucaggcuggucucaa

SEQ ID NO: 1271090 - RNA, 13 nt, Homo sapiens
uggucauccaaac

SEQ ID NO: 1271091 - RNA, 21 nt, Homo sapiens
uggucauuggccgacaucaca

SEQ ID NO: 1271092 - RNA, 11 nt, Homo sapiens
ugguccagaau

SEQ ID NO: 1271093 - RNA, 13 nt, Homo sapiens
uggucccaagaca

SEQ ID NO: 1271094 - RNA, 21 nt, Homo sapiens
uggucccggggccagcacuuc

SEQ ID NO: 1271095 - RNA, 22 nt, Homo sapiens
uggucccugccuuaggccuacc

SEQ ID NO: 1271096 - RNA, 14 nt, Homo sapiens
ugguccuagaacuu

SEQ ID NO: 1271097 - RNA, 23 nt, Homo sapiens
uggucuaaaaauaaaccaaagga

SEQ ID NO: 1271098 - RNA, 20 nt, Homo sapiens
uggucuaagguucagccuga

SEQ ID NO: 1271099 - RNA, 22 nt, Homo sapiens
uggucuaagguucagccugaaa

SEQ ID NO: 1271100 - RNA, 18 nt, Homo sapiens
uggucuccuugcacuuuc

SEQ ID NO: 1271101 - RNA, 15 nt, Homo sapiens
uggucugagccaaag

SEQ ID NO: 1271102 - RNA, 19 nt, Homo sapiens
uggucugcauuagucucau

SEQ ID NO: 1271103 - RNA, 15 nt, Homo sapiens
uggucugcuccgccu

SEQ ID NO: 1271104 - RNA, 20 nt, Homo sapiens
uggucugcugaguaacaggu

SEQ ID NO: 1271105 - RNA, 13 nt, Homo sapiens
uggucugugagau

SEQ ID NO: 1271106 - RNA, 21 nt, Homo sapiens
uggucuucaagacgacagcuc

SEQ ID NO: 1271107 - RNA, 18 nt, Homo sapiens
uggucuugagccaguaau

SEQ ID NO: 1271108 - RNA, 17 nt, Homo sapiens
uggucuugaucuccuga

SEQ ID NO: 1271109 - RNA, 22 nt, Homo sapiens
uggugaaacacccaucguucuc

SEQ ID NO: 1271110 - RNA, 21 nt, Homo sapiens
uggugaacaguguauaggaag

SEQ ID NO: 1271111 - RNA, 16 nt, Homo sapiens
uggugaccuuucacga

SEQ ID NO: 1271112 - RNA, 12 nt, Homo sapiens
uggugacugucc

SEQ ID NO: 1271113 - RNA, 19 nt, Homo sapiens
uggugagaaauuucuguga

SEQ ID NO: 1271114 - RNA, 14 nt, Homo sapiens
uggugauccucuau

SEQ ID NO: 1271115 - RNA, 12 nt, Homo sapiens
uggugcagacag

SEQ ID NO: 1271116 - RNA, 22 nt, Homo sapiens
uggugcauggccuuagcuuucu

SEQ ID NO: 1271117 - RNA, 20 nt, Homo sapiens
uggugccaccagccuuccug

SEQ ID NO: 1271118 - RNA, 15 nt, Homo sapiens
uggugccuggagcua

SEQ ID NO: 1271119 - RNA, 15 nt, Homo sapiens
uggugcuaauaugac

SEQ ID NO: 1271120 - RNA, 15 nt, Homo sapiens
ugguggagaaccaca

SEQ ID NO: 1271121 - RNA, 13 nt, Homo sapiens
ugguggagcugcu

SEQ ID NO: 1271122 - RNA, 22 nt, Homo sapiens
ugguggccgugccugagcugca

SEQ ID NO: 1271123 - RNA, 20 nt, Homo sapiens
ugguggguacaaaaagucaa

SEQ ID NO: 1271124 - RNA, 23 nt, Homo sapiens
ugugcccacgaagacaaccauca

SEQ ID NO: 1271125 - RNA, 23 nt, Homo sapiens
ugugccugugguuaacaucucag

SEQ ID NO: 1271126 - RNA, 14 nt, Homo sapiens
ugugcuaagucuuu

SEQ ID NO: 1271127 - RNA, 13 nt, Homo sapiens
ugugcuacagaug

SEQ ID NO: 1271128 - RNA, 23 nt, Homo sapiens
ugugcuaccccuuugauuaugca

SEQ ID NO: 1271129 - RNA, 17 nt, Homo sapiens
ugugcuauacacacaca

SEQ ID NO: 1271130 - RNA, 21 nt, Homo sapiens
ugugcuaucaugauggaauuu

SEQ ID NO: 1271131 - RNA, 18 nt, Homo sapiens
ugugcucaauguguaaau

SEQ ID NO: 1271132 - RNA, 19 nt, Homo sapiens
ugugcuccagauggugcua

SEQ ID NO: 1271133 - RNA, 16 nt, Homo sapiens
ugugcuccgugccucc

SEQ ID NO: 1271134 - RNA, 12 nt, Homo sapiens
ugugcugcucaa

SEQ ID NO: 1271135 - RNA, 15 nt, Homo sapiens
ugugcugcugcuuca

SEQ ID NO: 1271136 - RNA, 13 nt, Homo sapiens
ugugcugugacaa

SEQ ID NO: 1271137 - RNA, 20 nt, Homo sapiens
uguggaggcuaucaacaaag

SEQ ID NO: 1271138 - RNA, 21 nt, Homo sapiens
uguggaucaaccaucgcuuua

SEQ ID NO: 1271139 - RNA, 16 nt, Homo sapiens
uguggauggucauugc

SEQ ID NO: 1271140 - RNA, 13 nt, Homo sapiens
uguggcagagcca

SEQ ID NO: 1271141 - RNA, 15 nt, Homo sapiens
uguggcccaagacaa

SEQ ID NO: 1271142 - RNA, 19 nt, Homo sapiens
uguggcccagggaagccaa

SEQ ID NO: 1271143 - RNA, 20 nt, Homo sapiens
uguggcccaucuuacuggaa

SEQ ID NO: 1271144 - RNA, 20 nt, Homo sapiens
uguggccgccaccugaggug

SEQ ID NO: 1271145 - RNA, 18 nt, Homo sapiens
uguggccuguguccagca

SEQ ID NO: 1271146 - RNA, 18 nt, Homo sapiens
uguggcuggaagauccug

SEQ ID NO: 1271147 - RNA, 18 nt, Homo sapiens
uguggcuuuuaugcuuuc

SEQ ID NO: 1271148 - RNA, 16 nt, Homo sapiens
ugugggagaccgagga

SEQ ID NO: 1271149 - RNA, 14 nt, Homo sapiens
ugugggcugugagu

SEQ ID NO: 1271150 - RNA, 14 nt, Homo sapiens
ugugggcuugacca

SEQ ID NO: 1271151 - RNA, 14 nt, Homo sapiens
ugugggggaaaaau

SEQ ID NO: 1271152 - RNA, 19 nt, Homo sapiens
ugugggugucagucaggga

SEQ ID NO: 1271153 - RNA, 19 nt, Homo sapiens
ugugguaggccuuuuaaca

SEQ ID NO: 1271154 - RNA, 20 nt, Homo sapiens
uguggucaauccgaaguaug

SEQ ID NO: 1271155 - RNA, 20 nt, Homo sapiens
uguggucacuuguaccauau

SEQ ID NO: 1271156 - RNA, 15 nt, Homo sapiens
uguggucauccugcc

SEQ ID NO: 1271157 - RNA, 13 nt, Homo sapiens
uguggucugggga

SEQ ID NO: 1271158 - RNA, 20 nt, Homo sapiens
ugugguuaacaucucagaaa

SEQ ID NO: 1271159 - RNA, 19 nt, Homo sapiens
ugugguuccaugcagccuu

SEQ ID NO: 1271160 - RNA, 15 nt, Homo sapiens
uguguaaauuucuca

SEQ ID NO: 1271161 - RNA, 16 nt, Homo sapiens
uguguaauuagugcca

SEQ ID NO: 1271162 - RNA, 15 nt, Homo sapiens
uguguagccugugca

SEQ ID NO: 1271163 - RNA, 22 nt, Homo sapiens
uguguagcucucacaugcacag

SEQ ID NO: 1271164 - RNA, 12 nt, Homo sapiens
uguguagucaag

SEQ ID NO: 1271165 - RNA, 23 nt, Homo sapiens
uguguauauaguaugaaugcagu

SEQ ID NO: 1271166 - RNA, 17 nt, Homo sapiens
uguguauauauguguau

SEQ ID NO: 1271167 - RNA, 16 nt, Homo sapiens
uguguauguuugcaca

SEQ ID NO: 1271168 - RNA, 21 nt, Homo sapiens
uguguauuccacuuaggaaga

SEQ ID NO: 1271169 - RNA, 16 nt, Homo sapiens
ugugucaaaagccaga

SEQ ID NO: 1271170 - RNA, 12 nt, Homo sapiens
uguguccucuaa

SEQ ID NO: 1271171 - RNA, 15 nt, Homo sapiens
ugugugaaaauguga

SEQ ID NO: 1271172 - RNA, 23 nt, Homo sapiens
ugugugaaaggaagcuccacugu

SEQ ID NO: 1271173 - RNA, 17 nt, Homo sapiens
ugugugaauuuuucuaa

SEQ ID NO: 1271174 - RNA, 12 nt, Homo sapiens
ugugugauuucc

SEQ ID NO: 1271175 - RNA, 14 nt, Homo sapiens
ugugugggcuguga

SEQ ID NO: 1271176 - RNA, 13 nt, Homo sapiens
uguguguacucug

SEQ ID NO: 1271177 - RNA, 12 nt, Homo sapiens
uguguguagcca

SEQ ID NO: 1271178 - RNA, 13 nt, Homo sapiens
uguguguagccaa

SEQ ID NO: 1271179 - RNA, 19 nt, Homo sapiens
uguguguauguuugcacac

SEQ ID NO: 1271180 - RNA, 21 nt, Homo sapiens
uguguguucuggggcaaccua

SEQ ID NO: 1271181 - RNA, 13 nt, Homo sapiens
uguguuacuucaa

SEQ ID NO: 1271182 - RNA, 20 nt, Homo sapiens
uguguuauuauuuugcacug

SEQ ID NO: 1271183 - RNA, 22 nt, Homo sapiens
uguguuauuauuuugcacuguu

SEQ ID NO: 1271184 - RNA, 17 nt, Homo sapiens
uguguuccaaguuucca

SEQ ID NO: 1271185 - RNA, 23 nt, Homo sapiens
uguguuccacggaaaaugcuauc

SEQ ID NO: 1271186 - RNA, 14 nt, Homo sapiens
uguguucugucacc

SEQ ID NO: 1271187 - RNA, 18 nt, Homo sapiens
uguguucugucaccaacu

SEQ ID NO: 1271188 - RNA, 14 nt, Homo sapiens
uguguuggguugaa

SEQ ID NO: 1271189 - RNA, 15 nt, Homo sapiens
uguguuugugccaua

SEQ ID NO: 1271190 - RNA, 20 nt, Homo sapiens
uguguuuuauugacaucucu

SEQ ID NO: 1271191 - RNA, 22 nt, Homo sapiens
uguguuuuuaagauuaguugaa

SEQ ID NO: 1271192 - RNA, 14 nt, Homo sapiens
uguuaaagcuauuu

SEQ ID NO: 1271193 - RNA, 21 nt, Homo sapiens
uguuaacauggacaugaucuu

SEQ ID NO: 1271194 - RNA, 13 nt, Homo sapiens
uguuaagcauuua

SEQ ID NO: 1271195 - RNA, 17 nt, Homo sapiens
uguuaaguuaagcuuuu

SEQ ID NO: 1271196 - RNA, 13 nt, Homo sapiens
uguuaaucaucca

SEQ ID NO: 1271197 - RNA, 16 nt, Homo sapiens
uguuaauuacaccaua

SEQ ID NO: 1271198 - RNA, 18 nt, Homo sapiens
uguuaauuuuuuuuacua

SEQ ID NO: 1271199 - RNA, 19 nt, Homo sapiens
uguuacacagcccaagagg

SEQ ID NO: 1271200 - RNA, 20 nt, Homo sapiens
uguuacagcuuucugugcag

SEQ ID NO: 1271201 - RNA, 13 nt, Homo sapiens
uguuaccuaaagu

SEQ ID NO: 1271202 - RNA, 20 nt, Homo sapiens
uguuacgcacacguacuuaa

SEQ ID NO: 1271203 - RNA, 20 nt, Homo sapiens
uguuacucauuuuauucacu

SEQ ID NO: 1271204 - RNA, 22 nt, Homo sapiens
uguuacugguagaaaggcaguu

SEQ ID NO: 1271205 - RNA, 15 nt, Homo sapiens
uguuacuguucuugc

SEQ ID NO: 1271206 - RNA, 23 nt, Homo sapiens
uguuacuguucuugcugcuagaa

SEQ ID NO: 1271207 - RNA, 19 nt, Homo sapiens
uguuacuuuggcaauuucc

SEQ ID NO: 1271208 - RNA, 20 nt, Homo sapiens
uguuagaacacuauuuucag

SEQ ID NO: 1271209 - RNA, 15 nt, Homo sapiens
uguuagaugugcaca

SEQ ID NO: 1271210 - RNA, 20 nt, Homo sapiens
uguuaucuguguagcaagcu

SEQ ID NO: 1271211 - RNA, 18 nt, Homo sapiens
uguuaucuucacuuuuau

SEQ ID NO: 1271212 - RNA, 18 nt, Homo sapiens
uguuaugauauuguuuaa

SEQ ID NO: 1271213 - RNA, 14 nt, Homo sapiens
uguuauguacugua

SEQ ID NO: 1271214 - RNA, 17 nt, Homo sapiens
uguuauguuugcacuuu

SEQ ID NO: 1271215 - RNA, 19 nt, Homo sapiens
uguuauguuugcacuuugu

SEQ ID NO: 1271216 - RNA, 20 nt, Homo sapiens
uguuauuguugaacauacuu

SEQ ID NO: 1271217 - RNA, 22 nt, Homo sapiens
uguuauuuaaugagucagucaa

SEQ ID NO: 1271218 - RNA, 15 nt, Homo sapiens
uguuauuuagacuca

SEQ ID NO: 1271219 - RNA, 17 nt, Homo sapiens
uguuauuuuucaaggaa

SEQ ID NO: 1271220 - RNA, 12 nt, Homo sapiens
uguucaaagcac

SEQ ID NO: 1271221 - RNA, 13 nt, Homo sapiens
uguucaacauuuu

SEQ ID NO: 1271222 - RNA, 14 nt, Homo sapiens
uguucaaugcuaga

SEQ ID NO: 1271223 - RNA, 15 nt, Homo sapiens
uguucaaugguucug

SEQ ID NO: 1271224 - RNA, 21 nt, Homo sapiens
uguucacaaacuaccucugga

SEQ ID NO: 1271225 - RNA, 16 nt, Homo sapiens
uguucaugucagcuua

SEQ ID NO: 1271226 - RNA, 12 nt, Homo sapiens
uguucauuucac

SEQ ID NO: 1271227 - RNA, 20 nt, Homo sapiens
uguucauuuuagugacugua

SEQ ID NO: 1271228 - RNA, 18 nt, Homo sapiens
uguuccaaagccagugaa

SEQ ID NO: 1271229 - RNA, 19 nt, Homo sapiens
uguuccuaaaauggugaua

SEQ ID NO: 1271230 - RNA, 17 nt, Homo sapiens
uguuccuuucagaugac

SEQ ID NO: 1271231 - RNA, 19 nt, Homo sapiens
uguucuaaauaaaaagcau

SEQ ID NO: 1271232 - RNA, 13 nt, Homo sapiens
uguucuacacuca

SEQ ID NO: 1271233 - RNA, 16 nt, Homo sapiens
uguucuaugaacaacu

SEQ ID NO: 1271234 - RNA, 14 nt, Homo sapiens
uguucuauugucau

SEQ ID NO: 1271235 - RNA, 19 nt, Homo sapiens
uguucucaacuucaaaagu

SEQ ID NO: 1271236 - RNA, 19 nt, Homo sapiens
uguucuccggguguggccu

SEQ ID NO: 1271237 - RNA, 17 nt, Homo sapiens
uguucucgcaaaaacgu

SEQ ID NO: 1271238 - RNA, 19 nt, Homo sapiens
uguucucuauuagacuuua

SEQ ID NO: 1271239 - RNA, 11 nt, Homo sapiens
uguucugagaa

SEQ ID NO: 1271240 - RNA, 19 nt, Homo sapiens
uguucugaggauucagggg

SEQ ID NO: 1271241 - RNA, 13 nt, Homo sapiens
uguucugauuaga

SEQ ID NO: 1271242 - RNA, 13 nt, Homo sapiens
uguucugcacuga

SEQ ID NO: 1271243 - RNA, 13 nt, Homo sapiens
uguucugggacac

SEQ ID NO: 1271244 - RNA, 15 nt, Homo sapiens
uguucugggggacag

SEQ ID NO: 1271245 - RNA, 13 nt, Homo sapiens
uguucugucccag

SEQ ID NO: 1271246 - RNA, 13 nt, Homo sapiens
uguucuguucugg

SEQ ID NO: 1271247 - RNA, 19 nt, Homo sapiens
uguucuguuugcuguggaa

SEQ ID NO: 1271248 - RNA, 15 nt, Homo sapiens
uguucuuagagugua

SEQ ID NO: 1271249 - RNA, 12 nt, Homo sapiens
uguucuuuggaa

SEQ ID NO: 1271250 - RNA, 14 nt, Homo sapiens
uguucuuugucuca

SEQ ID NO: 1271251 - RNA, 15 nt, Homo sapiens
uauucugugcgcuac

SEQ ID NO: 1271252 - RNA, 22 nt, Homo sapiens
uauucuguuggccagugugaca

SEQ ID NO: 1271253 - RNA, 14 nt, Homo sapiens
uauucuugucaaaa

SEQ ID NO: 1271254 - RNA, 20 nt, Homo sapiens
uauucuuucuaaacuacaac

SEQ ID NO: 1271255 - RNA, 20 nt, Homo sapiens
uauucuuugaaaacagauga

SEQ ID NO: 1271256 - RNA, 15 nt, Homo sapiens
uauucuuuguuuccu

SEQ ID NO: 1271257 - RNA, 14 nt, Homo sapiens
uauugaaauucuau

SEQ ID NO: 1271258 - RNA, 16 nt, Homo sapiens
uauugcaagaguuuaa

SEQ ID NO: 1271259 - RNA, 19 nt, Homo sapiens
uauugcaugcucaacuuag

SEQ ID NO: 1271260 - RNA, 21 nt, Homo sapiens
uauugccgccagaagauccaa

SEQ ID NO: 1271261 - RNA, 14 nt, Homo sapiens
uauugcgcugcuac

SEQ ID NO: 1271262 - RNA, 14 nt, Homo sapiens
uauugcuacuauaa

SEQ ID NO: 1271263 - RNA, 15 nt, Homo sapiens
uauugcuacuauaau

SEQ ID NO: 1271264 - RNA, 17 nt, Homo sapiens
uauugcugcaaacacuu

SEQ ID NO: 1271265 - RNA, 19 nt, Homo sapiens
uauugcuuaccugaucuca

SEQ ID NO: 1271266 - RNA, 14 nt, Homo sapiens
uauugcuucaccau

SEQ ID NO: 1271267 - RNA, 17 nt, Homo sapiens
uauugcuucaccauggc

SEQ ID NO: 1271268 - RNA, 17 nt, Homo sapiens
uauuggaagcauacaaa

SEQ ID NO: 1271269 - RNA, 19 nt, Homo sapiens
uauuggacugauaaucucu

SEQ ID NO: 1271270 - RNA, 21 nt, Homo sapiens
uauuggagccccaggggacaa

SEQ ID NO: 1271271 - RNA, 15 nt, Homo sapiens
uauugggauaucauu

SEQ ID NO: 1271272 - RNA, 13 nt, Homo sapiens
uauuggugcuaga

SEQ ID NO: 1271273 - RNA, 17 nt, Homo sapiens
uauugguguuuacccag

SEQ ID NO: 1271274 - RNA, 14 nt, Homo sapiens
uauugguuugcaca

SEQ ID NO: 1271275 - RNA, 15 nt, Homo sapiens
uauuguauaaacuau

SEQ ID NO: 1271276 - RNA, 16 nt, Homo sapiens
uauuguauaaagcauu

SEQ ID NO: 1271277 - RNA, 19 nt, Homo sapiens
uauuguccugcuccccugu

SEQ ID NO: 1271278 - RNA, 21 nt, Homo sapiens
uauugucgguuaccucugcau

SEQ ID NO: 1271279 - RNA, 17 nt, Homo sapiens
uauugugaaguacauau

SEQ ID NO: 1271280 - RNA, 15 nt, Homo sapiens
uauuuaaacucgcuc

SEQ ID NO: 1271281 - RNA, 23 nt, Homo sapiens
uauuuaaauaaagucucucugac

SEQ ID NO: 1271282 - RNA, 18 nt, Homo sapiens
uauuuaaccuauuuccac

SEQ ID NO: 1271283 - RNA, 17 nt, Homo sapiens
uauuuaagaaaagcacu

SEQ ID NO: 1271284 - RNA, 23 nt, Homo sapiens
uauuuaagccuuauaaaccaauc

SEQ ID NO: 1271285 - RNA, 17 nt, Homo sapiens
uauuuacaguuuccaga

SEQ ID NO: 1271286 - RNA, 22 nt, Homo sapiens
uauuuagaagccaacuaugauu

SEQ ID NO: 1271287 - RNA, 18 nt, Homo sapiens
uauuuagacucaucuuac

SEQ ID NO: 1271288 - RNA, 22 nt, Homo sapiens
uauuuagaucuagaaacagauc

SEQ ID NO: 1271289 - RNA, 20 nt, Homo sapiens
uauuuaggagugugugacau

SEQ ID NO: 1271290 - RNA, 22 nt, Homo sapiens
uauuuaguuuuuaacaaucuaa

SEQ ID NO: 1271291 - RNA, 17 nt, Homo sapiens
uauuuauaaaugagcaa

SEQ ID NO: 1271292 - RNA, 13 nt, Homo sapiens
uauuuauaacuca

SEQ ID NO: 1271293 - RNA, 13 nt, Homo sapiens
uauuuaugaaggc

SEQ ID NO: 1271294 - RNA, 17 nt, Homo sapiens
uauuuauggauaucaca

SEQ ID NO: 1271295 - RNA, 16 nt, Homo sapiens
uauuuauguguucaca

SEQ ID NO: 1271296 - RNA, 13 nt, Homo sapiens
uauuuauuuucag

SEQ ID NO: 1271297 - RNA, 16 nt, Homo sapiens
uauuucaaaacacauc

SEQ ID NO: 1271298 - RNA, 21 nt, Homo sapiens
uauuucaaaacacaucuuucc

SEQ ID NO: 1271299 - RNA, 19 nt, Homo sapiens
uauuucaauucuaaaauac

SEQ ID NO: 1271300 - RNA, 16 nt, Homo sapiens
uauuucacuaucuucu

SEQ ID NO: 1271301 - RNA, 17 nt, Homo sapiens
uauuucaggaaggucuu

SEQ ID NO: 1271302 - RNA, 15 nt, Homo sapiens
uauuucauaaacaac

SEQ ID NO: 1271303 - RNA, 16 nt, Homo sapiens
uauuucauccaguuug

SEQ ID NO: 1271304 - RNA, 18 nt, Homo sapiens
uauuucccccuccuccca

SEQ ID NO: 1271305 - RNA, 16 nt, Homo sapiens
uauuucuacuaugagg

SEQ ID NO: 1271306 - RNA, 18 nt, Homo sapiens
uauuucuccuuugcaaua

SEQ ID NO: 1271307 - RNA, 14 nt, Homo sapiens
uauuucugauacug

SEQ ID NO: 1271308 - RNA, 20 nt, Homo sapiens
uauuucuggagggcaauuug

SEQ ID NO: 1271309 - RNA, 21 nt, Homo sapiens
uauuugaagcaucacauaaaa

SEQ ID NO: 1271310 - RNA, 13 nt, Homo sapiens
uauuugaauauca

SEQ ID NO: 1271311 - RNA, 13 nt, Homo sapiens
uauuugcacuaug

SEQ ID NO: 1271312 - RNA, 17 nt, Homo sapiens
uauuugcacuucaccuu

SEQ ID NO: 1271313 - RNA, 19 nt, Homo sapiens
uauuugcaguucaccugca

SEQ ID NO: 1271314 - RNA, 19 nt, Homo sapiens
uauuugcuuaaaauuguga

SEQ ID NO: 1271315 - RNA, 24 nt, Homo sapiens
uauuugcuuuuugcuaacaaugcu

SEQ ID NO: 1271316 - RNA, 14 nt, Homo sapiens
uauuuggaaccuug

SEQ ID NO: 1271317 - RNA, 15 nt, Homo sapiens
uauuuggacuuuuga

SEQ ID NO: 1271318 - RNA, 22 nt, Homo sapiens
uauuugggauauguauggguag

SEQ ID NO: 1271319 - RNA, 22 nt, Homo sapiens
uauuugggggaacuggacacaa

SEQ ID NO: 1271320 - RNA, 15 nt, Homo sapiens
uauuugguaccaugg

SEQ ID NO: 1271321 - RNA, 15 nt, Homo sapiens
uauuuguacaaaaaa

SEQ ID NO: 1271322 - RNA, 15 nt, Homo sapiens
uauuuuaaagcacuu

SEQ ID NO: 1271323 - RNA, 20 nt, Homo sapiens
uauuuuaaaguaaaagucua

SEQ ID NO: 1271324 - RNA, 18 nt, Homo sapiens
uauuuuaagcacucuuaa

SEQ ID NO: 1271325 - RNA, 22 nt, Homo sapiens
uauuuuacaaucaacaaaaugg

SEQ ID NO: 1271326 - RNA, 22 nt, Homo sapiens
uauuuuagacacuucccugcau

SEQ ID NO: 1271327 - RNA, 17 nt, Homo sapiens
uauuuuauuuagacaag

SEQ ID NO: 1271328 - RNA, 16 nt, Homo sapiens
uauuuucaguauacug

SEQ ID NO: 1271329 - RNA, 14 nt, Homo sapiens
uauuuucagugcau

SEQ ID NO: 1271330 - RNA, 19 nt, Homo sapiens
uauuuuccccuagcuuucc

SEQ ID NO: 1271331 - RNA, 17 nt, Homo sapiens
uauuuucuacagugguu

SEQ ID NO: 1271332 - RNA, 12 nt, Homo sapiens
uauuuugcccag

SEQ ID NO: 1271333 - RNA, 21 nt, Homo sapiens
uauuuuguaaugcugcacaga

SEQ ID NO: 1271334 - RNA, 16 nt, Homo sapiens
uauuuuguugccuuca

SEQ ID NO: 1271335 - RNA, 19 nt, Homo sapiens
uauuuuugugaaguauuca

SEQ ID NO: 1271336 - RNA, 18 nt, Homo sapiens
uauuuuuuaaacauacga

SEQ ID NO: 1271337 - RNA, 22 nt, Homo sapiens
uauuuuuucgugcacucugcua

SEQ ID NO: 1271338 - RNA, 12 nt, Homo sapiens
uauuuuuugcaa

SEQ ID NO: 1271339 - RNA, 16 nt, Homo sapiens
uauuuuuuuuuugcca

SEQ ID NO: 1271340 - RNA, 17 nt, Homo sapiens
ucuuuaauaaauugcuu

SEQ ID NO: 1271341 - RNA, 18 nt, Homo sapiens
ucuuuaauaaauugcuua

SEQ ID NO: 1271342 - RNA, 21 nt, Homo sapiens
ucuuuaauguuguccaggaaa

SEQ ID NO: 1271343 - RNA, 21 nt, Homo sapiens
ucuuuaauuucugucagaaug

SEQ ID NO: 1271344 - RNA, 12 nt, Homo sapiens
ucuuuaccugag

SEQ ID NO: 1271345 - RNA, 15 nt, Homo sapiens
ucuuuagaacaggga

SEQ ID NO: 1271346 - RNA, 17 nt, Homo sapiens
ucuuuagcaugcuacag

SEQ ID NO: 1271347 - RNA, 19 nt, Homo sapiens
ucuuuaggagacuaaugga

SEQ ID NO: 1271348 - RNA, 14 nt, Homo sapiens
ucuuuagugucuga

SEQ ID NO: 1271349 - RNA, 17 nt, Homo sapiens
ucuuuauaaucuacucc

SEQ ID NO: 1271350 - RNA, 18 nt, Homo sapiens
ucuuuauaaucuacuccu

SEQ ID NO: 1271351 - RNA, 13 nt, Homo sapiens
ucuuuauaauucu

SEQ ID NO: 1271352 - RNA, 14 nt, Homo sapiens
ucuuucagcacuca

SEQ ID NO: 1271353 - RNA, 21 nt, Homo sapiens
ucuuucaggacucuaccucau

SEQ ID NO: 1271354 - RNA, 21 nt, Homo sapiens
ucuuucaguggcuaccuacau

SEQ ID NO: 1271355 - RNA, 15 nt, Homo sapiens
ucuuucauccuugac

SEQ ID NO: 1271356 - RNA, 16 nt, Homo sapiens
ucuuucaucucugcuu

SEQ ID NO: 1271357 - RNA, 15 nt, Homo sapiens
ucuuucaucugggga

SEQ ID NO: 1271358 - RNA, 13 nt, Homo sapiens
ucuuuccaaaaca

SEQ ID NO: 1271359 - RNA, 18 nt, Homo sapiens
ucuuuccaaaacauuucu

SEQ ID NO: 1271360 - RNA, 15 nt, Homo sapiens
ucuuuccaggcuucc

SEQ ID NO: 1271361 - RNA, 22 nt, Homo sapiens
ucuuuccaggcuucccugacuu

SEQ ID NO: 1271362 - RNA, 17 nt, Homo sapiens
ucuuuccauuaugauuc

SEQ ID NO: 1271363 - RNA, 16 nt, Homo sapiens
ucuuuccugaaccaug

SEQ ID NO: 1271364 - RNA, 23 nt, Homo sapiens
ucuuuccuggcacuaacguugag

SEQ ID NO: 1271365 - RNA, 21 nt, Homo sapiens
ucuuucuagaggugcuacaua

SEQ ID NO: 1271366 - RNA, 16 nt, Homo sapiens
ucuuucucaaucuuga

SEQ ID NO: 1271367 - RNA, 20 nt, Homo sapiens
ucuuucucugccagugacag

SEQ ID NO: 1271368 - RNA, 19 nt, Homo sapiens
ucuuucuuugcaccaaaga

SEQ ID NO: 1271369 - RNA, 20 nt, Homo sapiens
ucuuugaacccuugcuugca

SEQ ID NO: 1271370 - RNA, 20 nt, Homo sapiens
ucuuugaagcgagcagucag

SEQ ID NO: 1271371 - RNA, 21 nt, Homo sapiens
ucuuugacauuuggugguacu

SEQ ID NO: 1271372 - RNA, 23 nt, Homo sapiens
ucuuugccagacaacuuguccug

SEQ ID NO: 1271373 - RNA, 17 nt, Homo sapiens
ucuuugccagucauuca

SEQ ID NO: 1271374 - RNA, 16 nt, Homo sapiens
ucuuugcucauggcaa

SEQ ID NO: 1271375 - RNA, 20 nt, Homo sapiens
ucuuugcucccugcaagaaa

SEQ ID NO: 1271376 - RNA, 19 nt, Homo sapiens
ucuuuggaaaaauguuugu

SEQ ID NO: 1271377 - RNA, 14 nt, Homo sapiens
ucuuuggauuugau

SEQ ID NO: 1271378 - RNA, 15 nt, Homo sapiens
ucuuuggcgaccucc

SEQ ID NO: 1271379 - RNA, 16 nt, Homo sapiens
ucuuugguucuaagga

SEQ ID NO: 1271380 - RNA, 21 nt, Homo sapiens
ucuuuguaagaguggaaccaa

SEQ ID NO: 1271381 - RNA, 14 nt, Homo sapiens
ucuuuguaccaaaa

SEQ ID NO: 1271382 - RNA, 16 nt, Homo sapiens
ucuuuguaucuuccau

SEQ ID NO: 1271383 - RNA, 17 nt, Homo sapiens
ucuuugucuuaucuggc

SEQ ID NO: 1271384 - RNA, 21 nt, Homo sapiens
ucuuuuaagcuauccacagcu

SEQ ID NO: 1271385 - RNA, 20 nt, Homo sapiens
ucuuuuaugagcagaaggaa

SEQ ID NO: 1271386 - RNA, 12 nt, Homo sapiens
ucuuuucugcau

SEQ ID NO: 1271387 - RNA, 18 nt, Homo sapiens
ucuuuucuucuauggggu

SEQ ID NO: 1271388 - RNA, 13 nt, Homo sapiens
ucuuuucuuucaa

SEQ ID NO: 1271389 - RNA, 11 nt, Homo sapiens
ucuuuugcucu

SEQ ID NO: 1271390 - RNA, 22 nt, Homo sapiens
ugaaaaaagguuguguagcugu

SEQ ID NO: 1271391 - RNA, 17 nt, Homo sapiens
ugaaaaacagaaagcau

SEQ ID NO: 1271392 - RNA, 19 nt, Homo sapiens
ugaaaaacagaaagcaucc

SEQ ID NO: 1271393 - RNA, 22 nt, Homo sapiens
ugaaaaacagaaagcauccuaa

SEQ ID NO: 1271394 - RNA, 12 nt, Homo sapiens
ugaaaaacauuc

SEQ ID NO: 1271395 - RNA, 15 nt, Homo sapiens
ugaaaaaucauccaa

SEQ ID NO: 1271396 - RNA, 21 nt, Homo sapiens
ugaaaaaugguaauuguugcu

SEQ ID NO: 1271397 - RNA, 22 nt, Homo sapiens
ugaaaaaugguaauuguugcua

SEQ ID NO: 1271398 - RNA, 20 nt, Homo sapiens
ugaaaaauguguuccauugc

SEQ ID NO: 1271399 - RNA, 16 nt, Homo sapiens
ugaaaaauuacagcuu

SEQ ID NO: 1271400 - RNA, 13 nt, Homo sapiens
ugaaaacagauga

SEQ ID NO: 1271401 - RNA, 21 nt, Homo sapiens
ugaaaacauagcaucucagga

SEQ ID NO: 1271402 - RNA, 17 nt, Homo sapiens
ugaaaaccaucuggccu

SEQ ID NO: 1271403 - RNA, 12 nt, Homo sapiens
ugaaaacucuau

SEQ ID NO: 1271404 - RNA, 16 nt, Homo sapiens
ugaaaacucuuugcug

SEQ ID NO: 1271405 - RNA, 23 nt, Homo sapiens
ugaaaacuuagagagguacaagu

SEQ ID NO: 1271406 - RNA, 17 nt, Homo sapiens
ugaaaacuuagccagag

SEQ ID NO: 1271407 - RNA, 12 nt, Homo sapiens
ugaaaacuucaa

SEQ ID NO: 1271408 - RNA, 13 nt, Homo sapiens
ugaaaacuucaaa

SEQ ID NO: 1271409 - RNA, 16 nt, Homo sapiens
ugaaaagaaucagcau

SEQ ID NO: 1271410 - RNA, 16 nt, Homo sapiens
ugaaaagaauuugaug

SEQ ID NO: 1271411 - RNA, 14 nt, Homo sapiens
ugaaaagaguaugu

SEQ ID NO: 1271412 - RNA, 17 nt, Homo sapiens
ugaaaaggaaguuaaua

SEQ ID NO: 1271413 - RNA, 17 nt, Homo sapiens
ugaaaagggggugggau

SEQ ID NO: 1271414 - RNA, 13 nt, Homo sapiens
ugaaaagugugua

SEQ ID NO: 1271415 - RNA, 23 nt, Homo sapiens
ugaaaauaaaaugacgucacaag

SEQ ID NO: 1271416 - RNA, 18 nt, Homo sapiens
ugaaaauaaagcagaagc

SEQ ID NO: 1271417 - RNA, 19 nt, Homo sapiens
ugaaaauaaauaaguuaua

SEQ ID NO: 1271418 - RNA, 20 nt, Homo sapiens
ugaaaauaacugaaccaaau

SEQ ID NO: 1271419 - RNA, 21 nt, Homo sapiens
ugaaaauaacugaaccaaauu

SEQ ID NO: 1271420 - RNA, 22 nt, Homo sapiens
ugaaaauaauuguuccaaauga

SEQ ID NO: 1271421 - RNA, 22 nt, Homo sapiens
ugaaaauacaacuuaaauaaua

SEQ ID NO: 1271422 - RNA, 19 nt, Homo sapiens
ugaaaaugaaccauucaca

SEQ ID NO: 1271423 - RNA, 16 nt, Homo sapiens
ugaaaaugaaucuuca

SEQ ID NO: 1271424 - RNA, 12 nt, Homo sapiens
ugaaaauguacu

SEQ ID NO: 1271425 - RNA, 22 nt, Homo sapiens
ugaaaauguauguguaaguauu

SEQ ID NO: 1271426 - RNA, 21 nt, Homo sapiens
ugaaaaugucagaaaccaguu

SEQ ID NO: 1271427 - RNA, 22 nt, Homo sapiens
ugaaaaugugaauugcaugacu

SEQ ID NO: 1271428 - RNA, 16 nt, Homo sapiens
ugaaaauugcaauaca

SEQ ID NO: 1271429 - RNA, 14 nt, Homo sapiens
ugaaacacaccagg

SEQ ID NO: 1271430 - RNA, 18 nt, Homo sapiens
ugaaacagccauguccaa

SEQ ID NO: 1271431 - RNA, 21 nt, Homo sapiens
ugaaacauggcuguguuugca

SEQ ID NO: 1271432 - RNA, 14 nt, Homo sapiens
ugaaacccacagau

SEQ ID NO: 1271433 - RNA, 22 nt, Homo sapiens
ugaaacccuuguauaaguaaua

SEQ ID NO: 1271434 - RNA, 14 nt, Homo sapiens
ugaaaccugugaag

SEQ ID NO: 1271435 - RNA, 17 nt, Homo sapiens
ugaaacgucauguguuu

SEQ ID NO: 1271436 - RNA, 20 nt, Homo sapiens
ugaaacgucuaggaaaucua

SEQ ID NO: 1271437 - RNA, 11 nt, Homo sapiens
ugaaacuaaga

SEQ ID NO: 1271438 - RNA, 17 nt, Homo sapiens
ugaaacuaggguuugaa

SEQ ID NO: 1271439 - RNA, 20 nt, Homo sapiens
ugaaacuauuuuaccugaac

SEQ ID NO: 1271440 - RNA, 15 nt, Homo sapiens
ugaaacugcugugaa

SEQ ID NO: 1271441 - RNA, 22 nt, Homo sapiens
ugaaagaaagcugagaagaaug

SEQ ID NO: 1271442 - RNA, 20 nt, Homo sapiens
ugaaagaccugaauaccacu

SEQ ID NO: 1271443 - RNA, 22 nt, Homo sapiens
ugaaagagcaagugacuuucua

SEQ ID NO: 1271444 - RNA, 13 nt, Homo sapiens
ugagccacugcac

SEQ ID NO: 1271445 - RNA, 18 nt, Homo sapiens
ugagccagugagggcagu

SEQ ID NO: 1271446 - RNA, 20 nt, Homo sapiens
ugagccaugaucgagccacu

SEQ ID NO: 1271447 - RNA, 17 nt, Homo sapiens
ugagcccacaaagccuu

SEQ ID NO: 1271448 - RNA, 21 nt, Homo sapiens
ugagcccccccaacacugugc

SEQ ID NO: 1271449 - RNA, 21 nt, Homo sapiens
ugagccccuggaggcacugaa

SEQ ID NO: 1271450 - RNA, 23 nt, Homo sapiens
ugagccgagauagcaccauugca

SEQ ID NO: 1271451 - RNA, 17 nt, Homo sapiens
ugagccgugaacugugc

SEQ ID NO: 1271452 - RNA, 14 nt, Homo sapiens
ugagcgagugucca

SEQ ID NO: 1271453 - RNA, 13 nt, Homo sapiens
ugagcuacaguag

SEQ ID NO: 1271454 - RNA, 18 nt, Homo sapiens
ugagcuauugcuguucuc

SEQ ID NO: 1271455 - RNA, 22 nt, Homo sapiens
ugagcuauuuccauuccagaau

SEQ ID NO: 1271456 - RNA, 14 nt, Homo sapiens
ugagcucaaaguac

SEQ ID NO: 1271457 - RNA, 13 nt, Homo sapiens
ugagcucaggcau

SEQ ID NO: 1271458 - RNA, 17 nt, Homo sapiens
ugagcuggaucacuuga

SEQ ID NO: 1271459 - RNA, 18 nt, Homo sapiens
ugagcugggagcccggca

SEQ ID NO: 1271460 - RNA, 20 nt, Homo sapiens
ugagcuucauauaccagcaa

SEQ ID NO: 1271461 - RNA, 16 nt, Homo sapiens
ugaggaaggaacagca

SEQ ID NO: 1271462 - RNA, 23 nt, Homo sapiens
ugaggaaguggcugucccugugg

SEQ ID NO: 1271463 - RNA, 18 nt, Homo sapiens
ugaggacagaccacagag

SEQ ID NO: 1271464 - RNA, 15 nt, Homo sapiens
ugaggacauguggaa

SEQ ID NO: 1271465 - RNA, 15 nt, Homo sapiens
ugaggagacagaaua

SEQ ID NO: 1271466 - RNA, 17 nt, Homo sapiens
ugaggagcccuaagcau

SEQ ID NO: 1271467 - RNA, 15 nt, Homo sapiens
ugaggagccucccag

SEQ ID NO: 1271468 - RNA, 17 nt, Homo sapiens
ugaggagcugcacugau

SEQ ID NO: 1271469 - RNA, 16 nt, Homo sapiens
ugaggagugaggaaua

SEQ ID NO: 1271470 - RNA, 15 nt, Homo sapiens
ugaggauuuuguuga

SEQ ID NO: 1271471 - RNA, 13 nt, Homo sapiens
ugaggcaggagaa

SEQ ID NO: 1271472 - RNA, 19 nt, Homo sapiens
ugaggcagggcaaaugaca

SEQ ID NO: 1271473 - RNA, 19 nt, Homo sapiens
ugaggccaucucaggagau

SEQ ID NO: 1271474 - RNA, 21 nt, Homo sapiens
ugaggcccauucuucacucuu

SEQ ID NO: 1271475 - RNA, 20 nt, Homo sapiens
ugaggcccugcccaaugaga

SEQ ID NO: 1271476 - RNA, 17 nt, Homo sapiens
ugaggccuagacucugu

SEQ ID NO: 1271477 - RNA, 21 nt, Homo sapiens
ugaggcggguggaucacuuga

SEQ ID NO: 1271478 - RNA, 19 nt, Homo sapiens
ugaggcuauggaggguccu

SEQ ID NO: 1271479 - RNA, 14 nt, Homo sapiens
ugaggcugcaccca

SEQ ID NO: 1271480 - RNA, 13 nt, Homo sapiens
ugaggcugucaca

SEQ ID NO: 1271481 - RNA, 15 nt, Homo sapiens
ugagggaaagugcau

SEQ ID NO: 1271482 - RNA, 14 nt, Homo sapiens
ugagggacugccuc

SEQ ID NO: 1271483 - RNA, 21 nt, Homo sapiens
ugagggaggaagaaggcagug

SEQ ID NO: 1271484 - RNA, 19 nt, Homo sapiens
ugagggagucccugggccu

SEQ ID NO: 1271485 - RNA, 17 nt, Homo sapiens
ugagggcagacuggggc

SEQ ID NO: 1271486 - RNA, 15 nt, Homo sapiens
ugagggccgcuuuga

SEQ ID NO: 1271487 - RNA, 12 nt, Homo sapiens
ugaggggugcug

SEQ ID NO: 1271488 - RNA, 12 nt, Homo sapiens
ugagggugcuga

SEQ ID NO: 1271489 - RNA, 14 nt, Homo sapiens
ugagggugggguaa

SEQ ID NO: 1271490 - RNA, 15 nt, Homo sapiens
ugaggguuaaugaaa

SEQ ID NO: 1271491 - RNA, 14 nt, Homo sapiens
ugagguacagcaga

SEQ ID NO: 1271492 - RNA, 16 nt, Homo sapiens
ugagguauaaagacaa

SEQ ID NO: 1271493 - RNA, 19 nt, Homo sapiens
ugagguauaaagacaagua

SEQ ID NO: 1271494 - RNA, 16 nt, Homo sapiens
ugaggugccuguccca

SEQ ID NO: 1271495 - RNA, 19 nt, Homo sapiens
ugaggugguggaguggagu

SEQ ID NO: 1271496 - RNA, 22 nt, Homo sapiens
ugagguugggguguacuaguua

SEQ ID NO: 1271497 - RNA, 16 nt, Homo sapiens
ugagguuuugaaagaa

SEQ ID NO: 1271498 - RNA, 20 nt, Homo sapiens
ugaguaauuguuauuuauuc

SEQ ID NO: 1271499 - RNA, 21 nt, Homo sapiens
ugaguagcugggauuacaggc

SEQ ID NO: 1271500 - RNA, 13 nt, Homo sapiens
ugaguauuuagga

SEQ ID NO: 1271501 - RNA, 16 nt, Homo sapiens
ugagucacuuguguca

SEQ ID NO: 1271502 - RNA, 15 nt, Homo sapiens
ugagucagacuguca

SEQ ID NO: 1271503 - RNA, 16 nt, Homo sapiens
ugagucagacugucag

SEQ ID NO: 1271504 - RNA, 18 nt, Homo sapiens
ugaguccaucuaacauca

SEQ ID NO: 1271505 - RNA, 15 nt, Homo sapiens
ugagucuccugugcc

SEQ ID NO: 1271506 - RNA, 22 nt, Homo sapiens
ugagucuuuauuuuuuguuacc

SEQ ID NO: 1271507 - RNA, 17 nt, Homo sapiens
ugagugaauuacagaca

SEQ ID NO: 1271508 - RNA, 22 nt, Homo sapiens
ugagugguguguguuaucagau

SEQ ID NO: 1271509 - RNA, 23 nt, Homo sapiens
ugagugguguguguuaucagaua

SEQ ID NO: 1271510 - RNA, 16 nt, Homo sapiens
ugaguguuauuugcac

SEQ ID NO: 1271511 - RNA, 22 nt, Homo sapiens
ugaguugcacuuauugaccauu

SEQ ID NO: 1271512 - RNA, 15 nt, Homo sapiens
ugaguuguguuccac

SEQ ID NO: 1271513 - RNA, 20 nt, Homo sapiens
ugaguuguuuaaacagucaa

SEQ ID NO: 1271514 - RNA, 15 nt, Homo sapiens
ugaguuucucuccac

SEQ ID NO: 1271515 - RNA, 18 nt, Homo sapiens
ugaguuugcuguuugcaa

SEQ ID NO: 1271516 - RNA, 13 nt, Homo sapiens
ugaguuuuuagug

SEQ ID NO: 1271517 - RNA, 16 nt, Homo sapiens
ugauaaaagauggcca

SEQ ID NO: 1271518 - RNA, 14 nt, Homo sapiens
ugauaaaccugcca

SEQ ID NO: 1271519 - RNA, 14 nt, Homo sapiens
ugauaagacuguuu

SEQ ID NO: 1271520 - RNA, 18 nt, Homo sapiens
ugauaagcauugacuugc

SEQ ID NO: 1271521 - RNA, 14 nt, Homo sapiens
ugauaaggcucuga

SEQ ID NO: 1271522 - RNA, 12 nt, Homo sapiens
ugauaaguaaau

SEQ ID NO: 1271523 - RNA, 15 nt, Homo sapiens
ugauacaaauuccac

SEQ ID NO: 1271524 - RNA, 14 nt, Homo sapiens
ugauacauaacuaa

SEQ ID NO: 1271525 - RNA, 15 nt, Homo sapiens
ugauaccacugcacu

SEQ ID NO: 1271526 - RNA, 23 nt, Homo sapiens
ugauaccauggcacugacaaugg

SEQ ID NO: 1271527 - RNA, 15 nt, Homo sapiens
ugauaccugcacugu

SEQ ID NO: 1271528 - RNA, 17 nt, Homo sapiens
ugauacgauaguuacau

SEQ ID NO: 1271529 - RNA, 18 nt, Homo sapiens
ugauacugauuaugaaau

SEQ ID NO: 1271530 - RNA, 20 nt, Homo sapiens
ugauacuuccaagugauaau

SEQ ID NO: 1271531 - RNA, 12 nt, Homo sapiens
ugauacuuuuaa

SEQ ID NO: 1271532 - RNA, 23 nt, Homo sapiens
ugauagagguucuuuauugcuca

SEQ ID NO: 1271533 - RNA, 23 nt, Homo sapiens
ugauagcacuuucuacaauguga

SEQ ID NO: 1271534 - RNA, 13 nt, Homo sapiens
ugauagcuuuauu

SEQ ID NO: 1271535 - RNA, 21 nt, Homo sapiens
ugauaggaagcgucuggcaga

SEQ ID NO: 1271536 - RNA, 14 nt, Homo sapiens
ugauauacaaagug

SEQ ID NO: 1271537 - RNA, 22 nt, Homo sapiens
ugauauaucaaacugaaacaaa

SEQ ID NO: 1271538 - RNA, 14 nt, Homo sapiens
ugauaugaguauac

SEQ ID NO: 1271539 - RNA, 15 nt, Homo sapiens
ugauauggguuuaua

SEQ ID NO: 1271540 - RNA, 18 nt, Homo sapiens
ugauauguaaacauaauu

SEQ ID NO: 1271541 - RNA, 19 nt, Homo sapiens
ugaucaaaaccugugccag

SEQ ID NO: 1271542 - RNA, 17 nt, Homo sapiens
ugaucaauaaaauguga

SEQ ID NO: 1271543 - RNA, 17 nt, Homo sapiens
ugaucacauucuuucca

SEQ ID NO: 1271544 - RNA, 12 nt, Homo sapiens
ugaucagacuga

SEQ ID NO: 1271545 - RNA, 18 nt, Homo sapiens
ugaucagcaucugugaug

SEQ ID NO: 1271546 - RNA, 19 nt, Homo sapiens
ugaucagugcaauugaccu

SEQ ID NO: 1271547 - RNA, 21 nt, Homo sapiens
ugaucauguguggaaguuauu

SEQ ID NO: 1271548 - RNA, 17 nt, Homo sapiens
ugauccacccaccucag

SEQ ID NO: 1271549 - RNA, 17 nt, Homo sapiens
ugauccccaagugguga

SEQ ID NO: 1271550 - RNA, 17 nt, Homo sapiens
ugauccggggguccagg

SEQ ID NO: 1271551 - RNA, 10 nt, Homo sapiens
ugauccucac

SEQ ID NO: 1271552 - RNA, 13 nt, Homo sapiens
ugaucgacguggu

SEQ ID NO: 1271553 - RNA, 13 nt, Homo sapiens
ugaucuauacaaa

SEQ ID NO: 1271554 - RNA, 13 nt, Homo sapiens
ugaucucugggag

SEQ ID NO: 1271555 - RNA, 22 nt, Homo sapiens
ugaucuucagggaacugcauag

SEQ ID NO: 1271556 - RNA, 18 nt, Homo sapiens
ugaucuuucuuuucccaa

SEQ ID NO: 1271557 - RNA, 14 nt, Homo sapiens
ugaugacauucccu

SEQ ID NO: 1271558 - RNA, 20 nt, Homo sapiens
ugaugagagaauggagacag

SEQ ID NO: 1271559 - RNA, 21 nt, Homo sapiens
ugaugaucaaaaccugugcca

SEQ ID NO: 1271560 - RNA, 13 nt, Homo sapiens
ugaugaucuuugc

SEQ ID NO: 1271561 - RNA, 13 nt, Homo sapiens
ugaugaugucucu

SEQ ID NO: 1271562 - RNA, 15 nt, Homo sapiens
ugaugcaggcacuua

SEQ ID NO: 1271563 - RNA, 15 nt, Homo sapiens
ugaugccauucuucc

SEQ ID NO: 1271564 - RNA, 20 nt, Homo sapiens
ugaugccuguguacugccuu

SEQ ID NO: 1271565 - RNA, 22 nt, Homo sapiens
ugaugccuguguacugccuuaa

SEQ ID NO: 1271566 - RNA, 16 nt, Homo sapiens
ugaugcugagauucuu

SEQ ID NO: 1271567 - RNA, 22 nt, Homo sapiens
ugaugcugccaggccugggacc

SEQ ID NO: 1271568 - RNA, 14 nt, Homo sapiens
ugaugcugggaccc

SEQ ID NO: 1271569 - RNA, 14 nt, Homo sapiens
ugaugcugugcuau

SEQ ID NO: 1271570 - RNA, 21 nt, Homo sapiens
ugauggaaauacacuguuauc

SEQ ID NO: 1271571 - RNA, 22 nt, Homo sapiens
ugauggaccuccuucgcuggaa

SEQ ID NO: 1271572 - RNA, 21 nt, Homo sapiens
ucucuuggaaaauaagacaau

SEQ ID NO: 1271573 - RNA, 19 nt, Homo sapiens
ucucuuuaaaaccauauca

SEQ ID NO: 1271574 - RNA, 21 nt, Homo sapiens
ucucuuuugagcuaaucuuca

SEQ ID NO: 1271575 - RNA, 22 nt, Homo sapiens
ucucuuuugagcuaaucuucau

SEQ ID NO: 1271576 - RNA, 21 nt, Homo sapiens
ucugaaagagaaaucaaugaa

SEQ ID NO: 1271577 - RNA, 15 nt, Homo sapiens
ucugaaauggaauau

SEQ ID NO: 1271578 - RNA, 15 nt, Homo sapiens
ucugaacauucuccu

SEQ ID NO: 1271579 - RNA, 19 nt, Homo sapiens
ucugaacucaaacugagga

SEQ ID NO: 1271580 - RNA, 15 nt, Homo sapiens
ucugaacucucaaaa

SEQ ID NO: 1271581 - RNA, 19 nt, Homo sapiens
ucugaaguacuaacacaag

SEQ ID NO: 1271582 - RNA, 15 nt, Homo sapiens
ucugaagucacugca

SEQ ID NO: 1271583 - RNA, 17 nt, Homo sapiens
ucugaagucacugcaca

SEQ ID NO: 1271584 - RNA, 18 nt, Homo sapiens
ucugaauggaagaguguu

SEQ ID NO: 1271585 - RNA, 15 nt, Homo sapiens
ucugaauguauuuau

SEQ ID NO: 1271586 - RNA, 18 nt, Homo sapiens
ucugaaugugcugaucau

SEQ ID NO: 1271587 - RNA, 15 nt, Homo sapiens
ucugaauuaauuaau

SEQ ID NO: 1271588 - RNA, 15 nt, Homo sapiens
ucugacaugcauugu

SEQ ID NO: 1271589 - RNA, 18 nt, Homo sapiens
ucugaccauuucaggggu

SEQ ID NO: 1271590 - RNA, 12 nt, Homo sapiens
ucugaccuguac

SEQ ID NO: 1271591 - RNA, 18 nt, Homo sapiens
ucugacugccaagccaga

SEQ ID NO: 1271592 - RNA, 23 nt, Homo sapiens
ucugagaagacacaaggugauuu

SEQ ID NO: 1271593 - RNA, 13 nt, Homo sapiens
ucugagaccagug

SEQ ID NO: 1271594 - RNA, 13 nt, Homo sapiens
ucugagacucaca

SEQ ID NO: 1271595 - RNA, 22 nt, Homo sapiens
ucugagccaaagagaaugccau

SEQ ID NO: 1271596 - RNA, 17 nt, Homo sapiens
ucugaggauucaggggc

SEQ ID NO: 1271597 - RNA, 20 nt, Homo sapiens
ucugaggcccugcccaauga

SEQ ID NO: 1271598 - RNA, 17 nt, Homo sapiens
ucugagggagcugagua

SEQ ID NO: 1271599 - RNA, 21 nt, Homo sapiens
ucugagggaggaggccaccuc

SEQ ID NO: 1271600 - RNA, 13 nt, Homo sapiens
ucugaggucauua

SEQ ID NO: 1271601 - RNA, 14 nt, Homo sapiens
ucugaggucccugu

SEQ ID NO: 1271602 - RNA, 18 nt, Homo sapiens
ucugaguccuuugcuaau

SEQ ID NO: 1271603 - RNA, 20 nt, Homo sapiens
ucugagugaauuacagacaa

SEQ ID NO: 1271604 - RNA, 21 nt, Homo sapiens
ucugauaaaagauggccauau

SEQ ID NO: 1271605 - RNA, 13 nt, Homo sapiens
ucugauaagcaag

SEQ ID NO: 1271606 - RNA, 21 nt, Homo sapiens
ucugauaagcuuccuagaaag

SEQ ID NO: 1271607 - RNA, 22 nt, Homo sapiens
ucugaucauccacugugccaug

SEQ ID NO: 1271608 - RNA, 22 nt, Homo sapiens
ucugaucugcaguuuuugccug

SEQ ID NO: 1271609 - RNA, 18 nt, Homo sapiens
ucugauuaaaaugcuucc

SEQ ID NO: 1271610 - RNA, 18 nt, Homo sapiens
ucugauuacuguccagcu

SEQ ID NO: 1271611 - RNA, 18 nt, Homo sapiens
ucugcaaagugauucacu

SEQ ID NO: 1271612 - RNA, 23 nt, Homo sapiens
ucugcaagugaggugugucacaa

SEQ ID NO: 1271613 - RNA, 23 nt, Homo sapiens
ucugcaauaugaauucaagaaag

SEQ ID NO: 1271614 - RNA, 20 nt, Homo sapiens
ucugcaaugggcacugggau

SEQ ID NO: 1271615 - RNA, 16 nt, Homo sapiens
ucugcacacaaaacuc

SEQ ID NO: 1271616 - RNA, 13 nt, Homo sapiens
ucugcacugaaaa

SEQ ID NO: 1271617 - RNA, 16 nt, Homo sapiens
ucugcagcuaacuuau

SEQ ID NO: 1271618 - RNA, 19 nt, Homo sapiens
ucugcauuccugaugacca

SEQ ID NO: 1271619 - RNA, 15 nt, Homo sapiens
ucugccacacucuga

SEQ ID NO: 1271620 - RNA, 12 nt, Homo sapiens
ucugccaggcaa

SEQ ID NO: 1271621 - RNA, 20 nt, Homo sapiens
ucugccccagcucuggcuuc

SEQ ID NO: 1271622 - RNA, 18 nt, Homo sapiens
ucugccccguuucuugcc

SEQ ID NO: 1271623 - RNA, 16 nt, Homo sapiens
ucugccccugaucacu

SEQ ID NO: 1271624 - RNA, 14 nt, Homo sapiens
ucugccucugacac

SEQ ID NO: 1271625 - RNA, 17 nt, Homo sapiens
ucugccugaagucacac

SEQ ID NO: 1271626 - RNA, 20 nt, Homo sapiens
ucugccuguggaguagccau

SEQ ID NO: 1271627 - RNA, 19 nt, Homo sapiens
ucugccuguuauaacucug

SEQ ID NO: 1271628 - RNA, 21 nt, Homo sapiens
ucugcgcaccaaggaauggag

SEQ ID NO: 1271629 - RNA, 13 nt, Homo sapiens
ucugcggaucuca

SEQ ID NO: 1271630 - RNA, 19 nt, Homo sapiens
ucugcggggcagggccuuc

SEQ ID NO: 1271631 - RNA, 13 nt, Homo sapiens
ucugcuaugcuau

SEQ ID NO: 1271632 - RNA, 18 nt, Homo sapiens
ucugcuaugcuauugaag

SEQ ID NO: 1271633 - RNA, 20 nt, Homo sapiens
ucugcucacauaucugucau

SEQ ID NO: 1271634 - RNA, 14 nt, Homo sapiens
ucugcucacuuuaa

SEQ ID NO: 1271635 - RNA, 17 nt, Homo sapiens
ucugcuccagguucacu

SEQ ID NO: 1271636 - RNA, 21 nt, Homo sapiens
ucugcucugguuagaaaaagg

SEQ ID NO: 1271637 - RNA, 19 nt, Homo sapiens
ucugcugcccaggccacag

SEQ ID NO: 1271638 - RNA, 19 nt, Homo sapiens
ucugcuggccuggaucucc

SEQ ID NO: 1271639 - RNA, 21 nt, Homo sapiens
ucugcugugauuuaucugcug

SEQ ID NO: 1271640 - RNA, 19 nt, Homo sapiens
ucugcuuuucccauugcca

SEQ ID NO: 1271641 - RNA, 23 nt, Homo sapiens
ucugcuuuuuaaagaaugcucuu

SEQ ID NO: 1271642 - RNA, 23 nt, Homo sapiens
ucuggaagggauggguggugcuc

SEQ ID NO: 1271643 - RNA, 14 nt, Homo sapiens
ucuggaagucaucu

SEQ ID NO: 1271644 - RNA, 21 nt, Homo sapiens
ucuggaccauauaccaucucc

SEQ ID NO: 1271645 - RNA, 22 nt, Homo sapiens
ucuggagaccguccuggagcug

SEQ ID NO: 1271646 - RNA, 23 nt, Homo sapiens
ucuggagggguguggcuccuucc

SEQ ID NO: 1271647 - RNA, 19 nt, Homo sapiens
ucuggagugguaacagcuc

SEQ ID NO: 1271648 - RNA, 23 nt, Homo sapiens
ucuggcaacagagcaagacucca

SEQ ID NO: 1271649 - RNA, 18 nt, Homo sapiens
ucuggcaucuuagaccuc

SEQ ID NO: 1271650 - RNA, 23 nt, Homo sapiens
ucuggcccacccccaacaggaau

SEQ ID NO: 1271651 - RNA, 20 nt, Homo sapiens
ucuggccugggcgacagagc

SEQ ID NO: 1271652 - RNA, 20 nt, Homo sapiens
ucuggccuugaaaccaccuu

SEQ ID NO: 1271653 - RNA, 18 nt, Homo sapiens
ucuggcucuaauucacag

SEQ ID NO: 1271654 - RNA, 12 nt, Homo sapiens
ucuggcucucau

SEQ ID NO: 1271655 - RNA, 20 nt, Homo sapiens
ucugggaagcugagggcaaa

SEQ ID NO: 1271656 - RNA, 23 nt, Homo sapiens
ucugggagaaaugagauaaaaga

SEQ ID NO: 1271657 - RNA, 17 nt, Homo sapiens
ucugggagcucaaguga

SEQ ID NO: 1271658 - RNA, 15 nt, Homo sapiens
ucugggaggcccuga

SEQ ID NO: 1271659 - RNA, 15 nt, Homo sapiens
ucugggcagcuccug

SEQ ID NO: 1271660 - RNA, 22 nt, Homo sapiens
ucugggcugucagcccaugugc

SEQ ID NO: 1271661 - RNA, 17 nt, Homo sapiens
ucuggggagcucaggaa

SEQ ID NO: 1271662 - RNA, 21 nt, Homo sapiens
ucuggggccuuuaucaaaaaa

SEQ ID NO: 1271663 - RNA, 20 nt, Homo sapiens
ucugggggacagagaaggcg

SEQ ID NO: 1271664 - RNA, 20 nt, Homo sapiens
ucuggggugcugagugagcu

SEQ ID NO: 1271665 - RNA, 17 nt, Homo sapiens
ucugggugcagcugaga

SEQ ID NO: 1271666 - RNA, 22 nt, Homo sapiens
ucugguaauauugacuuguaua

SEQ ID NO: 1271667 - RNA, 16 nt, Homo sapiens
ucuggucgcuccugcc

SEQ ID NO: 1271668 - RNA, 17 nt, Homo sapiens
ucuggugcuuucuguca

SEQ ID NO: 1271669 - RNA, 20 nt, Homo sapiens
ucugguuagaaaaaggacuc

SEQ ID NO: 1271670 - RNA, 20 nt, Homo sapiens
ucugguuuuaacaauuuccu

SEQ ID NO: 1271671 - RNA, 19 nt, Homo sapiens
ucagagcaugauacaaauu

SEQ ID NO: 1271672 - RNA, 20 nt, Homo sapiens
ucagagccccuacagcauug

SEQ ID NO: 1271673 - RNA, 21 nt, Homo sapiens
ucagaggacuggacgugcuca

SEQ ID NO: 1271674 - RNA, 15 nt, Homo sapiens
ucagaggagccaaua

SEQ ID NO: 1271675 - RNA, 14 nt, Homo sapiens
ucagaggagcucua

SEQ ID NO: 1271676 - RNA, 23 nt, Homo sapiens
ucagaggccugcugccagugcag

SEQ ID NO: 1271677 - RNA, 20 nt, Homo sapiens
ucagagguguacacuaacau

SEQ ID NO: 1271678 - RNA, 23 nt, Homo sapiens
ucagagugacuacacacaguacg

SEQ ID NO: 1271679 - RNA, 17 nt, Homo sapiens
ucagaguuuguguguau

SEQ ID NO: 1271680 - RNA, 18 nt, Homo sapiens
ucagauaaacaacaaaua

SEQ ID NO: 1271681 - RNA, 21 nt, Homo sapiens
ucagauacaugguugugaccu

SEQ ID NO: 1271682 - RNA, 13 nt, Homo sapiens
ucagauaugauau

SEQ ID NO: 1271683 - RNA, 17 nt, Homo sapiens
ucagaucauauuucaca

SEQ ID NO: 1271684 - RNA, 17 nt, Homo sapiens
ucagaucugaacacagu

SEQ ID NO: 1271685 - RNA, 20 nt, Homo sapiens
ucagaugcuccaagauucua

SEQ ID NO: 1271686 - RNA, 12 nt, Homo sapiens
ucagauggacaa

SEQ ID NO: 1271687 - RNA, 20 nt, Homo sapiens
ucagaugggucugauauuaa

SEQ ID NO: 1271688 - RNA, 23 nt, Homo sapiens
ucagauuaccaguuauaggaaca

SEQ ID NO: 1271689 - RNA, 15 nt, Homo sapiens
ucagauuuguguuau

SEQ ID NO: 1271690 - RNA, 21 nt, Homo sapiens
ucagauuuuaaaaagucuuca

SEQ ID NO: 1271691 - RNA, 13 nt, Homo sapiens
ucagcaaaccauu

SEQ ID NO: 1271692 - RNA, 18 nt, Homo sapiens
ucagcaaggggcucugcc

SEQ ID NO: 1271693 - RNA, 17 nt, Homo sapiens
ucagcaaugccauuuca

SEQ ID NO: 1271694 - RNA, 20 nt, Homo sapiens
ucagcacaggccauggugca

SEQ ID NO: 1271695 - RNA, 17 nt, Homo sapiens
ucagcaccugacccugu

SEQ ID NO: 1271696 - RNA, 22 nt, Homo sapiens
ucagcagaaacacacagucaca

SEQ ID NO: 1271697 - RNA, 22 nt, Homo sapiens
ucagcagaauacugcuugcuua

SEQ ID NO: 1271698 - RNA, 15 nt, Homo sapiens
ucagcagagaacugg

SEQ ID NO: 1271699 - RNA, 17 nt, Homo sapiens
ucagcagagaaguuuuc

SEQ ID NO: 1271700 - RNA, 16 nt, Homo sapiens
ucagcaguccacaaag

SEQ ID NO: 1271701 - RNA, 16 nt, Homo sapiens
ucagcaucugugaugg

SEQ ID NO: 1271702 - RNA, 21 nt, Homo sapiens
ucagcaugccugaacuacaua

SEQ ID NO: 1271703 - RNA, 15 nt, Homo sapiens
ucagcauguccaaca

SEQ ID NO: 1271704 - RNA, 20 nt, Homo sapiens
ucagcauuauuccuccagga

SEQ ID NO: 1271705 - RNA, 14 nt, Homo sapiens
ucagcauugucucg

SEQ ID NO: 1271706 - RNA, 23 nt, Homo sapiens
ucagcauugucucguguacagcu

SEQ ID NO: 1271707 - RNA, 23 nt, Homo sapiens
ucagccaagcuuguuaucagcuu

SEQ ID NO: 1271708 - RNA, 21 nt, Homo sapiens
ucagccaauccgauugccuua

SEQ ID NO: 1271709 - RNA, 14 nt, Homo sapiens
ucagccacauucua

SEQ ID NO: 1271710 - RNA, 21 nt, Homo sapiens
ucagccagcaagagggaacaa

SEQ ID NO: 1271711 - RNA, 23 nt, Homo sapiens
ucagccagcccauggcccccaau

SEQ ID NO: 1271712 - RNA, 13 nt, Homo sapiens
ucagcccuggauu

SEQ ID NO: 1271713 - RNA, 20 nt, Homo sapiens
ucagccucccaaagugcuga

SEQ ID NO: 1271714 - RNA, 13 nt, Homo sapiens
ucagccucccaca

SEQ ID NO: 1271715 - RNA, 20 nt, Homo sapiens
ucagcuacuucugaaacugc

SEQ ID NO: 1271716 - RNA, 15 nt, Homo sapiens
ucagcuacuuuccau

SEQ ID NO: 1271717 - RNA, 12 nt, Homo sapiens
ucagcugaccau

SEQ ID NO: 1271718 - RNA, 19 nt, Homo sapiens
ucagcugcaagguacucug

SEQ ID NO: 1271719 - RNA, 12 nt, Homo sapiens
ucagcugccuca

SEQ ID NO: 1271720 - RNA, 20 nt, Homo sapiens
ucagcuggguacgguggcac

SEQ ID NO: 1271721 - RNA, 19 nt, Homo sapiens
ucagcuguaguccucauaa

SEQ ID NO: 1271722 - RNA, 17 nt, Homo sapiens
ucagcuuauaugugaca

SEQ ID NO: 1271723 - RNA, 13 nt, Homo sapiens
ucagcuuaucucu

SEQ ID NO: 1271724 - RNA, 23 nt, Homo sapiens
ucagcuuuuugauccucuacugu

SEQ ID NO: 1271725 - RNA, 23 nt, Homo sapiens
ucaggaaagagauuagaacauuu

SEQ ID NO: 1271726 - RNA, 16 nt, Homo sapiens
ucaggaagaagagaug

SEQ ID NO: 1271727 - RNA, 21 nt, Homo sapiens
ucaggaaggucuucaaucuua

SEQ ID NO: 1271728 - RNA, 16 nt, Homo sapiens
ucaggaaguccagcca

SEQ ID NO: 1271729 - RNA, 22 nt, Homo sapiens
ucaggagaguagcaacaaaagg

SEQ ID NO: 1271730 - RNA, 18 nt, Homo sapiens
ucaggagcuagagccauu

SEQ ID NO: 1271731 - RNA, 20 nt, Homo sapiens
ucaggaugauacacuaugaa

SEQ ID NO: 1271732 - RNA, 12 nt, Homo sapiens
ucaggcaccugc

SEQ ID NO: 1271733 - RNA, 13 nt, Homo sapiens
ucaggcagcucaa

SEQ ID NO: 1271734 - RNA, 18 nt, Homo sapiens
ucaggccccacuccuucc

SEQ ID NO: 1271735 - RNA, 22 nt, Homo sapiens
ucaggccccugcagcugccuca

SEQ ID NO: 1271736 - RNA, 17 nt, Homo sapiens
ucaggcggggugggcag

SEQ ID NO: 1271737 - RNA, 23 nt, Homo sapiens
ucaggcugggcagccccagagag

SEQ ID NO: 1271738 - RNA, 14 nt, Homo sapiens
ucagggacagagcc

SEQ ID NO: 1271739 - RNA, 18 nt, Homo sapiens
ucagggaccagcuuuacu

SEQ ID NO: 1271740 - RNA, 13 nt, Homo sapiens
ucaggguccagug

SEQ ID NO: 1271741 - RNA, 18 nt, Homo sapiens
ucaggguuggugugcuga

SEQ ID NO: 1271742 - RNA, 15 nt, Homo sapiens
ucagguaccaaggaa

SEQ ID NO: 1271743 - RNA, 20 nt, Homo sapiens
ucagguggccagccuggauc

SEQ ID NO: 1271744 - RNA, 22 nt, Homo sapiens
ucaggugucccugcacuugcag

SEQ ID NO: 1271745 - RNA, 17 nt, Homo sapiens
ucagguuauauccaaua

SEQ ID NO: 1271746 - RNA, 14 nt, Homo sapiens
ucaguaaacaauga

SEQ ID NO: 1271747 - RNA, 18 nt, Homo sapiens
ucaguaaacaaugaauag

SEQ ID NO: 1271748 - RNA, 18 nt, Homo sapiens
ucaguaaucacuuuucag

SEQ ID NO: 1271749 - RNA, 21 nt, Homo sapiens
ucaguacacccaguugccaaa

SEQ ID NO: 1271750 - RNA, 16 nt, Homo sapiens
ucaguagaccuaauga

SEQ ID NO: 1271751 - RNA, 14 nt, Homo sapiens
ucaguauacugugu

SEQ ID NO: 1271752 - RNA, 14 nt, Homo sapiens
ucagucaacaacuu

SEQ ID NO: 1271753 - RNA, 12 nt, Homo sapiens
ucagucagggac

SEQ ID NO: 1271754 - RNA, 20 nt, Homo sapiens
ucaguccugcuccagaauuu

SEQ ID NO: 1271755 - RNA, 23 nt, Homo sapiens
ucaguccugggagacccauguaa

SEQ ID NO: 1271756 - RNA, 16 nt, Homo sapiens
ucagucuauccacaga

SEQ ID NO: 1271757 - RNA, 12 nt, Homo sapiens
ucagugaaggac

SEQ ID NO: 1271758 - RNA, 23 nt, Homo sapiens
ucagugacagaguucacuauaaa

SEQ ID NO: 1271759 - RNA, 16 nt, Homo sapiens
ucagugagauauuugg

SEQ ID NO: 1271760 - RNA, 14 nt, Homo sapiens
ucagugcaggagag

SEQ ID NO: 1271761 - RNA, 16 nt, Homo sapiens
ucagugggacucugau

SEQ ID NO: 1271762 - RNA, 17 nt, Homo sapiens
ucagugguggucuucaa

SEQ ID NO: 1271763 - RNA, 23 nt, Homo sapiens
ucagugguuagaagcaugucucu

SEQ ID NO: 1271764 - RNA, 17 nt, Homo sapiens
uccaacgccccuguggc

SEQ ID NO: 1271765 - RNA, 18 nt, Homo sapiens
uccaacuuuaucauggaa

SEQ ID NO: 1271766 - RNA, 15 nt, Homo sapiens
uccaagacagagaca

SEQ ID NO: 1271767 - RNA, 18 nt, Homo sapiens
uccaagcaaguagcuuuc

SEQ ID NO: 1271768 - RNA, 19 nt, Homo sapiens
uccaaggauggaccacaca

SEQ ID NO: 1271769 - RNA, 14 nt, Homo sapiens
uccaagggacccuu

SEQ ID NO: 1271770 - RNA, 17 nt, Homo sapiens
uccaagucuguaccuca

SEQ ID NO: 1271771 - RNA, 14 nt, Homo sapiens
uccaaguggcauaa

SEQ ID NO: 1271772 - RNA, 21 nt, Homo sapiens
uccaaguggcauaauucaggg

SEQ ID NO: 1271773 - RNA, 17 nt, Homo sapiens
uccaauaggcauuugau

SEQ ID NO: 1271774 - RNA, 13 nt, Homo sapiens
uccaauauuucug

SEQ ID NO: 1271775 - RNA, 15 nt, Homo sapiens
uccaaucaugaaaag

SEQ ID NO: 1271776 - RNA, 18 nt, Homo sapiens
uccaaugcacaguugcca

SEQ ID NO: 1271777 - RNA, 19 nt, Homo sapiens
uccaauggaauacugaaaa

SEQ ID NO: 1271778 - RNA, 11 nt, Homo sapiens
uccaaugucaa

SEQ ID NO: 1271779 - RNA, 14 nt, Homo sapiens
uccaauguguucaa

SEQ ID NO: 1271780 - RNA, 16 nt, Homo sapiens
uccaauuaguuuccuu

SEQ ID NO: 1271781 - RNA, 18 nt, Homo sapiens
uccaauuccaaagccaga

SEQ ID NO: 1271782 - RNA, 15 nt, Homo sapiens
uccacaccugggcau

SEQ ID NO: 1271783 - RNA, 22 nt, Homo sapiens
uccacagccgccugaaagccac

SEQ ID NO: 1271784 - RNA, 22 nt, Homo sapiens
uccacagcuuacagcaauuuga

SEQ ID NO: 1271785 - RNA, 23 nt, Homo sapiens
uccacagcuuuuacguaguaaaa

SEQ ID NO: 1271786 - RNA, 22 nt, Homo sapiens
uccacaguuaucuuagcuggau

SEQ ID NO: 1271787 - RNA, 16 nt, Homo sapiens
uccacaugcucugaga

SEQ ID NO: 1271788 - RNA, 14 nt, Homo sapiens
uccaccacaucugc

SEQ ID NO: 1271789 - RNA, 13 nt, Homo sapiens
uccaccagcagca

SEQ ID NO: 1271790 - RNA, 15 nt, Homo sapiens
uccacccagugcugc

SEQ ID NO: 1271791 - RNA, 17 nt, Homo sapiens
uccaccuaccacucaca

SEQ ID NO: 1271792 - RNA, 15 nt, Homo sapiens
uccaccuagacugua

SEQ ID NO: 1271793 - RNA, 16 nt, Homo sapiens
uccaccuagacuguaa

SEQ ID NO: 1271794 - RNA, 22 nt, Homo sapiens
uccaccuccaccacaucugcca

SEQ ID NO: 1271795 - RNA, 19 nt, Homo sapiens
uccaccucgggcacauuuu

SEQ ID NO: 1271796 - RNA, 13 nt, Homo sapiens
guuaaauuuagca

SEQ ID NO: 1271797 - RNA, 17 nt, Homo sapiens
guuaacacucaugaagc

SEQ ID NO: 1271798 - RNA, 14 nt, Homo sapiens
guuaacaggauauu

SEQ ID NO: 1271799 - RNA, 19 nt, Homo sapiens
guuaaccucagugucauuu

SEQ ID NO: 1271800 - RNA, 14 nt, Homo sapiens
guuaacuacauauu

SEQ ID NO: 1271801 - RNA, 19 nt, Homo sapiens
guuaacugugaaauaccac

SEQ ID NO: 1271802 - RNA, 13 nt, Homo sapiens
guuaacuguguau

SEQ ID NO: 1271803 - RNA, 11 nt, Homo sapiens
guuaacuuaau

SEQ ID NO: 1271804 - RNA, 17 nt, Homo sapiens
guuaagaacaucaaaac

SEQ ID NO: 1271805 - RNA, 23 nt, Homo sapiens
guuaagcaaaaugcuucugcaca

SEQ ID NO: 1271806 - RNA, 21 nt, Homo sapiens
guuaagcagauggaaugcugu

SEQ ID NO: 1271807 - RNA, 17 nt, Homo sapiens
guuaauaaaccuuugca

SEQ ID NO: 1271808 - RNA, 14 nt, Homo sapiens
guuaauaacagcuc

SEQ ID NO: 1271809 - RNA, 20 nt, Homo sapiens
guuaauaaucuaugaugaag

SEQ ID NO: 1271810 - RNA, 23 nt, Homo sapiens
guuaaucauauuugaaaaccaua

SEQ ID NO: 1271811 - RNA, 14 nt, Homo sapiens
guuaaucuccucag

SEQ ID NO: 1271812 - RNA, 13 nt, Homo sapiens
guuaaugccacaa

SEQ ID NO: 1271813 - RNA, 21 nt, Homo sapiens
guuaaugugauggauggcaca

SEQ ID NO: 1271814 - RNA, 17 nt, Homo sapiens
guuaauguuauaucaua

SEQ ID NO: 1271815 - RNA, 20 nt, Homo sapiens
guuaauucaccuauguuauu

SEQ ID NO: 1271816 - RNA, 16 nt, Homo sapiens
guuaauucagcacuga

SEQ ID NO: 1271817 - RNA, 14 nt, Homo sapiens
guuacaaagacaug

SEQ ID NO: 1271818 - RNA, 16 nt, Homo sapiens
guuacagguggggcau

SEQ ID NO: 1271819 - RNA, 13 nt, Homo sapiens
guuacccauucaa

SEQ ID NO: 1271820 - RNA, 14 nt, Homo sapiens
guuaccucugcaug

SEQ ID NO: 1271821 - RNA, 14 nt, Homo sapiens
guuacgaagacaaa

SEQ ID NO: 1271822 - RNA, 14 nt, Homo sapiens
guuacuagccucuc

SEQ ID NO: 1271823 - RNA, 18 nt, Homo sapiens
guuacuauucuguaucau

SEQ ID NO: 1271824 - RNA, 17 nt, Homo sapiens
guuacucccuacacuga

SEQ ID NO: 1271825 - RNA, 21 nt, Homo sapiens
guuacucccuacacugaugca

SEQ ID NO: 1271826 - RNA, 20 nt, Homo sapiens
guuacucuguaaaugaaaaa

SEQ ID NO: 1271827 - RNA, 21 nt, Homo sapiens
guuacugcuugaccaaagagc

SEQ ID NO: 1271828 - RNA, 24 nt, Homo sapiens
guuacuggcuucucuugagucaca

SEQ ID NO: 1271829 - RNA, 19 nt, Homo sapiens
guuacuguggccaguauuu

SEQ ID NO: 1271830 - RNA, 20 nt, Homo sapiens
guuacuguggccaguauuuu

SEQ ID NO: 1271831 - RNA, 15 nt, Homo sapiens
guuacuguucuugcu

SEQ ID NO: 1271832 - RNA, 16 nt, Homo sapiens
guuagaaaaauagcug

SEQ ID NO: 1271833 - RNA, 13 nt, Homo sapiens
guuagaccacuuu

SEQ ID NO: 1271834 - RNA, 22 nt, Homo sapiens
guuagagagcuuuucacuguga

SEQ ID NO: 1271835 - RNA, 13 nt, Homo sapiens
guuaggaguuaau

SEQ ID NO: 1271836 - RNA, 14 nt, Homo sapiens
guuaguagcccuuc

SEQ ID NO: 1271837 - RNA, 23 nt, Homo sapiens
guuaguugugaaagaaagcugag

SEQ ID NO: 1271838 - RNA, 22 nt, Homo sapiens
guuauaaaucaaugucacuuaa

SEQ ID NO: 1271839 - RNA, 19 nt, Homo sapiens
guuauaacucugcacuacu

SEQ ID NO: 1271840 - RNA, 16 nt, Homo sapiens
guuauauccaauagua

SEQ ID NO: 1271841 - RNA, 12 nt, Homo sapiens
guuaucaagcaa

SEQ ID NO: 1271842 - RNA, 16 nt, Homo sapiens
guuaucuuagcuggau

SEQ ID NO: 1271843 - RNA, 17 nt, Homo sapiens
guuaucuuagcuggaua

SEQ ID NO: 1271844 - RNA, 16 nt, Homo sapiens
guuauggucaauccca

SEQ ID NO: 1271845 - RNA, 10 nt, Homo sapiens
uaacagaauu

SEQ ID NO: 1271846 - RNA, 19 nt, Homo sapiens
uaacagaauuaaaguagau

SEQ ID NO: 1271847 - RNA, 15 nt, Homo sapiens
uaacagaccacugua

SEQ ID NO: 1271848 - RNA, 20 nt, Homo sapiens
uaacagacugaaaugugcuc

SEQ ID NO: 1271849 - RNA, 20 nt, Homo sapiens
uaacagaugcaaugugcuac

SEQ ID NO: 1271850 - RNA, 14 nt, Homo sapiens
uaacagcaaauaac

SEQ ID NO: 1271851 - RNA, 19 nt, Homo sapiens
uaacaguucacuuuuuaca

SEQ ID NO: 1271852 - RNA, 20 nt, Homo sapiens
uaacaguugugaugacuaug

SEQ ID NO: 1271853 - RNA, 19 nt, Homo sapiens
uaacauaaaggacaggcca

SEQ ID NO: 1271854 - RNA, 15 nt, Homo sapiens
uaacauaaugcacuu

SEQ ID NO: 1271855 - RNA, 18 nt, Homo sapiens
uaacaucaacaacacagc

SEQ ID NO: 1271856 - RNA, 20 nt, Homo sapiens
uaacaucaacaacacagcaa

SEQ ID NO: 1271857 - RNA, 22 nt, Homo sapiens
uaacaucgugggucacuacagg

SEQ ID NO: 1271858 - RNA, 20 nt, Homo sapiens
uaacaugaggcccauucuuc

SEQ ID NO: 1271859 - RNA, 14 nt, Homo sapiens
uaacaugauuucaa

SEQ ID NO: 1271860 - RNA, 15 nt, Homo sapiens
uaacaugcaaagauc

SEQ ID NO: 1271861 - RNA, 13 nt, Homo sapiens
uaacaugcuuaug

SEQ ID NO: 1271862 - RNA, 22 nt, Homo sapiens
uaacaugcuuaugacaaugacu

SEQ ID NO: 1271863 - RNA, 17 nt, Homo sapiens
uaacauuucuguucuca

SEQ ID NO: 1271864 - RNA, 18 nt, Homo sapiens
uaacauuucuguucucau

SEQ ID NO: 1271865 - RNA, 11 nt, Homo sapiens
uaacauuugcc

SEQ ID NO: 1271866 - RNA, 13 nt, Homo sapiens
uaacauuugccuu

SEQ ID NO: 1271867 - RNA, 21 nt, Homo sapiens
uaaccacaaagcacaguuuga

SEQ ID NO: 1271868 - RNA, 14 nt, Homo sapiens
uaaccaguucuguc

SEQ ID NO: 1271869 - RNA, 20 nt, Homo sapiens
uaaccccaacgcacaggaaa

SEQ ID NO: 1271870 - RNA, 21 nt, Homo sapiens
uaacccucacaagcaugaagu

SEQ ID NO: 1271871 - RNA, 13 nt, Homo sapiens
uaaccuauuucca

SEQ ID NO: 1271872 - RNA, 20 nt, Homo sapiens
uaaccuauuuccacauucuc

SEQ ID NO: 1271873 - RNA, 19 nt, Homo sapiens
uaaccucagugucauuuau

SEQ ID NO: 1271874 - RNA, 14 nt, Homo sapiens
uaaccucugcacua

SEQ ID NO: 1271875 - RNA, 12 nt, Homo sapiens
uaaccucuggcc

SEQ ID NO: 1271876 - RNA, 16 nt, Homo sapiens
uaaccucuucaccuua

SEQ ID NO: 1271877 - RNA, 17 nt, Homo sapiens
uaaccuggaccuggaac

SEQ ID NO: 1271878 - RNA, 16 nt, Homo sapiens
uaaccuuugcuaugua

SEQ ID NO: 1271879 - RNA, 14 nt, Homo sapiens
uaacuaacuggcag

SEQ ID NO: 1271880 - RNA, 18 nt, Homo sapiens
uaacuagaaaucugccaa

SEQ ID NO: 1271881 - RNA, 19 nt, Homo sapiens
uaacuagaaaucugccaau

SEQ ID NO: 1271882 - RNA, 17 nt, Homo sapiens
uaacuagaauuuauuca

SEQ ID NO: 1271883 - RNA, 22 nt, Homo sapiens
uaacuagacaccaaaguucuaa

SEQ ID NO: 1271884 - RNA, 18 nt, Homo sapiens
uaacuaugagccaggcau

SEQ ID NO: 1271885 - RNA, 23 nt, Homo sapiens
uaacucaccagccccacugccag

SEQ ID NO: 1271886 - RNA, 18 nt, Homo sapiens
uaacucaccucucaaggu

SEQ ID NO: 1271887 - RNA, 15 nt, Homo sapiens
uaacucacugagggu

SEQ ID NO: 1271888 - RNA, 13 nt, Homo sapiens
uaacucacuggaa

SEQ ID NO: 1271889 - RNA, 14 nt, Homo sapiens
uaacuccugccauu

SEQ ID NO: 1271890 - RNA, 15 nt, Homo sapiens
uaacugaaccaaauu

SEQ ID NO: 1271891 - RNA, 20 nt, Homo sapiens
uaacugaaccaaauugcacu

SEQ ID NO: 1271892 - RNA, 12 nt, Homo sapiens
uaagugugcaug

SEQ ID NO: 1271893 - RNA, 14 nt, Homo sapiens
uaaguguggagcug

SEQ ID NO: 1271894 - RNA, 21 nt, Homo sapiens
uaaguguguuguuuaaucuga

SEQ ID NO: 1271895 - RNA, 18 nt, Homo sapiens
uaaguguugguagcacuu

SEQ ID NO: 1271896 - RNA, 22 nt, Homo sapiens
uaaguugucuaaacaaugcuga

SEQ ID NO: 1271897 - RNA, 21 nt, Homo sapiens
uaaguuugaaggaaacaguua

SEQ ID NO: 1271898 - RNA, 21 nt, Homo sapiens
uaaguuuugaaauaagaaagu

SEQ ID NO: 1271899 - RNA, 21 nt, Homo sapiens
uaauaaaaccggucacugaug

SEQ ID NO: 1271900 - RNA, 19 nt, Homo sapiens
uaauaaaacugcacagugc

SEQ ID NO: 1271901 - RNA, 17 nt, Homo sapiens
uaauaaagcauucuuua

SEQ ID NO: 1271902 - RNA, 16 nt, Homo sapiens
uaauaaagucuaugga

SEQ ID NO: 1271903 - RNA, 14 nt, Homo sapiens
uaauaaauacugca

SEQ ID NO: 1271904 - RNA, 18 nt, Homo sapiens
uaauaaauauuuuugcca

SEQ ID NO: 1271905 - RNA, 13 nt, Homo sapiens
uaauaaaucacac

SEQ ID NO: 1271906 - RNA, 13 nt, Homo sapiens
uaauaacaauaua

SEQ ID NO: 1271907 - RNA, 13 nt, Homo sapiens
uaauaacagugca

SEQ ID NO: 1271908 - RNA, 17 nt, Homo sapiens
uaauaacagugcauauu

SEQ ID NO: 1271909 - RNA, 12 nt, Homo sapiens
uaauaauaccuc

SEQ ID NO: 1271910 - RNA, 21 nt, Homo sapiens
uaauaauagaaaaauacucau

SEQ ID NO: 1271911 - RNA, 15 nt, Homo sapiens
uaauaauguuuaaua

SEQ ID NO: 1271912 - RNA, 21 nt, Homo sapiens
uaauaauuauguauguuaugg

SEQ ID NO: 1271913 - RNA, 13 nt, Homo sapiens
uaauaauugauca

SEQ ID NO: 1271914 - RNA, 15 nt, Homo sapiens
uaauacagggcauuu

SEQ ID NO: 1271915 - RNA, 15 nt, Homo sapiens
uaauaccagaacucu

SEQ ID NO: 1271916 - RNA, 18 nt, Homo sapiens
uaauacuccuaagacuua

SEQ ID NO: 1271917 - RNA, 14 nt, Homo sapiens
uaauacugaaggac

SEQ ID NO: 1271918 - RNA, 23 nt, Homo sapiens
uaauagagauuaaaaacaacaaa

SEQ ID NO: 1271919 - RNA, 22 nt, Homo sapiens
uaauagcuauggaaucaauuca

SEQ ID NO: 1271920 - RNA, 16 nt, Homo sapiens
uaauaggcaucuccag

SEQ ID NO: 1271921 - RNA, 20 nt, Homo sapiens
uaauagggagaaaccaagag

SEQ ID NO: 1271922 - RNA, 16 nt, Homo sapiens
uaauagucuuugccag

SEQ ID NO: 1271923 - RNA, 17 nt, Homo sapiens
uaauagucuuugccagu

SEQ ID NO: 1271924 - RNA, 18 nt, Homo sapiens
uaauaguuuugauccuaa

SEQ ID NO: 1271925 - RNA, 22 nt, Homo sapiens
uaauauaaaaagcuuccaugau

SEQ ID NO: 1271926 - RNA, 13 nt, Homo sapiens
uaauaucuucaca

SEQ ID NO: 1271927 - RNA, 22 nt, Homo sapiens
uaauaugaaaaucuccaucuca

SEQ ID NO: 1271928 - RNA, 23 nt, Homo sapiens
uaauaugaguaauacaucaaaga

SEQ ID NO: 1271929 - RNA, 19 nt, Homo sapiens
uaauaugauuauuaaucag

SEQ ID NO: 1271930 - RNA, 17 nt, Homo sapiens
uaauauuaauuuccacu

SEQ ID NO: 1271931 - RNA, 20 nt, Homo sapiens
uaauauucacauguucuaau

SEQ ID NO: 1271932 - RNA, 15 nt, Homo sapiens
uaauauugaugucag

SEQ ID NO: 1271933 - RNA, 15 nt, Homo sapiens
uaauauugcagucaa

SEQ ID NO: 1271934 - RNA, 15 nt, Homo sapiens
uaauauugugcaaac

SEQ ID NO: 1271935 - RNA, 17 nt, Homo sapiens
uaauauuucaagugccu

SEQ ID NO: 1271936 - RNA, 18 nt, Homo sapiens
uaauauuucaagugccua

SEQ ID NO: 1271937 - RNA, 19 nt, Homo sapiens
uaauauuucaagugccuag

SEQ ID NO: 1271938 - RNA, 22 nt, Homo sapiens
uaauauuucugaaaaccuacca

SEQ ID NO: 1271939 - RNA, 20 nt, Homo sapiens
uaguuuuuccuaucauguua

SEQ ID NO: 1271940 - RNA, 21 nt, Homo sapiens
uaguuuuuggacuauguaaac

SEQ ID NO: 1271941 - RNA, 12 nt, Homo sapiens
uauaaacauauc

SEQ ID NO: 1271942 - RNA, 15 nt, Homo sapiens
uauaaaccaaucuua

SEQ ID NO: 1271943 - RNA, 13 nt, Homo sapiens
uauaaacuccuua

SEQ ID NO: 1271944 - RNA, 16 nt, Homo sapiens
uauaaagcaacuguua

SEQ ID NO: 1271945 - RNA, 19 nt, Homo sapiens
uauaaauacguauuacaaa

SEQ ID NO: 1271946 - RNA, 15 nt, Homo sapiens
uauaaaucuguuaua

SEQ ID NO: 1271947 - RNA, 22 nt, Homo sapiens
uauaaaugaauuugcauaccag

SEQ ID NO: 1271948 - RNA, 14 nt, Homo sapiens
uauaaaugagcaaa

SEQ ID NO: 1271949 - RNA, 20 nt, Homo sapiens
uauaaaugggaaaucagugu

SEQ ID NO: 1271950 - RNA, 18 nt, Homo sapiens
uauaaauguauauacaca

SEQ ID NO: 1271951 - RNA, 20 nt, Homo sapiens
uauaaauuuuauaacagaau

SEQ ID NO: 1271952 - RNA, 20 nt, Homo sapiens
uauaaccaagugugcucuuu

SEQ ID NO: 1271953 - RNA, 14 nt, Homo sapiens
uauaacuaacaugu

SEQ ID NO: 1271954 - RNA, 12 nt, Homo sapiens
uauaacucugca

SEQ ID NO: 1271955 - RNA, 18 nt, Homo sapiens
uauaacucugcacuacuc

SEQ ID NO: 1271956 - RNA, 19 nt, Homo sapiens
uauaagauucauauuuacu

SEQ ID NO: 1271957 - RNA, 16 nt, Homo sapiens
uauaagcaucugccau

SEQ ID NO: 1271958 - RNA, 19 nt, Homo sapiens
uauaauaaagaaguguucu

SEQ ID NO: 1271959 - RNA, 13 nt, Homo sapiens
uauaaucauauca

SEQ ID NO: 1271960 - RNA, 15 nt, Homo sapiens
uauaaucugaagaua

SEQ ID NO: 1271961 - RNA, 22 nt, Homo sapiens
uauaaucuuccauacuucuuca

SEQ ID NO: 1271962 - RNA, 17 nt, Homo sapiens
uauaauucacucaagca

SEQ ID NO: 1271963 - RNA, 22 nt, Homo sapiens
uauaauucuguacauagccuau

SEQ ID NO: 1271964 - RNA, 18 nt, Homo sapiens
uauaauuggugcauagca

SEQ ID NO: 1271965 - RNA, 15 nt, Homo sapiens
uauacaaaacuuuau

SEQ ID NO: 1271966 - RNA, 19 nt, Homo sapiens
uauacaaguuguucuagua

SEQ ID NO: 1271967 - RNA, 14 nt, Homo sapiens
uauacaauauacuu

SEQ ID NO: 1271968 - RNA, 21 nt, Homo sapiens
uauacacuauuugugagcaaa

SEQ ID NO: 1271969 - RNA, 19 nt, Homo sapiens
uauacagauucuagccaaa

SEQ ID NO: 1271970 - RNA, 23 nt, Homo sapiens
uauacauguguguauauaugugu

SEQ ID NO: 1271971 - RNA, 12 nt, Homo sapiens
uauacauuugau

SEQ ID NO: 1271972 - RNA, 18 nt, Homo sapiens
uauacauuugauguauug

SEQ ID NO: 1271973 - RNA, 23 nt, Homo sapiens
uauaccuccuauauguccauuua

SEQ ID NO: 1271974 - RNA, 15 nt, Homo sapiens
uauacgcaucuauaa

SEQ ID NO: 1271975 - RNA, 13 nt, Homo sapiens
uauacugcaaaag

SEQ ID NO: 1271976 - RNA, 15 nt, Homo sapiens
uauacuuuaguauga

SEQ ID NO: 1271977 - RNA, 16 nt, Homo sapiens
uauagaaguuugucca

SEQ ID NO: 1271978 - RNA, 15 nt, Homo sapiens
uauagauguuuacua

SEQ ID NO: 1271979 - RNA, 22 nt, Homo sapiens
uauagcaacuuuaagaaguaau

SEQ ID NO: 1271980 - RNA, 14 nt, Homo sapiens
uauaggucauggga

SEQ ID NO: 1271981 - RNA, 19 nt, Homo sapiens
uauaguaugaaugcagugg

SEQ ID NO: 1271982 - RNA, 17 nt, Homo sapiens
uauaguuaauaaucuau

SEQ ID NO: 1271983 - RNA, 21 nt, Homo sapiens
uauaguuauugcacaaguuca

SEQ ID NO: 1271984 - RNA, 23 nt, Homo sapiens
uauaguuguuuuauauguugcua

SEQ ID NO: 1271985 - RNA, 16 nt, Homo sapiens
uauaguuucugaggcu

SEQ ID NO: 1271986 - RNA, 12 nt, Homo sapiens
uauauaaccaau

SEQ ID NO: 1271987 - RNA, 13 nt, Homo sapiens
uauauaaguuuac

SEQ ID NO: 1271988 - RNA, 15 nt, Homo sapiens
uauauacauacugca

SEQ ID NO: 1271989 - RNA, 22 nt, Homo sapiens
uauauaccuggcuuuuacuuua

SEQ ID NO: 1271990 - RNA, 19 nt, Homo sapiens
uauauagaaaaugcuaaag

SEQ ID NO: 1271991 - RNA, 23 nt, Homo sapiens
uauauagaaugaucuauugcuca

SEQ ID NO: 1271992 - RNA, 17 nt, Homo sapiens
uauauagacaugcacac

SEQ ID NO: 1271993 - RNA, 17 nt, Homo sapiens
uauauaguaugaaugca

SEQ ID NO: 1271994 - RNA, 15 nt, Homo sapiens
uauauauacauaugu

SEQ ID NO: 1271995 - RNA, 12 nt, Homo sapiens
uauaucagggaa

SEQ ID NO: 1271996 - RNA, 13 nt, Homo sapiens
uauaucauaugua

SEQ ID NO: 1271997 - RNA, 15 nt, Homo sapiens
uauaucuaccccaga

SEQ ID NO: 1271998 - RNA, 20 nt, Homo sapiens
uauaucuuagguaagacaua

SEQ ID NO: 1271999 - RNA, 14 nt, Homo sapiens
uauaugauucacau

SEQ ID NO: 1272000 - RNA, 21 nt, Homo sapiens
uauaugcuggacugcauucac

SEQ ID NO: 1272001 - RNA, 14 nt, Homo sapiens
uauauguacaugag

SEQ ID NO: 1272002 - RNA, 20 nt, Homo sapiens
uauauuaaaauaagcacugu

SEQ ID NO: 1272003 - RNA, 13 nt, Homo sapiens
uauauuaauauca

SEQ ID NO: 1272004 - RNA, 17 nt, Homo sapiens
uauauuacaagccuaca

SEQ ID NO: 1272005 - RNA, 13 nt, Homo sapiens
uauauuauggaag

SEQ ID NO: 1272006 - RNA, 20 nt, Homo sapiens
uauauuuaaaaaauuaugga

SEQ ID NO: 1272007 - RNA, 18 nt, Homo sapiens
uauauuuaaauaaaggaa

SEQ ID NO: 1272008 - RNA, 17 nt, Homo sapiens
uauauuugaauaucauu

SEQ ID NO: 1272009 - RNA, 21 nt, Homo sapiens
uaucaaacccuagccuugcuu

SEQ ID NO: 1272010 - RNA, 11 nt, Homo sapiens
uaucaaagugu

SEQ ID NO: 1272011 - RNA, 20 nt, Homo sapiens
uaucaauuggcagugacuuu

SEQ ID NO: 1272012 - RNA, 14 nt, Homo sapiens
uaucacacauauca

SEQ ID NO: 1272013 - RNA, 20 nt, Homo sapiens
uaucacagcuuucaaaagca

SEQ ID NO: 1272014 - RNA, 19 nt, Homo sapiens
uaucaccucuuaugcacac

SEQ ID NO: 1272015 - RNA, 16 nt, Homo sapiens
uaucacgccuacuuaa

SEQ ID NO: 1272016 - RNA, 18 nt, Homo sapiens
uaucacucccacuuccuu

SEQ ID NO: 1272017 - RNA, 17 nt, Homo sapiens
uaucacucuaaaaaaca

SEQ ID NO: 1272018 - RNA, 13 nt, Homo sapiens
uaucagacaagca

SEQ ID NO: 1272019 - RNA, 16 nt, Homo sapiens
uaucagagcucuuaau

SEQ ID NO: 1272020 - RNA, 23 nt, Homo sapiens
uaucagccgauaucaacacuugu

SEQ ID NO: 1272021 - RNA, 13 nt, Homo sapiens
uaucaguuuccag

SEQ ID NO: 1272022 - RNA, 15 nt, Homo sapiens
uaucauacuguucaa

SEQ ID NO: 1272023 - RNA, 21 nt, Homo sapiens
uaucaucacauugagcugaua

SEQ ID NO: 1272024 - RNA, 18 nt, Homo sapiens
uaucaucuuuugaucuuu

SEQ ID NO: 1272025 - RNA, 19 nt, Homo sapiens
uaucaugaagcacaucaau

SEQ ID NO: 1272026 - RNA, 22 nt, Homo sapiens
uaucauuuuuuuaacacauaac

SEQ ID NO: 1272027 - RNA, 23 nt, Homo sapiens
gaugccgagguaaaaguucuuuu

SEQ ID NO: 1272028 - RNA, 12 nt, Homo sapiens
gaugccucagag

SEQ ID NO: 1272029 - RNA, 17 nt, Homo sapiens
gaugccuguguacugcc

SEQ ID NO: 1272030 - RNA, 22 nt, Homo sapiens
gaugcugaggguguuucuuccu

SEQ ID NO: 1272031 - RNA, 14 nt, Homo sapiens
gaugcugugcuaug

SEQ ID NO: 1272032 - RNA, 22 nt, Homo sapiens
gauggaauauuccccuaucucu

SEQ ID NO: 1272033 - RNA, 19 nt, Homo sapiens
gauggaccagugguuucca

SEQ ID NO: 1272034 - RNA, 21 nt, Homo sapiens
gauggaccuccuucgcuggaa

SEQ ID NO: 1272035 - RNA, 17 nt, Homo sapiens
gauggagacaccaaccg

SEQ ID NO: 1272036 - RNA, 17 nt, Homo sapiens
gauggaggggugguccu

SEQ ID NO: 1272037 - RNA, 22 nt, Homo sapiens
gauggaugaaucucccacucca

SEQ ID NO: 1272038 - RNA, 21 nt, Homo sapiens
gauggaugucuucuagcugca

SEQ ID NO: 1272039 - RNA, 23 nt, Homo sapiens
gauggcauaggccuuagcaguaa

SEQ ID NO: 1272040 - RNA, 22 nt, Homo sapiens
gauggccacugugaauaacugu

SEQ ID NO: 1272041 - RNA, 14 nt, Homo sapiens
gauggcucguggga

SEQ ID NO: 1272042 - RNA, 19 nt, Homo sapiens
gauggcuuuuucuccuugg

SEQ ID NO: 1272043 - RNA, 13 nt, Homo sapiens
gaugggaucccag

SEQ ID NO: 1272044 - RNA, 22 nt, Homo sapiens
gaugggccaccgccgacuuugu

SEQ ID NO: 1272045 - RNA, 20 nt, Homo sapiens
gaugggcggacggcugugga

SEQ ID NO: 1272046 - RNA, 13 nt, Homo sapiens
gauggggcacuga

SEQ ID NO: 1272047 - RNA, 22 nt, Homo sapiens
gauggggcaugugccauagugc

SEQ ID NO: 1272048 - RNA, 14 nt, Homo sapiens
gauggguccucacg

SEQ ID NO: 1272049 - RNA, 21 nt, Homo sapiens
gaugguaucuggguaagaaga

SEQ ID NO: 1272050 - RNA, 21 nt, Homo sapiens
gauggugguggaaggugugcu

SEQ ID NO: 1272051 - RNA, 18 nt, Homo sapiens
gauguaaaacugaacuuc

SEQ ID NO: 1272052 - RNA, 16 nt, Homo sapiens
gaugucauuaaugugu

SEQ ID NO: 1272053 - RNA, 16 nt, Homo sapiens
gaugucuaccucagaa

SEQ ID NO: 1272054 - RNA, 17 nt, Homo sapiens
gaugugaucacugagac

SEQ ID NO: 1272055 - RNA, 20 nt, Homo sapiens
gauguggguguccugcagaa

SEQ ID NO: 1272056 - RNA, 19 nt, Homo sapiens
gauguguuaggaaugucaa

SEQ ID NO: 1272057 - RNA, 20 nt, Homo sapiens
gauguugacgccuaacugaa

SEQ ID NO: 1272058 - RNA, 15 nt, Homo sapiens
gauguuucaaaaaau

SEQ ID NO: 1272059 - RNA, 15 nt, Homo sapiens
gauguuucauaagaa

SEQ ID NO: 1272060 - RNA, 18 nt, Homo sapiens
gauguuuucccuuaacuu

SEQ ID NO: 1272061 - RNA, 15 nt, Homo sapiens
gauuaaaagcacaag

SEQ ID NO: 1272062 - RNA, 17 nt, Homo sapiens
gauuaacaacaggaaau

SEQ ID NO: 1272063 - RNA, 17 nt, Homo sapiens
gauuaagauuuuacaaa

SEQ ID NO: 1272064 - RNA, 15 nt, Homo sapiens
gauuaauguuuugua

SEQ ID NO: 1272065 - RNA, 21 nt, Homo sapiens
gauuacaaaucagaagucauc

SEQ ID NO: 1272066 - RNA, 15 nt, Homo sapiens
gauuacaggcaccca

SEQ ID NO: 1272067 - RNA, 19 nt, Homo sapiens
gauuacaggcaugagccac

SEQ ID NO: 1272068 - RNA, 18 nt, Homo sapiens
gauuacaggugugaacca

SEQ ID NO: 1272069 - RNA, 19 nt, Homo sapiens
gauuaccugccaauugcua

SEQ ID NO: 1272070 - RNA, 20 nt, Homo sapiens
gauuacuaucauggcauaua

SEQ ID NO: 1272071 - RNA, 18 nt, Homo sapiens
gauuagcaaggucauuuc

SEQ ID NO: 1272072 - RNA, 20 nt, Homo sapiens
gauuagucucuucuguguga

SEQ ID NO: 1272073 - RNA, 14 nt, Homo sapiens
gauuauaaacugac

SEQ ID NO: 1272074 - RNA, 13 nt, Homo sapiens
gauuauagauucu

SEQ ID NO: 1272075 - RNA, 20 nt, Homo sapiens
gauuaugaagugacucucac

SEQ ID NO: 1272076 - RNA, 12 nt, Homo sapiens
gauuauucugau

SEQ ID NO: 1272077 - RNA, 16 nt, Homo sapiens
gauucaacacauauuu

SEQ ID NO: 1272078 - RNA, 23 nt, Homo sapiens
gauucagcgaagucucaugggaa

SEQ ID NO: 1272079 - RNA, 20 nt, Homo sapiens
gauuccacacugcacuguua

SEQ ID NO: 1272080 - RNA, 12 nt, Homo sapiens
gauuccagagag

SEQ ID NO: 1272081 - RNA, 18 nt, Homo sapiens
gauuccggugccuccuga

SEQ ID NO: 1272082 - RNA, 16 nt, Homo sapiens
gauuccucacuuugaa

SEQ ID NO: 1272083 - RNA, 18 nt, Homo sapiens
gauucucugugucuaaga

SEQ ID NO: 1272084 - RNA, 16 nt, Homo sapiens
gauucugaaaccacag

SEQ ID NO: 1272085 - RNA, 15 nt, Homo sapiens
gcugauuuuaacaau

SEQ ID NO: 1272086 - RNA, 19 nt, Homo sapiens
gcugcaccacuuccagggu

SEQ ID NO: 1272087 - RNA, 20 nt, Homo sapiens
gcugcaccuucacucuccag

SEQ ID NO: 1272088 - RNA, 16 nt, Homo sapiens
gcugcagcuugggaga

SEQ ID NO: 1272089 - RNA, 19 nt, Homo sapiens
gcugcaggucaacagcuau

SEQ ID NO: 1272090 - RNA, 15 nt, Homo sapiens
gcugcagguggcaga

SEQ ID NO: 1272091 - RNA, 14 nt, Homo sapiens
gcugcagucaucua

SEQ ID NO: 1272092 - RNA, 15 nt, Homo sapiens
gcugcagucaucuac

SEQ ID NO: 1272093 - RNA, 22 nt, Homo sapiens
gcugcaucuuauagcacuuuga

SEQ ID NO: 1272094 - RNA, 14 nt, Homo sapiens
gcugccagcccaga

SEQ ID NO: 1272095 - RNA, 16 nt, Homo sapiens
gcugccagccuucucc

SEQ ID NO: 1272096 - RNA, 15 nt, Homo sapiens
gcugccauccucacc

SEQ ID NO: 1272097 - RNA, 18 nt, Homo sapiens
gcugcccccaacacucca

SEQ ID NO: 1272098 - RNA, 20 nt, Homo sapiens
gcugccucugggccaugcca

SEQ ID NO: 1272099 - RNA, 20 nt, Homo sapiens
gcugccugugaaugcugagu

SEQ ID NO: 1272100 - RNA, 16 nt, Homo sapiens
gcugccugugccugcc

SEQ ID NO: 1272101 - RNA, 17 nt, Homo sapiens
gcugccuuggcucagac

SEQ ID NO: 1272102 - RNA, 21 nt, Homo sapiens
gcugccuuuggaaguccagag

SEQ ID NO: 1272103 - RNA, 17 nt, Homo sapiens
gcugcgcaccaaugccc

SEQ ID NO: 1272104 - RNA, 15 nt, Homo sapiens
gcugcuaaaggacag

SEQ ID NO: 1272105 - RNA, 13 nt, Homo sapiens
gcugcuccagugc

SEQ ID NO: 1272106 - RNA, 16 nt, Homo sapiens
gcugcugcacccaacu

SEQ ID NO: 1272107 - RNA, 17 nt, Homo sapiens
gcugcugggucaggcca

SEQ ID NO: 1272108 - RNA, 19 nt, Homo sapiens
gcugcuuccuccuggaaau

SEQ ID NO: 1272109 - RNA, 22 nt, Homo sapiens
gcugcuuccuggcugggaacaa

SEQ ID NO: 1272110 - RNA, 14 nt, Homo sapiens
gcugcuuuguucaa

SEQ ID NO: 1272111 - RNA, 15 nt, Homo sapiens
gcuggaagcaaagua

SEQ ID NO: 1272112 - RNA, 13 nt, Homo sapiens
gcuggaagggaaa

SEQ ID NO: 1272113 - RNA, 15 nt, Homo sapiens
gcuggaaggggucca

SEQ ID NO: 1272114 - RNA, 12 nt, Homo sapiens
gcuggaauucua

SEQ ID NO: 1272115 - RNA, 21 nt, Homo sapiens
gcuggacgugcgcgaugccug

SEQ ID NO: 1272116 - RNA, 22 nt, Homo sapiens
gcuggacgugcgcgaugccugg

SEQ ID NO: 1272117 - RNA, 20 nt, Homo sapiens
gcuggacuguuccaggcccu

SEQ ID NO: 1272118 - RNA, 16 nt, Homo sapiens
gcuggagguggggcga

SEQ ID NO: 1272119 - RNA, 20 nt, Homo sapiens
gcuggagugcagugguguga

SEQ ID NO: 1272120 - RNA, 20 nt, Homo sapiens
gcuggcaagucuuccaugac

SEQ ID NO: 1272121 - RNA, 16 nt, Homo sapiens
gcuggcagaaagggaa

SEQ ID NO: 1272122 - RNA, 21 nt, Homo sapiens
gcuggcaguagugcuucagua

SEQ ID NO: 1272123 - RNA, 15 nt, Homo sapiens
gcuggcaucaagagg

SEQ ID NO: 1272124 - RNA, 15 nt, Homo sapiens
gcuggcccagccaaa

SEQ ID NO: 1272125 - RNA, 19 nt, Homo sapiens
gcuggcccgucauguuccu

SEQ ID NO: 1272126 - RNA, 14 nt, Homo sapiens
gcuggccgcggugg

SEQ ID NO: 1272127 - RNA, 16 nt, Homo sapiens
gcuggccucuaccaca

SEQ ID NO: 1272128 - RNA, 16 nt, Homo sapiens
gcuggccucucuagca

SEQ ID NO: 1272129 - RNA, 17 nt, Homo sapiens
gcuggccucucuagcac

SEQ ID NO: 1272130 - RNA, 16 nt, Homo sapiens
gcuggcgucugcauac

SEQ ID NO: 1272131 - RNA, 17 nt, Homo sapiens
gcuggcucacaguacag

SEQ ID NO: 1272132 - RNA, 14 nt, Homo sapiens
gcuggcucugagaa

SEQ ID NO: 1272133 - RNA, 13 nt, Homo sapiens
gcuggcuugcagu

SEQ ID NO: 1272134 - RNA, 19 nt, Homo sapiens
gcugggaaccagcaucuca

SEQ ID NO: 1272135 - RNA, 16 nt, Homo sapiens
gcugggacuacaggug

SEQ ID NO: 1272136 - RNA, 22 nt, Homo sapiens
gcugggauuacaggugugugcc

SEQ ID NO: 1272137 - RNA, 18 nt, Homo sapiens
gcugggcuucaguggcag

SEQ ID NO: 1272138 - RNA, 19 nt, Homo sapiens
gcuggguauuggaaaugga

SEQ ID NO: 1272139 - RNA, 15 nt, Homo sapiens
gcuggguuauucaga

SEQ ID NO: 1272140 - RNA, 18 nt, Homo sapiens
gcugguaacaguggcugc

SEQ ID NO: 1272141 - RNA, 18 nt, Homo sapiens
gcuggucucaaacuccug

SEQ ID NO: 1272142 - RNA, 19 nt, Homo sapiens
gcuggucucugcugaaggu

SEQ ID NO: 1272143 - RNA, 21 nt, Homo sapiens
gcuggugaauaacuaugccag

SEQ ID NO: 1272144 - RNA, 15 nt, Homo sapiens
gcugguggugcugca

SEQ ID NO: 1272145 - RNA, 20 nt, Homo sapiens
gcugguuuuccuaaaugcag

SEQ ID NO: 1272146 - RNA, 22 nt, Homo sapiens
gcuguaaauccuagacuugaaa

SEQ ID NO: 1272147 - RNA, 20 nt, Homo sapiens
gcuguaacguggcacuggua

SEQ ID NO: 1272148 - RNA, 14 nt, Homo sapiens
gcuguaacuacuuu

SEQ ID NO: 1272149 - RNA, 21 nt, Homo sapiens
gcuguacccagagaguccugu

SEQ ID NO: 1272150 - RNA, 13 nt, Homo sapiens
gcuguagauccca

SEQ ID NO: 1272151 - RNA, 16 nt, Homo sapiens
ggaaagugcauaugaa

SEQ ID NO: 1272152 - RNA, 23 nt, Homo sapiens
ggaaauaguaccuucaauacuua

SEQ ID NO: 1272153 - RNA, 21 nt, Homo sapiens
ggaaauauuaagaaagacuau

SEQ ID NO: 1272154 - RNA, 20 nt, Homo sapiens
ggaaauauuuuaauguuucu

SEQ ID NO: 1272155 - RNA, 18 nt, Homo sapiens
ggaaauccauuccauuuu

SEQ ID NO: 1272156 - RNA, 21 nt, Homo sapiens
ggaacaaaaaaaccacaaagg

SEQ ID NO: 1272157 - RNA, 13 nt, Homo sapiens
ggaacacuggugg

SEQ ID NO: 1272158 - RNA, 13 nt, Homo sapiens
ggaacagaauguu

SEQ ID NO: 1272159 - RNA, 23 nt, Homo sapiens
ggaacagcacuggggagucuuug

SEQ ID NO: 1272160 - RNA, 11 nt, Homo sapiens
ggaacauuucu

SEQ ID NO: 1272161 - RNA, 21 nt, Homo sapiens
ggaaccacagggccagaggga

SEQ ID NO: 1272162 - RNA, 13 nt, Homo sapiens
ggaaccaugaaga

SEQ ID NO: 1272163 - RNA, 19 nt, Homo sapiens
ggaaccuugcuguccugau

SEQ ID NO: 1272164 - RNA, 13 nt, Homo sapiens
ggaacuacuguac

SEQ ID NO: 1272165 - RNA, 21 nt, Homo sapiens
ggaacuagagggauacacuga

SEQ ID NO: 1272166 - RNA, 14 nt, Homo sapiens
ggaacuucaucaua

SEQ ID NO: 1272167 - RNA, 19 nt, Homo sapiens
ggaacuuuccccagaucaa

SEQ ID NO: 1272168 - RNA, 17 nt, Homo sapiens
ggaagaaaaugguuuau

SEQ ID NO: 1272169 - RNA, 21 nt, Homo sapiens
ggaagaacuacagcucuuaaa

SEQ ID NO: 1272170 - RNA, 15 nt, Homo sapiens
ggaagaagugguacu

SEQ ID NO: 1272171 - RNA, 18 nt, Homo sapiens
ggaagaaugaacacuccc

SEQ ID NO: 1272172 - RNA, 21 nt, Homo sapiens
ggaagaccggcugguggagcu

SEQ ID NO: 1272173 - RNA, 13 nt, Homo sapiens
ggaagacuugaag

SEQ ID NO: 1272174 - RNA, 20 nt, Homo sapiens
ggaagagaaaauacuacuuu

SEQ ID NO: 1272175 - RNA, 12 nt, Homo sapiens
ggaagagcuaau

SEQ ID NO: 1272176 - RNA, 24 nt, Homo sapiens
ggaagagugguuaagacuacugaa

SEQ ID NO: 1272177 - RNA, 13 nt, Homo sapiens
ggaagaguguuuc

SEQ ID NO: 1272178 - RNA, 19 nt, Homo sapiens
ggaagaucagcacccuaag

SEQ ID NO: 1272179 - RNA, 20 nt, Homo sapiens
ggaagaucagcgacugccac

SEQ ID NO: 1272180 - RNA, 14 nt, Homo sapiens
ggaagauggcauaa

SEQ ID NO: 1272181 - RNA, 15 nt, Homo sapiens
ggaagcaagauguga

SEQ ID NO: 1272182 - RNA, 23 nt, Homo sapiens
ggaagcagggguggggggugcag

SEQ ID NO: 1272183 - RNA, 16 nt, Homo sapiens
ggaagcaucucucgag

SEQ ID NO: 1272184 - RNA, 16 nt, Homo sapiens
ggaagccccacuugaa

SEQ ID NO: 1272185 - RNA, 17 nt, Homo sapiens
ggaagccccacuugaag

SEQ ID NO: 1272186 - RNA, 22 nt, Homo sapiens
ggaagccccauccaacacugga

SEQ ID NO: 1272187 - RNA, 15 nt, Homo sapiens
ggaagcuccacuguc

SEQ ID NO: 1272188 - RNA, 21 nt, Homo sapiens
ggaagcuccgcuuucuaccca

SEQ ID NO: 1272189 - RNA, 23 nt, Homo sapiens
ggaagcuucuaaauggugcugca

SEQ ID NO: 1272190 - RNA, 13 nt, Homo sapiens
ggaagggaccugg

SEQ ID NO: 1272191 - RNA, 14 nt, Homo sapiens
ggaagggccaccac

SEQ ID NO: 1272192 - RNA, 19 nt, Homo sapiens
ggaaggucccuuguuucca

SEQ ID NO: 1272193 - RNA, 19 nt, Homo sapiens
ggaaggucuccccaugugc

SEQ ID NO: 1272194 - RNA, 13 nt, Homo sapiens
ggaagucaucuca

SEQ ID NO: 1272195 - RNA, 11 nt, Homo sapiens
ggaaguuauuu

SEQ ID NO: 1272196 - RNA, 15 nt, Homo sapiens
ggaaguucaacuucc

SEQ ID NO: 1272197 - RNA, 16 nt, Homo sapiens
ggaaguuuuccuacac

SEQ ID NO: 1272198 - RNA, 13 nt, Homo sapiens
ggaauaaaauccu

SEQ ID NO: 1272199 - RNA, 22 nt, Homo sapiens
ggaauaaauugcuccuugacau

SEQ ID NO: 1272200 - RNA, 21 nt, Homo sapiens
ggaauaaccuuccauacauuu

SEQ ID NO: 1272201 - RNA, 16 nt, Homo sapiens
ggaauaacuuuuacac

SEQ ID NO: 1272202 - RNA, 12 nt, Homo sapiens
ggaauaauguaa

SEQ ID NO: 1272203 - RNA, 16 nt, Homo sapiens
ggaauaauuauuuauu

SEQ ID NO: 1272204 - RNA, 21 nt, Homo sapiens
ggaauacugugcauaagccau

SEQ ID NO: 1272205 - RNA, 22 nt, Homo sapiens
ggaaucacuggcuguuaaucuu

SEQ ID NO: 1272206 - RNA, 12 nt, Homo sapiens
ggaaucagagag

SEQ ID NO: 1272207 - RNA, 13 nt, Homo sapiens
ggaaucagugaag

SEQ ID NO: 1272208 - RNA, 15 nt, Homo sapiens
ggaaucccacuguau

SEQ ID NO: 1272209 - RNA, 22 nt, Homo sapiens
ggaauccuggcagcccagagac

SEQ ID NO: 1272210 - RNA, 20 nt, Homo sapiens
ggaauccuuuggugccaacu

SEQ ID NO: 1272211 - RNA, 18 nt, Homo sapiens
ggaaucuuuguaccaaaa

SEQ ID NO: 1272212 - RNA, 21 nt, Homo sapiens
ggaaugcucccagcugugcug

SEQ ID NO: 1272213 - RNA, 19 nt, Homo sapiens
ggcagaugggccuggccuu

SEQ ID NO: 1272214 - RNA, 17 nt, Homo sapiens
ggcagauggggcacuga

SEQ ID NO: 1272215 - RNA, 17 nt, Homo sapiens
ggcagcaguaccaucua

SEQ ID NO: 1272216 - RNA, 23 nt, Homo sapiens
ggcagccccaccucacagccaga

SEQ ID NO: 1272217 - RNA, 16 nt, Homo sapiens
ggcagcuagugccuuu

SEQ ID NO: 1272218 - RNA, 22 nt, Homo sapiens
ggcagcugcuauccccaucucc

SEQ ID NO: 1272219 - RNA, 15 nt, Homo sapiens
ggcagcuucacucga

SEQ ID NO: 1272220 - RNA, 13 nt, Homo sapiens
ggcagcuugcccc

SEQ ID NO: 1272221 - RNA, 19 nt, Homo sapiens
ggcagcuuuuucauaccaa

SEQ ID NO: 1272222 - RNA, 18 nt, Homo sapiens
ggcaggaacaaacagggc

SEQ ID NO: 1272223 - RNA, 18 nt, Homo sapiens
ggcaggacugaguccccu

SEQ ID NO: 1272224 - RNA, 20 nt, Homo sapiens
ggcaggagaauugcuugaac

SEQ ID NO: 1272225 - RNA, 22 nt, Homo sapiens
ggcaggaguauaugagcauccu

SEQ ID NO: 1272226 - RNA, 13 nt, Homo sapiens
ggcaggaugcuga

SEQ ID NO: 1272227 - RNA, 12 nt, Homo sapiens
ggcaggcagcug

SEQ ID NO: 1272228 - RNA, 22 nt, Homo sapiens
ggcaggcucacugccaggccag

SEQ ID NO: 1272229 - RNA, 16 nt, Homo sapiens
ggcaggcuccaggccu

SEQ ID NO: 1272230 - RNA, 15 nt, Homo sapiens
ggcaggcugggccau

SEQ ID NO: 1272231 - RNA, 20 nt, Homo sapiens
ggcaggcugggccaugucca

SEQ ID NO: 1272232 - RNA, 16 nt, Homo sapiens
ggcagggcaaaugaca

SEQ ID NO: 1272233 - RNA, 14 nt, Homo sapiens
ggcagggcccagug

SEQ ID NO: 1272234 - RNA, 15 nt, Homo sapiens
ggcagguccacagag

SEQ ID NO: 1272235 - RNA, 12 nt, Homo sapiens
ggcaggugcaga

SEQ ID NO: 1272236 - RNA, 14 nt, Homo sapiens
ggcagucacuucca

SEQ ID NO: 1272237 - RNA, 14 nt, Homo sapiens
ggcagugcauguga

SEQ ID NO: 1272238 - RNA, 20 nt, Homo sapiens
ggcaguggaagcaguuucag

SEQ ID NO: 1272239 - RNA, 22 nt, Homo sapiens
ggcaguggcccuccaccuuguu

SEQ ID NO: 1272240 - RNA, 14 nt, Homo sapiens
ggcagugggaccca

SEQ ID NO: 1272241 - RNA, 16 nt, Homo sapiens
ggcaguugaacagagg

SEQ ID NO: 1272242 - RNA, 17 nt, Homo sapiens
ggcauacagacugggga

SEQ ID NO: 1272243 - RNA, 22 nt, Homo sapiens
ggcaucaaacagggcaaagugu

SEQ ID NO: 1272244 - RNA, 22 nt, Homo sapiens
ggcaucaguagcaucuguaaca

SEQ ID NO: 1272245 - RNA, 22 nt, Homo sapiens
ggcauccacccagugcugccau

SEQ ID NO: 1272246 - RNA, 22 nt, Homo sapiens
ggcaucuuugccuugggcugcu

SEQ ID NO: 1272247 - RNA, 20 nt, Homo sapiens
ggcaugagggaucacagggc

SEQ ID NO: 1272248 - RNA, 19 nt, Homo sapiens
ggcaugccaaauguuccau

SEQ ID NO: 1272249 - RNA, 20 nt, Homo sapiens
ggcauggcccugggguccca

SEQ ID NO: 1272250 - RNA, 12 nt, Homo sapiens
ggcaugggagac

SEQ ID NO: 1272251 - RNA, 12 nt, Homo sapiens
ggcaugugccau

SEQ ID NO: 1272252 - RNA, 19 nt, Homo sapiens
ggcauuucuuuucugcaug

SEQ ID NO: 1272253 - RNA, 20 nt, Homo sapiens
ggcauuugcaccuaccucac

SEQ ID NO: 1272254 - RNA, 19 nt, Homo sapiens
ggcauuuuccacuaguuuu

SEQ ID NO: 1272255 - RNA, 19 nt, Homo sapiens
ggccaaaaagaaucugcau

SEQ ID NO: 1272256 - RNA, 15 nt, Homo sapiens
ggccaacugcaaaaa

SEQ ID NO: 1272257 - RNA, 21 nt, Homo sapiens
ggccaagaaagagucaggccu

SEQ ID NO: 1272258 - RNA, 17 nt, Homo sapiens
ggccaagacuuggcaac

SEQ ID NO: 1272259 - RNA, 19 nt, Homo sapiens
ggccaagagcaucgugacc

SEQ ID NO: 1272260 - RNA, 19 nt, Homo sapiens
ggccaaugggagagcucuu

SEQ ID NO: 1272261 - RNA, 19 nt, Homo sapiens
ggccacaacagggcauuuu

SEQ ID NO: 1272262 - RNA, 15 nt, Homo sapiens
ggccacccagccagg

SEQ ID NO: 1272263 - RNA, 15 nt, Homo sapiens
ggccagaagaucuac

SEQ ID NO: 1272264 - RNA, 19 nt, Homo sapiens
ggccagacgugguggcuca

SEQ ID NO: 1272265 - RNA, 20 nt, Homo sapiens
ggccagagggcaguggcccu

SEQ ID NO: 1272266 - RNA, 23 nt, Homo sapiens
ggccagccccacccccagccagg

SEQ ID NO: 1272267 - RNA, 15 nt, Homo sapiens
ggccagcccggcugg

SEQ ID NO: 1272268 - RNA, 15 nt, Homo sapiens
ggccagcgggcacag

SEQ ID NO: 1272269 - RNA, 17 nt, Homo sapiens
ggccaggaccacacagu

SEQ ID NO: 1272270 - RNA, 17 nt, Homo sapiens
ggccagggaaagcccgu

SEQ ID NO: 1272271 - RNA, 24 nt, Homo sapiens
ggccagggaaagcccgugucaaug

SEQ ID NO: 1272272 - RNA, 17 nt, Homo sapiens
ggccaguaccuuuccau

SEQ ID NO: 1272273 - RNA, 11 nt, Homo sapiens
ggccaguguga

SEQ ID NO: 1272274 - RNA, 23 nt, Homo sapiens
ggccaguuucagcucacuuccuc

SEQ ID NO: 1272275 - RNA, 19 nt, Homo sapiens
ggccauaaacgguuccugg

SEQ ID NO: 1272276 - RNA, 23 nt, Homo sapiens
ggccaucugacugccaagccaga

SEQ ID NO: 1272277 - RNA, 22 nt, Homo sapiens
ggcuaccucaagacucaccuca

SEQ ID NO: 1272278 - RNA, 14 nt, Homo sapiens
ggcuagcuucugcu

SEQ ID NO: 1272279 - RNA, 15 nt, Homo sapiens
ggcuaugguugccac

SEQ ID NO: 1272280 - RNA, 17 nt, Homo sapiens
ggcuccaggacuccacu

SEQ ID NO: 1272281 - RNA, 20 nt, Homo sapiens
ggcucccugaugacacccac

SEQ ID NO: 1272282 - RNA, 17 nt, Homo sapiens
ggcuccuucccaucgcu

SEQ ID NO: 1272283 - RNA, 21 nt, Homo sapiens
ggcuccuuggauguagucagu

SEQ ID NO: 1272284 - RNA, 19 nt, Homo sapiens
ggcucuaauguacaauaaa

SEQ ID NO: 1272285 - RNA, 20 nt, Homo sapiens
ggcucucagcucagcgccag

SEQ ID NO: 1272286 - RNA, 18 nt, Homo sapiens
ggcucuccucgcaggugu

SEQ ID NO: 1272287 - RNA, 12 nt, Homo sapiens
ggcucugaccag

SEQ ID NO: 1272288 - RNA, 21 nt, Homo sapiens
ggcucugcaaugggcacuggg

SEQ ID NO: 1272289 - RNA, 21 nt, Homo sapiens
ggcucugugcagucacuggag

SEQ ID NO: 1272290 - RNA, 19 nt, Homo sapiens
ggcucuuagcagcuuccag

SEQ ID NO: 1272291 - RNA, 20 nt, Homo sapiens
ggcucuuaugugugccuuug

SEQ ID NO: 1272292 - RNA, 16 nt, Homo sapiens
ggcucuugacuacuug

SEQ ID NO: 1272293 - RNA, 15 nt, Homo sapiens
ggcucuuuccuugcu

SEQ ID NO: 1272294 - RNA, 19 nt, Homo sapiens
ggcugaaaagaagccucag

SEQ ID NO: 1272295 - RNA, 21 nt, Homo sapiens
ggcugaaaaugcaaagcugaa

SEQ ID NO: 1272296 - RNA, 19 nt, Homo sapiens
ggcugaauagcacagguga

SEQ ID NO: 1272297 - RNA, 21 nt, Homo sapiens
ggcugaauccgugguggcacc

SEQ ID NO: 1272298 - RNA, 21 nt, Homo sapiens
ggcugacaccuaccaugcugc

SEQ ID NO: 1272299 - RNA, 12 nt, Homo sapiens
ggcugacaucug

SEQ ID NO: 1272300 - RNA, 15 nt, Homo sapiens
ggcugagcugagcuu

SEQ ID NO: 1272301 - RNA, 17 nt, Homo sapiens
ggcugauuucucacaca

SEQ ID NO: 1272302 - RNA, 16 nt, Homo sapiens
ggcugcacagcucaac

SEQ ID NO: 1272303 - RNA, 17 nt, Homo sapiens
ggcugcacccacccagg

SEQ ID NO: 1272304 - RNA, 19 nt, Homo sapiens
ggcugcacuugauguuugu

SEQ ID NO: 1272305 - RNA, 16 nt, Homo sapiens
ggcugcugcugugcag

SEQ ID NO: 1272306 - RNA, 15 nt, Homo sapiens
ggcugcuggggcaug

SEQ ID NO: 1272307 - RNA, 19 nt, Homo sapiens
ggcuggagugcaauggcgc

SEQ ID NO: 1272308 - RNA, 15 nt, Homo sapiens
ggcuggagugcagug

SEQ ID NO: 1272309 - RNA, 20 nt, Homo sapiens
ggcuggagugcaguggcgca

SEQ ID NO: 1272310 - RNA, 11 nt, Homo sapiens
ggcuggcacug

SEQ ID NO: 1272311 - RNA, 13 nt, Homo sapiens
ggcuggcacugac

SEQ ID NO: 1272312 - RNA, 16 nt, Homo sapiens
ggcuggcaguagugcu

SEQ ID NO: 1272313 - RNA, 13 nt, Homo sapiens
ggcugggccaugu

SEQ ID NO: 1272314 - RNA, 21 nt, Homo sapiens
ggcuggggguggacuugggaa

SEQ ID NO: 1272315 - RNA, 17 nt, Homo sapiens
ggcugguaacaguucau

SEQ ID NO: 1272316 - RNA, 23 nt, Homo sapiens
ggcuggugacagaacaugcagca

SEQ ID NO: 1272317 - RNA, 14 nt, Homo sapiens
ggcugguugggagc

SEQ ID NO: 1272318 - RNA, 13 nt, Homo sapiens
ggcugugccaaca

SEQ ID NO: 1272319 - RNA, 13 nt, Homo sapiens
ggcuuagugccac

SEQ ID NO: 1272320 - RNA, 14 nt, Homo sapiens
ggcuuagugccacc

SEQ ID NO: 1272321 - RNA, 18 nt, Homo sapiens
ggcuucccaucuuccaca

SEQ ID NO: 1272322 - RNA, 19 nt, Homo sapiens
ggcuuccucuagaagccaa

SEQ ID NO: 1272323 - RNA, 14 nt, Homo sapiens
ggcuuccugugcua

SEQ ID NO: 1272324 - RNA, 15 nt, Homo sapiens
ggcuucuggucauga

SEQ ID NO: 1272325 - RNA, 20 nt, Homo sapiens
ggcuugaccaggcuuggccu

SEQ ID NO: 1272326 - RNA, 20 nt, Homo sapiens
ggcuuuaugcuaguuugacc

SEQ ID NO: 1272327 - RNA, 21 nt, Homo sapiens
ggcuuuguuuuuugugcuauu

SEQ ID NO: 1272328 - RNA, 19 nt, Homo sapiens
ggcuuuuaagaaacacagg

SEQ ID NO: 1272329 - RNA, 16 nt, Homo sapiens
ggcuuuucuagccuau

SEQ ID NO: 1272330 - RNA, 13 nt, Homo sapiens
gggaaaaugugaa

SEQ ID NO: 1272331 - RNA, 16 nt, Homo sapiens
gggaaacacacaagca

SEQ ID NO: 1272332 - RNA, 20 nt, Homo sapiens
gggaaacauagccucaccaa

SEQ ID NO: 1272333 - RNA, 16 nt, Homo sapiens
gggaaagagauccagg

SEQ ID NO: 1272334 - RNA, 15 nt, Homo sapiens
gggaaaggaggcaug

SEQ ID NO: 1272335 - RNA, 19 nt, Homo sapiens
gggaaaguaaauauuucag

SEQ ID NO: 1272336 - RNA, 14 nt, Homo sapiens
gggaaauccauucc

SEQ ID NO: 1272337 - RNA, 14 nt, Homo sapiens
gggaacagaccagu

SEQ ID NO: 1272338 - RNA, 23 nt, Homo sapiens
gggaacuuuuuuagaaaugcaaa

SEQ ID NO: 1272339 - RNA, 16 nt, Homo sapiens
gggaagaaggggccau

SEQ ID NO: 1272340 - RNA, 21 nt, Homo sapiens
gggaagaccagcuuugcagug

SEQ ID NO: 1272341 - RNA, 19 nt, Homo sapiens
gggaagcggcccuaaggga

SEQ ID NO: 1272342 - RNA, 22 nt, Homo sapiens
gggaagggggcuguguguccuu

SEQ ID NO: 1272343 - RNA, 16 nt, Homo sapiens
gucugguuaguuaaaa

SEQ ID NO: 1272344 - RNA, 14 nt, Homo sapiens
gucugucaccagcu

SEQ ID NO: 1272345 - RNA, 17 nt, Homo sapiens
gucugucucagcucaac

SEQ ID NO: 1272346 - RNA, 15 nt, Homo sapiens
gucugugaaugcuaa

SEQ ID NO: 1272347 - RNA, 22 nt, Homo sapiens
gucugugcauuucugguugcac

SEQ ID NO: 1272348 - RNA, 20 nt, Homo sapiens
gucugugugaugaacuuucu

SEQ ID NO: 1272349 - RNA, 15 nt, Homo sapiens
gucuuaucauuugaa

SEQ ID NO: 1272350 - RNA, 13 nt, Homo sapiens
gucuucaacaucc

SEQ ID NO: 1272351 - RNA, 20 nt, Homo sapiens
gucuucaacauccugccagc

SEQ ID NO: 1272352 - RNA, 18 nt, Homo sapiens
gucuucauuucauuguau

SEQ ID NO: 1272353 - RNA, 14 nt, Homo sapiens
gucuuccacuuugc

SEQ ID NO: 1272354 - RNA, 22 nt, Homo sapiens
gucuuccagaccugcuuccuga

SEQ ID NO: 1272355 - RNA, 18 nt, Homo sapiens
gucuuggacacuguacaa

SEQ ID NO: 1272356 - RNA, 17 nt, Homo sapiens
gucuugggggucagggg

SEQ ID NO: 1272357 - RNA, 21 nt, Homo sapiens
gucuuguucugucccuuccac

SEQ ID NO: 1272358 - RNA, 14 nt, Homo sapiens
gucuuucaguggaa

SEQ ID NO: 1272359 - RNA, 23 nt, Homo sapiens
gucuuucuguaagguggacuucc

SEQ ID NO: 1272360 - RNA, 22 nt, Homo sapiens
gucuuuuuuucccuaccauuca

SEQ ID NO: 1272361 - RNA, 21 nt, Homo sapiens
gugaaaaaguuaaacauugaa

SEQ ID NO: 1272362 - RNA, 12 nt, Homo sapiens
gugaaaauauga

SEQ ID NO: 1272363 - RNA, 20 nt, Homo sapiens
gugaaacacccaucguucuc

SEQ ID NO: 1272364 - RNA, 13 nt, Homo sapiens
gugaaacuaacag

SEQ ID NO: 1272365 - RNA, 18 nt, Homo sapiens
gugaaauauaugcuauau

SEQ ID NO: 1272366 - RNA, 14 nt, Homo sapiens
gugaaaugcuggca

SEQ ID NO: 1272367 - RNA, 23 nt, Homo sapiens
gugaaccaccacacccagcccac

SEQ ID NO: 1272368 - RNA, 13 nt, Homo sapiens
gugaacugagcug

SEQ ID NO: 1272369 - RNA, 12 nt, Homo sapiens
gugaacuuguag

SEQ ID NO: 1272370 - RNA, 17 nt, Homo sapiens
gugaagccaaagggacu

SEQ ID NO: 1272371 - RNA, 14 nt, Homo sapiens
gugaagccucugag

SEQ ID NO: 1272372 - RNA, 16 nt, Homo sapiens
gugaauaaccacuuaa

SEQ ID NO: 1272373 - RNA, 22 nt, Homo sapiens
gugaauacuuacuauaauuuga

SEQ ID NO: 1272374 - RNA, 20 nt, Homo sapiens
gugaauacuugaacucuguu

SEQ ID NO: 1272375 - RNA, 13 nt, Homo sapiens
gugaaucuugucu

SEQ ID NO: 1272376 - RNA, 23 nt, Homo sapiens
gugaaucuuugucagcaguuccc

SEQ ID NO: 1272377 - RNA, 16 nt, Homo sapiens
gugaaugaacacucuu

SEQ ID NO: 1272378 - RNA, 17 nt, Homo sapiens
gugaaugagaaaggugu

SEQ ID NO: 1272379 - RNA, 16 nt, Homo sapiens
gugaauuucacaagcu

SEQ ID NO: 1272380 - RNA, 13 nt, Homo sapiens
gugacaacaugcg

SEQ ID NO: 1272381 - RNA, 19 nt, Homo sapiens
gugacacccacaaucccac

SEQ ID NO: 1272382 - RNA, 12 nt, Homo sapiens
gugacaccucac

SEQ ID NO: 1272383 - RNA, 15 nt, Homo sapiens
gugacagggccagug

SEQ ID NO: 1272384 - RNA, 12 nt, Homo sapiens
gugacagucucc

SEQ ID NO: 1272385 - RNA, 11 nt, Homo sapiens
gugaccagcac

SEQ ID NO: 1272386 - RNA, 22 nt, Homo sapiens
gugaccccucagggguuucauu

SEQ ID NO: 1272387 - RNA, 21 nt, Homo sapiens
gugacccuucccaaucagcac

SEQ ID NO: 1272388 - RNA, 23 nt, Homo sapiens
gugacgguaaccccauacucucc

SEQ ID NO: 1272389 - RNA, 14 nt, Homo sapiens
gugacuaugaacuu

SEQ ID NO: 1272390 - RNA, 20 nt, Homo sapiens
gugacuuucaagcuacucac

SEQ ID NO: 1272391 - RNA, 20 nt, Homo sapiens
gugacuuuuuagccagugac

SEQ ID NO: 1272392 - RNA, 17 nt, Homo sapiens
gugagaaaaugccucaa

SEQ ID NO: 1272393 - RNA, 20 nt, Homo sapiens
gugagaaucaaaacucuccu

SEQ ID NO: 1272394 - RNA, 15 nt, Homo sapiens
gugagaggacucuga

SEQ ID NO: 1272395 - RNA, 12 nt, Homo sapiens
uguuuaguugca

SEQ ID NO: 1272396 - RNA, 19 nt, Homo sapiens
uguuuauuugcacuaugag

SEQ ID NO: 1272397 - RNA, 17 nt, Homo sapiens
uguuucacuuuuaggga

SEQ ID NO: 1272398 - RNA, 17 nt, Homo sapiens
uguuucaggaggcugga

SEQ ID NO: 1272399 - RNA, 14 nt, Homo sapiens
uguuucccguauug

SEQ ID NO: 1272400 - RNA, 14 nt, Homo sapiens
uguuucuauucuaa

SEQ ID NO: 1272401 - RNA, 12 nt, Homo sapiens
uguuucucauau

SEQ ID NO: 1272402 - RNA, 15 nt, Homo sapiens
uguuucuguuauuaa

SEQ ID NO: 1272403 - RNA, 13 nt, Homo sapiens
uguuucuuccaaa

SEQ ID NO: 1272404 - RNA, 22 nt, Homo sapiens
uguuugaaauucuagagccagc

SEQ ID NO: 1272405 - RNA, 14 nt, Homo sapiens
uguuugaccccagu

SEQ ID NO: 1272406 - RNA, 19 nt, Homo sapiens
uguuugauaugaaguguua

SEQ ID NO: 1272407 - RNA, 11 nt, Homo sapiens
uguuugcacuu

SEQ ID NO: 1272408 - RNA, 23 nt, Homo sapiens
uguuugccaggacaugcaauaaa

SEQ ID NO: 1272409 - RNA, 21 nt, Homo sapiens
uguuugggggacguuucucau

SEQ ID NO: 1272410 - RNA, 23 nt, Homo sapiens
uguuugguaguuagccaucuaau

SEQ ID NO: 1272411 - RNA, 23 nt, Homo sapiens
uguuugucauagggcaguuggaa

SEQ ID NO: 1272412 - RNA, 13 nt, Homo sapiens
uguuugugccaua

SEQ ID NO: 1272413 - RNA, 13 nt, Homo sapiens
uguuuuaaguuua

SEQ ID NO: 1272414 - RNA, 16 nt, Homo sapiens
uguuuuauauguugcu

SEQ ID NO: 1272415 - RNA, 19 nt, Homo sapiens
uguuuucucagaacagcug

SEQ ID NO: 1272416 - RNA, 20 nt, Homo sapiens
uguuuugccauguuggccag

SEQ ID NO: 1272417 - RNA, 15 nt, Homo sapiens
uguuuuguacuuuag

SEQ ID NO: 1272418 - RNA, 14 nt, Homo sapiens
uguuuuugaucaaa

SEQ ID NO: 1272419 - RNA, 23 nt, Homo sapiens
uguuuuuugccacagcuuuugca

SEQ ID NO: 1272420 - RNA, 19 nt, Homo sapiens
uguuuuuuuuuuccacuua

SEQ ID NO: 1272421 - RNA, 19 nt, Homo sapiens
uuaaaaaaagaacauaaaa

SEQ ID NO: 1272422 - RNA, 18 nt, Homo sapiens
uuaaaaaaauacaguauu

SEQ ID NO: 1272423 - RNA, 21 nt, Homo sapiens
uuaaaaaauacucugcuauuu

SEQ ID NO: 1272424 - RNA, 22 nt, Homo sapiens
uuaaaaaauggacucuugaaau

SEQ ID NO: 1272425 - RNA, 19 nt, Homo sapiens
uuaaaaagauguauguucc

SEQ ID NO: 1272426 - RNA, 22 nt, Homo sapiens
uuaaaaauacggacguacuuug

SEQ ID NO: 1272427 - RNA, 16 nt, Homo sapiens
uuaaaaauagacacuc

SEQ ID NO: 1272428 - RNA, 20 nt, Homo sapiens
uuaaaaauauuuucugaauu

SEQ ID NO: 1272429 - RNA, 22 nt, Homo sapiens
uuaaaaauggcucaaguagaaa

SEQ ID NO: 1272430 - RNA, 16 nt, Homo sapiens
uuaaaacagacacugg

SEQ ID NO: 1272431 - RNA, 12 nt, Homo sapiens
uuaaaacagcug

SEQ ID NO: 1272432 - RNA, 16 nt, Homo sapiens
uuaaaagcacacuccc

SEQ ID NO: 1272433 - RNA, 23 nt, Homo sapiens
uuaaaaggaaagcagauggugga

SEQ ID NO: 1272434 - RNA, 19 nt, Homo sapiens
uuaaaagugacauuugucu

SEQ ID NO: 1272435 - RNA, 15 nt, Homo sapiens
uuaaaauaaauuccu

SEQ ID NO: 1272436 - RNA, 17 nt, Homo sapiens
uuaaaauacauuuggcc

SEQ ID NO: 1272437 - RNA, 18 nt, Homo sapiens
uuaaaauauuugaaugaa

SEQ ID NO: 1272438 - RNA, 14 nt, Homo sapiens
uuaaaaucugugaa

SEQ ID NO: 1272439 - RNA, 12 nt, Homo sapiens
uuaaaaugauug

SEQ ID NO: 1272440 - RNA, 14 nt, Homo sapiens
uuaaacaccuccuc

SEQ ID NO: 1272441 - RNA, 21 nt, Homo sapiens
uuaaacagaugaugagaauuu

SEQ ID NO: 1272442 - RNA, 20 nt, Homo sapiens
uuaaacagaugugaauauuc

SEQ ID NO: 1272443 - RNA, 18 nt, Homo sapiens
uuaaacauugaaguaaug

SEQ ID NO: 1272444 - RNA, 18 nt, Homo sapiens
uuaaacccacagccaaac

SEQ ID NO: 1272445 - RNA, 18 nt, Homo sapiens
uuaaacccuuuggugcua

SEQ ID NO: 1272446 - RNA, 22 nt, Homo sapiens
uuaaaccugucuccacugugcc

SEQ ID NO: 1272447 - RNA, 21 nt, Homo sapiens
uuaaacucagggacagagcca

SEQ ID NO: 1272448 - RNA, 19 nt, Homo sapiens
uuaaacugugaauguucca

SEQ ID NO: 1272449 - RNA, 12 nt, Homo sapiens
uuaaacugugua

SEQ ID NO: 1272450 - RNA, 20 nt, Homo sapiens
uuaaagaaaaaaaaagucag

SEQ ID NO: 1272451 - RNA, 16 nt, Homo sapiens
uuaaagaaagaagugu

SEQ ID NO: 1272452 - RNA, 15 nt, Homo sapiens
uuaaagaauaugacu

SEQ ID NO: 1272453 - RNA, 14 nt, Homo sapiens
uuaaagacguaaaa

SEQ ID NO: 1272454 - RNA, 16 nt, Homo sapiens
uuaaagaucaugacau

SEQ ID NO: 1272455 - RNA, 21 nt, Homo sapiens
uuaaagcagggauaugcugua

SEQ ID NO: 1272456 - RNA, 13 nt, Homo sapiens
uuaaagccuccuc

SEQ ID NO: 1272457 - RNA, 19 nt, Homo sapiens
uuaaaggaaaaucacaucu

SEQ ID NO: 1272458 - RNA, 20 nt, Homo sapiens
uuaaaggaacagagugagag

SEQ ID NO: 1272459 - RNA, 22 nt, Homo sapiens
uuaaaggcugugguaguacucc

SEQ ID NO: 1272460 - RNA, 19 nt, Homo sapiens
uuaaaguggcagcuucacu

SEQ ID NO: 1272461 - RNA, 15 nt, Homo sapiens
uuaaaguuacuuugu

SEQ ID NO: 1272462 - RNA, 15 nt, Homo sapiens
uuaaaguucauugca

SEQ ID NO: 1272463 - RNA, 16 nt, Homo sapiens
uuaaauauagauuaga

SEQ ID NO: 1272464 - RNA, 14 nt, Homo sapiens
uuaaaucaaaaggg

SEQ ID NO: 1272465 - RNA, 13 nt, Homo sapiens
uuaaaucaagucc

SEQ ID NO: 1272466 - RNA, 19 nt, Homo sapiens
uuaaaucuuuggauuugau

SEQ ID NO: 1272467 - RNA, 14 nt, Homo sapiens
uuaaaugaagccaa

SEQ ID NO: 1272468 - RNA, 22 nt, Homo sapiens
uuaaauguagcaauggcacugu

SEQ ID NO: 1272469 - RNA, 16 nt, Homo sapiens
uuaaauucacuuucaa

SEQ ID NO: 1272470 - RNA, 17 nt, Homo sapiens
uuaaauuuaauaccaga

SEQ ID NO: 1272471 - RNA, 23 nt, Homo sapiens
uuaaauuugcaaaucucaggaua

SEQ ID NO: 1272472 - RNA, 17 nt, Homo sapiens
uuaaauuuuaacuaaau

SEQ ID NO: 1272473 - RNA, 19 nt, Homo sapiens
uuaaauuuugaaaacugug

SEQ ID NO: 1272474 - RNA, 15 nt, Homo sapiens
uuaacaacaauaaca

SEQ ID NO: 1272475 - RNA, 19 nt, Homo sapiens
uuaacagagauugaacucc

SEQ ID NO: 1272476 - RNA, 17 nt, Homo sapiens
uuaacagaucuuuacuc

SEQ ID NO: 1272477 - RNA, 21 nt, Homo sapiens
uuaacagaugcaaugugcuac

SEQ ID NO: 1272478 - RNA, 13 nt, Homo sapiens
uuaacaggauauu

SEQ ID NO: 1272479 - RNA, 13 nt, Homo sapiens
uuaacauaagaaa

SEQ ID NO: 1272480 - RNA, 16 nt, Homo sapiens
uuaacauaguaauucu

SEQ ID NO: 1272481 - RNA, 18 nt, Homo sapiens
uuaacaugggcucuucac

SEQ ID NO: 1272482 - RNA, 16 nt, Homo sapiens
uuaacauguauacaaa

SEQ ID NO: 1272483 - RNA, 14 nt, Homo sapiens
uuaacauuugccuu

SEQ ID NO: 1272484 - RNA, 18 nt, Homo sapiens
uuaaccgcacaugcacac

SEQ ID NO: 1272485 - RNA, 15 nt, Homo sapiens
uuaacuaugacagau

SEQ ID NO: 1272486 - RNA, 16 nt, Homo sapiens
uuaacuaugacagaua

SEQ ID NO: 1272487 - RNA, 18 nt, Homo sapiens
uuaacuuccaauuuacau

SEQ ID NO: 1272488 - RNA, 21 nt, Homo sapiens
uuaacuugaaaauuuuuuaac

SEQ ID NO: 1272489 - RNA, 16 nt, Homo sapiens
uuaacuuuuauaccua

SEQ ID NO: 1272490 - RNA, 19 nt, Homo sapiens
uuaacuuuuuuucuucuac

SEQ ID NO: 1272491 - RNA, 15 nt, Homo sapiens
uuaagaaaaaagugu

SEQ ID NO: 1272492 - RNA, 12 nt, Homo sapiens
uuaagaaaagca

SEQ ID NO: 1272493 - RNA, 16 nt, Homo sapiens
uuaagaagucuauaau

SEQ ID NO: 1272494 - RNA, 18 nt, Homo sapiens
uuaagaauuucacaagcu

SEQ ID NO: 1272495 - RNA, 13 nt, Homo sapiens
uuaagacagugua

SEQ ID NO: 1272496 - RNA, 15 nt, Homo sapiens
uuaagacaugcacua

SEQ ID NO: 1272497 - RNA, 19 nt, Homo sapiens
uuaagaccuacuguucuaa

SEQ ID NO: 1272498 - RNA, 20 nt, Homo sapiens
uuaagacgguuaaauacugu

SEQ ID NO: 1272499 - RNA, 17 nt, Homo sapiens
uuaagacugaaaauaua

SEQ ID NO: 1272500 - RNA, 14 nt, Homo sapiens
uuaagagccauaua

SEQ ID NO: 1272501 - RNA, 20 nt, Homo sapiens
uuaagaggcagggucucacu

SEQ ID NO: 1272502 - RNA, 19 nt, Homo sapiens
uuaagauccacaaaugaag

SEQ ID NO: 1272503 - RNA, 18 nt, Homo sapiens
uuaagauuuugcaccugu

SEQ ID NO: 1272504 - RNA, 13 nt, Homo sapiens
uuaagcacuuuaa

SEQ ID NO: 1272505 - RNA, 23 nt, Homo sapiens
uuaagcguucauaugcucugcuu

SEQ ID NO: 1272506 - RNA, 22 nt, Homo sapiens
uuaagcugggauaaucacauua

SEQ ID NO: 1272507 - RNA, 22 nt, Homo sapiens
uuagauucucugugucuaagau

SEQ ID NO: 1272508 - RNA, 20 nt, Homo sapiens
uuagcaauaaauaacacuug

SEQ ID NO: 1272509 - RNA, 15 nt, Homo sapiens
uuagcagcagccuuu

SEQ ID NO: 1272510 - RNA, 20 nt, Homo sapiens
uuagcauauuuuaaugcagu

SEQ ID NO: 1272511 - RNA, 23 nt, Homo sapiens
uuagccauaauuuugcauacuga

SEQ ID NO: 1272512 - RNA, 13 nt, Homo sapiens
uuagcuaccucac

SEQ ID NO: 1272513 - RNA, 22 nt, Homo sapiens
uuagcugugcgcaauugcucau

SEQ ID NO: 1272514 - RNA, 20 nt, Homo sapiens
uuaggagcagcucuucagca

SEQ ID NO: 1272515 - RNA, 21 nt, Homo sapiens
uuaggaguaccauaauucugg

SEQ ID NO: 1272516 - RNA, 16 nt, Homo sapiens
uuaggauggggcuccc

SEQ ID NO: 1272517 - RNA, 17 nt, Homo sapiens
uuaggaugucuguaaua

SEQ ID NO: 1272518 - RNA, 23 nt, Homo sapiens
uuaggauuuucacauucuuggcu

SEQ ID NO: 1272519 - RNA, 20 nt, Homo sapiens
uuaggcaggaucuguacaau

SEQ ID NO: 1272520 - RNA, 20 nt, Homo sapiens
uuaggccuccggaugacugc

SEQ ID NO: 1272521 - RNA, 16 nt, Homo sapiens
uuagggagagucauau

SEQ ID NO: 1272522 - RNA, 21 nt, Homo sapiens
uuaggugcuucuucacuucag

SEQ ID NO: 1272523 - RNA, 16 nt, Homo sapiens
ugcacguugcuucagg

SEQ ID NO: 1272524 - RNA, 23 nt, Homo sapiens
ugcacuacuccucugcagugccu

SEQ ID NO: 1272525 - RNA, 13 nt, Homo sapiens
ugcacuacugaca

SEQ ID NO: 1272526 - RNA, 20 nt, Homo sapiens
ugcacuauguauauacauau

SEQ ID NO: 1272527 - RNA, 21 nt, Homo sapiens
ugcacuccagccugggggaca

SEQ ID NO: 1272528 - RNA, 22 nt, Homo sapiens
ugcacuccagccugggggacag

SEQ ID NO: 1272529 - RNA, 16 nt, Homo sapiens
ugcacuguccugacca

SEQ ID NO: 1272530 - RNA, 15 nt, Homo sapiens
ugcacugucugagaa

SEQ ID NO: 1272531 - RNA, 14 nt, Homo sapiens
ugcacuuacuugcu

SEQ ID NO: 1272532 - RNA, 20 nt, Homo sapiens
ugcacuuauauagcaccuuu

SEQ ID NO: 1272533 - RNA, 15 nt, Homo sapiens
ugcacuuggccucag

SEQ ID NO: 1272534 - RNA, 18 nt, Homo sapiens
ugcacuuggccucagcug

SEQ ID NO: 1272535 - RNA, 15 nt, Homo sapiens
ugcacuuguggcaac

SEQ ID NO: 1272536 - RNA, 20 nt, Homo sapiens
ugcacuuguggcaacagaua

SEQ ID NO: 1272537 - RNA, 11 nt, Homo sapiens
ugcacuuuuaa

SEQ ID NO: 1272538 - RNA, 17 nt, Homo sapiens
ugcagaaacaguucacc

SEQ ID NO: 1272539 - RNA, 20 nt, Homo sapiens
ugcagaacaucgauauguau

SEQ ID NO: 1272540 - RNA, 14 nt, Homo sapiens
ugcagaagaagcug

SEQ ID NO: 1272541 - RNA, 21 nt, Homo sapiens
ugcagaaugacuccaccuucu

SEQ ID NO: 1272542 - RNA, 16 nt, Homo sapiens
ugcagacaacaccuuc

SEQ ID NO: 1272543 - RNA, 21 nt, Homo sapiens
ugcagacaaccucaucagcug

SEQ ID NO: 1272544 - RNA, 12 nt, Homo sapiens
uuuaauuaucuu

SEQ ID NO: 1272545 - RNA, 23 nt, Homo sapiens
uuuaauuuagugaucuuagcaua

SEQ ID NO: 1272546 - RNA, 12 nt, Homo sapiens
uuuaauuugcua

SEQ ID NO: 1272547 - RNA, 12 nt, Homo sapiens
uuuacaaaguau

SEQ ID NO: 1272548 - RNA, 17 nt, Homo sapiens
uuuacaaaguauuugcu

SEQ ID NO: 1272549 - RNA, 21 nt, Homo sapiens
uuuacaacucaaaaaacauug

SEQ ID NO: 1272550 - RNA, 20 nt, Homo sapiens
uuuacaauuugacauacaaa

SEQ ID NO: 1272551 - RNA, 14 nt, Homo sapiens
uuuacagaaaucaa

SEQ ID NO: 1272552 - RNA, 19 nt, Homo sapiens
uuuacagauaucugaaugg

SEQ ID NO: 1272553 - RNA, 22 nt, Homo sapiens
uuuacagauaucugaauggaag

SEQ ID NO: 1272554 - RNA, 15 nt, Homo sapiens
uuuacagcaagaaca

SEQ ID NO: 1272555 - RNA, 17 nt, Homo sapiens
uuuacagcaaguagaua

SEQ ID NO: 1272556 - RNA, 21 nt, Homo sapiens
uuuacagcuaucgaacuucac

SEQ ID NO: 1272557 - RNA, 12 nt, Homo sapiens
uuuacagucucu

SEQ ID NO: 1272558 - RNA, 20 nt, Homo sapiens
uuuacauaucaccucauggc

SEQ ID NO: 1272559 - RNA, 23 nt, Homo sapiens
uuuaccauaagggacugugccag

SEQ ID NO: 1272560 - RNA, 14 nt, Homo sapiens
uuuaccaucugcau

SEQ ID NO: 1272561 - RNA, 17 nt, Homo sapiens
uuuaccuuauguuuaau

SEQ ID NO: 1272562 - RNA, 19 nt, Homo sapiens
uuuacguggcaaaaugaac

SEQ ID NO: 1272563 - RNA, 16 nt, Homo sapiens
uuuacuaucauucuca

SEQ ID NO: 1272564 - RNA, 22 nt, Homo sapiens
uuuacucagaggagcugcaaau

SEQ ID NO: 1272565 - RNA, 21 nt, Homo sapiens
uuuacuguugcccauugcacu

SEQ ID NO: 1272566 - RNA, 23 nt, Homo sapiens
uuuacuugaaauuaaauuuggcu

SEQ ID NO: 1272567 - RNA, 16 nt, Homo sapiens
uuuagaaaugcaaaau

SEQ ID NO: 1272568 - RNA, 17 nt, Homo sapiens
uuuagaacuguauguca

SEQ ID NO: 1272569 - RNA, 21 nt, Homo sapiens
uuuagaagauagaugcacuua

SEQ ID NO: 1272570 - RNA, 15 nt, Homo sapiens
uuuagauauacauau

SEQ ID NO: 1272571 - RNA, 19 nt, Homo sapiens
uuuagauuaaacaaacaaa

SEQ ID NO: 1272572 - RNA, 12 nt, Homo sapiens
uuuagcacaaaa

SEQ ID NO: 1272573 - RNA, 15 nt, Homo sapiens
uuuagcagcugaaaa

SEQ ID NO: 1272574 - RNA, 21 nt, Homo sapiens
uuuagcauaguaccucugcua

SEQ ID NO: 1272575 - RNA, 22 nt, Homo sapiens
uuuagcauaguaccucugcuau

SEQ ID NO: 1272576 - RNA, 19 nt, Homo sapiens
uuuagcaucuuccuugaua

SEQ ID NO: 1272577 - RNA, 16 nt, Homo sapiens
uuuagccagugacuuu

SEQ ID NO: 1272578 - RNA, 14 nt, Homo sapiens
uuuagcuaccucac

SEQ ID NO: 1272579 - RNA, 23 nt, Homo sapiens
uuuagcuaccucacuaugcugcu

SEQ ID NO: 1272580 - RNA, 13 nt, Homo sapiens
uuuaggcacuguu

SEQ ID NO: 1272581 - RNA, 12 nt, Homo sapiens
uuuaguggcuca

SEQ ID NO: 1272582 - RNA, 12 nt, Homo sapiens
uuuaguuucaug

SEQ ID NO: 1272583 - RNA, 14 nt, Homo sapiens
uuuauaaacagaaa

SEQ ID NO: 1272584 - RNA, 19 nt, Homo sapiens
uuuauaaagauacuaaacc

SEQ ID NO: 1272585 - RNA, 15 nt, Homo sapiens
uuuauaaaggccaaa

SEQ ID NO: 1272586 - RNA, 19 nt, Homo sapiens
uuuauaaaucuuaugcucu

SEQ ID NO: 1272587 - RNA, 16 nt, Homo sapiens
uuuauaagagcuaaag

SEQ ID NO: 1272588 - RNA, 18 nt, Homo sapiens
uuuauaaggcugauguca

SEQ ID NO: 1272589 - RNA, 16 nt, Homo sapiens
uuuauacucacugagu

SEQ ID NO: 1272590 - RNA, 15 nt, Homo sapiens
uuuauacuguuuacu

SEQ ID NO: 1272591 - RNA, 15 nt, Homo sapiens
uuuauacuuugcaau

SEQ ID NO: 1272592 - RNA, 21 nt, Homo sapiens
uuuauauaaaauccauccaaa

SEQ ID NO: 1272593 - RNA, 13 nt, Homo sapiens
uuuauauacuggg

SEQ ID NO: 1272594 - RNA, 19 nt, Homo sapiens
uuuauauauuugaauauca

SEQ ID NO: 1272595 - RNA, 17 nt, Homo sapiens
uuuauauguacaugaga

SEQ ID NO: 1272596 - RNA, 15 nt, Homo sapiens
uuuaucaaagcauag

SEQ ID NO: 1272597 - RNA, 19 nt, Homo sapiens
uuuaucacacuucugugag

SEQ ID NO: 1272598 - RNA, 17 nt, Homo sapiens
uuuaucaugaagcacau

SEQ ID NO: 1272599 - RNA, 14 nt, Homo sapiens
uuuaucaugauccu

SEQ ID NO: 1272600 - RNA, 18 nt, Homo sapiens
uuuauccagccgagcuua

SEQ ID NO: 1272601 - RNA, 14 nt, Homo sapiens
uuuauccuagucau

SEQ ID NO: 1272602 - RNA, 16 nt, Homo sapiens
uuuauccucacauaaa

SEQ ID NO: 1272603 - RNA, 15 nt, Homo sapiens
uuuaucucacacaca

SEQ ID NO: 1272604 - RNA, 13 nt, Homo sapiens
uuuaugacucuua

SEQ ID NO: 1272605 - RNA, 13 nt, Homo sapiens
uuuaugagacagc

SEQ ID NO: 1272606 - RNA, 16 nt, Homo sapiens
uuuaugaugacugcuu

SEQ ID NO: 1272607 - RNA, 11 nt, Homo sapiens
uuuaugcacau

SEQ ID NO: 1272608 - RNA, 19 nt, Homo sapiens
uuuauggagaccucuccuu

SEQ ID NO: 1272609 - RNA, 18 nt, Homo sapiens
uuuaugguguguuccuaa

SEQ ID NO: 1272610 - RNA, 16 nt, Homo sapiens
uuuaugucuguaauca

SEQ ID NO: 1272611 - RNA, 21 nt, Homo sapiens
uuuauguuuggaauaaaguca

SEQ ID NO: 1272612 - RNA, 16 nt, Homo sapiens
uuuauuaaaugcauca

SEQ ID NO: 1272613 - RNA, 15 nt, Homo sapiens
uuuauuaaucuuagu

SEQ ID NO: 1272614 - RNA, 22 nt, Homo sapiens
uuuauuaguuaauauaucccag

SEQ ID NO: 1272615 - RNA, 17 nt, Homo sapiens
uuuauuauuuucaccug

SEQ ID NO: 1272616 - RNA, 14 nt, Homo sapiens
uuuauuccauauuc

SEQ ID NO: 1272617 - RNA, 21 nt, Homo sapiens
uuuauugucugucuacauuuc

SEQ ID NO: 1272618 - RNA, 15 nt, Homo sapiens
uuuauuuaaagcauu

SEQ ID NO: 1272619 - RNA, 14 nt, Homo sapiens
uuuauuuacuucgu

SEQ ID NO: 1272620 - RNA, 20 nt, Homo sapiens
uuuauuuaguuuuuaacaau

SEQ ID NO: 1272621 - RNA, 13 nt, Homo sapiens
uuuauuucucggg

SEQ ID NO: 1272622 - RNA, 15 nt, Homo sapiens
uuuauuucugaucua

SEQ ID NO: 1272623 - RNA, 20 nt, Homo sapiens
uuucaaaagaagaguuuuag

SEQ ID NO: 1272624 - RNA, 23 nt, Homo sapiens
uuucaaaagcaagaacaccaucc

SEQ ID NO: 1272625 - RNA, 19 nt, Homo sapiens
uuucaaaauauacauucaa

SEQ ID NO: 1272626 - RNA, 13 nt, Homo sapiens
uuucaaagagaug

SEQ ID NO: 1272627 - RNA, 13 nt, Homo sapiens
uuucaaagcuaaa

SEQ ID NO: 1272628 - RNA, 15 nt, Homo sapiens
uuucaaaugugcugu

SEQ ID NO: 1272629 - RNA, 14 nt, Homo sapiens
uuucaacauaucau

SEQ ID NO: 1272630 - RNA, 20 nt, Homo sapiens
uuucaagagugagcuaucaa

SEQ ID NO: 1272631 - RNA, 13 nt, Homo sapiens
uuucaagugccua

SEQ ID NO: 1272632 - RNA, 15 nt, Homo sapiens
uuucaauuacaaagc

SEQ ID NO: 1272633 - RNA, 18 nt, Homo sapiens
uuucaauuugagauucua

SEQ ID NO: 1272634 - RNA, 16 nt, Homo sapiens
uuucacaacauuugca

SEQ ID NO: 1272635 - RNA, 11 nt, Homo sapiens
uuucacaagcu

SEQ ID NO: 1272636 - RNA, 16 nt, Homo sapiens
uuucacaauaccucau

SEQ ID NO: 1272637 - RNA, 14 nt, Homo sapiens
uuucacacagugaa

SEQ ID NO: 1272638 - RNA, 15 nt, Homo sapiens
uuucacauaaaaccu

SEQ ID NO: 1272639 - RNA, 14 nt, Homo sapiens
uuucacauaugugu

SEQ ID NO: 1272640 - RNA, 21 nt, Homo sapiens
uuucacauuguuugcugcuau

SEQ ID NO: 1272641 - RNA, 19 nt, Homo sapiens
uuucaccaggggugcucac

SEQ ID NO: 1272642 - RNA, 15 nt, Homo sapiens
uuucacucugucauc

SEQ ID NO: 1272643 - RNA, 17 nt, Homo sapiens
uuucacuuugugauuau

SEQ ID NO: 1272644 - RNA, 16 nt, Homo sapiens
uuucagaacuuugaga

SEQ ID NO: 1272645 - RNA, 20 nt, Homo sapiens
uuucagaagcucuucuaaaa

SEQ ID NO: 1272646 - RNA, 23 nt, Homo sapiens
uuucagauuuuuuauuugaaggu

SEQ ID NO: 1272647 - RNA, 16 nt, Homo sapiens
uuucagcacucagaaa

SEQ ID NO: 1272648 - RNA, 22 nt, Homo sapiens
uuucaguacacccaguugccaa

SEQ ID NO: 1272649 - RNA, 22 nt, Homo sapiens
uuucauaaaaacacucaacaaa

SEQ ID NO: 1272650 - RNA, 18 nt, Homo sapiens
uuucauaaacuucaggga

SEQ ID NO: 1272651 - RNA, 19 nt, Homo sapiens
uuucauaaacuucagggau

SEQ ID NO: 1272652 - RNA, 18 nt, Homo sapiens
uuucauaaccuagccuua

SEQ ID NO: 1272653 - RNA, 13 nt, Homo sapiens
uuucauacaacag

SEQ ID NO: 1272654 - RNA, 21 nt, Homo sapiens
uuucaucacacuggguggugg

SEQ ID NO: 1272655 - RNA, 17 nt, Homo sapiens
uuucaucauaacauaaa

SEQ ID NO: 1272656 - RNA, 15 nt, Homo sapiens
uuucauccuugacua

SEQ ID NO: 1272657 - RNA, 15 nt, Homo sapiens
uuucaucuaauguga

SEQ ID NO: 1272658 - RNA, 20 nt, Homo sapiens
uuucaugcuuccagguaaaa

SEQ ID NO: 1272659 - RNA, 16 nt, Homo sapiens
uuucaugggacuaaau

SEQ ID NO: 1272660 - RNA, 18 nt, Homo sapiens
uuucauuaaagaauguuu

SEQ ID NO: 1272661 - RNA, 14 nt, Homo sapiens
uuucauucauccca

SEQ ID NO: 1272662 - RNA, 22 nt, Homo sapiens
uuucauuccuaacacagcaugu

SEQ ID NO: 1272663 - RNA, 18 nt, Homo sapiens
uuucauuguguucucuau

SEQ ID NO: 1272664 - RNA, 13 nt, Homo sapiens
uuucauuugccua

SEQ ID NO: 1272665 - RNA, 15 nt, Homo sapiens
uuuccaacuacuaau

SEQ ID NO: 1272666 - RNA, 21 nt, Homo sapiens
uuuccaacuuuaucauggaau

SEQ ID NO: 1272667 - RNA, 14 nt, Homo sapiens
uuuccaagaccaac

SEQ ID NO: 1272668 - RNA, 12 nt, Homo sapiens
uuuccagaguau

SEQ ID NO: 1272669 - RNA, 17 nt, Homo sapiens
uuuccagcagaagacaa

SEQ ID NO: 1272670 - RNA, 15 nt, Homo sapiens
uuuccaggcuagucc

SEQ ID NO: 1272671 - RNA, 12 nt, Homo sapiens
uuuccagggaua

SEQ ID NO: 1272672 - RNA, 11 nt, Homo sapiens
uuuugaugaaa

SEQ ID NO: 1272673 - RNA, 18 nt, Homo sapiens
uuuugauucuacucuuau

SEQ ID NO: 1272674 - RNA, 17 nt, Homo sapiens
uuuugcaaaacauaucu

SEQ ID NO: 1272675 - RNA, 15 nt, Homo sapiens
uuuugcaaucugugu

SEQ ID NO: 1272676 - RNA, 14 nt, Homo sapiens
uuuugcaugcaugc

SEQ ID NO: 1272677 - RNA, 15 nt, Homo sapiens
uuuugccacauuagc

SEQ ID NO: 1272678 - RNA, 15 nt, Homo sapiens
uuuuggaacauuucu

SEQ ID NO: 1272679 - RNA, 15 nt, Homo sapiens
uuuuggaacuguccu

SEQ ID NO: 1272680 - RNA, 13 nt, Homo sapiens
uuuuggccaaagu

SEQ ID NO: 1272681 - RNA, 20 nt, Homo sapiens
uuuuggggaaaaaagcacau

SEQ ID NO: 1272682 - RNA, 19 nt, Homo sapiens
uuuugguauuacacuguau

SEQ ID NO: 1272683 - RNA, 16 nt, Homo sapiens
uuuuguaaauguaucu

SEQ ID NO: 1272684 - RNA, 19 nt, Homo sapiens
uuuuguaacauaaugcacu

SEQ ID NO: 1272685 - RNA, 22 nt, Homo sapiens
uuuuguccuaaaacaccuggua

SEQ ID NO: 1272686 - RNA, 12 nt, Homo sapiens
uuuugucuuucc

SEQ ID NO: 1272687 - RNA, 22 nt, Homo sapiens
uuuugugggggugaagucuugc

SEQ ID NO: 1272688 - RNA, 16 nt, Homo sapiens
uuuuguguuuugguua

SEQ ID NO: 1272689 - RNA, 17 nt, Homo sapiens
uuuuguuaggcuguaaa

SEQ ID NO: 1272690 - RNA, 18 nt, Homo sapiens
uuuuguuccacaaguuaa

SEQ ID NO: 1272691 - RNA, 14 nt, Homo sapiens
uuuuguugagccag

SEQ ID NO: 1272692 - RNA, 14 nt, Homo sapiens
uuuuguugccuuca

SEQ ID NO: 1272693 - RNA, 14 nt, Homo sapiens
uuuuguuugucuga

SEQ ID NO: 1272694 - RNA, 18 nt, Homo sapiens
uuuuuaauauaaagccug

SEQ ID NO: 1272695 - RNA, 15 nt, Homo sapiens
uuuuuaaugaucucg

SEQ ID NO: 1272696 - RNA, 15 nt, Homo sapiens
uuuuuacauccauga

SEQ ID NO: 1272697 - RNA, 22 nt, Homo sapiens
uuuuuacuaaacucagaggcag

SEQ ID NO: 1272698 - RNA, 21 nt, Homo sapiens
uuuuuaugaagugcgugaaug

SEQ ID NO: 1272699 - RNA, 18 nt, Homo sapiens
uuuuuauuaugcauuaua

SEQ ID NO: 1272700 - RNA, 18 nt, Homo sapiens
uuuuucaaaaaaucagca

SEQ ID NO: 1272701 - RNA, 14 nt, Homo sapiens
uuuuucaagagcuc

SEQ ID NO: 1272702 - RNA, 14 nt, Homo sapiens
uuuuuccucugcau

SEQ ID NO: 1272703 - RNA, 22 nt, Homo sapiens
uuuuugacucccagaucaguca

SEQ ID NO: 1272704 - RNA, 16 nt, Homo sapiens
uuuuugagacaaaguc

SEQ ID NO: 1272705 - RNA, 17 nt, Homo sapiens
uuuuugagguggcacuu

SEQ ID NO: 1272706 - RNA, 18 nt, Homo sapiens
uuuuugcugcugccucuu

SEQ ID NO: 1272707 - RNA, 15 nt, Homo sapiens
uuuuuggaaagucag

SEQ ID NO: 1272708 - RNA, 21 nt, Homo sapiens
uuuuuggcuacacacaaacca

SEQ ID NO: 1272709 - RNA, 14 nt, Homo sapiens
uuuuuguaacugga

SEQ ID NO: 1272710 - RNA, 21 nt, Homo sapiens
uuuuuguuucuuccaaagcac

SEQ ID NO: 1272711 - RNA, 23 nt, Homo sapiens
uuuuuuaaaacacuaaaagcagc

SEQ ID NO: 1272712 - RNA, 13 nt, Homo sapiens
uuuuuuaacauuc

SEQ ID NO: 1272713 - RNA, 12 nt, Homo sapiens
uuuuuuaaucua

SEQ ID NO: 1272714 - RNA, 21 nt, Homo sapiens
uuuuuuguuauguuugcacuu

SEQ ID NO: 1272715 - RNA, 20 nt, Homo sapiens
gacagagacuugggggccau

SEQ ID NO: 1272716 - RNA, 16 nt, Homo sapiens
gacagagggcucaccu

SEQ ID NO: 1272717 - RNA, 22 nt, Homo sapiens
gacagagucccuggcuccucua

SEQ ID NO: 1272718 - RNA, 14 nt, Homo sapiens
gacagagucucacu

SEQ ID NO: 1272719 - RNA, 19 nt, Homo sapiens
gacagauccccguuccuga

SEQ ID NO: 1272720 - RNA, 20 nt, Homo sapiens
gacagauuuggaugcacuca

SEQ ID NO: 1272721 - RNA, 19 nt, Homo sapiens
gacagcaucuuccucccuc

SEQ ID NO: 1272722 - RNA, 15 nt, Homo sapiens
gacagccaagcaccu

SEQ ID NO: 1272723 - RNA, 22 nt, Homo sapiens
gacagccauuuguaaugaauuu

SEQ ID NO: 1272724 - RNA, 14 nt, Homo sapiens
gacagcuucaugaa

SEQ ID NO: 1272725 - RNA, 18 nt, Homo sapiens
gacagcuuguggcuuuuu

SEQ ID NO: 1272726 - RNA, 15 nt, Homo sapiens
gacaggaauacuuaa

SEQ ID NO: 1272727 - RNA, 13 nt, Homo sapiens
gacaggcacucca

SEQ ID NO: 1272728 - RNA, 15 nt, Homo sapiens
gacaggcaggccaga

SEQ ID NO: 1272729 - RNA, 17 nt, Homo sapiens
gacaggccagaugaacu

SEQ ID NO: 1272730 - RNA, 17 nt, Homo sapiens
gacagggucggccugua

SEQ ID NO: 1272731 - RNA, 14 nt, Homo sapiens
gacagucauauaaa

SEQ ID NO: 1272732 - RNA, 10 nt, Homo sapiens
gacagugaau

SEQ ID NO: 1272733 - RNA, 14 nt, Homo sapiens
gacagugccuggga

SEQ ID NO: 1272734 - RNA, 20 nt, Homo sapiens
gacagugggcaucagcagca

SEQ ID NO: 1272735 - RNA, 17 nt, Homo sapiens
gacaguguuuucuggga

SEQ ID NO: 1272736 - RNA, 16 nt, Homo sapiens
gacauaaauguucacu

SEQ ID NO: 1272737 - RNA, 17 nt, Homo sapiens
gacauaaucuaguuuua

SEQ ID NO: 1272738 - RNA, 19 nt, Homo sapiens
gacauacauuuaugcacau

SEQ ID NO: 1272739 - RNA, 16 nt, Homo sapiens
gacauacccucuaaaa

SEQ ID NO: 1272740 - RNA, 21 nt, Homo sapiens
gacauacugcauguaagccaa

SEQ ID NO: 1272741 - RNA, 15 nt, Homo sapiens
gacauacuuaaugca

SEQ ID NO: 1272742 - RNA, 17 nt, Homo sapiens
gacauacuuaaugcaua

SEQ ID NO: 1272743 - RNA, 11 nt, Homo sapiens
gacauauuuga

SEQ ID NO: 1272744 - RNA, 13 nt, Homo sapiens
gacauauuugaau

SEQ ID NO: 1272745 - RNA, 19 nt, Homo sapiens
gacauauuugaaugacugc

SEQ ID NO: 1272746 - RNA, 12 nt, Homo sapiens
gacaucaucaag

SEQ ID NO: 1272747 - RNA, 19 nt, Homo sapiens
gacaucggccuccaugacc

SEQ ID NO: 1272748 - RNA, 22 nt, Homo sapiens
gacaucgguguucuucuuccca

SEQ ID NO: 1272749 - RNA, 13 nt, Homo sapiens
gacaucucagggg

SEQ ID NO: 1272750 - RNA, 14 nt, Homo sapiens
gacaucucaggggc

SEQ ID NO: 1272751 - RNA, 12 nt, Homo sapiens
gacaugaacuac

SEQ ID NO: 1272752 - RNA, 14 nt, Homo sapiens
gacaugcacugacc

SEQ ID NO: 1272753 - RNA, 15 nt, Homo sapiens
gacaugcacugaccc

SEQ ID NO: 1272754 - RNA, 11 nt, Homo sapiens
gacaugcauug

SEQ ID NO: 1272755 - RNA, 14 nt, Homo sapiens
gacauggagguucu

SEQ ID NO: 1272756 - RNA, 12 nt, Homo sapiens
gacauggcucac

SEQ ID NO: 1272757 - RNA, 14 nt, Homo sapiens
gacaugugacauuu

SEQ ID NO: 1272758 - RNA, 15 nt, Homo sapiens
gacauguggggccag

SEQ ID NO: 1272759 - RNA, 19 nt, Homo sapiens
gacauuaaaaauguuagua

SEQ ID NO: 1272760 - RNA, 21 nt, Homo sapiens
gacauuaacaguuuuccauga

SEQ ID NO: 1272761 - RNA, 21 nt, Homo sapiens
gacauuacaauguguaaugga

SEQ ID NO: 1272762 - RNA, 17 nt, Homo sapiens
gacauuguggacuguau

SEQ ID NO: 1272763 - RNA, 22 nt, Homo sapiens
gacauuuaauuuagugaucuua

SEQ ID NO: 1272764 - RNA, 22 nt, Homo sapiens
gacauuuauccaagaccugaaa

SEQ ID NO: 1272765 - RNA, 18 nt, Homo sapiens
gaccaacuguguuguauu

SEQ ID NO: 1272766 - RNA, 20 nt, Homo sapiens
gaccaaucaucaacuaccau

SEQ ID NO: 1272767 - RNA, 11 nt, Homo sapiens
gaccaccacau

SEQ ID NO: 1272768 - RNA, 16 nt, Homo sapiens
gaccaccuaauaucaa

SEQ ID NO: 1272769 - RNA, 16 nt, Homo sapiens
gaccaccuuucacaaa

SEQ ID NO: 1272770 - RNA, 22 nt, Homo sapiens
gaccacugaagcaccacaggga

SEQ ID NO: 1272771 - RNA, 17 nt, Homo sapiens
gaccacugggcaaugau

SEQ ID NO: 1272772 - RNA, 17 nt, Homo sapiens
gaccacuuccaggggaa

SEQ ID NO: 1272773 - RNA, 14 nt, Homo sapiens
gaccagaaguggac

SEQ ID NO: 1272774 - RNA, 16 nt, Homo sapiens
gaccagaccuggccaa

SEQ ID NO: 1272775 - RNA, 13 nt, Homo sapiens
gaccagagaucga

SEQ ID NO: 1272776 - RNA, 16 nt, Homo sapiens
gaccagcccuugaggg

SEQ ID NO: 1272777 - RNA, 13 nt, Homo sapiens
gaccaggaccucc

SEQ ID NO: 1272778 - RNA, 15 nt, Homo sapiens
gaccagucacucccu

SEQ ID NO: 1272779 - RNA, 22 nt, Homo sapiens
gaccaguccuguuugcagggaa

SEQ ID NO: 1272780 - RNA, 21 nt, Homo sapiens
gaccaugcucaucugcugguc

SEQ ID NO: 1272781 - RNA, 17 nt, Homo sapiens
gaccauuguaacaauag

SEQ ID NO: 1272782 - RNA, 15 nt, Homo sapiens
gaccauuugacuguu

SEQ ID NO: 1272783 - RNA, 14 nt, Homo sapiens
gaccauuuggucag

SEQ ID NO: 1272784 - RNA, 22 nt, Homo sapiens
gaccauuuuuacauccaugaaa

SEQ ID NO: 1272785 - RNA, 11 nt, Homo sapiens
gacccaaaaca

SEQ ID NO: 1272786 - RNA, 16 nt, Homo sapiens
gacccaaaacacagga

SEQ ID NO: 1272787 - RNA, 17 nt, Homo sapiens
gacccaagauaaaagaa

SEQ ID NO: 1272788 - RNA, 13 nt, Homo sapiens
gacccaagcugcc

SEQ ID NO: 1272789 - RNA, 14 nt, Homo sapiens
gacccagccuucag

SEQ ID NO: 1272790 - RNA, 16 nt, Homo sapiens
gacccaggucuuccag

SEQ ID NO: 1272791 - RNA, 13 nt, Homo sapiens
gaccccaauccaa

SEQ ID NO: 1272792 - RNA, 11 nt, Homo sapiens
gaccccagugu

SEQ ID NO: 1272793 - RNA, 15 nt, Homo sapiens
gacccccagcacuug

SEQ ID NO: 1272794 - RNA, 14 nt, Homo sapiens
gaccccuccucacu

SEQ ID NO: 1272795 - RNA, 20 nt, Homo sapiens
gaccccuccucacuggccau

SEQ ID NO: 1272796 - RNA, 15 nt, Homo sapiens
gaccccugaccucac

SEQ ID NO: 1272797 - RNA, 16 nt, Homo sapiens
gacccuagccagagaa

SEQ ID NO: 1272798 - RNA, 15 nt, Homo sapiens
gacccuagcucuuuc

SEQ ID NO: 1272799 - RNA, 21 nt, Homo sapiens
gacccucauggcccccagggg

SEQ ID NO: 1272800 - RNA, 18 nt, Homo sapiens
gacccucgcccaacucca

SEQ ID NO: 1272801 - RNA, 13 nt, Homo sapiens
gacccucugggaa

SEQ ID NO: 1272802 - RNA, 15 nt, Homo sapiens
gacccugccacucuc

SEQ ID NO: 1272803 - RNA, 12 nt, Homo sapiens
gacccuggucuc

SEQ ID NO: 1272804 - RNA, 16 nt, Homo sapiens
gacccuguccggccca

SEQ ID NO: 1272805 - RNA, 17 nt, Homo sapiens
gaccggugcaugaugcu

SEQ ID NO: 1272806 - RNA, 23 nt, Homo sapiens
gaccuaacauucgaucucauuca

SEQ ID NO: 1272807 - RNA, 20 nt, Homo sapiens
gaccuaagggacucccacaa

SEQ ID NO: 1272808 - RNA, 19 nt, Homo sapiens
gaccuacuguucggacaaa

SEQ ID NO: 1272809 - RNA, 20 nt, Homo sapiens
gaccuacuguucggacaaaa

SEQ ID NO: 1272810 - RNA, 13 nt, Homo sapiens
gaccuacuguucu

SEQ ID NO: 1272811 - RNA, 15 nt, Homo sapiens
gaccuaggauuucau

SEQ ID NO: 1272812 - RNA, 17 nt, Homo sapiens
gaccuaugagcacauag

SEQ ID NO: 1272813 - RNA, 13 nt, Homo sapiens
gaccucacaguga

SEQ ID NO: 1272814 - RNA, 12 nt, Homo sapiens
gaccucucaggg

SEQ ID NO: 1272815 - RNA, 21 nt, Homo sapiens
gaccucugggagcucaaguga

SEQ ID NO: 1272816 - RNA, 19 nt, Homo sapiens
gacaauuaucugugucaaa

SEQ ID NO: 1272817 - RNA, 16 nt, Homo sapiens
gacacacaaaucccau

SEQ ID NO: 1272818 - RNA, 13 nt, Homo sapiens
gacacagaaaaug

SEQ ID NO: 1272819 - RNA, 21 nt, Homo sapiens
gacacagcagcuucaccagag

SEQ ID NO: 1272820 - RNA, 16 nt, Homo sapiens
gacacagcagugguau

SEQ ID NO: 1272821 - RNA, 18 nt, Homo sapiens
gacacagcucuucauucc

SEQ ID NO: 1272822 - RNA, 20 nt, Homo sapiens
gacaccagagcccacuucca

SEQ ID NO: 1272823 - RNA, 15 nt, Homo sapiens
gacacccacccugug

SEQ ID NO: 1272824 - RNA, 23 nt, Homo sapiens
gacaccccugcucuacccaugag

SEQ ID NO: 1272825 - RNA, 10 nt, Homo sapiens
gacaccucac

SEQ ID NO: 1272826 - RNA, 21 nt, Homo sapiens
gacaccuccauuucucuccag

SEQ ID NO: 1272827 - RNA, 17 nt, Homo sapiens
gacaccuugacagggca

SEQ ID NO: 1272828 - RNA, 16 nt, Homo sapiens
gacaccuuuagguucu

SEQ ID NO: 1272829 - RNA, 16 nt, Homo sapiens
gacacgaagccuuauu

SEQ ID NO: 1272830 - RNA, 18 nt, Homo sapiens
gacacuagccugugcacg

SEQ ID NO: 1272831 - RNA, 15 nt, Homo sapiens
gacacuaucacucau

SEQ ID NO: 1272832 - RNA, 16 nt, Homo sapiens
gacacuauucauuuga

SEQ ID NO: 1272833 - RNA, 15 nt, Homo sapiens
gacacugcaaaggcg

SEQ ID NO: 1272834 - RNA, 19 nt, Homo sapiens
gacacuggcguuacugcuu

SEQ ID NO: 1272835 - RNA, 17 nt, Homo sapiens
gacacuguuggggaccu

SEQ ID NO: 1272836 - RNA, 13 nt, Homo sapiens
gacacuuauuuau

SEQ ID NO: 1272837 - RNA, 16 nt, Homo sapiens
gacacuucagaucuga

SEQ ID NO: 1272838 - RNA, 18 nt, Homo sapiens
gacagaaggaacacugcu

SEQ ID NO: 1272839 - RNA, 19 nt, Homo sapiens
gacagaaggaacacugcuu

SEQ ID NO: 1272840 - RNA, 21 nt, Homo sapiens
gacagaaggaacacugcuuga

SEQ ID NO: 1272841 - RNA, 17 nt, Homo sapiens
gacagacagagaaggca

SEQ ID NO: 1272842 - RNA, 17 nt, Homo sapiens
gacagacaggcucuuag

SEQ ID NO: 1272843 - RNA, 13 nt, Homo sapiens
gacagacccaggu

SEQ ID NO: 1272844 - RNA, 19 nt, Homo sapiens
gacagagaaggcgcuuccc

SEQ ID NO: 1272845 - RNA, 16 nt, Homo sapiens
gaacaagaauugcuaa

SEQ ID NO: 1272846 - RNA, 17 nt, Homo sapiens
gaacaagaauugcuaaa

SEQ ID NO: 1272847 - RNA, 19 nt, Homo sapiens
gaacaagcccaacaguaau

SEQ ID NO: 1272848 - RNA, 21 nt, Homo sapiens
gaacaaugaauuauccagcau

SEQ ID NO: 1272849 - RNA, 15 nt, Homo sapiens
gaacacacagacuuu

SEQ ID NO: 1272850 - RNA, 17 nt, Homo sapiens
gaacacagcaugugcca

SEQ ID NO: 1272851 - RNA, 19 nt, Homo sapiens
gaacacagcaugugccaag

SEQ ID NO: 1272852 - RNA, 19 nt, Homo sapiens
gaacacuaacucaccagcc

SEQ ID NO: 1272853 - RNA, 22 nt, Homo sapiens
gaacacuaacucaccagcccca

SEQ ID NO: 1272854 - RNA, 18 nt, Homo sapiens
gaacacucuacuacaugu

SEQ ID NO: 1272855 - RNA, 20 nt, Homo sapiens
gaacacucuuuugcuuuauu

SEQ ID NO: 1272856 - RNA, 21 nt, Homo sapiens
gaacacuggcaacaacaaagc

SEQ ID NO: 1272857 - RNA, 22 nt, Homo sapiens
gaacagauaaucagugugucua

SEQ ID NO: 1272858 - RNA, 22 nt, Homo sapiens
gaacagcacuggggagucuuug

SEQ ID NO: 1272859 - RNA, 13 nt, Homo sapiens
gaacaguguuucc

SEQ ID NO: 1272860 - RNA, 14 nt, Homo sapiens
gaacaucacauucc

SEQ ID NO: 1272861 - RNA, 17 nt, Homo sapiens
gaacauccaaccuuccc

SEQ ID NO: 1272862 - RNA, 20 nt, Homo sapiens
gaacaugcagcaaggggaca

SEQ ID NO: 1272863 - RNA, 19 nt, Homo sapiens
gaacauggggaguguuuca

SEQ ID NO: 1272864 - RNA, 23 nt, Homo sapiens
gaacauuucuguaaauaccauug

SEQ ID NO: 1272865 - RNA, 20 nt, Homo sapiens
gaaccaaaucuggaagccaa

SEQ ID NO: 1272866 - RNA, 21 nt, Homo sapiens
gaaccaaggcagccuccagag

SEQ ID NO: 1272867 - RNA, 13 nt, Homo sapiens
gaaccacuaugaa

SEQ ID NO: 1272868 - RNA, 21 nt, Homo sapiens
gaaccagcuucugauaaacac

SEQ ID NO: 1272869 - RNA, 15 nt, Homo sapiens
gaaccaggaggacaa

SEQ ID NO: 1272870 - RNA, 22 nt, Homo sapiens
gaacccaagcuuagaacuuuaa

SEQ ID NO: 1272871 - RNA, 17 nt, Homo sapiens
gaacccaggacagccac

SEQ ID NO: 1272872 - RNA, 20 nt, Homo sapiens
gaacccauuucuccagacuu

SEQ ID NO: 1272873 - RNA, 13 nt, Homo sapiens
gaacccugugcug

SEQ ID NO: 1272874 - RNA, 17 nt, Homo sapiens
gaacccuuccugagacc

SEQ ID NO: 1272875 - RNA, 22 nt, Homo sapiens
gaaccuggauccagcacuggug

SEQ ID NO: 1272876 - RNA, 22 nt, Homo sapiens
gaaccuuaaugacaacacuuaa

SEQ ID NO: 1272877 - RNA, 15 nt, Homo sapiens
gaaccuugcuguccu

SEQ ID NO: 1272878 - RNA, 16 nt, Homo sapiens
gaacgucagccagcuc

SEQ ID NO: 1272879 - RNA, 15 nt, Homo sapiens
gaacuaacaugcaaa

SEQ ID NO: 1272880 - RNA, 14 nt, Homo sapiens
gaacuaacugacag

SEQ ID NO: 1272881 - RNA, 14 nt, Homo sapiens
gaacuaaugaggau

SEQ ID NO: 1272882 - RNA, 21 nt, Homo sapiens
gaacuacaaagcuucuauccc

SEQ ID NO: 1272883 - RNA, 16 nt, Homo sapiens
gaacuaugaacuacaa

SEQ ID NO: 1272884 - RNA, 15 nt, Homo sapiens
gaacuauuucuacac

SEQ ID NO: 1272885 - RNA, 22 nt, Homo sapiens
gaacucacugcgauggggguca

SEQ ID NO: 1272886 - RNA, 14 nt, Homo sapiens
gaacucacuggggc

SEQ ID NO: 1272887 - RNA, 11 nt, Homo sapiens
gaacucaggga

SEQ ID NO: 1272888 - RNA, 12 nt, Homo sapiens
gaacucaguccu

SEQ ID NO: 1272889 - RNA, 22 nt, Homo sapiens
gaacuccacaugcuggugcaua

SEQ ID NO: 1272890 - RNA, 13 nt, Homo sapiens
gaacucuguaaaa

SEQ ID NO: 1272891 - RNA, 18 nt, Homo sapiens
gaacugaaguuucacaug

SEQ ID NO: 1272892 - RNA, 17 nt, Homo sapiens
gaacuuaaccuugcaaa

SEQ ID NO: 1272893 - RNA, 16 nt, Homo sapiens
gaacuuacuauucauu

SEQ ID NO: 1272894 - RNA, 15 nt, Homo sapiens
gaacuucccuuaaga

SEQ ID NO: 1272895 - RNA, 19 nt, Homo sapiens
gaacuucugacuacuuguu

SEQ ID NO: 1272896 - RNA, 22 nt, Homo sapiens
gaacuugccuuaaacacucacc

SEQ ID NO: 1272897 - RNA, 20 nt, Homo sapiens
gaacuugcugcugagugcac

SEQ ID NO: 1272898 - RNA, 18 nt, Homo sapiens
gaacuuggcacacucucc

SEQ ID NO: 1272899 - RNA, 19 nt, Homo sapiens
gaacuuggcacacucucca

SEQ ID NO: 1272900 - RNA, 18 nt, Homo sapiens
gaacuuuaagaagcagug

SEQ ID NO: 1272901 - RNA, 16 nt, Homo sapiens
gaacuuucaaaauaua

SEQ ID NO: 1272902 - RNA, 21 nt, Homo sapiens
gaacuuuguggucgacaucaa

SEQ ID NO: 1272903 - RNA, 20 nt, Homo sapiens
gaacuuuguuaacgcacuug

SEQ ID NO: 1272904 - RNA, 20 nt, Homo sapiens
gaagaaaagcugccauuucc

SEQ ID NO: 1272905 - RNA, 13 nt, Homo sapiens
gaagaaagcaaca

SEQ ID NO: 1272906 - RNA, 17 nt, Homo sapiens
gaagaacauccaaggag

SEQ ID NO: 1272907 - RNA, 21 nt, Homo sapiens
gaagaacuggaaccccagcuu

SEQ ID NO: 1272908 - RNA, 14 nt, Homo sapiens
gaagaacuugcaug

SEQ ID NO: 1272909 - RNA, 20 nt, Homo sapiens
gaagaacuuggcacacucuc

SEQ ID NO: 1272910 - RNA, 20 nt, Homo sapiens
gaagaagacaaaugacagau

SEQ ID NO: 1272911 - RNA, 23 nt, Homo sapiens
gaagaagauaugugaagaaaaau

SEQ ID NO: 1272912 - RNA, 14 nt, Homo sapiens
gaagaagcuauguc

SEQ ID NO: 1272913 - RNA, 15 nt, Homo sapiens
gaagaagcuauguca

SEQ ID NO: 1272914 - RNA, 16 nt, Homo sapiens
gaagaagugguacuag

SEQ ID NO: 1272915 - RNA, 22 nt, Homo sapiens
gaagaaguguugauugccaaau

SEQ ID NO: 1272916 - RNA, 13 nt, Homo sapiens
gaagaaugaaaau

SEQ ID NO: 1272917 - RNA, 15 nt, Homo sapiens
gaagaaugagcaaga

SEQ ID NO: 1272918 - RNA, 22 nt, Homo sapiens
cuucauaagguaauucauggca

SEQ ID NO: 1272919 - RNA, 23 nt, Homo sapiens
cuucauacuggcaggagggugag

SEQ ID NO: 1272920 - RNA, 23 nt, Homo sapiens
cuucaucauucccucucaucuca

SEQ ID NO: 1272921 - RNA, 15 nt, Homo sapiens
cuucauccaacuucc

SEQ ID NO: 1272922 - RNA, 22 nt, Homo sapiens
cuucaucgaaucuacuaauucc

SEQ ID NO: 1272923 - RNA, 17 nt, Homo sapiens
cuucaucucaccauccu

SEQ ID NO: 1272924 - RNA, 21 nt, Homo sapiens
cuucaucuggcaacaucuuua

SEQ ID NO: 1272925 - RNA, 19 nt, Homo sapiens
cuucaucuucacugcaauu

SEQ ID NO: 1272926 - RNA, 16 nt, Homo sapiens
cuucaugcccuucuga

SEQ ID NO: 1272927 - RNA, 12 nt, Homo sapiens
cuucaugcuuuu

SEQ ID NO: 1272928 - RNA, 15 nt, Homo sapiens
cuucauggacuucca

SEQ ID NO: 1272929 - RNA, 20 nt, Homo sapiens
cuucauucuccuuguuguug

SEQ ID NO: 1272930 - RNA, 15 nt, Homo sapiens
cuucauuucaaucau

SEQ ID NO: 1272931 - RNA, 12 nt, Homo sapiens
cuucauuucagg

SEQ ID NO: 1272932 - RNA, 24 nt, Homo sapiens
cuucauuugaugcuaaauaggaga

SEQ ID NO: 1272933 - RNA, 14 nt, Homo sapiens
cuucauuuguguca

SEQ ID NO: 1272934 - RNA, 13 nt, Homo sapiens
cuuccaacccacu

SEQ ID NO: 1272935 - RNA, 18 nt, Homo sapiens
cuuccaacccacuggccc

SEQ ID NO: 1272936 - RNA, 19 nt, Homo sapiens
cuuccaaggguacuaagga

SEQ ID NO: 1272937 - RNA, 21 nt, Homo sapiens
cuuccaauuuacauacucugc

SEQ ID NO: 1272938 - RNA, 22 nt, Homo sapiens
cuuccacaacagaaguauuucu

SEQ ID NO: 1272939 - RNA, 18 nt, Homo sapiens
cuuccacaagagugaauu

SEQ ID NO: 1272940 - RNA, 13 nt, Homo sapiens
cuuccacuggugg

SEQ ID NO: 1272941 - RNA, 12 nt, Homo sapiens
cuuccacuuugc

SEQ ID NO: 1272942 - RNA, 13 nt, Homo sapiens
cuuccagauccug

SEQ ID NO: 1272943 - RNA, 16 nt, Homo sapiens
cuuccaguguccuuag

SEQ ID NO: 1272944 - RNA, 23 nt, Homo sapiens
cuuccauaggacauacugcaugu

SEQ ID NO: 1272945 - RNA, 20 nt, Homo sapiens
cuuccaucccaggacaccac

SEQ ID NO: 1272946 - RNA, 18 nt, Homo sapiens
cuuccaucuagucacaaa

SEQ ID NO: 1272947 - RNA, 12 nt, Homo sapiens
cuuccaugagaa

SEQ ID NO: 1272948 - RNA, 15 nt, Homo sapiens
cuucccaacaugccu

SEQ ID NO: 1272949 - RNA, 18 nt, Homo sapiens
cuucccagaaaaccaguc

SEQ ID NO: 1272950 - RNA, 19 nt, Homo sapiens
cuucccaugggcagaggac

SEQ ID NO: 1272951 - RNA, 22 nt, Homo sapiens
cuuccccaauuggcucuaguca

SEQ ID NO: 1272952 - RNA, 18 nt, Homo sapiens
cuucccccuuccaaauaa

SEQ ID NO: 1272953 - RNA, 19 nt, Homo sapiens
cuucccucgcaugucuccc

SEQ ID NO: 1272954 - RNA, 14 nt, Homo sapiens
cuucccuugccucg

SEQ ID NO: 1272955 - RNA, 12 nt, Homo sapiens
cuuccuaagucu

SEQ ID NO: 1272956 - RNA, 20 nt, Homo sapiens
cuuccucccugucucugcau

SEQ ID NO: 1272957 - RNA, 17 nt, Homo sapiens
cuuccuccucgcugcca

SEQ ID NO: 1272958 - RNA, 18 nt, Homo sapiens
cuuccuccucgcugccag

SEQ ID NO: 1272959 - RNA, 21 nt, Homo sapiens
cuuccucucaggcucuugacu

SEQ ID NO: 1272960 - RNA, 20 nt, Homo sapiens
cuuccugaaauaaacacugg

SEQ ID NO: 1272961 - RNA, 21 nt, Homo sapiens
cuuccugaaauaaacacuggu

SEQ ID NO: 1272962 - RNA, 15 nt, Homo sapiens
cuuccugacacuuua

SEQ ID NO: 1272963 - RNA, 14 nt, Homo sapiens
cuuccugauucauu

SEQ ID NO: 1272964 - RNA, 19 nt, Homo sapiens
cuuccugccagcaggggug

SEQ ID NO: 1272965 - RNA, 18 nt, Homo sapiens
cuuccuggaguacaaaca

SEQ ID NO: 1272966 - RNA, 19 nt, Homo sapiens
cuuccuggaguacaaacac

SEQ ID NO: 1272967 - RNA, 15 nt, Homo sapiens
cuuccuggcuguaaa

SEQ ID NO: 1272968 - RNA, 17 nt, Homo sapiens
cuuccugggcaaagaag

SEQ ID NO: 1272969 - RNA, 21 nt, Homo sapiens
cuuccugggcagccuuuccag

SEQ ID NO: 1272970 - RNA, 20 nt, Homo sapiens
cuuccugggucaagugcuaa

SEQ ID NO: 1272971 - RNA, 21 nt, Homo sapiens
cuuccugguuuuguacacugc

SEQ ID NO: 1272972 - RNA, 15 nt, Homo sapiens
cuuccuguccacucu

SEQ ID NO: 1272973 - RNA, 16 nt, Homo sapiens
cuuccuguuaauguau

SEQ ID NO: 1272974 - RNA, 15 nt, Homo sapiens
cuuccuuacccaaac

SEQ ID NO: 1272975 - RNA, 19 nt, Homo sapiens
cuuccuugaagaacugcag

SEQ ID NO: 1272976 - RNA, 12 nt, Homo sapiens
cuuccuugcucu

SEQ ID NO: 1272977 - RNA, 20 nt, Homo sapiens
cuuccuuggaggggggagcc

SEQ ID NO: 1272978 - RNA, 21 nt, Homo sapiens
cuuccuuggaggggggagcca

SEQ ID NO: 1272979 - RNA, 19 nt, Homo sapiens
cuucgaggcuuuacagugu

SEQ ID NO: 1272980 - RNA, 14 nt, Homo sapiens
cuucuaacacaaaa

SEQ ID NO: 1272981 - RNA, 18 nt, Homo sapiens
cuucuacagcagcacugu

SEQ ID NO: 1272982 - RNA, 19 nt, Homo sapiens
cuucuaccuuaaaauguaa

SEQ ID NO: 1272983 - RNA, 19 nt, Homo sapiens
cuucuacgggauggccaga

SEQ ID NO: 1272984 - RNA, 15 nt, Homo sapiens
cuucuagaaucucgu

SEQ ID NO: 1272985 - RNA, 21 nt, Homo sapiens
cuucucaaaacuggacaguca

SEQ ID NO: 1272986 - RNA, 20 nt, Homo sapiens
cuucucaaauuagcugcaau

SEQ ID NO: 1272987 - RNA, 17 nt, Homo sapiens
cuucucaagugccuuaa

SEQ ID NO: 1272988 - RNA, 15 nt, Homo sapiens
cuucucaucugcaaa

SEQ ID NO: 1272989 - RNA, 15 nt, Homo sapiens
cuucucaugauccaa

SEQ ID NO: 1272990 - RNA, 17 nt, Homo sapiens
cuucuccaccaaagaca

SEQ ID NO: 1272991 - RNA, 12 nt, Homo sapiens
cuucuccaguau

SEQ ID NO: 1272992 - RNA, 20 nt, Homo sapiens
cuucuccaucccucuaauga

SEQ ID NO: 1272993 - RNA, 15 nt, Homo sapiens
cuucuccaucuccug

SEQ ID NO: 1272994 - RNA, 16 nt, Homo sapiens
cuucuccucccagcgu

SEQ ID NO: 1272995 - RNA, 20 nt, Homo sapiens
cuucuccucucugggccuuu

SEQ ID NO: 1272996 - RNA, 14 nt, Homo sapiens
cuucucggcucagg

SEQ ID NO: 1272997 - RNA, 18 nt, Homo sapiens
cuucucuacagacuucuc

SEQ ID NO: 1272998 - RNA, 14 nt, Homo sapiens
cuucucuauggccu

SEQ ID NO: 1272999 - RNA, 22 nt, Homo sapiens
cuucucuggaaaggggggagcu

SEQ ID NO: 1273000 - RNA, 15 nt, Homo sapiens
cuucugaaacuggag

SEQ ID NO: 1273001 - RNA, 19 nt, Homo sapiens
cuucugacacugaaacuuc

SEQ ID NO: 1273002 - RNA, 22 nt, Homo sapiens
cuucugaugucucuaaagcacu

SEQ ID NO: 1273003 - RNA, 14 nt, Homo sapiens
cuucugcaacaucu

SEQ ID NO: 1273004 - RNA, 21 nt, Homo sapiens
cuucuggcagggaagugggga

SEQ ID NO: 1273005 - RNA, 16 nt, Homo sapiens
cuucugggcacagugg

SEQ ID NO: 1273006 - RNA, 17 nt, Homo sapiens
cuucuguccuacucugu

SEQ ID NO: 1273007 - RNA, 22 nt, Homo sapiens
cuucuguggaccacugcaugag

SEQ ID NO: 1273008 - RNA, 11 nt, Homo sapiens
cuucugugguc

SEQ ID NO: 1273009 - RNA, 16 nt, Homo sapiens
cuucuuacaacagaga

SEQ ID NO: 1273010 - RNA, 14 nt, Homo sapiens
cuucuuacucauua

SEQ ID NO: 1273011 - RNA, 22 nt, Homo sapiens
cuucuuauggaauugauuugca

SEQ ID NO: 1273012 - RNA, 14 nt, Homo sapiens
cuucuucauauucu

SEQ ID NO: 1273013 - RNA, 17 nt, Homo sapiens
cuucuuccugcuggaca

SEQ ID NO: 1273014 - RNA, 11 nt, Homo sapiens
cuucuugccuc

SEQ ID NO: 1273015 - RNA, 13 nt, Homo sapiens
cuucuugcucccc

SEQ ID NO: 1273016 - RNA, 19 nt, Homo sapiens
cuucuuguaguagucucau

SEQ ID NO: 1273017 - RNA, 23 nt, Homo sapiens
cuucuugucagacauaaagccau

SEQ ID NO: 1273018 - RNA, 17 nt, Homo sapiens
cuucuuuauacuguaau

SEQ ID NO: 1273019 - RNA, 20 nt, Homo sapiens
cuucuuuuggcuuccaugau

SEQ ID NO: 1273020 - RNA, 21 nt, Homo sapiens
cuucuuuuguggugucuucca

SEQ ID NO: 1273021 - RNA, 16 nt, Homo sapiens
cuugaaaagaagcaag

SEQ ID NO: 1273022 - RNA, 21 nt, Homo sapiens
cuugaaaagcuaguguaccuc

SEQ ID NO: 1273023 - RNA, 23 nt, Homo sapiens
cuugaaaagcuaguguaccuccu

SEQ ID NO: 1273024 - RNA, 13 nt, Homo sapiens
cuugaacccaaga

SEQ ID NO: 1273025 - RNA, 19 nt, Homo sapiens
cuugaauauguagcucauc

SEQ ID NO: 1273026 - RNA, 17 nt, Homo sapiens
cuugaaugugcaccuga

SEQ ID NO: 1273027 - RNA, 16 nt, Homo sapiens
cuugaauguggcuuga

SEQ ID NO: 1273028 - RNA, 13 nt, Homo sapiens
cuugaaugugguc

SEQ ID NO: 1273029 - RNA, 16 nt, Homo sapiens
cuugaccguacucuca

SEQ ID NO: 1273030 - RNA, 20 nt, Homo sapiens
cuugaccucaggugauccac

SEQ ID NO: 1273031 - RNA, 21 nt, Homo sapiens
cuugagaaaccuuauuguacc

SEQ ID NO: 1273032 - RNA, 13 nt, Homo sapiens
cuugagccaguaa

SEQ ID NO: 1273033 - RNA, 19 nt, Homo sapiens
cuugagccucccccaaagc

SEQ ID NO: 1273034 - RNA, 15 nt, Homo sapiens
cuugagcuacaguag

SEQ ID NO: 1273035 - RNA, 15 nt, Homo sapiens
cuugaggauugugga

SEQ ID NO: 1273036 - RNA, 21 nt, Homo sapiens
cuugagguggugccuucucac

SEQ ID NO: 1273037 - RNA, 23 nt, Homo sapiens
cuugaguuguuuaaacagucaaa

SEQ ID NO: 1273038 - RNA, 21 nt, Homo sapiens
cuugauaaauauauaugauca

SEQ ID NO: 1273039 - RNA, 19 nt, Homo sapiens
cuugauaggaauucaucuu

SEQ ID NO: 1273040 - RNA, 16 nt, Homo sapiens
cuugauauuuuccaaa

SEQ ID NO: 1273041 - RNA, 14 nt, Homo sapiens
cuugaugacugcug

SEQ ID NO: 1273042 - RNA, 18 nt, Homo sapiens
cuugauggagauauuuac

SEQ ID NO: 1273043 - RNA, 20 nt, Homo sapiens
cuugauuagugccuucugcc

SEQ ID NO: 1273044 - RNA, 12 nt, Homo sapiens
cuugauuccagu

SEQ ID NO: 1273045 - RNA, 17 nt, Homo sapiens
cuuaaaauauauuucag

SEQ ID NO: 1273046 - RNA, 16 nt, Homo sapiens
cuuaaaccacagcacu

SEQ ID NO: 1273047 - RNA, 22 nt, Homo sapiens
cuuaaacgaagaguucccuuga

SEQ ID NO: 1273048 - RNA, 21 nt, Homo sapiens
cuuaaacuaaauaaugaauaa

SEQ ID NO: 1273049 - RNA, 20 nt, Homo sapiens
cuuaaagaaacagcuuucaa

SEQ ID NO: 1273050 - RNA, 12 nt, Homo sapiens
cuuaaagccauu

SEQ ID NO: 1273051 - RNA, 22 nt, Homo sapiens
cuuaaagcccgccugacagaaa

SEQ ID NO: 1273052 - RNA, 23 nt, Homo sapiens
cuuaaaggccuggaaccagggag

SEQ ID NO: 1273053 - RNA, 17 nt, Homo sapiens
cuuaaagggucuuauga

SEQ ID NO: 1273054 - RNA, 12 nt, Homo sapiens
cuuaacauucau

SEQ ID NO: 1273055 - RNA, 22 nt, Homo sapiens
cuuaacccccuagaaagacaga

SEQ ID NO: 1273056 - RNA, 18 nt, Homo sapiens
cuuaacuaauuugaaugu

SEQ ID NO: 1273057 - RNA, 17 nt, Homo sapiens
cuuaacucugaugguuc

SEQ ID NO: 1273058 - RNA, 19 nt, Homo sapiens
cuuaacugaugacauucca

SEQ ID NO: 1273059 - RNA, 22 nt, Homo sapiens
cuuaagaaguuagaaggcuuaa

SEQ ID NO: 1273060 - RNA, 15 nt, Homo sapiens
cuuaagagacuacag

SEQ ID NO: 1273061 - RNA, 12 nt, Homo sapiens
cuuaagauuugg

SEQ ID NO: 1273062 - RNA, 17 nt, Homo sapiens
cuuaagauuuugcaccu

SEQ ID NO: 1273063 - RNA, 13 nt, Homo sapiens
cuuaagcugggau

SEQ ID NO: 1273064 - RNA, 17 nt, Homo sapiens
cuuaaggagguguuccu

SEQ ID NO: 1273065 - RNA, 14 nt, Homo sapiens
cuuaaggucuccaa

SEQ ID NO: 1273066 - RNA, 23 nt, Homo sapiens
cuuaaguuccagcagaugccaca

SEQ ID NO: 1273067 - RNA, 23 nt, Homo sapiens
cuuaauaaaggcccccacuucuc

SEQ ID NO: 1273068 - RNA, 15 nt, Homo sapiens
cuuaaugacauuccc

SEQ ID NO: 1273069 - RNA, 16 nt, Homo sapiens
cuuaaugguagcaacu

SEQ ID NO: 1273070 - RNA, 19 nt, Homo sapiens
cuuaaugguauccuacuga

SEQ ID NO: 1273071 - RNA, 15 nt, Homo sapiens
cuuaauguuuauucc

SEQ ID NO: 1273072 - RNA, 16 nt, Homo sapiens
cuuaauuaaauaucaa

SEQ ID NO: 1273073 - RNA, 15 nt, Homo sapiens
cuuaauuauuauaaa

SEQ ID NO: 1273074 - RNA, 15 nt, Homo sapiens
cuuacaaaacauuuu

SEQ ID NO: 1273075 - RNA, 18 nt, Homo sapiens
cuuacaauugcacugcug

SEQ ID NO: 1273076 - RNA, 18 nt, Homo sapiens
cuuacaggccuugcucac

SEQ ID NO: 1273077 - RNA, 14 nt, Homo sapiens
cuuacagucccaga

SEQ ID NO: 1273078 - RNA, 13 nt, Homo sapiens
cuuaccauauguu

SEQ ID NO: 1273079 - RNA, 17 nt, Homo sapiens
cuuaccugaccucuugc

SEQ ID NO: 1273080 - RNA, 14 nt, Homo sapiens
cuuacugcaggcaa

SEQ ID NO: 1273081 - RNA, 13 nt, Homo sapiens
cuuacuggugcua

SEQ ID NO: 1273082 - RNA, 14 nt, Homo sapiens
cuuacuuugaguua

SEQ ID NO: 1273083 - RNA, 21 nt, Homo sapiens
cuuagaaauguaaacugccau

SEQ ID NO: 1273084 - RNA, 15 nt, Homo sapiens
cuuagagaggacaau

SEQ ID NO: 1273085 - RNA, 22 nt, Homo sapiens
cuuagaugagggugacugucaa

SEQ ID NO: 1273086 - RNA, 19 nt, Homo sapiens
cuuagauguuccaguaauc

SEQ ID NO: 1273087 - RNA, 15 nt, Homo sapiens
cuuagcaugcacaaa

SEQ ID NO: 1273088 - RNA, 17 nt, Homo sapiens
cuuagccaagcaguuuc

SEQ ID NO: 1273089 - RNA, 11 nt, Homo sapiens
cuuagcugccu

SEQ ID NO: 1273090 - RNA, 16 nt, Homo sapiens
cuuaggaaccuaccag

SEQ ID NO: 1273091 - RNA, 23 nt, Homo sapiens
cuuaggagacgcugcacuugaca

SEQ ID NO: 1273092 - RNA, 16 nt, Homo sapiens
cuuagggacagaauua

SEQ ID NO: 1273093 - RNA, 20 nt, Homo sapiens
cuuagggugcugagugccug

SEQ ID NO: 1273094 - RNA, 21 nt, Homo sapiens
cuuaggugcuucuucacuuca

SEQ ID NO: 1273095 - RNA, 19 nt, Homo sapiens
cuuaguaguggguuucuau

SEQ ID NO: 1273096 - RNA, 22 nt, Homo sapiens
cuuaguccuacccugaaccuau

SEQ ID NO: 1273097 - RNA, 12 nt, Homo sapiens
cuuagugaaugg

SEQ ID NO: 1273098 - RNA, 12 nt, Homo sapiens
cuuagugacaaa

SEQ ID NO: 1273099 - RNA, 15 nt, Homo sapiens
cuuagugucacuuac

SEQ ID NO: 1273100 - RNA, 12 nt, Homo sapiens
cuuaguuuccac

SEQ ID NO: 1273101 - RNA, 18 nt, Homo sapiens
cuuauaagaaagaucaaa

SEQ ID NO: 1273102 - RNA, 22 nt, Homo sapiens
cuuauagcacuuugaaauaccu

SEQ ID NO: 1273103 - RNA, 13 nt, Homo sapiens
cuuauaugugaca

SEQ ID NO: 1273104 - RNA, 19 nt, Homo sapiens
cuuauauuuucguaugaaa

SEQ ID NO: 1273105 - RNA, 22 nt, Homo sapiens
cuuaucucagucaugcauaaau

SEQ ID NO: 1273106 - RNA, 14 nt, Homo sapiens
cuuaucugucacac

SEQ ID NO: 1273107 - RNA, 21 nt, Homo sapiens
cuuaugcaaucuauguuugca

SEQ ID NO: 1273108 - RNA, 12 nt, Homo sapiens
cuuaugugacau

SEQ ID NO: 1273109 - RNA, 14 nt, Homo sapiens
cuuauuaauacaaa

SEQ ID NO: 1273110 - RNA, 20 nt, Homo sapiens
cuuauuaauacaaacacaaa

SEQ ID NO: 1273111 - RNA, 21 nt, Homo sapiens
cuuauuacagcauuugauaaa

SEQ ID NO: 1273112 - RNA, 16 nt, Homo sapiens
cuuauucaaccugucc

SEQ ID NO: 1273113 - RNA, 21 nt, Homo sapiens
cuuauuccuaggcaacuauua

SEQ ID NO: 1273114 - RNA, 18 nt, Homo sapiens
cuuauugacaauugugua

SEQ ID NO: 1273115 - RNA, 23 nt, Homo sapiens
cuuauuuaaugccgauauacucu

SEQ ID NO: 1273116 - RNA, 14 nt, Homo sapiens
cuuauuuauaccuc

SEQ ID NO: 1273117 - RNA, 15 nt, Homo sapiens
cuuauuucauaaaca

SEQ ID NO: 1273118 - RNA, 21 nt, Homo sapiens
cuuauuuugucuuauucuuaa

SEQ ID NO: 1273119 - RNA, 21 nt, Homo sapiens
cuuauuuugugugcuuuccca

SEQ ID NO: 1273120 - RNA, 16 nt, Homo sapiens
cuuauuuuuagccaua

SEQ ID NO: 1273121 - RNA, 22 nt, Homo sapiens
cuucaaaagccauaacuugaaa

SEQ ID NO: 1273122 - RNA, 23 nt, Homo sapiens
cuucaaaagcuuuuuacucaaag

SEQ ID NO: 1273123 - RNA, 20 nt, Homo sapiens
cuucaaacugugaagcauuu

SEQ ID NO: 1273124 - RNA, 22 nt, Homo sapiens
cuucaacaaccggccaccagau

SEQ ID NO: 1273125 - RNA, 15 nt, Homo sapiens
cuucaacauccugcc

SEQ ID NO: 1273126 - RNA, 13 nt, Homo sapiens
cuucaaccaguga

SEQ ID NO: 1273127 - RNA, 17 nt, Homo sapiens
cuucaaccucauugaca

SEQ ID NO: 1273128 - RNA, 13 nt, Homo sapiens
cuucaagaccaaa

SEQ ID NO: 1273129 - RNA, 21 nt, Homo sapiens
cuucaaguauaacaacuuuga

SEQ ID NO: 1273130 - RNA, 14 nt, Homo sapiens
cuucaagugccaaa

SEQ ID NO: 1273131 - RNA, 21 nt, Homo sapiens
cuucaagugccuuuugcugcg

SEQ ID NO: 1273132 - RNA, 19 nt, Homo sapiens
cuucaaguuaaagugaaua

SEQ ID NO: 1273133 - RNA, 17 nt, Homo sapiens
cuucaaguuguaaaaau

SEQ ID NO: 1273134 - RNA, 13 nt, Homo sapiens
cuucaauacuuaa

SEQ ID NO: 1273135 - RNA, 14 nt, Homo sapiens
cuucaauacuuaaa

SEQ ID NO: 1273136 - RNA, 19 nt, Homo sapiens
cuucaauagaacuguuuca

SEQ ID NO: 1273137 - RNA, 18 nt, Homo sapiens
cuucaaugggcucuucca

SEQ ID NO: 1273138 - RNA, 17 nt, Homo sapiens
cuucaauuuauuacuga

SEQ ID NO: 1273139 - RNA, 20 nt, Homo sapiens
cuucacagaaaguucuuaaa

SEQ ID NO: 1273140 - RNA, 17 nt, Homo sapiens
cuucacaguacccaaac

SEQ ID NO: 1273141 - RNA, 20 nt, Homo sapiens
cuucacaguagagccagcuu

SEQ ID NO: 1273142 - RNA, 14 nt, Homo sapiens
cuucacaguguuuc

SEQ ID NO: 1273143 - RNA, 18 nt, Homo sapiens
cuucaccccuauggugcu

SEQ ID NO: 1273144 - RNA, 19 nt, Homo sapiens
cuucaccccuauggugcuc

SEQ ID NO: 1273145 - RNA, 11 nt, Homo sapiens
cuucaccugcg

SEQ ID NO: 1273146 - RNA, 20 nt, Homo sapiens
cuucacuacuuuaauaaaga

SEQ ID NO: 1273147 - RNA, 10 nt, Homo sapiens
cuucacugac

SEQ ID NO: 1273148 - RNA, 11 nt, Homo sapiens
cuucacugaca

SEQ ID NO: 1273149 - RNA, 12 nt, Homo sapiens
cuucacugacag

SEQ ID NO: 1273150 - RNA, 18 nt, Homo sapiens
cuucacugcaaguuuuag

SEQ ID NO: 1273151 - RNA, 15 nt, Homo sapiens
cuucacuggcuucca

SEQ ID NO: 1273152 - RNA, 16 nt, Homo sapiens
cuucacuggcuuccau

SEQ ID NO: 1273153 - RNA, 18 nt, Homo sapiens
cuucacuggcuuccauca

SEQ ID NO: 1273154 - RNA, 22 nt, Homo sapiens
cuucagaaauucucugcgauua

SEQ ID NO: 1273155 - RNA, 16 nt, Homo sapiens
cuucagaagacacugc

SEQ ID NO: 1273156 - RNA, 20 nt, Homo sapiens
cuucagaagacacugcaaag

SEQ ID NO: 1273157 - RNA, 20 nt, Homo sapiens
cuucagaggauaaauaucaa

SEQ ID NO: 1273158 - RNA, 21 nt, Homo sapiens
cuucagaggauaaauaucaau

SEQ ID NO: 1273159 - RNA, 18 nt, Homo sapiens
cuucagaguuugugugua

SEQ ID NO: 1273160 - RNA, 24 nt, Homo sapiens
cuucagauggugaagcauucuccc

SEQ ID NO: 1273161 - RNA, 23 nt, Homo sapiens
cuucaggaacuggggcuuugccu

SEQ ID NO: 1273162 - RNA, 14 nt, Homo sapiens
cuucagggccaguc

SEQ ID NO: 1273163 - RNA, 23 nt, Homo sapiens
cuucaggggcacuucauugagag

SEQ ID NO: 1273164 - RNA, 21 nt, Homo sapiens
cuucaggguuuaauagacuga

SEQ ID NO: 1273165 - RNA, 17 nt, Homo sapiens
cuucagguucucaugau

SEQ ID NO: 1273166 - RNA, 18 nt, Homo sapiens
cuucaguacucaaauuca

SEQ ID NO: 1273167 - RNA, 18 nt, Homo sapiens
cuucaguccaacugucaa

SEQ ID NO: 1273168 - RNA, 20 nt, Homo sapiens
cuucaguccacuucugcucu

SEQ ID NO: 1273169 - RNA, 22 nt, Homo sapiens
cuucagugcaaauuguaucuua

SEQ ID NO: 1273170 - RNA, 23 nt, Homo sapiens
cuucagugcaccuacugcuuacu

SEQ ID NO: 1273171 - RNA, 14 nt, Homo sapiens
cuucaguuaugauu

SEQ ID NO: 1273172 - RNA, 15 nt, Homo sapiens
cggggcccuguguag

SEQ ID NO: 1273173 - RNA, 15 nt, Homo sapiens
cggggcuccacugaa

SEQ ID NO: 1273174 - RNA, 20 nt, Homo sapiens
cggggguggagugagacuga

SEQ ID NO: 1273175 - RNA, 11 nt, Homo sapiens
cgggucccugc

SEQ ID NO: 1273176 - RNA, 12 nt, Homo sapiens
cgggugugcuau

SEQ ID NO: 1273177 - RNA, 13 nt, Homo sapiens
cggguguguacac

SEQ ID NO: 1273178 - RNA, 19 nt, Homo sapiens
cggguguguacaccaaggu

SEQ ID NO: 1273179 - RNA, 15 nt, Homo sapiens
cggguuacuuucaca

SEQ ID NO: 1273180 - RNA, 22 nt, Homo sapiens
cgguacuaguucagacacuuug

SEQ ID NO: 1273181 - RNA, 14 nt, Homo sapiens
cggucagugccuuu

SEQ ID NO: 1273182 - RNA, 23 nt, Homo sapiens
cggugcauacacccccaccuccu

SEQ ID NO: 1273183 - RNA, 16 nt, Homo sapiens
cggugugcaccaacau

SEQ ID NO: 1273184 - RNA, 16 nt, Homo sapiens
cgguguguaacacugu

SEQ ID NO: 1273185 - RNA, 21 nt, Homo sapiens
cgguuaaauacuguguggaac

SEQ ID NO: 1273186 - RNA, 14 nt, Homo sapiens
cgguuaccucugca

SEQ ID NO: 1273187 - RNA, 22 nt, Homo sapiens
cgguuuacagcuaucgaacuuc

SEQ ID NO: 1273188 - RNA, 19 nt, Homo sapiens
cgguuuuauaaaagccuug

SEQ ID NO: 1273189 - RNA, 16 nt, Homo sapiens
cguacaucugcaauau

SEQ ID NO: 1273190 - RNA, 14 nt, Homo sapiens
cguacucucacaug

SEQ ID NO: 1273191 - RNA, 19 nt, Homo sapiens
cguacugauucuaaugggg

SEQ ID NO: 1273192 - RNA, 21 nt, Homo sapiens
cguaggggagggguugccaca

SEQ ID NO: 1273193 - RNA, 13 nt, Homo sapiens
cguauagguugau

SEQ ID NO: 1273194 - RNA, 22 nt, Homo sapiens
cguauuuuuucuaaugugcauu

SEQ ID NO: 1273195 - RNA, 13 nt, Homo sapiens
cgucagccagcuc

SEQ ID NO: 1273196 - RNA, 21 nt, Homo sapiens
cgucagucuuuuucuguugua

SEQ ID NO: 1273197 - RNA, 17 nt, Homo sapiens
cgucaucaucacauuca

SEQ ID NO: 1273198 - RNA, 17 nt, Homo sapiens
cgucauguguuuugcca

SEQ ID NO: 1273199 - RNA, 21 nt, Homo sapiens
cguccacuccuccuacuguau

SEQ ID NO: 1273200 - RNA, 15 nt, Homo sapiens
cguccaucucccuua

SEQ ID NO: 1273201 - RNA, 12 nt, Homo sapiens
cguccuggucaa

SEQ ID NO: 1273202 - RNA, 13 nt, Homo sapiens
cguccuuccucuc

SEQ ID NO: 1273203 - RNA, 13 nt, Homo sapiens
cgucuaugcugcu

SEQ ID NO: 1273204 - RNA, 22 nt, Homo sapiens
cgucuucacuuccccacaggcu

SEQ ID NO: 1273205 - RNA, 23 nt, Homo sapiens
cgucuuccugaguggugccaaac

SEQ ID NO: 1273206 - RNA, 17 nt, Homo sapiens
cgugaaaccccaucucu

SEQ ID NO: 1273207 - RNA, 16 nt, Homo sapiens
cgugaacugugcauag

SEQ ID NO: 1273208 - RNA, 16 nt, Homo sapiens
cgugaauuuauaguua

SEQ ID NO: 1273209 - RNA, 14 nt, Homo sapiens
cgugacaacaugcg

SEQ ID NO: 1273210 - RNA, 12 nt, Homo sapiens
cgugagaaggag

SEQ ID NO: 1273211 - RNA, 17 nt, Homo sapiens
cgugagcagcuuuggaa

SEQ ID NO: 1273212 - RNA, 20 nt, Homo sapiens
cgugauaaugcagacuuccu

SEQ ID NO: 1273213 - RNA, 17 nt, Homo sapiens
cgugcacacaccagagc

SEQ ID NO: 1273214 - RNA, 17 nt, Homo sapiens
cgugcauuagcacagau

SEQ ID NO: 1273215 - RNA, 20 nt, Homo sapiens
cgugccaaaaaucuuuucau

SEQ ID NO: 1273216 - RNA, 19 nt, Homo sapiens
cgugcugcaugccuggucu

SEQ ID NO: 1273217 - RNA, 17 nt, Homo sapiens
cguggaacacauagguu

SEQ ID NO: 1273218 - RNA, 22 nt, Homo sapiens
cguggacucugcacaugucuug

SEQ ID NO: 1273219 - RNA, 21 nt, Homo sapiens
cguggcaaaaugaacacaucu

SEQ ID NO: 1273220 - RNA, 18 nt, Homo sapiens
cguggcaaauuaacuuga

SEQ ID NO: 1273221 - RNA, 19 nt, Homo sapiens
cguggcaacuagauaucau

SEQ ID NO: 1273222 - RNA, 18 nt, Homo sapiens
cgugggcaaacaggcagu

SEQ ID NO: 1273223 - RNA, 20 nt, Homo sapiens
cguggggaacugcguggugc

SEQ ID NO: 1273224 - RNA, 21 nt, Homo sapiens
cguggucccaacuacucagcc

SEQ ID NO: 1273225 - RNA, 19 nt, Homo sapiens
cgugguccccaacagcgac

SEQ ID NO: 1273226 - RNA, 20 nt, Homo sapiens
cguguaauuggcccaaguca

SEQ ID NO: 1273227 - RNA, 20 nt, Homo sapiens
cguguccucucccugccaag

SEQ ID NO: 1273228 - RNA, 20 nt, Homo sapiens
cgugugacucgccagcucau

SEQ ID NO: 1273229 - RNA, 15 nt, Homo sapiens
cguguguagaguuaa

SEQ ID NO: 1273230 - RNA, 20 nt, Homo sapiens
cguguugcaugaaggagcag

SEQ ID NO: 1273231 - RNA, 22 nt, Homo sapiens
cguguuuaauuaaauuucacaa

SEQ ID NO: 1273232 - RNA, 23 nt, Homo sapiens
cguuaguguauuuuauguguggc

SEQ ID NO: 1273233 - RNA, 17 nt, Homo sapiens
cguuccaccccaagaga

SEQ ID NO: 1273234 - RNA, 15 nt, Homo sapiens
cguucucugcuaaaa

SEQ ID NO: 1273235 - RNA, 16 nt, Homo sapiens
cguucugcaagcauca

SEQ ID NO: 1273236 - RNA, 17 nt, Homo sapiens
cguugcaugucgugacc

SEQ ID NO: 1273237 - RNA, 13 nt, Homo sapiens
cguuggagacuga

SEQ ID NO: 1273238 - RNA, 18 nt, Homo sapiens
cguuggccucagggccag

SEQ ID NO: 1273239 - RNA, 15 nt, Homo sapiens
cguuggcucaguccu

SEQ ID NO: 1273240 - RNA, 15 nt, Homo sapiens
cguuuagaccaagga

SEQ ID NO: 1273241 - RNA, 22 nt, Homo sapiens
cguuucuccaccuagacuguaa

SEQ ID NO: 1273242 - RNA, 16 nt, Homo sapiens
cguuugaacucaggga

SEQ ID NO: 1273243 - RNA, 21 nt, Homo sapiens
cguuuugccugugacuguaaa

SEQ ID NO: 1273244 - RNA, 23 nt, Homo sapiens
cuaaaaaucaaauaagcuaauaa

SEQ ID NO: 1273245 - RNA, 19 nt, Homo sapiens
cuaaaaauucuuaacuuuu

SEQ ID NO: 1273246 - RNA, 14 nt, Homo sapiens
cuaaaacagggugg

SEQ ID NO: 1273247 - RNA, 12 nt, Homo sapiens
cuaaaacauucc

SEQ ID NO: 1273248 - RNA, 12 nt, Homo sapiens
cuaaaacuuaac

SEQ ID NO: 1273249 - RNA, 14 nt, Homo sapiens
cuaaaauauuucau

SEQ ID NO: 1273250 - RNA, 22 nt, Homo sapiens
cuaaaaugauuuuaucugugaa

SEQ ID NO: 1273251 - RNA, 23 nt, Homo sapiens
cuaaaaugauuuuaucugugaau

SEQ ID NO: 1273252 - RNA, 19 nt, Homo sapiens
cuaaaauuagaugaacuca

SEQ ID NO: 1273253 - RNA, 16 nt, Homo sapiens
cuaaaccccuguccca

SEQ ID NO: 1273254 - RNA, 16 nt, Homo sapiens
cuaaacggauuccaaa

SEQ ID NO: 1273255 - RNA, 11 nt, Homo sapiens
cuaaacuacaa

SEQ ID NO: 1273256 - RNA, 22 nt, Homo sapiens
cuaaacuaguuuuuccuaucau

SEQ ID NO: 1273257 - RNA, 12 nt, Homo sapiens
cuaaagauauca

SEQ ID NO: 1273258 - RNA, 16 nt, Homo sapiens
cuaaaggacucuccag

SEQ ID NO: 1273259 - RNA, 22 nt, Homo sapiens
cuaaagguuuuaaccgcacaug

SEQ ID NO: 1273260 - RNA, 15 nt, Homo sapiens
cuaaaguuacaaaca

SEQ ID NO: 1273261 - RNA, 14 nt, Homo sapiens
cuaaaguucuaaga

SEQ ID NO: 1273262 - RNA, 19 nt, Homo sapiens
cuaaaguugcuccauacaa

SEQ ID NO: 1273263 - RNA, 21 nt, Homo sapiens
cuaaauaauguuaucugugua

SEQ ID NO: 1273264 - RNA, 22 nt, Homo sapiens
cuaaauagaaauaaaugauccc

SEQ ID NO: 1273265 - RNA, 22 nt, Homo sapiens
cuaaaucuguaagcucuuugaa

SEQ ID NO: 1273266 - RNA, 16 nt, Homo sapiens
cuaaaugaacuaauga

SEQ ID NO: 1273267 - RNA, 11 nt, Homo sapiens
cuaaaugccuu

SEQ ID NO: 1273268 - RNA, 12 nt, Homo sapiens
cuaaauguauuc

SEQ ID NO: 1273269 - RNA, 23 nt, Homo sapiens
cuaaauuauuuacugcaaaaaga

SEQ ID NO: 1273270 - RNA, 16 nt, Homo sapiens
cuaaauuuaaugcugc

SEQ ID NO: 1273271 - RNA, 11 nt, Homo sapiens
cuaaauuugaa

SEQ ID NO: 1273272 - RNA, 16 nt, Homo sapiens
cuaacaagauuuguaa

SEQ ID NO: 1273273 - RNA, 17 nt, Homo sapiens
cuaacaggcacuuugag

SEQ ID NO: 1273274 - RNA, 15 nt, Homo sapiens
cuaacaggccaaaga

SEQ ID NO: 1273275 - RNA, 17 nt, Homo sapiens
cuaacaggucuagaaaa

SEQ ID NO: 1273276 - RNA, 11 nt, Homo sapiens
cuaacauuucc

SEQ ID NO: 1273277 - RNA, 18 nt, Homo sapiens
cuaacccucacaagcaug

SEQ ID NO: 1273278 - RNA, 21 nt, Homo sapiens
cuaaccgacauuccugaaaua

SEQ ID NO: 1273279 - RNA, 17 nt, Homo sapiens
cuaacgacuucagggca

SEQ ID NO: 1273280 - RNA, 15 nt, Homo sapiens
cuaacgugaugagac

SEQ ID NO: 1273281 - RNA, 15 nt, Homo sapiens
cuaacuagcauugua

SEQ ID NO: 1273282 - RNA, 19 nt, Homo sapiens
cuaacuauauuugcuuuuu

SEQ ID NO: 1273283 - RNA, 16 nt, Homo sapiens
cuaacuccugccauuc

SEQ ID NO: 1273284 - RNA, 15 nt, Homo sapiens
cuaacugcagaccau

SEQ ID NO: 1273285 - RNA, 20 nt, Homo sapiens
cuaacuggcaggggagacag

SEQ ID NO: 1273286 - RNA, 20 nt, Homo sapiens
cuaacuuauuuuauuuccau

SEQ ID NO: 1273287 - RNA, 17 nt, Homo sapiens
cuaagaagagauuucuc

SEQ ID NO: 1273288 - RNA, 17 nt, Homo sapiens
cuaagagacacauacag

SEQ ID NO: 1273289 - RNA, 15 nt, Homo sapiens
cuaagauaaauucau

SEQ ID NO: 1273290 - RNA, 19 nt, Homo sapiens
cuaagauaaauucaugcac

SEQ ID NO: 1273291 - RNA, 17 nt, Homo sapiens
cuaagauaauuuacuua

SEQ ID NO: 1273292 - RNA, 14 nt, Homo sapiens
cuaagauggcuuuu

SEQ ID NO: 1273293 - RNA, 18 nt, Homo sapiens
cuaagaugugauauucua

SEQ ID NO: 1273294 - RNA, 22 nt, Homo sapiens
cuaagauuacaggcgugagcca

SEQ ID NO: 1273295 - RNA, 16 nt, Homo sapiens
cuaagauucuaaaggu

SEQ ID NO: 1273296 - RNA, 22 nt, Homo sapiens
cuaagcgaauguguacaaagug

SEQ ID NO: 1273297 - RNA, 23 nt, Homo sapiens
cuaagcgaauguguacaaagugu

SEQ ID NO: 1273298 - RNA, 16 nt, Homo sapiens
cuaagcuauucaguaa

SEQ ID NO: 1273299 - RNA, 14 nt, Homo sapiens
cugaacaaacuaaa

SEQ ID NO: 1273300 - RNA, 19 nt, Homo sapiens
cugaacaaucaaagcacuu

SEQ ID NO: 1273301 - RNA, 20 nt, Homo sapiens
cugaacaaucaaagcacuug

SEQ ID NO: 1273302 - RNA, 11 nt, Homo sapiens
cugaaccacaa

SEQ ID NO: 1273303 - RNA, 18 nt, Homo sapiens
cugaaccaucccugaugu

SEQ ID NO: 1273304 - RNA, 14 nt, Homo sapiens
cugaaccauuccaa

SEQ ID NO: 1273305 - RNA, 13 nt, Homo sapiens
cugaaccccaugg

SEQ ID NO: 1273306 - RNA, 17 nt, Homo sapiens
cugaacuuuguggucga

SEQ ID NO: 1273307 - RNA, 22 nt, Homo sapiens
cugaacuuuguggucgacauca

SEQ ID NO: 1273308 - RNA, 21 nt, Homo sapiens
cugaagaaaccuucagauuug

SEQ ID NO: 1273309 - RNA, 22 nt, Homo sapiens
cugaagagcuauuauauaaaaa

SEQ ID NO: 1273310 - RNA, 11 nt, Homo sapiens
cugaagcccau

SEQ ID NO: 1273311 - RNA, 20 nt, Homo sapiens
cugaaggcagucauaucaaa

SEQ ID NO: 1273312 - RNA, 19 nt, Homo sapiens
cugaaggcugaaagacagg

SEQ ID NO: 1273313 - RNA, 21 nt, Homo sapiens
cugaaguacuuaaacuuccac

SEQ ID NO: 1273314 - RNA, 21 nt, Homo sapiens
cugaagucaccucuugguuac

SEQ ID NO: 1273315 - RNA, 13 nt, Homo sapiens
cugaagugcuuag

SEQ ID NO: 1273316 - RNA, 14 nt, Homo sapiens
cugaaguggcuaaa

SEQ ID NO: 1273317 - RNA, 17 nt, Homo sapiens
cugaagugguugcauuc

SEQ ID NO: 1273318 - RNA, 18 nt, Homo sapiens
cugaagugucacagccug

SEQ ID NO: 1273319 - RNA, 20 nt, Homo sapiens
cugaaguuucacaugagcua

SEQ ID NO: 1273320 - RNA, 20 nt, Homo sapiens
cugaaguuugugggggccaa

SEQ ID NO: 1273321 - RNA, 20 nt, Homo sapiens
cugaaguuuuugaaauaccu

SEQ ID NO: 1273322 - RNA, 19 nt, Homo sapiens
cugaauaccacuuaccuca

SEQ ID NO: 1273323 - RNA, 23 nt, Homo sapiens
cugaauccaaacuaauccaucac

SEQ ID NO: 1273324 - RNA, 18 nt, Homo sapiens
cugaauccucaugaggcu

SEQ ID NO: 1273325 - RNA, 12 nt, Homo sapiens
cugaaucucaua

SEQ ID NO: 1273326 - RNA, 23 nt, Homo sapiens
cugaaucuuccuuuguugcacaa

SEQ ID NO: 1273327 - RNA, 16 nt, Homo sapiens
cugaaugaaaauaacu

SEQ ID NO: 1273328 - RNA, 21 nt, Homo sapiens
cugaaugguuccaugccugag

SEQ ID NO: 1273329 - RNA, 15 nt, Homo sapiens
cugaaugguuuucaa

SEQ ID NO: 1273330 - RNA, 21 nt, Homo sapiens
cugaauguuuaaagaucauga

SEQ ID NO: 1273331 - RNA, 15 nt, Homo sapiens
cugaauuaaauaugg

SEQ ID NO: 1273332 - RNA, 17 nt, Homo sapiens
cugaauuaugauggucu

SEQ ID NO: 1273333 - RNA, 22 nt, Homo sapiens
cugaauugcccguuuccauaca

SEQ ID NO: 1273334 - RNA, 22 nt, Homo sapiens
cugaauuuuuaaaacccauuua

SEQ ID NO: 1273335 - RNA, 16 nt, Homo sapiens
cugacaaauauuuuag

SEQ ID NO: 1273336 - RNA, 14 nt, Homo sapiens
cugacaaugggcac

SEQ ID NO: 1273337 - RNA, 11 nt, Homo sapiens
cugacacaaga

SEQ ID NO: 1273338 - RNA, 19 nt, Homo sapiens
cugacacaccaggcgcuaa

SEQ ID NO: 1273339 - RNA, 17 nt, Homo sapiens
cugacacaggaaaccaa

SEQ ID NO: 1273340 - RNA, 22 nt, Homo sapiens
cugacaccagagcccacuucca

SEQ ID NO: 1273341 - RNA, 19 nt, Homo sapiens
cugacagaaggaacacugc

SEQ ID NO: 1273342 - RNA, 11 nt, Homo sapiens
cugacagcuuc

SEQ ID NO: 1273343 - RNA, 16 nt, Homo sapiens
cugacagcuucaugaa

SEQ ID NO: 1273344 - RNA, 15 nt, Homo sapiens
cugacaguaaaucuc

SEQ ID NO: 1273345 - RNA, 19 nt, Homo sapiens
cugacauaauggggauuaa

SEQ ID NO: 1273346 - RNA, 21 nt, Homo sapiens
cugacauuucuucuagugaug

SEQ ID NO: 1273347 - RNA, 16 nt, Homo sapiens
cugaccccagugguau

SEQ ID NO: 1273348 - RNA, 13 nt, Homo sapiens
cugacccuagcuc

SEQ ID NO: 1273349 - RNA, 15 nt, Homo sapiens
cugaccucacuguga

SEQ ID NO: 1273350 - RNA, 16 nt, Homo sapiens
cugaccucccagugac

SEQ ID NO: 1273351 - RNA, 17 nt, Homo sapiens
cugaccucgugauccac

SEQ ID NO: 1273352 - RNA, 23 nt, Homo sapiens
cugaccucgugauccaccugccu

SEQ ID NO: 1273353 - RNA, 18 nt, Homo sapiens
cugaccuggagaugcugc

SEQ ID NO: 1273354 - RNA, 22 nt, Homo sapiens
cugacuaauuuuguaguuuuag

SEQ ID NO: 1273355 - RNA, 20 nt, Homo sapiens
cugacuagaagggccagucc

SEQ ID NO: 1273356 - RNA, 17 nt, Homo sapiens
cugacucuucaagugcc

SEQ ID NO: 1273357 - RNA, 13 nt, Homo sapiens
cugacucuugcag

SEQ ID NO: 1273358 - RNA, 21 nt, Homo sapiens
cugacugaaggaaaagcaaga

SEQ ID NO: 1273359 - RNA, 21 nt, Homo sapiens
cugacugagacacgaugccga

SEQ ID NO: 1273360 - RNA, 17 nt, Homo sapiens
cugacugccaagccaga

SEQ ID NO: 1273361 - RNA, 15 nt, Homo sapiens
cugacuggcaaagga

SEQ ID NO: 1273362 - RNA, 15 nt, Homo sapiens
cugacuuucucucca

SEQ ID NO: 1273363 - RNA, 17 nt, Homo sapiens
cugacuuucugauuacu

SEQ ID NO: 1273364 - RNA, 15 nt, Homo sapiens
cugacuuuuaaccca

SEQ ID NO: 1273365 - RNA, 18 nt, Homo sapiens
cugacuuuugcagaugga

SEQ ID NO: 1273366 - RNA, 23 nt, Homo sapiens
cugagaaaggugaggagggcagu

SEQ ID NO: 1273367 - RNA, 16 nt, Homo sapiens
cugagaacuccugacu

SEQ ID NO: 1273368 - RNA, 20 nt, Homo sapiens
cugagaacuccugacuguaa

SEQ ID NO: 1273369 - RNA, 21 nt, Homo sapiens
cugagaagaggagcccucauc

SEQ ID NO: 1273370 - RNA, 15 nt, Homo sapiens
cugagaauguggaau

SEQ ID NO: 1273371 - RNA, 16 nt, Homo sapiens
cugagaauguggaaua

SEQ ID NO: 1273372 - RNA, 12 nt, Homo sapiens
cugagacacaaa

SEQ ID NO: 1273373 - RNA, 18 nt, Homo sapiens
cugagacagacacacagc

SEQ ID NO: 1273374 - RNA, 21 nt, Homo sapiens
cugagacaggaggauugccug

SEQ ID NO: 1273375 - RNA, 14 nt, Homo sapiens
cugagacagggauu

SEQ ID NO: 1273376 - RNA, 18 nt, Homo sapiens
cugagaccaguguaucag

SEQ ID NO: 1273377 - RNA, 16 nt, Homo sapiens
cugagacugaagacca

SEQ ID NO: 1273378 - RNA, 20 nt, Homo sapiens
cugagacugaagaccaguau

SEQ ID NO: 1273379 - RNA, 17 nt, Homo sapiens
cugagacuuggcuccac

SEQ ID NO: 1273380 - RNA, 15 nt, Homo sapiens
cugagagacagaauu

SEQ ID NO: 1273381 - RNA, 22 nt, Homo sapiens
cugagaggcaggcauagaggcu

SEQ ID NO: 1273382 - RNA, 13 nt, Homo sapiens
cugagauccugca

SEQ ID NO: 1273383 - RNA, 21 nt, Homo sapiens
cugagauccugcacaaggugg

SEQ ID NO: 1273384 - RNA, 22 nt, Homo sapiens
cugagauuacagacaugagccu

SEQ ID NO: 1273385 - RNA, 18 nt, Homo sapiens
cugagauuuccuccuggc

SEQ ID NO: 1273386 - RNA, 19 nt, Homo sapiens
cugagauuuuuuuguguau

SEQ ID NO: 1273387 - RNA, 21 nt, Homo sapiens
cugagccaaagagaaugccau

SEQ ID NO: 1273388 - RNA, 19 nt, Homo sapiens
cugagccccagggugccca

SEQ ID NO: 1273389 - RNA, 18 nt, Homo sapiens
cugagcccccacauucuc

SEQ ID NO: 1273390 - RNA, 23 nt, Homo sapiens
cugagccccgccucacacccacc

SEQ ID NO: 1273391 - RNA, 13 nt, Homo sapiens
cugagcccuggca

SEQ ID NO: 1273392 - RNA, 23 nt, Homo sapiens
cugagcugcagcucuccaccagc

SEQ ID NO: 1273393 - RNA, 18 nt, Homo sapiens
cugagcuggaucacuuga

SEQ ID NO: 1273394 - RNA, 20 nt, Homo sapiens
cugagcuuuguccugaagga

SEQ ID NO: 1273395 - RNA, 14 nt, Homo sapiens
cugaggacaaagug

SEQ ID NO: 1273396 - RNA, 16 nt, Homo sapiens
cugaggacaccaguga

SEQ ID NO: 1273397 - RNA, 13 nt, Homo sapiens
cugaggaccagcc

SEQ ID NO: 1273398 - RNA, 20 nt, Homo sapiens
cugaggacccgugugacucg

SEQ ID NO: 1273399 - RNA, 23 nt, Homo sapiens
cugaggacccgugugacucgcca

SEQ ID NO: 1273400 - RNA, 18 nt, Homo sapiens
cugaggagauacugaaca

SEQ ID NO: 1273401 - RNA, 15 nt, Homo sapiens
cugaggaugcaucuu

SEQ ID NO: 1273402 - RNA, 16 nt, Homo sapiens
cugaggauucaggggc

SEQ ID NO: 1273403 - RNA, 22 nt, Homo sapiens
cugaggcaagagaauuacuuga

SEQ ID NO: 1273404 - RNA, 20 nt, Homo sapiens
cugaggcaggagaauggugu

SEQ ID NO: 1273405 - RNA, 22 nt, Homo sapiens
cugaggcaggagaauugcuuga

SEQ ID NO: 1273406 - RNA, 19 nt, Homo sapiens
cugaggccuggacuuuccu

SEQ ID NO: 1273407 - RNA, 22 nt, Homo sapiens
cugagggauuuucacagugugc

SEQ ID NO: 1273408 - RNA, 15 nt, Homo sapiens
cugagggcaguucug

SEQ ID NO: 1273409 - RNA, 17 nt, Homo sapiens
cugaggguggcacucaa

SEQ ID NO: 1273410 - RNA, 17 nt, Homo sapiens
cugaggguguuucuucc

SEQ ID NO: 1273411 - RNA, 21 nt, Homo sapiens
cugagguauaaagacaaguau

SEQ ID NO: 1273412 - RNA, 13 nt, Homo sapiens
cugaggucccugu

SEQ ID NO: 1273413 - RNA, 19 nt, Homo sapiens
cugaguagugacacacaga

SEQ ID NO: 1273414 - RNA, 17 nt, Homo sapiens
cugagucacaauaaaga

SEQ ID NO: 1273415 - RNA, 19 nt, Homo sapiens
cugagucucugaaugaagc

SEQ ID NO: 1273416 - RNA, 23 nt, Homo sapiens
cugagugaauuacagacaaccua

SEQ ID NO: 1273417 - RNA, 13 nt, Homo sapiens
cugagugccugau

SEQ ID NO: 1273418 - RNA, 18 nt, Homo sapiens
cugaguggcaggggacag

SEQ ID NO: 1273419 - RNA, 14 nt, Homo sapiens
cugaguggugccaa

SEQ ID NO: 1273420 - RNA, 16 nt, Homo sapiens
cugaguggugccaaac

SEQ ID NO: 1273421 - RNA, 19 nt, Homo sapiens
cugaguguuauuugcacac

SEQ ID NO: 1273422 - RNA, 18 nt, Homo sapiens
cugaguucuggucaaaga

SEQ ID NO: 1273423 - RNA, 18 nt, Homo sapiens
cugaguugccaagacaaa

SEQ ID NO: 1273424 - RNA, 21 nt, Homo sapiens
cugaguuugcuguuugcaauu

SEQ ID NO: 1273425 - RNA, 12 nt, Homo sapiens
cuggagauccuc

SEQ ID NO: 1273426 - RNA, 16 nt, Homo sapiens
cuggagcaauguugcu

SEQ ID NO: 1273427 - RNA, 18 nt, Homo sapiens
cuggagcccacaaccuuc

SEQ ID NO: 1273428 - RNA, 19 nt, Homo sapiens
cuggagccuccacugccuc

SEQ ID NO: 1273429 - RNA, 17 nt, Homo sapiens
cuggaggacggucaguc

SEQ ID NO: 1273430 - RNA, 20 nt, Homo sapiens
cuggaggagcaagggggcca

SEQ ID NO: 1273431 - RNA, 16 nt, Homo sapiens
cuggaggagcucugca

SEQ ID NO: 1273432 - RNA, 18 nt, Homo sapiens
cuggaggccggaaucuca

SEQ ID NO: 1273433 - RNA, 16 nt, Homo sapiens
cuggagggguguugua

SEQ ID NO: 1273434 - RNA, 21 nt, Homo sapiens
cuggagguggaaaauggugcc

SEQ ID NO: 1273435 - RNA, 15 nt, Homo sapiens
cuggaguacaccaac

SEQ ID NO: 1273436 - RNA, 12 nt, Homo sapiens
cuggagugcagu

SEQ ID NO: 1273437 - RNA, 20 nt, Homo sapiens
cuggagugcaguggcgcaau

SEQ ID NO: 1273438 - RNA, 21 nt, Homo sapiens
cuggagugcaguggugugauc

SEQ ID NO: 1273439 - RNA, 20 nt, Homo sapiens
cuggaguggaguggcgugau

SEQ ID NO: 1273440 - RNA, 21 nt, Homo sapiens
cuggauaacuuagguggcaag

SEQ ID NO: 1273441 - RNA, 13 nt, Homo sapiens
cuggauauuucau

SEQ ID NO: 1273442 - RNA, 23 nt, Homo sapiens
cuggauauuucauauaaauggaa

SEQ ID NO: 1273443 - RNA, 14 nt, Homo sapiens
cuggaucagggaau

SEQ ID NO: 1273444 - RNA, 18 nt, Homo sapiens
cuggauccggucugccug

SEQ ID NO: 1273445 - RNA, 12 nt, Homo sapiens
cuggaugacauu

SEQ ID NO: 1273446 - RNA, 19 nt, Homo sapiens
cuggaugagacuuccaaac

SEQ ID NO: 1273447 - RNA, 16 nt, Homo sapiens
cuggauggucaucucg

SEQ ID NO: 1273448 - RNA, 20 nt, Homo sapiens
cuggaugucaaacaguaaua

SEQ ID NO: 1273449 - RNA, 21 nt, Homo sapiens
cuggaugucugggugaccuca

SEQ ID NO: 1273450 - RNA, 15 nt, Homo sapiens
cuggauucacucacu

SEQ ID NO: 1273451 - RNA, 20 nt, Homo sapiens
cuggauuuauaguaugugac

SEQ ID NO: 1273452 - RNA, 19 nt, Homo sapiens
cuggauuucugguucugau

SEQ ID NO: 1273453 - RNA, 19 nt, Homo sapiens
cuggauuugcaggugaaca

SEQ ID NO: 1273454 - RNA, 14 nt, Homo sapiens
cuggcaacacagag

SEQ ID NO: 1273455 - RNA, 23 nt, Homo sapiens
cuggcaacaugaagaaugcauuc

SEQ ID NO: 1273456 - RNA, 19 nt, Homo sapiens
cuggcaagucuuccaugac

SEQ ID NO: 1273457 - RNA, 20 nt, Homo sapiens
cuggcaagucuuccaugacc

SEQ ID NO: 1273458 - RNA, 15 nt, Homo sapiens
cuggcaauaaacucc

SEQ ID NO: 1273459 - RNA, 20 nt, Homo sapiens
cuggcaauaaacuccuacua

SEQ ID NO: 1273460 - RNA, 14 nt, Homo sapiens
cuggcacagaggua

SEQ ID NO: 1273461 - RNA, 22 nt, Homo sapiens
cuggcacaguguaauccagggg

SEQ ID NO: 1273462 - RNA, 17 nt, Homo sapiens
cuggcacauuucaggga

SEQ ID NO: 1273463 - RNA, 16 nt, Homo sapiens
cuggcaccagaacuga

SEQ ID NO: 1273464 - RNA, 19 nt, Homo sapiens
cuggcacugaauuaaucau

SEQ ID NO: 1273465 - RNA, 12 nt, Homo sapiens
cuggcacugacu

SEQ ID NO: 1273466 - RNA, 18 nt, Homo sapiens
cuggcacuuagcccaaga

SEQ ID NO: 1273467 - RNA, 20 nt, Homo sapiens
cuggcagaucaugaagccca

SEQ ID NO: 1273468 - RNA, 20 nt, Homo sapiens
cuggcagcaucuucacuucu

SEQ ID NO: 1273469 - RNA, 17 nt, Homo sapiens
cuggcagggauggguuu

SEQ ID NO: 1273470 - RNA, 17 nt, Homo sapiens
cuggcagggcccaguga

SEQ ID NO: 1273471 - RNA, 14 nt, Homo sapiens
cuggcaguacuguu

SEQ ID NO: 1273472 - RNA, 16 nt, Homo sapiens
cuggcaucucacuuua

SEQ ID NO: 1273473 - RNA, 14 nt, Homo sapiens
cuggccaggccucc

SEQ ID NO: 1273474 - RNA, 23 nt, Homo sapiens
cuggccaguugcccagagcacuu

SEQ ID NO: 1273475 - RNA, 23 nt, Homo sapiens
cuggccaguuggaaccacggaga

SEQ ID NO: 1273476 - RNA, 13 nt, Homo sapiens
cuggcccaaagca

SEQ ID NO: 1273477 - RNA, 21 nt, Homo sapiens
cuggccccuaggcugcugcug

SEQ ID NO: 1273478 - RNA, 13 nt, Homo sapiens
cuggcccuugcaa

SEQ ID NO: 1273479 - RNA, 20 nt, Homo sapiens
cuggccuaaaaucuuggaag

SEQ ID NO: 1273480 - RNA, 22 nt, Homo sapiens
cuggccuaaugagauaauacuc

SEQ ID NO: 1273481 - RNA, 18 nt, Homo sapiens
cuggccuauguggucuaa

SEQ ID NO: 1273482 - RNA, 20 nt, Homo sapiens
cuggccucucuagcacaauu

SEQ ID NO: 1273483 - RNA, 23 nt, Homo sapiens
cuggccuugagaaaggcauuggc

SEQ ID NO: 1273484 - RNA, 20 nt, Homo sapiens
cagggucucacuauguugcc

SEQ ID NO: 1273485 - RNA, 21 nt, Homo sapiens
cagggucucacuauguugccc

SEQ ID NO: 1273486 - RNA, 16 nt, Homo sapiens
cagggucucucccuca

SEQ ID NO: 1273487 - RNA, 12 nt, Homo sapiens
cagggucugcuc

SEQ ID NO: 1273488 - RNA, 20 nt, Homo sapiens
cagggucugcucuuucucug

SEQ ID NO: 1273489 - RNA, 16 nt, Homo sapiens
cagggucugugugaau

SEQ ID NO: 1273490 - RNA, 23 nt, Homo sapiens
caggguuuacccagugggacaga

SEQ ID NO: 1273491 - RNA, 21 nt, Homo sapiens
caggguuucaccauguugccc

SEQ ID NO: 1273492 - RNA, 17 nt, Homo sapiens
caggguuugauagcacu

SEQ ID NO: 1273493 - RNA, 20 nt, Homo sapiens
caggguuuugccauguuggc

SEQ ID NO: 1273494 - RNA, 21 nt, Homo sapiens
caggguuuugccauguuggcc

SEQ ID NO: 1273495 - RNA, 15 nt, Homo sapiens
cagguaaaacagggc

SEQ ID NO: 1273496 - RNA, 19 nt, Homo sapiens
cagguaccucuuucagggu

SEQ ID NO: 1273497 - RNA, 19 nt, Homo sapiens
cagguacuuccucagucug

SEQ ID NO: 1273498 - RNA, 21 nt, Homo sapiens
cagguaggucggcacuuggac

SEQ ID NO: 1273499 - RNA, 21 nt, Homo sapiens
caggucaacuucagagacuau

SEQ ID NO: 1273500 - RNA, 19 nt, Homo sapiens
caggucacccuuugcugug

SEQ ID NO: 1273501 - RNA, 22 nt, Homo sapiens
caggucacuugaucaugcugca

SEQ ID NO: 1273502 - RNA, 13 nt, Homo sapiens
caggucacuuuac

SEQ ID NO: 1273503 - RNA, 18 nt, Homo sapiens
caggucaggaugcacauu

SEQ ID NO: 1273504 - RNA, 16 nt, Homo sapiens
cagguccaauuuguaa

SEQ ID NO: 1273505 - RNA, 22 nt, Homo sapiens
cagguccucuacuuaaugagau

SEQ ID NO: 1273506 - RNA, 14 nt, Homo sapiens
cagguccuuccuuu

SEQ ID NO: 1273507 - RNA, 14 nt, Homo sapiens
caggugaaaaucca

SEQ ID NO: 1273508 - RNA, 19 nt, Homo sapiens
caggugaccccuaggagca

SEQ ID NO: 1273509 - RNA, 21 nt, Homo sapiens
caggugauccacccaccucag

SEQ ID NO: 1273510 - RNA, 19 nt, Homo sapiens
caggugaucuaccugccuc

SEQ ID NO: 1273511 - RNA, 20 nt, Homo sapiens
caggugauucgcccaccuca

SEQ ID NO: 1273512 - RNA, 21 nt, Homo sapiens
caggugauucgcccaccucag

SEQ ID NO: 1273513 - RNA, 14 nt, Homo sapiens
caggugcauagcaa

SEQ ID NO: 1273514 - RNA, 17 nt, Homo sapiens
caggugccuucccagac

SEQ ID NO: 1273515 - RNA, 14 nt, Homo sapiens
caggugcugccauc

SEQ ID NO: 1273516 - RNA, 15 nt, Homo sapiens
caggugcugccaucc

SEQ ID NO: 1273517 - RNA, 16 nt, Homo sapiens
caggugcuuguggaca

SEQ ID NO: 1273518 - RNA, 19 nt, Homo sapiens
caggugggcucgcuaggcg

SEQ ID NO: 1273519 - RNA, 19 nt, Homo sapiens
caggugguaagcaccagga

SEQ ID NO: 1273520 - RNA, 17 nt, Homo sapiens
caggugguggcacugag

SEQ ID NO: 1273521 - RNA, 19 nt, Homo sapiens
caggugugaaccaccacac

SEQ ID NO: 1273522 - RNA, 20 nt, Homo sapiens
caggugugggccacugcacc

SEQ ID NO: 1273523 - RNA, 21 nt, Homo sapiens
cagguguuaacauuccaagac

SEQ ID NO: 1273524 - RNA, 14 nt, Homo sapiens
cagguucacacuca

SEQ ID NO: 1273525 - RNA, 22 nt, Homo sapiens
cagguucaugccaccauggcca

SEQ ID NO: 1273526 - RNA, 15 nt, Homo sapiens
cagguucccccagca

SEQ ID NO: 1273527 - RNA, 20 nt, Homo sapiens
cagguuccuuaucugucaca

SEQ ID NO: 1273528 - RNA, 21 nt, Homo sapiens
cagguuccuuaucugucacac

SEQ ID NO: 1273529 - RNA, 21 nt, Homo sapiens
cagguucuucagggccagucc

SEQ ID NO: 1273530 - RNA, 20 nt, Homo sapiens
cagguuuucuucacugccag

SEQ ID NO: 1273531 - RNA, 15 nt, Homo sapiens
cagguuuuuggucug

SEQ ID NO: 1273532 - RNA, 13 nt, Homo sapiens
caguaaacgggaa

SEQ ID NO: 1273533 - RNA, 14 nt, Homo sapiens
caguaaauguacaa

SEQ ID NO: 1273534 - RNA, 23 nt, Homo sapiens
caguaaauguacaacugcaccug

SEQ ID NO: 1273535 - RNA, 17 nt, Homo sapiens
caguaaccuagugaauu

SEQ ID NO: 1273536 - RNA, 19 nt, Homo sapiens
caguaagaacaucauaaaa

SEQ ID NO: 1273537 - RNA, 21 nt, Homo sapiens
caguaauaaaacaucuuucca

SEQ ID NO: 1273538 - RNA, 12 nt, Homo sapiens
caguaaucuuua

SEQ ID NO: 1273539 - RNA, 17 nt, Homo sapiens
caguaaucuuuauacug

SEQ ID NO: 1273540 - RNA, 22 nt, Homo sapiens
caguaauuccuguuacuuuaca

SEQ ID NO: 1273541 - RNA, 21 nt, Homo sapiens
caguacacccaguugccaaag

SEQ ID NO: 1273542 - RNA, 20 nt, Homo sapiens
caguacagcaugugccuuaa

SEQ ID NO: 1273543 - RNA, 19 nt, Homo sapiens
caguacaggggugcugcag

SEQ ID NO: 1273544 - RNA, 13 nt, Homo sapiens
caguacaugggaa

SEQ ID NO: 1273545 - RNA, 19 nt, Homo sapiens
caguacaugggaaaggagg

SEQ ID NO: 1273546 - RNA, 20 nt, Homo sapiens
caguaccccugguaaaccaa

SEQ ID NO: 1273547 - RNA, 16 nt, Homo sapiens
caguacccucucagcu

SEQ ID NO: 1273548 - RNA, 18 nt, Homo sapiens
caguacccucucagcucc

SEQ ID NO: 1273549 - RNA, 16 nt, Homo sapiens
caguaccuagcuggcu

SEQ ID NO: 1273550 - RNA, 19 nt, Homo sapiens
caguacuaaucaugugagg

SEQ ID NO: 1273551 - RNA, 23 nt, Homo sapiens
caguacuauggagugcucacaaa

SEQ ID NO: 1273552 - RNA, 16 nt, Homo sapiens
caguacuugugaaaca

SEQ ID NO: 1273553 - RNA, 19 nt, Homo sapiens
caguagaaauaauaugcau

SEQ ID NO: 1273554 - RNA, 14 nt, Homo sapiens
caguagaacuccag

SEQ ID NO: 1273555 - RNA, 14 nt, Homo sapiens
caguagagaucuau

SEQ ID NO: 1273556 - RNA, 15 nt, Homo sapiens
caguagagccagcuu

SEQ ID NO: 1273557 - RNA, 14 nt, Homo sapiens
caguagauuuucca

SEQ ID NO: 1273558 - RNA, 13 nt, Homo sapiens
caguauaccucau

SEQ ID NO: 1273559 - RNA, 17 nt, Homo sapiens
caguauauuuauaguca

SEQ ID NO: 1273560 - RNA, 20 nt, Homo sapiens
caguauccaggcuuuguaca

SEQ ID NO: 1273561 - RNA, 14 nt, Homo sapiens
caguaugacaguau

SEQ ID NO: 1273562 - RNA, 14 nt, Homo sapiens
caguaugacauuuc

SEQ ID NO: 1273563 - RNA, 17 nt, Homo sapiens
caguaugagucaaugug

SEQ ID NO: 1273564 - RNA, 22 nt, Homo sapiens
caguauggaauuccagugccag

SEQ ID NO: 1273565 - RNA, 22 nt, Homo sapiens
caguauggcaaaauuagucuug

SEQ ID NO: 1273566 - RNA, 17 nt, Homo sapiens
caguaugggaucugaua

SEQ ID NO: 1273567 - RNA, 21 nt, Homo sapiens
caguauguuuguuucauugug

SEQ ID NO: 1273568 - RNA, 12 nt, Homo sapiens
caguauuaugca

SEQ ID NO: 1273569 - RNA, 13 nt, Homo sapiens
caguauucucaga

SEQ ID NO: 1273570 - RNA, 23 nt, Homo sapiens
caguauuucuggagggcaauuug

SEQ ID NO: 1273571 - RNA, 21 nt, Homo sapiens
caguauuuuuuccacuacaca

SEQ ID NO: 1273572 - RNA, 21 nt, Homo sapiens
cagucacaugaccugaucacu

SEQ ID NO: 1273573 - RNA, 19 nt, Homo sapiens
cagucaccgacaacaugcu

SEQ ID NO: 1273574 - RNA, 16 nt, Homo sapiens
cagucacugacaguua

SEQ ID NO: 1273575 - RNA, 15 nt, Homo sapiens
cagucacugacucaa

SEQ ID NO: 1273576 - RNA, 19 nt, Homo sapiens
cagucacuuccacuggugg

SEQ ID NO: 1273577 - RNA, 11 nt, Homo sapiens
cagucagggac

SEQ ID NO: 1273578 - RNA, 22 nt, Homo sapiens
cagucaguuugcacaacaagau

SEQ ID NO: 1273579 - RNA, 19 nt, Homo sapiens
caguccaugcuucuagccu

SEQ ID NO: 1273580 - RNA, 21 nt, Homo sapiens
caguccccaaccugcacucua

SEQ ID NO: 1273581 - RNA, 20 nt, Homo sapiens
cagucccuauguauuugcag

SEQ ID NO: 1273582 - RNA, 14 nt, Homo sapiens
caguccuccagacc

SEQ ID NO: 1273583 - RNA, 14 nt, Homo sapiens
caguccugcuccag

SEQ ID NO: 1273584 - RNA, 16 nt, Homo sapiens
caguccuuaucugcuc

SEQ ID NO: 1273585 - RNA, 19 nt, Homo sapiens
cagucgaugcguucacucc

SEQ ID NO: 1273586 - RNA, 21 nt, Homo sapiens
cagucgaugcguucacuccaa

SEQ ID NO: 1273587 - RNA, 16 nt, Homo sapiens
cagucguaaccguggc

SEQ ID NO: 1273588 - RNA, 23 nt, Homo sapiens
cagucuccucacucugucccugu

SEQ ID NO: 1273589 - RNA, 22 nt, Homo sapiens
cagucucuucgaggcuuuacag

SEQ ID NO: 1273590 - RNA, 15 nt, Homo sapiens
cagucugucuacugu

SEQ ID NO: 1273591 - RNA, 16 nt, Homo sapiens
cagucuguguuuacag

SEQ ID NO: 1273592 - RNA, 14 nt, Homo sapiens
cagugaaagccaga

SEQ ID NO: 1273593 - RNA, 11 nt, Homo sapiens
cagugaaggcu

SEQ ID NO: 1273594 - RNA, 16 nt, Homo sapiens
cagugacaaagacucc

SEQ ID NO: 1273595 - RNA, 17 nt, Homo sapiens
cagugacagucagggaa

SEQ ID NO: 1273596 - RNA, 23 nt, Homo sapiens
cagugaccccugaccucacugug

SEQ ID NO: 1273597 - RNA, 14 nt, Homo sapiens
cagugacuccugcu

SEQ ID NO: 1273598 - RNA, 12 nt, Homo sapiens
cagugacuggca

SEQ ID NO: 1273599 - RNA, 20 nt, Homo sapiens
cagugagcugauaucaugcc

SEQ ID NO: 1273600 - RNA, 19 nt, Homo sapiens
cagugcaaauuguaucuua

SEQ ID NO: 1273601 - RNA, 17 nt, Homo sapiens
cagugcaacagcacugg

SEQ ID NO: 1273602 - RNA, 15 nt, Homo sapiens
cagugccagcaccug

SEQ ID NO: 1273603 - RNA, 17 nt, Homo sapiens
cagugccagcaccugcc

SEQ ID NO: 1273604 - RNA, 23 nt, Homo sapiens
cagugccaggccagugaccucau

SEQ ID NO: 1273605 - RNA, 14 nt, Homo sapiens
cagugccuugcucg

SEQ ID NO: 1273606 - RNA, 13 nt, Homo sapiens
acacacacaccaa

SEQ ID NO: 1273607 - RNA, 14 nt, Homo sapiens
acacacacaucuca

SEQ ID NO: 1273608 - RNA, 11 nt, Homo sapiens
acacacacugg

SEQ ID NO: 1273609 - RNA, 20 nt, Homo sapiens
acacacagacuuucugugac

SEQ ID NO: 1273610 - RNA, 12 nt, Homo sapiens
acacacagcucu

SEQ ID NO: 1273611 - RNA, 17 nt, Homo sapiens
acacacauuaugagcuu

SEQ ID NO: 1273612 - RNA, 20 nt, Homo sapiens
acacacgcacacaaaccaca

SEQ ID NO: 1273613 - RNA, 20 nt, Homo sapiens
acacacucugagucucugaa

SEQ ID NO: 1273614 - RNA, 21 nt, Homo sapiens
acacacuuuggucauuucuca

SEQ ID NO: 1273615 - RNA, 23 nt, Homo sapiens
acacagaauuguuccaguacuau

SEQ ID NO: 1273616 - RNA, 13 nt, Homo sapiens
acacagaccacca

SEQ ID NO: 1273617 - RNA, 16 nt, Homo sapiens
acacagcaacaaugac

SEQ ID NO: 1273618 - RNA, 18 nt, Homo sapiens
acacagcaagacuccguc

SEQ ID NO: 1273619 - RNA, 17 nt, Homo sapiens
acacagcaugugccaag

SEQ ID NO: 1273620 - RNA, 16 nt, Homo sapiens
acacagcuacagcuuu

SEQ ID NO: 1273621 - RNA, 20 nt, Homo sapiens
acacagcucuucuccaggcu

SEQ ID NO: 1273622 - RNA, 14 nt, Homo sapiens
acacaggcaaaauc

SEQ ID NO: 1273623 - RNA, 14 nt, Homo sapiens
acacaggcacgggu

SEQ ID NO: 1273624 - RNA, 13 nt, Homo sapiens
acacaggcuucau

SEQ ID NO: 1273625 - RNA, 18 nt, Homo sapiens
acacaguccccagacuca

SEQ ID NO: 1273626 - RNA, 11 nt, Homo sapiens
acacagugaaa

SEQ ID NO: 1273627 - RNA, 23 nt, Homo sapiens
acacaguguuggagguuaaggca

SEQ ID NO: 1273628 - RNA, 22 nt, Homo sapiens
acacaguuggauuuauucugcc

SEQ ID NO: 1273629 - RNA, 19 nt, Homo sapiens
acacaguugggacccaaaa

SEQ ID NO: 1273630 - RNA, 19 nt, Homo sapiens
acacaguuguaggguuaca

SEQ ID NO: 1273631 - RNA, 18 nt, Homo sapiens
acacauaaggacgugugu

SEQ ID NO: 1273632 - RNA, 15 nt, Homo sapiens
acacauagauaccuu

SEQ ID NO: 1273633 - RNA, 22 nt, Homo sapiens
acacauccccagaauccauaaa

SEQ ID NO: 1273634 - RNA, 15 nt, Homo sapiens
acacaugugcaguca

SEQ ID NO: 1273635 - RNA, 13 nt, Homo sapiens
acacauguucugu

SEQ ID NO: 1273636 - RNA, 20 nt, Homo sapiens
acacauuccugcauucaugu

SEQ ID NO: 1273637 - RNA, 19 nt, Homo sapiens
acacauugaaugcgcuuua

SEQ ID NO: 1273638 - RNA, 21 nt, Homo sapiens
acacauugaaugcgcuuuauu

SEQ ID NO: 1273639 - RNA, 21 nt, Homo sapiens
acacauuguacaugguacgaa

SEQ ID NO: 1273640 - RNA, 18 nt, Homo sapiens
acaccaaauuuuucuauc

SEQ ID NO: 1273641 - RNA, 15 nt, Homo sapiens
acaccaaccagacag

SEQ ID NO: 1273642 - RNA, 20 nt, Homo sapiens
acaccaccuauaccaauauu

SEQ ID NO: 1273643 - RNA, 19 nt, Homo sapiens
acaccagagcccacuucca

SEQ ID NO: 1273644 - RNA, 20 nt, Homo sapiens
acaccagcagcccugucacg

SEQ ID NO: 1273645 - RNA, 17 nt, Homo sapiens
acaccaggagagcuucu

SEQ ID NO: 1273646 - RNA, 20 nt, Homo sapiens
acaccaggcugugggccuca

SEQ ID NO: 1273647 - RNA, 19 nt, Homo sapiens
acaccagggacacauuucu

SEQ ID NO: 1273648 - RNA, 15 nt, Homo sapiens
acauucuuauugaca

SEQ ID NO: 1273649 - RNA, 13 nt, Homo sapiens
acauucuuccaaa

SEQ ID NO: 1273650 - RNA, 14 nt, Homo sapiens
acauugccaucacu

SEQ ID NO: 1273651 - RNA, 21 nt, Homo sapiens
acauuguuuuguguaacauau

SEQ ID NO: 1273652 - RNA, 22 nt, Homo sapiens
acauuguuuuguguaacauauu

SEQ ID NO: 1273653 - RNA, 17 nt, Homo sapiens
acauuuaaaauugcuau

SEQ ID NO: 1273654 - RNA, 16 nt, Homo sapiens
acauuuaaaccuuuua

SEQ ID NO: 1273655 - RNA, 17 nt, Homo sapiens
acauuuaugcacauuca

SEQ ID NO: 1273656 - RNA, 21 nt, Homo sapiens
acauuugccaacucgaacaaa

SEQ ID NO: 1273657 - RNA, 16 nt, Homo sapiens
acauuugcuguuuuaa

SEQ ID NO: 1273658 - RNA, 22 nt, Homo sapiens
acauuugguauauuaccucaaa

SEQ ID NO: 1273659 - RNA, 16 nt, Homo sapiens
acauuugucuucauga

SEQ ID NO: 1273660 - RNA, 13 nt, Homo sapiens
acauuugugcucc

SEQ ID NO: 1273661 - RNA, 18 nt, Homo sapiens
acauuuuauuaagcuuuu

SEQ ID NO: 1273662 - RNA, 14 nt, Homo sapiens
acauuuucauugau

SEQ ID NO: 1273663 - RNA, 23 nt, Homo sapiens
acauuuuuauaaaaaugagugcu

SEQ ID NO: 1273664 - RNA, 18 nt, Homo sapiens
acauuuuuuaacuuucua

SEQ ID NO: 1273665 - RNA, 17 nt, Homo sapiens
acauuuuuuugcaugca

SEQ ID NO: 1273666 - RNA, 13 nt, Homo sapiens
accaaaacauaaa

SEQ ID NO: 1273667 - RNA, 13 nt, Homo sapiens
accaaaaucagcu

SEQ ID NO: 1273668 - RNA, 21 nt, Homo sapiens
accaaaaugacaaugaugaug

SEQ ID NO: 1273669 - RNA, 15 nt, Homo sapiens
accaaagcaucaaua

SEQ ID NO: 1273670 - RNA, 13 nt, Homo sapiens
accaaagcugccc

SEQ ID NO: 1273671 - RNA, 18 nt, Homo sapiens
accaaagcugcccacugu

SEQ ID NO: 1273672 - RNA, 15 nt, Homo sapiens
accaaauaauuucau

SEQ ID NO: 1273673 - RNA, 19 nt, Homo sapiens
accaaauacuuuaauguau

SEQ ID NO: 1273674 - RNA, 20 nt, Homo sapiens
accaaauacuuuaauguaua

SEQ ID NO: 1273675 - RNA, 14 nt, Homo sapiens
accaaaugauuuca

SEQ ID NO: 1273676 - RNA, 21 nt, Homo sapiens
accaaauuagcaggugcaccu

SEQ ID NO: 1273677 - RNA, 21 nt, Homo sapiens
accaaccuacaauuuucccuu

SEQ ID NO: 1273678 - RNA, 15 nt, Homo sapiens
accaaccucauagag

SEQ ID NO: 1273679 - RNA, 18 nt, Homo sapiens
accaacuauagaauguau

SEQ ID NO: 1273680 - RNA, 21 nt, Homo sapiens
cagagagggcaccaucacaau

SEQ ID NO: 1273681 - RNA, 19 nt, Homo sapiens
cagagaggggcagguugac

SEQ ID NO: 1273682 - RNA, 18 nt, Homo sapiens
cagagagucccacugccu

SEQ ID NO: 1273683 - RNA, 16 nt, Homo sapiens
cagagauaaagaccuu

SEQ ID NO: 1273684 - RNA, 13 nt, Homo sapiens
cagagaugacugu

SEQ ID NO: 1273685 - RNA, 15 nt, Homo sapiens
cagagaugacugucc

SEQ ID NO: 1273686 - RNA, 20 nt, Homo sapiens
cagagcaagacuccaucuca

SEQ ID NO: 1273687 - RNA, 17 nt, Homo sapiens
cagagcacauuugucag

SEQ ID NO: 1273688 - RNA, 17 nt, Homo sapiens
cagagcacccccugcuc

SEQ ID NO: 1273689 - RNA, 12 nt, Homo sapiens
cagagcacuccc

SEQ ID NO: 1273690 - RNA, 14 nt, Homo sapiens
cagagcacuuuagc

SEQ ID NO: 1273691 - RNA, 20 nt, Homo sapiens
cagagcagagguggaaaaac

SEQ ID NO: 1273692 - RNA, 17 nt, Homo sapiens
cagagcagaugaggaaa

SEQ ID NO: 1273693 - RNA, 22 nt, Homo sapiens
cagagcagaugcagagagccau

SEQ ID NO: 1273694 - RNA, 18 nt, Homo sapiens
cagagcaggaagcauuca

SEQ ID NO: 1273695 - RNA, 19 nt, Homo sapiens
cagagcaggcaauuucacc

SEQ ID NO: 1273696 - RNA, 15 nt, Homo sapiens
cagagccagaugcag

SEQ ID NO: 1273697 - RNA, 18 nt, Homo sapiens
cagagccagaugcaggac

SEQ ID NO: 1273698 - RNA, 14 nt, Homo sapiens
cagagccagucuca

SEQ ID NO: 1273699 - RNA, 15 nt, Homo sapiens
cagagcccacuucca

SEQ ID NO: 1273700 - RNA, 20 nt, Homo sapiens
cagagcccuucacugccaug

SEQ ID NO: 1273701 - RNA, 20 nt, Homo sapiens
cagagcgagacuccgucuca

SEQ ID NO: 1273702 - RNA, 20 nt, Homo sapiens
cagagcgagagucugucuca

SEQ ID NO: 1273703 - RNA, 15 nt, Homo sapiens
cagagcuaguuuuca

SEQ ID NO: 1273704 - RNA, 17 nt, Homo sapiens
cagagcugaagaacuug

SEQ ID NO: 1273705 - RNA, 21 nt, Homo sapiens
cagagcugaagaacuuggcac

SEQ ID NO: 1273706 - RNA, 16 nt, Homo sapiens
cagagcugagcccuca

SEQ ID NO: 1273707 - RNA, 21 nt, Homo sapiens
cagagcuggaccaguggugcc

SEQ ID NO: 1273708 - RNA, 17 nt, Homo sapiens
cagagcuggaucucuca

SEQ ID NO: 1273709 - RNA, 13 nt, Homo sapiens
cagagcuggugau

SEQ ID NO: 1273710 - RNA, 23 nt, Homo sapiens
cagaggagccaauaaaccuguaa

SEQ ID NO: 1273711 - RNA, 19 nt, Homo sapiens
cagaggagccaccaguucu

SEQ ID NO: 1273712 - RNA, 20 nt, Homo sapiens
cagaggcagccucugcacuc

SEQ ID NO: 1273713 - RNA, 19 nt, Homo sapiens
cagaggcaguaaccaugcc

SEQ ID NO: 1273714 - RNA, 21 nt, Homo sapiens
cagaggcgcccuggguggugg

SEQ ID NO: 1273715 - RNA, 20 nt, Homo sapiens
cagaggcucuaauguacaau

SEQ ID NO: 1273716 - RNA, 23 nt, Homo sapiens
cagaggcucuugaugguggacua

SEQ ID NO: 1273717 - RNA, 17 nt, Homo sapiens
cagagggcaguggcccu

SEQ ID NO: 1273718 - RNA, 14 nt, Homo sapiens
cagaggggaaacca

SEQ ID NO: 1273719 - RNA, 22 nt, Homo sapiens
cagaggucaggaagcaggggug

SEQ ID NO: 1273720 - RNA, 13 nt, Homo sapiens
cagaggucuccca

SEQ ID NO: 1273721 - RNA, 15 nt, Homo sapiens
cagaggucucccaaa

SEQ ID NO: 1273722 - RNA, 19 nt, Homo sapiens
cagagguucugucuacagg

SEQ ID NO: 1273723 - RNA, 17 nt, Homo sapiens
cagagguuugcuuccuc

SEQ ID NO: 1273724 - RNA, 22 nt, Homo sapiens
cagagguuugcuuccucaguaa

SEQ ID NO: 1273725 - RNA, 16 nt, Homo sapiens
cagagucaaauuugaa

SEQ ID NO: 1273726 - RNA, 19 nt, Homo sapiens
cagaguccacuguggcacu

SEQ ID NO: 1273727 - RNA, 19 nt, Homo sapiens
cagagucguuggagacuga

SEQ ID NO: 1273728 - RNA, 19 nt, Homo sapiens
cagagucugggccucugac

SEQ ID NO: 1273729 - RNA, 20 nt, Homo sapiens
cagagugagacucugucuca

SEQ ID NO: 1273730 - RNA, 22 nt, Homo sapiens
cagagugagcaagggggcccaa

SEQ ID NO: 1273731 - RNA, 13 nt, Homo sapiens
cagaguggagucu

SEQ ID NO: 1273732 - RNA, 15 nt, Homo sapiens
cagaguguucccuga

SEQ ID NO: 1273733 - RNA, 21 nt, Homo sapiens
cagaguuccugcggagugaag

SEQ ID NO: 1273734 - RNA, 15 nt, Homo sapiens
cagaguucugugaca

SEQ ID NO: 1273735 - RNA, 16 nt, Homo sapiens
cagaguucugugacac

SEQ ID NO: 1273736 - RNA, 17 nt, Homo sapiens
cagaguuguacacugug

SEQ ID NO: 1273737 - RNA, 18 nt, Homo sapiens
cagaguuguacacugugu

SEQ ID NO: 1273738 - RNA, 14 nt, Homo sapiens
cagaguuguugcuu

SEQ ID NO: 1273739 - RNA, 17 nt, Homo sapiens
cagaguuuacauucuaa

SEQ ID NO: 1273740 - RNA, 15 nt, Homo sapiens
cagauaaacaacaaa

SEQ ID NO: 1273741 - RNA, 18 nt, Homo sapiens
cagauaaacaacaaauaa

SEQ ID NO: 1273742 - RNA, 21 nt, Homo sapiens
cagauacuucccauuuuggaa

SEQ ID NO: 1273743 - RNA, 18 nt, Homo sapiens
cagauagagaaauaguga

SEQ ID NO: 1273744 - RNA, 17 nt, Homo sapiens
cagauagauauaugcuc

SEQ ID NO: 1273745 - RNA, 23 nt, Homo sapiens
cagauaucagaaucauugaagua

SEQ ID NO: 1273746 - RNA, 19 nt, Homo sapiens
cagaucaacagcaaccucu

SEQ ID NO: 1273747 - RNA, 17 nt, Homo sapiens
cagaucauauuucacaa

SEQ ID NO: 1273748 - RNA, 19 nt, Homo sapiens
cagaucgcaccacugcacu

SEQ ID NO: 1273749 - RNA, 15 nt, Homo sapiens
cagaucucccacugc

SEQ ID NO: 1273750 - RNA, 12 nt, Homo sapiens
cagaucuuucag

SEQ ID NO: 1273751 - RNA, 16 nt, Homo sapiens
cagaugaauaaacuga

SEQ ID NO: 1273752 - RNA, 22 nt, Homo sapiens
cagaugauauaauuuaacugug

SEQ ID NO: 1273753 - RNA, 12 nt, Homo sapiens
cagaugaucucu

SEQ ID NO: 1273754 - RNA, 12 nt, Homo sapiens
cagaugcaauac

SEQ ID NO: 1273755 - RNA, 22 nt, Homo sapiens
cagaugcccuuuggaaagccau

SEQ ID NO: 1273756 - RNA, 21 nt, Homo sapiens
cagaugccucagccuacuuuc

SEQ ID NO: 1273757 - RNA, 17 nt, Homo sapiens
cagauggaaaaacugag

SEQ ID NO: 1273758 - RNA, 19 nt, Homo sapiens
cagauggaaacucuuuaac

SEQ ID NO: 1273759 - RNA, 20 nt, Homo sapiens
cagauggaaagaggugaaaa

SEQ ID NO: 1273760 - RNA, 20 nt, Homo sapiens
cagauggccuggcugcugcu

SEQ ID NO: 1273761 - RNA, 23 nt, Homo sapiens
cagauguauuaaaaaaagauuug

SEQ ID NO: 1273762 - RNA, 17 nt, Homo sapiens
cagauguauugacugua

SEQ ID NO: 1273763 - RNA, 22 nt, Homo sapiens
cagaugucuucugccuguuaua

SEQ ID NO: 1273764 - RNA, 20 nt, Homo sapiens
cagaugugaaaauauacuug

SEQ ID NO: 1273765 - RNA, 11 nt, Homo sapiens
cagauguuaaa

SEQ ID NO: 1273766 - RNA, 16 nt, Homo sapiens
cagauuauuuaaaugg

SEQ ID NO: 1273767 - RNA, 18 nt, Homo sapiens
cagauuauuuuuccucug

SEQ ID NO: 1273768 - RNA, 15 nt, Homo sapiens
cagauucccagagca

SEQ ID NO: 1273769 - RNA, 17 nt, Homo sapiens
cagauugaacaagagcu

SEQ ID NO: 1273770 - RNA, 18 nt, Homo sapiens
cagauuuaaaaaaagaac

SEQ ID NO: 1273771 - RNA, 16 nt, Homo sapiens
cagauuuacuaaauca

SEQ ID NO: 1273772 - RNA, 16 nt, Homo sapiens
cagauuucagaucaua

SEQ ID NO: 1273773 - RNA, 13 nt, Homo sapiens
cagauuugcacug

SEQ ID NO: 1273774 - RNA, 16 nt, Homo sapiens
cagauuuuacaaaaga

SEQ ID NO: 1273775 - RNA, 20 nt, Homo sapiens
cagauuuuaccuauccacaa

SEQ ID NO: 1273776 - RNA, 15 nt, Homo sapiens
cagauuuucagcaaa

SEQ ID NO: 1273777 - RNA, 16 nt, Homo sapiens
cagcaaaagaagacaa

SEQ ID NO: 1273778 - RNA, 21 nt, Homo sapiens
cagcaaaagaagacaacauuu

SEQ ID NO: 1273779 - RNA, 23 nt, Homo sapiens
cagcaaaagaagacaacauuucu

SEQ ID NO: 1273780 - RNA, 18 nt, Homo sapiens
cagcaaacccugauguga

SEQ ID NO: 1273781 - RNA, 20 nt, Homo sapiens
cagcaaagaggacucgcuug

SEQ ID NO: 1273782 - RNA, 22 nt, Homo sapiens
cagcaacacaauguuauucguu

SEQ ID NO: 1273783 - RNA, 15 nt, Homo sapiens
cagcaaccuauaaaa

SEQ ID NO: 1273784 - RNA, 18 nt, Homo sapiens
cagcaaccucuucaugag

SEQ ID NO: 1273785 - RNA, 16 nt, Homo sapiens
cagcaaggcccugcug

SEQ ID NO: 1273786 - RNA, 18 nt, Homo sapiens
cagcaaggggacaucuua

SEQ ID NO: 1273787 - RNA, 15 nt, Homo sapiens
cagcaauacaaagac

SEQ ID NO: 1273788 - RNA, 23 nt, Homo sapiens
cagcaauacuaagggaagaaaca

SEQ ID NO: 1273789 - RNA, 15 nt, Homo sapiens
cagcaauacucauca

SEQ ID NO: 1273790 - RNA, 18 nt, Homo sapiens
cagcaauaggguggcaca

SEQ ID NO: 1273791 - RNA, 22 nt, Homo sapiens
cagcaauucuccugccucagcc

SEQ ID NO: 1273792 - RNA, 12 nt, Homo sapiens
cagcacagccag

SEQ ID NO: 1273793 - RNA, 16 nt, Homo sapiens
cagcacagucacccau

SEQ ID NO: 1273794 - RNA, 12 nt, Homo sapiens
cagcaccacagu

SEQ ID NO: 1273795 - RNA, 17 nt, Homo sapiens
cagcacccccacccacc

SEQ ID NO: 1273796 - RNA, 18 nt, Homo sapiens
cagcacgaguggccaguu

SEQ ID NO: 1273797 - RNA, 14 nt, Homo sapiens
cagcacggacaaua

SEQ ID NO: 1273798 - RNA, 15 nt, Homo sapiens
cagcacuacucugug

SEQ ID NO: 1273799 - RNA, 17 nt, Homo sapiens
caguggauugauuauaa

SEQ ID NO: 1273800 - RNA, 17 nt, Homo sapiens
caguggauugcauuucu

SEQ ID NO: 1273801 - RNA, 15 nt, Homo sapiens
caguggcccuuucaa

SEQ ID NO: 1273802 - RNA, 16 nt, Homo sapiens
caguggcucauaaaaa

SEQ ID NO: 1273803 - RNA, 16 nt, Homo sapiens
caguggcugugccacc

SEQ ID NO: 1273804 - RNA, 21 nt, Homo sapiens
cagugggcguugggagccuag

SEQ ID NO: 1273805 - RNA, 19 nt, Homo sapiens
caguggggccuguggaaug

SEQ ID NO: 1273806 - RNA, 16 nt, Homo sapiens
cagugguauccuguga

SEQ ID NO: 1273807 - RNA, 15 nt, Homo sapiens
cagugguaugaucac

SEQ ID NO: 1273808 - RNA, 13 nt, Homo sapiens
caguguacaugga

SEQ ID NO: 1273809 - RNA, 14 nt, Homo sapiens
caguguacccuccu

SEQ ID NO: 1273810 - RNA, 21 nt, Homo sapiens
caguguagcccacacuugaga

SEQ ID NO: 1273811 - RNA, 15 nt, Homo sapiens
caguguauaggaaga

SEQ ID NO: 1273812 - RNA, 21 nt, Homo sapiens
caguguauguacuaagcagua

SEQ ID NO: 1273813 - RNA, 14 nt, Homo sapiens
cagugucacucugu

SEQ ID NO: 1273814 - RNA, 12 nt, Homo sapiens
cagugucauuua

SEQ ID NO: 1273815 - RNA, 18 nt, Homo sapiens
cagugucccaccuugacc

SEQ ID NO: 1273816 - RNA, 17 nt, Homo sapiens
cagugucccuuuugcua

SEQ ID NO: 1273817 - RNA, 23 nt, Homo sapiens
cagugugaucccaagugccaguc

SEQ ID NO: 1273818 - RNA, 22 nt, Homo sapiens
cagugugguuggccugaacaaa

SEQ ID NO: 1273819 - RNA, 15 nt, Homo sapiens
cagugugguuugcau

SEQ ID NO: 1273820 - RNA, 20 nt, Homo sapiens
caguguuauuaaugacaaag

SEQ ID NO: 1273821 - RNA, 12 nt, Homo sapiens
caguguuuacaa

SEQ ID NO: 1273822 - RNA, 18 nt, Homo sapiens
caguguuuuaaauucuga

SEQ ID NO: 1273823 - RNA, 17 nt, Homo sapiens
caguuaaugccacaaaa

SEQ ID NO: 1273824 - RNA, 18 nt, Homo sapiens
caguuaauucaaugugaa

SEQ ID NO: 1273825 - RNA, 19 nt, Homo sapiens
caguuacucccuacacuga

SEQ ID NO: 1273826 - RNA, 22 nt, Homo sapiens
caguuacucccuacacugaugc

SEQ ID NO: 1273827 - RNA, 16 nt, Homo sapiens
caguuauuaaucugga

SEQ ID NO: 1273828 - RNA, 15 nt, Homo sapiens
caguucaagacuuag

SEQ ID NO: 1273829 - RNA, 16 nt, Homo sapiens
caguucaccuugaaga

SEQ ID NO: 1273830 - RNA, 16 nt, Homo sapiens
caguucauuauuuugu

SEQ ID NO: 1273831 - RNA, 22 nt, Homo sapiens
caguuccacuggggcaagcucc

SEQ ID NO: 1273832 - RNA, 17 nt, Homo sapiens
caguucuacacugauac

SEQ ID NO: 1273833 - RNA, 16 nt, Homo sapiens
caguucucucccuucc

SEQ ID NO: 1273834 - RNA, 21 nt, Homo sapiens
caguugaaugacaacagaagc

SEQ ID NO: 1273835 - RNA, 15 nt, Homo sapiens
caguugacaaaaagc

SEQ ID NO: 1273836 - RNA, 20 nt, Homo sapiens
caguugagagagaaucucaa

SEQ ID NO: 1273837 - RNA, 22 nt, Homo sapiens
caguugauacauaguuguauau

SEQ ID NO: 1273838 - RNA, 17 nt, Homo sapiens
caguugaucagacugaa

SEQ ID NO: 1273839 - RNA, 15 nt, Homo sapiens
caguugcauaucuua

SEQ ID NO: 1273840 - RNA, 20 nt, Homo sapiens
caguugccacauuuaguccu

SEQ ID NO: 1273841 - RNA, 14 nt, Homo sapiens
caguugcccuagcc

SEQ ID NO: 1273842 - RNA, 20 nt, Homo sapiens
caguugguggggccaggcca

SEQ ID NO: 1273843 - RNA, 18 nt, Homo sapiens
caguugugucagcuacug

SEQ ID NO: 1273844 - RNA, 22 nt, Homo sapiens
caguuuaaugaacuaccaucug

SEQ ID NO: 1273845 - RNA, 16 nt, Homo sapiens
caguuucagcucacuu

SEQ ID NO: 1273846 - RNA, 19 nt, Homo sapiens
caguuugauaccugcacug

SEQ ID NO: 1273847 - RNA, 20 nt, Homo sapiens
caguuugcuuuguaugcacu

SEQ ID NO: 1273848 - RNA, 16 nt, Homo sapiens
caguuuggagucacug

SEQ ID NO: 1273849 - RNA, 17 nt, Homo sapiens
caguuuuagauacucau

SEQ ID NO: 1273850 - RNA, 21 nt, Homo sapiens
caguuuuaucuuuaaucuccu

SEQ ID NO: 1273851 - RNA, 18 nt, Homo sapiens
caguuuuauuuuugccaa

SEQ ID NO: 1273852 - RNA, 12 nt, Homo sapiens
caguuuuugccu

SEQ ID NO: 1273853 - RNA, 21 nt, Homo sapiens
caguuuuuuaaaaauguguca

SEQ ID NO: 1273854 - RNA, 17 nt, Homo sapiens
cauaaaaagcagaauuu

SEQ ID NO: 1273855 - RNA, 21 nt, Homo sapiens
cauaaaaagccugcaauuuca

SEQ ID NO: 1273856 - RNA, 20 nt, Homo sapiens
cauaaaaaguaauaaaugag

SEQ ID NO: 1273857 - RNA, 21 nt, Homo sapiens
cauaaaaauaaaucaguucau

SEQ ID NO: 1273858 - RNA, 18 nt, Homo sapiens
cauaaaaccaaguuuuac

SEQ ID NO: 1273859 - RNA, 19 nt, Homo sapiens
cauaaaagacaagcacuuu

SEQ ID NO: 1273860 - RNA, 18 nt, Homo sapiens
cauaaaagcauugucucu

SEQ ID NO: 1273861 - RNA, 16 nt, Homo sapiens
cauaaaaucugugaau

SEQ ID NO: 1273862 - RNA, 18 nt, Homo sapiens
cauaaacugucacucuag

SEQ ID NO: 1273863 - RNA, 16 nt, Homo sapiens
cauaaacuucagggau

SEQ ID NO: 1273864 - RNA, 17 nt, Homo sapiens
cauaaaugaagcagcuu

SEQ ID NO: 1273865 - RNA, 17 nt, Homo sapiens
cauaaaugaaucaucaa

SEQ ID NO: 1273866 - RNA, 22 nt, Homo sapiens
cauaaauuagaggucuccaaaa

SEQ ID NO: 1273867 - RNA, 19 nt, Homo sapiens
cauaaccuugaauaaugag

SEQ ID NO: 1273868 - RNA, 17 nt, Homo sapiens
cauaacugaaggcauau

SEQ ID NO: 1273869 - RNA, 15 nt, Homo sapiens
cauaagaaaagauua

SEQ ID NO: 1273870 - RNA, 21 nt, Homo sapiens
cauaagccuaccaauguagac

SEQ ID NO: 1273871 - RNA, 22 nt, Homo sapiens
cauaaggccggacgcaucucaa

SEQ ID NO: 1273872 - RNA, 19 nt, Homo sapiens
cauaagggacugugccaga

SEQ ID NO: 1273873 - RNA, 22 nt, Homo sapiens
cauaaguauacaguucaauaaa

SEQ ID NO: 1273874 - RNA, 16 nt, Homo sapiens
cauaaguauuaugucu

SEQ ID NO: 1273875 - RNA, 16 nt, Homo sapiens
cauaauaaauaauuaa

SEQ ID NO: 1273876 - RNA, 13 nt, Homo sapiens
cauaauaauagca

SEQ ID NO: 1273877 - RNA, 15 nt, Homo sapiens
cauaaucuaguuuac

SEQ ID NO: 1273878 - RNA, 21 nt, Homo sapiens
cauaaugcucauacuuaucua

SEQ ID NO: 1273879 - RNA, 21 nt, Homo sapiens
cauaaugcuuuggaaaaaugg

SEQ ID NO: 1273880 - RNA, 16 nt, Homo sapiens
cauaauucagcacuua

SEQ ID NO: 1273881 - RNA, 20 nt, Homo sapiens
cauaauucagcacuuaacua

SEQ ID NO: 1273882 - RNA, 20 nt, Homo sapiens
cauaauugcuuugccaaaau

SEQ ID NO: 1273883 - RNA, 18 nt, Homo sapiens
cauacaaagagguguaca

SEQ ID NO: 1273884 - RNA, 13 nt, Homo sapiens
cauacacacuguu

SEQ ID NO: 1273885 - RNA, 23 nt, Homo sapiens
cauacacccccaccuccugcaau

SEQ ID NO: 1273886 - RNA, 17 nt, Homo sapiens
cauacacucaaacaauc

SEQ ID NO: 1273887 - RNA, 20 nt, Homo sapiens
cauacagaacucuaaaagau

SEQ ID NO: 1273888 - RNA, 16 nt, Homo sapiens
cauacauauuaucuca

SEQ ID NO: 1273889 - RNA, 14 nt, Homo sapiens
cauacaugcauaca

SEQ ID NO: 1273890 - RNA, 21 nt, Homo sapiens
cauacauuuaugcacauucac

SEQ ID NO: 1273891 - RNA, 13 nt, Homo sapiens
cauaccacuugaa

SEQ ID NO: 1273892 - RNA, 15 nt, Homo sapiens
cauacccuguuacca

SEQ ID NO: 1273893 - RNA, 17 nt, Homo sapiens
cauaccuaaguacugua

SEQ ID NO: 1273894 - RNA, 13 nt, Homo sapiens
cauaccucugacc

SEQ ID NO: 1273895 - RNA, 14 nt, Homo sapiens
cauaccucugacca

SEQ ID NO: 1273896 - RNA, 17 nt, Homo sapiens
cauaccucugaccaaca

SEQ ID NO: 1273897 - RNA, 18 nt, Homo sapiens
cauaccucugaccaacag

SEQ ID NO: 1273898 - RNA, 16 nt, Homo sapiens
cauacuccuuccauca

SEQ ID NO: 1273899 - RNA, 18 nt, Homo sapiens
cauagaaaauuaaacaca

SEQ ID NO: 1273900 - RNA, 19 nt, Homo sapiens
cauagauuaauggcacuga

SEQ ID NO: 1273901 - RNA, 16 nt, Homo sapiens
cauagcaaacagagga

SEQ ID NO: 1273902 - RNA, 21 nt, Homo sapiens
cauagccauggaacccugcca

SEQ ID NO: 1273903 - RNA, 16 nt, Homo sapiens
cauagcgaagaccagu

SEQ ID NO: 1273904 - RNA, 15 nt, Homo sapiens
cauagggccuccuua

SEQ ID NO: 1273905 - RNA, 17 nt, Homo sapiens
cauagguaaaaacugga

SEQ ID NO: 1273906 - RNA, 18 nt, Homo sapiens
cauagguaaaaacuggaa

SEQ ID NO: 1273907 - RNA, 15 nt, Homo sapiens
cauaguaauucuuaa

SEQ ID NO: 1273908 - RNA, 17 nt, Homo sapiens
cauaguaguaugaugau

SEQ ID NO: 1273909 - RNA, 17 nt, Homo sapiens
cauaguuuaaacugcau

SEQ ID NO: 1273910 - RNA, 14 nt, Homo sapiens
cauauaaccaaaau

SEQ ID NO: 1273911 - RNA, 13 nt, Homo sapiens
cauauaauguugu

SEQ ID NO: 1273912 - RNA, 12 nt, Homo sapiens
cauauaccagca

SEQ ID NO: 1273913 - RNA, 13 nt, Homo sapiens
cauauaccagcaa

SEQ ID NO: 1273914 - RNA, 16 nt, Homo sapiens
cauauaccagcaauau

SEQ ID NO: 1273915 - RNA, 19 nt, Homo sapiens
cauauaggacacacauaga

SEQ ID NO: 1273916 - RNA, 17 nt, Homo sapiens
cauauaggccagaguug

SEQ ID NO: 1273917 - RNA, 21 nt, Homo sapiens
cauauaggccagaguugcaaa

SEQ ID NO: 1273918 - RNA, 20 nt, Homo sapiens
cauauauaagguaugugcua

SEQ ID NO: 1273919 - RNA, 20 nt, Homo sapiens
cauauauacaggcauaaaau

SEQ ID NO: 1273920 - RNA, 15 nt, Homo sapiens
cauauauacccacau

SEQ ID NO: 1273921 - RNA, 21 nt, Homo sapiens
cauauauacccacauguacag

SEQ ID NO: 1273922 - RNA, 21 nt, Homo sapiens
cauauauauuaauacugguau

SEQ ID NO: 1273923 - RNA, 15 nt, Homo sapiens
cauauaucaaaguga

SEQ ID NO: 1273924 - RNA, 14 nt, Homo sapiens
cauauaucucugug

SEQ ID NO: 1273925 - RNA, 16 nt, Homo sapiens
cauaucaucacauuga

SEQ ID NO: 1273926 - RNA, 17 nt, Homo sapiens
caaucuccuuacugugu

SEQ ID NO: 1273927 - RNA, 21 nt, Homo sapiens
caaucugagccagugcuuuaa

SEQ ID NO: 1273928 - RNA, 20 nt, Homo sapiens
caaucuguccguucacaugu

SEQ ID NO: 1273929 - RNA, 14 nt, Homo sapiens
caaucuucuacuuu

SEQ ID NO: 1273930 - RNA, 14 nt, Homo sapiens
caaucuuugacaau

SEQ ID NO: 1273931 - RNA, 20 nt, Homo sapiens
caaucuuugccuuuaucucu

SEQ ID NO: 1273932 - RNA, 19 nt, Homo sapiens
caaugaauuuuauaaucug

SEQ ID NO: 1273933 - RNA, 13 nt, Homo sapiens
caaugaccaaaca

SEQ ID NO: 1273934 - RNA, 22 nt, Homo sapiens
caaugagaaugaugcacacuga

SEQ ID NO: 1273935 - RNA, 15 nt, Homo sapiens
caaugauuauuugua

SEQ ID NO: 1273936 - RNA, 21 nt, Homo sapiens
caaugauuauuuucauuacaa

SEQ ID NO: 1273937 - RNA, 10 nt, Homo sapiens
caaugauuca

SEQ ID NO: 1273938 - RNA, 22 nt, Homo sapiens
caaugcacccccaaccuccauc

SEQ ID NO: 1273939 - RNA, 16 nt, Homo sapiens
caaugcacgaucucag

SEQ ID NO: 1273940 - RNA, 11 nt, Homo sapiens
caaugccagua

SEQ ID NO: 1273941 - RNA, 16 nt, Homo sapiens
caaugcuccaucccaa

SEQ ID NO: 1273942 - RNA, 18 nt, Homo sapiens
caaugcuggcuuucuccc

SEQ ID NO: 1273943 - RNA, 16 nt, Homo sapiens
caauggagacugucuc

SEQ ID NO: 1273944 - RNA, 20 nt, Homo sapiens
caaugucacaaccucucuga

SEQ ID NO: 1273945 - RNA, 16 nt, Homo sapiens
caaugucugcugagga

SEQ ID NO: 1273946 - RNA, 17 nt, Homo sapiens
caaugucugguuaguua

SEQ ID NO: 1273947 - RNA, 17 nt, Homo sapiens
caauuaauauuacucag

SEQ ID NO: 1273948 - RNA, 17 nt, Homo sapiens
caauuacauaguccagu

SEQ ID NO: 1273949 - RNA, 18 nt, Homo sapiens
caauuacucagguuugag

SEQ ID NO: 1273950 - RNA, 21 nt, Homo sapiens
caauuagcaauugacugucac

SEQ ID NO: 1273951 - RNA, 18 nt, Homo sapiens
caauuagcauucugucuc

SEQ ID NO: 1273952 - RNA, 13 nt, Homo sapiens
caauuauaacuua

SEQ ID NO: 1273953 - RNA, 22 nt, Homo sapiens
caauuauacuaaaccucacaaa

SEQ ID NO: 1273954 - RNA, 17 nt, Homo sapiens
caauuaucaucuuuuga

SEQ ID NO: 1273955 - RNA, 17 nt, Homo sapiens
caauucacuagaccaga

SEQ ID NO: 1273956 - RNA, 19 nt, Homo sapiens
caauucagauugucuugca

SEQ ID NO: 1273957 - RNA, 17 nt, Homo sapiens
caauuccaaagccagac

SEQ ID NO: 1273958 - RNA, 20 nt, Homo sapiens
caauuccaaaggaaucucca

SEQ ID NO: 1273959 - RNA, 13 nt, Homo sapiens
caauuccucuggg

SEQ ID NO: 1273960 - RNA, 19 nt, Homo sapiens
caauugaccuucucccuca

SEQ ID NO: 1273961 - RNA, 20 nt, Homo sapiens
caauugacugucacuguucc

SEQ ID NO: 1273962 - RNA, 14 nt, Homo sapiens
caauugcucaugca

SEQ ID NO: 1273963 - RNA, 15 nt, Homo sapiens
caauuggcauuaaca

SEQ ID NO: 1273964 - RNA, 21 nt, Homo sapiens
caauugucauuuauaaaacca

SEQ ID NO: 1273965 - RNA, 22 nt, Homo sapiens
caauuguugacaguucugaaga

SEQ ID NO: 1273966 - RNA, 18 nt, Homo sapiens
caauuuaaggaacacaga

SEQ ID NO: 1273967 - RNA, 10 nt, Homo sapiens
caauuucacu

SEQ ID NO: 1273968 - RNA, 19 nt, Homo sapiens
caauuucacuuagucugua

SEQ ID NO: 1273969 - RNA, 13 nt, Homo sapiens
caauuucauuuaa

SEQ ID NO: 1273970 - RNA, 18 nt, Homo sapiens
caauuucuuuuauguuaa

SEQ ID NO: 1273971 - RNA, 16 nt, Homo sapiens
caauuugaauauaaau

SEQ ID NO: 1273972 - RNA, 16 nt, Homo sapiens
caauuuguauuacuuu

SEQ ID NO: 1273973 - RNA, 23 nt, Homo sapiens
caauuuucuuuuuuauacucaau

SEQ ID NO: 1273974 - RNA, 18 nt, Homo sapiens
caauuuuuuaucaugcau

SEQ ID NO: 1273975 - RNA, 12 nt, Homo sapiens
cacaaaacagaa

SEQ ID NO: 1273976 - RNA, 20 nt, Homo sapiens
cacaaaauguaggguuauaa

SEQ ID NO: 1273977 - RNA, 12 nt, Homo sapiens
cacaaaccacaa

SEQ ID NO: 1273978 - RNA, 13 nt, Homo sapiens
cacaaaccaguau

SEQ ID NO: 1273979 - RNA, 12 nt, Homo sapiens
cacaaacuccau

SEQ ID NO: 1273980 - RNA, 16 nt, Homo sapiens
cacaaagcauuuucau

SEQ ID NO: 1273981 - RNA, 18 nt, Homo sapiens
cacaaagcccuuccaugu

SEQ ID NO: 1273982 - RNA, 17 nt, Homo sapiens
cacaaaggauacuuuua

SEQ ID NO: 1273983 - RNA, 16 nt, Homo sapiens
cacaaagguuaaguua

SEQ ID NO: 1273984 - RNA, 11 nt, Homo sapiens
cacaaauauca

SEQ ID NO: 1273985 - RNA, 23 nt, Homo sapiens
cacaaaucaaagcaagggcucca

SEQ ID NO: 1273986 - RNA, 16 nt, Homo sapiens
cacaacccuguuuuau

SEQ ID NO: 1273987 - RNA, 13 nt, Homo sapiens
cacaacugacaca

SEQ ID NO: 1273988 - RNA, 20 nt, Homo sapiens
cacaagaagcugguggagca

SEQ ID NO: 1273989 - RNA, 18 nt, Homo sapiens
cacaagaagugguccauc

SEQ ID NO: 1273990 - RNA, 15 nt, Homo sapiens
cacaagaaugugcag

SEQ ID NO: 1273991 - RNA, 19 nt, Homo sapiens
cacaagaggaauaagaaug

SEQ ID NO: 1273992 - RNA, 15 nt, Homo sapiens
cacaagagugaauuu

SEQ ID NO: 1273993 - RNA, 15 nt, Homo sapiens
cacaagcguguuucu

SEQ ID NO: 1273994 - RNA, 18 nt, Homo sapiens
cacaagcguguuucuaga

SEQ ID NO: 1273995 - RNA, 15 nt, Homo sapiens
cacaaggcugaccaa

SEQ ID NO: 1273996 - RNA, 20 nt, Homo sapiens
cacaaggcugaccaagagag

SEQ ID NO: 1273997 - RNA, 23 nt, Homo sapiens
cacaaggggaaggguacugaaaa

SEQ ID NO: 1273998 - RNA, 15 nt, Homo sapiens
cacaagguccacucc

SEQ ID NO: 1273999 - RNA, 15 nt, Homo sapiens
cacaaggugauuuca

SEQ ID NO: 1274000 - RNA, 21 nt, Homo sapiens
cacaaggugauuucagacugc

SEQ ID NO: 1274001 - RNA, 13 nt, Homo sapiens
cacaagucuucca

SEQ ID NO: 1274002 - RNA, 14 nt, Homo sapiens
cacaagucuuccag

SEQ ID NO: 1274003 - RNA, 14 nt, Homo sapiens
cacaauaaauguau

SEQ ID NO: 1274004 - RNA, 18 nt, Homo sapiens
cacaauaccuacaauaaa

SEQ ID NO: 1274005 - RNA, 20 nt, Homo sapiens
cacaauagcaguugaaacaa

SEQ ID NO: 1274006 - RNA, 14 nt, Homo sapiens
cacaauaggucuuu

SEQ ID NO: 1274007 - RNA, 15 nt, Homo sapiens
cacaauccuccaaga

SEQ ID NO: 1274008 - RNA, 21 nt, Homo sapiens
cacaauccuugccacagugug

SEQ ID NO: 1274009 - RNA, 20 nt, Homo sapiens
cacaaugucaugucugugau

SEQ ID NO: 1274010 - RNA, 12 nt, Homo sapiens
cacaauucacua

SEQ ID NO: 1274011 - RNA, 13 nt, Homo sapiens
cacacaaaccagu

SEQ ID NO: 1274012 - RNA, 15 nt, Homo sapiens
cacacaacagcagau

SEQ ID NO: 1274013 - RNA, 13 nt, Homo sapiens
cacacacacacga

SEQ ID NO: 1274014 - RNA, 13 nt, Homo sapiens
cacacacacaugc

SEQ ID NO: 1274015 - RNA, 14 nt, Homo sapiens
cacacacacaugcu

SEQ ID NO: 1274016 - RNA, 14 nt, Homo sapiens
cacacacacgcacg

SEQ ID NO: 1274017 - RNA, 13 nt, Homo sapiens
cacacacauccac

SEQ ID NO: 1274018 - RNA, 15 nt, Homo sapiens
cacacacaugcuagg

SEQ ID NO: 1274019 - RNA, 21 nt, Homo sapiens
cacacacccagcuugugccug

SEQ ID NO: 1274020 - RNA, 18 nt, Homo sapiens
cacacaccuguagcacuu

SEQ ID NO: 1274021 - RNA, 22 nt, Homo sapiens
cacacagcuacucuccccacga

SEQ ID NO: 1274022 - RNA, 22 nt, Homo sapiens
cacacauccccuuuguguagaa

SEQ ID NO: 1274023 - RNA, 12 nt, Homo sapiens
cacacaucucau

SEQ ID NO: 1274024 - RNA, 14 nt, Homo sapiens
cacacaugcacaca

SEQ ID NO: 1274025 - RNA, 12 nt, Homo sapiens
cacacaugcuag

SEQ ID NO: 1274026 - RNA, 18 nt, Homo sapiens
cacacaugcuaggaugcg

SEQ ID NO: 1274027 - RNA, 18 nt, Homo sapiens
cacacauuauuaccccac

SEQ ID NO: 1274028 - RNA, 13 nt, Homo sapiens
cacacccagccuc

SEQ ID NO: 1274029 - RNA, 18 nt, Homo sapiens
cacacccucacucugcca

SEQ ID NO: 1274030 - RNA, 17 nt, Homo sapiens
cacaccgcagggacaag

SEQ ID NO: 1274031 - RNA, 21 nt, Homo sapiens
cacaccuggcccuugcaaucu

SEQ ID NO: 1274032 - RNA, 23 nt, Homo sapiens
cacaccuuuguccacugucaggg

SEQ ID NO: 1274033 - RNA, 17 nt, Homo sapiens
cacaccuuuuauugaca

SEQ ID NO: 1274034 - RNA, 14 nt, Homo sapiens
cacacgaugcauuu

SEQ ID NO: 1274035 - RNA, 13 nt, Homo sapiens
cacacggaucuga

SEQ ID NO: 1274036 - RNA, 14 nt, Homo sapiens
cacacgugugcauu

SEQ ID NO: 1274037 - RNA, 17 nt, Homo sapiens
cacacuaagagggcaga

SEQ ID NO: 1274038 - RNA, 17 nt, Homo sapiens
cacacucaaaagacaaa

SEQ ID NO: 1274039 - RNA, 20 nt, Homo sapiens
cacacuccuccaaggcacaa

SEQ ID NO: 1274040 - RNA, 21 nt, Homo sapiens
cacacugccaaauaaacagcu

SEQ ID NO: 1274041 - RNA, 19 nt, Homo sapiens
cacacuguucugaaaguga

SEQ ID NO: 1274042 - RNA, 15 nt, Homo sapiens
cacacuuugcacuga

SEQ ID NO: 1274043 - RNA, 17 nt, Homo sapiens
cacacuuuggucauuuc

SEQ ID NO: 1274044 - RNA, 21 nt, Homo sapiens
cacagaacuauguacuuuaaa

SEQ ID NO: 1274045 - RNA, 15 nt, Homo sapiens
cacagaagacccgcu

SEQ ID NO: 1274046 - RNA, 11 nt, Homo sapiens
cacagacuccg

SEQ ID NO: 1274047 - RNA, 21 nt, Homo sapiens
cacagacuggcaauaaacucc

SEQ ID NO: 1274048 - RNA, 23 nt, Homo sapiens
cacagacuggcaauaaacuccua

SEQ ID NO: 1274049 - RNA, 14 nt, Homo sapiens
cacagagaguccca

SEQ ID NO: 1274050 - RNA, 16 nt, Homo sapiens
cacagagcaguggcca

SEQ ID NO: 1274051 - RNA, 23 nt, Homo sapiens
cacagagcuccuggcccuggcca

SEQ ID NO: 1274052 - RNA, 22 nt, Homo sapiens
cacagagggcaggcacucccau

SEQ ID NO: 1274053 - RNA, 19 nt, Homo sapiens
cacagaggucaggaagcag

SEQ ID NO: 1274054 - RNA, 19 nt, Homo sapiens
caugaccugcgcucucagc

SEQ ID NO: 1274055 - RNA, 18 nt, Homo sapiens
caugacgacaaagcugcu

SEQ ID NO: 1274056 - RNA, 22 nt, Homo sapiens
caugacuuguagcauauucuuu

SEQ ID NO: 1274057 - RNA, 18 nt, Homo sapiens
caugagaaagaauuugag

SEQ ID NO: 1274058 - RNA, 15 nt, Homo sapiens
caugagauaacucaa

SEQ ID NO: 1274059 - RNA, 19 nt, Homo sapiens
caugagauucauucaguua

SEQ ID NO: 1274060 - RNA, 19 nt, Homo sapiens
caugaggccaucucaggag

SEQ ID NO: 1274061 - RNA, 19 nt, Homo sapiens
caugauggagcgcaccugc

SEQ ID NO: 1274062 - RNA, 20 nt, Homo sapiens
caugauggagcgcaccugcc

SEQ ID NO: 1274063 - RNA, 20 nt, Homo sapiens
caugauggccuuacacugaa

SEQ ID NO: 1274064 - RNA, 21 nt, Homo sapiens
caugauggccuuacacugaaa

SEQ ID NO: 1274065 - RNA, 17 nt, Homo sapiens
caugaugucaacucacu

SEQ ID NO: 1274066 - RNA, 10 nt, Homo sapiens
caugaugucu

SEQ ID NO: 1274067 - RNA, 13 nt, Homo sapiens
caugaugugcaac

SEQ ID NO: 1274068 - RNA, 22 nt, Homo sapiens
caugauuucauuucaacuguuu

SEQ ID NO: 1274069 - RNA, 10 nt, Homo sapiens
caugcaaaau

SEQ ID NO: 1274070 - RNA, 16 nt, Homo sapiens
caugcaaggcacugua

SEQ ID NO: 1274071 - RNA, 21 nt, Homo sapiens
caugcacacacacacaucuca

SEQ ID NO: 1274072 - RNA, 22 nt, Homo sapiens
caugcacacacacacaucucau

SEQ ID NO: 1274073 - RNA, 14 nt, Homo sapiens
caugcacacgggaa

SEQ ID NO: 1274074 - RNA, 13 nt, Homo sapiens
caugcacugaccc

SEQ ID NO: 1274075 - RNA, 13 nt, Homo sapiens
caugcacugaugu

SEQ ID NO: 1274076 - RNA, 15 nt, Homo sapiens
caugcauuguuggcu

SEQ ID NO: 1274077 - RNA, 16 nt, Homo sapiens
caugccaaauguucca

SEQ ID NO: 1274078 - RNA, 19 nt, Homo sapiens
caugccacccuguuuucag

SEQ ID NO: 1274079 - RNA, 23 nt, Homo sapiens
caugccagaaggaaucuucucau

SEQ ID NO: 1274080 - RNA, 21 nt, Homo sapiens
caugcccagaccuucucacac

SEQ ID NO: 1274081 - RNA, 15 nt, Homo sapiens
caugccucagugaag

SEQ ID NO: 1274082 - RNA, 17 nt, Homo sapiens
caugccuguagucccag

SEQ ID NO: 1274083 - RNA, 14 nt, Homo sapiens
caugccuugugcug

SEQ ID NO: 1274084 - RNA, 16 nt, Homo sapiens
caugcguccuggucaa

SEQ ID NO: 1274085 - RNA, 15 nt, Homo sapiens
caugcuacaguuauu

SEQ ID NO: 1274086 - RNA, 16 nt, Homo sapiens
caugcuacaguuauua

SEQ ID NO: 1274087 - RNA, 17 nt, Homo sapiens
caugcugaaaacuacac

SEQ ID NO: 1274088 - RNA, 17 nt, Homo sapiens
caugcugcuuugccaag

SEQ ID NO: 1274089 - RNA, 13 nt, Homo sapiens
caugcuggggcaa

SEQ ID NO: 1274090 - RNA, 12 nt, Homo sapiens
caugcuggugaa

SEQ ID NO: 1274091 - RNA, 17 nt, Homo sapiens
caugcuucgugccacac

SEQ ID NO: 1274092 - RNA, 14 nt, Homo sapiens
cauggacuacacca

SEQ ID NO: 1274093 - RNA, 15 nt, Homo sapiens
cauggagacgcauuu

SEQ ID NO: 1274094 - RNA, 23 nt, Homo sapiens
cauggcagaguuuguguguuguc

SEQ ID NO: 1274095 - RNA, 15 nt, Homo sapiens
cauggcauugaacug

SEQ ID NO: 1274096 - RNA, 21 nt, Homo sapiens
cauggccagguggccacucca

SEQ ID NO: 1274097 - RNA, 14 nt, Homo sapiens
cauggccauggcag

SEQ ID NO: 1274098 - RNA, 21 nt, Homo sapiens
cauggcccuucaaauuggaau

SEQ ID NO: 1274099 - RNA, 15 nt, Homo sapiens
cauggccuaugcaca

SEQ ID NO: 1274100 - RNA, 19 nt, Homo sapiens
cauggccuaugcacauaug

SEQ ID NO: 1274101 - RNA, 22 nt, Homo sapiens
cauggccuugaaacaguuccau

SEQ ID NO: 1274102 - RNA, 15 nt, Homo sapiens
cauggcucucugcag

SEQ ID NO: 1274103 - RNA, 14 nt, Homo sapiens
cauggcugaaguca

SEQ ID NO: 1274104 - RNA, 15 nt, Homo sapiens
caugggaaaacagac

SEQ ID NO: 1274105 - RNA, 23 nt, Homo sapiens
caugggaagggcucccagccaca

SEQ ID NO: 1274106 - RNA, 18 nt, Homo sapiens
caugggcaccaaccugca

SEQ ID NO: 1274107 - RNA, 20 nt, Homo sapiens
caugguaaaaccccaucucu

SEQ ID NO: 1274108 - RNA, 20 nt, Homo sapiens
cauggugaaaccccgucucu

SEQ ID NO: 1274109 - RNA, 18 nt, Homo sapiens
cauggugugaguccaaag

SEQ ID NO: 1274110 - RNA, 20 nt, Homo sapiens
caugguuacaaacuacagac

SEQ ID NO: 1274111 - RNA, 16 nt, Homo sapiens
cauguaagccaaguca

SEQ ID NO: 1274112 - RNA, 17 nt, Homo sapiens
cauguagagaaaagcac

SEQ ID NO: 1274113 - RNA, 17 nt, Homo sapiens
cauguaguaguacuuga

SEQ ID NO: 1274114 - RNA, 15 nt, Homo sapiens
cauguaguuacuucc

SEQ ID NO: 1274115 - RNA, 17 nt, Homo sapiens
cauguauguuaugauau

SEQ ID NO: 1274116 - RNA, 20 nt, Homo sapiens
caugucccaaaccagacacc

SEQ ID NO: 1274117 - RNA, 16 nt, Homo sapiens
caugucuauucagcuu

SEQ ID NO: 1274118 - RNA, 22 nt, Homo sapiens
caugucuuuacuggaccugaaa

SEQ ID NO: 1274119 - RNA, 23 nt, Homo sapiens
caugugacaaagggccagcaguc

SEQ ID NO: 1274120 - RNA, 13 nt, Homo sapiens
caugugacauuua

SEQ ID NO: 1274121 - RNA, 19 nt, Homo sapiens
caugugacuggcaguauua

SEQ ID NO: 1274122 - RNA, 17 nt, Homo sapiens
caugugagccaccgcug

SEQ ID NO: 1274123 - RNA, 14 nt, Homo sapiens
caugugcacuugaa

SEQ ID NO: 1274124 - RNA, 16 nt, Homo sapiens
caugugccgaaugugc

SEQ ID NO: 1274125 - RNA, 13 nt, Homo sapiens
caugugccuuuag

SEQ ID NO: 1274126 - RNA, 19 nt, Homo sapiens
caugugcgcgcgugcaugu

SEQ ID NO: 1274127 - RNA, 19 nt, Homo sapiens
cauguggaagcacuuuaag

SEQ ID NO: 1274128 - RNA, 21 nt, Homo sapiens
cauguggagaaaggagugaaa

SEQ ID NO: 1274129 - RNA, 20 nt, Homo sapiens
cauguggcauguucaucgua

SEQ ID NO: 1274130 - RNA, 23 nt, Homo sapiens
cauguguaccuacagagcagcca

SEQ ID NO: 1274131 - RNA, 14 nt, Homo sapiens
cauguguaccucag

SEQ ID NO: 1274132 - RNA, 17 nt, Homo sapiens
cauguguguaagugugu

SEQ ID NO: 1274133 - RNA, 16 nt, Homo sapiens
cauguguguauauaug

SEQ ID NO: 1274134 - RNA, 20 nt, Homo sapiens
cauguuaacuuuauuacaau

SEQ ID NO: 1274135 - RNA, 22 nt, Homo sapiens
cauguuaagauaacuuacugua

SEQ ID NO: 1274136 - RNA, 21 nt, Homo sapiens
cauguuaaugacaauauucca

SEQ ID NO: 1274137 - RNA, 20 nt, Homo sapiens
cauguuauauuuaaugcauu

SEQ ID NO: 1274138 - RNA, 15 nt, Homo sapiens
cauguucacugugag

SEQ ID NO: 1274139 - RNA, 14 nt, Homo sapiens
cauguuccucaaaa

SEQ ID NO: 1274140 - RNA, 16 nt, Homo sapiens
cauguuguaaugcugc

SEQ ID NO: 1274141 - RNA, 21 nt, Homo sapiens
cauguuguugaggcugucaca

SEQ ID NO: 1274142 - RNA, 22 nt, Homo sapiens
cauguuguugaggcugucacag

SEQ ID NO: 1274143 - RNA, 15 nt, Homo sapiens
cauguuugcaccugu

SEQ ID NO: 1274144 - RNA, 19 nt, Homo sapiens
cauguuugcaccugugcau

SEQ ID NO: 1274145 - RNA, 23 nt, Homo sapiens
cauguuuugauuuguagcacuga

SEQ ID NO: 1274146 - RNA, 15 nt, Homo sapiens
cauguuuuguauaca

SEQ ID NO: 1274147 - RNA, 20 nt, Homo sapiens
cauuaaaacaaauccauaau

SEQ ID NO: 1274148 - RNA, 23 nt, Homo sapiens
cauuaaaccugucuccacugugc

SEQ ID NO: 1274149 - RNA, 18 nt, Homo sapiens
cauuaaagaaggguugag

SEQ ID NO: 1274150 - RNA, 14 nt, Homo sapiens
cauuaaauguuuga

SEQ ID NO: 1274151 - RNA, 18 nt, Homo sapiens
cauuaacaaaaauauuag

SEQ ID NO: 1274152 - RNA, 15 nt, Homo sapiens
cauuaaccugagguc

SEQ ID NO: 1274153 - RNA, 18 nt, Homo sapiens
cauuaauagcagccuuuc

SEQ ID NO: 1274154 - RNA, 13 nt, Homo sapiens
cauuaauguuucu

SEQ ID NO: 1274155 - RNA, 13 nt, Homo sapiens
cauuaccaucucu

SEQ ID NO: 1274156 - RNA, 22 nt, Homo sapiens
cauuaccgucauuggccuguga

SEQ ID NO: 1274157 - RNA, 15 nt, Homo sapiens
cauuacuauucacug

SEQ ID NO: 1274158 - RNA, 22 nt, Homo sapiens
cauuacugccaucuuuaucaug

SEQ ID NO: 1274159 - RNA, 12 nt, Homo sapiens
cauuacuuugau

SEQ ID NO: 1274160 - RNA, 19 nt, Homo sapiens
cauuagcuuccugccccag

SEQ ID NO: 1274161 - RNA, 21 nt, Homo sapiens
cauuaggaagaaaggagcucc

SEQ ID NO: 1274162 - RNA, 16 nt, Homo sapiens
cauuagucucauguga

SEQ ID NO: 1274163 - RNA, 15 nt, Homo sapiens
cauuauacauuugau

SEQ ID NO: 1274164 - RNA, 17 nt, Homo sapiens
cauuaucacagugaaug

SEQ ID NO: 1274165 - RNA, 22 nt, Homo sapiens
cauuccauuuugugaauuguga

SEQ ID NO: 1274166 - RNA, 19 nt, Homo sapiens
cauucccccuuccuaguga

SEQ ID NO: 1274167 - RNA, 20 nt, Homo sapiens
cauuccccuccccacuccuc

SEQ ID NO: 1274168 - RNA, 14 nt, Homo sapiens
cauuccugacaaag

SEQ ID NO: 1274169 - RNA, 16 nt, Homo sapiens
cauuccuuugucuuca

SEQ ID NO: 1274170 - RNA, 14 nt, Homo sapiens
cauucuacuagcag

SEQ ID NO: 1274171 - RNA, 16 nt, Homo sapiens
cauucugaccauuuca

SEQ ID NO: 1274172 - RNA, 17 nt, Homo sapiens
cauucugccugcccagg

SEQ ID NO: 1274173 - RNA, 17 nt, Homo sapiens
cauucuggaaaagcaaa

SEQ ID NO: 1274174 - RNA, 23 nt, Homo sapiens
cauucuggacaccaggggaccug

SEQ ID NO: 1274175 - RNA, 19 nt, Homo sapiens
cauucuguggccagccaaa

SEQ ID NO: 1274176 - RNA, 13 nt, Homo sapiens
cauucuuccaaaa

SEQ ID NO: 1274177 - RNA, 14 nt, Homo sapiens
cauugaaaugucac

SEQ ID NO: 1274178 - RNA, 19 nt, Homo sapiens
cauugaagccgacucuggc

SEQ ID NO: 1274179 - RNA, 23 nt, Homo sapiens
cauugaccgcgacuaauuucaaa

SEQ ID NO: 1274180 - RNA, 13 nt, Homo sapiens
cauugacugucac

SEQ ID NO: 1274181 - RNA, 18 nt, Homo sapiens
cauugagaucacuacuca

SEQ ID NO: 1274182 - RNA, 23 nt, Homo sapiens
cauugagcugauauaaauucugu

SEQ ID NO: 1274183 - RNA, 20 nt, Homo sapiens
cauugaugacccucugaccc

SEQ ID NO: 1274184 - RNA, 17 nt, Homo sapiens
cauugauggccucaaug

SEQ ID NO: 1274185 - RNA, 17 nt, Homo sapiens
cauugauuuaauguaau

SEQ ID NO: 1274186 - RNA, 14 nt, Homo sapiens
cauugcacuuugau

SEQ ID NO: 1274187 - RNA, 17 nt, Homo sapiens
cauugcuaaacugauga

SEQ ID NO: 1274188 - RNA, 14 nt, Homo sapiens
cauugcucuaugaa

SEQ ID NO: 1274189 - RNA, 17 nt, Homo sapiens
cauugcuugugccacac

SEQ ID NO: 1274190 - RNA, 17 nt, Homo sapiens
cauuggaacaacugaua

SEQ ID NO: 1274191 - RNA, 17 nt, Homo sapiens
cauuggaauaaggcaug

SEQ ID NO: 1274192 - RNA, 15 nt, Homo sapiens
cauuggacuuccucc

SEQ ID NO: 1274193 - RNA, 22 nt, Homo sapiens
cauuggauucaucagcauuugg

SEQ ID NO: 1274194 - RNA, 19 nt, Homo sapiens
cauuggcacuguggagcuc

SEQ ID NO: 1274195 - RNA, 23 nt, Homo sapiens
cauuggucuaauuuauucaaagg

SEQ ID NO: 1274196 - RNA, 16 nt, Homo sapiens
cauuggugacucacuu

SEQ ID NO: 1274197 - RNA, 22 nt, Homo sapiens
cauuguaagcccacaguaggca

SEQ ID NO: 1274198 - RNA, 15 nt, Homo sapiens
cauuguagaaacaca

SEQ ID NO: 1274199 - RNA, 23 nt, Homo sapiens
cauugucgcuauugauuuuuacu

SEQ ID NO: 1274200 - RNA, 22 nt, Homo sapiens
cauugucguauaggcauguaaa

SEQ ID NO: 1274201 - RNA, 17 nt, Homo sapiens
cauugugaaaaggcaaa

SEQ ID NO: 1274202 - RNA, 15 nt, Homo sapiens
cauugugacacuucc

SEQ ID NO: 1274203 - RNA, 17 nt, Homo sapiens
cauugugaucagcuagc

SEQ ID NO: 1274204 - RNA, 17 nt, Homo sapiens
cauugugcugcaccugg

SEQ ID NO: 1274205 - RNA, 18 nt, Homo sapiens
cauuguggacuguaucca

SEQ ID NO: 1274206 - RNA, 17 nt, Homo sapiens
cauuguggcuccuaucu

SEQ ID NO: 1274207 - RNA, 21 nt, Homo sapiens
cauuguggcuccuaucugugu

SEQ ID NO: 1274208 - RNA, 19 nt, Homo sapiens
cauuguuuauuguauacug

SEQ ID NO: 1274209 - RNA, 16 nt, Homo sapiens
cauuuaaaauucaauu

SEQ ID NO: 1274210 - RNA, 22 nt, Homo sapiens
cauuuaaaauugcuauguuacu

SEQ ID NO: 1274211 - RNA, 18 nt, Homo sapiens
cauuuaaauuuuacccuu

SEQ ID NO: 1274212 - RNA, 20 nt, Homo sapiens
cauuuaauacagcaguguca

SEQ ID NO: 1274213 - RNA, 22 nt, Homo sapiens
cauuuacagaaacgcauccagc

SEQ ID NO: 1274214 - RNA, 22 nt, Homo sapiens
cauuuaccuuuucuccuacaaa

SEQ ID NO: 1274215 - RNA, 22 nt, Homo sapiens
cauuuacuuagcagaaccacau

SEQ ID NO: 1274216 - RNA, 12 nt, Homo sapiens
cauuuagcacaa

SEQ ID NO: 1274217 - RNA, 23 nt, Homo sapiens
cauuuagcuuguuccacugcaaa

SEQ ID NO: 1274218 - RNA, 16 nt, Homo sapiens
cauuuagucaugugac

SEQ ID NO: 1274219 - RNA, 17 nt, Homo sapiens
cauuuagucaugugacc

SEQ ID NO: 1274220 - RNA, 17 nt, Homo sapiens
cauuuagucuugccagg

SEQ ID NO: 1274221 - RNA, 22 nt, Homo sapiens
cauuuauaaccccagccugacc

SEQ ID NO: 1274222 - RNA, 14 nt, Homo sapiens
cauuuaucaccucu

SEQ ID NO: 1274223 - RNA, 20 nt, Homo sapiens
cauuuauucaaaguuaaaag

SEQ ID NO: 1274224 - RNA, 15 nt, Homo sapiens
cauuucaaaacccaa

SEQ ID NO: 1274225 - RNA, 16 nt, Homo sapiens
cauuucacacagugaa

SEQ ID NO: 1274226 - RNA, 17 nt, Homo sapiens
cauuucagaaaugcugu

SEQ ID NO: 1274227 - RNA, 23 nt, Homo sapiens
cauuucagagaggccuuuuggaa

SEQ ID NO: 1274228 - RNA, 22 nt, Homo sapiens
cauuuccucuuuccaagaccaa

SEQ ID NO: 1274229 - RNA, 16 nt, Homo sapiens
cauuuccuggucagug

SEQ ID NO: 1274230 - RNA, 22 nt, Homo sapiens
cauuucuacuuuuugcaccuua

SEQ ID NO: 1274231 - RNA, 22 nt, Homo sapiens
cauuucucaaaugcacaucuca

SEQ ID NO: 1274232 - RNA, 19 nt, Homo sapiens
cauuucucauaccuucccc

SEQ ID NO: 1274233 - RNA, 23 nt, Homo sapiens
cauuucucauaccuuccccacau

SEQ ID NO: 1274234 - RNA, 19 nt, Homo sapiens
cauuucuccguugagucau

SEQ ID NO: 1274235 - RNA, 23 nt, Homo sapiens
cauuucucuaacuccugccauuc

SEQ ID NO: 1274236 - RNA, 22 nt, Homo sapiens
cauuucuggaaagugcaauuau

SEQ ID NO: 1274237 - RNA, 16 nt, Homo sapiens
cauuucuguaaauacc

SEQ ID NO: 1274238 - RNA, 20 nt, Homo sapiens
cauuucuguaaauaccauug

SEQ ID NO: 1274239 - RNA, 17 nt, Homo sapiens
cauuucugucacucaca

SEQ ID NO: 1274240 - RNA, 15 nt, Homo sapiens
cauuucugucuccag

SEQ ID NO: 1274241 - RNA, 17 nt, Homo sapiens
cauuucuucagucagaa

SEQ ID NO: 1274242 - RNA, 13 nt, Homo sapiens
cauuucuugaugu

SEQ ID NO: 1274243 - RNA, 15 nt, Homo sapiens
cauuucuugugaugu

SEQ ID NO: 1274244 - RNA, 17 nt, Homo sapiens
cauuucuuuucugcaug

SEQ ID NO: 1274245 - RNA, 20 nt, Homo sapiens
cauuugaguugcccaucuug

SEQ ID NO: 1274246 - RNA, 19 nt, Homo sapiens
cauuugauaaaauccaaaa

SEQ ID NO: 1274247 - RNA, 14 nt, Homo sapiens
cauuugauggccac

SEQ ID NO: 1274248 - RNA, 20 nt, Homo sapiens
cauuugauggccaccagcuu

SEQ ID NO: 1274249 - RNA, 14 nt, Homo sapiens
cauuugcauuugcu

SEQ ID NO: 1274250 - RNA, 19 nt, Homo sapiens
cauuugcucuuucaucucu

SEQ ID NO: 1274251 - RNA, 13 nt, Homo sapiens
cauuuggaaugaa

SEQ ID NO: 1274252 - RNA, 21 nt, Homo sapiens
cauuugguagaaggacugaac

SEQ ID NO: 1274253 - RNA, 21 nt, Homo sapiens
cauuuggugguacuuuauucu

SEQ ID NO: 1274254 - RNA, 18 nt, Homo sapiens
cauuuguauauuguggau

SEQ ID NO: 1274255 - RNA, 12 nt, Homo sapiens
cauuugucacag

SEQ ID NO: 1274256 - RNA, 21 nt, Homo sapiens
cauuugucaguauuuuugccg

SEQ ID NO: 1274257 - RNA, 15 nt, Homo sapiens
cauuugugucaaugg

SEQ ID NO: 1274258 - RNA, 16 nt, Homo sapiens
cauuugugugcucaug

SEQ ID NO: 1274259 - RNA, 22 nt, Homo sapiens
cauuuguguuuugaaagcccaa

SEQ ID NO: 1274260 - RNA, 18 nt, Homo sapiens
cauuuguuuguauacaua

SEQ ID NO: 1274261 - RNA, 18 nt, Homo sapiens
cauuuuaacgcugccuaa

SEQ ID NO: 1274262 - RNA, 22 nt, Homo sapiens
cauuuuaauaucuuaugcuauu

SEQ ID NO: 1274263 - RNA, 19 nt, Homo sapiens
cauuuuacaggugcgaaug

SEQ ID NO: 1274264 - RNA, 17 nt, Homo sapiens
cauuuuauguuaaggga

SEQ ID NO: 1274265 - RNA, 15 nt, Homo sapiens
cauuuucuuucaugg

SEQ ID NO: 1274266 - RNA, 17 nt, Homo sapiens
cauuuugacagcaucuu

SEQ ID NO: 1274267 - RNA, 14 nt, Homo sapiens
cauuuugcaaaauu

SEQ ID NO: 1274268 - RNA, 19 nt, Homo sapiens
cauuuugcaaaauuuccag

SEQ ID NO: 1274269 - RNA, 17 nt, Homo sapiens
cauuuugugaauuguga

SEQ ID NO: 1274270 - RNA, 18 nt, Homo sapiens
cauuuuguucuuacacau

SEQ ID NO: 1274271 - RNA, 15 nt, Homo sapiens
cauuuuuaacagcau

SEQ ID NO: 1274272 - RNA, 19 nt, Homo sapiens
ccuccacugccucuggaau

SEQ ID NO: 1274273 - RNA, 13 nt, Homo sapiens
ccuccacugcugc

SEQ ID NO: 1274274 - RNA, 22 nt, Homo sapiens
ccuccaggaugaguuacuugaa

SEQ ID NO: 1274275 - RNA, 23 nt, Homo sapiens
ccuccaggugugcacguggcaug

SEQ ID NO: 1274276 - RNA, 12 nt, Homo sapiens
ccuccaguucau

SEQ ID NO: 1274277 - RNA, 16 nt, Homo sapiens
ccuccauacucaggac

SEQ ID NO: 1274278 - RNA, 13 nt, Homo sapiens
ccuccauccagaa

SEQ ID NO: 1274279 - RNA, 13 nt, Homo sapiens
ccuccauccugag

SEQ ID NO: 1274280 - RNA, 11 nt, Homo sapiens
ccuccaugacc

SEQ ID NO: 1274281 - RNA, 12 nt, Homo sapiens
ccuccauucuga

SEQ ID NO: 1274282 - RNA, 21 nt, Homo sapiens
ccucccaaagugcugggauua

SEQ ID NO: 1274283 - RNA, 15 nt, Homo sapiens
ccucccaaguagcug

SEQ ID NO: 1274284 - RNA, 14 nt, Homo sapiens
ccucccacugcccc

SEQ ID NO: 1274285 - RNA, 16 nt, Homo sapiens
ccucccagguugacac

SEQ ID NO: 1274286 - RNA, 14 nt, Homo sapiens
ccuccccacccucc

SEQ ID NO: 1274287 - RNA, 18 nt, Homo sapiens
ccuccccgugccaaaaau

SEQ ID NO: 1274288 - RNA, 14 nt, Homo sapiens
ccucccgggcucaa

SEQ ID NO: 1274289 - RNA, 20 nt, Homo sapiens
ccucccggguucgcaccauu

SEQ ID NO: 1274290 - RNA, 21 nt, Homo sapiens
ccucccuagccagcacuugua

SEQ ID NO: 1274291 - RNA, 16 nt, Homo sapiens
ccucccuggaugacau

SEQ ID NO: 1274292 - RNA, 16 nt, Homo sapiens
ccuccgaccacuucca

SEQ ID NO: 1274293 - RNA, 18 nt, Homo sapiens
ccuccgccagauccugca

SEQ ID NO: 1274294 - RNA, 16 nt, Homo sapiens
ccuccuagauguaaca

SEQ ID NO: 1274295 - RNA, 13 nt, Homo sapiens
ccuccucaccucu

SEQ ID NO: 1274296 - RNA, 19 nt, Homo sapiens
ccuccucagaggacaguuu

SEQ ID NO: 1274297 - RNA, 20 nt, Homo sapiens
ccuccucaggcacacagcua

SEQ ID NO: 1274298 - RNA, 12 nt, Homo sapiens
ccuccucaguga

SEQ ID NO: 1274299 - RNA, 14 nt, Homo sapiens
ccuccucagugaca

SEQ ID NO: 1274300 - RNA, 14 nt, Homo sapiens
ccuccucuagcugu

SEQ ID NO: 1274301 - RNA, 21 nt, Homo sapiens
ccuccucucaguguuuuggac

SEQ ID NO: 1274302 - RNA, 19 nt, Homo sapiens
ccuccucuucugacgugcc

SEQ ID NO: 1274303 - RNA, 23 nt, Homo sapiens
ccuccugggcccacaacagcgug

SEQ ID NO: 1274304 - RNA, 22 nt, Homo sapiens
ccuccuguaaaugguguacaua

SEQ ID NO: 1274305 - RNA, 16 nt, Homo sapiens
ccuccuuugccuucca

SEQ ID NO: 1274306 - RNA, 13 nt, Homo sapiens
ccucgcaugacug

SEQ ID NO: 1274307 - RNA, 16 nt, Homo sapiens
ccucgcaugacuguua

SEQ ID NO: 1274308 - RNA, 16 nt, Homo sapiens
ccucgcccuccacaaa

SEQ ID NO: 1274309 - RNA, 19 nt, Homo sapiens
ccucgggccccauccucau

SEQ ID NO: 1274310 - RNA, 21 nt, Homo sapiens
ccucgggccgaggcccagcgg

SEQ ID NO: 1274311 - RNA, 13 nt, Homo sapiens
ccucgugaaguca

SEQ ID NO: 1274312 - RNA, 12 nt, Homo sapiens
ccucuaaugaga

SEQ ID NO: 1274313 - RNA, 18 nt, Homo sapiens
ccucuacuuaaugagaua

SEQ ID NO: 1274314 - RNA, 15 nt, Homo sapiens
ccucuagaagccaag

SEQ ID NO: 1274315 - RNA, 13 nt, Homo sapiens
ccucucaugacuu

SEQ ID NO: 1274316 - RNA, 19 nt, Homo sapiens
ccucuccaagggcuucugc

SEQ ID NO: 1274317 - RNA, 20 nt, Homo sapiens
ccucuccaggaaugccuccu

SEQ ID NO: 1274318 - RNA, 22 nt, Homo sapiens
ccucuccccaagaggaacugaa

SEQ ID NO: 1274319 - RNA, 20 nt, Homo sapiens
ccucucccgucagggcccaa

SEQ ID NO: 1274320 - RNA, 15 nt, Homo sapiens
ccucucccugccaag

SEQ ID NO: 1274321 - RNA, 15 nt, Homo sapiens
ccucuccuccagugu

SEQ ID NO: 1274322 - RNA, 17 nt, Homo sapiens
ccucuccuuccuuaccc

SEQ ID NO: 1274323 - RNA, 23 nt, Homo sapiens
ccucucuagcacaauuugcacua

SEQ ID NO: 1274324 - RNA, 21 nt, Homo sapiens
ccucucuaggccuguugccuc

SEQ ID NO: 1274325 - RNA, 12 nt, Homo sapiens
ccucucucagga

SEQ ID NO: 1274326 - RNA, 19 nt, Homo sapiens
ccucucucuucugcuccac

SEQ ID NO: 1274327 - RNA, 14 nt, Homo sapiens
ccucugaaaugccu

SEQ ID NO: 1274328 - RNA, 15 nt, Homo sapiens
ccucugaaaugccuc

SEQ ID NO: 1274329 - RNA, 20 nt, Homo sapiens
ccucugacuaguagauuucu

SEQ ID NO: 1274330 - RNA, 14 nt, Homo sapiens
ccucugagcccagc

SEQ ID NO: 1274331 - RNA, 18 nt, Homo sapiens
ccucugcagaacagugaa

SEQ ID NO: 1274332 - RNA, 16 nt, Homo sapiens
ccucugcuacuccauc

SEQ ID NO: 1274333 - RNA, 16 nt, Homo sapiens
ccucugcuauuugcug

SEQ ID NO: 1274334 - RNA, 16 nt, Homo sapiens
ccucuggagcccuaac

SEQ ID NO: 1274335 - RNA, 21 nt, Homo sapiens
ccucuggggaccccaaccuca

SEQ ID NO: 1274336 - RNA, 23 nt, Homo sapiens
ccucugguuuuccucugcuccuc

SEQ ID NO: 1274337 - RNA, 11 nt, Homo sapiens
ccucuguggac

SEQ ID NO: 1274338 - RNA, 18 nt, Homo sapiens
ccucuguucauuucacac

SEQ ID NO: 1274339 - RNA, 13 nt, Homo sapiens
ccucuucccauga

SEQ ID NO: 1274340 - RNA, 24 nt, Homo sapiens
ccucuuccccagaaaggagacuag

SEQ ID NO: 1274341 - RNA, 21 nt, Homo sapiens
ccucuucccccuuccaaauaa

SEQ ID NO: 1274342 - RNA, 16 nt, Homo sapiens
ccucuuccccuugccc

SEQ ID NO: 1274343 - RNA, 13 nt, Homo sapiens
ccucuugcucaaa

SEQ ID NO: 1274344 - RNA, 15 nt, Homo sapiens
ccucuuuucucugug

SEQ ID NO: 1274345 - RNA, 17 nt, Homo sapiens
ccucuuuuuagggcuaa

SEQ ID NO: 1274346 - RNA, 19 nt, Homo sapiens
ccugaaaagcugcauuuaa

SEQ ID NO: 1274347 - RNA, 15 nt, Homo sapiens
ccugaaaauugcaau

SEQ ID NO: 1274348 - RNA, 19 nt, Homo sapiens
ccugaaagcaacuacagaa

SEQ ID NO: 1274349 - RNA, 19 nt, Homo sapiens
ccugaaagccacaaugaga

SEQ ID NO: 1274350 - RNA, 20 nt, Homo sapiens
ccugaaauaaacacuggugc

SEQ ID NO: 1274351 - RNA, 20 nt, Homo sapiens
ccugaaauuuauucacauau

SEQ ID NO: 1274352 - RNA, 18 nt, Homo sapiens
ccugaaccuggagcacuu

SEQ ID NO: 1274353 - RNA, 19 nt, Homo sapiens
ccugaaccuggagcacuua

SEQ ID NO: 1274354 - RNA, 13 nt, Homo sapiens
ccugaacuugccu

SEQ ID NO: 1274355 - RNA, 16 nt, Homo sapiens
ccugaagaacugucua

SEQ ID NO: 1274356 - RNA, 13 nt, Homo sapiens
ccugaagacugag

SEQ ID NO: 1274357 - RNA, 22 nt, Homo sapiens
ccugaagacugaggacaaagug

SEQ ID NO: 1274358 - RNA, 13 nt, Homo sapiens
ccugaagucacac

SEQ ID NO: 1274359 - RNA, 14 nt, Homo sapiens
ccugaauccauuaa

SEQ ID NO: 1274360 - RNA, 13 nt, Homo sapiens
ccugaaugaaaua

SEQ ID NO: 1274361 - RNA, 21 nt, Homo sapiens
ccugaauucuuuuucauuuga

SEQ ID NO: 1274362 - RNA, 19 nt, Homo sapiens
ccugacaaguuauuacugu

SEQ ID NO: 1274363 - RNA, 15 nt, Homo sapiens
ccugccaggcugcua

SEQ ID NO: 1274364 - RNA, 10 nt, Homo sapiens
ccugccauuc

SEQ ID NO: 1274365 - RNA, 14 nt, Homo sapiens
ccugcccaaugaga

SEQ ID NO: 1274366 - RNA, 14 nt, Homo sapiens
ccugccccacccua

SEQ ID NO: 1274367 - RNA, 18 nt, Homo sapiens
ccugccccugcaaagaca

SEQ ID NO: 1274368 - RNA, 13 nt, Homo sapiens
ccugccccuggug

SEQ ID NO: 1274369 - RNA, 13 nt, Homo sapiens
ccugccgucuuca

SEQ ID NO: 1274370 - RNA, 22 nt, Homo sapiens
ccugccgucuucacuuccccac

SEQ ID NO: 1274371 - RNA, 13 nt, Homo sapiens
ccugccuggucac

SEQ ID NO: 1274372 - RNA, 10 nt, Homo sapiens
ccugccugua

SEQ ID NO: 1274373 - RNA, 19 nt, Homo sapiens
ccugccuguggcgccgucu

SEQ ID NO: 1274374 - RNA, 19 nt, Homo sapiens
ccugccuuaggguagugcu

SEQ ID NO: 1274375 - RNA, 16 nt, Homo sapiens
ccugcgagacgcacac

SEQ ID NO: 1274376 - RNA, 15 nt, Homo sapiens
ccugcggcccagaag

SEQ ID NO: 1274377 - RNA, 22 nt, Homo sapiens
ccugcggcuccggggccaaggc

SEQ ID NO: 1274378 - RNA, 12 nt, Homo sapiens
ccugcuaccugu

SEQ ID NO: 1274379 - RNA, 23 nt, Homo sapiens
ccugcucaacauaggccugcuca

SEQ ID NO: 1274380 - RNA, 23 nt, Homo sapiens
ccugcuccaagggacccuuugcc

SEQ ID NO: 1274381 - RNA, 16 nt, Homo sapiens
ccugcucccuagccag

SEQ ID NO: 1274382 - RNA, 18 nt, Homo sapiens
ccugcucuccucuugcca

SEQ ID NO: 1274383 - RNA, 23 nt, Homo sapiens
ccugcugcaggggcucuggagag

SEQ ID NO: 1274384 - RNA, 23 nt, Homo sapiens
ccugcugcaucuucccacagugg

SEQ ID NO: 1274385 - RNA, 12 nt, Homo sapiens
ccugcugugauu

SEQ ID NO: 1274386 - RNA, 18 nt, Homo sapiens
ccugcuuuggcagugcca

SEQ ID NO: 1274387 - RNA, 15 nt, Homo sapiens
ccugcuuuuugacau

SEQ ID NO: 1274388 - RNA, 17 nt, Homo sapiens
ccuggaaaccacagucc

SEQ ID NO: 1274389 - RNA, 20 nt, Homo sapiens
ccuggaaagaaaaagcaaua

SEQ ID NO: 1274390 - RNA, 16 nt, Homo sapiens
ccuggaacauccuuug

SEQ ID NO: 1274391 - RNA, 20 nt, Homo sapiens
ccuggaaucaagaugucaga

SEQ ID NO: 1274392 - RNA, 23 nt, Homo sapiens
ccuggacaaggcuaacaucccac

SEQ ID NO: 1274393 - RNA, 16 nt, Homo sapiens
ccuggacacgcuggug

SEQ ID NO: 1274394 - RNA, 14 nt, Homo sapiens
ccuggacuccagua

SEQ ID NO: 1274395 - RNA, 20 nt, Homo sapiens
ccuggagaugcugccuggug

SEQ ID NO: 1274396 - RNA, 13 nt, Homo sapiens
ccuggagcacuua

SEQ ID NO: 1274397 - RNA, 12 nt, Homo sapiens
ccuggagcugcu

SEQ ID NO: 1274398 - RNA, 18 nt, Homo sapiens
ccuggaggccgcagccaa

SEQ ID NO: 1274399 - RNA, 17 nt, Homo sapiens
ccuggaggcggcaaagg

SEQ ID NO: 1274400 - RNA, 22 nt, Homo sapiens
ccuggaguguaugacugcacau

SEQ ID NO: 1274401 - RNA, 23 nt, Homo sapiens
ccuggaguguaugacugcacaug

SEQ ID NO: 1274402 - RNA, 17 nt, Homo sapiens
ccuggaucuaccagcau

SEQ ID NO: 1274403 - RNA, 19 nt, Homo sapiens
ccuggaugucugggugacc

SEQ ID NO: 1274404 - RNA, 18 nt, Homo sapiens
ccuggauuccucacuuug

SEQ ID NO: 1274405 - RNA, 20 nt, Homo sapiens
ccuggcacccccacaagcug

SEQ ID NO: 1274406 - RNA, 19 nt, Homo sapiens
ccuggcacugguuuguucc

SEQ ID NO: 1274407 - RNA, 17 nt, Homo sapiens
ccuggcagggcccagug

SEQ ID NO: 1274408 - RNA, 12 nt, Homo sapiens
ccuggcaguuua

SEQ ID NO: 1274409 - RNA, 17 nt, Homo sapiens
ccuggcccagaugauau

SEQ ID NO: 1274410 - RNA, 18 nt, Homo sapiens
ccuggcccagaugauaua

SEQ ID NO: 1274411 - RNA, 18 nt, Homo sapiens
ccuggcccccaaccucag

SEQ ID NO: 1274412 - RNA, 14 nt, Homo sapiens
ccuggccucaagug

SEQ ID NO: 1274413 - RNA, 15 nt, Homo sapiens
ccuggccucaaguga

SEQ ID NO: 1274414 - RNA, 19 nt, Homo sapiens
ccuggccugguugugugca

SEQ ID NO: 1274415 - RNA, 19 nt, Homo sapiens
ccuggcuaagaucaugucu

SEQ ID NO: 1274416 - RNA, 21 nt, Homo sapiens
ccuggcuccaacacugcugcu

SEQ ID NO: 1274417 - RNA, 19 nt, Homo sapiens
ccuggcuggaagaggguga

SEQ ID NO: 1274418 - RNA, 16 nt, Homo sapiens
ccuggcuggugacaga

SEQ ID NO: 1274419 - RNA, 17 nt, Homo sapiens
ccugggaaaggacccac

SEQ ID NO: 1274420 - RNA, 19 nt, Homo sapiens
ccugggaauguauuauucu

SEQ ID NO: 1274421 - RNA, 21 nt, Homo sapiens
ccugggagcccccaccacaaa

SEQ ID NO: 1274422 - RNA, 22 nt, Homo sapiens
ccugggccccucuuauuccucu

SEQ ID NO: 1274423 - RNA, 16 nt, Homo sapiens
ccugggcccuuccuau

SEQ ID NO: 1274424 - RNA, 23 nt, Homo sapiens
ccugggcuuggccugcugugauu

SEQ ID NO: 1274425 - RNA, 18 nt, Homo sapiens
ccuggggacuguuccaaa

SEQ ID NO: 1274426 - RNA, 17 nt, Homo sapiens
ccuggggcagaaagcca

SEQ ID NO: 1274427 - RNA, 20 nt, Homo sapiens
ccuggggcaggucacuuuac

SEQ ID NO: 1274428 - RNA, 18 nt, Homo sapiens
ccugggggccgugcucac

SEQ ID NO: 1274429 - RNA, 16 nt, Homo sapiens
ccuggggugaauacuu

SEQ ID NO: 1274430 - RNA, 18 nt, Homo sapiens
ccugggucucugggcaca

SEQ ID NO: 1274431 - RNA, 13 nt, Homo sapiens
ccugggugggugg

SEQ ID NO: 1274432 - RNA, 15 nt, Homo sapiens
ccugguauauccaaa

SEQ ID NO: 1274433 - RNA, 11 nt, Homo sapiens
ccuggucaguc

SEQ ID NO: 1274434 - RNA, 19 nt, Homo sapiens
ccuggugcccugagacaga

SEQ ID NO: 1274435 - RNA, 21 nt, Homo sapiens
ccugguggagaaagcacugac

SEQ ID NO: 1274436 - RNA, 23 nt, Homo sapiens
ccugguguaguuucuucauuuca

SEQ ID NO: 1274437 - RNA, 22 nt, Homo sapiens
ccuggugucugcccugcuggga

SEQ ID NO: 1274438 - RNA, 17 nt, Homo sapiens
ccuggugugcaggguga

SEQ ID NO: 1274439 - RNA, 21 nt, Homo sapiens
ccugguuaaauuugaauuuca

SEQ ID NO: 1274440 - RNA, 19 nt, Homo sapiens
ccuguaaucccaacacuuu

SEQ ID NO: 1274441 - RNA, 18 nt, Homo sapiens
ccuguaaucccagcacuu

SEQ ID NO: 1274442 - RNA, 18 nt, Homo sapiens
ccuguaaucucagcacuu

SEQ ID NO: 1274443 - RNA, 14 nt, Homo sapiens
ccuguacacaggcg

SEQ ID NO: 1274444 - RNA, 17 nt, Homo sapiens
ccuguacuguauggaaa

SEQ ID NO: 1274445 - RNA, 17 nt, Homo sapiens
ccuguagcagccagucc

SEQ ID NO: 1274446 - RNA, 17 nt, Homo sapiens
ccuguagcagucacuga

SEQ ID NO: 1274447 - RNA, 22 nt, Homo sapiens
ccuguagucccagcuacuugag

SEQ ID NO: 1274448 - RNA, 19 nt, Homo sapiens
ccuguaucuauuguauauu

SEQ ID NO: 1274449 - RNA, 15 nt, Homo sapiens
ccuguauggcacugg

SEQ ID NO: 1274450 - RNA, 20 nt, Homo sapiens
ccuguauucuucaaccagug

SEQ ID NO: 1274451 - RNA, 16 nt, Homo sapiens
ccuguccacacccagc

SEQ ID NO: 1274452 - RNA, 16 nt, Homo sapiens
ccuuugugcacauuua

SEQ ID NO: 1274453 - RNA, 14 nt, Homo sapiens
ccuuuuaaaaaccu

SEQ ID NO: 1274454 - RNA, 21 nt, Homo sapiens
ccuuuuagccuaguucaucca

SEQ ID NO: 1274455 - RNA, 13 nt, Homo sapiens
ccuuuuauacuga

SEQ ID NO: 1274456 - RNA, 13 nt, Homo sapiens
ccuuuucauuuaa

SEQ ID NO: 1274457 - RNA, 12 nt, Homo sapiens
ccuuuuccagaa

SEQ ID NO: 1274458 - RNA, 18 nt, Homo sapiens
ccuuuuccccagucccag

SEQ ID NO: 1274459 - RNA, 21 nt, Homo sapiens
ccuuuucuauuccuucuggcc

SEQ ID NO: 1274460 - RNA, 13 nt, Homo sapiens
ccuuuucuguucu

SEQ ID NO: 1274461 - RNA, 17 nt, Homo sapiens
ccuuuuggaacauuucu

SEQ ID NO: 1274462 - RNA, 19 nt, Homo sapiens
ccuuuugucuucucugucu

SEQ ID NO: 1274463 - RNA, 14 nt, Homo sapiens
ccuuuugugugaug

SEQ ID NO: 1274464 - RNA, 21 nt, Homo sapiens
ccuuuuuaaaaagcaccuauu

SEQ ID NO: 1274465 - RNA, 13 nt, Homo sapiens
ccuuuuucaauga

SEQ ID NO: 1274466 - RNA, 16 nt, Homo sapiens
ccuuuuuuguuauuau

SEQ ID NO: 1274467 - RNA, 15 nt, Homo sapiens
cgaaaaggauaugca

SEQ ID NO: 1274468 - RNA, 21 nt, Homo sapiens
cgaaaccugggauucaggaau

SEQ ID NO: 1274469 - RNA, 18 nt, Homo sapiens
cgaaauaacaauguuaag

SEQ ID NO: 1274470 - RNA, 14 nt, Homo sapiens
cgaaaucaaaccac

SEQ ID NO: 1274471 - RNA, 18 nt, Homo sapiens
cgaaaucuuagugcccac

SEQ ID NO: 1274472 - RNA, 15 nt, Homo sapiens
cgaacauucuuugcc

SEQ ID NO: 1274473 - RNA, 15 nt, Homo sapiens
cgaaggcauuuucca

SEQ ID NO: 1274474 - RNA, 17 nt, Homo sapiens
cgaaucuacuaauucca

SEQ ID NO: 1274475 - RNA, 20 nt, Homo sapiens
cgaauuagcaauaacauaca

SEQ ID NO: 1274476 - RNA, 17 nt, Homo sapiens
cgaauucgcuguuaccg

SEQ ID NO: 1274477 - RNA, 16 nt, Homo sapiens
cgacauuccugaaaua

SEQ ID NO: 1274478 - RNA, 22 nt, Homo sapiens
cgaccaccuccaggacucagug

SEQ ID NO: 1274479 - RNA, 11 nt, Homo sapiens
cgacccauuca

SEQ ID NO: 1274480 - RNA, 18 nt, Homo sapiens
cgaccccuaguucccucu

SEQ ID NO: 1274481 - RNA, 16 nt, Homo sapiens
cgaccugcgccaaucc

SEQ ID NO: 1274482 - RNA, 17 nt, Homo sapiens
cgacuaauuucaaaaug

SEQ ID NO: 1274483 - RNA, 13 nt, Homo sapiens
cgacugggcucaa

SEQ ID NO: 1274484 - RNA, 11 nt, Homo sapiens
cgacuguaaau

SEQ ID NO: 1274485 - RNA, 18 nt, Homo sapiens
cgacuuauuuuguugaaa

SEQ ID NO: 1274486 - RNA, 22 nt, Homo sapiens
cgagaaggccgaggaauccuca

SEQ ID NO: 1274487 - RNA, 20 nt, Homo sapiens
cgagaucacgccacugcacu

SEQ ID NO: 1274488 - RNA, 21 nt, Homo sapiens
cgagaucgcgccacugcacuc

SEQ ID NO: 1274489 - RNA, 12 nt, Homo sapiens
cgagaugagccc

SEQ ID NO: 1274490 - RNA, 19 nt, Homo sapiens
cgagauugcaccacugcac

SEQ ID NO: 1274491 - RNA, 20 nt, Homo sapiens
cgagauugcaccacugcacu

SEQ ID NO: 1274492 - RNA, 15 nt, Homo sapiens
cgagcagaugaugcc

SEQ ID NO: 1274493 - RNA, 21 nt, Homo sapiens
cgagccucugguuuuccucug

SEQ ID NO: 1274494 - RNA, 14 nt, Homo sapiens
cgagccugcacugg

SEQ ID NO: 1274495 - RNA, 22 nt, Homo sapiens
cgagcuaugaucgcgccacuac

SEQ ID NO: 1274496 - RNA, 20 nt, Homo sapiens
cgagcuguuaccauucacaa

SEQ ID NO: 1274497 - RNA, 14 nt, Homo sapiens
cgaggaaaagaaca

SEQ ID NO: 1274498 - RNA, 23 nt, Homo sapiens
cgaggaaaagaacaaacaaaacu

SEQ ID NO: 1274499 - RNA, 19 nt, Homo sapiens
cgaggacagggaggugacc

SEQ ID NO: 1274500 - RNA, 22 nt, Homo sapiens
cgaggacuacaaccaauuuaca

SEQ ID NO: 1274501 - RNA, 15 nt, Homo sapiens
cgaggcgaugccacg

SEQ ID NO: 1274502 - RNA, 23 nt, Homo sapiens
cgagggcugauggaggaaaaagg

SEQ ID NO: 1274503 - RNA, 15 nt, Homo sapiens
cgaguaacugagauu

SEQ ID NO: 1274504 - RNA, 14 nt, Homo sapiens
cgagucucuucucc

SEQ ID NO: 1274505 - RNA, 15 nt, Homo sapiens
cgaguggccauggca

SEQ ID NO: 1274506 - RNA, 14 nt, Homo sapiens
cgaguuaagaacau

SEQ ID NO: 1274507 - RNA, 14 nt, Homo sapiens
cgauauacagauga

SEQ ID NO: 1274508 - RNA, 18 nt, Homo sapiens
cgauccuggggcccucag

SEQ ID NO: 1274509 - RNA, 20 nt, Homo sapiens
cgaucuggguucacugcaac

SEQ ID NO: 1274510 - RNA, 23 nt, Homo sapiens
cgaugaggaccaagggcaccugg

SEQ ID NO: 1274511 - RNA, 12 nt, Homo sapiens
cgaugugcccag

SEQ ID NO: 1274512 - RNA, 18 nt, Homo sapiens
cgauuaaaaucacucuca

SEQ ID NO: 1274513 - RNA, 14 nt, Homo sapiens
cgauuagacuccau

SEQ ID NO: 1274514 - RNA, 20 nt, Homo sapiens
cgauucaucuacccugcuga

SEQ ID NO: 1274515 - RNA, 16 nt, Homo sapiens
cgauugaaagaaccag

SEQ ID NO: 1274516 - RNA, 15 nt, Homo sapiens
cgauuucuaccucag

SEQ ID NO: 1274517 - RNA, 16 nt, Homo sapiens
cgauuucuuuccucca

SEQ ID NO: 1274518 - RNA, 17 nt, Homo sapiens
cgcacaaggcugaccaa

SEQ ID NO: 1274519 - RNA, 21 nt, Homo sapiens
cgcacaaggcugaccaagaga

SEQ ID NO: 1274520 - RNA, 14 nt, Homo sapiens
cgcacagcaguucc

SEQ ID NO: 1274521 - RNA, 13 nt, Homo sapiens
cgcacaugcacac

SEQ ID NO: 1274522 - RNA, 16 nt, Homo sapiens
cgcaccacuguguauu

SEQ ID NO: 1274523 - RNA, 20 nt, Homo sapiens
cgcaccauucuccugccuca

SEQ ID NO: 1274524 - RNA, 22 nt, Homo sapiens
cgcacccaguuugauaccugca

SEQ ID NO: 1274525 - RNA, 12 nt, Homo sapiens
cgcacccggcuc

SEQ ID NO: 1274526 - RNA, 11 nt, Homo sapiens
cgcaccugccc

SEQ ID NO: 1274527 - RNA, 14 nt, Homo sapiens
cgcacuaacccagc

SEQ ID NO: 1274528 - RNA, 18 nt, Homo sapiens
cgcacucucauaugccac

SEQ ID NO: 1274529 - RNA, 17 nt, Homo sapiens
cgcacuggggcuggcaa

SEQ ID NO: 1274530 - RNA, 20 nt, Homo sapiens
cgcagacacacccacagaag

SEQ ID NO: 1274531 - RNA, 14 nt, Homo sapiens
cgcagacgggcaca

SEQ ID NO: 1274532 - RNA, 23 nt, Homo sapiens
cgcagcucccaggcccuggagac

SEQ ID NO: 1274533 - RNA, 14 nt, Homo sapiens
cgcaggcccaguga

SEQ ID NO: 1274534 - RNA, 16 nt, Homo sapiens
cgcagggguugcagug

SEQ ID NO: 1274535 - RNA, 16 nt, Homo sapiens
cgcauacacacaugcc

SEQ ID NO: 1274536 - RNA, 16 nt, Homo sapiens
cgcaucucagugcagg

SEQ ID NO: 1274537 - RNA, 19 nt, Homo sapiens
cgcaugugcagcuauuuaa

SEQ ID NO: 1274538 - RNA, 16 nt, Homo sapiens
cgcauuggugacucac

SEQ ID NO: 1274539 - RNA, 14 nt, Homo sapiens
cgccacacagacca

SEQ ID NO: 1274540 - RNA, 22 nt, Homo sapiens
cgccacauagguaaaaacugga

SEQ ID NO: 1274541 - RNA, 13 nt, Homo sapiens
cgccacucgcuuc

SEQ ID NO: 1274542 - RNA, 21 nt, Homo sapiens
cgccagauaaaauguucagug

SEQ ID NO: 1274543 - RNA, 19 nt, Homo sapiens
cgcccaggggcccgggaac

SEQ ID NO: 1274544 - RNA, 21 nt, Homo sapiens
cgcccagucuggaaugcagug

SEQ ID NO: 1274545 - RNA, 23 nt, Homo sapiens
cgcccagugcagucggugguacc

SEQ ID NO: 1274546 - RNA, 22 nt, Homo sapiens
cgccccagggcacuacauaauu

SEQ ID NO: 1274547 - RNA, 19 nt, Homo sapiens
cgccccccgccucucccca

SEQ ID NO: 1274548 - RNA, 19 nt, Homo sapiens
cgcccccuccgcccugcca

SEQ ID NO: 1274549 - RNA, 16 nt, Homo sapiens
cgcccgaccaggauca

SEQ ID NO: 1274550 - RNA, 15 nt, Homo sapiens
cgcccgcugagcuga

SEQ ID NO: 1274551 - RNA, 14 nt, Homo sapiens
cgccgugaguucuc

SEQ ID NO: 1274552 - RNA, 15 nt, Homo sapiens
cgccuaugaucccag

SEQ ID NO: 1274553 - RNA, 21 nt, Homo sapiens
cgccuaugaucccagcacuuu

SEQ ID NO: 1274554 - RNA, 18 nt, Homo sapiens
cgccucacugaaacaugg

SEQ ID NO: 1274555 - RNA, 12 nt, Homo sapiens
cgccugcuccuc

SEQ ID NO: 1274556 - RNA, 13 nt, Homo sapiens
cgccuggcacauu

SEQ ID NO: 1274557 - RNA, 22 nt, Homo sapiens
cgccuguaaucccagcacuuug

SEQ ID NO: 1274558 - RNA, 22 nt, Homo sapiens
cgccuguggacagccugaguca

SEQ ID NO: 1274559 - RNA, 23 nt, Homo sapiens
cgccuuaugccucagucuauucu

SEQ ID NO: 1274560 - RNA, 15 nt, Homo sapiens
cgccuuuuguauaca

SEQ ID NO: 1274561 - RNA, 20 nt, Homo sapiens
cgcgcaccuguaaucccagc

SEQ ID NO: 1274562 - RNA, 12 nt, Homo sapiens
cgcgcucgccca

SEQ ID NO: 1274563 - RNA, 13 nt, Homo sapiens
cgcggcucuccag

SEQ ID NO: 1274564 - RNA, 14 nt, Homo sapiens
cgcguacagaucuc

SEQ ID NO: 1274565 - RNA, 22 nt, Homo sapiens
cgcuaccucccuccccgucuca

SEQ ID NO: 1274566 - RNA, 22 nt, Homo sapiens
cgcuagagauugcuacaaaucu

SEQ ID NO: 1274567 - RNA, 16 nt, Homo sapiens
cgcuagcaguacuaau

SEQ ID NO: 1274568 - RNA, 15 nt, Homo sapiens
cgcuaugugcacuga

SEQ ID NO: 1274569 - RNA, 22 nt, Homo sapiens
cgcuauuccucacucagaggaa

SEQ ID NO: 1274570 - RNA, 17 nt, Homo sapiens
cgcuccaaugccuacug

SEQ ID NO: 1274571 - RNA, 14 nt, Homo sapiens
cgcucgcugccauc

SEQ ID NO: 1274572 - RNA, 16 nt, Homo sapiens
cgcugacuucauggaa

SEQ ID NO: 1274573 - RNA, 20 nt, Homo sapiens
cgcugagcugaguggccagc

SEQ ID NO: 1274574 - RNA, 12 nt, Homo sapiens
cgcugggugguu

SEQ ID NO: 1274575 - RNA, 14 nt, Homo sapiens
cgcugucacuggcu

SEQ ID NO: 1274576 - RNA, 19 nt, Homo sapiens
cgcuucugccuuuucacug

SEQ ID NO: 1274577 - RNA, 21 nt, Homo sapiens
cggaagaacccucaggucaca

SEQ ID NO: 1274578 - RNA, 21 nt, Homo sapiens
cggaaggagggagcucugaug

SEQ ID NO: 1274579 - RNA, 20 nt, Homo sapiens
cggaaugaaccacaucuugc

SEQ ID NO: 1274580 - RNA, 21 nt, Homo sapiens
cggacaagacccccagcacuu

SEQ ID NO: 1274581 - RNA, 16 nt, Homo sapiens
cggacccaucuuugcu

SEQ ID NO: 1274582 - RNA, 23 nt, Homo sapiens
cggagacggagucccaccuuggc

SEQ ID NO: 1274583 - RNA, 20 nt, Homo sapiens
cggagcuugcagugagccga

SEQ ID NO: 1274584 - RNA, 12 nt, Homo sapiens
cggagcuuucaa

SEQ ID NO: 1274585 - RNA, 14 nt, Homo sapiens
cggaggcugcagug

SEQ ID NO: 1274586 - RNA, 17 nt, Homo sapiens
cggaggucucuguaaaa

SEQ ID NO: 1274587 - RNA, 18 nt, Homo sapiens
cggagugagcaauggagu

SEQ ID NO: 1274588 - RNA, 16 nt, Homo sapiens
cggauccagcaauucc

SEQ ID NO: 1274589 - RNA, 20 nt, Homo sapiens
cggauccagcaauuccugag

SEQ ID NO: 1274590 - RNA, 21 nt, Homo sapiens
cggaucuggggcucugggaua

SEQ ID NO: 1274591 - RNA, 13 nt, Homo sapiens
cggcaacaucucu

SEQ ID NO: 1274592 - RNA, 19 nt, Homo sapiens
cggcacccugauccucacc

SEQ ID NO: 1274593 - RNA, 19 nt, Homo sapiens
cggcagacgggaggggaaa

SEQ ID NO: 1274594 - RNA, 17 nt, Homo sapiens
cggcaggcccugcagug

SEQ ID NO: 1274595 - RNA, 18 nt, Homo sapiens
cggcaucaaggugcugaa

SEQ ID NO: 1274596 - RNA, 14 nt, Homo sapiens
cggccacgcacugg

SEQ ID NO: 1274597 - RNA, 18 nt, Homo sapiens
cggccacucuaccugaac

SEQ ID NO: 1274598 - RNA, 18 nt, Homo sapiens
cggccucucaguucuuga

SEQ ID NO: 1274599 - RNA, 23 nt, Homo sapiens
cggccuugucugucucagcucaa

SEQ ID NO: 1274600 - RNA, 15 nt, Homo sapiens
cggccuuuguugcuc

SEQ ID NO: 1274601 - RNA, 19 nt, Homo sapiens
cggcuaagaggcugcugaa

SEQ ID NO: 1274602 - RNA, 19 nt, Homo sapiens
cggcuaugggacugcagug

SEQ ID NO: 1274603 - RNA, 13 nt, Homo sapiens
cgggaaacacaca

SEQ ID NO: 1274604 - RNA, 17 nt, Homo sapiens
cgggaaagccuuaaaaa

SEQ ID NO: 1274605 - RNA, 13 nt, Homo sapiens
cgggaaaggagcu

SEQ ID NO: 1274606 - RNA, 13 nt, Homo sapiens
cgggaacaguguu

SEQ ID NO: 1274607 - RNA, 18 nt, Homo sapiens
cgggaaggaggcaacugc

SEQ ID NO: 1274608 - RNA, 13 nt, Homo sapiens
cgggagaaauuua

SEQ ID NO: 1274609 - RNA, 15 nt, Homo sapiens
cgggagcagugucuu

SEQ ID NO: 1274610 - RNA, 21 nt, Homo sapiens
cgggagcccccaaaacagccu

SEQ ID NO: 1274611 - RNA, 17 nt, Homo sapiens
cgggauggccagagaug

SEQ ID NO: 1274612 - RNA, 13 nt, Homo sapiens
cgggcaccuguag

SEQ ID NO: 1274613 - RNA, 18 nt, Homo sapiens
cgggcugggagcucugca

SEQ ID NO: 1274614 - RNA, 13 nt, Homo sapiens
cggggaagccgag

SEQ ID NO: 1274615 - RNA, 16 nt, Homo sapiens
cggggagcaaaccagc

SEQ ID NO: 1274616 - RNA, 20 nt, Homo sapiens
cggggaggcuccugccugag

SEQ ID NO: 1274617 - RNA, 20 nt, Homo sapiens
cggggcagucagauuuuuaa

SEQ ID NO: 1274618 - RNA, 18 nt, Homo sapiens
cggggccagcacuuccau

SEQ ID NO: 1274619 - RNA, 18 nt, Homo sapiens
cugcaguuuuauugcuaa

SEQ ID NO: 1274620 - RNA, 18 nt, Homo sapiens
cugcauacgagagacuug

SEQ ID NO: 1274621 - RNA, 22 nt, Homo sapiens
cugcaucauaagcugauuugau

SEQ ID NO: 1274622 - RNA, 16 nt, Homo sapiens
cugcaucauccuugca

SEQ ID NO: 1274623 - RNA, 15 nt, Homo sapiens
cugcaugaccuacca

SEQ ID NO: 1274624 - RNA, 15 nt, Homo sapiens
cugcauggauucagc

SEQ ID NO: 1274625 - RNA, 12 nt, Homo sapiens
cugcauguuaca

SEQ ID NO: 1274626 - RNA, 16 nt, Homo sapiens
cugcauuuacacacac

SEQ ID NO: 1274627 - RNA, 20 nt, Homo sapiens
cugccaacacgcccggcuaa

SEQ ID NO: 1274628 - RNA, 22 nt, Homo sapiens
cugccaacacgcccggcuaauu

SEQ ID NO: 1274629 - RNA, 15 nt, Homo sapiens
cugccaagacuccuc

SEQ ID NO: 1274630 - RNA, 17 nt, Homo sapiens
cugccacacucuccauc

SEQ ID NO: 1274631 - RNA, 19 nt, Homo sapiens
cugccaccacgucugccag

SEQ ID NO: 1274632 - RNA, 16 nt, Homo sapiens
cugccacccuggggag

SEQ ID NO: 1274633 - RNA, 13 nt, Homo sapiens
cugccaccugccc

SEQ ID NO: 1274634 - RNA, 19 nt, Homo sapiens
cugccagccccacacagcu

SEQ ID NO: 1274635 - RNA, 12 nt, Homo sapiens
cugccagccuug

SEQ ID NO: 1274636 - RNA, 21 nt, Homo sapiens
cugccaggcaugguagcucau

SEQ ID NO: 1274637 - RNA, 19 nt, Homo sapiens
cugccauauucuguuggcc

SEQ ID NO: 1274638 - RNA, 16 nt, Homo sapiens
cugccaugauagcugg

SEQ ID NO: 1274639 - RNA, 19 nt, Homo sapiens
cugccauuauuuucuguca

SEQ ID NO: 1274640 - RNA, 20 nt, Homo sapiens
cugcccacuguuucucuuga

SEQ ID NO: 1274641 - RNA, 22 nt, Homo sapiens
cugcccagacacagacuggcaa

SEQ ID NO: 1274642 - RNA, 20 nt, Homo sapiens
cugccccaaacaaauaugca

SEQ ID NO: 1274643 - RNA, 15 nt, Homo sapiens
cugccccagauuuac

SEQ ID NO: 1274644 - RNA, 21 nt, Homo sapiens
cugcccccuugggugaccucu

SEQ ID NO: 1274645 - RNA, 15 nt, Homo sapiens
cugccccucucacca

SEQ ID NO: 1274646 - RNA, 13 nt, Homo sapiens
cugccccuuccac

SEQ ID NO: 1274647 - RNA, 18 nt, Homo sapiens
cugcccgggagggcuucc

SEQ ID NO: 1274648 - RNA, 21 nt, Homo sapiens
cugcccuccagcugcugcucu

SEQ ID NO: 1274649 - RNA, 21 nt, Homo sapiens
cugcccuccccagagcacugg

SEQ ID NO: 1274650 - RNA, 17 nt, Homo sapiens
cugcccucuauuuauua

SEQ ID NO: 1274651 - RNA, 20 nt, Homo sapiens
cugcccucugggucccuccu

SEQ ID NO: 1274652 - RNA, 13 nt, Homo sapiens
cugccgaccccua

SEQ ID NO: 1274653 - RNA, 19 nt, Homo sapiens
cugccgcccccuccugaac

SEQ ID NO: 1274654 - RNA, 21 nt, Homo sapiens
cugccggcucuuuccuugcuc

SEQ ID NO: 1274655 - RNA, 16 nt, Homo sapiens
cugccuaauuuugcca

SEQ ID NO: 1274656 - RNA, 21 nt, Homo sapiens
cugccuacuuuuaguugacuc

SEQ ID NO: 1274657 - RNA, 14 nt, Homo sapiens
cugccucagccucc

SEQ ID NO: 1274658 - RNA, 17 nt, Homo sapiens
cugccucaguggcagca

SEQ ID NO: 1274659 - RNA, 23 nt, Homo sapiens
cugccuccagaauggucuuucua

SEQ ID NO: 1274660 - RNA, 15 nt, Homo sapiens
cugccuccugugacg

SEQ ID NO: 1274661 - RNA, 18 nt, Homo sapiens
cugccucuuucccuagga

SEQ ID NO: 1274662 - RNA, 16 nt, Homo sapiens
cugccugcggcccaga

SEQ ID NO: 1274663 - RNA, 21 nt, Homo sapiens
cugccuggguugggggcacuc

SEQ ID NO: 1274664 - RNA, 16 nt, Homo sapiens
cugccugguauaucca

SEQ ID NO: 1274665 - RNA, 19 nt, Homo sapiens
cugccuguuauaacucugc

SEQ ID NO: 1274666 - RNA, 22 nt, Homo sapiens
cugccuuagugcugaugccugu

SEQ ID NO: 1274667 - RNA, 18 nt, Homo sapiens
cugccuuaucuugcaccc

SEQ ID NO: 1274668 - RNA, 17 nt, Homo sapiens
cugccuuguccugaugc

SEQ ID NO: 1274669 - RNA, 17 nt, Homo sapiens
cugccuuuucaucuaau

SEQ ID NO: 1274670 - RNA, 13 nt, Homo sapiens
cugcgacugauga

SEQ ID NO: 1274671 - RNA, 15 nt, Homo sapiens
cugcgcaccaaggaa

SEQ ID NO: 1274672 - RNA, 14 nt, Homo sapiens
cugcgccacuuccu

SEQ ID NO: 1274673 - RNA, 18 nt, Homo sapiens
cugcggaccccucgucau

SEQ ID NO: 1274674 - RNA, 17 nt, Homo sapiens
cugcgugugauaagcaa

SEQ ID NO: 1274675 - RNA, 21 nt, Homo sapiens
cugcuacaggaggggucucau

SEQ ID NO: 1274676 - RNA, 19 nt, Homo sapiens
cugcuaguuuauauagaaa

SEQ ID NO: 1274677 - RNA, 16 nt, Homo sapiens
cugcucaagaagacau

SEQ ID NO: 1274678 - RNA, 21 nt, Homo sapiens
cugcucaccagaucucaggca

SEQ ID NO: 1274679 - RNA, 14 nt, Homo sapiens
cugcuccaccagca

SEQ ID NO: 1274680 - RNA, 22 nt, Homo sapiens
cugcuccaccagcagcauggca

SEQ ID NO: 1274681 - RNA, 15 nt, Homo sapiens
cugcuccagugcagg

SEQ ID NO: 1274682 - RNA, 13 nt, Homo sapiens
cugcucccauucc

SEQ ID NO: 1274683 - RNA, 18 nt, Homo sapiens
cugcucccugaagccagc

SEQ ID NO: 1274684 - RNA, 22 nt, Homo sapiens
cugcucccugacagcaccugaa

SEQ ID NO: 1274685 - RNA, 13 nt, Homo sapiens
cugcucccuggca

SEQ ID NO: 1274686 - RNA, 16 nt, Homo sapiens
cugcucuacccaugag

SEQ ID NO: 1274687 - RNA, 15 nt, Homo sapiens
cugcucuuaggugcu

SEQ ID NO: 1274688 - RNA, 13 nt, Homo sapiens
cugcugacagugu

SEQ ID NO: 1274689 - RNA, 22 nt, Homo sapiens
cugcugaccucccagugacccc

SEQ ID NO: 1274690 - RNA, 18 nt, Homo sapiens
cugcugagugcaccacuu

SEQ ID NO: 1274691 - RNA, 19 nt, Homo sapiens
cugcugauauaauaucaua

SEQ ID NO: 1274692 - RNA, 14 nt, Homo sapiens
cugcugauuuucug

SEQ ID NO: 1274693 - RNA, 16 nt, Homo sapiens
cugcugccauccucac

SEQ ID NO: 1274694 - RNA, 15 nt, Homo sapiens
cugcugcuaccagcg

SEQ ID NO: 1274695 - RNA, 16 nt, Homo sapiens
cugcugcuccagugca

SEQ ID NO: 1274696 - RNA, 15 nt, Homo sapiens
cugcuggaaaaagcc

SEQ ID NO: 1274697 - RNA, 15 nt, Homo sapiens
cugcuggacagccuc

SEQ ID NO: 1274698 - RNA, 13 nt, Homo sapiens
cugcuggugaaua

SEQ ID NO: 1274699 - RNA, 12 nt, Homo sapiens
cugcuguaaaau

SEQ ID NO: 1274700 - RNA, 21 nt, Homo sapiens
cugcuguggcgugagggugag

SEQ ID NO: 1274701 - RNA, 20 nt, Homo sapiens
cugcuguuccugcuccauga

SEQ ID NO: 1274702 - RNA, 13 nt, Homo sapiens
cugcuguuuccag

SEQ ID NO: 1274703 - RNA, 16 nt, Homo sapiens
cugcuuaaaguuuuaa

SEQ ID NO: 1274704 - RNA, 13 nt, Homo sapiens
cugcuucagucca

SEQ ID NO: 1274705 - RNA, 21 nt, Homo sapiens
cugcuucaguccacaguacau

SEQ ID NO: 1274706 - RNA, 19 nt, Homo sapiens
cugcuuccccuuccuaagu

SEQ ID NO: 1274707 - RNA, 18 nt, Homo sapiens
cugcuuccgguagggagg

SEQ ID NO: 1274708 - RNA, 18 nt, Homo sapiens
cugcuucuuauauugcaa

SEQ ID NO: 1274709 - RNA, 15 nt, Homo sapiens
cugcuugaccaaaga

SEQ ID NO: 1274710 - RNA, 16 nt, Homo sapiens
cugcuugaccaaagag

SEQ ID NO: 1274711 - RNA, 19 nt, Homo sapiens
cugcuugaccguacucuca

SEQ ID NO: 1274712 - RNA, 19 nt, Homo sapiens
cugcuuuaggaauucugca

SEQ ID NO: 1274713 - RNA, 13 nt, Homo sapiens
cuggaaaaagccc

SEQ ID NO: 1274714 - RNA, 16 nt, Homo sapiens
cuggaaaacccaaagu

SEQ ID NO: 1274715 - RNA, 16 nt, Homo sapiens
cuggaaagacauagcc

SEQ ID NO: 1274716 - RNA, 20 nt, Homo sapiens
cuggaaaggcucagucucag

SEQ ID NO: 1274717 - RNA, 23 nt, Homo sapiens
cuggaaaggcucagucucaggag

SEQ ID NO: 1274718 - RNA, 13 nt, Homo sapiens
cuggaaagugaug

SEQ ID NO: 1274719 - RNA, 19 nt, Homo sapiens
cuggaacgcagugguguuu

SEQ ID NO: 1274720 - RNA, 23 nt, Homo sapiens
cuggaacgcagugguguuuucag

SEQ ID NO: 1274721 - RNA, 16 nt, Homo sapiens
cuggaacuacaaggaa

SEQ ID NO: 1274722 - RNA, 23 nt, Homo sapiens
cuggaacuggcugugaagaccca

SEQ ID NO: 1274723 - RNA, 23 nt, Homo sapiens
cuggaagaaaaaaaccacacaaa

SEQ ID NO: 1274724 - RNA, 23 nt, Homo sapiens
cuggaagaaacaguccaguacuu

SEQ ID NO: 1274725 - RNA, 12 nt, Homo sapiens
cuggaagacacu

SEQ ID NO: 1274726 - RNA, 17 nt, Homo sapiens
cuggaagcuaauuugca

SEQ ID NO: 1274727 - RNA, 13 nt, Homo sapiens
cuggaaggcuucc

SEQ ID NO: 1274728 - RNA, 18 nt, Homo sapiens
cuggaagggaaaggggag

SEQ ID NO: 1274729 - RNA, 15 nt, Homo sapiens
cuggaaucacauucu

SEQ ID NO: 1274730 - RNA, 20 nt, Homo sapiens
cuggaaugcagugacacaau

SEQ ID NO: 1274731 - RNA, 16 nt, Homo sapiens
cuggaaugggcacagc

SEQ ID NO: 1274732 - RNA, 15 nt, Homo sapiens
cuggaauuauuuuag

SEQ ID NO: 1274733 - RNA, 20 nt, Homo sapiens
cuggacacagcucuucauuc

SEQ ID NO: 1274734 - RNA, 16 nt, Homo sapiens
cuggacaguaucccac

SEQ ID NO: 1274735 - RNA, 15 nt, Homo sapiens
cuggaccaaggugaa

SEQ ID NO: 1274736 - RNA, 15 nt, Homo sapiens
cuggaccacugggca

SEQ ID NO: 1274737 - RNA, 21 nt, Homo sapiens
cuggacccccagcuuugccca

SEQ ID NO: 1274738 - RNA, 22 nt, Homo sapiens
cuggacggcaggcucacugcca

SEQ ID NO: 1274739 - RNA, 21 nt, Homo sapiens
cuggacuaugcugaugggcca

SEQ ID NO: 1274740 - RNA, 17 nt, Homo sapiens
cuggagacccaccccac

SEQ ID NO: 1274741 - RNA, 22 nt, Homo sapiens
cuggagacccguagaugccagg

SEQ ID NO: 1274742 - RNA, 14 nt, Homo sapiens
cuggagaccuccag

SEQ ID NO: 1274743 - RNA, 17 nt, Homo sapiens
cuggagacguggaaccu

SEQ ID NO: 1274744 - RNA, 13 nt, Homo sapiens
cuggagagcucac

SEQ ID NO: 1274745 - RNA, 21 nt, Homo sapiens
uggcaacagagcaagacucca

SEQ ID NO: 1274746 - RNA, 20 nt, Homo sapiens
uggcaacaugaagaaugcau

SEQ ID NO: 1274747 - RNA, 19 nt, Homo sapiens
uggcaagucuagagucuca

SEQ ID NO: 1274748 - RNA, 20 nt, Homo sapiens
uggcaagucuuccaugaccc

SEQ ID NO: 1274749 - RNA, 22 nt, Homo sapiens
uggcaauaaacuccuacuaaau

SEQ ID NO: 1274750 - RNA, 19 nt, Homo sapiens
uggcaauuguccccaggga

SEQ ID NO: 1274751 - RNA, 19 nt, Homo sapiens
uggcaauuucacugaugua

SEQ ID NO: 1274752 - RNA, 23 nt, Homo sapiens
uggcacaaaaaaauaucagacaa

SEQ ID NO: 1274753 - RNA, 16 nt, Homo sapiens
uggcacaugccuguaa

SEQ ID NO: 1274754 - RNA, 13 nt, Homo sapiens
uggcaccucucaa

SEQ ID NO: 1274755 - RNA, 19 nt, Homo sapiens
uggcacucagggagcauuu

SEQ ID NO: 1274756 - RNA, 15 nt, Homo sapiens
uggcacucagucucu

SEQ ID NO: 1274757 - RNA, 16 nt, Homo sapiens
uggcacuggaugcaga

SEQ ID NO: 1274758 - RNA, 17 nt, Homo sapiens
uggcacuggaugcagaa

SEQ ID NO: 1274759 - RNA, 12 nt, Homo sapiens
uggcacuggcca

SEQ ID NO: 1274760 - RNA, 13 nt, Homo sapiens
uggcacuggccac

SEQ ID NO: 1274761 - RNA, 19 nt, Homo sapiens
uggcacugguuuguucccu

SEQ ID NO: 1274762 - RNA, 17 nt, Homo sapiens
uggcacuguggagcuca

SEQ ID NO: 1274763 - RNA, 19 nt, Homo sapiens
uggcacuguggagcucagu

SEQ ID NO: 1274764 - RNA, 16 nt, Homo sapiens
uggcacuugcuaacaa

SEQ ID NO: 1274765 - RNA, 10 nt, Homo sapiens
uggcacuuug

SEQ ID NO: 1274766 - RNA, 15 nt, Homo sapiens
uggcagaaccaaagc

SEQ ID NO: 1274767 - RNA, 23 nt, Homo sapiens
uggcagacaucggccuccaugac

SEQ ID NO: 1274768 - RNA, 16 nt, Homo sapiens
uggcagccauggccau

SEQ ID NO: 1274769 - RNA, 20 nt, Homo sapiens
uggcagcccuguguguguca

SEQ ID NO: 1274770 - RNA, 16 nt, Homo sapiens
uggcagcggguggcau

SEQ ID NO: 1274771 - RNA, 14 nt, Homo sapiens
uggcagcucuccag

SEQ ID NO: 1274772 - RNA, 21 nt, Homo sapiens
uggcaggugucauaugacuga

SEQ ID NO: 1274773 - RNA, 15 nt, Homo sapiens
uggcaguacuguugc

SEQ ID NO: 1274774 - RNA, 17 nt, Homo sapiens
uggcagucccuuauaau

SEQ ID NO: 1274775 - RNA, 23 nt, Homo sapiens
uggcaucaaacagggcaaagugu

SEQ ID NO: 1274776 - RNA, 20 nt, Homo sapiens
uggcauuacccucugcagaa

SEQ ID NO: 1274777 - RNA, 21 nt, Homo sapiens
uggcauugucccugugccuaa

SEQ ID NO: 1274778 - RNA, 14 nt, Homo sapiens
uggccaacugcaaa

SEQ ID NO: 1274779 - RNA, 19 nt, Homo sapiens
uggccaagaaaauugccuu

SEQ ID NO: 1274780 - RNA, 20 nt, Homo sapiens
uggccaagaaaauugccuuu

SEQ ID NO: 1274781 - RNA, 19 nt, Homo sapiens
uggccaagcaauuccucug

SEQ ID NO: 1274782 - RNA, 22 nt, Homo sapiens
uggccaagcaauuccucugaac

SEQ ID NO: 1274783 - RNA, 20 nt, Homo sapiens
uggccacaguaauuggucau

SEQ ID NO: 1274784 - RNA, 16 nt, Homo sapiens
uggccagccagugcca

SEQ ID NO: 1274785 - RNA, 18 nt, Homo sapiens
uggccagccagugccauu

SEQ ID NO: 1274786 - RNA, 22 nt, Homo sapiens
uggccaggagggcccaggguca

SEQ ID NO: 1274787 - RNA, 22 nt, Homo sapiens
uggccaggagguuggugacuga

SEQ ID NO: 1274788 - RNA, 16 nt, Homo sapiens
uggccaggcacugccu

SEQ ID NO: 1274789 - RNA, 18 nt, Homo sapiens
uggccaggcuggucucaa

SEQ ID NO: 1274790 - RNA, 19 nt, Homo sapiens
uggccaggcuggucucaaa

SEQ ID NO: 1274791 - RNA, 18 nt, Homo sapiens
uggccagugugaucccaa

SEQ ID NO: 1274792 - RNA, 23 nt, Homo sapiens
uggccaguuggaaccacggagau

SEQ ID NO: 1274793 - RNA, 17 nt, Homo sapiens
uggccauccacaaacag

SEQ ID NO: 1274794 - RNA, 18 nt, Homo sapiens
uggccauggugacauugu

SEQ ID NO: 1274795 - RNA, 13 nt, Homo sapiens
uggccauguucuc

SEQ ID NO: 1274796 - RNA, 15 nt, Homo sapiens
uggccauguucucca

SEQ ID NO: 1274797 - RNA, 18 nt, Homo sapiens
uggccauuccaacagcuc

SEQ ID NO: 1274798 - RNA, 21 nt, Homo sapiens
uggcccaagugguuugugcua

SEQ ID NO: 1274799 - RNA, 23 nt, Homo sapiens
uggcccaagugguuugugcuaac

SEQ ID NO: 1274800 - RNA, 12 nt, Homo sapiens
uggcccaggaau

SEQ ID NO: 1274801 - RNA, 17 nt, Homo sapiens
uggcccagggaagccaa

SEQ ID NO: 1274802 - RNA, 20 nt, Homo sapiens
uggcccauagaaacaugaca

SEQ ID NO: 1274803 - RNA, 12 nt, Homo sapiens
uggcccaucaac

SEQ ID NO: 1274804 - RNA, 18 nt, Homo sapiens
uggcccgcgucuagcuua

SEQ ID NO: 1274805 - RNA, 18 nt, Homo sapiens
uggcccggaugcugcuuc

SEQ ID NO: 1274806 - RNA, 13 nt, Homo sapiens
uggcccugugcua

SEQ ID NO: 1274807 - RNA, 22 nt, Homo sapiens
uggcccuuuccuuccagauccu

SEQ ID NO: 1274808 - RNA, 13 nt, Homo sapiens
uggccuaugcaca

SEQ ID NO: 1274809 - RNA, 14 nt, Homo sapiens
uggccuaugcacau

SEQ ID NO: 1274810 - RNA, 18 nt, Homo sapiens
uggccuaugcacauaugg

SEQ ID NO: 1274811 - RNA, 18 nt, Homo sapiens
uggccucagcuggcugua

SEQ ID NO: 1274812 - RNA, 19 nt, Homo sapiens
uggccucagcuggcuguau

SEQ ID NO: 1274813 - RNA, 19 nt, Homo sapiens
uggccucagggccaggaag

SEQ ID NO: 1274814 - RNA, 14 nt, Homo sapiens
uggccucccgccaa

SEQ ID NO: 1274815 - RNA, 17 nt, Homo sapiens
uggccugaacaaaauaa

SEQ ID NO: 1274816 - RNA, 14 nt, Homo sapiens
uggccugcacuggu

SEQ ID NO: 1274817 - RNA, 15 nt, Homo sapiens
uggccugcugggaac

SEQ ID NO: 1274818 - RNA, 19 nt, Homo sapiens
uggccugcugugauuccac

SEQ ID NO: 1274819 - RNA, 20 nt, Homo sapiens
uggccuggacaguaucccac

SEQ ID NO: 1274820 - RNA, 12 nt, Homo sapiens
uggccuggcaca

SEQ ID NO: 1274821 - RNA, 13 nt, Homo sapiens
uggccuggcacac

SEQ ID NO: 1274822 - RNA, 18 nt, Homo sapiens
uggccuggcacacaucag

SEQ ID NO: 1274823 - RNA, 22 nt, Homo sapiens
uggccuggucccuguuuuccca

SEQ ID NO: 1274824 - RNA, 18 nt, Homo sapiens
uggccugguucaauuucu

SEQ ID NO: 1274825 - RNA, 14 nt, Homo sapiens
uggccugucuuugg

SEQ ID NO: 1274826 - RNA, 18 nt, Homo sapiens
uggccuugaaaccaccuu

SEQ ID NO: 1274827 - RNA, 18 nt, Homo sapiens
uggcgcauauuaagcacu

SEQ ID NO: 1274828 - RNA, 21 nt, Homo sapiens
uggcgcgggaggcaccagcuc

SEQ ID NO: 1274829 - RNA, 21 nt, Homo sapiens
uggcggcuuccuguccacucu

SEQ ID NO: 1274830 - RNA, 16 nt, Homo sapiens
uggcgggcaccuguag

SEQ ID NO: 1274831 - RNA, 22 nt, Homo sapiens
uggcguagaaguuuuuguacug

SEQ ID NO: 1274832 - RNA, 15 nt, Homo sapiens
uggcguuacugcuug

SEQ ID NO: 1274833 - RNA, 22 nt, Homo sapiens
uggcguuacugcuugaccaaag

SEQ ID NO: 1274834 - RNA, 21 nt, Homo sapiens
uggcuaaagagcuuugugaua

SEQ ID NO: 1274835 - RNA, 19 nt, Homo sapiens
uggcuacacacaaaccagu

SEQ ID NO: 1274836 - RNA, 15 nt, Homo sapiens
uggcuagaguuucca

SEQ ID NO: 1274837 - RNA, 16 nt, Homo sapiens
uggcuaguacuguauu

SEQ ID NO: 1274838 - RNA, 21 nt, Homo sapiens
uggcuauaacaugucuuucag

SEQ ID NO: 1274839 - RNA, 15 nt, Homo sapiens
uggcuccaacacugc

SEQ ID NO: 1274840 - RNA, 22 nt, Homo sapiens
uggcuccccuuuuucuuccuca

SEQ ID NO: 1274841 - RNA, 13 nt, Homo sapiens
uggcuccuaucug

SEQ ID NO: 1274842 - RNA, 16 nt, Homo sapiens
uggcuccuaucugugu

SEQ ID NO: 1274843 - RNA, 16 nt, Homo sapiens
uggcuccucuacuguu

SEQ ID NO: 1274844 - RNA, 20 nt, Homo sapiens
uggcucuugaggcauuucca

SEQ ID NO: 1274845 - RNA, 14 nt, Homo sapiens
uggcugaaaaugca

SEQ ID NO: 1274846 - RNA, 17 nt, Homo sapiens
uggcugacuggcaguaa

SEQ ID NO: 1274847 - RNA, 13 nt, Homo sapiens
uggcugacugggg

SEQ ID NO: 1274848 - RNA, 17 nt, Homo sapiens
uggcugagguuccucug

SEQ ID NO: 1274849 - RNA, 18 nt, Homo sapiens
uggcugaguccauuagcu

SEQ ID NO: 1274850 - RNA, 17 nt, Homo sapiens
uggcugcuagauuuuaa

SEQ ID NO: 1274851 - RNA, 16 nt, Homo sapiens
uggcugcuuuguucaa

SEQ ID NO: 1274852 - RNA, 23 nt, Homo sapiens
uggcuggcuuguuugauuucaac

SEQ ID NO: 1274853 - RNA, 19 nt, Homo sapiens
uggcuuauaaacacauuga

SEQ ID NO: 1274854 - RNA, 16 nt, Homo sapiens
uggcuugacaugugca

SEQ ID NO: 1274855 - RNA, 21 nt, Homo sapiens
uggcuuggccacaaccugaaa

SEQ ID NO: 1274856 - RNA, 23 nt, Homo sapiens
uggcuuuuaguacugaagccaaa

SEQ ID NO: 1274857 - RNA, 20 nt, Homo sapiens
uggcuuuugcggccaguauu

SEQ ID NO: 1274858 - RNA, 15 nt, Homo sapiens
uggcuuuuucuccuu

SEQ ID NO: 1274859 - RNA, 18 nt, Homo sapiens
ugggaaaaaaacuuggca

SEQ ID NO: 1274860 - RNA, 23 nt, Homo sapiens
ugggaaaaaaacuuggcacuuuu

SEQ ID NO: 1274861 - RNA, 16 nt, Homo sapiens
ugggaaaacacugcca

SEQ ID NO: 1274862 - RNA, 12 nt, Homo sapiens
ugggaaagacau

SEQ ID NO: 1274863 - RNA, 21 nt, Homo sapiens
ugggaauagggagacagggua

SEQ ID NO: 1274864 - RNA, 19 nt, Homo sapiens
ugggaaugaaauuaacaca

SEQ ID NO: 1274865 - RNA, 20 nt, Homo sapiens
ugggaauguauuauucugca

SEQ ID NO: 1274866 - RNA, 23 nt, Homo sapiens
ugggaccucaguuuuaucauuuu

SEQ ID NO: 1274867 - RNA, 22 nt, Homo sapiens
ugggacuggacagcuuugcucc

SEQ ID NO: 1274868 - RNA, 15 nt, Homo sapiens
ugggacuuccuugcu

SEQ ID NO: 1274869 - RNA, 18 nt, Homo sapiens
ugggagaaggacuaucaa

SEQ ID NO: 1274870 - RNA, 14 nt, Homo sapiens
ugggagaaggcagu

SEQ ID NO: 1274871 - RNA, 20 nt, Homo sapiens
uggaaaugguggugcuuuaa

SEQ ID NO: 1274872 - RNA, 15 nt, Homo sapiens
uggaaauguauuuua

SEQ ID NO: 1274873 - RNA, 17 nt, Homo sapiens
uggaacaagcacagaug

SEQ ID NO: 1274874 - RNA, 16 nt, Homo sapiens
uggaacagaagacagc

SEQ ID NO: 1274875 - RNA, 21 nt, Homo sapiens
uggaacagcauuacccuccuc

SEQ ID NO: 1274876 - RNA, 18 nt, Homo sapiens
uggaacauauagaaugca

SEQ ID NO: 1274877 - RNA, 12 nt, Homo sapiens
uggaacauuucu

SEQ ID NO: 1274878 - RNA, 19 nt, Homo sapiens
uggaaccuuguuuuggaca

SEQ ID NO: 1274879 - RNA, 17 nt, Homo sapiens
uggaacuacauuacugu

SEQ ID NO: 1274880 - RNA, 14 nt, Homo sapiens
uggaacuguacacu

SEQ ID NO: 1274881 - RNA, 22 nt, Homo sapiens
uggaagaaaaaaaccacacaaa

SEQ ID NO: 1274882 - RNA, 12 nt, Homo sapiens
uggaagaaggga

SEQ ID NO: 1274883 - RNA, 13 nt, Homo sapiens
uggaagacacuuc

SEQ ID NO: 1274884 - RNA, 23 nt, Homo sapiens
uggaagaggaacagcacugggga

SEQ ID NO: 1274885 - RNA, 19 nt, Homo sapiens
uggaagaggcugagacauu

SEQ ID NO: 1274886 - RNA, 20 nt, Homo sapiens
uggaagaguguuucuuccac

SEQ ID NO: 1274887 - RNA, 14 nt, Homo sapiens
uggaagcacagcuu

SEQ ID NO: 1274888 - RNA, 19 nt, Homo sapiens
uggaagcaguuucagagaa

SEQ ID NO: 1274889 - RNA, 14 nt, Homo sapiens
uggaagcauacaaa

SEQ ID NO: 1274890 - RNA, 17 nt, Homo sapiens
uggaagcuuguuuucca

SEQ ID NO: 1274891 - RNA, 16 nt, Homo sapiens
uggaaggcuuccacua

SEQ ID NO: 1274892 - RNA, 19 nt, Homo sapiens
uggaaggggccuugcugag

SEQ ID NO: 1274893 - RNA, 14 nt, Homo sapiens
uggaaggugcuacu

SEQ ID NO: 1274894 - RNA, 16 nt, Homo sapiens
uggaaguaaagccuca

SEQ ID NO: 1274895 - RNA, 22 nt, Homo sapiens
uggaaguaaccauuugcacugg

SEQ ID NO: 1274896 - RNA, 15 nt, Homo sapiens
uggaagucaucucau

SEQ ID NO: 1274897 - RNA, 20 nt, Homo sapiens
uggaaguuggcugcacuuga

SEQ ID NO: 1274898 - RNA, 15 nt, Homo sapiens
uggaauaaaacuguc

SEQ ID NO: 1274899 - RNA, 20 nt, Homo sapiens
uggaauaaaguugcagauga

SEQ ID NO: 1274900 - RNA, 12 nt, Homo sapiens
uggaauaaggca

SEQ ID NO: 1274901 - RNA, 22 nt, Homo sapiens
uggaauauaaggaaagcaauaa

SEQ ID NO: 1274902 - RNA, 15 nt, Homo sapiens
uggaauaucacccaa

SEQ ID NO: 1274903 - RNA, 19 nt, Homo sapiens
uggaauaucaucugucauu

SEQ ID NO: 1274904 - RNA, 15 nt, Homo sapiens
uggaaugaauacagc

SEQ ID NO: 1274905 - RNA, 23 nt, Homo sapiens
uggaaugcagggaagagggcagu

SEQ ID NO: 1274906 - RNA, 13 nt, Homo sapiens
uggaaugcaguga

SEQ ID NO: 1274907 - RNA, 16 nt, Homo sapiens
uggaaugcuguguuaa

SEQ ID NO: 1274908 - RNA, 15 nt, Homo sapiens
uggaauggaagaacc

SEQ ID NO: 1274909 - RNA, 23 nt, Homo sapiens
uggaaugggcacagcacagccag

SEQ ID NO: 1274910 - RNA, 17 nt, Homo sapiens
uggaauguacaugucaa

SEQ ID NO: 1274911 - RNA, 21 nt, Homo sapiens
uggaauuauuuugaaugucac

SEQ ID NO: 1274912 - RNA, 20 nt, Homo sapiens
uggaauucuaacaagucaua

SEQ ID NO: 1274913 - RNA, 13 nt, Homo sapiens
uggaauugcucaa

SEQ ID NO: 1274914 - RNA, 20 nt, Homo sapiens
uggaauuugccugcugggau

SEQ ID NO: 1274915 - RNA, 23 nt, Homo sapiens
uggaauuuucucacgcaggagcc

SEQ ID NO: 1274916 - RNA, 23 nt, Homo sapiens
uggaauuuucuuacccauauauc

SEQ ID NO: 1274917 - RNA, 19 nt, Homo sapiens
uggacaaaccgagugcaau

SEQ ID NO: 1274918 - RNA, 20 nt, Homo sapiens
uggacacagaucccacugga

SEQ ID NO: 1274919 - RNA, 12 nt, Homo sapiens
uggacacagcuc

SEQ ID NO: 1274920 - RNA, 22 nt, Homo sapiens
uggacaggaggcccccaucuau

SEQ ID NO: 1274921 - RNA, 17 nt, Homo sapiens
uggacaguucacacccu

SEQ ID NO: 1274922 - RNA, 21 nt, Homo sapiens
uggacauccuguauaagcacu

SEQ ID NO: 1274923 - RNA, 18 nt, Homo sapiens
uggaccaaggugaagcaa

SEQ ID NO: 1274924 - RNA, 21 nt, Homo sapiens
uggaccaauagggcugagcuc

SEQ ID NO: 1274925 - RNA, 13 nt, Homo sapiens
uggaccacgggcc

SEQ ID NO: 1274926 - RNA, 21 nt, Homo sapiens
uggaccugcccugggccacac

SEQ ID NO: 1274927 - RNA, 16 nt, Homo sapiens
uggacggagggucccc

SEQ ID NO: 1274928 - RNA, 15 nt, Homo sapiens
uggacgugcucagac

SEQ ID NO: 1274929 - RNA, 17 nt, Homo sapiens
uggacucugcacauguc

SEQ ID NO: 1274930 - RNA, 14 nt, Homo sapiens
uggacucuugcucu

SEQ ID NO: 1274931 - RNA, 11 nt, Homo sapiens
uggacugggag

SEQ ID NO: 1274932 - RNA, 16 nt, Homo sapiens
uggacuguaacugacu

SEQ ID NO: 1274933 - RNA, 18 nt, Homo sapiens
uggacuucagucuugccu

SEQ ID NO: 1274934 - RNA, 17 nt, Homo sapiens
uggacuuuccuguuguc

SEQ ID NO: 1274935 - RNA, 21 nt, Homo sapiens
uggacuuuucguuaacauuga

SEQ ID NO: 1274936 - RNA, 19 nt, Homo sapiens
uggagaaaaaaauugcucu

SEQ ID NO: 1274937 - RNA, 22 nt, Homo sapiens
uggagacagacugauguguaua

SEQ ID NO: 1274938 - RNA, 20 nt, Homo sapiens
uggagaccguccuggagcug

SEQ ID NO: 1274939 - RNA, 15 nt, Homo sapiens
uggagaccucuccuu

SEQ ID NO: 1274940 - RNA, 16 nt, Homo sapiens
uggagaggacagagca

SEQ ID NO: 1274941 - RNA, 15 nt, Homo sapiens
uggagaguuugccug

SEQ ID NO: 1274942 - RNA, 23 nt, Homo sapiens
uggagauuuaucucuguuuccuu

SEQ ID NO: 1274943 - RNA, 14 nt, Homo sapiens
uggagcaaaccauu

SEQ ID NO: 1274944 - RNA, 23 nt, Homo sapiens
uggagccccggaucccaagcccu

SEQ ID NO: 1274945 - RNA, 16 nt, Homo sapiens
uggagcuggcacugug

SEQ ID NO: 1274946 - RNA, 18 nt, Homo sapiens
uggaggaaagugauaucc

SEQ ID NO: 1274947 - RNA, 20 nt, Homo sapiens
uggaggaggcuuugggacca

SEQ ID NO: 1274948 - RNA, 21 nt, Homo sapiens
uggaggcacugaagugcuuag

SEQ ID NO: 1274949 - RNA, 16 nt, Homo sapiens
uggaggcagagaccuc

SEQ ID NO: 1274950 - RNA, 18 nt, Homo sapiens
uggaggccagagggguca

SEQ ID NO: 1274951 - RNA, 16 nt, Homo sapiens
uggaggccgcagccaa

SEQ ID NO: 1274952 - RNA, 20 nt, Homo sapiens
uggaggccggaaucucagcc

SEQ ID NO: 1274953 - RNA, 16 nt, Homo sapiens
uggaggccucuggccc

SEQ ID NO: 1274954 - RNA, 19 nt, Homo sapiens
uggagggaaugcucagaaa

SEQ ID NO: 1274955 - RNA, 16 nt, Homo sapiens
uggagggacaugacua

SEQ ID NO: 1274956 - RNA, 15 nt, Homo sapiens
uggagggcaucaggc

SEQ ID NO: 1274957 - RNA, 19 nt, Homo sapiens
uggaggggagggaucuccu

SEQ ID NO: 1274958 - RNA, 11 nt, Homo sapiens
uggaggggugu

SEQ ID NO: 1274959 - RNA, 16 nt, Homo sapiens
uggaguauaauauuca

SEQ ID NO: 1274960 - RNA, 22 nt, Homo sapiens
uggaguccccucaccuccucua

SEQ ID NO: 1274961 - RNA, 18 nt, Homo sapiens
uggagugcaguggcauga

SEQ ID NO: 1274962 - RNA, 17 nt, Homo sapiens
uggagugguaacagcuc

SEQ ID NO: 1274963 - RNA, 13 nt, Homo sapiens
uggagugucacau

SEQ ID NO: 1274964 - RNA, 17 nt, Homo sapiens
uggaguucuugugccau

SEQ ID NO: 1274965 - RNA, 16 nt, Homo sapiens
uggaguugacucggug

SEQ ID NO: 1274966 - RNA, 13 nt, Homo sapiens
uggaguuucugac

SEQ ID NO: 1274967 - RNA, 14 nt, Homo sapiens
uggauaacuuuaca

SEQ ID NO: 1274968 - RNA, 22 nt, Homo sapiens
uggauaauuuucauagcugccu

SEQ ID NO: 1274969 - RNA, 14 nt, Homo sapiens
uggauagcauuguu

SEQ ID NO: 1274970 - RNA, 22 nt, Homo sapiens
uggauaggcacauagagaggga

SEQ ID NO: 1274971 - RNA, 22 nt, Homo sapiens
uggauauuaaaaaucuguaaau

SEQ ID NO: 1274972 - RNA, 18 nt, Homo sapiens
uggauauuauucuuguag

SEQ ID NO: 1274973 - RNA, 22 nt, Homo sapiens
uggauauuuaguucaacuguau

SEQ ID NO: 1274974 - RNA, 13 nt, Homo sapiens
uggauccagcacu

SEQ ID NO: 1274975 - RNA, 19 nt, Homo sapiens
uggauccagccaugccuga

SEQ ID NO: 1274976 - RNA, 16 nt, Homo sapiens
uggauccugggucaaa

SEQ ID NO: 1274977 - RNA, 20 nt, Homo sapiens
uggaugaaucucccacucca

SEQ ID NO: 1274978 - RNA, 20 nt, Homo sapiens
uggaugaaugcccagugaga

SEQ ID NO: 1274979 - RNA, 15 nt, Homo sapiens
uggaugaggagacag

SEQ ID NO: 1274980 - RNA, 19 nt, Homo sapiens
uggaugaggagacagaaua

SEQ ID NO: 1274981 - RNA, 19 nt, Homo sapiens
uggaugcagaaacaguuca

SEQ ID NO: 1274982 - RNA, 15 nt, Homo sapiens
uggaugcagcucuug

SEQ ID NO: 1274983 - RNA, 16 nt, Homo sapiens
uggauggcacaaugaa

SEQ ID NO: 1274984 - RNA, 15 nt, Homo sapiens
uggauguaaugcacu

SEQ ID NO: 1274985 - RNA, 14 nt, Homo sapiens
uggauguagucagu

SEQ ID NO: 1274986 - RNA, 13 nt, Homo sapiens
uggaugucuuccu

SEQ ID NO: 1274987 - RNA, 13 nt, Homo sapiens
uggauguucugac

SEQ ID NO: 1274988 - RNA, 13 nt, Homo sapiens
uggauucagaaua

SEQ ID NO: 1274989 - RNA, 19 nt, Homo sapiens
uggauuccucacagccuug

SEQ ID NO: 1274990 - RNA, 15 nt, Homo sapiens
uggauucucauugcc

SEQ ID NO: 1274991 - RNA, 12 nt, Homo sapiens
uggauugagggu

SEQ ID NO: 1274992 - RNA, 15 nt, Homo sapiens
uggauugcacguggc

SEQ ID NO: 1274993 - RNA, 17 nt, Homo sapiens
uggauuguuuauacucc

SEQ ID NO: 1274994 - RNA, 18 nt, Homo sapiens
uggauuuauagcuaugaa

SEQ ID NO: 1274995 - RNA, 17 nt, Homo sapiens
uggauuuauucugccaa

SEQ ID NO: 1274996 - RNA, 20 nt, Homo sapiens
uggcaacaacuuagaagaaa

SEQ ID NO: 1274997 - RNA, 19 nt, Homo sapiens
uggcaacagagcaagacuc

SEQ ID NO: 1274998 - RNA, 11 nt, Homo sapiens
ugcuauggaag

SEQ ID NO: 1274999 - RNA, 16 nt, Homo sapiens
ugcuaugguuugccau

SEQ ID NO: 1275000 - RNA, 22 nt, Homo sapiens
ugcuauucccuggggcugcugu

SEQ ID NO: 1275001 - RNA, 19 nt, Homo sapiens
ugcuauucuccauacucug

SEQ ID NO: 1275002 - RNA, 19 nt, Homo sapiens
ugcucaauaaaaauguguu

SEQ ID NO: 1275003 - RNA, 17 nt, Homo sapiens
ugcucaauaaacacuug

SEQ ID NO: 1275004 - RNA, 16 nt, Homo sapiens
ugcucacaaaggauac

SEQ ID NO: 1275005 - RNA, 20 nt, Homo sapiens
ugcucaccaugcuuccagcu

SEQ ID NO: 1275006 - RNA, 20 nt, Homo sapiens
ugcucagagaaggaaaagac

SEQ ID NO: 1275007 - RNA, 13 nt, Homo sapiens
ugcucagcacagg

SEQ ID NO: 1275008 - RNA, 20 nt, Homo sapiens
ugcucaggcuugaaaugcau

SEQ ID NO: 1275009 - RNA, 18 nt, Homo sapiens
ugcucauugaacuuuaag

SEQ ID NO: 1275010 - RNA, 22 nt, Homo sapiens
ugcuccaacccccgccaccuca

SEQ ID NO: 1275011 - RNA, 16 nt, Homo sapiens
ugcuccaagauucuag

SEQ ID NO: 1275012 - RNA, 12 nt, Homo sapiens
ugcuccaccagc

SEQ ID NO: 1275013 - RNA, 17 nt, Homo sapiens
ugcuccaggaucuuuga

SEQ ID NO: 1275014 - RNA, 14 nt, Homo sapiens
ugcuccagugcagg

SEQ ID NO: 1275015 - RNA, 18 nt, Homo sapiens
ugcuccagugcaggagac

SEQ ID NO: 1275016 - RNA, 21 nt, Homo sapiens
ugcucccucagccucagagga

SEQ ID NO: 1275017 - RNA, 21 nt, Homo sapiens
ugcuccuaaaccauugagcua

SEQ ID NO: 1275018 - RNA, 17 nt, Homo sapiens
ugcucuaggaagacauu

SEQ ID NO: 1275019 - RNA, 17 nt, Homo sapiens
ugcucucuauguaugua

SEQ ID NO: 1275020 - RNA, 16 nt, Homo sapiens
ugcucucucaucuugu

SEQ ID NO: 1275021 - RNA, 13 nt, Homo sapiens
ugcucugccaccc

SEQ ID NO: 1275022 - RNA, 19 nt, Homo sapiens
ugcucuggaagaccugaaa

SEQ ID NO: 1275023 - RNA, 14 nt, Homo sapiens
ugcucuguuaccca

SEQ ID NO: 1275024 - RNA, 14 nt, Homo sapiens
ugcucuugagucuu

SEQ ID NO: 1275025 - RNA, 20 nt, Homo sapiens
ugcucuugagucuuugcaga

SEQ ID NO: 1275026 - RNA, 18 nt, Homo sapiens
ugcucuugggaagaccag

SEQ ID NO: 1275027 - RNA, 13 nt, Homo sapiens
ugcugaaaaagua

SEQ ID NO: 1275028 - RNA, 17 nt, Homo sapiens
ugcugaaaaaucaucca

SEQ ID NO: 1275029 - RNA, 17 nt, Homo sapiens
ugcugaaaaccaucugg

SEQ ID NO: 1275030 - RNA, 15 nt, Homo sapiens
ugcugaaaacuacac

SEQ ID NO: 1275031 - RNA, 18 nt, Homo sapiens
ugcugaaacucagugcaa

SEQ ID NO: 1275032 - RNA, 23 nt, Homo sapiens
ugcugaauauauagaauucagaa

SEQ ID NO: 1275033 - RNA, 22 nt, Homo sapiens
ugcugaaucaaaucucuuccac

SEQ ID NO: 1275034 - RNA, 18 nt, Homo sapiens
ugcugaccagacagccuc

SEQ ID NO: 1275035 - RNA, 19 nt, Homo sapiens
ugcugaccucccagugacc

SEQ ID NO: 1275036 - RNA, 17 nt, Homo sapiens
ugcugagguacagaagc

SEQ ID NO: 1275037 - RNA, 15 nt, Homo sapiens
ugcugagugagcgag

SEQ ID NO: 1275038 - RNA, 22 nt, Homo sapiens
ugcugaugaucaaaaccugugc

SEQ ID NO: 1275039 - RNA, 23 nt, Homo sapiens
ugcugauggcuugacaugugcaa

SEQ ID NO: 1275040 - RNA, 15 nt, Homo sapiens
ugcugauuuggugac

SEQ ID NO: 1275041 - RNA, 19 nt, Homo sapiens
ugcugcacccaacuacuga

SEQ ID NO: 1275042 - RNA, 17 nt, Homo sapiens
ugcugcaccuggucaua

SEQ ID NO: 1275043 - RNA, 18 nt, Homo sapiens
ugcugcaggcguacaggu

SEQ ID NO: 1275044 - RNA, 15 nt, Homo sapiens
ugcugcagucaucua

SEQ ID NO: 1275045 - RNA, 18 nt, Homo sapiens
ugcugcaucuuauagcac

SEQ ID NO: 1275046 - RNA, 15 nt, Homo sapiens
ugcugccauccucac

SEQ ID NO: 1275047 - RNA, 11 nt, Homo sapiens
ugcugccuuaa

SEQ ID NO: 1275048 - RNA, 14 nt, Homo sapiens
ugcuggagacacuc

SEQ ID NO: 1275049 - RNA, 18 nt, Homo sapiens
ugcuggcagccauggcca

SEQ ID NO: 1275050 - RNA, 13 nt, Homo sapiens
ugcuggcauuugc

SEQ ID NO: 1275051 - RNA, 14 nt, Homo sapiens
ugcugggauuucca

SEQ ID NO: 1275052 - RNA, 20 nt, Homo sapiens
ugcugggcacuucaucugau

SEQ ID NO: 1275053 - RNA, 15 nt, Homo sapiens
ugcuggucauggaau

SEQ ID NO: 1275054 - RNA, 20 nt, Homo sapiens
ugcugguguccugaccaccc

SEQ ID NO: 1275055 - RNA, 14 nt, Homo sapiens
ugcugguuccugac

SEQ ID NO: 1275056 - RNA, 20 nt, Homo sapiens
ugcuguaaaauuauaaacuu

SEQ ID NO: 1275057 - RNA, 14 nt, Homo sapiens
ugcuguaugcugau

SEQ ID NO: 1275058 - RNA, 21 nt, Homo sapiens
ugcuguaugcugaucaucgcc

SEQ ID NO: 1275059 - RNA, 15 nt, Homo sapiens
ugcugucccuauaca

SEQ ID NO: 1275060 - RNA, 24 nt, Homo sapiens
ugcugucuaugauuguacuuugaa

SEQ ID NO: 1275061 - RNA, 14 nt, Homo sapiens
ugcugugaacaauu

SEQ ID NO: 1275062 - RNA, 22 nt, Homo sapiens
ugcugugaggcuguccuguaca

SEQ ID NO: 1275063 - RNA, 21 nt, Homo sapiens
ugcuguuauuuuaucugcuau

SEQ ID NO: 1275064 - RNA, 21 nt, Homo sapiens
ugcuguuucacaauaccucau

SEQ ID NO: 1275065 - RNA, 15 nt, Homo sapiens
ugcuuaaaauuguga

SEQ ID NO: 1275066 - RNA, 16 nt, Homo sapiens
ugcuuaaaauugugag

SEQ ID NO: 1275067 - RNA, 16 nt, Homo sapiens
ugcuuaaacaaaguga

SEQ ID NO: 1275068 - RNA, 14 nt, Homo sapiens
ugcuuaaaguuuua

SEQ ID NO: 1275069 - RNA, 13 nt, Homo sapiens
ugcuuacaaaguc

SEQ ID NO: 1275070 - RNA, 17 nt, Homo sapiens
ugcuuaccuacuuucuu

SEQ ID NO: 1275071 - RNA, 16 nt, Homo sapiens
ugcuuaccugaucuca

SEQ ID NO: 1275072 - RNA, 19 nt, Homo sapiens
ugcuuagacauaacaaaac

SEQ ID NO: 1275073 - RNA, 21 nt, Homo sapiens
ugcuuaggcacucauggguaa

SEQ ID NO: 1275074 - RNA, 23 nt, Homo sapiens
ugcuuaguagagcuuuuugcaug

SEQ ID NO: 1275075 - RNA, 17 nt, Homo sapiens
ugcuuagucccucaugc

SEQ ID NO: 1275076 - RNA, 17 nt, Homo sapiens
ugcuucagacauguaau

SEQ ID NO: 1275077 - RNA, 13 nt, Homo sapiens
ugcuucagaguuu

SEQ ID NO: 1275078 - RNA, 13 nt, Homo sapiens
ugcuucaucugcu

SEQ ID NO: 1275079 - RNA, 16 nt, Homo sapiens
ugcuucauuccaaucu

SEQ ID NO: 1275080 - RNA, 23 nt, Homo sapiens
ugcuucccggcgucccuaccucc

SEQ ID NO: 1275081 - RNA, 16 nt, Homo sapiens
ugcuuccugacaauca

SEQ ID NO: 1275082 - RNA, 13 nt, Homo sapiens
ugcuucgugccac

SEQ ID NO: 1275083 - RNA, 15 nt, Homo sapiens
ugcuucgugccacac

SEQ ID NO: 1275084 - RNA, 23 nt, Homo sapiens
ugcuucuuugaaacuuguaugaa

SEQ ID NO: 1275085 - RNA, 18 nt, Homo sapiens
ugcuugaacccaagaggu

SEQ ID NO: 1275086 - RNA, 15 nt, Homo sapiens
ugcuugaacuaggcu

SEQ ID NO: 1275087 - RNA, 14 nt, Homo sapiens
ugcuugaccaaaga

SEQ ID NO: 1275088 - RNA, 22 nt, Homo sapiens
ugcuugagcucgggaguuugag

SEQ ID NO: 1275089 - RNA, 23 nt, Homo sapiens
ugcuugauauguaaguacuucca

SEQ ID NO: 1275090 - RNA, 18 nt, Homo sapiens
ugcuugcaauguagucaa

SEQ ID NO: 1275091 - RNA, 14 nt, Homo sapiens
ugcuuggcugcugu

SEQ ID NO: 1275092 - RNA, 23 nt, Homo sapiens
ugcuuguugggauuccugaccca

SEQ ID NO: 1275093 - RNA, 15 nt, Homo sapiens
ugcuuuagcuuucca

SEQ ID NO: 1275094 - RNA, 22 nt, Homo sapiens
ugcuuucaagucugacucucca

SEQ ID NO: 1275095 - RNA, 20 nt, Homo sapiens
ugcuuuccagccugggcaac

SEQ ID NO: 1275096 - RNA, 20 nt, Homo sapiens
ugcuuucccauaucuugccu

SEQ ID NO: 1275097 - RNA, 13 nt, Homo sapiens
ugcuuucuguucc

SEQ ID NO: 1275098 - RNA, 17 nt, Homo sapiens
ugcuuugaaacuugccu

SEQ ID NO: 1275099 - RNA, 14 nt, Homo sapiens
ugcuuugaagcagu

SEQ ID NO: 1275100 - RNA, 23 nt, Homo sapiens
ugcuuugccaaguugcugucacu

SEQ ID NO: 1275101 - RNA, 16 nt, Homo sapiens
ugcuuuggcugagggg

SEQ ID NO: 1275102 - RNA, 22 nt, Homo sapiens
ugcuuugggauuuaauuuccag

SEQ ID NO: 1275103 - RNA, 15 nt, Homo sapiens
ugcuuugugagccag

SEQ ID NO: 1275104 - RNA, 19 nt, Homo sapiens
ugcuuuugggagacuggaa

SEQ ID NO: 1275105 - RNA, 15 nt, Homo sapiens
uggaaaaaaaccaca

SEQ ID NO: 1275106 - RNA, 16 nt, Homo sapiens
uggaaaaaaaccacag

SEQ ID NO: 1275107 - RNA, 20 nt, Homo sapiens
uggaaaaaaagacugaugaa

SEQ ID NO: 1275108 - RNA, 19 nt, Homo sapiens
uggaaaaaugguugaugga

SEQ ID NO: 1275109 - RNA, 19 nt, Homo sapiens
uggaaaaccuccuuuacca

SEQ ID NO: 1275110 - RNA, 15 nt, Homo sapiens
uggaaaacuguguug

SEQ ID NO: 1275111 - RNA, 14 nt, Homo sapiens
uggaaaaggaagac

SEQ ID NO: 1275112 - RNA, 23 nt, Homo sapiens
uggaaaauaagacaauaguauuu

SEQ ID NO: 1275113 - RNA, 15 nt, Homo sapiens
uggaaaauaccuaau

SEQ ID NO: 1275114 - RNA, 19 nt, Homo sapiens
uggaaaaugccaugaauua

SEQ ID NO: 1275115 - RNA, 13 nt, Homo sapiens
uggaaaaugucac

SEQ ID NO: 1275116 - RNA, 14 nt, Homo sapiens
uggaaacaggacca

SEQ ID NO: 1275117 - RNA, 12 nt, Homo sapiens
uggaaacuaaga

SEQ ID NO: 1275118 - RNA, 17 nt, Homo sapiens
uggaaagaaucuaauag

SEQ ID NO: 1275119 - RNA, 16 nt, Homo sapiens
uggaaagacugauugu

SEQ ID NO: 1275120 - RNA, 22 nt, Homo sapiens
uggaaagcaucaccucaggcca

SEQ ID NO: 1275121 - RNA, 22 nt, Homo sapiens
uggaaaggcucagucucaggag

SEQ ID NO: 1275122 - RNA, 16 nt, Homo sapiens
uggaaauacacuguua

SEQ ID NO: 1275123 - RNA, 21 nt, Homo sapiens
uggaaaugaaacugcugugaa

SEQ ID NO: 1275124 - RNA, 22 nt, Homo sapiens
uggaaaugacccuauuugauau

SEQ ID NO: 1275125 - RNA, 17 nt, Homo sapiens
ugaaugagccaaagaac

SEQ ID NO: 1275126 - RNA, 18 nt, Homo sapiens
ugaaugcacacuagccuc

SEQ ID NO: 1275127 - RNA, 22 nt, Homo sapiens
ugaaugcgugugcgugcaagca

SEQ ID NO: 1275128 - RNA, 16 nt, Homo sapiens
ugaaugcugccacaac

SEQ ID NO: 1275129 - RNA, 14 nt, Homo sapiens
ugaauggaagcaaa

SEQ ID NO: 1275130 - RNA, 21 nt, Homo sapiens
ugaauguauguaauguguggu

SEQ ID NO: 1275131 - RNA, 17 nt, Homo sapiens
ugaaugucuuacuguga

SEQ ID NO: 1275132 - RNA, 19 nt, Homo sapiens
ugaaugucuuacugugauc

SEQ ID NO: 1275133 - RNA, 11 nt, Homo sapiens
ugaaugugauu

SEQ ID NO: 1275134 - RNA, 11 nt, Homo sapiens
ugaaugugcug

SEQ ID NO: 1275135 - RNA, 23 nt, Homo sapiens
ugaaugugguuacuuccuacugu

SEQ ID NO: 1275136 - RNA, 19 nt, Homo sapiens
ugaauguuuaccaugaaga

SEQ ID NO: 1275137 - RNA, 16 nt, Homo sapiens
ugaauuaugcuuccac

SEQ ID NO: 1275138 - RNA, 13 nt, Homo sapiens
ugaauucaccgug

SEQ ID NO: 1275139 - RNA, 22 nt, Homo sapiens
ugaauucggaacuguccuuucc

SEQ ID NO: 1275140 - RNA, 14 nt, Homo sapiens
ugaauugcaugacu

SEQ ID NO: 1275141 - RNA, 13 nt, Homo sapiens
ugaauuuaauaca

SEQ ID NO: 1275142 - RNA, 11 nt, Homo sapiens
ugacaaaaagc

SEQ ID NO: 1275143 - RNA, 16 nt, Homo sapiens
ugacaacaucgcaaua

SEQ ID NO: 1275144 - RNA, 13 nt, Homo sapiens
ugacaacaugcua

SEQ ID NO: 1275145 - RNA, 19 nt, Homo sapiens
ugacaaccugaauuaucua

SEQ ID NO: 1275146 - RNA, 20 nt, Homo sapiens
ugacaaguauuuucuacuaa

SEQ ID NO: 1275147 - RNA, 13 nt, Homo sapiens
ugacaagugagac

SEQ ID NO: 1275148 - RNA, 23 nt, Homo sapiens
ugacaaucaacucuaauagugcu

SEQ ID NO: 1275149 - RNA, 20 nt, Homo sapiens
ugacaauuacucagguuuga

SEQ ID NO: 1275150 - RNA, 14 nt, Homo sapiens
ugacacaauuggaa

SEQ ID NO: 1275151 - RNA, 19 nt, Homo sapiens
ugacacaguuggauuuauu

SEQ ID NO: 1275152 - RNA, 14 nt, Homo sapiens
ugacacauaugcac

SEQ ID NO: 1275153 - RNA, 15 nt, Homo sapiens
ugacacauaugcacc

SEQ ID NO: 1275154 - RNA, 19 nt, Homo sapiens
ugacacaucaagcuuuucu

SEQ ID NO: 1275155 - RNA, 21 nt, Homo sapiens
ugacaccauucuccugccuca

SEQ ID NO: 1275156 - RNA, 24 nt, Homo sapiens
ugacaccauucuccugccucaccc

SEQ ID NO: 1275157 - RNA, 23 nt, Homo sapiens
ugacacgccuaaggucacagcua

SEQ ID NO: 1275158 - RNA, 21 nt, Homo sapiens
ugacacggccucccucugcua

SEQ ID NO: 1275159 - RNA, 18 nt, Homo sapiens
ugacacgucugccuaccc

SEQ ID NO: 1275160 - RNA, 15 nt, Homo sapiens
ugacacugcucuaac

SEQ ID NO: 1275161 - RNA, 15 nt, Homo sapiens
ugacagaaggaacac

SEQ ID NO: 1275162 - RNA, 13 nt, Homo sapiens
ugacagacaauga

SEQ ID NO: 1275163 - RNA, 19 nt, Homo sapiens
ugacagacaggcucuuagc

SEQ ID NO: 1275164 - RNA, 16 nt, Homo sapiens
ugacagagaauaacuc

SEQ ID NO: 1275165 - RNA, 16 nt, Homo sapiens
ugacagucuugugcuu

SEQ ID NO: 1275166 - RNA, 22 nt, Homo sapiens
ugacaguuaauaaaccuuugca

SEQ ID NO: 1275167 - RNA, 13 nt, Homo sapiens
ugacauaauaaua

SEQ ID NO: 1275168 - RNA, 16 nt, Homo sapiens
ugacauauuaugccug

SEQ ID NO: 1275169 - RNA, 17 nt, Homo sapiens
ugacauauuaugccuga

SEQ ID NO: 1275170 - RNA, 20 nt, Homo sapiens
ugacaucaaagccuggccua

SEQ ID NO: 1275171 - RNA, 15 nt, Homo sapiens
ugacaucacagcagc

SEQ ID NO: 1275172 - RNA, 19 nt, Homo sapiens
ugacaucacagcagccucc

SEQ ID NO: 1275173 - RNA, 17 nt, Homo sapiens
ugacauccaaaucuagc

SEQ ID NO: 1275174 - RNA, 13 nt, Homo sapiens
ugacaugcacuga

SEQ ID NO: 1275175 - RNA, 12 nt, Homo sapiens
ugacaugugcaa

SEQ ID NO: 1275176 - RNA, 20 nt, Homo sapiens
ugacauuuaucaccucugau

SEQ ID NO: 1275177 - RNA, 15 nt, Homo sapiens
ugacauuugguggua

SEQ ID NO: 1275178 - RNA, 17 nt, Homo sapiens
ugaccaaagagcccuca

SEQ ID NO: 1275179 - RNA, 16 nt, Homo sapiens
ugaccaagaacugcau

SEQ ID NO: 1275180 - RNA, 11 nt, Homo sapiens
ugaccaggaac

SEQ ID NO: 1275181 - RNA, 22 nt, Homo sapiens
ugaccaggaucccaagccuccu

SEQ ID NO: 1275182 - RNA, 22 nt, Homo sapiens
ugaccauggaggccagugccag

SEQ ID NO: 1275183 - RNA, 16 nt, Homo sapiens
ugaccauuugacuguu

SEQ ID NO: 1275184 - RNA, 14 nt, Homo sapiens
ugaccccacugcca

SEQ ID NO: 1275185 - RNA, 15 nt, Homo sapiens
ugacccugaugaaaa

SEQ ID NO: 1275186 - RNA, 21 nt, Homo sapiens
ugacccuugucccauguggcu

SEQ ID NO: 1275187 - RNA, 14 nt, Homo sapiens
ugaccgacaugaac

SEQ ID NO: 1275188 - RNA, 24 nt, Homo sapiens
ugaccguacucucacauguggcaa

SEQ ID NO: 1275189 - RNA, 14 nt, Homo sapiens
ugaccuaaauuauu

SEQ ID NO: 1275190 - RNA, 15 nt, Homo sapiens
ugaccuaguuuucca

SEQ ID NO: 1275191 - RNA, 20 nt, Homo sapiens
ugaccucaagugaucugccc

SEQ ID NO: 1275192 - RNA, 14 nt, Homo sapiens
ugaccucaggugau

SEQ ID NO: 1275193 - RNA, 23 nt, Homo sapiens
ugaccucagugagauauuuggua

SEQ ID NO: 1275194 - RNA, 18 nt, Homo sapiens
ugaccucauuuguaaaau

SEQ ID NO: 1275195 - RNA, 14 nt, Homo sapiens
ugaccucccaguga

SEQ ID NO: 1275196 - RNA, 15 nt, Homo sapiens
ugaccucccagugac

SEQ ID NO: 1275197 - RNA, 20 nt, Homo sapiens
ugaccucgcccuccacaaau

SEQ ID NO: 1275198 - RNA, 21 nt, Homo sapiens
ugaccucucagggccuggcag

SEQ ID NO: 1275199 - RNA, 21 nt, Homo sapiens
ugaccucuugcugucucugcu

SEQ ID NO: 1275200 - RNA, 15 nt, Homo sapiens
ugaccugcacaccgc

SEQ ID NO: 1275201 - RNA, 19 nt, Homo sapiens
ugaccuggaaucagugaag

SEQ ID NO: 1275202 - RNA, 22 nt, Homo sapiens
ugaccuggaaucagugaagcca

SEQ ID NO: 1275203 - RNA, 17 nt, Homo sapiens
ugaccugugaccagcac

SEQ ID NO: 1275204 - RNA, 14 nt, Homo sapiens
ugaccuugagcaaa

SEQ ID NO: 1275205 - RNA, 14 nt, Homo sapiens
ugaccuugaucaag

SEQ ID NO: 1275206 - RNA, 20 nt, Homo sapiens
ugaccuugcugauggugaca

SEQ ID NO: 1275207 - RNA, 18 nt, Homo sapiens
ugaccuuggagagacaca

SEQ ID NO: 1275208 - RNA, 15 nt, Homo sapiens
ugacgacaagugcug

SEQ ID NO: 1275209 - RNA, 19 nt, Homo sapiens
ugacgacauacaugcuacu

SEQ ID NO: 1275210 - RNA, 14 nt, Homo sapiens
ugacgcaaaaccac

SEQ ID NO: 1275211 - RNA, 12 nt, Homo sapiens
ugacgcuggaag

SEQ ID NO: 1275212 - RNA, 19 nt, Homo sapiens
ugacggcaccaucuggaag

SEQ ID NO: 1275213 - RNA, 22 nt, Homo sapiens
ugacgugccuuuugcaccccuc

SEQ ID NO: 1275214 - RNA, 17 nt, Homo sapiens
ugacuaacuagacacca

SEQ ID NO: 1275215 - RNA, 16 nt, Homo sapiens
ugacuaguagauuucu

SEQ ID NO: 1275216 - RNA, 15 nt, Homo sapiens
ugacuaucaccccua

SEQ ID NO: 1275217 - RNA, 19 nt, Homo sapiens
ugacuauggcuaccaaaaa

SEQ ID NO: 1275218 - RNA, 21 nt, Homo sapiens
ugacucacaccugaacugaac

SEQ ID NO: 1275219 - RNA, 16 nt, Homo sapiens
ugacucacuuauccca

SEQ ID NO: 1275220 - RNA, 13 nt, Homo sapiens
ugacuccuaccug

SEQ ID NO: 1275221 - RNA, 16 nt, Homo sapiens
ugacuccugcucucug

SEQ ID NO: 1275222 - RNA, 21 nt, Homo sapiens
ugacucuggcaaagcuuuuag

SEQ ID NO: 1275223 - RNA, 14 nt, Homo sapiens
ugacugaaacauuc

SEQ ID NO: 1275224 - RNA, 18 nt, Homo sapiens
ugacugaaggcugucagg

SEQ ID NO: 1275225 - RNA, 15 nt, Homo sapiens
ugacuggcaguauua

SEQ ID NO: 1275226 - RNA, 14 nt, Homo sapiens
ugacugggccuccc

SEQ ID NO: 1275227 - RNA, 16 nt, Homo sapiens
ugacuguaucuugaua

SEQ ID NO: 1275228 - RNA, 22 nt, Homo sapiens
ugacuguauuuuccaacuuguu

SEQ ID NO: 1275229 - RNA, 21 nt, Homo sapiens
ugacuuccccaaacccagaaa

SEQ ID NO: 1275230 - RNA, 18 nt, Homo sapiens
ugacuuccccacugcucu

SEQ ID NO: 1275231 - RNA, 19 nt, Homo sapiens
ugacuuccccacugcucuc

SEQ ID NO: 1275232 - RNA, 21 nt, Homo sapiens
ugacuuccugaacaaccagcu

SEQ ID NO: 1275233 - RNA, 15 nt, Homo sapiens
ugacuuccuuacuaa

SEQ ID NO: 1275234 - RNA, 19 nt, Homo sapiens
ugacuucuccaggucucac

SEQ ID NO: 1275235 - RNA, 22 nt, Homo sapiens
ugacuugcaaagaccuaccucc

SEQ ID NO: 1275236 - RNA, 17 nt, Homo sapiens
ugacuugugucccauga

SEQ ID NO: 1275237 - RNA, 18 nt, Homo sapiens
ugacuuuaaaaggauuaa

SEQ ID NO: 1275238 - RNA, 21 nt, Homo sapiens
ugacuuuauguuguaugauuc

SEQ ID NO: 1275239 - RNA, 17 nt, Homo sapiens
ugacuuucuaaguagga

SEQ ID NO: 1275240 - RNA, 21 nt, Homo sapiens
ugacuuugggaaagagggacc

SEQ ID NO: 1275241 - RNA, 23 nt, Homo sapiens
ugagaaaaguuuaaagacacuua

SEQ ID NO: 1275242 - RNA, 16 nt, Homo sapiens
ugagaaaauaucuugc

SEQ ID NO: 1275243 - RNA, 23 nt, Homo sapiens
ugagaaaauaucuugcuuucaaa

SEQ ID NO: 1275244 - RNA, 12 nt, Homo sapiens
ugagaaagccuu

SEQ ID NO: 1275245 - RNA, 13 nt, Homo sapiens
ugagaaaggugag

SEQ ID NO: 1275246 - RNA, 23 nt, Homo sapiens
ugagaaauuucugugaaaccugu

SEQ ID NO: 1275247 - RNA, 12 nt, Homo sapiens
ugagaacaaagc

SEQ ID NO: 1275248 - RNA, 15 nt, Homo sapiens
ugagaacuugacaag

SEQ ID NO: 1275249 - RNA, 21 nt, Homo sapiens
ugagaagaaugaaaaugcagu

SEQ ID NO: 1275250 - RNA, 13 nt, Homo sapiens
ugagaagaucuga

SEQ ID NO: 1275251 - RNA, 14 nt, Homo sapiens
ugagaagccuucag

SEQ ID NO: 1275252 - RNA, 13 nt, Homo sapiens
ucuuccaugaccc

SEQ ID NO: 1275253 - RNA, 14 nt, Homo sapiens
ucuucccaugacug

SEQ ID NO: 1275254 - RNA, 18 nt, Homo sapiens
ucuucccccuuccaaaua

SEQ ID NO: 1275255 - RNA, 11 nt, Homo sapiens
ucuucccuacc

SEQ ID NO: 1275256 - RNA, 13 nt, Homo sapiens
ucuucccuaccuc

SEQ ID NO: 1275257 - RNA, 21 nt, Homo sapiens
ucuucccuggguuuucugccc

SEQ ID NO: 1275258 - RNA, 18 nt, Homo sapiens
ucuuccuacaugucuaca

SEQ ID NO: 1275259 - RNA, 20 nt, Homo sapiens
ucuuccuacccuccuuccac

SEQ ID NO: 1275260 - RNA, 20 nt, Homo sapiens
ucuuccugaguggugccaaa

SEQ ID NO: 1275261 - RNA, 22 nt, Homo sapiens
ucuuccuggcuccaacacugcu

SEQ ID NO: 1275262 - RNA, 17 nt, Homo sapiens
ucuuccuguuaauguau

SEQ ID NO: 1275263 - RNA, 22 nt, Homo sapiens
ucuuccuuccacaguuaucuua

SEQ ID NO: 1275264 - RNA, 22 nt, Homo sapiens
ucuucuaagaauuuuaucuguu

SEQ ID NO: 1275265 - RNA, 13 nt, Homo sapiens
ucuucuaagcaaa

SEQ ID NO: 1275266 - RNA, 14 nt, Homo sapiens
ucuucuaagcaaaa

SEQ ID NO: 1275267 - RNA, 14 nt, Homo sapiens
ucuucuacuuuaag

SEQ ID NO: 1275268 - RNA, 23 nt, Homo sapiens
ucuucucaaguucuaagauucua

SEQ ID NO: 1275269 - RNA, 17 nt, Homo sapiens
ucuucucauagcauuaa

SEQ ID NO: 1275270 - RNA, 19 nt, Homo sapiens
ucuucucaucuuuuaucua

SEQ ID NO: 1275271 - RNA, 14 nt, Homo sapiens
ucuucuccacugga

SEQ ID NO: 1275272 - RNA, 23 nt, Homo sapiens
ucuucuccaggcuguaucccaug

SEQ ID NO: 1275273 - RNA, 15 nt, Homo sapiens
ucuucucucaucuga

SEQ ID NO: 1275274 - RNA, 12 nt, Homo sapiens
ucuucuggucug

SEQ ID NO: 1275275 - RNA, 18 nt, Homo sapiens
ucuucuggugcuacucca

SEQ ID NO: 1275276 - RNA, 15 nt, Homo sapiens
ucuucuucauucuau

SEQ ID NO: 1275277 - RNA, 19 nt, Homo sapiens
ucuucuuuuuuugugaugu

SEQ ID NO: 1275278 - RNA, 15 nt, Homo sapiens
ucuugaaguucaugg

SEQ ID NO: 1275279 - RNA, 21 nt, Homo sapiens
ucuugaauguggucucaggau

SEQ ID NO: 1275280 - RNA, 19 nt, Homo sapiens
ucuugacguuuacauauau

SEQ ID NO: 1275281 - RNA, 12 nt, Homo sapiens
ucuugacuuccc

SEQ ID NO: 1275282 - RNA, 16 nt, Homo sapiens
ucuugagcaguggcug

SEQ ID NO: 1275283 - RNA, 23 nt, Homo sapiens
ucuugaggaauaaaugccuuuau

SEQ ID NO: 1275284 - RNA, 15 nt, Homo sapiens
ucuugcaacucugua

SEQ ID NO: 1275285 - RNA, 17 nt, Homo sapiens
ucuugcaacucuguaaa

SEQ ID NO: 1275286 - RNA, 14 nt, Homo sapiens
ucuugccacugcac

SEQ ID NO: 1275287 - RNA, 13 nt, Homo sapiens
ucuugcucaaaaa

SEQ ID NO: 1275288 - RNA, 14 nt, Homo sapiens
ucuugcucugccac

SEQ ID NO: 1275289 - RNA, 22 nt, Homo sapiens
ucuuggaaaaaaaccacagcca

SEQ ID NO: 1275290 - RNA, 20 nt, Homo sapiens
ucuuggcguauuuauacuca

SEQ ID NO: 1275291 - RNA, 20 nt, Homo sapiens
ucuuggcucaccauaaccuc

SEQ ID NO: 1275292 - RNA, 16 nt, Homo sapiens
ucuuggcuuugccaca

SEQ ID NO: 1275293 - RNA, 19 nt, Homo sapiens
ucuugggaagaccagcuuu

SEQ ID NO: 1275294 - RNA, 13 nt, Homo sapiens
ucuuggggaauau

SEQ ID NO: 1275295 - RNA, 21 nt, Homo sapiens
ucuuggggcaagacugcaaac

SEQ ID NO: 1275296 - RNA, 23 nt, Homo sapiens
ucuuggggggguggccgcugagu

SEQ ID NO: 1275297 - RNA, 17 nt, Homo sapiens
ucuugguaauccccuaa

SEQ ID NO: 1275298 - RNA, 17 nt, Homo sapiens
ucuuggugaacacacau

SEQ ID NO: 1275299 - RNA, 21 nt, Homo sapiens
ucuuggugugauugcacagaa

SEQ ID NO: 1275300 - RNA, 22 nt, Homo sapiens
ucuuguaagucaucuacuuaau

SEQ ID NO: 1275301 - RNA, 18 nt, Homo sapiens
ucuuguauacacauauau

SEQ ID NO: 1275302 - RNA, 17 nt, Homo sapiens
ucuuguauucaugaaaa

SEQ ID NO: 1275303 - RNA, 22 nt, Homo sapiens
ucuugucagacauaaagccaug

SEQ ID NO: 1275304 - RNA, 15 nt, Homo sapiens
ucuugucccuaagua

SEQ ID NO: 1275305 - RNA, 17 nt, Homo sapiens
ucuugucccuuucccua

SEQ ID NO: 1275306 - RNA, 13 nt, Homo sapiens
ucuugugcuggau

SEQ ID NO: 1275307 - RNA, 17 nt, Homo sapiens
ucuuguuccccacugac

SEQ ID NO: 1275308 - RNA, 14 nt, Homo sapiens
ucuuguugcucaaa

SEQ ID NO: 1275309 - RNA, 22 nt, Homo sapiens
ucuuguuucaauuccaccugca

SEQ ID NO: 1275310 - RNA, 18 nt, Homo sapiens
ucuuuaaaauucacuaau

SEQ ID NO: 1275311 - RNA, 14 nt, Homo sapiens
ucuuuaaaggcauc

SEQ ID NO: 1275312 - RNA, 15 nt, Homo sapiens
ucuuuaagcagagaa

SEQ ID NO: 1275313 - RNA, 24 nt, Homo sapiens
ucuuuaaguauuuguuccugccac

SEQ ID NO: 1275314 - RNA, 17 nt, Homo sapiens
ucuuuaaugucacaggc

SEQ ID NO: 1275315 - RNA, 21 nt, Homo sapiens
ucuuuacaaaacuacaugaga

SEQ ID NO: 1275316 - RNA, 18 nt, Homo sapiens
ucuuuagagcauugccau

SEQ ID NO: 1275317 - RNA, 19 nt, Homo sapiens
ucuuuaguauagccacaaa

SEQ ID NO: 1275318 - RNA, 16 nt, Homo sapiens
ucuuuauacagcugua

SEQ ID NO: 1275319 - RNA, 19 nt, Homo sapiens
ucuuuaucaugaagcacau

SEQ ID NO: 1275320 - RNA, 22 nt, Homo sapiens
ucuuuaucaugaagcacaucaa

SEQ ID NO: 1275321 - RNA, 12 nt, Homo sapiens
ucuuucagagag

SEQ ID NO: 1275322 - RNA, 19 nt, Homo sapiens
ucuuucauaaaaacacuca

SEQ ID NO: 1275323 - RNA, 15 nt, Homo sapiens
ucuuuccaagaccaa

SEQ ID NO: 1275324 - RNA, 13 nt, Homo sapiens
ucuuuccauuuac

SEQ ID NO: 1275325 - RNA, 19 nt, Homo sapiens
ucuuuccuacacacucuga

SEQ ID NO: 1275326 - RNA, 20 nt, Homo sapiens
ucuuuccugaaccaugugga

SEQ ID NO: 1275327 - RNA, 19 nt, Homo sapiens
ucuuucuaaaauauuucau

SEQ ID NO: 1275328 - RNA, 15 nt, Homo sapiens
ucuuucuaaacuaca

SEQ ID NO: 1275329 - RNA, 15 nt, Homo sapiens
ucuuucuacaugacu

SEQ ID NO: 1275330 - RNA, 23 nt, Homo sapiens
ucuuucuauauaaaauguauuca

SEQ ID NO: 1275331 - RNA, 12 nt, Homo sapiens
ucuuucucucag

SEQ ID NO: 1275332 - RNA, 17 nt, Homo sapiens
ucuuucucugccaguga

SEQ ID NO: 1275333 - RNA, 15 nt, Homo sapiens
ucuuucugccaacuu

SEQ ID NO: 1275334 - RNA, 13 nt, Homo sapiens
ucuuucuuuccaa

SEQ ID NO: 1275335 - RNA, 13 nt, Homo sapiens
ucuuucuuucugc

SEQ ID NO: 1275336 - RNA, 20 nt, Homo sapiens
uccucguucaaaacauucca

SEQ ID NO: 1275337 - RNA, 14 nt, Homo sapiens
uccucguuugagaa

SEQ ID NO: 1275338 - RNA, 19 nt, Homo sapiens
uccucuccccagcaaguga

SEQ ID NO: 1275339 - RNA, 19 nt, Homo sapiens
uccucucgagcccagaugg

SEQ ID NO: 1275340 - RNA, 11 nt, Homo sapiens
uccucucugcu

SEQ ID NO: 1275341 - RNA, 14 nt, Homo sapiens
uccucugaacaaaa

SEQ ID NO: 1275342 - RNA, 11 nt, Homo sapiens
uccucugacau

SEQ ID NO: 1275343 - RNA, 10 nt, Homo sapiens
uccucugcau

SEQ ID NO: 1275344 - RNA, 19 nt, Homo sapiens
uccucuggggcauuaucca

SEQ ID NO: 1275345 - RNA, 19 nt, Homo sapiens
uccucuguccaggcacugc

SEQ ID NO: 1275346 - RNA, 22 nt, Homo sapiens
uccucuucucugcauaccguga

SEQ ID NO: 1275347 - RNA, 21 nt, Homo sapiens
uccucuugccucucucaggag

SEQ ID NO: 1275348 - RNA, 16 nt, Homo sapiens
uccugaaaauugcaau

SEQ ID NO: 1275349 - RNA, 13 nt, Homo sapiens
uccugaaagccaa

SEQ ID NO: 1275350 - RNA, 16 nt, Homo sapiens
uccugaacucagcuga

SEQ ID NO: 1275351 - RNA, 14 nt, Homo sapiens
uccugaacuuucuc

SEQ ID NO: 1275352 - RNA, 13 nt, Homo sapiens
uccugacacuuga

SEQ ID NO: 1275353 - RNA, 15 nt, Homo sapiens
uccugacacuuuaau

SEQ ID NO: 1275354 - RNA, 18 nt, Homo sapiens
uccugacaucacagcagc

SEQ ID NO: 1275355 - RNA, 13 nt, Homo sapiens
uccugaccucagg

SEQ ID NO: 1275356 - RNA, 17 nt, Homo sapiens
uccugacuccuaccugc

SEQ ID NO: 1275357 - RNA, 13 nt, Homo sapiens
uccugacuguaac

SEQ ID NO: 1275358 - RNA, 19 nt, Homo sapiens
uccugagaaaggugaggag

SEQ ID NO: 1275359 - RNA, 17 nt, Homo sapiens
uccugagaagcauguaa

SEQ ID NO: 1275360 - RNA, 20 nt, Homo sapiens
uccugagcagugccagcuuu

SEQ ID NO: 1275361 - RNA, 16 nt, Homo sapiens
uccugagccaaggagg

SEQ ID NO: 1275362 - RNA, 16 nt, Homo sapiens
ucacugaaguucuccu

SEQ ID NO: 1275363 - RNA, 18 nt, Homo sapiens
ucacugaugcagaaagac

SEQ ID NO: 1275364 - RNA, 14 nt, Homo sapiens
ucacugcaaccucc

SEQ ID NO: 1275365 - RNA, 12 nt, Homo sapiens
ucacugcaauuu

SEQ ID NO: 1275366 - RNA, 15 nt, Homo sapiens
ucacugccacuuugc

SEQ ID NO: 1275367 - RNA, 11 nt, Homo sapiens
ucacugcugau

SEQ ID NO: 1275368 - RNA, 23 nt, Homo sapiens
uaucaugaagcacaucaauuaca

SEQ ID NO: 1275369 - RNA, 22 nt, Homo sapiens
uaucaugauccucccuaucaag

SEQ ID NO: 1275370 - RNA, 11 nt, Homo sapiens
uaucaugcaaa

SEQ ID NO: 1275371 - RNA, 16 nt, Homo sapiens
uaucauggcauauaac

SEQ ID NO: 1275372 - RNA, 16 nt, Homo sapiens
uaucaugguagucacu

SEQ ID NO: 1275373 - RNA, 20 nt, Homo sapiens
uaucaugguagucacuaaca

SEQ ID NO: 1275374 - RNA, 16 nt, Homo sapiens
uaugucaaagcuuuga

SEQ ID NO: 1275375 - RNA, 21 nt, Homo sapiens
uaugucaggcaaagugcugcu

SEQ ID NO: 1275376 - RNA, 22 nt, Homo sapiens
uaugucaggcaaagugcugcug

SEQ ID NO: 1275377 - RNA, 19 nt, Homo sapiens
uaugucuuggacacuguac

SEQ ID NO: 1275378 - RNA, 20 nt, Homo sapiens
uaugucuuggacacuguaca

SEQ ID NO: 1275379 - RNA, 22 nt, Homo sapiens
uaugugaaaaaaaugagacuua

SEQ ID NO: 1275380 - RNA, 14 nt, Homo sapiens
uaugugcauuucaa

SEQ ID NO: 1275381 - RNA, 16 nt, Homo sapiens
uaugugcuauacacac

SEQ ID NO: 1275382 - RNA, 22 nt, Homo sapiens
uaugugcuauauaaauauguca

SEQ ID NO: 1275383 - RNA, 13 nt, Homo sapiens
uauguguaaguau

SEQ ID NO: 1275384 - RNA, 13 nt, Homo sapiens
uaugugugccuuu

SEQ ID NO: 1275385 - RNA, 22 nt, Homo sapiens
uauguuagagaaugcuugaauu

SEQ ID NO: 1275386 - RNA, 17 nt, Homo sapiens
uauguuaugaacaugca

SEQ ID NO: 1275387 - RNA, 13 nt, Homo sapiens
uauguuauugcau

SEQ ID NO: 1275388 - RNA, 16 nt, Homo sapiens
uauguucccucuuguc

SEQ ID NO: 1275389 - RNA, 20 nt, Homo sapiens
uauguucuccccuacauuag

SEQ ID NO: 1275390 - RNA, 20 nt, Homo sapiens
uauguugaauuccauugccu

SEQ ID NO: 1275391 - RNA, 15 nt, Homo sapiens
uauguugaguguuca

SEQ ID NO: 1275392 - RNA, 20 nt, Homo sapiens
uauguuuacauaucaccuca

SEQ ID NO: 1275393 - RNA, 17 nt, Homo sapiens
uauguuuacuucucacc

SEQ ID NO: 1275394 - RNA, 14 nt, Homo sapiens
uauguuucacugug

SEQ ID NO: 1275395 - RNA, 17 nt, Homo sapiens
uauguuuggaauaaagu

SEQ ID NO: 1275396 - RNA, 20 nt, Homo sapiens
uauuaaaauaaauguuguuu

SEQ ID NO: 1275397 - RNA, 18 nt, Homo sapiens
uauuaacauaagaaaaga

SEQ ID NO: 1275398 - RNA, 19 nt, Homo sapiens
uauuaacaugcuuaugaca

SEQ ID NO: 1275399 - RNA, 15 nt, Homo sapiens
uauuaacuugcuaca

SEQ ID NO: 1275400 - RNA, 12 nt, Homo sapiens
uauuaagcacuu

SEQ ID NO: 1275401 - RNA, 15 nt, Homo sapiens
uauuaagcacuuuaa

SEQ ID NO: 1275402 - RNA, 19 nt, Homo sapiens
uauuaagugccugagacac

SEQ ID NO: 1275403 - RNA, 15 nt, Homo sapiens
uauuaauaaagcauu

SEQ ID NO: 1275404 - RNA, 16 nt, Homo sapiens
uauuaauaaagcauuc

SEQ ID NO: 1275405 - RNA, 22 nt, Homo sapiens
uauuaauaaagcauucuuuaac

SEQ ID NO: 1275406 - RNA, 14 nt, Homo sapiens
uauuaauucuucac

SEQ ID NO: 1275407 - RNA, 13 nt, Homo sapiens
uauuacaaacaag

SEQ ID NO: 1275408 - RNA, 20 nt, Homo sapiens
uauuacaauuuguauuacuu

SEQ ID NO: 1275409 - RNA, 12 nt, Homo sapiens
uauuacagugaa

SEQ ID NO: 1275410 - RNA, 12 nt, Homo sapiens
uauuaccaaaaa

SEQ ID NO: 1275411 - RNA, 12 nt, Homo sapiens
uauuaccagcaa

SEQ ID NO: 1275412 - RNA, 18 nt, Homo sapiens
uauuacugaaaaugauuc

SEQ ID NO: 1275413 - RNA, 14 nt, Homo sapiens
uauuagaaauuaga

SEQ ID NO: 1275414 - RNA, 13 nt, Homo sapiens
uauuagauuuauu

SEQ ID NO: 1275415 - RNA, 16 nt, Homo sapiens
uauuagcuuauauauu

SEQ ID NO: 1275416 - RNA, 17 nt, Homo sapiens
uauuaggaaauucugau

SEQ ID NO: 1275417 - RNA, 15 nt, Homo sapiens
uauuaggccauauau

SEQ ID NO: 1275418 - RNA, 15 nt, Homo sapiens
uauuaguuaaucucc

SEQ ID NO: 1275419 - RNA, 13 nt, Homo sapiens
uauuauaagcauu

SEQ ID NO: 1275420 - RNA, 20 nt, Homo sapiens
uauuaucuacaaacacugca

SEQ ID NO: 1275421 - RNA, 20 nt, Homo sapiens
uauuauucaaaccaauuucu

SEQ ID NO: 1275422 - RNA, 13 nt, Homo sapiens
uauuauuguggaa

SEQ ID NO: 1275423 - RNA, 14 nt, Homo sapiens
uauucaagcacuua

SEQ ID NO: 1275424 - RNA, 23 nt, Homo sapiens
uauucacauauaucaaagugaga

SEQ ID NO: 1275425 - RNA, 20 nt, Homo sapiens
uauucaccuuuucuucaaaa

SEQ ID NO: 1275426 - RNA, 13 nt, Homo sapiens
uauucacugaugc

SEQ ID NO: 1275427 - RNA, 14 nt, Homo sapiens
uauucagacaagca

SEQ ID NO: 1275428 - RNA, 13 nt, Homo sapiens
uauucagcccacu

SEQ ID NO: 1275429 - RNA, 17 nt, Homo sapiens
uauucauccuaaaaagu

SEQ ID NO: 1275430 - RNA, 19 nt, Homo sapiens
uauucauccuaaaaaguuc

SEQ ID NO: 1275431 - RNA, 10 nt, Homo sapiens
uauucauugg

SEQ ID NO: 1275432 - RNA, 14 nt, Homo sapiens
uauucauuggucua

SEQ ID NO: 1275433 - RNA, 16 nt, Homo sapiens
uauuccacuuaggaag

SEQ ID NO: 1275434 - RNA, 22 nt, Homo sapiens
uauuccauauucauguaaacaa

SEQ ID NO: 1275435 - RNA, 11 nt, Homo sapiens
uauuccaucaa

SEQ ID NO: 1275436 - RNA, 23 nt, Homo sapiens
uauuccccccacuuaagacugug

SEQ ID NO: 1275437 - RNA, 14 nt, Homo sapiens
uauuccucuaggca

SEQ ID NO: 1275438 - RNA, 16 nt, Homo sapiens
uauuccuuucuaucau

SEQ ID NO: 1275439 - RNA, 17 nt, Homo sapiens
uauucgaaccacugaga

SEQ ID NO: 1275440 - RNA, 15 nt, Homo sapiens
uauucuagccugcau

SEQ ID NO: 1275441 - RNA, 16 nt, Homo sapiens
uauucucaguguaggg

SEQ ID NO: 1275442 - RNA, 15 nt, Homo sapiens
uauucucaugccuca

SEQ ID NO: 1275443 - RNA, 15 nt, Homo sapiens
uauucuccauacucu

SEQ ID NO: 1275444 - RNA, 21 nt, Homo sapiens
uauucucuuaugauacuugag

SEQ ID NO: 1275445 - RNA, 17 nt, Homo sapiens
uauucugauuccacuuu

SEQ ID NO: 1275446 - RNA, 17 nt, Homo sapiens
uauucugguuacugugg

SEQ ID NO: 1275447 - RNA, 15 nt, Homo sapiens
uauucuucauaacaa

SEQ ID NO: 1275448 - RNA, 13 nt, Homo sapiens
uauucuucuagag

SEQ ID NO: 1275449 - RNA, 15 nt, Homo sapiens
uauucuugugcuuuu

SEQ ID NO: 1275450 - RNA, 13 nt, Homo sapiens
uauucuuuacuau

SEQ ID NO: 1275451 - RNA, 19 nt, Homo sapiens
uauugaagaaaagcacuuu

SEQ ID NO: 1275452 - RNA, 14 nt, Homo sapiens
uauugaaucuuaau

SEQ ID NO: 1275453 - RNA, 19 nt, Homo sapiens
uauugaugauaacacuuaa

SEQ ID NO: 1275454 - RNA, 13 nt, Homo sapiens
uauugauuucaaa

SEQ ID NO: 1275455 - RNA, 15 nt, Homo sapiens
uauugcaagcauuga

SEQ ID NO: 1275456 - RNA, 18 nt, Homo sapiens
uauugcaggauucuguaa

SEQ ID NO: 1275457 - RNA, 13 nt, Homo sapiens
uauuggacagucu

SEQ ID NO: 1275458 - RNA, 20 nt, Homo sapiens
uauugggagaggucauaaaa

SEQ ID NO: 1275459 - RNA, 14 nt, Homo sapiens
uauugguguuuacc

SEQ ID NO: 1275460 - RNA, 15 nt, Homo sapiens
uauugguuugcacaa

SEQ ID NO: 1275461 - RNA, 15 nt, Homo sapiens
uauugucugccuuaa

SEQ ID NO: 1275462 - RNA, 19 nt, Homo sapiens
uauugugccaauauguauu

SEQ ID NO: 1275463 - RNA, 15 nt, Homo sapiens
uauugugguauugaa

SEQ ID NO: 1275464 - RNA, 17 nt, Homo sapiens
uauuguuccaagacauu

SEQ ID NO: 1275465 - RNA, 23 nt, Homo sapiens
uauuguuccaagacauugucaau

SEQ ID NO: 1275466 - RNA, 15 nt, Homo sapiens
uauuguuggcacaga

SEQ ID NO: 1275467 - RNA, 14 nt, Homo sapiens
uauuguuucugcau

SEQ ID NO: 1275468 - RNA, 18 nt, Homo sapiens
uauuuaaaaaauuaugga

SEQ ID NO: 1275469 - RNA, 19 nt, Homo sapiens
uauuuaaacucaagacaau

SEQ ID NO: 1275470 - RNA, 13 nt, Homo sapiens
uauuuaaagcauu

SEQ ID NO: 1275471 - RNA, 14 nt, Homo sapiens
uauuuaaguucaua

SEQ ID NO: 1275472 - RNA, 14 nt, Homo sapiens
uauuuacucauagu

SEQ ID NO: 1275473 - RNA, 20 nt, Homo sapiens
uauuuacuguacuaauuaga

SEQ ID NO: 1275474 - RNA, 13 nt, Homo sapiens
uauuuauaaacua

SEQ ID NO: 1275475 - RNA, 21 nt, Homo sapiens
uauuuauaauuccuauauccu

SEQ ID NO: 1275476 - RNA, 16 nt, Homo sapiens
uauuuauacuuugcaa

SEQ ID NO: 1275477 - RNA, 12 nt, Homo sapiens
uauuuaugcaag

SEQ ID NO: 1275478 - RNA, 21 nt, Homo sapiens
uauuuaugcacugugggaugu

SEQ ID NO: 1275479 - RNA, 14 nt, Homo sapiens
uauuuaugccucug

SEQ ID NO: 1275480 - RNA, 15 nt, Homo sapiens
uauuuaugugugagg

SEQ ID NO: 1275481 - RNA, 19 nt, Homo sapiens
uauuuauuuuuugccauuu

SEQ ID NO: 1275482 - RNA, 13 nt, Homo sapiens
uauuucacuuuag

SEQ ID NO: 1275483 - RNA, 15 nt, Homo sapiens
uauuucagaaauaca

SEQ ID NO: 1275484 - RNA, 16 nt, Homo sapiens
uauuucagaacuuuga

SEQ ID NO: 1275485 - RNA, 18 nt, Homo sapiens
uauuucagaacuuugaga

SEQ ID NO: 1275486 - RNA, 19 nt, Homo sapiens
uauuucauugccuguguau

SEQ ID NO: 1275487 - RNA, 21 nt, Homo sapiens
uauuuccacuuauaaaggaaa

SEQ ID NO: 1275488 - RNA, 13 nt, Homo sapiens
uauuuccacuugc

SEQ ID NO: 1275489 - RNA, 19 nt, Homo sapiens
uauuuccauucaacaagag

SEQ ID NO: 1275490 - RNA, 19 nt, Homo sapiens
uauuucccauuugugccag

SEQ ID NO: 1275491 - RNA, 18 nt, Homo sapiens
uauuucccucaccuuucc

SEQ ID NO: 1275492 - RNA, 12 nt, Homo sapiens
uauuuccuugcc

SEQ ID NO: 1275493 - RNA, 15 nt, Homo sapiens
uauuucuacauaguc

SEQ ID NO: 1275494 - RNA, 21 nt, Homo sapiens
uauuucucaacaaagcacagu

SEQ ID NO: 1275495 - RNA, 17 nt, Homo sapiens
uauuucuuccuaccaag

SEQ ID NO: 1275496 - RNA, 21 nt, Homo sapiens
uauuugaaaauuuuacuucca

SEQ ID NO: 1275497 - RNA, 12 nt, Homo sapiens
uauuugaacccc

SEQ ID NO: 1275498 - RNA, 14 nt, Homo sapiens
uauuugaauaucau

SEQ ID NO: 1275499 - RNA, 13 nt, Homo sapiens
uauuugcaauauu

SEQ ID NO: 1275500 - RNA, 20 nt, Homo sapiens
uauuugcacuauuuccacau

SEQ ID NO: 1275501 - RNA, 22 nt, Homo sapiens
guaccacccuucagaccccagu

SEQ ID NO: 1275502 - RNA, 21 nt, Homo sapiens
guaccacucaggccaacaagc

SEQ ID NO: 1275503 - RNA, 22 nt, Homo sapiens
guaccauuuucuaucauggaau

SEQ ID NO: 1275504 - RNA, 20 nt, Homo sapiens
guacccucgcaugacuguua

SEQ ID NO: 1275505 - RNA, 20 nt, Homo sapiens
guaccuacagagcagccagg

SEQ ID NO: 1275506 - RNA, 15 nt, Homo sapiens
guaccucacuuuaca

SEQ ID NO: 1275507 - RNA, 14 nt, Homo sapiens
guaccucucuuaua

SEQ ID NO: 1275508 - RNA, 15 nt, Homo sapiens
guacuaguccaucau

SEQ ID NO: 1275509 - RNA, 12 nt, Homo sapiens
guacucaaugga

SEQ ID NO: 1275510 - RNA, 16 nt, Homo sapiens
guacucagcgaaugaa

SEQ ID NO: 1275511 - RNA, 16 nt, Homo sapiens
guacuccuuaagaaca

SEQ ID NO: 1275512 - RNA, 15 nt, Homo sapiens
guacucucugcucua

SEQ ID NO: 1275513 - RNA, 19 nt, Homo sapiens
guacucuuaggauauuuga

SEQ ID NO: 1275514 - RNA, 16 nt, Homo sapiens
guacugauggacuuaa

SEQ ID NO: 1275515 - RNA, 15 nt, Homo sapiens
guacuggccaguguc

SEQ ID NO: 1275516 - RNA, 22 nt, Homo sapiens
guacuuauaaagaagguuggug

SEQ ID NO: 1275517 - RNA, 15 nt, Homo sapiens
guagaauugcauuga

SEQ ID NO: 1275518 - RNA, 13 nt, Homo sapiens
guagaauugcugu

SEQ ID NO: 1275519 - RNA, 12 nt, Homo sapiens
guagacuguggc

SEQ ID NO: 1275520 - RNA, 22 nt, Homo sapiens
guagagacaggguuuugccaug

SEQ ID NO: 1275521 - RNA, 20 nt, Homo sapiens
guagagacgguguuuugcca

SEQ ID NO: 1275522 - RNA, 19 nt, Homo sapiens
guagagcauaccacuugaa

SEQ ID NO: 1275523 - RNA, 18 nt, Homo sapiens
guagagguuuuguuguuu

SEQ ID NO: 1275524 - RNA, 15 nt, Homo sapiens
guagauauuaauuaa

SEQ ID NO: 1275525 - RNA, 20 nt, Homo sapiens
guagcaaauuaacuuuacau

SEQ ID NO: 1275526 - RNA, 12 nt, Homo sapiens
guagcacugagg

SEQ ID NO: 1275527 - RNA, 17 nt, Homo sapiens
guagcagugucuguaaa

SEQ ID NO: 1275528 - RNA, 15 nt, Homo sapiens
guagcauaacuguag

SEQ ID NO: 1275529 - RNA, 18 nt, Homo sapiens
guagcauuucuugauguu

SEQ ID NO: 1275530 - RNA, 16 nt, Homo sapiens
guagcccauccuuccc

SEQ ID NO: 1275531 - RNA, 16 nt, Homo sapiens
guagccugugcaugua

SEQ ID NO: 1275532 - RNA, 21 nt, Homo sapiens
guagcuauuuuucuuguugca

SEQ ID NO: 1275533 - RNA, 19 nt, Homo sapiens
guagcucuggaccugucuc

SEQ ID NO: 1275534 - RNA, 12 nt, Homo sapiens
guagcugaugaa

SEQ ID NO: 1275535 - RNA, 20 nt, Homo sapiens
guagcugggauuacaggugu

SEQ ID NO: 1275536 - RNA, 22 nt, Homo sapiens
guagcugugucauguauauacc

SEQ ID NO: 1275537 - RNA, 17 nt, Homo sapiens
guagcuuaccugacaca

SEQ ID NO: 1275538 - RNA, 17 nt, Homo sapiens
guagcuugcucccugug

SEQ ID NO: 1275539 - RNA, 16 nt, Homo sapiens
guaggggcuacuguga

SEQ ID NO: 1275540 - RNA, 16 nt, Homo sapiens
guaggugaaagaacaa

SEQ ID NO: 1275541 - RNA, 17 nt, Homo sapiens
guagugaaauuauacag

SEQ ID NO: 1275542 - RNA, 20 nt, Homo sapiens
guagugaaauuauacagaua

SEQ ID NO: 1275543 - RNA, 15 nt, Homo sapiens
guagugccacuguug

SEQ ID NO: 1275544 - RNA, 17 nt, Homo sapiens
gucacauggccuaugca

SEQ ID NO: 1275545 - RNA, 18 nt, Homo sapiens
gucacauggccuaugcac

SEQ ID NO: 1275546 - RNA, 21 nt, Homo sapiens
gucaccagaauauuucuuuca

SEQ ID NO: 1275547 - RNA, 21 nt, Homo sapiens
gucaccaguuaaaagcauuuu

SEQ ID NO: 1275548 - RNA, 14 nt, Homo sapiens
gucacccacuguca

SEQ ID NO: 1275549 - RNA, 13 nt, Homo sapiens
gucaccuagcuca

SEQ ID NO: 1275550 - RNA, 14 nt, Homo sapiens
gucaccuagcucaa

SEQ ID NO: 1275551 - RNA, 21 nt, Homo sapiens
gucacgcacaagggcacguga

SEQ ID NO: 1275552 - RNA, 23 nt, Homo sapiens
gucacgcuggggcucucugagac

SEQ ID NO: 1275553 - RNA, 15 nt, Homo sapiens
gucacucauugcuga

SEQ ID NO: 1275554 - RNA, 21 nt, Homo sapiens
gucacucuguaguuacugugg

SEQ ID NO: 1275555 - RNA, 16 nt, Homo sapiens
gucacugacacaaagg

SEQ ID NO: 1275556 - RNA, 16 nt, Homo sapiens
gucacugacaguuaau

SEQ ID NO: 1275557 - RNA, 16 nt, Homo sapiens
gucagaaaacagagaa

SEQ ID NO: 1275558 - RNA, 12 nt, Homo sapiens
gucagacauaaa

SEQ ID NO: 1275559 - RNA, 13 nt, Homo sapiens
gucagacauaaag

SEQ ID NO: 1275560 - RNA, 17 nt, Homo sapiens
gucagacauaaagccau

SEQ ID NO: 1275561 - RNA, 14 nt, Homo sapiens
gucagagcacuccc

SEQ ID NO: 1275562 - RNA, 20 nt, Homo sapiens
gucagaggauggccaguguc

SEQ ID NO: 1275563 - RNA, 20 nt, Homo sapiens
gucagcucccuucucuguag

SEQ ID NO: 1275564 - RNA, 19 nt, Homo sapiens
gucaggaaaacuguuccaa

SEQ ID NO: 1275565 - RNA, 13 nt, Homo sapiens
gucaggacuguga

SEQ ID NO: 1275566 - RNA, 15 nt, Homo sapiens
gucaggauucuucaa

SEQ ID NO: 1275567 - RNA, 23 nt, Homo sapiens
gucaggcccugaucuagugcagu

SEQ ID NO: 1275568 - RNA, 15 nt, Homo sapiens
gucaggcugcagagg

SEQ ID NO: 1275569 - RNA, 18 nt, Homo sapiens
gucagggaaggugccucu

SEQ ID NO: 1275570 - RNA, 14 nt, Homo sapiens
gucaguacuauuca

SEQ ID NO: 1275571 - RNA, 22 nt, Homo sapiens
gucaguauuucaacugcuguaa

SEQ ID NO: 1275572 - RNA, 16 nt, Homo sapiens
gucaguggaagcccca

SEQ ID NO: 1275573 - RNA, 12 nt, Homo sapiens
gucagugucugg

SEQ ID NO: 1275574 - RNA, 13 nt, Homo sapiens
gucaguguucuua

SEQ ID NO: 1275575 - RNA, 17 nt, Homo sapiens
gucaucacacucuccau

SEQ ID NO: 1275576 - RNA, 17 nt, Homo sapiens
gucauccucaugcugcu

SEQ ID NO: 1275577 - RNA, 23 nt, Homo sapiens
gucaucgggaggagcagccugaa

SEQ ID NO: 1275578 - RNA, 15 nt, Homo sapiens
gucaucgggccagaa

SEQ ID NO: 1275579 - RNA, 16 nt, Homo sapiens
gucaugaccuccaggg

SEQ ID NO: 1275580 - RNA, 18 nt, Homo sapiens
gucaugaccuccagggag

SEQ ID NO: 1275581 - RNA, 21 nt, Homo sapiens
gucaugacggggacagaguga

SEQ ID NO: 1275582 - RNA, 15 nt, Homo sapiens
gucaugguuacaaac

SEQ ID NO: 1275583 - RNA, 21 nt, Homo sapiens
gucaugucucugguggugcug

SEQ ID NO: 1275584 - RNA, 16 nt, Homo sapiens
gucauguguuuugcca

SEQ ID NO: 1275585 - RNA, 23 nt, Homo sapiens
gucauuauuuuuguuagcaaaga

SEQ ID NO: 1275586 - RNA, 20 nt, Homo sapiens
gucauuggccgacaucacag

SEQ ID NO: 1275587 - RNA, 17 nt, Homo sapiens
gaggcugucacaguccu

SEQ ID NO: 1275588 - RNA, 15 nt, Homo sapiens
gaggcuuuacagugu

SEQ ID NO: 1275589 - RNA, 23 nt, Homo sapiens
gagggaagaaugaacacucccca

SEQ ID NO: 1275590 - RNA, 15 nt, Homo sapiens
gagggagaagcauga

SEQ ID NO: 1275591 - RNA, 13 nt, Homo sapiens
gagggaggcgcug

SEQ ID NO: 1275592 - RNA, 14 nt, Homo sapiens
gagggagggcggug

SEQ ID NO: 1275593 - RNA, 20 nt, Homo sapiens
gagggagggcugacccagau

SEQ ID NO: 1275594 - RNA, 20 nt, Homo sapiens
gagggcaaucuuugccuuua

SEQ ID NO: 1275595 - RNA, 16 nt, Homo sapiens
gagggcagacuggggc

SEQ ID NO: 1275596 - RNA, 20 nt, Homo sapiens
gagggcccagggucauucuu

SEQ ID NO: 1275597 - RNA, 17 nt, Homo sapiens
gagggccccgcccagug

SEQ ID NO: 1275598 - RNA, 20 nt, Homo sapiens
gagggcggggagaaucucag

SEQ ID NO: 1275599 - RNA, 19 nt, Homo sapiens
gagggcugcugaccauuug

SEQ ID NO: 1275600 - RNA, 20 nt, Homo sapiens
gagggcuggcuggccucacc

SEQ ID NO: 1275601 - RNA, 23 nt, Homo sapiens
gagggcuuccucuagaagccaag

SEQ ID NO: 1275602 - RNA, 20 nt, Homo sapiens
gaggggagagagaaccacca

SEQ ID NO: 1275603 - RNA, 19 nt, Homo sapiens
gagggggcuugaagccaaa

SEQ ID NO: 1275604 - RNA, 19 nt, Homo sapiens
gagggguaagagaggaugu

SEQ ID NO: 1275605 - RNA, 19 nt, Homo sapiens
gaggguaugucagugucac

SEQ ID NO: 1275606 - RNA, 23 nt, Homo sapiens
gaggguccucaguccacugcuga

SEQ ID NO: 1275607 - RNA, 15 nt, Homo sapiens
gagggucuucuuaca

SEQ ID NO: 1275608 - RNA, 14 nt, Homo sapiens
gaggguguggugcu

SEQ ID NO: 1275609 - RNA, 21 nt, Homo sapiens
gaggguuccucuuaggucaga

SEQ ID NO: 1275610 - RNA, 22 nt, Homo sapiens
gagguaccagcaauauguaaau

SEQ ID NO: 1275611 - RNA, 13 nt, Homo sapiens
gaggucacuggaa

SEQ ID NO: 1275612 - RNA, 16 nt, Homo sapiens
gaggucaggaagcagg

SEQ ID NO: 1275613 - RNA, 17 nt, Homo sapiens
gaggucaggccccacuc

SEQ ID NO: 1275614 - RNA, 23 nt, Homo sapiens
gaggucagggagugcuggcucac

SEQ ID NO: 1275615 - RNA, 15 nt, Homo sapiens
gaggucucccaaacg

SEQ ID NO: 1275616 - RNA, 14 nt, Homo sapiens
gaggugagccucac

SEQ ID NO: 1275617 - RNA, 22 nt, Homo sapiens
gaggugagggggguucuccuuu

SEQ ID NO: 1275618 - RNA, 16 nt, Homo sapiens
gaggugaucuagcaga

SEQ ID NO: 1275619 - RNA, 20 nt, Homo sapiens
gagguggagauugcagugag

SEQ ID NO: 1275620 - RNA, 18 nt, Homo sapiens
gagguggagguugcagug

SEQ ID NO: 1275621 - RNA, 20 nt, Homo sapiens
gagguggagguugcagugag

SEQ ID NO: 1275622 - RNA, 21 nt, Homo sapiens
gaggugggcaugccacccuca

SEQ ID NO: 1275623 - RNA, 21 nt, Homo sapiens
gagguguacacuaacauuucc

SEQ ID NO: 1275624 - RNA, 14 nt, Homo sapiens
gagguuaggaguag

SEQ ID NO: 1275625 - RNA, 18 nt, Homo sapiens
gagguugcagugagccau

SEQ ID NO: 1275626 - RNA, 14 nt, Homo sapiens
gaguaaaacuguau

SEQ ID NO: 1275627 - RNA, 21 nt, Homo sapiens
gaguaaaacuguauaaacaaa

SEQ ID NO: 1275628 - RNA, 19 nt, Homo sapiens
gaguaacauuugcuguuuu

SEQ ID NO: 1275629 - RNA, 18 nt, Homo sapiens
gaguaauacaucaaagag

SEQ ID NO: 1275630 - RNA, 15 nt, Homo sapiens
gaguacaaacacagg

SEQ ID NO: 1275631 - RNA, 13 nt, Homo sapiens
gaguauacuaaaa

SEQ ID NO: 1275632 - RNA, 12 nt, Homo sapiens
gaguauaugcac

SEQ ID NO: 1275633 - RNA, 14 nt, Homo sapiens
gaguauccuaccca

SEQ ID NO: 1275634 - RNA, 21 nt, Homo sapiens
gcaugucagacagaacuugaa

SEQ ID NO: 1275635 - RNA, 15 nt, Homo sapiens
gcaugucgcacaaug

SEQ ID NO: 1275636 - RNA, 13 nt, Homo sapiens
gcaugugaucucc

SEQ ID NO: 1275637 - RNA, 14 nt, Homo sapiens
gcaugugcagcuau

SEQ ID NO: 1275638 - RNA, 11 nt, Homo sapiens
gcaugugccau

SEQ ID NO: 1275639 - RNA, 15 nt, Homo sapiens
gcaugugugauuuca

SEQ ID NO: 1275640 - RNA, 21 nt, Homo sapiens
gcauuaaaaaaaaaaucaaug

SEQ ID NO: 1275641 - RNA, 14 nt, Homo sapiens
gcauuaaccugucu

SEQ ID NO: 1275642 - RNA, 16 nt, Homo sapiens
gcauuacuugcuuuca

SEQ ID NO: 1275643 - RNA, 21 nt, Homo sapiens
gcauuagcucuuagacccaca

SEQ ID NO: 1275644 - RNA, 22 nt, Homo sapiens
gcauuaucuuugucuguucacu

SEQ ID NO: 1275645 - RNA, 20 nt, Homo sapiens
gcauuauguccacuguguau

SEQ ID NO: 1275646 - RNA, 19 nt, Homo sapiens
gcauucccucccaucaugc

SEQ ID NO: 1275647 - RNA, 15 nt, Homo sapiens
gcauuccugaugacc

SEQ ID NO: 1275648 - RNA, 19 nt, Homo sapiens
gcauuccuguaacuuuuaa

SEQ ID NO: 1275649 - RNA, 22 nt, Homo sapiens
gcauugucuuguucugucccuu

SEQ ID NO: 1275650 - RNA, 21 nt, Homo sapiens
gcauuuacagaaacgcaucca

SEQ ID NO: 1275651 - RNA, 19 nt, Homo sapiens
gcauuuacuuuguguucac

SEQ ID NO: 1275652 - RNA, 12 nt, Homo sapiens
gcauuuacuuuu

SEQ ID NO: 1275653 - RNA, 22 nt, Homo sapiens
gcauuuauuuauacagugccuu

SEQ ID NO: 1275654 - RNA, 16 nt, Homo sapiens
gcauuucaccugugac

SEQ ID NO: 1275655 - RNA, 22 nt, Homo sapiens
gcauuucauucuucucuagcug

SEQ ID NO: 1275656 - RNA, 15 nt, Homo sapiens
gcauuuccagacuug

SEQ ID NO: 1275657 - RNA, 18 nt, Homo sapiens
gcauuuccuggucagugg

SEQ ID NO: 1275658 - RNA, 16 nt, Homo sapiens
gcauuugauuuugccc

SEQ ID NO: 1275659 - RNA, 21 nt, Homo sapiens
gcauuugucaaugacaguuuc

SEQ ID NO: 1275660 - RNA, 14 nt, Homo sapiens
gcauuuuacaggug

SEQ ID NO: 1275661 - RNA, 19 nt, Homo sapiens
gcauuuucuucucugcacu

SEQ ID NO: 1275662 - RNA, 17 nt, Homo sapiens
gcauuuugucaguuuua

SEQ ID NO: 1275663 - RNA, 15 nt, Homo sapiens
gcauuuuuaaauaca

SEQ ID NO: 1275664 - RNA, 14 nt, Homo sapiens
gcauuuuucuggga

SEQ ID NO: 1275665 - RNA, 22 nt, Homo sapiens
gccaaacaaaacugaaccacaa

SEQ ID NO: 1275666 - RNA, 23 nt, Homo sapiens
gccaaagagaaugccauucucuu

SEQ ID NO: 1275667 - RNA, 18 nt, Homo sapiens
gccaaaggaugugauaua

SEQ ID NO: 1275668 - RNA, 16 nt, Homo sapiens
gccaaauaaacagcua

SEQ ID NO: 1275669 - RNA, 23 nt, Homo sapiens
gccaacaucuggaucaauguaau

SEQ ID NO: 1275670 - RNA, 17 nt, Homo sapiens
gccaaccggucacccag

SEQ ID NO: 1275671 - RNA, 22 nt, Homo sapiens
gccaacucuaacaggcacuuug

SEQ ID NO: 1275672 - RNA, 12 nt, Homo sapiens
gccaacugaaaa

SEQ ID NO: 1275673 - RNA, 12 nt, Homo sapiens
gccaacuuuguu

SEQ ID NO: 1275674 - RNA, 17 nt, Homo sapiens
gccaagaaaauugccuu

SEQ ID NO: 1275675 - RNA, 17 nt, Homo sapiens
gccaagaauacuugaag

SEQ ID NO: 1275676 - RNA, 12 nt, Homo sapiens
gccaagacuccu

SEQ ID NO: 1275677 - RNA, 23 nt, Homo sapiens
gccaagcuaauuuauagcaagau

SEQ ID NO: 1275678 - RNA, 20 nt, Homo sapiens
gccaagggaaaggggugcuu

SEQ ID NO: 1275679 - RNA, 14 nt, Homo sapiens
gccaagguccugcu

SEQ ID NO: 1275680 - RNA, 18 nt, Homo sapiens
gccaauaaaaaugucuca

SEQ ID NO: 1275681 - RNA, 18 nt, Homo sapiens
gccaauaauaaaugcccu

SEQ ID NO: 1275682 - RNA, 14 nt, Homo sapiens
gccaauauccugua

SEQ ID NO: 1275683 - RNA, 18 nt, Homo sapiens
gccaauauuucugauaua

SEQ ID NO: 1275684 - RNA, 19 nt, Homo sapiens
gccaaucccgccaugcuca

SEQ ID NO: 1275685 - RNA, 18 nt, Homo sapiens
gccaauggagacugucuc

SEQ ID NO: 1275686 - RNA, 11 nt, Homo sapiens
gccacaaccaa

SEQ ID NO: 1275687 - RNA, 15 nt, Homo sapiens
gccacaagucuucca

SEQ ID NO: 1275688 - RNA, 18 nt, Homo sapiens
gccacacccagcggcccc

SEQ ID NO: 1275689 - RNA, 21 nt, Homo sapiens
gccacagaccuaggauuucau

SEQ ID NO: 1275690 - RNA, 21 nt, Homo sapiens
gccacaggcaccucuccugcc

SEQ ID NO: 1275691 - RNA, 23 nt, Homo sapiens
gccacauaagggguuugccauuu

SEQ ID NO: 1275692 - RNA, 17 nt, Homo sapiens
gccacauggcugggauu

SEQ ID NO: 1275693 - RNA, 22 nt, Homo sapiens
gccaccacauuuagaacuuugg

SEQ ID NO: 1275694 - RNA, 13 nt, Homo sapiens
gccaccaguucuc

SEQ ID NO: 1275695 - RNA, 16 nt, Homo sapiens
gccaccccaacccaau

SEQ ID NO: 1275696 - RNA, 15 nt, Homo sapiens
gguuuuuucaauuua

SEQ ID NO: 1275697 - RNA, 15 nt, Homo sapiens
guaaaaacuguucuc

SEQ ID NO: 1275698 - RNA, 18 nt, Homo sapiens
guaaaaaugcugcucuca

SEQ ID NO: 1275699 - RNA, 12 nt, Homo sapiens
guaaaacagggc

SEQ ID NO: 1275700 - RNA, 14 nt, Homo sapiens
guaaaacaguuaca

SEQ ID NO: 1275701 - RNA, 16 nt, Homo sapiens
guaaaacuauauucuc

SEQ ID NO: 1275702 - RNA, 21 nt, Homo sapiens
guaaaacugaacuucagagca

SEQ ID NO: 1275703 - RNA, 19 nt, Homo sapiens
guaaaauacuuuuacucug

SEQ ID NO: 1275704 - RNA, 21 nt, Homo sapiens
guaaaauagaauguuacuuug

SEQ ID NO: 1275705 - RNA, 13 nt, Homo sapiens
guaaaauauuuau

SEQ ID NO: 1275706 - RNA, 14 nt, Homo sapiens
guaaaauuauuuca

SEQ ID NO: 1275707 - RNA, 18 nt, Homo sapiens
guaaaauuuaaaucauau

SEQ ID NO: 1275708 - RNA, 23 nt, Homo sapiens
guaaacacauguucugugccugc

SEQ ID NO: 1275709 - RNA, 20 nt, Homo sapiens
guaaacauauuggaauguac

SEQ ID NO: 1275710 - RNA, 13 nt, Homo sapiens
guaaacauuuuaa

SEQ ID NO: 1275711 - RNA, 12 nt, Homo sapiens
guaaacugccau

SEQ ID NO: 1275712 - RNA, 13 nt, Homo sapiens
guaaacuuuguca

SEQ ID NO: 1275713 - RNA, 12 nt, Homo sapiens
guaaagacugua

SEQ ID NO: 1275714 - RNA, 12 nt, Homo sapiens
guaaaggcagua

SEQ ID NO: 1275715 - RNA, 22 nt, Homo sapiens
guaaaguauuauuuauuugaau

SEQ ID NO: 1275716 - RNA, 13 nt, Homo sapiens
guaaagugccuua

SEQ ID NO: 1275717 - RNA, 21 nt, Homo sapiens
guaaauacacauagcauguaa

SEQ ID NO: 1275718 - RNA, 16 nt, Homo sapiens
guaaauaguauuugag

SEQ ID NO: 1275719 - RNA, 19 nt, Homo sapiens
guaaauauagcucagguag

SEQ ID NO: 1275720 - RNA, 11 nt, Homo sapiens
guaaaugccuc

SEQ ID NO: 1275721 - RNA, 23 nt, Homo sapiens
guaaaugcuuuuaaaugcucucu

SEQ ID NO: 1275722 - RNA, 14 nt, Homo sapiens
guaaaugguguaca

SEQ ID NO: 1275723 - RNA, 15 nt, Homo sapiens
guaaauguccauuua

SEQ ID NO: 1275724 - RNA, 15 nt, Homo sapiens
guaaauguccugcua

SEQ ID NO: 1275725 - RNA, 15 nt, Homo sapiens
guaaauuaguauuua

SEQ ID NO: 1275726 - RNA, 20 nt, Homo sapiens
guaaauugaaucaguauaaa

SEQ ID NO: 1275727 - RNA, 23 nt, Homo sapiens
guaaauugcaaauaaaccacuuu

SEQ ID NO: 1275728 - RNA, 19 nt, Homo sapiens
guaacaaauaaagugcagu

SEQ ID NO: 1275729 - RNA, 21 nt, Homo sapiens
guaacaaauaaauaagaucag

SEQ ID NO: 1275730 - RNA, 13 nt, Homo sapiens
guaacauaaugca

SEQ ID NO: 1275731 - RNA, 21 nt, Homo sapiens
guaacauauucuguaugaacu

SEQ ID NO: 1275732 - RNA, 22 nt, Homo sapiens
guaacauauucuguaugaacuu

SEQ ID NO: 1275733 - RNA, 15 nt, Homo sapiens
guaacauuugccuua

SEQ ID NO: 1275734 - RNA, 18 nt, Homo sapiens
guaaccuagugaauuucu

SEQ ID NO: 1275735 - RNA, 11 nt, Homo sapiens
guaacuacuuc

SEQ ID NO: 1275736 - RNA, 14 nt, Homo sapiens
guaacuagugaaau

SEQ ID NO: 1275737 - RNA, 12 nt, Homo sapiens
guaacuccagau

SEQ ID NO: 1275738 - RNA, 19 nt, Homo sapiens
guaacugugccaguucuuu

SEQ ID NO: 1275739 - RNA, 22 nt, Homo sapiens
guaacugugccaguucuuucca

SEQ ID NO: 1275740 - RNA, 18 nt, Homo sapiens
guaagaaagugaagcaaa

SEQ ID NO: 1275741 - RNA, 18 nt, Homo sapiens
guaagagcuggugucuga

SEQ ID NO: 1275742 - RNA, 14 nt, Homo sapiens
guaagcaguuucca

SEQ ID NO: 1275743 - RNA, 22 nt, Homo sapiens
guaagcucuacugaggugcuau

SEQ ID NO: 1275744 - RNA, 21 nt, Homo sapiens
guaagcucuuugaaacaacuu

SEQ ID NO: 1275745 - RNA, 22 nt, Homo sapiens
guaaguaaauugccugauuugu

SEQ ID NO: 1275746 - RNA, 14 nt, Homo sapiens
guaaguacuuccac

SEQ ID NO: 1275747 - RNA, 23 nt, Homo sapiens
guaaguugaauggccugccuuga

SEQ ID NO: 1275748 - RNA, 18 nt, Homo sapiens
guaaguuuuugauucuac

SEQ ID NO: 1275749 - RNA, 14 nt, Homo sapiens
guaauaauaccuca

SEQ ID NO: 1275750 - RNA, 16 nt, Homo sapiens
guaauacaucaaagag

SEQ ID NO: 1275751 - RNA, 17 nt, Homo sapiens
guaaucuacaaaggaaa

SEQ ID NO: 1275752 - RNA, 13 nt, Homo sapiens
guaaugaugcuga

SEQ ID NO: 1275753 - RNA, 13 nt, Homo sapiens
guaaugcaggacu

SEQ ID NO: 1275754 - RNA, 20 nt, Homo sapiens
guaauguuuuauacuguuua

SEQ ID NO: 1275755 - RNA, 14 nt, Homo sapiens
guaauuagcucugg

SEQ ID NO: 1275756 - RNA, 14 nt, Homo sapiens
guaauuuaugcaag

SEQ ID NO: 1275757 - RNA, 22 nt, Homo sapiens
guaauuuuuggggaaaaaagca

SEQ ID NO: 1275758 - RNA, 20 nt, Homo sapiens
guacaaacacaggauuugua

SEQ ID NO: 1275759 - RNA, 16 nt, Homo sapiens
guacaaagguugcagu

SEQ ID NO: 1275760 - RNA, 17 nt, Homo sapiens
guacaauaaagcaaugu

SEQ ID NO: 1275761 - RNA, 18 nt, Homo sapiens
guacaauaaagcaaugug

SEQ ID NO: 1275762 - RNA, 20 nt, Homo sapiens
guacaauucuuuaaaauuca

SEQ ID NO: 1275763 - RNA, 17 nt, Homo sapiens
guacaauugugggcaua

SEQ ID NO: 1275764 - RNA, 23 nt, Homo sapiens
guacacauuccugcauucaugua

SEQ ID NO: 1275765 - RNA, 18 nt, Homo sapiens
guacagaaagcugccugg

SEQ ID NO: 1275766 - RNA, 14 nt, Homo sapiens
guacagagcacauu

SEQ ID NO: 1275767 - RNA, 19 nt, Homo sapiens
guacaggaaugaaccuucu

SEQ ID NO: 1275768 - RNA, 20 nt, Homo sapiens
guacaguauguuuuacaugu

SEQ ID NO: 1275769 - RNA, 21 nt, Homo sapiens
guacaguucugggguacaugu

SEQ ID NO: 1275770 - RNA, 13 nt, Homo sapiens
guacauagccuau

SEQ ID NO: 1275771 - RNA, 15 nt, Homo sapiens
guacaucugcaauau

SEQ ID NO: 1275772 - RNA, 11 nt, Homo sapiens
guacaugagaa

SEQ ID NO: 1275773 - RNA, 22 nt, Homo sapiens
guacauggaauaacauguaauu

SEQ ID NO: 1275774 - RNA, 17 nt, Homo sapiens
guacauugggagucugu

SEQ ID NO: 1275775 - RNA, 17 nt, Homo sapiens
guacauuuaucacugaa

SEQ ID NO: 1275776 - RNA, 21 nt, Homo sapiens
guacauuuuuuaacuuucuag

SEQ ID NO: 1275777 - RNA, 13 nt, Homo sapiens
guaccacacauau

SEQ ID NO: 1275778 - RNA, 15 nt, Homo sapiens
guaccacacauauug

SEQ ID NO: 1275779 - RNA, 12 nt, Homo sapiens
gucucaccagcc

SEQ ID NO: 1275780 - RNA, 17 nt, Homo sapiens
gucucacuauguugccc

SEQ ID NO: 1275781 - RNA, 23 nt, Homo sapiens
gucucacugucccccguuugccu

SEQ ID NO: 1275782 - RNA, 13 nt, Homo sapiens
gucucauuuagaa

SEQ ID NO: 1275783 - RNA, 17 nt, Homo sapiens
gucuccaggggccugca

SEQ ID NO: 1275784 - RNA, 16 nt, Homo sapiens
gucuccauggcaucuu

SEQ ID NO: 1275785 - RNA, 20 nt, Homo sapiens
gucucccccaaacauggccu

SEQ ID NO: 1275786 - RNA, 17 nt, Homo sapiens
gucuccucugcagcuca

SEQ ID NO: 1275787 - RNA, 23 nt, Homo sapiens
gucuccuuugcacugagggccac

SEQ ID NO: 1275788 - RNA, 22 nt, Homo sapiens
gucucucccaccccggccucca

SEQ ID NO: 1275789 - RNA, 21 nt, Homo sapiens
gucucugccugcggcccagaa

SEQ ID NO: 1275790 - RNA, 13 nt, Homo sapiens
gucugacucucca

SEQ ID NO: 1275791 - RNA, 18 nt, Homo sapiens
gucugagacucacaggaa

SEQ ID NO: 1275792 - RNA, 20 nt, Homo sapiens
gucugauaaugauuugcucu

SEQ ID NO: 1275793 - RNA, 14 nt, Homo sapiens
gucugcaugugcac

SEQ ID NO: 1275794 - RNA, 15 nt, Homo sapiens
gucuggcccaccagg

SEQ ID NO: 1275795 - RNA, 19 nt, Homo sapiens
gucuggcugaggauuucaa

SEQ ID NO: 1275796 - RNA, 16 nt, Homo sapiens
gucugggagucacaca

SEQ ID NO: 1275797 - RNA, 19 nt, Homo sapiens
gucuggggagaauguaauc

SEQ ID NO: 1275798 - RNA, 19 nt, Homo sapiens
gucuguaaaagagccuagu

SEQ ID NO: 1275799 - RNA, 20 nt, Homo sapiens
gucuguagcuccucaacuca

SEQ ID NO: 1275800 - RNA, 21 nt, Homo sapiens
gucugucaugaacauguuccu

SEQ ID NO: 1275801 - RNA, 16 nt, Homo sapiens
gucugucucagcucaa

SEQ ID NO: 1275802 - RNA, 22 nt, Homo sapiens
gucugugauugccuucuuacaa

SEQ ID NO: 1275803 - RNA, 19 nt, Homo sapiens
gucugugugaaugugggca

SEQ ID NO: 1275804 - RNA, 13 nt, Homo sapiens
gucuguuaacuua

SEQ ID NO: 1275805 - RNA, 18 nt, Homo sapiens
gucuguuuggaagaccag

SEQ ID NO: 1275806 - RNA, 21 nt, Homo sapiens
gucuuaaacuaaaugugcaau

SEQ ID NO: 1275807 - RNA, 22 nt, Homo sapiens
gucuuaaaugagaaguacuugg

SEQ ID NO: 1275808 - RNA, 18 nt, Homo sapiens
gucuucauaaaguacuug

SEQ ID NO: 1275809 - RNA, 18 nt, Homo sapiens
gucuuccaauuaaugcuu

SEQ ID NO: 1275810 - RNA, 17 nt, Homo sapiens
gucuuccaggcacucaa

SEQ ID NO: 1275811 - RNA, 14 nt, Homo sapiens
gucuuccaugaccc

SEQ ID NO: 1275812 - RNA, 19 nt, Homo sapiens
gucuucuaauuucaaaaau

SEQ ID NO: 1275813 - RNA, 17 nt, Homo sapiens
gucuucuagcugcagau

SEQ ID NO: 1275814 - RNA, 18 nt, Homo sapiens
gucuucugggcacagugg

SEQ ID NO: 1275815 - RNA, 16 nt, Homo sapiens
gucuucuuaaucugaa

SEQ ID NO: 1275816 - RNA, 22 nt, Homo sapiens
gucuucuuuuguggugucuucc

SEQ ID NO: 1275817 - RNA, 12 nt, Homo sapiens
gucuugaacucc

SEQ ID NO: 1275818 - RNA, 17 nt, Homo sapiens
gucuugaugacugcuga

SEQ ID NO: 1275819 - RNA, 18 nt, Homo sapiens
gucuuggaacauuggaau

SEQ ID NO: 1275820 - RNA, 17 nt, Homo sapiens
gaaauaccacaagccug

SEQ ID NO: 1275821 - RNA, 19 nt, Homo sapiens
gaaauacccaacgcacaaa

SEQ ID NO: 1275822 - RNA, 11 nt, Homo sapiens
gaaauaccuca

SEQ ID NO: 1275823 - RNA, 12 nt, Homo sapiens
gaaauaccucau

SEQ ID NO: 1275824 - RNA, 15 nt, Homo sapiens
gaaauagugacaagu

SEQ ID NO: 1275825 - RNA, 14 nt, Homo sapiens
gaaauauauuacuu

SEQ ID NO: 1275826 - RNA, 20 nt, Homo sapiens
gaaauaugugguuuccacga

SEQ ID NO: 1275827 - RNA, 19 nt, Homo sapiens
gaaaucaaaccaccaggca

SEQ ID NO: 1275828 - RNA, 17 nt, Homo sapiens
gaaauccauaucuuaaa

SEQ ID NO: 1275829 - RNA, 20 nt, Homo sapiens
gaaauccauuccauuuugug

SEQ ID NO: 1275830 - RNA, 14 nt, Homo sapiens
gaaaucgcuuauau

SEQ ID NO: 1275831 - RNA, 22 nt, Homo sapiens
gaaaucuaaaagaauuuuacca

SEQ ID NO: 1275832 - RNA, 19 nt, Homo sapiens
gaaaucuagaagacuguca

SEQ ID NO: 1275833 - RNA, 18 nt, Homo sapiens
gaaaucucuaccugggug

SEQ ID NO: 1275834 - RNA, 16 nt, Homo sapiens
gaaaucuuaaaccuua

SEQ ID NO: 1275835 - RNA, 12 nt, Homo sapiens
gaaaucuugucu

SEQ ID NO: 1275836 - RNA, 22 nt, Homo sapiens
gaaaucuuguuggcaaaucaga

SEQ ID NO: 1275837 - RNA, 21 nt, Homo sapiens
gaaaugaaacaaauaaucaca

SEQ ID NO: 1275838 - RNA, 15 nt, Homo sapiens
gaaaugaacauucca

SEQ ID NO: 1275839 - RNA, 14 nt, Homo sapiens
gaaaugacccuauu

SEQ ID NO: 1275840 - RNA, 23 nt, Homo sapiens
gaaaugauccccaaguggugaau

SEQ ID NO: 1275841 - RNA, 13 nt, Homo sapiens
gaaaugcaaccaa

SEQ ID NO: 1275842 - RNA, 23 nt, Homo sapiens
gaaaugcugauguauccuuucau

SEQ ID NO: 1275843 - RNA, 15 nt, Homo sapiens
gaaaugggcagugaa

SEQ ID NO: 1275844 - RNA, 16 nt, Homo sapiens
gaaauguaaacugcca

SEQ ID NO: 1275845 - RNA, 17 nt, Homo sapiens
gaaauuacccacuguca

SEQ ID NO: 1275846 - RNA, 18 nt, Homo sapiens
gaaauugcauacuuugua

SEQ ID NO: 1275847 - RNA, 20 nt, Homo sapiens
gaaauuugcaacucacugau

SEQ ID NO: 1275848 - RNA, 24 nt, Homo sapiens
gaaauuugcaacucacugauucuc

SEQ ID NO: 1275849 - RNA, 21 nt, Homo sapiens
gaaauuuuaaugaagugcaau

SEQ ID NO: 1275850 - RNA, 14 nt, Homo sapiens
gaacaaaaaaacca

SEQ ID NO: 1275851 - RNA, 16 nt, Homo sapiens
gaacaaaaaaaccaca

SEQ ID NO: 1275852 - RNA, 21 nt, Homo sapiens
gaacaaaaaaaccacaaaggc

SEQ ID NO: 1275853 - RNA, 23 nt, Homo sapiens
gaacaaaaacaaaacaccaggga

SEQ ID NO: 1275854 - RNA, 18 nt, Homo sapiens
gaacaaaaauugagacau

SEQ ID NO: 1275855 - RNA, 20 nt, Homo sapiens
gaacaaaaugaauucuggga

SEQ ID NO: 1275856 - RNA, 21 nt, Homo sapiens
gaacaaaaugaauucugggaa

SEQ ID NO: 1275857 - RNA, 14 nt, Homo sapiens
gaacaaacucugaa

SEQ ID NO: 1275858 - RNA, 17 nt, Homo sapiens
gaacaaucaaagcacuu

SEQ ID NO: 1275859 - RNA, 17 nt, Homo sapiens
gaacaauccauaacuuu

SEQ ID NO: 1275860 - RNA, 13 nt, Homo sapiens
gaacaauguugca

SEQ ID NO: 1275861 - RNA, 14 nt, Homo sapiens
gaacacacagacuu

SEQ ID NO: 1275862 - RNA, 18 nt, Homo sapiens
gaacacacagacuuucug

SEQ ID NO: 1275863 - RNA, 21 nt, Homo sapiens
gaacacacagacuuucuguga

SEQ ID NO: 1275864 - RNA, 15 nt, Homo sapiens
gaacacacauuauua

SEQ ID NO: 1275865 - RNA, 18 nt, Homo sapiens
gaacacagcaugugccaa

SEQ ID NO: 1275866 - RNA, 21 nt, Homo sapiens
gaacacaguuuagugcuuuac

SEQ ID NO: 1275867 - RNA, 19 nt, Homo sapiens
gaacacaugugcagucacu

SEQ ID NO: 1275868 - RNA, 20 nt, Homo sapiens
gaacaccauccuacauaaua

SEQ ID NO: 1275869 - RNA, 20 nt, Homo sapiens
gaacacguuggcucaguccu

SEQ ID NO: 1275870 - RNA, 15 nt, Homo sapiens
gaacacuguucuacc

SEQ ID NO: 1275871 - RNA, 23 nt, Homo sapiens
gaacagaauguuuuacugugaaa

SEQ ID NO: 1275872 - RNA, 20 nt, Homo sapiens
gaacagaccggagaggacag

SEQ ID NO: 1275873 - RNA, 21 nt, Homo sapiens
gaacagcauuacccuccucuc

SEQ ID NO: 1275874 - RNA, 17 nt, Homo sapiens
gaacagcgggagaccug

SEQ ID NO: 1275875 - RNA, 23 nt, Homo sapiens
gaacagcgggagaccugugcuag

SEQ ID NO: 1275876 - RNA, 15 nt, Homo sapiens
gaacagcuucagguu

SEQ ID NO: 1275877 - RNA, 13 nt, Homo sapiens
gaacaggcugugu

SEQ ID NO: 1275878 - RNA, 20 nt, Homo sapiens
gaacagggucauguuugcag

SEQ ID NO: 1275879 - RNA, 17 nt, Homo sapiens
gaacaguuuuggcauaa

SEQ ID NO: 1275880 - RNA, 10 nt, Homo sapiens
gaacauaaaa

SEQ ID NO: 1275881 - RNA, 23 nt, Homo sapiens
gaacauaaaaaauaaaguaccac

SEQ ID NO: 1275882 - RNA, 17 nt, Homo sapiens
gaacauagacuagagaa

SEQ ID NO: 1275883 - RNA, 20 nt, Homo sapiens
gaacauauggaaaguauuag

SEQ ID NO: 1275884 - RNA, 14 nt, Homo sapiens
gaacauauguuugc

SEQ ID NO: 1275885 - RNA, 13 nt, Homo sapiens
gaacaugcaguuc

SEQ ID NO: 1275886 - RNA, 10 nt, Homo sapiens
gaaccaaaga

SEQ ID NO: 1275887 - RNA, 21 nt, Homo sapiens
gaaccaaaucuggaagccaaa

SEQ ID NO: 1275888 - RNA, 16 nt, Homo sapiens
gaaccaagcaggagac

SEQ ID NO: 1275889 - RNA, 12 nt, Homo sapiens
gaaccacagggc

SEQ ID NO: 1275890 - RNA, 21 nt, Homo sapiens
gaaccagagaggcucugagaa

SEQ ID NO: 1275891 - RNA, 14 nt, Homo sapiens
gaaccagcaucuca

SEQ ID NO: 1275892 - RNA, 17 nt, Homo sapiens
gaaccauuauacuuuau

SEQ ID NO: 1275893 - RNA, 11 nt, Homo sapiens
gaacccaugag

SEQ ID NO: 1275894 - RNA, 22 nt, Homo sapiens
gaacccaugucagucucucacc

SEQ ID NO: 1275895 - RNA, 23 nt, Homo sapiens
gaacccccuuccccgcucuugcc

SEQ ID NO: 1275896 - RNA, 23 nt, Homo sapiens
gaaccccgucgaggggcucucag

SEQ ID NO: 1275897 - RNA, 19 nt, Homo sapiens
gaacccugccaggcugcua

SEQ ID NO: 1275898 - RNA, 21 nt, Homo sapiens
gaacccugggccauccucaca

SEQ ID NO: 1275899 - RNA, 22 nt, Homo sapiens
gaacccugggccauccucacau

SEQ ID NO: 1275900 - RNA, 17 nt, Homo sapiens
gaaccgcacagcucagg

SEQ ID NO: 1275901 - RNA, 15 nt, Homo sapiens
gaaccuagugcauuu

SEQ ID NO: 1275902 - RNA, 15 nt, Homo sapiens
gaaccucugucucau

SEQ ID NO: 1275903 - RNA, 14 nt, Homo sapiens
gaaccuuaaugaca

SEQ ID NO: 1275904 - RNA, 13 nt, Homo sapiens
gaacgcucuuagc

SEQ ID NO: 1275905 - RNA, 12 nt, Homo sapiens
gaacgcuuucau

SEQ ID NO: 1275906 - RNA, 15 nt, Homo sapiens
gaacuacugcuggaa

SEQ ID NO: 1275907 - RNA, 15 nt, Homo sapiens
gaacuagagaaggac

SEQ ID NO: 1275908 - RNA, 16 nt, Homo sapiens
gaacuaggguaaggug

SEQ ID NO: 1275909 - RNA, 19 nt, Homo sapiens
gaacuauacccgggaccaa

SEQ ID NO: 1275910 - RNA, 15 nt, Homo sapiens
gaacuaugaaaucaa

SEQ ID NO: 1275911 - RNA, 14 nt, Homo sapiens
gaacuauguacuuu

SEQ ID NO: 1275912 - RNA, 13 nt, Homo sapiens
gaacucacugcga

SEQ ID NO: 1275913 - RNA, 14 nt, Homo sapiens
gaacucccuuucaa

SEQ ID NO: 1275914 - RNA, 18 nt, Homo sapiens
gaacucucaagugucuua

SEQ ID NO: 1275915 - RNA, 18 nt, Homo sapiens
gaacugaaagcacuagag

SEQ ID NO: 1275916 - RNA, 19 nt, Homo sapiens
gaacugagaccuccagaaa

SEQ ID NO: 1275917 - RNA, 15 nt, Homo sapiens
gaacuggacugugug

SEQ ID NO: 1275918 - RNA, 17 nt, Homo sapiens
gaacuggccacgcacag

SEQ ID NO: 1275919 - RNA, 20 nt, Homo sapiens
gaacuggggcuuugccuugc

SEQ ID NO: 1275920 - RNA, 23 nt, Homo sapiens
gaacuguacacuuguuuggugcu

SEQ ID NO: 1275921 - RNA, 16 nt, Homo sapiens
gaacugugcauagugc

SEQ ID NO: 1275922 - RNA, 23 nt, Homo sapiens
gaacugugcauagugcugggaug

SEQ ID NO: 1275923 - RNA, 21 nt, Homo sapiens
gaacuguugaaagaaaauaua

SEQ ID NO: 1275924 - RNA, 19 nt, Homo sapiens
gaacuguugccuaauugga

SEQ ID NO: 1275925 - RNA, 22 nt, Homo sapiens
gaacuguuuuguaagugcugcu

SEQ ID NO: 1275926 - RNA, 14 nt, Homo sapiens
gaacuucagagcau

SEQ ID NO: 1275927 - RNA, 14 nt, Homo sapiens
gaacuugccuuaaa

SEQ ID NO: 1275928 - RNA, 15 nt, Homo sapiens
gaacuuggcacacuc

SEQ ID NO: 1275929 - RNA, 23 nt, Homo sapiens
gaacuuuaagaagcaguguuuua

SEQ ID NO: 1275930 - RNA, 14 nt, Homo sapiens
gaacuuuaagcaac

SEQ ID NO: 1275931 - RNA, 24 nt, Homo sapiens
gaacuuuaagcaacaagaccacca

SEQ ID NO: 1275932 - RNA, 22 nt, Homo sapiens
gaacuuuagcaugguauugaag

SEQ ID NO: 1275933 - RNA, 19 nt, Homo sapiens
gaagaaaaaguacaaugaa

SEQ ID NO: 1275934 - RNA, 19 nt, Homo sapiens
gaagaaaaugaaugcugcu

SEQ ID NO: 1275935 - RNA, 13 nt, Homo sapiens
gaagaaacacuuu

SEQ ID NO: 1275936 - RNA, 14 nt, Homo sapiens
gaagaaagcaacaa

SEQ ID NO: 1275937 - RNA, 16 nt, Homo sapiens
gaagaaaucuuuccag

SEQ ID NO: 1275938 - RNA, 22 nt, Homo sapiens
gaagaacacagcaugugccaag

SEQ ID NO: 1275939 - RNA, 22 nt, Homo sapiens
gaagaacagauaaucccuguau

SEQ ID NO: 1275940 - RNA, 19 nt, Homo sapiens
gaagaauauucaggacuua

SEQ ID NO: 1275941 - RNA, 23 nt, Homo sapiens
gaagaaugaucagcaucugugau

SEQ ID NO: 1275942 - RNA, 22 nt, Homo sapiens
gaagaaugcacaagaauggauc

SEQ ID NO: 1275943 - RNA, 12 nt, Homo sapiens
gaagaauggaga

SEQ ID NO: 1275944 - RNA, 20 nt, Homo sapiens
gaagaauuggggauucucua

SEQ ID NO: 1275945 - RNA, 16 nt, Homo sapiens
gaagacauccugagca

SEQ ID NO: 1275946 - RNA, 17 nt, Homo sapiens
gaagacccgcucuccau

SEQ ID NO: 1275947 - RNA, 18 nt, Homo sapiens
gaaaaacauuccaggaaa

SEQ ID NO: 1275948 - RNA, 15 nt, Homo sapiens
gaaaaaccaaugauu

SEQ ID NO: 1275949 - RNA, 15 nt, Homo sapiens
gaaaaagacacagac

SEQ ID NO: 1275950 - RNA, 16 nt, Homo sapiens
gaaaaagccugugaaa

SEQ ID NO: 1275951 - RNA, 22 nt, Homo sapiens
gaaaaaggccaguggaaauuca

SEQ ID NO: 1275952 - RNA, 17 nt, Homo sapiens
gaaaaaggccucugucc

SEQ ID NO: 1275953 - RNA, 20 nt, Homo sapiens
gaaaaagguuugcauucuca

SEQ ID NO: 1275954 - RNA, 19 nt, Homo sapiens
gaaaaaguuaaacauugaa

SEQ ID NO: 1275955 - RNA, 16 nt, Homo sapiens
gaaaaauagcugugaa

SEQ ID NO: 1275956 - RNA, 18 nt, Homo sapiens
gaaaaaucauccaagaca

SEQ ID NO: 1275957 - RNA, 19 nt, Homo sapiens
gaaaaaucuaagugauaua

SEQ ID NO: 1275958 - RNA, 13 nt, Homo sapiens
gaaaaaugcugcu

SEQ ID NO: 1275959 - RNA, 20 nt, Homo sapiens
gaaaaauuaauuuacuagaa

SEQ ID NO: 1275960 - RNA, 15 nt, Homo sapiens
gaaaaauugccuuca

SEQ ID NO: 1275961 - RNA, 16 nt, Homo sapiens
gaaaacagaugaccau

SEQ ID NO: 1275962 - RNA, 17 nt, Homo sapiens
gaaaacagaugaccaua

SEQ ID NO: 1275963 - RNA, 15 nt, Homo sapiens
gaaaacauauuugug

SEQ ID NO: 1275964 - RNA, 16 nt, Homo sapiens
gaaaacaucucaauaa

SEQ ID NO: 1275965 - RNA, 14 nt, Homo sapiens
gaaaacauguuaau

SEQ ID NO: 1275966 - RNA, 14 nt, Homo sapiens
gaaaacauugcuuu

SEQ ID NO: 1275967 - RNA, 22 nt, Homo sapiens
gaaaaccugaagacugaggaca

SEQ ID NO: 1275968 - RNA, 18 nt, Homo sapiens
gaaaacuguagucucuga

SEQ ID NO: 1275969 - RNA, 16 nt, Homo sapiens
gaaaacuguuaccuaa

SEQ ID NO: 1275970 - RNA, 19 nt, Homo sapiens
gaaaacuuaugcugauuua

SEQ ID NO: 1275971 - RNA, 15 nt, Homo sapiens
gaaaagaaaccagag

SEQ ID NO: 1275972 - RNA, 14 nt, Homo sapiens
gaaaagaagacucu

SEQ ID NO: 1275973 - RNA, 16 nt, Homo sapiens
gaaaagaagccucagc

SEQ ID NO: 1275974 - RNA, 20 nt, Homo sapiens
gaaaagagaaggaaagugau

SEQ ID NO: 1275975 - RNA, 21 nt, Homo sapiens
gaaaagaggcccaagugcaaa

SEQ ID NO: 1275976 - RNA, 15 nt, Homo sapiens
gaaaagagucuucca

SEQ ID NO: 1275977 - RNA, 20 nt, Homo sapiens
gaaaagauuauauauuauuu

SEQ ID NO: 1275978 - RNA, 20 nt, Homo sapiens
gaaaagcaaaugacuaguaa

SEQ ID NO: 1275979 - RNA, 10 nt, Homo sapiens
gaaaagcagg

SEQ ID NO: 1275980 - RNA, 20 nt, Homo sapiens
gaaaagcuagguguuuaaua

SEQ ID NO: 1275981 - RNA, 23 nt, Homo sapiens
gaaaagcuauuagccaggaucau

SEQ ID NO: 1275982 - RNA, 20 nt, Homo sapiens
gaaaagcugaucauaaguga

SEQ ID NO: 1275983 - RNA, 14 nt, Homo sapiens
gaaaagcugccauu

SEQ ID NO: 1275984 - RNA, 18 nt, Homo sapiens
gaaaagcugccauuuccc

SEQ ID NO: 1275985 - RNA, 16 nt, Homo sapiens
gaaaaggaagacuaga

SEQ ID NO: 1275986 - RNA, 13 nt, Homo sapiens
gaaaaggacaaau

SEQ ID NO: 1275987 - RNA, 14 nt, Homo sapiens
gaaaaggauaugca

SEQ ID NO: 1275988 - RNA, 15 nt, Homo sapiens
gaaaagggaucugcu

SEQ ID NO: 1275989 - RNA, 16 nt, Homo sapiens
gaaaagguugccugaa

SEQ ID NO: 1275990 - RNA, 22 nt, Homo sapiens
gaaaaguagacaaucauuguuu

SEQ ID NO: 1275991 - RNA, 23 nt, Homo sapiens
gaaaaguaucccggaagcucaca

SEQ ID NO: 1275992 - RNA, 19 nt, Homo sapiens
gaaaaguguccuucuugcu

SEQ ID NO: 1275993 - RNA, 13 nt, Homo sapiens
gaaaaguucuccu

SEQ ID NO: 1275994 - RNA, 20 nt, Homo sapiens
gaaaaguuucccagucuuca

SEQ ID NO: 1275995 - RNA, 14 nt, Homo sapiens
gaaaauaaacauca

SEQ ID NO: 1275996 - RNA, 14 nt, Homo sapiens
gaaaauaaacugac

SEQ ID NO: 1275997 - RNA, 19 nt, Homo sapiens
gaaaauaacugaaccaaau

SEQ ID NO: 1275998 - RNA, 12 nt, Homo sapiens
gaaaauaaguga

SEQ ID NO: 1275999 - RNA, 18 nt, Homo sapiens
gaaaauagccaguuccug

SEQ ID NO: 1276000 - RNA, 17 nt, Homo sapiens
gaaaauaugauguuuca

SEQ ID NO: 1276001 - RNA, 16 nt, Homo sapiens
gaaaaucacaucucca

SEQ ID NO: 1276002 - RNA, 17 nt, Homo sapiens
gaaaaugaaaaacaacc

SEQ ID NO: 1276003 - RNA, 18 nt, Homo sapiens
gaaaaugaaccauucaca

SEQ ID NO: 1276004 - RNA, 16 nt, Homo sapiens
gaaaaugaacugccca

SEQ ID NO: 1276005 - RNA, 11 nt, Homo sapiens
gaaaaugcaaa

SEQ ID NO: 1276006 - RNA, 12 nt, Homo sapiens
gaaaauguucau

SEQ ID NO: 1276007 - RNA, 18 nt, Homo sapiens
gaaaauguuuaccagugu

SEQ ID NO: 1276008 - RNA, 20 nt, Homo sapiens
gaaaauuagacugugauuca

SEQ ID NO: 1276009 - RNA, 20 nt, Homo sapiens
gaaaauucaaaaaguguuua

SEQ ID NO: 1276010 - RNA, 13 nt, Homo sapiens
gaaaauugcaaua

SEQ ID NO: 1276011 - RNA, 14 nt, Homo sapiens
gaaacaacauuuau

SEQ ID NO: 1276012 - RNA, 22 nt, Homo sapiens
gaaacaauggcuaagauaccaa

SEQ ID NO: 1276013 - RNA, 22 nt, Homo sapiens
gaaacacaaaccacaacugaca

SEQ ID NO: 1276014 - RNA, 15 nt, Homo sapiens
gaaacacaauaccua

SEQ ID NO: 1276015 - RNA, 17 nt, Homo sapiens
gaaacacagaaaccuuu

SEQ ID NO: 1276016 - RNA, 13 nt, Homo sapiens
gaaacacauucuu

SEQ ID NO: 1276017 - RNA, 17 nt, Homo sapiens
gaaacagacaugaaaua

SEQ ID NO: 1276018 - RNA, 13 nt, Homo sapiens
gaaacagugugca

SEQ ID NO: 1276019 - RNA, 19 nt, Homo sapiens
gaaacaguugguaacuuuu

SEQ ID NO: 1276020 - RNA, 16 nt, Homo sapiens
gaaacauuacaguuca

SEQ ID NO: 1276021 - RNA, 19 nt, Homo sapiens
gaaacauucuuuuccacuu

SEQ ID NO: 1276022 - RNA, 17 nt, Homo sapiens
gaaacauuguaaauauu

SEQ ID NO: 1276023 - RNA, 12 nt, Homo sapiens
gaaaccaugacu

SEQ ID NO: 1276024 - RNA, 13 nt, Homo sapiens
gaaacccaaccuu

SEQ ID NO: 1276025 - RNA, 14 nt, Homo sapiens
gaaaccccgucucu

SEQ ID NO: 1276026 - RNA, 17 nt, Homo sapiens
gaaacccuauuucccca

SEQ ID NO: 1276027 - RNA, 14 nt, Homo sapiens
gaaacccucuguca

SEQ ID NO: 1276028 - RNA, 14 nt, Homo sapiens
gaaaccuacagaca

SEQ ID NO: 1276029 - RNA, 21 nt, Homo sapiens
gaaaccugucauuguauucag

SEQ ID NO: 1276030 - RNA, 13 nt, Homo sapiens
gaaaccuugccuu

SEQ ID NO: 1276031 - RNA, 17 nt, Homo sapiens
gaaacuagcuuuugcca

SEQ ID NO: 1276032 - RNA, 15 nt, Homo sapiens
cuggguggguggugg

SEQ ID NO: 1276033 - RNA, 21 nt, Homo sapiens
cugggugucgaaaucaaacca

SEQ ID NO: 1276034 - RNA, 14 nt, Homo sapiens
cugguacaauccuu

SEQ ID NO: 1276035 - RNA, 15 nt, Homo sapiens
cugguagcucaggug

SEQ ID NO: 1276036 - RNA, 15 nt, Homo sapiens
cuggucaaguuguaa

SEQ ID NO: 1276037 - RNA, 16 nt, Homo sapiens
cuggucagaugauaua

SEQ ID NO: 1276038 - RNA, 18 nt, Homo sapiens
cuggucauuaaugugucc

SEQ ID NO: 1276039 - RNA, 15 nt, Homo sapiens
cuggucccagcaucc

SEQ ID NO: 1276040 - RNA, 20 nt, Homo sapiens
cuggucucaaacuccugacc

SEQ ID NO: 1276041 - RNA, 18 nt, Homo sapiens
cuggucugaacuaguuga

SEQ ID NO: 1276042 - RNA, 22 nt, Homo sapiens
cuggucugugaagagccggugg

SEQ ID NO: 1276043 - RNA, 19 nt, Homo sapiens
cuggucuuccaggcacuca

SEQ ID NO: 1276044 - RNA, 16 nt, Homo sapiens
cuggugaaaaaagcca

SEQ ID NO: 1276045 - RNA, 18 nt, Homo sapiens
cuggugaauaacuaugcc

SEQ ID NO: 1276046 - RNA, 22 nt, Homo sapiens
cuggugaggagcacagcucagg

SEQ ID NO: 1276047 - RNA, 12 nt, Homo sapiens
cuggugcauggc

SEQ ID NO: 1276048 - RNA, 12 nt, Homo sapiens
cuggugccauuu

SEQ ID NO: 1276049 - RNA, 12 nt, Homo sapiens
cuggugccccac

SEQ ID NO: 1276050 - RNA, 17 nt, Homo sapiens
cuggugccccucgccag

SEQ ID NO: 1276051 - RNA, 17 nt, Homo sapiens
cuggugcuacuccaugc

SEQ ID NO: 1276052 - RNA, 18 nt, Homo sapiens
cuggugcuacuugcuuga

SEQ ID NO: 1276053 - RNA, 15 nt, Homo sapiens
cugguggcacaggag

SEQ ID NO: 1276054 - RNA, 22 nt, Homo sapiens
cugguggcacaggaguguccuc

SEQ ID NO: 1276055 - RNA, 16 nt, Homo sapiens
cugguggcaccagaug

SEQ ID NO: 1276056 - RNA, 19 nt, Homo sapiens
cugguggcccgacagccug

SEQ ID NO: 1276057 - RNA, 23 nt, Homo sapiens
cuggugggcuagccaauagaguu

SEQ ID NO: 1276058 - RNA, 13 nt, Homo sapiens
cugguggugcugc

SEQ ID NO: 1276059 - RNA, 16 nt, Homo sapiens
cugguggugcugcacc

SEQ ID NO: 1276060 - RNA, 12 nt, Homo sapiens
cugguguccuga

SEQ ID NO: 1276061 - RNA, 17 nt, Homo sapiens
cugguguuuguaguuga

SEQ ID NO: 1276062 - RNA, 12 nt, Homo sapiens
cugguucaauuu

SEQ ID NO: 1276063 - RNA, 23 nt, Homo sapiens
cugguugaacucugguggcacag

SEQ ID NO: 1276064 - RNA, 13 nt, Homo sapiens
cugguuucuacca

SEQ ID NO: 1276065 - RNA, 22 nt, Homo sapiens
cugguuucuaccagcucauaca

SEQ ID NO: 1276066 - RNA, 12 nt, Homo sapiens
cugguuuuaaca

SEQ ID NO: 1276067 - RNA, 15 nt, Homo sapiens
cugguuuucugccaa

SEQ ID NO: 1276068 - RNA, 15 nt, Homo sapiens
cuguaaacuguguau

SEQ ID NO: 1276069 - RNA, 12 nt, Homo sapiens
cuguaaauaugu

SEQ ID NO: 1276070 - RNA, 23 nt, Homo sapiens
cuguaacagcggcaggguguccc

SEQ ID NO: 1276071 - RNA, 13 nt, Homo sapiens
cuguaacuacuuc

SEQ ID NO: 1276072 - RNA, 15 nt, Homo sapiens
cuguaagccaaagaa

SEQ ID NO: 1276073 - RNA, 16 nt, Homo sapiens
cuguaaggcauuuuca

SEQ ID NO: 1276074 - RNA, 12 nt, Homo sapiens
cuguaagggcag

SEQ ID NO: 1276075 - RNA, 16 nt, Homo sapiens
cuguaauaauaccuca

SEQ ID NO: 1276076 - RNA, 23 nt, Homo sapiens
cuguaauagugaacauauggaaa

SEQ ID NO: 1276077 - RNA, 20 nt, Homo sapiens
cuguaaucccagcacuuugg

SEQ ID NO: 1276078 - RNA, 18 nt, Homo sapiens
cuguaaucccagcuacuu

SEQ ID NO: 1276079 - RNA, 18 nt, Homo sapiens
cuguaaucucagcacuuu

SEQ ID NO: 1276080 - RNA, 19 nt, Homo sapiens
cuguaaugauacugauuau

SEQ ID NO: 1276081 - RNA, 22 nt, Homo sapiens
cuguaauuaaguaaaccaaaaa

SEQ ID NO: 1276082 - RNA, 23 nt, Homo sapiens
cuguacaaaguagaagucuuaga

SEQ ID NO: 1276083 - RNA, 18 nt, Homo sapiens
cuguacauuauaaaccuu

SEQ ID NO: 1276084 - RNA, 18 nt, Homo sapiens
cuguaccuagaauagucu

SEQ ID NO: 1276085 - RNA, 11 nt, Homo sapiens
cuguaccucaa

SEQ ID NO: 1276086 - RNA, 16 nt, Homo sapiens
cuguaccucaaaugaa

SEQ ID NO: 1276087 - RNA, 15 nt, Homo sapiens
cuguacuaauacagc

SEQ ID NO: 1276088 - RNA, 13 nt, Homo sapiens
cuguacucaggag

SEQ ID NO: 1276089 - RNA, 16 nt, Homo sapiens
cuguacugacuugagg

SEQ ID NO: 1276090 - RNA, 20 nt, Homo sapiens
cuguacuguucugugucuuu

SEQ ID NO: 1276091 - RNA, 20 nt, Homo sapiens
cuguagaccaccuaauauca

SEQ ID NO: 1276092 - RNA, 17 nt, Homo sapiens
cuguagacuagugccgu

SEQ ID NO: 1276093 - RNA, 13 nt, Homo sapiens
cuguagaguugcu

SEQ ID NO: 1276094 - RNA, 19 nt, Homo sapiens
cuguagauguugucuuggc

SEQ ID NO: 1276095 - RNA, 18 nt, Homo sapiens
cuguagauucuguggaac

SEQ ID NO: 1276096 - RNA, 21 nt, Homo sapiens
cuguagcaccagagaauccau

SEQ ID NO: 1276097 - RNA, 21 nt, Homo sapiens
cuguaggacuguuugugacug

SEQ ID NO: 1276098 - RNA, 16 nt, Homo sapiens
cuguaggggcaaaaau

SEQ ID NO: 1276099 - RNA, 21 nt, Homo sapiens
cuguagucccagcuacucggg

SEQ ID NO: 1276100 - RNA, 17 nt, Homo sapiens
cuguauaagcacugaaa

SEQ ID NO: 1276101 - RNA, 22 nt, Homo sapiens
cuguauaaguuauuuuuguaca

SEQ ID NO: 1276102 - RNA, 13 nt, Homo sapiens
cuguauauguugu

SEQ ID NO: 1276103 - RNA, 19 nt, Homo sapiens
cuguaucacagacuggcaa

SEQ ID NO: 1276104 - RNA, 17 nt, Homo sapiens
cuguaucuugauaucuc

SEQ ID NO: 1276105 - RNA, 15 nt, Homo sapiens
cuguauggaaacacu

SEQ ID NO: 1276106 - RNA, 19 nt, Homo sapiens
cuguauuacagcuuucaca

SEQ ID NO: 1276107 - RNA, 13 nt, Homo sapiens
cuguauuaccucc

SEQ ID NO: 1276108 - RNA, 19 nt, Homo sapiens
cuguauuucgaaugagucu

SEQ ID NO: 1276109 - RNA, 20 nt, Homo sapiens
cuguauuuuauuggacaggu

SEQ ID NO: 1276110 - RNA, 18 nt, Homo sapiens
cugucaaaugucacagau

SEQ ID NO: 1276111 - RNA, 17 nt, Homo sapiens
cugucaaggcugcuuag

SEQ ID NO: 1276112 - RNA, 21 nt, Homo sapiens
cugucacuagucucaccagcc

SEQ ID NO: 1276113 - RNA, 22 nt, Homo sapiens
cugucagaaaaagcuagcacua

SEQ ID NO: 1276114 - RNA, 16 nt, Homo sapiens
cugucagaggcuaaga

SEQ ID NO: 1276115 - RNA, 18 nt, Homo sapiens
cugucaggguugucuacc

SEQ ID NO: 1276116 - RNA, 20 nt, Homo sapiens
cugucauccucaugcugcuc

SEQ ID NO: 1276117 - RNA, 20 nt, Homo sapiens
cugucaugcuucaucauucc

SEQ ID NO: 1276118 - RNA, 18 nt, Homo sapiens
cugucauucaaaugggug

SEQ ID NO: 1276119 - RNA, 22 nt, Homo sapiens
cugucauucgcucccacauucu

SEQ ID NO: 1276120 - RNA, 23 nt, Homo sapiens
cugucauucgcucccacauucug

SEQ ID NO: 1276121 - RNA, 14 nt, Homo sapiens
cugucauugcacau

SEQ ID NO: 1276122 - RNA, 18 nt, Homo sapiens
cugucauuuuuaacagca

SEQ ID NO: 1276123 - RNA, 14 nt, Homo sapiens
cuguccacacccag

SEQ ID NO: 1276124 - RNA, 20 nt, Homo sapiens
cuguccacccugccaagacu

SEQ ID NO: 1276125 - RNA, 23 nt, Homo sapiens
cuguccacugggccauuguggug

SEQ ID NO: 1276126 - RNA, 17 nt, Homo sapiens
cugucccaccugcacac

SEQ ID NO: 1276127 - RNA, 16 nt, Homo sapiens
cuguccccucagcucc

SEQ ID NO: 1276128 - RNA, 17 nt, Homo sapiens
cugucccuauacacuag

SEQ ID NO: 1276129 - RNA, 12 nt, Homo sapiens
cuguccuaagca

SEQ ID NO: 1276130 - RNA, 22 nt, Homo sapiens
cuguccugcagcaaacacucca

SEQ ID NO: 1276131 - RNA, 17 nt, Homo sapiens
cugucuauaagagaauu

SEQ ID NO: 1276132 - RNA, 13 nt, Homo sapiens
cugucucuuuaag

SEQ ID NO: 1276133 - RNA, 14 nt, Homo sapiens
cugucugacaaccu

SEQ ID NO: 1276134 - RNA, 21 nt, Homo sapiens
cugucuucaccugccaccaca

SEQ ID NO: 1276135 - RNA, 11 nt, Homo sapiens
cugucuuccaa

SEQ ID NO: 1276136 - RNA, 18 nt, Homo sapiens
cugucuuccaaauugaag

SEQ ID NO: 1276137 - RNA, 20 nt, Homo sapiens
cugucuuccaaggagaccaa

SEQ ID NO: 1276138 - RNA, 14 nt, Homo sapiens
cugucuucuggucu

SEQ ID NO: 1276139 - RNA, 14 nt, Homo sapiens
cugucuuugcugag

SEQ ID NO: 1276140 - RNA, 17 nt, Homo sapiens
cugucuuugucaccacg

SEQ ID NO: 1276141 - RNA, 17 nt, Homo sapiens
cugugaaauaccacaag

SEQ ID NO: 1276142 - RNA, 22 nt, Homo sapiens
cugugaaaugcuggcauuugca

SEQ ID NO: 1276143 - RNA, 14 nt, Homo sapiens
cugugaaugcuaag

SEQ ID NO: 1276144 - RNA, 21 nt, Homo sapiens
cugugacauacauauuaucuc

SEQ ID NO: 1276145 - RNA, 13 nt, Homo sapiens
cugugaccauuua

SEQ ID NO: 1276146 - RNA, 16 nt, Homo sapiens
cugugagaggugacac

SEQ ID NO: 1276147 - RNA, 19 nt, Homo sapiens
cugugagaggugacacugu

SEQ ID NO: 1276148 - RNA, 23 nt, Homo sapiens
cugugagcuggagagaacccaga

SEQ ID NO: 1276149 - RNA, 23 nt, Homo sapiens
cugugaggguagaaaaccucacc

SEQ ID NO: 1276150 - RNA, 18 nt, Homo sapiens
cugugauaacucugcaaa

SEQ ID NO: 1276151 - RNA, 15 nt, Homo sapiens
cugugauccacccaa

SEQ ID NO: 1276152 - RNA, 21 nt, Homo sapiens
cugugcacacacacacacaug

SEQ ID NO: 1276153 - RNA, 15 nt, Homo sapiens
cugugcagucacugg

SEQ ID NO: 1276154 - RNA, 14 nt, Homo sapiens
cugugccacuuuga

SEQ ID NO: 1276155 - RNA, 13 nt, Homo sapiens
cugugccagagau

SEQ ID NO: 1276156 - RNA, 17 nt, Homo sapiens
cugugccucugccuguc

SEQ ID NO: 1276157 - RNA, 10 nt, Homo sapiens
cugugccuga

SEQ ID NO: 1276158 - RNA, 16 nt, Homo sapiens
cugugccuuuuaucua

SEQ ID NO: 1276159 - RNA, 12 nt, Homo sapiens
cugugcucagau

SEQ ID NO: 1276160 - RNA, 14 nt, Homo sapiens
agcccaacaguaau

SEQ ID NO: 1276161 - RNA, 16 nt, Homo sapiens
agcccaagaggacuga

SEQ ID NO: 1276162 - RNA, 17 nt, Homo sapiens
agcccaauguaaugcau

SEQ ID NO: 1276163 - RNA, 13 nt, Homo sapiens
agcccacaccuaa

SEQ ID NO: 1276164 - RNA, 14 nt, Homo sapiens
agcccacacuugag

SEQ ID NO: 1276165 - RNA, 22 nt, Homo sapiens
agcccacagaggcauauccugc

SEQ ID NO: 1276166 - RNA, 19 nt, Homo sapiens
agcccaccugcacccaggu

SEQ ID NO: 1276167 - RNA, 16 nt, Homo sapiens
agcccaccuuggcuca

SEQ ID NO: 1276168 - RNA, 22 nt, Homo sapiens
agcccacgagcacgagcuggaa

SEQ ID NO: 1276169 - RNA, 18 nt, Homo sapiens
agcccacuuccauccucu

SEQ ID NO: 1276170 - RNA, 18 nt, Homo sapiens
agcccagacucugagcug

SEQ ID NO: 1276171 - RNA, 14 nt, Homo sapiens
agcccagagccacc

SEQ ID NO: 1276172 - RNA, 15 nt, Homo sapiens
agcccagccugggag

SEQ ID NO: 1276173 - RNA, 19 nt, Homo sapiens
agcccaggauacuggcaca

SEQ ID NO: 1276174 - RNA, 15 nt, Homo sapiens
agcccagugcugcug

SEQ ID NO: 1276175 - RNA, 16 nt, Homo sapiens
agcccauccagucucc

SEQ ID NO: 1276176 - RNA, 19 nt, Homo sapiens
agcccauggccucuggcca

SEQ ID NO: 1276177 - RNA, 14 nt, Homo sapiens
agcccaugugcacc

SEQ ID NO: 1276178 - RNA, 20 nt, Homo sapiens
agcccauuucuccauacgca

SEQ ID NO: 1276179 - RNA, 18 nt, Homo sapiens
agccccaccucacagcca

SEQ ID NO: 1276180 - RNA, 17 nt, Homo sapiens
agccccagacaacagcc

SEQ ID NO: 1276181 - RNA, 16 nt, Homo sapiens
agccccagagaugcca

SEQ ID NO: 1276182 - RNA, 17 nt, Homo sapiens
agccccuagaaacccaa

SEQ ID NO: 1276183 - RNA, 14 nt, Homo sapiens
agccccucaugccu

SEQ ID NO: 1276184 - RNA, 20 nt, Homo sapiens
agccccucccccaucuccca

SEQ ID NO: 1276185 - RNA, 17 nt, Homo sapiens
agccccuggggccuaga

SEQ ID NO: 1276186 - RNA, 17 nt, Homo sapiens
agccccugggguggcca

SEQ ID NO: 1276187 - RNA, 17 nt, Homo sapiens
agccccuuccuggguau

SEQ ID NO: 1276188 - RNA, 15 nt, Homo sapiens
agcccgacagugcca

SEQ ID NO: 1276189 - RNA, 23 nt, Homo sapiens
agcccgcuuuuguucuuccccac

SEQ ID NO: 1276190 - RNA, 19 nt, Homo sapiens
agcccggaugcuucuccau

SEQ ID NO: 1276191 - RNA, 16 nt, Homo sapiens
agcccgucuuggcuua

SEQ ID NO: 1276192 - RNA, 14 nt, Homo sapiens
agcccgugccccac

SEQ ID NO: 1276193 - RNA, 19 nt, Homo sapiens
agcccuccaaaagcacuua

SEQ ID NO: 1276194 - RNA, 18 nt, Homo sapiens
agcccugauguguccuca

SEQ ID NO: 1276195 - RNA, 13 nt, Homo sapiens
agcccuguuggca

SEQ ID NO: 1276196 - RNA, 15 nt, Homo sapiens
agcccuugggcaguu

SEQ ID NO: 1276197 - RNA, 15 nt, Homo sapiens
agcccuuuacuugac

SEQ ID NO: 1276198 - RNA, 21 nt, Homo sapiens
agcccuuuuguugagccaggc

SEQ ID NO: 1276199 - RNA, 16 nt, Homo sapiens
agcccuuuuuguacug

SEQ ID NO: 1276200 - RNA, 20 nt, Homo sapiens
agccgagauugcgccacugc

SEQ ID NO: 1276201 - RNA, 16 nt, Homo sapiens
agccgaggccuacccc

SEQ ID NO: 1276202 - RNA, 19 nt, Homo sapiens
agccgcauuggugacucac

SEQ ID NO: 1276203 - RNA, 15 nt, Homo sapiens
agccgccauugccac

SEQ ID NO: 1276204 - RNA, 16 nt, Homo sapiens
agccgcugcacaucac

SEQ ID NO: 1276205 - RNA, 13 nt, Homo sapiens
agccgcugugagc

SEQ ID NO: 1276206 - RNA, 14 nt, Homo sapiens
agccgugaugcuca

SEQ ID NO: 1276207 - RNA, 15 nt, Homo sapiens
agccgugaugcucag

SEQ ID NO: 1276208 - RNA, 23 nt, Homo sapiens
agccguugaggcgguuuccugaa

SEQ ID NO: 1276209 - RNA, 20 nt, Homo sapiens
agccuaaaagugggcuugau

SEQ ID NO: 1276210 - RNA, 13 nt, Homo sapiens
agccuaaauguua

SEQ ID NO: 1276211 - RNA, 22 nt, Homo sapiens
agccuacccuuccugcauuucu

SEQ ID NO: 1276212 - RNA, 15 nt, Homo sapiens
agccuagcggagccc

SEQ ID NO: 1276213 - RNA, 16 nt, Homo sapiens
agccuagcggagccca

SEQ ID NO: 1276214 - RNA, 19 nt, Homo sapiens
agccuaugauauuccccau

SEQ ID NO: 1276215 - RNA, 16 nt, Homo sapiens
agccuauuuaccugca

SEQ ID NO: 1276216 - RNA, 16 nt, Homo sapiens
agccucaagaugaagg

SEQ ID NO: 1276217 - RNA, 18 nt, Homo sapiens
agccucagaggagcucua

SEQ ID NO: 1276218 - RNA, 15 nt, Homo sapiens
agccucagugaccca

SEQ ID NO: 1276219 - RNA, 12 nt, Homo sapiens
agccuccacugc

SEQ ID NO: 1276220 - RNA, 15 nt, Homo sapiens
agccuccacugccuc

SEQ ID NO: 1276221 - RNA, 18 nt, Homo sapiens
agccucccccaaagcaau

SEQ ID NO: 1276222 - RNA, 17 nt, Homo sapiens
agccuccccgugccaaa

SEQ ID NO: 1276223 - RNA, 22 nt, Homo sapiens
agccucggcccuagcauugcac

SEQ ID NO: 1276224 - RNA, 23 nt, Homo sapiens
agccucucaccuggacuccagua

SEQ ID NO: 1276225 - RNA, 14 nt, Homo sapiens
agccucugcugcca

SEQ ID NO: 1276226 - RNA, 16 nt, Homo sapiens
agccucuggcuagagg

SEQ ID NO: 1276227 - RNA, 21 nt, Homo sapiens
agccugaaugucuuacuguga

SEQ ID NO: 1276228 - RNA, 17 nt, Homo sapiens
agccugagcagagacau

SEQ ID NO: 1276229 - RNA, 16 nt, Homo sapiens
agccugagucacuggu

SEQ ID NO: 1276230 - RNA, 18 nt, Homo sapiens
agccugcaaacucacugc

SEQ ID NO: 1276231 - RNA, 15 nt, Homo sapiens
agccugcagaaucca

SEQ ID NO: 1276232 - RNA, 18 nt, Homo sapiens
agccugccucaguggcag

SEQ ID NO: 1276233 - RNA, 23 nt, Homo sapiens
agccugccucccaagguccucuc

SEQ ID NO: 1276234 - RNA, 22 nt, Homo sapiens
agccugccuggcaggcugucug

SEQ ID NO: 1276235 - RNA, 18 nt, Homo sapiens
agccugcuggcacccacc

SEQ ID NO: 1276236 - RNA, 20 nt, Homo sapiens
agccugcuuugcuuuacugc

SEQ ID NO: 1276237 - RNA, 14 nt, Homo sapiens
agccuggagaccca

SEQ ID NO: 1276238 - RNA, 23 nt, Homo sapiens
agccugggcaacauaccaagacc

SEQ ID NO: 1276239 - RNA, 15 nt, Homo sapiens
agccuggugcugcug

SEQ ID NO: 1276240 - RNA, 23 nt, Homo sapiens
agccuguggcaucuuugccuugg

SEQ ID NO: 1276241 - RNA, 22 nt, Homo sapiens
agccuuaggaaggccuucagga

SEQ ID NO: 1276242 - RNA, 20 nt, Homo sapiens
cugcaccccucugcccucau

SEQ ID NO: 1276243 - RNA, 19 nt, Homo sapiens
cugcaccccugcaguuuga

SEQ ID NO: 1276244 - RNA, 16 nt, Homo sapiens
cugcacggugggagac

SEQ ID NO: 1276245 - RNA, 21 nt, Homo sapiens
cugcacggugggagaccugcu

SEQ ID NO: 1276246 - RNA, 17 nt, Homo sapiens
cugcacguauacaccca

SEQ ID NO: 1276247 - RNA, 15 nt, Homo sapiens
cugcacuaagagaaa

SEQ ID NO: 1276248 - RNA, 15 nt, Homo sapiens
cugcacuauuugccg

SEQ ID NO: 1276249 - RNA, 16 nt, Homo sapiens
cugcacuggggccacc

SEQ ID NO: 1276250 - RNA, 17 nt, Homo sapiens
cugcacuguccugacca

SEQ ID NO: 1276251 - RNA, 23 nt, Homo sapiens
cugcacuguccugaccaucgcac

SEQ ID NO: 1276252 - RNA, 16 nt, Homo sapiens
cugcacugucugagaa

SEQ ID NO: 1276253 - RNA, 15 nt, Homo sapiens
cugcacuguuuucaa

SEQ ID NO: 1276254 - RNA, 13 nt, Homo sapiens
cugcagaauccag

SEQ ID NO: 1276255 - RNA, 13 nt, Homo sapiens
cugcagaaugacu

SEQ ID NO: 1276256 - RNA, 18 nt, Homo sapiens
cugcagacugcuaguguu

SEQ ID NO: 1276257 - RNA, 16 nt, Homo sapiens
cugcagagauuucuca

SEQ ID NO: 1276258 - RNA, 19 nt, Homo sapiens
cugcagagcugacccagag

SEQ ID NO: 1276259 - RNA, 23 nt, Homo sapiens
cugcagaggggaaaccaguguag

SEQ ID NO: 1276260 - RNA, 13 nt, Homo sapiens
cugcagaucuucc

SEQ ID NO: 1276261 - RNA, 17 nt, Homo sapiens
cugcagcaggaguggug

SEQ ID NO: 1276262 - RNA, 22 nt, Homo sapiens
cugcagccccagaagaaauuag

SEQ ID NO: 1276263 - RNA, 21 nt, Homo sapiens
cugcagccccgcgccuccuuc

SEQ ID NO: 1276264 - RNA, 23 nt, Homo sapiens
cugcagcucagggacuggcacac

SEQ ID NO: 1276265 - RNA, 21 nt, Homo sapiens
cugcagggccuauaugccagc

SEQ ID NO: 1276266 - RNA, 16 nt, Homo sapiens
cugcaggggugccugg

SEQ ID NO: 1276267 - RNA, 22 nt, Homo sapiens
cugcagguggcagagugaaugu

SEQ ID NO: 1276268 - RNA, 13 nt, Homo sapiens
cugcaggugggac

SEQ ID NO: 1276269 - RNA, 23 nt, Homo sapiens
cugcaggugggacuuuguuguuu

SEQ ID NO: 1276270 - RNA, 15 nt, Homo sapiens
cugcaguaaaacaca

SEQ ID NO: 1276271 - RNA, 20 nt, Homo sapiens
cugcaguacaacaguuuuag

SEQ ID NO: 1276272 - RNA, 20 nt, Homo sapiens
cugcaguaugggaucugaua

SEQ ID NO: 1276273 - RNA, 17 nt, Homo sapiens
cugcagucaucuacuuu

SEQ ID NO: 1276274 - RNA, 21 nt, Homo sapiens
cugcagugacgugcaccugua

SEQ ID NO: 1276275 - RNA, 15 nt, Homo sapiens
cugcaucugugaaaa

SEQ ID NO: 1276276 - RNA, 22 nt, Homo sapiens
cugcaugacaaacacacaucca

SEQ ID NO: 1276277 - RNA, 20 nt, Homo sapiens
gaauaguaguaacuguuuca

SEQ ID NO: 1276278 - RNA, 18 nt, Homo sapiens
gaauauaaggaaagcaau

SEQ ID NO: 1276279 - RNA, 13 nt, Homo sapiens
gaauauaauuuca

SEQ ID NO: 1276280 - RNA, 13 nt, Homo sapiens
gaauauagagggu

SEQ ID NO: 1276281 - RNA, 20 nt, Homo sapiens
gaauauauuauaaucuucca

SEQ ID NO: 1276282 - RNA, 17 nt, Homo sapiens
gaauaucaucugucauu

SEQ ID NO: 1276283 - RNA, 19 nt, Homo sapiens
gaauaucuguaaugguacu

SEQ ID NO: 1276284 - RNA, 16 nt, Homo sapiens
gaauaugaaacuuuca

SEQ ID NO: 1276285 - RNA, 21 nt, Homo sapiens
gaauaugauaaaacacugccc

SEQ ID NO: 1276286 - RNA, 14 nt, Homo sapiens
gaauauuacuccua

SEQ ID NO: 1276287 - RNA, 17 nt, Homo sapiens
gaauauuagcauugcca

SEQ ID NO: 1276288 - RNA, 12 nt, Homo sapiens
gaauauucccaa

SEQ ID NO: 1276289 - RNA, 18 nt, Homo sapiens
gaauauucccaagcccau

SEQ ID NO: 1276290 - RNA, 21 nt, Homo sapiens
gaauauugcuuuggucauaug

SEQ ID NO: 1276291 - RNA, 18 nt, Homo sapiens
gaauauuuauaggccagg

SEQ ID NO: 1276292 - RNA, 18 nt, Homo sapiens
gaauauuuauuaccucug

SEQ ID NO: 1276293 - RNA, 21 nt, Homo sapiens
gaauauuuauuaccucugaua

SEQ ID NO: 1276294 - RNA, 20 nt, Homo sapiens
gaauauuuuaagaauuucac

SEQ ID NO: 1276295 - RNA, 14 nt, Homo sapiens
gaaucagcaugaaa

SEQ ID NO: 1276296 - RNA, 23 nt, Homo sapiens
gaaucagugaagaugccagugaa

SEQ ID NO: 1276297 - RNA, 13 nt, Homo sapiens
gaauccacagcuc

SEQ ID NO: 1276298 - RNA, 22 nt, Homo sapiens
gaauccaccucggagcauggug

SEQ ID NO: 1276299 - RNA, 22 nt, Homo sapiens
gaauccaguccagauauuucac

SEQ ID NO: 1276300 - RNA, 23 nt, Homo sapiens
gaauccaguccagauauuucaca

SEQ ID NO: 1276301 - RNA, 19 nt, Homo sapiens
gaauccccgaaggugcugg

SEQ ID NO: 1276302 - RNA, 22 nt, Homo sapiens
gaauccccuaucccauucugcg

SEQ ID NO: 1276303 - RNA, 13 nt, Homo sapiens
gaaucccuagucc

SEQ ID NO: 1276304 - RNA, 18 nt, Homo sapiens
gaauccgcucccaagggu

SEQ ID NO: 1276305 - RNA, 17 nt, Homo sapiens
gaauccuccuccagggu

SEQ ID NO: 1276306 - RNA, 19 nt, Homo sapiens
gaaucuacaaaaaacaaca

SEQ ID NO: 1276307 - RNA, 17 nt, Homo sapiens
gaaucuacuaauuccac

SEQ ID NO: 1276308 - RNA, 17 nt, Homo sapiens
gaaucugcuguugccau

SEQ ID NO: 1276309 - RNA, 20 nt, Homo sapiens
gaaucuucaagaccaaagca

SEQ ID NO: 1276310 - RNA, 17 nt, Homo sapiens
gaaucuuuguaccaaaa

SEQ ID NO: 1276311 - RNA, 16 nt, Homo sapiens
gaaugaagcugaaggu

SEQ ID NO: 1276312 - RNA, 23 nt, Homo sapiens
gaaugaaucucaagauucaguag

SEQ ID NO: 1276313 - RNA, 17 nt, Homo sapiens
gaaugaaugagccaaag

SEQ ID NO: 1276314 - RNA, 21 nt, Homo sapiens
gaaugaucagcaucugugaug

SEQ ID NO: 1276315 - RNA, 22 nt, Homo sapiens
gaaugauuaaucaaaggcauau

SEQ ID NO: 1276316 - RNA, 22 nt, Homo sapiens
gaaugauuuagguacgucaaag

SEQ ID NO: 1276317 - RNA, 19 nt, Homo sapiens
gaaugcaaaguagcaauuu

SEQ ID NO: 1276318 - RNA, 17 nt, Homo sapiens
cugcuucuccucccagc

SEQ ID NO: 1276319 - RNA, 14 nt, Homo sapiens
cugcuugaccaaag

SEQ ID NO: 1276320 - RNA, 20 nt, Homo sapiens
cugcuugaccguacucucac

SEQ ID NO: 1276321 - RNA, 13 nt, Homo sapiens
cugcuuguguuaa

SEQ ID NO: 1276322 - RNA, 13 nt, Homo sapiens
cugcuuugccaag

SEQ ID NO: 1276323 - RNA, 15 nt, Homo sapiens
cugcuuugugagcca

SEQ ID NO: 1276324 - RNA, 13 nt, Homo sapiens
cugcuuuguucaa

SEQ ID NO: 1276325 - RNA, 21 nt, Homo sapiens
cugcuuuguuuggaugccuca

SEQ ID NO: 1276326 - RNA, 18 nt, Homo sapiens
cugcuuuuugcuucuuga

SEQ ID NO: 1276327 - RNA, 16 nt, Homo sapiens
cuggaaaaagacugau

SEQ ID NO: 1276328 - RNA, 13 nt, Homo sapiens
cuggaaauggacu

SEQ ID NO: 1276329 - RNA, 18 nt, Homo sapiens
cuggaacuccuaaaccuu

SEQ ID NO: 1276330 - RNA, 21 nt, Homo sapiens
cuggaagcugcagaucuuugc

SEQ ID NO: 1276331 - RNA, 14 nt, Homo sapiens
cuggaagcuuucau

SEQ ID NO: 1276332 - RNA, 14 nt, Homo sapiens
cuggaaggggccac

SEQ ID NO: 1276333 - RNA, 18 nt, Homo sapiens
cuggaagggguccagccu

SEQ ID NO: 1276334 - RNA, 15 nt, Homo sapiens
cuggaagucaucuca

SEQ ID NO: 1276335 - RNA, 19 nt, Homo sapiens
cuggaaguucauaccuaag

SEQ ID NO: 1276336 - RNA, 22 nt, Homo sapiens
cuggaaucacauucuuagcaca

SEQ ID NO: 1276337 - RNA, 17 nt, Homo sapiens
cuggaaucuggagacca

SEQ ID NO: 1276338 - RNA, 21 nt, Homo sapiens
cuggaaugggcacagcacagc

SEQ ID NO: 1276339 - RNA, 17 nt, Homo sapiens
cuggaauguacaguauu

SEQ ID NO: 1276340 - RNA, 23 nt, Homo sapiens
cuggaauuaaaaggaaagucaag

SEQ ID NO: 1276341 - RNA, 15 nt, Homo sapiens
cuggaauuacaggcg

SEQ ID NO: 1276342 - RNA, 15 nt, Homo sapiens
cuggaauucuaacaa

SEQ ID NO: 1276343 - RNA, 22 nt, Homo sapiens
cuggacaaaugaugccauggca

SEQ ID NO: 1276344 - RNA, 13 nt, Homo sapiens
cuggacaagccaa

SEQ ID NO: 1276345 - RNA, 22 nt, Homo sapiens
cuggacaccgggccaguaucua

SEQ ID NO: 1276346 - RNA, 21 nt, Homo sapiens
cuggacaguaucccacaucca

SEQ ID NO: 1276347 - RNA, 16 nt, Homo sapiens
cuggacauucgaggaa

SEQ ID NO: 1276348 - RNA, 21 nt, Homo sapiens
cuggaccugcccugggccaca

SEQ ID NO: 1276349 - RNA, 19 nt, Homo sapiens
cuggacucuaaagaccaaa

SEQ ID NO: 1276350 - RNA, 13 nt, Homo sapiens
cuggacuugaaug

SEQ ID NO: 1276351 - RNA, 20 nt, Homo sapiens
cuggagaacuagagaaggac

SEQ ID NO: 1276352 - RNA, 22 nt, Homo sapiens
cuggagagguuaaggugcaaua

SEQ ID NO: 1276353 - RNA, 17 nt, Homo sapiens
cuggagaugcugccugg

SEQ ID NO: 1276354 - RNA, 16 nt, Homo sapiens
cuggagcccacaaccu

SEQ ID NO: 1276355 - RNA, 15 nt, Homo sapiens
cuggagcccuguugg

SEQ ID NO: 1276356 - RNA, 15 nt, Homo sapiens
gacaugugacauuua

SEQ ID NO: 1276357 - RNA, 17 nt, Homo sapiens
gacauguuuuuauaugu

SEQ ID NO: 1276358 - RNA, 13 nt, Homo sapiens
gacauuaugugug

SEQ ID NO: 1276359 - RNA, 16 nt, Homo sapiens
gacauuggacuuccuc

SEQ ID NO: 1276360 - RNA, 16 nt, Homo sapiens
gacauuguuggccaaa

SEQ ID NO: 1276361 - RNA, 14 nt, Homo sapiens
gacauuuauucaaa

SEQ ID NO: 1276362 - RNA, 14 nt, Homo sapiens
gaccaaaacaaaca

SEQ ID NO: 1276363 - RNA, 22 nt, Homo sapiens
gaccaaaauaccuuggucauuu

SEQ ID NO: 1276364 - RNA, 15 nt, Homo sapiens
gaccaacugggccca

SEQ ID NO: 1276365 - RNA, 15 nt, Homo sapiens
gaccaccacuucgaa

SEQ ID NO: 1276366 - RNA, 18 nt, Homo sapiens
gaccacugcuggaccaag

SEQ ID NO: 1276367 - RNA, 17 nt, Homo sapiens
gaccacuguuaucaaaa

SEQ ID NO: 1276368 - RNA, 23 nt, Homo sapiens
gaccacuuccaggggaaccugcc

SEQ ID NO: 1276369 - RNA, 21 nt, Homo sapiens
gaccacuuuggagacuggggu

SEQ ID NO: 1276370 - RNA, 16 nt, Homo sapiens
gaccagccugggcaac

SEQ ID NO: 1276371 - RNA, 20 nt, Homo sapiens
gaccaguugaagcugacuca

SEQ ID NO: 1276372 - RNA, 20 nt, Homo sapiens
gaccaguugggagcacugga

SEQ ID NO: 1276373 - RNA, 22 nt, Homo sapiens
gaccauccuggcuaacacguga

SEQ ID NO: 1276374 - RNA, 15 nt, Homo sapiens
gaccaugcagccgca

SEQ ID NO: 1276375 - RNA, 15 nt, Homo sapiens
gaccauggaggccag

SEQ ID NO: 1276376 - RNA, 15 nt, Homo sapiens
gaccauucauaccca

SEQ ID NO: 1276377 - RNA, 14 nt, Homo sapiens
gacccacagacugg

SEQ ID NO: 1276378 - RNA, 19 nt, Homo sapiens
gacccacgaacgcucuuag

SEQ ID NO: 1276379 - RNA, 19 nt, Homo sapiens
gacccagccuucagucaca

SEQ ID NO: 1276380 - RNA, 17 nt, Homo sapiens
gacccaggagagacaga

SEQ ID NO: 1276381 - RNA, 20 nt, Homo sapiens
gacccaguggacucuuccac

SEQ ID NO: 1276382 - RNA, 16 nt, Homo sapiens
gacccauuccugugua

SEQ ID NO: 1276383 - RNA, 23 nt, Homo sapiens
gacccccagcacuuggggguuca

SEQ ID NO: 1276384 - RNA, 19 nt, Homo sapiens
gacccccgcaaguuugcac

SEQ ID NO: 1276385 - RNA, 23 nt, Homo sapiens
gaccccuucccuguccuugcccu

SEQ ID NO: 1276386 - RNA, 23 nt, Homo sapiens
gacccgcacgccucuucccacac

SEQ ID NO: 1276387 - RNA, 14 nt, Homo sapiens
gacccgcucuccau

SEQ ID NO: 1276388 - RNA, 18 nt, Homo sapiens
gacccuccccacccugaa

SEQ ID NO: 1276389 - RNA, 16 nt, Homo sapiens
gacccuccccuaguca

SEQ ID NO: 1276390 - RNA, 17 nt, Homo sapiens
gacccugauacaggcau

SEQ ID NO: 1276391 - RNA, 22 nt, Homo sapiens
gacccuuugccuuucuucugcc

SEQ ID NO: 1276392 - RNA, 12 nt, Homo sapiens
gaccgaggacac

SEQ ID NO: 1276393 - RNA, 18 nt, Homo sapiens
gaccgaggacacagugga

SEQ ID NO: 1276394 - RNA, 17 nt, Homo sapiens
gaccggaguuaugacaa

SEQ ID NO: 1276395 - RNA, 15 nt, Homo sapiens
gaccuaacauucgau

SEQ ID NO: 1276396 - RNA, 19 nt, Homo sapiens
gaccuaccugcagugggaa

SEQ ID NO: 1276397 - RNA, 18 nt, Homo sapiens
gaccuauuagaguauuuu

SEQ ID NO: 1276398 - RNA, 20 nt, Homo sapiens
gaccucaggugauccaccca

SEQ ID NO: 1276399 - RNA, 22 nt, Homo sapiens
gaccucaggugauccacccacc

SEQ ID NO: 1276400 - RNA, 14 nt, Homo sapiens
gaccucaggugauu

SEQ ID NO: 1276401 - RNA, 15 nt, Homo sapiens
gaccucccacugccc

SEQ ID NO: 1276402 - RNA, 23 nt, Homo sapiens
gaccuccccagccccuagcccag

SEQ ID NO: 1276403 - RNA, 22 nt, Homo sapiens
gaccuccucuucccccuuccaa

SEQ ID NO: 1276404 - RNA, 22 nt, Homo sapiens
gaccucucagcagaaacacaca

SEQ ID NO: 1276405 - RNA, 10 nt, Homo sapiens
gaccucuugu

SEQ ID NO: 1276406 - RNA, 14 nt, Homo sapiens
gaccugcggcagua

SEQ ID NO: 1276407 - RNA, 16 nt, Homo sapiens
gaccuggagacugaca

SEQ ID NO: 1276408 - RNA, 16 nt, Homo sapiens
gaccuguucaaaaagg

SEQ ID NO: 1276409 - RNA, 19 nt, Homo sapiens
gaccuuaucugugcgugaa

SEQ ID NO: 1276410 - RNA, 13 nt, Homo sapiens
gaccuucaugccc

SEQ ID NO: 1276411 - RNA, 17 nt, Homo sapiens
gaccuucuccccauucu

SEQ ID NO: 1276412 - RNA, 20 nt, Homo sapiens
gaccuuggagagacacagcg

SEQ ID NO: 1276413 - RNA, 20 nt, Homo sapiens
gaccuuggguucccaauaca

SEQ ID NO: 1276414 - RNA, 19 nt, Homo sapiens
gacgaggggugucuugggc

SEQ ID NO: 1276415 - RNA, 20 nt, Homo sapiens
gacgcaacuuaagcugggau

SEQ ID NO: 1276416 - RNA, 23 nt, Homo sapiens
gacgccuccggugagcaggguca

SEQ ID NO: 1276417 - RNA, 15 nt, Homo sapiens
gacggaugauuggau

SEQ ID NO: 1276418 - RNA, 21 nt, Homo sapiens
gacggguuggggccgggcaca

SEQ ID NO: 1276419 - RNA, 18 nt, Homo sapiens
gacgguuaaauacugugu

SEQ ID NO: 1276420 - RNA, 15 nt, Homo sapiens
gacguaaucuccaca

SEQ ID NO: 1276421 - RNA, 19 nt, Homo sapiens
gacguacuuugugcuggga

SEQ ID NO: 1276422 - RNA, 18 nt, Homo sapiens
gacguccuaucuccccca

SEQ ID NO: 1276423 - RNA, 20 nt, Homo sapiens
gacguggagcgggguaugaa

SEQ ID NO: 1276424 - RNA, 15 nt, Homo sapiens
gacgugugccuauag

SEQ ID NO: 1276425 - RNA, 21 nt, Homo sapiens
gacuaacauaaaaucugugaa

SEQ ID NO: 1276426 - RNA, 12 nt, Homo sapiens
gacuacaggugu

SEQ ID NO: 1276427 - RNA, 12 nt, Homo sapiens
gacuacugccca

SEQ ID NO: 1276428 - RNA, 19 nt, Homo sapiens
gacuacuuggaacuaggcu

SEQ ID NO: 1276429 - RNA, 13 nt, Homo sapiens
gacuagaauuuag

SEQ ID NO: 1276430 - RNA, 18 nt, Homo sapiens
gacuagaggcuugcauaa

SEQ ID NO: 1276431 - RNA, 16 nt, Homo sapiens
gacuagaugauggaug

SEQ ID NO: 1276432 - RNA, 17 nt, Homo sapiens
gacuauggcuaccaaaa

SEQ ID NO: 1276433 - RNA, 15 nt, Homo sapiens
gacuauguagcaaua

SEQ ID NO: 1276434 - RNA, 16 nt, Homo sapiens
gacucaaauguucuaa

SEQ ID NO: 1276435 - RNA, 12 nt, Homo sapiens
gacucaaugcac

SEQ ID NO: 1276436 - RNA, 19 nt, Homo sapiens
gacucagcgcuccuccugu

SEQ ID NO: 1276437 - RNA, 21 nt, Homo sapiens
gacucagcuuaagucauggaa

SEQ ID NO: 1276438 - RNA, 12 nt, Homo sapiens
gacuccaagaac

SEQ ID NO: 1276439 - RNA, 23 nt, Homo sapiens
gacuccagaaucugcuguugcca

SEQ ID NO: 1276440 - RNA, 18 nt, Homo sapiens
gacuccaucucaaaaaau

SEQ ID NO: 1276441 - RNA, 14 nt, Homo sapiens
gacuccaucucuca

SEQ ID NO: 1276442 - RNA, 13 nt, Homo sapiens
gacucccacaaca

SEQ ID NO: 1276443 - RNA, 14 nt, Homo sapiens
gacucccacaacaa

SEQ ID NO: 1276444 - RNA, 16 nt, Homo sapiens
gacucccgcgugaaga

SEQ ID NO: 1276445 - RNA, 19 nt, Homo sapiens
gacucggagacuauggccu

SEQ ID NO: 1276446 - RNA, 16 nt, Homo sapiens
gacucgguuucuccaa

SEQ ID NO: 1276447 - RNA, 18 nt, Homo sapiens
gacucuaagcugugugca

SEQ ID NO: 1276448 - RNA, 18 nt, Homo sapiens
gacucugcacaugucuug

SEQ ID NO: 1276449 - RNA, 21 nt, Homo sapiens
gacucugccauuaaaacauua

SEQ ID NO: 1276450 - RNA, 20 nt, Homo sapiens
gacucugguuucucauucuu

SEQ ID NO: 1276451 - RNA, 16 nt, Homo sapiens
gacucuucgaugugcc

SEQ ID NO: 1276452 - RNA, 17 nt, Homo sapiens
gacucuuuagagcagcu

SEQ ID NO: 1276453 - RNA, 14 nt, Homo sapiens
gacugaaauugcau

SEQ ID NO: 1276454 - RNA, 16 nt, Homo sapiens
gacugaagacucagcc

SEQ ID NO: 1276455 - RNA, 20 nt, Homo sapiens
gacugaagugaacuaugaag

SEQ ID NO: 1276456 - RNA, 15 nt, Homo sapiens
gacugacaaccucau

SEQ ID NO: 1276457 - RNA, 13 nt, Homo sapiens
gacugacauuuag

SEQ ID NO: 1276458 - RNA, 20 nt, Homo sapiens
gacugagguauaaagacaag

SEQ ID NO: 1276459 - RNA, 14 nt, Homo sapiens
gacugauccaaaaa

SEQ ID NO: 1276460 - RNA, 15 nt, Homo sapiens
gacugccaagccaga

SEQ ID NO: 1276461 - RNA, 17 nt, Homo sapiens
gacugcuaccucugaga

SEQ ID NO: 1276462 - RNA, 16 nt, Homo sapiens
gacugcucauacccag

SEQ ID NO: 1276463 - RNA, 20 nt, Homo sapiens
gacugcugauuuucuggaau

SEQ ID NO: 1276464 - RNA, 12 nt, Homo sapiens
gacugcuuuuag

SEQ ID NO: 1276465 - RNA, 17 nt, Homo sapiens
gacuggagcucaucugc

SEQ ID NO: 1276466 - RNA, 17 nt, Homo sapiens
gacuggauucgugacaa

SEQ ID NO: 1276467 - RNA, 20 nt, Homo sapiens
gacuggcaauaaacuccuac

SEQ ID NO: 1276468 - RNA, 23 nt, Homo sapiens
gacuggcaguaaccuagugaauu

SEQ ID NO: 1276469 - RNA, 21 nt, Homo sapiens
gacugguggccccugccuugg

SEQ ID NO: 1276470 - RNA, 15 nt, Homo sapiens
gacugguuguucaaa

SEQ ID NO: 1276471 - RNA, 17 nt, Homo sapiens
gacuguacacacuuuau

SEQ ID NO: 1276472 - RNA, 13 nt, Homo sapiens
gacuguagaagaa

SEQ ID NO: 1276473 - RNA, 17 nt, Homo sapiens
gacuguccaagugccac

SEQ ID NO: 1276474 - RNA, 21 nt, Homo sapiens
gacuguccucuccccuccagc

SEQ ID NO: 1276475 - RNA, 13 nt, Homo sapiens
gacugugaccacc

SEQ ID NO: 1276476 - RNA, 17 nt, Homo sapiens
gacuguugccacuuaac

SEQ ID NO: 1276477 - RNA, 13 nt, Homo sapiens
gacuguugcucaa

SEQ ID NO: 1276478 - RNA, 16 nt, Homo sapiens
gacuguuuggcuuaua

SEQ ID NO: 1276479 - RNA, 20 nt, Homo sapiens
gacuuaaacagcagauuuca

SEQ ID NO: 1276480 - RNA, 22 nt, Homo sapiens
gacuuauacuugccuucugaua

SEQ ID NO: 1276481 - RNA, 14 nt, Homo sapiens
gacuucaaugauag

SEQ ID NO: 1276482 - RNA, 22 nt, Homo sapiens
gacuuccccucaacaugcugcc

SEQ ID NO: 1276483 - RNA, 22 nt, Homo sapiens
gaaugcaaaguagcaauuucca

SEQ ID NO: 1276484 - RNA, 18 nt, Homo sapiens
gaaugcaacuccauuuac

SEQ ID NO: 1276485 - RNA, 12 nt, Homo sapiens
gaaugcagggaa

SEQ ID NO: 1276486 - RNA, 16 nt, Homo sapiens
gaaugcagugguauga

SEQ ID NO: 1276487 - RNA, 12 nt, Homo sapiens
gaaugcauucaa

SEQ ID NO: 1276488 - RNA, 14 nt, Homo sapiens
gaaugccggggaca

SEQ ID NO: 1276489 - RNA, 15 nt, Homo sapiens
gaaugcuggcaaagg

SEQ ID NO: 1276490 - RNA, 14 nt, Homo sapiens
gaaugcuguguuaa

SEQ ID NO: 1276491 - RNA, 19 nt, Homo sapiens
gaauggacauccuguauaa

SEQ ID NO: 1276492 - RNA, 19 nt, Homo sapiens
gaauggcaggugucauaug

SEQ ID NO: 1276493 - RNA, 21 nt, Homo sapiens
gaauggcugcaccuuuuugca

SEQ ID NO: 1276494 - RNA, 20 nt, Homo sapiens
gaaugguacaugucuuccau

SEQ ID NO: 1276495 - RNA, 21 nt, Homo sapiens
gaaugguugaguuacauuaaa

SEQ ID NO: 1276496 - RNA, 14 nt, Homo sapiens
gaauguauaauauc

SEQ ID NO: 1276497 - RNA, 17 nt, Homo sapiens
gaaugugcuaugaagcu

SEQ ID NO: 1276498 - RNA, 20 nt, Homo sapiens
gaaugugcugaucauuugag

SEQ ID NO: 1276499 - RNA, 18 nt, Homo sapiens
gaauguggaauaccuaag

SEQ ID NO: 1276500 - RNA, 18 nt, Homo sapiens
gaauguggauucuuccca

SEQ ID NO: 1276501 - RNA, 17 nt, Homo sapiens
gaaugugguuacuuccu

SEQ ID NO: 1276502 - RNA, 15 nt, Homo sapiens
gaauguuaagcagau

SEQ ID NO: 1276503 - RNA, 13 nt, Homo sapiens
gaauguuacagua

SEQ ID NO: 1276504 - RNA, 23 nt, Homo sapiens
gaauguucccugcacccuggaaa

SEQ ID NO: 1276505 - RNA, 18 nt, Homo sapiens
gaauguugguuuacuuuc

SEQ ID NO: 1276506 - RNA, 14 nt, Homo sapiens
gaauguuugccucu

SEQ ID NO: 1276507 - RNA, 14 nt, Homo sapiens
gaauuaaccuggug

SEQ ID NO: 1276508 - RNA, 19 nt, Homo sapiens
gaauuacagacaaccuauc

SEQ ID NO: 1276509 - RNA, 22 nt, Homo sapiens
gaauuaccauuaauuacauaca

SEQ ID NO: 1276510 - RNA, 16 nt, Homo sapiens
gaauuauaacuguaaa

SEQ ID NO: 1276511 - RNA, 17 nt, Homo sapiens
gaauuauaagucacaaa

SEQ ID NO: 1276512 - RNA, 19 nt, Homo sapiens
gaauuauaggcgugcacca

SEQ ID NO: 1276513 - RNA, 21 nt, Homo sapiens
gaauuauguaauauauuguac

SEQ ID NO: 1276514 - RNA, 13 nt, Homo sapiens
gaauuaugugcac

SEQ ID NO: 1276515 - RNA, 21 nt, Homo sapiens
gaauuaugugcacuaccauag

SEQ ID NO: 1276516 - RNA, 21 nt, Homo sapiens
gaauucaaguggguauucugg

SEQ ID NO: 1276517 - RNA, 14 nt, Homo sapiens
gaauucuuggggcu

SEQ ID NO: 1276518 - RNA, 17 nt, Homo sapiens
gaauugcccguuuccau

SEQ ID NO: 1276519 - RNA, 14 nt, Homo sapiens
gaauugguugccau

SEQ ID NO: 1276520 - RNA, 20 nt, Homo sapiens
gaauuguacaagagucccuu

SEQ ID NO: 1276521 - RNA, 19 nt, Homo sapiens
gaauuguaggugacuauua

SEQ ID NO: 1276522 - RNA, 14 nt, Homo sapiens
gaauuuauaucuaa

SEQ ID NO: 1276523 - RNA, 20 nt, Homo sapiens
gaauuuauuauuuaccguug

SEQ ID NO: 1276524 - RNA, 15 nt, Homo sapiens
gaauuuccucuauug

SEQ ID NO: 1276525 - RNA, 11 nt, Homo sapiens
gaauuugcacc

SEQ ID NO: 1276526 - RNA, 22 nt, Homo sapiens
gaauuuguacuucuuauugcaa

SEQ ID NO: 1276527 - RNA, 18 nt, Homo sapiens
gaauuuguuuugguacuc

SEQ ID NO: 1276528 - RNA, 15 nt, Homo sapiens
gaauuuuaagugcuu

SEQ ID NO: 1276529 - RNA, 23 nt, Homo sapiens
gaauuuucucccuuuauguaucu

SEQ ID NO: 1276530 - RNA, 20 nt, Homo sapiens
gaauuuucucuaacuucaag

SEQ ID NO: 1276531 - RNA, 21 nt, Homo sapiens
gaauuuugggacuucuaccca

SEQ ID NO: 1276532 - RNA, 21 nt, Homo sapiens
gacaaagccaaacucugccag

SEQ ID NO: 1276533 - RNA, 21 nt, Homo sapiens
gacaaagguuuuccucuucua

SEQ ID NO: 1276534 - RNA, 14 nt, Homo sapiens
gacaacaccuuccu

SEQ ID NO: 1276535 - RNA, 12 nt, Homo sapiens
gacaacacuuaa

SEQ ID NO: 1276536 - RNA, 18 nt, Homo sapiens
gacaacagaaaaacaauc

SEQ ID NO: 1276537 - RNA, 16 nt, Homo sapiens
gacaacagugcuuugu

SEQ ID NO: 1276538 - RNA, 12 nt, Homo sapiens
gacaacauuucu

SEQ ID NO: 1276539 - RNA, 19 nt, Homo sapiens
gacaaccaaaacauauuca

SEQ ID NO: 1276540 - RNA, 23 nt, Homo sapiens
gacaaccugaaauuuauucacau

SEQ ID NO: 1276541 - RNA, 16 nt, Homo sapiens
gacaacgaugaugcuu

SEQ ID NO: 1276542 - RNA, 13 nt, Homo sapiens
gacaacugugacu

SEQ ID NO: 1276543 - RNA, 17 nt, Homo sapiens
gacaacuucaaaauaca

SEQ ID NO: 1276544 - RNA, 19 nt, Homo sapiens
gacaagaaacacauucuua

SEQ ID NO: 1276545 - RNA, 16 nt, Homo sapiens
gacaagacacugagga

SEQ ID NO: 1276546 - RNA, 17 nt, Homo sapiens
gacaagaccacacuuug

SEQ ID NO: 1276547 - RNA, 15 nt, Homo sapiens
gacaagauaccaagg

SEQ ID NO: 1276548 - RNA, 12 nt, Homo sapiens
gacaagcacuuu

SEQ ID NO: 1276549 - RNA, 15 nt, Homo sapiens
gacaagcagcuggug

SEQ ID NO: 1276550 - RNA, 17 nt, Homo sapiens
gacaagcagcuggugcu

SEQ ID NO: 1276551 - RNA, 21 nt, Homo sapiens
gacaaggagugugaccacuga

SEQ ID NO: 1276552 - RNA, 16 nt, Homo sapiens
gacaagggcugaccug

SEQ ID NO: 1276553 - RNA, 15 nt, Homo sapiens
gacaaguauggcucc

SEQ ID NO: 1276554 - RNA, 22 nt, Homo sapiens
gacaauaaaccuccgccaaugc

SEQ ID NO: 1276555 - RNA, 23 nt, Homo sapiens
gacaauaaaccuccgccaaugca

SEQ ID NO: 1276556 - RNA, 14 nt, Homo sapiens
gacaauacuggggu

SEQ ID NO: 1276557 - RNA, 23 nt, Homo sapiens
gacaauaguauuucuccuuugca

SEQ ID NO: 1276558 - RNA, 18 nt, Homo sapiens
gacaaucacuacaaguca

SEQ ID NO: 1276559 - RNA, 19 nt, Homo sapiens
gacaaucaugaaauaugca

SEQ ID NO: 1276560 - RNA, 20 nt, Homo sapiens
gacaaucaugaaauaugcau

SEQ ID NO: 1276561 - RNA, 23 nt, Homo sapiens
gacaaugaaaguuugcacuguau

SEQ ID NO: 1276562 - RNA, 21 nt, Homo sapiens
gacaauuccuagauaaaaaga

SEQ ID NO: 1276563 - RNA, 18 nt, Homo sapiens
gacacaaaacuccgcccc

SEQ ID NO: 1276564 - RNA, 14 nt, Homo sapiens
gacacaauccucaa

SEQ ID NO: 1276565 - RNA, 22 nt, Homo sapiens
gacacaaucucggcucacugaa

SEQ ID NO: 1276566 - RNA, 15 nt, Homo sapiens
gacacagacuggcaa

SEQ ID NO: 1276567 - RNA, 16 nt, Homo sapiens
gacacagacuggcaau

SEQ ID NO: 1276568 - RNA, 22 nt, Homo sapiens
gagauacauguugccucaccag

SEQ ID NO: 1276569 - RNA, 20 nt, Homo sapiens
gagauagcaccauugcacuc

SEQ ID NO: 1276570 - RNA, 20 nt, Homo sapiens
gagauauggcuaguggcaau

SEQ ID NO: 1276571 - RNA, 21 nt, Homo sapiens
gagaucaugccacuacacucc

SEQ ID NO: 1276572 - RNA, 14 nt, Homo sapiens
gagaucgagaccau

SEQ ID NO: 1276573 - RNA, 21 nt, Homo sapiens
gagaucgugcuacugcacucc

SEQ ID NO: 1276574 - RNA, 16 nt, Homo sapiens
gagaucguuguuuaca

SEQ ID NO: 1276575 - RNA, 20 nt, Homo sapiens
gagaucguuguuuacagugu

SEQ ID NO: 1276576 - RNA, 16 nt, Homo sapiens
gagaucuaaugugaaa

SEQ ID NO: 1276577 - RNA, 15 nt, Homo sapiens
gagaucugugccaua

SEQ ID NO: 1276578 - RNA, 16 nt, Homo sapiens
gagaucuuucccaggc

SEQ ID NO: 1276579 - RNA, 18 nt, Homo sapiens
gagaugaaccacauuaua

SEQ ID NO: 1276580 - RNA, 16 nt, Homo sapiens
gagaugagcccacaga

SEQ ID NO: 1276581 - RNA, 20 nt, Homo sapiens
gagaugcuggagaagagagg

SEQ ID NO: 1276582 - RNA, 17 nt, Homo sapiens
gagauggaggaaaguga

SEQ ID NO: 1276583 - RNA, 16 nt, Homo sapiens
gagaugucaucagagc

SEQ ID NO: 1276584 - RNA, 21 nt, Homo sapiens
gagauguggcaaagugcugua

SEQ ID NO: 1276585 - RNA, 20 nt, Homo sapiens
gagauugaauuucacugucu

SEQ ID NO: 1276586 - RNA, 20 nt, Homo sapiens
gagauugcacuauugcacuc

SEQ ID NO: 1276587 - RNA, 23 nt, Homo sapiens
gagauuuguaggaaggucucauu

SEQ ID NO: 1276588 - RNA, 19 nt, Homo sapiens
gagcaaaucaucugcauuc

SEQ ID NO: 1276589 - RNA, 14 nt, Homo sapiens
gagcaacagaguga

SEQ ID NO: 1276590 - RNA, 21 nt, Homo sapiens
gagcaaccccuguacccagcu

SEQ ID NO: 1276591 - RNA, 14 nt, Homo sapiens
gagcaagacccugu

SEQ ID NO: 1276592 - RNA, 22 nt, Homo sapiens
gagcaagacuccaucucaaaaa

SEQ ID NO: 1276593 - RNA, 15 nt, Homo sapiens
gagcaagcccuacuc

SEQ ID NO: 1276594 - RNA, 17 nt, Homo sapiens
gagcacaaacuucagaa

SEQ ID NO: 1276595 - RNA, 20 nt, Homo sapiens
gagcaccuacuacaugcaag

SEQ ID NO: 1276596 - RNA, 15 nt, Homo sapiens
gagcacuggccagag

SEQ ID NO: 1276597 - RNA, 12 nt, Homo sapiens
gagcacugugag

SEQ ID NO: 1276598 - RNA, 15 nt, Homo sapiens
gagcagccacaacca

SEQ ID NO: 1276599 - RNA, 13 nt, Homo sapiens
gagcagccugaac

SEQ ID NO: 1276600 - RNA, 12 nt, Homo sapiens
gagcagccugug

SEQ ID NO: 1276601 - RNA, 18 nt, Homo sapiens
gagcagcucuucagcaca

SEQ ID NO: 1276602 - RNA, 19 nt, Homo sapiens
gagcagcuuuggaaacagg

SEQ ID NO: 1276603 - RNA, 16 nt, Homo sapiens
gagcaggggaggcuca

SEQ ID NO: 1276604 - RNA, 15 nt, Homo sapiens
gagcagucagggugg

SEQ ID NO: 1276605 - RNA, 17 nt, Homo sapiens
gagcaguccugccucag

SEQ ID NO: 1276606 - RNA, 17 nt, Homo sapiens
gagcaguggccaggcca

SEQ ID NO: 1276607 - RNA, 17 nt, Homo sapiens
gagcaguggcuggucca

SEQ ID NO: 1276608 - RNA, 19 nt, Homo sapiens
gagcaguggcugguccagg

SEQ ID NO: 1276609 - RNA, 14 nt, Homo sapiens
gagcagugucuucc

SEQ ID NO: 1276610 - RNA, 20 nt, Homo sapiens
gagcauaacuguucucauuu

SEQ ID NO: 1276611 - RNA, 22 nt, Homo sapiens
gagcauaauaaauuauauuaaa

SEQ ID NO: 1276612 - RNA, 16 nt, Homo sapiens
gagcauggaugcauuu

SEQ ID NO: 1276613 - RNA, 12 nt, Homo sapiens
gagcauuuccaa

SEQ ID NO: 1276614 - RNA, 16 nt, Homo sapiens
gcagucuuauuuccaa

SEQ ID NO: 1276615 - RNA, 13 nt, Homo sapiens
gcagugaaguaua

SEQ ID NO: 1276616 - RNA, 17 nt, Homo sapiens
gcagugagcuguguucu

SEQ ID NO: 1276617 - RNA, 14 nt, Homo sapiens
gcagugagcuugua

SEQ ID NO: 1276618 - RNA, 14 nt, Homo sapiens
gcagugagugagcc

SEQ ID NO: 1276619 - RNA, 22 nt, Homo sapiens
gcaguggaguaaguauuuagaa

SEQ ID NO: 1276620 - RNA, 17 nt, Homo sapiens
gcaguggcaccaccaug

SEQ ID NO: 1276621 - RNA, 17 nt, Homo sapiens
gcaguggcugugccacc

SEQ ID NO: 1276622 - RNA, 19 nt, Homo sapiens
gcaguucccccaaccucag

SEQ ID NO: 1276623 - RNA, 15 nt, Homo sapiens
gcaguuuaugagaca

SEQ ID NO: 1276624 - RNA, 23 nt, Homo sapiens
gcaguuucaucaaagaacaaaca

SEQ ID NO: 1276625 - RNA, 22 nt, Homo sapiens
gcaguuuccaauaaacgcaagc

SEQ ID NO: 1276626 - RNA, 16 nt, Homo sapiens
gcauaaguuucuggga

SEQ ID NO: 1276627 - RNA, 21 nt, Homo sapiens
gcauaaguuucugggaccuca

SEQ ID NO: 1276628 - RNA, 14 nt, Homo sapiens
gcauaauagucaau

SEQ ID NO: 1276629 - RNA, 16 nt, Homo sapiens
gcauacaaagcaguuu

SEQ ID NO: 1276630 - RNA, 23 nt, Homo sapiens
gcauacagacuggggacccugga

SEQ ID NO: 1276631 - RNA, 14 nt, Homo sapiens
gcauaccacuugaa

SEQ ID NO: 1276632 - RNA, 20 nt, Homo sapiens
gcauaccugucucagcuguu

SEQ ID NO: 1276633 - RNA, 14 nt, Homo sapiens
gcauagccauggaa

SEQ ID NO: 1276634 - RNA, 20 nt, Homo sapiens
gcauaggccuuagcaguaac

SEQ ID NO: 1276635 - RNA, 14 nt, Homo sapiens
gcauaggcucuuaa

SEQ ID NO: 1276636 - RNA, 21 nt, Homo sapiens
gcauaggugaggcugggcccu

SEQ ID NO: 1276637 - RNA, 18 nt, Homo sapiens
gcauauaaaaacaucagu

SEQ ID NO: 1276638 - RNA, 15 nt, Homo sapiens
gcauaugcacaguca

SEQ ID NO: 1276639 - RNA, 19 nt, Homo sapiens
gcauauuaagcacuuuaag

SEQ ID NO: 1276640 - RNA, 23 nt, Homo sapiens
gcauauuuauccaaaauguguau

SEQ ID NO: 1276641 - RNA, 18 nt, Homo sapiens
gcauauuuuaaugcaguu

SEQ ID NO: 1276642 - RNA, 15 nt, Homo sapiens
gcaucaaggugcuga

SEQ ID NO: 1276643 - RNA, 19 nt, Homo sapiens
gcaucaauacaaccagccc

SEQ ID NO: 1276644 - RNA, 16 nt, Homo sapiens
gcaucacacaucacuc

SEQ ID NO: 1276645 - RNA, 13 nt, Homo sapiens
gcaucacugggug

SEQ ID NO: 1276646 - RNA, 21 nt, Homo sapiens
gcaucaggcagggugagcucc

SEQ ID NO: 1276647 - RNA, 20 nt, Homo sapiens
gcaucauaagcugauuugau

SEQ ID NO: 1276648 - RNA, 13 nt, Homo sapiens
gcaucaucuaugg

SEQ ID NO: 1276649 - RNA, 20 nt, Homo sapiens
gcauccccuuggcugugagg

SEQ ID NO: 1276650 - RNA, 19 nt, Homo sapiens
gcaucccugagacagggag

SEQ ID NO: 1276651 - RNA, 17 nt, Homo sapiens
gcaucgcuccucuccag

SEQ ID NO: 1276652 - RNA, 18 nt, Homo sapiens
gcaucggacaagaccccc

SEQ ID NO: 1276653 - RNA, 16 nt, Homo sapiens
gcaucuacacaauuua

SEQ ID NO: 1276654 - RNA, 15 nt, Homo sapiens
gcaucucagugcagg

SEQ ID NO: 1276655 - RNA, 17 nt, Homo sapiens
gcaucucccagcaagac

SEQ ID NO: 1276656 - RNA, 12 nt, Homo sapiens
gcaucugacaca

SEQ ID NO: 1276657 - RNA, 15 nt, Homo sapiens
gcaucugcaguacag

SEQ ID NO: 1276658 - RNA, 22 nt, Homo sapiens
gcaucuggcuguuuagcagaac

SEQ ID NO: 1276659 - RNA, 17 nt, Homo sapiens
gcaucugugccagagau

SEQ ID NO: 1276660 - RNA, 23 nt, Homo sapiens
gcaucugugccagagauguacug

SEQ ID NO: 1276661 - RNA, 19 nt, Homo sapiens
gcaucugugccuucucuau

SEQ ID NO: 1276662 - RNA, 22 nt, Homo sapiens
gcaucuugcuaugagguuugcu

SEQ ID NO: 1276663 - RNA, 15 nt, Homo sapiens
gcaucuuguuucaua

SEQ ID NO: 1276664 - RNA, 19 nt, Homo sapiens
gcaugaaaaggaugcuccg

SEQ ID NO: 1276665 - RNA, 14 nt, Homo sapiens
gcaugacagucaca

SEQ ID NO: 1276666 - RNA, 20 nt, Homo sapiens
gcaugacucagacugcauga

SEQ ID NO: 1276667 - RNA, 18 nt, Homo sapiens
gcaugccacccucacaca

SEQ ID NO: 1276668 - RNA, 17 nt, Homo sapiens
gcauggagagccucuua

SEQ ID NO: 1276669 - RNA, 20 nt, Homo sapiens
gcauggccccaguccaugcu

SEQ ID NO: 1276670 - RNA, 13 nt, Homo sapiens
gcaugggcacucc

SEQ ID NO: 1276671 - RNA, 17 nt, Homo sapiens
gcauggucccugccuua

SEQ ID NO: 1276672 - RNA, 23 nt, Homo sapiens
gcaugguggaacccccaucucua

SEQ ID NO: 1276673 - RNA, 14 nt, Homo sapiens
gcaugguguuuuca

SEQ ID NO: 1276674 - RNA, 13 nt, Homo sapiens
aaaucaguauuug

SEQ ID NO: 1276675 - RNA, 18 nt, Homo sapiens
aaaucaugccaguauuuu

SEQ ID NO: 1276676 - RNA, 21 nt, Homo sapiens
aaaucauuucaguaucaucuc

SEQ ID NO: 1276677 - RNA, 20 nt, Homo sapiens
aaauccagugagcacuagaa

SEQ ID NO: 1276678 - RNA, 21 nt, Homo sapiens
aaauccagugagcacuagaau

SEQ ID NO: 1276679 - RNA, 13 nt, Homo sapiens
aaauccaguucua

SEQ ID NO: 1276680 - RNA, 17 nt, Homo sapiens
aaauccuaagacacaaa

SEQ ID NO: 1276681 - RNA, 17 nt, Homo sapiens
aaauccuagacuugaaa

SEQ ID NO: 1276682 - RNA, 13 nt, Homo sapiens
aaauccucaggug

SEQ ID NO: 1276683 - RNA, 18 nt, Homo sapiens
aaauccucauguuacuca

SEQ ID NO: 1276684 - RNA, 13 nt, Homo sapiens
aaauccuuccaaa

SEQ ID NO: 1276685 - RNA, 21 nt, Homo sapiens
aaauccuuccuaaacccaaug

SEQ ID NO: 1276686 - RNA, 23 nt, Homo sapiens
aaaucggaucuggggcucuggga

SEQ ID NO: 1276687 - RNA, 21 nt, Homo sapiens
aaaucgugacaacacuugugu

SEQ ID NO: 1276688 - RNA, 14 nt, Homo sapiens
aaaucgugccuugu

SEQ ID NO: 1276689 - RNA, 16 nt, Homo sapiens
aaaucuaaaucuucag

SEQ ID NO: 1276690 - RNA, 16 nt, Homo sapiens
aaaucuaagugauaua

SEQ ID NO: 1276691 - RNA, 19 nt, Homo sapiens
aaaucuaaucucuuauucu

SEQ ID NO: 1276692 - RNA, 16 nt, Homo sapiens
aaaucuaccacuguau

SEQ ID NO: 1276693 - RNA, 14 nt, Homo sapiens
aaaucuauuacuuu

SEQ ID NO: 1276694 - RNA, 13 nt, Homo sapiens
aaaucucacaaau

SEQ ID NO: 1276695 - RNA, 16 nt, Homo sapiens
aaaucuccugcugauu

SEQ ID NO: 1276696 - RNA, 23 nt, Homo sapiens
aaaucugaauaaauaauucuuuc

SEQ ID NO: 1276697 - RNA, 20 nt, Homo sapiens
aaaucugagggagcugagua

SEQ ID NO: 1276698 - RNA, 19 nt, Homo sapiens
aaaucuggguaucuuucca

SEQ ID NO: 1276699 - RNA, 12 nt, Homo sapiens
aaaucuguaaau

SEQ ID NO: 1276700 - RNA, 22 nt, Homo sapiens
aaaucuuaaaagcccuaaguga

SEQ ID NO: 1276701 - RNA, 17 nt, Homo sapiens
aaaucuuggaaguacau

SEQ ID NO: 1276702 - RNA, 20 nt, Homo sapiens
aaaucuuuaagaauaguucu

SEQ ID NO: 1276703 - RNA, 17 nt, Homo sapiens
aaaucuuuuaaaucuuu

SEQ ID NO: 1276704 - RNA, 21 nt, Homo sapiens
aaaucuuuuucuauauucuca

SEQ ID NO: 1276705 - RNA, 21 nt, Homo sapiens
aaaucuuuuuuguucaaagau

SEQ ID NO: 1276706 - RNA, 15 nt, Homo sapiens
aaaugaaaauguuuc

SEQ ID NO: 1276707 - RNA, 16 nt, Homo sapiens
aaaugaaauccaguga

SEQ ID NO: 1276708 - RNA, 14 nt, Homo sapiens
aaaugaacauuuca

SEQ ID NO: 1276709 - RNA, 13 nt, Homo sapiens
aaaugaacugaag

SEQ ID NO: 1276710 - RNA, 15 nt, Homo sapiens
aaaugaaucuucaca

SEQ ID NO: 1276711 - RNA, 19 nt, Homo sapiens
aaaugacaagugagacaaa

SEQ ID NO: 1276712 - RNA, 20 nt, Homo sapiens
aaaugacuauuucuacccuu

SEQ ID NO: 1276713 - RNA, 20 nt, Homo sapiens
aaaugacucuggggagguga

SEQ ID NO: 1276714 - RNA, 15 nt, Homo sapiens
aaaugagaaguacuu

SEQ ID NO: 1276715 - RNA, 22 nt, Homo sapiens
aaaugagaauuuuauauucuaa

SEQ ID NO: 1276716 - RNA, 19 nt, Homo sapiens
aaaugagacuuacugggug

SEQ ID NO: 1276717 - RNA, 14 nt, Homo sapiens
aaaugagugcuuaa

SEQ ID NO: 1276718 - RNA, 18 nt, Homo sapiens
aaaugaguugugaugaau

SEQ ID NO: 1276719 - RNA, 20 nt, Homo sapiens
aacaugcugaaaacuacaca

SEQ ID NO: 1276720 - RNA, 16 nt, Homo sapiens
aacaugguaaaacccc

SEQ ID NO: 1276721 - RNA, 19 nt, Homo sapiens
aacauguaaaacaguuaca

SEQ ID NO: 1276722 - RNA, 23 nt, Homo sapiens
aacauguaauaaaaaguauaugu

SEQ ID NO: 1276723 - RNA, 14 nt, Homo sapiens
aacauguaugugca

SEQ ID NO: 1276724 - RNA, 15 nt, Homo sapiens
aacauguccuaauuc

SEQ ID NO: 1276725 - RNA, 17 nt, Homo sapiens
aacauguccuaauucuu

SEQ ID NO: 1276726 - RNA, 21 nt, Homo sapiens
aacauguuagaagcaaugaau

SEQ ID NO: 1276727 - RNA, 16 nt, Homo sapiens
aacauuauauugcaau

SEQ ID NO: 1276728 - RNA, 13 nt, Homo sapiens
aacauuaugccuu

SEQ ID NO: 1276729 - RNA, 20 nt, Homo sapiens
aacauuauuagcacuucccg

SEQ ID NO: 1276730 - RNA, 18 nt, Homo sapiens
aacauuauuuauucagcu

SEQ ID NO: 1276731 - RNA, 20 nt, Homo sapiens
aacauuauuuggauaucaaa

SEQ ID NO: 1276732 - RNA, 18 nt, Homo sapiens
aacauugaacucauaucu

SEQ ID NO: 1276733 - RNA, 14 nt, Homo sapiens
aacauugaccaaga

SEQ ID NO: 1276734 - RNA, 15 nt, Homo sapiens
aacauuguguugaca

SEQ ID NO: 1276735 - RNA, 22 nt, Homo sapiens
aacauuguuuuguguaacauau

SEQ ID NO: 1276736 - RNA, 13 nt, Homo sapiens
aacauuucucacu

SEQ ID NO: 1276737 - RNA, 20 nt, Homo sapiens
aacauuucuggacaguaccu

SEQ ID NO: 1276738 - RNA, 17 nt, Homo sapiens
aacauuugccuugcaga

SEQ ID NO: 1276739 - RNA, 18 nt, Homo sapiens
aacauuugcugccauuac

SEQ ID NO: 1276740 - RNA, 23 nt, Homo sapiens
aacauuuuauuuuuaaaauauua

SEQ ID NO: 1276741 - RNA, 15 nt, Homo sapiens
aaccaaacccagaca

SEQ ID NO: 1276742 - RNA, 22 nt, Homo sapiens
aaccaaacccagacaaccaaaa

SEQ ID NO: 1276743 - RNA, 17 nt, Homo sapiens
aaccaaacuuguucauu

SEQ ID NO: 1276744 - RNA, 20 nt, Homo sapiens
aaccaaaucuggaagccaaa

SEQ ID NO: 1276745 - RNA, 21 nt, Homo sapiens
aaccaacugaacgacaaagca

SEQ ID NO: 1276746 - RNA, 14 nt, Homo sapiens
aaccaauguagcac

SEQ ID NO: 1276747 - RNA, 15 nt, Homo sapiens
aaccacaacugacac

SEQ ID NO: 1276748 - RNA, 16 nt, Homo sapiens
aaccacacacaguaaa

SEQ ID NO: 1276749 - RNA, 10 nt, Homo sapiens
aaccacagag

SEQ ID NO: 1276750 - RNA, 17 nt, Homo sapiens
aaccacauuaauuaauu

SEQ ID NO: 1276751 - RNA, 14 nt, Homo sapiens
aaccaccaauccaa

SEQ ID NO: 1276752 - RNA, 13 nt, Homo sapiens
aaccacucaaauu

SEQ ID NO: 1276753 - RNA, 11 nt, Homo sapiens
aaccacuguac

SEQ ID NO: 1276754 - RNA, 21 nt, Homo sapiens
aaccagacaaggaaauacccu

SEQ ID NO: 1276755 - RNA, 13 nt, Homo sapiens
aaccagagaggcu

SEQ ID NO: 1276756 - RNA, 17 nt, Homo sapiens
aaccaggacccugucca

SEQ ID NO: 1276757 - RNA, 19 nt, Homo sapiens
aaccaggauuuccuugacu

SEQ ID NO: 1276758 - RNA, 20 nt, Homo sapiens
aaccauacacaggcuaucaa

SEQ ID NO: 1276759 - RNA, 15 nt, Homo sapiens
aaccauauaaauucu

SEQ ID NO: 1276760 - RNA, 19 nt, Homo sapiens
aaccauaugaacauauauu

SEQ ID NO: 1276761 - RNA, 14 nt, Homo sapiens
aaccaucagcauca

SEQ ID NO: 1276762 - RNA, 16 nt, Homo sapiens
aaccauccagugacaa

SEQ ID NO: 1276763 - RNA, 15 nt, Homo sapiens
aaccaucccugaugu

SEQ ID NO: 1276764 - RNA, 12 nt, Homo sapiens
aaccaucuucac

SEQ ID NO: 1276765 - RNA, 16 nt, Homo sapiens
aaccaugacugugacc

SEQ ID NO: 1276766 - RNA, 18 nt, Homo sapiens
aaccauuguaacuauuaa

SEQ ID NO: 1276767 - RNA, 19 nt, Homo sapiens
aaccauuuuuguuacucuc

SEQ ID NO: 1276768 - RNA, 19 nt, Homo sapiens
aacccacaccgucuuccuu

SEQ ID NO: 1276769 - RNA, 17 nt, Homo sapiens
aacccaccaaucuacuu

SEQ ID NO: 1276770 - RNA, 22 nt, Homo sapiens
aacccacuagaagcaacuagga

SEQ ID NO: 1276771 - RNA, 13 nt, Homo sapiens
aacuaccaucuga

SEQ ID NO: 1276772 - RNA, 17 nt, Homo sapiens
aacuacuaaagugccua

SEQ ID NO: 1276773 - RNA, 20 nt, Homo sapiens
aacuacuaaagugccuaccc

SEQ ID NO: 1276774 - RNA, 19 nt, Homo sapiens
aacuacugcuggaaaaagc

SEQ ID NO: 1276775 - RNA, 21 nt, Homo sapiens
aacuacuguguuccuggcaau

SEQ ID NO: 1276776 - RNA, 16 nt, Homo sapiens
aacuagaaaucugcca

SEQ ID NO: 1276777 - RNA, 17 nt, Homo sapiens
aacuagaaaucugccaa

SEQ ID NO: 1276778 - RNA, 13 nt, Homo sapiens
aacuauauucuca

SEQ ID NO: 1276779 - RNA, 14 nt, Homo sapiens
aacuauauucucag

SEQ ID NO: 1276780 - RNA, 17 nt, Homo sapiens
aacuauuacaccaaaua

SEQ ID NO: 1276781 - RNA, 21 nt, Homo sapiens
aacuauuggagggugggagag

SEQ ID NO: 1276782 - RNA, 15 nt, Homo sapiens
aacuauuuaaaggaa

SEQ ID NO: 1276783 - RNA, 19 nt, Homo sapiens
aacuauuucuacacagugg

SEQ ID NO: 1276784 - RNA, 15 nt, Homo sapiens
aacucaaaaccaucu

SEQ ID NO: 1276785 - RNA, 20 nt, Homo sapiens
aacucaacugggcucugucc

SEQ ID NO: 1276786 - RNA, 16 nt, Homo sapiens
aacucaacuuugacaa

SEQ ID NO: 1276787 - RNA, 13 nt, Homo sapiens
aacucaaugagcu

SEQ ID NO: 1276788 - RNA, 14 nt, Homo sapiens
aacucacugagggu

SEQ ID NO: 1276789 - RNA, 21 nt, Homo sapiens
aacucacugaggguaucugac

SEQ ID NO: 1276790 - RNA, 15 nt, Homo sapiens
aacucacugcucaag

SEQ ID NO: 1276791 - RNA, 18 nt, Homo sapiens
aacuccaccuucccacuu

SEQ ID NO: 1276792 - RNA, 12 nt, Homo sapiens
aacuccaucuca

SEQ ID NO: 1276793 - RNA, 16 nt, Homo sapiens
aacuccuacuaaaucc

SEQ ID NO: 1276794 - RNA, 17 nt, Homo sapiens
aacuccuacuaaauccc

SEQ ID NO: 1276795 - RNA, 18 nt, Homo sapiens
aacuccuacuaaaucccu

SEQ ID NO: 1276796 - RNA, 17 nt, Homo sapiens
aacuccuagguucacuu

SEQ ID NO: 1276797 - RNA, 14 nt, Homo sapiens
aacuccugaccuca

SEQ ID NO: 1276798 - RNA, 22 nt, Homo sapiens
aacuccugauuuuguaguuaau

SEQ ID NO: 1276799 - RNA, 16 nt, Homo sapiens
aacuccuuggccuagc

SEQ ID NO: 1276800 - RNA, 20 nt, Homo sapiens
aacucuacuauccaauaugg

SEQ ID NO: 1276801 - RNA, 20 nt, Homo sapiens
aacucuauaaccucagcuuu

SEQ ID NO: 1276802 - RNA, 13 nt, Homo sapiens
aacucucaagugu

SEQ ID NO: 1276803 - RNA, 13 nt, Homo sapiens
aacucucauuucu

SEQ ID NO: 1276804 - RNA, 20 nt, Homo sapiens
aacucucugguuuacuucaa

SEQ ID NO: 1276805 - RNA, 22 nt, Homo sapiens
aacucugaaagagaaaucaaug

SEQ ID NO: 1276806 - RNA, 23 nt, Homo sapiens
aacucugcuugauuuuugccucu

SEQ ID NO: 1276807 - RNA, 18 nt, Homo sapiens
aacucugggcugccaugu

SEQ ID NO: 1276808 - RNA, 16 nt, Homo sapiens
aacucuucagugcaaa

SEQ ID NO: 1276809 - RNA, 14 nt, Homo sapiens
aacucuugaccuca

SEQ ID NO: 1276810 - RNA, 15 nt, Homo sapiens
aacucuugugaauua

SEQ ID NO: 1276811 - RNA, 16 nt, Homo sapiens
aacugaaaauggaccu

SEQ ID NO: 1276812 - RNA, 14 nt, Homo sapiens
aacugaaagcacua

SEQ ID NO: 1276813 - RNA, 14 nt, Homo sapiens
aacugaacucacuu

SEQ ID NO: 1276814 - RNA, 19 nt, Homo sapiens
aacugacaguaaaucucac

SEQ ID NO: 1276815 - RNA, 18 nt, Homo sapiens
aacugagaccuccagaaa

SEQ ID NO: 1276816 - RNA, 21 nt, Homo sapiens
aacugagauuacaggcaccca

SEQ ID NO: 1276817 - RNA, 21 nt, Homo sapiens
aacugauuuuuagcuuuacaa

SEQ ID NO: 1276818 - RNA, 16 nt, Homo sapiens
aacugcacauugguca

SEQ ID NO: 1276819 - RNA, 21 nt, Homo sapiens
aacugccauuauuuucuguca

SEQ ID NO: 1276820 - RNA, 17 nt, Homo sapiens
aacugcguggugcucuu

SEQ ID NO: 1276821 - RNA, 22 nt, Homo sapiens
aacugcugcugugcacauuuau

SEQ ID NO: 1276822 - RNA, 17 nt, Homo sapiens
aacuggaagaaagcaac

SEQ ID NO: 1276823 - RNA, 19 nt, Homo sapiens
aacuggauugcagacuguu

SEQ ID NO: 1276824 - RNA, 19 nt, Homo sapiens
aacugggccuguugcccuu

SEQ ID NO: 1276825 - RNA, 23 nt, Homo sapiens
aacuggggaaugggguauggaag

SEQ ID NO: 1276826 - RNA, 19 nt, Homo sapiens
aacuggguacuuguggaca

SEQ ID NO: 1276827 - RNA, 20 nt, Homo sapiens
aagacuuccucaugaaucuc

SEQ ID NO: 1276828 - RNA, 23 nt, Homo sapiens
aagacuuugauccaggugccaag

SEQ ID NO: 1276829 - RNA, 16 nt, Homo sapiens
aagagaagagggccca

SEQ ID NO: 1276830 - RNA, 19 nt, Homo sapiens
aagagacuacagagucaaa

SEQ ID NO: 1276831 - RNA, 21 nt, Homo sapiens
aagagagaacaacuacuguga

SEQ ID NO: 1276832 - RNA, 16 nt, Homo sapiens
aagagaucuuucuuuc

SEQ ID NO: 1276833 - RNA, 19 nt, Homo sapiens
aagagaucuuucuuuccaa

SEQ ID NO: 1276834 - RNA, 22 nt, Homo sapiens
aagagaugggccuuuucuugaa

SEQ ID NO: 1276835 - RNA, 21 nt, Homo sapiens
aagagcaaacaaaaguucugc

SEQ ID NO: 1276836 - RNA, 18 nt, Homo sapiens
aagagcauggaugcauuu

SEQ ID NO: 1276837 - RNA, 18 nt, Homo sapiens
aagagcguagacaggugu

SEQ ID NO: 1276838 - RNA, 22 nt, Homo sapiens
aagagcuaaguucuaaguucau

SEQ ID NO: 1276839 - RNA, 13 nt, Homo sapiens
aagagcugaccca

SEQ ID NO: 1276840 - RNA, 18 nt, Homo sapiens
aagagcuuuccuucucca

SEQ ID NO: 1276841 - RNA, 23 nt, Homo sapiens
aagagcuuugugauauacugguu

SEQ ID NO: 1276842 - RNA, 14 nt, Homo sapiens
aagaggaaagggag

SEQ ID NO: 1276843 - RNA, 14 nt, Homo sapiens
aagaggaacagcac

SEQ ID NO: 1276844 - RNA, 13 nt, Homo sapiens
aagaggacugugu

SEQ ID NO: 1276845 - RNA, 22 nt, Homo sapiens
aagaggagcacuuccaaaauuc

SEQ ID NO: 1276846 - RNA, 12 nt, Homo sapiens
aagagggaacaa

SEQ ID NO: 1276847 - RNA, 17 nt, Homo sapiens
aagagggaacuuagcag

SEQ ID NO: 1276848 - RNA, 23 nt, Homo sapiens
aagaggguccuuuaguaccugaa

SEQ ID NO: 1276849 - RNA, 17 nt, Homo sapiens
aagagguaaaaaacugu

SEQ ID NO: 1276850 - RNA, 22 nt, Homo sapiens
aagaguacagaagcuuuagcaa

SEQ ID NO: 1276851 - RNA, 22 nt, Homo sapiens
aagagucaacaggucacuugau

SEQ ID NO: 1276852 - RNA, 15 nt, Homo sapiens
aagagugagagggca

SEQ ID NO: 1276853 - RNA, 21 nt, Homo sapiens
aagagugggggagagcaggcu

SEQ ID NO: 1276854 - RNA, 14 nt, Homo sapiens
aagaguuacuuaau

SEQ ID NO: 1276855 - RNA, 22 nt, Homo sapiens
aagaguucccuugaaacuuugg

SEQ ID NO: 1276856 - RNA, 18 nt, Homo sapiens
aagauaaaagaauggcca

SEQ ID NO: 1276857 - RNA, 14 nt, Homo sapiens
aagauaaaugugcu

SEQ ID NO: 1276858 - RNA, 19 nt, Homo sapiens
aagauaacaagaucuuuca

SEQ ID NO: 1276859 - RNA, 15 nt, Homo sapiens
aagauaauuuacuua

SEQ ID NO: 1276860 - RNA, 12 nt, Homo sapiens
aagauacagugu

SEQ ID NO: 1276861 - RNA, 19 nt, Homo sapiens
aagauaccaaaaccacagu

SEQ ID NO: 1276862 - RNA, 18 nt, Homo sapiens
aagauaccggugcuucug

SEQ ID NO: 1276863 - RNA, 15 nt, Homo sapiens
aagauagacaucaga

SEQ ID NO: 1276864 - RNA, 16 nt, Homo sapiens
aagauaguuuucuccu

SEQ ID NO: 1276865 - RNA, 19 nt, Homo sapiens
aagauauauuucacuuuug

SEQ ID NO: 1276866 - RNA, 17 nt, Homo sapiens
aagaugaccuuugucuc

SEQ ID NO: 1276867 - RNA, 23 nt, Homo sapiens
aagaugaccuuugucucaccuca

SEQ ID NO: 1276868 - RNA, 13 nt, Homo sapiens
aagaugcacugaa

SEQ ID NO: 1276869 - RNA, 14 nt, Homo sapiens
aagaugcacugaaa

SEQ ID NO: 1276870 - RNA, 22 nt, Homo sapiens
aagaugcuguaguaacugccuc

SEQ ID NO: 1276871 - RNA, 20 nt, Homo sapiens
aagauggauguaaugcacuu

SEQ ID NO: 1276872 - RNA, 20 nt, Homo sapiens
aagauggccuuugcuuauga

SEQ ID NO: 1276873 - RNA, 22 nt, Homo sapiens
aagaugguauauuugguacugu

SEQ ID NO: 1276874 - RNA, 14 nt, Homo sapiens
aagauguacuugug

SEQ ID NO: 1276875 - RNA, 17 nt, Homo sapiens
aagauguauccuuccaa

SEQ ID NO: 1276876 - RNA, 18 nt, Homo sapiens
aagaugucacaagggauu

SEQ ID NO: 1276877 - RNA, 17 nt, Homo sapiens
aagaugucuauguagcu

SEQ ID NO: 1276878 - RNA, 22 nt, Homo sapiens
aagauguuuacucauugccccc

SEQ ID NO: 1276879 - RNA, 14 nt, Homo sapiens
aagauuaaaugugu

SEQ ID NO: 1276880 - RNA, 19 nt, Homo sapiens
aagauucacaccugacucu

SEQ ID NO: 1276881 - RNA, 15 nt, Homo sapiens
aagauucaccugaga

SEQ ID NO: 1276882 - RNA, 16 nt, Homo sapiens
aagauucuacuuggug

SEQ ID NO: 1276883 - RNA, 14 nt, Homo sapiens
aagauugcugaaaa

SEQ ID NO: 1276884 - RNA, 14 nt, Homo sapiens
aagauuuucuauua

SEQ ID NO: 1276885 - RNA, 19 nt, Homo sapiens
aagauuuugaaugcuuccu

SEQ ID NO: 1276886 - RNA, 17 nt, Homo sapiens
aagauuuugcaccugua

SEQ ID NO: 1276887 - RNA, 21 nt, Homo sapiens
aagcaaaaaaugaaugucuaa

SEQ ID NO: 1276888 - RNA, 14 nt, Homo sapiens
aagcaaaagcaagg

SEQ ID NO: 1276889 - RNA, 14 nt, Homo sapiens
aagcaaaaugcuuc

SEQ ID NO: 1276890 - RNA, 12 nt, Homo sapiens
aagcaacaaaga

SEQ ID NO: 1276891 - RNA, 20 nt, Homo sapiens
aagcaagacuguugcucaaa

SEQ ID NO: 1276892 - RNA, 19 nt, Homo sapiens
aagcaaguguucacaacag

SEQ ID NO: 1276893 - RNA, 21 nt, Homo sapiens
aagcaaguuucaucagucaau

SEQ ID NO: 1276894 - RNA, 18 nt, Homo sapiens
aagcaaguuuucuuccau

SEQ ID NO: 1276895 - RNA, 16 nt, Homo sapiens
aagcaauacuguuucc

SEQ ID NO: 1276896 - RNA, 11 nt, Homo sapiens
aagcaaugugg

SEQ ID NO: 1276897 - RNA, 15 nt, Homo sapiens
aagcacaaagccauu

SEQ ID NO: 1276898 - RNA, 16 nt, Homo sapiens
aagcacaacucccuua

SEQ ID NO: 1276899 - RNA, 12 nt, Homo sapiens
aagcacaagcag

SEQ ID NO: 1276900 - RNA, 15 nt, Homo sapiens
aagcacaaguacuuu

SEQ ID NO: 1276901 - RNA, 15 nt, Homo sapiens
aagcacaguuugaac

SEQ ID NO: 1276902 - RNA, 23 nt, Homo sapiens
aagcaccuagccucgcucuuggc

SEQ ID NO: 1276903 - RNA, 19 nt, Homo sapiens
aagcaccugcaugugcugu

SEQ ID NO: 1276904 - RNA, 20 nt, Homo sapiens
aagcaccuuccccuccauuc

SEQ ID NO: 1276905 - RNA, 22 nt, Homo sapiens
aagcacugaaaaacaacaacac

SEQ ID NO: 1276906 - RNA, 12 nt, Homo sapiens
aagcacugugcu

SEQ ID NO: 1276907 - RNA, 20 nt, Homo sapiens
aagcacuuacaccaguuuga

SEQ ID NO: 1276908 - RNA, 17 nt, Homo sapiens
aagcacuuuaagaauau

SEQ ID NO: 1276909 - RNA, 15 nt, Homo sapiens
aagcagacagucaca

SEQ ID NO: 1276910 - RNA, 20 nt, Homo sapiens
aagcagacccaccucccagc

SEQ ID NO: 1276911 - RNA, 19 nt, Homo sapiens
aagcagauuuauuuuugaa

SEQ ID NO: 1276912 - RNA, 21 nt, Homo sapiens
aagcagauuucugcuuccuuu

SEQ ID NO: 1276913 - RNA, 16 nt, Homo sapiens
aagcagcaacagcaaa

SEQ ID NO: 1276914 - RNA, 14 nt, Homo sapiens
aagcagcgggcuaa

SEQ ID NO: 1276915 - RNA, 19 nt, Homo sapiens
aagcagcuuuuuauucccu

SEQ ID NO: 1276916 - RNA, 14 nt, Homo sapiens
aagcaggugcuaca

SEQ ID NO: 1276917 - RNA, 19 nt, Homo sapiens
aagcaguaagcuaucuuca

SEQ ID NO: 1276918 - RNA, 21 nt, Homo sapiens
aagcagucaauuuucacauca

SEQ ID NO: 1276919 - RNA, 21 nt, Homo sapiens
aagcagugccucgaggcaccg

SEQ ID NO: 1276920 - RNA, 13 nt, Homo sapiens
aagcauacuucua

SEQ ID NO: 1276921 - RNA, 14 nt, Homo sapiens
aagcauacuugaca

SEQ ID NO: 1276922 - RNA, 16 nt, Homo sapiens
aagcaucaccucaggc

SEQ ID NO: 1276923 - RNA, 24 nt, Homo sapiens
aagcaucucagccuaccaugagaa

SEQ ID NO: 1276924 - RNA, 15 nt, Homo sapiens
aagcaucuggcucua

SEQ ID NO: 1276925 - RNA, 22 nt, Homo sapiens
aagcaucuguagugacccacug

SEQ ID NO: 1276926 - RNA, 10 nt, Homo sapiens
aagcauucuu

SEQ ID NO: 1276927 - RNA, 17 nt, Homo sapiens
aagcauugacuugccgu

SEQ ID NO: 1276928 - RNA, 14 nt, Homo sapiens
aagcauuuacuuug

SEQ ID NO: 1276929 - RNA, 20 nt, Homo sapiens
aagcauuugcaacagcuaca

SEQ ID NO: 1276930 - RNA, 19 nt, Homo sapiens
aagcauuuugaaacauaca

SEQ ID NO: 1276931 - RNA, 14 nt, Homo sapiens
aagccaagcaaacc

SEQ ID NO: 1276932 - RNA, 17 nt, Homo sapiens
aagccacaagucuucca

SEQ ID NO: 1276933 - RNA, 18 nt, Homo sapiens
aagccacaagucuuccag

SEQ ID NO: 1276934 - RNA, 16 nt, Homo sapiens
aagccagcugcagcug

SEQ ID NO: 1276935 - RNA, 17 nt, Homo sapiens
aagccaggaccugcugu

SEQ ID NO: 1276936 - RNA, 23 nt, Homo sapiens
aagccagguuacauucuaaaaau

SEQ ID NO: 1276937 - RNA, 13 nt, Homo sapiens
aagccaguuuuca

SEQ ID NO: 1276938 - RNA, 16 nt, Homo sapiens
aagccaugugccagau

SEQ ID NO: 1276939 - RNA, 18 nt, Homo sapiens
aagccauuucugucucca

SEQ ID NO: 1276940 - RNA, 21 nt, Homo sapiens
aagcccaauuuugacccuggu

SEQ ID NO: 1276941 - RNA, 19 nt, Homo sapiens
aagcccacacuaugcacag

SEQ ID NO: 1276942 - RNA, 12 nt, Homo sapiens
aagcccacagca

SEQ ID NO: 1276943 - RNA, 15 nt, Homo sapiens
aagcccacagcacag

SEQ ID NO: 1276944 - RNA, 15 nt, Homo sapiens
aagcccagugcugcu

SEQ ID NO: 1276945 - RNA, 18 nt, Homo sapiens
aagcccaugaguccuuga

SEQ ID NO: 1276946 - RNA, 15 nt, Homo sapiens
aagccccaacgggaa

SEQ ID NO: 1276947 - RNA, 15 nt, Homo sapiens
aagccccacuugaag

SEQ ID NO: 1276948 - RNA, 20 nt, Homo sapiens
aagccccauccaacacugga

SEQ ID NO: 1276949 - RNA, 23 nt, Homo sapiens
aagcccuggagccaacugcugcu

SEQ ID NO: 1276950 - RNA, 15 nt, Homo sapiens
aagcccuuuacuuga

SEQ ID NO: 1276951 - RNA, 13 nt, Homo sapiens
aagcccuuugcca

SEQ ID NO: 1276952 - RNA, 16 nt, Homo sapiens
aagccuaaaugccuua

SEQ ID NO: 1276953 - RNA, 15 nt, Homo sapiens
aagccuaagaaucuu

SEQ ID NO: 1276954 - RNA, 19 nt, Homo sapiens
aagguguuuuccugaagaa

SEQ ID NO: 1276955 - RNA, 22 nt, Homo sapiens
aagguugcugaggcucugaccc

SEQ ID NO: 1276956 - RNA, 21 nt, Homo sapiens
aagguuggcccccacgugggg

SEQ ID NO: 1276957 - RNA, 19 nt, Homo sapiens
aagguuggugaauuucaca

SEQ ID NO: 1276958 - RNA, 21 nt, Homo sapiens
aaguaacugugagaacccagu

SEQ ID NO: 1276959 - RNA, 12 nt, Homo sapiens
aaguaagccaug

SEQ ID NO: 1276960 - RNA, 22 nt, Homo sapiens
aaguaagccauguaucucagga

SEQ ID NO: 1276961 - RNA, 13 nt, Homo sapiens
aaguaaugaauuu

SEQ ID NO: 1276962 - RNA, 24 nt, Homo sapiens
aaguaauuccuguauucuacagca

SEQ ID NO: 1276963 - RNA, 20 nt, Homo sapiens
aaguaccacacauauugcac

SEQ ID NO: 1276964 - RNA, 14 nt, Homo sapiens
aaguaccacacuga

SEQ ID NO: 1276965 - RNA, 16 nt, Homo sapiens
aaguaccacacugagu

SEQ ID NO: 1276966 - RNA, 13 nt, Homo sapiens
aaguacccuuuug

SEQ ID NO: 1276967 - RNA, 15 nt, Homo sapiens
aaguacuacagcaaa

SEQ ID NO: 1276968 - RNA, 22 nt, Homo sapiens
aaguacuguaauaauaccucaa

SEQ ID NO: 1276969 - RNA, 12 nt, Homo sapiens
aaguacuuucuu

SEQ ID NO: 1276970 - RNA, 20 nt, Homo sapiens
aaguagaagucauauguugu

SEQ ID NO: 1276971 - RNA, 13 nt, Homo sapiens
aaguagaggaauc

SEQ ID NO: 1276972 - RNA, 17 nt, Homo sapiens
aaguagcacccuggauu

SEQ ID NO: 1276973 - RNA, 19 nt, Homo sapiens
aaguaggugugacuugaac

SEQ ID NO: 1276974 - RNA, 15 nt, Homo sapiens
aaguauacaguucaa

SEQ ID NO: 1276975 - RNA, 19 nt, Homo sapiens
aaguauauaauccugugaa

SEQ ID NO: 1276976 - RNA, 19 nt, Homo sapiens
aaguauaucuuuaauucug

SEQ ID NO: 1276977 - RNA, 16 nt, Homo sapiens
aaguaucacacuguau

SEQ ID NO: 1276978 - RNA, 17 nt, Homo sapiens
aaguaucacacuguaua

SEQ ID NO: 1276979 - RNA, 16 nt, Homo sapiens
aaguaucacucuaaaa

SEQ ID NO: 1276980 - RNA, 10 nt, Homo sapiens
aaguauuuaa

SEQ ID NO: 1276981 - RNA, 22 nt, Homo sapiens
aaguauuugcuuaaaauuguga

SEQ ID NO: 1276982 - RNA, 12 nt, Homo sapiens
aagucacacagu

SEQ ID NO: 1276983 - RNA, 21 nt, Homo sapiens
aagucaccacuccauucccaa

SEQ ID NO: 1276984 - RNA, 18 nt, Homo sapiens
aagucaccggagcuuuca

SEQ ID NO: 1276985 - RNA, 14 nt, Homo sapiens
aagucacugacccu

SEQ ID NO: 1276986 - RNA, 13 nt, Homo sapiens
aagucacugcaca

SEQ ID NO: 1276987 - RNA, 13 nt, Homo sapiens
aagucagcuuuca

SEQ ID NO: 1276988 - RNA, 22 nt, Homo sapiens
aagucaucuguuuaauuuacac

SEQ ID NO: 1276989 - RNA, 15 nt, Homo sapiens
aagucaucuugcuac

SEQ ID NO: 1276990 - RNA, 14 nt, Homo sapiens
aagucaugccugag

SEQ ID NO: 1276991 - RNA, 15 nt, Homo sapiens
aaguccaauuccaaa

SEQ ID NO: 1276992 - RNA, 17 nt, Homo sapiens
aaguccaauuccaaagc

SEQ ID NO: 1276993 - RNA, 19 nt, Homo sapiens
aaguccagagcuggaucuc

SEQ ID NO: 1276994 - RNA, 22 nt, Homo sapiens
aaguccagcugggaagcccuuu

SEQ ID NO: 1276995 - RNA, 13 nt, Homo sapiens
aaguccuuuaugu

SEQ ID NO: 1276996 - RNA, 16 nt, Homo sapiens
aagucugcuacccuca

SEQ ID NO: 1276997 - RNA, 14 nt, Homo sapiens
aagucuuccaugac

SEQ ID NO: 1276998 - RNA, 15 nt, Homo sapiens
aagucuuccaugacc

SEQ ID NO: 1276999 - RNA, 16 nt, Homo sapiens
aagucuuccaugaccc

SEQ ID NO: 1277000 - RNA, 18 nt, Homo sapiens
aagucuuuacucugacuu

SEQ ID NO: 1277001 - RNA, 11 nt, Homo sapiens
aagucuuucau

SEQ ID NO: 1277002 - RNA, 13 nt, Homo sapiens
aagugacacagca

SEQ ID NO: 1277003 - RNA, 19 nt, Homo sapiens
aagugagaaaaugccucaa

SEQ ID NO: 1277004 - RNA, 22 nt, Homo sapiens
aagugagagagacaagaagcaa

SEQ ID NO: 1277005 - RNA, 22 nt, Homo sapiens
aagugaggagaaugaaauguau

SEQ ID NO: 1277006 - RNA, 15 nt, Homo sapiens
aagugauacuaucca

SEQ ID NO: 1277007 - RNA, 17 nt, Homo sapiens
aagugauaugcauuucc

SEQ ID NO: 1277008 - RNA, 20 nt, Homo sapiens
aagugauccucccaccucag

SEQ ID NO: 1277009 - RNA, 10 nt, Homo sapiens
aagugccuua

SEQ ID NO: 1277010 - RNA, 14 nt, Homo sapiens
aagugcuccugaaa

SEQ ID NO: 1277011 - RNA, 20 nt, Homo sapiens
aagugcugcgauuacaggca

SEQ ID NO: 1277012 - RNA, 13 nt, Homo sapiens
aagugcuguggcu

SEQ ID NO: 1277013 - RNA, 11 nt, Homo sapiens
aagugcuguuu

SEQ ID NO: 1277014 - RNA, 23 nt, Homo sapiens
acaacagugcuuuguaaauugug

SEQ ID NO: 1277015 - RNA, 18 nt, Homo sapiens
acaacauccauguccuau

SEQ ID NO: 1277016 - RNA, 19 nt, Homo sapiens
acaacauccuuaagucaaa

SEQ ID NO: 1277017 - RNA, 18 nt, Homo sapiens
acaaccaucccugccaca

SEQ ID NO: 1277018 - RNA, 15 nt, Homo sapiens
acaaccucauccagg

SEQ ID NO: 1277019 - RNA, 14 nt, Homo sapiens
acaacgaugaugcu

SEQ ID NO: 1277020 - RNA, 15 nt, Homo sapiens
acaacgccuggugcc

SEQ ID NO: 1277021 - RNA, 19 nt, Homo sapiens
acaacuguggacuccaguu

SEQ ID NO: 1277022 - RNA, 12 nt, Homo sapiens
acaacugugguc

SEQ ID NO: 1277023 - RNA, 21 nt, Homo sapiens
acaacuucaguccaacuguca

SEQ ID NO: 1277024 - RNA, 16 nt, Homo sapiens
acaacuuguauuucca

SEQ ID NO: 1277025 - RNA, 20 nt, Homo sapiens
acaagaacuuuaaauugugu

SEQ ID NO: 1277026 - RNA, 22 nt, Homo sapiens
acaagaagccacagaccuagga

SEQ ID NO: 1277027 - RNA, 23 nt, Homo sapiens
acaagaaucagucuauccacaga

SEQ ID NO: 1277028 - RNA, 14 nt, Homo sapiens
acaagacauugugu

SEQ ID NO: 1277029 - RNA, 19 nt, Homo sapiens
acaagacccccagcacuug

SEQ ID NO: 1277030 - RNA, 22 nt, Homo sapiens
acaagagcuuugguaaucucug

SEQ ID NO: 1277031 - RNA, 19 nt, Homo sapiens
acaagagugaauuugaccu

SEQ ID NO: 1277032 - RNA, 15 nt, Homo sapiens
acaagauaccaaggc

SEQ ID NO: 1277033 - RNA, 23 nt, Homo sapiens
acaagauaccaaggcaaacccua

SEQ ID NO: 1277034 - RNA, 14 nt, Homo sapiens
acaagauaccggug

SEQ ID NO: 1277035 - RNA, 19 nt, Homo sapiens
acaagauccuuaaugcaga

SEQ ID NO: 1277036 - RNA, 12 nt, Homo sapiens
acaagauugaaa

SEQ ID NO: 1277037 - RNA, 20 nt, Homo sapiens
acaagauuugcugcauuucc

SEQ ID NO: 1277038 - RNA, 16 nt, Homo sapiens
acaagcaacaaaccuc

SEQ ID NO: 1277039 - RNA, 11 nt, Homo sapiens
acaagcagcug

SEQ ID NO: 1277040 - RNA, 19 nt, Homo sapiens
acaagcagcuggugcucca

SEQ ID NO: 1277041 - RNA, 19 nt, Homo sapiens
acaagccacaagucuucca

SEQ ID NO: 1277042 - RNA, 17 nt, Homo sapiens
acaagccagucugccuc

SEQ ID NO: 1277043 - RNA, 19 nt, Homo sapiens
acaagcccguuagccccag

SEQ ID NO: 1277044 - RNA, 19 nt, Homo sapiens
acaagcgaaucucugccuu

SEQ ID NO: 1277045 - RNA, 21 nt, Homo sapiens
acaagcugacuuggcacuuaa

SEQ ID NO: 1277046 - RNA, 20 nt, Homo sapiens
acaaggaggaguuccaccau

SEQ ID NO: 1277047 - RNA, 16 nt, Homo sapiens
acaaggcuccaagacc

SEQ ID NO: 1277048 - RNA, 18 nt, Homo sapiens
acaaggcuccaagaccua

SEQ ID NO: 1277049 - RNA, 17 nt, Homo sapiens
acaagggcaggucuuca

SEQ ID NO: 1277050 - RNA, 22 nt, Homo sapiens
acaaggggcuccacaccuuugc

SEQ ID NO: 1277051 - RNA, 19 nt, Homo sapiens
acaagguugguugcuaaga

SEQ ID NO: 1277052 - RNA, 16 nt, Homo sapiens
acaaguaaaacugugg

SEQ ID NO: 1277053 - RNA, 17 nt, Homo sapiens
acaaguaaaacuguggu

SEQ ID NO: 1277054 - RNA, 18 nt, Homo sapiens
acaaguauggcuccucca

SEQ ID NO: 1277055 - RNA, 23 nt, Homo sapiens
acaagugccuccuggacuguuca

SEQ ID NO: 1277056 - RNA, 18 nt, Homo sapiens
acaaguuuuaauccagaa

SEQ ID NO: 1277057 - RNA, 21 nt, Homo sapiens
acaauaaacgguacuugucau

SEQ ID NO: 1277058 - RNA, 16 nt, Homo sapiens
acaauaaagcaaugug

SEQ ID NO: 1277059 - RNA, 21 nt, Homo sapiens
acaauaaauguauucaaauac

SEQ ID NO: 1277060 - RNA, 13 nt, Homo sapiens
acaauaaauuauu

SEQ ID NO: 1277061 - RNA, 22 nt, Homo sapiens
acaauaagccacgaggugcagu

SEQ ID NO: 1277062 - RNA, 18 nt, Homo sapiens
acaauacagauaacauua

SEQ ID NO: 1277063 - RNA, 12 nt, Homo sapiens
acaauacaguaa

SEQ ID NO: 1277064 - RNA, 13 nt, Homo sapiens
acaauaguauuuc

SEQ ID NO: 1277065 - RNA, 18 nt, Homo sapiens
acaauagugauugauaga

SEQ ID NO: 1277066 - RNA, 16 nt, Homo sapiens
acaauauacuuguaua

SEQ ID NO: 1277067 - RNA, 21 nt, Homo sapiens
acaauauuccagaucuuucag

SEQ ID NO: 1277068 - RNA, 22 nt, Homo sapiens
acaaucaaaucuccugcugauu

SEQ ID NO: 1277069 - RNA, 15 nt, Homo sapiens
acaaucagcagucua

SEQ ID NO: 1277070 - RNA, 18 nt, Homo sapiens
acaaucaugaaauaugca

SEQ ID NO: 1277071 - RNA, 20 nt, Homo sapiens
acaaucaugaacagcucuga

SEQ ID NO: 1277072 - RNA, 22 nt, Homo sapiens
acaaucaugaacagcucugaga

SEQ ID NO: 1277073 - RNA, 22 nt, Homo sapiens
acaaucaugagucagacauuug

SEQ ID NO: 1277074 - RNA, 14 nt, Homo sapiens
acaaucccaccuag

SEQ ID NO: 1277075 - RNA, 15 nt, Homo sapiens
acaaucuguaauugc

SEQ ID NO: 1277076 - RNA, 17 nt, Homo sapiens
acaaucuuugcuguaua

SEQ ID NO: 1277077 - RNA, 23 nt, Homo sapiens
acaaucuuugcuguauacuuuua

SEQ ID NO: 1277078 - RNA, 15 nt, Homo sapiens
acaaugaacacuuau

SEQ ID NO: 1277079 - RNA, 22 nt, Homo sapiens
acaaugacugcuuuguuuggau

SEQ ID NO: 1277080 - RNA, 12 nt, Homo sapiens
acaaugauccag

SEQ ID NO: 1277081 - RNA, 11 nt, Homo sapiens
acaaugcauuu

SEQ ID NO: 1277082 - RNA, 15 nt, Homo sapiens
acaaugcugagguua

SEQ ID NO: 1277083 - RNA, 18 nt, Homo sapiens
acaaugcugagguuauga

SEQ ID NO: 1277084 - RNA, 20 nt, Homo sapiens
acaaugugugggauaauguc

SEQ ID NO: 1277085 - RNA, 13 nt, Homo sapiens
acaauucuuuaaa

SEQ ID NO: 1277086 - RNA, 20 nt, Homo sapiens
acaauuguguauaacuggau

SEQ ID NO: 1277087 - RNA, 22 nt, Homo sapiens
acaauuuccuggguuccaccaa

SEQ ID NO: 1277088 - RNA, 21 nt, Homo sapiens
acaauuucucauacuuagaaa

SEQ ID NO: 1277089 - RNA, 15 nt, Homo sapiens
acacaaaccagacag

SEQ ID NO: 1277090 - RNA, 15 nt, Homo sapiens
acacaaauuuguaaa

SEQ ID NO: 1277091 - RNA, 19 nt, Homo sapiens
acacaagcccacagcacag

SEQ ID NO: 1277092 - RNA, 17 nt, Homo sapiens
acacaauuaauucaucc

SEQ ID NO: 1277093 - RNA, 12 nt, Homo sapiens
acacacacaaac

SEQ ID NO: 1277094 - RNA, 16 nt, Homo sapiens
acacacacacacaucc

SEQ ID NO: 1277095 - RNA, 20 nt, Homo sapiens
acagacauacauuuaugcac

SEQ ID NO: 1277096 - RNA, 14 nt, Homo sapiens
acagacaugaacug

SEQ ID NO: 1277097 - RNA, 13 nt, Homo sapiens
acagaccacagag

SEQ ID NO: 1277098 - RNA, 16 nt, Homo sapiens
acagaccacuugccac

SEQ ID NO: 1277099 - RNA, 18 nt, Homo sapiens
acagacccaggucuucca

SEQ ID NO: 1277100 - RNA, 12 nt, Homo sapiens
acagacgugugc

SEQ ID NO: 1277101 - RNA, 13 nt, Homo sapiens
acagacuggcaau

SEQ ID NO: 1277102 - RNA, 15 nt, Homo sapiens
acagacuggcaauaa

SEQ ID NO: 1277103 - RNA, 16 nt, Homo sapiens
acagacuggcaauaaa

SEQ ID NO: 1277104 - RNA, 23 nt, Homo sapiens
acagacuggcaauaaacuccuac

SEQ ID NO: 1277105 - RNA, 21 nt, Homo sapiens
acagacuggcuccaacacugc

SEQ ID NO: 1277106 - RNA, 23 nt, Homo sapiens
acagacuuccucuuucuaagauu

SEQ ID NO: 1277107 - RNA, 20 nt, Homo sapiens
acagagagacagacuugaga

SEQ ID NO: 1277108 - RNA, 13 nt, Homo sapiens
acagagaguccca

SEQ ID NO: 1277109 - RNA, 21 nt, Homo sapiens
acagagaucccacacuacuuc

SEQ ID NO: 1277110 - RNA, 14 nt, Homo sapiens
acagagcuccuggc

SEQ ID NO: 1277111 - RNA, 19 nt, Homo sapiens
acagagcucuccagcucca

SEQ ID NO: 1277112 - RNA, 22 nt, Homo sapiens
acagagcucuccagcuccaaga

SEQ ID NO: 1277113 - RNA, 15 nt, Homo sapiens
acagaggucucugcc

SEQ ID NO: 1277114 - RNA, 16 nt, Homo sapiens
acagaguagaaacuca

SEQ ID NO: 1277115 - RNA, 21 nt, Homo sapiens
acagagucccuggcuccucua

SEQ ID NO: 1277116 - RNA, 17 nt, Homo sapiens
acagagugcauugugag

SEQ ID NO: 1277117 - RNA, 14 nt, Homo sapiens
acagaguucacuau

SEQ ID NO: 1277118 - RNA, 18 nt, Homo sapiens
acagauaucagugucucc

SEQ ID NO: 1277119 - RNA, 12 nt, Homo sapiens
acagaugaaggu

SEQ ID NO: 1277120 - RNA, 19 nt, Homo sapiens
acagaugcaaugugcuacu

SEQ ID NO: 1277121 - RNA, 14 nt, Homo sapiens
acagauucuuucag

SEQ ID NO: 1277122 - RNA, 13 nt, Homo sapiens
acagcaaaaccau

SEQ ID NO: 1277123 - RNA, 14 nt, Homo sapiens
acagcaaaagaaga

SEQ ID NO: 1277124 - RNA, 20 nt, Homo sapiens
acagcaaacccugaugugac

SEQ ID NO: 1277125 - RNA, 13 nt, Homo sapiens
acagcaacaauga

SEQ ID NO: 1277126 - RNA, 23 nt, Homo sapiens
acagcaaccucuucaugagcuug

SEQ ID NO: 1277127 - RNA, 18 nt, Homo sapiens
acagcaagacuccgucuc

SEQ ID NO: 1277128 - RNA, 19 nt, Homo sapiens
acagcaagacuccgucuca

SEQ ID NO: 1277129 - RNA, 21 nt, Homo sapiens
acagcacuggggagucuuugu

SEQ ID NO: 1277130 - RNA, 12 nt, Homo sapiens
acagcacuuuga

SEQ ID NO: 1277131 - RNA, 17 nt, Homo sapiens
acagcagagaagcugua

SEQ ID NO: 1277132 - RNA, 13 nt, Homo sapiens
acagcagcacugu

SEQ ID NO: 1277133 - RNA, 15 nt, Homo sapiens
acagcagcaucuuca

SEQ ID NO: 1277134 - RNA, 23 nt, Homo sapiens
uuuaguauagccacaaaugccuu

SEQ ID NO: 1277135 - RNA, 15 nt, Homo sapiens
uuuagucaugugacc

SEQ ID NO: 1277136 - RNA, 14 nt, Homo sapiens
uuuaguucagugac

SEQ ID NO: 1277137 - RNA, 16 nt, Homo sapiens
uuuaguuuugauuuug

SEQ ID NO: 1277138 - RNA, 22 nt, Homo sapiens
uuuauaaaaaugagugcuuaaa

SEQ ID NO: 1277139 - RNA, 21 nt, Homo sapiens
uuuauaacuauuauauuauca

SEQ ID NO: 1277140 - RNA, 16 nt, Homo sapiens
uuuauaagagugccgu

SEQ ID NO: 1277141 - RNA, 14 nt, Homo sapiens
uuuauaauacccuu

SEQ ID NO: 1277142 - RNA, 10 nt, Homo sapiens
uuuauacaau

SEQ ID NO: 1277143 - RNA, 15 nt, Homo sapiens
uuuauacaauguucu

SEQ ID NO: 1277144 - RNA, 12 nt, Homo sapiens
uuuauacuuugc

SEQ ID NO: 1277145 - RNA, 23 nt, Homo sapiens
uuuauagaacauauuuuccuuua

SEQ ID NO: 1277146 - RNA, 23 nt, Homo sapiens
uuuauaguacuaguuuugcuuua

SEQ ID NO: 1277147 - RNA, 14 nt, Homo sapiens
uuuauaucaugcaa

SEQ ID NO: 1277148 - RNA, 19 nt, Homo sapiens
uuuauauguauauaacaaa

SEQ ID NO: 1277149 - RNA, 18 nt, Homo sapiens
uuuauauuuaaauaaagg

SEQ ID NO: 1277150 - RNA, 12 nt, Homo sapiens
uuuaucacugaa

SEQ ID NO: 1277151 - RNA, 20 nt, Homo sapiens
uuuaucaugaagcacaucaa

SEQ ID NO: 1277152 - RNA, 20 nt, Homo sapiens
uuuaucuaaauuaaagccuu

SEQ ID NO: 1277153 - RNA, 18 nt, Homo sapiens
uuuaucugcuaugcuauu

SEQ ID NO: 1277154 - RNA, 14 nt, Homo sapiens
uuuaucugcugaaa

SEQ ID NO: 1277155 - RNA, 11 nt, Homo sapiens
uuuaugaaaug

SEQ ID NO: 1277156 - RNA, 14 nt, Homo sapiens
uuuaugaauaucau

SEQ ID NO: 1277157 - RNA, 13 nt, Homo sapiens
uuuaugaguacuu

SEQ ID NO: 1277158 - RNA, 22 nt, Homo sapiens
uuuaugcagaagcauauuuugc

SEQ ID NO: 1277159 - RNA, 12 nt, Homo sapiens
uuuaugcugcug

SEQ ID NO: 1277160 - RNA, 13 nt, Homo sapiens
uuuauggccucag

SEQ ID NO: 1277161 - RNA, 18 nt, Homo sapiens
uuuaugugcucuccaaau

SEQ ID NO: 1277162 - RNA, 22 nt, Homo sapiens
uuuauuauggcuugugaacugc

SEQ ID NO: 1277163 - RNA, 11 nt, Homo sapiens
uuuauucacau

SEQ ID NO: 1277164 - RNA, 15 nt, Homo sapiens
uuuauugaaugcuua

SEQ ID NO: 1277165 - RNA, 18 nt, Homo sapiens
uuuauuuaagcaucaaau

SEQ ID NO: 1277166 - RNA, 14 nt, Homo sapiens
uuuauuuccacuaa

SEQ ID NO: 1277167 - RNA, 17 nt, Homo sapiens
uuuauuuguaaaccauu

SEQ ID NO: 1277168 - RNA, 19 nt, Homo sapiens
uuuauuuuauagagcagaa

SEQ ID NO: 1277169 - RNA, 20 nt, Homo sapiens
uuuauuuuucucucagugca

SEQ ID NO: 1277170 - RNA, 18 nt, Homo sapiens
uuucaaaaaauuauauga

SEQ ID NO: 1277171 - RNA, 15 nt, Homo sapiens
uuucaaaacacaucu

SEQ ID NO: 1277172 - RNA, 22 nt, Homo sapiens
uuucaaaagguauuauacaugu

SEQ ID NO: 1277173 - RNA, 15 nt, Homo sapiens
uuucaaauuggcacu

SEQ ID NO: 1277174 - RNA, 17 nt, Homo sapiens
uuucaacugugcucuug

SEQ ID NO: 1277175 - RNA, 18 nt, Homo sapiens
uuucaacuucaguacuca

SEQ ID NO: 1277176 - RNA, 13 nt, Homo sapiens
uuucaacuugcau

SEQ ID NO: 1277177 - RNA, 22 nt, Homo sapiens
uuucaaggcacucuagauucca

SEQ ID NO: 1277178 - RNA, 12 nt, Homo sapiens
uuucaagucaaa

SEQ ID NO: 1277179 - RNA, 12 nt, Homo sapiens
uuucaagucucu

SEQ ID NO: 1277180 - RNA, 19 nt, Homo sapiens
uuucaaguguaacuuauua

SEQ ID NO: 1277181 - RNA, 24 nt, Homo sapiens
uuucaaguuauucaaauuuguaca

SEQ ID NO: 1277182 - RNA, 13 nt, Homo sapiens
uuucaaguucaau

SEQ ID NO: 1277183 - RNA, 15 nt, Homo sapiens
uuucaauacugcuga

SEQ ID NO: 1277184 - RNA, 15 nt, Homo sapiens
uuucaaucaacuuua

SEQ ID NO: 1277185 - RNA, 19 nt, Homo sapiens
uuucaaucucugacuaaaa

SEQ ID NO: 1277186 - RNA, 16 nt, Homo sapiens
uuucacacagugaaac

SEQ ID NO: 1277187 - RNA, 19 nt, Homo sapiens
uuucacauacacucaaaca

SEQ ID NO: 1277188 - RNA, 17 nt, Homo sapiens
uuucaccacaugugcac

SEQ ID NO: 1277189 - RNA, 15 nt, Homo sapiens
uuucacccucaugaa

SEQ ID NO: 1277190 - RNA, 13 nt, Homo sapiens
uuucaccuguaaa

SEQ ID NO: 1277191 - RNA, 21 nt, Homo sapiens
uuucaccuguuuuuaagcugu

SEQ ID NO: 1277192 - RNA, 18 nt, Homo sapiens
uuucacuuuuaauuugcu

SEQ ID NO: 1277193 - RNA, 22 nt, Homo sapiens
uuucagaagagacugauccaaa

SEQ ID NO: 1277194 - RNA, 17 nt, Homo sapiens
uuucagagccagugaag

SEQ ID NO: 1277195 - RNA, 23 nt, Homo sapiens
uuucagagugacuacacacagua

SEQ ID NO: 1277196 - RNA, 12 nt, Homo sapiens
uuucagcuaaag

SEQ ID NO: 1277197 - RNA, 20 nt, Homo sapiens
uuucauaaacuucagggauc

SEQ ID NO: 1277198 - RNA, 14 nt, Homo sapiens
uuucauacaacaga

SEQ ID NO: 1277199 - RNA, 13 nt, Homo sapiens
uuucauacacuua

SEQ ID NO: 1277200 - RNA, 11 nt, Homo sapiens
uuucauaccaa

SEQ ID NO: 1277201 - RNA, 15 nt, Homo sapiens
uuucauacuauuuag

SEQ ID NO: 1277202 - RNA, 20 nt, Homo sapiens
uuucauacuguaacauucag

SEQ ID NO: 1277203 - RNA, 16 nt, Homo sapiens
uuucauaucuacagau

SEQ ID NO: 1277204 - RNA, 22 nt, Homo sapiens
uuucauguggcuguagauccca

SEQ ID NO: 1277205 - RNA, 19 nt, Homo sapiens
uuucauguuuuugaucaaa

SEQ ID NO: 1277206 - RNA, 15 nt, Homo sapiens
uuucauucuucucua

SEQ ID NO: 1277207 - RNA, 18 nt, Homo sapiens
uuucauugaugagcaaga

SEQ ID NO: 1277208 - RNA, 22 nt, Homo sapiens
uuucauugccuguguauggaaa

SEQ ID NO: 1277209 - RNA, 12 nt, Homo sapiens
uuucauuucuca

SEQ ID NO: 1277210 - RNA, 14 nt, Homo sapiens
uuucauuugccggg

SEQ ID NO: 1277211 - RNA, 16 nt, Homo sapiens
uuucauuugccuauuc

SEQ ID NO: 1277212 - RNA, 22 nt, Homo sapiens
uuucauuuggaaugaauacagc

SEQ ID NO: 1277213 - RNA, 16 nt, Homo sapiens
uuuccaaaacauuucu

SEQ ID NO: 1277214 - RNA, 14 nt, Homo sapiens
uuuccaaaacuuua

SEQ ID NO: 1277215 - RNA, 21 nt, Homo sapiens
uuuccaaaccuccacugcugc

SEQ ID NO: 1277216 - RNA, 20 nt, Homo sapiens
uuuccaaauauuuugcuuua

SEQ ID NO: 1277217 - RNA, 22 nt, Homo sapiens
uuuccaacuggcacucuguggg

SEQ ID NO: 1277218 - RNA, 20 nt, Homo sapiens
uuuccagaguuugucauuau

SEQ ID NO: 1277219 - RNA, 10 nt, Homo sapiens
uuuccaggga

SEQ ID NO: 1277220 - RNA, 19 nt, Homo sapiens
uuuccagugaguguaaaua

SEQ ID NO: 1277221 - RNA, 19 nt, Homo sapiens
uuuccauauuuuuugcaca

SEQ ID NO: 1277222 - RNA, 17 nt, Homo sapiens
uuuccaucucugguaaa

SEQ ID NO: 1277223 - RNA, 23 nt, Homo sapiens
uuuccauuaaguacaugugccag

SEQ ID NO: 1277224 - RNA, 16 nt, Homo sapiens
uuucccaacauaugcc

SEQ ID NO: 1277225 - RNA, 20 nt, Homo sapiens
uuucccacaucuuuccucaa

SEQ ID NO: 1277226 - RNA, 17 nt, Homo sapiens
uuucccacgaggaaucu

SEQ ID NO: 1277227 - RNA, 21 nt, Homo sapiens
uuucccagucccauuccucag

SEQ ID NO: 1277228 - RNA, 19 nt, Homo sapiens
uuucccaucagacugucaa

SEQ ID NO: 1277229 - RNA, 17 nt, Homo sapiens
uuuccccaaccacagag

SEQ ID NO: 1277230 - RNA, 23 nt, Homo sapiens
uuuccccaccccagcucaugccc

SEQ ID NO: 1277231 - RNA, 14 nt, Homo sapiens
uuuccccagaucaa

SEQ ID NO: 1277232 - RNA, 23 nt, Homo sapiens
uuucccccuccucagauggggca

SEQ ID NO: 1277233 - RNA, 23 nt, Homo sapiens
uuucccugcacccaucugcucac

SEQ ID NO: 1277234 - RNA, 13 nt, Homo sapiens
uuucccuuccagu

SEQ ID NO: 1277235 - RNA, 14 nt, Homo sapiens
uuuccguuuugccu

SEQ ID NO: 1277236 - RNA, 14 nt, Homo sapiens
uuuccucaagcaau

SEQ ID NO: 1277237 - RNA, 16 nt, Homo sapiens
uuuccucaccaggagc

SEQ ID NO: 1277238 - RNA, 16 nt, Homo sapiens
uuuccucagugcauuu

SEQ ID NO: 1277239 - RNA, 22 nt, Homo sapiens
uuuccucagugcauuugugcua

SEQ ID NO: 1277240 - RNA, 12 nt, Homo sapiens
uuuccuccugag

SEQ ID NO: 1277241 - RNA, 12 nt, Homo sapiens
uuuccucugcau

SEQ ID NO: 1277242 - RNA, 23 nt, Homo sapiens
uuuccuguauguuguacaaucaa

SEQ ID NO: 1277243 - RNA, 12 nt, Homo sapiens
uuuccuguucag

SEQ ID NO: 1277244 - RNA, 16 nt, Homo sapiens
uuuccuuaaacugugu

SEQ ID NO: 1277245 - RNA, 19 nt, Homo sapiens
uuuccuuaacgcuagagau

SEQ ID NO: 1277246 - RNA, 15 nt, Homo sapiens
uuuccuuugcuucaa

SEQ ID NO: 1277247 - RNA, 16 nt, Homo sapiens
uuuccuuuuuugucua

SEQ ID NO: 1277248 - RNA, 16 nt, Homo sapiens
uuucgggauucuuuga

SEQ ID NO: 1277249 - RNA, 14 nt, Homo sapiens
uuucuaaacuacaa

SEQ ID NO: 1277250 - RNA, 18 nt, Homo sapiens
uuucuaaaggaugcugcu

SEQ ID NO: 1277251 - RNA, 17 nt, Homo sapiens
uuucuacagugaauuua

SEQ ID NO: 1277252 - RNA, 12 nt, Homo sapiens
uuucuacauaca

SEQ ID NO: 1277253 - RNA, 16 nt, Homo sapiens
uuucuaucacauauuu

SEQ ID NO: 1277254 - RNA, 21 nt, Homo sapiens
uuucuauuauggaaaacugug

SEQ ID NO: 1277255 - RNA, 15 nt, Homo sapiens
uuucucaaaaaccac

SEQ ID NO: 1277256 - RNA, 22 nt, Homo sapiens
uuucucaaaggcccucagugag

SEQ ID NO: 1277257 - RNA, 16 nt, Homo sapiens
uuucuccaggaccaau

SEQ ID NO: 1277258 - RNA, 23 nt, Homo sapiens
uguuauauagggaucaaccagcu

SEQ ID NO: 1277259 - RNA, 17 nt, Homo sapiens
uguuauauucagugugu

SEQ ID NO: 1277260 - RNA, 15 nt, Homo sapiens
uguuaucagucaaua

SEQ ID NO: 1277261 - RNA, 14 nt, Homo sapiens
uguuaucagucaua

SEQ ID NO: 1277262 - RNA, 14 nt, Homo sapiens
uguuaucauagaau

SEQ ID NO: 1277263 - RNA, 18 nt, Homo sapiens
uguuaucuuccacuggaa

SEQ ID NO: 1277264 - RNA, 22 nt, Homo sapiens
uguuaugauuuguaacauucac

SEQ ID NO: 1277265 - RNA, 23 nt, Homo sapiens
uguuauuauauuccguagguaga

SEQ ID NO: 1277266 - RNA, 18 nt, Homo sapiens
uguuauuauuuugcacug

SEQ ID NO: 1277267 - RNA, 19 nt, Homo sapiens
uguuauuugcacacugcac

SEQ ID NO: 1277268 - RNA, 22 nt, Homo sapiens
uguucaauggaugaauuucuaa

SEQ ID NO: 1277269 - RNA, 17 nt, Homo sapiens
uguucaauguuccauuc

SEQ ID NO: 1277270 - RNA, 18 nt, Homo sapiens
uguucacaaacuaccucu

SEQ ID NO: 1277271 - RNA, 19 nt, Homo sapiens
uguucacaacagugaaaag

SEQ ID NO: 1277272 - RNA, 18 nt, Homo sapiens
uguucagaauggauuuau

SEQ ID NO: 1277273 - RNA, 21 nt, Homo sapiens
uguucaguccaacaaaccaca

SEQ ID NO: 1277274 - RNA, 17 nt, Homo sapiens
uguucauccucauugcc

SEQ ID NO: 1277275 - RNA, 24 nt, Homo sapiens
uguucauggguuuaccacuaacuc

SEQ ID NO: 1277276 - RNA, 18 nt, Homo sapiens
uguucauguuacucauga

SEQ ID NO: 1277277 - RNA, 22 nt, Homo sapiens
uguuccagauccuucaaagagu

SEQ ID NO: 1277278 - RNA, 19 nt, Homo sapiens
uguuccucuuggugucaua

SEQ ID NO: 1277279 - RNA, 14 nt, Homo sapiens
uguucuauuguggg

SEQ ID NO: 1277280 - RNA, 22 nt, Homo sapiens
uguucuccuuuggaauggugua

SEQ ID NO: 1277281 - RNA, 16 nt, Homo sapiens
uguucucugaggacac

SEQ ID NO: 1277282 - RNA, 18 nt, Homo sapiens
uguucugcauggauucag

SEQ ID NO: 1277283 - RNA, 20 nt, Homo sapiens
uguucugcugggaguucuag

SEQ ID NO: 1277284 - RNA, 22 nt, Homo sapiens
uguucuguuggaugacuuugag

SEQ ID NO: 1277285 - RNA, 15 nt, Homo sapiens
uguugaaauugucaa

SEQ ID NO: 1277286 - RNA, 19 nt, Homo sapiens
uguugaccuuccuucaaga

SEQ ID NO: 1277287 - RNA, 21 nt, Homo sapiens
uguugagacugauucagagga

SEQ ID NO: 1277288 - RNA, 22 nt, Homo sapiens
uguugaguucuguagagccuuc

SEQ ID NO: 1277289 - RNA, 18 nt, Homo sapiens
uguugauaaaccauaaau

SEQ ID NO: 1277290 - RNA, 18 nt, Homo sapiens
uguugaugaaguauacuu

SEQ ID NO: 1277291 - RNA, 13 nt, Homo sapiens
uguugauguaucu

SEQ ID NO: 1277292 - RNA, 15 nt, Homo sapiens
uguugauugacugca

SEQ ID NO: 1277293 - RNA, 21 nt, Homo sapiens
ugugaacacauaaggacgugu

SEQ ID NO: 1277294 - RNA, 15 nt, Homo sapiens
ugugaacaucccuua

SEQ ID NO: 1277295 - RNA, 17 nt, Homo sapiens
ugugaagacccaggaga

SEQ ID NO: 1277296 - RNA, 14 nt, Homo sapiens
ugugaauacuggaa

SEQ ID NO: 1277297 - RNA, 14 nt, Homo sapiens
ugugaaugaucucu

SEQ ID NO: 1277298 - RNA, 13 nt, Homo sapiens
ugugaauggauug

SEQ ID NO: 1277299 - RNA, 17 nt, Homo sapiens
ugugaauguggauucuu

SEQ ID NO: 1277300 - RNA, 18 nt, Homo sapiens
ugugacaccuaacucuuu

SEQ ID NO: 1277301 - RNA, 15 nt, Homo sapiens
ugugacacugcagca

SEQ ID NO: 1277302 - RNA, 13 nt, Homo sapiens
ugugacauacaua

SEQ ID NO: 1277303 - RNA, 19 nt, Homo sapiens
ugugacaucuacaacucca

SEQ ID NO: 1277304 - RNA, 14 nt, Homo sapiens
ugugacauuguagu

SEQ ID NO: 1277305 - RNA, 20 nt, Homo sapiens
ugugaccaacuguguuguau

SEQ ID NO: 1277306 - RNA, 19 nt, Homo sapiens
ugugacucgccagcucauu

SEQ ID NO: 1277307 - RNA, 15 nt, Homo sapiens
ugugagauccuucac

SEQ ID NO: 1277308 - RNA, 11 nt, Homo sapiens
ugugagccagc

SEQ ID NO: 1277309 - RNA, 14 nt, Homo sapiens
ugugagcuaugcaa

SEQ ID NO: 1277310 - RNA, 18 nt, Homo sapiens
ugugagcuaugcaaacaa

SEQ ID NO: 1277311 - RNA, 20 nt, Homo sapiens
ugugagcuucagauggugaa

SEQ ID NO: 1277312 - RNA, 15 nt, Homo sapiens
ugugaguccaaagaa

SEQ ID NO: 1277313 - RNA, 20 nt, Homo sapiens
ugugauauauaaguguacau

SEQ ID NO: 1277314 - RNA, 19 nt, Homo sapiens
ugugauauuuuuacuugca

SEQ ID NO: 1277315 - RNA, 20 nt, Homo sapiens
ugugaugacugguuguucaa

SEQ ID NO: 1277316 - RNA, 20 nt, Homo sapiens
ugugaugucuuuucuuggca

SEQ ID NO: 1277317 - RNA, 16 nt, Homo sapiens
ugugauguuuguccug

SEQ ID NO: 1277318 - RNA, 19 nt, Homo sapiens
ugugauucaaucuguaaac

SEQ ID NO: 1277319 - RNA, 14 nt, Homo sapiens
ugugauucugccuu

SEQ ID NO: 1277320 - RNA, 12 nt, Homo sapiens
ugugauugcaca

SEQ ID NO: 1277321 - RNA, 19 nt, Homo sapiens
ugugauugcugccauaauu

SEQ ID NO: 1277322 - RNA, 23 nt, Homo sapiens
ugugcaagcgacgacagaugcua

SEQ ID NO: 1277323 - RNA, 21 nt, Homo sapiens
ugugcaccaauuaucaucuuu

SEQ ID NO: 1277324 - RNA, 16 nt, Homo sapiens
ugugcacgagugggaa

SEQ ID NO: 1277325 - RNA, 23 nt, Homo sapiens
ugugcacgcgcgcgugcacacac

SEQ ID NO: 1277326 - RNA, 23 nt, Homo sapiens
ugugcauaaugcuuuggaaaaau

SEQ ID NO: 1277327 - RNA, 15 nt, Homo sapiens
ugugcaucaguggga

SEQ ID NO: 1277328 - RNA, 22 nt, Homo sapiens
ugugcauggaggcccuccugug

SEQ ID NO: 1277329 - RNA, 17 nt, Homo sapiens
ugugcauguaugucuug

SEQ ID NO: 1277330 - RNA, 13 nt, Homo sapiens
ugugccacuuuga

SEQ ID NO: 1277331 - RNA, 21 nt, Homo sapiens
ugugccauauuugugccauuc

SEQ ID NO: 1277332 - RNA, 17 nt, Homo sapiens
ugugcccaggguuuugc

SEQ ID NO: 1277333 - RNA, 14 nt, Homo sapiens
uguaguaauugaca

SEQ ID NO: 1277334 - RNA, 20 nt, Homo sapiens
uguauaaagcaacuguuaug

SEQ ID NO: 1277335 - RNA, 14 nt, Homo sapiens
uguauacacauaua

SEQ ID NO: 1277336 - RNA, 21 nt, Homo sapiens
uguauacagauucuagccaaa

SEQ ID NO: 1277337 - RNA, 15 nt, Homo sapiens
uguauaggacucuca

SEQ ID NO: 1277338 - RNA, 15 nt, Homo sapiens
uguauaguaucugua

SEQ ID NO: 1277339 - RNA, 13 nt, Homo sapiens
uguauauacaguu

SEQ ID NO: 1277340 - RNA, 15 nt, Homo sapiens
uguauauacauauau

SEQ ID NO: 1277341 - RNA, 14 nt, Homo sapiens
uguauauaguauga

SEQ ID NO: 1277342 - RNA, 22 nt, Homo sapiens
uguauaucauacauuguuuuca

SEQ ID NO: 1277343 - RNA, 17 nt, Homo sapiens
uguauauuuucucuaua

SEQ ID NO: 1277344 - RNA, 17 nt, Homo sapiens
uguaucaagucauggca

SEQ ID NO: 1277345 - RNA, 15 nt, Homo sapiens
uguaucaaguggcau

SEQ ID NO: 1277346 - RNA, 14 nt, Homo sapiens
uguauccagucuga

SEQ ID NO: 1277347 - RNA, 16 nt, Homo sapiens
uguaugaaaauccuuu

SEQ ID NO: 1277348 - RNA, 16 nt, Homo sapiens
uguaugccaagugaga

SEQ ID NO: 1277349 - RNA, 18 nt, Homo sapiens
uguauguacguuuguaug

SEQ ID NO: 1277350 - RNA, 20 nt, Homo sapiens
uguauguauuuucaguuaca

SEQ ID NO: 1277351 - RNA, 19 nt, Homo sapiens
uguauguuguacaaucaaa

SEQ ID NO: 1277352 - RNA, 19 nt, Homo sapiens
uguauuaauaaagcauucu

SEQ ID NO: 1277353 - RNA, 22 nt, Homo sapiens
uguauuacaucuaaugcuucaa

SEQ ID NO: 1277354 - RNA, 23 nt, Homo sapiens
uguauucacgugcagcagcaaca

SEQ ID NO: 1277355 - RNA, 14 nt, Homo sapiens
uguauuccacuuag

SEQ ID NO: 1277356 - RNA, 14 nt, Homo sapiens
uguauucgugcauu

SEQ ID NO: 1277357 - RNA, 16 nt, Homo sapiens
uguauucuucaaccuc

SEQ ID NO: 1277358 - RNA, 20 nt, Homo sapiens
uguauugugcugauugugga

SEQ ID NO: 1277359 - RNA, 16 nt, Homo sapiens
uguauuguucccagug

SEQ ID NO: 1277360 - RNA, 15 nt, Homo sapiens
uguauuuaacugccu

SEQ ID NO: 1277361 - RNA, 16 nt, Homo sapiens
uguauuucaagaccuc

SEQ ID NO: 1277362 - RNA, 20 nt, Homo sapiens
uguauuuccagugcaauugu

SEQ ID NO: 1277363 - RNA, 15 nt, Homo sapiens
uguauuuucagcuca

SEQ ID NO: 1277364 - RNA, 18 nt, Homo sapiens
uguauuuuccaacuuguu

SEQ ID NO: 1277365 - RNA, 17 nt, Homo sapiens
ugucaaaagccagaugu

SEQ ID NO: 1277366 - RNA, 14 nt, Homo sapiens
ugucaaagacugua

SEQ ID NO: 1277367 - RNA, 21 nt, Homo sapiens
ugucaacaccccuguguggau

SEQ ID NO: 1277368 - RNA, 22 nt, Homo sapiens
ugucaagaagcguuaugugcag

SEQ ID NO: 1277369 - RNA, 14 nt, Homo sapiens
ugucaaguacaagc

SEQ ID NO: 1277370 - RNA, 19 nt, Homo sapiens
ugucaauaaaaccacugua

SEQ ID NO: 1277371 - RNA, 20 nt, Homo sapiens
ugucaauaaaaccacuguac

SEQ ID NO: 1277372 - RNA, 20 nt, Homo sapiens
ugucaauaaggagcaucagc

SEQ ID NO: 1277373 - RNA, 17 nt, Homo sapiens
ugucaauaugagauauu

SEQ ID NO: 1277374 - RNA, 16 nt, Homo sapiens
ugucaaugacaguuuc

SEQ ID NO: 1277375 - RNA, 12 nt, Homo sapiens
ugucacaaagau

SEQ ID NO: 1277376 - RNA, 15 nt, Homo sapiens
ugucacacaaaaagu

SEQ ID NO: 1277377 - RNA, 22 nt, Homo sapiens
uggugaccugcggcaguaugua

SEQ ID NO: 1277378 - RNA, 21 nt, Homo sapiens
uggugacgcacggcauuagcu

SEQ ID NO: 1277379 - RNA, 20 nt, Homo sapiens
uggugagcucugggaagugu

SEQ ID NO: 1277380 - RNA, 20 nt, Homo sapiens
uggugaugggguuuagcaac

SEQ ID NO: 1277381 - RNA, 17 nt, Homo sapiens
uggugcgcccugucucu

SEQ ID NO: 1277382 - RNA, 14 nt, Homo sapiens
uggugcuaauauga

SEQ ID NO: 1277383 - RNA, 16 nt, Homo sapiens
uggugcuaauaugaca

SEQ ID NO: 1277384 - RNA, 13 nt, Homo sapiens
uggugcuaauuaa

SEQ ID NO: 1277385 - RNA, 14 nt, Homo sapiens
uggugcucuuugcu

SEQ ID NO: 1277386 - RNA, 22 nt, Homo sapiens
uggugcucuuugcugcacuauu

SEQ ID NO: 1277387 - RNA, 15 nt, Homo sapiens
uggugcugcucugug

SEQ ID NO: 1277388 - RNA, 16 nt, Homo sapiens
uggugcuuaaguucca

SEQ ID NO: 1277389 - RNA, 15 nt, Homo sapiens
ugguggaaacagugg

SEQ ID NO: 1277390 - RNA, 19 nt, Homo sapiens
ugguggagaaagcacugac

SEQ ID NO: 1277391 - RNA, 23 nt, Homo sapiens
ugguggaguggagugagagcaau

SEQ ID NO: 1277392 - RNA, 19 nt, Homo sapiens
ugguggcagauuuuacaaa

SEQ ID NO: 1277393 - RNA, 20 nt, Homo sapiens
ugguggcauaugccuguaau

SEQ ID NO: 1277394 - RNA, 12 nt, Homo sapiens
ugguggggccag

SEQ ID NO: 1277395 - RNA, 12 nt, Homo sapiens
ugguggugcacc

SEQ ID NO: 1277396 - RNA, 13 nt, Homo sapiens
uggugguucucag

SEQ ID NO: 1277397 - RNA, 15 nt, Homo sapiens
ugguguaauuuauaa

SEQ ID NO: 1277398 - RNA, 23 nt, Homo sapiens
ugguguacagaccaccuuucaca

SEQ ID NO: 1277399 - RNA, 13 nt, Homo sapiens
ugguguagacugu

SEQ ID NO: 1277400 - RNA, 14 nt, Homo sapiens
uggugucaguaucc

SEQ ID NO: 1277401 - RNA, 23 nt, Homo sapiens
uggugugaucucggcucacugca

SEQ ID NO: 1277402 - RNA, 21 nt, Homo sapiens
ugguguucaccaaaaccaaac

SEQ ID NO: 1277403 - RNA, 15 nt, Homo sapiens
ugguguuuucauucc

SEQ ID NO: 1277404 - RNA, 14 nt, Homo sapiens
ugguuaacaucuca

SEQ ID NO: 1277405 - RNA, 15 nt, Homo sapiens
ugguuacacuguuag

SEQ ID NO: 1277406 - RNA, 14 nt, Homo sapiens
ugguuacaguuuga

SEQ ID NO: 1277407 - RNA, 19 nt, Homo sapiens
ugguuaguuaaaagcccau

SEQ ID NO: 1277408 - RNA, 14 nt, Homo sapiens
ugguucaacaucua

SEQ ID NO: 1277409 - RNA, 14 nt, Homo sapiens
ugguucaucccuuu

SEQ ID NO: 1277410 - RNA, 18 nt, Homo sapiens
ugguuccaugcagccuug

SEQ ID NO: 1277411 - RNA, 12 nt, Homo sapiens
ugguugccaugg

SEQ ID NO: 1277412 - RNA, 20 nt, Homo sapiens
ugguuguagaaggagccuug

SEQ ID NO: 1277413 - RNA, 18 nt, Homo sapiens
ugguuguauuaaagcagg

SEQ ID NO: 1277414 - RNA, 13 nt, Homo sapiens
ugguuuacuucaa

SEQ ID NO: 1277415 - RNA, 17 nt, Homo sapiens
ugguuuauugaauguga

SEQ ID NO: 1277416 - RNA, 20 nt, Homo sapiens
ugguuuauugaaugugauuu

SEQ ID NO: 1277417 - RNA, 17 nt, Homo sapiens
ugguuuccauuuacuaa

SEQ ID NO: 1277418 - RNA, 16 nt, Homo sapiens
ugguuugaaagaugca

SEQ ID NO: 1277419 - RNA, 13 nt, Homo sapiens
ugguuugccaugu

SEQ ID NO: 1277420 - RNA, 21 nt, Homo sapiens
ugguuuucacauacacucaaa

SEQ ID NO: 1277421 - RNA, 18 nt, Homo sapiens
uguaaaagagucaucugg

SEQ ID NO: 1277422 - RNA, 19 nt, Homo sapiens
uguaaaauagaauguuacu

SEQ ID NO: 1277423 - RNA, 22 nt, Homo sapiens
uguaaaaugugaagugaaugaa

SEQ ID NO: 1277424 - RNA, 21 nt, Homo sapiens
uucucugugucuaagauucua

SEQ ID NO: 1277425 - RNA, 21 nt, Homo sapiens
uucucuguguuuguuccuaca

SEQ ID NO: 1277426 - RNA, 18 nt, Homo sapiens
uucucuugacguuuacau

SEQ ID NO: 1277427 - RNA, 20 nt, Homo sapiens
uucucuuuuccuuugguccu

SEQ ID NO: 1277428 - RNA, 20 nt, Homo sapiens
uucugaaaaccuaccagcca

SEQ ID NO: 1277429 - RNA, 23 nt, Homo sapiens
uucugaaaaccuaccagccagag

SEQ ID NO: 1277430 - RNA, 18 nt, Homo sapiens
uucugaaacuucauaaau

SEQ ID NO: 1277431 - RNA, 22 nt, Homo sapiens
uucugaaauaaacuucacugaa

SEQ ID NO: 1277432 - RNA, 19 nt, Homo sapiens
uucugaaugugcugaucau

SEQ ID NO: 1277433 - RNA, 15 nt, Homo sapiens
uucugagaaggugag

SEQ ID NO: 1277434 - RNA, 17 nt, Homo sapiens
uucugagacauguguca

SEQ ID NO: 1277435 - RNA, 21 nt, Homo sapiens
uucugagcaucugcaguacag

SEQ ID NO: 1277436 - RNA, 18 nt, Homo sapiens
uucugagggaaagugcau

SEQ ID NO: 1277437 - RNA, 19 nt, Homo sapiens
uucugaguagagcuuguaa

SEQ ID NO: 1277438 - RNA, 20 nt, Homo sapiens
uucugauaaaaauaauauua

SEQ ID NO: 1277439 - RNA, 20 nt, Homo sapiens
uucugauaaaagauggccau

SEQ ID NO: 1277440 - RNA, 14 nt, Homo sapiens
uucugaucagaggu

SEQ ID NO: 1277441 - RNA, 22 nt, Homo sapiens
uucugauuccccuccaccaaac

SEQ ID NO: 1277442 - RNA, 22 nt, Homo sapiens
uucugauuugucccuaugcaua

SEQ ID NO: 1277443 - RNA, 20 nt, Homo sapiens
uucugcaaaauagacauauu

SEQ ID NO: 1277444 - RNA, 11 nt, Homo sapiens
uucugccaaac

SEQ ID NO: 1277445 - RNA, 23 nt, Homo sapiens
uucugcccacaccgcagggacaa

SEQ ID NO: 1277446 - RNA, 15 nt, Homo sapiens
uucugcccaugggaa

SEQ ID NO: 1277447 - RNA, 13 nt, Homo sapiens
uucugcucuggaa

SEQ ID NO: 1277448 - RNA, 21 nt, Homo sapiens
uucugcuguagccugggacca

SEQ ID NO: 1277449 - RNA, 16 nt, Homo sapiens
uucugcuuugcacagg

SEQ ID NO: 1277450 - RNA, 18 nt, Homo sapiens
uucuggaaacuaccaggu

SEQ ID NO: 1277451 - RNA, 16 nt, Homo sapiens
uucuggaaagugcaau

SEQ ID NO: 1277452 - RNA, 17 nt, Homo sapiens
uucuggaagucaucuca

SEQ ID NO: 1277453 - RNA, 17 nt, Homo sapiens
uucuggagugagcacuc

SEQ ID NO: 1277454 - RNA, 22 nt, Homo sapiens
uucuggaugaaugcccagugag

SEQ ID NO: 1277455 - RNA, 18 nt, Homo sapiens
uucuggauuugcagguga

SEQ ID NO: 1277456 - RNA, 18 nt, Homo sapiens
uucugggaacuuccucag

SEQ ID NO: 1277457 - RNA, 23 nt, Homo sapiens
uucugggagacacccaaagggug

SEQ ID NO: 1277458 - RNA, 15 nt, Homo sapiens
uucugggcucaggga

SEQ ID NO: 1277459 - RNA, 22 nt, Homo sapiens
uucuggucuggcggcugugcau

SEQ ID NO: 1277460 - RNA, 17 nt, Homo sapiens
uucuggugcuacuccau

SEQ ID NO: 1277461 - RNA, 18 nt, Homo sapiens
uucugguuguuaugugau

SEQ ID NO: 1277462 - RNA, 22 nt, Homo sapiens
uucuguaaauaccauugacaca

SEQ ID NO: 1277463 - RNA, 19 nt, Homo sapiens
uucugucagaaugcuauug

SEQ ID NO: 1277464 - RNA, 19 nt, Homo sapiens
uucuguccuggugucacuu

SEQ ID NO: 1277465 - RNA, 16 nt, Homo sapiens
uucugucuggagugac

SEQ ID NO: 1277466 - RNA, 18 nt, Homo sapiens
uucugucuuuauaaucua

SEQ ID NO: 1277467 - RNA, 17 nt, Homo sapiens
uucugugcagagaugac

SEQ ID NO: 1277468 - RNA, 21 nt, Homo sapiens
uucuguggaccacugcaugag

SEQ ID NO: 1277469 - RNA, 14 nt, Homo sapiens
uucuguuguuccau

SEQ ID NO: 1277470 - RNA, 22 nt, Homo sapiens
uucuguuuuuaaugcuauuuga

SEQ ID NO: 1277471 - RNA, 15 nt, Homo sapiens
uucuuaaacucagaa

SEQ ID NO: 1277472 - RNA, 16 nt, Homo sapiens
uucuuacaauugcacu

SEQ ID NO: 1277473 - RNA, 19 nt, Homo sapiens
uucuuacaauugcacugcu

SEQ ID NO: 1277474 - RNA, 18 nt, Homo sapiens
uucuuacccaauuuccca

SEQ ID NO: 1277475 - RNA, 15 nt, Homo sapiens
uucuuacccauauau

SEQ ID NO: 1277476 - RNA, 23 nt, Homo sapiens
uucuuacuugacuugaaugugca

SEQ ID NO: 1277477 - RNA, 16 nt, Homo sapiens
uucuuagaguguagcu

SEQ ID NO: 1277478 - RNA, 14 nt, Homo sapiens
uucuuagucauuac

SEQ ID NO: 1277479 - RNA, 14 nt, Homo sapiens
uucuuauaauauua

SEQ ID NO: 1277480 - RNA, 22 nt, Homo sapiens
uucuuauaccacguuccacgga

SEQ ID NO: 1277481 - RNA, 14 nt, Homo sapiens
uucuuauugacaau

SEQ ID NO: 1277482 - RNA, 23 nt, Homo sapiens
uucuuauugaccaauuccugaca

SEQ ID NO: 1277483 - RNA, 16 nt, Homo sapiens
uucuucagggccaguc

SEQ ID NO: 1277484 - RNA, 17 nt, Homo sapiens
uucuucagggccagucc

SEQ ID NO: 1277485 - RNA, 18 nt, Homo sapiens
uucuuccccuuacucuca

SEQ ID NO: 1277486 - RNA, 20 nt, Homo sapiens
uucuuccccuuacucucaca

SEQ ID NO: 1277487 - RNA, 16 nt, Homo sapiens
uucuucuguccugaga

SEQ ID NO: 1277488 - RNA, 22 nt, Homo sapiens
uucuucuucagaagacacugca

SEQ ID NO: 1277489 - RNA, 15 nt, Homo sapiens
uucuugcugcuagaa

SEQ ID NO: 1277490 - RNA, 18 nt, Homo sapiens
uucuugcuggcucugaga

SEQ ID NO: 1277491 - RNA, 22 nt, Homo sapiens
uucuuggagggcccacuuguau

SEQ ID NO: 1277492 - RNA, 19 nt, Homo sapiens
uucuugggguacucuugau

SEQ ID NO: 1277493 - RNA, 17 nt, Homo sapiens
uucuugguaacugauua

SEQ ID NO: 1277494 - RNA, 15 nt, Homo sapiens
uucuuggugguggau

SEQ ID NO: 1277495 - RNA, 18 nt, Homo sapiens
uucuuggugguggaugac

SEQ ID NO: 1277496 - RNA, 10 nt, Homo sapiens
uucuugucag

SEQ ID NO: 1277497 - RNA, 23 nt, Homo sapiens
uucuugucagacauaaagccaug

SEQ ID NO: 1277498 - RNA, 17 nt, Homo sapiens
uucuuuaccaaggauau

SEQ ID NO: 1277499 - RNA, 18 nt, Homo sapiens
uucuuucaaagaagccag

SEQ ID NO: 1277500 - RNA, 18 nt, Homo sapiens
uucuuucagauguuuauu

SEQ ID NO: 1277501 - RNA, 13 nt, Homo sapiens
uucuuuccuccag

SEQ ID NO: 1277502 - RNA, 20 nt, Homo sapiens
uucuuugacaccacaccauc

SEQ ID NO: 1277503 - RNA, 18 nt, Homo sapiens
uucuuugacuuaaugucu

SEQ ID NO: 1277504 - RNA, 16 nt, Homo sapiens
uucuuugcaccaaaga

SEQ ID NO: 1277505 - RNA, 14 nt, Homo sapiens
uucuuugucuuauc

SEQ ID NO: 1277506 - RNA, 19 nt, Homo sapiens
uucuuuucuaaaugccaau

SEQ ID NO: 1277507 - RNA, 16 nt, Homo sapiens
uucuuuuggcuuccau

SEQ ID NO: 1277508 - RNA, 19 nt, Homo sapiens
uucuuuuggcuuccaugau

SEQ ID NO: 1277509 - RNA, 13 nt, Homo sapiens
uucuuuuuccaca

SEQ ID NO: 1277510 - RNA, 18 nt, Homo sapiens
uucuuuuucguuggugua

SEQ ID NO: 1277511 - RNA, 18 nt, Homo sapiens
uucuuuuuugcccccaga

SEQ ID NO: 1277512 - RNA, 20 nt, Homo sapiens
uugaaaaaaaacaguggauc

SEQ ID NO: 1277513 - RNA, 17 nt, Homo sapiens
uugaaaaaagcugaauu

SEQ ID NO: 1277514 - RNA, 17 nt, Homo sapiens
uugaaaaaauagaucca

SEQ ID NO: 1277515 - RNA, 15 nt, Homo sapiens
uugaaaacacacuca

SEQ ID NO: 1277516 - RNA, 17 nt, Homo sapiens
uugaaaauaauuguucc

SEQ ID NO: 1277517 - RNA, 20 nt, Homo sapiens
uugaaacagauucaggccag

SEQ ID NO: 1277518 - RNA, 17 nt, Homo sapiens
uugaaacguuaugauga

SEQ ID NO: 1277519 - RNA, 13 nt, Homo sapiens
uugaaacuuguau

SEQ ID NO: 1277520 - RNA, 21 nt, Homo sapiens
uugaaagaaauuuggcuauaa

SEQ ID NO: 1277521 - RNA, 14 nt, Homo sapiens
uugaaagaaccaga

SEQ ID NO: 1277522 - RNA, 17 nt, Homo sapiens
uugaaagcccaaggugc

SEQ ID NO: 1277523 - RNA, 20 nt, Homo sapiens
uugaaaguuuuccaguauug

SEQ ID NO: 1277524 - RNA, 13 nt, Homo sapiens
uugaaauccagaa

SEQ ID NO: 1277525 - RNA, 18 nt, Homo sapiens
uugaaaugccucuugacc

SEQ ID NO: 1277526 - RNA, 15 nt, Homo sapiens
uugaacauacuucaa

SEQ ID NO: 1277527 - RNA, 15 nt, Homo sapiens
uugaaccugugcaau

SEQ ID NO: 1277528 - RNA, 18 nt, Homo sapiens
uugaacuaggcugagcaa

SEQ ID NO: 1277529 - RNA, 17 nt, Homo sapiens
uugaacuauaacuguug

SEQ ID NO: 1277530 - RNA, 14 nt, Homo sapiens
uugaacucagggag

SEQ ID NO: 1277531 - RNA, 18 nt, Homo sapiens
uugaacugguucaugaaa

SEQ ID NO: 1277532 - RNA, 19 nt, Homo sapiens
uugaacuguuagaugcuga

SEQ ID NO: 1277533 - RNA, 22 nt, Homo sapiens
uugaacuguuagaugcugaaua

SEQ ID NO: 1277534 - RNA, 13 nt, Homo sapiens
uugaacuguuguc

SEQ ID NO: 1277535 - RNA, 14 nt, Homo sapiens
uugaagaagauaug

SEQ ID NO: 1277536 - RNA, 11 nt, Homo sapiens
uugaagaccag

SEQ ID NO: 1277537 - RNA, 22 nt, Homo sapiens
uugaagauuuaugaugcacuua

SEQ ID NO: 1277538 - RNA, 20 nt, Homo sapiens
uucccauuguggcuccuauc

SEQ ID NO: 1277539 - RNA, 15 nt, Homo sapiens
uuccccaaccacaga

SEQ ID NO: 1277540 - RNA, 19 nt, Homo sapiens
uuccccaauuacaggguga

SEQ ID NO: 1277541 - RNA, 12 nt, Homo sapiens
uuccccacugac

SEQ ID NO: 1277542 - RNA, 23 nt, Homo sapiens
uuccccggggucuucuaccucag

SEQ ID NO: 1277543 - RNA, 19 nt, Homo sapiens
uuccccucaacaugcugcc

SEQ ID NO: 1277544 - RNA, 15 nt, Homo sapiens
uuccccuggccucag

SEQ ID NO: 1277545 - RNA, 22 nt, Homo sapiens
uuccccugucuucaccugccac

SEQ ID NO: 1277546 - RNA, 11 nt, Homo sapiens
uuccccugugg

SEQ ID NO: 1277547 - RNA, 18 nt, Homo sapiens
uucccguauugacaggaa

SEQ ID NO: 1277548 - RNA, 16 nt, Homo sapiens
uucccucccuaucuaa

SEQ ID NO: 1277549 - RNA, 16 nt, Homo sapiens
uucccucugcucagcc

SEQ ID NO: 1277550 - RNA, 15 nt, Homo sapiens
uucccucuugcucag

SEQ ID NO: 1277551 - RNA, 19 nt, Homo sapiens
uucccugaagaucuaguga

SEQ ID NO: 1277552 - RNA, 18 nt, Homo sapiens
uucccugaccucccucua

SEQ ID NO: 1277553 - RNA, 23 nt, Homo sapiens
uucccugcuuccaggaaacucca

SEQ ID NO: 1277554 - RNA, 18 nt, Homo sapiens
uucccuguguagcucuca

SEQ ID NO: 1277555 - RNA, 17 nt, Homo sapiens
uucccuucuugcauccu

SEQ ID NO: 1277556 - RNA, 20 nt, Homo sapiens
uucccuuuuaaucaacugua

SEQ ID NO: 1277557 - RNA, 16 nt, Homo sapiens
uuccgauacaaagugu

SEQ ID NO: 1277558 - RNA, 18 nt, Homo sapiens
uuccgcuuugaaagaagc

SEQ ID NO: 1277559 - RNA, 19 nt, Homo sapiens
uuccggcacacugccaaau

SEQ ID NO: 1277560 - RNA, 21 nt, Homo sapiens
uuccgucaccacgacuggcca

SEQ ID NO: 1277561 - RNA, 14 nt, Homo sapiens
uuccuaaacccaau

SEQ ID NO: 1277562 - RNA, 15 nt, Homo sapiens
uuccuaauacuguca

SEQ ID NO: 1277563 - RNA, 21 nt, Homo sapiens
uuccuagauaugauaaauaua

SEQ ID NO: 1277564 - RNA, 22 nt, Homo sapiens
uuccucaccuuguaaccagugc

SEQ ID NO: 1277565 - RNA, 14 nt, Homo sapiens
uuccucacuuugaa

SEQ ID NO: 1277566 - RNA, 15 nt, Homo sapiens
uuccucacuuugaag

SEQ ID NO: 1277567 - RNA, 19 nt, Homo sapiens
uuccuccccgagucagggc

SEQ ID NO: 1277568 - RNA, 20 nt, Homo sapiens
uuccuccucaggcacacagc

SEQ ID NO: 1277569 - RNA, 14 nt, Homo sapiens
uuccucgccugaca

SEQ ID NO: 1277570 - RNA, 22 nt, Homo sapiens
uuccucuaugaaaauuauaucu

SEQ ID NO: 1277571 - RNA, 12 nt, Homo sapiens
uuccucugucaa

SEQ ID NO: 1277572 - RNA, 15 nt, Homo sapiens
uuccucuuacugggg

SEQ ID NO: 1277573 - RNA, 13 nt, Homo sapiens
uuccucuugccuc

SEQ ID NO: 1277574 - RNA, 22 nt, Homo sapiens
uuccucuugugauuucuuuaaa

SEQ ID NO: 1277575 - RNA, 18 nt, Homo sapiens
uuccugaaaauugcaaua

SEQ ID NO: 1277576 - RNA, 19 nt, Homo sapiens
uuccugaaauaaacacugg

SEQ ID NO: 1277577 - RNA, 15 nt, Homo sapiens
uuccugaaugaaaua

SEQ ID NO: 1277578 - RNA, 19 nt, Homo sapiens
uuccugacaucacagcagc

SEQ ID NO: 1277579 - RNA, 19 nt, Homo sapiens
uuccugaguggugccaaac

SEQ ID NO: 1277580 - RNA, 21 nt, Homo sapiens
uuccugcaacucaaggacuuu

SEQ ID NO: 1277581 - RNA, 17 nt, Homo sapiens
uuccugcagccccagaa

SEQ ID NO: 1277582 - RNA, 20 nt, Homo sapiens
uuccuggaaacagcaugaau

SEQ ID NO: 1277583 - RNA, 20 nt, Homo sapiens
uuccuggcccacucuguaau

SEQ ID NO: 1277584 - RNA, 18 nt, Homo sapiens
uuccuggguuuccugcag

SEQ ID NO: 1277585 - RNA, 11 nt, Homo sapiens
uuccuggugcu

SEQ ID NO: 1277586 - RNA, 20 nt, Homo sapiens
uuccuguaaugcaggacucc

SEQ ID NO: 1277587 - RNA, 14 nt, Homo sapiens
uuccuguuacuuua

SEQ ID NO: 1277588 - RNA, 20 nt, Homo sapiens
uuccuguugucuacaccaau

SEQ ID NO: 1277589 - RNA, 13 nt, Homo sapiens
uuccuguuuccau

SEQ ID NO: 1277590 - RNA, 18 nt, Homo sapiens
uuccuuaauccagcugau

SEQ ID NO: 1277591 - RNA, 17 nt, Homo sapiens
uuccuuaccauaccacu

SEQ ID NO: 1277592 - RNA, 15 nt, Homo sapiens
uuccuuagacuuacu

SEQ ID NO: 1277593 - RNA, 20 nt, Homo sapiens
uuccuucuugacauuuauca

SEQ ID NO: 1277594 - RNA, 16 nt, Homo sapiens
uuccuugggaugaucu

SEQ ID NO: 1277595 - RNA, 24 nt, Homo sapiens
uuccuuuauagagugucucagggu

SEQ ID NO: 1277596 - RNA, 24 nt, Homo sapiens
uuccuuucccuuuagcacguuuaa

SEQ ID NO: 1277597 - RNA, 16 nt, Homo sapiens
uuccuuuguguuuaua

SEQ ID NO: 1277598 - RNA, 21 nt, Homo sapiens
uuccuuuuaaaacacuuccau

SEQ ID NO: 1277599 - RNA, 23 nt, Homo sapiens
uuccuuuuauuuuuauaggaaua

SEQ ID NO: 1277600 - RNA, 20 nt, Homo sapiens
uuccuuuucccugcuuccag

SEQ ID NO: 1277601 - RNA, 20 nt, Homo sapiens
uucgagaccagccuggccaa

SEQ ID NO: 1277602 - RNA, 16 nt, Homo sapiens
uucgauuucuaccuca

SEQ ID NO: 1277603 - RNA, 17 nt, Homo sapiens
uucgauuucuaccucag

SEQ ID NO: 1277604 - RNA, 17 nt, Homo sapiens
uucggacaaaauaucuc

SEQ ID NO: 1277605 - RNA, 20 nt, Homo sapiens
uucggacagugcccaugcaa

SEQ ID NO: 1277606 - RNA, 14 nt, Homo sapiens
uucggauuugccau

SEQ ID NO: 1277607 - RNA, 19 nt, Homo sapiens
uucggcagcuacucagagg

SEQ ID NO: 1277608 - RNA, 17 nt, Homo sapiens
uucgucuguugugcgaa

SEQ ID NO: 1277609 - RNA, 23 nt, Homo sapiens
uucguggggaacugcguggugcu

SEQ ID NO: 1277610 - RNA, 14 nt, Homo sapiens
uucuaaacuacaac

SEQ ID NO: 1277611 - RNA, 17 nt, Homo sapiens
uucuaaagcucugacau

SEQ ID NO: 1277612 - RNA, 14 nt, Homo sapiens
uucuaaaguucuaa

SEQ ID NO: 1277613 - RNA, 22 nt, Homo sapiens
uucuaacagugaaguuuuacug

SEQ ID NO: 1277614 - RNA, 21 nt, Homo sapiens
uucuaagacuuacucuaagau

SEQ ID NO: 1277615 - RNA, 22 nt, Homo sapiens
uucuaagauaagaguugagauu

SEQ ID NO: 1277616 - RNA, 13 nt, Homo sapiens
uucuaagauucug

SEQ ID NO: 1277617 - RNA, 22 nt, Homo sapiens
uucuaaggaccugaaauuccaa

SEQ ID NO: 1277618 - RNA, 21 nt, Homo sapiens
uucuaaggcucugagagucua

SEQ ID NO: 1277619 - RNA, 13 nt, Homo sapiens
uucuaaugugcau

SEQ ID NO: 1277620 - RNA, 22 nt, Homo sapiens
uucuaauuugcauugugucaga

SEQ ID NO: 1277621 - RNA, 23 nt, Homo sapiens
uucuacacagagcaggacugcac

SEQ ID NO: 1277622 - RNA, 19 nt, Homo sapiens
uucuacagaauauucuccc

SEQ ID NO: 1277623 - RNA, 15 nt, Homo sapiens
uucuacaguguccua

SEQ ID NO: 1277624 - RNA, 13 nt, Homo sapiens
uucuaccagcuca

SEQ ID NO: 1277625 - RNA, 15 nt, Homo sapiens
uucuaccauuugaau

SEQ ID NO: 1277626 - RNA, 13 nt, Homo sapiens
uucuaccugcccu

SEQ ID NO: 1277627 - RNA, 20 nt, Homo sapiens
uucuacgggauggccagaga

SEQ ID NO: 1277628 - RNA, 15 nt, Homo sapiens
uucuacucugucuua

SEQ ID NO: 1277629 - RNA, 11 nt, Homo sapiens
uucuacuguaa

SEQ ID NO: 1277630 - RNA, 23 nt, Homo sapiens
uucuacuucuggaagucaucuca

SEQ ID NO: 1277631 - RNA, 12 nt, Homo sapiens
uucuacuuuaag

SEQ ID NO: 1277632 - RNA, 21 nt, Homo sapiens
uucuacuuuaagguuugcaga

SEQ ID NO: 1277633 - RNA, 20 nt, Homo sapiens
uucuagaaccugggcugugc

SEQ ID NO: 1277634 - RNA, 17 nt, Homo sapiens
uucuaggccaagcauuu

SEQ ID NO: 1277635 - RNA, 22 nt, Homo sapiens
uucuagucuccuuugcacugag

SEQ ID NO: 1277636 - RNA, 16 nt, Homo sapiens
uucuagucuuggccag

SEQ ID NO: 1277637 - RNA, 16 nt, Homo sapiens
uucuaguggucuuugu

SEQ ID NO: 1277638 - RNA, 20 nt, Homo sapiens
uucuauaauuuugccuuuaa

SEQ ID NO: 1277639 - RNA, 21 nt, Homo sapiens
uucuauacaacaggcagugga

SEQ ID NO: 1277640 - RNA, 15 nt, Homo sapiens
uucuaucauggaaua

SEQ ID NO: 1277641 - RNA, 14 nt, Homo sapiens
uucuaugaagccca

SEQ ID NO: 1277642 - RNA, 15 nt, Homo sapiens
uucuaugcauuaaga

SEQ ID NO: 1277643 - RNA, 15 nt, Homo sapiens
uucuauugcugagaa

SEQ ID NO: 1277644 - RNA, 15 nt, Homo sapiens
uucuauuuauuuacu

SEQ ID NO: 1277645 - RNA, 15 nt, Homo sapiens
uucucaaaguuuuga

SEQ ID NO: 1277646 - RNA, 14 nt, Homo sapiens
uucucacacacugg

SEQ ID NO: 1277647 - RNA, 16 nt, Homo sapiens
uucucacacacuggcu

SEQ ID NO: 1277648 - RNA, 18 nt, Homo sapiens
uucucacccuacucugga

SEQ ID NO: 1277649 - RNA, 17 nt, Homo sapiens
uucucagacacugccga

SEQ ID NO: 1277650 - RNA, 22 nt, Homo sapiens
uucucagaccugcgcacuccau

SEQ ID NO: 1277651 - RNA, 23 nt, Homo sapiens
uucucagauguugaaacuuugaa

SEQ ID NO: 1277652 - RNA, 21 nt, Homo sapiens
uucucagguguugccaaauau

SEQ ID NO: 1277653 - RNA, 23 nt, Homo sapiens
uucucagugggacucugauccca

SEQ ID NO: 1277654 - RNA, 18 nt, Homo sapiens
uucucauaccuuccccac

SEQ ID NO: 1277655 - RNA, 21 nt, Homo sapiens
uucucaucccccagccacagu

SEQ ID NO: 1277656 - RNA, 19 nt, Homo sapiens
uucucaucuuuuuacuaaa

SEQ ID NO: 1277657 - RNA, 21 nt, Homo sapiens
uucuccaccuagacuguaaac

SEQ ID NO: 1277658 - RNA, 11 nt, Homo sapiens
uucuccacugg

SEQ ID NO: 1277659 - RNA, 23 nt, Homo sapiens
uucuccagacccaccacaccgca

SEQ ID NO: 1277660 - RNA, 21 nt, Homo sapiens
uucuccagacuuuuaccuacc

SEQ ID NO: 1277661 - RNA, 22 nt, Homo sapiens
uucucccaccaccucaccaguu

SEQ ID NO: 1277662 - RNA, 17 nt, Homo sapiens
uucucccagcacacggc

SEQ ID NO: 1277663 - RNA, 13 nt, Homo sapiens
uucucccuguaaa

SEQ ID NO: 1277664 - RNA, 17 nt, Homo sapiens
uugaauguggucucagg

SEQ ID NO: 1277665 - RNA, 20 nt, Homo sapiens
uugacacuauucacuaaaau

SEQ ID NO: 1277666 - RNA, 13 nt, Homo sapiens
uugacacucugca

SEQ ID NO: 1277667 - RNA, 15 nt, Homo sapiens
uugacacugcucuaa

SEQ ID NO: 1277668 - RNA, 18 nt, Homo sapiens
uugacagcaaaauguuga

SEQ ID NO: 1277669 - RNA, 17 nt, Homo sapiens
uugaccaagaacugcau

SEQ ID NO: 1277670 - RNA, 18 nt, Homo sapiens
uugaccaagaacugcaug

SEQ ID NO: 1277671 - RNA, 12 nt, Homo sapiens
uugaccacagag

SEQ ID NO: 1277672 - RNA, 13 nt, Homo sapiens
uugaccacccacc

SEQ ID NO: 1277673 - RNA, 16 nt, Homo sapiens
uugacccuagccagag

SEQ ID NO: 1277674 - RNA, 14 nt, Homo sapiens
uugaccuugugaca

SEQ ID NO: 1277675 - RNA, 21 nt, Homo sapiens
uugacgacagugcauuugccu

SEQ ID NO: 1277676 - RNA, 21 nt, Homo sapiens
uugacuuccccacugcucucu

SEQ ID NO: 1277677 - RNA, 17 nt, Homo sapiens
uugagaaagccuucaua

SEQ ID NO: 1277678 - RNA, 14 nt, Homo sapiens
uugagacaggagac

SEQ ID NO: 1277679 - RNA, 15 nt, Homo sapiens
uugagacauuuacau

SEQ ID NO: 1277680 - RNA, 15 nt, Homo sapiens
uugagacugauucag

SEQ ID NO: 1277681 - RNA, 16 nt, Homo sapiens
uugagacuuccaaagg

SEQ ID NO: 1277682 - RNA, 23 nt, Homo sapiens
uugagaguauauuauguauuuau

SEQ ID NO: 1277683 - RNA, 16 nt, Homo sapiens
uugagaucacuacuca

SEQ ID NO: 1277684 - RNA, 18 nt, Homo sapiens
uugagaugguaacagauu

SEQ ID NO: 1277685 - RNA, 20 nt, Homo sapiens
uugagauguuguguggcaau

SEQ ID NO: 1277686 - RNA, 13 nt, Homo sapiens
uugagcaagccga

SEQ ID NO: 1277687 - RNA, 18 nt, Homo sapiens
uugagcaccgucauggcu

SEQ ID NO: 1277688 - RNA, 18 nt, Homo sapiens
uugagcccaggaguucaa

SEQ ID NO: 1277689 - RNA, 14 nt, Homo sapiens
uugagcuacuucaa

SEQ ID NO: 1277690 - RNA, 21 nt, Homo sapiens
uugagcugauauaaauucugu

SEQ ID NO: 1277691 - RNA, 10 nt, Homo sapiens
uugagcugca

SEQ ID NO: 1277692 - RNA, 21 nt, Homo sapiens
uugagcuucauauaccagcaa

SEQ ID NO: 1277693 - RNA, 21 nt, Homo sapiens
uugaggacaaccauuccagac

SEQ ID NO: 1277694 - RNA, 18 nt, Homo sapiens
uugaggacaagauaccaa

SEQ ID NO: 1277695 - RNA, 22 nt, Homo sapiens
uugaggagcauguuuuguauac

SEQ ID NO: 1277696 - RNA, 20 nt, Homo sapiens
uugaggauuguggaaaacca

SEQ ID NO: 1277697 - RNA, 18 nt, Homo sapiens
uugaggccuuuuuugcca

SEQ ID NO: 1277698 - RNA, 19 nt, Homo sapiens
uugaggccuuuuuugccag

SEQ ID NO: 1277699 - RNA, 12 nt, Homo sapiens
uugaggcuuuca

SEQ ID NO: 1277700 - RNA, 18 nt, Homo sapiens
uugaggggcccuggccag

SEQ ID NO: 1277701 - RNA, 22 nt, Homo sapiens
uugaggggcuuugucagcauca

SEQ ID NO: 1277702 - RNA, 16 nt, Homo sapiens
uugaggguccucaguc

SEQ ID NO: 1277703 - RNA, 22 nt, Homo sapiens
uugaggguccucaguccacugc

SEQ ID NO: 1277704 - RNA, 22 nt, Homo sapiens
uugagguaauaaugacacuccu

SEQ ID NO: 1277705 - RNA, 20 nt, Homo sapiens
uugaguagauauuacuuuau

SEQ ID NO: 1277706 - RNA, 22 nt, Homo sapiens
uugagugagcaccuccccagau

SEQ ID NO: 1277707 - RNA, 16 nt, Homo sapiens
uugagugucaagcuga

SEQ ID NO: 1277708 - RNA, 16 nt, Homo sapiens
uugagugucuucuaac

SEQ ID NO: 1277709 - RNA, 21 nt, Homo sapiens
uugaguuugucgcucaugugu

SEQ ID NO: 1277710 - RNA, 22 nt, Homo sapiens
uugauaaaugacacaaugaagu

SEQ ID NO: 1277711 - RNA, 17 nt, Homo sapiens
uugauaagcacauuaaa

SEQ ID NO: 1277712 - RNA, 21 nt, Homo sapiens
uugauaauauuagugauucug

SEQ ID NO: 1277713 - RNA, 20 nt, Homo sapiens
uugauaccauggcacugaca

SEQ ID NO: 1277714 - RNA, 15 nt, Homo sapiens
uugauacugaaugca

SEQ ID NO: 1277715 - RNA, 12 nt, Homo sapiens
uugauaucugau

SEQ ID NO: 1277716 - RNA, 15 nt, Homo sapiens
uugauaucugaucaa

SEQ ID NO: 1277717 - RNA, 20 nt, Homo sapiens
uugauauguaaguacuucca

SEQ ID NO: 1277718 - RNA, 13 nt, Homo sapiens
uugaucacuacaa

SEQ ID NO: 1277719 - RNA, 18 nt, Homo sapiens
uugaugaguuaacuguga

SEQ ID NO: 1277720 - RNA, 11 nt, Homo sapiens
uugauggaccc

SEQ ID NO: 1277721 - RNA, 23 nt, Homo sapiens
uugauuauucugauuccacuuuu

SEQ ID NO: 1277722 - RNA, 13 nt, Homo sapiens
uugauuauuguau

SEQ ID NO: 1277723 - RNA, 22 nt, Homo sapiens
uugauugaggagcugcacugau

SEQ ID NO: 1277724 - RNA, 14 nt, Homo sapiens
uugauugcacuuga

SEQ ID NO: 1277725 - RNA, 19 nt, Homo sapiens
uugauugucagcuacuaau

SEQ ID NO: 1277726 - RNA, 10 nt, Homo sapiens
uugauuucaa

SEQ ID NO: 1277727 - RNA, 21 nt, Homo sapiens
uugauuuuaaugaaugccuaa

SEQ ID NO: 1277728 - RNA, 19 nt, Homo sapiens
uugcaacucacugauucuc

SEQ ID NO: 1277729 - RNA, 16 nt, Homo sapiens
uugcaacucuguaaau

SEQ ID NO: 1277730 - RNA, 15 nt, Homo sapiens
uugcaagaaucauua

SEQ ID NO: 1277731 - RNA, 19 nt, Homo sapiens
uugcaagauuuaacacuaa

SEQ ID NO: 1277732 - RNA, 14 nt, Homo sapiens
uugcaauggcagcc

SEQ ID NO: 1277733 - RNA, 15 nt, Homo sapiens
uugcacaauccauga

SEQ ID NO: 1277734 - RNA, 12 nt, Homo sapiens
uugcacagcagc

SEQ ID NO: 1277735 - RNA, 19 nt, Homo sapiens
uugcacagugugugacuua

SEQ ID NO: 1277736 - RNA, 21 nt, Homo sapiens
uugcaccaggcacugcugcac

SEQ ID NO: 1277737 - RNA, 23 nt, Homo sapiens
uugcaccaggcacugcugcacaa

SEQ ID NO: 1277738 - RNA, 20 nt, Homo sapiens
uugcaccuguccccacccuc

SEQ ID NO: 1277739 - RNA, 14 nt, Homo sapiens
uugcagaacugcca

SEQ ID NO: 1277740 - RNA, 18 nt, Homo sapiens
uugcagccagggccagug

SEQ ID NO: 1277741 - RNA, 17 nt, Homo sapiens
uugcagcuggacuucuc

SEQ ID NO: 1277742 - RNA, 19 nt, Homo sapiens
uugcagcuguaaacauauu

SEQ ID NO: 1277743 - RNA, 16 nt, Homo sapiens
uugcaggagacauuuu

SEQ ID NO: 1277744 - RNA, 23 nt, Homo sapiens
uugcaggggauugaagcccucca

SEQ ID NO: 1277745 - RNA, 13 nt, Homo sapiens
uugcagggguccc

SEQ ID NO: 1277746 - RNA, 16 nt, Homo sapiens
uugcaggguccucuuc

SEQ ID NO: 1277747 - RNA, 21 nt, Homo sapiens
uugcaugaagagaagcaauuu

SEQ ID NO: 1277748 - RNA, 18 nt, Homo sapiens
uugccaaaauaccagagc

SEQ ID NO: 1277749 - RNA, 12 nt, Homo sapiens
uugccacaaagc

SEQ ID NO: 1277750 - RNA, 18 nt, Homo sapiens
uugccacagaugauacuu

SEQ ID NO: 1277751 - RNA, 12 nt, Homo sapiens
uugccacuuaac

SEQ ID NO: 1277752 - RNA, 14 nt, Homo sapiens
uugccagagccaaa

SEQ ID NO: 1277753 - RNA, 14 nt, Homo sapiens
uugccauguuggcc

SEQ ID NO: 1277754 - RNA, 17 nt, Homo sapiens
uugcccaguguucuccu

SEQ ID NO: 1277755 - RNA, 14 nt, Homo sapiens
uugcccauugcacu

SEQ ID NO: 1277756 - RNA, 22 nt, Homo sapiens
uugccuaaaauauauuccugag

SEQ ID NO: 1277757 - RNA, 18 nt, Homo sapiens
uugccuaacuaacuggca

SEQ ID NO: 1277758 - RNA, 13 nt, Homo sapiens
uugccuaccauuu

SEQ ID NO: 1277759 - RNA, 16 nt, Homo sapiens
uugccucguguaacau

SEQ ID NO: 1277760 - RNA, 15 nt, Homo sapiens
uugccucugugcugu

SEQ ID NO: 1277761 - RNA, 16 nt, Homo sapiens
uugccugccacugagc

SEQ ID NO: 1277762 - RNA, 21 nt, Homo sapiens
uugccugggggcuuuugccac

SEQ ID NO: 1277763 - RNA, 19 nt, Homo sapiens
uugccuggggucugagcau

SEQ ID NO: 1277764 - RNA, 13 nt, Homo sapiens
uugccuucauccc

SEQ ID NO: 1277765 - RNA, 22 nt, Homo sapiens
uugccuucaucuucacugcaau

SEQ ID NO: 1277766 - RNA, 16 nt, Homo sapiens
uugccuucuaggucac

SEQ ID NO: 1277767 - RNA, 13 nt, Homo sapiens
uugccuucuccac

SEQ ID NO: 1277768 - RNA, 17 nt, Homo sapiens
uugccuuucuucugccc

SEQ ID NO: 1277769 - RNA, 13 nt, Homo sapiens
uugccuuuuacuu

SEQ ID NO: 1277770 - RNA, 15 nt, Homo sapiens
uugcgauagagucuc

SEQ ID NO: 1277771 - RNA, 21 nt, Homo sapiens
uugcggaagcuguuggaugau

SEQ ID NO: 1277772 - RNA, 15 nt, Homo sapiens
uugcuaaaauauuau

SEQ ID NO: 1277773 - RNA, 20 nt, Homo sapiens
uugcuaaucagugucucaca

SEQ ID NO: 1277774 - RNA, 22 nt, Homo sapiens
uugcuacagaggaaacaauauu

SEQ ID NO: 1277775 - RNA, 12 nt, Homo sapiens
uugcuacauucu

SEQ ID NO: 1277776 - RNA, 18 nt, Homo sapiens
uugcuauaauaaagaagu

SEQ ID NO: 1277777 - RNA, 15 nt, Homo sapiens
uugcucacagcugau

SEQ ID NO: 1277778 - RNA, 23 nt, Homo sapiens
uugcucagugggggcagagccac

SEQ ID NO: 1277779 - RNA, 13 nt, Homo sapiens
uugcucccugcaa

SEQ ID NO: 1277780 - RNA, 15 nt, Homo sapiens
uugcucccugcaaga

SEQ ID NO: 1277781 - RNA, 16 nt, Homo sapiens
uugcucuuucaucucu

SEQ ID NO: 1277782 - RNA, 16 nt, Homo sapiens
uugcugaguuguucua

SEQ ID NO: 1277783 - RNA, 15 nt, Homo sapiens
guucugaaagugacu

SEQ ID NO: 1277784 - RNA, 23 nt, Homo sapiens
guucugacauuaacaguuuucca

SEQ ID NO: 1277785 - RNA, 16 nt, Homo sapiens
guucugagaccagugu

SEQ ID NO: 1277786 - RNA, 14 nt, Homo sapiens
guucugaguguuuu

SEQ ID NO: 1277787 - RNA, 19 nt, Homo sapiens
guucugaugggucccaaaa

SEQ ID NO: 1277788 - RNA, 22 nt, Homo sapiens
guucugcaagcaucaguucuac

SEQ ID NO: 1277789 - RNA, 14 nt, Homo sapiens
guucugcacugaaa

SEQ ID NO: 1277790 - RNA, 11 nt, Homo sapiens
guucugcagcc

SEQ ID NO: 1277791 - RNA, 21 nt, Homo sapiens
guucugcugggaccuuggaga

SEQ ID NO: 1277792 - RNA, 16 nt, Homo sapiens
guucuguuuggcacuu

SEQ ID NO: 1277793 - RNA, 21 nt, Homo sapiens
guucuuacacaggcuucauca

SEQ ID NO: 1277794 - RNA, 12 nt, Homo sapiens
guucuucagggc

SEQ ID NO: 1277795 - RNA, 17 nt, Homo sapiens
guucuucuggggugcua

SEQ ID NO: 1277796 - RNA, 22 nt, Homo sapiens
guucuucuuucucuguauuccg

SEQ ID NO: 1277797 - RNA, 21 nt, Homo sapiens
guucuuuaauguuguccagga

SEQ ID NO: 1277798 - RNA, 23 nt, Homo sapiens
guucuuuggaaaguacacucugc

SEQ ID NO: 1277799 - RNA, 17 nt, Homo sapiens
guucuuugucucaaaau

SEQ ID NO: 1277800 - RNA, 18 nt, Homo sapiens
guugaaccauuauacuuu

SEQ ID NO: 1277801 - RNA, 13 nt, Homo sapiens
guugaacuuugcc

SEQ ID NO: 1277802 - RNA, 15 nt, Homo sapiens
guugacaacugugac

SEQ ID NO: 1277803 - RNA, 18 nt, Homo sapiens
guugacaaggcucugcua

SEQ ID NO: 1277804 - RNA, 18 nt, Homo sapiens
guugagccccaaguccug

SEQ ID NO: 1277805 - RNA, 19 nt, Homo sapiens
guugaggccaggaguuuaa

SEQ ID NO: 1277806 - RNA, 16 nt, Homo sapiens
guugaggcugucacag

SEQ ID NO: 1277807 - RNA, 19 nt, Homo sapiens
guugagucgucaucacuuu

SEQ ID NO: 1277808 - RNA, 12 nt, Homo sapiens
guugaguguuca

SEQ ID NO: 1277809 - RNA, 20 nt, Homo sapiens
guugauaaauuccacuggac

SEQ ID NO: 1277810 - RNA, 13 nt, Homo sapiens
guugauucuugcc

SEQ ID NO: 1277811 - RNA, 19 nt, Homo sapiens
guugcaccaggcacugcug

SEQ ID NO: 1277812 - RNA, 14 nt, Homo sapiens
guugcacugauauu

SEQ ID NO: 1277813 - RNA, 17 nt, Homo sapiens
guugcagccagggcugu

SEQ ID NO: 1277814 - RNA, 15 nt, Homo sapiens
guugcauuccuuugu

SEQ ID NO: 1277815 - RNA, 12 nt, Homo sapiens
guugcauugcuu

SEQ ID NO: 1277816 - RNA, 14 nt, Homo sapiens
guugccacauuuag

SEQ ID NO: 1277817 - RNA, 17 nt, Homo sapiens
aaauaaaaugcagacag

SEQ ID NO: 1277818 - RNA, 13 nt, Homo sapiens
aaauaaacuucac

SEQ ID NO: 1277819 - RNA, 18 nt, Homo sapiens
aaauaaagaaauugcaau

SEQ ID NO: 1277820 - RNA, 16 nt, Homo sapiens
aaauaaauagcuauau

SEQ ID NO: 1277821 - RNA, 21 nt, Homo sapiens
aaauaaccacaagguccacuc

SEQ ID NO: 1277822 - RNA, 21 nt, Homo sapiens
aaauaagaauugaaugucaau

SEQ ID NO: 1277823 - RNA, 11 nt, Homo sapiens
aaauaagcaaa

SEQ ID NO: 1277824 - RNA, 14 nt, Homo sapiens
aaauaagucacuua

SEQ ID NO: 1277825 - RNA, 21 nt, Homo sapiens
aaauaagucagguucuuuaca

SEQ ID NO: 1277826 - RNA, 19 nt, Homo sapiens
aaauaauaaacaguggaau

SEQ ID NO: 1277827 - RNA, 19 nt, Homo sapiens
aaauaauaacaaucacaaa

SEQ ID NO: 1277828 - RNA, 19 nt, Homo sapiens
aaauaauauggcuaugcuu

SEQ ID NO: 1277829 - RNA, 14 nt, Homo sapiens
aaauaaucagugac

SEQ ID NO: 1277830 - RNA, 14 nt, Homo sapiens
aaauaaucaguuac

SEQ ID NO: 1277831 - RNA, 16 nt, Homo sapiens
aaauaauugauuucaa

SEQ ID NO: 1277832 - RNA, 19 nt, Homo sapiens
aaauaauuucuacucuguc

SEQ ID NO: 1277833 - RNA, 16 nt, Homo sapiens
aaauacaaaacuucca

SEQ ID NO: 1277834 - RNA, 17 nt, Homo sapiens
aaauacagauagauaua

SEQ ID NO: 1277835 - RNA, 22 nt, Homo sapiens
aaauacauaucgcugacuucau

SEQ ID NO: 1277836 - RNA, 18 nt, Homo sapiens
aaauaccagagccuucaa

SEQ ID NO: 1277837 - RNA, 16 nt, Homo sapiens
aaauacccaacgcaca

SEQ ID NO: 1277838 - RNA, 11 nt, Homo sapiens
aaauaccucau

SEQ ID NO: 1277839 - RNA, 18 nt, Homo sapiens
aaauaccuuggcugaugu

SEQ ID NO: 1277840 - RNA, 14 nt, Homo sapiens
aaauacucugcuau

SEQ ID NO: 1277841 - RNA, 13 nt, Homo sapiens
aaauacugaauua

SEQ ID NO: 1277842 - RNA, 17 nt, Homo sapiens
aaauacuguguggaacu

SEQ ID NO: 1277843 - RNA, 14 nt, Homo sapiens
aaauagacauauua

SEQ ID NO: 1277844 - RNA, 13 nt, Homo sapiens
aaauagacaugua

SEQ ID NO: 1277845 - RNA, 14 nt, Homo sapiens
aaauagacauguag

SEQ ID NO: 1277846 - RNA, 20 nt, Homo sapiens
aaauagcugugaacagagag

SEQ ID NO: 1277847 - RNA, 13 nt, Homo sapiens
aaauagucacuca

SEQ ID NO: 1277848 - RNA, 13 nt, Homo sapiens
aaauagucuucca

SEQ ID NO: 1277849 - RNA, 16 nt, Homo sapiens
aaauaguuuggauuac

SEQ ID NO: 1277850 - RNA, 14 nt, Homo sapiens
aaauauaacaggug

SEQ ID NO: 1277851 - RNA, 22 nt, Homo sapiens
aaauauagauuagaaaaauucc

SEQ ID NO: 1277852 - RNA, 13 nt, Homo sapiens
aaauauagccaaa

SEQ ID NO: 1277853 - RNA, 15 nt, Homo sapiens
aaauauauaagcuca

SEQ ID NO: 1277854 - RNA, 14 nt, Homo sapiens
aaauauauuucaga

SEQ ID NO: 1277855 - RNA, 18 nt, Homo sapiens
aaauauccuccaaugugu

SEQ ID NO: 1277856 - RNA, 15 nt, Homo sapiens
aaauaucugucauau

SEQ ID NO: 1277857 - RNA, 20 nt, Homo sapiens
aaauaugauuuuauuugaca

SEQ ID NO: 1277858 - RNA, 18 nt, Homo sapiens
aaauauuauuagauuuau

SEQ ID NO: 1277859 - RNA, 20 nt, Homo sapiens
aaauauuauugguguuuacc

SEQ ID NO: 1277860 - RNA, 22 nt, Homo sapiens
aaauauuauugguguuuaccca

SEQ ID NO: 1277861 - RNA, 13 nt, Homo sapiens
aaauauuccugca

SEQ ID NO: 1277862 - RNA, 12 nt, Homo sapiens
aaauauuucagg

SEQ ID NO: 1277863 - RNA, 20 nt, Homo sapiens
aaauauuuccuuaaacugug

SEQ ID NO: 1277864 - RNA, 16 nt, Homo sapiens
aaauauuuggucucua

SEQ ID NO: 1277865 - RNA, 22 nt, Homo sapiens
aaauauuuuggcauuguacuaa

SEQ ID NO: 1277866 - RNA, 14 nt, Homo sapiens
aaauauuuuugcca

SEQ ID NO: 1277867 - RNA, 15 nt, Homo sapiens
aaaucaauaaauucc

SEQ ID NO: 1277868 - RNA, 15 nt, Homo sapiens
aaaucaaugucacuu

SEQ ID NO: 1277869 - RNA, 13 nt, Homo sapiens
aaaucacaucucc

SEQ ID NO: 1277870 - RNA, 19 nt, Homo sapiens
aaaucacgaccacugauag

SEQ ID NO: 1277871 - RNA, 13 nt, Homo sapiens
aaaucacucucag

SEQ ID NO: 1277872 - RNA, 16 nt, Homo sapiens
aaaucacucucagugc

SEQ ID NO: 1277873 - RNA, 17 nt, Homo sapiens
aaaucagaaauaugaca

SEQ ID NO: 1277874 - RNA, 18 nt, Homo sapiens
aaaucagaccuggcugcu

SEQ ID NO: 1277875 - RNA, 14 nt, Homo sapiens
aaaucagagacaaa

SEQ ID NO: 1277876 - RNA, 17 nt, Homo sapiens
aaaucagcugcuacuac

SEQ ID NO: 1277877 - RNA, 23 nt, Homo sapiens
aaaucaggacagguggugcaaau

SEQ ID NO: 1277878 - RNA, 15 nt, Homo sapiens
aaaucauaguuuaaa

SEQ ID NO: 1277879 - RNA, 21 nt, Homo sapiens
aaaucauaguuuaaacugcau

SEQ ID NO: 1277880 - RNA, 21 nt, Homo sapiens
aaaucauauccuaugacccag

SEQ ID NO: 1277881 - RNA, 19 nt, Homo sapiens
aaaucauuaauacucuucu

SEQ ID NO: 1277882 - RNA, 17 nt, Homo sapiens
aaaucauuucaguauca

SEQ ID NO: 1277883 - RNA, 21 nt, Homo sapiens
aaauccacacacccagagcau

SEQ ID NO: 1277884 - RNA, 18 nt, Homo sapiens
aaauccagugagcacuag

SEQ ID NO: 1277885 - RNA, 15 nt, Homo sapiens
aaauccauaucuuaa

SEQ ID NO: 1277886 - RNA, 21 nt, Homo sapiens
aaaucccauggaauauuucca

SEQ ID NO: 1277887 - RNA, 22 nt, Homo sapiens
aaauccccuuaugacuugcuac

SEQ ID NO: 1277888 - RNA, 17 nt, Homo sapiens
aaauccgcuuuucugcc

SEQ ID NO: 1277889 - RNA, 17 nt, Homo sapiens
aaauccugaacuuucuc

SEQ ID NO: 1277890 - RNA, 13 nt, Homo sapiens
aaaucgugccuug

SEQ ID NO: 1277891 - RNA, 16 nt, Homo sapiens
aaaucuagaagacugu

SEQ ID NO: 1277892 - RNA, 12 nt, Homo sapiens
aaaucuauucca

SEQ ID NO: 1277893 - RNA, 17 nt, Homo sapiens
aaaucuauucuguguug

SEQ ID NO: 1277894 - RNA, 22 nt, Homo sapiens
aaaucuauucuguguugcauua

SEQ ID NO: 1277895 - RNA, 15 nt, Homo sapiens
aaaucucacaaauga

SEQ ID NO: 1277896 - RNA, 15 nt, Homo sapiens
aaaucuccaucucaa

SEQ ID NO: 1277897 - RNA, 13 nt, Homo sapiens
aaaucucuaauau

SEQ ID NO: 1277898 - RNA, 19 nt, Homo sapiens
aaaucucuacugcuuugga

SEQ ID NO: 1277899 - RNA, 23 nt, Homo sapiens
aaaucucuucuuugcugcaguca

SEQ ID NO: 1277900 - RNA, 12 nt, Homo sapiens
aaaucugaauaa

SEQ ID NO: 1277901 - RNA, 22 nt, Homo sapiens
aaaucugccacaaaaacaggua

SEQ ID NO: 1277902 - RNA, 18 nt, Homo sapiens
aaaucuguguaacuguaa

SEQ ID NO: 1277903 - RNA, 19 nt, Homo sapiens
aaaucuuguuggcaaauca

SEQ ID NO: 1277904 - RNA, 12 nt, Homo sapiens
aaaugaacauau

SEQ ID NO: 1277905 - RNA, 16 nt, Homo sapiens
aaaugaagggauauaa

SEQ ID NO: 1277906 - RNA, 21 nt, Homo sapiens
aaaugaagguuaggauuuaac

SEQ ID NO: 1277907 - RNA, 17 nt, Homo sapiens
aaaugacaugcacugac

SEQ ID NO: 1277908 - RNA, 21 nt, Homo sapiens
aaaugacuauuucuacccuuu

SEQ ID NO: 1277909 - RNA, 12 nt, Homo sapiens
aaaugagacaaa

SEQ ID NO: 1277910 - RNA, 16 nt, Homo sapiens
aaaugagagugguuag

SEQ ID NO: 1277911 - RNA, 13 nt, Homo sapiens
aaaugauacagua

SEQ ID NO: 1277912 - RNA, 19 nt, Homo sapiens
aaaugauucagcucccuua

SEQ ID NO: 1277913 - RNA, 22 nt, Homo sapiens
aaaugauuccuggacaucacca

SEQ ID NO: 1277914 - RNA, 21 nt, Homo sapiens
aaaugcagacaacaccuuccu

SEQ ID NO: 1277915 - RNA, 14 nt, Homo sapiens
aaaugcagugaauu

SEQ ID NO: 1277916 - RNA, 20 nt, Homo sapiens
aaaugcaucaaaagacuuaa

SEQ ID NO: 1277917 - RNA, 22 nt, Homo sapiens
aaaugccacguggucacugugc

SEQ ID NO: 1277918 - RNA, 16 nt, Homo sapiens
aaaugcccauuugccu

SEQ ID NO: 1277919 - RNA, 21 nt, Homo sapiens
aaaugcuagguuaauuccaau

SEQ ID NO: 1277920 - RNA, 16 nt, Homo sapiens
aaaugcuuacagggcu

SEQ ID NO: 1277921 - RNA, 12 nt, Homo sapiens
aaaugcuuccaa

SEQ ID NO: 1277922 - RNA, 15 nt, Homo sapiens
aaaugcuucugcaca

SEQ ID NO: 1277923 - RNA, 17 nt, Homo sapiens
aaaugcuucugcacaca

SEQ ID NO: 1277924 - RNA, 13 nt, Homo sapiens
aaauggcugagau

SEQ ID NO: 1277925 - RNA, 19 nt, Homo sapiens
aaaugggagacagccucuu

SEQ ID NO: 1277926 - RNA, 20 nt, Homo sapiens
aaaugggaguacugaugaaa

SEQ ID NO: 1277927 - RNA, 15 nt, Homo sapiens
aaauggguuuauuca

SEQ ID NO: 1277928 - RNA, 11 nt, Homo sapiens
aaauggugguc

SEQ ID NO: 1277929 - RNA, 15 nt, Homo sapiens
aaauguaacugugcc

SEQ ID NO: 1277930 - RNA, 18 nt, Homo sapiens
aaauguaauaaguaucac

SEQ ID NO: 1277931 - RNA, 11 nt, Homo sapiens
aaauguacaau

SEQ ID NO: 1277932 - RNA, 16 nt, Homo sapiens
aaauguacauuaauua

SEQ ID NO: 1277933 - RNA, 23 nt, Homo sapiens
aaauguaggcuuucauguugcaa

SEQ ID NO: 1277934 - RNA, 17 nt, Homo sapiens
aaauguaugugcucuua

SEQ ID NO: 1277935 - RNA, 14 nt, Homo sapiens
aaaugucacuguga

SEQ ID NO: 1277936 - RNA, 13 nt, Homo sapiens
aaaugucaucuca

SEQ ID NO: 1277937 - RNA, 13 nt, Homo sapiens
aaauguccaugau

SEQ ID NO: 1277938 - RNA, 16 nt, Homo sapiens
aaauguccguguaaaa

SEQ ID NO: 1277939 - RNA, 18 nt, Homo sapiens
aaaugucucgaguccuaa

SEQ ID NO: 1277940 - RNA, 17 nt, Homo sapiens
aaaugugcuauacugca

SEQ ID NO: 1277941 - RNA, 15 nt, Homo sapiens
aaaugugcuggucac

SEQ ID NO: 1277942 - RNA, 13 nt, Homo sapiens
aaauguggauuaa

SEQ ID NO: 1277943 - RNA, 16 nt, Homo sapiens
aaauguguaagaacaa

SEQ ID NO: 1277944 - RNA, 23 nt, Homo sapiens
aaauguuagaaaaauagcuguga

SEQ ID NO: 1277945 - RNA, 16 nt, Homo sapiens
aaauguuagauauugc

SEQ ID NO: 1277946 - RNA, 22 nt, Homo sapiens
acaaaaaauugcuccuaacucc

SEQ ID NO: 1277947 - RNA, 19 nt, Homo sapiens
acaaaaagccuuuuccaga

SEQ ID NO: 1277948 - RNA, 23 nt, Homo sapiens
acaaaaauauuagcaaacugaau

SEQ ID NO: 1277949 - RNA, 16 nt, Homo sapiens
acaaaaauuacaaaga

SEQ ID NO: 1277950 - RNA, 15 nt, Homo sapiens
acaaaaccacuggga

SEQ ID NO: 1277951 - RNA, 21 nt, Homo sapiens
acaaaacgaaaugcuaugacu

SEQ ID NO: 1277952 - RNA, 11 nt, Homo sapiens
acaaaacuaca

SEQ ID NO: 1277953 - RNA, 21 nt, Homo sapiens
acaaaagcccaauguaaugca

SEQ ID NO: 1277954 - RNA, 15 nt, Homo sapiens
acaaaagucugucuu

SEQ ID NO: 1277955 - RNA, 15 nt, Homo sapiens
acaaacaaacagaaa

SEQ ID NO: 1277956 - RNA, 11 nt, Homo sapiens
acaaacagggc

SEQ ID NO: 1277957 - RNA, 23 nt, Homo sapiens
acaaaccacaacugacacaggaa

SEQ ID NO: 1277958 - RNA, 14 nt, Homo sapiens
acaaaccacaccac

SEQ ID NO: 1277959 - RNA, 13 nt, Homo sapiens
acaaacuaaaaau

SEQ ID NO: 1277960 - RNA, 17 nt, Homo sapiens
acaaacucuacuaucca

SEQ ID NO: 1277961 - RNA, 19 nt, Homo sapiens
acaaacucugaaagaccua

SEQ ID NO: 1277962 - RNA, 23 nt, Homo sapiens
acaaacuggcugcuuuguucaau

SEQ ID NO: 1277963 - RNA, 15 nt, Homo sapiens
acaaacuucaaagag

SEQ ID NO: 1277964 - RNA, 18 nt, Homo sapiens
acaaacuucaaagaggaa

SEQ ID NO: 1277965 - RNA, 22 nt, Homo sapiens
acaaacuucccugacucuucaa

SEQ ID NO: 1277966 - RNA, 16 nt, Homo sapiens
acaaagagguguacag

SEQ ID NO: 1277967 - RNA, 19 nt, Homo sapiens
acaaagagguguacaggua

SEQ ID NO: 1277968 - RNA, 19 nt, Homo sapiens
acaaagauugagaagccau

SEQ ID NO: 1277969 - RNA, 15 nt, Homo sapiens
acaaagcacuagaga

SEQ ID NO: 1277970 - RNA, 16 nt, Homo sapiens
acaaagcagauccuca

SEQ ID NO: 1277971 - RNA, 13 nt, Homo sapiens
acaaagcaguuua

SEQ ID NO: 1277972 - RNA, 14 nt, Homo sapiens
acaaagcauuuuca

SEQ ID NO: 1277973 - RNA, 22 nt, Homo sapiens
acaaagccacccuaccaugaau

SEQ ID NO: 1277974 - RNA, 22 nt, Homo sapiens
acaaagccuguuugguagucuc

SEQ ID NO: 1277975 - RNA, 16 nt, Homo sapiens
acaaagcgagauccca

SEQ ID NO: 1277976 - RNA, 19 nt, Homo sapiens
acaaaggauacuuuuacag

SEQ ID NO: 1277977 - RNA, 14 nt, Homo sapiens
acaaaggcugagaa

SEQ ID NO: 1277978 - RNA, 14 nt, Homo sapiens
acaaaguauuugcu

SEQ ID NO: 1277979 - RNA, 15 nt, Homo sapiens
acaaagucucacugu

SEQ ID NO: 1277980 - RNA, 23 nt, Homo sapiens
acaaaguggaugccugcugcauc

SEQ ID NO: 1277981 - RNA, 13 nt, Homo sapiens
acaaaguguauac

SEQ ID NO: 1277982 - RNA, 18 nt, Homo sapiens
acaaauaaacucauuuaa

SEQ ID NO: 1277983 - RNA, 22 nt, Homo sapiens
acaaauaaauaagaucagacuc

SEQ ID NO: 1277984 - RNA, 13 nt, Homo sapiens
acaaauaauagca

SEQ ID NO: 1277985 - RNA, 16 nt, Homo sapiens
acaaauaggcucugcc

SEQ ID NO: 1277986 - RNA, 21 nt, Homo sapiens
acaaaugaucgcuaucuagca

SEQ ID NO: 1277987 - RNA, 15 nt, Homo sapiens
acaaaugcaauuuca

SEQ ID NO: 1277988 - RNA, 21 nt, Homo sapiens
acaaaugguggguacaaaaag

SEQ ID NO: 1277989 - RNA, 20 nt, Homo sapiens
acaaauguauuaaugcuaua

SEQ ID NO: 1277990 - RNA, 17 nt, Homo sapiens
acaaauuaauuuuacuc

SEQ ID NO: 1277991 - RNA, 17 nt, Homo sapiens
acaaauuagccauuuca

SEQ ID NO: 1277992 - RNA, 24 nt, Homo sapiens
acaaauuagccauuucacucucaa

SEQ ID NO: 1277993 - RNA, 22 nt, Homo sapiens
acaaauuuaugcauuucauuca

SEQ ID NO: 1277994 - RNA, 15 nt, Homo sapiens
acaacacaauaacac

SEQ ID NO: 1277995 - RNA, 12 nt, Homo sapiens
acaacacacuuu

SEQ ID NO: 1277996 - RNA, 11 nt, Homo sapiens
acaacacuuaa

SEQ ID NO: 1277997 - RNA, 22 nt, Homo sapiens
acaacaggcaguggaagcaguu

SEQ ID NO: 1277998 - RNA, 20 nt, Homo sapiens
acaacagguaaaacagggcc

SEQ ID NO: 1277999 - RNA, 13 nt, Homo sapiens
acaacagugaaaa

SEQ ID NO: 1278000 - RNA, 14 nt, Homo sapiens
acaacagugagaaa

SEQ ID NO: 1278001 - RNA, 19 nt, Homo sapiens
acaacauuuacuuaacaga

SEQ ID NO: 1278002 - RNA, 22 nt, Homo sapiens
acaacauuucucaaaugcacau

SEQ ID NO: 1278003 - RNA, 14 nt, Homo sapiens
acaacauuugcaga

SEQ ID NO: 1278004 - RNA, 16 nt, Homo sapiens
acaaccaaaaaauucu

SEQ ID NO: 1278005 - RNA, 14 nt, Homo sapiens
acaaccaucccugc

SEQ ID NO: 1278006 - RNA, 21 nt, Homo sapiens
acaaccaugagaccacuguua

SEQ ID NO: 1278007 - RNA, 21 nt, Homo sapiens
acaacccacaccgucuuccuu

SEQ ID NO: 1278008 - RNA, 16 nt, Homo sapiens
acaacuauuuuuccaa

SEQ ID NO: 1278009 - RNA, 17 nt, Homo sapiens
acaacucugaaagagaa

SEQ ID NO: 1278010 - RNA, 19 nt, Homo sapiens
acaacuggacucauuauca

SEQ ID NO: 1278011 - RNA, 22 nt, Homo sapiens
acaacuggacucauuaucacag

SEQ ID NO: 1278012 - RNA, 13 nt, Homo sapiens
acaacugugacug

SEQ ID NO: 1278013 - RNA, 17 nt, Homo sapiens
acaacuguggucaaucc

SEQ ID NO: 1278014 - RNA, 18 nt, Homo sapiens
acaacuguggucaauccg

SEQ ID NO: 1278015 - RNA, 16 nt, Homo sapiens
acaacuucagcaguac

SEQ ID NO: 1278016 - RNA, 19 nt, Homo sapiens
acaacuuggguucuucuca

SEQ ID NO: 1278017 - RNA, 21 nt, Homo sapiens
acaacuuguauuuccaaaccu

SEQ ID NO: 1278018 - RNA, 18 nt, Homo sapiens
acaacuuucucuuguaaa

SEQ ID NO: 1278019 - RNA, 21 nt, Homo sapiens
acaacuuugaaacuggaauaa

SEQ ID NO: 1278020 - RNA, 22 nt, Homo sapiens
acaacuuuuaaccaaacaauua

SEQ ID NO: 1278021 - RNA, 23 nt, Homo sapiens
acaagaaaaguugaagaagauau

SEQ ID NO: 1278022 - RNA, 16 nt, Homo sapiens
acaagaacacugaaaa

SEQ ID NO: 1278023 - RNA, 18 nt, Homo sapiens
acaagaauguaacuccag

SEQ ID NO: 1278024 - RNA, 15 nt, Homo sapiens
acaagaccaccacuu

SEQ ID NO: 1278025 - RNA, 18 nt, Homo sapiens
acaagacccccagcacuu

SEQ ID NO: 1278026 - RNA, 18 nt, Homo sapiens
acaagaccccgucucaaa

SEQ ID NO: 1278027 - RNA, 15 nt, Homo sapiens
acaagaccucagugc

SEQ ID NO: 1278028 - RNA, 16 nt, Homo sapiens
acaagagugaauuuga

SEQ ID NO: 1278029 - RNA, 12 nt, Homo sapiens
acaagauaccaa

SEQ ID NO: 1278030 - RNA, 20 nt, Homo sapiens
acaagauccuccugcugcag

SEQ ID NO: 1278031 - RNA, 18 nt, Homo sapiens
acaagaucuguaauguua

SEQ ID NO: 1278032 - RNA, 17 nt, Homo sapiens
acaagauuuccuacuuu

SEQ ID NO: 1278033 - RNA, 14 nt, Homo sapiens
acaagcaaugcaag

SEQ ID NO: 1278034 - RNA, 13 nt, Homo sapiens
acaagcacuuugg

SEQ ID NO: 1278035 - RNA, 17 nt, Homo sapiens
acaagcauucaagaaac

SEQ ID NO: 1278036 - RNA, 21 nt, Homo sapiens
acaagcauucaagaaacugau

SEQ ID NO: 1278037 - RNA, 17 nt, Homo sapiens
acaagccaacuuguaaa

SEQ ID NO: 1278038 - RNA, 23 nt, Homo sapiens
acaagcccacagcacagcucccu

SEQ ID NO: 1278039 - RNA, 16 nt, Homo sapiens
acaagccuuagcuuuu

SEQ ID NO: 1278040 - RNA, 20 nt, Homo sapiens
acaagcgugagccacugcac

SEQ ID NO: 1278041 - RNA, 15 nt, Homo sapiens
acaagcuuuaugugg

SEQ ID NO: 1278042 - RNA, 12 nt, Homo sapiens
acaaggcuccaa

SEQ ID NO: 1278043 - RNA, 15 nt, Homo sapiens
acaaggcugaccaag

SEQ ID NO: 1278044 - RNA, 18 nt, Homo sapiens
acaaguaaaacuguggua

SEQ ID NO: 1278045 - RNA, 21 nt, Homo sapiens
acaaguaccacucuuggucag

SEQ ID NO: 1278046 - RNA, 12 nt, Homo sapiens
acaagucuucca

SEQ ID NO: 1278047 - RNA, 15 nt, Homo sapiens
acaagugcugaacag

SEQ ID NO: 1278048 - RNA, 15 nt, Homo sapiens
acaaguuucagacag

SEQ ID NO: 1278049 - RNA, 21 nt, Homo sapiens
acaaguuucugauaccacugc

SEQ ID NO: 1278050 - RNA, 13 nt, Homo sapiens
acaauaaaagcuu

SEQ ID NO: 1278051 - RNA, 23 nt, Homo sapiens
acaauaaagauuguuuuaaagag

SEQ ID NO: 1278052 - RNA, 13 nt, Homo sapiens
acaauaaagcaau

SEQ ID NO: 1278053 - RNA, 14 nt, Homo sapiens
acaauaaagcaaug

SEQ ID NO: 1278054 - RNA, 14 nt, Homo sapiens
acaauaaauguauu

SEQ ID NO: 1278055 - RNA, 21 nt, Homo sapiens
acaauaauauuucaagugccu

SEQ ID NO: 1278056 - RNA, 17 nt, Homo sapiens
acaauacaugcugcuaa

SEQ ID NO: 1278057 - RNA, 16 nt, Homo sapiens
acaauaggucuuucuc

SEQ ID NO: 1278058 - RNA, 21 nt, Homo sapiens
acaauaggugcuuauucucaa

SEQ ID NO: 1278059 - RNA, 15 nt, Homo sapiens
acaauauacuuguau

SEQ ID NO: 1278060 - RNA, 15 nt, Homo sapiens
acaauauucaaucaa

SEQ ID NO: 1278061 - RNA, 16 nt, Homo sapiens
acaauauucaaucaaa

SEQ ID NO: 1278062 - RNA, 23 nt, Homo sapiens
acaaucaacucuaauagugcuua

SEQ ID NO: 1278063 - RNA, 18 nt, Homo sapiens
acaaucaugaacagcucu

SEQ ID NO: 1278064 - RNA, 20 nt, Homo sapiens
acaaucauuguuuugaauau

SEQ ID NO: 1278065 - RNA, 15 nt, Homo sapiens
acaauccaucucuca

SEQ ID NO: 1278066 - RNA, 23 nt, Homo sapiens
acaauccuucuauucuagccugc

SEQ ID NO: 1278067 - RNA, 16 nt, Homo sapiens
acaauccuugccacag

SEQ ID NO: 1278068 - RNA, 16 nt, Homo sapiens
acaaucuuugcuguau

SEQ ID NO: 1278069 - RNA, 11 nt, Homo sapiens
acaaugcugau

SEQ ID NO: 1278070 - RNA, 19 nt, Homo sapiens
acaauggaagauuugccca

SEQ ID NO: 1278071 - RNA, 18 nt, Homo sapiens
acaauggucucagccuag

SEQ ID NO: 1278072 - RNA, 13 nt, Homo sapiens
acaaugugcugga

SEQ ID NO: 1278073 - RNA, 17 nt, Homo sapiens
agacaccagcagcccug

SEQ ID NO: 1278074 - RNA, 18 nt, Homo sapiens
agacaccuugacagggca

SEQ ID NO: 1278075 - RNA, 21 nt, Homo sapiens
agacaccuuggacauccuccu

SEQ ID NO: 1278076 - RNA, 18 nt, Homo sapiens
agacacguggccucguga

SEQ ID NO: 1278077 - RNA, 22 nt, Homo sapiens
agacacugaaaaaucuaaguga

SEQ ID NO: 1278078 - RNA, 15 nt, Homo sapiens
agacacuuaacucaa

SEQ ID NO: 1278079 - RNA, 12 nt, Homo sapiens
agacagacccca

SEQ ID NO: 1278080 - RNA, 20 nt, Homo sapiens
agacagaguuuucacucuua

SEQ ID NO: 1278081 - RNA, 16 nt, Homo sapiens
agacagcagggacaag

SEQ ID NO: 1278082 - RNA, 19 nt, Homo sapiens
agacaggaagguggugcuu

SEQ ID NO: 1278083 - RNA, 22 nt, Homo sapiens
agacaggcaaauguacuucuca

SEQ ID NO: 1278084 - RNA, 19 nt, Homo sapiens
agacaggguuucacugugu

SEQ ID NO: 1278085 - RNA, 18 nt, Homo sapiens
agacaguaugagucaaug

SEQ ID NO: 1278086 - RNA, 19 nt, Homo sapiens
agacaguguuuucugggau

SEQ ID NO: 1278087 - RNA, 16 nt, Homo sapiens
agacaguuauugcaag

SEQ ID NO: 1278088 - RNA, 15 nt, Homo sapiens
agacauaaagccaug

SEQ ID NO: 1278089 - RNA, 16 nt, Homo sapiens
agacauaaauguucac

SEQ ID NO: 1278090 - RNA, 15 nt, Homo sapiens
agacauacauuucuc

SEQ ID NO: 1278091 - RNA, 16 nt, Homo sapiens
agacauacauuucuca

SEQ ID NO: 1278092 - RNA, 11 nt, Homo sapiens
agacauacucc

SEQ ID NO: 1278093 - RNA, 17 nt, Homo sapiens
agacauacuccuuccau

SEQ ID NO: 1278094 - RNA, 22 nt, Homo sapiens
agacauagcauccaaguggcau

SEQ ID NO: 1278095 - RNA, 14 nt, Homo sapiens
agacaucacaagaa

SEQ ID NO: 1278096 - RNA, 17 nt, Homo sapiens
agacauccugagcagug

SEQ ID NO: 1278097 - RNA, 21 nt, Homo sapiens
agacaucggccuccaugaccu

SEQ ID NO: 1278098 - RNA, 15 nt, Homo sapiens
agacaugcagcuuuc

SEQ ID NO: 1278099 - RNA, 21 nt, Homo sapiens
agacauggaagagagagccau

SEQ ID NO: 1278100 - RNA, 23 nt, Homo sapiens
agacaugucuagccacugaucau

SEQ ID NO: 1278101 - RNA, 14 nt, Homo sapiens
agacaugugacauu

SEQ ID NO: 1278102 - RNA, 17 nt, Homo sapiens
agacaugugacauuuau

SEQ ID NO: 1278103 - RNA, 15 nt, Homo sapiens
agacaugugcacuug

SEQ ID NO: 1278104 - RNA, 23 nt, Homo sapiens
agacauuacaauguguaauggaa

SEQ ID NO: 1278105 - RNA, 17 nt, Homo sapiens
agacauuucucuaacuc

SEQ ID NO: 1278106 - RNA, 18 nt, Homo sapiens
agaccaaagcauugccug

SEQ ID NO: 1278107 - RNA, 17 nt, Homo sapiens
agaccaaguccuggcua

SEQ ID NO: 1278108 - RNA, 15 nt, Homo sapiens
agaccaccacauuga

SEQ ID NO: 1278109 - RNA, 15 nt, Homo sapiens
agaccacuguuauca

SEQ ID NO: 1278110 - RNA, 18 nt, Homo sapiens
agaccagaagauucuauc

SEQ ID NO: 1278111 - RNA, 19 nt, Homo sapiens
agaccagggugguugggac

SEQ ID NO: 1278112 - RNA, 16 nt, Homo sapiens
agaccaggucuuguuu

SEQ ID NO: 1278113 - RNA, 17 nt, Homo sapiens
agaccaguguaucaggu

SEQ ID NO: 1278114 - RNA, 14 nt, Homo sapiens
agaccauaauguua

SEQ ID NO: 1278115 - RNA, 15 nt, Homo sapiens
agaccauaauguuac

SEQ ID NO: 1278116 - RNA, 17 nt, Homo sapiens
agacccaccacaccgca

SEQ ID NO: 1278117 - RNA, 17 nt, Homo sapiens
agacccaggucuuccag

SEQ ID NO: 1278118 - RNA, 14 nt, Homo sapiens
agacccaguggacu

SEQ ID NO: 1278119 - RNA, 13 nt, Homo sapiens
agaccccaucucu

SEQ ID NO: 1278120 - RNA, 22 nt, Homo sapiens
agacccuuauugcuguccugga

SEQ ID NO: 1278121 - RNA, 20 nt, Homo sapiens
agaccguccuggagcuggag

SEQ ID NO: 1278122 - RNA, 12 nt, Homo sapiens
agaccuacccuc

SEQ ID NO: 1278123 - RNA, 12 nt, Homo sapiens
agaccuaccuca

SEQ ID NO: 1278124 - RNA, 16 nt, Homo sapiens
agaccuaggauuucau

SEQ ID NO: 1278125 - RNA, 21 nt, Homo sapiens
agaccuccagaaaucuauucc

SEQ ID NO: 1278126 - RNA, 21 nt, Homo sapiens
agaccucuccuuccuacccuc

SEQ ID NO: 1278127 - RNA, 15 nt, Homo sapiens
agaccugagguuggg

SEQ ID NO: 1278128 - RNA, 21 nt, Homo sapiens
agaccuggagcggcuauucca

SEQ ID NO: 1278129 - RNA, 12 nt, Homo sapiens
agaccuggccaa

SEQ ID NO: 1278130 - RNA, 20 nt, Homo sapiens
agaccuguguuacuaaaaaa

SEQ ID NO: 1278131 - RNA, 20 nt, Homo sapiens
agaccuuccaaggacauauu

SEQ ID NO: 1278132 - RNA, 19 nt, Homo sapiens
agaccuuccauaaugcuac

SEQ ID NO: 1278133 - RNA, 20 nt, Homo sapiens
agacgcagacaugugcacuu

SEQ ID NO: 1278134 - RNA, 18 nt, Homo sapiens
agacgcagagcaaaugag

SEQ ID NO: 1278135 - RNA, 18 nt, Homo sapiens
agacgccuuccaggucag

SEQ ID NO: 1278136 - RNA, 20 nt, Homo sapiens
agacggagucucucacuguc

SEQ ID NO: 1278137 - RNA, 12 nt, Homo sapiens
agacuaaggugg

SEQ ID NO: 1278138 - RNA, 18 nt, Homo sapiens
agacuacacaggaugagg

SEQ ID NO: 1278139 - RNA, 16 nt, Homo sapiens
agacuagacuacucaa

SEQ ID NO: 1278140 - RNA, 19 nt, Homo sapiens
agacuagauguaguauuuu

SEQ ID NO: 1278141 - RNA, 13 nt, Homo sapiens
agacuagcaggcu

SEQ ID NO: 1278142 - RNA, 13 nt, Homo sapiens
agacuauauacau

SEQ ID NO: 1278143 - RNA, 15 nt, Homo sapiens
agacuaucaguuccc

SEQ ID NO: 1278144 - RNA, 23 nt, Homo sapiens
agacuauuaauaaauaagacugu

SEQ ID NO: 1278145 - RNA, 19 nt, Homo sapiens
agacuauuaggugcaauuu

SEQ ID NO: 1278146 - RNA, 12 nt, Homo sapiens
agacucaccuca

SEQ ID NO: 1278147 - RNA, 17 nt, Homo sapiens
agacucaucuuacugua

SEQ ID NO: 1278148 - RNA, 15 nt, Homo sapiens
agacucuaguauuua

SEQ ID NO: 1278149 - RNA, 14 nt, Homo sapiens
agacucuauucuca

SEQ ID NO: 1278150 - RNA, 18 nt, Homo sapiens
agacucugggcugucagc

SEQ ID NO: 1278151 - RNA, 15 nt, Homo sapiens
agacucugguguucu

SEQ ID NO: 1278152 - RNA, 17 nt, Homo sapiens
agacucuguaauugaau

SEQ ID NO: 1278153 - RNA, 19 nt, Homo sapiens
agacucuguaauugaauau

SEQ ID NO: 1278154 - RNA, 14 nt, Homo sapiens
agacucugucucaa

SEQ ID NO: 1278155 - RNA, 18 nt, Homo sapiens
agacugaacauguuuaca

SEQ ID NO: 1278156 - RNA, 17 nt, Homo sapiens
agacugacaaccucauc

SEQ ID NO: 1278157 - RNA, 16 nt, Homo sapiens
agacugacugcaagcc

SEQ ID NO: 1278158 - RNA, 23 nt, Homo sapiens
agacugccuucuccaucaugccc

SEQ ID NO: 1278159 - RNA, 17 nt, Homo sapiens
agacuggaagcacagcu

SEQ ID NO: 1278160 - RNA, 19 nt, Homo sapiens
agacuggaaugcagugaca

SEQ ID NO: 1278161 - RNA, 20 nt, Homo sapiens
agacugggucucgcuuuguu

SEQ ID NO: 1278162 - RNA, 21 nt, Homo sapiens
agacugggucucgcuuuguug

SEQ ID NO: 1278163 - RNA, 17 nt, Homo sapiens
agacugguuuucugcca

SEQ ID NO: 1278164 - RNA, 14 nt, Homo sapiens
agacuguacuggcc

SEQ ID NO: 1278165 - RNA, 17 nt, Homo sapiens
agacugucagcuuccaa

SEQ ID NO: 1278166 - RNA, 19 nt, Homo sapiens
agacugucccugaaaccua

SEQ ID NO: 1278167 - RNA, 20 nt, Homo sapiens
agacugugacaacugucuaa

SEQ ID NO: 1278168 - RNA, 17 nt, Homo sapiens
agacuguugccacuuaa

SEQ ID NO: 1278169 - RNA, 14 nt, Homo sapiens
agacuguugcucaa

SEQ ID NO: 1278170 - RNA, 15 nt, Homo sapiens
agacuguugcucaaa

SEQ ID NO: 1278171 - RNA, 16 nt, Homo sapiens
agacuuacucuaagau

SEQ ID NO: 1278172 - RNA, 17 nt, Homo sapiens
agacuuauguauuagcu

SEQ ID NO: 1278173 - RNA, 17 nt, Homo sapiens
agacuucagcuguuccu

SEQ ID NO: 1278174 - RNA, 17 nt, Homo sapiens
agacuuccaucuaguca

SEQ ID NO: 1278175 - RNA, 23 nt, Homo sapiens
agacuuccccucaacaugcugcc

SEQ ID NO: 1278176 - RNA, 16 nt, Homo sapiens
agacuucgacucagga

SEQ ID NO: 1278177 - RNA, 21 nt, Homo sapiens
agacuucuuccucuagacuug

SEQ ID NO: 1278178 - RNA, 19 nt, Homo sapiens
agacuuggggaaauugcuu

SEQ ID NO: 1278179 - RNA, 14 nt, Homo sapiens
agacuugguuucaa

SEQ ID NO: 1278180 - RNA, 20 nt, Homo sapiens
agacuuuacauggaugccaa

SEQ ID NO: 1278181 - RNA, 18 nt, Homo sapiens
agacuuucuuaucacuua

SEQ ID NO: 1278182 - RNA, 19 nt, Homo sapiens
agacuuuuuuuuaacacuu

SEQ ID NO: 1278183 - RNA, 15 nt, Homo sapiens
agagaaaaaccaaug

SEQ ID NO: 1278184 - RNA, 16 nt, Homo sapiens
agagaaaaaccaauga

SEQ ID NO: 1278185 - RNA, 13 nt, Homo sapiens
agagaaagccagg

SEQ ID NO: 1278186 - RNA, 12 nt, Homo sapiens
agagaaagggag

SEQ ID NO: 1278187 - RNA, 13 nt, Homo sapiens
agagaaaguguga

SEQ ID NO: 1278188 - RNA, 16 nt, Homo sapiens
agagaaauacuuucag

SEQ ID NO: 1278189 - RNA, 13 nt, Homo sapiens
agagaaauucugu

SEQ ID NO: 1278190 - RNA, 16 nt, Homo sapiens
agagaagcaaguggcu

SEQ ID NO: 1278191 - RNA, 20 nt, Homo sapiens
agagaauccauccaaaguuc

SEQ ID NO: 1278192 - RNA, 20 nt, Homo sapiens
agagaauucucuuauccaac

SEQ ID NO: 1278193 - RNA, 15 nt, Homo sapiens
agagaauuggcucaa

SEQ ID NO: 1278194 - RNA, 17 nt, Homo sapiens
agagaauuuucugcauu

SEQ ID NO: 1278195 - RNA, 13 nt, Homo sapiens
agagacagaauuc

SEQ ID NO: 1278196 - RNA, 14 nt, Homo sapiens
agagacagaauuca

SEQ ID NO: 1278197 - RNA, 21 nt, Homo sapiens
agagacagaggcgcccugggu

SEQ ID NO: 1278198 - RNA, 11 nt, Homo sapiens
agagacagggu

SEQ ID NO: 1278199 - RNA, 18 nt, Homo sapiens
agagacuacagagucaaa

SEQ ID NO: 1278200 - RNA, 15 nt, Homo sapiens
agagacuauggagcc

SEQ ID NO: 1278201 - RNA, 21 nt, Homo sapiens
acccagacuggaaugcaguga

SEQ ID NO: 1278202 - RNA, 21 nt, Homo sapiens
acccagagaguccugugcuga

SEQ ID NO: 1278203 - RNA, 19 nt, Homo sapiens
acccagauuuccuaacucu

SEQ ID NO: 1278204 - RNA, 15 nt, Homo sapiens
acccagcuacucugu

SEQ ID NO: 1278205 - RNA, 20 nt, Homo sapiens
acccagcuugugccuguggu

SEQ ID NO: 1278206 - RNA, 16 nt, Homo sapiens
acccaggaccaagcca

SEQ ID NO: 1278207 - RNA, 17 nt, Homo sapiens
acccaggaguguggcca

SEQ ID NO: 1278208 - RNA, 16 nt, Homo sapiens
acccaggcaugggcag

SEQ ID NO: 1278209 - RNA, 15 nt, Homo sapiens
acccaggcccagcug

SEQ ID NO: 1278210 - RNA, 16 nt, Homo sapiens
acccaggcccagcuga

SEQ ID NO: 1278211 - RNA, 19 nt, Homo sapiens
acccaggcccgcaccgcug

SEQ ID NO: 1278212 - RNA, 20 nt, Homo sapiens
acccaggcuggagugcagug

SEQ ID NO: 1278213 - RNA, 15 nt, Homo sapiens
acccaguccugcaca

SEQ ID NO: 1278214 - RNA, 20 nt, Homo sapiens
acccagucuucuacacagau

SEQ ID NO: 1278215 - RNA, 20 nt, Homo sapiens
acccagugcugccaugccac

SEQ ID NO: 1278216 - RNA, 23 nt, Homo sapiens
acccaguucugaauaacuugaag

SEQ ID NO: 1278217 - RNA, 14 nt, Homo sapiens
acccaguugccaaa

SEQ ID NO: 1278218 - RNA, 14 nt, Homo sapiens
acccauaccacagc

SEQ ID NO: 1278219 - RNA, 15 nt, Homo sapiens
acccaucugcucacc

SEQ ID NO: 1278220 - RNA, 23 nt, Homo sapiens
acccaucugcucaccagaucuca

SEQ ID NO: 1278221 - RNA, 16 nt, Homo sapiens
acccauuaaauuaaga

SEQ ID NO: 1278222 - RNA, 16 nt, Homo sapiens
acccauucacuacagg

SEQ ID NO: 1278223 - RNA, 17 nt, Homo sapiens
acccauucagagacugu

SEQ ID NO: 1278224 - RNA, 17 nt, Homo sapiens
acccauuccuguguaau

SEQ ID NO: 1278225 - RNA, 16 nt, Homo sapiens
acccauuucaaugugu

SEQ ID NO: 1278226 - RNA, 21 nt, Homo sapiens
acccauuucuacuuuuugcac

SEQ ID NO: 1278227 - RNA, 14 nt, Homo sapiens
acccauuuuugcuc

SEQ ID NO: 1278228 - RNA, 15 nt, Homo sapiens
accccaaaccuggca

SEQ ID NO: 1278229 - RNA, 12 nt, Homo sapiens
accccacagacu

SEQ ID NO: 1278230 - RNA, 15 nt, Homo sapiens
accccacucuaccuc

SEQ ID NO: 1278231 - RNA, 12 nt, Homo sapiens
accccacugcaa

SEQ ID NO: 1278232 - RNA, 13 nt, Homo sapiens
accccagccugaa

SEQ ID NO: 1278233 - RNA, 16 nt, Homo sapiens
accccagcucaugccc

SEQ ID NO: 1278234 - RNA, 19 nt, Homo sapiens
accccagggccuacugcca

SEQ ID NO: 1278235 - RNA, 18 nt, Homo sapiens
accccaguggauucucau

SEQ ID NO: 1278236 - RNA, 14 nt, Homo sapiens
accccaugccaaag

SEQ ID NO: 1278237 - RNA, 15 nt, Homo sapiens
accccauuucuacua

SEQ ID NO: 1278238 - RNA, 20 nt, Homo sapiens
accccauuucuacuaaaaau

SEQ ID NO: 1278239 - RNA, 13 nt, Homo sapiens
acccccagcacuu

SEQ ID NO: 1278240 - RNA, 17 nt, Homo sapiens
acccccaucucuacuaa

SEQ ID NO: 1278241 - RNA, 13 nt, Homo sapiens
acccccaucuuua

SEQ ID NO: 1278242 - RNA, 16 nt, Homo sapiens
acccccaucuuuacaa

SEQ ID NO: 1278243 - RNA, 12 nt, Homo sapiens
acccccugccca

SEQ ID NO: 1278244 - RNA, 13 nt, Homo sapiens
acccccugcccug

SEQ ID NO: 1278245 - RNA, 21 nt, Homo sapiens
acccccugcuccaccagcagc

SEQ ID NO: 1278246 - RNA, 17 nt, Homo sapiens
acccccuuugugcugug

SEQ ID NO: 1278247 - RNA, 22 nt, Homo sapiens
accccgaccaccugcccaaccu

SEQ ID NO: 1278248 - RNA, 21 nt, Homo sapiens
accccggcaggcccugcagug

SEQ ID NO: 1278249 - RNA, 20 nt, Homo sapiens
accccggggacccugugaca

SEQ ID NO: 1278250 - RNA, 15 nt, Homo sapiens
accccucauccaaag

SEQ ID NO: 1278251 - RNA, 18 nt, Homo sapiens
accccucccucuguccac

SEQ ID NO: 1278252 - RNA, 23 nt, Homo sapiens
accccucccucuguccaccagcc

SEQ ID NO: 1278253 - RNA, 23 nt, Homo sapiens
accccuccggacauccagcguga

SEQ ID NO: 1278254 - RNA, 15 nt, Homo sapiens
accccucuaccuccu

SEQ ID NO: 1278255 - RNA, 13 nt, Homo sapiens
accccugaccuca

SEQ ID NO: 1278256 - RNA, 18 nt, Homo sapiens
accccugaccucacugug

SEQ ID NO: 1278257 - RNA, 22 nt, Homo sapiens
accccugcucaguaaagcacuu

SEQ ID NO: 1278258 - RNA, 14 nt, Homo sapiens
accccugucccaac

SEQ ID NO: 1278259 - RNA, 17 nt, Homo sapiens
accccuguuucuggcac

SEQ ID NO: 1278260 - RNA, 22 nt, Homo sapiens
accccuuacuuagcaugcacaa

SEQ ID NO: 1278261 - RNA, 22 nt, Homo sapiens
accccuuucuaguucaaugccu

SEQ ID NO: 1278262 - RNA, 15 nt, Homo sapiens
acccgagaagcacuu

SEQ ID NO: 1278263 - RNA, 16 nt, Homo sapiens
acccggagagugcucc

SEQ ID NO: 1278264 - RNA, 21 nt, Homo sapiens
acccgggaggcagagguugca

SEQ ID NO: 1278265 - RNA, 22 nt, Homo sapiens
acccuaacacaguauaucccaa

SEQ ID NO: 1278266 - RNA, 19 nt, Homo sapiens
acccuacacccagacccca

SEQ ID NO: 1278267 - RNA, 14 nt, Homo sapiens
acccuaccaugaau

SEQ ID NO: 1278268 - RNA, 20 nt, Homo sapiens
acccuacuucuuuugcucuu

SEQ ID NO: 1278269 - RNA, 20 nt, Homo sapiens
acccuagccuugcuuguuaa

SEQ ID NO: 1278270 - RNA, 21 nt, Homo sapiens
acccuauuuagaaauggauuu

SEQ ID NO: 1278271 - RNA, 19 nt, Homo sapiens
acccucacaagcaugaagu

SEQ ID NO: 1278272 - RNA, 14 nt, Homo sapiens
acccucauacacag

SEQ ID NO: 1278273 - RNA, 17 nt, Homo sapiens
acccucauuucucaucu

SEQ ID NO: 1278274 - RNA, 21 nt, Homo sapiens
acccuccacucagcuguccug

SEQ ID NO: 1278275 - RNA, 23 nt, Homo sapiens
acccuccuccccacacagacucc

SEQ ID NO: 1278276 - RNA, 13 nt, Homo sapiens
acccuccucuugg

SEQ ID NO: 1278277 - RNA, 19 nt, Homo sapiens
acccuccuuccacauguac

SEQ ID NO: 1278278 - RNA, 14 nt, Homo sapiens
acccucgaugaagc

SEQ ID NO: 1278279 - RNA, 16 nt, Homo sapiens
acccucgcaugacugu

SEQ ID NO: 1278280 - RNA, 20 nt, Homo sapiens
acccucgcaugacuguuaca

SEQ ID NO: 1278281 - RNA, 21 nt, Homo sapiens
acccucgggccccauccucau

SEQ ID NO: 1278282 - RNA, 19 nt, Homo sapiens
acccucugccaccagagac

SEQ ID NO: 1278283 - RNA, 21 nt, Homo sapiens
acccugacacggacugugcau

SEQ ID NO: 1278284 - RNA, 16 nt, Homo sapiens
acccugagacuuggcu

SEQ ID NO: 1278285 - RNA, 18 nt, Homo sapiens
acccugcccgcucccaac

SEQ ID NO: 1278286 - RNA, 22 nt, Homo sapiens
acccugcugaccucccagugac

SEQ ID NO: 1278287 - RNA, 19 nt, Homo sapiens
agaaugaaauguaugugcu

SEQ ID NO: 1278288 - RNA, 20 nt, Homo sapiens
agaaugaaauguaugugcuc

SEQ ID NO: 1278289 - RNA, 21 nt, Homo sapiens
agaaugaauacugggaaucaa

SEQ ID NO: 1278290 - RNA, 20 nt, Homo sapiens
agaaugacuccaccuucuca

SEQ ID NO: 1278291 - RNA, 23 nt, Homo sapiens
agaaugaucagcaucugugaugg

SEQ ID NO: 1278292 - RNA, 16 nt, Homo sapiens
agaaugauuaaucaaa

SEQ ID NO: 1278293 - RNA, 22 nt, Homo sapiens
agaaugcugcaggacuugagaa

SEQ ID NO: 1278294 - RNA, 18 nt, Homo sapiens
agaauggagaggaacaca

SEQ ID NO: 1278295 - RNA, 14 nt, Homo sapiens
agaauggagcagua

SEQ ID NO: 1278296 - RNA, 18 nt, Homo sapiens
agaaugguugaguuacau

SEQ ID NO: 1278297 - RNA, 21 nt, Homo sapiens
agaaugguugaguuacauuaa

SEQ ID NO: 1278298 - RNA, 22 nt, Homo sapiens
agaaugguugaguuacauuaaa

SEQ ID NO: 1278299 - RNA, 15 nt, Homo sapiens
agaauguaacuccag

SEQ ID NO: 1278300 - RNA, 23 nt, Homo sapiens
agaauguagacagguauaaugau

SEQ ID NO: 1278301 - RNA, 21 nt, Homo sapiens
agaauguuacuuuggaaugac

SEQ ID NO: 1278302 - RNA, 16 nt, Homo sapiens
agaauuauaagucaca

SEQ ID NO: 1278303 - RNA, 23 nt, Homo sapiens
agaauuauauuagucuguuugca

SEQ ID NO: 1278304 - RNA, 14 nt, Homo sapiens
agaauuauguaaua

SEQ ID NO: 1278305 - RNA, 19 nt, Homo sapiens
agaauucacagaaccuacu

SEQ ID NO: 1278306 - RNA, 16 nt, Homo sapiens
agaauugguugccaua

SEQ ID NO: 1278307 - RNA, 16 nt, Homo sapiens
agaauuguaugucaug

SEQ ID NO: 1278308 - RNA, 21 nt, Homo sapiens
agaauuguuccaguacuaugg

SEQ ID NO: 1278309 - RNA, 15 nt, Homo sapiens
agaauuuucugcauu

SEQ ID NO: 1278310 - RNA, 16 nt, Homo sapiens
agaauuuucugcauua

SEQ ID NO: 1278311 - RNA, 18 nt, Homo sapiens
agacaaaauaaacauuuu

SEQ ID NO: 1278312 - RNA, 17 nt, Homo sapiens
agacaaaguaauuccuc

SEQ ID NO: 1278313 - RNA, 15 nt, Homo sapiens
agacaacauuucuca

SEQ ID NO: 1278314 - RNA, 23 nt, Homo sapiens
agacaacgaugaauuucuucuaa

SEQ ID NO: 1278315 - RNA, 16 nt, Homo sapiens
agacaagcugcauuuc

SEQ ID NO: 1278316 - RNA, 19 nt, Homo sapiens
agacaaguuccaugggaua

SEQ ID NO: 1278317 - RNA, 13 nt, Homo sapiens
agacaauauacaa

SEQ ID NO: 1278318 - RNA, 14 nt, Homo sapiens
agacaauaugugag

SEQ ID NO: 1278319 - RNA, 20 nt, Homo sapiens
agacacaacuauuuuuccaa

SEQ ID NO: 1278320 - RNA, 17 nt, Homo sapiens
agacacauacagagugg

SEQ ID NO: 1278321 - RNA, 17 nt, Homo sapiens
agacacaucuccuccau

SEQ ID NO: 1278322 - RNA, 16 nt, Homo sapiens
agacaccaaaguucua

SEQ ID NO: 1278323 - RNA, 18 nt, Homo sapiens
agacaccaaguuccguca

SEQ ID NO: 1278324 - RNA, 17 nt, Homo sapiens
agaucugcacucaccuc

SEQ ID NO: 1278325 - RNA, 14 nt, Homo sapiens
agaucuuuacucuu

SEQ ID NO: 1278326 - RNA, 17 nt, Homo sapiens
agaucuuucaggaaaga

SEQ ID NO: 1278327 - RNA, 13 nt, Homo sapiens
agaugaaccacau

SEQ ID NO: 1278328 - RNA, 20 nt, Homo sapiens
agaugaaggagaggcaacau

SEQ ID NO: 1278329 - RNA, 14 nt, Homo sapiens
agaugagguucuga

SEQ ID NO: 1278330 - RNA, 14 nt, Homo sapiens
agaugagugauccu

SEQ ID NO: 1278331 - RNA, 19 nt, Homo sapiens
agaugauggaugccaauau

SEQ ID NO: 1278332 - RNA, 14 nt, Homo sapiens
agaugauuguucaa

SEQ ID NO: 1278333 - RNA, 15 nt, Homo sapiens
agaugcaaccucacu

SEQ ID NO: 1278334 - RNA, 14 nt, Homo sapiens
agaugcauacaaag

SEQ ID NO: 1278335 - RNA, 15 nt, Homo sapiens
agaugccugugaaau

SEQ ID NO: 1278336 - RNA, 18 nt, Homo sapiens
agaugcuaaaaucccugg

SEQ ID NO: 1278337 - RNA, 22 nt, Homo sapiens
agaugcuguaggugguauguga

SEQ ID NO: 1278338 - RNA, 14 nt, Homo sapiens
agaugcuguaguaa

SEQ ID NO: 1278339 - RNA, 22 nt, Homo sapiens
agauggaaaaacugaggcuuag

SEQ ID NO: 1278340 - RNA, 20 nt, Homo sapiens
agauggaguucuugugccau

SEQ ID NO: 1278341 - RNA, 14 nt, Homo sapiens
agauggcacuuuga

SEQ ID NO: 1278342 - RNA, 16 nt, Homo sapiens
agauggcugugccucu

SEQ ID NO: 1278343 - RNA, 22 nt, Homo sapiens
agaugggcaaauuaaggcauaa

SEQ ID NO: 1278344 - RNA, 22 nt, Homo sapiens
agauguaagaaauguucuugca

SEQ ID NO: 1278345 - RNA, 17 nt, Homo sapiens
agauguauauauuuccu

SEQ ID NO: 1278346 - RNA, 17 nt, Homo sapiens
agaugucagcuucccag

SEQ ID NO: 1278347 - RNA, 16 nt, Homo sapiens
agaugugaaaacaucu

SEQ ID NO: 1278348 - RNA, 18 nt, Homo sapiens
agaugugaaaacaucuca

SEQ ID NO: 1278349 - RNA, 19 nt, Homo sapiens
agaugugaaaacaucucaa

SEQ ID NO: 1278350 - RNA, 19 nt, Homo sapiens
agaugugaaaauaaagcag

SEQ ID NO: 1278351 - RNA, 19 nt, Homo sapiens
agaugugauauucuaagac

SEQ ID NO: 1278352 - RNA, 19 nt, Homo sapiens
agauguggcaaagugcugu

SEQ ID NO: 1278353 - RNA, 16 nt, Homo sapiens
agauguguuaggaaug

SEQ ID NO: 1278354 - RNA, 11 nt, Homo sapiens
agauguuccuc

SEQ ID NO: 1278355 - RNA, 19 nt, Homo sapiens
agauguuuuggggacucau

SEQ ID NO: 1278356 - RNA, 16 nt, Homo sapiens
agauuaaaaagcacag

SEQ ID NO: 1278357 - RNA, 21 nt, Homo sapiens
agauuauauuggugguucuca

SEQ ID NO: 1278358 - RNA, 15 nt, Homo sapiens
agauucccaagccaa

SEQ ID NO: 1278359 - RNA, 21 nt, Homo sapiens
agauucccuuccggugcgugu

SEQ ID NO: 1278360 - RNA, 13 nt, Homo sapiens
agauucuaaagau

SEQ ID NO: 1278361 - RNA, 16 nt, Homo sapiens
agauucuauaguucua

SEQ ID NO: 1278362 - RNA, 16 nt, Homo sapiens
agauucuccugugcua

SEQ ID NO: 1278363 - RNA, 13 nt, Homo sapiens
agauugauacuuu

SEQ ID NO: 1278364 - RNA, 23 nt, Homo sapiens
agauugaucaaaguguaaacacc

SEQ ID NO: 1278365 - RNA, 21 nt, Homo sapiens
agauugauuaaugaacuauug

SEQ ID NO: 1278366 - RNA, 14 nt, Homo sapiens
agauugcacuauug

SEQ ID NO: 1278367 - RNA, 14 nt, Homo sapiens
agauugcuuucuuc

SEQ ID NO: 1278368 - RNA, 18 nt, Homo sapiens
agauuuaaaaaaagaaca

SEQ ID NO: 1278369 - RNA, 21 nt, Homo sapiens
agauuuaaaaaaagaacauaa

SEQ ID NO: 1278370 - RNA, 21 nt, Homo sapiens
agauuuaaaguggcagcuuca

SEQ ID NO: 1278371 - RNA, 14 nt, Homo sapiens
agauuuaagcacaa

SEQ ID NO: 1278372 - RNA, 16 nt, Homo sapiens
agauuuacuaaaucaa

SEQ ID NO: 1278373 - RNA, 22 nt, Homo sapiens
agauuuagaaaaaaguuuacaa

SEQ ID NO: 1278374 - RNA, 17 nt, Homo sapiens
agauuuaugaugcacuu

SEQ ID NO: 1278375 - RNA, 16 nt, Homo sapiens
agauuucaugccuggu

SEQ ID NO: 1278376 - RNA, 23 nt, Homo sapiens
agauuugggguauaggucucauc

SEQ ID NO: 1278377 - RNA, 15 nt, Homo sapiens
agauuuuacaaaaga

SEQ ID NO: 1278378 - RNA, 16 nt, Homo sapiens
agauuuuaugcugcug

SEQ ID NO: 1278379 - RNA, 13 nt, Homo sapiens
agauuuuccauug

SEQ ID NO: 1278380 - RNA, 16 nt, Homo sapiens
agcaaaaaugacaaca

SEQ ID NO: 1278381 - RNA, 19 nt, Homo sapiens
agcaaaaugcuucugcaca

SEQ ID NO: 1278382 - RNA, 19 nt, Homo sapiens
agcaaaauugauguguuua

SEQ ID NO: 1278383 - RNA, 18 nt, Homo sapiens
agcaaacacuuacagaau

SEQ ID NO: 1278384 - RNA, 12 nt, Homo sapiens
agcaaaccauua

SEQ ID NO: 1278385 - RNA, 22 nt, Homo sapiens
agcaaagaggacucgcuuguaa

SEQ ID NO: 1278386 - RNA, 21 nt, Homo sapiens
agcaaagcaaaaggcugagaa

SEQ ID NO: 1278387 - RNA, 20 nt, Homo sapiens
agcaaauaucauacuguuca

SEQ ID NO: 1278388 - RNA, 15 nt, Homo sapiens
agcaaaucacgacca

SEQ ID NO: 1278389 - RNA, 20 nt, Homo sapiens
agcaaauuugugguuguaga

SEQ ID NO: 1278390 - RNA, 11 nt, Homo sapiens
agcaacaaaga

SEQ ID NO: 1278391 - RNA, 11 nt, Homo sapiens
agcaacccagg

SEQ ID NO: 1278392 - RNA, 13 nt, Homo sapiens
agcaacucagaga

SEQ ID NO: 1278393 - RNA, 19 nt, Homo sapiens
agcaacucugagaucuaag

SEQ ID NO: 1278394 - RNA, 18 nt, Homo sapiens
agcaacuguuaugaaaua

SEQ ID NO: 1278395 - RNA, 17 nt, Homo sapiens
agcaagacuccaucuca

SEQ ID NO: 1278396 - RNA, 19 nt, Homo sapiens
agcaagaugugaaagaaga

SEQ ID NO: 1278397 - RNA, 14 nt, Homo sapiens
agcaagcuauucaa

SEQ ID NO: 1278398 - RNA, 17 nt, Homo sapiens
agcaaggcccugcugcc

SEQ ID NO: 1278399 - RNA, 15 nt, Homo sapiens
agcaaguguucacaa

SEQ ID NO: 1278400 - RNA, 19 nt, Homo sapiens
agcaaguuucaucagucaa

SEQ ID NO: 1278401 - RNA, 21 nt, Homo sapiens
agcaauaaauaacacuuguca

SEQ ID NO: 1278402 - RNA, 14 nt, Homo sapiens
agcaauacaaagac

SEQ ID NO: 1278403 - RNA, 14 nt, Homo sapiens
agcaauacucauca

SEQ ID NO: 1278404 - RNA, 16 nt, Homo sapiens
agcaauacuguuucca

SEQ ID NO: 1278405 - RNA, 14 nt, Homo sapiens
agcaaugacaucuc

SEQ ID NO: 1278406 - RNA, 17 nt, Homo sapiens
agcaaugacaucucagg

SEQ ID NO: 1278407 - RNA, 19 nt, Homo sapiens
agcaaugacaucucagggg

SEQ ID NO: 1278408 - RNA, 19 nt, Homo sapiens
agcaaugcccguaaugcuu

SEQ ID NO: 1278409 - RNA, 17 nt, Homo sapiens
agcaauggcacuguugc

SEQ ID NO: 1278410 - RNA, 12 nt, Homo sapiens
agcaaugguggu

SEQ ID NO: 1278411 - RNA, 20 nt, Homo sapiens
agcaaugucucuuugugcuc

SEQ ID NO: 1278412 - RNA, 18 nt, Homo sapiens
agcaauuaguaagccaug

SEQ ID NO: 1278413 - RNA, 17 nt, Homo sapiens
agcaauuccucugaaca

SEQ ID NO: 1278414 - RNA, 14 nt, Homo sapiens
agcacaauuugcac

SEQ ID NO: 1278415 - RNA, 21 nt, Homo sapiens
agcacagaggacuuauucaac

SEQ ID NO: 1278416 - RNA, 19 nt, Homo sapiens
agcacagcuugaccugagg

SEQ ID NO: 1278417 - RNA, 16 nt, Homo sapiens
agagacuauguagcaa

SEQ ID NO: 1278418 - RNA, 22 nt, Homo sapiens
agagacugcagggguccacugu

SEQ ID NO: 1278419 - RNA, 16 nt, Homo sapiens
agagacugucccugaa

SEQ ID NO: 1278420 - RNA, 15 nt, Homo sapiens
agagagaaauucugu

SEQ ID NO: 1278421 - RNA, 18 nt, Homo sapiens
agagagacagacuugaga

SEQ ID NO: 1278422 - RNA, 14 nt, Homo sapiens
agagagauguuccu

SEQ ID NO: 1278423 - RNA, 19 nt, Homo sapiens
agagagcaacucugagauc

SEQ ID NO: 1278424 - RNA, 15 nt, Homo sapiens
agagagcaucuuucc

SEQ ID NO: 1278425 - RNA, 13 nt, Homo sapiens
agagagccuggug

SEQ ID NO: 1278426 - RNA, 20 nt, Homo sapiens
agagaggccuuuuguuuaaa

SEQ ID NO: 1278427 - RNA, 15 nt, Homo sapiens
agagaggcucugaga

SEQ ID NO: 1278428 - RNA, 22 nt, Homo sapiens
agagaguauuuuuauacaaacc

SEQ ID NO: 1278429 - RNA, 17 nt, Homo sapiens
agagauaagucuuucau

SEQ ID NO: 1278430 - RNA, 22 nt, Homo sapiens
agagaucuuucuuuccaaaaca

SEQ ID NO: 1278431 - RNA, 20 nt, Homo sapiens
agagaugacaaggagcacaa

SEQ ID NO: 1278432 - RNA, 15 nt, Homo sapiens
agagaugacugucca

SEQ ID NO: 1278433 - RNA, 19 nt, Homo sapiens
agagaugcgaaccacccaa

SEQ ID NO: 1278434 - RNA, 17 nt, Homo sapiens
agagaugggacuaggac

SEQ ID NO: 1278435 - RNA, 20 nt, Homo sapiens
agagauggggucucacagug

SEQ ID NO: 1278436 - RNA, 16 nt, Homo sapiens
agagaugucaucagag

SEQ ID NO: 1278437 - RNA, 19 nt, Homo sapiens
agagauuacuuugcugccu

SEQ ID NO: 1278438 - RNA, 20 nt, Homo sapiens
agagauuuaucuuuauacag

SEQ ID NO: 1278439 - RNA, 22 nt, Homo sapiens
agagcaacaauccaucucucaa

SEQ ID NO: 1278440 - RNA, 19 nt, Homo sapiens
agagcaagacuccaucuca

SEQ ID NO: 1278441 - RNA, 19 nt, Homo sapiens
agagcaagacucugucuca

SEQ ID NO: 1278442 - RNA, 20 nt, Homo sapiens
agagcaagacucugucucaa

SEQ ID NO: 1278443 - RNA, 13 nt, Homo sapiens
agagcaauuguaa

SEQ ID NO: 1278444 - RNA, 15 nt, Homo sapiens
agagcagagguggaa

SEQ ID NO: 1278445 - RNA, 15 nt, Homo sapiens
agagcagaugcagag

SEQ ID NO: 1278446 - RNA, 19 nt, Homo sapiens
agagcagccuggcuaacau

SEQ ID NO: 1278447 - RNA, 20 nt, Homo sapiens
agagcaggaagcauucagag

SEQ ID NO: 1278448 - RNA, 14 nt, Homo sapiens
agagcauugccauu

SEQ ID NO: 1278449 - RNA, 21 nt, Homo sapiens
agagccaaccucggcuugugg

SEQ ID NO: 1278450 - RNA, 20 nt, Homo sapiens
agagccauuuaacauuuccu

SEQ ID NO: 1278451 - RNA, 14 nt, Homo sapiens
agagcccagucucc

SEQ ID NO: 1278452 - RNA, 21 nt, Homo sapiens
agagcccuucacugccaugau

SEQ ID NO: 1278453 - RNA, 17 nt, Homo sapiens
agagccuggugcugcug

SEQ ID NO: 1278454 - RNA, 19 nt, Homo sapiens
agagcgagacuccgucuca

SEQ ID NO: 1278455 - RNA, 15 nt, Homo sapiens
agagcgagaguccau

SEQ ID NO: 1278456 - RNA, 20 nt, Homo sapiens
agagcgcuuuugucugcaau

SEQ ID NO: 1278457 - RNA, 14 nt, Homo sapiens
agaggaacugucca

SEQ ID NO: 1278458 - RNA, 21 nt, Homo sapiens
agaggaaggaaaaggaggaaa

SEQ ID NO: 1278459 - RNA, 20 nt, Homo sapiens
agaggaaggagauuccacac

SEQ ID NO: 1278460 - RNA, 20 nt, Homo sapiens
agaggaauuuuuucuuuuga

SEQ ID NO: 1278461 - RNA, 20 nt, Homo sapiens
agaggagccaccaguucuca

SEQ ID NO: 1278462 - RNA, 18 nt, Homo sapiens
agaggaucuccuguccau

SEQ ID NO: 1278463 - RNA, 21 nt, Homo sapiens
agaggaugaauguaugugcac

SEQ ID NO: 1278464 - RNA, 17 nt, Homo sapiens
agaggaugucacaaaga

SEQ ID NO: 1278465 - RNA, 13 nt, Homo sapiens
agaggaugugcaa

SEQ ID NO: 1278466 - RNA, 22 nt, Homo sapiens
agaggcaaugauuguuaauuua

SEQ ID NO: 1278467 - RNA, 19 nt, Homo sapiens
agaggcagggucucacucu

SEQ ID NO: 1278468 - RNA, 17 nt, Homo sapiens
agaggcaucgccugcag

SEQ ID NO: 1278469 - RNA, 17 nt, Homo sapiens
agaggcugccccucuca

SEQ ID NO: 1278470 - RNA, 13 nt, Homo sapiens
agaggcugggcug

SEQ ID NO: 1278471 - RNA, 13 nt, Homo sapiens
agaggcuuuccaa

SEQ ID NO: 1278472 - RNA, 12 nt, Homo sapiens
agagggaccaga

SEQ ID NO: 1278473 - RNA, 24 nt, Homo sapiens
agagggaccaugugucacuugugc

SEQ ID NO: 1278474 - RNA, 17 nt, Homo sapiens
agagggauaaaaacaau

SEQ ID NO: 1278475 - RNA, 15 nt, Homo sapiens
agagggcccagccca

SEQ ID NO: 1278476 - RNA, 17 nt, Homo sapiens
agagggcccagcccaga

SEQ ID NO: 1278477 - RNA, 14 nt, Homo sapiens
agagggcccaggca

SEQ ID NO: 1278478 - RNA, 14 nt, Homo sapiens
agagggcugcauuc

SEQ ID NO: 1278479 - RNA, 23 nt, Homo sapiens
agagggguggaguuuuaacugua

SEQ ID NO: 1278480 - RNA, 13 nt, Homo sapiens
agaggguacuuua

SEQ ID NO: 1278481 - RNA, 14 nt, Homo sapiens
agagguagcacuac

SEQ ID NO: 1278482 - RNA, 21 nt, Homo sapiens
agagguagucucacugcuuga

SEQ ID NO: 1278483 - RNA, 18 nt, Homo sapiens
agaggucagacuaagaaa

SEQ ID NO: 1278484 - RNA, 13 nt, Homo sapiens
agaggucugagcc

SEQ ID NO: 1278485 - RNA, 22 nt, Homo sapiens
agagguguacacuaacauuucc

SEQ ID NO: 1278486 - RNA, 22 nt, Homo sapiens
agaguagaacagauaaucagug

SEQ ID NO: 1278487 - RNA, 15 nt, Homo sapiens
agaguaucacuccca

SEQ ID NO: 1278488 - RNA, 13 nt, Homo sapiens
agagucuaaagau

SEQ ID NO: 1278489 - RNA, 15 nt, Homo sapiens
agagucuccaguuua

SEQ ID NO: 1278490 - RNA, 16 nt, Homo sapiens
agagugacuaguacaa

SEQ ID NO: 1278491 - RNA, 17 nt, Homo sapiens
agagugacuaguacaaa

SEQ ID NO: 1278492 - RNA, 18 nt, Homo sapiens
agagugcuauaaaagacu

SEQ ID NO: 1278493 - RNA, 19 nt, Homo sapiens
agagugcuuggcugcugua

SEQ ID NO: 1278494 - RNA, 22 nt, Homo sapiens
agagugguuaagacuacugaag

SEQ ID NO: 1278495 - RNA, 17 nt, Homo sapiens
agaguguagacuguggc

SEQ ID NO: 1278496 - RNA, 15 nt, Homo sapiens
agaguguagcuguaa

SEQ ID NO: 1278497 - RNA, 15 nt, Homo sapiens
agagugugguuauga

SEQ ID NO: 1278498 - RNA, 19 nt, Homo sapiens
agaguguuaucagucauaa

SEQ ID NO: 1278499 - RNA, 19 nt, Homo sapiens
agaguuagguugucuccag

SEQ ID NO: 1278500 - RNA, 18 nt, Homo sapiens
agaguucuggaaaagaac

SEQ ID NO: 1278501 - RNA, 13 nt, Homo sapiens
agaguuguucucu

SEQ ID NO: 1278502 - RNA, 14 nt, Homo sapiens
agaguuuacugaag

SEQ ID NO: 1278503 - RNA, 21 nt, Homo sapiens
agaguuugcuauuagagcauu

SEQ ID NO: 1278504 - RNA, 23 nt, Homo sapiens
agauaaaagaaccgagcaauuuu

SEQ ID NO: 1278505 - RNA, 17 nt, Homo sapiens
agauaaaagauguacuu

SEQ ID NO: 1278506 - RNA, 14 nt, Homo sapiens
agauaaaugugcug

SEQ ID NO: 1278507 - RNA, 16 nt, Homo sapiens
agauaacuuacuguau

SEQ ID NO: 1278508 - RNA, 20 nt, Homo sapiens
agcagcaccaaccacagcau

SEQ ID NO: 1278509 - RNA, 22 nt, Homo sapiens
agcagcagaggcggucuucaac

SEQ ID NO: 1278510 - RNA, 19 nt, Homo sapiens
agcagccauuggcacugug

SEQ ID NO: 1278511 - RNA, 18 nt, Homo sapiens
agcagcccuaaggaucuc

SEQ ID NO: 1278512 - RNA, 18 nt, Homo sapiens
agcagcccugcucugggg

SEQ ID NO: 1278513 - RNA, 17 nt, Homo sapiens
agcagccuggagaccca

SEQ ID NO: 1278514 - RNA, 23 nt, Homo sapiens
agcagcgagggcaccuugugauc

SEQ ID NO: 1278515 - RNA, 17 nt, Homo sapiens
agcagcucuucagcaca

SEQ ID NO: 1278516 - RNA, 22 nt, Homo sapiens
agcagcucuugcuaaucagugu

SEQ ID NO: 1278517 - RNA, 21 nt, Homo sapiens
agcagcuucugggaccauaag

SEQ ID NO: 1278518 - RNA, 14 nt, Homo sapiens
agcagcuuuaaaca

SEQ ID NO: 1278519 - RNA, 21 nt, Homo sapiens
agcagcuuuaaacaaauucau

SEQ ID NO: 1278520 - RNA, 15 nt, Homo sapiens
agcaggacugcacag

SEQ ID NO: 1278521 - RNA, 16 nt, Homo sapiens
agcaggagauugagaa

SEQ ID NO: 1278522 - RNA, 13 nt, Homo sapiens
agcaggagccagc

SEQ ID NO: 1278523 - RNA, 23 nt, Homo sapiens
agcaggaggccaauaaaaaguuc

SEQ ID NO: 1278524 - RNA, 14 nt, Homo sapiens
agcaggaguggugc

SEQ ID NO: 1278525 - RNA, 15 nt, Homo sapiens
agcaggaguggugca

SEQ ID NO: 1278526 - RNA, 19 nt, Homo sapiens
agcaggcagcgccaagugc

SEQ ID NO: 1278527 - RNA, 21 nt, Homo sapiens
agcaggcagcgccaagugcgu

SEQ ID NO: 1278528 - RNA, 21 nt, Homo sapiens
agcaggccggaaccacagggc

SEQ ID NO: 1278529 - RNA, 18 nt, Homo sapiens
agcaggccuaagacaugu

SEQ ID NO: 1278530 - RNA, 23 nt, Homo sapiens
agcaggcggccuuuguugcucag

SEQ ID NO: 1278531 - RNA, 20 nt, Homo sapiens
agcaggcuggcagcucucca

SEQ ID NO: 1278532 - RNA, 24 nt, Homo sapiens
agcaggcuuucaagaagugccagu

SEQ ID NO: 1278533 - RNA, 17 nt, Homo sapiens
agcaggggggcugugcc

SEQ ID NO: 1278534 - RNA, 16 nt, Homo sapiens
agcaggguacccuuug

SEQ ID NO: 1278535 - RNA, 13 nt, Homo sapiens
agcaguaagcuau

SEQ ID NO: 1278536 - RNA, 19 nt, Homo sapiens
agcaguaccccccuaccac

SEQ ID NO: 1278537 - RNA, 19 nt, Homo sapiens
agcaguauguuuguuucau

SEQ ID NO: 1278538 - RNA, 22 nt, Homo sapiens
agcagucacugacaguuaauaa

SEQ ID NO: 1278539 - RNA, 22 nt, Homo sapiens
agcaguccacaaagcauuuuca

SEQ ID NO: 1278540 - RNA, 17 nt, Homo sapiens
agcagucccaguauucu

SEQ ID NO: 1278541 - RNA, 18 nt, Homo sapiens
agcagucgaccgcacuua

SEQ ID NO: 1278542 - RNA, 17 nt, Homo sapiens
agcagugccagcuuucu

SEQ ID NO: 1278543 - RNA, 16 nt, Homo sapiens
agcagugccuuccaua

SEQ ID NO: 1278544 - RNA, 12 nt, Homo sapiens
agcagugccuug

SEQ ID NO: 1278545 - RNA, 16 nt, Homo sapiens
agcagugucuuccaua

SEQ ID NO: 1278546 - RNA, 14 nt, Homo sapiens
agcaguguuuuaga

SEQ ID NO: 1278547 - RNA, 21 nt, Homo sapiens
agcaguugaaacaagaagcca

SEQ ID NO: 1278548 - RNA, 22 nt, Homo sapiens
agcaguuugcuuuguaugcacu

SEQ ID NO: 1278549 - RNA, 15 nt, Homo sapiens
agcauaacaaaaaga

SEQ ID NO: 1278550 - RNA, 13 nt, Homo sapiens
agcauaacuguag

SEQ ID NO: 1278551 - RNA, 20 nt, Homo sapiens
agcauacccuuacucugcca

SEQ ID NO: 1278552 - RNA, 20 nt, Homo sapiens
agcauagaaaccacuagaaa

SEQ ID NO: 1278553 - RNA, 20 nt, Homo sapiens
agcauaguaccucugcuauu

SEQ ID NO: 1278554 - RNA, 13 nt, Homo sapiens
agcauauggaauu

SEQ ID NO: 1278555 - RNA, 13 nt, Homo sapiens
agcauauggugcu

SEQ ID NO: 1278556 - RNA, 14 nt, Homo sapiens
agcauauuuugcug

SEQ ID NO: 1278557 - RNA, 23 nt, Homo sapiens
agcaucagagguuugcuuccuca

SEQ ID NO: 1278558 - RNA, 15 nt, Homo sapiens
agcaucccucagccu

SEQ ID NO: 1278559 - RNA, 22 nt, Homo sapiens
agcaucgggagcacccagagca

SEQ ID NO: 1278560 - RNA, 12 nt, Homo sapiens
agcaucuaagaa

SEQ ID NO: 1278561 - RNA, 16 nt, Homo sapiens
agcaucuguaacagca

SEQ ID NO: 1278562 - RNA, 22 nt, Homo sapiens
agcaucuucacuucuaaaugca

SEQ ID NO: 1278563 - RNA, 20 nt, Homo sapiens
agcaugaaccuuguuuaaau

SEQ ID NO: 1278564 - RNA, 16 nt, Homo sapiens
agcaugaauccagucc

SEQ ID NO: 1278565 - RNA, 23 nt, Homo sapiens
agcaugaggacagaccacagagc

SEQ ID NO: 1278566 - RNA, 16 nt, Homo sapiens
agcaugcacaaagugu

SEQ ID NO: 1278567 - RNA, 21 nt, Homo sapiens
agcaugcuuugcugcuaugaa

SEQ ID NO: 1278568 - RNA, 20 nt, Homo sapiens
agcaugugccuuaaugcuuc

SEQ ID NO: 1278569 - RNA, 13 nt, Homo sapiens
agcaugugucaga

SEQ ID NO: 1278570 - RNA, 20 nt, Homo sapiens
agcauuagcuggcgcauauu

SEQ ID NO: 1278571 - RNA, 16 nt, Homo sapiens
agcauuccuauugaca

SEQ ID NO: 1278572 - RNA, 23 nt, Homo sapiens
agcauuccuucuuugauaauguu

SEQ ID NO: 1278573 - RNA, 20 nt, Homo sapiens
agcauucuugucacaauaaa

SEQ ID NO: 1278574 - RNA, 14 nt, Homo sapiens
agcauugagcauaa

SEQ ID NO: 1278575 - RNA, 21 nt, Homo sapiens
agcauuguaaaauuauuucau

SEQ ID NO: 1278576 - RNA, 22 nt, Homo sapiens
agcauugucucguguacagcuc

SEQ ID NO: 1278577 - RNA, 17 nt, Homo sapiens
agcauuuagucuugcca

SEQ ID NO: 1278578 - RNA, 17 nt, Homo sapiens
agcauuuccacaccaag

SEQ ID NO: 1278579 - RNA, 14 nt, Homo sapiens
agccaaacucugcc

SEQ ID NO: 1278580 - RNA, 15 nt, Homo sapiens
agccaaacucugcca

SEQ ID NO: 1278581 - RNA, 21 nt, Homo sapiens
agccaaacucugccagccaca

SEQ ID NO: 1278582 - RNA, 19 nt, Homo sapiens
agccaaagagaaugccauu

SEQ ID NO: 1278583 - RNA, 19 nt, Homo sapiens
agccaaagcuuaugugaca

SEQ ID NO: 1278584 - RNA, 23 nt, Homo sapiens
agccaaaggauaaguguccccua

SEQ ID NO: 1278585 - RNA, 17 nt, Homo sapiens
agccaacacccugucua

SEQ ID NO: 1278586 - RNA, 11 nt, Homo sapiens
agccaaccuca

SEQ ID NO: 1278587 - RNA, 13 nt, Homo sapiens
agccaacugcugc

SEQ ID NO: 1278588 - RNA, 14 nt, Homo sapiens
agccaacuuuugca

SEQ ID NO: 1278589 - RNA, 15 nt, Homo sapiens
agccaauguguggcu

SEQ ID NO: 1278590 - RNA, 22 nt, Homo sapiens
agccaauguuuuccacccauaa

SEQ ID NO: 1278591 - RNA, 15 nt, Homo sapiens
agccacaaaugccuu

SEQ ID NO: 1278592 - RNA, 15 nt, Homo sapiens
agccacaaccaaaaa

SEQ ID NO: 1278593 - RNA, 17 nt, Homo sapiens
agccacaagucuuccag

SEQ ID NO: 1278594 - RNA, 16 nt, Homo sapiens
agccacaguggccaaa

SEQ ID NO: 1278595 - RNA, 23 nt, Homo sapiens
acauuucucuaacuccugccauu

SEQ ID NO: 1278596 - RNA, 14 nt, Homo sapiens
acauuucucugagc

SEQ ID NO: 1278597 - RNA, 13 nt, Homo sapiens
acauuucuguaaa

SEQ ID NO: 1278598 - RNA, 19 nt, Homo sapiens
acauuucuguaaauaccau

SEQ ID NO: 1278599 - RNA, 16 nt, Homo sapiens
acauuucuguucucau

SEQ ID NO: 1278600 - RNA, 12 nt, Homo sapiens
acauuugccuua

SEQ ID NO: 1278601 - RNA, 20 nt, Homo sapiens
acauuugggagacaugugac

SEQ ID NO: 1278602 - RNA, 15 nt, Homo sapiens
acauuugguugcuac

SEQ ID NO: 1278603 - RNA, 16 nt, Homo sapiens
acauuugguugcuacu

SEQ ID NO: 1278604 - RNA, 16 nt, Homo sapiens
acauuuucauugauga

SEQ ID NO: 1278605 - RNA, 14 nt, Homo sapiens
acauuuucuuucau

SEQ ID NO: 1278606 - RNA, 15 nt, Homo sapiens
acauuuugacacaaa

SEQ ID NO: 1278607 - RNA, 19 nt, Homo sapiens
acauuuuuauaaaaaugag

SEQ ID NO: 1278608 - RNA, 20 nt, Homo sapiens
acauuuuuauuuaguugaaa

SEQ ID NO: 1278609 - RNA, 20 nt, Homo sapiens
acauuuuugaauacauuaaa

SEQ ID NO: 1278610 - RNA, 19 nt, Homo sapiens
accaaaaugacaaugauga

SEQ ID NO: 1278611 - RNA, 19 nt, Homo sapiens
accaaacucauucaccaaa

SEQ ID NO: 1278612 - RNA, 20 nt, Homo sapiens
accaaagacaucagucucca

SEQ ID NO: 1278613 - RNA, 17 nt, Homo sapiens
accaaagccaccacauu

SEQ ID NO: 1278614 - RNA, 21 nt, Homo sapiens
accaaaggugugcccuguaca

SEQ ID NO: 1278615 - RNA, 13 nt, Homo sapiens
accaaaguaacug

SEQ ID NO: 1278616 - RNA, 17 nt, Homo sapiens
accaaaucagcugcuac

SEQ ID NO: 1278617 - RNA, 12 nt, Homo sapiens
accaaccacagc

SEQ ID NO: 1278618 - RNA, 22 nt, Homo sapiens
accaacugaaguggcuaaagag

SEQ ID NO: 1278619 - RNA, 22 nt, Homo sapiens
accaacugcugcugugcacauu

SEQ ID NO: 1278620 - RNA, 18 nt, Homo sapiens
accaacugggcccaagac

SEQ ID NO: 1278621 - RNA, 11 nt, Homo sapiens
accaacugugu

SEQ ID NO: 1278622 - RNA, 12 nt, Homo sapiens
accaacuuucug

SEQ ID NO: 1278623 - RNA, 23 nt, Homo sapiens
accaaggcaaggcaggugccucc

SEQ ID NO: 1278624 - RNA, 14 nt, Homo sapiens
accaaggcagccuc

SEQ ID NO: 1278625 - RNA, 14 nt, Homo sapiens
accaaggcgaguuu

SEQ ID NO: 1278626 - RNA, 15 nt, Homo sapiens
accaagugcugucuu

SEQ ID NO: 1278627 - RNA, 16 nt, Homo sapiens
accaauccaacaucca

SEQ ID NO: 1278628 - RNA, 15 nt, Homo sapiens
accaaucuacuuugu

SEQ ID NO: 1278629 - RNA, 20 nt, Homo sapiens
accaaugcccagcaggggag

SEQ ID NO: 1278630 - RNA, 13 nt, Homo sapiens
accaaugcuguug

SEQ ID NO: 1278631 - RNA, 20 nt, Homo sapiens
accaaugguccuagaacuuu

SEQ ID NO: 1278632 - RNA, 16 nt, Homo sapiens
accaauuaagcagcuu

SEQ ID NO: 1278633 - RNA, 14 nt, Homo sapiens
accaauucuaacag

SEQ ID NO: 1278634 - RNA, 20 nt, Homo sapiens
accacaaaaauugacucaaa

SEQ ID NO: 1278635 - RNA, 16 nt, Homo sapiens
accacaagccugagaa

SEQ ID NO: 1278636 - RNA, 12 nt, Homo sapiens
accacaaggaaa

SEQ ID NO: 1278637 - RNA, 13 nt, Homo sapiens
accacacauauug

SEQ ID NO: 1278638 - RNA, 20 nt, Homo sapiens
accacaguuuauugauuuca

SEQ ID NO: 1278639 - RNA, 17 nt, Homo sapiens
accacauccuccgucca

SEQ ID NO: 1278640 - RNA, 19 nt, Homo sapiens
accacauguguuucugucu

SEQ ID NO: 1278641 - RNA, 22 nt, Homo sapiens
accacauugagaucacuacuca

SEQ ID NO: 1278642 - RNA, 17 nt, Homo sapiens
accacccgaaaugccac

SEQ ID NO: 1278643 - RNA, 19 nt, Homo sapiens
accaccgaaucccuagucc

SEQ ID NO: 1278644 - RNA, 13 nt, Homo sapiens
accaccucaccag

SEQ ID NO: 1278645 - RNA, 22 nt, Homo sapiens
accaccuggggagagccugcuu

SEQ ID NO: 1278646 - RNA, 17 nt, Homo sapiens
accaccuucaccuggau

SEQ ID NO: 1278647 - RNA, 21 nt, Homo sapiens
accacggccacauuugguucu

SEQ ID NO: 1278648 - RNA, 21 nt, Homo sapiens
accacuaagaauucaaacugg

SEQ ID NO: 1278649 - RNA, 15 nt, Homo sapiens
accacuaauagcauu

SEQ ID NO: 1278650 - RNA, 21 nt, Homo sapiens
accacuacaugcagcccaugc

SEQ ID NO: 1278651 - RNA, 15 nt, Homo sapiens
accacuccauuccca

SEQ ID NO: 1278652 - RNA, 17 nt, Homo sapiens
accacugacuacuggcu

SEQ ID NO: 1278653 - RNA, 21 nt, Homo sapiens
accacugaguaccaggggcug

SEQ ID NO: 1278654 - RNA, 11 nt, Homo sapiens
accacugcacu

SEQ ID NO: 1278655 - RNA, 16 nt, Homo sapiens
accacugcacugucug

SEQ ID NO: 1278656 - RNA, 20 nt, Homo sapiens
accacuguaccccagguucu

SEQ ID NO: 1278657 - RNA, 15 nt, Homo sapiens
accacuuaccucaaa

SEQ ID NO: 1278658 - RNA, 14 nt, Homo sapiens
accacuuuuaacag

SEQ ID NO: 1278659 - RNA, 22 nt, Homo sapiens
accacuuuuaacagaacagaca

SEQ ID NO: 1278660 - RNA, 20 nt, Homo sapiens
accacuuuuaauuguuacuc

SEQ ID NO: 1278661 - RNA, 16 nt, Homo sapiens
accagaauuguccuca

SEQ ID NO: 1278662 - RNA, 14 nt, Homo sapiens
accagacagcacag

SEQ ID NO: 1278663 - RNA, 19 nt, Homo sapiens
accagagaccguccucacc

SEQ ID NO: 1278664 - RNA, 20 nt, Homo sapiens
accagagaggcucugagaaa

SEQ ID NO: 1278665 - RNA, 17 nt, Homo sapiens
accagagccagaugcag

SEQ ID NO: 1278666 - RNA, 16 nt, Homo sapiens
accagaggugcuucug

SEQ ID NO: 1278667 - RNA, 13 nt, Homo sapiens
accagaugcugaa

SEQ ID NO: 1278668 - RNA, 13 nt, Homo sapiens
accagauuugcua

SEQ ID NO: 1278669 - RNA, 13 nt, Homo sapiens
accagcaagaaua

SEQ ID NO: 1278670 - RNA, 16 nt, Homo sapiens
accagcaauacaaaga

SEQ ID NO: 1278671 - RNA, 13 nt, Homo sapiens
accagcagcaugg

SEQ ID NO: 1278672 - RNA, 16 nt, Homo sapiens
accagcauacccuuac

SEQ ID NO: 1278673 - RNA, 14 nt, Homo sapiens
accagcccaaccau

SEQ ID NO: 1278674 - RNA, 17 nt, Homo sapiens
accagccccacugccag

SEQ ID NO: 1278675 - RNA, 18 nt, Homo sapiens
accagcccugaccccagu

SEQ ID NO: 1278676 - RNA, 16 nt, Homo sapiens
accagccuacaagcug

SEQ ID NO: 1278677 - RNA, 16 nt, Homo sapiens
accagcuugcgaauaa

SEQ ID NO: 1278678 - RNA, 17 nt, Homo sapiens
accaggccugagcaaca

SEQ ID NO: 1278679 - RNA, 14 nt, Homo sapiens
accaggcuuggccu

SEQ ID NO: 1278680 - RNA, 15 nt, Homo sapiens
accagggacagagcu

SEQ ID NO: 1278681 - RNA, 19 nt, Homo sapiens
accagucugucuacugugg

SEQ ID NO: 1278682 - RNA, 18 nt, Homo sapiens
accagugaaagaagccac

SEQ ID NO: 1278683 - RNA, 19 nt, Homo sapiens
accagugguuuccagucau

SEQ ID NO: 1278684 - RNA, 20 nt, Homo sapiens
accaguguccccuccacugu

SEQ ID NO: 1278685 - RNA, 14 nt, Homo sapiens
accaguuaccacac

SEQ ID NO: 1278686 - RNA, 15 nt, Homo sapiens
accaguuaugugaau

SEQ ID NO: 1278687 - RNA, 12 nt, Homo sapiens
aacagcauguac

SEQ ID NO: 1278688 - RNA, 23 nt, Homo sapiens
aacagccaaaacuccacagucaa

SEQ ID NO: 1278689 - RNA, 19 nt, Homo sapiens
aacagccauaauaauaauu

SEQ ID NO: 1278690 - RNA, 18 nt, Homo sapiens
aacagccccagucuuccu

SEQ ID NO: 1278691 - RNA, 21 nt, Homo sapiens
aacagcgggagaccugugcua

SEQ ID NO: 1278692 - RNA, 22 nt, Homo sapiens
aacagcguguucuaaguauuug

SEQ ID NO: 1278693 - RNA, 16 nt, Homo sapiens
aacaggaaaccacuua

SEQ ID NO: 1278694 - RNA, 20 nt, Homo sapiens
aacaggauuacaguguagcu

SEQ ID NO: 1278695 - RNA, 14 nt, Homo sapiens
aacaggcacuuuga

SEQ ID NO: 1278696 - RNA, 21 nt, Homo sapiens
aacaggcaguggaagcaguuu

SEQ ID NO: 1278697 - RNA, 18 nt, Homo sapiens
aacaggcucaauauuccu

SEQ ID NO: 1278698 - RNA, 14 nt, Homo sapiens
aacaggcugaaauu

SEQ ID NO: 1278699 - RNA, 16 nt, Homo sapiens
aacaggguaccucaag

SEQ ID NO: 1278700 - RNA, 21 nt, Homo sapiens
aacaggguuugauagcacuua

SEQ ID NO: 1278701 - RNA, 15 nt, Homo sapiens
aacagguauauacuu

SEQ ID NO: 1278702 - RNA, 19 nt, Homo sapiens
aacagguauauacuuugaa

SEQ ID NO: 1278703 - RNA, 21 nt, Homo sapiens
aacaguaaaagccuuauucua

SEQ ID NO: 1278704 - RNA, 21 nt, Homo sapiens
aacaguacuuggguuugcaac

SEQ ID NO: 1278705 - RNA, 12 nt, Homo sapiens
aacaguauuuca

SEQ ID NO: 1278706 - RNA, 20 nt, Homo sapiens
aacaguucauguuugcuuca

SEQ ID NO: 1278707 - RNA, 18 nt, Homo sapiens
aacaguugugaugacuau

SEQ ID NO: 1278708 - RNA, 16 nt, Homo sapiens
aacaguuuuccaugaa

SEQ ID NO: 1278709 - RNA, 16 nt, Homo sapiens
aacaguuuuugcuaau

SEQ ID NO: 1278710 - RNA, 20 nt, Homo sapiens
aacauaaaaucugugaauua

SEQ ID NO: 1278711 - RNA, 20 nt, Homo sapiens
aacauaaaggacaggccaca

SEQ ID NO: 1278712 - RNA, 15 nt, Homo sapiens
aacauaaucuaguuu

SEQ ID NO: 1278713 - RNA, 14 nt, Homo sapiens
aacauaaugcacuu

SEQ ID NO: 1278714 - RNA, 16 nt, Homo sapiens
aacauacaugagauaa

SEQ ID NO: 1278715 - RNA, 13 nt, Homo sapiens
aacauaucuugag

SEQ ID NO: 1278716 - RNA, 19 nt, Homo sapiens
aacauauuuauauauguau

SEQ ID NO: 1278717 - RNA, 24 nt, Homo sapiens
aacauauuuauauauguaucuaaa

SEQ ID NO: 1278718 - RNA, 12 nt, Homo sapiens
aacauauuucau

SEQ ID NO: 1278719 - RNA, 16 nt, Homo sapiens
aacaucaacaacacag

SEQ ID NO: 1278720 - RNA, 13 nt, Homo sapiens
aacauccagaucu

SEQ ID NO: 1278721 - RNA, 21 nt, Homo sapiens
aacauccuugucugggucuac

SEQ ID NO: 1278722 - RNA, 11 nt, Homo sapiens
aauuaccaugc

SEQ ID NO: 1278723 - RNA, 15 nt, Homo sapiens
aauuacuguguaaau

SEQ ID NO: 1278724 - RNA, 22 nt, Homo sapiens
aauuagccauuucacucucaaa

SEQ ID NO: 1278725 - RNA, 21 nt, Homo sapiens
aauuagcugugugaaauacca

SEQ ID NO: 1278726 - RNA, 15 nt, Homo sapiens
aauuaggcuguaacu

SEQ ID NO: 1278727 - RNA, 13 nt, Homo sapiens
aauuaguauuuau

SEQ ID NO: 1278728 - RNA, 18 nt, Homo sapiens
acauaaaaaagaagcacu

SEQ ID NO: 1278729 - RNA, 21 nt, Homo sapiens
acauaaaaaauaaaguaccac

SEQ ID NO: 1278730 - RNA, 23 nt, Homo sapiens
acauaaaaaauaaaguaccacac

SEQ ID NO: 1278731 - RNA, 14 nt, Homo sapiens
acauaaaagacaca

SEQ ID NO: 1278732 - RNA, 13 nt, Homo sapiens
acauaaacuguca

SEQ ID NO: 1278733 - RNA, 15 nt, Homo sapiens
acauaaauguucacu

SEQ ID NO: 1278734 - RNA, 23 nt, Homo sapiens
acauaacucugcugaauguaaaa

SEQ ID NO: 1278735 - RNA, 13 nt, Homo sapiens
acauaacucugua

SEQ ID NO: 1278736 - RNA, 21 nt, Homo sapiens
acauaacucuguaaaaacacu

SEQ ID NO: 1278737 - RNA, 13 nt, Homo sapiens
acauaacuuccua

SEQ ID NO: 1278738 - RNA, 22 nt, Homo sapiens
acauaagaaauguauuccugaa

SEQ ID NO: 1278739 - RNA, 14 nt, Homo sapiens
acauaauaauagca

SEQ ID NO: 1278740 - RNA, 15 nt, Homo sapiens
acauaauacccagga

SEQ ID NO: 1278741 - RNA, 17 nt, Homo sapiens
acauaaucuaguuuaca

SEQ ID NO: 1278742 - RNA, 13 nt, Homo sapiens
acauacacucaaa

SEQ ID NO: 1278743 - RNA, 18 nt, Homo sapiens
acauacuggccuggacug

SEQ ID NO: 1278744 - RNA, 23 nt, Homo sapiens
acauagaaauggaaauuuugcua

SEQ ID NO: 1278745 - RNA, 13 nt, Homo sapiens
acauagagaucua

SEQ ID NO: 1278746 - RNA, 18 nt, Homo sapiens
acauagaugucccuuucu

SEQ ID NO: 1278747 - RNA, 22 nt, Homo sapiens
acauagccuauauuuacaguga

SEQ ID NO: 1278748 - RNA, 19 nt, Homo sapiens
acauagguaaaaacuggaa

SEQ ID NO: 1278749 - RNA, 15 nt, Homo sapiens
acauaguuguauaua

SEQ ID NO: 1278750 - RNA, 22 nt, Homo sapiens
acauauaaaauguaauuacuua

SEQ ID NO: 1278751 - RNA, 16 nt, Homo sapiens
acauauaaaugaaucu

SEQ ID NO: 1278752 - RNA, 22 nt, Homo sapiens
acauauauacccacauguacag

SEQ ID NO: 1278753 - RNA, 20 nt, Homo sapiens
acauaucaccucauggccua

SEQ ID NO: 1278754 - RNA, 14 nt, Homo sapiens
acauaugacaauaa

SEQ ID NO: 1278755 - RNA, 16 nt, Homo sapiens
acauauggacucugca

SEQ ID NO: 1278756 - RNA, 22 nt, Homo sapiens
acauauuaggaaaauauggguu

SEQ ID NO: 1278757 - RNA, 14 nt, Homo sapiens
acauauuaucucau

SEQ ID NO: 1278758 - RNA, 20 nt, Homo sapiens
acaucaaaacuaaccaucug

SEQ ID NO: 1278759 - RNA, 20 nt, Homo sapiens
acaucaaucuaaagauacag

SEQ ID NO: 1278760 - RNA, 12 nt, Homo sapiens
acaucaauguuc

SEQ ID NO: 1278761 - RNA, 14 nt, Homo sapiens
acaucaauguucau

SEQ ID NO: 1278762 - RNA, 13 nt, Homo sapiens
acaucacagcagc

SEQ ID NO: 1278763 - RNA, 16 nt, Homo sapiens
acaucacagcagccuc

SEQ ID NO: 1278764 - RNA, 20 nt, Homo sapiens
acaucaggguagcugaagga

SEQ ID NO: 1278765 - RNA, 14 nt, Homo sapiens
acaucagucuccaa

SEQ ID NO: 1278766 - RNA, 20 nt, Homo sapiens
acaucaguuguuuguuugau

SEQ ID NO: 1278767 - RNA, 17 nt, Homo sapiens
acaucauaauuacauuc

SEQ ID NO: 1278768 - RNA, 24 nt, Homo sapiens
acaucauuacugccaucuuuauca

SEQ ID NO: 1278769 - RNA, 21 nt, Homo sapiens
acauccaaggagaaacagaga

SEQ ID NO: 1278770 - RNA, 16 nt, Homo sapiens
acauccagaguucugu

SEQ ID NO: 1278771 - RNA, 14 nt, Homo sapiens
acauccaugaaaau

SEQ ID NO: 1278772 - RNA, 15 nt, Homo sapiens
acauccauguuccga

SEQ ID NO: 1278773 - RNA, 14 nt, Homo sapiens
acaucggccuccau

SEQ ID NO: 1278774 - RNA, 12 nt, Homo sapiens
acaucucagaaa

SEQ ID NO: 1278775 - RNA, 22 nt, Homo sapiens
acaucucagacccuuuagccaa

SEQ ID NO: 1278776 - RNA, 20 nt, Homo sapiens
acaucucgggaguccucuag

SEQ ID NO: 1278777 - RNA, 13 nt, Homo sapiens
acaucucugggaa

SEQ ID NO: 1278778 - RNA, 20 nt, Homo sapiens
acaucugagagaugacaggg

SEQ ID NO: 1278779 - RNA, 20 nt, Homo sapiens
acaucugcaauaugaauuca

SEQ ID NO: 1278780 - RNA, 23 nt, Homo sapiens
acaucuggcuuauuuuaauguga

SEQ ID NO: 1278781 - RNA, 15 nt, Homo sapiens
acaucuggucuucca

SEQ ID NO: 1278782 - RNA, 11 nt, Homo sapiens
acaucugucac

SEQ ID NO: 1278783 - RNA, 12 nt, Homo sapiens
acaucugucacg

SEQ ID NO: 1278784 - RNA, 18 nt, Homo sapiens
acaucuugcucugcugac

SEQ ID NO: 1278785 - RNA, 15 nt, Homo sapiens
acaucuuuaaacagu

SEQ ID NO: 1278786 - RNA, 20 nt, Homo sapiens
acaugaaaaacaggugacau

SEQ ID NO: 1278787 - RNA, 14 nt, Homo sapiens
acaugaacugccag

SEQ ID NO: 1278788 - RNA, 14 nt, Homo sapiens
acaugaagaagcua

SEQ ID NO: 1278789 - RNA, 18 nt, Homo sapiens
acaugacaacuuugccag

SEQ ID NO: 1278790 - RNA, 19 nt, Homo sapiens
acaugagaaggaacuucca

SEQ ID NO: 1278791 - RNA, 16 nt, Homo sapiens
acaugagaagugauaa

SEQ ID NO: 1278792 - RNA, 16 nt, Homo sapiens
acaugagcuauuucca

SEQ ID NO: 1278793 - RNA, 16 nt, Homo sapiens
acaugaggccaucuca

SEQ ID NO: 1278794 - RNA, 22 nt, Homo sapiens
acaugaucuguuuuucaccacu

SEQ ID NO: 1278795 - RNA, 20 nt, Homo sapiens
acaugcaaagauccccaaaa

SEQ ID NO: 1278796 - RNA, 21 nt, Homo sapiens
acaugcacacacacacaucuc

SEQ ID NO: 1278797 - RNA, 23 nt, Homo sapiens
acaugcacacacacacaucucau

SEQ ID NO: 1278798 - RNA, 13 nt, Homo sapiens
acaugcacugacc

SEQ ID NO: 1278799 - RNA, 21 nt, Homo sapiens
acaugcagcaaggggacaucu

SEQ ID NO: 1278800 - RNA, 15 nt, Homo sapiens
acaugccagugacac

SEQ ID NO: 1278801 - RNA, 20 nt, Homo sapiens
acaugccucugccaaaggau

SEQ ID NO: 1278802 - RNA, 23 nt, Homo sapiens
acaugcugaaaaauauagccuuu

SEQ ID NO: 1278803 - RNA, 14 nt, Homo sapiens
acaugcuggugcau

SEQ ID NO: 1278804 - RNA, 14 nt, Homo sapiens
acauggaacuuuag

SEQ ID NO: 1278805 - RNA, 15 nt, Homo sapiens
acauggaugccaacc

SEQ ID NO: 1278806 - RNA, 18 nt, Homo sapiens
acauggcuguguuugcag

SEQ ID NO: 1278807 - RNA, 14 nt, Homo sapiens
acaugggagcucuu

SEQ ID NO: 1278808 - RNA, 18 nt, Homo sapiens
acauggucaaaauuucac

SEQ ID NO: 1278809 - RNA, 20 nt, Homo sapiens
acauggugaaaccccgucuc

SEQ ID NO: 1278810 - RNA, 19 nt, Homo sapiens
acauguaauuaaguacuau

SEQ ID NO: 1278811 - RNA, 13 nt, Homo sapiens
acauguacagaca

SEQ ID NO: 1278812 - RNA, 18 nt, Homo sapiens
acauguaugugcauuuca

SEQ ID NO: 1278813 - RNA, 12 nt, Homo sapiens
acauguauugca

SEQ ID NO: 1278814 - RNA, 15 nt, Homo sapiens
acauguauugcacau

SEQ ID NO: 1278815 - RNA, 18 nt, Homo sapiens
acauguauugcacauugu

SEQ ID NO: 1278816 - RNA, 23 nt, Homo sapiens
acaugucuuuucuuccacugccu

SEQ ID NO: 1278817 - RNA, 11 nt, Homo sapiens
acaugugaugu

SEQ ID NO: 1278818 - RNA, 11 nt, Homo sapiens
acaugugauug

SEQ ID NO: 1278819 - RNA, 12 nt, Homo sapiens
acauguguaccu

SEQ ID NO: 1278820 - RNA, 20 nt, Homo sapiens
acauguguagccugugcaug

SEQ ID NO: 1278821 - RNA, 22 nt, Homo sapiens
acauguguuuuaauuccaauau

SEQ ID NO: 1278822 - RNA, 10 nt, Homo sapiens
acauguuaau

SEQ ID NO: 1278823 - RNA, 22 nt, Homo sapiens
acauguucauggguuuaccacu

SEQ ID NO: 1278824 - RNA, 15 nt, Homo sapiens
acauguucugugccu

SEQ ID NO: 1278825 - RNA, 18 nt, Homo sapiens
acauguugucacauucuc

SEQ ID NO: 1278826 - RNA, 19 nt, Homo sapiens
acauuaaaauaaaccaaau

SEQ ID NO: 1278827 - RNA, 17 nt, Homo sapiens
acauuaaggcaguauga

SEQ ID NO: 1278828 - RNA, 12 nt, Homo sapiens
acauuagaauaa

SEQ ID NO: 1278829 - RNA, 21 nt, Homo sapiens
acauuauccauccucugagau

SEQ ID NO: 1278830 - RNA, 15 nt, Homo sapiens
acauuaugugugcau

SEQ ID NO: 1278831 - RNA, 15 nt, Homo sapiens
acauucacacagaga

SEQ ID NO: 1278832 - RNA, 19 nt, Homo sapiens
acauucacacagggcucuu

SEQ ID NO: 1278833 - RNA, 12 nt, Homo sapiens
acauuccagggg

SEQ ID NO: 1278834 - RNA, 12 nt, Homo sapiens
acauuccuugag

SEQ ID NO: 1278835 - RNA, 20 nt, Homo sapiens
acauucuaaaggcuugauau

SEQ ID NO: 1278836 - RNA, 15 nt, Homo sapiens
acauucuaauuugca

SEQ ID NO: 1278837 - RNA, 19 nt, Homo sapiens
acauucuuaccauuucaca

SEQ ID NO: 1278838 - RNA, 12 nt, Homo sapiens
acauucuuggcu

SEQ ID NO: 1278839 - RNA, 23 nt, Homo sapiens
acauucuuguuuuaagugccuuu

SEQ ID NO: 1278840 - RNA, 18 nt, Homo sapiens
acauucuuuaucuugaca

SEQ ID NO: 1278841 - RNA, 12 nt, Homo sapiens
acauugagauca

SEQ ID NO: 1278842 - RNA, 21 nt, Homo sapiens
acauugagaucacuacucagu

SEQ ID NO: 1278843 - RNA, 20 nt, Homo sapiens
acauugcuugugccacaccc

SEQ ID NO: 1278844 - RNA, 19 nt, Homo sapiens
acauuggagcugacuguuc

SEQ ID NO: 1278845 - RNA, 12 nt, Homo sapiens
acauugugccuu

SEQ ID NO: 1278846 - RNA, 20 nt, Homo sapiens
acauuguuugucugucuuca

SEQ ID NO: 1278847 - RNA, 16 nt, Homo sapiens
acauuuaaaauucaau

SEQ ID NO: 1278848 - RNA, 19 nt, Homo sapiens
acauuuaaauguaacuuau

SEQ ID NO: 1278849 - RNA, 20 nt, Homo sapiens
acauuuacugaccauguacu

SEQ ID NO: 1278850 - RNA, 20 nt, Homo sapiens
acauuuaugaguaacuauua

SEQ ID NO: 1278851 - RNA, 18 nt, Homo sapiens
acauuuauucugcucaca

SEQ ID NO: 1278852 - RNA, 19 nt, Homo sapiens
acauuucccccgagcucuu

SEQ ID NO: 1278853 - RNA, 17 nt, Homo sapiens
acauuuccucagucaag

SEQ ID NO: 1278854 - RNA, 14 nt, Homo sapiens
acauuucucacuga

SEQ ID NO: 1278855 - RNA, 18 nt, Homo sapiens
acauuucucauaccuucc

SEQ ID NO: 1278856 - RNA, 15 nt, Homo sapiens
aaaaaacaaucugga

SEQ ID NO: 1278857 - RNA, 16 nt, Homo sapiens
aaaaaacacaucuggc

SEQ ID NO: 1278858 - RNA, 16 nt, Homo sapiens
aaaaaagccuccaagg

SEQ ID NO: 1278859 - RNA, 17 nt, Homo sapiens
aaaaaauaaaguaccac

SEQ ID NO: 1278860 - RNA, 14 nt, Homo sapiens
aaaaaauacucugc

SEQ ID NO: 1278861 - RNA, 12 nt, Homo sapiens
aaaaaauccauu

SEQ ID NO: 1278862 - RNA, 15 nt, Homo sapiens
aaaaacaaugugcug

SEQ ID NO: 1278863 - RNA, 22 nt, Homo sapiens
aaaaacaaugugcugcugcuuc

SEQ ID NO: 1278864 - RNA, 16 nt, Homo sapiens
aaaaacacguggagau

SEQ ID NO: 1278865 - RNA, 16 nt, Homo sapiens
aaaaacacucaacaaa

SEQ ID NO: 1278866 - RNA, 16 nt, Homo sapiens
aaaaacagagccuccu

SEQ ID NO: 1278867 - RNA, 15 nt, Homo sapiens
aaaaacaggucuuca

SEQ ID NO: 1278868 - RNA, 11 nt, Homo sapiens
aaaaacaugua

SEQ ID NO: 1278869 - RNA, 23 nt, Homo sapiens
aaaaaccaaacccagacaaccaa

SEQ ID NO: 1278870 - RNA, 18 nt, Homo sapiens
aaaaaccaauagcuuuaa

SEQ ID NO: 1278871 - RNA, 18 nt, Homo sapiens
aaaaacuaacacccaguc

SEQ ID NO: 1278872 - RNA, 18 nt, Homo sapiens
aaaaacugcuuacuuaug

SEQ ID NO: 1278873 - RNA, 13 nt, Homo sapiens
aaaaagaaugugc

SEQ ID NO: 1278874 - RNA, 19 nt, Homo sapiens
aaaaagaccuaugagcaca

SEQ ID NO: 1278875 - RNA, 18 nt, Homo sapiens
aaaaagcaacaucuucau

SEQ ID NO: 1278876 - RNA, 21 nt, Homo sapiens
aaaaagcaacaucuucauaga

SEQ ID NO: 1278877 - RNA, 13 nt, Homo sapiens
aaaaagcauacuu

SEQ ID NO: 1278878 - RNA, 17 nt, Homo sapiens
aaaaagccaguuugggu

SEQ ID NO: 1278879 - RNA, 14 nt, Homo sapiens
aaaaagccugugaa

SEQ ID NO: 1278880 - RNA, 12 nt, Homo sapiens
aaaaagcuucca

SEQ ID NO: 1278881 - RNA, 13 nt, Homo sapiens
aaaaaggacucug

SEQ ID NO: 1278882 - RNA, 17 nt, Homo sapiens
aaaaaggacucugcuuc

SEQ ID NO: 1278883 - RNA, 21 nt, Homo sapiens
aaaaaggauaugguagcauuu

SEQ ID NO: 1278884 - RNA, 12 nt, Homo sapiens
aaaaaguaccag

SEQ ID NO: 1278885 - RNA, 12 nt, Homo sapiens
aaaaaguguuua

SEQ ID NO: 1278886 - RNA, 16 nt, Homo sapiens
aaaaaguuaaacauug

SEQ ID NO: 1278887 - RNA, 12 nt, Homo sapiens
aaaaaguuccau

SEQ ID NO: 1278888 - RNA, 19 nt, Homo sapiens
aaaaaguugaaccauuaua

SEQ ID NO: 1278889 - RNA, 16 nt, Homo sapiens
aaaaaguuucacaggu

SEQ ID NO: 1278890 - RNA, 22 nt, Homo sapiens
aaaaauaaaacuucacauuuau

SEQ ID NO: 1278891 - RNA, 17 nt, Homo sapiens
aaaaauaaaccaaagga

SEQ ID NO: 1278892 - RNA, 11 nt, Homo sapiens
aaaaauacuuu

SEQ ID NO: 1278893 - RNA, 14 nt, Homo sapiens
aaaaauauguacaa

SEQ ID NO: 1278894 - RNA, 15 nt, Homo sapiens
aaaaauauugcugaa

SEQ ID NO: 1278895 - RNA, 23 nt, Homo sapiens
aaaaauauuguuucugcauucau

SEQ ID NO: 1278896 - RNA, 21 nt, Homo sapiens
aaaaauauuuauaaaacuucu

SEQ ID NO: 1278897 - RNA, 19 nt, Homo sapiens
aaaaaucccauuucuugaa

SEQ ID NO: 1278898 - RNA, 17 nt, Homo sapiens
aaaaaugaaauccagug

SEQ ID NO: 1278899 - RNA, 21 nt, Homo sapiens
aaaaaugcaagccaucucuaa

SEQ ID NO: 1278900 - RNA, 23 nt, Homo sapiens
aaaaauggaacuguacacuuguu

SEQ ID NO: 1278901 - RNA, 20 nt, Homo sapiens
aaaaaugugccuaguuuuau

SEQ ID NO: 1278902 - RNA, 15 nt, Homo sapiens
aaaaauguguuccau

SEQ ID NO: 1278903 - RNA, 19 nt, Homo sapiens
aaaaauuauacuaacuuau

SEQ ID NO: 1278904 - RNA, 14 nt, Homo sapiens
aaaaauuauggaau

SEQ ID NO: 1278905 - RNA, 16 nt, Homo sapiens
aaaaauucugaaugua

SEQ ID NO: 1278906 - RNA, 22 nt, Homo sapiens
aaaacaacagcucgauccaaau

SEQ ID NO: 1278907 - RNA, 20 nt, Homo sapiens
aaaacaacuucaauauccaa

SEQ ID NO: 1278908 - RNA, 17 nt, Homo sapiens
aaaacacaaaaguuucu

SEQ ID NO: 1278909 - RNA, 14 nt, Homo sapiens
aaaacacauugccu

SEQ ID NO: 1278910 - RNA, 16 nt, Homo sapiens
aaaacaccuagcuuua

SEQ ID NO: 1278911 - RNA, 11 nt, Homo sapiens
aaaacacugcc

SEQ ID NO: 1278912 - RNA, 12 nt, Homo sapiens
aaaacacugugg

SEQ ID NO: 1278913 - RNA, 13 nt, Homo sapiens
aaaacacugugga

SEQ ID NO: 1278914 - RNA, 18 nt, Homo sapiens
aaaacagagccugccuaa

SEQ ID NO: 1278915 - RNA, 15 nt, Homo sapiens
aaaacagaugaccau

SEQ ID NO: 1278916 - RNA, 15 nt, Homo sapiens
aaaacaggcaaauuc

SEQ ID NO: 1278917 - RNA, 11 nt, Homo sapiens
aaaacauaucu

SEQ ID NO: 1278918 - RNA, 20 nt, Homo sapiens
aaaacaucuuuccaguccuu

SEQ ID NO: 1278919 - RNA, 18 nt, Homo sapiens
aaaacaugauuguuuaca

SEQ ID NO: 1278920 - RNA, 15 nt, Homo sapiens
aaaacauuaccaucc

SEQ ID NO: 1278921 - RNA, 11 nt, Homo sapiens
aaaacauucca

SEQ ID NO: 1278922 - RNA, 12 nt, Homo sapiens
aaaacauuccaa

SEQ ID NO: 1278923 - RNA, 19 nt, Homo sapiens
aaaacauugauuauaagca

SEQ ID NO: 1278924 - RNA, 21 nt, Homo sapiens
aaaacauuguuuuguguaaca

SEQ ID NO: 1278925 - RNA, 13 nt, Homo sapiens
aaaacauuugcug

SEQ ID NO: 1278926 - RNA, 13 nt, Homo sapiens
aaaacauuuuacu

SEQ ID NO: 1278927 - RNA, 15 nt, Homo sapiens
aaaaccaaacccaga

SEQ ID NO: 1278928 - RNA, 16 nt, Homo sapiens
aaaaccaauagcuuua

SEQ ID NO: 1278929 - RNA, 16 nt, Homo sapiens
aaaaccacaguccuca

SEQ ID NO: 1278930 - RNA, 20 nt, Homo sapiens
aaaaccagucuguguuuaca

SEQ ID NO: 1278931 - RNA, 14 nt, Homo sapiens
aaaacccacagaag

SEQ ID NO: 1278932 - RNA, 18 nt, Homo sapiens
aaaacccaggacaucucc

SEQ ID NO: 1278933 - RNA, 22 nt, Homo sapiens
aaaacccuugauuauacucugu

SEQ ID NO: 1278934 - RNA, 15 nt, Homo sapiens
aaaaccucuaugcaa

SEQ ID NO: 1278935 - RNA, 14 nt, Homo sapiens
aaaaccugugccag

SEQ ID NO: 1278936 - RNA, 18 nt, Homo sapiens
aaaaccugugugccauuu

SEQ ID NO: 1278937 - RNA, 15 nt, Homo sapiens
aaaacgcaugugcag

SEQ ID NO: 1278938 - RNA, 17 nt, Homo sapiens
aaaacguuuuauugugu

SEQ ID NO: 1278939 - RNA, 14 nt, Homo sapiens
aaaacuacaaauca

SEQ ID NO: 1278940 - RNA, 14 nt, Homo sapiens
acggacucccgggc

SEQ ID NO: 1278941 - RNA, 13 nt, Homo sapiens
acggcccaugcaa

SEQ ID NO: 1278942 - RNA, 19 nt, Homo sapiens
acggcguuucaccauguug

SEQ ID NO: 1278943 - RNA, 16 nt, Homo sapiens
acgggaaaggagcugc

SEQ ID NO: 1278944 - RNA, 17 nt, Homo sapiens
acgggagaauauacaaa

SEQ ID NO: 1278945 - RNA, 17 nt, Homo sapiens
acgggcaagaagcugcu

SEQ ID NO: 1278946 - RNA, 18 nt, Homo sapiens
acgggcaugggcacuccc

SEQ ID NO: 1278947 - RNA, 16 nt, Homo sapiens
acggucaguccauguc

SEQ ID NO: 1278948 - RNA, 18 nt, Homo sapiens
acggucaguccaugucuc

SEQ ID NO: 1278949 - RNA, 16 nt, Homo sapiens
acggugugcaccaaca

SEQ ID NO: 1278950 - RNA, 15 nt, Homo sapiens
acgguguuuugccau

SEQ ID NO: 1278951 - RNA, 19 nt, Homo sapiens
acguaugagaaaccuauau

SEQ ID NO: 1278952 - RNA, 16 nt, Homo sapiens
acguaugguggcucau

SEQ ID NO: 1278953 - RNA, 16 nt, Homo sapiens
acguauuggaccugcc

SEQ ID NO: 1278954 - RNA, 23 nt, Homo sapiens
acgucgcccgcugagcugagugg

SEQ ID NO: 1278955 - RNA, 15 nt, Homo sapiens
acgugaggccugcac

SEQ ID NO: 1278956 - RNA, 17 nt, Homo sapiens
acgugauuuccagugag

SEQ ID NO: 1278957 - RNA, 16 nt, Homo sapiens
acgugcgcgaugugac

SEQ ID NO: 1278958 - RNA, 19 nt, Homo sapiens
acguggaaccucugucuca

SEQ ID NO: 1278959 - RNA, 20 nt, Homo sapiens
acguggccucuugagcagug

SEQ ID NO: 1278960 - RNA, 12 nt, Homo sapiens
acguguguaaau

SEQ ID NO: 1278961 - RNA, 22 nt, Homo sapiens
acguuuauaaacagaaauggaa

SEQ ID NO: 1278962 - RNA, 16 nt, Homo sapiens
acguuugcucauuuaa

SEQ ID NO: 1278963 - RNA, 21 nt, Homo sapiens
acguuugcucauuuaagaauu

SEQ ID NO: 1278964 - RNA, 15 nt, Homo sapiens
acguuuucuuucaca

SEQ ID NO: 1278965 - RNA, 15 nt, Homo sapiens
acuaaaaaguaccag

SEQ ID NO: 1278966 - RNA, 16 nt, Homo sapiens
acuaaaaauacaaaaa

SEQ ID NO: 1278967 - RNA, 22 nt, Homo sapiens
acuaaaaauauagcaaaugcag

SEQ ID NO: 1278968 - RNA, 17 nt, Homo sapiens
acuaaaacacacaggug

SEQ ID NO: 1278969 - RNA, 17 nt, Homo sapiens
acuaaaacugcauuucc

SEQ ID NO: 1278970 - RNA, 21 nt, Homo sapiens
acuaaaacuuuccugacuuac

SEQ ID NO: 1278971 - RNA, 20 nt, Homo sapiens
acuaaaagcagcgucacucu

SEQ ID NO: 1278972 - RNA, 22 nt, Homo sapiens
acuaaaccaacucuaauauugc

SEQ ID NO: 1278973 - RNA, 20 nt, Homo sapiens
acuaaagcuauguuacaugg

SEQ ID NO: 1278974 - RNA, 12 nt, Homo sapiens
acuaaccuggua

SEQ ID NO: 1278975 - RNA, 14 nt, Homo sapiens
acuaagacaccuga

SEQ ID NO: 1278976 - RNA, 20 nt, Homo sapiens
acuaagauaaauucaugcac

SEQ ID NO: 1278977 - RNA, 13 nt, Homo sapiens
acuaagcacaaag

SEQ ID NO: 1278978 - RNA, 19 nt, Homo sapiens
acuaaggcagcuaagacau

SEQ ID NO: 1278979 - RNA, 19 nt, Homo sapiens
acuaagguggaugccaacc

SEQ ID NO: 1278980 - RNA, 22 nt, Homo sapiens
acuaaucaagaaaaacaucuuu

SEQ ID NO: 1278981 - RNA, 17 nt, Homo sapiens
acuaauccucucugcaa

SEQ ID NO: 1278982 - RNA, 22 nt, Homo sapiens
acuaaugaucacauucuuucca

SEQ ID NO: 1278983 - RNA, 16 nt, Homo sapiens
acuaaugauguuuucc

SEQ ID NO: 1278984 - RNA, 14 nt, Homo sapiens
acuaauuaggcaag

SEQ ID NO: 1278985 - RNA, 20 nt, Homo sapiens
acuaauuauacuacuuuguu

SEQ ID NO: 1278986 - RNA, 17 nt, Homo sapiens
acuacaaacacaauauu

SEQ ID NO: 1278987 - RNA, 14 nt, Homo sapiens
acuacaagucagcu

SEQ ID NO: 1278988 - RNA, 14 nt, Homo sapiens
acuacacagcacac

SEQ ID NO: 1278989 - RNA, 13 nt, Homo sapiens
acuacacugagga

SEQ ID NO: 1278990 - RNA, 16 nt, Homo sapiens
acuacauaucuaaagc

SEQ ID NO: 1278991 - RNA, 15 nt, Homo sapiens
acuacaucuaguuaa

SEQ ID NO: 1278992 - RNA, 13 nt, Homo sapiens
acuaccuguguau

SEQ ID NO: 1278993 - RNA, 16 nt, Homo sapiens
acuacuaaagugccua

SEQ ID NO: 1278994 - RNA, 12 nt, Homo sapiens
acuacuaccucu

SEQ ID NO: 1278995 - RNA, 18 nt, Homo sapiens
acuagagggauacacuga

SEQ ID NO: 1278996 - RNA, 15 nt, Homo sapiens
acuagauacuacuuu

SEQ ID NO: 1278997 - RNA, 15 nt, Homo sapiens
acuagauucuuguca

SEQ ID NO: 1278998 - RNA, 15 nt, Homo sapiens
acuagauugcaugcu

SEQ ID NO: 1278999 - RNA, 21 nt, Homo sapiens
acuagcccaaugaaaugaauu

SEQ ID NO: 1279000 - RNA, 14 nt, Homo sapiens
acuagcuuuugcca

SEQ ID NO: 1279001 - RNA, 15 nt, Homo sapiens
acuaggacucugagg

SEQ ID NO: 1279002 - RNA, 18 nt, Homo sapiens
acuagggagccauuugag

SEQ ID NO: 1279003 - RNA, 23 nt, Homo sapiens
acuaguauguuuucaagucuccu

SEQ ID NO: 1279004 - RNA, 18 nt, Homo sapiens
acuaguggcucucaguua

SEQ ID NO: 1279005 - RNA, 20 nt, Homo sapiens
acuagugugguguguuugcu

SEQ ID NO: 1279006 - RNA, 17 nt, Homo sapiens
acuaguuuuuauuccuu

SEQ ID NO: 1279007 - RNA, 16 nt, Homo sapiens
acuauaaauauguaca

SEQ ID NO: 1279008 - RNA, 17 nt, Homo sapiens
acuauaauuugacuuga

SEQ ID NO: 1279009 - RNA, 13 nt, Homo sapiens
acuauaccuuauc

SEQ ID NO: 1279010 - RNA, 16 nt, Homo sapiens
acuauauguacagcuc

SEQ ID NO: 1279011 - RNA, 12 nt, Homo sapiens
acuaucauucuc

SEQ ID NO: 1279012 - RNA, 16 nt, Homo sapiens
acuauccaguuacugc

SEQ ID NO: 1279013 - RNA, 15 nt, Homo sapiens
acuaucccaaucaaa

SEQ ID NO: 1279014 - RNA, 19 nt, Homo sapiens
acuaugaagcuaccucaaa

SEQ ID NO: 1279015 - RNA, 14 nt, Homo sapiens
acuauggagccugg

SEQ ID NO: 1279016 - RNA, 19 nt, Homo sapiens
acuauggagccuggcacag

SEQ ID NO: 1279017 - RNA, 15 nt, Homo sapiens
acuauguugcccagg

SEQ ID NO: 1279018 - RNA, 16 nt, Homo sapiens
acuauucuauggccau

SEQ ID NO: 1279019 - RNA, 20 nt, Homo sapiens
acuauugaaaucaagcuuau

SEQ ID NO: 1279020 - RNA, 21 nt, Homo sapiens
acuauuuaaaggaaaaucaca

SEQ ID NO: 1279021 - RNA, 16 nt, Homo sapiens
acuauuuacuauucaa

SEQ ID NO: 1279022 - RNA, 15 nt, Homo sapiens
acuauuuuaccugaa

SEQ ID NO: 1279023 - RNA, 14 nt, Homo sapiens
acuauuuuuccaaa

SEQ ID NO: 1279024 - RNA, 23 nt, Homo sapiens
acucaaaacgcuacugagucaca

SEQ ID NO: 1279025 - RNA, 13 nt, Homo sapiens
acucaaaagacaa

SEQ ID NO: 1279026 - RNA, 14 nt, Homo sapiens
acucaaaagacaaa

SEQ ID NO: 1279027 - RNA, 22 nt, Homo sapiens
acucaaaagcugggaaccagca

SEQ ID NO: 1279028 - RNA, 20 nt, Homo sapiens
acucaaacaaucaugaguca

SEQ ID NO: 1279029 - RNA, 18 nt, Homo sapiens
acucaaauuggugaacag

SEQ ID NO: 1279030 - RNA, 15 nt, Homo sapiens
acucaaguaccacca

SEQ ID NO: 1279031 - RNA, 20 nt, Homo sapiens
acucaaguccuuaccucuuc

SEQ ID NO: 1279032 - RNA, 16 nt, Homo sapiens
acucaauacuaccucu

SEQ ID NO: 1279033 - RNA, 17 nt, Homo sapiens
acucaauggccuaaaac

SEQ ID NO: 1279034 - RNA, 12 nt, Homo sapiens
acucacacuccc

SEQ ID NO: 1279035 - RNA, 12 nt, Homo sapiens
acucaccaucug

SEQ ID NO: 1279036 - RNA, 19 nt, Homo sapiens
acucacccugggagccagu

SEQ ID NO: 1279037 - RNA, 17 nt, Homo sapiens
acucaccugcacuaaca

SEQ ID NO: 1279038 - RNA, 17 nt, Homo sapiens
acucacucauuccuuca

SEQ ID NO: 1279039 - RNA, 19 nt, Homo sapiens
acucacuucaaugugucau

SEQ ID NO: 1279040 - RNA, 14 nt, Homo sapiens
acucagaacccagg

SEQ ID NO: 1279041 - RNA, 17 nt, Homo sapiens
acucagaacccaggaca

SEQ ID NO: 1279042 - RNA, 16 nt, Homo sapiens
acucagaagacacuga

SEQ ID NO: 1279043 - RNA, 17 nt, Homo sapiens
acucagaagacacugau

SEQ ID NO: 1279044 - RNA, 17 nt, Homo sapiens
acucagagaaacaaugg

SEQ ID NO: 1279045 - RNA, 20 nt, Homo sapiens
acucagagaugaacaucuaa

SEQ ID NO: 1279046 - RNA, 21 nt, Homo sapiens
acucagaggagcugcaaauug

SEQ ID NO: 1279047 - RNA, 18 nt, Homo sapiens
acucagaggcagugacag

SEQ ID NO: 1279048 - RNA, 23 nt, Homo sapiens
acucagauugagcccuacauugu

SEQ ID NO: 1279049 - RNA, 13 nt, Homo sapiens
acucagccaagac

SEQ ID NO: 1279050 - RNA, 15 nt, Homo sapiens
acucagccacgacca

SEQ ID NO: 1279051 - RNA, 12 nt, Homo sapiens
acucaggaucca

SEQ ID NO: 1279052 - RNA, 16 nt, Homo sapiens
acucagucucuuccac

SEQ ID NO: 1279053 - RNA, 16 nt, Homo sapiens
acucagugcagcaaua

SEQ ID NO: 1279054 - RNA, 17 nt, Homo sapiens
acucagugcagcaauau

SEQ ID NO: 1279055 - RNA, 16 nt, Homo sapiens
acucaguuucuaggca

SEQ ID NO: 1279056 - RNA, 22 nt, Homo sapiens
acucaguuugucagacuuuaaa

SEQ ID NO: 1279057 - RNA, 17 nt, Homo sapiens
acucauccauccccugg

SEQ ID NO: 1279058 - RNA, 18 nt, Homo sapiens
acucaucuuagugccuga

SEQ ID NO: 1279059 - RNA, 20 nt, Homo sapiens
acucaucuuagugccugaga

SEQ ID NO: 1279060 - RNA, 15 nt, Homo sapiens
acucauuacugcaaa

SEQ ID NO: 1279061 - RNA, 19 nt, Homo sapiens
acucauuagugacuucaaa

SEQ ID NO: 1279062 - RNA, 17 nt, Homo sapiens
acucauugaaaugucac

SEQ ID NO: 1279063 - RNA, 13 nt, Homo sapiens
acucauugcugag

SEQ ID NO: 1279064 - RNA, 22 nt, Homo sapiens
acucauuucauuccuaacacag

SEQ ID NO: 1279065 - RNA, 19 nt, Homo sapiens
acuccaaaguccacacaaa

SEQ ID NO: 1279066 - RNA, 19 nt, Homo sapiens
acuguauauaaacuccuua

SEQ ID NO: 1279067 - RNA, 15 nt, Homo sapiens
acuguaucaagucau

SEQ ID NO: 1279068 - RNA, 17 nt, Homo sapiens
acugucaaguacaagca

SEQ ID NO: 1279069 - RNA, 20 nt, Homo sapiens
acugucaguguacacgucug

SEQ ID NO: 1279070 - RNA, 17 nt, Homo sapiens
acugucauccucaaaga

SEQ ID NO: 1279071 - RNA, 21 nt, Homo sapiens
acugucugggauuaagggcaa

SEQ ID NO: 1279072 - RNA, 18 nt, Homo sapiens
acugucuuaaagagagag

SEQ ID NO: 1279073 - RNA, 12 nt, Homo sapiens
acugucuuucag

SEQ ID NO: 1279074 - RNA, 21 nt, Homo sapiens
acugugaaauaccacaagccu

SEQ ID NO: 1279075 - RNA, 17 nt, Homo sapiens
acugugagaggugacac

SEQ ID NO: 1279076 - RNA, 23 nt, Homo sapiens
acugugagaggugacacuguugg

SEQ ID NO: 1279077 - RNA, 14 nt, Homo sapiens
acugugagcaagga

SEQ ID NO: 1279078 - RNA, 16 nt, Homo sapiens
acugugaggaagugug

SEQ ID NO: 1279079 - RNA, 18 nt, Homo sapiens
acugugccaugugccagg

SEQ ID NO: 1279080 - RNA, 23 nt, Homo sapiens
acugugccuuguuucaacaguuu

SEQ ID NO: 1279081 - RNA, 19 nt, Homo sapiens
acugugccuuugcaaauca

SEQ ID NO: 1279082 - RNA, 13 nt, Homo sapiens
acugugcuacugu

SEQ ID NO: 1279083 - RNA, 14 nt, Homo sapiens
acuguggagcucag

SEQ ID NO: 1279084 - RNA, 21 nt, Homo sapiens
acuguggccuguuaacuggua

SEQ ID NO: 1279085 - RNA, 14 nt, Homo sapiens
acuguggucauccu

SEQ ID NO: 1279086 - RNA, 13 nt, Homo sapiens
acuguguacugug

SEQ ID NO: 1279087 - RNA, 15 nt, Homo sapiens
acugugucacccaga

SEQ ID NO: 1279088 - RNA, 17 nt, Homo sapiens
acuguguuucaaguuca

SEQ ID NO: 1279089 - RNA, 16 nt, Homo sapiens
acuguuaacuaugaca

SEQ ID NO: 1279090 - RNA, 17 nt, Homo sapiens
acuguuaacuaugacag

SEQ ID NO: 1279091 - RNA, 22 nt, Homo sapiens
acuguuaagaagcagccaucac

SEQ ID NO: 1279092 - RNA, 21 nt, Homo sapiens
acuguuaagaauagaaaacug

SEQ ID NO: 1279093 - RNA, 20 nt, Homo sapiens
acuguuagucauuugcugag

SEQ ID NO: 1279094 - RNA, 22 nt, Homo sapiens
acuguucaauacuguaugccuu

SEQ ID NO: 1279095 - RNA, 13 nt, Homo sapiens
acuguuccaaagc

SEQ ID NO: 1279096 - RNA, 14 nt, Homo sapiens
acuguuccaaagcc

SEQ ID NO: 1279097 - RNA, 20 nt, Homo sapiens
acuguuccaaagccagugaa

SEQ ID NO: 1279098 - RNA, 13 nt, Homo sapiens
acuguucuaaagc

SEQ ID NO: 1279099 - RNA, 23 nt, Homo sapiens
acuguucucuauuagacuuuaga

SEQ ID NO: 1279100 - RNA, 15 nt, Homo sapiens
acuguucuugcugcu

SEQ ID NO: 1279101 - RNA, 19 nt, Homo sapiens
acuguucuugcugcuagaa

SEQ ID NO: 1279102 - RNA, 23 nt, Homo sapiens
acuguugagaggguuacuuacau

SEQ ID NO: 1279103 - RNA, 19 nt, Homo sapiens
acuguugcaaacucagugc

SEQ ID NO: 1279104 - RNA, 12 nt, Homo sapiens
acuguugcacug

SEQ ID NO: 1279105 - RNA, 13 nt, Homo sapiens
acuguugcucaaa

SEQ ID NO: 1279106 - RNA, 16 nt, Homo sapiens
acuguugucaaaaagu

SEQ ID NO: 1279107 - RNA, 20 nt, Homo sapiens
acuguuuuguaagugcugcu

SEQ ID NO: 1279108 - RNA, 15 nt, Homo sapiens
acuuaaaaguauuca

SEQ ID NO: 1279109 - RNA, 16 nt, Homo sapiens
acuuaaauuccucaac

SEQ ID NO: 1279110 - RNA, 13 nt, Homo sapiens
acuuaacuaugag

SEQ ID NO: 1279111 - RNA, 22 nt, Homo sapiens
acuuaagcugggauaaucacau

SEQ ID NO: 1279112 - RNA, 22 nt, Homo sapiens
acuuaccacucgugcaucccug

SEQ ID NO: 1279113 - RNA, 12 nt, Homo sapiens
acuuaccucaaa

SEQ ID NO: 1279114 - RNA, 18 nt, Homo sapiens
acuuacuauucauuaaau

SEQ ID NO: 1279115 - RNA, 23 nt, Homo sapiens
acuuagaaauugcauuuccugac

SEQ ID NO: 1279116 - RNA, 15 nt, Homo sapiens
acuuagcaugcacaa

SEQ ID NO: 1279117 - RNA, 23 nt, Homo sapiens
acuuaggggaguucaguauuuaa

SEQ ID NO: 1279118 - RNA, 17 nt, Homo sapiens
acuuaguauuuuaccua

SEQ ID NO: 1279119 - RNA, 19 nt, Homo sapiens
acuuagugguaugucucuu

SEQ ID NO: 1279120 - RNA, 21 nt, Homo sapiens
acuuauaagaaagaucaaaga

SEQ ID NO: 1279121 - RNA, 22 nt, Homo sapiens
acuuauaauuaugcuaccuacu

SEQ ID NO: 1279122 - RNA, 21 nt, Homo sapiens
acuuauauuuaaaacuugccu

SEQ ID NO: 1279123 - RNA, 19 nt, Homo sapiens
acuuaucacgccuacuuaa

SEQ ID NO: 1279124 - RNA, 20 nt, Homo sapiens
acuuaucacgccuacuuaag

SEQ ID NO: 1279125 - RNA, 20 nt, Homo sapiens
acuuaugggcccagccagcc

SEQ ID NO: 1279126 - RNA, 15 nt, Homo sapiens
acuuauguacuugau

SEQ ID NO: 1279127 - RNA, 22 nt, Homo sapiens
acuuauuggaacucugcuugau

SEQ ID NO: 1279128 - RNA, 15 nt, Homo sapiens
acuuauuucauaaac

SEQ ID NO: 1279129 - RNA, 19 nt, Homo sapiens
acuuauuucauaaacaacu

SEQ ID NO: 1279130 - RNA, 11 nt, Homo sapiens
acuucaaagag

SEQ ID NO: 1279131 - RNA, 20 nt, Homo sapiens
acuucaaagaggaaccagga

SEQ ID NO: 1279132 - RNA, 19 nt, Homo sapiens
acuucaaaugugguauaca

SEQ ID NO: 1279133 - RNA, 13 nt, Homo sapiens
acuucaagugacc

SEQ ID NO: 1279134 - RNA, 10 nt, Homo sapiens
agcugccauu

SEQ ID NO: 1279135 - RNA, 20 nt, Homo sapiens
agcugcccuugaagacuucc

SEQ ID NO: 1279136 - RNA, 14 nt, Homo sapiens
agcugccucacuuc

SEQ ID NO: 1279137 - RNA, 15 nt, Homo sapiens
agcugccucugggcc

SEQ ID NO: 1279138 - RNA, 20 nt, Homo sapiens
agcugcucagcaaccuuuca

SEQ ID NO: 1279139 - RNA, 23 nt, Homo sapiens
agcugcucuccuaucagaagcuc

SEQ ID NO: 1279140 - RNA, 15 nt, Homo sapiens
agcuggaaaaccucc

SEQ ID NO: 1279141 - RNA, 17 nt, Homo sapiens
agcuggaagucuaccug

SEQ ID NO: 1279142 - RNA, 18 nt, Homo sapiens
agcuggagggagggguga

SEQ ID NO: 1279143 - RNA, 14 nt, Homo sapiens
agcuggcacugugg

SEQ ID NO: 1279144 - RNA, 13 nt, Homo sapiens
agcuggccugaga

SEQ ID NO: 1279145 - RNA, 14 nt, Homo sapiens
agcuggcucuguga

SEQ ID NO: 1279146 - RNA, 16 nt, Homo sapiens
agcuggcuguauggaa

SEQ ID NO: 1279147 - RNA, 18 nt, Homo sapiens
agcugggacuacaggcac

SEQ ID NO: 1279148 - RNA, 18 nt, Homo sapiens
agcugggauuacaggugu

SEQ ID NO: 1279149 - RNA, 18 nt, Homo sapiens
agcugggccccaccuacu

SEQ ID NO: 1279150 - RNA, 19 nt, Homo sapiens
agcuggugguuucacggug

SEQ ID NO: 1279151 - RNA, 23 nt, Homo sapiens
agcuguauaauuaauugucauua

SEQ ID NO: 1279152 - RNA, 14 nt, Homo sapiens
agcugucacuuuug

SEQ ID NO: 1279153 - RNA, 13 nt, Homo sapiens
agcuguccagcug

SEQ ID NO: 1279154 - RNA, 17 nt, Homo sapiens
agcuguccagcugcaaa

SEQ ID NO: 1279155 - RNA, 16 nt, Homo sapiens
agcugucccacaucac

SEQ ID NO: 1279156 - RNA, 19 nt, Homo sapiens
agcugucgacuucaugaca

SEQ ID NO: 1279157 - RNA, 13 nt, Homo sapiens
agcugucugcuca

SEQ ID NO: 1279158 - RNA, 22 nt, Homo sapiens
agcugucuuagagugggaccaa

SEQ ID NO: 1279159 - RNA, 19 nt, Homo sapiens
agcugugacuucuccaggu

SEQ ID NO: 1279160 - RNA, 20 nt, Homo sapiens
agcugugcucagcacaggcc

SEQ ID NO: 1279161 - RNA, 22 nt, Homo sapiens
agcuguggccuaggcuaccuca

SEQ ID NO: 1279162 - RNA, 18 nt, Homo sapiens
agcuguuacuuucuuuca

SEQ ID NO: 1279163 - RNA, 14 nt, Homo sapiens
agcuguugaaguca

SEQ ID NO: 1279164 - RNA, 18 nt, Homo sapiens
agcuguuuauggccucag

SEQ ID NO: 1279165 - RNA, 16 nt, Homo sapiens
agcuguuuucccugac

SEQ ID NO: 1279166 - RNA, 21 nt, Homo sapiens
agcuguuuuuaggcuguuccu

SEQ ID NO: 1279167 - RNA, 22 nt, Homo sapiens
agcuuaaaauaaacaguuguga

SEQ ID NO: 1279168 - RNA, 15 nt, Homo sapiens
agcuuaccugacaca

SEQ ID NO: 1279169 - RNA, 18 nt, Homo sapiens
agcuuagcaucagagguu

SEQ ID NO: 1279170 - RNA, 14 nt, Homo sapiens
agcuuauagaauaa

SEQ ID NO: 1279171 - RNA, 16 nt, Homo sapiens
agcuuauagucuucca

SEQ ID NO: 1279172 - RNA, 17 nt, Homo sapiens
agcuuauagucuuccag

SEQ ID NO: 1279173 - RNA, 18 nt, Homo sapiens
agcuuauauauuacuugu

SEQ ID NO: 1279174 - RNA, 14 nt, Homo sapiens
agcuucaaacugca

SEQ ID NO: 1279175 - RNA, 17 nt, Homo sapiens
agcuucacucucugggg

SEQ ID NO: 1279176 - RNA, 22 nt, Homo sapiens
agcuucaggagggaaccagcuu

SEQ ID NO: 1279177 - RNA, 15 nt, Homo sapiens
agcuucaugccuuug

SEQ ID NO: 1279178 - RNA, 15 nt, Homo sapiens
agcuucccuugccuc

SEQ ID NO: 1279179 - RNA, 21 nt, Homo sapiens
agcuucucaaaguacugggau

SEQ ID NO: 1279180 - RNA, 22 nt, Homo sapiens
agcuucucugcaguaaaacaca

SEQ ID NO: 1279181 - RNA, 19 nt, Homo sapiens
agcuucugcuuuucugccc

SEQ ID NO: 1279182 - RNA, 20 nt, Homo sapiens
agcuugaguuuuuaguggaa

SEQ ID NO: 1279183 - RNA, 23 nt, Homo sapiens
agcuugauuaaaucaaccaccua

SEQ ID NO: 1279184 - RNA, 14 nt, Homo sapiens
agcuugcaacaaaa

SEQ ID NO: 1279185 - RNA, 14 nt, Homo sapiens
agcuugucaaagau

SEQ ID NO: 1279186 - RNA, 17 nt, Homo sapiens
agcuuuaaacucaggga

SEQ ID NO: 1279187 - RNA, 17 nt, Homo sapiens
agcuuucaaaagcaaga

SEQ ID NO: 1279188 - RNA, 22 nt, Homo sapiens
agcuuucagagccagugaagga

SEQ ID NO: 1279189 - RNA, 22 nt, Homo sapiens
agcuuucccugugccacuuuga

SEQ ID NO: 1279190 - RNA, 23 nt, Homo sapiens
agcuuugcuccgcucccaccgcc

SEQ ID NO: 1279191 - RNA, 16 nt, Homo sapiens
agcuuuggacccaagg

SEQ ID NO: 1279192 - RNA, 20 nt, Homo sapiens
agcuuuuagaaaaugcaguc

SEQ ID NO: 1279193 - RNA, 21 nt, Homo sapiens
aggccugccucccacuucacu

SEQ ID NO: 1279194 - RNA, 17 nt, Homo sapiens
aggccugcugccagugc

SEQ ID NO: 1279195 - RNA, 14 nt, Homo sapiens
aggccuggacuuuc

SEQ ID NO: 1279196 - RNA, 16 nt, Homo sapiens
aggccugggaccuccc

SEQ ID NO: 1279197 - RNA, 21 nt, Homo sapiens
aggccugggaccucccacugc

SEQ ID NO: 1279198 - RNA, 22 nt, Homo sapiens
aggccugggaccucccacugcc

SEQ ID NO: 1279199 - RNA, 18 nt, Homo sapiens
aggccugggccgcugcca

SEQ ID NO: 1279200 - RNA, 21 nt, Homo sapiens
aggccugggccgcugccacgu

SEQ ID NO: 1279201 - RNA, 22 nt, Homo sapiens
aggccuggguuuguacuuccac

SEQ ID NO: 1279202 - RNA, 17 nt, Homo sapiens
aggccuugcucacagcu

SEQ ID NO: 1279203 - RNA, 19 nt, Homo sapiens
aggccuugcucacagcuga

SEQ ID NO: 1279204 - RNA, 16 nt, Homo sapiens
aggccuuuuuugccag

SEQ ID NO: 1279205 - RNA, 19 nt, Homo sapiens
aggcuacuaccuagggcac

SEQ ID NO: 1279206 - RNA, 21 nt, Homo sapiens
aggcuagaacacuacagggga

SEQ ID NO: 1279207 - RNA, 14 nt, Homo sapiens
aggcucagcacuuu

SEQ ID NO: 1279208 - RNA, 16 nt, Homo sapiens
aggcucauggacgaga

SEQ ID NO: 1279209 - RNA, 19 nt, Homo sapiens
aggcuccccagggcucccu

SEQ ID NO: 1279210 - RNA, 14 nt, Homo sapiens
aggcucuaauguac

SEQ ID NO: 1279211 - RNA, 16 nt, Homo sapiens
aggcucuaauguacaa

SEQ ID NO: 1279212 - RNA, 18 nt, Homo sapiens
aggcucuaauguacaaua

SEQ ID NO: 1279213 - RNA, 18 nt, Homo sapiens
aggcucugccagcccugg

SEQ ID NO: 1279214 - RNA, 21 nt, Homo sapiens
aggcucuggcccuugccuuug

SEQ ID NO: 1279215 - RNA, 20 nt, Homo sapiens
aggcucuuaugugugccuuu

SEQ ID NO: 1279216 - RNA, 12 nt, Homo sapiens
aggcucuucucc

SEQ ID NO: 1279217 - RNA, 15 nt, Homo sapiens
aggcugaaagacagg

SEQ ID NO: 1279218 - RNA, 17 nt, Homo sapiens
aggcugaggcaagagaa

SEQ ID NO: 1279219 - RNA, 15 nt, Homo sapiens
aggcugcacagcuca

SEQ ID NO: 1279220 - RNA, 15 nt, Homo sapiens
aggcugccccucuca

SEQ ID NO: 1279221 - RNA, 18 nt, Homo sapiens
aggcugccccucucacca

SEQ ID NO: 1279222 - RNA, 19 nt, Homo sapiens
aggcugccccucucaccaa

SEQ ID NO: 1279223 - RNA, 17 nt, Homo sapiens
aggcugcgacugaugaa

SEQ ID NO: 1279224 - RNA, 20 nt, Homo sapiens
aggcugcgacugaugaaggc

SEQ ID NO: 1279225 - RNA, 17 nt, Homo sapiens
aggcugcugaaaaccau

SEQ ID NO: 1279226 - RNA, 12 nt, Homo sapiens
aggcugcugcug

SEQ ID NO: 1279227 - RNA, 16 nt, Homo sapiens
aggcuggagugcaaug

SEQ ID NO: 1279228 - RNA, 19 nt, Homo sapiens
aggcuggagugcaaugcac

SEQ ID NO: 1279229 - RNA, 16 nt, Homo sapiens
aggcuggagugcagug

SEQ ID NO: 1279230 - RNA, 20 nt, Homo sapiens
aggcuggagugcaguggcau

SEQ ID NO: 1279231 - RNA, 15 nt, Homo sapiens
aggcuggccagucca

SEQ ID NO: 1279232 - RNA, 12 nt, Homo sapiens
aggcugggagac

SEQ ID NO: 1279233 - RNA, 22 nt, Homo sapiens
aggcugggcacagaggucagga

SEQ ID NO: 1279234 - RNA, 12 nt, Homo sapiens
aggcugggccau

SEQ ID NO: 1279235 - RNA, 16 nt, Homo sapiens
aggcugggccaugucc

SEQ ID NO: 1279236 - RNA, 19 nt, Homo sapiens
aggcugguauuuuugucug

SEQ ID NO: 1279237 - RNA, 23 nt, Homo sapiens
aggcugucaggauucuucaagga

SEQ ID NO: 1279238 - RNA, 23 nt, Homo sapiens
aggcugucgugagcuaugauuau

SEQ ID NO: 1279239 - RNA, 16 nt, Homo sapiens
aggcugugggccucaa

SEQ ID NO: 1279240 - RNA, 17 nt, Homo sapiens
aggcuguucugcacuga

SEQ ID NO: 1279241 - RNA, 18 nt, Homo sapiens
aggcuguuugagaaccau

SEQ ID NO: 1279242 - RNA, 10 nt, Homo sapiens
aggcuuccug

SEQ ID NO: 1279243 - RNA, 15 nt, Homo sapiens
aggcuugggauuugc

SEQ ID NO: 1279244 - RNA, 16 nt, Homo sapiens
aggcuuuaucucaggg

SEQ ID NO: 1279245 - RNA, 17 nt, Homo sapiens
aggcuuugggaccaccc

SEQ ID NO: 1279246 - RNA, 20 nt, Homo sapiens
aggcuuuuaccauuagcaua

SEQ ID NO: 1279247 - RNA, 22 nt, Homo sapiens
agggaaaauguuuaccagugua

SEQ ID NO: 1279248 - RNA, 12 nt, Homo sapiens
auaaugaugaug

SEQ ID NO: 1279249 - RNA, 15 nt, Homo sapiens
auaaugcaccacuuu

SEQ ID NO: 1279250 - RNA, 22 nt, Homo sapiens
auaaugcuuucacaacauuugc

SEQ ID NO: 1279251 - RNA, 14 nt, Homo sapiens
auaauguauuuuca

SEQ ID NO: 1279252 - RNA, 18 nt, Homo sapiens
auaauguauuuucagcuc

SEQ ID NO: 1279253 - RNA, 21 nt, Homo sapiens
auaaugucauuaaacaugaca

SEQ ID NO: 1279254 - RNA, 16 nt, Homo sapiens
auaauguuacauuauu

SEQ ID NO: 1279255 - RNA, 17 nt, Homo sapiens
auaauguuacauuauua

SEQ ID NO: 1279256 - RNA, 21 nt, Homo sapiens
auaauguuacauuauuaucaa

SEQ ID NO: 1279257 - RNA, 20 nt, Homo sapiens
auaauuaaccaccaauccaa

SEQ ID NO: 1279258 - RNA, 20 nt, Homo sapiens
auaauucaaaggcauuucuu

SEQ ID NO: 1279259 - RNA, 20 nt, Homo sapiens
auaauucacucaagcacuga

SEQ ID NO: 1279260 - RNA, 23 nt, Homo sapiens
auaauuccuauauccugugacug

SEQ ID NO: 1279261 - RNA, 22 nt, Homo sapiens
auaauucuaaguuauuuacuuu

SEQ ID NO: 1279262 - RNA, 16 nt, Homo sapiens
auaauucuguacauag

SEQ ID NO: 1279263 - RNA, 19 nt, Homo sapiens
auaauugcuuugccaaaau

SEQ ID NO: 1279264 - RNA, 18 nt, Homo sapiens
auaauuguaccaaccuca

SEQ ID NO: 1279265 - RNA, 21 nt, Homo sapiens
auaauuguugaaauuuugcaa

SEQ ID NO: 1279266 - RNA, 14 nt, Homo sapiens
auaauuucuacucu

SEQ ID NO: 1279267 - RNA, 20 nt, Homo sapiens
auaauuugaaaaaguuccau

SEQ ID NO: 1279268 - RNA, 13 nt, Homo sapiens
auaauuugaucuu

SEQ ID NO: 1279269 - RNA, 11 nt, Homo sapiens
auaauuugcac

SEQ ID NO: 1279270 - RNA, 16 nt, Homo sapiens
auaauuuuagacauuc

SEQ ID NO: 1279271 - RNA, 22 nt, Homo sapiens
auacaaaaauaccuacugcuga

SEQ ID NO: 1279272 - RNA, 19 nt, Homo sapiens
auacaaccucccucuuguu

SEQ ID NO: 1279273 - RNA, 19 nt, Homo sapiens
auacaagaaagcaaugcca

SEQ ID NO: 1279274 - RNA, 13 nt, Homo sapiens
auacaagacuguu

SEQ ID NO: 1279275 - RNA, 19 nt, Homo sapiens
auacaaugacuagucaccu

SEQ ID NO: 1279276 - RNA, 13 nt, Homo sapiens
auacacaagcaau

SEQ ID NO: 1279277 - RNA, 23 nt, Homo sapiens
auacacauauauacccacaugua

SEQ ID NO: 1279278 - RNA, 23 nt, Homo sapiens
auacacguuacugaucuuacuca

SEQ ID NO: 1279279 - RNA, 13 nt, Homo sapiens
auacacuuacacu

SEQ ID NO: 1279280 - RNA, 15 nt, Homo sapiens
auacacuuacacuuu

SEQ ID NO: 1279281 - RNA, 12 nt, Homo sapiens
auacacuugaag

SEQ ID NO: 1279282 - RNA, 14 nt, Homo sapiens
auacagaaaugcaa

SEQ ID NO: 1279283 - RNA, 22 nt, Homo sapiens
auacagaauguucuauugucau

SEQ ID NO: 1279284 - RNA, 16 nt, Homo sapiens
auacagauagauauau

SEQ ID NO: 1279285 - RNA, 22 nt, Homo sapiens
auacagcccucccccagcaguu

SEQ ID NO: 1279286 - RNA, 19 nt, Homo sapiens
auacagggucucuuccuuc

SEQ ID NO: 1279287 - RNA, 21 nt, Homo sapiens
auacaggugucuagacugcca

SEQ ID NO: 1279288 - RNA, 21 nt, Homo sapiens
auacaguauucuguaccauag

SEQ ID NO: 1279289 - RNA, 11 nt, Homo sapiens
auacagugaag

SEQ ID NO: 1279290 - RNA, 19 nt, Homo sapiens
auacauaacuaaauuugau

SEQ ID NO: 1279291 - RNA, 16 nt, Homo sapiens
auacauacacuuguau

SEQ ID NO: 1279292 - RNA, 18 nt, Homo sapiens
auacauacacuuguauaa

SEQ ID NO: 1279293 - RNA, 20 nt, Homo sapiens
auacauaucgcugacuucau

SEQ ID NO: 1279294 - RNA, 17 nt, Homo sapiens
auacauaugaggacaag

SEQ ID NO: 1279295 - RNA, 22 nt, Homo sapiens
auacauauguagaaacauuuag

SEQ ID NO: 1279296 - RNA, 12 nt, Homo sapiens
auacaucaaaga

SEQ ID NO: 1279297 - RNA, 22 nt, Homo sapiens
auacauccacaggguuuugaca

SEQ ID NO: 1279298 - RNA, 18 nt, Homo sapiens
auacaugcauacaaagag

SEQ ID NO: 1279299 - RNA, 22 nt, Homo sapiens
auacaugccagugacacuucca

SEQ ID NO: 1279300 - RNA, 17 nt, Homo sapiens
auacauguguguauaua

SEQ ID NO: 1279301 - RNA, 18 nt, Homo sapiens
auacauuuaugcacauuc

SEQ ID NO: 1279302 - RNA, 14 nt, Homo sapiens
auacauuucaauua

SEQ ID NO: 1279303 - RNA, 21 nt, Homo sapiens
auauacgcccuugagcuacuu

SEQ ID NO: 1279304 - RNA, 14 nt, Homo sapiens
auauacucaugucc

SEQ ID NO: 1279305 - RNA, 18 nt, Homo sapiens
auauacuugacucuaaua

SEQ ID NO: 1279306 - RNA, 17 nt, Homo sapiens
auauacuuuugugaaca

SEQ ID NO: 1279307 - RNA, 22 nt, Homo sapiens
auauagaaugaucuauugcuca

SEQ ID NO: 1279308 - RNA, 16 nt, Homo sapiens
auauagcguucccaac

SEQ ID NO: 1279309 - RNA, 19 nt, Homo sapiens
auauaggccagaguugcaa

SEQ ID NO: 1279310 - RNA, 23 nt, Homo sapiens
auauaggccagaguugcaaagau

SEQ ID NO: 1279311 - RNA, 16 nt, Homo sapiens
auauagguugugcaaa

SEQ ID NO: 1279312 - RNA, 20 nt, Homo sapiens
auauagguuuuucucaugua

SEQ ID NO: 1279313 - RNA, 23 nt, Homo sapiens
auauaguccagacacuuaacuca

SEQ ID NO: 1279314 - RNA, 16 nt, Homo sapiens
auauaguuauugcaca

SEQ ID NO: 1279315 - RNA, 17 nt, Homo sapiens
auauauagaauuguaga

SEQ ID NO: 1279316 - RNA, 15 nt, Homo sapiens
auauauagugcuaua

SEQ ID NO: 1279317 - RNA, 19 nt, Homo sapiens
auauaucugcuauucucca

SEQ ID NO: 1279318 - RNA, 15 nt, Homo sapiens
auauauuaauaugca

SEQ ID NO: 1279319 - RNA, 12 nt, Homo sapiens
auauauucccaa

SEQ ID NO: 1279320 - RNA, 14 nt, Homo sapiens
auauauuuaauuga

SEQ ID NO: 1279321 - RNA, 12 nt, Homo sapiens
auauauuuuaga

SEQ ID NO: 1279322 - RNA, 20 nt, Homo sapiens
auauauuuucauccuauaag

SEQ ID NO: 1279323 - RNA, 13 nt, Homo sapiens
auauauuuuuaga

SEQ ID NO: 1279324 - RNA, 23 nt, Homo sapiens
auauauuuuugguugucaauauu

SEQ ID NO: 1279325 - RNA, 14 nt, Homo sapiens
auauauuuuuuaga

SEQ ID NO: 1279326 - RNA, 17 nt, Homo sapiens
auaucaaaaaguauuaa

SEQ ID NO: 1279327 - RNA, 14 nt, Homo sapiens
auaucaaaauucua

SEQ ID NO: 1279328 - RNA, 16 nt, Homo sapiens
auaucacuuccaugac

SEQ ID NO: 1279329 - RNA, 20 nt, Homo sapiens
auaucagauucuuggcugca

SEQ ID NO: 1279330 - RNA, 20 nt, Homo sapiens
auaucaguuuuuacuuucuc

SEQ ID NO: 1279331 - RNA, 13 nt, Homo sapiens
auaucaugaguga

SEQ ID NO: 1279332 - RNA, 23 nt, Homo sapiens
auaucaugccccuguacuccagc

SEQ ID NO: 1279333 - RNA, 16 nt, Homo sapiens
auaucccuacauguau

SEQ ID NO: 1279334 - RNA, 18 nt, Homo sapiens
auaucccuuccucucagg

SEQ ID NO: 1279335 - RNA, 15 nt, Homo sapiens
auauccugugacugu

SEQ ID NO: 1279336 - RNA, 16 nt, Homo sapiens
auaucgagaacugcca

SEQ ID NO: 1279337 - RNA, 14 nt, Homo sapiens
auaucgaucucuua

SEQ ID NO: 1279338 - RNA, 13 nt, Homo sapiens
auaucuaccccag

SEQ ID NO: 1279339 - RNA, 21 nt, Homo sapiens
auaucugaauggaagaguguu

SEQ ID NO: 1279340 - RNA, 16 nt, Homo sapiens
auaucugcuauucucc

SEQ ID NO: 1279341 - RNA, 14 nt, Homo sapiens
auaucuggcacugu

SEQ ID NO: 1279342 - RNA, 16 nt, Homo sapiens
auaucuugcuuucaaa

SEQ ID NO: 1279343 - RNA, 23 nt, Homo sapiens
auaucuugcuuucaaauuggcac

SEQ ID NO: 1279344 - RNA, 20 nt, Homo sapiens
auaucuuuaugggcucuguu

SEQ ID NO: 1279345 - RNA, 15 nt, Homo sapiens
auaucuuugugauaa

SEQ ID NO: 1279346 - RNA, 16 nt, Homo sapiens
auaugaaaaucuccau

SEQ ID NO: 1279347 - RNA, 14 nt, Homo sapiens
auaugaagcacuuu

SEQ ID NO: 1279348 - RNA, 15 nt, Homo sapiens
auaugaauucaagaa

SEQ ID NO: 1279349 - RNA, 14 nt, Homo sapiens
auaugacugauuac

SEQ ID NO: 1279350 - RNA, 13 nt, Homo sapiens
auaugaguauaca

SEQ ID NO: 1279351 - RNA, 21 nt, Homo sapiens
auaugaguuacugaaggugau

SEQ ID NO: 1279352 - RNA, 14 nt, Homo sapiens
auaugauaaaacac

SEQ ID NO: 1279353 - RNA, 11 nt, Homo sapiens
auaugcacaaa

SEQ ID NO: 1279354 - RNA, 14 nt, Homo sapiens
auaugcaucuggcc

SEQ ID NO: 1279355 - RNA, 12 nt, Homo sapiens
auaugcccucau

SEQ ID NO: 1279356 - RNA, 19 nt, Homo sapiens
auaugcugacagcucuuca

SEQ ID NO: 1279357 - RNA, 23 nt, Homo sapiens
auauggaugauucagaaauugga

SEQ ID NO: 1279358 - RNA, 13 nt, Homo sapiens
auauggcugccca

SEQ ID NO: 1279359 - RNA, 18 nt, Homo sapiens
auaugguugauaguuuac

SEQ ID NO: 1279360 - RNA, 17 nt, Homo sapiens
auauguaaguacuucca

SEQ ID NO: 1279361 - RNA, 14 nt, Homo sapiens
auauguagcucauc

SEQ ID NO: 1279362 - RNA, 14 nt, Homo sapiens
auauguaguauaau

SEQ ID NO: 1279363 - RNA, 12 nt, Homo sapiens
auauguaugggu

SEQ ID NO: 1279364 - RNA, 23 nt, Homo sapiens
auaugugggugucagucagggac

SEQ ID NO: 1279365 - RNA, 14 nt, Homo sapiens
auauguugcucagu

SEQ ID NO: 1279366 - RNA, 13 nt, Homo sapiens
auauuaaucaaaa

SEQ ID NO: 1279367 - RNA, 15 nt, Homo sapiens
auauuagaucaaaua

SEQ ID NO: 1279368 - RNA, 22 nt, Homo sapiens
auauuaucacgcagaucacuaa

SEQ ID NO: 1279369 - RNA, 18 nt, Homo sapiens
auauuccugcauuuguga

SEQ ID NO: 1279370 - RNA, 17 nt, Homo sapiens
auauuccuuucuaucau

SEQ ID NO: 1279371 - RNA, 14 nt, Homo sapiens
auauuccuuugcca

SEQ ID NO: 1279372 - RNA, 21 nt, Homo sapiens
auauuccuuugccaauucauu

SEQ ID NO: 1279373 - RNA, 20 nt, Homo sapiens
auauucuaagccaguuuuca

SEQ ID NO: 1279374 - RNA, 22 nt, Homo sapiens
auauucuaauuaaaauugugca

SEQ ID NO: 1279375 - RNA, 15 nt, Homo sapiens
auauucucauuuuaa

SEQ ID NO: 1279376 - RNA, 12 nt, Homo sapiens
auauucucccca

SEQ ID NO: 1279377 - RNA, 17 nt, Homo sapiens
ccagaucgcaccacugc

SEQ ID NO: 1279378 - RNA, 18 nt, Homo sapiens
ccagaugagaagucugcu

SEQ ID NO: 1279379 - RNA, 22 nt, Homo sapiens
ccagaugcccuuuggaaagcca

SEQ ID NO: 1279380 - RNA, 15 nt, Homo sapiens
ccagauggccccucc

SEQ ID NO: 1279381 - RNA, 20 nt, Homo sapiens
ccagaugugaaaacaucuca

SEQ ID NO: 1279382 - RNA, 18 nt, Homo sapiens
ccagauguuuccagacuu

SEQ ID NO: 1279383 - RNA, 12 nt, Homo sapiens
ccagauugcaac

SEQ ID NO: 1279384 - RNA, 22 nt, Homo sapiens
caaacuuggauacuuggauuua

SEQ ID NO: 1279385 - RNA, 16 nt, Homo sapiens
caaacuuuuauacucu

SEQ ID NO: 1279386 - RNA, 15 nt, Homo sapiens
caaagaaacuugaag

SEQ ID NO: 1279387 - RNA, 20 nt, Homo sapiens
caaagaaauuccccaagcac

SEQ ID NO: 1279388 - RNA, 22 nt, Homo sapiens
caaagaacaaacauccuugcaa

SEQ ID NO: 1279389 - RNA, 19 nt, Homo sapiens
caaagaagaguuaagaaga

SEQ ID NO: 1279390 - RNA, 13 nt, Homo sapiens
caaagaaggcauu

SEQ ID NO: 1279391 - RNA, 20 nt, Homo sapiens
caaagaaugggcuugaaaca

SEQ ID NO: 1279392 - RNA, 15 nt, Homo sapiens
caaagaauuacagua

SEQ ID NO: 1279393 - RNA, 16 nt, Homo sapiens
caaagacacagacuug

SEQ ID NO: 1279394 - RNA, 23 nt, Homo sapiens
caaagacagagaagaccaaagca

SEQ ID NO: 1279395 - RNA, 12 nt, Homo sapiens
caaagacuguac

SEQ ID NO: 1279396 - RNA, 23 nt, Homo sapiens
caaagacuguacuggccaguguc

SEQ ID NO: 1279397 - RNA, 17 nt, Homo sapiens
caaagagaaugccauuc

SEQ ID NO: 1279398 - RNA, 20 nt, Homo sapiens
caaagaggacucgcuuguaa

SEQ ID NO: 1279399 - RNA, 17 nt, Homo sapiens
caaagaggcugccccuc

SEQ ID NO: 1279400 - RNA, 20 nt, Homo sapiens
caaagaggcugccccucuca

SEQ ID NO: 1279401 - RNA, 15 nt, Homo sapiens
caaagagguguacag

SEQ ID NO: 1279402 - RNA, 23 nt, Homo sapiens
caaagaucaaaauaaaaagugac

SEQ ID NO: 1279403 - RNA, 23 nt, Homo sapiens
caaagauguuaugguguuuagau

SEQ ID NO: 1279404 - RNA, 21 nt, Homo sapiens
caaagauuaaaugugucauug

SEQ ID NO: 1279405 - RNA, 16 nt, Homo sapiens
caaagcacaguuugaa

SEQ ID NO: 1279406 - RNA, 15 nt, Homo sapiens
caaagcacaugcuua

SEQ ID NO: 1279407 - RNA, 21 nt, Homo sapiens
caaagcacuagagaaugcaca

SEQ ID NO: 1279408 - RNA, 18 nt, Homo sapiens
caaagccaaacucugcca

SEQ ID NO: 1279409 - RNA, 20 nt, Homo sapiens
caaagccacauuauuucuag

SEQ ID NO: 1279410 - RNA, 22 nt, Homo sapiens
caaagcccugguaaaagggaua

SEQ ID NO: 1279411 - RNA, 12 nt, Homo sapiens
caaagcuguuaa

SEQ ID NO: 1279412 - RNA, 20 nt, Homo sapiens
caaagcuguuaaacuguuag

SEQ ID NO: 1279413 - RNA, 17 nt, Homo sapiens
caaagcuuaugugacau

SEQ ID NO: 1279414 - RNA, 13 nt, Homo sapiens
caaagcuugugaa

SEQ ID NO: 1279415 - RNA, 20 nt, Homo sapiens
caaaggaaguccaaccugag

SEQ ID NO: 1279416 - RNA, 17 nt, Homo sapiens
caaaggcauaucuucua

SEQ ID NO: 1279417 - RNA, 18 nt, Homo sapiens
caaagguauuaguacaau

SEQ ID NO: 1279418 - RNA, 17 nt, Homo sapiens
caaaggugugcccugua

SEQ ID NO: 1279419 - RNA, 19 nt, Homo sapiens
caaagguuccaacuguaua

SEQ ID NO: 1279420 - RNA, 17 nt, Homo sapiens
caaagguugcagugcug

SEQ ID NO: 1279421 - RNA, 14 nt, Homo sapiens
caaaguaagccaug

SEQ ID NO: 1279422 - RNA, 16 nt, Homo sapiens
caaaguccacacaaag

SEQ ID NO: 1279423 - RNA, 18 nt, Homo sapiens
caaaguccacuuuacuca

SEQ ID NO: 1279424 - RNA, 18 nt, Homo sapiens
caaagugauucacugugc

SEQ ID NO: 1279425 - RNA, 14 nt, Homo sapiens
caaagugcacauga

SEQ ID NO: 1279426 - RNA, 21 nt, Homo sapiens
caaagugcuggauuguccuug

SEQ ID NO: 1279427 - RNA, 13 nt, Homo sapiens
caaaguggaggag

SEQ ID NO: 1279428 - RNA, 17 nt, Homo sapiens
caaaguguaugugacca

SEQ ID NO: 1279429 - RNA, 16 nt, Homo sapiens
caaaguguuaaucuua

SEQ ID NO: 1279430 - RNA, 22 nt, Homo sapiens
caaaguuaaaagcaaacacuua

SEQ ID NO: 1279431 - RNA, 19 nt, Homo sapiens
caaaguuuggauuguauca

SEQ ID NO: 1279432 - RNA, 13 nt, Homo sapiens
caaauaaaaucua

SEQ ID NO: 1279433 - RNA, 22 nt, Homo sapiens
caaauaaguauuuauaauagca

SEQ ID NO: 1279434 - RNA, 22 nt, Homo sapiens
caaauaauaaaaacagaaggaa

SEQ ID NO: 1279435 - RNA, 22 nt, Homo sapiens
caaauacauggauaacacauuu

SEQ ID NO: 1279436 - RNA, 19 nt, Homo sapiens
caaauauaucugcuauucu

SEQ ID NO: 1279437 - RNA, 23 nt, Homo sapiens
caaauauaucugcuauucuccau

SEQ ID NO: 1279438 - RNA, 21 nt, Homo sapiens
caaauauggggaaaaaacugu

SEQ ID NO: 1279439 - RNA, 17 nt, Homo sapiens
caaauauuauucuuaau

SEQ ID NO: 1279440 - RNA, 12 nt, Homo sapiens
caaauauuuccc

SEQ ID NO: 1279441 - RNA, 17 nt, Homo sapiens
caaaucccucucacaag

SEQ ID NO: 1279442 - RNA, 16 nt, Homo sapiens
caaaucuaccacugua

SEQ ID NO: 1279443 - RNA, 16 nt, Homo sapiens
caaaucuccugcugau

SEQ ID NO: 1279444 - RNA, 19 nt, Homo sapiens
caaaucuggcuccuuuaca

SEQ ID NO: 1279445 - RNA, 16 nt, Homo sapiens
caaaucuugaaauuaa

SEQ ID NO: 1279446 - RNA, 19 nt, Homo sapiens
caaaucuugggugggugaa

SEQ ID NO: 1279447 - RNA, 15 nt, Homo sapiens
caaaugacagauucu

SEQ ID NO: 1279448 - RNA, 17 nt, Homo sapiens
caaaugacaugcacuga

SEQ ID NO: 1279449 - RNA, 18 nt, Homo sapiens
caaaugacaugcacugac

SEQ ID NO: 1279450 - RNA, 20 nt, Homo sapiens
caaaugacaugcacugaccc

SEQ ID NO: 1279451 - RNA, 11 nt, Homo sapiens
caaaugagauc

SEQ ID NO: 1279452 - RNA, 22 nt, Homo sapiens
caaaugauuucauauugaucuu

SEQ ID NO: 1279453 - RNA, 14 nt, Homo sapiens
caaaugcacaucuc

SEQ ID NO: 1279454 - RNA, 19 nt, Homo sapiens
caaaugccuugaacuguug

SEQ ID NO: 1279455 - RNA, 16 nt, Homo sapiens
caaauggcagaaccaa

SEQ ID NO: 1279456 - RNA, 20 nt, Homo sapiens
caaaugguaggcauuuccua

SEQ ID NO: 1279457 - RNA, 13 nt, Homo sapiens
caaaugucuaagg

SEQ ID NO: 1279458 - RNA, 23 nt, Homo sapiens
caaaugucuucaugaccuacuuc

SEQ ID NO: 1279459 - RNA, 11 nt, Homo sapiens
caaaugugcug

SEQ ID NO: 1279460 - RNA, 16 nt, Homo sapiens
caaauuaacuuuacau

SEQ ID NO: 1279461 - RNA, 21 nt, Homo sapiens
caaauuaacuuuacauccuuu

SEQ ID NO: 1279462 - RNA, 15 nt, Homo sapiens
caaauuaagaaucua

SEQ ID NO: 1279463 - RNA, 20 nt, Homo sapiens
caaauuauauuugugugaaa

SEQ ID NO: 1279464 - RNA, 13 nt, Homo sapiens
caaauucauggca

SEQ ID NO: 1279465 - RNA, 22 nt, Homo sapiens
caaauucuaccuuauuuuacag

SEQ ID NO: 1279466 - RNA, 14 nt, Homo sapiens
caaauugcacugaa

SEQ ID NO: 1279467 - RNA, 19 nt, Homo sapiens
caaauugcugggauuacag

SEQ ID NO: 1279468 - RNA, 16 nt, Homo sapiens
caaauugggaaaucca

SEQ ID NO: 1279469 - RNA, 15 nt, Homo sapiens
caaauugucugguac

SEQ ID NO: 1279470 - RNA, 17 nt, Homo sapiens
caaauuuaugcauuuca

SEQ ID NO: 1279471 - RNA, 20 nt, Homo sapiens
caaauuuaugcauuucauuc

SEQ ID NO: 1279472 - RNA, 11 nt, Homo sapiens
caaauuucaca

SEQ ID NO: 1279473 - RNA, 13 nt, Homo sapiens
caacaaaccacac

SEQ ID NO: 1279474 - RNA, 21 nt, Homo sapiens
caacaaaccacacacaguaaa

SEQ ID NO: 1279475 - RNA, 13 nt, Homo sapiens
caacaacgacaca

SEQ ID NO: 1279476 - RNA, 19 nt, Homo sapiens
caacaacuuacacuuauuu

SEQ ID NO: 1279477 - RNA, 15 nt, Homo sapiens
caacaagaccaccac

SEQ ID NO: 1279478 - RNA, 21 nt, Homo sapiens
caacaagauuuccuugugcaa

SEQ ID NO: 1279479 - RNA, 23 nt, Homo sapiens
caacaauccuucuauucuagccu

SEQ ID NO: 1279480 - RNA, 14 nt, Homo sapiens
caacaaugacuuaa

SEQ ID NO: 1279481 - RNA, 19 nt, Homo sapiens
caacaauggggugggccca

SEQ ID NO: 1279482 - RNA, 22 nt, Homo sapiens
caacacugcugcuccagugcag

SEQ ID NO: 1279483 - RNA, 15 nt, Homo sapiens
caacagaaaccagaa

SEQ ID NO: 1279484 - RNA, 23 nt, Homo sapiens
caacagaaaccagaaaagcaaua

SEQ ID NO: 1279485 - RNA, 18 nt, Homo sapiens
caacagaagcuuccauuc

SEQ ID NO: 1279486 - RNA, 18 nt, Homo sapiens
auugcaaauaaaccacuu

SEQ ID NO: 1279487 - RNA, 17 nt, Homo sapiens
auugcaauacauuucaa

SEQ ID NO: 1279488 - RNA, 13 nt, Homo sapiens
auugcacaaguuc

SEQ ID NO: 1279489 - RNA, 15 nt, Homo sapiens
auugcaccacugcac

SEQ ID NO: 1279490 - RNA, 16 nt, Homo sapiens
auugcaccuggaugua

SEQ ID NO: 1279491 - RNA, 11 nt, Homo sapiens
auugcacuaaa

SEQ ID NO: 1279492 - RNA, 11 nt, Homo sapiens
auugcacucag

SEQ ID NO: 1279493 - RNA, 13 nt, Homo sapiens
auugcagacuguu

SEQ ID NO: 1279494 - RNA, 13 nt, Homo sapiens
auugcagcacaga

SEQ ID NO: 1279495 - RNA, 14 nt, Homo sapiens
auugcagcauuuau

SEQ ID NO: 1279496 - RNA, 15 nt, Homo sapiens
auugcauacuuugua

SEQ ID NO: 1279497 - RNA, 20 nt, Homo sapiens
auugccaccaggagaaccac

SEQ ID NO: 1279498 - RNA, 23 nt, Homo sapiens
auugccauagcugacuacaaauu

SEQ ID NO: 1279499 - RNA, 21 nt, Homo sapiens
auugccuucuuacaacagaga

SEQ ID NO: 1279500 - RNA, 14 nt, Homo sapiens
auugcugcaaagau

SEQ ID NO: 1279501 - RNA, 13 nt, Homo sapiens
auugcugcucucu

SEQ ID NO: 1279502 - RNA, 21 nt, Homo sapiens
auugcuguccuggaggggcug

SEQ ID NO: 1279503 - RNA, 17 nt, Homo sapiens
auugcuuaaaagacauu

SEQ ID NO: 1279504 - RNA, 18 nt, Homo sapiens
auugcuucaauaauauua

SEQ ID NO: 1279505 - RNA, 13 nt, Homo sapiens
auugcuuugccaa

SEQ ID NO: 1279506 - RNA, 16 nt, Homo sapiens
auuggaaaguacuccc

SEQ ID NO: 1279507 - RNA, 14 nt, Homo sapiens
auuggaagagcaca

SEQ ID NO: 1279508 - RNA, 17 nt, Homo sapiens
auuggaagcauacaaag

SEQ ID NO: 1279509 - RNA, 15 nt, Homo sapiens
auuggauuuccuaau

SEQ ID NO: 1279510 - RNA, 22 nt, Homo sapiens
auuggauuuccuaauacuguca

SEQ ID NO: 1279511 - RNA, 22 nt, Homo sapiens
auuggcaccccuuucuaguuca

SEQ ID NO: 1279512 - RNA, 17 nt, Homo sapiens
auuggccuccaaacaca

SEQ ID NO: 1279513 - RNA, 14 nt, Homo sapiens
auuggcucuaguca

SEQ ID NO: 1279514 - RNA, 15 nt, Homo sapiens
auuggcucugugaaa

SEQ ID NO: 1279515 - RNA, 22 nt, Homo sapiens
auugggacccuccagugcugga

SEQ ID NO: 1279516 - RNA, 13 nt, Homo sapiens
auugggcaugcca

SEQ ID NO: 1279517 - RNA, 14 nt, Homo sapiens
auugggccaaagaa

SEQ ID NO: 1279518 - RNA, 15 nt, Homo sapiens
auugggggacguggg

SEQ ID NO: 1279519 - RNA, 19 nt, Homo sapiens
auuggguacccaguuaaau

SEQ ID NO: 1279520 - RNA, 20 nt, Homo sapiens
auugguauacuuuugcuuca

SEQ ID NO: 1279521 - RNA, 14 nt, Homo sapiens
auuggucauuguga

SEQ ID NO: 1279522 - RNA, 13 nt, Homo sapiens
auugguccaagau

SEQ ID NO: 1279523 - RNA, 23 nt, Homo sapiens
auuguaaagauccuauagcucuu

SEQ ID NO: 1279524 - RNA, 20 nt, Homo sapiens
auuguacaaauguaagcaaa

SEQ ID NO: 1279525 - RNA, 20 nt, Homo sapiens
auuguacaagagucccuuug

SEQ ID NO: 1279526 - RNA, 13 nt, Homo sapiens
auuguacacuauc

SEQ ID NO: 1279527 - RNA, 21 nt, Homo sapiens
auuguacauauuuguggaaua

SEQ ID NO: 1279528 - RNA, 18 nt, Homo sapiens
auuguacaugguacgaau

SEQ ID NO: 1279529 - RNA, 22 nt, Homo sapiens
auuguacuuuuuuuuacuuugg

SEQ ID NO: 1279530 - RNA, 20 nt, Homo sapiens
auuguaguagggagugugua

SEQ ID NO: 1279531 - RNA, 15 nt, Homo sapiens
auuguaguuaaugau

SEQ ID NO: 1279532 - RNA, 14 nt, Homo sapiens
auuguauuuaguua

SEQ ID NO: 1279533 - RNA, 16 nt, Homo sapiens
auugucagaguucugc

SEQ ID NO: 1279534 - RNA, 23 nt, Homo sapiens
auugucauggggaucaauuuuca

SEQ ID NO: 1279535 - RNA, 15 nt, Homo sapiens
auuguccccagggac

SEQ ID NO: 1279536 - RNA, 19 nt, Homo sapiens
auuguccccuuuuuaguuu

SEQ ID NO: 1279537 - RNA, 21 nt, Homo sapiens
auugucuccuuccacaaugac

SEQ ID NO: 1279538 - RNA, 16 nt, Homo sapiens
auugucuguaaugaca

SEQ ID NO: 1279539 - RNA, 19 nt, Homo sapiens
auugucuuguucugugaug

SEQ ID NO: 1279540 - RNA, 18 nt, Homo sapiens
auugugaaaaggcaaauu

SEQ ID NO: 1279541 - RNA, 19 nt, Homo sapiens
auugugaagcaccuacuau

SEQ ID NO: 1279542 - RNA, 16 nt, Homo sapiens
auugugaaguacauau

SEQ ID NO: 1279543 - RNA, 20 nt, Homo sapiens
auugugaaugauucauguua

SEQ ID NO: 1279544 - RNA, 18 nt, Homo sapiens
auugugauauuuuuacuu

SEQ ID NO: 1279545 - RNA, 16 nt, Homo sapiens
auugugcuucgaguga

SEQ ID NO: 1279546 - RNA, 20 nt, Homo sapiens
auugugcuucgagugacuga

SEQ ID NO: 1279547 - RNA, 15 nt, Homo sapiens
auuguggaaaaccag

SEQ ID NO: 1279548 - RNA, 15 nt, Homo sapiens
auuguggaugaugau

SEQ ID NO: 1279549 - RNA, 18 nt, Homo sapiens
auuguggugugagcuuca

SEQ ID NO: 1279550 - RNA, 22 nt, Homo sapiens
auugugguuuauugaaugugau

SEQ ID NO: 1279551 - RNA, 23 nt, Homo sapiens
auugugguuuauugaaugugauu

SEQ ID NO: 1279552 - RNA, 21 nt, Homo sapiens
auugugugucacaagaauuua

SEQ ID NO: 1279553 - RNA, 17 nt, Homo sapiens
auuguuaauucuuccua

SEQ ID NO: 1279554 - RNA, 20 nt, Homo sapiens
auuguuacauuauguggaaa

SEQ ID NO: 1279555 - RNA, 16 nt, Homo sapiens
auuguuaucuaucaac

SEQ ID NO: 1279556 - RNA, 21 nt, Homo sapiens
auuguuccaaaugaauguugu

SEQ ID NO: 1279557 - RNA, 15 nt, Homo sapiens
auuguuccaagacau

SEQ ID NO: 1279558 - RNA, 19 nt, Homo sapiens
auuguugacaacugugacu

SEQ ID NO: 1279559 - RNA, 12 nt, Homo sapiens
auuguuguguag

SEQ ID NO: 1279560 - RNA, 16 nt, Homo sapiens
auuguuuggcuuccuc

SEQ ID NO: 1279561 - RNA, 18 nt, Homo sapiens
auuuaaaacaucauuacu

SEQ ID NO: 1279562 - RNA, 14 nt, Homo sapiens
auuuaaaacuugcc

SEQ ID NO: 1279563 - RNA, 13 nt, Homo sapiens
auuuaaaagacua

SEQ ID NO: 1279564 - RNA, 22 nt, Homo sapiens
auuuaaagaaaauaaacaccau

SEQ ID NO: 1279565 - RNA, 13 nt, Homo sapiens
auuuaaaguggca

SEQ ID NO: 1279566 - RNA, 15 nt, Homo sapiens
auuuaaauguaacuu

SEQ ID NO: 1279567 - RNA, 22 nt, Homo sapiens
auuuaacacccuuuagaaccuu

SEQ ID NO: 1279568 - RNA, 15 nt, Homo sapiens
auuuaacacuaaaaa

SEQ ID NO: 1279569 - RNA, 12 nt, Homo sapiens
auuuaagcacaa

SEQ ID NO: 1279570 - RNA, 15 nt, Homo sapiens
auuuaaguuuuuccc

SEQ ID NO: 1279571 - RNA, 18 nt, Homo sapiens
auuuaauaaagcacaaaa

SEQ ID NO: 1279572 - RNA, 21 nt, Homo sapiens
auuuaauaaaugacaaaugua

SEQ ID NO: 1279573 - RNA, 12 nt, Homo sapiens
auuuaauaacau

SEQ ID NO: 1279574 - RNA, 20 nt, Homo sapiens
auuuaauaucuggcacuguu

SEQ ID NO: 1279575 - RNA, 20 nt, Homo sapiens
auuuaaugaaacccuaugga

SEQ ID NO: 1279576 - RNA, 21 nt, Homo sapiens
auuuaaugaaacccuauggag

SEQ ID NO: 1279577 - RNA, 22 nt, Homo sapiens
auuuaauuuagugaucuuagca

SEQ ID NO: 1279578 - RNA, 18 nt, Homo sapiens
auuuacacauauccacaa

SEQ ID NO: 1279579 - RNA, 22 nt, Homo sapiens
auuuacaggaacuucaucauaa

SEQ ID NO: 1279580 - RNA, 15 nt, Homo sapiens
auuuacaguuuccag

SEQ ID NO: 1279581 - RNA, 21 nt, Homo sapiens
gcuuuccuggucccucacccc

SEQ ID NO: 1279582 - RNA, 19 nt, Homo sapiens
gcuuucuaggccacuggga

SEQ ID NO: 1279583 - RNA, 19 nt, Homo sapiens
gcuuucuuuuuaguucucu

SEQ ID NO: 1279584 - RNA, 15 nt, Homo sapiens
gcuuugcacaggaaa

SEQ ID NO: 1279585 - RNA, 12 nt, Homo sapiens
gcuuugcaguga

SEQ ID NO: 1279586 - RNA, 17 nt, Homo sapiens
gcuuugccgccauggga

SEQ ID NO: 1279587 - RNA, 15 nt, Homo sapiens
gcuuuucggcaaagc

SEQ ID NO: 1279588 - RNA, 13 nt, Homo sapiens
gcuuuucuguauu

SEQ ID NO: 1279589 - RNA, 15 nt, Homo sapiens
gcuuuuugcuucuug

SEQ ID NO: 1279590 - RNA, 15 nt, Homo sapiens
ggaaaaaaaugaaug

SEQ ID NO: 1279591 - RNA, 14 nt, Homo sapiens
ggaaaaaacccagc

SEQ ID NO: 1279592 - RNA, 19 nt, Homo sapiens
ggaaaaaagcacauacauu

SEQ ID NO: 1279593 - RNA, 13 nt, Homo sapiens
ggaaaacacugcc

SEQ ID NO: 1279594 - RNA, 15 nt, Homo sapiens
ggaaaacagaccugu

SEQ ID NO: 1279595 - RNA, 17 nt, Homo sapiens
ggaaaauaaacaucagu

SEQ ID NO: 1279596 - RNA, 12 nt, Homo sapiens
ggaaaaugacuc

SEQ ID NO: 1279597 - RNA, 12 nt, Homo sapiens
ggaaaauucucu

SEQ ID NO: 1279598 - RNA, 20 nt, Homo sapiens
ggaaacagcuaaugggacac

SEQ ID NO: 1279599 - RNA, 19 nt, Homo sapiens
ggaaacaguccaaacuguu

SEQ ID NO: 1279600 - RNA, 11 nt, Homo sapiens
ggaaaccacag

SEQ ID NO: 1279601 - RNA, 21 nt, Homo sapiens
ggaaaccaguuuggugauaua

SEQ ID NO: 1279602 - RNA, 20 nt, Homo sapiens
ggaaacccuagaccauguca

SEQ ID NO: 1279603 - RNA, 22 nt, Homo sapiens
ggaaacgccccgggcaaagggu

SEQ ID NO: 1279604 - RNA, 16 nt, Homo sapiens
ggaaacuauucaugaa

SEQ ID NO: 1279605 - RNA, 15 nt, Homo sapiens
ggaaagaaccgaaga

SEQ ID NO: 1279606 - RNA, 22 nt, Homo sapiens
ggaaagacguuuuugugcugug

SEQ ID NO: 1279607 - RNA, 21 nt, Homo sapiens
ggaaaggauuuuaccaaagca

SEQ ID NO: 1279608 - RNA, 20 nt, Homo sapiens
ggaaagugauuuuuuuccac

SEQ ID NO: 1279609 - RNA, 12 nt, Homo sapiens
ggaaagugcaua

SEQ ID NO: 1279610 - RNA, 14 nt, Homo sapiens
ggaaauacacuguu

SEQ ID NO: 1279611 - RNA, 22 nt, Homo sapiens
ggaacacccgacuccucaaaag

SEQ ID NO: 1279612 - RNA, 15 nt, Homo sapiens
ggaacaugaagccag

SEQ ID NO: 1279613 - RNA, 20 nt, Homo sapiens
ggaacccccaucucuacuaa

SEQ ID NO: 1279614 - RNA, 17 nt, Homo sapiens
ggaaccuguccuaagga

SEQ ID NO: 1279615 - RNA, 15 nt, Homo sapiens
ggaacgucagccagc

SEQ ID NO: 1279616 - RNA, 12 nt, Homo sapiens
ggaacuacgggg

SEQ ID NO: 1279617 - RNA, 14 nt, Homo sapiens
ggaacucacuuucc

SEQ ID NO: 1279618 - RNA, 21 nt, Homo sapiens
ggaacucuagaagaccaaaug

SEQ ID NO: 1279619 - RNA, 23 nt, Homo sapiens
ggaacucugcuugauuuuugccu

SEQ ID NO: 1279620 - RNA, 22 nt, Homo sapiens
ggaacugaagagggcccaaguc

SEQ ID NO: 1279621 - RNA, 23 nt, Homo sapiens
ggaacugggccaacucaccugag

SEQ ID NO: 1279622 - RNA, 10 nt, Homo sapiens
ggaacuuccu

SEQ ID NO: 1279623 - RNA, 19 nt, Homo sapiens
ggaagaaaagcugccauuu

SEQ ID NO: 1279624 - RNA, 19 nt, Homo sapiens
ggaagaaaucuggucuaau

SEQ ID NO: 1279625 - RNA, 14 nt, Homo sapiens
ggaagaaggggcca

SEQ ID NO: 1279626 - RNA, 23 nt, Homo sapiens
ggaagaccagcuuugcagugaca

SEQ ID NO: 1279627 - RNA, 21 nt, Homo sapiens
ggaagacgugcgcgaugugac

SEQ ID NO: 1279628 - RNA, 19 nt, Homo sapiens
ggaagacuagaggcuugca

SEQ ID NO: 1279629 - RNA, 23 nt, Homo sapiens
ggaagagcaggucaguacagagg

SEQ ID NO: 1279630 - RNA, 11 nt, Homo sapiens
ggaagauaucu

SEQ ID NO: 1279631 - RNA, 17 nt, Homo sapiens
ggaagauuugcccauuu

SEQ ID NO: 1279632 - RNA, 20 nt, Homo sapiens
ggaagcaaguuuucuuccau

SEQ ID NO: 1279633 - RNA, 13 nt, Homo sapiens
ggaagccagguac

SEQ ID NO: 1279634 - RNA, 15 nt, Homo sapiens
ggaagcuaauuugca

SEQ ID NO: 1279635 - RNA, 19 nt, Homo sapiens
ggaagcuuggggaacccau

SEQ ID NO: 1279636 - RNA, 20 nt, Homo sapiens
ggaagcuuguuuuccagucu

SEQ ID NO: 1279637 - RNA, 22 nt, Homo sapiens
ggaaggaaaucccaucagugaa

SEQ ID NO: 1279638 - RNA, 17 nt, Homo sapiens
ggaaggcuucuguguca

SEQ ID NO: 1279639 - RNA, 19 nt, Homo sapiens
ggaagggggguugcagugg

SEQ ID NO: 1279640 - RNA, 11 nt, Homo sapiens
ggaagggucaa

SEQ ID NO: 1279641 - RNA, 22 nt, Homo sapiens
ggaaggucucaggagaagggau

SEQ ID NO: 1279642 - RNA, 13 nt, Homo sapiens
ggaaggucuucaa

SEQ ID NO: 1279643 - RNA, 15 nt, Homo sapiens
ggaagguggggcccu

SEQ ID NO: 1279644 - RNA, 17 nt, Homo sapiens
uaaagggucuuaugaaa

SEQ ID NO: 1279645 - RNA, 16 nt, Homo sapiens
uaaaggugguccuucc

SEQ ID NO: 1279646 - RNA, 18 nt, Homo sapiens
uaaaguaguccugugaau

SEQ ID NO: 1279647 - RNA, 16 nt, Homo sapiens
uaaaguauauauuuau

SEQ ID NO: 1279648 - RNA, 21 nt, Homo sapiens
uaaaguauuauuuauuugaau

SEQ ID NO: 1279649 - RNA, 22 nt, Homo sapiens
uaaaguauucaacaauuucaau

SEQ ID NO: 1279650 - RNA, 11 nt, Homo sapiens
uaaagugcagu

SEQ ID NO: 1279651 - RNA, 18 nt, Homo sapiens
uaaagugccuuacagggu

SEQ ID NO: 1279652 - RNA, 16 nt, Homo sapiens
uaaaguguucugccag

SEQ ID NO: 1279653 - RNA, 22 nt, Homo sapiens
uaaaguuacuauucuguaucau

SEQ ID NO: 1279654 - RNA, 16 nt, Homo sapiens
uaaaguugguauuaau

SEQ ID NO: 1279655 - RNA, 18 nt, Homo sapiens
uaaaguuguucacauaua

SEQ ID NO: 1279656 - RNA, 17 nt, Homo sapiens
uaaaguuuuaacuuuua

SEQ ID NO: 1279657 - RNA, 21 nt, Homo sapiens
uaaaguuuuaggguacaguuu

SEQ ID NO: 1279658 - RNA, 16 nt, Homo sapiens
uaaauaaaagcacaag

SEQ ID NO: 1279659 - RNA, 18 nt, Homo sapiens
uaaauaagaucagacucu

SEQ ID NO: 1279660 - RNA, 18 nt, Homo sapiens
uaaauaagauucuaacgg

SEQ ID NO: 1279661 - RNA, 21 nt, Homo sapiens
uaaauaaguaaaagcuacuau

SEQ ID NO: 1279662 - RNA, 14 nt, Homo sapiens
uaaauaauucuucc

SEQ ID NO: 1279663 - RNA, 15 nt, Homo sapiens
uaaauaauucuuccu

SEQ ID NO: 1279664 - RNA, 20 nt, Homo sapiens
uaaauaauuucuacucuguc

SEQ ID NO: 1279665 - RNA, 12 nt, Homo sapiens
uaaauacagaca

SEQ ID NO: 1279666 - RNA, 15 nt, Homo sapiens
uaaauagaguuugcu

SEQ ID NO: 1279667 - RNA, 17 nt, Homo sapiens
uaaauagcuauauccau

SEQ ID NO: 1279668 - RNA, 17 nt, Homo sapiens
uaaauaggaaucauuca

SEQ ID NO: 1279669 - RNA, 22 nt, Homo sapiens
uaaauaguauuugagaguucua

SEQ ID NO: 1279670 - RNA, 13 nt, Homo sapiens
uaaauaguuugaa

SEQ ID NO: 1279671 - RNA, 12 nt, Homo sapiens
uaaauauaauua

SEQ ID NO: 1279672 - RNA, 17 nt, Homo sapiens
uaaauauagcucaggua

SEQ ID NO: 1279673 - RNA, 19 nt, Homo sapiens
uaaauaucaacccacuuaa

SEQ ID NO: 1279674 - RNA, 20 nt, Homo sapiens
ucaaguggcaugugcuguga

SEQ ID NO: 1279675 - RNA, 17 nt, Homo sapiens
ucaaguuaacaaggaau

SEQ ID NO: 1279676 - RNA, 13 nt, Homo sapiens
ucaaguucauuga

SEQ ID NO: 1279677 - RNA, 20 nt, Homo sapiens
ucaaguugugcuuguuuaca

SEQ ID NO: 1279678 - RNA, 16 nt, Homo sapiens
ucaauaaaaugugauu

SEQ ID NO: 1279679 - RNA, 19 nt, Homo sapiens
ucaauaaagauuucaagau

SEQ ID NO: 1279680 - RNA, 14 nt, Homo sapiens
ucaauaauuacugu

SEQ ID NO: 1279681 - RNA, 15 nt, Homo sapiens
ucaauaauuacugua

SEQ ID NO: 1279682 - RNA, 20 nt, Homo sapiens
ucaauauccaccccauccaa

SEQ ID NO: 1279683 - RNA, 14 nt, Homo sapiens
ucaauauuccugaa

SEQ ID NO: 1279684 - RNA, 18 nt, Homo sapiens
ucaaucauaauaccugcu

SEQ ID NO: 1279685 - RNA, 19 nt, Homo sapiens
ucaaucaucugugugaaaa

SEQ ID NO: 1279686 - RNA, 21 nt, Homo sapiens
ucaaucugcaguuuaacaaaa

SEQ ID NO: 1279687 - RNA, 16 nt, Homo sapiens
ucaaugccuggagaca

SEQ ID NO: 1279688 - RNA, 13 nt, Homo sapiens
ucaaugcuauucu

SEQ ID NO: 1279689 - RNA, 18 nt, Homo sapiens
ucaauggaguaugucuga

SEQ ID NO: 1279690 - RNA, 20 nt, Homo sapiens
ucaauuauacuaaaccucac

SEQ ID NO: 1279691 - RNA, 20 nt, Homo sapiens
ucaauuccaccugcaaucaa

SEQ ID NO: 1279692 - RNA, 18 nt, Homo sapiens
ucaauuuauuacugaaaa

SEQ ID NO: 1279693 - RNA, 17 nt, Homo sapiens
ucaauuuccugaugcau

SEQ ID NO: 1279694 - RNA, 17 nt, Homo sapiens
ucaauuuggacuggugu

SEQ ID NO: 1279695 - RNA, 17 nt, Homo sapiens
ucacugccccucucuca

SEQ ID NO: 1279696 - RNA, 18 nt, Homo sapiens
ucacugccccucucucag

SEQ ID NO: 1279697 - RNA, 12 nt, Homo sapiens
ucacugcugauc

SEQ ID NO: 1279698 - RNA, 15 nt, Homo sapiens
ucacugcugaucgua

SEQ ID NO: 1279699 - RNA, 20 nt, Homo sapiens
ucacugcugcaaauacugua

SEQ ID NO: 1279700 - RNA, 15 nt, Homo sapiens
ucacuggaaagggga

SEQ ID NO: 1279701 - RNA, 18 nt, Homo sapiens
ucacuggcaugggagacc

SEQ ID NO: 1279702 - RNA, 20 nt, Homo sapiens
ucacuggcuguuaaucuuuc

SEQ ID NO: 1279703 - RNA, 18 nt, Homo sapiens
ucacuucgggcuguguaa

SEQ ID NO: 1279704 - RNA, 20 nt, Homo sapiens
ucacuuggccaguuucagcu

SEQ ID NO: 1279705 - RNA, 15 nt, Homo sapiens
ucacuuguauugacu

SEQ ID NO: 1279706 - RNA, 20 nt, Homo sapiens
ucacuugugcaguguugaca

SEQ ID NO: 1279707 - RNA, 18 nt, Homo sapiens
ucacuuuccaccaagugu

SEQ ID NO: 1279708 - RNA, 19 nt, Homo sapiens
ucacuuuggauaugaucuu

SEQ ID NO: 1279709 - RNA, 19 nt, Homo sapiens
ucacuuuuuacagugcuau

SEQ ID NO: 1279710 - RNA, 23 nt, Homo sapiens
ucagaaaacagagaaaggguaau

SEQ ID NO: 1279711 - RNA, 14 nt, Homo sapiens
ucagaaaacucugg

SEQ ID NO: 1279712 - RNA, 17 nt, Homo sapiens
ucagaaaagaaaaccau

SEQ ID NO: 1279713 - RNA, 13 nt, Homo sapiens
ucagaaaaguaau

SEQ ID NO: 1279714 - RNA, 14 nt, Homo sapiens
ucagaaaaguaauu

SEQ ID NO: 1279715 - RNA, 17 nt, Homo sapiens
ucagaaagucaccagga

SEQ ID NO: 1279716 - RNA, 23 nt, Homo sapiens
ucauuuaaaaagcucacugcuga

SEQ ID NO: 1279717 - RNA, 22 nt, Homo sapiens
ucauuuacuuuuaaacuuugau

SEQ ID NO: 1279718 - RNA, 17 nt, Homo sapiens
ucauuuagucaugugac

SEQ ID NO: 1279719 - RNA, 18 nt, Homo sapiens
ucauuuccccauaacuca

SEQ ID NO: 1279720 - RNA, 17 nt, Homo sapiens
ucauuuccguuuugccu

SEQ ID NO: 1279721 - RNA, 13 nt, Homo sapiens
ucauuucuggaaa

SEQ ID NO: 1279722 - RNA, 22 nt, Homo sapiens
ucauuucuggaaagugcaauua

SEQ ID NO: 1279723 - RNA, 21 nt, Homo sapiens
ucauuugggcuuucuguugaa

SEQ ID NO: 1279724 - RNA, 19 nt, Homo sapiens
ucauuuguuuacauuugau

SEQ ID NO: 1279725 - RNA, 17 nt, Homo sapiens
ucauuuuuuucacugga

SEQ ID NO: 1279726 - RNA, 18 nt, Homo sapiens
uccaaaaauguguaagaa

SEQ ID NO: 1279727 - RNA, 15 nt, Homo sapiens
uccaaaacaaaaaga

SEQ ID NO: 1279728 - RNA, 13 nt, Homo sapiens
uccaaaacauuuc

SEQ ID NO: 1279729 - RNA, 13 nt, Homo sapiens
uccaaaagcacuu

SEQ ID NO: 1279730 - RNA, 16 nt, Homo sapiens
uccaaaccuccacugc

SEQ ID NO: 1279731 - RNA, 18 nt, Homo sapiens
uccaaacuguucugagaa

SEQ ID NO: 1279732 - RNA, 15 nt, Homo sapiens
uccaaagaacuugau

SEQ ID NO: 1279733 - RNA, 14 nt, Homo sapiens
uccaaagacuguac

SEQ ID NO: 1279734 - RNA, 21 nt, Homo sapiens
uccaaagagaagggcacugua

SEQ ID NO: 1279735 - RNA, 16 nt, Homo sapiens
uccaaagagccuucag

SEQ ID NO: 1279736 - RNA, 15 nt, Homo sapiens
uccaaagccagugaa

SEQ ID NO: 1279737 - RNA, 17 nt, Homo sapiens
ccagugcuuuaauggca

SEQ ID NO: 1279738 - RNA, 22 nt, Homo sapiens
ccaguggaacagcgggagaccu

SEQ ID NO: 1279739 - RNA, 23 nt, Homo sapiens
ccaguguccccuccacugucaca

SEQ ID NO: 1279740 - RNA, 20 nt, Homo sapiens
ccaguguuuacaaggugaca

SEQ ID NO: 1279741 - RNA, 19 nt, Homo sapiens
ccaguucauugcacuuuga

SEQ ID NO: 1279742 - RNA, 20 nt, Homo sapiens
ccaguucauugcacuuugau

SEQ ID NO: 1279743 - RNA, 14 nt, Homo sapiens
ccaguucuuuauaa

SEQ ID NO: 1279744 - RNA, 20 nt, Homo sapiens
ccaguugcccagagcacuuu

SEQ ID NO: 1279745 - RNA, 14 nt, Homo sapiens
ccaguugccuuuua

SEQ ID NO: 1279746 - RNA, 15 nt, Homo sapiens
ccaguugguuuaaug

SEQ ID NO: 1279747 - RNA, 22 nt, Homo sapiens
cuaaaggggacuagacaguuag

SEQ ID NO: 1279748 - RNA, 15 nt, Homo sapiens
cuaaaggugcacugc

SEQ ID NO: 1279749 - RNA, 21 nt, Homo sapiens
cuaaagguggugaggcaauaa

SEQ ID NO: 1279750 - RNA, 20 nt, Homo sapiens
cuaaaguuacaaacagacca

SEQ ID NO: 1279751 - RNA, 18 nt, Homo sapiens
cuaaaguugcuccauaca

SEQ ID NO: 1279752 - RNA, 21 nt, Homo sapiens
cuaaauaaugaauaaacugaa

SEQ ID NO: 1279753 - RNA, 22 nt, Homo sapiens
cuaaauaguucuaucaggaaaa

SEQ ID NO: 1279754 - RNA, 14 nt, Homo sapiens
cuaaauaucuguca

SEQ ID NO: 1279755 - RNA, 13 nt, Homo sapiens
cuaaaucagagac

SEQ ID NO: 1279756 - RNA, 18 nt, Homo sapiens
cuaaaucagagacaaaau

SEQ ID NO: 1279757 - RNA, 18 nt, Homo sapiens
cuaaauccuuuacuguua

SEQ ID NO: 1279758 - RNA, 18 nt, Homo sapiens
cuaaaucugccuuuucau

SEQ ID NO: 1279759 - RNA, 21 nt, Homo sapiens
cuaaaugaaaaucgugacaac

SEQ ID NO: 1279760 - RNA, 18 nt, Homo sapiens
cuaaaugaauguuuacac

SEQ ID NO: 1279761 - RNA, 22 nt, Homo sapiens
cuaaaugcagacaacaccuucc

SEQ ID NO: 1279762 - RNA, 23 nt, Homo sapiens
cuaaaugcagacaacaccuuccu

SEQ ID NO: 1279763 - RNA, 19 nt, Homo sapiens
cuaaauguauauguugauu

SEQ ID NO: 1279764 - RNA, 21 nt, Homo sapiens
cuaacaagauuuguaauuaca

SEQ ID NO: 1279765 - RNA, 17 nt, Homo sapiens
cuaacaauaauauuuca

SEQ ID NO: 1279766 - RNA, 22 nt, Homo sapiens
cuaacaauggaagauuugccca

SEQ ID NO: 1279767 - RNA, 23 nt, Homo sapiens
cuaacaauggaagauuugcccau

SEQ ID NO: 1279768 - RNA, 15 nt, Homo sapiens
cuaacaccaacauaa

SEQ ID NO: 1279769 - RNA, 17 nt, Homo sapiens
cuaacagcaaauaacag

SEQ ID NO: 1279770 - RNA, 21 nt, Homo sapiens
cuaacagcaacagcaagaaau

SEQ ID NO: 1279771 - RNA, 15 nt, Homo sapiens
cuaacaggcacuuug

SEQ ID NO: 1279772 - RNA, 16 nt, Homo sapiens
cuaacaggcacuuuga

SEQ ID NO: 1279773 - RNA, 18 nt, Homo sapiens
cuaacauuauauugcaau

SEQ ID NO: 1279774 - RNA, 19 nt, Homo sapiens
cuaaccaguaccucuguau

SEQ ID NO: 1279775 - RNA, 15 nt, Homo sapiens
cuaaccauuaaguca

SEQ ID NO: 1279776 - RNA, 16 nt, Homo sapiens
cuaaccccuuccagau

SEQ ID NO: 1279777 - RNA, 17 nt, Homo sapiens
cuaacuagcauuguaaa

SEQ ID NO: 1279778 - RNA, 16 nt, Homo sapiens
cuaacugcagaccaug

SEQ ID NO: 1279779 - RNA, 20 nt, Homo sapiens
cuaacuuauccaucuuugaa

SEQ ID NO: 1279780 - RNA, 16 nt, Homo sapiens
cuaagacacaaaugca

SEQ ID NO: 1279781 - RNA, 15 nt, Homo sapiens
cuaagaggggaaccu

SEQ ID NO: 1279782 - RNA, 15 nt, Homo sapiens
cuaagagugaaguag

SEQ ID NO: 1279783 - RNA, 15 nt, Homo sapiens
cuaagauaguaacaa

SEQ ID NO: 1279784 - RNA, 22 nt, Homo sapiens
cuaagcaaaauugcuaaagaga

SEQ ID NO: 1279785 - RNA, 20 nt, Homo sapiens
cuaagccacauggcugggau

SEQ ID NO: 1279786 - RNA, 15 nt, Homo sapiens
cuaagccaguuuuca

SEQ ID NO: 1279787 - RNA, 15 nt, Homo sapiens
cuaagcgcacauuca

SEQ ID NO: 1279788 - RNA, 13 nt, Homo sapiens
cuaaggaaccuuc

SEQ ID NO: 1279789 - RNA, 21 nt, Homo sapiens
cuaaggaagauaucuaguguu

SEQ ID NO: 1279790 - RNA, 21 nt, Homo sapiens
cuaaggagcugauacuuugac

SEQ ID NO: 1279791 - RNA, 13 nt, Homo sapiens
cuaaggcagcuaa

SEQ ID NO: 1279792 - RNA, 21 nt, Homo sapiens
cuaagguaguaacuuuccaua

SEQ ID NO: 1279793 - RNA, 21 nt, Homo sapiens
cuaaggucauuucuuugcuua

SEQ ID NO: 1279794 - RNA, 13 nt, Homo sapiens
cuaaguauauuaa

SEQ ID NO: 1279795 - RNA, 21 nt, Homo sapiens
cuaagucaggcccugaucuag

SEQ ID NO: 1279796 - RNA, 17 nt, Homo sapiens
cuaaguguuuucaaaua

SEQ ID NO: 1279797 - RNA, 23 nt, Homo sapiens
cuaaguuagagcuggcaccagaa

SEQ ID NO: 1279798 - RNA, 20 nt, Homo sapiens
cuaaguuauuuuaugacaug

SEQ ID NO: 1279799 - RNA, 21 nt, Homo sapiens
cuaaguuauuuuaugacauga

SEQ ID NO: 1279800 - RNA, 16 nt, Homo sapiens
cuaaguuggugcuuuu

SEQ ID NO: 1279801 - RNA, 19 nt, Homo sapiens
cuaaguuucuaagauucua

SEQ ID NO: 1279802 - RNA, 17 nt, Homo sapiens
cuaauagucuuugccag

SEQ ID NO: 1279803 - RNA, 18 nt, Homo sapiens
cuaauaugccuagcacaa

SEQ ID NO: 1279804 - RNA, 24 nt, Homo sapiens
cuaaucaagaaaaacaucuuuggc

SEQ ID NO: 1279805 - RNA, 14 nt, Homo sapiens
cuaaucaccaaagg

SEQ ID NO: 1279806 - RNA, 12 nt, Homo sapiens
cuaauccuaucu

SEQ ID NO: 1279807 - RNA, 16 nt, Homo sapiens
cuaaucgaaugaacaa

SEQ ID NO: 1279808 - RNA, 22 nt, Homo sapiens
cuaaucucauaccucugaccaa

SEQ ID NO: 1279809 - RNA, 23 nt, Homo sapiens
cuaaugacaaguauuuucuacua

SEQ ID NO: 1279810 - RNA, 16 nt, Homo sapiens
cuaaugagacugacca

SEQ ID NO: 1279811 - RNA, 19 nt, Homo sapiens
cuaaugagacugaccauau

SEQ ID NO: 1279812 - RNA, 15 nt, Homo sapiens
cuaauguaauaacug

SEQ ID NO: 1279813 - RNA, 19 nt, Homo sapiens
cuaauguacaauaaagcaa

SEQ ID NO: 1279814 - RNA, 22 nt, Homo sapiens
cuaauguacaauaaagcaaugu

SEQ ID NO: 1279815 - RNA, 18 nt, Homo sapiens
cuaauguaggacuguaua

SEQ ID NO: 1279816 - RNA, 19 nt, Homo sapiens
cuaauuaggguacauuuau

SEQ ID NO: 1279817 - RNA, 17 nt, Homo sapiens
cuaauucggauuugcca

SEQ ID NO: 1279818 - RNA, 14 nt, Homo sapiens
cuaauugcuuucug

SEQ ID NO: 1279819 - RNA, 11 nt, Homo sapiens
cuaauugugga

SEQ ID NO: 1279820 - RNA, 12 nt, Homo sapiens
cuaauuguggau

SEQ ID NO: 1279821 - RNA, 21 nt, Homo sapiens
cuaauuuccucugacauguaa

SEQ ID NO: 1279822 - RNA, 21 nt, Homo sapiens
cuaauuugcauuaaauucaca

SEQ ID NO: 1279823 - RNA, 19 nt, Homo sapiens
cuaauuuguaggaaaaagc

SEQ ID NO: 1279824 - RNA, 20 nt, Homo sapiens
cuaauuuucuagauuuucua

SEQ ID NO: 1279825 - RNA, 20 nt, Homo sapiens
cuaauuuuggauaauauuca

SEQ ID NO: 1279826 - RNA, 20 nt, Homo sapiens
cuaauuuuuaccgauguuaa

SEQ ID NO: 1279827 - RNA, 14 nt, Homo sapiens
cuacaacaaaagga

SEQ ID NO: 1279828 - RNA, 14 nt, Homo sapiens
cuacaagauuuaga

SEQ ID NO: 1279829 - RNA, 16 nt, Homo sapiens
cuacaagucagcucca

SEQ ID NO: 1279830 - RNA, 23 nt, Homo sapiens
cuacacaaaauacagcacuuuga

SEQ ID NO: 1279831 - RNA, 14 nt, Homo sapiens
cuacacaauuuaau

SEQ ID NO: 1279832 - RNA, 14 nt, Homo sapiens
cuacacacagauga

SEQ ID NO: 1279833 - RNA, 13 nt, Homo sapiens
cuacacacucuga

SEQ ID NO: 1279834 - RNA, 22 nt, Homo sapiens
cuacacagugggaacucugaca

SEQ ID NO: 1279835 - RNA, 19 nt, Homo sapiens
cuacacucaccugcacuaa

SEQ ID NO: 1279836 - RNA, 20 nt, Homo sapiens
cuacacugauacacuugaag

SEQ ID NO: 1279837 - RNA, 14 nt, Homo sapiens
cuacacugaugcaa

SEQ ID NO: 1279838 - RNA, 21 nt, Homo sapiens
cuacagagagaaaaauugccu

SEQ ID NO: 1279839 - RNA, 15 nt, Homo sapiens
cuacagcagcacugu

SEQ ID NO: 1279840 - RNA, 17 nt, Homo sapiens
cuucagcuguacauacu

SEQ ID NO: 1279841 - RNA, 21 nt, Homo sapiens
cuucagggcagggcucugaua

SEQ ID NO: 1279842 - RNA, 22 nt, Homo sapiens
cuucagguuaucgaaauaacaa

SEQ ID NO: 1279843 - RNA, 20 nt, Homo sapiens
cuucagguucucaugauacc

SEQ ID NO: 1279844 - RNA, 19 nt, Homo sapiens
cuucagugacaaacauauc

SEQ ID NO: 1279845 - RNA, 20 nt, Homo sapiens
cuucaguguuuuucauuucu

SEQ ID NO: 1279846 - RNA, 22 nt, Homo sapiens
cuucauagaugaaugaaacccu

SEQ ID NO: 1279847 - RNA, 19 nt, Homo sapiens
cuucauauagcauugauaa

SEQ ID NO: 1279848 - RNA, 21 nt, Homo sapiens
cuucauccucugagugugacc

SEQ ID NO: 1279849 - RNA, 20 nt, Homo sapiens
cuucaucugaaacccacaga

SEQ ID NO: 1279850 - RNA, 21 nt, Homo sapiens
cuucaucugaaacccacagau

SEQ ID NO: 1279851 - RNA, 18 nt, Homo sapiens
cuucaucuucacugcaau

SEQ ID NO: 1279852 - RNA, 16 nt, Homo sapiens
cuucaugaagcagauu

SEQ ID NO: 1279853 - RNA, 14 nt, Homo sapiens
cuucaugugcugcc

SEQ ID NO: 1279854 - RNA, 14 nt, Homo sapiens
cuucauucugcaag

SEQ ID NO: 1279855 - RNA, 14 nt, Homo sapiens
cuuccaaaccugac

SEQ ID NO: 1279856 - RNA, 14 nt, Homo sapiens
cuuccaacaaggaa

SEQ ID NO: 1279857 - RNA, 19 nt, Homo sapiens
cuuccacaauucacuagac

SEQ ID NO: 1279858 - RNA, 16 nt, Homo sapiens
cuuccacagagacauc

SEQ ID NO: 1279859 - RNA, 19 nt, Homo sapiens
cuuccacccccaccaucca

SEQ ID NO: 1279860 - RNA, 18 nt, Homo sapiens
cuuccacucgaugaugcu

SEQ ID NO: 1279861 - RNA, 13 nt, Homo sapiens
cuuccacugccuc

SEQ ID NO: 1279862 - RNA, 16 nt, Homo sapiens
cuuccacugccugaaa

SEQ ID NO: 1279863 - RNA, 18 nt, Homo sapiens
cuuccagauugacgacaa

SEQ ID NO: 1279864 - RNA, 18 nt, Homo sapiens
cuuccaggcacucaaaag

SEQ ID NO: 1279865 - RNA, 15 nt, Homo sapiens
cuuccagugcucaga

SEQ ID NO: 1279866 - RNA, 20 nt, Homo sapiens
cuuccauaaugcuacugucu

SEQ ID NO: 1279867 - RNA, 16 nt, Homo sapiens
cuuccauauuuggaag

SEQ ID NO: 1279868 - RNA, 13 nt, Homo sapiens
cuuccaucaugga

SEQ ID NO: 1279869 - RNA, 22 nt, Homo sapiens
cuuccaucccaaccagugccaa

SEQ ID NO: 1279870 - RNA, 21 nt, Homo sapiens
cuucccaaucagcacugaaaa

SEQ ID NO: 1279871 - RNA, 22 nt, Homo sapiens
cuucccagcucugacccuucua

SEQ ID NO: 1279872 - RNA, 14 nt, Homo sapiens
cuucccagugaauu

SEQ ID NO: 1279873 - RNA, 15 nt, Homo sapiens
cuuccccaacuuccc

SEQ ID NO: 1279874 - RNA, 17 nt, Homo sapiens
cuuccccaaugcuccau

SEQ ID NO: 1279875 - RNA, 15 nt, Homo sapiens
cuuccccagguccuu

SEQ ID NO: 1279876 - RNA, 21 nt, Homo sapiens
cuuccccagguccuuccuuua

SEQ ID NO: 1279877 - RNA, 22 nt, Homo sapiens
cuucccgaguaacugagauuac

SEQ ID NO: 1279878 - RNA, 22 nt, Homo sapiens
cuucccggcgucccuaccuccu

SEQ ID NO: 1279879 - RNA, 16 nt, Homo sapiens
cuucccuaaucuucca

SEQ ID NO: 1279880 - RNA, 16 nt, Homo sapiens
cuucccucccuaucua

SEQ ID NO: 1279881 - RNA, 19 nt, Homo sapiens
cuucccucgugacaguggu

SEQ ID NO: 1279882 - RNA, 17 nt, Homo sapiens
cuucccucucaugacuu

SEQ ID NO: 1279883 - RNA, 21 nt, Homo sapiens
cuucccucucugcagacuucc

SEQ ID NO: 1279884 - RNA, 18 nt, Homo sapiens
cuucccugacucuucaag

SEQ ID NO: 1279885 - RNA, 13 nt, Homo sapiens
cuucccugaucaa

SEQ ID NO: 1279886 - RNA, 12 nt, Homo sapiens
cuucccugauug

SEQ ID NO: 1279887 - RNA, 15 nt, Homo sapiens
cuucccugcauuaac

SEQ ID NO: 1279888 - RNA, 19 nt, Homo sapiens
cuucccugguaccuagcaa

SEQ ID NO: 1279889 - RNA, 18 nt, Homo sapiens
cuucccuguauuaccucc

SEQ ID NO: 1279890 - RNA, 22 nt, Homo sapiens
cuucccuugcuggaaaacccaa

SEQ ID NO: 1279891 - RNA, 15 nt, Homo sapiens
cuuccguacuauggc

SEQ ID NO: 1279892 - RNA, 21 nt, Homo sapiens
cuuccguggucagagugccac

SEQ ID NO: 1279893 - RNA, 23 nt, Homo sapiens
cuuccguggucagagugccacug

SEQ ID NO: 1279894 - RNA, 16 nt, Homo sapiens
cuuccuauaauuuuag

SEQ ID NO: 1279895 - RNA, 14 nt, Homo sapiens
cuuccucaugaauc

SEQ ID NO: 1279896 - RNA, 15 nt, Homo sapiens
cuuccucuccacugc

SEQ ID NO: 1279897 - RNA, 15 nt, Homo sapiens
cuuccucucugcaau

SEQ ID NO: 1279898 - RNA, 20 nt, Homo sapiens
cuuccugaguggccagggaa

SEQ ID NO: 1279899 - RNA, 12 nt, Homo sapiens
cuuuuuuacacu

SEQ ID NO: 1279900 - RNA, 20 nt, Homo sapiens
cuuuuuuagaaaugcaaaau

SEQ ID NO: 1279901 - RNA, 14 nt, Homo sapiens
cuuuuuuauacuca

SEQ ID NO: 1279902 - RNA, 18 nt, Homo sapiens
cuuuuuuauacucaauca

SEQ ID NO: 1279903 - RNA, 12 nt, Homo sapiens
cuuuuuuaucuu

SEQ ID NO: 1279904 - RNA, 14 nt, Homo sapiens
cuuuuuuucuuggc

SEQ ID NO: 1279905 - RNA, 22 nt, Homo sapiens
gaaaaaaaaaaaaaagaacaac

SEQ ID NO: 1279906 - RNA, 14 nt, Homo sapiens
gaaaaaaacauaaa

SEQ ID NO: 1279907 - RNA, 17 nt, Homo sapiens
gaaaaaaagaaguaugu

SEQ ID NO: 1279908 - RNA, 23 nt, Homo sapiens
gaaaaaaccguucaaauucucuu

SEQ ID NO: 1279909 - RNA, 12 nt, Homo sapiens
gaaaaacaacca

SEQ ID NO: 1279910 - RNA, 16 nt, Homo sapiens
gaaaaacagcauguac

SEQ ID NO: 1279911 - RNA, 14 nt, Homo sapiens
gaaaaacauuauuu

SEQ ID NO: 1279912 - RNA, 15 nt, Homo sapiens
gaaaaacuuccauga

SEQ ID NO: 1279913 - RNA, 20 nt, Homo sapiens
gaaaaagaccuaugagcaca

SEQ ID NO: 1279914 - RNA, 19 nt, Homo sapiens
gaaaaagauuguauuacuu

SEQ ID NO: 1279915 - RNA, 22 nt, Homo sapiens
gaaaaaggacucugcuucaguc

SEQ ID NO: 1279916 - RNA, 17 nt, Homo sapiens
gaaaaauaucuuggccu

SEQ ID NO: 1279917 - RNA, 19 nt, Homo sapiens
gaaaaauaugauacucuca

SEQ ID NO: 1279918 - RNA, 18 nt, Homo sapiens
gaaaaaucaugggccaga

SEQ ID NO: 1279919 - RNA, 17 nt, Homo sapiens
gaaaaaugcugcuucuc

SEQ ID NO: 1279920 - RNA, 20 nt, Homo sapiens
gaaaaaugcugcuucuccuc

SEQ ID NO: 1279921 - RNA, 23 nt, Homo sapiens
gaaaaaugcugcuucuccuccca

SEQ ID NO: 1279922 - RNA, 17 nt, Homo sapiens
gaaaaaugguggucauu

SEQ ID NO: 1279923 - RNA, 14 nt, Homo sapiens
gaaaaauguguuag

SEQ ID NO: 1279924 - RNA, 13 nt, Homo sapiens
gaaaacaggcaaa

SEQ ID NO: 1279925 - RNA, 18 nt, Homo sapiens
gaaaacaucucaauaaca

SEQ ID NO: 1279926 - RNA, 12 nt, Homo sapiens
gaaaaccagcuu

SEQ ID NO: 1279927 - RNA, 23 nt, Homo sapiens
gaaaagaacacuagagucuguca

SEQ ID NO: 1279928 - RNA, 16 nt, Homo sapiens
gaaaagaagacucuga

SEQ ID NO: 1279929 - RNA, 11 nt, Homo sapiens
gaaaagacucu

SEQ ID NO: 1279930 - RNA, 15 nt, Homo sapiens
gaaaagaguauguag

SEQ ID NO: 1279931 - RNA, 17 nt, Homo sapiens
gaaaagauuuaagcaca

SEQ ID NO: 1279932 - RNA, 14 nt, Homo sapiens
gaaaagcgucuuua

SEQ ID NO: 1279933 - RNA, 15 nt, Homo sapiens
gaaaagcugccauuu

SEQ ID NO: 1279934 - RNA, 15 nt, Homo sapiens
gaaaagcugcugaca

SEQ ID NO: 1279935 - RNA, 20 nt, Homo sapiens
gaaaagcugcugacaguguu

SEQ ID NO: 1279936 - RNA, 23 nt, Homo sapiens
gaaaagcuucuuaauuaauuuga

SEQ ID NO: 1279937 - RNA, 15 nt, Homo sapiens
gaaaaggccauuaaa

SEQ ID NO: 1279938 - RNA, 17 nt, Homo sapiens
gaaaaggccuucuuccc

SEQ ID NO: 1279939 - RNA, 16 nt, Homo sapiens
gaaaagggcugacauu

SEQ ID NO: 1279940 - RNA, 21 nt, Homo sapiens
gaaaagguagcuuaccugaca

SEQ ID NO: 1279941 - RNA, 19 nt, Homo sapiens
gaaaagguucuucaucccu

SEQ ID NO: 1279942 - RNA, 15 nt, Homo sapiens
gaaaagguugccuga

SEQ ID NO: 1279943 - RNA, 16 nt, Homo sapiens
gaaaaguacauuuaau

SEQ ID NO: 1279944 - RNA, 14 nt, Homo sapiens
gaaaaguagacaau

SEQ ID NO: 1279945 - RNA, 14 nt, Homo sapiens
gaaaagugcauauu

SEQ ID NO: 1279946 - RNA, 13 nt, Homo sapiens
gaaaaguguauua

SEQ ID NO: 1279947 - RNA, 23 nt, Homo sapiens
gaaaaguguguauauauuuugug

SEQ ID NO: 1279948 - RNA, 15 nt, Homo sapiens
gaaaauaaacaccau

SEQ ID NO: 1279949 - RNA, 14 nt, Homo sapiens
gaaaauaaagcaga

SEQ ID NO: 1279950 - RNA, 19 nt, Homo sapiens
gaaaauaaauucagaucaa

SEQ ID NO: 1279951 - RNA, 21 nt, Homo sapiens
gaaaauaggggaugguccagg

SEQ ID NO: 1279952 - RNA, 18 nt, Homo sapiens
gaaaauaguucccuuugc

SEQ ID NO: 1279953 - RNA, 20 nt, Homo sapiens
gaaaauaguuuggauuacuu

SEQ ID NO: 1279954 - RNA, 17 nt, Homo sapiens
gaaaauauaaaacaaau

SEQ ID NO: 1279955 - RNA, 12 nt, Homo sapiens
gaaaauaugccu

SEQ ID NO: 1279956 - RNA, 19 nt, Homo sapiens
gaaaauccccaacuaugca

SEQ ID NO: 1279957 - RNA, 18 nt, Homo sapiens
gaaaaucgaguuggcaaa

SEQ ID NO: 1279958 - RNA, 16 nt, Homo sapiens
gaaaaucuccaucuca

SEQ ID NO: 1279959 - RNA, 23 nt, Homo sapiens
gaaaaugaaccauucacagugca

SEQ ID NO: 1279960 - RNA, 12 nt, Homo sapiens
gaaaaugaaucu

SEQ ID NO: 1279961 - RNA, 16 nt, Homo sapiens
gaaaaugaaucuucac

SEQ ID NO: 1279962 - RNA, 13 nt, Homo sapiens
gaaaaugcaaaag

SEQ ID NO: 1279963 - RNA, 14 nt, Homo sapiens
gaaaauguacaaua

SEQ ID NO: 1279964 - RNA, 13 nt, Homo sapiens
cuuuauguaucuc

SEQ ID NO: 1279965 - RNA, 13 nt, Homo sapiens
cuuuauguggaaa

SEQ ID NO: 1279966 - RNA, 14 nt, Homo sapiens
cuuuauuguucaca

SEQ ID NO: 1279967 - RNA, 18 nt, Homo sapiens
cuuuauuguucacacaaa

SEQ ID NO: 1279968 - RNA, 22 nt, Homo sapiens
cuuucaaaagaagaguuuuaga

SEQ ID NO: 1279969 - RNA, 22 nt, Homo sapiens
cuuucaaaagcaagaacaccau

SEQ ID NO: 1279970 - RNA, 15 nt, Homo sapiens
cuuucaacuugcauc

SEQ ID NO: 1279971 - RNA, 16 nt, Homo sapiens
cuuucaccuuugugua

SEQ ID NO: 1279972 - RNA, 13 nt, Homo sapiens
cuuucacuaucug

SEQ ID NO: 1279973 - RNA, 18 nt, Homo sapiens
cuuucacuaucuguaaug

SEQ ID NO: 1279974 - RNA, 12 nt, Homo sapiens
cuuucacuuuga

SEQ ID NO: 1279975 - RNA, 21 nt, Homo sapiens
cuuucaggggcugacucucca

SEQ ID NO: 1279976 - RNA, 19 nt, Homo sapiens
cuuucaggguuuucuaacc

SEQ ID NO: 1279977 - RNA, 21 nt, Homo sapiens
cuuucauuccuucagauuugg

SEQ ID NO: 1279978 - RNA, 16 nt, Homo sapiens
cuuucccaucuuccaa

SEQ ID NO: 1279979 - RNA, 19 nt, Homo sapiens
cuuuccccaaaacucuccu

SEQ ID NO: 1279980 - RNA, 14 nt, Homo sapiens
cuuucccucaucca

SEQ ID NO: 1279981 - RNA, 13 nt, Homo sapiens
cuuucccuuccag

SEQ ID NO: 1279982 - RNA, 19 nt, Homo sapiens
cuuuccucagaucauccag

SEQ ID NO: 1279983 - RNA, 16 nt, Homo sapiens
cuuuccucgccugaca

SEQ ID NO: 1279984 - RNA, 19 nt, Homo sapiens
cuuuccucucuuuguucuc

SEQ ID NO: 1279985 - RNA, 15 nt, Homo sapiens
cuuuccugaaccaug

SEQ ID NO: 1279986 - RNA, 16 nt, Homo sapiens
cuuuccugaauccaaa

SEQ ID NO: 1279987 - RNA, 17 nt, Homo sapiens
cuuuccugaauccaaac

SEQ ID NO: 1279988 - RNA, 15 nt, Homo sapiens
cuuuccugcaacuca

SEQ ID NO: 1279989 - RNA, 20 nt, Homo sapiens
cuuuccuggcugaucagagc

SEQ ID NO: 1279990 - RNA, 21 nt, Homo sapiens
cuuuccugguuuucaucagga

SEQ ID NO: 1279991 - RNA, 22 nt, Homo sapiens
cuuucuaggagggagacacugg

SEQ ID NO: 1279992 - RNA, 17 nt, Homo sapiens
cuuucuaggccacuggg

SEQ ID NO: 1279993 - RNA, 15 nt, Homo sapiens
cuuucucccagugaa

SEQ ID NO: 1279994 - RNA, 19 nt, Homo sapiens
cuuucuccccgcuaaggaa

SEQ ID NO: 1279995 - RNA, 20 nt, Homo sapiens
cuuucuccuguuuauuccca

SEQ ID NO: 1279996 - RNA, 11 nt, Homo sapiens
cuuucucucag

SEQ ID NO: 1279997 - RNA, 17 nt, Homo sapiens
cuuucucucagccuuac

SEQ ID NO: 1279998 - RNA, 18 nt, Homo sapiens
cuuucucugccagugaca

SEQ ID NO: 1279999 - RNA, 16 nt, Homo sapiens
cuuucucuuucuaaaa

SEQ ID NO: 1280000 - RNA, 22 nt, Homo sapiens
cuuucucuuuuaggaggcacaa

SEQ ID NO: 1280001 - RNA, 20 nt, Homo sapiens
cuuucugcaggaaauaguca

SEQ ID NO: 1280002 - RNA, 20 nt, Homo sapiens
cuuucugccgaccccuaguu

SEQ ID NO: 1280003 - RNA, 15 nt, Homo sapiens
cuuucugcuuugcac

SEQ ID NO: 1280004 - RNA, 14 nt, Homo sapiens
cuuucugggagcag

SEQ ID NO: 1280005 - RNA, 11 nt, Homo sapiens
cuuucugugac

SEQ ID NO: 1280006 - RNA, 14 nt, Homo sapiens
cuuucugugcccua

SEQ ID NO: 1280007 - RNA, 16 nt, Homo sapiens
cuuucuuuacucuggg

SEQ ID NO: 1280008 - RNA, 20 nt, Homo sapiens
cuuucuuuccaaaacauuuc

SEQ ID NO: 1280009 - RNA, 12 nt, Homo sapiens
cuuucuuugcac

SEQ ID NO: 1280010 - RNA, 15 nt, Homo sapiens
cuuugaagaaaaaga

SEQ ID NO: 1280011 - RNA, 19 nt, Homo sapiens
cuuugaagcaguuguguca

SEQ ID NO: 1280012 - RNA, 13 nt, Homo sapiens
cuuugaauguggc

SEQ ID NO: 1280013 - RNA, 15 nt, Homo sapiens
cuuugacaguguuuu

SEQ ID NO: 1280014 - RNA, 20 nt, Homo sapiens
cuuugaccuaaauuauuuac

SEQ ID NO: 1280015 - RNA, 17 nt, Homo sapiens
cuuugagggacugccuc

SEQ ID NO: 1280016 - RNA, 12 nt, Homo sapiens
cuuugauacuga

SEQ ID NO: 1280017 - RNA, 14 nt, Homo sapiens
cuuugauaucugau

SEQ ID NO: 1280018 - RNA, 14 nt, Homo sapiens
cuuugcaauccaaa

SEQ ID NO: 1280019 - RNA, 15 nt, Homo sapiens
cuuugcacauuuuga

SEQ ID NO: 1280020 - RNA, 22 nt, Homo sapiens
cuuugccaauucauuucucuau

SEQ ID NO: 1280021 - RNA, 23 nt, Homo sapiens
cuuugccggaggaaaagcagcuc

SEQ ID NO: 1280022 - RNA, 17 nt, Homo sapiens
cuuugccuucauucugc

SEQ ID NO: 1280023 - RNA, 15 nt, Homo sapiens
cuuugccuuuaucuc

SEQ ID NO: 1280024 - RNA, 14 nt, Homo sapiens
cuuugcucccugca

SEQ ID NO: 1280025 - RNA, 15 nt, Homo sapiens
cuuugcucccugcaa

SEQ ID NO: 1280026 - RNA, 15 nt, Homo sapiens
cuuugcucuuuggua

SEQ ID NO: 1280027 - RNA, 23 nt, Homo sapiens
cuuugcugugaggcuguccugua

SEQ ID NO: 1280028 - RNA, 15 nt, Homo sapiens
cuuugcuucccauug

SEQ ID NO: 1280029 - RNA, 20 nt, Homo sapiens
ggccuggcccaaagcagugu

SEQ ID NO: 1280030 - RNA, 22 nt, Homo sapiens
ggccugggggcagugacuggca

SEQ ID NO: 1280031 - RNA, 16 nt, Homo sapiens
ggccugucgugccagu

SEQ ID NO: 1280032 - RNA, 14 nt, Homo sapiens
ggccugugugugaa

SEQ ID NO: 1280033 - RNA, 13 nt, Homo sapiens
ggccuuagcagua

SEQ ID NO: 1280034 - RNA, 17 nt, Homo sapiens
ggccuuagugggccagg

SEQ ID NO: 1280035 - RNA, 18 nt, Homo sapiens
ggccuugucugucucagc

SEQ ID NO: 1280036 - RNA, 12 nt, Homo sapiens
ggccuuuacuag

SEQ ID NO: 1280037 - RNA, 22 nt, Homo sapiens
ggcgaacccugggccauccuca

SEQ ID NO: 1280038 - RNA, 21 nt, Homo sapiens
ggcgaccuccuuucaucacac

SEQ ID NO: 1280039 - RNA, 19 nt, Homo sapiens
ggcgacugagccaugcuca

SEQ ID NO: 1280040 - RNA, 14 nt, Homo sapiens
ggcgagcacuguga

SEQ ID NO: 1280041 - RNA, 15 nt, Homo sapiens
ggcgagcacugugag

SEQ ID NO: 1280042 - RNA, 19 nt, Homo sapiens
ggcgagccaggaccacaga

SEQ ID NO: 1280043 - RNA, 13 nt, Homo sapiens
ggcgcagugcuuc

SEQ ID NO: 1280044 - RNA, 22 nt, Homo sapiens
ggcgcccuuggcuucugugaug

SEQ ID NO: 1280045 - RNA, 13 nt, Homo sapiens
ggcgcugacucug

SEQ ID NO: 1280046 - RNA, 23 nt, Homo sapiens
ggcggagcugugcucagcacagg

SEQ ID NO: 1280047 - RNA, 15 nt, Homo sapiens
ggcggcccacaccca

SEQ ID NO: 1280048 - RNA, 22 nt, Homo sapiens
ggcggcccggccagcgggcaca

SEQ ID NO: 1280049 - RNA, 14 nt, Homo sapiens
ggcggccucuugcu

SEQ ID NO: 1280050 - RNA, 14 nt, Homo sapiens
ggcgggcauggcgu

SEQ ID NO: 1280051 - RNA, 22 nt, Homo sapiens
ggcguauuuauacucacugagu

SEQ ID NO: 1280052 - RNA, 16 nt, Homo sapiens
ggcgucccuaccuccu

SEQ ID NO: 1280053 - RNA, 13 nt, Homo sapiens
ggcguuacugcuu

SEQ ID NO: 1280054 - RNA, 12 nt, Homo sapiens
ggcguuauuuau

SEQ ID NO: 1280055 - RNA, 14 nt, Homo sapiens
ggcuaacaucccac

SEQ ID NO: 1280056 - RNA, 24 nt, Homo sapiens
ggcuacuuuccacauauagagcuc

SEQ ID NO: 1280057 - RNA, 21 nt, Homo sapiens
ggcuagacacccauuuucaca

SEQ ID NO: 1280058 - RNA, 17 nt, Homo sapiens
ggcuaguaaaagccauc

SEQ ID NO: 1280059 - RNA, 23 nt, Homo sapiens
ggcuaucaacauguuauucaaug

SEQ ID NO: 1280060 - RNA, 20 nt, Homo sapiens
ggcuauggaggguccuccuc

SEQ ID NO: 1280061 - RNA, 17 nt, Homo sapiens
ggcuauuuguguguaug

SEQ ID NO: 1280062 - RNA, 19 nt, Homo sapiens
ggcucaaacaacauuccac

SEQ ID NO: 1280063 - RNA, 21 nt, Homo sapiens
ggcucaaggaaaggggguccc

SEQ ID NO: 1280064 - RNA, 15 nt, Homo sapiens
ggcucacaccuguaa

SEQ ID NO: 1280065 - RNA, 13 nt, Homo sapiens
ggcucacacugug

SEQ ID NO: 1280066 - RNA, 17 nt, Homo sapiens
ggcucacgccuguaauc

SEQ ID NO: 1280067 - RNA, 14 nt, Homo sapiens
ggcucagcacuuug

SEQ ID NO: 1280068 - RNA, 19 nt, Homo sapiens
ggcucagcggggacagcuc

SEQ ID NO: 1280069 - RNA, 15 nt, Homo sapiens
ggcucaggcucugcu

SEQ ID NO: 1280070 - RNA, 14 nt, Homo sapiens
ggcuccaccccagg

SEQ ID NO: 1280071 - RNA, 13 nt, Homo sapiens
ggcucccaugacc

SEQ ID NO: 1280072 - RNA, 14 nt, Homo sapiens
ggcucccaugacca

SEQ ID NO: 1280073 - RNA, 16 nt, Homo sapiens
ggcuccuggggcaaug

SEQ ID NO: 1280074 - RNA, 21 nt, Homo sapiens
ggcucuaauucacagugcucu

SEQ ID NO: 1280075 - RNA, 18 nt, Homo sapiens
ggcucucuuaggcaugua

SEQ ID NO: 1280076 - RNA, 14 nt, Homo sapiens
ggcucugccagugg

SEQ ID NO: 1280077 - RNA, 12 nt, Homo sapiens
ggcucuggagac

SEQ ID NO: 1280078 - RNA, 19 nt, Homo sapiens
ggcucugguaugaauucac

SEQ ID NO: 1280079 - RNA, 15 nt, Homo sapiens
ggcugaaagaugacg

SEQ ID NO: 1280080 - RNA, 14 nt, Homo sapiens
ggcugaacccugug

SEQ ID NO: 1280081 - RNA, 14 nt, Homo sapiens
ggcugacucuccag

SEQ ID NO: 1280082 - RNA, 13 nt, Homo sapiens
ggcugcaugaccu

SEQ ID NO: 1280083 - RNA, 18 nt, Homo sapiens
ggcugcgagagaaaggga

SEQ ID NO: 1280084 - RNA, 15 nt, Homo sapiens
ggcuggacaugcuga

SEQ ID NO: 1280085 - RNA, 20 nt, Homo sapiens
ggcuggacuggaggugggca

SEQ ID NO: 1280086 - RNA, 15 nt, Homo sapiens
uuccuuuucauuuaa

SEQ ID NO: 1280087 - RNA, 12 nt, Homo sapiens
uucgauggcuca

SEQ ID NO: 1280088 - RNA, 21 nt, Homo sapiens
uucgcgcccgccccugcagca

SEQ ID NO: 1280089 - RNA, 19 nt, Homo sapiens
uucgcuuaguaacuaguga

SEQ ID NO: 1280090 - RNA, 21 nt, Homo sapiens
uucuaaaaucuuauaguucua

SEQ ID NO: 1280091 - RNA, 15 nt, Homo sapiens
uucuaaagagcacuu

SEQ ID NO: 1280092 - RNA, 22 nt, Homo sapiens
uucuaaagauucuauaguucua

SEQ ID NO: 1280093 - RNA, 15 nt, Homo sapiens
uucuaaaguucuaag

SEQ ID NO: 1280094 - RNA, 17 nt, Homo sapiens
uucuaaaguucuaagau

SEQ ID NO: 1280095 - RNA, 19 nt, Homo sapiens
uucuaaauaaaaagcauua

SEQ ID NO: 1280096 - RNA, 23 nt, Homo sapiens
uucuaaaugaauguuuacacucu

SEQ ID NO: 1280097 - RNA, 13 nt, Homo sapiens
uucuaacccugac

SEQ ID NO: 1280098 - RNA, 17 nt, Homo sapiens
uucuaagcaaaauugcu

SEQ ID NO: 1280099 - RNA, 22 nt, Homo sapiens
uucuaagguccgguguucuaag

SEQ ID NO: 1280100 - RNA, 14 nt, Homo sapiens
uucuaaugucuuca

SEQ ID NO: 1280101 - RNA, 15 nt, Homo sapiens
uucuaaugugugaau

SEQ ID NO: 1280102 - RNA, 22 nt, Homo sapiens
uucuacagugaauuuaaucaaa

SEQ ID NO: 1280103 - RNA, 22 nt, Homo sapiens
uucuacuguaucgccagugccu

SEQ ID NO: 1280104 - RNA, 21 nt, Homo sapiens
uucuagaacaguaaaagccuu

SEQ ID NO: 1280105 - RNA, 21 nt, Homo sapiens
uucuagccuauuuaccugcag

SEQ ID NO: 1280106 - RNA, 15 nt, Homo sapiens
uucuaggcaucccag

SEQ ID NO: 1280107 - RNA, 15 nt, Homo sapiens
uucuagucuuggcca

SEQ ID NO: 1280108 - RNA, 19 nt, Homo sapiens
uucuagugggaaggggugc

SEQ ID NO: 1280109 - RNA, 22 nt, Homo sapiens
uucuauaacagauauggcagcu

SEQ ID NO: 1280110 - RNA, 13 nt, Homo sapiens
uucuauacaaaua

SEQ ID NO: 1280111 - RNA, 19 nt, Homo sapiens
uucuaucauuuuuguacag

SEQ ID NO: 1280112 - RNA, 14 nt, Homo sapiens
uucuaugccuuuag

SEQ ID NO: 1280113 - RNA, 18 nt, Homo sapiens
uucuauucuagccugcau

SEQ ID NO: 1280114 - RNA, 17 nt, Homo sapiens
uucuauuucucuuccua

SEQ ID NO: 1280115 - RNA, 16 nt, Homo sapiens
uucucaagugccuuaa

SEQ ID NO: 1280116 - RNA, 15 nt, Homo sapiens
uucucaaguucuaag

SEQ ID NO: 1280117 - RNA, 21 nt, Homo sapiens
uucucaaguucuaagauucua

SEQ ID NO: 1280118 - RNA, 16 nt, Homo sapiens
uucucaccauuugagu

SEQ ID NO: 1280119 - RNA, 18 nt, Homo sapiens
uucucaccugucaucuca

SEQ ID NO: 1280120 - RNA, 22 nt, Homo sapiens
uucucagauguugaaacuuuga

SEQ ID NO: 1280121 - RNA, 17 nt, Homo sapiens
uucucagccacaaaaua

SEQ ID NO: 1280122 - RNA, 16 nt, Homo sapiens
uucucagcucuuccau

SEQ ID NO: 1280123 - RNA, 22 nt, Homo sapiens
uucucagucauuuuuaaccucu

SEQ ID NO: 1280124 - RNA, 13 nt, Homo sapiens
uucucaucacuca

SEQ ID NO: 1280125 - RNA, 20 nt, Homo sapiens
uucucaucacucaaccuuau

SEQ ID NO: 1280126 - RNA, 14 nt, Homo sapiens
uucucaucccacgc

SEQ ID NO: 1280127 - RNA, 15 nt, Homo sapiens
uucucauuugucaca

SEQ ID NO: 1280128 - RNA, 13 nt, Homo sapiens
uucuccacagugu

SEQ ID NO: 1280129 - RNA, 23 nt, Homo sapiens
uucuccaccaacuggagcacuga

SEQ ID NO: 1280130 - RNA, 14 nt, Homo sapiens
uucuccacugcuug

SEQ ID NO: 1280131 - RNA, 15 nt, Homo sapiens
uucuccaucaugccc

SEQ ID NO: 1280132 - RNA, 19 nt, Homo sapiens
uucuccaucccucuaauga

SEQ ID NO: 1280133 - RNA, 21 nt, Homo sapiens
uucuccaucccucuaaugaga

SEQ ID NO: 1280134 - RNA, 19 nt, Homo sapiens
uucuccgcaacagccaagu

SEQ ID NO: 1280135 - RNA, 11 nt, Homo sapiens
uucuccugacc

SEQ ID NO: 1280136 - RNA, 14 nt, Homo sapiens
uucuccugccuuag

SEQ ID NO: 1280137 - RNA, 22 nt, Homo sapiens
uucuccugugaauggaggcaga

SEQ ID NO: 1280138 - RNA, 16 nt, Homo sapiens
uucucgcauuguagaa

SEQ ID NO: 1280139 - RNA, 13 nt, Homo sapiens
uucucuauggccu

SEQ ID NO: 1280140 - RNA, 19 nt, Homo sapiens
uucucuauuucuggaugaa

SEQ ID NO: 1280141 - RNA, 22 nt, Homo sapiens
uucucucccuuccucucuccuu

SEQ ID NO: 1280142 - RNA, 17 nt, Homo sapiens
uucucucuuaguaacau

SEQ ID NO: 1280143 - RNA, 19 nt, Homo sapiens
uucucugccgcuaccuccc

SEQ ID NO: 1280144 - RNA, 19 nt, Homo sapiens
uucucugccuuugacauuu

SEQ ID NO: 1280145 - RNA, 17 nt, Homo sapiens
uucucugcuccaccaca

SEQ ID NO: 1280146 - RNA, 14 nt, Homo sapiens
uucucugguaauau

SEQ ID NO: 1280147 - RNA, 19 nt, Homo sapiens
uucucugguaauauugacu

SEQ ID NO: 1280148 - RNA, 18 nt, Homo sapiens
uucucugugcaguagcau

SEQ ID NO: 1280149 - RNA, 16 nt, Homo sapiens
uucucugugucuaaga

SEQ ID NO: 1280150 - RNA, 21 nt, Homo sapiens
uucucuuagaacauuguauua

SEQ ID NO: 1280151 - RNA, 14 nt, Homo sapiens
uucucuuuacuuga

SEQ ID NO: 1280152 - RNA, 16 nt, Homo sapiens
uucucuuucucuccuu

SEQ ID NO: 1280153 - RNA, 15 nt, Homo sapiens
uucugaaacuggagu

SEQ ID NO: 1280154 - RNA, 21 nt, Homo sapiens
uucugaaauaaacuucacuga

SEQ ID NO: 1280155 - RNA, 22 nt, Homo sapiens
uucugaacuggaacaugggcau

SEQ ID NO: 1280156 - RNA, 13 nt, Homo sapiens
uucugacaucagc

SEQ ID NO: 1280157 - RNA, 18 nt, Homo sapiens
uucugacaucagcagaga

SEQ ID NO: 1280158 - RNA, 11 nt, Homo sapiens
uucugacccac

SEQ ID NO: 1280159 - RNA, 17 nt, Homo sapiens
uucugaggucccugugu

SEQ ID NO: 1280160 - RNA, 17 nt, Homo sapiens
uucugauaccacugcac

SEQ ID NO: 1280161 - RNA, 23 nt, Homo sapiens
uucugcaaaguguaugugaccau

SEQ ID NO: 1280162 - RNA, 11 nt, Homo sapiens
uucugcacuga

SEQ ID NO: 1280163 - RNA, 12 nt, Homo sapiens
uucugcagaaau

SEQ ID NO: 1280164 - RNA, 22 nt, Homo sapiens
uucugcagaaauuugcaacuca

SEQ ID NO: 1280165 - RNA, 20 nt, Homo sapiens
uucugcagcaugaccuguga

SEQ ID NO: 1280166 - RNA, 17 nt, Homo sapiens
uucugcauauguugaau

SEQ ID NO: 1280167 - RNA, 14 nt, Homo sapiens
uucugccugugcag

SEQ ID NO: 1280168 - RNA, 18 nt, Homo sapiens
uucugcugcccaggccac

SEQ ID NO: 1280169 - RNA, 15 nt, Homo sapiens
uucugcuucuuauau

SEQ ID NO: 1280170 - RNA, 17 nt, Homo sapiens
uucuggaaguuucuggu

SEQ ID NO: 1280171 - RNA, 20 nt, Homo sapiens
uucuggauuucauacuguaa

SEQ ID NO: 1280172 - RNA, 16 nt, Homo sapiens
uucugggaacuuccuc

SEQ ID NO: 1280173 - RNA, 13 nt, Homo sapiens
uucugggacacag

SEQ ID NO: 1280174 - RNA, 16 nt, Homo sapiens
uucugggggacagaga

SEQ ID NO: 1280175 - RNA, 19 nt, Homo sapiens
uucugggugcagcugagaa

SEQ ID NO: 1280176 - RNA, 19 nt, Homo sapiens
uucuggguggccucgggac

SEQ ID NO: 1280177 - RNA, 20 nt, Homo sapiens
uucuggugggguguguucca

SEQ ID NO: 1280178 - RNA, 14 nt, Homo sapiens
uucuguaaauacca

SEQ ID NO: 1280179 - RNA, 13 nt, Homo sapiens
uucuguaccaguu

SEQ ID NO: 1280180 - RNA, 22 nt, Homo sapiens
uucuguagcuuguucccugucu

SEQ ID NO: 1280181 - RNA, 23 nt, Homo sapiens
uucuguaucuuucauccuugacu

SEQ ID NO: 1280182 - RNA, 14 nt, Homo sapiens
uucugucaauuuca

SEQ ID NO: 1280183 - RNA, 18 nt, Homo sapiens
uucugucaggagagcagc

SEQ ID NO: 1280184 - RNA, 21 nt, Homo sapiens
uucugucagggguuucuucaa

SEQ ID NO: 1280185 - RNA, 15 nt, Homo sapiens
uucugucccuuccac

SEQ ID NO: 1280186 - RNA, 19 nt, Homo sapiens
uucugucgccuuagcaugu

SEQ ID NO: 1280187 - RNA, 16 nt, Homo sapiens
uucugugaaauauaau

SEQ ID NO: 1280188 - RNA, 23 nt, Homo sapiens
uucugugcagagaugacugucca

SEQ ID NO: 1280189 - RNA, 14 nt, Homo sapiens
uucuguguauuuaa

SEQ ID NO: 1280190 - RNA, 16 nt, Homo sapiens
uucuguugaaguuuac

SEQ ID NO: 1280191 - RNA, 13 nt, Homo sapiens
uucuguugccaca

SEQ ID NO: 1280192 - RNA, 19 nt, Homo sapiens
uucuguuggaugacuuuga

SEQ ID NO: 1280193 - RNA, 19 nt, Homo sapiens
auggcuucuggucaugaaa

SEQ ID NO: 1280194 - RNA, 23 nt, Homo sapiens
auggcuugccuaagacuugccca

SEQ ID NO: 1280195 - RNA, 19 nt, Homo sapiens
auggcuuuagcuaccucac

SEQ ID NO: 1280196 - RNA, 15 nt, Homo sapiens
auggcuuuaugcuag

SEQ ID NO: 1280197 - RNA, 20 nt, Homo sapiens
augggaaccuaguacucucu

SEQ ID NO: 1280198 - RNA, 16 nt, Homo sapiens
augggaagacugagcu

SEQ ID NO: 1280199 - RNA, 13 nt, Homo sapiens
augggacagggag

SEQ ID NO: 1280200 - RNA, 23 nt, Homo sapiens
augggaccugcucuuaaccucaa

SEQ ID NO: 1280201 - RNA, 18 nt, Homo sapiens
augggacuaaaugaacua

SEQ ID NO: 1280202 - RNA, 13 nt, Homo sapiens
augggacugagcc

SEQ ID NO: 1280203 - RNA, 18 nt, Homo sapiens
augggagugggcaccuca

SEQ ID NO: 1280204 - RNA, 19 nt, Homo sapiens
augggagugggcaccucag

SEQ ID NO: 1280205 - RNA, 22 nt, Homo sapiens
augggauugcacagagcuggag

SEQ ID NO: 1280206 - RNA, 20 nt, Homo sapiens
augggcaaauuaaggcauaa

SEQ ID NO: 1280207 - RNA, 16 nt, Homo sapiens
augggcagaaaaaugg

SEQ ID NO: 1280208 - RNA, 13 nt, Homo sapiens
auggggacacaga

SEQ ID NO: 1280209 - RNA, 16 nt, Homo sapiens
auggggacgguguaug

SEQ ID NO: 1280210 - RNA, 20 nt, Homo sapiens
auggggauuccacuaucuca

SEQ ID NO: 1280211 - RNA, 16 nt, Homo sapiens
auggggcaugugccau

SEQ ID NO: 1280212 - RNA, 18 nt, Homo sapiens
auggguccacugcaccag

SEQ ID NO: 1280213 - RNA, 17 nt, Homo sapiens
augggucuaggacacag

SEQ ID NO: 1280214 - RNA, 22 nt, Homo sapiens
augggugcuuaguaaguacuua

SEQ ID NO: 1280215 - RNA, 16 nt, Homo sapiens
augguaacagauuugc

SEQ ID NO: 1280216 - RNA, 16 nt, Homo sapiens
augguaaucaguuuug

SEQ ID NO: 1280217 - RNA, 16 nt, Homo sapiens
augguaauuguugcua

SEQ ID NO: 1280218 - RNA, 21 nt, Homo sapiens
auggucacgagguccagaccc

SEQ ID NO: 1280219 - RNA, 16 nt, Homo sapiens
auggucuaacacuggc

SEQ ID NO: 1280220 - RNA, 19 nt, Homo sapiens
auggugaaaccccgucucu

SEQ ID NO: 1280221 - RNA, 14 nt, Homo sapiens
auggugauaaggga

SEQ ID NO: 1280222 - RNA, 20 nt, Homo sapiens
auggugcaaauccuacugaa

SEQ ID NO: 1280223 - RNA, 12 nt, Homo sapiens
auggugcugaau

SEQ ID NO: 1280224 - RNA, 15 nt, Homo sapiens
auggugcugcucugu

SEQ ID NO: 1280225 - RNA, 13 nt, Homo sapiens
auggugcuuaaaa

SEQ ID NO: 1280226 - RNA, 17 nt, Homo sapiens
auggugggcacagaagu

SEQ ID NO: 1280227 - RNA, 13 nt, Homo sapiens
augguggguacaa

SEQ ID NO: 1280228 - RNA, 21 nt, Homo sapiens
augguggguacaaaaagucaa

SEQ ID NO: 1280229 - RNA, 11 nt, Homo sapiens
augguggugca

SEQ ID NO: 1280230 - RNA, 22 nt, Homo sapiens
augguguaggaaaaaugcaagc

SEQ ID NO: 1280231 - RNA, 17 nt, Homo sapiens
augguguuuucauuccc

SEQ ID NO: 1280232 - RNA, 15 nt, Homo sapiens
augguuacuaaaaag

SEQ ID NO: 1280233 - RNA, 13 nt, Homo sapiens
augguuucuccag

SEQ ID NO: 1280234 - RNA, 23 nt, Homo sapiens
augguuugaaguggagucucaug

SEQ ID NO: 1280235 - RNA, 14 nt, Homo sapiens
augguuuuacucau

SEQ ID NO: 1280236 - RNA, 19 nt, Homo sapiens
augguuuuacucaugugca

SEQ ID NO: 1280237 - RNA, 14 nt, Homo sapiens
auguaaaacaagaa

SEQ ID NO: 1280238 - RNA, 21 nt, Homo sapiens
auguaaagauauuuuuaucuu

SEQ ID NO: 1280239 - RNA, 15 nt, Homo sapiens
auguaaagcacauca

SEQ ID NO: 1280240 - RNA, 16 nt, Homo sapiens
auguaaauugcaaaua

SEQ ID NO: 1280241 - RNA, 14 nt, Homo sapiens
auguaacugugcca

SEQ ID NO: 1280242 - RNA, 17 nt, Homo sapiens
auguaagccaagucaug

SEQ ID NO: 1280243 - RNA, 12 nt, Homo sapiens
auguaagccugg

SEQ ID NO: 1280244 - RNA, 16 nt, Homo sapiens
auguaaguacuuccac

SEQ ID NO: 1280245 - RNA, 19 nt, Homo sapiens
auguaauauauuguacaaa

SEQ ID NO: 1280246 - RNA, 16 nt, Homo sapiens
auguaaucucaccuca

SEQ ID NO: 1280247 - RNA, 13 nt, Homo sapiens
auguaaugucaag

SEQ ID NO: 1280248 - RNA, 22 nt, Homo sapiens
auguaauuuagcaguccaaaga

SEQ ID NO: 1280249 - RNA, 12 nt, Homo sapiens
auguacaaauag

SEQ ID NO: 1280250 - RNA, 18 nt, Homo sapiens
auguacaauaaagcaaug

SEQ ID NO: 1280251 - RNA, 19 nt, Homo sapiens
auguacaucuggccuugaa

SEQ ID NO: 1280252 - RNA, 15 nt, Homo sapiens
auguaccugauguac

SEQ ID NO: 1280253 - RNA, 13 nt, Homo sapiens
auguacuauccaa

SEQ ID NO: 1280254 - RNA, 16 nt, Homo sapiens
auguacuauccaaucu

SEQ ID NO: 1280255 - RNA, 23 nt, Homo sapiens
auguacuauccaaucugugauga

SEQ ID NO: 1280256 - RNA, 18 nt, Homo sapiens
auguacuuagcuguacua

SEQ ID NO: 1280257 - RNA, 21 nt, Homo sapiens
auguagaauauauuuccuuau

SEQ ID NO: 1280258 - RNA, 16 nt, Homo sapiens
auguagcaaaacgcau

SEQ ID NO: 1280259 - RNA, 21 nt, Homo sapiens
auguagccagcugugcacuuu

SEQ ID NO: 1280260 - RNA, 23 nt, Homo sapiens
auguagcuauuuuucuuguugca

SEQ ID NO: 1280261 - RNA, 18 nt, Homo sapiens
auguagcucaguaauucc

SEQ ID NO: 1280262 - RNA, 18 nt, Homo sapiens
auguaucaaugaguaaca

SEQ ID NO: 1280263 - RNA, 16 nt, Homo sapiens
auguauccccacuuau

SEQ ID NO: 1280264 - RNA, 12 nt, Homo sapiens
auguaugaugcu

SEQ ID NO: 1280265 - RNA, 24 nt, Homo sapiens
auguauguacagcuggugcuuagu

SEQ ID NO: 1280266 - RNA, 12 nt, Homo sapiens
auguaugugcac

SEQ ID NO: 1280267 - RNA, 21 nt, Homo sapiens
auguauuuauauuuugugcua

SEQ ID NO: 1280268 - RNA, 19 nt, Homo sapiens
augucaaauaaagcaaagu

SEQ ID NO: 1280269 - RNA, 14 nt, Homo sapiens
augucaagccauaa

SEQ ID NO: 1280270 - RNA, 21 nt, Homo sapiens
augucaauaaaaccacuguac

SEQ ID NO: 1280271 - RNA, 15 nt, Homo sapiens
augucacauucuauu

SEQ ID NO: 1280272 - RNA, 21 nt, Homo sapiens
augucaguacuauucagguaa

SEQ ID NO: 1280273 - RNA, 18 nt, Homo sapiens
augucagucucucaccac

SEQ ID NO: 1280274 - RNA, 16 nt, Homo sapiens
augucagugucacugg

SEQ ID NO: 1280275 - RNA, 13 nt, Homo sapiens
augucaucaaaua

SEQ ID NO: 1280276 - RNA, 15 nt, Homo sapiens
augucccugggccag

SEQ ID NO: 1280277 - RNA, 22 nt, Homo sapiens
auguccgcccaccuagugcuuc

SEQ ID NO: 1280278 - RNA, 23 nt, Homo sapiens
auguccggagagacagugacagc

SEQ ID NO: 1280279 - RNA, 15 nt, Homo sapiens
auguccuacuaucac

SEQ ID NO: 1280280 - RNA, 13 nt, Homo sapiens
augucgcacaaug

SEQ ID NO: 1280281 - RNA, 20 nt, Homo sapiens
augucuacaugccaugaccu

SEQ ID NO: 1280282 - RNA, 13 nt, Homo sapiens
augucuaccucag

SEQ ID NO: 1280283 - RNA, 14 nt, Homo sapiens
augucuaccucuga

SEQ ID NO: 1280284 - RNA, 14 nt, Homo sapiens
augucuagcuuuca

SEQ ID NO: 1280285 - RNA, 14 nt, Homo sapiens
augucuauguagcu

SEQ ID NO: 1280286 - RNA, 15 nt, Homo sapiens
augucucccaggaca

SEQ ID NO: 1280287 - RNA, 22 nt, Homo sapiens
augucuccuuugcucuugccaa

SEQ ID NO: 1280288 - RNA, 17 nt, Homo sapiens
augucucuucugagcua

SEQ ID NO: 1280289 - RNA, 19 nt, Homo sapiens
augucucuuuaaugucaca

SEQ ID NO: 1280290 - RNA, 20 nt, Homo sapiens
augucuucucguuaaggaga

SEQ ID NO: 1280291 - RNA, 17 nt, Homo sapiens
augucuuggacacugua

SEQ ID NO: 1280292 - RNA, 16 nt, Homo sapiens
augucuuuucuuccac

SEQ ID NO: 1280293 - RNA, 21 nt, Homo sapiens
augucuuuucuuggcaaaagc

SEQ ID NO: 1280294 - RNA, 16 nt, Homo sapiens
augugaaaacaucuca

SEQ ID NO: 1280295 - RNA, 17 nt, Homo sapiens
augugaaaacaucucaa

SEQ ID NO: 1280296 - RNA, 13 nt, Homo sapiens
augugacaccuaa

SEQ ID NO: 1280297 - RNA, 13 nt, Homo sapiens
augugaggauuuu

SEQ ID NO: 1280298 - RNA, 17 nt, Homo sapiens
augugauauaaggauuu

SEQ ID NO: 1280299 - RNA, 14 nt, Homo sapiens
augugcacaugcac

SEQ ID NO: 1280300 - RNA, 18 nt, Homo sapiens
augugcaggauacuacau

SEQ ID NO: 1280301 - RNA, 19 nt, Homo sapiens
augugccauuuaugugagu

SEQ ID NO: 1280302 - RNA, 13 nt, Homo sapiens
augugccuuuagu

SEQ ID NO: 1280303 - RNA, 22 nt, Homo sapiens
augugcgcgcgugcaugugugc

SEQ ID NO: 1280304 - RNA, 17 nt, Homo sapiens
augugcugucaaaacaa

SEQ ID NO: 1280305 - RNA, 16 nt, Homo sapiens
auguggaacaacagca

SEQ ID NO: 1280306 - RNA, 19 nt, Homo sapiens
auguggaaggcagcagagc

SEQ ID NO: 1280307 - RNA, 21 nt, Homo sapiens
auguggacuaaauaucuguca

SEQ ID NO: 1280308 - RNA, 16 nt, Homo sapiens
auguggauaacuuuac

SEQ ID NO: 1280309 - RNA, 14 nt, Homo sapiens
auguggcauguuca

SEQ ID NO: 1280310 - RNA, 15 nt, Homo sapiens
auguggcccucugga

SEQ ID NO: 1280311 - RNA, 18 nt, Homo sapiens
augugggagggagcagac

SEQ ID NO: 1280312 - RNA, 15 nt, Homo sapiens
augugggugagccag

SEQ ID NO: 1280313 - RNA, 12 nt, Homo sapiens
auguggucucag

SEQ ID NO: 1280314 - RNA, 20 nt, Homo sapiens
augugguguauauccuucca

SEQ ID NO: 1280315 - RNA, 17 nt, Homo sapiens
augugguuacuuccuac

SEQ ID NO: 1280316 - RNA, 16 nt, Homo sapiens
auguguaugugccauu

SEQ ID NO: 1280317 - RNA, 22 nt, Homo sapiens
auguguauugaagaaaagcacu

SEQ ID NO: 1280318 - RNA, 15 nt, Homo sapiens
auguguccucaggga

SEQ ID NO: 1280319 - RNA, 15 nt, Homo sapiens
cauggauaacacauu

SEQ ID NO: 1280320 - RNA, 19 nt, Homo sapiens
cauggauucauuacagcuu

SEQ ID NO: 1280321 - RNA, 18 nt, Homo sapiens
cauggauuucauggugau

SEQ ID NO: 1280322 - RNA, 17 nt, Homo sapiens
cauggcaagucacaugc

SEQ ID NO: 1280323 - RNA, 12 nt, Homo sapiens
cauggcacugac

SEQ ID NO: 1280324 - RNA, 14 nt, Homo sapiens
cauggcacugacaa

SEQ ID NO: 1280325 - RNA, 16 nt, Homo sapiens
cauggcacugacaaug

SEQ ID NO: 1280326 - RNA, 20 nt, Homo sapiens
cauggcacugacaaugggca

SEQ ID NO: 1280327 - RNA, 18 nt, Homo sapiens
cauggccccaucccaguu

SEQ ID NO: 1280328 - RNA, 21 nt, Homo sapiens
cauggcccccaauaaaggcag

SEQ ID NO: 1280329 - RNA, 21 nt, Homo sapiens
cauggcccccaggggcaggac

SEQ ID NO: 1280330 - RNA, 14 nt, Homo sapiens
cauggcccugugcu

SEQ ID NO: 1280331 - RNA, 17 nt, Homo sapiens
cauggccuaugcacaua

SEQ ID NO: 1280332 - RNA, 18 nt, Homo sapiens
cauggcguaaugggccug

SEQ ID NO: 1280333 - RNA, 23 nt, Homo sapiens
cauggcugggauuuaaagccuuu

SEQ ID NO: 1280334 - RNA, 17 nt, Homo sapiens
cauggcuguguuugcag

SEQ ID NO: 1280335 - RNA, 12 nt, Homo sapiens
caugggagaccc

SEQ ID NO: 1280336 - RNA, 21 nt, Homo sapiens
caugggcgcaggcccagugac

SEQ ID NO: 1280337 - RNA, 16 nt, Homo sapiens
cauggguuuaccacua

SEQ ID NO: 1280338 - RNA, 16 nt, Homo sapiens
caugguacuaguguuu

SEQ ID NO: 1280339 - RNA, 18 nt, Homo sapiens
cauggugaaaauguacug

SEQ ID NO: 1280340 - RNA, 16 nt, Homo sapiens
cauggugacagucucc

SEQ ID NO: 1280341 - RNA, 13 nt, Homo sapiens
cauggugacauug

SEQ ID NO: 1280342 - RNA, 18 nt, Homo sapiens
cauggugaccaggcucuu

SEQ ID NO: 1280343 - RNA, 13 nt, Homo sapiens
cauggugagcucu

SEQ ID NO: 1280344 - RNA, 19 nt, Homo sapiens
cauggugugaguccaaaga

SEQ ID NO: 1280345 - RNA, 16 nt, Homo sapiens
caugguuuugaaaugc

SEQ ID NO: 1280346 - RNA, 15 nt, Homo sapiens
cauguaaauugcaaa

SEQ ID NO: 1280347 - RNA, 16 nt, Homo sapiens
cauguaaauugcaaau

SEQ ID NO: 1280348 - RNA, 17 nt, Homo sapiens
cauguaagccaagucau

SEQ ID NO: 1280349 - RNA, 14 nt, Homo sapiens
cauguaauccuuuu

SEQ ID NO: 1280350 - RNA, 21 nt, Homo sapiens
cauguagcccccuggccucug

SEQ ID NO: 1280351 - RNA, 18 nt, Homo sapiens
cauguaugcaaaccucau

SEQ ID NO: 1280352 - RNA, 22 nt, Homo sapiens
cauguaugucuuggacacugua

SEQ ID NO: 1280353 - RNA, 14 nt, Homo sapiens
cauguaugugcgaa

SEQ ID NO: 1280354 - RNA, 14 nt, Homo sapiens
cauguauuuuacac

SEQ ID NO: 1280355 - RNA, 17 nt, Homo sapiens
cauguauuuuacacaaa

SEQ ID NO: 1280356 - RNA, 15 nt, Homo sapiens
cauguccuaauucuu

SEQ ID NO: 1280357 - RNA, 17 nt, Homo sapiens
cauguccuaauucuucu

SEQ ID NO: 1280358 - RNA, 16 nt, Homo sapiens
caugucgccucugcau

SEQ ID NO: 1280359 - RNA, 19 nt, Homo sapiens
caugucuacaugccaugac

SEQ ID NO: 1280360 - RNA, 17 nt, Homo sapiens
caugucucaauaguaaa

SEQ ID NO: 1280361 - RNA, 18 nt, Homo sapiens
caugucuuguacaugugu

SEQ ID NO: 1280362 - RNA, 12 nt, Homo sapiens
caugucuuucag

SEQ ID NO: 1280363 - RNA, 20 nt, Homo sapiens
caugucuuuucuuccacugc

SEQ ID NO: 1280364 - RNA, 13 nt, Homo sapiens
caugugaacaucc

SEQ ID NO: 1280365 - RNA, 21 nt, Homo sapiens
caugugacauuuauauauuga

SEQ ID NO: 1280366 - RNA, 15 nt, Homo sapiens
caugugauugugauu

SEQ ID NO: 1280367 - RNA, 19 nt, Homo sapiens
caugugcaaaugugcuggu

SEQ ID NO: 1280368 - RNA, 14 nt, Homo sapiens
caugugcacaugca

SEQ ID NO: 1280369 - RNA, 13 nt, Homo sapiens
caugugcaccugc

SEQ ID NO: 1280370 - RNA, 17 nt, Homo sapiens
caugugcacgguggcga

SEQ ID NO: 1280371 - RNA, 16 nt, Homo sapiens
caugugcagcuauuua

SEQ ID NO: 1280372 - RNA, 19 nt, Homo sapiens
caugugcagucacuggugu

SEQ ID NO: 1280373 - RNA, 22 nt, Homo sapiens
caugugccagguuuuuggucug

SEQ ID NO: 1280374 - RNA, 19 nt, Homo sapiens
caugugccauagugcaggc

SEQ ID NO: 1280375 - RNA, 18 nt, Homo sapiens
caugugccuuaguguccu

SEQ ID NO: 1280376 - RNA, 18 nt, Homo sapiens
caugugccuuuaguccac

SEQ ID NO: 1280377 - RNA, 22 nt, Homo sapiens
caugugcgcgcgugcaugugug

SEQ ID NO: 1280378 - RNA, 15 nt, Homo sapiens
caugugcugccugca

SEQ ID NO: 1280379 - RNA, 16 nt, Homo sapiens
cauguggaagcacuuu

SEQ ID NO: 1280380 - RNA, 14 nt, Homo sapiens
caugugggcacgga

SEQ ID NO: 1280381 - RNA, 14 nt, Homo sapiens
cauguguaaagguu

SEQ ID NO: 1280382 - RNA, 18 nt, Homo sapiens
cauguguaauaugcacaa

SEQ ID NO: 1280383 - RNA, 18 nt, Homo sapiens
cauguguagccugugcau

SEQ ID NO: 1280384 - RNA, 13 nt, Homo sapiens
cauguguauuucc

SEQ ID NO: 1280385 - RNA, 16 nt, Homo sapiens
caugugucacuugugc

SEQ ID NO: 1280386 - RNA, 12 nt, Homo sapiens
cauguguggaag

SEQ ID NO: 1280387 - RNA, 21 nt, Homo sapiens
cauguguggcccugucugcuu

SEQ ID NO: 1280388 - RNA, 11 nt, Homo sapiens
cauguguuucu

SEQ ID NO: 1280389 - RNA, 17 nt, Homo sapiens
cauguuacucaguguua

SEQ ID NO: 1280390 - RNA, 18 nt, Homo sapiens
cauguuacugaccagcaa

SEQ ID NO: 1280391 - RNA, 14 nt, Homo sapiens
cauguuaguuaccu

SEQ ID NO: 1280392 - RNA, 13 nt, Homo sapiens
cauguucacugug

SEQ ID NO: 1280393 - RNA, 14 nt, Homo sapiens
cauguucacuguga

SEQ ID NO: 1280394 - RNA, 13 nt, Homo sapiens
cauguucaugggu

SEQ ID NO: 1280395 - RNA, 16 nt, Homo sapiens
cauguuccucaaaagc

SEQ ID NO: 1280396 - RNA, 22 nt, Homo sapiens
cauguucuaaauaaaaagcauu

SEQ ID NO: 1280397 - RNA, 23 nt, Homo sapiens
cauguugcaaagaacuccagagu

SEQ ID NO: 1280398 - RNA, 22 nt, Homo sapiens
cauguugccucaccagcccuga

SEQ ID NO: 1280399 - RNA, 23 nt, Homo sapiens
cauguuuauaaaucuuaugcucu

SEQ ID NO: 1280400 - RNA, 22 nt, Homo sapiens
cauguuucaagaaaauggauuu

SEQ ID NO: 1280401 - RNA, 13 nt, Homo sapiens
cauguuuccucuu

SEQ ID NO: 1280402 - RNA, 20 nt, Homo sapiens
cauguuuguuucuguagaaa

SEQ ID NO: 1280403 - RNA, 22 nt, Homo sapiens
cauguuuugauuuguagcacug

SEQ ID NO: 1280404 - RNA, 22 nt, Homo sapiens
cauuaaaaaaauuagaaaguag

SEQ ID NO: 1280405 - RNA, 20 nt, Homo sapiens
cauuaaaaauguuaguauuu

SEQ ID NO: 1280406 - RNA, 18 nt, Homo sapiens
cauuaaaacaaauccaua

SEQ ID NO: 1280407 - RNA, 14 nt, Homo sapiens
cauuaaacuugaag

SEQ ID NO: 1280408 - RNA, 17 nt, Homo sapiens
cauuaaauucacuuuca

SEQ ID NO: 1280409 - RNA, 20 nt, Homo sapiens
cauuaacugcacaaacaaua

SEQ ID NO: 1280410 - RNA, 13 nt, Homo sapiens
cauuaacuucucu

SEQ ID NO: 1280411 - RNA, 15 nt, Homo sapiens
cauuaacuucucugg

SEQ ID NO: 1280412 - RNA, 19 nt, Homo sapiens
cauuaaggggaagaaugaa

SEQ ID NO: 1280413 - RNA, 14 nt, Homo sapiens
cauuacuauucacu

SEQ ID NO: 1280414 - RNA, 19 nt, Homo sapiens
cauuacuguuccagauucc

SEQ ID NO: 1280415 - RNA, 19 nt, Homo sapiens
cauuacuuugauaucugau

SEQ ID NO: 1280416 - RNA, 19 nt, Homo sapiens
cauuagaacacugcauuag

SEQ ID NO: 1280417 - RNA, 21 nt, Homo sapiens
cauuagaauuuacagcaagaa

SEQ ID NO: 1280418 - RNA, 19 nt, Homo sapiens
cauuaggucccucacucca

SEQ ID NO: 1280419 - RNA, 20 nt, Homo sapiens
cauuaggucccucacuccac

SEQ ID NO: 1280420 - RNA, 19 nt, Homo sapiens
cauuagucaauaacuaaac

SEQ ID NO: 1280421 - RNA, 15 nt, Homo sapiens
cauuaguuguuauua

SEQ ID NO: 1280422 - RNA, 14 nt, Homo sapiens
cauuauacauuuga

SEQ ID NO: 1280423 - RNA, 15 nt, Homo sapiens
cauuaucaguugaca

SEQ ID NO: 1280424 - RNA, 19 nt, Homo sapiens
cauuaucgagcagcauuuu

SEQ ID NO: 1280425 - RNA, 19 nt, Homo sapiens
cauuaucuugcagcuguaa

SEQ ID NO: 1280426 - RNA, 22 nt, Homo sapiens
cauuaucuugcagcuguaaaca

SEQ ID NO: 1280427 - RNA, 21 nt, Homo sapiens
cauuaugaguaguguggaauu

SEQ ID NO: 1280428 - RNA, 21 nt, Homo sapiens
cauuaugugugcaugugugua

SEQ ID NO: 1280429 - RNA, 13 nt, Homo sapiens
cauuauucauuua

SEQ ID NO: 1280430 - RNA, 12 nt, Homo sapiens
cauuauuccucc

SEQ ID NO: 1280431 - RNA, 17 nt, Homo sapiens
cauuauuuaauuacaga

SEQ ID NO: 1280432 - RNA, 15 nt, Homo sapiens
cauuauuuucuguca

SEQ ID NO: 1280433 - RNA, 16 nt, Homo sapiens
cauuauuuucugucag

SEQ ID NO: 1280434 - RNA, 22 nt, Homo sapiens
cauuauuuucugucagaugaga

SEQ ID NO: 1280435 - RNA, 17 nt, Homo sapiens
cauucaacucuccaaug

SEQ ID NO: 1280436 - RNA, 14 nt, Homo sapiens
cauucaacugaaaa

SEQ ID NO: 1280437 - RNA, 12 nt, Homo sapiens
cauucacaccag

SEQ ID NO: 1280438 - RNA, 15 nt, Homo sapiens
cauucacagugcaag

SEQ ID NO: 1280439 - RNA, 17 nt, Homo sapiens
cauucacuugcauuucu

SEQ ID NO: 1280440 - RNA, 13 nt, Homo sapiens
cauucaguauuaa

SEQ ID NO: 1280441 - RNA, 20 nt, Homo sapiens
cauucagugauuacugucaa

SEQ ID NO: 1280442 - RNA, 23 nt, Homo sapiens
cauucauaggcaguaauguuccu

SEQ ID NO: 1280443 - RNA, 13 nt, Homo sapiens
cauuccacuccac

SEQ ID NO: 1280444 - RNA, 15 nt, Homo sapiens
cauucccaucuguca

SEQ ID NO: 1280445 - RNA, 22 nt, Homo sapiens
ccacauagguaaaaacuggaau

SEQ ID NO: 1280446 - RNA, 18 nt, Homo sapiens
ccacauauagagcuccag

SEQ ID NO: 1280447 - RNA, 18 nt, Homo sapiens
ccacauccaacuccagca

SEQ ID NO: 1280448 - RNA, 13 nt, Homo sapiens
ccacaucugccag

SEQ ID NO: 1280449 - RNA, 23 nt, Homo sapiens
ccacaucugccuuaaaaccaaag

SEQ ID NO: 1280450 - RNA, 19 nt, Homo sapiens
ccacaugggugcauuugua

SEQ ID NO: 1280451 - RNA, 17 nt, Homo sapiens
ccacauguacagacaua

SEQ ID NO: 1280452 - RNA, 19 nt, Homo sapiens
ccacaugugacacauaugc

SEQ ID NO: 1280453 - RNA, 14 nt, Homo sapiens
ccacaugugcacau

SEQ ID NO: 1280454 - RNA, 19 nt, Homo sapiens
ccacauuauacauuugaug

SEQ ID NO: 1280455 - RNA, 18 nt, Homo sapiens
ccacauuuagaacuuugg

SEQ ID NO: 1280456 - RNA, 13 nt, Homo sapiens
ccaccacauuuag

SEQ ID NO: 1280457 - RNA, 22 nt, Homo sapiens
ccaccacauuuagaacuuuggc

SEQ ID NO: 1280458 - RNA, 20 nt, Homo sapiens
ccaccagcauccacacugcc

SEQ ID NO: 1280459 - RNA, 19 nt, Homo sapiens
ccaccagcccgcaacucuc

SEQ ID NO: 1280460 - RNA, 18 nt, Homo sapiens
ccaccaguaugacaguau

SEQ ID NO: 1280461 - RNA, 17 nt, Homo sapiens
ccaccauccagguggag

SEQ ID NO: 1280462 - RNA, 19 nt, Homo sapiens
ccacccaacccuaucuccu

SEQ ID NO: 1280463 - RNA, 20 nt, Homo sapiens
ccacccacaaucacaagaag

SEQ ID NO: 1280464 - RNA, 16 nt, Homo sapiens
ccacccaccuuugcca

SEQ ID NO: 1280465 - RNA, 22 nt, Homo sapiens
ccacccaggcuggagugcagug

SEQ ID NO: 1280466 - RNA, 18 nt, Homo sapiens
ccacccaguccugcacac

SEQ ID NO: 1280467 - RNA, 13 nt, Homo sapiens
ccacccagucuca

SEQ ID NO: 1280468 - RNA, 16 nt, Homo sapiens
ccacccauaccacagc

SEQ ID NO: 1280469 - RNA, 13 nt, Homo sapiens
ccaccccaagaga

SEQ ID NO: 1280470 - RNA, 14 nt, Homo sapiens
ccaccccaagagaa

SEQ ID NO: 1280471 - RNA, 15 nt, Homo sapiens
ccaccccacacugcc

SEQ ID NO: 1280472 - RNA, 13 nt, Homo sapiens
ccaccccacacuu

SEQ ID NO: 1280473 - RNA, 21 nt, Homo sapiens
ccaccccagcaggacagugac

SEQ ID NO: 1280474 - RNA, 14 nt, Homo sapiens
ccacccccagcuca

SEQ ID NO: 1280475 - RNA, 16 nt, Homo sapiens
ccacccuccuugagac

SEQ ID NO: 1280476 - RNA, 21 nt, Homo sapiens
ccacccuguucccagucuucu

SEQ ID NO: 1280477 - RNA, 21 nt, Homo sapiens
ccaccuacuuuucuuuccuca

SEQ ID NO: 1280478 - RNA, 17 nt, Homo sapiens
ccaccuauaccaauauu

SEQ ID NO: 1280479 - RNA, 13 nt, Homo sapiens
ccaccucagggca

SEQ ID NO: 1280480 - RNA, 18 nt, Homo sapiens
ccaccucggucacuccaa

SEQ ID NO: 1280481 - RNA, 16 nt, Homo sapiens
ccaccucuccuuuggc

SEQ ID NO: 1280482 - RNA, 22 nt, Homo sapiens
ccaccugacacuaaccagaguc

SEQ ID NO: 1280483 - RNA, 24 nt, Homo sapiens
ccaccugccugcaucugugaaaag

SEQ ID NO: 1280484 - RNA, 13 nt, Homo sapiens
ccaccugucucag

SEQ ID NO: 1280485 - RNA, 15 nt, Homo sapiens
ccaccugugcccuca

SEQ ID NO: 1280486 - RNA, 19 nt, Homo sapiens
ccaccuuugccacaaagcu

SEQ ID NO: 1280487 - RNA, 14 nt, Homo sapiens
ccacgaggugcagu

SEQ ID NO: 1280488 - RNA, 22 nt, Homo sapiens
ccacgauuuucuccagcucaga

SEQ ID NO: 1280489 - RNA, 21 nt, Homo sapiens
ccacgcuagggcggggcacag

SEQ ID NO: 1280490 - RNA, 18 nt, Homo sapiens
ccacgcuggagugcagug

SEQ ID NO: 1280491 - RNA, 14 nt, Homo sapiens
ccacgguaggcuag

SEQ ID NO: 1280492 - RNA, 16 nt, Homo sapiens
ccacgucaacagaauu

SEQ ID NO: 1280493 - RNA, 13 nt, Homo sapiens
ccacuaaaguaua

SEQ ID NO: 1280494 - RNA, 14 nt, Homo sapiens
ccacuaagaauuca

SEQ ID NO: 1280495 - RNA, 17 nt, Homo sapiens
ccacuaauagcauuguc

SEQ ID NO: 1280496 - RNA, 14 nt, Homo sapiens
ccacuacugcagca

SEQ ID NO: 1280497 - RNA, 20 nt, Homo sapiens
ccacuaggguccaccaggag

SEQ ID NO: 1280498 - RNA, 17 nt, Homo sapiens
ccacuauuuaaguuauc

SEQ ID NO: 1280499 - RNA, 17 nt, Homo sapiens
ccacucagguucuucag

SEQ ID NO: 1280500 - RNA, 14 nt, Homo sapiens
ccacucccaaagcu

SEQ ID NO: 1280501 - RNA, 17 nt, Homo sapiens
ccacucccaaagcucag

SEQ ID NO: 1280502 - RNA, 16 nt, Homo sapiens
ccacucccuuugccag

SEQ ID NO: 1280503 - RNA, 13 nt, Homo sapiens
ccacuccuaauau

SEQ ID NO: 1280504 - RNA, 14 nt, Homo sapiens
ccacuccuguacac

SEQ ID NO: 1280505 - RNA, 15 nt, Homo sapiens
ccacucuaccaaaua

SEQ ID NO: 1280506 - RNA, 17 nt, Homo sapiens
ccacucucccaccuccu

SEQ ID NO: 1280507 - RNA, 18 nt, Homo sapiens
ccacugaagcaccacagg

SEQ ID NO: 1280508 - RNA, 14 nt, Homo sapiens
ccacugaagcccau

SEQ ID NO: 1280509 - RNA, 20 nt, Homo sapiens
ccacugcaaauaaagccuuu

SEQ ID NO: 1280510 - RNA, 22 nt, Homo sapiens
ccacugccuucgcuucuugccu

SEQ ID NO: 1280511 - RNA, 15 nt, Homo sapiens
ccacuggauugcuga

SEQ ID NO: 1280512 - RNA, 19 nt, Homo sapiens
ccacugggaccaacccugg

SEQ ID NO: 1280513 - RNA, 22 nt, Homo sapiens
ccacugggacccccaacauucu

SEQ ID NO: 1280514 - RNA, 13 nt, Homo sapiens
ccacuggucugua

SEQ ID NO: 1280515 - RNA, 16 nt, Homo sapiens
ccacugugcguuuuag

SEQ ID NO: 1280516 - RNA, 14 nt, Homo sapiens
ccacuguguacugu

SEQ ID NO: 1280517 - RNA, 21 nt, Homo sapiens
ccacuguuucucuugagcugg

SEQ ID NO: 1280518 - RNA, 22 nt, Homo sapiens
ccacuuacagaucuaucuccuc

SEQ ID NO: 1280519 - RNA, 15 nt, Homo sapiens
ccacuuagcaugugu

SEQ ID NO: 1280520 - RNA, 13 nt, Homo sapiens
ccacuuugacucc

SEQ ID NO: 1280521 - RNA, 14 nt, Homo sapiens
ccagaaacuuuaag

SEQ ID NO: 1280522 - RNA, 15 nt, Homo sapiens
ccagaaaucaaaaag

SEQ ID NO: 1280523 - RNA, 16 nt, Homo sapiens
ccagaaccacacuuga

SEQ ID NO: 1280524 - RNA, 14 nt, Homo sapiens
ccagaacccuuccu

SEQ ID NO: 1280525 - RNA, 16 nt, Homo sapiens
ccagaagaauauucag

SEQ ID NO: 1280526 - RNA, 13 nt, Homo sapiens
ccagaagauucua

SEQ ID NO: 1280527 - RNA, 15 nt, Homo sapiens
ccagaagauucuauc

SEQ ID NO: 1280528 - RNA, 23 nt, Homo sapiens
ccagaaggagggcagagccaugg

SEQ ID NO: 1280529 - RNA, 17 nt, Homo sapiens
ccagaaggcgugcuggc

SEQ ID NO: 1280530 - RNA, 18 nt, Homo sapiens
ccagaaggcgugcuggca

SEQ ID NO: 1280531 - RNA, 22 nt, Homo sapiens
ccagaaggguagcugggcgggg

SEQ ID NO: 1280532 - RNA, 15 nt, Homo sapiens
ccagaaguuccucaa

SEQ ID NO: 1280533 - RNA, 13 nt, Homo sapiens
ccagaauagcuuu

SEQ ID NO: 1280534 - RNA, 22 nt, Homo sapiens
ccagaaugcugcaggacuugag

SEQ ID NO: 1280535 - RNA, 13 nt, Homo sapiens
ccagacaaaugga

SEQ ID NO: 1280536 - RNA, 15 nt, Homo sapiens
ccagacaaccaaaac

SEQ ID NO: 1280537 - RNA, 18 nt, Homo sapiens
ccagacacagacuggcaa

SEQ ID NO: 1280538 - RNA, 13 nt, Homo sapiens
ccagacacugccu

SEQ ID NO: 1280539 - RNA, 20 nt, Homo sapiens
ccagacauacgaaacacaaa

SEQ ID NO: 1280540 - RNA, 21 nt, Homo sapiens
ccagacauacgaaacacaaac

SEQ ID NO: 1280541 - RNA, 12 nt, Homo sapiens
ccagacccagug

SEQ ID NO: 1280542 - RNA, 14 nt, Homo sapiens
ccagacggucagga

SEQ ID NO: 1280543 - RNA, 23 nt, Homo sapiens
ccagacucaccccaucugcagca

SEQ ID NO: 1280544 - RNA, 17 nt, Homo sapiens
ccagacuggaagacacu

SEQ ID NO: 1280545 - RNA, 18 nt, Homo sapiens
ccagacuuccuccuuucc

SEQ ID NO: 1280546 - RNA, 17 nt, Homo sapiens
ccagacuuuagugcccu

SEQ ID NO: 1280547 - RNA, 15 nt, Homo sapiens
ccagagaaaagaguc

SEQ ID NO: 1280548 - RNA, 22 nt, Homo sapiens
ccagagagcagcuucagugaca

SEQ ID NO: 1280549 - RNA, 20 nt, Homo sapiens
ccagagagccuggugcugcu

SEQ ID NO: 1280550 - RNA, 20 nt, Homo sapiens
ccagagaggguggugaccuc

SEQ ID NO: 1280551 - RNA, 18 nt, Homo sapiens
ccagagauggucacauga

SEQ ID NO: 1280552 - RNA, 14 nt, Homo sapiens
ccagagcaaaauaa

SEQ ID NO: 1280553 - RNA, 12 nt, Homo sapiens
ccagagcacugg

SEQ ID NO: 1280554 - RNA, 16 nt, Homo sapiens
ccagagcagaugcaga

SEQ ID NO: 1280555 - RNA, 16 nt, Homo sapiens
ccagagcccacuucca

SEQ ID NO: 1280556 - RNA, 17 nt, Homo sapiens
ccagagcccacuuccau

SEQ ID NO: 1280557 - RNA, 19 nt, Homo sapiens
ccagagcccuucacugcca

SEQ ID NO: 1280558 - RNA, 20 nt, Homo sapiens
ccagagcccuucacugccau

SEQ ID NO: 1280559 - RNA, 22 nt, Homo sapiens
ccagagcggaaggagggagcuc

SEQ ID NO: 1280560 - RNA, 18 nt, Homo sapiens
ccagagcuggaaggcagg

SEQ ID NO: 1280561 - RNA, 17 nt, Homo sapiens
ccagagcugugccagca

SEQ ID NO: 1280562 - RNA, 21 nt, Homo sapiens
ccagaggagccaccaguucuc

SEQ ID NO: 1280563 - RNA, 18 nt, Homo sapiens
ccagaggaugucacaaag

SEQ ID NO: 1280564 - RNA, 21 nt, Homo sapiens
ccagaggcucuaauguacaau

SEQ ID NO: 1280565 - RNA, 17 nt, Homo sapiens
ccagaggguagggcaca

SEQ ID NO: 1280566 - RNA, 20 nt, Homo sapiens
ccagaggguagggcacaaag

SEQ ID NO: 1280567 - RNA, 21 nt, Homo sapiens
ccagagguaauguuaguaaau

SEQ ID NO: 1280568 - RNA, 17 nt, Homo sapiens
ccagagucaaauuugaa

SEQ ID NO: 1280569 - RNA, 16 nt, Homo sapiens
ccagaguggagucuga

SEQ ID NO: 1280570 - RNA, 20 nt, Homo sapiens
ccagaguggccuggccagga

SEQ ID NO: 1280571 - RNA, 14 nt, Homo sapiens
cuggaacuggaguu

SEQ ID NO: 1280572 - RNA, 20 nt, Homo sapiens
cuggaagaaagcaacaaaga

SEQ ID NO: 1280573 - RNA, 14 nt, Homo sapiens
cuggaagacacuuc

SEQ ID NO: 1280574 - RNA, 17 nt, Homo sapiens
cuggaagaccugaaaga

SEQ ID NO: 1280575 - RNA, 22 nt, Homo sapiens
cuggaagaucagcacccuaaga

SEQ ID NO: 1280576 - RNA, 12 nt, Homo sapiens
cuggaagccaaa

SEQ ID NO: 1280577 - RNA, 16 nt, Homo sapiens
cuggaagccagagaaa

SEQ ID NO: 1280578 - RNA, 15 nt, Homo sapiens
cuggaaggacaucua

SEQ ID NO: 1280579 - RNA, 19 nt, Homo sapiens
cuggaaggggccacgugga

SEQ ID NO: 1280580 - RNA, 12 nt, Homo sapiens
cuggaaguagaa

SEQ ID NO: 1280581 - RNA, 16 nt, Homo sapiens
cuggaaguucauaccu

SEQ ID NO: 1280582 - RNA, 20 nt, Homo sapiens
cuggaaguuucuggugccau

SEQ ID NO: 1280583 - RNA, 16 nt, Homo sapiens
cuggaaugcagugaca

SEQ ID NO: 1280584 - RNA, 13 nt, Homo sapiens
cuggaauugcuca

SEQ ID NO: 1280585 - RNA, 14 nt, Homo sapiens
cuggacaacacagc

SEQ ID NO: 1280586 - RNA, 14 nt, Homo sapiens
cuggacaccagggg

SEQ ID NO: 1280587 - RNA, 14 nt, Homo sapiens
cuggacagacccag

SEQ ID NO: 1280588 - RNA, 18 nt, Homo sapiens
cuggacggggacugggga

SEQ ID NO: 1280589 - RNA, 21 nt, Homo sapiens
cuggacgugcgcgaugccugg

SEQ ID NO: 1280590 - RNA, 12 nt, Homo sapiens
cuggacugggag

SEQ ID NO: 1280591 - RNA, 11 nt, Homo sapiens
cuggacuguca

SEQ ID NO: 1280592 - RNA, 17 nt, Homo sapiens
cuggacugugugcaacg

SEQ ID NO: 1280593 - RNA, 15 nt, Homo sapiens
cuggacuugccuaaa

SEQ ID NO: 1280594 - RNA, 22 nt, Homo sapiens
cuggacuuuccuguugucuaca

SEQ ID NO: 1280595 - RNA, 21 nt, Homo sapiens
cuggagaccagggagccuuug

SEQ ID NO: 1280596 - RNA, 13 nt, Homo sapiens
cuggagauaugaa

SEQ ID NO: 1280597 - RNA, 14 nt, Homo sapiens
cuggagaugcugcc

SEQ ID NO: 1280598 - RNA, 16 nt, Homo sapiens
cuggagccaacugcug

SEQ ID NO: 1280599 - RNA, 20 nt, Homo sapiens
cuggagcccauccagucucc

SEQ ID NO: 1280600 - RNA, 20 nt, Homo sapiens
cuggagccuccacugccucu

SEQ ID NO: 1280601 - RNA, 18 nt, Homo sapiens
cuggagcucaucugcaaa

SEQ ID NO: 1280602 - RNA, 19 nt, Homo sapiens
cuggagcuggcgucugcau

SEQ ID NO: 1280603 - RNA, 23 nt, Homo sapiens
cuggaggcggcaaagggugaaau

SEQ ID NO: 1280604 - RNA, 19 nt, Homo sapiens
cuggagggaagcacugccu

SEQ ID NO: 1280605 - RNA, 19 nt, Homo sapiens
cuggagggaggggugagau

SEQ ID NO: 1280606 - RNA, 19 nt, Homo sapiens
cuggaguaucauucuuuac

SEQ ID NO: 1280607 - RNA, 16 nt, Homo sapiens
cuggagucuggcuuua

SEQ ID NO: 1280608 - RNA, 20 nt, Homo sapiens
cuggagugcaauggcgcgau

SEQ ID NO: 1280609 - RNA, 20 nt, Homo sapiens
cuggagugcaguggugugau

SEQ ID NO: 1280610 - RNA, 21 nt, Homo sapiens
cuggauccagccaugccugag

SEQ ID NO: 1280611 - RNA, 21 nt, Homo sapiens
cuggauccccucugucuacaa

SEQ ID NO: 1280612 - RNA, 22 nt, Homo sapiens
cuggauccccucugucuacaaa

SEQ ID NO: 1280613 - RNA, 21 nt, Homo sapiens
cuggaucuaccagcauaaaua

SEQ ID NO: 1280614 - RNA, 14 nt, Homo sapiens
cuggaugacauuaa

SEQ ID NO: 1280615 - RNA, 17 nt, Homo sapiens
cuggauggcccauagac

SEQ ID NO: 1280616 - RNA, 18 nt, Homo sapiens
cuggaugggggucccugu

SEQ ID NO: 1280617 - RNA, 19 nt, Homo sapiens
cuggaugguccucuuacca

SEQ ID NO: 1280618 - RNA, 18 nt, Homo sapiens
cuggauguacuuaagagu

SEQ ID NO: 1280619 - RNA, 15 nt, Homo sapiens
cuggauucgugacaa

SEQ ID NO: 1280620 - RNA, 17 nt, Homo sapiens
cuggauucuuaaccaag

SEQ ID NO: 1280621 - RNA, 18 nt, Homo sapiens
cuggauuucauacuguaa

SEQ ID NO: 1280622 - RNA, 18 nt, Homo sapiens
cuggauuucugguucuga

SEQ ID NO: 1280623 - RNA, 15 nt, Homo sapiens
cuggcaacacagagg

SEQ ID NO: 1280624 - RNA, 14 nt, Homo sapiens
cuggcaacaugaag

SEQ ID NO: 1280625 - RNA, 21 nt, Homo sapiens
cuggcaagaggccucaugccu

SEQ ID NO: 1280626 - RNA, 17 nt, Homo sapiens
cuggcaagucaccugca

SEQ ID NO: 1280627 - RNA, 18 nt, Homo sapiens
cuggcaagucuuccauga

SEQ ID NO: 1280628 - RNA, 22 nt, Homo sapiens
cuggcaauaaacuccuacuaaa

SEQ ID NO: 1280629 - RNA, 21 nt, Homo sapiens
cuggcaaugaaaaauucucag

SEQ ID NO: 1280630 - RNA, 13 nt, Homo sapiens
cuggcacacuggc

SEQ ID NO: 1280631 - RNA, 19 nt, Homo sapiens
cuggcacgcccuacuccac

SEQ ID NO: 1280632 - RNA, 19 nt, Homo sapiens
cuggcacuuagcccaagag

SEQ ID NO: 1280633 - RNA, 13 nt, Homo sapiens
cuggcagcaugac

SEQ ID NO: 1280634 - RNA, 19 nt, Homo sapiens
cuggcagccgugccuucag

SEQ ID NO: 1280635 - RNA, 17 nt, Homo sapiens
cuggcaggaugcugagc

SEQ ID NO: 1280636 - RNA, 22 nt, Homo sapiens
cuggcaguugaacagagggaga

SEQ ID NO: 1280637 - RNA, 19 nt, Homo sapiens
cuggcauuugcaccuaccu

SEQ ID NO: 1280638 - RNA, 16 nt, Homo sapiens
cuggccagcacccucu

SEQ ID NO: 1280639 - RNA, 13 nt, Homo sapiens
cuggccccugugc

SEQ ID NO: 1280640 - RNA, 17 nt, Homo sapiens
cuggcccuccacuccuc

SEQ ID NO: 1280641 - RNA, 17 nt, Homo sapiens
cuggcccucgacacuca

SEQ ID NO: 1280642 - RNA, 16 nt, Homo sapiens
cuggccuaaugagaua

SEQ ID NO: 1280643 - RNA, 21 nt, Homo sapiens
cuggccuauuuaucugaucaa

SEQ ID NO: 1280644 - RNA, 23 nt, Homo sapiens
cuggccuggaucuccccacucua

SEQ ID NO: 1280645 - RNA, 17 nt, Homo sapiens
cuggccuuugcucuuac

SEQ ID NO: 1280646 - RNA, 22 nt, Homo sapiens
cuggcgagccucugguuuuccu

SEQ ID NO: 1280647 - RNA, 15 nt, Homo sapiens
cuggcggcugugcau

SEQ ID NO: 1280648 - RNA, 22 nt, Homo sapiens
cuggcuagaguccucacuccca

SEQ ID NO: 1280649 - RNA, 16 nt, Homo sapiens
cuggcucacaguacag

SEQ ID NO: 1280650 - RNA, 17 nt, Homo sapiens
cuggcuccacaccucca

SEQ ID NO: 1280651 - RNA, 14 nt, Homo sapiens
cuggcucucagaag

SEQ ID NO: 1280652 - RNA, 12 nt, Homo sapiens
cuggcucuccaa

SEQ ID NO: 1280653 - RNA, 18 nt, Homo sapiens
cuggcugagguuccucug

SEQ ID NO: 1280654 - RNA, 19 nt, Homo sapiens
cuggcugcccuggcccuga

SEQ ID NO: 1280655 - RNA, 13 nt, Homo sapiens
cuggcugcugcug

SEQ ID NO: 1280656 - RNA, 18 nt, Homo sapiens
cuggcugcugcugugcag

SEQ ID NO: 1280657 - RNA, 19 nt, Homo sapiens
cuggcugcugcugugcagu

SEQ ID NO: 1280658 - RNA, 22 nt, Homo sapiens
cuggcuguuuagcagaacucau

SEQ ID NO: 1280659 - RNA, 15 nt, Homo sapiens
cuggcuuagugccac

SEQ ID NO: 1280660 - RNA, 20 nt, Homo sapiens
cuggcuucucuugagucaca

SEQ ID NO: 1280661 - RNA, 16 nt, Homo sapiens
cuggcuugggccugag

SEQ ID NO: 1280662 - RNA, 23 nt, Homo sapiens
cuggcuuggggucaagaaacagc

SEQ ID NO: 1280663 - RNA, 12 nt, Homo sapiens
cugggaaccagc

SEQ ID NO: 1280664 - RNA, 16 nt, Homo sapiens
cugggaccaacccugg

SEQ ID NO: 1280665 - RNA, 15 nt, Homo sapiens
cugggaccugaaccu

SEQ ID NO: 1280666 - RNA, 15 nt, Homo sapiens
cugggagcauagcag

SEQ ID NO: 1280667 - RNA, 22 nt, Homo sapiens
cugggagcccggcaacucuagu

SEQ ID NO: 1280668 - RNA, 22 nt, Homo sapiens
cugggagccggaggcugcagug

SEQ ID NO: 1280669 - RNA, 16 nt, Homo sapiens
cugggagucacacagu

SEQ ID NO: 1280670 - RNA, 15 nt, Homo sapiens
cugggaguguccuua

SEQ ID NO: 1280671 - RNA, 18 nt, Homo sapiens
cugggauggaggggagug

SEQ ID NO: 1280672 - RNA, 22 nt, Homo sapiens
cugggauuacagacaugaacug

SEQ ID NO: 1280673 - RNA, 20 nt, Homo sapiens
cugggauuacaggugugaac

SEQ ID NO: 1280674 - RNA, 22 nt, Homo sapiens
cugggauuucucccucucagug

SEQ ID NO: 1280675 - RNA, 14 nt, Homo sapiens
cugggcagccuuuc

SEQ ID NO: 1280676 - RNA, 20 nt, Homo sapiens
cugggcagucagaaagccca

SEQ ID NO: 1280677 - RNA, 12 nt, Homo sapiens
cugggccagugc

SEQ ID NO: 1280678 - RNA, 13 nt, Homo sapiens
cugggccaugucc

SEQ ID NO: 1280679 - RNA, 16 nt, Homo sapiens
cugggccauguccaaa

SEQ ID NO: 1280680 - RNA, 20 nt, Homo sapiens
cugggcccucucuucucacc

SEQ ID NO: 1280681 - RNA, 16 nt, Homo sapiens
cugggccgcugccacg

SEQ ID NO: 1280682 - RNA, 18 nt, Homo sapiens
cugggccugcuuuuccag

SEQ ID NO: 1280683 - RNA, 22 nt, Homo sapiens
cugggcuaaguaaauaggaauu

SEQ ID NO: 1280684 - RNA, 13 nt, Homo sapiens
cugggcuagggga

SEQ ID NO: 1280685 - RNA, 16 nt, Homo sapiens
cugggcugucugucac

SEQ ID NO: 1280686 - RNA, 17 nt, Homo sapiens
cuggggaacuagaggga

SEQ ID NO: 1280687 - RNA, 15 nt, Homo sapiens
cuggggacuuccuca

SEQ ID NO: 1280688 - RNA, 15 nt, Homo sapiens
cuggggagcucagga

SEQ ID NO: 1280689 - RNA, 19 nt, Homo sapiens
cuggggaggcccuagggga

SEQ ID NO: 1280690 - RNA, 16 nt, Homo sapiens
cuggggaggugaacug

SEQ ID NO: 1280691 - RNA, 15 nt, Homo sapiens
cuggggcaaugggag

SEQ ID NO: 1280692 - RNA, 15 nt, Homo sapiens
cuggggcaggucacu

SEQ ID NO: 1280693 - RNA, 15 nt, Homo sapiens
cuggggccacccagc

SEQ ID NO: 1280694 - RNA, 13 nt, Homo sapiens
cugggggccaagg

SEQ ID NO: 1280695 - RNA, 20 nt, Homo sapiens
cuggggugcugagugagcug

SEQ ID NO: 1280696 - RNA, 18 nt, Homo sapiens
cuggggugcugccugaau

SEQ ID NO: 1280697 - RNA, 12 nt, Homo sapiens
cuuccauuccau

SEQ ID NO: 1280698 - RNA, 12 nt, Homo sapiens
cuuccauuugcu

SEQ ID NO: 1280699 - RNA, 21 nt, Homo sapiens
cuucccaaggccuuaagcuuu

SEQ ID NO: 1280700 - RNA, 13 nt, Homo sapiens
cuucccacagugg

SEQ ID NO: 1280701 - RNA, 17 nt, Homo sapiens
cuucccaguucuugacc

SEQ ID NO: 1280702 - RNA, 13 nt, Homo sapiens
cuucccaugcauu

SEQ ID NO: 1280703 - RNA, 23 nt, Homo sapiens
cuucccauuguggcuccuaucug

SEQ ID NO: 1280704 - RNA, 15 nt, Homo sapiens
cuucccauuucucua

SEQ ID NO: 1280705 - RNA, 18 nt, Homo sapiens
cuucccauuucucuacac

SEQ ID NO: 1280706 - RNA, 17 nt, Homo sapiens
cuuccccaaacccagaa

SEQ ID NO: 1280707 - RNA, 17 nt, Homo sapiens
cuuccccaacuucccua

SEQ ID NO: 1280708 - RNA, 20 nt, Homo sapiens
cuuccccaggcccaccauca

SEQ ID NO: 1280709 - RNA, 16 nt, Homo sapiens
cuuccccaucuucuaa

SEQ ID NO: 1280710 - RNA, 20 nt, Homo sapiens
cuucccggcgucccuaccuc

SEQ ID NO: 1280711 - RNA, 17 nt, Homo sapiens
cuucccuaaucuuccac

SEQ ID NO: 1280712 - RNA, 13 nt, Homo sapiens
cuucccuaccuca

SEQ ID NO: 1280713 - RNA, 22 nt, Homo sapiens
cuucccucucugcagacuuccc

SEQ ID NO: 1280714 - RNA, 15 nt, Homo sapiens
cuucccugacucuuc

SEQ ID NO: 1280715 - RNA, 12 nt, Homo sapiens
cuucccuuccac

SEQ ID NO: 1280716 - RNA, 19 nt, Homo sapiens
cuucccuuuauuacaagaa

SEQ ID NO: 1280717 - RNA, 22 nt, Homo sapiens
cuuccgcugaggggucucggau

SEQ ID NO: 1280718 - RNA, 23 nt, Homo sapiens
cuuccgcuuugaaagaagcaaga

SEQ ID NO: 1280719 - RNA, 20 nt, Homo sapiens
cuuccguggucagagugcca

SEQ ID NO: 1280720 - RNA, 16 nt, Homo sapiens
cuuccuaaacuuucaa

SEQ ID NO: 1280721 - RNA, 23 nt, Homo sapiens
cuuccuacacguuagauuugccg

SEQ ID NO: 1280722 - RNA, 16 nt, Homo sapiens
cuuccuagauaugaua

SEQ ID NO: 1280723 - RNA, 18 nt, Homo sapiens
cuuccuagauaugauaaa

SEQ ID NO: 1280724 - RNA, 12 nt, Homo sapiens
cuuccuagguca

SEQ ID NO: 1280725 - RNA, 13 nt, Homo sapiens
cuuccuccagcug

SEQ ID NO: 1280726 - RNA, 20 nt, Homo sapiens
cuuccuccugauggccaaga

SEQ ID NO: 1280727 - RNA, 22 nt, Homo sapiens
cuuccucucaagcuagccagag

SEQ ID NO: 1280728 - RNA, 19 nt, Homo sapiens
cuuccugaguggugccaaa

SEQ ID NO: 1280729 - RNA, 12 nt, Homo sapiens
cuuccugcagua

SEQ ID NO: 1280730 - RNA, 17 nt, Homo sapiens
cuuccuuaccugaaagg

SEQ ID NO: 1280731 - RNA, 12 nt, Homo sapiens
cuuccuucaggg

SEQ ID NO: 1280732 - RNA, 14 nt, Homo sapiens
cuuccuugauaaua

SEQ ID NO: 1280733 - RNA, 20 nt, Homo sapiens
cuuccuugggaugaucuuga

SEQ ID NO: 1280734 - RNA, 15 nt, Homo sapiens
cuuccuuucuugucu

SEQ ID NO: 1280735 - RNA, 19 nt, Homo sapiens
cuuccuuugucguguuucu

SEQ ID NO: 1280736 - RNA, 17 nt, Homo sapiens
cuucgaguggccagcuu

SEQ ID NO: 1280737 - RNA, 17 nt, Homo sapiens
cuucggaguuucuuagu

SEQ ID NO: 1280738 - RNA, 17 nt, Homo sapiens
cuucggcagcuacucag

SEQ ID NO: 1280739 - RNA, 14 nt, Homo sapiens
cuucggcaucuucu

SEQ ID NO: 1280740 - RNA, 19 nt, Homo sapiens
cuucuaaacccaauccaaa

SEQ ID NO: 1280741 - RNA, 16 nt, Homo sapiens
cuucuacaauuguggu

SEQ ID NO: 1280742 - RNA, 18 nt, Homo sapiens
cuucuacgggauggccag

SEQ ID NO: 1280743 - RNA, 22 nt, Homo sapiens
cuucuaggauagcuaacuguaa

SEQ ID NO: 1280744 - RNA, 18 nt, Homo sapiens
cuucuaggucacuucuca

SEQ ID NO: 1280745 - RNA, 19 nt, Homo sapiens
cuucuauaauuuugccuuu

SEQ ID NO: 1280746 - RNA, 20 nt, Homo sapiens
cuucuauucagcauuguacu

SEQ ID NO: 1280747 - RNA, 18 nt, Homo sapiens
cuucuauuccauggcuaa

SEQ ID NO: 1280748 - RNA, 22 nt, Homo sapiens
cuucuauuccauggcuaacugg

SEQ ID NO: 1280749 - RNA, 23 nt, Homo sapiens
cuucuauuuuuaucaugaauucc

SEQ ID NO: 1280750 - RNA, 19 nt, Homo sapiens
cuucucaaauuagcugcaa

SEQ ID NO: 1280751 - RNA, 17 nt, Homo sapiens
cuucucaaguucuaaga

SEQ ID NO: 1280752 - RNA, 20 nt, Homo sapiens
cuucucagcucuuccaugau

SEQ ID NO: 1280753 - RNA, 14 nt, Homo sapiens
cuucucauagcauu

SEQ ID NO: 1280754 - RNA, 16 nt, Homo sapiens
cuucuccaaaugagau

SEQ ID NO: 1280755 - RNA, 15 nt, Homo sapiens
cuucuccaccaaaga

SEQ ID NO: 1280756 - RNA, 14 nt, Homo sapiens
cuucuccaugagac

SEQ ID NO: 1280757 - RNA, 17 nt, Homo sapiens
cuucuccgccagccucc

SEQ ID NO: 1280758 - RNA, 14 nt, Homo sapiens
cuucuccucccagc

SEQ ID NO: 1280759 - RNA, 15 nt, Homo sapiens
cuucuccucccagcg

SEQ ID NO: 1280760 - RNA, 12 nt, Homo sapiens
cuucuccugacc

SEQ ID NO: 1280761 - RNA, 16 nt, Homo sapiens
cuucucggcucaggcu

SEQ ID NO: 1280762 - RNA, 22 nt, Homo sapiens
cuucucuauaucaugcuuuaaa

SEQ ID NO: 1280763 - RNA, 19 nt, Homo sapiens
cuucucuauuucuggauga

SEQ ID NO: 1280764 - RNA, 10 nt, Homo sapiens
cuucucucac

SEQ ID NO: 1280765 - RNA, 14 nt, Homo sapiens
cuucucuccagcug

SEQ ID NO: 1280766 - RNA, 20 nt, Homo sapiens
cuucucugcaaugcuucugu

SEQ ID NO: 1280767 - RNA, 13 nt, Homo sapiens
cuucucugcucca

SEQ ID NO: 1280768 - RNA, 16 nt, Homo sapiens
cuucucuugagucaca

SEQ ID NO: 1280769 - RNA, 22 nt, Homo sapiens
cuucugaaacuggaguaucauu

SEQ ID NO: 1280770 - RNA, 19 nt, Homo sapiens
cuucugacuacuuguugua

SEQ ID NO: 1280771 - RNA, 16 nt, Homo sapiens
cuucugcaacugaaau

SEQ ID NO: 1280772 - RNA, 16 nt, Homo sapiens
cuucugcaccaacuca

SEQ ID NO: 1280773 - RNA, 17 nt, Homo sapiens
cuucugcaccaacucac

SEQ ID NO: 1280774 - RNA, 15 nt, Homo sapiens
cuucugccuguuaua

SEQ ID NO: 1280775 - RNA, 21 nt, Homo sapiens
cuucugguuguauuucuauau

SEQ ID NO: 1280776 - RNA, 16 nt, Homo sapiens
cuucuguucugcagac

SEQ ID NO: 1280777 - RNA, 21 nt, Homo sapiens
cuucuuagcacuguugagagg

SEQ ID NO: 1280778 - RNA, 15 nt, Homo sapiens
cuucuucaauacuga

SEQ ID NO: 1280779 - RNA, 14 nt, Homo sapiens
cuucuucagaagac

SEQ ID NO: 1280780 - RNA, 16 nt, Homo sapiens
cuucuugcuucaguca

SEQ ID NO: 1280781 - RNA, 16 nt, Homo sapiens
cuucuuuaccaaggau

SEQ ID NO: 1280782 - RNA, 22 nt, Homo sapiens
cuucuuugacaccacaccauca

SEQ ID NO: 1280783 - RNA, 17 nt, Homo sapiens
cuucuuuuggcuuccau

SEQ ID NO: 1280784 - RNA, 18 nt, Homo sapiens
cuugaaaaaaaacagugg

SEQ ID NO: 1280785 - RNA, 15 nt, Homo sapiens
cuugaaaguagcaau

SEQ ID NO: 1280786 - RNA, 14 nt, Homo sapiens
cuugaaaguuuucc

SEQ ID NO: 1280787 - RNA, 18 nt, Homo sapiens
cuugaaaguuuuccagua

SEQ ID NO: 1280788 - RNA, 12 nt, Homo sapiens
cuugaaaucuga

SEQ ID NO: 1280789 - RNA, 14 nt, Homo sapiens
cuugaaaugcauua

SEQ ID NO: 1280790 - RNA, 20 nt, Homo sapiens
cuugaacacaguauuuuccc

SEQ ID NO: 1280791 - RNA, 21 nt, Homo sapiens
cuugaacacaguauuuuccca

SEQ ID NO: 1280792 - RNA, 14 nt, Homo sapiens
cuugaagacuuccc

SEQ ID NO: 1280793 - RNA, 11 nt, Homo sapiens
cuugaagccaa

SEQ ID NO: 1280794 - RNA, 15 nt, Homo sapiens
cuugaauacaaguuu

SEQ ID NO: 1280795 - RNA, 12 nt, Homo sapiens
cuugacaugugc

SEQ ID NO: 1280796 - RNA, 12 nt, Homo sapiens
cuugacauuuau

SEQ ID NO: 1280797 - RNA, 15 nt, Homo sapiens
cuugaccuguuucuc

SEQ ID NO: 1280798 - RNA, 20 nt, Homo sapiens
cuugacugccgcaucauggg

SEQ ID NO: 1280799 - RNA, 21 nt, Homo sapiens
cuugagaggaugaauguaugu

SEQ ID NO: 1280800 - RNA, 21 nt, Homo sapiens
cuugagcaaccuggcuaagau

SEQ ID NO: 1280801 - RNA, 20 nt, Homo sapiens
cuugagggugcuuguucccu

SEQ ID NO: 1280802 - RNA, 12 nt, Homo sapiens
cuugagucagaa

SEQ ID NO: 1280803 - RNA, 23 nt, Homo sapiens
cuugagucagaaaacagagaaag

SEQ ID NO: 1280804 - RNA, 14 nt, Homo sapiens
cuugaguguguuac

SEQ ID NO: 1280805 - RNA, 19 nt, Homo sapiens
cuugaguuuuuaguggaag

SEQ ID NO: 1280806 - RNA, 19 nt, Homo sapiens
cuugauagcaaacacuggg

SEQ ID NO: 1280807 - RNA, 13 nt, Homo sapiens
cuugauauuuucc

SEQ ID NO: 1280808 - RNA, 16 nt, Homo sapiens
cuugaugccauaugcc

SEQ ID NO: 1280809 - RNA, 20 nt, Homo sapiens
cuugaugccauaugccuugg

SEQ ID NO: 1280810 - RNA, 18 nt, Homo sapiens
cuugaugcuagaaaggaa

SEQ ID NO: 1280811 - RNA, 18 nt, Homo sapiens
cuugauggaaauugacca

SEQ ID NO: 1280812 - RNA, 23 nt, Homo sapiens
cuugauuaagauuuuacaaaaga

SEQ ID NO: 1280813 - RNA, 17 nt, Homo sapiens
cuugauucugcaguaaa

SEQ ID NO: 1280814 - RNA, 21 nt, Homo sapiens
cuugauugugggauacuauuu

SEQ ID NO: 1280815 - RNA, 16 nt, Homo sapiens
cuugcaauguagucaa

SEQ ID NO: 1280816 - RNA, 15 nt, Homo sapiens
cuugcaccguccuca

SEQ ID NO: 1280817 - RNA, 15 nt, Homo sapiens
cuugcagaacugcca

SEQ ID NO: 1280818 - RNA, 21 nt, Homo sapiens
cuugcagugagccgagauugc

SEQ ID NO: 1280819 - RNA, 18 nt, Homo sapiens
cuugcaguuaaggguuag

SEQ ID NO: 1280820 - RNA, 10 nt, Homo sapiens
cuugcauaau

SEQ ID NO: 1280821 - RNA, 17 nt, Homo sapiens
cuugcauaggcucuuaa

SEQ ID NO: 1280822 - RNA, 19 nt, Homo sapiens
cuugcaugaauuacuguau

SEQ ID NO: 1280823 - RNA, 13 nt, Homo sapiens
cuugccacagugu

SEQ ID NO: 1280824 - RNA, 16 nt, Homo sapiens
gcuggaagucuaccug

SEQ ID NO: 1280825 - RNA, 19 nt, Homo sapiens
gcuggaauucuaacaaguc

SEQ ID NO: 1280826 - RNA, 15 nt, Homo sapiens
gcuggacaugcugac

SEQ ID NO: 1280827 - RNA, 15 nt, Homo sapiens
gcuggacgugcgcga

SEQ ID NO: 1280828 - RNA, 21 nt, Homo sapiens
gcuggacuacccacguucuca

SEQ ID NO: 1280829 - RNA, 14 nt, Homo sapiens
gcuggagacgggug

SEQ ID NO: 1280830 - RNA, 23 nt, Homo sapiens
gcuggagagguuaaggugcaaua

SEQ ID NO: 1280831 - RNA, 21 nt, Homo sapiens
gcuggagcgaagccuucugca

SEQ ID NO: 1280832 - RNA, 14 nt, Homo sapiens
gcuggagugcagug

SEQ ID NO: 1280833 - RNA, 15 nt, Homo sapiens
gcuggagugcaguga

SEQ ID NO: 1280834 - RNA, 20 nt, Homo sapiens
gcuggagugcaguggcacca

SEQ ID NO: 1280835 - RNA, 20 nt, Homo sapiens
gcuggagugcaguggcauga

SEQ ID NO: 1280836 - RNA, 19 nt, Homo sapiens
gcuggagugcaguggugca

SEQ ID NO: 1280837 - RNA, 22 nt, Homo sapiens
gcuggaucacuugaguucagga

SEQ ID NO: 1280838 - RNA, 18 nt, Homo sapiens
gcuggauccggucugccu

SEQ ID NO: 1280839 - RNA, 13 nt, Homo sapiens
gcuggcaccagaa

SEQ ID NO: 1280840 - RNA, 17 nt, Homo sapiens
gcuggcagaaagggaac

SEQ ID NO: 1280841 - RNA, 22 nt, Homo sapiens
gcuggccucacccaccccugca

SEQ ID NO: 1280842 - RNA, 21 nt, Homo sapiens
gcuggccuccuaugccucauc

SEQ ID NO: 1280843 - RNA, 20 nt, Homo sapiens
gcuggcgugcaguggugcga

SEQ ID NO: 1280844 - RNA, 13 nt, Homo sapiens
gcuggcugcagug

SEQ ID NO: 1280845 - RNA, 14 nt, Homo sapiens
gcuggcugcaguga

SEQ ID NO: 1280846 - RNA, 14 nt, Homo sapiens
gcugggacuccugg

SEQ ID NO: 1280847 - RNA, 19 nt, Homo sapiens
gcugggacuucuuacccaa

SEQ ID NO: 1280848 - RNA, 20 nt, Homo sapiens
gcugggacuucuuacccaaa

SEQ ID NO: 1280849 - RNA, 17 nt, Homo sapiens
gcugggagcacuggugu

SEQ ID NO: 1280850 - RNA, 20 nt, Homo sapiens
gcugggaggcaagaggggug

SEQ ID NO: 1280851 - RNA, 19 nt, Homo sapiens
gcugggaguucuagaacca

SEQ ID NO: 1280852 - RNA, 16 nt, Homo sapiens
gcugggaugagaggaa

SEQ ID NO: 1280853 - RNA, 16 nt, Homo sapiens
gcugggccauguccaa

SEQ ID NO: 1280854 - RNA, 19 nt, Homo sapiens
gcugggccauguccaaaga

SEQ ID NO: 1280855 - RNA, 20 nt, Homo sapiens
gcugggcuucccaucuucca

SEQ ID NO: 1280856 - RNA, 21 nt, Homo sapiens
gcuggggcuucaccagucugu

SEQ ID NO: 1280857 - RNA, 20 nt, Homo sapiens
gcugggugaccgacuacccc

SEQ ID NO: 1280858 - RNA, 15 nt, Homo sapiens
gcugguagcucaggu

SEQ ID NO: 1280859 - RNA, 16 nt, Homo sapiens
gcugguagcucaggug

SEQ ID NO: 1280860 - RNA, 22 nt, Homo sapiens
gcuggucccggggccagcacuu

SEQ ID NO: 1280861 - RNA, 20 nt, Homo sapiens
gcuggucucaaacuccugac

SEQ ID NO: 1280862 - RNA, 23 nt, Homo sapiens
gcuggugccccacagcuaccuga

SEQ ID NO: 1280863 - RNA, 14 nt, Homo sapiens
gcugguggcaauaa

SEQ ID NO: 1280864 - RNA, 16 nt, Homo sapiens
gcuguagaccaccuaa

SEQ ID NO: 1280865 - RNA, 17 nt, Homo sapiens
gcuguccugaucuguga

SEQ ID NO: 1280866 - RNA, 18 nt, Homo sapiens
gcuguccugaucugugau

SEQ ID NO: 1280867 - RNA, 23 nt, Homo sapiens
gcugugaccauuuauaauguuag

SEQ ID NO: 1280868 - RNA, 22 nt, Homo sapiens
gcugugagccccugguccugag

SEQ ID NO: 1280869 - RNA, 19 nt, Homo sapiens
gcugugaucacuccagugc

SEQ ID NO: 1280870 - RNA, 16 nt, Homo sapiens
gcugugcaucaguggg

SEQ ID NO: 1280871 - RNA, 11 nt, Homo sapiens
gcugugcugcu

SEQ ID NO: 1280872 - RNA, 14 nt, Homo sapiens
gcuguggaugcuuc

SEQ ID NO: 1280873 - RNA, 23 nt, Homo sapiens
gcugugggaaguccucccuggug

SEQ ID NO: 1280874 - RNA, 17 nt, Homo sapiens
gcuguguguccuugcau

SEQ ID NO: 1280875 - RNA, 18 nt, Homo sapiens
gcuguguuuccaucucaa

SEQ ID NO: 1280876 - RNA, 13 nt, Homo sapiens
gcuguguuugcag

SEQ ID NO: 1280877 - RNA, 14 nt, Homo sapiens
gcuguuccugagaa

SEQ ID NO: 1280878 - RNA, 15 nt, Homo sapiens
gcuguuccugagaaa

SEQ ID NO: 1280879 - RNA, 22 nt, Homo sapiens
gcuguugcgcucccaccucagc

SEQ ID NO: 1280880 - RNA, 20 nt, Homo sapiens
gcuguuguguuguuguuauu

SEQ ID NO: 1280881 - RNA, 20 nt, Homo sapiens
gcuguuuccauagggugaca

SEQ ID NO: 1280882 - RNA, 14 nt, Homo sapiens
gcuguuuguuucau

SEQ ID NO: 1280883 - RNA, 18 nt, Homo sapiens
gcuuaaaacaacacucac

SEQ ID NO: 1280884 - RNA, 18 nt, Homo sapiens
gcuuaaauaggaaaguuu

SEQ ID NO: 1280885 - RNA, 20 nt, Homo sapiens
gcuuaacacuaucauggacu

SEQ ID NO: 1280886 - RNA, 20 nt, Homo sapiens
gcuuaaccuuuccaguuuau

SEQ ID NO: 1280887 - RNA, 14 nt, Homo sapiens
gcuuaaugggagcu

SEQ ID NO: 1280888 - RNA, 14 nt, Homo sapiens
gcuuaauguuuauu

SEQ ID NO: 1280889 - RNA, 21 nt, Homo sapiens
gcuuaccagaagcuuccauag

SEQ ID NO: 1280890 - RNA, 15 nt, Homo sapiens
gcuuaccugaucuca

SEQ ID NO: 1280891 - RNA, 14 nt, Homo sapiens
gcuuagauuucaua

SEQ ID NO: 1280892 - RNA, 12 nt, Homo sapiens
gcuuagcauucc

SEQ ID NO: 1280893 - RNA, 23 nt, Homo sapiens
gcuuagggggagcccuggugcua

SEQ ID NO: 1280894 - RNA, 22 nt, Homo sapiens
gcuuaguccaauuccuugcaca

SEQ ID NO: 1280895 - RNA, 17 nt, Homo sapiens
gcuuauaaacacauuga

SEQ ID NO: 1280896 - RNA, 12 nt, Homo sapiens
gcuuaugugaca

SEQ ID NO: 1280897 - RNA, 15 nt, Homo sapiens
gcuuauuacauuuaa

SEQ ID NO: 1280898 - RNA, 17 nt, Homo sapiens
gcuucaagugccuuuug

SEQ ID NO: 1280899 - RNA, 14 nt, Homo sapiens
gcuucacuguauaa

SEQ ID NO: 1280900 - RNA, 17 nt, Homo sapiens
gcuucaguacuugugaa

SEQ ID NO: 1280901 - RNA, 12 nt, Homo sapiens
gcuucaguccac

SEQ ID NO: 1280902 - RNA, 15 nt, Homo sapiens
gcuucaguggcagcu

SEQ ID NO: 1280903 - RNA, 15 nt, Homo sapiens
gcuucaguugcauau

SEQ ID NO: 1280904 - RNA, 20 nt, Homo sapiens
gcuucauaaaugaagcagcu

SEQ ID NO: 1280905 - RNA, 12 nt, Homo sapiens
gcuuccaucagu

SEQ ID NO: 1280906 - RNA, 23 nt, Homo sapiens
gcuuccaucccaaccagugccaa

SEQ ID NO: 1280907 - RNA, 14 nt, Homo sapiens
gcuucccagaggga

SEQ ID NO: 1280908 - RNA, 21 nt, Homo sapiens
gcuucccagcaccaacaugua

SEQ ID NO: 1280909 - RNA, 23 nt, Homo sapiens
gcuucccggcgucccuaccuccu

SEQ ID NO: 1280910 - RNA, 15 nt, Homo sapiens
gcuucccuaaucuau

SEQ ID NO: 1280911 - RNA, 19 nt, Homo sapiens
gcuucccucuucugugguc

SEQ ID NO: 1280912 - RNA, 18 nt, Homo sapiens
gcuuccucuagaagccaa

SEQ ID NO: 1280913 - RNA, 23 nt, Homo sapiens
gcuuccugaaauaaacacuggug

SEQ ID NO: 1280914 - RNA, 20 nt, Homo sapiens
gcuuccuuagaacuucuaca

SEQ ID NO: 1280915 - RNA, 23 nt, Homo sapiens
gcuucuaaauggugcugcagauu

SEQ ID NO: 1280916 - RNA, 17 nt, Homo sapiens
gcuucuacagacuguag

SEQ ID NO: 1280917 - RNA, 18 nt, Homo sapiens
gcuucuauaauuuugccu

SEQ ID NO: 1280918 - RNA, 22 nt, Homo sapiens
gcuucuccuguuuuauauauua

SEQ ID NO: 1280919 - RNA, 22 nt, Homo sapiens
gcuucuccuucuccuucccauu

SEQ ID NO: 1280920 - RNA, 20 nt, Homo sapiens
gcuucugaaugcugcuacuu

SEQ ID NO: 1280921 - RNA, 19 nt, Homo sapiens
gcuucuguaguacuccuua

SEQ ID NO: 1280922 - RNA, 12 nt, Homo sapiens
gcuucugugaug

SEQ ID NO: 1280923 - RNA, 16 nt, Homo sapiens
gcuucuuauauugcaa

SEQ ID NO: 1280924 - RNA, 15 nt, Homo sapiens
gcuucuucacaggca

SEQ ID NO: 1280925 - RNA, 17 nt, Homo sapiens
gcuucuucacaggcacu

SEQ ID NO: 1280926 - RNA, 14 nt, Homo sapiens
gcuucuugccucug

SEQ ID NO: 1280927 - RNA, 20 nt, Homo sapiens
gcuucuugccucugugcugu

SEQ ID NO: 1280928 - RNA, 19 nt, Homo sapiens
gcuugaaaaggugaccuug

SEQ ID NO: 1280929 - RNA, 21 nt, Homo sapiens
gcuugagcaaccuggcuaaga

SEQ ID NO: 1280930 - RNA, 20 nt, Homo sapiens
gcuugaucaauucccuugaa

SEQ ID NO: 1280931 - RNA, 19 nt, Homo sapiens
gcuuggcccuuuccuucca

SEQ ID NO: 1280932 - RNA, 21 nt, Homo sapiens
gcuugggaaaaaaacuuggca

SEQ ID NO: 1280933 - RNA, 14 nt, Homo sapiens
gcuugggccugagu

SEQ ID NO: 1280934 - RNA, 19 nt, Homo sapiens
gcuuggggccaccaaagcu

SEQ ID NO: 1280935 - RNA, 20 nt, Homo sapiens
gcuuguaaauagcucaggug

SEQ ID NO: 1280936 - RNA, 13 nt, Homo sapiens
gcuugucaggggg

SEQ ID NO: 1280937 - RNA, 20 nt, Homo sapiens
gcuugucuuaaaauaaugaa

SEQ ID NO: 1280938 - RNA, 14 nt, Homo sapiens
gcuuguguguuuca

SEQ ID NO: 1280939 - RNA, 20 nt, Homo sapiens
gcuuguuuacagcacuacuc

SEQ ID NO: 1280940 - RNA, 20 nt, Homo sapiens
gcuuuaaacacccuucacau

SEQ ID NO: 1280941 - RNA, 13 nt, Homo sapiens
gcuuuacugccuu

SEQ ID NO: 1280942 - RNA, 13 nt, Homo sapiens
gcuuuagggcaau

SEQ ID NO: 1280943 - RNA, 12 nt, Homo sapiens
gcuuuagucacu

SEQ ID NO: 1280944 - RNA, 15 nt, Homo sapiens
gcuuuagucacuaau

SEQ ID NO: 1280945 - RNA, 19 nt, Homo sapiens
gcuuuauacguguagcuau

SEQ ID NO: 1280946 - RNA, 21 nt, Homo sapiens
gcuuuauuuuuuaaguauuua

SEQ ID NO: 1280947 - RNA, 14 nt, Homo sapiens
gcuuucaacacaca

SEQ ID NO: 1280948 - RNA, 19 nt, Homo sapiens
gcuuuccaauguagcucag

SEQ ID NO: 1280949 - RNA, 20 nt, Homo sapiens
ggacuaugcugaugggccag

SEQ ID NO: 1280950 - RNA, 13 nt, Homo sapiens
ggacuccaucucu

SEQ ID NO: 1280951 - RNA, 12 nt, Homo sapiens
ggacuccaugcu

SEQ ID NO: 1280952 - RNA, 14 nt, Homo sapiens
ggacuccuggugcc

SEQ ID NO: 1280953 - RNA, 13 nt, Homo sapiens
ggacucugcacau

SEQ ID NO: 1280954 - RNA, 14 nt, Homo sapiens
ggacugauaaucuc

SEQ ID NO: 1280955 - RNA, 23 nt, Homo sapiens
ggacugccucugccacacucuga

SEQ ID NO: 1280956 - RNA, 16 nt, Homo sapiens
ggacuguccaccuuuu

SEQ ID NO: 1280957 - RNA, 19 nt, Homo sapiens
ggacuuccacauuuuugca

SEQ ID NO: 1280958 - RNA, 20 nt, Homo sapiens
ggacuuccagugcucagagg

SEQ ID NO: 1280959 - RNA, 18 nt, Homo sapiens
ggacuucuggcagggaag

SEQ ID NO: 1280960 - RNA, 11 nt, Homo sapiens
ggacuugccuc

SEQ ID NO: 1280961 - RNA, 16 nt, Homo sapiens
ggagaaaauucaauug

SEQ ID NO: 1280962 - RNA, 13 nt, Homo sapiens
ggagaaacccuuc

SEQ ID NO: 1280963 - RNA, 23 nt, Homo sapiens
ggagaaccucaggcuuccuuggc

SEQ ID NO: 1280964 - RNA, 14 nt, Homo sapiens
ggagaacuagagaa

SEQ ID NO: 1280965 - RNA, 14 nt, Homo sapiens
ggagaacuauccaa

SEQ ID NO: 1280966 - RNA, 21 nt, Homo sapiens
ggagaagagaugcugccauuu

SEQ ID NO: 1280967 - RNA, 19 nt, Homo sapiens
ggagacacuggccccucaa

SEQ ID NO: 1280968 - RNA, 20 nt, Homo sapiens
ggagacccaccccaccugca

SEQ ID NO: 1280969 - RNA, 19 nt, Homo sapiens
ggagacccguagaugccag

SEQ ID NO: 1280970 - RNA, 15 nt, Homo sapiens
ggagaccuggcacug

SEQ ID NO: 1280971 - RNA, 18 nt, Homo sapiens
ggagacguggaaccucug

SEQ ID NO: 1280972 - RNA, 20 nt, Homo sapiens
ggagacuccuggucugugaa

SEQ ID NO: 1280973 - RNA, 16 nt, Homo sapiens
ggagacuuuacaugga

SEQ ID NO: 1280974 - RNA, 13 nt, Homo sapiens
ggagagcccuuca

SEQ ID NO: 1280975 - RNA, 19 nt, Homo sapiens
ggagaguagcaacaaaagg

SEQ ID NO: 1280976 - RNA, 13 nt, Homo sapiens
ggagauacugaac

SEQ ID NO: 1280977 - RNA, 14 nt, Homo sapiens
ggagcaaaccagcu

SEQ ID NO: 1280978 - RNA, 23 nt, Homo sapiens
ggagcagcuucugggaccauaag

SEQ ID NO: 1280979 - RNA, 21 nt, Homo sapiens
ggagcaggaccuacuaggaga

SEQ ID NO: 1280980 - RNA, 19 nt, Homo sapiens
ggagcauguuuuguauaca

SEQ ID NO: 1280981 - RNA, 20 nt, Homo sapiens
ggagcauguuuuguauacaa

SEQ ID NO: 1280982 - RNA, 13 nt, Homo sapiens
ggagccaccagca

SEQ ID NO: 1280983 - RNA, 12 nt, Homo sapiens
ggagccagugaa

SEQ ID NO: 1280984 - RNA, 22 nt, Homo sapiens
ggagccccaggggacaagggau

SEQ ID NO: 1280985 - RNA, 19 nt, Homo sapiens
ggagcccccaccacaaacu

SEQ ID NO: 1280986 - RNA, 18 nt, Homo sapiens
ggagccccgccacagccu

SEQ ID NO: 1280987 - RNA, 15 nt, Homo sapiens
ggagcccgugcagua

SEQ ID NO: 1280988 - RNA, 19 nt, Homo sapiens
ggagccuaggaccacucag

SEQ ID NO: 1280989 - RNA, 21 nt, Homo sapiens
ggagccuggcuccguccagga

SEQ ID NO: 1280990 - RNA, 17 nt, Homo sapiens
ggagcucaggucccagg

SEQ ID NO: 1280991 - RNA, 21 nt, Homo sapiens
ggagcugaugaaacucacaaa

SEQ ID NO: 1280992 - RNA, 13 nt, Homo sapiens
ggagcuugcagug

SEQ ID NO: 1280993 - RNA, 14 nt, Homo sapiens
ggagcuugcaguga

SEQ ID NO: 1280994 - RNA, 11 nt, Homo sapiens
ggaggacaaaa

SEQ ID NO: 1280995 - RNA, 15 nt, Homo sapiens
ggaggacgcucucug

SEQ ID NO: 1280996 - RNA, 16 nt, Homo sapiens
ggaggagggaggcgcu

SEQ ID NO: 1280997 - RNA, 23 nt, Homo sapiens
ggaggaugacuaacaagauuugu

SEQ ID NO: 1280998 - RNA, 17 nt, Homo sapiens
ggaggcaacugccucac

SEQ ID NO: 1280999 - RNA, 23 nt, Homo sapiens
ggaggcaccagcucuguggccug

SEQ ID NO: 1281000 - RNA, 20 nt, Homo sapiens
ggaggccagugccagcaccu

SEQ ID NO: 1281001 - RNA, 19 nt, Homo sapiens
ggaggcccugcacugccag

SEQ ID NO: 1281002 - RNA, 17 nt, Homo sapiens
ggaggcugcgugccagu

SEQ ID NO: 1281003 - RNA, 14 nt, Homo sapiens
ggaggcugggcaca

SEQ ID NO: 1281004 - RNA, 16 nt, Homo sapiens
ggaggcugugugccug

SEQ ID NO: 1281005 - RNA, 16 nt, Homo sapiens
ggagggaagcacugcc

SEQ ID NO: 1281006 - RNA, 14 nt, Homo sapiens
ggagggagcucuga

SEQ ID NO: 1281007 - RNA, 15 nt, Homo sapiens
ggagggcgguggaca

SEQ ID NO: 1281008 - RNA, 16 nt, Homo sapiens
ggagggcgguggacaa

SEQ ID NO: 1281009 - RNA, 15 nt, Homo sapiens
ggaggguguggugcu

SEQ ID NO: 1281010 - RNA, 17 nt, Homo sapiens
ggagguaguuaagggau

SEQ ID NO: 1281011 - RNA, 14 nt, Homo sapiens
ggagguauuugaaa

SEQ ID NO: 1281012 - RNA, 14 nt, Homo sapiens
ggaggucucuguaa

SEQ ID NO: 1281013 - RNA, 19 nt, Homo sapiens
ggagguggagauugcagug

SEQ ID NO: 1281014 - RNA, 19 nt, Homo sapiens
ggagguugagaaugcagug

SEQ ID NO: 1281015 - RNA, 17 nt, Homo sapiens
ggaguaaaacuguauaa

SEQ ID NO: 1281016 - RNA, 17 nt, Homo sapiens
ggaguaccauguggcaa

SEQ ID NO: 1281017 - RNA, 13 nt, Homo sapiens
ggaguacugauga

SEQ ID NO: 1281018 - RNA, 14 nt, Homo sapiens
ggaguacugaugaa

SEQ ID NO: 1281019 - RNA, 22 nt, Homo sapiens
ggaguauauuuccgcacuucag

SEQ ID NO: 1281020 - RNA, 19 nt, Homo sapiens
ggagucagaaacuguuucu

SEQ ID NO: 1281021 - RNA, 21 nt, Homo sapiens
ggagucucugccacccacuca

SEQ ID NO: 1281022 - RNA, 21 nt, Homo sapiens
ggagucugccuccaugcugca

SEQ ID NO: 1281023 - RNA, 22 nt, Homo sapiens
ggagugaccaaaggugugcccu

SEQ ID NO: 1281024 - RNA, 19 nt, Homo sapiens
ggagugagacugacugcaa

SEQ ID NO: 1281025 - RNA, 12 nt, Homo sapiens
ggagugcaaugg

SEQ ID NO: 1281026 - RNA, 17 nt, Homo sapiens
ggagugcaguggcacaa

SEQ ID NO: 1281027 - RNA, 16 nt, Homo sapiens
ggagugggcaccucag

SEQ ID NO: 1281028 - RNA, 16 nt, Homo sapiens
ggagugguaacagcuc

SEQ ID NO: 1281029 - RNA, 16 nt, Homo sapiens
ggagugugugacauuc

SEQ ID NO: 1281030 - RNA, 17 nt, Homo sapiens
ggaguuacaucuuuauu

SEQ ID NO: 1281031 - RNA, 18 nt, Homo sapiens
ggaguucaaaacauucau

SEQ ID NO: 1281032 - RNA, 16 nt, Homo sapiens
ggaguucuuacuugac

SEQ ID NO: 1281033 - RNA, 23 nt, Homo sapiens
ggaguuugagaccagccucauca

SEQ ID NO: 1281034 - RNA, 13 nt, Homo sapiens
ggauacuggcaca

SEQ ID NO: 1281035 - RNA, 17 nt, Homo sapiens
ggauacuggugcaguca

SEQ ID NO: 1281036 - RNA, 15 nt, Homo sapiens
ggauacuucauuaaa

SEQ ID NO: 1281037 - RNA, 19 nt, Homo sapiens
ggauauaaaaauaauguca

SEQ ID NO: 1281038 - RNA, 15 nt, Homo sapiens
ggauauacugcagcu

SEQ ID NO: 1281039 - RNA, 17 nt, Homo sapiens
ggauaucaaaagcaaau

SEQ ID NO: 1281040 - RNA, 18 nt, Homo sapiens
ggauaucacuuccaugac

SEQ ID NO: 1281041 - RNA, 21 nt, Homo sapiens
ggauauccuuaucagagcuaa

SEQ ID NO: 1281042 - RNA, 12 nt, Homo sapiens
ggauaugcagua

SEQ ID NO: 1281043 - RNA, 20 nt, Homo sapiens
ggauauuaacaacaauaaca

SEQ ID NO: 1281044 - RNA, 22 nt, Homo sapiens
ggauauuaguuaaugagccauc

SEQ ID NO: 1281045 - RNA, 21 nt, Homo sapiens
ggauauuuaguucaacuguau

SEQ ID NO: 1281046 - RNA, 16 nt, Homo sapiens
ggaucacaagauggaa

SEQ ID NO: 1281047 - RNA, 16 nt, Homo sapiens
ggaucagcccugccag

SEQ ID NO: 1281048 - RNA, 17 nt, Homo sapiens
ggaucaugguguaauaa

SEQ ID NO: 1281049 - RNA, 15 nt, Homo sapiens
ggauccagaacugca

SEQ ID NO: 1281050 - RNA, 12 nt, Homo sapiens
ggauccagcacu

SEQ ID NO: 1281051 - RNA, 17 nt, Homo sapiens
ggaucccguguugccau

SEQ ID NO: 1281052 - RNA, 14 nt, Homo sapiens
ggauccucccucau

SEQ ID NO: 1281053 - RNA, 19 nt, Homo sapiens
ggauccucuccacuccaug

SEQ ID NO: 1281054 - RNA, 23 nt, Homo sapiens
ggauccuggccccucaaccuccu

SEQ ID NO: 1281055 - RNA, 17 nt, Homo sapiens
ggaucuaccagcauaaa

SEQ ID NO: 1281056 - RNA, 22 nt, Homo sapiens
ggaucuugaauguggucucagg

SEQ ID NO: 1281057 - RNA, 13 nt, Homo sapiens
ggaucuugccaca

SEQ ID NO: 1281058 - RNA, 18 nt, Homo sapiens
ggaucuugccacauuucu

SEQ ID NO: 1281059 - RNA, 22 nt, Homo sapiens
ggaugaagaacacagcaugugc

SEQ ID NO: 1281060 - RNA, 11 nt, Homo sapiens
ggaugacauua

SEQ ID NO: 1281061 - RNA, 20 nt, Homo sapiens
ggaugaggcacuucugucaa

SEQ ID NO: 1281062 - RNA, 15 nt, Homo sapiens
ggaugaggggugcug

SEQ ID NO: 1281063 - RNA, 19 nt, Homo sapiens
ggaugaggucaccagggga

SEQ ID NO: 1281064 - RNA, 20 nt, Homo sapiens
ggaugauacgaaugauguca

SEQ ID NO: 1281065 - RNA, 19 nt, Homo sapiens
ggaugaucuugauuguggg

SEQ ID NO: 1281066 - RNA, 16 nt, Homo sapiens
ggaugaugguugcaaa

SEQ ID NO: 1281067 - RNA, 22 nt, Homo sapiens
ggaugcaggguuugagaauguu

SEQ ID NO: 1281068 - RNA, 12 nt, Homo sapiens
ggaugcaugugc

SEQ ID NO: 1281069 - RNA, 21 nt, Homo sapiens
ggaugccaaccggucacccag

SEQ ID NO: 1281070 - RNA, 22 nt, Homo sapiens
ggaugccaaccggucacccagg

SEQ ID NO: 1281071 - RNA, 23 nt, Homo sapiens
ggaugccaaccggucacccagga

SEQ ID NO: 1281072 - RNA, 15 nt, Homo sapiens
ggaugcuggccuuug

SEQ ID NO: 1281073 - RNA, 14 nt, Homo sapiens
ggauggggcuccca

SEQ ID NO: 1281074 - RNA, 15 nt, Homo sapiens
ggauggguguggaug

SEQ ID NO: 1281075 - RNA, 16 nt, Homo sapiens
ggguccucagccucag

SEQ ID NO: 1281076 - RNA, 19 nt, Homo sapiens
gggucucacaguguugccc

SEQ ID NO: 1281077 - RNA, 20 nt, Homo sapiens
gggucucacuauguugccca

SEQ ID NO: 1281078 - RNA, 15 nt, Homo sapiens
gggucuccccaaaca

SEQ ID NO: 1281079 - RNA, 21 nt, Homo sapiens
gggucucgcuuuguugcccag

SEQ ID NO: 1281080 - RNA, 20 nt, Homo sapiens
gggucuuguuucacauuugu

SEQ ID NO: 1281081 - RNA, 18 nt, Homo sapiens
gggugacccugaagugag

SEQ ID NO: 1281082 - RNA, 16 nt, Homo sapiens
gggugacggcccucau

SEQ ID NO: 1281083 - RNA, 17 nt, Homo sapiens
gggugcuggauggacag

SEQ ID NO: 1281084 - RNA, 20 nt, Homo sapiens
ggguggacaucaccuuggag

SEQ ID NO: 1281085 - RNA, 14 nt, Homo sapiens
ggguggcauccucc

SEQ ID NO: 1281086 - RNA, 11 nt, Homo sapiens
gggugggagag

SEQ ID NO: 1281087 - RNA, 16 nt, Homo sapiens
ggguuacaaacugcaa

SEQ ID NO: 1281088 - RNA, 21 nt, Homo sapiens
ggguuaguuuacaaucagcca

SEQ ID NO: 1281089 - RNA, 19 nt, Homo sapiens
ggguuggacuguaagggau

SEQ ID NO: 1281090 - RNA, 17 nt, Homo sapiens
ggguuggugcacaguga

SEQ ID NO: 1281091 - RNA, 22 nt, Homo sapiens
ggguuuaauagacugagucaga

SEQ ID NO: 1281092 - RNA, 12 nt, Homo sapiens
ggguuugagggu

SEQ ID NO: 1281093 - RNA, 14 nt, Homo sapiens
ggguuuugcuacau

SEQ ID NO: 1281094 - RNA, 12 nt, Homo sapiens
ggguuuugcucu

SEQ ID NO: 1281095 - RNA, 17 nt, Homo sapiens
gguaaaacucacuguga

SEQ ID NO: 1281096 - RNA, 18 nt, Homo sapiens
gguaaauaaaauuuaacu

SEQ ID NO: 1281097 - RNA, 23 nt, Homo sapiens
gguaacuuuuuuuuaaagcucau

SEQ ID NO: 1281098 - RNA, 21 nt, Homo sapiens
gguaauauugacuuguauauu

SEQ ID NO: 1281099 - RNA, 11 nt, Homo sapiens
gguaaucagca

SEQ ID NO: 1281100 - RNA, 17 nt, Homo sapiens
gguaauggugucccaaa

SEQ ID NO: 1281101 - RNA, 21 nt, Homo sapiens
gguacuauuuagauauaacac

SEQ ID NO: 1281102 - RNA, 15 nt, Homo sapiens
gguacucaauggagu

SEQ ID NO: 1281103 - RNA, 15 nt, Homo sapiens
gguagaaaaccucac

SEQ ID NO: 1281104 - RNA, 19 nt, Homo sapiens
gguagagaugggguuucac

SEQ ID NO: 1281105 - RNA, 19 nt, Homo sapiens
gguagccuuagggugcuga

SEQ ID NO: 1281106 - RNA, 16 nt, Homo sapiens
gguagcuagaugccac

SEQ ID NO: 1281107 - RNA, 19 nt, Homo sapiens
gguagugaccuaaccacuu

SEQ ID NO: 1281108 - RNA, 15 nt, Homo sapiens
gguaguuguggcuuu

SEQ ID NO: 1281109 - RNA, 23 nt, Homo sapiens
gguaguuuguuuuagaaccagcc

SEQ ID NO: 1281110 - RNA, 13 nt, Homo sapiens
gguauaauguuua

SEQ ID NO: 1281111 - RNA, 18 nt, Homo sapiens
gguaugaucacggcucac

SEQ ID NO: 1281112 - RNA, 23 nt, Homo sapiens
gguaugcuugaaaguagcaauua

SEQ ID NO: 1281113 - RNA, 14 nt, Homo sapiens
gguauguuuuacca

SEQ ID NO: 1281114 - RNA, 16 nt, Homo sapiens
gguauuacacuguauu

SEQ ID NO: 1281115 - RNA, 17 nt, Homo sapiens
gguauuagcaaagcaaa

SEQ ID NO: 1281116 - RNA, 14 nt, Homo sapiens
gguauuauucuguu

SEQ ID NO: 1281117 - RNA, 23 nt, Homo sapiens
gguauuucaaaacacaucuuucc

SEQ ID NO: 1281118 - RNA, 21 nt, Homo sapiens
gguauuuugauagauacugga

SEQ ID NO: 1281119 - RNA, 17 nt, Homo sapiens
ggucaagaguucaagac

SEQ ID NO: 1281120 - RNA, 16 nt, Homo sapiens
ggucaaguaagaagac

SEQ ID NO: 1281121 - RNA, 11 nt, Homo sapiens
ggucacagcua

SEQ ID NO: 1281122 - RNA, 12 nt, Homo sapiens
ggucacaugaug

SEQ ID NO: 1281123 - RNA, 18 nt, Homo sapiens
ggucacccuucaacgcuc

SEQ ID NO: 1281124 - RNA, 22 nt, Homo sapiens
ggucacuuuccuauuacacgga

SEQ ID NO: 1281125 - RNA, 20 nt, Homo sapiens
ggucagcuuuuguuguuuau

SEQ ID NO: 1281126 - RNA, 20 nt, Homo sapiens
ggucagggccagacuggaag

SEQ ID NO: 1281127 - RNA, 21 nt, Homo sapiens
ggucagugguggucuucaaga

SEQ ID NO: 1281128 - RNA, 13 nt, Homo sapiens
ggucauacaugca

SEQ ID NO: 1281129 - RNA, 15 nt, Homo sapiens
ggucauacaugcaua

SEQ ID NO: 1281130 - RNA, 15 nt, Homo sapiens
ggucauccaaacuca

SEQ ID NO: 1281131 - RNA, 16 nt, Homo sapiens
ggucauccugccccug

SEQ ID NO: 1281132 - RNA, 13 nt, Homo sapiens
ggucauugugaau

SEQ ID NO: 1281133 - RNA, 20 nt, Homo sapiens
gguccacucccugcuccacg

SEQ ID NO: 1281134 - RNA, 15 nt, Homo sapiens
gguccaggaaggcag

SEQ ID NO: 1281135 - RNA, 17 nt, Homo sapiens
ggucccaccuccauuug

SEQ ID NO: 1281136 - RNA, 23 nt, Homo sapiens
ggucccaggaugucucccaggac

SEQ ID NO: 1281137 - RNA, 21 nt, Homo sapiens
ggucccauuucucacugagaa

SEQ ID NO: 1281138 - RNA, 15 nt, Homo sapiens
gguccccacagcccg

SEQ ID NO: 1281139 - RNA, 20 nt, Homo sapiens
ggucccggggccagcacuuc

SEQ ID NO: 1281140 - RNA, 21 nt, Homo sapiens
ggucccuccucucaccucucc

SEQ ID NO: 1281141 - RNA, 22 nt, Homo sapiens
gguccgagcugaggacucugca

SEQ ID NO: 1281142 - RNA, 13 nt, Homo sapiens
gguccugauccca

SEQ ID NO: 1281143 - RNA, 20 nt, Homo sapiens
gguccuucccucucaugacu

SEQ ID NO: 1281144 - RNA, 18 nt, Homo sapiens
ggucgcagcuacauaaga

SEQ ID NO: 1281145 - RNA, 15 nt, Homo sapiens
ggucuaggacacagu

SEQ ID NO: 1281146 - RNA, 17 nt, Homo sapiens
ggucucccgauucccaa

SEQ ID NO: 1281147 - RNA, 14 nt, Homo sapiens
ggucucuuccuucg

SEQ ID NO: 1281148 - RNA, 16 nt, Homo sapiens
ggucugauuucaggau

SEQ ID NO: 1281149 - RNA, 18 nt, Homo sapiens
ggucugcaagucagagga

SEQ ID NO: 1281150 - RNA, 16 nt, Homo sapiens
ggucugcucuuucucu

SEQ ID NO: 1281151 - RNA, 23 nt, Homo sapiens
ggucugcucuuucucugccagug

SEQ ID NO: 1281152 - RNA, 21 nt, Homo sapiens
ggucugggacuuccuugcucu

SEQ ID NO: 1281153 - RNA, 13 nt, Homo sapiens
ggucugggccagu

SEQ ID NO: 1281154 - RNA, 18 nt, Homo sapiens
ggucugguuguugcacca

SEQ ID NO: 1281155 - RNA, 15 nt, Homo sapiens
ggucuguagggauuu

SEQ ID NO: 1281156 - RNA, 23 nt, Homo sapiens
ggucugugagaugcuagaacucc

SEQ ID NO: 1281157 - RNA, 12 nt, Homo sapiens
ggucugugucac

SEQ ID NO: 1281158 - RNA, 12 nt, Homo sapiens
ggucuucaagac

SEQ ID NO: 1281159 - RNA, 20 nt, Homo sapiens
ggucuucaagacgacagcuc

SEQ ID NO: 1281160 - RNA, 15 nt, Homo sapiens
ggucuucccuaccuc

SEQ ID NO: 1281161 - RNA, 19 nt, Homo sapiens
ggucuucuaccucagacac

SEQ ID NO: 1281162 - RNA, 20 nt, Homo sapiens
ggugaaaaaagccagccaga

SEQ ID NO: 1281163 - RNA, 19 nt, Homo sapiens
ggugaagggagagccagcu

SEQ ID NO: 1281164 - RNA, 22 nt, Homo sapiens
ggugacagaaggaccagcccuu

SEQ ID NO: 1281165 - RNA, 14 nt, Homo sapiens
ggugacagagcaag

SEQ ID NO: 1281166 - RNA, 19 nt, Homo sapiens
ggugaccacccaccaccug

SEQ ID NO: 1281167 - RNA, 16 nt, Homo sapiens
ggugaccucacuuuag

SEQ ID NO: 1281168 - RNA, 16 nt, Homo sapiens
ggugacgguugggagc

SEQ ID NO: 1281169 - RNA, 19 nt, Homo sapiens
ggugagcagggucagugga

SEQ ID NO: 1281170 - RNA, 19 nt, Homo sapiens
ggugaucaauuaaauguag

SEQ ID NO: 1281171 - RNA, 19 nt, Homo sapiens
ggugaucuaccugccucag

SEQ ID NO: 1281172 - RNA, 17 nt, Homo sapiens
ggugauucgcccaccuc

SEQ ID NO: 1281173 - RNA, 15 nt, Homo sapiens
ggugcagggacccga

SEQ ID NO: 1281174 - RNA, 16 nt, Homo sapiens
ggugcaugaugcugcc

SEQ ID NO: 1281175 - RNA, 22 nt, Homo sapiens
ggugcuauccugcccaggccag

SEQ ID NO: 1281176 - RNA, 20 nt, Homo sapiens
ggugcuaucgcaccacugug

SEQ ID NO: 1281177 - RNA, 12 nt, Homo sapiens
ggugcugagcuu

SEQ ID NO: 1281178 - RNA, 16 nt, Homo sapiens
gguggacuuccagcuu

SEQ ID NO: 1281179 - RNA, 19 nt, Homo sapiens
gguggacuuugggaccugc

SEQ ID NO: 1281180 - RNA, 22 nt, Homo sapiens
gguggauauuaaaaaucuguaa

SEQ ID NO: 1281181 - RNA, 19 nt, Homo sapiens
gguggcacucaacucugag

SEQ ID NO: 1281182 - RNA, 13 nt, Homo sapiens
gguggcacuuuuu

SEQ ID NO: 1281183 - RNA, 18 nt, Homo sapiens
gguggcauacagacuggg

SEQ ID NO: 1281184 - RNA, 17 nt, Homo sapiens
gguggcccuugcaguuc

SEQ ID NO: 1281185 - RNA, 17 nt, Homo sapiens
gguggcggcagggccag

SEQ ID NO: 1281186 - RNA, 18 nt, Homo sapiens
gguggcggcagggccagg

SEQ ID NO: 1281187 - RNA, 11 nt, Homo sapiens
ggugggguccu

SEQ ID NO: 1281188 - RNA, 20 nt, Homo sapiens
ggugguauguaauuuaugca

SEQ ID NO: 1281189 - RNA, 16 nt, Homo sapiens
gguggugcaccacugu

SEQ ID NO: 1281190 - RNA, 14 nt, Homo sapiens
ggugucgucuguga

SEQ ID NO: 1281191 - RNA, 13 nt, Homo sapiens
ggugucugcccug

SEQ ID NO: 1281192 - RNA, 20 nt, Homo sapiens
ggugugaaccaccacaccca

SEQ ID NO: 1281193 - RNA, 19 nt, Homo sapiens
ggugugcugagguguuaga

SEQ ID NO: 1281194 - RNA, 13 nt, Homo sapiens
gguguggccucag

SEQ ID NO: 1281195 - RNA, 18 nt, Homo sapiens
gguguuauuuucugagag

SEQ ID NO: 1281196 - RNA, 17 nt, Homo sapiens
gguguuguaugccuuua

SEQ ID NO: 1281197 - RNA, 15 nt, Homo sapiens
gguguuugucugugu

SEQ ID NO: 1281198 - RNA, 13 nt, Homo sapiens
gguguuuugccau

SEQ ID NO: 1281199 - RNA, 22 nt, Homo sapiens
gguuaauggcuaguacuguauu

SEQ ID NO: 1281200 - RNA, 12 nt, Homo sapiens
gguuacaaagac

SEQ ID NO: 1281201 - RNA, 18 nt, Homo sapiens
uaugucuuggacacugua

SEQ ID NO: 1281202 - RNA, 10 nt, Homo sapiens
uaugugaaca

SEQ ID NO: 1281203 - RNA, 13 nt, Homo sapiens
uaugugacaccaa

SEQ ID NO: 1281204 - RNA, 23 nt, Homo sapiens
uaugugagagaaagugugagcaa

SEQ ID NO: 1281205 - RNA, 20 nt, Homo sapiens
uauguggacguaaucuccac

SEQ ID NO: 1281206 - RNA, 17 nt, Homo sapiens
uauguguauauauacau

SEQ ID NO: 1281207 - RNA, 22 nt, Homo sapiens
uaugugucccgaauccacaguc

SEQ ID NO: 1281208 - RNA, 18 nt, Homo sapiens
uaugugugaggagcugcu

SEQ ID NO: 1281209 - RNA, 19 nt, Homo sapiens
uauguuaaagcaucagaga

SEQ ID NO: 1281210 - RNA, 16 nt, Homo sapiens
uauguuccuaagguca

SEQ ID NO: 1281211 - RNA, 21 nt, Homo sapiens
uauguucuccccuacauuagu

SEQ ID NO: 1281212 - RNA, 14 nt, Homo sapiens
uauguuugcacuuu

SEQ ID NO: 1281213 - RNA, 21 nt, Homo sapiens
uauguuuggaauaaagucaac

SEQ ID NO: 1281214 - RNA, 18 nt, Homo sapiens
uauuaaaaauguucucaa

SEQ ID NO: 1281215 - RNA, 18 nt, Homo sapiens
uauuaaaauaagcacugu

SEQ ID NO: 1281216 - RNA, 13 nt, Homo sapiens
uauuaaacaaagu

SEQ ID NO: 1281217 - RNA, 20 nt, Homo sapiens
uauuaaauaaaugugcaugc

SEQ ID NO: 1281218 - RNA, 23 nt, Homo sapiens
uauuaagauuuccaagugccaau

SEQ ID NO: 1281219 - RNA, 23 nt, Homo sapiens
uauuaauaaagcauucuuuaaca

SEQ ID NO: 1281220 - RNA, 20 nt, Homo sapiens
uauuaauauauaguccagac

SEQ ID NO: 1281221 - RNA, 18 nt, Homo sapiens
uauuaauucuucaccugu

SEQ ID NO: 1281222 - RNA, 23 nt, Homo sapiens
uauuaauuuuuaaggauguugcc

SEQ ID NO: 1281223 - RNA, 24 nt, Homo sapiens
uauuaauuuuuaaggauguugcca

SEQ ID NO: 1281224 - RNA, 19 nt, Homo sapiens
uauuacacggagugugcua

SEQ ID NO: 1281225 - RNA, 13 nt, Homo sapiens
uauuaccaaaaaa

SEQ ID NO: 1281226 - RNA, 13 nt, Homo sapiens
uauuaccaugaga

SEQ ID NO: 1281227 - RNA, 17 nt, Homo sapiens
uauuacucagcacagag

SEQ ID NO: 1281228 - RNA, 12 nt, Homo sapiens
uauuacuguugc

SEQ ID NO: 1281229 - RNA, 18 nt, Homo sapiens
uauuacuguugcauuuac

SEQ ID NO: 1281230 - RNA, 20 nt, Homo sapiens
uauuacuguugcauuuacuu

SEQ ID NO: 1281231 - RNA, 22 nt, Homo sapiens
uauuacuuauuuuugacagugu

SEQ ID NO: 1281232 - RNA, 21 nt, Homo sapiens
uauuagaucaaauaguugcau

SEQ ID NO: 1281233 - RNA, 13 nt, Homo sapiens
uauuagcuuauau

SEQ ID NO: 1281234 - RNA, 15 nt, Homo sapiens
uauuaguacugcucu

SEQ ID NO: 1281235 - RNA, 17 nt, Homo sapiens
uauuauacgcuggcaac

SEQ ID NO: 1281236 - RNA, 18 nt, Homo sapiens
uauuauagcaacuuuaag

SEQ ID NO: 1281237 - RNA, 23 nt, Homo sapiens
uauuaucagagacuauguagcaa

SEQ ID NO: 1281238 - RNA, 15 nt, Homo sapiens
uauuauguagcugaa

SEQ ID NO: 1281239 - RNA, 14 nt, Homo sapiens
uauuauguguuucc

SEQ ID NO: 1281240 - RNA, 14 nt, Homo sapiens
uauuauuaucacau

SEQ ID NO: 1281241 - RNA, 22 nt, Homo sapiens
uauuauuugcuuuucauguaga

SEQ ID NO: 1281242 - RNA, 17 nt, Homo sapiens
uauuauuuugcacuguu

SEQ ID NO: 1281243 - RNA, 13 nt, Homo sapiens
uauucaauggaaa

SEQ ID NO: 1281244 - RNA, 19 nt, Homo sapiens
uauucaauggaaagcugcu

SEQ ID NO: 1281245 - RNA, 15 nt, Homo sapiens
uauucagauugggaa

SEQ ID NO: 1281246 - RNA, 14 nt, Homo sapiens
uauucaggagagua

SEQ ID NO: 1281247 - RNA, 18 nt, Homo sapiens
uauucaguaauaacucua

SEQ ID NO: 1281248 - RNA, 14 nt, Homo sapiens
uauucauccuaaaa

SEQ ID NO: 1281249 - RNA, 11 nt, Homo sapiens
uauuccacuua

SEQ ID NO: 1281250 - RNA, 20 nt, Homo sapiens
uauuccgauacaaaguguug

SEQ ID NO: 1281251 - RNA, 18 nt, Homo sapiens
uauuccuccaaaucucuu

SEQ ID NO: 1281252 - RNA, 14 nt, Homo sapiens
uauuccuguuucca

SEQ ID NO: 1281253 - RNA, 20 nt, Homo sapiens
uauuccuuugccaauucauu

SEQ ID NO: 1281254 - RNA, 13 nt, Homo sapiens
uauucgugaauag

SEQ ID NO: 1281255 - RNA, 23 nt, Homo sapiens
uauucuaguuuugucaaacugua

SEQ ID NO: 1281256 - RNA, 20 nt, Homo sapiens
uauucuauaaaacucugcau

SEQ ID NO: 1281257 - RNA, 23 nt, Homo sapiens
uauucucaguguagggcagagag

SEQ ID NO: 1281258 - RNA, 16 nt, Homo sapiens
uauucuguuuugcaca

SEQ ID NO: 1281259 - RNA, 12 nt, Homo sapiens
uauucuugucaa

SEQ ID NO: 1281260 - RNA, 22 nt, Homo sapiens
uauucuuguuuuacauuuggau

SEQ ID NO: 1281261 - RNA, 17 nt, Homo sapiens
uauucuuucuaaacuac

SEQ ID NO: 1281262 - RNA, 19 nt, Homo sapiens
uauucuuucuaaacuacaa

SEQ ID NO: 1281263 - RNA, 13 nt, Homo sapiens
uauugaaucuaca

SEQ ID NO: 1281264 - RNA, 14 nt, Homo sapiens
uauugaauguuaaa

SEQ ID NO: 1281265 - RNA, 19 nt, Homo sapiens
uauugacuuuauguuguau

SEQ ID NO: 1281266 - RNA, 17 nt, Homo sapiens
uauugagugaagccuua

SEQ ID NO: 1281267 - RNA, 15 nt, Homo sapiens
uauugauuccucaca

SEQ ID NO: 1281268 - RNA, 15 nt, Homo sapiens
uauuggacagucuca

SEQ ID NO: 1281269 - RNA, 16 nt, Homo sapiens
uauugugccaauaugu

SEQ ID NO: 1281270 - RNA, 22 nt, Homo sapiens
uauuguggauguguucauucaa

SEQ ID NO: 1281271 - RNA, 18 nt, Homo sapiens
uauuguugacaacuguga

SEQ ID NO: 1281272 - RNA, 23 nt, Homo sapiens
uauuuaaaaauuguuucuugaca

SEQ ID NO: 1281273 - RNA, 20 nt, Homo sapiens
uauuuaaagaaaauaaacac

SEQ ID NO: 1281274 - RNA, 18 nt, Homo sapiens
uauuuaaagccuccucau

SEQ ID NO: 1281275 - RNA, 22 nt, Homo sapiens
uauuuaaagccuccucaucccg

SEQ ID NO: 1281276 - RNA, 17 nt, Homo sapiens
uauuuaaauaaaaucac

SEQ ID NO: 1281277 - RNA, 14 nt, Homo sapiens
uauuuaaguucaca

SEQ ID NO: 1281278 - RNA, 17 nt, Homo sapiens
uauuuaauuaaaucuca

SEQ ID NO: 1281279 - RNA, 22 nt, Homo sapiens
uauuuacagaaaagacucugac

SEQ ID NO: 1281280 - RNA, 13 nt, Homo sapiens
uauuuacagugaa

SEQ ID NO: 1281281 - RNA, 15 nt, Homo sapiens
uauuuacaugugauu

SEQ ID NO: 1281282 - RNA, 21 nt, Homo sapiens
uauuuacugagcuucucugug

SEQ ID NO: 1281283 - RNA, 17 nt, Homo sapiens
uauuuaguucaacugua

SEQ ID NO: 1281284 - RNA, 18 nt, Homo sapiens
uauuuauaaaugagcaaa

SEQ ID NO: 1281285 - RNA, 17 nt, Homo sapiens
uauuuauacucacugag

SEQ ID NO: 1281286 - RNA, 15 nt, Homo sapiens
uauuuauacuuugca

SEQ ID NO: 1281287 - RNA, 15 nt, Homo sapiens
uauuuauagucacaa

SEQ ID NO: 1281288 - RNA, 21 nt, Homo sapiens
uauuuauauauuuauaacuca

SEQ ID NO: 1281289 - RNA, 20 nt, Homo sapiens
uauuuauccaaaauguguau

SEQ ID NO: 1281290 - RNA, 18 nt, Homo sapiens
uauuuauguuugcacuug

SEQ ID NO: 1281291 - RNA, 14 nt, Homo sapiens
uauuuauuagccaa

SEQ ID NO: 1281292 - RNA, 16 nt, Homo sapiens
uauuuauuccauauuc

SEQ ID NO: 1281293 - RNA, 23 nt, Homo sapiens
uauuuauugcuguguaacacugu

SEQ ID NO: 1281294 - RNA, 22 nt, Homo sapiens
uauuucaagugccuagacuguu

SEQ ID NO: 1281295 - RNA, 14 nt, Homo sapiens
uauuucauaaacaa

SEQ ID NO: 1281296 - RNA, 19 nt, Homo sapiens
uauuucauauaaauggaau

SEQ ID NO: 1281297 - RNA, 23 nt, Homo sapiens
uauuuccaagaaauauuccuuaa

SEQ ID NO: 1281298 - RNA, 15 nt, Homo sapiens
uauuuccacuugccc

SEQ ID NO: 1281299 - RNA, 16 nt, Homo sapiens
uauuuccaucauguca

SEQ ID NO: 1281300 - RNA, 22 nt, Homo sapiens
uauuuccuaaaaucacaggaca

SEQ ID NO: 1281301 - RNA, 14 nt, Homo sapiens
uauuucuacacagu

SEQ ID NO: 1281302 - RNA, 14 nt, Homo sapiens
uauuucuacuauga

SEQ ID NO: 1281303 - RNA, 17 nt, Homo sapiens
uauuucucaacaaagca

SEQ ID NO: 1281304 - RNA, 16 nt, Homo sapiens
uauuucuccuuugcaa

SEQ ID NO: 1281305 - RNA, 21 nt, Homo sapiens
uauuucucucuuaacacuggc

SEQ ID NO: 1281306 - RNA, 12 nt, Homo sapiens
uauuucucuucc

SEQ ID NO: 1281307 - RNA, 13 nt, Homo sapiens
uauuucucuugcu

SEQ ID NO: 1281308 - RNA, 16 nt, Homo sapiens
uauuucugaaucgaga

SEQ ID NO: 1281309 - RNA, 16 nt, Homo sapiens
uauuucugucauucaa

SEQ ID NO: 1281310 - RNA, 23 nt, Homo sapiens
uauuucugucccucgugaaguca

SEQ ID NO: 1281311 - RNA, 23 nt, Homo sapiens
uauuucuucaaauaaaucucucc

SEQ ID NO: 1281312 - RNA, 16 nt, Homo sapiens
uauuugaaucuacaaa

SEQ ID NO: 1281313 - RNA, 17 nt, Homo sapiens
uauuugagagacauuug

SEQ ID NO: 1281314 - RNA, 16 nt, Homo sapiens
uauuugauaacaguua

SEQ ID NO: 1281315 - RNA, 14 nt, Homo sapiens
uauuugcacuauuu

SEQ ID NO: 1281316 - RNA, 21 nt, Homo sapiens
uauuugcaguucaccugcacu

SEQ ID NO: 1281317 - RNA, 15 nt, Homo sapiens
uauuuggauaucaaa

SEQ ID NO: 1281318 - RNA, 14 nt, Homo sapiens
uauuugguaccaug

SEQ ID NO: 1281319 - RNA, 19 nt, Homo sapiens
uauuugguaccauggugua

SEQ ID NO: 1281320 - RNA, 13 nt, Homo sapiens
uauuuguauuaau

SEQ ID NO: 1281321 - RNA, 19 nt, Homo sapiens
uauuuuaagagaaaacugc

SEQ ID NO: 1281322 - RNA, 13 nt, Homo sapiens
uauuuuaagcacu

SEQ ID NO: 1281323 - RNA, 16 nt, Homo sapiens
uauuuuaagcacucuu

SEQ ID NO: 1281324 - RNA, 17 nt, Homo sapiens
uauuuuacugaucucuu

SEQ ID NO: 1281325 - RNA, 20 nt, Homo sapiens
uauuuuauaccaaagccaau

SEQ ID NO: 1281326 - RNA, 18 nt, Homo sapiens
uauuuuaugaucuuggcu

SEQ ID NO: 1281327 - RNA, 15 nt, Homo sapiens
ucacuuccccacagg

SEQ ID NO: 1281328 - RNA, 13 nt, Homo sapiens
ucacuuccuacaa

SEQ ID NO: 1281329 - RNA, 14 nt, Homo sapiens
ucacuuuguuaaaa

SEQ ID NO: 1281330 - RNA, 14 nt, Homo sapiens
ucacuuuuagggag

SEQ ID NO: 1281331 - RNA, 20 nt, Homo sapiens
ucagaaaaagcuagcacuaa

SEQ ID NO: 1281332 - RNA, 15 nt, Homo sapiens
ucagaaaagugacag

SEQ ID NO: 1281333 - RNA, 22 nt, Homo sapiens
ucagaaaauguucuguuugcug

SEQ ID NO: 1281334 - RNA, 20 nt, Homo sapiens
ucagaaacaggugcaucugg

SEQ ID NO: 1281335 - RNA, 23 nt, Homo sapiens
ucagaaacccggcuuccugugcu

SEQ ID NO: 1281336 - RNA, 19 nt, Homo sapiens
ucagaaacuagaaauguga

SEQ ID NO: 1281337 - RNA, 19 nt, Homo sapiens
ucagaaauucucugcgauu

SEQ ID NO: 1281338 - RNA, 22 nt, Homo sapiens
ucagaacagcugaaacauuccg

SEQ ID NO: 1281339 - RNA, 20 nt, Homo sapiens
ucagaacccaggacagccac

SEQ ID NO: 1281340 - RNA, 21 nt, Homo sapiens
ucagaacccaggacagccaca

SEQ ID NO: 1281341 - RNA, 15 nt, Homo sapiens
ucagaagacacugca

SEQ ID NO: 1281342 - RNA, 21 nt, Homo sapiens
ucagaagagguugggcuucca

SEQ ID NO: 1281343 - RNA, 13 nt, Homo sapiens
ucagaagccugag

SEQ ID NO: 1281344 - RNA, 15 nt, Homo sapiens
ucagaagcucuucua

SEQ ID NO: 1281345 - RNA, 21 nt, Homo sapiens
ucagaauaaauugauccuuug

SEQ ID NO: 1281346 - RNA, 13 nt, Homo sapiens
ucagaauaugauu

SEQ ID NO: 1281347 - RNA, 16 nt, Homo sapiens
ucagaauucaucugaa

SEQ ID NO: 1281348 - RNA, 15 nt, Homo sapiens
ucagacagaacuuga

SEQ ID NO: 1281349 - RNA, 14 nt, Homo sapiens
ucagacagauguca

SEQ ID NO: 1281350 - RNA, 19 nt, Homo sapiens
ucagacagggucugaagga

SEQ ID NO: 1281351 - RNA, 14 nt, Homo sapiens
ucagaccugagguu

SEQ ID NO: 1281352 - RNA, 16 nt, Homo sapiens
ucagaccuggcugcuu

SEQ ID NO: 1281353 - RNA, 20 nt, Homo sapiens
ucagaccugucuuccaagga

SEQ ID NO: 1281354 - RNA, 14 nt, Homo sapiens
ucagacucucagac

SEQ ID NO: 1281355 - RNA, 21 nt, Homo sapiens
ucagacugcugggacuggcca

SEQ ID NO: 1281356 - RNA, 14 nt, Homo sapiens
ucagacuuaccagg

SEQ ID NO: 1281357 - RNA, 18 nt, Homo sapiens
ucagagaaauacuuucag

SEQ ID NO: 1281358 - RNA, 16 nt, Homo sapiens
ucagagacuaucugau

SEQ ID NO: 1281359 - RNA, 15 nt, Homo sapiens
ucagagccaccccua

SEQ ID NO: 1281360 - RNA, 18 nt, Homo sapiens
ucagagcccucaacuauu

SEQ ID NO: 1281361 - RNA, 20 nt, Homo sapiens
ucagagcuaacauaaaggac

SEQ ID NO: 1281362 - RNA, 20 nt, Homo sapiens
ucagaggauggccagugucu

SEQ ID NO: 1281363 - RNA, 18 nt, Homo sapiens
ucagagggcguguuguuu

SEQ ID NO: 1281364 - RNA, 18 nt, Homo sapiens
ucagaggguagccuugau

SEQ ID NO: 1281365 - RNA, 14 nt, Homo sapiens
ucagaguccuugca

SEQ ID NO: 1281366 - RNA, 22 nt, Homo sapiens
ucagauaaagcacccuguauca

SEQ ID NO: 1281367 - RNA, 16 nt, Homo sapiens
ucagauaggagugaau

SEQ ID NO: 1281368 - RNA, 16 nt, Homo sapiens
ucagauaucaaaauuc

SEQ ID NO: 1281369 - RNA, 20 nt, Homo sapiens
ucagauauuuuuucagaaau

SEQ ID NO: 1281370 - RNA, 21 nt, Homo sapiens
ucagauauuuuuucagaaaua

SEQ ID NO: 1281371 - RNA, 12 nt, Homo sapiens
ucagaugaacuc

SEQ ID NO: 1281372 - RNA, 16 nt, Homo sapiens
ucagaugaucucucca

SEQ ID NO: 1281373 - RNA, 23 nt, Homo sapiens
ucagaugcuguuaguaccuacau

SEQ ID NO: 1281374 - RNA, 23 nt, Homo sapiens
ucagaugcuugcggcaaaaggaa

SEQ ID NO: 1281375 - RNA, 18 nt, Homo sapiens
ucagauggagguucucag

SEQ ID NO: 1281376 - RNA, 20 nt, Homo sapiens
ucagauuauuuaaaugggaa

SEQ ID NO: 1281377 - RNA, 22 nt, Homo sapiens
ucagauuguuaucuaucaacua

SEQ ID NO: 1281378 - RNA, 16 nt, Homo sapiens
ucagcaauacucauca

SEQ ID NO: 1281379 - RNA, 17 nt, Homo sapiens
ucagcaauacucaucag

SEQ ID NO: 1281380 - RNA, 15 nt, Homo sapiens
ucagcacaaagacac

SEQ ID NO: 1281381 - RNA, 12 nt, Homo sapiens
ucagcacaggcc

SEQ ID NO: 1281382 - RNA, 20 nt, Homo sapiens
ucagcacaggccugggaccu

SEQ ID NO: 1281383 - RNA, 23 nt, Homo sapiens
ucagcacugaaaauaccaucagg

SEQ ID NO: 1281384 - RNA, 21 nt, Homo sapiens
ucagcagaaacacacagucac

SEQ ID NO: 1281385 - RNA, 23 nt, Homo sapiens
ucagcaggaguaauaaauuuacu

SEQ ID NO: 1281386 - RNA, 14 nt, Homo sapiens
ucagcaggcaaaga

SEQ ID NO: 1281387 - RNA, 22 nt, Homo sapiens
ucagcagucuaguucuuuucau

SEQ ID NO: 1281388 - RNA, 15 nt, Homo sapiens
ucagcaucucgguuc

SEQ ID NO: 1281389 - RNA, 13 nt, Homo sapiens
ucagcaucuguga

SEQ ID NO: 1281390 - RNA, 13 nt, Homo sapiens
ucagcaugcaucc

SEQ ID NO: 1281391 - RNA, 21 nt, Homo sapiens
ucagcauuuagucuugccagg

SEQ ID NO: 1281392 - RNA, 15 nt, Homo sapiens
ucagccaacugaaaa

SEQ ID NO: 1281393 - RNA, 20 nt, Homo sapiens
ucagccaauccgauugccuu

SEQ ID NO: 1281394 - RNA, 14 nt, Homo sapiens
ucagccacugugau

SEQ ID NO: 1281395 - RNA, 16 nt, Homo sapiens
ucagccagccuccagc

SEQ ID NO: 1281396 - RNA, 12 nt, Homo sapiens
ucagcccagaag

SEQ ID NO: 1281397 - RNA, 15 nt, Homo sapiens
ucagcccugccaggu

SEQ ID NO: 1281398 - RNA, 17 nt, Homo sapiens
ucagccuaggcccucau

SEQ ID NO: 1281399 - RNA, 19 nt, Homo sapiens
ucagccucccgaauagcug

SEQ ID NO: 1281400 - RNA, 19 nt, Homo sapiens
ucagccuccugagccugug

SEQ ID NO: 1281401 - RNA, 14 nt, Homo sapiens
ucagccuuaggaag

SEQ ID NO: 1281402 - RNA, 19 nt, Homo sapiens
ucagcgacugccacaucau

SEQ ID NO: 1281403 - RNA, 20 nt, Homo sapiens
ucagcuaacaaacuagaaaa

SEQ ID NO: 1281404 - RNA, 15 nt, Homo sapiens
ucagcucaaccacag

SEQ ID NO: 1281405 - RNA, 16 nt, Homo sapiens
ucagcucaggcagcuc

SEQ ID NO: 1281406 - RNA, 21 nt, Homo sapiens
ucagcucccuuauacccccau

SEQ ID NO: 1281407 - RNA, 15 nt, Homo sapiens
ucagcugaaugccuc

SEQ ID NO: 1281408 - RNA, 13 nt, Homo sapiens
ucagcuucucaaa

SEQ ID NO: 1281409 - RNA, 19 nt, Homo sapiens
ucagcuuguaaauagcuca

SEQ ID NO: 1281410 - RNA, 23 nt, Homo sapiens
ucagcuuuuguuguuuauauaca

SEQ ID NO: 1281411 - RNA, 20 nt, Homo sapiens
ucaggaaaacuguuccaauc

SEQ ID NO: 1281412 - RNA, 16 nt, Homo sapiens
ucaggacacaaaccag

SEQ ID NO: 1281413 - RNA, 20 nt, Homo sapiens
ucaggacagguggugcaaau

SEQ ID NO: 1281414 - RNA, 20 nt, Homo sapiens
ucaggagaguagcaacaaaa

SEQ ID NO: 1281415 - RNA, 15 nt, Homo sapiens
ucaggagucaacgug

SEQ ID NO: 1281416 - RNA, 18 nt, Homo sapiens
ucaggaguuggagaccag

SEQ ID NO: 1281417 - RNA, 16 nt, Homo sapiens
ucaggaugaacccagg

SEQ ID NO: 1281418 - RNA, 17 nt, Homo sapiens
ucaggcaaagugcugcu

SEQ ID NO: 1281419 - RNA, 18 nt, Homo sapiens
ucaggcaaagugcugcug

SEQ ID NO: 1281420 - RNA, 16 nt, Homo sapiens
ucaggcagaucucagc

SEQ ID NO: 1281421 - RNA, 19 nt, Homo sapiens
ucaggcagggugagcucca

SEQ ID NO: 1281422 - RNA, 17 nt, Homo sapiens
ucaggccaacaagccaa

SEQ ID NO: 1281423 - RNA, 13 nt, Homo sapiens
ucaggccagccca

SEQ ID NO: 1281424 - RNA, 22 nt, Homo sapiens
ucaggcccugaucuagugcagu

SEQ ID NO: 1281425 - RNA, 14 nt, Homo sapiens
ucaggcccuggaac

SEQ ID NO: 1281426 - RNA, 13 nt, Homo sapiens
ucaggccuccagc

SEQ ID NO: 1281427 - RNA, 23 nt, Homo sapiens
ucaggcgauccaccugucucagc

SEQ ID NO: 1281428 - RNA, 22 nt, Homo sapiens
ucaggcgccuggcacauuucag

SEQ ID NO: 1281429 - RNA, 15 nt, Homo sapiens
ucagggagcauuuaa

SEQ ID NO: 1281430 - RNA, 15 nt, Homo sapiens
ucagggccaguccuc

SEQ ID NO: 1281431 - RNA, 19 nt, Homo sapiens
ucagggcccaagucccugu

SEQ ID NO: 1281432 - RNA, 22 nt, Homo sapiens
ucagggccuggcaggccagugu

SEQ ID NO: 1281433 - RNA, 19 nt, Homo sapiens
ucagggccuggggccugag

SEQ ID NO: 1281434 - RNA, 14 nt, Homo sapiens
ucaggggacucagc

SEQ ID NO: 1281435 - RNA, 15 nt, Homo sapiens
ucaggggacuugaau

SEQ ID NO: 1281436 - RNA, 20 nt, Homo sapiens
ucagggggauaacuaccaga

SEQ ID NO: 1281437 - RNA, 19 nt, Homo sapiens
ucagggucuaagcaccuug

SEQ ID NO: 1281438 - RNA, 22 nt, Homo sapiens
ucagguagaagguugacacagu

SEQ ID NO: 1281439 - RNA, 12 nt, Homo sapiens
ucaggugacaug

SEQ ID NO: 1281440 - RNA, 15 nt, Homo sapiens
ucaggugauucgccc

SEQ ID NO: 1281441 - RNA, 12 nt, Homo sapiens
ucagguggugcc

SEQ ID NO: 1281442 - RNA, 21 nt, Homo sapiens
ucaguaacauuucuguucuca

SEQ ID NO: 1281443 - RNA, 20 nt, Homo sapiens
ucaguaauaaaacaucuuuc

SEQ ID NO: 1281444 - RNA, 21 nt, Homo sapiens
ucaguaccccugguaaaccaa

SEQ ID NO: 1281445 - RNA, 24 nt, Homo sapiens
ucaguaccccugguaaaccaagcc

SEQ ID NO: 1281446 - RNA, 23 nt, Homo sapiens
ucaguacuugugaaacacagcug

SEQ ID NO: 1281447 - RNA, 16 nt, Homo sapiens
ucaguauuucaacuga

SEQ ID NO: 1281448 - RNA, 17 nt, Homo sapiens
ucagucaaaacuuuaaa

SEQ ID NO: 1281449 - RNA, 19 nt, Homo sapiens
ucagucauuuuuaaccucu

SEQ ID NO: 1281450 - RNA, 15 nt, Homo sapiens
ucaguccacugcuga

SEQ ID NO: 1281451 - RNA, 16 nt, Homo sapiens
ucaguccacugcugag

SEQ ID NO: 1281452 - RNA, 14 nt, Homo sapiens
uccauacucuguaa

SEQ ID NO: 1281453 - RNA, 22 nt, Homo sapiens
uccauagccuaaucccugggca

SEQ ID NO: 1281454 - RNA, 21 nt, Homo sapiens
uccauaggcgcaggugcacag

SEQ ID NO: 1281455 - RNA, 21 nt, Homo sapiens
uccauagggccuccuuagauc

SEQ ID NO: 1281456 - RNA, 19 nt, Homo sapiens
uccauaguaguaugaugau

SEQ ID NO: 1281457 - RNA, 13 nt, Homo sapiens
uccaucaauaaau

SEQ ID NO: 1281458 - RNA, 22 nt, Homo sapiens
uccaucacccguacaggcaauu

SEQ ID NO: 1281459 - RNA, 23 nt, Homo sapiens
uccaucacccucuuccugugauc

SEQ ID NO: 1281460 - RNA, 18 nt, Homo sapiens
uccaucacguuagcuguc

SEQ ID NO: 1281461 - RNA, 19 nt, Homo sapiens
uccaucccaaccagugcca

SEQ ID NO: 1281462 - RNA, 14 nt, Homo sapiens
uccaucccuacccc

SEQ ID NO: 1281463 - RNA, 19 nt, Homo sapiens
uccaucccuuuuccuguca

SEQ ID NO: 1281464 - RNA, 15 nt, Homo sapiens
uccaucuccacucca

SEQ ID NO: 1281465 - RNA, 22 nt, Homo sapiens
uccaucuuccacgaaaugggcc

SEQ ID NO: 1281466 - RNA, 18 nt, Homo sapiens
uccaucuuugaacuucug

SEQ ID NO: 1281467 - RNA, 22 nt, Homo sapiens
uccaugaaguuugaacuucaua

SEQ ID NO: 1281468 - RNA, 19 nt, Homo sapiens
uccaugaccuaguuuucca

SEQ ID NO: 1281469 - RNA, 20 nt, Homo sapiens
uccaugauuuuaaauuguga

SEQ ID NO: 1281470 - RNA, 22 nt, Homo sapiens
uccaugccucuggaggccucug

SEQ ID NO: 1281471 - RNA, 22 nt, Homo sapiens
uccaugguguagcgugcaucag

SEQ ID NO: 1281472 - RNA, 17 nt, Homo sapiens
uccauguaaauugcaaa

SEQ ID NO: 1281473 - RNA, 16 nt, Homo sapiens
uccauguaguuacuuc

SEQ ID NO: 1281474 - RNA, 22 nt, Homo sapiens
uccaugucgccucugcauucag

SEQ ID NO: 1281475 - RNA, 16 nt, Homo sapiens
uccauguuugcaaugc

SEQ ID NO: 1281476 - RNA, 15 nt, Homo sapiens
uccauguuugcaccu

SEQ ID NO: 1281477 - RNA, 22 nt, Homo sapiens
uccauguuugcaccugugcauu

SEQ ID NO: 1281478 - RNA, 20 nt, Homo sapiens
uccauuaaauggucuaaaau

SEQ ID NO: 1281479 - RNA, 13 nt, Homo sapiens
uccauuagucaau

SEQ ID NO: 1281480 - RNA, 16 nt, Homo sapiens
uccauucaacugaaaa

SEQ ID NO: 1281481 - RNA, 15 nt, Homo sapiens
uccauucacaccagc

SEQ ID NO: 1281482 - RNA, 14 nt, Homo sapiens
uccauuccagaaua

SEQ ID NO: 1281483 - RNA, 12 nt, Homo sapiens
uccauucccaag

SEQ ID NO: 1281484 - RNA, 20 nt, Homo sapiens
uccauuucccacaucuuucc

SEQ ID NO: 1281485 - RNA, 16 nt, Homo sapiens
uccauuugcaaauaua

SEQ ID NO: 1281486 - RNA, 20 nt, Homo sapiens
uccauuuugugaauugugac

SEQ ID NO: 1281487 - RNA, 21 nt, Homo sapiens
uccauuuuuccucuguucaca

SEQ ID NO: 1281488 - RNA, 20 nt, Homo sapiens
ucccaaaagauugcugaaaa

SEQ ID NO: 1281489 - RNA, 14 nt, Homo sapiens
ucccaaagcucaga

SEQ ID NO: 1281490 - RNA, 19 nt, Homo sapiens
ucccaaauucauugacuua

SEQ ID NO: 1281491 - RNA, 16 nt, Homo sapiens
ucccaacacuuugaga

SEQ ID NO: 1281492 - RNA, 14 nt, Homo sapiens
ucccaacccauuca

SEQ ID NO: 1281493 - RNA, 22 nt, Homo sapiens
ucccaaccccaguggauucuca

SEQ ID NO: 1281494 - RNA, 16 nt, Homo sapiens
ucccaagguccucuca

SEQ ID NO: 1281495 - RNA, 20 nt, Homo sapiens
ucccaagguccucucaguuc

SEQ ID NO: 1281496 - RNA, 22 nt, Homo sapiens
ucccaagucagacagaugucag

SEQ ID NO: 1281497 - RNA, 19 nt, Homo sapiens
ucccaaucagcacugaaaa

SEQ ID NO: 1281498 - RNA, 15 nt, Homo sapiens
ucccaaucggccuua

SEQ ID NO: 1281499 - RNA, 19 nt, Homo sapiens
ucccaaucuuucuauauaa

SEQ ID NO: 1281500 - RNA, 13 nt, Homo sapiens
ucccacacaggcu

SEQ ID NO: 1281501 - RNA, 16 nt, Homo sapiens
ucccacaugaggccau

SEQ ID NO: 1281502 - RNA, 21 nt, Homo sapiens
ucccacccacaugugacacau

SEQ ID NO: 1281503 - RNA, 15 nt, Homo sapiens
ucccacccagcuaaa

SEQ ID NO: 1281504 - RNA, 17 nt, Homo sapiens
ucccacccccaucucuc

SEQ ID NO: 1281505 - RNA, 14 nt, Homo sapiens
ucccaccucagccu

SEQ ID NO: 1281506 - RNA, 23 nt, Homo sapiens
ucccaccuccauuugcaauugac

SEQ ID NO: 1281507 - RNA, 23 nt, Homo sapiens
ucccaccucuccuuuugaggcuu

SEQ ID NO: 1281508 - RNA, 14 nt, Homo sapiens
ucccacgaggaauc

SEQ ID NO: 1281509 - RNA, 20 nt, Homo sapiens
ucccacgucuggccaggcac

SEQ ID NO: 1281510 - RNA, 15 nt, Homo sapiens
ucccacucaguccau

SEQ ID NO: 1281511 - RNA, 11 nt, Homo sapiens
ucccacuccag

SEQ ID NO: 1281512 - RNA, 12 nt, Homo sapiens
ucccacuggaag

SEQ ID NO: 1281513 - RNA, 22 nt, Homo sapiens
ucccacuuggaggccuuucauc

SEQ ID NO: 1281514 - RNA, 18 nt, Homo sapiens
ucccagacggucaggaaa

SEQ ID NO: 1281515 - RNA, 13 nt, Homo sapiens
ucccagagcaccu

SEQ ID NO: 1281516 - RNA, 18 nt, Homo sapiens
ucccagaggaugucacaa

SEQ ID NO: 1281517 - RNA, 22 nt, Homo sapiens
ucccagaggcagagccugaguc

SEQ ID NO: 1281518 - RNA, 16 nt, Homo sapiens
ucccagauacacuaaa

SEQ ID NO: 1281519 - RNA, 17 nt, Homo sapiens
ucccagauggcuggaag

SEQ ID NO: 1281520 - RNA, 21 nt, Homo sapiens
ucccagcacgaguggccaguu

SEQ ID NO: 1281521 - RNA, 17 nt, Homo sapiens
ucccagcagcccaagcu

SEQ ID NO: 1281522 - RNA, 19 nt, Homo sapiens
ucccagcccuauggaugug

SEQ ID NO: 1281523 - RNA, 13 nt, Homo sapiens
ucccagcuacuca

SEQ ID NO: 1281524 - RNA, 17 nt, Homo sapiens
ucccagcugaaggcagu

SEQ ID NO: 1281525 - RNA, 19 nt, Homo sapiens
ucccaggcuggagugcagu

SEQ ID NO: 1281526 - RNA, 23 nt, Homo sapiens
ucccagggcuggcucugcacuaa

SEQ ID NO: 1281527 - RNA, 18 nt, Homo sapiens
ucccauaaacacugaauu

SEQ ID NO: 1281528 - RNA, 16 nt, Homo sapiens
ucccauagccaggaaa

SEQ ID NO: 1281529 - RNA, 14 nt, Homo sapiens
ucccauaucuugcc

SEQ ID NO: 1281530 - RNA, 22 nt, Homo sapiens
ucccaucacuucccuacaugga

SEQ ID NO: 1281531 - RNA, 14 nt, Homo sapiens
ucccauccuugaug

SEQ ID NO: 1281532 - RNA, 15 nt, Homo sapiens
ucccaucuuuacucc

SEQ ID NO: 1281533 - RNA, 18 nt, Homo sapiens
ucccaugccuggucccaa

SEQ ID NO: 1281534 - RNA, 22 nt, Homo sapiens
ucccauggguuguguguuuauu

SEQ ID NO: 1281535 - RNA, 18 nt, Homo sapiens
ucccauguuagcuacaca

SEQ ID NO: 1281536 - RNA, 14 nt, Homo sapiens
ucccauuacuuuga

SEQ ID NO: 1281537 - RNA, 22 nt, Homo sapiens
ucccauuguggcuccuaucugu

SEQ ID NO: 1281538 - RNA, 20 nt, Homo sapiens
ucccauuuccugagaccaca

SEQ ID NO: 1281539 - RNA, 15 nt, Homo sapiens
uccccaaccacagag

SEQ ID NO: 1281540 - RNA, 17 nt, Homo sapiens
uccccaacugaguucaa

SEQ ID NO: 1281541 - RNA, 17 nt, Homo sapiens
uccccaagcaccuuccc

SEQ ID NO: 1281542 - RNA, 15 nt, Homo sapiens
uccccaagggcccug

SEQ ID NO: 1281543 - RNA, 23 nt, Homo sapiens
uccccaagugguuuccacaugcu

SEQ ID NO: 1281544 - RNA, 16 nt, Homo sapiens
uccccacccagucuca

SEQ ID NO: 1281545 - RNA, 19 nt, Homo sapiens
uccccacccauaccacagc

SEQ ID NO: 1281546 - RNA, 23 nt, Homo sapiens
uccccacgagggcuggcuggccu

SEQ ID NO: 1281547 - RNA, 18 nt, Homo sapiens
uccccagaaacagugugc

SEQ ID NO: 1281548 - RNA, 21 nt, Homo sapiens
uccccagaagcagccauaaaa

SEQ ID NO: 1281549 - RNA, 16 nt, Homo sapiens
uccccagaugugacua

SEQ ID NO: 1281550 - RNA, 21 nt, Homo sapiens
uccccagggcccuuguacaac

SEQ ID NO: 1281551 - RNA, 24 nt, Homo sapiens
uccccagucccaaugcacauccau

SEQ ID NO: 1281552 - RNA, 21 nt, Homo sapiens
uccccaguucauugcacuuug

SEQ ID NO: 1281553 - RNA, 16 nt, Homo sapiens
uccccauccuccagcu

SEQ ID NO: 1281554 - RNA, 15 nt, Homo sapiens
ucccccgccacuccu

SEQ ID NO: 1281555 - RNA, 18 nt, Homo sapiens
ucccccuauccuuggcac

SEQ ID NO: 1281556 - RNA, 22 nt, Homo sapiens
ucccccuauuuauugacuuuga

SEQ ID NO: 1281557 - RNA, 21 nt, Homo sapiens
ucccccucaauagaucuccag

SEQ ID NO: 1281558 - RNA, 17 nt, Homo sapiens
ucccccucucugcccug

SEQ ID NO: 1281559 - RNA, 19 nt, Homo sapiens
ucccccuuugugcacauuu

SEQ ID NO: 1281560 - RNA, 14 nt, Homo sapiens
uccccgcucuugcc

SEQ ID NO: 1281561 - RNA, 15 nt, Homo sapiens
uccccggacauacuc

SEQ ID NO: 1281562 - RNA, 13 nt, Homo sapiens
uccccgugccaaa

SEQ ID NO: 1281563 - RNA, 14 nt, Homo sapiens
uccccgugccaaaa

SEQ ID NO: 1281564 - RNA, 20 nt, Homo sapiens
uccccguuccaccccaagag

SEQ ID NO: 1281565 - RNA, 14 nt, Homo sapiens
uccccuaucccauu

SEQ ID NO: 1281566 - RNA, 22 nt, Homo sapiens
uccccucagggauacgacacau

SEQ ID NO: 1281567 - RNA, 18 nt, Homo sapiens
uccccuccuugggcacuu

SEQ ID NO: 1281568 - RNA, 22 nt, Homo sapiens
uccccuggggguuucaccuggg

SEQ ID NO: 1281569 - RNA, 19 nt, Homo sapiens
uccccuuccuaaauaucca

SEQ ID NO: 1281570 - RNA, 15 nt, Homo sapiens
uccccuuggcuguga

SEQ ID NO: 1281571 - RNA, 18 nt, Homo sapiens
uccccuuuguguagaaag

SEQ ID NO: 1281572 - RNA, 20 nt, Homo sapiens
ucccgaagaauggagaggaa

SEQ ID NO: 1281573 - RNA, 19 nt, Homo sapiens
ucccgcgugaagaugucac

SEQ ID NO: 1281574 - RNA, 24 nt, Homo sapiens
ucccggaagcucacagugacauua

SEQ ID NO: 1281575 - RNA, 22 nt, Homo sapiens
ucccggguucaagugauucucc

SEQ ID NO: 1281576 - RNA, 20 nt, Homo sapiens
ugugccggcuuucaaguuug

SEQ ID NO: 1281577 - RNA, 15 nt, Homo sapiens
ugugccuacauuuaa

SEQ ID NO: 1281578 - RNA, 12 nt, Homo sapiens
ugugccuauagu

SEQ ID NO: 1281579 - RNA, 19 nt, Homo sapiens
ugugccugcucagcagagc

SEQ ID NO: 1281580 - RNA, 17 nt, Homo sapiens
ugugcuaauaacagugc

SEQ ID NO: 1281581 - RNA, 18 nt, Homo sapiens
ugugcuaauaacagugca

SEQ ID NO: 1281582 - RNA, 14 nt, Homo sapiens
ugugcuaugaagcu

SEQ ID NO: 1281583 - RNA, 18 nt, Homo sapiens
ugugcuccgugccuccac

SEQ ID NO: 1281584 - RNA, 19 nt, Homo sapiens
ugugcugcaccuggucaua

SEQ ID NO: 1281585 - RNA, 16 nt, Homo sapiens
ugugcuggucauggaa

SEQ ID NO: 1281586 - RNA, 14 nt, Homo sapiens
ugugcuuguuuaca

SEQ ID NO: 1281587 - RNA, 21 nt, Homo sapiens
uguggaaagaaagaccaucuc

SEQ ID NO: 1281588 - RNA, 16 nt, Homo sapiens
uguggaagagcauuag

SEQ ID NO: 1281589 - RNA, 14 nt, Homo sapiens
uguggacacagauc

SEQ ID NO: 1281590 - RNA, 12 nt, Homo sapiens
uguggacuccag

SEQ ID NO: 1281591 - RNA, 13 nt, Homo sapiens
uguggacugugau

SEQ ID NO: 1281592 - RNA, 20 nt, Homo sapiens
uguggcaaacuugcaguuua

SEQ ID NO: 1281593 - RNA, 15 nt, Homo sapiens
uguggcaaugggauu

SEQ ID NO: 1281594 - RNA, 13 nt, Homo sapiens
uguggcagugguu

SEQ ID NO: 1281595 - RNA, 14 nt, Homo sapiens
uguggccacagccc

SEQ ID NO: 1281596 - RNA, 23 nt, Homo sapiens
uguggcccagggaagccaaaaga

SEQ ID NO: 1281597 - RNA, 15 nt, Homo sapiens
uguggccccaacaca

SEQ ID NO: 1281598 - RNA, 23 nt, Homo sapiens
uguggcccucuggauccagccau

SEQ ID NO: 1281599 - RNA, 14 nt, Homo sapiens
uguggcugcaucuu

SEQ ID NO: 1281600 - RNA, 18 nt, Homo sapiens
uguggcuuauggauucau

SEQ ID NO: 1281601 - RNA, 17 nt, Homo sapiens
ugugggagccugcaaac

SEQ ID NO: 1281602 - RNA, 17 nt, Homo sapiens
uguggggaagaggggcu

SEQ ID NO: 1281603 - RNA, 18 nt, Homo sapiens
uguggggaagaguggucu

SEQ ID NO: 1281604 - RNA, 13 nt, Homo sapiens
uguggggauuuuc

SEQ ID NO: 1281605 - RNA, 12 nt, Homo sapiens
ugugggggccaa

SEQ ID NO: 1281606 - RNA, 20 nt, Homo sapiens
ugugggguccccaucauccc

SEQ ID NO: 1281607 - RNA, 13 nt, Homo sapiens
uguggucaauccg

SEQ ID NO: 1281608 - RNA, 14 nt, Homo sapiens
uguggucaucaugg

SEQ ID NO: 1281609 - RNA, 12 nt, Homo sapiens
uguggucauccu

SEQ ID NO: 1281610 - RNA, 14 nt, Homo sapiens
uguggucauccugc

SEQ ID NO: 1281611 - RNA, 21 nt, Homo sapiens
ugugguccagguccuuuccac

SEQ ID NO: 1281612 - RNA, 16 nt, Homo sapiens
uguggugagaucaugc

SEQ ID NO: 1281613 - RNA, 17 nt, Homo sapiens
ugugguuaacaucucag

SEQ ID NO: 1281614 - RNA, 14 nt, Homo sapiens
ugugguuacuuccu

SEQ ID NO: 1281615 - RNA, 23 nt, Homo sapiens
ugugguuuuuaaagaagggggcu

SEQ ID NO: 1281616 - RNA, 14 nt, Homo sapiens
uguguacugccuua

SEQ ID NO: 1281617 - RNA, 18 nt, Homo sapiens
uguguagcucucacaugc

SEQ ID NO: 1281618 - RNA, 18 nt, Homo sapiens
uguguagucaagucacca

SEQ ID NO: 1281619 - RNA, 9 nt, Homo sapiens
uguguauga

SEQ ID NO: 1281620 - RNA, 22 nt, Homo sapiens
uguguauguauaaguguguaca

SEQ ID NO: 1281621 - RNA, 17 nt, Homo sapiens
uguguauuuaacugccu

SEQ ID NO: 1281622 - RNA, 21 nt, Homo sapiens
uguguauuuacgcuuugauuc

SEQ ID NO: 1281623 - RNA, 19 nt, Homo sapiens
uguguauuuccagugcaau

SEQ ID NO: 1281624 - RNA, 24 nt, Homo sapiens
uguguauuuccagugcaauuguag

SEQ ID NO: 1281625 - RNA, 22 nt, Homo sapiens
uguguauuuguauuaauaaagc

SEQ ID NO: 1281626 - RNA, 13 nt, Homo sapiens
ugugucauguaua

SEQ ID NO: 1281627 - RNA, 14 nt, Homo sapiens
ugugucccaugacc

SEQ ID NO: 1281628 - RNA, 21 nt, Homo sapiens
uguguccuggggacuuccuca

SEQ ID NO: 1281629 - RNA, 16 nt, Homo sapiens
uguguccuugcauggc

SEQ ID NO: 1281630 - RNA, 13 nt, Homo sapiens
ugugucuguacac

SEQ ID NO: 1281631 - RNA, 16 nt, Homo sapiens
ugugucuguacacgug

SEQ ID NO: 1281632 - RNA, 13 nt, Homo sapiens
ugugucugucagc

SEQ ID NO: 1281633 - RNA, 21 nt, Homo sapiens
ugugugaaacaauguugucca

SEQ ID NO: 1281634 - RNA, 18 nt, Homo sapiens
ugugugaacuaacaugca

SEQ ID NO: 1281635 - RNA, 13 nt, Homo sapiens
ugugugacauucc

SEQ ID NO: 1281636 - RNA, 16 nt, Homo sapiens
ugugugaccaacugug

SEQ ID NO: 1281637 - RNA, 16 nt, Homo sapiens
ugugugcacguacaca

SEQ ID NO: 1281638 - RNA, 11 nt, Homo sapiens
ugugugccuuu

SEQ ID NO: 1281639 - RNA, 15 nt, Homo sapiens
ugugugcgucacugu

SEQ ID NO: 1281640 - RNA, 14 nt, Homo sapiens
uguguggacuguga

SEQ ID NO: 1281641 - RNA, 18 nt, Homo sapiens
uguguggcaaacuugcag

SEQ ID NO: 1281642 - RNA, 19 nt, Homo sapiens
uguguggugucgucuguga

SEQ ID NO: 1281643 - RNA, 20 nt, Homo sapiens
uguguguauaagugcacaca

SEQ ID NO: 1281644 - RNA, 12 nt, Homo sapiens
uguguguggcag

SEQ ID NO: 1281645 - RNA, 16 nt, Homo sapiens
uguguguguguauaca

SEQ ID NO: 1281646 - RNA, 20 nt, Homo sapiens
uguguguuccaaguuuccaa

SEQ ID NO: 1281647 - RNA, 19 nt, Homo sapiens
uguguuccuaacauaaaau

SEQ ID NO: 1281648 - RNA, 21 nt, Homo sapiens
uguguuccuuuuuaugaggca

SEQ ID NO: 1281649 - RNA, 22 nt, Homo sapiens
uguguucugucaccaacugaag

SEQ ID NO: 1281650 - RNA, 13 nt, Homo sapiens
uguguugccacag

SEQ ID NO: 1281651 - RNA, 20 nt, Homo sapiens
uguguugccaugugugcuga

SEQ ID NO: 1281652 - RNA, 20 nt, Homo sapiens
uguguuguauuaacaaaagu

SEQ ID NO: 1281653 - RNA, 14 nt, Homo sapiens
uguguugucuucag

SEQ ID NO: 1281654 - RNA, 21 nt, Homo sapiens
uguguuuauauggaagaaagu

SEQ ID NO: 1281655 - RNA, 14 nt, Homo sapiens
uguguuugugccau

SEQ ID NO: 1281656 - RNA, 22 nt, Homo sapiens
uguuaaaaucuauucuguguug

SEQ ID NO: 1281657 - RNA, 19 nt, Homo sapiens
uguuaacauuccaagacuc

SEQ ID NO: 1281658 - RNA, 18 nt, Homo sapiens
uguuaauuauuuugacaa

SEQ ID NO: 1281659 - RNA, 18 nt, Homo sapiens
uguuaauucagcacugau

SEQ ID NO: 1281660 - RNA, 20 nt, Homo sapiens
uguuacaacuuguauuucca

SEQ ID NO: 1281661 - RNA, 22 nt, Homo sapiens
uguuacauagguauauauaugc

SEQ ID NO: 1281662 - RNA, 15 nt, Homo sapiens
uguuacuauuccuuu

SEQ ID NO: 1281663 - RNA, 16 nt, Homo sapiens
uguuacucugguucuu

SEQ ID NO: 1281664 - RNA, 16 nt, Homo sapiens
uguuacuguucuugcu

SEQ ID NO: 1281665 - RNA, 20 nt, Homo sapiens
uguuacuuuuucuuguauuc

SEQ ID NO: 1281666 - RNA, 21 nt, Homo sapiens
uguuagaaaaauagcugugaa

SEQ ID NO: 1281667 - RNA, 19 nt, Homo sapiens
uguuagauagaauuuccaa

SEQ ID NO: 1281668 - RNA, 15 nt, Homo sapiens
uguuauaucagggaa

SEQ ID NO: 1281669 - RNA, 18 nt, Homo sapiens
uguuaucuaucaacuaua

SEQ ID NO: 1281670 - RNA, 15 nt, Homo sapiens
uguuaugacagugaa

SEQ ID NO: 1281671 - RNA, 17 nt, Homo sapiens
uguuauuacuguuccca

SEQ ID NO: 1281672 - RNA, 20 nt, Homo sapiens
uguuauuauaaaaguacuag

SEQ ID NO: 1281673 - RNA, 22 nt, Homo sapiens
uguuauuugcacacugcacugu

SEQ ID NO: 1281674 - RNA, 18 nt, Homo sapiens
uguuauuuuaucugcuau

SEQ ID NO: 1281675 - RNA, 12 nt, Homo sapiens
uguucaaaaagg

SEQ ID NO: 1281676 - RNA, 13 nt, Homo sapiens
uguucaacaucua

SEQ ID NO: 1281677 - RNA, 12 nt, Homo sapiens
uguucacauaua

SEQ ID NO: 1281678 - RNA, 15 nt, Homo sapiens
uguucacuguggcau

SEQ ID NO: 1281679 - RNA, 18 nt, Homo sapiens
uguucagagaggccuuuu

SEQ ID NO: 1281680 - RNA, 16 nt, Homo sapiens
uguucauccucauugc

SEQ ID NO: 1281681 - RNA, 15 nt, Homo sapiens
uguucauguuacuca

SEQ ID NO: 1281682 - RNA, 21 nt, Homo sapiens
uguuccacacccaaugcugcu

SEQ ID NO: 1281683 - RNA, 21 nt, Homo sapiens
uguuccacggaaaaugcuauc

SEQ ID NO: 1281684 - RNA, 20 nt, Homo sapiens
uguuccacugcaaauaaagc

SEQ ID NO: 1281685 - RNA, 21 nt, Homo sapiens
uguuccaguacuauggagugc

SEQ ID NO: 1281686 - RNA, 22 nt, Homo sapiens
uguuccaugaaggcagagccau

SEQ ID NO: 1281687 - RNA, 14 nt, Homo sapiens
uguuccccuaguuc

SEQ ID NO: 1281688 - RNA, 14 nt, Homo sapiens
uguuccuauuuccc

SEQ ID NO: 1281689 - RNA, 17 nt, Homo sapiens
uguuccucaagguccau

SEQ ID NO: 1281690 - RNA, 16 nt, Homo sapiens
uguuccugacuuuaua

SEQ ID NO: 1281691 - RNA, 19 nt, Homo sapiens
uguuccuugucacugguag

SEQ ID NO: 1281692 - RNA, 22 nt, Homo sapiens
uguucuaaagguggugaggcaa

SEQ ID NO: 1281693 - RNA, 22 nt, Homo sapiens
uguucuaguaacaauacaugag

SEQ ID NO: 1281694 - RNA, 16 nt, Homo sapiens
uguucuauuugugcuu

SEQ ID NO: 1281695 - RNA, 21 nt, Homo sapiens
uguucucauuugaucagggga

SEQ ID NO: 1281696 - RNA, 23 nt, Homo sapiens
uguucugaauaauuucuuacuaa

SEQ ID NO: 1281697 - RNA, 16 nt, Homo sapiens
uguucugggacacagu

SEQ ID NO: 1281698 - RNA, 19 nt, Homo sapiens
uguucugggggacagagaa

SEQ ID NO: 1281699 - RNA, 13 nt, Homo sapiens
uguucugugccug

SEQ ID NO: 1281700 - RNA, 14 nt, Homo sapiens
uguucuuaauugca

SEQ ID NO: 1281701 - RNA, 13 nt, Homo sapiens
uguucuuacacau

SEQ ID NO: 1281702 - RNA, 17 nt, Homo sapiens
uuacugaucuuacucac

SEQ ID NO: 1281703 - RNA, 18 nt, Homo sapiens
uuacugcuugaccaaaga

SEQ ID NO: 1281704 - RNA, 19 nt, Homo sapiens
uuacugguagaaaggcagu

SEQ ID NO: 1281705 - RNA, 15 nt, Homo sapiens
uuacuguccaaagac

SEQ ID NO: 1281706 - RNA, 18 nt, Homo sapiens
uuacuguuccagauuccu

SEQ ID NO: 1281707 - RNA, 17 nt, Homo sapiens
uuacuuaccuaaacaga

SEQ ID NO: 1281708 - RNA, 20 nt, Homo sapiens
uuacuuccuaucaagccagu

SEQ ID NO: 1281709 - RNA, 16 nt, Homo sapiens
uuacuugcauugaaua

SEQ ID NO: 1281710 - RNA, 23 nt, Homo sapiens
uuacuuuaaugauuauaaucaua

SEQ ID NO: 1281711 - RNA, 16 nt, Homo sapiens
uuacuuuuaccacuau

SEQ ID NO: 1281712 - RNA, 17 nt, Homo sapiens
uuacuuuuaccacuauu

SEQ ID NO: 1281713 - RNA, 14 nt, Homo sapiens
uuagaaaaauuccu

SEQ ID NO: 1281714 - RNA, 13 nt, Homo sapiens
uuagaaaauauuc

SEQ ID NO: 1281715 - RNA, 21 nt, Homo sapiens
uuagaaacuaagagaaugaua

SEQ ID NO: 1281716 - RNA, 20 nt, Homo sapiens
uuagaaaugucaguugcugc

SEQ ID NO: 1281717 - RNA, 12 nt, Homo sapiens
uuagaacaggga

SEQ ID NO: 1281718 - RNA, 12 nt, Homo sapiens
uuagaacuauua

SEQ ID NO: 1281719 - RNA, 12 nt, Homo sapiens
uuagaacuugca

SEQ ID NO: 1281720 - RNA, 16 nt, Homo sapiens
uuagaaggcuuaagaa

SEQ ID NO: 1281721 - RNA, 19 nt, Homo sapiens
uuagaagugcuaauuucug

SEQ ID NO: 1281722 - RNA, 20 nt, Homo sapiens
uuagaauaaaaaaauuuccc

SEQ ID NO: 1281723 - RNA, 21 nt, Homo sapiens
uuagaauaguguucugcaaaa

SEQ ID NO: 1281724 - RNA, 23 nt, Homo sapiens
uuagaauauccaugaccuaguuu

SEQ ID NO: 1281725 - RNA, 16 nt, Homo sapiens
uuagacccgguccugc

SEQ ID NO: 1281726 - RNA, 15 nt, Homo sapiens
uuagaccgcucucuu

SEQ ID NO: 1281727 - RNA, 17 nt, Homo sapiens
uuagaccuguguuacua

SEQ ID NO: 1281728 - RNA, 18 nt, Homo sapiens
uuagacucaucuuacugu

SEQ ID NO: 1281729 - RNA, 22 nt, Homo sapiens
uuagacuggaaguucauaccua

SEQ ID NO: 1281730 - RNA, 16 nt, Homo sapiens
uuagagagggaccaug

SEQ ID NO: 1281731 - RNA, 22 nt, Homo sapiens
uuagagcagcuuugggauccca

SEQ ID NO: 1281732 - RNA, 20 nt, Homo sapiens
uuagagcuggcaccagaacu

SEQ ID NO: 1281733 - RNA, 20 nt, Homo sapiens
uuagauauuaggggggaaag

SEQ ID NO: 1281734 - RNA, 14 nt, Homo sapiens
uuagauguuucaca

SEQ ID NO: 1281735 - RNA, 17 nt, Homo sapiens
uuagcaauaacauacau

SEQ ID NO: 1281736 - RNA, 17 nt, Homo sapiens
uuagcaauugacuguca

SEQ ID NO: 1281737 - RNA, 14 nt, Homo sapiens
uuagcacacucaca

SEQ ID NO: 1281738 - RNA, 22 nt, Homo sapiens
uuagcacagauuuuaauuguca

SEQ ID NO: 1281739 - RNA, 22 nt, Homo sapiens
uuagcaguaacggguagcagca

SEQ ID NO: 1281740 - RNA, 16 nt, Homo sapiens
uuagcauguuguugaa

SEQ ID NO: 1281741 - RNA, 18 nt, Homo sapiens
uuagccagagaugcaaua

SEQ ID NO: 1281742 - RNA, 16 nt, Homo sapiens
uuagccauuucacucu

SEQ ID NO: 1281743 - RNA, 15 nt, Homo sapiens
uuagccccagggauc

SEQ ID NO: 1281744 - RNA, 19 nt, Homo sapiens
uuagccuaaauguuaacua

SEQ ID NO: 1281745 - RNA, 18 nt, Homo sapiens
uuagcuacacagugcaga

SEQ ID NO: 1281746 - RNA, 20 nt, Homo sapiens
uuagcugguggcaauaaaua

SEQ ID NO: 1281747 - RNA, 15 nt, Homo sapiens
uuagcugucugcuca

SEQ ID NO: 1281748 - RNA, 15 nt, Homo sapiens
uuagcuuguuccacu

SEQ ID NO: 1281749 - RNA, 14 nt, Homo sapiens
uuagcuuuacaaau

SEQ ID NO: 1281750 - RNA, 13 nt, Homo sapiens
uuaggagcagcuc

SEQ ID NO: 1281751 - RNA, 20 nt, Homo sapiens
uuaggauaaccuugugccuu

SEQ ID NO: 1281752 - RNA, 21 nt, Homo sapiens
uuaggauaaccuugugccuug

SEQ ID NO: 1281753 - RNA, 16 nt, Homo sapiens
uuaggcaccagaagaa

SEQ ID NO: 1281754 - RNA, 16 nt, Homo sapiens
uuagguaagacauaua

SEQ ID NO: 1281755 - RNA, 16 nt, Homo sapiens
uuaguaauuucuugcu

SEQ ID NO: 1281756 - RNA, 15 nt, Homo sapiens
uuaguauagccacaa

SEQ ID NO: 1281757 - RNA, 11 nt, Homo sapiens
uuaguauuuau

SEQ ID NO: 1281758 - RNA, 17 nt, Homo sapiens
uuagucaggaauggcug

SEQ ID NO: 1281759 - RNA, 21 nt, Homo sapiens
uuaguuucaaauuuaccucag

SEQ ID NO: 1281760 - RNA, 17 nt, Homo sapiens
uuaguuuccguuuccag

SEQ ID NO: 1281761 - RNA, 22 nt, Homo sapiens
uuaguuuuuguucuuaauugca

SEQ ID NO: 1281762 - RNA, 13 nt, Homo sapiens
uuauaaaaaaugg

SEQ ID NO: 1281763 - RNA, 20 nt, Homo sapiens
uuauaaaaaugagugcuuaa

SEQ ID NO: 1281764 - RNA, 13 nt, Homo sapiens
uuauaaaccuuca

SEQ ID NO: 1281765 - RNA, 16 nt, Homo sapiens
uuauaaaccuucagaa

SEQ ID NO: 1281766 - RNA, 12 nt, Homo sapiens
uuauaaauauca

SEQ ID NO: 1281767 - RNA, 21 nt, Homo sapiens
uuauaaauuucgcuucuuaga

SEQ ID NO: 1281768 - RNA, 14 nt, Homo sapiens
uuauaacagaauua

SEQ ID NO: 1281769 - RNA, 13 nt, Homo sapiens
uuauaacuguaaa

SEQ ID NO: 1281770 - RNA, 19 nt, Homo sapiens
uuauaagcauacaacugga

SEQ ID NO: 1281771 - RNA, 14 nt, Homo sapiens
uuauaagcauguau

SEQ ID NO: 1281772 - RNA, 12 nt, Homo sapiens
uuauaagcuaca

SEQ ID NO: 1281773 - RNA, 21 nt, Homo sapiens
uuauaagugaagugauacuau

SEQ ID NO: 1281774 - RNA, 22 nt, Homo sapiens
uuauaaugaauacuuucuuaga

SEQ ID NO: 1281775 - RNA, 18 nt, Homo sapiens
uuauaauuccuauauccu

SEQ ID NO: 1281776 - RNA, 16 nt, Homo sapiens
uuauacaaaagagcau

SEQ ID NO: 1281777 - RNA, 23 nt, Homo sapiens
uuauacagauagaguuccauaua

SEQ ID NO: 1281778 - RNA, 21 nt, Homo sapiens
uuauacugauuaugucuuuua

SEQ ID NO: 1281779 - RNA, 16 nt, Homo sapiens
uuauacuggguuucaa

SEQ ID NO: 1281780 - RNA, 19 nt, Homo sapiens
uuauacuguggcuaugcaa

SEQ ID NO: 1281781 - RNA, 20 nt, Homo sapiens
uuauagaaguagcaaaaagu

SEQ ID NO: 1281782 - RNA, 21 nt, Homo sapiens
uuauagaauauuuauuaccuc

SEQ ID NO: 1281783 - RNA, 23 nt, Homo sapiens
uuauaggaaaaguuauugugaua

SEQ ID NO: 1281784 - RNA, 14 nt, Homo sapiens
uuauaguaugugac

SEQ ID NO: 1281785 - RNA, 20 nt, Homo sapiens
uuauagugaauacugcuaca

SEQ ID NO: 1281786 - RNA, 12 nt, Homo sapiens
uuauauaauuca

SEQ ID NO: 1281787 - RNA, 14 nt, Homo sapiens
uuauauaauucaag

SEQ ID NO: 1281788 - RNA, 16 nt, Homo sapiens
uuauauauguaucuaa

SEQ ID NO: 1281789 - RNA, 14 nt, Homo sapiens
uuauaucaguuuca

SEQ ID NO: 1281790 - RNA, 15 nt, Homo sapiens
uuauaucauauguau

SEQ ID NO: 1281791 - RNA, 21 nt, Homo sapiens
uuauaugaccauauuuacucu

SEQ ID NO: 1281792 - RNA, 16 nt, Homo sapiens
uuauauggaugauuca

SEQ ID NO: 1281793 - RNA, 22 nt, Homo sapiens
uuauauguggacuaaauaucug

SEQ ID NO: 1281794 - RNA, 16 nt, Homo sapiens
uuauauguugcuauaa

SEQ ID NO: 1281795 - RNA, 21 nt, Homo sapiens
uuauauuaaaauaagcacugu

SEQ ID NO: 1281796 - RNA, 19 nt, Homo sapiens
uuauauugcaagcuccauc

SEQ ID NO: 1281797 - RNA, 23 nt, Homo sapiens
uuauauuuccaagaaauauuccu

SEQ ID NO: 1281798 - RNA, 18 nt, Homo sapiens
uuauauuuugugcuauca

SEQ ID NO: 1281799 - RNA, 23 nt, Homo sapiens
uuaucaaaaucuuucagcacuca

SEQ ID NO: 1281800 - RNA, 20 nt, Homo sapiens
uuaucaaacuucagcuguac

SEQ ID NO: 1281801 - RNA, 20 nt, Homo sapiens
uuaucaccucugauggcuga

SEQ ID NO: 1281802 - RNA, 12 nt, Homo sapiens
uuaucagcuuuc

SEQ ID NO: 1281803 - RNA, 14 nt, Homo sapiens
uuaucagcuuucag

SEQ ID NO: 1281804 - RNA, 14 nt, Homo sapiens
uuaucaguaagaaa

SEQ ID NO: 1281805 - RNA, 17 nt, Homo sapiens
uuauccacaacuuuuca

SEQ ID NO: 1281806 - RNA, 20 nt, Homo sapiens
uuauccacaggaaaguguua

SEQ ID NO: 1281807 - RNA, 20 nt, Homo sapiens
uuauccaucuuucacuaucu

SEQ ID NO: 1281808 - RNA, 17 nt, Homo sapiens
uuaucugucucuucuac

SEQ ID NO: 1281809 - RNA, 17 nt, Homo sapiens
uuaucuguuuccugaca

SEQ ID NO: 1281810 - RNA, 15 nt, Homo sapiens
uuaucuugacauuca

SEQ ID NO: 1281811 - RNA, 13 nt, Homo sapiens
uuaucuugggaua

SEQ ID NO: 1281812 - RNA, 22 nt, Homo sapiens
uuaugaaaugaccucuguccuc

SEQ ID NO: 1281813 - RNA, 14 nt, Homo sapiens
uuaugacaaugacu

SEQ ID NO: 1281814 - RNA, 12 nt, Homo sapiens
uuaugacuguuu

SEQ ID NO: 1281815 - RNA, 18 nt, Homo sapiens
uuaugagaaaguucucau

SEQ ID NO: 1281816 - RNA, 23 nt, Homo sapiens
uuaugagaggcaaugauuguuaa

SEQ ID NO: 1281817 - RNA, 15 nt, Homo sapiens
uuaugaugcauacag

SEQ ID NO: 1281818 - RNA, 18 nt, Homo sapiens
uuaugauggucugcauua

SEQ ID NO: 1281819 - RNA, 17 nt, Homo sapiens
uuaugccuucacuuuac

SEQ ID NO: 1281820 - RNA, 14 nt, Homo sapiens
uuaugcuuccacag

SEQ ID NO: 1281821 - RNA, 21 nt, Homo sapiens
uuauggaauaucaucugucau

SEQ ID NO: 1281822 - RNA, 13 nt, Homo sapiens
uuauguaaucuca

SEQ ID NO: 1281823 - RNA, 17 nt, Homo sapiens
uuauguagguaagacug

SEQ ID NO: 1281824 - RNA, 17 nt, Homo sapiens
uuaugucaccagaauau

SEQ ID NO: 1281825 - RNA, 18 nt, Homo sapiens
uuaugucuagaaaguaag

SEQ ID NO: 1281826 - RNA, 21 nt, Homo sapiens
uuaugucuauuuaagccucau

SEQ ID NO: 1281827 - RNA, 12 nt, Homo sapiens
uuaugugcuaua

SEQ ID NO: 1281828 - RNA, 16 nt, Homo sapiens
cucuacagacuccaaa

SEQ ID NO: 1281829 - RNA, 17 nt, Homo sapiens
cucuacagacuccaaaa

SEQ ID NO: 1281830 - RNA, 19 nt, Homo sapiens
cucuacagacuccaaaagg

SEQ ID NO: 1281831 - RNA, 20 nt, Homo sapiens
cucuacagacuccaaaaggc

SEQ ID NO: 1281832 - RNA, 15 nt, Homo sapiens
cucuacccacuucuc

SEQ ID NO: 1281833 - RNA, 12 nt, Homo sapiens
cucuacccugag

SEQ ID NO: 1281834 - RNA, 16 nt, Homo sapiens
cucuaguuauauugaa

SEQ ID NO: 1281835 - RNA, 19 nt, Homo sapiens
cucuccccguggacccugu

SEQ ID NO: 1281836 - RNA, 11 nt, Homo sapiens
cucugaaaugc

SEQ ID NO: 1281837 - RNA, 20 nt, Homo sapiens
cucugacaaagugugucuca

SEQ ID NO: 1281838 - RNA, 21 nt, Homo sapiens
cucugagcagugcuugaauga

SEQ ID NO: 1281839 - RNA, 21 nt, Homo sapiens
cucuggacacagccccaugua

SEQ ID NO: 1281840 - RNA, 19 nt, Homo sapiens
cucuguuuuguaagcuuua

SEQ ID NO: 1281841 - RNA, 19 nt, Homo sapiens
cucuuuaagggaguguacu

SEQ ID NO: 1281842 - RNA, 20 nt, Homo sapiens
cucuuuuauaacuugcauua

SEQ ID NO: 1281843 - RNA, 17 nt, Homo sapiens
cucuuuugaauccaugc

SEQ ID NO: 1281844 - RNA, 17 nt, Homo sapiens
cugaaaauuaacacugc

SEQ ID NO: 1281845 - RNA, 20 nt, Homo sapiens
cugaaacagccagaucucau

SEQ ID NO: 1281846 - RNA, 17 nt, Homo sapiens
cugaaagucaugcacau

SEQ ID NO: 1281847 - RNA, 21 nt, Homo sapiens
cugaacauugcacugauauca

SEQ ID NO: 1281848 - RNA, 23 nt, Homo sapiens
cugaauauuaagaaacaauuuaa

SEQ ID NO: 1281849 - RNA, 19 nt, Homo sapiens
cugacacaaaagaagaaau

SEQ ID NO: 1281850 - RNA, 21 nt, Homo sapiens
cugacacaaaagaagaaauaa

SEQ ID NO: 1281851 - RNA, 22 nt, Homo sapiens
cugacuccuuagagacaucaaa

SEQ ID NO: 1281852 - RNA, 12 nt, Homo sapiens
cugagacuugaa

SEQ ID NO: 1281853 - RNA, 19 nt, Homo sapiens
cugagcagguguucuucau

SEQ ID NO: 1281854 - RNA, 18 nt, Homo sapiens
cugaguaguugggauuac

SEQ ID NO: 1281855 - RNA, 16 nt, Homo sapiens
cugauaauguauugca

SEQ ID NO: 1281856 - RNA, 21 nt, Homo sapiens
cugauauuuacuggaaaccua

SEQ ID NO: 1281857 - RNA, 12 nt, Homo sapiens
cugcaagcauuu

SEQ ID NO: 1281858 - RNA, 15 nt, Homo sapiens
cugcaagcuuuucaa

SEQ ID NO: 1281859 - RNA, 20 nt, Homo sapiens
cugcagccucagagacauca

SEQ ID NO: 1281860 - RNA, 23 nt, Homo sapiens
cugcaggagagaaugcccaguga

SEQ ID NO: 1281861 - RNA, 16 nt, Homo sapiens
cugcauguaaaaucuu

SEQ ID NO: 1281862 - RNA, 22 nt, Homo sapiens
cugccaacacgcccggcuaauu

SEQ ID NO: 1281863 - RNA, 13 nt, Homo sapiens
cugccccaugcug

SEQ ID NO: 1281864 - RNA, 19 nt, Homo sapiens
cugccugcggaccagauga

SEQ ID NO: 1281865 - RNA, 19 nt, Homo sapiens
cugccugggccuguucacg

SEQ ID NO: 1281866 - RNA, 19 nt, Homo sapiens
cugccuugguauagcauau

SEQ ID NO: 1281867 - RNA, 14 nt, Homo sapiens
cugcugaagggagg

SEQ ID NO: 1281868 - RNA, 11 nt, Homo sapiens
cugcuguggaa

SEQ ID NO: 1281869 - RNA, 14 nt, Homo sapiens
cugcuuuaauuuca

SEQ ID NO: 1281870 - RNA, 16 nt, Homo sapiens
cuggaagcauggagca

SEQ ID NO: 1281871 - RNA, 14 nt, Homo sapiens
cuggaggagcccag

SEQ ID NO: 1281872 - RNA, 20 nt, Homo sapiens
cuggaucugugaggggcucu

SEQ ID NO: 1281873 - RNA, 19 nt, Homo sapiens
cuggcagggacgaggacaa

SEQ ID NO: 1281874 - RNA, 21 nt, Homo sapiens
cuggcggcaggaagccaaaga

SEQ ID NO: 1281875 - RNA, 22 nt, Homo sapiens
cuggcucugagagccccaggac

SEQ ID NO: 1281876 - RNA, 15 nt, Homo sapiens
cuggcugccccguga

SEQ ID NO: 1281877 - RNA, 16 nt, Homo sapiens
cuggcugccccgugac

SEQ ID NO: 1281878 - RNA, 16 nt, Homo sapiens
cugggagcuucucugc

SEQ ID NO: 1281879 - RNA, 21 nt, Homo sapiens
cugggagcuucucugcugcuu

SEQ ID NO: 1281880 - RNA, 20 nt, Homo sapiens
cugggauccgggaucaaagu

SEQ ID NO: 1281881 - RNA, 18 nt, Homo sapiens
cugggcaagggaccugcu

SEQ ID NO: 1281882 - RNA, 16 nt, Homo sapiens
cuggggacaccucagg

SEQ ID NO: 1281883 - RNA, 21 nt, Homo sapiens
cuggggaugucucucaugacc

SEQ ID NO: 1281884 - RNA, 16 nt, Homo sapiens
cuggggauuaccauuc

SEQ ID NO: 1281885 - RNA, 16 nt, Homo sapiens
cugguaucugcaugua

SEQ ID NO: 1281886 - RNA, 20 nt, Homo sapiens
cugguucucaucuuucuuga

SEQ ID NO: 1281887 - RNA, 20 nt, Homo sapiens
cugguuucccuuacagggcc

SEQ ID NO: 1281888 - RNA, 21 nt, Homo sapiens
cuguaaaugaagggucauuuc

SEQ ID NO: 1281889 - RNA, 13 nt, Homo sapiens
cuguaaauuuggc

SEQ ID NO: 1281890 - RNA, 22 nt, Homo sapiens
cuguacauaguccuuuuaucuc

SEQ ID NO: 1281891 - RNA, 14 nt, Homo sapiens
cuguauuucauucu

SEQ ID NO: 1281892 - RNA, 23 nt, Homo sapiens
cugucacaucagcuccacuuuca

SEQ ID NO: 1281893 - RNA, 22 nt, Homo sapiens
cuguccccacagcuucucuaca

SEQ ID NO: 1281894 - RNA, 17 nt, Homo sapiens
cuguccuugaaugccau

SEQ ID NO: 1281895 - RNA, 21 nt, Homo sapiens
cugugaggggcucucucauga

SEQ ID NO: 1281896 - RNA, 16 nt, Homo sapiens
cuguggccuucgucac

SEQ ID NO: 1281897 - RNA, 18 nt, Homo sapiens
cuguguacacgugacaga

SEQ ID NO: 1281898 - RNA, 14 nt, Homo sapiens
cuguguucugcaca

SEQ ID NO: 1281899 - RNA, 21 nt, Homo sapiens
cuguuccuuaugauauucuca

SEQ ID NO: 1281900 - RNA, 12 nt, Homo sapiens
cuguuugucaau

SEQ ID NO: 1281901 - RNA, 15 nt, Homo sapiens
cuuaaaaugcaauau

SEQ ID NO: 1281902 - RNA, 23 nt, Homo sapiens
cuuaacauuccuaaaaugcuuca

SEQ ID NO: 1281903 - RNA, 11 nt, Homo sapiens
cuuaaucacac

SEQ ID NO: 1281904 - RNA, 23 nt, Homo sapiens
cuuaaugguaggucaaguaauaa

SEQ ID NO: 1281905 - RNA, 16 nt, Homo sapiens
cuuacuuuacugccug

SEQ ID NO: 1281906 - RNA, 14 nt, Homo sapiens
cuuagaggcaaaga

SEQ ID NO: 1281907 - RNA, 21 nt, Homo sapiens
cuuaguguacaugaaagcgua

SEQ ID NO: 1281908 - RNA, 22 nt, Homo sapiens
cuuauauuuggcccaaacucau

SEQ ID NO: 1281909 - RNA, 18 nt, Homo sapiens
cuuaugccccugcacuga

SEQ ID NO: 1281910 - RNA, 23 nt, Homo sapiens
cuuauguuacagguuacgugaga

SEQ ID NO: 1281911 - RNA, 14 nt, Homo sapiens
cuuauucucaagaa

SEQ ID NO: 1281912 - RNA, 18 nt, Homo sapiens
cuucaaauuggucugaaa

SEQ ID NO: 1281913 - RNA, 14 nt, Homo sapiens
cuucaagcagggaa

SEQ ID NO: 1281914 - RNA, 23 nt, Homo sapiens
cuucaagccuagcccuucucuca

SEQ ID NO: 1281915 - RNA, 18 nt, Homo sapiens
cuucacacaguaaaagca

SEQ ID NO: 1281916 - RNA, 14 nt, Homo sapiens
cuucagauuugccu

SEQ ID NO: 1281917 - RNA, 22 nt, Homo sapiens
cuucagcccucaccccugguuc

SEQ ID NO: 1281918 - RNA, 21 nt, Homo sapiens
cuucagcucuucuugacauca

SEQ ID NO: 1281919 - RNA, 21 nt, Homo sapiens
cuuccaaacagaacuauggaa

SEQ ID NO: 1281920 - RNA, 16 nt, Homo sapiens
cuuccagagucaucua

SEQ ID NO: 1281921 - RNA, 20 nt, Homo sapiens
cuucccaggaguacacccca

SEQ ID NO: 1281922 - RNA, 13 nt, Homo sapiens
cuuccucacacca

SEQ ID NO: 1281923 - RNA, 15 nt, Homo sapiens
cuucuacagaagcca

SEQ ID NO: 1281924 - RNA, 19 nt, Homo sapiens
cuucucagccacaaacccu

SEQ ID NO: 1281925 - RNA, 21 nt, Homo sapiens
cuucucuacagacuccaaaag

SEQ ID NO: 1281926 - RNA, 22 nt, Homo sapiens
cuucucuacagacuccaaaagg

SEQ ID NO: 1281927 - RNA, 22 nt, Homo sapiens
cuucuggggacaccucaggagc

SEQ ID NO: 1281928 - RNA, 19 nt, Homo sapiens
cuucuuacaugcauuugag

SEQ ID NO: 1281929 - RNA, 19 nt, Homo sapiens
cuucuuugauaauguuaaa

SEQ ID NO: 1281930 - RNA, 15 nt, Homo sapiens
cuugaaugcagggac

SEQ ID NO: 1281931 - RNA, 21 nt, Homo sapiens
cuugaaugccauagucaaaga

SEQ ID NO: 1281932 - RNA, 17 nt, Homo sapiens
cuugacagaacacuguc

SEQ ID NO: 1281933 - RNA, 15 nt, Homo sapiens
cuugaucauucucag

SEQ ID NO: 1281934 - RNA, 21 nt, Homo sapiens
cuugauccacuucucucagga

SEQ ID NO: 1281935 - RNA, 12 nt, Homo sapiens
cuugcacaaaca

SEQ ID NO: 1281936 - RNA, 14 nt, Homo sapiens
cuugcacuauucca

SEQ ID NO: 1281937 - RNA, 14 nt, Homo sapiens
cuugccugcaggca

SEQ ID NO: 1281938 - RNA, 15 nt, Homo sapiens
cuuggcccuccucag

SEQ ID NO: 1281939 - RNA, 22 nt, Homo sapiens
gucaaggauggaugcagaucca

SEQ ID NO: 1281940 - RNA, 15 nt, Homo sapiens
gucaauagcaugcaa

SEQ ID NO: 1281941 - RNA, 12 nt, Homo sapiens
gucaaugaacuu

SEQ ID NO: 1281942 - RNA, 12 nt, Homo sapiens
gucacauugccu

SEQ ID NO: 1281943 - RNA, 15 nt, Homo sapiens
gucacuguaugugaa

SEQ ID NO: 1281944 - RNA, 13 nt, Homo sapiens
gucacuucaccau

SEQ ID NO: 1281945 - RNA, 23 nt, Homo sapiens
gucaucaauaguguccuaugcaa

SEQ ID NO: 1281946 - RNA, 14 nt, Homo sapiens
gucaucuaccugag

SEQ ID NO: 1281947 - RNA, 20 nt, Homo sapiens
gucaugcauaaauaugcagu

SEQ ID NO: 1281948 - RNA, 21 nt, Homo sapiens
gucauuguaaccucgugucua

SEQ ID NO: 1281949 - RNA, 14 nt, Homo sapiens
guccaccaccaccu

SEQ ID NO: 1281950 - RNA, 23 nt, Homo sapiens
gucccagaaugccuccugcaggg

SEQ ID NO: 1281951 - RNA, 21 nt, Homo sapiens
guccgcuuucaugaacacagc

SEQ ID NO: 1281952 - RNA, 19 nt, Homo sapiens
guccuccacgccauuuccu

SEQ ID NO: 1281953 - RNA, 12 nt, Homo sapiens
guccuccuccag

SEQ ID NO: 1281954 - RNA, 14 nt, Homo sapiens
gucggugccuucaa

SEQ ID NO: 1281955 - RNA, 23 nt, Homo sapiens
gucguguaauuggcccaagucau

SEQ ID NO: 1281956 - RNA, 19 nt, Homo sapiens
gucuggcaaacaugugcaa

SEQ ID NO: 1281957 - RNA, 13 nt, Homo sapiens
gugaaacuaacag

SEQ ID NO: 1281958 - RNA, 20 nt, Homo sapiens
gugaaauaaaaguagaauaa

SEQ ID NO: 1281959 - RNA, 20 nt, Homo sapiens
gugaagagggagaagcauga

SEQ ID NO: 1281960 - RNA, 17 nt, Homo sapiens
gugaggggcucucucau

SEQ ID NO: 1281961 - RNA, 13 nt, Homo sapiens
gugaugugcaaag

SEQ ID NO: 1281962 - RNA, 16 nt, Homo sapiens
gugccaggauggaaug

SEQ ID NO: 1281963 - RNA, 18 nt, Homo sapiens
gugccauaaaaugugcuu

SEQ ID NO: 1281964 - RNA, 18 nt, Homo sapiens
gugcuaaacgcacacagu

SEQ ID NO: 1281965 - RNA, 15 nt, Homo sapiens
gugcuggucauacau

SEQ ID NO: 1281966 - RNA, 18 nt, Homo sapiens
gugcuuaaaaaucauuga

SEQ ID NO: 1281967 - RNA, 22 nt, Homo sapiens
guggcuggaucugugaggggcu

SEQ ID NO: 1281968 - RNA, 17 nt, Homo sapiens
gugggaccacagacuca

SEQ ID NO: 1281969 - RNA, 12 nt, Homo sapiens
gugggggguccc

SEQ ID NO: 1281970 - RNA, 18 nt, Homo sapiens
gugguaaagugaacaaaa

SEQ ID NO: 1281971 - RNA, 21 nt, Homo sapiens
guguauucuuaaaaugcaaua

SEQ ID NO: 1281972 - RNA, 18 nt, Homo sapiens
gugucaacuuucauuuga

SEQ ID NO: 1281973 - RNA, 13 nt, Homo sapiens
gugucacccuuag

SEQ ID NO: 1281974 - RNA, 15 nt, Homo sapiens
guguccgcuuucaug

SEQ ID NO: 1281975 - RNA, 11 nt, Homo sapiens
gugucugcaac

SEQ ID NO: 1281976 - RNA, 22 nt, Homo sapiens
gugucuggucuguuggcccugc

SEQ ID NO: 1281977 - RNA, 16 nt, Homo sapiens
gugugggaguguguaa

SEQ ID NO: 1281978 - RNA, 13 nt, Homo sapiens
guguguguguaug

SEQ ID NO: 1281979 - RNA, 17 nt, Homo sapiens
guguugacaugugcuuu

SEQ ID NO: 1281980 - RNA, 11 nt, Homo sapiens
guuaaugccau

SEQ ID NO: 1281981 - RNA, 15 nt, Homo sapiens
guuacacagugugaa

SEQ ID NO: 1281982 - RNA, 18 nt, Homo sapiens
guuaccugaucaaugaca

SEQ ID NO: 1281983 - RNA, 17 nt, Homo sapiens
guuaggccauucuugca

SEQ ID NO: 1281984 - RNA, 20 nt, Homo sapiens
guucaccuguguacugagua

SEQ ID NO: 1281985 - RNA, 17 nt, Homo sapiens
guucacugaggggcccu

SEQ ID NO: 1281986 - RNA, 13 nt, Homo sapiens
guucuacuugaua

SEQ ID NO: 1281987 - RNA, 18 nt, Homo sapiens
guugauccaucucaguca

SEQ ID NO: 1281988 - RNA, 16 nt, Homo sapiens
guuggaaaaugugcaa

SEQ ID NO: 1281989 - RNA, 18 nt, Homo sapiens
guuggaaaaugugcaaua

SEQ ID NO: 1281990 - RNA, 22 nt, Homo sapiens
guuggcgggggcuuggcugugc

SEQ ID NO: 1281991 - RNA, 22 nt, Homo sapiens
guuguagacuauggaaugucag

SEQ ID NO: 1281992 - RNA, 15 nt, Homo sapiens
guuguauaaccaaua

SEQ ID NO: 1281993 - RNA, 18 nt, Homo sapiens
guuuauuuaaaaugccua

SEQ ID NO: 1281994 - RNA, 21 nt, Homo sapiens
guuuauuuuauuuucuucauu

SEQ ID NO: 1281995 - RNA, 22 nt, Homo sapiens
guuucucucacauuacuguaua

SEQ ID NO: 1281996 - RNA, 23 nt, Homo sapiens
guuucuggcagccaguaccuccu

SEQ ID NO: 1281997 - RNA, 23 nt, Homo sapiens
guuucuuuagcaguuuugugaua

SEQ ID NO: 1281998 - RNA, 21 nt, Homo sapiens
guuugaacucuucuuugccag

SEQ ID NO: 1281999 - RNA, 18 nt, Homo sapiens
guuugaucauagaauugu

SEQ ID NO: 1282000 - RNA, 15 nt, Homo sapiens
guuuuaaacauucuu

SEQ ID NO: 1282001 - RNA, 15 nt, Homo sapiens
guuuucuaauaucuu

SEQ ID NO: 1282002 - RNA, 23 nt, Homo sapiens
guuuuuuucccucuccuguccuu

SEQ ID NO: 1282003 - RNA, 22 nt, Homo sapiens
uaaaaagagcuguccugguauc

SEQ ID NO: 1282004 - RNA, 14 nt, Homo sapiens
uaaaaauacauuuu

SEQ ID NO: 1282005 - RNA, 15 nt, Homo sapiens
uaaaacagauauuau

SEQ ID NO: 1282006 - RNA, 22 nt, Homo sapiens
uaaaagcaagaucuacuacauc

SEQ ID NO: 1282007 - RNA, 20 nt, Homo sapiens
uaaaauauuuuuaugugcaa

SEQ ID NO: 1282008 - RNA, 12 nt, Homo sapiens
uaaaaucuugca

SEQ ID NO: 1282009 - RNA, 12 nt, Homo sapiens
uaaaaugcaaua

SEQ ID NO: 1282010 - RNA, 15 nt, Homo sapiens
uaaaaugugcuucuc

SEQ ID NO: 1282011 - RNA, 18 nt, Homo sapiens
uaaacaaauguaugauua

SEQ ID NO: 1282012 - RNA, 22 nt, Homo sapiens
uaaaccaauuuuuuauucauuu

SEQ ID NO: 1282013 - RNA, 13 nt, Homo sapiens
uaaacuaguuuaa

SEQ ID NO: 1282014 - RNA, 19 nt, Homo sapiens
uaaagagagaauguagaua

SEQ ID NO: 1282015 - RNA, 20 nt, Homo sapiens
uaaagagagaauguagauau

SEQ ID NO: 1282016 - RNA, 12 nt, Homo sapiens
uaaagccuucaa

SEQ ID NO: 1282017 - RNA, 16 nt, Homo sapiens
uaaagcuugauuugau

SEQ ID NO: 1282018 - RNA, 17 nt, Homo sapiens
uaaaggacaaacaguga

SEQ ID NO: 1282019 - RNA, 22 nt, Homo sapiens
uaaaggcuuuuggcagcaaagu

SEQ ID NO: 1282020 - RNA, 14 nt, Homo sapiens
uaaaguauguccuu

SEQ ID NO: 1282021 - RNA, 17 nt, Homo sapiens
uaaaguauuuaagguac

SEQ ID NO: 1282022 - RNA, 14 nt, Homo sapiens
uaaagugacagaug

SEQ ID NO: 1282023 - RNA, 12 nt, Homo sapiens
uaaagugcugcg

SEQ ID NO: 1282024 - RNA, 18 nt, Homo sapiens
uaaauauuuauguagaug

SEQ ID NO: 1282025 - RNA, 15 nt, Homo sapiens
uaaaugaaugcacaa

SEQ ID NO: 1282026 - RNA, 12 nt, Homo sapiens
uaaaugcucaua

SEQ ID NO: 1282027 - RNA, 20 nt, Homo sapiens
uaaauggacaaaugcuuaug

SEQ ID NO: 1282028 - RNA, 18 nt, Homo sapiens
uaaauggauaaguagaau

SEQ ID NO: 1282029 - RNA, 13 nt, Homo sapiens
uaaauggauauua

SEQ ID NO: 1282030 - RNA, 18 nt, Homo sapiens
uaaauggcauaccaaaau

SEQ ID NO: 1282031 - RNA, 16 nt, Homo sapiens
uaaauguuuucauugg

SEQ ID NO: 1282032 - RNA, 22 nt, Homo sapiens
uaaauucucucuaacauaacaa

SEQ ID NO: 1282033 - RNA, 21 nt, Homo sapiens
uaaauugcauuucuaugccau

SEQ ID NO: 1282034 - RNA, 15 nt, Homo sapiens
uaaauuuaugugaug

SEQ ID NO: 1282035 - RNA, 20 nt, Homo sapiens
uaaauuuguaaguuucaggu

SEQ ID NO: 1282036 - RNA, 23 nt, Homo sapiens
uaacagauaauagcaacuuggga

SEQ ID NO: 1282037 - RNA, 22 nt, Homo sapiens
uaacagcuuucuuauucaguga

SEQ ID NO: 1282038 - RNA, 13 nt, Homo sapiens
uaacauuaccuua

SEQ ID NO: 1282039 - RNA, 23 nt, Homo sapiens
uaaccaguuuagcuuuuuccuua

SEQ ID NO: 1282040 - RNA, 17 nt, Homo sapiens
uaacuaaaugcucauac

SEQ ID NO: 1282041 - RNA, 18 nt, Homo sapiens
uaacuauuuuuuuaguua

SEQ ID NO: 1282042 - RNA, 13 nt, Homo sapiens
uaacucauagauu

SEQ ID NO: 1282043 - RNA, 19 nt, Homo sapiens
uaacuuuuuaaaacacaac

SEQ ID NO: 1282044 - RNA, 13 nt, Homo sapiens
uaagacuacugaa

SEQ ID NO: 1282045 - RNA, 11 nt, Homo sapiens
uaagagcaaaa

SEQ ID NO: 1282046 - RNA, 13 nt, Homo sapiens
uaagaugaucauc

SEQ ID NO: 1282047 - RNA, 15 nt, Homo sapiens
uaagguaauguaggg

SEQ ID NO: 1282048 - RNA, 12 nt, Homo sapiens
uaauauugcaag

SEQ ID NO: 1282049 - RNA, 21 nt, Homo sapiens
uaaucuccacccaaugaauga

SEQ ID NO: 1282050 - RNA, 16 nt, Homo sapiens
uaaucugagaggccac

SEQ ID NO: 1282051 - RNA, 23 nt, Homo sapiens
agcaugagauuugggcaggaaca

SEQ ID NO: 1282052 - RNA, 21 nt, Homo sapiens
agcauuuuacaagaucuugca

SEQ ID NO: 1282053 - RNA, 15 nt, Homo sapiens
agccaagccagucaa

SEQ ID NO: 1282054 - RNA, 13 nt, Homo sapiens
agccagugcucag

SEQ ID NO: 1282055 - RNA, 18 nt, Homo sapiens
agccaguuaaaauguguu

SEQ ID NO: 1282056 - RNA, 15 nt, Homo sapiens
agccauuuugugaau

SEQ ID NO: 1282057 - RNA, 14 nt, Homo sapiens
agcccaugaucuuc

SEQ ID NO: 1282058 - RNA, 19 nt, Homo sapiens
agccccucuggacacagcc

SEQ ID NO: 1282059 - RNA, 23 nt, Homo sapiens
agcccgggucaucuguaccucug

SEQ ID NO: 1282060 - RNA, 21 nt, Homo sapiens
agcccucaccccugguucuca

SEQ ID NO: 1282061 - RNA, 16 nt, Homo sapiens
agccugccucuuccag

SEQ ID NO: 1282062 - RNA, 18 nt, Homo sapiens
agccuuggcucuacccug

SEQ ID NO: 1282063 - RNA, 22 nt, Homo sapiens
agcuaagugaauuuuugcacau

SEQ ID NO: 1282064 - RNA, 16 nt, Homo sapiens
agcuacuaaugauguu

SEQ ID NO: 1282065 - RNA, 19 nt, Homo sapiens
agcucaggcagcucgaggc

SEQ ID NO: 1282066 - RNA, 14 nt, Homo sapiens
agcucuaucugcaa

SEQ ID NO: 1282067 - RNA, 17 nt, Homo sapiens
agcucucaguugcagcc

SEQ ID NO: 1282068 - RNA, 14 nt, Homo sapiens
agcugggagcacag

SEQ ID NO: 1282069 - RNA, 16 nt, Homo sapiens
agcuggugguaucuga

SEQ ID NO: 1282070 - RNA, 13 nt, Homo sapiens
agcuucaaaaacu

SEQ ID NO: 1282071 - RNA, 15 nt, Homo sapiens
agcuucucauccugc

SEQ ID NO: 1282072 - RNA, 17 nt, Homo sapiens
agcuucucugcugcuua

SEQ ID NO: 1282073 - RNA, 17 nt, Homo sapiens
agcuugcuuaaggcaua

SEQ ID NO: 1282074 - RNA, 15 nt, Homo sapiens
agcuuuacucauggc

SEQ ID NO: 1282075 - RNA, 19 nt, Homo sapiens
agcuuuccucaucaggcca

SEQ ID NO: 1282076 - RNA, 18 nt, Homo sapiens
agcuuuuuccuuacuuuu

SEQ ID NO: 1282077 - RNA, 16 nt, Homo sapiens
aggaaaaccgaauuag

SEQ ID NO: 1282078 - RNA, 15 nt, Homo sapiens
aggaaccuaauugaa

SEQ ID NO: 1282079 - RNA, 21 nt, Homo sapiens
aggaagacccaacacauggga

SEQ ID NO: 1282080 - RNA, 16 nt, Homo sapiens
aggaaguaugguuuua

SEQ ID NO: 1282081 - RNA, 18 nt, Homo sapiens
aggaaguaugguuuuauu

SEQ ID NO: 1282082 - RNA, 19 nt, Homo sapiens
aggaauauuaaagggauuc

SEQ ID NO: 1282083 - RNA, 21 nt, Homo sapiens
aggaauauuugcaagacauag

SEQ ID NO: 1282084 - RNA, 17 nt, Homo sapiens
aggaauuaaguuaggga

SEQ ID NO: 1282085 - RNA, 13 nt, Homo sapiens
aggacacaucucc

SEQ ID NO: 1282086 - RNA, 16 nt, Homo sapiens
aggacccugggaccac

SEQ ID NO: 1282087 - RNA, 15 nt, Homo sapiens
aggagccuaggccag

SEQ ID NO: 1282088 - RNA, 15 nt, Homo sapiens
aggagucccugccau

SEQ ID NO: 1282089 - RNA, 20 nt, Homo sapiens
aggauacugaggcacacaga

SEQ ID NO: 1282090 - RNA, 18 nt, Homo sapiens
aggauccccucucuuccu

SEQ ID NO: 1282091 - RNA, 15 nt, Homo sapiens
aggcaggcacuucac

SEQ ID NO: 1282092 - RNA, 22 nt, Homo sapiens
aggcaggcacuucacacaguaa

SEQ ID NO: 1282093 - RNA, 16 nt, Homo sapiens
aggcauccuuccucac

SEQ ID NO: 1282094 - RNA, 17 nt, Homo sapiens
aggccacagugcaauuu

SEQ ID NO: 1282095 - RNA, 16 nt, Homo sapiens
aggccaggcagauccc

SEQ ID NO: 1282096 - RNA, 17 nt, Homo sapiens
aggccauggauggaaaa

SEQ ID NO: 1282097 - RNA, 15 nt, Homo sapiens
aggccauucuugcau

SEQ ID NO: 1282098 - RNA, 15 nt, Homo sapiens
aggcccuagacucau

SEQ ID NO: 1282099 - RNA, 19 nt, Homo sapiens
aggcgggcgcacugccucu

SEQ ID NO: 1282100 - RNA, 23 nt, Homo sapiens
aggcucuuccguuccacauccac

SEQ ID NO: 1282101 - RNA, 14 nt, Homo sapiens
aggcugucuaccug

SEQ ID NO: 1282102 - RNA, 15 nt, Homo sapiens
aggcugucuaccuga

SEQ ID NO: 1282103 - RNA, 18 nt, Homo sapiens
aggcuuaaucacaccguc

SEQ ID NO: 1282104 - RNA, 16 nt, Homo sapiens
aggcuuucuguugcca

SEQ ID NO: 1282105 - RNA, 21 nt, Homo sapiens
agggaacccucuaagggaccu

SEQ ID NO: 1282106 - RNA, 22 nt, Homo sapiens
agggaaguuuccagaaagaaga

SEQ ID NO: 1282107 - RNA, 22 nt, Homo sapiens
agggaauucagugggaccaaug

SEQ ID NO: 1282108 - RNA, 18 nt, Homo sapiens
agggagcugcaggggcau

SEQ ID NO: 1282109 - RNA, 23 nt, Homo sapiens
agggcagggcugaggccucucau

SEQ ID NO: 1282110 - RNA, 19 nt, Homo sapiens
agggcauuguguucacugu

SEQ ID NO: 1282111 - RNA, 16 nt, Homo sapiens
agggcuuccuaaaaau

SEQ ID NO: 1282112 - RNA, 11 nt, Homo sapiens
aggggccagaa

SEQ ID NO: 1282113 - RNA, 17 nt, Homo sapiens
aggguaguaagaauuag

SEQ ID NO: 1282114 - RNA, 23 nt, Homo sapiens
agggucuucuuacaugcauuuga

SEQ ID NO: 1282115 - RNA, 20 nt, Homo sapiens
agggugggauuaaguacaag

SEQ ID NO: 1282116 - RNA, 21 nt, Homo sapiens
agguaucugguaucugcaugu

SEQ ID NO: 1282117 - RNA, 21 nt, Homo sapiens
aggugacaugugaaaccuuuu

SEQ ID NO: 1282118 - RNA, 18 nt, Homo sapiens
aggugagcaggugaugcc

SEQ ID NO: 1282119 - RNA, 20 nt, Homo sapiens
agguguucuucauuaccuca

SEQ ID NO: 1282120 - RNA, 13 nt, Homo sapiens
aguaaaagcagga

SEQ ID NO: 1282121 - RNA, 12 nt, Homo sapiens
aguaaaccacaa

SEQ ID NO: 1282122 - RNA, 12 nt, Homo sapiens
aguaaacugugc

SEQ ID NO: 1282123 - RNA, 20 nt, Homo sapiens
aguaauuuuaaguaauuuca

SEQ ID NO: 1282124 - RNA, 16 nt, Homo sapiens
aguacaccccaacagc

SEQ ID NO: 1282125 - RNA, 14 nt, Homo sapiens
aguacagacuuuuu

SEQ ID NO: 1282126 - RNA, 14 nt, Homo sapiens
aguaucaaacuacu

SEQ ID NO: 1282127 - RNA, 15 nt, Homo sapiens
aguauguggaagugu

SEQ ID NO: 1282128 - RNA, 23 nt, Homo sapiens
agucaaggauggaugcagaucca

SEQ ID NO: 1282129 - RNA, 18 nt, Homo sapiens
agucaccagccagaggau

SEQ ID NO: 1282130 - RNA, 17 nt, Homo sapiens
agucacucacuauugca

SEQ ID NO: 1282131 - RNA, 22 nt, Homo sapiens
agucacuuuuuccccugcaaug

SEQ ID NO: 1282132 - RNA, 17 nt, Homo sapiens
agucccugccaucaugu

SEQ ID NO: 1282133 - RNA, 17 nt, Homo sapiens
agucuggcaaacaugug

SEQ ID NO: 1282134 - RNA, 21 nt, Homo sapiens
agucuggcaaacaugugcaac

SEQ ID NO: 1282135 - RNA, 13 nt, Homo sapiens
agucuggcucugu

SEQ ID NO: 1282136 - RNA, 22 nt, Homo sapiens
agugacauaauuguccaguuau

SEQ ID NO: 1282137 - RNA, 16 nt, Homo sapiens
agugcccccaacagca

SEQ ID NO: 1282138 - RNA, 15 nt, Homo sapiens
agugcuauuguagag

SEQ ID NO: 1282139 - RNA, 18 nt, Homo sapiens
agugcuucuuguaauauu

SEQ ID NO: 1282140 - RNA, 21 nt, Homo sapiens
agugcuugauugcguggaauu

SEQ ID NO: 1282141 - RNA, 14 nt, Homo sapiens
aguggcuucacucc

SEQ ID NO: 1282142 - RNA, 14 nt, Homo sapiens
aguguccuaugcaa

SEQ ID NO: 1282143 - RNA, 15 nt, Homo sapiens
aguguugcucucuag

SEQ ID NO: 1282144 - RNA, 18 nt, Homo sapiens
auaaucacaacccuucag

SEQ ID NO: 1282145 - RNA, 15 nt, Homo sapiens
auaaugaacacucau

SEQ ID NO: 1282146 - RNA, 19 nt, Homo sapiens
auaauuugucuuaguugau

SEQ ID NO: 1282147 - RNA, 15 nt, Homo sapiens
auacaauauauagcu

SEQ ID NO: 1282148 - RNA, 15 nt, Homo sapiens
auacacacuuuccaa

SEQ ID NO: 1282149 - RNA, 16 nt, Homo sapiens
auacacaucucuguca

SEQ ID NO: 1282150 - RNA, 16 nt, Homo sapiens
auacaggcuagggaug

SEQ ID NO: 1282151 - RNA, 20 nt, Homo sapiens
auaccuggcccugugccuug

SEQ ID NO: 1282152 - RNA, 13 nt, Homo sapiens
auacggugggggu

SEQ ID NO: 1282153 - RNA, 21 nt, Homo sapiens
auagaagaugggaaaaccaug

SEQ ID NO: 1282154 - RNA, 22 nt, Homo sapiens
auaggaaaccacacagacuugg

SEQ ID NO: 1282155 - RNA, 13 nt, Homo sapiens
auagucacccggg

SEQ ID NO: 1282156 - RNA, 11 nt, Homo sapiens
auaguguaaac

SEQ ID NO: 1282157 - RNA, 10 nt, Homo sapiens
auagugucuu

SEQ ID NO: 1282158 - RNA, 16 nt, Homo sapiens
auauaaagaaauaccu

SEQ ID NO: 1282159 - RNA, 17 nt, Homo sapiens
auauaaagaaauaccug

SEQ ID NO: 1282160 - RNA, 23 nt, Homo sapiens
auauaagucuugguaacaaauaa

SEQ ID NO: 1282161 - RNA, 15 nt, Homo sapiens
auauacaagcuacag

SEQ ID NO: 1282162 - RNA, 22 nt, Homo sapiens
auauacuauaugaaaagagcaa

SEQ ID NO: 1282163 - RNA, 22 nt, Homo sapiens
auauagauagauaauguucucc

SEQ ID NO: 1282164 - RNA, 17 nt, Homo sapiens
auauauggcauuugcag

SEQ ID NO: 1282165 - RNA, 18 nt, Homo sapiens
auauauggcauuugcaga

SEQ ID NO: 1282166 - RNA, 20 nt, Homo sapiens
auaucaguuuuuacuuucuc

SEQ ID NO: 1282167 - RNA, 17 nt, Homo sapiens
auaugaaaagagcaaaa

SEQ ID NO: 1282168 - RNA, 16 nt, Homo sapiens
auauggcagugucuuu

SEQ ID NO: 1282169 - RNA, 15 nt, Homo sapiens
auauuaccuaaugaa

SEQ ID NO: 1282170 - RNA, 12 nt, Homo sapiens
auauucauauaa

SEQ ID NO: 1282171 - RNA, 19 nt, Homo sapiens
auauuuuuaugugcaauaa

SEQ ID NO: 1282172 - RNA, 16 nt, Homo sapiens
aucaaacuacugccau

SEQ ID NO: 1282173 - RNA, 20 nt, Homo sapiens
aucaaggcucuuccguucca

SEQ ID NO: 1282174 - RNA, 12 nt, Homo sapiens
aucaagucagca

SEQ ID NO: 1282175 - RNA, 21 nt, Homo sapiens
aucaauaguguccuaugcaau

SEQ ID NO: 1282176 - RNA, 16 nt, Homo sapiens
aucaaugaaaugaugu

SEQ ID NO: 1282177 - RNA, 18 nt, Homo sapiens
aucaaugaaaugauguca

SEQ ID NO: 1282178 - RNA, 21 nt, Homo sapiens
aucaauucuauuacgugcaau

SEQ ID NO: 1282179 - RNA, 22 nt, Homo sapiens
aucaauucuauuacgugcaaua

SEQ ID NO: 1282180 - RNA, 19 nt, Homo sapiens
aucacaucuaaagcuuuau

SEQ ID NO: 1282181 - RNA, 13 nt, Homo sapiens
aucagagagggaa

SEQ ID NO: 1282182 - RNA, 15 nt, Homo sapiens
aucagcuaaguugca

SEQ ID NO: 1282183 - RNA, 14 nt, Homo sapiens
aucauguuacuuga

SEQ ID NO: 1282184 - RNA, 15 nt, Homo sapiens
aucauuaucagccug

SEQ ID NO: 1282185 - RNA, 15 nt, Homo sapiens
aucauucucaguauc

SEQ ID NO: 1282186 - RNA, 19 nt, Homo sapiens
auccaaaugcugugcaaac

SEQ ID NO: 1282187 - RNA, 18 nt, Homo sapiens
auccacuucucucaggau

SEQ ID NO: 1282188 - RNA, 19 nt, Homo sapiens
auccauggggcugauugua

SEQ ID NO: 1282189 - RNA, 20 nt, Homo sapiens
aucccagcaagcgagcuuua

SEQ ID NO: 1282190 - RNA, 17 nt, Homo sapiens
aucccauuugcccuccu

SEQ ID NO: 1282191 - RNA, 19 nt, Homo sapiens
aucccccgcugguggcaga

SEQ ID NO: 1282192 - RNA, 15 nt, Homo sapiens
auccccucucuuccu

SEQ ID NO: 1282193 - RNA, 15 nt, Homo sapiens
auccgggaucaaagu

SEQ ID NO: 1282194 - RNA, 21 nt, Homo sapiens
auccgucuaguuaacauuuca

SEQ ID NO: 1282195 - RNA, 23 nt, Homo sapiens
auccuucaucaugucaguuccaa

SEQ ID NO: 1282196 - RNA, 22 nt, Homo sapiens
auccuuguuuucuaacuuuaug

SEQ ID NO: 1282197 - RNA, 17 nt, Homo sapiens
aucuacccagucaugua

SEQ ID NO: 1282198 - RNA, 13 nt, Homo sapiens
aucuagcauuuau

SEQ ID NO: 1282199 - RNA, 22 nt, Homo sapiens
aucucaugagaagucacucacu

SEQ ID NO: 1282200 - RNA, 21 nt, Homo sapiens
aucuccaguuuauagaccaga

SEQ ID NO: 1282201 - RNA, 15 nt, Homo sapiens
aucuccucagcaccc

SEQ ID NO: 1282202 - RNA, 13 nt, Homo sapiens
aucuccugaccuc

SEQ ID NO: 1282203 - RNA, 20 nt, Homo sapiens
aucucggcucacugcaagcu

SEQ ID NO: 1282204 - RNA, 21 nt, Homo sapiens
aucucuuuugaauccaugcuu

SEQ ID NO: 1282205 - RNA, 20 nt, Homo sapiens
aucugaguugacuugacaga

SEQ ID NO: 1282206 - RNA, 19 nt, Homo sapiens
aucuuuguagacuguuccu

SEQ ID NO: 1282207 - RNA, 23 nt, Homo sapiens
aucuuuguguaaucuaaguauau

SEQ ID NO: 1282208 - RNA, 20 nt, Homo sapiens
aucuuuguuuaaaugccaaa

SEQ ID NO: 1282209 - RNA, 15 nt, Homo sapiens
augaaaagagguuua

SEQ ID NO: 1282210 - RNA, 20 nt, Homo sapiens
augaaaagauuaugaucuca

SEQ ID NO: 1282211 - RNA, 11 nt, Homo sapiens
augaaacuggu

SEQ ID NO: 1282212 - RNA, 16 nt, Homo sapiens
augaacagacugaccu

SEQ ID NO: 1282213 - RNA, 15 nt, Homo sapiens
augaauuugacuggu

SEQ ID NO: 1282214 - RNA, 18 nt, Homo sapiens
augaauuugacugguuca

SEQ ID NO: 1282215 - RNA, 14 nt, Homo sapiens
augaccgacugcac

SEQ ID NO: 1282216 - RNA, 12 nt, Homo sapiens
augacuaaagag

SEQ ID NO: 1282217 - RNA, 21 nt, Homo sapiens
augacugagucuggcaaacau

SEQ ID NO: 1282218 - RNA, 16 nt, Homo sapiens
augagaaguacuuugu

SEQ ID NO: 1282219 - RNA, 22 nt, Homo sapiens
augaggucauagcagugcuuga

SEQ ID NO: 1282220 - RNA, 16 nt, Homo sapiens
augagguggagagugg

SEQ ID NO: 1282221 - RNA, 13 nt, Homo sapiens
augauauucucau

SEQ ID NO: 1282222 - RNA, 19 nt, Homo sapiens
augaucaaaaauaaugcau

SEQ ID NO: 1282223 - RNA, 13 nt, Homo sapiens
augaucuuuucaa

SEQ ID NO: 1282224 - RNA, 18 nt, Homo sapiens
augaugugggucaaggaa

SEQ ID NO: 1282225 - RNA, 16 nt, Homo sapiens
augauucaaauaucaa

SEQ ID NO: 1282226 - RNA, 21 nt, Homo sapiens
augauucuuuguuacaggcac

SEQ ID NO: 1282227 - RNA, 19 nt, Homo sapiens
augauuucagaaauguuaa

SEQ ID NO: 1282228 - RNA, 22 nt, Homo sapiens
augauuuuuguguauccaguau

SEQ ID NO: 1282229 - RNA, 15 nt, Homo sapiens
augcaacaacaugua

SEQ ID NO: 1282230 - RNA, 17 nt, Homo sapiens
augcaacaacauguaua

SEQ ID NO: 1282231 - RNA, 18 nt, Homo sapiens
augcaacaacauguauaa

SEQ ID NO: 1282232 - RNA, 21 nt, Homo sapiens
augcaauaaaauuauuugcag

SEQ ID NO: 1282233 - RNA, 18 nt, Homo sapiens
augcagccccaucuccuc

SEQ ID NO: 1282234 - RNA, 18 nt, Homo sapiens
auggaauuuuugaaucua

SEQ ID NO: 1282235 - RNA, 16 nt, Homo sapiens
auggaggcgcugcugc

SEQ ID NO: 1282236 - RNA, 13 nt, Homo sapiens
caggcaccugcca

SEQ ID NO: 1282237 - RNA, 20 nt, Homo sapiens
caggcagaucccacuugcag

SEQ ID NO: 1282238 - RNA, 20 nt, Homo sapiens
caggccauugucccugaaga

SEQ ID NO: 1282239 - RNA, 20 nt, Homo sapiens
caggcuguaugggaagcaug

SEQ ID NO: 1282240 - RNA, 19 nt, Homo sapiens
cagggaacaagcccaaagc

SEQ ID NO: 1282241 - RNA, 16 nt, Homo sapiens
cagggaagucacuuca

SEQ ID NO: 1282242 - RNA, 12 nt, Homo sapiens
cagggagccuuu

SEQ ID NO: 1282243 - RNA, 18 nt, Homo sapiens
cagggauucuuccugcuu

SEQ ID NO: 1282244 - RNA, 18 nt, Homo sapiens
cagggccccucuacccac

SEQ ID NO: 1282245 - RNA, 18 nt, Homo sapiens
caggggagggucagccag

SEQ ID NO: 1282246 - RNA, 21 nt, Homo sapiens
caggguuacaaaucuucuuga

SEQ ID NO: 1282247 - RNA, 21 nt, Homo sapiens
cagguagaacacaaggucauu

SEQ ID NO: 1282248 - RNA, 15 nt, Homo sapiens
cagguagaccugucu

SEQ ID NO: 1282249 - RNA, 22 nt, Homo sapiens
caguaacggaacaguauccagu

SEQ ID NO: 1282250 - RNA, 15 nt, Homo sapiens
caguauacacacuuu

SEQ ID NO: 1282251 - RNA, 15 nt, Homo sapiens
cagucaaggauggau

SEQ ID NO: 1282252 - RNA, 20 nt, Homo sapiens
cagucucaauuuuguauuua

SEQ ID NO: 1282253 - RNA, 18 nt, Homo sapiens
cagugaaagucaauucag

SEQ ID NO: 1282254 - RNA, 14 nt, Homo sapiens
cagugaacaguuug

SEQ ID NO: 1282255 - RNA, 16 nt, Homo sapiens
cagugaccagucacug

SEQ ID NO: 1282256 - RNA, 19 nt, Homo sapiens
cagugaccagucacugacc

SEQ ID NO: 1282257 - RNA, 14 nt, Homo sapiens
caacagcacccucu

SEQ ID NO: 1282258 - RNA, 13 nt, Homo sapiens
caaccaaauggag

SEQ ID NO: 1282259 - RNA, 20 nt, Homo sapiens
caaccaaauggagugacuua

SEQ ID NO: 1282260 - RNA, 14 nt, Homo sapiens
caaccacaagcaca

SEQ ID NO: 1282261 - RNA, 14 nt, Homo sapiens
caaccccaucaucc

SEQ ID NO: 1282262 - RNA, 19 nt, Homo sapiens
caaccccccagcacugagg

SEQ ID NO: 1282263 - RNA, 20 nt, Homo sapiens
caacugcagaaaauguccuc

SEQ ID NO: 1282264 - RNA, 13 nt, Homo sapiens
caagacaaaugac

SEQ ID NO: 1282265 - RNA, 10 nt, Homo sapiens
caagacauag

SEQ ID NO: 1282266 - RNA, 15 nt, Homo sapiens
caagcauuuuuccau

SEQ ID NO: 1282267 - RNA, 21 nt, Homo sapiens
caagccuagcccuucucucau

SEQ ID NO: 1282268 - RNA, 15 nt, Homo sapiens
caagcuaaucugccu

SEQ ID NO: 1282269 - RNA, 16 nt, Homo sapiens
caagcuccucccuuga

SEQ ID NO: 1282270 - RNA, 20 nt, Homo sapiens
caagcuuuucaaaauuggac

SEQ ID NO: 1282271 - RNA, 21 nt, Homo sapiens
caaggauggaugcagauccag

SEQ ID NO: 1282272 - RNA, 18 nt, Homo sapiens
caaggauggguccagaag

SEQ ID NO: 1282273 - RNA, 17 nt, Homo sapiens
caaggccgcuucgccau

SEQ ID NO: 1282274 - RNA, 13 nt, Homo sapiens
caagggagaguga

SEQ ID NO: 1282275 - RNA, 19 nt, Homo sapiens
caaggugggccuugcuacc

SEQ ID NO: 1282276 - RNA, 17 nt, Homo sapiens
caaguaagaagacauga

SEQ ID NO: 1282277 - RNA, 17 nt, Homo sapiens
caaguacucuuguagca

SEQ ID NO: 1282278 - RNA, 21 nt, Homo sapiens
ucucauuauuucaucaugacu

SEQ ID NO: 1282279 - RNA, 22 nt, Homo sapiens
ucucauuuguauuuucaguuug

SEQ ID NO: 1282280 - RNA, 23 nt, Homo sapiens
ucuccaaccccccagcacugagg

SEQ ID NO: 1282281 - RNA, 15 nt, Homo sapiens
ucuccacugacacaa

SEQ ID NO: 1282282 - RNA, 12 nt, Homo sapiens
ucuccagaugag

SEQ ID NO: 1282283 - RNA, 23 nt, Homo sapiens
ucuccagaugagaguacacccca

SEQ ID NO: 1282284 - RNA, 22 nt, Homo sapiens
ucuccaucucuaggaugucguc

SEQ ID NO: 1282285 - RNA, 16 nt, Homo sapiens
ucuccucuucccgccg

SEQ ID NO: 1282286 - RNA, 15 nt, Homo sapiens
ucucuacagacucca

SEQ ID NO: 1282287 - RNA, 13 nt, Homo sapiens
ucucucaucucuu

SEQ ID NO: 1282288 - RNA, 19 nt, Homo sapiens
ucucucaucucuuagcucc

SEQ ID NO: 1282289 - RNA, 14 nt, Homo sapiens
ucucuucuucggga

SEQ ID NO: 1282290 - RNA, 16 nt, Homo sapiens
ucugaaaugcacuaga

SEQ ID NO: 1282291 - RNA, 17 nt, Homo sapiens
ucugaagccucacuuau

SEQ ID NO: 1282292 - RNA, 16 nt, Homo sapiens
ucugaggacauuccaa

SEQ ID NO: 1282293 - RNA, 18 nt, Homo sapiens
ucugaguggcuucacucc

SEQ ID NO: 1282294 - RNA, 16 nt, Homo sapiens
ucugcaagcuuuucaa

SEQ ID NO: 1282295 - RNA, 13 nt, Homo sapiens
ucugcuucugggg

SEQ ID NO: 1282296 - RNA, 19 nt, Homo sapiens
ucuggacacagccccaugu

SEQ ID NO: 1282297 - RNA, 19 nt, Homo sapiens
ucuguaucccccacccacu

SEQ ID NO: 1282298 - RNA, 17 nt, Homo sapiens
ucuguccccuucucuca

SEQ ID NO: 1282299 - RNA, 14 nt, Homo sapiens
ucuguuaccagagg

SEQ ID NO: 1282300 - RNA, 18 nt, Homo sapiens
ucuuacagucagcacaga

SEQ ID NO: 1282301 - RNA, 19 nt, Homo sapiens
ucuuacagucagcacagaa

SEQ ID NO: 1282302 - RNA, 13 nt, Homo sapiens
ucuuacaugcauu

SEQ ID NO: 1282303 - RNA, 14 nt, Homo sapiens
ucuuacaugcauuu

SEQ ID NO: 1282304 - RNA, 23 nt, Homo sapiens
ucuuagcuccccuccaaccuggg

SEQ ID NO: 1282305 - RNA, 17 nt, Homo sapiens
ucuucagcugguggaug

SEQ ID NO: 1282306 - RNA, 14 nt, Homo sapiens
ucuucauuaccuca

SEQ ID NO: 1282307 - RNA, 20 nt, Homo sapiens
ucuucauuaccucagugaga

SEQ ID NO: 1282308 - RNA, 15 nt, Homo sapiens
ucuuccaggggacuc

SEQ ID NO: 1282309 - RNA, 22 nt, Homo sapiens
ucuucuauggguuggacaaccu

SEQ ID NO: 1282310 - RNA, 19 nt, Homo sapiens
ucuucuuacaugcauuuga

SEQ ID NO: 1282311 - RNA, 15 nt, Homo sapiens
ucuugcacuauucca

SEQ ID NO: 1282312 - RNA, 21 nt, Homo sapiens
ucuuuauauaaggucauagau

SEQ ID NO: 1282313 - RNA, 20 nt, Homo sapiens
ucuuuauauggccucaagau

SEQ ID NO: 1282314 - RNA, 13 nt, Homo sapiens
ucuuuggacagaa

SEQ ID NO: 1282315 - RNA, 14 nt, Homo sapiens
ucuuuguauugaca

SEQ ID NO: 1282316 - RNA, 14 nt, Homo sapiens
ucuuuuccccauga

SEQ ID NO: 1282317 - RNA, 14 nt, Homo sapiens
ucuuuugucccaga

SEQ ID NO: 1282318 - RNA, 16 nt, Homo sapiens
ugaaaauuaacacugc

SEQ ID NO: 1282319 - RNA, 16 nt, Homo sapiens
ugaaacauuacaguua

SEQ ID NO: 1282320 - RNA, 15 nt, Homo sapiens
ugaaaccgucccuga

SEQ ID NO: 1282321 - RNA, 22 nt, Homo sapiens
ugaaauaugaaacucaucugua

SEQ ID NO: 1282322 - RNA, 15 nt, Homo sapiens
ugaaaugaaaacaug

SEQ ID NO: 1282323 - RNA, 19 nt, Homo sapiens
ugaaauggugaaaugcaga

SEQ ID NO: 1282324 - RNA, 14 nt, Homo sapiens
ugaacaaaauaagc

SEQ ID NO: 1282325 - RNA, 19 nt, Homo sapiens
ugaacucacccccaugauc

SEQ ID NO: 1282326 - RNA, 15 nt, Homo sapiens
ugaagccucacuuau

SEQ ID NO: 1282327 - RNA, 18 nt, Homo sapiens
ugaauaaaugaaugcaca

SEQ ID NO: 1282328 - RNA, 15 nt, Homo sapiens
ugacacaaugacaca

SEQ ID NO: 1282329 - RNA, 14 nt, Homo sapiens
ugacaugugcuuug

SEQ ID NO: 1282330 - RNA, 17 nt, Homo sapiens
ugaccaaugcauuaccu

SEQ ID NO: 1282331 - RNA, 12 nt, Homo sapiens
ugaccaugugau

SEQ ID NO: 1282332 - RNA, 20 nt, Homo sapiens
ugaccuugcacaaacagccc

SEQ ID NO: 1282333 - RNA, 18 nt, Homo sapiens
ugacuuuugaagaacaaa

SEQ ID NO: 1282334 - RNA, 15 nt, Homo sapiens
ugagaagaaaaucag

SEQ ID NO: 1282335 - RNA, 20 nt, Homo sapiens
ugagaagaaagaaccaacca

SEQ ID NO: 1282336 - RNA, 15 nt, Homo sapiens
ugagaagucacucac

SEQ ID NO: 1282337 - RNA, 20 nt, Homo sapiens
ugagaauguauuaguacaaa

SEQ ID NO: 1282338 - RNA, 16 nt, Homo sapiens
ugagacacaggaugaa

SEQ ID NO: 1282339 - RNA, 20 nt, Homo sapiens
ugagacaguuucuuagcuuu

SEQ ID NO: 1282340 - RNA, 13 nt, Homo sapiens
ugagaccuggcag

SEQ ID NO: 1282341 - RNA, 14 nt, Homo sapiens
ugagacuugaauca

SEQ ID NO: 1282342 - RNA, 19 nt, Homo sapiens
ugagaggccacagugcaau

SEQ ID NO: 1282343 - RNA, 11 nt, Homo sapiens
ugagaguacac

SEQ ID NO: 1282344 - RNA, 16 nt, Homo sapiens
ugagaguacaccccaa

SEQ ID NO: 1282345 - RNA, 12 nt, Homo sapiens
ugagaguauuua

SEQ ID NO: 1282346 - RNA, 19 nt, Homo sapiens
ugagaguuuucuaaaguau

SEQ ID NO: 1282347 - RNA, 23 nt, Homo sapiens
ugagauuugggcaggaacacaga

SEQ ID NO: 1282348 - RNA, 23 nt, Homo sapiens
ugagcagguguucuucauuaccu

SEQ ID NO: 1282349 - RNA, 20 nt, Homo sapiens
ugagcuggggaugucucuca

SEQ ID NO: 1282350 - RNA, 13 nt, Homo sapiens
ugagcugugcaca

SEQ ID NO: 1282351 - RNA, 20 nt, Homo sapiens
ugaggcauccuuccucacac

SEQ ID NO: 1282352 - RNA, 20 nt, Homo sapiens
ugagggugacuauggagcug

SEQ ID NO: 1282353 - RNA, 20 nt, Homo sapiens
ugaguuacuuagaaugccau

SEQ ID NO: 1282354 - RNA, 15 nt, Homo sapiens
ugauaaauaaaguca

SEQ ID NO: 1282355 - RNA, 17 nt, Homo sapiens
ugauaaauggauauuaa

SEQ ID NO: 1282356 - RNA, 20 nt, Homo sapiens
ugauauaaagaaauaccuga

SEQ ID NO: 1282357 - RNA, 12 nt, Homo sapiens
ugauauucucau

SEQ ID NO: 1282358 - RNA, 16 nt, Homo sapiens
ugauccguuccauugc

SEQ ID NO: 1282359 - RNA, 16 nt, Homo sapiens
ugugaauaaagugcug

SEQ ID NO: 1282360 - RNA, 13 nt, Homo sapiens
ugugacuuuccua

SEQ ID NO: 1282361 - RNA, 17 nt, Homo sapiens
ugugagaaaggaaaaau

SEQ ID NO: 1282362 - RNA, 16 nt, Homo sapiens
ugugaugaaauaugaa

SEQ ID NO: 1282363 - RNA, 15 nt, Homo sapiens
ugugcaacauaacaa

SEQ ID NO: 1282364 - RNA, 15 nt, Homo sapiens
ugugcacccagaaga

SEQ ID NO: 1282365 - RNA, 18 nt, Homo sapiens
ugugcugaucgccuuauu

SEQ ID NO: 1282366 - RNA, 19 nt, Homo sapiens
uguggauacagucauuauu

SEQ ID NO: 1282367 - RNA, 14 nt, Homo sapiens
uguggcuuccucag

SEQ ID NO: 1282368 - RNA, 18 nt, Homo sapiens
ugugggugggaccacaga

SEQ ID NO: 1282369 - RNA, 20 nt, Homo sapiens
uguguacugaguauugauaa

SEQ ID NO: 1282370 - RNA, 20 nt, Homo sapiens
uguguagcaaauuucgagca

SEQ ID NO: 1282371 - RNA, 22 nt, Homo sapiens
uguguagcuuuguucauugcau

SEQ ID NO: 1282372 - RNA, 9 nt, Homo sapiens
uguguauga

SEQ ID NO: 1282373 - RNA, 13 nt, Homo sapiens
ugugucugcaaca

SEQ ID NO: 1282374 - RNA, 21 nt, Homo sapiens
ugugugaggacuucugcaucu

SEQ ID NO: 1282375 - RNA, 13 nt, Homo sapiens
ugugugcugcuaa

SEQ ID NO: 1282376 - RNA, 19 nt, Homo sapiens
uguguggcauuuucacuuu

SEQ ID NO: 1282377 - RNA, 22 nt, Homo sapiens
uguguguauucuuaaaaugcaa

SEQ ID NO: 1282378 - RNA, 18 nt, Homo sapiens
uguguuaguaaacugugc

SEQ ID NO: 1282379 - RNA, 21 nt, Homo sapiens
uguuaaaauagacuaaccucu

SEQ ID NO: 1282380 - RNA, 22 nt, Homo sapiens
uguuaaggaaacucuuaucuca

SEQ ID NO: 1282381 - RNA, 13 nt, Homo sapiens
uguuaauuuagag

SEQ ID NO: 1282382 - RNA, 22 nt, Homo sapiens
uguuacauuauuccaaugauac

SEQ ID NO: 1282383 - RNA, 15 nt, Homo sapiens
uguuauuaacagaua

SEQ ID NO: 1282384 - RNA, 22 nt, Homo sapiens
uguucacguguuuuccauccca

SEQ ID NO: 1282385 - RNA, 20 nt, Homo sapiens
uguucacuguacucuguggg

SEQ ID NO: 1282386 - RNA, 18 nt, Homo sapiens
uguucacuuauugacuau

SEQ ID NO: 1282387 - RNA, 16 nt, Homo sapiens
uguugccauggugaug

SEQ ID NO: 1282388 - RNA, 20 nt, Homo sapiens
uguugcucucuaguuuccag

SEQ ID NO: 1282389 - RNA, 12 nt, Homo sapiens
uguuggcagcuc

SEQ ID NO: 1282390 - RNA, 19 nt, Homo sapiens
uguuuacagaggacaguau

SEQ ID NO: 1282391 - RNA, 15 nt, Homo sapiens
uguuuauaaugcaau

SEQ ID NO: 1282392 - RNA, 23 nt, Homo sapiens
aaaaauaaagcuacugaauuuau

SEQ ID NO: 1282393 - RNA, 18 nt, Homo sapiens
aaaaccugagcagcaacu

SEQ ID NO: 1282394 - RNA, 22 nt, Homo sapiens
aaaagaagaaauaaauaaucua

SEQ ID NO: 1282395 - RNA, 18 nt, Homo sapiens
aaaagagacaaacuguaa

SEQ ID NO: 1282396 - RNA, 19 nt, Homo sapiens
aaaaggcccuuuucagggc

SEQ ID NO: 1282397 - RNA, 13 nt, Homo sapiens
aaaaguguuuaua

SEQ ID NO: 1282398 - RNA, 12 nt, Homo sapiens
aaaauaaucuau

SEQ ID NO: 1282399 - RNA, 18 nt, Homo sapiens
aaaauauucuucuuugau

SEQ ID NO: 1282400 - RNA, 13 nt, Homo sapiens
aaaauauuuuaca

SEQ ID NO: 1282401 - RNA, 15 nt, Homo sapiens
aaaaugaauuugacu

SEQ ID NO: 1282402 - RNA, 15 nt, Homo sapiens
aaaaugccuuugaga

SEQ ID NO: 1282403 - RNA, 18 nt, Homo sapiens
aaaaugcuuucuuggcca

SEQ ID NO: 1282404 - RNA, 22 nt, Homo sapiens
aaaauguccucccuuguggcuu

SEQ ID NO: 1282405 - RNA, 12 nt, Homo sapiens
aaaaugugcaau

SEQ ID NO: 1282406 - RNA, 20 nt, Homo sapiens
aaaaugugucugcaacaugg

SEQ ID NO: 1282407 - RNA, 19 nt, Homo sapiens
aaaauuccauuuacuugau

SEQ ID NO: 1282408 - RNA, 21 nt, Homo sapiens
aaaauugcaguuucauguaug

SEQ ID NO: 1282409 - RNA, 21 nt, Homo sapiens
aaaauuucacuuaauaaugug

SEQ ID NO: 1282410 - RNA, 22 nt, Homo sapiens
aaacaauguuuuaaacauucuu

SEQ ID NO: 1282411 - RNA, 18 nt, Homo sapiens
aaacacccagaagcagua

SEQ ID NO: 1282412 - RNA, 17 nt, Homo sapiens
aaacaugaaaacauuga

SEQ ID NO: 1282413 - RNA, 20 nt, Homo sapiens
aaaccauaccacacacauua

SEQ ID NO: 1282414 - RNA, 22 nt, Homo sapiens
aaaccccuuuucaguuugaacu

SEQ ID NO: 1282415 - RNA, 22 nt, Homo sapiens
aaacccugccucuuuuccccau

SEQ ID NO: 1282416 - RNA, 17 nt, Homo sapiens
aaacuaaggaacccugg

SEQ ID NO: 1282417 - RNA, 22 nt, Homo sapiens
aaacucaucuguaaacuuuuau

SEQ ID NO: 1282418 - RNA, 18 nt, Homo sapiens
aaacucaucuugaucaac

SEQ ID NO: 1282419 - RNA, 18 nt, Homo sapiens
aaacugcuuuauuuuccc

SEQ ID NO: 1282420 - RNA, 19 nt, Homo sapiens
aaagaaaaugugucugcaa

SEQ ID NO: 1282421 - RNA, 20 nt, Homo sapiens
aaagcaguggcuccauuggu

SEQ ID NO: 1282422 - RNA, 17 nt, Homo sapiens
aaagcauuguaacuuau

SEQ ID NO: 1282423 - RNA, 21 nt, Homo sapiens
aaagcccuuguccccaugaaa

SEQ ID NO: 1282424 - RNA, 18 nt, Homo sapiens
aaagccugagaagaaaga

SEQ ID NO: 1282425 - RNA, 14 nt, Homo sapiens
aaagcuucagggaa

SEQ ID NO: 1282426 - RNA, 17 nt, Homo sapiens
aaaggacaaacagugaa

SEQ ID NO: 1282427 - RNA, 21 nt, Homo sapiens
aaaggacaccuuuuaacucac

SEQ ID NO: 1282428 - RNA, 11 nt, Homo sapiens
aaaggccagac

SEQ ID NO: 1282429 - RNA, 22 nt, Homo sapiens
aaaguauauguuaaaaagugag

SEQ ID NO: 1282430 - RNA, 24 nt, Homo sapiens
aaaguauuuaagguacauggaaca

SEQ ID NO: 1282431 - RNA, 12 nt, Homo sapiens
aaaguuaugaaa

SEQ ID NO: 1282432 - RNA, 21 nt, Homo sapiens
aaauaaacagauacauucaca

SEQ ID NO: 1282433 - RNA, 21 nt, Homo sapiens
aaauaacuaggcguggacuua

SEQ ID NO: 1282434 - RNA, 19 nt, Homo sapiens
aaauagcagguaguccagg

SEQ ID NO: 1282435 - RNA, 21 nt, Homo sapiens
aaauaguuuggauuacuuaaa

SEQ ID NO: 1282436 - RNA, 12 nt, Homo sapiens
aaauaugcagug

SEQ ID NO: 1282437 - RNA, 17 nt, Homo sapiens
aaauauucuucuuugau

SEQ ID NO: 1282438 - RNA, 20 nt, Homo sapiens
aaauauuuuuaugugcaaua

SEQ ID NO: 1282439 - RNA, 22 nt, Homo sapiens
aaaucacacagccaagccaguc

SEQ ID NO: 1282440 - RNA, 13 nt, Homo sapiens
aaaugcugugcaa

SEQ ID NO: 1282441 - RNA, 16 nt, Homo sapiens
aaaugcuuuuccucaa

SEQ ID NO: 1282442 - RNA, 16 nt, Homo sapiens
aaauggaggaauauga

SEQ ID NO: 1282443 - RNA, 15 nt, Homo sapiens
aaauggagugacuua

SEQ ID NO: 1282444 - RNA, 17 nt, Homo sapiens
aaaugugucugcaacau

SEQ ID NO: 1282445 - RNA, 17 nt, Homo sapiens
aaauguuguauaaccaa

SEQ ID NO: 1282446 - RNA, 22 nt, Homo sapiens
aaauuacguucuuacaagcuua

SEQ ID NO: 1282447 - RNA, 14 nt, Homo sapiens
aaauuuaaauggag

SEQ ID NO: 1282448 - RNA, 18 nt, Homo sapiens
aaauuucgagcauaagaa

SEQ ID NO: 1282449 - RNA, 21 nt, Homo sapiens
aaauuuuuuaaaagagacaaa

SEQ ID NO: 1282450 - RNA, 13 nt, Homo sapiens
aacaaaaggcuuu

SEQ ID NO: 1282451 - RNA, 19 nt, Homo sapiens
aacaaaccuuaaacaccca

SEQ ID NO: 1282452 - RNA, 14 nt, Homo sapiens
aacaauaacacugc

SEQ ID NO: 1282453 - RNA, 13 nt, Homo sapiens
aacaaucauguaa

SEQ ID NO: 1282454 - RNA, 17 nt, Homo sapiens
aacaauccaaaugcauu

SEQ ID NO: 1282455 - RNA, 18 nt, Homo sapiens
aacaauccaaaugcauuc

SEQ ID NO: 1282456 - RNA, 22 nt, Homo sapiens
aacaauuaaaaucucaacuaua

SEQ ID NO: 1282457 - RNA, 21 nt, Homo sapiens
aacaauuacauggcucuaaaa

SEQ ID NO: 1282458 - RNA, 22 nt, Homo sapiens
aacacagacccaaaccauacca

SEQ ID NO: 1282459 - RNA, 15 nt, Homo sapiens
aacagaacuaucuca

SEQ ID NO: 1282460 - RNA, 14 nt, Homo sapiens
aacagaacuaugga

SEQ ID NO: 1282461 - RNA, 14 nt, Homo sapiens
aacagauacauuca

SEQ ID NO: 1282462 - RNA, 20 nt, Homo sapiens
aacagccccucuggacacag

SEQ ID NO: 1282463 - RNA, 19 nt, Homo sapiens
aacauaacaauucggcagu

SEQ ID NO: 1282464 - RNA, 18 nt, Homo sapiens
aacauaagauauuguaca

SEQ ID NO: 1282465 - RNA, 23 nt, Homo sapiens
aacaucuuuucuugccucugucc

SEQ ID NO: 1282466 - RNA, 20 nt, Homo sapiens
aacaugaaaacauugaugaa

SEQ ID NO: 1282467 - RNA, 17 nt, Homo sapiens
aacaugcagcucugcag

SEQ ID NO: 1282468 - RNA, 17 nt, Homo sapiens
aacaugcuugcauuaua

SEQ ID NO: 1282469 - RNA, 14 nt, Homo sapiens
aacauggugugugu

SEQ ID NO: 1282470 - RNA, 14 nt, Homo sapiens
aacauuaaagcaau

SEQ ID NO: 1282471 - RNA, 20 nt, Homo sapiens
aaccaaauggagugacuuag

SEQ ID NO: 1282472 - RNA, 15 nt, Homo sapiens
aaccacaagcacaca

SEQ ID NO: 1282473 - RNA, 18 nt, Homo sapiens
aaccauguugguugcacu

SEQ ID NO: 1282474 - RNA, 23 nt, Homo sapiens
aaccauguugguugcacuuugua

SEQ ID NO: 1282475 - RNA, 15 nt, Homo sapiens
aacccuuaucuguaa

SEQ ID NO: 1282476 - RNA, 15 nt, Homo sapiens
aaccuugucaauaaa

SEQ ID NO: 1282477 - RNA, 15 nt, Homo sapiens
aaccuuuacauccag

SEQ ID NO: 1282478 - RNA, 23 nt, Homo sapiens
aaccuuuuuuaagauuuuucuca

SEQ ID NO: 1282479 - RNA, 17 nt, Homo sapiens
aacgcacacaguaucua

SEQ ID NO: 1282480 - RNA, 21 nt, Homo sapiens
aacgcacacaguaucuaguca

SEQ ID NO: 1282481 - RNA, 20 nt, Homo sapiens
cauuacagggcacaggccau

SEQ ID NO: 1282482 - RNA, 16 nt, Homo sapiens
cauucaugaugaacuc

SEQ ID NO: 1282483 - RNA, 17 nt, Homo sapiens
cauucaugaugaacuca

SEQ ID NO: 1282484 - RNA, 18 nt, Homo sapiens
cauucaugaugaacucac

SEQ ID NO: 1282485 - RNA, 12 nt, Homo sapiens
cauuccuaacac

SEQ ID NO: 1282486 - RNA, 18 nt, Homo sapiens
cauucuagacccuauaca

SEQ ID NO: 1282487 - RNA, 18 nt, Homo sapiens
cauucucaguauccacug

SEQ ID NO: 1282488 - RNA, 12 nt, Homo sapiens
cauugucccuga

SEQ ID NO: 1282489 - RNA, 22 nt, Homo sapiens
cauuuaaauaucugaacauuua

SEQ ID NO: 1282490 - RNA, 14 nt, Homo sapiens
cauuuacccaacuc

SEQ ID NO: 1282491 - RNA, 21 nt, Homo sapiens
cauuuacuugaucauucucag

SEQ ID NO: 1282492 - RNA, 20 nt, Homo sapiens
cauuuagcgaacaaccacag

SEQ ID NO: 1282493 - RNA, 21 nt, Homo sapiens
cauuuaugauuuaauaaaaua

SEQ ID NO: 1282494 - RNA, 22 nt, Homo sapiens
cauuuccuuuuccuucaagccu

SEQ ID NO: 1282495 - RNA, 19 nt, Homo sapiens
cauuuucagcaucaaacau

SEQ ID NO: 1282496 - RNA, 19 nt, Homo sapiens
cauuuugaaugugaucauc

SEQ ID NO: 1282497 - RNA, 23 nt, Homo sapiens
cauuuuuaaaggacaaacaguga

SEQ ID NO: 1282498 - RNA, 15 nt, Homo sapiens
ccaaagugcugcgau

SEQ ID NO: 1282499 - RNA, 21 nt, Homo sapiens
ccaaauacucaauuuacuaau

SEQ ID NO: 1282500 - RNA, 23 nt, Homo sapiens
ccaacacaugggaccuauaacug

SEQ ID NO: 1282501 - RNA, 15 nt, Homo sapiens
ccaacagcacccucu

SEQ ID NO: 1282502 - RNA, 18 nt, Homo sapiens
ccaaccguucccucacag

SEQ ID NO: 1282503 - RNA, 12 nt, Homo sapiens
ccaacugaccac

SEQ ID NO: 1282504 - RNA, 17 nt, Homo sapiens
ccaagugccggacuagc

SEQ ID NO: 1282505 - RNA, 14 nt, Homo sapiens
ccaaguuccacugc

SEQ ID NO: 1282506 - RNA, 14 nt, Homo sapiens
ccaauucugaaaua

SEQ ID NO: 1282507 - RNA, 12 nt, Homo sapiens
ccacaagcacac

SEQ ID NO: 1282508 - RNA, 17 nt, Homo sapiens
ccacaagcacacaggaa

SEQ ID NO: 1282509 - RNA, 20 nt, Homo sapiens
ccacagcuucucuacagacu

SEQ ID NO: 1282510 - RNA, 13 nt, Homo sapiens
ccacauugcacuu

SEQ ID NO: 1282511 - RNA, 18 nt, Homo sapiens
ccacuagacaaguccagc

SEQ ID NO: 1282512 - RNA, 18 nt, Homo sapiens
ccacucaggggucauuca

SEQ ID NO: 1282513 - RNA, 13 nt, Homo sapiens
ccacuccuaauau

SEQ ID NO: 1282514 - RNA, 16 nt, Homo sapiens
ccacuucucucaggau

SEQ ID NO: 1282515 - RNA, 15 nt, Homo sapiens
ccagaaaaaaagccc

SEQ ID NO: 1282516 - RNA, 17 nt, Homo sapiens
ccagaaaagcaguggcu

SEQ ID NO: 1282517 - RNA, 18 nt, Homo sapiens
ccagaaugccuccugcag

SEQ ID NO: 1282518 - RNA, 20 nt, Homo sapiens
ccagaggaagggacaccaag

SEQ ID NO: 1282519 - RNA, 22 nt, Homo sapiens
ccagaggggccugccaccugga

SEQ ID NO: 1282520 - RNA, 21 nt, Homo sapiens
ccagauuggcucacacugaga

SEQ ID NO: 1282521 - RNA, 22 nt, Homo sapiens
ccagcaccggccccauuuaccc

SEQ ID NO: 1282522 - RNA, 14 nt, Homo sapiens
ccagcacugaggaa

SEQ ID NO: 1282523 - RNA, 19 nt, Homo sapiens
ccagccagaggaugcauag

SEQ ID NO: 1282524 - RNA, 23 nt, Homo sapiens
ccagccccucucccugugcugug

SEQ ID NO: 1282525 - RNA, 17 nt, Homo sapiens
ccagcuagugccaaaua

SEQ ID NO: 1282526 - RNA, 17 nt, Homo sapiens
ccagcuuuccucaucag

SEQ ID NO: 1282527 - RNA, 13 nt, Homo sapiens
ccaggacugggcc

SEQ ID NO: 1282528 - RNA, 16 nt, Homo sapiens
ccaggaguacacccca

SEQ ID NO: 1282529 - RNA, 23 nt, Homo sapiens
ccaggaguacaccccaacagcac

SEQ ID NO: 1282530 - RNA, 16 nt, Homo sapiens
ccagggagagcccagg

SEQ ID NO: 1282531 - RNA, 19 nt, Homo sapiens
ccagguguggacgggacag

SEQ ID NO: 1282532 - RNA, 14 nt, Homo sapiens
ccagguguucuaca

SEQ ID NO: 1282533 - RNA, 19 nt, Homo sapiens
ccagguguucuacacucau

SEQ ID NO: 1282534 - RNA, 17 nt, Homo sapiens
ccauaccacacacauua

SEQ ID NO: 1282535 - RNA, 11 nt, Homo sapiens
ccaucccacau

SEQ ID NO: 1282536 - RNA, 19 nt, Homo sapiens
ccaucggugaaacuaacag

SEQ ID NO: 1282537 - RNA, 12 nt, Homo sapiens
ccaucucaguca

SEQ ID NO: 1282538 - RNA, 17 nt, Homo sapiens
ccaucuccucagcaccc

SEQ ID NO: 1282539 - RNA, 17 nt, Homo sapiens
ccaucugugugcaacua

SEQ ID NO: 1282540 - RNA, 17 nt, Homo sapiens
ccaugaaaaugcaacaa

SEQ ID NO: 1282541 - RNA, 20 nt, Homo sapiens
ccaugugcuacaggggccag

SEQ ID NO: 1282542 - RNA, 22 nt, Homo sapiens
ccauuaaauugccuuuguaaua

SEQ ID NO: 1282543 - RNA, 12 nt, Homo sapiens
ccauucaggaca

SEQ ID NO: 1282544 - RNA, 16 nt, Homo sapiens
cccaaguuccacugcu

SEQ ID NO: 1282545 - RNA, 17 nt, Homo sapiens
cccacuucugcacuugc

SEQ ID NO: 1282546 - RNA, 23 nt, Homo sapiens
cccagagguaacagaacagcuuc

SEQ ID NO: 1282547 - RNA, 22 nt, Homo sapiens
cccagccccucucccugugcug

SEQ ID NO: 1282548 - RNA, 13 nt, Homo sapiens
cccaggacugggc

SEQ ID NO: 1282549 - RNA, 13 nt, Homo sapiens
cccaggaguacac

SEQ ID NO: 1282550 - RNA, 19 nt, Homo sapiens
cccaggcuggagugcagug

SEQ ID NO: 1282551 - RNA, 17 nt, Homo sapiens
cccagggcagccaggga

SEQ ID NO: 1282552 - RNA, 18 nt, Homo sapiens
cccaggucccuuguccca

SEQ ID NO: 1282553 - RNA, 22 nt, Homo sapiens
cccaugaucuucaagcagggaa

SEQ ID NO: 1282554 - RNA, 17 nt, Homo sapiens
cccaugggaagggucca

SEQ ID NO: 1282555 - RNA, 22 nt, Homo sapiens
cccauuugcuuacuuugcauuu

SEQ ID NO: 1282556 - RNA, 23 nt, Homo sapiens
ccccaacagcacccucuccagau

SEQ ID NO: 1282557 - RNA, 11 nt, Homo sapiens
cccccaacagc

SEQ ID NO: 1282558 - RNA, 22 nt, Homo sapiens
cccccagggcauuguguucacu

SEQ ID NO: 1282559 - RNA, 18 nt, Homo sapiens
cccccuuuccucuugggc

SEQ ID NO: 1282560 - RNA, 16 nt, Homo sapiens
ccccuccuccacucuc

SEQ ID NO: 1282561 - RNA, 21 nt, Homo sapiens
ccccucgacagcucucugggc

SEQ ID NO: 1282562 - RNA, 22 nt, Homo sapiens
cccuaugugggugggaccacag

SEQ ID NO: 1282563 - RNA, 16 nt, Homo sapiens
cccucauucugcauua

SEQ ID NO: 1282564 - RNA, 16 nt, Homo sapiens
cccuccccucguguca

SEQ ID NO: 1282565 - RNA, 13 nt, Homo sapiens
cccuccuucaucc

SEQ ID NO: 1282566 - RNA, 15 nt, Homo sapiens
cccucuaagggaccu

SEQ ID NO: 1282567 - RNA, 21 nt, Homo sapiens
cccucuagaggcugccugggc

SEQ ID NO: 1282568 - RNA, 16 nt, Homo sapiens
cccugaagucuugcau

SEQ ID NO: 1282569 - RNA, 12 nt, Homo sapiens
cccugcacugaa

SEQ ID NO: 1282570 - RNA, 20 nt, Homo sapiens
cccuggccucccccacuuuc

SEQ ID NO: 1282571 - RNA, 15 nt, Homo sapiens
cccuguuggcagcuc

SEQ ID NO: 1282572 - RNA, 14 nt, Homo sapiens
ccgaagucuuccau

SEQ ID NO: 1282573 - RNA, 18 nt, Homo sapiens
ccgagccuggcuccaaac

SEQ ID NO: 1282574 - RNA, 19 nt, Homo sapiens
ccgcuuucaugaacacagc

SEQ ID NO: 1282575 - RNA, 20 nt, Homo sapiens
ccgggucaucuguaccucug

SEQ ID NO: 1282576 - RNA, 13 nt, Homo sapiens
ccuaaaaugcuuc

SEQ ID NO: 1282577 - RNA, 12 nt, Homo sapiens
ccuaaacuguau

SEQ ID NO: 1282578 - RNA, 14 nt, Homo sapiens
ccuagauaugaaua

SEQ ID NO: 1282579 - RNA, 16 nt, Homo sapiens
ccuagcccuucucuca

SEQ ID NO: 1282580 - RNA, 12 nt, Homo sapiens
ccuaugcaauaa

SEQ ID NO: 1282581 - RNA, 22 nt, Homo sapiens
ccucacugcuguagacauuugc

SEQ ID NO: 1282582 - RNA, 12 nt, Homo sapiens
ccucagauuccg

SEQ ID NO: 1282583 - RNA, 21 nt, Homo sapiens
ccucagauuccgcaccaauaa

SEQ ID NO: 1282584 - RNA, 16 nt, Homo sapiens
ccucagugagaagcca

SEQ ID NO: 1282585 - RNA, 21 nt, Homo sapiens
ccuccagggcuggacugaggc

SEQ ID NO: 1282586 - RNA, 18 nt, Homo sapiens
ccuccugucccucaucca

SEQ ID NO: 1282587 - RNA, 19 nt, Homo sapiens
ccuccuuauauuuggccca

SEQ ID NO: 1282588 - RNA, 18 nt, Homo sapiens
ccucgaaagugucaucaa

SEQ ID NO: 1282589 - RNA, 18 nt, Homo sapiens
ccucuccccacugcucau

SEQ ID NO: 1282590 - RNA, 13 nt, Homo sapiens
ccucugugccgca

SEQ ID NO: 1282591 - RNA, 23 nt, Homo sapiens
ccucuuaaaaaauaaaaacugac

SEQ ID NO: 1282592 - RNA, 17 nt, Homo sapiens
ccucuuggcugccuugu

SEQ ID NO: 1282593 - RNA, 18 nt, Homo sapiens
ccucuuuaccuguucaaa

SEQ ID NO: 1282594 - RNA, 16 nt, Homo sapiens
ccucuuuuccccauga

SEQ ID NO: 1282595 - RNA, 17 nt, Homo sapiens
ccugaaccugggaacca

SEQ ID NO: 1282596 - RNA, 15 nt, Homo sapiens
ccugaacucugcaac

SEQ ID NO: 1282597 - RNA, 16 nt, Homo sapiens
ccugagauuucaucug

SEQ ID NO: 1282598 - RNA, 17 nt, Homo sapiens
ccugagauuucaucugc

SEQ ID NO: 1282599 - RNA, 17 nt, Homo sapiens
ccugccucuuuucccca

SEQ ID NO: 1282600 - RNA, 23 nt, Homo sapiens
ccugcugugaugugcaaaggcau

SEQ ID NO: 1282601 - RNA, 17 nt, Homo sapiens
ccuggacaguuuucugc

SEQ ID NO: 1282602 - RNA, 20 nt, Homo sapiens
ccuggacaguuuucugcuuu

SEQ ID NO: 1282603 - RNA, 16 nt, Homo sapiens
ccugggccuguucacg

SEQ ID NO: 1282604 - RNA, 18 nt, Homo sapiens
ccuguccugaaagccaca

SEQ ID NO: 1282605 - RNA, 19 nt, Homo sapiens
ccuguccugaaagccacag

SEQ ID NO: 1282606 - RNA, 21 nt, Homo sapiens
ccugugccauaaaaugugcuu

SEQ ID NO: 1282607 - RNA, 13 nt, Homo sapiens
ccuuaaacucagg

SEQ ID NO: 1282608 - RNA, 19 nt, Homo sapiens
ccuucugaggacauuccaa

SEQ ID NO: 1282609 - RNA, 20 nt, Homo sapiens
ccuucugugcuucagcucuu

SEQ ID NO: 1282610 - RNA, 13 nt, Homo sapiens
ccuugaaugccau

SEQ ID NO: 1282611 - RNA, 14 nt, Homo sapiens
ccuugaaugccaua

SEQ ID NO: 1282612 - RNA, 22 nt, Homo sapiens
ccuugcaagcuaauucuuugac

SEQ ID NO: 1282613 - RNA, 19 nt, Homo sapiens
ccuuucaagguaacuguac

SEQ ID NO: 1282614 - RNA, 14 nt, Homo sapiens
ccuuucagauucag

SEQ ID NO: 1282615 - RNA, 20 nt, Homo sapiens
ccuuucccagguaauuuaaa

SEQ ID NO: 1282616 - RNA, 17 nt, Homo sapiens
ccuuuccccucccucag

SEQ ID NO: 1282617 - RNA, 15 nt, Homo sapiens
ccuuugagacaguuu

SEQ ID NO: 1282618 - RNA, 18 nt, Homo sapiens
ccuuuggaugcacuuuau

SEQ ID NO: 1282619 - RNA, 23 nt, Homo sapiens
ccuuuuuaaggaaggcacuaaaa

SEQ ID NO: 1282620 - RNA, 22 nt, Homo sapiens
ccuuuuuuaagauuuuucucaa

SEQ ID NO: 1282621 - RNA, 20 nt, Homo sapiens
cgaaauaacaauguuaagga

SEQ ID NO: 1282622 - RNA, 13 nt, Homo sapiens
cgaagucuuccau

SEQ ID NO: 1282623 - RNA, 18 nt, Homo sapiens
cgagcgcuaccucuccag

SEQ ID NO: 1282624 - RNA, 12 nt, Homo sapiens
cgcaacauuucu

SEQ ID NO: 1282625 - RNA, 16 nt, Homo sapiens
cgcaccauugaacugu

SEQ ID NO: 1282626 - RNA, 13 nt, Homo sapiens
cgccgcuagcccg

SEQ ID NO: 1282627 - RNA, 12 nt, Homo sapiens
cgcugcugccac

SEQ ID NO: 1282628 - RNA, 12 nt, Homo sapiens
cggaacaguauc

SEQ ID NO: 1282629 - RNA, 16 nt, Homo sapiens
cggccccacauugcac

SEQ ID NO: 1282630 - RNA, 19 nt, Homo sapiens
cggcuccccucgacagcuc

SEQ ID NO: 1282631 - RNA, 14 nt, Homo sapiens
cgggagcugcacua

SEQ ID NO: 1282632 - RNA, 15 nt, Homo sapiens
cggggcucuucucau

SEQ ID NO: 1282633 - RNA, 14 nt, Homo sapiens
cggucaccuguugg

SEQ ID NO: 1282634 - RNA, 17 nt, Homo sapiens
cgguucacucuucucag

SEQ ID NO: 1282635 - RNA, 15 nt, Homo sapiens
cgugauccaccugcc

SEQ ID NO: 1282636 - RNA, 17 nt, Homo sapiens
cguguaauauucucuga

SEQ ID NO: 1282637 - RNA, 16 nt, Homo sapiens
cguuccacauccacac

SEQ ID NO: 1282638 - RNA, 16 nt, Homo sapiens
cuaaagguuguauugc

SEQ ID NO: 1282639 - RNA, 17 nt, Homo sapiens
cuaaaguaccagauuau

SEQ ID NO: 1282640 - RNA, 15 nt, Homo sapiens
cuaaagugcauuauu

SEQ ID NO: 1282641 - RNA, 21 nt, Homo sapiens
cuaacuuuuuugcuauccagc

SEQ ID NO: 1282642 - RNA, 18 nt, Homo sapiens
cuaauaauaaaugcauag

SEQ ID NO: 1282643 - RNA, 18 nt, Homo sapiens
cuaauaucuuaaugaaua

SEQ ID NO: 1282644 - RNA, 13 nt, Homo sapiens
cuacacaacaugu

SEQ ID NO: 1282645 - RNA, 13 nt, Homo sapiens
cuacagacuccaa

SEQ ID NO: 1282646 - RNA, 20 nt, Homo sapiens
cuacagacuccaaaaggccc

SEQ ID NO: 1282647 - RNA, 12 nt, Homo sapiens
cuacaucugccu

SEQ ID NO: 1282648 - RNA, 12 nt, Homo sapiens
cuaccucuccag

SEQ ID NO: 1282649 - RNA, 20 nt, Homo sapiens
cuagaccauauaacugugau

SEQ ID NO: 1282650 - RNA, 19 nt, Homo sapiens
cuagagauuugguguacaa

SEQ ID NO: 1282651 - RNA, 21 nt, Homo sapiens
cuagagguagaguuugaucau

SEQ ID NO: 1282652 - RNA, 20 nt, Homo sapiens
cuagaugauugauuaccaag

SEQ ID NO: 1282653 - RNA, 13 nt, Homo sapiens
cuagcaaguguaa

SEQ ID NO: 1282654 - RNA, 21 nt, Homo sapiens
cuauaaccaguuuagcuuuuu

SEQ ID NO: 1282655 - RNA, 21 nt, Homo sapiens
cuauaugaaaagagcaaaaac

SEQ ID NO: 1282656 - RNA, 13 nt, Homo sapiens
cuauaugauuuca

SEQ ID NO: 1282657 - RNA, 20 nt, Homo sapiens
cuaugugggugggaccacag

SEQ ID NO: 1282658 - RNA, 15 nt, Homo sapiens
cuauuacgugcaaua

SEQ ID NO: 1282659 - RNA, 20 nt, Homo sapiens
cuauugcaaggacagcauca

SEQ ID NO: 1282660 - RNA, 22 nt, Homo sapiens
cuauuuuuauuuguuugugcau

SEQ ID NO: 1282661 - RNA, 23 nt, Homo sapiens
cucaacacgacugcaagcuccau

SEQ ID NO: 1282662 - RNA, 20 nt, Homo sapiens
cucacuaaaaauauacagcu

SEQ ID NO: 1282663 - RNA, 16 nt, Homo sapiens
cucagccacugaagua

SEQ ID NO: 1282664 - RNA, 14 nt, Homo sapiens
cucagcccauuucu

SEQ ID NO: 1282665 - RNA, 22 nt, Homo sapiens
cucaggacacuaauacaccagg

SEQ ID NO: 1282666 - RNA, 23 nt, Homo sapiens
cucaggccucucuacaagcagca

SEQ ID NO: 1282667 - RNA, 15 nt, Homo sapiens
cucagugauugcaau

SEQ ID NO: 1282668 - RNA, 15 nt, Homo sapiens
cucauagauugcaaa

SEQ ID NO: 1282669 - RNA, 12 nt, Homo sapiens
cucauugcuugg

SEQ ID NO: 1282670 - RNA, 16 nt, Homo sapiens
cucauugcuuggaauu

SEQ ID NO: 1282671 - RNA, 14 nt, Homo sapiens
cuccaaaaggcccu

SEQ ID NO: 1282672 - RNA, 16 nt, Homo sapiens
cuccaaaaggcccuuu

SEQ ID NO: 1282673 - RNA, 20 nt, Homo sapiens
cuccaaaaggcccuuuucag

SEQ ID NO: 1282674 - RNA, 15 nt, Homo sapiens
cuccacgccauuucc

SEQ ID NO: 1282675 - RNA, 22 nt, Homo sapiens
cuccagaugagaguacacccca

SEQ ID NO: 1282676 - RNA, 16 nt, Homo sapiens
cucccaaaacagauua

SEQ ID NO: 1282677 - RNA, 12 nt, Homo sapiens
cucccacuuugc

SEQ ID NO: 1282678 - RNA, 15 nt, Homo sapiens
cuccccacugcucau

SEQ ID NO: 1282679 - RNA, 20 nt, Homo sapiens
cuccccugggcccaucucaa

SEQ ID NO: 1282680 - RNA, 21 nt, Homo sapiens
cuccccugggcccaucucaag

SEQ ID NO: 1282681 - RNA, 19 nt, Homo sapiens
cucccuuguggcuuccuca

SEQ ID NO: 1282682 - RNA, 17 nt, Homo sapiens
cuccuccagaccauuca

SEQ ID NO: 1282683 - RNA, 17 nt, Homo sapiens
cuccugaaugagacuua

SEQ ID NO: 1282684 - RNA, 18 nt, Homo sapiens
cuccugucccucauccau

SEQ ID NO: 1282685 - RNA, 21 nt, Homo sapiens
cucgcaagggaaguccuugca

SEQ ID NO: 1282686 - RNA, 23 nt, Homo sapiens
cucuaaauaaacagauacauuca

SEQ ID NO: 1282687 - RNA, 13 nt, Homo sapiens
cucuacuaccugu

SEQ ID NO: 1282688 - RNA, 18 nt, Homo sapiens
cucuaguuuccagaggcu

SEQ ID NO: 1282689 - RNA, 13 nt, Homo sapiens
cucuaucugcaau

SEQ ID NO: 1282690 - RNA, 11 nt, Homo sapiens
cucucaucucu

SEQ ID NO: 1282691 - RNA, 21 nt, Homo sapiens
cucuccaaggguggugaccaa

SEQ ID NO: 1282692 - RNA, 16 nt, Homo sapiens
cucuccaucucuagga

SEQ ID NO: 1282693 - RNA, 15 nt, Homo sapiens
cucucuaguuuccag

SEQ ID NO: 1282694 - RNA, 15 nt, Homo sapiens
cucucuggcuuccau

SEQ ID NO: 1282695 - RNA, 22 nt, Homo sapiens
cucugcagccucagagacauca

SEQ ID NO: 1282696 - RNA, 16 nt, Homo sapiens
cucugccccacccuca

SEQ ID NO: 1282697 - RNA, 20 nt, Homo sapiens
cucugcuuucccuuuuccau

SEQ ID NO: 1282698 - RNA, 15 nt, Homo sapiens
cucuggacacagccc

SEQ ID NO: 1282699 - RNA, 14 nt, Homo sapiens
cucuuaaaucauuu

SEQ ID NO: 1282700 - RNA, 19 nt, Homo sapiens
cucuuccuacccuuccuca

SEQ ID NO: 1282701 - RNA, 20 nt, Homo sapiens
cucuucuaaucagagcgcaa

SEQ ID NO: 1282702 - RNA, 16 nt, Homo sapiens
cucuucuugacaucaa

SEQ ID NO: 1282703 - RNA, 13 nt, Homo sapiens
cucuuuaccuccu

SEQ ID NO: 1282704 - RNA, 18 nt, Homo sapiens
cugaaacagccagaucuc

SEQ ID NO: 1282705 - RNA, 12 nt, Homo sapiens
cugaacugaugg

SEQ ID NO: 1282706 - RNA, 21 nt, Homo sapiens
cugaagcucccuguccugaaa

SEQ ID NO: 1282707 - RNA, 19 nt, Homo sapiens
cugacaaagugugucucaa

SEQ ID NO: 1282708 - RNA, 23 nt, Homo sapiens
cugaccucgugauccaccugccu

SEQ ID NO: 1282709 - RNA, 14 nt, Homo sapiens
cugaccuugcacaa

SEQ ID NO: 1282710 - RNA, 22 nt, Homo sapiens
cugagcagugcuugaaugaagu

SEQ ID NO: 1282711 - RNA, 20 nt, Homo sapiens
cugaggauuucugaucugau

SEQ ID NO: 1282712 - RNA, 15 nt, Homo sapiens
cugaggcacacagag

SEQ ID NO: 1282713 - RNA, 15 nt, Homo sapiens
cugaguauugauaaa

SEQ ID NO: 1282714 - RNA, 17 nt, Homo sapiens
cugaguggcuucacucc

SEQ ID NO: 1282715 - RNA, 20 nt, Homo sapiens
cugauaaccacuccuaauau

SEQ ID NO: 1282716 - RNA, 13 nt, Homo sapiens
cugauauuuacug

SEQ ID NO: 1282717 - RNA, 15 nt, Homo sapiens
cugaucaaugacaga

SEQ ID NO: 1282718 - RNA, 14 nt, Homo sapiens
cugauccuugcacg

SEQ ID NO: 1282719 - RNA, 16 nt, Homo sapiens
cugcacugaaguguga

SEQ ID NO: 1282720 - RNA, 16 nt, Homo sapiens
cugcaguuccaaaaga

SEQ ID NO: 1282721 - RNA, 23 nt, Homo sapiens
cugccaucauguuuacagaggac

SEQ ID NO: 1282722 - RNA, 18 nt, Homo sapiens
cugcccugguggcccucu

SEQ ID NO: 1282723 - RNA, 15 nt, Homo sapiens
cugccgaauauagaa

SEQ ID NO: 1282724 - RNA, 18 nt, Homo sapiens
cugcgucauuacagggca

SEQ ID NO: 1282725 - RNA, 20 nt, Homo sapiens
cugcugcgucauuacagggc

SEQ ID NO: 1282726 - RNA, 23 nt, Homo sapiens
cugcuguaaauuuggcuucuguu

SEQ ID NO: 1282727 - RNA, 20 nt, Homo sapiens
cugcuucuggggacaccuca

SEQ ID NO: 1282728 - RNA, 17 nt, Homo sapiens
cugcuuuuuuucaggga

SEQ ID NO: 1282729 - RNA, 15 nt, Homo sapiens
cuggagcccuguugg

SEQ ID NO: 1282730 - RNA, 15 nt, Homo sapiens
cuggaggagcccagg

SEQ ID NO: 1282731 - RNA, 13 nt, Homo sapiens
cuggagucgggac

SEQ ID NO: 1282732 - RNA, 14 nt, Homo sapiens
cuggcaaacaugug

SEQ ID NO: 1282733 - RNA, 13 nt, Homo sapiens
cuggccgggaccc

SEQ ID NO: 1282734 - RNA, 15 nt, Homo sapiens
cugggacucauucac

SEQ ID NO: 1282735 - RNA, 15 nt, Homo sapiens
cugggagcacaggca

SEQ ID NO: 1282736 - RNA, 18 nt, Homo sapiens
cugggagcacaggcacug

SEQ ID NO: 1282737 - RNA, 19 nt, Homo sapiens
cugguauuuuaucuuugau

SEQ ID NO: 1282738 - RNA, 17 nt, Homo sapiens
cuggucacauugccuua

SEQ ID NO: 1282739 - RNA, 13 nt, Homo sapiens
cuggucauacauu

SEQ ID NO: 1282740 - RNA, 23 nt, Homo sapiens
cuggugugugccucauugcuugg

SEQ ID NO: 1282741 - RNA, 15 nt, Homo sapiens
cuguaccaugugcua

SEQ ID NO: 1282742 - RNA, 21 nt, Homo sapiens
cuguagguacguuuuauauua

SEQ ID NO: 1282743 - RNA, 12 nt, Homo sapiens
cugucuaccuga

SEQ ID NO: 1282744 - RNA, 17 nt, Homo sapiens
cuguguaauauaaaaga

SEQ ID NO: 1282745 - RNA, 21 nt, Homo sapiens
cugugucacuguaugugaaag

SEQ ID NO: 1282746 - RNA, 15 nt, Homo sapiens
cuguuaccagaggac

SEQ ID NO: 1282747 - RNA, 15 nt, Homo sapiens
cuguucaaaauucca

SEQ ID NO: 1282748 - RNA, 16 nt, Homo sapiens
cuguucuuuuguccca

SEQ ID NO: 1282749 - RNA, 18 nt, Homo sapiens
cuuaaaagaacauguaua

SEQ ID NO: 1282750 - RNA, 14 nt, Homo sapiens
cuuaaaaucuaauu

SEQ ID NO: 1282751 - RNA, 15 nt, Homo sapiens
cuuaaaucaguuuau

SEQ ID NO: 1282752 - RNA, 21 nt, Homo sapiens
cuuaaguguaaauaauauaaa

SEQ ID NO: 1282753 - RNA, 17 nt, Homo sapiens
cuuaauaauguguacau

SEQ ID NO: 1282754 - RNA, 14 nt, Homo sapiens
cuuacaacuccccc

SEQ ID NO: 1282755 - RNA, 17 nt, Homo sapiens
cuuacagucagcacaga

SEQ ID NO: 1282756 - RNA, 15 nt, Homo sapiens
cuuacuuugugcaaa

SEQ ID NO: 1282757 - RNA, 13 nt, Homo sapiens
cuuagaaugccau

SEQ ID NO: 1282758 - RNA, 21 nt, Homo sapiens
cuuagauagaagaugggaaaa

SEQ ID NO: 1282759 - RNA, 23 nt, Homo sapiens
cuuaucaacauuuguuccaugag

SEQ ID NO: 1282760 - RNA, 19 nt, Homo sapiens
cuuaugaaagaaagcuuua

SEQ ID NO: 1282761 - RNA, 13 nt, Homo sapiens
cuuaugaaccuuu

SEQ ID NO: 1282762 - RNA, 16 nt, Homo sapiens
cuuaugauauucucau

SEQ ID NO: 1282763 - RNA, 11 nt, Homo sapiens
cuuauguuaca

SEQ ID NO: 1282764 - RNA, 12 nt, Homo sapiens
cuucaccaccuc

SEQ ID NO: 1282765 - RNA, 14 nt, Homo sapiens
cuucacgcuuucag

SEQ ID NO: 1282766 - RNA, 16 nt, Homo sapiens
cuucacuguauaaaua

SEQ ID NO: 1282767 - RNA, 13 nt, Homo sapiens
cuucagcugcuga

SEQ ID NO: 1282768 - RNA, 11 nt, Homo sapiens
cuucaguauua

SEQ ID NO: 1282769 - RNA, 14 nt, Homo sapiens
cuucauuaccucag

SEQ ID NO: 1282770 - RNA, 16 nt, Homo sapiens
cuuccuacccuuccuc

SEQ ID NO: 1282771 - RNA, 14 nt, Homo sapiens
cuuccucacaccag

SEQ ID NO: 1282772 - RNA, 23 nt, Homo sapiens
cuucuaccucuuggcugccuugu

SEQ ID NO: 1282773 - RNA, 21 nt, Homo sapiens
cuucucacccuaugugggugg

SEQ ID NO: 1282774 - RNA, 13 nt, Homo sapiens
cuucucuacagac

SEQ ID NO: 1282775 - RNA, 15 nt, Homo sapiens
cuucucuacagacuc

SEQ ID NO: 1282776 - RNA, 19 nt, Homo sapiens
cuucucuacagacuccaaa

SEQ ID NO: 1282777 - RNA, 20 nt, Homo sapiens
cuucucuacagacuccaaaa

SEQ ID NO: 1282778 - RNA, 21 nt, Homo sapiens
cuucuuguaauauuucuucaa

SEQ ID NO: 1282779 - RNA, 17 nt, Homo sapiens
cuucuuugauaguguaa

SEQ ID NO: 1282780 - RNA, 20 nt, Homo sapiens
cuucuuuuuuuuugagaugg

SEQ ID NO: 1282781 - RNA, 12 nt, Homo sapiens
cuugaaugccau

SEQ ID NO: 1282782 - RNA, 13 nt, Homo sapiens
cuugaaugccaua

SEQ ID NO: 1282783 - RNA, 20 nt, Homo sapiens
cuugaguguuaugugaauuu

SEQ ID NO: 1282784 - RNA, 22 nt, Homo sapiens
cuugaucaacaucuuuucuugc

SEQ ID NO: 1282785 - RNA, 16 nt, Homo sapiens
cuugauccacuucucu

SEQ ID NO: 1282786 - RNA, 10 nt, Homo sapiens
cuugcauaau

SEQ ID NO: 1282787 - RNA, 19 nt, Homo sapiens
cuuggcagcccgggucauc

SEQ ID NO: 1282788 - RNA, 15 nt, Homo sapiens
cuugguauagcauau

SEQ ID NO: 1282789 - RNA, 19 nt, Homo sapiens
cuuguaaaauuucacuuaa

SEQ ID NO: 1282790 - RNA, 15 nt, Homo sapiens
cuuguagcauccugu

SEQ ID NO: 1282791 - RNA, 13 nt, Homo sapiens
cuuguccccauga

SEQ ID NO: 1282792 - RNA, 18 nt, Homo sapiens
cuuuacagauguagauau

SEQ ID NO: 1282793 - RNA, 14 nt, Homo sapiens
cuuuaccuguucaa

SEQ ID NO: 1282794 - RNA, 23 nt, Homo sapiens
cuuuauaccccauuugauuucga

SEQ ID NO: 1282795 - RNA, 19 nt, Homo sapiens
cuuuauauggccucaagau

SEQ ID NO: 1282796 - RNA, 22 nt, Homo sapiens
cuuuauauggccucaagaucaa

SEQ ID NO: 1282797 - RNA, 13 nt, Homo sapiens
cuuuaugaacucc

SEQ ID NO: 1282798 - RNA, 18 nt, Homo sapiens
cuuucagcgaaugacaaa

SEQ ID NO: 1282799 - RNA, 18 nt, Homo sapiens
cuuucaugaacacagccu

SEQ ID NO: 1282800 - RNA, 16 nt, Homo sapiens
cuuucuguugccaugg

SEQ ID NO: 1282801 - RNA, 18 nt, Homo sapiens
cuuucuugcacuauucca

SEQ ID NO: 1282802 - RNA, 11 nt, Homo sapiens
cuuucuuggcc

SEQ ID NO: 1282803 - RNA, 15 nt, Homo sapiens
cuuugaagucugauu

SEQ ID NO: 1282804 - RNA, 23 nt, Homo sapiens
cuuugcugaaugucauuauuuga

SEQ ID NO: 1282805 - RNA, 19 nt, Homo sapiens
cuuuggacagaagcagcuc

SEQ ID NO: 1282806 - RNA, 21 nt, Homo sapiens
cuuuggacagaagcagcucuu

SEQ ID NO: 1282807 - RNA, 14 nt, Homo sapiens
cuuuguaucauuca

SEQ ID NO: 1282808 - RNA, 13 nt, Homo sapiens
cuuugucccagaa

SEQ ID NO: 1282809 - RNA, 16 nt, Homo sapiens
cuuuguuuaaaugcca

SEQ ID NO: 1282810 - RNA, 15 nt, Homo sapiens
gcuuaaagcuugauu

SEQ ID NO: 1282811 - RNA, 19 nt, Homo sapiens
gcuuauagaggaacuugaa

SEQ ID NO: 1282812 - RNA, 22 nt, Homo sapiens
gcuucacugguugaguguugcu

SEQ ID NO: 1282813 - RNA, 22 nt, Homo sapiens
gcuucagcucuucuugacauca

SEQ ID NO: 1282814 - RNA, 16 nt, Homo sapiens
aauguauuaguacaaa

SEQ ID NO: 1282815 - RNA, 17 nt, Homo sapiens
aaugucaguauguggaa

SEQ ID NO: 1282816 - RNA, 12 nt, Homo sapiens
aauguccaccug

SEQ ID NO: 1282817 - RNA, 13 nt, Homo sapiens
aaugucuguauca

SEQ ID NO: 1282818 - RNA, 19 nt, Homo sapiens
aauguuaaggaaacucuua

SEQ ID NO: 1282819 - RNA, 12 nt, Homo sapiens
aauuaacacugc

SEQ ID NO: 1282820 - RNA, 18 nt, Homo sapiens
aauuaauggaauauguaa

SEQ ID NO: 1282821 - RNA, 20 nt, Homo sapiens
aauuaaugguugaggcagga

SEQ ID NO: 1282822 - RNA, 22 nt, Homo sapiens
aauuacguucuuacaagcuuaa

SEQ ID NO: 1282823 - RNA, 21 nt, Homo sapiens
aauuaucuaaaguaugaagca

SEQ ID NO: 1282824 - RNA, 20 nt, Homo sapiens
aauucagugggaccaaugaa

SEQ ID NO: 1282825 - RNA, 18 nt, Homo sapiens
aauuccauuuacuugauc

SEQ ID NO: 1282826 - RNA, 15 nt, Homo sapiens
aauucugcaagcuuu

SEQ ID NO: 1282827 - RNA, 13 nt, Homo sapiens
aauuggucauucc

SEQ ID NO: 1282828 - RNA, 22 nt, Homo sapiens
aauuuacuuuuuaaacaguguu

SEQ ID NO: 1282829 - RNA, 15 nt, Homo sapiens
aauuuagucccuuaa

SEQ ID NO: 1282830 - RNA, 18 nt, Homo sapiens
guagaauugagucuucca

SEQ ID NO: 1282831 - RNA, 15 nt, Homo sapiens
guagcuagccugaga

SEQ ID NO: 1282832 - RNA, 19 nt, Homo sapiens
guagguaauauugcaaggc

SEQ ID NO: 1282833 - RNA, 20 nt, Homo sapiens
guaguggaauuaacaggaaa

SEQ ID NO: 1282834 - RNA, 20 nt, Homo sapiens
guaucucuuuugaauccaug

SEQ ID NO: 1282835 - RNA, 21 nt, Homo sapiens
guaucucuuuugaauccaugc

SEQ ID NO: 1282836 - RNA, 17 nt, Homo sapiens
guauuacuaauuuccau

SEQ ID NO: 1282837 - RNA, 21 nt, Homo sapiens
guauuccccuuuauguacagg

SEQ ID NO: 1282838 - RNA, 21 nt, Homo sapiens
guauuguucuguuuguguuau

SEQ ID NO: 1282839 - RNA, 20 nt, Homo sapiens
guauuuaacuacaucugccu

SEQ ID NO: 1282840 - RNA, 15 nt, Homo sapiens
gucaaaggagaacaa

SEQ ID NO: 1282841 - RNA, 17 nt, Homo sapiens
gucagcaacagagcaaa

SEQ ID NO: 1282842 - RNA, 16 nt, Homo sapiens
gucagcacagaacaca

SEQ ID NO: 1282843 - RNA, 23 nt, Homo sapiens
gucagcacagaacacacugagac

SEQ ID NO: 1282844 - RNA, 15 nt, Homo sapiens
gucaguauguggaag

SEQ ID NO: 1282845 - RNA, 18 nt, Homo sapiens
gucauaaugaacacucau

SEQ ID NO: 1282846 - RNA, 16 nt, Homo sapiens
guccagaagaccccac

SEQ ID NO: 1282847 - RNA, 17 nt, Homo sapiens
guccaugcaggggccac

SEQ ID NO: 1282848 - RNA, 22 nt, Homo sapiens
guccccacagcuucucuacaga

SEQ ID NO: 1282849 - RNA, 17 nt, Homo sapiens
gucccugaagucuugca

SEQ ID NO: 1282850 - RNA, 13 nt, Homo sapiens
guccuaugcaaua

SEQ ID NO: 1282851 - RNA, 22 nt, Homo sapiens
guccuuuccccggaguaccuau

SEQ ID NO: 1282852 - RNA, 13 nt, Homo sapiens
gucgacucuccau

SEQ ID NO: 1282853 - RNA, 17 nt, Homo sapiens
gucuaucuaaugacaug

SEQ ID NO: 1282854 - RNA, 19 nt, Homo sapiens
gucuauuugagacuuagaa

SEQ ID NO: 1282855 - RNA, 13 nt, Homo sapiens
gucucugugagac

SEQ ID NO: 1282856 - RNA, 20 nt, Homo sapiens
gucucuuuauauggccucaa

SEQ ID NO: 1282857 - RNA, 18 nt, Homo sapiens
gucugaugagaacucuga

SEQ ID NO: 1282858 - RNA, 13 nt, Homo sapiens
gucuuucuuugcu

SEQ ID NO: 1282859 - RNA, 14 nt, Homo sapiens
gucuuuuuguuaug

SEQ ID NO: 1282860 - RNA, 18 nt, Homo sapiens
gugaaauauaugcuauau

SEQ ID NO: 1282861 - RNA, 14 nt, Homo sapiens
gugagaccuggcag

SEQ ID NO: 1282862 - RNA, 21 nt, Homo sapiens
gugagcuuuuuguucccucau

SEQ ID NO: 1282863 - RNA, 15 nt, Homo sapiens
gugaucaucuuugcu

SEQ ID NO: 1282864 - RNA, 21 nt, Homo sapiens
gugauguguccugauaagcug

SEQ ID NO: 1282865 - RNA, 18 nt, Homo sapiens
gugccuuggugugcugua

SEQ ID NO: 1282866 - RNA, 15 nt, Homo sapiens
gugcuaaaccauuca

SEQ ID NO: 1282867 - RNA, 12 nt, Homo sapiens
gugcuacagggg

SEQ ID NO: 1282868 - RNA, 21 nt, Homo sapiens
gugcuuuauaccccauuugau

SEQ ID NO: 1282869 - RNA, 22 nt, Homo sapiens
guggcagaauggggugcaugaa

SEQ ID NO: 1282870 - RNA, 20 nt, Homo sapiens
guggcauguggguugugaua

SEQ ID NO: 1282871 - RNA, 16 nt, Homo sapiens
guggcauuuucacuuu

SEQ ID NO: 1282872 - RNA, 16 nt, Homo sapiens
guggccaggcugccug

SEQ ID NO: 1282873 - RNA, 21 nt, Homo sapiens
guggugaccaaugcauuaccu

SEQ ID NO: 1282874 - RNA, 19 nt, Homo sapiens
gugguguuaaucauuucau

SEQ ID NO: 1282875 - RNA, 14 nt, Homo sapiens
guguaacaggucuc

SEQ ID NO: 1282876 - RNA, 16 nt, Homo sapiens
guguacacgugacaga

SEQ ID NO: 1282877 - RNA, 17 nt, Homo sapiens
guguacacgugacagag

SEQ ID NO: 1282878 - RNA, 15 nt, Homo sapiens
guguccuaugcaaua

SEQ ID NO: 1282879 - RNA, 20 nt, Homo sapiens
gugugaauaaagugcugcgg

SEQ ID NO: 1282880 - RNA, 13 nt, Homo sapiens
gugugacuugaua

SEQ ID NO: 1282881 - RNA, 14 nt, Homo sapiens
gugugugucucuga

SEQ ID NO: 1282882 - RNA, 19 nt, Homo sapiens
guguucuacacucaucuua

SEQ ID NO: 1282883 - RNA, 14 nt, Homo sapiens
guguucuucauuac

SEQ ID NO: 1282884 - RNA, 19 nt, Homo sapiens
guguucuucauuaccucag

SEQ ID NO: 1282885 - RNA, 13 nt, Homo sapiens
guguugcauaaac

SEQ ID NO: 1282886 - RNA, 15 nt, Homo sapiens
guuaacagacacugu

SEQ ID NO: 1282887 - RNA, 23 nt, Homo sapiens
guuacaaauuuuuuaauuuccaa

SEQ ID NO: 1282888 - RNA, 15 nt, Homo sapiens
guuaccaaguaugaa

SEQ ID NO: 1282889 - RNA, 16 nt, Homo sapiens
guuaccuuacugaaaa

SEQ ID NO: 1282890 - RNA, 17 nt, Homo sapiens
guuacuuagaaugccau

SEQ ID NO: 1282891 - RNA, 19 nt, Homo sapiens
guuccaagagauccaucaa

SEQ ID NO: 1282892 - RNA, 16 nt, Homo sapiens
guucccucauucugca

SEQ ID NO: 1282893 - RNA, 20 nt, Homo sapiens
guuccuuacuuuacugccug

SEQ ID NO: 1282894 - RNA, 17 nt, Homo sapiens
guucuacacucaucuua

SEQ ID NO: 1282895 - RNA, 16 nt, Homo sapiens
guugguuuacuguguu

SEQ ID NO: 1282896 - RNA, 14 nt, Homo sapiens
guuguauugcauau

SEQ ID NO: 1282897 - RNA, 14 nt, Homo sapiens
guuguccagaucac

SEQ ID NO: 1282898 - RNA, 15 nt, Homo sapiens
guuuaaaugccaaaa

SEQ ID NO: 1282899 - RNA, 14 nt, Homo sapiens
guuuaugagccaga

SEQ ID NO: 1282900 - RNA, 15 nt, Homo sapiens
guuucaucccaugua

SEQ ID NO: 1282901 - RNA, 17 nt, Homo sapiens
guuucuccagagggaau

SEQ ID NO: 1282902 - RNA, 16 nt, Homo sapiens
guuucuggcagccagu

SEQ ID NO: 1282903 - RNA, 23 nt, Homo sapiens
guuucuuucuaguggucuuugua

SEQ ID NO: 1282904 - RNA, 21 nt, Homo sapiens
guuugccaagcuaaucugccu

SEQ ID NO: 1282905 - RNA, 13 nt, Homo sapiens
guuuucuaaagua

SEQ ID NO: 1282906 - RNA, 21 nt, Homo sapiens
guuuucuucuaaucauaacau

SEQ ID NO: 1282907 - RNA, 19 nt, Homo sapiens
guuuuggggacucauuuca

SEQ ID NO: 1282908 - RNA, 17 nt, Homo sapiens
uaaaaagcuucagggaa

SEQ ID NO: 1282909 - RNA, 14 nt, Homo sapiens
uaaaacagauauua

SEQ ID NO: 1282910 - RNA, 16 nt, Homo sapiens
uaaaauauauacuaua

SEQ ID NO: 1282911 - RNA, 14 nt, Homo sapiens
uaaaaucuaauuca

SEQ ID NO: 1282912 - RNA, 16 nt, Homo sapiens
uaaaaugcuucacugu

SEQ ID NO: 1282913 - RNA, 17 nt, Homo sapiens
uaaaauugcaguuucau

SEQ ID NO: 1282914 - RNA, 14 nt, Homo sapiens
uaaaauugugaugu

SEQ ID NO: 1282915 - RNA, 15 nt, Homo sapiens
uaaaauuucacuuaa

SEQ ID NO: 1282916 - RNA, 23 nt, Homo sapiens
uaaacaaauguaugauuacauca

SEQ ID NO: 1282917 - RNA, 23 nt, Homo sapiens
uaaacuuguguauugagucuuaa

SEQ ID NO: 1282918 - RNA, 14 nt, Homo sapiens
uaaacuuuucauua

SEQ ID NO: 1282919 - RNA, 12 nt, Homo sapiens
uaaagcuuuauc

SEQ ID NO: 1282920 - RNA, 21 nt, Homo sapiens
uaaagcuuuaucuuuguguaa

SEQ ID NO: 1282921 - RNA, 14 nt, Homo sapiens
uaaaggacaaacag

SEQ ID NO: 1282922 - RNA, 18 nt, Homo sapiens
uaaagggagaaaugccag

SEQ ID NO: 1282923 - RNA, 17 nt, Homo sapiens
uaaaguacagacuuuuu

SEQ ID NO: 1282924 - RNA, 23 nt, Homo sapiens
uaaaguauguuuucaauguuuca

SEQ ID NO: 1282925 - RNA, 13 nt, Homo sapiens
uaaauaugcagug

SEQ ID NO: 1282926 - RNA, 21 nt, Homo sapiens
uaaaucuguuugacagucugc

SEQ ID NO: 1282927 - RNA, 20 nt, Homo sapiens
uaaauuaugggaaucaagau

SEQ ID NO: 1282928 - RNA, 22 nt, Homo sapiens
uaaauuguuucucuuucugcau

SEQ ID NO: 1282929 - RNA, 21 nt, Homo sapiens
uaaauuuaugguucucaggcc

SEQ ID NO: 1282930 - RNA, 16 nt, Homo sapiens
uaaauuuaugugaugg

SEQ ID NO: 1282931 - RNA, 20 nt, Homo sapiens
uaaauuuggcuucuguuguc

SEQ ID NO: 1282932 - RNA, 19 nt, Homo sapiens
uaacagaacagcuucaggu

SEQ ID NO: 1282933 - RNA, 17 nt, Homo sapiens
uaacagguuuucuucua

SEQ ID NO: 1282934 - RNA, 22 nt, Homo sapiens
uaacauuaccuuacuguggagg

SEQ ID NO: 1282935 - RNA, 16 nt, Homo sapiens
uaaccaguuuagcuuu

SEQ ID NO: 1282936 - RNA, 22 nt, Homo sapiens
uaacucagucuuuaaucugaga

SEQ ID NO: 1282937 - RNA, 23 nt, Homo sapiens
uaacuguauuucaguauuuucca

SEQ ID NO: 1282938 - RNA, 19 nt, Homo sapiens
uuaacuguauuucaguauu

SEQ ID NO: 1282939 - RNA, 15 nt, Homo sapiens
uuaaguuuaccaaau

SEQ ID NO: 1282940 - RNA, 23 nt, Homo sapiens
uuaaucaaaccacuguuauuaac

SEQ ID NO: 1282941 - RNA, 16 nt, Homo sapiens
uuaaucucuaguaaaa

SEQ ID NO: 1282942 - RNA, 19 nt, Homo sapiens
uuacaacccgguucacucu

SEQ ID NO: 1282943 - RNA, 23 nt, Homo sapiens
uuacaaucgagacugcaauguga

SEQ ID NO: 1282944 - RNA, 18 nt, Homo sapiens
uuacauguuguaagcaug

SEQ ID NO: 1282945 - RNA, 21 nt, Homo sapiens
uuaccagagggucaaaggaga

SEQ ID NO: 1282946 - RNA, 19 nt, Homo sapiens
uuaccauucagcaugagau

SEQ ID NO: 1282947 - RNA, 21 nt, Homo sapiens
uuacuauuuauugcugaauga

SEQ ID NO: 1282948 - RNA, 15 nt, Homo sapiens
uuacuuaaaggaaua

SEQ ID NO: 1282949 - RNA, 21 nt, Homo sapiens
uuagaaaaauccuacaaggcu

SEQ ID NO: 1282950 - RNA, 22 nt, Homo sapiens
uuagcaguuuugugauaaguuc

SEQ ID NO: 1282951 - RNA, 16 nt, Homo sapiens
uuagcgagggugguaa

SEQ ID NO: 1282952 - RNA, 18 nt, Homo sapiens
uuagcuccaaaccuucac

SEQ ID NO: 1282953 - RNA, 22 nt, Homo sapiens
uuaggaguucauaguuggaaaa

SEQ ID NO: 1282954 - RNA, 18 nt, Homo sapiens
uuaguauuuaacuacauc

SEQ ID NO: 1282955 - RNA, 22 nt, Homo sapiens
uuagucauucaauaaauuguaa

SEQ ID NO: 1282956 - RNA, 13 nt, Homo sapiens
uuagucauugcag

SEQ ID NO: 1282957 - RNA, 14 nt, Homo sapiens
uuaguguacaugaa

SEQ ID NO: 1282958 - RNA, 19 nt, Homo sapiens
uuaguguuugaaauugaau

SEQ ID NO: 1282959 - RNA, 16 nt, Homo sapiens
uuauaccccauuugau

SEQ ID NO: 1282960 - RNA, 14 nt, Homo sapiens
uuaucagccugugc

SEQ ID NO: 1282961 - RNA, 20 nt, Homo sapiens
uuaugaaccuuuacauccag

SEQ ID NO: 1282962 - RNA, 17 nt, Homo sapiens
uuaugagacacaggaug

SEQ ID NO: 1282963 - RNA, 20 nt, Homo sapiens
uuaugagaugccugaagcca

SEQ ID NO: 1282964 - RNA, 14 nt, Homo sapiens
uuauguacaggaug

SEQ ID NO: 1282965 - RNA, 22 nt, Homo sapiens
uuauugcaucuguuauucacca

SEQ ID NO: 1282966 - RNA, 18 nt, Homo sapiens
uuauuugcaggucuuuaa

SEQ ID NO: 1282967 - RNA, 21 nt, Homo sapiens
uucaaaagcacuuugugcugu

SEQ ID NO: 1282968 - RNA, 17 nt, Homo sapiens
uucaaaauuggacuuaa

SEQ ID NO: 1282969 - RNA, 15 nt, Homo sapiens
uucaagcgcuuaacu

SEQ ID NO: 1282970 - RNA, 20 nt, Homo sapiens
uucaagugaguggcaugugg

SEQ ID NO: 1282971 - RNA, 15 nt, Homo sapiens
uucaauaaauuguaa

SEQ ID NO: 1282972 - RNA, 20 nt, Homo sapiens
uucaccauguaauucaggua

SEQ ID NO: 1282973 - RNA, 14 nt, Homo sapiens
uucagaguuuuacu

SEQ ID NO: 1282974 - RNA, 18 nt, Homo sapiens
uucagaguuuuacuaaga

SEQ ID NO: 1282975 - RNA, 21 nt, Homo sapiens
uucagcugacuccaguauaau

SEQ ID NO: 1282976 - RNA, 20 nt, Homo sapiens
uucaggacacagggaaauca

SEQ ID NO: 1282977 - RNA, 15 nt, Homo sapiens
uucauaguuggaaaa

SEQ ID NO: 1282978 - RNA, 13 nt, Homo sapiens
uucauccaaggaa

SEQ ID NO: 1282979 - RNA, 16 nt, Homo sapiens
uucaucugcucuccuu

SEQ ID NO: 1282980 - RNA, 21 nt, Homo sapiens
uucaugaacacagccugggac

SEQ ID NO: 1282981 - RNA, 16 nt, Homo sapiens
uucaugcauuugcacu

SEQ ID NO: 1282982 - RNA, 14 nt, Homo sapiens
uucauugcauuuau

SEQ ID NO: 1282983 - RNA, 21 nt, Homo sapiens
uuccacacccucacugcugua

SEQ ID NO: 1282984 - RNA, 21 nt, Homo sapiens
uuccgcaccaauaaagccuuc

SEQ ID NO: 1282985 - RNA, 23 nt, Homo sapiens
uuccgcaguguggccaggcugcc

SEQ ID NO: 1282986 - RNA, 15 nt, Homo sapiens
uuccuucaccaccuc

SEQ ID NO: 1282987 - RNA, 21 nt, Homo sapiens
uucuaacuuuaugaacucccu

SEQ ID NO: 1282988 - RNA, 20 nt, Homo sapiens
uucucauccugcaggcagcu

SEQ ID NO: 1282989 - RNA, 18 nt, Homo sapiens
uucucauuauuucaucau

SEQ ID NO: 1282990 - RNA, 22 nt, Homo sapiens
uucuuggcccucaguuugcagu

SEQ ID NO: 1282991 - RNA, 20 nt, Homo sapiens
uucuuuauugcaucuguuau

SEQ ID NO: 1282992 - RNA, 17 nt, Homo sapiens
uucuuuuaguuacauga

SEQ ID NO: 1282993 - RNA, 18 nt, Homo sapiens
uugaaugccauagucaaa

SEQ ID NO: 1282994 - RNA, 15 nt, Homo sapiens
uugaauuaccauaga

SEQ ID NO: 1282995 - RNA, 18 nt, Homo sapiens
uugaccugaacucugcaa

SEQ ID NO: 1282996 - RNA, 16 nt, Homo sapiens
uugacuggauauucau

SEQ ID NO: 1282997 - RNA, 17 nt, Homo sapiens
uugacuugacagaacac

SEQ ID NO: 1282998 - RNA, 15 nt, Homo sapiens
uugagcgugauucug

SEQ ID NO: 1282999 - RNA, 23 nt, Homo sapiens
uugaggucaaguaagaagacaug

SEQ ID NO: 1283000 - RNA, 16 nt, Homo sapiens
uugagucucugaacau

SEQ ID NO: 1283001 - RNA, 19 nt, Homo sapiens
uugagucuguuuuguaaag

SEQ ID NO: 1283002 - RNA, 15 nt, Homo sapiens
uugauccaucucagu

SEQ ID NO: 1283003 - RNA, 17 nt, Homo sapiens
uugaugagcugugcaca

SEQ ID NO: 1283004 - RNA, 21 nt, Homo sapiens
uugcaaauauugguuaguauu

SEQ ID NO: 1283005 - RNA, 19 nt, Homo sapiens
uugcacaaaaucacacagc

SEQ ID NO: 1283006 - RNA, 21 nt, Homo sapiens
uugcacaaaaucacacagcca

SEQ ID NO: 1283007 - RNA, 20 nt, Homo sapiens
uugcauaauaaaugcuucag

SEQ ID NO: 1283008 - RNA, 15 nt, Homo sapiens
uugcauggcauuaau

SEQ ID NO: 1283009 - RNA, 20 nt, Homo sapiens
uugccuuauuggcagcucua

SEQ ID NO: 1283010 - RNA, 21 nt, Homo sapiens
uugccuuuccauaaucacuca

SEQ ID NO: 1283011 - RNA, 15 nt, Homo sapiens
uugcuaccucaaggg

SEQ ID NO: 1283012 - RNA, 17 nt, Homo sapiens
uugcuacugguucagca

SEQ ID NO: 1283013 - RNA, 12 nt, Homo sapiens
uugcuccauuuu

SEQ ID NO: 1283014 - RNA, 15 nt, Homo sapiens
uuggaaaaugugcaa

SEQ ID NO: 1283015 - RNA, 22 nt, Homo sapiens
uuggaacuuuucuccugcaugu

SEQ ID NO: 1283016 - RNA, 17 nt, Homo sapiens
uuggagggaucauuuuc

SEQ ID NO: 1283017 - RNA, 13 nt, Homo sapiens
uuggcaacagaaa

SEQ ID NO: 1283018 - RNA, 16 nt, Homo sapiens
uuggcagcucuacucu

SEQ ID NO: 1283019 - RNA, 16 nt, Homo sapiens
uuggcucacacugaga

SEQ ID NO: 1283020 - RNA, 16 nt, Homo sapiens
uugggcaggaacacag

SEQ ID NO: 1283021 - RNA, 10 nt, Homo sapiens
uuggggacuc

SEQ ID NO: 1283022 - RNA, 13 nt, Homo sapiens
uuggggcuuuuac

SEQ ID NO: 1283023 - RNA, 22 nt, Homo sapiens
uuggguucacagaagcacagca

SEQ ID NO: 1283024 - RNA, 13 nt, Homo sapiens
uugguuaaucagu

SEQ ID NO: 1283025 - RNA, 19 nt, Homo sapiens
uugguuugaguuucucuca

SEQ ID NO: 1283026 - RNA, 17 nt, Homo sapiens
uuguaacuuaugaaccu

SEQ ID NO: 1283027 - RNA, 15 nt, Homo sapiens
uuguaagaguguaga

SEQ ID NO: 1283028 - RNA, 18 nt, Homo sapiens
uuguagccacuucacuuu

SEQ ID NO: 1283029 - RNA, 16 nt, Homo sapiens
uuguccccguccccca

SEQ ID NO: 1283030 - RNA, 15 nt, Homo sapiens
uugucugguuucccu

SEQ ID NO: 1283031 - RNA, 16 nt, Homo sapiens
uugugauguguccuga

SEQ ID NO: 1283032 - RNA, 11 nt, Homo sapiens
uuguguucacu

SEQ ID NO: 1283033 - RNA, 14 nt, Homo sapiens
uuguuaggccauuc

SEQ ID NO: 1283034 - RNA, 22 nt, Homo sapiens
uuguucguggagucucauggga

SEQ ID NO: 1283035 - RNA, 21 nt, Homo sapiens
uuuaaaagagacaaacuguaa

SEQ ID NO: 1283036 - RNA, 19 nt, Homo sapiens
uuuaaagauaagucuacau

SEQ ID NO: 1283037 - RNA, 16 nt, Homo sapiens
uuuaaauaucugaaca

SEQ ID NO: 1283038 - RNA, 17 nt, Homo sapiens
uuuaagcgcaacauuuc

SEQ ID NO: 1283039 - RNA, 17 nt, Homo sapiens
uuuaagcucugagcugu

SEQ ID NO: 1283040 - RNA, 15 nt, Homo sapiens
uuuaagguacaugga

SEQ ID NO: 1283041 - RNA, 15 nt, Homo sapiens
uuuaauccuagagau

SEQ ID NO: 1283042 - RNA, 19 nt, Homo sapiens
uuuaauuaaaaacuuuaaa

SEQ ID NO: 1283043 - RNA, 18 nt, Homo sapiens
uuuaauuagaaauaucuu

SEQ ID NO: 1283044 - RNA, 13 nt, Homo sapiens
uuuacuuccucag

SEQ ID NO: 1283045 - RNA, 18 nt, Homo sapiens
uuuacuugaucauucuca

SEQ ID NO: 1283046 - RNA, 16 nt, Homo sapiens
uuuauaauaagacauu

SEQ ID NO: 1283047 - RNA, 16 nt, Homo sapiens
uuuauaucuggaauga

SEQ ID NO: 1283048 - RNA, 19 nt, Homo sapiens
acagcacccucuccagaug

SEQ ID NO: 1283049 - RNA, 17 nt, Homo sapiens
acagccaauccaauuaa

SEQ ID NO: 1283050 - RNA, 20 nt, Homo sapiens
acaggacccugggaccacag

SEQ ID NO: 1283051 - RNA, 18 nt, Homo sapiens
acaggccauggauggaaa

SEQ ID NO: 1283052 - RNA, 17 nt, Homo sapiens
acaggccugagauuuca

SEQ ID NO: 1283053 - RNA, 17 nt, Homo sapiens
acagggcacaggccaug

SEQ ID NO: 1283054 - RNA, 20 nt, Homo sapiens
acagguuacgugagaacaau

SEQ ID NO: 1283055 - RNA, 20 nt, Homo sapiens
acaguaugauggaacaguga

SEQ ID NO: 1283056 - RNA, 13 nt, Homo sapiens
acagucugcucaa

SEQ ID NO: 1283057 - RNA, 22 nt, Homo sapiens
acaguggcaggacaggaaaaac

SEQ ID NO: 1283058 - RNA, 20 nt, Homo sapiens
acaguuuggauguccucaaa

SEQ ID NO: 1283059 - RNA, 23 nt, Homo sapiens
acauaaaugucuguauuucauuc

SEQ ID NO: 1283060 - RNA, 19 nt, Homo sapiens
acauaagcaaagacuauga

SEQ ID NO: 1283061 - RNA, 13 nt, Homo sapiens
gugcaauauguga

SEQ ID NO: 1283062 - RNA, 11 nt, Homo sapiens
gugcagaucac

SEQ ID NO: 1283063 - RNA, 16 nt, Homo sapiens
gugcuaaaccauucau

SEQ ID NO: 1283064 - RNA, 13 nt, Homo sapiens
gugcuggcccugc

SEQ ID NO: 1283065 - RNA, 15 nt, Homo sapiens
guggaauauguuacc

SEQ ID NO: 1283066 - RNA, 15 nt, Homo sapiens
guggaauugugcuga

SEQ ID NO: 1283067 - RNA, 18 nt, Homo sapiens
guggagccaagauuugaa

SEQ ID NO: 1283068 - RNA, 20 nt, Homo sapiens
guggcagcggggcaagcaaa

SEQ ID NO: 1283069 - RNA, 15 nt, Homo sapiens
guguaauuggcccaa

SEQ ID NO: 1283070 - RNA, 23 nt, Homo sapiens
guguauauaugucaaauugucag

SEQ ID NO: 1283071 - RNA, 14 nt, Homo sapiens
gugucuagagucau

SEQ ID NO: 1283072 - RNA, 19 nt, Homo sapiens
gugucuagagucaugugag

SEQ ID NO: 1283073 - RNA, 13 nt, Homo sapiens
gugucucuguaua

SEQ ID NO: 1283074 - RNA, 15 nt, Homo sapiens
gugugcgucacugug

SEQ ID NO: 1283075 - RNA, 13 nt, Homo sapiens
gugugugccucau

SEQ ID NO: 1283076 - RNA, 19 nt, Homo sapiens
gugugugggaguguguaau

SEQ ID NO: 1283077 - RNA, 20 nt, Homo sapiens
guguuggaaaaugugcaaua

SEQ ID NO: 1283078 - RNA, 15 nt, Homo sapiens
guguuggcaguguuu

SEQ ID NO: 1283079 - RNA, 16 nt, Homo sapiens
guguuuauaaugcaau

SEQ ID NO: 1283080 - RNA, 14 nt, Homo sapiens
guuaaugcagggac

SEQ ID NO: 1283081 - RNA, 14 nt, Homo sapiens
guuaggccauucuu

SEQ ID NO: 1283082 - RNA, 22 nt, Homo sapiens
guuaggccauucuugcauugau

SEQ ID NO: 1283083 - RNA, 14 nt, Homo sapiens
guuaguguuuagaa

SEQ ID NO: 1283084 - RNA, 12 nt, Homo sapiens
guuauaaugugu

SEQ ID NO: 1283085 - RNA, 21 nt, Homo sapiens
guuccacauccacacagccaa

SEQ ID NO: 1283086 - RNA, 15 nt, Homo sapiens
guucccucacagcaa

SEQ ID NO: 1283087 - RNA, 13 nt, Homo sapiens
guuccuguuugcu

SEQ ID NO: 1283088 - RNA, 16 nt, Homo sapiens
guucguggagucucau

SEQ ID NO: 1283089 - RNA, 18 nt, Homo sapiens
guucucaucuuucuugau

SEQ ID NO: 1283090 - RNA, 19 nt, Homo sapiens
guuggaugcggaacccaaa

SEQ ID NO: 1283091 - RNA, 10 nt, Homo sapiens
guuggugcaa

SEQ ID NO: 1283092 - RNA, 12 nt, Homo sapiens
guugguuuugac

SEQ ID NO: 1283093 - RNA, 22 nt, Homo sapiens
guuuacaacaaacacugugaug

SEQ ID NO: 1283094 - RNA, 16 nt, Homo sapiens
guuuauaaugcaauga

SEQ ID NO: 1283095 - RNA, 22 nt, Homo sapiens
guuuccugccugcggaccagau

SEQ ID NO: 1283096 - RNA, 16 nt, Homo sapiens
guuucuuagcuuuuua

SEQ ID NO: 1283097 - RNA, 18 nt, Homo sapiens
guuugaugaggcccucca

SEQ ID NO: 1283098 - RNA, 17 nt, Homo sapiens
guuuguaagguggucac

SEQ ID NO: 1283099 - RNA, 17 nt, Homo sapiens
guuuucagauuccacac

SEQ ID NO: 1283100 - RNA, 19 nt, Homo sapiens
guuuucugcuuuaauuuca

SEQ ID NO: 1283101 - RNA, 19 nt, Homo sapiens
guuuuguggaggagcucag

SEQ ID NO: 1283102 - RNA, 16 nt, Homo sapiens
uaaaaauaaagcuacu

SEQ ID NO: 1283103 - RNA, 19 nt, Homo sapiens
uaaaaaucauugauuguca

SEQ ID NO: 1283104 - RNA, 17 nt, Homo sapiens
uaaaagaucuugcagaa

SEQ ID NO: 1283105 - RNA, 21 nt, Homo sapiens
uaaaagcaagaucuacuacau

SEQ ID NO: 1283106 - RNA, 23 nt, Homo sapiens
uaaaauauuuuuaugugcaauaa

SEQ ID NO: 1283107 - RNA, 18 nt, Homo sapiens
uaaaaucuugcauggcau

SEQ ID NO: 1283108 - RNA, 18 nt, Homo sapiens
uaaaauguuggugcaauu

SEQ ID NO: 1283109 - RNA, 18 nt, Homo sapiens
uaaaauuucacuuaauaa

SEQ ID NO: 1283110 - RNA, 17 nt, Homo sapiens
uaaacaaaggaauuaug

SEQ ID NO: 1283111 - RNA, 14 nt, Homo sapiens
uaaacaugcuugca

SEQ ID NO: 1283112 - RNA, 23 nt, Homo sapiens
uaaacugguauuuuaucuuugau

SEQ ID NO: 1283113 - RNA, 18 nt, Homo sapiens
uaaagcaaucuguugaaa

SEQ ID NO: 1283114 - RNA, 17 nt, Homo sapiens
uaaagggagaaaugcca

SEQ ID NO: 1283115 - RNA, 14 nt, Homo sapiens
uaaaguacagacuu

SEQ ID NO: 1283116 - RNA, 22 nt, Homo sapiens
uaaaguauguccuucagcugac

SEQ ID NO: 1283117 - RNA, 16 nt, Homo sapiens
uaaagucauucuagac

SEQ ID NO: 1283118 - RNA, 13 nt, Homo sapiens
uaaauaaacagau

SEQ ID NO: 1283119 - RNA, 16 nt, Homo sapiens
uaaauaugcagugaua

SEQ ID NO: 1283120 - RNA, 17 nt, Homo sapiens
uaaauaugcagugauau

SEQ ID NO: 1283121 - RNA, 18 nt, Homo sapiens
uaaauuacccaguuuaga

SEQ ID NO: 1283122 - RNA, 12 nt, Homo sapiens
uaacagcuuucu

SEQ ID NO: 1283123 - RNA, 20 nt, Homo sapiens
uaacauuccuaaaaugcuuc

SEQ ID NO: 1283124 - RNA, 16 nt, Homo sapiens
uaaccauguaucuaau

SEQ ID NO: 1283125 - RNA, 16 nt, Homo sapiens
uaacuaaaugcucaua

SEQ ID NO: 1283126 - RNA, 15 nt, Homo sapiens
uaacuacaucugccu

SEQ ID NO: 1283127 - RNA, 17 nt, Homo sapiens
uaacucaauauuuucca

SEQ ID NO: 1283128 - RNA, 18 nt, Homo sapiens
uaacucaccucucaaggu

SEQ ID NO: 1283129 - RNA, 19 nt, Homo sapiens
uaacucccccucauucaca

SEQ ID NO: 1283130 - RNA, 12 nt, Homo sapiens
uaacucuacugu

SEQ ID NO: 1283131 - RNA, 17 nt, Homo sapiens
uaacucuguaaaagugu

SEQ ID NO: 1283132 - RNA, 16 nt, Homo sapiens
uaacugugaugaaaua

SEQ ID NO: 1283133 - RNA, 20 nt, Homo sapiens
uaagacauuuguuaggccau

SEQ ID NO: 1283134 - RNA, 21 nt, Homo sapiens
uaagacauuuguuaggccauu

SEQ ID NO: 1283135 - RNA, 18 nt, Homo sapiens
uaagcucuaucugcaaug

SEQ ID NO: 1283136 - RNA, 15 nt, Homo sapiens
uaagggugucuuccu

SEQ ID NO: 1283137 - RNA, 21 nt, Homo sapiens
uaaguacaagcacauuuggcu

SEQ ID NO: 1283138 - RNA, 14 nt, Homo sapiens
uaagucuacauuaa

SEQ ID NO: 1283139 - RNA, 18 nt, Homo sapiens
uaaguugcaccaacuuug

SEQ ID NO: 1283140 - RNA, 17 nt, Homo sapiens
uaaguuucaggugacau

SEQ ID NO: 1283141 - RNA, 20 nt, Homo sapiens
uaauaaaaagcuucagggaa

SEQ ID NO: 1283142 - RNA, 12 nt, Homo sapiens
uaauaagacauu

SEQ ID NO: 1283143 - RNA, 19 nt, Homo sapiens
uaauaauguguacauuagu

SEQ ID NO: 1283144 - RNA, 23 nt, Homo sapiens
uaauaucagcaagucucuuuaua

SEQ ID NO: 1283145 - RNA, 19 nt, Homo sapiens
uaauauggggaugcagcau

SEQ ID NO: 1283146 - RNA, 13 nt, Homo sapiens
uaaucaaaccacu

SEQ ID NO: 1283147 - RNA, 17 nt, Homo sapiens
uaaucaaaccacuguua

SEQ ID NO: 1283148 - RNA, 15 nt, Homo sapiens
uaaucaaguagaaca

SEQ ID NO: 1283149 - RNA, 17 nt, Homo sapiens
uaaucacucagugauug

SEQ ID NO: 1283150 - RNA, 20 nt, Homo sapiens
uaaucacucagugauugcaa

SEQ ID NO: 1283151 - RNA, 12 nt, Homo sapiens
uaaucauaacau

SEQ ID NO: 1283152 - RNA, 18 nt, Homo sapiens
uaaugcuugccaagaaau

SEQ ID NO: 1283153 - RNA, 14 nt, Homo sapiens
uaauucaaaagcac

SEQ ID NO: 1283154 - RNA, 15 nt, Homo sapiens
uaauucaaacuaaua

SEQ ID NO: 1283155 - RNA, 19 nt, Homo sapiens
uaauucuuaggguacucau

SEQ ID NO: 1283156 - RNA, 21 nt, Homo sapiens
uaauuugauaguauugugcau

SEQ ID NO: 1283157 - RNA, 18 nt, Homo sapiens
uaauuuuuuaaacuguag

SEQ ID NO: 1283158 - RNA, 15 nt, Homo sapiens
uacaacaaacacugu

SEQ ID NO: 1283159 - RNA, 19 nt, Homo sapiens
uacaaucgagacugcaaug

SEQ ID NO: 1283160 - RNA, 17 nt, Homo sapiens
uacaauucaggcuuugg

SEQ ID NO: 1283161 - RNA, 13 nt, Homo sapiens
uacaauuugccau

SEQ ID NO: 1283162 - RNA, 15 nt, Homo sapiens
uacaccccaacagca

SEQ ID NO: 1283163 - RNA, 19 nt, Homo sapiens
uacaccccaacagcacccu

SEQ ID NO: 1283164 - RNA, 16 nt, Homo sapiens
uacagacuccaaaagg

SEQ ID NO: 1283165 - RNA, 21 nt, Homo sapiens
uacagacuccaaaaggcccuu

SEQ ID NO: 1283166 - RNA, 14 nt, Homo sapiens
uacagaggacagua

SEQ ID NO: 1283167 - RNA, 22 nt, Homo sapiens
uacaggggccagaagaugaaca

SEQ ID NO: 1283168 - RNA, 14 nt, Homo sapiens
uacaguucauaaau

SEQ ID NO: 1283169 - RNA, 20 nt, Homo sapiens
uacauacagagauuguagua

SEQ ID NO: 1283170 - RNA, 16 nt, Homo sapiens
uaccagugggcaugua

SEQ ID NO: 1283171 - RNA, 16 nt, Homo sapiens
uaccaugaugcaugga

SEQ ID NO: 1283172 - RNA, 14 nt, Homo sapiens
uaccaugugugcua

SEQ ID NO: 1283173 - RNA, 21 nt, Homo sapiens
acugucuuucagauacauggu

SEQ ID NO: 1283174 - RNA, 17 nt, Homo sapiens
acuguuccuguuugcug

SEQ ID NO: 1283175 - RNA, 18 nt, Homo sapiens
acuguugauccaucucag

SEQ ID NO: 1283176 - RNA, 14 nt, Homo sapiens
acuuaauaaugugu

SEQ ID NO: 1283177 - RNA, 20 nt, Homo sapiens
acuuaauaauguguacauua

SEQ ID NO: 1283178 - RNA, 14 nt, Homo sapiens
acuuaucaacauuu

SEQ ID NO: 1283179 - RNA, 15 nt, Homo sapiens
acuuauucucaagaa

SEQ ID NO: 1283180 - RNA, 17 nt, Homo sapiens
acuuauugccaugugga

SEQ ID NO: 1283181 - RNA, 16 nt, Homo sapiens
acuucucucaggaucc

SEQ ID NO: 1283182 - RNA, 20 nt, Homo sapiens
acuucugcaucuuacaguca

SEQ ID NO: 1283183 - RNA, 18 nt, Homo sapiens
acuuuaaagauaagucua

SEQ ID NO: 1283184 - RNA, 17 nt, Homo sapiens
acuuuacugccugaaua

SEQ ID NO: 1283185 - RNA, 12 nt, Homo sapiens
acuuugugaaaa

SEQ ID NO: 1283186 - RNA, 20 nt, Homo sapiens
acuuuugugcuccccuuugc

SEQ ID NO: 1283187 - RNA, 17 nt, Homo sapiens
acuuuuuaaaacacaac

SEQ ID NO: 1283188 - RNA, 18 nt, Homo sapiens
ucacuuuccaccaagugu

SEQ ID NO: 1283189 - RNA, 16 nt, Homo sapiens
ucagaagaaauucugc

SEQ ID NO: 1283190 - RNA, 18 nt, Homo sapiens
ugcuggggaucuagggaa

SEQ ID NO: 1283191 - RNA, 18 nt, Homo sapiens
ugcuguagacauuugcua

SEQ ID NO: 1283192 - RNA, 20 nt, Homo sapiens
ugcuguagacauuugcuaug

SEQ ID NO: 1283193 - RNA, 21 nt, Homo sapiens
ugcuguagacauuugcuauga

SEQ ID NO: 1283194 - RNA, 15 nt, Homo sapiens
ugcuguauccaucca

SEQ ID NO: 1283195 - RNA, 18 nt, Homo sapiens
ugcuguauccauccaugg

SEQ ID NO: 1283196 - RNA, 10 nt, Homo sapiens
ugcugugcaa

SEQ ID NO: 1283197 - RNA, 23 nt, Homo sapiens
ugcuuagcuugagggugacuaug

SEQ ID NO: 1283198 - RNA, 22 nt, Homo sapiens
ugcuucacucaugcaaacugcu

SEQ ID NO: 1283199 - RNA, 22 nt, Homo sapiens
ugcuuuauuuucccuacuugca

SEQ ID NO: 1283200 - RNA, 12 nt, Homo sapiens
ugcuuucuuggc

SEQ ID NO: 1283201 - RNA, 16 nt, Homo sapiens
uggaaaaugugcaaua

SEQ ID NO: 1283202 - RNA, 22 nt, Homo sapiens
uggaagggaaaagcccaugauc

SEQ ID NO: 1283203 - RNA, 18 nt, Homo sapiens
uggaagugugggucugug

SEQ ID NO: 1283204 - RNA, 13 nt, Homo sapiens
uggaauugugcug

SEQ ID NO: 1283205 - RNA, 12 nt, Homo sapiens
uggacagaagca

SEQ ID NO: 1283206 - RNA, 17 nt, Homo sapiens
uggacagaagcagcucu

SEQ ID NO: 1283207 - RNA, 18 nt, Homo sapiens
uggaccacuccugaauga

SEQ ID NO: 1283208 - RNA, 21 nt, Homo sapiens
uggagguuuguuuagaagaag

SEQ ID NO: 1283209 - RNA, 18 nt, Homo sapiens
uggauuaugcccaugaac

SEQ ID NO: 1283210 - RNA, 20 nt, Homo sapiens
uggcagaaggcaaagcaaag

SEQ ID NO: 1283211 - RNA, 14 nt, Homo sapiens
uggcagccaguacc

SEQ ID NO: 1283212 - RNA, 13 nt, Homo sapiens
uggcaguguuugu

SEQ ID NO: 1283213 - RNA, 19 nt, Homo sapiens
uggcccccuauuuugccau

SEQ ID NO: 1283214 - RNA, 13 nt, Homo sapiens
uggccgggacccc

SEQ ID NO: 1283215 - RNA, 13 nt, Homo sapiens
uggccucccccac

SEQ ID NO: 1283216 - RNA, 22 nt, Homo sapiens
uggcggcaggaagccaaagaga

SEQ ID NO: 1283217 - RNA, 16 nt, Homo sapiens
uggcucacacugagaa

SEQ ID NO: 1283218 - RNA, 12 nt, Homo sapiens
uggcuccaaacc

SEQ ID NO: 1283219 - RNA, 21 nt, Homo sapiens
uggcugggaauaagugccagg

SEQ ID NO: 1283220 - RNA, 14 nt, Homo sapiens
uggcuuacuccagg

SEQ ID NO: 1283221 - RNA, 13 nt, Homo sapiens
ugggaccacagag

SEQ ID NO: 1283222 - RNA, 21 nt, Homo sapiens
ugggacucauucacauuucaa

SEQ ID NO: 1283223 - RNA, 17 nt, Homo sapiens
ugggagaaugucaguau

SEQ ID NO: 1283224 - RNA, 14 nt, Homo sapiens
ugggagcacaggca

SEQ ID NO: 1283225 - RNA, 15 nt, Homo sapiens
ugggaggaaccugaa

SEQ ID NO: 1283226 - RNA, 21 nt, Homo sapiens
ugggagugcccccaacagcac

SEQ ID NO: 1283227 - RNA, 17 nt, Homo sapiens
ugggaucgcauugcaua

SEQ ID NO: 1283228 - RNA, 22 nt, Homo sapiens
ugggcaagggaccugcuucuau

SEQ ID NO: 1283229 - RNA, 15 nt, Homo sapiens
uggggcugauuguau

SEQ ID NO: 1283230 - RNA, 12 nt, Homo sapiens
ugggugggacca

SEQ ID NO: 1283231 - RNA, 13 nt, Homo sapiens
uggucauaaugaa

SEQ ID NO: 1283232 - RNA, 16 nt, Homo sapiens
uggucuccaguggaag

SEQ ID NO: 1283233 - RNA, 14 nt, Homo sapiens
uggucugacuccuu

SEQ ID NO: 1283234 - RNA, 22 nt, Homo sapiens
uggucugacuccuugggguccu

SEQ ID NO: 1283235 - RNA, 22 nt, Homo sapiens
uggucuuuguaagaguguagaa

SEQ ID NO: 1283236 - RNA, 16 nt, Homo sapiens
ugguguugacauacau

SEQ ID NO: 1283237 - RNA, 17 nt, Homo sapiens
ugguuaagacuacugaa

SEQ ID NO: 1283238 - RNA, 15 nt, Homo sapiens
ugguuauaauguguu

SEQ ID NO: 1283239 - RNA, 16 nt, Homo sapiens
ugguucaccuguguac

SEQ ID NO: 1283240 - RNA, 22 nt, Homo sapiens
uguaaaaaaaaaugccuuugag

SEQ ID NO: 1283241 - RNA, 20 nt, Homo sapiens
uguaaaucuauaugauuuca

SEQ ID NO: 1283242 - RNA, 12 nt, Homo sapiens
uguaagcuuuaa

SEQ ID NO: 1283243 - RNA, 18 nt, Homo sapiens
uguaagguggucacuguu

SEQ ID NO: 1283244 - RNA, 15 nt, Homo sapiens
uguaccacaaacaca

SEQ ID NO: 1283245 - RNA, 13 nt, Homo sapiens
uguagaugugcau

SEQ ID NO: 1283246 - RNA, 17 nt, Homo sapiens
uguagccacuucacuuu

SEQ ID NO: 1283247 - RNA, 17 nt, Homo sapiens
uguagcuccucaacuca

SEQ ID NO: 1283248 - RNA, 23 nt, Homo sapiens
uguaucccccacccacuauccca

SEQ ID NO: 1283249 - RNA, 14 nt, Homo sapiens
uguaugacuaaaga

SEQ ID NO: 1283250 - RNA, 15 nt, Homo sapiens
uguaugggaagcaug

SEQ ID NO: 1283251 - RNA, 21 nt, Homo sapiens
uguauuagccagucauuguaa

SEQ ID NO: 1283252 - RNA, 20 nt, Homo sapiens
uguauuuaccuucuaccucu

SEQ ID NO: 1283253 - RNA, 17 nt, Homo sapiens
uguauuuccagugcaau

SEQ ID NO: 1283254 - RNA, 20 nt, Homo sapiens
uguauuuccagugcaauugu

SEQ ID NO: 1283255 - RNA, 12 nt, Homo sapiens
ugucaccuucac

SEQ ID NO: 1283256 - RNA, 20 nt, Homo sapiens
ugucagugugaaaauucagc

SEQ ID NO: 1283257 - RNA, 16 nt, Homo sapiens
uguccaccaccaccug

SEQ ID NO: 1283258 - RNA, 21 nt, Homo sapiens
ugucccaaguugcuaagugaa

SEQ ID NO: 1283259 - RNA, 17 nt, Homo sapiens
uguccgcuauccaccaa

SEQ ID NO: 1283260 - RNA, 18 nt, Homo sapiens
uguccgcuuucaugaaca

SEQ ID NO: 1283261 - RNA, 16 nt, Homo sapiens
ugucgggaauuuuccc

SEQ ID NO: 1283262 - RNA, 12 nt, Homo sapiens
ugucucugugag

SEQ ID NO: 1283263 - RNA, 22 nt, Homo sapiens
ugucucuguuuuguaagcuuua

SEQ ID NO: 1283264 - RNA, 20 nt, Homo sapiens
ugucugaguggcuucacucc

SEQ ID NO: 1283265 - RNA, 20 nt, Homo sapiens
ugugaaggccucgcaggaag

SEQ ID NO: 1283266 - RNA, 22 nt, Homo sapiens
ugugaaggccucgcaggaagac

SEQ ID NO: 1283267 - RNA, 14 nt, Homo sapiens
ugugaaguacauau

SEQ ID NO: 1283268 - RNA, 16 nt, Homo sapiens
ugugauggcaaagaag

SEQ ID NO: 1283269 - RNA, 14 nt, Homo sapiens
ugugauguguccug

SEQ ID NO: 1283270 - RNA, 17 nt, Homo sapiens
ugugcaaaggcaucuga

SEQ ID NO: 1283271 - RNA, 14 nt, Homo sapiens
ugugcccucagauu

SEQ ID NO: 1283272 - RNA, 20 nt, Homo sapiens
ugugccgcaccauugaacug

SEQ ID NO: 1283273 - RNA, 15 nt, Homo sapiens
ugugcucuuuuauaa

SEQ ID NO: 1283274 - RNA, 22 nt, Homo sapiens
ugugcugaguugguguugacau

SEQ ID NO: 1283275 - RNA, 17 nt, Homo sapiens
uguggauacagucauua

SEQ ID NO: 1283276 - RNA, 21 nt, Homo sapiens
uguggauuuuuaaaacagaua

SEQ ID NO: 1283277 - RNA, 19 nt, Homo sapiens
ugugguuaaugccauggac

SEQ ID NO: 1283278 - RNA, 21 nt, Homo sapiens
uguguacuggacauggucugc

SEQ ID NO: 1283279 - RNA, 20 nt, Homo sapiens
uguguacuuuuggguucaca

SEQ ID NO: 1283280 - RNA, 16 nt, Homo sapiens
ugugucaguggaugcu

SEQ ID NO: 1283281 - RNA, 15 nt, Homo sapiens
ugugugcgucacugu

SEQ ID NO: 1283282 - RNA, 15 nt, Homo sapiens
uguguucaguacaau

SEQ ID NO: 1283283 - RNA, 18 nt, Homo sapiens
uguuacagguuacgugag

SEQ ID NO: 1283284 - RNA, 20 nt, Homo sapiens
uguucguggagucucauggg

SEQ ID NO: 1283285 - RNA, 13 nt, Homo sapiens
uguucuacacuca

SEQ ID NO: 1283286 - RNA, 15 nt, Homo sapiens
uguuggcaguguuug

SEQ ID NO: 1283287 - RNA, 21 nt, Homo sapiens
uguuguuccaggauguggaau

SEQ ID NO: 1283288 - RNA, 15 nt, Homo sapiens
uguuucauuaaucaa

SEQ ID NO: 1283289 - RNA, 14 nt, Homo sapiens
uguuuuccuauaau

SEQ ID NO: 1283290 - RNA, 19 nt, Homo sapiens
uuaaaaauaaagcuacuga

SEQ ID NO: 1283291 - RNA, 20 nt, Homo sapiens
uuaaaagagacaaacuguaa

SEQ ID NO: 1283292 - RNA, 15 nt, Homo sapiens
uuaaaaucauaacau

SEQ ID NO: 1283293 - RNA, 21 nt, Homo sapiens
uuaaacucagggagcauuuau

SEQ ID NO: 1283294 - RNA, 22 nt, Homo sapiens
uuaaagaaaaugugucugcaac

SEQ ID NO: 1283295 - RNA, 11 nt, Homo sapiens
uuaaagcaaaa

SEQ ID NO: 1283296 - RNA, 16 nt, Homo sapiens
uuaaaggcuuuuggca

SEQ ID NO: 1283297 - RNA, 15 nt, Homo sapiens
uuaaaguaugcaaaa

SEQ ID NO: 1283298 - RNA, 18 nt, Homo sapiens
uuaaauggcauaccaaaa

SEQ ID NO: 1283299 - RNA, 20 nt, Homo sapiens
uuaacagacacuguaaaaua

SEQ ID NO: 1283300 - RNA, 22 nt, Homo sapiens
uuaacagcgugucaacuuucau

SEQ ID NO: 1283301 - RNA, 21 nt, Homo sapiens
ucugauuuuccuggacaguuu

SEQ ID NO: 1283302 - RNA, 15 nt, Homo sapiens
ucugcuuuaauuuca

SEQ ID NO: 1283303 - RNA, 16 nt, Homo sapiens
ucugcuuuaauuucau

SEQ ID NO: 1283304 - RNA, 18 nt, Homo sapiens
ucugcuuuuuuucaggga

SEQ ID NO: 1283305 - RNA, 14 nt, Homo sapiens
ucuggacacugcca

SEQ ID NO: 1283306 - RNA, 19 nt, Homo sapiens
ucuggcaaacaugugcaac

SEQ ID NO: 1283307 - RNA, 18 nt, Homo sapiens
ucugggcugccaugugaa

SEQ ID NO: 1283308 - RNA, 17 nt, Homo sapiens
ucuggggacaccucagg

SEQ ID NO: 1283309 - RNA, 18 nt, Homo sapiens
ucugggugauaaaauuau

SEQ ID NO: 1283310 - RNA, 18 nt, Homo sapiens
ucugguaucugcauguaa

SEQ ID NO: 1283311 - RNA, 22 nt, Homo sapiens
ucuggucauaaugaacacucau

SEQ ID NO: 1283312 - RNA, 22 nt, Homo sapiens
ucuggugguguuaaucauuuca

SEQ ID NO: 1283313 - RNA, 20 nt, Homo sapiens
ucuguauauagcucuacaca

SEQ ID NO: 1283314 - RNA, 15 nt, Homo sapiens
ucuuaaaaugcaaua

SEQ ID NO: 1283315 - RNA, 16 nt, Homo sapiens
ucuuacaugcauuuga

SEQ ID NO: 1283316 - RNA, 15 nt, Homo sapiens
ucuuccagguucacu

SEQ ID NO: 1283317 - RNA, 17 nt, Homo sapiens
ucuugcacuauuccaca

SEQ ID NO: 1283318 - RNA, 19 nt, Homo sapiens
ucuuggcuuucagaguuug

SEQ ID NO: 1283319 - RNA, 19 nt, Homo sapiens
ucuugguaacaaauaaccu

SEQ ID NO: 1283320 - RNA, 23 nt, Homo sapiens
ucuugguaacaaauaaccuauaa

SEQ ID NO: 1283321 - RNA, 15 nt, Homo sapiens
ucuuuggacagaagc

SEQ ID NO: 1283322 - RNA, 17 nt, Homo sapiens
ucuuuguccauuauuca

SEQ ID NO: 1283323 - RNA, 23 nt, Homo sapiens
ucuuugugcaguguuaguauuca

SEQ ID NO: 1283324 - RNA, 17 nt, Homo sapiens
ugaaaaauaucuuugca

SEQ ID NO: 1283325 - RNA, 21 nt, Homo sapiens
ugaaaauauuuuacccaaaua

SEQ ID NO: 1283326 - RNA, 17 nt, Homo sapiens
ugaaagccacagacaau

SEQ ID NO: 1283327 - RNA, 16 nt, Homo sapiens
ugaaaggaaaugcacc

SEQ ID NO: 1283328 - RNA, 16 nt, Homo sapiens
ugaaaguugcuuuuau

SEQ ID NO: 1283329 - RNA, 19 nt, Homo sapiens
ugaaauauuuugaauacac

SEQ ID NO: 1283330 - RNA, 19 nt, Homo sapiens
ugaacaaguuaguuucuca

SEQ ID NO: 1283331 - RNA, 19 nt, Homo sapiens
ugaaccugggaaccaugaa

SEQ ID NO: 1283332 - RNA, 19 nt, Homo sapiens
ugaacuauuagagcugccu

SEQ ID NO: 1283333 - RNA, 21 nt, Homo sapiens
ugaacuguaccaugugcuaca

SEQ ID NO: 1283334 - RNA, 12 nt, Homo sapiens
ugaagcuggaag

SEQ ID NO: 1283335 - RNA, 16 nt, Homo sapiens
ugaauaaagugcugcg

SEQ ID NO: 1283336 - RNA, 17 nt, Homo sapiens
ugaauaaagugcugcgg

SEQ ID NO: 1283337 - RNA, 14 nt, Homo sapiens
ugaaugcagggaca

SEQ ID NO: 1283338 - RNA, 22 nt, Homo sapiens
ugaauuuaagcaugaguggccu

SEQ ID NO: 1283339 - RNA, 11 nt, Homo sapiens
ugaauuugacu

SEQ ID NO: 1283340 - RNA, 16 nt, Homo sapiens
ugaauuuuugcacauu

SEQ ID NO: 1283341 - RNA, 18 nt, Homo sapiens
ugacaaucaacucuaaua

SEQ ID NO: 1283342 - RNA, 23 nt, Homo sapiens
ugacaaucaacucuaauagugcu

SEQ ID NO: 1283343 - RNA, 19 nt, Homo sapiens
ugacaccauuuuccugccu

SEQ ID NO: 1283344 - RNA, 14 nt, Homo sapiens
ugacagaacacugu

SEQ ID NO: 1283345 - RNA, 13 nt, Homo sapiens
ugacagagugccu

SEQ ID NO: 1283346 - RNA, 20 nt, Homo sapiens
ugaccugaacucugcaacug

SEQ ID NO: 1283347 - RNA, 22 nt, Homo sapiens
ugacguagaauugagucuucca

SEQ ID NO: 1283348 - RNA, 16 nt, Homo sapiens
ugacucucagcagcua

SEQ ID NO: 1283349 - RNA, 19 nt, Homo sapiens
ugacuuuugaagaacaaaa

SEQ ID NO: 1283350 - RNA, 13 nt, Homo sapiens
ugagaacaaucau

SEQ ID NO: 1283351 - RNA, 22 nt, Homo sapiens
ugagaagaaaaucagagaggga

SEQ ID NO: 1283352 - RNA, 14 nt, Homo sapiens
ugagaagaaugacu

SEQ ID NO: 1283353 - RNA, 12 nt, Homo sapiens
ugagacuugaau

SEQ ID NO: 1283354 - RNA, 16 nt, Homo sapiens
ugagcagcaacugugu

SEQ ID NO: 1283355 - RNA, 13 nt, Homo sapiens
ugagccaguguca

SEQ ID NO: 1283356 - RNA, 17 nt, Homo sapiens
ugagcuggggaugucuc

SEQ ID NO: 1283357 - RNA, 19 nt, Homo sapiens
ugaggaacaaucacaaaag

SEQ ID NO: 1283358 - RNA, 19 nt, Homo sapiens
ugaggcccuccacaccugc

SEQ ID NO: 1283359 - RNA, 14 nt, Homo sapiens
ugaggccucucauu

SEQ ID NO: 1283360 - RNA, 17 nt, Homo sapiens
ugagggcagggacauca

SEQ ID NO: 1283361 - RNA, 18 nt, Homo sapiens
ugaggggcucucucauga

SEQ ID NO: 1283362 - RNA, 19 nt, Homo sapiens
ugagggugacuauggagcu

SEQ ID NO: 1283363 - RNA, 20 nt, Homo sapiens
ugaguauugauaaacuuuga

SEQ ID NO: 1283364 - RNA, 17 nt, Homo sapiens
ugagugccaugcuuuuu

SEQ ID NO: 1283365 - RNA, 17 nt, Homo sapiens
ugaguguugcucucuag

SEQ ID NO: 1283366 - RNA, 13 nt, Homo sapiens
ugaguuucucuca

SEQ ID NO: 1283367 - RNA, 19 nt, Homo sapiens
ugauacccaacaguuuauu

SEQ ID NO: 1283368 - RNA, 18 nt, Homo sapiens
ugauauaaagaaauaccu

SEQ ID NO: 1283369 - RNA, 21 nt, Homo sapiens
ugaucacaucuaaagcuuuau

SEQ ID NO: 1283370 - RNA, 22 nt, Homo sapiens
ugaucacaucuaaagcuuuauc

SEQ ID NO: 1283371 - RNA, 16 nt, Homo sapiens
ugauccacuucucuca

SEQ ID NO: 1283372 - RNA, 18 nt, Homo sapiens
ugaugaaugaggaacaau

SEQ ID NO: 1283373 - RNA, 14 nt, Homo sapiens
ugaugagcugugca

SEQ ID NO: 1283374 - RNA, 20 nt, Homo sapiens
ugaugugcaaaggcaucuga

SEQ ID NO: 1283375 - RNA, 15 nt, Homo sapiens
ugauuguauuuaccu

SEQ ID NO: 1283376 - RNA, 22 nt, Homo sapiens
ugcaaaagcaggcuugugcuuu

SEQ ID NO: 1283377 - RNA, 20 nt, Homo sapiens
ugcaaaagggcuuccuaaaa

SEQ ID NO: 1283378 - RNA, 12 nt, Homo sapiens
ugcaaacagugu

SEQ ID NO: 1283379 - RNA, 18 nt, Homo sapiens
ugcaaccagggagcugca

SEQ ID NO: 1283380 - RNA, 15 nt, Homo sapiens
ugcacaaaguggcau

SEQ ID NO: 1283381 - RNA, 17 nt, Homo sapiens
ugcacaaaguggcauaa

SEQ ID NO: 1283382 - RNA, 19 nt, Homo sapiens
ugcagccucagagacauca

SEQ ID NO: 1283383 - RNA, 18 nt, Homo sapiens
ugcagccuccccaggugu

SEQ ID NO: 1283384 - RNA, 17 nt, Homo sapiens
ugcaggaaggagcugcc

SEQ ID NO: 1283385 - RNA, 15 nt, Homo sapiens
ugcaguuucauguau

SEQ ID NO: 1283386 - RNA, 14 nt, Homo sapiens
ugcauacaguaauu

SEQ ID NO: 1283387 - RNA, 19 nt, Homo sapiens
ugcaucauuaauaccuaaa

SEQ ID NO: 1283388 - RNA, 15 nt, Homo sapiens
ugcaucuguacucac

SEQ ID NO: 1283389 - RNA, 22 nt, Homo sapiens
ugcaugcuacucuuagauagaa

SEQ ID NO: 1283390 - RNA, 16 nt, Homo sapiens
ugcauggaguguuuga

SEQ ID NO: 1283391 - RNA, 19 nt, Homo sapiens
ugcauguguauauauguca

SEQ ID NO: 1283392 - RNA, 14 nt, Homo sapiens
ugcauuugcacuau

SEQ ID NO: 1283393 - RNA, 16 nt, Homo sapiens
ugccacacggcucuca

SEQ ID NO: 1283394 - RNA, 19 nt, Homo sapiens
ugccacacugaaacagcca

SEQ ID NO: 1283395 - RNA, 13 nt, Homo sapiens
ugccaugcuuuuu

SEQ ID NO: 1283396 - RNA, 16 nt, Homo sapiens
ugcccagugaccaguc

SEQ ID NO: 1283397 - RNA, 18 nt, Homo sapiens
ugcccagugaccagucac

SEQ ID NO: 1283398 - RNA, 13 nt, Homo sapiens
ugcccccaacagc

SEQ ID NO: 1283399 - RNA, 14 nt, Homo sapiens
ugccucgaaagugu

SEQ ID NO: 1283400 - RNA, 16 nt, Homo sapiens
ugccucgaaaguguca

SEQ ID NO: 1283401 - RNA, 18 nt, Homo sapiens
ugccugaagccaggccau

SEQ ID NO: 1283402 - RNA, 18 nt, Homo sapiens
ugccugggccuguucacg

SEQ ID NO: 1283403 - RNA, 19 nt, Homo sapiens
ugccuucccaggaguacac

SEQ ID NO: 1283404 - RNA, 18 nt, Homo sapiens
ugccuugguauagcauau

SEQ ID NO: 1283405 - RNA, 15 nt, Homo sapiens
ugcgaaagacccaca

SEQ ID NO: 1283406 - RNA, 13 nt, Homo sapiens
ugcggagcaagag

SEQ ID NO: 1283407 - RNA, 11 nt, Homo sapiens
ugcgucacugu

SEQ ID NO: 1283408 - RNA, 13 nt, Homo sapiens
ugcgucacuguga

SEQ ID NO: 1283409 - RNA, 22 nt, Homo sapiens
ugcuaacuagcuuggaaacugg

SEQ ID NO: 1283410 - RNA, 17 nt, Homo sapiens
ugcuacaggggccagaa

SEQ ID NO: 1283411 - RNA, 14 nt, Homo sapiens
acccacuucuccca

SEQ ID NO: 1283412 - RNA, 18 nt, Homo sapiens
acccacuucugcacuugc

SEQ ID NO: 1283413 - RNA, 22 nt, Homo sapiens
acccagaagcaguaauaaucau

SEQ ID NO: 1283414 - RNA, 16 nt, Homo sapiens
acccagcuaugguucu

SEQ ID NO: 1283415 - RNA, 12 nt, Homo sapiens
accccaacagca

SEQ ID NO: 1283416 - RNA, 15 nt, Homo sapiens
accccaacagcaccc

SEQ ID NO: 1283417 - RNA, 18 nt, Homo sapiens
accccaacagcacccucu

SEQ ID NO: 1283418 - RNA, 21 nt, Homo sapiens
accccacccacuucugcacuu

SEQ ID NO: 1283419 - RNA, 12 nt, Homo sapiens
accccauuugau

SEQ ID NO: 1283420 - RNA, 18 nt, Homo sapiens
accccccagcacugagga

SEQ ID NO: 1283421 - RNA, 20 nt, Homo sapiens
accccgagccuggcuccaaa

SEQ ID NO: 1283422 - RNA, 12 nt, Homo sapiens
accccugcauug

SEQ ID NO: 1283423 - RNA, 13 nt, Homo sapiens
acccugaguucau

SEQ ID NO: 1283424 - RNA, 24 nt, Homo sapiens
acccuggaaacuaccagugggcau

SEQ ID NO: 1283425 - RNA, 15 nt, Homo sapiens
acccuuccucaccac

SEQ ID NO: 1283426 - RNA, 18 nt, Homo sapiens
accgcuucucagccacaa

SEQ ID NO: 1283427 - RNA, 13 nt, Homo sapiens
accguucccucac

SEQ ID NO: 1283428 - RNA, 15 nt, Homo sapiens
accucacuagcuccc

SEQ ID NO: 1283429 - RNA, 18 nt, Homo sapiens
accucacuagcuccccaa

SEQ ID NO: 1283430 - RNA, 23 nt, Homo sapiens
accuccuaauuccacacccucac

SEQ ID NO: 1283431 - RNA, 12 nt, Homo sapiens
accuccugccuc

SEQ ID NO: 1283432 - RNA, 19 nt, Homo sapiens
accugaaccugggaaccau

SEQ ID NO: 1283433 - RNA, 19 nt, Homo sapiens
accugaacucugcaacuga

SEQ ID NO: 1283434 - RNA, 14 nt, Homo sapiens
accugcuucuauua

SEQ ID NO: 1283435 - RNA, 19 nt, Homo sapiens
accuggcccugugccuugg

SEQ ID NO: 1283436 - RNA, 14 nt, Homo sapiens
accuuacugaaaaa

SEQ ID NO: 1283437 - RNA, 15 nt, Homo sapiens
accuuccucucccaa

SEQ ID NO: 1283438 - RNA, 14 nt, Homo sapiens
accuucuaccucuu

SEQ ID NO: 1283439 - RNA, 19 nt, Homo sapiens
accuuuggaugcacuuuau

SEQ ID NO: 1283440 - RNA, 17 nt, Homo sapiens
acgacugcaagcuccau

SEQ ID NO: 1283441 - RNA, 15 nt, Homo sapiens
acggggcucuucuca

SEQ ID NO: 1283442 - RNA, 16 nt, Homo sapiens
acgugagaacaaucau

SEQ ID NO: 1283443 - RNA, 16 nt, Homo sapiens
acguuuauagccgaaa

SEQ ID NO: 1283444 - RNA, 20 nt, Homo sapiens
acuaagaugaucaucuccag

SEQ ID NO: 1283445 - RNA, 14 nt, Homo sapiens
acuaaggcauuuga

SEQ ID NO: 1283446 - RNA, 16 nt, Homo sapiens
acuaaugauguuuucc

SEQ ID NO: 1283447 - RNA, 22 nt, Homo sapiens
acuaauuuauucuucacugagg

SEQ ID NO: 1283448 - RNA, 16 nt, Homo sapiens
acuacaggcaccugcc

SEQ ID NO: 1283449 - RNA, 12 nt, Homo sapiens
acuacaucccac

SEQ ID NO: 1283450 - RNA, 19 nt, Homo sapiens
acuacucucuacucuguua

SEQ ID NO: 1283451 - RNA, 15 nt, Homo sapiens
acuacugccauuuca

SEQ ID NO: 1283452 - RNA, 15 nt, Homo sapiens
acuagacaaguccag

SEQ ID NO: 1283453 - RNA, 19 nt, Homo sapiens
acuauaugaaaagagcaaa

SEQ ID NO: 1283454 - RNA, 16 nt, Homo sapiens
acucagugauugcaau

SEQ ID NO: 1283455 - RNA, 18 nt, Homo sapiens
acucaucuuagugccuga

SEQ ID NO: 1283456 - RNA, 15 nt, Homo sapiens
acucccccauugugu

SEQ ID NO: 1283457 - RNA, 19 nt, Homo sapiens
acuccuuucuugcacuauu

SEQ ID NO: 1283458 - RNA, 18 nt, Homo sapiens
acucuccccauuggcacc

SEQ ID NO: 1283459 - RNA, 12 nt, Homo sapiens
acucugaaccac

SEQ ID NO: 1283460 - RNA, 21 nt, Homo sapiens
acucuggagguuuguuuagaa

SEQ ID NO: 1283461 - RNA, 17 nt, Homo sapiens
acucuguaaaagugucu

SEQ ID NO: 1283462 - RNA, 13 nt, Homo sapiens
acugaauacuuga

SEQ ID NO: 1283463 - RNA, 20 nt, Homo sapiens
acugagcuucgcugaguuaa

SEQ ID NO: 1283464 - RNA, 14 nt, Homo sapiens
acugauaaccacuc

SEQ ID NO: 1283465 - RNA, 17 nt, Homo sapiens
acugcugggcuuggcag

SEQ ID NO: 1283466 - RNA, 15 nt, Homo sapiens
acuggagaguggcaa

SEQ ID NO: 1283467 - RNA, 16 nt, Homo sapiens
acuggcagcaucuuca

SEQ ID NO: 1283468 - RNA, 22 nt, Homo sapiens
acuggcagggacgaggacaaau

SEQ ID NO: 1283469 - RNA, 15 nt, Homo sapiens
acuggcaugcuaaag

SEQ ID NO: 1283470 - RNA, 14 nt, Homo sapiens
acuggcugauggag

SEQ ID NO: 1283471 - RNA, 16 nt, Homo sapiens
acuggucacauugccu

SEQ ID NO: 1283472 - RNA, 18 nt, Homo sapiens
acuguacucugugggcaa

SEQ ID NO: 1283473 - RNA, 22 nt, Homo sapiens
acuguaugugaaaggaaaugca

SEQ ID NO: 1283474 - RNA, 23 nt, Homo sapiens
acuguauuuauugugaugccuug

SEQ ID NO: 1283475 - RNA, 22 nt, Homo sapiens
acugucccaaguugcuaaguga

SEQ ID NO: 1283476 - RNA, 12 nt, Homo sapiens
acugucuuucag

SEQ ID NO: 1283477 - RNA, 17 nt, Homo sapiens
acuuaaaaucuaauuca

SEQ ID NO: 1283478 - RNA, 22 nt, Homo sapiens
acuuauaauuaugcuaccuacu

SEQ ID NO: 1283479 - RNA, 18 nt, Homo sapiens
acuuaugaaccuuuacau

SEQ ID NO: 1283480 - RNA, 18 nt, Homo sapiens
acuuccuauaugcacuua

SEQ ID NO: 1283481 - RNA, 13 nt, Homo sapiens
acuucucucagga

SEQ ID NO: 1283482 - RNA, 11 nt, Homo sapiens
acuugcacaaa

SEQ ID NO: 1283483 - RNA, 15 nt, Homo sapiens
acuuggcaucauuca

SEQ ID NO: 1283484 - RNA, 18 nt, Homo sapiens
acuugugcccuuguauag

SEQ ID NO: 1283485 - RNA, 19 nt, Homo sapiens
acuuuaaagauaagucuac

SEQ ID NO: 1283486 - RNA, 16 nt, Homo sapiens
agaaaagcaguggcuc

SEQ ID NO: 1283487 - RNA, 21 nt, Homo sapiens
agaaaauaguuuggauuacuu

SEQ ID NO: 1283488 - RNA, 20 nt, Homo sapiens
agaaaauccuaggugcuacu

SEQ ID NO: 1283489 - RNA, 20 nt, Homo sapiens
agaaagucuaucuaaugaca

SEQ ID NO: 1283490 - RNA, 14 nt, Homo sapiens
agaaauauuuaacu

SEQ ID NO: 1283491 - RNA, 19 nt, Homo sapiens
agaaauuaacacccaaaag

SEQ ID NO: 1283492 - RNA, 12 nt, Homo sapiens
agaacaaaaacu

SEQ ID NO: 1283493 - RNA, 16 nt, Homo sapiens
agaacaaaaggcuuug

SEQ ID NO: 1283494 - RNA, 16 nt, Homo sapiens
agaacacaaggucauu

SEQ ID NO: 1283495 - RNA, 18 nt, Homo sapiens
agaaccagagcucagaga

SEQ ID NO: 1283496 - RNA, 18 nt, Homo sapiens
agaacggggcucuucuca

SEQ ID NO: 1283497 - RNA, 21 nt, Homo sapiens
agaacuaagaugaucaucucc

SEQ ID NO: 1283498 - RNA, 16 nt, Homo sapiens
agaacucugagcagug

SEQ ID NO: 1283499 - RNA, 16 nt, Homo sapiens
agaagaaugacuaugc

SEQ ID NO: 1283500 - RNA, 19 nt, Homo sapiens
agaaguuggucuuacuuug

SEQ ID NO: 1283501 - RNA, 18 nt, Homo sapiens
agaaguuugggcuaacau

SEQ ID NO: 1283502 - RNA, 14 nt, Homo sapiens
agaauuaaauugau

SEQ ID NO: 1283503 - RNA, 18 nt, Homo sapiens
agacaauauggucccaaa

SEQ ID NO: 1283504 - RNA, 16 nt, Homo sapiens
agacaggacccuggga

SEQ ID NO: 1283505 - RNA, 13 nt, Homo sapiens
agaccagaaccag

SEQ ID NO: 1283506 - RNA, 12 nt, Homo sapiens
agaccaggugug

SEQ ID NO: 1283507 - RNA, 21 nt, Homo sapiens
agaccauucaggacacaggga

SEQ ID NO: 1283508 - RNA, 19 nt, Homo sapiens
agaccugccccucccucua

SEQ ID NO: 1283509 - RNA, 18 nt, Homo sapiens
agacuauucccuucuaac

SEQ ID NO: 1283510 - RNA, 19 nt, Homo sapiens
agacuauucccuucuaacc

SEQ ID NO: 1283511 - RNA, 13 nt, Homo sapiens
agacuccaaaagg

SEQ ID NO: 1283512 - RNA, 17 nt, Homo sapiens
agacuccaaaaggcccu

SEQ ID NO: 1283513 - RNA, 22 nt, Homo sapiens
agacuggcagggacgaggacaa

SEQ ID NO: 1283514 - RNA, 17 nt, Homo sapiens
agagaaugcccagugac

SEQ ID NO: 1283515 - RNA, 12 nt, Homo sapiens
agagauccauca

SEQ ID NO: 1283516 - RNA, 14 nt, Homo sapiens
agagauggugcuaa

SEQ ID NO: 1283517 - RNA, 16 nt, Homo sapiens
agagauuccugagcca

SEQ ID NO: 1283518 - RNA, 22 nt, Homo sapiens
agagauuccugagccaguguca

SEQ ID NO: 1283519 - RNA, 15 nt, Homo sapiens
agagcccaggagcuc

SEQ ID NO: 1283520 - RNA, 23 nt, Homo sapiens
agagcugccugugccuuuugcca

SEQ ID NO: 1283521 - RNA, 23 nt, Homo sapiens
agagcugggauguuucugucaca

SEQ ID NO: 1283522 - RNA, 14 nt, Homo sapiens
agaggacaguauuu

SEQ ID NO: 1283523 - RNA, 23 nt, Homo sapiens
caucucuuuaccuccuaauucca

SEQ ID NO: 1283524 - RNA, 24 nt, Homo sapiens
caucuuuggguccuuagugcaaua

SEQ ID NO: 1283525 - RNA, 14 nt, Homo sapiens
caucuuuucuugcc

SEQ ID NO: 1283526 - RNA, 14 nt, Homo sapiens
caugaaaagauuau

SEQ ID NO: 1283527 - RNA, 22 nt, Homo sapiens
caugagggugacguagaauuga

SEQ ID NO: 1283528 - RNA, 13 nt, Homo sapiens
caugauccaauca

SEQ ID NO: 1283529 - RNA, 18 nt, Homo sapiens
caugauccaaucaccucc

SEQ ID NO: 1283530 - RNA, 19 nt, Homo sapiens
caugcaggggccacaucca

SEQ ID NO: 1283531 - RNA, 21 nt, Homo sapiens
cauggaacacacgggaagucu

SEQ ID NO: 1283532 - RNA, 18 nt, Homo sapiens
cauggaggcgcugcugcc

SEQ ID NO: 1283533 - RNA, 21 nt, Homo sapiens
caugggaaggguccaucucag

SEQ ID NO: 1283534 - RNA, 22 nt, Homo sapiens
cauguauguggauacagucauu

SEQ ID NO: 1283535 - RNA, 19 nt, Homo sapiens
cauguauuagccagucauu

SEQ ID NO: 1283536 - RNA, 14 nt, Homo sapiens
cauguguauauaug

SEQ ID NO: 1283537 - RNA, 15 nt, Homo sapiens
caugugugcuaauau

SEQ ID NO: 1283538 - RNA, 21 nt, Homo sapiens
cauuaaacucuaaagauuagg

SEQ ID NO: 1283539 - RNA, 20 nt, Homo sapiens
cauuaauaccuaaacuguau

SEQ ID NO: 1283540 - RNA, 16 nt, Homo sapiens
cauuauuauuacuuuu

SEQ ID NO: 1283541 - RNA, 13 nt, Homo sapiens
cauuccaagacag

SEQ ID NO: 1283542 - RNA, 17 nt, Homo sapiens
cauucuuguuggcuuuu

SEQ ID NO: 1283543 - RNA, 15 nt, Homo sapiens
cauugaacuguacca

SEQ ID NO: 1283544 - RNA, 13 nt, Homo sapiens
cauuguguucacu

SEQ ID NO: 1283545 - RNA, 18 nt, Homo sapiens
cauuuaaauuguuucucu

SEQ ID NO: 1283546 - RNA, 19 nt, Homo sapiens
cauuuauuucucuggcaaa

SEQ ID NO: 1283547 - RNA, 14 nt, Homo sapiens
cauuugaaagaaag

SEQ ID NO: 1283548 - RNA, 12 nt, Homo sapiens
cauuuggcuuac

SEQ ID NO: 1283549 - RNA, 11 nt, Homo sapiens
cauuugugccc

SEQ ID NO: 1283550 - RNA, 20 nt, Homo sapiens
cauuuguggucugacuccuu

SEQ ID NO: 1283551 - RNA, 18 nt, Homo sapiens
cauuuucuugucaaugga

SEQ ID NO: 1283552 - RNA, 13 nt, Homo sapiens
ccaaaaacauguu

SEQ ID NO: 1283553 - RNA, 17 nt, Homo sapiens
ccaaacagaacuaugga

SEQ ID NO: 1283554 - RNA, 13 nt, Homo sapiens
ccaaagugcugcg

SEQ ID NO: 1283555 - RNA, 22 nt, Homo sapiens
ccaaaugcugugcaaacagugu

SEQ ID NO: 1283556 - RNA, 10 nt, Homo sapiens
ccaacagcac

SEQ ID NO: 1283557 - RNA, 16 nt, Homo sapiens
ccaacagcacccucuc

SEQ ID NO: 1283558 - RNA, 20 nt, Homo sapiens
ccaaccccccagcacugagg

SEQ ID NO: 1283559 - RNA, 18 nt, Homo sapiens
ccaaccuggggggcagug

SEQ ID NO: 1283560 - RNA, 22 nt, Homo sapiens
ccaaguucuuucuccaucccuc

SEQ ID NO: 1283561 - RNA, 22 nt, Homo sapiens
ccaauaaagccuucaaacuccc

SEQ ID NO: 1283562 - RNA, 14 nt, Homo sapiens
ccaauuuacuuugu

SEQ ID NO: 1283563 - RNA, 21 nt, Homo sapiens
ccacaccugcggcccaaucca

SEQ ID NO: 1283564 - RNA, 19 nt, Homo sapiens
ccacaggccugagauuuca

SEQ ID NO: 1283565 - RNA, 21 nt, Homo sapiens
ccacaggccugagauuucauc

SEQ ID NO: 1283566 - RNA, 21 nt, Homo sapiens
ccacaguggaaagacagcuuc

SEQ ID NO: 1283567 - RNA, 22 nt, Homo sapiens
ccacguauuccagggagccuuu

SEQ ID NO: 1283568 - RNA, 15 nt, Homo sapiens
ccacuuuuugcagcu

SEQ ID NO: 1283569 - RNA, 13 nt, Homo sapiens
ccagacaaaugga

SEQ ID NO: 1283570 - RNA, 15 nt, Homo sapiens
ccagagcagaugcag

SEQ ID NO: 1283571 - RNA, 17 nt, Homo sapiens
ccagagcagaugcagag

SEQ ID NO: 1283572 - RNA, 14 nt, Homo sapiens
ccagaggacaaagc

SEQ ID NO: 1283573 - RNA, 16 nt, Homo sapiens
ccagagggaauugcag

SEQ ID NO: 1283574 - RNA, 17 nt, Homo sapiens
ccagaggggccugccac

SEQ ID NO: 1283575 - RNA, 17 nt, Homo sapiens
ccagaucccuuauccaa

SEQ ID NO: 1283576 - RNA, 17 nt, Homo sapiens
ccagaucucaugagaag

SEQ ID NO: 1283577 - RNA, 19 nt, Homo sapiens
ccagauuggcucacacuga

SEQ ID NO: 1283578 - RNA, 23 nt, Homo sapiens
ccagcaccggccccauuuaccca

SEQ ID NO: 1283579 - RNA, 22 nt, Homo sapiens
ccagcaccuauugaauuaccau

SEQ ID NO: 1283580 - RNA, 15 nt, Homo sapiens
ccagccuggcccacc

SEQ ID NO: 1283581 - RNA, 15 nt, Homo sapiens
ccagcuagugccaaa

SEQ ID NO: 1283582 - RNA, 14 nt, Homo sapiens
ccagcuuuccucau

SEQ ID NO: 1283583 - RNA, 21 nt, Homo sapiens
ccaguggcuggaucugugagg

SEQ ID NO: 1283584 - RNA, 15 nt, Homo sapiens
ccauagagacuuugu

SEQ ID NO: 1283585 - RNA, 16 nt, Homo sapiens
ccauagagacuuugug

SEQ ID NO: 1283586 - RNA, 14 nt, Homo sapiens
ccauagcaccucca

SEQ ID NO: 1283587 - RNA, 18 nt, Homo sapiens
ccauauacucuucaagga

SEQ ID NO: 1283588 - RNA, 15 nt, Homo sapiens
ccaugaaaaugcaac

SEQ ID NO: 1283589 - RNA, 23 nt, Homo sapiens
ccaugaaaaugcaacaacaugua

SEQ ID NO: 1283590 - RNA, 20 nt, Homo sapiens
ccaugaacaaguuaguuucu

SEQ ID NO: 1283591 - RNA, 19 nt, Homo sapiens
ccaugcugcccgcuucuca

SEQ ID NO: 1283592 - RNA, 16 nt, Homo sapiens
ccaugugcuacagggg

SEQ ID NO: 1283593 - RNA, 15 nt, Homo sapiens
ccauucuugcauuga

SEQ ID NO: 1283594 - RNA, 20 nt, Homo sapiens
ccauuugcccuccuccucag

SEQ ID NO: 1283595 - RNA, 17 nt, Homo sapiens
cccaaaggucuaucuac

SEQ ID NO: 1283596 - RNA, 16 nt, Homo sapiens
cccaauaaaauucuga

SEQ ID NO: 1283597 - RNA, 19 nt, Homo sapiens
cccacacccucccuuaccc

SEQ ID NO: 1283598 - RNA, 14 nt, Homo sapiens
cccacugcucauuu

SEQ ID NO: 1283599 - RNA, 13 nt, Homo sapiens
cccagaauggagg

SEQ ID NO: 1283600 - RNA, 23 nt, Homo sapiens
cccagagauaagggugucuuccu

SEQ ID NO: 1283601 - RNA, 19 nt, Homo sapiens
cccagagguaacagaacag

SEQ ID NO: 1283602 - RNA, 22 nt, Homo sapiens
cccagauuggcucacacugaga

SEQ ID NO: 1283603 - RNA, 17 nt, Homo sapiens
cccaggagccuaguaca

SEQ ID NO: 1283604 - RNA, 19 nt, Homo sapiens
cccaggagccuaguacaau

SEQ ID NO: 1283605 - RNA, 12 nt, Homo sapiens
cccaggaguaca

SEQ ID NO: 1283606 - RNA, 12 nt, Homo sapiens
cccaggccagga

SEQ ID NO: 1283607 - RNA, 15 nt, Homo sapiens
ccccaauccaugcuu

SEQ ID NO: 1283608 - RNA, 13 nt, Homo sapiens
ccccagcuuugca

SEQ ID NO: 1283609 - RNA, 23 nt, Homo sapiens
ccccgcagucgucccaggcugcc

SEQ ID NO: 1283610 - RNA, 18 nt, Homo sapiens
ccccucuacccacuucuc

SEQ ID NO: 1283611 - RNA, 16 nt, Homo sapiens
cccgagccuggcucca

SEQ ID NO: 1283612 - RNA, 12 nt, Homo sapiens
cccuauacauuu

SEQ ID NO: 1283613 - RNA, 19 nt, Homo sapiens
cccuaugugggugggacca

SEQ ID NO: 1283614 - RNA, 23 nt, Homo sapiens
cccuaugugggugggaccacaga

SEQ ID NO: 1283615 - RNA, 13 nt, Homo sapiens
cccucagauuccg

SEQ ID NO: 1283616 - RNA, 18 nt, Homo sapiens
cccucaguuugcaguaua

SEQ ID NO: 1283617 - RNA, 22 nt, Homo sapiens
cccucgaggcggaucuuuggac

SEQ ID NO: 1283618 - RNA, 21 nt, Homo sapiens
cccugccaugcucuccaaacc

SEQ ID NO: 1283619 - RNA, 20 nt, Homo sapiens
cccugggcagugagugccau

SEQ ID NO: 1283620 - RNA, 21 nt, Homo sapiens
cccuguaccacaaacacauua

SEQ ID NO: 1283621 - RNA, 15 nt, Homo sapiens
cccugugcugugugg

SEQ ID NO: 1283622 - RNA, 22 nt, Homo sapiens
cccuuuggauuaugcccaugaa

SEQ ID NO: 1283623 - RNA, 11 nt, Homo sapiens
cccuuuuccau

SEQ ID NO: 1283624 - RNA, 19 nt, Homo sapiens
ccgcaccaauaaagccuuc

SEQ ID NO: 1283625 - RNA, 20 nt, Homo sapiens
ccgcaggcuucugugugcug

SEQ ID NO: 1283626 - RNA, 19 nt, Homo sapiens
ccgggcagaggggcagaug

SEQ ID NO: 1283627 - RNA, 18 nt, Homo sapiens
ccuacugcuuccucugaa

SEQ ID NO: 1283628 - RNA, 17 nt, Homo sapiens
ccuagcccuucucucau

SEQ ID NO: 1283629 - RNA, 15 nt, Homo sapiens
ccuauaugcacuuau

SEQ ID NO: 1283630 - RNA, 16 nt, Homo sapiens
ccuaucaaagcuucaa

SEQ ID NO: 1283631 - RNA, 17 nt, Homo sapiens
ccucacuagcuccccaa

SEQ ID NO: 1283632 - RNA, 14 nt, Homo sapiens
ccucauccauagca

SEQ ID NO: 1283633 - RNA, 19 nt, Homo sapiens
ccucauucacaaaguauaa

SEQ ID NO: 1283634 - RNA, 20 nt, Homo sapiens
uuauaacuugcauuacaugu

SEQ ID NO: 1283635 - RNA, 12 nt, Homo sapiens
uuauaaucuuuu

SEQ ID NO: 1283636 - RNA, 14 nt, Homo sapiens
uuauauuaaucucu

SEQ ID NO: 1283637 - RNA, 17 nt, Homo sapiens
uuaucgaaauaacaaug

SEQ ID NO: 1283638 - RNA, 16 nt, Homo sapiens
uuaugaaccuuuacau

SEQ ID NO: 1283639 - RNA, 23 nt, Homo sapiens
uuaugauauucucauuauuucau

SEQ ID NO: 1283640 - RNA, 16 nt, Homo sapiens
uuaugcccaugaacaa

SEQ ID NO: 1283641 - RNA, 17 nt, Homo sapiens
uuaugccccugcacuga

SEQ ID NO: 1283642 - RNA, 19 nt, Homo sapiens
uuauuaggaaguaugguuu

SEQ ID NO: 1283643 - RNA, 17 nt, Homo sapiens
uuauucauuuuguggca

SEQ ID NO: 1283644 - RNA, 12 nt, Homo sapiens
uuauucucaaga

SEQ ID NO: 1283645 - RNA, 14 nt, Homo sapiens
uuauucucaagaag

SEQ ID NO: 1283646 - RNA, 15 nt, Homo sapiens
uuauuuaauaacauu

SEQ ID NO: 1283647 - RNA, 21 nt, Homo sapiens
uucaaaaauacucacauggcu

SEQ ID NO: 1283648 - RNA, 16 nt, Homo sapiens
uucaaaauuggacuua

SEQ ID NO: 1283649 - RNA, 18 nt, Homo sapiens
uucaaacuaauagaauua

SEQ ID NO: 1283650 - RNA, 18 nt, Homo sapiens
uucaagguaacuguacug

SEQ ID NO: 1283651 - RNA, 12 nt, Homo sapiens
uucaccauguaa

SEQ ID NO: 1283652 - RNA, 21 nt, Homo sapiens
uucaccugggcugaggcaucc

SEQ ID NO: 1283653 - RNA, 16 nt, Homo sapiens
uucaccuguguacuga

SEQ ID NO: 1283654 - RNA, 17 nt, Homo sapiens
uucagauuccacacaaa

SEQ ID NO: 1283655 - RNA, 16 nt, Homo sapiens
uucagcggcagugugu

SEQ ID NO: 1283656 - RNA, 21 nt, Homo sapiens
uucagugucgggaauuuuccc

SEQ ID NO: 1283657 - RNA, 20 nt, Homo sapiens
uucauacucuuaaguguaaa

SEQ ID NO: 1283658 - RNA, 12 nt, Homo sapiens
uucaucaugacu

SEQ ID NO: 1283659 - RNA, 21 nt, Homo sapiens
uucauuccuaacacagcaugu

SEQ ID NO: 1283660 - RNA, 23 nt, Homo sapiens
uucauuccuaacacagcaugugu

SEQ ID NO: 1283661 - RNA, 14 nt, Homo sapiens
uuccaggcugguuc

SEQ ID NO: 1283662 - RNA, 15 nt, Homo sapiens
uuccauuuacuugau

SEQ ID NO: 1283663 - RNA, 18 nt, Homo sapiens
uuccauuuacuugaucau

SEQ ID NO: 1283664 - RNA, 21 nt, Homo sapiens
uuccauuuuaaaaugcaucau

SEQ ID NO: 1283665 - RNA, 19 nt, Homo sapiens
uuccccggaguaccuauug

SEQ ID NO: 1283666 - RNA, 23 nt, Homo sapiens
uucccuccccagaauggaggcaa

SEQ ID NO: 1283667 - RNA, 22 nt, Homo sapiens
uuccugccugcggaccagauga

SEQ ID NO: 1283668 - RNA, 15 nt, Homo sapiens
uuccuggacaguuuu

SEQ ID NO: 1283669 - RNA, 20 nt, Homo sapiens
uucuaccucuuggcugccuu

SEQ ID NO: 1283670 - RNA, 20 nt, Homo sapiens
uucuagaugaucaacauaau

SEQ ID NO: 1283671 - RNA, 16 nt, Homo sapiens
uucuaguugcuuguaa

SEQ ID NO: 1283672 - RNA, 19 nt, Homo sapiens
uucuauaaagaucauauau

SEQ ID NO: 1283673 - RNA, 21 nt, Homo sapiens
uucuauggguuggacaaccuc

SEQ ID NO: 1283674 - RNA, 15 nt, Homo sapiens
uucucaagaagaaca

SEQ ID NO: 1283675 - RNA, 14 nt, Homo sapiens
uucucauuucaccc

SEQ ID NO: 1283676 - RNA, 17 nt, Homo sapiens
uucuccuccugucuuua

SEQ ID NO: 1283677 - RNA, 16 nt, Homo sapiens
uucucuacagacucca

SEQ ID NO: 1283678 - RNA, 23 nt, Homo sapiens
uucucuaguucaaguucaccaga

SEQ ID NO: 1283679 - RNA, 23 nt, Homo sapiens
uucugaaauuaaaguaugcaaaa

SEQ ID NO: 1283680 - RNA, 21 nt, Homo sapiens
uucugaggacauuccaagaca

SEQ ID NO: 1283681 - RNA, 20 nt, Homo sapiens
uucugagugaguuuuacucu

SEQ ID NO: 1283682 - RNA, 23 nt, Homo sapiens
uucugccuaucuucuuucacaua

SEQ ID NO: 1283683 - RNA, 19 nt, Homo sapiens
uucugcuuuuuuucaggga

SEQ ID NO: 1283684 - RNA, 19 nt, Homo sapiens
uucuggggacaccucagga

SEQ ID NO: 1283685 - RNA, 21 nt, Homo sapiens
uucuucgggauguuguuugcu

SEQ ID NO: 1283686 - RNA, 22 nt, Homo sapiens
uucuucuuuaaucacuuaacau

SEQ ID NO: 1283687 - RNA, 21 nt, Homo sapiens
uucuucuuugauaguguaaac

SEQ ID NO: 1283688 - RNA, 18 nt, Homo sapiens
uucuugcacuauuccaca

SEQ ID NO: 1283689 - RNA, 21 nt, Homo sapiens
uucuuggcccucaguuugcag

SEQ ID NO: 1283690 - RNA, 21 nt, Homo sapiens
uugaaaaacuuuuagguuguu

SEQ ID NO: 1283691 - RNA, 21 nt, Homo sapiens
uugacagucugcucaacacga

SEQ ID NO: 1283692 - RNA, 22 nt, Homo sapiens
uugacguaagcucuaucugcaa

SEQ ID NO: 1283693 - RNA, 20 nt, Homo sapiens
uugacuauuauagaauggaa

SEQ ID NO: 1283694 - RNA, 18 nt, Homo sapiens
uugaggcaggaccauaca

SEQ ID NO: 1283695 - RNA, 15 nt, Homo sapiens
uugauaaacuuugaa

SEQ ID NO: 1283696 - RNA, 23 nt, Homo sapiens
uugauaauguccaaauacucuga

SEQ ID NO: 1283697 - RNA, 16 nt, Homo sapiens
uugauaguauugugca

SEQ ID NO: 1283698 - RNA, 22 nt, Homo sapiens
uugaucauucucaguauccacu

SEQ ID NO: 1283699 - RNA, 13 nt, Homo sapiens
uugauucacuuca

SEQ ID NO: 1283700 - RNA, 22 nt, Homo sapiens
uugcaaauauugguuaguauuu

SEQ ID NO: 1283701 - RNA, 15 nt, Homo sapiens
uugcaagacauagaa

SEQ ID NO: 1283702 - RNA, 21 nt, Homo sapiens
uugcaaggcaaagacuauucc

SEQ ID NO: 1283703 - RNA, 15 nt, Homo sapiens
uugcacuauuccaca

SEQ ID NO: 1283704 - RNA, 10 nt, Homo sapiens
uugcauuugg

SEQ ID NO: 1283705 - RNA, 19 nt, Homo sapiens
uugccauggugauggugua

SEQ ID NO: 1283706 - RNA, 13 nt, Homo sapiens
uugcccauauaaa

SEQ ID NO: 1283707 - RNA, 13 nt, Homo sapiens
uugcuuaugaaag

SEQ ID NO: 1283708 - RNA, 20 nt, Homo sapiens
uugcuuccugauuaccaguc

SEQ ID NO: 1283709 - RNA, 21 nt, Homo sapiens
uugcuuuugaaggaauacaau

SEQ ID NO: 1283710 - RNA, 20 nt, Homo sapiens
uuggaacuggaggcagggaa

SEQ ID NO: 1283711 - RNA, 16 nt, Homo sapiens
uuggacagaagcagcu

SEQ ID NO: 1283712 - RNA, 23 nt, Homo sapiens
uuggcuucuguugucaccuucac

SEQ ID NO: 1283713 - RNA, 18 nt, Homo sapiens
uuggcuuuuguuacccac

SEQ ID NO: 1283714 - RNA, 17 nt, Homo sapiens
uugggcaggaacacaga

SEQ ID NO: 1283715 - RNA, 22 nt, Homo sapiens
uuggggguccuccuccagggac

SEQ ID NO: 1283716 - RNA, 14 nt, Homo sapiens
uuggguucacagaa

SEQ ID NO: 1283717 - RNA, 20 nt, Homo sapiens
uuggucuuacuuugugcaaa

SEQ ID NO: 1283718 - RNA, 19 nt, Homo sapiens
uuguaaaauuucacuuaau

SEQ ID NO: 1283719 - RNA, 21 nt, Homo sapiens
uuguaagaaauauauuugaua

SEQ ID NO: 1283720 - RNA, 16 nt, Homo sapiens
uuguaagaguguagaa

SEQ ID NO: 1283721 - RNA, 22 nt, Homo sapiens
uuguaagaguguagaagcauuc

SEQ ID NO: 1283722 - RNA, 16 nt, Homo sapiens
uuguauuuaccuucua

SEQ ID NO: 1283723 - RNA, 20 nt, Homo sapiens
uuguauuuaccuucuaccuc

SEQ ID NO: 1283724 - RNA, 21 nt, Homo sapiens
uugucaauagcaugcaaaaaa

SEQ ID NO: 1283725 - RNA, 21 nt, Homo sapiens
uugugaaggccucgcaggaag

SEQ ID NO: 1283726 - RNA, 22 nt, Homo sapiens
uugugcucaaaauaaaaagccu

SEQ ID NO: 1283727 - RNA, 21 nt, Homo sapiens
uuguuaggccauucuugcauu

SEQ ID NO: 1283728 - RNA, 22 nt, Homo sapiens
uuguucauccaaggaaccuaau

SEQ ID NO: 1283729 - RNA, 16 nt, Homo sapiens
uuguucucccaaaaca

SEQ ID NO: 1283730 - RNA, 16 nt, Homo sapiens
uuguuuaacuugucuu

SEQ ID NO: 1283731 - RNA, 22 nt, Homo sapiens
uuuaaaagagacaaacuguaaa

SEQ ID NO: 1283732 - RNA, 12 nt, Homo sapiens
uuuaaacagugu

SEQ ID NO: 1283733 - RNA, 11 nt, Homo sapiens
uuuaaacugua

SEQ ID NO: 1283734 - RNA, 13 nt, Homo sapiens
uuuaaaggacaaa

SEQ ID NO: 1283735 - RNA, 17 nt, Homo sapiens
uuuaaauagaacuugau

SEQ ID NO: 1283736 - RNA, 19 nt, Homo sapiens
uuuaagcucugagcuguca

SEQ ID NO: 1283737 - RNA, 23 nt, Homo sapiens
uuuaaggcagcaacaagaaaaga

SEQ ID NO: 1283738 - RNA, 16 nt, Homo sapiens
uuuacuagaaaggcau

SEQ ID NO: 1283739 - RNA, 13 nt, Homo sapiens
uuuacuugaucau

SEQ ID NO: 1283740 - RNA, 14 nt, Homo sapiens
uuuacuuuuaacua

SEQ ID NO: 1283741 - RNA, 23 nt, Homo sapiens
uuuaguaagagauuccugagcca

SEQ ID NO: 1283742 - RNA, 15 nt, Homo sapiens
uuuagugcacuuaau

SEQ ID NO: 1283743 - RNA, 23 nt, Homo sapiens
uuuauaauaaaaagcuucaggga

SEQ ID NO: 1283744 - RNA, 14 nt, Homo sapiens
acccuguuaauccc

SEQ ID NO: 1283745 - RNA, 16 nt, Homo sapiens
acccuguuaaucccaa

SEQ ID NO: 1283746 - RNA, 22 nt, Homo sapiens
acccuuaggccagcaccaucuc

SEQ ID NO: 1283747 - RNA, 17 nt, Homo sapiens
acccuucagauuugccu

SEQ ID NO: 1283748 - RNA, 12 nt, Homo sapiens
acccuucugccu

SEQ ID NO: 1283749 - RNA, 13 nt, Homo sapiens
accucacuagcuc

SEQ ID NO: 1283750 - RNA, 17 nt, Homo sapiens
accucuuggcugccuug

SEQ ID NO: 1283751 - RNA, 16 nt, Homo sapiens
accugagacuggguga

SEQ ID NO: 1283752 - RNA, 20 nt, Homo sapiens
accugaucaaugacagagcc

SEQ ID NO: 1283753 - RNA, 21 nt, Homo sapiens
accuggaccccugcauuggaa

SEQ ID NO: 1283754 - RNA, 19 nt, Homo sapiens
accuguucaaaauuccauu

SEQ ID NO: 1283755 - RNA, 16 nt, Homo sapiens
accuugaaagacauuu

SEQ ID NO: 1283756 - RNA, 20 nt, Homo sapiens
accuugaugagcugugcaca

SEQ ID NO: 1283757 - RNA, 23 nt, Homo sapiens
accuuugacacugacagaugugu

SEQ ID NO: 1283758 - RNA, 17 nt, Homo sapiens
accuuuuuuaagauuuu

SEQ ID NO: 1283759 - RNA, 19 nt, Homo sapiens
acgcggccccacauugcac

SEQ ID NO: 1283760 - RNA, 15 nt, Homo sapiens
acgugagaacaauca

SEQ ID NO: 1283761 - RNA, 17 nt, Homo sapiens
acuaacagauaagcaag

SEQ ID NO: 1283762 - RNA, 18 nt, Homo sapiens
acuacaauuuaaagcaaa

SEQ ID NO: 1283763 - RNA, 18 nt, Homo sapiens
acuagaggcuugcauaau

SEQ ID NO: 1283764 - RNA, 13 nt, Homo sapiens
acuagauacugaa

SEQ ID NO: 1283765 - RNA, 21 nt, Homo sapiens
acuaggauacugcugcgucau

SEQ ID NO: 1283766 - RNA, 17 nt, Homo sapiens
acuaucccauuugcccu

SEQ ID NO: 1283767 - RNA, 20 nt, Homo sapiens
acuaugaacugaaggcagca

SEQ ID NO: 1283768 - RNA, 20 nt, Homo sapiens
acucacauccugaccuugca

SEQ ID NO: 1283769 - RNA, 16 nt, Homo sapiens
acucacccccaugauc

SEQ ID NO: 1283770 - RNA, 16 nt, Homo sapiens
acucaggggucauuca

SEQ ID NO: 1283771 - RNA, 21 nt, Homo sapiens
acucagugauugcaauuugca

SEQ ID NO: 1283772 - RNA, 19 nt, Homo sapiens
acucaucuugaucaaccaa

SEQ ID NO: 1283773 - RNA, 21 nt, Homo sapiens
acucaucuuggcccuccucag

SEQ ID NO: 1283774 - RNA, 16 nt, Homo sapiens
acucccucugugucac

SEQ ID NO: 1283775 - RNA, 22 nt, Homo sapiens
acucccucugugucacuguaug

SEQ ID NO: 1283776 - RNA, 22 nt, Homo sapiens
acuccugguuccuaggugagca

SEQ ID NO: 1283777 - RNA, 17 nt, Homo sapiens
acuccuuagagacauca

SEQ ID NO: 1283778 - RNA, 15 nt, Homo sapiens
acucgagaacuuuca

SEQ ID NO: 1283779 - RNA, 23 nt, Homo sapiens
acucuauaaauaaaaccugacag

SEQ ID NO: 1283780 - RNA, 15 nt, Homo sapiens
acugaaacagccaga

SEQ ID NO: 1283781 - RNA, 12 nt, Homo sapiens
acugacuccuua

SEQ ID NO: 1283782 - RNA, 13 nt, Homo sapiens
acugagacuugaa

SEQ ID NO: 1283783 - RNA, 14 nt, Homo sapiens
acugcaagcauuuu

SEQ ID NO: 1283784 - RNA, 21 nt, Homo sapiens
acugcugcgucauuacagggc

SEQ ID NO: 1283785 - RNA, 16 nt, Homo sapiens
acugcugggcuuggca

SEQ ID NO: 1283786 - RNA, 20 nt, Homo sapiens
acugcuguagacauuugcua

SEQ ID NO: 1283787 - RNA, 17 nt, Homo sapiens
acugcuucucuuugugc

SEQ ID NO: 1283788 - RNA, 15 nt, Homo sapiens
acuggaugaggucau

SEQ ID NO: 1283789 - RNA, 20 nt, Homo sapiens
acuggcugccccgugacaca

SEQ ID NO: 1283790 - RNA, 14 nt, Homo sapiens
acuguaugugaaag

SEQ ID NO: 1283791 - RNA, 18 nt, Homo sapiens
acuguccaccaccaccug

SEQ ID NO: 1283792 - RNA, 20 nt, Homo sapiens
acuguguuaguaaacugugc

SEQ ID NO: 1283793 - RNA, 18 nt, Homo sapiens
acuuaaaaucuaauucaa

SEQ ID NO: 1283794 - RNA, 17 nt, Homo sapiens
acuuaauaauguguaca

SEQ ID NO: 1283795 - RNA, 15 nt, Homo sapiens
acuugaucauucuca

SEQ ID NO: 1283796 - RNA, 22 nt, Homo sapiens
acuugucuuuuuguuaugcaaa

SEQ ID NO: 1283797 - RNA, 13 nt, Homo sapiens
acuuucauuugaa

SEQ ID NO: 1283798 - RNA, 21 nt, Homo sapiens
acuuucugaagccucacuuau

SEQ ID NO: 1283799 - RNA, 18 nt, Homo sapiens
acuuucuuucuguaggug

SEQ ID NO: 1283800 - RNA, 15 nt, Homo sapiens
acuuuuggcuuguaa

SEQ ID NO: 1283801 - RNA, 13 nt, Homo sapiens
acuuuuugcagcu

SEQ ID NO: 1283802 - RNA, 19 nt, Homo sapiens
agaaaagcaguggcuccau

SEQ ID NO: 1283803 - RNA, 17 nt, Homo sapiens
agaaaauaauugcaaau

SEQ ID NO: 1283804 - RNA, 13 nt, Homo sapiens
agaaaaugaauuu

SEQ ID NO: 1283805 - RNA, 24 nt, Homo sapiens
agaaacccuuccacguguaugcaa

SEQ ID NO: 1283806 - RNA, 13 nt, Homo sapiens
agaaacugcucua

SEQ ID NO: 1283807 - RNA, 18 nt, Homo sapiens
agaaacuucugcuuuuaa

SEQ ID NO: 1283808 - RNA, 13 nt, Homo sapiens
agaaaguuaugaa

SEQ ID NO: 1283809 - RNA, 20 nt, Homo sapiens
agaaauaaaaucuaauuaau

SEQ ID NO: 1283810 - RNA, 18 nt, Homo sapiens
agaacacacugagacuug

SEQ ID NO: 1283811 - RNA, 18 nt, Homo sapiens
agaaccaaccacaagcac

SEQ ID NO: 1283812 - RNA, 16 nt, Homo sapiens
agaacuggaccaucuc

SEQ ID NO: 1283813 - RNA, 17 nt, Homo sapiens
agaagaccccacuucag

SEQ ID NO: 1283814 - RNA, 20 nt, Homo sapiens
agaagagaggacacaucucc

SEQ ID NO: 1283815 - RNA, 13 nt, Homo sapiens
agaagcagcucuu

SEQ ID NO: 1283816 - RNA, 21 nt, Homo sapiens
agaagucacucacuauugcaa

SEQ ID NO: 1283817 - RNA, 23 nt, Homo sapiens
agaauaaaugguuucucauuaaa

SEQ ID NO: 1283818 - RNA, 15 nt, Homo sapiens
agaauagacuaaguu

SEQ ID NO: 1283819 - RNA, 15 nt, Homo sapiens
agaauauaaugugca

SEQ ID NO: 1283820 - RNA, 13 nt, Homo sapiens
agaauauacuaaa

SEQ ID NO: 1283821 - RNA, 20 nt, Homo sapiens
agaauauacuaaauuaacuu

SEQ ID NO: 1283822 - RNA, 15 nt, Homo sapiens
agacaagcuccuccc

SEQ ID NO: 1283823 - RNA, 21 nt, Homo sapiens
agacaauggcuuacuccagga

SEQ ID NO: 1283824 - RNA, 13 nt, Homo sapiens
agacaaugggaau

SEQ ID NO: 1283825 - RNA, 22 nt, Homo sapiens
agacaccagagcagaugcagag

SEQ ID NO: 1283826 - RNA, 17 nt, Homo sapiens
agacaggacccugggac

SEQ ID NO: 1283827 - RNA, 16 nt, Homo sapiens
agacaugugcacuuga

SEQ ID NO: 1283828 - RNA, 18 nt, Homo sapiens
agaccauauaacugugau

SEQ ID NO: 1283829 - RNA, 23 nt, Homo sapiens
agacgggcaaaauaaagugacag

SEQ ID NO: 1283830 - RNA, 21 nt, Homo sapiens
agacuaaccucuaccagcaca

SEQ ID NO: 1283831 - RNA, 13 nt, Homo sapiens
agagaaaauaauu

SEQ ID NO: 1283832 - RNA, 18 nt, Homo sapiens
agagacgcagacaugugc

SEQ ID NO: 1283833 - RNA, 16 nt, Homo sapiens
agagagggcuuucuca

SEQ ID NO: 1283834 - RNA, 21 nt, Homo sapiens
agaggccggucccuuccuugg

SEQ ID NO: 1283835 - RNA, 16 nt, Homo sapiens
agaggugccacacuga

SEQ ID NO: 1283836 - RNA, 20 nt, Homo sapiens
agaguacaccccaacagcac

SEQ ID NO: 1283837 - RNA, 20 nt, Homo sapiens
agagucaaugaacuuuccac

SEQ ID NO: 1283838 - RNA, 16 nt, Homo sapiens
agagucaucuaccuga

SEQ ID NO: 1283839 - RNA, 19 nt, Homo sapiens
ccacugucuauguacaaua

SEQ ID NO: 1283840 - RNA, 20 nt, Homo sapiens
ccacuguuauuaacagauaa

SEQ ID NO: 1283841 - RNA, 21 nt, Homo sapiens
ccacuucuggguggggcagug

SEQ ID NO: 1283842 - RNA, 16 nt, Homo sapiens
ccagaaucaacagcuc

SEQ ID NO: 1283843 - RNA, 16 nt, Homo sapiens
ccagagcagaugcaga

SEQ ID NO: 1283844 - RNA, 11 nt, Homo sapiens
ccagagcucag

SEQ ID NO: 1283845 - RNA, 13 nt, Homo sapiens
ccagaggacaaag

SEQ ID NO: 1283846 - RNA, 18 nt, Homo sapiens
ccagaggcuuaaucacac

SEQ ID NO: 1283847 - RNA, 18 nt, Homo sapiens
ccagaggucuggcccuau

SEQ ID NO: 1283848 - RNA, 22 nt, Homo sapiens
ccagaucucaugagaagucacu

SEQ ID NO: 1283849 - RNA, 14 nt, Homo sapiens
ccagauuggcucac

SEQ ID NO: 1283850 - RNA, 23 nt, Homo sapiens
ccagauuggcucacacugagaau

SEQ ID NO: 1283851 - RNA, 19 nt, Homo sapiens
ccagccuuauguguuacau

SEQ ID NO: 1283852 - RNA, 17 nt, Homo sapiens
ccagcggacaguggcag

SEQ ID NO: 1283853 - RNA, 23 nt, Homo sapiens
ccagcugcgccugcgcugcagga

SEQ ID NO: 1283854 - RNA, 19 nt, Homo sapiens
ccaggaucaugguguaaua

SEQ ID NO: 1283855 - RNA, 14 nt, Homo sapiens
ccaggcagauccca

SEQ ID NO: 1283856 - RNA, 18 nt, Homo sapiens
ccagggcuggacugaggc

SEQ ID NO: 1283857 - RNA, 22 nt, Homo sapiens
ccagguguucuacacucaucuu

SEQ ID NO: 1283858 - RNA, 15 nt, Homo sapiens
ccagugaccagucac

SEQ ID NO: 1283859 - RNA, 17 nt, Homo sapiens
ccaucaagacaauggga

SEQ ID NO: 1283860 - RNA, 16 nt, Homo sapiens
ccaucucuuuaccucc

SEQ ID NO: 1283861 - RNA, 17 nt, Homo sapiens
ccuuguggccuaugaaa

SEQ ID NO: 1283862 - RNA, 19 nt, Homo sapiens
ccuuuggaugcacuuuaua

SEQ ID NO: 1283863 - RNA, 14 nt, Homo sapiens
ccuuugucccagaa

SEQ ID NO: 1283864 - RNA, 22 nt, Homo sapiens
ccuuuucugcuucaauaucuaa

SEQ ID NO: 1283865 - RNA, 13 nt, Homo sapiens
ccuuuugccaucc

SEQ ID NO: 1283866 - RNA, 18 nt, Homo sapiens
cgaaauaacaauguuaag

SEQ ID NO: 1283867 - RNA, 19 nt, Homo sapiens
cgaauuagguccacuucaa

SEQ ID NO: 1283868 - RNA, 22 nt, Homo sapiens
cgacuccccccuggccacagac

SEQ ID NO: 1283869 - RNA, 22 nt, Homo sapiens
cgagcauaagaaauaaaaucua

SEQ ID NO: 1283870 - RNA, 19 nt, Homo sapiens
cgauugcaggagucccugc

SEQ ID NO: 1283871 - RNA, 17 nt, Homo sapiens
cgcaaacuuuaacaggu

SEQ ID NO: 1283872 - RNA, 19 nt, Homo sapiens
cgcccacucuccaccucac

SEQ ID NO: 1283873 - RNA, 18 nt, Homo sapiens
cggccuccugucccucau

SEQ ID NO: 1283874 - RNA, 17 nt, Homo sapiens
cggcucucaccaguggc

SEQ ID NO: 1283875 - RNA, 19 nt, Homo sapiens
cguauaauuuagucccuua

SEQ ID NO: 1283876 - RNA, 18 nt, Homo sapiens
cgucuaguuaacauuuca

SEQ ID NO: 1283877 - RNA, 14 nt, Homo sapiens
cgugacacaugcuc

SEQ ID NO: 1283878 - RNA, 15 nt, Homo sapiens
cgugagaacaaucau

SEQ ID NO: 1283879 - RNA, 23 nt, Homo sapiens
cuaaagccuuccuauuuugcaua

SEQ ID NO: 1283880 - RNA, 19 nt, Homo sapiens
cuaaagggagaaaugccag

SEQ ID NO: 1283881 - RNA, 22 nt, Homo sapiens
cuaaccucuaccagcacauuaa

SEQ ID NO: 1283882 - RNA, 20 nt, Homo sapiens
cuaacuuuaugaacucccuc

SEQ ID NO: 1283883 - RNA, 17 nt, Homo sapiens
cuaauaauaaauuaaua

SEQ ID NO: 1283884 - RNA, 13 nt, Homo sapiens
cuaaucauaacau

SEQ ID NO: 1283885 - RNA, 12 nt, Homo sapiens
gaagucuuccau

SEQ ID NO: 1283886 - RNA, 19 nt, Homo sapiens
gaaguuuccagaaagaaga

SEQ ID NO: 1283887 - RNA, 17 nt, Homo sapiens
gaaguuuuuuacuuugg

SEQ ID NO: 1283888 - RNA, 22 nt, Homo sapiens
gaauacuggggauuaccauuca

SEQ ID NO: 1283889 - RNA, 23 nt, Homo sapiens
gaauaguguuggaaaaugugcaa

SEQ ID NO: 1283890 - RNA, 19 nt, Homo sapiens
gaauauacuaaauuaacuu

SEQ ID NO: 1283891 - RNA, 14 nt, Homo sapiens
gaaucaacagcucc

SEQ ID NO: 1283892 - RNA, 12 nt, Homo sapiens
gaauccaugcuu

SEQ ID NO: 1283893 - RNA, 16 nt, Homo sapiens
gaaucccuuaaacuca

SEQ ID NO: 1283894 - RNA, 14 nt, Homo sapiens
gaaugagaagaaug

SEQ ID NO: 1283895 - RNA, 17 nt, Homo sapiens
gaaugagaagaaugacu

SEQ ID NO: 1283896 - RNA, 14 nt, Homo sapiens
gaaugcagggacaa

SEQ ID NO: 1283897 - RNA, 15 nt, Homo sapiens
gaaugcagggacaaa

SEQ ID NO: 1283898 - RNA, 16 nt, Homo sapiens
gaauguagcagauccc

SEQ ID NO: 1283899 - RNA, 14 nt, Homo sapiens
gaauuuucuuccaa

SEQ ID NO: 1283900 - RNA, 15 nt, Homo sapiens
gacaaccucauuuua

SEQ ID NO: 1283901 - RNA, 17 nt, Homo sapiens
gacacaucucccaccau

SEQ ID NO: 1283902 - RNA, 13 nt, Homo sapiens
gacagaagcagcu

SEQ ID NO: 1283903 - RNA, 22 nt, Homo sapiens
gacagcucucugggcacccggu

SEQ ID NO: 1283904 - RNA, 22 nt, Homo sapiens
gacaucagcccuuggggguccu

SEQ ID NO: 1283905 - RNA, 21 nt, Homo sapiens
gaccauauaacugugaugaaa

SEQ ID NO: 1283906 - RNA, 11 nt, Homo sapiens
gacccauuccu

SEQ ID NO: 1283907 - RNA, 15 nt, Homo sapiens
gacccugggaccaca

SEQ ID NO: 1283908 - RNA, 22 nt, Homo sapiens
gacccuuugaggcccccaguga

SEQ ID NO: 1283909 - RNA, 17 nt, Homo sapiens
gaccucuuccuggaaua

SEQ ID NO: 1283910 - RNA, 22 nt, Homo sapiens
gaccuggcggcaggaagccaaa

SEQ ID NO: 1283911 - RNA, 13 nt, Homo sapiens
gaccuucuaggaa

SEQ ID NO: 1283912 - RNA, 21 nt, Homo sapiens
gccaguggcuggaucugugag

SEQ ID NO: 1283913 - RNA, 19 nt, Homo sapiens
gccauucuugcauugauau

SEQ ID NO: 1283914 - RNA, 14 nt, Homo sapiens
gccccacauugcac

SEQ ID NO: 1283915 - RNA, 14 nt, Homo sapiens
gcccugcgcugccu

SEQ ID NO: 1283916 - RNA, 18 nt, Homo sapiens
gcccuuguccccaugaaa

SEQ ID NO: 1283917 - RNA, 14 nt, Homo sapiens
gcccuuuucagggc

SEQ ID NO: 1283918 - RNA, 22 nt, Homo sapiens
gccuagauaugaauauauggca

SEQ ID NO: 1283919 - RNA, 11 nt, Homo sapiens
gccucagugac

SEQ ID NO: 1283920 - RNA, 13 nt, Homo sapiens
gccucaucuucaa

SEQ ID NO: 1283921 - RNA, 23 nt, Homo sapiens
gccucucuacaagcagcaggaaa

SEQ ID NO: 1283922 - RNA, 21 nt, Homo sapiens
gccugaagucccagcauugau

SEQ ID NO: 1283923 - RNA, 23 nt, Homo sapiens
gccuggcuccaaacccucgaggc

SEQ ID NO: 1283924 - RNA, 11 nt, Homo sapiens
gccuguucacg

SEQ ID NO: 1283925 - RNA, 20 nt, Homo sapiens
gcgaaugauuuaaauagaac

SEQ ID NO: 1283926 - RNA, 15 nt, Homo sapiens
gcgucauuacagggc

SEQ ID NO: 1283927 - RNA, 13 nt, Homo sapiens
gcuaaaccauuca

SEQ ID NO: 1283928 - RNA, 19 nt, Homo sapiens
gcuaaucuccacccaauga

SEQ ID NO: 1283929 - RNA, 21 nt, Homo sapiens
gcuaaucugccugguuuuauu

SEQ ID NO: 1283930 - RNA, 23 nt, Homo sapiens
gcuagagguagaguuugaucaua

SEQ ID NO: 1283931 - RNA, 22 nt, Homo sapiens
gcuaguccccuucuuuuggccc

SEQ ID NO: 1283932 - RNA, 15 nt, Homo sapiens
gcuauuguagagcca

SEQ ID NO: 1283933 - RNA, 23 nt, Homo sapiens
gcucagccccaccccagggcagc

SEQ ID NO: 1283934 - RNA, 13 nt, Homo sapiens
gcuccaaacccuc

SEQ ID NO: 1283935 - RNA, 21 nt, Homo sapiens
gcuccccuccccaacugacca

SEQ ID NO: 1283936 - RNA, 18 nt, Homo sapiens
gcuccccucgacagcucu

SEQ ID NO: 1283937 - RNA, 16 nt, Homo sapiens
gcucuacuaccuguac

SEQ ID NO: 1283938 - RNA, 14 nt, Homo sapiens
gcucugagcuguca

SEQ ID NO: 1283939 - RNA, 18 nt, Homo sapiens
gcugaggccucucauucc

SEQ ID NO: 1283940 - RNA, 16 nt, Homo sapiens
gcugccccgugacaca

SEQ ID NO: 1283941 - RNA, 12 nt, Homo sapiens
gcuggcucugag

SEQ ID NO: 1283942 - RNA, 18 nt, Homo sapiens
gcugggcucuacuaccug

SEQ ID NO: 1283943 - RNA, 13 nt, Homo sapiens
gcugucugaucuu

SEQ ID NO: 1283944 - RNA, 21 nt, Homo sapiens
gcuuaacucccccucauucac

SEQ ID NO: 1283945 - RNA, 23 nt, Homo sapiens
gcuuauguuacagguuacgugag

SEQ ID NO: 1283946 - RNA, 12 nt, Homo sapiens
gcuucaaaaacu

SEQ ID NO: 1283947 - RNA, 14 nt, Homo sapiens
gcuucacuguauaa

SEQ ID NO: 1283948 - RNA, 16 nt, Homo sapiens
gcuuggcugugcccuc

SEQ ID NO: 1283949 - RNA, 21 nt, Homo sapiens
gcuuuacagauguagauauaa

SEQ ID NO: 1283950 - RNA, 15 nt, Homo sapiens
gcuuuacucauggca

SEQ ID NO: 1283951 - RNA, 14 nt, Homo sapiens
gcuuucuguugcca

SEQ ID NO: 1283952 - RNA, 15 nt, Homo sapiens
gcuuuggcaacagaa

SEQ ID NO: 1283953 - RNA, 12 nt, Homo sapiens
gcuuuugaacug

SEQ ID NO: 1283954 - RNA, 22 nt, Homo sapiens
ggaaaaauaagaugggcccaaa

SEQ ID NO: 1283955 - RNA, 22 nt, Homo sapiens
ggaaaaugugcaauaugugaug

SEQ ID NO: 1283956 - RNA, 19 nt, Homo sapiens
ggaagacuagaggcuugca

SEQ ID NO: 1283957 - RNA, 21 nt, Homo sapiens
ggaagccagaaucaacagcuc

SEQ ID NO: 1283958 - RNA, 14 nt, Homo sapiens
ggaagcgagcuuug

SEQ ID NO: 1283959 - RNA, 23 nt, Homo sapiens
ggaagcgagcuuugcugggagag

SEQ ID NO: 1283960 - RNA, 13 nt, Homo sapiens
ggaagggacacca

SEQ ID NO: 1283961 - RNA, 14 nt, Homo sapiens
ggaagucacuucac

SEQ ID NO: 1283962 - RNA, 18 nt, Homo sapiens
ggaauauguuaccauuaa

SEQ ID NO: 1283963 - RNA, 18 nt, Homo sapiens
ggaauggccugugccaua

SEQ ID NO: 1283964 - RNA, 15 nt, Homo sapiens
ggaauuuucuuccaa

SEQ ID NO: 1283965 - RNA, 18 nt, Homo sapiens
ggacaccuuuuaacucac

SEQ ID NO: 1283966 - RNA, 17 nt, Homo sapiens
ggacagcaucaaagaga

SEQ ID NO: 1283967 - RNA, 20 nt, Homo sapiens
ggaccacuccugaaugagac

SEQ ID NO: 1283968 - RNA, 22 nt, Homo sapiens
ggacuucugcaucuuacaguca

SEQ ID NO: 1283969 - RNA, 18 nt, Homo sapiens
ggacuuucugaagccuca

SEQ ID NO: 1283970 - RNA, 17 nt, Homo sapiens
ggagaagcaugaaaaag

SEQ ID NO: 1283971 - RNA, 13 nt, Homo sapiens
ggaggacagggag

SEQ ID NO: 1283972 - RNA, 18 nt, Homo sapiens
ggaguacaccccaacagc

SEQ ID NO: 1283973 - RNA, 22 nt, Homo sapiens
ggaguacaccccaacagcaccc

SEQ ID NO: 1283974 - RNA, 21 nt, Homo sapiens
ggagugcccccaacagcaccc

SEQ ID NO: 1283975 - RNA, 19 nt, Homo sapiens
ggauaccuuaauucuuugu

SEQ ID NO: 1283976 - RNA, 13 nt, Homo sapiens
ggaugaggucaua

SEQ ID NO: 1283977 - RNA, 22 nt, Homo sapiens
ggaugcauagccuggacacaga

SEQ ID NO: 1283978 - RNA, 17 nt, Homo sapiens
ggauggaugcagaucca

SEQ ID NO: 1283979 - RNA, 14 nt, Homo sapiens
ggauggguccagaa

SEQ ID NO: 1283980 - RNA, 16 nt, Homo sapiens
ggauuaccaguagaug

SEQ ID NO: 1283981 - RNA, 17 nt, Homo sapiens
ggcaaaauaaagugaca

SEQ ID NO: 1283982 - RNA, 18 nt, Homo sapiens
ggcaaacuuuucuuucuu

SEQ ID NO: 1283983 - RNA, 23 nt, Homo sapiens
ggcacgaggccaggcagauccca

SEQ ID NO: 1283984 - RNA, 14 nt, Homo sapiens
ggcagauugaaaag

SEQ ID NO: 1283985 - RNA, 16 nt, Homo sapiens
ggcagccacaacugca

SEQ ID NO: 1283986 - RNA, 19 nt, Homo sapiens
ggcagcggggcaagcaaaa

SEQ ID NO: 1283987 - RNA, 16 nt, Homo sapiens
ggcaggaacuugcaca

SEQ ID NO: 1283988 - RNA, 23 nt, Homo sapiens
ggcagugacagaacuaagaugau

SEQ ID NO: 1283989 - RNA, 15 nt, Homo sapiens
ggcagugagugccau

SEQ ID NO: 1283990 - RNA, 22 nt, Homo sapiens
ggcauuugauuaaauuaugaau

SEQ ID NO: 1283991 - RNA, 11 nt, Homo sapiens
ggcauuugcag

SEQ ID NO: 1283992 - RNA, 14 nt, Homo sapiens
ggccccacauugca

SEQ ID NO: 1283993 - RNA, 16 nt, Homo sapiens
ggccccacauugcacu

SEQ ID NO: 1283994 - RNA, 23 nt, Homo sapiens
ggccccagccccucucccugugc

SEQ ID NO: 1283995 - RNA, 19 nt, Homo sapiens
uaaaaauauacaagcuaca

SEQ ID NO: 1283996 - RNA, 19 nt, Homo sapiens
uaaaagagacaaacuguaa

SEQ ID NO: 1283997 - RNA, 14 nt, Homo sapiens
uaaaagaucuugca

SEQ ID NO: 1283998 - RNA, 20 nt, Homo sapiens
uaaaauaguuuugcuuuguu

SEQ ID NO: 1283999 - RNA, 21 nt, Homo sapiens
uaaaauauuuuuaugugcaau

SEQ ID NO: 1284000 - RNA, 22 nt, Homo sapiens
uaaaauauuuuuaugugcaaua

SEQ ID NO: 1284001 - RNA, 16 nt, Homo sapiens
uaaaaucccuccuuca

SEQ ID NO: 1284002 - RNA, 18 nt, Homo sapiens
uaaaaugcuucacuguac

SEQ ID NO: 1284003 - RNA, 19 nt, Homo sapiens
uaaaauguuggugcaauua

SEQ ID NO: 1284004 - RNA, 14 nt, Homo sapiens
uaaaauuucacuua

SEQ ID NO: 1284005 - RNA, 14 nt, Homo sapiens
uaaacaaauguaug

SEQ ID NO: 1284006 - RNA, 14 nt, Homo sapiens
uaaagcauuuuaca

SEQ ID NO: 1284007 - RNA, 16 nt, Homo sapiens
uaaaguacagacuuuu

SEQ ID NO: 1284008 - RNA, 14 nt, Homo sapiens
uaaauaaucuacau

SEQ ID NO: 1284009 - RNA, 23 nt, Homo sapiens
uaaaucaguuuauuaaaucugaa

SEQ ID NO: 1284010 - RNA, 14 nt, Homo sapiens
uaaaucgcuaccuu

SEQ ID NO: 1284011 - RNA, 21 nt, Homo sapiens
uaaauuaugaaugaguuuuac

SEQ ID NO: 1284012 - RNA, 14 nt, Homo sapiens
uaacaauguuaagg

SEQ ID NO: 1284013 - RNA, 14 nt, Homo sapiens
uaacagacacugua

SEQ ID NO: 1284014 - RNA, 18 nt, Homo sapiens
uaacagcuuucuuauuca

SEQ ID NO: 1284015 - RNA, 18 nt, Homo sapiens
uaacaggucuccucuuaa

SEQ ID NO: 1284016 - RNA, 21 nt, Homo sapiens
uaacauuccuaaaaugcuuca

SEQ ID NO: 1284017 - RNA, 19 nt, Homo sapiens
uaaccaguuuagcuuuuuc

SEQ ID NO: 1284018 - RNA, 20 nt, Homo sapiens
uaaccucuaccagcacauua

SEQ ID NO: 1284019 - RNA, 17 nt, Homo sapiens
uaacucccccucauuca

SEQ ID NO: 1284020 - RNA, 19 nt, Homo sapiens
uaacucuguaaaagugucu

SEQ ID NO: 1284021 - RNA, 22 nt, Homo sapiens
uaacucuguaaaagugucugua

SEQ ID NO: 1284022 - RNA, 17 nt, Homo sapiens
uaacuuaugaaccuuua

SEQ ID NO: 1284023 - RNA, 20 nt, Homo sapiens
uaagaaauauauuugauaaa

SEQ ID NO: 1284024 - RNA, 17 nt, Homo sapiens
uaagaugaucaucucca

SEQ ID NO: 1284025 - RNA, 13 nt, Homo sapiens
uaguuauauugaa

SEQ ID NO: 1284026 - RNA, 17 nt, Homo sapiens
uaguuuggauuacuuaa

SEQ ID NO: 1284027 - RNA, 19 nt, Homo sapiens
uauaaauauauguauacau

SEQ ID NO: 1284028 - RNA, 14 nt, Homo sapiens
uauacuauaugaaa

SEQ ID NO: 1284029 - RNA, 18 nt, Homo sapiens
uauagaagaaaauuuugg

SEQ ID NO: 1284030 - RNA, 17 nt, Homo sapiens
uauagaauggaacucaa

SEQ ID NO: 1284031 - RNA, 20 nt, Homo sapiens
uauauagcucuacacaacau

SEQ ID NO: 1284032 - RNA, 22 nt, Homo sapiens
uauauagcucuacacaacaugu

SEQ ID NO: 1284033 - RNA, 23 nt, Homo sapiens
uauauagcucuacacaacaugua

SEQ ID NO: 1284034 - RNA, 13 nt, Homo sapiens
uauaugcacuuau

SEQ ID NO: 1284035 - RNA, 19 nt, Homo sapiens
uauauggcauuugcagauu

SEQ ID NO: 1284036 - RNA, 22 nt, Homo sapiens
uauauguugaauguuaacaggu

SEQ ID NO: 1284037 - RNA, 15 nt, Homo sapiens
uauauuugugugagg

SEQ ID NO: 1284038 - RNA, 18 nt, Homo sapiens
uaucaaacuacugccauu

SEQ ID NO: 1284039 - RNA, 13 nt, Homo sapiens
uaucccauuugcc

SEQ ID NO: 1284040 - RNA, 21 nt, Homo sapiens
uaucgaaauaacaauguuaag

SEQ ID NO: 1284041 - RNA, 14 nt, Homo sapiens
uaucuagcauuuau

SEQ ID NO: 1284042 - RNA, 15 nt, Homo sapiens
uaucuccucuugggc

SEQ ID NO: 1284043 - RNA, 14 nt, Homo sapiens
uaucugaguugacu

SEQ ID NO: 1284044 - RNA, 19 nt, Homo sapiens
uaucugguaucugcaugua

SEQ ID NO: 1284045 - RNA, 15 nt, Homo sapiens
uaucuuaguugguau

SEQ ID NO: 1284046 - RNA, 23 nt, Homo sapiens
uaugaacugaaggcagcauguau

SEQ ID NO: 1284047 - RNA, 16 nt, Homo sapiens
uaugauggaacaguga

SEQ ID NO: 1284048 - RNA, 23 nt, Homo sapiens
uaugcaaccuuuggaugcacuuu

SEQ ID NO: 1284049 - RNA, 18 nt, Homo sapiens
uaugccccugcacugaag

SEQ ID NO: 1284050 - RNA, 16 nt, Homo sapiens
uaugcuaccuacugau

SEQ ID NO: 1284051 - RNA, 16 nt, Homo sapiens
uauguagaugugcauu

SEQ ID NO: 1284052 - RNA, 14 nt, Homo sapiens
uaugugauguggca

SEQ ID NO: 1284053 - RNA, 11 nt, Homo sapiens
uaugugcaaua

SEQ ID NO: 1284054 - RNA, 23 nt, Homo sapiens
uauguggaagugugggucugugu

SEQ ID NO: 1284055 - RNA, 17 nt, Homo sapiens
uaugugggggucugugu

SEQ ID NO: 1284056 - RNA, 13 nt, Homo sapiens
ccuccacgccauu

SEQ ID NO: 1284057 - RNA, 21 nt, Homo sapiens
ccuccucuacaauuugccauu

SEQ ID NO: 1284058 - RNA, 23 nt, Homo sapiens
ccuccugugccucccuuuucucc

SEQ ID NO: 1284059 - RNA, 21 nt, Homo sapiens
ccucgaaagugucaucaauuu

SEQ ID NO: 1284060 - RNA, 15 nt, Homo sapiens
ccucgacagcucucu

SEQ ID NO: 1284061 - RNA, 18 nt, Homo sapiens
ccucgaggcggaucuuug

SEQ ID NO: 1284062 - RNA, 15 nt, Homo sapiens
ccucgugucagcuca

SEQ ID NO: 1284063 - RNA, 15 nt, Homo sapiens
ccucgugucaucucc

SEQ ID NO: 1284064 - RNA, 15 nt, Homo sapiens
ccucuacaauuugcc

SEQ ID NO: 1284065 - RNA, 16 nt, Homo sapiens
ccucuacaauuugcca

SEQ ID NO: 1284066 - RNA, 15 nt, Homo sapiens
ccucuaccagcacau

SEQ ID NO: 1284067 - RNA, 15 nt, Homo sapiens
ccucuacccacuucu

SEQ ID NO: 1284068 - RNA, 11 nt, Homo sapiens
ccucuaucuaa

SEQ ID NO: 1284069 - RNA, 12 nt, Homo sapiens
ccucucauucca

SEQ ID NO: 1284070 - RNA, 15 nt, Homo sapiens
ccucuggacacagcc

SEQ ID NO: 1284071 - RNA, 24 nt, Homo sapiens
ccucuuugugugcgucacugugaa

SEQ ID NO: 1284072 - RNA, 18 nt, Homo sapiens
ccugaagucccagcauug

SEQ ID NO: 1284073 - RNA, 20 nt, Homo sapiens
ccugacucccccauuguguu

SEQ ID NO: 1284074 - RNA, 22 nt, Homo sapiens
ccuggcagccacaacugcaguc

SEQ ID NO: 1284075 - RNA, 12 nt, Homo sapiens
ccuggcuggcau

SEQ ID NO: 1284076 - RNA, 14 nt, Homo sapiens
ccugggaccacaga

SEQ ID NO: 1284077 - RNA, 18 nt, Homo sapiens
ccugguaccuagcaaagc

SEQ ID NO: 1284078 - RNA, 23 nt, Homo sapiens
ccuguaccacaaacacauuacau

SEQ ID NO: 1284079 - RNA, 21 nt, Homo sapiens
ccuuaaaaauuaaauucucuc

SEQ ID NO: 1284080 - RNA, 17 nt, Homo sapiens
ccuuccuauuuugcaua

SEQ ID NO: 1284081 - RNA, 18 nt, Homo sapiens
ccuucugaggacauucca

SEQ ID NO: 1284082 - RNA, 15 nt, Homo sapiens
ccuuuuaacucaccu

SEQ ID NO: 1284083 - RNA, 13 nt, Homo sapiens
ccuuuuuaaggaa

SEQ ID NO: 1284084 - RNA, 23 nt, Homo sapiens
cgaauacuggggauuaccauuca

SEQ ID NO: 1284085 - RNA, 17 nt, Homo sapiens
cgagccuggcuccaaac

SEQ ID NO: 1284086 - RNA, 15 nt, Homo sapiens
cgauuccucagggcc

SEQ ID NO: 1284087 - RNA, 18 nt, Homo sapiens
cgccuuaugagaacaugg

SEQ ID NO: 1284088 - RNA, 16 nt, Homo sapiens
cgcuaccucuccagcc

SEQ ID NO: 1284089 - RNA, 22 nt, Homo sapiens
cgcugggauccgggaucaaagu

SEQ ID NO: 1284090 - RNA, 14 nt, Homo sapiens
cggaucuuuggaca

SEQ ID NO: 1284091 - RNA, 19 nt, Homo sapiens
cggaucuuuggacagaagc

SEQ ID NO: 1284092 - RNA, 20 nt, Homo sapiens
cggcaggaagccaaagagac

SEQ ID NO: 1284093 - RNA, 16 nt, Homo sapiens
cggcccaauccaaggu

SEQ ID NO: 1284094 - RNA, 22 nt, Homo sapiens
cgggaaugcgcccaccaaggcc

SEQ ID NO: 1284095 - RNA, 23 nt, Homo sapiens
cgggggcuuggcugugcccucag

SEQ ID NO: 1284096 - RNA, 22 nt, Homo sapiens
cgucgaaagaaagaauauguaa

SEQ ID NO: 1284097 - RNA, 19 nt, Homo sapiens
cgucuaguuaacauuucaa

SEQ ID NO: 1284098 - RNA, 9 nt, Homo sapiens
cgugcaaua

SEQ ID NO: 1284099 - RNA, 17 nt, Homo sapiens
cguguacuacaauuuaa

SEQ ID NO: 1284100 - RNA, 12 nt, Homo sapiens
cgugucagcuca

SEQ ID NO: 1284101 - RNA, 15 nt, Homo sapiens
cguguguagaguuaa

SEQ ID NO: 1284102 - RNA, 13 nt, Homo sapiens
cuaaagcuuuauc

SEQ ID NO: 1284103 - RNA, 17 nt, Homo sapiens
cuaaaucaauucuauua

SEQ ID NO: 1284104 - RNA, 19 nt, Homo sapiens
cuaaaucuguuugacaguc

SEQ ID NO: 1284105 - RNA, 13 nt, Homo sapiens
cuaagaugaucau

SEQ ID NO: 1284106 - RNA, 17 nt, Homo sapiens
cuaauuccacacccuca

SEQ ID NO: 1284107 - RNA, 16 nt, Homo sapiens
cuacacugggugcuga

SEQ ID NO: 1284108 - RNA, 17 nt, Homo sapiens
cuacagacuccaaaagg

SEQ ID NO: 1284109 - RNA, 13 nt, Homo sapiens
cuaccacuuugaa

SEQ ID NO: 1284110 - RNA, 21 nt, Homo sapiens
cuaccagguguucuacacuca

SEQ ID NO: 1284111 - RNA, 19 nt, Homo sapiens
cuaccugaguccugaagcu

SEQ ID NO: 1284112 - RNA, 21 nt, Homo sapiens
cuacuuuauaauaagacauuu

SEQ ID NO: 1284113 - RNA, 17 nt, Homo sapiens
cuagaugauugauuacc

SEQ ID NO: 1284114 - RNA, 22 nt, Homo sapiens
cuagcacaugcccuaaugucug

SEQ ID NO: 1284115 - RNA, 14 nt, Homo sapiens
cuagccagugcuca

SEQ ID NO: 1284116 - RNA, 20 nt, Homo sapiens
cuagcuuugcagucguguaa

SEQ ID NO: 1284117 - RNA, 20 nt, Homo sapiens
cuaggaagagucuacccgac

SEQ ID NO: 1284118 - RNA, 17 nt, Homo sapiens
cuaggauacugcugcgu

SEQ ID NO: 1284119 - RNA, 18 nt, Homo sapiens
cuaguacaauauagugau

SEQ ID NO: 1284120 - RNA, 16 nt, Homo sapiens
cuaguggucuuuguaa

SEQ ID NO: 1284121 - RNA, 16 nt, Homo sapiens
cuauauggcagugucu

SEQ ID NO: 1284122 - RNA, 17 nt, Homo sapiens
cuauauuguacacaccu

SEQ ID NO: 1284123 - RNA, 11 nt, Homo sapiens
cuauccagcua

SEQ ID NO: 1284124 - RNA, 14 nt, Homo sapiens
cuaucuagcauuua

SEQ ID NO: 1284125 - RNA, 21 nt, Homo sapiens
cuauggguggggcacuccuuu

SEQ ID NO: 1284126 - RNA, 11 nt, Homo sapiens
cuaugguucuc

SEQ ID NO: 1284127 - RNA, 15 nt, Homo sapiens
cuauguuucaucuug

SEQ ID NO: 1284128 - RNA, 21 nt, Homo sapiens
cuauucccuucuaaccugaac

SEQ ID NO: 1284129 - RNA, 15 nt, Homo sapiens
cuauuugccaugggc

SEQ ID NO: 1284130 - RNA, 20 nt, Homo sapiens
cuauuuuuaaaaucauaaca

SEQ ID NO: 1284131 - RNA, 21 nt, Homo sapiens
cucaaaggccagaccugcaga

SEQ ID NO: 1284132 - RNA, 17 nt, Homo sapiens
cucaacacgacugcaag

SEQ ID NO: 1284133 - RNA, 12 nt, Homo sapiens
cucaacuauaac

SEQ ID NO: 1284134 - RNA, 15 nt, Homo sapiens
cucaagaucaaugaa

SEQ ID NO: 1284135 - RNA, 17 nt, Homo sapiens
cucacccccaugaucca

SEQ ID NO: 1284136 - RNA, 18 nt, Homo sapiens
cucacccuguaccacaaa

SEQ ID NO: 1284137 - RNA, 15 nt, Homo sapiens
cucagaucauuauca

SEQ ID NO: 1284138 - RNA, 23 nt, Homo sapiens
cucagaucauuaucagccugugc

SEQ ID NO: 1284139 - RNA, 17 nt, Homo sapiens
cucaggagcuuuacuca

SEQ ID NO: 1284140 - RNA, 18 nt, Homo sapiens
cucaggccucucuacaag

SEQ ID NO: 1284141 - RNA, 22 nt, Homo sapiens
cucaguaagaagagcuuggaaa

SEQ ID NO: 1284142 - RNA, 15 nt, Homo sapiens
cucagucaugcauaa

SEQ ID NO: 1284143 - RNA, 21 nt, Homo sapiens
cucaguuugcaguauacacac

SEQ ID NO: 1284144 - RNA, 15 nt, Homo sapiens
cucaucugacuugaa

SEQ ID NO: 1284145 - RNA, 15 nt, Homo sapiens
cucaucuuucuugau

SEQ ID NO: 1284146 - RNA, 18 nt, Homo sapiens
cucaugagaagucacuca

SEQ ID NO: 1284147 - RNA, 16 nt, Homo sapiens
cucauuauuucaucau

SEQ ID NO: 1284148 - RNA, 19 nt, Homo sapiens
cuccaaaaggcccuuuuca

SEQ ID NO: 1284149 - RNA, 13 nt, Homo sapiens
cuccaaacccucg

SEQ ID NO: 1284150 - RNA, 12 nt, Homo sapiens
cuccacauaccu

SEQ ID NO: 1284151 - RNA, 17 nt, Homo sapiens
cuccagaccauucagga

SEQ ID NO: 1284152 - RNA, 18 nt, Homo sapiens
cuccagagggaauugcag

SEQ ID NO: 1284153 - RNA, 16 nt, Homo sapiens
cuccagggacagcaac

SEQ ID NO: 1284154 - RNA, 17 nt, Homo sapiens
cuccaguggaagggaaa

SEQ ID NO: 1284155 - RNA, 20 nt, Homo sapiens
cuccaguuuauagaccagaa

SEQ ID NO: 1284156 - RNA, 22 nt, Homo sapiens
cuccauuuucuugucaauggaa

SEQ ID NO: 1284157 - RNA, 14 nt, Homo sapiens
cucccuuacccucc

SEQ ID NO: 1284158 - RNA, 15 nt, Homo sapiens
cuccgccucugccag

SEQ ID NO: 1284159 - RNA, 22 nt, Homo sapiens
cuccgcugggaggaaccugaac

SEQ ID NO: 1284160 - RNA, 13 nt, Homo sapiens
cuccugcagggau

SEQ ID NO: 1284161 - RNA, 19 nt, Homo sapiens
cuccuggaagcgagcuuug

SEQ ID NO: 1284162 - RNA, 15 nt, Homo sapiens
cuccuguucgccucc

SEQ ID NO: 1284163 - RNA, 16 nt, Homo sapiens
cuccuuagagacauca

SEQ ID NO: 1284164 - RNA, 14 nt, Homo sapiens
cuccuuucuugcac

SEQ ID NO: 1284165 - RNA, 16 nt, Homo sapiens
cucgaggcggaucuuu

SEQ ID NO: 1284166 - RNA, 16 nt, Homo sapiens
cucuaagggaccucaa

SEQ ID NO: 1284167 - RNA, 13 nt, Homo sapiens
cucuacagacucc

SEQ ID NO: 1284168 - RNA, 23 nt, Homo sapiens
gcugccuggacccguucaugggg

SEQ ID NO: 1284169 - RNA, 20 nt, Homo sapiens
gcugccugggccuguucacg

SEQ ID NO: 1284170 - RNA, 13 nt, Homo sapiens
gcuggcagugaca

SEQ ID NO: 1284171 - RNA, 23 nt, Homo sapiens
gcuggcuuaugccccugcacuga

SEQ ID NO: 1284172 - RNA, 19 nt, Homo sapiens
gcugggaauaagugccagg

SEQ ID NO: 1284173 - RNA, 21 nt, Homo sapiens
gcugggauguuucugucacau

SEQ ID NO: 1284174 - RNA, 19 nt, Homo sapiens
gcuguagacauuugcuaug

SEQ ID NO: 1284175 - RNA, 21 nt, Homo sapiens
gcuguccccacagcuucucua

SEQ ID NO: 1284176 - RNA, 20 nt, Homo sapiens
gcuuauaaauggcaccacau

SEQ ID NO: 1284177 - RNA, 11 nt, Homo sapiens
gcuucacuggu

SEQ ID NO: 1284178 - RNA, 18 nt, Homo sapiens
gcuucucuacagacucca

SEQ ID NO: 1284179 - RNA, 18 nt, Homo sapiens
gcuucugugugcugcuaa

SEQ ID NO: 1284180 - RNA, 23 nt, Homo sapiens
gcuugauugcguggaauugugcu

SEQ ID NO: 1284181 - RNA, 23 nt, Homo sapiens
gcuuggaaacuggaugaggucau

SEQ ID NO: 1284182 - RNA, 23 nt, Homo sapiens
gcuuggcugugcccucagauucc

SEQ ID NO: 1284183 - RNA, 14 nt, Homo sapiens
gcuuguguuuuuaa

SEQ ID NO: 1284184 - RNA, 15 nt, Homo sapiens
gcuuuaaaagucauu

SEQ ID NO: 1284185 - RNA, 19 nt, Homo sapiens
gcuuuaagcgcaacauuuc

SEQ ID NO: 1284186 - RNA, 20 nt, Homo sapiens
gcuuuaagcgcaacauuucu

SEQ ID NO: 1284187 - RNA, 13 nt, Homo sapiens
gcuuuaccuuuau

SEQ ID NO: 1284188 - RNA, 19 nt, Homo sapiens
gcuuuauaccccauuugau

SEQ ID NO: 1284189 - RNA, 18 nt, Homo sapiens
gcuuucaugaacacagcc

SEQ ID NO: 1284190 - RNA, 21 nt, Homo sapiens
gcuuucucuggacacugccac

SEQ ID NO: 1284191 - RNA, 21 nt, Homo sapiens
gcuuugggauaauguuuauaa

SEQ ID NO: 1284192 - RNA, 15 nt, Homo sapiens
ggaaaaugugcaaua

SEQ ID NO: 1284193 - RNA, 22 nt, Homo sapiens
ggaaauagcuucaggauacugu

SEQ ID NO: 1284194 - RNA, 14 nt, Homo sapiens
ggaaccaugaagcu

SEQ ID NO: 1284195 - RNA, 16 nt, Homo sapiens
ggaauauuaaagggau

SEQ ID NO: 1284196 - RNA, 20 nt, Homo sapiens
ggaauauuugcaagacauag

SEQ ID NO: 1284197 - RNA, 19 nt, Homo sapiens
ggaauggccugugccauaa

SEQ ID NO: 1284198 - RNA, 16 nt, Homo sapiens
ggacagaagcagcucu

SEQ ID NO: 1284199 - RNA, 15 nt, Homo sapiens
ggacagcaucaaaga

SEQ ID NO: 1284200 - RNA, 22 nt, Homo sapiens
ggaccccgagccuggcuccaaa

SEQ ID NO: 1284201 - RNA, 14 nt, Homo sapiens
ggacuucugcaucu

SEQ ID NO: 1284202 - RNA, 19 nt, Homo sapiens
ggagaaaggacccucaaga

SEQ ID NO: 1284203 - RNA, 13 nt, Homo sapiens
ggagaaaugccag

SEQ ID NO: 1284204 - RNA, 13 nt, Homo sapiens
ggagaagacaauu

SEQ ID NO: 1284205 - RNA, 15 nt, Homo sapiens
ggagagggaaguuuc

SEQ ID NO: 1284206 - RNA, 20 nt, Homo sapiens
ggagaugcugcaguuccaaa

SEQ ID NO: 1284207 - RNA, 19 nt, Homo sapiens
ggagcgagagagaggugcc

SEQ ID NO: 1284208 - RNA, 20 nt, Homo sapiens
ggagcuucucugcugcuuaa

SEQ ID NO: 1284209 - RNA, 21 nt, Homo sapiens
ggaggauacugaggcacacag

SEQ ID NO: 1284210 - RNA, 14 nt, Homo sapiens
ggagggucagccag

SEQ ID NO: 1284211 - RNA, 17 nt, Homo sapiens
ggagugcccccaacagc

SEQ ID NO: 1284212 - RNA, 20 nt, Homo sapiens
ggagugcccccaacagcacc

SEQ ID NO: 1284213 - RNA, 16 nt, Homo sapiens
ggauuauuuaauaaca

SEQ ID NO: 1284214 - RNA, 22 nt, Homo sapiens
ggcaacacugaaggaacaguua

SEQ ID NO: 1284215 - RNA, 17 nt, Homo sapiens
ggcacuuuuauuuucau

SEQ ID NO: 1284216 - RNA, 18 nt, Homo sapiens
ggcagccacaacugcagu

SEQ ID NO: 1284217 - RNA, 15 nt, Homo sapiens
ggcagggaacauggg

SEQ ID NO: 1284218 - RNA, 21 nt, Homo sapiens
ggcagugguguggagaagcca

SEQ ID NO: 1284219 - RNA, 18 nt, Homo sapiens
ggccacagugcaauuuua

SEQ ID NO: 1284220 - RNA, 16 nt, Homo sapiens
ggccagcaccaucucu

SEQ ID NO: 1284221 - RNA, 15 nt, Homo sapiens
ggccccacauugcac

SEQ ID NO: 1284222 - RNA, 17 nt, Homo sapiens
ggccccauuuacccaac

SEQ ID NO: 1284223 - RNA, 16 nt, Homo sapiens
ggccccucucauuccc

SEQ ID NO: 1284224 - RNA, 23 nt, Homo sapiens
ggccucucuacaagcagcaggaa

SEQ ID NO: 1284225 - RNA, 14 nt, Homo sapiens
ggccuguucacgug

SEQ ID NO: 1284226 - RNA, 22 nt, Homo sapiens
ggcggaucuuuggacagaagca

SEQ ID NO: 1284227 - RNA, 16 nt, Homo sapiens
ggcucacaguucugca

SEQ ID NO: 1284228 - RNA, 16 nt, Homo sapiens
ggcuguuauucuucca

SEQ ID NO: 1284229 - RNA, 12 nt, Homo sapiens
ggcuuccaugcu

SEQ ID NO: 1284230 - RNA, 15 nt, Homo sapiens
ggcuuuaaaagucau

SEQ ID NO: 1284231 - RNA, 23 nt, Homo sapiens
ggcuuugugauucccuccaguga

SEQ ID NO: 1284232 - RNA, 14 nt, Homo sapiens
ggcuuuuauugcca

SEQ ID NO: 1284233 - RNA, 18 nt, Homo sapiens
gggaaggcugucuaccug

SEQ ID NO: 1284234 - RNA, 18 nt, Homo sapiens
gggaaggugggcgggcag

SEQ ID NO: 1284235 - RNA, 20 nt, Homo sapiens
gggaaguaucaaacuacugc

SEQ ID NO: 1284236 - RNA, 18 nt, Homo sapiens
gggacuguaaaaccaccu

SEQ ID NO: 1284237 - RNA, 14 nt, Homo sapiens
gggagaaaugccag

SEQ ID NO: 1284238 - RNA, 16 nt, Homo sapiens
gggagaaugucaguau

SEQ ID NO: 1284239 - RNA, 16 nt, Homo sapiens
gggagagagugcuauu

SEQ ID NO: 1284240 - RNA, 14 nt, Homo sapiens
gggagcugcagggg

SEQ ID NO: 1284241 - RNA, 16 nt, Homo sapiens
gggcaagggaccugcu

SEQ ID NO: 1284242 - RNA, 19 nt, Homo sapiens
gggcucucucaugauagaa

SEQ ID NO: 1284243 - RNA, 17 nt, Homo sapiens
gggcugaggccucucau

SEQ ID NO: 1284244 - RNA, 17 nt, Homo sapiens
gggucaaaggagaacaa

SEQ ID NO: 1284245 - RNA, 20 nt, Homo sapiens
gggugguaaagugaacaaaa

SEQ ID NO: 1284246 - RNA, 17 nt, Homo sapiens
ggguuggacaaccucau

SEQ ID NO: 1284247 - RNA, 14 nt, Homo sapiens
gguacauauuucuu

SEQ ID NO: 1284248 - RNA, 19 nt, Homo sapiens
gguaucaaccaaauggagu

SEQ ID NO: 1284249 - RNA, 21 nt, Homo sapiens
ggucuuuuacauacagugaua

SEQ ID NO: 1284250 - RNA, 14 nt, Homo sapiens
ggugacguagaauu

SEQ ID NO: 1284251 - RNA, 19 nt, Homo sapiens
ggugacguagaauugaguc

SEQ ID NO: 1284252 - RNA, 16 nt, Homo sapiens
ggugcuaaaccauuca

SEQ ID NO: 1284253 - RNA, 23 nt, Homo sapiens
gguggcagaaucuguuaccagag

SEQ ID NO: 1284254 - RNA, 22 nt, Homo sapiens
gguguuaaucauuucauuuuua

SEQ ID NO: 1284255 - RNA, 23 nt, Homo sapiens
gguuaccaguaacggaacaguau

SEQ ID NO: 1284256 - RNA, 23 nt, Homo sapiens
gguuuacaacaaacacugugaug

SEQ ID NO: 1284257 - RNA, 14 nt, Homo sapiens
guaaaucuauauga

SEQ ID NO: 1284258 - RNA, 21 nt, Homo sapiens
guaaccaguagucaccucugg

SEQ ID NO: 1284259 - RNA, 19 nt, Homo sapiens
guaagcagaguucuuugca

SEQ ID NO: 1284260 - RNA, 12 nt, Homo sapiens
guaaguuuugaa

SEQ ID NO: 1284261 - RNA, 20 nt, Homo sapiens
guaauaugagaauguauuag

SEQ ID NO: 1284262 - RNA, 14 nt, Homo sapiens
guaaucuaaguaua

SEQ ID NO: 1284263 - RNA, 22 nt, Homo sapiens
guacaauaaaaguaaaccacaa

SEQ ID NO: 1284264 - RNA, 12 nt, Homo sapiens
guacagacacuc

SEQ ID NO: 1284265 - RNA, 20 nt, Homo sapiens
guacauugggcacauaucuc

SEQ ID NO: 1284266 - RNA, 17 nt, Homo sapiens
guaccaugugcuacagg

SEQ ID NO: 1284267 - RNA, 15 nt, Homo sapiens
guagaguuugaucau

SEQ ID NO: 1284268 - RNA, 15 nt, Homo sapiens
guagccacuucacuu

SEQ ID NO: 1284269 - RNA, 14 nt, Homo sapiens
guaggaacugcugg

SEQ ID NO: 1284270 - RNA, 12 nt, Homo sapiens
guauacaguccu

SEQ ID NO: 1284271 - RNA, 23 nt, Homo sapiens
guauaguagaaagacaucugccu

SEQ ID NO: 1284272 - RNA, 18 nt, Homo sapiens
guaucaaccaaauggagu

SEQ ID NO: 1284273 - RNA, 15 nt, Homo sapiens
guauuagccagucau

SEQ ID NO: 1284274 - RNA, 18 nt, Homo sapiens
guauugauaaacuuugaa

SEQ ID NO: 1284275 - RNA, 13 nt, Homo sapiens
guauugugcauag

SEQ ID NO: 1284276 - RNA, 17 nt, Homo sapiens
guauuuaggcagauuga

SEQ ID NO: 1284277 - RNA, 18 nt, Homo sapiens
guauuuucaguuugcccu

SEQ ID NO: 1284278 - RNA, 16 nt, Homo sapiens
gucaacuuucauuuga

SEQ ID NO: 1284279 - RNA, 15 nt, Homo sapiens
augugucccagugaa

SEQ ID NO: 1284280 - RNA, 11 nt, Homo sapiens
auguguugcau

SEQ ID NO: 1284281 - RNA, 18 nt, Homo sapiens
auguuaaggaaacucuua

SEQ ID NO: 1284282 - RNA, 9 nt, Homo sapiens
auguugaau

SEQ ID NO: 1284283 - RNA, 23 nt, Homo sapiens
auguuuuuguguagaguggcgau

SEQ ID NO: 1284284 - RNA, 20 nt, Homo sapiens
auuaaacuuuucauuacacu

SEQ ID NO: 1284285 - RNA, 19 nt, Homo sapiens
auuaauaccuaaacuguau

SEQ ID NO: 1284286 - RNA, 19 nt, Homo sapiens
auuaauguuucuucuccaa

SEQ ID NO: 1284287 - RNA, 20 nt, Homo sapiens
auuacacuaaagugcauuau

SEQ ID NO: 1284288 - RNA, 17 nt, Homo sapiens
auuacauggcucuaaaa

SEQ ID NO: 1284289 - RNA, 20 nt, Homo sapiens
auuacuagaaauauuuaacu

SEQ ID NO: 1284290 - RNA, 13 nt, Homo sapiens
auuauagaaugga

SEQ ID NO: 1284291 - RNA, 15 nt, Homo sapiens
auuauauaaggacag

SEQ ID NO: 1284292 - RNA, 17 nt, Homo sapiens
auuaucuauacauaaaa

SEQ ID NO: 1284293 - RNA, 13 nt, Homo sapiens
auuauuauuguga

SEQ ID NO: 1284294 - RNA, 17 nt, Homo sapiens
auuauuucaucaugacu

SEQ ID NO: 1284295 - RNA, 13 nt, Homo sapiens
auucaggacacag

SEQ ID NO: 1284296 - RNA, 17 nt, Homo sapiens
auucauuuucugccuau

SEQ ID NO: 1284297 - RNA, 21 nt, Homo sapiens
auuccacacaaaaugucacac

SEQ ID NO: 1284298 - RNA, 15 nt, Homo sapiens
auuccaggagauugg

SEQ ID NO: 1284299 - RNA, 14 nt, Homo sapiens
auuccgcaccaaua

SEQ ID NO: 1284300 - RNA, 21 nt, Homo sapiens
auuccuuucagaguuuuacua

SEQ ID NO: 1284301 - RNA, 13 nt, Homo sapiens
auucuaaacagau

SEQ ID NO: 1284302 - RNA, 18 nt, Homo sapiens
auucuauuacgugcaaua

SEQ ID NO: 1284303 - RNA, 14 nt, Homo sapiens
auucucaguaucca

SEQ ID NO: 1284304 - RNA, 17 nt, Homo sapiens
auucucauuauuucauc

SEQ ID NO: 1284305 - RNA, 17 nt, Homo sapiens
auucuuaaaaugcaaua

SEQ ID NO: 1284306 - RNA, 12 nt, Homo sapiens
auugaacuguac

SEQ ID NO: 1284307 - RNA, 13 nt, Homo sapiens
auugagucuucca

SEQ ID NO: 1284308 - RNA, 16 nt, Homo sapiens
auugcaggagucccug

SEQ ID NO: 1284309 - RNA, 21 nt, Homo sapiens
auugcuccauuuucuugucaa

SEQ ID NO: 1284310 - RNA, 21 nt, Homo sapiens
auugggaaaggacagcuuuga

SEQ ID NO: 1284311 - RNA, 21 nt, Homo sapiens
auuguauuuaccuucuaccuc

SEQ ID NO: 1284312 - RNA, 12 nt, Homo sapiens
auuguguucacu

SEQ ID NO: 1284313 - RNA, 19 nt, Homo sapiens
auuguuaaacuuuguaaag

SEQ ID NO: 1284314 - RNA, 22 nt, Homo sapiens
auuuaaaaauaaagcuacugaa

SEQ ID NO: 1284315 - RNA, 15 nt, Homo sapiens
auuuacuugaucauu

SEQ ID NO: 1284316 - RNA, 21 nt, Homo sapiens
auuuagguaaauaaagcucaa

SEQ ID NO: 1284317 - RNA, 15 nt, Homo sapiens
auuuaugguucucag

SEQ ID NO: 1284318 - RNA, 21 nt, Homo sapiens
auuuaugguucucaggccuga

SEQ ID NO: 1284319 - RNA, 17 nt, Homo sapiens
auuuauuuuuuuacuuc

SEQ ID NO: 1284320 - RNA, 20 nt, Homo sapiens
auuuauuuuuuuacuuccuc

SEQ ID NO: 1284321 - RNA, 14 nt, Homo sapiens
auuucaccacucaa

SEQ ID NO: 1284322 - RNA, 15 nt, Homo sapiens
auuucaucaugacug

SEQ ID NO: 1284323 - RNA, 12 nt, Homo sapiens
auuucaucugcu

SEQ ID NO: 1284324 - RNA, 16 nt, Homo sapiens
auuucgagcauaagaa

SEQ ID NO: 1284325 - RNA, 19 nt, Homo sapiens
auuugaggucaaguaagaa

SEQ ID NO: 1284326 - RNA, 15 nt, Homo sapiens
auuugauaguauugu

SEQ ID NO: 1284327 - RNA, 14 nt, Homo sapiens
auuugcaagacaua

SEQ ID NO: 1284328 - RNA, 20 nt, Homo sapiens
auuugggcaggaacacagac

SEQ ID NO: 1284329 - RNA, 17 nt, Homo sapiens
auuugguuaugauggaa

SEQ ID NO: 1284330 - RNA, 22 nt, Homo sapiens
auuuguauguauuaaacuuuuc

SEQ ID NO: 1284331 - RNA, 20 nt, Homo sapiens
auuuguuaaugguuugaaua

SEQ ID NO: 1284332 - RNA, 21 nt, Homo sapiens
auuuguuaggccauucuugca

SEQ ID NO: 1284333 - RNA, 22 nt, Homo sapiens
auuuguuaggccauucuugcau

SEQ ID NO: 1284334 - RNA, 16 nt, Homo sapiens
auuuuaaguaauuuca

SEQ ID NO: 1284335 - RNA, 18 nt, Homo sapiens
auuuuauuuuucucauga

SEQ ID NO: 1284336 - RNA, 21 nt, Homo sapiens
auuuucaauuuggagcauuaa

SEQ ID NO: 1284337 - RNA, 20 nt, Homo sapiens
auuuucacuuuuggcuugua

SEQ ID NO: 1284338 - RNA, 13 nt, Homo sapiens
auuuucagcauca

SEQ ID NO: 1284339 - RNA, 19 nt, Homo sapiens
auuuucugcccaacuuuca

SEQ ID NO: 1284340 - RNA, 13 nt, Homo sapiens
auuuugugcaaca

SEQ ID NO: 1284341 - RNA, 19 nt, Homo sapiens
auuuugugcaacauaacaa

SEQ ID NO: 1284342 - RNA, 22 nt, Homo sapiens
auuuuguggcaaaauauucuuc

SEQ ID NO: 1284343 - RNA, 22 nt, Homo sapiens
auuuuuaguuuaaaaucuugca

SEQ ID NO: 1284344 - RNA, 15 nt, Homo sapiens
auuuuuaugugcaau

SEQ ID NO: 1284345 - RNA, 17 nt, Homo sapiens
auuuuucuauaaagauc

SEQ ID NO: 1284346 - RNA, 18 nt, Homo sapiens
auuuuugcacauucuaca

SEQ ID NO: 1284347 - RNA, 21 nt, Homo sapiens
auuuuuuaugaaacauuacag

SEQ ID NO: 1284348 - RNA, 13 nt, Homo sapiens
auuuuuuauucaa

SEQ ID NO: 1284349 - RNA, 21 nt, Homo sapiens
caaaaauugcucguguuauaa

SEQ ID NO: 1284350 - RNA, 17 nt, Homo sapiens
caaaacugaaaaucaau

SEQ ID NO: 1284351 - RNA, 19 nt, Homo sapiens
caaaagcacuuugugcugu

SEQ ID NO: 1284352 - RNA, 15 nt, Homo sapiens
caaaaucacacagcc

SEQ ID NO: 1284353 - RNA, 16 nt, Homo sapiens
caaaaucacacagcca

SEQ ID NO: 1284354 - RNA, 14 nt, Homo sapiens
caaaauguacuuaa

SEQ ID NO: 1284355 - RNA, 14 nt, Homo sapiens
caaacaaaauuucu

SEQ ID NO: 1284356 - RNA, 15 nt, Homo sapiens
caaacaccuuauuug

SEQ ID NO: 1284357 - RNA, 22 nt, Homo sapiens
caaacagccccucuggacacag

SEQ ID NO: 1284358 - RNA, 23 nt, Homo sapiens
caaacagccccucuggacacagc

SEQ ID NO: 1284359 - RNA, 11 nt, Homo sapiens
caaacaugugc

SEQ ID NO: 1284360 - RNA, 14 nt, Homo sapiens
caaaccacuguuau

SEQ ID NO: 1284361 - RNA, 14 nt, Homo sapiens
caaaccuucacaca

SEQ ID NO: 1284362 - RNA, 16 nt, Homo sapiens
caaagagaauguauuu

SEQ ID NO: 1284363 - RNA, 15 nt, Homo sapiens
caaagagauggugcu

SEQ ID NO: 1284364 - RNA, 18 nt, Homo sapiens
caaaggcaggcacuucac

SEQ ID NO: 1284365 - RNA, 17 nt, Homo sapiens
caaaggugauugugcca

SEQ ID NO: 1284366 - RNA, 18 nt, Homo sapiens
caaauacucaauuuacua

SEQ ID NO: 1284367 - RNA, 22 nt, Homo sapiens
caaaugcugugcaaacagugua

SEQ ID NO: 1284368 - RNA, 11 nt, Homo sapiens
caaauguccua

SEQ ID NO: 1284369 - RNA, 14 nt, Homo sapiens
caaauguuguauaa

SEQ ID NO: 1284370 - RNA, 12 nt, Homo sapiens
caacaacaugua

SEQ ID NO: 1284371 - RNA, 16 nt, Homo sapiens
caaguugcuaagugaa

SEQ ID NO: 1284372 - RNA, 19 nt, Homo sapiens
caauaacacugcuuauaaa

SEQ ID NO: 1284373 - RNA, 15 nt, Homo sapiens
caauacuaaauguac

SEQ ID NO: 1284374 - RNA, 18 nt, Homo sapiens
caauauagugaugccauc

SEQ ID NO: 1284375 - RNA, 17 nt, Homo sapiens
caaucgagacugcaaug

SEQ ID NO: 1284376 - RNA, 21 nt, Homo sapiens
caaugaaagcauggcugagaa

SEQ ID NO: 1284377 - RNA, 21 nt, Homo sapiens
caaugauacccaacaguuuau

SEQ ID NO: 1284378 - RNA, 22 nt, Homo sapiens
caaugccacauacuugcagcuc

SEQ ID NO: 1284379 - RNA, 22 nt, Homo sapiens
caaugguuugcaaggaagccac

SEQ ID NO: 1284380 - RNA, 14 nt, Homo sapiens
caauuaaagcaaaa

SEQ ID NO: 1284381 - RNA, 12 nt, Homo sapiens
caauuuacuuuu

SEQ ID NO: 1284382 - RNA, 18 nt, Homo sapiens
caauuugccauuguuucu

SEQ ID NO: 1284383 - RNA, 21 nt, Homo sapiens
caauuuuugaguagcauauua

SEQ ID NO: 1284384 - RNA, 23 nt, Homo sapiens
cacaacccuucagauuugccuua

SEQ ID NO: 1284385 - RNA, 15 nt, Homo sapiens
cacacaaaaugucac

SEQ ID NO: 1284386 - RNA, 16 nt, Homo sapiens
cacacaaaaugucaca

SEQ ID NO: 1284387 - RNA, 14 nt, Homo sapiens
cacacacagacugu

SEQ ID NO: 1284388 - RNA, 17 nt, Homo sapiens
cacacagaggggaguca

SEQ ID NO: 1284389 - RNA, 15 nt, Homo sapiens
cacacagugccugua

SEQ ID NO: 1284390 - RNA, 17 nt, Homo sapiens
cacaccugcggcccaau

SEQ ID NO: 1284391 - RNA, 21 nt, Homo sapiens
cacagcaagucacuggccagu

SEQ ID NO: 1284392 - RNA, 18 nt, Homo sapiens
cacagcauguguauuucc

SEQ ID NO: 1284393 - RNA, 18 nt, Homo sapiens
cacagcuucucuacagac

SEQ ID NO: 1284394 - RNA, 16 nt, Homo sapiens
cacaggcacugcagga

SEQ ID NO: 1284395 - RNA, 23 nt, Homo sapiens
cacaggccauggauggaaaacgc

SEQ ID NO: 1284396 - RNA, 13 nt, Homo sapiens
cacagugugaaua

SEQ ID NO: 1284397 - RNA, 17 nt, Homo sapiens
cacauccugaccuugca

SEQ ID NO: 1284398 - RNA, 20 nt, Homo sapiens
cacauccugaccuugcacaa

SEQ ID NO: 1284399 - RNA, 17 nt, Homo sapiens
cacaugcccuaaugucu

SEQ ID NO: 1284400 - RNA, 16 nt, Homo sapiens
caccaguuccuuucaa

SEQ ID NO: 1284401 - RNA, 19 nt, Homo sapiens
caccaucucuuuaccuccu

SEQ ID NO: 1284402 - RNA, 23 nt, Homo sapiens
caccauucuuucuuggugcauuc

SEQ ID NO: 1284403 - RNA, 14 nt, Homo sapiens
cacccucuccagau

SEQ ID NO: 1284404 - RNA, 22 nt, Homo sapiens
cacccugggcagugagugccau

SEQ ID NO: 1284405 - RNA, 20 nt, Homo sapiens
caccgagaauguuguauuca

SEQ ID NO: 1284406 - RNA, 15 nt, Homo sapiens
caccucaggagcuuu

SEQ ID NO: 1284407 - RNA, 16 nt, Homo sapiens
caccucaugucauuuc

SEQ ID NO: 1284408 - RNA, 21 nt, Homo sapiens
caccugugagaaaggaaaaau

SEQ ID NO: 1284409 - RNA, 20 nt, Homo sapiens
cacgagagagggcuuucuca

SEQ ID NO: 1284410 - RNA, 22 nt, Homo sapiens
cacuauggguggggcacuccuu

SEQ ID NO: 1284411 - RNA, 20 nt, Homo sapiens
cacucagugauugcaauuug

SEQ ID NO: 1284412 - RNA, 15 nt, Homo sapiens
cacucccuccuaucg

SEQ ID NO: 1284413 - RNA, 16 nt, Homo sapiens
cacuccugcuguaaau

SEQ ID NO: 1284414 - RNA, 14 nt, Homo sapiens
cacugacacaaaag

SEQ ID NO: 1284415 - RNA, 20 nt, Homo sapiens
cacugacagauguguuugca

SEQ ID NO: 1284416 - RNA, 22 nt, Homo sapiens
cacugagacuugaaucaaguca

SEQ ID NO: 1284417 - RNA, 16 nt, Homo sapiens
cacugcugccucuuga

SEQ ID NO: 1284418 - RNA, 14 nt, Homo sapiens
cacuguaugugaaa

SEQ ID NO: 1284419 - RNA, 23 nt, Homo sapiens
cacuuaugagaugccugaagcca

SEQ ID NO: 1284420 - RNA, 15 nt, Homo sapiens
cagaaaguuaugaaa

SEQ ID NO: 1284421 - RNA, 14 nt, Homo sapiens
cagaacuaucucag

SEQ ID NO: 1284422 - RNA, 20 nt, Homo sapiens
cagaacuggaccaucuccaa

SEQ ID NO: 1284423 - RNA, 17 nt, Homo sapiens
cagaagaccccacuuca

SEQ ID NO: 1284424 - RNA, 19 nt, Homo sapiens
cagaaggcucgccucuccc

SEQ ID NO: 1284425 - RNA, 13 nt, Homo sapiens
cagaauggaggca

SEQ ID NO: 1284426 - RNA, 14 nt, Homo sapiens
cagacacuguaaaa

SEQ ID NO: 1284427 - RNA, 21 nt, Homo sapiens
cagaccccuccccucguguca

SEQ ID NO: 1284428 - RNA, 17 nt, Homo sapiens
cagacucacauccugac

SEQ ID NO: 1284429 - RNA, 13 nt, Homo sapiens
cagacuccaaaag

SEQ ID NO: 1284430 - RNA, 21 nt, Homo sapiens
cagacugaccuugaugagcug

SEQ ID NO: 1284431 - RNA, 15 nt, Homo sapiens
cagagcagaugcaga

SEQ ID NO: 1284432 - RNA, 13 nt, Homo sapiens
cagaggacaguau

SEQ ID NO: 1284433 - RNA, 15 nt, Homo sapiens
cagaggcgugggcuc

SEQ ID NO: 1284434 - RNA, 18 nt, Homo sapiens
cagaggggcagauggaaa

SEQ ID NO: 1284435 - RNA, 18 nt, Homo sapiens
cagaguacuggcugaugg

SEQ ID NO: 1284436 - RNA, 19 nt, Homo sapiens
cagaguauggaaguagcuc

SEQ ID NO: 1284437 - RNA, 16 nt, Homo sapiens
cagagucaaugaacuu

SEQ ID NO: 1284438 - RNA, 17 nt, Homo sapiens
cagaugagaguacaccc

SEQ ID NO: 1284439 - RNA, 20 nt, Homo sapiens
cagaugagaguacaccccaa

SEQ ID NO: 1284440 - RNA, 23 nt, Homo sapiens
cagaugagaguacaccccaacag

SEQ ID NO: 1284441 - RNA, 15 nt, Homo sapiens
cagaugauucaaaua

SEQ ID NO: 1284442 - RNA, 19 nt, Homo sapiens
cagaugauucaaauaucaa

SEQ ID NO: 1284443 - RNA, 15 nt, Homo sapiens
cagauuccacacaaa

SEQ ID NO: 1284444 - RNA, 23 nt, Homo sapiens
cagcaggauuggauguuguguau

SEQ ID NO: 1284445 - RNA, 14 nt, Homo sapiens
cagccacaacugca

SEQ ID NO: 1284446 - RNA, 20 nt, Homo sapiens
cagccccuccccacaccagu

SEQ ID NO: 1284447 - RNA, 17 nt, Homo sapiens
cagccucagcucucagu

SEQ ID NO: 1284448 - RNA, 22 nt, Homo sapiens
cagccuccuuauauuuggccca

SEQ ID NO: 1284449 - RNA, 24 nt, Homo sapiens
cagcuacuucccagcuaaucucca

SEQ ID NO: 1284450 - RNA, 23 nt, Homo sapiens
cagcuccgccucugccagguguc

SEQ ID NO: 1284451 - RNA, 19 nt, Homo sapiens
cagcugaagaacaucucga

SEQ ID NO: 1284452 - RNA, 18 nt, Homo sapiens
cagcugagguucauuaca

SEQ ID NO: 1284453 - RNA, 18 nt, Homo sapiens
cagcuuugauaaugucca

SEQ ID NO: 1284454 - RNA, 14 nt, Homo sapiens
caggaaaucaugag

SEQ ID NO: 1284455 - RNA, 23 nt, Homo sapiens
caggaacuugcacaaaaucacac

SEQ ID NO: 1284456 - RNA, 18 nt, Homo sapiens
caggaauauuaaagggau

SEQ ID NO: 1284457 - RNA, 20 nt, Homo sapiens
caggacccugggaccacaga

SEQ ID NO: 1284458 - RNA, 18 nt, Homo sapiens
caggaggaaggcuuacac

SEQ ID NO: 1284459 - RNA, 19 nt, Homo sapiens
caggaguacaccccaacag

SEQ ID NO: 1284460 - RNA, 17 nt, Homo sapiens
caggauagucuaaggga

SEQ ID NO: 1284461 - RNA, 15 nt, Homo sapiens
uauguguuacauuau

SEQ ID NO: 1284462 - RNA, 15 nt, Homo sapiens
uauuaccuaaugaaa

SEQ ID NO: 1284463 - RNA, 15 nt, Homo sapiens
uauuacgugcaauac

SEQ ID NO: 1284464 - RNA, 16 nt, Homo sapiens
uauuacgugcaauacu

SEQ ID NO: 1284465 - RNA, 14 nt, Homo sapiens
uauuauugugacaa

SEQ ID NO: 1284466 - RNA, 17 nt, Homo sapiens
uauucauuuuguggcaa

SEQ ID NO: 1284467 - RNA, 12 nt, Homo sapiens
uauucccaugag

SEQ ID NO: 1284468 - RNA, 19 nt, Homo sapiens
uauucccuucuaaccugaa

SEQ ID NO: 1284469 - RNA, 22 nt, Homo sapiens
uauuccuaaauaaauggauaag

SEQ ID NO: 1284470 - RNA, 19 nt, Homo sapiens
uauucucauuauuucauca

SEQ ID NO: 1284471 - RNA, 13 nt, Homo sapiens
uauucugauaaug

SEQ ID NO: 1284472 - RNA, 13 nt, Homo sapiens
uauugugcauaga

SEQ ID NO: 1284473 - RNA, 18 nt, Homo sapiens
uauuuaaaagacaaacac

SEQ ID NO: 1284474 - RNA, 15 nt, Homo sapiens
uauuuauugugaugc

SEQ ID NO: 1284475 - RNA, 17 nt, Homo sapiens
uauuugcaagacauaga

SEQ ID NO: 1284476 - RNA, 14 nt, Homo sapiens
uauuuguucuuaua

SEQ ID NO: 1284477 - RNA, 15 nt, Homo sapiens
uauuuguuugugcau

SEQ ID NO: 1284478 - RNA, 14 nt, Homo sapiens
uauuuuccaugaaa

SEQ ID NO: 1284479 - RNA, 17 nt, Homo sapiens
uauuuugugcaacauaa

SEQ ID NO: 1284480 - RNA, 15 nt, Homo sapiens
uauuuuuaugugcaa

SEQ ID NO: 1284481 - RNA, 20 nt, Homo sapiens
ucaaaaauacucacauggcu

SEQ ID NO: 1284482 - RNA, 24 nt, Homo sapiens
ucaaaauuccauuuacuugaucau

SEQ ID NO: 1284483 - RNA, 23 nt, Homo sapiens
ucaacaagagacuggaaggacca

SEQ ID NO: 1284484 - RNA, 22 nt, Homo sapiens
ucaacacgacugcaagcuccau

SEQ ID NO: 1284485 - RNA, 18 nt, Homo sapiens
ucaagcagggaagcccca

SEQ ID NO: 1284486 - RNA, 21 nt, Homo sapiens
ucaagccuagcccuucucuca

SEQ ID NO: 1284487 - RNA, 15 nt, Homo sapiens
ucaagguaacuguac

SEQ ID NO: 1284488 - RNA, 23 nt, Homo sapiens
ucaaggugggccuugcuaccuca

SEQ ID NO: 1284489 - RNA, 18 nt, Homo sapiens
ucaauaaauuguaauugu

SEQ ID NO: 1284490 - RNA, 20 nt, Homo sapiens
ucaauaguguccuaugcaau

SEQ ID NO: 1284491 - RNA, 19 nt, Homo sapiens
ucaaugaaaugaugucaua

SEQ ID NO: 1284492 - RNA, 18 nt, Homo sapiens
ucaauucagugauggcaa

SEQ ID NO: 1284493 - RNA, 23 nt, Homo sapiens
ucacaccaggcuugccugcaggc

SEQ ID NO: 1284494 - RNA, 18 nt, Homo sapiens
ucacagaagcacagcacc

SEQ ID NO: 1284495 - RNA, 17 nt, Homo sapiens
ucacauugccuuaccua

SEQ ID NO: 1284496 - RNA, 18 nt, Homo sapiens
ucacuacucucuacucug

SEQ ID NO: 1284497 - RNA, 20 nt, Homo sapiens
ucacuauugcaaggacagca

SEQ ID NO: 1284498 - RNA, 19 nt, Homo sapiens
ucacucagugauugcaauu

SEQ ID NO: 1284499 - RNA, 21 nt, Homo sapiens
ucacucaugcaaacugcuuua

SEQ ID NO: 1284500 - RNA, 20 nt, Homo sapiens
ucacuguccaccaccaccug

SEQ ID NO: 1284501 - RNA, 20 nt, Homo sapiens
ucacuuuuuccccugcaaug

SEQ ID NO: 1284502 - RNA, 18 nt, Homo sapiens
ucacuuuuuuucuuuucu

SEQ ID NO: 1284503 - RNA, 13 nt, Homo sapiens
ucagaaauguuaa

SEQ ID NO: 1284504 - RNA, 19 nt, Homo sapiens
ucagaguuugguuaaucag

SEQ ID NO: 1284505 - RNA, 21 nt, Homo sapiens
ucagauacaugguugugaccu

SEQ ID NO: 1284506 - RNA, 23 nt, Homo sapiens
ucagauuccacacaaaaugucac

SEQ ID NO: 1284507 - RNA, 18 nt, Homo sapiens
ucagcccuuggggguccu

SEQ ID NO: 1284508 - RNA, 18 nt, Homo sapiens
ucaggccauugucccuga

SEQ ID NO: 1284509 - RNA, 18 nt, Homo sapiens
ucaggccucugugccgca

SEQ ID NO: 1284510 - RNA, 18 nt, Homo sapiens
ucagguaccacguauucc

SEQ ID NO: 1284511 - RNA, 14 nt, Homo sapiens
ucaguauuuuccag

SEQ ID NO: 1284512 - RNA, 22 nt, Homo sapiens
ucagucugaugagaacucugag

SEQ ID NO: 1284513 - RNA, 17 nt, Homo sapiens
ucauaagcgaucacuuc

SEQ ID NO: 1284514 - RNA, 17 nt, Homo sapiens
ucauagaaugaaaguau

SEQ ID NO: 1284515 - RNA, 21 nt, Homo sapiens
ucaucuccgggguggccacag

SEQ ID NO: 1284516 - RNA, 14 nt, Homo sapiens
ucauguuacuugag

SEQ ID NO: 1284517 - RNA, 22 nt, Homo sapiens
ucauuacaaucgagacugcaau

SEQ ID NO: 1284518 - RNA, 16 nt, Homo sapiens
ucauucucaguaucca

SEQ ID NO: 1284519 - RNA, 20 nt, Homo sapiens
uccaaugccacauacuugca

SEQ ID NO: 1284520 - RNA, 21 nt, Homo sapiens
uccaaugccacauacuugcag

SEQ ID NO: 1284521 - RNA, 13 nt, Homo sapiens
uccacacagccaa

SEQ ID NO: 1284522 - RNA, 17 nt, Homo sapiens
uccaccaagugucuaga

SEQ ID NO: 1284523 - RNA, 23 nt, Homo sapiens
uccacuucaauguccaccuguga

SEQ ID NO: 1284524 - RNA, 21 nt, Homo sapiens
uccagaguuguuguuugccaa

SEQ ID NO: 1284525 - RNA, 14 nt, Homo sapiens
uccagugcaauugu

SEQ ID NO: 1284526 - RNA, 23 nt, Homo sapiens
uccaguuauaagcguauuuagac

SEQ ID NO: 1284527 - RNA, 21 nt, Homo sapiens
uccaugagggcagggacauca

SEQ ID NO: 1284528 - RNA, 18 nt, Homo sapiens
uccauggcccugccaugc

SEQ ID NO: 1284529 - RNA, 18 nt, Homo sapiens
uccauuuacuugaucauu

SEQ ID NO: 1284530 - RNA, 20 nt, Homo sapiens
ucccagaggggccugccacc

SEQ ID NO: 1284531 - RNA, 21 nt, Homo sapiens
ucccagauuggcucacacuga

SEQ ID NO: 1284532 - RNA, 20 nt, Homo sapiens
ucccagcaccuauugaauua

SEQ ID NO: 1284533 - RNA, 20 nt, Homo sapiens
ucccaggcuggagugcagug

SEQ ID NO: 1284534 - RNA, 15 nt, Homo sapiens
uccccaaucccugac

SEQ ID NO: 1284535 - RNA, 12 nt, Homo sapiens
uccccacugcuc

SEQ ID NO: 1284536 - RNA, 17 nt, Homo sapiens
uccccauuugcuuacuu

SEQ ID NO: 1284537 - RNA, 14 nt, Homo sapiens
ucccccacucccuc

SEQ ID NO: 1284538 - RNA, 14 nt, Homo sapiens
uccccggaguaccu

SEQ ID NO: 1284539 - RNA, 14 nt, Homo sapiens
uccccuucucucau

SEQ ID NO: 1284540 - RNA, 18 nt, Homo sapiens
uccccuucucucaucucu

SEQ ID NO: 1284541 - RNA, 17 nt, Homo sapiens
uucugcaagcuuuucaa

SEQ ID NO: 1284542 - RNA, 13 nt, Homo sapiens
uucugcacuugcg

SEQ ID NO: 1284543 - RNA, 19 nt, Homo sapiens
uucugcaggcuguauggga

SEQ ID NO: 1284544 - RNA, 17 nt, Homo sapiens
uucuggggacaccucag

SEQ ID NO: 1284545 - RNA, 19 nt, Homo sapiens
uucuggggggugaccgacu

SEQ ID NO: 1284546 - RNA, 18 nt, Homo sapiens
uucugguuuguaaggugg

SEQ ID NO: 1284547 - RNA, 17 nt, Homo sapiens
uucuguugucaccuuca

SEQ ID NO: 1284548 - RNA, 14 nt, Homo sapiens
uucuuacaugcauu

SEQ ID NO: 1284549 - RNA, 17 nt, Homo sapiens
uucuuacaugcauuuga

SEQ ID NO: 1284550 - RNA, 15 nt, Homo sapiens
uucuuacuaaucuga

SEQ ID NO: 1284551 - RNA, 16 nt, Homo sapiens
uucuucauuaccucag

SEQ ID NO: 1284552 - RNA, 14 nt, Homo sapiens
uugaaaagcuauua

SEQ ID NO: 1284553 - RNA, 14 nt, Homo sapiens
uugaaaccuuugac

SEQ ID NO: 1284554 - RNA, 19 nt, Homo sapiens
uugaaaucagcauacucaa

SEQ ID NO: 1284555 - RNA, 18 nt, Homo sapiens
uugaagugacuucacaga

SEQ ID NO: 1284556 - RNA, 19 nt, Homo sapiens
uugaaucccuuaaacucag

SEQ ID NO: 1284557 - RNA, 15 nt, Homo sapiens
uugaaugcagggaca

SEQ ID NO: 1284558 - RNA, 16 nt, Homo sapiens
uugacagaacacuguc

SEQ ID NO: 1284559 - RNA, 19 nt, Homo sapiens
uugacagcugucauauaau

SEQ ID NO: 1284560 - RNA, 13 nt, Homo sapiens
uugaccaugugau

SEQ ID NO: 1284561 - RNA, 12 nt, Homo sapiens
uugagucuucca

SEQ ID NO: 1284562 - RNA, 14 nt, Homo sapiens
uugaucauucucag

SEQ ID NO: 1284563 - RNA, 14 nt, Homo sapiens
uugauucuccuuca

SEQ ID NO: 1284564 - RNA, 20 nt, Homo sapiens
uugauugcguggaauugugc

SEQ ID NO: 1284565 - RNA, 19 nt, Homo sapiens
uugauugucagcuacuaau

SEQ ID NO: 1284566 - RNA, 23 nt, Homo sapiens
uugcccauauaaaaugcugauau

SEQ ID NO: 1284567 - RNA, 21 nt, Homo sapiens
uugccuuaccuaaaucuguuu

SEQ ID NO: 1284568 - RNA, 23 nt, Homo sapiens
uugcuagagguagaguuugauca

SEQ ID NO: 1284569 - RNA, 23 nt, Homo sapiens
uugcugggagcuucucugcugcu

SEQ ID NO: 1284570 - RNA, 14 nt, Homo sapiens
uugcuguuuacucc

SEQ ID NO: 1284571 - RNA, 23 nt, Homo sapiens
uugcuuccugauuaccagucuga

SEQ ID NO: 1284572 - RNA, 21 nt, Homo sapiens
uugcuuguaaaauuucacuua

SEQ ID NO: 1284573 - RNA, 17 nt, Homo sapiens
uuggaaaaugugcaaua

SEQ ID NO: 1284574 - RNA, 21 nt, Homo sapiens
uuggacaacuagccucaucuc

SEQ ID NO: 1284575 - RNA, 21 nt, Homo sapiens
ugaucuuuguuuaaaugccaa

SEQ ID NO: 1284576 - RNA, 15 nt, Homo sapiens
ugaugccuuggucag

SEQ ID NO: 1284577 - RNA, 18 nt, Homo sapiens
ugauuaaauuaugaauga

SEQ ID NO: 1284578 - RNA, 15 nt, Homo sapiens
ugcaaacugcuuuau

SEQ ID NO: 1284579 - RNA, 13 nt, Homo sapiens
ugcaacauaacaa

SEQ ID NO: 1284580 - RNA, 21 nt, Homo sapiens
ugcaagacauagaauaguguu

SEQ ID NO: 1284581 - RNA, 18 nt, Homo sapiens
ugcaaggccgcuucgcca

SEQ ID NO: 1284582 - RNA, 19 nt, Homo sapiens
ugcaauaaaauuauuugca

SEQ ID NO: 1284583 - RNA, 19 nt, Homo sapiens
ugcacuacagcccuggccu

SEQ ID NO: 1284584 - RNA, 17 nt, Homo sapiens
ugcacuuauucucaaga

SEQ ID NO: 1284585 - RNA, 12 nt, Homo sapiens
ugcagagucaau

SEQ ID NO: 1284586 - RNA, 20 nt, Homo sapiens
ugcagggacuguaaaaccac

SEQ ID NO: 1284587 - RNA, 17 nt, Homo sapiens
ugcaggggccacaucca

SEQ ID NO: 1284588 - RNA, 16 nt, Homo sapiens
ugcaguguuaguauuc

SEQ ID NO: 1284589 - RNA, 16 nt, Homo sapiens
ugcaguuucauguaug

SEQ ID NO: 1284590 - RNA, 21 nt, Homo sapiens
ugcauaaacaauccaaaugca

SEQ ID NO: 1284591 - RNA, 19 nt, Homo sapiens
ugcauaaauaugcagugau

SEQ ID NO: 1284592 - RNA, 18 nt, Homo sapiens
ugcauaauaagcuaaaga

SEQ ID NO: 1284593 - RNA, 22 nt, Homo sapiens
ugcauaccuucgggguacaagu

SEQ ID NO: 1284594 - RNA, 19 nt, Homo sapiens
ugcauagagccacguaugu

SEQ ID NO: 1284595 - RNA, 13 nt, Homo sapiens
ugcauuugcacua

SEQ ID NO: 1284596 - RNA, 21 nt, Homo sapiens
ugcauuugugcccacucucca

SEQ ID NO: 1284597 - RNA, 15 nt, Homo sapiens
ugccacauacuugca

SEQ ID NO: 1284598 - RNA, 14 nt, Homo sapiens
ugccaccuggaccc

SEQ ID NO: 1284599 - RNA, 18 nt, Homo sapiens
ugccaccuuccucuccca

SEQ ID NO: 1284600 - RNA, 20 nt, Homo sapiens
ugcccagcggacaguggcag

SEQ ID NO: 1284601 - RNA, 14 nt, Homo sapiens
ugcccucagauucc

SEQ ID NO: 1284602 - RNA, 22 nt, Homo sapiens
ugcccuuggccugaagucccag

SEQ ID NO: 1284603 - RNA, 15 nt, Homo sapiens
ugccgcaccauugaa

SEQ ID NO: 1284604 - RNA, 19 nt, Homo sapiens
ugccugcaggcaugaguca

SEQ ID NO: 1284605 - RNA, 20 nt, Homo sapiens
ugccuuuccauaaucacuca

SEQ ID NO: 1284606 - RNA, 19 nt, Homo sapiens
ugcgcuacaaccgccagau

SEQ ID NO: 1284607 - RNA, 15 nt, Homo sapiens
auaagcuguuuuuau

SEQ ID NO: 1284608 - RNA, 20 nt, Homo sapiens
auaaguccuuguguagcaaa

SEQ ID NO: 1284609 - RNA, 16 nt, Homo sapiens
auaauaagcuaaagag

SEQ ID NO: 1284610 - RNA, 11 nt, Homo sapiens
auaaugaacac

SEQ ID NO: 1284611 - RNA, 13 nt, Homo sapiens
auacagugauaug

SEQ ID NO: 1284612 - RNA, 17 nt, Homo sapiens
auaccacacacauuauc

SEQ ID NO: 1284613 - RNA, 14 nt, Homo sapiens
auaccugagacugg

SEQ ID NO: 1284614 - RNA, 14 nt, Homo sapiens
auacucuucaagga

SEQ ID NO: 1284615 - RNA, 17 nt, Homo sapiens
auacucuucaaggacuu

SEQ ID NO: 1284616 - RNA, 17 nt, Homo sapiens
auacugaggcacacaga

SEQ ID NO: 1284617 - RNA, 23 nt, Homo sapiens
auacugcugcgucauuacagggc

SEQ ID NO: 1284618 - RNA, 20 nt, Homo sapiens
auagaauugugcuggucaua

SEQ ID NO: 1284619 - RNA, 15 nt, Homo sapiens
auagagccacguaug

SEQ ID NO: 1284620 - RNA, 16 nt, Homo sapiens
auagaggaacuugaaa

SEQ ID NO: 1284621 - RNA, 18 nt, Homo sapiens
auagaggugaugcugcua

SEQ ID NO: 1284622 - RNA, 22 nt, Homo sapiens
auaguauugugcauagagccac

SEQ ID NO: 1284623 - RNA, 18 nt, Homo sapiens
auagugcuucuuguaaua

SEQ ID NO: 1284624 - RNA, 15 nt, Homo sapiens
auauaaaaugcugau

SEQ ID NO: 1284625 - RNA, 15 nt, Homo sapiens
auauaaacacuauau

SEQ ID NO: 1284626 - RNA, 13 nt, Homo sapiens
auucacagcaagu

SEQ ID NO: 1284627 - RNA, 17 nt, Homo sapiens
auucagcggcagugugu

SEQ ID NO: 1284628 - RNA, 19 nt, Homo sapiens
auucaucucucuuuaauau

SEQ ID NO: 1284629 - RNA, 15 nt, Homo sapiens
auucaugaugaacuc

SEQ ID NO: 1284630 - RNA, 16 nt, Homo sapiens
auucaugaugaacuca

SEQ ID NO: 1284631 - RNA, 23 nt, Homo sapiens
auuccacacccucacugcuguag

SEQ ID NO: 1284632 - RNA, 16 nt, Homo sapiens
auuccacaucauguua

SEQ ID NO: 1284633 - RNA, 15 nt, Homo sapiens
auuccuaaugcauua

SEQ ID NO: 1284634 - RNA, 13 nt, Homo sapiens
auucuacacacag

SEQ ID NO: 1284635 - RNA, 18 nt, Homo sapiens
auucuagacccuauacau

SEQ ID NO: 1284636 - RNA, 19 nt, Homo sapiens
auucuauuacgugcaauac

SEQ ID NO: 1284637 - RNA, 18 nt, Homo sapiens
auucucaguauccacugu

SEQ ID NO: 1284638 - RNA, 18 nt, Homo sapiens
auucugaaauacuuuuga

SEQ ID NO: 1284639 - RNA, 16 nt, Homo sapiens
auucuguucuacuuga

SEQ ID NO: 1284640 - RNA, 20 nt, Homo sapiens
auucuuacaaacaugugguu

SEQ ID NO: 1284641 - RNA, 20 nt, Homo sapiens
auucuuccauuaaauugccu

SEQ ID NO: 1284642 - RNA, 16 nt, Homo sapiens
auucuuguuggcuuuu

SEQ ID NO: 1284643 - RNA, 14 nt, Homo sapiens
auucuuuguuacag

SEQ ID NO: 1284644 - RNA, 14 nt, Homo sapiens
auugaacuguacca

SEQ ID NO: 1284645 - RNA, 21 nt, Homo sapiens
auugaaucccuuaaacucagg

SEQ ID NO: 1284646 - RNA, 16 nt, Homo sapiens
auugagucuuccaggg

SEQ ID NO: 1284647 - RNA, 18 nt, Homo sapiens
auugauuucaacagaauc

SEQ ID NO: 1284648 - RNA, 18 nt, Homo sapiens
auugcuucagcugcugaa

SEQ ID NO: 1284649 - RNA, 12 nt, Homo sapiens
auuggaacugga

SEQ ID NO: 1284650 - RNA, 23 nt, Homo sapiens
auuggacuuaaaaucuaauucaa

SEQ ID NO: 1284651 - RNA, 15 nt, Homo sapiens
auuguaacuuaugaa

SEQ ID NO: 1284652 - RNA, 17 nt, Homo sapiens
auuguaacuuaugaacc

SEQ ID NO: 1284653 - RNA, 19 nt, Homo sapiens
auugucagcuacuaaugau

SEQ ID NO: 1284654 - RNA, 17 nt, Homo sapiens
auuguucugggugauuu

SEQ ID NO: 1284655 - RNA, 23 nt, Homo sapiens
auuguucuguuuguguuauuuca

SEQ ID NO: 1284656 - RNA, 20 nt, Homo sapiens
auuguuucaucccauguaca

SEQ ID NO: 1284657 - RNA, 20 nt, Homo sapiens
auuguuuuuguugucuuuau

SEQ ID NO: 1284658 - RNA, 13 nt, Homo sapiens
auuuaaagcacau

SEQ ID NO: 1284659 - RNA, 17 nt, Homo sapiens
auuuaaauagaacuuga

SEQ ID NO: 1284660 - RNA, 23 nt, Homo sapiens
auuuaagguacauggaacacacg

SEQ ID NO: 1284661 - RNA, 15 nt, Homo sapiens
auuuacauguuuaua

SEQ ID NO: 1284662 - RNA, 17 nt, Homo sapiens
auuuaccuucuaccucu

SEQ ID NO: 1284663 - RNA, 22 nt, Homo sapiens
auuuacugcucuagaaaguaua

SEQ ID NO: 1284664 - RNA, 20 nt, Homo sapiens
auuucuauguaugugccaau

SEQ ID NO: 1284665 - RNA, 13 nt, Homo sapiens
auuucucucugac

SEQ ID NO: 1284666 - RNA, 15 nt, Homo sapiens
auuucuuuauugcau

SEQ ID NO: 1284667 - RNA, 18 nt, Homo sapiens
auuuggcuuacaguaaau

SEQ ID NO: 1284668 - RNA, 12 nt, Homo sapiens
auuugguguaca

SEQ ID NO: 1284669 - RNA, 15 nt, Homo sapiens
auuuuaaaaauacau

SEQ ID NO: 1284670 - RNA, 14 nt, Homo sapiens
auuuuaauuugaua

SEQ ID NO: 1284671 - RNA, 21 nt, Homo sapiens
auuuuaguaagagauuccuga

SEQ ID NO: 1284672 - RNA, 12 nt, Homo sapiens
auuuucuuccaa

SEQ ID NO: 1284673 - RNA, 18 nt, Homo sapiens
auuuuuaaaacagauauu

SEQ ID NO: 1284674 - RNA, 16 nt, Homo sapiens
auuuuuaugugcaaua

SEQ ID NO: 1284675 - RNA, 23 nt, Homo sapiens
auuuuuccccaaaaagaauggga

SEQ ID NO: 1284676 - RNA, 22 nt, Homo sapiens
auuuuuguguauccaguaugca

SEQ ID NO: 1284677 - RNA, 19 nt, Homo sapiens
caaaacagauuacuagaaa

SEQ ID NO: 1284678 - RNA, 20 nt, Homo sapiens
caaaaggcccuuuucagggc

SEQ ID NO: 1284679 - RNA, 15 nt, Homo sapiens
caaaagggcuuccua

SEQ ID NO: 1284680 - RNA, 19 nt, Homo sapiens
caaaauccagaaguuuaaa

SEQ ID NO: 1284681 - RNA, 12 nt, Homo sapiens
caaacagaacua

SEQ ID NO: 1284682 - RNA, 11 nt, Homo sapiens
caaacagugaa

SEQ ID NO: 1284683 - RNA, 17 nt, Homo sapiens
caaacaugaaaacauug

SEQ ID NO: 1284684 - RNA, 18 nt, Homo sapiens
caaacccugugucacugu

SEQ ID NO: 1284685 - RNA, 21 nt, Homo sapiens
caaacuggugugugccucauu

SEQ ID NO: 1284686 - RNA, 19 nt, Homo sapiens
caaacuguaaaaaaugugu

SEQ ID NO: 1284687 - RNA, 18 nt, Homo sapiens
caaagagaauguauuucc

SEQ ID NO: 1284688 - RNA, 22 nt, Homo sapiens
caaagcccuuguccccaugaaa

SEQ ID NO: 1284689 - RNA, 11 nt, Homo sapiens
caaaggcaucu

SEQ ID NO: 1284690 - RNA, 14 nt, Homo sapiens
caaauaacagcuuu

SEQ ID NO: 1284691 - RNA, 15 nt, Homo sapiens
caaauaacagcuuuc

SEQ ID NO: 1284692 - RNA, 17 nt, Homo sapiens
caaauaacagcuuucuu

SEQ ID NO: 1284693 - RNA, 18 nt, Homo sapiens
caaauaaugucucuguga

SEQ ID NO: 1284694 - RNA, 20 nt, Homo sapiens
caaauauugguuaguauuua

SEQ ID NO: 1284695 - RNA, 22 nt, Homo sapiens
caaaucuucuugauccacuucu

SEQ ID NO: 1284696 - RNA, 18 nt, Homo sapiens
caaaugugucccagugaa

SEQ ID NO: 1284697 - RNA, 17 nt, Homo sapiens
caaauuucgagcauaag

SEQ ID NO: 1284698 - RNA, 14 nt, Homo sapiens
caacaagaaaagaa

SEQ ID NO: 1284699 - RNA, 16 nt, Homo sapiens
caacccgguucacucu

SEQ ID NO: 1284700 - RNA, 18 nt, Homo sapiens
caaccucauuuuaacuca

SEQ ID NO: 1284701 - RNA, 20 nt, Homo sapiens
caacucagguuuuggcauua

SEQ ID NO: 1284702 - RNA, 15 nt, Homo sapiens
caacucuguacaaag

SEQ ID NO: 1284703 - RNA, 15 nt, Homo sapiens
caacuuucauuugaa

SEQ ID NO: 1284704 - RNA, 11 nt, Homo sapiens
caagaaugaga

SEQ ID NO: 1284705 - RNA, 20 nt, Homo sapiens
caagcagggaagccccagug

SEQ ID NO: 1284706 - RNA, 20 nt, Homo sapiens
caagccuagcccuucucuca

SEQ ID NO: 1284707 - RNA, 18 nt, Homo sapiens
caagcuuaaagcuugauu

SEQ ID NO: 1284708 - RNA, 19 nt, Homo sapiens
caagcuuuucaaaauugga

SEQ ID NO: 1284709 - RNA, 16 nt, Homo sapiens
caaggcuggcagugac

SEQ ID NO: 1284710 - RNA, 14 nt, Homo sapiens
caagggaugucuca

SEQ ID NO: 1284711 - RNA, 19 nt, Homo sapiens
caagggggacugucuuuca

SEQ ID NO: 1284712 - RNA, 13 nt, Homo sapiens
caagguaacugua

SEQ ID NO: 1284713 - RNA, 14 nt, Homo sapiens
caagguaacuguac

SEQ ID NO: 1284714 - RNA, 23 nt, Homo sapiens
caagguaacuguacugggccaug

SEQ ID NO: 1284715 - RNA, 21 nt, Homo sapiens
cuccagggacagcaacuauca

SEQ ID NO: 1284716 - RNA, 22 nt, Homo sapiens
cuccauugguguugacauacau

SEQ ID NO: 1284717 - RNA, 20 nt, Homo sapiens
cucccaggcuggagugcagu

SEQ ID NO: 1284718 - RNA, 19 nt, Homo sapiens
cucccccacccaccucucu

SEQ ID NO: 1284719 - RNA, 15 nt, Homo sapiens
cucccccacucccuc

SEQ ID NO: 1284720 - RNA, 18 nt, Homo sapiens
cucccucuagaggcugcc

SEQ ID NO: 1284721 - RNA, 22 nt, Homo sapiens
cucccugggaggcgggcgcacu

SEQ ID NO: 1284722 - RNA, 23 nt, Homo sapiens
cuccuuccuggagcccagaggag

SEQ ID NO: 1284723 - RNA, 19 nt, Homo sapiens
cuccuuguggccuaugaaa

SEQ ID NO: 1284724 - RNA, 21 nt, Homo sapiens
cuccuuucuugcacuauucca

SEQ ID NO: 1284725 - RNA, 22 nt, Homo sapiens
cucgaggcggaucuuuggacag

SEQ ID NO: 1284726 - RNA, 22 nt, Homo sapiens
cucggugucuaugcaaggccgc

SEQ ID NO: 1284727 - RNA, 14 nt, Homo sapiens
cucuacagacucca

SEQ ID NO: 1284728 - RNA, 23 nt, Homo sapiens
cucuagucccuguguucugcaca

SEQ ID NO: 1284729 - RNA, 12 nt, Homo sapiens
cucuaucugcaa

SEQ ID NO: 1284730 - RNA, 20 nt, Homo sapiens
cucucaguugcagcccugcu

SEQ ID NO: 1284731 - RNA, 12 nt, Homo sapiens
cucuccaccuca

SEQ ID NO: 1284732 - RNA, 18 nt, Homo sapiens
cucuccccacugcucauu

SEQ ID NO: 1284733 - RNA, 23 nt, Homo sapiens
cucucgcaagggaaguccuugca

SEQ ID NO: 1284734 - RNA, 11 nt, Homo sapiens
cucucucauga

SEQ ID NO: 1284735 - RNA, 18 nt, Homo sapiens
cucuuaagagaacauuau

SEQ ID NO: 1284736 - RNA, 21 nt, Homo sapiens
cucuuaucucagucaugcaua

SEQ ID NO: 1284737 - RNA, 12 nt, Homo sapiens
cucuucaaggac

SEQ ID NO: 1284738 - RNA, 14 nt, Homo sapiens
cucuucaaggacuu

SEQ ID NO: 1284739 - RNA, 14 nt, Homo sapiens
cucuucucagccac

SEQ ID NO: 1284740 - RNA, 14 nt, Homo sapiens
cucuucucauuuca

SEQ ID NO: 1284741 - RNA, 15 nt, Homo sapiens
cucuucucauuucac

SEQ ID NO: 1284742 - RNA, 12 nt, Homo sapiens
cucuuuaccucc

SEQ ID NO: 1284743 - RNA, 23 nt, Homo sapiens
cucuuuaccuguucaaaauucca

SEQ ID NO: 1284744 - RNA, 18 nt, Homo sapiens
cucuuuugaauccaugcu

SEQ ID NO: 1284745 - RNA, 13 nt, Homo sapiens
cugaaaaucaaua

SEQ ID NO: 1284746 - RNA, 14 nt, Homo sapiens
cugaacauugcacu

SEQ ID NO: 1284747 - RNA, 17 nt, Homo sapiens
cugaauaaaugaaugca

SEQ ID NO: 1284748 - RNA, 15 nt, Homo sapiens
cugaaugagacuuaa

SEQ ID NO: 1284749 - RNA, 17 nt, Homo sapiens
cugaccucgugauccac

SEQ ID NO: 1284750 - RNA, 15 nt, Homo sapiens
cugacuucuccuagc

SEQ ID NO: 1284751 - RNA, 13 nt, Homo sapiens
cugacuugaacuc

SEQ ID NO: 1284752 - RNA, 20 nt, Homo sapiens
cugagacuugaaucaaguca

SEQ ID NO: 1284753 - RNA, 19 nt, Homo sapiens
cugaguuguugagucuguu

SEQ ID NO: 1284754 - RNA, 22 nt, Homo sapiens
cugcaagcuuuucaaaauugga

SEQ ID NO: 1284755 - RNA, 16 nt, Homo sapiens
cugcauuccuagaaau

SEQ ID NO: 1284756 - RNA, 20 nt, Homo sapiens
cugccaacacgcccggcuaa

SEQ ID NO: 1284757 - RNA, 20 nt, Homo sapiens
cugccucagguguccgcuau

SEQ ID NO: 1284758 - RNA, 15 nt, Homo sapiens
cugcuaauaauaaau

SEQ ID NO: 1284759 - RNA, 19 nt, Homo sapiens
cugcuggggaucuagggaa

SEQ ID NO: 1284760 - RNA, 18 nt, Homo sapiens
cugcuuuuuuucagggaa

SEQ ID NO: 1284761 - RNA, 12 nt, Homo sapiens
cuggacacagag

SEQ ID NO: 1284762 - RNA, 18 nt, Homo sapiens
cuggacacagccccaugu

SEQ ID NO: 1284763 - RNA, 21 nt, Homo sapiens
cuggagucgggacuaacccag

SEQ ID NO: 1284764 - RNA, 20 nt, Homo sapiens
cuggcagcaucuucacuucu

SEQ ID NO: 1284765 - RNA, 17 nt, Homo sapiens
cuggcccugugccuugg

SEQ ID NO: 1284766 - RNA, 17 nt, Homo sapiens
cuggccuugggcccucu

SEQ ID NO: 1284767 - RNA, 18 nt, Homo sapiens
cuggcuuuguucuuguca

SEQ ID NO: 1284768 - RNA, 20 nt, Homo sapiens
cugggagcacaggcacugca

SEQ ID NO: 1284769 - RNA, 13 nt, Homo sapiens
cugggcugaggca

SEQ ID NO: 1284770 - RNA, 17 nt, Homo sapiens
cuggggaagagguuuua

SEQ ID NO: 1284771 - RNA, 15 nt, Homo sapiens
cuggggaucuaggga

SEQ ID NO: 1284772 - RNA, 19 nt, Homo sapiens
cuggggaugucucucauga

SEQ ID NO: 1284773 - RNA, 18 nt, Homo sapiens
cuggggauuaccauucag

SEQ ID NO: 1284774 - RNA, 15 nt, Homo sapiens
cugguaacauagguu

SEQ ID NO: 1284775 - RNA, 15 nt, Homo sapiens
cugguauuuccuggc

SEQ ID NO: 1284776 - RNA, 13 nt, Homo sapiens
cuguaccaugugc

SEQ ID NO: 1284777 - RNA, 21 nt, Homo sapiens
cuguacugggccauguugugc

SEQ ID NO: 1284778 - RNA, 18 nt, Homo sapiens
cuguagcaauuggauaga

SEQ ID NO: 1284779 - RNA, 17 nt, Homo sapiens
cuguauauagcucuaca

SEQ ID NO: 1284780 - RNA, 18 nt, Homo sapiens
cugucauauaauuuugaa

SEQ ID NO: 1284781 - RNA, 20 nt, Homo sapiens
cuguccccacagcuucucua

SEQ ID NO: 1284782 - RNA, 17 nt, Homo sapiens
cuguccccuucucucau

SEQ ID NO: 1284783 - RNA, 18 nt, Homo sapiens
cuguccugaaagccacag

SEQ ID NO: 1284784 - RNA, 16 nt, Homo sapiens
cugugcacccagaaga

SEQ ID NO: 1284785 - RNA, 14 nt, Homo sapiens
cugugcccucagau

SEQ ID NO: 1284786 - RNA, 17 nt, Homo sapiens
cuguguccgcuuucaug

SEQ ID NO: 1284787 - RNA, 23 nt, Homo sapiens
cuguguggaguggacacccugac

SEQ ID NO: 1284788 - RNA, 13 nt, Homo sapiens
cuguuaccagagg

SEQ ID NO: 1284789 - RNA, 13 nt, Homo sapiens
cuguuccuuauga

SEQ ID NO: 1284790 - RNA, 17 nt, Homo sapiens
cuguuccuuaugauauu

SEQ ID NO: 1284791 - RNA, 17 nt, Homo sapiens
cuuaaaaucuaauucaa

SEQ ID NO: 1284792 - RNA, 14 nt, Homo sapiens
cuuaaaaugcaaua

SEQ ID NO: 1284793 - RNA, 13 nt, Homo sapiens
cuuaaaauuguau

SEQ ID NO: 1284794 - RNA, 13 nt, Homo sapiens
cuuaaagcuugau

SEQ ID NO: 1284795 - RNA, 12 nt, Homo sapiens
cuuaaguguaaa

SEQ ID NO: 1284796 - RNA, 16 nt, Homo sapiens
cuuaaguuuaccaaau

SEQ ID NO: 1284797 - RNA, 14 nt, Homo sapiens
cuuaauaaugugua

SEQ ID NO: 1284798 - RNA, 21 nt, Homo sapiens
cuuaaugauccguuccauugc

SEQ ID NO: 1284799 - RNA, 22 nt, Homo sapiens
ucaaaggugauugugccaggcu

SEQ ID NO: 1284800 - RNA, 22 nt, Homo sapiens
ucaagcagggaagccccaguga

SEQ ID NO: 1284801 - RNA, 22 nt, Homo sapiens
ucaagccuagcccuucucucau

SEQ ID NO: 1284802 - RNA, 23 nt, Homo sapiens
ucaaguagaacaaaaacuauuau

SEQ ID NO: 1284803 - RNA, 21 nt, Homo sapiens
ucaauucuauuacgugcaaua

SEQ ID NO: 1284804 - RNA, 20 nt, Homo sapiens
ucacagcaagucacuggcca

SEQ ID NO: 1284805 - RNA, 15 nt, Homo sapiens
ucacagguugaccaa

SEQ ID NO: 1284806 - RNA, 22 nt, Homo sapiens
ucaccaggauuuauacauacag

SEQ ID NO: 1284807 - RNA, 16 nt, Homo sapiens
ucacugcuguagacau

SEQ ID NO: 1284808 - RNA, 21 nt, Homo sapiens
ucacuuaauaauguguacauu

SEQ ID NO: 1284809 - RNA, 12 nt, Homo sapiens
ucagauuugccu

SEQ ID NO: 1284810 - RNA, 13 nt, Homo sapiens
ucagcaugagauu

SEQ ID NO: 1284811 - RNA, 12 nt, Homo sapiens
ucagcugcugaa

SEQ ID NO: 1284812 - RNA, 22 nt, Homo sapiens
ucagcugcuucuuuggucaucc

SEQ ID NO: 1284813 - RNA, 19 nt, Homo sapiens
ucaggaggaaggcuuacac

SEQ ID NO: 1284814 - RNA, 11 nt, Homo sapiens
ucaggcagcuc

SEQ ID NO: 1284815 - RNA, 12 nt, Homo sapiens
ucaggugacaug

SEQ ID NO: 1284816 - RNA, 12 nt, Homo sapiens
ucaguauccacu

SEQ ID NO: 1284817 - RNA, 19 nt, Homo sapiens
ucaguauuuuccagccuua

SEQ ID NO: 1284818 - RNA, 18 nt, Homo sapiens
ucagucuuuaaucugaga

SEQ ID NO: 1284819 - RNA, 12 nt, Homo sapiens
ucagugagaaaa

SEQ ID NO: 1284820 - RNA, 22 nt, Homo sapiens
ucaguuugcaguauacacacuu

SEQ ID NO: 1284821 - RNA, 19 nt, Homo sapiens
ucaguuuuuuuuuuuccag

SEQ ID NO: 1284822 - RNA, 15 nt, Homo sapiens
ucauaaucacaaccc

SEQ ID NO: 1284823 - RNA, 13 nt, Homo sapiens
ucauccugcaggc

SEQ ID NO: 1284824 - RNA, 20 nt, Homo sapiens
ucaugacugagucuggcaaa

SEQ ID NO: 1284825 - RNA, 18 nt, Homo sapiens
ucaugcaaacugcuuuau

SEQ ID NO: 1284826 - RNA, 15 nt, Homo sapiens
ucaugcucauguaua

SEQ ID NO: 1284827 - RNA, 19 nt, Homo sapiens
ucauuacagggcacaggcc

SEQ ID NO: 1284828 - RNA, 18 nt, Homo sapiens
ucauucacaaaguauaac

SEQ ID NO: 1284829 - RNA, 12 nt, Homo sapiens
ucauucucagua

SEQ ID NO: 1284830 - RNA, 19 nt, Homo sapiens
ucauucucaguauccacug

SEQ ID NO: 1284831 - RNA, 22 nt, Homo sapiens
ucauucucaguauccacugucu

SEQ ID NO: 1284832 - RNA, 12 nt, Homo sapiens
uccaaaagcaaa

SEQ ID NO: 1284833 - RNA, 14 nt, Homo sapiens
uccaaaccuucaca

SEQ ID NO: 1284834 - RNA, 22 nt, Homo sapiens
uccaaaccuucacacacagacu

SEQ ID NO: 1284835 - RNA, 14 nt, Homo sapiens
uccaaauacucuga

SEQ ID NO: 1284836 - RNA, 17 nt, Homo sapiens
uccaaaugcugugcaaa

SEQ ID NO: 1284837 - RNA, 17 nt, Homo sapiens
uccaacauuaaaagcca

SEQ ID NO: 1284838 - RNA, 16 nt, Homo sapiens
uuccccggaguaccua

SEQ ID NO: 1284839 - RNA, 13 nt, Homo sapiens
uuccccugcaaug

SEQ ID NO: 1284840 - RNA, 13 nt, Homo sapiens
uucccuccaguga

SEQ ID NO: 1284841 - RNA, 13 nt, Homo sapiens
uuccgcaccaaua

SEQ ID NO: 1284842 - RNA, 13 nt, Homo sapiens
uuccgcagugugg

SEQ ID NO: 1284843 - RNA, 21 nt, Homo sapiens
uuccggccuccugucccucau

SEQ ID NO: 1284844 - RNA, 21 nt, Homo sapiens
uuccuaaaagagaauggaaaa

SEQ ID NO: 1284845 - RNA, 17 nt, Homo sapiens
uuccuacccuuccucac

SEQ ID NO: 1284846 - RNA, 16 nt, Homo sapiens
uuccuguuugcuggga

SEQ ID NO: 1284847 - RNA, 20 nt, Homo sapiens
uuccuguuugcugggagcuu

SEQ ID NO: 1284848 - RNA, 17 nt, Homo sapiens
uucggauuuggggugga

SEQ ID NO: 1284849 - RNA, 15 nt, Homo sapiens
uucucaaaguuuuga

SEQ ID NO: 1284850 - RNA, 17 nt, Homo sapiens
uucucuacagacuccaa

SEQ ID NO: 1284851 - RNA, 19 nt, Homo sapiens
uucucuacagacuccaaaa

SEQ ID NO: 1284852 - RNA, 22 nt, Homo sapiens
uucucugccuugguauagcaua

SEQ ID NO: 1284853 - RNA, 17 nt, Homo sapiens
uucugaagccucacuua

SEQ ID NO: 1284854 - RNA, 17 nt, Homo sapiens
uucugcaggcuguaugg

SEQ ID NO: 1284855 - RNA, 21 nt, Homo sapiens
uucuuaaacaaauguaugauu

SEQ ID NO: 1284856 - RNA, 13 nt, Homo sapiens
uucuuacaaacau

SEQ ID NO: 1284857 - RNA, 16 nt, Homo sapiens
uucuuacaaacaugug

SEQ ID NO: 1284858 - RNA, 12 nt, Homo sapiens
uucuucuauggg

SEQ ID NO: 1284859 - RNA, 14 nt, Homo sapiens
uucuugguuccaau

SEQ ID NO: 1284860 - RNA, 19 nt, Homo sapiens
uucuuuauauaaggucaua

SEQ ID NO: 1284861 - RNA, 15 nt, Homo sapiens
uugaaaccuuugaca

SEQ ID NO: 1284862 - RNA, 22 nt, Homo sapiens
uugaacuguaccaugugcuaca

SEQ ID NO: 1284863 - RNA, 21 nt, Homo sapiens
uugaaguaggaaguaggaaau

SEQ ID NO: 1284864 - RNA, 16 nt, Homo sapiens
uugaauauaaacacua

SEQ ID NO: 1284865 - RNA, 15 nt, Homo sapiens
uugacagaacacugu

SEQ ID NO: 1284866 - RNA, 16 nt, Homo sapiens
uugaucaaccaaaaac

SEQ ID NO: 1284867 - RNA, 21 nt, Homo sapiens
uugauucuagaugaucaacau

SEQ ID NO: 1284868 - RNA, 16 nt, Homo sapiens
uugcaaccccaucauc

SEQ ID NO: 1284869 - RNA, 12 nt, Homo sapiens
uugcacauucua

SEQ ID NO: 1284870 - RNA, 15 nt, Homo sapiens
uugcaccaacuuuga

SEQ ID NO: 1284871 - RNA, 13 nt, Homo sapiens
uugcaguauacac

SEQ ID NO: 1284872 - RNA, 23 nt, Homo sapiens
uugcauugaauuuagucauuauu

SEQ ID NO: 1284873 - RNA, 13 nt, Homo sapiens
uugccauguggac

SEQ ID NO: 1284874 - RNA, 22 nt, Homo sapiens
uugccauuuagcgaacaaccac

SEQ ID NO: 1284875 - RNA, 14 nt, Homo sapiens
uugccuaaacccua

SEQ ID NO: 1284876 - RNA, 23 nt, Homo sapiens
uugcgcaaacuuuaacagguuuu

SEQ ID NO: 1284877 - RNA, 18 nt, Homo sapiens
uugcugaaugucauuauu

SEQ ID NO: 1284878 - RNA, 19 nt, Homo sapiens
uugcuguuccuuacuuuac

SEQ ID NO: 1284879 - RNA, 17 nt, Homo sapiens
uugcuucagcugcugaa

SEQ ID NO: 1284880 - RNA, 14 nt, Homo sapiens
uuggacaaccucau

SEQ ID NO: 1284881 - RNA, 17 nt, Homo sapiens
uuggacagaagcagcuc

SEQ ID NO: 1284882 - RNA, 16 nt, Homo sapiens
uuggaugcacuuuaua

SEQ ID NO: 1284883 - RNA, 17 nt, Homo sapiens
uuggcucacacugagaa

SEQ ID NO: 1284884 - RNA, 16 nt, Homo sapiens
uuggcucacaguucug

SEQ ID NO: 1284885 - RNA, 11 nt, Homo sapiens
uuggggguccu

SEQ ID NO: 1284886 - RNA, 23 nt, Homo sapiens
uuggggguccuccuccagggaca

SEQ ID NO: 1284887 - RNA, 21 nt, Homo sapiens
uugguacuagauacugaaugu

SEQ ID NO: 1284888 - RNA, 21 nt, Homo sapiens
uuguaaaguauuuaagguaca

SEQ ID NO: 1284889 - RNA, 22 nt, Homo sapiens
uuguaagaaauauauuugauaa

SEQ ID NO: 1284890 - RNA, 18 nt, Homo sapiens
uuguaagguggucacugu

SEQ ID NO: 1284891 - RNA, 17 nt, Homo sapiens
uuguaaguuuaugcaua

SEQ ID NO: 1284892 - RNA, 14 nt, Homo sapiens
uuguagacuguucc

SEQ ID NO: 1284893 - RNA, 15 nt, Homo sapiens
uuguauugcauauau

SEQ ID NO: 1284894 - RNA, 19 nt, Homo sapiens
uugucccaaguuccacugc

SEQ ID NO: 1284895 - RNA, 13 nt, Homo sapiens
uuguuucuugaua

SEQ ID NO: 1284896 - RNA, 16 nt, Homo sapiens
uuguuugcugucugau

SEQ ID NO: 1284897 - RNA, 21 nt, Homo sapiens
uuuaaaaauaaagcuacugaa

SEQ ID NO: 1284898 - RNA, 14 nt, Homo sapiens
uuuaaacaguuuag

SEQ ID NO: 1284899 - RNA, 23 nt, Homo sapiens
uuuaaagaaaaugugucugcaac

SEQ ID NO: 1284900 - RNA, 15 nt, Homo sapiens
uuuaagugacauaau

SEQ ID NO: 1284901 - RNA, 23 nt, Homo sapiens
uccaaccccccagcacugaggaa

SEQ ID NO: 1284902 - RNA, 17 nt, Homo sapiens
uccacacccucacugcu

SEQ ID NO: 1284903 - RNA, 19 nt, Homo sapiens
uccacagggauaccuuaau

SEQ ID NO: 1284904 - RNA, 17 nt, Homo sapiens
uccagaccauucaggac

SEQ ID NO: 1284905 - RNA, 20 nt, Homo sapiens
uccagaugagaguacacccc

SEQ ID NO: 1284906 - RNA, 14 nt, Homo sapiens
uccaggauguggaa

SEQ ID NO: 1284907 - RNA, 19 nt, Homo sapiens
uccagggcuggacugaggc

SEQ ID NO: 1284908 - RNA, 14 nt, Homo sapiens
uccagguucacuga

SEQ ID NO: 1284909 - RNA, 17 nt, Homo sapiens
uccaucccacauaaaua

SEQ ID NO: 1284910 - RNA, 14 nt, Homo sapiens
uccaucucagucac

SEQ ID NO: 1284911 - RNA, 16 nt, Homo sapiens
uccauuaaauugccuu

SEQ ID NO: 1284912 - RNA, 13 nt, Homo sapiens
ucccacuuggcau

SEQ ID NO: 1284913 - RNA, 20 nt, Homo sapiens
ucccacuuugcuguuccuua

SEQ ID NO: 1284914 - RNA, 17 nt, Homo sapiens
ucccaggaguacacccc

SEQ ID NO: 1284915 - RNA, 23 nt, Homo sapiens
ucccaggaguacaccccaacagc

SEQ ID NO: 1284916 - RNA, 16 nt, Homo sapiens
ucccauucuauguguc

SEQ ID NO: 1284917 - RNA, 13 nt, Homo sapiens
uccccucaaccca

SEQ ID NO: 1284918 - RNA, 12 nt, Homo sapiens
uccccugcaaug

SEQ ID NO: 1284919 - RNA, 20 nt, Homo sapiens
uccccuucucucaucucuua

SEQ ID NO: 1284920 - RNA, 19 nt, Homo sapiens
ucccucacagcaaagcaac

SEQ ID NO: 1284921 - RNA, 19 nt, Homo sapiens
ucccucaggccgaaggagg

SEQ ID NO: 1284922 - RNA, 17 nt, Homo sapiens
ucccucauucugcauua

SEQ ID NO: 1284923 - RNA, 13 nt, Homo sapiens
ucccucuguguca

SEQ ID NO: 1284924 - RNA, 21 nt, Homo sapiens
ucccucugugucacuguaugu

SEQ ID NO: 1284925 - RNA, 18 nt, Homo sapiens
ucccuuacccuccuccag

SEQ ID NO: 1284926 - RNA, 14 nt, Homo sapiens
uccgccuguaaaau

SEQ ID NO: 1284927 - RNA, 15 nt, Homo sapiens
uccuauaugcacuua

SEQ ID NO: 1284928 - RNA, 22 nt, Homo sapiens
uccucaaagggagagagugcua

SEQ ID NO: 1284929 - RNA, 17 nt, Homo sapiens
uccucaggugaccaaaa

SEQ ID NO: 1284930 - RNA, 19 nt, Homo sapiens
uccuccuccagggacagca

SEQ ID NO: 1284931 - RNA, 19 nt, Homo sapiens
uccugaccucgugauccac

SEQ ID NO: 1284932 - RNA, 20 nt, Homo sapiens
uccugagggauuucuaacca

SEQ ID NO: 1284933 - RNA, 16 nt, Homo sapiens
uccugcauguguauau

SEQ ID NO: 1284934 - RNA, 16 nt, Homo sapiens
uccugccccaugcugc

SEQ ID NO: 1284935 - RNA, 13 nt, Homo sapiens
uccugucccucau

SEQ ID NO: 1284936 - RNA, 18 nt, Homo sapiens
uccuguuuguaucauagc

SEQ ID NO: 1284937 - RNA, 15 nt, Homo sapiens
uccuuacuuuacugc

SEQ ID NO: 1284938 - RNA, 18 nt, Homo sapiens
uccuuaugauauucucau

SEQ ID NO: 1284939 - RNA, 18 nt, Homo sapiens
uccuucaagccuagcccu

SEQ ID NO: 1284940 - RNA, 22 nt, Homo sapiens
uccuuguuuucuaacuuuauga

SEQ ID NO: 1284941 - RNA, 21 nt, Homo sapiens
uccuuuccccucccucaggcc

SEQ ID NO: 1284942 - RNA, 22 nt, Homo sapiens
ucgaauacuggggauuaccauu

SEQ ID NO: 1284943 - RNA, 23 nt, Homo sapiens
ucggacucuuccagguucacuga

SEQ ID NO: 1284944 - RNA, 20 nt, Homo sapiens
ucggucaccuguuggcuaca

SEQ ID NO: 1284945 - RNA, 18 nt, Homo sapiens
ucguguaauuggcccaag

SEQ ID NO: 1284946 - RNA, 14 nt, Homo sapiens
ucgugucagcucag

SEQ ID NO: 1284947 - RNA, 18 nt, Homo sapiens
ucuaaauugaucauucau

SEQ ID NO: 1284948 - RNA, 14 nt, Homo sapiens
ucuaagggaccuca

SEQ ID NO: 1284949 - RNA, 16 nt, Homo sapiens
ucuacagacuccaaaa

SEQ ID NO: 1284950 - RNA, 16 nt, Homo sapiens
ucuauuacgugcaaua

SEQ ID NO: 1284951 - RNA, 22 nt, Homo sapiens
ucucaagaagaacaucuuuaug

SEQ ID NO: 1284952 - RNA, 17 nt, Homo sapiens
ucucaugaccaaaugcu

SEQ ID NO: 1284953 - RNA, 11 nt, Homo sapiens
ucucauucccu

SEQ ID NO: 1284954 - RNA, 22 nt, Homo sapiens
ucuccaaggguggugaccaaug

SEQ ID NO: 1284955 - RNA, 13 nt, Homo sapiens
ucuccagccucag

SEQ ID NO: 1284956 - RNA, 14 nt, Homo sapiens
ucucccugugcugu

SEQ ID NO: 1284957 - RNA, 18 nt, Homo sapiens
ucucuacagacuccaaaa

SEQ ID NO: 1284958 - RNA, 19 nt, Homo sapiens
ucucugucagugugaaaau

SEQ ID NO: 1284959 - RNA, 15 nt, Homo sapiens
ucucuuuaccuccua

SEQ ID NO: 1284960 - RNA, 22 nt, Homo sapiens
ucugaaagucaugcacauaccu

SEQ ID NO: 1284961 - RNA, 17 nt, Homo sapiens
ucugaauuuuaaaacau

SEQ ID NO: 1284962 - RNA, 23 nt, Homo sapiens
ucugagcagugcuugaaugaagu

SEQ ID NO: 1284963 - RNA, 14 nt, Homo sapiens
ucugaggacauucc

SEQ ID NO: 1284964 - RNA, 23 nt, Homo sapiens
ucugauguuuuauuugcacuugu

SEQ ID NO: 1284965 - RNA, 18 nt, Homo sapiens
ucugcaucuuacagucag

SEQ ID NO: 1284966 - RNA, 16 nt, Homo sapiens
ucugcaugaaaggcga

SEQ ID NO: 1284967 - RNA, 18 nt, Homo sapiens
ucugccuugguauagcau

SEQ ID NO: 1284968 - RNA, 11 nt, Homo sapiens
ucuggacacag

SEQ ID NO: 1284969 - RNA, 16 nt, Homo sapiens
ucuggaucuccugacc

SEQ ID NO: 1284970 - RNA, 14 nt, Homo sapiens
ucugggccagguug

SEQ ID NO: 1284971 - RNA, 22 nt, Homo sapiens
cacccuccccugggcccaucuc

SEQ ID NO: 1284972 - RNA, 21 nt, Homo sapiens
caccuaauguuuaugagccag

SEQ ID NO: 1284973 - RNA, 23 nt, Homo sapiens
caccucacuagcuccccaauccc

SEQ ID NO: 1284974 - RNA, 17 nt, Homo sapiens
cacggcucucaccagug

SEQ ID NO: 1284975 - RNA, 12 nt, Homo sapiens
cacguguaugca

SEQ ID NO: 1284976 - RNA, 21 nt, Homo sapiens
cacguguuuuccaucccacau

SEQ ID NO: 1284977 - RNA, 11 nt, Homo sapiens
cacuaucccau

SEQ ID NO: 1284978 - RNA, 18 nt, Homo sapiens
cacuaucccauuugcccu

SEQ ID NO: 1284979 - RNA, 22 nt, Homo sapiens
cacucagcugcuucuuugguca

SEQ ID NO: 1284980 - RNA, 21 nt, Homo sapiens
cacuccuuucuugcacuauuc

SEQ ID NO: 1284981 - RNA, 21 nt, Homo sapiens
cacugaaacagccagaucuca

SEQ ID NO: 1284982 - RNA, 16 nt, Homo sapiens
cacugaaggaacaguu

SEQ ID NO: 1284983 - RNA, 21 nt, Homo sapiens
cacugcucauuuggaucccag

SEQ ID NO: 1284984 - RNA, 12 nt, Homo sapiens
cacuuaccuuau

SEQ ID NO: 1284985 - RNA, 12 nt, Homo sapiens
cacuucacuuuu

SEQ ID NO: 1284986 - RNA, 20 nt, Homo sapiens
cacuuccugcugcgaaagac

SEQ ID NO: 1284987 - RNA, 16 nt, Homo sapiens
cacuucuaaaugcaua

SEQ ID NO: 1284988 - RNA, 14 nt, Homo sapiens
cacuucucucagga

SEQ ID NO: 1284989 - RNA, 15 nt, Homo sapiens
cacuucucucaggau

SEQ ID NO: 1284990 - RNA, 16 nt, Homo sapiens
cacuugaagaugcugc

SEQ ID NO: 1284991 - RNA, 14 nt, Homo sapiens
cacuugcagccucc

SEQ ID NO: 1284992 - RNA, 16 nt, Homo sapiens
cagaacaaacccugug

SEQ ID NO: 1284993 - RNA, 17 nt, Homo sapiens
cagaacaagaagcuuau

SEQ ID NO: 1284994 - RNA, 15 nt, Homo sapiens
cagaacacacugaga

SEQ ID NO: 1284995 - RNA, 22 nt, Homo sapiens
cagaacacugucuugaagacaa

SEQ ID NO: 1284996 - RNA, 19 nt, Homo sapiens
cagaacagcuucagguuau

SEQ ID NO: 1284997 - RNA, 17 nt, Homo sapiens
cagaacuggaccaucuc

SEQ ID NO: 1284998 - RNA, 15 nt, Homo sapiens
cagaaggggguggug

SEQ ID NO: 1284999 - RNA, 15 nt, Homo sapiens
cagaaucagaucuga

SEQ ID NO: 1285000 - RNA, 17 nt, Homo sapiens
cagaaucuguuaccaga

SEQ ID NO: 1285001 - RNA, 19 nt, Homo sapiens
cagaaucuguuaccagagg

SEQ ID NO: 1285002 - RNA, 16 nt, Homo sapiens
cagaaugagaaagccu

SEQ ID NO: 1285003 - RNA, 11 nt, Homo sapiens
cagaauggagg

SEQ ID NO: 1285004 - RNA, 12 nt, Homo sapiens
cagacaaaugga

SEQ ID NO: 1285005 - RNA, 15 nt, Homo sapiens
cagaccauucaggac

SEQ ID NO: 1285006 - RNA, 16 nt, Homo sapiens
cagaccauucaggaca

SEQ ID NO: 1285007 - RNA, 14 nt, Homo sapiens
cagacuccaaaagg

SEQ ID NO: 1285008 - RNA, 15 nt, Homo sapiens
cagacuccaaaaggc

SEQ ID NO: 1285009 - RNA, 16 nt, Homo sapiens
cagagaaaagacauaa

SEQ ID NO: 1285010 - RNA, 22 nt, Homo sapiens
cagagacgcagacaugugcacu

SEQ ID NO: 1285011 - RNA, 22 nt, Homo sapiens
cagagcagaugcagagagccau

SEQ ID NO: 1285012 - RNA, 20 nt, Homo sapiens
cagaggcauccggaucccag

SEQ ID NO: 1285013 - RNA, 17 nt, Homo sapiens
cagaggcuuaaucacac

SEQ ID NO: 1285014 - RNA, 14 nt, Homo sapiens
cagaucucaugaga

SEQ ID NO: 1285015 - RNA, 13 nt, Homo sapiens
cagaugucccuga

SEQ ID NO: 1285016 - RNA, 18 nt, Homo sapiens
cagauuacuagaaauauu

SEQ ID NO: 1285017 - RNA, 18 nt, Homo sapiens
cagauuccgcaccaauaa

SEQ ID NO: 1285018 - RNA, 13 nt, Homo sapiens
cagcaaagcaaca

SEQ ID NO: 1285019 - RNA, 19 nt, Homo sapiens
cagcaaagugucaguguug

SEQ ID NO: 1285020 - RNA, 13 nt, Homo sapiens
cagcaagucucuu

SEQ ID NO: 1285021 - RNA, 15 nt, Homo sapiens
cagcacccaugggaa

SEQ ID NO: 1285022 - RNA, 16 nt, Homo sapiens
cagcagcacgauccag

SEQ ID NO: 1285023 - RNA, 18 nt, Homo sapiens
cagcagcaucucugaaca

SEQ ID NO: 1285024 - RNA, 13 nt, Homo sapiens
cagccagaucuca

SEQ ID NO: 1285025 - RNA, 18 nt, Homo sapiens
cagcccgggucaucugua

SEQ ID NO: 1285026 - RNA, 13 nt, Homo sapiens
cagcuaaguugca

SEQ ID NO: 1285027 - RNA, 18 nt, Homo sapiens
cagcucucaguugcagcc

SEQ ID NO: 1285028 - RNA, 14 nt, Homo sapiens
cagcugacacaucu

SEQ ID NO: 1285029 - RNA, 14 nt, Homo sapiens
cagcuucucuacag

SEQ ID NO: 1285030 - RNA, 20 nt, Homo sapiens
cagcuucucuacagacucca

SEQ ID NO: 1285031 - RNA, 14 nt, Homo sapiens
caggaacuugcaca

SEQ ID NO: 1285032 - RNA, 16 nt, Homo sapiens
caggacccugggacca

SEQ ID NO: 1285033 - RNA, 16 nt, Homo sapiens
caggagccuaguacaa

SEQ ID NO: 1285034 - RNA, 20 nt, Homo sapiens
caggagcuuuacucauggca

SEQ ID NO: 1285035 - RNA, 13 nt, Homo sapiens
caggaguacaccc

SEQ ID NO: 1285036 - RNA, 12 nt, Homo sapiens
caggcaccugcc

SEQ ID NO: 1285037 - RNA, 20 nt, Homo sapiens
caggcagcuuuuucucuccc

SEQ ID NO: 1285038 - RNA, 19 nt, Homo sapiens
caggcaugagucagucuga

SEQ ID NO: 1285039 - RNA, 17 nt, Homo sapiens
caggccauggauggaaa

SEQ ID NO: 1285040 - RNA, 16 nt, Homo sapiens
caggcuggagugcagu

SEQ ID NO: 1285041 - RNA, 16 nt, Homo sapiens
caggcuguaugggaag

SEQ ID NO: 1285042 - RNA, 20 nt, Homo sapiens
cagggauucuuccugcuuag

SEQ ID NO: 1285043 - RNA, 22 nt, Homo sapiens
cagggccacguuaccacagacc

SEQ ID NO: 1285044 - RNA, 19 nt, Homo sapiens
cagggcugaggccucucau

SEQ ID NO: 1285045 - RNA, 15 nt, Homo sapiens
caggggccacaucca

SEQ ID NO: 1285046 - RNA, 15 nt, Homo sapiens
caggucuuuaaauca

SEQ ID NO: 1285047 - RNA, 21 nt, Homo sapiens
cagguguucuucauuaccuca

SEQ ID NO: 1285048 - RNA, 21 nt, Homo sapiens
caguaauuuuaaguaauuuca

SEQ ID NO: 1285049 - RNA, 14 nt, Homo sapiens
caguaccuccugcc

SEQ ID NO: 1285050 - RNA, 23 nt, Homo sapiens
cagugacagaacuaagaugauca

SEQ ID NO: 1285051 - RNA, 17 nt, Homo sapiens
cagugagaagccagcuu

SEQ ID NO: 1285052 - RNA, 13 nt, Homo sapiens
caguggaagggaa

SEQ ID NO: 1285053 - RNA, 21 nt, Homo sapiens
caguggaagggaaaagcccau

SEQ ID NO: 1285054 - RNA, 15 nt, Homo sapiens
cagugggaccaauga

SEQ ID NO: 1285055 - RNA, 19 nt, Homo sapiens
caguguuuguauaccauga

SEQ ID NO: 1285056 - RNA, 15 nt, Homo sapiens
caguuccaaaagaga

SEQ ID NO: 1285057 - RNA, 12 nt, Homo sapiens
caguuccaauga

SEQ ID NO: 1285058 - RNA, 12 nt, Homo sapiens
caguuugaacuc

SEQ ID NO: 1285059 - RNA, 18 nt, Homo sapiens
cauaagcaaagacuauga

SEQ ID NO: 1285060 - RNA, 22 nt, Homo sapiens
ccccacagcuucucuacagacu

SEQ ID NO: 1285061 - RNA, 19 nt, Homo sapiens
ccccacauugcacuucugg

SEQ ID NO: 1285062 - RNA, 19 nt, Homo sapiens
ccccucccacagcgcuggc

SEQ ID NO: 1285063 - RNA, 17 nt, Homo sapiens
ccccucgugucagcuca

SEQ ID NO: 1285064 - RNA, 22 nt, Homo sapiens
ccccugcaaugcgucuugugaa

SEQ ID NO: 1285065 - RNA, 17 nt, Homo sapiens
cccgugacacaugcucu

SEQ ID NO: 1285066 - RNA, 20 nt, Homo sapiens
cccucccaccuccgcuggga

SEQ ID NO: 1285067 - RNA, 13 nt, Homo sapiens
cccuccccugggc

SEQ ID NO: 1285068 - RNA, 14 nt, Homo sapiens
cccucccuuucucc

SEQ ID NO: 1285069 - RNA, 20 nt, Homo sapiens
cccuccuccagaccauucag

SEQ ID NO: 1285070 - RNA, 11 nt, Homo sapiens
cccugccauca

SEQ ID NO: 1285071 - RNA, 17 nt, Homo sapiens
cccuguccugaaagcca

SEQ ID NO: 1285072 - RNA, 13 nt, Homo sapiens
cccuuuucagggc

SEQ ID NO: 1285073 - RNA, 19 nt, Homo sapiens
ccgcaccauugaacuguac

SEQ ID NO: 1285074 - RNA, 14 nt, Homo sapiens
ccgccuguaaaaug

SEQ ID NO: 1285075 - RNA, 18 nt, Homo sapiens
ccgcuguggccuucguca

SEQ ID NO: 1285076 - RNA, 15 nt, Homo sapiens
ccgcuuucaugaaca

SEQ ID NO: 1285077 - RNA, 15 nt, Homo sapiens
ccguuccacauccac

SEQ ID NO: 1285078 - RNA, 16 nt, Homo sapiens
ccuaaaaugcuucacu

SEQ ID NO: 1285079 - RNA, 21 nt, Homo sapiens
ccuaaugaaagugaugacaua

SEQ ID NO: 1285080 - RNA, 23 nt, Homo sapiens
ccuaaugaaagugaugacauauu

SEQ ID NO: 1285081 - RNA, 19 nt, Homo sapiens
ccuaaugucuguaucacuc

SEQ ID NO: 1285082 - RNA, 17 nt, Homo sapiens
ccuaauuccacacccuc

SEQ ID NO: 1285083 - RNA, 23 nt, Homo sapiens
ccuagauaugaauauauggcauu

SEQ ID NO: 1285084 - RNA, 12 nt, Homo sapiens
ccuauuugccau

SEQ ID NO: 1285085 - RNA, 15 nt, Homo sapiens
aaaauguuggugcaa

SEQ ID NO: 1285086 - RNA, 16 nt, Homo sapiens
aaaauuuuuuacuuuu

SEQ ID NO: 1285087 - RNA, 21 nt, Homo sapiens
aaacagauuacuagaaauauu

SEQ ID NO: 1285088 - RNA, 17 nt, Homo sapiens
aaacagccccucuggac

SEQ ID NO: 1285089 - RNA, 15 nt, Homo sapiens
aaacaucauuggaua

SEQ ID NO: 1285090 - RNA, 23 nt, Homo sapiens
aaacaugugguuaaugccaugga

SEQ ID NO: 1285091 - RNA, 15 nt, Homo sapiens
aaacauguucacuua

SEQ ID NO: 1285092 - RNA, 13 nt, Homo sapiens
aaacccucgaggc

SEQ ID NO: 1285093 - RNA, 17 nt, Homo sapiens
aaacuaaggcauuugau

SEQ ID NO: 1285094 - RNA, 22 nt, Homo sapiens
gaguuugguuaaucaguguuga

SEQ ID NO: 1285095 - RNA, 22 nt, Homo sapiens
gauacugcugcgucauuacagg

SEQ ID NO: 1285096 - RNA, 14 nt, Homo sapiens
gauagaaggcuaug

SEQ ID NO: 1285097 - RNA, 12 nt, Homo sapiens
gaucauucucag

SEQ ID NO: 1285098 - RNA, 18 nt, Homo sapiens
gaucauucucaguaucca

SEQ ID NO: 1285099 - RNA, 16 nt, Homo sapiens
gauccccucucuuccu

SEQ ID NO: 1285100 - RNA, 16 nt, Homo sapiens
gaucuacuacauccca

SEQ ID NO: 1285101 - RNA, 15 nt, Homo sapiens
gaucuguacuuugug

SEQ ID NO: 1285102 - RNA, 20 nt, Homo sapiens
gaucuuuguuuaaaugccaa

SEQ ID NO: 1285103 - RNA, 13 nt, Homo sapiens
gaugagaguacac

SEQ ID NO: 1285104 - RNA, 14 nt, Homo sapiens
gaugaucaacauaa

SEQ ID NO: 1285105 - RNA, 16 nt, Homo sapiens
gaugauucaaauauca

SEQ ID NO: 1285106 - RNA, 18 nt, Homo sapiens
gaugauucaaauaucaaa

SEQ ID NO: 1285107 - RNA, 16 nt, Homo sapiens
gaugcauggaguguuu

SEQ ID NO: 1285108 - RNA, 18 nt, Homo sapiens
gauggaaaggagccuagg

SEQ ID NO: 1285109 - RNA, 19 nt, Homo sapiens
gauggcuuuaccuuuauua

SEQ ID NO: 1285110 - RNA, 15 nt, Homo sapiens
gaugucucacauccu

SEQ ID NO: 1285111 - RNA, 22 nt, Homo sapiens
gauuauuuaauaacauuaccuu

SEQ ID NO: 1285112 - RNA, 14 nt, Homo sapiens
gauucuuuguuaca

SEQ ID NO: 1285113 - RNA, 15 nt, Homo sapiens
gcaaacaugugcaac

SEQ ID NO: 1285114 - RNA, 14 nt, Homo sapiens
gcaaacugcuuuau

SEQ ID NO: 1285115 - RNA, 20 nt, Homo sapiens
gcaaugauaaauaaagucau

SEQ ID NO: 1285116 - RNA, 14 nt, Homo sapiens
gcaauuaacucugg

SEQ ID NO: 1285117 - RNA, 13 nt, Homo sapiens
gcacaggccaugg

SEQ ID NO: 1285118 - RNA, 18 nt, Homo sapiens
gcaccaauaaagccuuca

SEQ ID NO: 1285119 - RNA, 17 nt, Homo sapiens
gcaccauugaacuguac

SEQ ID NO: 1285120 - RNA, 14 nt, Homo sapiens
gcacccucuccaga

SEQ ID NO: 1285121 - RNA, 22 nt, Homo sapiens
gcacugauaucaucgauuagaa

SEQ ID NO: 1285122 - RNA, 13 nt, Homo sapiens
gcacuuauucuca

SEQ ID NO: 1285123 - RNA, 20 nt, Homo sapiens
gcagaaucuguuaccagagg

SEQ ID NO: 1285124 - RNA, 20 nt, Homo sapiens
gcagcaucucugaacauuuc

SEQ ID NO: 1285125 - RNA, 18 nt, Homo sapiens
gcagcgccucaucuucaa

SEQ ID NO: 1285126 - RNA, 21 nt, Homo sapiens
gcaggaacuugcacaaaauca

SEQ ID NO: 1285127 - RNA, 22 nt, Homo sapiens
gcaggaaggagcugccuggacc

SEQ ID NO: 1285128 - RNA, 19 nt, Homo sapiens
gcaggcuucugugugcugc

SEQ ID NO: 1285129 - RNA, 19 nt, Homo sapiens
gcagguguucuucauuacc

SEQ ID NO: 1285130 - RNA, 17 nt, Homo sapiens
gcaguaauaaucaucga

SEQ ID NO: 1285131 - RNA, 19 nt, Homo sapiens
gcagugcuugaaugaaguu

SEQ ID NO: 1285132 - RNA, 21 nt, Homo sapiens
gcaguuuugugauaaguucua

SEQ ID NO: 1285133 - RNA, 16 nt, Homo sapiens
gcauaaauaugcagug

SEQ ID NO: 1285134 - RNA, 13 nt, Homo sapiens
gcauagagcaauu

SEQ ID NO: 1285135 - RNA, 17 nt, Homo sapiens
gcaucauuaauaccuaa

SEQ ID NO: 1285136 - RNA, 13 nt, Homo sapiens
gcauggcauuaau

SEQ ID NO: 1285137 - RNA, 19 nt, Homo sapiens
gcauguaaaaucuucagcu

SEQ ID NO: 1285138 - RNA, 16 nt, Homo sapiens
gcauguguauuuccag

SEQ ID NO: 1285139 - RNA, 14 nt, Homo sapiens
gcauuguguucacu

SEQ ID NO: 1285140 - RNA, 15 nt, Homo sapiens
gcauuuucacuuuug

SEQ ID NO: 1285141 - RNA, 14 nt, Homo sapiens
gccacagugcaauu

SEQ ID NO: 1285142 - RNA, 21 nt, Homo sapiens
gccacguauguuuuuguguau

SEQ ID NO: 1285143 - RNA, 14 nt, Homo sapiens
gccacucuccccau

SEQ ID NO: 1285144 - RNA, 15 nt, Homo sapiens
gccagaaaaaagugu

SEQ ID NO: 1285145 - RNA, 19 nt, Homo sapiens
gccauggauggaaaacgcu

SEQ ID NO: 1285146 - RNA, 18 nt, Homo sapiens
gccauuguuucuccuggg

SEQ ID NO: 1285147 - RNA, 18 nt, Homo sapiens
gcccaguuucacugccau

SEQ ID NO: 1285148 - RNA, 22 nt, Homo sapiens
gcccaugaacaaguuaguuucu

SEQ ID NO: 1285149 - RNA, 19 nt, Homo sapiens
gcccauggaggcgcugcug

SEQ ID NO: 1285150 - RNA, 22 nt, Homo sapiens
gccccaugcugcccgcuucuca

SEQ ID NO: 1285151 - RNA, 22 nt, Homo sapiens
gcccuucucucauuauuucucu

SEQ ID NO: 1285152 - RNA, 23 nt, Homo sapiens
gccguaguggaauuaacaggaaa

SEQ ID NO: 1285153 - RNA, 10 nt, Homo sapiens
gccuaugaaa

SEQ ID NO: 1285154 - RNA, 16 nt, Homo sapiens
gccucagagacaucag

SEQ ID NO: 1285155 - RNA, 17 nt, Homo sapiens
gccucaggccucugugc

SEQ ID NO: 1285156 - RNA, 15 nt, Homo sapiens
gccucagugacccau

SEQ ID NO: 1285157 - RNA, 19 nt, Homo sapiens
gccuccucuacaauuugcc

SEQ ID NO: 1285158 - RNA, 16 nt, Homo sapiens
gccuccugucccucau

SEQ ID NO: 1285159 - RNA, 15 nt, Homo sapiens
gccucugccaggugu

SEQ ID NO: 1285160 - RNA, 21 nt, Homo sapiens
gccucugugccgcaccauuga

SEQ ID NO: 1285161 - RNA, 14 nt, Homo sapiens
gccucuuccaggaa

SEQ ID NO: 1285162 - RNA, 14 nt, Homo sapiens
gccugcggaccaga

SEQ ID NO: 1285163 - RNA, 15 nt, Homo sapiens
gccuggcuccaaacc

SEQ ID NO: 1285164 - RNA, 16 nt, Homo sapiens
gccugggggauguacc

SEQ ID NO: 1285165 - RNA, 12 nt, Homo sapiens
gccugugccuuu

SEQ ID NO: 1285166 - RNA, 15 nt, Homo sapiens
gccuuauuggcagcu

SEQ ID NO: 1285167 - RNA, 19 nt, Homo sapiens
gccuucccaggaguacacc

SEQ ID NO: 1285168 - RNA, 19 nt, Homo sapiens
gccuucugaggacauucca

SEQ ID NO: 1285169 - RNA, 14 nt, Homo sapiens
gcgaacaaccacag

SEQ ID NO: 1285170 - RNA, 16 nt, Homo sapiens
gcgaaugacaaaauca

SEQ ID NO: 1285171 - RNA, 16 nt, Homo sapiens
gcgauuacaggcauga

SEQ ID NO: 1285172 - RNA, 15 nt, Homo sapiens
gcgcguccagcugcc

SEQ ID NO: 1285173 - RNA, 11 nt, Homo sapiens
gcgggggcuug

SEQ ID NO: 1285174 - RNA, 21 nt, Homo sapiens
guagcagauccccagccucug

SEQ ID NO: 1285175 - RNA, 16 nt, Homo sapiens
guagccacuucacuuu

SEQ ID NO: 1285176 - RNA, 12 nt, Homo sapiens
guagcuagccug

SEQ ID NO: 1285177 - RNA, 16 nt, Homo sapiens
guaguauuuaguauau

SEQ ID NO: 1285178 - RNA, 22 nt, Homo sapiens
guaucugcauguaaaaucuuca

SEQ ID NO: 1285179 - RNA, 19 nt, Homo sapiens
guauuaaacuuuucauuac

SEQ ID NO: 1285180 - RNA, 17 nt, Homo sapiens
guauucuuaaaaugcaa

SEQ ID NO: 1285181 - RNA, 19 nt, Homo sapiens
guauucuuaaaaugcaaua

SEQ ID NO: 1285182 - RNA, 20 nt, Homo sapiens
guauugcuguccuugaaugc

SEQ ID NO: 1285183 - RNA, 16 nt, Homo sapiens
gucaucuguaccucug

SEQ ID NO: 1285184 - RNA, 13 nt, Homo sapiens
gucauuacagggc

SEQ ID NO: 1285185 - RNA, 15 nt, Homo sapiens
guccaccaccaccug

SEQ ID NO: 1285186 - RNA, 19 nt, Homo sapiens
guccccuucucucaucucu

SEQ ID NO: 1285187 - RNA, 12 nt, Homo sapiens
gucccuugcccc

SEQ ID NO: 1285188 - RNA, 17 nt, Homo sapiens
guccucccccacucccu

SEQ ID NO: 1285189 - RNA, 15 nt, Homo sapiens
guccugaaagccaca

SEQ ID NO: 1285190 - RNA, 10 nt, Homo sapiens
gucuaccuga

SEQ ID NO: 1285191 - RNA, 17 nt, Homo sapiens
gucuaguuaacauuuca

SEQ ID NO: 1285192 - RNA, 13 nt, Homo sapiens
gucuauguacaau

SEQ ID NO: 1285193 - RNA, 14 nt, Homo sapiens
gucucacacuguuu

SEQ ID NO: 1285194 - RNA, 14 nt, Homo sapiens
gucuccaguggaag

SEQ ID NO: 1285195 - RNA, 22 nt, Homo sapiens
gucucugacaaagugugucuca

SEQ ID NO: 1285196 - RNA, 11 nt, Homo sapiens
gucucuuuaua

SEQ ID NO: 1285197 - RNA, 16 nt, Homo sapiens
gucugggccacucagg

SEQ ID NO: 1285198 - RNA, 20 nt, Homo sapiens
gucuguagcuccucaacuca

SEQ ID NO: 1285199 - RNA, 17 nt, Homo sapiens
gucuuacuuugugcaaa

SEQ ID NO: 1285200 - RNA, 21 nt, Homo sapiens
gucuugaccugaacucugcaa

SEQ ID NO: 1285201 - RNA, 15 nt, Homo sapiens
gugaaaugcagaguc

SEQ ID NO: 1285202 - RNA, 20 nt, Homo sapiens
gugaauuuuugcacauucua

SEQ ID NO: 1285203 - RNA, 22 nt, Homo sapiens
gugaggaugucugggccacuca

SEQ ID NO: 1285204 - RNA, 14 nt, Homo sapiens
gugaggggcucucu

SEQ ID NO: 1285205 - RNA, 22 nt, Homo sapiens
gugaguagcugcauuccuagaa

SEQ ID NO: 1285206 - RNA, 22 nt, Homo sapiens
gugaguuuuacucuuaaaucau

SEQ ID NO: 1285207 - RNA, 17 nt, Homo sapiens
gugaucucgacuccccc

SEQ ID NO: 1285208 - RNA, 13 nt, Homo sapiens
gugauugugccag

SEQ ID NO: 1285209 - RNA, 15 nt, Homo sapiens
aaggggagagggaag

SEQ ID NO: 1285210 - RNA, 18 nt, Homo sapiens
aaggguggaaaaaugccc

SEQ ID NO: 1285211 - RNA, 17 nt, Homo sapiens
aagguacauggaacaca

SEQ ID NO: 1285212 - RNA, 22 nt, Homo sapiens
aaggugggccuugcuaccucaa

SEQ ID NO: 1285213 - RNA, 14 nt, Homo sapiens
aagguggucacugu

SEQ ID NO: 1285214 - RNA, 13 nt, Homo sapiens
aaguacagacuuu

SEQ ID NO: 1285215 - RNA, 23 nt, Homo sapiens
aagucuuccauagagacuuugug

SEQ ID NO: 1285216 - RNA, 14 nt, Homo sapiens
aagucuugcauuga

SEQ ID NO: 1285217 - RNA, 18 nt, Homo sapiens
aagucuuugaagugacuu

SEQ ID NO: 1285218 - RNA, 19 nt, Homo sapiens
aaguugcaccaacuuugaa

SEQ ID NO: 1285219 - RNA, 22 nt, Homo sapiens
aaguuggucuuacuuugugcaa

SEQ ID NO: 1285220 - RNA, 12 nt, Homo sapiens
aaguuuaugcau

SEQ ID NO: 1285221 - RNA, 19 nt, Homo sapiens
aaguuucuuaaagcaacac

SEQ ID NO: 1285222 - RNA, 11 nt, Homo sapiens
aauaaagcaau

SEQ ID NO: 1285223 - RNA, 22 nt, Homo sapiens
aauaaagguuagauaaguccuu

SEQ ID NO: 1285224 - RNA, 16 nt, Homo sapiens
aauaaauaaucuacau

SEQ ID NO: 1285225 - RNA, 20 nt, Homo sapiens
aauaaaugguuucucauuaa

SEQ ID NO: 1285226 - RNA, 21 nt, Homo sapiens
aauaaccuauaaaguguuuau

SEQ ID NO: 1285227 - RNA, 11 nt, Homo sapiens
aauaacuaaua

SEQ ID NO: 1285228 - RNA, 17 nt, Homo sapiens
aauaauugcaaauaucc

SEQ ID NO: 1285229 - RNA, 20 nt, Homo sapiens
aauacgguggggguaggggg

SEQ ID NO: 1285230 - RNA, 21 nt, Homo sapiens
aauacuggggauuaccauuca

SEQ ID NO: 1285231 - RNA, 20 nt, Homo sapiens
aauagaggugaugcugcuaa

SEQ ID NO: 1285232 - RNA, 19 nt, Homo sapiens
aauaguuccugaacauugc

SEQ ID NO: 1285233 - RNA, 22 nt, Homo sapiens
aauauaguugucuuucuuugcu

SEQ ID NO: 1285234 - RNA, 18 nt, Homo sapiens
aauauuugcaagacauag

SEQ ID NO: 1285235 - RNA, 12 nt, Homo sapiens
aaucaacucuaa

SEQ ID NO: 1285236 - RNA, 24 nt, Homo sapiens
aaucaaggcauaaaauacaauuaa

SEQ ID NO: 1285237 - RNA, 14 nt, Homo sapiens
aaucacucagugau

SEQ ID NO: 1285238 - RNA, 21 nt, Homo sapiens
aaucacuuaacauuccuaaaa

SEQ ID NO: 1285239 - RNA, 16 nt, Homo sapiens
aaucaugcucauguau

SEQ ID NO: 1285240 - RNA, 15 nt, Homo sapiens
aauccaaaugcauuc

SEQ ID NO: 1285241 - RNA, 11 nt, Homo sapiens
aauccaugcuu

SEQ ID NO: 1285242 - RNA, 18 nt, Homo sapiens
aauccuuuaaacauacaa

SEQ ID NO: 1285243 - RNA, 14 nt, Homo sapiens
aaucucggcucacu

SEQ ID NO: 1285244 - RNA, 21 nt, Homo sapiens
aaucuguuaccagaggacaaa

SEQ ID NO: 1285245 - RNA, 18 nt, Homo sapiens
aaucuucuugauccacuu

SEQ ID NO: 1285246 - RNA, 22 nt, Homo sapiens
aaugaucacaucuaaagcuuua

SEQ ID NO: 1285247 - RNA, 20 nt, Homo sapiens
aaugauccguuccauugcaa

SEQ ID NO: 1285248 - RNA, 21 nt, Homo sapiens
aaugcauccagcaguacaaua

SEQ ID NO: 1285249 - RNA, 20 nt, Homo sapiens
aaugccuuugagacaguuuc

SEQ ID NO: 1285250 - RNA, 22 nt, Homo sapiens
aauggaaaguuaccuuacugaa

SEQ ID NO: 1285251 - RNA, 16 nt, Homo sapiens
aauggaggcaacgcca

SEQ ID NO: 1285252 - RNA, 16 nt, Homo sapiens
aauggauaaguagaau

SEQ ID NO: 1285253 - RNA, 15 nt, Homo sapiens
aauggggugcaugaa

SEQ ID NO: 1285254 - RNA, 20 nt, Homo sapiens
aaugucaguguucagccaaa

SEQ ID NO: 1285255 - RNA, 20 nt, Homo sapiens
aauguccaaauacucugaaa

SEQ ID NO: 1285256 - RNA, 14 nt, Homo sapiens
aaugugucugcaac

SEQ ID NO: 1285257 - RNA, 13 nt, Homo sapiens
aauguuucacuac

SEQ ID NO: 1285258 - RNA, 15 nt, Homo sapiens
aauuaaaaacuuuaa

SEQ ID NO: 1285259 - RNA, 16 nt, Homo sapiens
aauuaaacuaguuuaa

SEQ ID NO: 1285260 - RNA, 16 nt, Homo sapiens
aauuacauacuauucu

SEQ ID NO: 1285261 - RNA, 12 nt, Homo sapiens
aauuaugaauga

SEQ ID NO: 1285262 - RNA, 20 nt, Homo sapiens
aauuccuuucagaguuuuac

SEQ ID NO: 1285263 - RNA, 20 nt, Homo sapiens
aauucggcaguuggccaaaa

SEQ ID NO: 1285264 - RNA, 19 nt, Homo sapiens
aauucuauuacgugcaaua

SEQ ID NO: 1285265 - RNA, 18 nt, Homo sapiens
aauucuuacaaacaugug

SEQ ID NO: 1285266 - RNA, 19 nt, Homo sapiens
aauucuuuguuuccucuuu

SEQ ID NO: 1285267 - RNA, 15 nt, Homo sapiens
aauugaucauucaua

SEQ ID NO: 1285268 - RNA, 21 nt, Homo sapiens
aauuggcucacaguucugcag

SEQ ID NO: 1285269 - RNA, 19 nt, Homo sapiens
aauugugcuggucauacau

SEQ ID NO: 1285270 - RNA, 21 nt, Homo sapiens
aauuuacuuuuuaaacagugu

SEQ ID NO: 1285271 - RNA, 20 nt, Homo sapiens
aauuucacuuaauaaugugu

SEQ ID NO: 1285272 - RNA, 20 nt, Homo sapiens
aauuuccaaaauaaucuaua

SEQ ID NO: 1285273 - RNA, 13 nt, Homo sapiens
aauuuccaugugu

SEQ ID NO: 1285274 - RNA, 19 nt, Homo sapiens
aauuuggcuucuguuguca

SEQ ID NO: 1285275 - RNA, 13 nt, Homo sapiens
aauuuucuuccaa

SEQ ID NO: 1285276 - RNA, 16 nt, Homo sapiens
aauuuuugaguagcau

SEQ ID NO: 1285277 - RNA, 17 nt, Homo sapiens
aauuuuuuaaacuguag

SEQ ID NO: 1285278 - RNA, 12 nt, Homo sapiens
acaaaaucacac

SEQ ID NO: 1285279 - RNA, 18 nt, Homo sapiens
acaaaaugucacacuugu

SEQ ID NO: 1285280 - RNA, 23 nt, Homo sapiens
acaaacuaacuaauaaaauauau

SEQ ID NO: 1285281 - RNA, 16 nt, Homo sapiens
acaaaguauaacaauu

SEQ ID NO: 1285282 - RNA, 13 nt, Homo sapiens
acaaauguaugau

SEQ ID NO: 1285283 - RNA, 15 nt, Homo sapiens
acaacaaacacugug

SEQ ID NO: 1285284 - RNA, 16 nt, Homo sapiens
acaacaaacacuguga

SEQ ID NO: 1285285 - RNA, 17 nt, Homo sapiens
acaacaaacacugugau

SEQ ID NO: 1285286 - RNA, 16 nt, Homo sapiens
acaagcagcaggaaac

SEQ ID NO: 1285287 - RNA, 18 nt, Homo sapiens
acaaggcuggcagugaca

SEQ ID NO: 1285288 - RNA, 17 nt, Homo sapiens
acaauacaggcuaggga

SEQ ID NO: 1285289 - RNA, 23 nt, Homo sapiens
acaauggaccggagagugggggu

SEQ ID NO: 1285290 - RNA, 17 nt, Homo sapiens
acaauguugcacugaaa

SEQ ID NO: 1285291 - RNA, 23 nt, Homo sapiens
acaauucggcaguuggccaaaac

SEQ ID NO: 1285292 - RNA, 12 nt, Homo sapiens
acacaaggucau

SEQ ID NO: 1285293 - RNA, 21 nt, Homo sapiens
acacagacccaaaccauacca

SEQ ID NO: 1285294 - RNA, 17 nt, Homo sapiens
acacagccaagccaguc

SEQ ID NO: 1285295 - RNA, 18 nt, Homo sapiens
acacagccaagccaguca

SEQ ID NO: 1285296 - RNA, 16 nt, Homo sapiens
acacagccugggacca

SEQ ID NO: 1285297 - RNA, 14 nt, Homo sapiens
acacaggaaggaaa

SEQ ID NO: 1285298 - RNA, 11 nt, Homo sapiens
acaccaaaaau

SEQ ID NO: 1285299 - RNA, 20 nt, Homo sapiens
acaccaguugaacugcagga

SEQ ID NO: 1285300 - RNA, 13 nt, Homo sapiens
acacccacagugg

SEQ ID NO: 1285301 - RNA, 12 nt, Homo sapiens
acacgugacaga

SEQ ID NO: 1285302 - RNA, 15 nt, Homo sapiens
acacuaauacaccag

SEQ ID NO: 1285303 - RNA, 22 nt, Homo sapiens
acacugaaacagccagaucuca

SEQ ID NO: 1285304 - RNA, 22 nt, Homo sapiens
acagacccccagggcauugugu

SEQ ID NO: 1285305 - RNA, 17 nt, Homo sapiens
acagagaaaagacauaa

SEQ ID NO: 1285306 - RNA, 23 nt, Homo sapiens
acagagggcaggaacuugcacaa

SEQ ID NO: 1285307 - RNA, 19 nt, Homo sapiens
uacccaaauacucaauuua

SEQ ID NO: 1285308 - RNA, 14 nt, Homo sapiens
uaccuaaacuguau

SEQ ID NO: 1285309 - RNA, 17 nt, Homo sapiens
uaccucaagggggacug

SEQ ID NO: 1285310 - RNA, 20 nt, Homo sapiens
uaccuggcccugugccuugg

SEQ ID NO: 1285311 - RNA, 12 nt, Homo sapiens
uaccuuacugaa

SEQ ID NO: 1285312 - RNA, 22 nt, Homo sapiens
uacuaagugguggagccaagau

SEQ ID NO: 1285313 - RNA, 12 nt, Homo sapiens
uacucugaaaug

SEQ ID NO: 1285314 - RNA, 14 nt, Homo sapiens
uacucugugggcaa

SEQ ID NO: 1285315 - RNA, 20 nt, Homo sapiens
uacuuucucuagggagaaaa

SEQ ID NO: 1285316 - RNA, 12 nt, Homo sapiens
uagaacuugauu

SEQ ID NO: 1285317 - RNA, 15 nt, Homo sapiens
uagaagcaucacagg

SEQ ID NO: 1285318 - RNA, 18 nt, Homo sapiens
uagaccucuuccuggaau

SEQ ID NO: 1285319 - RNA, 17 nt, Homo sapiens
uagagaaauuugccaau

SEQ ID NO: 1285320 - RNA, 14 nt, Homo sapiens
uagagcugccugug

SEQ ID NO: 1285321 - RNA, 13 nt, Homo sapiens
uagcauauuacca

SEQ ID NO: 1285322 - RNA, 16 nt, Homo sapiens
uagccgaaaugaucuu

SEQ ID NO: 1285323 - RNA, 15 nt, Homo sapiens
uagccuuugucccag

SEQ ID NO: 1285324 - RNA, 18 nt, Homo sapiens
uagcuucaggauacugua

SEQ ID NO: 1285325 - RNA, 15 nt, Homo sapiens
uagcuuggaaacugg

SEQ ID NO: 1285326 - RNA, 21 nt, Homo sapiens
uaggaaaauauggguugcauu

SEQ ID NO: 1285327 - RNA, 17 nt, Homo sapiens
uaggccagcaccaucuc

SEQ ID NO: 1285328 - RNA, 20 nt, Homo sapiens
uaggccaggaguucccaaau

SEQ ID NO: 1285329 - RNA, 13 nt, Homo sapiens
uaggccaggugca

SEQ ID NO: 1285330 - RNA, 16 nt, Homo sapiens
uaggccaggugcaacc

SEQ ID NO: 1285331 - RNA, 22 nt, Homo sapiens
uaguauuuaacuacaucugccu

SEQ ID NO: 1285332 - RNA, 12 nt, Homo sapiens
uagucauugcag

SEQ ID NO: 1285333 - RNA, 15 nt, Homo sapiens
uaguuaacauuucaa

SEQ ID NO: 1285334 - RNA, 21 nt, Homo sapiens
uauaaaaugcugauauuuacu

SEQ ID NO: 1285335 - RNA, 19 nt, Homo sapiens
uauaaagaaauaccugaga

SEQ ID NO: 1285336 - RNA, 19 nt, Homo sapiens
uauaacaauuaaaaucuca

SEQ ID NO: 1285337 - RNA, 13 nt, Homo sapiens
uauaacuugcauu

SEQ ID NO: 1285338 - RNA, 15 nt, Homo sapiens
uauaagguaauguag

SEQ ID NO: 1285339 - RNA, 17 nt, Homo sapiens
uauaauaaaaagcuuca

SEQ ID NO: 1285340 - RNA, 21 nt, Homo sapiens
uauaauaaaaagcuucaggga

SEQ ID NO: 1285341 - RNA, 11 nt, Homo sapiens
uauaauuuuga

SEQ ID NO: 1285342 - RNA, 14 nt, Homo sapiens
uauacauauagaua

SEQ ID NO: 1285343 - RNA, 19 nt, Homo sapiens
uauaccaugugugcuaaua

SEQ ID NO: 1285344 - RNA, 18 nt, Homo sapiens
uauacuauaugaaaagag

SEQ ID NO: 1285345 - RNA, 14 nt, Homo sapiens
uauagugaugccau

SEQ ID NO: 1285346 - RNA, 21 nt, Homo sapiens
uauagugucuugggaauuuuc

SEQ ID NO: 1285347 - RNA, 23 nt, Homo sapiens
uauauaaggucauagauucuuga

SEQ ID NO: 1285348 - RNA, 14 nt, Homo sapiens
uauauguauacaua

SEQ ID NO: 1285349 - RNA, 13 nt, Homo sapiens
uauccauccaugg

SEQ ID NO: 1285350 - RNA, 13 nt, Homo sapiens
uauccuucauugu

SEQ ID NO: 1285351 - RNA, 23 nt, Homo sapiens
uaucuugaguguuaugugaauuu

SEQ ID NO: 1285352 - RNA, 22 nt, Homo sapiens
uaugacuaaagagagaauguag

SEQ ID NO: 1285353 - RNA, 17 nt, Homo sapiens
uaugagaugccugaagc

SEQ ID NO: 1285354 - RNA, 22 nt, Homo sapiens
uaugcaauaaaauuauuugcag

SEQ ID NO: 1285355 - RNA, 14 nt, Homo sapiens
uaugcauacaguaa

SEQ ID NO: 1285356 - RNA, 16 nt, Homo sapiens
uauggccucaagauca

SEQ ID NO: 1285357 - RNA, 22 nt, Homo sapiens
uaugguaggaacugcugggcuu

SEQ ID NO: 1285358 - RNA, 14 nt, Homo sapiens
uaugguucucaggc

SEQ ID NO: 1285359 - RNA, 21 nt, Homo sapiens
uaugucaaauugucagcauga

SEQ ID NO: 1285360 - RNA, 18 nt, Homo sapiens
uaugugagaaaucagaau

SEQ ID NO: 1285361 - RNA, 9 nt, Homo sapiens
uaugugcaa

SEQ ID NO: 1285362 - RNA, 16 nt, Homo sapiens
uaugugggggucugug

SEQ ID NO: 1285363 - RNA, 19 nt, Homo sapiens
uaugugggugggaccacag

SEQ ID NO: 1285364 - RNA, 16 nt, Homo sapiens
uauuauaaaaguacua

SEQ ID NO: 1285365 - RNA, 17 nt, Homo sapiens
uauucuuaaaaugcaau

SEQ ID NO: 1285366 - RNA, 19 nt, Homo sapiens
uauucuuaaaaugcaauau

SEQ ID NO: 1285367 - RNA, 15 nt, Homo sapiens
uauucuuacuaaucu

SEQ ID NO: 1285368 - RNA, 17 nt, Homo sapiens
uauugcugaaugacuac

SEQ ID NO: 1285369 - RNA, 14 nt, Homo sapiens
uauuggcagcucua

SEQ ID NO: 1285370 - RNA, 12 nt, Homo sapiens
uauuguaucugu

SEQ ID NO: 1285371 - RNA, 18 nt, Homo sapiens
uauuuaccuucuaccucu

SEQ ID NO: 1285372 - RNA, 21 nt, Homo sapiens
uauuuuuaaaaguauacaugu

SEQ ID NO: 1285373 - RNA, 14 nt, Homo sapiens
uauuuuucucauga

SEQ ID NO: 1285374 - RNA, 22 nt, Homo sapiens
uauuuuuuaugaaacauuacag

SEQ ID NO: 1285375 - RNA, 13 nt, Homo sapiens
ucaaaaauacuca

SEQ ID NO: 1285376 - RNA, 20 nt, Homo sapiens
ucaaacaugaaaacauugau

SEQ ID NO: 1285377 - RNA, 18 nt, Homo sapiens
ucaaagagauggugcuaa

SEQ ID NO: 1285378 - RNA, 20 nt, Homo sapiens
ucaaagggagagagugcuau

SEQ ID NO: 1285379 - RNA, 22 nt, Homo sapiens
ucaaagggagagagugcuauug

SEQ ID NO: 1285380 - RNA, 24 nt, Homo sapiens
acuaaaugcucauacacaguuaaa

SEQ ID NO: 1285381 - RNA, 15 nt, Homo sapiens
acuaacagauaagca

SEQ ID NO: 1285382 - RNA, 20 nt, Homo sapiens
acuaauagaauuaauggaau

SEQ ID NO: 1285383 - RNA, 13 nt, Homo sapiens
acuacaucugccu

SEQ ID NO: 1285384 - RNA, 20 nt, Homo sapiens
acuaccagugggcauguauu

SEQ ID NO: 1285385 - RNA, 13 nt, Homo sapiens
acuagcuccccaa

SEQ ID NO: 1285386 - RNA, 13 nt, Homo sapiens
acuaggauacugc

SEQ ID NO: 1285387 - RNA, 21 nt, Homo sapiens
acuauuccacagggauaccuu

SEQ ID NO: 1285388 - RNA, 20 nt, Homo sapiens
acuauugcaaggacagcauc

SEQ ID NO: 1285389 - RNA, 22 nt, Homo sapiens
acucagcugcuucuuuggucau

SEQ ID NO: 1285390 - RNA, 14 nt, Homo sapiens
acucaggggucauu

SEQ ID NO: 1285391 - RNA, 17 nt, Homo sapiens
acucaucuuagugccug

SEQ ID NO: 1285392 - RNA, 22 nt, Homo sapiens
acucauuucauuccuaacacag

SEQ ID NO: 1285393 - RNA, 21 nt, Homo sapiens
acuccaaaaggcccuuuucag

SEQ ID NO: 1285394 - RNA, 21 nt, Homo sapiens
acucccccaccgcccacucuc

SEQ ID NO: 1285395 - RNA, 16 nt, Homo sapiens
acucuaauagugcuua

SEQ ID NO: 1285396 - RNA, 13 nt, Homo sapiens
acucuaucagaac

SEQ ID NO: 1285397 - RNA, 20 nt, Homo sapiens
acucucagcagcuaugguag

SEQ ID NO: 1285398 - RNA, 20 nt, Homo sapiens
acucuggaccucucuuguga

SEQ ID NO: 1285399 - RNA, 21 nt, Homo sapiens
acucugggguuuuuacuguua

SEQ ID NO: 1285400 - RNA, 19 nt, Homo sapiens
acucugugucugaguggcu

SEQ ID NO: 1285401 - RNA, 20 nt, Homo sapiens
acucuuaaguguaaauaaua

SEQ ID NO: 1285402 - RNA, 23 nt, Homo sapiens
acucuuaaguguaaauaauauaa

SEQ ID NO: 1285403 - RNA, 15 nt, Homo sapiens
acucuugacagcagg

SEQ ID NO: 1285404 - RNA, 23 nt, Homo sapiens
acugaacguguucuuuugugcuc

SEQ ID NO: 1285405 - RNA, 13 nt, Homo sapiens
acugacuccuuag

SEQ ID NO: 1285406 - RNA, 21 nt, Homo sapiens
acugcaggaagagaggaccca

SEQ ID NO: 1285407 - RNA, 20 nt, Homo sapiens
acugcucauuuggaucccag

SEQ ID NO: 1285408 - RNA, 23 nt, Homo sapiens
acugcugccucuugaaugcaggg

SEQ ID NO: 1285409 - RNA, 19 nt, Homo sapiens
acugcuggggaucuaggga

SEQ ID NO: 1285410 - RNA, 13 nt, Homo sapiens
acugcuguagaca

SEQ ID NO: 1285411 - RNA, 17 nt, Homo sapiens
acuggacauggucugca

SEQ ID NO: 1285412 - RNA, 13 nt, Homo sapiens
acuggcagcaucu

SEQ ID NO: 1285413 - RNA, 15 nt, Homo sapiens
acuggucacauugcc

SEQ ID NO: 1285414 - RNA, 20 nt, Homo sapiens
acuguauuuauugugaugcc

SEQ ID NO: 1285415 - RNA, 16 nt, Homo sapiens
acugucuugaagacaa

SEQ ID NO: 1285416 - RNA, 21 nt, Homo sapiens
acugucuugaagacaauggcu

SEQ ID NO: 1285417 - RNA, 17 nt, Homo sapiens
acuguuauuaacagaua

SEQ ID NO: 1285418 - RNA, 17 nt, Homo sapiens
acuuaaaagaacaugua

SEQ ID NO: 1285419 - RNA, 14 nt, Homo sapiens
acuuagaaugccau

SEQ ID NO: 1285420 - RNA, 16 nt, Homo sapiens
acuuaguguacaugaa

SEQ ID NO: 1285421 - RNA, 14 nt, Homo sapiens
acuucacgcuuuca

SEQ ID NO: 1285422 - RNA, 19 nt, Homo sapiens
acuuccuauaugcacuuau

SEQ ID NO: 1285423 - RNA, 15 nt, Homo sapiens
acuucuaaaugcaua

SEQ ID NO: 1285424 - RNA, 17 nt, Homo sapiens
acuugacagaacacugu

SEQ ID NO: 1285425 - RNA, 16 nt, Homo sapiens
acuugaucauucucag

SEQ ID NO: 1285426 - RNA, 15 nt, Homo sapiens
acuugcacaaaauca

SEQ ID NO: 1285427 - RNA, 20 nt, Homo sapiens
acuugcacaaaaucacacag

SEQ ID NO: 1285428 - RNA, 21 nt, Homo sapiens
acuugcacaaaaucacacagc

SEQ ID NO: 1285429 - RNA, 21 nt, Homo sapiens
acuuucucuagcaaguguaag

SEQ ID NO: 1285430 - RNA, 17 nt, Homo sapiens
acuuugggauucuuucc

SEQ ID NO: 1285431 - RNA, 17 nt, Homo sapiens
acuuuugaagaacaaaa

SEQ ID NO: 1285432 - RNA, 17 nt, Homo sapiens
agaaaaugaauuugacu

SEQ ID NO: 1285433 - RNA, 20 nt, Homo sapiens
agaaaaugugucugcaacau

SEQ ID NO: 1285434 - RNA, 19 nt, Homo sapiens
agaaacugcucuaauauca

SEQ ID NO: 1285435 - RNA, 21 nt, Homo sapiens
agaaaggacccucaagacaaa

SEQ ID NO: 1285436 - RNA, 12 nt, Homo sapiens
agaaaggcauga

SEQ ID NO: 1285437 - RNA, 21 nt, Homo sapiens
agaaagucuaucuaaugacau

SEQ ID NO: 1285438 - RNA, 15 nt, Homo sapiens
agaaauaaauaaucu

SEQ ID NO: 1285439 - RNA, 21 nt, Homo sapiens
agaaauagaggugaugcugcu

SEQ ID NO: 1285440 - RNA, 19 nt, Homo sapiens
agaaauuugccaauuuacu

SEQ ID NO: 1285441 - RNA, 22 nt, Homo sapiens
agaacauggugugugucucuga

SEQ ID NO: 1285442 - RNA, 19 nt, Homo sapiens
agaagacuauauuguacac

SEQ ID NO: 1285443 - RNA, 14 nt, Homo sapiens
agaagguccuuaau

SEQ ID NO: 1285444 - RNA, 24 nt, Homo sapiens
agaaguaagcagaguucuuugcaa

SEQ ID NO: 1285445 - RNA, 16 nt, Homo sapiens
agaaguaggcucugau

SEQ ID NO: 1285446 - RNA, 13 nt, Homo sapiens
agaagucacucac

SEQ ID NO: 1285447 - RNA, 20 nt, Homo sapiens
agaaguuggucuuacuuugu

SEQ ID NO: 1285448 - RNA, 18 nt, Homo sapiens
agaaguuuuuuacuuugg

SEQ ID NO: 1285449 - RNA, 15 nt, Homo sapiens
agaaucaacagcucc

SEQ ID NO: 1285450 - RNA, 18 nt, Homo sapiens
agaaucuguuaccagagg

SEQ ID NO: 1285451 - RNA, 22 nt, Homo sapiens
agaaucuguuaccagaggacaa

SEQ ID NO: 1285452 - RNA, 16 nt, Homo sapiens
agaaugcccagugacc

SEQ ID NO: 1285453 - RNA, 13 nt, Homo sapiens
agaauggaacuca

SEQ ID NO: 1285454 - RNA, 20 nt, Homo sapiens
agaauugugcuggucauaca

SEQ ID NO: 1285455 - RNA, 14 nt, Homo sapiens
agacagcuucucau

SEQ ID NO: 1285456 - RNA, 14 nt, Homo sapiens
agacaugaaccaag

SEQ ID NO: 1285457 - RNA, 15 nt, Homo sapiens
agacaugugcacuug

SEQ ID NO: 1285458 - RNA, 17 nt, Homo sapiens
agacucgagaacuuuca

SEQ ID NO: 1285459 - RNA, 18 nt, Homo sapiens
agacuguuccuguuugcu

SEQ ID NO: 1285460 - RNA, 20 nt, Homo sapiens
agacuuagaaaaauccuaca

SEQ ID NO: 1285461 - RNA, 21 nt, Homo sapiens
agacuuagaaaaauccuacaa

SEQ ID NO: 1285462 - RNA, 15 nt, Homo sapiens
agagaaaagacauaa

SEQ ID NO: 1285463 - RNA, 14 nt, Homo sapiens
agagaaauuugcca

SEQ ID NO: 1285464 - RNA, 12 nt, Homo sapiens
agagacaucaaa

SEQ ID NO: 1285465 - RNA, 16 nt, Homo sapiens
agagacgcagacaugu

SEQ ID NO: 1285466 - RNA, 17 nt, Homo sapiens
agagaggacacaucucc

SEQ ID NO: 1285467 - RNA, 18 nt, Homo sapiens
agagaggugccacacuga

SEQ ID NO: 1285468 - RNA, 14 nt, Homo sapiens
agagcagaugcaga

SEQ ID NO: 1285469 - RNA, 16 nt, Homo sapiens
agagcuacacaaacac

SEQ ID NO: 1285470 - RNA, 15 nt, Homo sapiens
agagggaagaucugg

SEQ ID NO: 1285471 - RNA, 14 nt, Homo sapiens
agaggggcuggacc

SEQ ID NO: 1285472 - RNA, 13 nt, Homo sapiens
agaggggguagcu

SEQ ID NO: 1285473 - RNA, 19 nt, Homo sapiens
agaggggguagcuagccug

SEQ ID NO: 1285474 - RNA, 22 nt, Homo sapiens
agagugguuaagacuacugaag

SEQ ID NO: 1285475 - RNA, 16 nt, Homo sapiens
agaguguuugugagcu

SEQ ID NO: 1285476 - RNA, 13 nt, Homo sapiens
agauaagcaagag

SEQ ID NO: 1285477 - RNA, 22 nt, Homo sapiens
agauaagggugucuuccuagaa

SEQ ID NO: 1285478 - RNA, 18 nt, Homo sapiens
agauaagucuacauuaaa

SEQ ID NO: 1285479 - RNA, 21 nt, Homo sapiens
agauacaugguugugaccuga

SEQ ID NO: 1285480 - RNA, 16 nt, Homo sapiens
agauacauucacauuc

SEQ ID NO: 1285481 - RNA, 19 nt, Homo sapiens
agauauugugaaguacaua

SEQ ID NO: 1285482 - RNA, 19 nt, Homo sapiens
agaucaaugaaaugauguc

SEQ ID NO: 1285483 - RNA, 22 nt, Homo sapiens
agaucaaugaaaugaugucaua

SEQ ID NO: 1285484 - RNA, 20 nt, Homo sapiens
agauccaaaugcugugcaaa

SEQ ID NO: 1285485 - RNA, 17 nt, Homo sapiens
agaucuacuacauccca

SEQ ID NO: 1285486 - RNA, 14 nt, Homo sapiens
agaucucaugagaa

SEQ ID NO: 1285487 - RNA, 18 nt, Homo sapiens
agaugauucaaauaucaa

SEQ ID NO: 1285488 - RNA, 19 nt, Homo sapiens
agauguagucucacacugu

SEQ ID NO: 1285489 - RNA, 16 nt, Homo sapiens
agauuccgcaccaaua

SEQ ID NO: 1285490 - RNA, 13 nt, Homo sapiens
agauuucaucugc

SEQ ID NO: 1285491 - RNA, 13 nt, Homo sapiens
agauuugccuuau

SEQ ID NO: 1285492 - RNA, 13 nt, Homo sapiens
agcaacugcagaa

SEQ ID NO: 1285493 - RNA, 19 nt, Homo sapiens
agcaagucacuggccagug

SEQ ID NO: 1285494 - RNA, 21 nt, Homo sapiens
agcacauuuggcuuacaguaa

SEQ ID NO: 1285495 - RNA, 20 nt, Homo sapiens
agcacccucuccagaugcag

SEQ ID NO: 1285496 - RNA, 17 nt, Homo sapiens
agcacguguggccuguu

SEQ ID NO: 1285497 - RNA, 15 nt, Homo sapiens
agcacugaggaagaa

SEQ ID NO: 1285498 - RNA, 17 nt, Homo sapiens
agcaggcuugugcuuua

SEQ ID NO: 1285499 - RNA, 13 nt, Homo sapiens
agcaguuuuguga

SEQ ID NO: 1285500 - RNA, 21 nt, Homo sapiens
agcaucacuugggauuaauau

SEQ ID NO: 1285501 - RNA, 15 nt, Homo sapiens
agcauguguauuucc

SEQ ID NO: 1285502 - RNA, 23 nt, Homo sapiens
agccaagcucccuggagcccugu

SEQ ID NO: 1285503 - RNA, 20 nt, Homo sapiens
agccacaggccugagauuuc

SEQ ID NO: 1285504 - RNA, 16 nt, Homo sapiens
agccacuucacuuuuu

SEQ ID NO: 1285505 - RNA, 17 nt, Homo sapiens
agccagaggucuggccc

SEQ ID NO: 1285506 - RNA, 15 nt, Homo sapiens
agccagaucucauga

SEQ ID NO: 1285507 - RNA, 16 nt, Homo sapiens
agcccaugaucuucaa

SEQ ID NO: 1285508 - RNA, 20 nt, Homo sapiens
agcccauuucuuuauugcau

SEQ ID NO: 1285509 - RNA, 23 nt, Homo sapiens
agcccauuucuuuauugcaucug

SEQ ID NO: 1285510 - RNA, 16 nt, Homo sapiens
agcccucccacuuugc

SEQ ID NO: 1285511 - RNA, 21 nt, Homo sapiens
agcccuguuggcagcucuagc

SEQ ID NO: 1285512 - RNA, 14 nt, Homo sapiens
agccuaguacaaua

SEQ ID NO: 1285513 - RNA, 14 nt, Homo sapiens
agccucagcucuca

SEQ ID NO: 1285514 - RNA, 23 nt, Homo sapiens
agccuguugggaucgcauugcau

SEQ ID NO: 1285515 - RNA, 14 nt, Homo sapiens
agcggacaguggca

SEQ ID NO: 1285516 - RNA, 15 nt, Homo sapiens
agcuaaagaggcuga

SEQ ID NO: 1285517 - RNA, 23 nt, Homo sapiens
agcuaaguugcaccaacuuugaa

SEQ ID NO: 1285518 - RNA, 13 nt, Homo sapiens
agcuaccaggugu

SEQ ID NO: 1285519 - RNA, 14 nt, Homo sapiens
agcuaccagguguu

SEQ ID NO: 1285520 - RNA, 23 nt, Homo sapiens
agcuaccagguguucuacacuca

SEQ ID NO: 1285521 - RNA, 10 nt, Homo sapiens
agcuacugaa

SEQ ID NO: 1285522 - RNA, 20 nt, Homo sapiens
agcuagccagucacuaggaa

SEQ ID NO: 1285523 - RNA, 16 nt, Homo sapiens
agcuauuagccaggau

SEQ ID NO: 1285524 - RNA, 21 nt, Homo sapiens
agcucagagaggcuagaugau

SEQ ID NO: 1285525 - RNA, 17 nt, Homo sapiens
agcucagcccauuucuu

SEQ ID NO: 1285526 - RNA, 14 nt, Homo sapiens
agcugcacuacagc

SEQ ID NO: 1285527 - RNA, 20 nt, Homo sapiens
agcugguggauggugacuuu

SEQ ID NO: 1285528 - RNA, 20 nt, Homo sapiens
agcuggugguaucugaguug

SEQ ID NO: 1285529 - RNA, 12 nt, Homo sapiens
agcuucucuaca

SEQ ID NO: 1285530 - RNA, 20 nt, Homo sapiens
agcuucucuacagacuccaa

SEQ ID NO: 1285531 - RNA, 21 nt, Homo sapiens
agcuucucuacagacuccaaa

SEQ ID NO: 1285532 - RNA, 16 nt, Homo sapiens
agcuucucugcugcuu

SEQ ID NO: 1285533 - RNA, 22 nt, Homo sapiens
agcuuggaaacuggaugagguc

SEQ ID NO: 1285534 - RNA, 15 nt, Homo sapiens
agcuuucucuaguuc

SEQ ID NO: 1285535 - RNA, 13 nt, Homo sapiens
agcuuugcaggau

SEQ ID NO: 1285536 - RNA, 16 nt, Homo sapiens
aggaaaggaugaucaa

SEQ ID NO: 1285537 - RNA, 12 nt, Homo sapiens
aggaaggagcug

SEQ ID NO: 1285538 - RNA, 13 nt, Homo sapiens
aggaauauuugca

SEQ ID NO: 1285539 - RNA, 17 nt, Homo sapiens
aggacaaacagugaauu

SEQ ID NO: 1285540 - RNA, 20 nt, Homo sapiens
aggacaaacagugaauuuaa

SEQ ID NO: 1285541 - RNA, 12 nt, Homo sapiens
aggacaaagccu

SEQ ID NO: 1285542 - RNA, 12 nt, Homo sapiens
aggacauuccaa

SEQ ID NO: 1285543 - RNA, 21 nt, Homo sapiens
aggaggccguugauucacuuc

SEQ ID NO: 1285544 - RNA, 21 nt, Homo sapiens
aggaguacaccccaacagcac

SEQ ID NO: 1285545 - RNA, 14 nt, Homo sapiens
aggagucagggaga

SEQ ID NO: 1285546 - RNA, 20 nt, Homo sapiens
aggauccccucucuuccuac

SEQ ID NO: 1285547 - RNA, 23 nt, Homo sapiens
aggaugagagcccagagguaaca

SEQ ID NO: 1285548 - RNA, 23 nt, Homo sapiens
aggaugaucaaaaauaaugcauc

SEQ ID NO: 1285549 - RNA, 15 nt, Homo sapiens
aggcaaagaacaauu

SEQ ID NO: 1285550 - RNA, 11 nt, Homo sapiens
aggcacuucac

SEQ ID NO: 1285551 - RNA, 18 nt, Homo sapiens
aggcagaucccacuugca

SEQ ID NO: 1285552 - RNA, 15 nt, Homo sapiens
aggccagcaccaucu

SEQ ID NO: 1285553 - RNA, 17 nt, Homo sapiens
aggccagcaccaucucu

SEQ ID NO: 1285554 - RNA, 19 nt, Homo sapiens
aggccaggaguucccaaau

SEQ ID NO: 1285555 - RNA, 17 nt, Homo sapiens
aggccauucuugcauug

SEQ ID NO: 1285556 - RNA, 16 nt, Homo sapiens
aggcccuuuucagggc

SEQ ID NO: 1285557 - RNA, 20 nt, Homo sapiens
aggccguugauucacuucac

SEQ ID NO: 1285558 - RNA, 16 nt, Homo sapiens
aggccugagauuucau

SEQ ID NO: 1285559 - RNA, 23 nt, Homo sapiens
aggccugagauuucaucugcucu

SEQ ID NO: 1285560 - RNA, 15 nt, Homo sapiens
aggcuguacauaguc

SEQ ID NO: 1285561 - RNA, 23 nt, Homo sapiens
aggcugucuaccugaagcuggac

SEQ ID NO: 1285562 - RNA, 20 nt, Homo sapiens
agggaaagggggcuaguccc

SEQ ID NO: 1285563 - RNA, 23 nt, Homo sapiens
agggaaagguaaauacaagugaa

SEQ ID NO: 1285564 - RNA, 15 nt, Homo sapiens
agggagaagcaugaa

SEQ ID NO: 1285565 - RNA, 16 nt, Homo sapiens
agggagagagugcuau

SEQ ID NO: 1285566 - RNA, 19 nt, Homo sapiens
agggaugguaauccuuuaa

SEQ ID NO: 1285567 - RNA, 18 nt, Homo sapiens
agggauuuggggcucaga

SEQ ID NO: 1285568 - RNA, 18 nt, Homo sapiens
agggcagccagggagagc

SEQ ID NO: 1285569 - RNA, 19 nt, Homo sapiens
aggggagucaccagccaga

SEQ ID NO: 1285570 - RNA, 20 nt, Homo sapiens
aggggccagaagaugaacag

SEQ ID NO: 1285571 - RNA, 14 nt, Homo sapiens
aggggcucucucau

SEQ ID NO: 1285572 - RNA, 19 nt, Homo sapiens
agggucuucuuacaugcau

SEQ ID NO: 1285573 - RNA, 18 nt, Homo sapiens
agguagaguuugaucaua

SEQ ID NO: 1285574 - RNA, 15 nt, Homo sapiens
aggugccacacugaa

SEQ ID NO: 1285575 - RNA, 15 nt, Homo sapiens
aggugcuacuuuaua

SEQ ID NO: 1285576 - RNA, 21 nt, Homo sapiens
aggugggccuugcuaccucaa

SEQ ID NO: 1285577 - RNA, 19 nt, Homo sapiens
aggugugaggacuucugca

SEQ ID NO: 1285578 - RNA, 18 nt, Homo sapiens
agguuaucgaaauaacaa

SEQ ID NO: 1285579 - RNA, 19 nt, Homo sapiens
agguuucuggcagccagua

SEQ ID NO: 1285580 - RNA, 17 nt, Homo sapiens
aguacaccccaacagca

SEQ ID NO: 1285581 - RNA, 18 nt, Homo sapiens
aguacaccccaacagcac

SEQ ID NO: 1285582 - RNA, 12 nt, Homo sapiens
aguauuaacucu

SEQ ID NO: 1285583 - RNA, 19 nt, Homo sapiens
agucacuucaccaucaaca

SEQ ID NO: 1285584 - RNA, 22 nt, Homo sapiens
agucaucuaccugaguccugaa

SEQ ID NO: 1285585 - RNA, 20 nt, Homo sapiens
agucccauccucuugucagg

SEQ ID NO: 1285586 - RNA, 18 nt, Homo sapiens
agucuggcaaacaugugc

SEQ ID NO: 1285587 - RNA, 15 nt, Homo sapiens
agucugguagcucag

SEQ ID NO: 1285588 - RNA, 19 nt, Homo sapiens
agucuugcauugaauuuag

SEQ ID NO: 1285589 - RNA, 17 nt, Homo sapiens
agucuugguaacaaaua

SEQ ID NO: 1285590 - RNA, 22 nt, Homo sapiens
agugaacaaaaaggggaaguau

SEQ ID NO: 1285591 - RNA, 12 nt, Homo sapiens
agugacagaucc

SEQ ID NO: 1285592 - RNA, 22 nt, Homo sapiens
agugagaaaauccuaggugcua

SEQ ID NO: 1285593 - RNA, 20 nt, Homo sapiens
agugcaauaccuggcagcua

SEQ ID NO: 1285594 - RNA, 12 nt, Homo sapiens
agugcacuuaau

SEQ ID NO: 1285595 - RNA, 12 nt, Homo sapiens
agugcauuauuu

SEQ ID NO: 1285596 - RNA, 15 nt, Homo sapiens
agugcguguguagag

SEQ ID NO: 1285597 - RNA, 12 nt, Homo sapiens
agugcucagcua

SEQ ID NO: 1285598 - RNA, 19 nt, Homo sapiens
agugggggugggggguccc

SEQ ID NO: 1285599 - RNA, 12 nt, Homo sapiens
aguguaauucca

SEQ ID NO: 1285600 - RNA, 20 nt, Homo sapiens
agugucaggaggaaggcuua

SEQ ID NO: 1285601 - RNA, 22 nt, Homo sapiens
aguguugauucuagaugaucaa

SEQ ID NO: 1285602 - RNA, 18 nt, Homo sapiens
aguuaagaagcuguugua

SEQ ID NO: 1285603 - RNA, 16 nt, Homo sapiens
aguugcuuuuauugca

SEQ ID NO: 1285604 - RNA, 19 nt, Homo sapiens
aguuguccagaucacugaa

SEQ ID NO: 1285605 - RNA, 23 nt, Homo sapiens
aguuuaaggguggaaaaaugccc

SEQ ID NO: 1285606 - RNA, 23 nt, Homo sapiens
aguuuauagaccagaaccagagc

SEQ ID NO: 1285607 - RNA, 14 nt, Homo sapiens
aguuucaggugaca

SEQ ID NO: 1285608 - RNA, 20 nt, Homo sapiens
aguuuucugcuuuaauuuca

SEQ ID NO: 1285609 - RNA, 14 nt, Homo sapiens
auaaaaaacauaau

SEQ ID NO: 1285610 - RNA, 15 nt, Homo sapiens
auaaaauuauuugca

SEQ ID NO: 1285611 - RNA, 12 nt, Homo sapiens
auaaacuuugaa

SEQ ID NO: 1285612 - RNA, 13 nt, Homo sapiens
auaaagugacaga

SEQ ID NO: 1285613 - RNA, 21 nt, Homo sapiens
auaacugugaugaaauaugaa

SEQ ID NO: 1285614 - RNA, 23 nt, Homo sapiens
auaagcagucauccucagaucau

SEQ ID NO: 1285615 - RNA, 15 nt, Homo sapiens
auaagucuacauuaa

SEQ ID NO: 1285616 - RNA, 21 nt, Homo sapiens
auaauaaaaagcuucagggaa

SEQ ID NO: 1285617 - RNA, 20 nt, Homo sapiens
auaauacguguguaccuaaa

SEQ ID NO: 1285618 - RNA, 23 nt, Homo sapiens
auaauagguuugugacuuuccua

SEQ ID NO: 1285619 - RNA, 19 nt, Homo sapiens
auaaucaugcucauguaua

SEQ ID NO: 1285620 - RNA, 15 nt, Homo sapiens
auaaugcauccagca

SEQ ID NO: 1285621 - RNA, 22 nt, Homo sapiens
auacacaucucugucaguguga

SEQ ID NO: 1285622 - RNA, 12 nt, Homo sapiens
auacagugucuu

SEQ ID NO: 1285623 - RNA, 14 nt, Homo sapiens
auaccccauuugau

SEQ ID NO: 1285624 - RNA, 17 nt, Homo sapiens
auacuucaauacuucau

SEQ ID NO: 1285625 - RNA, 19 nt, Homo sapiens
auagaagaugggaaaacca

SEQ ID NO: 1285626 - RNA, 15 nt, Homo sapiens
auagcaccuccacau

SEQ ID NO: 1285627 - RNA, 18 nt, Homo sapiens
auagcaccuccacauacc

SEQ ID NO: 1285628 - RNA, 20 nt, Homo sapiens
auagcaccuccacauaccug

SEQ ID NO: 1285629 - RNA, 14 nt, Homo sapiens
auagcacuggucac

SEQ ID NO: 1285630 - RNA, 21 nt, Homo sapiens
auagccuagauaugaauauau

SEQ ID NO: 1285631 - RNA, 21 nt, Homo sapiens
auaguagaaagacaucugccu

SEQ ID NO: 1285632 - RNA, 23 nt, Homo sapiens
auaguguuggaaaaugugcaaua

SEQ ID NO: 1285633 - RNA, 23 nt, Homo sapiens
auauaaaauguuucaagcgcuua

SEQ ID NO: 1285634 - RNA, 23 nt, Homo sapiens
auauaauuuugaaaaguaaaaau

SEQ ID NO: 1285635 - RNA, 19 nt, Homo sapiens
auaugcacuuauucucaag

SEQ ID NO: 1285636 - RNA, 17 nt, Homo sapiens
auauuaguugcuuuguu

SEQ ID NO: 1285637 - RNA, 15 nt, Homo sapiens
auauugaccauguga

SEQ ID NO: 1285638 - RNA, 19 nt, Homo sapiens
auauuugugugaggacuuc

SEQ ID NO: 1285639 - RNA, 18 nt, Homo sapiens
auauuuuuaugugcaaua

SEQ ID NO: 1285640 - RNA, 12 nt, Homo sapiens
aucaaacaugaa

SEQ ID NO: 1285641 - RNA, 17 nt, Homo sapiens
aucaacauuuguuccau

SEQ ID NO: 1285642 - RNA, 18 nt, Homo sapiens
aucaacauuuguuccaug

SEQ ID NO: 1285643 - RNA, 14 nt, Homo sapiens
aucaagucagcaac

SEQ ID NO: 1285644 - RNA, 19 nt, Homo sapiens
aucaccucucuguaucccc

SEQ ID NO: 1285645 - RNA, 22 nt, Homo sapiens
aucacucugugucugaguggcu

SEQ ID NO: 1285646 - RNA, 22 nt, Homo sapiens
aucacuuccuauaugcacuuau

SEQ ID NO: 1285647 - RNA, 20 nt, Homo sapiens
aucagaacuggaccaucucc

SEQ ID NO: 1285648 - RNA, 17 nt, Homo sapiens
aucauagcacuggucac

SEQ ID NO: 1285649 - RNA, 13 nt, Homo sapiens
aucaucuccaguu

SEQ ID NO: 1285650 - RNA, 12 nt, Homo sapiens
aucauucaucuu

SEQ ID NO: 1285651 - RNA, 15 nt, Homo sapiens
auccacuucucucag

SEQ ID NO: 1285652 - RNA, 22 nt, Homo sapiens
auccccggugguuuugugcuca

SEQ ID NO: 1285653 - RNA, 17 nt, Homo sapiens
auccugaccuugcacaa

SEQ ID NO: 1285654 - RNA, 12 nt, Homo sapiens
aucucacuaaaa

SEQ ID NO: 1285655 - RNA, 14 nt, Homo sapiens
aucucagucacuuu

SEQ ID NO: 1285656 - RNA, 13 nt, Homo sapiens
aucuccaguaucc

SEQ ID NO: 1285657 - RNA, 13 nt, Homo sapiens
aucugaacauuua

SEQ ID NO: 1285658 - RNA, 17 nt, Homo sapiens
aucugagaggccacagu

SEQ ID NO: 1285659 - RNA, 20 nt, Homo sapiens
aucugaguuugaagcuuucc

SEQ ID NO: 1285660 - RNA, 20 nt, Homo sapiens
aucugcaauguuuuugugua

SEQ ID NO: 1285661 - RNA, 23 nt, Homo sapiens
aucugcuuuugguuauaaugugu

SEQ ID NO: 1285662 - RNA, 23 nt, Homo sapiens
aucugugaggggcucucucauga

SEQ ID NO: 1285663 - RNA, 20 nt, Homo sapiens
aucuguuaccagaggacaaa

SEQ ID NO: 1285664 - RNA, 15 nt, Homo sapiens
aucuuacagucagca

SEQ ID NO: 1285665 - RNA, 19 nt, Homo sapiens
aucuugaucaaccaaaaac

SEQ ID NO: 1285666 - RNA, 11 nt, Homo sapiens
aucuuuggaca

SEQ ID NO: 1285667 - RNA, 14 nt, Homo sapiens
aucuuuggacagaa

SEQ ID NO: 1285668 - RNA, 20 nt, Homo sapiens
aucuuuggacagaagcagcu

SEQ ID NO: 1285669 - RNA, 18 nt, Homo sapiens
augaaaagauuaugaucu

SEQ ID NO: 1285670 - RNA, 15 nt, Homo sapiens
augaaagugaugaca

SEQ ID NO: 1285671 - RNA, 14 nt, Homo sapiens
augaacuuuccaca

SEQ ID NO: 1285672 - RNA, 13 nt, Homo sapiens
augacaaauuuag

SEQ ID NO: 1285673 - RNA, 11 nt, Homo sapiens
augacauauuu

SEQ ID NO: 1285674 - RNA, 17 nt, Homo sapiens
augacugagucuggcaa

SEQ ID NO: 1285675 - RNA, 21 nt, Homo sapiens
augagaauguauuaguacaaa

SEQ ID NO: 1285676 - RNA, 22 nt, Homo sapiens
augagcuggggaugucucucau

SEQ ID NO: 1285677 - RNA, 23 nt, Homo sapiens
augagcuggggaugucucucaug

SEQ ID NO: 1285678 - RNA, 23 nt, Homo sapiens
augagcugugcacaaaguggcau

SEQ ID NO: 1285679 - RNA, 17 nt, Homo sapiens
augaggaauauuugcaa

SEQ ID NO: 1285680 - RNA, 21 nt, Homo sapiens
augagggugacguagaauuga

SEQ ID NO: 1285681 - RNA, 22 nt, Homo sapiens
augaugagguuuucuuaacuua

SEQ ID NO: 1285682 - RNA, 18 nt, Homo sapiens
augauuuuuguguaucca

SEQ ID NO: 1285683 - RNA, 16 nt, Homo sapiens
augcaacaacauguau

SEQ ID NO: 1285684 - RNA, 18 nt, Homo sapiens
augcaaccuuuggaugca

SEQ ID NO: 1285685 - RNA, 22 nt, Homo sapiens
augcaaccuuuggaugcacuuu

SEQ ID NO: 1285686 - RNA, 18 nt, Homo sapiens
augcaggggccacaucca

SEQ ID NO: 1285687 - RNA, 18 nt, Homo sapiens
augcaugcgaacauaaau

SEQ ID NO: 1285688 - RNA, 16 nt, Homo sapiens
augcauuugcacuauu

SEQ ID NO: 1285689 - RNA, 15 nt, Homo sapiens
augccagaauauaau

SEQ ID NO: 1285690 - RNA, 21 nt, Homo sapiens
augcuacaagacgggcaaaau

SEQ ID NO: 1285691 - RNA, 14 nt, Homo sapiens
augcugcaguucca

SEQ ID NO: 1285692 - RNA, 19 nt, Homo sapiens
augcugcaguuccaaaaga

SEQ ID NO: 1285693 - RNA, 18 nt, Homo sapiens
augcugugcaaacagugu

SEQ ID NO: 1285694 - RNA, 16 nt, Homo sapiens
augcuguuuaugacac

SEQ ID NO: 1285695 - RNA, 17 nt, Homo sapiens
augcuuauguguugcau

SEQ ID NO: 1285696 - RNA, 21 nt, Homo sapiens
augcuuauguguugcauaaac

SEQ ID NO: 1285697 - RNA, 15 nt, Homo sapiens
augcuuccugacaau

SEQ ID NO: 1285698 - RNA, 19 nt, Homo sapiens
auggaaugucaguguucag

SEQ ID NO: 1285699 - RNA, 18 nt, Homo sapiens
auggaggcgcugcugcca

SEQ ID NO: 1285700 - RNA, 19 nt, Homo sapiens
auggccccugccuucccag

SEQ ID NO: 1285701 - RNA, 20 nt, Homo sapiens
auggccucaagaucaaugaa

SEQ ID NO: 1285702 - RNA, 22 nt, Homo sapiens
auggccucuuuguccauuauuc

SEQ ID NO: 1285703 - RNA, 20 nt, Homo sapiens
auggcuauaaacaauuacau

SEQ ID NO: 1285704 - RNA, 14 nt, Homo sapiens
auggcucuaaaaag

SEQ ID NO: 1285705 - RNA, 13 nt, Homo sapiens
augggaaaaccau

SEQ ID NO: 1285706 - RNA, 15 nt, Homo sapiens
augggaaggguccau

SEQ ID NO: 1285707 - RNA, 15 nt, Homo sapiens
auggguugcauuugg

SEQ ID NO: 1285708 - RNA, 21 nt, Homo sapiens
auggguuucuccagagggaau

SEQ ID NO: 1285709 - RNA, 14 nt, Homo sapiens
auggucccaaauga

SEQ ID NO: 1285710 - RNA, 18 nt, Homo sapiens
auggugcuaaaccauuca

SEQ ID NO: 1285711 - RNA, 21 nt, Homo sapiens
augguuugcaaggaagccaca

SEQ ID NO: 1285712 - RNA, 23 nt, Homo sapiens
auguaaaaucuucagcuggugga

SEQ ID NO: 1285713 - RNA, 20 nt, Homo sapiens
caagggggacugucuuucag

SEQ ID NO: 1285714 - RNA, 23 nt, Homo sapiens
caaggugggccuugcuaccucaa

SEQ ID NO: 1285715 - RNA, 16 nt, Homo sapiens
caagugucuagaguca

SEQ ID NO: 1285716 - RNA, 18 nt, Homo sapiens
caauaaaauuauuugcag

SEQ ID NO: 1285717 - RNA, 19 nt, Homo sapiens
caauaaagccuucaaacuc

SEQ ID NO: 1285718 - RNA, 14 nt, Homo sapiens
caauagcaugcaaa

SEQ ID NO: 1285719 - RNA, 15 nt, Homo sapiens
caauagcaugcaaaa

SEQ ID NO: 1285720 - RNA, 22 nt, Homo sapiens
caauauuuccauguuucauuaa

SEQ ID NO: 1285721 - RNA, 18 nt, Homo sapiens
caaucauguaaaucuaua

SEQ ID NO: 1285722 - RNA, 15 nt, Homo sapiens
caauuaaaaucucaa

SEQ ID NO: 1285723 - RNA, 20 nt, Homo sapiens
caauucuaacuuuuuugcua

SEQ ID NO: 1285724 - RNA, 13 nt, Homo sapiens
ucagagacaucag

SEQ ID NO: 1285725 - RNA, 14 nt, Homo sapiens
ucagaucauuauca

SEQ ID NO: 1285726 - RNA, 13 nt, Homo sapiens
ucagcaacagagc

SEQ ID NO: 1285727 - RNA, 19 nt, Homo sapiens
ucagcacguguggccuguu

SEQ ID NO: 1285728 - RNA, 16 nt, Homo sapiens
ucagcucaggcagcuc

SEQ ID NO: 1285729 - RNA, 17 nt, Homo sapiens
ucaggagcuuuacucau

SEQ ID NO: 1285730 - RNA, 16 nt, Homo sapiens
ucaggcuuuggauguu

SEQ ID NO: 1285731 - RNA, 18 nt, Homo sapiens
ucagggaagcugccaaag

SEQ ID NO: 1285732 - RNA, 11 nt, Homo sapiens
ucaguaugugg

SEQ ID NO: 1285733 - RNA, 22 nt, Homo sapiens
ucagugauugcaauuugcacaa

SEQ ID NO: 1285734 - RNA, 14 nt, Homo sapiens
ucauaacauugauu

SEQ ID NO: 1285735 - RNA, 17 nt, Homo sapiens
ucauaaugaacacucau

SEQ ID NO: 1285736 - RNA, 12 nt, Homo sapiens
ucauacucuuaa

SEQ ID NO: 1285737 - RNA, 13 nt, Homo sapiens
ucauccaaggaac

SEQ ID NO: 1285738 - RNA, 15 nt, Homo sapiens
ucaucuguaccucug

SEQ ID NO: 1285739 - RNA, 23 nt, Homo sapiens
ucaucuuagugccugagaguauu

SEQ ID NO: 1285740 - RNA, 22 nt, Homo sapiens
ucaugaacacagccugggacca

SEQ ID NO: 1285741 - RNA, 18 nt, Homo sapiens
ucaugagaagucacucac

SEQ ID NO: 1285742 - RNA, 15 nt, Homo sapiens
ucaugaugaacucac

SEQ ID NO: 1285743 - RNA, 13 nt, Homo sapiens
ucaugcauuugca

SEQ ID NO: 1285744 - RNA, 19 nt, Homo sapiens
ucauguuuacagaggacag

SEQ ID NO: 1285745 - RNA, 12 nt, Homo sapiens
ucauuacagggc

SEQ ID NO: 1285746 - RNA, 11 nt, Homo sapiens
ucauuaccuca

SEQ ID NO: 1285747 - RNA, 20 nt, Homo sapiens
ucauuauuucaucaugacug

SEQ ID NO: 1285748 - RNA, 20 nt, Homo sapiens
ucauucaauaaauuguaauu

SEQ ID NO: 1285749 - RNA, 15 nt, Homo sapiens
ucauuccuaacacag

SEQ ID NO: 1285750 - RNA, 22 nt, Homo sapiens
ucauugggaaaggacagcuuug

SEQ ID NO: 1285751 - RNA, 13 nt, Homo sapiens
uccaaaaagggga

SEQ ID NO: 1285752 - RNA, 13 nt, Homo sapiens
uccaaaaggcccu

SEQ ID NO: 1285753 - RNA, 19 nt, Homo sapiens
uccaaccccccagcacuga

SEQ ID NO: 1285754 - RNA, 14 nt, Homo sapiens
uccaagagauccau

SEQ ID NO: 1285755 - RNA, 22 nt, Homo sapiens
uccaaugauacccaacaguuua

SEQ ID NO: 1285756 - RNA, 14 nt, Homo sapiens
uccaccaccaccug

SEQ ID NO: 1285757 - RNA, 18 nt, Homo sapiens
uccagaccauucaggaca

SEQ ID NO: 1285758 - RNA, 17 nt, Homo sapiens
uccagaugagaguacac

SEQ ID NO: 1285759 - RNA, 14 nt, Homo sapiens
uccagcaguacaau

SEQ ID NO: 1285760 - RNA, 20 nt, Homo sapiens
uccaggauagucuaagggag

SEQ ID NO: 1285761 - RNA, 20 nt, Homo sapiens
uccauccauggggcugauug

SEQ ID NO: 1285762 - RNA, 17 nt, Homo sapiens
uccauugguguugacau

SEQ ID NO: 1285763 - RNA, 19 nt, Homo sapiens
ucccaaguucuuucuccau

SEQ ID NO: 1285764 - RNA, 11 nt, Homo sapiens
ucccagcauug

SEQ ID NO: 1285765 - RNA, 14 nt, Homo sapiens
ucccaggaguacac

SEQ ID NO: 1285766 - RNA, 21 nt, Homo sapiens
ucccauuugcccuccuccuca

SEQ ID NO: 1285767 - RNA, 18 nt, Homo sapiens
ucccauuugggcaguaua

SEQ ID NO: 1285768 - RNA, 16 nt, Homo sapiens
uccccuccaaccuggg

SEQ ID NO: 1285769 - RNA, 20 nt, Homo sapiens
uccccugcccccugcaggaa

SEQ ID NO: 1285770 - RNA, 15 nt, Homo sapiens
uccccuucucucauc

SEQ ID NO: 1285771 - RNA, 14 nt, Homo sapiens
ucccucauccauag

SEQ ID NO: 1285772 - RNA, 18 nt, Homo sapiens
ucccugaagagaagggca

SEQ ID NO: 1285773 - RNA, 20 nt, Homo sapiens
ucccugaagagaagggcagg

SEQ ID NO: 1285774 - RNA, 20 nt, Homo sapiens
ucccugaagucuugcauuga

SEQ ID NO: 1285775 - RNA, 17 nt, Homo sapiens
ucccugccuguuucccg

SEQ ID NO: 1285776 - RNA, 13 nt, Homo sapiens
ucccuuuuucaca

SEQ ID NO: 1285777 - RNA, 20 nt, Homo sapiens
uccgcugucggcacauucag

SEQ ID NO: 1285778 - RNA, 17 nt, Homo sapiens
uccguuccacauccaca

SEQ ID NO: 1285779 - RNA, 19 nt, Homo sapiens
uccuaauauuuugauucau

SEQ ID NO: 1285780 - RNA, 16 nt, Homo sapiens
uccuacuuauugccau

SEQ ID NO: 1285781 - RNA, 20 nt, Homo sapiens
uccuacuuauugccaugugg

SEQ ID NO: 1285782 - RNA, 17 nt, Homo sapiens
uccuaggaaggggacug

SEQ ID NO: 1285783 - RNA, 14 nt, Homo sapiens
uccucaaagggaga

SEQ ID NO: 1285784 - RNA, 17 nt, Homo sapiens
uccucagaucauuauca

SEQ ID NO: 1285785 - RNA, 23 nt, Homo sapiens
uccucagggccacguuaccacag

SEQ ID NO: 1285786 - RNA, 17 nt, Homo sapiens
uccucuuuaccuguuca

SEQ ID NO: 1285787 - RNA, 13 nt, Homo sapiens
uccugaaagccac

SEQ ID NO: 1285788 - RNA, 19 nt, Homo sapiens
uccugaaagccacagacaa

SEQ ID NO: 1285789 - RNA, 22 nt, Homo sapiens
uccugaaagccacagacaauau

SEQ ID NO: 1285790 - RNA, 22 nt, Homo sapiens
uccugccccagauggcuuugug

SEQ ID NO: 1285791 - RNA, 20 nt, Homo sapiens
uccugccucagccuccugag

SEQ ID NO: 1285792 - RNA, 13 nt, Homo sapiens
uccuggacaguuu

SEQ ID NO: 1285793 - RNA, 21 nt, Homo sapiens
uccuggggaggauacugaggc

SEQ ID NO: 1285794 - RNA, 16 nt, Homo sapiens
uccugucccucaucca

SEQ ID NO: 1285795 - RNA, 22 nt, Homo sapiens
uccuuagccuuugucccagaau

SEQ ID NO: 1285796 - RNA, 17 nt, Homo sapiens
uccuuaugauauucuca

SEQ ID NO: 1285797 - RNA, 21 nt, Homo sapiens
uccuucuuugauaauguuaaa

SEQ ID NO: 1285798 - RNA, 17 nt, Homo sapiens
uccuuggucuccagugg

SEQ ID NO: 1285799 - RNA, 22 nt, Homo sapiens
uccuuucaagguaacuguacug

SEQ ID NO: 1285800 - RNA, 17 nt, Homo sapiens
uccuuuccccucccuca

SEQ ID NO: 1285801 - RNA, 13 nt, Homo sapiens
uccuuuuaucucc

SEQ ID NO: 1285802 - RNA, 15 nt, Homo sapiens
ucgagacugcaaugu

SEQ ID NO: 1285803 - RNA, 19 nt, Homo sapiens
ucgagacuuggguguuugu

SEQ ID NO: 1285804 - RNA, 23 nt, Homo sapiens
ucgcuaccuuuugcuguggcaaa

SEQ ID NO: 1285805 - RNA, 15 nt, Homo sapiens
ucgugcuaaacgcac

SEQ ID NO: 1285806 - RNA, 12 nt, Homo sapiens
ucuaacuuuaug

SEQ ID NO: 1285807 - RNA, 14 nt, Homo sapiens
ucuacagacuccaa

SEQ ID NO: 1285808 - RNA, 18 nt, Homo sapiens
ucuacagacuccaaaagg

SEQ ID NO: 1285809 - RNA, 20 nt, Homo sapiens
ucuacuacaucccacauuag

SEQ ID NO: 1285810 - RNA, 12 nt, Homo sapiens
ucuacuaccugu

SEQ ID NO: 1285811 - RNA, 23 nt, Homo sapiens
ucuacucugcuuuuuuucuacug

SEQ ID NO: 1285812 - RNA, 13 nt, Homo sapiens
ucuagaacacuca

SEQ ID NO: 1285813 - RNA, 19 nt, Homo sapiens
ucuagucaggggaaaagac

SEQ ID NO: 1285814 - RNA, 15 nt, Homo sapiens
ucuaucuaaugacau

SEQ ID NO: 1285815 - RNA, 12 nt, Homo sapiens
ucuaucugcaau

SEQ ID NO: 1285816 - RNA, 18 nt, Homo sapiens
ucucaggccugacucuca

SEQ ID NO: 1285817 - RNA, 18 nt, Homo sapiens
ucucaguauccacugucu

SEQ ID NO: 1285818 - RNA, 19 nt, Homo sapiens
ucucaucuuucuugaucaa

SEQ ID NO: 1285819 - RNA, 17 nt, Homo sapiens
ucucaugauagaaggcu

SEQ ID NO: 1285820 - RNA, 13 nt, Homo sapiens
ucucauuccagag

SEQ ID NO: 1285821 - RNA, 18 nt, Homo sapiens
ucucauucccuccccaga

SEQ ID NO: 1285822 - RNA, 21 nt, Homo sapiens
ucuccaaccccccagcacuga

SEQ ID NO: 1285823 - RNA, 19 nt, Homo sapiens
ucuccagaugagaguacac

SEQ ID NO: 1285824 - RNA, 18 nt, Homo sapiens
ucuccauggcccugccau

SEQ ID NO: 1285825 - RNA, 15 nt, Homo sapiens
ucuccccguggaccc

SEQ ID NO: 1285826 - RNA, 12 nt, Homo sapiens
ucuccugagcua

SEQ ID NO: 1285827 - RNA, 14 nt, Homo sapiens
ucucuacagacucc

SEQ ID NO: 1285828 - RNA, 16 nt, Homo sapiens
ucucuacagacuccaa

SEQ ID NO: 1285829 - RNA, 12 nt, Homo sapiens
ucucucaucucu

SEQ ID NO: 1285830 - RNA, 15 nt, Homo sapiens
ucucugccuugguau

SEQ ID NO: 1285831 - RNA, 16 nt, Homo sapiens
ucucuggcuuccaugc

SEQ ID NO: 1285832 - RNA, 17 nt, Homo sapiens
ucucuguuuuguaagcu

SEQ ID NO: 1285833 - RNA, 21 nt, Homo sapiens
ucucuguuuuguaagcuuuaa

SEQ ID NO: 1285834 - RNA, 15 nt, Homo sapiens
ucucuuccuacccuu

SEQ ID NO: 1285835 - RNA, 20 nt, Homo sapiens
aauaauacguguguaccuaa

SEQ ID NO: 1285836 - RNA, 16 nt, Homo sapiens
aauaaugucucuguga

SEQ ID NO: 1285837 - RNA, 18 nt, Homo sapiens
aauacucaauuuacuaau

SEQ ID NO: 1285838 - RNA, 14 nt, Homo sapiens
aauacucucugaaa

SEQ ID NO: 1285839 - RNA, 17 nt, Homo sapiens
aauagccuagauaugaa

SEQ ID NO: 1285840 - RNA, 20 nt, Homo sapiens
aauaguguccuaugcaauaa

SEQ ID NO: 1285841 - RNA, 14 nt, Homo sapiens
aauauaaacacuau

SEQ ID NO: 1285842 - RNA, 20 nt, Homo sapiens
aauaugacggaagaacauag

SEQ ID NO: 1285843 - RNA, 15 nt, Homo sapiens
aauaugagaauguau

SEQ ID NO: 1285844 - RNA, 14 nt, Homo sapiens
aauaugcagugaua

SEQ ID NO: 1285845 - RNA, 23 nt, Homo sapiens
aauauuuuccaugaaaaugcaac

SEQ ID NO: 1285846 - RNA, 17 nt, Homo sapiens
aauauuuuuaugugcaa

SEQ ID NO: 1285847 - RNA, 19 nt, Homo sapiens
aauauuuuuaugugcaaua

SEQ ID NO: 1285848 - RNA, 14 nt, Homo sapiens
aaucaagauuuaau

SEQ ID NO: 1285849 - RNA, 20 nt, Homo sapiens
aaucaagucagcaacagagc

SEQ ID NO: 1285850 - RNA, 15 nt, Homo sapiens
aaucacucagugauu

SEQ ID NO: 1285851 - RNA, 14 nt, Homo sapiens
aaucccuccuucau

SEQ ID NO: 1285852 - RNA, 18 nt, Homo sapiens
aaucucggcucacugcaa

SEQ ID NO: 1285853 - RNA, 13 nt, Homo sapiens
aaucugcacugug

SEQ ID NO: 1285854 - RNA, 17 nt, Homo sapiens
aaucuucagaccuagaa

SEQ ID NO: 1285855 - RNA, 12 nt, Homo sapiens
aaugaaagcaug

SEQ ID NO: 1285856 - RNA, 14 nt, Homo sapiens
aaugaugggucagu

SEQ ID NO: 1285857 - RNA, 14 nt, Homo sapiens
aaugauguuuuccu

SEQ ID NO: 1285858 - RNA, 22 nt, Homo sapiens
aaugauuuaaauagaacuugau

SEQ ID NO: 1285859 - RNA, 16 nt, Homo sapiens
aaugcaacaacaugua

SEQ ID NO: 1285860 - RNA, 23 nt, Homo sapiens
aaugcauuagauuaucaaaaagu

SEQ ID NO: 1285861 - RNA, 18 nt, Homo sapiens
aaugccacauacuugcag

SEQ ID NO: 1285862 - RNA, 18 nt, Homo sapiens
aaugcccauuuuugcuaa

SEQ ID NO: 1285863 - RNA, 23 nt, Homo sapiens
aaugcuaggaguagaaaaugguc

SEQ ID NO: 1285864 - RNA, 21 nt, Homo sapiens
aauggaaaguuaccuuacuga

SEQ ID NO: 1285865 - RNA, 18 nt, Homo sapiens
aauggaggcaacgccaga

SEQ ID NO: 1285866 - RNA, 17 nt, Homo sapiens
aauggugaaaugcagag

SEQ ID NO: 1285867 - RNA, 20 nt, Homo sapiens
aaugucuguauuucauucuu

SEQ ID NO: 1285868 - RNA, 11 nt, Homo sapiens
aaugugcaaua

SEQ ID NO: 1285869 - RNA, 19 nt, Homo sapiens
aaugugucugcaacaugga

SEQ ID NO: 1285870 - RNA, 18 nt, Homo sapiens
aauguuuuaaacauucuu

SEQ ID NO: 1285871 - RNA, 16 nt, Homo sapiens
aauuaauuuacuagaa

SEQ ID NO: 1285872 - RNA, 16 nt, Homo sapiens
aauuagaaauaucuuc

SEQ ID NO: 1285873 - RNA, 17 nt, Homo sapiens
aauuagguccacuucaa

SEQ ID NO: 1285874 - RNA, 23 nt, Homo sapiens
aauucagugauggcaacacugaa

SEQ ID NO: 1285875 - RNA, 17 nt, Homo sapiens
aauucaucucucuuuaa

SEQ ID NO: 1285876 - RNA, 21 nt, Homo sapiens
aauucuauuacgugcaauacu

SEQ ID NO: 1285877 - RNA, 14 nt, Homo sapiens
aauugagucuucca

SEQ ID NO: 1285878 - RNA, 20 nt, Homo sapiens
aauugcagaguacuggcuga

SEQ ID NO: 1285879 - RNA, 12 nt, Homo sapiens
aauuuacuuugu

SEQ ID NO: 1285880 - RNA, 12 nt, Homo sapiens
aauuucacuuaa

SEQ ID NO: 1285881 - RNA, 22 nt, Homo sapiens
aauuugacugguucaccugugu

SEQ ID NO: 1285882 - RNA, 13 nt, Homo sapiens
aauuuuuuauuca

SEQ ID NO: 1285883 - RNA, 11 nt, Homo sapiens
acaaacaguga

SEQ ID NO: 1285884 - RNA, 20 nt, Homo sapiens
acaacauguauguggauaca

SEQ ID NO: 1285885 - RNA, 19 nt, Homo sapiens
acaaccucauuuuaacuca

SEQ ID NO: 1285886 - RNA, 22 nt, Homo sapiens
acaagacaggacccugggacca

SEQ ID NO: 1285887 - RNA, 21 nt, Homo sapiens
acaagcagcaggaaacauaga

SEQ ID NO: 1285888 - RNA, 21 nt, Homo sapiens
acaagucaguuucuacacugg

SEQ ID NO: 1285889 - RNA, 12 nt, Homo sapiens
acaauguugcac

SEQ ID NO: 1285890 - RNA, 17 nt, Homo sapiens
acacaguaaaagcagga

SEQ ID NO: 1285891 - RNA, 19 nt, Homo sapiens
acaccagagcagaugcaga

SEQ ID NO: 1285892 - RNA, 17 nt, Homo sapiens
acaccauuuuccugccu

SEQ ID NO: 1285893 - RNA, 19 nt, Homo sapiens
acaccauuuuccugccuca

SEQ ID NO: 1285894 - RNA, 20 nt, Homo sapiens
acacucccacuuggcaucau

SEQ ID NO: 1285895 - RNA, 17 nt, Homo sapiens
acacugaaggaacaguu

SEQ ID NO: 1285896 - RNA, 12 nt, Homo sapiens
acacugugaugu

SEQ ID NO: 1285897 - RNA, 21 nt, Homo sapiens
acagaacacugucuugaagac

SEQ ID NO: 1285898 - RNA, 23 nt, Homo sapiens
acagaacuaucucagcaucagaa

SEQ ID NO: 1285899 - RNA, 15 nt, Homo sapiens
acagacacucccacu

SEQ ID NO: 1285900 - RNA, 13 nt, Homo sapiens
acagacuccaaaa

SEQ ID NO: 1285901 - RNA, 16 nt, Homo sapiens
acagagaaaagacaua

SEQ ID NO: 1285902 - RNA, 23 nt, Homo sapiens
acagcaucaaagagauggugcua

SEQ ID NO: 1285903 - RNA, 13 nt, Homo sapiens
acagcauguguau

SEQ ID NO: 1285904 - RNA, 13 nt, Homo sapiens
acagcucuuguuu

SEQ ID NO: 1285905 - RNA, 14 nt, Homo sapiens
acagcugucauaua

SEQ ID NO: 1285906 - RNA, 19 nt, Homo sapiens
acagcuucucuacagacuc

SEQ ID NO: 1285907 - RNA, 17 nt, Homo sapiens
acaggaaaucaugaggg

SEQ ID NO: 1285908 - RNA, 21 nt, Homo sapiens
acaggacccugggaccacaga

SEQ ID NO: 1285909 - RNA, 20 nt, Homo sapiens
acaggccauggauggaaaac

SEQ ID NO: 1285910 - RNA, 14 nt, Homo sapiens
acaggccugagauu

SEQ ID NO: 1285911 - RNA, 21 nt, Homo sapiens
acaguaaaagcaggagcgaga

SEQ ID NO: 1285912 - RNA, 18 nt, Homo sapiens
acaguaaaugaacugauu

SEQ ID NO: 1285913 - RNA, 23 nt, Homo sapiens
acagucugcucaacacgacugca

SEQ ID NO: 1285914 - RNA, 10 nt, Homo sapiens
acagugcaag

SEQ ID NO: 1285915 - RNA, 14 nt, Homo sapiens
acaguguaagcuua

SEQ ID NO: 1285916 - RNA, 22 nt, Homo sapiens
acaguuuucugcuuuaauuuca

SEQ ID NO: 1285917 - RNA, 20 nt, Homo sapiens
acauaacguuuuuccuuuaa

SEQ ID NO: 1285918 - RNA, 14 nt, Homo sapiens
acauagaacucaga

SEQ ID NO: 1285919 - RNA, 21 nt, Homo sapiens
acauagccagauguagucuca

SEQ ID NO: 1285920 - RNA, 14 nt, Homo sapiens
acauauuaagaaua

SEQ ID NO: 1285921 - RNA, 16 nt, Homo sapiens
acaucaucucuuccau

SEQ ID NO: 1285922 - RNA, 19 nt, Homo sapiens
acauccagauagguuacca

SEQ ID NO: 1285923 - RNA, 20 nt, Homo sapiens
acauccugaccuugcacaaa

SEQ ID NO: 1285924 - RNA, 19 nt, Homo sapiens
acaugggaccuauaacugc

SEQ ID NO: 1285925 - RNA, 15 nt, Homo sapiens
acaugugcacuugaa

SEQ ID NO: 1285926 - RNA, 20 nt, Homo sapiens
acauucuacacacagugccu

SEQ ID NO: 1285927 - RNA, 14 nt, Homo sapiens
acauuuguuccaug

SEQ ID NO: 1285928 - RNA, 22 nt, Homo sapiens
acauuuuguuuauguuacuuaa

SEQ ID NO: 1285929 - RNA, 15 nt, Homo sapiens
accaacccauguaua

SEQ ID NO: 1285930 - RNA, 15 nt, Homo sapiens
accaaggggguaaaa

SEQ ID NO: 1285931 - RNA, 16 nt, Homo sapiens
accaaggggguaaaaa

SEQ ID NO: 1285932 - RNA, 17 nt, Homo sapiens
accaauaaagccuucaa

SEQ ID NO: 1285933 - RNA, 11 nt, Homo sapiens
accacuuugaa

SEQ ID NO: 1285934 - RNA, 13 nt, Homo sapiens
accagaggacaaa

SEQ ID NO: 1285935 - RNA, 18 nt, Homo sapiens
accagccuggcccacccc

SEQ ID NO: 1285936 - RNA, 22 nt, Homo sapiens
accagguagaacacaaggucau

SEQ ID NO: 1285937 - RNA, 19 nt, Homo sapiens
accaguaacggaacaguau

SEQ ID NO: 1285938 - RNA, 16 nt, Homo sapiens
accauauaacugugau

SEQ ID NO: 1285939 - RNA, 13 nt, Homo sapiens
accaugguaauaa

SEQ ID NO: 1285940 - RNA, 17 nt, Homo sapiens
accauuaccagaggguc

SEQ ID NO: 1285941 - RNA, 15 nt, Homo sapiens
accauucaugaugaa

SEQ ID NO: 1285942 - RNA, 23 nt, Homo sapiens
acccaaaagaauuaaauugauua

SEQ ID NO: 1285943 - RNA, 17 nt, Homo sapiens
acccaaugaaugaugau

SEQ ID NO: 1285944 - RNA, 20 nt, Homo sapiens
acccaccucucuggcuucca

SEQ ID NO: 1285945 - RNA, 13 nt, Homo sapiens
acccacuauccca

SEQ ID NO: 1285946 - RNA, 22 nt, Homo sapiens
acccacuaucccauuugcccuc

SEQ ID NO: 1285947 - RNA, 20 nt, Homo sapiens
caauguuuuaaacauucuuc

SEQ ID NO: 1285948 - RNA, 21 nt, Homo sapiens
caauuaaucaaaccacuguua

SEQ ID NO: 1285949 - RNA, 19 nt, Homo sapiens
caauucuuacaaacaugug

SEQ ID NO: 1285950 - RNA, 17 nt, Homo sapiens
cacaaaagaagaaauaa

SEQ ID NO: 1285951 - RNA, 12 nt, Homo sapiens
cacaauguugca

SEQ ID NO: 1285952 - RNA, 19 nt, Homo sapiens
cacaccugcggcccaaucc

SEQ ID NO: 1285953 - RNA, 20 nt, Homo sapiens
cacacugagacuugaaucaa

SEQ ID NO: 1285954 - RNA, 20 nt, Homo sapiens
cacagacccaaaccauacca

SEQ ID NO: 1285955 - RNA, 20 nt, Homo sapiens
cacagaggggagucaccagc

SEQ ID NO: 1285956 - RNA, 13 nt, Homo sapiens
cacagcacccaug

SEQ ID NO: 1285957 - RNA, 14 nt, Homo sapiens
cacaggccugagau

SEQ ID NO: 1285958 - RNA, 23 nt, Homo sapiens
cacauaccuggcccugugccuug

SEQ ID NO: 1285959 - RNA, 16 nt, Homo sapiens
cacauacuugcagcuc

SEQ ID NO: 1285960 - RNA, 18 nt, Homo sapiens
cacauccacacagccaau

SEQ ID NO: 1285961 - RNA, 20 nt, Homo sapiens
cacauccucugucuauuuga

SEQ ID NO: 1285962 - RNA, 21 nt, Homo sapiens
cacauccucugucuauuugag

SEQ ID NO: 1285963 - RNA, 16 nt, Homo sapiens
cacaucuaaagcuuua

SEQ ID NO: 1285964 - RNA, 18 nt, Homo sapiens
cacaucuaaagcuuuauc

SEQ ID NO: 1285965 - RNA, 15 nt, Homo sapiens
cacauugcacuucug

SEQ ID NO: 1285966 - RNA, 15 nt, Homo sapiens
caccaccagcuuaaa

SEQ ID NO: 1285967 - RNA, 19 nt, Homo sapiens
caccagccagaggaugcau

SEQ ID NO: 1285968 - RNA, 18 nt, Homo sapiens
caccauuuuccugccuca

SEQ ID NO: 1285969 - RNA, 21 nt, Homo sapiens
cacccgguccccucugcccca

SEQ ID NO: 1285970 - RNA, 14 nt, Homo sapiens
caccuauugaauua

SEQ ID NO: 1285971 - RNA, 15 nt, Homo sapiens
caccucacuagcucc

SEQ ID NO: 1285972 - RNA, 16 nt, Homo sapiens
caccugggcugaggca

SEQ ID NO: 1285973 - RNA, 20 nt, Homo sapiens
cacgcggccccacauugcac

SEQ ID NO: 1285974 - RNA, 21 nt, Homo sapiens
cacucuuaucuuacaacuccc

SEQ ID NO: 1285975 - RNA, 11 nt, Homo sapiens
cacugcuguag

SEQ ID NO: 1285976 - RNA, 15 nt, Homo sapiens
cacugugaaaccccc

SEQ ID NO: 1285977 - RNA, 16 nt, Homo sapiens
cacugugggcuuuuau

SEQ ID NO: 1285978 - RNA, 18 nt, Homo sapiens
cacuucuaaaugcauauc

SEQ ID NO: 1285979 - RNA, 12 nt, Homo sapiens
cacuucucucag

SEQ ID NO: 1285980 - RNA, 15 nt, Homo sapiens
cagaaauuguaucuu

SEQ ID NO: 1285981 - RNA, 13 nt, Homo sapiens
cagaacacugucu

SEQ ID NO: 1285982 - RNA, 16 nt, Homo sapiens
cagaacacugucuuga

SEQ ID NO: 1285983 - RNA, 15 nt, Homo sapiens
cagaaccagagcuca

SEQ ID NO: 1285984 - RNA, 23 nt, Homo sapiens
cagaagaaauucugcaagcuuuu

SEQ ID NO: 1285985 - RNA, 15 nt, Homo sapiens
cagaagaugaacaga

SEQ ID NO: 1285986 - RNA, 15 nt, Homo sapiens
cagaagcaguaauaa

SEQ ID NO: 1285987 - RNA, 14 nt, Homo sapiens
cagaaggcaaagca

SEQ ID NO: 1285988 - RNA, 22 nt, Homo sapiens
cagaaucagaucugagcuucau

SEQ ID NO: 1285989 - RNA, 23 nt, Homo sapiens
cagaccauucaggacacagggaa

SEQ ID NO: 1285990 - RNA, 14 nt, Homo sapiens
cagaccugccccuc

SEQ ID NO: 1285991 - RNA, 12 nt, Homo sapiens
cagacuccaaaa

SEQ ID NO: 1285992 - RNA, 23 nt, Homo sapiens
cagagagccauuuugugaaugga

SEQ ID NO: 1285993 - RNA, 21 nt, Homo sapiens
cagagauaagggugucuuccu

SEQ ID NO: 1285994 - RNA, 19 nt, Homo sapiens
cagagucaaugaacuuucc

SEQ ID NO: 1285995 - RNA, 18 nt, Homo sapiens
cagaucccacuugcagcc

SEQ ID NO: 1285996 - RNA, 20 nt, Homo sapiens
cagaucccacuugcagccuc

SEQ ID NO: 1285997 - RNA, 15 nt, Homo sapiens
cagauccccagccuc

SEQ ID NO: 1285998 - RNA, 14 nt, Homo sapiens
cagaugagaguaca

SEQ ID NO: 1285999 - RNA, 15 nt, Homo sapiens
cagauguagauauaa

SEQ ID NO: 1286000 - RNA, 13 nt, Homo sapiens
cagauguguuugc

SEQ ID NO: 1286001 - RNA, 14 nt, Homo sapiens
cagauuacuagaaa

SEQ ID NO: 1286002 - RNA, 21 nt, Homo sapiens
cagcaccaucucuuuaccucc

SEQ ID NO: 1286003 - RNA, 15 nt, Homo sapiens
cagcacccucuccag

SEQ ID NO: 1286004 - RNA, 19 nt, Homo sapiens
cagcacccucuccagauga

SEQ ID NO: 1286005 - RNA, 11 nt, Homo sapiens
cagcacugagg

SEQ ID NO: 1286006 - RNA, 23 nt, Homo sapiens
cagcaucaaagagauggugcuaa

SEQ ID NO: 1286007 - RNA, 12 nt, Homo sapiens
cagccagggccu

SEQ ID NO: 1286008 - RNA, 14 nt, Homo sapiens
cagccuggcaaggg

SEQ ID NO: 1286009 - RNA, 17 nt, Homo sapiens
cagcucuagcuuugcag

SEQ ID NO: 1286010 - RNA, 20 nt, Homo sapiens
cagcucuucuugacaucaag

SEQ ID NO: 1286011 - RNA, 12 nt, Homo sapiens
cagcugcugaag

SEQ ID NO: 1286012 - RNA, 13 nt, Homo sapiens
cagcuucagguua

SEQ ID NO: 1286013 - RNA, 17 nt, Homo sapiens
cagcuucucuacagacu

SEQ ID NO: 1286014 - RNA, 21 nt, Homo sapiens
cagcuucucuacagacuccaa

SEQ ID NO: 1286015 - RNA, 17 nt, Homo sapiens
cagcuuugauaaugucc

SEQ ID NO: 1286016 - RNA, 23 nt, Homo sapiens
caggaacacagacccaaaccaua

SEQ ID NO: 1286017 - RNA, 15 nt, Homo sapiens
caggaacuugcacaa

SEQ ID NO: 1286018 - RNA, 15 nt, Homo sapiens
caggaagccaaagag

SEQ ID NO: 1286019 - RNA, 22 nt, Homo sapiens
caggacacagggaaaucagggu

SEQ ID NO: 1286020 - RNA, 21 nt, Homo sapiens
caggagagaaugcccagugac

SEQ ID NO: 1286021 - RNA, 21 nt, Homo sapiens
caggcaaucguggaugucucu

SEQ ID NO: 1286022 - RNA, 19 nt, Homo sapiens
caggcagaucccacuugca

SEQ ID NO: 1286023 - RNA, 19 nt, Homo sapiens
caggcagcuuuuucucucc

SEQ ID NO: 1286024 - RNA, 17 nt, Homo sapiens
caggccaggacucugca

SEQ ID NO: 1286025 - RNA, 18 nt, Homo sapiens
cagggaagccccagugag

SEQ ID NO: 1286026 - RNA, 20 nt, Homo sapiens
cagggaagccccagugagua

SEQ ID NO: 1286027 - RNA, 15 nt, Homo sapiens
cagggcagccaggga

SEQ ID NO: 1286028 - RNA, 21 nt, Homo sapiens
cagggcauuguguucacugua

SEQ ID NO: 1286029 - RNA, 15 nt, Homo sapiens
caggggcaugggaag

SEQ ID NO: 1286030 - RNA, 15 nt, Homo sapiens
cagguaccacguauu

SEQ ID NO: 1286031 - RNA, 22 nt, Homo sapiens
cagguguucuacacucaucuua

SEQ ID NO: 1286032 - RNA, 18 nt, Homo sapiens
caguaaacuaaggguguc

SEQ ID NO: 1286033 - RNA, 14 nt, Homo sapiens
caguauacaguccu

SEQ ID NO: 1286034 - RNA, 17 nt, Homo sapiens
caguauagguguuugcu

SEQ ID NO: 1286035 - RNA, 15 nt, Homo sapiens
caguauccaguacuc

SEQ ID NO: 1286036 - RNA, 18 nt, Homo sapiens
caguggcuggaucuguga

SEQ ID NO: 1286037 - RNA, 21 nt, Homo sapiens
caguguucagccaaacaguau

SEQ ID NO: 1286038 - RNA, 18 nt, Homo sapiens
caguuaaaauguguuucu

SEQ ID NO: 1286039 - RNA, 13 nt, Homo sapiens
caguuccaaugag

SEQ ID NO: 1286040 - RNA, 19 nt, Homo sapiens
caguuguccagaucacuga

SEQ ID NO: 1286041 - RNA, 19 nt, Homo sapiens
caguuucuuagcuuuuuaa

SEQ ID NO: 1286042 - RNA, 22 nt, Homo sapiens
caguuugcaguauacacacuuu

SEQ ID NO: 1286043 - RNA, 19 nt, Homo sapiens
cauaaaauugcaguuucau

SEQ ID NO: 1286044 - RNA, 21 nt, Homo sapiens
cauaccuggcccugugccuug

SEQ ID NO: 1286045 - RNA, 22 nt, Homo sapiens
cauaccuggcccugugccuugg

SEQ ID NO: 1286046 - RNA, 15 nt, Homo sapiens
cauagauugcaaaua

SEQ ID NO: 1286047 - RNA, 18 nt, Homo sapiens
cauaucucuagucccugu

SEQ ID NO: 1286048 - RNA, 20 nt, Homo sapiens
cauauguuuuuguaaguuua

SEQ ID NO: 1286049 - RNA, 13 nt, Homo sapiens
cauauuaccagcu

SEQ ID NO: 1286050 - RNA, 15 nt, Homo sapiens
caucagaaugagaaa

SEQ ID NO: 1286051 - RNA, 15 nt, Homo sapiens
caucagugaucucac

SEQ ID NO: 1286052 - RNA, 23 nt, Homo sapiens
caucauuaauaccuaaacuguau

SEQ ID NO: 1286053 - RNA, 15 nt, Homo sapiens
cauccagauagguua

SEQ ID NO: 1286054 - RNA, 18 nt, Homo sapiens
caucccgucgacucucca

SEQ ID NO: 1286055 - RNA, 17 nt, Homo sapiens
cauccugaccuugcaca

SEQ ID NO: 1286056 - RNA, 19 nt, Homo sapiens
cauccugaccuugcacaaa

SEQ ID NO: 1286057 - RNA, 9 nt, Homo sapiens
caucucuag

SEQ ID NO: 1286058 - RNA, 13 nt, Homo sapiens
uuuaugcauacag

SEQ ID NO: 1286059 - RNA, 15 nt, Homo sapiens
uuuauguacaggaug

SEQ ID NO: 1286060 - RNA, 19 nt, Homo sapiens
uuuauuuuauagagcagaa

SEQ ID NO: 1286061 - RNA, 12 nt, Homo sapiens
uuucacuacucu

SEQ ID NO: 1286062 - RNA, 13 nt, Homo sapiens
uuucacugccaua

SEQ ID NO: 1286063 - RNA, 18 nt, Homo sapiens
uuucagauuccacacaaa

SEQ ID NO: 1286064 - RNA, 18 nt, Homo sapiens
uuucagugagaaaauccu

SEQ ID NO: 1286065 - RNA, 13 nt, Homo sapiens
uuucauagauuug

SEQ ID NO: 1286066 - RNA, 14 nt, Homo sapiens
uuucauucuuguug

SEQ ID NO: 1286067 - RNA, 10 nt, Homo sapiens
uuuccagaaa

SEQ ID NO: 1286068 - RNA, 15 nt, Homo sapiens
uuucuccucuccauc

SEQ ID NO: 1286069 - RNA, 18 nt, Homo sapiens
uuucucgccucacuuucc

SEQ ID NO: 1286070 - RNA, 12 nt, Homo sapiens
uuucugcuuuaa

SEQ ID NO: 1286071 - RNA, 16 nt, Homo sapiens
uuucugucacaucagc

SEQ ID NO: 1286072 - RNA, 14 nt, Homo sapiens
uuugaaaaguaaaa

SEQ ID NO: 1286073 - RNA, 17 nt, Homo sapiens
uuugagaagaaaaucag

SEQ ID NO: 1286074 - RNA, 18 nt, Homo sapiens
uuugaucuuuguuuaaau

SEQ ID NO: 1286075 - RNA, 19 nt, Homo sapiens
uuugaugaggcccuccaca

SEQ ID NO: 1286076 - RNA, 13 nt, Homo sapiens
uuugcaagacaua

SEQ ID NO: 1286077 - RNA, 22 nt, Homo sapiens
uuugccuuuccauaaucacuca

SEQ ID NO: 1286078 - RNA, 21 nt, Homo sapiens
uuuggcccaaacucaucuuga

SEQ ID NO: 1286079 - RNA, 19 nt, Homo sapiens
uuuguauaccaugaugcau

SEQ ID NO: 1286080 - RNA, 20 nt, Homo sapiens
uuugugcaaaagcaggcuug

SEQ ID NO: 1286081 - RNA, 17 nt, Homo sapiens
uuuguucucccaaaaca

SEQ ID NO: 1286082 - RNA, 21 nt, Homo sapiens
uuuuaaagaaaaugugucugc

SEQ ID NO: 1286083 - RNA, 17 nt, Homo sapiens
uuuuaacucaccucuca

SEQ ID NO: 1286084 - RNA, 15 nt, Homo sapiens
uuuuaaguaauuuca

SEQ ID NO: 1286085 - RNA, 15 nt, Homo sapiens
uuuuacacacugaaa

SEQ ID NO: 1286086 - RNA, 12 nt, Homo sapiens
uuuuacaccagu

SEQ ID NO: 1286087 - RNA, 12 nt, Homo sapiens
uuuuauuaucaa

SEQ ID NO: 1286088 - RNA, 14 nt, Homo sapiens
uuuucauacucuua

SEQ ID NO: 1286089 - RNA, 13 nt, Homo sapiens
uuuucauugggaa

SEQ ID NO: 1286090 - RNA, 12 nt, Homo sapiens
uuuuccuauaau

SEQ ID NO: 1286091 - RNA, 16 nt, Homo sapiens
uuuugaauacacaucu

SEQ ID NO: 1286092 - RNA, 22 nt, Homo sapiens
uuuugaauuuauauuguuucau

SEQ ID NO: 1286093 - RNA, 15 nt, Homo sapiens
uuuuguggcaaaaua

SEQ ID NO: 1286094 - RNA, 21 nt, Homo sapiens
uuuuuaaacaaaaaaagcauu

SEQ ID NO: 1286095 - RNA, 16 nt, Homo sapiens
uuuuuaugugcaauaa

SEQ ID NO: 1286096 - RNA, 21 nt, Homo sapiens
uuuuugaaaucagcauacuca

SEQ ID NO: 1286097 - RNA, 11 nt, Homo sapiens
uuuuugcagcu

SEQ ID NO: 1286098 - RNA, 22 nt, Homo sapiens
gaccuucuaggaagcuccaguu

SEQ ID NO: 1286099 - RNA, 12 nt, Homo sapiens
gaccuugcacaa

SEQ ID NO: 1286100 - RNA, 23 nt, Homo sapiens
gaccuuuuuaucuugaguguuau

SEQ ID NO: 1286101 - RNA, 22 nt, Homo sapiens
gacgggcaaaauaaagugacag

SEQ ID NO: 1286102 - RNA, 23 nt, Homo sapiens
gacgggcaaaauaaagugacaga

SEQ ID NO: 1286103 - RNA, 19 nt, Homo sapiens
gacuaugaggaauauuugc

SEQ ID NO: 1286104 - RNA, 23 nt, Homo sapiens
gacuauucccuucuaaccugaac

SEQ ID NO: 1286105 - RNA, 19 nt, Homo sapiens
gacuccaaaaggcccuuuu

SEQ ID NO: 1286106 - RNA, 22 nt, Homo sapiens
gacuccuuagagacaucaaaau

SEQ ID NO: 1286107 - RNA, 13 nt, Homo sapiens
gacucuccauuua

SEQ ID NO: 1286108 - RNA, 14 nt, Homo sapiens
gacuguaaaaccac

SEQ ID NO: 1286109 - RNA, 18 nt, Homo sapiens
gacuguucuuuuacaaga

SEQ ID NO: 1286110 - RNA, 22 nt, Homo sapiens
gacuuucugaagccucacuuau

SEQ ID NO: 1286111 - RNA, 12 nt, Homo sapiens
gagaaaugccag

SEQ ID NO: 1286112 - RNA, 18 nt, Homo sapiens
gagaagaaagaaccaacc

SEQ ID NO: 1286113 - RNA, 18 nt, Homo sapiens
gagaagaaugacuaugca

SEQ ID NO: 1286114 - RNA, 16 nt, Homo sapiens
gagaauguuguauuca

SEQ ID NO: 1286115 - RNA, 19 nt, Homo sapiens
gagacucgagaacuuucau

SEQ ID NO: 1286116 - RNA, 14 nt, Homo sapiens
gagagaggugccac

SEQ ID NO: 1286117 - RNA, 21 nt, Homo sapiens
gagagaggugccacacugaaa

SEQ ID NO: 1286118 - RNA, 12 nt, Homo sapiens
gagagauguuuu

SEQ ID NO: 1286119 - RNA, 19 nt, Homo sapiens
gagaguacaccccaacagc

SEQ ID NO: 1286120 - RNA, 11 nt, Homo sapiens
gagaucucuau

SEQ ID NO: 1286121 - RNA, 17 nt, Homo sapiens
gagauuucaucugcucu

SEQ ID NO: 1286122 - RNA, 23 nt, Homo sapiens
gagccaauugauuucaacagaau

SEQ ID NO: 1286123 - RNA, 17 nt, Homo sapiens
gagccauuuugugaaug

SEQ ID NO: 1286124 - RNA, 13 nt, Homo sapiens
gagcccaggagcu

SEQ ID NO: 1286125 - RNA, 19 nt, Homo sapiens
gagccuggcuccaaacccu

SEQ ID NO: 1286126 - RNA, 12 nt, Homo sapiens
gagcucagagag

SEQ ID NO: 1286127 - RNA, 20 nt, Homo sapiens
gagcuccccuccccaacuga

SEQ ID NO: 1286128 - RNA, 19 nt, Homo sapiens
gaggaggccguugauucac

SEQ ID NO: 1286129 - RNA, 19 nt, Homo sapiens
gaggagggucggugccuuc

SEQ ID NO: 1286130 - RNA, 12 nt, Homo sapiens
gaggcagggaac

SEQ ID NO: 1286131 - RNA, 18 nt, Homo sapiens
gaggccaggcagauccca

SEQ ID NO: 1286132 - RNA, 14 nt, Homo sapiens
gaggcggaucuuug

SEQ ID NO: 1286133 - RNA, 22 nt, Homo sapiens
gaggggcgagaaacaagacaag

SEQ ID NO: 1286134 - RNA, 21 nt, Homo sapiens
gagggucaaaggagaacaaga

SEQ ID NO: 1286135 - RNA, 13 nt, Homo sapiens
gagucgggacuaa

SEQ ID NO: 1286136 - RNA, 12 nt, Homo sapiens
gagucucugaac

SEQ ID NO: 1286137 - RNA, 20 nt, Homo sapiens
gagugacuuaguguacauga

SEQ ID NO: 1286138 - RNA, 14 nt, Homo sapiens
gagugcccccaaca

SEQ ID NO: 1286139 - RNA, 17 nt, Homo sapiens
gagugcccccaacagca

SEQ ID NO: 1286140 - RNA, 20 nt, Homo sapiens
gagugggguagguugggaga

SEQ ID NO: 1286141 - RNA, 15 nt, Homo sapiens
gaguugagugauaga

SEQ ID NO: 1286142 - RNA, 23 nt, Homo sapiens
gauacuaagugguggagccaaga

SEQ ID NO: 1286143 - RNA, 23 nt, Homo sapiens
gauacuccgcugucggcacauuc

SEQ ID NO: 1286144 - RNA, 21 nt, Homo sapiens
gauagguuaccaguaacggaa

SEQ ID NO: 1286145 - RNA, 20 nt, Homo sapiens
gauauuuccuucaccaccuc

SEQ ID NO: 1286146 - RNA, 19 nt, Homo sapiens
gaucacuuccuauaugcac

SEQ ID NO: 1286147 - RNA, 21 nt, Homo sapiens
gaucagaugcugaauugagaa

SEQ ID NO: 1286148 - RNA, 18 nt, Homo sapiens
gaucauuaucagccugug

SEQ ID NO: 1286149 - RNA, 14 nt, Homo sapiens
gauccacuucucuc

SEQ ID NO: 1286150 - RNA, 15 nt, Homo sapiens
gauccacuucucuca

SEQ ID NO: 1286151 - RNA, 19 nt, Homo sapiens
gauccaucaagacaauggg

SEQ ID NO: 1286152 - RNA, 15 nt, Homo sapiens
gaucuuuggacagaa

SEQ ID NO: 1286153 - RNA, 16 nt, Homo sapiens
gaucuuuggacagaag

SEQ ID NO: 1286154 - RNA, 15 nt, Homo sapiens
gaugaagcauuuaca

SEQ ID NO: 1286155 - RNA, 21 nt, Homo sapiens
gaugaggucauagcagugcuu

SEQ ID NO: 1286156 - RNA, 15 nt, Homo sapiens
gaugcagauccagag

SEQ ID NO: 1286157 - RNA, 23 nt, Homo sapiens
gaugccaucccgucgacucucca

SEQ ID NO: 1286158 - RNA, 23 nt, Homo sapiens
gauggugacuuuugaagaacaaa

SEQ ID NO: 1286159 - RNA, 18 nt, Homo sapiens
gauggugcuaaaccauuc

SEQ ID NO: 1286160 - RNA, 21 nt, Homo sapiens
gauggugugcuggcccugcgc

SEQ ID NO: 1286161 - RNA, 13 nt, Homo sapiens
gauguguggacac

SEQ ID NO: 1286162 - RNA, 15 nt, Homo sapiens
gauguuucugucaca

SEQ ID NO: 1286163 - RNA, 12 nt, Homo sapiens
gauuaaguacaa

SEQ ID NO: 1286164 - RNA, 23 nt, Homo sapiens
gauuccgcaccaauaaagccuuc

SEQ ID NO: 1286165 - RNA, 12 nt, Homo sapiens
gauucuccuuca

SEQ ID NO: 1286166 - RNA, 15 nt, Homo sapiens
gauugauuaccaagu

SEQ ID NO: 1286167 - RNA, 20 nt, Homo sapiens
gauuuaauccuagagauuug

SEQ ID NO: 1286168 - RNA, 23 nt, Homo sapiens
gauuucaccacucaaaggccaga

SEQ ID NO: 1286169 - RNA, 18 nt, Homo sapiens
gauuuuacacaccaccag

SEQ ID NO: 1286170 - RNA, 23 nt, Homo sapiens
gcaaaauaaagaauaugccguuu

SEQ ID NO: 1286171 - RNA, 18 nt, Homo sapiens
gcaaaauauucuucuuug

SEQ ID NO: 1286172 - RNA, 14 nt, Homo sapiens
gcaacagagcaaaa

SEQ ID NO: 1286173 - RNA, 20 nt, Homo sapiens
gcaaccagggagcugcaggg

SEQ ID NO: 1286174 - RNA, 19 nt, Homo sapiens
gcaaccuuuggaugcacuu

SEQ ID NO: 1286175 - RNA, 20 nt, Homo sapiens
gcacauaucuccucuugggc

SEQ ID NO: 1286176 - RNA, 13 nt, Homo sapiens
gcacccucuccag

SEQ ID NO: 1286177 - RNA, 15 nt, Homo sapiens
gcacccucuccagau

SEQ ID NO: 1286178 - RNA, 19 nt, Homo sapiens
gcacugaggaagaacgggg

SEQ ID NO: 1286179 - RNA, 16 nt, Homo sapiens
gcagaguacuggcuga

SEQ ID NO: 1286180 - RNA, 20 nt, Homo sapiens
gcagaguacuggcugaugga

SEQ ID NO: 1286181 - RNA, 13 nt, Homo sapiens
gcagauccagagg

SEQ ID NO: 1286182 - RNA, 18 nt, Homo sapiens
cuaaugaaagugaugaca

SEQ ID NO: 1286183 - RNA, 15 nt, Homo sapiens
cuaauuccacacccu

SEQ ID NO: 1286184 - RNA, 19 nt, Homo sapiens
cuacaaggcuggcagugac

SEQ ID NO: 1286185 - RNA, 14 nt, Homo sapiens
cuacaauuugccau

SEQ ID NO: 1286186 - RNA, 16 nt, Homo sapiens
cuacagacuccaaaag

SEQ ID NO: 1286187 - RNA, 19 nt, Homo sapiens
cuacaguuuuuaacucuac

SEQ ID NO: 1286188 - RNA, 15 nt, Homo sapiens
cuaccagcacauuaa

SEQ ID NO: 1286189 - RNA, 15 nt, Homo sapiens
cuacccacuucuccc

SEQ ID NO: 1286190 - RNA, 12 nt, Homo sapiens
cuaccucaaggg

SEQ ID NO: 1286191 - RNA, 20 nt, Homo sapiens
cuacuucccagcuaaucucc

SEQ ID NO: 1286192 - RNA, 14 nt, Homo sapiens
cuagagucauguga

SEQ ID NO: 1286193 - RNA, 15 nt, Homo sapiens
cuagcucuuggggaa

SEQ ID NO: 1286194 - RNA, 14 nt, Homo sapiens
cuaggaguagaaaa

SEQ ID NO: 1286195 - RNA, 21 nt, Homo sapiens
cuaggaguagaaaaugguccu

SEQ ID NO: 1286196 - RNA, 17 nt, Homo sapiens
cuaguagaacaauguac

SEQ ID NO: 1286197 - RNA, 22 nt, Homo sapiens
cuagucccuguguucugcacau

SEQ ID NO: 1286198 - RNA, 15 nt, Homo sapiens
cuaguuaacauuuca

SEQ ID NO: 1286199 - RNA, 12 nt, Homo sapiens
cuaguugcuugu

SEQ ID NO: 1286200 - RNA, 14 nt, Homo sapiens
cuauaaaguguuua

SEQ ID NO: 1286201 - RNA, 13 nt, Homo sapiens
cuauaacugccca

SEQ ID NO: 1286202 - RNA, 14 nt, Homo sapiens
cuauaugcacuuau

SEQ ID NO: 1286203 - RNA, 18 nt, Homo sapiens
cuaucuucuuucacauau

SEQ ID NO: 1286204 - RNA, 16 nt, Homo sapiens
cuauuacgugcaauac

SEQ ID NO: 1286205 - RNA, 12 nt, Homo sapiens
cuauuugccaug

SEQ ID NO: 1286206 - RNA, 23 nt, Homo sapiens
cuauuuuuauuuguuugugcauu

SEQ ID NO: 1286207 - RNA, 17 nt, Homo sapiens
cucaaaauaaaaagccu

SEQ ID NO: 1286208 - RNA, 22 nt, Homo sapiens
cucacaucacuguccaccacca

SEQ ID NO: 1286209 - RNA, 18 nt, Homo sapiens
cucacauccucugucuau

SEQ ID NO: 1286210 - RNA, 15 nt, Homo sapiens
cucagagacaucagc

SEQ ID NO: 1286211 - RNA, 15 nt, Homo sapiens
cucagcuagggccac

SEQ ID NO: 1286212 - RNA, 16 nt, Homo sapiens
cucaggggucauucau

SEQ ID NO: 1286213 - RNA, 13 nt, Homo sapiens
cucaguuccugcc

SEQ ID NO: 1286214 - RNA, 16 nt, Homo sapiens
cucauucugcauuaau

SEQ ID NO: 1286215 - RNA, 14 nt, Homo sapiens
cucauuuuaacuca

SEQ ID NO: 1286216 - RNA, 15 nt, Homo sapiens
cuccagaugagagua

SEQ ID NO: 1286217 - RNA, 18 nt, Homo sapiens
cuccauugguguugacau

SEQ ID NO: 1286218 - RNA, 12 nt, Homo sapiens
cuccccauuugc

SEQ ID NO: 1286219 - RNA, 14 nt, Homo sapiens
cucccccauugugu

SEQ ID NO: 1286220 - RNA, 13 nt, Homo sapiens
cuccccuuugccu

SEQ ID NO: 1286221 - RNA, 14 nt, Homo sapiens
cucccucuguguca

SEQ ID NO: 1286222 - RNA, 12 nt, Homo sapiens
cuccuccaggga

SEQ ID NO: 1286223 - RNA, 19 nt, Homo sapiens
cuccucuacaauuugccau

SEQ ID NO: 1286224 - RNA, 20 nt, Homo sapiens
cuccugaguaguugggauua

SEQ ID NO: 1286225 - RNA, 18 nt, Homo sapiens
cuccugccccaugcugcc

SEQ ID NO: 1286226 - RNA, 15 nt, Homo sapiens
cuccuuucuugcacu

SEQ ID NO: 1286227 - RNA, 15 nt, Homo sapiens
cucuacagacuccaa

SEQ ID NO: 1286228 - RNA, 20 nt, Homo sapiens
cucuacucuggagguuuguu

SEQ ID NO: 1286229 - RNA, 23 nt, Homo sapiens
cucuaucagaacuggaccaucuc

SEQ ID NO: 1286230 - RNA, 13 nt, Homo sapiens
cucucucaugaua

SEQ ID NO: 1286231 - RNA, 17 nt, Homo sapiens
cucuggcuuccaugcuc

SEQ ID NO: 1286232 - RNA, 19 nt, Homo sapiens
cucuuaaaucauuugguua

SEQ ID NO: 1286233 - RNA, 15 nt, Homo sapiens
cucuuaaguguaaau

SEQ ID NO: 1286234 - RNA, 12 nt, Homo sapiens
cucuuaucucag

SEQ ID NO: 1286235 - RNA, 23 nt, Homo sapiens
cucuuguagcauccuguuuguau

SEQ ID NO: 1286236 - RNA, 18 nt, Homo sapiens
cucuuuguccauuauuca

SEQ ID NO: 1286237 - RNA, 19 nt, Homo sapiens
cucuuuugaauccaugcuu

SEQ ID NO: 1286238 - RNA, 17 nt, Homo sapiens
cugaaagccacagacaa

SEQ ID NO: 1286239 - RNA, 19 nt, Homo sapiens
cugaaaguccugcuuuccu

SEQ ID NO: 1286240 - RNA, 18 nt, Homo sapiens
cugaaauuaaaguaugca

SEQ ID NO: 1286241 - RNA, 16 nt, Homo sapiens
cugaaccugggaacca

SEQ ID NO: 1286242 - RNA, 13 nt, Homo sapiens
cugaacucugcaa

SEQ ID NO: 1286243 - RNA, 18 nt, Homo sapiens
cugaacuuucucuagcaa

SEQ ID NO: 1286244 - RNA, 16 nt, Homo sapiens
cugaagccucacuuau

SEQ ID NO: 1286245 - RNA, 11 nt, Homo sapiens
cugacuccccc

SEQ ID NO: 1286246 - RNA, 23 nt, Homo sapiens
cugagcagguguucuucauuacc

SEQ ID NO: 1286247 - RNA, 23 nt, Homo sapiens
cugagcagugcuugaaugaaguu

SEQ ID NO: 1286248 - RNA, 14 nt, Homo sapiens
cugaggacauucca

SEQ ID NO: 1286249 - RNA, 22 nt, Homo sapiens
cugaguauugauaaacuuugaa

SEQ ID NO: 1286250 - RNA, 15 nt, Homo sapiens
cugauccuugcacgc

SEQ ID NO: 1286251 - RNA, 21 nt, Homo sapiens
cugauguccuaccacuuugaa

SEQ ID NO: 1286252 - RNA, 23 nt, Homo sapiens
cugcagucccauccucuugucag

SEQ ID NO: 1286253 - RNA, 23 nt, Homo sapiens
cugccuccuuuccccucccucag

SEQ ID NO: 1286254 - RNA, 19 nt, Homo sapiens
cugccucuuuuccccauga

SEQ ID NO: 1286255 - RNA, 18 nt, Homo sapiens
cugccugggccuguucac

SEQ ID NO: 1286256 - RNA, 22 nt, Homo sapiens
cugcuaaagggagaaaugccag

SEQ ID NO: 1286257 - RNA, 14 nt, Homo sapiens
cugcucuaauauca

SEQ ID NO: 1286258 - RNA, 18 nt, Homo sapiens
cugcuggugucuaguguu

SEQ ID NO: 1286259 - RNA, 15 nt, Homo sapiens
cugcuuccucugaau

SEQ ID NO: 1286260 - RNA, 18 nt, Homo sapiens
cugcuuucccuuuuccau

SEQ ID NO: 1286261 - RNA, 15 nt, Homo sapiens
cuggaggcagggaac

SEQ ID NO: 1286262 - RNA, 12 nt, Homo sapiens
cuggcccugugc

SEQ ID NO: 1286263 - RNA, 12 nt, Homo sapiens
cuggcuccaaac

SEQ ID NO: 1286264 - RNA, 16 nt, Homo sapiens
cuggcuccaaacccuc

SEQ ID NO: 1286265 - RNA, 15 nt, Homo sapiens
cuggcuuccaugcuc

SEQ ID NO: 1286266 - RNA, 13 nt, Homo sapiens
cugggaccacaga

SEQ ID NO: 1286267 - RNA, 17 nt, Homo sapiens
cuggggauuaccauuca

SEQ ID NO: 1286268 - RNA, 21 nt, Homo sapiens
cugggugauuuauaugaaaag

SEQ ID NO: 1286269 - RNA, 17 nt, Homo sapiens
cuguaaaauaguuuugc

SEQ ID NO: 1286270 - RNA, 19 nt, Homo sapiens
ggugcaugaagguuucuga

SEQ ID NO: 1286271 - RNA, 14 nt, Homo sapiens
gguggugucuccaa

SEQ ID NO: 1286272 - RNA, 23 nt, Homo sapiens
ggugugacuugauaaugauuucc

SEQ ID NO: 1286273 - RNA, 13 nt, Homo sapiens
gguuauaaugugu

SEQ ID NO: 1286274 - RNA, 15 nt, Homo sapiens
guaaacaaaggaauu

SEQ ID NO: 1286275 - RNA, 17 nt, Homo sapiens
guaaaguacagacuuuu

SEQ ID NO: 1286276 - RNA, 14 nt, Homo sapiens
guaaauaaagcuca

SEQ ID NO: 1286277 - RNA, 17 nt, Homo sapiens
guaagcuuuaagcgcaa

SEQ ID NO: 1286278 - RNA, 19 nt, Homo sapiens
guaaguuucaggugacaug

SEQ ID NO: 1286279 - RNA, 13 nt, Homo sapiens
guaauauucucug

SEQ ID NO: 1286280 - RNA, 18 nt, Homo sapiens
guacauuagucauucaau

SEQ ID NO: 1286281 - RNA, 21 nt, Homo sapiens
guacugaguauugauaaacuu

SEQ ID NO: 1286282 - RNA, 18 nt, Homo sapiens
guagaaagacaucugccu

SEQ ID NO: 1286283 - RNA, 16 nt, Homo sapiens
guagacauuugcuaug

SEQ ID NO: 1286284 - RNA, 15 nt, Homo sapiens
guagaguguuuguga

SEQ ID NO: 1286285 - RNA, 18 nt, Homo sapiens
guaucaaacuacugccau

SEQ ID NO: 1286286 - RNA, 14 nt, Homo sapiens
guaugacuaaagag

SEQ ID NO: 1286287 - RNA, 23 nt, Homo sapiens
guauuaacucuguaaaagugucu

SEQ ID NO: 1286288 - RNA, 21 nt, Homo sapiens
guauucuuugcgguauucuug

SEQ ID NO: 1286289 - RNA, 19 nt, Homo sapiens
guauuuccagugcaauugu

SEQ ID NO: 1286290 - RNA, 16 nt, Homo sapiens
guauuuuuaguagaga

SEQ ID NO: 1286291 - RNA, 17 nt, Homo sapiens
gucaacuuucauuugaa

SEQ ID NO: 1286292 - RNA, 19 nt, Homo sapiens
gucaaugaacuuuccacau

SEQ ID NO: 1286293 - RNA, 12 nt, Homo sapiens
gucacagccgcg

SEQ ID NO: 1286294 - RNA, 22 nt, Homo sapiens
gucacuuuuuccccugcaaugc

SEQ ID NO: 1286295 - RNA, 21 nt, Homo sapiens
gucagcuacuaaugauguuuu

SEQ ID NO: 1286296 - RNA, 22 nt, Homo sapiens
gucagucugaugagaacucuga

SEQ ID NO: 1286297 - RNA, 21 nt, Homo sapiens
gucaugcauaaauaugcagug

SEQ ID NO: 1286298 - RNA, 20 nt, Homo sapiens
gucauugcagaguucuuauu

SEQ ID NO: 1286299 - RNA, 16 nt, Homo sapiens
guccaaauacucugaa

SEQ ID NO: 1286300 - RNA, 13 nt, Homo sapiens
guccccuucuuuu

SEQ ID NO: 1286301 - RNA, 17 nt, Homo sapiens
guccuccuccagggaca

SEQ ID NO: 1286302 - RNA, 16 nt, Homo sapiens
guccugaaagccacag

SEQ ID NO: 1286303 - RNA, 16 nt, Homo sapiens
guccuugaaugccaua

SEQ ID NO: 1286304 - RNA, 13 nt, Homo sapiens
guccuuguguuga

SEQ ID NO: 1286305 - RNA, 22 nt, Homo sapiens
gucuccucuuaaaaaauaaaaa

SEQ ID NO: 1286306 - RNA, 20 nt, Homo sapiens
gucucugacaaagugugucu

SEQ ID NO: 1286307 - RNA, 17 nt, Homo sapiens
gucugggccacucaggg

SEQ ID NO: 1286308 - RNA, 19 nt, Homo sapiens
gucuguguguuuaugugug

SEQ ID NO: 1286309 - RNA, 16 nt, Homo sapiens
gucuuacuuugugcaa

SEQ ID NO: 1286310 - RNA, 23 nt, Homo sapiens
gucuuugaagugacuucacagag

SEQ ID NO: 1286311 - RNA, 20 nt, Homo sapiens
gugaaagcaucacuugggau

SEQ ID NO: 1286312 - RNA, 16 nt, Homo sapiens
gugacaaaauguugau

SEQ ID NO: 1286313 - RNA, 17 nt, Homo sapiens
gugacaugugaaaccuu

SEQ ID NO: 1286314 - RNA, 16 nt, Homo sapiens
gugacuuaguguacau

SEQ ID NO: 1286315 - RNA, 19 nt, Homo sapiens
gugauagagcuaacccuua

SEQ ID NO: 1286316 - RNA, 20 nt, Homo sapiens
gugauuuauaugaaaagagg

SEQ ID NO: 1286317 - RNA, 16 nt, Homo sapiens
gugcacaaaguggcau

SEQ ID NO: 1286318 - RNA, 23 nt, Homo sapiens
gugcaggggugagggguccaugc

SEQ ID NO: 1286319 - RNA, 18 nt, Homo sapiens
gugcauagagccacguau

SEQ ID NO: 1286320 - RNA, 20 nt, Homo sapiens
gugcuuuauaccccauuuga

SEQ ID NO: 1286321 - RNA, 17 nt, Homo sapiens
guggauacagucauuau

SEQ ID NO: 1286322 - RNA, 15 nt, Homo sapiens
guggcauuuucacuu

SEQ ID NO: 1286323 - RNA, 20 nt, Homo sapiens
guggguacucaauguguacu

SEQ ID NO: 1286324 - RNA, 14 nt, Homo sapiens
gugugaaaauucag

SEQ ID NO: 1286325 - RNA, 23 nt, Homo sapiens
guguucuucauuaccucagugag

SEQ ID NO: 1286326 - RNA, 17 nt, Homo sapiens
guguuuuuuuacauacg

SEQ ID NO: 1286327 - RNA, 16 nt, Homo sapiens
guuaacagacacugua

SEQ ID NO: 1286328 - RNA, 14 nt, Homo sapiens
guuaaucauuucau

SEQ ID NO: 1286329 - RNA, 14 nt, Homo sapiens
guuaaugguuugaa

SEQ ID NO: 1286330 - RNA, 12 nt, Homo sapiens
guuacaugaauu

SEQ ID NO: 1286331 - RNA, 22 nt, Homo sapiens
guuaccaguaacggaacaguau

SEQ ID NO: 1286332 - RNA, 19 nt, Homo sapiens
guucacucuucucagccac

SEQ ID NO: 1286333 - RNA, 16 nt, Homo sapiens
guuccaggauguggaa

SEQ ID NO: 1286334 - RNA, 21 nt, Homo sapiens
guucuauauaaaaaacauaau

SEQ ID NO: 1286335 - RNA, 11 nt, Homo sapiens
guucucaggcc

SEQ ID NO: 1286336 - RNA, 16 nt, Homo sapiens
guucuucauuaccuca

SEQ ID NO: 1286337 - RNA, 13 nt, Homo sapiens
guugcacuuugua

SEQ ID NO: 1286338 - RNA, 14 nt, Homo sapiens
guuggcaguguuug

SEQ ID NO: 1286339 - RNA, 17 nt, Homo sapiens
guuguuuaacuugucuu

SEQ ID NO: 1286340 - RNA, 13 nt, Homo sapiens
guuuaaaugccaa

SEQ ID NO: 1286341 - RNA, 22 nt, Homo sapiens
guuuagcuuuuuccuuacuuuu

SEQ ID NO: 1286342 - RNA, 13 nt, Homo sapiens
guuuauaaugcaa

SEQ ID NO: 1286343 - RNA, 15 nt, Homo sapiens
guuuauaaugcaaug

SEQ ID NO: 1286344 - RNA, 15 nt, Homo sapiens
guuuauagaccagaa

SEQ ID NO: 1286345 - RNA, 19 nt, Homo sapiens
guuucaccauguuagccag

SEQ ID NO: 1286346 - RNA, 17 nt, Homo sapiens
guuucaucccauguaca

SEQ ID NO: 1286347 - RNA, 21 nt, Homo sapiens
guuucuccagagggaauugca

SEQ ID NO: 1286348 - RNA, 13 nt, Homo sapiens
guuucucccccau

SEQ ID NO: 1286349 - RNA, 15 nt, Homo sapiens
guuucuccugagcua

SEQ ID NO: 1286350 - RNA, 17 nt, Homo sapiens
guuucucuuucugcaua

SEQ ID NO: 1286351 - RNA, 12 nt, Homo sapiens
guuucuuucuag

SEQ ID NO: 1286352 - RNA, 13 nt, Homo sapiens
guuuuaaauugca

SEQ ID NO: 1286353 - RNA, 18 nt, Homo sapiens
uaagaugaucaucuccag

SEQ ID NO: 1286354 - RNA, 16 nt, Homo sapiens
uaagcaaagacuauga

SEQ ID NO: 1286355 - RNA, 15 nt, Homo sapiens
uaagcagaauggagu

SEQ ID NO: 1286356 - RNA, 16 nt, Homo sapiens
uaaggaagaaucuucu

SEQ ID NO: 1286357 - RNA, 15 nt, Homo sapiens
uaaggcuguacauag

SEQ ID NO: 1286358 - RNA, 13 nt, Homo sapiens
uaagggaccucaa

SEQ ID NO: 1286359 - RNA, 13 nt, Homo sapiens
uaaguaauuucag

SEQ ID NO: 1286360 - RNA, 19 nt, Homo sapiens
uaagugaauuuaugagauu

SEQ ID NO: 1286361 - RNA, 19 nt, Homo sapiens
uaaguuagggaauggcaca

SEQ ID NO: 1286362 - RNA, 20 nt, Homo sapiens
uaaguugcaccaacuuugaa

SEQ ID NO: 1286363 - RNA, 20 nt, Homo sapiens
uaaguuugaaacuaacucau

SEQ ID NO: 1286364 - RNA, 19 nt, Homo sapiens
uaauaaaauauauacuaua

SEQ ID NO: 1286365 - RNA, 12 nt, Homo sapiens
uaauaacuaaua

SEQ ID NO: 1286366 - RNA, 17 nt, Homo sapiens
uaauaccuaaacuguau

SEQ ID NO: 1286367 - RNA, 12 nt, Homo sapiens
uaaucaaaccac

SEQ ID NO: 1286368 - RNA, 18 nt, Homo sapiens
uaaucuccucugcucauu

SEQ ID NO: 1286369 - RNA, 14 nt, Homo sapiens
uaaugacaugccua

SEQ ID NO: 1286370 - RNA, 20 nt, Homo sapiens
uaauguccaaauacucugaa

SEQ ID NO: 1286371 - RNA, 14 nt, Homo sapiens
uaauucagguacca

SEQ ID NO: 1286372 - RNA, 23 nt, Homo sapiens
uaauuccuguguagcuuuguuca

SEQ ID NO: 1286373 - RNA, 13 nt, Homo sapiens
uaauugaucagau

SEQ ID NO: 1286374 - RNA, 13 nt, Homo sapiens
uaauuucaugaaa

SEQ ID NO: 1286375 - RNA, 18 nt, Homo sapiens
uaauuuuaaguaauuuca

SEQ ID NO: 1286376 - RNA, 22 nt, Homo sapiens
uaauuuuaguauuaacucugua

SEQ ID NO: 1286377 - RNA, 12 nt, Homo sapiens
uacaaacaugug

SEQ ID NO: 1286378 - RNA, 18 nt, Homo sapiens
uacaacccgguucacucu

SEQ ID NO: 1286379 - RNA, 19 nt, Homo sapiens
uacaagcuacaguugucca

SEQ ID NO: 1286380 - RNA, 19 nt, Homo sapiens
uacaaggggugugacuuga

SEQ ID NO: 1286381 - RNA, 19 nt, Homo sapiens
uacaaguuaagguaucugg

SEQ ID NO: 1286382 - RNA, 20 nt, Homo sapiens
uacaaucgagacugcaaugu

SEQ ID NO: 1286383 - RNA, 17 nt, Homo sapiens
uacacccacaguggaaa

SEQ ID NO: 1286384 - RNA, 21 nt, Homo sapiens
uacagacacucccacuuggca

SEQ ID NO: 1286385 - RNA, 11 nt, Homo sapiens
uacagacucca

SEQ ID NO: 1286386 - RNA, 13 nt, Homo sapiens
uacagacuccaaa

SEQ ID NO: 1286387 - RNA, 15 nt, Homo sapiens
uacagacuccaaaag

SEQ ID NO: 1286388 - RNA, 14 nt, Homo sapiens
uacagauguagaua

SEQ ID NO: 1286389 - RNA, 23 nt, Homo sapiens
uacauucuugguuguuaauuuag

SEQ ID NO: 1286390 - RNA, 22 nt, Homo sapiens
uaccaaaaauaucccuuuuuca

SEQ ID NO: 1286391 - RNA, 16 nt, Homo sapiens
uaccaaggggguaaaa

SEQ ID NO: 1286392 - RNA, 14 nt, Homo sapiens
uacccaacucugua

SEQ ID NO: 1286393 - RNA, 15 nt, Homo sapiens
uacccacuucuccca

SEQ ID NO: 1286394 - RNA, 17 nt, Homo sapiens
uacccuccucuauuucu

SEQ ID NO: 1286395 - RNA, 23 nt, Homo sapiens
uaccuaaaucuguuugacagucu

SEQ ID NO: 1286396 - RNA, 16 nt, Homo sapiens
uaccuaaugaaaguga

SEQ ID NO: 1286397 - RNA, 23 nt, Homo sapiens
uaccuccuaauuccacacccuca

SEQ ID NO: 1286398 - RNA, 16 nt, Homo sapiens
uaccugaagcuggacu

SEQ ID NO: 1286399 - RNA, 13 nt, Homo sapiens
uaccuggcagcua

SEQ ID NO: 1286400 - RNA, 19 nt, Homo sapiens
uaccuggcccugugccuug

SEQ ID NO: 1286401 - RNA, 14 nt, Homo sapiens
uaccuucuaccucu

SEQ ID NO: 1286402 - RNA, 21 nt, Homo sapiens
uaccuucuaccucuuggcugc

SEQ ID NO: 1286403 - RNA, 13 nt, Homo sapiens
uacuaagaucaca

SEQ ID NO: 1286404 - RNA, 18 nt, Homo sapiens
uacucauggcagaaggca

SEQ ID NO: 1286405 - RNA, 17 nt, Homo sapiens
uacuccaggagacccac

SEQ ID NO: 1286406 - RNA, 19 nt, Homo sapiens
uacugauaaccacuccuaa

SEQ ID NO: 1286407 - RNA, 17 nt, Homo sapiens
uacuugaucauucucag

SEQ ID NO: 1286408 - RNA, 17 nt, Homo sapiens
uacuuuuuaaacagugu

SEQ ID NO: 1286409 - RNA, 19 nt, Homo sapiens
uagaacucagagccagauc

SEQ ID NO: 1286410 - RNA, 23 nt, Homo sapiens
uagaacucugggcugccauguga

SEQ ID NO: 1286411 - RNA, 19 nt, Homo sapiens
uagaagaugggaaaaccau

SEQ ID NO: 1286412 - RNA, 22 nt, Homo sapiens
uagaauugugcuggucauacau

SEQ ID NO: 1286413 - RNA, 19 nt, Homo sapiens
uagacuauggaaugucagu

SEQ ID NO: 1286414 - RNA, 22 nt, Homo sapiens
uagagacgggguuucaccaugu

SEQ ID NO: 1286415 - RNA, 18 nt, Homo sapiens
uagagauuugguguacaa

SEQ ID NO: 1286416 - RNA, 14 nt, Homo sapiens
uagaguuugaucau

SEQ ID NO: 1286417 - RNA, 21 nt, Homo sapiens
uagauauugugaaguacauau

SEQ ID NO: 1286418 - RNA, 18 nt, Homo sapiens
uagcaccuccacauaccu

SEQ ID NO: 1286419 - RNA, 15 nt, Homo sapiens
uagccacuucacuuu

SEQ ID NO: 1286420 - RNA, 15 nt, Homo sapiens
uagccagugcucagc

SEQ ID NO: 1286421 - RNA, 21 nt, Homo sapiens
uagcuaauaauaaaugcauag

SEQ ID NO: 1286422 - RNA, 15 nt, Homo sapiens
uagcuagcuauuucu

SEQ ID NO: 1286423 - RNA, 17 nt, Homo sapiens
uagcuccaaaccuucac

SEQ ID NO: 1286424 - RNA, 12 nt, Homo sapiens
uagcuccccaau

SEQ ID NO: 1286425 - RNA, 18 nt, Homo sapiens
uagcugcauuccuagaaa

SEQ ID NO: 1286426 - RNA, 16 nt, Homo sapiens
uaggauacugcugcgu

SEQ ID NO: 1286427 - RNA, 16 nt, Homo sapiens
uaguaagagauuccug

SEQ ID NO: 1286428 - RNA, 13 nt, Homo sapiens
uagugaugccauc

SEQ ID NO: 1286429 - RNA, 14 nt, Homo sapiens
uaguguacaugaaa

SEQ ID NO: 1286430 - RNA, 16 nt, Homo sapiens
uaguguccuaugcaau

SEQ ID NO: 1286431 - RNA, 19 nt, Homo sapiens
uaguguuggaaaaugugca

SEQ ID NO: 1286432 - RNA, 21 nt, Homo sapiens
uaguguuggaaaaugugcaau

SEQ ID NO: 1286433 - RNA, 22 nt, Homo sapiens
uaguguuggaaaaugugcaaua

SEQ ID NO: 1286434 - RNA, 19 nt, Homo sapiens
uuggacagaagcagcucuu

SEQ ID NO: 1286435 - RNA, 20 nt, Homo sapiens
uuggcaccgcuucucagcca

SEQ ID NO: 1286436 - RNA, 23 nt, Homo sapiens
uuggcagcucuacucuggagguu

SEQ ID NO: 1286437 - RNA, 21 nt, Homo sapiens
uuggcgggggcuuggcugugc

SEQ ID NO: 1286438 - RNA, 15 nt, Homo sapiens
uuggcucuacccuga

SEQ ID NO: 1286439 - RNA, 22 nt, Homo sapiens
uuggcugugcccucagauuccg

SEQ ID NO: 1286440 - RNA, 18 nt, Homo sapiens
uuguaguauuuaguauau

SEQ ID NO: 1286441 - RNA, 14 nt, Homo sapiens
uugucuagaacacu

SEQ ID NO: 1286442 - RNA, 22 nt, Homo sapiens
uuguuaauaacuaauaacugga

SEQ ID NO: 1286443 - RNA, 17 nt, Homo sapiens
uuguuccaaugccacau

SEQ ID NO: 1286444 - RNA, 14 nt, Homo sapiens
uuguugucuuuaug

SEQ ID NO: 1286445 - RNA, 18 nt, Homo sapiens
uuguuuucuaacuuuaug

SEQ ID NO: 1286446 - RNA, 20 nt, Homo sapiens
uuuaaaaauaaagcuacuga

SEQ ID NO: 1286447 - RNA, 15 nt, Homo sapiens
uuuaaaacaugcugu

SEQ ID NO: 1286448 - RNA, 13 nt, Homo sapiens
uuuaaaagucauu

SEQ ID NO: 1286449 - RNA, 14 nt, Homo sapiens
uuuaaaauugugau

SEQ ID NO: 1286450 - RNA, 17 nt, Homo sapiens
uuuaagauuuuucucaa

SEQ ID NO: 1286451 - RNA, 12 nt, Homo sapiens
uuuaaggcagca

SEQ ID NO: 1286452 - RNA, 14 nt, Homo sapiens
uuuaaguaauuuca

SEQ ID NO: 1286453 - RNA, 13 nt, Homo sapiens
uuuaauuaucuaa

SEQ ID NO: 1286454 - RNA, 14 nt, Homo sapiens
uuuaauuuauacug

SEQ ID NO: 1286455 - RNA, 20 nt, Homo sapiens
uuuaauuuuuuaaacuguag

SEQ ID NO: 1286456 - RNA, 12 nt, Homo sapiens
uuuacaccaguu

SEQ ID NO: 1286457 - RNA, 11 nt, Homo sapiens
uuuacuuuguu

SEQ ID NO: 1286458 - RNA, 17 nt, Homo sapiens
uuuagagcguuugguua

SEQ ID NO: 1286459 - RNA, 22 nt, Homo sapiens
uuuagagugaaauauaugcuau

SEQ ID NO: 1286460 - RNA, 16 nt, Homo sapiens
uuuauaaauggacaaa

SEQ ID NO: 1286461 - RNA, 21 nt, Homo sapiens
uuuauagaccagaaccagagc

SEQ ID NO: 1286462 - RNA, 23 nt, Homo sapiens
uuuauagagcagaacccuagucu

SEQ ID NO: 1286463 - RNA, 19 nt, Homo sapiens
uuuaucuuugauucuccuu

SEQ ID NO: 1286464 - RNA, 11 nt, Homo sapiens
uuuaugguucu

SEQ ID NO: 1286465 - RNA, 11 nt, Homo sapiens
uuuaugugcaa

SEQ ID NO: 1286466 - RNA, 13 nt, Homo sapiens
uuuauugccauga

SEQ ID NO: 1286467 - RNA, 21 nt, Homo sapiens
uuucacuacucucuacucugu

SEQ ID NO: 1286468 - RNA, 15 nt, Homo sapiens
uuucaucugcucucc

SEQ ID NO: 1286469 - RNA, 22 nt, Homo sapiens
uuucaugaaaagauuaugaucu

SEQ ID NO: 1286470 - RNA, 12 nt, Homo sapiens
uuucauucuugu

SEQ ID NO: 1286471 - RNA, 24 nt, Homo sapiens
uuucucauagcuuuacagauguag

SEQ ID NO: 1286472 - RNA, 17 nt, Homo sapiens
uuucucuagggagaaaa

SEQ ID NO: 1286473 - RNA, 17 nt, Homo sapiens
uuucuuggccaggguag

SEQ ID NO: 1286474 - RNA, 20 nt, Homo sapiens
uuucuuuugugcagaucacu

SEQ ID NO: 1286475 - RNA, 14 nt, Homo sapiens
uuugagacuuagaa

SEQ ID NO: 1286476 - RNA, 10 nt, Homo sapiens
uuugaucaua

SEQ ID NO: 1286477 - RNA, 18 nt, Homo sapiens
uuuggcuugcuguuuacu

SEQ ID NO: 1286478 - RNA, 11 nt, Homo sapiens
uuuggggcuca

SEQ ID NO: 1286479 - RNA, 20 nt, Homo sapiens
uuuggggcucagaguggggu

SEQ ID NO: 1286480 - RNA, 16 nt, Homo sapiens
uuuguaauauggaaug

SEQ ID NO: 1286481 - RNA, 19 nt, Homo sapiens
uuuguagccacuucacuuu

SEQ ID NO: 1286482 - RNA, 23 nt, Homo sapiens
uuugugaaaugaaaacauguaau

SEQ ID NO: 1286483 - RNA, 17 nt, Homo sapiens
uuugugugcgucacugu

SEQ ID NO: 1286484 - RNA, 13 nt, Homo sapiens
uuuguuaugcaaa

SEQ ID NO: 1286485 - RNA, 14 nt, Homo sapiens
uuuguugaauaaua

SEQ ID NO: 1286486 - RNA, 20 nt, Homo sapiens
uuuuaaaguaaacuugugua

SEQ ID NO: 1286487 - RNA, 22 nt, Homo sapiens
uuuuaaguuugaaacuaacuca

SEQ ID NO: 1286488 - RNA, 19 nt, Homo sapiens
uuuuaggaaaggaugauca

SEQ ID NO: 1286489 - RNA, 20 nt, Homo sapiens
uuuuagucuaauugaauccc

SEQ ID NO: 1286490 - RNA, 23 nt, Homo sapiens
uuuucagggaagcugccaaagaa

SEQ ID NO: 1286491 - RNA, 16 nt, Homo sapiens
uuuucuaaacuuuaau

SEQ ID NO: 1286492 - RNA, 17 nt, Homo sapiens
uuuugaguagcauauua

SEQ ID NO: 1286493 - RNA, 19 nt, Homo sapiens
uuuuuaaaauguuggugca

SEQ ID NO: 1286494 - RNA, 16 nt, Homo sapiens
uuuuucuccucuccau

SEQ ID NO: 1286495 - RNA, 15 nt, Homo sapiens
uaauaagcuaaagag

SEQ ID NO: 1286496 - RNA, 20 nt, Homo sapiens
uaauauuuuuaaaaguauac

SEQ ID NO: 1286497 - RNA, 13 nt, Homo sapiens
uaaucaugcucau

SEQ ID NO: 1286498 - RNA, 14 nt, Homo sapiens
uaaucaugcucaug

SEQ ID NO: 1286499 - RNA, 21 nt, Homo sapiens
uaaucccaauaaaauucugag

SEQ ID NO: 1286500 - RNA, 21 nt, Homo sapiens
uaaucugagaggccacagugc

SEQ ID NO: 1286501 - RNA, 16 nt, Homo sapiens
uaauuggcccaaguca

SEQ ID NO: 1286502 - RNA, 22 nt, Homo sapiens
uacaaagcccuuguccccauga

SEQ ID NO: 1286503 - RNA, 23 nt, Homo sapiens
uacaacccgguucacucuucuca

SEQ ID NO: 1286504 - RNA, 20 nt, Homo sapiens
uacaagcuuaaagcuugauu

SEQ ID NO: 1286505 - RNA, 12 nt, Homo sapiens
uacacaacaugu

SEQ ID NO: 1286506 - RNA, 14 nt, Homo sapiens
uacacaacauguau

SEQ ID NO: 1286507 - RNA, 14 nt, Homo sapiens
uacacacuuuccaa

SEQ ID NO: 1286508 - RNA, 20 nt, Homo sapiens
uacacacuuuccaaguacuc

SEQ ID NO: 1286509 - RNA, 21 nt, Homo sapiens
uacacaucucugucaguguga

SEQ ID NO: 1286510 - RNA, 15 nt, Homo sapiens
uacacgugacagagu

SEQ ID NO: 1286511 - RNA, 23 nt, Homo sapiens
uacagauggagcaaauguccuaa

SEQ ID NO: 1286512 - RNA, 21 nt, Homo sapiens
uacagguuacgugagaacaau

SEQ ID NO: 1286513 - RNA, 18 nt, Homo sapiens
uacaguuagagauuuuua

SEQ ID NO: 1286514 - RNA, 15 nt, Homo sapiens
uacauacagugauau

SEQ ID NO: 1286515 - RNA, 21 nt, Homo sapiens
uacauauuucuuugccuuuau

SEQ ID NO: 1286516 - RNA, 19 nt, Homo sapiens
uacauuagucauucaauaa

SEQ ID NO: 1286517 - RNA, 21 nt, Homo sapiens
uacauugggcacauaucuccu

SEQ ID NO: 1286518 - RNA, 16 nt, Homo sapiens
uaccacaaacacauua

SEQ ID NO: 1286519 - RNA, 15 nt, Homo sapiens
uaccauucagcauga

SEQ ID NO: 1286520 - RNA, 17 nt, Homo sapiens
uaccguguugguuuuga

SEQ ID NO: 1286521 - RNA, 17 nt, Homo sapiens
uaccuaaacuguaucau

SEQ ID NO: 1286522 - RNA, 21 nt, Homo sapiens
uaccuagcaaagcuccugccu

SEQ ID NO: 1286523 - RNA, 11 nt, Homo sapiens
uaccucaaggg

SEQ ID NO: 1286524 - RNA, 23 nt, Homo sapiens
uaccuggcagcuagccagugcuc

SEQ ID NO: 1286525 - RNA, 15 nt, Homo sapiens
uaccuucuaccucuu

SEQ ID NO: 1286526 - RNA, 19 nt, Homo sapiens
uacucauggcagaaggcaa

SEQ ID NO: 1286527 - RNA, 14 nt, Homo sapiens
uacuuuacugccug

SEQ ID NO: 1286528 - RNA, 18 nt, Homo sapiens
uagaaagaaacugcucua

SEQ ID NO: 1286529 - RNA, 20 nt, Homo sapiens
uagaaagaaacugcucuaau

SEQ ID NO: 1286530 - RNA, 17 nt, Homo sapiens
uagaaauugaaguuuca

SEQ ID NO: 1286531 - RNA, 12 nt, Homo sapiens
uagaaugccaua

SEQ ID NO: 1286532 - RNA, 17 nt, Homo sapiens
uagaauugagucuucca

SEQ ID NO: 1286533 - RNA, 20 nt, Homo sapiens
uagaccagaaccagagcuca

SEQ ID NO: 1286534 - RNA, 19 nt, Homo sapiens
uagagaaauuugccaauuu

SEQ ID NO: 1286535 - RNA, 17 nt, Homo sapiens
uagagacuuugugaaaa

SEQ ID NO: 1286536 - RNA, 18 nt, Homo sapiens
uagaggcaaagaacaauu

SEQ ID NO: 1286537 - RNA, 21 nt, Homo sapiens
uagaggcugccugggccuguu

SEQ ID NO: 1286538 - RNA, 12 nt, Homo sapiens
uagaugugcauu

SEQ ID NO: 1286539 - RNA, 21 nt, Homo sapiens
uagcacaugcccuaaugucug

SEQ ID NO: 1286540 - RNA, 21 nt, Homo sapiens
uaggaacugcugggcuuggca

SEQ ID NO: 1286541 - RNA, 23 nt, Homo sapiens
uaggguacucaucugacuugaac

SEQ ID NO: 1286542 - RNA, 20 nt, Homo sapiens
uaguagaaagacaucugccu

SEQ ID NO: 1286543 - RNA, 15 nt, Homo sapiens
uagugcaauaccugg

SEQ ID NO: 1286544 - RNA, 11 nt, Homo sapiens
uagugcuucuu

SEQ ID NO: 1286545 - RNA, 13 nt, Homo sapiens
uaguggucuuugu

SEQ ID NO: 1286546 - RNA, 20 nt, Homo sapiens
uaguuguauuuuguacauuu

SEQ ID NO: 1286547 - RNA, 20 nt, Homo sapiens
uauaaggacagaccaaaaau

SEQ ID NO: 1286548 - RNA, 23 nt, Homo sapiens
uauaccugccuuuuaaguuugaa

SEQ ID NO: 1286549 - RNA, 15 nt, Homo sapiens
uauacucuucaagga

SEQ ID NO: 1286550 - RNA, 16 nt, Homo sapiens
uauacucuucaaggac

SEQ ID NO: 1286551 - RNA, 13 nt, Homo sapiens
uauagguguuugc

SEQ ID NO: 1286552 - RNA, 13 nt, Homo sapiens
uauauggccucaa

SEQ ID NO: 1286553 - RNA, 15 nt, Homo sapiens
uauauguauacauau

SEQ ID NO: 1286554 - RNA, 17 nt, Homo sapiens
uauauguauacauauag

SEQ ID NO: 1286555 - RNA, 13 nt, Homo sapiens
uauauuguuucau

SEQ ID NO: 1286556 - RNA, 19 nt, Homo sapiens
uaucagccugugccacgau

SEQ ID NO: 1286557 - RNA, 21 nt, Homo sapiens
uaucuacccagucauguacug

SEQ ID NO: 1286558 - RNA, 13 nt, Homo sapiens
uaucuuugauucu

SEQ ID NO: 1286559 - RNA, 18 nt, Homo sapiens
uaugaaaagagcaaaaac

SEQ ID NO: 1286560 - RNA, 22 nt, Homo sapiens
uaugagcuggggaugucucuca

SEQ ID NO: 1286561 - RNA, 16 nt, Homo sapiens
uaugccccugcacuga

SEQ ID NO: 1286562 - RNA, 23 nt, Homo sapiens
uauggauucagaauauacuaaau

SEQ ID NO: 1286563 - RNA, 19 nt, Homo sapiens
uauggcagugucuuuccac

SEQ ID NO: 1286564 - RNA, 14 nt, Homo sapiens
uauggcauuugcag

SEQ ID NO: 1286565 - RNA, 16 nt, Homo sapiens
uauggguugcauuugg

SEQ ID NO: 1286566 - RNA, 18 nt, Homo sapiens
uauggguuggacaaccuc

SEQ ID NO: 1286567 - RNA, 20 nt, Homo sapiens
uauggguuggacaaccucau

SEQ ID NO: 1286568 - RNA, 17 nt, Homo sapiens
uaugguucucucgcaag

SEQ ID NO: 1286569 - RNA, 21 nt, Homo sapiens
uauguaaauagaaacguguau

SEQ ID NO: 1286570 - RNA, 20 nt, Homo sapiens
uaugugaaaggaaaugcacc

SEQ ID NO: 1286571 - RNA, 22 nt, Homo sapiens
uauguggaagugugggucugug

SEQ ID NO: 1286572 - RNA, 13 nt, Homo sapiens
uauuaaauuugaa

SEQ ID NO: 1286573 - RNA, 12 nt, Homo sapiens
uauuaacagaua

SEQ ID NO: 1286574 - RNA, 18 nt, Homo sapiens
uauuagagcugccugugc

SEQ ID NO: 1286575 - RNA, 20 nt, Homo sapiens
uauuuaacuaugaacugaag

SEQ ID NO: 1286576 - RNA, 15 nt, Homo sapiens
uauuuauugcugaau

SEQ ID NO: 1286577 - RNA, 17 nt, Homo sapiens
uauuuccuucuccuccu

SEQ ID NO: 1286578 - RNA, 17 nt, Homo sapiens
uauuugcacuuguggaa

SEQ ID NO: 1286579 - RNA, 17 nt, Homo sapiens
uauuuuauagagcagaa

SEQ ID NO: 1286580 - RNA, 19 nt, Homo sapiens
uauuuugugcaacauaaca

SEQ ID NO: 1286581 - RNA, 20 nt, Homo sapiens
uauuuugugcaacauaacaa

SEQ ID NO: 1286582 - RNA, 18 nt, Homo sapiens
uauuuuuaaaaguauaca

SEQ ID NO: 1286583 - RNA, 20 nt, Homo sapiens
uauuuuuaaaaucauaacau

SEQ ID NO: 1286584 - RNA, 15 nt, Homo sapiens
ucaaaagcacuuugu

SEQ ID NO: 1286585 - RNA, 22 nt, Homo sapiens
ucaaaagcacuuugugcugugu

SEQ ID NO: 1286586 - RNA, 15 nt, Homo sapiens
ucaaacuacugccau

SEQ ID NO: 1286587 - RNA, 20 nt, Homo sapiens
ucaaaguuuugaaaagcuau

SEQ ID NO: 1286588 - RNA, 22 nt, Homo sapiens
ucaaaguuuugaaaagcuauua

SEQ ID NO: 1286589 - RNA, 19 nt, Homo sapiens
ucaacauuccugccccaga

SEQ ID NO: 1286590 - RNA, 18 nt, Homo sapiens
ucaaggacuuucugaagc

SEQ ID NO: 1286591 - RNA, 19 nt, Homo sapiens
ucaauaguguccuaugcaa

SEQ ID NO: 1286592 - RNA, 21 nt, Homo sapiens
ucaauaguguccuaugcaaua

SEQ ID NO: 1286593 - RNA, 23 nt, Homo sapiens
ucaauuuacuuuuuaaacagugu

SEQ ID NO: 1286594 - RNA, 21 nt, Homo sapiens
ucacacagccaagccagucaa

SEQ ID NO: 1286595 - RNA, 13 nt, Homo sapiens
ucaccacuucccu

SEQ ID NO: 1286596 - RNA, 15 nt, Homo sapiens
ucaccaucaacauuc

SEQ ID NO: 1286597 - RNA, 14 nt, Homo sapiens
ucaccucucaaggu

SEQ ID NO: 1286598 - RNA, 18 nt, Homo sapiens
ucaccugggcugaggcau

SEQ ID NO: 1286599 - RNA, 10 nt, Homo sapiens
ucaccuucac

SEQ ID NO: 1286600 - RNA, 16 nt, Homo sapiens
ucacugccauauacuc

SEQ ID NO: 1286601 - RNA, 21 nt, Homo sapiens
ucacugccauauacucuucaa

SEQ ID NO: 1286602 - RNA, 15 nt, Homo sapiens
ucacuucaccaucaa

SEQ ID NO: 1286603 - RNA, 19 nt, Homo sapiens
ucacuuccuauaugcacuu

SEQ ID NO: 1286604 - RNA, 23 nt, Homo sapiens
ucucuuuuuagagaaauuugcca

SEQ ID NO: 1286605 - RNA, 15 nt, Homo sapiens
augucucugacaaag

SEQ ID NO: 1286606 - RNA, 15 nt, Homo sapiens
augugcaaaggcauc

SEQ ID NO: 1286607 - RNA, 16 nt, Homo sapiens
augugcaaaggcaucu

SEQ ID NO: 1286608 - RNA, 10 nt, Homo sapiens
augugcaaua

SEQ ID NO: 1286609 - RNA, 11 nt, Homo sapiens
augugcaauau

SEQ ID NO: 1286610 - RNA, 20 nt, Homo sapiens
augugccuguguacuggaca

SEQ ID NO: 1286611 - RNA, 16 nt, Homo sapiens
auguggauacagucau

SEQ ID NO: 1286612 - RNA, 18 nt, Homo sapiens
auguggguugugauauug

SEQ ID NO: 1286613 - RNA, 12 nt, Homo sapiens
auguguauauau

SEQ ID NO: 1286614 - RNA, 19 nt, Homo sapiens
auguguauauaugucaaau

SEQ ID NO: 1286615 - RNA, 16 nt, Homo sapiens
auguguguguguugug

SEQ ID NO: 1286616 - RNA, 18 nt, Homo sapiens
auguuacuuaaacaucau

SEQ ID NO: 1286617 - RNA, 17 nt, Homo sapiens
auguugggaagcuauuu

SEQ ID NO: 1286618 - RNA, 19 nt, Homo sapiens
auuaaauucucucuaacau

SEQ ID NO: 1286619 - RNA, 17 nt, Homo sapiens
auuaaauuguuccauuu

SEQ ID NO: 1286620 - RNA, 20 nt, Homo sapiens
auuaaucaaaccacuguuau

SEQ ID NO: 1286621 - RNA, 18 nt, Homo sapiens
auuaaucaaggcauaaaa

SEQ ID NO: 1286622 - RNA, 20 nt, Homo sapiens
auuacaaucgagacugcaau

SEQ ID NO: 1286623 - RNA, 12 nt, Homo sapiens
auuaccauucag

SEQ ID NO: 1286624 - RNA, 20 nt, Homo sapiens
auuacccccuuuccucuugg

SEQ ID NO: 1286625 - RNA, 13 nt, Homo sapiens
auuacgugcaaua

SEQ ID NO: 1286626 - RNA, 19 nt, Homo sapiens
auuacgugcaauacuucaa

SEQ ID NO: 1286627 - RNA, 23 nt, Homo sapiens
auuagagguuaaugcagggacug

SEQ ID NO: 1286628 - RNA, 18 nt, Homo sapiens
auuaugagacacaggaug

SEQ ID NO: 1286629 - RNA, 14 nt, Homo sapiens
auuaugcuaccuac

SEQ ID NO: 1286630 - RNA, 13 nt, Homo sapiens
auuauucccauga

SEQ ID NO: 1286631 - RNA, 20 nt, Homo sapiens
auuauuuugugcaacauaac

SEQ ID NO: 1286632 - RNA, 18 nt, Homo sapiens
auucacagcaagucacug

SEQ ID NO: 1286633 - RNA, 23 nt, Homo sapiens
auucacuggggcaugagauuuug

SEQ ID NO: 1286634 - RNA, 15 nt, Homo sapiens
auuccacacccucac

SEQ ID NO: 1286635 - RNA, 15 nt, Homo sapiens
auuccauuuacuuga

SEQ ID NO: 1286636 - RNA, 14 nt, Homo sapiens
auuccugagccagu

SEQ ID NO: 1286637 - RNA, 21 nt, Homo sapiens
auuccugccccagauggcuuu

SEQ ID NO: 1286638 - RNA, 18 nt, Homo sapiens
auucuaacuuuuuugcua

SEQ ID NO: 1286639 - RNA, 19 nt, Homo sapiens
auucucucuaacauaacaa

SEQ ID NO: 1286640 - RNA, 13 nt, Homo sapiens
auucuuccugcuu

SEQ ID NO: 1286641 - RNA, 14 nt, Homo sapiens
auucuucuuugaua

SEQ ID NO: 1286642 - RNA, 15 nt, Homo sapiens
auucuuugaccuguu

SEQ ID NO: 1286643 - RNA, 23 nt, Homo sapiens
auugaacuguaccaugugcuaca

SEQ ID NO: 1286644 - RNA, 22 nt, Homo sapiens
auugauauaaagaaauaccuga

SEQ ID NO: 1286645 - RNA, 22 nt, Homo sapiens
auugaugaaugaggaacaauca

SEQ ID NO: 1286646 - RNA, 14 nt, Homo sapiens
auugauuaccaagu

SEQ ID NO: 1286647 - RNA, 17 nt, Homo sapiens
auugcaguuucauguau

SEQ ID NO: 1286648 - RNA, 20 nt, Homo sapiens
auugcuccauuuucuuguca

SEQ ID NO: 1286649 - RNA, 22 nt, Homo sapiens
auuggaacuggaggcagggaac

SEQ ID NO: 1286650 - RNA, 18 nt, Homo sapiens
auuggauguuguguauug

SEQ ID NO: 1286651 - RNA, 23 nt, Homo sapiens
auugggaaaggacagcuuugaua

SEQ ID NO: 1286652 - RNA, 16 nt, Homo sapiens
auuguaucuguuuaga

SEQ ID NO: 1286653 - RNA, 16 nt, Homo sapiens
auugugaaguacauau

SEQ ID NO: 1286654 - RNA, 10 nt, Homo sapiens
auugugaugu

SEQ ID NO: 1286655 - RNA, 15 nt, Homo sapiens
auuuaaaagacaaac

SEQ ID NO: 1286656 - RNA, 13 nt, Homo sapiens
auuuaaaaugccu

SEQ ID NO: 1286657 - RNA, 14 nt, Homo sapiens
auuuaaaaugccua

SEQ ID NO: 1286658 - RNA, 20 nt, Homo sapiens
auuuaagguacauggaacac

SEQ ID NO: 1286659 - RNA, 12 nt, Homo sapiens
auuuaauaacau

SEQ ID NO: 1286660 - RNA, 22 nt, Homo sapiens
auuuacaacccgguucacucuu

SEQ ID NO: 1286661 - RNA, 21 nt, Homo sapiens
auuuacccaacucuguacaaa

SEQ ID NO: 1286662 - RNA, 18 nt, Homo sapiens
auuuacugucuuaaauca

SEQ ID NO: 1286663 - RNA, 20 nt, Homo sapiens
auuuagcuccaaaccuucac

SEQ ID NO: 1286664 - RNA, 13 nt, Homo sapiens
auuuaugugaugg

SEQ ID NO: 1286665 - RNA, 16 nt, Homo sapiens
auuuauucuucacuga

SEQ ID NO: 1286666 - RNA, 22 nt, Homo sapiens
auuucaccacucaaaggccaga

SEQ ID NO: 1286667 - RNA, 19 nt, Homo sapiens
auuucagugagaaaauccu

SEQ ID NO: 1286668 - RNA, 13 nt, Homo sapiens
auuucaucaugac

SEQ ID NO: 1286669 - RNA, 17 nt, Homo sapiens
auuuccuuugcgcaaac

SEQ ID NO: 1286670 - RNA, 21 nt, Homo sapiens
auuuccuuugcgcaaacuuua

SEQ ID NO: 1286671 - RNA, 16 nt, Homo sapiens
auuucucucugacccu

SEQ ID NO: 1286672 - RNA, 15 nt, Homo sapiens
auuugcaagacauag

SEQ ID NO: 1286673 - RNA, 17 nt, Homo sapiens
auuugccaauuuacuuu

SEQ ID NO: 1286674 - RNA, 16 nt, Homo sapiens
auuuggcuugcuguuu

SEQ ID NO: 1286675 - RNA, 23 nt, Homo sapiens
auuuguucucccaaaacagauua

SEQ ID NO: 1286676 - RNA, 15 nt, Homo sapiens
auuuguugacugaau

SEQ ID NO: 1286677 - RNA, 18 nt, Homo sapiens
auuuuaaguaauuucaga

SEQ ID NO: 1286678 - RNA, 19 nt, Homo sapiens
auuuuacccaaauacucaa

SEQ ID NO: 1286679 - RNA, 14 nt, Homo sapiens
auuuucuugucaau

SEQ ID NO: 1286680 - RNA, 12 nt, Homo sapiens
auuuugaaaaua

SEQ ID NO: 1286681 - RNA, 20 nt, Homo sapiens
auuuuguguucaguacaauu

SEQ ID NO: 1286682 - RNA, 16 nt, Homo sapiens
auuuuuuaaacuguag

SEQ ID NO: 1286683 - RNA, 19 nt, Homo sapiens
caaaaaggggaaguaucaa

SEQ ID NO: 1286684 - RNA, 13 nt, Homo sapiens
caaaaaguguaau

SEQ ID NO: 1286685 - RNA, 13 nt, Homo sapiens
caaaaggcccuuu

SEQ ID NO: 1286686 - RNA, 18 nt, Homo sapiens
caaaauaaagaauaugcc

SEQ ID NO: 1286687 - RNA, 17 nt, Homo sapiens
caaaauaaagugacaga

SEQ ID NO: 1286688 - RNA, 18 nt, Homo sapiens
caaaauaaucuauauuaa

SEQ ID NO: 1286689 - RNA, 14 nt, Homo sapiens
caaaaucacacagc

SEQ ID NO: 1286690 - RNA, 23 nt, Homo sapiens
caaaccacuguuauuaacagaua

SEQ ID NO: 1286691 - RNA, 16 nt, Homo sapiens
caaagacuauucccuu

SEQ ID NO: 1286692 - RNA, 17 nt, Homo sapiens
caaagugcugcgauuac

SEQ ID NO: 1286693 - RNA, 18 nt, Homo sapiens
caaauccuucaucauguc

SEQ ID NO: 1286694 - RNA, 14 nt, Homo sapiens
caaaugcugugcaa

SEQ ID NO: 1286695 - RNA, 16 nt, Homo sapiens
caaaugcuuuuccuca

SEQ ID NO: 1286696 - RNA, 12 nt, Homo sapiens
caacaccaaaaa

SEQ ID NO: 1286697 - RNA, 17 nt, Homo sapiens
caaccccccagcacuga

SEQ ID NO: 1286698 - RNA, 14 nt, Homo sapiens
caacuuuugugcuc

SEQ ID NO: 1286699 - RNA, 16 nt, Homo sapiens
caagacaagcuccucc

SEQ ID NO: 1286700 - RNA, 15 nt, Homo sapiens
caagcagcaggaaac

SEQ ID NO: 1286701 - RNA, 17 nt, Homo sapiens
caagcugggagcacagg

SEQ ID NO: 1286702 - RNA, 19 nt, Homo sapiens
caaggauggguccagaaga

SEQ ID NO: 1286703 - RNA, 18 nt, Homo sapiens
caaggcaaagacuauucc

SEQ ID NO: 1286704 - RNA, 21 nt, Homo sapiens
caaggcaaagacuauucccuu

SEQ ID NO: 1286705 - RNA, 19 nt, Homo sapiens
caaggcuggcagugacaga

SEQ ID NO: 1286706 - RNA, 17 nt, Homo sapiens
ugcuggagucgggacua

SEQ ID NO: 1286707 - RNA, 15 nt, Homo sapiens
ugcugggcuuggcag

SEQ ID NO: 1286708 - RNA, 20 nt, Homo sapiens
aaacuaaggcauuugauuaa

SEQ ID NO: 1286709 - RNA, 17 nt, Homo sapiens
aaacuauguaaugcuua

SEQ ID NO: 1286710 - RNA, 14 nt, Homo sapiens
aaacugguuuauaa

SEQ ID NO: 1286711 - RNA, 14 nt, Homo sapiens
aaagaaagcuuuag

SEQ ID NO: 1286712 - RNA, 14 nt, Homo sapiens
aaagacugcauuua

SEQ ID NO: 1286713 - RNA, 18 nt, Homo sapiens
aaagagacaaacuguaaa

SEQ ID NO: 1286714 - RNA, 17 nt, Homo sapiens
aaagcauggcugagaaa

SEQ ID NO: 1286715 - RNA, 17 nt, Homo sapiens
aaagccuucaaacuccc

SEQ ID NO: 1286716 - RNA, 14 nt, Homo sapiens
aaagcuucaaaaac

SEQ ID NO: 1286717 - RNA, 18 nt, Homo sapiens
aaaggagccuaggccagg

SEQ ID NO: 1286718 - RNA, 13 nt, Homo sapiens
aaaggcaggcacu

SEQ ID NO: 1286719 - RNA, 15 nt, Homo sapiens
aaaggcccuuuucag

SEQ ID NO: 1286720 - RNA, 17 nt, Homo sapiens
aaaggcccuuuucaggg

SEQ ID NO: 1286721 - RNA, 14 nt, Homo sapiens
aaaggggagaggga

SEQ ID NO: 1286722 - RNA, 21 nt, Homo sapiens
aaaguauguuuucaauguuuc

SEQ ID NO: 1286723 - RNA, 19 nt, Homo sapiens
aaagucuaucuaaugacau

SEQ ID NO: 1286724 - RNA, 20 nt, Homo sapiens
aaauaaaaagccucagugac

SEQ ID NO: 1286725 - RNA, 21 nt, Homo sapiens
aaauaaauggauaaguagaau

SEQ ID NO: 1286726 - RNA, 21 nt, Homo sapiens
aaauacaauaaacuuacuaua

SEQ ID NO: 1286727 - RNA, 13 nt, Homo sapiens
aaauaugcaguga

SEQ ID NO: 1286728 - RNA, 22 nt, Homo sapiens
aaauauuuuacccaaauacuca

SEQ ID NO: 1286729 - RNA, 18 nt, Homo sapiens
aaauauuuuuaugugcaa

SEQ ID NO: 1286730 - RNA, 13 nt, Homo sapiens
aaauccuaggugc

SEQ ID NO: 1286731 - RNA, 16 nt, Homo sapiens
aaaugcauagagcaau

SEQ ID NO: 1286732 - RNA, 20 nt, Homo sapiens
aaaugcuuucuuggccaggg

SEQ ID NO: 1286733 - RNA, 15 nt, Homo sapiens
aaaugcuuuuccuca

SEQ ID NO: 1286734 - RNA, 16 nt, Homo sapiens
aaaugucuguauuuca

SEQ ID NO: 1286735 - RNA, 14 nt, Homo sapiens
aaaugugucugcaa

SEQ ID NO: 1286736 - RNA, 13 nt, Homo sapiens
aaauuauuugcag

SEQ ID NO: 1286737 - RNA, 23 nt, Homo sapiens
aaauugauuauuuugugcaacau

SEQ ID NO: 1286738 - RNA, 20 nt, Homo sapiens
aaauugccuuuguaauauga

SEQ ID NO: 1286739 - RNA, 24 nt, Homo sapiens
aaauuuaagugcguguguagaguu

SEQ ID NO: 1286740 - RNA, 13 nt, Homo sapiens
aaauuucacuuaa

SEQ ID NO: 1286741 - RNA, 22 nt, Homo sapiens
aaauuuguugucauguguauga

SEQ ID NO: 1286742 - RNA, 13 nt, Homo sapiens
aaauuuuacacac

SEQ ID NO: 1286743 - RNA, 15 nt, Homo sapiens
aacacccaaaagaau

SEQ ID NO: 1286744 - RNA, 14 nt, Homo sapiens
aacacucagcugcu

SEQ ID NO: 1286745 - RNA, 14 nt, Homo sapiens
aacagaaaacaauu

SEQ ID NO: 1286746 - RNA, 15 nt, Homo sapiens
aacagacacuguaaa

SEQ ID NO: 1286747 - RNA, 15 nt, Homo sapiens
aacagauaagcaaga

SEQ ID NO: 1286748 - RNA, 23 nt, Homo sapiens
aacagcuuucuuauucagugaaa

SEQ ID NO: 1286749 - RNA, 17 nt, Homo sapiens
aacaugaaaacauugau

SEQ ID NO: 1286750 - RNA, 16 nt, Homo sapiens
aacaugcuugcauuau

SEQ ID NO: 1286751 - RNA, 23 nt, Homo sapiens
aacauguaauaaaaaguauaugu

SEQ ID NO: 1286752 - RNA, 23 nt, Homo sapiens
aacauguauguggauacagucau

SEQ ID NO: 1286753 - RNA, 19 nt, Homo sapiens
aacaugugguuaaugccau

SEQ ID NO: 1286754 - RNA, 21 nt, Homo sapiens
aacaugugguuaaugccaugg

SEQ ID NO: 1286755 - RNA, 22 nt, Homo sapiens
aacauuguuuuuguugucuuua

SEQ ID NO: 1286756 - RNA, 15 nt, Homo sapiens
aacauuucucuggau

SEQ ID NO: 1286757 - RNA, 13 nt, Homo sapiens
aacauuucuuggu

SEQ ID NO: 1286758 - RNA, 15 nt, Homo sapiens
aaccaugcccaagaa

SEQ ID NO: 1286759 - RNA, 16 nt, Homo sapiens
aaccauuuuuuccuac

SEQ ID NO: 1286760 - RNA, 17 nt, Homo sapiens
aacccagcaacccagga

SEQ ID NO: 1286761 - RNA, 21 nt, Homo sapiens
aacccagcuagaaugugccug

SEQ ID NO: 1286762 - RNA, 19 nt, Homo sapiens
aacccucuaagggaccuca

SEQ ID NO: 1286763 - RNA, 20 nt, Homo sapiens
aacccuucagauuugccuua

SEQ ID NO: 1286764 - RNA, 12 nt, Homo sapiens
aaccgucccuga

SEQ ID NO: 1286765 - RNA, 20 nt, Homo sapiens
aaccucccccccaaauacuc

SEQ ID NO: 1286766 - RNA, 17 nt, Homo sapiens
aaccugaaccugggaac

SEQ ID NO: 1286767 - RNA, 16 nt, Homo sapiens
aacuaaggcauuugau

SEQ ID NO: 1286768 - RNA, 14 nt, Homo sapiens
aacuacaucugccu

SEQ ID NO: 1286769 - RNA, 18 nt, Homo sapiens
aacuagcuuggaaacugg

SEQ ID NO: 1286770 - RNA, 16 nt, Homo sapiens
aacuaucucagcauca

SEQ ID NO: 1286771 - RNA, 18 nt, Homo sapiens
aacuaucucagcaucaga

SEQ ID NO: 1286772 - RNA, 19 nt, Homo sapiens
aacucaauauuuuccauga

SEQ ID NO: 1286773 - RNA, 20 nt, Homo sapiens
aacucaauauuuuccaugaa

SEQ ID NO: 1286774 - RNA, 21 nt, Homo sapiens
aacugcuuuugcccauauaaa

SEQ ID NO: 1286775 - RNA, 19 nt, Homo sapiens
aacuguaccaugugcuaca

SEQ ID NO: 1286776 - RNA, 23 nt, Homo sapiens
aacuguauuucaguauuuuccag

SEQ ID NO: 1286777 - RNA, 13 nt, Homo sapiens
aacuguauuugau

SEQ ID NO: 1286778 - RNA, 14 nt, Homo sapiens
aacuuaaaagcaag

SEQ ID NO: 1286779 - RNA, 22 nt, Homo sapiens
aacuugauuguugagacgccuu

SEQ ID NO: 1286780 - RNA, 15 nt, Homo sapiens
aacuuuaugaacucc

SEQ ID NO: 1286781 - RNA, 13 nt, Homo sapiens
aagaaaguacaga

SEQ ID NO: 1286782 - RNA, 23 nt, Homo sapiens
aagaaauucugcaagcuuuucaa

SEQ ID NO: 1286783 - RNA, 23 nt, Homo sapiens
aagaaauuuaauguuucucugga

SEQ ID NO: 1286784 - RNA, 16 nt, Homo sapiens
aagaacaucuuuaugg

SEQ ID NO: 1286785 - RNA, 12 nt, Homo sapiens
aagaagacauga

SEQ ID NO: 1286786 - RNA, 21 nt, Homo sapiens
aagaauagccuagauaugaau

SEQ ID NO: 1286787 - RNA, 13 nt, Homo sapiens
aagacaauggcuu

SEQ ID NO: 1286788 - RNA, 16 nt, Homo sapiens
aagacagagcugggau

SEQ ID NO: 1286789 - RNA, 13 nt, Homo sapiens
aagacaucugccu

SEQ ID NO: 1286790 - RNA, 13 nt, Homo sapiens
aagacaugaacca

SEQ ID NO: 1286791 - RNA, 13 nt, Homo sapiens
aagacuacugaag

SEQ ID NO: 1286792 - RNA, 17 nt, Homo sapiens
aagacuauauuguacac

SEQ ID NO: 1286793 - RNA, 18 nt, Homo sapiens
aagacuauucccuucuaa

SEQ ID NO: 1286794 - RNA, 13 nt, Homo sapiens
aagagaauguauu

SEQ ID NO: 1286795 - RNA, 13 nt, Homo sapiens
aagagauuccuga

SEQ ID NO: 1286796 - RNA, 19 nt, Homo sapiens
aagagucuacccgacauaa

SEQ ID NO: 1286797 - RNA, 13 nt, Homo sapiens
aagaucuugcaga

SEQ ID NO: 1286798 - RNA, 15 nt, Homo sapiens
aagauuaugaucuca

SEQ ID NO: 1286799 - RNA, 19 nt, Homo sapiens
aagauuuugaaugcuuccu

SEQ ID NO: 1286800 - RNA, 21 nt, Homo sapiens
aagcaaagacuaugaggaaua

SEQ ID NO: 1286801 - RNA, 14 nt, Homo sapiens
aagcaacaauacag

SEQ ID NO: 1286802 - RNA, 20 nt, Homo sapiens
aagccuagcccuucucucau

SEQ ID NO: 1286803 - RNA, 17 nt, Homo sapiens
aagccuuuggcucuucu

SEQ ID NO: 1286804 - RNA, 16 nt, Homo sapiens
aagcugggagcacagg

SEQ ID NO: 1286805 - RNA, 17 nt, Homo sapiens
aagcuguuguacauuua

SEQ ID NO: 1286806 - RNA, 19 nt, Homo sapiens
aagcuuauuuagcacauuu

SEQ ID NO: 1286807 - RNA, 23 nt, Homo sapiens
aagcuuuccugacuucuccuagc

SEQ ID NO: 1286808 - RNA, 15 nt, Homo sapiens
acauacauccaacau

SEQ ID NO: 1286809 - RNA, 21 nt, Homo sapiens
acauaccuaugggauuuuaca

SEQ ID NO: 1286810 - RNA, 22 nt, Homo sapiens
acauaccuggcccugugccuug

SEQ ID NO: 1286811 - RNA, 23 nt, Homo sapiens
acauaccuggcccugugccuugg

SEQ ID NO: 1286812 - RNA, 15 nt, Homo sapiens
acauacguacuuuuc

SEQ ID NO: 1286813 - RNA, 18 nt, Homo sapiens
acauacuauucuuacuaa

SEQ ID NO: 1286814 - RNA, 17 nt, Homo sapiens
acauauuaggaaaauau

SEQ ID NO: 1286815 - RNA, 23 nt, Homo sapiens
acaucacuguccaccaccaccug

SEQ ID NO: 1286816 - RNA, 20 nt, Homo sapiens
acauccacacagccaaucca

SEQ ID NO: 1286817 - RNA, 22 nt, Homo sapiens
acauccucugucuauuugagac

SEQ ID NO: 1286818 - RNA, 18 nt, Homo sapiens
acaucucugucaguguga

SEQ ID NO: 1286819 - RNA, 10 nt, Homo sapiens
acaucugccu

SEQ ID NO: 1286820 - RNA, 14 nt, Homo sapiens
acauuaaagcaauc

SEQ ID NO: 1286821 - RNA, 20 nt, Homo sapiens
acauuacaguuagagauuuu

SEQ ID NO: 1286822 - RNA, 18 nt, Homo sapiens
acauuaccuuacugugga

SEQ ID NO: 1286823 - RNA, 20 nt, Homo sapiens
acauuacuguauauacuuug

SEQ ID NO: 1286824 - RNA, 15 nt, Homo sapiens
acauuagucauucaa

SEQ ID NO: 1286825 - RNA, 17 nt, Homo sapiens
acauucuugguuguuaa

SEQ ID NO: 1286826 - RNA, 19 nt, Homo sapiens
acauuuggcuuacaguaaa

SEQ ID NO: 1286827 - RNA, 18 nt, Homo sapiens
accaaaugcuuuuccuca

SEQ ID NO: 1286828 - RNA, 16 nt, Homo sapiens
accaaugcauuaccuu

SEQ ID NO: 1286829 - RNA, 17 nt, Homo sapiens
accacucaaaggccaga

SEQ ID NO: 1286830 - RNA, 20 nt, Homo sapiens
accaggauuuauacauacag

SEQ ID NO: 1286831 - RNA, 20 nt, Homo sapiens
accauauaacugugaugaaa

SEQ ID NO: 1286832 - RNA, 17 nt, Homo sapiens
accaucucuuuaccucc

SEQ ID NO: 1286833 - RNA, 20 nt, Homo sapiens
accaucucuuuaccuccuaa

SEQ ID NO: 1286834 - RNA, 22 nt, Homo sapiens
accauuaaucagaaacaucaug

SEQ ID NO: 1286835 - RNA, 13 nt, Homo sapiens
accauucaggaca

SEQ ID NO: 1286836 - RNA, 19 nt, Homo sapiens
accauucaggacacaggga

SEQ ID NO: 1286837 - RNA, 15 nt, Homo sapiens
accauugaacuguac

SEQ ID NO: 1286838 - RNA, 13 nt, Homo sapiens
acccaacucugua

SEQ ID NO: 1286839 - RNA, 20 nt, Homo sapiens
acccacaguggaaagacagc

SEQ ID NO: 1286840 - RNA, 15 nt, Homo sapiens
acccacuaucccauu

SEQ ID NO: 1286841 - RNA, 19 nt, Homo sapiens
acccaguuuagaggggaaa

SEQ ID NO: 1286842 - RNA, 18 nt, Homo sapiens
acccaugggaagggucca

SEQ ID NO: 1286843 - RNA, 22 nt, Homo sapiens
accccaacagcacccucuccag

SEQ ID NO: 1286844 - RNA, 23 nt, Homo sapiens
acccccagggcauuguguucacu

SEQ ID NO: 1286845 - RNA, 18 nt, Homo sapiens
accccccuauugcugcug

SEQ ID NO: 1286846 - RNA, 17 nt, Homo sapiens
accccucccuuucuccc

SEQ ID NO: 1286847 - RNA, 16 nt, Homo sapiens
accccugguucucauc

SEQ ID NO: 1286848 - RNA, 22 nt, Homo sapiens
acccuaugugggugggaccaca

SEQ ID NO: 1286849 - RNA, 18 nt, Homo sapiens
acccucuccccacugcuc

SEQ ID NO: 1286850 - RNA, 14 nt, Homo sapiens
acccugggaccaca

SEQ ID NO: 1286851 - RNA, 16 nt, Homo sapiens
acccugggaccacaga

SEQ ID NO: 1286852 - RNA, 15 nt, Homo sapiens
acccuguuaauccca

SEQ ID NO: 1286853 - RNA, 14 nt, Homo sapiens
acccuuaggccagc

SEQ ID NO: 1286854 - RNA, 18 nt, Homo sapiens
acccuuccacguguaugc

SEQ ID NO: 1286855 - RNA, 21 nt, Homo sapiens
accuaauguuuaugagccaga

SEQ ID NO: 1286856 - RNA, 19 nt, Homo sapiens
accucgugauccaccugcc

SEQ ID NO: 1286857 - RNA, 19 nt, Homo sapiens
accucuaccagcacauuaa

SEQ ID NO: 1286858 - RNA, 16 nt, Homo sapiens
accugaacucugcaac

SEQ ID NO: 1286859 - RNA, 19 nt, Homo sapiens
accugagcagcaacugugu

SEQ ID NO: 1286860 - RNA, 17 nt, Homo sapiens
accugccccucccucua

SEQ ID NO: 1286861 - RNA, 18 nt, Homo sapiens
accuggcccugugccuug

SEQ ID NO: 1286862 - RNA, 17 nt, Homo sapiens
accuguucaaaauucca

SEQ ID NO: 1286863 - RNA, 21 nt, Homo sapiens
accuucuaggaagcuccaguu

SEQ ID NO: 1286864 - RNA, 12 nt, Homo sapiens
accuucuguucc

SEQ ID NO: 1286865 - RNA, 13 nt, Homo sapiens
accuugaugagcu

SEQ ID NO: 1286866 - RNA, 15 nt, Homo sapiens
accuuuccugaggaa

SEQ ID NO: 1286867 - RNA, 12 nt, Homo sapiens
acgagcagggau

SEQ ID NO: 1286868 - RNA, 15 nt, Homo sapiens
acgagcgaaugauuu

SEQ ID NO: 1286869 - RNA, 14 nt, Homo sapiens
acgugagaacaauc

SEQ ID NO: 1286870 - RNA, 14 nt, Homo sapiens
acguuaacagcgug

SEQ ID NO: 1286871 - RNA, 12 nt, Homo sapiens
acuaaaugagac

SEQ ID NO: 1286872 - RNA, 21 nt, Homo sapiens
acuaaauguacuacugagcuu

SEQ ID NO: 1286873 - RNA, 18 nt, Homo sapiens
acuaauaaaauauauacu

SEQ ID NO: 1286874 - RNA, 17 nt, Homo sapiens
acuacaggcaccugcca

SEQ ID NO: 1286875 - RNA, 19 nt, Homo sapiens
acuaccagugggcauguau

SEQ ID NO: 1286876 - RNA, 20 nt, Homo sapiens
acuauaugaaaagagcaaaa

SEQ ID NO: 1286877 - RNA, 19 nt, Homo sapiens
acuaucucagcaucagaau

SEQ ID NO: 1286878 - RNA, 21 nt, Homo sapiens
acuauggagcugagcaggugu

SEQ ID NO: 1286879 - RNA, 21 nt, Homo sapiens
acuauggguggggcacuccuu

SEQ ID NO: 1286880 - RNA, 19 nt, Homo sapiens
acuauugcaaggacagcau

SEQ ID NO: 1286881 - RNA, 17 nt, Homo sapiens
acuauuuuuuuaguuaa

SEQ ID NO: 1286882 - RNA, 14 nt, Homo sapiens
acucaaaggccaga

SEQ ID NO: 1286883 - RNA, 20 nt, Homo sapiens
acucacauagguagguaucu

SEQ ID NO: 1286884 - RNA, 17 nt, Homo sapiens
acucaggggucauucau

SEQ ID NO: 1286885 - RNA, 18 nt, Homo sapiens
acucagucuuuaaucuga

SEQ ID NO: 1286886 - RNA, 20 nt, Homo sapiens
acucaucuuagugccugaga

SEQ ID NO: 1286887 - RNA, 21 nt, Homo sapiens
acucaugacugagucuggcaa

SEQ ID NO: 1286888 - RNA, 15 nt, Homo sapiens
acucccacuuggcau

SEQ ID NO: 1286889 - RNA, 21 nt, Homo sapiens
acucugcuuuuuuucuacugu

SEQ ID NO: 1286890 - RNA, 19 nt, Homo sapiens
acucugggcugccauguga

SEQ ID NO: 1286891 - RNA, 17 nt, Homo sapiens
acugaaacagccagauc

SEQ ID NO: 1286892 - RNA, 18 nt, Homo sapiens
acugaauguaaacaaagg

SEQ ID NO: 1286893 - RNA, 22 nt, Homo sapiens
acugaccuugaugagcugugca

SEQ ID NO: 1286894 - RNA, 13 nt, Homo sapiens
acugacucuguua

SEQ ID NO: 1286895 - RNA, 14 nt, Homo sapiens
acugacucuguuau

SEQ ID NO: 1286896 - RNA, 20 nt, Homo sapiens
acugaggggcccuggucucc

SEQ ID NO: 1286897 - RNA, 23 nt, Homo sapiens
acugaguauugauaaacuuugaa

SEQ ID NO: 1286898 - RNA, 18 nt, Homo sapiens
acugagucuggcaaacau

SEQ ID NO: 1286899 - RNA, 20 nt, Homo sapiens
acugccauauacucuucaag

SEQ ID NO: 1286900 - RNA, 13 nt, Homo sapiens
acugccugaauaa

SEQ ID NO: 1286901 - RNA, 19 nt, Homo sapiens
acugguauuuuaucuuuga

SEQ ID NO: 1286902 - RNA, 17 nt, Homo sapiens
acuguauauacuuugcc

SEQ ID NO: 1286903 - RNA, 22 nt, Homo sapiens
acugucuugaagacaauggcuu

SEQ ID NO: 1286904 - RNA, 12 nt, Homo sapiens
gaccgacugcac

SEQ ID NO: 1286905 - RNA, 21 nt, Homo sapiens
gaccucaaaggugauugugcc

SEQ ID NO: 1286906 - RNA, 18 nt, Homo sapiens
gaccuugaugagcugugc

SEQ ID NO: 1286907 - RNA, 18 nt, Homo sapiens
gacuagaggcuugcauaa

SEQ ID NO: 1286908 - RNA, 12 nt, Homo sapiens
gacuauggagcu

SEQ ID NO: 1286909 - RNA, 20 nt, Homo sapiens
gacuauuauagaauggaacu

SEQ ID NO: 1286910 - RNA, 14 nt, Homo sapiens
gacuucugcaucuu

SEQ ID NO: 1286911 - RNA, 20 nt, Homo sapiens
gagaagccacaggccugaga

SEQ ID NO: 1286912 - RNA, 16 nt, Homo sapiens
gagaauguaagaacua

SEQ ID NO: 1286913 - RNA, 21 nt, Homo sapiens
gagaauuuacgagcagggaug

SEQ ID NO: 1286914 - RNA, 13 nt, Homo sapiens
gagacugcaaugu

SEQ ID NO: 1286915 - RNA, 15 nt, Homo sapiens
gagagaggugccaca

SEQ ID NO: 1286916 - RNA, 20 nt, Homo sapiens
gagagaggugccacacugaa

SEQ ID NO: 1286917 - RNA, 19 nt, Homo sapiens
gagaggccacagugcaauu

SEQ ID NO: 1286918 - RNA, 20 nt, Homo sapiens
gagauaagggugucuuccua

SEQ ID NO: 1286919 - RNA, 19 nt, Homo sapiens
gagaugcugcaguuccaaa

SEQ ID NO: 1286920 - RNA, 15 nt, Homo sapiens
gagauuccugagcca

SEQ ID NO: 1286921 - RNA, 23 nt, Homo sapiens
gagcaguagcagcagcaucucug

SEQ ID NO: 1286922 - RNA, 20 nt, Homo sapiens
gagcagugcuugaaugaagu

SEQ ID NO: 1286923 - RNA, 17 nt, Homo sapiens
gagcaugggacuguucu

SEQ ID NO: 1286924 - RNA, 13 nt, Homo sapiens
gaggacacaucuc

SEQ ID NO: 1286925 - RNA, 18 nt, Homo sapiens
gaggacacaucucccacc

SEQ ID NO: 1286926 - RNA, 23 nt, Homo sapiens
gaggauguguggcauuuucacuu

SEQ ID NO: 1286927 - RNA, 18 nt, Homo sapiens
gaggggcgagaaacaaga

SEQ ID NO: 1286928 - RNA, 17 nt, Homo sapiens
gagggugguaaagugaa

SEQ ID NO: 1286929 - RNA, 16 nt, Homo sapiens
gaggugccacacugaa

SEQ ID NO: 1286930 - RNA, 23 nt, Homo sapiens
gaguaaugauguaacagugcaag

SEQ ID NO: 1286931 - RNA, 15 nt, Homo sapiens
gaguacaccccaaca

SEQ ID NO: 1286932 - RNA, 17 nt, Homo sapiens
gagucgggacuaaccca

SEQ ID NO: 1286933 - RNA, 23 nt, Homo sapiens
gagugccuuuucgagacuggcag

SEQ ID NO: 1286934 - RNA, 23 nt, Homo sapiens
ccucacugcuguagacauuugcu

SEQ ID NO: 1286935 - RNA, 22 nt, Homo sapiens
ccucagggccacguuaccacag

SEQ ID NO: 1286936 - RNA, 16 nt, Homo sapiens
ccucagucccaacucc

SEQ ID NO: 1286937 - RNA, 16 nt, Homo sapiens
ccuccacgccauuucc

SEQ ID NO: 1286938 - RNA, 10 nt, Homo sapiens
ccuccaggga

SEQ ID NO: 1286939 - RNA, 22 nt, Homo sapiens
ccucucuggcuuccaugcuccg

SEQ ID NO: 1286940 - RNA, 22 nt, Homo sapiens
ccugacucccccauuguguuaa

SEQ ID NO: 1286941 - RNA, 15 nt, Homo sapiens
ccugcacucuuuaag

SEQ ID NO: 1286942 - RNA, 14 nt, Homo sapiens
ccugcaggcagcuu

SEQ ID NO: 1286943 - RNA, 22 nt, Homo sapiens
ccugcugugaugugcaaaggca

SEQ ID NO: 1286944 - RNA, 22 nt, Homo sapiens
ccugcuuuccuaucuagcauuu

SEQ ID NO: 1286945 - RNA, 17 nt, Homo sapiens
ccuggccuuguccucag

SEQ ID NO: 1286946 - RNA, 21 nt, Homo sapiens
ccuggcuggcauggaggguga

SEQ ID NO: 1286947 - RNA, 16 nt, Homo sapiens
ccugggaaccaugaag

SEQ ID NO: 1286948 - RNA, 18 nt, Homo sapiens
ccugggaaccaugaagcu

SEQ ID NO: 1286949 - RNA, 13 nt, Homo sapiens
ccugggaccacag

SEQ ID NO: 1286950 - RNA, 17 nt, Homo sapiens
ccuguacugucaggugc

SEQ ID NO: 1286951 - RNA, 21 nt, Homo sapiens
ccuguacugucaggugcacuu

SEQ ID NO: 1286952 - RNA, 15 nt, Homo sapiens
ccugugccuuuugcc

SEQ ID NO: 1286953 - RNA, 22 nt, Homo sapiens
ccuguggauuuuuaaaacagau

SEQ ID NO: 1286954 - RNA, 23 nt, Homo sapiens
ccuuaaugauccguuccauugca

SEQ ID NO: 1286955 - RNA, 14 nt, Homo sapiens
ccuuaugauauucu

SEQ ID NO: 1286956 - RNA, 16 nt, Homo sapiens
ccuuaugauauucuca

SEQ ID NO: 1286957 - RNA, 17 nt, Homo sapiens
ccuuaugauauucucau

SEQ ID NO: 1286958 - RNA, 14 nt, Homo sapiens
ccuucagauuugcc

SEQ ID NO: 1286959 - RNA, 14 nt, Homo sapiens
ccuucucucaucuc

SEQ ID NO: 1286960 - RNA, 19 nt, Homo sapiens
ccuugaugagcugugcaca

SEQ ID NO: 1286961 - RNA, 23 nt, Homo sapiens
ccuuggugugcuguauccaucca

SEQ ID NO: 1286962 - RNA, 14 nt, Homo sapiens
ccuuguauaguguc

SEQ ID NO: 1286963 - RNA, 16 nt, Homo sapiens
ccuuguccucagccag

SEQ ID NO: 1286964 - RNA, 13 nt, Homo sapiens
ccuugugaaggaa

SEQ ID NO: 1286965 - RNA, 15 nt, Homo sapiens
ccuuuacauccagau

SEQ ID NO: 1286966 - RNA, 20 nt, Homo sapiens
ccuuuccccggaguaccuau

SEQ ID NO: 1286967 - RNA, 15 nt, Homo sapiens
ccuuuuaaguuugaa

SEQ ID NO: 1286968 - RNA, 17 nt, Homo sapiens
ccuuuuauuucuuaaac

SEQ ID NO: 1286969 - RNA, 12 nt, Homo sapiens
ccuuuucagggc

SEQ ID NO: 1286970 - RNA, 13 nt, Homo sapiens
ccuuuucagggcc

SEQ ID NO: 1286971 - RNA, 19 nt, Homo sapiens
ccuuuuuauucagcuagaa

SEQ ID NO: 1286972 - RNA, 18 nt, Homo sapiens
cgagagagaggugccaca

SEQ ID NO: 1286973 - RNA, 15 nt, Homo sapiens
cgagccuggcuccaa

SEQ ID NO: 1286974 - RNA, 17 nt, Homo sapiens
cgaggcggaucuuugga

SEQ ID NO: 1286975 - RNA, 17 nt, Homo sapiens
cgcaccaauaaagccuu

SEQ ID NO: 1286976 - RNA, 18 nt, Homo sapiens
cgcaccaauaaagccuuc

SEQ ID NO: 1286977 - RNA, 19 nt, Homo sapiens
cgcaggaagacccaacaca

SEQ ID NO: 1286978 - RNA, 18 nt, Homo sapiens
cgcaggcuucugugugcu

SEQ ID NO: 1286979 - RNA, 16 nt, Homo sapiens
cgccuguaaaaugggg

SEQ ID NO: 1286980 - RNA, 14 nt, Homo sapiens
cggacaguggcagg

SEQ ID NO: 1286981 - RNA, 14 nt, Homo sapiens
cgggaccccgagcc

SEQ ID NO: 1286982 - RNA, 16 nt, Homo sapiens
cgggauguuguuugcu

SEQ ID NO: 1286983 - RNA, 21 nt, Homo sapiens
cgggcaaaauaaagugacaga

SEQ ID NO: 1286984 - RNA, 11 nt, Homo sapiens
cgguucacucu

SEQ ID NO: 1286985 - RNA, 22 nt, Homo sapiens
cguaguggaauuaacaggaaau

SEQ ID NO: 1286986 - RNA, 16 nt, Homo sapiens
cguauaaugcuuucug

SEQ ID NO: 1286987 - RNA, 14 nt, Homo sapiens
cgucauuacagggc

SEQ ID NO: 1286988 - RNA, 17 nt, Homo sapiens
cgugacacaugcucuaa

SEQ ID NO: 1286989 - RNA, 20 nt, Homo sapiens
cguggaauugugcugaguug

SEQ ID NO: 1286990 - RNA, 19 nt, Homo sapiens
cgugggcucgauuccucag

SEQ ID NO: 1286991 - RNA, 20 nt, Homo sapiens
cguguaauuggcccaaguca

SEQ ID NO: 1286992 - RNA, 19 nt, Homo sapiens
cguguuuuccaucccacau

SEQ ID NO: 1286993 - RNA, 19 nt, Homo sapiens
cuaaaaugcuucacuguac

SEQ ID NO: 1286994 - RNA, 13 nt, Homo sapiens
cuaaaccauucau

SEQ ID NO: 1286995 - RNA, 11 nt, Homo sapiens
cuaaacuguau

SEQ ID NO: 1286996 - RNA, 18 nt, Homo sapiens
cuaaagggagaaaugcca

SEQ ID NO: 1286997 - RNA, 19 nt, Homo sapiens
cuaaagguuguauugcaua

SEQ ID NO: 1286998 - RNA, 16 nt, Homo sapiens
cuaaaguauguuuuca

SEQ ID NO: 1286999 - RNA, 22 nt, Homo sapiens
cuaaauauuuguugacugaaua

SEQ ID NO: 1287000 - RNA, 16 nt, Homo sapiens
cuaaccugaacugaug

SEQ ID NO: 1287001 - RNA, 13 nt, Homo sapiens
cuaacuagcuugg

SEQ ID NO: 1287002 - RNA, 21 nt, Homo sapiens
cuaacuguauuuauugugaug

SEQ ID NO: 1287003 - RNA, 21 nt, Homo sapiens
cuaagaagcucguuucuuaga

SEQ ID NO: 1287004 - RNA, 20 nt, Homo sapiens
cuaauaauaaauuaauaaca

SEQ ID NO: 1287005 - RNA, 18 nt, Homo sapiens
cuaauagaauuaauggaa

SEQ ID NO: 1287006 - RNA, 11 nt, Homo sapiens
cuaaugcauua

SEQ ID NO: 1287007 - RNA, 12 nt, Homo sapiens
cuaauuaauucu

SEQ ID NO: 1287008 - RNA, 18 nt, Homo sapiens
cuaauuccuguguagcuu

SEQ ID NO: 1287009 - RNA, 17 nt, Homo sapiens
cuacaagcagcaggaaa

SEQ ID NO: 1287010 - RNA, 13 nt, Homo sapiens
cuacaauuugcca

SEQ ID NO: 1287011 - RNA, 20 nt, Homo sapiens
cuaccaucucacggugggga

SEQ ID NO: 1287012 - RNA, 22 nt, Homo sapiens
cuacccuuccucaccacuuccc

SEQ ID NO: 1287013 - RNA, 13 nt, Homo sapiens
cuaccucuuggcu

SEQ ID NO: 1287014 - RNA, 18 nt, Homo sapiens
cuaccuuuugcuguggca

SEQ ID NO: 1287015 - RNA, 14 nt, Homo sapiens
cuacugccauuuca

SEQ ID NO: 1287016 - RNA, 22 nt, Homo sapiens
cuacugccauuucagugagaaa

SEQ ID NO: 1287017 - RNA, 22 nt, Homo sapiens
cuagaggcuugcauaauaagcu

SEQ ID NO: 1287018 - RNA, 15 nt, Homo sapiens
cuagauacugaaugu

SEQ ID NO: 1287019 - RNA, 14 nt, Homo sapiens
cuuacaaacaugug

SEQ ID NO: 1287020 - RNA, 19 nt, Homo sapiens
cuuauagaggaacuugaaa

SEQ ID NO: 1287021 - RNA, 19 nt, Homo sapiens
cuuaucaacauuuguucca

SEQ ID NO: 1287022 - RNA, 15 nt, Homo sapiens
cuuaugaaacuaaga

SEQ ID NO: 1287023 - RNA, 17 nt, Homo sapiens
cuuauguguuacauuau

SEQ ID NO: 1287024 - RNA, 15 nt, Homo sapiens
cuucaagcagggaag

SEQ ID NO: 1287025 - RNA, 16 nt, Homo sapiens
cuucagauuugccuua

SEQ ID NO: 1287026 - RNA, 22 nt, Homo sapiens
cuucagguuaucgaaauaacaa

SEQ ID NO: 1287027 - RNA, 16 nt, Homo sapiens
cuucaugcauuugcac

SEQ ID NO: 1287028 - RNA, 19 nt, Homo sapiens
cuuccaaacagaacuaugg

SEQ ID NO: 1287029 - RNA, 19 nt, Homo sapiens
cuucccugguaccuagcaa

SEQ ID NO: 1287030 - RNA, 17 nt, Homo sapiens
cuuccgcaguguggcca

SEQ ID NO: 1287031 - RNA, 16 nt, Homo sapiens
cuuccucagcuguaga

SEQ ID NO: 1287032 - RNA, 20 nt, Homo sapiens
cuucuaaccugaacugaugg

SEQ ID NO: 1287033 - RNA, 17 nt, Homo sapiens
cuucuccaauucugaaa

SEQ ID NO: 1287034 - RNA, 16 nt, Homo sapiens
cuucucuacagacucc

SEQ ID NO: 1287035 - RNA, 17 nt, Homo sapiens
cuucugaggacauucca

SEQ ID NO: 1287036 - RNA, 18 nt, Homo sapiens
cuucugccccagcuuugc

SEQ ID NO: 1287037 - RNA, 15 nt, Homo sapiens
cuucugugugcugcu

SEQ ID NO: 1287038 - RNA, 20 nt, Homo sapiens
cuucuuuuaguuguaucucu

SEQ ID NO: 1287039 - RNA, 18 nt, Homo sapiens
cuugaagacaauggcuua

SEQ ID NO: 1287040 - RNA, 22 nt, Homo sapiens
cuugaaucaagucagcaacaga

SEQ ID NO: 1287041 - RNA, 12 nt, Homo sapiens
cuugaucauucu

SEQ ID NO: 1287042 - RNA, 14 nt, Homo sapiens
cuugaucauucuca

SEQ ID NO: 1287043 - RNA, 15 nt, Homo sapiens
cuugcacuauuccac

SEQ ID NO: 1287044 - RNA, 10 nt, Homo sapiens
cuuggcugug

SEQ ID NO: 1287045 - RNA, 15 nt, Homo sapiens
cuuggcugugcccuc

SEQ ID NO: 1287046 - RNA, 22 nt, Homo sapiens
cuugguaacaaauaaccuauaa

SEQ ID NO: 1287047 - RNA, 17 nt, Homo sapiens
cauaagcgaucacuucc

SEQ ID NO: 1287048 - RNA, 11 nt, Homo sapiens
cauacagugau

SEQ ID NO: 1287049 - RNA, 20 nt, Homo sapiens
cauacauuuguggucugacu

SEQ ID NO: 1287050 - RNA, 15 nt, Homo sapiens
cauagcagugcuuga

SEQ ID NO: 1287051 - RNA, 18 nt, Homo sapiens
cauauacucuucaaggac

SEQ ID NO: 1287052 - RNA, 22 nt, Homo sapiens
cauauuaagaauagucucuggg

SEQ ID NO: 1287053 - RNA, 14 nt, Homo sapiens
caucaacauuccug

SEQ ID NO: 1287054 - RNA, 12 nt, Homo sapiens
caucaugacuga

SEQ ID NO: 1287055 - RNA, 21 nt, Homo sapiens
caucaugucaguuccaaugag

SEQ ID NO: 1287056 - RNA, 16 nt, Homo sapiens
cauccagcaguacaau

SEQ ID NO: 1287057 - RNA, 18 nt, Homo sapiens
cauccugcaggcagcuuu

SEQ ID NO: 1287058 - RNA, 17 nt, Homo sapiens
caucuaaauugaucauu

SEQ ID NO: 1287059 - RNA, 12 nt, Homo sapiens
caucuaccugag

SEQ ID NO: 1287060 - RNA, 14 nt, Homo sapiens
caucucucuuuaau

SEQ ID NO: 1287061 - RNA, 23 nt, Homo sapiens
caucugcuucuggggacaccuca

SEQ ID NO: 1287062 - RNA, 14 nt, Homo sapiens
caucuguaccucug

SEQ ID NO: 1287063 - RNA, 18 nt, Homo sapiens
caucuugaucaaccaaaa

SEQ ID NO: 1287064 - RNA, 21 nt, Homo sapiens
caucuuugcugaaugucauua

SEQ ID NO: 1287065 - RNA, 21 nt, Homo sapiens
caugaacaaguuaguuucuca

SEQ ID NO: 1287066 - RNA, 13 nt, Homo sapiens
caugagaagucac

SEQ ID NO: 1287067 - RNA, 14 nt, Homo sapiens
caugagaagucacu

SEQ ID NO: 1287068 - RNA, 16 nt, Homo sapiens
caugagaagucacuca

SEQ ID NO: 1287069 - RNA, 15 nt, Homo sapiens
caugagucagucuga

SEQ ID NO: 1287070 - RNA, 18 nt, Homo sapiens
aggacagggagaugcugc

SEQ ID NO: 1287071 - RNA, 22 nt, Homo sapiens
aggacccagaaaaaaagcccaa

SEQ ID NO: 1287072 - RNA, 14 nt, Homo sapiens
aggacugggccacu

SEQ ID NO: 1287073 - RNA, 18 nt, Homo sapiens
aggagacccacagguaug

SEQ ID NO: 1287074 - RNA, 17 nt, Homo sapiens
aggagccuaguacaaua

SEQ ID NO: 1287075 - RNA, 19 nt, Homo sapiens
aggagggucggugccuuca

SEQ ID NO: 1287076 - RNA, 20 nt, Homo sapiens
aggaguacaccccaacagca

SEQ ID NO: 1287077 - RNA, 13 nt, Homo sapiens
aggcacuaaaaag

SEQ ID NO: 1287078 - RNA, 23 nt, Homo sapiens
aggcagcuuuuucucucccacua

SEQ ID NO: 1287079 - RNA, 20 nt, Homo sapiens
aggcauccuuccucacacca

SEQ ID NO: 1287080 - RNA, 20 nt, Homo sapiens
aggcaugagccaccgcgccu

SEQ ID NO: 1287081 - RNA, 11 nt, Homo sapiens
aggccaggacu

SEQ ID NO: 1287082 - RNA, 15 nt, Homo sapiens
aggccauugucccug

SEQ ID NO: 1287083 - RNA, 12 nt, Homo sapiens
aggccugagauu

SEQ ID NO: 1287084 - RNA, 15 nt, Homo sapiens
aggcggaucuuugga

SEQ ID NO: 1287085 - RNA, 22 nt, Homo sapiens
aggcugccugggccuguucacg

SEQ ID NO: 1287086 - RNA, 15 nt, Homo sapiens
aggcuggcagugaca

SEQ ID NO: 1287087 - RNA, 20 nt, Homo sapiens
agggacaccaagccuuggcu

SEQ ID NO: 1287088 - RNA, 16 nt, Homo sapiens
aggggcagauggaaag

SEQ ID NO: 1287089 - RNA, 18 nt, Homo sapiens
agggggcuggcucugaga

SEQ ID NO: 1287090 - RNA, 14 nt, Homo sapiens
aggggucauucaug

SEQ ID NO: 1287091 - RNA, 21 nt, Homo sapiens
aggguggugaccaaugcauua

SEQ ID NO: 1287092 - RNA, 13 nt, Homo sapiens
agggugucuuccu

SEQ ID NO: 1287093 - RNA, 14 nt, Homo sapiens
aggguuacaaaucu

SEQ ID NO: 1287094 - RNA, 12 nt, Homo sapiens
agguaacuguac

SEQ ID NO: 1287095 - RNA, 14 nt, Homo sapiens
agguaagagcaaaa

SEQ ID NO: 1287096 - RNA, 23 nt, Homo sapiens
aggucccuugucccaaguuccac

SEQ ID NO: 1287097 - RNA, 15 nt, Homo sapiens
aggucuaucuacuaa

SEQ ID NO: 1287098 - RNA, 20 nt, Homo sapiens
aggucuuuuacauacaguga

SEQ ID NO: 1287099 - RNA, 22 nt, Homo sapiens
aggugcuacuuuauaauaagac

SEQ ID NO: 1287100 - RNA, 21 nt, Homo sapiens
agguguucuucauuaccucag

SEQ ID NO: 1287101 - RNA, 20 nt, Homo sapiens
agguuaaugcagggacugua

SEQ ID NO: 1287102 - RNA, 14 nt, Homo sapiens
agguuaucgaaaua

SEQ ID NO: 1287103 - RNA, 21 nt, Homo sapiens
agguuuguuuagaagaagugu

SEQ ID NO: 1287104 - RNA, 17 nt, Homo sapiens
aguaacggaacaguauc

SEQ ID NO: 1287105 - RNA, 15 nt, Homo sapiens
aguaagaagacauga

SEQ ID NO: 1287106 - RNA, 21 nt, Homo sapiens
aguacaccccaacagcacccu

SEQ ID NO: 1287107 - RNA, 23 nt, Homo sapiens
aguacaccccaacagcacccucu

SEQ ID NO: 1287108 - RNA, 13 nt, Homo sapiens
aguacagacuuuu

SEQ ID NO: 1287109 - RNA, 23 nt, Homo sapiens
aguagaacaaaaacuauuaucac

SEQ ID NO: 1287110 - RNA, 23 nt, Homo sapiens
aguaguugggauuaccaguagau

SEQ ID NO: 1287111 - RNA, 23 nt, Homo sapiens
aguauacacacuuuccaaguacu

SEQ ID NO: 1287112 - RNA, 15 nt, Homo sapiens
aguaucaaacuacug

SEQ ID NO: 1287113 - RNA, 19 nt, Homo sapiens
aguaucaaacuacugccau

SEQ ID NO: 1287114 - RNA, 20 nt, Homo sapiens
aguauguccuucagcugacu

SEQ ID NO: 1287115 - RNA, 12 nt, Homo sapiens
aguauugugcau

SEQ ID NO: 1287116 - RNA, 21 nt, Homo sapiens
aguauuuaacuacaucugccu

SEQ ID NO: 1287117 - RNA, 13 nt, Homo sapiens
agucacugacccu

SEQ ID NO: 1287118 - RNA, 20 nt, Homo sapiens
agucacuuauaauuaugcua

SEQ ID NO: 1287119 - RNA, 19 nt, Homo sapiens
agucagcaacagagcaaaa

SEQ ID NO: 1287120 - RNA, 23 nt, Homo sapiens
agucaguuguggccccagccccu

SEQ ID NO: 1287121 - RNA, 13 nt, Homo sapiens
agucauccucaga

SEQ ID NO: 1287122 - RNA, 16 nt, Homo sapiens
agucauccucagauca

SEQ ID NO: 1287123 - RNA, 11 nt, Homo sapiens
agucauugcag

SEQ ID NO: 1287124 - RNA, 21 nt, Homo sapiens
aguccagccuggcaaggguuc

SEQ ID NO: 1287125 - RNA, 14 nt, Homo sapiens
aguccauauuucaa

SEQ ID NO: 1287126 - RNA, 23 nt, Homo sapiens
aguccccuucuuuuggcccuccg

SEQ ID NO: 1287127 - RNA, 17 nt, Homo sapiens
agucugcucaacacgac

SEQ ID NO: 1287128 - RNA, 23 nt, Homo sapiens
agucugcucaacacgacugcaag

SEQ ID NO: 1287129 - RNA, 20 nt, Homo sapiens
agugaaagcaucacuuggga

SEQ ID NO: 1287130 - RNA, 16 nt, Homo sapiens
agugaaauauaugcua

SEQ ID NO: 1287131 - RNA, 18 nt, Homo sapiens
agugacugcaagcauuuu

SEQ ID NO: 1287132 - RNA, 17 nt, Homo sapiens
agugacuucacagagac

SEQ ID NO: 1287133 - RNA, 22 nt, Homo sapiens
agugagggucuucuuacaugca

SEQ ID NO: 1287134 - RNA, 16 nt, Homo sapiens
agugagugccaugcuu

SEQ ID NO: 1287135 - RNA, 13 nt, Homo sapiens
agugaugccaucc

SEQ ID NO: 1287136 - RNA, 13 nt, Homo sapiens
agugcuucuugua

SEQ ID NO: 1287137 - RNA, 22 nt, Homo sapiens
aguggaaagacagcuucucauc

SEQ ID NO: 1287138 - RNA, 21 nt, Homo sapiens
aguggcauaaaaaacaugugg

SEQ ID NO: 1287139 - RNA, 20 nt, Homo sapiens
aguggcguaaucucggcuca

SEQ ID NO: 1287140 - RNA, 13 nt, Homo sapiens
agugggcauguau

SEQ ID NO: 1287141 - RNA, 17 nt, Homo sapiens
aguguggccaggcugcc

SEQ ID NO: 1287142 - RNA, 18 nt, Homo sapiens
aguguuaugugaauuuga

SEQ ID NO: 1287143 - RNA, 14 nt, Homo sapiens
aguguuuguauacc

SEQ ID NO: 1287144 - RNA, 23 nt, Homo sapiens
aguuaugaaaaauaagucacuua

SEQ ID NO: 1287145 - RNA, 17 nt, Homo sapiens
aguucaccagacucuau

SEQ ID NO: 1287146 - RNA, 20 nt, Homo sapiens
aguugcuuguaaaauuucac

SEQ ID NO: 1287147 - RNA, 18 nt, Homo sapiens
aguuuaugcauacaguaa

SEQ ID NO: 1287148 - RNA, 18 nt, Homo sapiens
aguuucucucacauuacu

SEQ ID NO: 1287149 - RNA, 15 nt, Homo sapiens
aguuucuuagcuuuu

SEQ ID NO: 1287150 - RNA, 17 nt, Homo sapiens
aguuuuuuuuuuuccag

SEQ ID NO: 1287151 - RNA, 18 nt, Homo sapiens
auaaaagaucuugcagaa

SEQ ID NO: 1287152 - RNA, 17 nt, Homo sapiens
auaaaaguaaaccacaa

SEQ ID NO: 1287153 - RNA, 20 nt, Homo sapiens
auaaaaucuaauuaauucuu

SEQ ID NO: 1287154 - RNA, 23 nt, Homo sapiens
auaaaauugcaguuucauguaug

SEQ ID NO: 1287155 - RNA, 17 nt, Homo sapiens
auaaaauuuuuuacuuu

SEQ ID NO: 1287156 - RNA, 19 nt, Homo sapiens
auaaagguuagauaagucc

SEQ ID NO: 1287157 - RNA, 13 nt, Homo sapiens
auaaauaugcagu

SEQ ID NO: 1287158 - RNA, 13 nt, Homo sapiens
auaagacauaacg

SEQ ID NO: 1287159 - RNA, 17 nt, Homo sapiens
auaagcaaagacuauga

SEQ ID NO: 1287160 - RNA, 20 nt, Homo sapiens
auaagcagucauccucagau

SEQ ID NO: 1287161 - RNA, 18 nt, Homo sapiens
auaagcuaaagaggcuga

SEQ ID NO: 1287162 - RNA, 21 nt, Homo sapiens
augugggggucuguguguuua

SEQ ID NO: 1287163 - RNA, 19 nt, Homo sapiens
augugggugggaccacaga

SEQ ID NO: 1287164 - RNA, 24 nt, Homo sapiens
augugguuaaugccauggacagaa

SEQ ID NO: 1287165 - RNA, 14 nt, Homo sapiens
augugucccaguga

SEQ ID NO: 1287166 - RNA, 16 nt, Homo sapiens
auguguggcauuuuca

SEQ ID NO: 1287167 - RNA, 19 nt, Homo sapiens
auguguuucuccugagcua

SEQ ID NO: 1287168 - RNA, 16 nt, Homo sapiens
auguguuuuuuuacau

SEQ ID NO: 1287169 - RNA, 16 nt, Homo sapiens
auguuaccauuaauca

SEQ ID NO: 1287170 - RNA, 22 nt, Homo sapiens
auguuucugucacaucagcucc

SEQ ID NO: 1287171 - RNA, 17 nt, Homo sapiens
auguuuuagccagugau

SEQ ID NO: 1287172 - RNA, 21 nt, Homo sapiens
auuaacuuuuuaaaacacaac

SEQ ID NO: 1287173 - RNA, 19 nt, Homo sapiens
auuaauaauagcuaauaau

SEQ ID NO: 1287174 - RNA, 20 nt, Homo sapiens
auuaauauggggaugcagca

SEQ ID NO: 1287175 - RNA, 16 nt, Homo sapiens
auuacuguauauacuu

SEQ ID NO: 1287176 - RNA, 14 nt, Homo sapiens
auuagaaauaucuu

SEQ ID NO: 1287177 - RNA, 15 nt, Homo sapiens
auuaguugcuuuguu

SEQ ID NO: 1287178 - RNA, 20 nt, Homo sapiens
auuauauaaggacagaccaa

SEQ ID NO: 1287179 - RNA, 20 nt, Homo sapiens
auuaucuaaaguaugaagca

SEQ ID NO: 1287180 - RNA, 17 nt, Homo sapiens
auuaugcccaugaacaa

SEQ ID NO: 1287181 - RNA, 15 nt, Homo sapiens
auuauuuaauaacau

SEQ ID NO: 1287182 - RNA, 23 nt, Homo sapiens
auucaaaagcacuuugugcugug

SEQ ID NO: 1287183 - RNA, 18 nt, Homo sapiens
cuuguaaaauuucacuua

SEQ ID NO: 1287184 - RNA, 16 nt, Homo sapiens
cuuguuccaaugccac

SEQ ID NO: 1287185 - RNA, 23 nt, Homo sapiens
cuuuaagcgcaacauuucuuggu

SEQ ID NO: 1287186 - RNA, 14 nt, Homo sapiens
cuuuacugccugaa

SEQ ID NO: 1287187 - RNA, 19 nt, Homo sapiens
cuuuagcaguuuugugaua

SEQ ID NO: 1287188 - RNA, 13 nt, Homo sapiens
cuuuauauaccuu

SEQ ID NO: 1287189 - RNA, 21 nt, Homo sapiens
cuuucaaauuuacugucuuaa

SEQ ID NO: 1287190 - RNA, 18 nt, Homo sapiens
cuuucaagguaacuguac

SEQ ID NO: 1287191 - RNA, 16 nt, Homo sapiens
cuuuccucaucaggcc

SEQ ID NO: 1287192 - RNA, 15 nt, Homo sapiens
cuuucuaccaucuca

SEQ ID NO: 1287193 - RNA, 14 nt, Homo sapiens
cuuucuugcacuau

SEQ ID NO: 1287194 - RNA, 19 nt, Homo sapiens
cuuucuugcacuauuccac

SEQ ID NO: 1287195 - RNA, 14 nt, Homo sapiens
cuuugaauguauug

SEQ ID NO: 1287196 - RNA, 15 nt, Homo sapiens
cuuugauaguguaaa

SEQ ID NO: 1287197 - RNA, 19 nt, Homo sapiens
cuuugccuuuccauaauca

SEQ ID NO: 1287198 - RNA, 19 nt, Homo sapiens
cuuuguaucauucaucuuc

SEQ ID NO: 1287199 - RNA, 16 nt, Homo sapiens
cuuuguccauuauuca

SEQ ID NO: 1287200 - RNA, 20 nt, Homo sapiens
cuuugugugcgucacuguga

SEQ ID NO: 1287201 - RNA, 14 nt, Homo sapiens
cuuuguuuccucuu

SEQ ID NO: 1287202 - RNA, 14 nt, Homo sapiens
cuuuuacaccaguu

SEQ ID NO: 1287203 - RNA, 19 nt, Homo sapiens
cuuuuaguuacaugaauua

SEQ ID NO: 1287204 - RNA, 17 nt, Homo sapiens
cuuuuaucuccuugugg

SEQ ID NO: 1287205 - RNA, 12 nt, Homo sapiens
cuuuucagggcc

SEQ ID NO: 1287206 - RNA, 16 nt, Homo sapiens
cuuuuuguuaugcaaa

SEQ ID NO: 1287207 - RNA, 14 nt, Homo sapiens
gaaaaaaguguuua

SEQ ID NO: 1287208 - RNA, 11 nt, Homo sapiens
gaaaaauaaga

SEQ ID NO: 1287209 - RNA, 23 nt, Homo sapiens
gaaaagcuauuagccaggaucau

SEQ ID NO: 1287210 - RNA, 20 nt, Homo sapiens
gaaaauaauugcaaauaucc

SEQ ID NO: 1287211 - RNA, 20 nt, Homo sapiens
gaaaauaguuuggauuacuu

SEQ ID NO: 1287212 - RNA, 16 nt, Homo sapiens
gaaaauauggguugca

SEQ ID NO: 1287213 - RNA, 21 nt, Homo sapiens
gaaaauccuaggugcuacuuu

SEQ ID NO: 1287214 - RNA, 14 nt, Homo sapiens
gaaaaugugcaaua

SEQ ID NO: 1287215 - RNA, 21 nt, Homo sapiens
gaaacaagacaagcuccuccc

SEQ ID NO: 1287216 - RNA, 21 nt, Homo sapiens
gaaacucuuaucucagucaug

SEQ ID NO: 1287217 - RNA, 18 nt, Homo sapiens
gaaagcaucacuugggau

SEQ ID NO: 1287218 - RNA, 17 nt, Homo sapiens
gaaaggcgagguggcug

SEQ ID NO: 1287219 - RNA, 22 nt, Homo sapiens
gaaauaaaaucuaauuaauucu

SEQ ID NO: 1287220 - RNA, 15 nt, Homo sapiens
gaaauaacaauguua

SEQ ID NO: 1287221 - RNA, 14 nt, Homo sapiens
gaaaucaugagggu

SEQ ID NO: 1287222 - RNA, 19 nt, Homo sapiens
gaaauccgucuaguuaaca

SEQ ID NO: 1287223 - RNA, 19 nt, Homo sapiens
gaaauuaacacccaaaaga

SEQ ID NO: 1287224 - RNA, 22 nt, Homo sapiens
gaaauugaaguuucagagcuac

SEQ ID NO: 1287225 - RNA, 16 nt, Homo sapiens
gaacaaaauaagcaac

SEQ ID NO: 1287226 - RNA, 14 nt, Homo sapiens
gaacacaaggucau

SEQ ID NO: 1287227 - RNA, 16 nt, Homo sapiens
gaacauagaacucugg

SEQ ID NO: 1287228 - RNA, 15 nt, Homo sapiens
gaaccugggaaccau

SEQ ID NO: 1287229 - RNA, 21 nt, Homo sapiens
gaacucaaggaaaucuguguc

SEQ ID NO: 1287230 - RNA, 23 nt, Homo sapiens
gaacucagagccagaucccuuau

SEQ ID NO: 1287231 - RNA, 17 nt, Homo sapiens
gaacucugaauaugccu

SEQ ID NO: 1287232 - RNA, 19 nt, Homo sapiens
gaagaaauuccaggaaaau

SEQ ID NO: 1287233 - RNA, 14 nt, Homo sapiens
gaagaaauucugca

SEQ ID NO: 1287234 - RNA, 20 nt, Homo sapiens
gaagaacggggcucuucuca

SEQ ID NO: 1287235 - RNA, 20 nt, Homo sapiens
gaagacacgagcgaaugauu

SEQ ID NO: 1287236 - RNA, 20 nt, Homo sapiens
gaagagggagaagcaugaaa

SEQ ID NO: 1287237 - RNA, 17 nt, Homo sapiens
gaagaugggaaaaccau

SEQ ID NO: 1287238 - RNA, 21 nt, Homo sapiens
gaagaugggaaaaccauggua

SEQ ID NO: 1287239 - RNA, 20 nt, Homo sapiens
gaagcauggcggcaucugcu

SEQ ID NO: 1287240 - RNA, 18 nt, Homo sapiens
gaagccacaggccugaga

SEQ ID NO: 1287241 - RNA, 17 nt, Homo sapiens
gaagccagcuuuccuca

SEQ ID NO: 1287242 - RNA, 18 nt, Homo sapiens
gaagcuguuguacauuua

SEQ ID NO: 1287243 - RNA, 17 nt, Homo sapiens
gaagugugggucugugu

SEQ ID NO: 1287244 - RNA, 17 nt, Homo sapiens
gaaguuuaaagaugccu

SEQ ID NO: 1287245 - RNA, 18 nt, Homo sapiens
gaauaaaugaaugcacaa

SEQ ID NO: 1287246 - RNA, 23 nt, Homo sapiens
gaauauauggcauuugcagauuu

SEQ ID NO: 1287247 - RNA, 17 nt, Homo sapiens
gaauauguaaauagaaa

SEQ ID NO: 1287248 - RNA, 20 nt, Homo sapiens
gaaucaagucagcaacagag

SEQ ID NO: 1287249 - RNA, 15 nt, Homo sapiens
gaaucuguuaccaga

SEQ ID NO: 1287250 - RNA, 19 nt, Homo sapiens
gaauguauuaguacaaacu

SEQ ID NO: 1287251 - RNA, 23 nt, Homo sapiens
gaauuaaguuagggaauggcaca

SEQ ID NO: 1287252 - RNA, 13 nt, Homo sapiens
gaauuaauggaau

SEQ ID NO: 1287253 - RNA, 14 nt, Homo sapiens
gaauuuuugcacau

SEQ ID NO: 1287254 - RNA, 20 nt, Homo sapiens
gacaaagugugucucaaaaa

SEQ ID NO: 1287255 - RNA, 16 nt, Homo sapiens
gacaaccucauuuuaa

SEQ ID NO: 1287256 - RNA, 19 nt, Homo sapiens
gacacaauguugcacugaa

SEQ ID NO: 1287257 - RNA, 15 nt, Homo sapiens
gacacaucucccacc

SEQ ID NO: 1287258 - RNA, 22 nt, Homo sapiens
gacaccagagcagaugcagaga

SEQ ID NO: 1287259 - RNA, 14 nt, Homo sapiens
gacagaagcagcuc

SEQ ID NO: 1287260 - RNA, 16 nt, Homo sapiens
gacagaccaaaaauca

SEQ ID NO: 1287261 - RNA, 19 nt, Homo sapiens
gacauaagcaaagacuaug

SEQ ID NO: 1287262 - RNA, 21 nt, Homo sapiens
gacauuccaagacaguauaca

SEQ ID NO: 1287263 - RNA, 16 nt, Homo sapiens
gacccauuccuuccca

SEQ ID NO: 1287264 - RNA, 22 nt, Homo sapiens
aacuaccagugggcauguauua

SEQ ID NO: 1287265 - RNA, 11 nt, Homo sapiens
aacucaauauu

SEQ ID NO: 1287266 - RNA, 22 nt, Homo sapiens
aacucaugacugagucuggcaa

SEQ ID NO: 1287267 - RNA, 16 nt, Homo sapiens
aacucugaaccaccuu

SEQ ID NO: 1287268 - RNA, 22 nt, Homo sapiens
aacucugcaacugaauacuuga

SEQ ID NO: 1287269 - RNA, 12 nt, Homo sapiens
aacucuguacaa

SEQ ID NO: 1287270 - RNA, 21 nt, Homo sapiens
aacucuguugguuuacugugu

SEQ ID NO: 1287271 - RNA, 13 nt, Homo sapiens
aacucuuaucuca

SEQ ID NO: 1287272 - RNA, 17 nt, Homo sapiens
aacugcuuuauuuuccc

SEQ ID NO: 1287273 - RNA, 16 nt, Homo sapiens
aacuggaugaggucau

SEQ ID NO: 1287274 - RNA, 17 nt, Homo sapiens
aacuguaccaugugcua

SEQ ID NO: 1287275 - RNA, 23 nt, Homo sapiens
aacuugcacaaaaucacacagcc

SEQ ID NO: 1287276 - RNA, 16 nt, Homo sapiens
aacuuuugugcucccc

SEQ ID NO: 1287277 - RNA, 13 nt, Homo sapiens
aagaaagaaccaa

SEQ ID NO: 1287278 - RNA, 18 nt, Homo sapiens
aagaaauaaaaucuaauu

SEQ ID NO: 1287279 - RNA, 16 nt, Homo sapiens
aagaaauuaacaccca

SEQ ID NO: 1287280 - RNA, 16 nt, Homo sapiens
aagaaugacuaugcaa

SEQ ID NO: 1287281 - RNA, 22 nt, Homo sapiens
aagacauaacguuuuuccuuua

SEQ ID NO: 1287282 - RNA, 16 nt, Homo sapiens
aagagaauguauuucc

SEQ ID NO: 1287283 - RNA, 14 nt, Homo sapiens
aagaucuacuacau

SEQ ID NO: 1287284 - RNA, 22 nt, Homo sapiens
aagaugacucguucccauagau

SEQ ID NO: 1287285 - RNA, 20 nt, Homo sapiens
aagaugggagcccaguuuca

SEQ ID NO: 1287286 - RNA, 22 nt, Homo sapiens
aagcaagaucuacuacauccca

SEQ ID NO: 1287287 - RNA, 13 nt, Homo sapiens
aagcacagcaccc

SEQ ID NO: 1287288 - RNA, 16 nt, Homo sapiens
aagcacuuugugcugu

SEQ ID NO: 1287289 - RNA, 14 nt, Homo sapiens
aagcagccuccuua

SEQ ID NO: 1287290 - RNA, 15 nt, Homo sapiens
aagcaugaaaaagca

SEQ ID NO: 1287291 - RNA, 17 nt, Homo sapiens
aagcauggcggcaucug

SEQ ID NO: 1287292 - RNA, 12 nt, Homo sapiens
aagcauuuacaa

SEQ ID NO: 1287293 - RNA, 16 nt, Homo sapiens
aagcauuuuacaagau

SEQ ID NO: 1287294 - RNA, 23 nt, Homo sapiens
aagcauuuuacaagaucuugcau

SEQ ID NO: 1287295 - RNA, 14 nt, Homo sapiens
aagcauuuuuccau

SEQ ID NO: 1287296 - RNA, 20 nt, Homo sapiens
aagcccuuguccccaugaaa

SEQ ID NO: 1287297 - RNA, 18 nt, Homo sapiens
aagccuagcccuucucuc

SEQ ID NO: 1287298 - RNA, 14 nt, Homo sapiens
aagcuaaucugccu

SEQ ID NO: 1287299 - RNA, 16 nt, Homo sapiens
aagcuacugaauuuau

SEQ ID NO: 1287300 - RNA, 20 nt, Homo sapiens
aagcuauuagccaggaucau

SEQ ID NO: 1287301 - RNA, 19 nt, Homo sapiens
aagcuccugccucuuugug

SEQ ID NO: 1287302 - RNA, 14 nt, Homo sapiens
aagcugggagcaca

SEQ ID NO: 1287303 - RNA, 22 nt, Homo sapiens
aagcugggagcacaggcacugc

SEQ ID NO: 1287304 - RNA, 12 nt, Homo sapiens
aagcuucaggga

SEQ ID NO: 1287305 - RNA, 14 nt, Homo sapiens
aaggaagauucuuc

SEQ ID NO: 1287306 - RNA, 14 nt, Homo sapiens
aaggaauacaauau

SEQ ID NO: 1287307 - RNA, 16 nt, Homo sapiens
aaggacaaacagugaa

SEQ ID NO: 1287308 - RNA, 20 nt, Homo sapiens
aaggacaccuuuuaacucac

SEQ ID NO: 1287309 - RNA, 18 nt, Homo sapiens
aaggacagaccaaaaauc

SEQ ID NO: 1287310 - RNA, 13 nt, Homo sapiens
aaggagaacaaga

SEQ ID NO: 1287311 - RNA, 14 nt, Homo sapiens
aaggcccuuuucag

SEQ ID NO: 1287312 - RNA, 20 nt, Homo sapiens
aaggcugcccccuuccucac

SEQ ID NO: 1287313 - RNA, 21 nt, Homo sapiens
aaggcuuacacccacagugga

SEQ ID NO: 1287314 - RNA, 14 nt, Homo sapiens
aagggugucuuccu

SEQ ID NO: 1287315 - RNA, 15 nt, Homo sapiens
aaguaaaccacaaaa

SEQ ID NO: 1287316 - RNA, 19 nt, Homo sapiens
aaguacuagcuuacuuuug

SEQ ID NO: 1287317 - RNA, 19 nt, Homo sapiens
aagucgagggacuuuaugu

SEQ ID NO: 1287318 - RNA, 22 nt, Homo sapiens
aagucuuccauagagacuuugu

SEQ ID NO: 1287319 - RNA, 23 nt, Homo sapiens
aagucuugguaacaaauaaccua

SEQ ID NO: 1287320 - RNA, 13 nt, Homo sapiens
aagugaguggcau

SEQ ID NO: 1287321 - RNA, 19 nt, Homo sapiens
aagugcauuauuuuauuga

SEQ ID NO: 1287322 - RNA, 20 nt, Homo sapiens
aagugcugcgauuacaggca

SEQ ID NO: 1287323 - RNA, 18 nt, Homo sapiens
aagugugucucaaaaaua

SEQ ID NO: 1287324 - RNA, 17 nt, Homo sapiens
aaguuucuuaaagcaac

SEQ ID NO: 1287325 - RNA, 14 nt, Homo sapiens
aauaaaaacugacu

SEQ ID NO: 1287326 - RNA, 17 nt, Homo sapiens
aauaaaauuauuugcag

SEQ ID NO: 1287327 - RNA, 15 nt, Homo sapiens
aauaauaaaugcaua

SEQ ID NO: 1287328 - RNA, 23 nt, Homo sapiens
aauaaucaucgagguauguuuau

SEQ ID NO: 1287329 - RNA, 15 nt, Homo sapiens
aauaaucuauauuaa

SEQ ID NO: 1287330 - RNA, 19 nt, Homo sapiens
aauacguguguaccuaaaa

SEQ ID NO: 1287331 - RNA, 18 nt, Homo sapiens
aauaguguccuaugcaau

SEQ ID NO: 1287332 - RNA, 19 nt, Homo sapiens
aauauaaaagaucuugcag

SEQ ID NO: 1287333 - RNA, 18 nt, Homo sapiens
aauauauggcauuugcag

SEQ ID NO: 1287334 - RNA, 18 nt, Homo sapiens
aauauggguugcauuugg

SEQ ID NO: 1287335 - RNA, 23 nt, Homo sapiens
aauauguaaauagaaacguguau

SEQ ID NO: 1287336 - RNA, 17 nt, Homo sapiens
aauauuugcaagacaua

SEQ ID NO: 1287337 - RNA, 21 nt, Homo sapiens
aauauuuuuaaaaguauacau

SEQ ID NO: 1287338 - RNA, 18 nt, Homo sapiens
aaucaagucagcaacaga

SEQ ID NO: 1287339 - RNA, 18 nt, Homo sapiens
aaucacacagccaagcca

SEQ ID NO: 1287340 - RNA, 17 nt, Homo sapiens
aaucaugcucauguaua

SEQ ID NO: 1287341 - RNA, 22 nt, Homo sapiens
aaucaugcucauguauauuuag

SEQ ID NO: 1287342 - RNA, 21 nt, Homo sapiens
aauccaauuaaucaaaccacu

SEQ ID NO: 1287343 - RNA, 16 nt, Homo sapiens
aauccuaggugcuacu

SEQ ID NO: 1287344 - RNA, 21 nt, Homo sapiens
aaucuauaugauuucagaaau

SEQ ID NO: 1287345 - RNA, 22 nt, Homo sapiens
aaucuguuugacagucugcuca

SEQ ID NO: 1287346 - RNA, 20 nt, Homo sapiens
aaucuucuugauccacuucu

SEQ ID NO: 1287347 - RNA, 22 nt, Homo sapiens
aaucuucuugauccacuucucu

SEQ ID NO: 1287348 - RNA, 13 nt, Homo sapiens
aaugaacacucau

SEQ ID NO: 1287349 - RNA, 21 nt, Homo sapiens
aaugagaagaaugacuaugca

SEQ ID NO: 1287350 - RNA, 22 nt, Homo sapiens
aaugagauuucuuugaauguau

SEQ ID NO: 1287351 - RNA, 23 nt, Homo sapiens
aaugauuuaaauagaacuugauu

SEQ ID NO: 1287352 - RNA, 19 nt, Homo sapiens
aaugcagggacaaaugcca

SEQ ID NO: 1287353 - RNA, 20 nt, Homo sapiens
aaugcagggacaaaugccac

SEQ ID NO: 1287354 - RNA, 19 nt, Homo sapiens
aaugccacacggcucucac

SEQ ID NO: 1287355 - RNA, 17 nt, Homo sapiens
aaugccacauacuugca

SEQ ID NO: 1287356 - RNA, 14 nt, Homo sapiens
aaugcccagugacc

SEQ ID NO: 1287357 - RNA, 17 nt, Homo sapiens
aauggggugcaugaagg

SEQ ID NO: 1287358 - RNA, 20 nt, Homo sapiens
aaugguaggucaaguaauaa

SEQ ID NO: 1287359 - RNA, 21 nt, Homo sapiens
acaaaaaaagcauuguaacuu

SEQ ID NO: 1287360 - RNA, 13 nt, Homo sapiens
acaaaaggcuuug

SEQ ID NO: 1287361 - RNA, 12 nt, Homo sapiens
acaaacagugaa

SEQ ID NO: 1287362 - RNA, 12 nt, Homo sapiens
acaaacaugugg

SEQ ID NO: 1287363 - RNA, 14 nt, Homo sapiens
acaaacaugugguu

SEQ ID NO: 1287364 - RNA, 22 nt, Homo sapiens
acaaauauggaugagguggaga

SEQ ID NO: 1287365 - RNA, 21 nt, Homo sapiens
acaaauguuguauaaccaaua

SEQ ID NO: 1287366 - RNA, 22 nt, Homo sapiens
acaaauguuguauaaccaauac

SEQ ID NO: 1287367 - RNA, 17 nt, Homo sapiens
acaacauguauaauauu

SEQ ID NO: 1287368 - RNA, 17 nt, Homo sapiens
acaacauguauguggau

SEQ ID NO: 1287369 - RNA, 23 nt, Homo sapiens
acaaucaacucuaauagugcuua

SEQ ID NO: 1287370 - RNA, 17 nt, Homo sapiens
acaauggcuuacuccag

SEQ ID NO: 1287371 - RNA, 18 nt, Homo sapiens
acaauguacaagguaugu

SEQ ID NO: 1287372 - RNA, 13 nt, Homo sapiens
acacaacauguau

SEQ ID NO: 1287373 - RNA, 17 nt, Homo sapiens
acacagacccaaaccau

SEQ ID NO: 1287374 - RNA, 20 nt, Homo sapiens
acacagacccaaaccauacc

SEQ ID NO: 1287375 - RNA, 15 nt, Homo sapiens
acacagacuguuguc

SEQ ID NO: 1287376 - RNA, 17 nt, Homo sapiens
acacagaggggagucac

SEQ ID NO: 1287377 - RNA, 21 nt, Homo sapiens
acacagaggggagucaccagc

SEQ ID NO: 1287378 - RNA, 17 nt, Homo sapiens
acacagccccauguaca

SEQ ID NO: 1287379 - RNA, 20 nt, Homo sapiens
acacagugccuguaaaucuc

SEQ ID NO: 1287380 - RNA, 13 nt, Homo sapiens
acacaugcucuaa

SEQ ID NO: 1287381 - RNA, 22 nt, Homo sapiens
acaccagagcagaugcagagag

SEQ ID NO: 1287382 - RNA, 19 nt, Homo sapiens
acaccguccuccacgccau

SEQ ID NO: 1287383 - RNA, 21 nt, Homo sapiens
acaccucaggagcuuuacuca

SEQ ID NO: 1287384 - RNA, 17 nt, Homo sapiens
acacuaauacaccaggu

SEQ ID NO: 1287385 - RNA, 22 nt, Homo sapiens
acacucagcugcuucuuugguc

SEQ ID NO: 1287386 - RNA, 20 nt, Homo sapiens
acacucauuuuguuagcgag

SEQ ID NO: 1287387 - RNA, 17 nt, Homo sapiens
acacucccacuuggcau

SEQ ID NO: 1287388 - RNA, 15 nt, Homo sapiens
acacugucuugaaga

SEQ ID NO: 1287389 - RNA, 16 nt, Homo sapiens
acagaacacacugaga

SEQ ID NO: 1287390 - RNA, 20 nt, Homo sapiens
acagaacacacugagacuug

SEQ ID NO: 1287391 - RNA, 14 nt, Homo sapiens
acagaacacugucu

SEQ ID NO: 1287392 - RNA, 16 nt, Homo sapiens
acagaacuaagaugau

SEQ ID NO: 1287393 - RNA, 13 nt, Homo sapiens
acagaacuaugga

SEQ ID NO: 1287394 - RNA, 22 nt, Homo sapiens
acagaagcacagcacccauggg

SEQ ID NO: 1287395 - RNA, 23 nt, Homo sapiens
acagacacucccacuuggcauca

SEQ ID NO: 1287396 - RNA, 19 nt, Homo sapiens
acagacccaaaccauacca

SEQ ID NO: 1287397 - RNA, 16 nt, Homo sapiens
acagacuccaaaaggc

SEQ ID NO: 1287398 - RNA, 21 nt, Homo sapiens
acagacuccaaaaggcccuuu

SEQ ID NO: 1287399 - RNA, 22 nt, Homo sapiens
acagagggcaggaacuugcaca

SEQ ID NO: 1287400 - RNA, 20 nt, Homo sapiens
acagaggggagucaccagcc

SEQ ID NO: 1287401 - RNA, 18 nt, Homo sapiens
acagcacccucuccagau

SEQ ID NO: 1287402 - RNA, 14 nt, Homo sapiens
acagcauguguauu

SEQ ID NO: 1287403 - RNA, 19 nt, Homo sapiens
acagccccucuggacacag

SEQ ID NO: 1287404 - RNA, 16 nt, Homo sapiens
acagcucucugggcac

SEQ ID NO: 1287405 - RNA, 21 nt, Homo sapiens
acagcuucucuacagacucca

SEQ ID NO: 1287406 - RNA, 18 nt, Homo sapiens
acaggacccugggaccac

SEQ ID NO: 1287407 - RNA, 13 nt, Homo sapiens
acaggcaccugcc

SEQ ID NO: 1287408 - RNA, 17 nt, Homo sapiens
acaggcaccugccaaca

SEQ ID NO: 1287409 - RNA, 21 nt, Homo sapiens
acaguaugauggaacagugaa

SEQ ID NO: 1287410 - RNA, 18 nt, Homo sapiens
acagugaauuuaagcaug

SEQ ID NO: 1287411 - RNA, 12 nt, Homo sapiens
acauacagugau

SEQ ID NO: 1287412 - RNA, 22 nt, Homo sapiens
acaucaaggcucuuccguucca

SEQ ID NO: 1287413 - RNA, 12 nt, Homo sapiens
acaucuuguuaa

SEQ ID NO: 1287414 - RNA, 16 nt, Homo sapiens
acaugcagcucugcag

SEQ ID NO: 1287415 - RNA, 18 nt, Homo sapiens
acaugcccuaaugucugu

SEQ ID NO: 1287416 - RNA, 10 nt, Homo sapiens
acaugugcuu

SEQ ID NO: 1287417 - RNA, 14 nt, Homo sapiens
acauuagucauuca

SEQ ID NO: 1287418 - RNA, 13 nt, Homo sapiens
acauuaguguucu

SEQ ID NO: 1287419 - RNA, 16 nt, Homo sapiens
acauucagcugagguu

SEQ ID NO: 1287420 - RNA, 12 nt, Homo sapiens
acauuuguucca

SEQ ID NO: 1287421 - RNA, 23 nt, Homo sapiens
accaagccuuggcucuacccuga

SEQ ID NO: 1287422 - RNA, 15 nt, Homo sapiens
accaauaaagccuuc

SEQ ID NO: 1287423 - RNA, 23 nt, Homo sapiens
accacuccugaaugagacuuaau

SEQ ID NO: 1287424 - RNA, 17 nt, Homo sapiens
accacuuuuugcagcuu

SEQ ID NO: 1287425 - RNA, 18 nt, Homo sapiens
accagaggacaaagccuu

SEQ ID NO: 1287426 - RNA, 21 nt, Homo sapiens
accagggagcugcaggggcau

SEQ ID NO: 1287427 - RNA, 18 nt, Homo sapiens
accauaaauuuaaaugga

SEQ ID NO: 1287428 - RNA, 22 nt, Homo sapiens
accaugaagcuggaagcacugc

SEQ ID NO: 1287429 - RNA, 15 nt, Homo sapiens
acccaacacauggga

SEQ ID NO: 1287430 - RNA, 17 nt, Homo sapiens
acccaacucuguacaaa

SEQ ID NO: 1287431 - RNA, 13 nt, Homo sapiens
acccaaugaauga

SEQ ID NO: 1287432 - RNA, 20 nt, Homo sapiens
acccaggagccuaguacaau

SEQ ID NO: 1287433 - RNA, 22 nt, Homo sapiens
acccaggagccuaguacaauau

SEQ ID NO: 1287434 - RNA, 13 nt, Homo sapiens
acccccaugaucc

SEQ ID NO: 1287435 - RNA, 22 nt, Homo sapiens
accccugcuccccugagcugaa

SEQ ID NO: 1287436 - RNA, 20 nt, Homo sapiens
acccuaugugggugggacca

SEQ ID NO: 1287437 - RNA, 21 nt, Homo sapiens
acccuaugugggugggaccac

SEQ ID NO: 1287438 - RNA, 17 nt, Homo sapiens
acccucaagacaaauga

SEQ ID NO: 1287439 - RNA, 19 nt, Homo sapiens
acccucuccccacugcuca

SEQ ID NO: 1287440 - RNA, 16 nt, Homo sapiens
acccugugcagaaccu

SEQ ID NO: 1287441 - RNA, 13 nt, Homo sapiens
accuaaacuguau

SEQ ID NO: 1287442 - RNA, 22 nt, Homo sapiens
accuacugauaaccacuccuaa

SEQ ID NO: 1287443 - RNA, 20 nt, Homo sapiens
accuagcaaagcuccugccu

SEQ ID NO: 1287444 - RNA, 14 nt, Homo sapiens
accucaaaggugau

SEQ ID NO: 1287445 - RNA, 19 nt, Homo sapiens
accucaggagcuuuacuca

SEQ ID NO: 1287446 - RNA, 15 nt, Homo sapiens
accuccacauaccug

SEQ ID NO: 1287447 - RNA, 22 nt, Homo sapiens
accuccuuucaagguaacugua

SEQ ID NO: 1287448 - RNA, 20 nt, Homo sapiens
accucgugauccaccugccu

SEQ ID NO: 1287449 - RNA, 14 nt, Homo sapiens
accucuccagccuc

SEQ ID NO: 1287450 - RNA, 13 nt, Homo sapiens
accugaaccuggg

SEQ ID NO: 1287451 - RNA, 18 nt, Homo sapiens
accugaaccugggaacca

SEQ ID NO: 1287452 - RNA, 14 nt, Homo sapiens
accugaacucugca

SEQ ID NO: 1287453 - RNA, 14 nt, Homo sapiens
accugaacugaugg

SEQ ID NO: 1287454 - RNA, 16 nt, Homo sapiens
accugaacugaugggu

SEQ ID NO: 1287455 - RNA, 16 nt, Homo sapiens
accugcgggagcugca

SEQ ID NO: 1287456 - RNA, 19 nt, Homo sapiens
accuggcagccacaacugc

SEQ ID NO: 1287457 - RNA, 22 nt, Homo sapiens
accugggcugaggcauccuucc

SEQ ID NO: 1287458 - RNA, 17 nt, Homo sapiens
accuguuuguuucuuau

SEQ ID NO: 1287459 - RNA, 23 nt, Homo sapiens
accuuacugaaaaaaaaaaaaga

SEQ ID NO: 1287460 - RNA, 21 nt, Homo sapiens
accuucugugcuucagcucuu

SEQ ID NO: 1287461 - RNA, 20 nt, Homo sapiens
accuugcacaaacagccccu

SEQ ID NO: 1287462 - RNA, 17 nt, Homo sapiens
accuuuggaugcacuuu

SEQ ID NO: 1287463 - RNA, 16 nt, Homo sapiens
accuuuuucuggucau

SEQ ID NO: 1287464 - RNA, 22 nt, Homo sapiens
acgccauuuccuuuuccuucaa

SEQ ID NO: 1287465 - RNA, 15 nt, Homo sapiens
acggcucucaccagu

SEQ ID NO: 1287466 - RNA, 20 nt, Homo sapiens
acggggcucuucucauuuca

SEQ ID NO: 1287467 - RNA, 10 nt, Homo sapiens
acgugcaaua

SEQ ID NO: 1287468 - RNA, 20 nt, Homo sapiens
acguguucuuuugugcucuu

SEQ ID NO: 1287469 - RNA, 16 nt, Homo sapiens
acuaaacuagcucuug

SEQ ID NO: 1287470 - RNA, 20 nt, Homo sapiens
caauucuauuacgugcaaua

SEQ ID NO: 1287471 - RNA, 21 nt, Homo sapiens
caauucuauuacgugcaauac

SEQ ID NO: 1287472 - RNA, 15 nt, Homo sapiens
caauugggagagaaa

SEQ ID NO: 1287473 - RNA, 14 nt, Homo sapiens
cacaaaguggcaua

SEQ ID NO: 1287474 - RNA, 13 nt, Homo sapiens
cacaacugcaguc

SEQ ID NO: 1287475 - RNA, 19 nt, Homo sapiens
cacaauuacauacuauucu

SEQ ID NO: 1287476 - RNA, 22 nt, Homo sapiens
cacacacagacuguugucccug

SEQ ID NO: 1287477 - RNA, 18 nt, Homo sapiens
cacacugagacuugaauc

SEQ ID NO: 1287478 - RNA, 15 nt, Homo sapiens
cacagccugggacca

SEQ ID NO: 1287479 - RNA, 15 nt, Homo sapiens
cacagcuucucuaca

SEQ ID NO: 1287480 - RNA, 19 nt, Homo sapiens
cacaggccugagauuucau

SEQ ID NO: 1287481 - RNA, 17 nt, Homo sapiens
cacauccacacagccaa

SEQ ID NO: 1287482 - RNA, 15 nt, Homo sapiens
cacaugcuacaagac

SEQ ID NO: 1287483 - RNA, 19 nt, Homo sapiens
caccaauuaaguguugaaa

SEQ ID NO: 1287484 - RNA, 18 nt, Homo sapiens
caccaggauuuauacaua

SEQ ID NO: 1287485 - RNA, 22 nt, Homo sapiens
caccauugaacuguaccaugug

SEQ ID NO: 1287486 - RNA, 22 nt, Homo sapiens
caccgcccacucuccaccucac

SEQ ID NO: 1287487 - RNA, 22 nt, Homo sapiens
caccuaauguuuaugagccaga

SEQ ID NO: 1287488 - RNA, 14 nt, Homo sapiens
caccucaggagcuu

SEQ ID NO: 1287489 - RNA, 14 nt, Homo sapiens
caccucaugucauu

SEQ ID NO: 1287490 - RNA, 17 nt, Homo sapiens
caccuccugccucaggu

SEQ ID NO: 1287491 - RNA, 21 nt, Homo sapiens
caccugaacuuucucuagcaa

SEQ ID NO: 1287492 - RNA, 17 nt, Homo sapiens
caccuguguacugagua

SEQ ID NO: 1287493 - RNA, 12 nt, Homo sapiens
caccuguuggcu

SEQ ID NO: 1287494 - RNA, 14 nt, Homo sapiens
caccuuuuaacuca

SEQ ID NO: 1287495 - RNA, 14 nt, Homo sapiens
cacugcucauuugg

SEQ ID NO: 1287496 - RNA, 18 nt, Homo sapiens
cacuggcagcaucuucac

SEQ ID NO: 1287497 - RNA, 16 nt, Homo sapiens
cacuuauucucaagaa

SEQ ID NO: 1287498 - RNA, 16 nt, Homo sapiens
cacuuauugacuauua

SEQ ID NO: 1287499 - RNA, 18 nt, Homo sapiens
cacuuccuauaugcacuu

SEQ ID NO: 1287500 - RNA, 19 nt, Homo sapiens
cacuuuuuccccugcaaug

SEQ ID NO: 1287501 - RNA, 16 nt, Homo sapiens
cagaagcaguaauaau

SEQ ID NO: 1287502 - RNA, 15 nt, Homo sapiens
cagaaggcaaagcaa

SEQ ID NO: 1287503 - RNA, 14 nt, Homo sapiens
cagaauauacuaaa

SEQ ID NO: 1287504 - RNA, 22 nt, Homo sapiens
cagacaauauggucccaaauga

SEQ ID NO: 1287505 - RNA, 19 nt, Homo sapiens
cagaccauucaggacacag

SEQ ID NO: 1287506 - RNA, 20 nt, Homo sapiens
cagagcgcaagcugggagca

SEQ ID NO: 1287507 - RNA, 20 nt, Homo sapiens
cagaggccgcgcguccagcu

SEQ ID NO: 1287508 - RNA, 23 nt, Homo sapiens
cagagguuucuggcagccaguac

SEQ ID NO: 1287509 - RNA, 13 nt, Homo sapiens
cagauaauagcaa

SEQ ID NO: 1287510 - RNA, 15 nt, Homo sapiens
cagaucccacuugca

SEQ ID NO: 1287511 - RNA, 22 nt, Homo sapiens
cagaugggagugcccccaacag

SEQ ID NO: 1287512 - RNA, 18 nt, Homo sapiens
cagauuggcucacacuga

SEQ ID NO: 1287513 - RNA, 20 nt, Homo sapiens
cagauuggcucacacugaga

SEQ ID NO: 1287514 - RNA, 20 nt, Homo sapiens
cagcacagaacacacugaga

SEQ ID NO: 1287515 - RNA, 17 nt, Homo sapiens
cagcacccucuccagau

SEQ ID NO: 1287516 - RNA, 20 nt, Homo sapiens
cagcaccugcgggagcugca

SEQ ID NO: 1287517 - RNA, 23 nt, Homo sapiens
cagcacguguggccuguucuucu

SEQ ID NO: 1287518 - RNA, 16 nt, Homo sapiens
cagcaucaaacaugaa

SEQ ID NO: 1287519 - RNA, 16 nt, Homo sapiens
cagcaucaaagagaug

SEQ ID NO: 1287520 - RNA, 20 nt, Homo sapiens
cagccaagccagucaaggau

SEQ ID NO: 1287521 - RNA, 19 nt, Homo sapiens
cagccagggccugcgaggg

SEQ ID NO: 1287522 - RNA, 21 nt, Homo sapiens
cagccccucucccugugcugu

SEQ ID NO: 1287523 - RNA, 14 nt, Homo sapiens
cagccugggaccag

SEQ ID NO: 1287524 - RNA, 15 nt, Homo sapiens
cagcggacaguggca

SEQ ID NO: 1287525 - RNA, 14 nt, Homo sapiens
cagcggcagugugu

SEQ ID NO: 1287526 - RNA, 17 nt, Homo sapiens
cagcuccgccucugcca

SEQ ID NO: 1287527 - RNA, 14 nt, Homo sapiens
cagcugagguucau

SEQ ID NO: 1287528 - RNA, 13 nt, Homo sapiens
cagcuucucuaca

SEQ ID NO: 1287529 - RNA, 20 nt, Homo sapiens
cagcuuuccucaucaggcca

SEQ ID NO: 1287530 - RNA, 15 nt, Homo sapiens
cagcuuucuuauuca

SEQ ID NO: 1287531 - RNA, 16 nt, Homo sapiens
caggaaaaacccguca

SEQ ID NO: 1287532 - RNA, 15 nt, Homo sapiens
caggaaaaucugcac

SEQ ID NO: 1287533 - RNA, 18 nt, Homo sapiens
caggaagagaggacccau

SEQ ID NO: 1287534 - RNA, 14 nt, Homo sapiens
caggaagccaaaga

SEQ ID NO: 1287535 - RNA, 15 nt, Homo sapiens
caggacaggaaaaac

SEQ ID NO: 1287536 - RNA, 13 nt, Homo sapiens
caggagucccugc

SEQ ID NO: 1287537 - RNA, 18 nt, Homo sapiens
caggagucccugccauca

SEQ ID NO: 1287538 - RNA, 15 nt, Homo sapiens
caggaucauggugua

SEQ ID NO: 1287539 - RNA, 15 nt, Homo sapiens
caggccacaaaugug

SEQ ID NO: 1287540 - RNA, 18 nt, Homo sapiens
caggccauugucccugaa

SEQ ID NO: 1287541 - RNA, 23 nt, Homo sapiens
caggcuagggaugguaauccuuu

SEQ ID NO: 1287542 - RNA, 20 nt, Homo sapiens
caggcuccaccucgaauacu

SEQ ID NO: 1287543 - RNA, 20 nt, Homo sapiens
cagggaaaucaggguuacaa

SEQ ID NO: 1287544 - RNA, 18 nt, Homo sapiens
cagggacuguaaaaccac

SEQ ID NO: 1287545 - RNA, 18 nt, Homo sapiens
caggggaguguucagggc

SEQ ID NO: 1287546 - RNA, 20 nt, Homo sapiens
cagguagaacacaaggucau

SEQ ID NO: 1287547 - RNA, 20 nt, Homo sapiens
caggucuuuaaaucauuuua

SEQ ID NO: 1287548 - RNA, 20 nt, Homo sapiens
caguaccuccugccccaugc

SEQ ID NO: 1287549 - RNA, 17 nt, Homo sapiens
caguagcagcagcaucu

SEQ ID NO: 1287550 - RNA, 17 nt, Homo sapiens
caguagucaccucuggg

SEQ ID NO: 1287551 - RNA, 18 nt, Homo sapiens
caguauuuuccagccuua

SEQ ID NO: 1287552 - RNA, 18 nt, Homo sapiens
cagucaaggauggaugca

SEQ ID NO: 1287553 - RNA, 16 nt, Homo sapiens
cagugaucucgacucc

SEQ ID NO: 1287554 - RNA, 16 nt, Homo sapiens
cagugcuugaaugaag

SEQ ID NO: 1287555 - RNA, 19 nt, Homo sapiens
caguggcuggaucugugag

SEQ ID NO: 1287556 - RNA, 21 nt, Homo sapiens
cagugggaccaaugaaagcau

SEQ ID NO: 1287557 - RNA, 17 nt, Homo sapiens
cagugucuuuccaccuu

SEQ ID NO: 1287558 - RNA, 21 nt, Homo sapiens
caguguggccaggcugccugg

SEQ ID NO: 1287559 - RNA, 18 nt, Homo sapiens
cauacauuuguggucuga

SEQ ID NO: 1287560 - RNA, 13 nt, Homo sapiens
cauagagacuuug

SEQ ID NO: 1287561 - RNA, 15 nt, Homo sapiens
cauauccugagccau

SEQ ID NO: 1287562 - RNA, 23 nt, Homo sapiens
caucaauaguguccuaugcaaua

SEQ ID NO: 1287563 - RNA, 17 nt, Homo sapiens
cauccauagcaccucca

SEQ ID NO: 1287564 - RNA, 21 nt, Homo sapiens
cauccugccacaggacccaga

SEQ ID NO: 1287565 - RNA, 21 nt, Homo sapiens
cauccuguuuguaucauagca

SEQ ID NO: 1287566 - RNA, 16 nt, Homo sapiens
caucugacuugaacuc

SEQ ID NO: 1287567 - RNA, 17 nt, Homo sapiens
caucuugaucaaccaaa

SEQ ID NO: 1287568 - RNA, 23 nt, Homo sapiens
caugaccaaaugcuuuuccucaa

SEQ ID NO: 1287569 - RNA, 23 nt, Homo sapiens
caugagauuugggcaggaacaca

SEQ ID NO: 1287570 - RNA, 12 nt, Homo sapiens
caugcucuccaa

SEQ ID NO: 1287571 - RNA, 16 nt, Homo sapiens
cauggagcaugggacu

SEQ ID NO: 1287572 - RNA, 14 nt, Homo sapiens
cauggaguguuuga

SEQ ID NO: 1287573 - RNA, 16 nt, Homo sapiens
cauggcucuaaaaagu

SEQ ID NO: 1287574 - RNA, 17 nt, Homo sapiens
cauggggguaauaagag

SEQ ID NO: 1287575 - RNA, 19 nt, Homo sapiens
caugguaauaaaauaugaa

SEQ ID NO: 1287576 - RNA, 14 nt, Homo sapiens
cauguaaaaucuuc

SEQ ID NO: 1287577 - RNA, 22 nt, Homo sapiens
cauguacacggccucaagggau

SEQ ID NO: 1287578 - RNA, 19 nt, Homo sapiens
cauguauagcuagcuauuu

SEQ ID NO: 1287579 - RNA, 20 nt, Homo sapiens
cauguauuagccagucauug

SEQ ID NO: 1287580 - RNA, 22 nt, Homo sapiens
cauguauuagccagucauugua

SEQ ID NO: 1287581 - RNA, 17 nt, Homo sapiens
gaucuauguuucaucuu

SEQ ID NO: 1287582 - RNA, 17 nt, Homo sapiens
gaucuucaagcagggaa

SEQ ID NO: 1287583 - RNA, 18 nt, Homo sapiens
gaucuucaagcagggaag

SEQ ID NO: 1287584 - RNA, 14 nt, Homo sapiens
gaugaaaaccugca

SEQ ID NO: 1287585 - RNA, 21 nt, Homo sapiens
gaugagaguacaccccaacag

SEQ ID NO: 1287586 - RNA, 21 nt, Homo sapiens
gaugccccagggaccuuugua

SEQ ID NO: 1287587 - RNA, 20 nt, Homo sapiens
gaugggagugcccccaacag

SEQ ID NO: 1287588 - RNA, 19 nt, Homo sapiens
gauuacaggcaugagccac

SEQ ID NO: 1287589 - RNA, 18 nt, Homo sapiens
gauuaccagucugauuau

SEQ ID NO: 1287590 - RNA, 12 nt, Homo sapiens
gauuaccauuca

SEQ ID NO: 1287591 - RNA, 20 nt, Homo sapiens
gauucaaauaucaaaaggaa

SEQ ID NO: 1287592 - RNA, 19 nt, Homo sapiens
gauucagguguauggaauu

SEQ ID NO: 1287593 - RNA, 22 nt, Homo sapiens
gauucuuccauuaaauugccuu

SEQ ID NO: 1287594 - RNA, 16 nt, Homo sapiens
gauucuuccugcuuag

SEQ ID NO: 1287595 - RNA, 18 nt, Homo sapiens
gauucuuuccauuaugau

SEQ ID NO: 1287596 - RNA, 15 nt, Homo sapiens
gauugcaauuugcac

SEQ ID NO: 1287597 - RNA, 21 nt, Homo sapiens
gauuguaaaaaaaaaugccuu

SEQ ID NO: 1287598 - RNA, 19 nt, Homo sapiens
gauuuaaauagaacuugau

SEQ ID NO: 1287599 - RNA, 20 nt, Homo sapiens
gauuuaauuuuuuaaacugu

SEQ ID NO: 1287600 - RNA, 22 nt, Homo sapiens
gauuuaauuuuuuaaacuguag

SEQ ID NO: 1287601 - RNA, 19 nt, Homo sapiens
gcaacuaaaugagaccuaa

SEQ ID NO: 1287602 - RNA, 16 nt, Homo sapiens
gcaagcauuuuuccau

SEQ ID NO: 1287603 - RNA, 16 nt, Homo sapiens
gcaauaaaauguauuu

SEQ ID NO: 1287604 - RNA, 17 nt, Homo sapiens
gcacagcacccauggga

SEQ ID NO: 1287605 - RNA, 15 nt, Homo sapiens
gcaccaauaaagccu

SEQ ID NO: 1287606 - RNA, 16 nt, Homo sapiens
gcaccaauaaagccuu

SEQ ID NO: 1287607 - RNA, 19 nt, Homo sapiens
gcaccauugaacuguacca

SEQ ID NO: 1287608 - RNA, 22 nt, Homo sapiens
gcacguguggccuguucuucua

SEQ ID NO: 1287609 - RNA, 16 nt, Homo sapiens
gcagaaccuccuggaa

SEQ ID NO: 1287610 - RNA, 23 nt, Homo sapiens
gcagaguacuggcugauggagua

SEQ ID NO: 1287611 - RNA, 13 nt, Homo sapiens
gcagcucuacucu

SEQ ID NO: 1287612 - RNA, 23 nt, Homo sapiens
gcaggagagaaugcccagugacc

SEQ ID NO: 1287613 - RNA, 22 nt, Homo sapiens
gcaguaaacuaagggugucaag

SEQ ID NO: 1287614 - RNA, 15 nt, Homo sapiens
gcauauauacauaua

SEQ ID NO: 1287615 - RNA, 23 nt, Homo sapiens
gcaucauuaauaccuaaacugua

SEQ ID NO: 1287616 - RNA, 17 nt, Homo sapiens
gcaucucccaguucaua

SEQ ID NO: 1287617 - RNA, 18 nt, Homo sapiens
gcaucucugaacauuucu

SEQ ID NO: 1287618 - RNA, 15 nt, Homo sapiens
gcaugacaaaaguga

SEQ ID NO: 1287619 - RNA, 19 nt, Homo sapiens
gcaugagucagucugauga

SEQ ID NO: 1287620 - RNA, 18 nt, Homo sapiens
gcaugcaaaaaaugcuuu

SEQ ID NO: 1287621 - RNA, 19 nt, Homo sapiens
gcaugcaggucuccaugaa

SEQ ID NO: 1287622 - RNA, 14 nt, Homo sapiens
gcauggaguguuug

SEQ ID NO: 1287623 - RNA, 17 nt, Homo sapiens
gcauuccuagaaauuga

SEQ ID NO: 1287624 - RNA, 14 nt, Homo sapiens
gcauuuaggagaua

SEQ ID NO: 1287625 - RNA, 20 nt, Homo sapiens
gcauuugugcccacucucca

SEQ ID NO: 1287626 - RNA, 20 nt, Homo sapiens
gcauuuuacaagaucuugca

SEQ ID NO: 1287627 - RNA, 11 nt, Homo sapiens
gccaagccagu

SEQ ID NO: 1287628 - RNA, 17 nt, Homo sapiens
gccaagccagucaagga

SEQ ID NO: 1287629 - RNA, 22 nt, Homo sapiens
gccacaaaugugucccagugaa

SEQ ID NO: 1287630 - RNA, 16 nt, Homo sapiens
gccacacggcucucac

SEQ ID NO: 1287631 - RNA, 19 nt, Homo sapiens
gccacacggcucucaccag

SEQ ID NO: 1287632 - RNA, 21 nt, Homo sapiens
gccacagcuggugguaucuga

SEQ ID NO: 1287633 - RNA, 19 nt, Homo sapiens
gccacucaggggucauuca

SEQ ID NO: 1287634 - RNA, 21 nt, Homo sapiens
gccagaagaugaacagacuga

SEQ ID NO: 1287635 - RNA, 21 nt, Homo sapiens
gccaggcagaucccacuugca

SEQ ID NO: 1287636 - RNA, 17 nt, Homo sapiens
gccauauaugcuguauu

SEQ ID NO: 1287637 - RNA, 16 nt, Homo sapiens
gccaucagugaucuca

SEQ ID NO: 1287638 - RNA, 20 nt, Homo sapiens
gccaucggugaaacuaacag

SEQ ID NO: 1287639 - RNA, 18 nt, Homo sapiens
gcccacucuccaccucac

SEQ ID NO: 1287640 - RNA, 15 nt, Homo sapiens
gccccacauugcacu

SEQ ID NO: 1287641 - RNA, 16 nt, Homo sapiens
gccccacauugcacuu

SEQ ID NO: 1287642 - RNA, 14 nt, Homo sapiens
gccccauuuaccca

SEQ ID NO: 1287643 - RNA, 15 nt, Homo sapiens
gccccauuuacccaa

SEQ ID NO: 1287644 - RNA, 13 nt, Homo sapiens
gcccccaacagca

SEQ ID NO: 1287645 - RNA, 21 nt, Homo sapiens
gcccucaccccugguucucau

SEQ ID NO: 1287646 - RNA, 14 nt, Homo sapiens
gcccucagauuccg

SEQ ID NO: 1287647 - RNA, 14 nt, Homo sapiens
gcccugccaugcuc

SEQ ID NO: 1287648 - RNA, 16 nt, Homo sapiens
gcccugccaugcucuc

SEQ ID NO: 1287649 - RNA, 15 nt, Homo sapiens
gcccuucaugcauuu

SEQ ID NO: 1287650 - RNA, 15 nt, Homo sapiens
gcccuuggggguccu

SEQ ID NO: 1287651 - RNA, 14 nt, Homo sapiens
gccgcaccauugaa

SEQ ID NO: 1287652 - RNA, 12 nt, Homo sapiens
gccuaguacaau

SEQ ID NO: 1287653 - RNA, 17 nt, Homo sapiens
gccucagagacaucagc

SEQ ID NO: 1287654 - RNA, 23 nt, Homo sapiens
gccucuuugugugcgucacugug

SEQ ID NO: 1287655 - RNA, 20 nt, Homo sapiens
gccucuuuuccccaugaacu

SEQ ID NO: 1287656 - RNA, 17 nt, Homo sapiens
gccugaagccaggccau

SEQ ID NO: 1287657 - RNA, 14 nt, Homo sapiens
gccugccucuucca

SEQ ID NO: 1287658 - RNA, 20 nt, Homo sapiens
gccugcggaccagaugaaug

SEQ ID NO: 1287659 - RNA, 23 nt, Homo sapiens
gccugcugugaugugcaaaggca

SEQ ID NO: 1287660 - RNA, 14 nt, Homo sapiens
gccuggacacagag

SEQ ID NO: 1287661 - RNA, 16 nt, Homo sapiens
gccuugguauagcaua

SEQ ID NO: 1287662 - RNA, 19 nt, Homo sapiens
gcgaacauaaaugucugua

SEQ ID NO: 1287663 - RNA, 24 nt, Homo sapiens
gcgaaugauuuaaauagaacuuga

SEQ ID NO: 1287664 - RNA, 14 nt, Homo sapiens
gcggacaguggcag

SEQ ID NO: 1287665 - RNA, 18 nt, Homo sapiens
gcggaucuuuggacagaa

SEQ ID NO: 1287666 - RNA, 22 nt, Homo sapiens
gcgggagccucccugccucagg

SEQ ID NO: 1287667 - RNA, 20 nt, Homo sapiens
gcuaaaccauucaugaugaa

SEQ ID NO: 1287668 - RNA, 21 nt, Homo sapiens
gcuacuucccagcuaaucucc

SEQ ID NO: 1287669 - RNA, 13 nt, Homo sapiens
gcuagugccaaau

SEQ ID NO: 1287670 - RNA, 20 nt, Homo sapiens
gcuauggggauagaugugug

SEQ ID NO: 1287671 - RNA, 16 nt, Homo sapiens
gcucgauuccucaggg

SEQ ID NO: 1287672 - RNA, 19 nt, Homo sapiens
gcucguuucuuagaccucu

SEQ ID NO: 1287673 - RNA, 21 nt, Homo sapiens
gcucuaaaaaguuuugcccuu

SEQ ID NO: 1287674 - RNA, 19 nt, Homo sapiens
gcucuacccugaguucaua

SEQ ID NO: 1287675 - RNA, 14 nt, Homo sapiens
gcucuacuaccugu

SEQ ID NO: 1287676 - RNA, 16 nt, Homo sapiens
gcucuucucauuucac

SEQ ID NO: 1287677 - RNA, 23 nt, Homo sapiens
gcugagcagguguucuucauuac

SEQ ID NO: 1287678 - RNA, 20 nt, Homo sapiens
gcugccucuugaaugcaggg

SEQ ID NO: 1287679 - RNA, 21 nt, Homo sapiens
gcugccuggccuuguccucag

SEQ ID NO: 1287680 - RNA, 23 nt, Homo sapiens
gcugcuaaagggagaaaugccag

SEQ ID NO: 1287681 - RNA, 17 nt, Homo sapiens
gcuggagucgggacuaa

SEQ ID NO: 1287682 - RNA, 17 nt, Homo sapiens
gcuguauccauccaugg

SEQ ID NO: 1287683 - RNA, 23 nt, Homo sapiens
gcuguccccacagcuucucuaca

SEQ ID NO: 1287684 - RNA, 14 nt, Homo sapiens
gcugucuaccugaa

SEQ ID NO: 1287685 - RNA, 16 nt, Homo sapiens
gcugugaugugcaaag

SEQ ID NO: 1287686 - RNA, 19 nt, Homo sapiens
gcuguuuuuauauauguga

SEQ ID NO: 1287687 - RNA, 22 nt, Homo sapiens
guacucaucugacuugaacucu

SEQ ID NO: 1287688 - RNA, 14 nt, Homo sapiens
guacugggccaugu

SEQ ID NO: 1287689 - RNA, 14 nt, Homo sapiens
guacuuugugcuga

SEQ ID NO: 1287690 - RNA, 17 nt, Homo sapiens
guagaacaauguacaag

SEQ ID NO: 1287691 - RNA, 17 nt, Homo sapiens
cuuuuuaaacucacaua

SEQ ID NO: 1287692 - RNA, 22 nt, Homo sapiens
cuuuuugaaaucagcauacuca

SEQ ID NO: 1287693 - RNA, 23 nt, Homo sapiens
gaaaaauaagaugggcccaaagg

SEQ ID NO: 1287694 - RNA, 18 nt, Homo sapiens
gaaaagauuaugaucuca

SEQ ID NO: 1287695 - RNA, 12 nt, Homo sapiens
gaaaaugugcaa

SEQ ID NO: 1287696 - RNA, 21 nt, Homo sapiens
gaaaauucagcggcagugugu

SEQ ID NO: 1287697 - RNA, 15 nt, Homo sapiens
gaaaccuuugacacu

SEQ ID NO: 1287698 - RNA, 18 nt, Homo sapiens
gaaacuggaugaggucau

SEQ ID NO: 1287699 - RNA, 15 nt, Homo sapiens
gaaagaaaaugaauu

SEQ ID NO: 1287700 - RNA, 17 nt, Homo sapiens
gaaagaagagaggacac

SEQ ID NO: 1287701 - RNA, 17 nt, Homo sapiens
gaaagcauggcugagaa

SEQ ID NO: 1287702 - RNA, 16 nt, Homo sapiens
gaaagccacagacaau

SEQ ID NO: 1287703 - RNA, 18 nt, Homo sapiens
gaaaggacagcuuugaua

SEQ ID NO: 1287704 - RNA, 19 nt, Homo sapiens
gaaaggagccuaggccagg

SEQ ID NO: 1287705 - RNA, 16 nt, Homo sapiens
gaaaguacagaacaaa

SEQ ID NO: 1287706 - RNA, 18 nt, Homo sapiens
gaaaguauagauggccaa

SEQ ID NO: 1287707 - RNA, 19 nt, Homo sapiens
gaaagucaugcacauaccu

SEQ ID NO: 1287708 - RNA, 15 nt, Homo sapiens
gaaagugaugacaua

SEQ ID NO: 1287709 - RNA, 16 nt, Homo sapiens
gaaaguugcuuuuauu

SEQ ID NO: 1287710 - RNA, 15 nt, Homo sapiens
gaaauaaauaaucua

SEQ ID NO: 1287711 - RNA, 13 nt, Homo sapiens
gaaauaccugaga

SEQ ID NO: 1287712 - RNA, 14 nt, Homo sapiens
gaaauauuuggaaa

SEQ ID NO: 1287713 - RNA, 19 nt, Homo sapiens
gaacacagccugggaccag

SEQ ID NO: 1287714 - RNA, 21 nt, Homo sapiens
gaacauuagccguaguggaau

SEQ ID NO: 1287715 - RNA, 16 nt, Homo sapiens
gaacucugcaacugaa

SEQ ID NO: 1287716 - RNA, 13 nt, Homo sapiens
gaagaacauagaa

SEQ ID NO: 1287717 - RNA, 18 nt, Homo sapiens
gaagacccauuccuuccc

SEQ ID NO: 1287718 - RNA, 19 nt, Homo sapiens
gaagacuauauuguacaca

SEQ ID NO: 1287719 - RNA, 13 nt, Homo sapiens
gaagagaagggca

SEQ ID NO: 1287720 - RNA, 18 nt, Homo sapiens
gaagcauuccuucuuuga

SEQ ID NO: 1287721 - RNA, 14 nt, Homo sapiens
gaaggaauuauucc

SEQ ID NO: 1287722 - RNA, 19 nt, Homo sapiens
gaaggaggagucagggaga

SEQ ID NO: 1287723 - RNA, 14 nt, Homo sapiens
gaaggcuaugggga

SEQ ID NO: 1287724 - RNA, 17 nt, Homo sapiens
gaaggcugucuaccuga

SEQ ID NO: 1287725 - RNA, 16 nt, Homo sapiens
gaagucuuccauagag

SEQ ID NO: 1287726 - RNA, 22 nt, Homo sapiens
gaagugugucacccuuaggcca

SEQ ID NO: 1287727 - RNA, 22 nt, Homo sapiens
gaauaguguuggaaaaugugca

SEQ ID NO: 1287728 - RNA, 17 nt, Homo sapiens
gaauauaaacacuauau

SEQ ID NO: 1287729 - RNA, 22 nt, Homo sapiens
gaaucuguuaccagaggacaaa

SEQ ID NO: 1287730 - RNA, 19 nt, Homo sapiens
gaaugaggaacaaucacaa

SEQ ID NO: 1287731 - RNA, 13 nt, Homo sapiens
gaauugcagagua

SEQ ID NO: 1287732 - RNA, 19 nt, Homo sapiens
gaauuggcauaauuugucu

SEQ ID NO: 1287733 - RNA, 18 nt, Homo sapiens
gacaaaauguugauaaau

SEQ ID NO: 1287734 - RNA, 22 nt, Homo sapiens
gacaagcuccucccuugagaau

SEQ ID NO: 1287735 - RNA, 17 nt, Homo sapiens
gacacugccacucuccc

SEQ ID NO: 1287736 - RNA, 13 nt, Homo sapiens
gacagaacacugu

SEQ ID NO: 1287737 - RNA, 14 nt, Homo sapiens
gacagaacuaagau

SEQ ID NO: 1287738 - RNA, 15 nt, Homo sapiens
gacaggaaaaacccg

SEQ ID NO: 1287739 - RNA, 22 nt, Homo sapiens
gacaggacccugggaccacaga

SEQ ID NO: 1287740 - RNA, 11 nt, Homo sapiens
gacaucugccu

SEQ ID NO: 1287741 - RNA, 15 nt, Homo sapiens
gacaugugaaaccuu

SEQ ID NO: 1287742 - RNA, 16 nt, Homo sapiens
gacaugugaaaccuuu

SEQ ID NO: 1287743 - RNA, 20 nt, Homo sapiens
gaccaaaugcuuuuccucaa

SEQ ID NO: 1287744 - RNA, 12 nt, Homo sapiens
gaccaaugcauu

SEQ ID NO: 1287745 - RNA, 19 nt, Homo sapiens
gaccacagagggcaggaac

SEQ ID NO: 1287746 - RNA, 14 nt, Homo sapiens
gaccagaaccagag

SEQ ID NO: 1287747 - RNA, 15 nt, Homo sapiens
gaccagccuggccca

SEQ ID NO: 1287748 - RNA, 23 nt, Homo sapiens
gacccccagggcauuguguucac

SEQ ID NO: 1287749 - RNA, 17 nt, Homo sapiens
gacccuauacauuuuga

SEQ ID NO: 1287750 - RNA, 13 nt, Homo sapiens
gaccugaacucug

SEQ ID NO: 1287751 - RNA, 17 nt, Homo sapiens
gaccugccccucccucu

SEQ ID NO: 1287752 - RNA, 14 nt, Homo sapiens
gaccuguugggagu

SEQ ID NO: 1287753 - RNA, 22 nt, Homo sapiens
gaccuuuguagccacuucacuu

SEQ ID NO: 1287754 - RNA, 16 nt, Homo sapiens
gacgggacagugagug

SEQ ID NO: 1287755 - RNA, 12 nt, Homo sapiens
gacucacauccu

SEQ ID NO: 1287756 - RNA, 22 nt, Homo sapiens
gacucaucuuggcccuccucag

SEQ ID NO: 1287757 - RNA, 13 nt, Homo sapiens
gacucuuccaggu

SEQ ID NO: 1287758 - RNA, 21 nt, Homo sapiens
gacucuuccagguucacugag

SEQ ID NO: 1287759 - RNA, 16 nt, Homo sapiens
gacuuagaaaaauccu

SEQ ID NO: 1287760 - RNA, 21 nt, Homo sapiens
gacuucugcaucuuacaguca

SEQ ID NO: 1287761 - RNA, 18 nt, Homo sapiens
gacuugacagaacacugu

SEQ ID NO: 1287762 - RNA, 19 nt, Homo sapiens
gacuuuugaagaacaaaag

SEQ ID NO: 1287763 - RNA, 15 nt, Homo sapiens
gagaaagccugagaa

SEQ ID NO: 1287764 - RNA, 14 nt, Homo sapiens
gagaacucugagca

SEQ ID NO: 1287765 - RNA, 20 nt, Homo sapiens
gagaagccagcuuuccucau

SEQ ID NO: 1287766 - RNA, 21 nt, Homo sapiens
gagaagccagcuuuccucauc

SEQ ID NO: 1287767 - RNA, 21 nt, Homo sapiens
gagaaguaagcagaguucuuu

SEQ ID NO: 1287768 - RNA, 20 nt, Homo sapiens
gagaaguuggucuuacuuug

SEQ ID NO: 1287769 - RNA, 13 nt, Homo sapiens
gagaaugucagua

SEQ ID NO: 1287770 - RNA, 15 nt, Homo sapiens
gagaauucccugugg

SEQ ID NO: 1287771 - RNA, 17 nt, Homo sapiens
gagaccucagauguguu

SEQ ID NO: 1287772 - RNA, 21 nt, Homo sapiens
gagacugggccuaggccagga

SEQ ID NO: 1287773 - RNA, 21 nt, Homo sapiens
gagauggugcuaaaccauuca

SEQ ID NO: 1287774 - RNA, 19 nt, Homo sapiens
gagauuccugagccagugu

SEQ ID NO: 1287775 - RNA, 15 nt, Homo sapiens
gagauuggauuugcu

SEQ ID NO: 1287776 - RNA, 19 nt, Homo sapiens
gagcauuuauaaauggaca

SEQ ID NO: 1287777 - RNA, 16 nt, Homo sapiens
gagccacguauguuuu

SEQ ID NO: 1287778 - RNA, 16 nt, Homo sapiens
gagccuggcuccaaac

SEQ ID NO: 1287779 - RNA, 13 nt, Homo sapiens
gagcgcuccugcc

SEQ ID NO: 1287780 - RNA, 17 nt, Homo sapiens
gagcuccuuagccuuug

SEQ ID NO: 1287781 - RNA, 22 nt, Homo sapiens
gagcuggggaugucucucauga

SEQ ID NO: 1287782 - RNA, 22 nt, Homo sapiens
gaggaauucucagccacugcgg

SEQ ID NO: 1287783 - RNA, 21 nt, Homo sapiens
gaggagggucggugccuucaa

SEQ ID NO: 1287784 - RNA, 16 nt, Homo sapiens
gaggccucucauucca

SEQ ID NO: 1287785 - RNA, 15 nt, Homo sapiens
gagggagaagcauga

SEQ ID NO: 1287786 - RNA, 15 nt, Homo sapiens
gagggucuucuuaca

SEQ ID NO: 1287787 - RNA, 18 nt, Homo sapiens
gaguacaccccaacagca

SEQ ID NO: 1287788 - RNA, 19 nt, Homo sapiens
gaguacaccccaacagcac

SEQ ID NO: 1287789 - RNA, 13 nt, Homo sapiens
gaguagcauauua

SEQ ID NO: 1287790 - RNA, 16 nt, Homo sapiens
gaguccuccuguccag

SEQ ID NO: 1287791 - RNA, 13 nt, Homo sapiens
gagugccaugcuu

SEQ ID NO: 1287792 - RNA, 20 nt, Homo sapiens
gagugggggugggggguccc

SEQ ID NO: 1287793 - RNA, 16 nt, Homo sapiens
gagugugguuccaaga

SEQ ID NO: 1287794 - RNA, 19 nt, Homo sapiens
gaguuacuuagaaugccau

SEQ ID NO: 1287795 - RNA, 14 nt, Homo sapiens
gaguucuuugcaag

SEQ ID NO: 1287796 - RNA, 19 nt, Homo sapiens
gauaaaauuauugaugauu

SEQ ID NO: 1287797 - RNA, 20 nt, Homo sapiens
uaagcugagcuccuuagccu

SEQ ID NO: 1287798 - RNA, 21 nt, Homo sapiens
uaaggcuuguuccaaugccac

SEQ ID NO: 1287799 - RNA, 13 nt, Homo sapiens
uaaggucauagau

SEQ ID NO: 1287800 - RNA, 20 nt, Homo sapiens
cuugguuugaguuucucuca

SEQ ID NO: 1287801 - RNA, 20 nt, Homo sapiens
cuugucuuuuuguuaugcaa

SEQ ID NO: 1287802 - RNA, 14 nt, Homo sapiens
cuuguguuuuuaac

SEQ ID NO: 1287803 - RNA, 19 nt, Homo sapiens
cuuuaaagccugccucuuc

SEQ ID NO: 1287804 - RNA, 18 nt, Homo sapiens
cuuuaagcgcaacauuuc

SEQ ID NO: 1287805 - RNA, 22 nt, Homo sapiens
cuuuaaucacuuaacauuccua

SEQ ID NO: 1287806 - RNA, 22 nt, Homo sapiens
cuuuaauuucaugaaaagauua

SEQ ID NO: 1287807 - RNA, 18 nt, Homo sapiens
cuuucagaguuugguuaa

SEQ ID NO: 1287808 - RNA, 13 nt, Homo sapiens
cuuuccacauuca

SEQ ID NO: 1287809 - RNA, 16 nt, Homo sapiens
cuuuccccucccucag

SEQ ID NO: 1287810 - RNA, 13 nt, Homo sapiens
cuuucuguugcca

SEQ ID NO: 1287811 - RNA, 22 nt, Homo sapiens
cuuugaagugacuucacagaga

SEQ ID NO: 1287812 - RNA, 18 nt, Homo sapiens
cuuugaucuguuugucaa

SEQ ID NO: 1287813 - RNA, 13 nt, Homo sapiens
cuuuggcaacaga

SEQ ID NO: 1287814 - RNA, 14 nt, Homo sapiens
cuuuggcaacagaa

SEQ ID NO: 1287815 - RNA, 20 nt, Homo sapiens
cuuuggguccuuagugcaau

SEQ ID NO: 1287816 - RNA, 18 nt, Homo sapiens
cuuuguaagaguguagaa

SEQ ID NO: 1287817 - RNA, 15 nt, Homo sapiens
cuuugugauucccuc

SEQ ID NO: 1287818 - RNA, 14 nt, Homo sapiens
cuuuguucuuguca

SEQ ID NO: 1287819 - RNA, 17 nt, Homo sapiens
cuuuguuuaaaugccaa

SEQ ID NO: 1287820 - RNA, 18 nt, Homo sapiens
cuuuuacauacagugaua

SEQ ID NO: 1287821 - RNA, 19 nt, Homo sapiens
cuuuucaaaauuggacuua

SEQ ID NO: 1287822 - RNA, 12 nt, Homo sapiens
cuuuucaguuug

SEQ ID NO: 1287823 - RNA, 13 nt, Homo sapiens
cuuuuccauuuga

SEQ ID NO: 1287824 - RNA, 17 nt, Homo sapiens
cuuuuccuuggucucca

SEQ ID NO: 1287825 - RNA, 21 nt, Homo sapiens
cuuuuccuuggucuccagugg

SEQ ID NO: 1287826 - RNA, 22 nt, Homo sapiens
cuuuuggcuuguaaaguacaga

SEQ ID NO: 1287827 - RNA, 15 nt, Homo sapiens
cuuuuuaaacagugu

SEQ ID NO: 1287828 - RNA, 18 nt, Homo sapiens
cuuuuuaaacaguguuua

SEQ ID NO: 1287829 - RNA, 17 nt, Homo sapiens
cuuuuuccccugcaaug

SEQ ID NO: 1287830 - RNA, 14 nt, Homo sapiens
cuuuuucuguccca

SEQ ID NO: 1287831 - RNA, 20 nt, Homo sapiens
gaaaaauuaauuuacuagaa

SEQ ID NO: 1287832 - RNA, 17 nt, Homo sapiens
gaaaacaggcacugccc

SEQ ID NO: 1287833 - RNA, 15 nt, Homo sapiens
gaaaacuugugcccu

SEQ ID NO: 1287834 - RNA, 17 nt, Homo sapiens
gaaaacuugugcccuug

SEQ ID NO: 1287835 - RNA, 17 nt, Homo sapiens
gaaaagcuauuagccag

SEQ ID NO: 1287836 - RNA, 14 nt, Homo sapiens
gaaaauguccuccc

SEQ ID NO: 1287837 - RNA, 15 nt, Homo sapiens
gaaaaugugcaauau

SEQ ID NO: 1287838 - RNA, 19 nt, Homo sapiens
gaaacuggaugaggucaua

SEQ ID NO: 1287839 - RNA, 20 nt, Homo sapiens
gaaacuuucaaauccuucau

SEQ ID NO: 1287840 - RNA, 13 nt, Homo sapiens
gaaagccugagaa

SEQ ID NO: 1287841 - RNA, 22 nt, Homo sapiens
gaaauagcuucaggauacugua

SEQ ID NO: 1287842 - RNA, 13 nt, Homo sapiens
gaaauauauuuga

SEQ ID NO: 1287843 - RNA, 14 nt, Homo sapiens
gaaaugcagaguca

SEQ ID NO: 1287844 - RNA, 14 nt, Homo sapiens
gaaauuaacaccca

SEQ ID NO: 1287845 - RNA, 18 nt, Homo sapiens
gaaauuaacacccaaaag

SEQ ID NO: 1287846 - RNA, 16 nt, Homo sapiens
gaaauuuaauguuucu

SEQ ID NO: 1287847 - RNA, 23 nt, Homo sapiens
gaaauuugccaauuuacuuuguu

SEQ ID NO: 1287848 - RNA, 13 nt, Homo sapiens
gaacacacugaga

SEQ ID NO: 1287849 - RNA, 22 nt, Homo sapiens
gaacacacugagacuugaauca

SEQ ID NO: 1287850 - RNA, 17 nt, Homo sapiens
gaacagugaaagucaau

SEQ ID NO: 1287851 - RNA, 18 nt, Homo sapiens
gaacaucucgaauacaau

SEQ ID NO: 1287852 - RNA, 14 nt, Homo sapiens
gaaccaugaagcug

SEQ ID NO: 1287853 - RNA, 16 nt, Homo sapiens
gaacucccucuguguc

SEQ ID NO: 1287854 - RNA, 12 nt, Homo sapiens
gaacucugagca

SEQ ID NO: 1287855 - RNA, 13 nt, Homo sapiens
gaacucugagcag

SEQ ID NO: 1287856 - RNA, 20 nt, Homo sapiens
gaacugaaggcagcauguau

SEQ ID NO: 1287857 - RNA, 15 nt, Homo sapiens
gaacuggaccaucuc

SEQ ID NO: 1287858 - RNA, 17 nt, Homo sapiens
gaacuggaccaucucca

SEQ ID NO: 1287859 - RNA, 13 nt, Homo sapiens
gaacuugcacaaa

SEQ ID NO: 1287860 - RNA, 23 nt, Homo sapiens
gaagacaauggcuuacuccagga

SEQ ID NO: 1287861 - RNA, 16 nt, Homo sapiens
gaagcuggaagcacug

SEQ ID NO: 1287862 - RNA, 13 nt, Homo sapiens
gaagcuuauagag

SEQ ID NO: 1287863 - RNA, 15 nt, Homo sapiens
gaaggaauuauuccc

SEQ ID NO: 1287864 - RNA, 20 nt, Homo sapiens
gaagggaaaagcccaugauc

SEQ ID NO: 1287865 - RNA, 15 nt, Homo sapiens
gaaguccagaacaag

SEQ ID NO: 1287866 - RNA, 19 nt, Homo sapiens
gaauacuggggauuaccau

SEQ ID NO: 1287867 - RNA, 19 nt, Homo sapiens
gaauggggugcaugaaggu

SEQ ID NO: 1287868 - RNA, 17 nt, Homo sapiens
gaauguagcagaucccc

SEQ ID NO: 1287869 - RNA, 17 nt, Homo sapiens
gaauguauuaguacaaa

SEQ ID NO: 1287870 - RNA, 16 nt, Homo sapiens
gaauguuaacagguau

SEQ ID NO: 1287871 - RNA, 15 nt, Homo sapiens
gaauuaacaggaaau

SEQ ID NO: 1287872 - RNA, 15 nt, Homo sapiens
gaauugagucuucca

SEQ ID NO: 1287873 - RNA, 18 nt, Homo sapiens
gaauuuuugcacauucua

SEQ ID NO: 1287874 - RNA, 12 nt, Homo sapiens
gacaaacaguga

SEQ ID NO: 1287875 - RNA, 21 nt, Homo sapiens
gacaaaugacccccaucccau

SEQ ID NO: 1287876 - RNA, 18 nt, Homo sapiens
gacaaaugccacacggcu

SEQ ID NO: 1287877 - RNA, 17 nt, Homo sapiens
gacaauauggucccaaa

SEQ ID NO: 1287878 - RNA, 20 nt, Homo sapiens
gacaauggcuuacuccagga

SEQ ID NO: 1287879 - RNA, 21 nt, Homo sapiens
gacaccagagcagaugcagag

SEQ ID NO: 1287880 - RNA, 14 nt, Homo sapiens
gacacccugacccc

SEQ ID NO: 1287881 - RNA, 20 nt, Homo sapiens
gacacugccacucuccccau

SEQ ID NO: 1287882 - RNA, 14 nt, Homo sapiens
gacagagcugggau

SEQ ID NO: 1287883 - RNA, 15 nt, Homo sapiens
gacagcaucaaagag

SEQ ID NO: 1287884 - RNA, 13 nt, Homo sapiens
gacagcuucucau

SEQ ID NO: 1287885 - RNA, 15 nt, Homo sapiens
gacaguuuucugcuu

SEQ ID NO: 1287886 - RNA, 22 nt, Homo sapiens
gaccaauaaccaugcccaagaa

SEQ ID NO: 1287887 - RNA, 16 nt, Homo sapiens
gaccacagacucacau

SEQ ID NO: 1287888 - RNA, 22 nt, Homo sapiens
gaccagaaccagagcucagaga

SEQ ID NO: 1287889 - RNA, 24 nt, Homo sapiens
gaccagucacugacccugugcaga

SEQ ID NO: 1287890 - RNA, 17 nt, Homo sapiens
gaccauucaggacacag

SEQ ID NO: 1287891 - RNA, 17 nt, Homo sapiens
gaccccccuauugcugc

SEQ ID NO: 1287892 - RNA, 14 nt, Homo sapiens
gaccccgagccugg

SEQ ID NO: 1287893 - RNA, 13 nt, Homo sapiens
gacccugggacca

SEQ ID NO: 1287894 - RNA, 12 nt, Homo sapiens
gaccugcuucua

SEQ ID NO: 1287895 - RNA, 23 nt, Homo sapiens
gaccuuuauccagcuagugccaa

SEQ ID NO: 1287896 - RNA, 17 nt, Homo sapiens
gacuagaggcuugcaua

SEQ ID NO: 1287897 - RNA, 22 nt, Homo sapiens
gacuauggaaugucaguguuca

SEQ ID NO: 1287898 - RNA, 15 nt, Homo sapiens
gacuccaaaaggccc

SEQ ID NO: 1287899 - RNA, 14 nt, Homo sapiens
gacucucagcagcu

SEQ ID NO: 1287900 - RNA, 14 nt, Homo sapiens
gacugucuuucaga

SEQ ID NO: 1287901 - RNA, 15 nt, Homo sapiens
gacuuaaaaucuaau

SEQ ID NO: 1287902 - RNA, 12 nt, Homo sapiens
gacuuaucaaca

SEQ ID NO: 1287903 - RNA, 17 nt, Homo sapiens
gacuucugcaucuuaca

SEQ ID NO: 1287904 - RNA, 16 nt, Homo sapiens
gacuugaaucaaguca

SEQ ID NO: 1287905 - RNA, 20 nt, Homo sapiens
gacuugacagaacacugucu

SEQ ID NO: 1287906 - RNA, 14 nt, Homo sapiens
gagaaaagacauaa

SEQ ID NO: 1287907 - RNA, 20 nt, Homo sapiens
gagaaaauccuaggugcuac

SEQ ID NO: 1287908 - RNA, 18 nt, Homo sapiens
gagaacucugagcagugc

SEQ ID NO: 1287909 - RNA, 18 nt, Homo sapiens
gagacuugaaucaaguca

SEQ ID NO: 1287910 - RNA, 14 nt, Homo sapiens
gagagagugcuauu

SEQ ID NO: 1287911 - RNA, 22 nt, Homo sapiens
gagagugggggugggggguccc

SEQ ID NO: 1287912 - RNA, 16 nt, Homo sapiens
uaaucugagaguuuuc

SEQ ID NO: 1287913 - RNA, 14 nt, Homo sapiens
uaaugaacacucau

SEQ ID NO: 1287914 - RNA, 22 nt, Homo sapiens
uaauggaauauguaaauagaaa

SEQ ID NO: 1287915 - RNA, 22 nt, Homo sapiens
uaauguguacauuagucauuca

SEQ ID NO: 1287916 - RNA, 21 nt, Homo sapiens
uaauguguuuuuaauuaucua

SEQ ID NO: 1287917 - RNA, 23 nt, Homo sapiens
uaauuccacacccucacugcugu

SEQ ID NO: 1287918 - RNA, 13 nt, Homo sapiens
uaauuucagaaga

SEQ ID NO: 1287919 - RNA, 21 nt, Homo sapiens
uaauuugugcuacaguuuuuc

SEQ ID NO: 1287920 - RNA, 20 nt, Homo sapiens
uacaacaaacacugugaugu

SEQ ID NO: 1287921 - RNA, 23 nt, Homo sapiens
uacaagacaggacccugggacca

SEQ ID NO: 1287922 - RNA, 20 nt, Homo sapiens
uacaauauagugaugccauc

SEQ ID NO: 1287923 - RNA, 18 nt, Homo sapiens
uacaaucgagacugcaau

SEQ ID NO: 1287924 - RNA, 13 nt, Homo sapiens
uacacgugacaga

SEQ ID NO: 1287925 - RNA, 18 nt, Homo sapiens
uacagagaaaagacauaa

SEQ ID NO: 1287926 - RNA, 14 nt, Homo sapiens
uacaggcuagggau

SEQ ID NO: 1287927 - RNA, 19 nt, Homo sapiens
uacagucagcacagaacac

SEQ ID NO: 1287928 - RNA, 13 nt, Homo sapiens
uacaugcauuuga

SEQ ID NO: 1287929 - RNA, 14 nt, Homo sapiens
uacauggcucuaaa

SEQ ID NO: 1287930 - RNA, 21 nt, Homo sapiens
uacauguuuauauuaaucucu

SEQ ID NO: 1287931 - RNA, 21 nt, Homo sapiens
uacauuuuggauuucuuuaua

SEQ ID NO: 1287932 - RNA, 15 nt, Homo sapiens
uaccagcaucuccca

SEQ ID NO: 1287933 - RNA, 18 nt, Homo sapiens
uaccaugugcuacagggg

SEQ ID NO: 1287934 - RNA, 18 nt, Homo sapiens
uacccuuccucaccacuu

SEQ ID NO: 1287935 - RNA, 13 nt, Homo sapiens
uaccuauuguaga

SEQ ID NO: 1287936 - RNA, 14 nt, Homo sapiens
uaccucuuggcugc

SEQ ID NO: 1287937 - RNA, 19 nt, Homo sapiens
uaccucuuggcugccuugu

SEQ ID NO: 1287938 - RNA, 16 nt, Homo sapiens
uaccugaucaaugaca

SEQ ID NO: 1287939 - RNA, 12 nt, Homo sapiens
uaccuguucaaa

SEQ ID NO: 1287940 - RNA, 14 nt, Homo sapiens
uaccuuacugaaaa

SEQ ID NO: 1287941 - RNA, 18 nt, Homo sapiens
uaccuuuugcuguggcaa

SEQ ID NO: 1287942 - RNA, 11 nt, Homo sapiens
uacgugcaaua

SEQ ID NO: 1287943 - RNA, 18 nt, Homo sapiens
uacuaauuuccaugugua

SEQ ID NO: 1287944 - RNA, 21 nt, Homo sapiens
uacuauaugaaaagagcaaaa

SEQ ID NO: 1287945 - RNA, 19 nt, Homo sapiens
uacuauucuuacuaaucug

SEQ ID NO: 1287946 - RNA, 21 nt, Homo sapiens
uacucaauguuacuaucugcu

SEQ ID NO: 1287947 - RNA, 20 nt, Homo sapiens
uacugccauuucagugagaa

SEQ ID NO: 1287948 - RNA, 16 nt, Homo sapiens
uacuguauauacuuug

SEQ ID NO: 1287949 - RNA, 15 nt, Homo sapiens
uacuuagaaugccau

SEQ ID NO: 1287950 - RNA, 13 nt, Homo sapiens
uagaacaaaaacu

SEQ ID NO: 1287951 - RNA, 21 nt, Homo sapiens
uagaacacucagcugcuucuu

SEQ ID NO: 1287952 - RNA, 20 nt, Homo sapiens
uagaauaauacuagucuuau

SEQ ID NO: 1287953 - RNA, 15 nt, Homo sapiens
uagaaugugccugug

SEQ ID NO: 1287954 - RNA, 15 nt, Homo sapiens
uagaauuaauggaau

SEQ ID NO: 1287955 - RNA, 15 nt, Homo sapiens
uagagauuuggugua

SEQ ID NO: 1287956 - RNA, 21 nt, Homo sapiens
uagagauuugguguacaauuc

SEQ ID NO: 1287957 - RNA, 15 nt, Homo sapiens
uagaguggcgauuga

SEQ ID NO: 1287958 - RNA, 14 nt, Homo sapiens
uagcacuggucaca

SEQ ID NO: 1287959 - RNA, 20 nt, Homo sapiens
uagcuccaaaccuucacaca

SEQ ID NO: 1287960 - RNA, 14 nt, Homo sapiens
uagcucuuggggaa

SEQ ID NO: 1287961 - RNA, 20 nt, Homo sapiens
uaggccagcaccaucucuuu

SEQ ID NO: 1287962 - RNA, 13 nt, Homo sapiens
uaguaaacugugc

SEQ ID NO: 1287963 - RNA, 16 nt, Homo sapiens
uaguaugugcauaaug

SEQ ID NO: 1287964 - RNA, 20 nt, Homo sapiens
uagucauugcagaguucuua

SEQ ID NO: 1287965 - RNA, 23 nt, Homo sapiens
uaguguuggaaaaugugcaauau

SEQ ID NO: 1287966 - RNA, 13 nt, Homo sapiens
uaguuacaugaau

SEQ ID NO: 1287967 - RNA, 15 nt, Homo sapiens
uaguuguaucucuuu

SEQ ID NO: 1287968 - RNA, 17 nt, Homo sapiens
uaguuuccucuaucuaa

SEQ ID NO: 1287969 - RNA, 18 nt, Homo sapiens
uaguuuugcuuuguugaa

SEQ ID NO: 1287970 - RNA, 13 nt, Homo sapiens
uauaaaaguacua

SEQ ID NO: 1287971 - RNA, 13 nt, Homo sapiens
uauaacugugaug

SEQ ID NO: 1287972 - RNA, 15 nt, Homo sapiens
uauaacugugaugaa

SEQ ID NO: 1287973 - RNA, 17 nt, Homo sapiens
uauaacuugcauuacau

SEQ ID NO: 1287974 - RNA, 23 nt, Homo sapiens
uauacuuugccuuuccauaauca

SEQ ID NO: 1287975 - RNA, 21 nt, Homo sapiens
uauagauagauaauguucucc

SEQ ID NO: 1287976 - RNA, 15 nt, Homo sapiens
uauauggccucaaga

SEQ ID NO: 1287977 - RNA, 23 nt, Homo sapiens
uaucaaaaagguuucugcacauu

SEQ ID NO: 1287978 - RNA, 19 nt, Homo sapiens
uaucaaacuacugccauuu

SEQ ID NO: 1287979 - RNA, 20 nt, Homo sapiens
uauccugagccaucggugaa

SEQ ID NO: 1287980 - RNA, 18 nt, Homo sapiens
uaucuagacccaucuucu

SEQ ID NO: 1287981 - RNA, 24 nt, Homo sapiens
uaucucagcaucagaaugagaaag

SEQ ID NO: 1287982 - RNA, 15 nt, Homo sapiens
uaugagaauguauua

SEQ ID NO: 1287983 - RNA, 15 nt, Homo sapiens
uaugagaugccugaa

SEQ ID NO: 1287984 - RNA, 23 nt, Homo sapiens
uaugagcuggggaugucucucau

SEQ ID NO: 1287985 - RNA, 12 nt, Homo sapiens
uaugcagugaua

SEQ ID NO: 1287986 - RNA, 15 nt, Homo sapiens
uaugguucucaggcc

SEQ ID NO: 1287987 - RNA, 10 nt, Homo sapiens
uaugugcaau

SEQ ID NO: 1287988 - RNA, 16 nt, Homo sapiens
uaugugggugggacca

SEQ ID NO: 1287989 - RNA, 20 nt, Homo sapiens
uaugugggugggaccacaga

SEQ ID NO: 1287990 - RNA, 20 nt, Homo sapiens
uauuaacucuguaaaagugu

SEQ ID NO: 1287991 - RNA, 23 nt, Homo sapiens
uauuacccccuuuccucuugggc

SEQ ID NO: 1287992 - RNA, 14 nt, Homo sapiens
uauuacgugcaaua

SEQ ID NO: 1287993 - RNA, 21 nt, Homo sapiens
uauuagagcugccugugccuu

SEQ ID NO: 1287994 - RNA, 16 nt, Homo sapiens
uauucauuuuguggca

SEQ ID NO: 1287995 - RNA, 12 nt, Homo sapiens
uauucucaagaa

SEQ ID NO: 1287996 - RNA, 17 nt, Homo sapiens
uauucuuacuaaucuga

SEQ ID NO: 1287997 - RNA, 21 nt, Homo sapiens
uauucuucuuugauaguguaa

SEQ ID NO: 1287998 - RNA, 19 nt, Homo sapiens
uauugaaaguugcuuuuau

SEQ ID NO: 1287999 - RNA, 21 nt, Homo sapiens
uauugcugcuggggcucccca

SEQ ID NO: 1288000 - RNA, 23 nt, Homo sapiens
uauuguacauugggcacauaucu

SEQ ID NO: 1288001 - RNA, 17 nt, Homo sapiens
uauugugaaguacauau

SEQ ID NO: 1288002 - RNA, 21 nt, Homo sapiens
uauuuuacccaaauacucaau

SEQ ID NO: 1288003 - RNA, 15 nt, Homo sapiens
uauuuuauugagcaa

SEQ ID NO: 1288004 - RNA, 14 nt, Homo sapiens
uauuuuuaugugca

SEQ ID NO: 1288005 - RNA, 16 nt, Homo sapiens
ucaaaaauacucacau

SEQ ID NO: 1288006 - RNA, 13 nt, Homo sapiens
ucaaaaugcuuca

SEQ ID NO: 1288007 - RNA, 23 nt, Homo sapiens
ucaaacuacugccauuucaguga

SEQ ID NO: 1288008 - RNA, 18 nt, Homo sapiens
ucaaaggccagaccugca

SEQ ID NO: 1288009 - RNA, 20 nt, Homo sapiens
ucaaaggugauugugccagg

SEQ ID NO: 1288010 - RNA, 15 nt, Homo sapiens
ucaaauaucaaaagg

SEQ ID NO: 1288011 - RNA, 23 nt, Homo sapiens
ucaaauuuacugucuuaaaucag

SEQ ID NO: 1288012 - RNA, 19 nt, Homo sapiens
ucaaccaaaaacauguuuc

SEQ ID NO: 1288013 - RNA, 13 nt, Homo sapiens
ucaagcagguuuc

SEQ ID NO: 1288014 - RNA, 13 nt, Homo sapiens
ucaaggugggccu

SEQ ID NO: 1288015 - RNA, 23 nt, Homo sapiens
ucaagucagcaacagagcaaaau

SEQ ID NO: 1288016 - RNA, 18 nt, Homo sapiens
ucaauguuucacuacucu

SEQ ID NO: 1288017 - RNA, 23 nt, Homo sapiens
ucaauuuguaauuuuaguauuaa

SEQ ID NO: 1288018 - RNA, 18 nt, Homo sapiens
ucacagcaaagcaacaau

SEQ ID NO: 1288019 - RNA, 17 nt, Homo sapiens
ucacaucuaaagcuuua

SEQ ID NO: 1288020 - RNA, 17 nt, Homo sapiens
ucaccaccucaugucau

SEQ ID NO: 1288021 - RNA, 18 nt, Homo sapiens
ucaccccugguucucauc

SEQ ID NO: 1288022 - RNA, 16 nt, Homo sapiens
ucaccuguuggcuaca

SEQ ID NO: 1288023 - RNA, 21 nt, Homo sapiens
aguguuggaaaaugugcaaua

SEQ ID NO: 1288024 - RNA, 13 nt, Homo sapiens
aguuacaugaauu

SEQ ID NO: 1288025 - RNA, 15 nt, Homo sapiens
aguuaccuuacugaa

SEQ ID NO: 1288026 - RNA, 16 nt, Homo sapiens
aguuccuuucaauggu

SEQ ID NO: 1288027 - RNA, 15 nt, Homo sapiens
aguugacuugacaga

SEQ ID NO: 1288028 - RNA, 22 nt, Homo sapiens
aguugacuugacagaacacugu

SEQ ID NO: 1288029 - RNA, 19 nt, Homo sapiens
aguuguagguaauauugca

SEQ ID NO: 1288030 - RNA, 17 nt, Homo sapiens
auaaaaagccucaguga

SEQ ID NO: 1288031 - RNA, 20 nt, Homo sapiens
auaaaaguacuagcuuacuu

SEQ ID NO: 1288032 - RNA, 16 nt, Homo sapiens
auaaacagauacauuc

SEQ ID NO: 1288033 - RNA, 14 nt, Homo sapiens
auaaauaugcagug

SEQ ID NO: 1288034 - RNA, 14 nt, Homo sapiens
auaaauggacaaau

SEQ ID NO: 1288035 - RNA, 15 nt, Homo sapiens
auaacagcuuucuua

SEQ ID NO: 1288036 - RNA, 14 nt, Homo sapiens
auaaccacuccuaa

SEQ ID NO: 1288037 - RNA, 22 nt, Homo sapiens
auaacuaggcguggacuuacua

SEQ ID NO: 1288038 - RNA, 12 nt, Homo sapiens
auaacugugaug

SEQ ID NO: 1288039 - RNA, 21 nt, Homo sapiens
auaagacauuuguuaggccau

SEQ ID NO: 1288040 - RNA, 11 nt, Homo sapiens
auaagcaagag

SEQ ID NO: 1288041 - RNA, 16 nt, Homo sapiens
auaagucuugguaaca

SEQ ID NO: 1288042 - RNA, 14 nt, Homo sapiens
auaauaaagcaauc

SEQ ID NO: 1288043 - RNA, 15 nt, Homo sapiens
uccgaagucuuccau

SEQ ID NO: 1288044 - RNA, 20 nt, Homo sapiens
uccggccuccugucccucau

SEQ ID NO: 1288045 - RNA, 13 nt, Homo sapiens
uccgggaucaaag

SEQ ID NO: 1288046 - RNA, 15 nt, Homo sapiens
uccuaccacuuugaa

SEQ ID NO: 1288047 - RNA, 18 nt, Homo sapiens
uccuagagauuuggugua

SEQ ID NO: 1288048 - RNA, 22 nt, Homo sapiens
uccucccuuguggcuuccucag

SEQ ID NO: 1288049 - RNA, 14 nt, Homo sapiens
uccucuuuaccugu

SEQ ID NO: 1288050 - RNA, 22 nt, Homo sapiens
uccugaggaagagggacuguuc

SEQ ID NO: 1288051 - RNA, 16 nt, Homo sapiens
uccuuagagacaucaa

SEQ ID NO: 1288052 - RNA, 22 nt, Homo sapiens
uccuuauauuuggcccaaacuc

SEQ ID NO: 1288053 - RNA, 14 nt, Homo sapiens
uccuucaccaccuc

SEQ ID NO: 1288054 - RNA, 13 nt, Homo sapiens
uccuucuuugaua

SEQ ID NO: 1288055 - RNA, 14 nt, Homo sapiens
uccuuuaaacauac

SEQ ID NO: 1288056 - RNA, 21 nt, Homo sapiens
uccuuuccccggaguaccuau

SEQ ID NO: 1288057 - RNA, 22 nt, Homo sapiens
uccuuucuugcacuauuccaca

SEQ ID NO: 1288058 - RNA, 21 nt, Homo sapiens
uccuuugcgcaaacuuuaaca

SEQ ID NO: 1288059 - RNA, 12 nt, Homo sapiens
ucgaaaguguca

SEQ ID NO: 1288060 - RNA, 23 nt, Homo sapiens
ucgccuccucuacaauuugccau

SEQ ID NO: 1288061 - RNA, 15 nt, Homo sapiens
ucgggacuaacccag

SEQ ID NO: 1288062 - RNA, 16 nt, Homo sapiens
ucuaaacuuuaauuca

SEQ ID NO: 1288063 - RNA, 21 nt, Homo sapiens
ucuaacuuuaugaacucccuc

SEQ ID NO: 1288064 - RNA, 17 nt, Homo sapiens
ucuacaauuugccauug

SEQ ID NO: 1288065 - RNA, 17 nt, Homo sapiens
ucuacagacuccaaaag

SEQ ID NO: 1288066 - RNA, 19 nt, Homo sapiens
ucuacagacuccaaaaggc

SEQ ID NO: 1288067 - RNA, 20 nt, Homo sapiens
ucuaccucuuggcugccuug

SEQ ID NO: 1288068 - RNA, 20 nt, Homo sapiens
ucuagcaaguguaagcagaa

SEQ ID NO: 1288069 - RNA, 23 nt, Homo sapiens
ucuaguuaacauuucaagggcaa

SEQ ID NO: 1288070 - RNA, 22 nt, Homo sapiens
ucuauaaagaucauauauuacu

SEQ ID NO: 1288071 - RNA, 13 nt, Homo sapiens
ucuauaccugccu

SEQ ID NO: 1288072 - RNA, 14 nt, Homo sapiens
ucucagccacugaa

SEQ ID NO: 1288073 - RNA, 12 nt, Homo sapiens
ucucauccugca

SEQ ID NO: 1288074 - RNA, 12 nt, Homo sapiens
ugcuaaaccauu

SEQ ID NO: 1288075 - RNA, 17 nt, Homo sapiens
ugcuaugucucuaucca

SEQ ID NO: 1288076 - RNA, 11 nt, Homo sapiens
ugcucauguau

SEQ ID NO: 1288077 - RNA, 13 nt, Homo sapiens
ugcucauguauau

SEQ ID NO: 1288078 - RNA, 17 nt, Homo sapiens
ugcucauguauauuuag

SEQ ID NO: 1288079 - RNA, 20 nt, Homo sapiens
ugcuccauuuucuugucaau

SEQ ID NO: 1288080 - RNA, 13 nt, Homo sapiens
ugcugcuguggaa

SEQ ID NO: 1288081 - RNA, 13 nt, Homo sapiens
ugcuuacuuugca

SEQ ID NO: 1288082 - RNA, 21 nt, Homo sapiens
ugcuuaugaaagaaagcuuua

SEQ ID NO: 1288083 - RNA, 19 nt, Homo sapiens
ugcuucagcucuucuugac

SEQ ID NO: 1288084 - RNA, 14 nt, Homo sapiens
ugcuugaaugaagu

SEQ ID NO: 1288085 - RNA, 16 nt, Homo sapiens
ugcuuuuuuucaggga

SEQ ID NO: 1288086 - RNA, 16 nt, Homo sapiens
ugcuuuuuuucuacug

SEQ ID NO: 1288087 - RNA, 15 nt, Homo sapiens
uggaacucaaggaaa

SEQ ID NO: 1288088 - RNA, 12 nt, Homo sapiens
uggaacuggagg

SEQ ID NO: 1288089 - RNA, 17 nt, Homo sapiens
uggaaugucaguguuca

SEQ ID NO: 1288090 - RNA, 18 nt, Homo sapiens
uggaaugucaguguucag

SEQ ID NO: 1288091 - RNA, 21 nt, Homo sapiens
uggagcccuguuggcagcucu

SEQ ID NO: 1288092 - RNA, 13 nt, Homo sapiens
uggauaaguagaa

SEQ ID NO: 1288093 - RNA, 14 nt, Homo sapiens
uggauaaguagaau

SEQ ID NO: 1288094 - RNA, 22 nt, Homo sapiens
uggauagauaauuuuauuugaa

SEQ ID NO: 1288095 - RNA, 17 nt, Homo sapiens
uggcagcaaagugucag

SEQ ID NO: 1288096 - RNA, 20 nt, Homo sapiens
uggcagcgccucaucuucaa

SEQ ID NO: 1288097 - RNA, 15 nt, Homo sapiens
uggcauuuucacuuu

SEQ ID NO: 1288098 - RNA, 22 nt, Homo sapiens
uggccaggguaguaagaauuag

SEQ ID NO: 1288099 - RNA, 13 nt, Homo sapiens
uggcccuccgccc

SEQ ID NO: 1288100 - RNA, 14 nt, Homo sapiens
uggcugauggagua

SEQ ID NO: 1288101 - RNA, 14 nt, Homo sapiens
uggcugccccguga

SEQ ID NO: 1288102 - RNA, 18 nt, Homo sapiens
uggcuguuauucuuccac

SEQ ID NO: 1288103 - RNA, 12 nt, Homo sapiens
ugggaccacaga

SEQ ID NO: 1288104 - RNA, 16 nt, Homo sapiens
ugggaccacagacuca

SEQ ID NO: 1288105 - RNA, 19 nt, Homo sapiens
ugggagcccaguuucacug

SEQ ID NO: 1288106 - RNA, 16 nt, Homo sapiens
ugggaucgcauugcau

SEQ ID NO: 1288107 - RNA, 18 nt, Homo sapiens
ugggcaggguacagacac

SEQ ID NO: 1288108 - RNA, 17 nt, Homo sapiens
ugggcagugagugccau

SEQ ID NO: 1288109 - RNA, 17 nt, Homo sapiens
ugggccccucucauucc

SEQ ID NO: 1288110 - RNA, 18 nt, Homo sapiens
uggggaagagguuuuauu

SEQ ID NO: 1288111 - RNA, 18 nt, Homo sapiens
uggggaugucucucauga

SEQ ID NO: 1288112 - RNA, 17 nt, Homo sapiens
ugggggugggggguccc

SEQ ID NO: 1288113 - RNA, 17 nt, Homo sapiens
uggggguuaccaaaaau

SEQ ID NO: 1288114 - RNA, 17 nt, Homo sapiens
uggguuggacaaccuca

SEQ ID NO: 1288115 - RNA, 22 nt, Homo sapiens
ugguaauccuuuaaacauacaa

SEQ ID NO: 1288116 - RNA, 13 nt, Homo sapiens
ugguaucugcaug

SEQ ID NO: 1288117 - RNA, 21 nt, Homo sapiens
uggucaagauuuugaaugcuu

SEQ ID NO: 1288118 - RNA, 19 nt, Homo sapiens
uggucauaaugaacacuca

SEQ ID NO: 1288119 - RNA, 20 nt, Homo sapiens
uggucauccuuguuuucuaa

SEQ ID NO: 1288120 - RNA, 18 nt, Homo sapiens
ugguccgaagucuuccau

SEQ ID NO: 1288121 - RNA, 16 nt, Homo sapiens
uggugaccaaugcauu

SEQ ID NO: 1288122 - RNA, 13 nt, Homo sapiens
uggugugcuguau

SEQ ID NO: 1288123 - RNA, 15 nt, Homo sapiens
uggugugugccucau

SEQ ID NO: 1288124 - RNA, 17 nt, Homo sapiens
ugguguugacaugugcu

SEQ ID NO: 1288125 - RNA, 21 nt, Homo sapiens
ugguucucacugccuccuaca

SEQ ID NO: 1288126 - RNA, 17 nt, Homo sapiens
ugguuuagucauugcag

SEQ ID NO: 1288127 - RNA, 23 nt, Homo sapiens
ugguuuuuguugagucucugaac

SEQ ID NO: 1288128 - RNA, 12 nt, Homo sapiens
uguaaaaugggg

SEQ ID NO: 1288129 - RNA, 19 nt, Homo sapiens
uguaaaugaagggucauuu

SEQ ID NO: 1288130 - RNA, 16 nt, Homo sapiens
uguaaauuuaugugau

SEQ ID NO: 1288131 - RNA, 14 nt, Homo sapiens
uguaacagugcaag

SEQ ID NO: 1288132 - RNA, 17 nt, Homo sapiens
uguaaguuuaugcauac

SEQ ID NO: 1288133 - RNA, 17 nt, Homo sapiens
uguaaguuucaggugac

SEQ ID NO: 1288134 - RNA, 19 nt, Homo sapiens
uguaauucagguaccacgu

SEQ ID NO: 1288135 - RNA, 18 nt, Homo sapiens
uguaauuuaaaauuguga

SEQ ID NO: 1288136 - RNA, 11 nt, Homo sapiens
uguacaggaug

SEQ ID NO: 1288137 - RNA, 12 nt, Homo sapiens
uguagauauugu

SEQ ID NO: 1288138 - RNA, 24 nt, Homo sapiens
uguagcaaauuucgagcauaagaa

SEQ ID NO: 1288139 - RNA, 19 nt, Homo sapiens
uguauccauccauggggcu

SEQ ID NO: 1288140 - RNA, 20 nt, Homo sapiens
uguaugauuacaucaaggcu

SEQ ID NO: 1288141 - RNA, 16 nt, Homo sapiens
ugucagcuacuaauga

SEQ ID NO: 1288142 - RNA, 15 nt, Homo sapiens
ugucccagaaaagca

SEQ ID NO: 1288143 - RNA, 16 nt, Homo sapiens
ugucccagaaugccuc

SEQ ID NO: 1288144 - RNA, 21 nt, Homo sapiens
ugucccagaaugccuccugca

SEQ ID NO: 1288145 - RNA, 20 nt, Homo sapiens
uguccccuucucucaucucu

SEQ ID NO: 1288146 - RNA, 15 nt, Homo sapiens
ugucccucauccaua

SEQ ID NO: 1288147 - RNA, 17 nt, Homo sapiens
uguccuugaaugccaua

SEQ ID NO: 1288148 - RNA, 16 nt, Homo sapiens
ugucuaguagaacaau

SEQ ID NO: 1288149 - RNA, 12 nt, Homo sapiens
ugucucucauga

SEQ ID NO: 1288150 - RNA, 24 nt, Homo sapiens
ugucucugacaaugcguggcacau

SEQ ID NO: 1288151 - RNA, 14 nt, Homo sapiens
ugucuuaaaucagu

SEQ ID NO: 1288152 - RNA, 22 nt, Homo sapiens
ugucuugggaauuuucuuccaa

SEQ ID NO: 1288153 - RNA, 23 nt, Homo sapiens
ugugaaggaauuauucccaugag

SEQ ID NO: 1288154 - RNA, 17 nt, Homo sapiens
uguuuaugacacaauga

SEQ ID NO: 1288155 - RNA, 20 nt, Homo sapiens
uguuuaugacacaaugacac

SEQ ID NO: 1288156 - RNA, 19 nt, Homo sapiens
uguuugacagucugcucaa

SEQ ID NO: 1288157 - RNA, 19 nt, Homo sapiens
uuaaaaauuaaauucucuc

SEQ ID NO: 1288158 - RNA, 23 nt, Homo sapiens
uuaaaauauuuuuaugugcaaua

SEQ ID NO: 1288159 - RNA, 20 nt, Homo sapiens
uuaaaaucuaauucaaacua

SEQ ID NO: 1288160 - RNA, 18 nt, Homo sapiens
uuaaaaucucaacuauaa

SEQ ID NO: 1288161 - RNA, 17 nt, Homo sapiens
uuaaaggaauaaggugu

SEQ ID NO: 1288162 - RNA, 14 nt, Homo sapiens
uuaaauaucugaac

SEQ ID NO: 1288163 - RNA, 19 nt, Homo sapiens
uuaaauggagaaaggaccc

SEQ ID NO: 1288164 - RNA, 15 nt, Homo sapiens
uuaaauguuucucaa

SEQ ID NO: 1288165 - RNA, 14 nt, Homo sapiens
uuaaauuaugggaa

SEQ ID NO: 1288166 - RNA, 18 nt, Homo sapiens
uuaacagacacuguaaaa

SEQ ID NO: 1288167 - RNA, 21 nt, Homo sapiens
uuaacagcgugucaacuuuca

SEQ ID NO: 1288168 - RNA, 16 nt, Homo sapiens
uuaacuaaaugcucau

SEQ ID NO: 1288169 - RNA, 20 nt, Homo sapiens
uuaacucccccucauucaca

SEQ ID NO: 1288170 - RNA, 14 nt, Homo sapiens
uuaagacuacugaa

SEQ ID NO: 1288171 - RNA, 13 nt, Homo sapiens
uuaauaaugugua

SEQ ID NO: 1288172 - RNA, 20 nt, Homo sapiens
uuaaucacaccguccuccac

SEQ ID NO: 1288173 - RNA, 20 nt, Homo sapiens
uuaauuggcucacaguucug

SEQ ID NO: 1288174 - RNA, 15 nt, Homo sapiens
uuacaagaucuugca

SEQ ID NO: 1288175 - RNA, 22 nt, Homo sapiens
uuacauuauuaaauguuucuca

SEQ ID NO: 1288176 - RNA, 19 nt, Homo sapiens
uuacccaacucuguacaaa

SEQ ID NO: 1288177 - RNA, 13 nt, Homo sapiens
uuaccuguucaaa

SEQ ID NO: 1288178 - RNA, 20 nt, Homo sapiens
uuaccuucuaccucuuggcu

SEQ ID NO: 1288179 - RNA, 22 nt, Homo sapiens
uuacuauuuauugcugaaugac

SEQ ID NO: 1288180 - RNA, 21 nt, Homo sapiens
uuagaacuucuacagaagcca

SEQ ID NO: 1288181 - RNA, 20 nt, Homo sapiens
uuagagcugccugugccuuu

SEQ ID NO: 1288182 - RNA, 15 nt, Homo sapiens
uuagccagugaugcu

SEQ ID NO: 1288183 - RNA, 21 nt, Homo sapiens
uuagcuccaaaccuucacaca

SEQ ID NO: 1288184 - RNA, 14 nt, Homo sapiens
uuaguaaacugugc

SEQ ID NO: 1288185 - RNA, 23 nt, Homo sapiens
uuauauuuguaaauuuaugugau

SEQ ID NO: 1288186 - RNA, 17 nt, Homo sapiens
uuaucaccaggauuuau

SEQ ID NO: 1288187 - RNA, 17 nt, Homo sapiens
uuaucuguaaguuuuga

SEQ ID NO: 1288188 - RNA, 21 nt, Homo sapiens
uuaugaaaaauaagucacuua

SEQ ID NO: 1288189 - RNA, 16 nt, Homo sapiens
uuaugaaacauuacag

SEQ ID NO: 1288190 - RNA, 17 nt, Homo sapiens
uuaugaaugaguuuuac

SEQ ID NO: 1288191 - RNA, 16 nt, Homo sapiens
uuaugagacacaggau

SEQ ID NO: 1288192 - RNA, 20 nt, Homo sapiens
uuauugcaucuguuauucac

SEQ ID NO: 1288193 - RNA, 17 nt, Homo sapiens
uuauuugcacuugugga

SEQ ID NO: 1288194 - RNA, 14 nt, Homo sapiens
uucaaaauuccauu

SEQ ID NO: 1288195 - RNA, 15 nt, Homo sapiens
uucaacaaaccuuaa

SEQ ID NO: 1288196 - RNA, 21 nt, Homo sapiens
uucacuuaauaauguguacau

SEQ ID NO: 1288197 - RNA, 14 nt, Homo sapiens
uucacuuauugacu

SEQ ID NO: 1288198 - RNA, 15 nt, Homo sapiens
uucagauuugccuua

SEQ ID NO: 1288199 - RNA, 13 nt, Homo sapiens
uucagcugcugaa

SEQ ID NO: 1288200 - RNA, 17 nt, Homo sapiens
uucagugggaccaauga

SEQ ID NO: 1288201 - RNA, 13 nt, Homo sapiens
uucaguguucuga

SEQ ID NO: 1288202 - RNA, 22 nt, Homo sapiens
uucaucaugucaguuccaauga

SEQ ID NO: 1288203 - RNA, 11 nt, Homo sapiens
uucaugaacac

SEQ ID NO: 1288204 - RNA, 12 nt, Homo sapiens
uucauuaccuca

SEQ ID NO: 1288205 - RNA, 21 nt, Homo sapiens
uucauuuuuacccuuacuugg

SEQ ID NO: 1288206 - RNA, 12 nt, Homo sapiens
uuccaagacagu

SEQ ID NO: 1288207 - RNA, 20 nt, Homo sapiens
uuccacagggauaccuuaau

SEQ ID NO: 1288208 - RNA, 12 nt, Homo sapiens
uuccacugcugc

SEQ ID NO: 1288209 - RNA, 15 nt, Homo sapiens
uucccaggaguacac

SEQ ID NO: 1288210 - RNA, 19 nt, Homo sapiens
uucccucacagcaaagcaa

SEQ ID NO: 1288211 - RNA, 20 nt, Homo sapiens
uuccuaaaagagaauggaaa

SEQ ID NO: 1288212 - RNA, 16 nt, Homo sapiens
uuccuauaugcacuua

SEQ ID NO: 1288213 - RNA, 23 nt, Homo sapiens
uuccuauaugcacuuauucucaa

SEQ ID NO: 1288214 - RNA, 19 nt, Homo sapiens
uuccucuugggcuuuugaa

SEQ ID NO: 1288215 - RNA, 17 nt, Homo sapiens
uucgauguacagucuca

SEQ ID NO: 1288216 - RNA, 14 nt, Homo sapiens
uucuaaaugcauau

SEQ ID NO: 1288217 - RNA, 16 nt, Homo sapiens
uucuaggaagcuccag

SEQ ID NO: 1288218 - RNA, 17 nt, Homo sapiens
uucuaggaagcuccagu

SEQ ID NO: 1288219 - RNA, 16 nt, Homo sapiens
uucuaguggucuuugu

SEQ ID NO: 1288220 - RNA, 19 nt, Homo sapiens
uucuauaccuuuuucuggu

SEQ ID NO: 1288221 - RNA, 16 nt, Homo sapiens
uucuaugugucaucaa

SEQ ID NO: 1288222 - RNA, 17 nt, Homo sapiens
uucuauuacgugcaaua

SEQ ID NO: 1288223 - RNA, 22 nt, Homo sapiens
uucuauuacgugcaauacuuca

SEQ ID NO: 1288224 - RNA, 14 nt, Homo sapiens
uucuccuucagccc

SEQ ID NO: 1288225 - RNA, 15 nt, Homo sapiens
uucucuacagacucc

SEQ ID NO: 1288226 - RNA, 21 nt, Homo sapiens
uucucuacagacuccaaaagg

SEQ ID NO: 1288227 - RNA, 13 nt, Homo sapiens
uucucucaucucu

SEQ ID NO: 1288228 - RNA, 22 nt, Homo sapiens
uucucucugacccucuccccac

SEQ ID NO: 1288229 - RNA, 18 nt, Homo sapiens
uucucuggacacugccac

SEQ ID NO: 1288230 - RNA, 17 nt, Homo sapiens
uucugaggacauuccaa

SEQ ID NO: 1288231 - RNA, 13 nt, Homo sapiens
uucugcaagcuuu

SEQ ID NO: 1288232 - RNA, 12 nt, Homo sapiens
aaaaacaugugg

SEQ ID NO: 1288233 - RNA, 17 nt, Homo sapiens
aaaaauacucacauggc

SEQ ID NO: 1288234 - RNA, 15 nt, Homo sapiens
aaaaauaucuuugca

SEQ ID NO: 1288235 - RNA, 15 nt, Homo sapiens
aaaaauccuacaagg

SEQ ID NO: 1288236 - RNA, 14 nt, Homo sapiens
aaaaauguaucaaa

SEQ ID NO: 1288237 - RNA, 22 nt, Homo sapiens
aaaaccaccuuuucugcuucaa

SEQ ID NO: 1288238 - RNA, 18 nt, Homo sapiens
aaaaccauuuuuuccuac

SEQ ID NO: 1288239 - RNA, 18 nt, Homo sapiens
aaaacuuaaaagcaagau

SEQ ID NO: 1288240 - RNA, 14 nt, Homo sapiens
aaaagcagcuacca

SEQ ID NO: 1288241 - RNA, 18 nt, Homo sapiens
aaaagcuucagggaacaa

SEQ ID NO: 1288242 - RNA, 16 nt, Homo sapiens
aaaaggcccuuuucag

SEQ ID NO: 1288243 - RNA, 15 nt, Homo sapiens
aaaaguaaacaacau

SEQ ID NO: 1288244 - RNA, 14 nt, Homo sapiens
aaaaguauacaugu

SEQ ID NO: 1288245 - RNA, 12 nt, Homo sapiens
aaaauaauucua

SEQ ID NO: 1288246 - RNA, 21 nt, Homo sapiens
aaaauagacuaaccucuacca

SEQ ID NO: 1288247 - RNA, 19 nt, Homo sapiens
aaaauauuuuuaugugcaa

SEQ ID NO: 1288248 - RNA, 22 nt, Homo sapiens
aaaaucacacagccaagccagu

SEQ ID NO: 1288249 - RNA, 12 nt, Homo sapiens
aaaaucagagag

SEQ ID NO: 1288250 - RNA, 15 nt, Homo sapiens
aaaaugcaacaacau

SEQ ID NO: 1288251 - RNA, 12 nt, Homo sapiens
aaaaugcaauau

SEQ ID NO: 1288252 - RNA, 12 nt, Homo sapiens
aaaaugccuuug

SEQ ID NO: 1288253 - RNA, 20 nt, Homo sapiens
aaaauucagcggcagugugu

SEQ ID NO: 1288254 - RNA, 18 nt, Homo sapiens
aaaauuuaaaaaacugug

SEQ ID NO: 1288255 - RNA, 22 nt, Homo sapiens
aaacacuauauggcagugucuu

SEQ ID NO: 1288256 - RNA, 18 nt, Homo sapiens
aaacaugaaaacauugau

SEQ ID NO: 1288257 - RNA, 18 nt, Homo sapiens
aaacaugugcaacucuug

SEQ ID NO: 1288258 - RNA, 20 nt, Homo sapiens
aaacaugugguuaaugccau

SEQ ID NO: 1288259 - RNA, 18 nt, Homo sapiens
aaaccacuuuuugcagcu

SEQ ID NO: 1288260 - RNA, 17 nt, Homo sapiens
aaaccauuuuuuccuac

SEQ ID NO: 1288261 - RNA, 21 nt, Homo sapiens
aaacccuuccacguguaugca

SEQ ID NO: 1288262 - RNA, 15 nt, Homo sapiens
aaagaaagaauaugu

SEQ ID NO: 1288263 - RNA, 16 nt, Homo sapiens
aaagaaaguacagaac

SEQ ID NO: 1288264 - RNA, 22 nt, Homo sapiens
aaagacauuuguucucccaaaa

SEQ ID NO: 1288265 - RNA, 17 nt, Homo sapiens
aaagacuaugaggaaua

SEQ ID NO: 1288266 - RNA, 19 nt, Homo sapiens
aaagagaagguuucuucca

SEQ ID NO: 1288267 - RNA, 22 nt, Homo sapiens
aaagagaauggaaaaaugauuu

SEQ ID NO: 1288268 - RNA, 21 nt, Homo sapiens
aaagagauggugcuaaaccau

SEQ ID NO: 1288269 - RNA, 17 nt, Homo sapiens
aaagcaaucuguugaaa

SEQ ID NO: 1288270 - RNA, 17 nt, Homo sapiens
aaagccaccuuguuaca

SEQ ID NO: 1288271 - RNA, 22 nt, Homo sapiens
aaagccugagaagaaagaacca

SEQ ID NO: 1288272 - RNA, 17 nt, Homo sapiens
aaagccugccucuucca

SEQ ID NO: 1288273 - RNA, 20 nt, Homo sapiens
aaagccugccucuuccagga

SEQ ID NO: 1288274 - RNA, 16 nt, Homo sapiens
aaaggagccuaggcca

SEQ ID NO: 1288275 - RNA, 21 nt, Homo sapiens
aaaguauagauggccaaagga

SEQ ID NO: 1288276 - RNA, 18 nt, Homo sapiens
aaaguccccagagaaagc

SEQ ID NO: 1288277 - RNA, 22 nt, Homo sapiens
aaagucuuugaagugacuucac

SEQ ID NO: 1288278 - RNA, 23 nt, Homo sapiens
aaagucuuugaagugacuucaca

SEQ ID NO: 1288279 - RNA, 22 nt, Homo sapiens
agaggccgcgcguccagcugcc

SEQ ID NO: 1288280 - RNA, 16 nt, Homo sapiens
agagguuaaugcaggg

SEQ ID NO: 1288281 - RNA, 21 nt, Homo sapiens
agaguacaccccaacagcacc

SEQ ID NO: 1288282 - RNA, 15 nt, Homo sapiens
agagucaucuaccug

SEQ ID NO: 1288283 - RNA, 23 nt, Homo sapiens
agagucaugugagccucguguca

SEQ ID NO: 1288284 - RNA, 16 nt, Homo sapiens
agauaagggugucuuc

SEQ ID NO: 1288285 - RNA, 18 nt, Homo sapiens
agauagauaauguucucc

SEQ ID NO: 1288286 - RNA, 13 nt, Homo sapiens
agauccuccauuu

SEQ ID NO: 1288287 - RNA, 18 nt, Homo sapiens
agaugaaaccgucccuga

SEQ ID NO: 1288288 - RNA, 20 nt, Homo sapiens
agaugggagcccaguuucac

SEQ ID NO: 1288289 - RNA, 19 nt, Homo sapiens
agauggugcuaaaccauuc

SEQ ID NO: 1288290 - RNA, 21 nt, Homo sapiens
agaugucccugaagucuugca

SEQ ID NO: 1288291 - RNA, 17 nt, Homo sapiens
agauuccgcaccaauaa

SEQ ID NO: 1288292 - RNA, 22 nt, Homo sapiens
agauuuaauccuagagauuugg

SEQ ID NO: 1288293 - RNA, 14 nt, Homo sapiens
agcaacaccaaaaa

SEQ ID NO: 1288294 - RNA, 21 nt, Homo sapiens
agcaagugcuggagucgggac

SEQ ID NO: 1288295 - RNA, 18 nt, Homo sapiens
agcacagcacccauggga

SEQ ID NO: 1288296 - RNA, 15 nt, Homo sapiens
agcacauuuugacac

SEQ ID NO: 1288297 - RNA, 21 nt, Homo sapiens
agcaccaucucuuuaccuccu

SEQ ID NO: 1288298 - RNA, 15 nt, Homo sapiens
agcagcaacuguguc

SEQ ID NO: 1288299 - RNA, 17 nt, Homo sapiens
agcagcagcaucucuga

SEQ ID NO: 1288300 - RNA, 16 nt, Homo sapiens
agcagcccuuuuuaca

SEQ ID NO: 1288301 - RNA, 14 nt, Homo sapiens
agcagguggcagaa

SEQ ID NO: 1288302 - RNA, 19 nt, Homo sapiens
agcagguuucuugcuucug

SEQ ID NO: 1288303 - RNA, 20 nt, Homo sapiens
agcaucaaagagauggugcu

SEQ ID NO: 1288304 - RNA, 22 nt, Homo sapiens
agcaucucccaguucauaauca

SEQ ID NO: 1288305 - RNA, 16 nt, Homo sapiens
agcauggagcauggga

SEQ ID NO: 1288306 - RNA, 18 nt, Homo sapiens
agcauuaugauguggguc

SEQ ID NO: 1288307 - RNA, 14 nt, Homo sapiens
agccaaacaguaug

SEQ ID NO: 1288308 - RNA, 11 nt, Homo sapiens
agccacaggcc

SEQ ID NO: 1288309 - RNA, 14 nt, Homo sapiens
agccacuucacuuu

SEQ ID NO: 1288310 - RNA, 14 nt, Homo sapiens
agcccaggagcucc

SEQ ID NO: 1288311 - RNA, 21 nt, Homo sapiens
agcccaggagcuccccucccc

SEQ ID NO: 1288312 - RNA, 13 nt, Homo sapiens
agcccuguuggca

SEQ ID NO: 1288313 - RNA, 17 nt, Homo sapiens
agcccuguuggcagcuc

SEQ ID NO: 1288314 - RNA, 20 nt, Homo sapiens
agcccuucaugcauuugcac

SEQ ID NO: 1288315 - RNA, 17 nt, Homo sapiens
agccuagcccuucucuc

SEQ ID NO: 1288316 - RNA, 12 nt, Homo sapiens
agccucacuuau

SEQ ID NO: 1288317 - RNA, 18 nt, Homo sapiens
agccugccucuuccagga

SEQ ID NO: 1288318 - RNA, 13 nt, Homo sapiens
agccugggaccag

SEQ ID NO: 1288319 - RNA, 20 nt, Homo sapiens
agccuucugaggacauucca

SEQ ID NO: 1288320 - RNA, 12 nt, Homo sapiens
agccuuugcacu

SEQ ID NO: 1288321 - RNA, 15 nt, Homo sapiens
agcggacaguggcag

SEQ ID NO: 1288322 - RNA, 20 nt, Homo sapiens
agcggacaguggcaggacag

SEQ ID NO: 1288323 - RNA, 22 nt, Homo sapiens
agcgggagccucccugccucag

SEQ ID NO: 1288324 - RNA, 13 nt, Homo sapiens
agcuacuaaugau

SEQ ID NO: 1288325 - RNA, 16 nt, Homo sapiens
agcuacuucccagcua

SEQ ID NO: 1288326 - RNA, 18 nt, Homo sapiens
agcuccacuuucagugaa

SEQ ID NO: 1288327 - RNA, 14 nt, Homo sapiens
agcugcaggggcau

SEQ ID NO: 1288328 - RNA, 22 nt, Homo sapiens
agcugggagcacaggcacugca

SEQ ID NO: 1288329 - RNA, 19 nt, Homo sapiens
agcuggggaugucucucau

SEQ ID NO: 1288330 - RNA, 20 nt, Homo sapiens
agcugugcacaaaguggcau

SEQ ID NO: 1288331 - RNA, 13 nt, Homo sapiens
agcuucucuacag

SEQ ID NO: 1288332 - RNA, 18 nt, Homo sapiens
agcuucucuacagacucc

SEQ ID NO: 1288333 - RNA, 19 nt, Homo sapiens
agcuucucuacagacucca

SEQ ID NO: 1288334 - RNA, 22 nt, Homo sapiens
agcuucucuacagacuccaaaa

SEQ ID NO: 1288335 - RNA, 23 nt, Homo sapiens
agcuucucuacagacuccaaaag

SEQ ID NO: 1288336 - RNA, 15 nt, Homo sapiens
agcuucucugcugcu

SEQ ID NO: 1288337 - RNA, 21 nt, Homo sapiens
agcuugagggugacuauggag

SEQ ID NO: 1288338 - RNA, 14 nt, Homo sapiens
agcuuggaaacugg

SEQ ID NO: 1288339 - RNA, 20 nt, Homo sapiens
agcuuggggaagacccauuc

SEQ ID NO: 1288340 - RNA, 16 nt, Homo sapiens
agcuuugcugggagag

SEQ ID NO: 1288341 - RNA, 22 nt, Homo sapiens
agcuuuucaaaauuggacuuaa

SEQ ID NO: 1288342 - RNA, 18 nt, Homo sapiens
agcuuuuuguucccucau

SEQ ID NO: 1288343 - RNA, 20 nt, Homo sapiens
aggaaauauucuguaaucuu

SEQ ID NO: 1288344 - RNA, 11 nt, Homo sapiens
aggaaccuaau

SEQ ID NO: 1288345 - RNA, 22 nt, Homo sapiens
aggaagaacggggcucuucuca

SEQ ID NO: 1288346 - RNA, 14 nt, Homo sapiens
aggaagcuccaguu

SEQ ID NO: 1288347 - RNA, 19 nt, Homo sapiens
aggaauacaauauauagcu

SEQ ID NO: 1288348 - RNA, 18 nt, Homo sapiens
aggaauauuaaagggauu

SEQ ID NO: 1288349 - RNA, 19 nt, Homo sapiens
aggaauuuuuuucaguauu

SEQ ID NO: 1288350 - RNA, 18 nt, Homo sapiens
aggacaccuuuuaacuca

SEQ ID NO: 1288351 - RNA, 15 nt, Homo sapiens
aggagacccacaggu

SEQ ID NO: 1288352 - RNA, 17 nt, Homo sapiens
aggagcugccuggaccc

SEQ ID NO: 1288353 - RNA, 22 nt, Homo sapiens
aggaguacaccccaacagcacc

SEQ ID NO: 1288354 - RNA, 21 nt, Homo sapiens
aggagucccugccaucauguu

SEQ ID NO: 1288355 - RNA, 13 nt, Homo sapiens
aggcaagcccuuc

SEQ ID NO: 1288356 - RNA, 17 nt, Homo sapiens
aggcagcugacacaucu

SEQ ID NO: 1288357 - RNA, 20 nt, Homo sapiens
aggcagcuuuuucucuccca

SEQ ID NO: 1288358 - RNA, 21 nt, Homo sapiens
aggcagcuuuuucucucccac

SEQ ID NO: 1288359 - RNA, 17 nt, Homo sapiens
aggcauacuuuuaauca

SEQ ID NO: 1288360 - RNA, 13 nt, Homo sapiens
aggcaugaaauga

SEQ ID NO: 1288361 - RNA, 18 nt, Homo sapiens
aggcaugagucagucuga

SEQ ID NO: 1288362 - RNA, 13 nt, Homo sapiens
aggcccuuuucag

SEQ ID NO: 1288363 - RNA, 12 nt, Homo sapiens
aggccucugugc

SEQ ID NO: 1288364 - RNA, 22 nt, Homo sapiens
aggcggaucuuuggacagaagc

SEQ ID NO: 1288365 - RNA, 12 nt, Homo sapiens
aggcuagaugau

SEQ ID NO: 1288366 - RNA, 22 nt, Homo sapiens
aggcugcccccuuccucaccua

SEQ ID NO: 1288367 - RNA, 22 nt, Homo sapiens
aggcuggcagugacagaacuaa

SEQ ID NO: 1288368 - RNA, 22 nt, Homo sapiens
aggcuguacauaguccuuuuau

SEQ ID NO: 1288369 - RNA, 17 nt, Homo sapiens
aggcuucugugugcugc

SEQ ID NO: 1288370 - RNA, 15 nt, Homo sapiens
agggaaguccuugca

SEQ ID NO: 1288371 - RNA, 20 nt, Homo sapiens
agggaauggcacagcccaaa

SEQ ID NO: 1288372 - RNA, 17 nt, Homo sapiens
agggacaucaucucuuc

SEQ ID NO: 1288373 - RNA, 12 nt, Homo sapiens
agggcagcagaa

SEQ ID NO: 1288374 - RNA, 16 nt, Homo sapiens
agggcaggaacuugca

SEQ ID NO: 1288375 - RNA, 20 nt, Homo sapiens
agggcauuguguucacugua

SEQ ID NO: 1288376 - RNA, 15 nt, Homo sapiens
agggcuuucucagga

SEQ ID NO: 1288377 - RNA, 17 nt, Homo sapiens
aggggccacauccaaaa

SEQ ID NO: 1288378 - RNA, 15 nt, Homo sapiens
aggggcucucucaug

SEQ ID NO: 1288379 - RNA, 13 nt, Homo sapiens
aggggucauucau

SEQ ID NO: 1288380 - RNA, 14 nt, Homo sapiens
agggugacuaugga

SEQ ID NO: 1288381 - RNA, 20 nt, Homo sapiens
agguaacuguacugggccau

SEQ ID NO: 1288382 - RNA, 14 nt, Homo sapiens
aggucaaguaagaa

SEQ ID NO: 1288383 - RNA, 17 nt, Homo sapiens
aggucauagcagugcuu

SEQ ID NO: 1288384 - RNA, 21 nt, Homo sapiens
aggucuuuuacauacagugau

SEQ ID NO: 1288385 - RNA, 19 nt, Homo sapiens
aggugggccuugcuaccuc

SEQ ID NO: 1288386 - RNA, 23 nt, Homo sapiens
agguguucuucauuaccucagug

SEQ ID NO: 1288387 - RNA, 16 nt, Homo sapiens
aguauacacacuuucc

SEQ ID NO: 1288388 - RNA, 14 nt, Homo sapiens
aguaugaaguauaa

SEQ ID NO: 1288389 - RNA, 19 nt, Homo sapiens
agucacugacccugugcag

SEQ ID NO: 1288390 - RNA, 13 nt, Homo sapiens
augucucucauga

SEQ ID NO: 1288391 - RNA, 22 nt, Homo sapiens
augucuguagcuccucaacuca

SEQ ID NO: 1288392 - RNA, 16 nt, Homo sapiens
augugggugggaccac

SEQ ID NO: 1288393 - RNA, 18 nt, Homo sapiens
augugggugggaccacag

SEQ ID NO: 1288394 - RNA, 15 nt, Homo sapiens
auguggguugugaua

SEQ ID NO: 1288395 - RNA, 22 nt, Homo sapiens
auguucacuuauugacuauuau

SEQ ID NO: 1288396 - RNA, 15 nt, Homo sapiens
auguucuccacugac

SEQ ID NO: 1288397 - RNA, 20 nt, Homo sapiens
auguuguuccaggaugugga

SEQ ID NO: 1288398 - RNA, 13 nt, Homo sapiens
auguuguuugcug

SEQ ID NO: 1288399 - RNA, 15 nt, Homo sapiens
auguuuaugagccag

SEQ ID NO: 1288400 - RNA, 21 nt, Homo sapiens
auguuucaagcgcuuaacucc

SEQ ID NO: 1288401 - RNA, 17 nt, Homo sapiens
auuaaguacaagcacau

SEQ ID NO: 1288402 - RNA, 21 nt, Homo sapiens
auuaaucaaaccacuguuauu

SEQ ID NO: 1288403 - RNA, 22 nt, Homo sapiens
auuaaucucuaguaaaacauug

SEQ ID NO: 1288404 - RNA, 13 nt, Homo sapiens
auuacauacuauu

SEQ ID NO: 1288405 - RNA, 13 nt, Homo sapiens
auuaccuaaugaa

SEQ ID NO: 1288406 - RNA, 17 nt, Homo sapiens
auuagccguaguggaau

SEQ ID NO: 1288407 - RNA, 16 nt, Homo sapiens
auuagguccacuucaa

SEQ ID NO: 1288408 - RNA, 13 nt, Homo sapiens
auuauauaagucu

SEQ ID NO: 1288409 - RNA, 19 nt, Homo sapiens
auuaucaaugggauaugau

SEQ ID NO: 1288410 - RNA, 16 nt, Homo sapiens
auuaucuaaaguauga

SEQ ID NO: 1288411 - RNA, 12 nt, Homo sapiens
auuauucccaug

SEQ ID NO: 1288412 - RNA, 22 nt, Homo sapiens
auuauuuugugcaacauaacaa

SEQ ID NO: 1288413 - RNA, 20 nt, Homo sapiens
auucacagcaagucacuggc

SEQ ID NO: 1288414 - RNA, 14 nt, Homo sapiens
auucaggcuuugga

SEQ ID NO: 1288415 - RNA, 23 nt, Homo sapiens
auucagugagggucuucuuacau

SEQ ID NO: 1288416 - RNA, 18 nt, Homo sapiens
auuccacagggauaccuu

SEQ ID NO: 1288417 - RNA, 17 nt, Homo sapiens
auuccauuuacuugauc

SEQ ID NO: 1288418 - RNA, 17 nt, Homo sapiens
auuccuaaaaugcuuca

SEQ ID NO: 1288419 - RNA, 12 nt, Homo sapiens
auuccucagggc

SEQ ID NO: 1288420 - RNA, 16 nt, Homo sapiens
auuccugagccagugu

SEQ ID NO: 1288421 - RNA, 17 nt, Homo sapiens
auucucaguauccacug

SEQ ID NO: 1288422 - RNA, 15 nt, Homo sapiens
auucugcaagcuuuu

SEQ ID NO: 1288423 - RNA, 17 nt, Homo sapiens
auucugcaagcuuuuca

SEQ ID NO: 1288424 - RNA, 16 nt, Homo sapiens
auucuuaaaaugcaau

SEQ ID NO: 1288425 - RNA, 19 nt, Homo sapiens
auucuuugcgguauucuug

SEQ ID NO: 1288426 - RNA, 17 nt, Homo sapiens
auugauauaaagaaaua

SEQ ID NO: 1288427 - RNA, 20 nt, Homo sapiens
auugauuauuuugugcaaca

SEQ ID NO: 1288428 - RNA, 15 nt, Homo sapiens
auugcagaguacugg

SEQ ID NO: 1288429 - RNA, 14 nt, Homo sapiens
auugccauguggac

SEQ ID NO: 1288430 - RNA, 17 nt, Homo sapiens
auuggcucacacugaga

SEQ ID NO: 1288431 - RNA, 19 nt, Homo sapiens
auuggcucacaguucugca

SEQ ID NO: 1288432 - RNA, 18 nt, Homo sapiens
auugguguugacauacau

SEQ ID NO: 1288433 - RNA, 12 nt, Homo sapiens
auugucccugaa

SEQ ID NO: 1288434 - RNA, 14 nt, Homo sapiens
auuguguagagugu

SEQ ID NO: 1288435 - RNA, 14 nt, Homo sapiens
auuguguucacugu

SEQ ID NO: 1288436 - RNA, 18 nt, Homo sapiens
auuuaaauagaacuugau

SEQ ID NO: 1288437 - RNA, 19 nt, Homo sapiens
auuuaaauagaacuugauu

SEQ ID NO: 1288438 - RNA, 19 nt, Homo sapiens
auuuaacuaugaacugaag

SEQ ID NO: 1288439 - RNA, 22 nt, Homo sapiens
auuuaaggaagaaucuucugcc

SEQ ID NO: 1288440 - RNA, 21 nt, Homo sapiens
auuuaauuuuuuaaacuguag

SEQ ID NO: 1288441 - RNA, 18 nt, Homo sapiens
auuuaccuucuaccucuu

SEQ ID NO: 1288442 - RNA, 23 nt, Homo sapiens
auuucaccacucaaaggccagac

SEQ ID NO: 1288443 - RNA, 23 nt, Homo sapiens
auuucagaugauucaaauaucaa

SEQ ID NO: 1288444 - RNA, 18 nt, Homo sapiens
auuucauuuuuacccuua

SEQ ID NO: 1288445 - RNA, 17 nt, Homo sapiens
auuuccuuuuccuucaa

SEQ ID NO: 1288446 - RNA, 21 nt, Homo sapiens
auuucuucaagugaguggcau

SEQ ID NO: 1288447 - RNA, 19 nt, Homo sapiens
auuucuuuugugcagauca

SEQ ID NO: 1288448 - RNA, 11 nt, Homo sapiens
auuugcacuau

SEQ ID NO: 1288449 - RNA, 13 nt, Homo sapiens
auuugcuaugagc

SEQ ID NO: 1288450 - RNA, 19 nt, Homo sapiens
auuugggcaggaacacaga

SEQ ID NO: 1288451 - RNA, 15 nt, Homo sapiens
auuugguguacaauu

SEQ ID NO: 1288452 - RNA, 20 nt, Homo sapiens
auuuguaaauuuaugugaug

SEQ ID NO: 1288453 - RNA, 14 nt, Homo sapiens
auuuguuugugcau

SEQ ID NO: 1288454 - RNA, 16 nt, Homo sapiens
auuuuacccaaauacu

SEQ ID NO: 1288455 - RNA, 13 nt, Homo sapiens
auuuucacuuuug

SEQ ID NO: 1288456 - RNA, 16 nt, Homo sapiens
auuuucagcaucaaac

SEQ ID NO: 1288457 - RNA, 19 nt, Homo sapiens
auuuucccuacuugcagcg

SEQ ID NO: 1288458 - RNA, 16 nt, Homo sapiens
auuuugccauuuagcg

SEQ ID NO: 1288459 - RNA, 17 nt, Homo sapiens
auuuugugcaacauaac

SEQ ID NO: 1288460 - RNA, 17 nt, Homo sapiens
auuuuuaaaaguauaca

SEQ ID NO: 1288461 - RNA, 19 nt, Homo sapiens
auuuuuaaaaucauaacau

SEQ ID NO: 1288462 - RNA, 17 nt, Homo sapiens
auuuuuaaaggacaaac

SEQ ID NO: 1288463 - RNA, 16 nt, Homo sapiens
auuuuuuucaguauua

SEQ ID NO: 1288464 - RNA, 18 nt, Homo sapiens
caaaaauacucacauggc

SEQ ID NO: 1288465 - RNA, 17 nt, Homo sapiens
caaacagaacuauggaa

SEQ ID NO: 1288466 - RNA, 19 nt, Homo sapiens
caaacagccccucuggaca

SEQ ID NO: 1288467 - RNA, 21 nt, Homo sapiens
caaacagccccucuggacaca

SEQ ID NO: 1288468 - RNA, 19 nt, Homo sapiens
caaacuacugccauuucag

SEQ ID NO: 1288469 - RNA, 12 nt, Homo sapiens
caaacuguaaaa

SEQ ID NO: 1288470 - RNA, 14 nt, Homo sapiens
caaagacuauuccc

SEQ ID NO: 1288471 - RNA, 21 nt, Homo sapiens
caaagcccuuguccccaugaa

SEQ ID NO: 1288472 - RNA, 20 nt, Homo sapiens
caaagccuuuggcucuucua

SEQ ID NO: 1288473 - RNA, 14 nt, Homo sapiens
caaaggcaggcacu

SEQ ID NO: 1288474 - RNA, 21 nt, Homo sapiens
caaaggcaggcacuucacaca

SEQ ID NO: 1288475 - RNA, 11 nt, Homo sapiens
caaaguuggcg

SEQ ID NO: 1288476 - RNA, 13 nt, Homo sapiens
caaaucucuauua

SEQ ID NO: 1288477 - RNA, 15 nt, Homo sapiens
caaaugccacacggc

SEQ ID NO: 1288478 - RNA, 20 nt, Homo sapiens
caacaauacaggcuagggau

SEQ ID NO: 1288479 - RNA, 18 nt, Homo sapiens
caacagaaucagaucuga

SEQ ID NO: 1288480 - RNA, 13 nt, Homo sapiens
caacagagcaaaa

SEQ ID NO: 1288481 - RNA, 18 nt, Homo sapiens
caacauuuguuccaugag

SEQ ID NO: 1288482 - RNA, 12 nt, Homo sapiens
caacgccagaau

SEQ ID NO: 1288483 - RNA, 19 nt, Homo sapiens
caacucuguacaaagcccu

SEQ ID NO: 1288484 - RNA, 20 nt, Homo sapiens
caagacaaugggaauggccu

SEQ ID NO: 1288485 - RNA, 21 nt, Homo sapiens
caagauccaaaugcugugcaa

SEQ ID NO: 1288486 - RNA, 19 nt, Homo sapiens
caagauuuuuucauuucaa

SEQ ID NO: 1288487 - RNA, 22 nt, Homo sapiens
caaggaaccuaauugaaauuua

SEQ ID NO: 1288488 - RNA, 15 nt, Homo sapiens
caaggucauuugcua

SEQ ID NO: 1288489 - RNA, 17 nt, Homo sapiens
caaguagaacaaaaacu

SEQ ID NO: 1288490 - RNA, 16 nt, Homo sapiens
caaguaugaaguauaa

SEQ ID NO: 1288491 - RNA, 15 nt, Homo sapiens
caaguguaagcagaa

SEQ ID NO: 1288492 - RNA, 13 nt, Homo sapiens
caauaaagccuuc

SEQ ID NO: 1288493 - RNA, 15 nt, Homo sapiens
caauaaagccuucaa

SEQ ID NO: 1288494 - RNA, 21 nt, Homo sapiens
caauagcaugcaaaaaaugcu

SEQ ID NO: 1288495 - RNA, 11 nt, Homo sapiens
caauauaguga

SEQ ID NO: 1288496 - RNA, 18 nt, Homo sapiens
caaucccugacccuuuga

SEQ ID NO: 1288497 - RNA, 11 nt, Homo sapiens
caaugaacuuu

SEQ ID NO: 1288498 - RNA, 21 nt, Homo sapiens
caaugccacauacuugcagcu

SEQ ID NO: 1288499 - RNA, 16 nt, Homo sapiens
caauggcuuacuccag

SEQ ID NO: 1288500 - RNA, 15 nt, Homo sapiens
caauguuacuaucug

SEQ ID NO: 1288501 - RNA, 19 nt, Homo sapiens
caauguuuuaaacauucuu

SEQ ID NO: 1288502 - RNA, 21 nt, Homo sapiens
uggaaagacagcuucucaucc

SEQ ID NO: 1288503 - RNA, 16 nt, Homo sapiens
uggaacucaaggaaau

SEQ ID NO: 1288504 - RNA, 18 nt, Homo sapiens
uggaauauguaaauagaa

SEQ ID NO: 1288505 - RNA, 18 nt, Homo sapiens
uggacaauggaccggaga

SEQ ID NO: 1288506 - RNA, 14 nt, Homo sapiens
uggacacagaggaa

SEQ ID NO: 1288507 - RNA, 12 nt, Homo sapiens
uggacacagccc

SEQ ID NO: 1288508 - RNA, 16 nt, Homo sapiens
uggagcaaauguccua

SEQ ID NO: 1288509 - RNA, 14 nt, Homo sapiens
uggaugcagaucca

SEQ ID NO: 1288510 - RNA, 13 nt, Homo sapiens
uggauucagaaua

SEQ ID NO: 1288511 - RNA, 17 nt, Homo sapiens
uggcaaacaugugcaac

SEQ ID NO: 1288512 - RNA, 22 nt, Homo sapiens
uggcaaaucucuauuaggaaau

SEQ ID NO: 1288513 - RNA, 17 nt, Homo sapiens
uggcaacagaaaacaau

SEQ ID NO: 1288514 - RNA, 18 nt, Homo sapiens
uggcaugcuaaagccuuc

SEQ ID NO: 1288515 - RNA, 20 nt, Homo sapiens
uggcauguggguugugauau

SEQ ID NO: 1288516 - RNA, 23 nt, Homo sapiens
uggccaaaacuuaaaagcaagau

SEQ ID NO: 1288517 - RNA, 14 nt, Homo sapiens
uggcccuaugcuuc

SEQ ID NO: 1288518 - RNA, 15 nt, Homo sapiens
uggccuccugugcau

SEQ ID NO: 1288519 - RNA, 15 nt, Homo sapiens
uggcucacacugaga

SEQ ID NO: 1288520 - RNA, 14 nt, Homo sapiens
uggcuccaaacccu

SEQ ID NO: 1288521 - RNA, 17 nt, Homo sapiens
uggcugauggaguaaau

SEQ ID NO: 1288522 - RNA, 15 nt, Homo sapiens
uggcuggaucuguga

SEQ ID NO: 1288523 - RNA, 22 nt, Homo sapiens
uggcuuaugccccugcacugaa

SEQ ID NO: 1288524 - RNA, 14 nt, Homo sapiens
uggcuucacuccug

SEQ ID NO: 1288525 - RNA, 17 nt, Homo sapiens
ugggaauuuucuuccaa

SEQ ID NO: 1288526 - RNA, 13 nt, Homo sapiens
ugggaccacagac

SEQ ID NO: 1288527 - RNA, 20 nt, Homo sapiens
ugggaugcgggcauuuugaa

SEQ ID NO: 1288528 - RNA, 22 nt, Homo sapiens
ugggccacucaggggucauuca

SEQ ID NO: 1288529 - RNA, 16 nt, Homo sapiens
ugggcucuacuaccug

SEQ ID NO: 1288530 - RNA, 15 nt, Homo sapiens
uggggaggacaggga

SEQ ID NO: 1288531 - RNA, 18 nt, Homo sapiens
uggggauggagaagacaa

SEQ ID NO: 1288532 - RNA, 15 nt, Homo sapiens
ugggugauuucuaga

SEQ ID NO: 1288533 - RNA, 16 nt, Homo sapiens
ugggugggaccacaga

SEQ ID NO: 1288534 - RNA, 23 nt, Homo sapiens
uggguucacagaagcacagcacc

SEQ ID NO: 1288535 - RNA, 21 nt, Homo sapiens
uggucuccaguggaagggaaa

SEQ ID NO: 1288536 - RNA, 22 nt, Homo sapiens
uggucuccccgcagucguccca

SEQ ID NO: 1288537 - RNA, 14 nt, Homo sapiens
uggugaaaugcaga

SEQ ID NO: 1288538 - RNA, 13 nt, Homo sapiens
uggugcucauuua

SEQ ID NO: 1288539 - RNA, 17 nt, Homo sapiens
ugguguuaaucauuuca

SEQ ID NO: 1288540 - RNA, 12 nt, Homo sapiens
ugguuaaaguau

SEQ ID NO: 1288541 - RNA, 12 nt, Homo sapiens
ugguuaaaucau

SEQ ID NO: 1288542 - RNA, 16 nt, Homo sapiens
ugguuuagucauugca

SEQ ID NO: 1288543 - RNA, 22 nt, Homo sapiens
uguaaguuuaugcauacaguaa

SEQ ID NO: 1288544 - RNA, 14 nt, Homo sapiens
uguaauucagguac

SEQ ID NO: 1288545 - RNA, 16 nt, Homo sapiens
uguaauuuuaguauua

SEQ ID NO: 1288546 - RNA, 12 nt, Homo sapiens
uguacaaagccc

SEQ ID NO: 1288547 - RNA, 23 nt, Homo sapiens
uguacaagguauguacaguucau

SEQ ID NO: 1288548 - RNA, 17 nt, Homo sapiens
uguacauuagucauuca

SEQ ID NO: 1288549 - RNA, 18 nt, Homo sapiens
uguacugaguauugauaa

SEQ ID NO: 1288550 - RNA, 19 nt, Homo sapiens
uguacuggagaguggcaaa

SEQ ID NO: 1288551 - RNA, 22 nt, Homo sapiens
uguagcauccuguuuguaucau

SEQ ID NO: 1288552 - RNA, 17 nt, Homo sapiens
uguagucucacacuguu

SEQ ID NO: 1288553 - RNA, 20 nt, Homo sapiens
ugucagcuacuaaugauguu

SEQ ID NO: 1288554 - RNA, 15 nt, Homo sapiens
ugucccaaguuccac

SEQ ID NO: 1288555 - RNA, 22 nt, Homo sapiens
ugucccucauccauagcaccuc

SEQ ID NO: 1288556 - RNA, 14 nt, Homo sapiens
uguccuaugcaaua

SEQ ID NO: 1288557 - RNA, 17 nt, Homo sapiens
uguccucccuuguggcu

SEQ ID NO: 1288558 - RNA, 17 nt, Homo sapiens
ugucuaaaaucccuccu

SEQ ID NO: 1288559 - RNA, 15 nt, Homo sapiens
ugucuagaacacuca

SEQ ID NO: 1288560 - RNA, 22 nt, Homo sapiens
ugucuuacagagaaaagacaua

SEQ ID NO: 1288561 - RNA, 23 nt, Homo sapiens
ugucuuacagagaaaagacauaa

SEQ ID NO: 1288562 - RNA, 23 nt, Homo sapiens
ugugagacucgagaacuuucauu

SEQ ID NO: 1288563 - RNA, 18 nt, Homo sapiens
uguggaggagcucaggac

SEQ ID NO: 1288564 - RNA, 14 nt, Homo sapiens
ugugggugggacca

SEQ ID NO: 1288565 - RNA, 21 nt, Homo sapiens
ugugguccgaagucuuccaua

SEQ ID NO: 1288566 - RNA, 22 nt, Homo sapiens
ugugguuaaugccauggacaga

SEQ ID NO: 1288567 - RNA, 19 nt, Homo sapiens
ugugguuacacagugugaa

SEQ ID NO: 1288568 - RNA, 19 nt, Homo sapiens
ugugguuuuuagugcacuu

SEQ ID NO: 1288569 - RNA, 12 nt, Homo sapiens
uguguaaucuaa

SEQ ID NO: 1288570 - RNA, 18 nt, Homo sapiens
uguguauuuccagugcaa

SEQ ID NO: 1288571 - RNA, 19 nt, Homo sapiens
uguguauuuccagugcaau

SEQ ID NO: 1288572 - RNA, 24 nt, Homo sapiens
uguguauuuccagugcaauuguag

SEQ ID NO: 1288573 - RNA, 12 nt, Homo sapiens
ugugucugcaac

SEQ ID NO: 1288574 - RNA, 18 nt, Homo sapiens
ugugugaggacuucugca

SEQ ID NO: 1288575 - RNA, 16 nt, Homo sapiens
uguguggcauuuucac

SEQ ID NO: 1288576 - RNA, 14 nt, Homo sapiens
uguguuuuuaauua

SEQ ID NO: 1288577 - RNA, 15 nt, Homo sapiens
uguuaaggaaacucu

SEQ ID NO: 1288578 - RNA, 16 nt, Homo sapiens
uguuacuuaaacauca

SEQ ID NO: 1288579 - RNA, 14 nt, Homo sapiens
uguuauaacuucau

SEQ ID NO: 1288580 - RNA, 20 nt, Homo sapiens
uguuauuauaaaaguacuag

SEQ ID NO: 1288581 - RNA, 17 nt, Homo sapiens
uguucaaaauuccauuu

SEQ ID NO: 1288582 - RNA, 16 nt, Homo sapiens
uguucugucccuugcc

SEQ ID NO: 1288583 - RNA, 17 nt, Homo sapiens
uguuggaaaaugugcaa

SEQ ID NO: 1288584 - RNA, 15 nt, Homo sapiens
uguugucauguguau

SEQ ID NO: 1288585 - RNA, 17 nt, Homo sapiens
uguuguuuaacuugucu

SEQ ID NO: 1288586 - RNA, 14 nt, Homo sapiens
uguuuaacuugucu

SEQ ID NO: 1288587 - RNA, 12 nt, Homo sapiens
uguuucuuuagc

SEQ ID NO: 1288588 - RNA, 15 nt, Homo sapiens
uuaaaagucauuauu

SEQ ID NO: 1288589 - RNA, 23 nt, Homo sapiens
uuaaaaucuugcauggcauuaau

SEQ ID NO: 1288590 - RNA, 17 nt, Homo sapiens
uuaaacaaauguaugau

SEQ ID NO: 1288591 - RNA, 23 nt, Homo sapiens
uuaaacacccagaagcaguaaua

SEQ ID NO: 1288592 - RNA, 10 nt, Homo sapiens
uuaaacuggu

SEQ ID NO: 1288593 - RNA, 11 nt, Homo sapiens
uuaaacuguag

SEQ ID NO: 1288594 - RNA, 18 nt, Homo sapiens
uuaaaggacaaacaguga

SEQ ID NO: 1288595 - RNA, 15 nt, Homo sapiens
uuaaaguauguccuu

SEQ ID NO: 1288596 - RNA, 13 nt, Homo sapiens
uuaaaucugaauu

SEQ ID NO: 1288597 - RNA, 15 nt, Homo sapiens
uuaaauugcauuucu

SEQ ID NO: 1288598 - RNA, 22 nt, Homo sapiens
uuaaauugccuuuguaauauga

SEQ ID NO: 1288599 - RNA, 17 nt, Homo sapiens
uuaacuaugaacugaag

SEQ ID NO: 1288600 - RNA, 21 nt, Homo sapiens
uuaacuuaaaagaacauguau

SEQ ID NO: 1288601 - RNA, 20 nt, Homo sapiens
uuaagcucugagcugucaac

SEQ ID NO: 1288602 - RNA, 21 nt, Homo sapiens
uuaaggaaacucuuaucucag

SEQ ID NO: 1288603 - RNA, 17 nt, Homo sapiens
uuaaggaaggcacuaaa

SEQ ID NO: 1288604 - RNA, 13 nt, Homo sapiens
uuacaacaaacac

SEQ ID NO: 1288605 - RNA, 19 nt, Homo sapiens
uuacaacaaacacugugau

SEQ ID NO: 1288606 - RNA, 18 nt, Homo sapiens
uuacagagaaaagacaua

SEQ ID NO: 1288607 - RNA, 19 nt, Homo sapiens
uuacagguuacgugagaac

SEQ ID NO: 1288608 - RNA, 14 nt, Homo sapiens
uuacaugcauuuga

SEQ ID NO: 1288609 - RNA, 13 nt, Homo sapiens
uuacauguuguaa

SEQ ID NO: 1288610 - RNA, 15 nt, Homo sapiens
uuacgagcagggaug

SEQ ID NO: 1288611 - RNA, 14 nt, Homo sapiens
uuagagacaucaaa

SEQ ID NO: 1288612 - RNA, 20 nt, Homo sapiens
uuaggagagagaaaauaauu

SEQ ID NO: 1288613 - RNA, 19 nt, Homo sapiens
uuagguaaauaaagcucaa

SEQ ID NO: 1288614 - RNA, 21 nt, Homo sapiens
cuguagacauuugcuaugagc

SEQ ID NO: 1288615 - RNA, 17 nt, Homo sapiens
cuguccaccaccaccug

SEQ ID NO: 1288616 - RNA, 21 nt, Homo sapiens
cuguccccuucucucaucucu

SEQ ID NO: 1288617 - RNA, 19 nt, Homo sapiens
cugucccucauccauagca

SEQ ID NO: 1288618 - RNA, 22 nt, Homo sapiens
cuguccuugaaugccauaguca

SEQ ID NO: 1288619 - RNA, 18 nt, Homo sapiens
cugugcacaaaguggcau

SEQ ID NO: 1288620 - RNA, 18 nt, Homo sapiens
cugugcccucagauuccg

SEQ ID NO: 1288621 - RNA, 20 nt, Homo sapiens
cugugccuuggugugcugua

SEQ ID NO: 1288622 - RNA, 21 nt, Homo sapiens
cugugccuuggugugcuguau

SEQ ID NO: 1288623 - RNA, 14 nt, Homo sapiens
cugugccuuuugcc

SEQ ID NO: 1288624 - RNA, 14 nt, Homo sapiens
cugugucacuguau

SEQ ID NO: 1288625 - RNA, 19 nt, Homo sapiens
cugugucaguggaugcugc

SEQ ID NO: 1288626 - RNA, 20 nt, Homo sapiens
cuguuaccugaucaaugaca

SEQ ID NO: 1288627 - RNA, 16 nt, Homo sapiens
cuguuauuaacagaua

SEQ ID NO: 1288628 - RNA, 16 nt, Homo sapiens
cuguuccuuaugauau

SEQ ID NO: 1288629 - RNA, 13 nt, Homo sapiens
cuguuggcagcuc

SEQ ID NO: 1288630 - RNA, 16 nt, Homo sapiens
cuguuuuguaaagucc

SEQ ID NO: 1288631 - RNA, 12 nt, Homo sapiens
cuuaaacaucau

SEQ ID NO: 1288632 - RNA, 16 nt, Homo sapiens
cuuaacauuccuaaaa

SEQ ID NO: 1288633 - RNA, 18 nt, Homo sapiens
cuuacaaacaugugguua

SEQ ID NO: 1288634 - RNA, 18 nt, Homo sapiens
cuuacagucagcacagaa

SEQ ID NO: 1288635 - RNA, 18 nt, Homo sapiens
cuuacccuccuccagacc

SEQ ID NO: 1288636 - RNA, 15 nt, Homo sapiens
cuuacuuuuaaaaua

SEQ ID NO: 1288637 - RNA, 15 nt, Homo sapiens
cuuaggccagcacca

SEQ ID NO: 1288638 - RNA, 17 nt, Homo sapiens
cuuagugcaauaccugg

SEQ ID NO: 1288639 - RNA, 14 nt, Homo sapiens
cuuauccaacucuc

SEQ ID NO: 1288640 - RNA, 21 nt, Homo sapiens
gcagauugaaaaggacaccuu

SEQ ID NO: 1288641 - RNA, 23 nt, Homo sapiens
gcagcggggcaagcaaaaacaau

SEQ ID NO: 1288642 - RNA, 18 nt, Homo sapiens
gcagcuagccagugcuca

SEQ ID NO: 1288643 - RNA, 19 nt, Homo sapiens
gcaggaaacauagaacuca

SEQ ID NO: 1288644 - RNA, 13 nt, Homo sapiens
gcaggaagccaaa

SEQ ID NO: 1288645 - RNA, 22 nt, Homo sapiens
gcaggcaaucguggaugucucu

SEQ ID NO: 1288646 - RNA, 17 nt, Homo sapiens
gcaggcacuucacacag

SEQ ID NO: 1288647 - RNA, 16 nt, Homo sapiens
gcagggaacaugggga

SEQ ID NO: 1288648 - RNA, 19 nt, Homo sapiens
gcaguagcagcagcaucuc

SEQ ID NO: 1288649 - RNA, 18 nt, Homo sapiens
gcaguguguccaucauau

SEQ ID NO: 1288650 - RNA, 19 nt, Homo sapiens
gcauaaauaugcagugaua

SEQ ID NO: 1288651 - RNA, 20 nt, Homo sapiens
gcauaaauaugcagugauau

SEQ ID NO: 1288652 - RNA, 18 nt, Homo sapiens
gcauaauaagcuaaagag

SEQ ID NO: 1288653 - RNA, 17 nt, Homo sapiens
gcaugaagguuucugaa

SEQ ID NO: 1288654 - RNA, 19 nt, Homo sapiens
gcauuugugcccacucucc

SEQ ID NO: 1288655 - RNA, 17 nt, Homo sapiens
gccaagcuaaucugccu

SEQ ID NO: 1288656 - RNA, 19 nt, Homo sapiens
gccaaugccccacuggcag

SEQ ID NO: 1288657 - RNA, 12 nt, Homo sapiens
gccaauuuacuu

SEQ ID NO: 1288658 - RNA, 16 nt, Homo sapiens
gccacagacaauaugg

SEQ ID NO: 1288659 - RNA, 12 nt, Homo sapiens
gccaccuggacc

SEQ ID NO: 1288660 - RNA, 17 nt, Homo sapiens
gccaccuuccucuccca

SEQ ID NO: 1288661 - RNA, 22 nt, Homo sapiens
gccacgcggccccacauugcac

SEQ ID NO: 1288662 - RNA, 15 nt, Homo sapiens
gccacuucacuuuuu

SEQ ID NO: 1288663 - RNA, 17 nt, Homo sapiens
gccagaucucaugagaa

SEQ ID NO: 1288664 - RNA, 13 nt, Homo sapiens
gccaggcagaucc

SEQ ID NO: 1288665 - RNA, 15 nt, Homo sapiens
gccaggcagauccca

SEQ ID NO: 1288666 - RNA, 19 nt, Homo sapiens
gccaggguaguaagaauua

SEQ ID NO: 1288667 - RNA, 22 nt, Homo sapiens
gccaguaccuccugccccaugc

SEQ ID NO: 1288668 - RNA, 13 nt, Homo sapiens
aaaaaagcccaac

SEQ ID NO: 1288669 - RNA, 22 nt, Homo sapiens
aaaaaugcccauuuuugcuaau

SEQ ID NO: 1288670 - RNA, 16 nt, Homo sapiens
aaaacaugugguuaca

SEQ ID NO: 1288671 - RNA, 21 nt, Homo sapiens
aaaaccgaauuagguccacuu

SEQ ID NO: 1288672 - RNA, 22 nt, Homo sapiens
aaaacuaaggcauuugauuaaa

SEQ ID NO: 1288673 - RNA, 11 nt, Homo sapiens
aaaacugacuc

SEQ ID NO: 1288674 - RNA, 19 nt, Homo sapiens
aaaagcccaugaucuucaa

SEQ ID NO: 1288675 - RNA, 14 nt, Homo sapiens
aaaagccucaguga

SEQ ID NO: 1288676 - RNA, 19 nt, Homo sapiens
aaaauagacuaaccucuac

SEQ ID NO: 1288677 - RNA, 18 nt, Homo sapiens
aaaauauauacuauauga

SEQ ID NO: 1288678 - RNA, 22 nt, Homo sapiens
aaaauauuuuuaugugcaauaa

SEQ ID NO: 1288679 - RNA, 14 nt, Homo sapiens
aaaaucaauauuuc

SEQ ID NO: 1288680 - RNA, 16 nt, Homo sapiens
aaaaucucaacuauaa

SEQ ID NO: 1288681 - RNA, 15 nt, Homo sapiens
aaaaucuucagcugg

SEQ ID NO: 1288682 - RNA, 16 nt, Homo sapiens
aaaaucuucagcuggu

SEQ ID NO: 1288683 - RNA, 22 nt, Homo sapiens
aaaaucuucagcugguggaugg

SEQ ID NO: 1288684 - RNA, 22 nt, Homo sapiens
aaaaugcaucauuaauaccuaa

SEQ ID NO: 1288685 - RNA, 13 nt, Homo sapiens
aaaaugcugauau

SEQ ID NO: 1288686 - RNA, 17 nt, Homo sapiens
aaaaugcuucacuguac

SEQ ID NO: 1288687 - RNA, 13 nt, Homo sapiens
aaaaugugcaaua

SEQ ID NO: 1288688 - RNA, 15 nt, Homo sapiens
aaaaugugcaauaug

SEQ ID NO: 1288689 - RNA, 16 nt, Homo sapiens
aaaauuccauuuacuu

SEQ ID NO: 1288690 - RNA, 22 nt, Homo sapiens
aaaauuuugggguaaaaaggag

SEQ ID NO: 1288691 - RNA, 18 nt, Homo sapiens
aaaauuuuuuacuuuuaa

SEQ ID NO: 1288692 - RNA, 13 nt, Homo sapiens
aaacaccaaaaau

SEQ ID NO: 1288693 - RNA, 16 nt, Homo sapiens
aaacagauuacuagaa

SEQ ID NO: 1288694 - RNA, 21 nt, Homo sapiens
aaacagccccucuggacacag

SEQ ID NO: 1288695 - RNA, 16 nt, Homo sapiens
aaacaugaaaacauug

SEQ ID NO: 1288696 - RNA, 22 nt, Homo sapiens
aaacauguuucugccuucuuua

SEQ ID NO: 1288697 - RNA, 23 nt, Homo sapiens
aaacauuguuuuuguugucuuua

SEQ ID NO: 1288698 - RNA, 21 nt, Homo sapiens
aaaccauucaugaugaacuca

SEQ ID NO: 1288699 - RNA, 20 nt, Homo sapiens
aaacccccacccuucugccu

SEQ ID NO: 1288700 - RNA, 21 nt, Homo sapiens
aaaccugagcagcaacugugu

SEQ ID NO: 1288701 - RNA, 18 nt, Homo sapiens
aaaccuugaaagacauuu

SEQ ID NO: 1288702 - RNA, 23 nt, Homo sapiens
aaacucaugacugagucuggcaa

SEQ ID NO: 1288703 - RNA, 17 nt, Homo sapiens
aaacuuuucauuacacu

SEQ ID NO: 1288704 - RNA, 21 nt, Homo sapiens
aaacuuuucauuacacuaaag

SEQ ID NO: 1288705 - RNA, 12 nt, Homo sapiens
aaagaaauaccu

SEQ ID NO: 1288706 - RNA, 19 nt, Homo sapiens
aaagacauuuguucuccca

SEQ ID NO: 1288707 - RNA, 21 nt, Homo sapiens
aaagaguuugaugaggcccuc

SEQ ID NO: 1288708 - RNA, 18 nt, Homo sapiens
aaagccugccucuuccag

SEQ ID NO: 1288709 - RNA, 23 nt, Homo sapiens
aaagcuaagugaauuuuugcaca

SEQ ID NO: 1288710 - RNA, 21 nt, Homo sapiens
aaagcugugucucuguauaua

SEQ ID NO: 1288711 - RNA, 13 nt, Homo sapiens
aaagcuucaggga

SEQ ID NO: 1288712 - RNA, 14 nt, Homo sapiens
aaaggaagacuaga

SEQ ID NO: 1288713 - RNA, 16 nt, Homo sapiens
aaaggacagcuuugau

SEQ ID NO: 1288714 - RNA, 21 nt, Homo sapiens
aaaggagccaauugauuucaa

SEQ ID NO: 1288715 - RNA, 13 nt, Homo sapiens
aaaggaugaucaa

SEQ ID NO: 1288716 - RNA, 17 nt, Homo sapiens
aaagggagaaaugccag

SEQ ID NO: 1288717 - RNA, 18 nt, Homo sapiens
aaaggucuaucuacuaaa

SEQ ID NO: 1288718 - RNA, 17 nt, Homo sapiens
aaaguaaaaauuuugac

SEQ ID NO: 1288719 - RNA, 14 nt, Homo sapiens
aaaguaaaccacaa

SEQ ID NO: 1288720 - RNA, 22 nt, Homo sapiens
aaaguaccagauuauaaugcca

SEQ ID NO: 1288721 - RNA, 22 nt, Homo sapiens
aaaguccacauuagaucagaua

SEQ ID NO: 1288722 - RNA, 22 nt, Homo sapiens
aaauaaacagauacauucacau

SEQ ID NO: 1288723 - RNA, 14 nt, Homo sapiens
aaauaaagcucaag

SEQ ID NO: 1288724 - RNA, 14 nt, Homo sapiens
aaauaagucacuua

SEQ ID NO: 1288725 - RNA, 17 nt, Homo sapiens
aaauaaucuauauuaaa

SEQ ID NO: 1288726 - RNA, 21 nt, Homo sapiens
aaauaaugcauccagcaguac

SEQ ID NO: 1288727 - RNA, 20 nt, Homo sapiens
aaauagacuaaccucuacca

SEQ ID NO: 1288728 - RNA, 16 nt, Homo sapiens
aaauaguuuggauuac

SEQ ID NO: 1288729 - RNA, 14 nt, Homo sapiens
aaauauuuuaccca

SEQ ID NO: 1288730 - RNA, 15 nt, Homo sapiens
aaaucaucuuuguga

SEQ ID NO: 1288731 - RNA, 17 nt, Homo sapiens
aaaucccuccuucaucc

SEQ ID NO: 1288732 - RNA, 20 nt, Homo sapiens
aaaugcauauccugagccau

SEQ ID NO: 1288733 - RNA, 20 nt, Homo sapiens
aaaugccacacggcucucac

SEQ ID NO: 1288734 - RNA, 12 nt, Homo sapiens
aaaugugcaaua

SEQ ID NO: 1288735 - RNA, 14 nt, Homo sapiens
aaaugugcuucucu

SEQ ID NO: 1288736 - RNA, 13 nt, Homo sapiens
aaauuaacaccca

SEQ ID NO: 1288737 - RNA, 12 nt, Homo sapiens
aaauuccuuuca

SEQ ID NO: 1288738 - RNA, 12 nt, Homo sapiens
aaauuggacuua

SEQ ID NO: 1288739 - RNA, 14 nt, Homo sapiens
aaauuuagccaaua

SEQ ID NO: 1288740 - RNA, 13 nt, Homo sapiens
aaauuuaugugau

SEQ ID NO: 1288741 - RNA, 16 nt, Homo sapiens
aacaaaaaaagcauug

SEQ ID NO: 1288742 - RNA, 19 nt, Homo sapiens
aacaauguuuuaaacauuc

SEQ ID NO: 1288743 - RNA, 19 nt, Homo sapiens
aacacacugagacuugaau

SEQ ID NO: 1288744 - RNA, 21 nt, Homo sapiens
aacacagcauguguauuucca

SEQ ID NO: 1288745 - RNA, 12 nt, Homo sapiens
aacacagccugg

SEQ ID NO: 1288746 - RNA, 17 nt, Homo sapiens
aacacgacugcaagcuc

SEQ ID NO: 1288747 - RNA, 16 nt, Homo sapiens
aacacucagcugcuuc

SEQ ID NO: 1288748 - RNA, 13 nt, Homo sapiens
aacagcacccucu

SEQ ID NO: 1288749 - RNA, 15 nt, Homo sapiens
aacagcacccucucc

SEQ ID NO: 1288750 - RNA, 17 nt, Homo sapiens
aacagcacccucuccag

SEQ ID NO: 1288751 - RNA, 22 nt, Homo sapiens
aacagcacccucuccagaugag

SEQ ID NO: 1288752 - RNA, 15 nt, Homo sapiens
aacagccagaucuca

SEQ ID NO: 1288753 - RNA, 19 nt, Homo sapiens
aacauuaccuuacugugga

SEQ ID NO: 1288754 - RNA, 16 nt, Homo sapiens
aacauuuuguuuaugu

SEQ ID NO: 1288755 - RNA, 15 nt, Homo sapiens
aaccaacccauguau

SEQ ID NO: 1288756 - RNA, 23 nt, Homo sapiens
aaccaccuuuucugcuucaauau

SEQ ID NO: 1288757 - RNA, 14 nt, Homo sapiens
aaccacuaaugcuu

SEQ ID NO: 1288758 - RNA, 16 nt, Homo sapiens
aaccauguugguugca

SEQ ID NO: 1288759 - RNA, 19 nt, Homo sapiens
aaccauguugguugcacuu

SEQ ID NO: 1288760 - RNA, 17 nt, Homo sapiens
aaccauucaugaugaac

SEQ ID NO: 1288761 - RNA, 18 nt, Homo sapiens
aaccccccagcacugagg

SEQ ID NO: 1288762 - RNA, 22 nt, Homo sapiens
aaccccuuuucaguuugaacuc

SEQ ID NO: 1288763 - RNA, 23 nt, Homo sapiens
aaccccuuuucaguuugaacucu

SEQ ID NO: 1288764 - RNA, 17 nt, Homo sapiens
aaccucuaccagcacau

SEQ ID NO: 1288765 - RNA, 16 nt, Homo sapiens
aacggaacaguaucca

SEQ ID NO: 1288766 - RNA, 16 nt, Homo sapiens
aacuaccagugggcau

SEQ ID NO: 1288767 - RNA, 16 nt, Homo sapiens
aacuacugccauuuca

SEQ ID NO: 1288768 - RNA, 16 nt, Homo sapiens
aacuauguaaugcuua

SEQ ID NO: 1288769 - RNA, 21 nt, Homo sapiens
aacucagguuuuggcauuaaa

SEQ ID NO: 1288770 - RNA, 21 nt, Homo sapiens
aacucaucuguaaacuuuuau

SEQ ID NO: 1288771 - RNA, 17 nt, Homo sapiens
aacucuuaagagaacau

SEQ ID NO: 1288772 - RNA, 16 nt, Homo sapiens
aacugacucuguuauu

SEQ ID NO: 1288773 - RNA, 23 nt, Homo sapiens
aacuguaccaugugcuacagggg

SEQ ID NO: 1288774 - RNA, 15 nt, Homo sapiens
aacuguacugggcca

SEQ ID NO: 1288775 - RNA, 21 nt, Homo sapiens
aacuguauuuauugugaugcc

SEQ ID NO: 1288776 - RNA, 20 nt, Homo sapiens
aacugugaugaaauaugaaa

SEQ ID NO: 1288777 - RNA, 14 nt, Homo sapiens
aacuugauuguuga

SEQ ID NO: 1288778 - RNA, 14 nt, Homo sapiens
aacuuuaugaacuc

SEQ ID NO: 1288779 - RNA, 22 nt, Homo sapiens
aacuuucauuuuuuuccaggcu

SEQ ID NO: 1288780 - RNA, 18 nt, Homo sapiens
aagaaacugcucuaauau

SEQ ID NO: 1288781 - RNA, 21 nt, Homo sapiens
aagaaagucuaucuaaugaca

SEQ ID NO: 1288782 - RNA, 20 nt, Homo sapiens
aagaaauaccugagacuggg

SEQ ID NO: 1288783 - RNA, 18 nt, Homo sapiens
aagaaauuuaauguuucu

SEQ ID NO: 1288784 - RNA, 17 nt, Homo sapiens
aagacaccagagcagau

SEQ ID NO: 1288785 - RNA, 18 nt, Homo sapiens
aagacuagaggcuugcau

SEQ ID NO: 1288786 - RNA, 17 nt, Homo sapiens
aagacuuaucaacauuu

SEQ ID NO: 1288787 - RNA, 19 nt, Homo sapiens
aagagauccaucaagacaa

SEQ ID NO: 1288788 - RNA, 13 nt, Homo sapiens
aagagauggugcu

SEQ ID NO: 1288789 - RNA, 14 nt, Homo sapiens
aagaugaucaucuc

SEQ ID NO: 1288790 - RNA, 18 nt, Homo sapiens
aagcagaguucuuugcaa

SEQ ID NO: 1288791 - RNA, 16 nt, Homo sapiens
aagcaucacuugggau

SEQ ID NO: 1288792 - RNA, 15 nt, Homo sapiens
aagcaugaguggccu

SEQ ID NO: 1288793 - RNA, 12 nt, Homo sapiens
aagcaugguccg

SEQ ID NO: 1288794 - RNA, 21 nt, Homo sapiens
aagcauuccuucuuugauaau

SEQ ID NO: 1288795 - RNA, 20 nt, Homo sapiens
aagccacagcuggugguauc

SEQ ID NO: 1288796 - RNA, 16 nt, Homo sapiens
aagccagcuuuccuca

SEQ ID NO: 1288797 - RNA, 20 nt, Homo sapiens
aagccucagugacccaugag

SEQ ID NO: 1288798 - RNA, 22 nt, Homo sapiens
aagcugggacucauucacauuu

SEQ ID NO: 1288799 - RNA, 17 nt, Homo sapiens
aagcuuuaucuuugugu

SEQ ID NO: 1288800 - RNA, 12 nt, Homo sapiens
aaggaaccuaau

SEQ ID NO: 1288801 - RNA, 15 nt, Homo sapiens
aaggaagccacagcu

SEQ ID NO: 1288802 - RNA, 23 nt, Homo sapiens
aaggaccauaaauuuaaauggag

SEQ ID NO: 1288803 - RNA, 13 nt, Homo sapiens
aaggcagcaacaa

SEQ ID NO: 1288804 - RNA, 17 nt, Homo sapiens
aaggccucauccugggg

SEQ ID NO: 1288805 - RNA, 23 nt, Homo sapiens
aaggccucccugucuaaaauccc

SEQ ID NO: 1288806 - RNA, 23 nt, Homo sapiens
aaggcuuacacccacaguggaaa

SEQ ID NO: 1288807 - RNA, 16 nt, Homo sapiens
aaggggugugacuuga

SEQ ID NO: 1288808 - RNA, 18 nt, Homo sapiens
aagguuucugcacauugu

SEQ ID NO: 1288809 - RNA, 20 nt, Homo sapiens
aaguaagcagaguucuuugc

SEQ ID NO: 1288810 - RNA, 15 nt, Homo sapiens
aagucacuggccagu

SEQ ID NO: 1288811 - RNA, 14 nt, Homo sapiens
aagucucuuuauau

SEQ ID NO: 1288812 - RNA, 11 nt, Homo sapiens
aagucuuccau

SEQ ID NO: 1288813 - RNA, 14 nt, Homo sapiens
aagucuuccauaga

SEQ ID NO: 1288814 - RNA, 15 nt, Homo sapiens
aagugacuucacaga

SEQ ID NO: 1288815 - RNA, 14 nt, Homo sapiens
aaguguaagcagaa

SEQ ID NO: 1288816 - RNA, 18 nt, Homo sapiens
aaguuuaugcauacagua

SEQ ID NO: 1288817 - RNA, 19 nt, Homo sapiens
aaguuuaugcauacaguaa

SEQ ID NO: 1288818 - RNA, 13 nt, Homo sapiens
aauaaaaacugac

SEQ ID NO: 1288819 - RNA, 13 nt, Homo sapiens
aauaaaauaauuc

SEQ ID NO: 1288820 - RNA, 20 nt, Homo sapiens
aauaaaugcauagagcaauu

SEQ ID NO: 1288821 - RNA, 15 nt, Homo sapiens
aauaauagcuaauaa

SEQ ID NO: 1288822 - RNA, 19 nt, Homo sapiens
aauaauauaaaauguuuca

SEQ ID NO: 1288823 - RNA, 16 nt, Homo sapiens
aauaauguguacauua

SEQ ID NO: 1288824 - RNA, 17 nt, Homo sapiens
aauacaauuaaagcaaa

SEQ ID NO: 1288825 - RNA, 23 nt, Homo sapiens
aauacacaucucugucaguguga

SEQ ID NO: 1288826 - RNA, 21 nt, Homo sapiens
aauagacuaaccucuaccagc

SEQ ID NO: 1288827 - RNA, 19 nt, Homo sapiens
aauagcagguaguccagga

SEQ ID NO: 1288828 - RNA, 14 nt, Homo sapiens
aauagcaugcaaaa

SEQ ID NO: 1288829 - RNA, 24 nt, Homo sapiens
aauaggagaggaugagagcccaga

SEQ ID NO: 1288830 - RNA, 22 nt, Homo sapiens
aauaguguuggaaaaugugcaa

SEQ ID NO: 1288831 - RNA, 20 nt, Homo sapiens
aauauacuuuuuuuguuaua

SEQ ID NO: 1288832 - RNA, 15 nt, Homo sapiens
aauauauagcuggca

SEQ ID NO: 1288833 - RNA, 15 nt, Homo sapiens
aauauauguauacau

SEQ ID NO: 1288834 - RNA, 12 nt, Homo sapiens
aauauauuugau

SEQ ID NO: 1288835 - RNA, 21 nt, Homo sapiens
aauaugaaacucaucuguaaa

SEQ ID NO: 1288836 - RNA, 13 nt, Homo sapiens
aauaugcagugau

SEQ ID NO: 1288837 - RNA, 19 nt, Homo sapiens
aauauggaaugggcucagu

SEQ ID NO: 1288838 - RNA, 17 nt, Homo sapiens
aauauuagcuugcuuaa

SEQ ID NO: 1288839 - RNA, 17 nt, Homo sapiens
aauauucuucuuugaua

SEQ ID NO: 1288840 - RNA, 15 nt, Homo sapiens
aauauuuuccaugaa

SEQ ID NO: 1288841 - RNA, 18 nt, Homo sapiens
aauauuuugaauacacau

SEQ ID NO: 1288842 - RNA, 14 nt, Homo sapiens
aaucaaccuaucaa

SEQ ID NO: 1288843 - RNA, 20 nt, Homo sapiens
aaucacacagccaagccagu

SEQ ID NO: 1288844 - RNA, 22 nt, Homo sapiens
aaucacucagugauugcaauuu

SEQ ID NO: 1288845 - RNA, 14 nt, Homo sapiens
aaucauaacauuga

SEQ ID NO: 1288846 - RNA, 23 nt, Homo sapiens
aaucauugauugucagcuacuaa

SEQ ID NO: 1288847 - RNA, 20 nt, Homo sapiens
aaucuccacccaaugaauga

SEQ ID NO: 1288848 - RNA, 16 nt, Homo sapiens
aaucucggcucacugc

SEQ ID NO: 1288849 - RNA, 23 nt, Homo sapiens
aaucugagaggccacagugcaau

SEQ ID NO: 1288850 - RNA, 16 nt, Homo sapiens
aaugaagggucauuuc

SEQ ID NO: 1288851 - RNA, 17 nt, Homo sapiens
aaugacccccaucccau

SEQ ID NO: 1288852 - RNA, 14 nt, Homo sapiens
aaugagaaagccug

SEQ ID NO: 1288853 - RNA, 16 nt, Homo sapiens
aaugcagagucaauga

SEQ ID NO: 1288854 - RNA, 23 nt, Homo sapiens
aaugcccagugaccagucacuga

SEQ ID NO: 1288855 - RNA, 23 nt, Homo sapiens
aaugcguggcacaucuaaauuga

SEQ ID NO: 1288856 - RNA, 19 nt, Homo sapiens
aaugcugugcaaacagugu

SEQ ID NO: 1288857 - RNA, 14 nt, Homo sapiens
aaugguuugaauau

SEQ ID NO: 1288858 - RNA, 19 nt, Homo sapiens
aaugguuuucuaauaucuu

SEQ ID NO: 1288859 - RNA, 20 nt, Homo sapiens
aaugguuuucuaauaucuua

SEQ ID NO: 1288860 - RNA, 18 nt, Homo sapiens
aauguacuacugagcuuc

SEQ ID NO: 1288861 - RNA, 13 nt, Homo sapiens
aaugucucuguga

SEQ ID NO: 1288862 - RNA, 14 nt, Homo sapiens
aaugucuguaucac

SEQ ID NO: 1288863 - RNA, 21 nt, Homo sapiens
aaugucuguaucacucugugu

SEQ ID NO: 1288864 - RNA, 13 nt, Homo sapiens
aauuacauacuau

SEQ ID NO: 1288865 - RNA, 19 nt, Homo sapiens
aauuccauuuacuugauca

SEQ ID NO: 1288866 - RNA, 19 nt, Homo sapiens
aauucuuacaaacaugugg

SEQ ID NO: 1288867 - RNA, 22 nt, Homo sapiens
aauuggucauuccuaaugcauu

SEQ ID NO: 1288868 - RNA, 16 nt, Homo sapiens
aauugguuguauauaa

SEQ ID NO: 1288869 - RNA, 13 nt, Homo sapiens
aauuuagccaaua

SEQ ID NO: 1288870 - RNA, 18 nt, Homo sapiens
aauuuuuuucaguauuau

SEQ ID NO: 1288871 - RNA, 22 nt, Homo sapiens
acaaaaggcuuuggcaacagaa

SEQ ID NO: 1288872 - RNA, 17 nt, Homo sapiens
acaaacaccuuauuugu

SEQ ID NO: 1288873 - RNA, 22 nt, Homo sapiens
acaaaugccacacggcucucac

SEQ ID NO: 1288874 - RNA, 13 nt, Homo sapiens
acaagacaagcuc

SEQ ID NO: 1288875 - RNA, 11 nt, Homo sapiens
acaaguccagc

SEQ ID NO: 1288876 - RNA, 12 nt, Homo sapiens
acaaucauguaa

SEQ ID NO: 1288877 - RNA, 20 nt, Homo sapiens
acaauguuuuaaacauucuu

SEQ ID NO: 1288878 - RNA, 15 nt, Homo sapiens
acaauuaaagcaaaa

SEQ ID NO: 1288879 - RNA, 12 nt, Homo sapiens
acacaacaugua

SEQ ID NO: 1288880 - RNA, 14 nt, Homo sapiens
acacaacauguaug

SEQ ID NO: 1288881 - RNA, 15 nt, Homo sapiens
acacaacauguaugu

SEQ ID NO: 1288882 - RNA, 23 nt, Homo sapiens
acacacgggaagucugguagcuc

SEQ ID NO: 1288883 - RNA, 18 nt, Homo sapiens
acacacugagacuugaau

SEQ ID NO: 1288884 - RNA, 16 nt, Homo sapiens
acacaucucccaccau

SEQ ID NO: 1288885 - RNA, 12 nt, Homo sapiens
acacaugcucua

SEQ ID NO: 1288886 - RNA, 16 nt, Homo sapiens
acaccagguagaacac

SEQ ID NO: 1288887 - RNA, 21 nt, Homo sapiens
acaccugcggcccaauccaag

SEQ ID NO: 1288888 - RNA, 19 nt, Homo sapiens
acacucaucuuagugccug

SEQ ID NO: 1288889 - RNA, 16 nt, Homo sapiens
acacugaaacagccag

SEQ ID NO: 1288890 - RNA, 21 nt, Homo sapiens
acacugaaacagccagaucuc

SEQ ID NO: 1288891 - RNA, 17 nt, Homo sapiens
acacugagacuugaauc

SEQ ID NO: 1288892 - RNA, 22 nt, Homo sapiens
acacugagacuugaaucaaguc

SEQ ID NO: 1288893 - RNA, 23 nt, Homo sapiens
acacugagacuugaaucaaguca

SEQ ID NO: 1288894 - RNA, 22 nt, Homo sapiens
acacuuguuucuuguucaucca

SEQ ID NO: 1288895 - RNA, 17 nt, Homo sapiens
acagaaaacaauuguuc

SEQ ID NO: 1288896 - RNA, 22 nt, Homo sapiens
acagaacuaagaugaucaucuc

SEQ ID NO: 1288897 - RNA, 16 nt, Homo sapiens
acagaagccaagcucc

SEQ ID NO: 1288898 - RNA, 20 nt, Homo sapiens
acagacacucccacuuggca

SEQ ID NO: 1288899 - RNA, 15 nt, Homo sapiens
acagacccaaaccau

SEQ ID NO: 1288900 - RNA, 14 nt, Homo sapiens
acagacucacaucc

SEQ ID NO: 1288901 - RNA, 16 nt, Homo sapiens
acagcacccucuccag

SEQ ID NO: 1288902 - RNA, 18 nt, Homo sapiens
acagccccucuggacaca

SEQ ID NO: 1288903 - RNA, 19 nt, Homo sapiens
acagcgcuggccgggaccc

SEQ ID NO: 1288904 - RNA, 17 nt, Homo sapiens
acaggaaggaaagcgca

SEQ ID NO: 1288905 - RNA, 21 nt, Homo sapiens
acagguuuucuucuaaucaua

SEQ ID NO: 1288906 - RNA, 19 nt, Homo sapiens
acaguggcaggacaggaaa

SEQ ID NO: 1288907 - RNA, 22 nt, Homo sapiens
acaguuguccagaucacugaau

SEQ ID NO: 1288908 - RNA, 23 nt, Homo sapiens
acaguuuuuaacucuacugugua

SEQ ID NO: 1288909 - RNA, 19 nt, Homo sapiens
acauaaaaccugagcagca

SEQ ID NO: 1288910 - RNA, 20 nt, Homo sapiens
acauagaacucagagccaga

SEQ ID NO: 1288911 - RNA, 22 nt, Homo sapiens
acauauuaggaaaauauggguu

SEQ ID NO: 1288912 - RNA, 14 nt, Homo sapiens
acaucaaggcucuu

SEQ ID NO: 1288913 - RNA, 15 nt, Homo sapiens
acaugaaaacauuga

SEQ ID NO: 1288914 - RNA, 16 nt, Homo sapiens
acaugaaaacauugau

SEQ ID NO: 1288915 - RNA, 16 nt, Homo sapiens
acaugcuugcauuaua

SEQ ID NO: 1288916 - RNA, 22 nt, Homo sapiens
acauguauguggauacagucau

SEQ ID NO: 1288917 - RNA, 19 nt, Homo sapiens
acauuaaacaaugaucaca

SEQ ID NO: 1288918 - RNA, 17 nt, Homo sapiens
acauucagagcuuacuu

SEQ ID NO: 1288919 - RNA, 20 nt, Homo sapiens
acauuucuugguuccaauaa

SEQ ID NO: 1288920 - RNA, 21 nt, Homo sapiens
acauuuguggucugacuccuu

SEQ ID NO: 1288921 - RNA, 17 nt, Homo sapiens
agagucaucuaccugag

SEQ ID NO: 1288922 - RNA, 18 nt, Homo sapiens
agauaagggugucuuccu

SEQ ID NO: 1288923 - RNA, 17 nt, Homo sapiens
agauagguuaccaguaa

SEQ ID NO: 1288924 - RNA, 22 nt, Homo sapiens
agaucucaugagaagucacuca

SEQ ID NO: 1288925 - RNA, 14 nt, Homo sapiens
agaugaucaucucc

SEQ ID NO: 1288926 - RNA, 16 nt, Homo sapiens
agaugcagccccaucu

SEQ ID NO: 1288927 - RNA, 21 nt, Homo sapiens
agauggagucuggcucugucu

SEQ ID NO: 1288928 - RNA, 19 nt, Homo sapiens
agauguuuuggggacucau

SEQ ID NO: 1288929 - RNA, 22 nt, Homo sapiens
agauuuugaaugcuuccugaca

SEQ ID NO: 1288930 - RNA, 17 nt, Homo sapiens
agcacagcacccauggg

SEQ ID NO: 1288931 - RNA, 18 nt, Homo sapiens
agcacaggcacugcagga

SEQ ID NO: 1288932 - RNA, 20 nt, Homo sapiens
agcagggaagccccagugag

SEQ ID NO: 1288933 - RNA, 14 nt, Homo sapiens
agcagggaugaagg

SEQ ID NO: 1288934 - RNA, 20 nt, Homo sapiens
agcauaggaaaccacacaga

SEQ ID NO: 1288935 - RNA, 16 nt, Homo sapiens
agcauauuaccagcua

SEQ ID NO: 1288936 - RNA, 17 nt, Homo sapiens
agcaucaaagagauggu

SEQ ID NO: 1288937 - RNA, 17 nt, Homo sapiens
agcaucucccaguucau

SEQ ID NO: 1288938 - RNA, 22 nt, Homo sapiens
agcaucuucacuucuaaaugca

SEQ ID NO: 1288939 - RNA, 21 nt, Homo sapiens
ccaugagggcagggacaucau

SEQ ID NO: 1288940 - RNA, 17 nt, Homo sapiens
ccaugauccaaucaccu

SEQ ID NO: 1288941 - RNA, 20 nt, Homo sapiens
ccaugcugcccgcuucucac

SEQ ID NO: 1288942 - RNA, 21 nt, Homo sapiens
ccauggacagaagaaggcagc

SEQ ID NO: 1288943 - RNA, 23 nt, Homo sapiens
ccaugggaaggguccaucucaga

SEQ ID NO: 1288944 - RNA, 22 nt, Homo sapiens
ccaugggauuuuaucuguggau

SEQ ID NO: 1288945 - RNA, 15 nt, Homo sapiens
ccaugugugcuaaua

SEQ ID NO: 1288946 - RNA, 19 nt, Homo sapiens
ccauguuucauuaaucaag

SEQ ID NO: 1288947 - RNA, 13 nt, Homo sapiens
ccauucagcauga

SEQ ID NO: 1288948 - RNA, 18 nt, Homo sapiens
ccauucaugaugaacuca

SEQ ID NO: 1288949 - RNA, 21 nt, Homo sapiens
ccauugccaucagugaucuca

SEQ ID NO: 1288950 - RNA, 21 nt, Homo sapiens
ccauuuagcgaacaaccacag

SEQ ID NO: 1288951 - RNA, 14 nt, Homo sapiens
ccauuuugugaaug

SEQ ID NO: 1288952 - RNA, 21 nt, Homo sapiens
cccaagauuuuuucauuucaa

SEQ ID NO: 1288953 - RNA, 14 nt, Homo sapiens
cccaauccaugcuu

SEQ ID NO: 1288954 - RNA, 21 nt, Homo sapiens
cccacagcuucucuacagacu

SEQ ID NO: 1288955 - RNA, 13 nt, Homo sapiens
cccacagguauga

SEQ ID NO: 1288956 - RNA, 19 nt, Homo sapiens
cccacauaaauacaguauu

SEQ ID NO: 1288957 - RNA, 14 nt, Homo sapiens
cccacauugcacuu

SEQ ID NO: 1288958 - RNA, 14 nt, Homo sapiens
cccacuuggcauca

SEQ ID NO: 1288959 - RNA, 19 nt, Homo sapiens
cccacuuggcaucauucac

SEQ ID NO: 1288960 - RNA, 18 nt, Homo sapiens
cccagaagaagauggcug

SEQ ID NO: 1288961 - RNA, 18 nt, Homo sapiens
cccagaaugccuccugca

SEQ ID NO: 1288962 - RNA, 18 nt, Homo sapiens
cccagagguaacagaaca

SEQ ID NO: 1288963 - RNA, 14 nt, Homo sapiens
cccagcaacccagg

SEQ ID NO: 1288964 - RNA, 13 nt, Homo sapiens
cccagcacugagg

SEQ ID NO: 1288965 - RNA, 14 nt, Homo sapiens
cccagcacugagga

SEQ ID NO: 1288966 - RNA, 19 nt, Homo sapiens
cccaggccaggacucugca

SEQ ID NO: 1288967 - RNA, 16 nt, Homo sapiens
cccauggggguaauaa

SEQ ID NO: 1288968 - RNA, 11 nt, Homo sapiens
ccccaacagca

SEQ ID NO: 1288969 - RNA, 13 nt, Homo sapiens
ccccaugaacucu

SEQ ID NO: 1288970 - RNA, 13 nt, Homo sapiens
ccccauuggcacc

SEQ ID NO: 1288971 - RNA, 23 nt, Homo sapiens
ccccauuguguuaagaacccagc

SEQ ID NO: 1288972 - RNA, 15 nt, Homo sapiens
cccccagcacugagg

SEQ ID NO: 1288973 - RNA, 22 nt, Homo sapiens
ccccgggaaugcgcccaccaag

SEQ ID NO: 1288974 - RNA, 12 nt, Homo sapiens
ccccugcacuga

SEQ ID NO: 1288975 - RNA, 16 nt, Homo sapiens
ccccuucucucaucuc

SEQ ID NO: 1288976 - RNA, 22 nt, Homo sapiens
ccccuuuuggggaucaccucuc

SEQ ID NO: 1288977 - RNA, 20 nt, Homo sapiens
cccgcaggcuucugugugcu

SEQ ID NO: 1288978 - RNA, 17 nt, Homo sapiens
cccuagucuuuuaaaca

SEQ ID NO: 1288979 - RNA, 21 nt, Homo sapiens
cccuccccugggcccaucuca

SEQ ID NO: 1288980 - RNA, 18 nt, Homo sapiens
cccucuccccacugcuca

SEQ ID NO: 1288981 - RNA, 14 nt, Homo sapiens
cccugggaccacag

SEQ ID NO: 1288982 - RNA, 19 nt, Homo sapiens
cccuucuaaccugaacuga

SEQ ID NO: 1288983 - RNA, 17 nt, Homo sapiens
cccuuuauguacaggau

SEQ ID NO: 1288984 - RNA, 19 nt, Homo sapiens
cccuuuuggggaucaccuc

SEQ ID NO: 1288985 - RNA, 17 nt, Homo sapiens
ccgagccuggcuccaaa

SEQ ID NO: 1288986 - RNA, 16 nt, Homo sapiens
ccggcauggacaaugg

SEQ ID NO: 1288987 - RNA, 19 nt, Homo sapiens
ccggccuccugucccucau

SEQ ID NO: 1288988 - RNA, 16 nt, Homo sapiens
ccuaaacuguaucaua

SEQ ID NO: 1288989 - RNA, 19 nt, Homo sapiens
ccuaaugaaagugaugaca

SEQ ID NO: 1288990 - RNA, 21 nt, Homo sapiens
ccuacaaggcuggcagugaca

SEQ ID NO: 1288991 - RNA, 23 nt, Homo sapiens
ccuacaaggcuggcagugacaga

SEQ ID NO: 1288992 - RNA, 19 nt, Homo sapiens
ccuacugcuuccucugaau

SEQ ID NO: 1288993 - RNA, 19 nt, Homo sapiens
ccuaguacaauauagugau

SEQ ID NO: 1288994 - RNA, 20 nt, Homo sapiens
ccuagucuuuuaaacaguuu

SEQ ID NO: 1288995 - RNA, 13 nt, Homo sapiens
ccuauaugcacuu

SEQ ID NO: 1288996 - RNA, 18 nt, Homo sapiens
ccuaugugggugggacca

SEQ ID NO: 1288997 - RNA, 22 nt, Homo sapiens
ccuaugugggugggaccacaga

SEQ ID NO: 1288998 - RNA, 13 nt, Homo sapiens
ccucaugucauuu

SEQ ID NO: 1288999 - RNA, 13 nt, Homo sapiens
ccucccucaggcc

SEQ ID NO: 1289000 - RNA, 15 nt, Homo sapiens
ccuccugucccucau

SEQ ID NO: 1289001 - RNA, 15 nt, Homo sapiens
ccucgaauacugggg

SEQ ID NO: 1289002 - RNA, 23 nt, Homo sapiens
ccucuccaaggguggugaccaau

SEQ ID NO: 1289003 - RNA, 21 nt, Homo sapiens
ccucuccagaugagaguacac

SEQ ID NO: 1289004 - RNA, 19 nt, Homo sapiens
ccucuguccccuucucuca

SEQ ID NO: 1289005 - RNA, 14 nt, Homo sapiens
ccugaaagccacag

SEQ ID NO: 1289006 - RNA, 18 nt, Homo sapiens
ccugaaagccacagacaa

SEQ ID NO: 1289007 - RNA, 14 nt, Homo sapiens
ccugaacucugcaa

SEQ ID NO: 1289008 - RNA, 17 nt, Homo sapiens
ccugaacuuucucuagc

SEQ ID NO: 1289009 - RNA, 15 nt, Homo sapiens
ccugagagggaaccc

SEQ ID NO: 1289010 - RNA, 16 nt, Homo sapiens
ccugcauuggaacugg

SEQ ID NO: 1289011 - RNA, 23 nt, Homo sapiens
ccugcccccugcaggaaggagcu

SEQ ID NO: 1289012 - RNA, 13 nt, Homo sapiens
ccugcgagggcag

SEQ ID NO: 1289013 - RNA, 22 nt, Homo sapiens
ccuggacaguuuucugcuuuaa

SEQ ID NO: 1289014 - RNA, 19 nt, Homo sapiens
ccuggaccccugcauugga

SEQ ID NO: 1289015 - RNA, 21 nt, Homo sapiens
ccuggcagcuagccagugcuc

SEQ ID NO: 1289016 - RNA, 12 nt, Homo sapiens
ccugguucucau

SEQ ID NO: 1289017 - RNA, 20 nt, Homo sapiens
ccuguaauuaaacuaguuua

SEQ ID NO: 1289018 - RNA, 16 nt, Homo sapiens
ccuguguucugcacau

SEQ ID NO: 1289019 - RNA, 23 nt, Homo sapiens
ccuuaaacucagggagcauuuau

SEQ ID NO: 1289020 - RNA, 18 nt, Homo sapiens
ccuuaccuaaaucuguuu

SEQ ID NO: 1289021 - RNA, 19 nt, Homo sapiens
ccuuauuuauauucaucaa

SEQ ID NO: 1289022 - RNA, 18 nt, Homo sapiens
ccuuccucaccacuuccc

SEQ ID NO: 1289023 - RNA, 12 nt, Homo sapiens
ccuucuaccucu

SEQ ID NO: 1289024 - RNA, 20 nt, Homo sapiens
ccuucuuugauaauguuaaa

SEQ ID NO: 1289025 - RNA, 17 nt, Homo sapiens
ccuugaugagcugugca

SEQ ID NO: 1289026 - RNA, 15 nt, Homo sapiens
ccuuggugugcugua

SEQ ID NO: 1289027 - RNA, 14 nt, Homo sapiens
ccuuguccccauga

SEQ ID NO: 1289028 - RNA, 21 nt, Homo sapiens
aaaaaaauuuuauagugucuu

SEQ ID NO: 1289029 - RNA, 11 nt, Homo sapiens
aaaaacauguu

SEQ ID NO: 1289030 - RNA, 16 nt, Homo sapiens
aaaacaauguuuuaaa

SEQ ID NO: 1289031 - RNA, 21 nt, Homo sapiens
aaaaccuugaaaccuuugaca

SEQ ID NO: 1289032 - RNA, 23 nt, Homo sapiens
aaaagaagaaauaaauaaucuac

SEQ ID NO: 1289033 - RNA, 11 nt, Homo sapiens
aaaagacauaa

SEQ ID NO: 1289034 - RNA, 14 nt, Homo sapiens
aaaagcaagaucua

SEQ ID NO: 1289035 - RNA, 18 nt, Homo sapiens
aaaagccuuucagauuca

SEQ ID NO: 1289036 - RNA, 22 nt, Homo sapiens
aaaagcuauuagccaggaucau

SEQ ID NO: 1289037 - RNA, 14 nt, Homo sapiens
aaaagcuucaggga

SEQ ID NO: 1289038 - RNA, 15 nt, Homo sapiens
aaaaguaaaccacaa

SEQ ID NO: 1289039 - RNA, 21 nt, Homo sapiens
aaaauacaauuaaagcaaaau

SEQ ID NO: 1289040 - RNA, 22 nt, Homo sapiens
aaaauaguuuggauuacuuaaa

SEQ ID NO: 1289041 - RNA, 17 nt, Homo sapiens
aaaauauuuuacccaaa

SEQ ID NO: 1289042 - RNA, 17 nt, Homo sapiens
aaaaugaauuugacugg

SEQ ID NO: 1289043 - RNA, 18 nt, Homo sapiens
aaaaugcaacaacaugua

SEQ ID NO: 1289044 - RNA, 11 nt, Homo sapiens
aaaaugcaaua

SEQ ID NO: 1289045 - RNA, 15 nt, Homo sapiens
aaaaugcuucacugu

SEQ ID NO: 1289046 - RNA, 13 nt, Homo sapiens
aaaaugcuuuguu

SEQ ID NO: 1289047 - RNA, 15 nt, Homo sapiens
aaaaugugucugcaa

SEQ ID NO: 1289048 - RNA, 13 nt, Homo sapiens
agcgcaacauuuc

SEQ ID NO: 1289049 - RNA, 13 nt, Homo sapiens
agcuaaucugccu

SEQ ID NO: 1289050 - RNA, 21 nt, Homo sapiens
agcuacaguuguccagaucac

SEQ ID NO: 1289051 - RNA, 14 nt, Homo sapiens
agcucaggcagcuc

SEQ ID NO: 1289052 - RNA, 16 nt, Homo sapiens
agcuccaaaccuucac

SEQ ID NO: 1289053 - RNA, 16 nt, Homo sapiens
agcucccuguccugaa

SEQ ID NO: 1289054 - RNA, 13 nt, Homo sapiens
agcuccugccucu

SEQ ID NO: 1289055 - RNA, 18 nt, Homo sapiens
agcucuacacaacaugua

SEQ ID NO: 1289056 - RNA, 13 nt, Homo sapiens
agcucuacucugg

SEQ ID NO: 1289057 - RNA, 15 nt, Homo sapiens
agcucucaguugcag

SEQ ID NO: 1289058 - RNA, 18 nt, Homo sapiens
agcugcgccugcgcugca

SEQ ID NO: 1289059 - RNA, 22 nt, Homo sapiens
agcuguuguacauuuaugauuu

SEQ ID NO: 1289060 - RNA, 17 nt, Homo sapiens
agcuuucucuaguucaa

SEQ ID NO: 1289061 - RNA, 22 nt, Homo sapiens
agcuuucuuauucagugaaaaa

SEQ ID NO: 1289062 - RNA, 17 nt, Homo sapiens
aggaaaaucugcacugu

SEQ ID NO: 1289063 - RNA, 14 nt, Homo sapiens
aggaaggagcugcc

SEQ ID NO: 1289064 - RNA, 22 nt, Homo sapiens
aggacaccuuuuaacucaccuc

SEQ ID NO: 1289065 - RNA, 18 nt, Homo sapiens
caugagucagucugauga

SEQ ID NO: 1289066 - RNA, 17 nt, Homo sapiens
caugcaggucuccauga

SEQ ID NO: 1289067 - RNA, 19 nt, Homo sapiens
caugcauaaauaugcagug

SEQ ID NO: 1289068 - RNA, 11 nt, Homo sapiens
caugcauuuga

SEQ ID NO: 1289069 - RNA, 23 nt, Homo sapiens
caugcgaacauaaaugucuguau

SEQ ID NO: 1289070 - RNA, 18 nt, Homo sapiens
caugcuccgccuguaaaa

SEQ ID NO: 1289071 - RNA, 22 nt, Homo sapiens
caugcuugcauuauauuuguaa

SEQ ID NO: 1289072 - RNA, 16 nt, Homo sapiens
cauggggcugauugua

SEQ ID NO: 1289073 - RNA, 18 nt, Homo sapiens
cauguauguauauaauca

SEQ ID NO: 1289074 - RNA, 13 nt, Homo sapiens
cauguuguaagca

SEQ ID NO: 1289075 - RNA, 18 nt, Homo sapiens
cauuaauaccuaaacugu

SEQ ID NO: 1289076 - RNA, 21 nt, Homo sapiens
cauuacauguuguaagcaugg

SEQ ID NO: 1289077 - RNA, 19 nt, Homo sapiens
cauuaccuucuguuccuua

SEQ ID NO: 1289078 - RNA, 20 nt, Homo sapiens
cauuaucagccugugccacg

SEQ ID NO: 1289079 - RNA, 19 nt, Homo sapiens
cauuauuaaauguuucuca

SEQ ID NO: 1289080 - RNA, 18 nt, Homo sapiens
cauuauuucaucaugacu

SEQ ID NO: 1289081 - RNA, 18 nt, Homo sapiens
cauuauuucucucugacc

SEQ ID NO: 1289082 - RNA, 16 nt, Homo sapiens
cauucucaguauccac

SEQ ID NO: 1289083 - RNA, 22 nt, Homo sapiens
cauugaacuguaccaugugcua

SEQ ID NO: 1289084 - RNA, 22 nt, Homo sapiens
cauugcaagcuucuuuuaguug

SEQ ID NO: 1289085 - RNA, 21 nt, Homo sapiens
cauuggaccuuuccugaggaa

SEQ ID NO: 1289086 - RNA, 20 nt, Homo sapiens
cauugggaaaggacagcuuu

SEQ ID NO: 1289087 - RNA, 19 nt, Homo sapiens
cauugguguugacauacau

SEQ ID NO: 1289088 - RNA, 14 nt, Homo sapiens
cauuuacuugauca

SEQ ID NO: 1289089 - RNA, 16 nt, Homo sapiens
cauuuacuugaucauu

SEQ ID NO: 1289090 - RNA, 16 nt, Homo sapiens
cauuucaaaaugcuuc

SEQ ID NO: 1289091 - RNA, 22 nt, Homo sapiens
cauuugauuaaauuaugaauga

SEQ ID NO: 1289092 - RNA, 13 nt, Homo sapiens
cauuugcacuauu

SEQ ID NO: 1289093 - RNA, 23 nt, Homo sapiens
cauuugcuuacuuugcauuugug

SEQ ID NO: 1289094 - RNA, 21 nt, Homo sapiens
cauuuguggucugacuccuug

SEQ ID NO: 1289095 - RNA, 12 nt, Homo sapiens
cauuuucacuuu

SEQ ID NO: 1289096 - RNA, 14 nt, Homo sapiens
cauuuugaauguga

SEQ ID NO: 1289097 - RNA, 20 nt, Homo sapiens
ccaaaagaauuaaauugauu

SEQ ID NO: 1289098 - RNA, 16 nt, Homo sapiens
ccaaaauguacuuaaa

SEQ ID NO: 1289099 - RNA, 14 nt, Homo sapiens
ccaaacaguaugau

SEQ ID NO: 1289100 - RNA, 13 nt, Homo sapiens
ccaaauacucaau

SEQ ID NO: 1289101 - RNA, 12 nt, Homo sapiens
ccaacagcaccc

SEQ ID NO: 1289102 - RNA, 14 nt, Homo sapiens
ccaacagcacccuc

SEQ ID NO: 1289103 - RNA, 21 nt, Homo sapiens
ccaacagcacccucuccagau

SEQ ID NO: 1289104 - RNA, 18 nt, Homo sapiens
ccaacucucgacuuuucc

SEQ ID NO: 1289105 - RNA, 22 nt, Homo sapiens
ccacaauuacauacuauucuua

SEQ ID NO: 1289106 - RNA, 16 nt, Homo sapiens
ccacacccucacugcu

SEQ ID NO: 1289107 - RNA, 23 nt, Homo sapiens
ccacaccugcggcccaauccaag

SEQ ID NO: 1289108 - RNA, 19 nt, Homo sapiens
ccacagcgcuggccgggac

SEQ ID NO: 1289109 - RNA, 13 nt, Homo sapiens
ccacaggacccag

SEQ ID NO: 1289110 - RNA, 15 nt, Homo sapiens
ccacauugcacuucu

SEQ ID NO: 1289111 - RNA, 21 nt, Homo sapiens
ccacgcggccccacauugcac

SEQ ID NO: 1289112 - RNA, 19 nt, Homo sapiens
ccacucaggggucauucau

SEQ ID NO: 1289113 - RNA, 17 nt, Homo sapiens
ccacuuggcaucauuca

SEQ ID NO: 1289114 - RNA, 18 nt, Homo sapiens
ccacuuugcuguuccuua

SEQ ID NO: 1289115 - RNA, 19 nt, Homo sapiens
ccagaagcaguaauaauca

SEQ ID NO: 1289116 - RNA, 20 nt, Homo sapiens
ccagaccauucaggacacag

SEQ ID NO: 1289117 - RNA, 15 nt, Homo sapiens
ccagauguagucuca

SEQ ID NO: 1289118 - RNA, 22 nt, Homo sapiens
ccagauuggcucacacugagaa

SEQ ID NO: 1289119 - RNA, 15 nt, Homo sapiens
ccagcaguacaauaa

SEQ ID NO: 1289120 - RNA, 19 nt, Homo sapiens
ccagcaucucccaguucau

SEQ ID NO: 1289121 - RNA, 13 nt, Homo sapiens
ccagcuaaucucc

SEQ ID NO: 1289122 - RNA, 18 nt, Homo sapiens
ccaggagccuaguacaau

SEQ ID NO: 1289123 - RNA, 15 nt, Homo sapiens
ccaggaucauggugu

SEQ ID NO: 1289124 - RNA, 20 nt, Homo sapiens
ccaggaucaugguguaauaa

SEQ ID NO: 1289125 - RNA, 14 nt, Homo sapiens
ccaggccaggacuc

SEQ ID NO: 1289126 - RNA, 15 nt, Homo sapiens
ccagggagagcccag

SEQ ID NO: 1289127 - RNA, 21 nt, Homo sapiens
ccagggagagcccaggagcuc

SEQ ID NO: 1289128 - RNA, 21 nt, Homo sapiens
ccagggagcugcaggggcaug

SEQ ID NO: 1289129 - RNA, 19 nt, Homo sapiens
ccagggcauuguguucacu

SEQ ID NO: 1289130 - RNA, 13 nt, Homo sapiens
ccaguauaaucuc

SEQ ID NO: 1289131 - RNA, 21 nt, Homo sapiens
ccauaaaaugugcuucucuuc

SEQ ID NO: 1289132 - RNA, 13 nt, Homo sapiens
ccauaaucacuca

SEQ ID NO: 1289133 - RNA, 21 nt, Homo sapiens
ccauauacucuucaaggacuu

SEQ ID NO: 1289134 - RNA, 13 nt, Homo sapiens
ccaucucuuuacc

SEQ ID NO: 1289135 - RNA, 13 nt, Homo sapiens
ccaugaagcugga

SEQ ID NO: 1289136 - RNA, 20 nt, Homo sapiens
ccaugcaggggccacaucca

SEQ ID NO: 1289137 - RNA, 20 nt, Homo sapiens
ccaugcuucacucaugcaaa

SEQ ID NO: 1289138 - RNA, 21 nt, Homo sapiens
ccauggggcugauuguauuua

SEQ ID NO: 1289139 - RNA, 14 nt, Homo sapiens
ccauugaacuguac

SEQ ID NO: 1289140 - RNA, 15 nt, Homo sapiens
ccauugguguugaca

SEQ ID NO: 1289141 - RNA, 20 nt, Homo sapiens
ccauuuuaaaaugcaucauu

SEQ ID NO: 1289142 - RNA, 21 nt, Homo sapiens
cccaaaggucuaucuacuaaa

SEQ ID NO: 1289143 - RNA, 23 nt, Homo sapiens
cccaaauacucaauuuacuaauu

SEQ ID NO: 1289144 - RNA, 10 nt, Homo sapiens
cccaacagca

SEQ ID NO: 1289145 - RNA, 22 nt, Homo sapiens
cccaacagcacccucuccagau

SEQ ID NO: 1289146 - RNA, 13 nt, Homo sapiens
cccacaguggaaa

SEQ ID NO: 1289147 - RNA, 23 nt, Homo sapiens
cccaccuccgcugggaggaaccu

SEQ ID NO: 1289148 - RNA, 15 nt, Homo sapiens
cccacuucugcacuu

SEQ ID NO: 1289149 - RNA, 21 nt, Homo sapiens
cccaugggcucccacugcagc

SEQ ID NO: 1289150 - RNA, 20 nt, Homo sapiens
cccauucuaugugucaucaa

SEQ ID NO: 1289151 - RNA, 14 nt, Homo sapiens
cuagggaugguaau

SEQ ID NO: 1289152 - RNA, 14 nt, Homo sapiens
cuauaaagaucaua

SEQ ID NO: 1289153 - RNA, 19 nt, Homo sapiens
cuauauaaaaaacauaaua

SEQ ID NO: 1289154 - RNA, 20 nt, Homo sapiens
cuaucaaagcuucaaaaacu

SEQ ID NO: 1289155 - RNA, 21 nt, Homo sapiens
cuaugugggugggaccacaga

SEQ ID NO: 1289156 - RNA, 23 nt, Homo sapiens
cuauuagagcugccugugccuuu

SEQ ID NO: 1289157 - RNA, 23 nt, Homo sapiens
cuauuauagaauggaacucaagg

SEQ ID NO: 1289158 - RNA, 19 nt, Homo sapiens
cuauuguagauaacacuau

SEQ ID NO: 1289159 - RNA, 22 nt, Homo sapiens
cuauuuccuucuccuccugucu

SEQ ID NO: 1289160 - RNA, 15 nt, Homo sapiens
cucaagacaaaugac

SEQ ID NO: 1289161 - RNA, 16 nt, Homo sapiens
cucaagggaugucuca

SEQ ID NO: 1289162 - RNA, 15 nt, Homo sapiens
cucacaguucugcag

SEQ ID NO: 1289163 - RNA, 11 nt, Homo sapiens
cucacuagcuc

SEQ ID NO: 1289164 - RNA, 14 nt, Homo sapiens
cucacuauugcaag

SEQ ID NO: 1289165 - RNA, 16 nt, Homo sapiens
cucaggugaccaaaac

SEQ ID NO: 1289166 - RNA, 14 nt, Homo sapiens
cucagucacuuuuu

SEQ ID NO: 1289167 - RNA, 18 nt, Homo sapiens
cucagucaugcauaaaua

SEQ ID NO: 1289168 - RNA, 14 nt, Homo sapiens
cucaucaggccauu

SEQ ID NO: 1289169 - RNA, 23 nt, Homo sapiens
cucaucaggccauugucccugaa

SEQ ID NO: 1289170 - RNA, 15 nt, Homo sapiens
cucauccugcaggca

SEQ ID NO: 1289171 - RNA, 16 nt, Homo sapiens
cucaucucuuagcucc

SEQ ID NO: 1289172 - RNA, 15 nt, Homo sapiens
cucauuccagaggaa

SEQ ID NO: 1289173 - RNA, 18 nt, Homo sapiens
cucauucccuccccagaa

SEQ ID NO: 1289174 - RNA, 23 nt, Homo sapiens
cuccaaccuggggggcaguggug

SEQ ID NO: 1289175 - RNA, 19 nt, Homo sapiens
cuccagagggaauugcaga

SEQ ID NO: 1289176 - RNA, 17 nt, Homo sapiens
cuccagccucagcucuc

SEQ ID NO: 1289177 - RNA, 14 nt, Homo sapiens
auauaacugugaug

SEQ ID NO: 1289178 - RNA, 16 nt, Homo sapiens
auauacucuucaagga

SEQ ID NO: 1289179 - RNA, 23 nt, Homo sapiens
auaugagaauguauuaguacaaa

SEQ ID NO: 1289180 - RNA, 22 nt, Homo sapiens
auaugcagugauauggcagaag

SEQ ID NO: 1289181 - RNA, 14 nt, Homo sapiens
auauguauacauau

SEQ ID NO: 1289182 - RNA, 23 nt, Homo sapiens
auauuaccagcuagccagucacu

SEQ ID NO: 1289183 - RNA, 19 nt, Homo sapiens
auauuuccuucaccaccuc

SEQ ID NO: 1289184 - RNA, 16 nt, Homo sapiens
auauuucuucaaguga

SEQ ID NO: 1289185 - RNA, 23 nt, Homo sapiens
auauuuuuuaugaaacauuacag

SEQ ID NO: 1289186 - RNA, 15 nt, Homo sapiens
aucaaaccacuguua

SEQ ID NO: 1289187 - RNA, 19 nt, Homo sapiens
aucaaaccacuguuauuaa

SEQ ID NO: 1289188 - RNA, 12 nt, Homo sapiens
aucaaccaaaaa

SEQ ID NO: 1289189 - RNA, 14 nt, Homo sapiens
aucaaccaaaugga

SEQ ID NO: 1289190 - RNA, 14 nt, Homo sapiens
aucaacucuaauag

SEQ ID NO: 1289191 - RNA, 21 nt, Homo sapiens
aucaaggcaggagaugcagca

SEQ ID NO: 1289192 - RNA, 23 nt, Homo sapiens
aucaauucuauuacgugcaauac

SEQ ID NO: 1289193 - RNA, 23 nt, Homo sapiens
aucacaccguccuccacgccauu

SEQ ID NO: 1289194 - RNA, 17 nt, Homo sapiens
aucacuuccuauaugca

SEQ ID NO: 1289195 - RNA, 16 nt, Homo sapiens
aucauaacauugauuu

SEQ ID NO: 1289196 - RNA, 23 nt, Homo sapiens
aucaucuuugcugaaugucauua

SEQ ID NO: 1289197 - RNA, 17 nt, Homo sapiens
auccaaaugcugugcaa

SEQ ID NO: 1289198 - RNA, 16 nt, Homo sapiens
auccagaaauaaugaa

SEQ ID NO: 1289199 - RNA, 19 nt, Homo sapiens
auccagauagguuaccagu

SEQ ID NO: 1289200 - RNA, 17 nt, Homo sapiens
auccagcaguacaauaa

SEQ ID NO: 1289201 - RNA, 22 nt, Homo sapiens
auccauagcaccuccacauacc

SEQ ID NO: 1289202 - RNA, 14 nt, Homo sapiens
auccaucaagacaa

SEQ ID NO: 1289203 - RNA, 20 nt, Homo sapiens
auccaugcuuggguguaaca

SEQ ID NO: 1289204 - RNA, 23 nt, Homo sapiens
auccauugccaucagugaucuca

SEQ ID NO: 1289205 - RNA, 22 nt, Homo sapiens
auccgucuaguuaacauuucaa

SEQ ID NO: 1289206 - RNA, 20 nt, Homo sapiens
auccuacaaggcuggcagug

SEQ ID NO: 1289207 - RNA, 22 nt, Homo sapiens
auccuacaaggcuggcagugac

SEQ ID NO: 1289208 - RNA, 16 nt, Homo sapiens
auccuuguuaagcaac

SEQ ID NO: 1289209 - RNA, 14 nt, Homo sapiens
aucgagacugcaau

SEQ ID NO: 1289210 - RNA, 23 nt, Homo sapiens
aucuaaugacaugccuauaugag

SEQ ID NO: 1289211 - RNA, 11 nt, Homo sapiens
aucuacuacau

SEQ ID NO: 1289212 - RNA, 19 nt, Homo sapiens
aucucuauuauaucuugua

SEQ ID NO: 1289213 - RNA, 15 nt, Homo sapiens
aucucuuuaccuccu

SEQ ID NO: 1289214 - RNA, 22 nt, Homo sapiens
aucugcuuuugguuauaaugug

SEQ ID NO: 1289215 - RNA, 13 nt, Homo sapiens
aucuguaccucug

SEQ ID NO: 1289216 - RNA, 15 nt, Homo sapiens
aucuguacuuugugu

SEQ ID NO: 1289217 - RNA, 16 nt, Homo sapiens
aucuguuugacagucu

SEQ ID NO: 1289218 - RNA, 19 nt, Homo sapiens
aucuuacagucagcacaga

SEQ ID NO: 1289219 - RNA, 14 nt, Homo sapiens
aucuuagugccuga

SEQ ID NO: 1289220 - RNA, 23 nt, Homo sapiens
aucuucacuucuaaaugcauauc

SEQ ID NO: 1289221 - RNA, 12 nt, Homo sapiens
aucuuuggacag

SEQ ID NO: 1289222 - RNA, 21 nt, Homo sapiens
aucuuuggacagaagcagcuc

SEQ ID NO: 1289223 - RNA, 20 nt, Homo sapiens
augaaaaauaagucacuuau

SEQ ID NO: 1289224 - RNA, 22 nt, Homo sapiens
augaaaagauuaugaucucaga

SEQ ID NO: 1289225 - RNA, 16 nt, Homo sapiens
augaaagugaugacau

SEQ ID NO: 1289226 - RNA, 12 nt, Homo sapiens
augaagcuggaa

SEQ ID NO: 1289227 - RNA, 21 nt, Homo sapiens
augaagguuucugaaaauuaa

SEQ ID NO: 1289228 - RNA, 23 nt, Homo sapiens
augacuaaagagagaauguagau

SEQ ID NO: 1289229 - RNA, 10 nt, Homo sapiens
augacuaugc

SEQ ID NO: 1289230 - RNA, 13 nt, Homo sapiens
augagaagucacu

SEQ ID NO: 1289231 - RNA, 23 nt, Homo sapiens
augagaagucacucacuauugca

SEQ ID NO: 1289232 - RNA, 21 nt, Homo sapiens
augaguuacuuagaaugccau

SEQ ID NO: 1289233 - RNA, 17 nt, Homo sapiens
augauauucucauuauu

SEQ ID NO: 1289234 - RNA, 16 nt, Homo sapiens
augcaaacugcuuuau

SEQ ID NO: 1289235 - RNA, 14 nt, Homo sapiens
augcagcucugcag

SEQ ID NO: 1289236 - RNA, 21 nt, Homo sapiens
augcauaaauaugcagugaua

SEQ ID NO: 1289237 - RNA, 20 nt, Homo sapiens
augcauagccuggacacaga

SEQ ID NO: 1289238 - RNA, 18 nt, Homo sapiens
augcauauccugagccau

SEQ ID NO: 1289239 - RNA, 13 nt, Homo sapiens
augcaucauuaau

SEQ ID NO: 1289240 - RNA, 20 nt, Homo sapiens
augcauccagcaguacaaua

SEQ ID NO: 1289241 - RNA, 22 nt, Homo sapiens
augccacacggcucucaccagu

SEQ ID NO: 1289242 - RNA, 22 nt, Homo sapiens
augccaucccgucgacucucca

SEQ ID NO: 1289243 - RNA, 11 nt, Homo sapiens
augcucuccaa

SEQ ID NO: 1289244 - RNA, 19 nt, Homo sapiens
augcugauauuuacuggaa

SEQ ID NO: 1289245 - RNA, 15 nt, Homo sapiens
augcuugcauuauau

SEQ ID NO: 1289246 - RNA, 14 nt, Homo sapiens
auggaacagugaaa

SEQ ID NO: 1289247 - RNA, 13 nt, Homo sapiens
auggacaauggac

SEQ ID NO: 1289248 - RNA, 14 nt, Homo sapiens
auggagugacuuag

SEQ ID NO: 1289249 - RNA, 16 nt, Homo sapiens
auggaguguuugacga

SEQ ID NO: 1289250 - RNA, 22 nt, Homo sapiens
auggcacagcccaaagaaggaa

SEQ ID NO: 1289251 - RNA, 20 nt, Homo sapiens
auggcagaaggcaaagcaaa

SEQ ID NO: 1289252 - RNA, 14 nt, Homo sapiens
auggccugugccau

SEQ ID NO: 1289253 - RNA, 20 nt, Homo sapiens
augggaaggguccaucucag

SEQ ID NO: 1289254 - RNA, 14 nt, Homo sapiens
auggguccagaaga

SEQ ID NO: 1289255 - RNA, 22 nt, Homo sapiens
augguguagcccucccacuuug

SEQ ID NO: 1289256 - RNA, 17 nt, Homo sapiens
auguacaagguauguac

SEQ ID NO: 1289257 - RNA, 15 nt, Homo sapiens
auguaccagcaucuc

SEQ ID NO: 1289258 - RNA, 18 nt, Homo sapiens
auguacuaggauacugcu

SEQ ID NO: 1289259 - RNA, 23 nt, Homo sapiens
auguauugcagugcggcucacau

SEQ ID NO: 1289260 - RNA, 18 nt, Homo sapiens
augucagguacauaacau

SEQ ID NO: 1289261 - RNA, 17 nt, Homo sapiens
augucaguuccaaugag

SEQ ID NO: 1289262 - RNA, 18 nt, Homo sapiens
auguccaaauacucugaa

SEQ ID NO: 1289263 - RNA, 23 nt, Homo sapiens
augugaagagggagaagcaugaa

SEQ ID NO: 1289264 - RNA, 11 nt, Homo sapiens
augugcaauaa

SEQ ID NO: 1289265 - RNA, 14 nt, Homo sapiens
augugcuacagggg

SEQ ID NO: 1289266 - RNA, 15 nt, Homo sapiens
auguggaaugcagcc

SEQ ID NO: 1289267 - RNA, 20 nt, Homo sapiens
caagguauguacaguucaua

SEQ ID NO: 1289268 - RNA, 19 nt, Homo sapiens
caauaguguccuaugcaau

SEQ ID NO: 1289269 - RNA, 20 nt, Homo sapiens
caauaguguccuaugcaaua

SEQ ID NO: 1289270 - RNA, 17 nt, Homo sapiens
caauccaauuaaucaaa

SEQ ID NO: 1289271 - RNA, 18 nt, Homo sapiens
caaucgagacugcaaugu

SEQ ID NO: 1289272 - RNA, 16 nt, Homo sapiens
caaugaaaugauguca

SEQ ID NO: 1289273 - RNA, 14 nt, Homo sapiens
caauuaacucugga

SEQ ID NO: 1289274 - RNA, 23 nt, Homo sapiens
caauuauuccuaaauaaauggau

SEQ ID NO: 1289275 - RNA, 20 nt, Homo sapiens
caauuuuuuauucauuuuaa

SEQ ID NO: 1289276 - RNA, 13 nt, Homo sapiens
cacaaaaucacac

SEQ ID NO: 1289277 - RNA, 16 nt, Homo sapiens
cacacagaggggaguc

SEQ ID NO: 1289278 - RNA, 16 nt, Homo sapiens
cacacagccaauccaa

SEQ ID NO: 1289279 - RNA, 22 nt, Homo sapiens
cacaccuuauauuuacguauga

SEQ ID NO: 1289280 - RNA, 19 nt, Homo sapiens
cacagcuucucuacagacu

SEQ ID NO: 1289281 - RNA, 22 nt, Homo sapiens
cacagcuucucuacagacucca

SEQ ID NO: 1289282 - RNA, 9 nt, Homo sapiens
cacaucucc

SEQ ID NO: 1289283 - RNA, 20 nt, Homo sapiens
cacaugcccuaaugucugua

SEQ ID NO: 1289284 - RNA, 16 nt, Homo sapiens
caccaauaaagccuuc

SEQ ID NO: 1289285 - RNA, 15 nt, Homo sapiens
caccagccagaggau

SEQ ID NO: 1289286 - RNA, 18 nt, Homo sapiens
caccaucucuuuaccucc

SEQ ID NO: 1289287 - RNA, 12 nt, Homo sapiens
caccccaacagc

SEQ ID NO: 1289288 - RNA, 19 nt, Homo sapiens
cacccccaugauccaauca

SEQ ID NO: 1289289 - RNA, 21 nt, Homo sapiens
ugguuuauaauaaacucuuaa

SEQ ID NO: 1289290 - RNA, 17 nt, Homo sapiens
ugguuuuuguugagucu

SEQ ID NO: 1289291 - RNA, 17 nt, Homo sapiens
uguaaaauuucacuuaa

SEQ ID NO: 1289292 - RNA, 15 nt, Homo sapiens
uguaagcagaaugga

SEQ ID NO: 1289293 - RNA, 17 nt, Homo sapiens
uguaagguggucacugu

SEQ ID NO: 1289294 - RNA, 20 nt, Homo sapiens
uguaccaugugcuacagggg

SEQ ID NO: 1289295 - RNA, 17 nt, Homo sapiens
uguagauauugugaagu

SEQ ID NO: 1289296 - RNA, 16 nt, Homo sapiens
uguauaccaugaugca

SEQ ID NO: 1289297 - RNA, 19 nt, Homo sapiens
uguaucauagcacugguca

SEQ ID NO: 1289298 - RNA, 14 nt, Homo sapiens
uguauccauccaug

SEQ ID NO: 1289299 - RNA, 23 nt, Homo sapiens
ugucagcaugacaaaagugacag

SEQ ID NO: 1289300 - RNA, 22 nt, Homo sapiens
ugucauaagcgaucacuuccua

SEQ ID NO: 1289301 - RNA, 17 nt, Homo sapiens
uguccaaauacucugaa

SEQ ID NO: 1289302 - RNA, 18 nt, Homo sapiens
ugucccagaaugccuccu

SEQ ID NO: 1289303 - RNA, 11 nt, Homo sapiens
ugucuaccuga

SEQ ID NO: 1289304 - RNA, 17 nt, Homo sapiens
ugucucuauccaucaga

SEQ ID NO: 1289305 - RNA, 15 nt, Homo sapiens
ugucucucaugacca

SEQ ID NO: 1289306 - RNA, 15 nt, Homo sapiens
ugucugcaacaugga

SEQ ID NO: 1289307 - RNA, 13 nt, Homo sapiens
ugugaauggauug

SEQ ID NO: 1289308 - RNA, 14 nt, Homo sapiens
ugugcaaacagugu

SEQ ID NO: 1289309 - RNA, 9 nt, Homo sapiens
ugugcaaua

SEQ ID NO: 1289310 - RNA, 17 nt, Homo sapiens
ugugcacaaaguggcau

SEQ ID NO: 1289311 - RNA, 15 nt, Homo sapiens
ugugcagaaccuccu

SEQ ID NO: 1289312 - RNA, 16 nt, Homo sapiens
ugugcaucuguacuca

SEQ ID NO: 1289313 - RNA, 13 nt, Homo sapiens
ugugcccucagau

SEQ ID NO: 1289314 - RNA, 18 nt, Homo sapiens
ugugccuuggugugcugu

SEQ ID NO: 1289315 - RNA, 17 nt, Homo sapiens
uguggcauuuucacuuu

SEQ ID NO: 1289316 - RNA, 21 nt, Homo sapiens
uguggggagggauuuggggcu

SEQ ID NO: 1289317 - RNA, 22 nt, Homo sapiens
ugugggugggaccacagacuca

SEQ ID NO: 1289318 - RNA, 17 nt, Homo sapiens
uguguaaucuaaguaua

SEQ ID NO: 1289319 - RNA, 19 nt, Homo sapiens
uguguacauuagucauuca

SEQ ID NO: 1289320 - RNA, 22 nt, Homo sapiens
uguguacauuagucauucaaua

SEQ ID NO: 1289321 - RNA, 14 nt, Homo sapiens
ugugucacuguaug

SEQ ID NO: 1289322 - RNA, 13 nt, Homo sapiens
ugugugucucuga

SEQ ID NO: 1289323 - RNA, 14 nt, Homo sapiens
uguuaaucauuuca

SEQ ID NO: 1289324 - RNA, 17 nt, Homo sapiens
uguuauuaacagauaau

SEQ ID NO: 1289325 - RNA, 17 nt, Homo sapiens
uguuccaggauguggaa

SEQ ID NO: 1289326 - RNA, 19 nt, Homo sapiens
uguuccuguuugcugggag

SEQ ID NO: 1289327 - RNA, 16 nt, Homo sapiens
uguuccuugcuuuuau

SEQ ID NO: 1289328 - RNA, 23 nt, Homo sapiens
uguucuucauuaccucagugaga

SEQ ID NO: 1289329 - RNA, 13 nt, Homo sapiens
uguugacaugugc

SEQ ID NO: 1289330 - RNA, 14 nt, Homo sapiens
uguugacaugugcu

SEQ ID NO: 1289331 - RNA, 14 nt, Homo sapiens
uguugagacgccuu

SEQ ID NO: 1289332 - RNA, 18 nt, Homo sapiens
uguuggaaaaugugcaau

SEQ ID NO: 1289333 - RNA, 19 nt, Homo sapiens
uguuggaaaaugugcaaua

SEQ ID NO: 1289334 - RNA, 14 nt, Homo sapiens
uguuuaugagccag

SEQ ID NO: 1289335 - RNA, 18 nt, Homo sapiens
uguuucaucccauguaca

SEQ ID NO: 1289336 - RNA, 22 nt, Homo sapiens
uguuuucaauguuucacuacuc

SEQ ID NO: 1289337 - RNA, 19 nt, Homo sapiens
uuaaaaaauaaaaacugac

SEQ ID NO: 1289338 - RNA, 20 nt, Homo sapiens
uuaaaaauaaagcuacugaa

SEQ ID NO: 1289339 - RNA, 14 nt, Homo sapiens
uuaaaagagacaaa

SEQ ID NO: 1289340 - RNA, 19 nt, Homo sapiens
uuaaaaguauacaugucaa

SEQ ID NO: 1289341 - RNA, 14 nt, Homo sapiens
uuaaaaucauaaca

SEQ ID NO: 1289342 - RNA, 21 nt, Homo sapiens
uuaaacaaaauuucacaguuc

SEQ ID NO: 1289343 - RNA, 23 nt, Homo sapiens
uuaaacuuuucauuacacuaaag

SEQ ID NO: 1289344 - RNA, 22 nt, Homo sapiens
uuaaagcaaucuguugaaaugc

SEQ ID NO: 1289345 - RNA, 16 nt, Homo sapiens
uuaaauagaacuugau

SEQ ID NO: 1289346 - RNA, 16 nt, Homo sapiens
uuaacagacacuguaa

SEQ ID NO: 1289347 - RNA, 11 nt, Homo sapiens
uuaacuaugaa

SEQ ID NO: 1289348 - RNA, 19 nt, Homo sapiens
uuaacucaccucucaaggu

SEQ ID NO: 1289349 - RNA, 20 nt, Homo sapiens
uuaagguacauggaacacac

SEQ ID NO: 1289350 - RNA, 22 nt, Homo sapiens
uuaaguuugaaacuaacucaua

SEQ ID NO: 1289351 - RNA, 14 nt, Homo sapiens
uuaaucaaaccacu

SEQ ID NO: 1289352 - RNA, 18 nt, Homo sapiens
uuaaucugagaggccaca

SEQ ID NO: 1289353 - RNA, 18 nt, Homo sapiens
uuaauuugauaguauugu

SEQ ID NO: 1289354 - RNA, 18 nt, Homo sapiens
uuacaaucgagacugcaa

SEQ ID NO: 1289355 - RNA, 19 nt, Homo sapiens
uuacaaucgagacugcaau

SEQ ID NO: 1289356 - RNA, 22 nt, Homo sapiens
uuacagauguagauauaaauau

SEQ ID NO: 1289357 - RNA, 14 nt, Homo sapiens
uuacauacagugau

SEQ ID NO: 1289358 - RNA, 15 nt, Homo sapiens
uuacauacagugaua

SEQ ID NO: 1289359 - RNA, 14 nt, Homo sapiens
uuacauacuauucu

SEQ ID NO: 1289360 - RNA, 17 nt, Homo sapiens
uuacauacuauucuuac

SEQ ID NO: 1289361 - RNA, 18 nt, Homo sapiens
uuaccuaaaucuguuuga

SEQ ID NO: 1289362 - RNA, 12 nt, Homo sapiens
uuacgugcaaua

SEQ ID NO: 1289363 - RNA, 23 nt, Homo sapiens
uuacuauuuauugcugaaugacu

SEQ ID NO: 1289364 - RNA, 16 nt, Homo sapiens
uuagagcugccugugc

SEQ ID NO: 1289365 - RNA, 14 nt, Homo sapiens
uuagaggcaaagaa

SEQ ID NO: 1289366 - RNA, 13 nt, Homo sapiens
uuagaggggaaaa

SEQ ID NO: 1289367 - RNA, 20 nt, Homo sapiens
uuaggaaaggaugaucaaaa

SEQ ID NO: 1289368 - RNA, 20 nt, Homo sapiens
uuauagaccagaaccagagc

SEQ ID NO: 1289369 - RNA, 18 nt, Homo sapiens
uuauagccgaaaugaucu

SEQ ID NO: 1289370 - RNA, 19 nt, Homo sapiens
uuauauuguuucaucccau

SEQ ID NO: 1289371 - RNA, 14 nt, Homo sapiens
uuauauuuggccca

SEQ ID NO: 1289372 - RNA, 22 nt, Homo sapiens
uuauauuuggcccaaacucauc

SEQ ID NO: 1289373 - RNA, 18 nt, Homo sapiens
uuaugaaacauuacaguu

SEQ ID NO: 1289374 - RNA, 11 nt, Homo sapiens
uuaugagauuu

SEQ ID NO: 1289375 - RNA, 15 nt, Homo sapiens
uuaugauauucucau

SEQ ID NO: 1289376 - RNA, 18 nt, Homo sapiens
uuaugccccugcacugaa

SEQ ID NO: 1289377 - RNA, 17 nt, Homo sapiens
uuaugcuaccuacugau

SEQ ID NO: 1289378 - RNA, 11 nt, Homo sapiens
uuaugugcaau

SEQ ID NO: 1289379 - RNA, 12 nt, Homo sapiens
uuaugugcaaua

SEQ ID NO: 1289380 - RNA, 20 nt, Homo sapiens
uuauuuaaaaagaacucuga

SEQ ID NO: 1289381 - RNA, 17 nt, Homo sapiens
uuauuuuuuuacuuccu

SEQ ID NO: 1289382 - RNA, 21 nt, Homo sapiens
uucaaaauuccauuuacuuga

SEQ ID NO: 1289383 - RNA, 22 nt, Homo sapiens
uucaaaauuccauuuacuugau

SEQ ID NO: 1289384 - RNA, 13 nt, Homo sapiens
uucaaauaucaaa

SEQ ID NO: 1289385 - RNA, 21 nt, Homo sapiens
uucaagguaacuguacugggc

SEQ ID NO: 1289386 - RNA, 17 nt, Homo sapiens
uucacacaguaaaagca

SEQ ID NO: 1289387 - RNA, 20 nt, Homo sapiens
uucacuggggcaugagauuu

SEQ ID NO: 1289388 - RNA, 16 nt, Homo sapiens
uucacuuauugacuau

SEQ ID NO: 1289389 - RNA, 14 nt, Homo sapiens
uucagauuugccuu

SEQ ID NO: 1289390 - RNA, 19 nt, Homo sapiens
uucagccaaacaguaugau

SEQ ID NO: 1289391 - RNA, 18 nt, Homo sapiens
uucaucaugucaguucca

SEQ ID NO: 1289392 - RNA, 18 nt, Homo sapiens
uucaucuauuucugagaa

SEQ ID NO: 1289393 - RNA, 18 nt, Homo sapiens
uucaucugcucuccuucc

SEQ ID NO: 1289394 - RNA, 21 nt, Homo sapiens
uucaugaaaagauuaugaucu

SEQ ID NO: 1289395 - RNA, 17 nt, Homo sapiens
uucauuuuguggcaaaa

SEQ ID NO: 1289396 - RNA, 20 nt, Homo sapiens
uuccacaucauguuacuuga

SEQ ID NO: 1289397 - RNA, 19 nt, Homo sapiens
uuccaggaaaaucugcacu

SEQ ID NO: 1289398 - RNA, 14 nt, Homo sapiens
uuccaucuuugggu

SEQ ID NO: 1289399 - RNA, 16 nt, Homo sapiens
uuccaugaaaaugcaa

SEQ ID NO: 1289400 - RNA, 16 nt, Homo sapiens
uuccauuaugauucuu

SEQ ID NO: 1289401 - RNA, 11 nt, Homo sapiens
ugacuaaagag

SEQ ID NO: 1289402 - RNA, 18 nt, Homo sapiens
ugagaagccagcuuuccu

SEQ ID NO: 1289403 - RNA, 20 nt, Homo sapiens
ugagagcccuucaugcauuu

SEQ ID NO: 1289404 - RNA, 17 nt, Homo sapiens
ugagcagcaacuguguc

SEQ ID NO: 1289405 - RNA, 17 nt, Homo sapiens
ugaggaauauuugcaag

SEQ ID NO: 1289406 - RNA, 22 nt, Homo sapiens
ugaggggcgagaaacaagacaa

SEQ ID NO: 1289407 - RNA, 16 nt, Homo sapiens
ugaggggcucucucau

SEQ ID NO: 1289408 - RNA, 19 nt, Homo sapiens
ugaguccucuuaaugcuag

SEQ ID NO: 1289409 - RNA, 15 nt, Homo sapiens
ugauaaaauuauuga

SEQ ID NO: 1289410 - RNA, 14 nt, Homo sapiens
ugauaaacuuugaa

SEQ ID NO: 1289411 - RNA, 12 nt, Homo sapiens
ugauagugcuuc

SEQ ID NO: 1289412 - RNA, 13 nt, Homo sapiens
ugauaguuacuca

SEQ ID NO: 1289413 - RNA, 14 nt, Homo sapiens
ugauauucucauua

SEQ ID NO: 1289414 - RNA, 18 nt, Homo sapiens
ugauauugaccaugugau

SEQ ID NO: 1289415 - RNA, 17 nt, Homo sapiens
ugauccacuucucucag

SEQ ID NO: 1289416 - RNA, 17 nt, Homo sapiens
ugauccguuccauugca

SEQ ID NO: 1289417 - RNA, 14 nt, Homo sapiens
ugaucuguacuuug

SEQ ID NO: 1289418 - RNA, 20 nt, Homo sapiens
ugaucuuuguuuaaaugcca

SEQ ID NO: 1289419 - RNA, 15 nt, Homo sapiens
ugauggcaacacuga

SEQ ID NO: 1289420 - RNA, 21 nt, Homo sapiens
ugaugugcaaaggcaucugag

SEQ ID NO: 1289421 - RNA, 21 nt, Homo sapiens
ugauuaccagucugauuauac

SEQ ID NO: 1289422 - RNA, 22 nt, Homo sapiens
ugauuauuuugugcaacauaac

SEQ ID NO: 1289423 - RNA, 16 nt, Homo sapiens
ugauucaaauaucaaa

SEQ ID NO: 1289424 - RNA, 17 nt, Homo sapiens
ugauugucagcuacuaa

SEQ ID NO: 1289425 - RNA, 12 nt, Homo sapiens
ugcaagacauag

SEQ ID NO: 1289426 - RNA, 23 nt, Homo sapiens
ugcaagcuucuuuuaguuguauc

SEQ ID NO: 1289427 - RNA, 11 nt, Homo sapiens
ugcaagcuuuu

SEQ ID NO: 1289428 - RNA, 14 nt, Homo sapiens
ugcaauuugcacaa

SEQ ID NO: 1289429 - RNA, 14 nt, Homo sapiens
ugcacuuauucuca

SEQ ID NO: 1289430 - RNA, 15 nt, Homo sapiens
ugcacuuauucucaa

SEQ ID NO: 1289431 - RNA, 13 nt, Homo sapiens
ugcagagagccau

SEQ ID NO: 1289432 - RNA, 13 nt, Homo sapiens
ugcagaguacugg

SEQ ID NO: 1289433 - RNA, 21 nt, Homo sapiens
ugcaggagucccugccaucau

SEQ ID NO: 1289434 - RNA, 21 nt, Homo sapiens
ugcauaaauaugcagugauau

SEQ ID NO: 1289435 - RNA, 17 nt, Homo sapiens
ugcauaauaaaugcuuc

SEQ ID NO: 1289436 - RNA, 14 nt, Homo sapiens
ugcauaauaagcua

SEQ ID NO: 1289437 - RNA, 13 nt, Homo sapiens
ugcauauauacau

SEQ ID NO: 1289438 - RNA, 19 nt, Homo sapiens
ugccacauuagccuuugca

SEQ ID NO: 1289439 - RNA, 18 nt, Homo sapiens
ugccaccuccugccucag

SEQ ID NO: 1289440 - RNA, 17 nt, Homo sapiens
ugccauagucaaagaga

SEQ ID NO: 1289441 - RNA, 13 nt, Homo sapiens
ugccaugugaaga

SEQ ID NO: 1289442 - RNA, 14 nt, Homo sapiens
ugcccacucuccac

SEQ ID NO: 1289443 - RNA, 16 nt, Homo sapiens
ugccccagggaccuuu

SEQ ID NO: 1289444 - RNA, 14 nt, Homo sapiens
ugcccccaacagca

SEQ ID NO: 1289445 - RNA, 22 nt, Homo sapiens
ugccucaggccucugugccgca

SEQ ID NO: 1289446 - RNA, 23 nt, Homo sapiens
ugccucuugaaugcagggacaaa

SEQ ID NO: 1289447 - RNA, 18 nt, Homo sapiens
ugccugugccuuuugcca

SEQ ID NO: 1289448 - RNA, 14 nt, Homo sapiens
ugcuaaaccauuca

SEQ ID NO: 1289449 - RNA, 23 nt, Homo sapiens
ugcuaaacgcacacaguaucuag

SEQ ID NO: 1289450 - RNA, 19 nt, Homo sapiens
ugcuacaguuuuuccuaaa

SEQ ID NO: 1289451 - RNA, 14 nt, Homo sapiens
ugcuauaucaguuu

SEQ ID NO: 1289452 - RNA, 19 nt, Homo sapiens
ugcuauuguagagccagag

SEQ ID NO: 1289453 - RNA, 21 nt, Homo sapiens
ugcuauuguagagccagaggu

SEQ ID NO: 1289454 - RNA, 13 nt, Homo sapiens
ugcugaagggagg

SEQ ID NO: 1289455 - RNA, 20 nt, Homo sapiens
ugcugaaugucauuauuuga

SEQ ID NO: 1289456 - RNA, 21 nt, Homo sapiens
ugcugcccagggucaguguau

SEQ ID NO: 1289457 - RNA, 14 nt, Homo sapiens
ugcugccugccugg

SEQ ID NO: 1289458 - RNA, 21 nt, Homo sapiens
ugcugggagaggggguagcua

SEQ ID NO: 1289459 - RNA, 20 nt, Homo sapiens
ugcuguuuuaaauugcauuu

SEQ ID NO: 1289460 - RNA, 13 nt, Homo sapiens
ugcuuaaggcaua

SEQ ID NO: 1289461 - RNA, 16 nt, Homo sapiens
ugcuuccugacaauca

SEQ ID NO: 1289462 - RNA, 19 nt, Homo sapiens
ugcuucuggggacaccuca

SEQ ID NO: 1289463 - RNA, 17 nt, Homo sapiens
ugcuuuuuuucagggaa

SEQ ID NO: 1289464 - RNA, 16 nt, Homo sapiens
uggaaaaaugauuuaa

SEQ ID NO: 1289465 - RNA, 17 nt, Homo sapiens
uggaaaagaaaguacag

SEQ ID NO: 1289466 - RNA, 14 nt, Homo sapiens
uggaaaaggaagac

SEQ ID NO: 1289467 - RNA, 15 nt, Homo sapiens
uggaaaaugugcaau

SEQ ID NO: 1289468 - RNA, 18 nt, Homo sapiens
uggaagggaaaagcccau

SEQ ID NO: 1289469 - RNA, 15 nt, Homo sapiens
uggaaguccagaaca

SEQ ID NO: 1289470 - RNA, 15 nt, Homo sapiens
uggacagaagcagcu

SEQ ID NO: 1289471 - RNA, 21 nt, Homo sapiens
uggacaguuuucugcuuuaau

SEQ ID NO: 1289472 - RNA, 21 nt, Homo sapiens
uggaccacuccugaaugagac

SEQ ID NO: 1289473 - RNA, 23 nt, Homo sapiens
uggagaagccacaggccugagau

SEQ ID NO: 1289474 - RNA, 24 nt, Homo sapiens
uggagcugagcagguguucuucau

SEQ ID NO: 1289475 - RNA, 12 nt, Homo sapiens
uggaucugugag

SEQ ID NO: 1289476 - RNA, 21 nt, Homo sapiens
uggcagcaucuucacuucuaa

SEQ ID NO: 1289477 - RNA, 21 nt, Homo sapiens
uggcagcgccucaucuucaac

SEQ ID NO: 1289478 - RNA, 20 nt, Homo sapiens
uggcagcuagccagugcuca

SEQ ID NO: 1289479 - RNA, 13 nt, Homo sapiens
uggcccaccccac

SEQ ID NO: 1289480 - RNA, 22 nt, Homo sapiens
uggccuguucuucuauggguug

SEQ ID NO: 1289481 - RNA, 18 nt, Homo sapiens
uggcggcaucugcuucug

SEQ ID NO: 1289482 - RNA, 19 nt, Homo sapiens
uggcuagugguggguacuc

SEQ ID NO: 1289483 - RNA, 20 nt, Homo sapiens
uggcucugagagccccagga

SEQ ID NO: 1289484 - RNA, 19 nt, Homo sapiens
uggcugccccgugacacau

SEQ ID NO: 1289485 - RNA, 12 nt, Homo sapiens
uggcugccuugu

SEQ ID NO: 1289486 - RNA, 20 nt, Homo sapiens
uggcugggaggaagccagaa

SEQ ID NO: 1289487 - RNA, 19 nt, Homo sapiens
uggcuuacaguaaaugaac

SEQ ID NO: 1289488 - RNA, 21 nt, Homo sapiens
uggcuuaugccccugcacuga

SEQ ID NO: 1289489 - RNA, 10 nt, Homo sapiens
uggcuuccau

SEQ ID NO: 1289490 - RNA, 17 nt, Homo sapiens
ugggaagcaggagccca

SEQ ID NO: 1289491 - RNA, 15 nt, Homo sapiens
ugggaagcuauuucc

SEQ ID NO: 1289492 - RNA, 22 nt, Homo sapiens
ugggaaggguccaucucagaga

SEQ ID NO: 1289493 - RNA, 21 nt, Homo sapiens
ugggagcuucucugcugcuua

SEQ ID NO: 1289494 - RNA, 17 nt, Homo sapiens
ugggcaggaacacagac

SEQ ID NO: 1289495 - RNA, 17 nt, Homo sapiens
ugggcuuuugaacugua

SEQ ID NO: 1289496 - RNA, 21 nt, Homo sapiens
uggggaucuagggaauucagu

SEQ ID NO: 1289497 - RNA, 16 nt, Homo sapiens
uggggaugucucucau

SEQ ID NO: 1289498 - RNA, 16 nt, Homo sapiens
uggggauuaccauuca

SEQ ID NO: 1289499 - RNA, 18 nt, Homo sapiens
uggggcuuuuacaccagu

SEQ ID NO: 1289500 - RNA, 14 nt, Homo sapiens
ugggucaguuguau

SEQ ID NO: 1289501 - RNA, 19 nt, Homo sapiens
uggguccagaagaccccac

SEQ ID NO: 1289502 - RNA, 21 nt, Homo sapiens
ugggucccagauuggcucaca

SEQ ID NO: 1289503 - RNA, 17 nt, Homo sapiens
uggguccuuagugcaau

SEQ ID NO: 1289504 - RNA, 16 nt, Homo sapiens
ugguacuaaggagaau

SEQ ID NO: 1289505 - RNA, 21 nt, Homo sapiens
uggucagggccccucuaccca

SEQ ID NO: 1289506 - RNA, 17 nt, Homo sapiens
uggugaaaugcagaguc

SEQ ID NO: 1289507 - RNA, 14 nt, Homo sapiens
uggugacuuuugaa

SEQ ID NO: 1289508 - RNA, 14 nt, Homo sapiens
uggugcucauuuaa

SEQ ID NO: 1289509 - RNA, 15 nt, Homo sapiens
ugguucucaucuuuc

SEQ ID NO: 1289510 - RNA, 20 nt, Homo sapiens
ugguugaguguugcucucua

SEQ ID NO: 1289511 - RNA, 14 nt, Homo sapiens
ugguuuacuguguu

SEQ ID NO: 1289512 - RNA, 18 nt, Homo sapiens
ugguuuagucauugcaga

SEQ ID NO: 1289513 - RNA, 18 nt, Homo sapiens
ucuggucauaaugaacac

SEQ ID NO: 1289514 - RNA, 21 nt, Homo sapiens
ucuggucauaaugaacacuca

SEQ ID NO: 1289515 - RNA, 21 nt, Homo sapiens
ucugugccgcaccauugaacu

SEQ ID NO: 1289516 - RNA, 12 nt, Homo sapiens
ucugugugcugc

SEQ ID NO: 1289517 - RNA, 19 nt, Homo sapiens
ucuguguguguguaugugg

SEQ ID NO: 1289518 - RNA, 23 nt, Homo sapiens
ucuguguguguguaugugggggu

SEQ ID NO: 1289519 - RNA, 17 nt, Homo sapiens
ucuguugccauggugau

SEQ ID NO: 1289520 - RNA, 16 nt, Homo sapiens
ucuuaaaaugcaauau

SEQ ID NO: 1289521 - RNA, 17 nt, Homo sapiens
ucuuaagagaacauuau

SEQ ID NO: 1289522 - RNA, 16 nt, Homo sapiens
ucuuaucucagucaug

SEQ ID NO: 1289523 - RNA, 21 nt, Homo sapiens
ucuucacuucuaaaugcauau

SEQ ID NO: 1289524 - RNA, 12 nt, Homo sapiens
ucuucauuaccu

SEQ ID NO: 1289525 - RNA, 13 nt, Homo sapiens
ucuucucauuuca

SEQ ID NO: 1289526 - RNA, 23 nt, Homo sapiens
ucuucugccccagcuuugcagga

SEQ ID NO: 1289527 - RNA, 14 nt, Homo sapiens
ucuucuuacaugca

SEQ ID NO: 1289528 - RNA, 20 nt, Homo sapiens
ucuugaguguuaugugaauu

SEQ ID NO: 1289529 - RNA, 20 nt, Homo sapiens
ucuugggaauuuucuuccaa

SEQ ID NO: 1289530 - RNA, 15 nt, Homo sapiens
ucuuguauugcucca

SEQ ID NO: 1289531 - RNA, 14 nt, Homo sapiens
ucuuguucauccaa

SEQ ID NO: 1289532 - RNA, 15 nt, Homo sapiens
ucuuuagcaguuuug

SEQ ID NO: 1289533 - RNA, 12 nt, Homo sapiens
ucuuuauugcau

SEQ ID NO: 1289534 - RNA, 15 nt, Homo sapiens
ucuuucugcauaaua

SEQ ID NO: 1289535 - RNA, 13 nt, Homo sapiens
ucuuuugugcucu

SEQ ID NO: 1289536 - RNA, 17 nt, Homo sapiens
ugaaaaauaagucacuu

SEQ ID NO: 1289537 - RNA, 19 nt, Homo sapiens
ugaaaagauuaugaucuca

SEQ ID NO: 1289538 - RNA, 20 nt, Homo sapiens
ugaaaaugcuuucuuggcca

SEQ ID NO: 1289539 - RNA, 19 nt, Homo sapiens
ugaaacagccagaucucau

SEQ ID NO: 1289540 - RNA, 14 nt, Homo sapiens
ugaaacuaacagau

SEQ ID NO: 1289541 - RNA, 23 nt, Homo sapiens
ugaaacuaacagauaagcaagag

SEQ ID NO: 1289542 - RNA, 17 nt, Homo sapiens
ugaaagucaugcacaua

SEQ ID NO: 1289543 - RNA, 17 nt, Homo sapiens
ugaaaguugcuuuuauu

SEQ ID NO: 1289544 - RNA, 19 nt, Homo sapiens
ugaacacagccugggacca

SEQ ID NO: 1289545 - RNA, 19 nt, Homo sapiens
ugaacuguaccaugugcua

SEQ ID NO: 1289546 - RNA, 18 nt, Homo sapiens
ugaagagggagaagcaug

SEQ ID NO: 1289547 - RNA, 14 nt, Homo sapiens
ugaaguacauauua

SEQ ID NO: 1289548 - RNA, 17 nt, Homo sapiens
ugaauauaaacacuaua

SEQ ID NO: 1289549 - RNA, 12 nt, Homo sapiens
ugaaugcuuccu

SEQ ID NO: 1289550 - RNA, 23 nt, Homo sapiens
ugaaugucauuauuugauaacau

SEQ ID NO: 1289551 - RNA, 15 nt, Homo sapiens
ugaauuuuugcacau

SEQ ID NO: 1289552 - RNA, 12 nt, Homo sapiens
ugacaugugcuu

SEQ ID NO: 1289553 - RNA, 18 nt, Homo sapiens
ugacccucuccccacugc

SEQ ID NO: 1289554 - RNA, 18 nt, Homo sapiens
uuuaagugcguguguaga

SEQ ID NO: 1289555 - RNA, 16 nt, Homo sapiens
uuuaauuugauaguau

SEQ ID NO: 1289556 - RNA, 16 nt, Homo sapiens
uuuaguuacguauaau

SEQ ID NO: 1289557 - RNA, 21 nt, Homo sapiens
uuuauaguuguagacuaugga

SEQ ID NO: 1289558 - RNA, 13 nt, Homo sapiens
uuuaugugcaaua

SEQ ID NO: 1289559 - RNA, 15 nt, Homo sapiens
uuuauugcugaauga

SEQ ID NO: 1289560 - RNA, 16 nt, Homo sapiens
uuuauuuuucucauga

SEQ ID NO: 1289561 - RNA, 16 nt, Homo sapiens
uuucaaaaugcuucaa

SEQ ID NO: 1289562 - RNA, 20 nt, Homo sapiens
uuucacuuuuggcuuguaaa

SEQ ID NO: 1289563 - RNA, 12 nt, Homo sapiens
uuucaguauuau

SEQ ID NO: 1289564 - RNA, 22 nt, Homo sapiens
uuucaucugcucuccuuccugg

SEQ ID NO: 1289565 - RNA, 19 nt, Homo sapiens
uuucauguauguauauaau

SEQ ID NO: 1289566 - RNA, 22 nt, Homo sapiens
uuucauuccuaacacagcaugu

SEQ ID NO: 1289567 - RNA, 17 nt, Homo sapiens
uuucauuuuuuuccagg

SEQ ID NO: 1289568 - RNA, 14 nt, Homo sapiens
uuuccaccaagugu

SEQ ID NO: 1289569 - RNA, 16 nt, Homo sapiens
uuuccauaaucacuca

SEQ ID NO: 1289570 - RNA, 13 nt, Homo sapiens
uuuccucuaucua

SEQ ID NO: 1289571 - RNA, 13 nt, Homo sapiens
uuuccucuugggc

SEQ ID NO: 1289572 - RNA, 21 nt, Homo sapiens
uuuccuguguacacgugacag

SEQ ID NO: 1289573 - RNA, 23 nt, Homo sapiens
uuucuaacuuuaugaacucccuc

SEQ ID NO: 1289574 - RNA, 17 nt, Homo sapiens
uuucuaccaucucacgg

SEQ ID NO: 1289575 - RNA, 13 nt, Homo sapiens
uuucugccuaucu

SEQ ID NO: 1289576 - RNA, 17 nt, Homo sapiens
uuucuggcagccaguac

SEQ ID NO: 1289577 - RNA, 16 nt, Homo sapiens
uuucuuuguaucauuc

SEQ ID NO: 1289578 - RNA, 13 nt, Homo sapiens
uuugaauacacau

SEQ ID NO: 1289579 - RNA, 14 nt, Homo sapiens
uuugaggucuacau

SEQ ID NO: 1289580 - RNA, 15 nt, Homo sapiens
uuugaguuucucuca

SEQ ID NO: 1289581 - RNA, 17 nt, Homo sapiens
uuugauuaaauuaugaa

SEQ ID NO: 1289582 - RNA, 18 nt, Homo sapiens
uuugcccuuuuuaaggaa

SEQ ID NO: 1289583 - RNA, 15 nt, Homo sapiens
uuuggauuacuuaaa

SEQ ID NO: 1289584 - RNA, 13 nt, Homo sapiens
uuuggcaacagaa

SEQ ID NO: 1289585 - RNA, 21 nt, Homo sapiens
uuuggcucuucuaaucagagc

SEQ ID NO: 1289586 - RNA, 22 nt, Homo sapiens
uuuggguucacagaagcacagc

SEQ ID NO: 1289587 - RNA, 21 nt, Homo sapiens
uuugugauucccuccagugaa

SEQ ID NO: 1289588 - RNA, 23 nt, Homo sapiens
uuuguuccccuccuccacucucc

SEQ ID NO: 1289589 - RNA, 15 nt, Homo sapiens
uuuuaaaaugcauca

SEQ ID NO: 1289590 - RNA, 13 nt, Homo sapiens
uuuuaaacauucu

SEQ ID NO: 1289591 - RNA, 17 nt, Homo sapiens
uuuuacacaccaccagc

SEQ ID NO: 1289592 - RNA, 15 nt, Homo sapiens
uuuucauuacacuaa

SEQ ID NO: 1289593 - RNA, 17 nt, Homo sapiens
uuuuccuauuuacaugu

SEQ ID NO: 1289594 - RNA, 14 nt, Homo sapiens
uuuucucaugauga

SEQ ID NO: 1289595 - RNA, 13 nt, Homo sapiens
uuuuucaguauua

SEQ ID NO: 1289596 - RNA, 14 nt, Homo sapiens
uuuuuccuaaaaga

SEQ ID NO: 1289597 - RNA, 13 nt, Homo sapiens
gauaaugauuucc

SEQ ID NO: 1289598 - RNA, 19 nt, Homo sapiens
gauacugaggcacacagag

SEQ ID NO: 1289599 - RNA, 20 nt, Homo sapiens
gauauuuaaaagacaaacac

SEQ ID NO: 1289600 - RNA, 23 nt, Homo sapiens
gaucaccugaacuuucucuagca

SEQ ID NO: 1289601 - RNA, 23 nt, Homo sapiens
gaucauuaucagccugugccacg

SEQ ID NO: 1289602 - RNA, 15 nt, Homo sapiens
cuuuuauugccauga

SEQ ID NO: 1289603 - RNA, 11 nt, Homo sapiens
cuuuucucugc

SEQ ID NO: 1289604 - RNA, 18 nt, Homo sapiens
cuuuucuugccucugucc

SEQ ID NO: 1289605 - RNA, 20 nt, Homo sapiens
cuuuucuuuguaucauucau

SEQ ID NO: 1289606 - RNA, 14 nt, Homo sapiens
cuuuugucccagaa

SEQ ID NO: 1289607 - RNA, 22 nt, Homo sapiens
cuuuugugcuccccuuugccua

SEQ ID NO: 1289608 - RNA, 13 nt, Homo sapiens
gcuucucagccac

SEQ ID NO: 1289609 - RNA, 21 nt, Homo sapiens
gcuucucuacagacuccaaaa

SEQ ID NO: 1289610 - RNA, 23 nt, Homo sapiens
gcuucucuacagacuccaaaagg

SEQ ID NO: 1289611 - RNA, 21 nt, Homo sapiens
gcuucuggggacaccucagga

SEQ ID NO: 1289612 - RNA, 16 nt, Homo sapiens
gcuucugugugcugcu

SEQ ID NO: 1289613 - RNA, 13 nt, Homo sapiens
gcuuggcugugcc

SEQ ID NO: 1289614 - RNA, 21 nt, Homo sapiens
gcuuguaaaauuucacuuaau

SEQ ID NO: 1289615 - RNA, 14 nt, Homo sapiens
gcuuguuccaaugc

SEQ ID NO: 1289616 - RNA, 14 nt, Homo sapiens
gcuuuacucauggc

SEQ ID NO: 1289617 - RNA, 12 nt, Homo sapiens
ggaaacauagaa

SEQ ID NO: 1289618 - RNA, 17 nt, Homo sapiens
ggaaacuggaugagguc

SEQ ID NO: 1289619 - RNA, 20 nt, Homo sapiens
ggaaacuggaugaggucaua

SEQ ID NO: 1289620 - RNA, 24 nt, Homo sapiens
ggaagagugguuaagacuacugaa

SEQ ID NO: 1289621 - RNA, 18 nt, Homo sapiens
ggaaggcugucuaccuga

SEQ ID NO: 1289622 - RNA, 21 nt, Homo sapiens
ggaaguuuuguggaggagcuc

SEQ ID NO: 1289623 - RNA, 22 nt, Homo sapiens
ggaauauuugcaagacauagaa

SEQ ID NO: 1289624 - RNA, 16 nt, Homo sapiens
ggaauuauucccauga

SEQ ID NO: 1289625 - RNA, 14 nt, Homo sapiens
ggacaaagccuuug

SEQ ID NO: 1289626 - RNA, 16 nt, Homo sapiens
ggacaaccucauuuua

SEQ ID NO: 1289627 - RNA, 18 nt, Homo sapiens
ggacacuaauacaccagg

SEQ ID NO: 1289628 - RNA, 13 nt, Homo sapiens
ggacagaagcagc

SEQ ID NO: 1289629 - RNA, 16 nt, Homo sapiens
ggacagcaacuaucag

SEQ ID NO: 1289630 - RNA, 14 nt, Homo sapiens
ggacagcuuugaua

SEQ ID NO: 1289631 - RNA, 18 nt, Homo sapiens
ggaccggagagugggggu

SEQ ID NO: 1289632 - RNA, 21 nt, Homo sapiens
ggacgggacagugaguggcug

SEQ ID NO: 1289633 - RNA, 22 nt, Homo sapiens
ggacucugcagccucagagaca

SEQ ID NO: 1289634 - RNA, 16 nt, Homo sapiens
ggacuuacuauuuauu

SEQ ID NO: 1289635 - RNA, 15 nt, Homo sapiens
ggagagagugcuauu

SEQ ID NO: 1289636 - RNA, 23 nt, Homo sapiens
ggaggagaaaagugacagauccu

SEQ ID NO: 1289637 - RNA, 22 nt, Homo sapiens
ggaggauacugaggcacacaga

SEQ ID NO: 1289638 - RNA, 23 nt, Homo sapiens
ggagugaggaugucugggccacu

SEQ ID NO: 1289639 - RNA, 21 nt, Homo sapiens
ggaguguucagggccagcccu

SEQ ID NO: 1289640 - RNA, 14 nt, Homo sapiens
ggauaaguagaauu

SEQ ID NO: 1289641 - RNA, 17 nt, Homo sapiens
ggaucaugguguaauaa

SEQ ID NO: 1289642 - RNA, 16 nt, Homo sapiens
ggauguaccagcaucu

SEQ ID NO: 1289643 - RNA, 12 nt, Homo sapiens
ggaugucucuca

SEQ ID NO: 1289644 - RNA, 15 nt, Homo sapiens
ggaugucucucauga

SEQ ID NO: 1289645 - RNA, 16 nt, Homo sapiens
ggcaagggaccugcuu

SEQ ID NO: 1289646 - RNA, 16 nt, Homo sapiens
ggcacuccuuucuugc

SEQ ID NO: 1289647 - RNA, 14 nt, Homo sapiens
ggcagcaucuucac

SEQ ID NO: 1289648 - RNA, 14 nt, Homo sapiens
ggcaggaacacaga

SEQ ID NO: 1289649 - RNA, 21 nt, Homo sapiens
ggcagggcugaggccucucau

SEQ ID NO: 1289650 - RNA, 22 nt, Homo sapiens
ggcagugagugccaugcuuuuu

SEQ ID NO: 1289651 - RNA, 15 nt, Homo sapiens
ggcauuguguucacu

SEQ ID NO: 1289652 - RNA, 16 nt, Homo sapiens
ggcauuuucacuuuug

SEQ ID NO: 1289653 - RNA, 23 nt, Homo sapiens
ggccaggaguucccaaaugugag

SEQ ID NO: 1289654 - RNA, 19 nt, Homo sapiens
ggcccaaacucaucuugau

SEQ ID NO: 1289655 - RNA, 21 nt, Homo sapiens
ggcccccgaccaacacuugca

SEQ ID NO: 1289656 - RNA, 14 nt, Homo sapiens
ggcccuagacucau

SEQ ID NO: 1289657 - RNA, 20 nt, Homo sapiens
ggcccugccaugcucuccaa

SEQ ID NO: 1289658 - RNA, 15 nt, Homo sapiens
ggcccugugccuugg

SEQ ID NO: 1289659 - RNA, 15 nt, Homo sapiens
ggccgcuguggccuu

SEQ ID NO: 1289660 - RNA, 17 nt, Homo sapiens
ggccgcuucgccauugc

SEQ ID NO: 1289661 - RNA, 12 nt, Homo sapiens
ggccucaaggga

SEQ ID NO: 1289662 - RNA, 17 nt, Homo sapiens
ggccuccugucccucau

SEQ ID NO: 1289663 - RNA, 21 nt, Homo sapiens
ggccugaagucccagcauuga

SEQ ID NO: 1289664 - RNA, 15 nt, Homo sapiens
ggccugagauuucau

SEQ ID NO: 1289665 - RNA, 16 nt, Homo sapiens
ggccuugcuaccucaa

SEQ ID NO: 1289666 - RNA, 21 nt, Homo sapiens
ggcgagaaacaagacaagcuc

SEQ ID NO: 1289667 - RNA, 16 nt, Homo sapiens
ggcggaucuuuggaca

SEQ ID NO: 1289668 - RNA, 23 nt, Homo sapiens
ggcggaucuuuggacagaagcag

SEQ ID NO: 1289669 - RNA, 14 nt, Homo sapiens
ggcucacacugaga

SEQ ID NO: 1289670 - RNA, 19 nt, Homo sapiens
ggcuccccucgacagcucu

SEQ ID NO: 1289671 - RNA, 21 nt, Homo sapiens
ggcucugagagccccaggacu

SEQ ID NO: 1289672 - RNA, 12 nt, Homo sapiens
ggcucuucucau

SEQ ID NO: 1289673 - RNA, 16 nt, Homo sapiens
ggcucuucucauuuca

SEQ ID NO: 1289674 - RNA, 19 nt, Homo sapiens
ggcuggagugcaguggcgu

SEQ ID NO: 1289675 - RNA, 20 nt, Homo sapiens
ggcuuacacccacaguggaa

SEQ ID NO: 1289676 - RNA, 21 nt, Homo sapiens
ggcuucuguugucaccuucac

SEQ ID NO: 1289677 - RNA, 13 nt, Homo sapiens
ggcuuuugaacug

SEQ ID NO: 1289678 - RNA, 18 nt, Homo sapiens
ggcuuuuggcagcaaagu

SEQ ID NO: 1289679 - RNA, 15 nt, Homo sapiens
gggaaaucaggguua

SEQ ID NO: 1289680 - RNA, 15 nt, Homo sapiens
gggaauugcagagua

SEQ ID NO: 1289681 - RNA, 16 nt, Homo sapiens
gggaccacagacucac

SEQ ID NO: 1289682 - RNA, 17 nt, Homo sapiens
gggauguuucugucaca

SEQ ID NO: 1289683 - RNA, 22 nt, Homo sapiens
gggcuuggcugugcccucagau

SEQ ID NO: 1289684 - RNA, 16 nt, Homo sapiens
gggcuuuuacaccagu

SEQ ID NO: 1289685 - RNA, 15 nt, Homo sapiens
ggggaugucucucau

SEQ ID NO: 1289686 - RNA, 17 nt, Homo sapiens
ggguccaucucagagaa

SEQ ID NO: 1289687 - RNA, 19 nt, Homo sapiens
ggguccuccuccagggaca

SEQ ID NO: 1289688 - RNA, 12 nt, Homo sapiens
gggugggaccac

SEQ ID NO: 1289689 - RNA, 21 nt, Homo sapiens
gguaaaaaggagaauuuuucc

SEQ ID NO: 1289690 - RNA, 21 nt, Homo sapiens
gguacagacacucccacuugg

SEQ ID NO: 1289691 - RNA, 16 nt, Homo sapiens
ggucaaguaagaagac

SEQ ID NO: 1289692 - RNA, 20 nt, Homo sapiens
ggucagggccccucuaccca

SEQ ID NO: 1289693 - RNA, 17 nt, Homo sapiens
ggucauaaugaacacuc

SEQ ID NO: 1289694 - RNA, 15 nt, Homo sapiens
gguccaugcaggggc

SEQ ID NO: 1289695 - RNA, 18 nt, Homo sapiens
ggucuuacuuugugcaaa

SEQ ID NO: 1289696 - RNA, 13 nt, Homo sapiens
ggucuucuuacau

SEQ ID NO: 1289697 - RNA, 17 nt, Homo sapiens
ggugcaugaagguuucu

SEQ ID NO: 1289698 - RNA, 18 nt, Homo sapiens
ggugggaccacagacuca

SEQ ID NO: 1289699 - RNA, 13 nt, Homo sapiens
ggugggggguccc

SEQ ID NO: 1289700 - RNA, 13 nt, Homo sapiens
gguguugacaugu

SEQ ID NO: 1289701 - RNA, 16 nt, Homo sapiens
gguuccggcauggaca

SEQ ID NO: 1289702 - RNA, 21 nt, Homo sapiens
gguuccucaggugaccaaaac

SEQ ID NO: 1289703 - RNA, 11 nt, Homo sapiens
gguucucaggc

SEQ ID NO: 1289704 - RNA, 17 nt, Homo sapiens
gguuucuccagagggaa

SEQ ID NO: 1289705 - RNA, 21 nt, Homo sapiens
gguuucuggcagccaguaccu

SEQ ID NO: 1289706 - RNA, 18 nt, Homo sapiens
guaaagugaacaaaaagg

SEQ ID NO: 1289707 - RNA, 16 nt, Homo sapiens
guaagcagaauggagu

SEQ ID NO: 1289708 - RNA, 11 nt, Homo sapiens
guaagcuuuaa

SEQ ID NO: 1289709 - RNA, 18 nt, Homo sapiens
guaaguuuaugcauacag

SEQ ID NO: 1289710 - RNA, 15 nt, Homo sapiens
guaaucuaaguauau

SEQ ID NO: 1289711 - RNA, 15 nt, Homo sapiens
guaaucucggcucac

SEQ ID NO: 1289712 - RNA, 18 nt, Homo sapiens
guaauuuaaaauugugau

SEQ ID NO: 1289713 - RNA, 19 nt, Homo sapiens
guaauuuuaaguaauuuca

SEQ ID NO: 1289714 - RNA, 22 nt, Homo sapiens
guacaagguauguacaguucau

SEQ ID NO: 1289715 - RNA, 16 nt, Homo sapiens
guaccacguauuccag

SEQ ID NO: 1289716 - RNA, 16 nt, Homo sapiens
uuuauauuugugugag

SEQ ID NO: 1289717 - RNA, 12 nt, Homo sapiens
uuuaugguucuc

SEQ ID NO: 1289718 - RNA, 13 nt, Homo sapiens
uuucaaauuuacu

SEQ ID NO: 1289719 - RNA, 14 nt, Homo sapiens
uuucacauaugugu

SEQ ID NO: 1289720 - RNA, 19 nt, Homo sapiens
uuucacuuaauaaugugua

SEQ ID NO: 1289721 - RNA, 19 nt, Homo sapiens
uuucagugaaagcaucacu

SEQ ID NO: 1289722 - RNA, 21 nt, Homo sapiens
uuuccauaaucacucagugau

SEQ ID NO: 1289723 - RNA, 15 nt, Homo sapiens
uuuccuuugcgcaaa

SEQ ID NO: 1289724 - RNA, 22 nt, Homo sapiens
uuucugucacaucagcuccacu

SEQ ID NO: 1289725 - RNA, 22 nt, Homo sapiens
uuugaaugguuuucuaauaucu

SEQ ID NO: 1289726 - RNA, 22 nt, Homo sapiens
uuugcagcuuucucuaguucaa

SEQ ID NO: 1289727 - RNA, 16 nt, Homo sapiens
uuugcugcuguggaaa

SEQ ID NO: 1289728 - RNA, 19 nt, Homo sapiens
uuuggagcauuaacuaaau

SEQ ID NO: 1289729 - RNA, 17 nt, Homo sapiens
uuuggggacucauuuca

SEQ ID NO: 1289730 - RNA, 18 nt, Homo sapiens
uuugucuagaacacucag

SEQ ID NO: 1289731 - RNA, 13 nt, Homo sapiens
uuugucucugcag

SEQ ID NO: 1289732 - RNA, 16 nt, Homo sapiens
uuugugacuuuccuaa

SEQ ID NO: 1289733 - RNA, 14 nt, Homo sapiens
uuugugauucccuc

SEQ ID NO: 1289734 - RNA, 14 nt, Homo sapiens
uuugugugcgucac

SEQ ID NO: 1289735 - RNA, 18 nt, Homo sapiens
uuuguuauuuuuccccaa

SEQ ID NO: 1289736 - RNA, 13 nt, Homo sapiens
uuuguuccaugag

SEQ ID NO: 1289737 - RNA, 16 nt, Homo sapiens
uuuguugagucucuga

SEQ ID NO: 1289738 - RNA, 22 nt, Homo sapiens
uuuguuuauuuaaaaugccuau

SEQ ID NO: 1289739 - RNA, 14 nt, Homo sapiens
uuuuaaacauucuu

SEQ ID NO: 1289740 - RNA, 18 nt, Homo sapiens
uuuuaauuagaaauaucu

SEQ ID NO: 1289741 - RNA, 18 nt, Homo sapiens
uuuuaauuuauacuggca

SEQ ID NO: 1289742 - RNA, 15 nt, Homo sapiens
uuuuacuuugguuua

SEQ ID NO: 1289743 - RNA, 19 nt, Homo sapiens
uuuuaguuuaaaaucuugc

SEQ ID NO: 1289744 - RNA, 18 nt, Homo sapiens
uuuuaucuugaguguuau

SEQ ID NO: 1289745 - RNA, 18 nt, Homo sapiens
uuuuaugaaacauuacag

SEQ ID NO: 1289746 - RNA, 13 nt, Homo sapiens
uuuugcacauucu

SEQ ID NO: 1289747 - RNA, 14 nt, Homo sapiens
uuuugcacauucua

SEQ ID NO: 1289748 - RNA, 19 nt, Homo sapiens
uuuuggcagcaaaguguca

SEQ ID NO: 1289749 - RNA, 12 nt, Homo sapiens
uuuuugaaucua

SEQ ID NO: 1289750 - RNA, 13 nt, Homo sapiens
uuuuuuucuccuc

SEQ ID NO: 1289751 - RNA, 22 nt, Homo sapiens
gagauccaucaagacaauggga

SEQ ID NO: 1289752 - RNA, 14 nt, Homo sapiens
gagauggugcuaaa

SEQ ID NO: 1289753 - RNA, 16 nt, Homo sapiens
gagauuugguguacaa

SEQ ID NO: 1289754 - RNA, 21 nt, Homo sapiens
gagcagugcuugaaugaaguu

SEQ ID NO: 1289755 - RNA, 13 nt, Homo sapiens
gagcccaguuuca

SEQ ID NO: 1289756 - RNA, 17 nt, Homo sapiens
gagccuaggccaggugc

SEQ ID NO: 1289757 - RNA, 17 nt, Homo sapiens
gagcgcuaccucuccag

SEQ ID NO: 1289758 - RNA, 19 nt, Homo sapiens
gagcuaggaagagucuacc

SEQ ID NO: 1289759 - RNA, 18 nt, Homo sapiens
gagcucagagaggcuaga

SEQ ID NO: 1289760 - RNA, 15 nt, Homo sapiens
gagcugcaggggcau

SEQ ID NO: 1289761 - RNA, 16 nt, Homo sapiens
gagcugggauguuucu

SEQ ID NO: 1289762 - RNA, 19 nt, Homo sapiens
gagcuuuuuguucccucau

SEQ ID NO: 1289763 - RNA, 12 nt, Homo sapiens
gaggaagggaca

SEQ ID NO: 1289764 - RNA, 15 nt, Homo sapiens
gaggacuucugcauc

SEQ ID NO: 1289765 - RNA, 15 nt, Homo sapiens
gaggcaaagaacaau

SEQ ID NO: 1289766 - RNA, 17 nt, Homo sapiens
gaguacaccccaacagc

SEQ ID NO: 1289767 - RNA, 19 nt, Homo sapiens
gaguacuggcugauggagu

SEQ ID NO: 1289768 - RNA, 17 nt, Homo sapiens
gagucucugaacauccu

SEQ ID NO: 1289769 - RNA, 18 nt, Homo sapiens
gagugcccccaacagcac

SEQ ID NO: 1289770 - RNA, 23 nt, Homo sapiens
gaguggcugggaggaagccagaa

SEQ ID NO: 1289771 - RNA, 23 nt, Homo sapiens
gaguggcuucacuccugcuguaa

SEQ ID NO: 1289772 - RNA, 13 nt, Homo sapiens
gauaaacuuugaa

SEQ ID NO: 1289773 - RNA, 18 nt, Homo sapiens
gauaagggugucuuccua

SEQ ID NO: 1289774 - RNA, 20 nt, Homo sapiens
gauaaguucuaguugcuugu

SEQ ID NO: 1289775 - RNA, 20 nt, Homo sapiens
gauaauguucuccacugaca

SEQ ID NO: 1289776 - RNA, 20 nt, Homo sapiens
gauacaugguugugaccuga

SEQ ID NO: 1289777 - RNA, 20 nt, Homo sapiens
gauauaaagaaauaccugag

SEQ ID NO: 1289778 - RNA, 11 nt, Homo sapiens
gauauucucau

SEQ ID NO: 1289779 - RNA, 20 nt, Homo sapiens
gaucaacaucuuuucuugcc

SEQ ID NO: 1289780 - RNA, 18 nt, Homo sapiens
gauccacuucucucagga

SEQ ID NO: 1289781 - RNA, 18 nt, Homo sapiens
gauccaucucagucacuu

SEQ ID NO: 1289782 - RNA, 19 nt, Homo sapiens
gaucccaggggaguguuca

SEQ ID NO: 1289783 - RNA, 14 nt, Homo sapiens
gaucuuuggacaga

SEQ ID NO: 1289784 - RNA, 13 nt, Homo sapiens
gaugaucaucucc

SEQ ID NO: 1289785 - RNA, 22 nt, Homo sapiens
gaugcauagccuggacacagag

SEQ ID NO: 1289786 - RNA, 20 nt, Homo sapiens
gauguaccagcaucucccag

SEQ ID NO: 1289787 - RNA, 23 nt, Homo sapiens
gaugucucacauccucugucuau

SEQ ID NO: 1289788 - RNA, 19 nt, Homo sapiens
gauuaugacuaaaguacca

SEQ ID NO: 1289789 - RNA, 19 nt, Homo sapiens
gauuaugagacacaggaug

SEQ ID NO: 1289790 - RNA, 21 nt, Homo sapiens
gauuucaucugcucuccuucc

SEQ ID NO: 1289791 - RNA, 17 nt, Homo sapiens
gauuuccucugaauuau

SEQ ID NO: 1289792 - RNA, 21 nt, Homo sapiens
gauuuuucucaaaguuuugaa

SEQ ID NO: 1289793 - RNA, 19 nt, Homo sapiens
gcaaccccaucauccucag

SEQ ID NO: 1289794 - RNA, 14 nt, Homo sapiens
gcaagucacuggcc

SEQ ID NO: 1289795 - RNA, 22 nt, Homo sapiens
gcaauucuaacuuuuuugcuau

SEQ ID NO: 1289796 - RNA, 12 nt, Homo sapiens
gcacacaggaag

SEQ ID NO: 1289797 - RNA, 22 nt, Homo sapiens
gcacacaggaaggaaagcgcag

SEQ ID NO: 1289798 - RNA, 18 nt, Homo sapiens
gcacauaucuccucuugg

SEQ ID NO: 1289799 - RNA, 14 nt, Homo sapiens
gcaccaacuuugaa

SEQ ID NO: 1289800 - RNA, 18 nt, Homo sapiens
gcaccgcuucucagccac

SEQ ID NO: 1289801 - RNA, 21 nt, Homo sapiens
gcagaaucuguuaccagagga

SEQ ID NO: 1289802 - RNA, 22 nt, Homo sapiens
gcagagagccauuuugugaaug

SEQ ID NO: 1289803 - RNA, 18 nt, Homo sapiens
gcagauccagagguuucu

SEQ ID NO: 1289804 - RNA, 22 nt, Homo sapiens
gcagcuaccagguguucuacac

SEQ ID NO: 1289805 - RNA, 12 nt, Homo sapiens
gcaggaagccaa

SEQ ID NO: 1289806 - RNA, 20 nt, Homo sapiens
gcaggcacuucacacaguaa

SEQ ID NO: 1289807 - RNA, 23 nt, Homo sapiens
gcaggcaugagucagucugauga

SEQ ID NO: 1289808 - RNA, 21 nt, Homo sapiens
gcaggcuucugugugcugcua

SEQ ID NO: 1289809 - RNA, 17 nt, Homo sapiens
gcagggacaucaucucu

SEQ ID NO: 1289810 - RNA, 14 nt, Homo sapiens
gcagggauucuucc

SEQ ID NO: 1289811 - RNA, 15 nt, Homo sapiens
gcagugacagaacua

SEQ ID NO: 1289812 - RNA, 18 nt, Homo sapiens
gcagugagugccaugcuu

SEQ ID NO: 1289813 - RNA, 16 nt, Homo sapiens
gcaguuggccaaaacu

SEQ ID NO: 1289814 - RNA, 20 nt, Homo sapiens
gcaguuucauguauguauau

SEQ ID NO: 1289815 - RNA, 16 nt, Homo sapiens
gcauaaaaaacaugug

SEQ ID NO: 1289816 - RNA, 13 nt, Homo sapiens
gcaucaaacauga

SEQ ID NO: 1289817 - RNA, 11 nt, Homo sapiens
gcaucauucac

SEQ ID NO: 1289818 - RNA, 17 nt, Homo sapiens
gcaucucugaacauuuc

SEQ ID NO: 1289819 - RNA, 15 nt, Homo sapiens
gcauggagcauggga

SEQ ID NO: 1289820 - RNA, 18 nt, Homo sapiens
gcauguguauauauguca

SEQ ID NO: 1289821 - RNA, 17 nt, Homo sapiens
gcauuguaacuuaugaa

SEQ ID NO: 1289822 - RNA, 20 nt, Homo sapiens
gccacaggccugagauuuca

SEQ ID NO: 1289823 - RNA, 24 nt, Homo sapiens
gccagcaccugcgggagcugcacu

SEQ ID NO: 1289824 - RNA, 12 nt, Homo sapiens
gccagugcucag

SEQ ID NO: 1289825 - RNA, 17 nt, Homo sapiens
gccauggugauggugua

SEQ ID NO: 1289826 - RNA, 23 nt, Homo sapiens
gccauguugugccucccugguga

SEQ ID NO: 1289827 - RNA, 20 nt, Homo sapiens
gccauucuugcauugauaua

SEQ ID NO: 1289828 - RNA, 20 nt, Homo sapiens
gcccaguuucacugccauau

SEQ ID NO: 1289829 - RNA, 20 nt, Homo sapiens
gcccccugcaggaaggagcu

SEQ ID NO: 1289830 - RNA, 15 nt, Homo sapiens
gcccccuuccucacc

SEQ ID NO: 1289831 - RNA, 13 nt, Homo sapiens
gccccucuaccca

SEQ ID NO: 1289832 - RNA, 19 nt, Homo sapiens
gcccucagauuccgcacca

SEQ ID NO: 1289833 - RNA, 16 nt, Homo sapiens
gcccugcggccagggu

SEQ ID NO: 1289834 - RNA, 16 nt, Homo sapiens
gcccuguuggcagcuc

SEQ ID NO: 1289835 - RNA, 11 nt, Homo sapiens
gcccuuuucag

SEQ ID NO: 1289836 - RNA, 20 nt, Homo sapiens
gccgggcagaggggcagaug

SEQ ID NO: 1289837 - RNA, 13 nt, Homo sapiens
gccuagauaugaa

SEQ ID NO: 1289838 - RNA, 14 nt, Homo sapiens
gccucaagaucaau

SEQ ID NO: 1289839 - RNA, 23 nt, Homo sapiens
gccucacuuaugagaugccugaa

SEQ ID NO: 1289840 - RNA, 16 nt, Homo sapiens
gccucagccuccugag

SEQ ID NO: 1289841 - RNA, 14 nt, Homo sapiens
gccucauugcuugg

SEQ ID NO: 1289842 - RNA, 21 nt, Homo sapiens
gccuccuuuccccucccucag

SEQ ID NO: 1289843 - RNA, 15 nt, Homo sapiens
gccucgaaaguguca

SEQ ID NO: 1289844 - RNA, 14 nt, Homo sapiens
gccucgagugcccc

SEQ ID NO: 1289845 - RNA, 15 nt, Homo sapiens
gccucuuuuccccau

SEQ ID NO: 1289846 - RNA, 13 nt, Homo sapiens
gccuucaaacucc

SEQ ID NO: 1289847 - RNA, 18 nt, Homo sapiens
gccuucccaggaguacac

SEQ ID NO: 1289848 - RNA, 12 nt, Homo sapiens
gcgcaacauuuc

SEQ ID NO: 1289849 - RNA, 13 nt, Homo sapiens
gcgcaacauuucu

SEQ ID NO: 1289850 - RNA, 15 nt, Homo sapiens
gcgcaagcugggagc

SEQ ID NO: 1289851 - RNA, 23 nt, Homo sapiens
gcgccaaauaaugucucugugag

SEQ ID NO: 1289852 - RNA, 23 nt, Homo sapiens
gcgcuauugcuucagcugcugaa

SEQ ID NO: 1289853 - RNA, 12 nt, Homo sapiens
gcgucacuguga

SEQ ID NO: 1289854 - RNA, 20 nt, Homo sapiens
gcuaaguugcaccaacuuug

SEQ ID NO: 1289855 - RNA, 23 nt, Homo sapiens
gcuaccagguguucuacacucau

SEQ ID NO: 1289856 - RNA, 15 nt, Homo sapiens
gcuaccuacugauaa

SEQ ID NO: 1289857 - RNA, 22 nt, Homo sapiens
gcucacacugagaauguaagaa

SEQ ID NO: 1289858 - RNA, 18 nt, Homo sapiens
gcuccauuuucuugucaa

SEQ ID NO: 1289859 - RNA, 14 nt, Homo sapiens
gcucuaucugcaau

SEQ ID NO: 1289860 - RNA, 17 nt, Homo sapiens
gcugaaauaaaaauaca

SEQ ID NO: 1289861 - RNA, 18 nt, Homo sapiens
gcugaguugguguugaca

SEQ ID NO: 1289862 - RNA, 18 nt, Homo sapiens
ucacuggggcaugagauu

SEQ ID NO: 1289863 - RNA, 15 nt, Homo sapiens
ucacuuccuauaugc

SEQ ID NO: 1289864 - RNA, 23 nt, Homo sapiens
ucacuuuuuuucuuuucucugcc

SEQ ID NO: 1289865 - RNA, 17 nt, Homo sapiens
ucagaaugagaaagccu

SEQ ID NO: 1289866 - RNA, 14 nt, Homo sapiens
ucagagcuacacaa

SEQ ID NO: 1289867 - RNA, 18 nt, Homo sapiens
ucagauuccgcaccaaua

SEQ ID NO: 1289868 - RNA, 17 nt, Homo sapiens
ucagcaacagagcaaaa

SEQ ID NO: 1289869 - RNA, 14 nt, Homo sapiens
ucagccaaacagua

SEQ ID NO: 1289870 - RNA, 20 nt, Homo sapiens
ucagcgaaugacaaaaucau

SEQ ID NO: 1289871 - RNA, 20 nt, Homo sapiens
ucagcucccugccuguuucc

SEQ ID NO: 1289872 - RNA, 19 nt, Homo sapiens
ucagcucucaguugcagcc

SEQ ID NO: 1289873 - RNA, 20 nt, Homo sapiens
ucagcugagguucauuacaa

SEQ ID NO: 1289874 - RNA, 21 nt, Homo sapiens
ucaggacacuaauacaccagg

SEQ ID NO: 1289875 - RNA, 15 nt, Homo sapiens
ucagggagcauuuau

SEQ ID NO: 1289876 - RNA, 12 nt, Homo sapiens
ucaguaugugga

SEQ ID NO: 1289877 - RNA, 14 nt, Homo sapiens
ucagugaucucacu

SEQ ID NO: 1289878 - RNA, 23 nt, Homo sapiens
ucauaaagucuuugaagugacuu

SEQ ID NO: 1289879 - RNA, 12 nt, Homo sapiens
ucaucaggccau

SEQ ID NO: 1289880 - RNA, 19 nt, Homo sapiens
ucaucaugucaguuccaau

SEQ ID NO: 1289881 - RNA, 14 nt, Homo sapiens
ucaugagaagucac

SEQ ID NO: 1289882 - RNA, 14 nt, Homo sapiens
ucaugcauuugcac

SEQ ID NO: 1289883 - RNA, 18 nt, Homo sapiens
ucaugucaguuccaauga

SEQ ID NO: 1289884 - RNA, 18 nt, Homo sapiens
ucauuacagggcacaggc

SEQ ID NO: 1289885 - RNA, 20 nt, Homo sapiens
ucauuccuaacacagcaugu

SEQ ID NO: 1289886 - RNA, 23 nt, Homo sapiens
ucauucuagacccuauacauuuu

SEQ ID NO: 1289887 - RNA, 14 nt, Homo sapiens
ucauuuuguucuga

SEQ ID NO: 1289888 - RNA, 15 nt, Homo sapiens
uccaaaagcaaacaa

SEQ ID NO: 1289889 - RNA, 22 nt, Homo sapiens
uccaaaaggcccuuuucagggc

SEQ ID NO: 1289890 - RNA, 17 nt, Homo sapiens
uccaauaaagcauuuua

SEQ ID NO: 1289891 - RNA, 22 nt, Homo sapiens
uccacaccugcggcccaaucca

SEQ ID NO: 1289892 - RNA, 16 nt, Homo sapiens
uccaccucacuagcuc

SEQ ID NO: 1289893 - RNA, 18 nt, Homo sapiens
uccacguguaugcaagug

SEQ ID NO: 1289894 - RNA, 20 nt, Homo sapiens
uccacugacacaaaagaaga

SEQ ID NO: 1289895 - RNA, 18 nt, Homo sapiens
uccacugucuauguacaa

SEQ ID NO: 1289896 - RNA, 14 nt, Homo sapiens
uccagaccauucag

SEQ ID NO: 1289897 - RNA, 17 nt, Homo sapiens
uccagagggaauugcag

SEQ ID NO: 1289898 - RNA, 14 nt, Homo sapiens
uccagggacagcaa

SEQ ID NO: 1289899 - RNA, 21 nt, Homo sapiens
uccaguuauaagcguauuuag

SEQ ID NO: 1289900 - RNA, 23 nt, Homo sapiens
uccaucauauuaaaaauauacaa

SEQ ID NO: 1289901 - RNA, 15 nt, Homo sapiens
uccauguguaucugg

SEQ ID NO: 1289902 - RNA, 15 nt, Homo sapiens
uccauuaaauugccu

SEQ ID NO: 1289903 - RNA, 17 nt, Homo sapiens
uccauuuacuugaucau

SEQ ID NO: 1289904 - RNA, 21 nt, Homo sapiens
ucccacagcgcuggccgggac

SEQ ID NO: 1289905 - RNA, 17 nt, Homo sapiens
ucccacucuuaucuuac

SEQ ID NO: 1289906 - RNA, 19 nt, Homo sapiens
ucccaggcuggagugcagu

SEQ ID NO: 1289907 - RNA, 17 nt, Homo sapiens
ucccagguaauuuaaau

SEQ ID NO: 1289908 - RNA, 19 nt, Homo sapiens
ucccauuugggcaguauag

SEQ ID NO: 1289909 - RNA, 15 nt, Homo sapiens
uccccacugcucauu

SEQ ID NO: 1289910 - RNA, 13 nt, Homo sapiens
uccccucccucag

SEQ ID NO: 1289911 - RNA, 11 nt, Homo sapiens
ucccucaggcc

SEQ ID NO: 1289912 - RNA, 19 nt, Homo sapiens
ucccugaagucuugcauug

SEQ ID NO: 1289913 - RNA, 16 nt, Homo sapiens
ucccuucuaaccugaa

SEQ ID NO: 1289914 - RNA, 16 nt, Homo sapiens
uccgcuuucaugaaca

SEQ ID NO: 1289915 - RNA, 19 nt, Homo sapiens
uccggccuccugucccuca

SEQ ID NO: 1289916 - RNA, 13 nt, Homo sapiens
uccuaugcaauaa

SEQ ID NO: 1289917 - RNA, 14 nt, Homo sapiens
uccucaccacuucc

SEQ ID NO: 1289918 - RNA, 14 nt, Homo sapiens
uccuccagaccauu

SEQ ID NO: 1289919 - RNA, 17 nt, Homo sapiens
uccuccagggacagcaa

SEQ ID NO: 1289920 - RNA, 23 nt, Homo sapiens
uccuccagggacagcaacuauca

SEQ ID NO: 1289921 - RNA, 18 nt, Homo sapiens
uccucucccaaguucuuu

SEQ ID NO: 1289922 - RNA, 20 nt, Homo sapiens
uccugaguaguugggauuac

SEQ ID NO: 1289923 - RNA, 19 nt, Homo sapiens
uccugccugcggaccagau

SEQ ID NO: 1289924 - RNA, 13 nt, Homo sapiens
uccugcuguaaau

SEQ ID NO: 1289925 - RNA, 21 nt, Homo sapiens
uccugguuccuaggugagcag

SEQ ID NO: 1289926 - RNA, 19 nt, Homo sapiens
uccugucccucauccauag

SEQ ID NO: 1289927 - RNA, 18 nt, Homo sapiens
uccuuuccccucccucag

SEQ ID NO: 1289928 - RNA, 16 nt, Homo sapiens
uccuuuucccuauuuc

SEQ ID NO: 1289929 - RNA, 16 nt, Homo sapiens
ucgacagcucucuggg

SEQ ID NO: 1289930 - RNA, 16 nt, Homo sapiens
ucgagggacuuuaugu

SEQ ID NO: 1289931 - RNA, 20 nt, Homo sapiens
ucguccucccccacucccuc

SEQ ID NO: 1289932 - RNA, 21 nt, Homo sapiens
ucguguaauuggcccaaguca

SEQ ID NO: 1289933 - RNA, 23 nt, Homo sapiens
ucuaaaugcauauccugagccau

SEQ ID NO: 1289934 - RNA, 14 nt, Homo sapiens
ucuaaccauguauc

SEQ ID NO: 1289935 - RNA, 14 nt, Homo sapiens
ucuacacaacaugu

SEQ ID NO: 1289936 - RNA, 15 nt, Homo sapiens
ucuagaacacucagc

SEQ ID NO: 1289937 - RNA, 15 nt, Homo sapiens
ucuagagucauguga

SEQ ID NO: 1289938 - RNA, 16 nt, Homo sapiens
ucuaguuaacauuuca

SEQ ID NO: 1289939 - RNA, 17 nt, Homo sapiens
ucuaguuaacauuucaa

SEQ ID NO: 1289940 - RNA, 13 nt, Homo sapiens
ucuauaaagauca

SEQ ID NO: 1289941 - RNA, 20 nt, Homo sapiens
ucuaucuaaugacaugccua

SEQ ID NO: 1289942 - RNA, 19 nt, Homo sapiens
ucuauggguuggacaaccu

SEQ ID NO: 1289943 - RNA, 23 nt, Homo sapiens
ucucaagaagaacaucuuuaugg

SEQ ID NO: 1289944 - RNA, 14 nt, Homo sapiens
ucucaguugcagcc

SEQ ID NO: 1289945 - RNA, 20 nt, Homo sapiens
ucucauccugcaggcagcuu

SEQ ID NO: 1289946 - RNA, 16 nt, Homo sapiens
ucucaucuuucuugau

SEQ ID NO: 1289947 - RNA, 15 nt, Homo sapiens
ucucaugagaaguca

SEQ ID NO: 1289948 - RNA, 23 nt, Homo sapiens
ucuccaaaccacuuuuugcagcu

SEQ ID NO: 1289949 - RNA, 20 nt, Homo sapiens
ucuccagagggaauugcaga

SEQ ID NO: 1289950 - RNA, 23 nt, Homo sapiens
ucuccagagggaauugcagagua

SEQ ID NO: 1289951 - RNA, 17 nt, Homo sapiens
ucuccaguggaagggaa

SEQ ID NO: 1289952 - RNA, 22 nt, Homo sapiens
ucuccccacugcucauuuggau

SEQ ID NO: 1289953 - RNA, 19 nt, Homo sapiens
ucucuaguuuccagaggcu

SEQ ID NO: 1289954 - RNA, 13 nt, Homo sapiens
ucucucaugacca

SEQ ID NO: 1289955 - RNA, 16 nt, Homo sapiens
ucucucgcaagggaag

SEQ ID NO: 1289956 - RNA, 15 nt, Homo sapiens
ucucuggguuuacaa

SEQ ID NO: 1289957 - RNA, 21 nt, Homo sapiens
ucucuuuauauggccucaaga

SEQ ID NO: 1289958 - RNA, 15 nt, Homo sapiens
ucucuuucugcauaa

SEQ ID NO: 1289959 - RNA, 18 nt, Homo sapiens
ucugaaaauuaacacugc

SEQ ID NO: 1289960 - RNA, 19 nt, Homo sapiens
ucugaaaauuaacacugcu

SEQ ID NO: 1289961 - RNA, 13 nt, Homo sapiens
ucugaacauuucu

SEQ ID NO: 1289962 - RNA, 18 nt, Homo sapiens
ucugauuuuccuggacag

SEQ ID NO: 1289963 - RNA, 21 nt, Homo sapiens
ucugccaggugucuggucugu

SEQ ID NO: 1289964 - RNA, 15 nt, Homo sapiens
ucugccuucuuuaug

SEQ ID NO: 1289965 - RNA, 14 nt, Homo sapiens
ucuggacacagccc

SEQ ID NO: 1289966 - RNA, 17 nt, Homo sapiens
ucuguaaaagugucugu

SEQ ID NO: 1289967 - RNA, 21 nt, Homo sapiens
ucuguaaaugaagggucauuu

SEQ ID NO: 1289968 - RNA, 12 nt, Homo sapiens
ucuguaaucuuc

SEQ ID NO: 1289969 - RNA, 14 nt, Homo sapiens
ucuguaauguaggc

SEQ ID NO: 1289970 - RNA, 21 nt, Homo sapiens
ucugugaggggcucucucaug

SEQ ID NO: 1289971 - RNA, 13 nt, Homo sapiens
ucuguugccaugg

SEQ ID NO: 1289972 - RNA, 11 nt, Homo sapiens
ucuuacuuugu

SEQ ID NO: 1289973 - RNA, 15 nt, Homo sapiens
auggcagaagacacc

SEQ ID NO: 1289974 - RNA, 13 nt, Homo sapiens
auggccucaagau

SEQ ID NO: 1289975 - RNA, 18 nt, Homo sapiens
augggaaggguccaucuc

SEQ ID NO: 1289976 - RNA, 18 nt, Homo sapiens
augguaggucaaguaaua

SEQ ID NO: 1289977 - RNA, 18 nt, Homo sapiens
augguguaauaagacaua

SEQ ID NO: 1289978 - RNA, 22 nt, Homo sapiens
auguaauucagguaccacguau

SEQ ID NO: 1289979 - RNA, 16 nt, Homo sapiens
auguacaaaaccauuu

SEQ ID NO: 1289980 - RNA, 12 nt, Homo sapiens
auguacaggaug

SEQ ID NO: 1289981 - RNA, 19 nt, Homo sapiens
auguacuggagaguggcaa

SEQ ID NO: 1289982 - RNA, 17 nt, Homo sapiens
auguagcagauccccag

SEQ ID NO: 1289983 - RNA, 17 nt, Homo sapiens
auguauuagccagucau

SEQ ID NO: 1289984 - RNA, 14 nt, Homo sapiens
auguauuaguacaa

SEQ ID NO: 1289985 - RNA, 20 nt, Homo sapiens
augucccugaagucuugcau

SEQ ID NO: 1289986 - RNA, 21 nt, Homo sapiens
augucucugugagacucgaga

SEQ ID NO: 1289987 - RNA, 18 nt, Homo sapiens
augucuguagcuccucaa

SEQ ID NO: 1289988 - RNA, 17 nt, Homo sapiens
augucuguaucacucug

SEQ ID NO: 1289989 - RNA, 23 nt, Homo sapiens
augucuguauuucauucuuguug

SEQ ID NO: 1289990 - RNA, 17 nt, Homo sapiens
augugaucaucuuugcu

SEQ ID NO: 1289991 - RNA, 15 nt, Homo sapiens
auguggauacaguca

SEQ ID NO: 1289992 - RNA, 19 nt, Homo sapiens
augugggucaaggaauuaa

SEQ ID NO: 1289993 - RNA, 19 nt, Homo sapiens
aaggagaacaagagaccag

SEQ ID NO: 1289994 - RNA, 14 nt, Homo sapiens
aaggagagcauagg

SEQ ID NO: 1289995 - RNA, 24 nt, Homo sapiens
aaggagccaauugauuucaacaga

SEQ ID NO: 1289996 - RNA, 13 nt, Homo sapiens
aaggauguuuaua

SEQ ID NO: 1289997 - RNA, 18 nt, Homo sapiens
aaggcaggagaugcagca

SEQ ID NO: 1289998 - RNA, 13 nt, Homo sapiens
aaggcccuuuuca

SEQ ID NO: 1289999 - RNA, 16 nt, Homo sapiens
aagggaaaagcccaug

SEQ ID NO: 1290000 - RNA, 19 nt, Homo sapiens
aagggacaccaagccuugg

SEQ ID NO: 1290001 - RNA, 15 nt, Homo sapiens
aagggagaaaugcca

SEQ ID NO: 1290002 - RNA, 19 nt, Homo sapiens
aagggauggaaaaggaaga

SEQ ID NO: 1290003 - RNA, 18 nt, Homo sapiens
aagggaugucucacaucc

SEQ ID NO: 1290004 - RNA, 20 nt, Homo sapiens
aaggggaaguaucaaacuac

SEQ ID NO: 1290005 - RNA, 20 nt, Homo sapiens
gcuucucuacagacuccaaa

SEQ ID NO: 1290006 - RNA, 18 nt, Homo sapiens
gcuuggcugugcccucag

SEQ ID NO: 1290007 - RNA, 13 nt, Homo sapiens
gcuuuaauuucau

SEQ ID NO: 1290008 - RNA, 16 nt, Homo sapiens
gcuuuaauuucaugaa

SEQ ID NO: 1290009 - RNA, 13 nt, Homo sapiens
gcuuugauaaugu

SEQ ID NO: 1290010 - RNA, 21 nt, Homo sapiens
gcuuuguugaauaauacgugu

SEQ ID NO: 1290011 - RNA, 19 nt, Homo sapiens
gcuuuugguuauaaugugu

SEQ ID NO: 1290012 - RNA, 19 nt, Homo sapiens
ggaaacuggaugaggucau

SEQ ID NO: 1290013 - RNA, 18 nt, Homo sapiens
ggaaagacagcuucucau

SEQ ID NO: 1290014 - RNA, 13 nt, Homo sapiens
ggaaccaugaagc

SEQ ID NO: 1290015 - RNA, 16 nt, Homo sapiens
ggaacccucuaaggga

SEQ ID NO: 1290016 - RNA, 18 nt, Homo sapiens
ggaacuggaggcagggaa

SEQ ID NO: 1290017 - RNA, 14 nt, Homo sapiens
ggaaggagcugccu

SEQ ID NO: 1290018 - RNA, 13 nt, Homo sapiens
ggaauucaucucu

SEQ ID NO: 1290019 - RNA, 15 nt, Homo sapiens
ggacaccaagccuug

SEQ ID NO: 1290020 - RNA, 15 nt, Homo sapiens
ggacagaagcagcuc

SEQ ID NO: 1290021 - RNA, 16 nt, Homo sapiens
ggacagcaucaaagag

SEQ ID NO: 1290022 - RNA, 16 nt, Homo sapiens
ggacagcuuugauaau

SEQ ID NO: 1290023 - RNA, 12 nt, Homo sapiens
ggacaguggcag

SEQ ID NO: 1290024 - RNA, 17 nt, Homo sapiens
ggacaucaucucuucca

SEQ ID NO: 1290025 - RNA, 12 nt, Homo sapiens
ggaccucaaagg

SEQ ID NO: 1290026 - RNA, 17 nt, Homo sapiens
ggacuugcugguggaug

SEQ ID NO: 1290027 - RNA, 15 nt, Homo sapiens
ggaggcaacgccaga

SEQ ID NO: 1290028 - RNA, 14 nt, Homo sapiens
ggaguacaccccaa

SEQ ID NO: 1290029 - RNA, 17 nt, Homo sapiens
ggaguucauaguuggaa

SEQ ID NO: 1290030 - RNA, 12 nt, Homo sapiens
ggauacagucau

SEQ ID NO: 1290031 - RNA, 14 nt, Homo sapiens
ggauacugcugcgu

SEQ ID NO: 1290032 - RNA, 13 nt, Homo sapiens
ggaucuuuggaca

SEQ ID NO: 1290033 - RNA, 22 nt, Homo sapiens
ggaugaaggccucccugucuaa

SEQ ID NO: 1290034 - RNA, 13 nt, Homo sapiens
ggauuaccauuca

SEQ ID NO: 1290035 - RNA, 16 nt, Homo sapiens
ggauuaugcccaugaa

SEQ ID NO: 1290036 - RNA, 22 nt, Homo sapiens
ggcaaggauggguccagaagac

SEQ ID NO: 1290037 - RNA, 19 nt, Homo sapiens
ggcagaucccacuugcagc

SEQ ID NO: 1290038 - RNA, 13 nt, Homo sapiens
ggcauaccaaaau

SEQ ID NO: 1290039 - RNA, 18 nt, Homo sapiens
ggcauuguguucacugua

SEQ ID NO: 1290040 - RNA, 19 nt, Homo sapiens
ggccagaaaaaaguguuua

SEQ ID NO: 1290041 - RNA, 11 nt, Homo sapiens
ggccagcacca

SEQ ID NO: 1290042 - RNA, 11 nt, Homo sapiens
ggccuaugaaa

SEQ ID NO: 1290043 - RNA, 19 nt, Homo sapiens
ggccuccugugcaucugua

SEQ ID NO: 1290044 - RNA, 14 nt, Homo sapiens
ggccugacucucag

SEQ ID NO: 1290045 - RNA, 19 nt, Homo sapiens
ggccuuguccucagccagu

SEQ ID NO: 1290046 - RNA, 18 nt, Homo sapiens
ggcuucacuguauaaaua

SEQ ID NO: 1290047 - RNA, 14 nt, Homo sapiens
ggcuuuuccaaaag

SEQ ID NO: 1290048 - RNA, 19 nt, Homo sapiens
gggaagaucugguauuucc

SEQ ID NO: 1290049 - RNA, 21 nt, Homo sapiens
gggaaggguccaucucagaga

SEQ ID NO: 1290050 - RNA, 19 nt, Homo sapiens
gggaggaagccagaaucaa

SEQ ID NO: 1290051 - RNA, 20 nt, Homo sapiens
gggagugcccccaacagcac

SEQ ID NO: 1290052 - RNA, 14 nt, Homo sapiens
gggaguguguaauu

SEQ ID NO: 1290053 - RNA, 22 nt, Homo sapiens
gggccacucaggggucauucau

SEQ ID NO: 1290054 - RNA, 16 nt, Homo sapiens
gggcgagaaacaagac

SEQ ID NO: 1290055 - RNA, 16 nt, Homo sapiens
gggcucagaguggggu

SEQ ID NO: 1290056 - RNA, 14 nt, Homo sapiens
gggcucucucauga

SEQ ID NO: 1290057 - RNA, 19 nt, Homo sapiens
gggcugauuguauuuaccu

SEQ ID NO: 1290058 - RNA, 20 nt, Homo sapiens
gggcuuuuccaaaagcaaac

SEQ ID NO: 1290059 - RNA, 15 nt, Homo sapiens
ggggaucaccucucu

SEQ ID NO: 1290060 - RNA, 23 nt, Homo sapiens
ggggcgagaaacaagacaagcuc

SEQ ID NO: 1290061 - RNA, 17 nt, Homo sapiens
ggggcuuuuacaccagu

SEQ ID NO: 1290062 - RNA, 13 nt, Homo sapiens
ggucauaaugaac

SEQ ID NO: 1290063 - RNA, 11 nt, Homo sapiens
ggucauuugcu

SEQ ID NO: 1290064 - RNA, 15 nt, Homo sapiens
gguccaucucagaga

SEQ ID NO: 1290065 - RNA, 17 nt, Homo sapiens
gguccccucugccccac

SEQ ID NO: 1290066 - RNA, 17 nt, Homo sapiens
gguccgaagucuuccau

SEQ ID NO: 1290067 - RNA, 18 nt, Homo sapiens
gguccuccuccagggaca

SEQ ID NO: 1290068 - RNA, 18 nt, Homo sapiens
ggugacguagaauugagu

SEQ ID NO: 1290069 - RNA, 18 nt, Homo sapiens
ggugagagggccgggcag

SEQ ID NO: 1290070 - RNA, 16 nt, Homo sapiens
ggugcaaccagggagc

SEQ ID NO: 1290071 - RNA, 15 nt, Homo sapiens
ggugcuacuuuauaa

SEQ ID NO: 1290072 - RNA, 12 nt, Homo sapiens
ggugugcuguau

SEQ ID NO: 1290073 - RNA, 22 nt, Homo sapiens
gguucacagaagcacagcaccc

SEQ ID NO: 1290074 - RNA, 21 nt, Homo sapiens
gguuccggcauggacaaugga

SEQ ID NO: 1290075 - RNA, 16 nt, Homo sapiens
gguuuacaacaaacac

SEQ ID NO: 1290076 - RNA, 21 nt, Homo sapiens
guaaauaauauaaaauguuuc

SEQ ID NO: 1290077 - RNA, 14 nt, Homo sapiens
guaaaugaacugau

SEQ ID NO: 1290078 - RNA, 21 nt, Homo sapiens
guaaguuuaugcauacaguaa

SEQ ID NO: 1290079 - RNA, 14 nt, Homo sapiens
guaaguuucaggug

SEQ ID NO: 1290080 - RNA, 19 nt, Homo sapiens
guaauuggcccaagucauu

SEQ ID NO: 1290081 - RNA, 19 nt, Homo sapiens
guacaccccaacagcaccc

SEQ ID NO: 1290082 - RNA, 13 nt, Homo sapiens
guacagacacucc

SEQ ID NO: 1290083 - RNA, 24 nt, Homo sapiens
agaaaaaaguguuuauaaugcaau

SEQ ID NO: 1290084 - RNA, 13 nt, Homo sapiens
agaaaaauuaauu

SEQ ID NO: 1290085 - RNA, 22 nt, Homo sapiens
agaaagacuuaucaacauuugu

SEQ ID NO: 1290086 - RNA, 14 nt, Homo sapiens
agaaagccugagaa

SEQ ID NO: 1290087 - RNA, 10 nt, Homo sapiens
agaaauaucu

SEQ ID NO: 1290088 - RNA, 11 nt, Homo sapiens
agaaaugccag

SEQ ID NO: 1290089 - RNA, 16 nt, Homo sapiens
agaaauuaacacccaa

SEQ ID NO: 1290090 - RNA, 22 nt, Homo sapiens
agaaauuccaggaaaaucugca

SEQ ID NO: 1290091 - RNA, 23 nt, Homo sapiens
agaaauuccaggaaaaucugcac

SEQ ID NO: 1290092 - RNA, 16 nt, Homo sapiens
agaacacucagcugcu

SEQ ID NO: 1290093 - RNA, 23 nt, Homo sapiens
agaacggggcucuucucauuuca

SEQ ID NO: 1290094 - RNA, 12 nt, Homo sapiens
agaacucugaau

SEQ ID NO: 1290095 - RNA, 18 nt, Homo sapiens
agaagacaccagagcaga

SEQ ID NO: 1290096 - RNA, 13 nt, Homo sapiens
agaagccagcuuu

SEQ ID NO: 1290097 - RNA, 20 nt, Homo sapiens
agaagcuguuguacauuuau

SEQ ID NO: 1290098 - RNA, 15 nt, Homo sapiens
agaaggcuaugggga

SEQ ID NO: 1290099 - RNA, 13 nt, Homo sapiens
agaaguacuuugu

SEQ ID NO: 1290100 - RNA, 17 nt, Homo sapiens
agaauguauuaguacaa

SEQ ID NO: 1290101 - RNA, 13 nt, Homo sapiens
agaauucccugug

SEQ ID NO: 1290102 - RNA, 16 nt, Homo sapiens
agaauugagucuucca

SEQ ID NO: 1290103 - RNA, 23 nt, Homo sapiens
agacacucccacuuggcaucauu

SEQ ID NO: 1290104 - RNA, 15 nt, Homo sapiens
agacagcuucucauc

SEQ ID NO: 1290105 - RNA, 16 nt, Homo sapiens
agacaucagcccuugg

SEQ ID NO: 1290106 - RNA, 12 nt, Homo sapiens
agacaucugccu

SEQ ID NO: 1290107 - RNA, 18 nt, Homo sapiens
agacauuugcuaugagcu

SEQ ID NO: 1290108 - RNA, 19 nt, Homo sapiens
agacauuugcuaugagcug

SEQ ID NO: 1290109 - RNA, 19 nt, Homo sapiens
agaccauauaacugugaug

SEQ ID NO: 1290110 - RNA, 15 nt, Homo sapiens
agacccaaaccauac

SEQ ID NO: 1290111 - RNA, 20 nt, Homo sapiens
agacgcagacaugugcacuu

SEQ ID NO: 1290112 - RNA, 22 nt, Homo sapiens
agacuaugaggaauauuugcaa

SEQ ID NO: 1290113 - RNA, 17 nt, Homo sapiens
agacucacauccugacc

SEQ ID NO: 1290114 - RNA, 14 nt, Homo sapiens
agacuuugcuguua

SEQ ID NO: 1290115 - RNA, 20 nt, Homo sapiens
agagagccauuuugugaaug

SEQ ID NO: 1290116 - RNA, 14 nt, Homo sapiens
agagagugcuauug

SEQ ID NO: 1290117 - RNA, 23 nt, Homo sapiens
agagcaaaaaguguaauuccaca

SEQ ID NO: 1290118 - RNA, 18 nt, Homo sapiens
agagcagaacccuagucu

SEQ ID NO: 1290119 - RNA, 15 nt, Homo sapiens
agagcagaugcagag

SEQ ID NO: 1290120 - RNA, 22 nt, Homo sapiens
agagcccuucaugcauuugcac

SEQ ID NO: 1290121 - RNA, 23 nt, Homo sapiens
agagcccuucaugcauuugcacu

SEQ ID NO: 1290122 - RNA, 20 nt, Homo sapiens
agagcgcaagcugggagcac

SEQ ID NO: 1290123 - RNA, 17 nt, Homo sapiens
agagcugaacuauuaga

SEQ ID NO: 1290124 - RNA, 14 nt, Homo sapiens
agaggacacaucuc

SEQ ID NO: 1290125 - RNA, 15 nt, Homo sapiens
agaggacacaucucc

SEQ ID NO: 1290126 - RNA, 17 nt, Homo sapiens
agagggcuuucucagga

SEQ ID NO: 1290127 - RNA, 20 nt, Homo sapiens
agaggggccugccaccugga

SEQ ID NO: 1290128 - RNA, 17 nt, Homo sapiens
agaggugccacacugaa

SEQ ID NO: 1290129 - RNA, 21 nt, Homo sapiens
agagguuucuggcagccagua

SEQ ID NO: 1290130 - RNA, 13 nt, Homo sapiens
agaguacacccca

SEQ ID NO: 1290131 - RNA, 19 nt, Homo sapiens
agaguacaccccaacagca

SEQ ID NO: 1290132 - RNA, 21 nt, Homo sapiens
agagugggguagguugggaga

SEQ ID NO: 1290133 - RNA, 19 nt, Homo sapiens
agaguuguuguuugccaag

SEQ ID NO: 1290134 - RNA, 19 nt, Homo sapiens
agaucacuuuuuaaacuca

SEQ ID NO: 1290135 - RNA, 20 nt, Homo sapiens
agaugaauguagcagauccc

SEQ ID NO: 1290136 - RNA, 15 nt, Homo sapiens
agaugagaguacacc

SEQ ID NO: 1290137 - RNA, 16 nt, Homo sapiens
agaugagaguacaccc

SEQ ID NO: 1290138 - RNA, 15 nt, Homo sapiens
agaugggaaaaccau

SEQ ID NO: 1290139 - RNA, 21 nt, Homo sapiens
agaugggaaaaccaugguaau

SEQ ID NO: 1290140 - RNA, 13 nt, Homo sapiens
agauuaugaucuc

SEQ ID NO: 1290141 - RNA, 19 nt, Homo sapiens
agauuggcucacacugaga

SEQ ID NO: 1290142 - RNA, 20 nt, Homo sapiens
agauuggcucacacugagaa

SEQ ID NO: 1290143 - RNA, 20 nt, Homo sapiens
agauuugaacccagcuagaa

SEQ ID NO: 1290144 - RNA, 17 nt, Homo sapiens
agcaaagcuccugccuc

SEQ ID NO: 1290145 - RNA, 23 nt, Homo sapiens
agcaacccaggagccuaguacaa

SEQ ID NO: 1290146 - RNA, 22 nt, Homo sapiens
agcaacuaucagacuaagccag

SEQ ID NO: 1290147 - RNA, 22 nt, Homo sapiens
agcaacucagguuuuggcauua

SEQ ID NO: 1290148 - RNA, 16 nt, Homo sapiens
agcaagucacuggcca

SEQ ID NO: 1290149 - RNA, 24 nt, Homo sapiens
agcaagucucuuuauauggccuca

SEQ ID NO: 1290150 - RNA, 22 nt, Homo sapiens
agcacauuuggcuuacaguaaa

SEQ ID NO: 1290151 - RNA, 14 nt, Homo sapiens
agcacccucuccag

SEQ ID NO: 1290152 - RNA, 19 nt, Homo sapiens
agcacccucuccagaugag

SEQ ID NO: 1290153 - RNA, 21 nt, Homo sapiens
agcaccugcgggagcugcacu

SEQ ID NO: 1290154 - RNA, 10 nt, Homo sapiens
agcacugagg

SEQ ID NO: 1290155 - RNA, 23 nt, Homo sapiens
agcacugcuguguccgcuuucau

SEQ ID NO: 1290156 - RNA, 17 nt, Homo sapiens
agcagaguucuuugcaa

SEQ ID NO: 1290157 - RNA, 14 nt, Homo sapiens
agcagcaacugugu

SEQ ID NO: 1290158 - RNA, 17 nt, Homo sapiens
agcagguaguccaggau

SEQ ID NO: 1290159 - RNA, 16 nt, Homo sapiens
agcaguggcuccauug

SEQ ID NO: 1290160 - RNA, 22 nt, Homo sapiens
agcauauguuuuuguaaguuua

SEQ ID NO: 1290161 - RNA, 19 nt, Homo sapiens
agcauggcggcaucugcuu

SEQ ID NO: 1290162 - RNA, 15 nt, Homo sapiens
agcauggcugagaaa

SEQ ID NO: 1290163 - RNA, 22 nt, Homo sapiens
agcauguguauuuccagugcaa

SEQ ID NO: 1290164 - RNA, 23 nt, Homo sapiens
agcauuccuucuuugauaauguu

SEQ ID NO: 1290165 - RNA, 19 nt, Homo sapiens
agccacaaacccugccucu

SEQ ID NO: 1290166 - RNA, 15 nt, Homo sapiens
agccacaacugcagu

SEQ ID NO: 1290167 - RNA, 15 nt, Homo sapiens
agccacagacaauau

SEQ ID NO: 1290168 - RNA, 21 nt, Homo sapiens
agccacaggccugagauuuca

SEQ ID NO: 1290169 - RNA, 16 nt, Homo sapiens
agcccauuucuuuauu

SEQ ID NO: 1290170 - RNA, 17 nt, Homo sapiens
agccguaguggaauuaa

SEQ ID NO: 1290171 - RNA, 19 nt, Homo sapiens
agccuagcccuucucucau

SEQ ID NO: 1290172 - RNA, 15 nt, Homo sapiens
agccucagugaccca

SEQ ID NO: 1290173 - RNA, 14 nt, Homo sapiens
agccuggcuccaaa

SEQ ID NO: 1290174 - RNA, 18 nt, Homo sapiens
agccuggcuccaaacccu

SEQ ID NO: 1290175 - RNA, 20 nt, Homo sapiens
agccuggcuccaaacccucg

SEQ ID NO: 1290176 - RNA, 17 nt, Homo sapiens
agccuuggcucuacccu

SEQ ID NO: 1290177 - RNA, 19 nt, Homo sapiens
gcguguguagaguuaagaa

SEQ ID NO: 1290178 - RNA, 12 nt, Homo sapiens
gcuaaucugccu

SEQ ID NO: 1290179 - RNA, 16 nt, Homo sapiens
gcuacaggggccagaa

SEQ ID NO: 1290180 - RNA, 16 nt, Homo sapiens
gcuaccucuccagccu

SEQ ID NO: 1290181 - RNA, 18 nt, Homo sapiens
gcuaugguucucucgcaa

SEQ ID NO: 1290182 - RNA, 13 nt, Homo sapiens
gcucaggcagcuc

SEQ ID NO: 1290183 - RNA, 16 nt, Homo sapiens
gcuccaaaccuucaca

SEQ ID NO: 1290184 - RNA, 22 nt, Homo sapiens
gcuccacuuucagugaaagcau

SEQ ID NO: 1290185 - RNA, 20 nt, Homo sapiens
gcuccauugguguugacaua

SEQ ID NO: 1290186 - RNA, 18 nt, Homo sapiens
gcuccccaaucccugacc

SEQ ID NO: 1290187 - RNA, 14 nt, Homo sapiens
gcucgauuccucag

SEQ ID NO: 1290188 - RNA, 16 nt, Homo sapiens
gcucuagaaaguauag

SEQ ID NO: 1290189 - RNA, 15 nt, Homo sapiens
gcucuucucauuuca

SEQ ID NO: 1290190 - RNA, 22 nt, Homo sapiens
gcucuuuuauaacuugcauuac

SEQ ID NO: 1290191 - RNA, 20 nt, Homo sapiens
gcugaggcauccuuccucac

SEQ ID NO: 1290192 - RNA, 22 nt, Homo sapiens
gcugaggccucucauuccagag

SEQ ID NO: 1290193 - RNA, 18 nt, Homo sapiens
gcugcaggggcaugggaa

SEQ ID NO: 1290194 - RNA, 23 nt, Homo sapiens
gcugcauuccuagaaauugaagu

SEQ ID NO: 1290195 - RNA, 20 nt, Homo sapiens
gcugccggcuccccucgaca

SEQ ID NO: 1290196 - RNA, 11 nt, Homo sapiens
gcugccucuug

SEQ ID NO: 1290197 - RNA, 22 nt, Homo sapiens
gcugccucuugaaugcagggac

SEQ ID NO: 1290198 - RNA, 14 nt, Homo sapiens
gcugcucugugguc

SEQ ID NO: 1290199 - RNA, 15 nt, Homo sapiens
gcugggagcuucucu

SEQ ID NO: 1290200 - RNA, 17 nt, Homo sapiens
gcugggaggaagccaga

SEQ ID NO: 1290201 - RNA, 14 nt, Homo sapiens
gcuggggaugucuc

SEQ ID NO: 1290202 - RNA, 12 nt, Homo sapiens
gcuggugucuag

SEQ ID NO: 1290203 - RNA, 16 nt, Homo sapiens
gcuguuauucuuccac

SEQ ID NO: 1290204 - RNA, 14 nt, Homo sapiens
gcuuagcuugaggg

SEQ ID NO: 1290205 - RNA, 23 nt, Homo sapiens
gcuuauaaauggcaccacaucuu

SEQ ID NO: 1290206 - RNA, 15 nt, Homo sapiens
gcuucaggauacugu

SEQ ID NO: 1290207 - RNA, 20 nt, Homo sapiens
gcuuccuuagaacuucuaca

SEQ ID NO: 1290208 - RNA, 17 nt, Homo sapiens
gcuucucuacagacucc

SEQ ID NO: 1290209 - RNA, 13 nt, Homo sapiens
aaagugaugacau

SEQ ID NO: 1290210 - RNA, 21 nt, Homo sapiens
aaaguguaauuccacaucaug

SEQ ID NO: 1290211 - RNA, 17 nt, Homo sapiens
aaaguuaccuuacugaa

SEQ ID NO: 1290212 - RNA, 21 nt, Homo sapiens
aaaguugcuuuuauugcacca

SEQ ID NO: 1290213 - RNA, 20 nt, Homo sapiens
aaauaaaaucuaauuaauuc

SEQ ID NO: 1290214 - RNA, 17 nt, Homo sapiens
aaauaaagcuacugaau

SEQ ID NO: 1290215 - RNA, 20 nt, Homo sapiens
aaauaaagguuagauaaguc

SEQ ID NO: 1290216 - RNA, 14 nt, Homo sapiens
aaauaaauggauaa

SEQ ID NO: 1290217 - RNA, 18 nt, Homo sapiens
aaauacaguauucccacu

SEQ ID NO: 1290218 - RNA, 14 nt, Homo sapiens
aaauagaacuugau

SEQ ID NO: 1290219 - RNA, 17 nt, Homo sapiens
aaauaguuuugcuuugu

SEQ ID NO: 1290220 - RNA, 14 nt, Homo sapiens
aaauauauuugaua

SEQ ID NO: 1290221 - RNA, 22 nt, Homo sapiens
aaaucagagagggaagaucugg

SEQ ID NO: 1290222 - RNA, 15 nt, Homo sapiens
aaaucccuccuucau

SEQ ID NO: 1290223 - RNA, 17 nt, Homo sapiens
aaaugcaacaacaugua

SEQ ID NO: 1290224 - RNA, 20 nt, Homo sapiens
aaaugcauagagcaauuaaa

SEQ ID NO: 1290225 - RNA, 20 nt, Homo sapiens
aaaugcugugcaaacagugu

SEQ ID NO: 1290226 - RNA, 16 nt, Homo sapiens
aaauguacuacugagc

SEQ ID NO: 1290227 - RNA, 21 nt, Homo sapiens
aaaugugucugcaacauggau

SEQ ID NO: 1290228 - RNA, 14 nt, Homo sapiens
aaauguuggugcaa

SEQ ID NO: 1290229 - RNA, 12 nt, Homo sapiens
aaauguuucuca

SEQ ID NO: 1290230 - RNA, 13 nt, Homo sapiens
aaauuacccaguu

SEQ ID NO: 1290231 - RNA, 21 nt, Homo sapiens
aaauuucacuuaauaaugugu

SEQ ID NO: 1290232 - RNA, 21 nt, Homo sapiens
aaauuuggcuucuguugucac

SEQ ID NO: 1290233 - RNA, 13 nt, Homo sapiens
aaauuuguaaguu

SEQ ID NO: 1290234 - RNA, 23 nt, Homo sapiens
aaauuuuuuacuuuuaacuauuu

SEQ ID NO: 1290235 - RNA, 17 nt, Homo sapiens
aacaaguuaguuucuca

SEQ ID NO: 1290236 - RNA, 17 nt, Homo sapiens
aacaauuacauggcucu

SEQ ID NO: 1290237 - RNA, 19 nt, Homo sapiens
aacacacgggaagucuggu

SEQ ID NO: 1290238 - RNA, 17 nt, Homo sapiens
aacagaacuaucucagc

SEQ ID NO: 1290239 - RNA, 13 nt, Homo sapiens
aacagacugaccu

SEQ ID NO: 1290240 - RNA, 15 nt, Homo sapiens
aacagauuacuagaa

SEQ ID NO: 1290241 - RNA, 21 nt, Homo sapiens
aacauagaacucagagccaga

SEQ ID NO: 1290242 - RNA, 22 nt, Homo sapiens
aacauagccagauguagucuca

SEQ ID NO: 1290243 - RNA, 14 nt, Homo sapiens
aacauguucacuua

SEQ ID NO: 1290244 - RNA, 22 nt, Homo sapiens
aacauuucuugguuccaauaaa

SEQ ID NO: 1290245 - RNA, 22 nt, Homo sapiens
aaccauaccacacacauuauca

SEQ ID NO: 1290246 - RNA, 19 nt, Homo sapiens
aaccaugguaauaaaauau

SEQ ID NO: 1290247 - RNA, 23 nt, Homo sapiens
aacccuuuggauuaugcccauga

SEQ ID NO: 1290248 - RNA, 20 nt, Homo sapiens
aaccugggaaccaugaagcu

SEQ ID NO: 1290249 - RNA, 20 nt, Homo sapiens
aacuaccagugggcauguau

SEQ ID NO: 1290250 - RNA, 19 nt, Homo sapiens
aacuaucagacuaagccag

SEQ ID NO: 1290251 - RNA, 15 nt, Homo sapiens
aacuauguaaugcuu

SEQ ID NO: 1290252 - RNA, 21 nt, Homo sapiens
aacucaaggaaaucuguguca

SEQ ID NO: 1290253 - RNA, 23 nt, Homo sapiens
aacucugagcagugcuugaauga

SEQ ID NO: 1290254 - RNA, 17 nt, Homo sapiens
aacucugggcugccaug

SEQ ID NO: 1290255 - RNA, 18 nt, Homo sapiens
aacucugggcugccaugu

SEQ ID NO: 1290256 - RNA, 21 nt, Homo sapiens
aacucuuguauugcuccauuu

SEQ ID NO: 1290257 - RNA, 23 nt, Homo sapiens
aacugcccagcggacaguggcag

SEQ ID NO: 1290258 - RNA, 20 nt, Homo sapiens
aacugguauuuuaucuuuga

SEQ ID NO: 1290259 - RNA, 16 nt, Homo sapiens
aacuguaccaugugcu

SEQ ID NO: 1290260 - RNA, 18 nt, Homo sapiens
aacuuuuagguuguuacc

SEQ ID NO: 1290261 - RNA, 13 nt, Homo sapiens
aacuuuugugcuc

SEQ ID NO: 1290262 - RNA, 15 nt, Homo sapiens
aacuuuugugcuccc

SEQ ID NO: 1290263 - RNA, 22 nt, Homo sapiens
aagaaaauuuugggguaaaaag

SEQ ID NO: 1290264 - RNA, 15 nt, Homo sapiens
aagaaagacuuauca

SEQ ID NO: 1290265 - RNA, 13 nt, Homo sapiens
aagaaagcuuuag

SEQ ID NO: 1290266 - RNA, 17 nt, Homo sapiens
aagaaaguacagaacaa

SEQ ID NO: 1290267 - RNA, 13 nt, Homo sapiens
aagaaauucugca

SEQ ID NO: 1290268 - RNA, 14 nt, Homo sapiens
aagaaauucugcaa

SEQ ID NO: 1290269 - RNA, 11 nt, Homo sapiens
aagaacccagc

SEQ ID NO: 1290270 - RNA, 22 nt, Homo sapiens
aagaaucuucugccccagcuuu

SEQ ID NO: 1290271 - RNA, 16 nt, Homo sapiens
aagacaagcuccuccc

SEQ ID NO: 1290272 - RNA, 15 nt, Homo sapiens
aagacagcuucucau

SEQ ID NO: 1290273 - RNA, 23 nt, Homo sapiens
aagacaggacccugggaccacag

SEQ ID NO: 1290274 - RNA, 13 nt, Homo sapiens
aagacccauuccu

SEQ ID NO: 1290275 - RNA, 23 nt, Homo sapiens
aagacuauucccuucuaaccuga

SEQ ID NO: 1290276 - RNA, 15 nt, Homo sapiens
aagagauggugcuaa

SEQ ID NO: 1290277 - RNA, 23 nt, Homo sapiens
aagagauuccugagccaguguca

SEQ ID NO: 1290278 - RNA, 24 nt, Homo sapiens
aagaguucuauggagacuuugcug

SEQ ID NO: 1290279 - RNA, 17 nt, Homo sapiens
aagaugggaaaaccaug

SEQ ID NO: 1290280 - RNA, 16 nt, Homo sapiens
aagauuuuuucauuuc

SEQ ID NO: 1290281 - RNA, 12 nt, Homo sapiens
aagcaacaauac

SEQ ID NO: 1290282 - RNA, 12 nt, Homo sapiens
aagcacuuugug

SEQ ID NO: 1290283 - RNA, 22 nt, Homo sapiens
aagcauuuuacaagaucuugca

SEQ ID NO: 1290284 - RNA, 19 nt, Homo sapiens
aagccagcaccggaccagc

SEQ ID NO: 1290285 - RNA, 13 nt, Homo sapiens
aagccccagugag

SEQ ID NO: 1290286 - RNA, 19 nt, Homo sapiens
aagccuagcccuucucuca

SEQ ID NO: 1290287 - RNA, 15 nt, Homo sapiens
aagcucuaucugcaa

SEQ ID NO: 1290288 - RNA, 16 nt, Homo sapiens
aagcuuuaucuuugug

SEQ ID NO: 1290289 - RNA, 23 nt, Homo sapiens
aaggaagaaauuccaggaaaauc

SEQ ID NO: 1290290 - RNA, 15 nt, Homo sapiens
aaggacagcaucaaa

SEQ ID NO: 1290291 - RNA, 16 nt, Homo sapiens
aaggacagcuuugaua

SEQ ID NO: 1290292 - RNA, 21 nt, Homo sapiens
aaggacuuucugaagccucac

SEQ ID NO: 1290293 - RNA, 15 nt, Homo sapiens
aaggagcugccugga

SEQ ID NO: 1290294 - RNA, 15 nt, Homo sapiens
aaggauggaugcaga

SEQ ID NO: 1290295 - RNA, 18 nt, Homo sapiens
aaggcacuaaaaagagcu

SEQ ID NO: 1290296 - RNA, 11 nt, Homo sapiens
aaggcaucuga

SEQ ID NO: 1290297 - RNA, 17 nt, Homo sapiens
aaggcccuuuucagggc

SEQ ID NO: 1290298 - RNA, 18 nt, Homo sapiens
aaggcuggcagugacaga

SEQ ID NO: 1290299 - RNA, 16 nt, Homo sapiens
aaggcugucuaccuga

SEQ ID NO: 1290300 - RNA, 18 nt, Homo sapiens
aagggacaccaagccuug

SEQ ID NO: 1290301 - RNA, 18 nt, Homo sapiens
aaggggugugacuugaua

SEQ ID NO: 1290302 - RNA, 13 nt, Homo sapiens
aaggucuaucuac

SEQ ID NO: 1290303 - RNA, 15 nt, Homo sapiens
aagguggucacuguu

SEQ ID NO: 1290304 - RNA, 20 nt, Homo sapiens
aagucacuggccaguggcug

SEQ ID NO: 1290305 - RNA, 13 nt, Homo sapiens
aagucagcaacag

SEQ ID NO: 1290306 - RNA, 14 nt, Homo sapiens
aagucccagcauug

SEQ ID NO: 1290307 - RNA, 19 nt, Homo sapiens
aagugaacagaacuaucuc

SEQ ID NO: 1290308 - RNA, 15 nt, Homo sapiens
aagugaugacauauu

SEQ ID NO: 1290309 - RNA, 15 nt, Homo sapiens
aagugguggagccaa

SEQ ID NO: 1290310 - RNA, 17 nt, Homo sapiens
aagugucuagagucaug

SEQ ID NO: 1290311 - RNA, 22 nt, Homo sapiens
aaguuagggaauggcacagccc

SEQ ID NO: 1290312 - RNA, 18 nt, Homo sapiens
aaguucuuaguguugguu

SEQ ID NO: 1290313 - RNA, 16 nt, Homo sapiens
aaguugcaccaacuuu

SEQ ID NO: 1290314 - RNA, 21 nt, Homo sapiens
aaguuuuguggaggagcucag

SEQ ID NO: 1290315 - RNA, 11 nt, Homo sapiens
aauaaaaagcu

SEQ ID NO: 1290316 - RNA, 16 nt, Homo sapiens
aauaaaaucuaauuaa

SEQ ID NO: 1290317 - RNA, 14 nt, Homo sapiens
aauaaagaaauuaa

SEQ ID NO: 1290318 - RNA, 14 nt, Homo sapiens
aauaaaugaaugca

SEQ ID NO: 1290319 - RNA, 12 nt, Homo sapiens
aauaagugccag

SEQ ID NO: 1290320 - RNA, 13 nt, Homo sapiens
aauaauaaauuaa

SEQ ID NO: 1290321 - RNA, 18 nt, Homo sapiens
agucacuucaccaucaac

SEQ ID NO: 1290322 - RNA, 20 nt, Homo sapiens
agucaugugagccucguguc

SEQ ID NO: 1290323 - RNA, 20 nt, Homo sapiens
aguccccuucuuuuggcccu

SEQ ID NO: 1290324 - RNA, 19 nt, Homo sapiens
agucugaugagaacucuga

SEQ ID NO: 1290325 - RNA, 19 nt, Homo sapiens
agucuugguaacaaauaac

SEQ ID NO: 1290326 - RNA, 13 nt, Homo sapiens
agugagaagccag

SEQ ID NO: 1290327 - RNA, 22 nt, Homo sapiens
aguggcauguggguugugauau

SEQ ID NO: 1290328 - RNA, 15 nt, Homo sapiens
agugggguagguugg

SEQ ID NO: 1290329 - RNA, 17 nt, Homo sapiens
aguggucuuuguaagag

SEQ ID NO: 1290330 - RNA, 16 nt, Homo sapiens
aguguagaagcauucc

SEQ ID NO: 1290331 - RNA, 16 nt, Homo sapiens
aguguccuaugcaaua

SEQ ID NO: 1290332 - RNA, 21 nt, Homo sapiens
agugugaauaaagugcugcgg

SEQ ID NO: 1290333 - RNA, 18 nt, Homo sapiens
agugugguuccaagagau

SEQ ID NO: 1290334 - RNA, 20 nt, Homo sapiens
aguguuggaaaaugugcaau

SEQ ID NO: 1290335 - RNA, 17 nt, Homo sapiens
aguguuuaugacaaauu

SEQ ID NO: 1290336 - RNA, 13 nt, Homo sapiens
aguuccacugcug

SEQ ID NO: 1290337 - RNA, 13 nt, Homo sapiens
aguugcaccauuc

SEQ ID NO: 1290338 - RNA, 15 nt, Homo sapiens
aguuugaucauagaa

SEQ ID NO: 1290339 - RNA, 20 nt, Homo sapiens
aguuuugcccuuuuuaagga

SEQ ID NO: 1290340 - RNA, 15 nt, Homo sapiens
auaaaagaucuugca

SEQ ID NO: 1290341 - RNA, 18 nt, Homo sapiens
auaaacaugcuugcauua

SEQ ID NO: 1290342 - RNA, 15 nt, Homo sapiens
auaaacuuugaauuu

SEQ ID NO: 1290343 - RNA, 19 nt, Homo sapiens
auaaauagaaagaguucua

SEQ ID NO: 1290344 - RNA, 14 nt, Homo sapiens
auaacaauguuaag

SEQ ID NO: 1290345 - RNA, 22 nt, Homo sapiens
auaacugcccagcggacagugg

SEQ ID NO: 1290346 - RNA, 16 nt, Homo sapiens
auaagauauuguacau

SEQ ID NO: 1290347 - RNA, 14 nt, Homo sapiens
auaaguagaauuaa

SEQ ID NO: 1290348 - RNA, 22 nt, Homo sapiens
auaagucuugguaacaaauaac

SEQ ID NO: 1290349 - RNA, 19 nt, Homo sapiens
auaaguucuaguugcuugu

SEQ ID NO: 1290350 - RNA, 17 nt, Homo sapiens
auaauaaaaagcuucag

SEQ ID NO: 1290351 - RNA, 16 nt, Homo sapiens
auaauacuagucuuau

SEQ ID NO: 1290352 - RNA, 14 nt, Homo sapiens
auaaugaacacuca

SEQ ID NO: 1290353 - RNA, 17 nt, Homo sapiens
auaauguuuauaaguca

SEQ ID NO: 1290354 - RNA, 14 nt, Homo sapiens
auaccuaaacugua

SEQ ID NO: 1290355 - RNA, 17 nt, Homo sapiens
auacucaauuuacuaau

SEQ ID NO: 1290356 - RNA, 15 nt, Homo sapiens
auacucuucaaggac

SEQ ID NO: 1290357 - RNA, 18 nt, Homo sapiens
auagaacucagagccaga

SEQ ID NO: 1290358 - RNA, 20 nt, Homo sapiens
auagaacucugggcugccau

SEQ ID NO: 1290359 - RNA, 15 nt, Homo sapiens
auagaggaacuugaa

SEQ ID NO: 1290360 - RNA, 12 nt, Homo sapiens
auagcuaauaau

SEQ ID NO: 1290361 - RNA, 15 nt, Homo sapiens
auaggagaggaugag

SEQ ID NO: 1290362 - RNA, 14 nt, Homo sapiens
auaguauugugcau

SEQ ID NO: 1290363 - RNA, 15 nt, Homo sapiens
auaguauugugcaua

SEQ ID NO: 1290364 - RNA, 18 nt, Homo sapiens
auaguguccuaugcaaua

SEQ ID NO: 1290365 - RNA, 16 nt, Homo sapiens
auaguguuggaaaaug

SEQ ID NO: 1290366 - RNA, 18 nt, Homo sapiens
auauaaacaugcuugcau

SEQ ID NO: 1290367 - RNA, 20 nt, Homo sapiens
auauaaggacagaccaaaaa

SEQ ID NO: 1290368 - RNA, 22 nt, Homo sapiens
auauagcucuacacaacaugua

SEQ ID NO: 1290369 - RNA, 20 nt, Homo sapiens
auauauggcauuugcagauu

SEQ ID NO: 1290370 - RNA, 16 nt, Homo sapiens
auauauuaaauuugaa

SEQ ID NO: 1290371 - RNA, 16 nt, Homo sapiens
auaucuuguaugguuu

SEQ ID NO: 1290372 - RNA, 21 nt, Homo sapiens
auaugcacuuauucucaagaa

SEQ ID NO: 1290373 - RNA, 14 nt, Homo sapiens
auaugcagugauau

SEQ ID NO: 1290374 - RNA, 17 nt, Homo sapiens
auauguauacauauaga

SEQ ID NO: 1290375 - RNA, 21 nt, Homo sapiens
auauuacugaucuuaccuuua

SEQ ID NO: 1290376 - RNA, 20 nt, Homo sapiens
auauugaaaguugcuuuuau

SEQ ID NO: 1290377 - RNA, 15 nt, Homo sapiens
auauuuaacuaugaa

SEQ ID NO: 1290378 - RNA, 14 nt, Homo sapiens
auauuuauguagau

SEQ ID NO: 1290379 - RNA, 20 nt, Homo sapiens
auauuuuuaaaaguauacau

SEQ ID NO: 1290380 - RNA, 21 nt, Homo sapiens
aucaaaaagguuucugcacau

SEQ ID NO: 1290381 - RNA, 16 nt, Homo sapiens
aucaaagcuucaaaaa

SEQ ID NO: 1290382 - RNA, 16 nt, Homo sapiens
aucaaccaaauggagu

SEQ ID NO: 1290383 - RNA, 22 nt, Homo sapiens
aucaagauuuaauccuagagau

SEQ ID NO: 1290384 - RNA, 22 nt, Homo sapiens
aucaauaguguccuaugcaaua

SEQ ID NO: 1290385 - RNA, 20 nt, Homo sapiens
aucacuuccuauaugcacuu

SEQ ID NO: 1290386 - RNA, 13 nt, Homo sapiens
aucauagcacugg

SEQ ID NO: 1290387 - RNA, 13 nt, Homo sapiens
aucauguauuuau

SEQ ID NO: 1290388 - RNA, 14 nt, Homo sapiens
auccacuucucuca

SEQ ID NO: 1290389 - RNA, 18 nt, Homo sapiens
aucccuuauccaacucuc

SEQ ID NO: 1290390 - RNA, 18 nt, Homo sapiens
auccugccacaggaccca

SEQ ID NO: 1290391 - RNA, 16 nt, Homo sapiens
aucuauuucugagaag

SEQ ID NO: 1290392 - RNA, 20 nt, Homo sapiens
aucucaugagaagucacuca

SEQ ID NO: 1290393 - RNA, 15 nt, Homo sapiens
aucucugaacauuuc

SEQ ID NO: 1290394 - RNA, 20 nt, Homo sapiens
aucucugucagugugaaaau

SEQ ID NO: 1290395 - RNA, 14 nt, Homo sapiens
aucucuuuaccucc

SEQ ID NO: 1290396 - RNA, 15 nt, Homo sapiens
aucugaacauuuacu

SEQ ID NO: 1290397 - RNA, 17 nt, Homo sapiens
aucugcuuuugguuaua

SEQ ID NO: 1290398 - RNA, 13 nt, Homo sapiens
aucuguacuuugu

SEQ ID NO: 1290399 - RNA, 18 nt, Homo sapiens
aucuuugauucuccuuca

SEQ ID NO: 1290400 - RNA, 23 nt, Homo sapiens
aucuuuggacagaagcagcucuu

SEQ ID NO: 1290401 - RNA, 18 nt, Homo sapiens
aucuuuguuuaaaugcca

SEQ ID NO: 1290402 - RNA, 19 nt, Homo sapiens
aucuuuguuuaaaugccaa

SEQ ID NO: 1290403 - RNA, 14 nt, Homo sapiens
augaaaagagcaaa

SEQ ID NO: 1290404 - RNA, 21 nt, Homo sapiens
augaaacuuucaaauccuuca

SEQ ID NO: 1290405 - RNA, 21 nt, Homo sapiens
augaacacagccugggaccag

SEQ ID NO: 1290406 - RNA, 18 nt, Homo sapiens
augagaaagccugagaag

SEQ ID NO: 1290407 - RNA, 14 nt, Homo sapiens
augagaaguacuuu

SEQ ID NO: 1290408 - RNA, 16 nt, Homo sapiens
augagaagucacucac

SEQ ID NO: 1290409 - RNA, 15 nt, Homo sapiens
augagaauguauuag

SEQ ID NO: 1290410 - RNA, 19 nt, Homo sapiens
augagggcagggacaucau

SEQ ID NO: 1290411 - RNA, 20 nt, Homo sapiens
augauggcuuuaccuuuauu

SEQ ID NO: 1290412 - RNA, 23 nt, Homo sapiens
augauuuaauuuuuuaaacugua

SEQ ID NO: 1290413 - RNA, 19 nt, Homo sapiens
augcaaaaaaugcuuuguu

SEQ ID NO: 1290414 - RNA, 24 nt, Homo sapiens
augcaaccuuuggaugcacuuuau

SEQ ID NO: 1290415 - RNA, 13 nt, Homo sapiens
augcagggacaaa

SEQ ID NO: 1290416 - RNA, 14 nt, Homo sapiens
augcagggacaaau

SEQ ID NO: 1290417 - RNA, 18 nt, Homo sapiens
augcagugauauggcaga

SEQ ID NO: 1290418 - RNA, 13 nt, Homo sapiens
augcauacaguaa

SEQ ID NO: 1290419 - RNA, 23 nt, Homo sapiens
augcauccagcaguacaauaaaa

SEQ ID NO: 1290420 - RNA, 14 nt, Homo sapiens
augcccaugaacaa

SEQ ID NO: 1290421 - RNA, 17 nt, Homo sapiens
augcucuccaaaccacu

SEQ ID NO: 1290422 - RNA, 19 nt, Homo sapiens
augcuguuuaugacacaau

SEQ ID NO: 1290423 - RNA, 14 nt, Homo sapiens
auggcaacacugaa

SEQ ID NO: 1290424 - RNA, 16 nt, Homo sapiens
augggaccuauaacug

SEQ ID NO: 1290425 - RNA, 18 nt, Homo sapiens
augggcuucacuguauaa

SEQ ID NO: 1290426 - RNA, 14 nt, Homo sapiens
auggugaaaugcag

SEQ ID NO: 1290427 - RNA, 23 nt, Homo sapiens
augguguagcccucccacuuugc

SEQ ID NO: 1290428 - RNA, 20 nt, Homo sapiens
auggugugugucucugacaa

SEQ ID NO: 1290429 - RNA, 18 nt, Homo sapiens
augguuuagucauugcag

SEQ ID NO: 1290430 - RNA, 14 nt, Homo sapiens
auguaccagcaucu

SEQ ID NO: 1290431 - RNA, 19 nt, Homo sapiens
augucaguuccaaugaggu

SEQ ID NO: 1290432 - RNA, 16 nt, Homo sapiens
ucuuacuuugugcaaa

SEQ ID NO: 1290433 - RNA, 14 nt, Homo sapiens
ucuuauucagugaa

SEQ ID NO: 1290434 - RNA, 19 nt, Homo sapiens
ucuucaacuuuugugcucc

SEQ ID NO: 1290435 - RNA, 18 nt, Homo sapiens
ucuucacuucuaaaugca

SEQ ID NO: 1290436 - RNA, 22 nt, Homo sapiens
ucuucacuucuaaaugcauauc

SEQ ID NO: 1290437 - RNA, 15 nt, Homo sapiens
ucuucauuaccucag

SEQ ID NO: 1290438 - RNA, 17 nt, Homo sapiens
ucuuggcccucaguuug

SEQ ID NO: 1290439 - RNA, 12 nt, Homo sapiens
ucuuuaccuccu

SEQ ID NO: 1290440 - RNA, 17 nt, Homo sapiens
ucuuuccauuaugauuc

SEQ ID NO: 1290441 - RNA, 15 nt, Homo sapiens
ucuuucuuugcugcu

SEQ ID NO: 1290442 - RNA, 18 nt, Homo sapiens
ucuuuggacagaagcagc

SEQ ID NO: 1290443 - RNA, 20 nt, Homo sapiens
ucuuuggacagaagcagcuc

SEQ ID NO: 1290444 - RNA, 16 nt, Homo sapiens
ucuuuugucccagaaa

SEQ ID NO: 1290445 - RNA, 21 nt, Homo sapiens
ucuuuuuagagaaauuugcca

SEQ ID NO: 1290446 - RNA, 14 nt, Homo sapiens
ucuuuuugaaauca

SEQ ID NO: 1290447 - RNA, 22 nt, Homo sapiens
ugaaaaaaaauuuuauaguguc

SEQ ID NO: 1290448 - RNA, 15 nt, Homo sapiens
ugaaaaccugcauuu

SEQ ID NO: 1290449 - RNA, 15 nt, Homo sapiens
ugaaacagccagauc

SEQ ID NO: 1290450 - RNA, 22 nt, Homo sapiens
ugaaacccccacccuucugccu

SEQ ID NO: 1290451 - RNA, 21 nt, Homo sapiens
ugaaaugcagagucaaugaac

SEQ ID NO: 1290452 - RNA, 13 nt, Homo sapiens
ugaacagaacuau

SEQ ID NO: 1290453 - RNA, 11 nt, Homo sapiens
ugaacauuucu

SEQ ID NO: 1290454 - RNA, 17 nt, Homo sapiens
ugaagcuggaagcacug

SEQ ID NO: 1290455 - RNA, 24 nt, Homo sapiens
ugaaguuucagagcuacacaaaca

SEQ ID NO: 1290456 - RNA, 19 nt, Homo sapiens
ugaauaaagggaacaugca

SEQ ID NO: 1290457 - RNA, 13 nt, Homo sapiens
ugaaugucauuau

SEQ ID NO: 1290458 - RNA, 16 nt, Homo sapiens
ugaauuuagucauuau

SEQ ID NO: 1290459 - RNA, 17 nt, Homo sapiens
ugacaaauuuagccaau

SEQ ID NO: 1290460 - RNA, 14 nt, Homo sapiens
ugacaaucaacucu

SEQ ID NO: 1290461 - RNA, 16 nt, Homo sapiens
ugacaaucaacucuaa

SEQ ID NO: 1290462 - RNA, 11 nt, Homo sapiens
ugacacaugcu

SEQ ID NO: 1290463 - RNA, 15 nt, Homo sapiens
ugacagaacacuguc

SEQ ID NO: 1290464 - RNA, 14 nt, Homo sapiens
ugacagucugcuca

SEQ ID NO: 1290465 - RNA, 15 nt, Homo sapiens
ugacagucugcucaa

SEQ ID NO: 1290466 - RNA, 21 nt, Homo sapiens
ugacagucugcucaacacgac

SEQ ID NO: 1290467 - RNA, 16 nt, Homo sapiens
ugacauacauccaaca

SEQ ID NO: 1290468 - RNA, 23 nt, Homo sapiens
ugacaugccuauaugagaagaau

SEQ ID NO: 1290469 - RNA, 22 nt, Homo sapiens
ugaccuugaugagcugugcaca

SEQ ID NO: 1290470 - RNA, 18 nt, Homo sapiens
ugacuuaguguacaugaa

SEQ ID NO: 1290471 - RNA, 19 nt, Homo sapiens
ugacuugacagaacacugu

SEQ ID NO: 1290472 - RNA, 23 nt, Homo sapiens
ugagaagaaaaucagagagggaa

SEQ ID NO: 1290473 - RNA, 18 nt, Homo sapiens
ugagaccuggcagccaca

SEQ ID NO: 1290474 - RNA, 15 nt, Homo sapiens
ugagcagguguucuu

SEQ ID NO: 1290475 - RNA, 21 nt, Homo sapiens
ugagcagugcuugaaugaagu

SEQ ID NO: 1290476 - RNA, 18 nt, Homo sapiens
ugagcuggggaugucucu

SEQ ID NO: 1290477 - RNA, 22 nt, Homo sapiens
ugagcuggggaugucucucaug

SEQ ID NO: 1290478 - RNA, 13 nt, Homo sapiens
ugaggccucucau

SEQ ID NO: 1290479 - RNA, 15 nt, Homo sapiens
ugaggggcucucuca

SEQ ID NO: 1290480 - RNA, 19 nt, Homo sapiens
ugaggucuuuuacauacag

SEQ ID NO: 1290481 - RNA, 19 nt, Homo sapiens
ugaguauggcuaucuauac

SEQ ID NO: 1290482 - RNA, 12 nt, Homo sapiens
ugaguuacuuag

SEQ ID NO: 1290483 - RNA, 17 nt, Homo sapiens
ugaguugcaccauucuu

SEQ ID NO: 1290484 - RNA, 21 nt, Homo sapiens
ugaguugguguugacaugugc

SEQ ID NO: 1290485 - RNA, 17 nt, Homo sapiens
ugauaagcugagcuccu

SEQ ID NO: 1290486 - RNA, 19 nt, Homo sapiens
ugauauggcagaagacacc

SEQ ID NO: 1290487 - RNA, 21 nt, Homo sapiens
ugauauuuccuucaccaccuc

SEQ ID NO: 1290488 - RNA, 16 nt, Homo sapiens
ugaucaacauaaugga

SEQ ID NO: 1290489 - RNA, 12 nt, Homo sapiens
ugaucauagaau

SEQ ID NO: 1290490 - RNA, 23 nt, Homo sapiens
ugaugucauaagcgaucacuucc

SEQ ID NO: 1290491 - RNA, 15 nt, Homo sapiens
ugauuaaauuaugaa

SEQ ID NO: 1290492 - RNA, 17 nt, Homo sapiens
ugauucauuuucugccu

SEQ ID NO: 1290493 - RNA, 16 nt, Homo sapiens
ugcaaacugcuuuauu

SEQ ID NO: 1290494 - RNA, 21 nt, Homo sapiens
ugcaaauauugguuaguauuu

SEQ ID NO: 1290495 - RNA, 13 nt, Homo sapiens
ugcaacaacaugu

SEQ ID NO: 1290496 - RNA, 14 nt, Homo sapiens
ugcaacaacaugua

SEQ ID NO: 1290497 - RNA, 15 nt, Homo sapiens
ugcaacauaacaauu

SEQ ID NO: 1290498 - RNA, 20 nt, Homo sapiens
ugcaaccccaucauccucag

SEQ ID NO: 1290499 - RNA, 12 nt, Homo sapiens
ugcaaugugauc

SEQ ID NO: 1290500 - RNA, 17 nt, Homo sapiens
ugcaaugugaucuaugu

SEQ ID NO: 1290501 - RNA, 16 nt, Homo sapiens
ugcaccaacuuugaag

SEQ ID NO: 1290502 - RNA, 23 nt, Homo sapiens
ugcaccauucuuucuuggugcau

SEQ ID NO: 1290503 - RNA, 21 nt, Homo sapiens
ugcagaggaggagaaaaguga

SEQ ID NO: 1290504 - RNA, 19 nt, Homo sapiens
ugcaguauacacacuuucc

SEQ ID NO: 1290505 - RNA, 18 nt, Homo sapiens
ugcaguuccaaaagagaa

SEQ ID NO: 1290506 - RNA, 15 nt, Homo sapiens
ugcauagagcaauua

SEQ ID NO: 1290507 - RNA, 14 nt, Homo sapiens
ugcaucauagaaca

SEQ ID NO: 1290508 - RNA, 18 nt, Homo sapiens
ugcauccagcaguacaau

SEQ ID NO: 1290509 - RNA, 21 nt, Homo sapiens
ugcauuaauaauagcuaauaa

SEQ ID NO: 1290510 - RNA, 22 nt, Homo sapiens
ugcauuaauaauagcuaauaau

SEQ ID NO: 1290511 - RNA, 16 nt, Homo sapiens
ugcauuuuugugaaau

SEQ ID NO: 1290512 - RNA, 16 nt, Homo sapiens
ugccauauacucuuca

SEQ ID NO: 1290513 - RNA, 12 nt, Homo sapiens
ugccauggugau

SEQ ID NO: 1290514 - RNA, 19 nt, Homo sapiens
ugcccagugaccagucacu

SEQ ID NO: 1290515 - RNA, 21 nt, Homo sapiens
ugccccagauggcuuugugau

SEQ ID NO: 1290516 - RNA, 15 nt, Homo sapiens
ugcccucagauuccg

SEQ ID NO: 1290517 - RNA, 18 nt, Homo sapiens
ugcccuuccgcagugugg

SEQ ID NO: 1290518 - RNA, 18 nt, Homo sapiens
ugccuaucuucuuucaca

SEQ ID NO: 1290519 - RNA, 22 nt, Homo sapiens
ugccucagccuccugaguaguu

SEQ ID NO: 1290520 - RNA, 17 nt, Homo sapiens
ugccucgaaagugucau

SEQ ID NO: 1290521 - RNA, 18 nt, Homo sapiens
ugccugcaggcaugaguc

SEQ ID NO: 1290522 - RNA, 13 nt, Homo sapiens
ugccugguuuuau

SEQ ID NO: 1290523 - RNA, 19 nt, Homo sapiens
ugccugguuuuauuuauau

SEQ ID NO: 1290524 - RNA, 16 nt, Homo sapiens
ugccuuggugugcugu

SEQ ID NO: 1290525 - RNA, 21 nt, Homo sapiens
ugcgggcauuuugaaugugau

SEQ ID NO: 1290526 - RNA, 15 nt, Homo sapiens
ugcuaaaccauucau

SEQ ID NO: 1290527 - RNA, 20 nt, Homo sapiens
ugcuaaagggagaaaugcca

SEQ ID NO: 1290528 - RNA, 18 nt, Homo sapiens
ugcuacuuuauaauaaga

SEQ ID NO: 1290529 - RNA, 18 nt, Homo sapiens
ugcucauguauauuuagu

SEQ ID NO: 1290530 - RNA, 20 nt, Homo sapiens
ugcugaccuuuuuaucuuga

SEQ ID NO: 1290531 - RNA, 16 nt, Homo sapiens
ugcugcggagcaagag

SEQ ID NO: 1290532 - RNA, 22 nt, Homo sapiens
ugcugugaugugcaaaggcauc

SEQ ID NO: 1290533 - RNA, 11 nt, Homo sapiens
ugcugugcaaa

SEQ ID NO: 1290534 - RNA, 18 nt, Homo sapiens
ugcuguguggaguggaca

SEQ ID NO: 1290535 - RNA, 14 nt, Homo sapiens
ugcuuggguguaac

SEQ ID NO: 1290536 - RNA, 20 nt, Homo sapiens
ugcuuguaaaauuucacuua

SEQ ID NO: 1290537 - RNA, 20 nt, Homo sapiens
ugcuuuauaccccauuugau

SEQ ID NO: 1290538 - RNA, 17 nt, Homo sapiens
ugcuuucuauuaucuau

SEQ ID NO: 1290539 - RNA, 22 nt, Homo sapiens
ugcuuugccucgaaagugucau

SEQ ID NO: 1290540 - RNA, 16 nt, Homo sapiens
uggaaaaaaaggaaga

SEQ ID NO: 1290541 - RNA, 19 nt, Homo sapiens
uggaaaaggaagacuagag

SEQ ID NO: 1290542 - RNA, 14 nt, Homo sapiens
uggaaaaugugcaa

SEQ ID NO: 1290543 - RNA, 19 nt, Homo sapiens
accaaaugcuuuuccucaa

SEQ ID NO: 1290544 - RNA, 23 nt, Homo sapiens
accaagugucuagagucauguga

SEQ ID NO: 1290545 - RNA, 14 nt, Homo sapiens
accaauaaagccuu

SEQ ID NO: 1290546 - RNA, 13 nt, Homo sapiens
accagagcucaga

SEQ ID NO: 1290547 - RNA, 14 nt, Homo sapiens
accagaggacaaag

SEQ ID NO: 1290548 - RNA, 11 nt, Homo sapiens
accaugaagcu

SEQ ID NO: 1290549 - RNA, 23 nt, Homo sapiens
accaugugauuauggacaucgau

SEQ ID NO: 1290550 - RNA, 17 nt, Homo sapiens
accauguuagccaggau

SEQ ID NO: 1290551 - RNA, 18 nt, Homo sapiens
accauucaggacacaggg

SEQ ID NO: 1290552 - RNA, 14 nt, Homo sapiens
acccacuaucccau

SEQ ID NO: 1290553 - RNA, 19 nt, Homo sapiens
acccagaaaaaaagcccaa

SEQ ID NO: 1290554 - RNA, 13 nt, Homo sapiens
accccaacagcac

SEQ ID NO: 1290555 - RNA, 20 nt, Homo sapiens
accccugcuccccugagcug

SEQ ID NO: 1290556 - RNA, 15 nt, Homo sapiens
accccugguucucau

SEQ ID NO: 1290557 - RNA, 17 nt, Homo sapiens
acccuagucuuuuaaac

SEQ ID NO: 1290558 - RNA, 16 nt, Homo sapiens
acccucuaagggaccu

SEQ ID NO: 1290559 - RNA, 16 nt, Homo sapiens
cagugauauggcagaa

SEQ ID NO: 1290560 - RNA, 17 nt, Homo sapiens
cagugaucucacuaaaa

SEQ ID NO: 1290561 - RNA, 17 nt, Homo sapiens
cagugaucucgacuccc

SEQ ID NO: 1290562 - RNA, 15 nt, Homo sapiens
cagugcucagcuaaa

SEQ ID NO: 1290563 - RNA, 16 nt, Homo sapiens
caguuccuuucaaugg

SEQ ID NO: 1290564 - RNA, 23 nt, Homo sapiens
caguuuuguuuugagggcuauua

SEQ ID NO: 1290565 - RNA, 18 nt, Homo sapiens
caguuuuuuuuuuuccag

SEQ ID NO: 1290566 - RNA, 21 nt, Homo sapiens
cauaaagucuuugaagugacu

SEQ ID NO: 1290567 - RNA, 23 nt, Homo sapiens
cauaaauuuaugguucucaggcc

SEQ ID NO: 1290568 - RNA, 21 nt, Homo sapiens
cauaagaaauaaaaucuaauu

SEQ ID NO: 1290569 - RNA, 17 nt, Homo sapiens
cauaauaagcuaaagag

SEQ ID NO: 1290570 - RNA, 15 nt, Homo sapiens
cauaaugaacacuca

SEQ ID NO: 1290571 - RNA, 21 nt, Homo sapiens
cauacagagauuguaguauuu

SEQ ID NO: 1290572 - RNA, 23 nt, Homo sapiens
cauagaauugugcuggucauaca

SEQ ID NO: 1290573 - RNA, 19 nt, Homo sapiens
cauauuaaaaauauacaag

SEQ ID NO: 1290574 - RNA, 22 nt, Homo sapiens
caucaaagagauggugcuaaac

SEQ ID NO: 1290575 - RNA, 12 nt, Homo sapiens
caucaauagugu

SEQ ID NO: 1290576 - RNA, 22 nt, Homo sapiens
caucaauaguguccuaugcaau

SEQ ID NO: 1290577 - RNA, 15 nt, Homo sapiens
caucagaaauaguca

SEQ ID NO: 1290578 - RNA, 19 nt, Homo sapiens
cauccaacauuaaaagcca

SEQ ID NO: 1290579 - RNA, 20 nt, Homo sapiens
caucuaaauugaucauucau

SEQ ID NO: 1290580 - RNA, 17 nt, Homo sapiens
caucucugaacauuucu

SEQ ID NO: 1290581 - RNA, 16 nt, Homo sapiens
caucucuuuaccuccu

SEQ ID NO: 1290582 - RNA, 19 nt, Homo sapiens
caucugagcccagagauaa

SEQ ID NO: 1290583 - RNA, 12 nt, Homo sapiens
caucuguacuca

SEQ ID NO: 1290584 - RNA, 22 nt, Homo sapiens
caucuuuggguccuuagugcaa

SEQ ID NO: 1290585 - RNA, 13 nt, Homo sapiens
caugaaagcguaa

SEQ ID NO: 1290586 - RNA, 15 nt, Homo sapiens
caugaaccaagugga

SEQ ID NO: 1290587 - RNA, 12 nt, Homo sapiens
caugaagcugga

SEQ ID NO: 1290588 - RNA, 20 nt, Homo sapiens
caugaagcuggaagcacugc

SEQ ID NO: 1290589 - RNA, 17 nt, Homo sapiens
caugaguuggcugggaa

SEQ ID NO: 1290590 - RNA, 22 nt, Homo sapiens
caugaugaacucacccccauga

SEQ ID NO: 1290591 - RNA, 23 nt, Homo sapiens
caugcaaacugcuuuauuuuccc

SEQ ID NO: 1290592 - RNA, 17 nt, Homo sapiens
caugcuccgccuguaaa

SEQ ID NO: 1290593 - RNA, 22 nt, Homo sapiens
cauggcagaaggcaaagcaaag

SEQ ID NO: 1290594 - RNA, 14 nt, Homo sapiens
cauggcccugccau

SEQ ID NO: 1290595 - RNA, 21 nt, Homo sapiens
cauggcuauaaacaauuacau

SEQ ID NO: 1290596 - RNA, 14 nt, Homo sapiens
caugugcacuugaa

SEQ ID NO: 1290597 - RNA, 14 nt, Homo sapiens
caugugcuacaggg

SEQ ID NO: 1290598 - RNA, 13 nt, Homo sapiens
cauguguauuucc

SEQ ID NO: 1290599 - RNA, 16 nt, Homo sapiens
cauguugguugcacuu

SEQ ID NO: 1290600 - RNA, 17 nt, Homo sapiens
cauuauuaaauguuucu

SEQ ID NO: 1290601 - RNA, 17 nt, Homo sapiens
cauuauuucaucaugac

SEQ ID NO: 1290602 - RNA, 16 nt, Homo sapiens
cauuauuugauaacau

SEQ ID NO: 1290603 - RNA, 21 nt, Homo sapiens
cauucacaaaguauaacaauu

SEQ ID NO: 1290604 - RNA, 22 nt, Homo sapiens
cauucacagcaagucacuggcc

SEQ ID NO: 1290605 - RNA, 15 nt, Homo sapiens
cauucagcaugagau

SEQ ID NO: 1290606 - RNA, 17 nt, Homo sapiens
cauucagcaugagauuu

SEQ ID NO: 1290607 - RNA, 19 nt, Homo sapiens
cauucagcaugagauuugg

SEQ ID NO: 1290608 - RNA, 14 nt, Homo sapiens
cauucaugaugaac

SEQ ID NO: 1290609 - RNA, 13 nt, Homo sapiens
cauugaacuguac

SEQ ID NO: 1290610 - RNA, 23 nt, Homo sapiens
cauugauauaaagaaauaccuga

SEQ ID NO: 1290611 - RNA, 17 nt, Homo sapiens
cauugggcacauaucuc

SEQ ID NO: 1290612 - RNA, 12 nt, Homo sapiens
cauugguguuga

SEQ ID NO: 1290613 - RNA, 18 nt, Homo sapiens
cauuucuugguuccaaua

SEQ ID NO: 1290614 - RNA, 18 nt, Homo sapiens
cauuugcuuacuuugcau

SEQ ID NO: 1290615 - RNA, 14 nt, Homo sapiens
cauuuguuccauga

SEQ ID NO: 1290616 - RNA, 14 nt, Homo sapiens
cauuuucaauuugg

SEQ ID NO: 1290617 - RNA, 13 nt, Homo sapiens
cauuuucacuuuu

SEQ ID NO: 1290618 - RNA, 17 nt, Homo sapiens
cauuuucugccacccaa

SEQ ID NO: 1290619 - RNA, 14 nt, Homo sapiens
cauuuucugccuau

SEQ ID NO: 1290620 - RNA, 20 nt, Homo sapiens
cauuuugacacaauguugca

SEQ ID NO: 1290621 - RNA, 12 nt, Homo sapiens
ccaaaacuuaaa

SEQ ID NO: 1290622 - RNA, 14 nt, Homo sapiens
ccaaaagaauuaaa

SEQ ID NO: 1290623 - RNA, 14 nt, Homo sapiens
ccaaaaggcccuuu

SEQ ID NO: 1290624 - RNA, 13 nt, Homo sapiens
ccaaaauaaucua

SEQ ID NO: 1290625 - RNA, 14 nt, Homo sapiens
ccaaauuacgugua

SEQ ID NO: 1290626 - RNA, 20 nt, Homo sapiens
ccaaauuacguguacuacaa

SEQ ID NO: 1290627 - RNA, 21 nt, Homo sapiens
ccaacauuaaaagccaccccc

SEQ ID NO: 1290628 - RNA, 15 nt, Homo sapiens
ccaaccacaagcaca

SEQ ID NO: 1290629 - RNA, 18 nt, Homo sapiens
ccaaccacaagcacacag

SEQ ID NO: 1290630 - RNA, 20 nt, Homo sapiens
ccaacuuugaagucugauuu

SEQ ID NO: 1290631 - RNA, 18 nt, Homo sapiens
ccaagaaugagaagaaug

SEQ ID NO: 1290632 - RNA, 16 nt, Homo sapiens
ccaagagauccaucaa

SEQ ID NO: 1290633 - RNA, 23 nt, Homo sapiens
ccaaggccucauccuggggagga

SEQ ID NO: 1290634 - RNA, 14 nt, Homo sapiens
ccaauaaagaaauu

SEQ ID NO: 1290635 - RNA, 13 nt, Homo sapiens
ccaauaaagccuu

SEQ ID NO: 1290636 - RNA, 15 nt, Homo sapiens
ccacacaaaauguca

SEQ ID NO: 1290637 - RNA, 13 nt, Homo sapiens
ccacacacauuau

SEQ ID NO: 1290638 - RNA, 16 nt, Homo sapiens
ccacacacauuaucau

SEQ ID NO: 1290639 - RNA, 17 nt, Homo sapiens
ccacacugaaacagcca

SEQ ID NO: 1290640 - RNA, 11 nt, Homo sapiens
ccacagacuca

SEQ ID NO: 1290641 - RNA, 20 nt, Homo sapiens
ccacaguggaaagacagcuu

SEQ ID NO: 1290642 - RNA, 14 nt, Homo sapiens
ccacauaccuggcc

SEQ ID NO: 1290643 - RNA, 17 nt, Homo sapiens
ccacauccacacagcca

SEQ ID NO: 1290644 - RNA, 22 nt, Homo sapiens
ccacauuagccuuugcacugua

SEQ ID NO: 1290645 - RNA, 11 nt, Homo sapiens
ccacauugcac

SEQ ID NO: 1290646 - RNA, 15 nt, Homo sapiens
ccaccucacuagcuc

SEQ ID NO: 1290647 - RNA, 20 nt, Homo sapiens
ccaccuggaccccugcauug

SEQ ID NO: 1290648 - RNA, 20 nt, Homo sapiens
ccacuaucccauuugcccuc

SEQ ID NO: 1290649 - RNA, 20 nt, Homo sapiens
ccacucuuaucuuacaacuc

SEQ ID NO: 1290650 - RNA, 23 nt, Homo sapiens
cuuauccaacucucgacuuuucc

SEQ ID NO: 1290651 - RNA, 22 nt, Homo sapiens
cuuaucucagucaugcauaaau

SEQ ID NO: 1290652 - RNA, 16 nt, Homo sapiens
cuuaucuuacaacucc

SEQ ID NO: 1290653 - RNA, 13 nt, Homo sapiens
cuuauguguugca

SEQ ID NO: 1290654 - RNA, 14 nt, Homo sapiens
cuuauugacuauua

SEQ ID NO: 1290655 - RNA, 15 nt, Homo sapiens
cuucacucaugcaaa

SEQ ID NO: 1290656 - RNA, 17 nt, Homo sapiens
cuucagcucuucuugac

SEQ ID NO: 1290657 - RNA, 22 nt, Homo sapiens
cuucagcucuucuugacaucaa

SEQ ID NO: 1290658 - RNA, 21 nt, Homo sapiens
cuucaggauacuguaguuucc

SEQ ID NO: 1290659 - RNA, 13 nt, Homo sapiens
cuucauuaccuca

SEQ ID NO: 1290660 - RNA, 17 nt, Homo sapiens
cuucauuaccucaguga

SEQ ID NO: 1290661 - RNA, 14 nt, Homo sapiens
cuuccagagucauc

SEQ ID NO: 1290662 - RNA, 20 nt, Homo sapiens
cuuccaucuuuggguccuua

SEQ ID NO: 1290663 - RNA, 14 nt, Homo sapiens
cuuccucaccacuu

SEQ ID NO: 1290664 - RNA, 14 nt, Homo sapiens
cuucucagccacaa

SEQ ID NO: 1290665 - RNA, 19 nt, Homo sapiens
cuucuccuagcuggcuuau

SEQ ID NO: 1290666 - RNA, 18 nt, Homo sapiens
cuucugaggacauuccaa

SEQ ID NO: 1290667 - RNA, 19 nt, Homo sapiens
cuucugcaucuuacaguca

SEQ ID NO: 1290668 - RNA, 20 nt, Homo sapiens
cuucugcuuuuuuucaggga

SEQ ID NO: 1290669 - RNA, 17 nt, Homo sapiens
cuucugugugcugcuaa

SEQ ID NO: 1290670 - RNA, 18 nt, Homo sapiens
cuucuugacaucaaggcu

SEQ ID NO: 1290671 - RNA, 18 nt, Homo sapiens
cuugaaugccauagucaa

SEQ ID NO: 1290672 - RNA, 18 nt, Homo sapiens
cuugacaucaaggcucuu

SEQ ID NO: 1290673 - RNA, 22 nt, Homo sapiens
cuugauauuuccuucaccaccu

SEQ ID NO: 1290674 - RNA, 23 nt, Homo sapiens
cuugaucaacaucuuuucuugcc

SEQ ID NO: 1290675 - RNA, 20 nt, Homo sapiens
cuugaugagcugugcacaaa

SEQ ID NO: 1290676 - RNA, 22 nt, Homo sapiens
cuugaugagcugugcacaaagu

SEQ ID NO: 1290677 - RNA, 21 nt, Homo sapiens
cuugcauugaauuuagucauu

SEQ ID NO: 1290678 - RNA, 15 nt, Homo sapiens
cuuggcccucaguuu

SEQ ID NO: 1290679 - RNA, 20 nt, Homo sapiens
cuugguaacaaauaaccuau

SEQ ID NO: 1290680 - RNA, 23 nt, Homo sapiens
cuugucuuuuuguuaugcaaaug

SEQ ID NO: 1290681 - RNA, 15 nt, Homo sapiens
cuuuaaaagucauua

SEQ ID NO: 1290682 - RNA, 16 nt, Homo sapiens
cuuuaaucacuuaaca

SEQ ID NO: 1290683 - RNA, 18 nt, Homo sapiens
cuuuaaucuguuguuuga

SEQ ID NO: 1290684 - RNA, 22 nt, Homo sapiens
cuuuagcagggaagucacuuca

SEQ ID NO: 1290685 - RNA, 16 nt, Homo sapiens
cuuuagguuugaaagg

SEQ ID NO: 1290686 - RNA, 15 nt, Homo sapiens
cuuuaucuuugugua

SEQ ID NO: 1290687 - RNA, 16 nt, Homo sapiens
cuuuaugaacucccuc

SEQ ID NO: 1290688 - RNA, 14 nt, Homo sapiens
cuuucaaauccuuc

SEQ ID NO: 1290689 - RNA, 15 nt, Homo sapiens
cuuucaaauuuacug

SEQ ID NO: 1290690 - RNA, 14 nt, Homo sapiens
cuuuccacauucag

SEQ ID NO: 1290691 - RNA, 19 nt, Homo sapiens
cuuuccccggaguaccuau

SEQ ID NO: 1290692 - RNA, 23 nt, Homo sapiens
cuuuccccggaguaccuauugua

SEQ ID NO: 1290693 - RNA, 21 nt, Homo sapiens
cuuucucaggaccuaguugcu

SEQ ID NO: 1290694 - RNA, 15 nt, Homo sapiens
cuuucugcauaauaa

SEQ ID NO: 1290695 - RNA, 13 nt, Homo sapiens
cuuugaagucuga

SEQ ID NO: 1290696 - RNA, 20 nt, Homo sapiens
cuuugaauuuuuuuaauugc

SEQ ID NO: 1290697 - RNA, 23 nt, Homo sapiens
cuuugccuuuccauaaucacuca

SEQ ID NO: 1290698 - RNA, 13 nt, Homo sapiens
cuuugcuccagac

SEQ ID NO: 1290699 - RNA, 18 nt, Homo sapiens
cuuugggauucuuuccau

SEQ ID NO: 1290700 - RNA, 16 nt, Homo sapiens
cuuuuaguuguaucuc

SEQ ID NO: 1290701 - RNA, 13 nt, Homo sapiens
cuuuugucccaga

SEQ ID NO: 1290702 - RNA, 16 nt, Homo sapiens
gaaaaauaagucacuu

SEQ ID NO: 1290703 - RNA, 13 nt, Homo sapiens
gaaaagagcaaaa

SEQ ID NO: 1290704 - RNA, 19 nt, Homo sapiens
gaaaagcaguggcuccauu

SEQ ID NO: 1290705 - RNA, 20 nt, Homo sapiens
gaaaagcccaugaucuucaa

SEQ ID NO: 1290706 - RNA, 16 nt, Homo sapiens
gaaaaggaagacuaga

SEQ ID NO: 1290707 - RNA, 19 nt, Homo sapiens
gaaaaucugcacugugggc

SEQ ID NO: 1290708 - RNA, 15 nt, Homo sapiens
gaaaauguccucccu

SEQ ID NO: 1290709 - RNA, 14 nt, Homo sapiens
gaaaauuaacacug

SEQ ID NO: 1290710 - RNA, 15 nt, Homo sapiens
gaaaauuaacacugc

SEQ ID NO: 1290711 - RNA, 18 nt, Homo sapiens
gaaaccacacagacuugg

SEQ ID NO: 1290712 - RNA, 19 nt, Homo sapiens
gaaaccuugaaagacauuu

SEQ ID NO: 1290713 - RNA, 18 nt, Homo sapiens
gaaagacagagcugggau

SEQ ID NO: 1290714 - RNA, 12 nt, Homo sapiens
gaaauacuuuug

SEQ ID NO: 1290715 - RNA, 18 nt, Homo sapiens
gaacaagagaccaggugu

SEQ ID NO: 1290716 - RNA, 15 nt, Homo sapiens
gaacacaaggucauu

SEQ ID NO: 1290717 - RNA, 19 nt, Homo sapiens
gaacacacugagacuugaa

SEQ ID NO: 1290718 - RNA, 22 nt, Homo sapiens
gaacacagccugggaccagggc

SEQ ID NO: 1290719 - RNA, 16 nt, Homo sapiens
gaacacucagcugcuu

SEQ ID NO: 1290720 - RNA, 14 nt, Homo sapiens
gaacagacugaccu

SEQ ID NO: 1290721 - RNA, 15 nt, Homo sapiens
gaacagcuucagguu

SEQ ID NO: 1290722 - RNA, 15 nt, Homo sapiens
gaacauuuacuacag

SEQ ID NO: 1290723 - RNA, 17 nt, Homo sapiens
gaaccagagcucagaga

SEQ ID NO: 1290724 - RNA, 21 nt, Homo sapiens
gaaccauguugguugcacuuu

SEQ ID NO: 1290725 - RNA, 23 nt, Homo sapiens
gaacucccucugugucacuguau

SEQ ID NO: 1290726 - RNA, 18 nt, Homo sapiens
gaacuggaccaucuccaa

SEQ ID NO: 1290727 - RNA, 19 nt, Homo sapiens
gaacuggaggcagggaaca

SEQ ID NO: 1290728 - RNA, 12 nt, Homo sapiens
gaacuugcacaa

SEQ ID NO: 1290729 - RNA, 16 nt, Homo sapiens
gaacuuucucuagcaa

SEQ ID NO: 1290730 - RNA, 17 nt, Homo sapiens
gaagacuauauuguaca

SEQ ID NO: 1290731 - RNA, 14 nt, Homo sapiens
gaagagcuuggaaa

SEQ ID NO: 1290732 - RNA, 13 nt, Homo sapiens
gaagcacugcugu

SEQ ID NO: 1290733 - RNA, 16 nt, Homo sapiens
gaagcaguaauaauca

SEQ ID NO: 1290734 - RNA, 16 nt, Homo sapiens
gaagcuuuccugacuu

SEQ ID NO: 1290735 - RNA, 14 nt, Homo sapiens
ggcccugccaugcu

SEQ ID NO: 1290736 - RNA, 20 nt, Homo sapiens
ggccucaagggaugucucac

SEQ ID NO: 1290737 - RNA, 19 nt, Homo sapiens
ggcucuucuaaucagagcg

SEQ ID NO: 1290738 - RNA, 15 nt, Homo sapiens
ggcucuucucauuuc

SEQ ID NO: 1290739 - RNA, 20 nt, Homo sapiens
ggcugaggccucucauucca

SEQ ID NO: 1290740 - RNA, 17 nt, Homo sapiens
ggcugccccgugacaca

SEQ ID NO: 1290741 - RNA, 11 nt, Homo sapiens
ggcugccuugu

SEQ ID NO: 1290742 - RNA, 15 nt, Homo sapiens
ggcuucacuguauaa

SEQ ID NO: 1290743 - RNA, 14 nt, Homo sapiens
ggcuuuaccuuuau

SEQ ID NO: 1290744 - RNA, 19 nt, Homo sapiens
ggcuuuuccaaaagcaaac

SEQ ID NO: 1290745 - RNA, 22 nt, Homo sapiens
gggaaaagcccaugaucuucaa

SEQ ID NO: 1290746 - RNA, 11 nt, Homo sapiens
gggaaccauga

SEQ ID NO: 1290747 - RNA, 17 nt, Homo sapiens
gggaauguuguuccagg

SEQ ID NO: 1290748 - RNA, 21 nt, Homo sapiens
gggaccacagacucacauccu

SEQ ID NO: 1290749 - RNA, 23 nt, Homo sapiens
gggagagaaagcuuuauauuugu

SEQ ID NO: 1290750 - RNA, 18 nt, Homo sapiens
gggcaugggaaggugggc

SEQ ID NO: 1290751 - RNA, 13 nt, Homo sapiens
gggcgagaaacaa

SEQ ID NO: 1290752 - RNA, 16 nt, Homo sapiens
gggcugggcucuacua

SEQ ID NO: 1290753 - RNA, 15 nt, Homo sapiens
ggggacugucuuuca

SEQ ID NO: 1290754 - RNA, 13 nt, Homo sapiens
ggggcucucucau

SEQ ID NO: 1290755 - RNA, 13 nt, Homo sapiens
ggggcucuucuca

SEQ ID NO: 1290756 - RNA, 20 nt, Homo sapiens
gggggcuuggcugugcccuc

SEQ ID NO: 1290757 - RNA, 10 nt, Homo sapiens
gggucugugu

SEQ ID NO: 1290758 - RNA, 14 nt, Homo sapiens
gguagguugggaga

SEQ ID NO: 1290759 - RNA, 22 nt, Homo sapiens
ggugaaacuaacagauaagcaa

SEQ ID NO: 1290760 - RNA, 15 nt, Homo sapiens
ggugaccaaugcauu

SEQ ID NO: 1290761 - RNA, 11 nt, Homo sapiens
ggugauggugu

SEQ ID NO: 1290762 - RNA, 19 nt, Homo sapiens
ggugauuucuagaaugguu

SEQ ID NO: 1290763 - RNA, 21 nt, Homo sapiens
ggugcaggggugaggggucca

SEQ ID NO: 1290764 - RNA, 22 nt, Homo sapiens
acaacaaaggauuaauugcugc

SEQ ID NO: 1290765 - RNA, 22 nt, Homo sapiens
acaacauuuacaacucauucca

SEQ ID NO: 1290766 - RNA, 18 nt, Homo sapiens
acaacgaggaagcccuaa

SEQ ID NO: 1290767 - RNA, 17 nt, Homo sapiens
acaacucauuccagauc

SEQ ID NO: 1290768 - RNA, 18 nt, Homo sapiens
acaacuugaauaauacac

SEQ ID NO: 1290769 - RNA, 18 nt, Homo sapiens
acaagaagcacugacaau

SEQ ID NO: 1290770 - RNA, 22 nt, Homo sapiens
acaagacccaaguagcugcuac

SEQ ID NO: 1290771 - RNA, 16 nt, Homo sapiens
acaagauauuauguau

SEQ ID NO: 1290772 - RNA, 21 nt, Homo sapiens
acaagcaagggucuccuucaa

SEQ ID NO: 1290773 - RNA, 20 nt, Homo sapiens
acaagcaauuagacaagaac

SEQ ID NO: 1290774 - RNA, 17 nt, Homo sapiens
acaagccagaacuugac

SEQ ID NO: 1290775 - RNA, 14 nt, Homo sapiens
acaagcuaagaguu

SEQ ID NO: 1290776 - RNA, 16 nt, Homo sapiens
acaaggcgaucccauc

SEQ ID NO: 1290777 - RNA, 17 nt, Homo sapiens
acaaguugaaauaugcu

SEQ ID NO: 1290778 - RNA, 20 nt, Homo sapiens
acaauacaaagguuccauuc

SEQ ID NO: 1290779 - RNA, 19 nt, Homo sapiens
acaaugaggcugcuuauga

SEQ ID NO: 1290780 - RNA, 11 nt, Homo sapiens
acaaugcauuu

SEQ ID NO: 1290781 - RNA, 12 nt, Homo sapiens
acaaugcugauu

SEQ ID NO: 1290782 - RNA, 22 nt, Homo sapiens
acaauggcccgacauuucuuca

SEQ ID NO: 1290783 - RNA, 13 nt, Homo sapiens
acaaugucccuuc

SEQ ID NO: 1290784 - RNA, 19 nt, Homo sapiens
acaauuccuccucuggcca

SEQ ID NO: 1290785 - RNA, 16 nt, Homo sapiens
acaauugacaacaguu

SEQ ID NO: 1290786 - RNA, 22 nt, Homo sapiens
acaauugacaacaguuacauaa

SEQ ID NO: 1290787 - RNA, 14 nt, Homo sapiens
acaauugugaaguc

SEQ ID NO: 1290788 - RNA, 23 nt, Homo sapiens
acaauuuaugcgaaccuaugucu

SEQ ID NO: 1290789 - RNA, 16 nt, Homo sapiens
acaauuugacauacaa

SEQ ID NO: 1290790 - RNA, 17 nt, Homo sapiens
acacaaaaauuagccag

SEQ ID NO: 1290791 - RNA, 17 nt, Homo sapiens
acacaaaccacaccaca

SEQ ID NO: 1290792 - RNA, 23 nt, Homo sapiens
acacaagcuugucaaugauuuca

SEQ ID NO: 1290793 - RNA, 15 nt, Homo sapiens
acacacagagcucac

SEQ ID NO: 1290794 - RNA, 12 nt, Homo sapiens
acacacagcucu

SEQ ID NO: 1290795 - RNA, 21 nt, Homo sapiens
acacagaggggagucaccagc

SEQ ID NO: 1290796 - RNA, 16 nt, Homo sapiens
acacagauagaccuuu

SEQ ID NO: 1290797 - RNA, 21 nt, Homo sapiens
acacagcucuucuccaggcug

SEQ ID NO: 1290798 - RNA, 17 nt, Homo sapiens
acacaguauuacuucug

SEQ ID NO: 1290799 - RNA, 16 nt, Homo sapiens
acacaguucaauucuc

SEQ ID NO: 1290800 - RNA, 18 nt, Homo sapiens
acacauaguggcuucucc

SEQ ID NO: 1290801 - RNA, 20 nt, Homo sapiens
acacaugcuauguucugucu

SEQ ID NO: 1290802 - RNA, 19 nt, Homo sapiens
aaugcauaaugucuuuaaa

SEQ ID NO: 1290803 - RNA, 13 nt, Homo sapiens
aaugccauccuca

SEQ ID NO: 1290804 - RNA, 21 nt, Homo sapiens
aaugccauccucaaacacugc

SEQ ID NO: 1290805 - RNA, 16 nt, Homo sapiens
aaugccgcgauggguc

SEQ ID NO: 1290806 - RNA, 23 nt, Homo sapiens
aaugccugacuagggagccaugu

SEQ ID NO: 1290807 - RNA, 18 nt, Homo sapiens
aaugcuaagaaugcauua

SEQ ID NO: 1290808 - RNA, 23 nt, Homo sapiens
aaugcucaagaaacaacuucuac

SEQ ID NO: 1290809 - RNA, 15 nt, Homo sapiens
aaugcucaccuuuau

SEQ ID NO: 1290810 - RNA, 16 nt, Homo sapiens
aauggaauucccaugc

SEQ ID NO: 1290811 - RNA, 19 nt, Homo sapiens
aauggacacuuuucaccuc

SEQ ID NO: 1290812 - RNA, 16 nt, Homo sapiens
aauggaggcaacgcca

SEQ ID NO: 1290813 - RNA, 18 nt, Homo sapiens
aauggaggcaacgccaga

SEQ ID NO: 1290814 - RNA, 22 nt, Homo sapiens
aaugggccacugaaaucuguca

SEQ ID NO: 1290815 - RNA, 13 nt, Homo sapiens
aauggggccagau

SEQ ID NO: 1290816 - RNA, 17 nt, Homo sapiens
aauggugaaaugcagag

SEQ ID NO: 1290817 - RNA, 19 nt, Homo sapiens
aauguaacacugaugauag

SEQ ID NO: 1290818 - RNA, 15 nt, Homo sapiens
aauguaacugugcca

SEQ ID NO: 1290819 - RNA, 21 nt, Homo sapiens
aauguacaccagagccucagu

SEQ ID NO: 1290820 - RNA, 20 nt, Homo sapiens
aauguacucuccuuuuaugu

SEQ ID NO: 1290821 - RNA, 15 nt, Homo sapiens
aauguaugugcucuu

SEQ ID NO: 1290822 - RNA, 13 nt, Homo sapiens
aauguauugaacu

SEQ ID NO: 1290823 - RNA, 15 nt, Homo sapiens
aaugucaaugccagg

SEQ ID NO: 1290824 - RNA, 19 nt, Homo sapiens
aaugucuugaugcaugcac

SEQ ID NO: 1290825 - RNA, 19 nt, Homo sapiens
aaugucuugcuguugacau

SEQ ID NO: 1290826 - RNA, 20 nt, Homo sapiens
aaugugaccuuuaauucagg

SEQ ID NO: 1290827 - RNA, 12 nt, Homo sapiens
aaugugauugca

SEQ ID NO: 1290828 - RNA, 18 nt, Homo sapiens
aauguguuucaaaaccau

SEQ ID NO: 1290829 - RNA, 19 nt, Homo sapiens
aauguguuucaaaaccaug

SEQ ID NO: 1290830 - RNA, 19 nt, Homo sapiens
aauguguuuuguacaugaa

SEQ ID NO: 1290831 - RNA, 21 nt, Homo sapiens
aauguuaacacucaugaagca

SEQ ID NO: 1290832 - RNA, 13 nt, Homo sapiens
aauguucauccca

SEQ ID NO: 1290833 - RNA, 19 nt, Homo sapiens
aauguucuuuugacugaag

SEQ ID NO: 1290834 - RNA, 15 nt, Homo sapiens
aauguugcuuucuga

SEQ ID NO: 1290835 - RNA, 20 nt, Homo sapiens
aauguugguuuuaauacuug

SEQ ID NO: 1290836 - RNA, 19 nt, Homo sapiens
aauguuugucucaucccau

SEQ ID NO: 1290837 - RNA, 22 nt, Homo sapiens
aauguuuguuaaagcuagauag

SEQ ID NO: 1290838 - RNA, 17 nt, Homo sapiens
aauguuuucuuugcaaa

SEQ ID NO: 1290839 - RNA, 19 nt, Homo sapiens
aauuaaaauccucaaucca

SEQ ID NO: 1290840 - RNA, 20 nt, Homo sapiens
aauuaagaugguaagaccuc

SEQ ID NO: 1290841 - RNA, 22 nt, Homo sapiens
aauuacacaguaagucauuuaa

SEQ ID NO: 1290842 - RNA, 20 nt, Homo sapiens
aauuagaaacaacauagcaa

SEQ ID NO: 1290843 - RNA, 21 nt, Homo sapiens
aauuagggagcucuugacaga

SEQ ID NO: 1290844 - RNA, 18 nt, Homo sapiens
aauuagugccacaaauaa

SEQ ID NO: 1290845 - RNA, 19 nt, Homo sapiens
aauuauaagaggauaugaa

SEQ ID NO: 1290846 - RNA, 17 nt, Homo sapiens
aauuauaaucuguggau

SEQ ID NO: 1290847 - RNA, 16 nt, Homo sapiens
aauuauacuacuuugu

SEQ ID NO: 1290848 - RNA, 12 nt, Homo sapiens
aauuauuugacu

SEQ ID NO: 1290849 - RNA, 21 nt, Homo sapiens
aauucacucugaguguuuuau

SEQ ID NO: 1290850 - RNA, 22 nt, Homo sapiens
aauucagaagaccccugacuca

SEQ ID NO: 1290851 - RNA, 12 nt, Homo sapiens
aauucauguuuc

SEQ ID NO: 1290852 - RNA, 13 nt, Homo sapiens
aauuccaaagcaa

SEQ ID NO: 1290853 - RNA, 18 nt, Homo sapiens
aauuccauuuccaguuca

SEQ ID NO: 1290854 - RNA, 13 nt, Homo sapiens
aauuccgcauuua

SEQ ID NO: 1290855 - RNA, 18 nt, Homo sapiens
aauucuagaugacuuuaa

SEQ ID NO: 1290856 - RNA, 18 nt, Homo sapiens
aauucucauuugucacac

SEQ ID NO: 1290857 - RNA, 14 nt, Homo sapiens
aauucuccaacagc

SEQ ID NO: 1290858 - RNA, 17 nt, Homo sapiens
aauucugaauuugcaaa

SEQ ID NO: 1290859 - RNA, 21 nt, Homo sapiens
aauucuguuuuuaaugcuauu

SEQ ID NO: 1290860 - RNA, 14 nt, Homo sapiens
aauugacaacccaa

SEQ ID NO: 1290861 - RNA, 16 nt, Homo sapiens
aauugacaacccaaac

SEQ ID NO: 1290862 - RNA, 17 nt, Homo sapiens
aauugauguuacuguau

SEQ ID NO: 1290863 - RNA, 16 nt, Homo sapiens
aauugcuaauguugcu

SEQ ID NO: 1290864 - RNA, 21 nt, Homo sapiens
aauugcugcaccaaugcacug

SEQ ID NO: 1290865 - RNA, 16 nt, Homo sapiens
aauuguacuaaagcca

SEQ ID NO: 1290866 - RNA, 17 nt, Homo sapiens
aauuguacuaaagccaa

SEQ ID NO: 1290867 - RNA, 18 nt, Homo sapiens
aauuguaucaaaugugac

SEQ ID NO: 1290868 - RNA, 18 nt, Homo sapiens
aauuuauucaauuccucu

SEQ ID NO: 1290869 - RNA, 23 nt, Homo sapiens
aauuucacauuaauauuugcuga

SEQ ID NO: 1290870 - RNA, 14 nt, Homo sapiens
aauuucagcauuau

SEQ ID NO: 1290871 - RNA, 11 nt, Homo sapiens
aauuucuagag

SEQ ID NO: 1290872 - RNA, 17 nt, Homo sapiens
aauuugcaaaguacugu

SEQ ID NO: 1290873 - RNA, 15 nt, Homo sapiens
aauuugcaccaguuu

SEQ ID NO: 1290874 - RNA, 23 nt, Homo sapiens
aauuugucuuuuaauuuagcuua

SEQ ID NO: 1290875 - RNA, 16 nt, Homo sapiens
aauuugugauggaauc

SEQ ID NO: 1290876 - RNA, 17 nt, Homo sapiens
aauuuuaagcuguacac

SEQ ID NO: 1290877 - RNA, 17 nt, Homo sapiens
aauuuugaugcuuguau

SEQ ID NO: 1290878 - RNA, 12 nt, Homo sapiens
aauuuugcuuau

SEQ ID NO: 1290879 - RNA, 13 nt, Homo sapiens
aauuuugugguuc

SEQ ID NO: 1290880 - RNA, 20 nt, Homo sapiens
aauuuuguucucugggagaa

SEQ ID NO: 1290881 - RNA, 16 nt, Homo sapiens
aauuuuucaguguuga

SEQ ID NO: 1290882 - RNA, 15 nt, Homo sapiens
acaaaaaaacagacc

SEQ ID NO: 1290883 - RNA, 20 nt, Homo sapiens
acaaaaaaugugcuguucaa

SEQ ID NO: 1290884 - RNA, 16 nt, Homo sapiens
acaaaacccugcaccu

SEQ ID NO: 1290885 - RNA, 20 nt, Homo sapiens
acaaaauuggaagcugucau

SEQ ID NO: 1290886 - RNA, 16 nt, Homo sapiens
acaaacaaugcaauca

SEQ ID NO: 1290887 - RNA, 14 nt, Homo sapiens
acaaaccacaccac

SEQ ID NO: 1290888 - RNA, 16 nt, Homo sapiens
acaaacccaaaaaaga

SEQ ID NO: 1290889 - RNA, 17 nt, Homo sapiens
acaaaccucaagccagc

SEQ ID NO: 1290890 - RNA, 14 nt, Homo sapiens
acaaacuucaaaga

SEQ ID NO: 1290891 - RNA, 15 nt, Homo sapiens
acaaacuucaaagag

SEQ ID NO: 1290892 - RNA, 13 nt, Homo sapiens
acaaagauuugca

SEQ ID NO: 1290893 - RNA, 19 nt, Homo sapiens
acaaaggcaaaggguccag

SEQ ID NO: 1290894 - RNA, 21 nt, Homo sapiens
acaaagugaggagaaugaaau

SEQ ID NO: 1290895 - RNA, 22 nt, Homo sapiens
acaaauauggaugagguggaga

SEQ ID NO: 1290896 - RNA, 15 nt, Homo sapiens
aaauaaaucaucuuu

SEQ ID NO: 1290897 - RNA, 14 nt, Homo sapiens
aaauaaauggaaua

SEQ ID NO: 1290898 - RNA, 13 nt, Homo sapiens
aaauaaguuacau

SEQ ID NO: 1290899 - RNA, 20 nt, Homo sapiens
aaauaaguuacaucuacaaa

SEQ ID NO: 1290900 - RNA, 18 nt, Homo sapiens
aaauaauuccacaguccu

SEQ ID NO: 1290901 - RNA, 15 nt, Homo sapiens
aaauacagucuucca

SEQ ID NO: 1290902 - RNA, 19 nt, Homo sapiens
aaauacagucuuccacaaa

SEQ ID NO: 1290903 - RNA, 22 nt, Homo sapiens
aaauacagucuuccacaaagaa

SEQ ID NO: 1290904 - RNA, 14 nt, Homo sapiens
aaauacuauuucaa

SEQ ID NO: 1290905 - RNA, 16 nt, Homo sapiens
aaauacugaauuagua

SEQ ID NO: 1290906 - RNA, 17 nt, Homo sapiens
aaauacugauacaucca

SEQ ID NO: 1290907 - RNA, 22 nt, Homo sapiens
aaauacuuuuguacuuaaucca

SEQ ID NO: 1290908 - RNA, 20 nt, Homo sapiens
aaauagacuaaccucuacca

SEQ ID NO: 1290909 - RNA, 17 nt, Homo sapiens
aaauagagccugaggga

SEQ ID NO: 1290910 - RNA, 20 nt, Homo sapiens
aaauagcaacuuguguuaca

SEQ ID NO: 1290911 - RNA, 15 nt, Homo sapiens
aaauauauaugauau

SEQ ID NO: 1290912 - RNA, 14 nt, Homo sapiens
aaauauaucacuuu

SEQ ID NO: 1290913 - RNA, 15 nt, Homo sapiens
aaauauauuuccuca

SEQ ID NO: 1290914 - RNA, 16 nt, Homo sapiens
aaauauggaacuuaca

SEQ ID NO: 1290915 - RNA, 18 nt, Homo sapiens
aaauauggaauaggagac

SEQ ID NO: 1290916 - RNA, 14 nt, Homo sapiens
aaauauuuacagua

SEQ ID NO: 1290917 - RNA, 16 nt, Homo sapiens
aaauauuucuuagcaa

SEQ ID NO: 1290918 - RNA, 16 nt, Homo sapiens
aaauauuuuaaaggua

SEQ ID NO: 1290919 - RNA, 16 nt, Homo sapiens
aaauauuuugcauaua

SEQ ID NO: 1290920 - RNA, 21 nt, Homo sapiens
aaauccuuagaucuggcaugu

SEQ ID NO: 1290921 - RNA, 21 nt, Homo sapiens
aaauccuuuuaaaucuugaua

SEQ ID NO: 1290922 - RNA, 21 nt, Homo sapiens
aaaucgugacaacacuugugu

SEQ ID NO: 1290923 - RNA, 15 nt, Homo sapiens
aaaucugacccagug

SEQ ID NO: 1290924 - RNA, 20 nt, Homo sapiens
aaaucugagggagcugagua

SEQ ID NO: 1290925 - RNA, 12 nt, Homo sapiens
aaaucuuguaca

SEQ ID NO: 1290926 - RNA, 20 nt, Homo sapiens
aaaucuuucuuucuuagaaa

SEQ ID NO: 1290927 - RNA, 13 nt, Homo sapiens
aaaugacuccuaa

SEQ ID NO: 1290928 - RNA, 19 nt, Homo sapiens
aaaugacucuacuaaaagu

SEQ ID NO: 1290929 - RNA, 12 nt, Homo sapiens
aaaugagcauug

SEQ ID NO: 1290930 - RNA, 15 nt, Homo sapiens
aaaugagccaugaga

SEQ ID NO: 1290931 - RNA, 18 nt, Homo sapiens
aaaugaggccuacucuaa

SEQ ID NO: 1290932 - RNA, 14 nt, Homo sapiens
aaaugagugcuuaa

SEQ ID NO: 1290933 - RNA, 18 nt, Homo sapiens
aaaugauguguacccaaa

SEQ ID NO: 1290934 - RNA, 17 nt, Homo sapiens
aaaugcucagaccagcu

SEQ ID NO: 1290935 - RNA, 16 nt, Homo sapiens
aaaugcucucucuucu

SEQ ID NO: 1290936 - RNA, 19 nt, Homo sapiens
aaauggaagacacauugaa

SEQ ID NO: 1290937 - RNA, 18 nt, Homo sapiens
aacugcuguugggaacca

SEQ ID NO: 1290938 - RNA, 13 nt, Homo sapiens
aacuggaaugccu

SEQ ID NO: 1290939 - RNA, 14 nt, Homo sapiens
aacuggaaugccuu

SEQ ID NO: 1290940 - RNA, 20 nt, Homo sapiens
aacugucacucauugcugag

SEQ ID NO: 1290941 - RNA, 15 nt, Homo sapiens
aacuguuaccaguug

SEQ ID NO: 1290942 - RNA, 11 nt, Homo sapiens
aacuguugcuc

SEQ ID NO: 1290943 - RNA, 20 nt, Homo sapiens
aacuuacaucacgacuuucu

SEQ ID NO: 1290944 - RNA, 22 nt, Homo sapiens
aacuuaccauucaacugaacaa

SEQ ID NO: 1290945 - RNA, 15 nt, Homo sapiens
aacuucaaagaggaa

SEQ ID NO: 1290946 - RNA, 17 nt, Homo sapiens
aacuucuacuucugccc

SEQ ID NO: 1290947 - RNA, 14 nt, Homo sapiens
aacuugacccccuu

SEQ ID NO: 1290948 - RNA, 18 nt, Homo sapiens
aacuuguauuaaagacag

SEQ ID NO: 1290949 - RNA, 22 nt, Homo sapiens
aacuuucauuuuuuuccaggcu

SEQ ID NO: 1290950 - RNA, 14 nt, Homo sapiens
aacuuugaggauaa

SEQ ID NO: 1290951 - RNA, 22 nt, Homo sapiens
aacuuugcauagcagcugcuac

SEQ ID NO: 1290952 - RNA, 20 nt, Homo sapiens
aacuuuguuuagcccaaaac

SEQ ID NO: 1290953 - RNA, 23 nt, Homo sapiens
aacuuuguuuagcccaaaaccaa

SEQ ID NO: 1290954 - RNA, 21 nt, Homo sapiens
aacuuuuccuuucauacgucu

SEQ ID NO: 1290955 - RNA, 15 nt, Homo sapiens
aagaaaaaggaacua

SEQ ID NO: 1290956 - RNA, 23 nt, Homo sapiens
aagaaaaagggcugccgggccag

SEQ ID NO: 1290957 - RNA, 17 nt, Homo sapiens
aagaaaaagguuugcau

SEQ ID NO: 1290958 - RNA, 14 nt, Homo sapiens
aagaaaaauaucuu

SEQ ID NO: 1290959 - RNA, 15 nt, Homo sapiens
aagaaaaccaccccu

SEQ ID NO: 1290960 - RNA, 21 nt, Homo sapiens
aagaaaauuccuauaaggaag

SEQ ID NO: 1290961 - RNA, 14 nt, Homo sapiens
aagaaagaucaaag

SEQ ID NO: 1290962 - RNA, 15 nt, Homo sapiens
aagaaagaucaaaga

SEQ ID NO: 1290963 - RNA, 18 nt, Homo sapiens
aagaaaggccagcaaauu

SEQ ID NO: 1290964 - RNA, 21 nt, Homo sapiens
aagaacaauauugacuuuguc

SEQ ID NO: 1290965 - RNA, 13 nt, Homo sapiens
aagaacacccucu

SEQ ID NO: 1290966 - RNA, 17 nt, Homo sapiens
aagaacaugcaguuuga

SEQ ID NO: 1290967 - RNA, 16 nt, Homo sapiens
aagaacucaucacugu

SEQ ID NO: 1290968 - RNA, 23 nt, Homo sapiens
aagaacuuuuucuuuucccucaa

SEQ ID NO: 1290969 - RNA, 19 nt, Homo sapiens
aagaagcauacaacuuugg

SEQ ID NO: 1290970 - RNA, 23 nt, Homo sapiens
aagaagcugguggagcagagugu

SEQ ID NO: 1290971 - RNA, 11 nt, Homo sapiens
aagaaggcauu

SEQ ID NO: 1290972 - RNA, 22 nt, Homo sapiens
aagaaggccacuguuugucuca

SEQ ID NO: 1290973 - RNA, 21 nt, Homo sapiens
aagaagggaauuuauugccuc

SEQ ID NO: 1290974 - RNA, 15 nt, Homo sapiens
aagaaggggacaaug

SEQ ID NO: 1290975 - RNA, 17 nt, Homo sapiens
aagaaguucacaucaga

SEQ ID NO: 1290976 - RNA, 12 nt, Homo sapiens
aagaauacucca

SEQ ID NO: 1290977 - RNA, 23 nt, Homo sapiens
aagaaucaccaguggguauucaa

SEQ ID NO: 1290978 - RNA, 15 nt, Homo sapiens
aagaaucacuugaac

SEQ ID NO: 1290979 - RNA, 13 nt, Homo sapiens
aagaaucuguuuc

SEQ ID NO: 1290980 - RNA, 23 nt, Homo sapiens
aagaauucaaacuggggccucca

SEQ ID NO: 1290981 - RNA, 15 nt, Homo sapiens
aagaauuccaaagca

SEQ ID NO: 1290982 - RNA, 17 nt, Homo sapiens
aagacaaucacugccaa

SEQ ID NO: 1290983 - RNA, 13 nt, Homo sapiens
aagaccaccacuu

SEQ ID NO: 1290984 - RNA, 20 nt, Homo sapiens
aagaccugacaccuuucaua

SEQ ID NO: 1290985 - RNA, 19 nt, Homo sapiens
aagaccugggguugucagc

SEQ ID NO: 1290986 - RNA, 22 nt, Homo sapiens
aagaccuucguauccccucuca

SEQ ID NO: 1290987 - RNA, 19 nt, Homo sapiens
aagacggaaaccucccuuu

SEQ ID NO: 1290988 - RNA, 18 nt, Homo sapiens
aagacuauucccuucuaa

SEQ ID NO: 1290989 - RNA, 21 nt, Homo sapiens
aagacuggaagcuaauuugca

SEQ ID NO: 1290990 - RNA, 22 nt, Homo sapiens
aagacuucccuaacacuuaccc

SEQ ID NO: 1290991 - RNA, 21 nt, Homo sapiens
aagacuucucuuuugcacauc

SEQ ID NO: 1290992 - RNA, 15 nt, Homo sapiens
aagacuugcauuuaa

SEQ ID NO: 1290993 - RNA, 19 nt, Homo sapiens
aagacuuuguccccacuua

SEQ ID NO: 1290994 - RNA, 18 nt, Homo sapiens
aagagaacauuuuacugu

SEQ ID NO: 1290995 - RNA, 16 nt, Homo sapiens
aagagaaccauaucaa

SEQ ID NO: 1290996 - RNA, 14 nt, Homo sapiens
aagagaaugucucc

SEQ ID NO: 1290997 - RNA, 20 nt, Homo sapiens
aagagcagucuaucauugca

SEQ ID NO: 1290998 - RNA, 19 nt, Homo sapiens
aagagggcacacacugugu

SEQ ID NO: 1290999 - RNA, 11 nt, Homo sapiens
aagaguggcuu

SEQ ID NO: 1291000 - RNA, 17 nt, Homo sapiens
aagauacagaacucuuu

SEQ ID NO: 1291001 - RNA, 22 nt, Homo sapiens
aagauccugugaggagccccau

SEQ ID NO: 1291002 - RNA, 18 nt, Homo sapiens
aagaucucgguuugccaa

SEQ ID NO: 1291003 - RNA, 13 nt, Homo sapiens
aagaucucugcag

SEQ ID NO: 1291004 - RNA, 15 nt, Homo sapiens
aagaucuguuuugaa

SEQ ID NO: 1291005 - RNA, 20 nt, Homo sapiens
aagaugacacaacugcacuc

SEQ ID NO: 1291006 - RNA, 21 nt, Homo sapiens
aagaugacgaguaacuccccu

SEQ ID NO: 1291007 - RNA, 20 nt, Homo sapiens
aagauggguggaucacuuga

SEQ ID NO: 1291008 - RNA, 14 nt, Homo sapiens
aagaugugcuuaua

SEQ ID NO: 1291009 - RNA, 15 nt, Homo sapiens
aagauuccaaaaagc

SEQ ID NO: 1291010 - RNA, 16 nt, Homo sapiens
aagauuccaaaaagca

SEQ ID NO: 1291011 - RNA, 13 nt, Homo sapiens
aagcaaacccaga

SEQ ID NO: 1291012 - RNA, 14 nt, Homo sapiens
aagcaacaggccau

SEQ ID NO: 1291013 - RNA, 17 nt, Homo sapiens
aagcaacuuauguauuu

SEQ ID NO: 1291014 - RNA, 19 nt, Homo sapiens
aagcaacuuuacugagaca

SEQ ID NO: 1291015 - RNA, 18 nt, Homo sapiens
aagcaaggcuuuaaauga

SEQ ID NO: 1291016 - RNA, 20 nt, Homo sapiens
aagcacagauuugcauuuca

SEQ ID NO: 1291017 - RNA, 20 nt, Homo sapiens
aagcacaggugggcuuccca

SEQ ID NO: 1291018 - RNA, 13 nt, Homo sapiens
aagcacaucugca

SEQ ID NO: 1291019 - RNA, 14 nt, Homo sapiens
aagcagaagugcaa

SEQ ID NO: 1291020 - RNA, 15 nt, Homo sapiens
aagcagaccacugau

SEQ ID NO: 1291021 - RNA, 16 nt, Homo sapiens
aagcagagagcacagc

SEQ ID NO: 1291022 - RNA, 19 nt, Homo sapiens
aagcagagcuaguaaugcu

SEQ ID NO: 1291023 - RNA, 16 nt, Homo sapiens
aagcagaugcucugaa

SEQ ID NO: 1291024 - RNA, 18 nt, Homo sapiens
aagcagccaagcuccuug

SEQ ID NO: 1291025 - RNA, 16 nt, Homo sapiens
aagcaggaagcucaga

SEQ ID NO: 1291026 - RNA, 21 nt, Homo sapiens
aagcagucuuucuauccuguu

SEQ ID NO: 1291027 - RNA, 20 nt, Homo sapiens
aagcauaaaaauuagccaag

SEQ ID NO: 1291028 - RNA, 13 nt, Homo sapiens
aagcauacuucua

SEQ ID NO: 1291029 - RNA, 12 nt, Homo sapiens
aagcauacuuug

SEQ ID NO: 1291030 - RNA, 19 nt, Homo sapiens
aagcauuuuuaaucugugu

SEQ ID NO: 1291031 - RNA, 16 nt, Homo sapiens
aagccaaagccaauaa

SEQ ID NO: 1291032 - RNA, 23 nt, Homo sapiens
agcucucggaacugcaugcugcu

SEQ ID NO: 1291033 - RNA, 20 nt, Homo sapiens
agcucugaaaccaguguuag

SEQ ID NO: 1291034 - RNA, 17 nt, Homo sapiens
agcucuuccgaaaacca

SEQ ID NO: 1291035 - RNA, 15 nt, Homo sapiens
agcucuuuacuguaa

SEQ ID NO: 1291036 - RNA, 14 nt, Homo sapiens
agcugaacaauagg

SEQ ID NO: 1291037 - RNA, 18 nt, Homo sapiens
agcugaacaauaggcugu

SEQ ID NO: 1291038 - RNA, 18 nt, Homo sapiens
agcugaauuaucuauaca

SEQ ID NO: 1291039 - RNA, 21 nt, Homo sapiens
agcugacucucgugcauuuca

SEQ ID NO: 1291040 - RNA, 14 nt, Homo sapiens
agcugcacuacagc

SEQ ID NO: 1291041 - RNA, 19 nt, Homo sapiens
agcugcacugaugcugccc

SEQ ID NO: 1291042 - RNA, 20 nt, Homo sapiens
agcugcagucaacaguucaa

SEQ ID NO: 1291043 - RNA, 17 nt, Homo sapiens
agcugcuacuagcucuu

SEQ ID NO: 1291044 - RNA, 14 nt, Homo sapiens
agcugcuccgugcu

SEQ ID NO: 1291045 - RNA, 15 nt, Homo sapiens
agcugcucugagcca

SEQ ID NO: 1291046 - RNA, 12 nt, Homo sapiens
agcugcuucuau

SEQ ID NO: 1291047 - RNA, 17 nt, Homo sapiens
agcuggggcuacaggag

SEQ ID NO: 1291048 - RNA, 18 nt, Homo sapiens
agcugguaaucuugcucu

SEQ ID NO: 1291049 - RNA, 12 nt, Homo sapiens
agcuguucaaac

SEQ ID NO: 1291050 - RNA, 14 nt, Homo sapiens
agcuguugggaaca

SEQ ID NO: 1291051 - RNA, 16 nt, Homo sapiens
agcuuagcauaucuga

SEQ ID NO: 1291052 - RNA, 14 nt, Homo sapiens
agcuuagugaaaag

SEQ ID NO: 1291053 - RNA, 17 nt, Homo sapiens
agcuuaucucuuuuaua

SEQ ID NO: 1291054 - RNA, 15 nt, Homo sapiens
agcuucuagaggcuc

SEQ ID NO: 1291055 - RNA, 14 nt, Homo sapiens
agcuucucugugaa

SEQ ID NO: 1291056 - RNA, 17 nt, Homo sapiens
agcuucuuaguuacuuu

SEQ ID NO: 1291057 - RNA, 23 nt, Homo sapiens
agcuucuuccaggugcccagcua

SEQ ID NO: 1291058 - RNA, 22 nt, Homo sapiens
agcuugcucacaucuuggcaca

SEQ ID NO: 1291059 - RNA, 20 nt, Homo sapiens
agcuugcugucacuucuuca

SEQ ID NO: 1291060 - RNA, 15 nt, Homo sapiens
agcuuucucuaguuc

SEQ ID NO: 1291061 - RNA, 17 nt, Homo sapiens
aggaaaaaaacuauuaa

SEQ ID NO: 1291062 - RNA, 19 nt, Homo sapiens
auugcugcaccaaugcacu

SEQ ID NO: 1291063 - RNA, 18 nt, Homo sapiens
auugcuugggucucucuc

SEQ ID NO: 1291064 - RNA, 16 nt, Homo sapiens
auuggaagcugucaua

SEQ ID NO: 1291065 - RNA, 15 nt, Homo sapiens
auuggaaugcacagg

SEQ ID NO: 1291066 - RNA, 22 nt, Homo sapiens
auuggaaugcagaggucuccaa

SEQ ID NO: 1291067 - RNA, 13 nt, Homo sapiens
auuggacagugag

SEQ ID NO: 1291068 - RNA, 13 nt, Homo sapiens
auuggagaugcaa

SEQ ID NO: 1291069 - RNA, 20 nt, Homo sapiens
auuggauaaaauaaaugcaa

SEQ ID NO: 1291070 - RNA, 21 nt, Homo sapiens
auuggcaccuaauccaggcag

SEQ ID NO: 1291071 - RNA, 17 nt, Homo sapiens
auuggcucacacugaga

SEQ ID NO: 1291072 - RNA, 19 nt, Homo sapiens
auuguacauaaguaccuca

SEQ ID NO: 1291073 - RNA, 16 nt, Homo sapiens
auuguaguguucaaaa

SEQ ID NO: 1291074 - RNA, 15 nt, Homo sapiens
auuguauuacagaug

SEQ ID NO: 1291075 - RNA, 14 nt, Homo sapiens
auuguauuuaguua

SEQ ID NO: 1291076 - RNA, 21 nt, Homo sapiens
auuguauuuuuaacaccagaa

SEQ ID NO: 1291077 - RNA, 18 nt, Homo sapiens
auuguccccuaaaccaaa

SEQ ID NO: 1291078 - RNA, 17 nt, Homo sapiens
auugucuuauuacagca

SEQ ID NO: 1291079 - RNA, 18 nt, Homo sapiens
auugugaaaaggcaaauu

SEQ ID NO: 1291080 - RNA, 21 nt, Homo sapiens
auugugccuacgaauagccac

SEQ ID NO: 1291081 - RNA, 15 nt, Homo sapiens
auuguuaaaauaacu

SEQ ID NO: 1291082 - RNA, 18 nt, Homo sapiens
auuguuacauaguuaaau

SEQ ID NO: 1291083 - RNA, 20 nt, Homo sapiens
auuguucucccuccuaccug

SEQ ID NO: 1291084 - RNA, 16 nt, Homo sapiens
auuguugucaggccau

SEQ ID NO: 1291085 - RNA, 17 nt, Homo sapiens
auuguuuccugagcaua

SEQ ID NO: 1291086 - RNA, 21 nt, Homo sapiens
auuuaaaccuuuguuaacucu

SEQ ID NO: 1291087 - RNA, 18 nt, Homo sapiens
auuuaaccauggcacuga

SEQ ID NO: 1291088 - RNA, 12 nt, Homo sapiens
auuuaagaggaa

SEQ ID NO: 1291089 - RNA, 20 nt, Homo sapiens
auuuaagggaaugugagcac

SEQ ID NO: 1291090 - RNA, 12 nt, Homo sapiens
auuuacacucag

SEQ ID NO: 1291091 - RNA, 21 nt, Homo sapiens
auuuacccaacucuguacaaa

SEQ ID NO: 1291092 - RNA, 17 nt, Homo sapiens
auuuacucaaagacaua

SEQ ID NO: 1291093 - RNA, 12 nt, Homo sapiens
auuuagaacuuu

SEQ ID NO: 1291094 - RNA, 22 nt, Homo sapiens
auuuagauccugguuucauaac

SEQ ID NO: 1291095 - RNA, 21 nt, Homo sapiens
auuuagcuaaacggauuccaa

SEQ ID NO: 1291096 - RNA, 18 nt, Homo sapiens
auuuagguuuuuauuagu

SEQ ID NO: 1291097 - RNA, 17 nt, Homo sapiens
auuuauaaaacuucuca

SEQ ID NO: 1291098 - RNA, 13 nt, Homo sapiens
auuuauacuguau

SEQ ID NO: 1291099 - RNA, 15 nt, Homo sapiens
auuuaucugugcaaa

SEQ ID NO: 1291100 - RNA, 19 nt, Homo sapiens
auuuauuuccuaguucugu

SEQ ID NO: 1291101 - RNA, 14 nt, Homo sapiens
auuuauuugguucc

SEQ ID NO: 1291102 - RNA, 21 nt, Homo sapiens
auuuauuuugagaagcucuga

SEQ ID NO: 1291103 - RNA, 23 nt, Homo sapiens
auuucaaaacucauuuccuaugu

SEQ ID NO: 1291104 - RNA, 22 nt, Homo sapiens
auuucaaaauucuccaacagcu

SEQ ID NO: 1291105 - RNA, 14 nt, Homo sapiens
auuucacaagcuau

SEQ ID NO: 1291106 - RNA, 16 nt, Homo sapiens
auuucacaagcuauuu

SEQ ID NO: 1291107 - RNA, 12 nt, Homo sapiens
auuucagacucc

SEQ ID NO: 1291108 - RNA, 14 nt, Homo sapiens
auuucagcauuauu

SEQ ID NO: 1291109 - RNA, 16 nt, Homo sapiens
auuuccaaauucacaa

SEQ ID NO: 1291110 - RNA, 17 nt, Homo sapiens
auuuccaaauucacaag

SEQ ID NO: 1291111 - RNA, 21 nt, Homo sapiens
auuuccacuauuuucaaagaa

SEQ ID NO: 1291112 - RNA, 23 nt, Homo sapiens
auuucccccuaaaccaacugaag

SEQ ID NO: 1291113 - RNA, 19 nt, Homo sapiens
auuuccucagcuuaucucu

SEQ ID NO: 1291114 - RNA, 16 nt, Homo sapiens
auuucuaaaagccaau

SEQ ID NO: 1291115 - RNA, 14 nt, Homo sapiens
auuucuacuuucag

SEQ ID NO: 1291116 - RNA, 17 nt, Homo sapiens
auuucucugcucacaga

SEQ ID NO: 1291117 - RNA, 16 nt, Homo sapiens
auuucuucuacugcua

SEQ ID NO: 1291118 - RNA, 17 nt, Homo sapiens
auuucuucuacugcuau

SEQ ID NO: 1291119 - RNA, 14 nt, Homo sapiens
auuugaaugcauuu

SEQ ID NO: 1291120 - RNA, 17 nt, Homo sapiens
auuugcaaaguacugua

SEQ ID NO: 1291121 - RNA, 23 nt, Homo sapiens
auuugcaccaguuuuauccauaa

SEQ ID NO: 1291122 - RNA, 19 nt, Homo sapiens
auuugcuggaacacaaaga

SEQ ID NO: 1291123 - RNA, 14 nt, Homo sapiens
auuuggaggcaauc

SEQ ID NO: 1291124 - RNA, 16 nt, Homo sapiens
auuuggcaaugccauc

SEQ ID NO: 1291125 - RNA, 17 nt, Homo sapiens
auuugggccugcuccag

SEQ ID NO: 1291126 - RNA, 14 nt, Homo sapiens
auuugggucagccu

SEQ ID NO: 1291127 - RNA, 20 nt, Homo sapiens
auuuggguucugccugccag

SEQ ID NO: 1291128 - RNA, 22 nt, Homo sapiens
auuugguucccuuccuauucca

SEQ ID NO: 1291129 - RNA, 17 nt, Homo sapiens
auuuguaauugaacuua

SEQ ID NO: 1291130 - RNA, 18 nt, Homo sapiens
auuuguggaaaagaaaua

SEQ ID NO: 1291131 - RNA, 13 nt, Homo sapiens
auuuuacauacac

SEQ ID NO: 1291132 - RNA, 22 nt, Homo sapiens
auuuuacccugaggucacugcu

SEQ ID NO: 1291133 - RNA, 18 nt, Homo sapiens
auuuuagcaucuacuugu

SEQ ID NO: 1291134 - RNA, 16 nt, Homo sapiens
auuuuaggaugcagug

SEQ ID NO: 1291135 - RNA, 13 nt, Homo sapiens
auuuuagucacac

SEQ ID NO: 1291136 - RNA, 15 nt, Homo sapiens
auuuuauagcuacua

SEQ ID NO: 1291137 - RNA, 15 nt, Homo sapiens
auuuuauaugaagau

SEQ ID NO: 1291138 - RNA, 18 nt, Homo sapiens
auuuuauucccuuucaca

SEQ ID NO: 1291139 - RNA, 15 nt, Homo sapiens
auuuuauuguacaag

SEQ ID NO: 1291140 - RNA, 22 nt, Homo sapiens
auuuucaagagucuaauagucu

SEQ ID NO: 1291141 - RNA, 22 nt, Homo sapiens
auuuucaaggccuucaguuuau

SEQ ID NO: 1291142 - RNA, 14 nt, Homo sapiens
auuuucaguuauua

SEQ ID NO: 1291143 - RNA, 21 nt, Homo sapiens
auuuucuuguauauuuugcua

SEQ ID NO: 1291144 - RNA, 14 nt, Homo sapiens
auuuugacgucacu

SEQ ID NO: 1291145 - RNA, 14 nt, Homo sapiens
auuuugcacuguaa

SEQ ID NO: 1291146 - RNA, 14 nt, Homo sapiens
auuuuggcauugua

SEQ ID NO: 1291147 - RNA, 15 nt, Homo sapiens
auuuugugacauucc

SEQ ID NO: 1291148 - RNA, 21 nt, Homo sapiens
auuuuguuuuugucuuaaaaa

SEQ ID NO: 1291149 - RNA, 19 nt, Homo sapiens
auuuuuacaguucucccaa

SEQ ID NO: 1291150 - RNA, 17 nt, Homo sapiens
auuuuucuauaaagauc

SEQ ID NO: 1291151 - RNA, 16 nt, Homo sapiens
auuuuucucuaacuca

SEQ ID NO: 1291152 - RNA, 18 nt, Homo sapiens
auuuuugaagacaucaaa

SEQ ID NO: 1291153 - RNA, 14 nt, Homo sapiens
auuuuugugcacau

SEQ ID NO: 1291154 - RNA, 23 nt, Homo sapiens
auuuuuuaaaacaagccaagaaa

SEQ ID NO: 1291155 - RNA, 18 nt, Homo sapiens
auuuuuuugagacagagu

SEQ ID NO: 1291156 - RNA, 14 nt, Homo sapiens
caaaaaaagacagg

SEQ ID NO: 1291157 - RNA, 19 nt, Homo sapiens
caaaaaaauuaaaauggau

SEQ ID NO: 1291158 - RNA, 12 nt, Homo sapiens
caaaaacugaaa

SEQ ID NO: 1291159 - RNA, 17 nt, Homo sapiens
caaaaauauuuacacuu

SEQ ID NO: 1291160 - RNA, 23 nt, Homo sapiens
caaaacauaaacugagaaaaagu

SEQ ID NO: 1291161 - RNA, 14 nt, Homo sapiens
caaaacuacaaauc

SEQ ID NO: 1291162 - RNA, 14 nt, Homo sapiens
caaaacucuuucau

SEQ ID NO: 1291163 - RNA, 13 nt, Homo sapiens
caaaacugccuca

SEQ ID NO: 1291164 - RNA, 15 nt, Homo sapiens
caaaacuugggaaua

SEQ ID NO: 1291165 - RNA, 16 nt, Homo sapiens
caaaagcucauccauu

SEQ ID NO: 1291166 - RNA, 19 nt, Homo sapiens
caaaauaaagcuguucuca

SEQ ID NO: 1291167 - RNA, 21 nt, Homo sapiens
caaaaucauuuuauaugucaa

SEQ ID NO: 1291168 - RNA, 14 nt, Homo sapiens
caaaaucuuuccaa

SEQ ID NO: 1291169 - RNA, 19 nt, Homo sapiens
caaaaugauacuuacugaa

SEQ ID NO: 1291170 - RNA, 13 nt, Homo sapiens
caaaaugcuuuuu

SEQ ID NO: 1291171 - RNA, 20 nt, Homo sapiens
caaaauggacucaagagaga

SEQ ID NO: 1291172 - RNA, 19 nt, Homo sapiens
caaaauggauacauaaaga

SEQ ID NO: 1291173 - RNA, 13 nt, Homo sapiens
caaaaugugaaaa

SEQ ID NO: 1291174 - RNA, 17 nt, Homo sapiens
caaaauugcaaaccacg

SEQ ID NO: 1291175 - RNA, 15 nt, Homo sapiens
cauuuuucugcagaa

SEQ ID NO: 1291176 - RNA, 21 nt, Homo sapiens
cauuuuuguaauaacauuuaa

SEQ ID NO: 1291177 - RNA, 21 nt, Homo sapiens
ccaaaaauuuugugacauucc

SEQ ID NO: 1291178 - RNA, 19 nt, Homo sapiens
ccaaaagcugcucagggaa

SEQ ID NO: 1291179 - RNA, 21 nt, Homo sapiens
ccaaaaguucaacaacaccag

SEQ ID NO: 1291180 - RNA, 16 nt, Homo sapiens
ccaaaauacuccaaag

SEQ ID NO: 1291181 - RNA, 18 nt, Homo sapiens
ccaaaauacuccaaagau

SEQ ID NO: 1291182 - RNA, 19 nt, Homo sapiens
ccaaaauaguuaagacaug

SEQ ID NO: 1291183 - RNA, 18 nt, Homo sapiens
ccaaaaucggaucugggg

SEQ ID NO: 1291184 - RNA, 18 nt, Homo sapiens
ccaaaaucugucacuaca

SEQ ID NO: 1291185 - RNA, 22 nt, Homo sapiens
ccaaaaucuuaucauggucuca

SEQ ID NO: 1291186 - RNA, 16 nt, Homo sapiens
ccaaaccuuaucucca

SEQ ID NO: 1291187 - RNA, 21 nt, Homo sapiens
ccaaagagccuuuccaaagag

SEQ ID NO: 1291188 - RNA, 20 nt, Homo sapiens
ccaaagccaauaacacacag

SEQ ID NO: 1291189 - RNA, 17 nt, Homo sapiens
ccaaagcuuucauguaa

SEQ ID NO: 1291190 - RNA, 20 nt, Homo sapiens
ccaaaggaacacugacauca

SEQ ID NO: 1291191 - RNA, 20 nt, Homo sapiens
ccaaaguaucaggacgagaa

SEQ ID NO: 1291192 - RNA, 20 nt, Homo sapiens
ccaaaguccuuuuuuuccau

SEQ ID NO: 1291193 - RNA, 16 nt, Homo sapiens
ccaaaucuuguuauug

SEQ ID NO: 1291194 - RNA, 15 nt, Homo sapiens
ccaaaugcucucucu

SEQ ID NO: 1291195 - RNA, 13 nt, Homo sapiens
ccaacaaaccauc

SEQ ID NO: 1291196 - RNA, 17 nt, Homo sapiens
ccaacaaggaaacuuuc

SEQ ID NO: 1291197 - RNA, 21 nt, Homo sapiens
ccaacagaagcuuccauucca

SEQ ID NO: 1291198 - RNA, 22 nt, Homo sapiens
ccaacaggagcugggauccuaa

SEQ ID NO: 1291199 - RNA, 14 nt, Homo sapiens
ccaaccaugaauga

SEQ ID NO: 1291200 - RNA, 22 nt, Homo sapiens
ccaacuagcucuauguuuacaa

SEQ ID NO: 1291201 - RNA, 12 nt, Homo sapiens
ccaagagaccag

SEQ ID NO: 1291202 - RNA, 19 nt, Homo sapiens
ccaagcaagacugaggggu

SEQ ID NO: 1291203 - RNA, 16 nt, Homo sapiens
ccaagcaggaagcuca

SEQ ID NO: 1291204 - RNA, 19 nt, Homo sapiens
ccaagcaggaagcucagac

SEQ ID NO: 1291205 - RNA, 15 nt, Homo sapiens
ccaagcaggacagug

SEQ ID NO: 1291206 - RNA, 12 nt, Homo sapiens
ccaagccagcug

SEQ ID NO: 1291207 - RNA, 22 nt, Homo sapiens
ccaagcuccuugggaggcccca

SEQ ID NO: 1291208 - RNA, 12 nt, Homo sapiens
ccaagcucugcu

SEQ ID NO: 1291209 - RNA, 16 nt, Homo sapiens
ccaaggagcaugucac

SEQ ID NO: 1291210 - RNA, 21 nt, Homo sapiens
ccaaggagggugagugcaagg

SEQ ID NO: 1291211 - RNA, 17 nt, Homo sapiens
ccaagggccacgggaac

SEQ ID NO: 1291212 - RNA, 20 nt, Homo sapiens
ccaaggggaaucagaacuca

SEQ ID NO: 1291213 - RNA, 12 nt, Homo sapiens
ccaaggugggag

SEQ ID NO: 1291214 - RNA, 14 nt, Homo sapiens
ccaaguaccaguau

SEQ ID NO: 1291215 - RNA, 17 nt, Homo sapiens
ccaauccuggacaugaa

SEQ ID NO: 1291216 - RNA, 12 nt, Homo sapiens
ccaaugaaauga

SEQ ID NO: 1291217 - RNA, 12 nt, Homo sapiens
ccaaugaccccc

SEQ ID NO: 1291218 - RNA, 18 nt, Homo sapiens
ccaaugccaaaaaaagac

SEQ ID NO: 1291219 - RNA, 19 nt, Homo sapiens
ccaauucaauuacuauuga

SEQ ID NO: 1291220 - RNA, 18 nt, Homo sapiens
ccaauuuuuccagcauuu

SEQ ID NO: 1291221 - RNA, 18 nt, Homo sapiens
ccacaaccgaccagaugc

SEQ ID NO: 1291222 - RNA, 22 nt, Homo sapiens
ccacaauuccuccucuggccac

SEQ ID NO: 1291223 - RNA, 22 nt, Homo sapiens
ccacacccaauuccacucugau

SEQ ID NO: 1291224 - RNA, 21 nt, Homo sapiens
ccacagcaaccccaggcugaa

SEQ ID NO: 1291225 - RNA, 14 nt, Homo sapiens
ccacagcacagcca

SEQ ID NO: 1291226 - RNA, 17 nt, Homo sapiens
ccacagcuucugcagca

SEQ ID NO: 1291227 - RNA, 21 nt, Homo sapiens
ccacaguggaaagacagcuuc

SEQ ID NO: 1291228 - RNA, 21 nt, Homo sapiens
ccacaucuugcucugcugaca

SEQ ID NO: 1291229 - RNA, 11 nt, Homo sapiens
ccacauugcac

SEQ ID NO: 1291230 - RNA, 18 nt, Homo sapiens
ccaccaaccaagauuucu

SEQ ID NO: 1291231 - RNA, 17 nt, Homo sapiens
ccaccaccucaccaguu

SEQ ID NO: 1291232 - RNA, 19 nt, Homo sapiens
ccaccaccucaccaguuuc

SEQ ID NO: 1291233 - RNA, 20 nt, Homo sapiens
ccaccagcauccacacugcc

SEQ ID NO: 1291234 - RNA, 20 nt, Homo sapiens
ccacccaaugcugauguccu

SEQ ID NO: 1291235 - RNA, 22 nt, Homo sapiens
ccacccagaugggggaaagcac

SEQ ID NO: 1291236 - RNA, 23 nt, Homo sapiens
ccaccccaggcccugccagagca

SEQ ID NO: 1291237 - RNA, 14 nt, Homo sapiens
ccaccgcccagaga

SEQ ID NO: 1291238 - RNA, 17 nt, Homo sapiens
ccaccuuggcucaaguc

SEQ ID NO: 1291239 - RNA, 22 nt, Homo sapiens
ccacgagcuguuuacuagggau

SEQ ID NO: 1291240 - RNA, 18 nt, Homo sapiens
ccacgcuggagugcagug

SEQ ID NO: 1291241 - RNA, 17 nt, Homo sapiens
ccacgucacuucaugca

SEQ ID NO: 1291242 - RNA, 22 nt, Homo sapiens
ccacuaggguccaccaggaguu

SEQ ID NO: 1291243 - RNA, 15 nt, Homo sapiens
ccacucaguugcaac

SEQ ID NO: 1291244 - RNA, 14 nt, Homo sapiens
ccacucccaggcag

SEQ ID NO: 1291245 - RNA, 16 nt, Homo sapiens
ccacuccucugacuca

SEQ ID NO: 1291246 - RNA, 16 nt, Homo sapiens
ccacugacccaaauga

SEQ ID NO: 1291247 - RNA, 23 nt, Homo sapiens
ccacugauuuagccaugugaaac

SEQ ID NO: 1291248 - RNA, 12 nt, Homo sapiens
ccacugucugcc

SEQ ID NO: 1291249 - RNA, 20 nt, Homo sapiens
ccacuguuauuaacagauaa

SEQ ID NO: 1291250 - RNA, 19 nt, Homo sapiens
ccacuuucuucuaccagac

SEQ ID NO: 1291251 - RNA, 22 nt, Homo sapiens
ccagaaugcugcaggacuugag

SEQ ID NO: 1291252 - RNA, 22 nt, Homo sapiens
ccagacacuggcguuacugcuu

SEQ ID NO: 1291253 - RNA, 21 nt, Homo sapiens
ccagacagacaacacugggaa

SEQ ID NO: 1291254 - RNA, 14 nt, Homo sapiens
ccagacggcuccac

SEQ ID NO: 1291255 - RNA, 17 nt, Homo sapiens
ccagacuggagugcagg

SEQ ID NO: 1291256 - RNA, 20 nt, Homo sapiens
ccagagacauacuugaaggg

SEQ ID NO: 1291257 - RNA, 20 nt, Homo sapiens
ccagagaggguggugaccuc

SEQ ID NO: 1291258 - RNA, 18 nt, Homo sapiens
ccagagccucagugagcc

SEQ ID NO: 1291259 - RNA, 22 nt, Homo sapiens
ccagagccugucuuucagcauu

SEQ ID NO: 1291260 - RNA, 20 nt, Homo sapiens
ccagaggauugcugccccau

SEQ ID NO: 1291261 - RNA, 18 nt, Homo sapiens
ccagaggcaccucaagaa

SEQ ID NO: 1291262 - RNA, 16 nt, Homo sapiens
ccagagggaauugcag

SEQ ID NO: 1291263 - RNA, 21 nt, Homo sapiens
ccagaguuccccaugcagaca

SEQ ID NO: 1291264 - RNA, 12 nt, Homo sapiens
ccagaucuugcc

SEQ ID NO: 1291265 - RNA, 19 nt, Homo sapiens
ccagaucuugccuccagag

SEQ ID NO: 1291266 - RNA, 12 nt, Homo sapiens
ccagaugugguu

SEQ ID NO: 1291267 - RNA, 18 nt, Homo sapiens
ccagauguuuccagacuu

SEQ ID NO: 1291268 - RNA, 12 nt, Homo sapiens
ccagauugcaac

SEQ ID NO: 1291269 - RNA, 17 nt, Homo sapiens
ccagcacacagggcagu

SEQ ID NO: 1291270 - RNA, 22 nt, Homo sapiens
ccagcaccggccccauuuaccc

SEQ ID NO: 1291271 - RNA, 13 nt, Homo sapiens
ccagcacuugaau

SEQ ID NO: 1291272 - RNA, 10 nt, Homo sapiens
ccagcacuuu

SEQ ID NO: 1291273 - RNA, 12 nt, Homo sapiens
ccagcacuuugg

SEQ ID NO: 1291274 - RNA, 20 nt, Homo sapiens
ccagcacuuugggaggccaa

SEQ ID NO: 1291275 - RNA, 15 nt, Homo sapiens
ccagcagcgccuuuc

SEQ ID NO: 1291276 - RNA, 19 nt, Homo sapiens
ccagcagggaaaaugcagc

SEQ ID NO: 1291277 - RNA, 17 nt, Homo sapiens
ccagccacuggcugcua

SEQ ID NO: 1291278 - RNA, 19 nt, Homo sapiens
ccagccagauggacuccag

SEQ ID NO: 1291279 - RNA, 16 nt, Homo sapiens
ccagccccugccagcu

SEQ ID NO: 1291280 - RNA, 22 nt, Homo sapiens
ccagccucaaaaacgcccucaa

SEQ ID NO: 1291281 - RNA, 15 nt, Homo sapiens
ccagccuccaaugua

SEQ ID NO: 1291282 - RNA, 22 nt, Homo sapiens
ccagccugcuagcuagcucaac

SEQ ID NO: 1291283 - RNA, 16 nt, Homo sapiens
ccagcuacaccuuucu

SEQ ID NO: 1291284 - RNA, 12 nt, Homo sapiens
ccagcuaucugc

SEQ ID NO: 1291285 - RNA, 16 nt, Homo sapiens
ccagcuaucugccuga

SEQ ID NO: 1291286 - RNA, 18 nt, Homo sapiens
ccagcugcacugaugcug

SEQ ID NO: 1291287 - RNA, 20 nt, Homo sapiens
ccagcuuaaaggcaguauuu

SEQ ID NO: 1291288 - RNA, 12 nt, Homo sapiens
ccagcuuucuaa

SEQ ID NO: 1291289 - RNA, 18 nt, Homo sapiens
ccagcuuuggcugcugaa

SEQ ID NO: 1291290 - RNA, 23 nt, Homo sapiens
ccaggaaacaaggggucugagga

SEQ ID NO: 1291291 - RNA, 14 nt, Homo sapiens
ccaggaccaugcag

SEQ ID NO: 1291292 - RNA, 13 nt, Homo sapiens
ccaggacccugaa

SEQ ID NO: 1291293 - RNA, 21 nt, Homo sapiens
ccaggagauggaaguugcagu

SEQ ID NO: 1291294 - RNA, 16 nt, Homo sapiens
ccaggagcgcaucuca

SEQ ID NO: 1291295 - RNA, 21 nt, Homo sapiens
ccaggaggaguuagccaaaca

SEQ ID NO: 1291296 - RNA, 22 nt, Homo sapiens
ccaggaggcccugguccuggcc

SEQ ID NO: 1291297 - RNA, 21 nt, Homo sapiens
ccaggccaguuugaagacuac

SEQ ID NO: 1291298 - RNA, 20 nt, Homo sapiens
ccaggcccauuuccugcuuu

SEQ ID NO: 1291299 - RNA, 18 nt, Homo sapiens
ccaggccugggaauggau

SEQ ID NO: 1291300 - RNA, 23 nt, Homo sapiens
ccaggcugaccacagcacagcca

SEQ ID NO: 1291301 - RNA, 23 nt, Homo sapiens
ccaggcuggaaugcaguggugcg

SEQ ID NO: 1291302 - RNA, 20 nt, Homo sapiens
ccaggcuggagugcaguggu

SEQ ID NO: 1291303 - RNA, 14 nt, Homo sapiens
ccagggaacagcca

SEQ ID NO: 1291304 - RNA, 16 nt, Homo sapiens
ccagggacacauuucu

SEQ ID NO: 1291305 - RNA, 17 nt, Homo sapiens
ccagggagaagcuccuc

SEQ ID NO: 1291306 - RNA, 17 nt, Homo sapiens
ccagggauuugccucac

SEQ ID NO: 1291307 - RNA, 21 nt, Homo sapiens
ccagggcugccccuaaucucu

SEQ ID NO: 1291308 - RNA, 17 nt, Homo sapiens
acaucuuuuacauucug

SEQ ID NO: 1291309 - RNA, 19 nt, Homo sapiens
acaucuuuuacauucugca

SEQ ID NO: 1291310 - RNA, 17 nt, Homo sapiens
acaugagaagugauaaa

SEQ ID NO: 1291311 - RNA, 17 nt, Homo sapiens
acaugcacucagcucuu

SEQ ID NO: 1291312 - RNA, 21 nt, Homo sapiens
acaugcacucagcucuuggcu

SEQ ID NO: 1291313 - RNA, 14 nt, Homo sapiens
acaugccaagcacu

SEQ ID NO: 1291314 - RNA, 17 nt, Homo sapiens
acaugcgguagccagca

SEQ ID NO: 1291315 - RNA, 23 nt, Homo sapiens
acaugcuauguucugucuuccca

SEQ ID NO: 1291316 - RNA, 15 nt, Homo sapiens
acaugcucaggcuac

SEQ ID NO: 1291317 - RNA, 18 nt, Homo sapiens
acaugcugaagccaaagc

SEQ ID NO: 1291318 - RNA, 14 nt, Homo sapiens
acaugcuucagugc

SEQ ID NO: 1291319 - RNA, 19 nt, Homo sapiens
acaugcuucagugcugcuc

SEQ ID NO: 1291320 - RNA, 17 nt, Homo sapiens
acauggugaaacccugu

SEQ ID NO: 1291321 - RNA, 15 nt, Homo sapiens
acauguaauuugaug

SEQ ID NO: 1291322 - RNA, 13 nt, Homo sapiens
acaugugcacaug

SEQ ID NO: 1291323 - RNA, 23 nt, Homo sapiens
acauguuaggaagguacugucau

SEQ ID NO: 1291324 - RNA, 13 nt, Homo sapiens
acauuagaucuag

SEQ ID NO: 1291325 - RNA, 15 nt, Homo sapiens
acauuaguugcacua

SEQ ID NO: 1291326 - RNA, 17 nt, Homo sapiens
acauucagagcuuacuu

SEQ ID NO: 1291327 - RNA, 20 nt, Homo sapiens
acauucugcaagcacaucug

SEQ ID NO: 1291328 - RNA, 12 nt, Homo sapiens
acauucuuggcu

SEQ ID NO: 1291329 - RNA, 18 nt, Homo sapiens
acauugauucaugucuca

SEQ ID NO: 1291330 - RNA, 22 nt, Homo sapiens
acauuggcaccuaauccaggca

SEQ ID NO: 1291331 - RNA, 18 nt, Homo sapiens
acauugugaaaaggcaaa

SEQ ID NO: 1291332 - RNA, 21 nt, Homo sapiens
acauuguuuuguguaacauau

SEQ ID NO: 1291333 - RNA, 18 nt, Homo sapiens
acauuuauucugcucaca

SEQ ID NO: 1291334 - RNA, 21 nt, Homo sapiens
acauuuggaaauguggucauc

SEQ ID NO: 1291335 - RNA, 19 nt, Homo sapiens
acauuuuacccacacacag

SEQ ID NO: 1291336 - RNA, 22 nt, Homo sapiens
acauuuuuaaaaauugucauuu

SEQ ID NO: 1291337 - RNA, 18 nt, Homo sapiens
acauuuuuccguuugcuu

SEQ ID NO: 1291338 - RNA, 12 nt, Homo sapiens
accaaaaacuga

SEQ ID NO: 1291339 - RNA, 22 nt, Homo sapiens
accaaaauuuugucccaucucu

SEQ ID NO: 1291340 - RNA, 12 nt, Homo sapiens
accaaagcuuua

SEQ ID NO: 1291341 - RNA, 13 nt, Homo sapiens
accaaauuuguau

SEQ ID NO: 1291342 - RNA, 17 nt, Homo sapiens
accaacugaaggcuaaa

SEQ ID NO: 1291343 - RNA, 20 nt, Homo sapiens
accaagcuuucaaacauguu

SEQ ID NO: 1291344 - RNA, 16 nt, Homo sapiens
accaauuugcaccagu

SEQ ID NO: 1291345 - RNA, 18 nt, Homo sapiens
ccaggggggacaauaugu

SEQ ID NO: 1291346 - RNA, 17 nt, Homo sapiens
ccaggguagaggcugac

SEQ ID NO: 1291347 - RNA, 17 nt, Homo sapiens
ccaggguggagugcagu

SEQ ID NO: 1291348 - RNA, 22 nt, Homo sapiens
ccaggucucuccacugcucuca

SEQ ID NO: 1291349 - RNA, 13 nt, Homo sapiens
ccaggugggccug

SEQ ID NO: 1291350 - RNA, 22 nt, Homo sapiens
ccaguaggaaaagcaaugcuuu

SEQ ID NO: 1291351 - RNA, 23 nt, Homo sapiens
ccagucccuguccggaaugccac

SEQ ID NO: 1291352 - RNA, 14 nt, Homo sapiens
ccagucgaccccaa

SEQ ID NO: 1291353 - RNA, 19 nt, Homo sapiens
ccaguuguuaaaaugagca

SEQ ID NO: 1291354 - RNA, 22 nt, Homo sapiens
ccaguuugaagacuacaugaac

SEQ ID NO: 1291355 - RNA, 16 nt, Homo sapiens
ccauaguaccauuuau

SEQ ID NO: 1291356 - RNA, 18 nt, Homo sapiens
cccgaaauagauccagug

SEQ ID NO: 1291357 - RNA, 15 nt, Homo sapiens
cccgacucugauacc

SEQ ID NO: 1291358 - RNA, 21 nt, Homo sapiens
cccggggcggcaggaaggggg

SEQ ID NO: 1291359 - RNA, 17 nt, Homo sapiens
cccuaaaagcacacuca

SEQ ID NO: 1291360 - RNA, 17 nt, Homo sapiens
cccuaaaauauuacaaa

SEQ ID NO: 1291361 - RNA, 23 nt, Homo sapiens
cccuaaaauauuacaaaauaagu

SEQ ID NO: 1291362 - RNA, 15 nt, Homo sapiens
cccuaaaccaaaaac

SEQ ID NO: 1291363 - RNA, 17 nt, Homo sapiens
cccuaaaucuugacuac

SEQ ID NO: 1291364 - RNA, 20 nt, Homo sapiens
cccuacaaaaccacuggaaa

SEQ ID NO: 1291365 - RNA, 15 nt, Homo sapiens
cccuacugcugugaa

SEQ ID NO: 1291366 - RNA, 18 nt, Homo sapiens
cccuagauuuaaccaugg

SEQ ID NO: 1291367 - RNA, 23 nt, Homo sapiens
cccuagauuuaaccauggcacug

SEQ ID NO: 1291368 - RNA, 23 nt, Homo sapiens
cccuauaugcuuacugugcaccu

SEQ ID NO: 1291369 - RNA, 15 nt, Homo sapiens
cccucagagugcaag

SEQ ID NO: 1291370 - RNA, 13 nt, Homo sapiens
cccucaucauagc

SEQ ID NO: 1291371 - RNA, 18 nt, Homo sapiens
cccuccguggcaucaccu

SEQ ID NO: 1291372 - RNA, 21 nt, Homo sapiens
cccucgucaucaggugcauag

SEQ ID NO: 1291373 - RNA, 17 nt, Homo sapiens
cccucucguguuugauu

SEQ ID NO: 1291374 - RNA, 19 nt, Homo sapiens
cccucugucauccucagga

SEQ ID NO: 1291375 - RNA, 19 nt, Homo sapiens
cccucuuuguuucugcuuc

SEQ ID NO: 1291376 - RNA, 21 nt, Homo sapiens
cccugccaugcucuccaaacc

SEQ ID NO: 1291377 - RNA, 13 nt, Homo sapiens
cccugcccggcug

SEQ ID NO: 1291378 - RNA, 14 nt, Homo sapiens
cccugccgugggcc

SEQ ID NO: 1291379 - RNA, 15 nt, Homo sapiens
cccuggccaccccau

SEQ ID NO: 1291380 - RNA, 19 nt, Homo sapiens
cccuggccuccccugccac

SEQ ID NO: 1291381 - RNA, 16 nt, Homo sapiens
cccugggccucagugu

SEQ ID NO: 1291382 - RNA, 23 nt, Homo sapiens
cccugggccuggcagcucagcuu

SEQ ID NO: 1291383 - RNA, 17 nt, Homo sapiens
cccuggggaaggagcca

SEQ ID NO: 1291384 - RNA, 20 nt, Homo sapiens
cccugggggcugugauauua

SEQ ID NO: 1291385 - RNA, 14 nt, Homo sapiens
cccugggguggcca

SEQ ID NO: 1291386 - RNA, 20 nt, Homo sapiens
cccugggguggccaccagua

SEQ ID NO: 1291387 - RNA, 18 nt, Homo sapiens
cccuguaguugacaauuc

SEQ ID NO: 1291388 - RNA, 19 nt, Homo sapiens
cccuguaguugacaauucu

SEQ ID NO: 1291389 - RNA, 22 nt, Homo sapiens
cccuguaguugacaauucugca

SEQ ID NO: 1291390 - RNA, 17 nt, Homo sapiens
cccuguccugaaagcca

SEQ ID NO: 1291391 - RNA, 17 nt, Homo sapiens
cccuuacuaugaucuca

SEQ ID NO: 1291392 - RNA, 19 nt, Homo sapiens
cccuucauacccaccagga

SEQ ID NO: 1291393 - RNA, 20 nt, Homo sapiens
cccuucccucaccuuggcac

SEQ ID NO: 1291394 - RNA, 15 nt, Homo sapiens
cccuuggaugugaug

SEQ ID NO: 1291395 - RNA, 16 nt, Homo sapiens
cccuuuccccagugac

SEQ ID NO: 1291396 - RNA, 13 nt, Homo sapiens
cccuuuuacauac

SEQ ID NO: 1291397 - RNA, 13 nt, Homo sapiens
ccgaaaucagaag

SEQ ID NO: 1291398 - RNA, 20 nt, Homo sapiens
ccgaagucuuuuguucgcau

SEQ ID NO: 1291399 - RNA, 17 nt, Homo sapiens
ccgaauagcugggacua

SEQ ID NO: 1291400 - RNA, 22 nt, Homo sapiens
ccgagcuuugaaaauucagugg

SEQ ID NO: 1291401 - RNA, 14 nt, Homo sapiens
ccgaggaaggugug

SEQ ID NO: 1291402 - RNA, 15 nt, Homo sapiens
ccgccugccugccac

SEQ ID NO: 1291403 - RNA, 20 nt, Homo sapiens
ccgccuggccggcuccaguu

SEQ ID NO: 1291404 - RNA, 18 nt, Homo sapiens
ccgcgagccaggcugacc

SEQ ID NO: 1291405 - RNA, 23 nt, Homo sapiens
ccgcgugaucaaagccacacucu

SEQ ID NO: 1291406 - RNA, 16 nt, Homo sapiens
ccgcugcgggcccacg

SEQ ID NO: 1291407 - RNA, 19 nt, Homo sapiens
ccgcuggugacccucugcu

SEQ ID NO: 1291408 - RNA, 18 nt, Homo sapiens
ccgcuguggccuucguca

SEQ ID NO: 1291409 - RNA, 18 nt, Homo sapiens
ccggcaccuacaucccca

SEQ ID NO: 1291410 - RNA, 23 nt, Homo sapiens
ccggcgaaauaaaaucagaguug

SEQ ID NO: 1291411 - RNA, 20 nt, Homo sapiens
ccgggaagagggugauugcu

SEQ ID NO: 1291412 - RNA, 12 nt, Homo sapiens
ccgggagacuga

SEQ ID NO: 1291413 - RNA, 17 nt, Homo sapiens
ccgggcaauccagacag

SEQ ID NO: 1291414 - RNA, 22 nt, Homo sapiens
ccgggcuuuuccaagcugccac

SEQ ID NO: 1291415 - RNA, 15 nt, Homo sapiens
ccggggaaaggcaag

SEQ ID NO: 1291416 - RNA, 16 nt, Homo sapiens
ccggggccagcacuuc

SEQ ID NO: 1291417 - RNA, 13 nt, Homo sapiens
ccguccauuccag

SEQ ID NO: 1291418 - RNA, 17 nt, Homo sapiens
ccgugaccagugcugcu

SEQ ID NO: 1291419 - RNA, 18 nt, Homo sapiens
ccgugaggcaaugggagc

SEQ ID NO: 1291420 - RNA, 16 nt, Homo sapiens
ccguggcacucaugga

SEQ ID NO: 1291421 - RNA, 15 nt, Homo sapiens
ccgugggaguacaaa

SEQ ID NO: 1291422 - RNA, 15 nt, Homo sapiens
ccguuccacauccac

SEQ ID NO: 1291423 - RNA, 13 nt, Homo sapiens
ccguucucuguau

SEQ ID NO: 1291424 - RNA, 13 nt, Homo sapiens
ccuaaaagcacac

SEQ ID NO: 1291425 - RNA, 14 nt, Homo sapiens
ccuaaauguuaacu

SEQ ID NO: 1291426 - RNA, 19 nt, Homo sapiens
ccuaacguuugucauucca

SEQ ID NO: 1291427 - RNA, 16 nt, Homo sapiens
ccuaagacgucccuuu

SEQ ID NO: 1291428 - RNA, 14 nt, Homo sapiens
ccuaaggugucuga

SEQ ID NO: 1291429 - RNA, 13 nt, Homo sapiens
ccuaagucuuucu

SEQ ID NO: 1291430 - RNA, 19 nt, Homo sapiens
ccuaauccaggcagaucca

SEQ ID NO: 1291431 - RNA, 22 nt, Homo sapiens
ccuaaucuauggucgggagaca

SEQ ID NO: 1291432 - RNA, 16 nt, Homo sapiens
ccuaaugcugcagauu

SEQ ID NO: 1291433 - RNA, 18 nt, Homo sapiens
ccuacaccucuugaaaau

SEQ ID NO: 1291434 - RNA, 21 nt, Homo sapiens
ccuaccucacagagugcauug

SEQ ID NO: 1291435 - RNA, 15 nt, Homo sapiens
ccuagcccugggaca

SEQ ID NO: 1291436 - RNA, 12 nt, Homo sapiens
ccuagcuaccuu

SEQ ID NO: 1291437 - RNA, 17 nt, Homo sapiens
ccuaggcauuugcugaa

SEQ ID NO: 1291438 - RNA, 20 nt, Homo sapiens
ccuauauagaugcagcauuu

SEQ ID NO: 1291439 - RNA, 17 nt, Homo sapiens
ccuaugcuauugacaau

SEQ ID NO: 1291440 - RNA, 11 nt, Homo sapiens
ccuauuugacu

SEQ ID NO: 1291441 - RNA, 20 nt, Homo sapiens
ccucacagagugcauuguga

SEQ ID NO: 1291442 - RNA, 20 nt, Homo sapiens
ccucacccccuccuucauau

SEQ ID NO: 1291443 - RNA, 22 nt, Homo sapiens
ccucacucuguuuccuggucag

SEQ ID NO: 1291444 - RNA, 21 nt, Homo sapiens
ccucagccuugaaaaacaagu

SEQ ID NO: 1291445 - RNA, 17 nt, Homo sapiens
ccucaggcaggugggau

SEQ ID NO: 1291446 - RNA, 21 nt, Homo sapiens
ccucagggcuggcagaugcag

SEQ ID NO: 1291447 - RNA, 16 nt, Homo sapiens
ccucaggugcuaggga

SEQ ID NO: 1291448 - RNA, 21 nt, Homo sapiens
ccucaguaagacgacaaggaa

SEQ ID NO: 1291449 - RNA, 13 nt, Homo sapiens
ccucaucaucaga

SEQ ID NO: 1291450 - RNA, 13 nt, Homo sapiens
ccucauuagcauu

SEQ ID NO: 1291451 - RNA, 12 nt, Homo sapiens
ccuccacugacu

SEQ ID NO: 1291452 - RNA, 16 nt, Homo sapiens
ccuccagaauggagcu

SEQ ID NO: 1291453 - RNA, 10 nt, Homo sapiens
ccuccaggga

SEQ ID NO: 1291454 - RNA, 15 nt, Homo sapiens
ccucccugcaucuga

SEQ ID NO: 1291455 - RNA, 11 nt, Homo sapiens
ccuccucacaa

SEQ ID NO: 1291456 - RNA, 18 nt, Homo sapiens
ccuccucccuaaugcuca

SEQ ID NO: 1291457 - RNA, 17 nt, Homo sapiens
ccuccugaggcuuuggc

SEQ ID NO: 1291458 - RNA, 20 nt, Homo sapiens
ccuccugcccagcacaggaa

SEQ ID NO: 1291459 - RNA, 15 nt, Homo sapiens
ccucgcuggacucuc

SEQ ID NO: 1291460 - RNA, 15 nt, Homo sapiens
ccucuacccacuucu

SEQ ID NO: 1291461 - RNA, 20 nt, Homo sapiens
ccucuaguagcugaaaugca

SEQ ID NO: 1291462 - RNA, 13 nt, Homo sapiens
ccucuaugaacua

SEQ ID NO: 1291463 - RNA, 15 nt, Homo sapiens
ccucucaguacuuug

SEQ ID NO: 1291464 - RNA, 18 nt, Homo sapiens
ccucucccggcaacaucu

SEQ ID NO: 1291465 - RNA, 15 nt, Homo sapiens
ccucuccuccguggc

SEQ ID NO: 1291466 - RNA, 12 nt, Homo sapiens
ccucucugcucu

SEQ ID NO: 1291467 - RNA, 22 nt, Homo sapiens
ccucugcauggaacagcauuac

SEQ ID NO: 1291468 - RNA, 17 nt, Homo sapiens
ccucugggucagugguc

SEQ ID NO: 1291469 - RNA, 21 nt, Homo sapiens
ccucuggucgcuccugcccac

SEQ ID NO: 1291470 - RNA, 19 nt, Homo sapiens
ccucuguccccuucucuca

SEQ ID NO: 1291471 - RNA, 13 nt, Homo sapiens
ccucugugaagca

SEQ ID NO: 1291472 - RNA, 17 nt, Homo sapiens
ccucuuagaaaaaccac

SEQ ID NO: 1291473 - RNA, 22 nt, Homo sapiens
ccucuuggccugaucagaccac

SEQ ID NO: 1291474 - RNA, 21 nt, Homo sapiens
ccucuuuagccagaaucucau

SEQ ID NO: 1291475 - RNA, 16 nt, Homo sapiens
ccucuuucacauugaa

SEQ ID NO: 1291476 - RNA, 18 nt, Homo sapiens
ccucuuugucuaaaacaa

SEQ ID NO: 1291477 - RNA, 14 nt, Homo sapiens
ccugaaacuuugag

SEQ ID NO: 1291478 - RNA, 14 nt, Homo sapiens
ccugaagaaccagu

SEQ ID NO: 1291479 - RNA, 14 nt, Homo sapiens
ccugaagucacaca

SEQ ID NO: 1291480 - RNA, 14 nt, Homo sapiens
ccugacaccuuuca

SEQ ID NO: 1291481 - RNA, 12 nt, Homo sapiens
ccugacccugua

SEQ ID NO: 1291482 - RNA, 18 nt, Homo sapiens
ccugacuccuccaaggaa

SEQ ID NO: 1291483 - RNA, 19 nt, Homo sapiens
ccugagaaacccaccagcc

SEQ ID NO: 1291484 - RNA, 13 nt, Homo sapiens
ccugagagucagc

SEQ ID NO: 1291485 - RNA, 17 nt, Homo sapiens
ccugagauuucaucugc

SEQ ID NO: 1291486 - RNA, 15 nt, Homo sapiens
ccugagcagaaagag

SEQ ID NO: 1291487 - RNA, 14 nt, Homo sapiens
ccugagccagagac

SEQ ID NO: 1291488 - RNA, 17 nt, Homo sapiens
ccugaggaugggucaga

SEQ ID NO: 1291489 - RNA, 15 nt, Homo sapiens
ccugagggagcucca

SEQ ID NO: 1291490 - RNA, 15 nt, Homo sapiens
ccugagguuugccag

SEQ ID NO: 1291491 - RNA, 15 nt, Homo sapiens
cgguuaccucugcau

SEQ ID NO: 1291492 - RNA, 18 nt, Homo sapiens
cgguuugaagccuggaac

SEQ ID NO: 1291493 - RNA, 17 nt, Homo sapiens
cguaaacacgccugcaa

SEQ ID NO: 1291494 - RNA, 19 nt, Homo sapiens
cguaaacacgccugcaaac

SEQ ID NO: 1291495 - RNA, 20 nt, Homo sapiens
cguccagcuggaagggucaa

SEQ ID NO: 1291496 - RNA, 12 nt, Homo sapiens
cguccuggucaa

SEQ ID NO: 1291497 - RNA, 21 nt, Homo sapiens
gagcucccaggugcagccaga

SEQ ID NO: 1291498 - RNA, 16 nt, Homo sapiens
gagcugacacaggaug

SEQ ID NO: 1291499 - RNA, 22 nt, Homo sapiens
gagcugcccccuccaggccagu

SEQ ID NO: 1291500 - RNA, 16 nt, Homo sapiens
gagcuugcaagaagca

SEQ ID NO: 1291501 - RNA, 23 nt, Homo sapiens
gaggaaaagagaaggaaagugau

SEQ ID NO: 1291502 - RNA, 18 nt, Homo sapiens
gaggacacuaaccacgcu

SEQ ID NO: 1291503 - RNA, 15 nt, Homo sapiens
gaggacccagcacug

SEQ ID NO: 1291504 - RNA, 20 nt, Homo sapiens
gaggcaaauggcacugcagg

SEQ ID NO: 1291505 - RNA, 19 nt, Homo sapiens
gaggcaagugugggccacu

SEQ ID NO: 1291506 - RNA, 20 nt, Homo sapiens
gaggcagagguugcagugag

SEQ ID NO: 1291507 - RNA, 21 nt, Homo sapiens
gaggcagggacaccuggacaa

SEQ ID NO: 1291508 - RNA, 17 nt, Homo sapiens
gaggccaacacuguggg

SEQ ID NO: 1291509 - RNA, 18 nt, Homo sapiens
gaggccagccagugaccu

SEQ ID NO: 1291510 - RNA, 19 nt, Homo sapiens
gccacaaugcaguucugag

SEQ ID NO: 1291511 - RNA, 22 nt, Homo sapiens
gccacacucagcacaaggccau

SEQ ID NO: 1291512 - RNA, 16 nt, Homo sapiens
gccacagacaauaugg

SEQ ID NO: 1291513 - RNA, 16 nt, Homo sapiens
gccacagcagcuuugu

SEQ ID NO: 1291514 - RNA, 18 nt, Homo sapiens
gccacauuuggaauacuu

SEQ ID NO: 1291515 - RNA, 11 nt, Homo sapiens
gccacccagca

SEQ ID NO: 1291516 - RNA, 22 nt, Homo sapiens
gccacccugugggccgggcaau

SEQ ID NO: 1291517 - RNA, 16 nt, Homo sapiens
gccaccgcccagagac

SEQ ID NO: 1291518 - RNA, 14 nt, Homo sapiens
gccacgugggcaaa

SEQ ID NO: 1291519 - RNA, 16 nt, Homo sapiens
gccacuauuacuggga

SEQ ID NO: 1291520 - RNA, 19 nt, Homo sapiens
gccacuccccuccacucuc

SEQ ID NO: 1291521 - RNA, 19 nt, Homo sapiens
gccagacaugccacaagga

SEQ ID NO: 1291522 - RNA, 16 nt, Homo sapiens
gccagagauaaacuaa

SEQ ID NO: 1291523 - RNA, 24 nt, Homo sapiens
gccagcaccugcgggagcugcacu

SEQ ID NO: 1291524 - RNA, 11 nt, Homo sapiens
gccagcacuuc

SEQ ID NO: 1291525 - RNA, 12 nt, Homo sapiens
gccagcagagua

SEQ ID NO: 1291526 - RNA, 19 nt, Homo sapiens
gccagcagggaagaucugg

SEQ ID NO: 1291527 - RNA, 21 nt, Homo sapiens
gccagcuucgagcuacaugca

SEQ ID NO: 1291528 - RNA, 17 nt, Homo sapiens
gccaggagcgcaucuca

SEQ ID NO: 1291529 - RNA, 18 nt, Homo sapiens
gccaggcaugguggccca

SEQ ID NO: 1291530 - RNA, 15 nt, Homo sapiens
gccaggcugaucucg

SEQ ID NO: 1291531 - RNA, 17 nt, Homo sapiens
gccaggggcgaggcccu

SEQ ID NO: 1291532 - RNA, 23 nt, Homo sapiens
gccaguacucgggacagacuaag

SEQ ID NO: 1291533 - RNA, 16 nt, Homo sapiens
gcuuugcuuucugcuc

SEQ ID NO: 1291534 - RNA, 21 nt, Homo sapiens
gcuuuggcaaauaaaccuccu

SEQ ID NO: 1291535 - RNA, 20 nt, Homo sapiens
gcuuuggugagaaccugggu

SEQ ID NO: 1291536 - RNA, 13 nt, Homo sapiens
gcuuuguugcacu

SEQ ID NO: 1291537 - RNA, 13 nt, Homo sapiens
gcuuuugccauua

SEQ ID NO: 1291538 - RNA, 18 nt, Homo sapiens
gcuuuuuuaaacuugaau

SEQ ID NO: 1291539 - RNA, 22 nt, Homo sapiens
ggaaaaaauaacaaugaaaguu

SEQ ID NO: 1291540 - RNA, 16 nt, Homo sapiens
ggaaaacgaagcucau

SEQ ID NO: 1291541 - RNA, 22 nt, Homo sapiens
ggaaaacgaagcucauucccaa

SEQ ID NO: 1291542 - RNA, 23 nt, Homo sapiens
ggaaaacuacagguguuguccaa

SEQ ID NO: 1291543 - RNA, 12 nt, Homo sapiens
ggaaaaugcauu

SEQ ID NO: 1291544 - RNA, 14 nt, Homo sapiens
ggaaaccacagcug

SEQ ID NO: 1291545 - RNA, 16 nt, Homo sapiens
ggaaagaaaugcccau

SEQ ID NO: 1291546 - RNA, 16 nt, Homo sapiens
ggaaagaacugucaug

SEQ ID NO: 1291547 - RNA, 15 nt, Homo sapiens
ggaaagcagcucaaa

SEQ ID NO: 1291548 - RNA, 22 nt, Homo sapiens
ggaaaggcaaaugcccaaggga

SEQ ID NO: 1291549 - RNA, 11 nt, Homo sapiens
ggaaaugucac

SEQ ID NO: 1291550 - RNA, 22 nt, Homo sapiens
ggaaauguucuuuagauggugg

SEQ ID NO: 1291551 - RNA, 16 nt, Homo sapiens
ggaacacugaaacugu

SEQ ID NO: 1291552 - RNA, 19 nt, Homo sapiens
ggaacauccuccacugacu

SEQ ID NO: 1291553 - RNA, 14 nt, Homo sapiens
ggaacccagacuca

SEQ ID NO: 1291554 - RNA, 18 nt, Homo sapiens
ggaacccagacucagaca

SEQ ID NO: 1291555 - RNA, 23 nt, Homo sapiens
ggaaccgcaggaagcugcuccgu

SEQ ID NO: 1291556 - RNA, 19 nt, Homo sapiens
ggaaccguaggacccaagc

SEQ ID NO: 1291557 - RNA, 22 nt, Homo sapiens
ggaaccguaggacccaagcaga

SEQ ID NO: 1291558 - RNA, 22 nt, Homo sapiens
ggaaccucagccuggccagaca

SEQ ID NO: 1291559 - RNA, 17 nt, Homo sapiens
ggaaccucgaguacugu

SEQ ID NO: 1291560 - RNA, 14 nt, Homo sapiens
ggaacucagaucca

SEQ ID NO: 1291561 - RNA, 16 nt, Homo sapiens
ggaagagcagugcugu

SEQ ID NO: 1291562 - RNA, 17 nt, Homo sapiens
ggaagaggcuacagggc

SEQ ID NO: 1291563 - RNA, 14 nt, Homo sapiens
ggaagccaaagagu

SEQ ID NO: 1291564 - RNA, 15 nt, Homo sapiens
ggaagcuaauuugca

SEQ ID NO: 1291565 - RNA, 22 nt, Homo sapiens
ggaagcuaccaggggaggcagu

SEQ ID NO: 1291566 - RNA, 21 nt, Homo sapiens
ggaagcuuucugucuccuuaa

SEQ ID NO: 1291567 - RNA, 12 nt, Homo sapiens
gguucugaugau

SEQ ID NO: 1291568 - RNA, 14 nt, Homo sapiens
gguucugccucucc

SEQ ID NO: 1291569 - RNA, 14 nt, Homo sapiens
gguugaucuugcaa

SEQ ID NO: 1291570 - RNA, 17 nt, Homo sapiens
gguugguuuaaugcaau

SEQ ID NO: 1291571 - RNA, 20 nt, Homo sapiens
gguuuagaggaccagugagu

SEQ ID NO: 1291572 - RNA, 17 nt, Homo sapiens
gguuuaucagcaaaaaa

SEQ ID NO: 1291573 - RNA, 17 nt, Homo sapiens
gguuucucagaauccaa

SEQ ID NO: 1291574 - RNA, 21 nt, Homo sapiens
gguuugccaaaauucauuucu

SEQ ID NO: 1291575 - RNA, 23 nt, Homo sapiens
gguuugucacacgauaaagggau

SEQ ID NO: 1291576 - RNA, 23 nt, Homo sapiens
gguuugucgggcaccagccagcg

SEQ ID NO: 1291577 - RNA, 15 nt, Homo sapiens
gguuuuacugcagcu

SEQ ID NO: 1291578 - RNA, 12 nt, Homo sapiens
guaaaacaugcu

SEQ ID NO: 1291579 - RNA, 21 nt, Homo sapiens
guaaaacauuccaaauaauuc

SEQ ID NO: 1291580 - RNA, 20 nt, Homo sapiens
guaaaagucuguaaauaugu

SEQ ID NO: 1291581 - RNA, 20 nt, Homo sapiens
guaaaauauagcuguacaaa

SEQ ID NO: 1291582 - RNA, 23 nt, Homo sapiens
guaaaauugaaaggcauucucug

SEQ ID NO: 1291583 - RNA, 14 nt, Homo sapiens
guaaacugugcacc

SEQ ID NO: 1291584 - RNA, 12 nt, Homo sapiens
guaaagccaugc

SEQ ID NO: 1291585 - RNA, 17 nt, Homo sapiens
guaaagggcgcaaaggg

SEQ ID NO: 1291586 - RNA, 14 nt, Homo sapiens
guaaagugauuaaa

SEQ ID NO: 1291587 - RNA, 19 nt, Homo sapiens
guaaaguuuauuacuuuau

SEQ ID NO: 1291588 - RNA, 17 nt, Homo sapiens
guaaauagcucaggugu

SEQ ID NO: 1291589 - RNA, 21 nt, Homo sapiens
guaaaucauguugaucaugua

SEQ ID NO: 1291590 - RNA, 22 nt, Homo sapiens
guaacugugccaguucuuucca

SEQ ID NO: 1291591 - RNA, 23 nt, Homo sapiens
guaagaaacauccauauugcaca

SEQ ID NO: 1291592 - RNA, 19 nt, Homo sapiens
guaagaccucugagaccaa

SEQ ID NO: 1291593 - RNA, 18 nt, Homo sapiens
guaagucaaaugugugcu

SEQ ID NO: 1291594 - RNA, 13 nt, Homo sapiens
guaauaacauuua

SEQ ID NO: 1291595 - RNA, 15 nt, Homo sapiens
guaaucaacauucca

SEQ ID NO: 1291596 - RNA, 16 nt, Homo sapiens
guaaucccagcacuuu

SEQ ID NO: 1291597 - RNA, 18 nt, Homo sapiens
guaaucccagcacuuugg

SEQ ID NO: 1291598 - RNA, 18 nt, Homo sapiens
guaaucccagcuacucga

SEQ ID NO: 1291599 - RNA, 17 nt, Homo sapiens
guaaucuuuggcuguaa

SEQ ID NO: 1291600 - RNA, 19 nt, Homo sapiens
guaauggaacuuagccauu

SEQ ID NO: 1291601 - RNA, 11 nt, Homo sapiens
guaauggagca

SEQ ID NO: 1291602 - RNA, 13 nt, Homo sapiens
guaauucucaggc

SEQ ID NO: 1291603 - RNA, 22 nt, Homo sapiens
guacaaaaauaaauuuauauga

SEQ ID NO: 1291604 - RNA, 13 nt, Homo sapiens
guacaaaggggaa

SEQ ID NO: 1291605 - RNA, 11 nt, Homo sapiens
guacaacugaa

SEQ ID NO: 1291606 - RNA, 18 nt, Homo sapiens
guacaccagagccucagu

SEQ ID NO: 1291607 - RNA, 20 nt, Homo sapiens
guacaccagagccucaguga

SEQ ID NO: 1291608 - RNA, 14 nt, Homo sapiens
guacagacagagaa

SEQ ID NO: 1291609 - RNA, 18 nt, Homo sapiens
guaccagaugcagcucaa

SEQ ID NO: 1291610 - RNA, 12 nt, Homo sapiens
guacuaaagcca

SEQ ID NO: 1291611 - RNA, 14 nt, Homo sapiens
uagugguuacccag

SEQ ID NO: 1291612 - RNA, 21 nt, Homo sapiens
uagugguuuuaggauacuuaa

SEQ ID NO: 1291613 - RNA, 20 nt, Homo sapiens
uaguguaccuccucucagug

SEQ ID NO: 1291614 - RNA, 18 nt, Homo sapiens
uauaaaaaugagugcuua

SEQ ID NO: 1291615 - RNA, 20 nt, Homo sapiens
uauaaacagacaauauguga

SEQ ID NO: 1291616 - RNA, 21 nt, Homo sapiens
uauaaagcacagauuugcauu

SEQ ID NO: 1291617 - RNA, 18 nt, Homo sapiens
uauaaaggauuaauguca

SEQ ID NO: 1291618 - RNA, 15 nt, Homo sapiens
uauaaauauauacag

SEQ ID NO: 1291619 - RNA, 15 nt, Homo sapiens
uauaaaugaauuugc

SEQ ID NO: 1291620 - RNA, 21 nt, Homo sapiens
uauaaaugugauugcagcuuu

SEQ ID NO: 1291621 - RNA, 16 nt, Homo sapiens
uauaagaaagaucaaa

SEQ ID NO: 1291622 - RNA, 17 nt, Homo sapiens
uauaagcagucuuucua

SEQ ID NO: 1291623 - RNA, 14 nt, Homo sapiens
uauaaugguugacu

SEQ ID NO: 1291624 - RNA, 17 nt, Homo sapiens
uauaauguuguauuuaa

SEQ ID NO: 1291625 - RNA, 22 nt, Homo sapiens
uauaauguuguauuuaauuuua

SEQ ID NO: 1291626 - RNA, 23 nt, Homo sapiens
uauacaauaaagucuuaccucag

SEQ ID NO: 1291627 - RNA, 12 nt, Homo sapiens
uauacaauaaug

SEQ ID NO: 1291628 - RNA, 21 nt, Homo sapiens
uauacacuauuugugagcaaa

SEQ ID NO: 1291629 - RNA, 13 nt, Homo sapiens
uauacugcaaaag

SEQ ID NO: 1291630 - RNA, 22 nt, Homo sapiens
uauagaacagugcuugccacag

SEQ ID NO: 1291631 - RNA, 15 nt, Homo sapiens
uauagacaaauaaua

SEQ ID NO: 1291632 - RNA, 12 nt, Homo sapiens
uauagacagucc

SEQ ID NO: 1291633 - RNA, 14 nt, Homo sapiens
uauagacucuagga

SEQ ID NO: 1291634 - RNA, 20 nt, Homo sapiens
uauagccuggggugggguca

SEQ ID NO: 1291635 - RNA, 20 nt, Homo sapiens
uauaguuuucccuauugaau

SEQ ID NO: 1291636 - RNA, 17 nt, Homo sapiens
uauauaggugugugaga

SEQ ID NO: 1291637 - RNA, 13 nt, Homo sapiens
uauaucauaugua

SEQ ID NO: 1291638 - RNA, 16 nt, Homo sapiens
uauaugcuuguguaac

SEQ ID NO: 1291639 - RNA, 16 nt, Homo sapiens
uauauucauccaugcc

SEQ ID NO: 1291640 - RNA, 18 nt, Homo sapiens
uauauuugggccugcucc

SEQ ID NO: 1291641 - RNA, 19 nt, Homo sapiens
uauauuugugauagcacuu

SEQ ID NO: 1291642 - RNA, 16 nt, Homo sapiens
uaucaaaaaguauuau

SEQ ID NO: 1291643 - RNA, 22 nt, Homo sapiens
uaucaccucauucugaacccuu

SEQ ID NO: 1291644 - RNA, 14 nt, Homo sapiens
uaucaggugcugcc

SEQ ID NO: 1291645 - RNA, 15 nt, Homo sapiens
uaucaguauugugaa

SEQ ID NO: 1291646 - RNA, 17 nt, Homo sapiens
uaucaugcccugugcaa

SEQ ID NO: 1291647 - RNA, 19 nt, Homo sapiens
uaucauuuauccuuacauu

SEQ ID NO: 1291648 - RNA, 22 nt, Homo sapiens
uauccacaaaugacugcaaaag

SEQ ID NO: 1291649 - RNA, 20 nt, Homo sapiens
uauccaugccccaaguguua

SEQ ID NO: 1291650 - RNA, 17 nt, Homo sapiens
uaucccugcccauuuca

SEQ ID NO: 1291651 - RNA, 23 nt, Homo sapiens
uauccugacaaguuccuaggaaa

SEQ ID NO: 1291652 - RNA, 12 nt, Homo sapiens
uauccuguucuu

SEQ ID NO: 1291653 - RNA, 16 nt, Homo sapiens
uaucucaaacuacugg

SEQ ID NO: 1291654 - RNA, 14 nt, Homo sapiens
uaucucacuugugc

SEQ ID NO: 1291655 - RNA, 17 nt, Homo sapiens
uaucugauuguugucag

SEQ ID NO: 1291656 - RNA, 14 nt, Homo sapiens
uaucugccauguga

SEQ ID NO: 1291657 - RNA, 21 nt, Homo sapiens
uaucuguuuuuauuagccaau

SEQ ID NO: 1291658 - RNA, 21 nt, Homo sapiens
uaucuuaaugcagacaaacaa

SEQ ID NO: 1291659 - RNA, 20 nt, Homo sapiens
uaucuuuauuaaucacuauu

SEQ ID NO: 1291660 - RNA, 17 nt, Homo sapiens
uaugaaauuauaaucug

SEQ ID NO: 1291661 - RNA, 19 nt, Homo sapiens
uaugaauuacccuuucauu

SEQ ID NO: 1291662 - RNA, 17 nt, Homo sapiens
uaugaucacggcucacu

SEQ ID NO: 1291663 - RNA, 19 nt, Homo sapiens
uaugcaacugcaguucauc

SEQ ID NO: 1291664 - RNA, 14 nt, Homo sapiens
uaugcagugugcuc

SEQ ID NO: 1291665 - RNA, 18 nt, Homo sapiens
uaugccauagcaagauug

SEQ ID NO: 1291666 - RNA, 21 nt, Homo sapiens
uaugccauggaggcacuaaca

SEQ ID NO: 1291667 - RNA, 22 nt, Homo sapiens
uaugcuacaaucugugucauau

SEQ ID NO: 1291668 - RNA, 17 nt, Homo sapiens
uaugcugcaacaaaaug

SEQ ID NO: 1291669 - RNA, 21 nt, Homo sapiens
uaugcugcaacaaaauguaga

SEQ ID NO: 1291670 - RNA, 14 nt, Homo sapiens
uaugcuucuuucaa

SEQ ID NO: 1291671 - RNA, 19 nt, Homo sapiens
uauggaauugauuugcauu

SEQ ID NO: 1291672 - RNA, 20 nt, Homo sapiens
uauggagagaaaacagaccu

SEQ ID NO: 1291673 - RNA, 17 nt, Homo sapiens
uauggaggcaagccagu

SEQ ID NO: 1291674 - RNA, 18 nt, Homo sapiens
uauggaggggagggaucu

SEQ ID NO: 1291675 - RNA, 17 nt, Homo sapiens
uauggcugccugcaucu

SEQ ID NO: 1291676 - RNA, 14 nt, Homo sapiens
uaugggaacacugg

SEQ ID NO: 1291677 - RNA, 18 nt, Homo sapiens
uaugggucuugagugcau

SEQ ID NO: 1291678 - RNA, 16 nt, Homo sapiens
ccugagugguccccac

SEQ ID NO: 1291679 - RNA, 17 nt, Homo sapiens
ccugauguuuacagugu

SEQ ID NO: 1291680 - RNA, 19 nt, Homo sapiens
ccugauuuaggagaagcca

SEQ ID NO: 1291681 - RNA, 13 nt, Homo sapiens
ccugcaaaaucug

SEQ ID NO: 1291682 - RNA, 21 nt, Homo sapiens
ccugcacagcuuacacuguca

SEQ ID NO: 1291683 - RNA, 18 nt, Homo sapiens
ccugcaccccugcaguuu

SEQ ID NO: 1291684 - RNA, 23 nt, Homo sapiens
ccugcacucccuccuggagcucu

SEQ ID NO: 1291685 - RNA, 21 nt, Homo sapiens
ccugcagaagcagaagugcaa

SEQ ID NO: 1291686 - RNA, 19 nt, Homo sapiens
ucacgaaguuuguucauca

SEQ ID NO: 1291687 - RNA, 23 nt, Homo sapiens
ucacggagcucacccaugugcac

SEQ ID NO: 1291688 - RNA, 13 nt, Homo sapiens
ucacuagcagcug

SEQ ID NO: 1291689 - RNA, 21 nt, Homo sapiens
ucacuaggcccccacuugccu

SEQ ID NO: 1291690 - RNA, 15 nt, Homo sapiens
ucacuauguugccua

SEQ ID NO: 1291691 - RNA, 14 nt, Homo sapiens
ucacucauugcuga

SEQ ID NO: 1291692 - RNA, 17 nt, Homo sapiens
ucacucucaccuuccaa

SEQ ID NO: 1291693 - RNA, 17 nt, Homo sapiens
ucacucuucaaaugccu

SEQ ID NO: 1291694 - RNA, 14 nt, Homo sapiens
ucacugcaaccucc

SEQ ID NO: 1291695 - RNA, 18 nt, Homo sapiens
ucacugcaacuucugccu

SEQ ID NO: 1291696 - RNA, 20 nt, Homo sapiens
ucacuguuuguuacuaugua

SEQ ID NO: 1291697 - RNA, 12 nt, Homo sapiens
ucacuucaugca

SEQ ID NO: 1291698 - RNA, 18 nt, Homo sapiens
ucacuucucacaaugucc

SEQ ID NO: 1291699 - RNA, 19 nt, Homo sapiens
ucacuugugccaacacuca

SEQ ID NO: 1291700 - RNA, 13 nt, Homo sapiens
ucacuuugcuaca

SEQ ID NO: 1291701 - RNA, 12 nt, Homo sapiens
ucagaaaccaaa

SEQ ID NO: 1291702 - RNA, 13 nt, Homo sapiens
ucagaaauguuaa

SEQ ID NO: 1291703 - RNA, 14 nt, Homo sapiens
ucagaacaaaguga

SEQ ID NO: 1291704 - RNA, 17 nt, Homo sapiens
ucagaacccugccaugg

SEQ ID NO: 1291705 - RNA, 16 nt, Homo sapiens
ucagaacugugccaca

SEQ ID NO: 1291706 - RNA, 15 nt, Homo sapiens
ucagaauagccacau

SEQ ID NO: 1291707 - RNA, 20 nt, Homo sapiens
ucagaaucacuucugagaac

SEQ ID NO: 1291708 - RNA, 17 nt, Homo sapiens
ucagaauuagcugcuuc

SEQ ID NO: 1291709 - RNA, 17 nt, Homo sapiens
ucagaauuuguguugaa

SEQ ID NO: 1291710 - RNA, 18 nt, Homo sapiens
ucagacacaugcuauguu

SEQ ID NO: 1291711 - RNA, 21 nt, Homo sapiens
ucagacuccugugcaacuuuc

SEQ ID NO: 1291712 - RNA, 19 nt, Homo sapiens
ucagagagggcaggcauga

SEQ ID NO: 1291713 - RNA, 16 nt, Homo sapiens
ucagaggaagacaucu

SEQ ID NO: 1291714 - RNA, 16 nt, Homo sapiens
ucagaguauggagcuc

SEQ ID NO: 1291715 - RNA, 12 nt, Homo sapiens
ucagagugcaag

SEQ ID NO: 1291716 - RNA, 13 nt, Homo sapiens
ucagagugcaagc

SEQ ID NO: 1291717 - RNA, 18 nt, Homo sapiens
ucagaguggaccccguca

SEQ ID NO: 1291718 - RNA, 17 nt, Homo sapiens
ucagaugggcagcagcu

SEQ ID NO: 1291719 - RNA, 17 nt, Homo sapiens
ucagauugcaugugacu

SEQ ID NO: 1291720 - RNA, 13 nt, Homo sapiens
ucagcaaaccauu

SEQ ID NO: 1291721 - RNA, 17 nt, Homo sapiens
ucagcaacaaccagcau

SEQ ID NO: 1291722 - RNA, 17 nt, Homo sapiens
ucagcaccugacccugu

SEQ ID NO: 1291723 - RNA, 14 nt, Homo sapiens
ucagcagacaagga

SEQ ID NO: 1291724 - RNA, 12 nt, Homo sapiens
ucagccagguga

SEQ ID NO: 1291725 - RNA, 16 nt, Homo sapiens
ucagccuggccagaca

SEQ ID NO: 1291726 - RNA, 18 nt, Homo sapiens
ucagccuugccagagauc

SEQ ID NO: 1291727 - RNA, 16 nt, Homo sapiens
ucagcucacuguucua

SEQ ID NO: 1291728 - RNA, 19 nt, Homo sapiens
ucagcucucaguugcagcc

SEQ ID NO: 1291729 - RNA, 13 nt, Homo sapiens
ucagcucuuggcu

SEQ ID NO: 1291730 - RNA, 15 nt, Homo sapiens
ucagcugaaccuggg

SEQ ID NO: 1291731 - RNA, 17 nt, Homo sapiens
ucaggacagaugccaca

SEQ ID NO: 1291732 - RNA, 19 nt, Homo sapiens
ucaggaccaggcaauguga

SEQ ID NO: 1291733 - RNA, 20 nt, Homo sapiens
ucaggacucaaucuacaggc

SEQ ID NO: 1291734 - RNA, 21 nt, Homo sapiens
ucaggacucaaucuacaggcc

SEQ ID NO: 1291735 - RNA, 21 nt, Homo sapiens
ucaggagcagccucagaacaa

SEQ ID NO: 1291736 - RNA, 19 nt, Homo sapiens
ucaggaggaaggcuuacac

SEQ ID NO: 1291737 - RNA, 19 nt, Homo sapiens
ucaggaggcaucuggaaag

SEQ ID NO: 1291738 - RNA, 19 nt, Homo sapiens
ucaggcaaagcuugaauca

SEQ ID NO: 1291739 - RNA, 15 nt, Homo sapiens
ucaggcacacagcua

SEQ ID NO: 1291740 - RNA, 17 nt, Homo sapiens
ucaggcagggugcagua

SEQ ID NO: 1291741 - RNA, 14 nt, Homo sapiens
ucaggccaucauca

SEQ ID NO: 1291742 - RNA, 23 nt, Homo sapiens
ucaggcgauccaccugucucagc

SEQ ID NO: 1291743 - RNA, 15 nt, Homo sapiens
aaaccuggaugucac

SEQ ID NO: 1291744 - RNA, 12 nt, Homo sapiens
aaaccuguaacc

SEQ ID NO: 1291745 - RNA, 19 nt, Homo sapiens
aaacgaagcucauucccaa

SEQ ID NO: 1291746 - RNA, 16 nt, Homo sapiens
aaacggauuccaaaga

SEQ ID NO: 1291747 - RNA, 16 nt, Homo sapiens
aaacguccuacuguau

SEQ ID NO: 1291748 - RNA, 16 nt, Homo sapiens
aaacgugacagggaaa

SEQ ID NO: 1291749 - RNA, 24 nt, Homo sapiens
aaacuaacacagccaucaagggaa

SEQ ID NO: 1291750 - RNA, 18 nt, Homo sapiens
aaacuauguaacauguag

SEQ ID NO: 1291751 - RNA, 21 nt, Homo sapiens
aaacucaucucauuacccuuu

SEQ ID NO: 1291752 - RNA, 17 nt, Homo sapiens
aaacucuuuuucaucca

SEQ ID NO: 1291753 - RNA, 21 nt, Homo sapiens
aaacuggguuugggcuuugcu

SEQ ID NO: 1291754 - RNA, 15 nt, Homo sapiens
aaacuguaugugcug

SEQ ID NO: 1291755 - RNA, 20 nt, Homo sapiens
aaacuguuccaaucaugaaa

SEQ ID NO: 1291756 - RNA, 19 nt, Homo sapiens
aaacuuagacagcauguau

SEQ ID NO: 1291757 - RNA, 13 nt, Homo sapiens
aaacuucaaagag

SEQ ID NO: 1291758 - RNA, 15 nt, Homo sapiens
aaagaaacacgcacu

SEQ ID NO: 1291759 - RNA, 18 nt, Homo sapiens
aaagaaauuguauuauca

SEQ ID NO: 1291760 - RNA, 17 nt, Homo sapiens
aaagaacccaucuggaa

SEQ ID NO: 1291761 - RNA, 22 nt, Homo sapiens
aaagaagguuggugaauuucac

SEQ ID NO: 1291762 - RNA, 14 nt, Homo sapiens
aaagaaguucacau

SEQ ID NO: 1291763 - RNA, 14 nt, Homo sapiens
aaagaauacuugaa

SEQ ID NO: 1291764 - RNA, 21 nt, Homo sapiens
aaagaaucccuagacuuuagg

SEQ ID NO: 1291765 - RNA, 13 nt, Homo sapiens
aaagaauguuacu

SEQ ID NO: 1291766 - RNA, 13 nt, Homo sapiens
aaagaauuugcac

SEQ ID NO: 1291767 - RNA, 18 nt, Homo sapiens
aaagacaagacucugggg

SEQ ID NO: 1291768 - RNA, 15 nt, Homo sapiens
aaagaggaaccagga

SEQ ID NO: 1291769 - RNA, 21 nt, Homo sapiens
aaagaggcugaggcuggcaca

SEQ ID NO: 1291770 - RNA, 16 nt, Homo sapiens
aaagagguagcacuac

SEQ ID NO: 1291771 - RNA, 18 nt, Homo sapiens
aaagagugaaggauuuau

SEQ ID NO: 1291772 - RNA, 18 nt, Homo sapiens
aaagauauaagugcugua

SEQ ID NO: 1291773 - RNA, 14 nt, Homo sapiens
aaagcaaguguuca

SEQ ID NO: 1291774 - RNA, 13 nt, Homo sapiens
aaagcacugagca

SEQ ID NO: 1291775 - RNA, 22 nt, Homo sapiens
aaagcagacagcuccacccugg

SEQ ID NO: 1291776 - RNA, 22 nt, Homo sapiens
aaagcagccacgaggugcaaca

SEQ ID NO: 1291777 - RNA, 18 nt, Homo sapiens
aaagcaggggaguaugca

SEQ ID NO: 1291778 - RNA, 18 nt, Homo sapiens
aaagcauaaaaagguuuu

SEQ ID NO: 1291779 - RNA, 17 nt, Homo sapiens
aaagcaugggaucucau

SEQ ID NO: 1291780 - RNA, 17 nt, Homo sapiens
aaagccucgccuuccau

SEQ ID NO: 1291781 - RNA, 17 nt, Homo sapiens
aaagccuucaaacuccc

SEQ ID NO: 1291782 - RNA, 19 nt, Homo sapiens
aaagcgagacuccaucuca

SEQ ID NO: 1291783 - RNA, 17 nt, Homo sapiens
aaagcggacaucagcug

SEQ ID NO: 1291784 - RNA, 16 nt, Homo sapiens
aaagcuaauuaaucau

SEQ ID NO: 1291785 - RNA, 19 nt, Homo sapiens
aaagcuaguguaccuccuc

SEQ ID NO: 1291786 - RNA, 17 nt, Homo sapiens
aaagcuccaucaaugag

SEQ ID NO: 1291787 - RNA, 17 nt, Homo sapiens
aaagcugcugacagugu

SEQ ID NO: 1291788 - RNA, 22 nt, Homo sapiens
aaagcuugcucacaucuuggca

SEQ ID NO: 1291789 - RNA, 23 nt, Homo sapiens
aaagcuuucauguaaacugugca

SEQ ID NO: 1291790 - RNA, 23 nt, Homo sapiens
aaagcuuucugccaccccuaaac

SEQ ID NO: 1291791 - RNA, 17 nt, Homo sapiens
aaaggaaucacguuaga

SEQ ID NO: 1291792 - RNA, 14 nt, Homo sapiens
aaaggaauccacuc

SEQ ID NO: 1291793 - RNA, 21 nt, Homo sapiens
aaaggauaaugaauacuuuau

SEQ ID NO: 1291794 - RNA, 15 nt, Homo sapiens
aaaggccgggugaca

SEQ ID NO: 1291795 - RNA, 18 nt, Homo sapiens
aaaggcguauguauuaag

SEQ ID NO: 1291796 - RNA, 16 nt, Homo sapiens
aaagggagugcaugug

SEQ ID NO: 1291797 - RNA, 19 nt, Homo sapiens
aaagggcgcaaagggcaug

SEQ ID NO: 1291798 - RNA, 12 nt, Homo sapiens
aaaggggacaag

SEQ ID NO: 1291799 - RNA, 23 nt, Homo sapiens
aaaggugagcccucauagggaga

SEQ ID NO: 1291800 - RNA, 18 nt, Homo sapiens
aaaguaacagccuuucaa

SEQ ID NO: 1291801 - RNA, 15 nt, Homo sapiens
aaaguaaucuaccuc

SEQ ID NO: 1291802 - RNA, 15 nt, Homo sapiens
aaaguaguccuguga

SEQ ID NO: 1291803 - RNA, 23 nt, Homo sapiens
aaaguauaauuugcuggaacaca

SEQ ID NO: 1291804 - RNA, 23 nt, Homo sapiens
aaaguauguaccaaaacauugau

SEQ ID NO: 1291805 - RNA, 21 nt, Homo sapiens
aaagucaucccucuguucaca

SEQ ID NO: 1291806 - RNA, 21 nt, Homo sapiens
aaaguuauauuucagauguaa

SEQ ID NO: 1291807 - RNA, 22 nt, Homo sapiens
aaaguucugacuugacuuuagu

SEQ ID NO: 1291808 - RNA, 14 nt, Homo sapiens
aaaguucugggacu

SEQ ID NO: 1291809 - RNA, 18 nt, Homo sapiens
aaaguucuuuuugcucua

SEQ ID NO: 1291810 - RNA, 16 nt, Homo sapiens
aaaguugagcgucauu

SEQ ID NO: 1291811 - RNA, 16 nt, Homo sapiens
aaauaaaaaccuucca

SEQ ID NO: 1291812 - RNA, 17 nt, Homo sapiens
aaauaaaacaguaucuc

SEQ ID NO: 1291813 - RNA, 13 nt, Homo sapiens
aaauaaaauguuc

SEQ ID NO: 1291814 - RNA, 13 nt, Homo sapiens
aaauaaccacugc

SEQ ID NO: 1291815 - RNA, 16 nt, Homo sapiens
aaauacaaaacuucca

SEQ ID NO: 1291816 - RNA, 18 nt, Homo sapiens
aaauagagugcauuugaa

SEQ ID NO: 1291817 - RNA, 15 nt, Homo sapiens
aaauagauccagugc

SEQ ID NO: 1291818 - RNA, 17 nt, Homo sapiens
aaauagauccagugcug

SEQ ID NO: 1291819 - RNA, 18 nt, Homo sapiens
aaauagcaaaacuaaaua

SEQ ID NO: 1291820 - RNA, 20 nt, Homo sapiens
aaauauaaaacugcguuaaa

SEQ ID NO: 1291821 - RNA, 22 nt, Homo sapiens
aaauauaaguggugcuuagaaa

SEQ ID NO: 1291822 - RNA, 17 nt, Homo sapiens
aaauauaauaugcacac

SEQ ID NO: 1291823 - RNA, 22 nt, Homo sapiens
aaauauccuguacauauuuaca

SEQ ID NO: 1291824 - RNA, 18 nt, Homo sapiens
aaauaucuuggccuaaac

SEQ ID NO: 1291825 - RNA, 22 nt, Homo sapiens
aaauaugcucagccacccugug

SEQ ID NO: 1291826 - RNA, 16 nt, Homo sapiens
aaauauguauuuacca

SEQ ID NO: 1291827 - RNA, 16 nt, Homo sapiens
aaauauuaaguguuua

SEQ ID NO: 1291828 - RNA, 15 nt, Homo sapiens
aaauauuaguauaaa

SEQ ID NO: 1291829 - RNA, 13 nt, Homo sapiens
aaauauuaugaga

SEQ ID NO: 1291830 - RNA, 22 nt, Homo sapiens
aaauauuguauaaagcauuugu

SEQ ID NO: 1291831 - RNA, 22 nt, Homo sapiens
aaauauuuuggcauuguacuaa

SEQ ID NO: 1291832 - RNA, 21 nt, Homo sapiens
aaaucaacuuuuuauugccuu

SEQ ID NO: 1291833 - RNA, 19 nt, Homo sapiens
aaaucacgaccacugauag

SEQ ID NO: 1291834 - RNA, 13 nt, Homo sapiens
aaaucauagcugg

SEQ ID NO: 1291835 - RNA, 11 nt, Homo sapiens
aaauccuugau

SEQ ID NO: 1291836 - RNA, 11 nt, Homo sapiens
aaaucuauucc

SEQ ID NO: 1291837 - RNA, 16 nt, Homo sapiens
aaaucugucacuacaa

SEQ ID NO: 1291838 - RNA, 14 nt, Homo sapiens
aaaugaaacacuuu

SEQ ID NO: 1291839 - RNA, 14 nt, Homo sapiens
aaaugaacugacuu

SEQ ID NO: 1291840 - RNA, 14 nt, Homo sapiens
aaaugagcaaaagu

SEQ ID NO: 1291841 - RNA, 13 nt, Homo sapiens
aaaugagugcuua

SEQ ID NO: 1291842 - RNA, 15 nt, Homo sapiens
aaaugagugcuuaaa

SEQ ID NO: 1291843 - RNA, 17 nt, Homo sapiens
aaaugaugauaguauaa

SEQ ID NO: 1291844 - RNA, 11 nt, Homo sapiens
aaaugcaaaau

SEQ ID NO: 1291845 - RNA, 20 nt, Homo sapiens
aaaugcaaaauccuggugau

SEQ ID NO: 1291846 - RNA, 14 nt, Homo sapiens
aaaugcacaaacaa

SEQ ID NO: 1291847 - RNA, 19 nt, Homo sapiens
aaaugcacaaacaaugcaa

SEQ ID NO: 1291848 - RNA, 21 nt, Homo sapiens
aaaugcccaucuaugucccuu

SEQ ID NO: 1291849 - RNA, 21 nt, Homo sapiens
aaauggggccagauccagccu

SEQ ID NO: 1291850 - RNA, 22 nt, Homo sapiens
aaaugguccaggagaaggccaa

SEQ ID NO: 1291851 - RNA, 13 nt, Homo sapiens
aaauguaacugug

SEQ ID NO: 1291852 - RNA, 17 nt, Homo sapiens
aaauguaugugcucuua

SEQ ID NO: 1291853 - RNA, 21 nt, Homo sapiens
aaaugucucuuuaaugucaca

SEQ ID NO: 1291854 - RNA, 15 nt, Homo sapiens
aaaugugcuggucac

SEQ ID NO: 1291855 - RNA, 15 nt, Homo sapiens
aaauguuuucugggg

SEQ ID NO: 1291856 - RNA, 12 nt, Homo sapiens
aaauuaagaagg

SEQ ID NO: 1291857 - RNA, 14 nt, Homo sapiens
aaauuauccaugcc

SEQ ID NO: 1291858 - RNA, 14 nt, Homo sapiens
aaauucacuuucau

SEQ ID NO: 1291859 - RNA, 23 nt, Homo sapiens
aaauucccuuuaugcacccaaga

SEQ ID NO: 1291860 - RNA, 13 nt, Homo sapiens
aaauucuaccuua

SEQ ID NO: 1291861 - RNA, 17 nt, Homo sapiens
aaauugaacuucaggga

SEQ ID NO: 1291862 - RNA, 22 nt, Homo sapiens
aaauuguaucaaaugugacauu

SEQ ID NO: 1291863 - RNA, 22 nt, Homo sapiens
aaauuguauuaucaacagcauu

SEQ ID NO: 1291864 - RNA, 15 nt, Homo sapiens
aaauuucagcagcug

SEQ ID NO: 1291865 - RNA, 17 nt, Homo sapiens
aaauuugauaaugacac

SEQ ID NO: 1291866 - RNA, 18 nt, Homo sapiens
aaauuugauugauuugaa

SEQ ID NO: 1291867 - RNA, 18 nt, Homo sapiens
aaauuuugugacauuccu

SEQ ID NO: 1291868 - RNA, 15 nt, Homo sapiens
aacaaaacaacauuu

SEQ ID NO: 1291869 - RNA, 13 nt, Homo sapiens
aacaaaauggacu

SEQ ID NO: 1291870 - RNA, 12 nt, Homo sapiens
aacaaacuggag

SEQ ID NO: 1291871 - RNA, 13 nt, Homo sapiens
aacaaagaagaca

SEQ ID NO: 1291872 - RNA, 16 nt, Homo sapiens
aacaaauguauuucaa

SEQ ID NO: 1291873 - RNA, 21 nt, Homo sapiens
aacaaccagcaucccuugacc

SEQ ID NO: 1291874 - RNA, 13 nt, Homo sapiens
aacaagccuaaaa

SEQ ID NO: 1291875 - RNA, 19 nt, Homo sapiens
aacaaugauuaaauugaau

SEQ ID NO: 1291876 - RNA, 13 nt, Homo sapiens
acagaaggggugg

SEQ ID NO: 1291877 - RNA, 12 nt, Homo sapiens
acagaagguccu

SEQ ID NO: 1291878 - RNA, 15 nt, Homo sapiens
acagaccuucacaga

SEQ ID NO: 1291879 - RNA, 15 nt, Homo sapiens
acagacucauuacaa

SEQ ID NO: 1291880 - RNA, 16 nt, Homo sapiens
acagagcuucccugac

SEQ ID NO: 1291881 - RNA, 18 nt, Homo sapiens
acagagcuucccugacuc

SEQ ID NO: 1291882 - RNA, 16 nt, Homo sapiens
acagagucucacucuc

SEQ ID NO: 1291883 - RNA, 20 nt, Homo sapiens
acagagugagacucugucuc

SEQ ID NO: 1291884 - RNA, 18 nt, Homo sapiens
acagauaaaaaaugaaau

SEQ ID NO: 1291885 - RNA, 18 nt, Homo sapiens
acagaucuggaaccucag

SEQ ID NO: 1291886 - RNA, 21 nt, Homo sapiens
acagauguucccccaucucgc

SEQ ID NO: 1291887 - RNA, 19 nt, Homo sapiens
acagcaacaggaaucucag

SEQ ID NO: 1291888 - RNA, 17 nt, Homo sapiens
acagccaauccaauuaa

SEQ ID NO: 1291889 - RNA, 15 nt, Homo sapiens
acagccuacagccag

SEQ ID NO: 1291890 - RNA, 18 nt, Homo sapiens
acagccucugaaaaccaa

SEQ ID NO: 1291891 - RNA, 20 nt, Homo sapiens
acagccugagucaccugcag

SEQ ID NO: 1291892 - RNA, 23 nt, Homo sapiens
acagccuuugcccaaaacuguca

SEQ ID NO: 1291893 - RNA, 16 nt, Homo sapiens
acagcucuucuaagga

SEQ ID NO: 1291894 - RNA, 18 nt, Homo sapiens
acagcucuucuccaggcu

SEQ ID NO: 1291895 - RNA, 21 nt, Homo sapiens
acagcugacucucgugcauuu

SEQ ID NO: 1291896 - RNA, 14 nt, Homo sapiens
acagcugcuccuag

SEQ ID NO: 1291897 - RNA, 20 nt, Homo sapiens
acagcugcuggagacuccua

SEQ ID NO: 1291898 - RNA, 22 nt, Homo sapiens
acagcugcuggagacuccuagg

SEQ ID NO: 1291899 - RNA, 14 nt, Homo sapiens
acagcugugcucug

SEQ ID NO: 1291900 - RNA, 20 nt, Homo sapiens
acagcuuugcugcugaaggc

SEQ ID NO: 1291901 - RNA, 22 nt, Homo sapiens
acaggaaaaaugaaaauguuac

SEQ ID NO: 1291902 - RNA, 14 nt, Homo sapiens
acaggacacaguca

SEQ ID NO: 1291903 - RNA, 16 nt, Homo sapiens
acaggagaaucucuug

SEQ ID NO: 1291904 - RNA, 23 nt, Homo sapiens
acaggagcugggauccuaagggc

SEQ ID NO: 1291905 - RNA, 20 nt, Homo sapiens
acaggaugaaggcaaugcca

SEQ ID NO: 1291906 - RNA, 14 nt, Homo sapiens
acaggccauuguga

SEQ ID NO: 1291907 - RNA, 14 nt, Homo sapiens
acaggccugagauu

SEQ ID NO: 1291908 - RNA, 21 nt, Homo sapiens
acaggcugaaauuucuuguuc

SEQ ID NO: 1291909 - RNA, 17 nt, Homo sapiens
acaggugccuucccaga

SEQ ID NO: 1291910 - RNA, 15 nt, Homo sapiens
acaggugugagucac

SEQ ID NO: 1291911 - RNA, 20 nt, Homo sapiens
acagguuacgugagaacaau

SEQ ID NO: 1291912 - RNA, 23 nt, Homo sapiens
acaguaaauggcuuauccagcug

SEQ ID NO: 1291913 - RNA, 14 nt, Homo sapiens
acaguaacugccau

SEQ ID NO: 1291914 - RNA, 17 nt, Homo sapiens
acaguaacugccaucaa

SEQ ID NO: 1291915 - RNA, 19 nt, Homo sapiens
acaguaauaagaauggaaa

SEQ ID NO: 1291916 - RNA, 21 nt, Homo sapiens
acaguaauaagaauggaaaag

SEQ ID NO: 1291917 - RNA, 19 nt, Homo sapiens
acaguacaggcagcacaga

SEQ ID NO: 1291918 - RNA, 14 nt, Homo sapiens
acaguaucucaggg

SEQ ID NO: 1291919 - RNA, 11 nt, Homo sapiens
acaguaucucu

SEQ ID NO: 1291920 - RNA, 16 nt, Homo sapiens
acagucaauucugauu

SEQ ID NO: 1291921 - RNA, 19 nt, Homo sapiens
acagucagcucuucaucug

SEQ ID NO: 1291922 - RNA, 20 nt, Homo sapiens
acagucuugcagcaggaucu

SEQ ID NO: 1291923 - RNA, 14 nt, Homo sapiens
acagugaggcugca

SEQ ID NO: 1291924 - RNA, 21 nt, Homo sapiens
acagugagucgaggacaggga

SEQ ID NO: 1291925 - RNA, 15 nt, Homo sapiens
acagugauauacuua

SEQ ID NO: 1291926 - RNA, 17 nt, Homo sapiens
acagugcagugcgcugu

SEQ ID NO: 1291927 - RNA, 22 nt, Homo sapiens
acaguggggagcauggagggau

SEQ ID NO: 1291928 - RNA, 20 nt, Homo sapiens
acagugugggacaggcucuu

SEQ ID NO: 1291929 - RNA, 20 nt, Homo sapiens
acaguguuuuguagauuuca

SEQ ID NO: 1291930 - RNA, 13 nt, Homo sapiens
acaguuaaggaau

SEQ ID NO: 1291931 - RNA, 18 nt, Homo sapiens
acaguuuugccugcuaaa

SEQ ID NO: 1291932 - RNA, 14 nt, Homo sapiens
acauaaguaccuca

SEQ ID NO: 1291933 - RNA, 17 nt, Homo sapiens
acauaaguaccucagca

SEQ ID NO: 1291934 - RNA, 14 nt, Homo sapiens
acauaauaaauuaa

SEQ ID NO: 1291935 - RNA, 12 nt, Homo sapiens
acauacaauuau

SEQ ID NO: 1291936 - RNA, 17 nt, Homo sapiens
acauacacuguauguua

SEQ ID NO: 1291937 - RNA, 16 nt, Homo sapiens
acauacuagcaucuua

SEQ ID NO: 1291938 - RNA, 15 nt, Homo sapiens
acauacuuaaugcau

SEQ ID NO: 1291939 - RNA, 20 nt, Homo sapiens
acauagaaaguucauggaac

SEQ ID NO: 1291940 - RNA, 14 nt, Homo sapiens
acauagcugugcua

SEQ ID NO: 1291941 - RNA, 16 nt, Homo sapiens
acauauaaaauaaugc

SEQ ID NO: 1291942 - RNA, 18 nt, Homo sapiens
acauauauauacuauuaa

SEQ ID NO: 1291943 - RNA, 13 nt, Homo sapiens
acauauccacaaa

SEQ ID NO: 1291944 - RNA, 16 nt, Homo sapiens
acauauguuuaucuca

SEQ ID NO: 1291945 - RNA, 19 nt, Homo sapiens
acaucacucucaccuucca

SEQ ID NO: 1291946 - RNA, 23 nt, Homo sapiens
acaucagcuaguggcucuucuca

SEQ ID NO: 1291947 - RNA, 12 nt, Homo sapiens
acaucaggaaau

SEQ ID NO: 1291948 - RNA, 18 nt, Homo sapiens
acaucaguuacucugaag

SEQ ID NO: 1291949 - RNA, 20 nt, Homo sapiens
acauccacacagccaaucca

SEQ ID NO: 1291950 - RNA, 14 nt, Homo sapiens
acaucuacaaacag

SEQ ID NO: 1291951 - RNA, 22 nt, Homo sapiens
acaucuauuuuggauuguauau

SEQ ID NO: 1291952 - RNA, 16 nt, Homo sapiens
acaucucugcuuucac

SEQ ID NO: 1291953 - RNA, 16 nt, Homo sapiens
acaucuuggcacauuu

SEQ ID NO: 1291954 - RNA, 20 nt, Homo sapiens
acaucuuuagugucugagcu

SEQ ID NO: 1291955 - RNA, 11 nt, Homo sapiens
acaucuuucac

SEQ ID NO: 1291956 - RNA, 13 nt, Homo sapiens
acaucuuuuacau

SEQ ID NO: 1291957 - RNA, 19 nt, Homo sapiens
acaugaagacaucuuaucc

SEQ ID NO: 1291958 - RNA, 16 nt, Homo sapiens
acaugagaagugauaa

SEQ ID NO: 1291959 - RNA, 20 nt, Homo sapiens
acaugauguuuuaagcugcu

SEQ ID NO: 1291960 - RNA, 18 nt, Homo sapiens
acaugccaagcacugugc

SEQ ID NO: 1291961 - RNA, 23 nt, Homo sapiens
acaugccuguccugaaagcggcu

SEQ ID NO: 1291962 - RNA, 19 nt, Homo sapiens
acaugcgugaccagcagua

SEQ ID NO: 1291963 - RNA, 16 nt, Homo sapiens
acaugcuucagugcug

SEQ ID NO: 1291964 - RNA, 15 nt, Homo sapiens
acauggaugccaacc

SEQ ID NO: 1291965 - RNA, 23 nt, Homo sapiens
acaugguggaaaacgaagcucau

SEQ ID NO: 1291966 - RNA, 22 nt, Homo sapiens
acauguaauugcagauaacuuu

SEQ ID NO: 1291967 - RNA, 19 nt, Homo sapiens
acauguaugugcauuucaa

SEQ ID NO: 1291968 - RNA, 21 nt, Homo sapiens
acauuacagggaaugccugag

SEQ ID NO: 1291969 - RNA, 18 nt, Homo sapiens
acauuagaagacaauuga

SEQ ID NO: 1291970 - RNA, 17 nt, Homo sapiens
acauuagcuaaaacugc

SEQ ID NO: 1291971 - RNA, 13 nt, Homo sapiens
acauucaugccug

SEQ ID NO: 1291972 - RNA, 15 nt, Homo sapiens
acauucucuaauaag

SEQ ID NO: 1291973 - RNA, 15 nt, Homo sapiens
acauugacacaauaa

SEQ ID NO: 1291974 - RNA, 14 nt, Homo sapiens
acauugccaaaaag

SEQ ID NO: 1291975 - RNA, 19 nt, Homo sapiens
acauuggacagugagguca

SEQ ID NO: 1291976 - RNA, 15 nt, Homo sapiens
acauuuaaacucagc

SEQ ID NO: 1291977 - RNA, 18 nt, Homo sapiens
acauuuaagggaauguga

SEQ ID NO: 1291978 - RNA, 22 nt, Homo sapiens
acauuuauuuuucucaugaauc

SEQ ID NO: 1291979 - RNA, 13 nt, Homo sapiens
acauuuccaugca

SEQ ID NO: 1291980 - RNA, 14 nt, Homo sapiens
acauuucuauuuca

SEQ ID NO: 1291981 - RNA, 22 nt, Homo sapiens
acauuuuauuuuuucuugcaaa

SEQ ID NO: 1291982 - RNA, 14 nt, Homo sapiens
accaaaaacugaaa

SEQ ID NO: 1291983 - RNA, 15 nt, Homo sapiens
accaaaauacuccaa

SEQ ID NO: 1291984 - RNA, 19 nt, Homo sapiens
accaaaucuggaagccaaa

SEQ ID NO: 1291985 - RNA, 13 nt, Homo sapiens
accaacaaggaaa

SEQ ID NO: 1291986 - RNA, 13 nt, Homo sapiens
accaagcaggaag

SEQ ID NO: 1291987 - RNA, 21 nt, Homo sapiens
accaaggacugagcacccucu

SEQ ID NO: 1291988 - RNA, 17 nt, Homo sapiens
accaaguaccaguauaa

SEQ ID NO: 1291989 - RNA, 14 nt, Homo sapiens
accaauaaagccuu

SEQ ID NO: 1291990 - RNA, 14 nt, Homo sapiens
accaaugccaaaaa

SEQ ID NO: 1291991 - RNA, 21 nt, Homo sapiens
accaaugccaaaaaaagacag

SEQ ID NO: 1291992 - RNA, 13 nt, Homo sapiens
accaaugucuuga

SEQ ID NO: 1291993 - RNA, 13 nt, Homo sapiens
accaauguucucu

SEQ ID NO: 1291994 - RNA, 17 nt, Homo sapiens
accaauuugcaccaguu

SEQ ID NO: 1291995 - RNA, 20 nt, Homo sapiens
accaauuugcaccaguuuua

SEQ ID NO: 1291996 - RNA, 16 nt, Homo sapiens
accacaaaacuuuucu

SEQ ID NO: 1291997 - RNA, 13 nt, Homo sapiens
accacaacuauuu

SEQ ID NO: 1291998 - RNA, 11 nt, Homo sapiens
accacacaaag

SEQ ID NO: 1291999 - RNA, 16 nt, Homo sapiens
accacagcacagccaa

SEQ ID NO: 1292000 - RNA, 18 nt, Homo sapiens
accacaucuugcucugcu

SEQ ID NO: 1292001 - RNA, 11 nt, Homo sapiens
accacaugcca

SEQ ID NO: 1292002 - RNA, 13 nt, Homo sapiens
accacgacuggcc

SEQ ID NO: 1292003 - RNA, 18 nt, Homo sapiens
accacgacuggccagggc

SEQ ID NO: 1292004 - RNA, 20 nt, Homo sapiens
accacgugagaucauucacu

SEQ ID NO: 1292005 - RNA, 17 nt, Homo sapiens
accacuucgaaaccugg

SEQ ID NO: 1292006 - RNA, 21 nt, Homo sapiens
accagaacaguaugaauuuga

SEQ ID NO: 1292007 - RNA, 19 nt, Homo sapiens
accagaacugugugucuca

SEQ ID NO: 1292008 - RNA, 22 nt, Homo sapiens
accagacagacaacacugggaa

SEQ ID NO: 1292009 - RNA, 21 nt, Homo sapiens
agaccaagcugugcccugacc

SEQ ID NO: 1292010 - RNA, 22 nt, Homo sapiens
agaccacgcccguccugccugu

SEQ ID NO: 1292011 - RNA, 17 nt, Homo sapiens
agaccaggcccuggcua

SEQ ID NO: 1292012 - RNA, 13 nt, Homo sapiens
agaccauugcaau

SEQ ID NO: 1292013 - RNA, 15 nt, Homo sapiens
agaccuaaugcuccu

SEQ ID NO: 1292014 - RNA, 22 nt, Homo sapiens
agaccucacacacacaaaaaau

SEQ ID NO: 1292015 - RNA, 21 nt, Homo sapiens
agaccuccagaaaucuauucc

SEQ ID NO: 1292016 - RNA, 19 nt, Homo sapiens
agaccugacaccuuucaua

SEQ ID NO: 1292017 - RNA, 14 nt, Homo sapiens
agaccuggacacag

SEQ ID NO: 1292018 - RNA, 12 nt, Homo sapiens
agaccugucacc

SEQ ID NO: 1292019 - RNA, 16 nt, Homo sapiens
agaccuucguaucccc

SEQ ID NO: 1292020 - RNA, 15 nt, Homo sapiens
agaccuuggcgcuac

SEQ ID NO: 1292021 - RNA, 17 nt, Homo sapiens
agacgaaauagugacau

SEQ ID NO: 1292022 - RNA, 16 nt, Homo sapiens
agacguccuccgucca

SEQ ID NO: 1292023 - RNA, 22 nt, Homo sapiens
agacuauguagcaauauaucag

SEQ ID NO: 1292024 - RNA, 19 nt, Homo sapiens
agacuauucccuucuaacc

SEQ ID NO: 1292025 - RNA, 19 nt, Homo sapiens
agacucagacauuggcacc

SEQ ID NO: 1292026 - RNA, 18 nt, Homo sapiens
agacucuccuucaggguu

SEQ ID NO: 1292027 - RNA, 14 nt, Homo sapiens
agacucugucucaa

SEQ ID NO: 1292028 - RNA, 14 nt, Homo sapiens
agacugaagaaagu

SEQ ID NO: 1292029 - RNA, 21 nt, Homo sapiens
agacugggucucgcuuuguug

SEQ ID NO: 1292030 - RNA, 21 nt, Homo sapiens
agacugguugaguucagguag

SEQ ID NO: 1292031 - RNA, 13 nt, Homo sapiens
agacuucuuggcu

SEQ ID NO: 1292032 - RNA, 17 nt, Homo sapiens
agacuugauggacaaac

SEQ ID NO: 1292033 - RNA, 14 nt, Homo sapiens
agacuugcauuuaa

SEQ ID NO: 1292034 - RNA, 20 nt, Homo sapiens
agacuuuacauggaugccaa

SEQ ID NO: 1292035 - RNA, 23 nt, Homo sapiens
agagaagucuggucagagccaca

SEQ ID NO: 1292036 - RNA, 21 nt, Homo sapiens
agagacaggguuuugccaugu

SEQ ID NO: 1292037 - RNA, 16 nt, Homo sapiens
agagaccauugcaaug

SEQ ID NO: 1292038 - RNA, 20 nt, Homo sapiens
agagacccgagggcugcuuu

SEQ ID NO: 1292039 - RNA, 14 nt, Homo sapiens
agagaccuauguaa

SEQ ID NO: 1292040 - RNA, 18 nt, Homo sapiens
agagacgguguuuugcca

SEQ ID NO: 1292041 - RNA, 13 nt, Homo sapiens
agagagaggaauu

SEQ ID NO: 1292042 - RNA, 22 nt, Homo sapiens
agagagucgcaucucagugcag

SEQ ID NO: 1292043 - RNA, 19 nt, Homo sapiens
agagauaccaucuucugua

SEQ ID NO: 1292044 - RNA, 17 nt, Homo sapiens
agagaucccaaguagaa

SEQ ID NO: 1292045 - RNA, 20 nt, Homo sapiens
agagauggggucucacagug

SEQ ID NO: 1292046 - RNA, 23 nt, Homo sapiens
agagauuggaaugggcagcucau

SEQ ID NO: 1292047 - RNA, 19 nt, Homo sapiens
agagcaagacucugucuca

SEQ ID NO: 1292048 - RNA, 18 nt, Homo sapiens
agagcauuuuuuaugaua

SEQ ID NO: 1292049 - RNA, 12 nt, Homo sapiens
agagccaaacag

SEQ ID NO: 1292050 - RNA, 22 nt, Homo sapiens
agagccuggggaggccagggua

SEQ ID NO: 1292051 - RNA, 17 nt, Homo sapiens
agagccuggugcugcug

SEQ ID NO: 1292052 - RNA, 17 nt, Homo sapiens
agagcucuggugauaag

SEQ ID NO: 1292053 - RNA, 16 nt, Homo sapiens
agagcugacacaggau

SEQ ID NO: 1292054 - RNA, 17 nt, Homo sapiens
agagcuggagccuggug

SEQ ID NO: 1292055 - RNA, 21 nt, Homo sapiens
agagcuuggacuggaugcaug

SEQ ID NO: 1292056 - RNA, 20 nt, Homo sapiens
agaggaaaagaaagaaguua

SEQ ID NO: 1292057 - RNA, 16 nt, Homo sapiens
agaggaaguucagauc

SEQ ID NO: 1292058 - RNA, 22 nt, Homo sapiens
agaggagauaaauauuuugcau

SEQ ID NO: 1292059 - RNA, 13 nt, Homo sapiens
agaggaugagcuc

SEQ ID NO: 1292060 - RNA, 19 nt, Homo sapiens
agaggcguugcuuucacuc

SEQ ID NO: 1292061 - RNA, 17 nt, Homo sapiens
agaggcugagcaccuuu

SEQ ID NO: 1292062 - RNA, 18 nt, Homo sapiens
agagggcacacacugugu

SEQ ID NO: 1292063 - RNA, 14 nt, Homo sapiens
agagggcaggcaug

SEQ ID NO: 1292064 - RNA, 22 nt, Homo sapiens
agagguuacagguuacagugag

SEQ ID NO: 1292065 - RNA, 16 nt, Homo sapiens
agaguagagggcacug

SEQ ID NO: 1292066 - RNA, 16 nt, Homo sapiens
agaguauaugcacuuu

SEQ ID NO: 1292067 - RNA, 14 nt, Homo sapiens
agaguauuaaugaa

SEQ ID NO: 1292068 - RNA, 14 nt, Homo sapiens
agagucgcaucuca

SEQ ID NO: 1292069 - RNA, 22 nt, Homo sapiens
agagucuaauagucuuugccag

SEQ ID NO: 1292070 - RNA, 20 nt, Homo sapiens
agagugagacucugucucaa

SEQ ID NO: 1292071 - RNA, 17 nt, Homo sapiens
agaguggaccccgucau

SEQ ID NO: 1292072 - RNA, 15 nt, Homo sapiens
agagugugguuauga

SEQ ID NO: 1292073 - RNA, 18 nt, Homo sapiens
agaguuauagugagggaa

SEQ ID NO: 1292074 - RNA, 18 nt, Homo sapiens
agaguugccccgucucug

SEQ ID NO: 1292075 - RNA, 24 nt, Homo sapiens
agaguuuccugaaacaacuuggaa

SEQ ID NO: 1292076 - RNA, 13 nt, Homo sapiens
agauaacuaggaa

SEQ ID NO: 1292077 - RNA, 15 nt, Homo sapiens
agauaauacauuccg

SEQ ID NO: 1292078 - RNA, 14 nt, Homo sapiens
agauaauaugagaa

SEQ ID NO: 1292079 - RNA, 17 nt, Homo sapiens
agauacauacagaauua

SEQ ID NO: 1292080 - RNA, 12 nt, Homo sapiens
agauaccaaaug

SEQ ID NO: 1292081 - RNA, 12 nt, Homo sapiens
agauagggaaaa

SEQ ID NO: 1292082 - RNA, 19 nt, Homo sapiens
agauauauuaagugacugu

SEQ ID NO: 1292083 - RNA, 13 nt, Homo sapiens
agauaugugaaga

SEQ ID NO: 1292084 - RNA, 17 nt, Homo sapiens
agauauuggacaaagaa

SEQ ID NO: 1292085 - RNA, 17 nt, Homo sapiens
agaucacgccacugcac

SEQ ID NO: 1292086 - RNA, 20 nt, Homo sapiens
agaucaugucucacuucaca

SEQ ID NO: 1292087 - RNA, 14 nt, Homo sapiens
agauccagugcuga

SEQ ID NO: 1292088 - RNA, 16 nt, Homo sapiens
agauccccguguuacu

SEQ ID NO: 1292089 - RNA, 19 nt, Homo sapiens
agauccucuucucaaagcu

SEQ ID NO: 1292090 - RNA, 19 nt, Homo sapiens
agaucgugccauugcacuc

SEQ ID NO: 1292091 - RNA, 18 nt, Homo sapiens
agaucuaguuacuguggu

SEQ ID NO: 1292092 - RNA, 20 nt, Homo sapiens
agaucugggggacagaggaa

SEQ ID NO: 1292093 - RNA, 22 nt, Homo sapiens
agaucugucuugaugugucauc

SEQ ID NO: 1292094 - RNA, 18 nt, Homo sapiens
agaucuugccuccagaga

SEQ ID NO: 1292095 - RNA, 20 nt, Homo sapiens
agaugaaggagaggcaacau

SEQ ID NO: 1292096 - RNA, 19 nt, Homo sapiens
agaugacacaacugcacuc

SEQ ID NO: 1292097 - RNA, 17 nt, Homo sapiens
agaugacgaguaacucc

SEQ ID NO: 1292098 - RNA, 15 nt, Homo sapiens
agaugauacauccaa

SEQ ID NO: 1292099 - RNA, 19 nt, Homo sapiens
agaugauacauccaaagca

SEQ ID NO: 1292100 - RNA, 17 nt, Homo sapiens
agaugauggaugccaau

SEQ ID NO: 1292101 - RNA, 19 nt, Homo sapiens
agaugauggcucauuuaca

SEQ ID NO: 1292102 - RNA, 14 nt, Homo sapiens
agaugccccagccu

SEQ ID NO: 1292103 - RNA, 15 nt, Homo sapiens
agaugccugugaaau

SEQ ID NO: 1292104 - RNA, 14 nt, Homo sapiens
agauggacagagaa

SEQ ID NO: 1292105 - RNA, 16 nt, Homo sapiens
agauggacuccagccu

SEQ ID NO: 1292106 - RNA, 14 nt, Homo sapiens
agauggaugcaugu

SEQ ID NO: 1292107 - RNA, 21 nt, Homo sapiens
agauggggucucacaguguug

SEQ ID NO: 1292108 - RNA, 18 nt, Homo sapiens
agaugugcuuauaucauu

SEQ ID NO: 1292109 - RNA, 19 nt, Homo sapiens
agauguguuaggaauguca

SEQ ID NO: 1292110 - RNA, 16 nt, Homo sapiens
agauuaaaaagcacag

SEQ ID NO: 1292111 - RNA, 18 nt, Homo sapiens
agauuagcuaggggacag

SEQ ID NO: 1292112 - RNA, 22 nt, Homo sapiens
agauucauuuucuagauacaau

SEQ ID NO: 1292113 - RNA, 15 nt, Homo sapiens
agauuccaaaaagca

SEQ ID NO: 1292114 - RNA, 16 nt, Homo sapiens
agauuggaccagugcu

SEQ ID NO: 1292115 - RNA, 13 nt, Homo sapiens
agauuucaucugc

SEQ ID NO: 1292116 - RNA, 16 nt, Homo sapiens
agauuucugucuacua

SEQ ID NO: 1292117 - RNA, 23 nt, Homo sapiens
agauuuggaagcucuucuuccca

SEQ ID NO: 1292118 - RNA, 18 nt, Homo sapiens
agauuuggaugcacucau

SEQ ID NO: 1292119 - RNA, 15 nt, Homo sapiens
agauuuuuuccucug

SEQ ID NO: 1292120 - RNA, 17 nt, Homo sapiens
agcaaaacuaaauacuu

SEQ ID NO: 1292121 - RNA, 20 nt, Homo sapiens
agcaaaauacaugacauuua

SEQ ID NO: 1292122 - RNA, 18 nt, Homo sapiens
agcaaacuauuugcgacu

SEQ ID NO: 1292123 - RNA, 14 nt, Homo sapiens
agcaaagaagggaa

SEQ ID NO: 1292124 - RNA, 16 nt, Homo sapiens
agcaaaggcugagaac

SEQ ID NO: 1292125 - RNA, 18 nt, Homo sapiens
agcaaagggagcacuggg

SEQ ID NO: 1292126 - RNA, 20 nt, Homo sapiens
agcaaauaaaugaacugacu

SEQ ID NO: 1292127 - RNA, 18 nt, Homo sapiens
agcaaauguuaugcauaa

SEQ ID NO: 1292128 - RNA, 22 nt, Homo sapiens
agcaacaucuuuuuaaccugca

SEQ ID NO: 1292129 - RNA, 16 nt, Homo sapiens
agcaaccuucuugccu

SEQ ID NO: 1292130 - RNA, 14 nt, Homo sapiens
agcaacuuauguau

SEQ ID NO: 1292131 - RNA, 21 nt, Homo sapiens
agcaagugaauuuuucucuaa

SEQ ID NO: 1292132 - RNA, 15 nt, Homo sapiens
agcaaguguucacaa

SEQ ID NO: 1292133 - RNA, 21 nt, Homo sapiens
agcaauaucauaauuaaugua

SEQ ID NO: 1292134 - RNA, 16 nt, Homo sapiens
agcaauaugcauuuaa

SEQ ID NO: 1292135 - RNA, 19 nt, Homo sapiens
agcaauccucucaccucag

SEQ ID NO: 1292136 - RNA, 18 nt, Homo sapiens
agcaauugaaaugcauug

SEQ ID NO: 1292137 - RNA, 18 nt, Homo sapiens
agcacaaaaccuguccua

SEQ ID NO: 1292138 - RNA, 15 nt, Homo sapiens
agcacacagggcagu

SEQ ID NO: 1292139 - RNA, 14 nt, Homo sapiens
agcacagauguucc

SEQ ID NO: 1292140 - RNA, 19 nt, Homo sapiens
agcacagauuugcauuuca

SEQ ID NO: 1292141 - RNA, 21 nt, Homo sapiens
cagagacccagaucucaugga

SEQ ID NO: 1292142 - RNA, 14 nt, Homo sapiens
cagagaccuaugua

SEQ ID NO: 1292143 - RNA, 15 nt, Homo sapiens
cagagagaggcauuu

SEQ ID NO: 1292144 - RNA, 15 nt, Homo sapiens
cagagagcacagccc

SEQ ID NO: 1292145 - RNA, 13 nt, Homo sapiens
cagagcaagugag

SEQ ID NO: 1292146 - RNA, 15 nt, Homo sapiens
cagagcaucuugcau

SEQ ID NO: 1292147 - RNA, 21 nt, Homo sapiens
cagagccagccggcuaugaaa

SEQ ID NO: 1292148 - RNA, 14 nt, Homo sapiens
cagagccucaguga

SEQ ID NO: 1292149 - RNA, 23 nt, Homo sapiens
cagagcggaaggagggagcucug

SEQ ID NO: 1292150 - RNA, 18 nt, Homo sapiens
cagagcuggccaggccac

SEQ ID NO: 1292151 - RNA, 22 nt, Homo sapiens
cagagcugguggacccagggaa

SEQ ID NO: 1292152 - RNA, 24 nt, Homo sapiens
cagagcuugaagaaaagcuuauuu

SEQ ID NO: 1292153 - RNA, 22 nt, Homo sapiens
cagagcuuggacuggaugcaug

SEQ ID NO: 1292154 - RNA, 14 nt, Homo sapiens
cagaggcaccucaa

SEQ ID NO: 1292155 - RNA, 15 nt, Homo sapiens
cagaggucucccaaa

SEQ ID NO: 1292156 - RNA, 20 nt, Homo sapiens
cagagguugcagugagccga

SEQ ID NO: 1292157 - RNA, 12 nt, Homo sapiens
cagagucucacu

SEQ ID NO: 1292158 - RNA, 18 nt, Homo sapiens
cagagucucacuguugcc

SEQ ID NO: 1292159 - RNA, 16 nt, Homo sapiens
cagaguguucccugac

SEQ ID NO: 1292160 - RNA, 14 nt, Homo sapiens
cagauaacuuugac

SEQ ID NO: 1292161 - RNA, 20 nt, Homo sapiens
cagauacugucucuuucaug

SEQ ID NO: 1292162 - RNA, 12 nt, Homo sapiens
cagauacuuggg

SEQ ID NO: 1292163 - RNA, 15 nt, Homo sapiens
cagaucacagugucu

SEQ ID NO: 1292164 - RNA, 12 nt, Homo sapiens
cagauccaggga

SEQ ID NO: 1292165 - RNA, 17 nt, Homo sapiens
cagauccucuucucaaa

SEQ ID NO: 1292166 - RNA, 17 nt, Homo sapiens
cagaucuagucaaucaa

SEQ ID NO: 1292167 - RNA, 19 nt, Homo sapiens
cagaucugcccacaucuuu

SEQ ID NO: 1292168 - RNA, 12 nt, Homo sapiens
cagaucuugccu

SEQ ID NO: 1292169 - RNA, 15 nt, Homo sapiens
cagaucuugccucca

SEQ ID NO: 1292170 - RNA, 16 nt, Homo sapiens
cagaucuuggacucau

SEQ ID NO: 1292171 - RNA, 12 nt, Homo sapiens
cagaugcaauga

SEQ ID NO: 1292172 - RNA, 16 nt, Homo sapiens
cagaugcaaugacuca

SEQ ID NO: 1292173 - RNA, 15 nt, Homo sapiens
cagaugcagggcagu

SEQ ID NO: 1292174 - RNA, 21 nt, Homo sapiens
cagauggacuccagccugccu

SEQ ID NO: 1292175 - RNA, 14 nt, Homo sapiens
cagauggcauaaau

SEQ ID NO: 1292176 - RNA, 20 nt, Homo sapiens
cagaugggcauaugugucag

SEQ ID NO: 1292177 - RNA, 23 nt, Homo sapiens
cagauguaauguuuucuuugcaa

SEQ ID NO: 1292178 - RNA, 23 nt, Homo sapiens
cagauguauuaaaaaaagauuug

SEQ ID NO: 1292179 - RNA, 17 nt, Homo sapiens
cagaugugaaccauuaa

SEQ ID NO: 1292180 - RNA, 17 nt, Homo sapiens
cagauguuuuggucaag

SEQ ID NO: 1292181 - RNA, 12 nt, Homo sapiens
cagauugaacuu

SEQ ID NO: 1292182 - RNA, 18 nt, Homo sapiens
cagauuuggaugcacuca

SEQ ID NO: 1292183 - RNA, 16 nt, Homo sapiens
cagauuuugcuguaua

SEQ ID NO: 1292184 - RNA, 14 nt, Homo sapiens
cagcacaaggccau

SEQ ID NO: 1292185 - RNA, 11 nt, Homo sapiens
cagcacugagg

SEQ ID NO: 1292186 - RNA, 18 nt, Homo sapiens
cagcagacugguuugcag

SEQ ID NO: 1292187 - RNA, 14 nt, Homo sapiens
cagcaguggacuca

SEQ ID NO: 1292188 - RNA, 14 nt, Homo sapiens
cagcauuauugaaa

SEQ ID NO: 1292189 - RNA, 16 nt, Homo sapiens
cagcauugacucugug

SEQ ID NO: 1292190 - RNA, 13 nt, Homo sapiens
cagcauugcugga

SEQ ID NO: 1292191 - RNA, 21 nt, Homo sapiens
cagcauuuagacccugcauuu

SEQ ID NO: 1292192 - RNA, 17 nt, Homo sapiens
cagcauuuccacaccaa

SEQ ID NO: 1292193 - RNA, 20 nt, Homo sapiens
cagcauuugauaaaauccaa

SEQ ID NO: 1292194 - RNA, 17 nt, Homo sapiens
cagccaaaaaggacuuu

SEQ ID NO: 1292195 - RNA, 16 nt, Homo sapiens
cagccaaguagccucu

SEQ ID NO: 1292196 - RNA, 17 nt, Homo sapiens
cagccacuggcugcuaa

SEQ ID NO: 1292197 - RNA, 17 nt, Homo sapiens
cagcccaagaugcuuua

SEQ ID NO: 1292198 - RNA, 16 nt, Homo sapiens
cagcccaccccugugc

SEQ ID NO: 1292199 - RNA, 20 nt, Homo sapiens
cagcccaccccugugcccac

SEQ ID NO: 1292200 - RNA, 19 nt, Homo sapiens
cagccccagaguagcugga

SEQ ID NO: 1292201 - RNA, 16 nt, Homo sapiens
cagccccagugcccac

SEQ ID NO: 1292202 - RNA, 13 nt, Homo sapiens
cagcccgugcacc

SEQ ID NO: 1292203 - RNA, 19 nt, Homo sapiens
cagcccgugcacccuggaa

SEQ ID NO: 1292204 - RNA, 23 nt, Homo sapiens
cagcccuacaacaaccugaagca

SEQ ID NO: 1292205 - RNA, 14 nt, Homo sapiens
cagccucccagugu

SEQ ID NO: 1292206 - RNA, 15 nt, Homo sapiens
cagccucccauccag

SEQ ID NO: 1292207 - RNA, 19 nt, Homo sapiens
cagccucccgaguagcugg

SEQ ID NO: 1292208 - RNA, 14 nt, Homo sapiens
cagccucccugaag

SEQ ID NO: 1292209 - RNA, 15 nt, Homo sapiens
cagccugcuccagcu

SEQ ID NO: 1292210 - RNA, 14 nt, Homo sapiens
cagccuggcaaggg

SEQ ID NO: 1292211 - RNA, 17 nt, Homo sapiens
cagccuggccaacaugg

SEQ ID NO: 1292212 - RNA, 18 nt, Homo sapiens
cagccugggcaaugugau

SEQ ID NO: 1292213 - RNA, 20 nt, Homo sapiens
cagccugggugacagagcaa

SEQ ID NO: 1292214 - RNA, 16 nt, Homo sapiens
cagccuugccagagau

SEQ ID NO: 1292215 - RNA, 22 nt, Homo sapiens
cagccuuugcccaaaacuguca

SEQ ID NO: 1292216 - RNA, 15 nt, Homo sapiens
cagcgaccccaggac

SEQ ID NO: 1292217 - RNA, 14 nt, Homo sapiens
cagcgugaagggau

SEQ ID NO: 1292218 - RNA, 21 nt, Homo sapiens
cagcguggucugucauccugc

SEQ ID NO: 1292219 - RNA, 13 nt, Homo sapiens
cagcuaaagcaau

SEQ ID NO: 1292220 - RNA, 16 nt, Homo sapiens
cagcuaacaauuguga

SEQ ID NO: 1292221 - RNA, 12 nt, Homo sapiens
cagcuaacacac

SEQ ID NO: 1292222 - RNA, 20 nt, Homo sapiens
cagcuaacacacagcuccca

SEQ ID NO: 1292223 - RNA, 11 nt, Homo sapiens
cagcucaaagg

SEQ ID NO: 1292224 - RNA, 12 nt, Homo sapiens
cagcucaucucu

SEQ ID NO: 1292225 - RNA, 18 nt, Homo sapiens
cagcuccaaccugcaaag

SEQ ID NO: 1292226 - RNA, 19 nt, Homo sapiens
cagcucgggcccucuguga

SEQ ID NO: 1292227 - RNA, 11 nt, Homo sapiens
cagcucugcaa

SEQ ID NO: 1292228 - RNA, 18 nt, Homo sapiens
cagcucuguaucugccau

SEQ ID NO: 1292229 - RNA, 16 nt, Homo sapiens
cagcucuucacagucc

SEQ ID NO: 1292230 - RNA, 22 nt, Homo sapiens
cagcugacucucgugcauuuca

SEQ ID NO: 1292231 - RNA, 19 nt, Homo sapiens
cagcugauugcacuaagcc

SEQ ID NO: 1292232 - RNA, 20 nt, Homo sapiens
cagcugcagucaacaguuca

SEQ ID NO: 1292233 - RNA, 19 nt, Homo sapiens
cagcugcgguccacccagg

SEQ ID NO: 1292234 - RNA, 12 nt, Homo sapiens
cagcugcuccua

SEQ ID NO: 1292235 - RNA, 18 nt, Homo sapiens
cagcuggccccggagcca

SEQ ID NO: 1292236 - RNA, 17 nt, Homo sapiens
cagcuggguggcacugc

SEQ ID NO: 1292237 - RNA, 16 nt, Homo sapiens
cagcugguaaucuugc

SEQ ID NO: 1292238 - RNA, 19 nt, Homo sapiens
cagcuuagaaugcaucuca

SEQ ID NO: 1292239 - RNA, 14 nt, Homo sapiens
cagcuucuacggug

SEQ ID NO: 1292240 - RNA, 19 nt, Homo sapiens
cagcuucuuaguuacuuug

SEQ ID NO: 1292241 - RNA, 22 nt, Homo sapiens
cagcuuguaaauagcucaggug

SEQ ID NO: 1292242 - RNA, 23 nt, Homo sapiens
cagcuuuguuuguugucagcuga

SEQ ID NO: 1292243 - RNA, 16 nt, Homo sapiens
cagcuuuuccaaaaua

SEQ ID NO: 1292244 - RNA, 15 nt, Homo sapiens
caggaaccacaccac

SEQ ID NO: 1292245 - RNA, 19 nt, Homo sapiens
caggaaccucgaguacugu

SEQ ID NO: 1292246 - RNA, 16 nt, Homo sapiens
caggaauguguggccu

SEQ ID NO: 1292247 - RNA, 15 nt, Homo sapiens
caggaccugccugua

SEQ ID NO: 1292248 - RNA, 13 nt, Homo sapiens
caggacucagaag

SEQ ID NO: 1292249 - RNA, 21 nt, Homo sapiens
caggacugcagagcagauggc

SEQ ID NO: 1292250 - RNA, 19 nt, Homo sapiens
caggagaccuggcacugga

SEQ ID NO: 1292251 - RNA, 23 nt, Homo sapiens
caggagauguaggaggggaacua

SEQ ID NO: 1292252 - RNA, 23 nt, Homo sapiens
caggaguucucccaccaccucac

SEQ ID NO: 1292253 - RNA, 24 nt, Homo sapiens
caggauagagacuggaacacuaga

SEQ ID NO: 1292254 - RNA, 12 nt, Homo sapiens
caggauauucca

SEQ ID NO: 1292255 - RNA, 13 nt, Homo sapiens
caggauuccagaa

SEQ ID NO: 1292256 - RNA, 12 nt, Homo sapiens
caggauuucuca

SEQ ID NO: 1292257 - RNA, 16 nt, Homo sapiens
caggcaagcaccuccu

SEQ ID NO: 1292258 - RNA, 17 nt, Homo sapiens
caggcaaggaugucuga

SEQ ID NO: 1292259 - RNA, 13 nt, Homo sapiens
caggcaccugcca

SEQ ID NO: 1292260 - RNA, 14 nt, Homo sapiens
caggccaguuugaa

SEQ ID NO: 1292261 - RNA, 23 nt, Homo sapiens
caggccaguuugaagacuacaug

SEQ ID NO: 1292262 - RNA, 22 nt, Homo sapiens
caggcccuggccuccccugcca

SEQ ID NO: 1292263 - RNA, 17 nt, Homo sapiens
caggccgcagcuccauu

SEQ ID NO: 1292264 - RNA, 22 nt, Homo sapiens
caggccucuuggcagucacauc

SEQ ID NO: 1292265 - RNA, 16 nt, Homo sapiens
caggccuuaucuccaa

SEQ ID NO: 1292266 - RNA, 13 nt, Homo sapiens
caggcuacacuga

SEQ ID NO: 1292267 - RNA, 19 nt, Homo sapiens
caggcuacacugacacugg

SEQ ID NO: 1292268 - RNA, 16 nt, Homo sapiens
caggcucaagcugucc

SEQ ID NO: 1292269 - RNA, 19 nt, Homo sapiens
caggcucccagggacaccu

SEQ ID NO: 1292270 - RNA, 14 nt, Homo sapiens
caggcucgucauug

SEQ ID NO: 1292271 - RNA, 12 nt, Homo sapiens
caggcugggaac

SEQ ID NO: 1292272 - RNA, 15 nt, Homo sapiens
caggcuuaugaauau

SEQ ID NO: 1292273 - RNA, 19 nt, Homo sapiens
cagggaagcugucccucac

SEQ ID NO: 1292274 - RNA, 14 nt, Homo sapiens
cccucagagugcaa

SEQ ID NO: 1292275 - RNA, 18 nt, Homo sapiens
cccucagagugcaagccc

SEQ ID NO: 1292276 - RNA, 11 nt, Homo sapiens
cccucauuccc

SEQ ID NO: 1292277 - RNA, 18 nt, Homo sapiens
cccucauucuacugaaaa

SEQ ID NO: 1292278 - RNA, 21 nt, Homo sapiens
cccuccacucucuaccagaua

SEQ ID NO: 1292279 - RNA, 14 nt, Homo sapiens
cccucccuuucucc

SEQ ID NO: 1292280 - RNA, 16 nt, Homo sapiens
cccucuaucaugguga

SEQ ID NO: 1292281 - RNA, 17 nt, Homo sapiens
cccucugcugaagacuu

SEQ ID NO: 1292282 - RNA, 13 nt, Homo sapiens
cccucuucugagc

SEQ ID NO: 1292283 - RNA, 14 nt, Homo sapiens
cccucuuugcugca

SEQ ID NO: 1292284 - RNA, 17 nt, Homo sapiens
cccugaacccacugcug

SEQ ID NO: 1292285 - RNA, 22 nt, Homo sapiens
cccugaccugugagcccagcug

SEQ ID NO: 1292286 - RNA, 17 nt, Homo sapiens
cccugagaaagcccugu

SEQ ID NO: 1292287 - RNA, 12 nt, Homo sapiens
cccugcauuuau

SEQ ID NO: 1292288 - RNA, 20 nt, Homo sapiens
cccugcccuccccucucugc

SEQ ID NO: 1292289 - RNA, 19 nt, Homo sapiens
cccugcgggugaacaaagc

SEQ ID NO: 1292290 - RNA, 21 nt, Homo sapiens
cccugcgggugaacaaagcag

SEQ ID NO: 1292291 - RNA, 17 nt, Homo sapiens
cccuggaccaguggucu

SEQ ID NO: 1292292 - RNA, 20 nt, Homo sapiens
cccuggagcccauccagucu

SEQ ID NO: 1292293 - RNA, 22 nt, Homo sapiens
cccuggcucugaccgaaacagc

SEQ ID NO: 1292294 - RNA, 20 nt, Homo sapiens
cccuggggagucugggcaca

SEQ ID NO: 1292295 - RNA, 14 nt, Homo sapiens
cccugucucaaaaa

SEQ ID NO: 1292296 - RNA, 17 nt, Homo sapiens
cccugucugugugcuga

SEQ ID NO: 1292297 - RNA, 12 nt, Homo sapiens
cccugugcaacc

SEQ ID NO: 1292298 - RNA, 18 nt, Homo sapiens
cccugugcgucucagugu

SEQ ID NO: 1292299 - RNA, 21 nt, Homo sapiens
cccuguggcaggacacacaug

SEQ ID NO: 1292300 - RNA, 19 nt, Homo sapiens
cccuguguugugcucagga

SEQ ID NO: 1292301 - RNA, 21 nt, Homo sapiens
cccuuaaacauuggacaguga

SEQ ID NO: 1292302 - RNA, 13 nt, Homo sapiens
cccuucacaaagc

SEQ ID NO: 1292303 - RNA, 15 nt, Homo sapiens
cccuucugcucagcu

SEQ ID NO: 1292304 - RNA, 20 nt, Homo sapiens
cccuugauuuaaacacacag

SEQ ID NO: 1292305 - RNA, 13 nt, Homo sapiens
cccuuuacuccuc

SEQ ID NO: 1292306 - RNA, 19 nt, Homo sapiens
cccuuugaugauuaauuca

SEQ ID NO: 1292307 - RNA, 13 nt, Homo sapiens
cccuuugugacuu

SEQ ID NO: 1292308 - RNA, 19 nt, Homo sapiens
ccgacaacagagacuggac

SEQ ID NO: 1292309 - RNA, 19 nt, Homo sapiens
ccgauauacucuagaugaa

SEQ ID NO: 1292310 - RNA, 12 nt, Homo sapiens
ccgauucaccug

SEQ ID NO: 1292311 - RNA, 19 nt, Homo sapiens
ccgcaaaagacaagucuuu

SEQ ID NO: 1292312 - RNA, 17 nt, Homo sapiens
ccgcagcacccugcaga

SEQ ID NO: 1292313 - RNA, 20 nt, Homo sapiens
ccgcaggcuucugugugcug

SEQ ID NO: 1292314 - RNA, 17 nt, Homo sapiens
ccgcaggugcugguccc

SEQ ID NO: 1292315 - RNA, 16 nt, Homo sapiens
ccgcucacugaacucc

SEQ ID NO: 1292316 - RNA, 14 nt, Homo sapiens
ccggaggccagcua

SEQ ID NO: 1292317 - RNA, 22 nt, Homo sapiens
ccggauauauacauagcaugac

SEQ ID NO: 1292318 - RNA, 19 nt, Homo sapiens
ccgggcaauccagacagca

SEQ ID NO: 1292319 - RNA, 15 nt, Homo sapiens
ccggggccagcacuu

SEQ ID NO: 1292320 - RNA, 15 nt, Homo sapiens
ccggguccccagcuc

SEQ ID NO: 1292321 - RNA, 14 nt, Homo sapiens
ccguaacaccugau

SEQ ID NO: 1292322 - RNA, 11 nt, Homo sapiens
ccguguugcag

SEQ ID NO: 1292323 - RNA, 18 nt, Homo sapiens
ccguuugaccaauuugca

SEQ ID NO: 1292324 - RNA, 20 nt, Homo sapiens
ccuaaaacaccugguaggag

SEQ ID NO: 1292325 - RNA, 16 nt, Homo sapiens
ccuaaaagcacacuca

SEQ ID NO: 1292326 - RNA, 18 nt, Homo sapiens
ccuaaaaggaaaucucac

SEQ ID NO: 1292327 - RNA, 19 nt, Homo sapiens
ccuaaaagugggcuugauu

SEQ ID NO: 1292328 - RNA, 17 nt, Homo sapiens
ccuaaaugcacagucau

SEQ ID NO: 1292329 - RNA, 22 nt, Homo sapiens
ccuaaauguuaacuacauauug

SEQ ID NO: 1292330 - RNA, 21 nt, Homo sapiens
ccuaagaucucgguuugccaa

SEQ ID NO: 1292331 - RNA, 18 nt, Homo sapiens
ccuaagcagaccacugau

SEQ ID NO: 1292332 - RNA, 16 nt, Homo sapiens
ccuaauaacgugaaac

SEQ ID NO: 1292333 - RNA, 20 nt, Homo sapiens
ccuaauccaggcagauccag

SEQ ID NO: 1292334 - RNA, 11 nt, Homo sapiens
ccuacagccag

SEQ ID NO: 1292335 - RNA, 18 nt, Homo sapiens
ccuaccugcagaguuacu

SEQ ID NO: 1292336 - RNA, 21 nt, Homo sapiens
ccuaccuuagaaaacaaguau

SEQ ID NO: 1292337 - RNA, 19 nt, Homo sapiens
ccuacuccaguaugacaga

SEQ ID NO: 1292338 - RNA, 13 nt, Homo sapiens
ccuacuuuagcca

SEQ ID NO: 1292339 - RNA, 21 nt, Homo sapiens
ccuacuuuugggaaucuguag

SEQ ID NO: 1292340 - RNA, 13 nt, Homo sapiens
ccuagaggugcuc

SEQ ID NO: 1292341 - RNA, 21 nt, Homo sapiens
ccuagauuuaaccauggcacu

SEQ ID NO: 1292342 - RNA, 20 nt, Homo sapiens
ccuagcacuuugggaggcca

SEQ ID NO: 1292343 - RNA, 23 nt, Homo sapiens
ccuagcagcaccguucugugcac

SEQ ID NO: 1292344 - RNA, 21 nt, Homo sapiens
ccuagccuuagaagucacaca

SEQ ID NO: 1292345 - RNA, 21 nt, Homo sapiens
ccuagcuaccuucucuaccca

SEQ ID NO: 1292346 - RNA, 19 nt, Homo sapiens
ccuagggccacugaagaua

SEQ ID NO: 1292347 - RNA, 20 nt, Homo sapiens
ccuauaugcagucucuuuau

SEQ ID NO: 1292348 - RNA, 16 nt, Homo sapiens
ccuaugugauuuuaac

SEQ ID NO: 1292349 - RNA, 18 nt, Homo sapiens
ccuauguugauccaucca

SEQ ID NO: 1292350 - RNA, 20 nt, Homo sapiens
ccucaaccaaugccaaaaaa

SEQ ID NO: 1292351 - RNA, 23 nt, Homo sapiens
ccucaagaaauaaaaggaagcca

SEQ ID NO: 1292352 - RNA, 14 nt, Homo sapiens
ccucaagugauccu

SEQ ID NO: 1292353 - RNA, 19 nt, Homo sapiens
ccucaaucucaauccugca

SEQ ID NO: 1292354 - RNA, 23 nt, Homo sapiens
ccucacagagugcauugugaggg

SEQ ID NO: 1292355 - RNA, 22 nt, Homo sapiens
ccucaccuagccugaugagauu

SEQ ID NO: 1292356 - RNA, 13 nt, Homo sapiens
ccucagagugcaa

SEQ ID NO: 1292357 - RNA, 15 nt, Homo sapiens
ccucagcuucucaaa

SEQ ID NO: 1292358 - RNA, 16 nt, Homo sapiens
ccucagggcacaaaga

SEQ ID NO: 1292359 - RNA, 15 nt, Homo sapiens
ccucaggugcugucc

SEQ ID NO: 1292360 - RNA, 15 nt, Homo sapiens
ccucauaaaaggacu

SEQ ID NO: 1292361 - RNA, 14 nt, Homo sapiens
ccucaucaucagag

SEQ ID NO: 1292362 - RNA, 18 nt, Homo sapiens
ccucaucucucugcccaa

SEQ ID NO: 1292363 - RNA, 22 nt, Homo sapiens
ccucaugucuucucacaagcca

SEQ ID NO: 1292364 - RNA, 19 nt, Homo sapiens
ccucauuagcauuuugcua

SEQ ID NO: 1292365 - RNA, 20 nt, Homo sapiens
ccucauuccccaaccacuuc

SEQ ID NO: 1292366 - RNA, 19 nt, Homo sapiens
ccucauuguucuguacaaa

SEQ ID NO: 1292367 - RNA, 13 nt, Homo sapiens
ccuccaauguaca

SEQ ID NO: 1292368 - RNA, 13 nt, Homo sapiens
ccuccagaacuca

SEQ ID NO: 1292369 - RNA, 22 nt, Homo sapiens
ccuccagcacccccagugcagc

SEQ ID NO: 1292370 - RNA, 22 nt, Homo sapiens
ccuccaggaaccacaccacauc

SEQ ID NO: 1292371 - RNA, 14 nt, Homo sapiens
ccuccaggccaguu

SEQ ID NO: 1292372 - RNA, 18 nt, Homo sapiens
ccuccauuucucugggac

SEQ ID NO: 1292373 - RNA, 18 nt, Homo sapiens
ccucccaaaugagccaug

SEQ ID NO: 1292374 - RNA, 22 nt, Homo sapiens
ccucccaggcucaagcuguccu

SEQ ID NO: 1292375 - RNA, 20 nt, Homo sapiens
ccucccagugugcugggauu

SEQ ID NO: 1292376 - RNA, 23 nt, Homo sapiens
ccuccccaaggagacacaacaac

SEQ ID NO: 1292377 - RNA, 16 nt, Homo sapiens
ccucccccccaugcac

SEQ ID NO: 1292378 - RNA, 13 nt, Homo sapiens
ccuccguggcaca

SEQ ID NO: 1292379 - RNA, 14 nt, Homo sapiens
ccuccguggcacau

SEQ ID NO: 1292380 - RNA, 13 nt, Homo sapiens
ccuccuacuccag

SEQ ID NO: 1292381 - RNA, 20 nt, Homo sapiens
ccuccucaggcacacagcua

SEQ ID NO: 1292382 - RNA, 21 nt, Homo sapiens
ccuccuucaauuccauauauc

SEQ ID NO: 1292383 - RNA, 15 nt, Homo sapiens
ccuccuuccauggaa

SEQ ID NO: 1292384 - RNA, 16 nt, Homo sapiens
ccuccuucccuguguc

SEQ ID NO: 1292385 - RNA, 18 nt, Homo sapiens
ccucgacguuuacaagcc

SEQ ID NO: 1292386 - RNA, 19 nt, Homo sapiens
ccucgacguuuacaagccc

SEQ ID NO: 1292387 - RNA, 15 nt, Homo sapiens
ccucuaccagcacau

SEQ ID NO: 1292388 - RNA, 18 nt, Homo sapiens
ccucuagagccuucagcc

SEQ ID NO: 1292389 - RNA, 15 nt, Homo sapiens
ccucuccaggcauuu

SEQ ID NO: 1292390 - RNA, 19 nt, Homo sapiens
ccucuccaggcauuuagcc

SEQ ID NO: 1292391 - RNA, 23 nt, Homo sapiens
ccucucugcagacuucccagcua

SEQ ID NO: 1292392 - RNA, 20 nt, Homo sapiens
ccucucugugggauaucaca

SEQ ID NO: 1292393 - RNA, 14 nt, Homo sapiens
ccucugaaacagcu

SEQ ID NO: 1292394 - RNA, 16 nt, Homo sapiens
ccucugacuccacuca

SEQ ID NO: 1292395 - RNA, 17 nt, Homo sapiens
ccucuggguaggaauca

SEQ ID NO: 1292396 - RNA, 18 nt, Homo sapiens
ccucugggucaguggucc

SEQ ID NO: 1292397 - RNA, 17 nt, Homo sapiens
ccucuguaccccaugac

SEQ ID NO: 1292398 - RNA, 18 nt, Homo sapiens
ccucuguccaggcacuga

SEQ ID NO: 1292399 - RNA, 16 nt, Homo sapiens
ccucuuguugcugagu

SEQ ID NO: 1292400 - RNA, 19 nt, Homo sapiens
ccucuuuccucuguggcaa

SEQ ID NO: 1292401 - RNA, 13 nt, Homo sapiens
ccucuuugcuuug

SEQ ID NO: 1292402 - RNA, 21 nt, Homo sapiens
ccugaaacaacuuggaaagau

SEQ ID NO: 1292403 - RNA, 21 nt, Homo sapiens
ccugaagaacaguaacugcca

SEQ ID NO: 1292404 - RNA, 12 nt, Homo sapiens
ccugaagaacca

SEQ ID NO: 1292405 - RNA, 15 nt, Homo sapiens
ccugaagaaccaguc

SEQ ID NO: 1292406 - RNA, 22 nt, Homo sapiens
cugccacgccgcccuaaaagca

SEQ ID NO: 1292407 - RNA, 13 nt, Homo sapiens
cugccagggccag

SEQ ID NO: 1292408 - RNA, 18 nt, Homo sapiens
cugccagggccagucuug

SEQ ID NO: 1292409 - RNA, 20 nt, Homo sapiens
cugcccaacccuucccucac

SEQ ID NO: 1292410 - RNA, 14 nt, Homo sapiens
cugcccaccuguca

SEQ ID NO: 1292411 - RNA, 19 nt, Homo sapiens
cugcccccuuuacuccucg

SEQ ID NO: 1292412 - RNA, 21 nt, Homo sapiens
cugccccuggcucugaccgaa

SEQ ID NO: 1292413 - RNA, 23 nt, Homo sapiens
cugcccguaaacacgccugcaaa

SEQ ID NO: 1292414 - RNA, 15 nt, Homo sapiens
cugcccuaaacccug

SEQ ID NO: 1292415 - RNA, 23 nt, Homo sapiens
cugccgguaaacacgccugcaaa

SEQ ID NO: 1292416 - RNA, 20 nt, Homo sapiens
cugccucagguguccgcuau

SEQ ID NO: 1292417 - RNA, 15 nt, Homo sapiens
cugccucugacacac

SEQ ID NO: 1292418 - RNA, 20 nt, Homo sapiens
cugccucuucuggccuggug

SEQ ID NO: 1292419 - RNA, 15 nt, Homo sapiens
cugccugaagucaca

SEQ ID NO: 1292420 - RNA, 17 nt, Homo sapiens
cugccuggagagcuccu

SEQ ID NO: 1292421 - RNA, 19 nt, Homo sapiens
cugccuggagagcuccuau

SEQ ID NO: 1292422 - RNA, 15 nt, Homo sapiens
cugccuuccagccac

SEQ ID NO: 1292423 - RNA, 15 nt, Homo sapiens
cugcggcgucugucu

SEQ ID NO: 1292424 - RNA, 17 nt, Homo sapiens
cugcgugguugaugauc

SEQ ID NO: 1292425 - RNA, 21 nt, Homo sapiens
cugcuacuggcaaaaggaucu

SEQ ID NO: 1292426 - RNA, 18 nt, Homo sapiens
cugcuauaggucagagau

SEQ ID NO: 1292427 - RNA, 14 nt, Homo sapiens
cugcucacaguccu

SEQ ID NO: 1292428 - RNA, 13 nt, Homo sapiens
cugcucacuuuaa

SEQ ID NO: 1292429 - RNA, 15 nt, Homo sapiens
cugcuccagaccuga

SEQ ID NO: 1292430 - RNA, 19 nt, Homo sapiens
cugcucgccuuagcacuac

SEQ ID NO: 1292431 - RNA, 13 nt, Homo sapiens
cugcugacagugu

SEQ ID NO: 1292432 - RNA, 20 nt, Homo sapiens
cugcuggaaaccucaugcca

SEQ ID NO: 1292433 - RNA, 21 nt, Homo sapiens
cugcuguggcgugagggugag

SEQ ID NO: 1292434 - RNA, 15 nt, Homo sapiens
cugcuugaccaaaga

SEQ ID NO: 1292435 - RNA, 13 nt, Homo sapiens
cugcuuucacucu

SEQ ID NO: 1292436 - RNA, 18 nt, Homo sapiens
cugcuuuuaacucuagaa

SEQ ID NO: 1292437 - RNA, 19 nt, Homo sapiens
cuggaaacauucaggagcu

SEQ ID NO: 1292438 - RNA, 20 nt, Homo sapiens
cuggaacacuagacaagcca

SEQ ID NO: 1292439 - RNA, 16 nt, Homo sapiens
cuggaagaggaaccag

SEQ ID NO: 1292440 - RNA, 13 nt, Homo sapiens
cuggaaugcagug

SEQ ID NO: 1292441 - RNA, 20 nt, Homo sapiens
cuggaaugcaguggugcgau

SEQ ID NO: 1292442 - RNA, 17 nt, Homo sapiens
cuggacaaagaauucca

SEQ ID NO: 1292443 - RNA, 17 nt, Homo sapiens
cuggacggaaccacgua

SEQ ID NO: 1292444 - RNA, 18 nt, Homo sapiens
cuggaggcugccucccaa

SEQ ID NO: 1292445 - RNA, 19 nt, Homo sapiens
cuggagugcaguggcgcau

SEQ ID NO: 1292446 - RNA, 21 nt, Homo sapiens
cuggaguuucauguacaagau

SEQ ID NO: 1292447 - RNA, 18 nt, Homo sapiens
cuggauuaggucucuguu

SEQ ID NO: 1292448 - RNA, 17 nt, Homo sapiens
cuggcaagucaccugca

SEQ ID NO: 1292449 - RNA, 18 nt, Homo sapiens
cuggcacauuuuucucuu

SEQ ID NO: 1292450 - RNA, 20 nt, Homo sapiens
cuggcaccaaaguccaggac

SEQ ID NO: 1292451 - RNA, 16 nt, Homo sapiens
cuggcaccagaacuga

SEQ ID NO: 1292452 - RNA, 14 nt, Homo sapiens
cuggcacuggacuu

SEQ ID NO: 1292453 - RNA, 14 nt, Homo sapiens
cuggcaugauccaa

SEQ ID NO: 1292454 - RNA, 14 nt, Homo sapiens
cuggcccaggugag

SEQ ID NO: 1292455 - RNA, 22 nt, Homo sapiens
cuggcucuugaggcauuuccag

SEQ ID NO: 1292456 - RNA, 23 nt, Homo sapiens
cuggcugcaaaggguaucaggug

SEQ ID NO: 1292457 - RNA, 13 nt, Homo sapiens
cuggcugugugac

SEQ ID NO: 1292458 - RNA, 17 nt, Homo sapiens
cugggacuacaggugug

SEQ ID NO: 1292459 - RNA, 16 nt, Homo sapiens
cugggauuacaggugu

SEQ ID NO: 1292460 - RNA, 18 nt, Homo sapiens
cugggauuacagguguga

SEQ ID NO: 1292461 - RNA, 20 nt, Homo sapiens
cugggauuacaggugugaac

SEQ ID NO: 1292462 - RNA, 20 nt, Homo sapiens
cugggauuacaggugugcac

SEQ ID NO: 1292463 - RNA, 18 nt, Homo sapiens
cugggcaagggaccugcu

SEQ ID NO: 1292464 - RNA, 22 nt, Homo sapiens
cugggcccucucugcucugcgu

SEQ ID NO: 1292465 - RNA, 17 nt, Homo sapiens
cugggccuggcagcuca

SEQ ID NO: 1292466 - RNA, 17 nt, Homo sapiens
cugggcuccuccagggu

SEQ ID NO: 1292467 - RNA, 20 nt, Homo sapiens
cuggggccuacagcuuugau

SEQ ID NO: 1292468 - RNA, 20 nt, Homo sapiens
cuggguccaccccaugucac

SEQ ID NO: 1292469 - RNA, 23 nt, Homo sapiens
cuggguugcugcuguccagugcc

SEQ ID NO: 1292470 - RNA, 22 nt, Homo sapiens
cugguauguuggggcccugugc

SEQ ID NO: 1292471 - RNA, 15 nt, Homo sapiens
cugguauuuccuggc

SEQ ID NO: 1292472 - RNA, 21 nt, Homo sapiens
cuggucccggggccagcacuu

SEQ ID NO: 1292473 - RNA, 22 nt, Homo sapiens
cuggucccggggccagcacuuc

SEQ ID NO: 1292474 - RNA, 18 nt, Homo sapiens
cugguggaaacucauggc

SEQ ID NO: 1292475 - RNA, 17 nt, Homo sapiens
cugguuagguagaggga

SEQ ID NO: 1292476 - RNA, 17 nt, Homo sapiens
cugguuuccugccucca

SEQ ID NO: 1292477 - RNA, 22 nt, Homo sapiens
cuguaaauaugaaucugcucac

SEQ ID NO: 1292478 - RNA, 21 nt, Homo sapiens
cuguaaucccagcuacuuggg

SEQ ID NO: 1292479 - RNA, 18 nt, Homo sapiens
cuguaccugugcacguug

SEQ ID NO: 1292480 - RNA, 17 nt, Homo sapiens
cuguagauucacauaca

SEQ ID NO: 1292481 - RNA, 17 nt, Homo sapiens
cuguagccucagaugau

SEQ ID NO: 1292482 - RNA, 11 nt, Homo sapiens
cuguagguuaa

SEQ ID NO: 1292483 - RNA, 22 nt, Homo sapiens
cuguauaaguuauuuuuguaca

SEQ ID NO: 1292484 - RNA, 14 nt, Homo sapiens
cuguaucuugaugu

SEQ ID NO: 1292485 - RNA, 20 nt, Homo sapiens
cuguaucuugauguuuagaa

SEQ ID NO: 1292486 - RNA, 21 nt, Homo sapiens
cuguauucccaguuacuuggg

SEQ ID NO: 1292487 - RNA, 20 nt, Homo sapiens
cuguauuuaacaaaaagugc

SEQ ID NO: 1292488 - RNA, 24 nt, Homo sapiens
cuguauuuaacaaaaagugcuuca

SEQ ID NO: 1292489 - RNA, 22 nt, Homo sapiens
cugucaaacaaagccagaagcu

SEQ ID NO: 1292490 - RNA, 19 nt, Homo sapiens
cugucacguagaacuugga

SEQ ID NO: 1292491 - RNA, 20 nt, Homo sapiens
cugucauccucaggaaccaa

SEQ ID NO: 1292492 - RNA, 19 nt, Homo sapiens
cugucauuuugcacuguaa

SEQ ID NO: 1292493 - RNA, 14 nt, Homo sapiens
cuguccacacccag

SEQ ID NO: 1292494 - RNA, 23 nt, Homo sapiens
cuguccccucuuccuacccugcc

SEQ ID NO: 1292495 - RNA, 13 nt, Homo sapiens
cuguccugcaaau

SEQ ID NO: 1292496 - RNA, 14 nt, Homo sapiens
cuguccugucccac

SEQ ID NO: 1292497 - RNA, 14 nt, Homo sapiens
cugucgcccagucu

SEQ ID NO: 1292498 - RNA, 13 nt, Homo sapiens
cugucuccauggc

SEQ ID NO: 1292499 - RNA, 14 nt, Homo sapiens
cugucucucugucu

SEQ ID NO: 1292500 - RNA, 19 nt, Homo sapiens
cugucucuuucaugaguuu

SEQ ID NO: 1292501 - RNA, 14 nt, Homo sapiens
cugucugacaaccu

SEQ ID NO: 1292502 - RNA, 16 nt, Homo sapiens
cugucugugugcugag

SEQ ID NO: 1292503 - RNA, 22 nt, Homo sapiens
cugucuucaccugauucaacua

SEQ ID NO: 1292504 - RNA, 22 nt, Homo sapiens
cugugaaaugcuggcauuugca

SEQ ID NO: 1292505 - RNA, 15 nt, Homo sapiens
cugugaagaucucac

SEQ ID NO: 1292506 - RNA, 14 nt, Homo sapiens
cugugauacauuuc

SEQ ID NO: 1292507 - RNA, 21 nt, Homo sapiens
cugugauucccuccugcuacu

SEQ ID NO: 1292508 - RNA, 20 nt, Homo sapiens
cugugcccggggaaaggcaa

SEQ ID NO: 1292509 - RNA, 12 nt, Homo sapiens
cugugcccugac

SEQ ID NO: 1292510 - RNA, 18 nt, Homo sapiens
cugugcuaccugagccaa

SEQ ID NO: 1292511 - RNA, 20 nt, Homo sapiens
cugugcugggagaaauacuu

SEQ ID NO: 1292512 - RNA, 21 nt, Homo sapiens
cuguggagacaaugucugcag

SEQ ID NO: 1292513 - RNA, 23 nt, Homo sapiens
cuguggugugucccccucugucc

SEQ ID NO: 1292514 - RNA, 13 nt, Homo sapiens
cuguguacuguac

SEQ ID NO: 1292515 - RNA, 23 nt, Homo sapiens
cuguguagcaucugcauugccca

SEQ ID NO: 1292516 - RNA, 20 nt, Homo sapiens
cugugucuuuuuucacuaca

SEQ ID NO: 1292517 - RNA, 13 nt, Homo sapiens
cugugugaugaug

SEQ ID NO: 1292518 - RNA, 17 nt, Homo sapiens
cugugugugugugugca

SEQ ID NO: 1292519 - RNA, 19 nt, Homo sapiens
cugugugugugugugcaua

SEQ ID NO: 1292520 - RNA, 15 nt, Homo sapiens
cuguguuugcugagg

SEQ ID NO: 1292521 - RNA, 22 nt, Homo sapiens
cuguuaaaauuuuucaguguug

SEQ ID NO: 1292522 - RNA, 21 nt, Homo sapiens
cuguuaacgucaucucagggu

SEQ ID NO: 1292523 - RNA, 20 nt, Homo sapiens
cuguucaagagcacacuugg

SEQ ID NO: 1292524 - RNA, 22 nt, Homo sapiens
cuguucaaguuuucagcuuuaa

SEQ ID NO: 1292525 - RNA, 17 nt, Homo sapiens
cuguucagcugguugag

SEQ ID NO: 1292526 - RNA, 15 nt, Homo sapiens
cuguuccaugucucc

SEQ ID NO: 1292527 - RNA, 14 nt, Homo sapiens
cuguuccccagaga

SEQ ID NO: 1292528 - RNA, 22 nt, Homo sapiens
cuguucuauucaucucaaggaa

SEQ ID NO: 1292529 - RNA, 20 nt, Homo sapiens
cuguucucuugggaacugaa

SEQ ID NO: 1292530 - RNA, 15 nt, Homo sapiens
cuguugacuggcugu

SEQ ID NO: 1292531 - RNA, 16 nt, Homo sapiens
cuguuggccaguguga

SEQ ID NO: 1292532 - RNA, 16 nt, Homo sapiens
cuguuguugaaauuga

SEQ ID NO: 1292533 - RNA, 15 nt, Homo sapiens
cuguuuaaaguguca

SEQ ID NO: 1292534 - RNA, 21 nt, Homo sapiens
cuguuuccuacagacacccau

SEQ ID NO: 1292535 - RNA, 19 nt, Homo sapiens
cuguuucuaccuauaugca

SEQ ID NO: 1292536 - RNA, 14 nt, Homo sapiens
cuguuugucucacc

SEQ ID NO: 1292537 - RNA, 15 nt, Homo sapiens
gacauacuuaaugca

SEQ ID NO: 1292538 - RNA, 17 nt, Homo sapiens
gacauacuuaaugcaua

SEQ ID NO: 1292539 - RNA, 22 nt, Homo sapiens
gacauagaaaguucauggaacu

SEQ ID NO: 1292540 - RNA, 16 nt, Homo sapiens
gacauagaagagccaa

SEQ ID NO: 1292541 - RNA, 20 nt, Homo sapiens
gacauccccccgccaaaagc

SEQ ID NO: 1292542 - RNA, 16 nt, Homo sapiens
gacaucuguagggaau

SEQ ID NO: 1292543 - RNA, 15 nt, Homo sapiens
gacaugagccauuug

SEQ ID NO: 1292544 - RNA, 16 nt, Homo sapiens
gacaugauuuccuuga

SEQ ID NO: 1292545 - RNA, 18 nt, Homo sapiens
gacaugauuuccuugaau

SEQ ID NO: 1292546 - RNA, 21 nt, Homo sapiens
gacaugcugaagccaaagcca

SEQ ID NO: 1292547 - RNA, 19 nt, Homo sapiens
gacaugcuucagugcugcu

SEQ ID NO: 1292548 - RNA, 19 nt, Homo sapiens
gacauggagaccgugacca

SEQ ID NO: 1292549 - RNA, 19 nt, Homo sapiens
gacauuggcaccuaaucca

SEQ ID NO: 1292550 - RNA, 19 nt, Homo sapiens
gaccacagcacagccaaca

SEQ ID NO: 1292551 - RNA, 15 nt, Homo sapiens
gaccaccacuucgaa

SEQ ID NO: 1292552 - RNA, 20 nt, Homo sapiens
gaccaccaguuaacguauua

SEQ ID NO: 1292553 - RNA, 19 nt, Homo sapiens
gaccacgugagaucauuca

SEQ ID NO: 1292554 - RNA, 22 nt, Homo sapiens
gaccacugaagcaccacaggga

SEQ ID NO: 1292555 - RNA, 18 nt, Homo sapiens
gacccagcugauugcacu

SEQ ID NO: 1292556 - RNA, 23 nt, Homo sapiens
gacccaggggucagccuuaggaa

SEQ ID NO: 1292557 - RNA, 15 nt, Homo sapiens
gacccccagcacuug

SEQ ID NO: 1292558 - RNA, 22 nt, Homo sapiens
gacccccgcccccugcccuccc

SEQ ID NO: 1292559 - RNA, 17 nt, Homo sapiens
gacccuguaaaauggag

SEQ ID NO: 1292560 - RNA, 19 nt, Homo sapiens
gaccgugaccagugcugcu

SEQ ID NO: 1292561 - RNA, 18 nt, Homo sapiens
gaccucagggcacaaaga

SEQ ID NO: 1292562 - RNA, 17 nt, Homo sapiens
gaccugaggcugugguc

SEQ ID NO: 1292563 - RNA, 14 nt, Homo sapiens
gaccuucauuucau

SEQ ID NO: 1292564 - RNA, 13 nt, Homo sapiens
gacgaaaguggaa

SEQ ID NO: 1292565 - RNA, 17 nt, Homo sapiens
gacgggagagggcagug

SEQ ID NO: 1292566 - RNA, 22 nt, Homo sapiens
gacgggcaaaauaaagugacag

SEQ ID NO: 1292567 - RNA, 21 nt, Homo sapiens
gacgguaacuuggcugcauuu

SEQ ID NO: 1292568 - RNA, 13 nt, Homo sapiens
gacggucagucca

SEQ ID NO: 1292569 - RNA, 22 nt, Homo sapiens
gacgugauucaauucaacacuc

SEQ ID NO: 1292570 - RNA, 21 nt, Homo sapiens
gacguuggccuaacacugggc

SEQ ID NO: 1292571 - RNA, 17 nt, Homo sapiens
gacuaugcagaggccug

SEQ ID NO: 1292572 - RNA, 20 nt, Homo sapiens
gacuauggauaaacuaaaca

SEQ ID NO: 1292573 - RNA, 23 nt, Homo sapiens
gacuauucccuucuaaccugaac

SEQ ID NO: 1292574 - RNA, 21 nt, Homo sapiens
gacucacccucauaccaucug

SEQ ID NO: 1292575 - RNA, 16 nt, Homo sapiens
gacucagaaagccaac

SEQ ID NO: 1292576 - RNA, 22 nt, Homo sapiens
gacuccacgcuguccuuuggga

SEQ ID NO: 1292577 - RNA, 15 nt, Homo sapiens
gacuccggcccuccu

SEQ ID NO: 1292578 - RNA, 15 nt, Homo sapiens
gacuccuaagggacu

SEQ ID NO: 1292579 - RNA, 21 nt, Homo sapiens
gacuccuaggcaggacaugcu

SEQ ID NO: 1292580 - RNA, 18 nt, Homo sapiens
gacuccucuuugugcaga

SEQ ID NO: 1292581 - RNA, 22 nt, Homo sapiens
gacucugaccccagcauucuca

SEQ ID NO: 1292582 - RNA, 19 nt, Homo sapiens
gacugcaguggacaguccc

SEQ ID NO: 1292583 - RNA, 15 nt, Homo sapiens
gacugcaucucaaaa

SEQ ID NO: 1292584 - RNA, 16 nt, Homo sapiens
gacugcaucucaaaaa

SEQ ID NO: 1292585 - RNA, 19 nt, Homo sapiens
gacuggaccccgcccagca

SEQ ID NO: 1292586 - RNA, 22 nt, Homo sapiens
gacuggcagcauugacucugug

SEQ ID NO: 1292587 - RNA, 23 nt, Homo sapiens
gacugggacagcccaggaaacaa

SEQ ID NO: 1292588 - RNA, 15 nt, Homo sapiens
gacuuaccuguucag

SEQ ID NO: 1292589 - RNA, 23 nt, Homo sapiens
gacuuccccugccuccuacucca

SEQ ID NO: 1292590 - RNA, 23 nt, Homo sapiens
gacuugaaauucucaucagucca

SEQ ID NO: 1292591 - RNA, 16 nt, Homo sapiens
gacuuuucaccuuaau

SEQ ID NO: 1292592 - RNA, 23 nt, Homo sapiens
gagaaaaaauauuuuccugccag

SEQ ID NO: 1292593 - RNA, 16 nt, Homo sapiens
gagaaaaaguucuaua

SEQ ID NO: 1292594 - RNA, 20 nt, Homo sapiens
gagaaaccuuauuguaccuc

SEQ ID NO: 1292595 - RNA, 23 nt, Homo sapiens
gagaaagagaaaucaauagugca

SEQ ID NO: 1292596 - RNA, 18 nt, Homo sapiens
gagaaagggacaaugaua

SEQ ID NO: 1292597 - RNA, 19 nt, Homo sapiens
gagaaagguggacuggaag

SEQ ID NO: 1292598 - RNA, 16 nt, Homo sapiens
gagaacaaugugcuau

SEQ ID NO: 1292599 - RNA, 14 nt, Homo sapiens
gagaacacugugaa

SEQ ID NO: 1292600 - RNA, 20 nt, Homo sapiens
gagaacuccuaggguggcug

SEQ ID NO: 1292601 - RNA, 19 nt, Homo sapiens
gagaacugcauauguuucg

SEQ ID NO: 1292602 - RNA, 20 nt, Homo sapiens
gagaagccaggaauuuccca

SEQ ID NO: 1292603 - RNA, 15 nt, Homo sapiens
gagaaggaaagugau

SEQ ID NO: 1292604 - RNA, 19 nt, Homo sapiens
gagaauaauucuugcaaua

SEQ ID NO: 1292605 - RNA, 16 nt, Homo sapiens
gagaauggauccucau

SEQ ID NO: 1292606 - RNA, 21 nt, Homo sapiens
gagaauguguuucaaaaccau

SEQ ID NO: 1292607 - RNA, 22 nt, Homo sapiens
gagacaaaauauuuuccugcca

SEQ ID NO: 1292608 - RNA, 13 nt, Homo sapiens
gagacaaggucac

SEQ ID NO: 1292609 - RNA, 22 nt, Homo sapiens
gagacacuauuuaucugugcaa

SEQ ID NO: 1292610 - RNA, 12 nt, Homo sapiens
gagacaggguuu

SEQ ID NO: 1292611 - RNA, 24 nt, Homo sapiens
gagacaggguuuggcugugucuaa

SEQ ID NO: 1292612 - RNA, 16 nt, Homo sapiens
gagaccaggcaaagca

SEQ ID NO: 1292613 - RNA, 15 nt, Homo sapiens
gagacccagaucuca

SEQ ID NO: 1292614 - RNA, 18 nt, Homo sapiens
gagacccagaucucaugg

SEQ ID NO: 1292615 - RNA, 19 nt, Homo sapiens
gagacccgagggcugcuuu

SEQ ID NO: 1292616 - RNA, 21 nt, Homo sapiens
gagacccugccuuuaaaaaca

SEQ ID NO: 1292617 - RNA, 13 nt, Homo sapiens
gagacugggucuc

SEQ ID NO: 1292618 - RNA, 18 nt, Homo sapiens
gagacuuaaaaaauacuu

SEQ ID NO: 1292619 - RNA, 17 nt, Homo sapiens
gagacuuuacauggaug

SEQ ID NO: 1292620 - RNA, 22 nt, Homo sapiens
gagagaaaacagaccuaaugcu

SEQ ID NO: 1292621 - RNA, 14 nt, Homo sapiens
gagagagaaggcag

SEQ ID NO: 1292622 - RNA, 14 nt, Homo sapiens
gagagauagccugu

SEQ ID NO: 1292623 - RNA, 20 nt, Homo sapiens
gagagaugaaccacauuaua

SEQ ID NO: 1292624 - RNA, 23 nt, Homo sapiens
gagagcccugggcuggaggcuga

SEQ ID NO: 1292625 - RNA, 16 nt, Homo sapiens
gagagcgccugccccu

SEQ ID NO: 1292626 - RNA, 14 nt, Homo sapiens
gagauaaacuaaug

SEQ ID NO: 1292627 - RNA, 17 nt, Homo sapiens
gagauagucucauucug

SEQ ID NO: 1292628 - RNA, 20 nt, Homo sapiens
gagauauuuauuaaacacca

SEQ ID NO: 1292629 - RNA, 21 nt, Homo sapiens
gagaucacgccacugcacuau

SEQ ID NO: 1292630 - RNA, 15 nt, Homo sapiens
gagaucaugucucac

SEQ ID NO: 1292631 - RNA, 18 nt, Homo sapiens
gagauccaaaguccugug

SEQ ID NO: 1292632 - RNA, 21 nt, Homo sapiens
gagauccaaaguccugugguu

SEQ ID NO: 1292633 - RNA, 11 nt, Homo sapiens
gagauccuccu

SEQ ID NO: 1292634 - RNA, 20 nt, Homo sapiens
gagaucgugccauugcacuc

SEQ ID NO: 1292635 - RNA, 21 nt, Homo sapiens
gagaucgugccauugcacucc

SEQ ID NO: 1292636 - RNA, 16 nt, Homo sapiens
gagaugaaaaagacug

SEQ ID NO: 1292637 - RNA, 17 nt, Homo sapiens
gagaugagguuucacca

SEQ ID NO: 1292638 - RNA, 16 nt, Homo sapiens
gagaugauacauccaa

SEQ ID NO: 1292639 - RNA, 16 nt, Homo sapiens
gagauuaaguccagaa

SEQ ID NO: 1292640 - RNA, 22 nt, Homo sapiens
gagauuaaguccagaaauguac

SEQ ID NO: 1292641 - RNA, 21 nt, Homo sapiens
gagcaaaggcugagaacacug

SEQ ID NO: 1292642 - RNA, 18 nt, Homo sapiens
gagcaagugagacccugu

SEQ ID NO: 1292643 - RNA, 12 nt, Homo sapiens
gagcacuacaga

SEQ ID NO: 1292644 - RNA, 23 nt, Homo sapiens
gagcagcugaacuuacuugccuc

SEQ ID NO: 1292645 - RNA, 19 nt, Homo sapiens
gagcaucacagaaugugau

SEQ ID NO: 1292646 - RNA, 18 nt, Homo sapiens
gagcaugacagccugcag

SEQ ID NO: 1292647 - RNA, 17 nt, Homo sapiens
gagccaagcuucaaccc

SEQ ID NO: 1292648 - RNA, 15 nt, Homo sapiens
gagccaaguuccaaa

SEQ ID NO: 1292649 - RNA, 13 nt, Homo sapiens
gagccaccccagg

SEQ ID NO: 1292650 - RNA, 15 nt, Homo sapiens
gagccagcucccucu

SEQ ID NO: 1292651 - RNA, 13 nt, Homo sapiens
gagccauaugaau

SEQ ID NO: 1292652 - RNA, 18 nt, Homo sapiens
gagccauguuaauguaau

SEQ ID NO: 1292653 - RNA, 24 nt, Homo sapiens
gagcccagggcaucuugcuggcua

SEQ ID NO: 1292654 - RNA, 15 nt, Homo sapiens
gagccggagcucaug

SEQ ID NO: 1292655 - RNA, 18 nt, Homo sapiens
gagccuggggaggccagg

SEQ ID NO: 1292656 - RNA, 22 nt, Homo sapiens
gagccugucuuucagcauucag

SEQ ID NO: 1292657 - RNA, 21 nt, Homo sapiens
gagccuugggagccacugcca

SEQ ID NO: 1292658 - RNA, 13 nt, Homo sapiens
gagcgaaacucca

SEQ ID NO: 1292659 - RNA, 16 nt, Homo sapiens
gagcuaaacuccuucc

SEQ ID NO: 1292660 - RNA, 17 nt, Homo sapiens
gagcuaauuuacuggac

SEQ ID NO: 1292661 - RNA, 12 nt, Homo sapiens
gagcuauaacuu

SEQ ID NO: 1292662 - RNA, 19 nt, Homo sapiens
gagcucacccaugugcaca

SEQ ID NO: 1292663 - RNA, 18 nt, Homo sapiens
gagcugacacaaaccugc

SEQ ID NO: 1292664 - RNA, 19 nt, Homo sapiens
gagcugcuucacuagggaa

SEQ ID NO: 1292665 - RNA, 16 nt, Homo sapiens
gagcuggggaucccuc

SEQ ID NO: 1292666 - RNA, 11 nt, Homo sapiens
gagcugugcag

SEQ ID NO: 1292667 - RNA, 13 nt, Homo sapiens
gagcuguuaacuu

SEQ ID NO: 1292668 - RNA, 19 nt, Homo sapiens
uauaaaaaugagugcuuaa

SEQ ID NO: 1292669 - RNA, 15 nt, Homo sapiens
uauaaaucuguuaua

SEQ ID NO: 1292670 - RNA, 12 nt, Homo sapiens
uauaacauccac

SEQ ID NO: 1292671 - RNA, 18 nt, Homo sapiens
uauaagaaagaucaaaga

SEQ ID NO: 1292672 - RNA, 12 nt, Homo sapiens
uauaauacugua

SEQ ID NO: 1292673 - RNA, 18 nt, Homo sapiens
uauaauuugcuggaacac

SEQ ID NO: 1292674 - RNA, 18 nt, Homo sapiens
uauacuccucaagcugaa

SEQ ID NO: 1292675 - RNA, 16 nt, Homo sapiens
uauacugcuuggagcu

SEQ ID NO: 1292676 - RNA, 14 nt, Homo sapiens
uauagaaaaaccaa

SEQ ID NO: 1292677 - RNA, 14 nt, Homo sapiens
uauagaugaggcag

SEQ ID NO: 1292678 - RNA, 16 nt, Homo sapiens
uauagcaucuuucaua

SEQ ID NO: 1292679 - RNA, 14 nt, Homo sapiens
uauagcuacuaauu

SEQ ID NO: 1292680 - RNA, 17 nt, Homo sapiens
uauagcuacuaauuuua

SEQ ID NO: 1292681 - RNA, 13 nt, Homo sapiens
uauaggcucuugu

SEQ ID NO: 1292682 - RNA, 22 nt, Homo sapiens
uauagucgaacaauucauauau

SEQ ID NO: 1292683 - RNA, 23 nt, Homo sapiens
uauaguuguuuuauauguugcua

SEQ ID NO: 1292684 - RNA, 16 nt, Homo sapiens
uauaguuuauugacaa

SEQ ID NO: 1292685 - RNA, 21 nt, Homo sapiens
uauauaaaugugauugcagcu

SEQ ID NO: 1292686 - RNA, 13 nt, Homo sapiens
uauauacauagca

SEQ ID NO: 1292687 - RNA, 20 nt, Homo sapiens
uauauacccguacaacgugu

SEQ ID NO: 1292688 - RNA, 19 nt, Homo sapiens
uauauagaaaaugcuaaag

SEQ ID NO: 1292689 - RNA, 19 nt, Homo sapiens
uauauauguauguaugugu

SEQ ID NO: 1292690 - RNA, 18 nt, Homo sapiens
uauauauuuuugugcaca

SEQ ID NO: 1292691 - RNA, 20 nt, Homo sapiens
uauauauuuuugugcacauu

SEQ ID NO: 1292692 - RNA, 22 nt, Homo sapiens
uauauccgccuggcauuucaca

SEQ ID NO: 1292693 - RNA, 23 nt, Homo sapiens
uauaucuuaaugcagacaaacaa

SEQ ID NO: 1292694 - RNA, 16 nt, Homo sapiens
uauaugcuaagucuua

SEQ ID NO: 1292695 - RNA, 21 nt, Homo sapiens
uauaugcuuguguaacaggaa

SEQ ID NO: 1292696 - RNA, 11 nt, Homo sapiens
uauauguauau

SEQ ID NO: 1292697 - RNA, 14 nt, Homo sapiens
uauaugugugccua

SEQ ID NO: 1292698 - RNA, 15 nt, Homo sapiens
uauaugugugccuau

SEQ ID NO: 1292699 - RNA, 19 nt, Homo sapiens
uauauguguguauacauau

SEQ ID NO: 1292700 - RNA, 14 nt, Homo sapiens
uauauguugcuaua

SEQ ID NO: 1292701 - RNA, 24 nt, Homo sapiens
uauauguuuugugggaacagaugu

SEQ ID NO: 1292702 - RNA, 16 nt, Homo sapiens
uauauuuuagccuuua

SEQ ID NO: 1292703 - RNA, 17 nt, Homo sapiens
uaucaccgugggcuccc

SEQ ID NO: 1292704 - RNA, 13 nt, Homo sapiens
uaucagcaaaaaa

SEQ ID NO: 1292705 - RNA, 15 nt, Homo sapiens
uaucaggguauucca

SEQ ID NO: 1292706 - RNA, 17 nt, Homo sapiens
uaucauaaaaaugagug

SEQ ID NO: 1292707 - RNA, 20 nt, Homo sapiens
uaucauggugaaaagcucca

SEQ ID NO: 1292708 - RNA, 22 nt, Homo sapiens
uaucauugcaggagccauauga

SEQ ID NO: 1292709 - RNA, 13 nt, Homo sapiens
uauccaugcaccu

SEQ ID NO: 1292710 - RNA, 11 nt, Homo sapiens
uauccaugccu

SEQ ID NO: 1292711 - RNA, 22 nt, Homo sapiens
uauccauucuuucugauaacua

SEQ ID NO: 1292712 - RNA, 19 nt, Homo sapiens
uauccuguuuuuaaaccau

SEQ ID NO: 1292713 - RNA, 12 nt, Homo sapiens
uaucuacuacaa

SEQ ID NO: 1292714 - RNA, 15 nt, Homo sapiens
uaucuccacaaccuc

SEQ ID NO: 1292715 - RNA, 17 nt, Homo sapiens
uaucuguguuugcugag

SEQ ID NO: 1292716 - RNA, 13 nt, Homo sapiens
uaucuuugauucu

SEQ ID NO: 1292717 - RNA, 17 nt, Homo sapiens
uaugaaaauaaaucauc

SEQ ID NO: 1292718 - RNA, 22 nt, Homo sapiens
uaugaaauaaaauuacacagua

SEQ ID NO: 1292719 - RNA, 18 nt, Homo sapiens
uaugaacauuagaaaaau

SEQ ID NO: 1292720 - RNA, 18 nt, Homo sapiens
uaugacauggaggcacug

SEQ ID NO: 1292721 - RNA, 19 nt, Homo sapiens
uaugacauggaggcacuga

SEQ ID NO: 1292722 - RNA, 19 nt, Homo sapiens
uaugaguggaaaaagccaa

SEQ ID NO: 1292723 - RNA, 17 nt, Homo sapiens
uaugauaaauauaacau

SEQ ID NO: 1292724 - RNA, 23 nt, Homo sapiens
uaugauaaauauaacaucuauga

SEQ ID NO: 1292725 - RNA, 15 nt, Homo sapiens
uaugauucguguaau

SEQ ID NO: 1292726 - RNA, 16 nt, Homo sapiens
uaugcugacagcucuu

SEQ ID NO: 1292727 - RNA, 20 nt, Homo sapiens
uaugcugacagcucuucaca

SEQ ID NO: 1292728 - RNA, 22 nt, Homo sapiens
uaugcuuuccuucuuugggaua

SEQ ID NO: 1292729 - RNA, 23 nt, Homo sapiens
uauggacugacuggguuauugaa

SEQ ID NO: 1292730 - RNA, 19 nt, Homo sapiens
uauggcugccugcaucuau

SEQ ID NO: 1292731 - RNA, 15 nt, Homo sapiens
uauguaaaugacucu

SEQ ID NO: 1292732 - RNA, 13 nt, Homo sapiens
uauguaacaugua

SEQ ID NO: 1292733 - RNA, 22 nt, Homo sapiens
uauguaauggaacuuagccauu

SEQ ID NO: 1292734 - RNA, 14 nt, Homo sapiens
uauguacaugagaa

SEQ ID NO: 1292735 - RNA, 22 nt, Homo sapiens
uauguagcaaaauacaugacau

SEQ ID NO: 1292736 - RNA, 23 nt, Homo sapiens
uauguaguaauugacaugugcca

SEQ ID NO: 1292737 - RNA, 13 nt, Homo sapiens
uauguauauacau

SEQ ID NO: 1292738 - RNA, 21 nt, Homo sapiens
uaugugaucaauuuugacuua

SEQ ID NO: 1292739 - RNA, 14 nt, Homo sapiens
uauguggcuguauc

SEQ ID NO: 1292740 - RNA, 15 nt, Homo sapiens
uaugugugugugugc

SEQ ID NO: 1292741 - RNA, 18 nt, Homo sapiens
uauguuggggcccugugc

SEQ ID NO: 1292742 - RNA, 15 nt, Homo sapiens
uauuaacaugaugua

SEQ ID NO: 1292743 - RNA, 15 nt, Homo sapiens
uauuaagccacuuaa

SEQ ID NO: 1292744 - RNA, 19 nt, Homo sapiens
uauuaaggauguagcuuuu

SEQ ID NO: 1292745 - RNA, 24 nt, Homo sapiens
uauuaauuuuuaaggauguugcca

SEQ ID NO: 1292746 - RNA, 18 nt, Homo sapiens
uauuacaaauccaaugaa

SEQ ID NO: 1292747 - RNA, 14 nt, Homo sapiens
uauuaguugccaau

SEQ ID NO: 1292748 - RNA, 23 nt, Homo sapiens
uauuaucagagacuauguagcaa

SEQ ID NO: 1292749 - RNA, 18 nt, Homo sapiens
uauuauccuucuacuugu

SEQ ID NO: 1292750 - RNA, 12 nt, Homo sapiens
uauuauugaacu

SEQ ID NO: 1292751 - RNA, 18 nt, Homo sapiens
uauucuaaacagacucau

SEQ ID NO: 1292752 - RNA, 20 nt, Homo sapiens
uauucuucccuuuuaaacac

SEQ ID NO: 1292753 - RNA, 18 nt, Homo sapiens
uauugacaauaauuucag

SEQ ID NO: 1292754 - RNA, 18 nt, Homo sapiens
uauugagggugacagcca

SEQ ID NO: 1292755 - RNA, 19 nt, Homo sapiens
uauugcaugcucaacuuag

SEQ ID NO: 1292756 - RNA, 16 nt, Homo sapiens
uauugccucuacuuug

SEQ ID NO: 1292757 - RNA, 21 nt, Homo sapiens
uauugcuugggucucucucca

SEQ ID NO: 1292758 - RNA, 14 nt, Homo sapiens
uauuggaaugcaca

SEQ ID NO: 1292759 - RNA, 16 nt, Homo sapiens
uauugguguacuguaa

SEQ ID NO: 1292760 - RNA, 16 nt, Homo sapiens
uauuguauaaagcauu

SEQ ID NO: 1292761 - RNA, 22 nt, Homo sapiens
uauuguccccuaaaccaaaaac

SEQ ID NO: 1292762 - RNA, 20 nt, Homo sapiens
uauuuaaauuguuuuggacg

SEQ ID NO: 1292763 - RNA, 18 nt, Homo sapiens
uauuuaacaaaaagugcu

SEQ ID NO: 1292764 - RNA, 20 nt, Homo sapiens
uauuuaauuuuaacugccaa

SEQ ID NO: 1292765 - RNA, 16 nt, Homo sapiens
uauuuaccagaccaca

SEQ ID NO: 1292766 - RNA, 17 nt, Homo sapiens
uauuuaccagaccacaa

SEQ ID NO: 1292767 - RNA, 21 nt, Homo sapiens
uauuuauagucgaacaauuca

SEQ ID NO: 1292768 - RNA, 16 nt, Homo sapiens
uauuuaucugugcaaa

SEQ ID NO: 1292769 - RNA, 13 nt, Homo sapiens
uauuuauuuacug

SEQ ID NO: 1292770 - RNA, 21 nt, Homo sapiens
uauuuccacuuauaaaggaaa

SEQ ID NO: 1292771 - RNA, 16 nt, Homo sapiens
uauuucugaaucgaga

SEQ ID NO: 1292772 - RNA, 22 nt, Homo sapiens
uauuucuucuacugcuaucuac

SEQ ID NO: 1292773 - RNA, 17 nt, Homo sapiens
uauuugugcuauaguau

SEQ ID NO: 1292774 - RNA, 16 nt, Homo sapiens
uauuuuauagcuacua

SEQ ID NO: 1292775 - RNA, 19 nt, Homo sapiens
uauuuuauucccuuucaca

SEQ ID NO: 1292776 - RNA, 20 nt, Homo sapiens
uauuuuauucccuuucacaa

SEQ ID NO: 1292777 - RNA, 21 nt, Homo sapiens
uauuuucagaugugaaccauu

SEQ ID NO: 1292778 - RNA, 12 nt, Homo sapiens
uauuuuccaaag

SEQ ID NO: 1292779 - RNA, 13 nt, Homo sapiens
uauuuuccugcca

SEQ ID NO: 1292780 - RNA, 16 nt, Homo sapiens
uauuuucuacuugcca

SEQ ID NO: 1292781 - RNA, 16 nt, Homo sapiens
uauuuugaaacuuugc

SEQ ID NO: 1292782 - RNA, 14 nt, Homo sapiens
uauuuuguguccuc

SEQ ID NO: 1292783 - RNA, 23 nt, Homo sapiens
uauuuuuaaccugccaacauacu

SEQ ID NO: 1292784 - RNA, 14 nt, Homo sapiens
uauuuuugugcaca

SEQ ID NO: 1292785 - RNA, 13 nt, Homo sapiens
uauuuuuguggac

SEQ ID NO: 1292786 - RNA, 15 nt, Homo sapiens
uauuuuuucuugaca

SEQ ID NO: 1292787 - RNA, 20 nt, Homo sapiens
uauuuuuugacacuuccauu

SEQ ID NO: 1292788 - RNA, 23 nt, Homo sapiens
ucaaaaauagggaaguaacagua

SEQ ID NO: 1292789 - RNA, 14 nt, Homo sapiens
ucaaaacauugaua

SEQ ID NO: 1292790 - RNA, 15 nt, Homo sapiens
ucaaaacccuaaaau

SEQ ID NO: 1292791 - RNA, 18 nt, Homo sapiens
ucaaaacuggagucccaa

SEQ ID NO: 1292792 - RNA, 19 nt, Homo sapiens
ucaaaagucuggccuuuca

SEQ ID NO: 1292793 - RNA, 16 nt, Homo sapiens
ucaaaauccuacagau

SEQ ID NO: 1292794 - RNA, 13 nt, Homo sapiens
ucaaaaucuuucc

SEQ ID NO: 1292795 - RNA, 13 nt, Homo sapiens
ucaaaauuugcug

SEQ ID NO: 1292796 - RNA, 15 nt, Homo sapiens
ucaaagcugggauua

SEQ ID NO: 1292797 - RNA, 21 nt, Homo sapiens
ucaaauggaagacacauugaa

SEQ ID NO: 1292798 - RNA, 23 nt, Homo sapiens
ucaaauuauuuccaagagagauu

SEQ ID NO: 1292799 - RNA, 16 nt, Homo sapiens
ucaaauuggagcuuca

SEQ ID NO: 1292800 - RNA, 13 nt, Homo sapiens
ucuauaaagauca

SEQ ID NO: 1292801 - RNA, 22 nt, Homo sapiens
ucuauaaagaucauauauuacu

SEQ ID NO: 1292802 - RNA, 17 nt, Homo sapiens
ucuaugauaauuacaau

SEQ ID NO: 1292803 - RNA, 23 nt, Homo sapiens
ucuaugggacucaaugcacugac

SEQ ID NO: 1292804 - RNA, 15 nt, Homo sapiens
ucuauguucaaagac

SEQ ID NO: 1292805 - RNA, 19 nt, Homo sapiens
ucuauguuuacaaauggac

SEQ ID NO: 1292806 - RNA, 20 nt, Homo sapiens
ucuauucuuuguaccaucug

SEQ ID NO: 1292807 - RNA, 13 nt, Homo sapiens
ucuauuugugcuu

SEQ ID NO: 1292808 - RNA, 20 nt, Homo sapiens
ucucaaacucuugaccucag

SEQ ID NO: 1292809 - RNA, 17 nt, Homo sapiens
ucucaaauuuguggucc

SEQ ID NO: 1292810 - RNA, 18 nt, Homo sapiens
ucucaaguuaucagggua

SEQ ID NO: 1292811 - RNA, 18 nt, Homo sapiens
ucucaauugugcuuugua

SEQ ID NO: 1292812 - RNA, 17 nt, Homo sapiens
ucucaccagcugcaaag

SEQ ID NO: 1292813 - RNA, 16 nt, Homo sapiens
ucucaccuacuccaga

SEQ ID NO: 1292814 - RNA, 12 nt, Homo sapiens
ucucacucugcc

SEQ ID NO: 1292815 - RNA, 18 nt, Homo sapiens
ucucacuguugcccaggc

SEQ ID NO: 1292816 - RNA, 15 nt, Homo sapiens
ucucacuguugugaa

SEQ ID NO: 1292817 - RNA, 22 nt, Homo sapiens
ucucagacuuuggaaaaugcau

SEQ ID NO: 1292818 - RNA, 16 nt, Homo sapiens
ucucagcacuaugaca

SEQ ID NO: 1292819 - RNA, 18 nt, Homo sapiens
ucucagcuaccuaagaaa

SEQ ID NO: 1292820 - RNA, 17 nt, Homo sapiens
ucucagcuccaauuuca

SEQ ID NO: 1292821 - RNA, 14 nt, Homo sapiens
ucucaggaccaaag

SEQ ID NO: 1292822 - RNA, 20 nt, Homo sapiens
ucucaggagcuugcaagaag

SEQ ID NO: 1292823 - RNA, 17 nt, Homo sapiens
ucucaggagucucuggu

SEQ ID NO: 1292824 - RNA, 12 nt, Homo sapiens
ucucagugcagg

SEQ ID NO: 1292825 - RNA, 23 nt, Homo sapiens
ucucaguugauuuucuggauucc

SEQ ID NO: 1292826 - RNA, 13 nt, Homo sapiens
ucucauccaucac

SEQ ID NO: 1292827 - RNA, 20 nt, Homo sapiens
ucucauccugcaggcagcuu

SEQ ID NO: 1292828 - RNA, 19 nt, Homo sapiens
ucucaucuuucuugaucaa

SEQ ID NO: 1292829 - RNA, 16 nt, Homo sapiens
ucucaugggaagggga

SEQ ID NO: 1292830 - RNA, 17 nt, Homo sapiens
ucucaugggaaggggag

SEQ ID NO: 1292831 - RNA, 18 nt, Homo sapiens
ucucauucccuccccaga

SEQ ID NO: 1292832 - RNA, 21 nt, Homo sapiens
ucuccaaccccccagcacuga

SEQ ID NO: 1292833 - RNA, 23 nt, Homo sapiens
ucuccaaccccccagcacugagg

SEQ ID NO: 1292834 - RNA, 19 nt, Homo sapiens
ucuccacuucuuguucccc

SEQ ID NO: 1292835 - RNA, 23 nt, Homo sapiens
ucuccagagggaauugcagagua

SEQ ID NO: 1292836 - RNA, 13 nt, Homo sapiens
ucuccagccucag

SEQ ID NO: 1292837 - RNA, 18 nt, Homo sapiens
ucuccauggcccugccau

SEQ ID NO: 1292838 - RNA, 16 nt, Homo sapiens
ucucccauaaacacug

SEQ ID NO: 1292839 - RNA, 20 nt, Homo sapiens
ucuccccugaccugugagcc

SEQ ID NO: 1292840 - RNA, 16 nt, Homo sapiens
ucucccguccauucca

SEQ ID NO: 1292841 - RNA, 19 nt, Homo sapiens
ucucccucuaggcucugcc

SEQ ID NO: 1292842 - RNA, 14 nt, Homo sapiens
ucucccugugcugu

SEQ ID NO: 1292843 - RNA, 23 nt, Homo sapiens
ucuccucaugcccccucagugag

SEQ ID NO: 1292844 - RNA, 19 nt, Homo sapiens
ucuccugccuuugccucca

SEQ ID NO: 1292845 - RNA, 13 nt, Homo sapiens
ucuccuguggucu

SEQ ID NO: 1292846 - RNA, 14 nt, Homo sapiens
ucuccuuaacacug

SEQ ID NO: 1292847 - RNA, 17 nt, Homo sapiens
ucucucacggcuuguaa

SEQ ID NO: 1292848 - RNA, 13 nt, Homo sapiens
ucucucaucucuu

SEQ ID NO: 1292849 - RNA, 17 nt, Homo sapiens
ucucuccaaaaaugcac

SEQ ID NO: 1292850 - RNA, 14 nt, Homo sapiens
ucucucucugucuc

SEQ ID NO: 1292851 - RNA, 17 nt, Homo sapiens
ucucucugucucucugu

SEQ ID NO: 1292852 - RNA, 19 nt, Homo sapiens
ucucucuuucccuuuggca

SEQ ID NO: 1292853 - RNA, 19 nt, Homo sapiens
ucucugagcagugaaugau

SEQ ID NO: 1292854 - RNA, 17 nt, Homo sapiens
ucucugaggacacuaac

SEQ ID NO: 1292855 - RNA, 21 nt, Homo sapiens
ucucugaguccuggcccaaag

SEQ ID NO: 1292856 - RNA, 14 nt, Homo sapiens
ucucugugccuucg

SEQ ID NO: 1292857 - RNA, 23 nt, Homo sapiens
ucucuucccugcgccugugaugc

SEQ ID NO: 1292858 - RNA, 16 nt, Homo sapiens
ucucuucuaagcaaaa

SEQ ID NO: 1292859 - RNA, 15 nt, Homo sapiens
ucucuugaaccuggg

SEQ ID NO: 1292860 - RNA, 16 nt, Homo sapiens
ucucuugcauugugac

SEQ ID NO: 1292861 - RNA, 22 nt, Homo sapiens
ucucuuuugaggcucucucaua

SEQ ID NO: 1292862 - RNA, 12 nt, Homo sapiens
ucugaaacuggg

SEQ ID NO: 1292863 - RNA, 20 nt, Homo sapiens
ucugaaagauaagaaucacu

SEQ ID NO: 1292864 - RNA, 16 nt, Homo sapiens
ucugaacccugagcag

SEQ ID NO: 1292865 - RNA, 18 nt, Homo sapiens
ucugaaucccgacucuga

SEQ ID NO: 1292866 - RNA, 15 nt, Homo sapiens
ucugaauuugcaaag

SEQ ID NO: 1292867 - RNA, 20 nt, Homo sapiens
ucugaauuugcaaaguacug

SEQ ID NO: 1292868 - RNA, 22 nt, Homo sapiens
ucugaauuugcaaaguacugua

SEQ ID NO: 1292869 - RNA, 13 nt, Homo sapiens
ucugaccagcagc

SEQ ID NO: 1292870 - RNA, 12 nt, Homo sapiens
ucugacccagug

SEQ ID NO: 1292871 - RNA, 15 nt, Homo sapiens
ucugacuccacucaa

SEQ ID NO: 1292872 - RNA, 22 nt, Homo sapiens
ucugacuccacucaaagagggu

SEQ ID NO: 1292873 - RNA, 19 nt, Homo sapiens
ucugacuuaagcaaaagaa

SEQ ID NO: 1292874 - RNA, 13 nt, Homo sapiens
ucugagcauuuaa

SEQ ID NO: 1292875 - RNA, 11 nt, Homo sapiens
ucugaguauaa

SEQ ID NO: 1292876 - RNA, 21 nt, Homo sapiens
ucugagucuauguucaaagac

SEQ ID NO: 1292877 - RNA, 20 nt, Homo sapiens
ucugagugaaccuguauaag

SEQ ID NO: 1292878 - RNA, 13 nt, Homo sapiens
ucugagugccuuc

SEQ ID NO: 1292879 - RNA, 21 nt, Homo sapiens
ucugauuguugucaggccaua

SEQ ID NO: 1292880 - RNA, 12 nt, Homo sapiens
ucugcacagcuu

SEQ ID NO: 1292881 - RNA, 23 nt, Homo sapiens
ucugcacuuauaagaaagaucaa

SEQ ID NO: 1292882 - RNA, 23 nt, Homo sapiens
ucugcauuucgguggcuagucaa

SEQ ID NO: 1292883 - RNA, 16 nt, Homo sapiens
ucugccccagcccaga

SEQ ID NO: 1292884 - RNA, 14 nt, Homo sapiens
ucugcccucuagag

SEQ ID NO: 1292885 - RNA, 22 nt, Homo sapiens
ucugcccugaacccacugcugc

SEQ ID NO: 1292886 - RNA, 19 nt, Homo sapiens
ucugcccuguguacuuccc

SEQ ID NO: 1292887 - RNA, 19 nt, Homo sapiens
ucugccucugacacacagc

SEQ ID NO: 1292888 - RNA, 16 nt, Homo sapiens
ucugccuggguuuugu

SEQ ID NO: 1292889 - RNA, 13 nt, Homo sapiens
ucugccuguggaa

SEQ ID NO: 1292890 - RNA, 14 nt, Homo sapiens
ucugccuugccuuu

SEQ ID NO: 1292891 - RNA, 20 nt, Homo sapiens
ucugcgugucaccugugcuu

SEQ ID NO: 1292892 - RNA, 13 nt, Homo sapiens
ucugcucacuuua

SEQ ID NO: 1292893 - RNA, 18 nt, Homo sapiens
ucugcucaucauucucug

SEQ ID NO: 1292894 - RNA, 17 nt, Homo sapiens
ucugcucuguucuggau

SEQ ID NO: 1292895 - RNA, 15 nt, Homo sapiens
ucuggaaacugugaa

SEQ ID NO: 1292896 - RNA, 13 nt, Homo sapiens
ucuggaaccucag

SEQ ID NO: 1292897 - RNA, 13 nt, Homo sapiens
ucuggaaucugga

SEQ ID NO: 1292898 - RNA, 15 nt, Homo sapiens
ucuggauucugaauc

SEQ ID NO: 1292899 - RNA, 17 nt, Homo sapiens
ucuggauucugaaucuc

SEQ ID NO: 1292900 - RNA, 21 nt, Homo sapiens
ucuggcaucucccacacaaga

SEQ ID NO: 1292901 - RNA, 19 nt, Homo sapiens
ucuggcauuccuuuuccca

SEQ ID NO: 1292902 - RNA, 15 nt, Homo sapiens
ucugggagucacaca

SEQ ID NO: 1292903 - RNA, 19 nt, Homo sapiens
ucugggucagugguccaca

SEQ ID NO: 1292904 - RNA, 20 nt, Homo sapiens
ucuggucagagccacagggu

SEQ ID NO: 1292905 - RNA, 17 nt, Homo sapiens
ucuguaauacauaucau

SEQ ID NO: 1292906 - RNA, 18 nt, Homo sapiens
ucuguacgucugacaggc

SEQ ID NO: 1292907 - RNA, 14 nt, Homo sapiens
ucuguagugucacu

SEQ ID NO: 1292908 - RNA, 11 nt, Homo sapiens
ucuguaucugc

SEQ ID NO: 1292909 - RNA, 17 nt, Homo sapiens
ucugucauacauccuag

SEQ ID NO: 1292910 - RNA, 15 nt, Homo sapiens
ucugucauccugcua

SEQ ID NO: 1292911 - RNA, 20 nt, Homo sapiens
ucugucccucacagcacuag

SEQ ID NO: 1292912 - RNA, 19 nt, Homo sapiens
ucugucucucugucucucu

SEQ ID NO: 1292913 - RNA, 21 nt, Homo sapiens
ucuguggaucagagaugcacc

SEQ ID NO: 1292914 - RNA, 17 nt, Homo sapiens
ucuguggcacucagaua

SEQ ID NO: 1292915 - RNA, 19 nt, Homo sapiens
ucugugggcuccauguaga

SEQ ID NO: 1292916 - RNA, 20 nt, Homo sapiens
ucuguuggccagugugacaa

SEQ ID NO: 1292917 - RNA, 17 nt, Homo sapiens
ucuguuuugaaggcaaa

SEQ ID NO: 1292918 - RNA, 14 nt, Homo sapiens
ucuuaaagcaaaua

SEQ ID NO: 1292919 - RNA, 17 nt, Homo sapiens
ucuuaaggaacaucucu

SEQ ID NO: 1292920 - RNA, 12 nt, Homo sapiens
ucuuaauacugu

SEQ ID NO: 1292921 - RNA, 13 nt, Homo sapiens
ucuuaauguucac

SEQ ID NO: 1292922 - RNA, 12 nt, Homo sapiens
ucuuacacaaga

SEQ ID NO: 1292923 - RNA, 13 nt, Homo sapiens
ucuuacacaagag

SEQ ID NO: 1292924 - RNA, 13 nt, Homo sapiens
ucuuacuuggcuu

SEQ ID NO: 1292925 - RNA, 20 nt, Homo sapiens
ucuuagcacaccuacaccuc

SEQ ID NO: 1292926 - RNA, 19 nt, Homo sapiens
ucuuauucuuuuguaauau

SEQ ID NO: 1292927 - RNA, 14 nt, Homo sapiens
ucuucaccauuugg

SEQ ID NO: 1292928 - RNA, 15 nt, Homo sapiens
ucuucaccucuucca

SEQ ID NO: 1292929 - RNA, 15 nt, Homo sapiens
ucuucaccuuauuca

SEQ ID NO: 1292930 - RNA, 16 nt, Homo sapiens
ucuucauguaccugcu

SEQ ID NO: 1292931 - RNA, 17 nt, Homo sapiens
ucuuccauuugcaaggg

SEQ ID NO: 1292932 - RNA, 15 nt, Homo sapiens
ucuucccucucugca

SEQ ID NO: 1292933 - RNA, 13 nt, Homo sapiens
uggagaugcaaau

SEQ ID NO: 1292934 - RNA, 22 nt, Homo sapiens
uggagccagcaaccagcacauc

SEQ ID NO: 1292935 - RNA, 19 nt, Homo sapiens
uggagcccauccagucucc

SEQ ID NO: 1292936 - RNA, 18 nt, Homo sapiens
uggaggaucucacuuaau

SEQ ID NO: 1292937 - RNA, 14 nt, Homo sapiens
uggaggcugagcug

SEQ ID NO: 1292938 - RNA, 22 nt, Homo sapiens
uggagguauucaauauccuuug

SEQ ID NO: 1292939 - RNA, 17 nt, Homo sapiens
uggaggucagcauuuga

SEQ ID NO: 1292940 - RNA, 23 nt, Homo sapiens
uggaguacuuagcuaguuuuauu

SEQ ID NO: 1292941 - RNA, 24 nt, Homo sapiens
uggaguuucauguacaagaugaag

SEQ ID NO: 1292942 - RNA, 15 nt, Homo sapiens
uggaugcagcucuug

SEQ ID NO: 1292943 - RNA, 17 nt, Homo sapiens
uggaugccaaccgguca

SEQ ID NO: 1292944 - RNA, 14 nt, Homo sapiens
uggaugcccugugg

SEQ ID NO: 1292945 - RNA, 11 nt, Homo sapiens
uggaugccuug

SEQ ID NO: 1292946 - RNA, 22 nt, Homo sapiens
uggaugggccuuugagccugau

SEQ ID NO: 1292947 - RNA, 16 nt, Homo sapiens
uggaugggggaacuca

SEQ ID NO: 1292948 - RNA, 18 nt, Homo sapiens
uggauuccccaucucagg

SEQ ID NO: 1292949 - RNA, 14 nt, Homo sapiens
uggauugggguccc

SEQ ID NO: 1292950 - RNA, 13 nt, Homo sapiens
uggauuuugucaa

SEQ ID NO: 1292951 - RNA, 15 nt, Homo sapiens
uggcaaggugacauu

SEQ ID NO: 1292952 - RNA, 19 nt, Homo sapiens
uggcacauaaagaaaucuu

SEQ ID NO: 1292953 - RNA, 12 nt, Homo sapiens
uggcaccagcag

SEQ ID NO: 1292954 - RNA, 16 nt, Homo sapiens
uggcacugacugggca

SEQ ID NO: 1292955 - RNA, 13 nt, Homo sapiens
uggcacugcauac

SEQ ID NO: 1292956 - RNA, 15 nt, Homo sapiens
uggcacugccaugca

SEQ ID NO: 1292957 - RNA, 17 nt, Homo sapiens
uggcacuggaugcagaa

SEQ ID NO: 1292958 - RNA, 22 nt, Homo sapiens
uggcagaaauacagucuuccac

SEQ ID NO: 1292959 - RNA, 14 nt, Homo sapiens
uggcagcugcaaua

SEQ ID NO: 1292960 - RNA, 17 nt, Homo sapiens
uggcaguccagccagcu

SEQ ID NO: 1292961 - RNA, 19 nt, Homo sapiens
uggcauagcccauguuaag

SEQ ID NO: 1292962 - RNA, 17 nt, Homo sapiens
uggcaugagaaauacaa

SEQ ID NO: 1292963 - RNA, 11 nt, Homo sapiens
uggcauuucaa

SEQ ID NO: 1292964 - RNA, 17 nt, Homo sapiens
uggccaaauagcaaaga

SEQ ID NO: 1292965 - RNA, 16 nt, Homo sapiens
uggccaaggagcugcu

SEQ ID NO: 1292966 - RNA, 19 nt, Homo sapiens
uggccaagggccagacaga

SEQ ID NO: 1292967 - RNA, 15 nt, Homo sapiens
uggccacaugucuuu

SEQ ID NO: 1292968 - RNA, 22 nt, Homo sapiens
uggccacugggucucugcaaac

SEQ ID NO: 1292969 - RNA, 21 nt, Homo sapiens
uggccaggccucuuggcaguc

SEQ ID NO: 1292970 - RNA, 13 nt, Homo sapiens
uggccaguucauu

SEQ ID NO: 1292971 - RNA, 12 nt, Homo sapiens
uggcccagguga

SEQ ID NO: 1292972 - RNA, 17 nt, Homo sapiens
uggccccugcccggcug

SEQ ID NO: 1292973 - RNA, 23 nt, Homo sapiens
uggccucacccaccccugcacag

SEQ ID NO: 1292974 - RNA, 15 nt, Homo sapiens
uggccucccacagac

SEQ ID NO: 1292975 - RNA, 22 nt, Homo sapiens
uggccuccccugccaccaggcc

SEQ ID NO: 1292976 - RNA, 22 nt, Homo sapiens
uggccuccuuccccguacuuug

SEQ ID NO: 1292977 - RNA, 14 nt, Homo sapiens
uggccugcacuggu

SEQ ID NO: 1292978 - RNA, 18 nt, Homo sapiens
uggcgggugccuguaauc

SEQ ID NO: 1292979 - RNA, 16 nt, Homo sapiens
uggcuaagaguguccu

SEQ ID NO: 1292980 - RNA, 16 nt, Homo sapiens
uggcucacgccuguaa

SEQ ID NO: 1292981 - RNA, 17 nt, Homo sapiens
uggcucagccagcacuu

SEQ ID NO: 1292982 - RNA, 14 nt, Homo sapiens
uggcugcauuugcc

SEQ ID NO: 1292983 - RNA, 15 nt, Homo sapiens
uggcuggcucugcac

SEQ ID NO: 1292984 - RNA, 12 nt, Homo sapiens
uggcuggcugcc

SEQ ID NO: 1292985 - RNA, 15 nt, Homo sapiens
uggcuguggagacaa

SEQ ID NO: 1292986 - RNA, 16 nt, Homo sapiens
uggcuguggggacccc

SEQ ID NO: 1292987 - RNA, 21 nt, Homo sapiens
uggcuuggguucacagugcau

SEQ ID NO: 1292988 - RNA, 16 nt, Homo sapiens
ugggaagggcagggaa

SEQ ID NO: 1292989 - RNA, 17 nt, Homo sapiens
ugggaaggggaggaccc

SEQ ID NO: 1292990 - RNA, 22 nt, Homo sapiens
ugggaaguuggcuggugucccu

SEQ ID NO: 1292991 - RNA, 19 nt, Homo sapiens
ugggaaucaacagcauauu

SEQ ID NO: 1292992 - RNA, 15 nt, Homo sapiens
ugggaaugucucuuu

SEQ ID NO: 1292993 - RNA, 22 nt, Homo sapiens
ugggacuacaggugugagucac

SEQ ID NO: 1292994 - RNA, 19 nt, Homo sapiens
ugggagauguuagacucau

SEQ ID NO: 1292995 - RNA, 17 nt, Homo sapiens
ugggagcagcuaaagau

SEQ ID NO: 1292996 - RNA, 17 nt, Homo sapiens
ugggaggcuguggagcc

SEQ ID NO: 1292997 - RNA, 20 nt, Homo sapiens
ugggauagagaauguuccag

SEQ ID NO: 1292998 - RNA, 21 nt, Homo sapiens
ugggauagagaauguuccaga

SEQ ID NO: 1292999 - RNA, 18 nt, Homo sapiens
ugggaucucaucgaauaa

SEQ ID NO: 1293000 - RNA, 22 nt, Homo sapiens
ugggaugagagggcccagaaga

SEQ ID NO: 1293001 - RNA, 16 nt, Homo sapiens
ugggaugcucucuggu

SEQ ID NO: 1293002 - RNA, 21 nt, Homo sapiens
ugggcaagccuguuccgguga

SEQ ID NO: 1293003 - RNA, 22 nt, Homo sapiens
ugggcaagggaccugcuucuau

SEQ ID NO: 1293004 - RNA, 16 nt, Homo sapiens
ugggcaauauagcaag

SEQ ID NO: 1293005 - RNA, 18 nt, Homo sapiens
ugggcagagcugcaucau

SEQ ID NO: 1293006 - RNA, 16 nt, Homo sapiens
ugggcagcucaucucu

SEQ ID NO: 1293007 - RNA, 17 nt, Homo sapiens
ugggccaaaaucaugcc

SEQ ID NO: 1293008 - RNA, 16 nt, Homo sapiens
ugggcccccauaauaa

SEQ ID NO: 1293009 - RNA, 21 nt, Homo sapiens
ugggccgggcaauccagacag

SEQ ID NO: 1293010 - RNA, 21 nt, Homo sapiens
ugggcuaggguggucagagga

SEQ ID NO: 1293011 - RNA, 21 nt, Homo sapiens
ugggcucgccacaucccauga

SEQ ID NO: 1293012 - RNA, 13 nt, Homo sapiens
ugggcuucacugg

SEQ ID NO: 1293013 - RNA, 21 nt, Homo sapiens
uggggaagagugacucuccag

SEQ ID NO: 1293014 - RNA, 13 nt, Homo sapiens
uggggacggugua

SEQ ID NO: 1293015 - RNA, 15 nt, Homo sapiens
uggggagucagggac

SEQ ID NO: 1293016 - RNA, 16 nt, Homo sapiens
uggggauaugauuuaa

SEQ ID NO: 1293017 - RNA, 15 nt, Homo sapiens
uggggccagauccag

SEQ ID NO: 1293018 - RNA, 15 nt, Homo sapiens
ugggggaaagcacag

SEQ ID NO: 1293019 - RNA, 22 nt, Homo sapiens
ugggggagaaccacugacccaa

SEQ ID NO: 1293020 - RNA, 22 nt, Homo sapiens
ugggggcagggcugugcuugaa

SEQ ID NO: 1293021 - RNA, 15 nt, Homo sapiens
uggggucaugcccuc

SEQ ID NO: 1293022 - RNA, 18 nt, Homo sapiens
ugggguggggauagggag

SEQ ID NO: 1293023 - RNA, 13 nt, Homo sapiens
uggguaccuguau

SEQ ID NO: 1293024 - RNA, 22 nt, Homo sapiens
ugggucauagaaauucuuuaua

SEQ ID NO: 1293025 - RNA, 17 nt, Homo sapiens
ugggucccggcucugug

SEQ ID NO: 1293026 - RNA, 22 nt, Homo sapiens
ugggugggcaggaaaaggugau

SEQ ID NO: 1293027 - RNA, 13 nt, Homo sapiens
uggguucauccua

SEQ ID NO: 1293028 - RNA, 20 nt, Homo sapiens
uggguuuugggucuuugaac

SEQ ID NO: 1293029 - RNA, 19 nt, Homo sapiens
ugguaccuauuugacuuac

SEQ ID NO: 1293030 - RNA, 15 nt, Homo sapiens
ugguacucaagcccg

SEQ ID NO: 1293031 - RNA, 21 nt, Homo sapiens
ugguacuccaauucagaauga

SEQ ID NO: 1293032 - RNA, 23 nt, Homo sapiens
ugguacuccaugcauucaccugc

SEQ ID NO: 1293033 - RNA, 18 nt, Homo sapiens
ugguauuuucaaccauaa

SEQ ID NO: 1293034 - RNA, 19 nt, Homo sapiens
uggucagggccacggccaa

SEQ ID NO: 1293035 - RNA, 21 nt, Homo sapiens
uggucauuggccgacaucaca

SEQ ID NO: 1293036 - RNA, 17 nt, Homo sapiens
ugguccacagcaucucc

SEQ ID NO: 1293037 - RNA, 16 nt, Homo sapiens
uggucccaagacauga

SEQ ID NO: 1293038 - RNA, 17 nt, Homo sapiens
uggucccaagacaugaa

SEQ ID NO: 1293039 - RNA, 20 nt, Homo sapiens
uggucccggggccagcacuu

SEQ ID NO: 1293040 - RNA, 20 nt, Homo sapiens
uggucguuuucaacagaauu

SEQ ID NO: 1293041 - RNA, 17 nt, Homo sapiens
uggucuggccacugucc

SEQ ID NO: 1293042 - RNA, 21 nt, Homo sapiens
uggucuucaagacgacagcuc

SEQ ID NO: 1293043 - RNA, 14 nt, Homo sapiens
uggugaaaugcaga

SEQ ID NO: 1293044 - RNA, 20 nt, Homo sapiens
uggugagcucugggaagugu

SEQ ID NO: 1293045 - RNA, 12 nt, Homo sapiens
uggugcugagaa

SEQ ID NO: 1293046 - RNA, 21 nt, Homo sapiens
ugguggacgcuggccugggau

SEQ ID NO: 1293047 - RNA, 20 nt, Homo sapiens
ugguggagagaagugagaau

SEQ ID NO: 1293048 - RNA, 20 nt, Homo sapiens
uggugucccaguaaagccaa

SEQ ID NO: 1293049 - RNA, 14 nt, Homo sapiens
ugguguguuacaca

SEQ ID NO: 1293050 - RNA, 19 nt, Homo sapiens
ugguuaacgccuucauuua

SEQ ID NO: 1293051 - RNA, 20 nt, Homo sapiens
ugguuaucuaauauguaaca

SEQ ID NO: 1293052 - RNA, 14 nt, Homo sapiens
ugguucaacaucua

SEQ ID NO: 1293053 - RNA, 14 nt, Homo sapiens
ugguucaggguugg

SEQ ID NO: 1293054 - RNA, 19 nt, Homo sapiens
ugguucccccacugaucac

SEQ ID NO: 1293055 - RNA, 20 nt, Homo sapiens
ugguuccugugauacauuuc

SEQ ID NO: 1293056 - RNA, 22 nt, Homo sapiens
ugguugaauaguucuauacaaa

SEQ ID NO: 1293057 - RNA, 17 nt, Homo sapiens
ugguugaguucagguag

SEQ ID NO: 1293058 - RNA, 16 nt, Homo sapiens
ugguuuagucauugca

SEQ ID NO: 1293059 - RNA, 15 nt, Homo sapiens
ugguuuccacauuua

SEQ ID NO: 1293060 - RNA, 17 nt, Homo sapiens
ugguuuuaauacuugau

SEQ ID NO: 1293061 - RNA, 22 nt, Homo sapiens
uguaaaaaaaaaaaacauacau

SEQ ID NO: 1293062 - RNA, 12 nt, Homo sapiens
uguaaaaagccc

SEQ ID NO: 1293063 - RNA, 14 nt, Homo sapiens
uguaaaagcacaug

SEQ ID NO: 1293064 - RNA, 14 nt, Homo sapiens
uguaaaagggauuu

SEQ ID NO: 1293065 - RNA, 16 nt, Homo sapiens
uucuaccuauaugcag

SEQ ID NO: 1293066 - RNA, 17 nt, Homo sapiens
uucuaccuauaugcagu

SEQ ID NO: 1293067 - RNA, 17 nt, Homo sapiens
uucuagaugacuuuaau

SEQ ID NO: 1293068 - RNA, 16 nt, Homo sapiens
uucuaggaggucuguu

SEQ ID NO: 1293069 - RNA, 13 nt, Homo sapiens
uucuaggcauaca

SEQ ID NO: 1293070 - RNA, 12 nt, Homo sapiens
uucuauaacaaa

SEQ ID NO: 1293071 - RNA, 15 nt, Homo sapiens
uucuauccuguucuu

SEQ ID NO: 1293072 - RNA, 15 nt, Homo sapiens
uucucaccagcugca

SEQ ID NO: 1293073 - RNA, 22 nt, Homo sapiens
uucucagacuuuggaaaaugca

SEQ ID NO: 1293074 - RNA, 20 nt, Homo sapiens
uucucauuucuguagccuga

SEQ ID NO: 1293075 - RNA, 15 nt, Homo sapiens
uucucccucauuuca

SEQ ID NO: 1293076 - RNA, 22 nt, Homo sapiens
uucuccuuggaggacaguggga

SEQ ID NO: 1293077 - RNA, 16 nt, Homo sapiens
uucucuaacucagaaa

SEQ ID NO: 1293078 - RNA, 13 nt, Homo sapiens
uucucucaucucu

SEQ ID NO: 1293079 - RNA, 20 nt, Homo sapiens
uucucucucucugucucucu

SEQ ID NO: 1293080 - RNA, 15 nt, Homo sapiens
uucucucuucuccac

SEQ ID NO: 1293081 - RNA, 23 nt, Homo sapiens
uucucuguguaugagugugaaug

SEQ ID NO: 1293082 - RNA, 15 nt, Homo sapiens
uucugaauuugcaaa

SEQ ID NO: 1293083 - RNA, 23 nt, Homo sapiens
uucugacuugacuuuagucugca

SEQ ID NO: 1293084 - RNA, 15 nt, Homo sapiens
uucugagaaggugag

SEQ ID NO: 1293085 - RNA, 18 nt, Homo sapiens
uucugagacagcuugucu

SEQ ID NO: 1293086 - RNA, 12 nt, Homo sapiens
uucugagcauuu

SEQ ID NO: 1293087 - RNA, 13 nt, Homo sapiens
uucugagcuguau

SEQ ID NO: 1293088 - RNA, 18 nt, Homo sapiens
uucugcauuuagcuguau

SEQ ID NO: 1293089 - RNA, 11 nt, Homo sapiens
uucugccaaac

SEQ ID NO: 1293090 - RNA, 20 nt, Homo sapiens
uucugccugccuuccagcca

SEQ ID NO: 1293091 - RNA, 14 nt, Homo sapiens
uucuggcugugcua

SEQ ID NO: 1293092 - RNA, 13 nt, Homo sapiens
uucugggacacag

SEQ ID NO: 1293093 - RNA, 19 nt, Homo sapiens
uucuggggggugaccgacu

SEQ ID NO: 1293094 - RNA, 15 nt, Homo sapiens
uucuguacucaaaug

SEQ ID NO: 1293095 - RNA, 21 nt, Homo sapiens
uucugucacccagacuggagu

SEQ ID NO: 1293096 - RNA, 18 nt, Homo sapiens
uucuguccccucuuccua

SEQ ID NO: 1293097 - RNA, 12 nt, Homo sapiens
uucugucuuccc

SEQ ID NO: 1293098 - RNA, 22 nt, Homo sapiens
uucugugggagaauucuuacau

SEQ ID NO: 1293099 - RNA, 15 nt, Homo sapiens
uucuguguugccaag

SEQ ID NO: 1293100 - RNA, 15 nt, Homo sapiens
uucuuagacuuaucu

SEQ ID NO: 1293101 - RNA, 16 nt, Homo sapiens
uucuucccuacaguug

SEQ ID NO: 1293102 - RNA, 16 nt, Homo sapiens
uucuucuguccugaga

SEQ ID NO: 1293103 - RNA, 16 nt, Homo sapiens
uucuugaaaaacuuac

SEQ ID NO: 1293104 - RNA, 23 nt, Homo sapiens
uucuugaguugucuuuugccauu

SEQ ID NO: 1293105 - RNA, 13 nt, Homo sapiens
uucuugcauauau

SEQ ID NO: 1293106 - RNA, 22 nt, Homo sapiens
uucuuuaaaauguaaagccaug

SEQ ID NO: 1293107 - RNA, 20 nt, Homo sapiens
uucuuuauaauccucuguaa

SEQ ID NO: 1293108 - RNA, 22 nt, Homo sapiens
uucuuuugaaaauuaguauggu

SEQ ID NO: 1293109 - RNA, 13 nt, Homo sapiens
uucuuuugacuga

SEQ ID NO: 1293110 - RNA, 16 nt, Homo sapiens
uugaaaguuagcauaa

SEQ ID NO: 1293111 - RNA, 21 nt, Homo sapiens
uugaaaguuuauaugcuucua

SEQ ID NO: 1293112 - RNA, 18 nt, Homo sapiens
uugaacagcuugcugcua

SEQ ID NO: 1293113 - RNA, 19 nt, Homo sapiens
uugaaggcccugcugaguc

SEQ ID NO: 1293114 - RNA, 13 nt, Homo sapiens
uugaagggccaga

SEQ ID NO: 1293115 - RNA, 17 nt, Homo sapiens
uugaauaauaagcagga

SEQ ID NO: 1293116 - RNA, 19 nt, Homo sapiens
uugaaugcagucuguccag

SEQ ID NO: 1293117 - RNA, 13 nt, Homo sapiens
uugacaacuggca

SEQ ID NO: 1293118 - RNA, 19 nt, Homo sapiens
uugacagcuuugcugcuga

SEQ ID NO: 1293119 - RNA, 11 nt, Homo sapiens
uugaccaaaga

SEQ ID NO: 1293120 - RNA, 14 nt, Homo sapiens
uugaccaccaguua

SEQ ID NO: 1293121 - RNA, 16 nt, Homo sapiens
uugacuuucuagcuuc

SEQ ID NO: 1293122 - RNA, 14 nt, Homo sapiens
uugagaaucccaaa

SEQ ID NO: 1293123 - RNA, 19 nt, Homo sapiens
uugaggcauuuccagacuu

SEQ ID NO: 1293124 - RNA, 19 nt, Homo sapiens
uugagggacugagccagac

SEQ ID NO: 1293125 - RNA, 22 nt, Homo sapiens
uugaguuaaugugcugagcauu

SEQ ID NO: 1293126 - RNA, 16 nt, Homo sapiens
uugauaccaccuauau

SEQ ID NO: 1293127 - RNA, 19 nt, Homo sapiens
uugauauguuuuauuucau

SEQ ID NO: 1293128 - RNA, 21 nt, Homo sapiens
uugaucuucagggaacugcau

SEQ ID NO: 1293129 - RNA, 20 nt, Homo sapiens
uugauucugauaaugcucac

SEQ ID NO: 1293130 - RNA, 21 nt, Homo sapiens
uugcaaggcaaagacuauucc

SEQ ID NO: 1293131 - RNA, 14 nt, Homo sapiens
uugcaccacugcac

SEQ ID NO: 1293132 - RNA, 21 nt, Homo sapiens
uugcagcuuauauucauccau

SEQ ID NO: 1293133 - RNA, 16 nt, Homo sapiens
uugcaggguccucuuc

SEQ ID NO: 1293134 - RNA, 23 nt, Homo sapiens
uugcagguggggguugcuguaua

SEQ ID NO: 1293135 - RNA, 17 nt, Homo sapiens
uugcauacccaaaccag

SEQ ID NO: 1293136 - RNA, 17 nt, Homo sapiens
uugcauagcagcugcua

SEQ ID NO: 1293137 - RNA, 19 nt, Homo sapiens
uugcauagcagcugcuacu

SEQ ID NO: 1293138 - RNA, 21 nt, Homo sapiens
uugcaucagcaacaaccagca

SEQ ID NO: 1293139 - RNA, 14 nt, Homo sapiens
uugcauugauucag

SEQ ID NO: 1293140 - RNA, 22 nt, Homo sapiens
uugcauugauucaguauuacaa

SEQ ID NO: 1293141 - RNA, 23 nt, Homo sapiens
uugccaagcucaggaccaggcaa

SEQ ID NO: 1293142 - RNA, 16 nt, Homo sapiens
uugccacuacccccuc

SEQ ID NO: 1293143 - RNA, 20 nt, Homo sapiens
uugcccaggcuggucucaaa

SEQ ID NO: 1293144 - RNA, 16 nt, Homo sapiens
uugcccagucuuucau

SEQ ID NO: 1293145 - RNA, 14 nt, Homo sapiens
uugccuaaauccaa

SEQ ID NO: 1293146 - RNA, 23 nt, Homo sapiens
uugccucccgggcucaagcgauu

SEQ ID NO: 1293147 - RNA, 15 nt, Homo sapiens
uugccucuacuuuga

SEQ ID NO: 1293148 - RNA, 22 nt, Homo sapiens
uugccucuacuuugauucugau

SEQ ID NO: 1293149 - RNA, 18 nt, Homo sapiens
uugccucuuucacauuga

SEQ ID NO: 1293150 - RNA, 18 nt, Homo sapiens
uugccucuuuuaccugcu

SEQ ID NO: 1293151 - RNA, 18 nt, Homo sapiens
uugccuuggagaucaaaa

SEQ ID NO: 1293152 - RNA, 19 nt, Homo sapiens
uugcgauucugcagccaca

SEQ ID NO: 1293153 - RNA, 17 nt, Homo sapiens
uugcuaacacacagagc

SEQ ID NO: 1293154 - RNA, 20 nt, Homo sapiens
uugcuacagggcucacagaa

SEQ ID NO: 1293155 - RNA, 15 nt, Homo sapiens
uugcuccauuuacaa

SEQ ID NO: 1293156 - RNA, 14 nt, Homo sapiens
uugcugccaaaugc

SEQ ID NO: 1293157 - RNA, 21 nt, Homo sapiens
uugcugucccauagucccugc

SEQ ID NO: 1293158 - RNA, 20 nt, Homo sapiens
uugcuuuagguaucacugga

SEQ ID NO: 1293159 - RNA, 19 nt, Homo sapiens
uuggaaaaagccugugaaa

SEQ ID NO: 1293160 - RNA, 23 nt, Homo sapiens
uuggaaaaauucauugucucuag

SEQ ID NO: 1293161 - RNA, 18 nt, Homo sapiens
uuggaagcugucauaaaa

SEQ ID NO: 1293162 - RNA, 13 nt, Homo sapiens
uuggaaugcacag

SEQ ID NO: 1293163 - RNA, 11 nt, Homo sapiens
uuggacagggg

SEQ ID NO: 1293164 - RNA, 23 nt, Homo sapiens
uuggaggagcaaaggcugagaac

SEQ ID NO: 1293165 - RNA, 20 nt, Homo sapiens
uuggaggagcaaaguuaaaa

SEQ ID NO: 1293166 - RNA, 17 nt, Homo sapiens
uuggagggugucccaaa

SEQ ID NO: 1293167 - RNA, 18 nt, Homo sapiens
uuggagugcgggugggcu

SEQ ID NO: 1293168 - RNA, 18 nt, Homo sapiens
uuggauacauacaccagc

SEQ ID NO: 1293169 - RNA, 20 nt, Homo sapiens
uuggauaucaaaagcaaaua

SEQ ID NO: 1293170 - RNA, 23 nt, Homo sapiens
uuggauuuuugacucuggcaaag

SEQ ID NO: 1293171 - RNA, 13 nt, Homo sapiens
uuggcaaugccau

SEQ ID NO: 1293172 - RNA, 19 nt, Homo sapiens
uuggccaccaggugccuuu

SEQ ID NO: 1293173 - RNA, 15 nt, Homo sapiens
uuggccagugugaca

SEQ ID NO: 1293174 - RNA, 15 nt, Homo sapiens
uuggccaucucugga

SEQ ID NO: 1293175 - RNA, 21 nt, Homo sapiens
uuggccuauuccauucuggau

SEQ ID NO: 1293176 - RNA, 11 nt, Homo sapiens
uuggccuccau

SEQ ID NO: 1293177 - RNA, 22 nt, Homo sapiens
uuggcugugcccucagauuccg

SEQ ID NO: 1293178 - RNA, 16 nt, Homo sapiens
uugggccagacaugcc

SEQ ID NO: 1293179 - RNA, 18 nt, Homo sapiens
uuggggaaggccaggacc

SEQ ID NO: 1293180 - RNA, 13 nt, Homo sapiens
uugggggggcucc

SEQ ID NO: 1293181 - RNA, 17 nt, Homo sapiens
uuggguucacagugcau

SEQ ID NO: 1293182 - RNA, 15 nt, Homo sapiens
uugguaaauggcaaa

SEQ ID NO: 1293183 - RNA, 15 nt, Homo sapiens
uugguaaauucacaa

SEQ ID NO: 1293184 - RNA, 14 nt, Homo sapiens
uuggucacauauca

SEQ ID NO: 1293185 - RNA, 14 nt, Homo sapiens
uuggucaugcaaua

SEQ ID NO: 1293186 - RNA, 14 nt, Homo sapiens
uuggugaauuucac

SEQ ID NO: 1293187 - RNA, 23 nt, Homo sapiens
uuggugaggaaaagcggacauca

SEQ ID NO: 1293188 - RNA, 17 nt, Homo sapiens
uuggugcuuuccagaau

SEQ ID NO: 1293189 - RNA, 21 nt, Homo sapiens
uugguucaauaaagcacugag

SEQ ID NO: 1293190 - RNA, 17 nt, Homo sapiens
uugguuggauaagcuau

SEQ ID NO: 1293191 - RNA, 22 nt, Homo sapiens
uuguaaaaagcccagcacuuga

SEQ ID NO: 1293192 - RNA, 17 nt, Homo sapiens
uuguaaacagaagcaac

SEQ ID NO: 1293193 - RNA, 16 nt, Homo sapiens
uuguacacgaagacca

SEQ ID NO: 1293194 - RNA, 18 nt, Homo sapiens
uuguacuucuguaccugu

SEQ ID NO: 1293195 - RNA, 24 nt, Homo sapiens
uuguauaaagcauuuguagcaauu

SEQ ID NO: 1293196 - RNA, 15 nt, Homo sapiens
uuguaugagguuuga

SEQ ID NO: 1293197 - RNA, 15 nt, Homo sapiens
aauauuuuaucuuuc

SEQ ID NO: 1293198 - RNA, 15 nt, Homo sapiens
aauauuuuccugcca

SEQ ID NO: 1293199 - RNA, 14 nt, Homo sapiens
aauauuuugcauau

SEQ ID NO: 1293200 - RNA, 22 nt, Homo sapiens
aauauuuuggcauuguacuaau

SEQ ID NO: 1293201 - RNA, 20 nt, Homo sapiens
aauauuuuucuguaguguga

SEQ ID NO: 1293202 - RNA, 22 nt, Homo sapiens
aaucaaguauuugggaagugaa

SEQ ID NO: 1293203 - RNA, 21 nt, Homo sapiens
aaucaaguucuagcauuuuag

SEQ ID NO: 1293204 - RNA, 23 nt, Homo sapiens
aaucaccacaaacuguaauacaa

SEQ ID NO: 1293205 - RNA, 13 nt, Homo sapiens
aaucaccacucaa

SEQ ID NO: 1293206 - RNA, 14 nt, Homo sapiens
aaucacggcucacu

SEQ ID NO: 1293207 - RNA, 18 nt, Homo sapiens
aaucacuucugagaacuc

SEQ ID NO: 1293208 - RNA, 14 nt, Homo sapiens
aaucagaucauuuc

SEQ ID NO: 1293209 - RNA, 15 nt, Homo sapiens
aaucagaucauuuca

SEQ ID NO: 1293210 - RNA, 15 nt, Homo sapiens
aaucagccacauucu

SEQ ID NO: 1293211 - RNA, 20 nt, Homo sapiens
aaucagugaagccaaaggga

SEQ ID NO: 1293212 - RNA, 21 nt, Homo sapiens
aaucagugaagccaaagggac

SEQ ID NO: 1293213 - RNA, 13 nt, Homo sapiens
aaucauaaauauu

SEQ ID NO: 1293214 - RNA, 21 nt, Homo sapiens
aaucauuuguuuacauuugau

SEQ ID NO: 1293215 - RNA, 18 nt, Homo sapiens
aaucauuuucauuccuaa

SEQ ID NO: 1293216 - RNA, 15 nt, Homo sapiens
aauccaauaccucuu

SEQ ID NO: 1293217 - RNA, 20 nt, Homo sapiens
aauccaggcagauccaggac

SEQ ID NO: 1293218 - RNA, 16 nt, Homo sapiens
aaucccagcuaccuca

SEQ ID NO: 1293219 - RNA, 15 nt, Homo sapiens
aauccuagcacuuug

SEQ ID NO: 1293220 - RNA, 16 nt, Homo sapiens
aauccuagcacuuugg

SEQ ID NO: 1293221 - RNA, 16 nt, Homo sapiens
aauccuguauauuuag

SEQ ID NO: 1293222 - RNA, 22 nt, Homo sapiens
aauccuuucacccgcuccuaca

SEQ ID NO: 1293223 - RNA, 14 nt, Homo sapiens
aaucuacuaauucc

SEQ ID NO: 1293224 - RNA, 18 nt, Homo sapiens
aaucuagaagcuuaagaa

SEQ ID NO: 1293225 - RNA, 21 nt, Homo sapiens
aaucugaggcauccucugacu

SEQ ID NO: 1293226 - RNA, 12 nt, Homo sapiens
aaucugaguaua

SEQ ID NO: 1293227 - RNA, 18 nt, Homo sapiens
aaucuguguaaacacagg

SEQ ID NO: 1293228 - RNA, 16 nt, Homo sapiens
aaucuuacaacaggcu

SEQ ID NO: 1293229 - RNA, 13 nt, Homo sapiens
aaucuuaugcucu

SEQ ID NO: 1293230 - RNA, 21 nt, Homo sapiens
aaucuuccuuuguugcacaaa

SEQ ID NO: 1293231 - RNA, 20 nt, Homo sapiens
aaucuugcucugcuugacaa

SEQ ID NO: 1293232 - RNA, 16 nt, Homo sapiens
aaucuuguacauuaua

SEQ ID NO: 1293233 - RNA, 16 nt, Homo sapiens
aaucuuucaaaccagc

SEQ ID NO: 1293234 - RNA, 15 nt, Homo sapiens
aaugaaacacuuuca

SEQ ID NO: 1293235 - RNA, 16 nt, Homo sapiens
aaugaaacacuuucag

SEQ ID NO: 1293236 - RNA, 12 nt, Homo sapiens
aaugaaccacug

SEQ ID NO: 1293237 - RNA, 13 nt, Homo sapiens
aaugaaccuucug

SEQ ID NO: 1293238 - RNA, 16 nt, Homo sapiens
aaugaaccuucuggcc

SEQ ID NO: 1293239 - RNA, 14 nt, Homo sapiens
aaugaauacuuuau

SEQ ID NO: 1293240 - RNA, 22 nt, Homo sapiens
aaugacacuagcuaauaucaau

SEQ ID NO: 1293241 - RNA, 19 nt, Homo sapiens
aaugacuaaaaaacaaaga

SEQ ID NO: 1293242 - RNA, 13 nt, Homo sapiens
aaugagcauugau

SEQ ID NO: 1293243 - RNA, 13 nt, Homo sapiens
aaugagccuuaag

SEQ ID NO: 1293244 - RNA, 12 nt, Homo sapiens
aaugagugcuua

SEQ ID NO: 1293245 - RNA, 14 nt, Homo sapiens
aaugaugcucaaaa

SEQ ID NO: 1293246 - RNA, 17 nt, Homo sapiens
aaugcaagagaacauuu

SEQ ID NO: 1293247 - RNA, 22 nt, Homo sapiens
aaugcagacaaacaaacauaaa

SEQ ID NO: 1293248 - RNA, 16 nt, Homo sapiens
aaugcagucuguccag

SEQ ID NO: 1293249 - RNA, 15 nt, Homo sapiens
aaugcaucucaucaa

SEQ ID NO: 1293250 - RNA, 17 nt, Homo sapiens
aaugcauuauggguggu

SEQ ID NO: 1293251 - RNA, 19 nt, Homo sapiens
aaugcauuucuaaagccau

SEQ ID NO: 1293252 - RNA, 11 nt, Homo sapiens
aaugcucucuc

SEQ ID NO: 1293253 - RNA, 17 nt, Homo sapiens
aaugcugagguuaugaa

SEQ ID NO: 1293254 - RNA, 16 nt, Homo sapiens
aaugcugauguccuca

SEQ ID NO: 1293255 - RNA, 20 nt, Homo sapiens
aaugcugcaggacuugagaa

SEQ ID NO: 1293256 - RNA, 12 nt, Homo sapiens
aauggaaccagg

SEQ ID NO: 1293257 - RNA, 12 nt, Homo sapiens
aauggauccuca

SEQ ID NO: 1293258 - RNA, 13 nt, Homo sapiens
aauggauccucau

SEQ ID NO: 1293259 - RNA, 15 nt, Homo sapiens
aauggcacugagaaa

SEQ ID NO: 1293260 - RNA, 14 nt, Homo sapiens
aauggcuccuucac

SEQ ID NO: 1293261 - RNA, 16 nt, Homo sapiens
aaugggcaauuccaga

SEQ ID NO: 1293262 - RNA, 12 nt, Homo sapiens
aauggggccaga

SEQ ID NO: 1293263 - RNA, 15 nt, Homo sapiens
aaugguuccauucuc

SEQ ID NO: 1293264 - RNA, 23 nt, Homo sapiens
aaugguuuuaauguucuuuugac

SEQ ID NO: 1293265 - RNA, 13 nt, Homo sapiens
aauguaaacauuu

SEQ ID NO: 1293266 - RNA, 15 nt, Homo sapiens
aauguaaagccaugc

SEQ ID NO: 1293267 - RNA, 17 nt, Homo sapiens
aauguaacugugccagu

SEQ ID NO: 1293268 - RNA, 19 nt, Homo sapiens
aauguaauagccaaaccca

SEQ ID NO: 1293269 - RNA, 17 nt, Homo sapiens
aauguacagacauauuu

SEQ ID NO: 1293270 - RNA, 18 nt, Homo sapiens
aauguauugagcauguga

SEQ ID NO: 1293271 - RNA, 19 nt, Homo sapiens
aaugucaauucuugccaaa

SEQ ID NO: 1293272 - RNA, 14 nt, Homo sapiens
aaugucccauuuca

SEQ ID NO: 1293273 - RNA, 22 nt, Homo sapiens
aaugucuuuuuucaaacuuuau

SEQ ID NO: 1293274 - RNA, 20 nt, Homo sapiens
aaugugacauuauaugcacu

SEQ ID NO: 1293275 - RNA, 13 nt, Homo sapiens
aauguuagcaguu

SEQ ID NO: 1293276 - RNA, 17 nt, Homo sapiens
aauguuggauaaggaau

SEQ ID NO: 1293277 - RNA, 16 nt, Homo sapiens
aauguuuuaacucuuu

SEQ ID NO: 1293278 - RNA, 15 nt, Homo sapiens
aauguuuuguaaaua

SEQ ID NO: 1293279 - RNA, 17 nt, Homo sapiens
aauuaaaaaagcauacu

SEQ ID NO: 1293280 - RNA, 23 nt, Homo sapiens
aauuaaaccagauuggagcaauu

SEQ ID NO: 1293281 - RNA, 22 nt, Homo sapiens
aauuaaagugaauuguugacaa

SEQ ID NO: 1293282 - RNA, 11 nt, Homo sapiens
ucuggacaaag

SEQ ID NO: 1293283 - RNA, 21 nt, Homo sapiens
ucuggaggacggucaguccau

SEQ ID NO: 1293284 - RNA, 21 nt, Homo sapiens
ucuggauggccaaacccaaga

SEQ ID NO: 1293285 - RNA, 17 nt, Homo sapiens
ucuggauggugugccuu

SEQ ID NO: 1293286 - RNA, 17 nt, Homo sapiens
ucuggcaccaaagucca

SEQ ID NO: 1293287 - RNA, 20 nt, Homo sapiens
ucuggcagccucccauccag

SEQ ID NO: 1293288 - RNA, 14 nt, Homo sapiens
ucuggcagguccuc

SEQ ID NO: 1293289 - RNA, 15 nt, Homo sapiens
ucuggcccaguuaau

SEQ ID NO: 1293290 - RNA, 19 nt, Homo sapiens
ucuggccguugauguuggc

SEQ ID NO: 1293291 - RNA, 13 nt, Homo sapiens
ucugggaagccaa

SEQ ID NO: 1293292 - RNA, 20 nt, Homo sapiens
ucugggcucaagcaauccuc

SEQ ID NO: 1293293 - RNA, 20 nt, Homo sapiens
ucugggcuuggggcuuccua

SEQ ID NO: 1293294 - RNA, 19 nt, Homo sapiens
ucuggggaaaggggacaag

SEQ ID NO: 1293295 - RNA, 16 nt, Homo sapiens
ucugguagccugcaga

SEQ ID NO: 1293296 - RNA, 16 nt, Homo sapiens
ucuggucgcuccugcc

SEQ ID NO: 1293297 - RNA, 23 nt, Homo sapiens
ucuguaaaaagaucccugagauu

SEQ ID NO: 1293298 - RNA, 14 nt, Homo sapiens
ucuguagggccacc

SEQ ID NO: 1293299 - RNA, 15 nt, Homo sapiens
ucuguaucugccaug

SEQ ID NO: 1293300 - RNA, 23 nt, Homo sapiens
ucuguauuaaaauuagaaucuga

SEQ ID NO: 1293301 - RNA, 17 nt, Homo sapiens
ucugucagucacagcca

SEQ ID NO: 1293302 - RNA, 17 nt, Homo sapiens
ucugucauccucaggaa

SEQ ID NO: 1293303 - RNA, 21 nt, Homo sapiens
ucugucccagguuaucugggc

SEQ ID NO: 1293304 - RNA, 22 nt, Homo sapiens
ucugugcaaauccuugauacug

SEQ ID NO: 1293305 - RNA, 21 nt, Homo sapiens
ucugugcucaggacucagaag

SEQ ID NO: 1293306 - RNA, 19 nt, Homo sapiens
ucuguggauuggccuuuaa

SEQ ID NO: 1293307 - RNA, 17 nt, Homo sapiens
ucuguuggccaguguga

SEQ ID NO: 1293308 - RNA, 14 nt, Homo sapiens
ucuuaacaaacucu

SEQ ID NO: 1293309 - RNA, 16 nt, Homo sapiens
ucuuagaaaaaccacc

SEQ ID NO: 1293310 - RNA, 16 nt, Homo sapiens
ucuuaggugcgcagug

SEQ ID NO: 1293311 - RNA, 22 nt, Homo sapiens
ucuuaguuacuuuggaacacua

SEQ ID NO: 1293312 - RNA, 21 nt, Homo sapiens
ucuuauccuagcacaugcuuc

SEQ ID NO: 1293313 - RNA, 22 nt, Homo sapiens
ucuucaaaugccugacuaggga

SEQ ID NO: 1293314 - RNA, 18 nt, Homo sapiens
ucuucaagacgacagcuc

SEQ ID NO: 1293315 - RNA, 21 nt, Homo sapiens
ucuucaaggcuucagucucau

SEQ ID NO: 1293316 - RNA, 24 nt, Homo sapiens
ucuucaccauuuggcaaugccauc

SEQ ID NO: 1293317 - RNA, 16 nt, Homo sapiens
ucuucagagcugacac

SEQ ID NO: 1293318 - RNA, 18 nt, Homo sapiens
ucuucccccuuucuaaaa

SEQ ID NO: 1293319 - RNA, 19 nt, Homo sapiens
ucuucccuuuuaaacacau

SEQ ID NO: 1293320 - RNA, 22 nt, Homo sapiens
ucuuccuggcuccaacacugcu

SEQ ID NO: 1293321 - RNA, 19 nt, Homo sapiens
ucuuccuuuuugguuuuua

SEQ ID NO: 1293322 - RNA, 15 nt, Homo sapiens
ucuucuaaacuuccc

SEQ ID NO: 1293323 - RNA, 18 nt, Homo sapiens
ucuucuccuggaguugca

SEQ ID NO: 1293324 - RNA, 15 nt, Homo sapiens
ucuucugagcacaga

SEQ ID NO: 1293325 - RNA, 18 nt, Homo sapiens
ucuucuuucagacuugcc

SEQ ID NO: 1293326 - RNA, 17 nt, Homo sapiens
ucuugaugcaugcacug

SEQ ID NO: 1293327 - RNA, 15 nt, Homo sapiens
ucuugcaacucugua

SEQ ID NO: 1293328 - RNA, 20 nt, Homo sapiens
ucuuggccggauguccucag

SEQ ID NO: 1293329 - RNA, 14 nt, Homo sapiens
ucuuggcucugaga

SEQ ID NO: 1293330 - RNA, 15 nt, Homo sapiens
ucuuggucacauaca

SEQ ID NO: 1293331 - RNA, 21 nt, Homo sapiens
ucuuguaguaagaaacaucca

SEQ ID NO: 1293332 - RNA, 22 nt, Homo sapiens
ucuuguccugguccuggccaca

SEQ ID NO: 1293333 - RNA, 16 nt, Homo sapiens
ucuuguguuaccugaa

SEQ ID NO: 1293334 - RNA, 18 nt, Homo sapiens
ucuuguuauugaaguguu

SEQ ID NO: 1293335 - RNA, 19 nt, Homo sapiens
ucuuguucugagauucaau

SEQ ID NO: 1293336 - RNA, 18 nt, Homo sapiens
ucuuguugcuuuguugca

SEQ ID NO: 1293337 - RNA, 14 nt, Homo sapiens
ucuuuaagaugugu

SEQ ID NO: 1293338 - RNA, 17 nt, Homo sapiens
ucuuuaaugucacaggc

SEQ ID NO: 1293339 - RNA, 19 nt, Homo sapiens
ucuuuagccagaaucucau

SEQ ID NO: 1293340 - RNA, 14 nt, Homo sapiens
ucuuuagugucuga

SEQ ID NO: 1293341 - RNA, 20 nt, Homo sapiens
ucuuuaugucuuuugaugaa

SEQ ID NO: 1293342 - RNA, 21 nt, Homo sapiens
ucuuuauuuuuguuaauauua

SEQ ID NO: 1293343 - RNA, 20 nt, Homo sapiens
ucuuucacauuguuugcugc

SEQ ID NO: 1293344 - RNA, 17 nt, Homo sapiens
ucuuucaugugugccaa

SEQ ID NO: 1293345 - RNA, 14 nt, Homo sapiens
ucuuucccaaaauu

SEQ ID NO: 1293346 - RNA, 12 nt, Homo sapiens
ucuuuccuagau

SEQ ID NO: 1293347 - RNA, 17 nt, Homo sapiens
ucuuucgucuacugcaa

SEQ ID NO: 1293348 - RNA, 17 nt, Homo sapiens
ucuuucuuacaaggaag

SEQ ID NO: 1293349 - RNA, 14 nt, Homo sapiens
ucuuucuuguuuca

SEQ ID NO: 1293350 - RNA, 15 nt, Homo sapiens
ucuuuguuucugcuu

SEQ ID NO: 1293351 - RNA, 16 nt, Homo sapiens
ucuuuuacauucugca

SEQ ID NO: 1293352 - RNA, 13 nt, Homo sapiens
ucuuuugccauua

SEQ ID NO: 1293353 - RNA, 14 nt, Homo sapiens
ugaaaaaaaaaugg

SEQ ID NO: 1293354 - RNA, 16 nt, Homo sapiens
ugaaaaacuaugucag

SEQ ID NO: 1293355 - RNA, 14 nt, Homo sapiens
ugaaaaauguauau

SEQ ID NO: 1293356 - RNA, 16 nt, Homo sapiens
ugaaaaccucuccuca

SEQ ID NO: 1293357 - RNA, 20 nt, Homo sapiens
ugaaaagagaaugaugcuca

SEQ ID NO: 1293358 - RNA, 23 nt, Homo sapiens
ugaaaaggguguuagcuaaagga

SEQ ID NO: 1293359 - RNA, 19 nt, Homo sapiens
ugaaacagcugcccugugu

SEQ ID NO: 1293360 - RNA, 22 nt, Homo sapiens
ugaaacccuggaccaguggucu

SEQ ID NO: 1293361 - RNA, 16 nt, Homo sapiens
ugaaacccuguaucua

SEQ ID NO: 1293362 - RNA, 19 nt, Homo sapiens
ugaaaccuacacacuguca

SEQ ID NO: 1293363 - RNA, 15 nt, Homo sapiens
ugaaacuuauaguua

SEQ ID NO: 1293364 - RNA, 22 nt, Homo sapiens
ugaaagaggacguguuacccac

SEQ ID NO: 1293365 - RNA, 17 nt, Homo sapiens
ugaaagccacagacaau

SEQ ID NO: 1293366 - RNA, 13 nt, Homo sapiens
ugaaaguggacaa

SEQ ID NO: 1293367 - RNA, 23 nt, Homo sapiens
ugaaaguucagauuguguuacuc

SEQ ID NO: 1293368 - RNA, 20 nt, Homo sapiens
ugaaauaaaauuacacagua

SEQ ID NO: 1293369 - RNA, 12 nt, Homo sapiens
ugaaauaugcau

SEQ ID NO: 1293370 - RNA, 14 nt, Homo sapiens
ugaaauaugugaag

SEQ ID NO: 1293371 - RNA, 17 nt, Homo sapiens
ugaaauguaugugcucu

SEQ ID NO: 1293372 - RNA, 23 nt, Homo sapiens
ugaaauguaugugcucuuagcaa

SEQ ID NO: 1293373 - RNA, 21 nt, Homo sapiens
ugaaauugauguuacuguaua

SEQ ID NO: 1293374 - RNA, 18 nt, Homo sapiens
ugaaauuugagagacaaa

SEQ ID NO: 1293375 - RNA, 18 nt, Homo sapiens
ugaacaagcaaacccaga

SEQ ID NO: 1293376 - RNA, 19 nt, Homo sapiens
ugaacagucacgccugaaa

SEQ ID NO: 1293377 - RNA, 12 nt, Homo sapiens
ugaacccacugc

SEQ ID NO: 1293378 - RNA, 15 nt, Homo sapiens
ugaacccacugcugc

SEQ ID NO: 1293379 - RNA, 23 nt, Homo sapiens
ugaaccuauuucuuaaacacuug

SEQ ID NO: 1293380 - RNA, 16 nt, Homo sapiens
ugaacuggucuuccuu

SEQ ID NO: 1293381 - RNA, 18 nt, Homo sapiens
ugaacuguggggugugca

SEQ ID NO: 1293382 - RNA, 21 nt, Homo sapiens
ugaacuuggaaagaaaugccc

SEQ ID NO: 1293383 - RNA, 24 nt, Homo sapiens
ugaacuuggaaagaaaugcccauc

SEQ ID NO: 1293384 - RNA, 20 nt, Homo sapiens
ugaacuuugggaagccuuua

SEQ ID NO: 1293385 - RNA, 16 nt, Homo sapiens
ugaagacuuaaaagag

SEQ ID NO: 1293386 - RNA, 16 nt, Homo sapiens
ugaagagaguugcuuu

SEQ ID NO: 1293387 - RNA, 12 nt, Homo sapiens
ugaagagcuaau

SEQ ID NO: 1293388 - RNA, 15 nt, Homo sapiens
ugaagaguccucuga

SEQ ID NO: 1293389 - RNA, 19 nt, Homo sapiens
ugaagaguccucugaauga

SEQ ID NO: 1293390 - RNA, 21 nt, Homo sapiens
ugaagauaguaacuguagaug

SEQ ID NO: 1293391 - RNA, 20 nt, Homo sapiens
ugaagcaacagagaggaaau

SEQ ID NO: 1293392 - RNA, 10 nt, Homo sapiens
ugaagcacaa

SEQ ID NO: 1293393 - RNA, 23 nt, Homo sapiens
ugaagcauaccccggccucucag

SEQ ID NO: 1293394 - RNA, 15 nt, Homo sapiens
ugaagccaaagccaa

SEQ ID NO: 1293395 - RNA, 21 nt, Homo sapiens
ugaagccaauucagacaggca

SEQ ID NO: 1293396 - RNA, 15 nt, Homo sapiens
ugaagucacacagug

SEQ ID NO: 1293397 - RNA, 22 nt, Homo sapiens
ugaagugcucacuacucaguga

SEQ ID NO: 1293398 - RNA, 16 nt, Homo sapiens
ugaagugcuguggcug

SEQ ID NO: 1293399 - RNA, 15 nt, Homo sapiens
ugaaguuuccuuggc

SEQ ID NO: 1293400 - RNA, 13 nt, Homo sapiens
ugaauagcuuaug

SEQ ID NO: 1293401 - RNA, 18 nt, Homo sapiens
ugaauauaucccaugggu

SEQ ID NO: 1293402 - RNA, 16 nt, Homo sapiens
ugaaucccgacucuga

SEQ ID NO: 1293403 - RNA, 13 nt, Homo sapiens
ugaauuacccuuu

SEQ ID NO: 1293404 - RNA, 20 nt, Homo sapiens
ugaauuauuuccugcuuauu

SEQ ID NO: 1293405 - RNA, 22 nt, Homo sapiens
ugaauucggaacuguccuuucc

SEQ ID NO: 1293406 - RNA, 13 nt, Homo sapiens
ugaauugccaggg

SEQ ID NO: 1293407 - RNA, 15 nt, Homo sapiens
ugacaagaauuguua

SEQ ID NO: 1293408 - RNA, 18 nt, Homo sapiens
ugacacaaguggaccuua

SEQ ID NO: 1293409 - RNA, 12 nt, Homo sapiens
ugacacacagcu

SEQ ID NO: 1293410 - RNA, 14 nt, Homo sapiens
ugacaccuuucaua

SEQ ID NO: 1293411 - RNA, 16 nt, Homo sapiens
ugacagacacaggccc

SEQ ID NO: 1293412 - RNA, 12 nt, Homo sapiens
ugacagccagag

SEQ ID NO: 1293413 - RNA, 17 nt, Homo sapiens
ugacagccagagccugu

SEQ ID NO: 1293414 - RNA, 14 nt, Homo sapiens
ugacaggcaaugcu

SEQ ID NO: 1293415 - RNA, 15 nt, Homo sapiens
ugacauaauuuacau

SEQ ID NO: 1293416 - RNA, 19 nt, Homo sapiens
uccuuuuuuaaaaaugcaa

SEQ ID NO: 1293417 - RNA, 18 nt, Homo sapiens
ucgaaaccugggauucag

SEQ ID NO: 1293418 - RNA, 17 nt, Homo sapiens
ucgaaauacaagccauu

SEQ ID NO: 1293419 - RNA, 17 nt, Homo sapiens
ucgaaucucugugccuu

SEQ ID NO: 1293420 - RNA, 20 nt, Homo sapiens
ucgagauggcagauucccac

SEQ ID NO: 1293421 - RNA, 14 nt, Homo sapiens
ucgaggccugaagc

SEQ ID NO: 1293422 - RNA, 23 nt, Homo sapiens
ucgaugauucaggugcagaggaa

SEQ ID NO: 1293423 - RNA, 13 nt, Homo sapiens
ucgcaagagccau

SEQ ID NO: 1293424 - RNA, 20 nt, Homo sapiens
ucgcaguguucaaggccauc

SEQ ID NO: 1293425 - RNA, 21 nt, Homo sapiens
ucgcccugcgguagaugggag

SEQ ID NO: 1293426 - RNA, 23 nt, Homo sapiens
ucgcuaccuuuugcuguggcaaa

SEQ ID NO: 1293427 - RNA, 17 nt, Homo sapiens
ucgcugucccccaacac

SEQ ID NO: 1293428 - RNA, 13 nt, Homo sapiens
ucgcuucuugccu

SEQ ID NO: 1293429 - RNA, 14 nt, Homo sapiens
ucgcuucuugccuc

SEQ ID NO: 1293430 - RNA, 17 nt, Homo sapiens
ucgcuugcuagaaguag

SEQ ID NO: 1293431 - RNA, 23 nt, Homo sapiens
ucggacaagacccccagcacuug

SEQ ID NO: 1293432 - RNA, 20 nt, Homo sapiens
ucggagaaacgggugagcug

SEQ ID NO: 1293433 - RNA, 22 nt, Homo sapiens
ucgggaggcugaggcggaagaa

SEQ ID NO: 1293434 - RNA, 18 nt, Homo sapiens
ucgggauaaaacagcauu

SEQ ID NO: 1293435 - RNA, 23 nt, Homo sapiens
ucgugauuggaaacucaccaucg

SEQ ID NO: 1293436 - RNA, 13 nt, Homo sapiens
ucgugcuguagag

SEQ ID NO: 1293437 - RNA, 16 nt, Homo sapiens
ucguuuggaucuguga

SEQ ID NO: 1293438 - RNA, 12 nt, Homo sapiens
ucuaaaagacuu

SEQ ID NO: 1293439 - RNA, 14 nt, Homo sapiens
ucuaaacagacuca

SEQ ID NO: 1293440 - RNA, 14 nt, Homo sapiens
ucuaauaaacuugg

SEQ ID NO: 1293441 - RNA, 14 nt, Homo sapiens
ucuaauauggccac

SEQ ID NO: 1293442 - RNA, 18 nt, Homo sapiens
ucuacaggccagcaccuu

SEQ ID NO: 1293443 - RNA, 19 nt, Homo sapiens
ucuacuaagugaugcugug

SEQ ID NO: 1293444 - RNA, 12 nt, Homo sapiens
ucuacuaauucc

SEQ ID NO: 1293445 - RNA, 21 nt, Homo sapiens
ucuacuacaaacuucaaagag

SEQ ID NO: 1293446 - RNA, 16 nt, Homo sapiens
ucuacuucugcccuug

SEQ ID NO: 1293447 - RNA, 18 nt, Homo sapiens
ucuagacaacuaccccuu

SEQ ID NO: 1293448 - RNA, 15 nt, Homo sapiens
ucuagagacaacaaa

SEQ ID NO: 1293449 - RNA, 23 nt, Homo sapiens
ucuagauacaauaaauugcuaau

SEQ ID NO: 1293450 - RNA, 16 nt, Homo sapiens
ucuaggcaacauagua

SEQ ID NO: 1293451 - RNA, 20 nt, Homo sapiens
ucuaggcuggggaaguccuc

SEQ ID NO: 1293452 - RNA, 16 nt, Homo sapiens
ucuaggucacuucuca

SEQ ID NO: 1293453 - RNA, 14 nt, Homo sapiens
ucuaggugcccuug

SEQ ID NO: 1293454 - RNA, 14 nt, Homo sapiens
ucuaggugcuuucc

SEQ ID NO: 1293455 - RNA, 21 nt, Homo sapiens
ucuaguuuuaugcgacagcuu

SEQ ID NO: 1293456 - RNA, 12 nt, Homo sapiens
ucuauaucauga

SEQ ID NO: 1293457 - RNA, 19 nt, Homo sapiens
ucuaugcuggauaagaaau

SEQ ID NO: 1293458 - RNA, 18 nt, Homo sapiens
ucuaugggacucaaugca

SEQ ID NO: 1293459 - RNA, 13 nt, Homo sapiens
ucuauuacagcuu

SEQ ID NO: 1293460 - RNA, 15 nt, Homo sapiens
ucuauuccaguauuu

SEQ ID NO: 1293461 - RNA, 21 nt, Homo sapiens
ucuauuuuaagacugauuuua

SEQ ID NO: 1293462 - RNA, 16 nt, Homo sapiens
ucucaaacuacuggca

SEQ ID NO: 1293463 - RNA, 17 nt, Homo sapiens
ucucaaagaaggcauuu

SEQ ID NO: 1293464 - RNA, 18 nt, Homo sapiens
ucucacaguguugcccag

SEQ ID NO: 1293465 - RNA, 20 nt, Homo sapiens
ucucacggcuuguaaaugug

SEQ ID NO: 1293466 - RNA, 15 nt, Homo sapiens
ucucacuauaccagu

SEQ ID NO: 1293467 - RNA, 16 nt, Homo sapiens
ucucacuguugcccag

SEQ ID NO: 1293468 - RNA, 16 nt, Homo sapiens
ucucagaauccaaaga

SEQ ID NO: 1293469 - RNA, 17 nt, Homo sapiens
ucucagcacuaugacau

SEQ ID NO: 1293470 - RNA, 23 nt, Homo sapiens
ucucagccccugauccugugaag

SEQ ID NO: 1293471 - RNA, 19 nt, Homo sapiens
ucucaggaccaaagcuuuc

SEQ ID NO: 1293472 - RNA, 20 nt, Homo sapiens
ucucaggaccaaagcuuuca

SEQ ID NO: 1293473 - RNA, 19 nt, Homo sapiens
ucucaggagcuugcaagaa

SEQ ID NO: 1293474 - RNA, 21 nt, Homo sapiens
ucucauagguugagcaauuuc

SEQ ID NO: 1293475 - RNA, 14 nt, Homo sapiens
ucucaucaguccau

SEQ ID NO: 1293476 - RNA, 22 nt, Homo sapiens
ucucauccuccaguaccuugcu

SEQ ID NO: 1293477 - RNA, 22 nt, Homo sapiens
ucucaucgaauaagacucauca

SEQ ID NO: 1293478 - RNA, 14 nt, Homo sapiens
ucucaucugugauu

SEQ ID NO: 1293479 - RNA, 16 nt, Homo sapiens
ucucaucuuucuugau

SEQ ID NO: 1293480 - RNA, 18 nt, Homo sapiens
ucucauuacugcuucauu

SEQ ID NO: 1293481 - RNA, 15 nt, Homo sapiens
ucucauuauucacag

SEQ ID NO: 1293482 - RNA, 20 nt, Homo sapiens
ucuccaagugcggcacugca

SEQ ID NO: 1293483 - RNA, 18 nt, Homo sapiens
ucuccacggccugcccag

SEQ ID NO: 1293484 - RNA, 12 nt, Homo sapiens
ucuccacugcuc

SEQ ID NO: 1293485 - RNA, 22 nt, Homo sapiens
ucuccagcuucccgaguaccag

SEQ ID NO: 1293486 - RNA, 13 nt, Homo sapiens
ucuccaggcauuu

SEQ ID NO: 1293487 - RNA, 22 nt, Homo sapiens
ucuccaggcauuuagcccucac

SEQ ID NO: 1293488 - RNA, 16 nt, Homo sapiens
ucucccaccaccucac

SEQ ID NO: 1293489 - RNA, 13 nt, Homo sapiens
ucucccaucucuu

SEQ ID NO: 1293490 - RNA, 17 nt, Homo sapiens
ucuccccagcccagaga

SEQ ID NO: 1293491 - RNA, 18 nt, Homo sapiens
ucuccccagcccagagac

SEQ ID NO: 1293492 - RNA, 19 nt, Homo sapiens
ucucccuccccugccauuu

SEQ ID NO: 1293493 - RNA, 23 nt, Homo sapiens
ucucccuguuggucgguggguug

SEQ ID NO: 1293494 - RNA, 18 nt, Homo sapiens
ucuccuacuaugcaauuu

SEQ ID NO: 1293495 - RNA, 12 nt, Homo sapiens
ucuccuccgugg

SEQ ID NO: 1293496 - RNA, 23 nt, Homo sapiens
ucuccugcgcccuucauugccac

SEQ ID NO: 1293497 - RNA, 16 nt, Homo sapiens
ucuccuggaguugcau

SEQ ID NO: 1293498 - RNA, 15 nt, Homo sapiens
ucuccugugcauugu

SEQ ID NO: 1293499 - RNA, 19 nt, Homo sapiens
ucucgaacuccuaaccuca

SEQ ID NO: 1293500 - RNA, 12 nt, Homo sapiens
ucucgcuuuguu

SEQ ID NO: 1293501 - RNA, 15 nt, Homo sapiens
ucucgggcacaggcc

SEQ ID NO: 1293502 - RNA, 15 nt, Homo sapiens
ucucgguuugccaaa

SEQ ID NO: 1293503 - RNA, 22 nt, Homo sapiens
ucucuaacagcucaggaucucu

SEQ ID NO: 1293504 - RNA, 19 nt, Homo sapiens
ucucuaacccuuucaaaag

SEQ ID NO: 1293505 - RNA, 16 nt, Homo sapiens
ucucuaacucagaaac

SEQ ID NO: 1293506 - RNA, 15 nt, Homo sapiens
ucucuagaagugcca

SEQ ID NO: 1293507 - RNA, 11 nt, Homo sapiens
ucucucucuuu

SEQ ID NO: 1293508 - RNA, 11 nt, Homo sapiens
ucucucugauc

SEQ ID NO: 1293509 - RNA, 17 nt, Homo sapiens
ucucucuugucaaguca

SEQ ID NO: 1293510 - RNA, 17 nt, Homo sapiens
ucucugcaaaccaacag

SEQ ID NO: 1293511 - RNA, 12 nt, Homo sapiens
ucucugcucugc

SEQ ID NO: 1293512 - RNA, 22 nt, Homo sapiens
ucucugucccuugcuguaugcu

SEQ ID NO: 1293513 - RNA, 13 nt, Homo sapiens
ucucugucucucu

SEQ ID NO: 1293514 - RNA, 16 nt, Homo sapiens
ucucugucucucuguc

SEQ ID NO: 1293515 - RNA, 21 nt, Homo sapiens
ucucuucuuauuacccaaacc

SEQ ID NO: 1293516 - RNA, 12 nt, Homo sapiens
ucugaaaaccaa

SEQ ID NO: 1293517 - RNA, 18 nt, Homo sapiens
ggggaauaaaagagaucu

SEQ ID NO: 1293518 - RNA, 17 nt, Homo sapiens
ggggcgaucgcggcgga

SEQ ID NO: 1293519 - RNA, 22 nt, Homo sapiens
gggggagcugcagucccaugca

SEQ ID NO: 1293520 - RNA, 20 nt, Homo sapiens
gggggcuuggcugugcccuc

SEQ ID NO: 1293521 - RNA, 11 nt, Homo sapiens
ggggggcuccc

SEQ ID NO: 1293522 - RNA, 20 nt, Homo sapiens
ggguauaguucaugucugcu

SEQ ID NO: 1293523 - RNA, 17 nt, Homo sapiens
gggucauagauguuucc

SEQ ID NO: 1293524 - RNA, 19 nt, Homo sapiens
gggucucacaguguugccc

SEQ ID NO: 1293525 - RNA, 19 nt, Homo sapiens
gggugacagagcaagugag

SEQ ID NO: 1293526 - RNA, 12 nt, Homo sapiens
ggcaacaucaac

SEQ ID NO: 1293527 - RNA, 15 nt, Homo sapiens
ggcaagagaauuacu

SEQ ID NO: 1293528 - RNA, 18 nt, Homo sapiens
ggcaauauagcaagaucc

SEQ ID NO: 1293529 - RNA, 12 nt, Homo sapiens
ggcacacagcua

SEQ ID NO: 1293530 - RNA, 19 nt, Homo sapiens
ggcacacgccucccacugg

SEQ ID NO: 1293531 - RNA, 15 nt, Homo sapiens
ggcacauagugaaag

SEQ ID NO: 1293532 - RNA, 14 nt, Homo sapiens
ggcaccaaacacug

SEQ ID NO: 1293533 - RNA, 12 nt, Homo sapiens
ggcaccagacac

SEQ ID NO: 1293534 - RNA, 11 nt, Homo sapiens
ggcacccaaga

SEQ ID NO: 1293535 - RNA, 13 nt, Homo sapiens
ggcacccaagacc

SEQ ID NO: 1293536 - RNA, 14 nt, Homo sapiens
ggcacccacccugg

SEQ ID NO: 1293537 - RNA, 17 nt, Homo sapiens
ggcaccuguaaucccag

SEQ ID NO: 1293538 - RNA, 18 nt, Homo sapiens
ggcacucagaagacacug

SEQ ID NO: 1293539 - RNA, 20 nt, Homo sapiens
ggcacucagaagacacugau

SEQ ID NO: 1293540 - RNA, 22 nt, Homo sapiens
gccuggacuagagggaccucuc

SEQ ID NO: 1293541 - RNA, 20 nt, Homo sapiens
gccuggaguguaugacugca

SEQ ID NO: 1293542 - RNA, 15 nt, Homo sapiens
gccuggcauuucaca

SEQ ID NO: 1293543 - RNA, 20 nt, Homo sapiens
gccuggccaacauggugaaa

SEQ ID NO: 1293544 - RNA, 19 nt, Homo sapiens
gccuggccaagagaccagc

SEQ ID NO: 1293545 - RNA, 20 nt, Homo sapiens
gccuggccaguauggugaaa

SEQ ID NO: 1293546 - RNA, 23 nt, Homo sapiens
gccuggggucugacaauaccucg

SEQ ID NO: 1293547 - RNA, 14 nt, Homo sapiens
gccugguggcagcu

SEQ ID NO: 1293548 - RNA, 20 nt, Homo sapiens
gccugucugugaccugcauc

SEQ ID NO: 1293549 - RNA, 23 nt, Homo sapiens
gccuguggcgccgucuccagggg

SEQ ID NO: 1293550 - RNA, 13 nt, Homo sapiens
gccuucaaacucc

SEQ ID NO: 1293551 - RNA, 13 nt, Homo sapiens
gccuucaguuuau

SEQ ID NO: 1293552 - RNA, 19 nt, Homo sapiens
gccuucaguuuauuuccac

SEQ ID NO: 1293553 - RNA, 16 nt, Homo sapiens
gccuugaaaccaccuu

SEQ ID NO: 1293554 - RNA, 12 nt, Homo sapiens
gccuuggcagcc

SEQ ID NO: 1293555 - RNA, 20 nt, Homo sapiens
gccuuggcugccuuggugca

SEQ ID NO: 1293556 - RNA, 18 nt, Homo sapiens
gccuugggggugugaugu

SEQ ID NO: 1293557 - RNA, 16 nt, Homo sapiens
gccuuucccccuguga

SEQ ID NO: 1293558 - RNA, 16 nt, Homo sapiens
gccuuugaccccagca

SEQ ID NO: 1293559 - RNA, 19 nt, Homo sapiens
gccuuugaccccagcagcu

SEQ ID NO: 1293560 - RNA, 23 nt, Homo sapiens
gccuuugaccccagcagcuugga

SEQ ID NO: 1293561 - RNA, 18 nt, Homo sapiens
gcgauucuccugccucag

SEQ ID NO: 1293562 - RNA, 18 nt, Homo sapiens
cuacuucugcccuugcca

SEQ ID NO: 1293563 - RNA, 17 nt, Homo sapiens
cuagaaauagguuaaac

SEQ ID NO: 1293564 - RNA, 21 nt, Homo sapiens
cuagaauuugggcuuggacca

SEQ ID NO: 1293565 - RNA, 15 nt, Homo sapiens
cuagagacaacaaaa

SEQ ID NO: 1293566 - RNA, 20 nt, Homo sapiens
cuagagacaacaaaaaugcu

SEQ ID NO: 1293567 - RNA, 23 nt, Homo sapiens
cuagagacgcugauccauaaaga

SEQ ID NO: 1293568 - RNA, 22 nt, Homo sapiens
cuagagagggaggcaagcccug

SEQ ID NO: 1293569 - RNA, 16 nt, Homo sapiens
cuagagcuacaggggu

SEQ ID NO: 1293570 - RNA, 14 nt, Homo sapiens
cuagauacaauaaa

SEQ ID NO: 1293571 - RNA, 23 nt, Homo sapiens
cuagauuuaaccauggcacugag

SEQ ID NO: 1293572 - RNA, 20 nt, Homo sapiens
cuagcacuuugggaggccaa

SEQ ID NO: 1293573 - RNA, 13 nt, Homo sapiens
cuagcagcaccgu

SEQ ID NO: 1293574 - RNA, 13 nt, Homo sapiens
cuagccaaauggu

SEQ ID NO: 1293575 - RNA, 18 nt, Homo sapiens
cuaggaaauccauucaca

SEQ ID NO: 1293576 - RNA, 18 nt, Homo sapiens
cuaggaagagcaggacuc

SEQ ID NO: 1293577 - RNA, 15 nt, Homo sapiens
cuaggaagugaaagg

SEQ ID NO: 1293578 - RNA, 16 nt, Homo sapiens
cuaggcagugacagug

SEQ ID NO: 1293579 - RNA, 16 nt, Homo sapiens
cuagggccaagcccag

SEQ ID NO: 1293580 - RNA, 18 nt, Homo sapiens
cuagggucuuguguugca

SEQ ID NO: 1293581 - RNA, 14 nt, Homo sapiens
cuaguuuucuuucc

SEQ ID NO: 1293582 - RNA, 19 nt, Homo sapiens
cuauaaaagcuuucugcca

SEQ ID NO: 1293583 - RNA, 14 nt, Homo sapiens
cuauaaagaucaua

SEQ ID NO: 1293584 - RNA, 18 nt, Homo sapiens
cuauaaggccauaaaaca

SEQ ID NO: 1293585 - RNA, 17 nt, Homo sapiens
cuauagguccagaaguc

SEQ ID NO: 1293586 - RNA, 18 nt, Homo sapiens
cuauauuuauacuguaua

SEQ ID NO: 1293587 - RNA, 16 nt, Homo sapiens
cuaucaguauugugaa

SEQ ID NO: 1293588 - RNA, 17 nt, Homo sapiens
cuaucaguauugugaaa

SEQ ID NO: 1293589 - RNA, 21 nt, Homo sapiens
cuaucuacuacaaacuucaaa

SEQ ID NO: 1293590 - RNA, 13 nt, Homo sapiens
cuaucugccugac

SEQ ID NO: 1293591 - RNA, 22 nt, Homo sapiens
cuaugaaaagcccacaccuaac

SEQ ID NO: 1293592 - RNA, 12 nt, Homo sapiens
cuaugagcuucu

SEQ ID NO: 1293593 - RNA, 23 nt, Homo sapiens
cuaugcaauuuuucaagagcucc

SEQ ID NO: 1293594 - RNA, 23 nt, Homo sapiens
cuaugcuggauaagaaauggugg

SEQ ID NO: 1293595 - RNA, 14 nt, Homo sapiens
cuauguuauauuga

SEQ ID NO: 1293596 - RNA, 20 nt, Homo sapiens
cuauguucaaagacugugaa

SEQ ID NO: 1293597 - RNA, 22 nt, Homo sapiens
cuauguuccgaauugagcacaa

SEQ ID NO: 1293598 - RNA, 23 nt, Homo sapiens
cuauguugccuaagcuggucuca

SEQ ID NO: 1293599 - RNA, 22 nt, Homo sapiens
cuauguuuuuguucaaagccag

SEQ ID NO: 1293600 - RNA, 14 nt, Homo sapiens
cuauuaacaugaug

SEQ ID NO: 1293601 - RNA, 12 nt, Homo sapiens
cuauuaagguga

SEQ ID NO: 1293602 - RNA, 18 nt, Homo sapiens
cuauucuugcugaugaaa

SEQ ID NO: 1293603 - RNA, 17 nt, Homo sapiens
cuauugaguggcagugu

SEQ ID NO: 1293604 - RNA, 23 nt, Homo sapiens
cuauuguggguuuuuuugaaugu

SEQ ID NO: 1293605 - RNA, 11 nt, Homo sapiens
cuauuuccauu

SEQ ID NO: 1293606 - RNA, 19 nt, Homo sapiens
cuauuucuucuacugcuau

SEQ ID NO: 1293607 - RNA, 16 nt, Homo sapiens
cuauuucuucuucaca

SEQ ID NO: 1293608 - RNA, 15 nt, Homo sapiens
cuauuuuuucuugac

SEQ ID NO: 1293609 - RNA, 11 nt, Homo sapiens
cucaaaaucuu

SEQ ID NO: 1293610 - RNA, 13 nt, Homo sapiens
cucaaaaucuuuc

SEQ ID NO: 1293611 - RNA, 19 nt, Homo sapiens
cucaaacucuuaaaaccca

SEQ ID NO: 1293612 - RNA, 20 nt, Homo sapiens
cucaaacucuugaccucagg

SEQ ID NO: 1293613 - RNA, 14 nt, Homo sapiens
cucaaaguuucaga

SEQ ID NO: 1293614 - RNA, 18 nt, Homo sapiens
cucaaaucugagggagcu

SEQ ID NO: 1293615 - RNA, 18 nt, Homo sapiens
cucaaccaaugccaaaaa

SEQ ID NO: 1293616 - RNA, 14 nt, Homo sapiens
cucaagaauuuaau

SEQ ID NO: 1293617 - RNA, 16 nt, Homo sapiens
cucaaggaaaggccug

SEQ ID NO: 1293618 - RNA, 12 nt, Homo sapiens
cucaauccugca

SEQ ID NO: 1293619 - RNA, 23 nt, Homo sapiens
cucaaucuacaggccagcaccuu

SEQ ID NO: 1293620 - RNA, 17 nt, Homo sapiens
cucaaugaaauauguga

SEQ ID NO: 1293621 - RNA, 16 nt, Homo sapiens
cucacaagcaugaagu

SEQ ID NO: 1293622 - RNA, 23 nt, Homo sapiens
cucacaaugucccuucagcaccu

SEQ ID NO: 1293623 - RNA, 16 nt, Homo sapiens
cucacacuuacuguaa

SEQ ID NO: 1293624 - RNA, 20 nt, Homo sapiens
cucacagagugcauugugag

SEQ ID NO: 1293625 - RNA, 21 nt, Homo sapiens
cucacagagugcauugugagg

SEQ ID NO: 1293626 - RNA, 14 nt, Homo sapiens
cucacaguguugcc

SEQ ID NO: 1293627 - RNA, 13 nt, Homo sapiens
ccuguucuuuuaa

SEQ ID NO: 1293628 - RNA, 18 nt, Homo sapiens
ccuguuguaacugcccaa

SEQ ID NO: 1293629 - RNA, 16 nt, Homo sapiens
ccuguuucccacccag

SEQ ID NO: 1293630 - RNA, 21 nt, Homo sapiens
ccuguuucuaccuauaugcag

SEQ ID NO: 1293631 - RNA, 16 nt, Homo sapiens
ccuguuugaaaccaag

SEQ ID NO: 1293632 - RNA, 15 nt, Homo sapiens
ccuguuuuuuugcuu

SEQ ID NO: 1293633 - RNA, 20 nt, Homo sapiens
ccuuaacacugagcugucau

SEQ ID NO: 1293634 - RNA, 14 nt, Homo sapiens
ccuuacaguaggag

SEQ ID NO: 1293635 - RNA, 15 nt, Homo sapiens
ccuuacuaugaucuc

SEQ ID NO: 1293636 - RNA, 23 nt, Homo sapiens
ccuuagauguucuaagucuuucc

SEQ ID NO: 1293637 - RNA, 16 nt, Homo sapiens
ccuuagccaugaucug

SEQ ID NO: 1293638 - RNA, 20 nt, Homo sapiens
ccuuaguuauaauucugugu

SEQ ID NO: 1293639 - RNA, 14 nt, Homo sapiens
ccuuaucaccugcc

SEQ ID NO: 1293640 - RNA, 19 nt, Homo sapiens
ccuuauuaauacaaacaca

SEQ ID NO: 1293641 - RNA, 21 nt, Homo sapiens
ccuucacagaugccuacuuuu

SEQ ID NO: 1293642 - RNA, 16 nt, Homo sapiens
ccuucagacacccuca

SEQ ID NO: 1293643 - RNA, 17 nt, Homo sapiens
ccuucaguuuauuucca

SEQ ID NO: 1293644 - RNA, 17 nt, Homo sapiens
ccuucaugaucaucaca

SEQ ID NO: 1293645 - RNA, 15 nt, Homo sapiens
ccuucccaugaccca

SEQ ID NO: 1293646 - RNA, 20 nt, Homo sapiens
ccuuccccacuucugugcca

SEQ ID NO: 1293647 - RNA, 23 nt, Homo sapiens
ccuuccccuccucucuccaggga

SEQ ID NO: 1293648 - RNA, 14 nt, Homo sapiens
ccuuccuccugggc

SEQ ID NO: 1293649 - RNA, 18 nt, Homo sapiens
ccuucggguuggcaaaau

SEQ ID NO: 1293650 - RNA, 22 nt, Homo sapiens
ccuucuaggucacuucucacaa

SEQ ID NO: 1293651 - RNA, 14 nt, Homo sapiens
ccuucucucaucuc

SEQ ID NO: 1293652 - RNA, 23 nt, Homo sapiens
ccuucugcucagcucugggccau

SEQ ID NO: 1293653 - RNA, 11 nt, Homo sapiens
ccuugagaaac

SEQ ID NO: 1293654 - RNA, 20 nt, Homo sapiens
ccuugcauccaucugggcua

SEQ ID NO: 1293655 - RNA, 20 nt, Homo sapiens
ccuugcgauucugcagccac

SEQ ID NO: 1293656 - RNA, 23 nt, Homo sapiens
ccuuggaggacccagcacugacc

SEQ ID NO: 1293657 - RNA, 21 nt, Homo sapiens
ccuuggcaguggacucagaaa

SEQ ID NO: 1293658 - RNA, 14 nt, Homo sapiens
ccuuguugaugugg

SEQ ID NO: 1293659 - RNA, 21 nt, Homo sapiens
ccuuuaagccugcauucuuaa

SEQ ID NO: 1293660 - RNA, 12 nt, Homo sapiens
ccuuuaccccau

SEQ ID NO: 1293661 - RNA, 15 nt, Homo sapiens
ccuuuagugaucaca

SEQ ID NO: 1293662 - RNA, 21 nt, Homo sapiens
ccuuuaucaccucauucugaa

SEQ ID NO: 1293663 - RNA, 11 nt, Homo sapiens
ccuuuccuguc

SEQ ID NO: 1293664 - RNA, 19 nt, Homo sapiens
ccuuucuggguaacaagcc

SEQ ID NO: 1293665 - RNA, 13 nt, Homo sapiens
ccuuugcaauuug

SEQ ID NO: 1293666 - RNA, 21 nt, Homo sapiens
ccuuuggggugaacuaccuug

SEQ ID NO: 1293667 - RNA, 13 nt, Homo sapiens
ccuuuuacauacu

SEQ ID NO: 1293668 - RNA, 16 nt, Homo sapiens
ccuuuugccaaucuca

SEQ ID NO: 1293669 - RNA, 21 nt, Homo sapiens
ccuuuuugucaucuauuuaaa

SEQ ID NO: 1293670 - RNA, 18 nt, Homo sapiens
ccuuuuuuaaaaaugcaa

SEQ ID NO: 1293671 - RNA, 13 nt, Homo sapiens
ccuuuuuucccau

SEQ ID NO: 1293672 - RNA, 16 nt, Homo sapiens
ccuuuuuugcaugugc

SEQ ID NO: 1293673 - RNA, 23 nt, Homo sapiens
ccuuuuuuugaaaaaaagcuuuu

SEQ ID NO: 1293674 - RNA, 18 nt, Homo sapiens
cgaaagaagaaaauauca

SEQ ID NO: 1293675 - RNA, 16 nt, Homo sapiens
cgaaauagauccagug

SEQ ID NO: 1293676 - RNA, 14 nt, Homo sapiens
cgaacaauucauau

SEQ ID NO: 1293677 - RNA, 14 nt, Homo sapiens
cgaagaguggacaa

SEQ ID NO: 1293678 - RNA, 16 nt, Homo sapiens
cgaauagccacugcau

SEQ ID NO: 1293679 - RNA, 12 nt, Homo sapiens
cgacaguuuucc

SEQ ID NO: 1293680 - RNA, 13 nt, Homo sapiens
cgaccagacaccu

SEQ ID NO: 1293681 - RNA, 22 nt, Homo sapiens
cgacuaauuucaaaaugcuuuu

SEQ ID NO: 1293682 - RNA, 16 nt, Homo sapiens
cgacuugacuuuuuaa

SEQ ID NO: 1293683 - RNA, 19 nt, Homo sapiens
cgagaauguauggauuuac

SEQ ID NO: 1293684 - RNA, 23 nt, Homo sapiens
cgagagaaagggagugcaugugc

SEQ ID NO: 1293685 - RNA, 17 nt, Homo sapiens
cgagaggugggccaguc

SEQ ID NO: 1293686 - RNA, 20 nt, Homo sapiens
cgagaucgugccauugcacu

SEQ ID NO: 1293687 - RNA, 20 nt, Homo sapiens
cgagauugcaccacugcacu

SEQ ID NO: 1293688 - RNA, 23 nt, Homo sapiens
cgagccccucggcucuggaggca

SEQ ID NO: 1293689 - RNA, 18 nt, Homo sapiens
cgagcgcuaccucuccag

SEQ ID NO: 1293690 - RNA, 23 nt, Homo sapiens
cgaggaaaagagaaggaaaguga

SEQ ID NO: 1293691 - RNA, 19 nt, Homo sapiens
cgaggacagggaggugacc

SEQ ID NO: 1293692 - RNA, 17 nt, Homo sapiens
cgaggggcucaguucug

SEQ ID NO: 1293693 - RNA, 19 nt, Homo sapiens
cgaguaacuccccucaggg

SEQ ID NO: 1293694 - RNA, 17 nt, Homo sapiens
cgaguuguuggcugcuc

SEQ ID NO: 1293695 - RNA, 17 nt, Homo sapiens
cgauaaaagacagugaa

SEQ ID NO: 1293696 - RNA, 14 nt, Homo sapiens
cgauaucagaauuu

SEQ ID NO: 1293697 - RNA, 12 nt, Homo sapiens
cgaucaguggug

SEQ ID NO: 1293698 - RNA, 14 nt, Homo sapiens
cgaucccaucuuga

SEQ ID NO: 1293699 - RNA, 13 nt, Homo sapiens
cgcaccugccuca

SEQ ID NO: 1293700 - RNA, 18 nt, Homo sapiens
cgcaggcuucugugugcu

SEQ ID NO: 1293701 - RNA, 17 nt, Homo sapiens
cgcagugugcacuaagg

SEQ ID NO: 1293702 - RNA, 16 nt, Homo sapiens
cgcaucucagugcagg

SEQ ID NO: 1293703 - RNA, 17 nt, Homo sapiens
cgccagccuccaaugua

SEQ ID NO: 1293704 - RNA, 16 nt, Homo sapiens
cgccaggcugaccaca

SEQ ID NO: 1293705 - RNA, 17 nt, Homo sapiens
cgccaggcugaccacag

SEQ ID NO: 1293706 - RNA, 15 nt, Homo sapiens
cgcccaggcuggaau

SEQ ID NO: 1293707 - RNA, 20 nt, Homo sapiens
cgcccaggcuggagugcagu

SEQ ID NO: 1293708 - RNA, 23 nt, Homo sapiens
cgccccagcaggugcugacuuca

SEQ ID NO: 1293709 - RNA, 12 nt, Homo sapiens
cgcccucaagaa

SEQ ID NO: 1293710 - RNA, 13 nt, Homo sapiens
cgccgcuagcccg

SEQ ID NO: 1293711 - RNA, 11 nt, Homo sapiens
cgccugcaaac

SEQ ID NO: 1293712 - RNA, 23 nt, Homo sapiens
cgcgugaucaaagccacacucug

SEQ ID NO: 1293713 - RNA, 18 nt, Homo sapiens
cgcugugucagcauagaa

SEQ ID NO: 1293714 - RNA, 21 nt, Homo sapiens
cggaaaccucccuuuacagca

SEQ ID NO: 1293715 - RNA, 17 nt, Homo sapiens
cggaacugcaugcugcu

SEQ ID NO: 1293716 - RNA, 21 nt, Homo sapiens
cggaaggagggagcucugaug

SEQ ID NO: 1293717 - RNA, 12 nt, Homo sapiens
cggaaguuuuca

SEQ ID NO: 1293718 - RNA, 13 nt, Homo sapiens
cggaaguuuucaa

SEQ ID NO: 1293719 - RNA, 15 nt, Homo sapiens
cggaaucagcuucua

SEQ ID NO: 1293720 - RNA, 20 nt, Homo sapiens
cggaaugaaccacaucuugc

SEQ ID NO: 1293721 - RNA, 21 nt, Homo sapiens
cggacaagacccccagcacuu

SEQ ID NO: 1293722 - RNA, 14 nt, Homo sapiens
cggaggauauuaaa

SEQ ID NO: 1293723 - RNA, 14 nt, Homo sapiens
cggaggcugcucag

SEQ ID NO: 1293724 - RNA, 16 nt, Homo sapiens
cggcaaccucugagcc

SEQ ID NO: 1293725 - RNA, 12 nt, Homo sapiens
cggccaaacaga

SEQ ID NO: 1293726 - RNA, 16 nt, Homo sapiens
cggccagccaugucug

SEQ ID NO: 1293727 - RNA, 16 nt, Homo sapiens
cggccccacauugcac

SEQ ID NO: 1293728 - RNA, 18 nt, Homo sapiens
cggccccucccccugaga

SEQ ID NO: 1293729 - RNA, 18 nt, Homo sapiens
cggccucucaguucuuga

SEQ ID NO: 1293730 - RNA, 17 nt, Homo sapiens
cggccugcccagucgac

SEQ ID NO: 1293731 - RNA, 17 nt, Homo sapiens
cgggaagaaggggacaa

SEQ ID NO: 1293732 - RNA, 22 nt, Homo sapiens
cgggagaucaugucucacuuca

SEQ ID NO: 1293733 - RNA, 14 nt, Homo sapiens
cgggagcugcacua

SEQ ID NO: 1293734 - RNA, 22 nt, Homo sapiens
cgggcuaggaagaucucugcag

SEQ ID NO: 1293735 - RNA, 17 nt, Homo sapiens
cgggcugugcccgggga

SEQ ID NO: 1293736 - RNA, 23 nt, Homo sapiens
cgggugagcugagcuuggcguuu

SEQ ID NO: 1293737 - RNA, 12 nt, Homo sapiens
cgguacccgggg

SEQ ID NO: 1293738 - RNA, 15 nt, Homo sapiens
cggugaaucuaguga

SEQ ID NO: 1293739 - RNA, 14 nt, Homo sapiens
cguaaagaacuuuu

SEQ ID NO: 1293740 - RNA, 20 nt, Homo sapiens
cguaugccaccaacuuacaa

SEQ ID NO: 1293741 - RNA, 21 nt, Homo sapiens
cguauuaguugccaauaugcc

SEQ ID NO: 1293742 - RNA, 22 nt, Homo sapiens
cgucaguaguuugagaccagcc

SEQ ID NO: 1293743 - RNA, 12 nt, Homo sapiens
cgucccuaccuc

SEQ ID NO: 1293744 - RNA, 13 nt, Homo sapiens
cguccuuuggacu

SEQ ID NO: 1293745 - RNA, 21 nt, Homo sapiens
cgugaagggauuuuagucaca

SEQ ID NO: 1293746 - RNA, 17 nt, Homo sapiens
cgugacacaaacacaca

SEQ ID NO: 1293747 - RNA, 14 nt, Homo sapiens
cgugaccagcagua

SEQ ID NO: 1293748 - RNA, 16 nt, Homo sapiens
cgugcacacaccagag

SEQ ID NO: 1293749 - RNA, 15 nt, Homo sapiens
cgugcccuaccacac

SEQ ID NO: 1293750 - RNA, 20 nt, Homo sapiens
cguggaugcgcagugccuug

SEQ ID NO: 1293751 - RNA, 13 nt, Homo sapiens
cguggcauuucaa

SEQ ID NO: 1293752 - RNA, 15 nt, Homo sapiens
cguggcugcaggggu

SEQ ID NO: 1293753 - RNA, 18 nt, Homo sapiens
cgugggcaaacaggcagu

SEQ ID NO: 1293754 - RNA, 21 nt, Homo sapiens
cgugugccaccaggagggagu

SEQ ID NO: 1293755 - RNA, 22 nt, Homo sapiens
cgugugugugugauugcacgug

SEQ ID NO: 1293756 - RNA, 13 nt, Homo sapiens
cguucacucccaa

SEQ ID NO: 1293757 - RNA, 20 nt, Homo sapiens
cguugauguuggcugggaac

SEQ ID NO: 1293758 - RNA, 23 nt, Homo sapiens
cguuuacaagcccccccuuccac

SEQ ID NO: 1293759 - RNA, 21 nt, Homo sapiens
cguuucccagagucaucugau

SEQ ID NO: 1293760 - RNA, 12 nt, Homo sapiens
cguuucuacuaa

SEQ ID NO: 1293761 - RNA, 16 nt, Homo sapiens
cguuucugguggucug

SEQ ID NO: 1293762 - RNA, 23 nt, Homo sapiens
cuaaaaacacaaaaauuagccag

SEQ ID NO: 1293763 - RNA, 12 nt, Homo sapiens
cuaaaaaucaaa

SEQ ID NO: 1293764 - RNA, 23 nt, Homo sapiens
cuaaaaaucaaauaagcuaauaa

SEQ ID NO: 1293765 - RNA, 18 nt, Homo sapiens
cuaaaagcacacucaucc

SEQ ID NO: 1293766 - RNA, 15 nt, Homo sapiens
cuaaaauacauuuau

SEQ ID NO: 1293767 - RNA, 20 nt, Homo sapiens
cuaaacaaugcugauuuggu

SEQ ID NO: 1293768 - RNA, 21 nt, Homo sapiens
cuaaacacgugacacaaacac

SEQ ID NO: 1293769 - RNA, 12 nt, Homo sapiens
cuaaaccaaaaa

SEQ ID NO: 1293770 - RNA, 18 nt, Homo sapiens
cuaaaccagaaaggugau

SEQ ID NO: 1293771 - RNA, 21 nt, Homo sapiens
cuaaagaaaaauaucuuggcc

SEQ ID NO: 1293772 - RNA, 21 nt, Homo sapiens
cuaaagaauucuugaaaaacu

SEQ ID NO: 1293773 - RNA, 18 nt, Homo sapiens
cuaaagagagaugaacca

SEQ ID NO: 1293774 - RNA, 15 nt, Homo sapiens
cuaaagcaugggauc

SEQ ID NO: 1293775 - RNA, 18 nt, Homo sapiens
cuaaauaaucuuacucua

SEQ ID NO: 1293776 - RNA, 13 nt, Homo sapiens
cuaaauccaaaga

SEQ ID NO: 1293777 - RNA, 15 nt, Homo sapiens
cuaaaugcacaguca

SEQ ID NO: 1293778 - RNA, 17 nt, Homo sapiens
cuaaauggugcuuuaua

SEQ ID NO: 1293779 - RNA, 22 nt, Homo sapiens
cuaaaugugaaugaugauccua

SEQ ID NO: 1293780 - RNA, 15 nt, Homo sapiens
cuaaauuugguucua

SEQ ID NO: 1293781 - RNA, 21 nt, Homo sapiens
cuaaauuuucugaaacugcau

SEQ ID NO: 1293782 - RNA, 20 nt, Homo sapiens
cuaacaagucaccaaaagac

SEQ ID NO: 1293783 - RNA, 13 nt, Homo sapiens
cuaacaauuguga

SEQ ID NO: 1293784 - RNA, 20 nt, Homo sapiens
cuaacacagccaucaaggga

SEQ ID NO: 1293785 - RNA, 16 nt, Homo sapiens
cuaacacuuaccccau

SEQ ID NO: 1293786 - RNA, 16 nt, Homo sapiens
cuaacauguaauugca

SEQ ID NO: 1293787 - RNA, 20 nt, Homo sapiens
cuaacauguaauugcagaua

SEQ ID NO: 1293788 - RNA, 11 nt, Homo sapiens
cuaaccaaaua

SEQ ID NO: 1293789 - RNA, 21 nt, Homo sapiens
cuaaccucugagucaccaucu

SEQ ID NO: 1293790 - RNA, 21 nt, Homo sapiens
cuaacuguauuuauugugaug

SEQ ID NO: 1293791 - RNA, 19 nt, Homo sapiens
cuaacuucuccaaggagca

SEQ ID NO: 1293792 - RNA, 15 nt, Homo sapiens
cuaagauuuugugaa

SEQ ID NO: 1293793 - RNA, 17 nt, Homo sapiens
cuaagcuucacuguaaa

SEQ ID NO: 1293794 - RNA, 14 nt, Homo sapiens
cuaaggugugcucu

SEQ ID NO: 1293795 - RNA, 22 nt, Homo sapiens
cuaaguagaccaaaucuuguua

SEQ ID NO: 1293796 - RNA, 15 nt, Homo sapiens
cuaagucaaauucca

SEQ ID NO: 1293797 - RNA, 23 nt, Homo sapiens
cuaagugauccucccaccucagc

SEQ ID NO: 1293798 - RNA, 21 nt, Homo sapiens
cuaauaagaaaaccaccccuu

SEQ ID NO: 1293799 - RNA, 17 nt, Homo sapiens
cuaauagcccaagaaug

SEQ ID NO: 1293800 - RNA, 16 nt, Homo sapiens
cuaauagucuuugcca

SEQ ID NO: 1293801 - RNA, 18 nt, Homo sapiens
cuaaucauccaaugcuca

SEQ ID NO: 1293802 - RNA, 19 nt, Homo sapiens
cuaaucauccaaugcucaa

SEQ ID NO: 1293803 - RNA, 11 nt, Homo sapiens
cuaaugcucac

SEQ ID NO: 1293804 - RNA, 16 nt, Homo sapiens
cuaauuagcuucagga

SEQ ID NO: 1293805 - RNA, 15 nt, Homo sapiens
cuacaacaaccugaa

SEQ ID NO: 1293806 - RNA, 19 nt, Homo sapiens
cuacaaucugugucauaua

SEQ ID NO: 1293807 - RNA, 19 nt, Homo sapiens
cuacacgagauacagaauu

SEQ ID NO: 1293808 - RNA, 16 nt, Homo sapiens
cuacacugacacuggu

SEQ ID NO: 1293809 - RNA, 18 nt, Homo sapiens
cuacaggauuugaaauug

SEQ ID NO: 1293810 - RNA, 18 nt, Homo sapiens
cuacauauugucuggaaa

SEQ ID NO: 1293811 - RNA, 15 nt, Homo sapiens
cuaccagcacauuaa

SEQ ID NO: 1293812 - RNA, 13 nt, Homo sapiens
cuacccaguacuc

SEQ ID NO: 1293813 - RNA, 14 nt, Homo sapiens
cuacccaugaccug

SEQ ID NO: 1293814 - RNA, 13 nt, Homo sapiens
cuaccugucugua

SEQ ID NO: 1293815 - RNA, 14 nt, Homo sapiens
cuaccugucuguag

SEQ ID NO: 1293816 - RNA, 22 nt, Homo sapiens
cuaccuugguucccccacugau

SEQ ID NO: 1293817 - RNA, 20 nt, Homo sapiens
cuacucuaaagaauucuuga

SEQ ID NO: 1293818 - RNA, 23 nt, Homo sapiens
cuacucuaggcagugacagugcc

SEQ ID NO: 1293819 - RNA, 23 nt, Homo sapiens
cuacucuguuccuucacauccug

SEQ ID NO: 1293820 - RNA, 19 nt, Homo sapiens
cuacugagggcaguucuga

SEQ ID NO: 1293821 - RNA, 12 nt, Homo sapiens
augguguucucu

SEQ ID NO: 1293822 - RNA, 15 nt, Homo sapiens
augguuccauucucu

SEQ ID NO: 1293823 - RNA, 15 nt, Homo sapiens
auguaaaagcacaug

SEQ ID NO: 1293824 - RNA, 12 nt, Homo sapiens
auguaaagccau

SEQ ID NO: 1293825 - RNA, 13 nt, Homo sapiens
auguaacugcauu

SEQ ID NO: 1293826 - RNA, 22 nt, Homo sapiens
auguacaccagagccucaguga

SEQ ID NO: 1293827 - RNA, 15 nt, Homo sapiens
auguacagacauauu

SEQ ID NO: 1293828 - RNA, 18 nt, Homo sapiens
auguacuguuugcugcca

SEQ ID NO: 1293829 - RNA, 21 nt, Homo sapiens
auguagaauauucagacaaaa

SEQ ID NO: 1293830 - RNA, 15 nt, Homo sapiens
auguauaaagugauu

SEQ ID NO: 1293831 - RNA, 21 nt, Homo sapiens
auguauggaaucccacuguau

SEQ ID NO: 1293832 - RNA, 21 nt, Homo sapiens
auguauuuauuugggagaccg

SEQ ID NO: 1293833 - RNA, 16 nt, Homo sapiens
augucaacagagcaag

SEQ ID NO: 1293834 - RNA, 22 nt, Homo sapiens
augucaaugccaggauuucuca

SEQ ID NO: 1293835 - RNA, 20 nt, Homo sapiens
augucaccuacauguuauuc

SEQ ID NO: 1293836 - RNA, 12 nt, Homo sapiens
augucauuuagu

SEQ ID NO: 1293837 - RNA, 15 nt, Homo sapiens
augucccccauaucu

SEQ ID NO: 1293838 - RNA, 20 nt, Homo sapiens
augucuauuauauuuacuua

SEQ ID NO: 1293839 - RNA, 12 nt, Homo sapiens
augucucugcaa

SEQ ID NO: 1293840 - RNA, 20 nt, Homo sapiens
augucucuuuaaugucacag

SEQ ID NO: 1293841 - RNA, 13 nt, Homo sapiens
augucuuaagauu

SEQ ID NO: 1293842 - RNA, 22 nt, Homo sapiens
augucuugcuguugacauauuu

SEQ ID NO: 1293843 - RNA, 22 nt, Homo sapiens
augugaaaacccaucucuacaa

SEQ ID NO: 1293844 - RNA, 17 nt, Homo sapiens
augugaaacucaucuca

SEQ ID NO: 1293845 - RNA, 18 nt, Homo sapiens
augugaaacucaucucau

SEQ ID NO: 1293846 - RNA, 12 nt, Homo sapiens
augugaagccaa

SEQ ID NO: 1293847 - RNA, 21 nt, Homo sapiens
augugaagccaauucagacag

SEQ ID NO: 1293848 - RNA, 20 nt, Homo sapiens
augugaauuauuuccugcuu

SEQ ID NO: 1293849 - RNA, 19 nt, Homo sapiens
augugacauuauaugcacu

SEQ ID NO: 1293850 - RNA, 13 nt, Homo sapiens
augugacuacuga

SEQ ID NO: 1293851 - RNA, 19 nt, Homo sapiens
augugaugguacacagugg

SEQ ID NO: 1293852 - RNA, 20 nt, Homo sapiens
augugaugguacacaguggg

SEQ ID NO: 1293853 - RNA, 17 nt, Homo sapiens
augugcaaccacugcuu

SEQ ID NO: 1293854 - RNA, 17 nt, Homo sapiens
augugccucuguccuua

SEQ ID NO: 1293855 - RNA, 18 nt, Homo sapiens
auguggacuuuuuuguac

SEQ ID NO: 1293856 - RNA, 20 nt, Homo sapiens
auguggcuggaagauccugc

SEQ ID NO: 1293857 - RNA, 20 nt, Homo sapiens
auguggcuuuugcaauucac

SEQ ID NO: 1293858 - RNA, 14 nt, Homo sapiens
auguguaaggugaa

SEQ ID NO: 1293859 - RNA, 20 nt, Homo sapiens
auguguaggugaacagucac

SEQ ID NO: 1293860 - RNA, 18 nt, Homo sapiens
auguguguguguauauau

SEQ ID NO: 1293861 - RNA, 17 nt, Homo sapiens
auguguuucaaaaccau

SEQ ID NO: 1293862 - RNA, 18 nt, Homo sapiens
auguguuucaaaaccaug

SEQ ID NO: 1293863 - RNA, 23 nt, Homo sapiens
auguuaaacuagcauaucugccu

SEQ ID NO: 1293864 - RNA, 18 nt, Homo sapiens
auguuaauguuauaucau

SEQ ID NO: 1293865 - RNA, 13 nt, Homo sapiens
auguuacaagcua

SEQ ID NO: 1293866 - RNA, 12 nt, Homo sapiens
auguuacagauu

SEQ ID NO: 1293867 - RNA, 19 nt, Homo sapiens
auguuaggaaaauuucaca

SEQ ID NO: 1293868 - RNA, 12 nt, Homo sapiens
auguuauaucau

SEQ ID NO: 1293869 - RNA, 14 nt, Homo sapiens
auguuauaucauau

SEQ ID NO: 1293870 - RNA, 14 nt, Homo sapiens
auguuaugcaaaaa

SEQ ID NO: 1293871 - RNA, 19 nt, Homo sapiens
auguucacauagugaaaua

SEQ ID NO: 1293872 - RNA, 16 nt, Homo sapiens
auguucacuuccaaga

SEQ ID NO: 1293873 - RNA, 22 nt, Homo sapiens
auguucacuuuugacaaaggca

SEQ ID NO: 1293874 - RNA, 12 nt, Homo sapiens
auguuccagaca

SEQ ID NO: 1293875 - RNA, 14 nt, Homo sapiens
auguucugggacac

SEQ ID NO: 1293876 - RNA, 16 nt, Homo sapiens
auguugaccaugucua

SEQ ID NO: 1293877 - RNA, 22 nt, Homo sapiens
auguugcacacccacucagcuc

SEQ ID NO: 1293878 - RNA, 14 nt, Homo sapiens
auguugcccaggca

SEQ ID NO: 1293879 - RNA, 18 nt, Homo sapiens
auguuggcugggaacuca

SEQ ID NO: 1293880 - RNA, 21 nt, Homo sapiens
auguugguuuuaauacuugau

SEQ ID NO: 1293881 - RNA, 19 nt, Homo sapiens
auguuucgcugauauaugu

SEQ ID NO: 1293882 - RNA, 19 nt, Homo sapiens
auguuuuaaauaguugcaa

SEQ ID NO: 1293883 - RNA, 13 nt, Homo sapiens
auguuuugcccac

SEQ ID NO: 1293884 - RNA, 21 nt, Homo sapiens
auguuuuuauaaaagcaaaag

SEQ ID NO: 1293885 - RNA, 16 nt, Homo sapiens
auuaaaacacuuucaa

SEQ ID NO: 1293886 - RNA, 18 nt, Homo sapiens
auuaaauguacuuuuuga

SEQ ID NO: 1293887 - RNA, 18 nt, Homo sapiens
auuaaauuaccuugccaa

SEQ ID NO: 1293888 - RNA, 17 nt, Homo sapiens
auuaaauucacaaacuu

SEQ ID NO: 1293889 - RNA, 15 nt, Homo sapiens
auuaacacagaggac

SEQ ID NO: 1293890 - RNA, 16 nt, Homo sapiens
auuaacauaagaaaag

SEQ ID NO: 1293891 - RNA, 16 nt, Homo sapiens
auuaaccacuucagcu

SEQ ID NO: 1293892 - RNA, 20 nt, Homo sapiens
auuaagaauugguugccaua

SEQ ID NO: 1293893 - RNA, 17 nt, Homo sapiens
auuaagagauugccauu

SEQ ID NO: 1293894 - RNA, 15 nt, Homo sapiens
auuaauacuaugcaa

SEQ ID NO: 1293895 - RNA, 21 nt, Homo sapiens
auuaaucaaaccacuguuauu

SEQ ID NO: 1293896 - RNA, 14 nt, Homo sapiens
auuaaugcuaucaa

SEQ ID NO: 1293897 - RNA, 19 nt, Homo sapiens
auuaauuccaacuguacuu

SEQ ID NO: 1293898 - RNA, 22 nt, Homo sapiens
auuaauuuuuaaggauguugcc

SEQ ID NO: 1293899 - RNA, 23 nt, Homo sapiens
auuacaagcgugagccacugcac

SEQ ID NO: 1293900 - RNA, 16 nt, Homo sapiens
auuacaggcaugagcu

SEQ ID NO: 1293901 - RNA, 17 nt, Homo sapiens
auuacaggugugcacca

SEQ ID NO: 1293902 - RNA, 14 nt, Homo sapiens
auuacaucuuucac

SEQ ID NO: 1293903 - RNA, 15 nt, Homo sapiens
auuacccugauacua

SEQ ID NO: 1293904 - RNA, 16 nt, Homo sapiens
auuaccuccugagaaa

SEQ ID NO: 1293905 - RNA, 16 nt, Homo sapiens
auuacggggugaccuu

SEQ ID NO: 1293906 - RNA, 19 nt, Homo sapiens
auuagaaacaacauagcaa

SEQ ID NO: 1293907 - RNA, 17 nt, Homo sapiens
auuagaaguuaccaaau

SEQ ID NO: 1293908 - RNA, 18 nt, Homo sapiens
auuagcauuuugcuaaau

SEQ ID NO: 1293909 - RNA, 17 nt, Homo sapiens
auuagccaaguguggua

SEQ ID NO: 1293910 - RNA, 23 nt, Homo sapiens
auuagccaagugugguagagugu

SEQ ID NO: 1293911 - RNA, 16 nt, Homo sapiens
auuagguuucagcaga

SEQ ID NO: 1293912 - RNA, 23 nt, Homo sapiens
auuagugggauuuuaugccaguu

SEQ ID NO: 1293913 - RNA, 16 nt, Homo sapiens
auuauaagcuuaacua

SEQ ID NO: 1293914 - RNA, 24 nt, Homo sapiens
auuauacgcuggcaacacagaggc

SEQ ID NO: 1293915 - RNA, 16 nt, Homo sapiens
auuauaugcacuagca

SEQ ID NO: 1293916 - RNA, 20 nt, Homo sapiens
auuauauuuacaaaugggaa

SEQ ID NO: 1293917 - RNA, 14 nt, Homo sapiens
auuauauuugacau

SEQ ID NO: 1293918 - RNA, 17 nt, Homo sapiens
auuauccuucuacuugu

SEQ ID NO: 1293919 - RNA, 21 nt, Homo sapiens
auuaucucaaggaauguacaa

SEQ ID NO: 1293920 - RNA, 18 nt, Homo sapiens
auuauggaaaacauuuca

SEQ ID NO: 1293921 - RNA, 22 nt, Homo sapiens
auucaacaagagcacuacauuc

SEQ ID NO: 1293922 - RNA, 19 nt, Homo sapiens
auucaagaggaaaugucac

SEQ ID NO: 1293923 - RNA, 18 nt, Homo sapiens
auucaagguugguucaac

SEQ ID NO: 1293924 - RNA, 14 nt, Homo sapiens
auucacagagccuu

SEQ ID NO: 1293925 - RNA, 16 nt, Homo sapiens
auucacaguugauaca

SEQ ID NO: 1293926 - RNA, 21 nt, Homo sapiens
auucacuguuuguuacuaugu

SEQ ID NO: 1293927 - RNA, 22 nt, Homo sapiens
auucacuguuuguuacuaugua

SEQ ID NO: 1293928 - RNA, 16 nt, Homo sapiens
auucacuugcauuucu

SEQ ID NO: 1293929 - RNA, 21 nt, Homo sapiens
auucagaaugaucugcaagaa

SEQ ID NO: 1293930 - RNA, 21 nt, Homo sapiens
auucagucucuucuaagcaaa

SEQ ID NO: 1293931 - RNA, 22 nt, Homo sapiens
auucagucucuucuaagcaaaa

SEQ ID NO: 1293932 - RNA, 12 nt, Homo sapiens
auucaguguuaa

SEQ ID NO: 1293933 - RNA, 21 nt, Homo sapiens
auucaguuuucaguagaagaa

SEQ ID NO: 1293934 - RNA, 15 nt, Homo sapiens
auucaucaaauggaa

SEQ ID NO: 1293935 - RNA, 15 nt, Homo sapiens
auucaugacuaugga

SEQ ID NO: 1293936 - RNA, 20 nt, Homo sapiens
auucauugucucuagagauu

SEQ ID NO: 1293937 - RNA, 19 nt, Homo sapiens
auucauuuucuagauacaa

SEQ ID NO: 1293938 - RNA, 18 nt, Homo sapiens
auuccaagaauagcaucu

SEQ ID NO: 1293939 - RNA, 17 nt, Homo sapiens
auuccagaaugcuguac

SEQ ID NO: 1293940 - RNA, 19 nt, Homo sapiens
auuccagaaugcuguacau

SEQ ID NO: 1293941 - RNA, 23 nt, Homo sapiens
auuccaggaggaguuagccaaac

SEQ ID NO: 1293942 - RNA, 16 nt, Homo sapiens
auuccccacccugaaa

SEQ ID NO: 1293943 - RNA, 21 nt, Homo sapiens
auuccccuguagcagucacug

SEQ ID NO: 1293944 - RNA, 22 nt, Homo sapiens
auucccucaccugucgcuuccu

SEQ ID NO: 1293945 - RNA, 14 nt, Homo sapiens
auuccugagccagu

SEQ ID NO: 1293946 - RNA, 16 nt, Homo sapiens
auuccugagccagugu

SEQ ID NO: 1293947 - RNA, 23 nt, Homo sapiens
auuccuucucccaucucuuccuu

SEQ ID NO: 1293948 - RNA, 19 nt, Homo sapiens
auucuauuuauauguacau

SEQ ID NO: 1293949 - RNA, 22 nt, Homo sapiens
auucucaggccaucaucagugg

SEQ ID NO: 1293950 - RNA, 16 nt, Homo sapiens
auucucaucaguccau

SEQ ID NO: 1293951 - RNA, 18 nt, Homo sapiens
auucucaucaguccauug

SEQ ID NO: 1293952 - RNA, 19 nt, Homo sapiens
auucucaucaguccauugc

SEQ ID NO: 1293953 - RNA, 13 nt, Homo sapiens
auucucauucuca

SEQ ID NO: 1293954 - RNA, 16 nt, Homo sapiens
auucucucuccuguac

SEQ ID NO: 1293955 - RNA, 16 nt, Homo sapiens
aucuguauauacaaua

SEQ ID NO: 1293956 - RNA, 23 nt, Homo sapiens
aucugugcacugcccauggacag

SEQ ID NO: 1293957 - RNA, 20 nt, Homo sapiens
aucuguuuugaaggcaaaau

SEQ ID NO: 1293958 - RNA, 14 nt, Homo sapiens
aucuuacugaaggu

SEQ ID NO: 1293959 - RNA, 20 nt, Homo sapiens
aucuuagugccuuuaucugu

SEQ ID NO: 1293960 - RNA, 20 nt, Homo sapiens
aucuuaucauggucucaguc

SEQ ID NO: 1293961 - RNA, 14 nt, Homo sapiens
aucuucagaccuuu

SEQ ID NO: 1293962 - RNA, 14 nt, Homo sapiens
aucuuccugugucc

SEQ ID NO: 1293963 - RNA, 18 nt, Homo sapiens
aucuucuuuuucaggcuc

SEQ ID NO: 1293964 - RNA, 22 nt, Homo sapiens
aucuugcauccaaaccuguaac

SEQ ID NO: 1293965 - RNA, 20 nt, Homo sapiens
aucuugcuucugcuucucau

SEQ ID NO: 1293966 - RNA, 22 nt, Homo sapiens
aucuuguuuuuccacuacugcu

SEQ ID NO: 1293967 - RNA, 24 nt, Homo sapiens
aucuuguuuuuccacuacugcuac

SEQ ID NO: 1293968 - RNA, 14 nt, Homo sapiens
aucuuuauugaacu

SEQ ID NO: 1293969 - RNA, 16 nt, Homo sapiens
aucuuucaaaccagcu

SEQ ID NO: 1293970 - RNA, 18 nt, Homo sapiens
aucuuuguggccaaggag

SEQ ID NO: 1293971 - RNA, 20 nt, Homo sapiens
augaaaaagacaagauuuau

SEQ ID NO: 1293972 - RNA, 17 nt, Homo sapiens
augaaauuauaaucugu

SEQ ID NO: 1293973 - RNA, 11 nt, Homo sapiens
augaacauaua

SEQ ID NO: 1293974 - RNA, 13 nt, Homo sapiens
augaaccacauua

SEQ ID NO: 1293975 - RNA, 12 nt, Homo sapiens
augaagccagcu

SEQ ID NO: 1293976 - RNA, 14 nt, Homo sapiens
augaagguaauauu

SEQ ID NO: 1293977 - RNA, 21 nt, Homo sapiens
augaauguaaucaacauucca

SEQ ID NO: 1293978 - RNA, 14 nt, Homo sapiens
augacacuuguccc

SEQ ID NO: 1293979 - RNA, 21 nt, Homo sapiens
augacaguauuauacgcuggc

SEQ ID NO: 1293980 - RNA, 19 nt, Homo sapiens
augacauagacgcacuugg

SEQ ID NO: 1293981 - RNA, 17 nt, Homo sapiens
augacauucaugccugg

SEQ ID NO: 1293982 - RNA, 16 nt, Homo sapiens
augaccauaaccacug

SEQ ID NO: 1293983 - RNA, 14 nt, Homo sapiens
augaccgacugcac

SEQ ID NO: 1293984 - RNA, 22 nt, Homo sapiens
augaccuuggacaaucaugaaa

SEQ ID NO: 1293985 - RNA, 19 nt, Homo sapiens
augacuaaagcagggacaa

SEQ ID NO: 1293986 - RNA, 13 nt, Homo sapiens
augacucacauga

SEQ ID NO: 1293987 - RNA, 11 nt, Homo sapiens
augacugccuu

SEQ ID NO: 1293988 - RNA, 16 nt, Homo sapiens
augacugccuugccuc

SEQ ID NO: 1293989 - RNA, 17 nt, Homo sapiens
augacuggucucuggcu

SEQ ID NO: 1293990 - RNA, 20 nt, Homo sapiens
augagaaucagaucauuuca

SEQ ID NO: 1293991 - RNA, 14 nt, Homo sapiens
augagagaacugga

SEQ ID NO: 1293992 - RNA, 16 nt, Homo sapiens
augagauaauacucuu

SEQ ID NO: 1293993 - RNA, 18 nt, Homo sapiens
augaggcccucauuccca

SEQ ID NO: 1293994 - RNA, 22 nt, Homo sapiens
augagguuucuuugacuucaau

SEQ ID NO: 1293995 - RNA, 13 nt, Homo sapiens
augagugcuuaaa

SEQ ID NO: 1293996 - RNA, 14 nt, Homo sapiens
augagugcuuaaac

SEQ ID NO: 1293997 - RNA, 20 nt, Homo sapiens
augauaaauauaacaucuau

SEQ ID NO: 1293998 - RNA, 16 nt, Homo sapiens
augauaauuacaauac

SEQ ID NO: 1293999 - RNA, 13 nt, Homo sapiens
augauacauccaa

SEQ ID NO: 1294000 - RNA, 19 nt, Homo sapiens
augauacuuggaugcagcu

SEQ ID NO: 1294001 - RNA, 14 nt, Homo sapiens
augauagcuacugu

SEQ ID NO: 1294002 - RNA, 15 nt, Homo sapiens
augaucaccauguau

SEQ ID NO: 1294003 - RNA, 14 nt, Homo sapiens
augaucacggcuca

SEQ ID NO: 1294004 - RNA, 22 nt, Homo sapiens
augauccaagcaagacugaggg

SEQ ID NO: 1294005 - RNA, 22 nt, Homo sapiens
augauccuaggcauuugcugaa

SEQ ID NO: 1294006 - RNA, 14 nt, Homo sapiens
augauggaugccaa

SEQ ID NO: 1294007 - RNA, 17 nt, Homo sapiens
augauggccaggcugau

SEQ ID NO: 1294008 - RNA, 23 nt, Homo sapiens
augauguagagugugguuaugaa

SEQ ID NO: 1294009 - RNA, 21 nt, Homo sapiens
augauuccuuccuguucugaa

SEQ ID NO: 1294010 - RNA, 19 nt, Homo sapiens
augauuuccaaaauugcaa

SEQ ID NO: 1294011 - RNA, 21 nt, Homo sapiens
augcaaaaguucugacuugac

SEQ ID NO: 1294012 - RNA, 22 nt, Homo sapiens
augcaaagaaucccuagacuuu

SEQ ID NO: 1294013 - RNA, 17 nt, Homo sapiens
augcaaauccuauguga

SEQ ID NO: 1294014 - RNA, 17 nt, Homo sapiens
augcaagagaacauuuu

SEQ ID NO: 1294015 - RNA, 16 nt, Homo sapiens
augcaaugacucagga

SEQ ID NO: 1294016 - RNA, 19 nt, Homo sapiens
augcaauuggcauuaacaa

SEQ ID NO: 1294017 - RNA, 16 nt, Homo sapiens
augcaauuuuucaaga

SEQ ID NO: 1294018 - RNA, 19 nt, Homo sapiens
augcacaaaacuuugauuc

SEQ ID NO: 1294019 - RNA, 13 nt, Homo sapiens
augcacacagugc

SEQ ID NO: 1294020 - RNA, 19 nt, Homo sapiens
augcacucagcucuuggcu

SEQ ID NO: 1294021 - RNA, 22 nt, Homo sapiens
augcacuguucccccugugcag

SEQ ID NO: 1294022 - RNA, 14 nt, Homo sapiens
augcagacaaacaa

SEQ ID NO: 1294023 - RNA, 22 nt, Homo sapiens
augcagcucaagagaucccaag

SEQ ID NO: 1294024 - RNA, 13 nt, Homo sapiens
augcagucucuuu

SEQ ID NO: 1294025 - RNA, 15 nt, Homo sapiens
augcagucucuuuau

SEQ ID NO: 1294026 - RNA, 14 nt, Homo sapiens
augcauggaaaaug

SEQ ID NO: 1294027 - RNA, 22 nt, Homo sapiens
augcauggugccccaggaccag

SEQ ID NO: 1294028 - RNA, 23 nt, Homo sapiens
augcauggugccccaggaccagc

SEQ ID NO: 1294029 - RNA, 20 nt, Homo sapiens
augcauuuauagaucauuuc

SEQ ID NO: 1294030 - RNA, 17 nt, Homo sapiens
augcauuuuugaagaca

SEQ ID NO: 1294031 - RNA, 18 nt, Homo sapiens
augccaagcacugugcuc

SEQ ID NO: 1294032 - RNA, 21 nt, Homo sapiens
augccaagcacugugcucagg

SEQ ID NO: 1294033 - RNA, 23 nt, Homo sapiens
augccacaaggacuuccugucca

SEQ ID NO: 1294034 - RNA, 17 nt, Homo sapiens
augccaccaacuuacaa

SEQ ID NO: 1294035 - RNA, 19 nt, Homo sapiens
augccaccaacuuacaaaa

SEQ ID NO: 1294036 - RNA, 17 nt, Homo sapiens
augccacccugcauuug

SEQ ID NO: 1294037 - RNA, 12 nt, Homo sapiens
augccacuccuc

SEQ ID NO: 1294038 - RNA, 16 nt, Homo sapiens
augccagcuuaucuca

SEQ ID NO: 1294039 - RNA, 17 nt, Homo sapiens
augccagugugcugaug

SEQ ID NO: 1294040 - RNA, 15 nt, Homo sapiens
augccauagcaagau

SEQ ID NO: 1294041 - RNA, 23 nt, Homo sapiens
augccauagcaagauugcuuaaa

SEQ ID NO: 1294042 - RNA, 16 nt, Homo sapiens
augcccaaccuauccu

SEQ ID NO: 1294043 - RNA, 19 nt, Homo sapiens
augcccugugcaaccucuu

SEQ ID NO: 1294044 - RNA, 23 nt, Homo sapiens
augccucagcccugacccugugg

SEQ ID NO: 1294045 - RNA, 17 nt, Homo sapiens
augccugguggcagcug

SEQ ID NO: 1294046 - RNA, 20 nt, Homo sapiens
augcgguagccagcacacag

SEQ ID NO: 1294047 - RNA, 23 nt, Homo sapiens
augcuaaaagcuauccaggauuu

SEQ ID NO: 1294048 - RNA, 18 nt, Homo sapiens
augcucaggcuacuauag

SEQ ID NO: 1294049 - RNA, 14 nt, Homo sapiens
augcucagggucaa

SEQ ID NO: 1294050 - RNA, 11 nt, Homo sapiens
augcucuccaa

SEQ ID NO: 1294051 - RNA, 14 nt, Homo sapiens
augcugacagcucu

SEQ ID NO: 1294052 - RNA, 14 nt, Homo sapiens
augcugacauucac

SEQ ID NO: 1294053 - RNA, 22 nt, Homo sapiens
augcugagguuaugaacaaagu

SEQ ID NO: 1294054 - RNA, 21 nt, Homo sapiens
augcugauguccucaccacau

SEQ ID NO: 1294055 - RNA, 22 nt, Homo sapiens
augcuggaaaauaauacugcug

SEQ ID NO: 1294056 - RNA, 15 nt, Homo sapiens
augcuggcauuugca

SEQ ID NO: 1294057 - RNA, 19 nt, Homo sapiens
augcugugauugugccuac

SEQ ID NO: 1294058 - RNA, 18 nt, Homo sapiens
augcuuguauuuuacuuu

SEQ ID NO: 1294059 - RNA, 20 nt, Homo sapiens
auggaagaaacacagaaagg

SEQ ID NO: 1294060 - RNA, 12 nt, Homo sapiens
auggaagcaucu

SEQ ID NO: 1294061 - RNA, 15 nt, Homo sapiens
auggaauuacaugua

SEQ ID NO: 1294062 - RNA, 15 nt, Homo sapiens
auggacacuuuucac

SEQ ID NO: 1294063 - RNA, 21 nt, Homo sapiens
auggaggggagggaucuccug

SEQ ID NO: 1294064 - RNA, 13 nt, Homo sapiens
auggaucaugucc

SEQ ID NO: 1294065 - RNA, 19 nt, Homo sapiens
auggaugggggaacucaga

SEQ ID NO: 1294066 - RNA, 20 nt, Homo sapiens
auggcaaaggaagguggaug

SEQ ID NO: 1294067 - RNA, 17 nt, Homo sapiens
auggcagagcauccucu

SEQ ID NO: 1294068 - RNA, 13 nt, Homo sapiens
auggcagcugcca

SEQ ID NO: 1294069 - RNA, 21 nt, Homo sapiens
auggcaguccagccagcuccu

SEQ ID NO: 1294070 - RNA, 14 nt, Homo sapiens
auggcagugaugaa

SEQ ID NO: 1294071 - RNA, 18 nt, Homo sapiens
auggcaugagaaauacaa

SEQ ID NO: 1294072 - RNA, 20 nt, Homo sapiens
auggccacugggucucugca

SEQ ID NO: 1294073 - RNA, 15 nt, Homo sapiens
auggcccaaauccag

SEQ ID NO: 1294074 - RNA, 17 nt, Homo sapiens
auggccucauguggcug

SEQ ID NO: 1294075 - RNA, 13 nt, Homo sapiens
auggccuuaccuu

SEQ ID NO: 1294076 - RNA, 22 nt, Homo sapiens
augggaggagaggacaagggaa

SEQ ID NO: 1294077 - RNA, 13 nt, Homo sapiens
auggggccagauc

SEQ ID NO: 1294078 - RNA, 18 nt, Homo sapiens
augggugaaggcuggcau

SEQ ID NO: 1294079 - RNA, 20 nt, Homo sapiens
auggguuuagggaagacauu

SEQ ID NO: 1294080 - RNA, 21 nt, Homo sapiens
auggguuucuccagagggaau

SEQ ID NO: 1294081 - RNA, 18 nt, Homo sapiens
auggucacaagcacaaag

SEQ ID NO: 1294082 - RNA, 17 nt, Homo sapiens
ugacauaggcaauaaua

SEQ ID NO: 1294083 - RNA, 13 nt, Homo sapiens
ugacauauuuaau

SEQ ID NO: 1294084 - RNA, 18 nt, Homo sapiens
ugacaucagcaauacaga

SEQ ID NO: 1294085 - RNA, 15 nt, Homo sapiens
ugacaugcacucagc

SEQ ID NO: 1294086 - RNA, 14 nt, Homo sapiens
ugacauuauaugca

SEQ ID NO: 1294087 - RNA, 17 nt, Homo sapiens
ugacauuauaugcacua

SEQ ID NO: 1294088 - RNA, 15 nt, Homo sapiens
ugacauugcauuugg

SEQ ID NO: 1294089 - RNA, 23 nt, Homo sapiens
ugacauugcguuugaccuuuuau

SEQ ID NO: 1294090 - RNA, 19 nt, Homo sapiens
ugacauuucuuugugcuuu

SEQ ID NO: 1294091 - RNA, 23 nt, Homo sapiens
ugacauuugucagugauguugcc

SEQ ID NO: 1294092 - RNA, 19 nt, Homo sapiens
ugaccaauuugcaccaguu

SEQ ID NO: 1294093 - RNA, 17 nt, Homo sapiens
ugaccacagcacagcca

SEQ ID NO: 1294094 - RNA, 22 nt, Homo sapiens
ugaccaggcgcccgggauccag

SEQ ID NO: 1294095 - RNA, 15 nt, Homo sapiens
ugaccagugcugcug

SEQ ID NO: 1294096 - RNA, 17 nt, Homo sapiens
ugaccaguuuaaccuga

SEQ ID NO: 1294097 - RNA, 14 nt, Homo sapiens
ugaccuucagcuca

SEQ ID NO: 1294098 - RNA, 20 nt, Homo sapiens
ugacggcgcaagaccagcuu

SEQ ID NO: 1294099 - RNA, 13 nt, Homo sapiens
ugacguagcugca

SEQ ID NO: 1294100 - RNA, 21 nt, Homo sapiens
ugacucuggcaaagcuuuuag

SEQ ID NO: 1294101 - RNA, 22 nt, Homo sapiens
ugacugagaauauaauacugua

SEQ ID NO: 1294102 - RNA, 20 nt, Homo sapiens
ugacugcucagaacuugcug

SEQ ID NO: 1294103 - RNA, 17 nt, Homo sapiens
ugacuguuuucuuuaug

SEQ ID NO: 1294104 - RNA, 14 nt, Homo sapiens
ugacuuccucccac

SEQ ID NO: 1294105 - RNA, 14 nt, Homo sapiens
ugacuugacuuuag

SEQ ID NO: 1294106 - RNA, 10 nt, Homo sapiens
ugacuuucaa

SEQ ID NO: 1294107 - RNA, 15 nt, Homo sapiens
ugacuuuuaauguca

SEQ ID NO: 1294108 - RNA, 14 nt, Homo sapiens
ugacuuuucaccuu

SEQ ID NO: 1294109 - RNA, 18 nt, Homo sapiens
ugagaaacucuacaugua

SEQ ID NO: 1294110 - RNA, 22 nt, Homo sapiens
ugagaaacucuacauguaacua

SEQ ID NO: 1294111 - RNA, 18 nt, Homo sapiens
ugagaaagagcacuuaag

SEQ ID NO: 1294112 - RNA, 22 nt, Homo sapiens
ugagaaagagcacuuaagagaa

SEQ ID NO: 1294113 - RNA, 23 nt, Homo sapiens
ugagaaaugggacuuaacuccuu

SEQ ID NO: 1294114 - RNA, 13 nt, Homo sapiens
ugagaacaaagau

SEQ ID NO: 1294115 - RNA, 13 nt, Homo sapiens
ugagaacaaucau

SEQ ID NO: 1294116 - RNA, 14 nt, Homo sapiens
ugagaacacuguga

SEQ ID NO: 1294117 - RNA, 16 nt, Homo sapiens
ugagaaggaacuucca

SEQ ID NO: 1294118 - RNA, 16 nt, Homo sapiens
ugagacagagucucac

SEQ ID NO: 1294119 - RNA, 14 nt, Homo sapiens
ugagacaggcaguu

SEQ ID NO: 1294120 - RNA, 12 nt, Homo sapiens
ugagaccauuca

SEQ ID NO: 1294121 - RNA, 19 nt, Homo sapiens
ugagaccuuggcgcuacaa

SEQ ID NO: 1294122 - RNA, 22 nt, Homo sapiens
ugagacuacaagugugugccac

SEQ ID NO: 1294123 - RNA, 13 nt, Homo sapiens
ugagacuacaggu

SEQ ID NO: 1294124 - RNA, 17 nt, Homo sapiens
ugagacucugucucaaa

SEQ ID NO: 1294125 - RNA, 15 nt, Homo sapiens
ugagagaccaggcaa

SEQ ID NO: 1294126 - RNA, 13 nt, Homo sapiens
ugagagcugcuuu

SEQ ID NO: 1294127 - RNA, 15 nt, Homo sapiens
ugagagcugcuuuga

SEQ ID NO: 1294128 - RNA, 15 nt, Homo sapiens
ugagaguuauaguga

SEQ ID NO: 1294129 - RNA, 16 nt, Homo sapiens
ugagaucauucacuca

SEQ ID NO: 1294130 - RNA, 19 nt, Homo sapiens
ugagauccggcaacaucaa

SEQ ID NO: 1294131 - RNA, 22 nt, Homo sapiens
ugagaugauacauccaaagcag

SEQ ID NO: 1294132 - RNA, 20 nt, Homo sapiens
ugagcacugcguacaaacau

SEQ ID NO: 1294133 - RNA, 14 nt, Homo sapiens
ugagcagcuuuucu

SEQ ID NO: 1294134 - RNA, 15 nt, Homo sapiens
ugagcaucccaggau

SEQ ID NO: 1294135 - RNA, 13 nt, Homo sapiens
ugagcauccucuc

SEQ ID NO: 1294136 - RNA, 12 nt, Homo sapiens
ugagcaugugau

SEQ ID NO: 1294137 - RNA, 13 nt, Homo sapiens
ugagccacugcac

SEQ ID NO: 1294138 - RNA, 13 nt, Homo sapiens
ugagccaguguca

SEQ ID NO: 1294139 - RNA, 22 nt, Homo sapiens
ugagcccagcugggucaggcag

SEQ ID NO: 1294140 - RNA, 16 nt, Homo sapiens
ugagcuauaacuuacu

SEQ ID NO: 1294141 - RNA, 18 nt, Homo sapiens
ugagcuauugcuguucuc

SEQ ID NO: 1294142 - RNA, 21 nt, Homo sapiens
ugagcuauugcuguucucuug

SEQ ID NO: 1294143 - RNA, 23 nt, Homo sapiens
ugagcucccaggugcagccagag

SEQ ID NO: 1294144 - RNA, 16 nt, Homo sapiens
ugaggaagugaacauu

SEQ ID NO: 1294145 - RNA, 14 nt, Homo sapiens
ugaggaauguauau

SEQ ID NO: 1294146 - RNA, 16 nt, Homo sapiens
ugaggauaaauugcca

SEQ ID NO: 1294147 - RNA, 18 nt, Homo sapiens
ugaggauaaauugccaua

SEQ ID NO: 1294148 - RNA, 18 nt, Homo sapiens
ugaggcaagagaauuacu

SEQ ID NO: 1294149 - RNA, 13 nt, Homo sapiens
ugaggcaguucca

SEQ ID NO: 1294150 - RNA, 21 nt, Homo sapiens
ugaggcauccacuucuuucag

SEQ ID NO: 1294151 - RNA, 13 nt, Homo sapiens
ugaggcaugccca

SEQ ID NO: 1294152 - RNA, 19 nt, Homo sapiens
ugaggcauuuccagacuug

SEQ ID NO: 1294153 - RNA, 21 nt, Homo sapiens
ugaggcggguggaucacuuga

SEQ ID NO: 1294154 - RNA, 11 nt, Homo sapiens
ugaggcucacg

SEQ ID NO: 1294155 - RNA, 17 nt, Homo sapiens
ugaggcuuagcuuugcu

SEQ ID NO: 1294156 - RNA, 15 nt, Homo sapiens
ugagggccugcugga

SEQ ID NO: 1294157 - RNA, 19 nt, Homo sapiens
ugaggguaucugacaaugc

SEQ ID NO: 1294158 - RNA, 20 nt, Homo sapiens
ugaggguaucugacaaugcu

SEQ ID NO: 1294159 - RNA, 16 nt, Homo sapiens
ugagggugacagccac

SEQ ID NO: 1294160 - RNA, 21 nt, Homo sapiens
ugaggguguuucuuccugcac

SEQ ID NO: 1294161 - RNA, 18 nt, Homo sapiens
ugaguaacaggugccuuc

SEQ ID NO: 1294162 - RNA, 18 nt, Homo sapiens
ugaguaauacaucaaaga

SEQ ID NO: 1294163 - RNA, 19 nt, Homo sapiens
ugaguagaaaggccuuuaa

SEQ ID NO: 1294164 - RNA, 17 nt, Homo sapiens
ugaguagcucuccugac

SEQ ID NO: 1294165 - RNA, 14 nt, Homo sapiens
ugagucgaggacag

SEQ ID NO: 1294166 - RNA, 14 nt, Homo sapiens
ugagucugugccac

SEQ ID NO: 1294167 - RNA, 17 nt, Homo sapiens
ugagugaaccuguauaa

SEQ ID NO: 1294168 - RNA, 20 nt, Homo sapiens
ugagugggugcauauguaca

SEQ ID NO: 1294169 - RNA, 22 nt, Homo sapiens
ugaguuucuggcucuugaggca

SEQ ID NO: 1294170 - RNA, 15 nt, Homo sapiens
ugauaaagcacagcu

SEQ ID NO: 1294171 - RNA, 20 nt, Homo sapiens
ugauaacuagauggugcuga

SEQ ID NO: 1294172 - RNA, 22 nt, Homo sapiens
ugauaagagggcacacacugug

SEQ ID NO: 1294173 - RNA, 20 nt, Homo sapiens
ugauacaaauugcagacugu

SEQ ID NO: 1294174 - RNA, 22 nt, Homo sapiens
ugauacaaauugcagacugugu

SEQ ID NO: 1294175 - RNA, 18 nt, Homo sapiens
cugcugcuccagugcagg

SEQ ID NO: 1294176 - RNA, 14 nt, Homo sapiens
cugcugucuuguug

SEQ ID NO: 1294177 - RNA, 14 nt, Homo sapiens
cugcuugaccaaag

SEQ ID NO: 1294178 - RNA, 16 nt, Homo sapiens
cugcuugaccaaagag

SEQ ID NO: 1294179 - RNA, 20 nt, Homo sapiens
cugcuugagucagguuugag

SEQ ID NO: 1294180 - RNA, 23 nt, Homo sapiens
cugcuugccauucucuugcauug

SEQ ID NO: 1294181 - RNA, 18 nt, Homo sapiens
cugcuuuuugcuucuuga

SEQ ID NO: 1294182 - RNA, 14 nt, Homo sapiens
cuggaacagauuca

SEQ ID NO: 1294183 - RNA, 20 nt, Homo sapiens
cuggaacagauucacacugu

SEQ ID NO: 1294184 - RNA, 16 nt, Homo sapiens
cuggaaccugcaaaaa

SEQ ID NO: 1294185 - RNA, 17 nt, Homo sapiens
cuggaaccugcaaaaaa

SEQ ID NO: 1294186 - RNA, 17 nt, Homo sapiens
cuggaagcuaauuugca

SEQ ID NO: 1294187 - RNA, 13 nt, Homo sapiens
cuggaaggcuucc

SEQ ID NO: 1294188 - RNA, 15 nt, Homo sapiens
cuggaaucacauucu

SEQ ID NO: 1294189 - RNA, 17 nt, Homo sapiens
cuggaaucacauucuua

SEQ ID NO: 1294190 - RNA, 17 nt, Homo sapiens
cuggaaucuggagacca

SEQ ID NO: 1294191 - RNA, 13 nt, Homo sapiens
cuggacucucagu

SEQ ID NO: 1294192 - RNA, 12 nt, Homo sapiens
cuggacugaccu

SEQ ID NO: 1294193 - RNA, 20 nt, Homo sapiens
cuggagcccauccagucucc

SEQ ID NO: 1294194 - RNA, 15 nt, Homo sapiens
cuggaggaacacuug

SEQ ID NO: 1294195 - RNA, 17 nt, Homo sapiens
cuggaggacggucaguc

SEQ ID NO: 1294196 - RNA, 17 nt, Homo sapiens
cuggaggaguuccuuga

SEQ ID NO: 1294197 - RNA, 21 nt, Homo sapiens
cuggaggcagaaucccggcug

SEQ ID NO: 1294198 - RNA, 17 nt, Homo sapiens
cuggaggcugagcugca

SEQ ID NO: 1294199 - RNA, 19 nt, Homo sapiens
cuggaggcugagcugcauc

SEQ ID NO: 1294200 - RNA, 20 nt, Homo sapiens
cuggaguggaguggcgugau

SEQ ID NO: 1294201 - RNA, 22 nt, Homo sapiens
cuggaguugaucuggaacccag

SEQ ID NO: 1294202 - RNA, 19 nt, Homo sapiens
cuggaugauggucuucagc

SEQ ID NO: 1294203 - RNA, 13 nt, Homo sapiens
cuggaugccugau

SEQ ID NO: 1294204 - RNA, 14 nt, Homo sapiens
cuggcaacacagag

SEQ ID NO: 1294205 - RNA, 19 nt, Homo sapiens
cuggcauuugcaccuaccu

SEQ ID NO: 1294206 - RNA, 19 nt, Homo sapiens
cuggccagccuacaauggg

SEQ ID NO: 1294207 - RNA, 23 nt, Homo sapiens
cuggccagggccuggaagacaga

SEQ ID NO: 1294208 - RNA, 15 nt, Homo sapiens
cuggccugagaguca

SEQ ID NO: 1294209 - RNA, 20 nt, Homo sapiens
cuggcucccucuucuuucag

SEQ ID NO: 1294210 - RNA, 15 nt, Homo sapiens
cuggcuccuucacca

SEQ ID NO: 1294211 - RNA, 21 nt, Homo sapiens
cuggcugugcuaccugagcca

SEQ ID NO: 1294212 - RNA, 14 nt, Homo sapiens
cuggcuucuggcca

SEQ ID NO: 1294213 - RNA, 15 nt, Homo sapiens
cuggcuuuccagcuu

SEQ ID NO: 1294214 - RNA, 21 nt, Homo sapiens
cugggauccuaagggcucacc

SEQ ID NO: 1294215 - RNA, 23 nt, Homo sapiens
cugggcaaggaggccacgugaug

SEQ ID NO: 1294216 - RNA, 14 nt, Homo sapiens
cugggcacagucag

SEQ ID NO: 1294217 - RNA, 18 nt, Homo sapiens
cugggcagcauacugaga

SEQ ID NO: 1294218 - RNA, 20 nt, Homo sapiens
cugggccauucuccacagca

SEQ ID NO: 1294219 - RNA, 23 nt, Homo sapiens
cugggcucgccacaucccaugag

SEQ ID NO: 1294220 - RNA, 19 nt, Homo sapiens
cugggcugcagagacugga

SEQ ID NO: 1294221 - RNA, 15 nt, Homo sapiens
cuggggcaaugggag

SEQ ID NO: 1294222 - RNA, 14 nt, Homo sapiens
cugggucagugguc

SEQ ID NO: 1294223 - RNA, 16 nt, Homo sapiens
cugggucucugcaaac

SEQ ID NO: 1294224 - RNA, 15 nt, Homo sapiens
cugguaaucuugcuc

SEQ ID NO: 1294225 - RNA, 19 nt, Homo sapiens
cugguaccgagccccugaa

SEQ ID NO: 1294226 - RNA, 20 nt, Homo sapiens
cugguaccgagccccugaac

SEQ ID NO: 1294227 - RNA, 22 nt, Homo sapiens
cugguccacagggcaccugcca

SEQ ID NO: 1294228 - RNA, 13 nt, Homo sapiens
cugguuagguaga

SEQ ID NO: 1294229 - RNA, 14 nt, Homo sapiens
cugguucugaugau

SEQ ID NO: 1294230 - RNA, 18 nt, Homo sapiens
cugguuugucaaacaaca

SEQ ID NO: 1294231 - RNA, 23 nt, Homo sapiens
cuguaaaaucuuucuuucuuaga

SEQ ID NO: 1294232 - RNA, 20 nt, Homo sapiens
cuguaacacauaguggcuuc

SEQ ID NO: 1294233 - RNA, 14 nt, Homo sapiens
cuguaaccucuuca

SEQ ID NO: 1294234 - RNA, 17 nt, Homo sapiens
cuguaaucccagcacuu

SEQ ID NO: 1294235 - RNA, 18 nt, Homo sapiens
cuguaaucccagcauuuu

SEQ ID NO: 1294236 - RNA, 18 nt, Homo sapiens
cuguaguuuggagacaaa

SEQ ID NO: 1294237 - RNA, 16 nt, Homo sapiens
cuguauauacaauaac

SEQ ID NO: 1294238 - RNA, 19 nt, Homo sapiens
cuguaucuuguuuuuccac

SEQ ID NO: 1294239 - RNA, 18 nt, Homo sapiens
cuguauucccaguuacuu

SEQ ID NO: 1294240 - RNA, 15 nt, Homo sapiens
cuguauucugaccca

SEQ ID NO: 1294241 - RNA, 12 nt, Homo sapiens
cugucaaacaaa

SEQ ID NO: 1294242 - RNA, 17 nt, Homo sapiens
cugucaaggcugcuuag

SEQ ID NO: 1294243 - RNA, 19 nt, Homo sapiens
cugucacccagacuggagu

SEQ ID NO: 1294244 - RNA, 17 nt, Homo sapiens
cugucacuacaauuuaa

SEQ ID NO: 1294245 - RNA, 16 nt, Homo sapiens
cugucaggauucaguu

SEQ ID NO: 1294246 - RNA, 15 nt, Homo sapiens
cugucagucacagcc

SEQ ID NO: 1294247 - RNA, 16 nt, Homo sapiens
cugucauuuugcacug

SEQ ID NO: 1294248 - RNA, 18 nt, Homo sapiens
cugucauuuugcacugua

SEQ ID NO: 1294249 - RNA, 20 nt, Homo sapiens
cugucauuuugcacuguaaa

SEQ ID NO: 1294250 - RNA, 14 nt, Homo sapiens
cuguccagugccua

SEQ ID NO: 1294251 - RNA, 18 nt, Homo sapiens
cugucccccaacacugag

SEQ ID NO: 1294252 - RNA, 17 nt, Homo sapiens
cuguccccuucucucau

SEQ ID NO: 1294253 - RNA, 19 nt, Homo sapiens
cugucccuugcuguaugcu

SEQ ID NO: 1294254 - RNA, 18 nt, Homo sapiens
cuguccucaagauggagg

SEQ ID NO: 1294255 - RNA, 15 nt, Homo sapiens
cuguccucagccuug

SEQ ID NO: 1294256 - RNA, 20 nt, Homo sapiens
cuguccucagccuugccaga

SEQ ID NO: 1294257 - RNA, 17 nt, Homo sapiens
cuguccuccagcugucu

SEQ ID NO: 1294258 - RNA, 15 nt, Homo sapiens
cugucuccuuucacc

SEQ ID NO: 1294259 - RNA, 15 nt, Homo sapiens
cugucugcccugaac

SEQ ID NO: 1294260 - RNA, 16 nt, Homo sapiens
cugucuuccucugcaa

SEQ ID NO: 1294261 - RNA, 14 nt, Homo sapiens
cugucuugucuccc

SEQ ID NO: 1294262 - RNA, 14 nt, Homo sapiens
cugugaacagcuug

SEQ ID NO: 1294263 - RNA, 22 nt, Homo sapiens
cugugaauugccuguaacacau

SEQ ID NO: 1294264 - RNA, 18 nt, Homo sapiens
cugugagccggagcucau

SEQ ID NO: 1294265 - RNA, 22 nt, Homo sapiens
cugugaugugaagacaccugca

SEQ ID NO: 1294266 - RNA, 19 nt, Homo sapiens
cugugcacaaaacccagac

SEQ ID NO: 1294267 - RNA, 18 nt, Homo sapiens
cugugcacugcccaugga

SEQ ID NO: 1294268 - RNA, 22 nt, Homo sapiens
cugugcagguggggagacuggg

SEQ ID NO: 1294269 - RNA, 16 nt, Homo sapiens
cauccagguucagcuu

SEQ ID NO: 1294270 - RNA, 14 nt, Homo sapiens
cauccauauugcac

SEQ ID NO: 1294271 - RNA, 22 nt, Homo sapiens
cauccaucauaaccaccccagc

SEQ ID NO: 1294272 - RNA, 13 nt, Homo sapiens
caucccaggaucg

SEQ ID NO: 1294273 - RNA, 20 nt, Homo sapiens
cauccccuuacccuuagaau

SEQ ID NO: 1294274 - RNA, 13 nt, Homo sapiens
cauccgcacugua

SEQ ID NO: 1294275 - RNA, 14 nt, Homo sapiens
cauccgcacuguaa

SEQ ID NO: 1294276 - RNA, 15 nt, Homo sapiens
cauccuuuacguguu

SEQ ID NO: 1294277 - RNA, 22 nt, Homo sapiens
caucgaaucuacuaauuccaca

SEQ ID NO: 1294278 - RNA, 13 nt, Homo sapiens
caucggucaugug

SEQ ID NO: 1294279 - RNA, 19 nt, Homo sapiens
caucguuuucuucacuguc

SEQ ID NO: 1294280 - RNA, 13 nt, Homo sapiens
caucuaagcccau

SEQ ID NO: 1294281 - RNA, 13 nt, Homo sapiens
caucuaauaugau

SEQ ID NO: 1294282 - RNA, 19 nt, Homo sapiens
caucuauucucuccaaaaa

SEQ ID NO: 1294283 - RNA, 13 nt, Homo sapiens
caucucagugcag

SEQ ID NO: 1294284 - RNA, 15 nt, Homo sapiens
caucucagugcagga

SEQ ID NO: 1294285 - RNA, 23 nt, Homo sapiens
caucucucccuccccugccauuu

SEQ ID NO: 1294286 - RNA, 17 nt, Homo sapiens
caucucuggaugccuga

SEQ ID NO: 1294287 - RNA, 22 nt, Homo sapiens
caucugaucccagccaaggagg

SEQ ID NO: 1294288 - RNA, 22 nt, Homo sapiens
caucugcuuuucccauugccau

SEQ ID NO: 1294289 - RNA, 18 nt, Homo sapiens
caucuggaaucugaggca

SEQ ID NO: 1294290 - RNA, 15 nt, Homo sapiens
caucuggaaucugga

SEQ ID NO: 1294291 - RNA, 15 nt, Homo sapiens
caucuuccauuucca

SEQ ID NO: 1294292 - RNA, 21 nt, Homo sapiens
caucuugaccaagcaggaagc

SEQ ID NO: 1294293 - RNA, 19 nt, Homo sapiens
caucuuguaggaucuacuu

SEQ ID NO: 1294294 - RNA, 12 nt, Homo sapiens
caucuuucacau

SEQ ID NO: 1294295 - RNA, 23 nt, Homo sapiens
caucuuuccuucggguuggcaaa

SEQ ID NO: 1294296 - RNA, 14 nt, Homo sapiens
caucuuuucuugcc

SEQ ID NO: 1294297 - RNA, 18 nt, Homo sapiens
caugaaaguggacaagga

SEQ ID NO: 1294298 - RNA, 15 nt, Homo sapiens
caugaaauacugugc

SEQ ID NO: 1294299 - RNA, 14 nt, Homo sapiens
caugaaauaugcau

SEQ ID NO: 1294300 - RNA, 19 nt, Homo sapiens
caugagauucauucaguua

SEQ ID NO: 1294301 - RNA, 14 nt, Homo sapiens
cuuaaugcucugau

SEQ ID NO: 1294302 - RNA, 21 nt, Homo sapiens
cuuaauggaagguuggaucca

SEQ ID NO: 1294303 - RNA, 19 nt, Homo sapiens
cuuaaugucuuuaaaagua

SEQ ID NO: 1294304 - RNA, 18 nt, Homo sapiens
cuuacuguagccucagau

SEQ ID NO: 1294305 - RNA, 23 nt, Homo sapiens
cuuacuuggcuuuuuacuauuaa

SEQ ID NO: 1294306 - RNA, 15 nt, Homo sapiens
cuuagaccuauggca

SEQ ID NO: 1294307 - RNA, 13 nt, Homo sapiens
cuuagauugccuc

SEQ ID NO: 1294308 - RNA, 22 nt, Homo sapiens
cuuagccauuuuucaaagcaau

SEQ ID NO: 1294309 - RNA, 23 nt, Homo sapiens
cuuagccauuuuucaaagcaauu

SEQ ID NO: 1294310 - RNA, 21 nt, Homo sapiens
cuuagcuaguuuuauucuugg

SEQ ID NO: 1294311 - RNA, 23 nt, Homo sapiens
cuuaggccuuccucucuccagau

SEQ ID NO: 1294312 - RNA, 23 nt, Homo sapiens
cuuaguccaauuccuugcacaua

SEQ ID NO: 1294313 - RNA, 12 nt, Homo sapiens
cuuagugacaaa

SEQ ID NO: 1294314 - RNA, 19 nt, Homo sapiens
cuuaguuaucaguccuguc

SEQ ID NO: 1294315 - RNA, 18 nt, Homo sapiens
cuuauaagaaagaucaaa

SEQ ID NO: 1294316 - RNA, 14 nt, Homo sapiens
cuuauaauuugcau

SEQ ID NO: 1294317 - RNA, 19 nt, Homo sapiens
cuuauaauuugcauaccau

SEQ ID NO: 1294318 - RNA, 15 nt, Homo sapiens
cuuauacugcuguaa

SEQ ID NO: 1294319 - RNA, 14 nt, Homo sapiens
cuuauauucaucca

SEQ ID NO: 1294320 - RNA, 18 nt, Homo sapiens
cuuauauucauccaugcc

SEQ ID NO: 1294321 - RNA, 23 nt, Homo sapiens
cuuaucgggcuccagccaucuca

SEQ ID NO: 1294322 - RNA, 18 nt, Homo sapiens
cuuaucuccaagaccaga

SEQ ID NO: 1294323 - RNA, 17 nt, Homo sapiens
cuuaugaucaccaugua

SEQ ID NO: 1294324 - RNA, 16 nt, Homo sapiens
cuuaugcuucuuucaa

SEQ ID NO: 1294325 - RNA, 14 nt, Homo sapiens
cuuauuaauacaaa

SEQ ID NO: 1294326 - RNA, 22 nt, Homo sapiens
cuucaacaaccggccaccagau

SEQ ID NO: 1294327 - RNA, 22 nt, Homo sapiens
cuucaaggcccauaucugugaa

SEQ ID NO: 1294328 - RNA, 19 nt, Homo sapiens
cuucacaaaaucuguuuag

SEQ ID NO: 1294329 - RNA, 17 nt, Homo sapiens
cuucacagaugccuacu

SEQ ID NO: 1294330 - RNA, 17 nt, Homo sapiens
cuucacccuggagccca

SEQ ID NO: 1294331 - RNA, 20 nt, Homo sapiens
cuucagcagcacccauguaa

SEQ ID NO: 1294332 - RNA, 21 nt, Homo sapiens
cuucaggaaccucgaguacug

SEQ ID NO: 1294333 - RNA, 13 nt, Homo sapiens
cuucagugcugcu

SEQ ID NO: 1294334 - RNA, 13 nt, Homo sapiens
cuucauagguaga

SEQ ID NO: 1294335 - RNA, 22 nt, Homo sapiens
cuucaugcaggugaaacccagu

SEQ ID NO: 1294336 - RNA, 21 nt, Homo sapiens
cuuccacuuggcuacacaggg

SEQ ID NO: 1294337 - RNA, 14 nt, Homo sapiens
cuuccagaaaacaa

SEQ ID NO: 1294338 - RNA, 17 nt, Homo sapiens
cuuccagaaaacaaaac

SEQ ID NO: 1294339 - RNA, 14 nt, Homo sapiens
cuuccagagucauc

SEQ ID NO: 1294340 - RNA, 21 nt, Homo sapiens
cuuccagggauuugccucacc

SEQ ID NO: 1294341 - RNA, 23 nt, Homo sapiens
cuuccagguguuacuguaauucc

SEQ ID NO: 1294342 - RNA, 14 nt, Homo sapiens
cuuccccugccucc

SEQ ID NO: 1294343 - RNA, 19 nt, Homo sapiens
cuucccgaaccccaaggag

SEQ ID NO: 1294344 - RNA, 20 nt, Homo sapiens
cuucccggcgucccuaccuc

SEQ ID NO: 1294345 - RNA, 21 nt, Homo sapiens
cuucccucucugcagacuucc

SEQ ID NO: 1294346 - RNA, 22 nt, Homo sapiens
cuuccguauccaucgaagcaga

SEQ ID NO: 1294347 - RNA, 21 nt, Homo sapiens
cuuccuaaauauuaugagaug

SEQ ID NO: 1294348 - RNA, 14 nt, Homo sapiens
cuuccuaagccugu

SEQ ID NO: 1294349 - RNA, 19 nt, Homo sapiens
cuuccuaagccuguggcug

SEQ ID NO: 1294350 - RNA, 13 nt, Homo sapiens
cuuccucacacca

SEQ ID NO: 1294351 - RNA, 20 nt, Homo sapiens
cuuccuccagggacucuggg

SEQ ID NO: 1294352 - RNA, 15 nt, Homo sapiens
cuuccuguguccuga

SEQ ID NO: 1294353 - RNA, 20 nt, Homo sapiens
cuuccuuaugcuucuuucaa

SEQ ID NO: 1294354 - RNA, 12 nt, Homo sapiens
cuuccuuccucu

SEQ ID NO: 1294355 - RNA, 18 nt, Homo sapiens
cuuccuuccucucugcaa

SEQ ID NO: 1294356 - RNA, 15 nt, Homo sapiens
cuuccuuccucuugc

SEQ ID NO: 1294357 - RNA, 16 nt, Homo sapiens
cuucgaccuacugaaa

SEQ ID NO: 1294358 - RNA, 19 nt, Homo sapiens
cuucgccagccuccaaugu

SEQ ID NO: 1294359 - RNA, 21 nt, Homo sapiens
cuucgggaagaaggggacaau

SEQ ID NO: 1294360 - RNA, 22 nt, Homo sapiens
cuucguuuacuaugccuguguc

SEQ ID NO: 1294361 - RNA, 15 nt, Homo sapiens
cuucuagaugccacu

SEQ ID NO: 1294362 - RNA, 22 nt, Homo sapiens
cuucuaggauagcuaacuguaa

SEQ ID NO: 1294363 - RNA, 18 nt, Homo sapiens
cuucuaggguuauugcau

SEQ ID NO: 1294364 - RNA, 16 nt, Homo sapiens
cuucucaaaccuccaa

SEQ ID NO: 1294365 - RNA, 18 nt, Homo sapiens
cuucucaccagcugcaaa

SEQ ID NO: 1294366 - RNA, 10 nt, Homo sapiens
cuucugccau

SEQ ID NO: 1294367 - RNA, 12 nt, Homo sapiens
cuucugcuaaaa

SEQ ID NO: 1294368 - RNA, 14 nt, Homo sapiens
cuucuggccaggaa

SEQ ID NO: 1294369 - RNA, 15 nt, Homo sapiens
cuucuggcugugcua

SEQ ID NO: 1294370 - RNA, 21 nt, Homo sapiens
cuucugucccucacagcacua

SEQ ID NO: 1294371 - RNA, 15 nt, Homo sapiens
cuucuguccuacucu

SEQ ID NO: 1294372 - RNA, 12 nt, Homo sapiens
cuucuuacugau

SEQ ID NO: 1294373 - RNA, 18 nt, Homo sapiens
cuucuuuagaacagggaa

SEQ ID NO: 1294374 - RNA, 23 nt, Homo sapiens
cuucuuucagacuugccauguga

SEQ ID NO: 1294375 - RNA, 20 nt, Homo sapiens
cuugaaauuaagaaggcaaa

SEQ ID NO: 1294376 - RNA, 14 nt, Homo sapiens
cuugaaucaggacu

SEQ ID NO: 1294377 - RNA, 22 nt, Homo sapiens
cuugaauuuuuuuaauuuacac

SEQ ID NO: 1294378 - RNA, 18 nt, Homo sapiens
cuugacccccuugagggu

SEQ ID NO: 1294379 - RNA, 21 nt, Homo sapiens
cuugagaaaccuuauuguacc

SEQ ID NO: 1294380 - RNA, 21 nt, Homo sapiens
cuugauagaaaugccaagcac

SEQ ID NO: 1294381 - RNA, 19 nt, Homo sapiens
cuugcaggcagaaggcagu

SEQ ID NO: 1294382 - RNA, 19 nt, Homo sapiens
cuugcauccaaaccuguaa

SEQ ID NO: 1294383 - RNA, 11 nt, Homo sapiens
cuugccucuuc

SEQ ID NO: 1294384 - RNA, 19 nt, Homo sapiens
cuugccuuccuaagccugu

SEQ ID NO: 1294385 - RNA, 16 nt, Homo sapiens
cuugcuccauuuacaa

SEQ ID NO: 1294386 - RNA, 21 nt, Homo sapiens
cuugcucuaagucaaauucca

SEQ ID NO: 1294387 - RNA, 16 nt, Homo sapiens
cuugcugaugaaaugg

SEQ ID NO: 1294388 - RNA, 23 nt, Homo sapiens
cuuggaggacccagcacugaccc

SEQ ID NO: 1294389 - RNA, 19 nt, Homo sapiens
cuuggaggccagccaguga

SEQ ID NO: 1294390 - RNA, 16 nt, Homo sapiens
cuuggagugugugaua

SEQ ID NO: 1294391 - RNA, 24 nt, Homo sapiens
cuuggcacauuuaagagacaguca

SEQ ID NO: 1294392 - RNA, 15 nt, Homo sapiens
cuuggcagcaccugu

SEQ ID NO: 1294393 - RNA, 19 nt, Homo sapiens
gaaaguauguaccaaaaca

SEQ ID NO: 1294394 - RNA, 17 nt, Homo sapiens
gaaaguauucuguacuc

SEQ ID NO: 1294395 - RNA, 15 nt, Homo sapiens
gaaaguucauggaac

SEQ ID NO: 1294396 - RNA, 20 nt, Homo sapiens
gaaauaaaaaaugaaaaaca

SEQ ID NO: 1294397 - RNA, 14 nt, Homo sapiens
gaaauaaccacugc

SEQ ID NO: 1294398 - RNA, 16 nt, Homo sapiens
gaaauacagucuucca

SEQ ID NO: 1294399 - RNA, 22 nt, Homo sapiens
gaaauagcggugaaucuaguga

SEQ ID NO: 1294400 - RNA, 20 nt, Homo sapiens
gaaauaguacuuacaaauga

SEQ ID NO: 1294401 - RNA, 22 nt, Homo sapiens
gaaauaguacuuacaaaugacu

SEQ ID NO: 1294402 - RNA, 22 nt, Homo sapiens
gaaauauggaacuuacauuguu

SEQ ID NO: 1294403 - RNA, 15 nt, Homo sapiens
gaaaucgaugagaaa

SEQ ID NO: 1294404 - RNA, 16 nt, Homo sapiens
gaaaugauuaauuuga

SEQ ID NO: 1294405 - RNA, 14 nt, Homo sapiens
gaaaugcauugcuc

SEQ ID NO: 1294406 - RNA, 19 nt, Homo sapiens
gaaaugugcaaccacugcu

SEQ ID NO: 1294407 - RNA, 22 nt, Homo sapiens
gaaauguggucaucaaagauga

SEQ ID NO: 1294408 - RNA, 14 nt, Homo sapiens
gaaauuagucuauu

SEQ ID NO: 1294409 - RNA, 19 nt, Homo sapiens
gaaauucucaucaguccau

SEQ ID NO: 1294410 - RNA, 21 nt, Homo sapiens
gaaauuuaaaagcagagcauu

SEQ ID NO: 1294411 - RNA, 20 nt, Homo sapiens
gaaauuuaauucauguuucu

SEQ ID NO: 1294412 - RNA, 18 nt, Homo sapiens
gaacaaaaaaaucugcag

SEQ ID NO: 1294413 - RNA, 21 nt, Homo sapiens
gaacaacuaguugucaacuaa

SEQ ID NO: 1294414 - RNA, 15 nt, Homo sapiens
gaacacaaagaccaa

SEQ ID NO: 1294415 - RNA, 18 nt, Homo sapiens
gaacacucuuuugcuuua

SEQ ID NO: 1294416 - RNA, 20 nt, Homo sapiens
gaacacucuuuugcuuuauu

SEQ ID NO: 1294417 - RNA, 20 nt, Homo sapiens
gaacagccagguagagcccu

SEQ ID NO: 1294418 - RNA, 21 nt, Homo sapiens
gaacaggaaugcugggcuguu

SEQ ID NO: 1294419 - RNA, 16 nt, Homo sapiens
gaacaguaacugccau

SEQ ID NO: 1294420 - RNA, 17 nt, Homo sapiens
gaacaguaugaauuuga

SEQ ID NO: 1294421 - RNA, 20 nt, Homo sapiens
gaacagucauuaauuuucaa

SEQ ID NO: 1294422 - RNA, 17 nt, Homo sapiens
gaacauuaguugcacua

SEQ ID NO: 1294423 - RNA, 21 nt, Homo sapiens
gaacauuucaguugccauuga

SEQ ID NO: 1294424 - RNA, 19 nt, Homo sapiens
gaacauuuuaauucauccc

SEQ ID NO: 1294425 - RNA, 19 nt, Homo sapiens
gaaccaaaagaauuugcac

SEQ ID NO: 1294426 - RNA, 17 nt, Homo sapiens
gaaccaugguaugaagg

SEQ ID NO: 1294427 - RNA, 21 nt, Homo sapiens
gaaccguaggacccaagcaga

SEQ ID NO: 1294428 - RNA, 15 nt, Homo sapiens
gaacgaguuguuggc

SEQ ID NO: 1294429 - RNA, 17 nt, Homo sapiens
gaacuaaacucauuuau

SEQ ID NO: 1294430 - RNA, 17 nt, Homo sapiens
gaacuauguaaaugacu

SEQ ID NO: 1294431 - RNA, 17 nt, Homo sapiens
gaacuauuguggguuuu

SEQ ID NO: 1294432 - RNA, 14 nt, Homo sapiens
gaacucacuggggc

SEQ ID NO: 1294433 - RNA, 13 nt, Homo sapiens
gaacucagaucca

SEQ ID NO: 1294434 - RNA, 15 nt, Homo sapiens
gaacucuagccaaau

SEQ ID NO: 1294435 - RNA, 14 nt, Homo sapiens
gaacucugguggca

SEQ ID NO: 1294436 - RNA, 19 nt, Homo sapiens
gaacucuucacucuucaaa

SEQ ID NO: 1294437 - RNA, 19 nt, Homo sapiens
gaacugagaccuccagaaa

SEQ ID NO: 1294438 - RNA, 24 nt, Homo sapiens
gaacugcguuaugaagagcuaauu

SEQ ID NO: 1294439 - RNA, 16 nt, Homo sapiens
gaacugugugucucau

SEQ ID NO: 1294440 - RNA, 19 nt, Homo sapiens
gaacuuacuguagccucag

SEQ ID NO: 1294441 - RNA, 19 nt, Homo sapiens
gaacuugugagaacacagc

SEQ ID NO: 1294442 - RNA, 21 nt, Homo sapiens
gaacuuugcauagcagcugcu

SEQ ID NO: 1294443 - RNA, 13 nt, Homo sapiens
gaagaaaagaucu

SEQ ID NO: 1294444 - RNA, 23 nt, Homo sapiens
gaagaagguaggagaaagggcgg

SEQ ID NO: 1294445 - RNA, 14 nt, Homo sapiens
gaagaaucuguuuc

SEQ ID NO: 1294446 - RNA, 22 nt, Homo sapiens
gaagacaucuuauccauccuca

SEQ ID NO: 1294447 - RNA, 19 nt, Homo sapiens
gaagaguuaagaagaaaau

SEQ ID NO: 1294448 - RNA, 14 nt, Homo sapiens
gaagauagccagag

SEQ ID NO: 1294449 - RNA, 18 nt, Homo sapiens
gaagcagaagugcaaucc

SEQ ID NO: 1294450 - RNA, 18 nt, Homo sapiens
gaagccacaggccugaga

SEQ ID NO: 1294451 - RNA, 20 nt, Homo sapiens
gaagccacuauuacugggac

SEQ ID NO: 1294452 - RNA, 12 nt, Homo sapiens
gaagcccagcau

SEQ ID NO: 1294453 - RNA, 14 nt, Homo sapiens
gaagccgugcccug

SEQ ID NO: 1294454 - RNA, 17 nt, Homo sapiens
gaagccuauguaugcca

SEQ ID NO: 1294455 - RNA, 16 nt, Homo sapiens
gaagcuguucucagga

SEQ ID NO: 1294456 - RNA, 16 nt, Homo sapiens
gaagcuuccuuggcuu

SEQ ID NO: 1294457 - RNA, 14 nt, Homo sapiens
gaaggaacuuccag

SEQ ID NO: 1294458 - RNA, 15 nt, Homo sapiens
gaaggagacaggcag

SEQ ID NO: 1294459 - RNA, 20 nt, Homo sapiens
gaaggcaugacacaccuggg

SEQ ID NO: 1294460 - RNA, 14 nt, Homo sapiens
gaaggccuucagga

SEQ ID NO: 1294461 - RNA, 19 nt, Homo sapiens
gaagggugccgcgagccag

SEQ ID NO: 1294462 - RNA, 13 nt, Homo sapiens
gaagguuaaguca

SEQ ID NO: 1294463 - RNA, 13 nt, Homo sapiens
gaagguugcaccu

SEQ ID NO: 1294464 - RNA, 19 nt, Homo sapiens
gaaguaagccucaucauca

SEQ ID NO: 1294465 - RNA, 13 nt, Homo sapiens
gaaguagauucug

SEQ ID NO: 1294466 - RNA, 18 nt, Homo sapiens
gaagucuaaaagcagaaa

SEQ ID NO: 1294467 - RNA, 19 nt, Homo sapiens
gaagucucaggagucucug

SEQ ID NO: 1294468 - RNA, 21 nt, Homo sapiens
gaagugaccuggaaucaguga

SEQ ID NO: 1294469 - RNA, 13 nt, Homo sapiens
gaagugccaucuc

SEQ ID NO: 1294470 - RNA, 14 nt, Homo sapiens
gaaguuauuuucca

SEQ ID NO: 1294471 - RNA, 13 nt, Homo sapiens
gaaguuuuacuag

SEQ ID NO: 1294472 - RNA, 14 nt, Homo sapiens
gaauaaacaaaauu

SEQ ID NO: 1294473 - RNA, 18 nt, Homo sapiens
gaauacacuuaacauaga

SEQ ID NO: 1294474 - RNA, 23 nt, Homo sapiens
gaauacagcuuucugaccuucag

SEQ ID NO: 1294475 - RNA, 13 nt, Homo sapiens
gaauacuauguau

SEQ ID NO: 1294476 - RNA, 23 nt, Homo sapiens
gaauacucauucgucuacucuga

SEQ ID NO: 1294477 - RNA, 20 nt, Homo sapiens
gaauacucugcccucuagag

SEQ ID NO: 1294478 - RNA, 14 nt, Homo sapiens
gaauauaauacugu

SEQ ID NO: 1294479 - RNA, 19 nt, Homo sapiens
gaauauaauacuguauuug

SEQ ID NO: 1294480 - RNA, 17 nt, Homo sapiens
gaauauagcaucuuuca

SEQ ID NO: 1294481 - RNA, 18 nt, Homo sapiens
gaauauuauaaagugcuu

SEQ ID NO: 1294482 - RNA, 16 nt, Homo sapiens
gaauauucccaauauu

SEQ ID NO: 1294483 - RNA, 20 nt, Homo sapiens
gaauauuuuaagaauuucac

SEQ ID NO: 1294484 - RNA, 16 nt, Homo sapiens
gaaucaaaugcaauuu

SEQ ID NO: 1294485 - RNA, 22 nt, Homo sapiens
gaaucaacaauaguaacucuuu

SEQ ID NO: 1294486 - RNA, 16 nt, Homo sapiens
gaaucacuucugagaa

SEQ ID NO: 1294487 - RNA, 22 nt, Homo sapiens
gaaucagugaagccaaagggac

SEQ ID NO: 1294488 - RNA, 17 nt, Homo sapiens
gaaucuacuaauuccac

SEQ ID NO: 1294489 - RNA, 20 nt, Homo sapiens
gaaucucuuuuugcuuucga

SEQ ID NO: 1294490 - RNA, 14 nt, Homo sapiens
gaaucuggagacca

SEQ ID NO: 1294491 - RNA, 19 nt, Homo sapiens
gaaucuguagcugugcuuu

SEQ ID NO: 1294492 - RNA, 19 nt, Homo sapiens
gaaucugugggucugggag

SEQ ID NO: 1294493 - RNA, 15 nt, Homo sapiens
gaaugaaagacugaa

SEQ ID NO: 1294494 - RNA, 14 nt, Homo sapiens
gaaugaaccacugc

SEQ ID NO: 1294495 - RNA, 17 nt, Homo sapiens
gaaugcagaggucucca

SEQ ID NO: 1294496 - RNA, 11 nt, Homo sapiens
gaaugcagugg

SEQ ID NO: 1294497 - RNA, 16 nt, Homo sapiens
gaaugcagugguauga

SEQ ID NO: 1294498 - RNA, 14 nt, Homo sapiens
gaauguacucuguu

SEQ ID NO: 1294499 - RNA, 21 nt, Homo sapiens
gaaugugagcacaaugcauaa

SEQ ID NO: 1294500 - RNA, 21 nt, Homo sapiens
gaauguuaaauaaauuguaua

SEQ ID NO: 1294501 - RNA, 13 nt, Homo sapiens
gaauguugguuuu

SEQ ID NO: 1294502 - RNA, 14 nt, Homo sapiens
gaauguuugccucu

SEQ ID NO: 1294503 - RNA, 18 nt, Homo sapiens
gaauguuugucucauccc

SEQ ID NO: 1294504 - RNA, 17 nt, Homo sapiens
gaauuaaaaaagcauac

SEQ ID NO: 1294505 - RNA, 20 nt, Homo sapiens
gaauuauaauuaguuccuca

SEQ ID NO: 1294506 - RNA, 18 nt, Homo sapiens
gaauuauuuaaauuacag

SEQ ID NO: 1294507 - RNA, 13 nt, Homo sapiens
gaauucaaacugg

SEQ ID NO: 1294508 - RNA, 23 nt, Homo sapiens
gaauucuuacauguuuucuuugc

SEQ ID NO: 1294509 - RNA, 17 nt, Homo sapiens
gaauugacaacccaaac

SEQ ID NO: 1294510 - RNA, 14 nt, Homo sapiens
gaauuuauugccuc

SEQ ID NO: 1294511 - RNA, 17 nt, Homo sapiens
gaauuucacaagcuauu

SEQ ID NO: 1294512 - RNA, 19 nt, Homo sapiens
gaauuucacaagcuauuuu

SEQ ID NO: 1294513 - RNA, 12 nt, Homo sapiens
gaauuugagugc

SEQ ID NO: 1294514 - RNA, 13 nt, Homo sapiens
gaauuugcaaagu

SEQ ID NO: 1294515 - RNA, 19 nt, Homo sapiens
gaauuuucucuaacuucaa

SEQ ID NO: 1294516 - RNA, 19 nt, Homo sapiens
gaauuuuugcaauaaugca

SEQ ID NO: 1294517 - RNA, 19 nt, Homo sapiens
gacaaaauauuuuccugcc

SEQ ID NO: 1294518 - RNA, 18 nt, Homo sapiens
gacaaagacaaauucugu

SEQ ID NO: 1294519 - RNA, 14 nt, Homo sapiens
gacaaaggaaucaa

SEQ ID NO: 1294520 - RNA, 13 nt, Homo sapiens
gacaaauucuguu

SEQ ID NO: 1294521 - RNA, 15 nt, Homo sapiens
gacaacagguuuuca

SEQ ID NO: 1294522 - RNA, 16 nt, Homo sapiens
gacaagacucugggga

SEQ ID NO: 1294523 - RNA, 13 nt, Homo sapiens
gacaagauuuaug

SEQ ID NO: 1294524 - RNA, 22 nt, Homo sapiens
gacaaggucaccugggcuguga

SEQ ID NO: 1294525 - RNA, 17 nt, Homo sapiens
gacaaguuccuaggaaa

SEQ ID NO: 1294526 - RNA, 17 nt, Homo sapiens
gacaauauggucccaaa

SEQ ID NO: 1294527 - RNA, 14 nt, Homo sapiens
gacaaucacugcca

SEQ ID NO: 1294528 - RNA, 20 nt, Homo sapiens
gacaaucaugaaauaugcau

SEQ ID NO: 1294529 - RNA, 20 nt, Homo sapiens
gacaauuugcugccaaacac

SEQ ID NO: 1294530 - RNA, 14 nt, Homo sapiens
gacacaaacacaca

SEQ ID NO: 1294531 - RNA, 13 nt, Homo sapiens
gacacagaaaaug

SEQ ID NO: 1294532 - RNA, 17 nt, Homo sapiens
gacacagucaauucuga

SEQ ID NO: 1294533 - RNA, 22 nt, Homo sapiens
gacacauuuagaugcacuacca

SEQ ID NO: 1294534 - RNA, 16 nt, Homo sapiens
gacaccugcagccuuu

SEQ ID NO: 1294535 - RNA, 17 nt, Homo sapiens
gacaccuugacagggca

SEQ ID NO: 1294536 - RNA, 17 nt, Homo sapiens
gacacuaaaaacuguua

SEQ ID NO: 1294537 - RNA, 21 nt, Homo sapiens
gacacuauuuaucugugcaaa

SEQ ID NO: 1294538 - RNA, 22 nt, Homo sapiens
gacacucuauaagauuccaaaa

SEQ ID NO: 1294539 - RNA, 19 nt, Homo sapiens
gacacuggcguuacugcuu

SEQ ID NO: 1294540 - RNA, 14 nt, Homo sapiens
gacacuuaauacua

SEQ ID NO: 1294541 - RNA, 23 nt, Homo sapiens
gacagaaagcaguucugaugcuu

SEQ ID NO: 1294542 - RNA, 18 nt, Homo sapiens
gacagaacacccaauuca

SEQ ID NO: 1294543 - RNA, 16 nt, Homo sapiens
gacagagaaacagaca

SEQ ID NO: 1294544 - RNA, 19 nt, Homo sapiens
gacagaggaugagcucuac

SEQ ID NO: 1294545 - RNA, 19 nt, Homo sapiens
gacagagugagacucuguc

SEQ ID NO: 1294546 - RNA, 24 nt, Homo sapiens
gacagaugggcauaugugucagug

SEQ ID NO: 1294547 - RNA, 15 nt, Homo sapiens
gacagccugcagcag

SEQ ID NO: 1294548 - RNA, 18 nt, Homo sapiens
gacagcucuguaucugcc

SEQ ID NO: 1294549 - RNA, 17 nt, Homo sapiens
gacaggccagaugaacu

SEQ ID NO: 1294550 - RNA, 21 nt, Homo sapiens
gacaguuuguggcaucuugcc

SEQ ID NO: 1294551 - RNA, 14 nt, Homo sapiens
gacauaauuuacau

SEQ ID NO: 1294552 - RNA, 11 nt, Homo sapiens
gacaucacugu

SEQ ID NO: 1294553 - RNA, 17 nt, Homo sapiens
gacaugcccaaggccac

SEQ ID NO: 1294554 - RNA, 18 nt, Homo sapiens
gacaugcccaaggccacg

SEQ ID NO: 1294555 - RNA, 15 nt, Homo sapiens
gacaugggggugcca

SEQ ID NO: 1294556 - RNA, 16 nt, Homo sapiens
gacauuccuucuccca

SEQ ID NO: 1294557 - RNA, 18 nt, Homo sapiens
gacauugcggacagccac

SEQ ID NO: 1294558 - RNA, 16 nt, Homo sapiens
gacauuguuggccaaa

SEQ ID NO: 1294559 - RNA, 21 nt, Homo sapiens
gacauuuauuuuucucaugaa

SEQ ID NO: 1294560 - RNA, 17 nt, Homo sapiens
gaccaaagagcccucaa

SEQ ID NO: 1294561 - RNA, 21 nt, Homo sapiens
gaccaauuugcaccaguuuua

SEQ ID NO: 1294562 - RNA, 23 nt, Homo sapiens
gaccaccaccccaacaaaccauc

SEQ ID NO: 1294563 - RNA, 14 nt, Homo sapiens
gaccagacaauguu

SEQ ID NO: 1294564 - RNA, 16 nt, Homo sapiens
gaccaggcaaugugac

SEQ ID NO: 1294565 - RNA, 22 nt, Homo sapiens
gaccaggcaaugugacuuugca

SEQ ID NO: 1294566 - RNA, 23 nt, Homo sapiens
gaccaguggucucacauggugcu

SEQ ID NO: 1294567 - RNA, 20 nt, Homo sapiens
gaccaguuuaaccugaugca

SEQ ID NO: 1294568 - RNA, 17 nt, Homo sapiens
gaccaugcgacacuggg

SEQ ID NO: 1294569 - RNA, 18 nt, Homo sapiens
gacccaaguagcugcuac

SEQ ID NO: 1294570 - RNA, 13 nt, Homo sapiens
gacccaugggaga

SEQ ID NO: 1294571 - RNA, 15 nt, Homo sapiens
gugcuuuguacugcu

SEQ ID NO: 1294572 - RNA, 14 nt, Homo sapiens
guggaaaagaaaua

SEQ ID NO: 1294573 - RNA, 21 nt, Homo sapiens
guggacaugcgugaccagcag

SEQ ID NO: 1294574 - RNA, 12 nt, Homo sapiens
guggagaacucc

SEQ ID NO: 1294575 - RNA, 13 nt, Homo sapiens
guggagucauuau

SEQ ID NO: 1294576 - RNA, 13 nt, Homo sapiens
guggagugcagug

SEQ ID NO: 1294577 - RNA, 12 nt, Homo sapiens
guggaucacuug

SEQ ID NO: 1294578 - RNA, 15 nt, Homo sapiens
guggcacugccaugc

SEQ ID NO: 1294579 - RNA, 15 nt, Homo sapiens
guggcaucuugccaa

SEQ ID NO: 1294580 - RNA, 19 nt, Homo sapiens
guggccaaggagcugcuau

SEQ ID NO: 1294581 - RNA, 13 nt, Homo sapiens
guggcccuguccu

SEQ ID NO: 1294582 - RNA, 22 nt, Homo sapiens
guggcgagaaauaaaguuugcu

SEQ ID NO: 1294583 - RNA, 19 nt, Homo sapiens
gugggaggcggugcacuca

SEQ ID NO: 1294584 - RNA, 20 nt, Homo sapiens
gugggcccagccccugccag

SEQ ID NO: 1294585 - RNA, 15 nt, Homo sapiens
gugggccuggcagga

SEQ ID NO: 1294586 - RNA, 20 nt, Homo sapiens
guggggugugcacaucucug

SEQ ID NO: 1294587 - RNA, 14 nt, Homo sapiens
guggucccugagga

SEQ ID NO: 1294588 - RNA, 21 nt, Homo sapiens
gugguuauuuagggaacugcu

SEQ ID NO: 1294589 - RNA, 12 nt, Homo sapiens
gugguuugaaaa

SEQ ID NO: 1294590 - RNA, 14 nt, Homo sapiens
guguaagaaacaca

SEQ ID NO: 1294591 - RNA, 19 nt, Homo sapiens
guguaaggaaggugcucac

SEQ ID NO: 1294592 - RNA, 17 nt, Homo sapiens
guguaauuuuguucuag

SEQ ID NO: 1294593 - RNA, 16 nt, Homo sapiens
guguacacgugacaga

SEQ ID NO: 1294594 - RNA, 15 nt, Homo sapiens
guguaccuccucuca

SEQ ID NO: 1294595 - RNA, 12 nt, Homo sapiens
guguacuguaau

SEQ ID NO: 1294596 - RNA, 14 nt, Homo sapiens
guguagacauguca

SEQ ID NO: 1294597 - RNA, 22 nt, Homo sapiens
guguauccaugcaccuaccuua

SEQ ID NO: 1294598 - RNA, 19 nt, Homo sapiens
guguaugguucugugccaa

SEQ ID NO: 1294599 - RNA, 15 nt, Homo sapiens
gugucaccugugcuu

SEQ ID NO: 1294600 - RNA, 23 nt, Homo sapiens
gugucauuuaugugucaguucau

SEQ ID NO: 1294601 - RNA, 13 nt, Homo sapiens
gugugauugcacg

SEQ ID NO: 1294602 - RNA, 19 nt, Homo sapiens
gugugcuuuguacugcugu

SEQ ID NO: 1294603 - RNA, 12 nt, Homo sapiens
guguguccaaaa

SEQ ID NO: 1294604 - RNA, 22 nt, Homo sapiens
gugugugcacguacacacacau

SEQ ID NO: 1294605 - RNA, 14 nt, Homo sapiens
gugugugugcauau

SEQ ID NO: 1294606 - RNA, 15 nt, Homo sapiens
guguuaaaacugaau

SEQ ID NO: 1294607 - RNA, 19 nt, Homo sapiens
guguuacccacugccaugc

SEQ ID NO: 1294608 - RNA, 17 nt, Homo sapiens
guguuacugcuuugcaa

SEQ ID NO: 1294609 - RNA, 14 nt, Homo sapiens
guguucaggauacu

SEQ ID NO: 1294610 - RNA, 14 nt, Homo sapiens
guguucuguacuua

SEQ ID NO: 1294611 - RNA, 16 nt, Homo sapiens
guguuuucaccauuca

SEQ ID NO: 1294612 - RNA, 23 nt, Homo sapiens
guguuuuuaaagaaaagcauuca

SEQ ID NO: 1294613 - RNA, 18 nt, Homo sapiens
guguuuuucacauuugcg

SEQ ID NO: 1294614 - RNA, 20 nt, Homo sapiens
guuaaaaaaaagaauaaagg

SEQ ID NO: 1294615 - RNA, 11 nt, Homo sapiens
guuaacaucau

SEQ ID NO: 1294616 - RNA, 22 nt, Homo sapiens
guuaaguguuuccuuccuuugu

SEQ ID NO: 1294617 - RNA, 12 nt, Homo sapiens
guuaaguucaaa

SEQ ID NO: 1294618 - RNA, 21 nt, Homo sapiens
guuaauaguaccuaaaauugc

SEQ ID NO: 1294619 - RNA, 14 nt, Homo sapiens
guuacagcacaaaa

SEQ ID NO: 1294620 - RNA, 10 nt, Homo sapiens
guuacauuuc

SEQ ID NO: 1294621 - RNA, 14 nt, Homo sapiens
guuaccucugcaug

SEQ ID NO: 1294622 - RNA, 22 nt, Homo sapiens
guuaccugaaaacacugugcac

SEQ ID NO: 1294623 - RNA, 16 nt, Homo sapiens
guuacuccagugccaa

SEQ ID NO: 1294624 - RNA, 19 nt, Homo sapiens
guuacugcuugaccaaaga

SEQ ID NO: 1294625 - RNA, 14 nt, Homo sapiens
guuacugucuucag

SEQ ID NO: 1294626 - RNA, 18 nt, Homo sapiens
uaaagagagaugaaccac

SEQ ID NO: 1294627 - RNA, 15 nt, Homo sapiens
uaaaggaacugcauc

SEQ ID NO: 1294628 - RNA, 23 nt, Homo sapiens
uaaaggaagcaaguuuucuucca

SEQ ID NO: 1294629 - RNA, 20 nt, Homo sapiens
uaaagggcgcaaagggcaug

SEQ ID NO: 1294630 - RNA, 17 nt, Homo sapiens
uaaaggugagcccucau

SEQ ID NO: 1294631 - RNA, 18 nt, Homo sapiens
uaaaguaguccugugaau

SEQ ID NO: 1294632 - RNA, 21 nt, Homo sapiens
uaaauaaauguaucuuauuca

SEQ ID NO: 1294633 - RNA, 15 nt, Homo sapiens
uaaauacagucuucc

SEQ ID NO: 1294634 - RNA, 17 nt, Homo sapiens
uaaauacuacugcucua

SEQ ID NO: 1294635 - RNA, 16 nt, Homo sapiens
uaaauauauauuauuc

SEQ ID NO: 1294636 - RNA, 18 nt, Homo sapiens
uaaauauuuugcauauaa

SEQ ID NO: 1294637 - RNA, 15 nt, Homo sapiens
uaaaucacauccuua

SEQ ID NO: 1294638 - RNA, 20 nt, Homo sapiens
uaaaucugcgaucaucguca

SEQ ID NO: 1294639 - RNA, 14 nt, Homo sapiens
uaaaugaacugacu

SEQ ID NO: 1294640 - RNA, 19 nt, Homo sapiens
uaaaugagacgagacaugu

SEQ ID NO: 1294641 - RNA, 20 nt, Homo sapiens
uaaauguaucuuauucacau

SEQ ID NO: 1294642 - RNA, 22 nt, Homo sapiens
uaaaugucucuuuaaugucaca

SEQ ID NO: 1294643 - RNA, 24 nt, Homo sapiens
uaaauguuuaauaaacacugacau

SEQ ID NO: 1294644 - RNA, 16 nt, Homo sapiens
uaaauuaccuugccaa

SEQ ID NO: 1294645 - RNA, 18 nt, Homo sapiens
uaaauucccuggggaaaa

SEQ ID NO: 1294646 - RNA, 18 nt, Homo sapiens
uaaauuuaaaacuggccu

SEQ ID NO: 1294647 - RNA, 17 nt, Homo sapiens
uaaauuugguucuaggc

SEQ ID NO: 1294648 - RNA, 17 nt, Homo sapiens
uaacaaauacauucaaa

SEQ ID NO: 1294649 - RNA, 15 nt, Homo sapiens
uaacaauaaaagaca

SEQ ID NO: 1294650 - RNA, 14 nt, Homo sapiens
uaacaccaugauua

SEQ ID NO: 1294651 - RNA, 15 nt, Homo sapiens
uaacacucaugaagc

SEQ ID NO: 1294652 - RNA, 14 nt, Homo sapiens
uaacacugaugaua

SEQ ID NO: 1294653 - RNA, 20 nt, Homo sapiens
uaacacuggcuucaggcaaa

SEQ ID NO: 1294654 - RNA, 15 nt, Homo sapiens
uaacacuuaccccau

SEQ ID NO: 1294655 - RNA, 21 nt, Homo sapiens
uaacagggagacugcaucuca

SEQ ID NO: 1294656 - RNA, 12 nt, Homo sapiens
uaacaugaugua

SEQ ID NO: 1294657 - RNA, 19 nt, Homo sapiens
uaacauuagcuaaaacugc

SEQ ID NO: 1294658 - RNA, 12 nt, Homo sapiens
uaacauucccac

SEQ ID NO: 1294659 - RNA, 17 nt, Homo sapiens
uaacauucccacugcca

SEQ ID NO: 1294660 - RNA, 12 nt, Homo sapiens
uaacuagaauuu

SEQ ID NO: 1294661 - RNA, 15 nt, Homo sapiens
uaacucacugagggu

SEQ ID NO: 1294662 - RNA, 16 nt, Homo sapiens
uaacucuagaauuugg

SEQ ID NO: 1294663 - RNA, 15 nt, Homo sapiens
uaacuggggauauaa

SEQ ID NO: 1294664 - RNA, 14 nt, Homo sapiens
uaacuuacuuccaa

SEQ ID NO: 1294665 - RNA, 20 nt, Homo sapiens
uaacuucaaggcccauaucu

SEQ ID NO: 1294666 - RNA, 12 nt, Homo sapiens
uaagaaaaucau

SEQ ID NO: 1294667 - RNA, 15 nt, Homo sapiens
uaagaaacacacuga

SEQ ID NO: 1294668 - RNA, 16 nt, Homo sapiens
uaagaaagaucaaaga

SEQ ID NO: 1294669 - RNA, 23 nt, Homo sapiens
uaagaacuuugagcuacugccgu

SEQ ID NO: 1294670 - RNA, 12 nt, Homo sapiens
uaagaagcucug

SEQ ID NO: 1294671 - RNA, 14 nt, Homo sapiens
uaagaauagaaaua

SEQ ID NO: 1294672 - RNA, 17 nt, Homo sapiens
uaagaauuagacaucuu

SEQ ID NO: 1294673 - RNA, 13 nt, Homo sapiens
uaagaauuucaca

SEQ ID NO: 1294674 - RNA, 20 nt, Homo sapiens
uaagaauuucacaagcuauu

SEQ ID NO: 1294675 - RNA, 16 nt, Homo sapiens
uaagacagagaaacag

SEQ ID NO: 1294676 - RNA, 18 nt, Homo sapiens
uaagacaugauuuccuug

SEQ ID NO: 1294677 - RNA, 23 nt, Homo sapiens
uaagaccaagcugugcccugacc

SEQ ID NO: 1294678 - RNA, 13 nt, Homo sapiens
uaagaccuggcag

SEQ ID NO: 1294679 - RNA, 16 nt, Homo sapiens
uaagacguauguaaca

SEQ ID NO: 1294680 - RNA, 20 nt, Homo sapiens
uaagacucucgcaucuuccc

SEQ ID NO: 1294681 - RNA, 15 nt, Homo sapiens
uaagagcaauucaaa

SEQ ID NO: 1294682 - RNA, 16 nt, Homo sapiens
uaagaucugaauucua

SEQ ID NO: 1294683 - RNA, 11 nt, Homo sapiens
uaagauuuauu

SEQ ID NO: 1294684 - RNA, 20 nt, Homo sapiens
uaagcaccaggacgcccucg

SEQ ID NO: 1294685 - RNA, 22 nt, Homo sapiens
uaagcauuuugguuggauuucu

SEQ ID NO: 1294686 - RNA, 20 nt, Homo sapiens
uaagccugcauucuuaacaa

SEQ ID NO: 1294687 - RNA, 18 nt, Homo sapiens
uaaggacaugaugcuuuu

SEQ ID NO: 1294688 - RNA, 14 nt, Homo sapiens
uaaggauguugcca

SEQ ID NO: 1294689 - RNA, 19 nt, Homo sapiens
uaaggcugaggaaaggcca

SEQ ID NO: 1294690 - RNA, 21 nt, Homo sapiens
uaaguaccucagcauuuaauc

SEQ ID NO: 1294691 - RNA, 22 nt, Homo sapiens
uaaguauaaaauacaacaaagg

SEQ ID NO: 1294692 - RNA, 12 nt, Homo sapiens
uaagucagggaa

SEQ ID NO: 1294693 - RNA, 24 nt, Homo sapiens
uaagugaaaaucuuacaacaggcu

SEQ ID NO: 1294694 - RNA, 18 nt, Homo sapiens
uaaguggggaaaauccua

SEQ ID NO: 1294695 - RNA, 18 nt, Homo sapiens
uaaguuacaucuacaaac

SEQ ID NO: 1294696 - RNA, 20 nt, Homo sapiens
uaaguuuccuuccagcccag

SEQ ID NO: 1294697 - RNA, 21 nt, Homo sapiens
uaauaagcaaagggagcacug

SEQ ID NO: 1294698 - RNA, 21 nt, Homo sapiens
uaauacuauauuuauacugua

SEQ ID NO: 1294699 - RNA, 16 nt, Homo sapiens
uaauagaaacauugaa

SEQ ID NO: 1294700 - RNA, 14 nt, Homo sapiens
uaauagcgugugaa

SEQ ID NO: 1294701 - RNA, 18 nt, Homo sapiens
uaauagguguuuguuuaa

SEQ ID NO: 1294702 - RNA, 16 nt, Homo sapiens
uaauagucuuugccag

SEQ ID NO: 1294703 - RNA, 13 nt, Homo sapiens
uaauaugcugcaa

SEQ ID NO: 1294704 - RNA, 17 nt, Homo sapiens
uaauaugguuacauuua

SEQ ID NO: 1294705 - RNA, 23 nt, Homo sapiens
uaaucauuuguuuacauuugaug

SEQ ID NO: 1294706 - RNA, 14 nt, Homo sapiens
uggcuccacuggga

SEQ ID NO: 1294707 - RNA, 16 nt, Homo sapiens
uggcucugcaccugua

SEQ ID NO: 1294708 - RNA, 20 nt, Homo sapiens
uggcucuugaggcauuucca

SEQ ID NO: 1294709 - RNA, 23 nt, Homo sapiens
uggcugagauucccucaccuguc

SEQ ID NO: 1294710 - RNA, 14 nt, Homo sapiens
uggcugauggagua

SEQ ID NO: 1294711 - RNA, 22 nt, Homo sapiens
uggcuggagcugcccccuccag

SEQ ID NO: 1294712 - RNA, 22 nt, Homo sapiens
uggcuugacuguuuucuuuaug

SEQ ID NO: 1294713 - RNA, 16 nt, Homo sapiens
uggcuuggguucacag

SEQ ID NO: 1294714 - RNA, 20 nt, Homo sapiens
uggcuuggguucacagugca

SEQ ID NO: 1294715 - RNA, 16 nt, Homo sapiens
uggcuuucuggcugcu

SEQ ID NO: 1294716 - RNA, 12 nt, Homo sapiens
ugggaagugaag

SEQ ID NO: 1294717 - RNA, 15 nt, Homo sapiens
ugggaauaaaucaua

SEQ ID NO: 1294718 - RNA, 14 nt, Homo sapiens
ugggacaaauugca

SEQ ID NO: 1294719 - RNA, 20 nt, Homo sapiens
ugggacgcaggagaucaucu

SEQ ID NO: 1294720 - RNA, 21 nt, Homo sapiens
ugggacgcaggagaucaucug

SEQ ID NO: 1294721 - RNA, 14 nt, Homo sapiens
ugggacuacaggca

SEQ ID NO: 1294722 - RNA, 16 nt, Homo sapiens
ugggagaaaucuggcu

SEQ ID NO: 1294723 - RNA, 16 nt, Homo sapiens
ugggaggagugguggg

SEQ ID NO: 1294724 - RNA, 15 nt, Homo sapiens
ugggaggcagggaca

SEQ ID NO: 1294725 - RNA, 22 nt, Homo sapiens
ugggagguugguuuaaugcaau

SEQ ID NO: 1294726 - RNA, 17 nt, Homo sapiens
ugggagucacacagugu

SEQ ID NO: 1294727 - RNA, 14 nt, Homo sapiens
ugggagucaucuca

SEQ ID NO: 1294728 - RNA, 18 nt, Homo sapiens
ugggauagagaauguucc

SEQ ID NO: 1294729 - RNA, 23 nt, Homo sapiens
ugggaucacgaggaaaagagaag

SEQ ID NO: 1294730 - RNA, 16 nt, Homo sapiens
ugggaugagagggccc

SEQ ID NO: 1294731 - RNA, 21 nt, Homo sapiens
ugggaugagagggcccagaag

SEQ ID NO: 1294732 - RNA, 17 nt, Homo sapiens
ugggauuacagguguga

SEQ ID NO: 1294733 - RNA, 19 nt, Homo sapiens
ugggauuacaggugugaac

SEQ ID NO: 1294734 - RNA, 16 nt, Homo sapiens
ugggcaaacaggcagu

SEQ ID NO: 1294735 - RNA, 14 nt, Homo sapiens
ugggcaaugugaua

SEQ ID NO: 1294736 - RNA, 13 nt, Homo sapiens
ugggcagagccca

SEQ ID NO: 1294737 - RNA, 14 nt, Homo sapiens
ugggcagagcccaa

SEQ ID NO: 1294738 - RNA, 15 nt, Homo sapiens
ugggcagagcugcau

SEQ ID NO: 1294739 - RNA, 15 nt, Homo sapiens
ugggcagcauacuga

SEQ ID NO: 1294740 - RNA, 15 nt, Homo sapiens
ugggcagcuugagag

SEQ ID NO: 1294741 - RNA, 14 nt, Homo sapiens
ugggccacugugaa

SEQ ID NO: 1294742 - RNA, 19 nt, Homo sapiens
ugggccagacaugccacaa

SEQ ID NO: 1294743 - RNA, 14 nt, Homo sapiens
ugggcccacaaagg

SEQ ID NO: 1294744 - RNA, 23 nt, Homo sapiens
ugggccccugucgucaggaccuc

SEQ ID NO: 1294745 - RNA, 20 nt, Homo sapiens
ugggccuccucacaacaugg

SEQ ID NO: 1294746 - RNA, 14 nt, Homo sapiens
ugggccugcuccag

SEQ ID NO: 1294747 - RNA, 14 nt, Homo sapiens
ugggccuggcagga

SEQ ID NO: 1294748 - RNA, 22 nt, Homo sapiens
ugggcgcuguuuucucagcucc

SEQ ID NO: 1294749 - RNA, 19 nt, Homo sapiens
ugggcugggcucgccacau

SEQ ID NO: 1294750 - RNA, 14 nt, Homo sapiens
ugggcuugauucug

SEQ ID NO: 1294751 - RNA, 16 nt, Homo sapiens
uggggaaaacuugcag

SEQ ID NO: 1294752 - RNA, 14 nt, Homo sapiens
uggggaaaauccua

SEQ ID NO: 1294753 - RNA, 14 nt, Homo sapiens
uggggaccaggugc

SEQ ID NO: 1294754 - RNA, 16 nt, Homo sapiens
uggggagaaaguacuu

SEQ ID NO: 1294755 - RNA, 17 nt, Homo sapiens
uggggagacuucuuggc

SEQ ID NO: 1294756 - RNA, 15 nt, Homo sapiens
uggggaggacaggga

SEQ ID NO: 1294757 - RNA, 17 nt, Homo sapiens
uggggaggccaggguag

SEQ ID NO: 1294758 - RNA, 19 nt, Homo sapiens
uggggaguaggacauacca

SEQ ID NO: 1294759 - RNA, 14 nt, Homo sapiens
uggggagucaggga

SEQ ID NO: 1294760 - RNA, 23 nt, Homo sapiens
uggggcagcacccuauaaaucaa

SEQ ID NO: 1294761 - RNA, 18 nt, Homo sapiens
uggggccuccagaacuca

SEQ ID NO: 1294762 - RNA, 22 nt, Homo sapiens
ugggggaucacagccucugaaa

SEQ ID NO: 1294763 - RNA, 23 nt, Homo sapiens
ugggggggcucccguggccugua

SEQ ID NO: 1294764 - RNA, 14 nt, Homo sapiens
ugggggugcagaug

SEQ ID NO: 1294765 - RNA, 21 nt, Homo sapiens
ugggguacccacugcucuggu

SEQ ID NO: 1294766 - RNA, 14 nt, Homo sapiens
ugggguggggucau

SEQ ID NO: 1294767 - RNA, 20 nt, Homo sapiens
ugggguugucagcucucauc

SEQ ID NO: 1294768 - RNA, 15 nt, Homo sapiens
uggguacuucuugaa

SEQ ID NO: 1294769 - RNA, 14 nt, Homo sapiens
uggguccaggggau

SEQ ID NO: 1294770 - RNA, 21 nt, Homo sapiens
ugggucccagauuggcucaca

SEQ ID NO: 1294771 - RNA, 11 nt, Homo sapiens
ugggugacaaa

SEQ ID NO: 1294772 - RNA, 16 nt, Homo sapiens
ugggugggugggauga

SEQ ID NO: 1294773 - RNA, 17 nt, Homo sapiens
uggguuuugugccuuug

SEQ ID NO: 1294774 - RNA, 15 nt, Homo sapiens
ugguaagaccucuga

SEQ ID NO: 1294775 - RNA, 23 nt, Homo sapiens
ugguaagaccucugagaccaaaa

SEQ ID NO: 1294776 - RNA, 10 nt, Homo sapiens
uuccacugag

SEQ ID NO: 1294777 - RNA, 20 nt, Homo sapiens
uuccacuuguuugcacugug

SEQ ID NO: 1294778 - RNA, 13 nt, Homo sapiens
uuccagacauucu

SEQ ID NO: 1294779 - RNA, 19 nt, Homo sapiens
uuccagacuuccuugagac

SEQ ID NO: 1294780 - RNA, 22 nt, Homo sapiens
uuccagcuuagaaugcaucuca

SEQ ID NO: 1294781 - RNA, 22 nt, Homo sapiens
uuccaggaggaguuagccaaac

SEQ ID NO: 1294782 - RNA, 14 nt, Homo sapiens
uuccaggugcccag

SEQ ID NO: 1294783 - RNA, 15 nt, Homo sapiens
uuccaugacaacaga

SEQ ID NO: 1294784 - RNA, 16 nt, Homo sapiens
uuccaugggaccacaa

SEQ ID NO: 1294785 - RNA, 20 nt, Homo sapiens
uuccaugucuccuuuaagag

SEQ ID NO: 1294786 - RNA, 15 nt, Homo sapiens
uuccauuccaagccu

SEQ ID NO: 1294787 - RNA, 16 nt, Homo sapiens
uuccauuugcaaggga

SEQ ID NO: 1294788 - RNA, 20 nt, Homo sapiens
uucccaccugcuggagugaa

SEQ ID NO: 1294789 - RNA, 17 nt, Homo sapiens
uucccagcuacaccuuu

SEQ ID NO: 1294790 - RNA, 16 nt, Homo sapiens
uuccccaucuucuaaa

SEQ ID NO: 1294791 - RNA, 20 nt, Homo sapiens
uucccccacacccagaucac

SEQ ID NO: 1294792 - RNA, 13 nt, Homo sapiens
uucccccacugau

SEQ ID NO: 1294793 - RNA, 16 nt, Homo sapiens
uuccccuuccacugag

SEQ ID NO: 1294794 - RNA, 14 nt, Homo sapiens
uucccucaccuguc

SEQ ID NO: 1294795 - RNA, 22 nt, Homo sapiens
uucccucucccggcaacaucuc

SEQ ID NO: 1294796 - RNA, 19 nt, Homo sapiens
uucccuguacuuuucccau

SEQ ID NO: 1294797 - RNA, 20 nt, Homo sapiens
uucccuguacuuuucccauu

SEQ ID NO: 1294798 - RNA, 17 nt, Homo sapiens
uuccgagauccaccaga

SEQ ID NO: 1294799 - RNA, 16 nt, Homo sapiens
uuccguggcacugcau

SEQ ID NO: 1294800 - RNA, 23 nt, Homo sapiens
uuccuaacugucugacuuauaau

SEQ ID NO: 1294801 - RNA, 12 nt, Homo sapiens
uuccuaggucau

SEQ ID NO: 1294802 - RNA, 16 nt, Homo sapiens
uuccuaguucuguaga

SEQ ID NO: 1294803 - RNA, 14 nt, Homo sapiens
uuccucccugcuua

SEQ ID NO: 1294804 - RNA, 15 nt, Homo sapiens
uuccucccugcuuaa

SEQ ID NO: 1294805 - RNA, 20 nt, Homo sapiens
uuccuccucaggcacacagc

SEQ ID NO: 1294806 - RNA, 17 nt, Homo sapiens
uuccucgagaccauaca

SEQ ID NO: 1294807 - RNA, 11 nt, Homo sapiens
uuccucugcau

SEQ ID NO: 1294808 - RNA, 12 nt, Homo sapiens
uuccugcuuauu

SEQ ID NO: 1294809 - RNA, 20 nt, Homo sapiens
uuccuggaggucagcauuug

SEQ ID NO: 1294810 - RNA, 22 nt, Homo sapiens
uuccuguggggggaaguccaug

SEQ ID NO: 1294811 - RNA, 13 nt, Homo sapiens
uuccuucucccau

SEQ ID NO: 1294812 - RNA, 17 nt, Homo sapiens
uuccuugaucuguauau

SEQ ID NO: 1294813 - RNA, 23 nt, Homo sapiens
uuccuuuggugacuucacaguga

SEQ ID NO: 1294814 - RNA, 16 nt, Homo sapiens
uuccuuuguugcacaa

SEQ ID NO: 1294815 - RNA, 15 nt, Homo sapiens
uuccuuuuuucccau

SEQ ID NO: 1294816 - RNA, 20 nt, Homo sapiens
uucgagaccagccuggccaa

SEQ ID NO: 1294817 - RNA, 21 nt, Homo sapiens
uucgucggaggcaucauggaa

SEQ ID NO: 1294818 - RNA, 19 nt, Homo sapiens
uucgugaaguauacuguau

SEQ ID NO: 1294819 - RNA, 20 nt, Homo sapiens
uucuaagagguagauaccag

SEQ ID NO: 1294820 - RNA, 15 nt, Homo sapiens
uucuaauuaaccuua

SEQ ID NO: 1294821 - RNA, 19 nt, Homo sapiens
uucuacagaauauucuccc

SEQ ID NO: 1294822 - RNA, 16 nt, Homo sapiens
uucuaggcucacugca

SEQ ID NO: 1294823 - RNA, 19 nt, Homo sapiens
uucuauaaagaucauauau

SEQ ID NO: 1294824 - RNA, 19 nt, Homo sapiens
uucuauucaucucaaggaa

SEQ ID NO: 1294825 - RNA, 22 nt, Homo sapiens
uucucagaaucuacccaaagga

SEQ ID NO: 1294826 - RNA, 22 nt, Homo sapiens
uucucccaccaccucaccaguu

SEQ ID NO: 1294827 - RNA, 13 nt, Homo sapiens
uucuccuccaugg

SEQ ID NO: 1294828 - RNA, 14 nt, Homo sapiens
uucuccuucagccc

SEQ ID NO: 1294829 - RNA, 16 nt, Homo sapiens
uucucucucucuuuga

SEQ ID NO: 1294830 - RNA, 14 nt, Homo sapiens
uucucugaaggaca

SEQ ID NO: 1294831 - RNA, 19 nt, Homo sapiens
uucucuggcgacaguuuuc

SEQ ID NO: 1294832 - RNA, 15 nt, Homo sapiens
uucugaaacugcaua

SEQ ID NO: 1294833 - RNA, 11 nt, Homo sapiens
uucugagauca

SEQ ID NO: 1294834 - RNA, 17 nt, Homo sapiens
uucugcauauguugaau

SEQ ID NO: 1294835 - RNA, 22 nt, Homo sapiens
uucugccaccccuaaacuccag

SEQ ID NO: 1294836 - RNA, 17 nt, Homo sapiens
uucugccucuccaggca

SEQ ID NO: 1294837 - RNA, 18 nt, Homo sapiens
uucugcucuguucuggau

SEQ ID NO: 1294838 - RNA, 13 nt, Homo sapiens
uucuggacaggau

SEQ ID NO: 1294839 - RNA, 18 nt, Homo sapiens
uucuggacggaaccacgu

SEQ ID NO: 1294840 - RNA, 18 nt, Homo sapiens
uucuggagaucauuuaaa

SEQ ID NO: 1294841 - RNA, 21 nt, Homo sapiens
uucuggagauggaagcuuguu

SEQ ID NO: 1294842 - RNA, 19 nt, Homo sapiens
uucuggauuccccaucuca

SEQ ID NO: 1294843 - RNA, 21 nt, Homo sapiens
uucuggcccaguuaauuugca

SEQ ID NO: 1294844 - RNA, 17 nt, Homo sapiens
uucuggccucccacaga

SEQ ID NO: 1294845 - RNA, 12 nt, Homo sapiens
uucuggcugugc

SEQ ID NO: 1294846 - RNA, 20 nt, Homo sapiens
uucuguccgagcuuugaaaa

SEQ ID NO: 1294847 - RNA, 23 nt, Homo sapiens
uucuguccugagaagcauguaau

SEQ ID NO: 1294848 - RNA, 13 nt, Homo sapiens
uucuuaagacaug

SEQ ID NO: 1294849 - RNA, 18 nt, Homo sapiens
uguauuaaagacagaggc

SEQ ID NO: 1294850 - RNA, 16 nt, Homo sapiens
uguauucacacuuuaa

SEQ ID NO: 1294851 - RNA, 13 nt, Homo sapiens
uguauucauauau

SEQ ID NO: 1294852 - RNA, 21 nt, Homo sapiens
uguauucucugagcugugcag

SEQ ID NO: 1294853 - RNA, 15 nt, Homo sapiens
uguauuguggaacac

SEQ ID NO: 1294854 - RNA, 17 nt, Homo sapiens
uguauuuuauuacaucu

SEQ ID NO: 1294855 - RNA, 20 nt, Homo sapiens
ugucaagcugcucugagcca

SEQ ID NO: 1294856 - RNA, 16 nt, Homo sapiens
ugucaaugauuucaaa

SEQ ID NO: 1294857 - RNA, 13 nt, Homo sapiens
ugucaaugugaac

SEQ ID NO: 1294858 - RNA, 20 nt, Homo sapiens
ugucaaugugaacguccaca

SEQ ID NO: 1294859 - RNA, 12 nt, Homo sapiens
ugucacagggac

SEQ ID NO: 1294860 - RNA, 18 nt, Homo sapiens
ugucacaugaaacauuug

SEQ ID NO: 1294861 - RNA, 18 nt, Homo sapiens
ugucagccauugcaccca

SEQ ID NO: 1294862 - RNA, 23 nt, Homo sapiens
ugucagcuugguccacaucacca

SEQ ID NO: 1294863 - RNA, 18 nt, Homo sapiens
ugucaguaguuucuuauu

SEQ ID NO: 1294864 - RNA, 15 nt, Homo sapiens
ugucaucugugcacu

SEQ ID NO: 1294865 - RNA, 21 nt, Homo sapiens
ugucauucuguuagauacuaa

SEQ ID NO: 1294866 - RNA, 17 nt, Homo sapiens
ugucauuuugcacugua

SEQ ID NO: 1294867 - RNA, 19 nt, Homo sapiens
uguccccacuuacagaucu

SEQ ID NO: 1294868 - RNA, 19 nt, Homo sapiens
uguccccucugcaugcccu

SEQ ID NO: 1294869 - RNA, 21 nt, Homo sapiens
uguccccuuuccccagugaca

SEQ ID NO: 1294870 - RNA, 14 nt, Homo sapiens
ugucccguggcauu

SEQ ID NO: 1294871 - RNA, 12 nt, Homo sapiens
ugucccuaguaa

SEQ ID NO: 1294872 - RNA, 16 nt, Homo sapiens
ugucccucacuguuga

SEQ ID NO: 1294873 - RNA, 19 nt, Homo sapiens
uguccggucccugucccag

SEQ ID NO: 1294874 - RNA, 16 nt, Homo sapiens
uguccucccaccucag

SEQ ID NO: 1294875 - RNA, 16 nt, Homo sapiens
uguccucccagcuccu

SEQ ID NO: 1294876 - RNA, 21 nt, Homo sapiens
uguccugaugcuuuugucuaa

SEQ ID NO: 1294877 - RNA, 22 nt, Homo sapiens
uguccuuucuagagcacugcca

SEQ ID NO: 1294878 - RNA, 18 nt, Homo sapiens
ugucgguuaccucugcau

SEQ ID NO: 1294879 - RNA, 22 nt, Homo sapiens
ugucuaauuaaaacacuuucaa

SEQ ID NO: 1294880 - RNA, 18 nt, Homo sapiens
ugucuccacggccugccc

SEQ ID NO: 1294881 - RNA, 22 nt, Homo sapiens
ugucucuagaagugccaucuca

SEQ ID NO: 1294882 - RNA, 18 nt, Homo sapiens
ugucuucauagcagauuu

SEQ ID NO: 1294883 - RNA, 17 nt, Homo sapiens
ugucuugccagccagaa

SEQ ID NO: 1294884 - RNA, 22 nt, Homo sapiens
ugucuuguucauuuugaguauu

SEQ ID NO: 1294885 - RNA, 14 nt, Homo sapiens
ugucuuugccaagu

SEQ ID NO: 1294886 - RNA, 17 nt, Homo sapiens
ugugaaacucaucucau

SEQ ID NO: 1294887 - RNA, 12 nt, Homo sapiens
ugugaacccugg

SEQ ID NO: 1294888 - RNA, 13 nt, Homo sapiens
ugugaaugaucaa

SEQ ID NO: 1294889 - RNA, 23 nt, Homo sapiens
ugugaccacugaagcaccacagg

SEQ ID NO: 1294890 - RNA, 23 nt, Homo sapiens
ugugagacucgagaacuuucauu

SEQ ID NO: 1294891 - RNA, 15 nt, Homo sapiens
ugugagagacggugu

SEQ ID NO: 1294892 - RNA, 17 nt, Homo sapiens
ugugagaggaucaucug

SEQ ID NO: 1294893 - RNA, 16 nt, Homo sapiens
ugugagccaccacguc

SEQ ID NO: 1294894 - RNA, 15 nt, Homo sapiens
ugugauagcacuuuc

SEQ ID NO: 1294895 - RNA, 17 nt, Homo sapiens
ugugauuuuaacucugu

SEQ ID NO: 1294896 - RNA, 13 nt, Homo sapiens
ugugcccucagau

SEQ ID NO: 1294897 - RNA, 15 nt, Homo sapiens
ugugcccuguucaaa

SEQ ID NO: 1294898 - RNA, 15 nt, Homo sapiens
ugugcgccuacagga

SEQ ID NO: 1294899 - RNA, 18 nt, Homo sapiens
ugugcugggauuacaggc

SEQ ID NO: 1294900 - RNA, 21 nt, Homo sapiens
ugugcuguagauucacauaca

SEQ ID NO: 1294901 - RNA, 13 nt, Homo sapiens
uguggaauguugg

SEQ ID NO: 1294902 - RNA, 17 nt, Homo sapiens
uguggaugauaaaacac

SEQ ID NO: 1294903 - RNA, 18 nt, Homo sapiens
uguggaugauaaaacaca

SEQ ID NO: 1294904 - RNA, 17 nt, Homo sapiens
uguggauggucauugca

SEQ ID NO: 1294905 - RNA, 17 nt, Homo sapiens
uguggccacagcagcuu

SEQ ID NO: 1294906 - RNA, 17 nt, Homo sapiens
uguggcucacgugagag

SEQ ID NO: 1294907 - RNA, 23 nt, Homo sapiens
uguggcuuuugcaauucacgccc

SEQ ID NO: 1294908 - RNA, 15 nt, Homo sapiens
ugugggcuccaugua

SEQ ID NO: 1294909 - RNA, 15 nt, Homo sapiens
ugugggucucuggaa

SEQ ID NO: 1294910 - RNA, 15 nt, Homo sapiens
uguguaaugugcaaa

SEQ ID NO: 1294911 - RNA, 14 nt, Homo sapiens
uguguauacuugua

SEQ ID NO: 1294912 - RNA, 17 nt, Homo sapiens
ugugucauugacaaagc

SEQ ID NO: 1294913 - RNA, 18 nt, Homo sapiens
ugugucccccucugucca

SEQ ID NO: 1294914 - RNA, 9 nt, Homo sapiens
ugugugaga

SEQ ID NO: 1294915 - RNA, 13 nt, Homo sapiens
ugugugauugcac

SEQ ID NO: 1294916 - RNA, 16 nt, Homo sapiens
ugugugcacguacaca

SEQ ID NO: 1294917 - RNA, 21 nt, Homo sapiens
ugugugcacguacacacacau

SEQ ID NO: 1294918 - RNA, 17 nt, Homo sapiens
uguguggggugggcaca

SEQ ID NO: 1294919 - RNA, 15 nt, Homo sapiens
uuaaagaauaugacu

SEQ ID NO: 1294920 - RNA, 14 nt, Homo sapiens
uuaaagcaaaugaa

SEQ ID NO: 1294921 - RNA, 15 nt, Homo sapiens
uuaaauaaauggaau

SEQ ID NO: 1294922 - RNA, 20 nt, Homo sapiens
uuaaaugugacauucuuaaa

SEQ ID NO: 1294923 - RNA, 21 nt, Homo sapiens
uuaacagcugguauggccuua

SEQ ID NO: 1294924 - RNA, 13 nt, Homo sapiens
uuaacccagugua

SEQ ID NO: 1294925 - RNA, 18 nt, Homo sapiens
uuaaccugccaacauacu

SEQ ID NO: 1294926 - RNA, 22 nt, Homo sapiens
uuaaccugccaacauacuuuaa

SEQ ID NO: 1294927 - RNA, 19 nt, Homo sapiens
uuaacuaugaauucuuaag

SEQ ID NO: 1294928 - RNA, 12 nt, Homo sapiens
uuaacucuagaa

SEQ ID NO: 1294929 - RNA, 18 nt, Homo sapiens
uuaagaaucaagauauaa

SEQ ID NO: 1294930 - RNA, 14 nt, Homo sapiens
uuaagaauuucaca

SEQ ID NO: 1294931 - RNA, 18 nt, Homo sapiens
uuaagaauuucacaagcu

SEQ ID NO: 1294932 - RNA, 14 nt, Homo sapiens
uuaagagauggcau

SEQ ID NO: 1294933 - RNA, 11 nt, Homo sapiens
uuaagcugcua

SEQ ID NO: 1294934 - RNA, 14 nt, Homo sapiens
uuaaggacacuggg

SEQ ID NO: 1294935 - RNA, 12 nt, Homo sapiens
uuaaggagccua

SEQ ID NO: 1294936 - RNA, 14 nt, Homo sapiens
uuaaggccugaauc

SEQ ID NO: 1294937 - RNA, 19 nt, Homo sapiens
uuaaggggagcaacagagg

SEQ ID NO: 1294938 - RNA, 19 nt, Homo sapiens
uuaaggucauuacucucaa

SEQ ID NO: 1294939 - RNA, 17 nt, Homo sapiens
uuaagguucaagacaga

SEQ ID NO: 1294940 - RNA, 18 nt, Homo sapiens
uuaagguucaagacagau

SEQ ID NO: 1294941 - RNA, 18 nt, Homo sapiens
uuaauauaguugguacac

SEQ ID NO: 1294942 - RNA, 13 nt, Homo sapiens
uuaauaugcugca

SEQ ID NO: 1294943 - RNA, 17 nt, Homo sapiens
uuaaucuaccuugcagu

SEQ ID NO: 1294944 - RNA, 21 nt, Homo sapiens
uuaaugaacacacaagcuugu

SEQ ID NO: 1294945 - RNA, 21 nt, Homo sapiens
uuaaugcaagagaacauuuua

SEQ ID NO: 1294946 - RNA, 15 nt, Homo sapiens
uuaaugcagacaaac

SEQ ID NO: 1294947 - RNA, 17 nt, Homo sapiens
uuaaugcagacaaacaa

SEQ ID NO: 1294948 - RNA, 18 nt, Homo sapiens
uuaaugcauauuccccuc

SEQ ID NO: 1294949 - RNA, 15 nt, Homo sapiens
uuaauguucugugau

SEQ ID NO: 1294950 - RNA, 16 nt, Homo sapiens
uuaauguucugugaua

SEQ ID NO: 1294951 - RNA, 17 nt, Homo sapiens
uuaauuuuaacugccaa

SEQ ID NO: 1294952 - RNA, 15 nt, Homo sapiens
uuaauuuugauauaa

SEQ ID NO: 1294953 - RNA, 17 nt, Homo sapiens
uuaauuuuuugguacaa

SEQ ID NO: 1294954 - RNA, 17 nt, Homo sapiens
uuacaaaaaaauacaaa

SEQ ID NO: 1294955 - RNA, 18 nt, Homo sapiens
uuacaaaaaaauacaaaa

SEQ ID NO: 1294956 - RNA, 18 nt, Homo sapiens
uuacaaauggacauagga

SEQ ID NO: 1294957 - RNA, 13 nt, Homo sapiens
uuacaauugugag

SEQ ID NO: 1294958 - RNA, 19 nt, Homo sapiens
uuacacugugucauucugu

SEQ ID NO: 1294959 - RNA, 19 nt, Homo sapiens
uuacagaagugaaagugag

SEQ ID NO: 1294960 - RNA, 21 nt, Homo sapiens
uuacagacuccuaacuacagg

SEQ ID NO: 1294961 - RNA, 16 nt, Homo sapiens
uuacagggaaugccug

SEQ ID NO: 1294962 - RNA, 19 nt, Homo sapiens
uuacagguuacgugagaac

SEQ ID NO: 1294963 - RNA, 23 nt, Homo sapiens
uuacaguaggagcccagcucuga

SEQ ID NO: 1294964 - RNA, 21 nt, Homo sapiens
uuacaguauauguugcaaaau

SEQ ID NO: 1294965 - RNA, 16 nt, Homo sapiens
uuacaguuccuucaau

SEQ ID NO: 1294966 - RNA, 15 nt, Homo sapiens
uuaccuuuaccccau

SEQ ID NO: 1294967 - RNA, 17 nt, Homo sapiens
uuacgcccaucucagga

SEQ ID NO: 1294968 - RNA, 16 nt, Homo sapiens
uuacuaacuaaacucu

SEQ ID NO: 1294969 - RNA, 17 nt, Homo sapiens
uuacuaauuauacuacu

SEQ ID NO: 1294970 - RNA, 16 nt, Homo sapiens
uuacuccucacacuua

SEQ ID NO: 1294971 - RNA, 18 nt, Homo sapiens
uuacuccuucuguuuuga

SEQ ID NO: 1294972 - RNA, 23 nt, Homo sapiens
uuacucuagauaccuaaaacaua

SEQ ID NO: 1294973 - RNA, 17 nt, Homo sapiens
uuacugauucauacauu

SEQ ID NO: 1294974 - RNA, 12 nt, Homo sapiens
uuacugcuugac

SEQ ID NO: 1294975 - RNA, 17 nt, Homo sapiens
uuacuggacaaagaauu

SEQ ID NO: 1294976 - RNA, 19 nt, Homo sapiens
uuacuggauuugacuucag

SEQ ID NO: 1294977 - RNA, 19 nt, Homo sapiens
uuacuuuagaagcacagua

SEQ ID NO: 1294978 - RNA, 20 nt, Homo sapiens
uuacuuuuuugguacuauaa

SEQ ID NO: 1294979 - RNA, 19 nt, Homo sapiens
uuagaaaaaccaccaccau

SEQ ID NO: 1294980 - RNA, 21 nt, Homo sapiens
uuagaaaaagaacaugcaguu

SEQ ID NO: 1294981 - RNA, 18 nt, Homo sapiens
uuagaaacaacauagcaa

SEQ ID NO: 1294982 - RNA, 17 nt, Homo sapiens
uuagaaauaauggucau

SEQ ID NO: 1294983 - RNA, 12 nt, Homo sapiens
uuagaacaggga

SEQ ID NO: 1294984 - RNA, 23 nt, Homo sapiens
uuagaacagucauuaauuuucaa

SEQ ID NO: 1294985 - RNA, 14 nt, Homo sapiens
uuagaagucacaca

SEQ ID NO: 1294986 - RNA, 18 nt, Homo sapiens
uuagaaucugaguauaaa

SEQ ID NO: 1294987 - RNA, 19 nt, Homo sapiens
uuagaauuaaaaaagcaua

SEQ ID NO: 1294988 - RNA, 18 nt, Homo sapiens
uuagacguccuccgucca

SEQ ID NO: 1294989 - RNA, 20 nt, Homo sapiens
uuagagaagggggauaaaga

SEQ ID NO: 1294990 - RNA, 19 nt, Homo sapiens
uuagagcuggcaccagaac

SEQ ID NO: 1294991 - RNA, 20 nt, Homo sapiens
uuagagcuggcaccagaacu

SEQ ID NO: 1294992 - RNA, 17 nt, Homo sapiens
uuagaggaccagugagu

SEQ ID NO: 1294993 - RNA, 15 nt, Homo sapiens
uuagagggagcccag

SEQ ID NO: 1294994 - RNA, 15 nt, Homo sapiens
uuagaggggggaaau

SEQ ID NO: 1294995 - RNA, 18 nt, Homo sapiens
uuagaguccuaguuuucc

SEQ ID NO: 1294996 - RNA, 12 nt, Homo sapiens
uuagcagacagg

SEQ ID NO: 1294997 - RNA, 15 nt, Homo sapiens
uuagcauuuugcuaa

SEQ ID NO: 1294998 - RNA, 20 nt, Homo sapiens
uuagccauuuuucaaagcaa

SEQ ID NO: 1294999 - RNA, 19 nt, Homo sapiens
uuaggaaaaaaacuauuaa

SEQ ID NO: 1295000 - RNA, 18 nt, Homo sapiens
uuaggaagguacugucau

SEQ ID NO: 1295001 - RNA, 18 nt, Homo sapiens
uuaggauuuucacauucu

SEQ ID NO: 1295002 - RNA, 12 nt, Homo sapiens
uuaguugccaau

SEQ ID NO: 1295003 - RNA, 20 nt, Homo sapiens
uuauaaaaaugagugcuuaa

SEQ ID NO: 1295004 - RNA, 18 nt, Homo sapiens
uuauaaacaacaucaaaa

SEQ ID NO: 1295005 - RNA, 13 nt, Homo sapiens
uuauaacaagugu

SEQ ID NO: 1295006 - RNA, 20 nt, Homo sapiens
uuauaacauccacaaagaga

SEQ ID NO: 1295007 - RNA, 12 nt, Homo sapiens
uuauaacuuuaa

SEQ ID NO: 1295008 - RNA, 15 nt, Homo sapiens
uuauaagacaaugag

SEQ ID NO: 1295009 - RNA, 16 nt, Homo sapiens
uuauacgcuggcaaca

SEQ ID NO: 1295010 - RNA, 22 nt, Homo sapiens
uuauaggaaaauauaugaagaa

SEQ ID NO: 1295011 - RNA, 17 nt, Homo sapiens
uuauauaauuguugaac

SEQ ID NO: 1295012 - RNA, 13 nt, Homo sapiens
uuauaucaguauu

SEQ ID NO: 1295013 - RNA, 15 nt, Homo sapiens
uuauaucauauguau

SEQ ID NO: 1295014 - RNA, 16 nt, Homo sapiens
uuauauguugcuauaa

SEQ ID NO: 1295015 - RNA, 17 nt, Homo sapiens
uuauauuaauguacuug

SEQ ID NO: 1295016 - RNA, 18 nt, Homo sapiens
uuaucaccucauucugaa

SEQ ID NO: 1295017 - RNA, 22 nt, Homo sapiens
uuaucagcaaaaaaguccaauu

SEQ ID NO: 1295018 - RNA, 21 nt, Homo sapiens
uuaucaugcaaaugcuguauu

SEQ ID NO: 1295019 - RNA, 12 nt, Homo sapiens
uuauccaugccu

SEQ ID NO: 1295020 - RNA, 18 nt, Homo sapiens
uuaucucacuugugccaa

SEQ ID NO: 1295021 - RNA, 23 nt, Homo sapiens
uuaucugucccagguuaucuggg

SEQ ID NO: 1295022 - RNA, 12 nt, Homo sapiens
uuaucugugcaa

SEQ ID NO: 1295023 - RNA, 22 nt, Homo sapiens
uuaugaaaaacagaagcacaaa

SEQ ID NO: 1295024 - RNA, 19 nt, Homo sapiens
uuaugauagugguaugaca

SEQ ID NO: 1295025 - RNA, 16 nt, Homo sapiens
uuaugcauaaagucag

SEQ ID NO: 1295026 - RNA, 17 nt, Homo sapiens
uuaugcgaaccuauguc

SEQ ID NO: 1295027 - RNA, 13 nt, Homo sapiens
uuaugcggcauuu

SEQ ID NO: 1295028 - RNA, 16 nt, Homo sapiens
uuaugcugaaacagaa

SEQ ID NO: 1295029 - RNA, 11 nt, Homo sapiens
uuauguacaaa

SEQ ID NO: 1295030 - RNA, 20 nt, Homo sapiens
uuaugucccugacuguaaau

SEQ ID NO: 1295031 - RNA, 15 nt, Homo sapiens
uuauuaauacuaugc

SEQ ID NO: 1295032 - RNA, 17 nt, Homo sapiens
uuauuacauggggucua

SEQ ID NO: 1295033 - RNA, 15 nt, Homo sapiens
uuauuaccucugaua

SEQ ID NO: 1295034 - RNA, 21 nt, Homo sapiens
uuauuaccucugauaccucaa

SEQ ID NO: 1295035 - RNA, 13 nt, Homo sapiens
uuauuauaacauc

SEQ ID NO: 1295036 - RNA, 21 nt, Homo sapiens
uuauuuggauaucaaaagcaa

SEQ ID NO: 1295037 - RNA, 17 nt, Homo sapiens
uuauuuuccccaaccuc

SEQ ID NO: 1295038 - RNA, 16 nt, Homo sapiens
uuauuuuuacaguucu

SEQ ID NO: 1295039 - RNA, 21 nt, Homo sapiens
uucaaaggaaaauagacagaa

SEQ ID NO: 1295040 - RNA, 21 nt, Homo sapiens
gugagcacuaaggugugcucu

SEQ ID NO: 1295041 - RNA, 18 nt, Homo sapiens
gugaggaugucacucaga

SEQ ID NO: 1295042 - RNA, 15 nt, Homo sapiens
gugagguucuugggu

SEQ ID NO: 1295043 - RNA, 12 nt, Homo sapiens
gugagugcaagg

SEQ ID NO: 1295044 - RNA, 19 nt, Homo sapiens
gugaguguuucuaugagug

SEQ ID NO: 1295045 - RNA, 13 nt, Homo sapiens
gugauacauuucu

SEQ ID NO: 1295046 - RNA, 18 nt, Homo sapiens
gugauccacccaccucag

SEQ ID NO: 1295047 - RNA, 18 nt, Homo sapiens
gugauccucccaccucag

SEQ ID NO: 1295048 - RNA, 23 nt, Homo sapiens
gugauugacagcuuugcugcuga

SEQ ID NO: 1295049 - RNA, 18 nt, Homo sapiens
gugcacaggcgcauccca

SEQ ID NO: 1295050 - RNA, 16 nt, Homo sapiens
gugcacaucugugucu

SEQ ID NO: 1295051 - RNA, 20 nt, Homo sapiens
gugcagugagccgagaucac

SEQ ID NO: 1295052 - RNA, 19 nt, Homo sapiens
gugcaguggugcgaucucg

SEQ ID NO: 1295053 - RNA, 15 nt, Homo sapiens
gugcauaugcaugug

SEQ ID NO: 1295054 - RNA, 20 nt, Homo sapiens
gugccacaaauaaaauggau

SEQ ID NO: 1295055 - RNA, 22 nt, Homo sapiens
gugccacuuuaauccuuccacu

SEQ ID NO: 1295056 - RNA, 21 nt, Homo sapiens
gugcccagggcucuaaugugu

SEQ ID NO: 1295057 - RNA, 16 nt, Homo sapiens
gugcccuagacuggcu

SEQ ID NO: 1295058 - RNA, 20 nt, Homo sapiens
gugccugugggccugggaua

SEQ ID NO: 1295059 - RNA, 14 nt, Homo sapiens
gugcucacauagga

SEQ ID NO: 1295060 - RNA, 14 nt, Homo sapiens
gugcuguaauuuaa

SEQ ID NO: 1295061 - RNA, 20 nt, Homo sapiens
gugcuguauaaaaucagcca

SEQ ID NO: 1295062 - RNA, 22 nt, Homo sapiens
gugcuguauaaaaucagccaau

SEQ ID NO: 1295063 - RNA, 19 nt, Homo sapiens
guggaaaacgaagcucauu

SEQ ID NO: 1295064 - RNA, 12 nt, Homo sapiens
guggacaggugu

SEQ ID NO: 1295065 - RNA, 17 nt, Homo sapiens
guggacaguccccaccu

SEQ ID NO: 1295066 - RNA, 18 nt, Homo sapiens
guggagugcaguggugcg

SEQ ID NO: 1295067 - RNA, 19 nt, Homo sapiens
guggagugcaguggugcga

SEQ ID NO: 1295068 - RNA, 13 nt, Homo sapiens
guggcacaggagu

SEQ ID NO: 1295069 - RNA, 14 nt, Homo sapiens
guggcacucaugga

SEQ ID NO: 1295070 - RNA, 17 nt, Homo sapiens
guggccacagcagcuuu

SEQ ID NO: 1295071 - RNA, 18 nt, Homo sapiens
guggccacuucuguccau

SEQ ID NO: 1295072 - RNA, 18 nt, Homo sapiens
guggcccaagggugguga

SEQ ID NO: 1295073 - RNA, 14 nt, Homo sapiens
guggcgacucuaua

SEQ ID NO: 1295074 - RNA, 16 nt, Homo sapiens
guggcucugaugcuga

SEQ ID NO: 1295075 - RNA, 21 nt, Homo sapiens
gugggaccucagacaaaaccc

SEQ ID NO: 1295076 - RNA, 14 nt, Homo sapiens
gugggccuggcaca

SEQ ID NO: 1295077 - RNA, 14 nt, Homo sapiens
gugguccacugagc

SEQ ID NO: 1295078 - RNA, 15 nt, Homo sapiens
guggugucugugaag

SEQ ID NO: 1295079 - RNA, 19 nt, Homo sapiens
gugguugaagagcaaugug

SEQ ID NO: 1295080 - RNA, 14 nt, Homo sapiens
guguaaaauguaau

SEQ ID NO: 1295081 - RNA, 22 nt, Homo sapiens
gugucacucaaggcggugcuug

SEQ ID NO: 1295082 - RNA, 19 nt, Homo sapiens
gugucagagcugaaauuca

SEQ ID NO: 1295083 - RNA, 15 nt, Homo sapiens
gugucaugauucacc

SEQ ID NO: 1295084 - RNA, 13 nt, Homo sapiens
gugucccauagaa

SEQ ID NO: 1295085 - RNA, 16 nt, Homo sapiens
gugugcauaugcaugu

SEQ ID NO: 1295086 - RNA, 13 nt, Homo sapiens
gugugucagcuga

SEQ ID NO: 1295087 - RNA, 19 nt, Homo sapiens
guguguccaaaacugccuc

SEQ ID NO: 1295088 - RNA, 15 nt, Homo sapiens
gugugugacaauucu

SEQ ID NO: 1295089 - RNA, 15 nt, Homo sapiens
guguuauucuugccc

SEQ ID NO: 1295090 - RNA, 18 nt, Homo sapiens
guguucacaacagugaaa

SEQ ID NO: 1295091 - RNA, 18 nt, Homo sapiens
guguugcaaguuggucca

SEQ ID NO: 1295092 - RNA, 14 nt, Homo sapiens
guguuuguggucaa

SEQ ID NO: 1295093 - RNA, 20 nt, Homo sapiens
guuaaauagaguauaugcac

SEQ ID NO: 1295094 - RNA, 17 nt, Homo sapiens
guuaacacucaugaagc

SEQ ID NO: 1295095 - RNA, 18 nt, Homo sapiens
guuaaggguuaguuuaca

SEQ ID NO: 1295096 - RNA, 21 nt, Homo sapiens
guuaauuuuuugguacaaaaa

SEQ ID NO: 1295097 - RNA, 16 nt, Homo sapiens
guuacagcacaaaaug

SEQ ID NO: 1295098 - RNA, 13 nt, Homo sapiens
guuacaucuugua

SEQ ID NO: 1295099 - RNA, 21 nt, Homo sapiens
guuacuuuuucuuguauucau

SEQ ID NO: 1295100 - RNA, 14 nt, Homo sapiens
guuaguuccuucau

SEQ ID NO: 1295101 - RNA, 18 nt, Homo sapiens
guuaucuaauauguaaca

SEQ ID NO: 1295102 - RNA, 17 nt, Homo sapiens
guuaugaaaaacagaag

SEQ ID NO: 1295103 - RNA, 16 nt, Homo sapiens
guuauggcagaugaca

SEQ ID NO: 1295104 - RNA, 19 nt, Homo sapiens
guuauuuagggaacugcuu

SEQ ID NO: 1295105 - RNA, 18 nt, Homo sapiens
guucaagagcacacuugg

SEQ ID NO: 1295106 - RNA, 14 nt, Homo sapiens
guucacagugcaua

SEQ ID NO: 1295107 - RNA, 16 nt, Homo sapiens
guucacucccaaccug

SEQ ID NO: 1295108 - RNA, 21 nt, Homo sapiens
guucaucagacuccugugcaa

SEQ ID NO: 1295109 - RNA, 20 nt, Homo sapiens
guuccagcaaacaaaaugga

SEQ ID NO: 1295110 - RNA, 21 nt, Homo sapiens
guuccagcaaacaaaauggac

SEQ ID NO: 1295111 - RNA, 13 nt, Homo sapiens
guuccccagagaa

SEQ ID NO: 1295112 - RNA, 15 nt, Homo sapiens
guuccccuucaguac

SEQ ID NO: 1295113 - RNA, 18 nt, Homo sapiens
guucccuuacuguuucac

SEQ ID NO: 1295114 - RNA, 19 nt, Homo sapiens
guucccuuccuauuccaag

SEQ ID NO: 1295115 - RNA, 16 nt, Homo sapiens
guuccuuaucaccugc

SEQ ID NO: 1295116 - RNA, 18 nt, Homo sapiens
guuccuucacauccugug

SEQ ID NO: 1295117 - RNA, 20 nt, Homo sapiens
guucgcauggucacacacug

SEQ ID NO: 1295118 - RNA, 18 nt, Homo sapiens
guucucucucucugucuc

SEQ ID NO: 1295119 - RNA, 21 nt, Homo sapiens
guucucucucucugucucucu

SEQ ID NO: 1295120 - RNA, 14 nt, Homo sapiens
guucugugcacaaa

SEQ ID NO: 1295121 - RNA, 23 nt, Homo sapiens
guuuucuggggaaaggggacaag

SEQ ID NO: 1295122 - RNA, 13 nt, Homo sapiens
guuuucuguucuc

SEQ ID NO: 1295123 - RNA, 16 nt, Homo sapiens
guuuuggaugcagugc

SEQ ID NO: 1295124 - RNA, 15 nt, Homo sapiens
guuuuguauucucug

SEQ ID NO: 1295125 - RNA, 18 nt, Homo sapiens
guuuuuccacuacugcua

SEQ ID NO: 1295126 - RNA, 17 nt, Homo sapiens
guuuuucuuuucauuua

SEQ ID NO: 1295127 - RNA, 23 nt, Homo sapiens
guuuuugugaaaagcuccauuuu

SEQ ID NO: 1295128 - RNA, 19 nt, Homo sapiens
guuuuuuuuaagauuuauu

SEQ ID NO: 1295129 - RNA, 15 nt, Homo sapiens
uaaaaaaaaaauuca

SEQ ID NO: 1295130 - RNA, 15 nt, Homo sapiens
uaaaaacauugccuu

SEQ ID NO: 1295131 - RNA, 15 nt, Homo sapiens
uaaaaaccuuccaaa

SEQ ID NO: 1295132 - RNA, 19 nt, Homo sapiens
uaaaaagcaacaggccauu

SEQ ID NO: 1295133 - RNA, 18 nt, Homo sapiens
uaaaaauaaaucccaugg

SEQ ID NO: 1295134 - RNA, 17 nt, Homo sapiens
uaaaaaucacacuguaa

SEQ ID NO: 1295135 - RNA, 14 nt, Homo sapiens
uaaaaaucugagaa

SEQ ID NO: 1295136 - RNA, 12 nt, Homo sapiens
uaaaaaugcaaa

SEQ ID NO: 1295137 - RNA, 15 nt, Homo sapiens
uaaaaaugcaacuuc

SEQ ID NO: 1295138 - RNA, 21 nt, Homo sapiens
uaaaaauuguuuuaaacuaca

SEQ ID NO: 1295139 - RNA, 19 nt, Homo sapiens
uaaaacaagcacuaaacaa

SEQ ID NO: 1295140 - RNA, 17 nt, Homo sapiens
uaaaacagcauuagaua

SEQ ID NO: 1295141 - RNA, 16 nt, Homo sapiens
uaaaacaguaucucuu

SEQ ID NO: 1295142 - RNA, 14 nt, Homo sapiens
uaaaagacagugaa

SEQ ID NO: 1295143 - RNA, 17 nt, Homo sapiens
uaaaagugggcuugauu

SEQ ID NO: 1295144 - RNA, 12 nt, Homo sapiens
uaaaaguucuuu

SEQ ID NO: 1295145 - RNA, 20 nt, Homo sapiens
uaaaaguucuuuuugcucua

SEQ ID NO: 1295146 - RNA, 15 nt, Homo sapiens
uaaaauaaagcuacc

SEQ ID NO: 1295147 - RNA, 23 nt, Homo sapiens
uaaaauaaagcuaccauuuuaca

SEQ ID NO: 1295148 - RNA, 21 nt, Homo sapiens
uaaaaugcaaaauccugguga

SEQ ID NO: 1295149 - RNA, 15 nt, Homo sapiens
uaaaauggaugccuu

SEQ ID NO: 1295150 - RNA, 18 nt, Homo sapiens
uaaaauggaugccuugaa

SEQ ID NO: 1295151 - RNA, 16 nt, Homo sapiens
uaaaauguaaagccau

SEQ ID NO: 1295152 - RNA, 16 nt, Homo sapiens
uaaaauguuaagcugc

SEQ ID NO: 1295153 - RNA, 23 nt, Homo sapiens
uaaaauuagaaucugaguauaaa

SEQ ID NO: 1295154 - RNA, 12 nt, Homo sapiens
uaaacaaaccac

SEQ ID NO: 1295155 - RNA, 16 nt, Homo sapiens
uaaacacgccugcaaa

SEQ ID NO: 1295156 - RNA, 20 nt, Homo sapiens
uaaacaguaaaccuuaacag

SEQ ID NO: 1295157 - RNA, 20 nt, Homo sapiens
uaaaccauaugaacauauau

SEQ ID NO: 1295158 - RNA, 17 nt, Homo sapiens
uaaaccaucaucuugcc

SEQ ID NO: 1295159 - RNA, 15 nt, Homo sapiens
uaaaccugacaaugg

SEQ ID NO: 1295160 - RNA, 19 nt, Homo sapiens
uaaacuggaauccuuucac

SEQ ID NO: 1295161 - RNA, 17 nt, Homo sapiens
uaaacuguaaacuaaua

SEQ ID NO: 1295162 - RNA, 21 nt, Homo sapiens
uaaacuuuagaauuaauuuau

SEQ ID NO: 1295163 - RNA, 21 nt, Homo sapiens
uaaagaacaggauuccagaau

SEQ ID NO: 1295164 - RNA, 21 nt, Homo sapiens
uaaagaauacuugaacuuguc

SEQ ID NO: 1295165 - RNA, 20 nt, Homo sapiens
uaaagaccugacaccuuuca

SEQ ID NO: 1295166 - RNA, 19 nt, Homo sapiens
uaaagcaacaaaaauuacu

SEQ ID NO: 1295167 - RNA, 21 nt, Homo sapiens
uaaagcagagcuaguaaugcu

SEQ ID NO: 1295168 - RNA, 13 nt, Homo sapiens
uaaagcauaaaaa

SEQ ID NO: 1295169 - RNA, 16 nt, Homo sapiens
uaaagccaaacauaua

SEQ ID NO: 1295170 - RNA, 19 nt, Homo sapiens
uaaagggcgcaaagggcau

SEQ ID NO: 1295171 - RNA, 13 nt, Homo sapiens
uaaagguaugaaa

SEQ ID NO: 1295172 - RNA, 14 nt, Homo sapiens
uaaagugacagaug

SEQ ID NO: 1295173 - RNA, 20 nt, Homo sapiens
uaaagugacuaauggcauga

SEQ ID NO: 1295174 - RNA, 20 nt, Homo sapiens
uaaagugcuuuagguaugaa

SEQ ID NO: 1295175 - RNA, 14 nt, Homo sapiens
uaaauaaauaucuc

SEQ ID NO: 1295176 - RNA, 21 nt, Homo sapiens
uaaauaaauguaauagccaaa

SEQ ID NO: 1295177 - RNA, 13 nt, Homo sapiens
uaaauaaugcaua

SEQ ID NO: 1295178 - RNA, 20 nt, Homo sapiens
uaaauauauauaaaccuaaa

SEQ ID NO: 1295179 - RNA, 20 nt, Homo sapiens
uaaauauauauuauucucau

SEQ ID NO: 1295180 - RNA, 13 nt, Homo sapiens
uaaaucaucuuug

SEQ ID NO: 1295181 - RNA, 16 nt, Homo sapiens
uaaauccaugcaccua

SEQ ID NO: 1295182 - RNA, 22 nt, Homo sapiens
uaaauccugucuuauuuguuca

SEQ ID NO: 1295183 - RNA, 14 nt, Homo sapiens
uaaaucgcuaccuu

SEQ ID NO: 1295184 - RNA, 17 nt, Homo sapiens
uaaaugaagaaggaaua

SEQ ID NO: 1295185 - RNA, 16 nt, Homo sapiens
uaaaugacucuacuaa

SEQ ID NO: 1295186 - RNA, 15 nt, Homo sapiens
uaaaugaguucaaca

SEQ ID NO: 1295187 - RNA, 14 nt, Homo sapiens
uaaauguaucuuau

SEQ ID NO: 1295188 - RNA, 14 nt, Homo sapiens
uaaaugugaacuua

SEQ ID NO: 1295189 - RNA, 21 nt, Homo sapiens
uaaaugugaaugaugauccua

SEQ ID NO: 1295190 - RNA, 11 nt, Homo sapiens
uaaaugugcag

SEQ ID NO: 1295191 - RNA, 11 nt, Homo sapiens
uaacaaugaag

SEQ ID NO: 1295192 - RNA, 15 nt, Homo sapiens
uaacaauugugaagu

SEQ ID NO: 1295193 - RNA, 13 nt, Homo sapiens
uaacacacagcua

SEQ ID NO: 1295194 - RNA, 13 nt, Homo sapiens
uaacacagaggac

SEQ ID NO: 1295195 - RNA, 16 nt, Homo sapiens
uaacagaaaauguguc

SEQ ID NO: 1295196 - RNA, 10 nt, Homo sapiens
uaacagagag

SEQ ID NO: 1295197 - RNA, 14 nt, Homo sapiens
uaacagccuuucaa

SEQ ID NO: 1295198 - RNA, 19 nt, Homo sapiens
ugucccaucucuacccccu

SEQ ID NO: 1295199 - RNA, 19 nt, Homo sapiens
uguccccuaaaccaaaaac

SEQ ID NO: 1295200 - RNA, 15 nt, Homo sapiens
ugucccugacuguaa

SEQ ID NO: 1295201 - RNA, 16 nt, Homo sapiens
ugucccugcacuugca

SEQ ID NO: 1295202 - RNA, 15 nt, Homo sapiens
uguccuccaagccag

SEQ ID NO: 1295203 - RNA, 17 nt, Homo sapiens
ugucuaaacaaugcuga

SEQ ID NO: 1295204 - RNA, 14 nt, Homo sapiens
ugucuauuccauuc

SEQ ID NO: 1295205 - RNA, 21 nt, Homo sapiens
ugucuauuucuaaaagccaau

SEQ ID NO: 1295206 - RNA, 19 nt, Homo sapiens
ugucuauuuuuucuugaca

SEQ ID NO: 1295207 - RNA, 15 nt, Homo sapiens
ugucucaccuaccca

SEQ ID NO: 1295208 - RNA, 18 nt, Homo sapiens
ugucucacuucacagccc

SEQ ID NO: 1295209 - RNA, 14 nt, Homo sapiens
ugucucagccuccc

SEQ ID NO: 1295210 - RNA, 16 nt, Homo sapiens
ugucuccuuaacacug

SEQ ID NO: 1295211 - RNA, 21 nt, Homo sapiens
ugucucggagggauuccccua

SEQ ID NO: 1295212 - RNA, 20 nt, Homo sapiens
ugucucugggccacuuggag

SEQ ID NO: 1295213 - RNA, 18 nt, Homo sapiens
ugucucuuuaaugucaca

SEQ ID NO: 1295214 - RNA, 19 nt, Homo sapiens
ugucuggauucccaggaug

SEQ ID NO: 1295215 - RNA, 13 nt, Homo sapiens
ugucuucaccuga

SEQ ID NO: 1295216 - RNA, 15 nt, Homo sapiens
ugucuuuaacuguca

SEQ ID NO: 1295217 - RNA, 18 nt, Homo sapiens
ugucuuuuuucacuacau

SEQ ID NO: 1295218 - RNA, 16 nt, Homo sapiens
ugugaaacucaucuca

SEQ ID NO: 1295219 - RNA, 15 nt, Homo sapiens
ugugaacagcuugcu

SEQ ID NO: 1295220 - RNA, 21 nt, Homo sapiens
ugugaacagcuugcugucacu

SEQ ID NO: 1295221 - RNA, 20 nt, Homo sapiens
ugugaccaaugucuugaugc

SEQ ID NO: 1295222 - RNA, 21 nt, Homo sapiens
ugugacugaggcggagcccag

SEQ ID NO: 1295223 - RNA, 12 nt, Homo sapiens
ugugagcaagaa

SEQ ID NO: 1295224 - RNA, 17 nt, Homo sapiens
ugugagccggagcucau

SEQ ID NO: 1295225 - RNA, 14 nt, Homo sapiens
ugugagcuaggaga

SEQ ID NO: 1295226 - RNA, 14 nt, Homo sapiens
ugugauacauuucu

SEQ ID NO: 1295227 - RNA, 18 nt, Homo sapiens
ugugauagcacuuucuac

SEQ ID NO: 1295228 - RNA, 18 nt, Homo sapiens
ugugaugguacacagugg

SEQ ID NO: 1295229 - RNA, 11 nt, Homo sapiens
ugugcacauuu

SEQ ID NO: 1295230 - RNA, 23 nt, Homo sapiens
ugugcaccccuccccauucacag

SEQ ID NO: 1295231 - RNA, 14 nt, Homo sapiens
ugugcauaugcaug

SEQ ID NO: 1295232 - RNA, 18 nt, Homo sapiens
ugugccacuacacuccag

SEQ ID NO: 1295233 - RNA, 14 nt, Homo sapiens
ugugccccucaugc

SEQ ID NO: 1295234 - RNA, 12 nt, Homo sapiens
ugugcccgggga

SEQ ID NO: 1295235 - RNA, 17 nt, Homo sapiens
ugugcccuccuucccaa

SEQ ID NO: 1295236 - RNA, 13 nt, Homo sapiens
ugugcccugacca

SEQ ID NO: 1295237 - RNA, 17 nt, Homo sapiens
ugugccugaagucccag

SEQ ID NO: 1295238 - RNA, 24 nt, Homo sapiens
ugugcucugaucauccacugugcc

SEQ ID NO: 1295239 - RNA, 17 nt, Homo sapiens
uguggagacuucaucaa

SEQ ID NO: 1295240 - RNA, 22 nt, Homo sapiens
uguggagaugcccaggauuuga

SEQ ID NO: 1295241 - RNA, 20 nt, Homo sapiens
uguggaugagcccucagaac

SEQ ID NO: 1295242 - RNA, 17 nt, Homo sapiens
uguggcaucuugccaag

SEQ ID NO: 1295243 - RNA, 20 nt, Homo sapiens
uguggccugggccuccucac

SEQ ID NO: 1295244 - RNA, 13 nt, Homo sapiens
ugugggauaucac

SEQ ID NO: 1295245 - RNA, 18 nt, Homo sapiens
ugugggcugugggcugca

SEQ ID NO: 1295246 - RNA, 18 nt, Homo sapiens
uguggggugggcacauug

SEQ ID NO: 1295247 - RNA, 14 nt, Homo sapiens
ugugguagcucaca

SEQ ID NO: 1295248 - RNA, 20 nt, Homo sapiens
ugugguccacugagcuauaa

SEQ ID NO: 1295249 - RNA, 15 nt, Homo sapiens
ugugguuaacgccuu

SEQ ID NO: 1295250 - RNA, 23 nt, Homo sapiens
uguguauccaugcaccuaccuua

SEQ ID NO: 1295251 - RNA, 12 nt, Homo sapiens
ugugucagcaua

SEQ ID NO: 1295252 - RNA, 13 nt, Homo sapiens
ugugucauauagu

SEQ ID NO: 1295253 - RNA, 11 nt, Homo sapiens
uguguccaaaa

SEQ ID NO: 1295254 - RNA, 18 nt, Homo sapiens
uguguccugaaacgcucc

SEQ ID NO: 1295255 - RNA, 17 nt, Homo sapiens
ugugucuuaggugcgca

SEQ ID NO: 1295256 - RNA, 20 nt, Homo sapiens
ugugugacucuuuagcaaaa

SEQ ID NO: 1295257 - RNA, 22 nt, Homo sapiens
uguguuacugcuuugcaaagac

SEQ ID NO: 1295258 - RNA, 16 nt, Homo sapiens
uguuaaccuaggcagu

SEQ ID NO: 1295259 - RNA, 12 nt, Homo sapiens
uguuaagcugcu

SEQ ID NO: 1295260 - RNA, 23 nt, Homo sapiens
uguuaagguccugaaaguaacuc

SEQ ID NO: 1295261 - RNA, 21 nt, Homo sapiens
uguuacccaggguggagugca

SEQ ID NO: 1295262 - RNA, 14 nt, Homo sapiens
uguuacuguaauuc

SEQ ID NO: 1295263 - RNA, 20 nt, Homo sapiens
uguuaggcgggagcucuccu

SEQ ID NO: 1295264 - RNA, 17 nt, Homo sapiens
uguuagguguacauccu

SEQ ID NO: 1295265 - RNA, 20 nt, Homo sapiens
uguuaucuuauacuguacaa

SEQ ID NO: 1295266 - RNA, 15 nt, Homo sapiens
uguuauuaacagaua

SEQ ID NO: 1295267 - RNA, 22 nt, Homo sapiens
uguuauuuaaugagucagucaa

SEQ ID NO: 1295268 - RNA, 11 nt, Homo sapiens
uguucaaagac

SEQ ID NO: 1295269 - RNA, 13 nt, Homo sapiens
uguucaacaucua

SEQ ID NO: 1295270 - RNA, 19 nt, Homo sapiens
uguucacaacagugaaaag

SEQ ID NO: 1295271 - RNA, 15 nt, Homo sapiens
uguucacuuccaaga

SEQ ID NO: 1295272 - RNA, 23 nt, Homo sapiens
uguucaggauacuuaguucaugg

SEQ ID NO: 1295273 - RNA, 15 nt, Homo sapiens
uguuccagacauucu

SEQ ID NO: 1295274 - RNA, 16 nt, Homo sapiens
uguuccccaucaucug

SEQ ID NO: 1295275 - RNA, 21 nt, Homo sapiens
uguuccuggaggucagcauuu

SEQ ID NO: 1295276 - RNA, 18 nt, Homo sapiens
uguuccuuaucaccugcc

SEQ ID NO: 1295277 - RNA, 17 nt, Homo sapiens
uguucucuuaugaucac

SEQ ID NO: 1295278 - RNA, 13 nt, Homo sapiens
uguucugggacac

SEQ ID NO: 1295279 - RNA, 17 nt, Homo sapiens
uguucuguauucugacc

SEQ ID NO: 1295280 - RNA, 15 nt, Homo sapiens
uguucugucuuccca

SEQ ID NO: 1295281 - RNA, 19 nt, Homo sapiens
uguucuucuucauauucua

SEQ ID NO: 1295282 - RNA, 18 nt, Homo sapiens
uguugaaggaacuugucu

SEQ ID NO: 1295283 - RNA, 15 nt, Homo sapiens
uguugaagucucagg

SEQ ID NO: 1295284 - RNA, 17 nt, Homo sapiens
uguugagcaucacagaa

SEQ ID NO: 1295285 - RNA, 13 nt, Homo sapiens
uguugauagcaag

SEQ ID NO: 1295286 - RNA, 21 nt, Homo sapiens
uguugauccauccagcuugcc

SEQ ID NO: 1295287 - RNA, 21 nt, Homo sapiens
uguugcccaggcuggucucaa

SEQ ID NO: 1295288 - RNA, 18 nt, Homo sapiens
uguugccuaagcuggucu

SEQ ID NO: 1295289 - RNA, 21 nt, Homo sapiens
uguugccuaagcuggucucaa

SEQ ID NO: 1295290 - RNA, 20 nt, Homo sapiens
uguuggccaaagccaaagcu

SEQ ID NO: 1295291 - RNA, 18 nt, Homo sapiens
uguugguucuuagaccuc

SEQ ID NO: 1295292 - RNA, 14 nt, Homo sapiens
uguuguacauuuca

SEQ ID NO: 1295293 - RNA, 18 nt, Homo sapiens
uguuguagguuucaggga

SEQ ID NO: 1295294 - RNA, 12 nt, Homo sapiens
uguuguguuucu

SEQ ID NO: 1295295 - RNA, 19 nt, Homo sapiens
uguuuaagaaaaaauaaca

SEQ ID NO: 1295296 - RNA, 17 nt, Homo sapiens
uguuuaagucacauuau

SEQ ID NO: 1295297 - RNA, 20 nt, Homo sapiens
uguuucaauugcaucuccca

SEQ ID NO: 1295298 - RNA, 18 nt, Homo sapiens
uguuucuuuuguauguaa

SEQ ID NO: 1295299 - RNA, 19 nt, Homo sapiens
uguuucuuuuguauguaaa

SEQ ID NO: 1295300 - RNA, 11 nt, Homo sapiens
uguuugcacac

SEQ ID NO: 1295301 - RNA, 21 nt, Homo sapiens
uguuuguaacuuuuuacauua

SEQ ID NO: 1295302 - RNA, 22 nt, Homo sapiens
uguuugucucaccuacccauga

SEQ ID NO: 1295303 - RNA, 16 nt, Homo sapiens
uguuuguuguauacuu

SEQ ID NO: 1295304 - RNA, 21 nt, Homo sapiens
uguuuuaaauuuugugguucc

SEQ ID NO: 1295305 - RNA, 22 nt, Homo sapiens
uguuuuccaaagaaaaguauug

SEQ ID NO: 1295306 - RNA, 22 nt, Homo sapiens
uguuuucgaauacgucagauug

SEQ ID NO: 1295307 - RNA, 14 nt, Homo sapiens
uguuuucucuugag

SEQ ID NO: 1295308 - RNA, 13 nt, Homo sapiens
uguuuuuuuucag

SEQ ID NO: 1295309 - RNA, 22 nt, Homo sapiens
uuaaaaaaaagaauaaagguau

SEQ ID NO: 1295310 - RNA, 16 nt, Homo sapiens
uuaaaaagcacagggg

SEQ ID NO: 1295311 - RNA, 20 nt, Homo sapiens
uuaaaaagguuuacagaauu

SEQ ID NO: 1295312 - RNA, 20 nt, Homo sapiens
uuaaaaaucuuguacauuau

SEQ ID NO: 1295313 - RNA, 22 nt, Homo sapiens
uuaaaacaacacucacauuuau

SEQ ID NO: 1295314 - RNA, 15 nt, Homo sapiens
auuccuugguaauau

SEQ ID NO: 1295315 - RNA, 18 nt, Homo sapiens
auucuaagucaauccaag

SEQ ID NO: 1295316 - RNA, 21 nt, Homo sapiens
auucuaaucccaacaagcaag

SEQ ID NO: 1295317 - RNA, 22 nt, Homo sapiens
auucuaccagagugauggauuu

SEQ ID NO: 1295318 - RNA, 11 nt, Homo sapiens
auucuacucaa

SEQ ID NO: 1295319 - RNA, 17 nt, Homo sapiens
auucuagaaacaggaaa

SEQ ID NO: 1295320 - RNA, 15 nt, Homo sapiens
auucuaggccuccug

SEQ ID NO: 1295321 - RNA, 20 nt, Homo sapiens
auucuauugaguggcagugu

SEQ ID NO: 1295322 - RNA, 17 nt, Homo sapiens
auucuauuuauauguac

SEQ ID NO: 1295323 - RNA, 18 nt, Homo sapiens
auucucaggccaucauca

SEQ ID NO: 1295324 - RNA, 19 nt, Homo sapiens
auucucaugggaaggggag

SEQ ID NO: 1295325 - RNA, 17 nt, Homo sapiens
auucucauuugucacac

SEQ ID NO: 1295326 - RNA, 19 nt, Homo sapiens
auucucauuugucacacac

SEQ ID NO: 1295327 - RNA, 19 nt, Homo sapiens
auucucugucucauccauc

SEQ ID NO: 1295328 - RNA, 19 nt, Homo sapiens
auucugauuuuacauguaa

SEQ ID NO: 1295329 - RNA, 22 nt, Homo sapiens
auucugucacccagacuggagu

SEQ ID NO: 1295330 - RNA, 22 nt, Homo sapiens
auucuucccuuuuaaacacauu

SEQ ID NO: 1295331 - RNA, 21 nt, Homo sapiens
auucuucuuugguggagauaa

SEQ ID NO: 1295332 - RNA, 13 nt, Homo sapiens
auugaaaugcauu

SEQ ID NO: 1295333 - RNA, 22 nt, Homo sapiens
auugacacagaaaauguugaga

SEQ ID NO: 1295334 - RNA, 24 nt, Homo sapiens
auugacaugugccagggcaaugau

SEQ ID NO: 1295335 - RNA, 18 nt, Homo sapiens
auugacucuguggcuuug

SEQ ID NO: 1295336 - RNA, 12 nt, Homo sapiens
auugacuuuguc

SEQ ID NO: 1295337 - RNA, 21 nt, Homo sapiens
auugaggauaaauugccauaa

SEQ ID NO: 1295338 - RNA, 16 nt, Homo sapiens
auugaguuuucagugg

SEQ ID NO: 1295339 - RNA, 15 nt, Homo sapiens
auugaugagcaagac

SEQ ID NO: 1295340 - RNA, 17 nt, Homo sapiens
auugauggguuaauuaa

SEQ ID NO: 1295341 - RNA, 16 nt, Homo sapiens
auugauucaugucuca

SEQ ID NO: 1295342 - RNA, 15 nt, Homo sapiens
auugcagacugugua

SEQ ID NO: 1295343 - RNA, 15 nt, Homo sapiens
auugcaugugacucu

SEQ ID NO: 1295344 - RNA, 18 nt, Homo sapiens
auugcaugugacucugaa

SEQ ID NO: 1295345 - RNA, 12 nt, Homo sapiens
auugccaaaaag

SEQ ID NO: 1295346 - RNA, 14 nt, Homo sapiens
auugccucuacuuu

SEQ ID NO: 1295347 - RNA, 17 nt, Homo sapiens
auugccuguaacacaua

SEQ ID NO: 1295348 - RNA, 13 nt, Homo sapiens
auugcugacuuua

SEQ ID NO: 1295349 - RNA, 21 nt, Homo sapiens
auugcugcaccaaugcacuga

SEQ ID NO: 1295350 - RNA, 13 nt, Homo sapiens
auugcugccagag

SEQ ID NO: 1295351 - RNA, 22 nt, Homo sapiens
auugcugccccaucagugcucc

SEQ ID NO: 1295352 - RNA, 14 nt, Homo sapiens
auuggaagaaagaa

SEQ ID NO: 1295353 - RNA, 22 nt, Homo sapiens
auuggagaugcaaauagcaaaa

SEQ ID NO: 1295354 - RNA, 14 nt, Homo sapiens
auuggcacugcuaa

SEQ ID NO: 1295355 - RNA, 14 nt, Homo sapiens
auugguaugaugcu

SEQ ID NO: 1295356 - RNA, 17 nt, Homo sapiens
auuggugcauagcagau

SEQ ID NO: 1295357 - RNA, 15 nt, Homo sapiens
auuguacaguuuaaa

SEQ ID NO: 1295358 - RNA, 15 nt, Homo sapiens
auuguacuaaagcca

SEQ ID NO: 1295359 - RNA, 14 nt, Homo sapiens
auuguacuaauacc

SEQ ID NO: 1295360 - RNA, 15 nt, Homo sapiens
auuguaguguucaaa

SEQ ID NO: 1295361 - RNA, 21 nt, Homo sapiens
auuguccccuaaaccaaaaac

SEQ ID NO: 1295362 - RNA, 17 nt, Homo sapiens
auugucgguuaccucug

SEQ ID NO: 1295363 - RNA, 20 nt, Homo sapiens
auugucgguuaccucugcau

SEQ ID NO: 1295364 - RNA, 17 nt, Homo sapiens
auugugaccacucugaa

SEQ ID NO: 1295365 - RNA, 22 nt, Homo sapiens
auuguuaccugucauuuugcac

SEQ ID NO: 1295366 - RNA, 13 nt, Homo sapiens
auuguuguuacuu

SEQ ID NO: 1295367 - RNA, 19 nt, Homo sapiens
auuuaaaacguuuugguca

SEQ ID NO: 1295368 - RNA, 15 nt, Homo sapiens
auuuaaagacaaaga

SEQ ID NO: 1295369 - RNA, 13 nt, Homo sapiens
auuuaaauaggaa

SEQ ID NO: 1295370 - RNA, 20 nt, Homo sapiens
auuuaacaaaaagugcuuca

SEQ ID NO: 1295371 - RNA, 13 nt, Homo sapiens
auuuaacagagcu

SEQ ID NO: 1295372 - RNA, 16 nt, Homo sapiens
auuuaacagugcaaaa

SEQ ID NO: 1295373 - RNA, 19 nt, Homo sapiens
auuuaaccauggcacugag

SEQ ID NO: 1295374 - RNA, 17 nt, Homo sapiens
auuuaagagacagucac

SEQ ID NO: 1295375 - RNA, 23 nt, Homo sapiens
auuuaagggaaugugagcacaau

SEQ ID NO: 1295376 - RNA, 17 nt, Homo sapiens
auuuaaguucaagagaa

SEQ ID NO: 1295377 - RNA, 15 nt, Homo sapiens
auuuaauccaaacag

SEQ ID NO: 1295378 - RNA, 15 nt, Homo sapiens
auuuaauccuuguga

SEQ ID NO: 1295379 - RNA, 16 nt, Homo sapiens
auuuacaaagugugua

SEQ ID NO: 1295380 - RNA, 17 nt, Homo sapiens
auuuacaacucauucca

SEQ ID NO: 1295381 - RNA, 20 nt, Homo sapiens
auuuagaaaaagaacaugca

SEQ ID NO: 1295382 - RNA, 18 nt, Homo sapiens
auuuagacccugcauuua

SEQ ID NO: 1295383 - RNA, 23 nt, Homo sapiens
auuuagcaucuuccuugauaaua

SEQ ID NO: 1295384 - RNA, 22 nt, Homo sapiens
auuuaguuugauuauucagugu

SEQ ID NO: 1295385 - RNA, 21 nt, Homo sapiens
auuuauaaaacuucucaagau

SEQ ID NO: 1295386 - RNA, 14 nt, Homo sapiens
auuuauaggaggaa

SEQ ID NO: 1295387 - RNA, 21 nt, Homo sapiens
auuuauguaacuugaaccuau

SEQ ID NO: 1295388 - RNA, 21 nt, Homo sapiens
auuuaugucccugacuguaaa

SEQ ID NO: 1295389 - RNA, 17 nt, Homo sapiens
auuuauuuacagaugaa

SEQ ID NO: 1295390 - RNA, 20 nt, Homo sapiens
auuuauuugguucccuuccu

SEQ ID NO: 1295391 - RNA, 22 nt, Homo sapiens
auuucaaauauuuacaguacuu

SEQ ID NO: 1295392 - RNA, 16 nt, Homo sapiens
auuucaauuccuggcc

SEQ ID NO: 1295393 - RNA, 16 nt, Homo sapiens
auuucacaagcuauuc

SEQ ID NO: 1295394 - RNA, 13 nt, Homo sapiens
auuucacauuaau

SEQ ID NO: 1295395 - RNA, 23 nt, Homo sapiens
auuucacuggccuaaugagauaa

SEQ ID NO: 1295396 - RNA, 22 nt, Homo sapiens
auuucagaauauuagccaguac

SEQ ID NO: 1295397 - RNA, 12 nt, Homo sapiens
auuucaucugcu

SEQ ID NO: 1295398 - RNA, 19 nt, Homo sapiens
auuucaugggaauauucaa

SEQ ID NO: 1295399 - RNA, 22 nt, Homo sapiens
auuucaugugcggggaucaucu

SEQ ID NO: 1295400 - RNA, 17 nt, Homo sapiens
auuucuacaaguucaga

SEQ ID NO: 1295401 - RNA, 22 nt, Homo sapiens
auuucuacuuucagaaacuaaa

SEQ ID NO: 1295402 - RNA, 14 nt, Homo sapiens
auuucuagagacaa

SEQ ID NO: 1295403 - RNA, 13 nt, Homo sapiens
auuucucauucau

SEQ ID NO: 1295404 - RNA, 22 nt, Homo sapiens
auuucuccaggauuuccugcuu

SEQ ID NO: 1295405 - RNA, 22 nt, Homo sapiens
auuucuguuauggggacuuuau

SEQ ID NO: 1295406 - RNA, 19 nt, Homo sapiens
auuucuucuucacauccau

SEQ ID NO: 1295407 - RNA, 11 nt, Homo sapiens
auuucuuugcc

SEQ ID NO: 1295408 - RNA, 11 nt, Homo sapiens
auuugacuuac

SEQ ID NO: 1295409 - RNA, 13 nt, Homo sapiens
auuugagugcucu

SEQ ID NO: 1295410 - RNA, 13 nt, Homo sapiens
auuugcaccaguu

SEQ ID NO: 1295411 - RNA, 19 nt, Homo sapiens
auuugcauaacaauuccuc

SEQ ID NO: 1295412 - RNA, 13 nt, Homo sapiens
auuugcauaccau

SEQ ID NO: 1295413 - RNA, 12 nt, Homo sapiens
auuugcauuuca

SEQ ID NO: 1295414 - RNA, 17 nt, Homo sapiens
auuugccagagccaaau

SEQ ID NO: 1295415 - RNA, 16 nt, Homo sapiens
auuugcugaauacaga

SEQ ID NO: 1295416 - RNA, 18 nt, Homo sapiens
auuuggaaauguggucau

SEQ ID NO: 1295417 - RNA, 12 nt, Homo sapiens
auuugguacaaa

SEQ ID NO: 1295418 - RNA, 20 nt, Homo sapiens
auuuguaauugaacuuaucc

SEQ ID NO: 1295419 - RNA, 21 nt, Homo sapiens
auuuguauugguucagggaac

SEQ ID NO: 1295420 - RNA, 20 nt, Homo sapiens
auuugugguccacugagcua

SEQ ID NO: 1295421 - RNA, 21 nt, Homo sapiens
auuugugguccacugagcuau

SEQ ID NO: 1295422 - RNA, 23 nt, Homo sapiens
auuuguguugaaggaacuugucu

SEQ ID NO: 1295423 - RNA, 18 nt, Homo sapiens
auuuguuaagguucaaga

SEQ ID NO: 1295424 - RNA, 20 nt, Homo sapiens
auuuguucguauuuagaaug

SEQ ID NO: 1295425 - RNA, 23 nt, Homo sapiens
auuuguuuuucucuuuucacagc

SEQ ID NO: 1295426 - RNA, 17 nt, Homo sapiens
auuuuaagaauuucaca

SEQ ID NO: 1295427 - RNA, 19 nt, Homo sapiens
auuuuaagaauuucacaag

SEQ ID NO: 1295428 - RNA, 19 nt, Homo sapiens
auuuuaagucccugucacc

SEQ ID NO: 1295429 - RNA, 23 nt, Homo sapiens
auuuuaauagggaauauaucucu

SEQ ID NO: 1295430 - RNA, 18 nt, Homo sapiens
auuuuacccacacacaga

SEQ ID NO: 1295431 - RNA, 17 nt, Homo sapiens
auuuuagugaacuugaa

SEQ ID NO: 1295432 - RNA, 23 nt, Homo sapiens
auuuuauccauggaagaaacaca

SEQ ID NO: 1295433 - RNA, 17 nt, Homo sapiens
auuuuaugccaguuguu

SEQ ID NO: 1295434 - RNA, 16 nt, Homo sapiens
auuuucaguuauaugu

SEQ ID NO: 1295435 - RNA, 21 nt, Homo sapiens
auuuuccaguaggaaaagcaa

SEQ ID NO: 1295436 - RNA, 22 nt, Homo sapiens
auuuuccaguaggaaaagcaau

SEQ ID NO: 1295437 - RNA, 15 nt, Homo sapiens
auuuuccccaaccuc

SEQ ID NO: 1295438 - RNA, 23 nt, Homo sapiens
auuuuccuccaucgcaguguuca

SEQ ID NO: 1295439 - RNA, 16 nt, Homo sapiens
auuuucuuuuuuuaac

SEQ ID NO: 1295440 - RNA, 16 nt, Homo sapiens
auuuugaaaaaugaga

SEQ ID NO: 1295441 - RNA, 20 nt, Homo sapiens
auuuugaaguaccaccaaaa

SEQ ID NO: 1295442 - RNA, 12 nt, Homo sapiens
auuuugacuuaa

SEQ ID NO: 1295443 - RNA, 19 nt, Homo sapiens
auuuugauauaaucuuuca

SEQ ID NO: 1295444 - RNA, 13 nt, Homo sapiens
auuuugcacugua

SEQ ID NO: 1295445 - RNA, 19 nt, Homo sapiens
auuuugcuaaaugugaaug

SEQ ID NO: 1295446 - RNA, 19 nt, Homo sapiens
gagcuuaauuuucugugga

SEQ ID NO: 1295447 - RNA, 13 nt, Homo sapiens
gagcuuauuacuu

SEQ ID NO: 1295448 - RNA, 20 nt, Homo sapiens
gaggaacuuuuucucuguua

SEQ ID NO: 1295449 - RNA, 22 nt, Homo sapiens
gaggaauauuucaagcucugca

SEQ ID NO: 1295450 - RNA, 17 nt, Homo sapiens
gaggacuuuucuuugug

SEQ ID NO: 1295451 - RNA, 14 nt, Homo sapiens
gaggagcagugcag

SEQ ID NO: 1295452 - RNA, 16 nt, Homo sapiens
gaggaguacaggugaa

SEQ ID NO: 1295453 - RNA, 20 nt, Homo sapiens
gaggaguggugggugcaguc

SEQ ID NO: 1295454 - RNA, 14 nt, Homo sapiens
gaggaguuccuuga

SEQ ID NO: 1295455 - RNA, 14 nt, Homo sapiens
gaggaugagcucua

SEQ ID NO: 1295456 - RNA, 20 nt, Homo sapiens
gaggcaagagaauugcuuga

SEQ ID NO: 1295457 - RNA, 14 nt, Homo sapiens
gaggcaaugggagc

SEQ ID NO: 1295458 - RNA, 19 nt, Homo sapiens
gaggcagagguuacagguu

SEQ ID NO: 1295459 - RNA, 22 nt, Homo sapiens
gaggcagccccauucugccugc

SEQ ID NO: 1295460 - RNA, 20 nt, Homo sapiens
gaggcaggaggaucacuuga

SEQ ID NO: 1295461 - RNA, 14 nt, Homo sapiens
gaggcccucauucc

SEQ ID NO: 1295462 - RNA, 19 nt, Homo sapiens
gaggcuacagggccaaacg

SEQ ID NO: 1295463 - RNA, 20 nt, Homo sapiens
gaggcugcacccacccagga

SEQ ID NO: 1295464 - RNA, 23 nt, Homo sapiens
gagggagcccagucuggaugugg

SEQ ID NO: 1295465 - RNA, 15 nt, Homo sapiens
gagggccagagcaag

SEQ ID NO: 1295466 - RNA, 20 nt, Homo sapiens
gagggcuggcuggccucacc

SEQ ID NO: 1295467 - RNA, 14 nt, Homo sapiens
gaggguuugcagaa

SEQ ID NO: 1295468 - RNA, 15 nt, Homo sapiens
gaggucacaguccac

SEQ ID NO: 1295469 - RNA, 15 nt, Homo sapiens
gaggucucccaaacg

SEQ ID NO: 1295470 - RNA, 16 nt, Homo sapiens
gaggugcaacaagguc

SEQ ID NO: 1295471 - RNA, 23 nt, Homo sapiens
gagguuuuuuugucaacauugug

SEQ ID NO: 1295472 - RNA, 19 nt, Homo sapiens
gaguacuuacuauugguca

SEQ ID NO: 1295473 - RNA, 14 nt, Homo sapiens
gaguagaauugcau

SEQ ID NO: 1295474 - RNA, 13 nt, Homo sapiens
gaguagcuggaau

SEQ ID NO: 1295475 - RNA, 16 nt, Homo sapiens
gaguauaaauuuacuu

SEQ ID NO: 1295476 - RNA, 22 nt, Homo sapiens
gaguauuaaugaaaagcacaaa

SEQ ID NO: 1295477 - RNA, 14 nt, Homo sapiens
gagucacacagugu

SEQ ID NO: 1295478 - RNA, 18 nt, Homo sapiens
gagucuauguucaaagac

SEQ ID NO: 1295479 - RNA, 23 nt, Homo sapiens
gagucugccccacauguggccau

SEQ ID NO: 1295480 - RNA, 13 nt, Homo sapiens
gagucuugcuaua

SEQ ID NO: 1295481 - RNA, 20 nt, Homo sapiens
gagucuugcuauauugccca

SEQ ID NO: 1295482 - RNA, 15 nt, Homo sapiens
gagucuuugcagaga

SEQ ID NO: 1295483 - RNA, 18 nt, Homo sapiens
gagugaaggggccaagga

SEQ ID NO: 1295484 - RNA, 14 nt, Homo sapiens
gagugacucuccag

SEQ ID NO: 1295485 - RNA, 19 nt, Homo sapiens
gagugcaguggugugaucu

SEQ ID NO: 1295486 - RNA, 20 nt, Homo sapiens
gagugccuggccaaagggau

SEQ ID NO: 1295487 - RNA, 13 nt, Homo sapiens
gaguggucuucaa

SEQ ID NO: 1295488 - RNA, 16 nt, Homo sapiens
gaguguccucuucccu

SEQ ID NO: 1295489 - RNA, 18 nt, Homo sapiens
gagugugguuaugaacuu

SEQ ID NO: 1295490 - RNA, 21 nt, Homo sapiens
gaguguuccccuuccacugag

SEQ ID NO: 1295491 - RNA, 13 nt, Homo sapiens
gaguuagccaaac

SEQ ID NO: 1295492 - RNA, 23 nt, Homo sapiens
gaguuccagcaaacaaaauggac

SEQ ID NO: 1295493 - RNA, 21 nt, Homo sapiens
gaguugauucagcucugcaag

SEQ ID NO: 1295494 - RNA, 21 nt, Homo sapiens
gaguugggaguuauuacucaa

SEQ ID NO: 1295495 - RNA, 18 nt, Homo sapiens
gauaaaagacagugaaag

SEQ ID NO: 1295496 - RNA, 13 nt, Homo sapiens
gauaaacucagaa

SEQ ID NO: 1295497 - RNA, 14 nt, Homo sapiens
gauaacacuggcuu

SEQ ID NO: 1295498 - RNA, 21 nt, Homo sapiens
gauaagagggcacacacugug

SEQ ID NO: 1295499 - RNA, 18 nt, Homo sapiens
gauaagcuaacaccagac

SEQ ID NO: 1295500 - RNA, 13 nt, Homo sapiens
gauaauaugagaa

SEQ ID NO: 1295501 - RNA, 17 nt, Homo sapiens
gauaauuuucauagcug

SEQ ID NO: 1295502 - RNA, 15 nt, Homo sapiens
gauacagaacucuuu

SEQ ID NO: 1295503 - RNA, 11 nt, Homo sapiens
gauaccaaaug

SEQ ID NO: 1295504 - RNA, 22 nt, Homo sapiens
gauaccuucuggcugugcuacc

SEQ ID NO: 1295505 - RNA, 20 nt, Homo sapiens
gauacuaacauuuucauuga

SEQ ID NO: 1295506 - RNA, 19 nt, Homo sapiens
gauacugaggcacacagag

SEQ ID NO: 1295507 - RNA, 17 nt, Homo sapiens
gauacugcgacuuucug

SEQ ID NO: 1295508 - RNA, 19 nt, Homo sapiens
gauacugcgacuuucugcc

SEQ ID NO: 1295509 - RNA, 14 nt, Homo sapiens
gauagaagauuguu

SEQ ID NO: 1295510 - RNA, 14 nt, Homo sapiens
gauagaugcuggcc

SEQ ID NO: 1295511 - RNA, 13 nt, Homo sapiens
gauagaugucuau

SEQ ID NO: 1295512 - RNA, 12 nt, Homo sapiens
gauagcacuuuc

SEQ ID NO: 1295513 - RNA, 19 nt, Homo sapiens
gauagggagcagaugcaau

SEQ ID NO: 1295514 - RNA, 23 nt, Homo sapiens
gauaguggggagacuucuuggcu

SEQ ID NO: 1295515 - RNA, 12 nt, Homo sapiens
gauauaauacua

SEQ ID NO: 1295516 - RNA, 20 nt, Homo sapiens
gauauaauggauaauuuuca

SEQ ID NO: 1295517 - RNA, 16 nt, Homo sapiens
gauaucaaaagcaaau

SEQ ID NO: 1295518 - RNA, 18 nt, Homo sapiens
gauaucuuuggauaaugu

SEQ ID NO: 1295519 - RNA, 16 nt, Homo sapiens
gauauuuaguaauauu

SEQ ID NO: 1295520 - RNA, 19 nt, Homo sapiens
gaucagacgaaagugagaa

SEQ ID NO: 1295521 - RNA, 17 nt, Homo sapiens
gaucagauugcauguga

SEQ ID NO: 1295522 - RNA, 19 nt, Homo sapiens
gaucagauugcaugugacu

SEQ ID NO: 1295523 - RNA, 20 nt, Homo sapiens
gaucagccugggcaauguga

SEQ ID NO: 1295524 - RNA, 21 nt, Homo sapiens
gaucaguggugucugugaagg

SEQ ID NO: 1295525 - RNA, 15 nt, Homo sapiens
gaucaucgucauuug

SEQ ID NO: 1295526 - RNA, 16 nt, Homo sapiens
gauccacccaccucag

SEQ ID NO: 1295527 - RNA, 16 nt, Homo sapiens
gaucccaucuugauaa

SEQ ID NO: 1295528 - RNA, 15 nt, Homo sapiens
gaucccucucuggau

SEQ ID NO: 1295529 - RNA, 12 nt, Homo sapiens
gaucccugacau

SEQ ID NO: 1295530 - RNA, 22 nt, Homo sapiens
gauccuaaaacaaaagcucauc

SEQ ID NO: 1295531 - RNA, 20 nt, Homo sapiens
gaucucgaacuccuaaccuc

SEQ ID NO: 1295532 - RNA, 15 nt, Homo sapiens
gaucucggcucagug

SEQ ID NO: 1295533 - RNA, 16 nt, Homo sapiens
gaucucgguuugccaa

SEQ ID NO: 1295534 - RNA, 20 nt, Homo sapiens
gaucugauaaggaucuagga

SEQ ID NO: 1295535 - RNA, 16 nt, Homo sapiens
gaucugauucuaccag

SEQ ID NO: 1295536 - RNA, 22 nt, Homo sapiens
gaucugcccccuuuacuccucg

SEQ ID NO: 1295537 - RNA, 19 nt, Homo sapiens
gaucuggaacccagacuca

SEQ ID NO: 1295538 - RNA, 18 nt, Homo sapiens
gaucuggaaccucagccu

SEQ ID NO: 1295539 - RNA, 20 nt, Homo sapiens
gaugaauugcguuggucucu

SEQ ID NO: 1295540 - RNA, 13 nt, Homo sapiens
gaugauacaucca

SEQ ID NO: 1295541 - RNA, 16 nt, Homo sapiens
gaugauggaugccaau

SEQ ID NO: 1295542 - RNA, 17 nt, Homo sapiens
gaugauuuguggaaaag

SEQ ID NO: 1295543 - RNA, 20 nt, Homo sapiens
gaugcagcauuuuguauuug

SEQ ID NO: 1295544 - RNA, 16 nt, Homo sapiens
gaugccagggacccac

SEQ ID NO: 1295545 - RNA, 11 nt, Homo sapiens
gaugcccugug

SEQ ID NO: 1295546 - RNA, 20 nt, Homo sapiens
gaugcucugaacccugagca

SEQ ID NO: 1295547 - RNA, 19 nt, Homo sapiens
gaugcugagcgaagcuaua

SEQ ID NO: 1295548 - RNA, 22 nt, Homo sapiens
gaugcugaggguguuucuuccu

SEQ ID NO: 1295549 - RNA, 19 nt, Homo sapiens
gaugcugccggcacagcug

SEQ ID NO: 1295550 - RNA, 13 nt, Homo sapiens
gauggaagcuugu

SEQ ID NO: 1295551 - RNA, 18 nt, Homo sapiens
gauggaaguugcagugag

SEQ ID NO: 1295552 - RNA, 13 nt, Homo sapiens
gauggauuuccag

SEQ ID NO: 1295553 - RNA, 23 nt, Homo sapiens
gauggcaccuauugagggugaca

SEQ ID NO: 1295554 - RNA, 14 nt, Homo sapiens
gauggccacugggu

SEQ ID NO: 1295555 - RNA, 18 nt, Homo sapiens
gaugggcagcagcuugga

SEQ ID NO: 1295556 - RNA, 17 nt, Homo sapiens
gauggugcccuguucuc

SEQ ID NO: 1295557 - RNA, 14 nt, Homo sapiens
gauggugugccuuc

SEQ ID NO: 1295558 - RNA, 22 nt, Homo sapiens
gaugucgcccuacucaccugag

SEQ ID NO: 1295559 - RNA, 19 nt, Homo sapiens
gaugugccgauccuuguca

SEQ ID NO: 1295560 - RNA, 15 nt, Homo sapiens
gaugugcuuauauca

SEQ ID NO: 1295561 - RNA, 19 nt, Homo sapiens
gauguguuaggaaugucaa

SEQ ID NO: 1295562 - RNA, 20 nt, Homo sapiens
gauguuuacagugucugugu

SEQ ID NO: 1295563 - RNA, 14 nt, Homo sapiens
gauguuuccagacu

SEQ ID NO: 1295564 - RNA, 19 nt, Homo sapiens
gauguuugaccuucagagc

SEQ ID NO: 1295565 - RNA, 20 nt, Homo sapiens
gauguuuuaacucuaucugu

SEQ ID NO: 1295566 - RNA, 17 nt, Homo sapiens
gauuaaucuaccuugca

SEQ ID NO: 1295567 - RNA, 15 nt, Homo sapiens
gauuaaugcuaucaa

SEQ ID NO: 1295568 - RNA, 12 nt, Homo sapiens
gauuauguugcu

SEQ ID NO: 1295569 - RNA, 13 nt, Homo sapiens
gauucaagccauu

SEQ ID NO: 1295570 - RNA, 17 nt, Homo sapiens
gauucaagccauuccaa

SEQ ID NO: 1295571 - RNA, 23 nt, Homo sapiens
gauucacccccaaacagugacau

SEQ ID NO: 1295572 - RNA, 17 nt, Homo sapiens
gauuccaaaaagcacau

SEQ ID NO: 1295573 - RNA, 18 nt, Homo sapiens
gauuccucagcuacuuuu

SEQ ID NO: 1295574 - RNA, 12 nt, Homo sapiens
gauucuccuuca

SEQ ID NO: 1295575 - RNA, 17 nt, Homo sapiens
gauucuuucccaauuca

SEQ ID NO: 1295576 - RNA, 19 nt, Homo sapiens
gauugcaugugacucugaa

SEQ ID NO: 1295577 - RNA, 15 nt, Homo sapiens
gauuggccccacuga

SEQ ID NO: 1295578 - RNA, 12 nt, Homo sapiens
gauugggguccc

SEQ ID NO: 1295579 - RNA, 21 nt, Homo sapiens
gcggaaggagggagcucugau

SEQ ID NO: 1295580 - RNA, 13 nt, Homo sapiens
gcggcuggcagcc

SEQ ID NO: 1295581 - RNA, 18 nt, Homo sapiens
gcgucaugcuuguguuau

SEQ ID NO: 1295582 - RNA, 20 nt, Homo sapiens
gcguccauauuuaacaugua

SEQ ID NO: 1295583 - RNA, 16 nt, Homo sapiens
gcgugagccacugcac

SEQ ID NO: 1295584 - RNA, 12 nt, Homo sapiens
gcguuacugcuu

SEQ ID NO: 1295585 - RNA, 20 nt, Homo sapiens
gcuaaaccaaggacugagca

SEQ ID NO: 1295586 - RNA, 22 nt, Homo sapiens
gcuaaauaaucuuacucuagau

SEQ ID NO: 1295587 - RNA, 13 nt, Homo sapiens
gcuaagaaccugg

SEQ ID NO: 1295588 - RNA, 14 nt, Homo sapiens
gcuacaaaugcauu

SEQ ID NO: 1295589 - RNA, 14 nt, Homo sapiens
gcuacaaucugugu

SEQ ID NO: 1295590 - RNA, 18 nt, Homo sapiens
gcuacaggagcauaccac

SEQ ID NO: 1295591 - RNA, 18 nt, Homo sapiens
gcuaccaacuuguaucca

SEQ ID NO: 1295592 - RNA, 16 nt, Homo sapiens
gcuaccucuccagccu

SEQ ID NO: 1295593 - RNA, 18 nt, Homo sapiens
gcuacuauagguccagaa

SEQ ID NO: 1295594 - RNA, 21 nt, Homo sapiens
gcuacucuguuccuucacauc

SEQ ID NO: 1295595 - RNA, 20 nt, Homo sapiens
gcuacugccgucagugcugu

SEQ ID NO: 1295596 - RNA, 15 nt, Homo sapiens
gcuagggaaggcggg

SEQ ID NO: 1295597 - RNA, 19 nt, Homo sapiens
gcuaggguggucagaggaa

SEQ ID NO: 1295598 - RNA, 12 nt, Homo sapiens
gcuaguguuucc

SEQ ID NO: 1295599 - RNA, 17 nt, Homo sapiens
gcuauaacuuacuucug

SEQ ID NO: 1295600 - RNA, 14 nt, Homo sapiens
gcuauagucuggca

SEQ ID NO: 1295601 - RNA, 19 nt, Homo sapiens
gcuauguucugucuuccca

SEQ ID NO: 1295602 - RNA, 21 nt, Homo sapiens
gcuauguuggaaaugugcaac

SEQ ID NO: 1295603 - RNA, 21 nt, Homo sapiens
gcucaaagcguggacaggugu

SEQ ID NO: 1295604 - RNA, 12 nt, Homo sapiens
gcucacaguccu

SEQ ID NO: 1295605 - RNA, 11 nt, Homo sapiens
gcucaccuguu

SEQ ID NO: 1295606 - RNA, 15 nt, Homo sapiens
gcucaccuuuaucac

SEQ ID NO: 1295607 - RNA, 14 nt, Homo sapiens
gcucacugcagccu

SEQ ID NO: 1295608 - RNA, 14 nt, Homo sapiens
gcucagaccagcuc

SEQ ID NO: 1295609 - RNA, 22 nt, Homo sapiens
gcucagccagcacuuguccagc

SEQ ID NO: 1295610 - RNA, 16 nt, Homo sapiens
gcucaggaccaggcaa

SEQ ID NO: 1295611 - RNA, 19 nt, Homo sapiens
gcucagggaaaagcagcuc

SEQ ID NO: 1295612 - RNA, 20 nt, Homo sapiens
gcucaggugucccugcacuu

SEQ ID NO: 1295613 - RNA, 12 nt, Homo sapiens
gcucagugcaac

SEQ ID NO: 1295614 - RNA, 21 nt, Homo sapiens
gcucauaugcauguagucacu

SEQ ID NO: 1295615 - RNA, 13 nt, Homo sapiens
gcucaucauucuc

SEQ ID NO: 1295616 - RNA, 21 nt, Homo sapiens
gcuccaccuugugacccaggg

SEQ ID NO: 1295617 - RNA, 13 nt, Homo sapiens
gcuccacugaaca

SEQ ID NO: 1295618 - RNA, 13 nt, Homo sapiens
gcuccagugcagg

SEQ ID NO: 1295619 - RNA, 13 nt, Homo sapiens
gcuccauguagaa

SEQ ID NO: 1295620 - RNA, 20 nt, Homo sapiens
gcuccauguagaagccacua

SEQ ID NO: 1295621 - RNA, 12 nt, Homo sapiens
gcucccaggugc

SEQ ID NO: 1295622 - RNA, 18 nt, Homo sapiens
gcuccccgugagcacugc

SEQ ID NO: 1295623 - RNA, 16 nt, Homo sapiens
gcuccccucacucugu

SEQ ID NO: 1295624 - RNA, 20 nt, Homo sapiens
gcuccccuccucggcuuccu

SEQ ID NO: 1295625 - RNA, 21 nt, Homo sapiens
gcucccucuauuuauguuugc

SEQ ID NO: 1295626 - RNA, 13 nt, Homo sapiens
gcuccuccagggu

SEQ ID NO: 1295627 - RNA, 20 nt, Homo sapiens
gcuccucccucugacccaga

SEQ ID NO: 1295628 - RNA, 16 nt, Homo sapiens
gcuccugggcagcuug

SEQ ID NO: 1295629 - RNA, 15 nt, Homo sapiens
gcuccuggggcaaug

SEQ ID NO: 1295630 - RNA, 15 nt, Homo sapiens
gcuccuucuguccua

SEQ ID NO: 1295631 - RNA, 22 nt, Homo sapiens
gcucgccccagcaggugcugac

SEQ ID NO: 1295632 - RNA, 15 nt, Homo sapiens
gcucuaaguaccuuu

SEQ ID NO: 1295633 - RNA, 15 nt, Homo sapiens
gcucucugaguccug

SEQ ID NO: 1295634 - RNA, 20 nt, Homo sapiens
gcucucuuuuucuccagggu

SEQ ID NO: 1295635 - RNA, 14 nt, Homo sapiens
gcucugagagggaa

SEQ ID NO: 1295636 - RNA, 16 nt, Homo sapiens
gcucuucucauuucac

SEQ ID NO: 1295637 - RNA, 14 nt, Homo sapiens
gcucuucuuuccca

SEQ ID NO: 1295638 - RNA, 18 nt, Homo sapiens
gcucuugaggcauuucca

SEQ ID NO: 1295639 - RNA, 14 nt, Homo sapiens
gcugaaacccaaug

SEQ ID NO: 1295640 - RNA, 15 nt, Homo sapiens
gcugaacucaugaga

SEQ ID NO: 1295641 - RNA, 15 nt, Homo sapiens
gcugaccuccacagc

SEQ ID NO: 1295642 - RNA, 12 nt, Homo sapiens
gcugaccuuuaa

SEQ ID NO: 1295643 - RNA, 15 nt, Homo sapiens
gcugagagaaccuca

SEQ ID NO: 1295644 - RNA, 16 nt, Homo sapiens
gcugagagaaccucac

SEQ ID NO: 1295645 - RNA, 23 nt, Homo sapiens
gcugagggugagugggugaauaa

SEQ ID NO: 1295646 - RNA, 16 nt, Homo sapiens
gcugagucugcagaug

SEQ ID NO: 1295647 - RNA, 14 nt, Homo sapiens
gcugcaaugcagca

SEQ ID NO: 1295648 - RNA, 16 nt, Homo sapiens
gcugcacccacccagg

SEQ ID NO: 1295649 - RNA, 18 nt, Homo sapiens
gcugcaucccccccaccu

SEQ ID NO: 1295650 - RNA, 16 nt, Homo sapiens
gcugccagggcuuccu

SEQ ID NO: 1295651 - RNA, 19 nt, Homo sapiens
gcugccucuaccugacacu

SEQ ID NO: 1295652 - RNA, 21 nt, Homo sapiens
gcugccugcccguaaacacgc

SEQ ID NO: 1295653 - RNA, 13 nt, Homo sapiens
gcugcuccagugc

SEQ ID NO: 1295654 - RNA, 16 nt, Homo sapiens
gcugcuccagugcagg

SEQ ID NO: 1295655 - RNA, 19 nt, Homo sapiens
gcugcuccucccucugacc

SEQ ID NO: 1295656 - RNA, 14 nt, Homo sapiens
gcugcugaccucca

SEQ ID NO: 1295657 - RNA, 12 nt, Homo sapiens
gcugcugccagg

SEQ ID NO: 1295658 - RNA, 19 nt, Homo sapiens
gcugcuuccuccuggaaau

SEQ ID NO: 1295659 - RNA, 18 nt, Homo sapiens
gcuggaaccugcaaaaaa

SEQ ID NO: 1295660 - RNA, 21 nt, Homo sapiens
gcuggaauuacaggcacacac

SEQ ID NO: 1295661 - RNA, 15 nt, Homo sapiens
gcuggagugcaguga

SEQ ID NO: 1295662 - RNA, 13 nt, Homo sapiens
gcuggcaaccacu

SEQ ID NO: 1295663 - RNA, 17 nt, Homo sapiens
gcuggccaaauagcaaa

SEQ ID NO: 1295664 - RNA, 21 nt, Homo sapiens
gcuggcgucaugcaaagucau

SEQ ID NO: 1295665 - RNA, 20 nt, Homo sapiens
gcuggcgugcaguggugcga

SEQ ID NO: 1295666 - RNA, 23 nt, Homo sapiens
gcugggacguggcucagccagca

SEQ ID NO: 1295667 - RNA, 16 nt, Homo sapiens
gcugggacuacaggug

SEQ ID NO: 1295668 - RNA, 19 nt, Homo sapiens
gcugggauuacagguguga

SEQ ID NO: 1295669 - RNA, 23 nt, Homo sapiens
gcugggcgcagcggcucacgccu

SEQ ID NO: 1295670 - RNA, 23 nt, Homo sapiens
gcuggucccggggccagcacuuc

SEQ ID NO: 1295671 - RNA, 17 nt, Homo sapiens
gcugguugagguuucaa

SEQ ID NO: 1295672 - RNA, 21 nt, Homo sapiens
gcugucaagggcagaaugaau

SEQ ID NO: 1295673 - RNA, 20 nt, Homo sapiens
gcugucuauguggcuguauc

SEQ ID NO: 1295674 - RNA, 22 nt, Homo sapiens
gcugugagaggaucaucugggg

SEQ ID NO: 1295675 - RNA, 15 nt, Homo sapiens
gcugugugaccuggg

SEQ ID NO: 1295676 - RNA, 15 nt, Homo sapiens
gcuguuccuguucag

SEQ ID NO: 1295677 - RNA, 14 nt, Homo sapiens
gcuguucucauucc

SEQ ID NO: 1295678 - RNA, 18 nt, Homo sapiens
gcuguucucauuccuguu

SEQ ID NO: 1295679 - RNA, 16 nt, Homo sapiens
gcuuaaaggcaguauu

SEQ ID NO: 1295680 - RNA, 21 nt, Homo sapiens
gcuuagacuaaggccauuauu

SEQ ID NO: 1295681 - RNA, 20 nt, Homo sapiens
gcuuaggaaagaacaucacu

SEQ ID NO: 1295682 - RNA, 22 nt, Homo sapiens
gcuuaguccaauuccuugcaca

SEQ ID NO: 1295683 - RNA, 12 nt, Homo sapiens
gcuuauauucau

SEQ ID NO: 1295684 - RNA, 23 nt, Homo sapiens
gcuuauguuacagguuacgugag

SEQ ID NO: 1295685 - RNA, 17 nt, Homo sapiens
gcuucccagguucaagc

SEQ ID NO: 1295686 - RNA, 23 nt, Homo sapiens
gcuucccggcgucccuaccuccu

SEQ ID NO: 1295687 - RNA, 16 nt, Homo sapiens
gcuucgggcuaugcaa

SEQ ID NO: 1295688 - RNA, 21 nt, Homo sapiens
gcuucuagcugacuugcacag

SEQ ID NO: 1295689 - RNA, 22 nt, Homo sapiens
gcuucuccaggguccacaggaa

SEQ ID NO: 1295690 - RNA, 16 nt, Homo sapiens
gcuucuccugugugau

SEQ ID NO: 1295691 - RNA, 22 nt, Homo sapiens
gcuucuccugugugauugacag

SEQ ID NO: 1295692 - RNA, 23 nt, Homo sapiens
gcuucuggaauuuguucaaguuu

SEQ ID NO: 1295693 - RNA, 14 nt, Homo sapiens
gcuucuugccucug

SEQ ID NO: 1295694 - RNA, 14 nt, Homo sapiens
gcuugacaacaucu

SEQ ID NO: 1295695 - RNA, 14 nt, Homo sapiens
gcuugauacaggaa

SEQ ID NO: 1295696 - RNA, 18 nt, Homo sapiens
gcuugauagaaaugccaa

SEQ ID NO: 1295697 - RNA, 18 nt, Homo sapiens
gcuuggcugugcccucag

SEQ ID NO: 1295698 - RNA, 20 nt, Homo sapiens
gcuuguaaauagcucaggug

SEQ ID NO: 1295699 - RNA, 15 nt, Homo sapiens
gcuuuaggugguguu

SEQ ID NO: 1295700 - RNA, 20 nt, Homo sapiens
gcuuuauuccagaaugcugu

SEQ ID NO: 1295701 - RNA, 16 nt, Homo sapiens
gcuuucuacccagcga

SEQ ID NO: 1295702 - RNA, 15 nt, Homo sapiens
gcuuuguacugcugu

SEQ ID NO: 1295703 - RNA, 22 nt, Homo sapiens
gcuuuguacugcuguuguugaa

SEQ ID NO: 1295704 - RNA, 14 nt, Homo sapiens
gcuuuguugcccag

SEQ ID NO: 1295705 - RNA, 18 nt, Homo sapiens
gcuuuuccaaacauucuc

SEQ ID NO: 1295706 - RNA, 21 nt, Homo sapiens
gcuuuuccaagcugccacugg

SEQ ID NO: 1295707 - RNA, 14 nt, Homo sapiens
ggaaaacuacaggu

SEQ ID NO: 1295708 - RNA, 17 nt, Homo sapiens
ggaaaaggggcuccuug

SEQ ID NO: 1295709 - RNA, 22 nt, Homo sapiens
ggaaaauaauacugcugagaua

SEQ ID NO: 1295710 - RNA, 14 nt, Homo sapiens
ggaaacaacagcuu

SEQ ID NO: 1295711 - RNA, 20 nt, Homo sapiens
ggaaacagcuaaugggacac

SEQ ID NO: 1295712 - RNA, 15 nt, Homo sapiens
gguccagaaggagac

SEQ ID NO: 1295713 - RNA, 13 nt, Homo sapiens
ggucccggggcca

SEQ ID NO: 1295714 - RNA, 20 nt, Homo sapiens
ggucccggggccagcacuuc

SEQ ID NO: 1295715 - RNA, 21 nt, Homo sapiens
ggucccugaggaugggucaga

SEQ ID NO: 1295716 - RNA, 13 nt, Homo sapiens
gguccuacccauc

SEQ ID NO: 1295717 - RNA, 21 nt, Homo sapiens
gguccuguuaacgucaucuca

SEQ ID NO: 1295718 - RNA, 17 nt, Homo sapiens
ggucuaauuauuuacuc

SEQ ID NO: 1295719 - RNA, 20 nt, Homo sapiens
ggucucacaguguugcccag

SEQ ID NO: 1295720 - RNA, 14 nt, Homo sapiens
ggucucccaaacgc

SEQ ID NO: 1295721 - RNA, 20 nt, Homo sapiens
ggucucgcuuuguugcccag

SEQ ID NO: 1295722 - RNA, 23 nt, Homo sapiens
ggucugagucuauguucaaagac

SEQ ID NO: 1295723 - RNA, 16 nt, Homo sapiens
ggucuggccacugucc

SEQ ID NO: 1295724 - RNA, 12 nt, Homo sapiens
ggucuucaagac

SEQ ID NO: 1295725 - RNA, 21 nt, Homo sapiens
ggucuuuccuaaggcugcaag

SEQ ID NO: 1295726 - RNA, 15 nt, Homo sapiens
ggucuuuucuagucu

SEQ ID NO: 1295727 - RNA, 19 nt, Homo sapiens
ggugaaacacuuugguauu

SEQ ID NO: 1295728 - RNA, 16 nt, Homo sapiens
ggugaacaagcaaacc

SEQ ID NO: 1295729 - RNA, 20 nt, Homo sapiens
ggugaacaagcaaacccaga

SEQ ID NO: 1295730 - RNA, 20 nt, Homo sapiens
ggugaaccuuaguaccuaaa

SEQ ID NO: 1295731 - RNA, 13 nt, Homo sapiens
ggugacacucuau

SEQ ID NO: 1295732 - RNA, 16 nt, Homo sapiens
ggugaccucacaguac

SEQ ID NO: 1295733 - RNA, 16 nt, Homo sapiens
ggugacuucacaguga

SEQ ID NO: 1295734 - RNA, 13 nt, Homo sapiens
ggugcccacaggc

SEQ ID NO: 1295735 - RNA, 15 nt, Homo sapiens
gguggaaaaacugag

SEQ ID NO: 1295736 - RNA, 13 nt, Homo sapiens
gguggagggccac

SEQ ID NO: 1295737 - RNA, 17 nt, Homo sapiens
gguggcugccucauuua

SEQ ID NO: 1295738 - RNA, 22 nt, Homo sapiens
gguggcugccucauuuagagag

SEQ ID NO: 1295739 - RNA, 15 nt, Homo sapiens
gguggggacagggau

SEQ ID NO: 1295740 - RNA, 13 nt, Homo sapiens
ggugggugggaug

SEQ ID NO: 1295741 - RNA, 18 nt, Homo sapiens
gguguccagcauugcugg

SEQ ID NO: 1295742 - RNA, 13 nt, Homo sapiens
ggugucugugaag

SEQ ID NO: 1295743 - RNA, 12 nt, Homo sapiens
gguguguuacac

SEQ ID NO: 1295744 - RNA, 21 nt, Homo sapiens
gguucacacccuguuuuauaa

SEQ ID NO: 1295745 - RNA, 20 nt, Homo sapiens
gguugaacucugguggcaca

SEQ ID NO: 1295746 - RNA, 23 nt, Homo sapiens
gguuuagggaagacauugcaaug

SEQ ID NO: 1295747 - RNA, 12 nt, Homo sapiens
gguuucauucug

SEQ ID NO: 1295748 - RNA, 17 nt, Homo sapiens
gguuucuccagagggaa

SEQ ID NO: 1295749 - RNA, 14 nt, Homo sapiens
gguuucucuguaua

SEQ ID NO: 1295750 - RNA, 21 nt, Homo sapiens
guaaaaguucuuuuugcucua

SEQ ID NO: 1295751 - RNA, 13 nt, Homo sapiens
guaaaauguucuc

SEQ ID NO: 1295752 - RNA, 22 nt, Homo sapiens
guaaacagaggaguacagguga

SEQ ID NO: 1295753 - RNA, 13 nt, Homo sapiens
guaaacugugcac

SEQ ID NO: 1295754 - RNA, 21 nt, Homo sapiens
guaaagaaauauauaugauau

SEQ ID NO: 1295755 - RNA, 16 nt, Homo sapiens
guaaaggcaagccagc

SEQ ID NO: 1295756 - RNA, 18 nt, Homo sapiens
guaaagggcgcaaagggc

SEQ ID NO: 1295757 - RNA, 14 nt, Homo sapiens
guaaauaugaaucu

SEQ ID NO: 1295758 - RNA, 17 nt, Homo sapiens
guaaauauuaaguguuu

SEQ ID NO: 1295759 - RNA, 14 nt, Homo sapiens
guaaaugcuccauu

SEQ ID NO: 1295760 - RNA, 14 nt, Homo sapiens
guaaauguguugcc

SEQ ID NO: 1295761 - RNA, 21 nt, Homo sapiens
guaaauguuaucuuauacugu

SEQ ID NO: 1295762 - RNA, 19 nt, Homo sapiens
guaacuccccucagggaua

SEQ ID NO: 1295763 - RNA, 18 nt, Homo sapiens
guaacuuuuuacauuaca

SEQ ID NO: 1295764 - RNA, 16 nt, Homo sapiens
guaagaaacacacuga

SEQ ID NO: 1295765 - RNA, 22 nt, Homo sapiens
guaagaccucugagaccaaaau

SEQ ID NO: 1295766 - RNA, 17 nt, Homo sapiens
guaagaucugaauucua

SEQ ID NO: 1295767 - RNA, 22 nt, Homo sapiens
guaagaugucuguuugcugaug

SEQ ID NO: 1295768 - RNA, 18 nt, Homo sapiens
guaaggccuuagccauga

SEQ ID NO: 1295769 - RNA, 15 nt, Homo sapiens
guaauacaucaaaga

SEQ ID NO: 1295770 - RNA, 18 nt, Homo sapiens
guaauauuuuacuuugag

SEQ ID NO: 1295771 - RNA, 14 nt, Homo sapiens
guaaucaacauucc

SEQ ID NO: 1295772 - RNA, 20 nt, Homo sapiens
guaauugcagauaacuuuga

SEQ ID NO: 1295773 - RNA, 20 nt, Homo sapiens
guaauuuuaguagagacagg

SEQ ID NO: 1295774 - RNA, 22 nt, Homo sapiens
guacaaaaccacucgccagagc

SEQ ID NO: 1295775 - RNA, 15 nt, Homo sapiens
guacaaacccaaaaa

SEQ ID NO: 1295776 - RNA, 19 nt, Homo sapiens
guacaaaguacuagcuaaa

SEQ ID NO: 1295777 - RNA, 17 nt, Homo sapiens
guacaaauauaagaaua

SEQ ID NO: 1295778 - RNA, 18 nt, Homo sapiens
guacaggcagcacagaga

SEQ ID NO: 1295779 - RNA, 13 nt, Homo sapiens
guacagguauauu

SEQ ID NO: 1295780 - RNA, 15 nt, Homo sapiens
guacaucuguuugua

SEQ ID NO: 1295781 - RNA, 11 nt, Homo sapiens
guacauuucac

SEQ ID NO: 1295782 - RNA, 20 nt, Homo sapiens
guacauuuuucaacuuugaa

SEQ ID NO: 1295783 - RNA, 13 nt, Homo sapiens
guaccugugcacg

SEQ ID NO: 1295784 - RNA, 14 nt, Homo sapiens
guacuauugcagac

SEQ ID NO: 1295785 - RNA, 19 nt, Homo sapiens
guacuuacaaaugacuccu

SEQ ID NO: 1295786 - RNA, 22 nt, Homo sapiens
guacuuauaaagaagguuggug

SEQ ID NO: 1295787 - RNA, 14 nt, Homo sapiens
guacuuguuugcaa

SEQ ID NO: 1295788 - RNA, 20 nt, Homo sapiens
guacuuugaguauaacauca

SEQ ID NO: 1295789 - RNA, 22 nt, Homo sapiens
guagaaaauuuguuauuuugca

SEQ ID NO: 1295790 - RNA, 18 nt, Homo sapiens
guagaaauaauaugcauu

SEQ ID NO: 1295791 - RNA, 18 nt, Homo sapiens
guagaccaaaucuuguua

SEQ ID NO: 1295792 - RNA, 20 nt, Homo sapiens
guagagacgguguuuugcca

SEQ ID NO: 1295793 - RNA, 21 nt, Homo sapiens
guagagacgguguuuugccau

SEQ ID NO: 1295794 - RNA, 23 nt, Homo sapiens
guagauauuggacaaagaaccuu

SEQ ID NO: 1295795 - RNA, 19 nt, Homo sapiens
guagauuucagggagacaa

SEQ ID NO: 1295796 - RNA, 21 nt, Homo sapiens
guagcagagaaaggauugauu

SEQ ID NO: 1295797 - RNA, 13 nt, Homo sapiens
guagcccauccuu

SEQ ID NO: 1295798 - RNA, 16 nt, Homo sapiens
guagcucuccugacuu

SEQ ID NO: 1295799 - RNA, 14 nt, Homo sapiens
guagcugcuaccuu

SEQ ID NO: 1295800 - RNA, 19 nt, Homo sapiens
guagcugggacuacaggca

SEQ ID NO: 1295801 - RNA, 13 nt, Homo sapiens
guaggacauacca

SEQ ID NO: 1295802 - RNA, 21 nt, Homo sapiens
guaggaccaagcaucuugggg

SEQ ID NO: 1295803 - RNA, 20 nt, Homo sapiens
guagggaaucucauccauca

SEQ ID NO: 1295804 - RNA, 19 nt, Homo sapiens
guagguaauauugcaaggc

SEQ ID NO: 1295805 - RNA, 16 nt, Homo sapiens
guagguagauaccaaa

SEQ ID NO: 1295806 - RNA, 14 nt, Homo sapiens
guagugucacucaa

SEQ ID NO: 1295807 - RNA, 20 nt, Homo sapiens
guauaaaauguaacacugau

SEQ ID NO: 1295808 - RNA, 14 nt, Homo sapiens
guauaagcaucugc

SEQ ID NO: 1295809 - RNA, 19 nt, Homo sapiens
guauaaguggaggcacuuu

SEQ ID NO: 1295810 - RNA, 14 nt, Homo sapiens
guauauauaauacu

SEQ ID NO: 1295811 - RNA, 10 nt, Homo sapiens
guauaugcac

SEQ ID NO: 1295812 - RNA, 17 nt, Homo sapiens
guaucagcagcucuuuu

SEQ ID NO: 1295813 - RNA, 15 nt, Homo sapiens
guaucaggacccaga

SEQ ID NO: 1295814 - RNA, 16 nt, Homo sapiens
guaucaggugcugcca

SEQ ID NO: 1295815 - RNA, 16 nt, Homo sapiens
guaucaguucugcuga

SEQ ID NO: 1295816 - RNA, 18 nt, Homo sapiens
guaucaguucugcugaca

SEQ ID NO: 1295817 - RNA, 23 nt, Homo sapiens
guauccaugcaccuaccuuagaa

SEQ ID NO: 1295818 - RNA, 19 nt, Homo sapiens
guauccccccaucuugcuu

SEQ ID NO: 1295819 - RNA, 14 nt, Homo sapiens
guaucgauguuaug

SEQ ID NO: 1295820 - RNA, 20 nt, Homo sapiens
guaucugacaaugcugaggu

SEQ ID NO: 1295821 - RNA, 21 nt, Homo sapiens
guaucuucuuuagugguggua

SEQ ID NO: 1295822 - RNA, 21 nt, Homo sapiens
guaucuuuacgaggagucuca

SEQ ID NO: 1295823 - RNA, 21 nt, Homo sapiens
guaugcuugcucuaagucaaa

SEQ ID NO: 1295824 - RNA, 16 nt, Homo sapiens
guauggagcucagaga

SEQ ID NO: 1295825 - RNA, 22 nt, Homo sapiens
guauggucuuggcagcaccugu

SEQ ID NO: 1295826 - RNA, 15 nt, Homo sapiens
guauguaacucuuaa

SEQ ID NO: 1295827 - RNA, 14 nt, Homo sapiens
guaugugcuguaau

SEQ ID NO: 1295828 - RNA, 20 nt, Homo sapiens
guauuaaaaaaaacaaaaag

SEQ ID NO: 1295829 - RNA, 14 nt, Homo sapiens
guauuaaaagcuaa

SEQ ID NO: 1295830 - RNA, 18 nt, Homo sapiens
guauuaagagcaauucaa

SEQ ID NO: 1295831 - RNA, 21 nt, Homo sapiens
guauucacacaccccucaaaa

SEQ ID NO: 1295832 - RNA, 13 nt, Homo sapiens
guauucacaguug

SEQ ID NO: 1295833 - RNA, 21 nt, Homo sapiens
guauucuuugcgguauucuug

SEQ ID NO: 1295834 - RNA, 18 nt, Homo sapiens
guauuguggaacacugaa

SEQ ID NO: 1295835 - RNA, 23 nt, Homo sapiens
guauuuauucaauaaaguauuua

SEQ ID NO: 1295836 - RNA, 23 nt, Homo sapiens
guauuuuauuacaucuuucacau

SEQ ID NO: 1295837 - RNA, 19 nt, Homo sapiens
gucaaccugccugacauuu

SEQ ID NO: 1295838 - RNA, 12 nt, Homo sapiens
gucaaugaacuu

SEQ ID NO: 1295839 - RNA, 19 nt, Homo sapiens
gucaaugaacuuuccacau

SEQ ID NO: 1295840 - RNA, 18 nt, Homo sapiens
gucacacgauaaagggau

SEQ ID NO: 1295841 - RNA, 17 nt, Homo sapiens
gucacagaagcagcuaa

SEQ ID NO: 1295842 - RNA, 21 nt, Homo sapiens
gucaccacccacccuaccugc

SEQ ID NO: 1295843 - RNA, 14 nt, Homo sapiens
gucaccauucugca

SEQ ID NO: 1295844 - RNA, 21 nt, Homo sapiens
uuugcuaaaugugaaugauga

SEQ ID NO: 1295845 - RNA, 15 nt, Homo sapiens
uuugcucugucuccu

SEQ ID NO: 1295846 - RNA, 14 nt, Homo sapiens
uuugcugccaaaca

SEQ ID NO: 1295847 - RNA, 15 nt, Homo sapiens
uuugcuuucugcuca

SEQ ID NO: 1295848 - RNA, 21 nt, Homo sapiens
uuuggaaguguucccugagaa

SEQ ID NO: 1295849 - RNA, 16 nt, Homo sapiens
uuuggacccaguucag

SEQ ID NO: 1295850 - RNA, 21 nt, Homo sapiens
uuuggauaucaaaagcaaaua

SEQ ID NO: 1295851 - RNA, 15 nt, Homo sapiens
uuuggccuccuccag

SEQ ID NO: 1295852 - RNA, 13 nt, Homo sapiens
uuugguaauguua

SEQ ID NO: 1295853 - RNA, 23 nt, Homo sapiens
uuugguagagauggagucuugcu

SEQ ID NO: 1295854 - RNA, 21 nt, Homo sapiens
uuuggucaaguaguuugacuc

SEQ ID NO: 1295855 - RNA, 22 nt, Homo sapiens
uuugguguaagccuucaaagaa

SEQ ID NO: 1295856 - RNA, 16 nt, Homo sapiens
uuugguuaaacccaug

SEQ ID NO: 1295857 - RNA, 18 nt, Homo sapiens
uuuguaauaacauuuaau

SEQ ID NO: 1295858 - RNA, 21 nt, Homo sapiens
uuuguacacgaagaccaucca

SEQ ID NO: 1295859 - RNA, 21 nt, Homo sapiens
uuuguagaaugaaccacugcc

SEQ ID NO: 1295860 - RNA, 17 nt, Homo sapiens
uuugugaauauuuucaa

SEQ ID NO: 1295861 - RNA, 19 nt, Homo sapiens
uuugugauagcacuuucua

SEQ ID NO: 1295862 - RNA, 14 nt, Homo sapiens
uuuguggaaaagaa

SEQ ID NO: 1295863 - RNA, 11 nt, Homo sapiens
uuuguggcauc

SEQ ID NO: 1295864 - RNA, 20 nt, Homo sapiens
uuuguuuggguuacaguaug

SEQ ID NO: 1295865 - RNA, 17 nt, Homo sapiens
uuuuaaaaagugugcuu

SEQ ID NO: 1295866 - RNA, 23 nt, Homo sapiens
uuuuaaauaaaaauaaguguaca

SEQ ID NO: 1295867 - RNA, 17 nt, Homo sapiens
uuuuaacucugucuuca

SEQ ID NO: 1295868 - RNA, 23 nt, Homo sapiens
uuuuacaauaaaacuuugcugcc

SEQ ID NO: 1295869 - RNA, 15 nt, Homo sapiens
uuuuacacuugcauc

SEQ ID NO: 1295870 - RNA, 22 nt, Homo sapiens
uuuuacauacauugauucaugu

SEQ ID NO: 1295871 - RNA, 17 nt, Homo sapiens
uuuuacccacacacaga

SEQ ID NO: 1295872 - RNA, 12 nt, Homo sapiens
uuuuacugcuug

SEQ ID NO: 1295873 - RNA, 13 nt, Homo sapiens
uuuuagacagagu

SEQ ID NO: 1295874 - RNA, 20 nt, Homo sapiens
uuuuaggaaaggcugaugau

SEQ ID NO: 1295875 - RNA, 20 nt, Homo sapiens
uuuuauaaaauuaagcaaug

SEQ ID NO: 1295876 - RNA, 20 nt, Homo sapiens
uuuuauacagugauauacuu

SEQ ID NO: 1295877 - RNA, 16 nt, Homo sapiens
uuuucaaggccuucag

SEQ ID NO: 1295878 - RNA, 18 nt, Homo sapiens
uuuucacagauuggggua

SEQ ID NO: 1295879 - RNA, 13 nt, Homo sapiens
uuuucaccccacc

SEQ ID NO: 1295880 - RNA, 14 nt, Homo sapiens
uuuucagaugugaa

SEQ ID NO: 1295881 - RNA, 13 nt, Homo sapiens
uuuuccagcauuu

SEQ ID NO: 1295882 - RNA, 23 nt, Homo sapiens
uuuuccaguccccagaagcagag

SEQ ID NO: 1295883 - RNA, 17 nt, Homo sapiens
uuuucccuuugccuuca

SEQ ID NO: 1295884 - RNA, 22 nt, Homo sapiens
uuuuccuaugcuauugacaaua

SEQ ID NO: 1295885 - RNA, 15 nt, Homo sapiens
uuuuccuuaccuuua

SEQ ID NO: 1295886 - RNA, 22 nt, Homo sapiens
uuuucuccccucauaucugcgu

SEQ ID NO: 1295887 - RNA, 19 nt, Homo sapiens
uuuucuguggaucauuucc

SEQ ID NO: 1295888 - RNA, 22 nt, Homo sapiens
uuuucuugcuaaaacucuaugu

SEQ ID NO: 1295889 - RNA, 17 nt, Homo sapiens
uuuugaaaaugcuuuag

SEQ ID NO: 1295890 - RNA, 14 nt, Homo sapiens
uuuugaaggcaaaa

SEQ ID NO: 1295891 - RNA, 20 nt, Homo sapiens
uuuugaaguaccaccaaaaa

SEQ ID NO: 1295892 - RNA, 21 nt, Homo sapiens
uuuugaccaaaaaaauugugc

SEQ ID NO: 1295893 - RNA, 18 nt, Homo sapiens
uuuugcacacuuugccau

SEQ ID NO: 1295894 - RNA, 22 nt, Homo sapiens
uuuuguccuaaaacaccuggua

SEQ ID NO: 1295895 - RNA, 18 nt, Homo sapiens
uuuuuaaaaaacugcuga

SEQ ID NO: 1295896 - RNA, 16 nt, Homo sapiens
uuuuuaaaaaagcaag

SEQ ID NO: 1295897 - RNA, 18 nt, Homo sapiens
uuuuuaauauaaagccug

SEQ ID NO: 1295898 - RNA, 14 nt, Homo sapiens
uuuuucaagagcuc

SEQ ID NO: 1295899 - RNA, 14 nt, Homo sapiens
uuuuuccucugcau

SEQ ID NO: 1295900 - RNA, 23 nt, Homo sapiens
uuuuuccuuccuuaucacugaca

SEQ ID NO: 1295901 - RNA, 22 nt, Homo sapiens
uuuuucuuugagacugggucuc

SEQ ID NO: 1295902 - RNA, 19 nt, Homo sapiens
uuuuuguuaucagucaaua

SEQ ID NO: 1295903 - RNA, 12 nt, Homo sapiens
uuuuuuccacaa

SEQ ID NO: 1295904 - RNA, 12 nt, Homo sapiens
aaaaaaaauccc

SEQ ID NO: 1295905 - RNA, 12 nt, Homo sapiens
aaaaaaauggaa

SEQ ID NO: 1295906 - RNA, 15 nt, Homo sapiens
aaaaaacaaucugga

SEQ ID NO: 1295907 - RNA, 13 nt, Homo sapiens
aaaaaacuauuaa

SEQ ID NO: 1295908 - RNA, 17 nt, Homo sapiens
aaaaaauaacaaugaaa

SEQ ID NO: 1295909 - RNA, 16 nt, Homo sapiens
aaaaacacucaacaaa

SEQ ID NO: 1295910 - RNA, 11 nt, Homo sapiens
aaaaacaugua

SEQ ID NO: 1295911 - RNA, 14 nt, Homo sapiens
aaaaaccuuccaaa

SEQ ID NO: 1295912 - RNA, 15 nt, Homo sapiens
aaaaacuguuaauca

SEQ ID NO: 1295913 - RNA, 14 nt, Homo sapiens
aaaaagacaacuca

SEQ ID NO: 1295914 - RNA, 12 nt, Homo sapiens
aaaaagccucca

SEQ ID NO: 1295915 - RNA, 14 nt, Homo sapiens
aaaaagccugugaa

SEQ ID NO: 1295916 - RNA, 20 nt, Homo sapiens
aaaaaggaaagaacugucau

SEQ ID NO: 1295917 - RNA, 14 nt, Homo sapiens
aaaaaguauugcau

SEQ ID NO: 1295918 - RNA, 22 nt, Homo sapiens
aaaaauacaacagugcauuuac

SEQ ID NO: 1295919 - RNA, 15 nt, Homo sapiens
aaaaauagacacucc

SEQ ID NO: 1295920 - RNA, 21 nt, Homo sapiens
aaaaauagccugccucuucuc

SEQ ID NO: 1295921 - RNA, 17 nt, Homo sapiens
aaaaauauauuuccuca

SEQ ID NO: 1295922 - RNA, 22 nt, Homo sapiens
aaaaauauguaccaagaaucuu

SEQ ID NO: 1295923 - RNA, 15 nt, Homo sapiens
aaaaaucagugaaua

SEQ ID NO: 1295924 - RNA, 15 nt, Homo sapiens
aaaaaucccuuaccu

SEQ ID NO: 1295925 - RNA, 24 nt, Homo sapiens
aaaaaugaaaagagaaugaugcuc

SEQ ID NO: 1295926 - RNA, 23 nt, Homo sapiens
aaaaaugcguaagaccaagcugu

SEQ ID NO: 1295927 - RNA, 18 nt, Homo sapiens
aaaaauggcagugaugaa

SEQ ID NO: 1295928 - RNA, 20 nt, Homo sapiens
aaaaauguauaugcacuuau

SEQ ID NO: 1295929 - RNA, 20 nt, Homo sapiens
aaaaauguauuuuuccuaaa

SEQ ID NO: 1295930 - RNA, 19 nt, Homo sapiens
aaaacaaaacaaaccuuaa

SEQ ID NO: 1295931 - RNA, 17 nt, Homo sapiens
aaaacacaaaaguuucu

SEQ ID NO: 1295932 - RNA, 14 nt, Homo sapiens
aaaacacugugcac

SEQ ID NO: 1295933 - RNA, 15 nt, Homo sapiens
aaaacaggucuucau

SEQ ID NO: 1295934 - RNA, 14 nt, Homo sapiens
aaaacauaaacuga

SEQ ID NO: 1295935 - RNA, 15 nt, Homo sapiens
aaaacauugauaauu

SEQ ID NO: 1295936 - RNA, 24 nt, Homo sapiens
aaaaccaauguucucucuucucca

SEQ ID NO: 1295937 - RNA, 23 nt, Homo sapiens
aaaaccaccaccaucaccagaca

SEQ ID NO: 1295938 - RNA, 18 nt, Homo sapiens
aaaaccagaacaguauga

SEQ ID NO: 1295939 - RNA, 19 nt, Homo sapiens
aaaaccaggccuuaucucc

SEQ ID NO: 1295940 - RNA, 13 nt, Homo sapiens
aaaacucauuucc

SEQ ID NO: 1295941 - RNA, 20 nt, Homo sapiens
aaaacucauuuccuauguaa

SEQ ID NO: 1295942 - RNA, 11 nt, Homo sapiens
aaaacugccuc

SEQ ID NO: 1295943 - RNA, 16 nt, Homo sapiens
aaaacuuagugacaaa

SEQ ID NO: 1295944 - RNA, 16 nt, Homo sapiens
aaaacuuaugaccucu

SEQ ID NO: 1295945 - RNA, 15 nt, Homo sapiens
aaaacuuggaccacu

SEQ ID NO: 1295946 - RNA, 15 nt, Homo sapiens
aaaagaacaugcagu

SEQ ID NO: 1295947 - RNA, 14 nt, Homo sapiens
aaaagacacugcag

SEQ ID NO: 1295948 - RNA, 15 nt, Homo sapiens
aaaagacacugcaga

SEQ ID NO: 1295949 - RNA, 13 nt, Homo sapiens
aaaagagaucuua

SEQ ID NO: 1295950 - RNA, 23 nt, Homo sapiens
aaaagaugcuucucacugccaug

SEQ ID NO: 1295951 - RNA, 21 nt, Homo sapiens
aaaagauggggucuguaaaau

SEQ ID NO: 1295952 - RNA, 13 nt, Homo sapiens
aaaagcaaaauca

SEQ ID NO: 1295953 - RNA, 14 nt, Homo sapiens
aaaagcaaggcaca

SEQ ID NO: 1295954 - RNA, 11 nt, Homo sapiens
aaaagccaaaa

SEQ ID NO: 1295955 - RNA, 19 nt, Homo sapiens
aaaagcccagcacuugaau

SEQ ID NO: 1295956 - RNA, 21 nt, Homo sapiens
aaaaggggcuccuugcuccac

SEQ ID NO: 1295957 - RNA, 23 nt, Homo sapiens
aaaagucaccauucugcauuuag

SEQ ID NO: 1295958 - RNA, 22 nt, Homo sapiens
aaaagugcuucauucuuugcag

SEQ ID NO: 1295959 - RNA, 14 nt, Homo sapiens
aaaaguuguuuguu

SEQ ID NO: 1295960 - RNA, 16 nt, Homo sapiens
aaaauaaacacuacag

SEQ ID NO: 1295961 - RNA, 17 nt, Homo sapiens
aaaauaaagcuguucuc

SEQ ID NO: 1295962 - RNA, 13 nt, Homo sapiens
aaaauacaugaca

SEQ ID NO: 1295963 - RNA, 18 nt, Homo sapiens
aaaauacaugacauuuau

SEQ ID NO: 1295964 - RNA, 19 nt, Homo sapiens
aaaauagacuaaccucuac

SEQ ID NO: 1295965 - RNA, 18 nt, Homo sapiens
aaaauagucuaguguagu

SEQ ID NO: 1295966 - RNA, 18 nt, Homo sapiens
aaaauaguuaagacauga

SEQ ID NO: 1295967 - RNA, 20 nt, Homo sapiens
aaaauauagcuguacaaaua

SEQ ID NO: 1295968 - RNA, 17 nt, Homo sapiens
aaaauauuuuuucugua

SEQ ID NO: 1295969 - RNA, 16 nt, Homo sapiens
aaaauccaaaacucuu

SEQ ID NO: 1295970 - RNA, 15 nt, Homo sapiens
aaaaucuuauaauuu

SEQ ID NO: 1295971 - RNA, 12 nt, Homo sapiens
aaaaucuuauca

SEQ ID NO: 1295972 - RNA, 13 nt, Homo sapiens
aaaaucuuguaca

SEQ ID NO: 1295973 - RNA, 18 nt, Homo sapiens
aaaaucuuguacauuaua

SEQ ID NO: 1295974 - RNA, 18 nt, Homo sapiens
aaaaugagagcuguaacu

SEQ ID NO: 1295975 - RNA, 12 nt, Homo sapiens
aaaaugcaauug

SEQ ID NO: 1295976 - RNA, 21 nt, Homo sapiens
aaaaugcaauuggcauuaaca

SEQ ID NO: 1295977 - RNA, 18 nt, Homo sapiens
aaaaugccucaguguauu

SEQ ID NO: 1295978 - RNA, 18 nt, Homo sapiens
aaaauguagcagcuucuu

SEQ ID NO: 1295979 - RNA, 15 nt, Homo sapiens
aaaauguauuuuucc

SEQ ID NO: 1295980 - RNA, 17 nt, Homo sapiens
aaaaugucauuguucuc

SEQ ID NO: 1295981 - RNA, 14 nt, Homo sapiens
aaaauguucucuua

SEQ ID NO: 1295982 - RNA, 19 nt, Homo sapiens
aaaauguugagaaucccaa

SEQ ID NO: 1295983 - RNA, 18 nt, Homo sapiens
aaaauucauuucuaauua

SEQ ID NO: 1295984 - RNA, 21 nt, Homo sapiens
aaaauuuacaauuugacauac

SEQ ID NO: 1295985 - RNA, 18 nt, Homo sapiens
aaaauuuuaagcuguaca

SEQ ID NO: 1295986 - RNA, 21 nt, Homo sapiens
aaaauuuugugacauuccuuc

SEQ ID NO: 1295987 - RNA, 23 nt, Homo sapiens
aaaauuuuuuuagaaagcauuug

SEQ ID NO: 1295988 - RNA, 16 nt, Homo sapiens
aaacaacagcuuuaaa

SEQ ID NO: 1295989 - RNA, 19 nt, Homo sapiens
aaacacagacauucugcca

SEQ ID NO: 1295990 - RNA, 13 nt, Homo sapiens
aaacacuugcaac

SEQ ID NO: 1295991 - RNA, 15 nt, Homo sapiens
aaacagaugccccag

SEQ ID NO: 1295992 - RNA, 23 nt, Homo sapiens
aaacagcuccccaccaaccaaga

SEQ ID NO: 1295993 - RNA, 22 nt, Homo sapiens
aaacaggcaguuggccagagag

SEQ ID NO: 1295994 - RNA, 14 nt, Homo sapiens
aaacagugacauuu

SEQ ID NO: 1295995 - RNA, 14 nt, Homo sapiens
aaacauacuucuaa

SEQ ID NO: 1295996 - RNA, 22 nt, Homo sapiens
aaacaucacaccugcccuaaac

SEQ ID NO: 1295997 - RNA, 18 nt, Homo sapiens
aaacauucaggagcuucc

SEQ ID NO: 1295998 - RNA, 14 nt, Homo sapiens
aaacauugccuuug

SEQ ID NO: 1295999 - RNA, 20 nt, Homo sapiens
aaacauuguuuuguguaaca

SEQ ID NO: 1296000 - RNA, 18 nt, Homo sapiens
aaacauuuuuaucuauca

SEQ ID NO: 1296001 - RNA, 18 nt, Homo sapiens
aaaccacuuuuugcagcu

SEQ ID NO: 1296002 - RNA, 17 nt, Homo sapiens
aaaccagaacaguauga

SEQ ID NO: 1296003 - RNA, 13 nt, Homo sapiens
aaacccaauccaa

SEQ ID NO: 1296004 - RNA, 14 nt, Homo sapiens
aaacccagucuccu

SEQ ID NO: 1296005 - RNA, 14 nt, Homo sapiens
aaaccucuccucau

SEQ ID NO: 1296006 - RNA, 15 nt, Homo sapiens
aaaccugauuuacua

SEQ ID NO: 1296007 - RNA, 21 nt, Homo sapiens
aaaccuguugaauaauuugau

SEQ ID NO: 1296008 - RNA, 15 nt, Homo sapiens
aaaccuuaguuucaa

SEQ ID NO: 1296009 - RNA, 13 nt, Homo sapiens
aaacgaaucauug

SEQ ID NO: 1296010 - RNA, 19 nt, Homo sapiens
aaacgucuucuaaacuucc

SEQ ID NO: 1296011 - RNA, 13 nt, Homo sapiens
aaacucaccaucu

SEQ ID NO: 1296012 - RNA, 15 nt, Homo sapiens
aaacuccgagugaac

SEQ ID NO: 1296013 - RNA, 18 nt, Homo sapiens
aaacucuacuuaauccaa

SEQ ID NO: 1296014 - RNA, 13 nt, Homo sapiens
aaacucucugaac

SEQ ID NO: 1296015 - RNA, 22 nt, Homo sapiens
aaacucugcauccagagauuca

SEQ ID NO: 1296016 - RNA, 16 nt, Homo sapiens
aaacugaauccauuca

SEQ ID NO: 1296017 - RNA, 21 nt, Homo sapiens
aaacugucgguuugcuuugau

SEQ ID NO: 1296018 - RNA, 19 nt, Homo sapiens
aaacuuagugacaaaauag

SEQ ID NO: 1296019 - RNA, 16 nt, Homo sapiens
aaacuuuauugacaag

SEQ ID NO: 1296020 - RNA, 21 nt, Homo sapiens
aaagaaaauuccuauaaggaa

SEQ ID NO: 1296021 - RNA, 23 nt, Homo sapiens
aaagaaggcauuugcaggguccu

SEQ ID NO: 1296022 - RNA, 19 nt, Homo sapiens
aaagaagucauggcccaaa

SEQ ID NO: 1296023 - RNA, 14 nt, Homo sapiens
aaagaauaguagua

SEQ ID NO: 1296024 - RNA, 22 nt, Homo sapiens
aaagaauccauaaaaaguaaua

SEQ ID NO: 1296025 - RNA, 17 nt, Homo sapiens
aaagaauguuacugccu

SEQ ID NO: 1296026 - RNA, 21 nt, Homo sapiens
aaagaauguuacugccuuaau

SEQ ID NO: 1296027 - RNA, 15 nt, Homo sapiens
aaagaauucuugaaa

SEQ ID NO: 1296028 - RNA, 20 nt, Homo sapiens
aaagaccugacaccuuucau

SEQ ID NO: 1296029 - RNA, 13 nt, Homo sapiens
aaagagaaaaaga

SEQ ID NO: 1296030 - RNA, 17 nt, Homo sapiens
aaagagagggcuuuaau

SEQ ID NO: 1296031 - RNA, 15 nt, Homo sapiens
aaagagcacuuaaga

SEQ ID NO: 1296032 - RNA, 12 nt, Homo sapiens
aaagaguauuaa

SEQ ID NO: 1296033 - RNA, 15 nt, Homo sapiens
aaagauaccauucuu

SEQ ID NO: 1296034 - RNA, 20 nt, Homo sapiens
aaagaugaccauaaccacug

SEQ ID NO: 1296035 - RNA, 13 nt, Homo sapiens
aaagaugacuuga

SEQ ID NO: 1296036 - RNA, 14 nt, Homo sapiens
aaagaugacuugaa

SEQ ID NO: 1296037 - RNA, 16 nt, Homo sapiens
aaagauggggucugua

SEQ ID NO: 1296038 - RNA, 13 nt, Homo sapiens
aaagauguauaua

SEQ ID NO: 1296039 - RNA, 20 nt, Homo sapiens
aaagauuucuugaguuuugu

SEQ ID NO: 1296040 - RNA, 19 nt, Homo sapiens
aaagauuugcaacauuaga

SEQ ID NO: 1296041 - RNA, 15 nt, Homo sapiens
aaagcaaguugccug

SEQ ID NO: 1296042 - RNA, 21 nt, Homo sapiens
aaagcacacucauccccucac

SEQ ID NO: 1296043 - RNA, 17 nt, Homo sapiens
aaagcaguucugaugcu

SEQ ID NO: 1296044 - RNA, 15 nt, Homo sapiens
aaagcauaaaaaggu

SEQ ID NO: 1296045 - RNA, 16 nt, Homo sapiens
aaagccaagaccucac

SEQ ID NO: 1296046 - RNA, 13 nt, Homo sapiens
aaagccacacucu

SEQ ID NO: 1296047 - RNA, 18 nt, Homo sapiens
aaagcccagcacuugaau

SEQ ID NO: 1296048 - RNA, 19 nt, Homo sapiens
aaagccuccaguccaagga

SEQ ID NO: 1296049 - RNA, 17 nt, Homo sapiens
aaagcgcuuuuccuugg

SEQ ID NO: 1296050 - RNA, 21 nt, Homo sapiens
aaagcuccauuuuuagugaaa

SEQ ID NO: 1296051 - RNA, 13 nt, Homo sapiens
aaagcugcugaca

SEQ ID NO: 1296052 - RNA, 20 nt, Homo sapiens
aaagcuguugcugucccuaa

SEQ ID NO: 1296053 - RNA, 14 nt, Homo sapiens
aaagcuuuauuuca

SEQ ID NO: 1296054 - RNA, 21 nt, Homo sapiens
aaagcuuuuagaaauacugca

SEQ ID NO: 1296055 - RNA, 20 nt, Homo sapiens
aaaggaacguugcagaagca

SEQ ID NO: 1296056 - RNA, 22 nt, Homo sapiens
aaaggaauccacucccaggcag

SEQ ID NO: 1296057 - RNA, 18 nt, Homo sapiens
aaaggaauguagcucaac

SEQ ID NO: 1296058 - RNA, 23 nt, Homo sapiens
aaaggacuagccacauacuagca

SEQ ID NO: 1296059 - RNA, 18 nt, Homo sapiens
aaaggauuaauugcugca

SEQ ID NO: 1296060 - RNA, 20 nt, Homo sapiens
aaaggcaaaugcccaaggga

SEQ ID NO: 1296061 - RNA, 22 nt, Homo sapiens
aaaggcuaagcuucacuguaaa

SEQ ID NO: 1296062 - RNA, 23 nt, Homo sapiens
aaaggcucgauuuuguaucugca

SEQ ID NO: 1296063 - RNA, 19 nt, Homo sapiens
aaaggcugggaccacguga

SEQ ID NO: 1296064 - RNA, 17 nt, Homo sapiens
aaagggagcacuggguu

SEQ ID NO: 1296065 - RNA, 15 nt, Homo sapiens
aaagggcaugggucg

SEQ ID NO: 1296066 - RNA, 18 nt, Homo sapiens
aaagggcccagagagggu

SEQ ID NO: 1296067 - RNA, 18 nt, Homo sapiens
aaagggcgcaaagggcau

SEQ ID NO: 1296068 - RNA, 22 nt, Homo sapiens
aaaggggauggagugagcccau

SEQ ID NO: 1296069 - RNA, 23 nt, Homo sapiens
aaagguaaaacaugcuggugaac

SEQ ID NO: 1296070 - RNA, 18 nt, Homo sapiens
aaaggugguguuucugua

SEQ ID NO: 1296071 - RNA, 23 nt, Homo sapiens
aaagguuuugagcauggguucau

SEQ ID NO: 1296072 - RNA, 14 nt, Homo sapiens
aaaguacuucucca

SEQ ID NO: 1296073 - RNA, 17 nt, Homo sapiens
aaaguaggaaauacaau

SEQ ID NO: 1296074 - RNA, 16 nt, Homo sapiens
aaaguaguccugugaa

SEQ ID NO: 1296075 - RNA, 22 nt, Homo sapiens
aaagucaccauucugcauuuag

SEQ ID NO: 1296076 - RNA, 22 nt, Homo sapiens
aaaguccugugguuaacgccuu

SEQ ID NO: 1296077 - RNA, 15 nt, Homo sapiens
aaagucuuaccucag

SEQ ID NO: 1296078 - RNA, 16 nt, Homo sapiens
aaaguggaaauggaga

SEQ ID NO: 1296079 - RNA, 18 nt, Homo sapiens
aaaguggacaaggagugu

SEQ ID NO: 1296080 - RNA, 14 nt, Homo sapiens
aaagugggcuugau

SEQ ID NO: 1296081 - RNA, 20 nt, Homo sapiens
aaaguguuugaaagcuuuau

SEQ ID NO: 1296082 - RNA, 20 nt, Homo sapiens
aaaguugauaaguacaugau

SEQ ID NO: 1296083 - RNA, 17 nt, Homo sapiens
aaaguuucucuuuucaa

SEQ ID NO: 1296084 - RNA, 15 nt, Homo sapiens
aaauaaaaaccaaga

SEQ ID NO: 1296085 - RNA, 16 nt, Homo sapiens
aaauaaaaaucucuuu

SEQ ID NO: 1296086 - RNA, 20 nt, Homo sapiens
aaauaaaaaucucuuuucca

SEQ ID NO: 1296087 - RNA, 18 nt, Homo sapiens
aaauaaaacaguaucucu

SEQ ID NO: 1296088 - RNA, 13 nt, Homo sapiens
aaauaaaccuccu

SEQ ID NO: 1296089 - RNA, 15 nt, Homo sapiens
aaauaaaggaguuau

SEQ ID NO: 1296090 - RNA, 12 nt, Homo sapiens
aaauaaccacug

SEQ ID NO: 1296091 - RNA, 14 nt, Homo sapiens
aaauaaccacugca

SEQ ID NO: 1296092 - RNA, 21 nt, Homo sapiens
aaauacagucuuccauuugca

SEQ ID NO: 1296093 - RNA, 11 nt, Homo sapiens
aaauacaugua

SEQ ID NO: 1296094 - RNA, 13 nt, Homo sapiens
aaauacuugcaug

SEQ ID NO: 1296095 - RNA, 13 nt, Homo sapiens
aaauacuugcucc

SEQ ID NO: 1296096 - RNA, 14 nt, Homo sapiens
aaauacuugcucca

SEQ ID NO: 1296097 - RNA, 21 nt, Homo sapiens
aaauacuugcuccauuuacaa

SEQ ID NO: 1296098 - RNA, 18 nt, Homo sapiens
aaauauaacaucuaugaa

SEQ ID NO: 1296099 - RNA, 15 nt, Homo sapiens
aaauauaauaugcac

SEQ ID NO: 1296100 - RNA, 17 nt, Homo sapiens
aaauauuuacaguacuu

SEQ ID NO: 1296101 - RNA, 22 nt, Homo sapiens
aaauauuuuccugccacugugu

SEQ ID NO: 1296102 - RNA, 15 nt, Homo sapiens
aaauauuuugucuaa

SEQ ID NO: 1296103 - RNA, 22 nt, Homo sapiens
aaaucagagagggaagaucugg

SEQ ID NO: 1296104 - RNA, 10 nt, Homo sapiens
aaauccaaag

SEQ ID NO: 1296105 - RNA, 21 nt, Homo sapiens
aaauccgaaccuccucuguga

SEQ ID NO: 1296106 - RNA, 20 nt, Homo sapiens
aaauccuaaagaaggugaua

SEQ ID NO: 1296107 - RNA, 13 nt, Homo sapiens
aaauccuggugau

SEQ ID NO: 1296108 - RNA, 12 nt, Homo sapiens
aaauccuugaua

SEQ ID NO: 1296109 - RNA, 23 nt, Homo sapiens
aaaucggaucuggggcucuggga

SEQ ID NO: 1296110 - RNA, 14 nt, Homo sapiens
aaaucguccaggga

SEQ ID NO: 1296111 - RNA, 12 nt, Homo sapiens
aaaucuauucca

SEQ ID NO: 1296112 - RNA, 22 nt, Homo sapiens
aaaucucaaugaagccagcuca

SEQ ID NO: 1296113 - RNA, 12 nt, Homo sapiens
aaaucugaggga

SEQ ID NO: 1296114 - RNA, 13 nt, Homo sapiens
aaaugaacugacu

SEQ ID NO: 1296115 - RNA, 14 nt, Homo sapiens
aaaugagccuuaag

SEQ ID NO: 1296116 - RNA, 12 nt, Homo sapiens
aaaugcaaaaua

SEQ ID NO: 1296117 - RNA, 13 nt, Homo sapiens
aaaugcaaaauaa

SEQ ID NO: 1296118 - RNA, 11 nt, Homo sapiens
aaaugcaacuu

SEQ ID NO: 1296119 - RNA, 22 nt, Homo sapiens
aaaugcaauguaagcauacuuu

SEQ ID NO: 1296120 - RNA, 21 nt, Homo sapiens
aaaugcagcagggaugcccug

SEQ ID NO: 1296121 - RNA, 23 nt, Homo sapiens
aaaugcccagcuuaaaggggcua

SEQ ID NO: 1296122 - RNA, 15 nt, Homo sapiens
aaaugcucucucuuc

SEQ ID NO: 1296123 - RNA, 12 nt, Homo sapiens
aaauggcacugc

SEQ ID NO: 1296124 - RNA, 11 nt, Homo sapiens
aaauggugguc

SEQ ID NO: 1296125 - RNA, 19 nt, Homo sapiens
aaauguaacugugccaguu

SEQ ID NO: 1296126 - RNA, 13 nt, Homo sapiens
aaauguagcagcu

SEQ ID NO: 1296127 - RNA, 23 nt, Homo sapiens
aaaugucaguaguuucuuauuaa

SEQ ID NO: 1296128 - RNA, 14 nt, Homo sapiens
aaaugucaucaggu

SEQ ID NO: 1296129 - RNA, 22 nt, Homo sapiens
aaugucccccauaucuguaugu

SEQ ID NO: 1296130 - RNA, 13 nt, Homo sapiens
aaugucucuguga

SEQ ID NO: 1296131 - RNA, 23 nt, Homo sapiens
aaugucuugcuguugacauauuu

SEQ ID NO: 1296132 - RNA, 17 nt, Homo sapiens
aaugugacgaaagugga

SEQ ID NO: 1296133 - RNA, 17 nt, Homo sapiens
aaugugcaaccacugcu

SEQ ID NO: 1296134 - RNA, 11 nt, Homo sapiens
aaugugcuguu

SEQ ID NO: 1296135 - RNA, 23 nt, Homo sapiens
aaugugguugaagagcaaugugu

SEQ ID NO: 1296136 - RNA, 17 nt, Homo sapiens
aauguguggcugaagac

SEQ ID NO: 1296137 - RNA, 16 nt, Homo sapiens
aauguuaacuacauau

SEQ ID NO: 1296138 - RNA, 14 nt, Homo sapiens
aauguuaauguuau

SEQ ID NO: 1296139 - RNA, 15 nt, Homo sapiens
aauguucacuuuuga

SEQ ID NO: 1296140 - RNA, 16 nt, Homo sapiens
aauguuggagcuuuag

SEQ ID NO: 1296141 - RNA, 15 nt, Homo sapiens
aauguuuaaacauuu

SEQ ID NO: 1296142 - RNA, 16 nt, Homo sapiens
aauuaaaaaagcauac

SEQ ID NO: 1296143 - RNA, 17 nt, Homo sapiens
aauuaaaacacuuucaa

SEQ ID NO: 1296144 - RNA, 22 nt, Homo sapiens
aauuagaauaguguucugcaaa

SEQ ID NO: 1296145 - RNA, 14 nt, Homo sapiens
aauuagacaucuuc

SEQ ID NO: 1296146 - RNA, 16 nt, Homo sapiens
aauuagcugcuucuau

SEQ ID NO: 1296147 - RNA, 15 nt, Homo sapiens
aauuagggagcucuu

SEQ ID NO: 1296148 - RNA, 15 nt, Homo sapiens
aauuaguaacaugug

SEQ ID NO: 1296149 - RNA, 12 nt, Homo sapiens
aauuaugccaua

SEQ ID NO: 1296150 - RNA, 22 nt, Homo sapiens
aauuauguucuacagaauauuc

SEQ ID NO: 1296151 - RNA, 11 nt, Homo sapiens
aauuauucccc

SEQ ID NO: 1296152 - RNA, 22 nt, Homo sapiens
aauuauuuaugugaaagucaaa

SEQ ID NO: 1296153 - RNA, 17 nt, Homo sapiens
aauuauuucacaaauaa

SEQ ID NO: 1296154 - RNA, 18 nt, Homo sapiens
aauucacaaauacauaac

SEQ ID NO: 1296155 - RNA, 21 nt, Homo sapiens
aauuccaaagcaaaaccagaa

SEQ ID NO: 1296156 - RNA, 13 nt, Homo sapiens
aauuccucagugg

SEQ ID NO: 1296157 - RNA, 13 nt, Homo sapiens
aauuccucuggga

SEQ ID NO: 1296158 - RNA, 15 nt, Homo sapiens
aauuccuugcacaua

SEQ ID NO: 1296159 - RNA, 22 nt, Homo sapiens
aauucgcugcaaccuguugaua

SEQ ID NO: 1296160 - RNA, 18 nt, Homo sapiens
aauucuaaaccaaucaaa

SEQ ID NO: 1296161 - RNA, 19 nt, Homo sapiens
aauucuagaugacuuuaau

SEQ ID NO: 1296162 - RNA, 17 nt, Homo sapiens
aauucuauucugaucuu

SEQ ID NO: 1296163 - RNA, 17 nt, Homo sapiens
aauucucauuugucaca

SEQ ID NO: 1296164 - RNA, 14 nt, Homo sapiens
aauucuugcauaua

SEQ ID NO: 1296165 - RNA, 18 nt, Homo sapiens
aauucuuuggaacuuuaa

SEQ ID NO: 1296166 - RNA, 17 nt, Homo sapiens
aauugaaaggcauucuc

SEQ ID NO: 1296167 - RNA, 16 nt, Homo sapiens
aauugauguuacugua

SEQ ID NO: 1296168 - RNA, 16 nt, Homo sapiens
aauugauuugcauuga

SEQ ID NO: 1296169 - RNA, 22 nt, Homo sapiens
aauugcaacuucuaaacacaaa

SEQ ID NO: 1296170 - RNA, 21 nt, Homo sapiens
aauugccauaauaugaugcaa

SEQ ID NO: 1296171 - RNA, 18 nt, Homo sapiens
aauugccuguaacacaua

SEQ ID NO: 1296172 - RNA, 14 nt, Homo sapiens
aauugggauuugca

SEQ ID NO: 1296173 - RNA, 15 nt, Homo sapiens
aauugggauuugcag

SEQ ID NO: 1296174 - RNA, 23 nt, Homo sapiens
aauuguuugucuuuaacugucaa

SEQ ID NO: 1296175 - RNA, 18 nt, Homo sapiens
aauuuacaguuccuucaa

SEQ ID NO: 1296176 - RNA, 14 nt, Homo sapiens
aauuuauugcacau

SEQ ID NO: 1296177 - RNA, 12 nt, Homo sapiens
aauuucacaagc

SEQ ID NO: 1296178 - RNA, 16 nt, Homo sapiens
aauuucacaagcuauu

SEQ ID NO: 1296179 - RNA, 11 nt, Homo sapiens
aauuucuacua

SEQ ID NO: 1296180 - RNA, 18 nt, Homo sapiens
aauuugcaaaguacugua

SEQ ID NO: 1296181 - RNA, 17 nt, Homo sapiens
aauuugggcuuggacca

SEQ ID NO: 1296182 - RNA, 19 nt, Homo sapiens
aauuuggggcagauuuuag

SEQ ID NO: 1296183 - RNA, 16 nt, Homo sapiens
aauuugugccacuuua

SEQ ID NO: 1296184 - RNA, 23 nt, Homo sapiens
aauuuuaagcuguacacuuucaa

SEQ ID NO: 1296185 - RNA, 19 nt, Homo sapiens
aauuuucaaggagaaucaa

SEQ ID NO: 1296186 - RNA, 18 nt, Homo sapiens
aauuuucgacuugacuuu

SEQ ID NO: 1296187 - RNA, 17 nt, Homo sapiens
aauuuuguucucuggga

SEQ ID NO: 1296188 - RNA, 15 nt, Homo sapiens
aauuuuuacauggag

SEQ ID NO: 1296189 - RNA, 18 nt, Homo sapiens
aauuuuuccuaugcuauu

SEQ ID NO: 1296190 - RNA, 15 nt, Homo sapiens
aauuuuugcaauaau

SEQ ID NO: 1296191 - RNA, 19 nt, Homo sapiens
aauuuuuuaaauaaaugga

SEQ ID NO: 1296192 - RNA, 14 nt, Homo sapiens
acaaaaaaugugcu

SEQ ID NO: 1296193 - RNA, 14 nt, Homo sapiens
acaaaaccacugga

SEQ ID NO: 1296194 - RNA, 16 nt, Homo sapiens
acaaaacuacaugaga

SEQ ID NO: 1296195 - RNA, 19 nt, Homo sapiens
acaaaauagacaauuugca

SEQ ID NO: 1296196 - RNA, 19 nt, Homo sapiens
acaaaauguagaauauuca

SEQ ID NO: 1296197 - RNA, 11 nt, Homo sapiens
acaaacaaaca

SEQ ID NO: 1296198 - RNA, 11 nt, Homo sapiens
acaaacuaagg

SEQ ID NO: 1296199 - RNA, 14 nt, Homo sapiens
acaaacuacuugau

SEQ ID NO: 1296200 - RNA, 21 nt, Homo sapiens
acaaacucaccaucugugcac

SEQ ID NO: 1296201 - RNA, 20 nt, Homo sapiens
acaaagaugaccauaaccac

SEQ ID NO: 1296202 - RNA, 16 nt, Homo sapiens
acaaauacauaaccuu

SEQ ID NO: 1296203 - RNA, 22 nt, Homo sapiens
acaaauacuugacucagugaua

SEQ ID NO: 1296204 - RNA, 22 nt, Homo sapiens
acaaauccaaugaaaugaguuu

SEQ ID NO: 1296205 - RNA, 13 nt, Homo sapiens
acaacagugaaaa

SEQ ID NO: 1296206 - RNA, 20 nt, Homo sapiens
acaacuauuuucagauguga

SEQ ID NO: 1296207 - RNA, 20 nt, Homo sapiens
acaacucauuccagauccca

SEQ ID NO: 1296208 - RNA, 23 nt, Homo sapiens
acaagaaaaguugaagaagauau

SEQ ID NO: 1296209 - RNA, 11 nt, Homo sapiens
acaagaagcug

SEQ ID NO: 1296210 - RNA, 15 nt, Homo sapiens
acaagaccaccacuu

SEQ ID NO: 1296211 - RNA, 20 nt, Homo sapiens
acaagacccaaguagcugcu

SEQ ID NO: 1296212 - RNA, 18 nt, Homo sapiens
acaaggauagaugcuggc

SEQ ID NO: 1296213 - RNA, 20 nt, Homo sapiens
acaagguccucugucaguca

SEQ ID NO: 1296214 - RNA, 23 nt, Homo sapiens
acaagucaccaaaagacacugca

SEQ ID NO: 1296215 - RNA, 11 nt, Homo sapiens
acaaguccagc

SEQ ID NO: 1296216 - RNA, 17 nt, Homo sapiens
acaauaaaaacauugcc

SEQ ID NO: 1296217 - RNA, 13 nt, Homo sapiens
acaauaaaagaca

SEQ ID NO: 1296218 - RNA, 21 nt, Homo sapiens
acaauaaacgguacuugucau

SEQ ID NO: 1296219 - RNA, 18 nt, Homo sapiens
acaauaacgauaaaagac

SEQ ID NO: 1296220 - RNA, 16 nt, Homo sapiens
acaauaguaauucuca

SEQ ID NO: 1296221 - RNA, 23 nt, Homo sapiens
acaauaguaauucucaggccauc

SEQ ID NO: 1296222 - RNA, 16 nt, Homo sapiens
acaauauucaaucaaa

SEQ ID NO: 1296223 - RNA, 14 nt, Homo sapiens
acaaucagcuccuu

SEQ ID NO: 1296224 - RNA, 15 nt, Homo sapiens
acaaugcugagguua

SEQ ID NO: 1296225 - RNA, 18 nt, Homo sapiens
acaaugcugagguuauga

SEQ ID NO: 1296226 - RNA, 18 nt, Homo sapiens
acaauggcagaacaggug

SEQ ID NO: 1296227 - RNA, 18 nt, Homo sapiens
acaauuauaucaguccuc

SEQ ID NO: 1296228 - RNA, 15 nt, Homo sapiens
acacaaaaaucauua

SEQ ID NO: 1296229 - RNA, 20 nt, Homo sapiens
acacaaacgggcucagcaaa

SEQ ID NO: 1296230 - RNA, 18 nt, Homo sapiens
acacaaagacauugauuc

SEQ ID NO: 1296231 - RNA, 18 nt, Homo sapiens
acacaaggauagaugcug

SEQ ID NO: 1296232 - RNA, 14 nt, Homo sapiens
acacaauaauguga

SEQ ID NO: 1296233 - RNA, 15 nt, Homo sapiens
acacacacaaaaaau

SEQ ID NO: 1296234 - RNA, 13 nt, Homo sapiens
acacaccuagcca

SEQ ID NO: 1296235 - RNA, 10 nt, Homo sapiens
acacacucca

SEQ ID NO: 1296236 - RNA, 19 nt, Homo sapiens
acacagagcaggacugcac

SEQ ID NO: 1296237 - RNA, 22 nt, Homo sapiens
acacagagcaggacugcacagc

SEQ ID NO: 1296238 - RNA, 17 nt, Homo sapiens
acacagaggggagucac

SEQ ID NO: 1296239 - RNA, 14 nt, Homo sapiens
acacagcucccaua

SEQ ID NO: 1296240 - RNA, 15 nt, Homo sapiens
acacaggaugaaggc

SEQ ID NO: 1296241 - RNA, 18 nt, Homo sapiens
acacaggccugcucucuu

SEQ ID NO: 1296242 - RNA, 16 nt, Homo sapiens
acacaugcccaugaug

SEQ ID NO: 1296243 - RNA, 14 nt, Homo sapiens
acaccaauuaaugu

SEQ ID NO: 1296244 - RNA, 23 nt, Homo sapiens
acaccacaucuaagccugaaggg

SEQ ID NO: 1296245 - RNA, 18 nt, Homo sapiens
acaccagagccucaguga

SEQ ID NO: 1296246 - RNA, 19 nt, Homo sapiens
acaccagagccucagugag

SEQ ID NO: 1296247 - RNA, 16 nt, Homo sapiens
acacccaauucaaauu

SEQ ID NO: 1296248 - RNA, 14 nt, Homo sapiens
acacccaauuccac

SEQ ID NO: 1296249 - RNA, 20 nt, Homo sapiens
acacccagcucagcauuucc

SEQ ID NO: 1296250 - RNA, 19 nt, Homo sapiens
acacccccaugacauugca

SEQ ID NO: 1296251 - RNA, 18 nt, Homo sapiens
acaccuagccagcuguca

SEQ ID NO: 1296252 - RNA, 19 nt, Homo sapiens
acaccugauuaacugaggc

SEQ ID NO: 1296253 - RNA, 14 nt, Homo sapiens
acaccugcccuaaa

SEQ ID NO: 1296254 - RNA, 13 nt, Homo sapiens
acaccuggacaau

SEQ ID NO: 1296255 - RNA, 15 nt, Homo sapiens
acaccuguaauccca

SEQ ID NO: 1296256 - RNA, 19 nt, Homo sapiens
acacgcaccugccucagga

SEQ ID NO: 1296257 - RNA, 14 nt, Homo sapiens
acacgcgugcacac

SEQ ID NO: 1296258 - RNA, 20 nt, Homo sapiens
acacucaagaagcaggcuac

SEQ ID NO: 1296259 - RNA, 12 nt, Homo sapiens
acacugaugaua

SEQ ID NO: 1296260 - RNA, 18 nt, Homo sapiens
acacuggcguuacugcuu

SEQ ID NO: 1296261 - RNA, 22 nt, Homo sapiens
acacugggcugcagagacugga

SEQ ID NO: 1296262 - RNA, 15 nt, Homo sapiens
acacuucccaacuua

SEQ ID NO: 1296263 - RNA, 20 nt, Homo sapiens
acagagcaagacucugucuc

SEQ ID NO: 1296264 - RNA, 18 nt, Homo sapiens
acagagcaggacugcaca

SEQ ID NO: 1296265 - RNA, 15 nt, Homo sapiens
acagagucucacucu

SEQ ID NO: 1296266 - RNA, 13 nt, Homo sapiens
acagagugcauug

SEQ ID NO: 1296267 - RNA, 21 nt, Homo sapiens
acagaugaguuaucuaagaau

SEQ ID NO: 1296268 - RNA, 18 nt, Homo sapiens
acagaugccacacaagga

SEQ ID NO: 1296269 - RNA, 16 nt, Homo sapiens
acagauugucuuauua

SEQ ID NO: 1296270 - RNA, 13 nt, Homo sapiens
acagcacagccaa

SEQ ID NO: 1296271 - RNA, 15 nt, Homo sapiens
acagcagccuggggc

SEQ ID NO: 1296272 - RNA, 23 nt, Homo sapiens
acagccagugggagauguuagac

SEQ ID NO: 1296273 - RNA, 21 nt, Homo sapiens
acagccuuucaauucauauac

SEQ ID NO: 1296274 - RNA, 19 nt, Homo sapiens
acagcuaacacacagcucc

SEQ ID NO: 1296275 - RNA, 12 nt, Homo sapiens
acagcuacucuc

SEQ ID NO: 1296276 - RNA, 17 nt, Homo sapiens
acagcucaggaucucuu

SEQ ID NO: 1296277 - RNA, 16 nt, Homo sapiens
acagcuccuucugucc

SEQ ID NO: 1296278 - RNA, 20 nt, Homo sapiens
acagcucgggcccucuguga

SEQ ID NO: 1296279 - RNA, 14 nt, Homo sapiens
acagcucuucucca

SEQ ID NO: 1296280 - RNA, 21 nt, Homo sapiens
acagcugguauggccuuaccu

SEQ ID NO: 1296281 - RNA, 20 nt, Homo sapiens
acagcuuccccucucuccuc

SEQ ID NO: 1296282 - RNA, 19 nt, Homo sapiens
acaggaaucgguggucucc

SEQ ID NO: 1296283 - RNA, 15 nt, Homo sapiens
acaggagaccuggca

SEQ ID NO: 1296284 - RNA, 23 nt, Homo sapiens
acaggaguguccucuucccucuc

SEQ ID NO: 1296285 - RNA, 20 nt, Homo sapiens
acaggauuccagaaugauca

SEQ ID NO: 1296286 - RNA, 13 nt, Homo sapiens
acaggcacccacc

SEQ ID NO: 1296287 - RNA, 17 nt, Homo sapiens
acaggcaguuucagaga

SEQ ID NO: 1296288 - RNA, 21 nt, Homo sapiens
acaggccauugugaaccaaug

SEQ ID NO: 1296289 - RNA, 15 nt, Homo sapiens
acagggaggugaccc

SEQ ID NO: 1296290 - RNA, 15 nt, Homo sapiens
acagggcaccugcca

SEQ ID NO: 1296291 - RNA, 13 nt, Homo sapiens
acaggugugaacc

SEQ ID NO: 1296292 - RNA, 23 nt, Homo sapiens
acagguguuuuuccacaagugcc

SEQ ID NO: 1296293 - RNA, 15 nt, Homo sapiens
acagguucugagaua

SEQ ID NO: 1296294 - RNA, 18 nt, Homo sapiens
acagguugggaugggaua

SEQ ID NO: 1296295 - RNA, 14 nt, Homo sapiens
acaguaaaauccac

SEQ ID NO: 1296296 - RNA, 15 nt, Homo sapiens
acaguauauguugca

SEQ ID NO: 1296297 - RNA, 22 nt, Homo sapiens
acagucacgccugaaacuuuga

SEQ ID NO: 1296298 - RNA, 12 nt, Homo sapiens
acagucagcucu

SEQ ID NO: 1296299 - RNA, 23 nt, Homo sapiens
acagucauuaauuuucaacucaa

SEQ ID NO: 1296300 - RNA, 14 nt, Homo sapiens
acaguccacccacc

SEQ ID NO: 1296301 - RNA, 20 nt, Homo sapiens
acaguccucauuuacuggau

SEQ ID NO: 1296302 - RNA, 14 nt, Homo sapiens
acagucucacuuug

SEQ ID NO: 1296303 - RNA, 18 nt, Homo sapiens
acagucuuccauuugcaa

SEQ ID NO: 1296304 - RNA, 18 nt, Homo sapiens
acagugaaucagucccau

SEQ ID NO: 1296305 - RNA, 14 nt, Homo sapiens
acaguguugcccag

SEQ ID NO: 1296306 - RNA, 23 nt, Homo sapiens
acaguguuggagguuaaggcaua

SEQ ID NO: 1296307 - RNA, 22 nt, Homo sapiens
acaguucaauucucauuuguca

SEQ ID NO: 1296308 - RNA, 23 nt, Homo sapiens
acauacauugauucaugucucac

SEQ ID NO: 1296309 - RNA, 23 nt, Homo sapiens
acauagaaauggaaauuuugcua

SEQ ID NO: 1296310 - RNA, 15 nt, Homo sapiens
acauagaagagccaa

SEQ ID NO: 1296311 - RNA, 14 nt, Homo sapiens
acauagcaaauuaa

SEQ ID NO: 1296312 - RNA, 15 nt, Homo sapiens
acauagcgaauacaa

SEQ ID NO: 1296313 - RNA, 19 nt, Homo sapiens
acauagugaaauaaauucu

SEQ ID NO: 1296314 - RNA, 18 nt, Homo sapiens
acauauauauuaauacug

SEQ ID NO: 1296315 - RNA, 21 nt, Homo sapiens
acauaucuguguauuaucuca

SEQ ID NO: 1296316 - RNA, 18 nt, Homo sapiens
acauauuuagaccaauau

SEQ ID NO: 1296317 - RNA, 22 nt, Homo sapiens
acauauuucaugggaauauuca

SEQ ID NO: 1296318 - RNA, 22 nt, Homo sapiens
acaucaaggcucuuccguucca

SEQ ID NO: 1296319 - RNA, 16 nt, Homo sapiens
acaucagaacagacaa

SEQ ID NO: 1296320 - RNA, 23 nt, Homo sapiens
acauccugugccuccaucagcua

SEQ ID NO: 1296321 - RNA, 18 nt, Homo sapiens
acaucucugcuugaguca

SEQ ID NO: 1296322 - RNA, 22 nt, Homo sapiens
acaucucugcuuucacucuuua

SEQ ID NO: 1296323 - RNA, 22 nt, Homo sapiens
acaucuggccuugaaaccaccu

SEQ ID NO: 1296324 - RNA, 15 nt, Homo sapiens
acaucugugucuugu

SEQ ID NO: 1296325 - RNA, 21 nt, Homo sapiens
acaucuugaauacucugcccu

SEQ ID NO: 1296326 - RNA, 18 nt, Homo sapiens
acaucuugcucugcugac

SEQ ID NO: 1296327 - RNA, 13 nt, Homo sapiens
acaucuuucacau

SEQ ID NO: 1296328 - RNA, 14 nt, Homo sapiens
acaucuuucacauu

SEQ ID NO: 1296329 - RNA, 19 nt, Homo sapiens
acaugagaacaaacagauc

SEQ ID NO: 1296330 - RNA, 22 nt, Homo sapiens
acaugauuccuuccuguucuga

SEQ ID NO: 1296331 - RNA, 13 nt, Homo sapiens
acaugcaccuacc

SEQ ID NO: 1296332 - RNA, 15 nt, Homo sapiens
acaugcaccuaccca

SEQ ID NO: 1296333 - RNA, 15 nt, Homo sapiens
acaugcacgugugug

SEQ ID NO: 1296334 - RNA, 14 nt, Homo sapiens
acaugcacucagcu

SEQ ID NO: 1296335 - RNA, 10 nt, Homo sapiens
acaugcaguu

SEQ ID NO: 1296336 - RNA, 16 nt, Homo sapiens
acaugccaagcacugu

SEQ ID NO: 1296337 - RNA, 14 nt, Homo sapiens
acaugccacaagga

SEQ ID NO: 1296338 - RNA, 18 nt, Homo sapiens
acaugcuucaauaguuca

SEQ ID NO: 1296339 - RNA, 22 nt, Homo sapiens
acauggacaugcuucagugcug

SEQ ID NO: 1296340 - RNA, 21 nt, Homo sapiens
acauggucuaauuauuuacuc

SEQ ID NO: 1296341 - RNA, 12 nt, Homo sapiens
acaugugcacau

SEQ ID NO: 1296342 - RNA, 22 nt, Homo sapiens
acauguuggaggagagagccuu

SEQ ID NO: 1296343 - RNA, 20 nt, Homo sapiens
acauucaggagcuuccuguc

SEQ ID NO: 1296344 - RNA, 20 nt, Homo sapiens
acauuccaaauaauuccaca

SEQ ID NO: 1296345 - RNA, 23 nt, Homo sapiens
acauucugcaagcacaucugcau

SEQ ID NO: 1296346 - RNA, 13 nt, Homo sapiens
acauugagguucc

SEQ ID NO: 1296347 - RNA, 15 nt, Homo sapiens
acauugauaauucaa

SEQ ID NO: 1296348 - RNA, 17 nt, Homo sapiens
acauuggcaccuaaucc

SEQ ID NO: 1296349 - RNA, 20 nt, Homo sapiens
acauuguuugucugucuuca

SEQ ID NO: 1296350 - RNA, 20 nt, Homo sapiens
acauuuagaugcacuaccau

SEQ ID NO: 1296351 - RNA, 16 nt, Homo sapiens
acauuuauuuuucuca

SEQ ID NO: 1296352 - RNA, 13 nt, Homo sapiens
acauuucaccaug

SEQ ID NO: 1296353 - RNA, 15 nt, Homo sapiens
acauuugucagugau

SEQ ID NO: 1296354 - RNA, 16 nt, Homo sapiens
acauuuucauugauga

SEQ ID NO: 1296355 - RNA, 19 nt, Homo sapiens
acauuuuuauaaaaaugag

SEQ ID NO: 1296356 - RNA, 23 nt, Homo sapiens
acauuuuuauaaaaaugagugcu

SEQ ID NO: 1296357 - RNA, 23 nt, Homo sapiens
acauuuuuuuuaacuacuauauu

SEQ ID NO: 1296358 - RNA, 17 nt, Homo sapiens
accaaaauuuuguccca

SEQ ID NO: 1296359 - RNA, 18 nt, Homo sapiens
accaaagcuuuauuucaa

SEQ ID NO: 1296360 - RNA, 11 nt, Homo sapiens
accaaccuggg

SEQ ID NO: 1296361 - RNA, 21 nt, Homo sapiens
accaaccuguuucuaccuaua

SEQ ID NO: 1296362 - RNA, 14 nt, Homo sapiens
accaagcacagcag

SEQ ID NO: 1296363 - RNA, 18 nt, Homo sapiens
accaagcaggaagcucag

SEQ ID NO: 1296364 - RNA, 15 nt, Homo sapiens
accaaggacugagca

SEQ ID NO: 1296365 - RNA, 14 nt, Homo sapiens
accaaucaaauguc

SEQ ID NO: 1296366 - RNA, 22 nt, Homo sapiens
accaaugccaaaaaaagacagg

SEQ ID NO: 1296367 - RNA, 18 nt, Homo sapiens
accaauuugcaccaguuu

SEQ ID NO: 1296368 - RNA, 17 nt, Homo sapiens
accacagguucaugcca

SEQ ID NO: 1296369 - RNA, 14 nt, Homo sapiens
accaccaagccaag

SEQ ID NO: 1296370 - RNA, 10 nt, Homo sapiens
accaccaguu

SEQ ID NO: 1296371 - RNA, 21 nt, Homo sapiens
accaccccaacaaaccaucca

SEQ ID NO: 1296372 - RNA, 13 nt, Homo sapiens
accaccucaccag

SEQ ID NO: 1296373 - RNA, 14 nt, Homo sapiens
accacucaaaaaug

SEQ ID NO: 1296374 - RNA, 14 nt, Homo sapiens
accacugaagggaa

SEQ ID NO: 1296375 - RNA, 18 nt, Homo sapiens
accacuuuggagcacugu

SEQ ID NO: 1296376 - RNA, 15 nt, Homo sapiens
accagaacaguauga

SEQ ID NO: 1296377 - RNA, 19 nt, Homo sapiens
accagagauaauaugagaa

SEQ ID NO: 1296378 - RNA, 14 nt, Homo sapiens
accagcagcgccuu

SEQ ID NO: 1296379 - RNA, 15 nt, Homo sapiens
accagcaguacucag

SEQ ID NO: 1296380 - RNA, 17 nt, Homo sapiens
accagccuaagaagcuc

SEQ ID NO: 1296381 - RNA, 22 nt, Homo sapiens
accagccuggccaacaugguga

SEQ ID NO: 1296382 - RNA, 20 nt, Homo sapiens
accaggauagagacuggaac

SEQ ID NO: 1296383 - RNA, 21 nt, Homo sapiens
accaggauggcagagagccag

SEQ ID NO: 1296384 - RNA, 19 nt, Homo sapiens
accagugaauuuuugcaau

SEQ ID NO: 1296385 - RNA, 22 nt, Homo sapiens
accagugaauuuuugcaauaau

SEQ ID NO: 1296386 - RNA, 20 nt, Homo sapiens
accagugaguugggaguuau

SEQ ID NO: 1296387 - RNA, 19 nt, Homo sapiens
accaguuuaaccugaugca

SEQ ID NO: 1296388 - RNA, 19 nt, Homo sapiens
agguccucugucagucaca

SEQ ID NO: 1296389 - RNA, 16 nt, Homo sapiens
agguccuggugguauu

SEQ ID NO: 1296390 - RNA, 19 nt, Homo sapiens
aggucuccaaacugauuaa

SEQ ID NO: 1296391 - RNA, 19 nt, Homo sapiens
aggugaagcaccaagcuca

SEQ ID NO: 1296392 - RNA, 14 nt, Homo sapiens
aggugagcccucau

SEQ ID NO: 1296393 - RNA, 16 nt, Homo sapiens
aggugauccacccacc

SEQ ID NO: 1296394 - RNA, 20 nt, Homo sapiens
aggugauccacccaccucag

SEQ ID NO: 1296395 - RNA, 13 nt, Homo sapiens
aggugcagccaga

SEQ ID NO: 1296396 - RNA, 15 nt, Homo sapiens
aggugcagcuccuca

SEQ ID NO: 1296397 - RNA, 18 nt, Homo sapiens
aggugcauagcaagugaa

SEQ ID NO: 1296398 - RNA, 19 nt, Homo sapiens
aggugcauagcaagugaaa

SEQ ID NO: 1296399 - RNA, 14 nt, Homo sapiens
aggugccugccaua

SEQ ID NO: 1296400 - RNA, 16 nt, Homo sapiens
aggugcgcaguggcau

SEQ ID NO: 1296401 - RNA, 17 nt, Homo sapiens
agguggaaaaacugaga

SEQ ID NO: 1296402 - RNA, 20 nt, Homo sapiens
aggugggccagucuguggau

SEQ ID NO: 1296403 - RNA, 14 nt, Homo sapiens
agguggggcagcuu

SEQ ID NO: 1296404 - RNA, 18 nt, Homo sapiens
aguuguuuggaugauuaa

SEQ ID NO: 1296405 - RNA, 16 nt, Homo sapiens
aguuuacaaucagcca

SEQ ID NO: 1296406 - RNA, 21 nt, Homo sapiens
aguuuagggaaaaaaaacagg

SEQ ID NO: 1296407 - RNA, 15 nt, Homo sapiens
aguuuauacuucucu

SEQ ID NO: 1296408 - RNA, 21 nt, Homo sapiens
aguuucauguacaagaugaag

SEQ ID NO: 1296409 - RNA, 14 nt, Homo sapiens
aguuucuuuaccua

SEQ ID NO: 1296410 - RNA, 13 nt, Homo sapiens
aguuuggagacaa

SEQ ID NO: 1296411 - RNA, 18 nt, Homo sapiens
aguuugucauauacugcu

SEQ ID NO: 1296412 - RNA, 19 nt, Homo sapiens
aguuuguggcaucuugcca

SEQ ID NO: 1296413 - RNA, 13 nt, Homo sapiens
aguuuucaaguca

SEQ ID NO: 1296414 - RNA, 15 nt, Homo sapiens
aguuuucagcuuuaa

SEQ ID NO: 1296415 - RNA, 21 nt, Homo sapiens
aguuuucuuuccuccuuuccu

SEQ ID NO: 1296416 - RNA, 12 nt, Homo sapiens
auaaaaacccaa

SEQ ID NO: 1296417 - RNA, 16 nt, Homo sapiens
auaaaaaccuuccaaa

SEQ ID NO: 1296418 - RNA, 15 nt, Homo sapiens
auaaaaaguaaaaac

SEQ ID NO: 1296419 - RNA, 15 nt, Homo sapiens
auaaaaauaaaucag

SEQ ID NO: 1296420 - RNA, 16 nt, Homo sapiens
auaaaacaggucaaua

SEQ ID NO: 1296421 - RNA, 17 nt, Homo sapiens
auaaaaccccaucucua

SEQ ID NO: 1296422 - RNA, 17 nt, Homo sapiens
auaaaaggaaucuuccu

SEQ ID NO: 1296423 - RNA, 20 nt, Homo sapiens
auaaaauuaugccauagcaa

SEQ ID NO: 1296424 - RNA, 19 nt, Homo sapiens
auaaagacaaucacugcca

SEQ ID NO: 1296425 - RNA, 14 nt, Homo sapiens
auaaagcagcucag

SEQ ID NO: 1296426 - RNA, 19 nt, Homo sapiens
auaaauaaacuguugcucg

SEQ ID NO: 1296427 - RNA, 14 nt, Homo sapiens
auaaauaugcucag

SEQ ID NO: 1296428 - RNA, 13 nt, Homo sapiens
auaaaucagucaa

SEQ ID NO: 1296429 - RNA, 13 nt, Homo sapiens
auaaaugaacuga

SEQ ID NO: 1296430 - RNA, 15 nt, Homo sapiens
auaaauucacuuuca

SEQ ID NO: 1296431 - RNA, 13 nt, Homo sapiens
auaaauugccaua

SEQ ID NO: 1296432 - RNA, 14 nt, Homo sapiens
auaaauuugguucu

SEQ ID NO: 1296433 - RNA, 12 nt, Homo sapiens
auaacaaugaaa

SEQ ID NO: 1296434 - RNA, 18 nt, Homo sapiens
auaacauuuaauuuagau

SEQ ID NO: 1296435 - RNA, 18 nt, Homo sapiens
auaacuuuuuaaagugac

SEQ ID NO: 1296436 - RNA, 18 nt, Homo sapiens
auaagaaagaucaaagac

SEQ ID NO: 1296437 - RNA, 21 nt, Homo sapiens
auaagagggcacacacugugu

SEQ ID NO: 1296438 - RNA, 15 nt, Homo sapiens
auaagccaauauucc

SEQ ID NO: 1296439 - RNA, 17 nt, Homo sapiens
auaaggggucaaaauuu

SEQ ID NO: 1296440 - RNA, 23 nt, Homo sapiens
auaaggggucaaaauuugcugcc

SEQ ID NO: 1296441 - RNA, 19 nt, Homo sapiens
auaagguaaaaugccauga

SEQ ID NO: 1296442 - RNA, 16 nt, Homo sapiens
auaagugcuguauaaa

SEQ ID NO: 1296443 - RNA, 22 nt, Homo sapiens
auaaguuacaucuacaaacagg

SEQ ID NO: 1296444 - RNA, 13 nt, Homo sapiens
auaauaacuggga

SEQ ID NO: 1296445 - RNA, 12 nt, Homo sapiens
auaauacuauau

SEQ ID NO: 1296446 - RNA, 12 nt, Homo sapiens
auaauacuguau

SEQ ID NO: 1296447 - RNA, 16 nt, Homo sapiens
auaauauauuuucaag

SEQ ID NO: 1296448 - RNA, 24 nt, Homo sapiens
auaauauccagccucccacaagaa

SEQ ID NO: 1296449 - RNA, 23 nt, Homo sapiens
auaauauuaaggaagacaaugug

SEQ ID NO: 1296450 - RNA, 19 nt, Homo sapiens
auaauauuuuacauacacu

SEQ ID NO: 1296451 - RNA, 23 nt, Homo sapiens
auaauccuauuacauaguuugaa

SEQ ID NO: 1296452 - RNA, 15 nt, Homo sapiens
auaaucuugcucaca

SEQ ID NO: 1296453 - RNA, 14 nt, Homo sapiens
auaauuagcaguau

SEQ ID NO: 1296454 - RNA, 15 nt, Homo sapiens
auaauuaguuccuca

SEQ ID NO: 1296455 - RNA, 16 nt, Homo sapiens
auaauuauuuauguga

SEQ ID NO: 1296456 - RNA, 17 nt, Homo sapiens
auaauuuacaugcaaua

SEQ ID NO: 1296457 - RNA, 22 nt, Homo sapiens
auacaagauauuauguauaaaa

SEQ ID NO: 1296458 - RNA, 18 nt, Homo sapiens
auacaaggggguaacuca

SEQ ID NO: 1296459 - RNA, 22 nt, Homo sapiens
auacacacacacgcgugcacac

SEQ ID NO: 1296460 - RNA, 12 nt, Homo sapiens
auacagcuuucu

SEQ ID NO: 1296461 - RNA, 19 nt, Homo sapiens
auacaggaaaaaugaaaau

SEQ ID NO: 1296462 - RNA, 18 nt, Homo sapiens
auacaguacaggcagcac

SEQ ID NO: 1296463 - RNA, 14 nt, Homo sapiens
auacaguaucucag

SEQ ID NO: 1296464 - RNA, 15 nt, Homo sapiens
auacaguaucucagg

SEQ ID NO: 1296465 - RNA, 16 nt, Homo sapiens
auacaguaucucaggg

SEQ ID NO: 1296466 - RNA, 15 nt, Homo sapiens
auacagucuuccaca

SEQ ID NO: 1296467 - RNA, 21 nt, Homo sapiens
auacagucuuccacaaagaaa

SEQ ID NO: 1296468 - RNA, 21 nt, Homo sapiens
auacagugauauacuuacuca

SEQ ID NO: 1296469 - RNA, 12 nt, Homo sapiens
auacaucaaaga

SEQ ID NO: 1296470 - RNA, 14 nt, Homo sapiens
auacauccuaguga

SEQ ID NO: 1296471 - RNA, 20 nt, Homo sapiens
auacauugauucaugucuca

SEQ ID NO: 1296472 - RNA, 20 nt, Homo sapiens
auaccaacccacuggcacau

SEQ ID NO: 1296473 - RNA, 16 nt, Homo sapiens
auaccagaauguugcu

SEQ ID NO: 1296474 - RNA, 22 nt, Homo sapiens
auaccauuaaauaaugcauaau

SEQ ID NO: 1296475 - RNA, 23 nt, Homo sapiens
auaccgggaacaugaagccaggu

SEQ ID NO: 1296476 - RNA, 17 nt, Homo sapiens
auacgcuuuuaaugaaa

SEQ ID NO: 1296477 - RNA, 14 nt, Homo sapiens
auacgguaugauau

SEQ ID NO: 1296478 - RNA, 17 nt, Homo sapiens
auacuaucuacucuccu

SEQ ID NO: 1296479 - RNA, 14 nt, Homo sapiens
auacuccacacaua

SEQ ID NO: 1296480 - RNA, 23 nt, Homo sapiens
auacucuagaugaaguuuuacau

SEQ ID NO: 1296481 - RNA, 17 nt, Homo sapiens
auacugaggcacacaga

SEQ ID NO: 1296482 - RNA, 19 nt, Homo sapiens
auacugcucaucauuccuu

SEQ ID NO: 1296483 - RNA, 21 nt, Homo sapiens
auacugcucaucauuccuuga

SEQ ID NO: 1296484 - RNA, 20 nt, Homo sapiens
auacuuaacaaauacauuca

SEQ ID NO: 1296485 - RNA, 23 nt, Homo sapiens
auacuuccuuaugcuucuuucaa

SEQ ID NO: 1296486 - RNA, 22 nt, Homo sapiens
auacuugauuuaaucaccacuc

SEQ ID NO: 1296487 - RNA, 18 nt, Homo sapiens
auacuuuaauguuuuaac

SEQ ID NO: 1296488 - RNA, 13 nt, Homo sapiens
auacuuugcauau

SEQ ID NO: 1296489 - RNA, 20 nt, Homo sapiens
auagacaagagaaugcuguc

SEQ ID NO: 1296490 - RNA, 16 nt, Homo sapiens
auagacagaaugauuu

SEQ ID NO: 1296491 - RNA, 15 nt, Homo sapiens
auagaguauaugcac

SEQ ID NO: 1296492 - RNA, 20 nt, Homo sapiens
auagauggucacgcaccugg

SEQ ID NO: 1296493 - RNA, 16 nt, Homo sapiens
auagauguuuccuugc

SEQ ID NO: 1296494 - RNA, 23 nt, Homo sapiens
auagcaccccuacucacauacac

SEQ ID NO: 1296495 - RNA, 22 nt, Homo sapiens
auagcagcugcuacuagcucuu

SEQ ID NO: 1296496 - RNA, 20 nt, Homo sapiens
auagccaggagcgcaucuca

SEQ ID NO: 1296497 - RNA, 17 nt, Homo sapiens
auagccuacguuaaccc

SEQ ID NO: 1296498 - RNA, 18 nt, Homo sapiens
auaggaagccacaaauuu

SEQ ID NO: 1296499 - RNA, 21 nt, Homo sapiens
auaggauggcuggcucugcac

SEQ ID NO: 1296500 - RNA, 14 nt, Homo sapiens
auaggcccagugag

SEQ ID NO: 1296501 - RNA, 21 nt, Homo sapiens
auagucucauucugucaccca

SEQ ID NO: 1296502 - RNA, 23 nt, Homo sapiens
auaguuuuucagucuauggguuu

SEQ ID NO: 1296503 - RNA, 19 nt, Homo sapiens
auauaaaguaguccuguga

SEQ ID NO: 1296504 - RNA, 20 nt, Homo sapiens
auauaauaugcacacagugc

SEQ ID NO: 1296505 - RNA, 16 nt, Homo sapiens
auauacaauaauguaa

SEQ ID NO: 1296506 - RNA, 15 nt, Homo sapiens
auauagaacagugcu

SEQ ID NO: 1296507 - RNA, 17 nt, Homo sapiens
auauaggugugugagac

SEQ ID NO: 1296508 - RNA, 14 nt, Homo sapiens
auauauacuauuaa

SEQ ID NO: 1296509 - RNA, 12 nt, Homo sapiens
auauauaugcac

SEQ ID NO: 1296510 - RNA, 20 nt, Homo sapiens
auauauauguauguaugugu

SEQ ID NO: 1296511 - RNA, 22 nt, Homo sapiens
auauaucccauggguuaucugu

SEQ ID NO: 1296512 - RNA, 16 nt, Homo sapiens
auauaugcacuaugua

SEQ ID NO: 1296513 - RNA, 14 nt, Homo sapiens
auauauuauucuca

SEQ ID NO: 1296514 - RNA, 20 nt, Homo sapiens
auauauuauucucauuuagu

SEQ ID NO: 1296515 - RNA, 13 nt, Homo sapiens
auauauuuccuca

SEQ ID NO: 1296516 - RNA, 14 nt, Homo sapiens
auauauuuuuuaga

SEQ ID NO: 1296517 - RNA, 13 nt, Homo sapiens
auaucagaacugu

SEQ ID NO: 1296518 - RNA, 19 nt, Homo sapiens
auaucauuuauccuuacau

SEQ ID NO: 1296519 - RNA, 21 nt, Homo sapiens
auauuuauucauuauuuguca

SEQ ID NO: 1296520 - RNA, 14 nt, Homo sapiens
auauuucuuagcaa

SEQ ID NO: 1296521 - RNA, 22 nt, Homo sapiens
auauuuguucuaaaauaaguca

SEQ ID NO: 1296522 - RNA, 23 nt, Homo sapiens
auauuuuaagaauuucacaagcu

SEQ ID NO: 1296523 - RNA, 16 nt, Homo sapiens
auauuuuacauacacu

SEQ ID NO: 1296524 - RNA, 14 nt, Homo sapiens
auauuuuccugcca

SEQ ID NO: 1296525 - RNA, 11 nt, Homo sapiens
auauuuugcua

SEQ ID NO: 1296526 - RNA, 15 nt, Homo sapiens
auauuuuugugcaca

SEQ ID NO: 1296527 - RNA, 17 nt, Homo sapiens
auauuuuugugcacauu

SEQ ID NO: 1296528 - RNA, 19 nt, Homo sapiens
aucaaaccacuguuauuaa

SEQ ID NO: 1296529 - RNA, 13 nt, Homo sapiens
aucaacagcauuu

SEQ ID NO: 1296530 - RNA, 13 nt, Homo sapiens
aucaagacuggaa

SEQ ID NO: 1296531 - RNA, 19 nt, Homo sapiens
aucaauagcaccccuacuc

SEQ ID NO: 1296532 - RNA, 23 nt, Homo sapiens
aucaaugauggcaccuacuuuug

SEQ ID NO: 1296533 - RNA, 12 nt, Homo sapiens
aucacagaugag

SEQ ID NO: 1296534 - RNA, 16 nt, Homo sapiens
aucacagccucugaaa

SEQ ID NO: 1296535 - RNA, 21 nt, Homo sapiens
aucacagcuaacaauugugaa

SEQ ID NO: 1296536 - RNA, 19 nt, Homo sapiens
aucacauccuuauccuuca

SEQ ID NO: 1296537 - RNA, 11 nt, Homo sapiens
aucaccagaca

SEQ ID NO: 1296538 - RNA, 17 nt, Homo sapiens
aucaccauguauuuugu

SEQ ID NO: 1296539 - RNA, 19 nt, Homo sapiens
aucaccguuucugcucugu

SEQ ID NO: 1296540 - RNA, 14 nt, Homo sapiens
aucagaaacucaaa

SEQ ID NO: 1296541 - RNA, 17 nt, Homo sapiens
aucagaaggacauggug

SEQ ID NO: 1296542 - RNA, 19 nt, Homo sapiens
aucagaauagccacauuug

SEQ ID NO: 1296543 - RNA, 15 nt, Homo sapiens
aucagagacuaugua

SEQ ID NO: 1296544 - RNA, 15 nt, Homo sapiens
aucagaucugacaug

SEQ ID NO: 1296545 - RNA, 13 nt, Homo sapiens
aucagaucugucu

SEQ ID NO: 1296546 - RNA, 18 nt, Homo sapiens
aucagauguuuuggucaa

SEQ ID NO: 1296547 - RNA, 22 nt, Homo sapiens
aucagauugcaugugacucuga

SEQ ID NO: 1296548 - RNA, 23 nt, Homo sapiens
aucagcaacaaccagcaucccuu

SEQ ID NO: 1296549 - RNA, 18 nt, Homo sapiens
aucagcaccccaguggag

SEQ ID NO: 1296550 - RNA, 14 nt, Homo sapiens
aucagcagcucuuu

SEQ ID NO: 1296551 - RNA, 21 nt, Homo sapiens
aucagccugggcaaugugaua

SEQ ID NO: 1296552 - RNA, 19 nt, Homo sapiens
aucaggaauauuuuccaaa

SEQ ID NO: 1296553 - RNA, 15 nt, Homo sapiens
aucaggacccagagg

SEQ ID NO: 1296554 - RNA, 16 nt, Homo sapiens
aucaggaccuccaagc

SEQ ID NO: 1296555 - RNA, 21 nt, Homo sapiens
aucaggugcauagcaagugaa

SEQ ID NO: 1296556 - RNA, 13 nt, Homo sapiens
aucaguccugucc

SEQ ID NO: 1296557 - RNA, 21 nt, Homo sapiens
aucagugaagccaaagggacu

SEQ ID NO: 1296558 - RNA, 19 nt, Homo sapiens
aucagugaauaaaccauca

SEQ ID NO: 1296559 - RNA, 16 nt, Homo sapiens
aucaguguuguugcuc

SEQ ID NO: 1296560 - RNA, 15 nt, Homo sapiens
aucauacccuucccu

SEQ ID NO: 1296561 - RNA, 17 nt, Homo sapiens
aucaucaguggagccau

SEQ ID NO: 1296562 - RNA, 13 nt, Homo sapiens
aucaucauucuca

SEQ ID NO: 1296563 - RNA, 12 nt, Homo sapiens
aucaucuuguuc

SEQ ID NO: 1296564 - RNA, 13 nt, Homo sapiens
aucauggccucuu

SEQ ID NO: 1296565 - RNA, 16 nt, Homo sapiens
aucauucccucucauc

SEQ ID NO: 1296566 - RNA, 21 nt, Homo sapiens
aucauugcaggagccauauga

SEQ ID NO: 1296567 - RNA, 14 nt, Homo sapiens
auccaaaaguucaa

SEQ ID NO: 1296568 - RNA, 14 nt, Homo sapiens
auccacaugggagc

SEQ ID NO: 1296569 - RNA, 15 nt, Homo sapiens
auccacccaccucag

SEQ ID NO: 1296570 - RNA, 12 nt, Homo sapiens
auccaccugccu

SEQ ID NO: 1296571 - RNA, 17 nt, Homo sapiens
auccagaagagaauuag

SEQ ID NO: 1296572 - RNA, 18 nt, Homo sapiens
auccagccucacuucuag

SEQ ID NO: 1296573 - RNA, 20 nt, Homo sapiens
auccaggccugccaagguga

SEQ ID NO: 1296574 - RNA, 16 nt, Homo sapiens
auccaggccugggaau

SEQ ID NO: 1296575 - RNA, 16 nt, Homo sapiens
auccagucucccaacu

SEQ ID NO: 1296576 - RNA, 12 nt, Homo sapiens
auccagugacaa

SEQ ID NO: 1296577 - RNA, 13 nt, Homo sapiens
auccauucccaag

SEQ ID NO: 1296578 - RNA, 21 nt, Homo sapiens
auccauucccaagaugccuga

SEQ ID NO: 1296579 - RNA, 22 nt, Homo sapiens
auccauucccaagaugccugau

SEQ ID NO: 1296580 - RNA, 22 nt, Homo sapiens
auccauugucucuucaugucua

SEQ ID NO: 1296581 - RNA, 16 nt, Homo sapiens
aucccaaacugugaug

SEQ ID NO: 1296582 - RNA, 17 nt, Homo sapiens
aucccagcuacucgaga

SEQ ID NO: 1296583 - RNA, 17 nt, Homo sapiens
aucccauuugcccuccu

SEQ ID NO: 1296584 - RNA, 21 nt, Homo sapiens
aucccggcugucaaggggugu

SEQ ID NO: 1296585 - RNA, 17 nt, Homo sapiens
aucccuaaugcugcaga

SEQ ID NO: 1296586 - RNA, 19 nt, Homo sapiens
aucccucuccaacugccua

SEQ ID NO: 1296587 - RNA, 14 nt, Homo sapiens
aucccucuguucac

SEQ ID NO: 1296588 - RNA, 16 nt, Homo sapiens
aucccuuaccucggug

SEQ ID NO: 1296589 - RNA, 15 nt, Homo sapiens
auccuagcacuuugg

SEQ ID NO: 1296590 - RNA, 22 nt, Homo sapiens
auccuccacugacuuccuccca

SEQ ID NO: 1296591 - RNA, 16 nt, Homo sapiens
auccugagucaugugu

SEQ ID NO: 1296592 - RNA, 18 nt, Homo sapiens
auccugcuguucuagcac

SEQ ID NO: 1296593 - RNA, 22 nt, Homo sapiens
auccugggggacccaauguagg

SEQ ID NO: 1296594 - RNA, 22 nt, Homo sapiens
auccuuaaugguguucucucuc

SEQ ID NO: 1296595 - RNA, 17 nt, Homo sapiens
auccuuugccucaagga

SEQ ID NO: 1296596 - RNA, 16 nt, Homo sapiens
aucgaaucuacuaauu

SEQ ID NO: 1296597 - RNA, 21 nt, Homo sapiens
aucgacuuguuuuugcacaug

SEQ ID NO: 1296598 - RNA, 14 nt, Homo sapiens
aucgcaguguucaa

SEQ ID NO: 1296599 - RNA, 18 nt, Homo sapiens
aucgucauuugcugugaa

SEQ ID NO: 1296600 - RNA, 22 nt, Homo sapiens
aucguuuuggggggaaugcucc

SEQ ID NO: 1296601 - RNA, 16 nt, Homo sapiens
aucuaauaugauagcg

SEQ ID NO: 1296602 - RNA, 14 nt, Homo sapiens
aucuaugagcuucu

SEQ ID NO: 1296603 - RNA, 14 nt, Homo sapiens
aucuauucucucca

SEQ ID NO: 1296604 - RNA, 15 nt, Homo sapiens
aucucaaacuacugg

SEQ ID NO: 1296605 - RNA, 21 nt, Homo sapiens
aucucaaacuacuggcaauuu

SEQ ID NO: 1296606 - RNA, 22 nt, Homo sapiens
aucucaaacuacuggcaauuug

SEQ ID NO: 1296607 - RNA, 16 nt, Homo sapiens
aucucaaagaaggcau

SEQ ID NO: 1296608 - RNA, 17 nt, Homo sapiens
aucucauccaucacaga

SEQ ID NO: 1296609 - RNA, 22 nt, Homo sapiens
aucucauuggacccuuccaugg

SEQ ID NO: 1296610 - RNA, 15 nt, Homo sapiens
aucuccaagaccaga

SEQ ID NO: 1296611 - RNA, 18 nt, Homo sapiens
aucuccaagaccagagau

SEQ ID NO: 1296612 - RNA, 14 nt, Homo sapiens
aucucccaccuaaa

SEQ ID NO: 1296613 - RNA, 15 nt, Homo sapiens
aucuccuuuacuaga

SEQ ID NO: 1296614 - RNA, 19 nt, Homo sapiens
aucucggcucagugcaacc

SEQ ID NO: 1296615 - RNA, 19 nt, Homo sapiens
aucucugcagggccgccag

SEQ ID NO: 1296616 - RNA, 21 nt, Homo sapiens
aucucuuccuccgaggccagu

SEQ ID NO: 1296617 - RNA, 20 nt, Homo sapiens
aucucuuuagagaaguccaa

SEQ ID NO: 1296618 - RNA, 23 nt, Homo sapiens
aucugaucgggggcguagcauca

SEQ ID NO: 1296619 - RNA, 20 nt, Homo sapiens
aucugauuguugucaggcca

SEQ ID NO: 1296620 - RNA, 13 nt, Homo sapiens
aucugcaaugugg

SEQ ID NO: 1296621 - RNA, 17 nt, Homo sapiens
aucugcaugucuacuca

SEQ ID NO: 1296622 - RNA, 15 nt, Homo sapiens
aucugcauugcccag

SEQ ID NO: 1296623 - RNA, 14 nt, Homo sapiens
aucuggaacccaga

SEQ ID NO: 1296624 - RNA, 15 nt, Homo sapiens
aucuggaaccucagc

SEQ ID NO: 1296625 - RNA, 13 nt, Homo sapiens
aucuggaaguuga

SEQ ID NO: 1296626 - RNA, 19 nt, Homo sapiens
aucuguagcugugcuuuga

SEQ ID NO: 1296627 - RNA, 13 nt, Homo sapiens
aucuguauggacu

SEQ ID NO: 1296628 - RNA, 20 nt, Homo sapiens
aucugucuugccagccagaa

SEQ ID NO: 1296629 - RNA, 10 nt, Homo sapiens
aucugugcac

SEQ ID NO: 1296630 - RNA, 13 nt, Homo sapiens
aucugugucauau

SEQ ID NO: 1296631 - RNA, 21 nt, Homo sapiens
aucuuaaugaacacacaagcu

SEQ ID NO: 1296632 - RNA, 17 nt, Homo sapiens
aucuuagauguuucaca

SEQ ID NO: 1296633 - RNA, 18 nt, Homo sapiens
aucuuauacuguacaaua

SEQ ID NO: 1296634 - RNA, 16 nt, Homo sapiens
cccgaaauagauccag

SEQ ID NO: 1296635 - RNA, 19 nt, Homo sapiens
cccgaaauagauccagugc

SEQ ID NO: 1296636 - RNA, 22 nt, Homo sapiens
cccgccgccugguacucaagcc

SEQ ID NO: 1296637 - RNA, 17 nt, Homo sapiens
cccggcugucaaggggu

SEQ ID NO: 1296638 - RNA, 17 nt, Homo sapiens
cccggggcuccacugaa

SEQ ID NO: 1296639 - RNA, 13 nt, Homo sapiens
cccguggcacuca

SEQ ID NO: 1296640 - RNA, 15 nt, Homo sapiens
cccuaacuucuguaa

SEQ ID NO: 1296641 - RNA, 15 nt, Homo sapiens
cccuacucaccugag

SEQ ID NO: 1296642 - RNA, 21 nt, Homo sapiens
cccuagagauuaaguccagaa

SEQ ID NO: 1296643 - RNA, 21 nt, Homo sapiens
cccuauugcugcuugaggcaa

SEQ ID NO: 1296644 - RNA, 19 nt, Homo sapiens
cccucaaaaaaagccuuua

SEQ ID NO: 1296645 - RNA, 15 nt, Homo sapiens
cccucacuguugaau

SEQ ID NO: 1296646 - RNA, 17 nt, Homo sapiens
cccucagagugcaagcc

SEQ ID NO: 1296647 - RNA, 15 nt, Homo sapiens
cccuccccugccauu

SEQ ID NO: 1296648 - RNA, 20 nt, Homo sapiens
cccucccuguuccccagaga

SEQ ID NO: 1296649 - RNA, 14 nt, Homo sapiens
cccuccuacccugc

SEQ ID NO: 1296650 - RNA, 19 nt, Homo sapiens
cccucuccuccguggcaca

SEQ ID NO: 1296651 - RNA, 18 nt, Homo sapiens
cccucugcuuuuaacucu

SEQ ID NO: 1296652 - RNA, 22 nt, Homo sapiens
cccucuggaguggccacuaagc

SEQ ID NO: 1296653 - RNA, 14 nt, Homo sapiens
cccucuucauggau

SEQ ID NO: 1296654 - RNA, 23 nt, Homo sapiens
cccucuuuguuucugcuucauuu

SEQ ID NO: 1296655 - RNA, 14 nt, Homo sapiens
cccugaaagacuga

SEQ ID NO: 1296656 - RNA, 15 nt, Homo sapiens
cccugacucaucauu

SEQ ID NO: 1296657 - RNA, 16 nt, Homo sapiens
cccugacucaucauuu

SEQ ID NO: 1296658 - RNA, 19 nt, Homo sapiens
cccugagauucagauguca

SEQ ID NO: 1296659 - RNA, 20 nt, Homo sapiens
cccugcacucccuccuggag

SEQ ID NO: 1296660 - RNA, 17 nt, Homo sapiens
cccugcaggaaaacuga

SEQ ID NO: 1296661 - RNA, 17 nt, Homo sapiens
cccugcaguuugagaca

SEQ ID NO: 1296662 - RNA, 11 nt, Homo sapiens
cccugcauguu

SEQ ID NO: 1296663 - RNA, 22 nt, Homo sapiens
cccugcuuuuugcuucuugagu

SEQ ID NO: 1296664 - RNA, 22 nt, Homo sapiens
cccuggacgaaggucugaaucc

SEQ ID NO: 1296665 - RNA, 18 nt, Homo sapiens
cccuggcaccuguggcca

SEQ ID NO: 1296666 - RNA, 13 nt, Homo sapiens
cccuggcaggcag

SEQ ID NO: 1296667 - RNA, 16 nt, Homo sapiens
cccuggccgaguccaa

SEQ ID NO: 1296668 - RNA, 12 nt, Homo sapiens
cgcaaagggcau

SEQ ID NO: 1296669 - RNA, 17 nt, Homo sapiens
cgcaccaauaaagccuu

SEQ ID NO: 1296670 - RNA, 13 nt, Homo sapiens
cgcaccagguguc

SEQ ID NO: 1296671 - RNA, 17 nt, Homo sapiens
cgcagaccaccagcauc

SEQ ID NO: 1296672 - RNA, 17 nt, Homo sapiens
cgcaggagaucaucuga

SEQ ID NO: 1296673 - RNA, 11 nt, Homo sapiens
cgcaucucaau

SEQ ID NO: 1296674 - RNA, 15 nt, Homo sapiens
cgcaucucagugcag

SEQ ID NO: 1296675 - RNA, 15 nt, Homo sapiens
cgcccaaggcccacg

SEQ ID NO: 1296676 - RNA, 16 nt, Homo sapiens
cgccccuuccuagguc

SEQ ID NO: 1296677 - RNA, 22 nt, Homo sapiens
cgccuguaaucccagcacuuug

SEQ ID NO: 1296678 - RNA, 23 nt, Homo sapiens
cgcuacaaaauaaagcuguucuc

SEQ ID NO: 1296679 - RNA, 15 nt, Homo sapiens
cgcuggagugcagug

SEQ ID NO: 1296680 - RNA, 21 nt, Homo sapiens
cgcuggcuuuccagcuuagaa

SEQ ID NO: 1296681 - RNA, 22 nt, Homo sapiens
cgcugggauccgggaucaaagu

SEQ ID NO: 1296682 - RNA, 15 nt, Homo sapiens
cgcuuuguugcccag

SEQ ID NO: 1296683 - RNA, 15 nt, Homo sapiens
cggaaugccacccac

SEQ ID NO: 1296684 - RNA, 22 nt, Homo sapiens
cggacaagacccccagcacuug

SEQ ID NO: 1296685 - RNA, 18 nt, Homo sapiens
cggaccaugcgacacugg

SEQ ID NO: 1296686 - RNA, 17 nt, Homo sapiens
cggagaacaaaugugaa

SEQ ID NO: 1296687 - RNA, 18 nt, Homo sapiens
cggagaggcugcacuugu

SEQ ID NO: 1296688 - RNA, 15 nt, Homo sapiens
cggagguuccaguga

SEQ ID NO: 1296689 - RNA, 13 nt, Homo sapiens
cggaguuccagca

SEQ ID NO: 1296690 - RNA, 18 nt, Homo sapiens
cggauauauacauagcau

SEQ ID NO: 1296691 - RNA, 15 nt, Homo sapiens
cggcagcauggagcu

SEQ ID NO: 1296692 - RNA, 20 nt, Homo sapiens
cggcaguucugggugcuccc

SEQ ID NO: 1296693 - RNA, 14 nt, Homo sapiens
cggcucagugcaac

SEQ ID NO: 1296694 - RNA, 15 nt, Homo sapiens
cggcucagugcaacc

SEQ ID NO: 1296695 - RNA, 16 nt, Homo sapiens
cggcuuguaaauguga

SEQ ID NO: 1296696 - RNA, 16 nt, Homo sapiens
cgggaagaaggggaca

SEQ ID NO: 1296697 - RNA, 22 nt, Homo sapiens
cgggagagggcagugcaauggg

SEQ ID NO: 1296698 - RNA, 13 nt, Homo sapiens
cgggauccagcuc

SEQ ID NO: 1296699 - RNA, 21 nt, Homo sapiens
cgggcaaaauaaagugacaga

SEQ ID NO: 1296700 - RNA, 14 nt, Homo sapiens
cgggccgggcgggg

SEQ ID NO: 1296701 - RNA, 13 nt, Homo sapiens
cgggccucagugc

SEQ ID NO: 1296702 - RNA, 18 nt, Homo sapiens
cgggcuccagccaucuca

SEQ ID NO: 1296703 - RNA, 23 nt, Homo sapiens
cgggcucccccauaguucacuga

SEQ ID NO: 1296704 - RNA, 21 nt, Homo sapiens
cucaaacggcaacauuccuca

SEQ ID NO: 1296705 - RNA, 22 nt, Homo sapiens
cucaaacucuugaccucaggug

SEQ ID NO: 1296706 - RNA, 16 nt, Homo sapiens
cucaaagaaaacuguc

SEQ ID NO: 1296707 - RNA, 20 nt, Homo sapiens
cucaaauggggccagaucca

SEQ ID NO: 1296708 - RNA, 19 nt, Homo sapiens
cucaaccaccuaggcaaug

SEQ ID NO: 1296709 - RNA, 14 nt, Homo sapiens
cucaaccuauggua

SEQ ID NO: 1296710 - RNA, 22 nt, Homo sapiens
cucaaccuccugggcuaaguga

SEQ ID NO: 1296711 - RNA, 17 nt, Homo sapiens
cucaagccaagcagcca

SEQ ID NO: 1296712 - RNA, 21 nt, Homo sapiens
cucaagccaagcagccaagcu

SEQ ID NO: 1296713 - RNA, 18 nt, Homo sapiens
cucaagcccgcggggaca

SEQ ID NO: 1296714 - RNA, 16 nt, Homo sapiens
cucaagcuguccuccc

SEQ ID NO: 1296715 - RNA, 16 nt, Homo sapiens
cucaaucuacaggcca

SEQ ID NO: 1296716 - RNA, 19 nt, Homo sapiens
cucaaugcacaacaaagga

SEQ ID NO: 1296717 - RNA, 15 nt, Homo sapiens
cucaaugcacugaca

SEQ ID NO: 1296718 - RNA, 15 nt, Homo sapiens
cucacaagcaugaag

SEQ ID NO: 1296719 - RNA, 13 nt, Homo sapiens
cucacaccuguaa

SEQ ID NO: 1296720 - RNA, 20 nt, Homo sapiens
cucacaccuguaaucccagc

SEQ ID NO: 1296721 - RNA, 13 nt, Homo sapiens
cucacaguacugg

SEQ ID NO: 1296722 - RNA, 17 nt, Homo sapiens
cucacauuuauucugcu

SEQ ID NO: 1296723 - RNA, 13 nt, Homo sapiens
cucaccacaugcg

SEQ ID NO: 1296724 - RNA, 19 nt, Homo sapiens
cucaccaucggcaggcagu

SEQ ID NO: 1296725 - RNA, 13 nt, Homo sapiens
cucacgccuguaa

SEQ ID NO: 1296726 - RNA, 17 nt, Homo sapiens
cucacgccuguaauccc

SEQ ID NO: 1296727 - RNA, 15 nt, Homo sapiens
cucacgucucccuaa

SEQ ID NO: 1296728 - RNA, 22 nt, Homo sapiens
cucacuaggcccccacuugccu

SEQ ID NO: 1296729 - RNA, 21 nt, Homo sapiens
cucacucccuucccauaagcu

SEQ ID NO: 1296730 - RNA, 15 nt, Homo sapiens
cucacucuguuuccu

SEQ ID NO: 1296731 - RNA, 21 nt, Homo sapiens
cucacugaggguaucugacaa

SEQ ID NO: 1296732 - RNA, 18 nt, Homo sapiens
cucacuggagacucacuu

SEQ ID NO: 1296733 - RNA, 21 nt, Homo sapiens
cucacugugggaaggccagcu

SEQ ID NO: 1296734 - RNA, 18 nt, Homo sapiens
cucacugugggcuagggu

SEQ ID NO: 1296735 - RNA, 15 nt, Homo sapiens
cucagaauccaaaga

SEQ ID NO: 1296736 - RNA, 14 nt, Homo sapiens
cucagaccagagaa

SEQ ID NO: 1296737 - RNA, 16 nt, Homo sapiens
cucagaccagcucuuc

SEQ ID NO: 1296738 - RNA, 19 nt, Homo sapiens
cucagagagggcaggcaug

SEQ ID NO: 1296739 - RNA, 17 nt, Homo sapiens
cucagagcagaguauua

SEQ ID NO: 1296740 - RNA, 13 nt, Homo sapiens
cucagagugcaag

SEQ ID NO: 1296741 - RNA, 13 nt, Homo sapiens
cucagcaaaagau

SEQ ID NO: 1296742 - RNA, 12 nt, Homo sapiens
cucagcauuuaa

SEQ ID NO: 1296743 - RNA, 11 nt, Homo sapiens
cucagcccagc

SEQ ID NO: 1296744 - RNA, 15 nt, Homo sapiens
cucagcccugacccu

SEQ ID NO: 1296745 - RNA, 15 nt, Homo sapiens
cucagcuagggccac

SEQ ID NO: 1296746 - RNA, 22 nt, Homo sapiens
cucagcucugguccaggcccug

SEQ ID NO: 1296747 - RNA, 12 nt, Homo sapiens
cucaggaccagg

SEQ ID NO: 1296748 - RNA, 17 nt, Homo sapiens
cucaggcucuccauuca

SEQ ID NO: 1296749 - RNA, 15 nt, Homo sapiens
cucagggcacaaaga

SEQ ID NO: 1296750 - RNA, 14 nt, Homo sapiens
cucaggugcugucc

SEQ ID NO: 1296751 - RNA, 17 nt, Homo sapiens
cucagugaggaucuuca

SEQ ID NO: 1296752 - RNA, 15 nt, Homo sapiens
cucaguucagaauca

SEQ ID NO: 1296753 - RNA, 15 nt, Homo sapiens
cucauaaucuauaaa

SEQ ID NO: 1296754 - RNA, 13 nt, Homo sapiens
cucauaguauggu

SEQ ID NO: 1296755 - RNA, 17 nt, Homo sapiens
cucaucagaaacucaaa

SEQ ID NO: 1296756 - RNA, 21 nt, Homo sapiens
cucaucauagcaauaacauuc

SEQ ID NO: 1296757 - RNA, 22 nt, Homo sapiens
cucaucauagcaauaacauucc

SEQ ID NO: 1296758 - RNA, 11 nt, Homo sapiens
cucaugacagc

SEQ ID NO: 1296759 - RNA, 19 nt, Homo sapiens
cucaugcccccucagugag

SEQ ID NO: 1296760 - RNA, 18 nt, Homo sapiens
cucaugccuguaauccca

SEQ ID NO: 1296761 - RNA, 20 nt, Homo sapiens
cucaugccuguaaucccagc

SEQ ID NO: 1296762 - RNA, 18 nt, Homo sapiens
cucauggagggggcugca

SEQ ID NO: 1296763 - RNA, 18 nt, Homo sapiens
cucaugggaaggggagga

SEQ ID NO: 1296764 - RNA, 13 nt, Homo sapiens
cucauuauucaca

SEQ ID NO: 1296765 - RNA, 18 nt, Homo sapiens
cucauucccuccccagaa

SEQ ID NO: 1296766 - RNA, 21 nt, Homo sapiens
cucauuggacccuuccauggu

SEQ ID NO: 1296767 - RNA, 15 nt, Homo sapiens
cucauuucaggagca

SEQ ID NO: 1296768 - RNA, 15 nt, Homo sapiens
cucauuuuaggcaaa

SEQ ID NO: 1296769 - RNA, 13 nt, Homo sapiens
cuccaaacugaag

SEQ ID NO: 1296770 - RNA, 23 nt, Homo sapiens
cuccaaccuggggggcaguggug

SEQ ID NO: 1296771 - RNA, 16 nt, Homo sapiens
cuccaaggagcauguc

SEQ ID NO: 1296772 - RNA, 13 nt, Homo sapiens
cuccagaagcacu

SEQ ID NO: 1296773 - RNA, 21 nt, Homo sapiens
cuccagagauuugcuuuaccu

SEQ ID NO: 1296774 - RNA, 18 nt, Homo sapiens
cuccagagggaauugcag

SEQ ID NO: 1296775 - RNA, 18 nt, Homo sapiens
cuccagaugcagggcagu

SEQ ID NO: 1296776 - RNA, 21 nt, Homo sapiens
cuccagcacccccagugcagc

SEQ ID NO: 1296777 - RNA, 16 nt, Homo sapiens
cuccaggaucuauuga

SEQ ID NO: 1296778 - RNA, 22 nt, Homo sapiens
cuccagggaugauucaagccau

SEQ ID NO: 1296779 - RNA, 23 nt, Homo sapiens
cuccagggaugauucaagccauu

SEQ ID NO: 1296780 - RNA, 18 nt, Homo sapiens
cuccaggggggacaauau

SEQ ID NO: 1296781 - RNA, 14 nt, Homo sapiens
cuccaguacuauuu

SEQ ID NO: 1296782 - RNA, 21 nt, Homo sapiens
cuccaguaguaguauggcacu

SEQ ID NO: 1296783 - RNA, 15 nt, Homo sapiens
cuccaguuuccccau

SEQ ID NO: 1296784 - RNA, 19 nt, Homo sapiens
cuccaguuuuuuguuauau

SEQ ID NO: 1296785 - RNA, 21 nt, Homo sapiens
cuccaucaguuagagcugaca

SEQ ID NO: 1296786 - RNA, 16 nt, Homo sapiens
cuccaucgcaguguuc

SEQ ID NO: 1296787 - RNA, 17 nt, Homo sapiens
cuccaucucucauccuc

SEQ ID NO: 1296788 - RNA, 19 nt, Homo sapiens
cuccauuaaauuugguaca

SEQ ID NO: 1296789 - RNA, 20 nt, Homo sapiens
cucccaaagugcugggauua

SEQ ID NO: 1296790 - RNA, 20 nt, Homo sapiens
cucccaaaugagccaugaga

SEQ ID NO: 1296791 - RNA, 13 nt, Homo sapiens
cucccaagggaug

SEQ ID NO: 1296792 - RNA, 12 nt, Homo sapiens
cuccccauggag

SEQ ID NO: 1296793 - RNA, 23 nt, Homo sapiens
cucccggguucaagcgauuuccu

SEQ ID NO: 1296794 - RNA, 15 nt, Homo sapiens
cucccguccauucca

SEQ ID NO: 1296795 - RNA, 19 nt, Homo sapiens
cucccucccaggacucuga

SEQ ID NO: 1296796 - RNA, 21 nt, Homo sapiens
cucccugaagccuuugcauuu

SEQ ID NO: 1296797 - RNA, 13 nt, Homo sapiens
cuccgaggccagu

SEQ ID NO: 1296798 - RNA, 14 nt, Homo sapiens
cuccgaggccagua

SEQ ID NO: 1296799 - RNA, 22 nt, Homo sapiens
cuccgauuuugcucugucuccu

SEQ ID NO: 1296800 - RNA, 17 nt, Homo sapiens
gagaugaaucaaaacca

SEQ ID NO: 1296801 - RNA, 20 nt, Homo sapiens
gagaugaaucaaaaccagug

SEQ ID NO: 1296802 - RNA, 20 nt, Homo sapiens
gagauggcgcuauugcacuc

SEQ ID NO: 1296803 - RNA, 17 nt, Homo sapiens
gagauggguuugacaag

SEQ ID NO: 1296804 - RNA, 18 nt, Homo sapiens
gagauguccauagucaaa

SEQ ID NO: 1296805 - RNA, 17 nt, Homo sapiens
gagauuucaucugcucu

SEQ ID NO: 1296806 - RNA, 11 nt, Homo sapiens
gagcaaaggcu

SEQ ID NO: 1296807 - RNA, 15 nt, Homo sapiens
gagcaacagaggaca

SEQ ID NO: 1296808 - RNA, 22 nt, Homo sapiens
gagcaagacucugucucaaaaa

SEQ ID NO: 1296809 - RNA, 23 nt, Homo sapiens
gagcaaugggaauggcauuauug

SEQ ID NO: 1296810 - RNA, 16 nt, Homo sapiens
gagcacacuuggccca

SEQ ID NO: 1296811 - RNA, 22 nt, Homo sapiens
gagcagccucagaacaaaguga

SEQ ID NO: 1296812 - RNA, 17 nt, Homo sapiens
gagcaguccugccucag

SEQ ID NO: 1296813 - RNA, 21 nt, Homo sapiens
gagcagugaaugauucagugu

SEQ ID NO: 1296814 - RNA, 20 nt, Homo sapiens
gagcagugcuugaaugaagu

SEQ ID NO: 1296815 - RNA, 14 nt, Homo sapiens
gagcaguucagagu

SEQ ID NO: 1296816 - RNA, 14 nt, Homo sapiens
gagcaucaagccac

SEQ ID NO: 1296817 - RNA, 15 nt, Homo sapiens
gagccaccccaggaa

SEQ ID NO: 1296818 - RNA, 22 nt, Homo sapiens
gagccagaccuucggagaguaa

SEQ ID NO: 1296819 - RNA, 20 nt, Homo sapiens
gagcccagaaaaccuccagu

SEQ ID NO: 1296820 - RNA, 17 nt, Homo sapiens
gagcccauccagucucc

SEQ ID NO: 1296821 - RNA, 14 nt, Homo sapiens
gagcccuuaugaca

SEQ ID NO: 1296822 - RNA, 12 nt, Homo sapiens
gagccugcaguu

SEQ ID NO: 1296823 - RNA, 16 nt, Homo sapiens
gagccuggcaagaaug

SEQ ID NO: 1296824 - RNA, 13 nt, Homo sapiens
gagccuggugccc

SEQ ID NO: 1296825 - RNA, 22 nt, Homo sapiens
gagccuuuccucaaaacuggag

SEQ ID NO: 1296826 - RNA, 17 nt, Homo sapiens
gagcucacccaugugca

SEQ ID NO: 1296827 - RNA, 15 nt, Homo sapiens
gagcuggcaccagaa

SEQ ID NO: 1296828 - RNA, 20 nt, Homo sapiens
gagcuguaucuugauguuua

SEQ ID NO: 1296829 - RNA, 20 nt, Homo sapiens
gagcuguuuucccugaccuc

SEQ ID NO: 1296830 - RNA, 16 nt, Homo sapiens
gagcuuagauugccuc

SEQ ID NO: 1296831 - RNA, 13 nt, Homo sapiens
gagcuuagcauau

SEQ ID NO: 1296832 - RNA, 20 nt, Homo sapiens
gagcuuauuacuuauuugug

SEQ ID NO: 1296833 - RNA, 21 nt, Homo sapiens
gagcuucccugacucauucug

SEQ ID NO: 1296834 - RNA, 23 nt, Homo sapiens
gagcuuggcguuuggacccaguu

SEQ ID NO: 1296835 - RNA, 16 nt, Homo sapiens
gaggaaagaacacuuc

SEQ ID NO: 1296836 - RNA, 20 nt, Homo sapiens
gaggaaaggccagcuggcag

SEQ ID NO: 1296837 - RNA, 22 nt, Homo sapiens
gaggacaagggaaaugucaggg

SEQ ID NO: 1296838 - RNA, 19 nt, Homo sapiens
gaggacauaaugggguccu

SEQ ID NO: 1296839 - RNA, 23 nt, Homo sapiens
gaggagccccuggacaugccugu

SEQ ID NO: 1296840 - RNA, 18 nt, Homo sapiens
gaggaguuagccaaacaa

SEQ ID NO: 1296841 - RNA, 18 nt, Homo sapiens
gaggaugggucagagcua

SEQ ID NO: 1296842 - RNA, 19 nt, Homo sapiens
gaggauugcuugagcucag

SEQ ID NO: 1296843 - RNA, 16 nt, Homo sapiens
gaggauuucaucucuu

SEQ ID NO: 1296844 - RNA, 16 nt, Homo sapiens
gaggcaaauggcacug

SEQ ID NO: 1296845 - RNA, 18 nt, Homo sapiens
gaugacugccuugccucc

SEQ ID NO: 1296846 - RNA, 14 nt, Homo sapiens
gaugaggcccucau

SEQ ID NO: 1296847 - RNA, 13 nt, Homo sapiens
gaugauaaaacac

SEQ ID NO: 1296848 - RNA, 16 nt, Homo sapiens
gaugauaaaacacaaa

SEQ ID NO: 1296849 - RNA, 14 nt, Homo sapiens
gaugauacauccaa

SEQ ID NO: 1296850 - RNA, 12 nt, Homo sapiens
gaugcacuacca

SEQ ID NO: 1296851 - RNA, 22 nt, Homo sapiens
gaugcacuaccauugcuguucu

SEQ ID NO: 1296852 - RNA, 16 nt, Homo sapiens
gaugcagcucuuggga

SEQ ID NO: 1296853 - RNA, 19 nt, Homo sapiens
gaugcaguagacugcagug

SEQ ID NO: 1296854 - RNA, 21 nt, Homo sapiens
gaugcagugugaaacuuacca

SEQ ID NO: 1296855 - RNA, 22 nt, Homo sapiens
gaugcauagccuggacacagag

SEQ ID NO: 1296856 - RNA, 12 nt, Homo sapiens
gaugccuacuuu

SEQ ID NO: 1296857 - RNA, 20 nt, Homo sapiens
gaugcugccccucaucucuc

SEQ ID NO: 1296858 - RNA, 14 nt, Homo sapiens
gaugggagguugug

SEQ ID NO: 1296859 - RNA, 15 nt, Homo sapiens
gaugggcagcagcuu

SEQ ID NO: 1296860 - RNA, 20 nt, Homo sapiens
gaugggcauaugugucagug

SEQ ID NO: 1296861 - RNA, 18 nt, Homo sapiens
gauggggcaagggcacaa

SEQ ID NO: 1296862 - RNA, 14 nt, Homo sapiens
gauggggucuguaa

SEQ ID NO: 1296863 - RNA, 15 nt, Homo sapiens
gaugguacacagugg

SEQ ID NO: 1296864 - RNA, 12 nt, Homo sapiens
gaugguacguga

SEQ ID NO: 1296865 - RNA, 13 nt, Homo sapiens
gaugguggcacau

SEQ ID NO: 1296866 - RNA, 18 nt, Homo sapiens
gauguacacauuuuguaa

SEQ ID NO: 1296867 - RNA, 15 nt, Homo sapiens
gauguacuaaaguag

SEQ ID NO: 1296868 - RNA, 15 nt, Homo sapiens
gauguagcuuuucac

SEQ ID NO: 1296869 - RNA, 14 nt, Homo sapiens
gauguagugccucu

SEQ ID NO: 1296870 - RNA, 18 nt, Homo sapiens
gaugucauauuccauuuu

SEQ ID NO: 1296871 - RNA, 14 nt, Homo sapiens
gauguccucaccac

SEQ ID NO: 1296872 - RNA, 20 nt, Homo sapiens
gaugucucugcaaaccaaca

SEQ ID NO: 1296873 - RNA, 19 nt, Homo sapiens
gauguguauauauauguga

SEQ ID NO: 1296874 - RNA, 14 nt, Homo sapiens
gaugugucaucuaa

SEQ ID NO: 1296875 - RNA, 17 nt, Homo sapiens
gauguuuccccagaccg

SEQ ID NO: 1296876 - RNA, 15 nt, Homo sapiens
gauuaaguccagaaa

SEQ ID NO: 1296877 - RNA, 21 nt, Homo sapiens
gauuaaugucaauucuugcca

SEQ ID NO: 1296878 - RNA, 18 nt, Homo sapiens
gauuacaggugugcacca

SEQ ID NO: 1296879 - RNA, 17 nt, Homo sapiens
gauucaauucaacacuc

SEQ ID NO: 1296880 - RNA, 19 nt, Homo sapiens
gauucaccugagcaggacc

SEQ ID NO: 1296881 - RNA, 17 nt, Homo sapiens
gauucagaugucauuua

SEQ ID NO: 1296882 - RNA, 15 nt, Homo sapiens
gauucaugucucacg

SEQ ID NO: 1296883 - RNA, 19 nt, Homo sapiens
gauuccaaaaagcacauau

SEQ ID NO: 1296884 - RNA, 21 nt, Homo sapiens
gauuccccaucucaggccaga

SEQ ID NO: 1296885 - RNA, 15 nt, Homo sapiens
gauucuccugccuca

SEQ ID NO: 1296886 - RNA, 23 nt, Homo sapiens
gauugccucugaagccuauguau

SEQ ID NO: 1296887 - RNA, 22 nt, Homo sapiens
gauuggccccacugacguuggc

SEQ ID NO: 1296888 - RNA, 19 nt, Homo sapiens
gauuggccggcuaguguuu

SEQ ID NO: 1296889 - RNA, 17 nt, Homo sapiens
gauuguugucaggccau

SEQ ID NO: 1296890 - RNA, 15 nt, Homo sapiens
gauuuaauacaguuu

SEQ ID NO: 1296891 - RNA, 23 nt, Homo sapiens
gcauuaacaaggaaaaauacuga

SEQ ID NO: 1296892 - RNA, 21 nt, Homo sapiens
gcauucaccugcccugugcau

SEQ ID NO: 1296893 - RNA, 18 nt, Homo sapiens
gcauuuccuggucagugg

SEQ ID NO: 1296894 - RNA, 17 nt, Homo sapiens
gcauuuuccagcacuuu

SEQ ID NO: 1296895 - RNA, 21 nt, Homo sapiens
gcauuuuccagcacuuugcaa

SEQ ID NO: 1296896 - RNA, 13 nt, Homo sapiens
gccaaaaugcucu

SEQ ID NO: 1296897 - RNA, 23 nt, Homo sapiens
gccaaaccucuguucaguguaaa

SEQ ID NO: 1296898 - RNA, 22 nt, Homo sapiens
gccaaagccaauaacacacagc

SEQ ID NO: 1296899 - RNA, 21 nt, Homo sapiens
gccaacauguggcuccuccca

SEQ ID NO: 1296900 - RNA, 17 nt, Homo sapiens
gccaaccggucacccag

SEQ ID NO: 1296901 - RNA, 21 nt, Homo sapiens
gccaagaguccaggaggcccu

SEQ ID NO: 1296902 - RNA, 19 nt, Homo sapiens
gccaagcagccaagcuccu

SEQ ID NO: 1296903 - RNA, 19 nt, Homo sapiens
gccaagcaggacagugcuu

SEQ ID NO: 1296904 - RNA, 19 nt, Homo sapiens
gccaagcagugccugccua

SEQ ID NO: 1296905 - RNA, 13 nt, Homo sapiens
gccaagccagcug

SEQ ID NO: 1296906 - RNA, 20 nt, Homo sapiens
gccaagcucaggaccaggca

SEQ ID NO: 1296907 - RNA, 17 nt, Homo sapiens
gccaaggagcugcuaua

SEQ ID NO: 1296908 - RNA, 20 nt, Homo sapiens
gccaaggcagcgaccccagg

SEQ ID NO: 1296909 - RNA, 21 nt, Homo sapiens
gccaaggcagcgaccccagga

SEQ ID NO: 1296910 - RNA, 22 nt, Homo sapiens
gccaaggcggguggaucacuug

SEQ ID NO: 1296911 - RNA, 16 nt, Homo sapiens
gccaagggccacggga

SEQ ID NO: 1296912 - RNA, 18 nt, Homo sapiens
gccaauaacacacagcua

SEQ ID NO: 1296913 - RNA, 17 nt, Homo sapiens
gccacaggggauucuua

SEQ ID NO: 1296914 - RNA, 21 nt, Homo sapiens
gccacaucuccuguggucucu

SEQ ID NO: 1296915 - RNA, 14 nt, Homo sapiens
gccacccugcauuu

SEQ ID NO: 1296916 - RNA, 17 nt, Homo sapiens
gccaccuuccucuccca

SEQ ID NO: 1296917 - RNA, 22 nt, Homo sapiens
gccacgcggccccacauugcac

SEQ ID NO: 1296918 - RNA, 15 nt, Homo sapiens
gccacuggcugcuaa

SEQ ID NO: 1296919 - RNA, 15 nt, Homo sapiens
gccagacaugccaca

SEQ ID NO: 1296920 - RNA, 15 nt, Homo sapiens
gccagaggcaccuca

SEQ ID NO: 1296921 - RNA, 17 nt, Homo sapiens
gccagauggacuccagc

SEQ ID NO: 1296922 - RNA, 18 nt, Homo sapiens
gccagcacacagggcagu

SEQ ID NO: 1296923 - RNA, 15 nt, Homo sapiens
gccagcuaucugccu

SEQ ID NO: 1296924 - RNA, 19 nt, Homo sapiens
gccagcuuaucucaggggu

SEQ ID NO: 1296925 - RNA, 18 nt, Homo sapiens
gccaggaccaugcaggga

SEQ ID NO: 1296926 - RNA, 21 nt, Homo sapiens
gccaggccucuuggcagucac

SEQ ID NO: 1296927 - RNA, 22 nt, Homo sapiens
gccagggaacccacagagucac

SEQ ID NO: 1296928 - RNA, 18 nt, Homo sapiens
gccagggcaaugaugaau

SEQ ID NO: 1296929 - RNA, 18 nt, Homo sapiens
gccaggugccaucaucuc

SEQ ID NO: 1296930 - RNA, 22 nt, Homo sapiens
gccauaaaaauaaaucaguuca

SEQ ID NO: 1296931 - RNA, 16 nt, Homo sapiens
gccaugagaugauaca

SEQ ID NO: 1296932 - RNA, 19 nt, Homo sapiens
gccaugugaaacucaucuc

SEQ ID NO: 1296933 - RNA, 21 nt, Homo sapiens
gccauuacugcauaaaauaga

SEQ ID NO: 1296934 - RNA, 16 nt, Homo sapiens
gccauugcacuccagc

SEQ ID NO: 1296935 - RNA, 22 nt, Homo sapiens
gccauuuuggguuuugggucuu

SEQ ID NO: 1296936 - RNA, 15 nt, Homo sapiens
gcccaaccuauccug

SEQ ID NO: 1296937 - RNA, 20 nt, Homo sapiens
gcccaaccuccuauauauag

SEQ ID NO: 1296938 - RNA, 20 nt, Homo sapiens
gcccacgcuggagugcagug

SEQ ID NO: 1296939 - RNA, 22 nt, Homo sapiens
gcccacuucaccguacuaacca

SEQ ID NO: 1296940 - RNA, 22 nt, Homo sapiens
gcccagaaaucugggauguacu

SEQ ID NO: 1296941 - RNA, 17 nt, Homo sapiens
gcccagagcccagcucc

SEQ ID NO: 1296942 - RNA, 14 nt, Homo sapiens
gcccagaugugguu

SEQ ID NO: 1296943 - RNA, 21 nt, Homo sapiens
gcccaggaguuugaauccauc

SEQ ID NO: 1296944 - RNA, 17 nt, Homo sapiens
gcccaggcaggucuuga

SEQ ID NO: 1296945 - RNA, 20 nt, Homo sapiens
gcccaggcuggaaugcagug

SEQ ID NO: 1296946 - RNA, 19 nt, Homo sapiens
gcccaggcuggagugcagu

SEQ ID NO: 1296947 - RNA, 13 nt, Homo sapiens
gcccagucuuuca

SEQ ID NO: 1296948 - RNA, 18 nt, Homo sapiens
gcccauaaccaguauuuu

SEQ ID NO: 1296949 - RNA, 14 nt, Homo sapiens
gcccauaucuguga

SEQ ID NO: 1296950 - RNA, 18 nt, Homo sapiens
gcccauaucugugaaaug

SEQ ID NO: 1296951 - RNA, 14 nt, Homo sapiens
gcccauccagucuc

SEQ ID NO: 1296952 - RNA, 14 nt, Homo sapiens
gccccacauugcac

SEQ ID NO: 1296953 - RNA, 20 nt, Homo sapiens
gccccagaguagcuggaauu

SEQ ID NO: 1296954 - RNA, 15 nt, Homo sapiens
gccccaggaagccgu

SEQ ID NO: 1296955 - RNA, 19 nt, Homo sapiens
gccccaggcauugccaagg

SEQ ID NO: 1296956 - RNA, 21 nt, Homo sapiens
gccccauccuccagcagggaa

SEQ ID NO: 1296957 - RNA, 21 nt, Homo sapiens
gccccauggcgaggccccuug

SEQ ID NO: 1296958 - RNA, 14 nt, Homo sapiens
gccccauuuaccca

SEQ ID NO: 1296959 - RNA, 17 nt, Homo sapiens
gccccucggcucuggag

SEQ ID NO: 1296960 - RNA, 17 nt, Homo sapiens
gccccugcuccagaaga

SEQ ID NO: 1296961 - RNA, 18 nt, Homo sapiens
gccccuggacgaaggucu

SEQ ID NO: 1296962 - RNA, 18 nt, Homo sapiens
gccccuggcucugaccga

SEQ ID NO: 1296963 - RNA, 22 nt, Homo sapiens
gccccugucgucaggaccuccu

SEQ ID NO: 1296964 - RNA, 18 nt, Homo sapiens
gcccgugcacccuggaag

SEQ ID NO: 1296965 - RNA, 15 nt, Homo sapiens
gcccuaaaagcacac

SEQ ID NO: 1296966 - RNA, 16 nt, Homo sapiens
gcccuacuucuuugcu

SEQ ID NO: 1296967 - RNA, 14 nt, Homo sapiens
gcccucagauuccg

SEQ ID NO: 1296968 - RNA, 18 nt, Homo sapiens
gcccugagaaagcccugu

SEQ ID NO: 1296969 - RNA, 15 nt, Homo sapiens
gcccugcagugcccu

SEQ ID NO: 1296970 - RNA, 14 nt, Homo sapiens
gcccugccaugcuc

SEQ ID NO: 1296971 - RNA, 16 nt, Homo sapiens
gcccugcgggugaaca

SEQ ID NO: 1296972 - RNA, 13 nt, Homo sapiens
gcccugugcaacc

SEQ ID NO: 1296973 - RNA, 14 nt, Homo sapiens
gcccuugucacugg

SEQ ID NO: 1296974 - RNA, 13 nt, Homo sapiens
gccgaccuuagau

SEQ ID NO: 1296975 - RNA, 21 nt, Homo sapiens
gccgagauugcaccacugcac

SEQ ID NO: 1296976 - RNA, 14 nt, Homo sapiens
gccgguaaacacgc

SEQ ID NO: 1296977 - RNA, 19 nt, Homo sapiens
gcgcccccaccccagaccc

SEQ ID NO: 1296978 - RNA, 16 nt, Homo sapiens
gcgcccgggauccagc

SEQ ID NO: 1296979 - RNA, 14 nt, Homo sapiens
gcgcgguggcucac

SEQ ID NO: 1296980 - RNA, 19 nt, Homo sapiens
gcggagucuguccugugac

SEQ ID NO: 1296981 - RNA, 15 nt, Homo sapiens
gcgggcgcgugagug

SEQ ID NO: 1296982 - RNA, 21 nt, Homo sapiens
gcggggacucgguaagcacuu

SEQ ID NO: 1296983 - RNA, 12 nt, Homo sapiens
gcguacacagag

SEQ ID NO: 1296984 - RNA, 19 nt, Homo sapiens
gcgugaccagcaguacuca

SEQ ID NO: 1296985 - RNA, 15 nt, Homo sapiens
gcuaacaagucacca

SEQ ID NO: 1296986 - RNA, 12 nt, Homo sapiens
gcuaagacugau

SEQ ID NO: 1296987 - RNA, 12 nt, Homo sapiens
gcuaauaccugu

SEQ ID NO: 1296988 - RNA, 21 nt, Homo sapiens
gcuaauuuacuggacaaagaa

SEQ ID NO: 1296989 - RNA, 12 nt, Homo sapiens
gcuacaccuuuc

SEQ ID NO: 1296990 - RNA, 20 nt, Homo sapiens
gcuacaccuuucuccuuugu

SEQ ID NO: 1296991 - RNA, 15 nt, Homo sapiens
gcuaccaacuuguau

SEQ ID NO: 1296992 - RNA, 22 nt, Homo sapiens
gcuaccuucucuacccaucucc

SEQ ID NO: 1296993 - RNA, 22 nt, Homo sapiens
gcuacuacgguugaucuugcaa

SEQ ID NO: 1296994 - RNA, 14 nt, Homo sapiens
gcuacuagcucuuu

SEQ ID NO: 1296995 - RNA, 18 nt, Homo sapiens
gcuaggguggucagagga

SEQ ID NO: 1296996 - RNA, 22 nt, Homo sapiens
gcuaguccccuucuuuuggccc

SEQ ID NO: 1296997 - RNA, 15 nt, Homo sapiens
gcuauaauaaagaag

SEQ ID NO: 1296998 - RNA, 22 nt, Homo sapiens
gcuauccguguugcagguucau

SEQ ID NO: 1296999 - RNA, 22 nt, Homo sapiens
gcuaugugaagaguaagucaac

SEQ ID NO: 1297000 - RNA, 20 nt, Homo sapiens
gcuauucccucaaaucugag

SEQ ID NO: 1297001 - RNA, 16 nt, Homo sapiens
gcuauugucuguaaua

SEQ ID NO: 1297002 - RNA, 20 nt, Homo sapiens
gcuauuucuucuacugcuau

SEQ ID NO: 1297003 - RNA, 22 nt, Homo sapiens
gcucacacugagaauguaagaa

SEQ ID NO: 1297004 - RNA, 21 nt, Homo sapiens
gcucaccuuuaucaccucauu

SEQ ID NO: 1297005 - RNA, 18 nt, Homo sapiens
gcucacuguucuauucau

SEQ ID NO: 1297006 - RNA, 21 nt, Homo sapiens
gcucagaggcgcacugugacc

SEQ ID NO: 1297007 - RNA, 19 nt, Homo sapiens
gcucaggacagaugccaca

SEQ ID NO: 1297008 - RNA, 21 nt, Homo sapiens
gcucagggaaaagcagcucuc

SEQ ID NO: 1297009 - RNA, 20 nt, Homo sapiens
gcucagggaaauggccuucc

SEQ ID NO: 1297010 - RNA, 14 nt, Homo sapiens
gcucaguucugccu

SEQ ID NO: 1297011 - RNA, 17 nt, Homo sapiens
gcucaguucugccuuau

SEQ ID NO: 1297012 - RNA, 15 nt, Homo sapiens
gcucaucauucucug

SEQ ID NO: 1297013 - RNA, 20 nt, Homo sapiens
gcucauucauuuaacagagc

SEQ ID NO: 1297014 - RNA, 21 nt, Homo sapiens
gcucauuuacacucagcugcu

SEQ ID NO: 1297015 - RNA, 13 nt, Homo sapiens
gcuccacccauga

SEQ ID NO: 1297016 - RNA, 14 nt, Homo sapiens
gcuccacuaggacu

SEQ ID NO: 1297017 - RNA, 16 nt, Homo sapiens
gcuccagaugcagggc

SEQ ID NO: 1297018 - RNA, 19 nt, Homo sapiens
gcuccagaugcagggcagu

SEQ ID NO: 1297019 - RNA, 21 nt, Homo sapiens
gcuccagcucauaugcugaca

SEQ ID NO: 1297020 - RNA, 17 nt, Homo sapiens
gcuccagugcaggagac

SEQ ID NO: 1297021 - RNA, 15 nt, Homo sapiens
gcuccaucaaugagg

SEQ ID NO: 1297022 - RNA, 15 nt, Homo sapiens
gcuccucacucaccu

SEQ ID NO: 1297023 - RNA, 18 nt, Homo sapiens
gcuccucacucaccuuca

SEQ ID NO: 1297024 - RNA, 21 nt, Homo sapiens
gcucuccccucagagugcaag

SEQ ID NO: 1297025 - RNA, 17 nt, Homo sapiens
gcucuccugacuuuuaa

SEQ ID NO: 1297026 - RNA, 17 nt, Homo sapiens
gcucugaccgaaacagc

SEQ ID NO: 1297027 - RNA, 19 nt, Homo sapiens
gcucugagccacaguggga

SEQ ID NO: 1297028 - RNA, 18 nt, Homo sapiens
gcucugaucauccacugu

SEQ ID NO: 1297029 - RNA, 19 nt, Homo sapiens
gcucuguucuggaucugcc

SEQ ID NO: 1297030 - RNA, 14 nt, Homo sapiens
gcucuucuaaggaa

SEQ ID NO: 1297031 - RNA, 15 nt, Homo sapiens
gcucuucucauuuca

SEQ ID NO: 1297032 - RNA, 19 nt, Homo sapiens
gcucuuggcuccacuggga

SEQ ID NO: 1297033 - RNA, 17 nt, Homo sapiens
gcugaacaauaggcugu

SEQ ID NO: 1297034 - RNA, 19 nt, Homo sapiens
gcugacaguuuguggcauc

SEQ ID NO: 1297035 - RNA, 23 nt, Homo sapiens
gcugaccaggcgcccgggaucca

SEQ ID NO: 1297036 - RNA, 14 nt, Homo sapiens
gcugagaacacugu

SEQ ID NO: 1297037 - RNA, 14 nt, Homo sapiens
gcugagagugcuau

SEQ ID NO: 1297038 - RNA, 16 nt, Homo sapiens
gcugagcaccagggga

SEQ ID NO: 1297039 - RNA, 20 nt, Homo sapiens
gcugaggcauccuuccucac

SEQ ID NO: 1297040 - RNA, 18 nt, Homo sapiens
gcugagggccugcuggag

SEQ ID NO: 1297041 - RNA, 17 nt, Homo sapiens
gcugcacccacccagga

SEQ ID NO: 1297042 - RNA, 17 nt, Homo sapiens
gcugcacugaugcugcc

SEQ ID NO: 1297043 - RNA, 17 nt, Homo sapiens
gcugcaggacuugagaa

SEQ ID NO: 1297044 - RNA, 16 nt, Homo sapiens
gcugcauacuggccga

SEQ ID NO: 1297045 - RNA, 14 nt, Homo sapiens
gcugccaaaugcgu

SEQ ID NO: 1297046 - RNA, 16 nt, Homo sapiens
gcugccucuaccugac

SEQ ID NO: 1297047 - RNA, 18 nt, Homo sapiens
gcugcgagagaaagggag

SEQ ID NO: 1297048 - RNA, 14 nt, Homo sapiens
gcugcuacuagcuc

SEQ ID NO: 1297049 - RNA, 13 nt, Homo sapiens
gcugcucagggaa

SEQ ID NO: 1297050 - RNA, 15 nt, Homo sapiens
gcuggaauuaugcug

SEQ ID NO: 1297051 - RNA, 23 nt, Homo sapiens
gcuggaggccucaggugcugucc

SEQ ID NO: 1297052 - RNA, 14 nt, Homo sapiens
gcuggagugcagug

SEQ ID NO: 1297053 - RNA, 15 nt, Homo sapiens
gcuggcccagccaaa

SEQ ID NO: 1297054 - RNA, 22 nt, Homo sapiens
gcuggccucacccaccccugca

SEQ ID NO: 1297055 - RNA, 22 nt, Homo sapiens
gcugggauggugggcuucaggg

SEQ ID NO: 1297056 - RNA, 13 nt, Homo sapiens
gcugggcacuucc

SEQ ID NO: 1297057 - RNA, 18 nt, Homo sapiens
gcugggcuucaguggcag

SEQ ID NO: 1297058 - RNA, 15 nt, Homo sapiens
gcuggguccagggga

SEQ ID NO: 1297059 - RNA, 17 nt, Homo sapiens
gcuggguggcacugcca

SEQ ID NO: 1297060 - RNA, 17 nt, Homo sapiens
gcugguaaucuugcucu

SEQ ID NO: 1297061 - RNA, 22 nt, Homo sapiens
gcuguauuuugaaaaugcuuua

SEQ ID NO: 1297062 - RNA, 15 nt, Homo sapiens
ggccugagagucagc

SEQ ID NO: 1297063 - RNA, 16 nt, Homo sapiens
ggccuggcccgggccu

SEQ ID NO: 1297064 - RNA, 16 nt, Homo sapiens
ggccuggugucuccuc

SEQ ID NO: 1297065 - RNA, 14 nt, Homo sapiens
ggccuguccuccaa

SEQ ID NO: 1297066 - RNA, 21 nt, Homo sapiens
ggccuuaucuccaagaccaga

SEQ ID NO: 1297067 - RNA, 21 nt, Homo sapiens
ggccuucccgccggaggccag

SEQ ID NO: 1297068 - RNA, 13 nt, Homo sapiens
ggcgacaguuuuc

SEQ ID NO: 1297069 - RNA, 16 nt, Homo sapiens
ggcgucccuaccuccu

SEQ ID NO: 1297070 - RNA, 15 nt, Homo sapiens
ggcguggagcugccu

SEQ ID NO: 1297071 - RNA, 23 nt, Homo sapiens
ggcguuuggacccaguucaguga

SEQ ID NO: 1297072 - RNA, 16 nt, Homo sapiens
ggcuacacagggaugu

SEQ ID NO: 1297073 - RNA, 17 nt, Homo sapiens
ggcuacacugacacugg

SEQ ID NO: 1297074 - RNA, 16 nt, Homo sapiens
ggcuccaacacugcug

SEQ ID NO: 1297075 - RNA, 20 nt, Homo sapiens
ggcuccagaugcagggcagu

SEQ ID NO: 1297076 - RNA, 22 nt, Homo sapiens
ggcuccauccguggcugcaggg

SEQ ID NO: 1297077 - RNA, 14 nt, Homo sapiens
ggcucugaugcuga

SEQ ID NO: 1297078 - RNA, 15 nt, Homo sapiens
ggcugaccaugcuca

SEQ ID NO: 1297079 - RNA, 16 nt, Homo sapiens
ggcugagaacacugug

SEQ ID NO: 1297080 - RNA, 15 nt, Homo sapiens
ggcugagggugcccu

SEQ ID NO: 1297081 - RNA, 20 nt, Homo sapiens
ggcugcaugauguuugccca

SEQ ID NO: 1297082 - RNA, 19 nt, Homo sapiens
ggcuggaggcugagcugca

SEQ ID NO: 1297083 - RNA, 19 nt, Homo sapiens
ggcuggaguggaguggcgu

SEQ ID NO: 1297084 - RNA, 14 nt, Homo sapiens
ggcuggguggcacc

SEQ ID NO: 1297085 - RNA, 16 nt, Homo sapiens
ggcugucccgugcaug

SEQ ID NO: 1297086 - RNA, 16 nt, Homo sapiens
ggcuuuucccuugcuu

SEQ ID NO: 1297087 - RNA, 17 nt, Homo sapiens
ggcuuuuuacuauuaac

SEQ ID NO: 1297088 - RNA, 14 nt, Homo sapiens
gggaacauguccua

SEQ ID NO: 1297089 - RNA, 13 nt, Homo sapiens
gggaacucaccug

SEQ ID NO: 1297090 - RNA, 19 nt, Homo sapiens
gggaagaucugguauuucc

SEQ ID NO: 1297091 - RNA, 17 nt, Homo sapiens
gggaagcugaccuuuaa

SEQ ID NO: 1297092 - RNA, 21 nt, Homo sapiens
gggaaggaggccaagcagugc

SEQ ID NO: 1297093 - RNA, 15 nt, Homo sapiens
gggaauugcagagua

SEQ ID NO: 1297094 - RNA, 16 nt, Homo sapiens
gggacaaggaaggaaa

SEQ ID NO: 1297095 - RNA, 14 nt, Homo sapiens
gggacacuuaccca

SEQ ID NO: 1297096 - RNA, 22 nt, Homo sapiens
gggacaggcucuucuuucccaa

SEQ ID NO: 1297097 - RNA, 22 nt, Homo sapiens
gggaccccaggugggccuggca

SEQ ID NO: 1297098 - RNA, 19 nt, Homo sapiens
gggacgcaggccccucucc

SEQ ID NO: 1297099 - RNA, 16 nt, Homo sapiens
gggacucaaugcacug

SEQ ID NO: 1297100 - RNA, 23 nt, Homo sapiens
gggacuccggcugugcugggaga

SEQ ID NO: 1297101 - RNA, 19 nt, Homo sapiens
gggagacugggcugaggga

SEQ ID NO: 1297102 - RNA, 21 nt, Homo sapiens
gggagaucaugucucacuuca

SEQ ID NO: 1297103 - RNA, 20 nt, Homo sapiens
gggagcggaaagcagcucaa

SEQ ID NO: 1297104 - RNA, 23 nt, Homo sapiens
gggagcugcagucccaugcacaa

SEQ ID NO: 1297105 - RNA, 23 nt, Homo sapiens
gggaugucuccgucucugucuca

SEQ ID NO: 1297106 - RNA, 16 nt, Homo sapiens
gggcaagggaccugcu

SEQ ID NO: 1297107 - RNA, 21 nt, Homo sapiens
gggcaaggugugguagcucac

SEQ ID NO: 1297108 - RNA, 22 nt, Homo sapiens
gggcacacgccucccacugggg

SEQ ID NO: 1297109 - RNA, 22 nt, Homo sapiens
gggcaccucucuugaaccccaa

SEQ ID NO: 1297110 - RNA, 19 nt, Homo sapiens
gggcauagaugcaggugag

SEQ ID NO: 1297111 - RNA, 13 nt, Homo sapiens
gggcaugaaugag

SEQ ID NO: 1297112 - RNA, 13 nt, Homo sapiens
gggccacugccug

SEQ ID NO: 1297113 - RNA, 14 nt, Homo sapiens
gggccccugcacac

SEQ ID NO: 1297114 - RNA, 19 nt, Homo sapiens
gggcccugugcgucucagu

SEQ ID NO: 1297115 - RNA, 11 nt, Homo sapiens
gggccucagug

SEQ ID NO: 1297116 - RNA, 17 nt, Homo sapiens
gggccugggacuuccau

SEQ ID NO: 1297117 - RNA, 21 nt, Homo sapiens
gggccugggacuuccaugccu

SEQ ID NO: 1297118 - RNA, 18 nt, Homo sapiens
gggcgaucgcggcggagc

SEQ ID NO: 1297119 - RNA, 21 nt, Homo sapiens
gggcgccaccgccacccgcag

SEQ ID NO: 1297120 - RNA, 17 nt, Homo sapiens
gggcuaucccuuuccaa

SEQ ID NO: 1297121 - RNA, 12 nt, Homo sapiens
gggcucagcaaa

SEQ ID NO: 1297122 - RNA, 14 nt, Homo sapiens
gggcuccugaggga

SEQ ID NO: 1297123 - RNA, 11 nt, Homo sapiens
gggcugagggu

SEQ ID NO: 1297124 - RNA, 17 nt, Homo sapiens
gggcugcgccugcugca

SEQ ID NO: 1297125 - RNA, 13 nt, Homo sapiens
gggcugcuuccca

SEQ ID NO: 1297126 - RNA, 20 nt, Homo sapiens
gggcuggaggcugagcugca

SEQ ID NO: 1297127 - RNA, 12 nt, Homo sapiens
gggcuggcagau

SEQ ID NO: 1297128 - RNA, 19 nt, Homo sapiens
gggcuggcccagggcugca

SEQ ID NO: 1297129 - RNA, 20 nt, Homo sapiens
gggcugucaucugugcacug

SEQ ID NO: 1297130 - RNA, 12 nt, Homo sapiens
ggggacagggau

SEQ ID NO: 1297131 - RNA, 16 nt, Homo sapiens
ggggacugccuggaga

SEQ ID NO: 1297132 - RNA, 17 nt, Homo sapiens
ggggagacuucuuggcu

SEQ ID NO: 1297133 - RNA, 14 nt, Homo sapiens
ggggaucccucccc

SEQ ID NO: 1297134 - RNA, 15 nt, Homo sapiens
ggggccagauccagc

SEQ ID NO: 1297135 - RNA, 13 nt, Homo sapiens
ggggccuccagaa

SEQ ID NO: 1297136 - RNA, 21 nt, Homo sapiens
ggggcugugagaggaucaucu

SEQ ID NO: 1297137 - RNA, 17 nt, Homo sapiens
ggggcuucuagcugacu

SEQ ID NO: 1297138 - RNA, 16 nt, Homo sapiens
ggggucaaaauuugcu

SEQ ID NO: 1297139 - RNA, 22 nt, Homo sapiens
ggggugccaggugccaucaucu

SEQ ID NO: 1297140 - RNA, 19 nt, Homo sapiens
ggguagauuucagggagac

SEQ ID NO: 1297141 - RNA, 12 nt, Homo sapiens
ggguccaccagg

SEQ ID NO: 1297142 - RNA, 20 nt, Homo sapiens
gggucucacaguguugccca

SEQ ID NO: 1297143 - RNA, 21 nt, Homo sapiens
gggucucgcuuuguugcccag

SEQ ID NO: 1297144 - RNA, 15 nt, Homo sapiens
gggucugcaggugag

SEQ ID NO: 1297145 - RNA, 19 nt, Homo sapiens
gguuaacgccuucauuuau

SEQ ID NO: 1297146 - RNA, 14 nt, Homo sapiens
gguucaacaucuaa

SEQ ID NO: 1297147 - RNA, 22 nt, Homo sapiens
gguuccagggucccucugugua

SEQ ID NO: 1297148 - RNA, 13 nt, Homo sapiens
gguucucacuguu

SEQ ID NO: 1297149 - RNA, 18 nt, Homo sapiens
gguucuggaaacauucag

SEQ ID NO: 1297150 - RNA, 19 nt, Homo sapiens
gguucuuagucucagcacu

SEQ ID NO: 1297151 - RNA, 14 nt, Homo sapiens
gguucuugagccag

SEQ ID NO: 1297152 - RNA, 21 nt, Homo sapiens
gguuggauggauggguggaug

SEQ ID NO: 1297153 - RNA, 16 nt, Homo sapiens
gguuggauuugaagac

SEQ ID NO: 1297154 - RNA, 13 nt, Homo sapiens
gguuggcaaaaua

SEQ ID NO: 1297155 - RNA, 20 nt, Homo sapiens
gguuuuguuuuuuuucagcc

SEQ ID NO: 1297156 - RNA, 23 nt, Homo sapiens
guaaaaagcccagcacuugaauu

SEQ ID NO: 1297157 - RNA, 18 nt, Homo sapiens
guaaaacaugcuggugaa

SEQ ID NO: 1297158 - RNA, 21 nt, Homo sapiens
guaaaagcaucacaugaacuu

SEQ ID NO: 1297159 - RNA, 12 nt, Homo sapiens
guaaaauggagg

SEQ ID NO: 1297160 - RNA, 13 nt, Homo sapiens
guaaaauugaaag

SEQ ID NO: 1297161 - RNA, 18 nt, Homo sapiens
guaaacacgccugcaaac

SEQ ID NO: 1297162 - RNA, 21 nt, Homo sapiens
guaaaccaaguucaaaggaaa

SEQ ID NO: 1297163 - RNA, 18 nt, Homo sapiens
guaaagagauauuuucca

SEQ ID NO: 1297164 - RNA, 15 nt, Homo sapiens
guaaauccaggaaua

SEQ ID NO: 1297165 - RNA, 17 nt, Homo sapiens
guaaauccuaaagaagg

SEQ ID NO: 1297166 - RNA, 19 nt, Homo sapiens
guaaauuauauuugugcua

SEQ ID NO: 1297167 - RNA, 21 nt, Homo sapiens
guaacacugaugauagguuaa

SEQ ID NO: 1297168 - RNA, 21 nt, Homo sapiens
guaacaugaggggacauuuug

SEQ ID NO: 1297169 - RNA, 23 nt, Homo sapiens
guaacaugaggggacauuuuggu

SEQ ID NO: 1297170 - RNA, 13 nt, Homo sapiens
guaacaugauguu

SEQ ID NO: 1297171 - RNA, 19 nt, Homo sapiens
guaacucuuaaagcaaaua

SEQ ID NO: 1297172 - RNA, 19 nt, Homo sapiens
guaacugugccaguucuuu

SEQ ID NO: 1297173 - RNA, 14 nt, Homo sapiens
guaagacaggccag

SEQ ID NO: 1297174 - RNA, 14 nt, Homo sapiens
guaagucauuuaac

SEQ ID NO: 1297175 - RNA, 20 nt, Homo sapiens
guaauauuuugacccuuuau

SEQ ID NO: 1297176 - RNA, 16 nt, Homo sapiens
guaauccuagcacuuu

SEQ ID NO: 1297177 - RNA, 15 nt, Homo sapiens
guaauccucaagaaa

SEQ ID NO: 1297178 - RNA, 23 nt, Homo sapiens
guaaugaguuuaaaaaucaacuu

SEQ ID NO: 1297179 - RNA, 17 nt, Homo sapiens
guaauucucaggccauc

SEQ ID NO: 1297180 - RNA, 21 nt, Homo sapiens
guaauuguacuaaagccaaac

SEQ ID NO: 1297181 - RNA, 12 nt, Homo sapiens
guacaaaaccac

SEQ ID NO: 1297182 - RNA, 14 nt, Homo sapiens
guacacauuuugua

SEQ ID NO: 1297183 - RNA, 23 nt, Homo sapiens
guacacgaagaccauccauccuc

SEQ ID NO: 1297184 - RNA, 14 nt, Homo sapiens
guacagacauauuu

SEQ ID NO: 1297185 - RNA, 18 nt, Homo sapiens
guacaguagauuuuccaa

SEQ ID NO: 1297186 - RNA, 13 nt, Homo sapiens
guacagucuugca

SEQ ID NO: 1297187 - RNA, 18 nt, Homo sapiens
guacauccugcagcuuau

SEQ ID NO: 1297188 - RNA, 11 nt, Homo sapiens
guacaugagaa

SEQ ID NO: 1297189 - RNA, 12 nt, Homo sapiens
guaccccaugac

SEQ ID NO: 1297190 - RNA, 14 nt, Homo sapiens
guaccucucuuaua

SEQ ID NO: 1297191 - RNA, 18 nt, Homo sapiens
guaccugcccccaaucca

SEQ ID NO: 1297192 - RNA, 13 nt, Homo sapiens
guagaacuuggau

SEQ ID NO: 1297193 - RNA, 17 nt, Homo sapiens
guagaagccacuauuac

SEQ ID NO: 1297194 - RNA, 15 nt, Homo sapiens
guagaauugcauuga

SEQ ID NO: 1297195 - RNA, 20 nt, Homo sapiens
guagagacaggguuuugcca

SEQ ID NO: 1297196 - RNA, 22 nt, Homo sapiens
guagagacaggguuuugccaug

SEQ ID NO: 1297197 - RNA, 20 nt, Homo sapiens
guagaggcuuagagacaguu

SEQ ID NO: 1297198 - RNA, 22 nt, Homo sapiens
guagagggaguugucaagucuc

SEQ ID NO: 1297199 - RNA, 16 nt, Homo sapiens
guagagggcacugggu

SEQ ID NO: 1297200 - RNA, 23 nt, Homo sapiens
guagaggggccccugauccucac

SEQ ID NO: 1297201 - RNA, 17 nt, Homo sapiens
guagauaaaaaacauca

SEQ ID NO: 1297202 - RNA, 16 nt, Homo sapiens
guagauucacauacag

SEQ ID NO: 1297203 - RNA, 16 nt, Homo sapiens
guagcccauccuuccc

SEQ ID NO: 1297204 - RNA, 21 nt, Homo sapiens
guaggaaaagcaaugcuuucu

SEQ ID NO: 1297205 - RNA, 16 nt, Homo sapiens
guaggacccaagcaga

SEQ ID NO: 1297206 - RNA, 15 nt, Homo sapiens
guaggagcugccuug

SEQ ID NO: 1297207 - RNA, 17 nt, Homo sapiens
guagggccccugcacac

SEQ ID NO: 1297208 - RNA, 21 nt, Homo sapiens
guagugucacucaaggcggug

SEQ ID NO: 1297209 - RNA, 23 nt, Homo sapiens
guagugucacucaaggcggugcu

SEQ ID NO: 1297210 - RNA, 16 nt, Homo sapiens
guauaaauuuacuuuu

SEQ ID NO: 1297211 - RNA, 21 nt, Homo sapiens
guauaaguggaggcacuuuag

SEQ ID NO: 1297212 - RNA, 21 nt, Homo sapiens
guauaaguuauuuuuguacau

SEQ ID NO: 1297213 - RNA, 18 nt, Homo sapiens
guauaaugguugacuggg

SEQ ID NO: 1297214 - RNA, 19 nt, Homo sapiens
guauaaugguugacugggu

SEQ ID NO: 1297215 - RNA, 14 nt, Homo sapiens
guauacuuccuuau

SEQ ID NO: 1297216 - RNA, 21 nt, Homo sapiens
guauacuuguauaacuuugua

SEQ ID NO: 1297217 - RNA, 15 nt, Homo sapiens
guauaguacuggcau

SEQ ID NO: 1297218 - RNA, 21 nt, Homo sapiens
guauauuuugacgucacugau

SEQ ID NO: 1297219 - RNA, 14 nt, Homo sapiens
guaucaaaugugac

SEQ ID NO: 1297220 - RNA, 18 nt, Homo sapiens
guaucccaugagccucag

SEQ ID NO: 1297221 - RNA, 20 nt, Homo sapiens
guaucuagcucuaguucaaa

SEQ ID NO: 1297222 - RNA, 21 nt, Homo sapiens
guaucuccggcucccagccuc

SEQ ID NO: 1297223 - RNA, 13 nt, Homo sapiens
guaucuugauguu

SEQ ID NO: 1297224 - RNA, 15 nt, Homo sapiens
guaugacugcacaug

SEQ ID NO: 1297225 - RNA, 19 nt, Homo sapiens
guauucaugacuauggaua

SEQ ID NO: 1297226 - RNA, 20 nt, Homo sapiens
guauucccacaccaggucuu

SEQ ID NO: 1297227 - RNA, 15 nt, Homo sapiens
uagcugggacuacag

SEQ ID NO: 1297228 - RNA, 16 nt, Homo sapiens
uagcugggacuacagg

SEQ ID NO: 1297229 - RNA, 17 nt, Homo sapiens
uagcugggacuacaggc

SEQ ID NO: 1297230 - RNA, 23 nt, Homo sapiens
uaggaagcuuuuguuauguauuu

SEQ ID NO: 1297231 - RNA, 16 nt, Homo sapiens
uaggcaggaagcccaa

SEQ ID NO: 1297232 - RNA, 22 nt, Homo sapiens
uaggcagugggaggcaaauggg

SEQ ID NO: 1297233 - RNA, 15 nt, Homo sapiens
uaggcauuugcugaa

SEQ ID NO: 1297234 - RNA, 21 nt, Homo sapiens
uaggcauuugcugaauacaga

SEQ ID NO: 1297235 - RNA, 18 nt, Homo sapiens
uagggcuuauccaugccu

SEQ ID NO: 1297236 - RNA, 23 nt, Homo sapiens
uagggggagccccuucugcucag

SEQ ID NO: 1297237 - RNA, 16 nt, Homo sapiens
uagggucuuguguugc

SEQ ID NO: 1297238 - RNA, 20 nt, Homo sapiens
uaggugacagagugagacuc

SEQ ID NO: 1297239 - RNA, 12 nt, Homo sapiens
uaguaacaacuc

SEQ ID NO: 1297240 - RNA, 22 nt, Homo sapiens
uaguaauuuuaaaagucucaca

SEQ ID NO: 1297241 - RNA, 16 nt, Homo sapiens
uaguacagguuacuca

SEQ ID NO: 1297242 - RNA, 19 nt, Homo sapiens
uaguacuuacaucaggaaa

SEQ ID NO: 1297243 - RNA, 16 nt, Homo sapiens
uaguauaaaaauguua

SEQ ID NO: 1297244 - RNA, 12 nt, Homo sapiens
uaguauugugau

SEQ ID NO: 1297245 - RNA, 20 nt, Homo sapiens
uagucaagugcguccacgag

SEQ ID NO: 1297246 - RNA, 22 nt, Homo sapiens
uagucagaauuagcugcuucua

SEQ ID NO: 1297247 - RNA, 23 nt, Homo sapiens
uagucauaccuggaaugugucaa

SEQ ID NO: 1297248 - RNA, 13 nt, Homo sapiens
uagugaacuugaa

SEQ ID NO: 1297249 - RNA, 19 nt, Homo sapiens
uagugcccucuuuagccag

SEQ ID NO: 1297250 - RNA, 21 nt, Homo sapiens
uaguggcugccucauauagca

SEQ ID NO: 1297251 - RNA, 21 nt, Homo sapiens
uagugguuuaucagcaaaaaa

SEQ ID NO: 1297252 - RNA, 14 nt, Homo sapiens
uaguguaacacugc

SEQ ID NO: 1297253 - RNA, 19 nt, Homo sapiens
uaguguaacacugcaagaa

SEQ ID NO: 1297254 - RNA, 13 nt, Homo sapiens
uaguguaccuccu

SEQ ID NO: 1297255 - RNA, 14 nt, Homo sapiens
uaguucaugucugc

SEQ ID NO: 1297256 - RNA, 15 nt, Homo sapiens
uaguuugacucagua

SEQ ID NO: 1297257 - RNA, 19 nt, Homo sapiens
uaguuuuucagucuauggg

SEQ ID NO: 1297258 - RNA, 15 nt, Homo sapiens
uauaaaaacaaaaac

SEQ ID NO: 1297259 - RNA, 15 nt, Homo sapiens
uauaaaaagcuucca

SEQ ID NO: 1297260 - RNA, 19 nt, Homo sapiens
uauaaaccuaaaaaagaua

SEQ ID NO: 1297261 - RNA, 13 nt, Homo sapiens
uauaaagugcuuu

SEQ ID NO: 1297262 - RNA, 16 nt, Homo sapiens
uauaaaucaacaccuu

SEQ ID NO: 1297263 - RNA, 23 nt, Homo sapiens
uauaaauuuucccaaaacugaua

SEQ ID NO: 1297264 - RNA, 14 nt, Homo sapiens
uauaagauuccaaa

SEQ ID NO: 1297265 - RNA, 15 nt, Homo sapiens
uauaagauuccaaaa

SEQ ID NO: 1297266 - RNA, 22 nt, Homo sapiens
uauaaggcagccuugaguugca

SEQ ID NO: 1297267 - RNA, 19 nt, Homo sapiens
uauaauaaagaaguguucu

SEQ ID NO: 1297268 - RNA, 16 nt, Homo sapiens
uauaauugaguuuuca

SEQ ID NO: 1297269 - RNA, 18 nt, Homo sapiens
uauaauuggugcauagca

SEQ ID NO: 1297270 - RNA, 14 nt, Homo sapiens
uauaauuugcauac

SEQ ID NO: 1297271 - RNA, 21 nt, Homo sapiens
uauacaaauuagaaaauguua

SEQ ID NO: 1297272 - RNA, 13 nt, Homo sapiens
uauacagugauau

SEQ ID NO: 1297273 - RNA, 14 nt, Homo sapiens
uauacagugauaua

SEQ ID NO: 1297274 - RNA, 17 nt, Homo sapiens
uauaccaacccacuggc

SEQ ID NO: 1297275 - RNA, 14 nt, Homo sapiens
uauaccauuuccuc

SEQ ID NO: 1297276 - RNA, 20 nt, Homo sapiens
uauacuagggagccauuuga

SEQ ID NO: 1297277 - RNA, 12 nt, Homo sapiens
uauacugcugua

SEQ ID NO: 1297278 - RNA, 16 nt, Homo sapiens
uauagcaagaucccau

SEQ ID NO: 1297279 - RNA, 14 nt, Homo sapiens
uauaguacuggcau

SEQ ID NO: 1297280 - RNA, 21 nt, Homo sapiens
uauaguuuauugacaauaauu

SEQ ID NO: 1297281 - RNA, 22 nt, Homo sapiens
uauaguuugggcuucagccuag

SEQ ID NO: 1297282 - RNA, 21 nt, Homo sapiens
uauauagggaucaaccagcua

SEQ ID NO: 1297283 - RNA, 14 nt, Homo sapiens
uauauauguauaua

SEQ ID NO: 1297284 - RNA, 21 nt, Homo sapiens
uauauauuuuugugcacauuu

SEQ ID NO: 1297285 - RNA, 13 nt, Homo sapiens
uauaucaguccuc

SEQ ID NO: 1297286 - RNA, 21 nt, Homo sapiens
uauauccgccuggcauuucac

SEQ ID NO: 1297287 - RNA, 16 nt, Homo sapiens
uauaucuuaaugcaga

SEQ ID NO: 1297288 - RNA, 20 nt, Homo sapiens
uauaugugauuuacauuuca

SEQ ID NO: 1297289 - RNA, 18 nt, Homo sapiens
uauauguguuuuucacau

SEQ ID NO: 1297290 - RNA, 17 nt, Homo sapiens
uauauuggcacugcuaa

SEQ ID NO: 1297291 - RNA, 19 nt, Homo sapiens
uauauuugaaguggagcca

SEQ ID NO: 1297292 - RNA, 15 nt, Homo sapiens
uauauuuuugugcac

SEQ ID NO: 1297293 - RNA, 12 nt, Homo sapiens
uaucaacucaag

SEQ ID NO: 1297294 - RNA, 15 nt, Homo sapiens
uaucaguuacccacu

SEQ ID NO: 1297295 - RNA, 23 nt, Homo sapiens
uaucaguucugcugacacuuugg

SEQ ID NO: 1297296 - RNA, 20 nt, Homo sapiens
uaucauauuauuauccuccu

SEQ ID NO: 1297297 - RNA, 14 nt, Homo sapiens
uauccagccuccca

SEQ ID NO: 1297298 - RNA, 13 nt, Homo sapiens
uaucccauuugcc

SEQ ID NO: 1297299 - RNA, 19 nt, Homo sapiens
uauccuagcacaugcuuca

SEQ ID NO: 1297300 - RNA, 14 nt, Homo sapiens
uauccuucuacuug

SEQ ID NO: 1297301 - RNA, 13 nt, Homo sapiens
uaucgaucucuua

SEQ ID NO: 1297302 - RNA, 14 nt, Homo sapiens
uaucuaaaccauau

SEQ ID NO: 1297303 - RNA, 16 nt, Homo sapiens
uaucugacaaugcuga

SEQ ID NO: 1297304 - RNA, 16 nt, Homo sapiens
uaucugcgugcacuuc

SEQ ID NO: 1297305 - RNA, 20 nt, Homo sapiens
uaucugcgugcacuucccag

SEQ ID NO: 1297306 - RNA, 15 nt, Homo sapiens
uaucugucauacauc

SEQ ID NO: 1297307 - RNA, 17 nt, Homo sapiens
uaucuuguuuuuccacu

SEQ ID NO: 1297308 - RNA, 19 nt, Homo sapiens
uaugaaauuauaaucugug

SEQ ID NO: 1297309 - RNA, 14 nt, Homo sapiens
uaugaaucugcuca

SEQ ID NO: 1297310 - RNA, 19 nt, Homo sapiens
uaugaaugagaaugugcca

SEQ ID NO: 1297311 - RNA, 17 nt, Homo sapiens
uaugagauggaucacau

SEQ ID NO: 1297312 - RNA, 21 nt, Homo sapiens
uaugagguuucuuugacuuca

SEQ ID NO: 1297313 - RNA, 18 nt, Homo sapiens
uaugaguaauacaucaaa

SEQ ID NO: 1297314 - RNA, 20 nt, Homo sapiens
uaugaguaauacaucaaaga

SEQ ID NO: 1297315 - RNA, 20 nt, Homo sapiens
uaugauaaauauaacaucua

SEQ ID NO: 1297316 - RNA, 14 nt, Homo sapiens
uaugauaauuacaa

SEQ ID NO: 1297317 - RNA, 15 nt, Homo sapiens
uaugauauugcagcu

SEQ ID NO: 1297318 - RNA, 10 nt, Homo sapiens
uaugcaaaag

SEQ ID NO: 1297319 - RNA, 14 nt, Homo sapiens
uaugcaagggacug

SEQ ID NO: 1297320 - RNA, 13 nt, Homo sapiens
uaugcagugugcu

SEQ ID NO: 1297321 - RNA, 15 nt, Homo sapiens
uaugcagugugcucc

SEQ ID NO: 1297322 - RNA, 18 nt, Homo sapiens
uaugcucagggucaauuu

SEQ ID NO: 1297323 - RNA, 14 nt, Homo sapiens
uaugcucuaaacau

SEQ ID NO: 1297324 - RNA, 14 nt, Homo sapiens
uaugcuugcucuaa

SEQ ID NO: 1297325 - RNA, 21 nt, Homo sapiens
uaugcuugcucuaagucaaau

SEQ ID NO: 1297326 - RNA, 19 nt, Homo sapiens
uaugcuuuccaaaccuuau

SEQ ID NO: 1297327 - RNA, 17 nt, Homo sapiens
uauggagagaaaacaga

SEQ ID NO: 1297328 - RNA, 19 nt, Homo sapiens
uauggcagagcauccucuc

SEQ ID NO: 1297329 - RNA, 16 nt, Homo sapiens
uaugggaucugauaag

SEQ ID NO: 1297330 - RNA, 17 nt, Homo sapiens
uauggguagcacuacua

SEQ ID NO: 1297331 - RNA, 17 nt, Homo sapiens
uaugucuuuugaugaau

SEQ ID NO: 1297332 - RNA, 14 nt, Homo sapiens
uaugugaagcccag

SEQ ID NO: 1297333 - RNA, 17 nt, Homo sapiens
uaugugucaguggggcu

SEQ ID NO: 1297334 - RNA, 19 nt, Homo sapiens
uaugugugugugugcauau

SEQ ID NO: 1297335 - RNA, 18 nt, Homo sapiens
uauguuaaacuagcauau

SEQ ID NO: 1297336 - RNA, 21 nt, Homo sapiens
uauguuauagaacuucaugga

SEQ ID NO: 1297337 - RNA, 14 nt, Homo sapiens
uauguucaaagacu

SEQ ID NO: 1297338 - RNA, 22 nt, Homo sapiens
uauguucaacuggagacacuau

SEQ ID NO: 1297339 - RNA, 12 nt, Homo sapiens
uauguugcccag

SEQ ID NO: 1297340 - RNA, 18 nt, Homo sapiens
uauuaacauaagaaaaga

SEQ ID NO: 1297341 - RNA, 20 nt, Homo sapiens
uauuaaggaagacaauguga

SEQ ID NO: 1297342 - RNA, 14 nt, Homo sapiens
uauuaauacuaugc

SEQ ID NO: 1297343 - RNA, 23 nt, Homo sapiens
uauuaauuuuuaaggauguugcc

SEQ ID NO: 1297344 - RNA, 15 nt, Homo sapiens
uauuacagcauuuga

SEQ ID NO: 1297345 - RNA, 16 nt, Homo sapiens
uauuaccauguaaaua

SEQ ID NO: 1297346 - RNA, 17 nt, Homo sapiens
uauuauaaagugcuuua

SEQ ID NO: 1297347 - RNA, 17 nt, Homo sapiens
uauuauacgcuggcaac

SEQ ID NO: 1297348 - RNA, 21 nt, Homo sapiens
uauucacaaccacucauucaa

SEQ ID NO: 1297349 - RNA, 15 nt, Homo sapiens
uauucagacaaaaug

SEQ ID NO: 1297350 - RNA, 23 nt, Homo sapiens
uauucaugaagcggucacagauc

SEQ ID NO: 1297351 - RNA, 16 nt, Homo sapiens
uauucauuauuuguca

SEQ ID NO: 1297352 - RNA, 16 nt, Homo sapiens
uauucuaaaaccauuc

SEQ ID NO: 1297353 - RNA, 22 nt, Homo sapiens
uauucuguuggccagugugaca

SEQ ID NO: 1297354 - RNA, 15 nt, Homo sapiens
uauucuugugcuuuu

SEQ ID NO: 1297355 - RNA, 15 nt, Homo sapiens
uauucuuuuuugccc

SEQ ID NO: 1297356 - RNA, 21 nt, Homo sapiens
uauugaauacuuacauucucu

SEQ ID NO: 1297357 - RNA, 14 nt, Homo sapiens
uauugagcauguga

SEQ ID NO: 1297358 - RNA, 21 nt, Homo sapiens
uauuggacaguaaaauccaca

SEQ ID NO: 1297359 - RNA, 23 nt, Homo sapiens
uauugguucagggaacucuggca

SEQ ID NO: 1297360 - RNA, 16 nt, Homo sapiens
uauuguuucaauugca

SEQ ID NO: 1297361 - RNA, 18 nt, Homo sapiens
uauuuaaagacaaagaca

SEQ ID NO: 1297362 - RNA, 22 nt, Homo sapiens
ucagauaagguaaaaugccaug

SEQ ID NO: 1297363 - RNA, 19 nt, Homo sapiens
ucagauaauuaauuuccaa

SEQ ID NO: 1297364 - RNA, 15 nt, Homo sapiens
ucagauggcauaaau

SEQ ID NO: 1297365 - RNA, 16 nt, Homo sapiens
ucagauugcaugugac

SEQ ID NO: 1297366 - RNA, 13 nt, Homo sapiens
ucagauuggacca

SEQ ID NO: 1297367 - RNA, 21 nt, Homo sapiens
ucagauuuuuuccucugcauu

SEQ ID NO: 1297368 - RNA, 17 nt, Homo sapiens
ucagcaagaagauccua

SEQ ID NO: 1297369 - RNA, 16 nt, Homo sapiens
ucagcacugucuuguc

SEQ ID NO: 1297370 - RNA, 17 nt, Homo sapiens
ucagcacugucuugucu

SEQ ID NO: 1297371 - RNA, 10 nt, Homo sapiens
ucagccacua

SEQ ID NO: 1297372 - RNA, 17 nt, Homo sapiens
ucagccuugaaaaacaa

SEQ ID NO: 1297373 - RNA, 14 nt, Homo sapiens
ucagcggcuccagc

SEQ ID NO: 1297374 - RNA, 20 nt, Homo sapiens
ucagcuccgugaacuuguga

SEQ ID NO: 1297375 - RNA, 18 nt, Homo sapiens
ucagcugcucugcaagca

SEQ ID NO: 1297376 - RNA, 18 nt, Homo sapiens
ucagcuggucaaacaaac

SEQ ID NO: 1297377 - RNA, 19 nt, Homo sapiens
ucagcuguaguccucauaa

SEQ ID NO: 1297378 - RNA, 13 nt, Homo sapiens
ucagcuuaucucu

SEQ ID NO: 1297379 - RNA, 18 nt, Homo sapiens
ucagcuuccuuccuucug

SEQ ID NO: 1297380 - RNA, 19 nt, Homo sapiens
ucagcuuguaaauagcuca

SEQ ID NO: 1297381 - RNA, 18 nt, Homo sapiens
ucaggaaaacuacaggug

SEQ ID NO: 1297382 - RNA, 20 nt, Homo sapiens
ucaggaacacccccaugaca

SEQ ID NO: 1297383 - RNA, 18 nt, Homo sapiens
ucaggaccaggcaaugug

SEQ ID NO: 1297384 - RNA, 22 nt, Homo sapiens
ucaggaccuccaagccacugag

SEQ ID NO: 1297385 - RNA, 16 nt, Homo sapiens
ucaggagaaaaagccu

SEQ ID NO: 1297386 - RNA, 15 nt, Homo sapiens
ucaggagcagccuca

SEQ ID NO: 1297387 - RNA, 17 nt, Homo sapiens
ucaggcacacagcuacu

SEQ ID NO: 1297388 - RNA, 16 nt, Homo sapiens
ucaggcagggugcagu

SEQ ID NO: 1297389 - RNA, 11 nt, Homo sapiens
ucagggccacg

SEQ ID NO: 1297390 - RNA, 22 nt, Homo sapiens
ucaggggcggggagggugacag

SEQ ID NO: 1297391 - RNA, 19 nt, Homo sapiens
ucaggguccagacccugaa

SEQ ID NO: 1297392 - RNA, 22 nt, Homo sapiens
ucagguagaagguugacacagu

SEQ ID NO: 1297393 - RNA, 16 nt, Homo sapiens
ucagguggggcagcuu

SEQ ID NO: 1297394 - RNA, 15 nt, Homo sapiens
ucagucacagccacc

SEQ ID NO: 1297395 - RNA, 13 nt, Homo sapiens
ucagucucugagc

SEQ ID NO: 1297396 - RNA, 16 nt, Homo sapiens
ucagugaaaacaaguc

SEQ ID NO: 1297397 - RNA, 16 nt, Homo sapiens
ucagugauuacuguca

SEQ ID NO: 1297398 - RNA, 17 nt, Homo sapiens
ucagugauuacugucaa

SEQ ID NO: 1297399 - RNA, 16 nt, Homo sapiens
ucagugccccauucuc

SEQ ID NO: 1297400 - RNA, 18 nt, Homo sapiens
ucagugccccauucucac

SEQ ID NO: 1297401 - RNA, 12 nt, Homo sapiens
ucaguggugguc

SEQ ID NO: 1297402 - RNA, 18 nt, Homo sapiens
ucaguuauuauauuuaca

SEQ ID NO: 1297403 - RNA, 16 nt, Homo sapiens
ucaguuuuuuguuuua

SEQ ID NO: 1297404 - RNA, 18 nt, Homo sapiens
ucauaaaaagacaacuca

SEQ ID NO: 1297405 - RNA, 20 nt, Homo sapiens
ucauaaaaggacucucagcc

SEQ ID NO: 1297406 - RNA, 17 nt, Homo sapiens
ucauaaucuuugcuuua

SEQ ID NO: 1297407 - RNA, 20 nt, Homo sapiens
ucauaauuuuaguaauuucc

SEQ ID NO: 1297408 - RNA, 11 nt, Homo sapiens
ucauacaggug

SEQ ID NO: 1297409 - RNA, 12 nt, Homo sapiens
ucauacauccua

SEQ ID NO: 1297410 - RNA, 21 nt, Homo sapiens
ucauacgucuuuauuacccaa

SEQ ID NO: 1297411 - RNA, 14 nt, Homo sapiens
ucauaguaacuucu

SEQ ID NO: 1297412 - RNA, 20 nt, Homo sapiens
ucaucaaagaugacuugaaa

SEQ ID NO: 1297413 - RNA, 19 nt, Homo sapiens
ucaucaaauggaagacaca

SEQ ID NO: 1297414 - RNA, 20 nt, Homo sapiens
ucaucaaauggaagacacau

SEQ ID NO: 1297415 - RNA, 18 nt, Homo sapiens
ucaucaaggcacugccug

SEQ ID NO: 1297416 - RNA, 23 nt, Homo sapiens
ucaucaaggcacugccugaugga

SEQ ID NO: 1297417 - RNA, 21 nt, Homo sapiens
ucaucagagccuuuccucaaa

SEQ ID NO: 1297418 - RNA, 16 nt, Homo sapiens
ucaucaugugugucca

SEQ ID NO: 1297419 - RNA, 20 nt, Homo sapiens
ucaucauuuaauccuuguga

SEQ ID NO: 1297420 - RNA, 22 nt, Homo sapiens
ucauccaauaccccuuuacuag

SEQ ID NO: 1297421 - RNA, 13 nt, Homo sapiens
ucauccauuugcg

SEQ ID NO: 1297422 - RNA, 16 nt, Homo sapiens
ucauccccuuacccuu

SEQ ID NO: 1297423 - RNA, 17 nt, Homo sapiens
ucauccuauucuuucga

SEQ ID NO: 1297424 - RNA, 13 nt, Homo sapiens
ucaucugugcacu

SEQ ID NO: 1297425 - RNA, 21 nt, Homo sapiens
ucaucuuccuguguccugaaa

SEQ ID NO: 1297426 - RNA, 14 nt, Homo sapiens
ucaugaaauaugca

SEQ ID NO: 1297427 - RNA, 17 nt, Homo sapiens
ucaugagccugcuggaa

SEQ ID NO: 1297428 - RNA, 18 nt, Homo sapiens
ucaugagccugcuggaag

SEQ ID NO: 1297429 - RNA, 16 nt, Homo sapiens
ucaugaguucugcuga

SEQ ID NO: 1297430 - RNA, 13 nt, Homo sapiens
ucaugcaggugaa

SEQ ID NO: 1297431 - RNA, 20 nt, Homo sapiens
ucaugccccuggcugggacg

SEQ ID NO: 1297432 - RNA, 22 nt, Homo sapiens
ucaugcuggaaccugcaaaaaa

SEQ ID NO: 1297433 - RNA, 17 nt, Homo sapiens
ucauguaaacugugcac

SEQ ID NO: 1297434 - RNA, 17 nt, Homo sapiens
ucaugucucacuucaca

SEQ ID NO: 1297435 - RNA, 19 nt, Homo sapiens
ucaugucucacuucacagc

SEQ ID NO: 1297436 - RNA, 21 nt, Homo sapiens
uccaucuucagaccuuuggac

SEQ ID NO: 1297437 - RNA, 20 nt, Homo sapiens
uccaugcaccuaccuuagaa

SEQ ID NO: 1297438 - RNA, 15 nt, Homo sapiens
uccaugcucuugacc

SEQ ID NO: 1297439 - RNA, 18 nt, Homo sapiens
uccauggcccugccaugc

SEQ ID NO: 1297440 - RNA, 16 nt, Homo sapiens
uccaugggaccacaac

SEQ ID NO: 1297441 - RNA, 16 nt, Homo sapiens
uccauguauucacaca

SEQ ID NO: 1297442 - RNA, 11 nt, Homo sapiens
uccaugucucg

SEQ ID NO: 1297443 - RNA, 20 nt, Homo sapiens
uccauucuuucugauaacua

SEQ ID NO: 1297444 - RNA, 19 nt, Homo sapiens
uccauugguuuaccuguga

SEQ ID NO: 1297445 - RNA, 19 nt, Homo sapiens
uccauuguuuaaaaauaca

SEQ ID NO: 1297446 - RNA, 20 nt, Homo sapiens
uccauuuauucuuugaucuu

SEQ ID NO: 1297447 - RNA, 22 nt, Homo sapiens
uccauuuccauguccccuccca

SEQ ID NO: 1297448 - RNA, 20 nt, Homo sapiens
ucccaaaauuagggagcucu

SEQ ID NO: 1297449 - RNA, 15 nt, Homo sapiens
ucccaacgugcaaag

SEQ ID NO: 1297450 - RNA, 20 nt, Homo sapiens
ucccaaguagcugagacuac

SEQ ID NO: 1297451 - RNA, 22 nt, Homo sapiens
ucccaauuucagacucccauuc

SEQ ID NO: 1297452 - RNA, 15 nt, Homo sapiens
ucccacccagcuaaa

SEQ ID NO: 1297453 - RNA, 18 nt, Homo sapiens
ucccacccccaucucucc

SEQ ID NO: 1297454 - RNA, 16 nt, Homo sapiens
ucccacgggaccuggg

SEQ ID NO: 1297455 - RNA, 20 nt, Homo sapiens
ucccacgggaccuggggcuu

SEQ ID NO: 1297456 - RNA, 23 nt, Homo sapiens
ucccagacggucaggaaaacugu

SEQ ID NO: 1297457 - RNA, 15 nt, Homo sapiens
ucccagcuacucggg

SEQ ID NO: 1297458 - RNA, 19 nt, Homo sapiens
ucccagcuauuccuacucu

SEQ ID NO: 1297459 - RNA, 14 nt, Homo sapiens
ucccaggacucuga

SEQ ID NO: 1297460 - RNA, 18 nt, Homo sapiens
ucccaggcccagugcagu

SEQ ID NO: 1297461 - RNA, 9 nt, Homo sapiens
ucccagugc

SEQ ID NO: 1297462 - RNA, 20 nt, Homo sapiens
ucccaucuugauaagaccac

SEQ ID NO: 1297463 - RNA, 21 nt, Homo sapiens
ucccauucgggagaucauguc

SEQ ID NO: 1297464 - RNA, 22 nt, Homo sapiens
uccccaaugagacuugccuucc

SEQ ID NO: 1297465 - RNA, 20 nt, Homo sapiens
uccccacuuacagaucuauc

SEQ ID NO: 1297466 - RNA, 16 nt, Homo sapiens
uccccagaugugacua

SEQ ID NO: 1297467 - RNA, 11 nt, Homo sapiens
uccccagcucc

SEQ ID NO: 1297468 - RNA, 20 nt, Homo sapiens
uccccauucacagagccuuu

SEQ ID NO: 1297469 - RNA, 15 nt, Homo sapiens
ucccccaaacauguu

SEQ ID NO: 1297470 - RNA, 12 nt, Homo sapiens
ucccccacugau

SEQ ID NO: 1297471 - RNA, 17 nt, Homo sapiens
ucccccagcagccuggg

SEQ ID NO: 1297472 - RNA, 12 nt, Homo sapiens
ucccccccaugc

SEQ ID NO: 1297473 - RNA, 14 nt, Homo sapiens
ucccccugugaaag

SEQ ID NO: 1297474 - RNA, 15 nt, Homo sapiens
ucccccuucacaaag

SEQ ID NO: 1297475 - RNA, 17 nt, Homo sapiens
uccccuaaaccaaaaac

SEQ ID NO: 1297476 - RNA, 23 nt, Homo sapiens
uccccuaaaccaaaaacugaaag

SEQ ID NO: 1297477 - RNA, 15 nt, Homo sapiens
uccccugaccuguga

SEQ ID NO: 1297478 - RNA, 12 nt, Homo sapiens
uccccuguguca

SEQ ID NO: 1297479 - RNA, 15 nt, Homo sapiens
uccccuucucucauc

SEQ ID NO: 1297480 - RNA, 20 nt, Homo sapiens
uccccuucucucaucucuua

SEQ ID NO: 1297481 - RNA, 19 nt, Homo sapiens
ucccggcgucccuaccucc

SEQ ID NO: 1297482 - RNA, 20 nt, Homo sapiens
ucccggcgucccuaccuccu

SEQ ID NO: 1297483 - RNA, 17 nt, Homo sapiens
ucccggggccagcacuu

SEQ ID NO: 1297484 - RNA, 18 nt, Homo sapiens
ucccggggcuccacugaa

SEQ ID NO: 1297485 - RNA, 16 nt, Homo sapiens
ucccguggccuguaga

SEQ ID NO: 1297486 - RNA, 12 nt, Homo sapiens
ucccuaacacuu

SEQ ID NO: 1297487 - RNA, 22 nt, Homo sapiens
ucccuauuuuucucuccugucc

SEQ ID NO: 1297488 - RNA, 21 nt, Homo sapiens
ucccucccaggacucugaccc

SEQ ID NO: 1297489 - RNA, 14 nt, Homo sapiens
ucccuccuaccugu

SEQ ID NO: 1297490 - RNA, 15 nt, Homo sapiens
ucccucuccaacugc

SEQ ID NO: 1297491 - RNA, 24 nt, Homo sapiens
ucccuggggaaaacuugcagcuaa

SEQ ID NO: 1297492 - RNA, 14 nt, Homo sapiens
ucccuugcuguaug

SEQ ID NO: 1297493 - RNA, 15 nt, Homo sapiens
ucccuugcuguaugc

SEQ ID NO: 1297494 - RNA, 18 nt, Homo sapiens
ucccuugggaagggcagg

SEQ ID NO: 1297495 - RNA, 21 nt, Homo sapiens
ucccuugggaagggcagggaa

SEQ ID NO: 1297496 - RNA, 17 nt, Homo sapiens
ucccuuuacagcaccac

SEQ ID NO: 1297497 - RNA, 18 nt, Homo sapiens
ucccuuuuuacacuuuau

SEQ ID NO: 1297498 - RNA, 17 nt, Homo sapiens
uccgacgcugccucuca

SEQ ID NO: 1297499 - RNA, 23 nt, Homo sapiens
uccgaucaguggugucugugaag

SEQ ID NO: 1297500 - RNA, 13 nt, Homo sapiens
uccgcacuguaaa

SEQ ID NO: 1297501 - RNA, 15 nt, Homo sapiens
uccgcaggacuuccc

SEQ ID NO: 1297502 - RNA, 15 nt, Homo sapiens
uccguagacuguuua

SEQ ID NO: 1297503 - RNA, 19 nt, Homo sapiens
uccgucccccaaacauguu

SEQ ID NO: 1297504 - RNA, 13 nt, Homo sapiens
uccgugcuaugac

SEQ ID NO: 1297505 - RNA, 16 nt, Homo sapiens
uccuaaaacaaaagcu

SEQ ID NO: 1297506 - RNA, 24 nt, Homo sapiens
uccuaaagaaaaauaucuuggccu

SEQ ID NO: 1297507 - RNA, 21 nt, Homo sapiens
uccuaaagcuuuuauuuaaca

SEQ ID NO: 1297508 - RNA, 14 nt, Homo sapiens
uccuaagggcucac

SEQ ID NO: 1297509 - RNA, 16 nt, Homo sapiens
ucgcuuuguugcccag

SEQ ID NO: 1297510 - RNA, 12 nt, Homo sapiens
ucggcaggcagu

SEQ ID NO: 1297511 - RNA, 22 nt, Homo sapiens
ucggcauguggaggaaggcagc

SEQ ID NO: 1297512 - RNA, 20 nt, Homo sapiens
ucgguggucuccaccuguca

SEQ ID NO: 1297513 - RNA, 18 nt, Homo sapiens
ucgucaucaggugcauag

SEQ ID NO: 1297514 - RNA, 15 nt, Homo sapiens
ucgucuaaacuuuag

SEQ ID NO: 1297515 - RNA, 18 nt, Homo sapiens
ucuaaaauaagucaaaau

SEQ ID NO: 1297516 - RNA, 17 nt, Homo sapiens
ucuaaaccauaugaaca

SEQ ID NO: 1297517 - RNA, 21 nt, Homo sapiens
ucuaaacuuccccaucuucua

SEQ ID NO: 1297518 - RNA, 14 nt, Homo sapiens
ucuaaaguguuuag

SEQ ID NO: 1297519 - RNA, 21 nt, Homo sapiens
ucuaacuuuugugaagaacua

SEQ ID NO: 1297520 - RNA, 11 nt, Homo sapiens
ucuaagauauu

SEQ ID NO: 1297521 - RNA, 17 nt, Homo sapiens
ucuaagucaaauuccaa

SEQ ID NO: 1297522 - RNA, 14 nt, Homo sapiens
ucuaagucuuucca

SEQ ID NO: 1297523 - RNA, 17 nt, Homo sapiens
ucuaauauuucuaguau

SEQ ID NO: 1297524 - RNA, 16 nt, Homo sapiens
ucuaaucccaacaagc

SEQ ID NO: 1297525 - RNA, 14 nt, Homo sapiens
ucuaaugugucucu

SEQ ID NO: 1297526 - RNA, 20 nt, Homo sapiens
ucuaauuauuuacucaaaga

SEQ ID NO: 1297527 - RNA, 15 nt, Homo sapiens
ucuacaucacucuca

SEQ ID NO: 1297528 - RNA, 18 nt, Homo sapiens
ucuaccagauaacugagg

SEQ ID NO: 1297529 - RNA, 15 nt, Homo sapiens
ucuacccaaaggaua

SEQ ID NO: 1297530 - RNA, 21 nt, Homo sapiens
ucuacccaaaggauacuguaa

SEQ ID NO: 1297531 - RNA, 15 nt, Homo sapiens
ucuacuaaaaauaca

SEQ ID NO: 1297532 - RNA, 19 nt, Homo sapiens
ucuacuaaaaauacaaaaa

SEQ ID NO: 1297533 - RNA, 14 nt, Homo sapiens
ucuacugcaagagc

SEQ ID NO: 1297534 - RNA, 18 nt, Homo sapiens
ucuacuuguuuuucccau

SEQ ID NO: 1297535 - RNA, 15 nt, Homo sapiens
ucuacuuuaucaauu

SEQ ID NO: 1297536 - RNA, 17 nt, Homo sapiens
ucuacuuugauucugau

SEQ ID NO: 1297537 - RNA, 13 nt, Homo sapiens
ucuagaacuugac

SEQ ID NO: 1297538 - RNA, 15 nt, Homo sapiens
ucuagagcacugcca

SEQ ID NO: 1297539 - RNA, 17 nt, Homo sapiens
ucuagaugccacuccca

SEQ ID NO: 1297540 - RNA, 21 nt, Homo sapiens
ucuagcaaauguuaugcauaa

SEQ ID NO: 1297541 - RNA, 20 nt, Homo sapiens
ucuaguucaaauuauuugga

SEQ ID NO: 1297542 - RNA, 23 nt, Homo sapiens
ucuaucaaaggcagaucaguaag

SEQ ID NO: 1297543 - RNA, 23 nt, Homo sapiens
ucuauggcaguccagccagcucc

SEQ ID NO: 1297544 - RNA, 21 nt, Homo sapiens
ucuauguucaaagacugugaa

SEQ ID NO: 1297545 - RNA, 13 nt, Homo sapiens
ucuauuaucucaa

SEQ ID NO: 1297546 - RNA, 14 nt, Homo sapiens
ucuauucagcauug

SEQ ID NO: 1297547 - RNA, 21 nt, Homo sapiens
ucuauugagugaacagaauug

SEQ ID NO: 1297548 - RNA, 19 nt, Homo sapiens
ucuauuucuccuccauggg

SEQ ID NO: 1297549 - RNA, 20 nt, Homo sapiens
ucucaaacuccugggcucaa

SEQ ID NO: 1297550 - RNA, 17 nt, Homo sapiens
ucucaaaggaaauaagg

SEQ ID NO: 1297551 - RNA, 17 nt, Homo sapiens
ucucaaugaagccagcu

SEQ ID NO: 1297552 - RNA, 16 nt, Homo sapiens
ucucacagauugcugc

SEQ ID NO: 1297553 - RNA, 16 nt, Homo sapiens
ucucaccagcugcaaa

SEQ ID NO: 1297554 - RNA, 20 nt, Homo sapiens
ucucacucugucgcccaguc

SEQ ID NO: 1297555 - RNA, 12 nt, Homo sapiens
ucucacuguugu

SEQ ID NO: 1297556 - RNA, 21 nt, Homo sapiens
ucucagguagaagguugacac

SEQ ID NO: 1297557 - RNA, 16 nt, Homo sapiens
ucucaucaguccauug

SEQ ID NO: 1297558 - RNA, 12 nt, Homo sapiens
ucucauccugca

SEQ ID NO: 1297559 - RNA, 18 nt, Homo sapiens
ucucaucugaggcaucca

SEQ ID NO: 1297560 - RNA, 19 nt, Homo sapiens
ucucaugggaaggggagga

SEQ ID NO: 1297561 - RNA, 18 nt, Homo sapiens
ucucaugucuuugcugca

SEQ ID NO: 1297562 - RNA, 14 nt, Homo sapiens
ucucauuauucaca

SEQ ID NO: 1297563 - RNA, 17 nt, Homo sapiens
ucucauuucccuuugau

SEQ ID NO: 1297564 - RNA, 15 nt, Homo sapiens
ucucauuugucacac

SEQ ID NO: 1297565 - RNA, 23 nt, Homo sapiens
ucuccaaaccacuuuuugcagcu

SEQ ID NO: 1297566 - RNA, 12 nt, Homo sapiens
ucuccccaauga

SEQ ID NO: 1297567 - RNA, 23 nt, Homo sapiens
ucucccggcaacaucucugggaa

SEQ ID NO: 1297568 - RNA, 13 nt, Homo sapiens
ucuccugccucag

SEQ ID NO: 1297569 - RNA, 22 nt, Homo sapiens
ucuccuguauuuaacaaaaagu

SEQ ID NO: 1297570 - RNA, 21 nt, Homo sapiens
ucucggagcauauauguagcu

SEQ ID NO: 1297571 - RNA, 17 nt, Homo sapiens
ucucggcucagugcaac

SEQ ID NO: 1297572 - RNA, 15 nt, Homo sapiens
ucucgugcauuucaa

SEQ ID NO: 1297573 - RNA, 18 nt, Homo sapiens
ucucuacuuuucccugua

SEQ ID NO: 1297574 - RNA, 12 nt, Homo sapiens
ucucucaucucu

SEQ ID NO: 1297575 - RNA, 13 nt, Homo sapiens
ucucucuucucca

SEQ ID NO: 1297576 - RNA, 14 nt, Homo sapiens
ucucucuucuccac

SEQ ID NO: 1297577 - RNA, 15 nt, Homo sapiens
ucucugagcagugaa

SEQ ID NO: 1297578 - RNA, 23 nt, Homo sapiens
ucucugauagguagcauuuucca

SEQ ID NO: 1297579 - RNA, 17 nt, Homo sapiens
ucucugcagacuuccca

SEQ ID NO: 1297580 - RNA, 12 nt, Homo sapiens
aaaaaagccaaa

SEQ ID NO: 1297581 - RNA, 15 nt, Homo sapiens
aaaaacaggucuuca

SEQ ID NO: 1297582 - RNA, 19 nt, Homo sapiens
aaaaacuggcaacauucca

SEQ ID NO: 1297583 - RNA, 18 nt, Homo sapiens
aaaaagucuguauggcau

SEQ ID NO: 1297584 - RNA, 16 nt, Homo sapiens
aaaaauccuacuuuca

SEQ ID NO: 1297585 - RNA, 11 nt, Homo sapiens
aaaaaugaaga

SEQ ID NO: 1297586 - RNA, 16 nt, Homo sapiens
aaaaauguuaggauaa

SEQ ID NO: 1297587 - RNA, 17 nt, Homo sapiens
aaaaauuagccaggugu

SEQ ID NO: 1297588 - RNA, 16 nt, Homo sapiens
ugguaccuauuugacu

SEQ ID NO: 1297589 - RNA, 15 nt, Homo sapiens
ugguaggcauuuccu

SEQ ID NO: 1297590 - RNA, 21 nt, Homo sapiens
ugguauaaacguccuacugua

SEQ ID NO: 1297591 - RNA, 22 nt, Homo sapiens
ugguauaaacguccuacuguau

SEQ ID NO: 1297592 - RNA, 19 nt, Homo sapiens
ugguauaggaauguagaag

SEQ ID NO: 1297593 - RNA, 19 nt, Homo sapiens
ugguauguaauggaacuua

SEQ ID NO: 1297594 - RNA, 20 nt, Homo sapiens
uggucacccuucaacgcucc

SEQ ID NO: 1297595 - RNA, 21 nt, Homo sapiens
uggucagggccccucuaccca

SEQ ID NO: 1297596 - RNA, 20 nt, Homo sapiens
ugguccugcugcuggcugcc

SEQ ID NO: 1297597 - RNA, 15 nt, Homo sapiens
uggucggccaguaca

SEQ ID NO: 1297598 - RNA, 20 nt, Homo sapiens
uggucugcugaguaacaggu

SEQ ID NO: 1297599 - RNA, 15 nt, Homo sapiens
uggugaaaagcucca

SEQ ID NO: 1297600 - RNA, 17 nt, Homo sapiens
uggugaaaugcagaguc

SEQ ID NO: 1297601 - RNA, 14 nt, Homo sapiens
uggugaauuucaca

SEQ ID NO: 1297602 - RNA, 16 nt, Homo sapiens
uggugccaucauugcu

SEQ ID NO: 1297603 - RNA, 19 nt, Homo sapiens
uggugccccaggaccagcu

SEQ ID NO: 1297604 - RNA, 18 nt, Homo sapiens
uggugcccuguucucuac

SEQ ID NO: 1297605 - RNA, 22 nt, Homo sapiens
ugguggagccaguaaacagagg

SEQ ID NO: 1297606 - RNA, 24 nt, Homo sapiens
ugguggcacaggaguguccucuuc

SEQ ID NO: 1297607 - RNA, 14 nt, Homo sapiens
ugguggcuacccaa

SEQ ID NO: 1297608 - RNA, 12 nt, Homo sapiens
uggugggaauca

SEQ ID NO: 1297609 - RNA, 12 nt, Homo sapiens
ugguuacauuua

SEQ ID NO: 1297610 - RNA, 13 nt, Homo sapiens
ugguuaugaacuu

SEQ ID NO: 1297611 - RNA, 21 nt, Homo sapiens
ugguuccaucuaguaccagag

SEQ ID NO: 1297612 - RNA, 16 nt, Homo sapiens
ugguuguauuguggaa

SEQ ID NO: 1297613 - RNA, 18 nt, Homo sapiens
ugguuuagucauugcaga

SEQ ID NO: 1297614 - RNA, 12 nt, Homo sapiens
uguaaaauggag

SEQ ID NO: 1297615 - RNA, 14 nt, Homo sapiens
uguaaacaaaccac

SEQ ID NO: 1297616 - RNA, 15 nt, Homo sapiens
uguaaacugugcacc

SEQ ID NO: 1297617 - RNA, 20 nt, Homo sapiens
uguaaagugaagaauccuuu

SEQ ID NO: 1297618 - RNA, 13 nt, Homo sapiens
uguaaaugugcau

SEQ ID NO: 1297619 - RNA, 16 nt, Homo sapiens
uguaacaugauguuaa

SEQ ID NO: 1297620 - RNA, 17 nt, Homo sapiens
uguaacccagauuuugc

SEQ ID NO: 1297621 - RNA, 19 nt, Homo sapiens
uguaacuugaaccuaugaa

SEQ ID NO: 1297622 - RNA, 19 nt, Homo sapiens
uguaagaaacacacugagg

SEQ ID NO: 1297623 - RNA, 18 nt, Homo sapiens
uguaauagccaaacccac

SEQ ID NO: 1297624 - RNA, 15 nt, Homo sapiens
uguaaucaacauucc

SEQ ID NO: 1297625 - RNA, 21 nt, Homo sapiens
uguaaucgcccuacuauucag

SEQ ID NO: 1297626 - RNA, 18 nt, Homo sapiens
uguaauggaacuuagcca

SEQ ID NO: 1297627 - RNA, 12 nt, Homo sapiens
uguacaaagccc

SEQ ID NO: 1297628 - RNA, 19 nt, Homo sapiens
uguacaccagagccucagu

SEQ ID NO: 1297629 - RNA, 16 nt, Homo sapiens
uguaccaaaacauuga

SEQ ID NO: 1297630 - RNA, 15 nt, Homo sapiens
uguaccagugaauuu

SEQ ID NO: 1297631 - RNA, 21 nt, Homo sapiens
uguaccuguuuccuacagaca

SEQ ID NO: 1297632 - RNA, 14 nt, Homo sapiens
uguacuaaagccaa

SEQ ID NO: 1297633 - RNA, 15 nt, Homo sapiens
uguacuaguccucua

SEQ ID NO: 1297634 - RNA, 21 nt, Homo sapiens
uguagcacucaggcucuccau

SEQ ID NO: 1297635 - RNA, 16 nt, Homo sapiens
uguagcccauccuucc

SEQ ID NO: 1297636 - RNA, 17 nt, Homo sapiens
uguaguccgugcugaca

SEQ ID NO: 1297637 - RNA, 17 nt, Homo sapiens
uguagucucgaccuccc

SEQ ID NO: 1297638 - RNA, 18 nt, Homo sapiens
uguauacugugugcuaaa

SEQ ID NO: 1297639 - RNA, 15 nt, Homo sapiens
uguauauacauauau

SEQ ID NO: 1297640 - RNA, 16 nt, Homo sapiens
uguaucaaaugugaca

SEQ ID NO: 1297641 - RNA, 13 nt, Homo sapiens
uguauccaugcac

SEQ ID NO: 1297642 - RNA, 23 nt, Homo sapiens
uguaucccccacccacuauccca

SEQ ID NO: 1297643 - RNA, 22 nt, Homo sapiens
uguauggaaucccacuguauga

SEQ ID NO: 1297644 - RNA, 19 nt, Homo sapiens
uguauucauauauugcauu

SEQ ID NO: 1297645 - RNA, 11 nt, Homo sapiens
uguauuuacuu

SEQ ID NO: 1297646 - RNA, 22 nt, Homo sapiens
uguauuuuuaacaccagaaaga

SEQ ID NO: 1297647 - RNA, 16 nt, Homo sapiens
ugucaaaaugagauuc

SEQ ID NO: 1297648 - RNA, 19 nt, Homo sapiens
ugucacacgauaaagggau

SEQ ID NO: 1297649 - RNA, 13 nt, Homo sapiens
ugucacuccagca

SEQ ID NO: 1297650 - RNA, 22 nt, Homo sapiens
ugucacuucuucaccucuucca

SEQ ID NO: 1297651 - RNA, 16 nt, Homo sapiens
ugucacuuugcuacag

SEQ ID NO: 1297652 - RNA, 13 nt, Homo sapiens
ugucagcaaaaag

SEQ ID NO: 1297653 - RNA, 16 nt, Homo sapiens
ugucauaaaaagacaa

SEQ ID NO: 1297654 - RNA, 13 nt, Homo sapiens
ugucauacauccu

SEQ ID NO: 1297655 - RNA, 14 nt, Homo sapiens
ugucauauguagcc

SEQ ID NO: 1297656 - RNA, 13 nt, Homo sapiens
ugucauucuagaa

SEQ ID NO: 1297657 - RNA, 13 nt, Homo sapiens
ugucauuguauuc

SEQ ID NO: 1297658 - RNA, 16 nt, Homo sapiens
ugucauuuauguguca

SEQ ID NO: 1297659 - RNA, 15 nt, Homo sapiens
ugucauuuugcacug

SEQ ID NO: 1297660 - RNA, 16 nt, Homo sapiens
ugucauuuugcacugu

SEQ ID NO: 1297661 - RNA, 14 nt, Homo sapiens
uguccaaaacugcc

SEQ ID NO: 1297662 - RNA, 17 nt, Homo sapiens
uguccaggcacugagau

SEQ ID NO: 1297663 - RNA, 15 nt, Homo sapiens
uguccagugccuaca

SEQ ID NO: 1297664 - RNA, 17 nt, Homo sapiens
uguccauguauucacac

SEQ ID NO: 1297665 - RNA, 17 nt, Homo sapiens
ugucccauagucccugc

SEQ ID NO: 1297666 - RNA, 20 nt, Homo sapiens
uguccccuucucucaucucu

SEQ ID NO: 1297667 - RNA, 21 nt, Homo sapiens
uguccccuuuuauugcugcuu

SEQ ID NO: 1297668 - RNA, 20 nt, Homo sapiens
ugucccggggcuccacugaa

SEQ ID NO: 1297669 - RNA, 13 nt, Homo sapiens
ugucccgugcaug

SEQ ID NO: 1297670 - RNA, 14 nt, Homo sapiens
aacuacugccuuua

SEQ ID NO: 1297671 - RNA, 16 nt, Homo sapiens
aacuacugccuuuaga

SEQ ID NO: 1297672 - RNA, 21 nt, Homo sapiens
aacuagauuuucacuuaugaa

SEQ ID NO: 1297673 - RNA, 14 nt, Homo sapiens
aacuaguauucccu

SEQ ID NO: 1297674 - RNA, 19 nt, Homo sapiens
aacuauguagguaaauucu

SEQ ID NO: 1297675 - RNA, 20 nt, Homo sapiens
aacucaaacucuuaaaaccc

SEQ ID NO: 1297676 - RNA, 18 nt, Homo sapiens
aacucagcugaucugauu

SEQ ID NO: 1297677 - RNA, 15 nt, Homo sapiens
aacucggacaaguga

SEQ ID NO: 1297678 - RNA, 15 nt, Homo sapiens
aacucuaucugucau

SEQ ID NO: 1297679 - RNA, 12 nt, Homo sapiens
aacucuguacaa

SEQ ID NO: 1297680 - RNA, 13 nt, Homo sapiens
aacucuucacucu

SEQ ID NO: 1297681 - RNA, 14 nt, Homo sapiens
aacucuugaccuca

SEQ ID NO: 1297682 - RNA, 17 nt, Homo sapiens
aacugaaggcuaaaaag

SEQ ID NO: 1297683 - RNA, 18 nt, Homo sapiens
aacugaaggcuaaaaagc

SEQ ID NO: 1297684 - RNA, 14 nt, Homo sapiens
aacugcauugagaa

SEQ ID NO: 1297685 - RNA, 23 nt, Homo sapiens
aacugcugagagacagagcuauu

SEQ ID NO: 1297686 - RNA, 19 nt, Homo sapiens
aacuggaggaguuccuuga

SEQ ID NO: 1297687 - RNA, 20 nt, Homo sapiens
aacuggaggaguuccuugau

SEQ ID NO: 1297688 - RNA, 21 nt, Homo sapiens
aacuggaggaguuccuugauc

SEQ ID NO: 1297689 - RNA, 14 nt, Homo sapiens
aacuggcaguuuuc

SEQ ID NO: 1297690 - RNA, 11 nt, Homo sapiens
aacuggcugca

SEQ ID NO: 1297691 - RNA, 19 nt, Homo sapiens
aacuggguacuuguggaca

SEQ ID NO: 1297692 - RNA, 20 nt, Homo sapiens
aacugguauuuuaucuuuga

SEQ ID NO: 1297693 - RNA, 19 nt, Homo sapiens
aacuguauuuugaauccuu

SEQ ID NO: 1297694 - RNA, 14 nt, Homo sapiens
aacugucacucauu

SEQ ID NO: 1297695 - RNA, 9 nt, Homo sapiens
aacugucau

SEQ ID NO: 1297696 - RNA, 15 nt, Homo sapiens
aacugucugacuuau

SEQ ID NO: 1297697 - RNA, 17 nt, Homo sapiens
aacugucugacuuauaa

SEQ ID NO: 1297698 - RNA, 18 nt, Homo sapiens
aacuguucccaccugcug

SEQ ID NO: 1297699 - RNA, 21 nt, Homo sapiens
aacuguuggcaaggugacauu

SEQ ID NO: 1297700 - RNA, 16 nt, Homo sapiens
aacuguuucaaagcca

SEQ ID NO: 1297701 - RNA, 19 nt, Homo sapiens
aacuuaaaagucaguauca

SEQ ID NO: 1297702 - RNA, 14 nt, Homo sapiens
aacuuaagcaaagg

SEQ ID NO: 1297703 - RNA, 14 nt, Homo sapiens
aacuuacuuccaag

SEQ ID NO: 1297704 - RNA, 23 nt, Homo sapiens
aacuuagccauuuuucaaagcaa

SEQ ID NO: 1297705 - RNA, 13 nt, Homo sapiens
aacuuagugacaa

SEQ ID NO: 1297706 - RNA, 12 nt, Homo sapiens
aacuucaaagag

SEQ ID NO: 1297707 - RNA, 13 nt, Homo sapiens
aacuucaaagagg

SEQ ID NO: 1297708 - RNA, 16 nt, Homo sapiens
aacuucuaaacacaaa

SEQ ID NO: 1297709 - RNA, 20 nt, Homo sapiens
aacuucuaaacacaaauaaa

SEQ ID NO: 1297710 - RNA, 15 nt, Homo sapiens
aacuucuccaaggag

SEQ ID NO: 1297711 - RNA, 22 nt, Homo sapiens
aacuucugccucccaugcuuac

SEQ ID NO: 1297712 - RNA, 16 nt, Homo sapiens
aacuugaaauauccug

SEQ ID NO: 1297713 - RNA, 20 nt, Homo sapiens
aacuuugaauaaagaauacu

SEQ ID NO: 1297714 - RNA, 14 nt, Homo sapiens
aacuuugacuuucu

SEQ ID NO: 1297715 - RNA, 19 nt, Homo sapiens
aagaaaaaaaaagucuuug

SEQ ID NO: 1297716 - RNA, 11 nt, Homo sapiens
aagaaaacugg

SEQ ID NO: 1297717 - RNA, 14 nt, Homo sapiens
aagaaaaucauauu

SEQ ID NO: 1297718 - RNA, 15 nt, Homo sapiens
aagaaacgucuucua

SEQ ID NO: 1297719 - RNA, 19 nt, Homo sapiens
aagaaagcaacuuuacuga

SEQ ID NO: 1297720 - RNA, 17 nt, Homo sapiens
aagaaauuuuucuagua

SEQ ID NO: 1297721 - RNA, 20 nt, Homo sapiens
aagaacaguaacugccauca

SEQ ID NO: 1297722 - RNA, 15 nt, Homo sapiens
aagaaccccucugcu

SEQ ID NO: 1297723 - RNA, 14 nt, Homo sapiens
aagaacuuaccccc

SEQ ID NO: 1297724 - RNA, 15 nt, Homo sapiens
aagaagcucucuccu

SEQ ID NO: 1297725 - RNA, 13 nt, Homo sapiens
aagaaggcauuug

SEQ ID NO: 1297726 - RNA, 19 nt, Homo sapiens
aagaagggaguuccaguca

SEQ ID NO: 1297727 - RNA, 22 nt, Homo sapiens
aagaagguuggugaauuucaca

SEQ ID NO: 1297728 - RNA, 14 nt, Homo sapiens
aagaauaagugucu

SEQ ID NO: 1297729 - RNA, 16 nt, Homo sapiens
aagaauagcaucugua

SEQ ID NO: 1297730 - RNA, 16 nt, Homo sapiens
aagaaucacuugaacc

SEQ ID NO: 1297731 - RNA, 18 nt, Homo sapiens
aagaauguguuuaaacuu

SEQ ID NO: 1297732 - RNA, 12 nt, Homo sapiens
aagaauuucaca

SEQ ID NO: 1297733 - RNA, 17 nt, Homo sapiens
aagaauuucacaagcua

SEQ ID NO: 1297734 - RNA, 14 nt, Homo sapiens
aagacaaauucugu

SEQ ID NO: 1297735 - RNA, 17 nt, Homo sapiens
aagacagaaguuugcac

SEQ ID NO: 1297736 - RNA, 16 nt, Homo sapiens
aagaccaccaccucag

SEQ ID NO: 1297737 - RNA, 16 nt, Homo sapiens
aagacccccagcacuu

SEQ ID NO: 1297738 - RNA, 19 nt, Homo sapiens
aagacccccagcacuuggg

SEQ ID NO: 1297739 - RNA, 23 nt, Homo sapiens
aagacugauuuuaauagggaaua

SEQ ID NO: 1297740 - RNA, 22 nt, Homo sapiens
aagacuggaagcuaauuugcau

SEQ ID NO: 1297741 - RNA, 17 nt, Homo sapiens
aagacuguguuuuugcc

SEQ ID NO: 1297742 - RNA, 20 nt, Homo sapiens
aagacuucaguauguuguca

SEQ ID NO: 1297743 - RNA, 23 nt, Homo sapiens
aagagagucgcaucucagugcag

SEQ ID NO: 1297744 - RNA, 18 nt, Homo sapiens
cacugggucucugcaaac

SEQ ID NO: 1297745 - RNA, 13 nt, Homo sapiens
cacuggguugacu

SEQ ID NO: 1297746 - RNA, 15 nt, Homo sapiens
cacuguagucucgac

SEQ ID NO: 1297747 - RNA, 20 nt, Homo sapiens
cacugucaugcuucaucauu

SEQ ID NO: 1297748 - RNA, 21 nt, Homo sapiens
cacuguccugggccugcagaa

SEQ ID NO: 1297749 - RNA, 22 nt, Homo sapiens
cacuuauaagaaagaucaaaga

SEQ ID NO: 1297750 - RNA, 23 nt, Homo sapiens
cacuuauaagaaagaucaaagac

SEQ ID NO: 1297751 - RNA, 16 nt, Homo sapiens
cacuucauggaccaag

SEQ ID NO: 1297752 - RNA, 14 nt, Homo sapiens
cacuucucuuccuu

SEQ ID NO: 1297753 - RNA, 19 nt, Homo sapiens
cacuucugagaacucaucc

SEQ ID NO: 1297754 - RNA, 12 nt, Homo sapiens
cacuucuuucag

SEQ ID NO: 1297755 - RNA, 20 nt, Homo sapiens
cacuugauguguagacaugu

SEQ ID NO: 1297756 - RNA, 15 nt, Homo sapiens
cacuuggcaucagcu

SEQ ID NO: 1297757 - RNA, 18 nt, Homo sapiens
cagaaaacaaaacugcau

SEQ ID NO: 1297758 - RNA, 21 nt, Homo sapiens
cagaaaucugggauguacugu

SEQ ID NO: 1297759 - RNA, 15 nt, Homo sapiens
cagaaauuuaauuca

SEQ ID NO: 1297760 - RNA, 14 nt, Homo sapiens
cagaacacacucca

SEQ ID NO: 1297761 - RNA, 18 nt, Homo sapiens
cagaacacacuccaucag

SEQ ID NO: 1297762 - RNA, 18 nt, Homo sapiens
cagaacaguaugaauuug

SEQ ID NO: 1297763 - RNA, 15 nt, Homo sapiens
cagaaccagccucaa

SEQ ID NO: 1297764 - RNA, 16 nt, Homo sapiens
cagaaccagccucaaa

SEQ ID NO: 1297765 - RNA, 16 nt, Homo sapiens
cagaacccugccaugg

SEQ ID NO: 1297766 - RNA, 18 nt, Homo sapiens
cagaacugaagagacuag

SEQ ID NO: 1297767 - RNA, 22 nt, Homo sapiens
cagaacuucugagcauccucuc

SEQ ID NO: 1297768 - RNA, 19 nt, Homo sapiens
cagaagaccccugacucau

SEQ ID NO: 1297769 - RNA, 16 nt, Homo sapiens
cagaagagaauuagaa

SEQ ID NO: 1297770 - RNA, 19 nt, Homo sapiens
cagaagauuaagacagaga

SEQ ID NO: 1297771 - RNA, 12 nt, Homo sapiens
cagaagcacugg

SEQ ID NO: 1297772 - RNA, 14 nt, Homo sapiens
cagaagccugaugc

SEQ ID NO: 1297773 - RNA, 15 nt, Homo sapiens
cagaaggggguggug

SEQ ID NO: 1297774 - RNA, 12 nt, Homo sapiens
cagaagugcaau

SEQ ID NO: 1297775 - RNA, 16 nt, Homo sapiens
cagaaguuugagauca

SEQ ID NO: 1297776 - RNA, 20 nt, Homo sapiens
cagaauauuagccaguacca

SEQ ID NO: 1297777 - RNA, 17 nt, Homo sapiens
cagaaucaaaugcaauu

SEQ ID NO: 1297778 - RNA, 21 nt, Homo sapiens
cagaaucccguaacaccugau

SEQ ID NO: 1297779 - RNA, 22 nt, Homo sapiens
cagaaugaaucuaugcuggaua

SEQ ID NO: 1297780 - RNA, 18 nt, Homo sapiens
cagaaugcugcaggacuu

SEQ ID NO: 1297781 - RNA, 12 nt, Homo sapiens
cagaauggagcu

SEQ ID NO: 1297782 - RNA, 11 nt, Homo sapiens
cagaauggagg

SEQ ID NO: 1297783 - RNA, 15 nt, Homo sapiens
cagacaaaugugguu

SEQ ID NO: 1297784 - RNA, 19 nt, Homo sapiens
cagacaacacugggaaaca

SEQ ID NO: 1297785 - RNA, 21 nt, Homo sapiens
cagacaacacugggaaacaga

SEQ ID NO: 1297786 - RNA, 18 nt, Homo sapiens
cagacacaggcccggcuc

SEQ ID NO: 1297787 - RNA, 18 nt, Homo sapiens
cagacacaugcuauguuc

SEQ ID NO: 1297788 - RNA, 21 nt, Homo sapiens
cagacacuggcguuacugcuu

SEQ ID NO: 1297789 - RNA, 22 nt, Homo sapiens
cagacagguggaaaaacugaga

SEQ ID NO: 1297790 - RNA, 10 nt, Homo sapiens
cagacauauu

SEQ ID NO: 1297791 - RNA, 13 nt, Homo sapiens
cagacaugccaca

SEQ ID NO: 1297792 - RNA, 13 nt, Homo sapiens
cagaccaccagca

SEQ ID NO: 1297793 - RNA, 16 nt, Homo sapiens
cagaccacggcucgau

SEQ ID NO: 1297794 - RNA, 14 nt, Homo sapiens
cagaccucuggauu

SEQ ID NO: 1297795 - RNA, 21 nt, Homo sapiens
cagacucuacagaggccaugg

SEQ ID NO: 1297796 - RNA, 16 nt, Homo sapiens
cagagaaacagacaga

SEQ ID NO: 1297797 - RNA, 14 nt, Homo sapiens
cagagaaaguacuu

SEQ ID NO: 1297798 - RNA, 16 nt, Homo sapiens
cagagaccauugcaau

SEQ ID NO: 1297799 - RNA, 18 nt, Homo sapiens
cagagacccagaucucau

SEQ ID NO: 1297800 - RNA, 18 nt, Homo sapiens
cagagacuuuagucuuug

SEQ ID NO: 1297801 - RNA, 20 nt, Homo sapiens
cagagagagagaaggcagca

SEQ ID NO: 1297802 - RNA, 22 nt, Homo sapiens
cagagagggcaggcaugaaguu

SEQ ID NO: 1297803 - RNA, 15 nt, Homo sapiens
cagagauccaaaaga

SEQ ID NO: 1297804 - RNA, 15 nt, Homo sapiens
cagagaugaaaaaga

SEQ ID NO: 1297805 - RNA, 19 nt, Homo sapiens
cagagauggaugcauguuc

SEQ ID NO: 1297806 - RNA, 22 nt, Homo sapiens
cagagauggaugcauguucuga

SEQ ID NO: 1297807 - RNA, 22 nt, Homo sapiens
cagagcacccagaucagacucu

SEQ ID NO: 1297808 - RNA, 14 nt, Homo sapiens
cagagccacagggu

SEQ ID NO: 1297809 - RNA, 16 nt, Homo sapiens
cagagcccagcuccaa

SEQ ID NO: 1297810 - RNA, 16 nt, Homo sapiens
cagagcuucuuccagg

SEQ ID NO: 1297811 - RNA, 18 nt, Homo sapiens
cagaggaguacaggugaa

SEQ ID NO: 1297812 - RNA, 19 nt, Homo sapiens
cagaggccaacacuguggg

SEQ ID NO: 1297813 - RNA, 14 nt, Homo sapiens
cagaggcugcagga

SEQ ID NO: 1297814 - RNA, 17 nt, Homo sapiens
cagaggcugcaggacuu

SEQ ID NO: 1297815 - RNA, 13 nt, Homo sapiens
cagaggucuccca

SEQ ID NO: 1297816 - RNA, 18 nt, Homo sapiens
cagaguacuggcugaugg

SEQ ID NO: 1297817 - RNA, 21 nt, Homo sapiens
cagaguauuggucuccucuca

SEQ ID NO: 1297818 - RNA, 13 nt, Homo sapiens
cagagucaucuga

SEQ ID NO: 1297819 - RNA, 17 nt, Homo sapiens
cagaguccucuaugaac

SEQ ID NO: 1297820 - RNA, 19 nt, Homo sapiens
cagagucucacuguugccc

SEQ ID NO: 1297821 - RNA, 22 nt, Homo sapiens
cagagugagacccagcccucau

SEQ ID NO: 1297822 - RNA, 23 nt, Homo sapiens
cagagugagacccagcccucauc

SEQ ID NO: 1297823 - RNA, 11 nt, Homo sapiens
cagagugcaag

SEQ ID NO: 1297824 - RNA, 24 nt, Homo sapiens
cagaguggggaugacaugcacuca

SEQ ID NO: 1297825 - RNA, 17 nt, Homo sapiens
cagaguuccccaugcag

SEQ ID NO: 1297826 - RNA, 14 nt, Homo sapiens
cagauaacugagga

SEQ ID NO: 1297827 - RNA, 13 nt, Homo sapiens
cagauaauagcaa

SEQ ID NO: 1297828 - RNA, 19 nt, Homo sapiens
cagauacauaucuguguau

SEQ ID NO: 1297829 - RNA, 20 nt, Homo sapiens
cagaucugacaugauuccuu

SEQ ID NO: 1297830 - RNA, 16 nt, Homo sapiens
cagaugcuuuacaguc

SEQ ID NO: 1297831 - RNA, 22 nt, Homo sapiens
cagaugggcauaugugucagug

SEQ ID NO: 1297832 - RNA, 15 nt, Homo sapiens
cagauucacacuguc

SEQ ID NO: 1297833 - RNA, 19 nt, Homo sapiens
cagauugcaacaggcuggg

SEQ ID NO: 1297834 - RNA, 20 nt, Homo sapiens
cagauugucuuauuacagca

SEQ ID NO: 1297835 - RNA, 16 nt, Homo sapiens
cagauuugcauuucag

SEQ ID NO: 1297836 - RNA, 19 nt, Homo sapiens
cagauuuuaacagcucucu

SEQ ID NO: 1297837 - RNA, 13 nt, Homo sapiens
cagcaacaggaau

SEQ ID NO: 1297838 - RNA, 15 nt, Homo sapiens
cagcaaccuauaaaa

SEQ ID NO: 1297839 - RNA, 17 nt, Homo sapiens
cagcaaggaaagcucac

SEQ ID NO: 1297840 - RNA, 12 nt, Homo sapiens
cagcacagccaa

SEQ ID NO: 1297841 - RNA, 17 nt, Homo sapiens
cagcacccccagugcag

SEQ ID NO: 1297842 - RNA, 13 nt, Homo sapiens
cagcacuuugcaa

SEQ ID NO: 1297843 - RNA, 13 nt, Homo sapiens
cagcaggugcuga

SEQ ID NO: 1297844 - RNA, 13 nt, Homo sapiens
cagcaucccuuga

SEQ ID NO: 1297845 - RNA, 14 nt, Homo sapiens
cagcauuuccacac

SEQ ID NO: 1297846 - RNA, 15 nt, Homo sapiens
cagcauuugauaaaa

SEQ ID NO: 1297847 - RNA, 22 nt, Homo sapiens
cagccaaccuaauuaccuguau

SEQ ID NO: 1297848 - RNA, 15 nt, Homo sapiens
cagccaacuuuugca

SEQ ID NO: 1297849 - RNA, 14 nt, Homo sapiens
cagccacaacugca

SEQ ID NO: 1297850 - RNA, 20 nt, Homo sapiens
cagccacaucgccugagauu

SEQ ID NO: 1297851 - RNA, 13 nt, Homo sapiens
cagccacauucua

SEQ ID NO: 1297852 - RNA, 16 nt, Homo sapiens
cagccaccccugagau

SEQ ID NO: 1297853 - RNA, 20 nt, Homo sapiens
cagccaggaaauagcgguga

SEQ ID NO: 1297854 - RNA, 12 nt, Homo sapiens
cagccagugacc

SEQ ID NO: 1297855 - RNA, 13 nt, Homo sapiens
cagccaucaaggg

SEQ ID NO: 1297856 - RNA, 15 nt, Homo sapiens
cagccaucaagggaa

SEQ ID NO: 1297857 - RNA, 19 nt, Homo sapiens
cagcccaagcuucccucca

SEQ ID NO: 1297858 - RNA, 23 nt, Homo sapiens
cagcccauggugagcucugggaa

SEQ ID NO: 1297859 - RNA, 21 nt, Homo sapiens
cagccccucucccugugcugu

SEQ ID NO: 1297860 - RNA, 21 nt, Homo sapiens
cagcccuacaacaaccugaag

SEQ ID NO: 1297861 - RNA, 17 nt, Homo sapiens
cagccucagcucucagu

SEQ ID NO: 1297862 - RNA, 22 nt, Homo sapiens
cagccucagcugggaacaugug

SEQ ID NO: 1297863 - RNA, 16 nt, Homo sapiens
cagccuccaauguaca

SEQ ID NO: 1297864 - RNA, 17 nt, Homo sapiens
cagccuccaauguacaa

SEQ ID NO: 1297865 - RNA, 19 nt, Homo sapiens
cagccuccaauguacaacu

SEQ ID NO: 1297866 - RNA, 20 nt, Homo sapiens
cagccucccaaguagcugag

SEQ ID NO: 1297867 - RNA, 20 nt, Homo sapiens
cagccucccgaguagcuggg

SEQ ID NO: 1297868 - RNA, 23 nt, Homo sapiens
cagccucccgaguagcugggauu

SEQ ID NO: 1297869 - RNA, 18 nt, Homo sapiens
cagccucccugaagccuu

SEQ ID NO: 1297870 - RNA, 22 nt, Homo sapiens
cagccucugaaaaccaauguuc

SEQ ID NO: 1297871 - RNA, 19 nt, Homo sapiens
cagccugaccaacaucgug

SEQ ID NO: 1297872 - RNA, 15 nt, Homo sapiens
cagccugcuuucaca

SEQ ID NO: 1297873 - RNA, 22 nt, Homo sapiens
cagccuggccaagagaccagcc

SEQ ID NO: 1297874 - RNA, 21 nt, Homo sapiens
cagccuggccaguauggugaa

SEQ ID NO: 1297875 - RNA, 22 nt, Homo sapiens
cagccuggcugguccccaaggc

SEQ ID NO: 1297876 - RNA, 19 nt, Homo sapiens
cagccugggugacagagca

SEQ ID NO: 1297877 - RNA, 21 nt, Homo sapiens
cagccuggucaacauggugaa

SEQ ID NO: 1297878 - RNA, 14 nt, Homo sapiens
cagccuugccagag

SEQ ID NO: 1297879 - RNA, 17 nt, Homo sapiens
caaugugaacuuuauua

SEQ ID NO: 1297880 - RNA, 21 nt, Homo sapiens
caauuaaucaaaccacuguua

SEQ ID NO: 1297881 - RNA, 14 nt, Homo sapiens
caauuaauguagcu

SEQ ID NO: 1297882 - RNA, 23 nt, Homo sapiens
caauuauaucaguccucuuucaa

SEQ ID NO: 1297883 - RNA, 13 nt, Homo sapiens
caauuauguuaaa

SEQ ID NO: 1297884 - RNA, 22 nt, Homo sapiens
caauuuagaaaaagaacaugca

SEQ ID NO: 1297885 - RNA, 14 nt, Homo sapiens
caauuucagacucc

SEQ ID NO: 1297886 - RNA, 23 nt, Homo sapiens
caauuucccccuaaaccaacuga

SEQ ID NO: 1297887 - RNA, 16 nt, Homo sapiens
caauuugcugccaaac

SEQ ID NO: 1297888 - RNA, 20 nt, Homo sapiens
caauuuuucaagagcuccuu

SEQ ID NO: 1297889 - RNA, 15 nt, Homo sapiens
cacaaaacagccuuu

SEQ ID NO: 1297890 - RNA, 17 nt, Homo sapiens
cacaaagaccaaaauga

SEQ ID NO: 1297891 - RNA, 18 nt, Homo sapiens
cacaaagcucaagaugac

SEQ ID NO: 1297892 - RNA, 15 nt, Homo sapiens
cacaagcaugaagug

SEQ ID NO: 1297893 - RNA, 16 nt, Homo sapiens
cacaaggacuuccugu

SEQ ID NO: 1297894 - RNA, 16 nt, Homo sapiens
cacaaguggaccuuag

SEQ ID NO: 1297895 - RNA, 23 nt, Homo sapiens
cacaaugcauaaugucuuuaaaa

SEQ ID NO: 1297896 - RNA, 17 nt, Homo sapiens
cacacaaaagggaaccc

SEQ ID NO: 1297897 - RNA, 17 nt, Homo sapiens
cacacagaggggaguca

SEQ ID NO: 1297898 - RNA, 22 nt, Homo sapiens
cacacagcuacucuccccacga

SEQ ID NO: 1297899 - RNA, 16 nt, Homo sapiens
cacacaucuguggaga

SEQ ID NO: 1297900 - RNA, 18 nt, Homo sapiens
cacaccaaguaccaguau

SEQ ID NO: 1297901 - RNA, 15 nt, Homo sapiens
cacacccaauuccac

SEQ ID NO: 1297902 - RNA, 15 nt, Homo sapiens
cacaccccucaaaaa

SEQ ID NO: 1297903 - RNA, 20 nt, Homo sapiens
cacaccccucaaaaaaagcc

SEQ ID NO: 1297904 - RNA, 14 nt, Homo sapiens
cacacgcgugcaca

SEQ ID NO: 1297905 - RNA, 16 nt, Homo sapiens
cacacuguaaauauga

SEQ ID NO: 1297906 - RNA, 12 nt, Homo sapiens
cacagaacugcu

SEQ ID NO: 1297907 - RNA, 17 nt, Homo sapiens
cacagaagguccuggug

SEQ ID NO: 1297908 - RNA, 14 nt, Homo sapiens
cacagaaugugaua

SEQ ID NO: 1297909 - RNA, 18 nt, Homo sapiens
cacagagaaggcuaugua

SEQ ID NO: 1297910 - RNA, 17 nt, Homo sapiens
cacagauguucccccau

SEQ ID NO: 1297911 - RNA, 14 nt, Homo sapiens
cacagcaucuguag

SEQ ID NO: 1297912 - RNA, 21 nt, Homo sapiens
cacagcccugcagugcccuag

SEQ ID NO: 1297913 - RNA, 19 nt, Homo sapiens
cacagcguccuguccacac

SEQ ID NO: 1297914 - RNA, 20 nt, Homo sapiens
cacagcucccauaaccgcug

SEQ ID NO: 1297915 - RNA, 22 nt, Homo sapiens
cacagcuucugcagcagacugu

SEQ ID NO: 1297916 - RNA, 14 nt, Homo sapiens
cacaggaguguccu

SEQ ID NO: 1297917 - RNA, 22 nt, Homo sapiens
cacaggaugaaggcaaugccau

SEQ ID NO: 1297918 - RNA, 23 nt, Homo sapiens
cacaggaugaaggcaaugccauc

SEQ ID NO: 1297919 - RNA, 14 nt, Homo sapiens
cacaggcccggcuc

SEQ ID NO: 1297920 - RNA, 19 nt, Homo sapiens
cacaggccugagauuucau

SEQ ID NO: 1297921 - RNA, 14 nt, Homo sapiens
cacagggacuugaa

SEQ ID NO: 1297922 - RNA, 16 nt, Homo sapiens
cacaguaagucauuua

SEQ ID NO: 1297923 - RNA, 16 nt, Homo sapiens
cacagucaauucugau

SEQ ID NO: 1297924 - RNA, 19 nt, Homo sapiens
cacagugaucgaugauuca

SEQ ID NO: 1297925 - RNA, 22 nt, Homo sapiens
cacauaguagguacccaauuca

SEQ ID NO: 1297926 - RNA, 16 nt, Homo sapiens
cacaucuaaccucauc

SEQ ID NO: 1297927 - RNA, 13 nt, Homo sapiens
cacaucuagugag

SEQ ID NO: 1297928 - RNA, 19 nt, Homo sapiens
cacaucucugcuugaguca

SEQ ID NO: 1297929 - RNA, 14 nt, Homo sapiens
cacaucuugcucug

SEQ ID NO: 1297930 - RNA, 19 nt, Homo sapiens
cacaugagaagugauaaaa

SEQ ID NO: 1297931 - RNA, 14 nt, Homo sapiens
cacaugcacgugug

SEQ ID NO: 1297932 - RNA, 17 nt, Homo sapiens
cacaugccaagcacugu

SEQ ID NO: 1297933 - RNA, 18 nt, Homo sapiens
cacaugccaagcacugug

SEQ ID NO: 1297934 - RNA, 17 nt, Homo sapiens
cacaugcccaugaugag

SEQ ID NO: 1297935 - RNA, 17 nt, Homo sapiens
cacauuggaacagugaa

SEQ ID NO: 1297936 - RNA, 23 nt, Homo sapiens
cacauuuuuauaaaaaugagugc

SEQ ID NO: 1297937 - RNA, 20 nt, Homo sapiens
caccaagcagcaacagcaaa

SEQ ID NO: 1297938 - RNA, 22 nt, Homo sapiens
caccaaguaccaguauaagcau

SEQ ID NO: 1297939 - RNA, 14 nt, Homo sapiens
caccacacacacac

SEQ ID NO: 1297940 - RNA, 14 nt, Homo sapiens
caccacaugugcac

SEQ ID NO: 1297941 - RNA, 21 nt, Homo sapiens
caccacgcagaccaccagcau

SEQ ID NO: 1297942 - RNA, 15 nt, Homo sapiens
caccacgucacuuca

SEQ ID NO: 1297943 - RNA, 20 nt, Homo sapiens
caccagagauaauaugagaa

SEQ ID NO: 1297944 - RNA, 19 nt, Homo sapiens
caccagccagaggaugcau

SEQ ID NO: 1297945 - RNA, 16 nt, Homo sapiens
caccauaaaaaggaau

SEQ ID NO: 1297946 - RNA, 21 nt, Homo sapiens
cacccaagagggcugcuuccc

SEQ ID NO: 1297947 - RNA, 21 nt, Homo sapiens
cacccaaguugaagacuuugu

SEQ ID NO: 1297948 - RNA, 13 nt, Homo sapiens
cacccaauuccac

SEQ ID NO: 1297949 - RNA, 14 nt, Homo sapiens
cacccacccaggag

SEQ ID NO: 1297950 - RNA, 16 nt, Homo sapiens
cacccagacuggagug

SEQ ID NO: 1297951 - RNA, 19 nt, Homo sapiens
cacccagcccccacauccu

SEQ ID NO: 1297952 - RNA, 20 nt, Homo sapiens
cacccaugugcacaagugug

SEQ ID NO: 1297953 - RNA, 16 nt, Homo sapiens
cacccccuuguuguaa

SEQ ID NO: 1297954 - RNA, 15 nt, Homo sapiens
cacccugaaagcccu

SEQ ID NO: 1297955 - RNA, 19 nt, Homo sapiens
cacccugcaggacuugcca

SEQ ID NO: 1297956 - RNA, 21 nt, Homo sapiens
cacccuuccccuccuucuccc

SEQ ID NO: 1297957 - RNA, 17 nt, Homo sapiens
caccguucugugcacaa

SEQ ID NO: 1297958 - RNA, 12 nt, Homo sapiens
caccuaauccag

SEQ ID NO: 1297959 - RNA, 23 nt, Homo sapiens
caccuaccuuagaaaacaaguau

SEQ ID NO: 1297960 - RNA, 12 nt, Homo sapiens
caccuacuccag

SEQ ID NO: 1297961 - RNA, 14 nt, Homo sapiens
caccucauucugaa

SEQ ID NO: 1297962 - RNA, 16 nt, Homo sapiens
caccugggcugaggca

SEQ ID NO: 1297963 - RNA, 15 nt, Homo sapiens
caccuggguguuaca

SEQ ID NO: 1297964 - RNA, 12 nt, Homo sapiens
caccuguaggca

SEQ ID NO: 1297965 - RNA, 12 nt, Homo sapiens
caccuguggcca

SEQ ID NO: 1297966 - RNA, 19 nt, Homo sapiens
caccuuaauaugcugcaac

SEQ ID NO: 1297967 - RNA, 22 nt, Homo sapiens
caccuugcgauucugcagccac

SEQ ID NO: 1297968 - RNA, 16 nt, Homo sapiens
caccuuggcaccagac

SEQ ID NO: 1297969 - RNA, 22 nt, Homo sapiens
caccuuggcaccagacacccag

SEQ ID NO: 1297970 - RNA, 20 nt, Homo sapiens
caccuuggcuuguuauugcc

SEQ ID NO: 1297971 - RNA, 23 nt, Homo sapiens
caccuuucauaaucuuugcuuua

SEQ ID NO: 1297972 - RNA, 17 nt, Homo sapiens
caccuuuuauugacaca

SEQ ID NO: 1297973 - RNA, 19 nt, Homo sapiens
caccuuuuuucaacaguga

SEQ ID NO: 1297974 - RNA, 19 nt, Homo sapiens
cacgauugguaugaugcug

SEQ ID NO: 1297975 - RNA, 13 nt, Homo sapiens
cacgccuguaauc

SEQ ID NO: 1297976 - RNA, 16 nt, Homo sapiens
cacgccuguaauccca

SEQ ID NO: 1297977 - RNA, 13 nt, Homo sapiens
cacgcgugcacac

SEQ ID NO: 1297978 - RNA, 23 nt, Homo sapiens
cacggagcucacccaugugcaca

SEQ ID NO: 1297979 - RNA, 16 nt, Homo sapiens
cacggcaaaaugucau

SEQ ID NO: 1297980 - RNA, 18 nt, Homo sapiens
cacggcguuguaccugua

SEQ ID NO: 1297981 - RNA, 22 nt, Homo sapiens
cacuaaauucuagaaaguacuu

SEQ ID NO: 1297982 - RNA, 18 nt, Homo sapiens
cacuaauggggcggugag

SEQ ID NO: 1297983 - RNA, 19 nt, Homo sapiens
cacuaauuuauaacuauua

SEQ ID NO: 1297984 - RNA, 22 nt, Homo sapiens
cacuaccauugcuguucuacuu

SEQ ID NO: 1297985 - RNA, 13 nt, Homo sapiens
cacuacucaguga

SEQ ID NO: 1297986 - RNA, 16 nt, Homo sapiens
cacuagacaagccaga

SEQ ID NO: 1297987 - RNA, 18 nt, Homo sapiens
cacuaucccauuugcccu

SEQ ID NO: 1297988 - RNA, 21 nt, Homo sapiens
cacucacauuuauucugcuca

SEQ ID NO: 1297989 - RNA, 16 nt, Homo sapiens
cacucaggcuggagua

SEQ ID NO: 1297990 - RNA, 18 nt, Homo sapiens
cacucauccccucacuug

SEQ ID NO: 1297991 - RNA, 23 nt, Homo sapiens
cacuccgagaggugggccagucu

SEQ ID NO: 1297992 - RNA, 20 nt, Homo sapiens
cacuccuucucucacugugu

SEQ ID NO: 1297993 - RNA, 15 nt, Homo sapiens
cacuccuuuuuugca

SEQ ID NO: 1297994 - RNA, 19 nt, Homo sapiens
cacuccuuuuuugcaugug

SEQ ID NO: 1297995 - RNA, 18 nt, Homo sapiens
cacucuguugguagcaau

SEQ ID NO: 1297996 - RNA, 15 nt, Homo sapiens
cacugacaguuaaua

SEQ ID NO: 1297997 - RNA, 22 nt, Homo sapiens
cacugacccauagagggcuccu

SEQ ID NO: 1297998 - RNA, 16 nt, Homo sapiens
cacugagcaauguaua

SEQ ID NO: 1297999 - RNA, 20 nt, Homo sapiens
cacugagcuauaacuuacuu

SEQ ID NO: 1298000 - RNA, 15 nt, Homo sapiens
cacugauaaaaccau

SEQ ID NO: 1298001 - RNA, 19 nt, Homo sapiens
cacugcacuauagccuagg

SEQ ID NO: 1298002 - RNA, 17 nt, Homo sapiens
cacugcagaaacccuga

SEQ ID NO: 1298003 - RNA, 14 nt, Homo sapiens
cacugcagccacag

SEQ ID NO: 1298004 - RNA, 19 nt, Homo sapiens
cacugcaggcaucacagcu

SEQ ID NO: 1298005 - RNA, 13 nt, Homo sapiens
cacugcauacaau

SEQ ID NO: 1298006 - RNA, 13 nt, Homo sapiens
cacugcauaccaa

SEQ ID NO: 1298007 - RNA, 14 nt, Homo sapiens
cacugcauaccaac

SEQ ID NO: 1298008 - RNA, 21 nt, Homo sapiens
cacugccagggguucuugagc

SEQ ID NO: 1298009 - RNA, 13 nt, Homo sapiens
cacugccugaugg

SEQ ID NO: 1298010 - RNA, 20 nt, Homo sapiens
cacugcguacaaacauccaa

SEQ ID NO: 1298011 - RNA, 14 nt, Homo sapiens
cacuggaaaguuua

SEQ ID NO: 1298012 - RNA, 17 nt, Homo sapiens
cacugggcccugagcca

SEQ ID NO: 1298013 - RNA, 14 nt, Homo sapiens
caagguaaaaaggu

SEQ ID NO: 1298014 - RNA, 21 nt, Homo sapiens
caaguauacuagggagccauu

SEQ ID NO: 1298015 - RNA, 18 nt, Homo sapiens
caagucaugugcauuucc

SEQ ID NO: 1298016 - RNA, 17 nt, Homo sapiens
caagugaaaaacaucca

SEQ ID NO: 1298017 - RNA, 18 nt, Homo sapiens
caagugaaaaacauccag

SEQ ID NO: 1298018 - RNA, 15 nt, Homo sapiens
caagugauccuccca

SEQ ID NO: 1298019 - RNA, 16 nt, Homo sapiens
caagugccaagacaca

SEQ ID NO: 1298020 - RNA, 13 nt, Homo sapiens
caauaaugcagua

SEQ ID NO: 1298021 - RNA, 14 nt, Homo sapiens
caauaauuucaggu

SEQ ID NO: 1298022 - RNA, 12 nt, Homo sapiens
caauagucaaaa

SEQ ID NO: 1298023 - RNA, 16 nt, Homo sapiens
caauauuaacauaaga

SEQ ID NO: 1298024 - RNA, 15 nt, Homo sapiens
caauauugacuuugu

SEQ ID NO: 1298025 - RNA, 15 nt, Homo sapiens
caaucaacagaaaag

SEQ ID NO: 1298026 - RNA, 16 nt, Homo sapiens
caauccagcuauguua

SEQ ID NO: 1298027 - RNA, 18 nt, Homo sapiens
caauccagcuauguuaua

SEQ ID NO: 1298028 - RNA, 13 nt, Homo sapiens
caauccuauguuu

SEQ ID NO: 1298029 - RNA, 16 nt, Homo sapiens
caaucugugucauaua

SEQ ID NO: 1298030 - RNA, 17 nt, Homo sapiens
caaugaauccccaauaa

SEQ ID NO: 1298031 - RNA, 16 nt, Homo sapiens
caaugaggcugcuuau

SEQ ID NO: 1298032 - RNA, 13 nt, Homo sapiens
caaugcauaaugu

SEQ ID NO: 1298033 - RNA, 12 nt, Homo sapiens
caaugcugaggu

SEQ ID NO: 1298034 - RNA, 23 nt, Homo sapiens
acgugauguggagggcacauucc

SEQ ID NO: 1298035 - RNA, 19 nt, Homo sapiens
acgugggcaaacaggcagu

SEQ ID NO: 1298036 - RNA, 18 nt, Homo sapiens
acuaaacacgugacacaa

SEQ ID NO: 1298037 - RNA, 16 nt, Homo sapiens
acuaaaugacuuucaa

SEQ ID NO: 1298038 - RNA, 18 nt, Homo sapiens
acuaaauuugaacuuaaa

SEQ ID NO: 1298039 - RNA, 14 nt, Homo sapiens
acuaacuucuccaa

SEQ ID NO: 1298040 - RNA, 17 nt, Homo sapiens
acuaaggugugcucuga

SEQ ID NO: 1298041 - RNA, 22 nt, Homo sapiens
acuaauggcaugagaaauacaa

SEQ ID NO: 1298042 - RNA, 19 nt, Homo sapiens
acuaauuauacuacuuugu

SEQ ID NO: 1298043 - RNA, 19 nt, Homo sapiens
acuaauuuauaacuauuau

SEQ ID NO: 1298044 - RNA, 15 nt, Homo sapiens
acuaauuuuacaugu

SEQ ID NO: 1298045 - RNA, 15 nt, Homo sapiens
acuacaaacuucaaa

SEQ ID NO: 1298046 - RNA, 21 nt, Homo sapiens
acuaccauugcuguucuacuu

SEQ ID NO: 1298047 - RNA, 14 nt, Homo sapiens
acuacuucuauuca

SEQ ID NO: 1298048 - RNA, 15 nt, Homo sapiens
acuagacaaguccag

SEQ ID NO: 1298049 - RNA, 17 nt, Homo sapiens
acuagcagcugcaguca

SEQ ID NO: 1298050 - RNA, 17 nt, Homo sapiens
acuagcuaaaccagaaa

SEQ ID NO: 1298051 - RNA, 20 nt, Homo sapiens
acuaggcccccacuugccuc

SEQ ID NO: 1298052 - RNA, 15 nt, Homo sapiens
acuagggagccaugu

SEQ ID NO: 1298053 - RNA, 11 nt, Homo sapiens
acuagggccaa

SEQ ID NO: 1298054 - RNA, 19 nt, Homo sapiens
acuagguuaccgcuuauca

SEQ ID NO: 1298055 - RNA, 22 nt, Homo sapiens
acuauagccuaggugacagagu

SEQ ID NO: 1298056 - RNA, 19 nt, Homo sapiens
acuauauuuauacuguaua

SEQ ID NO: 1298057 - RNA, 17 nt, Homo sapiens
acuaucuacucuccuca

SEQ ID NO: 1298058 - RNA, 20 nt, Homo sapiens
acuaugcaaauauggaauag

SEQ ID NO: 1298059 - RNA, 22 nt, Homo sapiens
acuaugcauggugccccaggac

SEQ ID NO: 1298060 - RNA, 22 nt, Homo sapiens
acuaugcccaaccuauccuguu

SEQ ID NO: 1298061 - RNA, 14 nt, Homo sapiens
acuaugucuagagc

SEQ ID NO: 1298062 - RNA, 19 nt, Homo sapiens
acuauuaacaugauguacu

SEQ ID NO: 1298063 - RNA, 18 nt, Homo sapiens
acucaaagaaaacugucu

SEQ ID NO: 1298064 - RNA, 22 nt, Homo sapiens
acucaaagaaaacugucuggga

SEQ ID NO: 1298065 - RNA, 16 nt, Homo sapiens
agcugugcccugacca

SEQ ID NO: 1298066 - RNA, 13 nt, Homo sapiens
agcuguucagcug

SEQ ID NO: 1298067 - RNA, 12 nt, Homo sapiens
agcuguucucug

SEQ ID NO: 1298068 - RNA, 21 nt, Homo sapiens
agcuuaagaauuuacaguucc

SEQ ID NO: 1298069 - RNA, 14 nt, Homo sapiens
agcuuagaaugcau

SEQ ID NO: 1298070 - RNA, 14 nt, Homo sapiens
agcuuaucucaggg

SEQ ID NO: 1298071 - RNA, 14 nt, Homo sapiens
agcuucaacccuca

SEQ ID NO: 1298072 - RNA, 20 nt, Homo sapiens
agcuuccuguccucccagcu

SEQ ID NO: 1298073 - RNA, 15 nt, Homo sapiens
agcuucucauccugc

SEQ ID NO: 1298074 - RNA, 12 nt, Homo sapiens
agcuucuuguuu

SEQ ID NO: 1298075 - RNA, 20 nt, Homo sapiens
agcuugucaaugauuucaaa

SEQ ID NO: 1298076 - RNA, 14 nt, Homo sapiens
agcuuuauuucaaa

SEQ ID NO: 1298077 - RNA, 17 nt, Homo sapiens
agcuuucucuaguucaa

SEQ ID NO: 1298078 - RNA, 23 nt, Homo sapiens
agcuuuuaggaaaggcugaugau

SEQ ID NO: 1298079 - RNA, 19 nt, Homo sapiens
agggucuuguguugcaagu

SEQ ID NO: 1298080 - RNA, 16 nt, Homo sapiens
agggugagggccuucu

SEQ ID NO: 1298081 - RNA, 13 nt, Homo sapiens
agggugagugcaa

SEQ ID NO: 1298082 - RNA, 13 nt, Homo sapiens
aggguggucucaa

SEQ ID NO: 1298083 - RNA, 23 nt, Homo sapiens
aggguuaacccuucaucuuccug

SEQ ID NO: 1298084 - RNA, 22 nt, Homo sapiens
aggguuuuaguuuuuaauuuau

SEQ ID NO: 1298085 - RNA, 14 nt, Homo sapiens
agguaaaagcauca

SEQ ID NO: 1298086 - RNA, 14 nt, Homo sapiens
agguacauccauga

SEQ ID NO: 1298087 - RNA, 20 nt, Homo sapiens
agguagcugccccuggcucu

SEQ ID NO: 1298088 - RNA, 12 nt, Homo sapiens
aggucacugcua

SEQ ID NO: 1298089 - RNA, 13 nt, Homo sapiens
aggucuccaaaau

SEQ ID NO: 1298090 - RNA, 23 nt, Homo sapiens
aggucugaaucccgacucugaua

SEQ ID NO: 1298091 - RNA, 17 nt, Homo sapiens
aggucuggcggcuccau

SEQ ID NO: 1298092 - RNA, 14 nt, Homo sapiens
aggugaaacccagu

SEQ ID NO: 1298093 - RNA, 15 nt, Homo sapiens
aggugaacagucacg

SEQ ID NO: 1298094 - RNA, 21 nt, Homo sapiens
aggugaagguaugagaauuaa

SEQ ID NO: 1298095 - RNA, 19 nt, Homo sapiens
aggugacaaugucccccau

SEQ ID NO: 1298096 - RNA, 18 nt, Homo sapiens
aggugcuggagcacuggg

SEQ ID NO: 1298097 - RNA, 10 nt, Homo sapiens
aggugucuga

SEQ ID NO: 1298098 - RNA, 12 nt, Homo sapiens
agguuccaguga

SEQ ID NO: 1298099 - RNA, 14 nt, Homo sapiens
agguucugagauaa

SEQ ID NO: 1298100 - RNA, 19 nt, Homo sapiens
agguuggagcccagggcau

SEQ ID NO: 1298101 - RNA, 14 nt, Homo sapiens
agguuggcaaaaag

SEQ ID NO: 1298102 - RNA, 15 nt, Homo sapiens
agguuuacauuguca

SEQ ID NO: 1298103 - RNA, 20 nt, Homo sapiens
agguuuccucuuagguguua

SEQ ID NO: 1298104 - RNA, 17 nt, Homo sapiens
agguuuuacacuugcau

SEQ ID NO: 1298105 - RNA, 23 nt, Homo sapiens
agguuuuauucucuaaauaccau

SEQ ID NO: 1298106 - RNA, 21 nt, Homo sapiens
agguuuugagcauggguucau

SEQ ID NO: 1298107 - RNA, 22 nt, Homo sapiens
agguuuuuggucugacccacug

SEQ ID NO: 1298108 - RNA, 21 nt, Homo sapiens
agguuuuuuugucaacauugu

SEQ ID NO: 1298109 - RNA, 15 nt, Homo sapiens
aguaacauguguuaa

SEQ ID NO: 1298110 - RNA, 21 nt, Homo sapiens
aguaacauuaacucaguggaa

SEQ ID NO: 1298111 - RNA, 22 nt, Homo sapiens
aguaacccccacuggacugacc

SEQ ID NO: 1298112 - RNA, 13 nt, Homo sapiens
aguaagcaucuac

SEQ ID NO: 1298113 - RNA, 15 nt, Homo sapiens
aguaagccucaucau

SEQ ID NO: 1298114 - RNA, 19 nt, Homo sapiens
aguaauauagcugagacua

SEQ ID NO: 1298115 - RNA, 18 nt, Homo sapiens
aguacaguggugccauca

SEQ ID NO: 1298116 - RNA, 22 nt, Homo sapiens
aguacuguaacugugucaugau

SEQ ID NO: 1298117 - RNA, 18 nt, Homo sapiens
aguagagggcacuggguc

SEQ ID NO: 1298118 - RNA, 23 nt, Homo sapiens
aguagcagggggggaaaugcauu

SEQ ID NO: 1298119 - RNA, 12 nt, Homo sapiens
aguagcugcuac

SEQ ID NO: 1298120 - RNA, 20 nt, Homo sapiens
aguaggaaaagcaaugcuuu

SEQ ID NO: 1298121 - RNA, 15 nt, Homo sapiens
aguauaaauuuacuu

SEQ ID NO: 1298122 - RNA, 18 nt, Homo sapiens
aguauaagcaucugccau

SEQ ID NO: 1298123 - RNA, 13 nt, Homo sapiens
aguauaauuugcu

SEQ ID NO: 1298124 - RNA, 22 nt, Homo sapiens
aguauaugaauuacccuuucau

SEQ ID NO: 1298125 - RNA, 16 nt, Homo sapiens
aguauauuaauaucau

SEQ ID NO: 1298126 - RNA, 12 nt, Homo sapiens
aguaugcaaaag

SEQ ID NO: 1298127 - RNA, 14 nt, Homo sapiens
aguaugcuugcucu

SEQ ID NO: 1298128 - RNA, 18 nt, Homo sapiens
aguauggugaaacccugu

SEQ ID NO: 1298129 - RNA, 22 nt, Homo sapiens
aguauugaauacuuacauucuc

SEQ ID NO: 1298130 - RNA, 15 nt, Homo sapiens
aguauugcaugcuca

SEQ ID NO: 1298131 - RNA, 15 nt, Homo sapiens
aguauuguggcugca

SEQ ID NO: 1298132 - RNA, 21 nt, Homo sapiens
aguauuguuuggaggagcaaa

SEQ ID NO: 1298133 - RNA, 23 nt, Homo sapiens
aguauuugggaagugaagacugg

SEQ ID NO: 1298134 - RNA, 17 nt, Homo sapiens
agucaaaacuacaaauc

SEQ ID NO: 1298135 - RNA, 15 nt, Homo sapiens
agucaaauuuguaaa

SEQ ID NO: 1298136 - RNA, 14 nt, Homo sapiens
agucaacaguucaa

SEQ ID NO: 1298137 - RNA, 18 nt, Homo sapiens
agucaacucaacauggca

SEQ ID NO: 1298138 - RNA, 13 nt, Homo sapiens
agucacagccacc

SEQ ID NO: 1298139 - RNA, 15 nt, Homo sapiens
agucacaguucaaaa

SEQ ID NO: 1298140 - RNA, 17 nt, Homo sapiens
agucacaucucuuccuc

SEQ ID NO: 1298141 - RNA, 18 nt, Homo sapiens
agucaccauucugcauuu

SEQ ID NO: 1298142 - RNA, 21 nt, Homo sapiens
agucacgccugaaacuuugag

SEQ ID NO: 1298143 - RNA, 17 nt, Homo sapiens
agucacugacaguuaau

SEQ ID NO: 1298144 - RNA, 12 nt, Homo sapiens
agucaucuauag

SEQ ID NO: 1298145 - RNA, 14 nt, Homo sapiens
agucaucucaacca

SEQ ID NO: 1298146 - RNA, 18 nt, Homo sapiens
agucaucuugaccaagca

SEQ ID NO: 1298147 - RNA, 11 nt, Homo sapiens
agucauugcag

SEQ ID NO: 1298148 - RNA, 20 nt, Homo sapiens
aguccaauuccuugcacaua

SEQ ID NO: 1298149 - RNA, 19 nt, Homo sapiens
agucccaaaugucaucagg

SEQ ID NO: 1298150 - RNA, 23 nt, Homo sapiens
aguccccuucuuuuggcccuccg

SEQ ID NO: 1298151 - RNA, 20 nt, Homo sapiens
agucccuaaaaacacagaca

SEQ ID NO: 1298152 - RNA, 15 nt, Homo sapiens
agucccuuugugacu

SEQ ID NO: 1298153 - RNA, 21 nt, Homo sapiens
aguccgugggcuggcaguuug

SEQ ID NO: 1298154 - RNA, 18 nt, Homo sapiens
aguccucauuuacuggau

SEQ ID NO: 1298155 - RNA, 16 nt, Homo sapiens
aguccuggaaucacau

SEQ ID NO: 1298156 - RNA, 17 nt, Homo sapiens
aguccuguaugucuguc

SEQ ID NO: 1298157 - RNA, 19 nt, Homo sapiens
aguccuguaugucugucau

SEQ ID NO: 1298158 - RNA, 23 nt, Homo sapiens
aguccuguccugucccacucagg

SEQ ID NO: 1298159 - RNA, 15 nt, Homo sapiens
aguccuuugugaaua

SEQ ID NO: 1298160 - RNA, 23 nt, Homo sapiens
agucgccuccccucucugggcua

SEQ ID NO: 1298161 - RNA, 17 nt, Homo sapiens
agucuaaauuuucagag

SEQ ID NO: 1298162 - RNA, 11 nt, Homo sapiens
agucuauggcc

SEQ ID NO: 1298163 - RNA, 14 nt, Homo sapiens
agucuauggguuua

SEQ ID NO: 1298164 - RNA, 15 nt, Homo sapiens
agucucugccuugcc

SEQ ID NO: 1298165 - RNA, 17 nt, Homo sapiens
agucugauucccaagcu

SEQ ID NO: 1298166 - RNA, 13 nt, Homo sapiens
agucugcaaaaug

SEQ ID NO: 1298167 - RNA, 19 nt, Homo sapiens
agucuugcaguuaucuuag

SEQ ID NO: 1298168 - RNA, 15 nt, Homo sapiens
agugaaaaacaucca

SEQ ID NO: 1298169 - RNA, 16 nt, Homo sapiens
agugaaauacuguaca

SEQ ID NO: 1298170 - RNA, 21 nt, Homo sapiens
agugaacuugaaauauccugc

SEQ ID NO: 1298171 - RNA, 14 nt, Homo sapiens
agugaagacuggaa

SEQ ID NO: 1298172 - RNA, 19 nt, Homo sapiens
agugaagcugguggaacau

SEQ ID NO: 1298173 - RNA, 19 nt, Homo sapiens
agugaaugccagugugcug

SEQ ID NO: 1298174 - RNA, 20 nt, Homo sapiens
agugaauguaaaaugcaaaa

SEQ ID NO: 1298175 - RNA, 17 nt, Homo sapiens
agugaauuucacacugu

SEQ ID NO: 1298176 - RNA, 23 nt, Homo sapiens
agugacaaaauagacaauuugca

SEQ ID NO: 1298177 - RNA, 11 nt, Homo sapiens
agugacagagg

SEQ ID NO: 1298178 - RNA, 19 nt, Homo sapiens
agugacauaauauauucua

SEQ ID NO: 1298179 - RNA, 15 nt, Homo sapiens
agugacauguuuaca

SEQ ID NO: 1298180 - RNA, 21 nt, Homo sapiens
agugaccuggaaucagugaag

SEQ ID NO: 1298181 - RNA, 16 nt, Homo sapiens
agugacuaauggcaug

SEQ ID NO: 1298182 - RNA, 13 nt, Homo sapiens
agugagacccugu

SEQ ID NO: 1298183 - RNA, 12 nt, Homo sapiens
agugagcccaug

SEQ ID NO: 1298184 - RNA, 12 nt, Homo sapiens
agugauguaauc

SEQ ID NO: 1298185 - RNA, 16 nt, Homo sapiens
agugauuggcucugug

SEQ ID NO: 1298186 - RNA, 19 nt, Homo sapiens
agugcaagccccugcucca

SEQ ID NO: 1298187 - RNA, 20 nt, Homo sapiens
agugcacaacauuacaggga

SEQ ID NO: 1298188 - RNA, 20 nt, Homo sapiens
agugcacaggcgcaucccag

SEQ ID NO: 1298189 - RNA, 20 nt, Homo sapiens
agugcaguggugugaucuca

SEQ ID NO: 1298190 - RNA, 20 nt, Homo sapiens
agugcaugggacccacgaaa

SEQ ID NO: 1298191 - RNA, 12 nt, Homo sapiens
agugccaucuca

SEQ ID NO: 1298192 - RNA, 17 nt, Homo sapiens
agugccugccuaugaaa

SEQ ID NO: 1298193 - RNA, 23 nt, Homo sapiens
agugcugagcaagcaauguacac

SEQ ID NO: 1298194 - RNA, 21 nt, Homo sapiens
agugcugggauuacaggugug

SEQ ID NO: 1298195 - RNA, 13 nt, Homo sapiens
agugcugugcugu

SEQ ID NO: 1298196 - RNA, 22 nt, Homo sapiens
agugcuuguuccucucaucucc

SEQ ID NO: 1298197 - RNA, 22 nt, Homo sapiens
aguggaaagacagcuucucauc

SEQ ID NO: 1298198 - RNA, 15 nt, Homo sapiens
aguggaggcacuuua

SEQ ID NO: 1298199 - RNA, 16 nt, Homo sapiens
aguggauugcauuucu

SEQ ID NO: 1298200 - RNA, 18 nt, Homo sapiens
aguggcauuuccugguca

SEQ ID NO: 1298201 - RNA, 20 nt, Homo sapiens
aguggcuuggguucacagug

SEQ ID NO: 1298202 - RNA, 23 nt, Homo sapiens
agugggaaacaagaacacucgga

SEQ ID NO: 1298203 - RNA, 16 nt, Homo sapiens
agugguaguaauuucc

SEQ ID NO: 1298204 - RNA, 22 nt, Homo sapiens
aguggugcgaucucggcucagu

SEQ ID NO: 1298205 - RNA, 20 nt, Homo sapiens
uccagcucuuuccuccuucc

SEQ ID NO: 1298206 - RNA, 17 nt, Homo sapiens
uccagcuugccagaugc

SEQ ID NO: 1298207 - RNA, 19 nt, Homo sapiens
uccaggcuuaaaaucaguc

SEQ ID NO: 1298208 - RNA, 19 nt, Homo sapiens
uccagggcccccaucucau

SEQ ID NO: 1298209 - RNA, 19 nt, Homo sapiens
uccagggcuggacugaggc

SEQ ID NO: 1298210 - RNA, 18 nt, Homo sapiens
uccaggguccacaggaag

SEQ ID NO: 1298211 - RNA, 20 nt, Homo sapiens
uccagguaccuugaccuuug

SEQ ID NO: 1298212 - RNA, 18 nt, Homo sapiens
uccaguaggaaaagcaau

SEQ ID NO: 1298213 - RNA, 14 nt, Homo sapiens
uccaguucaaauaa

SEQ ID NO: 1298214 - RNA, 14 nt, Homo sapiens
uccaguucaucuau

SEQ ID NO: 1298215 - RNA, 20 nt, Homo sapiens
uccaucauaaccaccccagc

SEQ ID NO: 1298216 - RNA, 14 nt, Homo sapiens
uccauccucacugc

SEQ ID NO: 1298217 - RNA, 14 nt, Homo sapiens
uccaucuccaucca

SEQ ID NO: 1298218 - RNA, 15 nt, Homo sapiens
uccaugcauucaccu

SEQ ID NO: 1298219 - RNA, 17 nt, Homo sapiens
uccauggaagaaacaca

SEQ ID NO: 1298220 - RNA, 18 nt, Homo sapiens
uccaugggaccacaacua

SEQ ID NO: 1298221 - RNA, 15 nt, Homo sapiens
uccauucagugcagc

SEQ ID NO: 1298222 - RNA, 19 nt, Homo sapiens
uccauucccaagaugccug

SEQ ID NO: 1298223 - RNA, 15 nt, Homo sapiens
uccauuuacaaacua

SEQ ID NO: 1298224 - RNA, 16 nt, Homo sapiens
uccauuucucugggac

SEQ ID NO: 1298225 - RNA, 15 nt, Homo sapiens
uccauuugcuuuguc

SEQ ID NO: 1298226 - RNA, 19 nt, Homo sapiens
ucccaaaugagccaugaga

SEQ ID NO: 1298227 - RNA, 16 nt, Homo sapiens
ucccaaauuugauuga

SEQ ID NO: 1298228 - RNA, 19 nt, Homo sapiens
ucccaacgugcaaagccaa

SEQ ID NO: 1298229 - RNA, 23 nt, Homo sapiens
ucccaacuccucaugucuucuca

SEQ ID NO: 1298230 - RNA, 19 nt, Homo sapiens
ucccaaggugaaaugaagc

SEQ ID NO: 1298231 - RNA, 13 nt, Homo sapiens
ucccacacaagac

SEQ ID NO: 1298232 - RNA, 14 nt, Homo sapiens
ucccaccugcaucu

SEQ ID NO: 1298233 - RNA, 22 nt, Homo sapiens
ucccacguacuuauaaagaagg

SEQ ID NO: 1298234 - RNA, 15 nt, Homo sapiens
ucccacucaguccau

SEQ ID NO: 1298235 - RNA, 18 nt, Homo sapiens
ucccagacggucaggaaa

SEQ ID NO: 1298236 - RNA, 16 nt, Homo sapiens
ucccagagucaucuga

SEQ ID NO: 1298237 - RNA, 15 nt, Homo sapiens
ucccaggcucaagcu

SEQ ID NO: 1298238 - RNA, 14 nt, Homo sapiens
ucccaggcugaggc

SEQ ID NO: 1298239 - RNA, 15 nt, Homo sapiens
ucccaugcacaagau

SEQ ID NO: 1298240 - RNA, 22 nt, Homo sapiens
ucccaugugauuuaaacaaaca

SEQ ID NO: 1298241 - RNA, 13 nt, Homo sapiens
ucccauugccaug

SEQ ID NO: 1298242 - RNA, 21 nt, Homo sapiens
ucccauuugcccuccuccuca

SEQ ID NO: 1298243 - RNA, 16 nt, Homo sapiens
uccccaaccacuucau

SEQ ID NO: 1298244 - RNA, 21 nt, Homo sapiens
uccccaaccucccccaggugc

SEQ ID NO: 1298245 - RNA, 18 nt, Homo sapiens
uccccacuucugugccac

SEQ ID NO: 1298246 - RNA, 20 nt, Homo sapiens
uccccagccccuuggaugug

SEQ ID NO: 1298247 - RNA, 20 nt, Homo sapiens
uccccauucgguguggugca

SEQ ID NO: 1298248 - RNA, 20 nt, Homo sapiens
ucccccaucccccacugcca

SEQ ID NO: 1298249 - RNA, 17 nt, Homo sapiens
ucccccuaaaccaacug

SEQ ID NO: 1298250 - RNA, 16 nt, Homo sapiens
ucccccuaagucuuuc

SEQ ID NO: 1298251 - RNA, 21 nt, Homo sapiens
uccccgcagugugcacuaagg

SEQ ID NO: 1298252 - RNA, 14 nt, Homo sapiens
uccccuaaaccaaa

SEQ ID NO: 1298253 - RNA, 15 nt, Homo sapiens
uccccuaaaccaaaa

SEQ ID NO: 1298254 - RNA, 16 nt, Homo sapiens
uccccuaaaccaaaaa

SEQ ID NO: 1298255 - RNA, 17 nt, Homo sapiens
uccccucagagugcaag

SEQ ID NO: 1298256 - RNA, 16 nt, Homo sapiens
uccccuccaaccuggg

SEQ ID NO: 1298257 - RNA, 15 nt, Homo sapiens
uccccucucugcugc

SEQ ID NO: 1298258 - RNA, 18 nt, Homo sapiens
uccccucuuccucucuuc

SEQ ID NO: 1298259 - RNA, 17 nt, Homo sapiens
uccccucuucugagcua

SEQ ID NO: 1298260 - RNA, 14 nt, Homo sapiens
ucccgaguaccagu

SEQ ID NO: 1298261 - RNA, 23 nt, Homo sapiens
ucccgaguagggaggaccacagg

SEQ ID NO: 1298262 - RNA, 20 nt, Homo sapiens
ucccuaaaaacacagacauu

SEQ ID NO: 1298263 - RNA, 14 nt, Homo sapiens
ucccuaaugcucac

SEQ ID NO: 1298264 - RNA, 23 nt, Homo sapiens
ucccucaccuuggcaccagacac

SEQ ID NO: 1298265 - RNA, 18 nt, Homo sapiens
ucccucacuguugaauuu

SEQ ID NO: 1298266 - RNA, 18 nt, Homo sapiens
ucccucccccccaugcac

SEQ ID NO: 1298267 - RNA, 22 nt, Homo sapiens
ucccucccccccaugcacugug

SEQ ID NO: 1298268 - RNA, 15 nt, Homo sapiens
ucccucuacagguca

SEQ ID NO: 1298269 - RNA, 14 nt, Homo sapiens
ucccugacuguaaa

SEQ ID NO: 1298270 - RNA, 17 nt, Homo sapiens
ucccugaggauggguca

SEQ ID NO: 1298271 - RNA, 19 nt, Homo sapiens
ucccugcgccugugaugcu

SEQ ID NO: 1298272 - RNA, 21 nt, Homo sapiens
ucccugcuuaaaaauguagca

SEQ ID NO: 1298273 - RNA, 22 nt, Homo sapiens
ucccuguacaguagauuuucca

SEQ ID NO: 1298274 - RNA, 15 nt, Homo sapiens
ucccuuuaugcaccc

SEQ ID NO: 1298275 - RNA, 13 nt, Homo sapiens
ucccuuucuuccc

SEQ ID NO: 1298276 - RNA, 16 nt, Homo sapiens
ucccuuuggagaugcu

SEQ ID NO: 1298277 - RNA, 20 nt, Homo sapiens
ucccuuuuacauacugcugu

SEQ ID NO: 1298278 - RNA, 16 nt, Homo sapiens
uccgagauccaccaga

SEQ ID NO: 1298279 - RNA, 17 nt, Homo sapiens
uccgagauccaccagau

SEQ ID NO: 1298280 - RNA, 13 nt, Homo sapiens
uccgggaucaaag

SEQ ID NO: 1298281 - RNA, 18 nt, Homo sapiens
uccgugaaggugaccuca

SEQ ID NO: 1298282 - RNA, 15 nt, Homo sapiens
uccgugcuaugacau

SEQ ID NO: 1298283 - RNA, 22 nt, Homo sapiens
uccgugcugacagcugcuccua

SEQ ID NO: 1298284 - RNA, 17 nt, Homo sapiens
uccguuccacauccaca

SEQ ID NO: 1298285 - RNA, 18 nt, Homo sapiens
uccuaaaaguguaagaaa

SEQ ID NO: 1298286 - RNA, 12 nt, Homo sapiens
uccuaacuacag

SEQ ID NO: 1298287 - RNA, 19 nt, Homo sapiens
uccuacagcuaacccucac

SEQ ID NO: 1298288 - RNA, 22 nt, Homo sapiens
uccuacuccaguaugacagagg

SEQ ID NO: 1298289 - RNA, 19 nt, Homo sapiens
uccuacuuauaaaguagaa

SEQ ID NO: 1298290 - RNA, 20 nt, Homo sapiens
uccuagauggcagucacuga

SEQ ID NO: 1298291 - RNA, 21 nt, Homo sapiens
uccuagauguuuccccagacc

SEQ ID NO: 1298292 - RNA, 18 nt, Homo sapiens
uccuaggcauuugcugaa

SEQ ID NO: 1298293 - RNA, 15 nt, Homo sapiens
uccuauguaacugca

SEQ ID NO: 1298294 - RNA, 12 nt, Homo sapiens
uccuaugugauu

SEQ ID NO: 1298295 - RNA, 14 nt, Homo sapiens
uccucaauccagcu

SEQ ID NO: 1298296 - RNA, 11 nt, Homo sapiens
uccucacuccc

SEQ ID NO: 1298297 - RNA, 18 nt, Homo sapiens
uccucaguuaaguguuuc

SEQ ID NO: 1298298 - RNA, 17 nt, Homo sapiens
uccucauaaacauuuga

SEQ ID NO: 1298299 - RNA, 19 nt, Homo sapiens
uccucauuucuccagauua

SEQ ID NO: 1298300 - RNA, 16 nt, Homo sapiens
uccuccaacaccaagc

SEQ ID NO: 1298301 - RNA, 18 nt, Homo sapiens
uccuccagaauggagcug

SEQ ID NO: 1298302 - RNA, 15 nt, Homo sapiens
uccucccaccucagc

SEQ ID NO: 1298303 - RNA, 19 nt, Homo sapiens
uccucuccccagcaaguga

SEQ ID NO: 1298304 - RNA, 15 nt, Homo sapiens
uccucugaaacagcu

SEQ ID NO: 1298305 - RNA, 19 nt, Homo sapiens
uccucugaaacagcugccu

SEQ ID NO: 1298306 - RNA, 10 nt, Homo sapiens
uccucugcau

SEQ ID NO: 1298307 - RNA, 22 nt, Homo sapiens
uccucuggguaggaaucagcaa

SEQ ID NO: 1298308 - RNA, 16 nt, Homo sapiens
uccucuucucaaagcu

SEQ ID NO: 1298309 - RNA, 21 nt, Homo sapiens
uccucuugcaguuguucuuua

SEQ ID NO: 1298310 - RNA, 16 nt, Homo sapiens
uccucuuguugcugag

SEQ ID NO: 1298311 - RNA, 13 nt, Homo sapiens
ucagaauagccac

SEQ ID NO: 1298312 - RNA, 13 nt, Homo sapiens
ucagacaggcaaa

SEQ ID NO: 1298313 - RNA, 16 nt, Homo sapiens
ucagacauuggcaccu

SEQ ID NO: 1298314 - RNA, 13 nt, Homo sapiens
ucagacuugucaa

SEQ ID NO: 1298315 - RNA, 22 nt, Homo sapiens
ucagacuuuggaaaaugcauug

SEQ ID NO: 1298316 - RNA, 15 nt, Homo sapiens
ucagagaccauugca

SEQ ID NO: 1298317 - RNA, 13 nt, Homo sapiens
ucagagcagagua

SEQ ID NO: 1298318 - RNA, 10 nt, Homo sapiens
ucagagccag

SEQ ID NO: 1298319 - RNA, 22 nt, Homo sapiens
ucagagccagccggcuaugaaa

SEQ ID NO: 1298320 - RNA, 17 nt, Homo sapiens
ucagagccuuuccucaa

SEQ ID NO: 1298321 - RNA, 21 nt, Homo sapiens
ucagauaagguaaaaugccau

SEQ ID NO: 1298322 - RNA, 23 nt, Homo sapiens
ucagauaagguaaaaugccauga

SEQ ID NO: 1298323 - RNA, 18 nt, Homo sapiens
ucagauaccgacuggggc

SEQ ID NO: 1298324 - RNA, 15 nt, Homo sapiens
ucagauccagggaca

SEQ ID NO: 1298325 - RNA, 23 nt, Homo sapiens
ucagauuguggaauguuggauaa

SEQ ID NO: 1298326 - RNA, 19 nt, Homo sapiens
ucagcaauacagacuacuu

SEQ ID NO: 1298327 - RNA, 19 nt, Homo sapiens
ucagcaguaucaaggcuga

SEQ ID NO: 1298328 - RNA, 15 nt, Homo sapiens
ucagcauuuaaucca

SEQ ID NO: 1298329 - RNA, 19 nt, Homo sapiens
ucagcauuuccacaccaag

SEQ ID NO: 1298330 - RNA, 23 nt, Homo sapiens
ucagcauuuucuucucugcacuu

SEQ ID NO: 1298331 - RNA, 18 nt, Homo sapiens
ucagccaauuauguuaaa

SEQ ID NO: 1298332 - RNA, 14 nt, Homo sapiens
ucagccacauucua

SEQ ID NO: 1298333 - RNA, 18 nt, Homo sapiens
ucagccaggugaacugga

SEQ ID NO: 1298334 - RNA, 14 nt, Homo sapiens
ucagccucccaaag

SEQ ID NO: 1298335 - RNA, 19 nt, Homo sapiens
ucagccucccgaauagcug

SEQ ID NO: 1298336 - RNA, 21 nt, Homo sapiens
ucagccuugccagagauccaa

SEQ ID NO: 1298337 - RNA, 21 nt, Homo sapiens
ucagcucacgcuucacaguga

SEQ ID NO: 1298338 - RNA, 13 nt, Homo sapiens
ucagcucugggcc

SEQ ID NO: 1298339 - RNA, 21 nt, Homo sapiens
ucagcugaucugauucuacca

SEQ ID NO: 1298340 - RNA, 15 nt, Homo sapiens
ucaggaaaacuacag

SEQ ID NO: 1298341 - RNA, 13 nt, Homo sapiens
ucaggaacacccc

SEQ ID NO: 1298342 - RNA, 18 nt, Homo sapiens
ucaggaauguggcugcaa

SEQ ID NO: 1298343 - RNA, 14 nt, Homo sapiens
ucaggacagaugcc

SEQ ID NO: 1298344 - RNA, 17 nt, Homo sapiens
ucaggagcuugcaagaa

SEQ ID NO: 1298345 - RNA, 18 nt, Homo sapiens
ucaggaguuccuaaccag

SEQ ID NO: 1298346 - RNA, 16 nt, Homo sapiens
ucaggaucacugggcu

SEQ ID NO: 1298347 - RNA, 22 nt, Homo sapiens
ucagggcauugccugugacuga

SEQ ID NO: 1298348 - RNA, 22 nt, Homo sapiens
ucaggugucccugcacuugcag

SEQ ID NO: 1298349 - RNA, 22 nt, Homo sapiens
ucagguuugaggguuugcagaa

SEQ ID NO: 1298350 - RNA, 18 nt, Homo sapiens
ucaguaagacgacaagga

SEQ ID NO: 1298351 - RNA, 22 nt, Homo sapiens
ucagucacagccaccccugaga

SEQ ID NO: 1298352 - RNA, 13 nt, Homo sapiens
ucagucauaauca

SEQ ID NO: 1298353 - RNA, 20 nt, Homo sapiens
ucagucccuaaaaacacaga

SEQ ID NO: 1298354 - RNA, 14 nt, Homo sapiens
ucaguccucuuuca

SEQ ID NO: 1298355 - RNA, 22 nt, Homo sapiens
ucagucugaugagaacucugag

SEQ ID NO: 1298356 - RNA, 18 nt, Homo sapiens
ucagugaauaaaccauca

SEQ ID NO: 1298357 - RNA, 14 nt, Homo sapiens
ucagugcaggagag

SEQ ID NO: 1298358 - RNA, 12 nt, Homo sapiens
ucagugcugcuc

SEQ ID NO: 1298359 - RNA, 17 nt, Homo sapiens
ucagugguggucuucaa

SEQ ID NO: 1298360 - RNA, 16 nt, Homo sapiens
ucaguggugucuguga

SEQ ID NO: 1298361 - RNA, 17 nt, Homo sapiens
ucaguguaccauuugcc

SEQ ID NO: 1298362 - RNA, 15 nt, Homo sapiens
ucaguguuaaaugug

SEQ ID NO: 1298363 - RNA, 13 nt, Homo sapiens
ucaguuacucuga

SEQ ID NO: 1298364 - RNA, 21 nt, Homo sapiens
ucauaaaaaaaugucaaggaa

SEQ ID NO: 1298365 - RNA, 22 nt, Homo sapiens
ucauaaaaauacaacagugcau

SEQ ID NO: 1298366 - RNA, 15 nt, Homo sapiens
ucauaaacauuugag

SEQ ID NO: 1298367 - RNA, 16 nt, Homo sapiens
ucauaaguuggaccag

SEQ ID NO: 1298368 - RNA, 20 nt, Homo sapiens
ucauacauuaucucacuugu

SEQ ID NO: 1298369 - RNA, 20 nt, Homo sapiens
ucauacccaccaggaugugu

SEQ ID NO: 1298370 - RNA, 14 nt, Homo sapiens
ucauauacugccuu

SEQ ID NO: 1298371 - RNA, 20 nt, Homo sapiens
ucauaugaaaggugccaugg

SEQ ID NO: 1298372 - RNA, 14 nt, Homo sapiens
ucaucaggugcaua

SEQ ID NO: 1298373 - RNA, 22 nt, Homo sapiens
ucaucaguccauugcucuugag

SEQ ID NO: 1298374 - RNA, 16 nt, Homo sapiens
ucaucauucccucuca

SEQ ID NO: 1298375 - RNA, 18 nt, Homo sapiens
ucauccaaugcucaagaa

SEQ ID NO: 1298376 - RNA, 13 nt, Homo sapiens
ucauccaucacag

SEQ ID NO: 1298377 - RNA, 15 nt, Homo sapiens
ucauccaucacagau

SEQ ID NO: 1298378 - RNA, 14 nt, Homo sapiens
ucauccgcacugua

SEQ ID NO: 1298379 - RNA, 14 nt, Homo sapiens
ucauccuagcaaau

SEQ ID NO: 1298380 - RNA, 13 nt, Homo sapiens
ucauccugcaggc

SEQ ID NO: 1298381 - RNA, 17 nt, Homo sapiens
ucaucguaaacauacuu

SEQ ID NO: 1298382 - RNA, 13 nt, Homo sapiens
ucaucuauaguug

SEQ ID NO: 1298383 - RNA, 13 nt, Homo sapiens
ucaucucaaggaa

SEQ ID NO: 1298384 - RNA, 18 nt, Homo sapiens
ucaucucccaccuagcag

SEQ ID NO: 1298385 - RNA, 21 nt, Homo sapiens
ucaucugaaggggcaaauucu

SEQ ID NO: 1298386 - RNA, 17 nt, Homo sapiens
ucaucugcaugucuacu

SEQ ID NO: 1298387 - RNA, 23 nt, Homo sapiens
ucaucugugauucccuccugcua

SEQ ID NO: 1298388 - RNA, 19 nt, Homo sapiens
ucaucuuggucacauacaa

SEQ ID NO: 1298389 - RNA, 15 nt, Homo sapiens
ucaugaaauaugcau

SEQ ID NO: 1298390 - RNA, 18 nt, Homo sapiens
ucaugaaucugcaaugug

SEQ ID NO: 1298391 - RNA, 19 nt, Homo sapiens
ucaugaauuuauugcacau

SEQ ID NO: 1298392 - RNA, 15 nt, Homo sapiens
ucaugacagccagag

SEQ ID NO: 1298393 - RNA, 16 nt, Homo sapiens
ucaugagccugcugga

SEQ ID NO: 1298394 - RNA, 24 nt, Homo sapiens
ucaugcaaaggcugggaccacgug

SEQ ID NO: 1298395 - RNA, 13 nt, Homo sapiens
ucaugcccugugc

SEQ ID NO: 1298396 - RNA, 16 nt, Homo sapiens
ucaugcggacccucac

SEQ ID NO: 1298397 - RNA, 14 nt, Homo sapiens
ucaugcuucacuua

SEQ ID NO: 1298398 - RNA, 17 nt, Homo sapiens
ucaugggaauauucaaa

SEQ ID NO: 1298399 - RNA, 14 nt, Homo sapiens
ucauguaaacauac

SEQ ID NO: 1298400 - RNA, 14 nt, Homo sapiens
ucaugucuauucca

SEQ ID NO: 1298401 - RNA, 14 nt, Homo sapiens
ucauucagccuuua

SEQ ID NO: 1298402 - RNA, 21 nt, Homo sapiens
ucauuccagaauucauucccc

SEQ ID NO: 1298403 - RNA, 17 nt, Homo sapiens
ucauucccucucaucuc

SEQ ID NO: 1298404 - RNA, 22 nt, Homo sapiens
ucauucccucucaucucaggua

SEQ ID NO: 1298405 - RNA, 13 nt, Homo sapiens
ucauucuacugaa

SEQ ID NO: 1298406 - RNA, 18 nt, Homo sapiens
ucauucuagaaacaggaa

SEQ ID NO: 1298407 - RNA, 17 nt, Homo sapiens
ucauuucauguauaguu

SEQ ID NO: 1298408 - RNA, 14 nt, Homo sapiens
ucauuucucuauga

SEQ ID NO: 1298409 - RNA, 19 nt, Homo sapiens
ucauuuguuuacauuugau

SEQ ID NO: 1298410 - RNA, 17 nt, Homo sapiens
ucauuuuauaugucaaa

SEQ ID NO: 1298411 - RNA, 13 nt, Homo sapiens
ucauuuugcacug

SEQ ID NO: 1298412 - RNA, 18 nt, Homo sapiens
uccaaaacuaaauuugaa

SEQ ID NO: 1298413 - RNA, 18 nt, Homo sapiens
uccaaaacucuuucauaa

SEQ ID NO: 1298414 - RNA, 18 nt, Homo sapiens
uccaaaauaaagcauaaa

SEQ ID NO: 1298415 - RNA, 21 nt, Homo sapiens
uccaaagagaagggcacugua

SEQ ID NO: 1298416 - RNA, 23 nt, Homo sapiens
uccaaagaguagaauugcauuga

SEQ ID NO: 1298417 - RNA, 16 nt, Homo sapiens
uccaaauaauuccaca

SEQ ID NO: 1298418 - RNA, 17 nt, Homo sapiens
uccaaccugcaaagauc

SEQ ID NO: 1298419 - RNA, 14 nt, Homo sapiens
uccaagaccagaga

SEQ ID NO: 1298420 - RNA, 18 nt, Homo sapiens
uccaagcaagacugaggg

SEQ ID NO: 1298421 - RNA, 14 nt, Homo sapiens
uccaagccacugag

SEQ ID NO: 1298422 - RNA, 13 nt, Homo sapiens
uauuaccauguaa

SEQ ID NO: 1298423 - RNA, 14 nt, Homo sapiens
uauuaccauguaaa

SEQ ID NO: 1298424 - RNA, 20 nt, Homo sapiens
uauuacugggacugugcuca

SEQ ID NO: 1298425 - RNA, 14 nt, Homo sapiens
uauuagaauuucau

SEQ ID NO: 1298426 - RNA, 11 nt, Homo sapiens
uauuagcaaac

SEQ ID NO: 1298427 - RNA, 14 nt, Homo sapiens
uauuauauuugaca

SEQ ID NO: 1298428 - RNA, 19 nt, Homo sapiens
uauucagacaaaauggaua

SEQ ID NO: 1298429 - RNA, 19 nt, Homo sapiens
uauucccuucuaaccugaa

SEQ ID NO: 1298430 - RNA, 15 nt, Homo sapiens
uauucuaaaaccauu

SEQ ID NO: 1298431 - RNA, 13 nt, Homo sapiens
uauucuuuacuau

SEQ ID NO: 1298432 - RNA, 15 nt, Homo sapiens
uauugccucuuucac

SEQ ID NO: 1298433 - RNA, 16 nt, Homo sapiens
uauugccucuuucaca

SEQ ID NO: 1298434 - RNA, 14 nt, Homo sapiens
uauugcgcugcuac

SEQ ID NO: 1298435 - RNA, 15 nt, Homo sapiens
uauuggcacugcuaa

SEQ ID NO: 1298436 - RNA, 22 nt, Homo sapiens
uauugggguuggaacauuucag

SEQ ID NO: 1298437 - RNA, 18 nt, Homo sapiens
uauuguaaaaaauucaca

SEQ ID NO: 1298438 - RNA, 19 nt, Homo sapiens
uauuguaaaaaauucacau

SEQ ID NO: 1298439 - RNA, 18 nt, Homo sapiens
uauuguaggcucccccuc

SEQ ID NO: 1298440 - RNA, 21 nt, Homo sapiens
uauugucgguuaccucugcau

SEQ ID NO: 1298441 - RNA, 14 nt, Homo sapiens
uauuguggugccac

SEQ ID NO: 1298442 - RNA, 20 nt, Homo sapiens
uauuguuccuuaucaccugc

SEQ ID NO: 1298443 - RNA, 19 nt, Homo sapiens
uauuuaacagugcaaaagg

SEQ ID NO: 1298444 - RNA, 13 nt, Homo sapiens
uauuuaacaugua

SEQ ID NO: 1298445 - RNA, 21 nt, Homo sapiens
uauuuacugagcuucucugug

SEQ ID NO: 1298446 - RNA, 19 nt, Homo sapiens
uauuuagaaauagaacuac

SEQ ID NO: 1298447 - RNA, 23 nt, Homo sapiens
uauuucaaauuguuuucagugaa

SEQ ID NO: 1298448 - RNA, 20 nt, Homo sapiens
uauuucaugggaauauucaa

SEQ ID NO: 1298449 - RNA, 19 nt, Homo sapiens
uauuuccauucaacaagag

SEQ ID NO: 1298450 - RNA, 20 nt, Homo sapiens
uauuucuucuucacauccau

SEQ ID NO: 1298451 - RNA, 22 nt, Homo sapiens
uauuuuaagaauuucacaagcu

SEQ ID NO: 1298452 - RNA, 22 nt, Homo sapiens
uauuuuccuucuuuguuucccc

SEQ ID NO: 1298453 - RNA, 22 nt, Homo sapiens
uauuuuugcugaaacccaauga

SEQ ID NO: 1298454 - RNA, 20 nt, Homo sapiens
uauuuuuucuugcaaauacc

SEQ ID NO: 1298455 - RNA, 15 nt, Homo sapiens
ucaaaaaucuguccg

SEQ ID NO: 1298456 - RNA, 17 nt, Homo sapiens
ucaaaagcugguggugu

SEQ ID NO: 1298457 - RNA, 14 nt, Homo sapiens
ucaaacuacuggca

SEQ ID NO: 1298458 - RNA, 20 nt, Homo sapiens
ucaaagacauagaugugaaa

SEQ ID NO: 1298459 - RNA, 16 nt, Homo sapiens
ucaaagacugugaaca

SEQ ID NO: 1298460 - RNA, 15 nt, Homo sapiens
ucaaagaugacuuga

SEQ ID NO: 1298461 - RNA, 15 nt, Homo sapiens
ucaaaggcacaguga

SEQ ID NO: 1298462 - RNA, 22 nt, Homo sapiens
ucaaaguucugggacuacaggc

SEQ ID NO: 1298463 - RNA, 20 nt, Homo sapiens
ucaaauaagcuaauauacag

SEQ ID NO: 1298464 - RNA, 23 nt, Homo sapiens
ucaaaugcucagaccagcucuuc

SEQ ID NO: 1298465 - RNA, 12 nt, Homo sapiens
ucaaaugcuuag

SEQ ID NO: 1298466 - RNA, 20 nt, Homo sapiens
ucaaauggaagacacauuga

SEQ ID NO: 1298467 - RNA, 20 nt, Homo sapiens
ucaaauggggccagauccag

SEQ ID NO: 1298468 - RNA, 18 nt, Homo sapiens
ucaaauuccaaggaacua

SEQ ID NO: 1298469 - RNA, 13 nt, Homo sapiens
ucaacaguucaaa

SEQ ID NO: 1298470 - RNA, 19 nt, Homo sapiens
ucaacaucuuuuacauucu

SEQ ID NO: 1298471 - RNA, 15 nt, Homo sapiens
ucaaccaaugccaaa

SEQ ID NO: 1298472 - RNA, 18 nt, Homo sapiens
ucaaccaaugccaaaaaa

SEQ ID NO: 1298473 - RNA, 20 nt, Homo sapiens
ucaacgcucccagacgguca

SEQ ID NO: 1298474 - RNA, 22 nt, Homo sapiens
ucaacuuggugacacucuauaa

SEQ ID NO: 1298475 - RNA, 23 nt, Homo sapiens
ucaagaaauaaaaggaagccaaa

SEQ ID NO: 1298476 - RNA, 22 nt, Homo sapiens
ucaagaacaugaugggccugaa

SEQ ID NO: 1298477 - RNA, 16 nt, Homo sapiens
ucaagagagauuugau

SEQ ID NO: 1298478 - RNA, 17 nt, Homo sapiens
ucaagaugacagcucuu

SEQ ID NO: 1298479 - RNA, 18 nt, Homo sapiens
ucaagaugagagaacugg

SEQ ID NO: 1298480 - RNA, 13 nt, Homo sapiens
ucaagcaauccuc

SEQ ID NO: 1298481 - RNA, 20 nt, Homo sapiens
ucaagcagccaagggaugaa

SEQ ID NO: 1298482 - RNA, 12 nt, Homo sapiens
ucaagcauuuag

SEQ ID NO: 1298483 - RNA, 15 nt, Homo sapiens
ucaagccauuccaaa

SEQ ID NO: 1298484 - RNA, 15 nt, Homo sapiens
ucaagcuguccuccc

SEQ ID NO: 1298485 - RNA, 19 nt, Homo sapiens
ucaaggaaaggccugaaag

SEQ ID NO: 1298486 - RNA, 18 nt, Homo sapiens
ucaaggccuucaguuuau

SEQ ID NO: 1298487 - RNA, 17 nt, Homo sapiens
ucaagguuuguucaaca

SEQ ID NO: 1298488 - RNA, 16 nt, Homo sapiens
ucaaguuauacaucuu

SEQ ID NO: 1298489 - RNA, 18 nt, Homo sapiens
ucaaguuguuugucaaug

SEQ ID NO: 1298490 - RNA, 14 nt, Homo sapiens
ucaauaaagcacug

SEQ ID NO: 1298491 - RNA, 19 nt, Homo sapiens
ucaauagcaccccuacuca

SEQ ID NO: 1298492 - RNA, 13 nt, Homo sapiens
ucaauccaagagu

SEQ ID NO: 1298493 - RNA, 20 nt, Homo sapiens
ucaauccaagagucugauga

SEQ ID NO: 1298494 - RNA, 12 nt, Homo sapiens
ucaauccagcua

SEQ ID NO: 1298495 - RNA, 24 nt, Homo sapiens
ucaaugaagccagcucacagugcu

SEQ ID NO: 1298496 - RNA, 18 nt, Homo sapiens
ucaauggaaacaucacug

SEQ ID NO: 1298497 - RNA, 15 nt, Homo sapiens
ucaauuuugacuuaa

SEQ ID NO: 1298498 - RNA, 19 nt, Homo sapiens
ucacaaacuuuuauacucu

SEQ ID NO: 1298499 - RNA, 14 nt, Homo sapiens
ucacaaauacauaa

SEQ ID NO: 1298500 - RNA, 13 nt, Homo sapiens
ucacaacagugaa

SEQ ID NO: 1298501 - RNA, 19 nt, Homo sapiens
ucacaaccacucauucaaa

SEQ ID NO: 1298502 - RNA, 13 nt, Homo sapiens
ucacaagcaugaa

SEQ ID NO: 1298503 - RNA, 15 nt, Homo sapiens
ucacacacacaaaaa

SEQ ID NO: 1298504 - RNA, 12 nt, Homo sapiens
ucacacuguaaa

SEQ ID NO: 1298505 - RNA, 12 nt, Homo sapiens
ucacagcacuag

SEQ ID NO: 1298506 - RNA, 20 nt, Homo sapiens
ucacagccaccccugagauc

SEQ ID NO: 1298507 - RNA, 14 nt, Homo sapiens
ucacagccucugaa

SEQ ID NO: 1298508 - RNA, 18 nt, Homo sapiens
ucacagcuaacaauugug

SEQ ID NO: 1298509 - RNA, 17 nt, Homo sapiens
ucacaggugucagccau

SEQ ID NO: 1298510 - RNA, 20 nt, Homo sapiens
ucacaguccuggacuccugc

SEQ ID NO: 1298511 - RNA, 23 nt, Homo sapiens
ucacauuggcuauuuaaagacaa

SEQ ID NO: 1298512 - RNA, 21 nt, Homo sapiens
ucaccaaaagacacugcagaa

SEQ ID NO: 1298513 - RNA, 17 nt, Homo sapiens
ucaccacaaacuguaau

SEQ ID NO: 1298514 - RNA, 16 nt, Homo sapiens
ucaccacaugugcaca

SEQ ID NO: 1298515 - RNA, 14 nt, Homo sapiens
ucaccacucaaaaa

SEQ ID NO: 1298516 - RNA, 18 nt, Homo sapiens
ucaccaucggcaggcagu

SEQ ID NO: 1298517 - RNA, 22 nt, Homo sapiens
ucaccauggcccccucaucaua

SEQ ID NO: 1298518 - RNA, 19 nt, Homo sapiens
ucaccauguauuuuguaaa

SEQ ID NO: 1298519 - RNA, 13 nt, Homo sapiens
ucaccauguugcc

SEQ ID NO: 1298520 - RNA, 20 nt, Homo sapiens
ucaccauuuggcaaugccau

SEQ ID NO: 1298521 - RNA, 17 nt, Homo sapiens
ucacccacaauugccuu

SEQ ID NO: 1298522 - RNA, 17 nt, Homo sapiens
ucacccccuccuucaua

SEQ ID NO: 1298523 - RNA, 17 nt, Homo sapiens
ucaccccucacugugac

SEQ ID NO: 1298524 - RNA, 14 nt, Homo sapiens
ucaccucuugccuu

SEQ ID NO: 1298525 - RNA, 16 nt, Homo sapiens
ucaccucuugccuucu

SEQ ID NO: 1298526 - RNA, 17 nt, Homo sapiens
ucaccugggcugugaug

SEQ ID NO: 1298527 - RNA, 22 nt, Homo sapiens
ucaccuggggcugcuggccuga

SEQ ID NO: 1298528 - RNA, 18 nt, Homo sapiens
ucaccuguuugaaaccaa

SEQ ID NO: 1298529 - RNA, 12 nt, Homo sapiens
ucaccuuauuca

SEQ ID NO: 1298530 - RNA, 15 nt, Homo sapiens
ucaccuuggggccuu

SEQ ID NO: 1298531 - RNA, 18 nt, Homo sapiens
ucaccuuuguagcacuca

SEQ ID NO: 1298532 - RNA, 21 nt, Homo sapiens
ucacgaggaaaagagaaggaa

SEQ ID NO: 1298533 - RNA, 20 nt, Homo sapiens
ucacgccucuguguucagga

SEQ ID NO: 1298534 - RNA, 19 nt, Homo sapiens
ucacgccuguaaucccagc

SEQ ID NO: 1298535 - RNA, 16 nt, Homo sapiens
ucacggcucacugcag

SEQ ID NO: 1298536 - RNA, 15 nt, Homo sapiens
ucacuacucagugau

SEQ ID NO: 1298537 - RNA, 23 nt, Homo sapiens
ucacuccuuuuuugcaugugcaa

SEQ ID NO: 1298538 - RNA, 18 nt, Homo sapiens
ucacugaguuuuccaugg

SEQ ID NO: 1298539 - RNA, 23 nt, Homo sapiens
ucacugaugggaaaacugccaau

SEQ ID NO: 1298540 - RNA, 14 nt, Homo sapiens
ucacugcauccuca

SEQ ID NO: 1298541 - RNA, 23 nt, Homo sapiens
ucacugccagagauaaacuaaug

SEQ ID NO: 1298542 - RNA, 14 nt, Homo sapiens
ucacugguugcacu

SEQ ID NO: 1298543 - RNA, 12 nt, Homo sapiens
ucacuguaaaau

SEQ ID NO: 1298544 - RNA, 23 nt, Homo sapiens
ucacuucacagcccugcagugcc

SEQ ID NO: 1298545 - RNA, 12 nt, Homo sapiens
ucacuucacccu

SEQ ID NO: 1298546 - RNA, 18 nt, Homo sapiens
ucacuuccaagagccuuu

SEQ ID NO: 1298547 - RNA, 21 nt, Homo sapiens
ucacuucuaggguaugggaaa

SEQ ID NO: 1298548 - RNA, 14 nt, Homo sapiens
ucacuucucuuccu

SEQ ID NO: 1298549 - RNA, 16 nt, Homo sapiens
ucacuucucuuccuug

SEQ ID NO: 1298550 - RNA, 13 nt, Homo sapiens
ucagaaagccaac

SEQ ID NO: 1298551 - RNA, 13 nt, Homo sapiens
ucagaacaaggua

SEQ ID NO: 1298552 - RNA, 17 nt, Homo sapiens
ucagaacagacaaucac

SEQ ID NO: 1298553 - RNA, 16 nt, Homo sapiens
ucagaacagccaggua

SEQ ID NO: 1298554 - RNA, 22 nt, Homo sapiens
ucagaacccuuggcuugcccac

SEQ ID NO: 1298555 - RNA, 22 nt, Homo sapiens
ucagaagacacugaugggcaac

SEQ ID NO: 1298556 - RNA, 19 nt, Homo sapiens
ucagaagaccccugacuca

SEQ ID NO: 1298557 - RNA, 21 nt, Homo sapiens
uagcaacuuguguuacaaaaa

SEQ ID NO: 1298558 - RNA, 21 nt, Homo sapiens
uagcaaguugguaaauucaca

SEQ ID NO: 1298559 - RNA, 14 nt, Homo sapiens
uagcagacaggccc

SEQ ID NO: 1298560 - RNA, 10 nt, Homo sapiens
uagcagagua

SEQ ID NO: 1298561 - RNA, 22 nt, Homo sapiens
uagcagcaccguucugugcaca

SEQ ID NO: 1298562 - RNA, 16 nt, Homo sapiens
uagcaggcacaggaca

SEQ ID NO: 1298563 - RNA, 18 nt, Homo sapiens
uagcagggaaacagcuaa

SEQ ID NO: 1298564 - RNA, 18 nt, Homo sapiens
uagcauacgguaugauau

SEQ ID NO: 1298565 - RNA, 17 nt, Homo sapiens
uagcauaucugccuuua

SEQ ID NO: 1298566 - RNA, 14 nt, Homo sapiens
uagcaugcugugau

SEQ ID NO: 1298567 - RNA, 14 nt, Homo sapiens
uagccacagcaguu

SEQ ID NO: 1298568 - RNA, 21 nt, Homo sapiens
uagccacauacuagcaucuua

SEQ ID NO: 1298569 - RNA, 18 nt, Homo sapiens
uagccagaggacugugau

SEQ ID NO: 1298570 - RNA, 21 nt, Homo sapiens
uagccagauuugucuuuuugu

SEQ ID NO: 1298571 - RNA, 18 nt, Homo sapiens
uagccagcacacagggca

SEQ ID NO: 1298572 - RNA, 20 nt, Homo sapiens
uagccagcacacagggcagu

SEQ ID NO: 1298573 - RNA, 22 nt, Homo sapiens
uagccaugugaaacucaucuca

SEQ ID NO: 1298574 - RNA, 18 nt, Homo sapiens
uagcccauaaggggucaa

SEQ ID NO: 1298575 - RNA, 18 nt, Homo sapiens
uagccgauaucagaauuu

SEQ ID NO: 1298576 - RNA, 18 nt, Homo sapiens
uagccuuagaagucacac

SEQ ID NO: 1298577 - RNA, 19 nt, Homo sapiens
uagcuaaacggauuccaaa

SEQ ID NO: 1298578 - RNA, 16 nt, Homo sapiens
uagcucuauguuuaca

SEQ ID NO: 1298579 - RNA, 13 nt, Homo sapiens
uagcugacuugca

SEQ ID NO: 1298580 - RNA, 18 nt, Homo sapiens
uagcugggacuacaggug

SEQ ID NO: 1298581 - RNA, 13 nt, Homo sapiens
uagcuuucaauuc

SEQ ID NO: 1298582 - RNA, 21 nt, Homo sapiens
uagcuuucaauuccguagcca

SEQ ID NO: 1298583 - RNA, 17 nt, Homo sapiens
uaggaaaaaaacuauua

SEQ ID NO: 1298584 - RNA, 16 nt, Homo sapiens
uaggaagagaaaccag

SEQ ID NO: 1298585 - RNA, 16 nt, Homo sapiens
uaggaagaucucugca

SEQ ID NO: 1298586 - RNA, 19 nt, Homo sapiens
uaggaagaugauggcucau

SEQ ID NO: 1298587 - RNA, 15 nt, Homo sapiens
uaggcaggacaugcu

SEQ ID NO: 1298588 - RNA, 12 nt, Homo sapiens
uaggcagggaag

SEQ ID NO: 1298589 - RNA, 12 nt, Homo sapiens
uaggcauacaag

SEQ ID NO: 1298590 - RNA, 12 nt, Homo sapiens
uaggcauguaaa

SEQ ID NO: 1298591 - RNA, 17 nt, Homo sapiens
uaggccccugcccugua

SEQ ID NO: 1298592 - RNA, 23 nt, Homo sapiens
uaggccucaacuccucccauaga

SEQ ID NO: 1298593 - RNA, 20 nt, Homo sapiens
uaggcucuuugucaucuuau

SEQ ID NO: 1298594 - RNA, 14 nt, Homo sapiens
uagggaaaaaccag

SEQ ID NO: 1298595 - RNA, 20 nt, Homo sapiens
uagguaggggcccacuucac

SEQ ID NO: 1298596 - RNA, 21 nt, Homo sapiens
uagguccagaaguccuuaugu

SEQ ID NO: 1298597 - RNA, 18 nt, Homo sapiens
uaggugcgcaguggcaug

SEQ ID NO: 1298598 - RNA, 19 nt, Homo sapiens
uaguaaagugauaauuucu

SEQ ID NO: 1298599 - RNA, 14 nt, Homo sapiens
uaguauacaaaaag

SEQ ID NO: 1298600 - RNA, 17 nt, Homo sapiens
uaguauggcacuugaug

SEQ ID NO: 1298601 - RNA, 12 nt, Homo sapiens
uaguauucauga

SEQ ID NO: 1298602 - RNA, 18 nt, Homo sapiens
uagucucaccuacuccag

SEQ ID NO: 1298603 - RNA, 13 nt, Homo sapiens
uagucuuugccag

SEQ ID NO: 1298604 - RNA, 18 nt, Homo sapiens
uagugaucacagcagcuu

SEQ ID NO: 1298605 - RNA, 14 nt, Homo sapiens
uagugauggagcuu

SEQ ID NO: 1298606 - RNA, 12 nt, Homo sapiens
uagugcagccaa

SEQ ID NO: 1298607 - RNA, 17 nt, Homo sapiens
uagugguuuuaggauac

SEQ ID NO: 1298608 - RNA, 17 nt, Homo sapiens
uaguuacuccagugcca

SEQ ID NO: 1298609 - RNA, 16 nt, Homo sapiens
uauaaaagcaaaagga

SEQ ID NO: 1298610 - RNA, 23 nt, Homo sapiens
uauaaagauacagaacucuuuca

SEQ ID NO: 1298611 - RNA, 15 nt, Homo sapiens
uauaaagcacaucuc

SEQ ID NO: 1298612 - RNA, 18 nt, Homo sapiens
uauaaauauauacagaua

SEQ ID NO: 1298613 - RNA, 22 nt, Homo sapiens
uauaaaugaauuugcauaccag

SEQ ID NO: 1298614 - RNA, 13 nt, Homo sapiens
uauaaaugugauu

SEQ ID NO: 1298615 - RNA, 21 nt, Homo sapiens
uauaaauuggagaugcaaaua

SEQ ID NO: 1298616 - RNA, 16 nt, Homo sapiens
uauaacgcaggccuuu

SEQ ID NO: 1298617 - RNA, 23 nt, Homo sapiens
uauaacuacuccggagacagggu

SEQ ID NO: 1298618 - RNA, 18 nt, Homo sapiens
uauaagauuccaaaaagc

SEQ ID NO: 1298619 - RNA, 16 nt, Homo sapiens
uauaagcaucugccau

SEQ ID NO: 1298620 - RNA, 13 nt, Homo sapiens
uauaauacuguau

SEQ ID NO: 1298621 - RNA, 14 nt, Homo sapiens
uauaauacuguauu

SEQ ID NO: 1298622 - RNA, 20 nt, Homo sapiens
uauaaucuuucaaaccagcu

SEQ ID NO: 1298623 - RNA, 16 nt, Homo sapiens
uauaauuggugcauag

SEQ ID NO: 1298624 - RNA, 21 nt, Homo sapiens
uauaauuuaaaauaugcucua

SEQ ID NO: 1298625 - RNA, 19 nt, Homo sapiens
uauacgcuggcaacacaga

SEQ ID NO: 1298626 - RNA, 22 nt, Homo sapiens
uauacugccuuguguucaguga

SEQ ID NO: 1298627 - RNA, 23 nt, Homo sapiens
uauacugccuuguguucagugaa

SEQ ID NO: 1298628 - RNA, 20 nt, Homo sapiens
uauacuuccuuaugcuucuu

SEQ ID NO: 1298629 - RNA, 20 nt, Homo sapiens
uauacuucucuauuaucuca

SEQ ID NO: 1298630 - RNA, 14 nt, Homo sapiens
uauagaacuucaug

SEQ ID NO: 1298631 - RNA, 16 nt, Homo sapiens
uauagaauuagcuuuu

SEQ ID NO: 1298632 - RNA, 19 nt, Homo sapiens
uauaguugguacacaacua

SEQ ID NO: 1298633 - RNA, 18 nt, Homo sapiens
uauauaaaugugauugca

SEQ ID NO: 1298634 - RNA, 19 nt, Homo sapiens
uauaucaguccucuuucaa

SEQ ID NO: 1298635 - RNA, 14 nt, Homo sapiens
uauaucgaucucuu

SEQ ID NO: 1298636 - RNA, 16 nt, Homo sapiens
uauaugcacuauguau

SEQ ID NO: 1298637 - RNA, 14 nt, Homo sapiens
uauauguacaugag

SEQ ID NO: 1298638 - RNA, 16 nt, Homo sapiens
uauauguugaaugaca

SEQ ID NO: 1298639 - RNA, 13 nt, Homo sapiens
uauauuaauauca

SEQ ID NO: 1298640 - RNA, 16 nt, Homo sapiens
uauauuuauacuguau

SEQ ID NO: 1298641 - RNA, 20 nt, Homo sapiens
uauauuugugauagcacuuu

SEQ ID NO: 1298642 - RNA, 20 nt, Homo sapiens
uauauuuuuuuaaaauguua

SEQ ID NO: 1298643 - RNA, 14 nt, Homo sapiens
uaucaacagcauuu

SEQ ID NO: 1298644 - RNA, 13 nt, Homo sapiens
uaucaacuuccua

SEQ ID NO: 1298645 - RNA, 18 nt, Homo sapiens
uaucaagagagcuuaaca

SEQ ID NO: 1298646 - RNA, 17 nt, Homo sapiens
uaucaaggcugacuugu

SEQ ID NO: 1298647 - RNA, 14 nt, Homo sapiens
uaucagaaguguua

SEQ ID NO: 1298648 - RNA, 14 nt, Homo sapiens
uaucaguccugucc

SEQ ID NO: 1298649 - RNA, 19 nt, Homo sapiens
uaucaugcccugugcaacc

SEQ ID NO: 1298650 - RNA, 17 nt, Homo sapiens
uaucauggugaaaagcu

SEQ ID NO: 1298651 - RNA, 13 nt, Homo sapiens
uauccuagcacau

SEQ ID NO: 1298652 - RNA, 17 nt, Homo sapiens
uauccuccuguucugaa

SEQ ID NO: 1298653 - RNA, 18 nt, Homo sapiens
uauccuccuguucugaaa

SEQ ID NO: 1298654 - RNA, 22 nt, Homo sapiens
uauccuggugccccccaccccu

SEQ ID NO: 1298655 - RNA, 18 nt, Homo sapiens
uaucguaaagcuguucaa

SEQ ID NO: 1298656 - RNA, 23 nt, Homo sapiens
uaucuaauauguaacaagccacc

SEQ ID NO: 1298657 - RNA, 23 nt, Homo sapiens
uaucucaaacuacuggcaauuug

SEQ ID NO: 1298658 - RNA, 15 nt, Homo sapiens
uaucugcgugcacuu

SEQ ID NO: 1298659 - RNA, 11 nt, Homo sapiens
uaucugugaaa

SEQ ID NO: 1298660 - RNA, 22 nt, Homo sapiens
uaucugugaaaugcuggcauuu

SEQ ID NO: 1298661 - RNA, 14 nt, Homo sapiens
uaucuucaguuuaa

SEQ ID NO: 1298662 - RNA, 19 nt, Homo sapiens
uaucuuuauuaaucacuau

SEQ ID NO: 1298663 - RNA, 13 nt, Homo sapiens
uaugaacuuuaua

SEQ ID NO: 1298664 - RNA, 15 nt, Homo sapiens
uaugacaucagcaau

SEQ ID NO: 1298665 - RNA, 14 nt, Homo sapiens
uaugcagaauguug

SEQ ID NO: 1298666 - RNA, 19 nt, Homo sapiens
uaugcauggugccccagga

SEQ ID NO: 1298667 - RNA, 13 nt, Homo sapiens
uaugcauucacuc

SEQ ID NO: 1298668 - RNA, 22 nt, Homo sapiens
uaugccaggcccauuuccugcu

SEQ ID NO: 1298669 - RNA, 12 nt, Homo sapiens
uaugccauagca

SEQ ID NO: 1298670 - RNA, 21 nt, Homo sapiens
uaugccucugcucccaacuuc

SEQ ID NO: 1298671 - RNA, 17 nt, Homo sapiens
uaugcuacaaucugugu

SEQ ID NO: 1298672 - RNA, 22 nt, Homo sapiens
uaugcucagggucaauuucuuu

SEQ ID NO: 1298673 - RNA, 14 nt, Homo sapiens
uaugcugaaacaga

SEQ ID NO: 1298674 - RNA, 18 nt, Homo sapiens
uaugcuuacugugcaccu

SEQ ID NO: 1298675 - RNA, 17 nt, Homo sapiens
uaugcuuuugguggcua

SEQ ID NO: 1298676 - RNA, 21 nt, Homo sapiens
uauggagagauggucagaaau

SEQ ID NO: 1298677 - RNA, 19 nt, Homo sapiens
uauggcuaauaccugucaa

SEQ ID NO: 1298678 - RNA, 16 nt, Homo sapiens
uauggcuuaaugacac

SEQ ID NO: 1298679 - RNA, 20 nt, Homo sapiens
guggccucugcaggccuagg

SEQ ID NO: 1298680 - RNA, 22 nt, Homo sapiens
uaaaauauuuaucugauuaagu

SEQ ID NO: 1298681 - RNA, 17 nt, Homo sapiens
gcauugcugacugugua

SEQ ID NO: 1298682 - RNA, 19 nt, Homo sapiens
gcauuguaucgauguuaug

SEQ ID NO: 1298683 - RNA, 19 nt, Homo sapiens
gcauuucacaaaacagccu

SEQ ID NO: 1298684 - RNA, 17 nt, Homo sapiens
gcauuugaaugcauuuu

SEQ ID NO: 1298685 - RNA, 17 nt, Homo sapiens
gcauuuucaagcaguua

SEQ ID NO: 1298686 - RNA, 17 nt, Homo sapiens
gcauuuuuaaucugugu

SEQ ID NO: 1298687 - RNA, 19 nt, Homo sapiens
gccaaaagcugcucaggga

SEQ ID NO: 1298688 - RNA, 20 nt, Homo sapiens
gccaacaaagaacacuaacu

SEQ ID NO: 1298689 - RNA, 19 nt, Homo sapiens
gccaaccggucacccagga

SEQ ID NO: 1298690 - RNA, 19 nt, Homo sapiens
gccaagaaacgucuucuaa

SEQ ID NO: 1298691 - RNA, 15 nt, Homo sapiens
gccaagagaccagcc

SEQ ID NO: 1298692 - RNA, 14 nt, Homo sapiens
gccaaggagcugcu

SEQ ID NO: 1298693 - RNA, 21 nt, Homo sapiens
gccaaggagggugagugcaag

SEQ ID NO: 1298694 - RNA, 19 nt, Homo sapiens
gccaagggaaccugugucc

SEQ ID NO: 1298695 - RNA, 17 nt, Homo sapiens
gccaauaacacacagcu

SEQ ID NO: 1298696 - RNA, 11 nt, Homo sapiens
gccaaucucaa

SEQ ID NO: 1298697 - RNA, 19 nt, Homo sapiens
gccaauuuuuccagcauuu

SEQ ID NO: 1298698 - RNA, 12 nt, Homo sapiens
gccacagcagcu

SEQ ID NO: 1298699 - RNA, 20 nt, Homo sapiens
gccacaggccugagauuuca

SEQ ID NO: 1298700 - RNA, 11 nt, Homo sapiens
gccacauggga

SEQ ID NO: 1298701 - RNA, 18 nt, Homo sapiens
gccaccaacuuacaaaaa

SEQ ID NO: 1298702 - RNA, 16 nt, Homo sapiens
gccagaggugcuucac

SEQ ID NO: 1298703 - RNA, 22 nt, Homo sapiens
gccagaguauuggucuccucuc

SEQ ID NO: 1298704 - RNA, 17 nt, Homo sapiens
gccagccagugaccuga

SEQ ID NO: 1298705 - RNA, 22 nt, Homo sapiens
gccagccugcgggaagcugacc

SEQ ID NO: 1298706 - RNA, 15 nt, Homo sapiens
gccaggagcugucac

SEQ ID NO: 1298707 - RNA, 21 nt, Homo sapiens
gccaggaggggaaacaucaca

SEQ ID NO: 1298708 - RNA, 21 nt, Homo sapiens
gccagggggaugccacuccuc

SEQ ID NO: 1298709 - RNA, 17 nt, Homo sapiens
gccaggugaacuggaau

SEQ ID NO: 1298710 - RNA, 13 nt, Homo sapiens
gccaguacagccu

SEQ ID NO: 1298711 - RNA, 22 nt, Homo sapiens
gccauaugaaugucaguaguuu

SEQ ID NO: 1298712 - RNA, 22 nt, Homo sapiens
gccauauucuguuggccagugu

SEQ ID NO: 1298713 - RNA, 18 nt, Homo sapiens
gccaucaaaaugcuuuuu

SEQ ID NO: 1298714 - RNA, 14 nt, Homo sapiens
gccaucaagggaau

SEQ ID NO: 1298715 - RNA, 21 nt, Homo sapiens
gccaucaucucuuuaccuggg

SEQ ID NO: 1298716 - RNA, 15 nt, Homo sapiens
gccauugcacuccag

SEQ ID NO: 1298717 - RNA, 20 nt, Homo sapiens
gccauugugaaccaaugcaa

SEQ ID NO: 1298718 - RNA, 23 nt, Homo sapiens
gcccacguggaggcccaccugcc

SEQ ID NO: 1298719 - RNA, 19 nt, Homo sapiens
gcccacuguccugggccug

SEQ ID NO: 1298720 - RNA, 12 nt, Homo sapiens
gcccagcacuug

SEQ ID NO: 1298721 - RNA, 23 nt, Homo sapiens
gcccagcuccaaggggaaucaga

SEQ ID NO: 1298722 - RNA, 17 nt, Homo sapiens
gcccaggcuggucuuga

SEQ ID NO: 1298723 - RNA, 16 nt, Homo sapiens
gcccagggcugcaaug

SEQ ID NO: 1298724 - RNA, 16 nt, Homo sapiens
gcccagucuggaugug

SEQ ID NO: 1298725 - RNA, 18 nt, Homo sapiens
gcccaguuggguggaugc

SEQ ID NO: 1298726 - RNA, 20 nt, Homo sapiens
gcccauggugagcucuggga

SEQ ID NO: 1298727 - RNA, 20 nt, Homo sapiens
gcccauuucauauucuuuca

SEQ ID NO: 1298728 - RNA, 15 nt, Homo sapiens
gccccaggaccagcu

SEQ ID NO: 1298729 - RNA, 21 nt, Homo sapiens
gcccccaccgugggcagggag

SEQ ID NO: 1298730 - RNA, 16 nt, Homo sapiens
gcccccccuuccacuu

SEQ ID NO: 1298731 - RNA, 13 nt, Homo sapiens
gcccccucaguga

SEQ ID NO: 1298732 - RNA, 16 nt, Homo sapiens
gccccgccgccuggua

SEQ ID NO: 1298733 - RNA, 13 nt, Homo sapiens
gccccuacugcug

SEQ ID NO: 1298734 - RNA, 22 nt, Homo sapiens
gccccucccagaacacacucca

SEQ ID NO: 1298735 - RNA, 13 nt, Homo sapiens
gccccucuaccca

SEQ ID NO: 1298736 - RNA, 21 nt, Homo sapiens
gccccucuccuccguggcaca

SEQ ID NO: 1298737 - RNA, 11 nt, Homo sapiens
gccccuggaca

SEQ ID NO: 1298738 - RNA, 22 nt, Homo sapiens
gcccggggcugucccgugcaug

SEQ ID NO: 1298739 - RNA, 14 nt, Homo sapiens
gcccguaaacacgc

SEQ ID NO: 1298740 - RNA, 15 nt, Homo sapiens
gcccgugcacccugg

SEQ ID NO: 1298741 - RNA, 19 nt, Homo sapiens
gcccgugcccuaccacaca

SEQ ID NO: 1298742 - RNA, 13 nt, Homo sapiens
gcccuacucaccu

SEQ ID NO: 1298743 - RNA, 17 nt, Homo sapiens
gcccugaacccacugcu

SEQ ID NO: 1298744 - RNA, 18 nt, Homo sapiens
gcccugaacccacugcug

SEQ ID NO: 1298745 - RNA, 17 nt, Homo sapiens
gcccugacccuguggaa

SEQ ID NO: 1298746 - RNA, 15 nt, Homo sapiens
gcccugcagccagcu

SEQ ID NO: 1298747 - RNA, 18 nt, Homo sapiens
gcccugcagggaguaccg

SEQ ID NO: 1298748 - RNA, 15 nt, Homo sapiens
gcccuggcaccugug

SEQ ID NO: 1298749 - RNA, 19 nt, Homo sapiens
gcccuggcaccuguggcca

SEQ ID NO: 1298750 - RNA, 13 nt, Homo sapiens
gcccugggugacc

SEQ ID NO: 1298751 - RNA, 19 nt, Homo sapiens
gcccugucugugugcugag

SEQ ID NO: 1298752 - RNA, 12 nt, Homo sapiens
gcccuguggcag

SEQ ID NO: 1298753 - RNA, 18 nt, Homo sapiens
gcccuuguccccaugaaa

SEQ ID NO: 1298754 - RNA, 17 nt, Homo sapiens
gccgcaaaccacacugg

SEQ ID NO: 1298755 - RNA, 13 nt, Homo sapiens
gccgccagggaga

SEQ ID NO: 1298756 - RNA, 17 nt, Homo sapiens
gccgccaguacuuguca

SEQ ID NO: 1298757 - RNA, 17 nt, Homo sapiens
gccgcgauggucagggc

SEQ ID NO: 1298758 - RNA, 13 nt, Homo sapiens
gccggacguggug

SEQ ID NO: 1298759 - RNA, 13 nt, Homo sapiens
gccggggacugcc

SEQ ID NO: 1298760 - RNA, 20 nt, Homo sapiens
gccuaaaagugggcuugauu

SEQ ID NO: 1298761 - RNA, 22 nt, Homo sapiens
gccuacccccugaaagugacag

SEQ ID NO: 1298762 - RNA, 19 nt, Homo sapiens
gccuagcaggcacaggaca

SEQ ID NO: 1298763 - RNA, 17 nt, Homo sapiens
gccuauuccugaacuau

SEQ ID NO: 1298764 - RNA, 19 nt, Homo sapiens
gccucaaaaacgcccucaa

SEQ ID NO: 1298765 - RNA, 13 nt, Homo sapiens
gccucaaggacuu

SEQ ID NO: 1298766 - RNA, 20 nt, Homo sapiens
gccucaccuuggggccuuga

SEQ ID NO: 1298767 - RNA, 17 nt, Homo sapiens
gccucagaugauuuccc

SEQ ID NO: 1298768 - RNA, 13 nt, Homo sapiens
gccucagugccac

SEQ ID NO: 1298769 - RNA, 16 nt, Homo sapiens
gccuccagaagcacug

SEQ ID NO: 1298770 - RNA, 13 nt, Homo sapiens
gccucccacaaga

SEQ ID NO: 1298771 - RNA, 19 nt, Homo sapiens
gccucccacccccaucucu

SEQ ID NO: 1298772 - RNA, 18 nt, Homo sapiens
gccucccacuggggucca

SEQ ID NO: 1298773 - RNA, 16 nt, Homo sapiens
gccucccauccagggc

SEQ ID NO: 1298774 - RNA, 17 nt, Homo sapiens
gccucccuugacuuugc

SEQ ID NO: 1298775 - RNA, 20 nt, Homo sapiens
gccucccuugacuuugcucc

SEQ ID NO: 1298776 - RNA, 20 nt, Homo sapiens
gccuccuccagaauggagcu

SEQ ID NO: 1298777 - RNA, 20 nt, Homo sapiens
gccuccugcccagcacagga

SEQ ID NO: 1298778 - RNA, 20 nt, Homo sapiens
gccuccugugacuggcagca

SEQ ID NO: 1298779 - RNA, 16 nt, Homo sapiens
gccucgaaacacagaa

SEQ ID NO: 1298780 - RNA, 23 nt, Homo sapiens
gccucgaggugccuucuucaggg

SEQ ID NO: 1298781 - RNA, 14 nt, Homo sapiens
gccucuacuuuauc

SEQ ID NO: 1298782 - RNA, 14 nt, Homo sapiens
gccucugaagccua

SEQ ID NO: 1298783 - RNA, 18 nt, Homo sapiens
gccugaagaguccucuga

SEQ ID NO: 1298784 - RNA, 13 nt, Homo sapiens
gccugacaggcug

SEQ ID NO: 1298785 - RNA, 13 nt, Homo sapiens
gccugagucaccu

SEQ ID NO: 1298786 - RNA, 21 nt, Homo sapiens
gccugcacagugaagugcugg

SEQ ID NO: 1298787 - RNA, 11 nt, Homo sapiens
gccugccauag

SEQ ID NO: 1298788 - RNA, 20 nt, Homo sapiens
gccugccgguaaacacgccu

SEQ ID NO: 1298789 - RNA, 23 nt, Homo sapiens
gauguuguguuucuguucaccuu

SEQ ID NO: 1298790 - RNA, 18 nt, Homo sapiens
gauguuuccagacuuccu

SEQ ID NO: 1298791 - RNA, 19 nt, Homo sapiens
gauguuuccagacuuccuu

SEQ ID NO: 1298792 - RNA, 16 nt, Homo sapiens
gauguuuccuugccuu

SEQ ID NO: 1298793 - RNA, 22 nt, Homo sapiens
gauuacaagcgugagccacugc

SEQ ID NO: 1298794 - RNA, 13 nt, Homo sapiens
gauuauucagugu

SEQ ID NO: 1298795 - RNA, 12 nt, Homo sapiens
gauucacauaca

SEQ ID NO: 1298796 - RNA, 21 nt, Homo sapiens
gauucacccccaaacagugac

SEQ ID NO: 1298797 - RNA, 14 nt, Homo sapiens
gauucaguguuaaa

SEQ ID NO: 1298798 - RNA, 23 nt, Homo sapiens
gauuccgcaccaauaaagccuuc

SEQ ID NO: 1298799 - RNA, 18 nt, Homo sapiens
gauucuauaucaugacca

SEQ ID NO: 1298800 - RNA, 11 nt, Homo sapiens
gauucucaggg

SEQ ID NO: 1298801 - RNA, 15 nt, Homo sapiens
gauucugaaucucaa

SEQ ID NO: 1298802 - RNA, 18 nt, Homo sapiens
gauucugauaaugcucac

SEQ ID NO: 1298803 - RNA, 14 nt, Homo sapiens
gauugacuugacuu

SEQ ID NO: 1298804 - RNA, 22 nt, Homo sapiens
gauugaguuuucuucugugauu

SEQ ID NO: 1298805 - RNA, 18 nt, Homo sapiens
gauuguugucaggccaua

SEQ ID NO: 1298806 - RNA, 21 nt, Homo sapiens
gauuuaaucaccacucaaaaa

SEQ ID NO: 1298807 - RNA, 21 nt, Homo sapiens
gauuucaucugcucuccuucc

SEQ ID NO: 1298808 - RNA, 13 nt, Homo sapiens
gauuuccuugaau

SEQ ID NO: 1298809 - RNA, 19 nt, Homo sapiens
gauuugaagaacaugugag

SEQ ID NO: 1298810 - RNA, 13 nt, Homo sapiens
gauuuggugacca

SEQ ID NO: 1298811 - RNA, 19 nt, Homo sapiens
gcaaaaagcaaaaucauuu

SEQ ID NO: 1298812 - RNA, 22 nt, Homo sapiens
gcaaaaggaucuuuguggccaa

SEQ ID NO: 1298813 - RNA, 16 nt, Homo sapiens
gcaaaauagcuuggac

SEQ ID NO: 1298814 - RNA, 18 nt, Homo sapiens
gcaaaaucuguucuaaca

SEQ ID NO: 1298815 - RNA, 23 nt, Homo sapiens
gcaaaaucuguucuaacauguaa

SEQ ID NO: 1298816 - RNA, 12 nt, Homo sapiens
gcaaaauugcaa

SEQ ID NO: 1298817 - RNA, 14 nt, Homo sapiens
gcaaaccauuuuua

SEQ ID NO: 1298818 - RNA, 23 nt, Homo sapiens
gcaaaggcugagaacacugugaa

SEQ ID NO: 1298819 - RNA, 12 nt, Homo sapiens
gcaaaguacugu

SEQ ID NO: 1298820 - RNA, 16 nt, Homo sapiens
gcaaauguaacugugc

SEQ ID NO: 1298821 - RNA, 19 nt, Homo sapiens
gcaaauuuucagcauuaag

SEQ ID NO: 1298822 - RNA, 14 nt, Homo sapiens
gcaacaaccagcau

SEQ ID NO: 1298823 - RNA, 23 nt, Homo sapiens
gcaacaagaaacucaaugcacaa

SEQ ID NO: 1298824 - RNA, 16 nt, Homo sapiens
gcaacaucucugggaa

SEQ ID NO: 1298825 - RNA, 11 nt, Homo sapiens
gcaaccacugc

SEQ ID NO: 1298826 - RNA, 16 nt, Homo sapiens
gcaaccucugucuccc

SEQ ID NO: 1298827 - RNA, 14 nt, Homo sapiens
gcaacucuguaaau

SEQ ID NO: 1298828 - RNA, 21 nt, Homo sapiens
gcaagaacucaucacuguggc

SEQ ID NO: 1298829 - RNA, 16 nt, Homo sapiens
gcaagcucccaaggga

SEQ ID NO: 1298830 - RNA, 17 nt, Homo sapiens
gcaaggacacagaugaa

SEQ ID NO: 1298831 - RNA, 13 nt, Homo sapiens
gcaaggagaaaaa

SEQ ID NO: 1298832 - RNA, 23 nt, Homo sapiens
gcaagguuuaggcugguggccca

SEQ ID NO: 1298833 - RNA, 16 nt, Homo sapiens
gcaagucccuuuguga

SEQ ID NO: 1298834 - RNA, 15 nt, Homo sapiens
gcaagugaaagcaag

SEQ ID NO: 1298835 - RNA, 17 nt, Homo sapiens
gcaagugagacccuguc

SEQ ID NO: 1298836 - RNA, 19 nt, Homo sapiens
gcaauaaaucugacccagu

SEQ ID NO: 1298837 - RNA, 21 nt, Homo sapiens
gcaauaaaucugacccagugc

SEQ ID NO: 1298838 - RNA, 20 nt, Homo sapiens
gcaaugacucaggacauccc

SEQ ID NO: 1298839 - RNA, 18 nt, Homo sapiens
gcaaugagggagcaugua

SEQ ID NO: 1298840 - RNA, 15 nt, Homo sapiens
gcaaugggaaguaaa

SEQ ID NO: 1298841 - RNA, 18 nt, Homo sapiens
gcaauucuccugccuuug

SEQ ID NO: 1298842 - RNA, 12 nt, Homo sapiens
gcacaaagaugg

SEQ ID NO: 1298843 - RNA, 21 nt, Homo sapiens
gcacaaagcucaagaugacag

SEQ ID NO: 1298844 - RNA, 13 nt, Homo sapiens
gcacaauaguaac

SEQ ID NO: 1298845 - RNA, 18 nt, Homo sapiens
gcacaauaguaaccuggg

SEQ ID NO: 1298846 - RNA, 17 nt, Homo sapiens
gcacaaugcauaauguc

SEQ ID NO: 1298847 - RNA, 17 nt, Homo sapiens
gcacacgccuguauucc

SEQ ID NO: 1298848 - RNA, 20 nt, Homo sapiens
gcacacgccuguauucccac

SEQ ID NO: 1298849 - RNA, 22 nt, Homo sapiens
gcacagggagacccguccauuu

SEQ ID NO: 1298850 - RNA, 17 nt, Homo sapiens
gcacagggucucuacca

SEQ ID NO: 1298851 - RNA, 22 nt, Homo sapiens
gcacaucugcauuuucacccca

SEQ ID NO: 1298852 - RNA, 14 nt, Homo sapiens
gcacaugcaccuac

SEQ ID NO: 1298853 - RNA, 21 nt, Homo sapiens
gcacauuuaagagacagucac

SEQ ID NO: 1298854 - RNA, 22 nt, Homo sapiens
gcacauuuuucucuuguuuucu

SEQ ID NO: 1298855 - RNA, 16 nt, Homo sapiens
gcaccaauaaagccuu

SEQ ID NO: 1298856 - RNA, 18 nt, Homo sapiens
gcaccaauaaagccuuca

SEQ ID NO: 1298857 - RNA, 17 nt, Homo sapiens
gcaccagacacccagga

SEQ ID NO: 1298858 - RNA, 18 nt, Homo sapiens
gcacccagaucagacucu

SEQ ID NO: 1298859 - RNA, 14 nt, Homo sapiens
gcacccuggaaggg

SEQ ID NO: 1298860 - RNA, 21 nt, Homo sapiens
gcaccuagaauuggcugaacu

SEQ ID NO: 1298861 - RNA, 17 nt, Homo sapiens
gcaccuccagccugaac

SEQ ID NO: 1298862 - RNA, 21 nt, Homo sapiens
gcaccuguaaucccagcuacu

SEQ ID NO: 1298863 - RNA, 21 nt, Homo sapiens
gcacuacauucauuuagcuaa

SEQ ID NO: 1298864 - RNA, 11 nt, Homo sapiens
gcacuaugaca

SEQ ID NO: 1298865 - RNA, 19 nt, Homo sapiens
gcacucagaagacacugau

SEQ ID NO: 1298866 - RNA, 21 nt, Homo sapiens
gcacucauggagggggcugca

SEQ ID NO: 1298867 - RNA, 21 nt, Homo sapiens
gcacugacauuguuggccaaa

SEQ ID NO: 1298868 - RNA, 13 nt, Homo sapiens
gcacugugcucag

SEQ ID NO: 1298869 - RNA, 17 nt, Homo sapiens
gcacuuugggaggccaa

SEQ ID NO: 1298870 - RNA, 19 nt, Homo sapiens
gcagaaauacagucuucca

SEQ ID NO: 1298871 - RNA, 22 nt, Homo sapiens
gcagaagugcaauccagcccau

SEQ ID NO: 1298872 - RNA, 21 nt, Homo sapiens
gcagacagcuccacccuggcc

SEQ ID NO: 1298873 - RNA, 15 nt, Homo sapiens
gcagagagagacugg

SEQ ID NO: 1298874 - RNA, 23 nt, Homo sapiens
gcagaguacuggcugauggagua

SEQ ID NO: 1298875 - RNA, 19 nt, Homo sapiens
gcagauacaggaaaagcug

SEQ ID NO: 1298876 - RNA, 21 nt, Homo sapiens
gcagauacugucucuuucaug

SEQ ID NO: 1298877 - RNA, 18 nt, Homo sapiens
gcagaugcuuuacaguca

SEQ ID NO: 1298878 - RNA, 19 nt, Homo sapiens
gcagaugcuuuacagucaa

SEQ ID NO: 1298879 - RNA, 19 nt, Homo sapiens
gcagcaccguucugugcac

SEQ ID NO: 1298880 - RNA, 15 nt, Homo sapiens
gcagccaagggauga

SEQ ID NO: 1298881 - RNA, 18 nt, Homo sapiens
gcagccccaucugugcau

SEQ ID NO: 1298882 - RNA, 19 nt, Homo sapiens
gcagccuggggucugacaa

SEQ ID NO: 1298883 - RNA, 22 nt, Homo sapiens
gcagcuugaauuucaaauaucc

SEQ ID NO: 1298884 - RNA, 16 nt, Homo sapiens
gcaggagaucaucuga

SEQ ID NO: 1298885 - RNA, 16 nt, Homo sapiens
gcaggcagaaggcagu

SEQ ID NO: 1298886 - RNA, 23 nt, Homo sapiens
gcaggcaugagucagucugauga

SEQ ID NO: 1298887 - RNA, 21 nt, Homo sapiens
gcaggcuucugugugcugcua

SEQ ID NO: 1298888 - RNA, 18 nt, Homo sapiens
gcagggacaauuugcugc

SEQ ID NO: 1298889 - RNA, 18 nt, Homo sapiens
gcagggacaccuggacaa

SEQ ID NO: 1298890 - RNA, 22 nt, Homo sapiens
gcagggggggaaaugcauuuau

SEQ ID NO: 1298891 - RNA, 20 nt, Homo sapiens
cuucccuaaaaucagggaau

SEQ ID NO: 1298892 - RNA, 22 nt, Homo sapiens
cuucccucucugcagacuuccc

SEQ ID NO: 1298893 - RNA, 22 nt, Homo sapiens
cuucccugucugccagggccag

SEQ ID NO: 1298894 - RNA, 17 nt, Homo sapiens
cuucccuuuuaaacaca

SEQ ID NO: 1298895 - RNA, 16 nt, Homo sapiens
cuuccuagauaugaua

SEQ ID NO: 1298896 - RNA, 22 nt, Homo sapiens
cuuccugacagguucugagaua

SEQ ID NO: 1298897 - RNA, 15 nt, Homo sapiens
cuuccuguacuugaa

SEQ ID NO: 1298898 - RNA, 14 nt, Homo sapiens
cuuccuguccuccc

SEQ ID NO: 1298899 - RNA, 14 nt, Homo sapiens
cuuccuguguccug

SEQ ID NO: 1298900 - RNA, 13 nt, Homo sapiens
cuucgaaaaucua

SEQ ID NO: 1298901 - RNA, 21 nt, Homo sapiens
cuucgaaaaucuagaggaaaa

SEQ ID NO: 1298902 - RNA, 16 nt, Homo sapiens
cuucggccaaacagac

SEQ ID NO: 1298903 - RNA, 19 nt, Homo sapiens
cuucuaaacccaauccaaa

SEQ ID NO: 1298904 - RNA, 12 nt, Homo sapiens
cuucuacugcua

SEQ ID NO: 1298905 - RNA, 22 nt, Homo sapiens
cuucuaggacgccacccagcaa

SEQ ID NO: 1298906 - RNA, 18 nt, Homo sapiens
cuucuaggucacuucuca

SEQ ID NO: 1298907 - RNA, 21 nt, Homo sapiens
cuucuaggucacuucucacaa

SEQ ID NO: 1298908 - RNA, 22 nt, Homo sapiens
cuucuaggucacuucucacaau

SEQ ID NO: 1298909 - RNA, 17 nt, Homo sapiens
cuucucauaggugucca

SEQ ID NO: 1298910 - RNA, 12 nt, Homo sapiens
cuucucauuucu

SEQ ID NO: 1298911 - RNA, 22 nt, Homo sapiens
cuucuccaaggagcaugucacu

SEQ ID NO: 1298912 - RNA, 13 nt, Homo sapiens
cuucucugugaau

SEQ ID NO: 1298913 - RNA, 21 nt, Homo sapiens
cuucugaacguggcacucuuc

SEQ ID NO: 1298914 - RNA, 11 nt, Homo sapiens
cuucugagcua

SEQ ID NO: 1298915 - RNA, 13 nt, Homo sapiens
cuucugcuucuca

SEQ ID NO: 1298916 - RNA, 22 nt, Homo sapiens
cuucugucccucacagcacuag

SEQ ID NO: 1298917 - RNA, 17 nt, Homo sapiens
cuucuguccuacucugu

SEQ ID NO: 1298918 - RNA, 15 nt, Homo sapiens
cuucugugugcugcu

SEQ ID NO: 1298919 - RNA, 17 nt, Homo sapiens
cuucugugugcugcuaa

SEQ ID NO: 1298920 - RNA, 22 nt, Homo sapiens
cuucuuauggaauugauuugca

SEQ ID NO: 1298921 - RNA, 16 nt, Homo sapiens
cuucuucaccauuugg

SEQ ID NO: 1298922 - RNA, 19 nt, Homo sapiens
cuucuucagagcugacaca

SEQ ID NO: 1298923 - RNA, 14 nt, Homo sapiens
cuucuucauauucu

SEQ ID NO: 1298924 - RNA, 21 nt, Homo sapiens
cuucuugcccuggggaucaaa

SEQ ID NO: 1298925 - RNA, 11 nt, Homo sapiens
cuucuugccuc

SEQ ID NO: 1298926 - RNA, 16 nt, Homo sapiens
cuucuuguacuacaca

SEQ ID NO: 1298927 - RNA, 21 nt, Homo sapiens
cuucuuguucugagauucaau

SEQ ID NO: 1298928 - RNA, 15 nt, Homo sapiens
cuugaaccuaugaag

SEQ ID NO: 1298929 - RNA, 19 nt, Homo sapiens
cuugaagggccagagccag

SEQ ID NO: 1298930 - RNA, 22 nt, Homo sapiens
cuugaaguugcuuuuuugacuc

SEQ ID NO: 1298931 - RNA, 22 nt, Homo sapiens
cuugaauacucugcccucuaga

SEQ ID NO: 1298932 - RNA, 14 nt, Homo sapiens
cuugacagggcaca

SEQ ID NO: 1298933 - RNA, 18 nt, Homo sapiens
cuugacaucaaggcucuu

SEQ ID NO: 1298934 - RNA, 23 nt, Homo sapiens
cuugaccaagcaggaagcucaga

SEQ ID NO: 1298935 - RNA, 19 nt, Homo sapiens
cuugacccugagcugacca

SEQ ID NO: 1298936 - RNA, 19 nt, Homo sapiens
cuugaccucaggugaucca

SEQ ID NO: 1298937 - RNA, 15 nt, Homo sapiens
cuugaccuguuucuc

SEQ ID NO: 1298938 - RNA, 21 nt, Homo sapiens
cuugacuuuagucugcaaaau

SEQ ID NO: 1298939 - RNA, 19 nt, Homo sapiens
gagauggagucuugcuaua

SEQ ID NO: 1298940 - RNA, 21 nt, Homo sapiens
gagauggcgcuauugcacucc

SEQ ID NO: 1298941 - RNA, 19 nt, Homo sapiens
gagaugggguuucacuaug

SEQ ID NO: 1298942 - RNA, 17 nt, Homo sapiens
gagauuaccuccugaga

SEQ ID NO: 1298943 - RNA, 15 nt, Homo sapiens
gagauuccugagcca

SEQ ID NO: 1298944 - RNA, 18 nt, Homo sapiens
gagcaaggguucccucaa

SEQ ID NO: 1298945 - RNA, 15 nt, Homo sapiens
gagcaauucaaaaaa

SEQ ID NO: 1298946 - RNA, 19 nt, Homo sapiens
gagcacagccccugcugug

SEQ ID NO: 1298947 - RNA, 17 nt, Homo sapiens
gagcagaggucucccaa

SEQ ID NO: 1298948 - RNA, 17 nt, Homo sapiens
gagcauauauguagcuu

SEQ ID NO: 1298949 - RNA, 14 nt, Homo sapiens
gagcauggguucau

SEQ ID NO: 1298950 - RNA, 23 nt, Homo sapiens
gagcccuccgccuucacauuccc

SEQ ID NO: 1298951 - RNA, 15 nt, Homo sapiens
gagccugaacaugcc

SEQ ID NO: 1298952 - RNA, 20 nt, Homo sapiens
gagccugauguuuacagugu

SEQ ID NO: 1298953 - RNA, 17 nt, Homo sapiens
gagcgcuaccucuccag

SEQ ID NO: 1298954 - RNA, 13 nt, Homo sapiens
gagcgcuccugcc

SEQ ID NO: 1298955 - RNA, 21 nt, Homo sapiens
gagcucagacaccugugugcu

SEQ ID NO: 1298956 - RNA, 22 nt, Homo sapiens
gagcucagagagggcaggcaug

SEQ ID NO: 1298957 - RNA, 14 nt, Homo sapiens
gagcucccaggugc

SEQ ID NO: 1298958 - RNA, 18 nt, Homo sapiens
gagcucucggaacugcau

SEQ ID NO: 1298959 - RNA, 12 nt, Homo sapiens
gagcucuugaca

SEQ ID NO: 1298960 - RNA, 15 nt, Homo sapiens
gagcugacacaggau

SEQ ID NO: 1298961 - RNA, 20 nt, Homo sapiens
gagcugcagucccaugcaca

SEQ ID NO: 1298962 - RNA, 23 nt, Homo sapiens
gagcugcccccuccaggccaguu

SEQ ID NO: 1298963 - RNA, 12 nt, Homo sapiens
gagcugucaugu

SEQ ID NO: 1298964 - RNA, 14 nt, Homo sapiens
gagcuuucugcuau

SEQ ID NO: 1298965 - RNA, 16 nt, Homo sapiens
gaggaaaggccagcug

SEQ ID NO: 1298966 - RNA, 22 nt, Homo sapiens
gaggagaaauuugauaaugaca

SEQ ID NO: 1298967 - RNA, 16 nt, Homo sapiens
gaggaguuagccaaac

SEQ ID NO: 1298968 - RNA, 15 nt, Homo sapiens
gaggcaauggcuccu

SEQ ID NO: 1298969 - RNA, 14 nt, Homo sapiens
gaggcaccucaaga

SEQ ID NO: 1298970 - RNA, 17 nt, Homo sapiens
gaggcaccucaagaaga

SEQ ID NO: 1298971 - RNA, 12 nt, Homo sapiens
gaggcagggaag

SEQ ID NO: 1298972 - RNA, 17 nt, Homo sapiens
gaggcagggcugcauug

SEQ ID NO: 1298973 - RNA, 10 nt, Homo sapiens
gaggcauuuc

SEQ ID NO: 1298974 - RNA, 22 nt, Homo sapiens
gaggccaauuuuuccagcauuu

SEQ ID NO: 1298975 - RNA, 13 nt, Homo sapiens
gaggccacgugau

SEQ ID NO: 1298976 - RNA, 19 nt, Homo sapiens
gaggccaguaccuuuccau

SEQ ID NO: 1298977 - RNA, 22 nt, Homo sapiens
gaggccguggcucugaugcuga

SEQ ID NO: 1298978 - RNA, 19 nt, Homo sapiens
gaggcggguggaucacuug

SEQ ID NO: 1298979 - RNA, 12 nt, Homo sapiens
gaggcugagaca

SEQ ID NO: 1298980 - RNA, 19 nt, Homo sapiens
gaggcuggguucauuugug

SEQ ID NO: 1298981 - RNA, 15 nt, Homo sapiens
gaggcugugucagaa

SEQ ID NO: 1298982 - RNA, 14 nt, Homo sapiens
gagggagcccaguc

SEQ ID NO: 1298983 - RNA, 17 nt, Homo sapiens
gagggaggguggccuaa

SEQ ID NO: 1298984 - RNA, 14 nt, Homo sapiens
gagggagugacaga

SEQ ID NO: 1298985 - RNA, 20 nt, Homo sapiens
gagggcaaacccaaaaccuc

SEQ ID NO: 1298986 - RNA, 21 nt, Homo sapiens
gaggggaaguccagccuacca

SEQ ID NO: 1298987 - RNA, 22 nt, Homo sapiens
gaggguuauaaauuuuagcaag

SEQ ID NO: 1298988 - RNA, 23 nt, Homo sapiens
gaggucauuaaaauuacauugag

SEQ ID NO: 1298989 - RNA, 17 nt, Homo sapiens
gaggucuccaaacugau

SEQ ID NO: 1298990 - RNA, 16 nt, Homo sapiens
gaggugaacaagcaaa

SEQ ID NO: 1298991 - RNA, 23 nt, Homo sapiens
gaggugaacaagcaaacccagac

SEQ ID NO: 1298992 - RNA, 20 nt, Homo sapiens
gagguuuagccaucuuacuu

SEQ ID NO: 1298993 - RNA, 22 nt, Homo sapiens
gagguuuagccaucuuacuugg

SEQ ID NO: 1298994 - RNA, 18 nt, Homo sapiens
gaguagagggcacugggu

SEQ ID NO: 1298995 - RNA, 18 nt, Homo sapiens
gaguagguuuaccagaga

SEQ ID NO: 1298996 - RNA, 12 nt, Homo sapiens
gaguauaugcac

SEQ ID NO: 1298997 - RNA, 20 nt, Homo sapiens
gagucaucucaaccaucccc

SEQ ID NO: 1298998 - RNA, 14 nt, Homo sapiens
gagucauugcugua

SEQ ID NO: 1298999 - RNA, 22 nt, Homo sapiens
gagucccaaccccagcuacucu

SEQ ID NO: 1299000 - RNA, 12 nt, Homo sapiens
gagugacaccca

SEQ ID NO: 1299001 - RNA, 19 nt, Homo sapiens
gagugcauugugaggguua

SEQ ID NO: 1299002 - RNA, 23 nt, Homo sapiens
gagugccuuuucgagacuggcag

SEQ ID NO: 1299003 - RNA, 24 nt, Homo sapiens
gagugcuaugaagacaggaucuag

SEQ ID NO: 1299004 - RNA, 16 nt, Homo sapiens
gaguggguuucacaag

SEQ ID NO: 1299005 - RNA, 19 nt, Homo sapiens
gaguuacuaauuaguuuau

SEQ ID NO: 1299006 - RNA, 18 nt, Homo sapiens
gaguuaggcuauucacaa

SEQ ID NO: 1299007 - RNA, 23 nt, Homo sapiens
gaguuucuggcucuugaggcauu

SEQ ID NO: 1299008 - RNA, 12 nt, Homo sapiens
gauaaaagacag

SEQ ID NO: 1299009 - RNA, 18 nt, Homo sapiens
gauaacuaggaaauccau

SEQ ID NO: 1299010 - RNA, 22 nt, Homo sapiens
gauaagaccaccaccucagagu

SEQ ID NO: 1299011 - RNA, 12 nt, Homo sapiens
gauaagcauuuu

SEQ ID NO: 1299012 - RNA, 15 nt, Homo sapiens
gauaauuagcaguau

SEQ ID NO: 1299013 - RNA, 15 nt, Homo sapiens
gauacaauaaauugc

SEQ ID NO: 1299014 - RNA, 17 nt, Homo sapiens
gauacauacaccagcau

SEQ ID NO: 1299015 - RNA, 21 nt, Homo sapiens
gauaccucaacccccauuucu

SEQ ID NO: 1299016 - RNA, 19 nt, Homo sapiens
gauacugaguaaauccaug

SEQ ID NO: 1299017 - RNA, 21 nt, Homo sapiens
gauacuuggaugcagcucuug

SEQ ID NO: 1299018 - RNA, 16 nt, Homo sapiens
gauagaauuauuucac

SEQ ID NO: 1299019 - RNA, 22 nt, Homo sapiens
gauagagaauguuccagacauu

SEQ ID NO: 1299020 - RNA, 19 nt, Homo sapiens
gauagccuaguuaaauauu

SEQ ID NO: 1299021 - RNA, 18 nt, Homo sapiens
gauagucucauucuguca

SEQ ID NO: 1299022 - RNA, 15 nt, Homo sapiens
gauauagaacagugc

SEQ ID NO: 1299023 - RNA, 15 nt, Homo sapiens
gauaucaugccccug

SEQ ID NO: 1299024 - RNA, 13 nt, Homo sapiens
gauauugcagcuu

SEQ ID NO: 1299025 - RNA, 16 nt, Homo sapiens
gauauugucagucuuu

SEQ ID NO: 1299026 - RNA, 19 nt, Homo sapiens
gauauuuugggcauguggg

SEQ ID NO: 1299027 - RNA, 20 nt, Homo sapiens
gaucaacaucuuuucuugcc

SEQ ID NO: 1299028 - RNA, 19 nt, Homo sapiens
gaucagccugggcaaugug

SEQ ID NO: 1299029 - RNA, 18 nt, Homo sapiens
gaucaguggugucuguga

SEQ ID NO: 1299030 - RNA, 14 nt, Homo sapiens
gaucaucaagguga

SEQ ID NO: 1299031 - RNA, 18 nt, Homo sapiens
gaucaugauguagagugu

SEQ ID NO: 1299032 - RNA, 23 nt, Homo sapiens
gauccaaaagaagcccccagcua

SEQ ID NO: 1299033 - RNA, 15 nt, Homo sapiens
gauccaaaguccugu

SEQ ID NO: 1299034 - RNA, 14 nt, Homo sapiens
gaucccaucuugau

SEQ ID NO: 1299035 - RNA, 23 nt, Homo sapiens
gauccccccacagccccugguca

SEQ ID NO: 1299036 - RNA, 16 nt, Homo sapiens
gaucccgugugccacc

SEQ ID NO: 1299037 - RNA, 23 nt, Homo sapiens
cugggucucgcuuuguugcccag

SEQ ID NO: 1299038 - RNA, 17 nt, Homo sapiens
cugggugcggugacuca

SEQ ID NO: 1299039 - RNA, 12 nt, Homo sapiens
cugggugcuccc

SEQ ID NO: 1299040 - RNA, 18 nt, Homo sapiens
cuggguggcacugccaug

SEQ ID NO: 1299041 - RNA, 22 nt, Homo sapiens
cuggguggcacugccaugcagg

SEQ ID NO: 1299042 - RNA, 22 nt, Homo sapiens
cuggguugcugcuguccagugc

SEQ ID NO: 1299043 - RNA, 16 nt, Homo sapiens
cuggucagcauguacu

SEQ ID NO: 1299044 - RNA, 21 nt, Homo sapiens
cuggucagcauguacuccccu

SEQ ID NO: 1299045 - RNA, 23 nt, Homo sapiens
cuggucagucugcccuugucacu

SEQ ID NO: 1299046 - RNA, 16 nt, Homo sapiens
cuggucccacucaguc

SEQ ID NO: 1299047 - RNA, 15 nt, Homo sapiens
cuggucucaaacucc

SEQ ID NO: 1299048 - RNA, 23 nt, Homo sapiens
cuggucucaaacuccugggcuca

SEQ ID NO: 1299049 - RNA, 20 nt, Homo sapiens
cugguucucaucuuucuuga

SEQ ID NO: 1299050 - RNA, 19 nt, Homo sapiens
cugguuucucagaauccaa

SEQ ID NO: 1299051 - RNA, 13 nt, Homo sapiens
cugguuuucacau

SEQ ID NO: 1299052 - RNA, 14 nt, Homo sapiens
cuguaaacccugac

SEQ ID NO: 1299053 - RNA, 12 nt, Homo sapiens
cuguaaauaugu

SEQ ID NO: 1299054 - RNA, 21 nt, Homo sapiens
cuguaagaaaccuacugccca

SEQ ID NO: 1299055 - RNA, 18 nt, Homo sapiens
cuguaaucccagcuacuu

SEQ ID NO: 1299056 - RNA, 21 nt, Homo sapiens
cuguaauccuagcacuuuggg

SEQ ID NO: 1299057 - RNA, 21 nt, Homo sapiens
cuguaauuuaauuuaggacac

SEQ ID NO: 1299058 - RNA, 22 nt, Homo sapiens
cuguacaaaggggaaagaacau

SEQ ID NO: 1299059 - RNA, 16 nt, Homo sapiens
cuguaccugugcacgu

SEQ ID NO: 1299060 - RNA, 22 nt, Homo sapiens
cuguacuccagccugggugaca

SEQ ID NO: 1299061 - RNA, 15 nt, Homo sapiens
cuguacuuuuuccag

SEQ ID NO: 1299062 - RNA, 12 nt, Homo sapiens
cuguagccucag

SEQ ID NO: 1299063 - RNA, 13 nt, Homo sapiens
cuguauaagugga

SEQ ID NO: 1299064 - RNA, 16 nt, Homo sapiens
cuguauaguacuggca

SEQ ID NO: 1299065 - RNA, 19 nt, Homo sapiens
cuguauauacaauaacaua

SEQ ID NO: 1299066 - RNA, 16 nt, Homo sapiens
cuguauuaagccacuu

SEQ ID NO: 1299067 - RNA, 18 nt, Homo sapiens
cuguauuuaacaaaaagu

SEQ ID NO: 1299068 - RNA, 21 nt, Homo sapiens
cugucaaacaaagccagaagc

SEQ ID NO: 1299069 - RNA, 19 nt, Homo sapiens
cugucaagccggaugccua

SEQ ID NO: 1299070 - RNA, 16 nt, Homo sapiens
cugucauccucaggaa

SEQ ID NO: 1299071 - RNA, 17 nt, Homo sapiens
cuguccagcagucacuu

SEQ ID NO: 1299072 - RNA, 12 nt, Homo sapiens
cuguccagcucc

SEQ ID NO: 1299073 - RNA, 22 nt, Homo sapiens
cugucccaaggugaaaugaagc

SEQ ID NO: 1299074 - RNA, 19 nt, Homo sapiens
cuguccucagccuugccag

SEQ ID NO: 1299075 - RNA, 22 nt, Homo sapiens
cuguccucagccuugccagaga

SEQ ID NO: 1299076 - RNA, 18 nt, Homo sapiens
cuguccugaaagccacag

SEQ ID NO: 1299077 - RNA, 16 nt, Homo sapiens
cugucuacuugcucag

SEQ ID NO: 1299078 - RNA, 20 nt, Homo sapiens
cugucuccuuaacacugagc

SEQ ID NO: 1299079 - RNA, 19 nt, Homo sapiens
cugucuccuuuggucuucu

SEQ ID NO: 1299080 - RNA, 22 nt, Homo sapiens
cugucugacuuauaauuugcau

SEQ ID NO: 1299081 - RNA, 17 nt, Homo sapiens
cugucugcccugaaccc

SEQ ID NO: 1299082 - RNA, 21 nt, Homo sapiens
cugugaaaugcuggcauuugc

SEQ ID NO: 1299083 - RNA, 24 nt, Homo sapiens
cugugacuggcagcauugacucug

SEQ ID NO: 1299084 - RNA, 19 nt, Homo sapiens
cugugagcccagcuggguc

SEQ ID NO: 1299085 - RNA, 20 nt, Homo sapiens
cugugagcucccaggugcag

SEQ ID NO: 1299086 - RNA, 17 nt, Homo sapiens
cugugauucgguggaga

SEQ ID NO: 1299087 - RNA, 23 nt, Homo sapiens
cugugauucgguggagacuauca

SEQ ID NO: 1299088 - RNA, 22 nt, Homo sapiens
cugugcaaccucuuggccugau

SEQ ID NO: 1299089 - RNA, 20 nt, Homo sapiens
ccccgugaggaugucacuca

SEQ ID NO: 1299090 - RNA, 13 nt, Homo sapiens
ccccuaaaccaaa

SEQ ID NO: 1299091 - RNA, 16 nt, Homo sapiens
ccccuacugcugugaa

SEQ ID NO: 1299092 - RNA, 24 nt, Homo sapiens
ccccucucugggcuagaguuuccu

SEQ ID NO: 1299093 - RNA, 15 nt, Homo sapiens
ccccugaacugcugu

SEQ ID NO: 1299094 - RNA, 12 nt, Homo sapiens
ccccugccagcu

SEQ ID NO: 1299095 - RNA, 14 nt, Homo sapiens
ccccuggcucugac

SEQ ID NO: 1299096 - RNA, 22 nt, Homo sapiens
ccccuguagagugggagcugag

SEQ ID NO: 1299097 - RNA, 20 nt, Homo sapiens
cccgcaggcuucugugugcu

SEQ ID NO: 1299098 - RNA, 19 nt, Homo sapiens
cccggcugucaaggggugu

SEQ ID NO: 1299099 - RNA, 23 nt, Homo sapiens
cccgggagacugaacugcagggu

SEQ ID NO: 1299100 - RNA, 21 nt, Homo sapiens
cccgggccagggcugccccua

SEQ ID NO: 1299101 - RNA, 15 nt, Homo sapiens
cccguggcauuucaa

SEQ ID NO: 1299102 - RNA, 18 nt, Homo sapiens
cccgugggagucaucuca

SEQ ID NO: 1299103 - RNA, 18 nt, Homo sapiens
cccuaacacuuaccccau

SEQ ID NO: 1299104 - RNA, 19 nt, Homo sapiens
cccuaaccucugagucacc

SEQ ID NO: 1299105 - RNA, 21 nt, Homo sapiens
cccuaagcuucuagaggcuca

SEQ ID NO: 1299106 - RNA, 18 nt, Homo sapiens
cccuacuauucaguggcg

SEQ ID NO: 1299107 - RNA, 14 nt, Homo sapiens
cccucaaaucugag

SEQ ID NO: 1299108 - RNA, 21 nt, Homo sapiens
cccucaccuuggcaccagaca

SEQ ID NO: 1299109 - RNA, 13 nt, Homo sapiens
cccucagauuccg

SEQ ID NO: 1299110 - RNA, 17 nt, Homo sapiens
cccucauucuacugaaa

SEQ ID NO: 1299111 - RNA, 13 nt, Homo sapiens
cccuccccauuca

SEQ ID NO: 1299112 - RNA, 20 nt, Homo sapiens
cccuccccauucagacacuu

SEQ ID NO: 1299113 - RNA, 15 nt, Homo sapiens
cccuccguggcauca

SEQ ID NO: 1299114 - RNA, 19 nt, Homo sapiens
cccucggcucuggaggcaa

SEQ ID NO: 1299115 - RNA, 19 nt, Homo sapiens
cccucuaggcucugccuuc

SEQ ID NO: 1299116 - RNA, 18 nt, Homo sapiens
cccucuccaacugccuaa

SEQ ID NO: 1299117 - RNA, 21 nt, Homo sapiens
cccucugcuuuuaacucuaga

SEQ ID NO: 1299118 - RNA, 21 nt, Homo sapiens
cccucugggggcucuggccaa

SEQ ID NO: 1299119 - RNA, 16 nt, Homo sapiens
cccucuucauggaugg

SEQ ID NO: 1299120 - RNA, 12 nt, Homo sapiens
cccucuucugag

SEQ ID NO: 1299121 - RNA, 15 nt, Homo sapiens
cccugaagauuucag

SEQ ID NO: 1299122 - RNA, 21 nt, Homo sapiens
cccugacaucuggaaucugga

SEQ ID NO: 1299123 - RNA, 21 nt, Homo sapiens
cccugacugggaguugaucgc

SEQ ID NO: 1299124 - RNA, 18 nt, Homo sapiens
cccugagcuuucugcuau

SEQ ID NO: 1299125 - RNA, 19 nt, Homo sapiens
cccugauuguguauauuca

SEQ ID NO: 1299126 - RNA, 13 nt, Homo sapiens
cccugcacacuca

SEQ ID NO: 1299127 - RNA, 15 nt, Homo sapiens
cccugccagcucuuc

SEQ ID NO: 1299128 - RNA, 18 nt, Homo sapiens
cccugcccuuggcaccca

SEQ ID NO: 1299129 - RNA, 13 nt, Homo sapiens
cccugccgugggc

SEQ ID NO: 1299130 - RNA, 23 nt, Homo sapiens
cccugccuuuaaaaacaaacaga

SEQ ID NO: 1299131 - RNA, 15 nt, Homo sapiens
cccuggcuccaguga

SEQ ID NO: 1299132 - RNA, 14 nt, Homo sapiens
cccuggggacagca

SEQ ID NO: 1299133 - RNA, 18 nt, Homo sapiens
cccuggggacccacgugg

SEQ ID NO: 1299134 - RNA, 21 nt, Homo sapiens
cccugguggcuacccaauaga

SEQ ID NO: 1299135 - RNA, 16 nt, Homo sapiens
cccugguucugaugau

SEQ ID NO: 1299136 - RNA, 22 nt, Homo sapiens
cccuguaguuaggccuggcuca

SEQ ID NO: 1299137 - RNA, 18 nt, Homo sapiens
cccuguaucuacuaaaaa

SEQ ID NO: 1299138 - RNA, 23 nt, Homo sapiens
cccuguccggaaugccacccaca

SEQ ID NO: 1299139 - RNA, 22 nt, Homo sapiens
cccugucucuacuaaaaauaca

SEQ ID NO: 1299140 - RNA, 15 nt, Homo sapiens
cccugugcgucucag

SEQ ID NO: 1299141 - RNA, 13 nt, Homo sapiens
cccuguggaugag

SEQ ID NO: 1299142 - RNA, 18 nt, Homo sapiens
cccuuacuaugaucucag

SEQ ID NO: 1299143 - RNA, 17 nt, Homo sapiens
cccuuauaauuggugca

SEQ ID NO: 1299144 - RNA, 17 nt, Homo sapiens
cccuucauugauuuccu

SEQ ID NO: 1299145 - RNA, 19 nt, Homo sapiens
cccuucuaaccugaacuga

SEQ ID NO: 1299146 - RNA, 22 nt, Homo sapiens
cccuugcuguaugcugaucauc

SEQ ID NO: 1299147 - RNA, 18 nt, Homo sapiens
cccuuguccaaaccuggg

SEQ ID NO: 1299148 - RNA, 17 nt, Homo sapiens
cccuuuaacucaugagg

SEQ ID NO: 1299149 - RNA, 21 nt, Homo sapiens
cccuuuacagcaccaccuugc

SEQ ID NO: 1299150 - RNA, 11 nt, Homo sapiens
cccuuucacaa

SEQ ID NO: 1299151 - RNA, 21 nt, Homo sapiens
cccuuuccuccucaggcacac

SEQ ID NO: 1299152 - RNA, 19 nt, Homo sapiens
cccuuugugacuucaagaa

SEQ ID NO: 1299153 - RNA, 19 nt, Homo sapiens
ccgaauugacaacccaaac

SEQ ID NO: 1299154 - RNA, 12 nt, Homo sapiens
ccgacaucacag

SEQ ID NO: 1299155 - RNA, 17 nt, Homo sapiens
ccgagauccaccagauc

SEQ ID NO: 1299156 - RNA, 13 nt, Homo sapiens
ccgaggacaugaa

SEQ ID NO: 1299157 - RNA, 18 nt, Homo sapiens
ccgaggggcucaguucug

SEQ ID NO: 1299158 - RNA, 17 nt, Homo sapiens
ccgcaaaccacacugga

SEQ ID NO: 1299159 - RNA, 19 nt, Homo sapiens
ccgcaccaauaaagccuuc

SEQ ID NO: 1299160 - RNA, 20 nt, Homo sapiens
ccgcugcuuccaggcugggc

SEQ ID NO: 1299161 - RNA, 15 nt, Homo sapiens
ccggauauauacaua

SEQ ID NO: 1299162 - RNA, 19 nt, Homo sapiens
ccggcaacaucucugggaa

SEQ ID NO: 1299163 - RNA, 20 nt, Homo sapiens
ccggcacuuccgagauccac

SEQ ID NO: 1299164 - RNA, 16 nt, Homo sapiens
ccggcucuguggguga

SEQ ID NO: 1299165 - RNA, 12 nt, Homo sapiens
ccggcugcgugg

SEQ ID NO: 1299166 - RNA, 14 nt, Homo sapiens
ccgggauccagcuc

SEQ ID NO: 1299167 - RNA, 16 nt, Homo sapiens
ccggggcuccacugaa

SEQ ID NO: 1299168 - RNA, 23 nt, Homo sapiens
ccgugcacccuggaagggcaggu

SEQ ID NO: 1299169 - RNA, 19 nt, Homo sapiens
cugccucugucucacugaa

SEQ ID NO: 1299170 - RNA, 20 nt, Homo sapiens
cugccugcccguaaacacgc

SEQ ID NO: 1299171 - RNA, 14 nt, Homo sapiens
cugccuuaccgaga

SEQ ID NO: 1299172 - RNA, 21 nt, Homo sapiens
cugccuucaccuccucuuuca

SEQ ID NO: 1299173 - RNA, 19 nt, Homo sapiens
cugccuuguguucagugaa

SEQ ID NO: 1299174 - RNA, 14 nt, Homo sapiens
cugccuuugccucc

SEQ ID NO: 1299175 - RNA, 19 nt, Homo sapiens
cugcgacgcuugcucuguu

SEQ ID NO: 1299176 - RNA, 15 nt, Homo sapiens
cugcgcuuccaaaag

SEQ ID NO: 1299177 - RNA, 21 nt, Homo sapiens
cugcgcuuccaaaagcaaaug

SEQ ID NO: 1299178 - RNA, 21 nt, Homo sapiens
cugcgugcacuucccagagca

SEQ ID NO: 1299179 - RNA, 21 nt, Homo sapiens
cugcuaacaagucaccaaaag

SEQ ID NO: 1299180 - RNA, 15 nt, Homo sapiens
cugcuaccuuccuag

SEQ ID NO: 1299181 - RNA, 15 nt, Homo sapiens
cugcuagcuagcuca

SEQ ID NO: 1299182 - RNA, 14 nt, Homo sapiens
cugcuccacccaug

SEQ ID NO: 1299183 - RNA, 14 nt, Homo sapiens
cugcuccagugcag

SEQ ID NO: 1299184 - RNA, 22 nt, Homo sapiens
cugcucccugacagcaccugaa

SEQ ID NO: 1299185 - RNA, 20 nt, Homo sapiens
cugcucuucuguuugcacac

SEQ ID NO: 1299186 - RNA, 16 nt, Homo sapiens
cugcugaagacuugcc

SEQ ID NO: 1299187 - RNA, 17 nt, Homo sapiens
cugcugaagacuugccc

SEQ ID NO: 1299188 - RNA, 14 nt, Homo sapiens
cugcugacaguguu

SEQ ID NO: 1299189 - RNA, 18 nt, Homo sapiens
cugcugaccuccacagcu

SEQ ID NO: 1299190 - RNA, 16 nt, Homo sapiens
cugcugcuccagugca

SEQ ID NO: 1299191 - RNA, 20 nt, Homo sapiens
cugcuggagccaggccuucc

SEQ ID NO: 1299192 - RNA, 21 nt, Homo sapiens
cugcuggagugaaggggccaa

SEQ ID NO: 1299193 - RNA, 23 nt, Homo sapiens
cugcugucaccucucccacggga

SEQ ID NO: 1299194 - RNA, 23 nt, Homo sapiens
cugcuguuguugaaauugauguu

SEQ ID NO: 1299195 - RNA, 18 nt, Homo sapiens
cugcuuaaaaauguagca

SEQ ID NO: 1299196 - RNA, 19 nt, Homo sapiens
cugcuuaaaaauguagcag

SEQ ID NO: 1299197 - RNA, 14 nt, Homo sapiens
cugcuuauucaguc

SEQ ID NO: 1299198 - RNA, 17 nt, Homo sapiens
cugcuuauucaguccuu

SEQ ID NO: 1299199 - RNA, 22 nt, Homo sapiens
cugcuugaggaaaacaagcauu

SEQ ID NO: 1299200 - RNA, 20 nt, Homo sapiens
cugcuuucuccccaaugaga

SEQ ID NO: 1299201 - RNA, 17 nt, Homo sapiens
cugcuuugggaagccgu

SEQ ID NO: 1299202 - RNA, 12 nt, Homo sapiens
cuggaacccaga

SEQ ID NO: 1299203 - RNA, 23 nt, Homo sapiens
cuggaagaaaaaaaccacacaaa

SEQ ID NO: 1299204 - RNA, 16 nt, Homo sapiens
cuggaaggcuuccacu

SEQ ID NO: 1299205 - RNA, 22 nt, Homo sapiens
cuggaaucacauucuuagcaca

SEQ ID NO: 1299206 - RNA, 14 nt, Homo sapiens
cuggaaugugucaa

SEQ ID NO: 1299207 - RNA, 14 nt, Homo sapiens
cuggacaugccugu

SEQ ID NO: 1299208 - RNA, 12 nt, Homo sapiens
cuggagauccuc

SEQ ID NO: 1299209 - RNA, 22 nt, Homo sapiens
cuggaggcccaguucacccuga

SEQ ID NO: 1299210 - RNA, 23 nt, Homo sapiens
cuggaggcccaguucacccugau

SEQ ID NO: 1299211 - RNA, 20 nt, Homo sapiens
cuggaguacaguggugccau

SEQ ID NO: 1299212 - RNA, 13 nt, Homo sapiens
cuggagugcagug

SEQ ID NO: 1299213 - RNA, 20 nt, Homo sapiens
cuggagugcaguggugugau

SEQ ID NO: 1299214 - RNA, 22 nt, Homo sapiens
cuggaguugcauugauucagua

SEQ ID NO: 1299215 - RNA, 20 nt, Homo sapiens
cuggcaccuguggccaguac

SEQ ID NO: 1299216 - RNA, 12 nt, Homo sapiens
cuggcacugacu

SEQ ID NO: 1299217 - RNA, 19 nt, Homo sapiens
cuggcagggacgaggacaa

SEQ ID NO: 1299218 - RNA, 22 nt, Homo sapiens
cuggcccaguuaauuugcacag

SEQ ID NO: 1299219 - RNA, 22 nt, Homo sapiens
cuggccuaaugagauaauacuc

SEQ ID NO: 1299220 - RNA, 20 nt, Homo sapiens
cuggcgugcaguggugcgau

SEQ ID NO: 1299221 - RNA, 18 nt, Homo sapiens
cuggcuccuucaccaccc

SEQ ID NO: 1299222 - RNA, 16 nt, Homo sapiens
cuggcucuuugcugug

SEQ ID NO: 1299223 - RNA, 18 nt, Homo sapiens
cuggcuggggccuguuga

SEQ ID NO: 1299224 - RNA, 14 nt, Homo sapiens
cuggcuugccugaa

SEQ ID NO: 1299225 - RNA, 17 nt, Homo sapiens
cugggacagcccaggaa

SEQ ID NO: 1299226 - RNA, 16 nt, Homo sapiens
cugggaccaacccugg

SEQ ID NO: 1299227 - RNA, 20 nt, Homo sapiens
cugggauccgggaucaaagu

SEQ ID NO: 1299228 - RNA, 14 nt, Homo sapiens
cugggaugucuccg

SEQ ID NO: 1299229 - RNA, 16 nt, Homo sapiens
cugggauuaaggggau

SEQ ID NO: 1299230 - RNA, 18 nt, Homo sapiens
cugggauuacaagcguga

SEQ ID NO: 1299231 - RNA, 15 nt, Homo sapiens
cugggauuacaggug

SEQ ID NO: 1299232 - RNA, 15 nt, Homo sapiens
cugggcaauauagca

SEQ ID NO: 1299233 - RNA, 23 nt, Homo sapiens
cugggcacacgccucccacuggg

SEQ ID NO: 1299234 - RNA, 17 nt, Homo sapiens
cugggcauagaugcagg

SEQ ID NO: 1299235 - RNA, 20 nt, Homo sapiens
cugggcccucucuucucacc

SEQ ID NO: 1299236 - RNA, 16 nt, Homo sapiens
cugggccgcugccacg

SEQ ID NO: 1299237 - RNA, 15 nt, Homo sapiens
cugggccugaccaaa

SEQ ID NO: 1299238 - RNA, 13 nt, Homo sapiens
cugggcugaggca

SEQ ID NO: 1299239 - RNA, 17 nt, Homo sapiens
cugggcuucgggcuaug

SEQ ID NO: 1299240 - RNA, 14 nt, Homo sapiens
cuggggcaauggga

SEQ ID NO: 1299241 - RNA, 15 nt, Homo sapiens
cuggggccuccagaa

SEQ ID NO: 1299242 - RNA, 22 nt, Homo sapiens
cuggggcuccgaaauuccaagg

SEQ ID NO: 1299243 - RNA, 18 nt, Homo sapiens
cugggggaaauuggcgau

SEQ ID NO: 1299244 - RNA, 16 nt, Homo sapiens
cugggggacagaggaa

SEQ ID NO: 1299245 - RNA, 16 nt, Homo sapiens
cugggggccucagugc

SEQ ID NO: 1299246 - RNA, 17 nt, Homo sapiens
ccaggaagccgugcccu

SEQ ID NO: 1299247 - RNA, 12 nt, Homo sapiens
ccaggaccaguc

SEQ ID NO: 1299248 - RNA, 16 nt, Homo sapiens
ccaggacucacccuca

SEQ ID NO: 1299249 - RNA, 13 nt, Homo sapiens
ccaggacugggcc

SEQ ID NO: 1299250 - RNA, 13 nt, Homo sapiens
ccaggcaaagcaa

SEQ ID NO: 1299251 - RNA, 13 nt, Homo sapiens
ccaggcagaucca

SEQ ID NO: 1299252 - RNA, 16 nt, Homo sapiens
ccaggcccugccagag

SEQ ID NO: 1299253 - RNA, 20 nt, Homo sapiens
ccaggccugggaauggauua

SEQ ID NO: 1299254 - RNA, 18 nt, Homo sapiens
ccaggcuggaaugcagug

SEQ ID NO: 1299255 - RNA, 20 nt, Homo sapiens
ccaggcuggaaugcaguggu

SEQ ID NO: 1299256 - RNA, 23 nt, Homo sapiens
ccaggcuggcagauuuccaaaag

SEQ ID NO: 1299257 - RNA, 15 nt, Homo sapiens
ccaggcugggaacuc

SEQ ID NO: 1299258 - RNA, 16 nt, Homo sapiens
ccaggcuggucucaaa

SEQ ID NO: 1299259 - RNA, 16 nt, Homo sapiens
ccagggcaagcuccgc

SEQ ID NO: 1299260 - RNA, 16 nt, Homo sapiens
ccaggguccacaggaa

SEQ ID NO: 1299261 - RNA, 23 nt, Homo sapiens
ccaggguggagugcaguggugcg

SEQ ID NO: 1299262 - RNA, 13 nt, Homo sapiens
ccagguacaucca

SEQ ID NO: 1299263 - RNA, 21 nt, Homo sapiens
ccagguccugagagcugcuuu

SEQ ID NO: 1299264 - RNA, 23 nt, Homo sapiens
ccagguuuuacacuugcaucucu

SEQ ID NO: 1299265 - RNA, 20 nt, Homo sapiens
ccagguuuuuggucugaccc

SEQ ID NO: 1299266 - RNA, 23 nt, Homo sapiens
ccaguacucugggaagccaaggc

SEQ ID NO: 1299267 - RNA, 19 nt, Homo sapiens
ccaguacuugucauaugua

SEQ ID NO: 1299268 - RNA, 19 nt, Homo sapiens
ccaguaggaaaagcaaugc

SEQ ID NO: 1299269 - RNA, 13 nt, Homo sapiens
ccaguauggugaa

SEQ ID NO: 1299270 - RNA, 19 nt, Homo sapiens
ccagucacugugagcuccc

SEQ ID NO: 1299271 - RNA, 23 nt, Homo sapiens
ccagucgcccuuacuucuugccc

SEQ ID NO: 1299272 - RNA, 22 nt, Homo sapiens
ccagugacacgucucgccaagc

SEQ ID NO: 1299273 - RNA, 14 nt, Homo sapiens
ccagugccuacauc

SEQ ID NO: 1299274 - RNA, 20 nt, Homo sapiens
ccaguggggaaggaggccaa

SEQ ID NO: 1299275 - RNA, 15 nt, Homo sapiens
ccagugggguggagu

SEQ ID NO: 1299276 - RNA, 18 nt, Homo sapiens
ccaguucaucuauggcag

SEQ ID NO: 1299277 - RNA, 21 nt, Homo sapiens
ccaguuuaaccugaugcaguc

SEQ ID NO: 1299278 - RNA, 20 nt, Homo sapiens
ccauaaagacaaucacugcc

SEQ ID NO: 1299279 - RNA, 14 nt, Homo sapiens
ccauaaugauggau

SEQ ID NO: 1299280 - RNA, 21 nt, Homo sapiens
ccauacacccccucuucugag

SEQ ID NO: 1299281 - RNA, 14 nt, Homo sapiens
ccauacgagcaccu

SEQ ID NO: 1299282 - RNA, 20 nt, Homo sapiens
ccauagcaagauugcuuaaa

SEQ ID NO: 1299283 - RNA, 21 nt, Homo sapiens
ccauagggacccauucuacac

SEQ ID NO: 1299284 - RNA, 23 nt, Homo sapiens
ccauaugaaaaggcuaagcuuca

SEQ ID NO: 1299285 - RNA, 19 nt, Homo sapiens
ccauauuuaauaaagcaca

SEQ ID NO: 1299286 - RNA, 20 nt, Homo sapiens
ccauauuuucaccauuugau

SEQ ID NO: 1299287 - RNA, 12 nt, Homo sapiens
ccaucaccagac

SEQ ID NO: 1299288 - RNA, 23 nt, Homo sapiens
ccaucagugcucccucacauguc

SEQ ID NO: 1299289 - RNA, 12 nt, Homo sapiens
ccauccagguuc

SEQ ID NO: 1299290 - RNA, 14 nt, Homo sapiens
ccauccucaucucu

SEQ ID NO: 1299291 - RNA, 19 nt, Homo sapiens
ccauccuguuuguaugaaa

SEQ ID NO: 1299292 - RNA, 15 nt, Homo sapiens
ccaucggcaggcagu

SEQ ID NO: 1299293 - RNA, 10 nt, Homo sapiens
ccaucucagg

SEQ ID NO: 1299294 - RNA, 22 nt, Homo sapiens
ccaucuucuaaacccaauccaa

SEQ ID NO: 1299295 - RNA, 20 nt, Homo sapiens
ccaugaaugaaccccuggcu

SEQ ID NO: 1299296 - RNA, 20 nt, Homo sapiens
ccaugagaugauacauccaa

SEQ ID NO: 1299297 - RNA, 14 nt, Homo sapiens
ccauggacaggcug

SEQ ID NO: 1299298 - RNA, 18 nt, Homo sapiens
ccauggcacugaggugcc

SEQ ID NO: 1299299 - RNA, 15 nt, Homo sapiens
ccaugggaccacaac

SEQ ID NO: 1299300 - RNA, 13 nt, Homo sapiens
ccauggugagcuc

SEQ ID NO: 1299301 - RNA, 19 nt, Homo sapiens
ccauggugagcucugggaa

SEQ ID NO: 1299302 - RNA, 15 nt, Homo sapiens
ccaugucugcauuuc

SEQ ID NO: 1299303 - RNA, 21 nt, Homo sapiens
ccaugucuuuggacaaccaug

SEQ ID NO: 1299304 - RNA, 19 nt, Homo sapiens
ccaugugaaacucaucuca

SEQ ID NO: 1299305 - RNA, 17 nt, Homo sapiens
ccaugugcacaagugug

SEQ ID NO: 1299306 - RNA, 19 nt, Homo sapiens
ccaugugcacaagugugca

SEQ ID NO: 1299307 - RNA, 17 nt, Homo sapiens
ccauguuggccaggcug

SEQ ID NO: 1299308 - RNA, 13 nt, Homo sapiens
ccauguuucacaa

SEQ ID NO: 1299309 - RNA, 22 nt, Homo sapiens
ccauuaagugguaguaauuucc

SEQ ID NO: 1299310 - RNA, 11 nt, Homo sapiens
ccauuagccaa

SEQ ID NO: 1299311 - RNA, 19 nt, Homo sapiens
ccauucagugcagcauaua

SEQ ID NO: 1299312 - RNA, 19 nt, Homo sapiens
ccauucccaagaugccuga

SEQ ID NO: 1299313 - RNA, 18 nt, Homo sapiens
ccauugcucuucuuuuga

SEQ ID NO: 1299314 - RNA, 19 nt, Homo sapiens
ccauuucauauucuuucaa

SEQ ID NO: 1299315 - RNA, 21 nt, Homo sapiens
ccauuuggcaaugccaucauc

SEQ ID NO: 1299316 - RNA, 19 nt, Homo sapiens
ccauuuguaaaacauucca

SEQ ID NO: 1299317 - RNA, 23 nt, Homo sapiens
ccauuuucuuauugcgcugcuac

SEQ ID NO: 1299318 - RNA, 16 nt, Homo sapiens
ccauuuuuagugaaau

SEQ ID NO: 1299319 - RNA, 14 nt, Homo sapiens
cccaaaacugucau

SEQ ID NO: 1299320 - RNA, 16 nt, Homo sapiens
cccaaacccauggcuc

SEQ ID NO: 1299321 - RNA, 23 nt, Homo sapiens
cccaaauccuuagaucuggcaug

SEQ ID NO: 1299322 - RNA, 16 nt, Homo sapiens
cccaacaaaccaucca

SEQ ID NO: 1299323 - RNA, 21 nt, Homo sapiens
cccaacuucgccagccuccaa

SEQ ID NO: 1299324 - RNA, 23 nt, Homo sapiens
cccaagauuauuaaaagaugucu

SEQ ID NO: 1299325 - RNA, 14 nt, Homo sapiens
cccaagcuucccuc

SEQ ID NO: 1299326 - RNA, 18 nt, Homo sapiens
cccaaggccccacucucg

SEQ ID NO: 1299327 - RNA, 16 nt, Homo sapiens
cccaauucacaucuaa

SEQ ID NO: 1299328 - RNA, 13 nt, Homo sapiens
cccacaguggaaa

SEQ ID NO: 1299329 - RNA, 16 nt, Homo sapiens
cccaccccacaauucc

SEQ ID NO: 1299330 - RNA, 23 nt, Homo sapiens
cauagaggagaggaaaaggugua

SEQ ID NO: 1299331 - RNA, 17 nt, Homo sapiens
cauagcaagauugcuua

SEQ ID NO: 1299332 - RNA, 18 nt, Homo sapiens
cauagcagaugguuucca

SEQ ID NO: 1299333 - RNA, 19 nt, Homo sapiens
cauaggacucaaaguuuca

SEQ ID NO: 1299334 - RNA, 15 nt, Homo sapiens
cauaggcccagugag

SEQ ID NO: 1299335 - RNA, 16 nt, Homo sapiens
cauagguuuaauaauu

SEQ ID NO: 1299336 - RNA, 22 nt, Homo sapiens
cauaguagguacccaauucaau

SEQ ID NO: 1299337 - RNA, 23 nt, Homo sapiens
cauauacugccauguacuaguuu

SEQ ID NO: 1299338 - RNA, 22 nt, Homo sapiens
cauauauuaucaucaaaugcau

SEQ ID NO: 1299339 - RNA, 14 nt, Homo sapiens
cauauauugcauuu

SEQ ID NO: 1299340 - RNA, 18 nt, Homo sapiens
cauauauuggcacugcua

SEQ ID NO: 1299341 - RNA, 15 nt, Homo sapiens
cauaucagaacugug

SEQ ID NO: 1299342 - RNA, 21 nt, Homo sapiens
cauaucuguguauuaucucaa

SEQ ID NO: 1299343 - RNA, 19 nt, Homo sapiens
cauaugaaaggugccaugg

SEQ ID NO: 1299344 - RNA, 21 nt, Homo sapiens
cauauguagccuucacacaga

SEQ ID NO: 1299345 - RNA, 20 nt, Homo sapiens
cauauguauauauauauaug

SEQ ID NO: 1299346 - RNA, 22 nt, Homo sapiens
cauaugugugugugugcauaug

SEQ ID NO: 1299347 - RNA, 16 nt, Homo sapiens
cauauguuuaucucac

SEQ ID NO: 1299348 - RNA, 16 nt, Homo sapiens
cauauucuguuggcca

SEQ ID NO: 1299349 - RNA, 19 nt, Homo sapiens
cauauuuaauaaagcacaa

SEQ ID NO: 1299350 - RNA, 20 nt, Homo sapiens
cauauuuaauaaagcacaaa

SEQ ID NO: 1299351 - RNA, 21 nt, Homo sapiens
cauauuuucuguccagucaau

SEQ ID NO: 1299352 - RNA, 14 nt, Homo sapiens
caucaaaugcauuu

SEQ ID NO: 1299353 - RNA, 13 nt, Homo sapiens
caucaacuuaaaa

SEQ ID NO: 1299354 - RNA, 21 nt, Homo sapiens
caucaagaugagagaacugga

SEQ ID NO: 1299355 - RNA, 12 nt, Homo sapiens
caucacacuggg

SEQ ID NO: 1299356 - RNA, 16 nt, Homo sapiens
caucacagaaugugau

SEQ ID NO: 1299357 - RNA, 17 nt, Homo sapiens
caucacugguugcacuu

SEQ ID NO: 1299358 - RNA, 18 nt, Homo sapiens
caucagacuccugugcaa

SEQ ID NO: 1299359 - RNA, 14 nt, Homo sapiens
caucaugucuggcu

SEQ ID NO: 1299360 - RNA, 17 nt, Homo sapiens
cauccaaaccuguaacc

SEQ ID NO: 1299361 - RNA, 14 nt, Homo sapiens
cauccagugacaaa

SEQ ID NO: 1299362 - RNA, 16 nt, Homo sapiens
caucccucuguucaca

SEQ ID NO: 1299363 - RNA, 17 nt, Homo sapiens
cauccgugcuaugacau

SEQ ID NO: 1299364 - RNA, 13 nt, Homo sapiens
cauccucaucucu

SEQ ID NO: 1299365 - RNA, 19 nt, Homo sapiens
cauccucugacuccacuca

SEQ ID NO: 1299366 - RNA, 13 nt, Homo sapiens
caucuaagccuga

SEQ ID NO: 1299367 - RNA, 12 nt, Homo sapiens
caucuaauauga

SEQ ID NO: 1299368 - RNA, 19 nt, Homo sapiens
caucuauuuggaacccaag

SEQ ID NO: 1299369 - RNA, 17 nt, Homo sapiens
caucucaaagaaggcau

SEQ ID NO: 1299370 - RNA, 13 nt, Homo sapiens
caucucaaggaau

SEQ ID NO: 1299371 - RNA, 23 nt, Homo sapiens
caucucaauugugcuuuguauca

SEQ ID NO: 1299372 - RNA, 14 nt, Homo sapiens
caucucagugcagg

SEQ ID NO: 1299373 - RNA, 12 nt, Homo sapiens
caucucaugccc

SEQ ID NO: 1299374 - RNA, 21 nt, Homo sapiens
caucucccagauaaugugaaa

SEQ ID NO: 1299375 - RNA, 17 nt, Homo sapiens
caucucugcuuucacuc

SEQ ID NO: 1299376 - RNA, 14 nt, Homo sapiens
caucucuuguauau

SEQ ID NO: 1299377 - RNA, 21 nt, Homo sapiens
caucugaagaaauugguccca

SEQ ID NO: 1299378 - RNA, 14 nt, Homo sapiens
caucugcacagugg

SEQ ID NO: 1299379 - RNA, 21 nt, Homo sapiens
caucugcauugcccagucuuu

SEQ ID NO: 1299380 - RNA, 23 nt, Homo sapiens
caucugucuugccagccagaagc

SEQ ID NO: 1299381 - RNA, 14 nt, Homo sapiens
caucuuggucacau

SEQ ID NO: 1299382 - RNA, 19 nt, Homo sapiens
caucuuggucacauacaau

SEQ ID NO: 1299383 - RNA, 18 nt, Homo sapiens
caucuuuuacauucugca

SEQ ID NO: 1299384 - RNA, 21 nt, Homo sapiens
caucuuuuuaaccugcaaaau

SEQ ID NO: 1299385 - RNA, 19 nt, Homo sapiens
caugaaaguggacaaggag

SEQ ID NO: 1299386 - RNA, 22 nt, Homo sapiens
caugaacugcggcagcaguuug

SEQ ID NO: 1299387 - RNA, 16 nt, Homo sapiens
caugaagauucuuucc

SEQ ID NO: 1299388 - RNA, 23 nt, Homo sapiens
caugaccugaagccccucccuga

SEQ ID NO: 1299389 - RNA, 21 nt, Homo sapiens
caugacucggggguggggaaa

SEQ ID NO: 1299390 - RNA, 17 nt, Homo sapiens
caugagaaguugauaua

SEQ ID NO: 1299391 - RNA, 15 nt, Homo sapiens
caugagaauaaagau

SEQ ID NO: 1299392 - RNA, 17 nt, Homo sapiens
caugaugcuuuuacuga

SEQ ID NO: 1299393 - RNA, 17 nt, Homo sapiens
caugauguacuaaagua

SEQ ID NO: 1299394 - RNA, 21 nt, Homo sapiens
caugcaagaacucaucacugu

SEQ ID NO: 1299395 - RNA, 22 nt, Homo sapiens
caugcaggugaaacccagucac

SEQ ID NO: 1299396 - RNA, 16 nt, Homo sapiens
caugcauaaaugcgau

SEQ ID NO: 1299397 - RNA, 15 nt, Homo sapiens
caugccaagcacugu

SEQ ID NO: 1299398 - RNA, 16 nt, Homo sapiens
caugccacaaggacuu

SEQ ID NO: 1299399 - RNA, 15 nt, Homo sapiens
caugccauugcacuc

SEQ ID NO: 1299400 - RNA, 16 nt, Homo sapiens
caugcccccucaguga

SEQ ID NO: 1299401 - RNA, 14 nt, Homo sapiens
caugccccuggcug

SEQ ID NO: 1299402 - RNA, 15 nt, Homo sapiens
caugccugggaaaug

SEQ ID NO: 1299403 - RNA, 22 nt, Homo sapiens
caugcguaagacguucugugua

SEQ ID NO: 1299404 - RNA, 18 nt, Homo sapiens
caugcuucagugcugcuc

SEQ ID NO: 1299405 - RNA, 17 nt, Homo sapiens
cauggaaagacugggac

SEQ ID NO: 1299406 - RNA, 21 nt, Homo sapiens
cauggaacagcauuacccucc

SEQ ID NO: 1299407 - RNA, 21 nt, Homo sapiens
cauggacaugcuucagugcug

SEQ ID NO: 1299408 - RNA, 23 nt, Homo sapiens
cauggacaugcuucagugcugcu

SEQ ID NO: 1299409 - RNA, 13 nt, Homo sapiens
cauggagcuauaa

SEQ ID NO: 1299410 - RNA, 19 nt, Homo sapiens
cauggaucaucaaggugaa

SEQ ID NO: 1299411 - RNA, 20 nt, Homo sapiens
cauggauuacuucucuauaa

SEQ ID NO: 1299412 - RNA, 21 nt, Homo sapiens
cauggcagaaggcaaacccau

SEQ ID NO: 1299413 - RNA, 23 nt, Homo sapiens
cauggcgaaaccccucucuacua

SEQ ID NO: 1299414 - RNA, 22 nt, Homo sapiens
cauggcuuuggcuuugcaaaau

SEQ ID NO: 1299415 - RNA, 19 nt, Homo sapiens
caugggucgggagagggga

SEQ ID NO: 1299416 - RNA, 16 nt, Homo sapiens
cauggguucauccuau

SEQ ID NO: 1299417 - RNA, 23 nt, Homo sapiens
cauggugagccuagcccugggac

SEQ ID NO: 1299418 - RNA, 13 nt, Homo sapiens
cauggugagcucu

SEQ ID NO: 1299419 - RNA, 21 nt, Homo sapiens
cauggugccccaggaccagcu

SEQ ID NO: 1299420 - RNA, 17 nt, Homo sapiens
caugguggguccauggg

SEQ ID NO: 1299421 - RNA, 16 nt, Homo sapiens
cauguaaacugugcac

SEQ ID NO: 1299422 - RNA, 17 nt, Homo sapiens
cauguaaacugugcacc

SEQ ID NO: 1299423 - RNA, 15 nt, Homo sapiens
cauguaauugcagau

SEQ ID NO: 1299424 - RNA, 16 nt, Homo sapiens
ccacgggaacuuggag

SEQ ID NO: 1299425 - RNA, 20 nt, Homo sapiens
ccacgugggcaaacaggcag

SEQ ID NO: 1299426 - RNA, 14 nt, Homo sapiens
ccacuaagaauuca

SEQ ID NO: 1299427 - RNA, 15 nt, Homo sapiens
ccacuaggacuucaa

SEQ ID NO: 1299428 - RNA, 23 nt, Homo sapiens
ccacucucgcucuggauuccauu

SEQ ID NO: 1299429 - RNA, 18 nt, Homo sapiens
ccacugaagcaccacagg

SEQ ID NO: 1299430 - RNA, 12 nt, Homo sapiens
ccacugaccaga

SEQ ID NO: 1299431 - RNA, 14 nt, Homo sapiens
ccacugacuuccuc

SEQ ID NO: 1299432 - RNA, 22 nt, Homo sapiens
ccacugauuuagccaugugaaa

SEQ ID NO: 1299433 - RNA, 18 nt, Homo sapiens
ccacugccacuccagucc

SEQ ID NO: 1299434 - RNA, 22 nt, Homo sapiens
ccacugccuucgcuucuugccu

SEQ ID NO: 1299435 - RNA, 18 nt, Homo sapiens
ccacugguccugcugcug

SEQ ID NO: 1299436 - RNA, 17 nt, Homo sapiens
ccacugguuucucagaa

SEQ ID NO: 1299437 - RNA, 20 nt, Homo sapiens
ccacugugguggcaguggag

SEQ ID NO: 1299438 - RNA, 17 nt, Homo sapiens
ccacuuuggagcacugu

SEQ ID NO: 1299439 - RNA, 15 nt, Homo sapiens
ccacuuuuugcagcu

SEQ ID NO: 1299440 - RNA, 21 nt, Homo sapiens
ccagaaaacaaaacugcauuu

SEQ ID NO: 1299441 - RNA, 13 nt, Homo sapiens
ccagaaacuguuc

SEQ ID NO: 1299442 - RNA, 20 nt, Homo sapiens
ccagaacaguaugaauuuga

SEQ ID NO: 1299443 - RNA, 15 nt, Homo sapiens
ccagacaauguugug

SEQ ID NO: 1299444 - RNA, 19 nt, Homo sapiens
ccagacccugaagauuuca

SEQ ID NO: 1299445 - RNA, 17 nt, Homo sapiens
ccagaccucaggugcua

SEQ ID NO: 1299446 - RNA, 17 nt, Homo sapiens
ccagagaccaaauguca

SEQ ID NO: 1299447 - RNA, 19 nt, Homo sapiens
ccagagaggguggugaccu

SEQ ID NO: 1299448 - RNA, 15 nt, Homo sapiens
ccagagcaucuugca

SEQ ID NO: 1299449 - RNA, 15 nt, Homo sapiens
ccagagcuguggugu

SEQ ID NO: 1299450 - RNA, 19 nt, Homo sapiens
ccagaugucgcccuacuca

SEQ ID NO: 1299451 - RNA, 19 nt, Homo sapiens
ccagcaaaacauaaacuga

SEQ ID NO: 1299452 - RNA, 23 nt, Homo sapiens
ccagcaccggccccauuuaccca

SEQ ID NO: 1299453 - RNA, 19 nt, Homo sapiens
ccagcacgaguggccaguu

SEQ ID NO: 1299454 - RNA, 15 nt, Homo sapiens
ccagcacuaugcuuu

SEQ ID NO: 1299455 - RNA, 12 nt, Homo sapiens
ccagcacuucca

SEQ ID NO: 1299456 - RNA, 14 nt, Homo sapiens
ccagcaguacucag

SEQ ID NO: 1299457 - RNA, 23 nt, Homo sapiens
ccagcaguggacucaaaacccau

SEQ ID NO: 1299458 - RNA, 20 nt, Homo sapiens
ccagccaucaaaaugcuuuu

SEQ ID NO: 1299459 - RNA, 14 nt, Homo sapiens
ccagccucccacaa

SEQ ID NO: 1299460 - RNA, 16 nt, Homo sapiens
ccagccuggccaauac

SEQ ID NO: 1299461 - RNA, 22 nt, Homo sapiens
ccagccuggccaguauggugaa

SEQ ID NO: 1299462 - RNA, 22 nt, Homo sapiens
ccagcuaaaauuuucgacuuga

SEQ ID NO: 1299463 - RNA, 17 nt, Homo sapiens
ccagcuaucugccugac

SEQ ID NO: 1299464 - RNA, 19 nt, Homo sapiens
ccagcuccaaccugcaaag

SEQ ID NO: 1299465 - RNA, 15 nt, Homo sapiens
ccagcuccucaucca

SEQ ID NO: 1299466 - RNA, 13 nt, Homo sapiens
ccagcugcacuga

SEQ ID NO: 1299467 - RNA, 17 nt, Homo sapiens
ccagcugggucaggcag

SEQ ID NO: 1299468 - RNA, 14 nt, Homo sapiens
ccaggaaaggccca

SEQ ID NO: 1299469 - RNA, 18 nt, Homo sapiens
aaacaccuuguacuuuau

SEQ ID NO: 1299470 - RNA, 21 nt, Homo sapiens
aaacacgccugcaaacgcugc

SEQ ID NO: 1299471 - RNA, 22 nt, Homo sapiens
aaacagaaaaaaaaauggaagc

SEQ ID NO: 1299472 - RNA, 17 nt, Homo sapiens
aaacagccuacagccag

SEQ ID NO: 1299473 - RNA, 14 nt, Homo sapiens
aaacagcugagggu

SEQ ID NO: 1299474 - RNA, 13 nt, Homo sapiens
aaacagcugccuu

SEQ ID NO: 1299475 - RNA, 21 nt, Homo sapiens
aaacauaugcacauucacuua

SEQ ID NO: 1299476 - RNA, 17 nt, Homo sapiens
aaacaucacaccugccc

SEQ ID NO: 1299477 - RNA, 19 nt, Homo sapiens
aaacaucacaccugcccua

SEQ ID NO: 1299478 - RNA, 14 nt, Homo sapiens
aaacauccaaaagu

SEQ ID NO: 1299479 - RNA, 23 nt, Homo sapiens
aaacauugccuuugaauguuaau

SEQ ID NO: 1299480 - RNA, 15 nt, Homo sapiens
aaaccaaccaugaau

SEQ ID NO: 1299481 - RNA, 17 nt, Homo sapiens
aaaccaaccaugaauga

SEQ ID NO: 1299482 - RNA, 16 nt, Homo sapiens
aaacccagucacugug

SEQ ID NO: 1299483 - RNA, 14 nt, Homo sapiens
aaacccuaaaaaga

SEQ ID NO: 1299484 - RNA, 14 nt, Homo sapiens
aaaccucaagccag

SEQ ID NO: 1299485 - RNA, 18 nt, Homo sapiens
aaaccucauuguucugua

SEQ ID NO: 1299486 - RNA, 17 nt, Homo sapiens
aaaccuuuguuaacucu

SEQ ID NO: 1299487 - RNA, 13 nt, Homo sapiens
aaacgcuaccucu

SEQ ID NO: 1299488 - RNA, 13 nt, Homo sapiens
aaacuaaaacaga

SEQ ID NO: 1299489 - RNA, 18 nt, Homo sapiens
aaacuaaaugacuuucaa

SEQ ID NO: 1299490 - RNA, 16 nt, Homo sapiens
aaacuacaucuugaaa

SEQ ID NO: 1299491 - RNA, 21 nt, Homo sapiens
aaacuagcauaucugccuuua

SEQ ID NO: 1299492 - RNA, 19 nt, Homo sapiens
aaacuauaagccaauauuc

SEQ ID NO: 1299493 - RNA, 17 nt, Homo sapiens
aaacuauguaacaugua

SEQ ID NO: 1299494 - RNA, 16 nt, Homo sapiens
aaacuauuugcgacuc

SEQ ID NO: 1299495 - RNA, 22 nt, Homo sapiens
aaacucaaaagaaggccacugu

SEQ ID NO: 1299496 - RNA, 12 nt, Homo sapiens
aaacucaucuca

SEQ ID NO: 1299497 - RNA, 13 nt, Homo sapiens
aaacucaucucau

SEQ ID NO: 1299498 - RNA, 18 nt, Homo sapiens
aaacuccugggcucaggc

SEQ ID NO: 1299499 - RNA, 12 nt, Homo sapiens
aaacugugcacc

SEQ ID NO: 1299500 - RNA, 21 nt, Homo sapiens
aaacugugcuucucuaugaua

SEQ ID NO: 1299501 - RNA, 19 nt, Homo sapiens
aaacuguuccaaucaugaa

SEQ ID NO: 1299502 - RNA, 22 nt, Homo sapiens
aaacuucuuuaguacuuacauc

SEQ ID NO: 1299503 - RNA, 18 nt, Homo sapiens
aaacuuuuaaacaugaga

SEQ ID NO: 1299504 - RNA, 23 nt, Homo sapiens
aaagaaaaauaucuuggccuaaa

SEQ ID NO: 1299505 - RNA, 12 nt, Homo sapiens
aaagaaaacugg

SEQ ID NO: 1299506 - RNA, 15 nt, Homo sapiens
aaagaaaaguauugu

SEQ ID NO: 1299507 - RNA, 22 nt, Homo sapiens
aaagaaaccacuucuggucaau

SEQ ID NO: 1299508 - RNA, 12 nt, Homo sapiens
aaagaagcuuug

SEQ ID NO: 1299509 - RNA, 21 nt, Homo sapiens
aaagaagguuggugaauuuca

SEQ ID NO: 1299510 - RNA, 15 nt, Homo sapiens
aaagaagugaaacua

SEQ ID NO: 1299511 - RNA, 18 nt, Homo sapiens
aaagaaguucacaucaga

SEQ ID NO: 1299512 - RNA, 15 nt, Homo sapiens
aaagaauuccaaagc

SEQ ID NO: 1299513 - RNA, 18 nt, Homo sapiens
aaagaauuccaaagcaaa

SEQ ID NO: 1299514 - RNA, 15 nt, Homo sapiens
aaagaauucugugag

SEQ ID NO: 1299515 - RNA, 21 nt, Homo sapiens
aaagacaagcucaaguguuca

SEQ ID NO: 1299516 - RNA, 12 nt, Homo sapiens
aaagacagugaa

SEQ ID NO: 1299517 - RNA, 18 nt, Homo sapiens
aaagacugugaacagcuu

SEQ ID NO: 1299518 - RNA, 18 nt, Homo sapiens
aaagagagucgcaucuca

SEQ ID NO: 1299519 - RNA, 15 nt, Homo sapiens
aaagaggacaucaga

SEQ ID NO: 1299520 - RNA, 23 nt, Homo sapiens
aaagaguauuaagagcaauucaa

SEQ ID NO: 1299521 - RNA, 15 nt, Homo sapiens
aaagaugacuugaaa

SEQ ID NO: 1299522 - RNA, 12 nt, Homo sapiens
aaagcacacuca

SEQ ID NO: 1299523 - RNA, 13 nt, Homo sapiens
aaagcacagauuu

SEQ ID NO: 1299524 - RNA, 16 nt, Homo sapiens
aaagcagccacgaggu

SEQ ID NO: 1299525 - RNA, 22 nt, Homo sapiens
aaagccacacucugggcuccag

SEQ ID NO: 1299526 - RNA, 21 nt, Homo sapiens
aaagcccuuguccccaugaaa

SEQ ID NO: 1299527 - RNA, 17 nt, Homo sapiens
aaagcggcugccuccau

SEQ ID NO: 1299528 - RNA, 17 nt, Homo sapiens
aaagcuaguguaccucc

SEQ ID NO: 1299529 - RNA, 22 nt, Homo sapiens
aaagcuaguguaccuccucuca

SEQ ID NO: 1299530 - RNA, 12 nt, Homo sapiens
aaagcugcucag

SEQ ID NO: 1299531 - RNA, 13 nt, Homo sapiens
aaagcugcucagg

SEQ ID NO: 1299532 - RNA, 20 nt, Homo sapiens
aaaggaaucacguuagagga

SEQ ID NO: 1299533 - RNA, 23 nt, Homo sapiens
aaaggacucuggaagauuuucau

SEQ ID NO: 1299534 - RNA, 16 nt, Homo sapiens
aaaggcaagccagcau

SEQ ID NO: 1299535 - RNA, 13 nt, Homo sapiens
aaaggcacaguga

SEQ ID NO: 1299536 - RNA, 16 nt, Homo sapiens
aaaggcccaaagguga

SEQ ID NO: 1299537 - RNA, 20 nt, Homo sapiens
aaaggcugagaacacuguga

SEQ ID NO: 1299538 - RNA, 15 nt, Homo sapiens
aaaggcugguggcaa

SEQ ID NO: 1299539 - RNA, 14 nt, Homo sapiens
aaaggggacaagga

SEQ ID NO: 1299540 - RNA, 16 nt, Homo sapiens
aaaggggauggaguga

SEQ ID NO: 1299541 - RNA, 15 nt, Homo sapiens
aaagguggacuggaa

SEQ ID NO: 1299542 - RNA, 16 nt, Homo sapiens
aaagguugaagcacca

SEQ ID NO: 1299543 - RNA, 17 nt, Homo sapiens
aaagguuuacagaauuu

SEQ ID NO: 1299544 - RNA, 15 nt, Homo sapiens
aaaguacuagcuaaa

SEQ ID NO: 1299545 - RNA, 17 nt, Homo sapiens
aaaguagggaccucaga

SEQ ID NO: 1299546 - RNA, 20 nt, Homo sapiens
aaagucacacgaaucucacc

SEQ ID NO: 1299547 - RNA, 23 nt, Homo sapiens
aaagucagugcccaacuguuaua

SEQ ID NO: 1299548 - RNA, 21 nt, Homo sapiens
aaagugacuaauggcaugaga

SEQ ID NO: 1299549 - RNA, 17 nt, Homo sapiens
aaagugagaagaccucu

SEQ ID NO: 1299550 - RNA, 18 nt, Homo sapiens
aaagugcauauuuaucca

SEQ ID NO: 1299551 - RNA, 23 nt, Homo sapiens
aaagugcuucauucuuugcagga

SEQ ID NO: 1299552 - RNA, 18 nt, Homo sapiens
aaaguguauuuguguaua

SEQ ID NO: 1299553 - RNA, 22 nt, Homo sapiens
aaagugucaccccucacuguga

SEQ ID NO: 1299554 - RNA, 20 nt, Homo sapiens
aaaguugagggaaagagcuu

SEQ ID NO: 1299555 - RNA, 14 nt, Homo sapiens
aaaguuuagggaaa

SEQ ID NO: 1299556 - RNA, 23 nt, Homo sapiens
aaaguuuuauaacuuguguuauu

SEQ ID NO: 1299557 - RNA, 13 nt, Homo sapiens
aaauaaaacugag

SEQ ID NO: 1299558 - RNA, 17 nt, Homo sapiens
aaauaaaaggaagccaa

SEQ ID NO: 1299559 - RNA, 17 nt, Homo sapiens
aaauaaagcuguucuca

SEQ ID NO: 1299560 - RNA, 22 nt, Homo sapiens
aaauaaagcuguucucauuccu

SEQ ID NO: 1299561 - RNA, 16 nt, Homo sapiens
aaauaaaucaguucau

SEQ ID NO: 1299562 - RNA, 21 nt, Homo sapiens
aaucacagaugaguuaucuaa

SEQ ID NO: 1299563 - RNA, 17 nt, Homo sapiens
aaucagaacuguuggca

SEQ ID NO: 1299564 - RNA, 16 nt, Homo sapiens
aaucagccacauucua

SEQ ID NO: 1299565 - RNA, 13 nt, Homo sapiens
aaucagugcuccu

SEQ ID NO: 1299566 - RNA, 23 nt, Homo sapiens
aaucauagcaauaucauaauuaa

SEQ ID NO: 1299567 - RNA, 18 nt, Homo sapiens
aaucaugccauugcacuc

SEQ ID NO: 1299568 - RNA, 21 nt, Homo sapiens
aaucaugccauugcacuccag

SEQ ID NO: 1299569 - RNA, 21 nt, Homo sapiens
aaucauguugaucauguacuu

SEQ ID NO: 1299570 - RNA, 19 nt, Homo sapiens
aaucauuuuauaugucaaa

SEQ ID NO: 1299571 - RNA, 20 nt, Homo sapiens
aaucauuuucauuccuaaag

SEQ ID NO: 1299572 - RNA, 21 nt, Homo sapiens
aauccaauuaaucaaaccacu

SEQ ID NO: 1299573 - RNA, 16 nt, Homo sapiens
aauccagacccggcug

SEQ ID NO: 1299574 - RNA, 20 nt, Homo sapiens
aauccaugaaccaagaccau

SEQ ID NO: 1299575 - RNA, 14 nt, Homo sapiens
aaucccagcacuuu

SEQ ID NO: 1299576 - RNA, 16 nt, Homo sapiens
aaucccagcacuuugg

SEQ ID NO: 1299577 - RNA, 17 nt, Homo sapiens
aauccuuccacuaucau

SEQ ID NO: 1299578 - RNA, 23 nt, Homo sapiens
aaucuaccaacgaaagacgugau

SEQ ID NO: 1299579 - RNA, 17 nt, Homo sapiens
aaucuaccuugcagugu

SEQ ID NO: 1299580 - RNA, 15 nt, Homo sapiens
aaucuacuaauucca

SEQ ID NO: 1299581 - RNA, 16 nt, Homo sapiens
aaucuacuaauuccac

SEQ ID NO: 1299582 - RNA, 14 nt, Homo sapiens
aaucuagugaucuc

SEQ ID NO: 1299583 - RNA, 18 nt, Homo sapiens
aaucucaccccaucccac

SEQ ID NO: 1299584 - RNA, 17 nt, Homo sapiens
aaucugagaaacucuac

SEQ ID NO: 1299585 - RNA, 23 nt, Homo sapiens
aaucugaggccuccucucucagu

SEQ ID NO: 1299586 - RNA, 16 nt, Homo sapiens
aaucugcucacuuuaa

SEQ ID NO: 1299587 - RNA, 18 nt, Homo sapiens
aaucugggauguacuguu

SEQ ID NO: 1299588 - RNA, 17 nt, Homo sapiens
aaucuugcucugcuuga

SEQ ID NO: 1299589 - RNA, 18 nt, Homo sapiens
aaucuuuuacaacugccu

SEQ ID NO: 1299590 - RNA, 17 nt, Homo sapiens
aaugaaauguaugugcu

SEQ ID NO: 1299591 - RNA, 22 nt, Homo sapiens
aaugaacacucuuuugcuuuau

SEQ ID NO: 1299592 - RNA, 22 nt, Homo sapiens
aaugaagaaaagagucuauaca

SEQ ID NO: 1299593 - RNA, 15 nt, Homo sapiens
aaugagccuggcaag

SEQ ID NO: 1299594 - RNA, 13 nt, Homo sapiens
aaugauacuuacu

SEQ ID NO: 1299595 - RNA, 12 nt, Homo sapiens
aaugaucauuaa

SEQ ID NO: 1299596 - RNA, 13 nt, Homo sapiens
aaugauccuguau

SEQ ID NO: 1299597 - RNA, 19 nt, Homo sapiens
aaugauuuuagauuuucca

SEQ ID NO: 1299598 - RNA, 16 nt, Homo sapiens
aaugcagcagggaugc

SEQ ID NO: 1299599 - RNA, 20 nt, Homo sapiens
aaugcagcagggaugcccug

SEQ ID NO: 1299600 - RNA, 17 nt, Homo sapiens
aaugcagcauguugccc

SEQ ID NO: 1299601 - RNA, 19 nt, Homo sapiens
aaugcagcgugaagggauu

SEQ ID NO: 1299602 - RNA, 21 nt, Homo sapiens
acacauuuuuauaaaaaugag

SEQ ID NO: 1299603 - RNA, 17 nt, Homo sapiens
acaccaugauuaaccac

SEQ ID NO: 1299604 - RNA, 21 nt, Homo sapiens
acaccugagaaacaucuagaa

SEQ ID NO: 1299605 - RNA, 18 nt, Homo sapiens
acaccuuuuauugacaca

SEQ ID NO: 1299606 - RNA, 13 nt, Homo sapiens
acacgaagaccau

SEQ ID NO: 1299607 - RNA, 21 nt, Homo sapiens
acacgccugcaaacgcugccu

SEQ ID NO: 1299608 - RNA, 14 nt, Homo sapiens
acacuaacuaugca

SEQ ID NO: 1299609 - RNA, 22 nt, Homo sapiens
acacuacucuuacauguauaaa

SEQ ID NO: 1299610 - RNA, 22 nt, Homo sapiens
acacuagacaagccagaacuug

SEQ ID NO: 1299611 - RNA, 20 nt, Homo sapiens
acacuauuuaucugugcaaa

SEQ ID NO: 1299612 - RNA, 13 nt, Homo sapiens
acacucaugaagc

SEQ ID NO: 1299613 - RNA, 14 nt, Homo sapiens
acacucaugaagca

SEQ ID NO: 1299614 - RNA, 16 nt, Homo sapiens
acacucuauaagauuc

SEQ ID NO: 1299615 - RNA, 22 nt, Homo sapiens
acacucuggcugcucccugaca

SEQ ID NO: 1299616 - RNA, 13 nt, Homo sapiens
acacugaugauuu

SEQ ID NO: 1299617 - RNA, 16 nt, Homo sapiens
acacugaugcuuagau

SEQ ID NO: 1299618 - RNA, 15 nt, Homo sapiens
acacugcaggcauca

SEQ ID NO: 1299619 - RNA, 21 nt, Homo sapiens
acacugcugcuccagugcagg

SEQ ID NO: 1299620 - RNA, 15 nt, Homo sapiens
acacuggcagacugu

SEQ ID NO: 1299621 - RNA, 21 nt, Homo sapiens
acacuggcguuacugcuugac

SEQ ID NO: 1299622 - RNA, 21 nt, Homo sapiens
acacuguauguuauagaacuu

SEQ ID NO: 1299623 - RNA, 13 nt, Homo sapiens
acacugugucauu

SEQ ID NO: 1299624 - RNA, 19 nt, Homo sapiens
acacuuacuguaagacauu

SEQ ID NO: 1299625 - RNA, 21 nt, Homo sapiens
acacuuacuguaagacauuag

SEQ ID NO: 1299626 - RNA, 14 nt, Homo sapiens
acagaacacccaau

SEQ ID NO: 1299627 - RNA, 13 nt, Homo sapiens
acagacaacacug

SEQ ID NO: 1299628 - RNA, 11 nt, Homo sapiens
acagaccucag

SEQ ID NO: 1299629 - RNA, 19 nt, Homo sapiens
acagagcuucccugacuca

SEQ ID NO: 1299630 - RNA, 22 nt, Homo sapiens
acagauccagggacugaagcca

SEQ ID NO: 1299631 - RNA, 16 nt, Homo sapiens
acagaucuaucuccuc

SEQ ID NO: 1299632 - RNA, 15 nt, Homo sapiens
acagauucacacugu

SEQ ID NO: 1299633 - RNA, 16 nt, Homo sapiens
acagauugcugccuca

SEQ ID NO: 1299634 - RNA, 10 nt, Homo sapiens
acagauuuga

SEQ ID NO: 1299635 - RNA, 18 nt, Homo sapiens
acagcaaccccaggcuga

SEQ ID NO: 1299636 - RNA, 14 nt, Homo sapiens
acagcacagccaac

SEQ ID NO: 1299637 - RNA, 11 nt, Homo sapiens
acagcaucucc

SEQ ID NO: 1299638 - RNA, 22 nt, Homo sapiens
acagcauuugauaaaauccaaa

SEQ ID NO: 1299639 - RNA, 20 nt, Homo sapiens
acagccacuccccuccacuc

SEQ ID NO: 1299640 - RNA, 15 nt, Homo sapiens
acagccaucaaggga

SEQ ID NO: 1299641 - RNA, 23 nt, Homo sapiens
acagccccacccuggugggccaa

SEQ ID NO: 1299642 - RNA, 21 nt, Homo sapiens
acagccguccucccuccuagg

SEQ ID NO: 1299643 - RNA, 23 nt, Homo sapiens
acagccucccacccccaucucuc

SEQ ID NO: 1299644 - RNA, 14 nt, Homo sapiens
acagccuuugccca

SEQ ID NO: 1299645 - RNA, 15 nt, Homo sapiens
acagccuuugcccaa

SEQ ID NO: 1299646 - RNA, 16 nt, Homo sapiens
acagcuugcugcuaaa

SEQ ID NO: 1299647 - RNA, 16 nt, Homo sapiens
acagcuugcugucacu

SEQ ID NO: 1299648 - RNA, 23 nt, Homo sapiens
acagcuuucugaccuucagcuca

SEQ ID NO: 1299649 - RNA, 22 nt, Homo sapiens
acaggacacagucagauuucca

SEQ ID NO: 1299650 - RNA, 14 nt, Homo sapiens
acaggagcugggau

SEQ ID NO: 1299651 - RNA, 15 nt, Homo sapiens
acaggaggaguauga

SEQ ID NO: 1299652 - RNA, 13 nt, Homo sapiens
acaggcaccugcc

SEQ ID NO: 1299653 - RNA, 14 nt, Homo sapiens
acaggcaccugcca

SEQ ID NO: 1299654 - RNA, 17 nt, Homo sapiens
acaggccugagauuuca

SEQ ID NO: 1299655 - RNA, 22 nt, Homo sapiens
acagggaaugccugagugccug

SEQ ID NO: 1299656 - RNA, 20 nt, Homo sapiens
acagggagacugcaucucaa

SEQ ID NO: 1299657 - RNA, 17 nt, Homo sapiens
acagggucugccuccag

SEQ ID NO: 1299658 - RNA, 22 nt, Homo sapiens
acaggguuuugccauguuggcc

SEQ ID NO: 1299659 - RNA, 15 nt, Homo sapiens
acagguacagcaaca

SEQ ID NO: 1299660 - RNA, 21 nt, Homo sapiens
acagguggccuagcaggcaca

SEQ ID NO: 1299661 - RNA, 17 nt, Homo sapiens
acagguguuggugacaa

SEQ ID NO: 1299662 - RNA, 21 nt, Homo sapiens
acagguguuguccaagcucuu

SEQ ID NO: 1299663 - RNA, 19 nt, Homo sapiens
acagguuacagugagcaaa

SEQ ID NO: 1299664 - RNA, 19 nt, Homo sapiens
acaguaaauggcuuaucca

SEQ ID NO: 1299665 - RNA, 21 nt, Homo sapiens
acaguacaggcagcacagaga

SEQ ID NO: 1299666 - RNA, 17 nt, Homo sapiens
acaguacuugucuucac

SEQ ID NO: 1299667 - RNA, 16 nt, Homo sapiens
acaguagauuuuccaa

SEQ ID NO: 1299668 - RNA, 12 nt, Homo sapiens
acaguaucucag

SEQ ID NO: 1299669 - RNA, 11 nt, Homo sapiens
acagugacauu

SEQ ID NO: 1299670 - RNA, 22 nt, Homo sapiens
acagugacauuuauuuuucuca

SEQ ID NO: 1299671 - RNA, 13 nt, Homo sapiens
acagugcauuuac

SEQ ID NO: 1299672 - RNA, 22 nt, Homo sapiens
acaguggggaagagugacucuc

SEQ ID NO: 1299673 - RNA, 23 nt, Homo sapiens
acaguggggaagagugacucucc

SEQ ID NO: 1299674 - RNA, 21 nt, Homo sapiens
acaguggggaaggcaugacac

SEQ ID NO: 1299675 - RNA, 20 nt, Homo sapiens
acaguucggugagcuacaaa

SEQ ID NO: 1299676 - RNA, 17 nt, Homo sapiens
acaguucuuugggccag

SEQ ID NO: 1299677 - RNA, 22 nt, Homo sapiens
acaguugaaaaacagcugaggg

SEQ ID NO: 1299678 - RNA, 22 nt, Homo sapiens
acauacauugauucaugucuca

SEQ ID NO: 1299679 - RNA, 14 nt, Homo sapiens
acauagcaugacau

SEQ ID NO: 1299680 - RNA, 21 nt, Homo sapiens
acauagccaccugucaccucu

SEQ ID NO: 1299681 - RNA, 15 nt, Homo sapiens
acauagcugagguaa

SEQ ID NO: 1299682 - RNA, 12 nt, Homo sapiens
acauagcugugc

SEQ ID NO: 1299683 - RNA, 13 nt, Homo sapiens
acauaucugucau

SEQ ID NO: 1299684 - RNA, 23 nt, Homo sapiens
acauauucuaguguaacacugca

SEQ ID NO: 1299685 - RNA, 23 nt, Homo sapiens
acaucaugcuggaaccugcaaaa

SEQ ID NO: 1299686 - RNA, 15 nt, Homo sapiens
acaucauuacuauaa

SEQ ID NO: 1299687 - RNA, 17 nt, Homo sapiens
acaucauuuuaacagcu

SEQ ID NO: 1299688 - RNA, 19 nt, Homo sapiens
acauccaaagcagacagcu

SEQ ID NO: 1299689 - RNA, 20 nt, Homo sapiens
acauccaaagcagacagcuc

SEQ ID NO: 1299690 - RNA, 19 nt, Homo sapiens
acauccauugucucuucau

SEQ ID NO: 1299691 - RNA, 21 nt, Homo sapiens
acaucccgggacgcagcagga

SEQ ID NO: 1299692 - RNA, 16 nt, Homo sapiens
acauccugugccucca

SEQ ID NO: 1299693 - RNA, 18 nt, Homo sapiens
acauccugugccuccauc

SEQ ID NO: 1299694 - RNA, 15 nt, Homo sapiens
acaucuauucucucc

SEQ ID NO: 1299695 - RNA, 21 nt, Homo sapiens
acaucuccuguggucucugac

SEQ ID NO: 1299696 - RNA, 13 nt, Homo sapiens
acaucucugggaa

SEQ ID NO: 1299697 - RNA, 15 nt, Homo sapiens
acaucuugaaaauau

SEQ ID NO: 1299698 - RNA, 16 nt, Homo sapiens
aagccacacucugggc

SEQ ID NO: 1299699 - RNA, 19 nt, Homo sapiens
aagccagccaacucuuucu

SEQ ID NO: 1299700 - RNA, 13 nt, Homo sapiens
aagccauuccaaa

SEQ ID NO: 1299701 - RNA, 20 nt, Homo sapiens
aagcccgcggggacauuggg

SEQ ID NO: 1299702 - RNA, 20 nt, Homo sapiens
aagcccuuguccccaugaaa

SEQ ID NO: 1299703 - RNA, 12 nt, Homo sapiens
aagccugugaaa

SEQ ID NO: 1299704 - RNA, 14 nt, Homo sapiens
aagccugugaaagg

SEQ ID NO: 1299705 - RNA, 20 nt, Homo sapiens
aagcgauccucccaccucag

SEQ ID NO: 1299706 - RNA, 13 nt, Homo sapiens
aagcggcugccuc

SEQ ID NO: 1299707 - RNA, 12 nt, Homo sapiens
aagcgugaaggc

SEQ ID NO: 1299708 - RNA, 16 nt, Homo sapiens
aagcuauccaggauuu

SEQ ID NO: 1299709 - RNA, 18 nt, Homo sapiens
aagcucaggaccaggcaa

SEQ ID NO: 1299710 - RNA, 20 nt, Homo sapiens
aagcugagcaccaggggaug

SEQ ID NO: 1299711 - RNA, 13 nt, Homo sapiens
aagcuggucucaa

SEQ ID NO: 1299712 - RNA, 19 nt, Homo sapiens
aagcuguugaagucucagg

SEQ ID NO: 1299713 - RNA, 19 nt, Homo sapiens
aagcuuaauggauuguuaa

SEQ ID NO: 1299714 - RNA, 18 nt, Homo sapiens
aagcuucccuccaucccc

SEQ ID NO: 1299715 - RNA, 13 nt, Homo sapiens
aagcuucuagagg

SEQ ID NO: 1299716 - RNA, 20 nt, Homo sapiens
aaggaaaaaacuaguauucc

SEQ ID NO: 1299717 - RNA, 14 nt, Homo sapiens
aaggaacacugaca

SEQ ID NO: 1299718 - RNA, 14 nt, Homo sapiens
aaggaacugcauca

SEQ ID NO: 1299719 - RNA, 14 nt, Homo sapiens
aaggaaucacguua

SEQ ID NO: 1299720 - RNA, 22 nt, Homo sapiens
aaggaaucauauuccuuuauga

SEQ ID NO: 1299721 - RNA, 15 nt, Homo sapiens
aaggacacagaugaa

SEQ ID NO: 1299722 - RNA, 20 nt, Homo sapiens
aaggacuucacugcaaguuu

SEQ ID NO: 1299723 - RNA, 14 nt, Homo sapiens
aaggagcaugucac

SEQ ID NO: 1299724 - RNA, 16 nt, Homo sapiens
aaggaggccacgugau

SEQ ID NO: 1299725 - RNA, 19 nt, Homo sapiens
aaggagggagcuacucuca

SEQ ID NO: 1299726 - RNA, 20 nt, Homo sapiens
aaggagggcagaucacuuca

SEQ ID NO: 1299727 - RNA, 20 nt, Homo sapiens
aaggauaaugaauacuuuau

SEQ ID NO: 1299728 - RNA, 12 nt, Homo sapiens
aaggauguugcc

SEQ ID NO: 1299729 - RNA, 11 nt, Homo sapiens
aaggauguuuu

SEQ ID NO: 1299730 - RNA, 20 nt, Homo sapiens
aaggcaggcagaucacuuga

SEQ ID NO: 1299731 - RNA, 20 nt, Homo sapiens
aaggccacuguuugucucac

SEQ ID NO: 1299732 - RNA, 17 nt, Homo sapiens
aaggcccugcugaguca

SEQ ID NO: 1299733 - RNA, 17 nt, Homo sapiens
aaggccucauccugggg

SEQ ID NO: 1299734 - RNA, 13 nt, Homo sapiens
aaggccucugugg

SEQ ID NO: 1299735 - RNA, 16 nt, Homo sapiens
aaggcguauguauuaa

SEQ ID NO: 1299736 - RNA, 20 nt, Homo sapiens
aaggcguggagcugccugau

SEQ ID NO: 1299737 - RNA, 13 nt, Homo sapiens
accacaugccaag

SEQ ID NO: 1299738 - RNA, 15 nt, Homo sapiens
accaccucaccaguu

SEQ ID NO: 1299739 - RNA, 21 nt, Homo sapiens
accacuaagaauucaaacugg

SEQ ID NO: 1299740 - RNA, 13 nt, Homo sapiens
accacuccugcca

SEQ ID NO: 1299741 - RNA, 17 nt, Homo sapiens
accacugauaaaaccau

SEQ ID NO: 1299742 - RNA, 15 nt, Homo sapiens
accacuuaauugcuu

SEQ ID NO: 1299743 - RNA, 14 nt, Homo sapiens
accacuucagcuga

SEQ ID NO: 1299744 - RNA, 17 nt, Homo sapiens
accacuuuuugcagcuu

SEQ ID NO: 1299745 - RNA, 16 nt, Homo sapiens
accagaacaguaugaa

SEQ ID NO: 1299746 - RNA, 13 nt, Homo sapiens
accagacagacaa

SEQ ID NO: 1299747 - RNA, 19 nt, Homo sapiens
accagacagacaacacugg

SEQ ID NO: 1299748 - RNA, 15 nt, Homo sapiens
accagagaccaaaug

SEQ ID NO: 1299749 - RNA, 16 nt, Homo sapiens
accagagccucaguga

SEQ ID NO: 1299750 - RNA, 17 nt, Homo sapiens
accagagccucagugag

SEQ ID NO: 1299751 - RNA, 16 nt, Homo sapiens
accagauaacugagga

SEQ ID NO: 1299752 - RNA, 13 nt, Homo sapiens
accagcccacccc

SEQ ID NO: 1299753 - RNA, 23 nt, Homo sapiens
accagccucaaaaacgcccucaa

SEQ ID NO: 1299754 - RNA, 22 nt, Homo sapiens
accagccuggucaacaugguga

SEQ ID NO: 1299755 - RNA, 17 nt, Homo sapiens
accagcuucauguggcu

SEQ ID NO: 1299756 - RNA, 15 nt, Homo sapiens
accaggaggacaaga

SEQ ID NO: 1299757 - RNA, 16 nt, Homo sapiens
accaggccaccucccc

SEQ ID NO: 1299758 - RNA, 20 nt, Homo sapiens
accaggcgcccgggauccag

SEQ ID NO: 1299759 - RNA, 11 nt, Homo sapiens
accagggacac

SEQ ID NO: 1299760 - RNA, 20 nt, Homo sapiens
accauaaaaaggaauccacu

SEQ ID NO: 1299761 - RNA, 14 nt, Homo sapiens
accauaaccacuga

SEQ ID NO: 1299762 - RNA, 17 nt, Homo sapiens
accauacagccaggaaa

SEQ ID NO: 1299763 - RNA, 15 nt, Homo sapiens
accauaguaccauuu

SEQ ID NO: 1299764 - RNA, 14 nt, Homo sapiens
accauauugcccag

SEQ ID NO: 1299765 - RNA, 17 nt, Homo sapiens
accauauugcccagggu

SEQ ID NO: 1299766 - RNA, 17 nt, Homo sapiens
accaucgaucaugaugu

SEQ ID NO: 1299767 - RNA, 14 nt, Homo sapiens
accaucugucuugc

SEQ ID NO: 1299768 - RNA, 16 nt, Homo sapiens
accaucugucuugcca

SEQ ID NO: 1299769 - RNA, 14 nt, Homo sapiens
accauggcacugag

SEQ ID NO: 1299770 - RNA, 18 nt, Homo sapiens
accauugcuguucuacuu

SEQ ID NO: 1299771 - RNA, 21 nt, Homo sapiens
accauuuguaaaacauuccaa

SEQ ID NO: 1299772 - RNA, 16 nt, Homo sapiens
accauuuguauccacu

SEQ ID NO: 1299773 - RNA, 15 nt, Homo sapiens
acccaagaccucagg

SEQ ID NO: 1299774 - RNA, 21 nt, Homo sapiens
acccaagcagagaagcucucg

SEQ ID NO: 1299775 - RNA, 17 nt, Homo sapiens
acccaagugccaagaca

SEQ ID NO: 1299776 - RNA, 20 nt, Homo sapiens
acccaagugccaagacacag

SEQ ID NO: 1299777 - RNA, 19 nt, Homo sapiens
acccaaguugaagacuuug

SEQ ID NO: 1299778 - RNA, 15 nt, Homo sapiens
acccaauagcugccc

SEQ ID NO: 1299779 - RNA, 17 nt, Homo sapiens
acccaauucaaauugac

SEQ ID NO: 1299780 - RNA, 20 nt, Homo sapiens
acccacaguggaaagacagc

SEQ ID NO: 1299781 - RNA, 15 nt, Homo sapiens
acccacuaucccauu

SEQ ID NO: 1299782 - RNA, 15 nt, Homo sapiens
acccacuggcacauu

SEQ ID NO: 1299783 - RNA, 14 nt, Homo sapiens
acccacuucuccca

SEQ ID NO: 1299784 - RNA, 13 nt, Homo sapiens
acccagagcaccc

SEQ ID NO: 1299785 - RNA, 22 nt, Homo sapiens
acccagaugggggaaagcacag

SEQ ID NO: 1299786 - RNA, 12 nt, Homo sapiens
acccaucugcac

SEQ ID NO: 1299787 - RNA, 17 nt, Homo sapiens
acccaugcccagcugua

SEQ ID NO: 1299788 - RNA, 13 nt, Homo sapiens
acccauucuacac

SEQ ID NO: 1299789 - RNA, 23 nt, Homo sapiens
accccaaaggaacacugacauca

SEQ ID NO: 1299790 - RNA, 20 nt, Homo sapiens
acccccggaacaagccuaaa

SEQ ID NO: 1299791 - RNA, 16 nt, Homo sapiens
accccucaacaccucu

SEQ ID NO: 1299792 - RNA, 17 nt, Homo sapiens
accccucacugugacug

SEQ ID NO: 1299793 - RNA, 21 nt, Homo sapiens
accccucucuacuaaaaauac

SEQ ID NO: 1299794 - RNA, 20 nt, Homo sapiens
acccggcugcagaggccaga

SEQ ID NO: 1299795 - RNA, 12 nt, Homo sapiens
acccuaaaaaga

SEQ ID NO: 1299796 - RNA, 17 nt, Homo sapiens
acccuauaaaucaacac

SEQ ID NO: 1299797 - RNA, 20 nt, Homo sapiens
acccuccuugggacugaagg

SEQ ID NO: 1299798 - RNA, 22 nt, Homo sapiens
acccucugcuucccucucucuu

SEQ ID NO: 1299799 - RNA, 15 nt, Homo sapiens
acccucuuugcugca

SEQ ID NO: 1299800 - RNA, 17 nt, Homo sapiens
acccugaaggggccaug

SEQ ID NO: 1299801 - RNA, 17 nt, Homo sapiens
acccugcaggacuugcc

SEQ ID NO: 1299802 - RNA, 22 nt, Homo sapiens
acccugcgcccaguccuuccac

SEQ ID NO: 1299803 - RNA, 15 nt, Homo sapiens
acccuguuaauccca

SEQ ID NO: 1299804 - RNA, 16 nt, Homo sapiens
acccuguuaaucccaa

SEQ ID NO: 1299805 - RNA, 18 nt, Homo sapiens
acccuucaucuuccugug

SEQ ID NO: 1299806 - RNA, 21 nt, Homo sapiens
acccuucuggaaacugugaag

SEQ ID NO: 1299807 - RNA, 19 nt, Homo sapiens
acccuuguuuacacauacc

SEQ ID NO: 1299808 - RNA, 20 nt, Homo sapiens
acccuuucauucagccuuua

SEQ ID NO: 1299809 - RNA, 14 nt, Homo sapiens
accgagagccaaac

SEQ ID NO: 1299810 - RNA, 20 nt, Homo sapiens
accgcuccagguaccuugac

SEQ ID NO: 1299811 - RNA, 23 nt, Homo sapiens
accgcugauucucagggucucug

SEQ ID NO: 1299812 - RNA, 16 nt, Homo sapiens
accggguggaagggau

SEQ ID NO: 1299813 - RNA, 14 nt, Homo sapiens
accguacuguggaa

SEQ ID NO: 1299814 - RNA, 21 nt, Homo sapiens
accguuuugaagcuacugugu

SEQ ID NO: 1299815 - RNA, 15 nt, Homo sapiens
accuacacacuguca

SEQ ID NO: 1299816 - RNA, 14 nt, Homo sapiens
accuacccaugacc

SEQ ID NO: 1299817 - RNA, 15 nt, Homo sapiens
accuacccaugaccu

SEQ ID NO: 1299818 - RNA, 21 nt, Homo sapiens
accuagccuuagaagucacac

SEQ ID NO: 1299819 - RNA, 17 nt, Homo sapiens
accucaaccuaugguau

SEQ ID NO: 1299820 - RNA, 16 nt, Homo sapiens
accucaccaguuucca

SEQ ID NO: 1299821 - RNA, 17 nt, Homo sapiens
accucacgcaccuccca

SEQ ID NO: 1299822 - RNA, 22 nt, Homo sapiens
accucagaguauggagcucaga

SEQ ID NO: 1299823 - RNA, 21 nt, Homo sapiens
accucaggugauccaccugcc

SEQ ID NO: 1299824 - RNA, 20 nt, Homo sapiens
accuccauuaaauuugguac

SEQ ID NO: 1299825 - RNA, 17 nt, Homo sapiens
accucccauccuaauca

SEQ ID NO: 1299826 - RNA, 21 nt, Homo sapiens
accuccucccuaaugcucacc

SEQ ID NO: 1299827 - RNA, 14 nt, Homo sapiens
accuccugucucug

SEQ ID NO: 1299828 - RNA, 21 nt, Homo sapiens
accucgaguacugugggcaau

SEQ ID NO: 1299829 - RNA, 10 nt, Homo sapiens
accucugcau

SEQ ID NO: 1299830 - RNA, 11 nt, Homo sapiens
accucuuccac

SEQ ID NO: 1299831 - RNA, 15 nt, Homo sapiens
accucuugaaaauag

SEQ ID NO: 1299832 - RNA, 13 nt, Homo sapiens
accugauuuacua

SEQ ID NO: 1299833 - RNA, 12 nt, Homo sapiens
accugcaaaaaa

SEQ ID NO: 1299834 - RNA, 17 nt, Homo sapiens
accugcagcccauggug

SEQ ID NO: 1299835 - RNA, 23 nt, Homo sapiens
cucaagaaauaaaaggaagccaa

SEQ ID NO: 1299836 - RNA, 17 nt, Homo sapiens
cucaagcaauccucuca

SEQ ID NO: 1299837 - RNA, 23 nt, Homo sapiens
cucaagcgauccucccaccucag

SEQ ID NO: 1299838 - RNA, 23 nt, Homo sapiens
cucaagcuguccucccaccucag

SEQ ID NO: 1299839 - RNA, 22 nt, Homo sapiens
cucaagugauucuccugccuca

SEQ ID NO: 1299840 - RNA, 15 nt, Homo sapiens
cucaaucuacaggcc

SEQ ID NO: 1299841 - RNA, 13 nt, Homo sapiens
cucacaaccugaa

SEQ ID NO: 1299842 - RNA, 19 nt, Homo sapiens
cucacaccuguaaucccag

SEQ ID NO: 1299843 - RNA, 22 nt, Homo sapiens
cucacacggacacucaaaagcu

SEQ ID NO: 1299844 - RNA, 20 nt, Homo sapiens
cucacacuuuuggaaccaug

SEQ ID NO: 1299845 - RNA, 18 nt, Homo sapiens
cucacaggccccaggaaa

SEQ ID NO: 1299846 - RNA, 12 nt, Homo sapiens
cucacaguacug

SEQ ID NO: 1299847 - RNA, 15 nt, Homo sapiens
cucacauaucuguca

SEQ ID NO: 1299848 - RNA, 15 nt, Homo sapiens
cucacauuagaucua

SEQ ID NO: 1299849 - RNA, 21 nt, Homo sapiens
cucacauuagaucuaguuacu

SEQ ID NO: 1299850 - RNA, 14 nt, Homo sapiens
cucaccuacuccag

SEQ ID NO: 1299851 - RNA, 16 nt, Homo sapiens
cucacgcaccucccau

SEQ ID NO: 1299852 - RNA, 18 nt, Homo sapiens
cucacgcuucacagugau

SEQ ID NO: 1299853 - RNA, 17 nt, Homo sapiens
cucacucccaccugcau

SEQ ID NO: 1299854 - RNA, 13 nt, Homo sapiens
cucagaaagccaa

SEQ ID NO: 1299855 - RNA, 13 nt, Homo sapiens
cucagacaaaacc

SEQ ID NO: 1299856 - RNA, 22 nt, Homo sapiens
cucagacaccugugugcuguag

SEQ ID NO: 1299857 - RNA, 13 nt, Homo sapiens
cucagagcugucc

SEQ ID NO: 1299858 - RNA, 16 nt, Homo sapiens
cucagagcuguccuca

SEQ ID NO: 1299859 - RNA, 16 nt, Homo sapiens
cucagaggcgcacugu

SEQ ID NO: 1299860 - RNA, 22 nt, Homo sapiens
cucagaggcgcacugugacccc

SEQ ID NO: 1299861 - RNA, 18 nt, Homo sapiens
cucagaucaguguaccau

SEQ ID NO: 1299862 - RNA, 21 nt, Homo sapiens
cucagcagcugguaaucuugc

SEQ ID NO: 1299863 - RNA, 22 nt, Homo sapiens
cucagcauuugauuaacauuug

SEQ ID NO: 1299864 - RNA, 14 nt, Homo sapiens
cucagccagcacuu

SEQ ID NO: 1299865 - RNA, 19 nt, Homo sapiens
cucagccuggccagacaca

SEQ ID NO: 1299866 - RNA, 21 nt, Homo sapiens
cucagccuuggcagcccugau

SEQ ID NO: 1299867 - RNA, 14 nt, Homo sapiens
cucagcucuuggcu

SEQ ID NO: 1299868 - RNA, 18 nt, Homo sapiens
cucaggaguuugagacca

SEQ ID NO: 1299869 - RNA, 22 nt, Homo sapiens
cucagguagaagguugacacag

SEQ ID NO: 1299870 - RNA, 17 nt, Homo sapiens
cucaggucuguacuuag

SEQ ID NO: 1299871 - RNA, 18 nt, Homo sapiens
cucaguauccaugcucuu

SEQ ID NO: 1299872 - RNA, 18 nt, Homo sapiens
cucagucucugagcagug

SEQ ID NO: 1299873 - RNA, 11 nt, Homo sapiens
cucagugcagg

SEQ ID NO: 1299874 - RNA, 23 nt, Homo sapiens
cucaguuauuacauguaauuuga

SEQ ID NO: 1299875 - RNA, 22 nt, Homo sapiens
cucaguucuugagggccucccc

SEQ ID NO: 1299876 - RNA, 15 nt, Homo sapiens
cucauaaaaagcaaa

SEQ ID NO: 1299877 - RNA, 19 nt, Homo sapiens
cucauagauguuaugcaaa

SEQ ID NO: 1299878 - RNA, 16 nt, Homo sapiens
cucauagguugagcaa

SEQ ID NO: 1299879 - RNA, 23 nt, Homo sapiens
cucaucauagcaauaacauuccc

SEQ ID NO: 1299880 - RNA, 14 nt, Homo sapiens
cucaucauuccuug

SEQ ID NO: 1299881 - RNA, 17 nt, Homo sapiens
cucaucccgagcaccuc

SEQ ID NO: 1299882 - RNA, 16 nt, Homo sapiens
cucaucucuuagcucc

SEQ ID NO: 1299883 - RNA, 23 nt, Homo sapiens
cucaugaauuaauuaaagcaaau

SEQ ID NO: 1299884 - RNA, 20 nt, Homo sapiens
cucaugucuucucacaagcc

SEQ ID NO: 1299885 - RNA, 19 nt, Homo sapiens
cucaugucuuugcugcaga

SEQ ID NO: 1299886 - RNA, 18 nt, Homo sapiens
cucauguuuuuaaagggc

SEQ ID NO: 1299887 - RNA, 12 nt, Homo sapiens
cucauucaaaag

SEQ ID NO: 1299888 - RNA, 18 nt, Homo sapiens
cucauucccaacgugcaa

SEQ ID NO: 1299889 - RNA, 23 nt, Homo sapiens
cucauucccaacgugcaaagcca

SEQ ID NO: 1299890 - RNA, 13 nt, Homo sapiens
cucauuugucaca

SEQ ID NO: 1299891 - RNA, 22 nt, Homo sapiens
cuccaacaccaagcacagcagc

SEQ ID NO: 1299892 - RNA, 23 nt, Homo sapiens
cuccaagugcggcacugcaaaga

SEQ ID NO: 1299893 - RNA, 13 nt, Homo sapiens
cuccacaaccucu

SEQ ID NO: 1299894 - RNA, 15 nt, Homo sapiens
cuccaccacgcuggg

SEQ ID NO: 1299895 - RNA, 22 nt, Homo sapiens
cuccacucaguugcaacuugga

SEQ ID NO: 1299896 - RNA, 18 nt, Homo sapiens
cuccacucucuaccagau

SEQ ID NO: 1299897 - RNA, 16 nt, Homo sapiens
cuccacuuccaagcaa

SEQ ID NO: 1299898 - RNA, 20 nt, Homo sapiens
cuccagauguuuccagacuu

SEQ ID NO: 1299899 - RNA, 14 nt, Homo sapiens
cuccagccaucuca

SEQ ID NO: 1299900 - RNA, 17 nt, Homo sapiens
cuccagccucagcucuc

SEQ ID NO: 1299901 - RNA, 22 nt, Homo sapiens
cuccagcucaccagccccagug

SEQ ID NO: 1299902 - RNA, 12 nt, Homo sapiens
cuccagcugucu

SEQ ID NO: 1299903 - RNA, 18 nt, Homo sapiens
cuccaggcccaaggcucc

SEQ ID NO: 1299904 - RNA, 23 nt, Homo sapiens
cuccauuauccauucccaagaug

SEQ ID NO: 1299905 - RNA, 19 nt, Homo sapiens
cucccaaguagcugggauu

SEQ ID NO: 1299906 - RNA, 23 nt, Homo sapiens
cucccacugggguccagggagca

SEQ ID NO: 1299907 - RNA, 17 nt, Homo sapiens
cucccagaacacacucc

SEQ ID NO: 1299908 - RNA, 20 nt, Homo sapiens
cucccagaacacacuccauc

SEQ ID NO: 1299909 - RNA, 17 nt, Homo sapiens
cucccagauaaugugaa

SEQ ID NO: 1299910 - RNA, 19 nt, Homo sapiens
cuccccaaugagacuugcc

SEQ ID NO: 1299911 - RNA, 21 nt, Homo sapiens
cuccccagaugugacuacuga

SEQ ID NO: 1299912 - RNA, 18 nt, Homo sapiens
cuccccagcaagugagag

SEQ ID NO: 1299913 - RNA, 16 nt, Homo sapiens
cuccccagcccagaga

SEQ ID NO: 1299914 - RNA, 13 nt, Homo sapiens
cuccccaggggag

SEQ ID NO: 1299915 - RNA, 16 nt, Homo sapiens
cuccccauuagcuuuc

SEQ ID NO: 1299916 - RNA, 15 nt, Homo sapiens
cucccccaggugcag

SEQ ID NO: 1299917 - RNA, 17 nt, Homo sapiens
cuccccgugagcacugc

SEQ ID NO: 1299918 - RNA, 18 nt, Homo sapiens
cuccccuggggacagcaa

SEQ ID NO: 1299919 - RNA, 22 nt, Homo sapiens
cucccgcgcccccaccccagac

SEQ ID NO: 1299920 - RNA, 20 nt, Homo sapiens
cucccugcaucugaccagca

SEQ ID NO: 1299921 - RNA, 20 nt, Homo sapiens
cucccugcuguuugcugaga

SEQ ID NO: 1299922 - RNA, 21 nt, Homo sapiens
cucccugcuuaaaaauguagc

SEQ ID NO: 1299923 - RNA, 18 nt, Homo sapiens
cucccuggcuucuguggg

SEQ ID NO: 1299924 - RNA, 19 nt, Homo sapiens
cucccugguucugaugaug

SEQ ID NO: 1299925 - RNA, 23 nt, Homo sapiens
cucccuuuuuacacuuuauggua

SEQ ID NO: 1299926 - RNA, 20 nt, Homo sapiens
cuccgagaggugggccaguc

SEQ ID NO: 1299927 - RNA, 13 nt, Homo sapiens
cuccguggcacau

SEQ ID NO: 1299928 - RNA, 16 nt, Homo sapiens
cuccuaaagcuuuuau

SEQ ID NO: 1299929 - RNA, 17 nt, Homo sapiens
cuccuaagggacuguga

SEQ ID NO: 1299930 - RNA, 15 nt, Homo sapiens
cuccuacuaugcaau

SEQ ID NO: 1299931 - RNA, 19 nt, Homo sapiens
cuccucaggcacacagcua

SEQ ID NO: 1299932 - RNA, 21 nt, Homo sapiens
cuccucaucucuaacagcuca

SEQ ID NO: 1299933 - RNA, 15 nt, Homo sapiens
cuccuccguggcaca

SEQ ID NO: 1299934 - RNA, 14 nt, Homo sapiens
cuccugaagccaca

SEQ ID NO: 1299935 - RNA, 15 nt, Homo sapiens
cuccugaagccacag

SEQ ID NO: 1299936 - RNA, 14 nt, Homo sapiens
cuccugacuuuuaa

SEQ ID NO: 1299937 - RNA, 16 nt, Homo sapiens
cuccugagggagcucc

SEQ ID NO: 1299938 - RNA, 17 nt, Homo sapiens
cuccuggaguugcauug

SEQ ID NO: 1299939 - RNA, 20 nt, Homo sapiens
cuccugggcucaagcgaucc

SEQ ID NO: 1299940 - RNA, 13 nt, Homo sapiens
cuccugggcucag

SEQ ID NO: 1299941 - RNA, 14 nt, Homo sapiens
cuccugugcaacuu

SEQ ID NO: 1299942 - RNA, 16 nt, Homo sapiens
cuccugugcauuguag

SEQ ID NO: 1299943 - RNA, 18 nt, Homo sapiens
cuccuguucugaaaccuu

SEQ ID NO: 1299944 - RNA, 15 nt, Homo sapiens
cuccuucaauuccau

SEQ ID NO: 1299945 - RNA, 14 nt, Homo sapiens
cuccuucaccaccc

SEQ ID NO: 1299946 - RNA, 22 nt, Homo sapiens
cuccuuccuuguuacccaugaa

SEQ ID NO: 1299947 - RNA, 22 nt, Homo sapiens
cuccuugcaggcagaaggcagu

SEQ ID NO: 1299948 - RNA, 22 nt, Homo sapiens
cuccuuugugugugugucagcu

SEQ ID NO: 1299949 - RNA, 14 nt, Homo sapiens
cucgaaacacagaa

SEQ ID NO: 1299950 - RNA, 16 nt, Homo sapiens
cucgagcaguccugcc

SEQ ID NO: 1299951 - RNA, 13 nt, Homo sapiens
cucgaguacugug

SEQ ID NO: 1299952 - RNA, 15 nt, Homo sapiens
cucgccaagcaggac

SEQ ID NO: 1299953 - RNA, 16 nt, Homo sapiens
cucgcucuguuaccca

SEQ ID NO: 1299954 - RNA, 17 nt, Homo sapiens
cucgcuuuguugcccag

SEQ ID NO: 1299955 - RNA, 16 nt, Homo sapiens
cucggcucagugcaac

SEQ ID NO: 1299956 - RNA, 15 nt, Homo sapiens
cucgggcuaggaaga

SEQ ID NO: 1299957 - RNA, 19 nt, Homo sapiens
cucggggaacccaaggccc

SEQ ID NO: 1299958 - RNA, 15 nt, Homo sapiens
cucggguucucucuc

SEQ ID NO: 1299959 - RNA, 21 nt, Homo sapiens
cucgugauuggaaacucacca

SEQ ID NO: 1299960 - RNA, 19 nt, Homo sapiens
cucuaaagaauucuugaaa

SEQ ID NO: 1299961 - RNA, 19 nt, Homo sapiens
cucuaaauaccauucccuu

SEQ ID NO: 1299962 - RNA, 20 nt, Homo sapiens
cucuaacucagaaacaucag

SEQ ID NO: 1299963 - RNA, 14 nt, Homo sapiens
ccugcaggcagcuu

SEQ ID NO: 1299964 - RNA, 17 nt, Homo sapiens
ccugcaucuaagcccau

SEQ ID NO: 1299965 - RNA, 21 nt, Homo sapiens
ccugcauuugugucauugaca

SEQ ID NO: 1299966 - RNA, 23 nt, Homo sapiens
ccugcauuugugucauugacaaa

SEQ ID NO: 1299967 - RNA, 14 nt, Homo sapiens
ccugccaacauacu

SEQ ID NO: 1299968 - RNA, 22 nt, Homo sapiens
ccugccccaaacaaauaugcaa

SEQ ID NO: 1299969 - RNA, 17 nt, Homo sapiens
ccugccuccuacuccag

SEQ ID NO: 1299970 - RNA, 15 nt, Homo sapiens
ccugccuccuugaaa

SEQ ID NO: 1299971 - RNA, 19 nt, Homo sapiens
ccugccuguggcgccgucu

SEQ ID NO: 1299972 - RNA, 17 nt, Homo sapiens
ccugcuguugguccucu

SEQ ID NO: 1299973 - RNA, 16 nt, Homo sapiens
ccugcuuugggaagcc

SEQ ID NO: 1299974 - RNA, 13 nt, Homo sapiens
ccuggaagacaga

SEQ ID NO: 1299975 - RNA, 22 nt, Homo sapiens
ccuggacuagagggaccucucc

SEQ ID NO: 1299976 - RNA, 12 nt, Homo sapiens
ccuggcaagaau

SEQ ID NO: 1299977 - RNA, 16 nt, Homo sapiens
ccuggcaggacuccag

SEQ ID NO: 1299978 - RNA, 14 nt, Homo sapiens
ccuggccucaagug

SEQ ID NO: 1299979 - RNA, 14 nt, Homo sapiens
ccugggcaauguga

SEQ ID NO: 1299980 - RNA, 15 nt, Homo sapiens
ccugggcugugaugu

SEQ ID NO: 1299981 - RNA, 14 nt, Homo sapiens
ccuggggaugugaa

SEQ ID NO: 1299982 - RNA, 17 nt, Homo sapiens
ccuggguaacuagggaa

SEQ ID NO: 1299983 - RNA, 18 nt, Homo sapiens
ccuggguaacuagggaag

SEQ ID NO: 1299984 - RNA, 16 nt, Homo sapiens
ccugguccacagggca

SEQ ID NO: 1299985 - RNA, 22 nt, Homo sapiens
ccugguugagcuucugcuaaaa

SEQ ID NO: 1299986 - RNA, 18 nt, Homo sapiens
ccuguaaucccagcacuu

SEQ ID NO: 1299987 - RNA, 22 nt, Homo sapiens
ccuguaucuacuaaaaauacaa

SEQ ID NO: 1299988 - RNA, 14 nt, Homo sapiens
ccugucaaauauca

SEQ ID NO: 1299989 - RNA, 16 nt, Homo sapiens
ccugucauuguauuca

SEQ ID NO: 1299990 - RNA, 15 nt, Homo sapiens
ccuguccagcuccaa

SEQ ID NO: 1299991 - RNA, 21 nt, Homo sapiens
ccugucccacucaggucugua

SEQ ID NO: 1299992 - RNA, 22 nt, Homo sapiens
ccuguccggaaugccacccaca

SEQ ID NO: 1299993 - RNA, 19 nt, Homo sapiens
ccuguccugaaagccacag

SEQ ID NO: 1299994 - RNA, 13 nt, Homo sapiens
ccugugaaugcca

SEQ ID NO: 1299995 - RNA, 18 nt, Homo sapiens
ccugugacuggcagcauu

SEQ ID NO: 1299996 - RNA, 19 nt, Homo sapiens
ccugugagccggagcucau

SEQ ID NO: 1299997 - RNA, 17 nt, Homo sapiens
ccuguggccuuugcaau

SEQ ID NO: 1299998 - RNA, 21 nt, Homo sapiens
ccugugugauugacagcuuug

SEQ ID NO: 1299999 - RNA, 22 nt, Homo sapiens
ccugugugggacugaguggcaa

SEQ ID NO: 1300000 - RNA, 21 nt, Homo sapiens
ccuguguguccaaaacugccu

SEQ ID NO: 1300001 - RNA, 11 nt, Homo sapiens
ccuguucucua

SEQ ID NO: 1300002 - RNA, 21 nt, Homo sapiens
ccuguucuuucuuacacaaga

SEQ ID NO: 1300003 - RNA, 18 nt, Homo sapiens
ccuguugagcaucacaga

SEQ ID NO: 1300004 - RNA, 15 nt, Homo sapiens
ccuuaaaaaucacac

SEQ ID NO: 1300005 - RNA, 12 nt, Homo sapiens
ccuuaacacuga

SEQ ID NO: 1300006 - RNA, 15 nt, Homo sapiens
ccuuaaguccuuaau

SEQ ID NO: 1300007 - RNA, 12 nt, Homo sapiens
ccuuaauaugcu

SEQ ID NO: 1300008 - RNA, 19 nt, Homo sapiens
ccuuagaaaacaaguauug

SEQ ID NO: 1300009 - RNA, 15 nt, Homo sapiens
ccuuagaagucacac

SEQ ID NO: 1300010 - RNA, 22 nt, Homo sapiens
ccuuagauguucuaagucuuuc

SEQ ID NO: 1300011 - RNA, 22 nt, Homo sapiens
ccuuagauugaaguaaacugca

SEQ ID NO: 1300012 - RNA, 20 nt, Homo sapiens
ccuuaucuaaaucaccagag

SEQ ID NO: 1300013 - RNA, 20 nt, Homo sapiens
ccuuauuagagugucuuucc

SEQ ID NO: 1300014 - RNA, 16 nt, Homo sapiens
ccuuauuguaccucuc

SEQ ID NO: 1300015 - RNA, 22 nt, Homo sapiens
ccuucaaguugagaacugguca

SEQ ID NO: 1300016 - RNA, 15 nt, Homo sapiens
ccuucaauuccauau

SEQ ID NO: 1300017 - RNA, 20 nt, Homo sapiens
ccuucacaaagcccaaggga

SEQ ID NO: 1300018 - RNA, 14 nt, Homo sapiens
ccuucagccuuaau

SEQ ID NO: 1300019 - RNA, 18 nt, Homo sapiens
ccuucaguuuauuuccac

SEQ ID NO: 1300020 - RNA, 15 nt, Homo sapiens
ccuucauaugcagua

SEQ ID NO: 1300021 - RNA, 21 nt, Homo sapiens
ccuucaucuuccuguguccug

SEQ ID NO: 1300022 - RNA, 18 nt, Homo sapiens
ccuucauuuauagaugag

SEQ ID NO: 1300023 - RNA, 14 nt, Homo sapiens
ccuuccagccacau

SEQ ID NO: 1300024 - RNA, 17 nt, Homo sapiens
ccuucccaugacccagg

SEQ ID NO: 1300025 - RNA, 13 nt, Homo sapiens
ccuuccuugccua

SEQ ID NO: 1300026 - RNA, 15 nt, Homo sapiens
ccuucgaaaggccuu

SEQ ID NO: 1300027 - RNA, 15 nt, Homo sapiens
ccuucuaggucacuu

SEQ ID NO: 1300028 - RNA, 21 nt, Homo sapiens
ccuucucgcuuuugccauuag

SEQ ID NO: 1300029 - RNA, 17 nt, Homo sapiens
ccuucuggcugugcuac

SEQ ID NO: 1300030 - RNA, 22 nt, Homo sapiens
ccuucuggugccagauccucuu

SEQ ID NO: 1300031 - RNA, 23 nt, Homo sapiens
ccuucuuuugggggucaacaguu

SEQ ID NO: 1300032 - RNA, 13 nt, Homo sapiens
ccuugaugacugc

SEQ ID NO: 1300033 - RNA, 21 nt, Homo sapiens
ccuugcgauucugcagccaca

SEQ ID NO: 1300034 - RNA, 21 nt, Homo sapiens
ccuuggaggacccagcacuga

SEQ ID NO: 1300035 - RNA, 15 nt, Homo sapiens
ccuuggaugugaugg

SEQ ID NO: 1300036 - RNA, 15 nt, Homo sapiens
ccuuggcuuguuauu

SEQ ID NO: 1300037 - RNA, 23 nt, Homo sapiens
ccuuguuauuucucagacuuugg

SEQ ID NO: 1300038 - RNA, 18 nt, Homo sapiens
ccuuuaagccugcauucu

SEQ ID NO: 1300039 - RNA, 13 nt, Homo sapiens
ccuuuacuccucg

SEQ ID NO: 1300040 - RNA, 13 nt, Homo sapiens
ccuuuccauuuau

SEQ ID NO: 1300041 - RNA, 13 nt, Homo sapiens
ccuuuccucaaaa

SEQ ID NO: 1300042 - RNA, 12 nt, Homo sapiens
ccuuugccuugg

SEQ ID NO: 1300043 - RNA, 20 nt, Homo sapiens
ccuuuggaaacaacauuuaa

SEQ ID NO: 1300044 - RNA, 16 nt, Homo sapiens
ccuuuggucuccugga

SEQ ID NO: 1300045 - RNA, 17 nt, Homo sapiens
ccuuuggugacuucaca

SEQ ID NO: 1300046 - RNA, 17 nt, Homo sapiens
ccuuuuauagaugguca

SEQ ID NO: 1300047 - RNA, 16 nt, Homo sapiens
ccuuuuuacacuuuau

SEQ ID NO: 1300048 - RNA, 15 nt, Homo sapiens
ccuuuuuguuauuag

SEQ ID NO: 1300049 - RNA, 14 nt, Homo sapiens
ccuuuuuuaaggaa

SEQ ID NO: 1300050 - RNA, 21 nt, Homo sapiens
cgaaaccgguggggcugguuc

SEQ ID NO: 1300051 - RNA, 16 nt, Homo sapiens
cgaacaauucauauau

SEQ ID NO: 1300052 - RNA, 24 nt, Homo sapiens
cgaagcucauucccaacgugcaaa

SEQ ID NO: 1300053 - RNA, 14 nt, Homo sapiens
cgaccccaaaggaa

SEQ ID NO: 1300054 - RNA, 19 nt, Homo sapiens
cgacuuguuuuugcacaug

SEQ ID NO: 1300055 - RNA, 19 nt, Homo sapiens
cgagaucacgccacugcac

SEQ ID NO: 1300056 - RNA, 19 nt, Homo sapiens
cgagcaccuccagccugaa

SEQ ID NO: 1300057 - RNA, 16 nt, Homo sapiens
cgagccaggcugacca

SEQ ID NO: 1300058 - RNA, 14 nt, Homo sapiens
cgaguaacuccccu

SEQ ID NO: 1300059 - RNA, 21 nt, Homo sapiens
cgaucaguggugucugugaag

SEQ ID NO: 1300060 - RNA, 15 nt, Homo sapiens
cgauucaaacugcuc

SEQ ID NO: 1300061 - RNA, 10 nt, Homo sapiens
cgcaaagggc

SEQ ID NO: 1300062 - RNA, 13 nt, Homo sapiens
cgcaagaccagcu

SEQ ID NO: 1300063 - RNA, 19 nt, Homo sapiens
cgcaagaccagcuuuagcc

SEQ ID NO: 1300064 - RNA, 19 nt, Homo sapiens
cgcacaauaguaaccuggg

SEQ ID NO: 1300065 - RNA, 18 nt, Homo sapiens
cgcaccaauaaagccuuc

SEQ ID NO: 1300066 - RNA, 17 nt, Homo sapiens
cgcaguggcauguccac

SEQ ID NO: 1300067 - RNA, 21 nt, Homo sapiens
cgcccagucuggaaugcagug

SEQ ID NO: 1300068 - RNA, 18 nt, Homo sapiens
cgcccucuaucaugguga

SEQ ID NO: 1300069 - RNA, 16 nt, Homo sapiens
cgccugaaacuuugag

SEQ ID NO: 1300070 - RNA, 15 nt, Homo sapiens
cgccugccugccacc

SEQ ID NO: 1300071 - RNA, 22 nt, Homo sapiens
cgccuguggacagccugaguca

SEQ ID NO: 1300072 - RNA, 11 nt, Homo sapiens
cgcgugcacac

SEQ ID NO: 1300073 - RNA, 22 nt, Homo sapiens
cgcuaaaugaaaaucgugacaa

SEQ ID NO: 1300074 - RNA, 22 nt, Homo sapiens
cgcuaccucccuccccgucuca

SEQ ID NO: 1300075 - RNA, 22 nt, Homo sapiens
cgcugagcgaggagaugcuccu

SEQ ID NO: 1300076 - RNA, 12 nt, Homo sapiens
cgcugcugccac

SEQ ID NO: 1300077 - RNA, 20 nt, Homo sapiens
cggagaaacgggugagcuga

SEQ ID NO: 1300078 - RNA, 21 nt, Homo sapiens
cggaucuggggcucugggaua

SEQ ID NO: 1300079 - RNA, 13 nt, Homo sapiens
cggcaacaucucu

SEQ ID NO: 1300080 - RNA, 15 nt, Homo sapiens
cggcauuaaagccau

SEQ ID NO: 1300081 - RNA, 15 nt, Homo sapiens
cggccuugggaaauc

SEQ ID NO: 1300082 - RNA, 18 nt, Homo sapiens
cggcucacgccuguaauc

SEQ ID NO: 1300083 - RNA, 19 nt, Homo sapiens
cgggcacucagaagacacu

SEQ ID NO: 1300084 - RNA, 15 nt, Homo sapiens
cggggccagcacuuc

SEQ ID NO: 1300085 - RNA, 15 nt, Homo sapiens
cggggcuccacugaa

SEQ ID NO: 1300086 - RNA, 15 nt, Homo sapiens
cggggcucuucucau

SEQ ID NO: 1300087 - RNA, 12 nt, Homo sapiens
cgguaagcacuu

SEQ ID NO: 1300088 - RNA, 20 nt, Homo sapiens
cggucccaguuuuguugccc

SEQ ID NO: 1300089 - RNA, 18 nt, Homo sapiens
cgguggacuugaacuuuc

SEQ ID NO: 1300090 - RNA, 20 nt, Homo sapiens
gaggcccaaccuccuauaua

SEQ ID NO: 1300091 - RNA, 21 nt, Homo sapiens
gaggccucaggugcuguccau

SEQ ID NO: 1300092 - RNA, 15 nt, Homo sapiens
gaggccucgacccac

SEQ ID NO: 1300093 - RNA, 16 nt, Homo sapiens
gaggcugaggcaagag

SEQ ID NO: 1300094 - RNA, 18 nt, Homo sapiens
gaggcugaggcgggugga

SEQ ID NO: 1300095 - RNA, 18 nt, Homo sapiens
gaggcugccucccaacag

SEQ ID NO: 1300096 - RNA, 18 nt, Homo sapiens
gagggaccucucccaggg

SEQ ID NO: 1300097 - RNA, 17 nt, Homo sapiens
gagggaggcucaggucc

SEQ ID NO: 1300098 - RNA, 15 nt, Homo sapiens
gagggaguggcagcu

SEQ ID NO: 1300099 - RNA, 19 nt, Homo sapiens
gagggauuucuuugcugua

SEQ ID NO: 1300100 - RNA, 15 nt, Homo sapiens
gagggcacacacugu

SEQ ID NO: 1300101 - RNA, 16 nt, Homo sapiens
gagggcacacacugug

SEQ ID NO: 1300102 - RNA, 20 nt, Homo sapiens
gagguagcacuacaaacaca

SEQ ID NO: 1300103 - RNA, 20 nt, Homo sapiens
gagguagguagauugcuuga

SEQ ID NO: 1300104 - RNA, 20 nt, Homo sapiens
gaggucaaggcugcagugag

SEQ ID NO: 1300105 - RNA, 18 nt, Homo sapiens
gaggugccuucuucaggg

SEQ ID NO: 1300106 - RNA, 14 nt, Homo sapiens
gagguugcagugag

SEQ ID NO: 1300107 - RNA, 17 nt, Homo sapiens
gagguuuauacugcaaa

SEQ ID NO: 1300108 - RNA, 17 nt, Homo sapiens
gagguuugccagcauuu

SEQ ID NO: 1300109 - RNA, 17 nt, Homo sapiens
gaguaacaggugccuuc

SEQ ID NO: 1300110 - RNA, 19 nt, Homo sapiens
gaguacuggcugauggagu

SEQ ID NO: 1300111 - RNA, 16 nt, Homo sapiens
gaguagauaaaaaaca

SEQ ID NO: 1300112 - RNA, 15 nt, Homo sapiens
gagucauugcuguag

SEQ ID NO: 1300113 - RNA, 14 nt, Homo sapiens
gaguccacuuuguu

SEQ ID NO: 1300114 - RNA, 11 nt, Homo sapiens
gaguccucuau

SEQ ID NO: 1300115 - RNA, 17 nt, Homo sapiens
gagucgaggacagggag

SEQ ID NO: 1300116 - RNA, 12 nt, Homo sapiens
gagucuauguuc

SEQ ID NO: 1300117 - RNA, 19 nt, Homo sapiens
gagugcaggggggcaauca

SEQ ID NO: 1300118 - RNA, 15 nt, Homo sapiens
gagugcaguggugcg

SEQ ID NO: 1300119 - RNA, 14 nt, Homo sapiens
gagugcgugcucag

SEQ ID NO: 1300120 - RNA, 19 nt, Homo sapiens
gaguggaacagaaggggug

SEQ ID NO: 1300121 - RNA, 22 nt, Homo sapiens
gaguguuccccuuccacugagg

SEQ ID NO: 1300122 - RNA, 21 nt, Homo sapiens
gaguugcauagagauuuguau

SEQ ID NO: 1300123 - RNA, 23 nt, Homo sapiens
gaguuggacccauugccagugag

SEQ ID NO: 1300124 - RNA, 13 nt, Homo sapiens
gaguuuucagugg

SEQ ID NO: 1300125 - RNA, 12 nt, Homo sapiens
gauaacuuugac

SEQ ID NO: 1300126 - RNA, 19 nt, Homo sapiens
gauacaggaaaagcugcug

SEQ ID NO: 1300127 - RNA, 18 nt, Homo sapiens
gauacauaaacuuuugca

SEQ ID NO: 1300128 - RNA, 13 nt, Homo sapiens
gauacauaaagac

SEQ ID NO: 1300129 - RNA, 21 nt, Homo sapiens
gauacauaaugggccacugaa

SEQ ID NO: 1300130 - RNA, 22 nt, Homo sapiens
gauacauuucugaaugggcaau

SEQ ID NO: 1300131 - RNA, 16 nt, Homo sapiens
gauacgcugcucucau

SEQ ID NO: 1300132 - RNA, 11 nt, Homo sapiens
gauagcugucc

SEQ ID NO: 1300133 - RNA, 15 nt, Homo sapiens
gauagucucauucug

SEQ ID NO: 1300134 - RNA, 13 nt, Homo sapiens
gauagugguauga

SEQ ID NO: 1300135 - RNA, 16 nt, Homo sapiens
gauauaagugcuguau

SEQ ID NO: 1300136 - RNA, 13 nt, Homo sapiens
gauauaaucuuuc

SEQ ID NO: 1300137 - RNA, 17 nt, Homo sapiens
gauauauuaagugacug

SEQ ID NO: 1300138 - RNA, 17 nt, Homo sapiens
gauaucaaaagcaaaua

SEQ ID NO: 1300139 - RNA, 21 nt, Homo sapiens
gauaugcaacugcaguucauc

SEQ ID NO: 1300140 - RNA, 17 nt, Homo sapiens
gauauguucaacuggag

SEQ ID NO: 1300141 - RNA, 17 nt, Homo sapiens
gauauuggaaugcacag

SEQ ID NO: 1300142 - RNA, 15 nt, Homo sapiens
gaucagcgacccuga

SEQ ID NO: 1300143 - RNA, 19 nt, Homo sapiens
gaucaguguuguugcucua

SEQ ID NO: 1300144 - RNA, 20 nt, Homo sapiens
gaucaucacuuccuugcccc

SEQ ID NO: 1300145 - RNA, 17 nt, Homo sapiens
gaucaugucucacuuca

SEQ ID NO: 1300146 - RNA, 17 nt, Homo sapiens
gaucauuucuaggcaaa

SEQ ID NO: 1300147 - RNA, 13 nt, Homo sapiens
gauccaagcaaga

SEQ ID NO: 1300148 - RNA, 14 nt, Homo sapiens
gauccaagcugguc

SEQ ID NO: 1300149 - RNA, 16 nt, Homo sapiens
gauccagugcugagca

SEQ ID NO: 1300150 - RNA, 18 nt, Homo sapiens
gauccauccagcuugcca

SEQ ID NO: 1300151 - RNA, 21 nt, Homo sapiens
gauccccggggcggcaggaag

SEQ ID NO: 1300152 - RNA, 14 nt, Homo sapiens
gaucccgugugcca

SEQ ID NO: 1300153 - RNA, 21 nt, Homo sapiens
gauccgucuuuggccuccucc

SEQ ID NO: 1300154 - RNA, 22 nt, Homo sapiens
gauccguuugaccaauuugcac

SEQ ID NO: 1300155 - RNA, 16 nt, Homo sapiens
gauccuaaaacaaaag

SEQ ID NO: 1300156 - RNA, 16 nt, Homo sapiens
gauccucccaccucag

SEQ ID NO: 1300157 - RNA, 20 nt, Homo sapiens
gaucgugccauugcacucca

SEQ ID NO: 1300158 - RNA, 23 nt, Homo sapiens
gaucuacuuuuugaacuuuucau

SEQ ID NO: 1300159 - RNA, 23 nt, Homo sapiens
gaucugauaaggaucuaggagaa

SEQ ID NO: 1300160 - RNA, 14 nt, Homo sapiens
gaucugauucuacc

SEQ ID NO: 1300161 - RNA, 18 nt, Homo sapiens
gaucuguuuugaaggcaa

SEQ ID NO: 1300162 - RNA, 22 nt, Homo sapiens
gaucuuaggcaugacuguagaa

SEQ ID NO: 1300163 - RNA, 19 nt, Homo sapiens
gaucuucagggaacugcau

SEQ ID NO: 1300164 - RNA, 22 nt, Homo sapiens
gaucuucauguaccugcucuuc

SEQ ID NO: 1300165 - RNA, 18 nt, Homo sapiens
gaugacuuaccuguucag

SEQ ID NO: 1300166 - RNA, 16 nt, Homo sapiens
gaugauggcucauuua

SEQ ID NO: 1300167 - RNA, 20 nt, Homo sapiens
gaugauggucuucagccucu

SEQ ID NO: 1300168 - RNA, 16 nt, Homo sapiens
gaugauucaagccauu

SEQ ID NO: 1300169 - RNA, 23 nt, Homo sapiens
gaugauuuuguaaaaguggcauu

SEQ ID NO: 1300170 - RNA, 18 nt, Homo sapiens
gaugcaaugacucaggac

SEQ ID NO: 1300171 - RNA, 20 nt, Homo sapiens
gaugcacuaccauugcuguu

SEQ ID NO: 1300172 - RNA, 23 nt, Homo sapiens
gaugccgagguaaaaguucuuuu

SEQ ID NO: 1300173 - RNA, 20 nt, Homo sapiens
gauggaacacggccacauca

SEQ ID NO: 1300174 - RNA, 14 nt, Homo sapiens
gauggaagcuuguu

SEQ ID NO: 1300175 - RNA, 17 nt, Homo sapiens
gauggaauaacucugug

SEQ ID NO: 1300176 - RNA, 20 nt, Homo sapiens
gauggacagacucacaaccu

SEQ ID NO: 1300177 - RNA, 16 nt, Homo sapiens
gauggaggaugcugcc

SEQ ID NO: 1300178 - RNA, 20 nt, Homo sapiens
gauggcagauucccacugcc

SEQ ID NO: 1300179 - RNA, 20 nt, Homo sapiens
gauggcgcuauugcacucca

SEQ ID NO: 1300180 - RNA, 17 nt, Homo sapiens
gauggucacgcaccugg

SEQ ID NO: 1300181 - RNA, 12 nt, Homo sapiens
gaugguccugca

SEQ ID NO: 1300182 - RNA, 17 nt, Homo sapiens
gauggugggcuucaggg

SEQ ID NO: 1300183 - RNA, 18 nt, Homo sapiens
gaugucuguuugcugaug

SEQ ID NO: 1300184 - RNA, 17 nt, Homo sapiens
gaugugaagacaccugc

SEQ ID NO: 1300185 - RNA, 13 nt, Homo sapiens
gaugugaagccaa

SEQ ID NO: 1300186 - RNA, 17 nt, Homo sapiens
gauguggggaagagcua

SEQ ID NO: 1300187 - RNA, 14 nt, Homo sapiens
gaugugguugcaua

SEQ ID NO: 1300188 - RNA, 13 nt, Homo sapiens
gauguuacuguau

SEQ ID NO: 1300189 - RNA, 12 nt, Homo sapiens
gauuaacuauga

SEQ ID NO: 1300190 - RNA, 22 nt, Homo sapiens
gauuaaugaaucguaaugaagu

SEQ ID NO: 1300191 - RNA, 16 nt, Homo sapiens
gauuacaggcaccugc

SEQ ID NO: 1300192 - RNA, 18 nt, Homo sapiens
gauuacaggugugaacca

SEQ ID NO: 1300193 - RNA, 14 nt, Homo sapiens
gauucaaaucuaug

SEQ ID NO: 1300194 - RNA, 15 nt, Homo sapiens
gauucaauauugaau

SEQ ID NO: 1300195 - RNA, 13 nt, Homo sapiens
gauucacacuguc

SEQ ID NO: 1300196 - RNA, 15 nt, Homo sapiens
gauucaguauuacaa

SEQ ID NO: 1300197 - RNA, 13 nt, Homo sapiens
gauucauauugaa

SEQ ID NO: 1300198 - RNA, 14 nt, Homo sapiens
gauucaugucucac

SEQ ID NO: 1300199 - RNA, 13 nt, Homo sapiens
gauuccaaaaagc

SEQ ID NO: 1300200 - RNA, 18 nt, Homo sapiens
gauuccaaaaagcacaua

SEQ ID NO: 1300201 - RNA, 22 nt, Homo sapiens
gauuccaggaggaguuagccaa

SEQ ID NO: 1300202 - RNA, 15 nt, Homo sapiens
gauuccccaucucag

SEQ ID NO: 1300203 - RNA, 19 nt, Homo sapiens
gauucugcaguaaaucuuu

SEQ ID NO: 1300204 - RNA, 17 nt, Homo sapiens
gauucugguuccagggu

SEQ ID NO: 1300205 - RNA, 12 nt, Homo sapiens
gauucuucagcu

SEQ ID NO: 1300206 - RNA, 15 nt, Homo sapiens
gauucuucagcuuga

SEQ ID NO: 1300207 - RNA, 14 nt, Homo sapiens
gcaaaugcuguauu

SEQ ID NO: 1300208 - RNA, 23 nt, Homo sapiens
gcaaaugcuguauucuucuuugg

SEQ ID NO: 1300209 - RNA, 23 nt, Homo sapiens
gcaaaugugcuggucacccuuca

SEQ ID NO: 1300210 - RNA, 15 nt, Homo sapiens
gcaacaaaaauuacu

SEQ ID NO: 1300211 - RNA, 17 nt, Homo sapiens
gcaacaaaaauuacucu

SEQ ID NO: 1300212 - RNA, 22 nt, Homo sapiens
gcaacaagaccaccacuucgaa

SEQ ID NO: 1300213 - RNA, 22 nt, Homo sapiens
gcaacagcaaaucacgaccacu

SEQ ID NO: 1300214 - RNA, 11 nt, Homo sapiens
gcaacaucucu

SEQ ID NO: 1300215 - RNA, 14 nt, Homo sapiens
gcaaccacuaagaa

SEQ ID NO: 1300216 - RNA, 18 nt, Homo sapiens
gcaagaacucaucacugu

SEQ ID NO: 1300217 - RNA, 16 nt, Homo sapiens
gcaagagaauuacuug

SEQ ID NO: 1300218 - RNA, 18 nt, Homo sapiens
gcaagaucccaucucuuu

SEQ ID NO: 1300219 - RNA, 23 nt, Homo sapiens
gcaaggacacagaugaaacacaa

SEQ ID NO: 1300220 - RNA, 18 nt, Homo sapiens
gcaaguaaguaugaagga

SEQ ID NO: 1300221 - RNA, 17 nt, Homo sapiens
gcaauaauaagugaugu

SEQ ID NO: 1300222 - RNA, 22 nt, Homo sapiens
gcaauacagacuacuucuuccc

SEQ ID NO: 1300223 - RNA, 20 nt, Homo sapiens
gcaaucacggcucacuguag

SEQ ID NO: 1300224 - RNA, 22 nt, Homo sapiens
gcaaucacggcucacuguaguc

SEQ ID NO: 1300225 - RNA, 18 nt, Homo sapiens
gcaauggcuccuucacaa

SEQ ID NO: 1300226 - RNA, 17 nt, Homo sapiens
gcaauuagacaagaacu

SEQ ID NO: 1300227 - RNA, 21 nt, Homo sapiens
gcaauugaaggaucaucugaa

SEQ ID NO: 1300228 - RNA, 21 nt, Homo sapiens
gcaauuuuucaagagcuccuu

SEQ ID NO: 1300229 - RNA, 20 nt, Homo sapiens
gcacaaagcucaagaugaca

SEQ ID NO: 1300230 - RNA, 18 nt, Homo sapiens
gcacaaggccaucugggc

SEQ ID NO: 1300231 - RNA, 17 nt, Homo sapiens
gcacaauaguaaccugg

SEQ ID NO: 1300232 - RNA, 19 nt, Homo sapiens
gcacacacuguguacagua

SEQ ID NO: 1300233 - RNA, 21 nt, Homo sapiens
gcacacacuguguacaguaaa

SEQ ID NO: 1300234 - RNA, 14 nt, Homo sapiens
gcacacagggcagu

SEQ ID NO: 1300235 - RNA, 21 nt, Homo sapiens
gcacagccuuugcccaaaacu

SEQ ID NO: 1300236 - RNA, 20 nt, Homo sapiens
gcacagcguccuguccacac

SEQ ID NO: 1300237 - RNA, 23 nt, Homo sapiens
gcacaggacaugcgguagccagc

SEQ ID NO: 1300238 - RNA, 22 nt, Homo sapiens
gcacaggaguguccucuucccu

SEQ ID NO: 1300239 - RNA, 18 nt, Homo sapiens
gcacaugcaccuacccau

SEQ ID NO: 1300240 - RNA, 16 nt, Homo sapiens
gcaccaccaagccaag

SEQ ID NO: 1300241 - RNA, 18 nt, Homo sapiens
gcacccagcccagauugu

SEQ ID NO: 1300242 - RNA, 18 nt, Homo sapiens
gcaccgggccacagagaa

SEQ ID NO: 1300243 - RNA, 12 nt, Homo sapiens
gcaccuaccuca

SEQ ID NO: 1300244 - RNA, 21 nt, Homo sapiens
gcaccuaccuuagaaaacaag

SEQ ID NO: 1300245 - RNA, 14 nt, Homo sapiens
gcaccucaagaaga

SEQ ID NO: 1300246 - RNA, 11 nt, Homo sapiens
gcaccuggcau

SEQ ID NO: 1300247 - RNA, 22 nt, Homo sapiens
gcaccuuuggaaacaacauuua

SEQ ID NO: 1300248 - RNA, 18 nt, Homo sapiens
gcacgguacaaacccaaa

SEQ ID NO: 1300249 - RNA, 21 nt, Homo sapiens
gcacucacuccugacugcccg

SEQ ID NO: 1300250 - RNA, 11 nt, Homo sapiens
gcacucaugga

SEQ ID NO: 1300251 - RNA, 19 nt, Homo sapiens
gcacugaggaagaacgggg

SEQ ID NO: 1300252 - RNA, 16 nt, Homo sapiens
gcacugcguacaaaca

SEQ ID NO: 1300253 - RNA, 20 nt, Homo sapiens
gcacuguucccccugugcag

SEQ ID NO: 1300254 - RNA, 23 nt, Homo sapiens
gcacuuauaagaaagaucaaaga

SEQ ID NO: 1300255 - RNA, 22 nt, Homo sapiens
gcacuugauguguagacauguc

SEQ ID NO: 1300256 - RNA, 23 nt, Homo sapiens
gcacuugauguguagacauguca

SEQ ID NO: 1300257 - RNA, 22 nt, Homo sapiens
gcagaacagaucuuuuacuuug

SEQ ID NO: 1300258 - RNA, 19 nt, Homo sapiens
gcagaacugaagagacuag

SEQ ID NO: 1300259 - RNA, 23 nt, Homo sapiens
gcagaacugaagagacuaggcgc

SEQ ID NO: 1300260 - RNA, 18 nt, Homo sapiens
gcagaagcagaagugcaa

SEQ ID NO: 1300261 - RNA, 13 nt, Homo sapiens
gcagaagugcaau

SEQ ID NO: 1300262 - RNA, 21 nt, Homo sapiens
gcagaccacugauaaaaccau

SEQ ID NO: 1300263 - RNA, 13 nt, Homo sapiens
gcagacugucccu

SEQ ID NO: 1300264 - RNA, 19 nt, Homo sapiens
gcagagaaacuuaagcaaa

SEQ ID NO: 1300265 - RNA, 15 nt, Homo sapiens
gcagagaaagggaca

SEQ ID NO: 1300266 - RNA, 20 nt, Homo sapiens
gcagaguacuggcugaugga

SEQ ID NO: 1300267 - RNA, 16 nt, Homo sapiens
gcagaguauuaaugaa

SEQ ID NO: 1300268 - RNA, 20 nt, Homo sapiens
gcagauggcagaugcacaug

SEQ ID NO: 1300269 - RNA, 21 nt, Homo sapiens
gcagcagcaaggaaagcucac

SEQ ID NO: 1300270 - RNA, 18 nt, Homo sapiens
gcagccaaguagccucuc

SEQ ID NO: 1300271 - RNA, 18 nt, Homo sapiens
gcagccuggggucugaca

SEQ ID NO: 1300272 - RNA, 17 nt, Homo sapiens
gcagcgccaggcugacc

SEQ ID NO: 1300273 - RNA, 20 nt, Homo sapiens
gcagcuuagacuaaggccau

SEQ ID NO: 1300274 - RNA, 18 nt, Homo sapiens
gcagcuuauuggcuuaaa

SEQ ID NO: 1300275 - RNA, 15 nt, Homo sapiens
gcaggaaaaacaaau

SEQ ID NO: 1300276 - RNA, 14 nt, Homo sapiens
gcaggacuugccac

SEQ ID NO: 1300277 - RNA, 17 nt, Homo sapiens
gcaggcucccccugagg

SEQ ID NO: 1300278 - RNA, 17 nt, Homo sapiens
gcaggggucucaugugg

SEQ ID NO: 1300279 - RNA, 22 nt, Homo sapiens
gcaggugcugacuucaucuccc

SEQ ID NO: 1300280 - RNA, 20 nt, Homo sapiens
gcagguggggagacugggcu

SEQ ID NO: 1300281 - RNA, 16 nt, Homo sapiens
gcagguucccaagcuc

SEQ ID NO: 1300282 - RNA, 21 nt, Homo sapiens
gcagguuggaacuaugcagug

SEQ ID NO: 1300283 - RNA, 21 nt, Homo sapiens
gcagugagccgagaucgugcc

SEQ ID NO: 1300284 - RNA, 21 nt, Homo sapiens
gcagugagcugauaucaugcc

SEQ ID NO: 1300285 - RNA, 20 nt, Homo sapiens
gcaguggacucagaaagcca

SEQ ID NO: 1300286 - RNA, 19 nt, Homo sapiens
gcaguucugggugcucccu

SEQ ID NO: 1300287 - RNA, 12 nt, Homo sapiens
gcauaucugccu

SEQ ID NO: 1300288 - RNA, 15 nt, Homo sapiens
gcauauguugaauac

SEQ ID NO: 1300289 - RNA, 14 nt, Homo sapiens
gcaucacagaaugu

SEQ ID NO: 1300290 - RNA, 17 nt, Homo sapiens
gcaucagcaacaaccag

SEQ ID NO: 1300291 - RNA, 20 nt, Homo sapiens
gcauccagagauucauuuuc

SEQ ID NO: 1300292 - RNA, 22 nt, Homo sapiens
gcauccaucugggcuaccccac

SEQ ID NO: 1300293 - RNA, 22 nt, Homo sapiens
gcauccucuuuuuccaacuugg

SEQ ID NO: 1300294 - RNA, 18 nt, Homo sapiens
gcaucggacaagaccccc

SEQ ID NO: 1300295 - RNA, 22 nt, Homo sapiens
gcaucuuucauaugguaggaac

SEQ ID NO: 1300296 - RNA, 19 nt, Homo sapiens
gcaugagucagucugauga

SEQ ID NO: 1300297 - RNA, 20 nt, Homo sapiens
gcaugcaccuguagucucac

SEQ ID NO: 1300298 - RNA, 20 nt, Homo sapiens
gcaugggggaccccuuccca

SEQ ID NO: 1300299 - RNA, 13 nt, Homo sapiens
gcauguccuuugc

SEQ ID NO: 1300300 - RNA, 22 nt, Homo sapiens
gcauguccuuugcgccugugac

SEQ ID NO: 1300301 - RNA, 14 nt, Homo sapiens
gcauguuuguugua

SEQ ID NO: 1300302 - RNA, 16 nt, Homo sapiens
gcauguuuguuguaua

SEQ ID NO: 1300303 - RNA, 17 nt, Homo sapiens
gcauuagagggagccca

SEQ ID NO: 1300304 - RNA, 21 nt, Homo sapiens
gcauugauucaguauuacaaa

SEQ ID NO: 1300305 - RNA, 15 nt, Homo sapiens
gcauugccugugacu

SEQ ID NO: 1300306 - RNA, 19 nt, Homo sapiens
gcauuuacuuuguguucac

SEQ ID NO: 1300307 - RNA, 20 nt, Homo sapiens
gcauuuagacccugcauuua

SEQ ID NO: 1300308 - RNA, 9 nt, Homo sapiens
gcauuucaa

SEQ ID NO: 1300309 - RNA, 15 nt, Homo sapiens
gcauuuccagacuug

SEQ ID NO: 1300310 - RNA, 17 nt, Homo sapiens
gccaaacacccaugccc

SEQ ID NO: 1300311 - RNA, 22 nt, Homo sapiens
gccaaacauuaaaauuagcacu

SEQ ID NO: 1300312 - RNA, 20 nt, Homo sapiens
gccaacaagguuauaugaau

SEQ ID NO: 1300313 - RNA, 20 nt, Homo sapiens
gccaagaugacacaacugca

SEQ ID NO: 1300314 - RNA, 22 nt, Homo sapiens
gccaagaugacacaacugcacu

SEQ ID NO: 1300315 - RNA, 11 nt, Homo sapiens
gccaaggagcu

SEQ ID NO: 1300316 - RNA, 12 nt, Homo sapiens
gccaagggauga

SEQ ID NO: 1300317 - RNA, 19 nt, Homo sapiens
gccuugggagccacugcca

SEQ ID NO: 1300318 - RNA, 19 nt, Homo sapiens
gcgaaaccccucucuacua

SEQ ID NO: 1300319 - RNA, 17 nt, Homo sapiens
gcgaccuccuuucauca

SEQ ID NO: 1300320 - RNA, 16 nt, Homo sapiens
gcgagagaaagggagu

SEQ ID NO: 1300321 - RNA, 14 nt, Homo sapiens
gcgagcaccuguaa

SEQ ID NO: 1300322 - RNA, 20 nt, Homo sapiens
gcgaucuggguucacugcaa

SEQ ID NO: 1300323 - RNA, 21 nt, Homo sapiens
gcgccaggauggaacacggcc

SEQ ID NO: 1300324 - RNA, 17 nt, Homo sapiens
gcgcccaguccuuccac

SEQ ID NO: 1300325 - RNA, 16 nt, Homo sapiens
gcgcccccaccccaga

SEQ ID NO: 1300326 - RNA, 20 nt, Homo sapiens
gcgcgugaguggucuucaaa

SEQ ID NO: 1300327 - RNA, 14 nt, Homo sapiens
gcgcucagggccau

SEQ ID NO: 1300328 - RNA, 16 nt, Homo sapiens
gcggaaucagcuucua

SEQ ID NO: 1300329 - RNA, 14 nt, Homo sapiens
gcggacaucagcug

SEQ ID NO: 1300330 - RNA, 16 nt, Homo sapiens
gcggggaucaucugcc

SEQ ID NO: 1300331 - RNA, 11 nt, Homo sapiens
gcgggggcuug

SEQ ID NO: 1300332 - RNA, 20 nt, Homo sapiens
gcggugacucaugccuguaa

SEQ ID NO: 1300333 - RNA, 12 nt, Homo sapiens
gcguccugguca

SEQ ID NO: 1300334 - RNA, 18 nt, Homo sapiens
gcguuggucucugcauuu

SEQ ID NO: 1300335 - RNA, 13 nt, Homo sapiens
gcuaacacacagc

SEQ ID NO: 1300336 - RNA, 19 nt, Homo sapiens
gcuaacacacagcucccau

SEQ ID NO: 1300337 - RNA, 14 nt, Homo sapiens
gcuaagacugaugu

SEQ ID NO: 1300338 - RNA, 19 nt, Homo sapiens
gcuaauauugauacaauga

SEQ ID NO: 1300339 - RNA, 12 nt, Homo sapiens
gcuaauguugcu

SEQ ID NO: 1300340 - RNA, 19 nt, Homo sapiens
gcuacacugacacugguau

SEQ ID NO: 1300341 - RNA, 15 nt, Homo sapiens
gcuaccucaaccaau

SEQ ID NO: 1300342 - RNA, 10 nt, Homo sapiens
gcuaccuccc

SEQ ID NO: 1300343 - RNA, 18 nt, Homo sapiens
gcuacuguaauuuuauau

SEQ ID NO: 1300344 - RNA, 14 nt, Homo sapiens
gcuauaacuaagca

SEQ ID NO: 1300345 - RNA, 18 nt, Homo sapiens
gcuauaauaaagaagugu

SEQ ID NO: 1300346 - RNA, 23 nt, Homo sapiens
ucaacuaaugaaaauaaaacauu

SEQ ID NO: 1300347 - RNA, 15 nt, Homo sapiens
ucaacuccucccaua

SEQ ID NO: 1300348 - RNA, 16 nt, Homo sapiens
ucaacugggauacauu

SEQ ID NO: 1300349 - RNA, 19 nt, Homo sapiens
ucaacuuggugacacucua

SEQ ID NO: 1300350 - RNA, 20 nt, Homo sapiens
ucaacuuugaauaaagaaua

SEQ ID NO: 1300351 - RNA, 18 nt, Homo sapiens
ucaacuuuuccuuucaua

SEQ ID NO: 1300352 - RNA, 22 nt, Homo sapiens
ucaagaagaagaggggcauaaa

SEQ ID NO: 1300353 - RNA, 19 nt, Homo sapiens
ucaagagaaaaguugacac

SEQ ID NO: 1300354 - RNA, 18 nt, Homo sapiens
ucaagaguaguuauauaa

SEQ ID NO: 1300355 - RNA, 14 nt, Homo sapiens
ucaagagugagcua

SEQ ID NO: 1300356 - RNA, 19 nt, Homo sapiens
ucaagauacugcuacugua

SEQ ID NO: 1300357 - RNA, 21 nt, Homo sapiens
ucaagauuuucauacuuuuac

SEQ ID NO: 1300358 - RNA, 22 nt, Homo sapiens
ucaagcagacauagaagagcca

SEQ ID NO: 1300359 - RNA, 18 nt, Homo sapiens
ucaagcaguagacaagca

SEQ ID NO: 1300360 - RNA, 16 nt, Homo sapiens
ucaagcagucgugccu

SEQ ID NO: 1300361 - RNA, 18 nt, Homo sapiens
ucaagccugugcaaaaaa

SEQ ID NO: 1300362 - RNA, 22 nt, Homo sapiens
ucaagcgauucuccugccucag

SEQ ID NO: 1300363 - RNA, 18 nt, Homo sapiens
ucaagcugguggccucug

SEQ ID NO: 1300364 - RNA, 18 nt, Homo sapiens
ucaaggaauaaugggcuu

SEQ ID NO: 1300365 - RNA, 12 nt, Homo sapiens
ucaaggcacugc

SEQ ID NO: 1300366 - RNA, 17 nt, Homo sapiens
ucaaggccuucaguuua

SEQ ID NO: 1300367 - RNA, 15 nt, Homo sapiens
ucaaggcugcaguga

SEQ ID NO: 1300368 - RNA, 18 nt, Homo sapiens
ucaaguacuguaacugug

SEQ ID NO: 1300369 - RNA, 14 nt, Homo sapiens
ucaaguaguuugac

SEQ ID NO: 1300370 - RNA, 15 nt, Homo sapiens
ucaagugauccuccc

SEQ ID NO: 1300371 - RNA, 17 nt, Homo sapiens
ucaaguuguuugucaau

SEQ ID NO: 1300372 - RNA, 14 nt, Homo sapiens
ucaauagugcaacu

SEQ ID NO: 1300373 - RNA, 22 nt, Homo sapiens
ucaauccaagagucugaugauu

SEQ ID NO: 1300374 - RNA, 14 nt, Homo sapiens
ucaauccugccaau

SEQ ID NO: 1300375 - RNA, 13 nt, Homo sapiens
ucaaucuacaggc

SEQ ID NO: 1300376 - RNA, 20 nt, Homo sapiens
ucaauuacuugaaguugcuu

SEQ ID NO: 1300377 - RNA, 21 nt, Homo sapiens
ucacaaaccagagaccaaaug

SEQ ID NO: 1300378 - RNA, 15 nt, Homo sapiens
ucacaacagugaaaa

SEQ ID NO: 1300379 - RNA, 16 nt, Homo sapiens
ucacaagaaaacuaua

SEQ ID NO: 1300380 - RNA, 17 nt, Homo sapiens
ucacaagaaaacuauaa

SEQ ID NO: 1300381 - RNA, 12 nt, Homo sapiens
ucacaagcuauu

SEQ ID NO: 1300382 - RNA, 21 nt, Homo sapiens
ucacaaucaucaucauucuca

SEQ ID NO: 1300383 - RNA, 11 nt, Homo sapiens
ucacacacuga

SEQ ID NO: 1300384 - RNA, 12 nt, Homo sapiens
ucacaccuguaa

SEQ ID NO: 1300385 - RNA, 15 nt, Homo sapiens
ucacagagugcauug

SEQ ID NO: 1300386 - RNA, 16 nt, Homo sapiens
ucacagagugcauugu

SEQ ID NO: 1300387 - RNA, 18 nt, Homo sapiens
ucacagagugcauuguga

SEQ ID NO: 1300388 - RNA, 21 nt, Homo sapiens
ucacaggcagguccaggguuu

SEQ ID NO: 1300389 - RNA, 22 nt, Homo sapiens
ucacaguccucauuuacuggau

SEQ ID NO: 1300390 - RNA, 11 nt, Homo sapiens
ucacagugcau

SEQ ID NO: 1300391 - RNA, 16 nt, Homo sapiens
ucacaguguugcccag

SEQ ID NO: 1300392 - RNA, 18 nt, Homo sapiens
ucacaucagaacagacaa

SEQ ID NO: 1300393 - RNA, 13 nt, Homo sapiens
ucacauccauugu

SEQ ID NO: 1300394 - RNA, 14 nt, Homo sapiens
ucacauccuguguu

SEQ ID NO: 1300395 - RNA, 16 nt, Homo sapiens
ucacaucugcaucuua

SEQ ID NO: 1300396 - RNA, 18 nt, Homo sapiens
ucacaugaacuuguaaag

SEQ ID NO: 1300397 - RNA, 19 nt, Homo sapiens
ucacaugaggaauguacuu

SEQ ID NO: 1300398 - RNA, 15 nt, Homo sapiens
ucacaugaugcauac

SEQ ID NO: 1300399 - RNA, 14 nt, Homo sapiens
ucacauucuuggcu

SEQ ID NO: 1300400 - RNA, 19 nt, Homo sapiens
ucacauuguuugcugcuau

SEQ ID NO: 1300401 - RNA, 21 nt, Homo sapiens
ucacauuguuugcugcuauug

SEQ ID NO: 1300402 - RNA, 12 nt, Homo sapiens
ucaccaagccca

SEQ ID NO: 1300403 - RNA, 21 nt, Homo sapiens
ucaccaaggaaacgcuaccuc

SEQ ID NO: 1300404 - RNA, 17 nt, Homo sapiens
ucaccacaugugcacau

SEQ ID NO: 1300405 - RNA, 16 nt, Homo sapiens
ucaccaguuuccaggu

SEQ ID NO: 1300406 - RNA, 16 nt, Homo sapiens
ucaccauauugcccag

SEQ ID NO: 1300407 - RNA, 14 nt, Homo sapiens
ucaccaucugugca

SEQ ID NO: 1300408 - RNA, 15 nt, Homo sapiens
ucacccaugugcaca

SEQ ID NO: 1300409 - RNA, 18 nt, Homo sapiens
ucaccccugguucucauc

SEQ ID NO: 1300410 - RNA, 18 nt, Homo sapiens
ucacccucauaccaucug

SEQ ID NO: 1300411 - RNA, 16 nt, Homo sapiens
ucaccgaggacaugaa

SEQ ID NO: 1300412 - RNA, 16 nt, Homo sapiens
ucaccuacccaugacc

SEQ ID NO: 1300413 - RNA, 21 nt, Homo sapiens
ucaccugagcaggaccucuga

SEQ ID NO: 1300414 - RNA, 13 nt, Homo sapiens
ucaccugccaaca

SEQ ID NO: 1300415 - RNA, 17 nt, Homo sapiens
ucaccugcccugugcau

SEQ ID NO: 1300416 - RNA, 16 nt, Homo sapiens
ucaccugggcugugau

SEQ ID NO: 1300417 - RNA, 17 nt, Homo sapiens
ucaccuuaggcagggaa

SEQ ID NO: 1300418 - RNA, 22 nt, Homo sapiens
ucaccuucguuuacuaugccug

SEQ ID NO: 1300419 - RNA, 14 nt, Homo sapiens
uccaauucagaaug

SEQ ID NO: 1300420 - RNA, 17 nt, Homo sapiens
uccaauuccuugcacau

SEQ ID NO: 1300421 - RNA, 17 nt, Homo sapiens
uccaauuuuaauuuagu

SEQ ID NO: 1300422 - RNA, 22 nt, Homo sapiens
uccaauuuuaauuuaguaaaug

SEQ ID NO: 1300423 - RNA, 12 nt, Homo sapiens
uccacacauaaa

SEQ ID NO: 1300424 - RNA, 14 nt, Homo sapiens
uccacacccagcuc

SEQ ID NO: 1300425 - RNA, 13 nt, Homo sapiens
uccacccaugaug

SEQ ID NO: 1300426 - RNA, 13 nt, Homo sapiens
uccaccugucuca

SEQ ID NO: 1300427 - RNA, 23 nt, Homo sapiens
uccacggagccacuccucugacu

SEQ ID NO: 1300428 - RNA, 14 nt, Homo sapiens
uccacuacugcuac

SEQ ID NO: 1300429 - RNA, 21 nt, Homo sapiens
uccacuaggguccaccaggag

SEQ ID NO: 1300430 - RNA, 17 nt, Homo sapiens
uccacuauuuucaaaga

SEQ ID NO: 1300431 - RNA, 14 nt, Homo sapiens
uccacucucuacca

SEQ ID NO: 1300432 - RNA, 15 nt, Homo sapiens
uccacugucaagaaa

SEQ ID NO: 1300433 - RNA, 19 nt, Homo sapiens
uccacuucuuguuccccac

SEQ ID NO: 1300434 - RNA, 23 nt, Homo sapiens
uccacuucuuguuccccacugac

SEQ ID NO: 1300435 - RNA, 20 nt, Homo sapiens
uccagaaaacaaaacugcau

SEQ ID NO: 1300436 - RNA, 18 nt, Homo sapiens
uccagaaugaucauuaaa

SEQ ID NO: 1300437 - RNA, 14 nt, Homo sapiens
uccagacccggcug

SEQ ID NO: 1300438 - RNA, 20 nt, Homo sapiens
uccagacuuccuugagacac

SEQ ID NO: 1300439 - RNA, 22 nt, Homo sapiens
uccagcacccccagugcagcuc

SEQ ID NO: 1300440 - RNA, 19 nt, Homo sapiens
uccagccacuggcugcuaa

SEQ ID NO: 1300441 - RNA, 18 nt, Homo sapiens
uccagcuaauucagguca

SEQ ID NO: 1300442 - RNA, 18 nt, Homo sapiens
uccagcuccaaccugcaa

SEQ ID NO: 1300443 - RNA, 21 nt, Homo sapiens
uccagcuuagaaugcaucuca

SEQ ID NO: 1300444 - RNA, 18 nt, Homo sapiens
uccaggaaccacaccaca

SEQ ID NO: 1300445 - RNA, 16 nt, Homo sapiens
uccaggagaaggccaa

SEQ ID NO: 1300446 - RNA, 13 nt, Homo sapiens
uccaggagcugca

SEQ ID NO: 1300447 - RNA, 21 nt, Homo sapiens
uccaggaggaguuagccaaac

SEQ ID NO: 1300448 - RNA, 23 nt, Homo sapiens
uccagggaugauucaagccauuc

SEQ ID NO: 1300449 - RNA, 15 nt, Homo sapiens
uccagugcaggagac

SEQ ID NO: 1300450 - RNA, 17 nt, Homo sapiens
uccauauuuaacaugua

SEQ ID NO: 1300451 - RNA, 13 nt, Homo sapiens
uccaucagcuaaa

SEQ ID NO: 1300452 - RNA, 17 nt, Homo sapiens
uccauccucacugcugu

SEQ ID NO: 1300453 - RNA, 13 nt, Homo sapiens
uccaucucucauc

SEQ ID NO: 1300454 - RNA, 21 nt, Homo sapiens
uccaucucucauccuccagua

SEQ ID NO: 1300455 - RNA, 20 nt, Homo sapiens
uccaucuuuacaaaacuaca

SEQ ID NO: 1300456 - RNA, 22 nt, Homo sapiens
uccaugauuuuaaauugugauc

SEQ ID NO: 1300457 - RNA, 20 nt, Homo sapiens
uccaugggccauaugaaaag

SEQ ID NO: 1300458 - RNA, 12 nt, Homo sapiens
uccauguacuug

SEQ ID NO: 1300459 - RNA, 22 nt, Homo sapiens
uccauucagugcagcauauaca

SEQ ID NO: 1300460 - RNA, 12 nt, Homo sapiens
uccauucccaag

SEQ ID NO: 1300461 - RNA, 19 nt, Homo sapiens
uccauucuggaaacaccug

SEQ ID NO: 1300462 - RNA, 18 nt, Homo sapiens
uccauuuacaaacuacuu

SEQ ID NO: 1300463 - RNA, 17 nt, Homo sapiens
ucccaaacugugaugaa

SEQ ID NO: 1300464 - RNA, 21 nt, Homo sapiens
ucccaacuacgcugauuugau

SEQ ID NO: 1300465 - RNA, 21 nt, Homo sapiens
ucccaacuucgccagccucca

SEQ ID NO: 1300466 - RNA, 21 nt, Homo sapiens
ucccaacuuguauuaaagaca

SEQ ID NO: 1300467 - RNA, 18 nt, Homo sapiens
ucccaaguagaaucucag

SEQ ID NO: 1300468 - RNA, 20 nt, Homo sapiens
ucccaaguagcugggauuac

SEQ ID NO: 1300469 - RNA, 13 nt, Homo sapiens
ucccacacaggcu

SEQ ID NO: 1300470 - RNA, 21 nt, Homo sapiens
uccucucugugucccugcugc

SEQ ID NO: 1300471 - RNA, 17 nt, Homo sapiens
uccucugcauuuacaca

SEQ ID NO: 1300472 - RNA, 22 nt, Homo sapiens
uccugaaagccacagacaauau

SEQ ID NO: 1300473 - RNA, 17 nt, Homo sapiens
uccugagaagcauguaa

SEQ ID NO: 1300474 - RNA, 15 nt, Homo sapiens
uccugagagcugcuu

SEQ ID NO: 1300475 - RNA, 23 nt, Homo sapiens
uccugaggcuuuggauuugacau

SEQ ID NO: 1300476 - RNA, 23 nt, Homo sapiens
uccugcagaagcagaagugcaau

SEQ ID NO: 1300477 - RNA, 21 nt, Homo sapiens
uccugcagcuuauuggcuuaa

SEQ ID NO: 1300478 - RNA, 20 nt, Homo sapiens
uccugcccaccugucaaaca

SEQ ID NO: 1300479 - RNA, 13 nt, Homo sapiens
uccugcuuauuca

SEQ ID NO: 1300480 - RNA, 16 nt, Homo sapiens
uccuggccucaaguga

SEQ ID NO: 1300481 - RNA, 13 nt, Homo sapiens
uccuggccugaga

SEQ ID NO: 1300482 - RNA, 16 nt, Homo sapiens
uccugggccugcagaa

SEQ ID NO: 1300483 - RNA, 17 nt, Homo sapiens
uccugggcuaagugauc

SEQ ID NO: 1300484 - RNA, 22 nt, Homo sapiens
uccuggugccccccaccccugg

SEQ ID NO: 1300485 - RNA, 20 nt, Homo sapiens
uccuguaagucaaaugugug

SEQ ID NO: 1300486 - RNA, 21 nt, Homo sapiens
uccuguacuuuuuccagacac

SEQ ID NO: 1300487 - RNA, 20 nt, Homo sapiens
uccugugaaugccacugccu

SEQ ID NO: 1300488 - RNA, 16 nt, Homo sapiens
uccuguuuacugaaaa

SEQ ID NO: 1300489 - RNA, 13 nt, Homo sapiens
uccuuaacacuga

SEQ ID NO: 1300490 - RNA, 19 nt, Homo sapiens
uccuucucucacuguguua

SEQ ID NO: 1300491 - RNA, 13 nt, Homo sapiens
uccuugcaggcag

SEQ ID NO: 1300492 - RNA, 14 nt, Homo sapiens
uccuuguuccuaga

SEQ ID NO: 1300493 - RNA, 23 nt, Homo sapiens
uccuuucacccgcuccuacagcu

SEQ ID NO: 1300494 - RNA, 14 nt, Homo sapiens
uccuuugugaauau

SEQ ID NO: 1300495 - RNA, 16 nt, Homo sapiens
uccuuuuacuacagcu

SEQ ID NO: 1300496 - RNA, 17 nt, Homo sapiens
uccuuuuauguggucuc

SEQ ID NO: 1300497 - RNA, 14 nt, Homo sapiens
uccuuuucugucuc

SEQ ID NO: 1300498 - RNA, 18 nt, Homo sapiens
uccuuuuuugcaugugca

SEQ ID NO: 1300499 - RNA, 14 nt, Homo sapiens
ucgaauaagacuca

SEQ ID NO: 1300500 - RNA, 14 nt, Homo sapiens
ucgaccuacugaaa

SEQ ID NO: 1300501 - RNA, 19 nt, Homo sapiens
ucgacuucgggcuggccau

SEQ ID NO: 1300502 - RNA, 15 nt, Homo sapiens
ucgacuugacuuuuu

SEQ ID NO: 1300503 - RNA, 18 nt, Homo sapiens
ucgagaauguauggauuu

SEQ ID NO: 1300504 - RNA, 21 nt, Homo sapiens
ucgagccacaaccgaccagau

SEQ ID NO: 1300505 - RNA, 16 nt, Homo sapiens
ucgcaucucagugcag

SEQ ID NO: 1300506 - RNA, 17 nt, Homo sapiens
ucgcaucucagugcagg

SEQ ID NO: 1300507 - RNA, 17 nt, Homo sapiens
ucggaugaggcccucau

SEQ ID NO: 1300508 - RNA, 17 nt, Homo sapiens
ucggccaaacagacagg

SEQ ID NO: 1300509 - RNA, 14 nt, Homo sapiens
ucggccccagcaca

SEQ ID NO: 1300510 - RNA, 16 nt, Homo sapiens
ucggccccagcacaug

SEQ ID NO: 1300511 - RNA, 15 nt, Homo sapiens
ucggcucagugcaac

SEQ ID NO: 1300512 - RNA, 17 nt, Homo sapiens
ucgggaggcugagacag

SEQ ID NO: 1300513 - RNA, 21 nt, Homo sapiens
ucgguauccccccaucuugcu

SEQ ID NO: 1300514 - RNA, 12 nt, Homo sapiens
ucggugugcacc

SEQ ID NO: 1300515 - RNA, 13 nt, Homo sapiens
ucgucuacugcaa

SEQ ID NO: 1300516 - RNA, 16 nt, Homo sapiens
ucgucuggcaucuccc

SEQ ID NO: 1300517 - RNA, 15 nt, Homo sapiens
ugaaagcggcugccu

SEQ ID NO: 1300518 - RNA, 17 nt, Homo sapiens
ugaaaggcauucucuga

SEQ ID NO: 1300519 - RNA, 15 nt, Homo sapiens
ugaaaggugccaugg

SEQ ID NO: 1300520 - RNA, 17 nt, Homo sapiens
ugaaaguggacaaggag

SEQ ID NO: 1300521 - RNA, 19 nt, Homo sapiens
ugaaaugcuggcauuugca

SEQ ID NO: 1300522 - RNA, 19 nt, Homo sapiens
ugaaauuugugauggaauc

SEQ ID NO: 1300523 - RNA, 11 nt, Homo sapiens
ugaacaaagca

SEQ ID NO: 1300524 - RNA, 18 nt, Homo sapiens
ugaacaagauuaaauucc

SEQ ID NO: 1300525 - RNA, 21 nt, Homo sapiens
ugaacacucuuuugcuuuauu

SEQ ID NO: 1300526 - RNA, 20 nt, Homo sapiens
ugaacccaagaaauguaaua

SEQ ID NO: 1300527 - RNA, 16 nt, Homo sapiens
ugaacuccuuccccac

SEQ ID NO: 1300528 - RNA, 19 nt, Homo sapiens
ugaacucuucacucuucaa

SEQ ID NO: 1300529 - RNA, 15 nt, Homo sapiens
ugaacugacuucaac

SEQ ID NO: 1300530 - RNA, 17 nt, Homo sapiens
ugaacugagccuagcua

SEQ ID NO: 1300531 - RNA, 14 nt, Homo sapiens
ugaacuucagggag

SEQ ID NO: 1300532 - RNA, 23 nt, Homo sapiens
ugaagaacaacaacucucagugg

SEQ ID NO: 1300533 - RNA, 18 nt, Homo sapiens
ugaagaacaguaacugcc

SEQ ID NO: 1300534 - RNA, 23 nt, Homo sapiens
ugaagaacugcaggcccuggccu

SEQ ID NO: 1300535 - RNA, 16 nt, Homo sapiens
ugaagaagauauguga

SEQ ID NO: 1300536 - RNA, 17 nt, Homo sapiens
ugaagaagauaugugaa

SEQ ID NO: 1300537 - RNA, 15 nt, Homo sapiens
ugaagaaucuguuuc

SEQ ID NO: 1300538 - RNA, 15 nt, Homo sapiens
ugaagauagccagag

SEQ ID NO: 1300539 - RNA, 19 nt, Homo sapiens
ugaagccaauucagacagg

SEQ ID NO: 1300540 - RNA, 17 nt, Homo sapiens
ugaagccccucccugag

SEQ ID NO: 1300541 - RNA, 18 nt, Homo sapiens
ugaagccuauguaugcca

SEQ ID NO: 1300542 - RNA, 21 nt, Homo sapiens
ugaagcucuuuacuguaaagg

SEQ ID NO: 1300543 - RNA, 15 nt, Homo sapiens
ugaaggcaaugccau

SEQ ID NO: 1300544 - RNA, 14 nt, Homo sapiens
ugaagucacacagu

SEQ ID NO: 1300545 - RNA, 19 nt, Homo sapiens
ugaagucccagauacuugg

SEQ ID NO: 1300546 - RNA, 19 nt, Homo sapiens
ugaaguccuggcuucaggc

SEQ ID NO: 1300547 - RNA, 23 nt, Homo sapiens
ugaagugaccuggaaucagugaa

SEQ ID NO: 1300548 - RNA, 13 nt, Homo sapiens
ugaaguuugaaug

SEQ ID NO: 1300549 - RNA, 22 nt, Homo sapiens
ugaauaaaccaucaucuugcca

SEQ ID NO: 1300550 - RNA, 20 nt, Homo sapiens
ugaauaauacaguaucucag

SEQ ID NO: 1300551 - RNA, 19 nt, Homo sapiens
ugaauagcuuauguacaaa

SEQ ID NO: 1300552 - RNA, 21 nt, Homo sapiens
ugaaucaugagccugcuggaa

SEQ ID NO: 1300553 - RNA, 20 nt, Homo sapiens
ugaauccuuaaaggugagcc

SEQ ID NO: 1300554 - RNA, 15 nt, Homo sapiens
ugaaucugcucacuu

SEQ ID NO: 1300555 - RNA, 22 nt, Homo sapiens
ugaaugagaaugugccauguau

SEQ ID NO: 1300556 - RNA, 15 nt, Homo sapiens
ugaauugguugaaua

SEQ ID NO: 1300557 - RNA, 23 nt, Homo sapiens
ugaauuugcaaaguacuguaaga

SEQ ID NO: 1300558 - RNA, 13 nt, Homo sapiens
ugaauuuuugcaa

SEQ ID NO: 1300559 - RNA, 14 nt, Homo sapiens
ugaauuuuugcaau

SEQ ID NO: 1300560 - RNA, 18 nt, Homo sapiens
ugacaacgcccuacagca

SEQ ID NO: 1300561 - RNA, 18 nt, Homo sapiens
ugacaagagcgaaacucc

SEQ ID NO: 1300562 - RNA, 15 nt, Homo sapiens
ugacacaacugcacu

SEQ ID NO: 1300563 - RNA, 13 nt, Homo sapiens
ugacacacagcuc

SEQ ID NO: 1300564 - RNA, 22 nt, Homo sapiens
ugacacaggaugaaggcaaugc

SEQ ID NO: 1300565 - RNA, 23 nt, Homo sapiens
ugacacucuauaagauuccaaaa

SEQ ID NO: 1300566 - RNA, 15 nt, Homo sapiens
ugacacuuccauugu

SEQ ID NO: 1300567 - RNA, 13 nt, Homo sapiens
ugacagagugccu

SEQ ID NO: 1300568 - RNA, 16 nt, Homo sapiens
ugacagccugcagcag

SEQ ID NO: 1300569 - RNA, 19 nt, Homo sapiens
ugacagcuuugcugcugaa

SEQ ID NO: 1300570 - RNA, 16 nt, Homo sapiens
ugacaguuuguggcau

SEQ ID NO: 1300571 - RNA, 16 nt, Homo sapiens
ugacauaauauauucu

SEQ ID NO: 1300572 - RNA, 21 nt, Homo sapiens
ugacauggagaccgugaccag

SEQ ID NO: 1300573 - RNA, 15 nt, Homo sapiens
ugacauuauaugcac

SEQ ID NO: 1300574 - RNA, 18 nt, Homo sapiens
ugacauucaggcaauguc

SEQ ID NO: 1300575 - RNA, 12 nt, Homo sapiens
ugaccacagcac

SEQ ID NO: 1300576 - RNA, 15 nt, Homo sapiens
ugaccacagcacagc

SEQ ID NO: 1300577 - RNA, 18 nt, Homo sapiens
ugaccacagcacagccaa

SEQ ID NO: 1300578 - RNA, 21 nt, Homo sapiens
ugaccacugaagcaccacagg

SEQ ID NO: 1300579 - RNA, 14 nt, Homo sapiens
ugaccagugcugcu

SEQ ID NO: 1300580 - RNA, 10 nt, Homo sapiens
ugacccugua

SEQ ID NO: 1300581 - RNA, 14 nt, Homo sapiens
ugaccucaggugau

SEQ ID NO: 1300582 - RNA, 13 nt, Homo sapiens
ugaccuccacagc

SEQ ID NO: 1300583 - RNA, 18 nt, Homo sapiens
ugaccugaggaagcguga

SEQ ID NO: 1300584 - RNA, 18 nt, Homo sapiens
ugaccuggaaucagugaa

SEQ ID NO: 1300585 - RNA, 19 nt, Homo sapiens
ugaccuggaaucagugaag

SEQ ID NO: 1300586 - RNA, 19 nt, Homo sapiens
ugaccugguccacagggca

SEQ ID NO: 1300587 - RNA, 16 nt, Homo sapiens
ugacuccugcucucug

SEQ ID NO: 1300588 - RNA, 15 nt, Homo sapiens
ugacucgggccuuag

SEQ ID NO: 1300589 - RNA, 16 nt, Homo sapiens
ugacucgggccuuaga

SEQ ID NO: 1300590 - RNA, 21 nt, Homo sapiens
ugacucucgugcauuucaacu

SEQ ID NO: 1300591 - RNA, 18 nt, Homo sapiens
ugacugcccggcacagau

SEQ ID NO: 1300592 - RNA, 16 nt, Homo sapiens
ugacuuauaauuugca

SEQ ID NO: 1300593 - RNA, 17 nt, Homo sapiens
ugacuuauguaaucaaa

SEQ ID NO: 1300594 - RNA, 17 nt, Homo sapiens
ugacuuuagguucacau

SEQ ID NO: 1300595 - RNA, 13 nt, Homo sapiens
ugacuuugcauca

SEQ ID NO: 1300596 - RNA, 16 nt, Homo sapiens
ugacuuugcuccucac

SEQ ID NO: 1300597 - RNA, 17 nt, Homo sapiens
ugacuuugcuccucaca

SEQ ID NO: 1300598 - RNA, 23 nt, Homo sapiens
ugacuuuucaccuuaaugcauau

SEQ ID NO: 1300599 - RNA, 14 nt, Homo sapiens
ugagaaagcccugu

SEQ ID NO: 1300600 - RNA, 12 nt, Homo sapiens
ugagaacacugu

SEQ ID NO: 1300601 - RNA, 22 nt, Homo sapiens
ugagaagaaaacaucuauucuc

SEQ ID NO: 1300602 - RNA, 22 nt, Homo sapiens
ugagaagaaaaucagagaggga

SEQ ID NO: 1300603 - RNA, 14 nt, Homo sapiens
ugagaauauaaaaa

SEQ ID NO: 1300604 - RNA, 18 nt, Homo sapiens
ugagaauauaauacugua

SEQ ID NO: 1300605 - RNA, 14 nt, Homo sapiens
ugagaaugugccau

SEQ ID NO: 1300606 - RNA, 16 nt, Homo sapiens
ugagaauuuugugagg

SEQ ID NO: 1300607 - RNA, 13 nt, Homo sapiens
ugagaccuggcag

SEQ ID NO: 1300608 - RNA, 21 nt, Homo sapiens
ugagagaaaauacuauuucaa

SEQ ID NO: 1300609 - RNA, 22 nt, Homo sapiens
ugagagaaaauacuauuucaag

SEQ ID NO: 1300610 - RNA, 13 nt, Homo sapiens
ugagagaaccuca

SEQ ID NO: 1300611 - RNA, 16 nt, Homo sapiens
ugagagggcccagaag

SEQ ID NO: 1300612 - RNA, 16 nt, Homo sapiens
ugagauaauacauucc

SEQ ID NO: 1300613 - RNA, 17 nt, Homo sapiens
ugagauucaauauugaa

SEQ ID NO: 1300614 - RNA, 12 nt, Homo sapiens
ugagcaacucuu

SEQ ID NO: 1300615 - RNA, 18 nt, Homo sapiens
ugagcaagacauacuuaa

SEQ ID NO: 1300616 - RNA, 22 nt, Homo sapiens
ugagcaauguauaaccccaaag

SEQ ID NO: 1300617 - RNA, 15 nt, Homo sapiens
ugagcaccaggggau

SEQ ID NO: 1300618 - RNA, 13 nt, Homo sapiens
ugagcaugugaug

SEQ ID NO: 1300619 - RNA, 17 nt, Homo sapiens
ugagccauuaucaguca

SEQ ID NO: 1300620 - RNA, 16 nt, Homo sapiens
ugagccauuugagggg

SEQ ID NO: 1300621 - RNA, 15 nt, Homo sapiens
ugagcucccaggugc

SEQ ID NO: 1300622 - RNA, 21 nt, Homo sapiens
ugagcucccaggugcagccag

SEQ ID NO: 1300623 - RNA, 23 nt, Homo sapiens
ugagcugcaucccugcuccccac

SEQ ID NO: 1300624 - RNA, 17 nt, Homo sapiens
ugagcuuagauugccuc

SEQ ID NO: 1300625 - RNA, 21 nt, Homo sapiens
ugaggaaaagcggacaucagc

SEQ ID NO: 1300626 - RNA, 21 nt, Homo sapiens
ugaggaaaggccagcuggcag

SEQ ID NO: 1300627 - RNA, 16 nt, Homo sapiens
ugaggaauauuucaag

SEQ ID NO: 1300628 - RNA, 18 nt, Homo sapiens
ugaggaauguacuuuuaa

SEQ ID NO: 1300629 - RNA, 14 nt, Homo sapiens
ugaggauaacuuuu

SEQ ID NO: 1300630 - RNA, 20 nt, Homo sapiens
ugaggauuuugauccaagcu

SEQ ID NO: 1300631 - RNA, 19 nt, Homo sapiens
ugaggcaguuccaggagua

SEQ ID NO: 1300632 - RNA, 20 nt, Homo sapiens
ugaggcauccuuccucacac

SEQ ID NO: 1300633 - RNA, 20 nt, Homo sapiens
ugaggcauuuccagacuuga

SEQ ID NO: 1300634 - RNA, 19 nt, Homo sapiens
ugaggccuacucuaaagaa

SEQ ID NO: 1300635 - RNA, 14 nt, Homo sapiens
ugaggcugcaccca

SEQ ID NO: 1300636 - RNA, 16 nt, Homo sapiens
ugaggcuuuggcaaau

SEQ ID NO: 1300637 - RNA, 15 nt, Homo sapiens
ugagggcaguucuga

SEQ ID NO: 1300638 - RNA, 13 nt, Homo sapiens
ugagguaucuucu

SEQ ID NO: 1300639 - RNA, 17 nt, Homo sapiens
ugagguaucuucuuuag

SEQ ID NO: 1300640 - RNA, 14 nt, Homo sapiens
ugaggucacagucc

SEQ ID NO: 1300641 - RNA, 21 nt, Homo sapiens
ugagguuucuuugacuucaau

SEQ ID NO: 1300642 - RNA, 20 nt, Homo sapiens
ugagucaccaagcccaguua

SEQ ID NO: 1300643 - RNA, 19 nt, Homo sapiens
ugagucuauguucaaagac

SEQ ID NO: 1300644 - RNA, 15 nt, Homo sapiens
ugagugggugaauaa

SEQ ID NO: 1300645 - RNA, 16 nt, Homo sapiens
ugaguuacagccuguu

SEQ ID NO: 1300646 - RNA, 19 nt, Homo sapiens
ugaguuucuggcucuugag

SEQ ID NO: 1300647 - RNA, 14 nt, Homo sapiens
ugaguuuucagugg

SEQ ID NO: 1300648 - RNA, 15 nt, Homo sapiens
ugauaaaauuauuga

SEQ ID NO: 1300649 - RNA, 21 nt, Homo sapiens
ugauaagagggcacacacugu

SEQ ID NO: 1300650 - RNA, 12 nt, Homo sapiens
ugauaagcauuu

SEQ ID NO: 1300651 - RNA, 13 nt, Homo sapiens
ugauaaugcucac

SEQ ID NO: 1300652 - RNA, 20 nt, Homo sapiens
ucugaaaaauuuguaguuua

SEQ ID NO: 1300653 - RNA, 18 nt, Homo sapiens
ucugaaccccucccucca

SEQ ID NO: 1300654 - RNA, 21 nt, Homo sapiens
ucugaaggagccccauuccug

SEQ ID NO: 1300655 - RNA, 21 nt, Homo sapiens
ucugaauuugcaaaguacugu

SEQ ID NO: 1300656 - RNA, 22 nt, Homo sapiens
ucugacccagugcccccacuga

SEQ ID NO: 1300657 - RNA, 17 nt, Homo sapiens
ucugacucagggcuccu

SEQ ID NO: 1300658 - RNA, 17 nt, Homo sapiens
ucugacuccacucaaag

SEQ ID NO: 1300659 - RNA, 18 nt, Homo sapiens
ucugacuccacucaaaga

SEQ ID NO: 1300660 - RNA, 13 nt, Homo sapiens
ucugagaaacucu

SEQ ID NO: 1300661 - RNA, 19 nt, Homo sapiens
ucugagaaacucuacaugu

SEQ ID NO: 1300662 - RNA, 23 nt, Homo sapiens
ucugagaccacuugggcgcuguu

SEQ ID NO: 1300663 - RNA, 17 nt, Homo sapiens
ucugaggaugcauucga

SEQ ID NO: 1300664 - RNA, 17 nt, Homo sapiens
ucugagggagcugagua

SEQ ID NO: 1300665 - RNA, 20 nt, Homo sapiens
ucugagucuauguucaaaga

SEQ ID NO: 1300666 - RNA, 22 nt, Homo sapiens
ucugaucauccacugugccaug

SEQ ID NO: 1300667 - RNA, 15 nt, Homo sapiens
ucugaucccagccaa

SEQ ID NO: 1300668 - RNA, 21 nt, Homo sapiens
ucugcaagcacaucugcauuu

SEQ ID NO: 1300669 - RNA, 18 nt, Homo sapiens
ucugcacagcuuuuccaa

SEQ ID NO: 1300670 - RNA, 15 nt, Homo sapiens
ucugcauccagagau

SEQ ID NO: 1300671 - RNA, 17 nt, Homo sapiens
ucugcauccagagauuc

SEQ ID NO: 1300672 - RNA, 20 nt, Homo sapiens
ucugcauccagagauucauu

SEQ ID NO: 1300673 - RNA, 19 nt, Homo sapiens
ucugcauugcccagucuuu

SEQ ID NO: 1300674 - RNA, 11 nt, Homo sapiens
ucugcauuuac

SEQ ID NO: 1300675 - RNA, 13 nt, Homo sapiens
ucugcccuugcca

SEQ ID NO: 1300676 - RNA, 16 nt, Homo sapiens
ucugccgcuaccuccc

SEQ ID NO: 1300677 - RNA, 20 nt, Homo sapiens
ucugccggcccuggggcuag

SEQ ID NO: 1300678 - RNA, 16 nt, Homo sapiens
ucugccugaagucaca

SEQ ID NO: 1300679 - RNA, 17 nt, Homo sapiens
ucugccugaagucacac

SEQ ID NO: 1300680 - RNA, 19 nt, Homo sapiens
ucugcguaggaaaaugaau

SEQ ID NO: 1300681 - RNA, 20 nt, Homo sapiens
ucugcucacauaucugucau

SEQ ID NO: 1300682 - RNA, 14 nt, Homo sapiens
ucugcucacuuuaa

SEQ ID NO: 1300683 - RNA, 14 nt, Homo sapiens
ucugcucaucauuc

SEQ ID NO: 1300684 - RNA, 18 nt, Homo sapiens
ucugcucccaacuucgcc

SEQ ID NO: 1300685 - RNA, 18 nt, Homo sapiens
ucugcugacagacacagg

SEQ ID NO: 1300686 - RNA, 24 nt, Homo sapiens
ucugcuuaauacaucuacaaccau

SEQ ID NO: 1300687 - RNA, 17 nt, Homo sapiens
ucugcuuuucccauugc

SEQ ID NO: 1300688 - RNA, 19 nt, Homo sapiens
ucugcuuuucccauugcca

SEQ ID NO: 1300689 - RNA, 20 nt, Homo sapiens
ucugcuuuucccauugccau

SEQ ID NO: 1300690 - RNA, 18 nt, Homo sapiens
ucuggaacccagacucag

SEQ ID NO: 1300691 - RNA, 13 nt, Homo sapiens
ucuggaaguccaa

SEQ ID NO: 1300692 - RNA, 18 nt, Homo sapiens
ucuggaaucuggagacca

SEQ ID NO: 1300693 - RNA, 12 nt, Homo sapiens
ugauacauccaa

SEQ ID NO: 1300694 - RNA, 20 nt, Homo sapiens
ugauacuggaggaacacuug

SEQ ID NO: 1300695 - RNA, 12 nt, Homo sapiens
ugauacuuuuaa

SEQ ID NO: 1300696 - RNA, 22 nt, Homo sapiens
ugauagccuaguuaaauauuuc

SEQ ID NO: 1300697 - RNA, 15 nt, Homo sapiens
ugauauaaucuuuca

SEQ ID NO: 1300698 - RNA, 15 nt, Homo sapiens
ugauaugcaacugca

SEQ ID NO: 1300699 - RNA, 17 nt, Homo sapiens
ugauaugugaaugcuca

SEQ ID NO: 1300700 - RNA, 19 nt, Homo sapiens
ugauauguucaacuggaga

SEQ ID NO: 1300701 - RNA, 13 nt, Homo sapiens
ugauauugcagcu

SEQ ID NO: 1300702 - RNA, 20 nt, Homo sapiens
ugauauuuuuuauacaguga

SEQ ID NO: 1300703 - RNA, 23 nt, Homo sapiens
ugaucaggaccuccaagccacug

SEQ ID NO: 1300704 - RNA, 17 nt, Homo sapiens
ugauccacccaccucag

SEQ ID NO: 1300705 - RNA, 19 nt, Homo sapiens
ugauccuaggcauuugcug

SEQ ID NO: 1300706 - RNA, 20 nt, Homo sapiens
ugauccuggaggcccaguuc

SEQ ID NO: 1300707 - RNA, 12 nt, Homo sapiens
ugauccugugaa

SEQ ID NO: 1300708 - RNA, 22 nt, Homo sapiens
ugaucucgaacuccuaaccuca

SEQ ID NO: 1300709 - RNA, 22 nt, Homo sapiens
ugaucuucagggaacugcauag

SEQ ID NO: 1300710 - RNA, 18 nt, Homo sapiens
ugaucuucuaaucuguga

SEQ ID NO: 1300711 - RNA, 15 nt, Homo sapiens
ugaugaaauaucacu

SEQ ID NO: 1300712 - RNA, 12 nt, Homo sapiens
ugaugaaugaga

SEQ ID NO: 1300713 - RNA, 23 nt, Homo sapiens
ugaugcuuguauaaaugucagau

SEQ ID NO: 1300714 - RNA, 20 nt, Homo sapiens
ugauggcucauuuacacuca

SEQ ID NO: 1300715 - RNA, 22 nt, Homo sapiens
ugauguucauggguauaguuca

SEQ ID NO: 1300716 - RNA, 23 nt, Homo sapiens
ugauuauccauauugagucaaau

SEQ ID NO: 1300717 - RNA, 20 nt, Homo sapiens
ugauucaagccauuccaaag

SEQ ID NO: 1300718 - RNA, 22 nt, Homo sapiens
ugauucccuccugcuacucugu

SEQ ID NO: 1300719 - RNA, 24 nt, Homo sapiens
ugauuccuuuccuaaaaguguaag

SEQ ID NO: 1300720 - RNA, 19 nt, Homo sapiens
ugauucugauaaugcucac

SEQ ID NO: 1300721 - RNA, 16 nt, Homo sapiens
ugauugugccuacgaa

SEQ ID NO: 1300722 - RNA, 12 nt, Homo sapiens
ugauuguuuaca

SEQ ID NO: 1300723 - RNA, 15 nt, Homo sapiens
ugcaaaauauaucac

SEQ ID NO: 1300724 - RNA, 17 nt, Homo sapiens
ugcaaagucaugcaaag

SEQ ID NO: 1300725 - RNA, 18 nt, Homo sapiens
uugaagauaguaacugua

SEQ ID NO: 1300726 - RNA, 16 nt, Homo sapiens
uugaagcugacucaaa

SEQ ID NO: 1300727 - RNA, 19 nt, Homo sapiens
uugaauaguucuauacaaa

SEQ ID NO: 1300728 - RNA, 20 nt, Homo sapiens
uugaauaguucuauacaaau

SEQ ID NO: 1300729 - RNA, 16 nt, Homo sapiens
uugaaugcuaagaaug

SEQ ID NO: 1300730 - RNA, 14 nt, Homo sapiens
uuuagaacagggaa

SEQ ID NO: 1300731 - RNA, 20 nt, Homo sapiens
uuuagauauuuuccauauau

SEQ ID NO: 1300732 - RNA, 20 nt, Homo sapiens
uuuagcaauuuauacaauau

SEQ ID NO: 1300733 - RNA, 19 nt, Homo sapiens
uuuagcaucuuccuugaua

SEQ ID NO: 1300734 - RNA, 17 nt, Homo sapiens
uuuagcuguauucauau

SEQ ID NO: 1300735 - RNA, 13 nt, Homo sapiens
uuuaggaugcuuu

SEQ ID NO: 1300736 - RNA, 21 nt, Homo sapiens
uuuagguucccaaaccuucag

SEQ ID NO: 1300737 - RNA, 22 nt, Homo sapiens
uuuauaaaaaugagugcuuaaa

SEQ ID NO: 1300738 - RNA, 14 nt, Homo sapiens
uuuauaaaagcaaa

SEQ ID NO: 1300739 - RNA, 18 nt, Homo sapiens
uuuauaaggcugauguca

SEQ ID NO: 1300740 - RNA, 13 nt, Homo sapiens
uuuauaauguugu

SEQ ID NO: 1300741 - RNA, 20 nt, Homo sapiens
uuuauagucgaacaauucau

SEQ ID NO: 1300742 - RNA, 19 nt, Homo sapiens
uuuauauguauauaacaaa

SEQ ID NO: 1300743 - RNA, 18 nt, Homo sapiens
uuuaucaccucauucuga

SEQ ID NO: 1300744 - RNA, 17 nt, Homo sapiens
uuuaucuugucucuggg

SEQ ID NO: 1300745 - RNA, 21 nt, Homo sapiens
uuuauugcaggauggugucuc

SEQ ID NO: 1300746 - RNA, 11 nt, Homo sapiens
uuuauugccuc

SEQ ID NO: 1300747 - RNA, 11 nt, Homo sapiens
uuucaaaaaga

SEQ ID NO: 1300748 - RNA, 16 nt, Homo sapiens
uuucaaaaccuuuuga

SEQ ID NO: 1300749 - RNA, 16 nt, Homo sapiens
uuucaacugcagugua

SEQ ID NO: 1300750 - RNA, 19 nt, Homo sapiens
uuucaagagugagcuauca

SEQ ID NO: 1300751 - RNA, 12 nt, Homo sapiens
uuucacacuguc

SEQ ID NO: 1300752 - RNA, 12 nt, Homo sapiens
uuucacauugaa

SEQ ID NO: 1300753 - RNA, 21 nt, Homo sapiens
uuucacauuguuugcugcuau

SEQ ID NO: 1300754 - RNA, 17 nt, Homo sapiens
uuucaccacaugugcac

SEQ ID NO: 1300755 - RNA, 13 nt, Homo sapiens
uuucacucuuuag

SEQ ID NO: 1300756 - RNA, 19 nt, Homo sapiens
uuucagaugugaaccauua

SEQ ID NO: 1300757 - RNA, 19 nt, Homo sapiens
uuucaggcuccccagauca

SEQ ID NO: 1300758 - RNA, 21 nt, Homo sapiens
uuucaucacacuggguggugg

SEQ ID NO: 1300759 - RNA, 19 nt, Homo sapiens
uuucauccacuagugcaaa

SEQ ID NO: 1300760 - RNA, 23 nt, Homo sapiens
uuucaucguaaacauacuucuaa

SEQ ID NO: 1300761 - RNA, 17 nt, Homo sapiens
uuucauuuuuuuccagg

SEQ ID NO: 1300762 - RNA, 17 nt, Homo sapiens
uuuccaauuauuugacu

SEQ ID NO: 1300763 - RNA, 18 nt, Homo sapiens
uuuccaauuauuugacuu

SEQ ID NO: 1300764 - RNA, 22 nt, Homo sapiens
uuucccacgaggaaucuguggg

SEQ ID NO: 1300765 - RNA, 19 nt, Homo sapiens
uuucccagagucaucugau

SEQ ID NO: 1300766 - RNA, 13 nt, Homo sapiens
uuucccauugcca

SEQ ID NO: 1300767 - RNA, 13 nt, Homo sapiens
uuucccuuuggca

SEQ ID NO: 1300768 - RNA, 15 nt, Homo sapiens
uuuccuaaaagugua

SEQ ID NO: 1300769 - RNA, 17 nt, Homo sapiens
uuuccucaaaacuggag

SEQ ID NO: 1300770 - RNA, 22 nt, Homo sapiens
uuuccucagugcauuugugcua

SEQ ID NO: 1300771 - RNA, 15 nt, Homo sapiens
uuuccucccugcuua

SEQ ID NO: 1300772 - RNA, 16 nt, Homo sapiens
uuuccucccugcuuaa

SEQ ID NO: 1300773 - RNA, 12 nt, Homo sapiens
uuuccuccugag

SEQ ID NO: 1300774 - RNA, 18 nt, Homo sapiens
uuuccugagccauuauca

SEQ ID NO: 1300775 - RNA, 22 nt, Homo sapiens
uuuccugugucaauccagaugg

SEQ ID NO: 1300776 - RNA, 22 nt, Homo sapiens
uuucuacuuugaagucauacca

SEQ ID NO: 1300777 - RNA, 15 nt, Homo sapiens
uuucuagagcacugc

SEQ ID NO: 1300778 - RNA, 22 nt, Homo sapiens
uuucuagauacaauaaauugcu

SEQ ID NO: 1300779 - RNA, 20 nt, Homo sapiens
uuucucagaacaagguaaaa

SEQ ID NO: 1300780 - RNA, 16 nt, Homo sapiens
uuucucagacuuugga

SEQ ID NO: 1300781 - RNA, 23 nt, Homo sapiens
uuucucagacuuuggaaaaugca

SEQ ID NO: 1300782 - RNA, 12 nt, Homo sapiens
uuucuggcucuu

SEQ ID NO: 1300783 - RNA, 15 nt, Homo sapiens
uuucuguagugugaa

SEQ ID NO: 1300784 - RNA, 16 nt, Homo sapiens
uuucuuagugugccaa

SEQ ID NO: 1300785 - RNA, 20 nt, Homo sapiens
uuucuuauccuagcacaugc

SEQ ID NO: 1300786 - RNA, 15 nt, Homo sapiens
uuucuucuaccagac

SEQ ID NO: 1300787 - RNA, 20 nt, Homo sapiens
uuucuugugagaaaagaaua

SEQ ID NO: 1300788 - RNA, 17 nt, Homo sapiens
uuugaaauaaugacaua

SEQ ID NO: 1300789 - RNA, 18 nt, Homo sapiens
uuugaagaacaugugaga

SEQ ID NO: 1300790 - RNA, 22 nt, Homo sapiens
uuugaagcuacuguguguguga

SEQ ID NO: 1300791 - RNA, 20 nt, Homo sapiens
uuugaaggcaaaauugcaaa

SEQ ID NO: 1300792 - RNA, 19 nt, Homo sapiens
uuugacaugggggugccag

SEQ ID NO: 1300793 - RNA, 15 nt, Homo sapiens
uuugaccccagcagc

SEQ ID NO: 1300794 - RNA, 15 nt, Homo sapiens
uuugacucuggcaaa

SEQ ID NO: 1300795 - RNA, 17 nt, Homo sapiens
uuugacuucagauugaa

SEQ ID NO: 1300796 - RNA, 16 nt, Homo sapiens
uuugacuuuacuaaaa

SEQ ID NO: 1300797 - RNA, 15 nt, Homo sapiens
uuugagaagcucuga

SEQ ID NO: 1300798 - RNA, 23 nt, Homo sapiens
uuugaggaccccuuaaucuugcu

SEQ ID NO: 1300799 - RNA, 20 nt, Homo sapiens
uuugaugauuaauucaccuu

SEQ ID NO: 1300800 - RNA, 17 nt, Homo sapiens
uuugauuaaagacucca

SEQ ID NO: 1300801 - RNA, 14 nt, Homo sapiens
uuugauugauuuga

SEQ ID NO: 1300802 - RNA, 22 nt, Homo sapiens
uuugcaaaguacuguaagaaua

SEQ ID NO: 1300803 - RNA, 11 nt, Homo sapiens
uuugcacagaa

SEQ ID NO: 1300804 - RNA, 22 nt, Homo sapiens
uuugcagcuuucucuaguucaa

SEQ ID NO: 1300805 - RNA, 19 nt, Homo sapiens
uuugcauuaaauucacaaa

SEQ ID NO: 1300806 - RNA, 23 nt, Homo sapiens
uuugccauauuuucaccauuuga

SEQ ID NO: 1300807 - RNA, 17 nt, Homo sapiens
uuugcccaaaacuguca

SEQ ID NO: 1300808 - RNA, 14 nt, Homo sapiens
uuugcguacacaga

SEQ ID NO: 1300809 - RNA, 21 nt, Homo sapiens
uuuggacuggcuucucccagg

SEQ ID NO: 1300810 - RNA, 15 nt, Homo sapiens
uuuggagagugcuau

SEQ ID NO: 1300811 - RNA, 20 nt, Homo sapiens
uuuggagauagucucauucu

SEQ ID NO: 1300812 - RNA, 15 nt, Homo sapiens
uuuggagguauucaa

SEQ ID NO: 1300813 - RNA, 14 nt, Homo sapiens
uuuggauaauguua

SEQ ID NO: 1300814 - RNA, 21 nt, Homo sapiens
uuuggcagagcuucuuccagg

SEQ ID NO: 1300815 - RNA, 12 nt, Homo sapiens
uuuggccuccau

SEQ ID NO: 1300816 - RNA, 14 nt, Homo sapiens
uuuggcuuugcaaa

SEQ ID NO: 1300817 - RNA, 19 nt, Homo sapiens
uuugggauagagaauguuc

SEQ ID NO: 1300818 - RNA, 13 nt, Homo sapiens
uuugggccagaca

SEQ ID NO: 1300819 - RNA, 14 nt, Homo sapiens
uuugggccagacau

SEQ ID NO: 1300820 - RNA, 13 nt, Homo sapiens
uuugggguuuugu

SEQ ID NO: 1300821 - RNA, 16 nt, Homo sapiens
uuuguagcaguguacc

SEQ ID NO: 1300822 - RNA, 23 nt, Homo sapiens
uuuguauuguaaaaaauucacau

SEQ ID NO: 1300823 - RNA, 11 nt, Homo sapiens
uuugugucauu

SEQ ID NO: 1300824 - RNA, 15 nt, Homo sapiens
uuuguugagcaugac

SEQ ID NO: 1300825 - RNA, 12 nt, Homo sapiens
uuuguugcccag

SEQ ID NO: 1300826 - RNA, 21 nt, Homo sapiens
uuuguuuggguuacaguaugc

SEQ ID NO: 1300827 - RNA, 24 nt, Homo sapiens
uuuguuuugagacaaagacucacu

SEQ ID NO: 1300828 - RNA, 21 nt, Homo sapiens
uuuuaaaaaaaucccauuuaa

SEQ ID NO: 1300829 - RNA, 12 nt, Homo sapiens
uuuuaacucugu

SEQ ID NO: 1300830 - RNA, 18 nt, Homo sapiens
uuuuaaguuuccuuccag

SEQ ID NO: 1300831 - RNA, 17 nt, Homo sapiens
uuuuaaugcuauuugaa

SEQ ID NO: 1300832 - RNA, 23 nt, Homo sapiens
uuuuaccaaagugucuuuugaca

SEQ ID NO: 1300833 - RNA, 22 nt, Homo sapiens
uuuuagaauuaaaaaagcauac

SEQ ID NO: 1300834 - RNA, 12 nt, Homo sapiens
uuuuagcccagu

SEQ ID NO: 1300835 - RNA, 23 nt, Homo sapiens
uuuuagguagaaaaacauauucu

SEQ ID NO: 1300836 - RNA, 13 nt, Homo sapiens
uuuuauauguugc

SEQ ID NO: 1300837 - RNA, 13 nt, Homo sapiens
uuuuaugauauca

SEQ ID NO: 1300838 - RNA, 23 nt, Homo sapiens
uuuucaauguuagccacagugua

SEQ ID NO: 1300839 - RNA, 12 nt, Homo sapiens
uuuucacuugua

SEQ ID NO: 1300840 - RNA, 14 nt, Homo sapiens
uuuuccugccaggc

SEQ ID NO: 1300841 - RNA, 22 nt, Homo sapiens
uuuucuaaaaugaugauaguau

SEQ ID NO: 1300842 - RNA, 17 nt, Homo sapiens
uuuucuaacuucugcua

SEQ ID NO: 1300843 - RNA, 13 nt, Homo sapiens
uuuucuccagggu

SEQ ID NO: 1300844 - RNA, 20 nt, Homo sapiens
uuuucucuuagaacauugua

SEQ ID NO: 1300845 - RNA, 15 nt, Homo sapiens
uuuucuguaguguga

SEQ ID NO: 1300846 - RNA, 17 nt, Homo sapiens
uuuugaaauuaaccucu

SEQ ID NO: 1300847 - RNA, 21 nt, Homo sapiens
uuuugaagaggccuaagucaa

SEQ ID NO: 1300848 - RNA, 12 nt, Homo sapiens
uuuugaaggcaa

SEQ ID NO: 1300849 - RNA, 13 nt, Homo sapiens
uuuugacucugcc

SEQ ID NO: 1300850 - RNA, 16 nt, Homo sapiens
uuuugacuucagauug

SEQ ID NO: 1300851 - RNA, 13 nt, Homo sapiens
uuuugcacuguaa

SEQ ID NO: 1300852 - RNA, 19 nt, Homo sapiens
uuuuggcuugcuuaugugu

SEQ ID NO: 1300853 - RNA, 18 nt, Homo sapiens
uuuuggguguuccuggca

SEQ ID NO: 1300854 - RNA, 16 nt, Homo sapiens
uuuugucaacauugug

SEQ ID NO: 1300855 - RNA, 13 nt, Homo sapiens
uuuugugauugcc

SEQ ID NO: 1300856 - RNA, 17 nt, Homo sapiens
uuuuguucucaacuuca

SEQ ID NO: 1300857 - RNA, 19 nt, Homo sapiens
uuuuguucucaacuucaaa

SEQ ID NO: 1300858 - RNA, 14 nt, Homo sapiens
uuuuuaacugguga

SEQ ID NO: 1300859 - RNA, 15 nt, Homo sapiens
uuuuuaacuggugaa

SEQ ID NO: 1300860 - RNA, 20 nt, Homo sapiens
uuuuuauaaaaaugagugcu

SEQ ID NO: 1300861 - RNA, 22 nt, Homo sapiens
uuuuuauaaaaaugagugcuua

SEQ ID NO: 1300862 - RNA, 22 nt, Homo sapiens
uuuuucaagagcuccuugaccc

SEQ ID NO: 1300863 - RNA, 15 nt, Homo sapiens
ugccucucugcucca

SEQ ID NO: 1300864 - RNA, 20 nt, Homo sapiens
ugccucugacacacagcucu

SEQ ID NO: 1300865 - RNA, 14 nt, Homo sapiens
ugccugacuaggga

SEQ ID NO: 1300866 - RNA, 12 nt, Homo sapiens
ugccugugaaau

SEQ ID NO: 1300867 - RNA, 20 nt, Homo sapiens
ugccugugaaauaguacugc

SEQ ID NO: 1300868 - RNA, 23 nt, Homo sapiens
ugccuuaucuaaaucaccagaga

SEQ ID NO: 1300869 - RNA, 18 nt, Homo sapiens
ugccuucuaggucacuuc

SEQ ID NO: 1300870 - RNA, 17 nt, Homo sapiens
ugccuuguugaugugga

SEQ ID NO: 1300871 - RNA, 16 nt, Homo sapiens
ugcgagagaaagggag

SEQ ID NO: 1300872 - RNA, 22 nt, Homo sapiens
ugcgaucucggcucagugcaac

SEQ ID NO: 1300873 - RNA, 19 nt, Homo sapiens
ugcgauucugcagccacaa

SEQ ID NO: 1300874 - RNA, 16 nt, Homo sapiens
ugcgcaguggcauguc

SEQ ID NO: 1300875 - RNA, 11 nt, Homo sapiens
ugcgcccuuca

SEQ ID NO: 1300876 - RNA, 16 nt, Homo sapiens
ugcggauggauggaag

SEQ ID NO: 1300877 - RNA, 20 nt, Homo sapiens
ugcgggaagcugaccuuuaa

SEQ ID NO: 1300878 - RNA, 16 nt, Homo sapiens
ugcuaaagaauccaua

SEQ ID NO: 1300879 - RNA, 21 nt, Homo sapiens
ugcuaagccccagcaagcaau

SEQ ID NO: 1300880 - RNA, 16 nt, Homo sapiens
ugcuauaguauuugau

SEQ ID NO: 1300881 - RNA, 16 nt, Homo sapiens
ugcucacaguccucau

SEQ ID NO: 1300882 - RNA, 17 nt, Homo sapiens
ugcucacguuaccuuga

SEQ ID NO: 1300883 - RNA, 14 nt, Homo sapiens
ugcucauaugcaug

SEQ ID NO: 1300884 - RNA, 19 nt, Homo sapiens
ugcuccccgugagcacugc

SEQ ID NO: 1300885 - RNA, 15 nt, Homo sapiens
ugcuccccucugcac

SEQ ID NO: 1300886 - RNA, 12 nt, Homo sapiens
ugcuccuuccaa

SEQ ID NO: 1300887 - RNA, 16 nt, Homo sapiens
ugcucugcaagcagaa

SEQ ID NO: 1300888 - RNA, 16 nt, Homo sapiens
ugcucuugagucuuug

SEQ ID NO: 1300889 - RNA, 20 nt, Homo sapiens
ugcucuugagucuuugcaga

SEQ ID NO: 1300890 - RNA, 16 nt, Homo sapiens
ugcugaagacuugccc

SEQ ID NO: 1300891 - RNA, 21 nt, Homo sapiens
ugcugagauacauacagaauu

SEQ ID NO: 1300892 - RNA, 19 nt, Homo sapiens
cugcgcccaguccuuccac

SEQ ID NO: 1300893 - RNA, 22 nt, Homo sapiens
cugcuaacaagucaccaaaaga

SEQ ID NO: 1300894 - RNA, 13 nt, Homo sapiens
cugcuagcuauug

SEQ ID NO: 1300895 - RNA, 13 nt, Homo sapiens
cugcucacagucc

SEQ ID NO: 1300896 - RNA, 16 nt, Homo sapiens
cugcucacaguccuca

SEQ ID NO: 1300897 - RNA, 18 nt, Homo sapiens
guauuuuuaacaccagaa

SEQ ID NO: 1300898 - RNA, 22 nt, Homo sapiens
gucaaaguaaaacuugcugccu

SEQ ID NO: 1300899 - RNA, 21 nt, Homo sapiens
gucaacaucuuuuacauucug

SEQ ID NO: 1300900 - RNA, 16 nt, Homo sapiens
gucaagcugcucugag

SEQ ID NO: 1300901 - RNA, 22 nt, Homo sapiens
gucaagcuguugaagucucagg

SEQ ID NO: 1300902 - RNA, 18 nt, Homo sapiens
gucaaguuguuugucaau

SEQ ID NO: 1300903 - RNA, 19 nt, Homo sapiens
gucaaguuguuugucaaug

SEQ ID NO: 1300904 - RNA, 21 nt, Homo sapiens
gucaauccaagagucugauga

SEQ ID NO: 1300905 - RNA, 12 nt, Homo sapiens
gucacacacuga

SEQ ID NO: 1300906 - RNA, 18 nt, Homo sapiens
gucacacacuuuggcuau

SEQ ID NO: 1300907 - RNA, 20 nt, Homo sapiens
gucacagaucacagugucuu

SEQ ID NO: 1300908 - RNA, 11 nt, Homo sapiens
gucacagucca

SEQ ID NO: 1300909 - RNA, 16 nt, Homo sapiens
gucaccccucacugug

SEQ ID NO: 1300910 - RNA, 13 nt, Homo sapiens
gucacgcaccugg

SEQ ID NO: 1300911 - RNA, 14 nt, Homo sapiens
gucacgcaccuggg

SEQ ID NO: 1300912 - RNA, 22 nt, Homo sapiens
gucacuucuucaccucuuccac

SEQ ID NO: 1300913 - RNA, 14 nt, Homo sapiens
gucagaacagccag

SEQ ID NO: 1300914 - RNA, 17 nt, Homo sapiens
gucagaggaagccagca

SEQ ID NO: 1300915 - RNA, 21 nt, Homo sapiens
gucagaggagagauagccugu

SEQ ID NO: 1300916 - RNA, 17 nt, Homo sapiens
gucagcaaaaagcaaaa

SEQ ID NO: 1300917 - RNA, 17 nt, Homo sapiens
gucaguggggcucucug

SEQ ID NO: 1300918 - RNA, 18 nt, Homo sapiens
gucagugguggucuucaa

SEQ ID NO: 1300919 - RNA, 14 nt, Homo sapiens
gucauagauguuuc

SEQ ID NO: 1300920 - RNA, 17 nt, Homo sapiens
gucaucaaagaugacuu

SEQ ID NO: 1300921 - RNA, 17 nt, Homo sapiens
gucaucaggugcauagc

SEQ ID NO: 1300922 - RNA, 14 nt, Homo sapiens
gucaucuaccugag

SEQ ID NO: 1300923 - RNA, 18 nt, Homo sapiens
gucaucuauuuaaaccuu

SEQ ID NO: 1300924 - RNA, 16 nt, Homo sapiens
gucauugacaaagcug

SEQ ID NO: 1300925 - RNA, 13 nt, Homo sapiens
gucauuguauuca

SEQ ID NO: 1300926 - RNA, 14 nt, Homo sapiens
gucauuuugcacug

SEQ ID NO: 1300927 - RNA, 18 nt, Homo sapiens
gucauuuugcacuguaaa

SEQ ID NO: 1300928 - RNA, 20 nt, Homo sapiens
guccaaaacugccucaggag

SEQ ID NO: 1300929 - RNA, 20 nt, Homo sapiens
guccacccacccucucucug

SEQ ID NO: 1300930 - RNA, 14 nt, Homo sapiens
guccagcagucacu

SEQ ID NO: 1300931 - RNA, 16 nt, Homo sapiens
guccaggcacugagau

SEQ ID NO: 1300932 - RNA, 17 nt, Homo sapiens
guccccuaaaccaaaaa

SEQ ID NO: 1300933 - RNA, 18 nt, Homo sapiens
guccccuaaaccaaaaac

SEQ ID NO: 1300934 - RNA, 18 nt, Homo sapiens
gucccggggccagcacuu

SEQ ID NO: 1300935 - RNA, 17 nt, Homo sapiens
gucccguggcauuucaa

SEQ ID NO: 1300936 - RNA, 16 nt, Homo sapiens
gucccugcugcugcca

SEQ ID NO: 1300937 - RNA, 18 nt, Homo sapiens
gucccuguuguaacugcc

SEQ ID NO: 1300938 - RNA, 19 nt, Homo sapiens
gucccuugcuguaugcuga

SEQ ID NO: 1300939 - RNA, 21 nt, Homo sapiens
guccgccuggccggcuccagu

SEQ ID NO: 1300940 - RNA, 17 nt, Homo sapiens
guccggaaugccaccca

SEQ ID NO: 1300941 - RNA, 17 nt, Homo sapiens
guccuagagcuacaggg

SEQ ID NO: 1300942 - RNA, 22 nt, Homo sapiens
guccugcagaagcagaagugca

SEQ ID NO: 1300943 - RNA, 21 nt, Homo sapiens
gucgcccuuacuucuugcccu

SEQ ID NO: 1300944 - RNA, 20 nt, Homo sapiens
gucggaacccaagcuuagaa

SEQ ID NO: 1300945 - RNA, 16 nt, Homo sapiens
gucggagccacugguc

SEQ ID NO: 1300946 - RNA, 19 nt, Homo sapiens
gucuaaacuuuagaauuaa

SEQ ID NO: 1300947 - RNA, 23 nt, Homo sapiens
gucuaacuggggauauaauacua

SEQ ID NO: 1300948 - RNA, 15 nt, Homo sapiens
gucucaaacuccugg

SEQ ID NO: 1300949 - RNA, 13 nt, Homo sapiens
aggaaacaacagc

SEQ ID NO: 1300950 - RNA, 15 nt, Homo sapiens
aggaaaccacagcug

SEQ ID NO: 1300951 - RNA, 15 nt, Homo sapiens
aggaaagaacaucac

SEQ ID NO: 1300952 - RNA, 13 nt, Homo sapiens
aggaaagugauuu

SEQ ID NO: 1300953 - RNA, 23 nt, Homo sapiens
aggaaauccauucacaguucuuu

SEQ ID NO: 1300954 - RNA, 20 nt, Homo sapiens
aggaaauggagaagcucugu

SEQ ID NO: 1300955 - RNA, 22 nt, Homo sapiens
aggaaauucuugaaaauauaag

SEQ ID NO: 1300956 - RNA, 23 nt, Homo sapiens
aggaacacccccaugacauugca

SEQ ID NO: 1300957 - RNA, 21 nt, Homo sapiens
aggaacaucucugcuuucacu

SEQ ID NO: 1300958 - RNA, 18 nt, Homo sapiens
aggaaccaaauuuaagac

SEQ ID NO: 1300959 - RNA, 16 nt, Homo sapiens
aggaaccccaggagau

SEQ ID NO: 1300960 - RNA, 17 nt, Homo sapiens
aggaagaugauggcuca

SEQ ID NO: 1300961 - RNA, 20 nt, Homo sapiens
aggaagccucccacgacugc

SEQ ID NO: 1300962 - RNA, 20 nt, Homo sapiens
aggaagcuuuuguuauguau

SEQ ID NO: 1300963 - RNA, 20 nt, Homo sapiens
aggaaggcucuucuccccag

SEQ ID NO: 1300964 - RNA, 13 nt, Homo sapiens
aggaaguaacuuu

SEQ ID NO: 1300965 - RNA, 12 nt, Homo sapiens
aggaauacucau

SEQ ID NO: 1300966 - RNA, 18 nt, Homo sapiens
aggaauauaugugugccu

SEQ ID NO: 1300967 - RNA, 20 nt, Homo sapiens
aggaauauaugugugccuau

SEQ ID NO: 1300968 - RNA, 22 nt, Homo sapiens
aggaaucaacaauaguaacucu

SEQ ID NO: 1300969 - RNA, 17 nt, Homo sapiens
aggaaucaaugacuuaa

SEQ ID NO: 1300970 - RNA, 16 nt, Homo sapiens
aggaaugcugggcugu

SEQ ID NO: 1300971 - RNA, 20 nt, Homo sapiens
aggaauguggcugcaagcaa

SEQ ID NO: 1300972 - RNA, 18 nt, Homo sapiens
aggaauuauagaccucua

SEQ ID NO: 1300973 - RNA, 21 nt, Homo sapiens
aggaauucaagguuuguucaa

SEQ ID NO: 1300974 - RNA, 18 nt, Homo sapiens
aggacaagaggagcauga

SEQ ID NO: 1300975 - RNA, 13 nt, Homo sapiens
aggacacagucag

SEQ ID NO: 1300976 - RNA, 18 nt, Homo sapiens
aggacagggaggugaccc

SEQ ID NO: 1300977 - RNA, 15 nt, Homo sapiens
aggacaguauuccug

SEQ ID NO: 1300978 - RNA, 20 nt, Homo sapiens
aggacauccccccgccaaaa

SEQ ID NO: 1300979 - RNA, 16 nt, Homo sapiens
aggaccuuccuuccuc

SEQ ID NO: 1300980 - RNA, 22 nt, Homo sapiens
aggaccuuccuuccucuugcag

SEQ ID NO: 1300981 - RNA, 16 nt, Homo sapiens
aggacuuccauuugcu

SEQ ID NO: 1300982 - RNA, 15 nt, Homo sapiens
aggagaagggucuca

SEQ ID NO: 1300983 - RNA, 18 nt, Homo sapiens
aggagaaucaaaaugcaa

SEQ ID NO: 1300984 - RNA, 18 nt, Homo sapiens
aggagaaugaaauguaug

SEQ ID NO: 1300985 - RNA, 14 nt, Homo sapiens
aggagcacuacaga

SEQ ID NO: 1300986 - RNA, 13 nt, Homo sapiens
aggagcagugcag

SEQ ID NO: 1300987 - RNA, 18 nt, Homo sapiens
aggagcagugcaggcaca

SEQ ID NO: 1300988 - RNA, 20 nt, Homo sapiens
aggagcaugucacuccagca

SEQ ID NO: 1300989 - RNA, 20 nt, Homo sapiens
aggaggaguuagccaaacaa

SEQ ID NO: 1300990 - RNA, 21 nt, Homo sapiens
aggagguucucacuguuguga

SEQ ID NO: 1300991 - RNA, 14 nt, Homo sapiens
aggaguacagguga

SEQ ID NO: 1300992 - RNA, 16 nt, Homo sapiens
aggagucucacugggc

SEQ ID NO: 1300993 - RNA, 16 nt, Homo sapiens
aggaguugauaugcaa

SEQ ID NO: 1300994 - RNA, 18 nt, Homo sapiens
aggaguuugagaccaacc

SEQ ID NO: 1300995 - RNA, 14 nt, Homo sapiens
aggauauugucagu

SEQ ID NO: 1300996 - RNA, 14 nt, Homo sapiens
aggaucacugggcu

SEQ ID NO: 1300997 - RNA, 21 nt, Homo sapiens
aggaugaaagugaccauguuu

SEQ ID NO: 1300998 - RNA, 21 nt, Homo sapiens
aggauggcuugcgcucaggag

SEQ ID NO: 1300999 - RNA, 17 nt, Homo sapiens
aggauguucugggacac

SEQ ID NO: 1301000 - RNA, 11 nt, Homo sapiens
aggauguugcc

SEQ ID NO: 1301001 - RNA, 14 nt, Homo sapiens
aggauucuauauca

SEQ ID NO: 1301002 - RNA, 16 nt, Homo sapiens
aggauuugaauuuguc

SEQ ID NO: 1301003 - RNA, 13 nt, Homo sapiens
aggcaacugcauu

SEQ ID NO: 1301004 - RNA, 13 nt, Homo sapiens
aggcaaugggagc

SEQ ID NO: 1301005 - RNA, 17 nt, Homo sapiens
aggcaccucaagaagaa

SEQ ID NO: 1301006 - RNA, 15 nt, Homo sapiens
aggcagacucuuuau

SEQ ID NO: 1301007 - RNA, 12 nt, Homo sapiens
aggcagcacaga

SEQ ID NO: 1301008 - RNA, 15 nt, Homo sapiens
aggcagcagugugag

SEQ ID NO: 1301009 - RNA, 23 nt, Homo sapiens
aggcagggugcaguaucaugccc

SEQ ID NO: 1301010 - RNA, 18 nt, Homo sapiens
aggcaguauuuugugucc

SEQ ID NO: 1301011 - RNA, 19 nt, Homo sapiens
aggcaguauuuuguguccu

SEQ ID NO: 1301012 - RNA, 20 nt, Homo sapiens
aggcaguuccaggaguacuu

SEQ ID NO: 1301013 - RNA, 16 nt, Homo sapiens
aggcauccuuccucac

SEQ ID NO: 1301014 - RNA, 17 nt, Homo sapiens
aggcaugaaauacugug

SEQ ID NO: 1301015 - RNA, 23 nt, Homo sapiens
aggcaugagcuacuaugcccaac

SEQ ID NO: 1301016 - RNA, 11 nt, Homo sapiens
aggcauucucu

SEQ ID NO: 1301017 - RNA, 15 nt, Homo sapiens
aggcauucucugaag

SEQ ID NO: 1301018 - RNA, 15 nt, Homo sapiens
aggccaacacugugg

SEQ ID NO: 1301019 - RNA, 21 nt, Homo sapiens
aggccaauuuuuccagcauuu

SEQ ID NO: 1301020 - RNA, 19 nt, Homo sapiens
aggccacacucagcacaag

SEQ ID NO: 1301021 - RNA, 20 nt, Homo sapiens
aggccagagggagugacaga

SEQ ID NO: 1301022 - RNA, 18 nt, Homo sapiens
aggccaggccagcugccu

SEQ ID NO: 1301023 - RNA, 23 nt, Homo sapiens
aggccaguuugaagacuacauga

SEQ ID NO: 1301024 - RNA, 19 nt, Homo sapiens
aggccauugugaaccaaug

SEQ ID NO: 1301025 - RNA, 21 nt, Homo sapiens
aggccauugugaaccaaugca

SEQ ID NO: 1301026 - RNA, 16 nt, Homo sapiens
aggcccagaugugguu

SEQ ID NO: 1301027 - RNA, 16 nt, Homo sapiens
aggcccccacuugccu

SEQ ID NO: 1301028 - RNA, 16 nt, Homo sapiens
aggcccugcugaguca

SEQ ID NO: 1301029 - RNA, 16 nt, Homo sapiens
aggccgagaagcaaga

SEQ ID NO: 1301030 - RNA, 15 nt, Homo sapiens
aggccucuguggcac

SEQ ID NO: 1301031 - RNA, 10 nt, Homo sapiens
aggccugaag

SEQ ID NO: 1301032 - RNA, 23 nt, Homo sapiens
aggccugagauuucaucugcucu

SEQ ID NO: 1301033 - RNA, 12 nt, Homo sapiens
aggccugagcug

SEQ ID NO: 1301034 - RNA, 23 nt, Homo sapiens
aggccugagcugcuucacuaggg

SEQ ID NO: 1301035 - RNA, 18 nt, Homo sapiens
aggccugggccgcugcca

SEQ ID NO: 1301036 - RNA, 21 nt, Homo sapiens
aggccugggccgcugccacgu

SEQ ID NO: 1301037 - RNA, 21 nt, Homo sapiens
aggcgaucacaacgugcauug

SEQ ID NO: 1301038 - RNA, 21 nt, Homo sapiens
aggcgcccgggauccagcuca

SEQ ID NO: 1301039 - RNA, 15 nt, Homo sapiens
aggcgggagcucucc

SEQ ID NO: 1301040 - RNA, 15 nt, Homo sapiens
aggcuaaaaagcaac

SEQ ID NO: 1301041 - RNA, 20 nt, Homo sapiens
aggcuaccaacuuguaucca

SEQ ID NO: 1301042 - RNA, 20 nt, Homo sapiens
aggcuacuauagguccagaa

SEQ ID NO: 1301043 - RNA, 20 nt, Homo sapiens
aggcuauguaaacaaaccac

SEQ ID NO: 1301044 - RNA, 20 nt, Homo sapiens
aggcucccccuccucugacu

SEQ ID NO: 1301045 - RNA, 17 nt, Homo sapiens
aggcucguugacuggcu

SEQ ID NO: 1301046 - RNA, 18 nt, Homo sapiens
aggcucuucuuucccaaa

SEQ ID NO: 1301047 - RNA, 19 nt, Homo sapiens
aggcugaccacagcacagc

SEQ ID NO: 1301048 - RNA, 21 nt, Homo sapiens
aggcugaggcaagagaauuac

SEQ ID NO: 1301049 - RNA, 18 nt, Homo sapiens
aggcugaucccugagauc

SEQ ID NO: 1301050 - RNA, 18 nt, Homo sapiens
aggcugcacuugugagag

SEQ ID NO: 1301051 - RNA, 16 nt, Homo sapiens
aggcugccucccaaca

SEQ ID NO: 1301052 - RNA, 20 nt, Homo sapiens
aggcugcgagagaaagggag

SEQ ID NO: 1301053 - RNA, 20 nt, Homo sapiens
aacacaaacgggcucagcaa

SEQ ID NO: 1301054 - RNA, 19 nt, Homo sapiens
aacacagacauucugccag

SEQ ID NO: 1301055 - RNA, 15 nt, Homo sapiens
aacaccaagcacagc

SEQ ID NO: 1301056 - RNA, 17 nt, Homo sapiens
aacaccacgucacuuca

SEQ ID NO: 1301057 - RNA, 23 nt, Homo sapiens
aacaccagaacugugugucucau

SEQ ID NO: 1301058 - RNA, 15 nt, Homo sapiens
aacacgccugcaaac

SEQ ID NO: 1301059 - RNA, 13 nt, Homo sapiens
aacacuacucuua

SEQ ID NO: 1301060 - RNA, 22 nt, Homo sapiens
aacacuacucuuacauguauaa

SEQ ID NO: 1301061 - RNA, 23 nt, Homo sapiens
aacacuacucuuacauguauaaa

SEQ ID NO: 1301062 - RNA, 22 nt, Homo sapiens
aacacugcaagaagucuugaga

SEQ ID NO: 1301063 - RNA, 14 nt, Homo sapiens
aacacuuaccccau

SEQ ID NO: 1301064 - RNA, 22 nt, Homo sapiens
aacacuucguucgcagagcuuu

SEQ ID NO: 1301065 - RNA, 13 nt, Homo sapiens
aacagaagccuga

SEQ ID NO: 1301066 - RNA, 18 nt, Homo sapiens
aacagacccacauuggaa

SEQ ID NO: 1301067 - RNA, 16 nt, Homo sapiens
aacagacucgauucau

SEQ ID NO: 1301068 - RNA, 14 nt, Homo sapiens
aacagauaucuuca

SEQ ID NO: 1301069 - RNA, 18 nt, Homo sapiens
aacagccuuucaauucau

SEQ ID NO: 1301070 - RNA, 20 nt, Homo sapiens
aacagcgcuggguccacccc

SEQ ID NO: 1301071 - RNA, 20 nt, Homo sapiens
aacagcuguggcucacguga

SEQ ID NO: 1301072 - RNA, 11 nt, Homo sapiens
aacagcuguug

SEQ ID NO: 1301073 - RNA, 15 nt, Homo sapiens
aacagcuugcuguca

SEQ ID NO: 1301074 - RNA, 15 nt, Homo sapiens
aacaggcuaccaacu

SEQ ID NO: 1301075 - RNA, 15 nt, Homo sapiens
aacagggggcaaaga

SEQ ID NO: 1301076 - RNA, 22 nt, Homo sapiens
aacaggugucagagcugaaauu

SEQ ID NO: 1301077 - RNA, 17 nt, Homo sapiens
aacagguugggauggga

SEQ ID NO: 1301078 - RNA, 22 nt, Homo sapiens
aacagguuuucaccauagccua

SEQ ID NO: 1301079 - RNA, 18 nt, Homo sapiens
aacauaaaacuucuuuag

SEQ ID NO: 1301080 - RNA, 24 nt, Homo sapiens
aacauauuuauauauguaucuaaa

SEQ ID NO: 1301081 - RNA, 15 nt, Homo sapiens
aacaucacaccugcc

SEQ ID NO: 1301082 - RNA, 21 nt, Homo sapiens
aacaucaucaaggcacugccu

SEQ ID NO: 1301083 - RNA, 18 nt, Homo sapiens
aacaucgucuaaacuuua

SEQ ID NO: 1301084 - RNA, 20 nt, Homo sapiens
aacaucgucuaaacuuuaga

SEQ ID NO: 1301085 - RNA, 19 nt, Homo sapiens
aacaucucugcuuucacuc

SEQ ID NO: 1301086 - RNA, 16 nt, Homo sapiens
aacaucuuuagugucu

SEQ ID NO: 1301087 - RNA, 18 nt, Homo sapiens
aacaucuuuuacauucug

SEQ ID NO: 1301088 - RNA, 23 nt, Homo sapiens
aacaucuuuucuugccucugucc

SEQ ID NO: 1301089 - RNA, 16 nt, Homo sapiens
aacauguaauugcaga

SEQ ID NO: 1301090 - RNA, 23 nt, Homo sapiens
aacaugugagagguuugacuaga

SEQ ID NO: 1301091 - RNA, 19 nt, Homo sapiens
aacauuccaaauaauucca

SEQ ID NO: 1301092 - RNA, 23 nt, Homo sapiens
aacauuccagccacuggcugcua

SEQ ID NO: 1301093 - RNA, 21 nt, Homo sapiens
aacauucuccaguaagcaggu

SEQ ID NO: 1301094 - RNA, 13 nt, Homo sapiens
aacauugugaugu

SEQ ID NO: 1301095 - RNA, 16 nt, Homo sapiens
aacauuuaauuuagau

SEQ ID NO: 1301096 - RNA, 16 nt, Homo sapiens
aacauuuuacuguugu

SEQ ID NO: 1301097 - RNA, 18 nt, Homo sapiens
aaccaaaagaauuugcac

SEQ ID NO: 1301098 - RNA, 23 nt, Homo sapiens
aaccaaauuuguauuuaagguau

SEQ ID NO: 1301099 - RNA, 14 nt, Homo sapiens
aaccaagcuuucaa

SEQ ID NO: 1301100 - RNA, 13 nt, Homo sapiens
aaccaaguucaaa

SEQ ID NO: 1301101 - RNA, 16 nt, Homo sapiens
aaccaaucaaaugucu

SEQ ID NO: 1301102 - RNA, 16 nt, Homo sapiens
aaccaauggaauguga

SEQ ID NO: 1301103 - RNA, 14 nt, Homo sapiens
aaccaauguagcac

SEQ ID NO: 1301104 - RNA, 12 nt, Homo sapiens
aaccacauuaua

SEQ ID NO: 1301105 - RNA, 14 nt, Homo sapiens
aaccacuucagcug

SEQ ID NO: 1301106 - RNA, 18 nt, Homo sapiens
aaccacuucauucuugaa

SEQ ID NO: 1301107 - RNA, 20 nt, Homo sapiens
aaccagaucuagucaaucaa

SEQ ID NO: 1301108 - RNA, 19 nt, Homo sapiens
aaccagcaucccuugacca

SEQ ID NO: 1301109 - RNA, 13 nt, Homo sapiens
aaccagccucaaa

SEQ ID NO: 1301110 - RNA, 17 nt, Homo sapiens
aaccauaugaacauaua

SEQ ID NO: 1301111 - RNA, 14 nt, Homo sapiens
aaccauggcacuga

SEQ ID NO: 1301112 - RNA, 18 nt, Homo sapiens
aaccauugcugacuuuag

SEQ ID NO: 1301113 - RNA, 19 nt, Homo sapiens
aacccaaaaccucaugaca

SEQ ID NO: 1301114 - RNA, 12 nt, Homo sapiens
aacccagacuca

SEQ ID NO: 1301115 - RNA, 22 nt, Homo sapiens
aacccagcucuaauacauucca

SEQ ID NO: 1301116 - RNA, 21 nt, Homo sapiens
aacccaggaguucagggucau

SEQ ID NO: 1301117 - RNA, 17 nt, Homo sapiens
aacccagucacugugag

SEQ ID NO: 1301118 - RNA, 19 nt, Homo sapiens
aacccauuugucucuacuu

SEQ ID NO: 1301119 - RNA, 18 nt, Homo sapiens
aaccccccagcacugagg

SEQ ID NO: 1301120 - RNA, 20 nt, Homo sapiens
aaccccucugcuuuuaacuc

SEQ ID NO: 1301121 - RNA, 21 nt, Homo sapiens
aacccugacuccucuuugugc

SEQ ID NO: 1301122 - RNA, 23 nt, Homo sapiens
aacccugacuccucuuugugcag

SEQ ID NO: 1301123 - RNA, 19 nt, Homo sapiens
aacccuggaccaguggucu

SEQ ID NO: 1301124 - RNA, 18 nt, Homo sapiens
aacccuggugguugcugu

SEQ ID NO: 1301125 - RNA, 12 nt, Homo sapiens
aacccugucuga

SEQ ID NO: 1301126 - RNA, 23 nt, Homo sapiens
aacccuucccucaccuuggcacc

SEQ ID NO: 1301127 - RNA, 20 nt, Homo sapiens
aacccuucuggaaacuguga

SEQ ID NO: 1301128 - RNA, 14 nt, Homo sapiens
aacccuugcuugca

SEQ ID NO: 1301129 - RNA, 21 nt, Homo sapiens
aaccucaguuauuacauguaa

SEQ ID NO: 1301130 - RNA, 21 nt, Homo sapiens
aaccucaugacagccagagcc

SEQ ID NO: 1301131 - RNA, 17 nt, Homo sapiens
aaccucauuguucugua

SEQ ID NO: 1301132 - RNA, 21 nt, Homo sapiens
aaccucauuguucuguacaaa

SEQ ID NO: 1301133 - RNA, 16 nt, Homo sapiens
aaccucgaguacugug

SEQ ID NO: 1301134 - RNA, 13 nt, Homo sapiens
aaccuuaauugac

SEQ ID NO: 1301135 - RNA, 13 nt, Homo sapiens
aaccuuaucucca

SEQ ID NO: 1301136 - RNA, 12 nt, Homo sapiens
aacgcugccugc

SEQ ID NO: 1301137 - RNA, 18 nt, Homo sapiens
aacgguuuaauucugucu

SEQ ID NO: 1301138 - RNA, 14 nt, Homo sapiens
aacgugacagggaa

SEQ ID NO: 1301139 - RNA, 14 nt, Homo sapiens
aacgugcaaagcca

SEQ ID NO: 1301140 - RNA, 16 nt, Homo sapiens
aacgugcucaugggcu

SEQ ID NO: 1301141 - RNA, 16 nt, Homo sapiens
aacguguuugugguca

SEQ ID NO: 1301142 - RNA, 18 nt, Homo sapiens
aacguuugucauuccagu

SEQ ID NO: 1301143 - RNA, 19 nt, Homo sapiens
aacguuugucauuccaguu

SEQ ID NO: 1301144 - RNA, 21 nt, Homo sapiens
aacuaaugguccacacccaau

SEQ ID NO: 1301145 - RNA, 17 nt, Homo sapiens
aacuacccaaaacaagc

SEQ ID NO: 1301146 - RNA, 17 nt, Homo sapiens
aacuagaauuuauucaa

SEQ ID NO: 1301147 - RNA, 19 nt, Homo sapiens
aacuagcucuauguuuaca

SEQ ID NO: 1301148 - RNA, 19 nt, Homo sapiens
aacuagggaagauaauauu

SEQ ID NO: 1301149 - RNA, 17 nt, Homo sapiens
aacuauaacaccugcca

SEQ ID NO: 1301150 - RNA, 16 nt, Homo sapiens
aacuauguaacaugua

SEQ ID NO: 1301151 - RNA, 19 nt, Homo sapiens
aacuauuaaggauguagcu

SEQ ID NO: 1301152 - RNA, 18 nt, Homo sapiens
aacucaaauggggccaga

SEQ ID NO: 1301153 - RNA, 12 nt, Homo sapiens
aacucaccaucg

SEQ ID NO: 1301154 - RNA, 22 nt, Homo sapiens
aacucagagucggaacggagaa

SEQ ID NO: 1301155 - RNA, 23 nt, Homo sapiens
aacucagauccagggacagaggc

SEQ ID NO: 1301156 - RNA, 15 nt, Homo sapiens
aacucagcugaucug

SEQ ID NO: 1301157 - RNA, 12 nt, Homo sapiens
aacucaucucau

SEQ ID NO: 1301158 - RNA, 19 nt, Homo sapiens
aacucaugaggagggaaaa

SEQ ID NO: 1301159 - RNA, 14 nt, Homo sapiens
aacuccucaugucu

SEQ ID NO: 1301160 - RNA, 14 nt, Homo sapiens
aacucuuaaaaccc

SEQ ID NO: 1301161 - RNA, 23 nt, Homo sapiens
aacucuucaguuaauucuuagau

SEQ ID NO: 1301162 - RNA, 16 nt, Homo sapiens
aacucuugaccucagg

SEQ ID NO: 1301163 - RNA, 19 nt, Homo sapiens
aacugaaggcuaaaaagca

SEQ ID NO: 1301164 - RNA, 20 nt, Homo sapiens
aacugaaggcuaaaaagcaa

SEQ ID NO: 1301165 - RNA, 23 nt, Homo sapiens
aacugaggacuguuugcaauuga

SEQ ID NO: 1301166 - RNA, 20 nt, Homo sapiens
aacugagggcugaucuuuaa

SEQ ID NO: 1301167 - RNA, 22 nt, Homo sapiens
aacugcaggcccuggccucccc

SEQ ID NO: 1301168 - RNA, 14 nt, Homo sapiens
aacugcaugcugcu

SEQ ID NO: 1301169 - RNA, 17 nt, Homo sapiens
aacugcauuccuucccc

SEQ ID NO: 1301170 - RNA, 19 nt, Homo sapiens
aacugccucgaaacacaga

SEQ ID NO: 1301171 - RNA, 23 nt, Homo sapiens
aacuggucagggcaaaccugccu

SEQ ID NO: 1301172 - RNA, 14 nt, Homo sapiens
aacuguagauggaa

SEQ ID NO: 1301173 - RNA, 13 nt, Homo sapiens
aacugucauguaa

SEQ ID NO: 1301174 - RNA, 15 nt, Homo sapiens
aacugugaugaagcc

SEQ ID NO: 1301175 - RNA, 22 nt, Homo sapiens
aacugugcuucucuaugauaau

SEQ ID NO: 1301176 - RNA, 14 nt, Homo sapiens
aacugugugucuca

SEQ ID NO: 1301177 - RNA, 13 nt, Homo sapiens
aacuguuaaucag

SEQ ID NO: 1301178 - RNA, 22 nt, Homo sapiens
aacuuacaucacgacuuucucu

SEQ ID NO: 1301179 - RNA, 11 nt, Homo sapiens
aacuuagccau

SEQ ID NO: 1301180 - RNA, 14 nt, Homo sapiens
aacuuagugacaaa

SEQ ID NO: 1301181 - RNA, 18 nt, Homo sapiens
aacuucgaccuacugaaa

SEQ ID NO: 1301182 - RNA, 24 nt, Homo sapiens
aacuucuacuucugcccuugccaa

SEQ ID NO: 1301183 - RNA, 19 nt, Homo sapiens
aacuuggauguaccugccc

SEQ ID NO: 1301184 - RNA, 12 nt, Homo sapiens
aacuuggcugca

SEQ ID NO: 1301185 - RNA, 18 nt, Homo sapiens
aauuagcuuuuucauccc

SEQ ID NO: 1301186 - RNA, 21 nt, Homo sapiens
aauuaguuccucauuagcauu

SEQ ID NO: 1301187 - RNA, 18 nt, Homo sapiens
aauuauucauuuaaucaa

SEQ ID NO: 1301188 - RNA, 22 nt, Homo sapiens
aauuauuugcauaacaauuccu

SEQ ID NO: 1301189 - RNA, 19 nt, Homo sapiens
aauuauuuuuacaguucuc

SEQ ID NO: 1301190 - RNA, 14 nt, Homo sapiens
aauucaaacugggg

SEQ ID NO: 1301191 - RNA, 15 nt, Homo sapiens
aauucaagcauuuag

SEQ ID NO: 1301192 - RNA, 21 nt, Homo sapiens
aauucauauacugccuugugu

SEQ ID NO: 1301193 - RNA, 11 nt, Homo sapiens
aauuccaaagc

SEQ ID NO: 1301194 - RNA, 23 nt, Homo sapiens
aauuccuugcauagucucucuug

SEQ ID NO: 1301195 - RNA, 15 nt, Homo sapiens
aauucgcugcaaccu

SEQ ID NO: 1301196 - RNA, 15 nt, Homo sapiens
aauucggugugcacc

SEQ ID NO: 1301197 - RNA, 21 nt, Homo sapiens
aauucuauugaguggcagugu

SEQ ID NO: 1301198 - RNA, 17 nt, Homo sapiens
aauucuuacauguuuuc

SEQ ID NO: 1301199 - RNA, 18 nt, Homo sapiens
aauucuuagccaggugua

SEQ ID NO: 1301200 - RNA, 18 nt, Homo sapiens
aauucuucuguccugaga

SEQ ID NO: 1301201 - RNA, 22 nt, Homo sapiens
aauucuucuguccugagaagca

SEQ ID NO: 1301202 - RNA, 16 nt, Homo sapiens
aauucuuuggaacuuu

SEQ ID NO: 1301203 - RNA, 19 nt, Homo sapiens
aauucuuuggaacuuuaau

SEQ ID NO: 1301204 - RNA, 19 nt, Homo sapiens
aauugaaaguuuauaugcu

SEQ ID NO: 1301205 - RNA, 13 nt, Homo sapiens
aauugacaugugc

SEQ ID NO: 1301206 - RNA, 13 nt, Homo sapiens
aauugacuaaaaa

SEQ ID NO: 1301207 - RNA, 15 nt, Homo sapiens
aauugacuaaaaagu

SEQ ID NO: 1301208 - RNA, 18 nt, Homo sapiens
aauugagggacugagcca

SEQ ID NO: 1301209 - RNA, 16 nt, Homo sapiens
aauugcaaaucuugaa

SEQ ID NO: 1301210 - RNA, 20 nt, Homo sapiens
aauugcagaguacuggcuga

SEQ ID NO: 1301211 - RNA, 14 nt, Homo sapiens
aauugccuguaaca

SEQ ID NO: 1301212 - RNA, 20 nt, Homo sapiens
aauugcucuuggcugugaaa

SEQ ID NO: 1301213 - RNA, 13 nt, Homo sapiens
aauugggugugua

SEQ ID NO: 1301214 - RNA, 20 nt, Homo sapiens
aauuggucccaagacaugaa

SEQ ID NO: 1301215 - RNA, 23 nt, Homo sapiens
aauugugaagucgucuuaacuca

SEQ ID NO: 1301216 - RNA, 15 nt, Homo sapiens
aauuguuuggggaug

SEQ ID NO: 1301217 - RNA, 14 nt, Homo sapiens
aauuuaaaaauccu

SEQ ID NO: 1301218 - RNA, 17 nt, Homo sapiens
aauuuaaaauaugcucu

SEQ ID NO: 1301219 - RNA, 22 nt, Homo sapiens
aauuuauaguuaaggcuaaaaa

SEQ ID NO: 1301220 - RNA, 20 nt, Homo sapiens
aauuuaucuugucucugggc

SEQ ID NO: 1301221 - RNA, 15 nt, Homo sapiens
aauuucccccuaaac

SEQ ID NO: 1301222 - RNA, 14 nt, Homo sapiens
aauuucuacuuuga

SEQ ID NO: 1301223 - RNA, 23 nt, Homo sapiens
aauuucuucuccuggaguugcau

SEQ ID NO: 1301224 - RNA, 13 nt, Homo sapiens
aauuugacauaca

SEQ ID NO: 1301225 - RNA, 12 nt, Homo sapiens
aauuuguacaua

SEQ ID NO: 1301226 - RNA, 24 nt, Homo sapiens
aauuugugguccacugagcuauaa

SEQ ID NO: 1301227 - RNA, 22 nt, Homo sapiens
aauuuuaagcuguacacuuuca

SEQ ID NO: 1301228 - RNA, 23 nt, Homo sapiens
aauuuuagaugccugugaaauag

SEQ ID NO: 1301229 - RNA, 20 nt, Homo sapiens
aauuuucuguggaucauuuc

SEQ ID NO: 1301230 - RNA, 20 nt, Homo sapiens
aauuuugauauaaucuuuca

SEQ ID NO: 1301231 - RNA, 12 nt, Homo sapiens
aauuuugcugga

SEQ ID NO: 1301232 - RNA, 18 nt, Homo sapiens
aauuuugguuacuugaau

SEQ ID NO: 1301233 - RNA, 18 nt, Homo sapiens
aauuuuuccagcauuuau

SEQ ID NO: 1301234 - RNA, 20 nt, Homo sapiens
aauuuuuuaaauaaauggaa

SEQ ID NO: 1301235 - RNA, 22 nt, Homo sapiens
aauuuuuuuagaaagcauuuga

SEQ ID NO: 1301236 - RNA, 17 nt, Homo sapiens
acaaaaaagguaaucca

SEQ ID NO: 1301237 - RNA, 17 nt, Homo sapiens
acaaaaaaugugcuguu

SEQ ID NO: 1301238 - RNA, 12 nt, Homo sapiens
acaaaaauauua

SEQ ID NO: 1301239 - RNA, 23 nt, Homo sapiens
acaaaaauauuagcaaacugaau

SEQ ID NO: 1301240 - RNA, 14 nt, Homo sapiens
acaaaaauuugcca

SEQ ID NO: 1301241 - RNA, 11 nt, Homo sapiens
acaaaacuaca

SEQ ID NO: 1301242 - RNA, 19 nt, Homo sapiens
acaaaauaaagcuguucuc

SEQ ID NO: 1301243 - RNA, 15 nt, Homo sapiens
acaaaauggauacau

SEQ ID NO: 1301244 - RNA, 18 nt, Homo sapiens
acaaagaauuccaaagca

SEQ ID NO: 1301245 - RNA, 15 nt, Homo sapiens
acaaagacucacucu

SEQ ID NO: 1301246 - RNA, 21 nt, Homo sapiens
acaaagcagaagguuaaguca

SEQ ID NO: 1301247 - RNA, 24 nt, Homo sapiens
acaaaggagagcuagcagcaggga

SEQ ID NO: 1301248 - RNA, 14 nt, Homo sapiens
acaaagguuccauu

SEQ ID NO: 1301249 - RNA, 22 nt, Homo sapiens
acaaauaaaaagaaaauauuua

SEQ ID NO: 1301250 - RNA, 16 nt, Homo sapiens
acaaauaaguuacauc

SEQ ID NO: 1301251 - RNA, 16 nt, Homo sapiens
acaaauacuugacuca

SEQ ID NO: 1301252 - RNA, 15 nt, Homo sapiens
acaaaugacuccuaa

SEQ ID NO: 1301253 - RNA, 23 nt, Homo sapiens
acaaaugguggaggauugcugcc

SEQ ID NO: 1301254 - RNA, 14 nt, Homo sapiens
acaacacaguucuc

SEQ ID NO: 1301255 - RNA, 13 nt, Homo sapiens
acaacaugguguc

SEQ ID NO: 1301256 - RNA, 12 nt, Homo sapiens
acaacucagucc

SEQ ID NO: 1301257 - RNA, 18 nt, Homo sapiens
acaagacccccagcacuu

SEQ ID NO: 1301258 - RNA, 19 nt, Homo sapiens
acaagacccccagcacuug

SEQ ID NO: 1301259 - RNA, 17 nt, Homo sapiens
acaagauauuauguaua

SEQ ID NO: 1301260 - RNA, 15 nt, Homo sapiens
acaagcaaacccaga

SEQ ID NO: 1301261 - RNA, 18 nt, Homo sapiens
acaagcacuaaacaaaga

SEQ ID NO: 1301262 - RNA, 15 nt, Homo sapiens
acaagccaagaaaga

SEQ ID NO: 1301263 - RNA, 18 nt, Homo sapiens
acaagcccccccuuccac

SEQ ID NO: 1301264 - RNA, 20 nt, Homo sapiens
acaagcgugagccacugcac

SEQ ID NO: 1301265 - RNA, 19 nt, Homo sapiens
acaagcuugucaaugauuu

SEQ ID NO: 1301266 - RNA, 20 nt, Homo sapiens
acaaggaaggaaaagaaaga

SEQ ID NO: 1301267 - RNA, 12 nt, Homo sapiens
acaaggccaucu

SEQ ID NO: 1301268 - RNA, 15 nt, Homo sapiens
acaaguauccaguca

SEQ ID NO: 1301269 - RNA, 12 nt, Homo sapiens
acaagugguggu

SEQ ID NO: 1301270 - RNA, 22 nt, Homo sapiens
acaauagccgauaucagaauuu

SEQ ID NO: 1301271 - RNA, 19 nt, Homo sapiens
acaaucaucaucauucuca

SEQ ID NO: 1301272 - RNA, 18 nt, Homo sapiens
acaaucaugaaauaugca

SEQ ID NO: 1301273 - RNA, 19 nt, Homo sapiens
acaaucauguucugguggu

SEQ ID NO: 1301274 - RNA, 20 nt, Homo sapiens
acaaucccuuucuaaggaag

SEQ ID NO: 1301275 - RNA, 14 nt, Homo sapiens
acaaugcaugccca

SEQ ID NO: 1301276 - RNA, 15 nt, Homo sapiens
acaauguaagagccu

SEQ ID NO: 1301277 - RNA, 15 nt, Homo sapiens
acaauguucauccca

SEQ ID NO: 1301278 - RNA, 23 nt, Homo sapiens
acaauguuguguuuggauuugua

SEQ ID NO: 1301279 - RNA, 12 nt, Homo sapiens
acaauucugcau

SEQ ID NO: 1301280 - RNA, 13 nt, Homo sapiens
acacaaauauuua

SEQ ID NO: 1301281 - RNA, 13 nt, Homo sapiens
acacaacaacucc

SEQ ID NO: 1301282 - RNA, 16 nt, Homo sapiens
acacaagagcuggagc

SEQ ID NO: 1301283 - RNA, 20 nt, Homo sapiens
acacaaggauagaugcuggc

SEQ ID NO: 1301284 - RNA, 13 nt, Homo sapiens
acacacuccauca

SEQ ID NO: 1301285 - RNA, 18 nt, Homo sapiens
acacacugaggcagggaa

SEQ ID NO: 1301286 - RNA, 20 nt, Homo sapiens
acacagcucuucuccaggcu

SEQ ID NO: 1301287 - RNA, 21 nt, Homo sapiens
acacaggcccggcuccaggcu

SEQ ID NO: 1301288 - RNA, 13 nt, Homo sapiens
acacagucagauu

SEQ ID NO: 1301289 - RNA, 19 nt, Homo sapiens
acacaguuguaggguuaca

SEQ ID NO: 1301290 - RNA, 15 nt, Homo sapiens
acacauacauaggau

SEQ ID NO: 1301291 - RNA, 15 nt, Homo sapiens
acacauauccacaaa

SEQ ID NO: 1301292 - RNA, 21 nt, Homo sapiens
acacauuuagaugcacuacca

SEQ ID NO: 1301293 - RNA, 13 nt, Homo sapiens
acacccacagugg

SEQ ID NO: 1301294 - RNA, 23 nt, Homo sapiens
acacccccaugacauugcauuug

SEQ ID NO: 1301295 - RNA, 23 nt, Homo sapiens
acacccccucuucugagcacaga

SEQ ID NO: 1301296 - RNA, 12 nt, Homo sapiens
acaccugagaaa

SEQ ID NO: 1301297 - RNA, 17 nt, Homo sapiens
acaccuguaaucccagc

SEQ ID NO: 1301298 - RNA, 15 nt, Homo sapiens
acaccuugacagggc

SEQ ID NO: 1301299 - RNA, 17 nt, Homo sapiens
acacgccugcaaacgcu

SEQ ID NO: 1301300 - RNA, 23 nt, Homo sapiens
acacgggggcagcugauacaaau

SEQ ID NO: 1301301 - RNA, 13 nt, Homo sapiens
acacgucucgcca

SEQ ID NO: 1301302 - RNA, 23 nt, Homo sapiens
acacuaacgauuuguuaaugaua

SEQ ID NO: 1301303 - RNA, 15 nt, Homo sapiens
acacucacauuuauu

SEQ ID NO: 1301304 - RNA, 21 nt, Homo sapiens
acacucacuucucuuccuugg

SEQ ID NO: 1301305 - RNA, 19 nt, Homo sapiens
acacucccuucccaugacc

SEQ ID NO: 1301306 - RNA, 23 nt, Homo sapiens
acacucuauaagauuccaaaaag

SEQ ID NO: 1301307 - RNA, 23 nt, Homo sapiens
acacugaaacuguaugugcugua

SEQ ID NO: 1301308 - RNA, 12 nt, Homo sapiens
acacugcugcuc

SEQ ID NO: 1301309 - RNA, 22 nt, Homo sapiens
acacugcugcuccagugcagga

SEQ ID NO: 1301310 - RNA, 20 nt, Homo sapiens
acacugugggugugugacuc

SEQ ID NO: 1301311 - RNA, 14 nt, Homo sapiens
acacuuauguauug

SEQ ID NO: 1301312 - RNA, 21 nt, Homo sapiens
acacuucaguauagcauuggu

SEQ ID NO: 1301313 - RNA, 13 nt, Homo sapiens
acacuuucaggac

SEQ ID NO: 1301314 - RNA, 23 nt, Homo sapiens
acacuuugcuccucuggcccaag

SEQ ID NO: 1301315 - RNA, 17 nt, Homo sapiens
acagaacucaacuguau

SEQ ID NO: 1301316 - RNA, 21 nt, Homo sapiens
acagaagccugaugcugacau

SEQ ID NO: 1301317 - RNA, 21 nt, Homo sapiens
acuucgccagccuccaaugua

SEQ ID NO: 1301318 - RNA, 20 nt, Homo sapiens
acuucggacaccugccaugg

SEQ ID NO: 1301319 - RNA, 17 nt, Homo sapiens
acuucuaaacacaaaua

SEQ ID NO: 1301320 - RNA, 14 nt, Homo sapiens
acuucucaagauac

SEQ ID NO: 1301321 - RNA, 17 nt, Homo sapiens
acuucucuauuaucuca

SEQ ID NO: 1301322 - RNA, 13 nt, Homo sapiens
acuucucuuccuu

SEQ ID NO: 1301323 - RNA, 21 nt, Homo sapiens
acuucuguaauuuaaaagcuc

SEQ ID NO: 1301324 - RNA, 23 nt, Homo sapiens
acuucuuauggaauugauuugca

SEQ ID NO: 1301325 - RNA, 19 nt, Homo sapiens
acuucuucaccucuuccac

SEQ ID NO: 1301326 - RNA, 17 nt, Homo sapiens
acuugaaauucucauca

SEQ ID NO: 1301327 - RNA, 19 nt, Homo sapiens
acuugaucgugcagcugcu

SEQ ID NO: 1301328 - RNA, 17 nt, Homo sapiens
acuuggcuacacaggga

SEQ ID NO: 1301329 - RNA, 20 nt, Homo sapiens
acuuggcuacacagggaugu

SEQ ID NO: 1301330 - RNA, 19 nt, Homo sapiens
acuuggcuuuuuacuauua

SEQ ID NO: 1301331 - RNA, 22 nt, Homo sapiens
acuugggaauaaaucauagcaa

SEQ ID NO: 1301332 - RNA, 20 nt, Homo sapiens
acuugggccacugugaagag

SEQ ID NO: 1301333 - RNA, 23 nt, Homo sapiens
acuuggggaguuaagaccuggca

SEQ ID NO: 1301334 - RNA, 22 nt, Homo sapiens
acuuggucuggccacuguccca

SEQ ID NO: 1301335 - RNA, 21 nt, Homo sapiens
acuugucaagccugugcaaaa

SEQ ID NO: 1301336 - RNA, 16 nt, Homo sapiens
acuuguccaguucaaa

SEQ ID NO: 1301337 - RNA, 15 nt, Homo sapiens
acuuguuuuaugcuc

SEQ ID NO: 1301338 - RNA, 22 nt, Homo sapiens
acuuguuuuucccaucucuucc

SEQ ID NO: 1301339 - RNA, 21 nt, Homo sapiens
acuuuaaaauucaaguuauac

SEQ ID NO: 1301340 - RNA, 17 nt, Homo sapiens
acuuuacaaccugaugu

SEQ ID NO: 1301341 - RNA, 15 nt, Homo sapiens
acuuuagaagcacag

SEQ ID NO: 1301342 - RNA, 14 nt, Homo sapiens
acuuuauaguuguu

SEQ ID NO: 1301343 - RNA, 20 nt, Homo sapiens
acuuucagguacuaaauacc

SEQ ID NO: 1301344 - RNA, 19 nt, Homo sapiens
acuuucccccacacccaga

SEQ ID NO: 1301345 - RNA, 17 nt, Homo sapiens
acuuuccucuuccugcc

SEQ ID NO: 1301346 - RNA, 19 nt, Homo sapiens
acuuucuguucuccagugu

SEQ ID NO: 1301347 - RNA, 15 nt, Homo sapiens
acuuucuucuaccag

SEQ ID NO: 1301348 - RNA, 16 nt, Homo sapiens
acuuugagcuacugcc

SEQ ID NO: 1301349 - RNA, 12 nt, Homo sapiens
acuuugcuccuc

SEQ ID NO: 1301350 - RNA, 22 nt, Homo sapiens
acuuuggaauguacucuguuca

SEQ ID NO: 1301351 - RNA, 18 nt, Homo sapiens
acuuugggaggccaagga

SEQ ID NO: 1301352 - RNA, 18 nt, Homo sapiens
acuuugguuccugugaua

SEQ ID NO: 1301353 - RNA, 13 nt, Homo sapiens
acuuuuaauguca

SEQ ID NO: 1301354 - RNA, 16 nt, Homo sapiens
acuuuucaccuccuuc

SEQ ID NO: 1301355 - RNA, 14 nt, Homo sapiens
acuuuugaccaaaa

SEQ ID NO: 1301356 - RNA, 17 nt, Homo sapiens
acuuuuggaaccaugcc

SEQ ID NO: 1301357 - RNA, 22 nt, Homo sapiens
acuuuuuaacuuaacucaugaa

SEQ ID NO: 1301358 - RNA, 18 nt, Homo sapiens
acuuuuucuuguauucau

SEQ ID NO: 1301359 - RNA, 19 nt, Homo sapiens
agaaaaaaaccacacaaag

SEQ ID NO: 1301360 - RNA, 17 nt, Homo sapiens
agaaaaauaucuuggcc

SEQ ID NO: 1301361 - RNA, 22 nt, Homo sapiens
agaaaacagaccuaaugcuccu

SEQ ID NO: 1301362 - RNA, 12 nt, Homo sapiens
agaaaagauuau

SEQ ID NO: 1301363 - RNA, 21 nt, Homo sapiens
agaaaagugcauauuuaucca

SEQ ID NO: 1301364 - RNA, 21 nt, Homo sapiens
agaaaaguuauuagugguuua

SEQ ID NO: 1301365 - RNA, 20 nt, Homo sapiens
agaaaauaacgauaaaagac

SEQ ID NO: 1301366 - RNA, 21 nt, Homo sapiens
agaaaauaacgauaaaagaca

SEQ ID NO: 1301367 - RNA, 21 nt, Homo sapiens
agaaaccuuauuguaccucuc

SEQ ID NO: 1301368 - RNA, 14 nt, Homo sapiens
agaaacgucuucua

SEQ ID NO: 1301369 - RNA, 12 nt, Homo sapiens
agaaacucccau

SEQ ID NO: 1301370 - RNA, 20 nt, Homo sapiens
agaaagcaguucugaugcuu

SEQ ID NO: 1301371 - RNA, 14 nt, Homo sapiens
agaaaguacuucuc

SEQ ID NO: 1301372 - RNA, 22 nt, Homo sapiens
agaaaguacuucuccacccugc

SEQ ID NO: 1301373 - RNA, 15 nt, Homo sapiens
agaaagugugcuuua

SEQ ID NO: 1301374 - RNA, 15 nt, Homo sapiens
agaaauaauaugcau

SEQ ID NO: 1301375 - RNA, 17 nt, Homo sapiens
agaaauacagucuucca

SEQ ID NO: 1301376 - RNA, 15 nt, Homo sapiens
agaaauacuugaacu

SEQ ID NO: 1301377 - RNA, 23 nt, Homo sapiens
agaaaucuggcuucuggccagga

SEQ ID NO: 1301378 - RNA, 21 nt, Homo sapiens
agaaaucugggauguacuguu

SEQ ID NO: 1301379 - RNA, 15 nt, Homo sapiens
agaaauguacuuucu

SEQ ID NO: 1301380 - RNA, 22 nt, Homo sapiens
agaaauuuaaaagcagagcauu

SEQ ID NO: 1301381 - RNA, 18 nt, Homo sapiens
agaaauuuugccuuuaag

SEQ ID NO: 1301382 - RNA, 21 nt, Homo sapiens
agaacacccaauucaaauuga

SEQ ID NO: 1301383 - RNA, 11 nt, Homo sapiens
agaacagggaa

SEQ ID NO: 1301384 - RNA, 19 nt, Homo sapiens
agaacaguaacugccauca

SEQ ID NO: 1301385 - RNA, 13 nt, Homo sapiens
agaacaugcaguu

SEQ ID NO: 1301386 - RNA, 12 nt, Homo sapiens
agaacauuuuaa

SEQ ID NO: 1301387 - RNA, 19 nt, Homo sapiens
agaaccaugguaugaaggu

SEQ ID NO: 1301388 - RNA, 15 nt, Homo sapiens
agaaccucagaucag

SEQ ID NO: 1301389 - RNA, 16 nt, Homo sapiens
agaacucugagcagug

SEQ ID NO: 1301390 - RNA, 18 nt, Homo sapiens
agaacugcacgguacaaa

SEQ ID NO: 1301391 - RNA, 15 nt, Homo sapiens
agaacugugugucuc

SEQ ID NO: 1301392 - RNA, 19 nt, Homo sapiens
agaacuucauggaucagau

SEQ ID NO: 1301393 - RNA, 15 nt, Homo sapiens
agaagaaaauaucau

SEQ ID NO: 1301394 - RNA, 15 nt, Homo sapiens
agaagacaacauuaa

SEQ ID NO: 1301395 - RNA, 15 nt, Homo sapiens
agaagagaauuccuu

SEQ ID NO: 1301396 - RNA, 20 nt, Homo sapiens
agaagcacccaggacuucca

SEQ ID NO: 1301397 - RNA, 21 nt, Homo sapiens
agaagcugcagugguauuaau

SEQ ID NO: 1301398 - RNA, 23 nt, Homo sapiens
agaaggccacuguuugucucacc

SEQ ID NO: 1301399 - RNA, 21 nt, Homo sapiens
agaagguuggugaauuucaca

SEQ ID NO: 1301400 - RNA, 21 nt, Homo sapiens
agaaguaagccucaucaucag

SEQ ID NO: 1301401 - RNA, 16 nt, Homo sapiens
agaagucauggcccaa

SEQ ID NO: 1301402 - RNA, 14 nt, Homo sapiens
agaagucuugagaa

SEQ ID NO: 1301403 - RNA, 19 nt, Homo sapiens
agaagugcaauccagccca

SEQ ID NO: 1301404 - RNA, 16 nt, Homo sapiens
agaagugccaucucaa

SEQ ID NO: 1301405 - RNA, 23 nt, Homo sapiens
agaaguucacaucagaacagaca

SEQ ID NO: 1301406 - RNA, 14 nt, Homo sapiens
agaaguuuagcaca

SEQ ID NO: 1301407 - RNA, 15 nt, Homo sapiens
agaauaaagauuuau

SEQ ID NO: 1301408 - RNA, 18 nt, Homo sapiens
agaauaguaguaacuguu

SEQ ID NO: 1301409 - RNA, 17 nt, Homo sapiens
agaauauaaaaaacuuu

SEQ ID NO: 1301410 - RNA, 18 nt, Homo sapiens
agaauauaauacuguauu

SEQ ID NO: 1301411 - RNA, 20 nt, Homo sapiens
agaauauucucccauaaaca

SEQ ID NO: 1301412 - RNA, 21 nt, Homo sapiens
agaauauucucccauaaacac

SEQ ID NO: 1301413 - RNA, 21 nt, Homo sapiens
agaauauuuuaagaauuucac

SEQ ID NO: 1301414 - RNA, 21 nt, Homo sapiens
agaauauuuuaaguauugcau

SEQ ID NO: 1301415 - RNA, 19 nt, Homo sapiens
agaauauuuucaacauaaa

SEQ ID NO: 1301416 - RNA, 14 nt, Homo sapiens
agaaucaaaaugca

SEQ ID NO: 1301417 - RNA, 11 nt, Homo sapiens
agaauccaaag

SEQ ID NO: 1301418 - RNA, 19 nt, Homo sapiens
agaauccccuucuccaaac

SEQ ID NO: 1301419 - RNA, 21 nt, Homo sapiens
agaaucucauuacugcuucau

SEQ ID NO: 1301420 - RNA, 16 nt, Homo sapiens
agaaugaaauguaugu

SEQ ID NO: 1301421 - RNA, 21 nt, Homo sapiens
agaaugcaucucaucaacuua

SEQ ID NO: 1301422 - RNA, 11 nt, Homo sapiens
agaauggagcu

SEQ ID NO: 1301423 - RNA, 12 nt, Homo sapiens
agaauggagcug

SEQ ID NO: 1301424 - RNA, 19 nt, Homo sapiens
agaauguuccagacauucu

SEQ ID NO: 1301425 - RNA, 18 nt, Homo sapiens
agaauuaaaaaagcauac

SEQ ID NO: 1301426 - RNA, 13 nt, Homo sapiens
agaauuagcugcu

SEQ ID NO: 1301427 - RNA, 14 nt, Homo sapiens
agaauuagcugcuu

SEQ ID NO: 1301428 - RNA, 15 nt, Homo sapiens
agaauuccaaagcaa

SEQ ID NO: 1301429 - RNA, 17 nt, Homo sapiens
agaauugccaucgguca

SEQ ID NO: 1301430 - RNA, 19 nt, Homo sapiens
agaauugcuugaacccagg

SEQ ID NO: 1301431 - RNA, 24 nt, Homo sapiens
agaauuguuaccugucauuuugca

SEQ ID NO: 1301432 - RNA, 20 nt, Homo sapiens
agaauuuacaguuccuucaa

SEQ ID NO: 1301433 - RNA, 11 nt, Homo sapiens
agaauuugcac

SEQ ID NO: 1301434 - RNA, 19 nt, Homo sapiens
agacaagaacuuggaggca

SEQ ID NO: 1301435 - RNA, 20 nt, Homo sapiens
agacaaggucaccugggcug

SEQ ID NO: 1301436 - RNA, 18 nt, Homo sapiens
agacaauauggucccaaa

SEQ ID NO: 1301437 - RNA, 22 nt, Homo sapiens
agacaaugugaaaagaaaaaug

SEQ ID NO: 1301438 - RNA, 19 nt, Homo sapiens
agacacaacaacuccuagg

SEQ ID NO: 1301439 - RNA, 17 nt, Homo sapiens
agacacaggcccggcuc

SEQ ID NO: 1301440 - RNA, 18 nt, Homo sapiens
agacaccuugacagggca

SEQ ID NO: 1301441 - RNA, 18 nt, Homo sapiens
agacacuucauggaccaa

SEQ ID NO: 1301442 - RNA, 17 nt, Homo sapiens
agacagaaccuuguuau

SEQ ID NO: 1301443 - RNA, 19 nt, Homo sapiens
agacagagcgagacucuug

SEQ ID NO: 1301444 - RNA, 23 nt, Homo sapiens
agacaggcaaauaaaagugaccu

SEQ ID NO: 1301445 - RNA, 18 nt, Homo sapiens
agacaggguuuugccaug

SEQ ID NO: 1301446 - RNA, 21 nt, Homo sapiens
agacauacuugaagggccaga

SEQ ID NO: 1301447 - RNA, 17 nt, Homo sapiens
agacaugauuuccuuga

SEQ ID NO: 1301448 - RNA, 14 nt, Homo sapiens
cacauguggccaug

SEQ ID NO: 1301449 - RNA, 21 nt, Homo sapiens
cacauuuagauccugguuuca

SEQ ID NO: 1301450 - RNA, 24 nt, Homo sapiens
caccaacccuucauuuaacaagua

SEQ ID NO: 1301451 - RNA, 22 nt, Homo sapiens
caccaaggaaacgcuaccucuc

SEQ ID NO: 1301452 - RNA, 17 nt, Homo sapiens
caccaauuaauguagcu

SEQ ID NO: 1301453 - RNA, 18 nt, Homo sapiens
caccacccacccuaccug

SEQ ID NO: 1301454 - RNA, 16 nt, Homo sapiens
caccacgucacuucau

SEQ ID NO: 1301455 - RNA, 15 nt, Homo sapiens
caccacucaaaaaug

SEQ ID NO: 1301456 - RNA, 15 nt, Homo sapiens
caccagacacccagg

SEQ ID NO: 1301457 - RNA, 15 nt, Homo sapiens
caccagagaccaaac

SEQ ID NO: 1301458 - RNA, 13 nt, Homo sapiens
caccagcagccug

SEQ ID NO: 1301459 - RNA, 15 nt, Homo sapiens
caccagccagaggau

SEQ ID NO: 1301460 - RNA, 22 nt, Homo sapiens
caccaggagggaguggcagcua

SEQ ID NO: 1301461 - RNA, 17 nt, Homo sapiens
caccaucggcaggcagu

SEQ ID NO: 1301462 - RNA, 17 nt, Homo sapiens
caccauuuagaacuuuc

SEQ ID NO: 1301463 - RNA, 16 nt, Homo sapiens
caccauuuguauccac

SEQ ID NO: 1301464 - RNA, 23 nt, Homo sapiens
cacccacccuccaggaccccagc

SEQ ID NO: 1301465 - RNA, 18 nt, Homo sapiens
cacccacuucccugcagg

SEQ ID NO: 1301466 - RNA, 21 nt, Homo sapiens
cacccagaucacaaacagccu

SEQ ID NO: 1301467 - RNA, 15 nt, Homo sapiens
cacccccagugcagc

SEQ ID NO: 1301468 - RNA, 20 nt, Homo sapiens
cacccucauucuacugaaaa

SEQ ID NO: 1301469 - RNA, 21 nt, Homo sapiens
cacccucccucccugaucccg

SEQ ID NO: 1301470 - RNA, 24 nt, Homo sapiens
cacccugcauuugugucauugaca

SEQ ID NO: 1301471 - RNA, 17 nt, Homo sapiens
cacccugccccuugcca

SEQ ID NO: 1301472 - RNA, 19 nt, Homo sapiens
cacccuggccaccccaucu

SEQ ID NO: 1301473 - RNA, 20 nt, Homo sapiens
caccuaauccaggcagaucc

SEQ ID NO: 1301474 - RNA, 21 nt, Homo sapiens
caccucagaguauggagcuca

SEQ ID NO: 1301475 - RNA, 19 nt, Homo sapiens
caccucauucugaacccuu

SEQ ID NO: 1301476 - RNA, 21 nt, Homo sapiens
caccuccccagccuuugauca

SEQ ID NO: 1301477 - RNA, 17 nt, Homo sapiens
caccuccugccucaggu

SEQ ID NO: 1301478 - RNA, 18 nt, Homo sapiens
caccuccuucaauuccau

SEQ ID NO: 1301479 - RNA, 23 nt, Homo sapiens
caccucuuccgacucuuucugag

SEQ ID NO: 1301480 - RNA, 13 nt, Homo sapiens
caccugagcagga

SEQ ID NO: 1301481 - RNA, 21 nt, Homo sapiens
caccugccaccacuauaaaau

SEQ ID NO: 1301482 - RNA, 11 nt, Homo sapiens
caccuguaauc

SEQ ID NO: 1301483 - RNA, 21 nt, Homo sapiens
caccugucaaacaaagccaga

SEQ ID NO: 1301484 - RNA, 14 nt, Homo sapiens
caccugucauucua

SEQ ID NO: 1301485 - RNA, 14 nt, Homo sapiens
caccuuaauaugcu

SEQ ID NO: 1301486 - RNA, 19 nt, Homo sapiens
caccuuaaugcauauuccc

SEQ ID NO: 1301487 - RNA, 14 nt, Homo sapiens
caccuucguuuacu

SEQ ID NO: 1301488 - RNA, 14 nt, Homo sapiens
caccuuucccacuu

SEQ ID NO: 1301489 - RNA, 13 nt, Homo sapiens
cacgccugcaaac

SEQ ID NO: 1301490 - RNA, 21 nt, Homo sapiens
cacggcaaaaugucauuguuc

SEQ ID NO: 1301491 - RNA, 11 nt, Homo sapiens
cacggcugcug

SEQ ID NO: 1301492 - RNA, 18 nt, Homo sapiens
cacggcuuguaaauguga

SEQ ID NO: 1301493 - RNA, 19 nt, Homo sapiens
cacgguuuggaaauauuca

SEQ ID NO: 1301494 - RNA, 20 nt, Homo sapiens
cacuaagaauucaaacuggg

SEQ ID NO: 1301495 - RNA, 21 nt, Homo sapiens
cacuagcaauaaaaugcuaau

SEQ ID NO: 1301496 - RNA, 19 nt, Homo sapiens
cacuauagccuaggugaca

SEQ ID NO: 1301497 - RNA, 21 nt, Homo sapiens
cacuauagccuaggugacaga

SEQ ID NO: 1301498 - RNA, 23 nt, Homo sapiens
cacuauagccuaggugacagagu

SEQ ID NO: 1301499 - RNA, 14 nt, Homo sapiens
cacuauuacuggga

SEQ ID NO: 1301500 - RNA, 21 nt, Homo sapiens
cacuauuguuccagcaguuuu

SEQ ID NO: 1301501 - RNA, 19 nt, Homo sapiens
cacuauuuaucugugcaaa

SEQ ID NO: 1301502 - RNA, 19 nt, Homo sapiens
cacucaaggcggugcuuga

SEQ ID NO: 1301503 - RNA, 22 nt, Homo sapiens
cacucagauggaaccgcaggaa

SEQ ID NO: 1301504 - RNA, 12 nt, Homo sapiens
cacucaguuucu

SEQ ID NO: 1301505 - RNA, 22 nt, Homo sapiens
cacuccugggggagaaccacug

SEQ ID NO: 1301506 - RNA, 19 nt, Homo sapiens
cacucuauaagauuccaaa

SEQ ID NO: 1301507 - RNA, 23 nt, Homo sapiens
cacucuauaagauuccaaaaagc

SEQ ID NO: 1301508 - RNA, 20 nt, Homo sapiens
cacucuuuugcuuuauucca

SEQ ID NO: 1301509 - RNA, 13 nt, Homo sapiens
cacugaagcacca

SEQ ID NO: 1301510 - RNA, 18 nt, Homo sapiens
cacugaagggaaucacau

SEQ ID NO: 1301511 - RNA, 14 nt, Homo sapiens
cacugaauuccauu

SEQ ID NO: 1301512 - RNA, 15 nt, Homo sapiens
cacugacugucuccu

SEQ ID NO: 1301513 - RNA, 21 nt, Homo sapiens
cacugcaccgggccacagaga

SEQ ID NO: 1301514 - RNA, 14 nt, Homo sapiens
cacugcaggcauca

SEQ ID NO: 1301515 - RNA, 18 nt, Homo sapiens
cacugccaugcagggccu

SEQ ID NO: 1301516 - RNA, 20 nt, Homo sapiens
cacugcugcuccagugcagg

SEQ ID NO: 1301517 - RNA, 16 nt, Homo sapiens
cacugcuucuugggag

SEQ ID NO: 1301518 - RNA, 21 nt, Homo sapiens
cacugcuuuuggccuggaguu

SEQ ID NO: 1301519 - RNA, 14 nt, Homo sapiens
cacuggaugcagaa

SEQ ID NO: 1301520 - RNA, 17 nt, Homo sapiens
cacuggcguuacugcuu

SEQ ID NO: 1301521 - RNA, 21 nt, Homo sapiens
cacugggcugcagagacugga

SEQ ID NO: 1301522 - RNA, 22 nt, Homo sapiens
cacugggugguggccugguccc

SEQ ID NO: 1301523 - RNA, 23 nt, Homo sapiens
cacuguaaauaugaaucugcuca

SEQ ID NO: 1301524 - RNA, 14 nt, Homo sapiens
cacuguaucuaggc

SEQ ID NO: 1301525 - RNA, 19 nt, Homo sapiens
cacugugccaugugccagg

SEQ ID NO: 1301526 - RNA, 18 nt, Homo sapiens
cacugugggaaggccagc

SEQ ID NO: 1301527 - RNA, 15 nt, Homo sapiens
cacuguugugaaggu

SEQ ID NO: 1301528 - RNA, 14 nt, Homo sapiens
cacuguuucuaaaa

SEQ ID NO: 1301529 - RNA, 15 nt, Homo sapiens
cacuguuugucucac

SEQ ID NO: 1301530 - RNA, 22 nt, Homo sapiens
cacuguuuuuuggcuugcuuau

SEQ ID NO: 1301531 - RNA, 16 nt, Homo sapiens
cacuuccaagagccuu

SEQ ID NO: 1301532 - RNA, 20 nt, Homo sapiens
cacuuccugcugcgaaagac

SEQ ID NO: 1301533 - RNA, 22 nt, Homo sapiens
cacuuccuugcccccauuucac

SEQ ID NO: 1301534 - RNA, 21 nt, Homo sapiens
cacuucuuguuccccacugac

SEQ ID NO: 1301535 - RNA, 21 nt, Homo sapiens
cacuugcagacucuacagagg

SEQ ID NO: 1301536 - RNA, 23 nt, Homo sapiens
cacuugcuccccgugagcacugc

SEQ ID NO: 1301537 - RNA, 15 nt, Homo sapiens
cacuugguaauugua

SEQ ID NO: 1301538 - RNA, 21 nt, Homo sapiens
cacuuucagcgcuuauacuga

SEQ ID NO: 1301539 - RNA, 19 nt, Homo sapiens
cacuuucauuauagcagag

SEQ ID NO: 1301540 - RNA, 19 nt, Homo sapiens
cagaaagccaacauguggc

SEQ ID NO: 1301541 - RNA, 12 nt, Homo sapiens
cagaaaggugau

SEQ ID NO: 1301542 - RNA, 19 nt, Homo sapiens
cagaaaggugauuccagga

SEQ ID NO: 1301543 - RNA, 12 nt, Homo sapiens
cagaaaugcugc

SEQ ID NO: 1301544 - RNA, 18 nt, Homo sapiens
cagaaauuuaauucaugu

SEQ ID NO: 1301545 - RNA, 12 nt, Homo sapiens
cagaacagccag

SEQ ID NO: 1301546 - RNA, 12 nt, Homo sapiens
cagaacugaaga

SEQ ID NO: 1301547 - RNA, 14 nt, Homo sapiens
cagaagacaaaaag

SEQ ID NO: 1301548 - RNA, 18 nt, Homo sapiens
cagaagcagaagugcaau

SEQ ID NO: 1301549 - RNA, 14 nt, Homo sapiens
cagaagccucugcc

SEQ ID NO: 1301550 - RNA, 16 nt, Homo sapiens
cagaaggcaaacccau

SEQ ID NO: 1301551 - RNA, 19 nt, Homo sapiens
cagaaggcucgccucuccc

SEQ ID NO: 1301552 - RNA, 12 nt, Homo sapiens
cagaaggggugg

SEQ ID NO: 1301553 - RNA, 17 nt, Homo sapiens
cagaauaaauaugcuca

SEQ ID NO: 1301554 - RNA, 16 nt, Homo sapiens
cagaauauucucccau

SEQ ID NO: 1301555 - RNA, 14 nt, Homo sapiens
cagaaucccggcug

SEQ ID NO: 1301556 - RNA, 22 nt, Homo sapiens
cagaaucccggcugucaagggg

SEQ ID NO: 1301557 - RNA, 13 nt, Homo sapiens
cagaaucucauua

SEQ ID NO: 1301558 - RNA, 22 nt, Homo sapiens
cagaaugcugcaggacuugaga

SEQ ID NO: 1301559 - RNA, 13 nt, Homo sapiens
cagaauguaacug

SEQ ID NO: 1301560 - RNA, 13 nt, Homo sapiens
cagaauuacugua

SEQ ID NO: 1301561 - RNA, 20 nt, Homo sapiens
cagaauuuuaugcggcauuu

SEQ ID NO: 1301562 - RNA, 15 nt, Homo sapiens
cagacaaaacccugc

SEQ ID NO: 1301563 - RNA, 12 nt, Homo sapiens
cagacaacacug

SEQ ID NO: 1301564 - RNA, 15 nt, Homo sapiens
cagacaacacuggga

SEQ ID NO: 1301565 - RNA, 19 nt, Homo sapiens
cagacacacacacacacaa

SEQ ID NO: 1301566 - RNA, 14 nt, Homo sapiens
cagacagaaagaga

SEQ ID NO: 1301567 - RNA, 23 nt, Homo sapiens
cagacagguggaaaaacugagac

SEQ ID NO: 1301568 - RNA, 17 nt, Homo sapiens
cagacaugccacaagga

SEQ ID NO: 1301569 - RNA, 16 nt, Homo sapiens
cagaccuaaugcuccu

SEQ ID NO: 1301570 - RNA, 19 nt, Homo sapiens
cagacggcuccacuaggac

SEQ ID NO: 1301571 - RNA, 21 nt, Homo sapiens
cagacuacuucuuccccagau

SEQ ID NO: 1301572 - RNA, 20 nt, Homo sapiens
cagacucuacagaggccaug

SEQ ID NO: 1301573 - RNA, 14 nt, Homo sapiens
cagacuucccugaa

SEQ ID NO: 1301574 - RNA, 11 nt, Homo sapiens
cagacuugcca

SEQ ID NO: 1301575 - RNA, 19 nt, Homo sapiens
cagacuuuggaaaaugcau

SEQ ID NO: 1301576 - RNA, 18 nt, Homo sapiens
cagagaaacuuaagcaaa

SEQ ID NO: 1301577 - RNA, 14 nt, Homo sapiens
cagagaaaggauug

SEQ ID NO: 1301578 - RNA, 17 nt, Homo sapiens
cagagaaagggacaaug

SEQ ID NO: 1301579 - RNA, 23 nt, Homo sapiens
cagagaccagcccaccccugugc

SEQ ID NO: 1301580 - RNA, 14 nt, Homo sapiens
ccaguauggugaaa

SEQ ID NO: 1301581 - RNA, 17 nt, Homo sapiens
ccagucacugugagcuc

SEQ ID NO: 1301582 - RNA, 18 nt, Homo sapiens
ccagucgaccccaaagga

SEQ ID NO: 1301583 - RNA, 19 nt, Homo sapiens
ccagucuguugaguuaguu

SEQ ID NO: 1301584 - RNA, 14 nt, Homo sapiens
ccaguucugaaggu

SEQ ID NO: 1301585 - RNA, 16 nt, Homo sapiens
ccaguuuuuugaacau

SEQ ID NO: 1301586 - RNA, 15 nt, Homo sapiens
ccauaaagacaauca

SEQ ID NO: 1301587 - RNA, 13 nt, Homo sapiens
ccauacagccagg

SEQ ID NO: 1301588 - RNA, 22 nt, Homo sapiens
ccauagccaggagcgcaucuca

SEQ ID NO: 1301589 - RNA, 22 nt, Homo sapiens
ccauaggcccagugagaugcau

SEQ ID NO: 1301590 - RNA, 19 nt, Homo sapiens
ccauagggacccauucuac

SEQ ID NO: 1301591 - RNA, 20 nt, Homo sapiens
ccauagucaaauuuguaaau

SEQ ID NO: 1301592 - RNA, 16 nt, Homo sapiens
ccauaguucacugacu

SEQ ID NO: 1301593 - RNA, 16 nt, Homo sapiens
ccauaucugugaaaug

SEQ ID NO: 1301594 - RNA, 22 nt, Homo sapiens
ccauauugcacaacucuacugu

SEQ ID NO: 1301595 - RNA, 12 nt, Homo sapiens
ccauauuuucac

SEQ ID NO: 1301596 - RNA, 14 nt, Homo sapiens
ccaucaccagacag

SEQ ID NO: 1301597 - RNA, 21 nt, Homo sapiens
ccaucaguuagagcugacaca

SEQ ID NO: 1301598 - RNA, 13 nt, Homo sapiens
ccauccaguggag

SEQ ID NO: 1301599 - RNA, 17 nt, Homo sapiens
ccauccucaaacacugc

SEQ ID NO: 1301600 - RNA, 18 nt, Homo sapiens
ccauccuucccuuuggag

SEQ ID NO: 1301601 - RNA, 15 nt, Homo sapiens
ccaucuaugucccuu

SEQ ID NO: 1301602 - RNA, 19 nt, Homo sapiens
ccaucucuacaaaaagcau

SEQ ID NO: 1301603 - RNA, 12 nt, Homo sapiens
ccaugacaugga

SEQ ID NO: 1301604 - RNA, 23 nt, Homo sapiens
ccaugagaguagagggcacuggg

SEQ ID NO: 1301605 - RNA, 17 nt, Homo sapiens
ccaugauggcaacagau

SEQ ID NO: 1301606 - RNA, 22 nt, Homo sapiens
ccaugauggcaacagaucugga

SEQ ID NO: 1301607 - RNA, 22 nt, Homo sapiens
ccaugauggccaggcugaucuc

SEQ ID NO: 1301608 - RNA, 22 nt, Homo sapiens
ccaugcaagaacucaucacugu

SEQ ID NO: 1301609 - RNA, 14 nt, Homo sapiens
ccaugcagacauga

SEQ ID NO: 1301610 - RNA, 22 nt, Homo sapiens
ccaugccgacggggacugcuuc

SEQ ID NO: 1301611 - RNA, 17 nt, Homo sapiens
ccauggacccaauauuu

SEQ ID NO: 1301612 - RNA, 23 nt, Homo sapiens
ccaugggagauuuggagcugucu

SEQ ID NO: 1301613 - RNA, 12 nt, Homo sapiens
ccauuccaaagu

SEQ ID NO: 1301614 - RNA, 15 nt, Homo sapiens
ccauucccuucucaa

SEQ ID NO: 1301615 - RNA, 11 nt, Homo sapiens
ccauugcaaug

SEQ ID NO: 1301616 - RNA, 13 nt, Homo sapiens
ccauugcaaugaa

SEQ ID NO: 1301617 - RNA, 17 nt, Homo sapiens
ccauuuuucaaagcaau

SEQ ID NO: 1301618 - RNA, 18 nt, Homo sapiens
cccaaacucuccagacau

SEQ ID NO: 1301619 - RNA, 14 nt, Homo sapiens
cccaaauauuuagc

SEQ ID NO: 1301620 - RNA, 16 nt, Homo sapiens
cccaagcagagaagcu

SEQ ID NO: 1301621 - RNA, 16 nt, Homo sapiens
cccaaguagcugcuac

SEQ ID NO: 1301622 - RNA, 17 nt, Homo sapiens
cccacagaacugcuuac

SEQ ID NO: 1301623 - RNA, 18 nt, Homo sapiens
cccacauccugugccucc

SEQ ID NO: 1301624 - RNA, 17 nt, Homo sapiens
cccaccaguuauuccuu

SEQ ID NO: 1301625 - RNA, 21 nt, Homo sapiens
cccacgacugcccggcagggu

SEQ ID NO: 1301626 - RNA, 19 nt, Homo sapiens
cccacgcuggagugcagug

SEQ ID NO: 1301627 - RNA, 17 nt, Homo sapiens
cccacuguaugauuuau

SEQ ID NO: 1301628 - RNA, 18 nt, Homo sapiens
cccagaaaaccuccagua

SEQ ID NO: 1301629 - RNA, 13 nt, Homo sapiens
cccagaauggagg

SEQ ID NO: 1301630 - RNA, 22 nt, Homo sapiens
cccagagacauacuugaagggc

SEQ ID NO: 1301631 - RNA, 20 nt, Homo sapiens
cccagagcaucuugcaucca

SEQ ID NO: 1301632 - RNA, 18 nt, Homo sapiens
cccagaggccaacacugu

SEQ ID NO: 1301633 - RNA, 21 nt, Homo sapiens
cccagauagcuggcugggugg

SEQ ID NO: 1301634 - RNA, 15 nt, Homo sapiens
cccagaucacaaaca

SEQ ID NO: 1301635 - RNA, 20 nt, Homo sapiens
cccagauucuucagcuugau

SEQ ID NO: 1301636 - RNA, 12 nt, Homo sapiens
cccagauugcaa

SEQ ID NO: 1301637 - RNA, 13 nt, Homo sapiens
cccagcacugagg

SEQ ID NO: 1301638 - RNA, 20 nt, Homo sapiens
cccagcauucucaggcacca

SEQ ID NO: 1301639 - RNA, 11 nt, Homo sapiens
cccagcauuuu

SEQ ID NO: 1301640 - RNA, 20 nt, Homo sapiens
cccagcccacuucugccaua

SEQ ID NO: 1301641 - RNA, 23 nt, Homo sapiens
cccagcccagggcuccugcacuu

SEQ ID NO: 1301642 - RNA, 18 nt, Homo sapiens
cccagccccugccagcuu

SEQ ID NO: 1301643 - RNA, 21 nt, Homo sapiens
cccagcuccggccuguccucc

SEQ ID NO: 1301644 - RNA, 19 nt, Homo sapiens
cccaggaauucaagguugg

SEQ ID NO: 1301645 - RNA, 14 nt, Homo sapiens
cccaggacccugaa

SEQ ID NO: 1301646 - RNA, 16 nt, Homo sapiens
cccaggauuugacucg

SEQ ID NO: 1301647 - RNA, 15 nt, Homo sapiens
cccaggcacugcaaa

SEQ ID NO: 1301648 - RNA, 20 nt, Homo sapiens
cccaggcccugccagagcag

SEQ ID NO: 1301649 - RNA, 21 nt, Homo sapiens
cccaggccuguacagauguau

SEQ ID NO: 1301650 - RNA, 17 nt, Homo sapiens
cccaggcugggaacuca

SEQ ID NO: 1301651 - RNA, 15 nt, Homo sapiens
cccaggcugggcaag

SEQ ID NO: 1301652 - RNA, 15 nt, Homo sapiens
cccagggaacagcca

SEQ ID NO: 1301653 - RNA, 14 nt, Homo sapiens
cccaggguggagug

SEQ ID NO: 1301654 - RNA, 23 nt, Homo sapiens
cccaggugcagugugacauuauu

SEQ ID NO: 1301655 - RNA, 22 nt, Homo sapiens
cccaggugguuauggagagggu

SEQ ID NO: 1301656 - RNA, 23 nt, Homo sapiens
cccagguuucuggucucuaggcu

SEQ ID NO: 1301657 - RNA, 12 nt, Homo sapiens
cccaguccccau

SEQ ID NO: 1301658 - RNA, 22 nt, Homo sapiens
cccagugcagcucgugauugga

SEQ ID NO: 1301659 - RNA, 22 nt, Homo sapiens
cccagugcccccacugaccaga

SEQ ID NO: 1301660 - RNA, 21 nt, Homo sapiens
cccaguuuuuugaacauggaa

SEQ ID NO: 1301661 - RNA, 13 nt, Homo sapiens
cccauaguucacu

SEQ ID NO: 1301662 - RNA, 14 nt, Homo sapiens
cccauaucugugaa

SEQ ID NO: 1301663 - RNA, 12 nt, Homo sapiens
cccaugagauuc

SEQ ID NO: 1301664 - RNA, 14 nt, Homo sapiens
cccaugcacuguga

SEQ ID NO: 1301665 - RNA, 18 nt, Homo sapiens
cccaugcagacaugagug

SEQ ID NO: 1301666 - RNA, 14 nt, Homo sapiens
cccaugcccagcug

SEQ ID NO: 1301667 - RNA, 11 nt, Homo sapiens
cccauggcucu

SEQ ID NO: 1301668 - RNA, 20 nt, Homo sapiens
cccaugguacuccaugcauu

SEQ ID NO: 1301669 - RNA, 14 nt, Homo sapiens
cccauuccugaaga

SEQ ID NO: 1301670 - RNA, 19 nt, Homo sapiens
cccauucuacucaaaguca

SEQ ID NO: 1301671 - RNA, 15 nt, Homo sapiens
cccauuucacccaug

SEQ ID NO: 1301672 - RNA, 14 nt, Homo sapiens
cccauuuccugcuu

SEQ ID NO: 1301673 - RNA, 18 nt, Homo sapiens
cccauuuguaauuuguaa

SEQ ID NO: 1301674 - RNA, 14 nt, Homo sapiens
ccccaacacgcagg

SEQ ID NO: 1301675 - RNA, 14 nt, Homo sapiens
ccccaauccaugaa

SEQ ID NO: 1301676 - RNA, 17 nt, Homo sapiens
ccccacuggacugaccu

SEQ ID NO: 1301677 - RNA, 22 nt, Homo sapiens
ccccagaaaaaggccgggugac

SEQ ID NO: 1301678 - RNA, 21 nt, Homo sapiens
ccccagcauucucaggcacca

SEQ ID NO: 1301679 - RNA, 20 nt, Homo sapiens
ccccaggcaaggaugucuga

SEQ ID NO: 1301680 - RNA, 23 nt, Homo sapiens
ccccaggucucuccacugcucuc

SEQ ID NO: 1301681 - RNA, 15 nt, Homo sapiens
ccccagugcccacag

SEQ ID NO: 1301682 - RNA, 15 nt, Homo sapiens
ccccaugcacuguga

SEQ ID NO: 1301683 - RNA, 16 nt, Homo sapiens
ccccauucucacugcu

SEQ ID NO: 1301684 - RNA, 12 nt, Homo sapiens
cccccagcacuu

SEQ ID NO: 1301685 - RNA, 17 nt, Homo sapiens
cccccagugcagcucgu

SEQ ID NO: 1301686 - RNA, 13 nt, Homo sapiens
cccccucagugag

SEQ ID NO: 1301687 - RNA, 17 nt, Homo sapiens
cccccuccaggccaguu

SEQ ID NO: 1301688 - RNA, 13 nt, Homo sapiens
ccccggaacaagc

SEQ ID NO: 1301689 - RNA, 14 nt, Homo sapiens
ccccuaaaccaaaa

SEQ ID NO: 1301690 - RNA, 11 nt, Homo sapiens
ccccucaaaaa

SEQ ID NO: 1301691 - RNA, 23 nt, Homo sapiens
ccccucauccgauuccccuguag

SEQ ID NO: 1301692 - RNA, 17 nt, Homo sapiens
ccccucccagaacacac

SEQ ID NO: 1301693 - RNA, 19 nt, Homo sapiens
ccccucggccccagcacau

SEQ ID NO: 1301694 - RNA, 14 nt, Homo sapiens
ccccugcuccagaa

SEQ ID NO: 1301695 - RNA, 15 nt, Homo sapiens
ccccuggcucugggc

SEQ ID NO: 1301696 - RNA, 16 nt, Homo sapiens
ccccugugucauccca

SEQ ID NO: 1301697 - RNA, 15 nt, Homo sapiens
ccccuuagcaauaag

SEQ ID NO: 1301698 - RNA, 20 nt, Homo sapiens
ccccuuguuguaaaaagccc

SEQ ID NO: 1301699 - RNA, 14 nt, Homo sapiens
cccgacuuccugac

SEQ ID NO: 1301700 - RNA, 14 nt, Homo sapiens
cccggcacuuccga

SEQ ID NO: 1301701 - RNA, 16 nt, Homo sapiens
cccggggccagcacuu

SEQ ID NO: 1301702 - RNA, 17 nt, Homo sapiens
cccggggccagcacuuc

SEQ ID NO: 1301703 - RNA, 23 nt, Homo sapiens
cccgucacgugcgcugggcacuu

SEQ ID NO: 1301704 - RNA, 23 nt, Homo sapiens
cccguggccauuacugcauaaaa

SEQ ID NO: 1301705 - RNA, 14 nt, Homo sapiens
cccuaaaccaaaaa

SEQ ID NO: 1301706 - RNA, 21 nt, Homo sapiens
cccuaaaccaaaaacugaaag

SEQ ID NO: 1301707 - RNA, 18 nt, Homo sapiens
cccuaagcagaccacuga

SEQ ID NO: 1301708 - RNA, 13 nt, Homo sapiens
cccuacugcugug

SEQ ID NO: 1301709 - RNA, 17 nt, Homo sapiens
cccucaaaucugaggga

SEQ ID NO: 1301710 - RNA, 18 nt, Homo sapiens
cccucaacaccucugcac

SEQ ID NO: 1301711 - RNA, 23 nt, Homo sapiens
cccucaacaccucugcacaagcu

SEQ ID NO: 1301712 - RNA, 13 nt, Homo sapiens
cccucaccucccu

SEQ ID NO: 1301713 - RNA, 21 nt, Homo sapiens
cucuaugacauugauuggaau

SEQ ID NO: 1301714 - RNA, 21 nt, Homo sapiens
cucuauuucuagagacaacaa

SEQ ID NO: 1301715 - RNA, 21 nt, Homo sapiens
cucucagucucugagcaguga

SEQ ID NO: 1301716 - RNA, 20 nt, Homo sapiens
cucucaguugcagcccugcu

SEQ ID NO: 1301717 - RNA, 11 nt, Homo sapiens
cucucaucucu

SEQ ID NO: 1301718 - RNA, 20 nt, Homo sapiens
cucucccacgggaccugggg

SEQ ID NO: 1301719 - RNA, 18 nt, Homo sapiens
cucuccccagcccagaga

SEQ ID NO: 1301720 - RNA, 17 nt, Homo sapiens
cucucccugacccugua

SEQ ID NO: 1301721 - RNA, 15 nt, Homo sapiens
cucuccgaccagaca

SEQ ID NO: 1301722 - RNA, 21 nt, Homo sapiens
cucucggaacugcaugcugcu

SEQ ID NO: 1301723 - RNA, 14 nt, Homo sapiens
cucucguguuugau

SEQ ID NO: 1301724 - RNA, 12 nt, Homo sapiens
cucucucugucu

SEQ ID NO: 1301725 - RNA, 13 nt, Homo sapiens
cucucugaucucc

SEQ ID NO: 1301726 - RNA, 13 nt, Homo sapiens
cucucugucucuc

SEQ ID NO: 1301727 - RNA, 15 nt, Homo sapiens
cucucugucucucuc

SEQ ID NO: 1301728 - RNA, 19 nt, Homo sapiens
cucucuugucaagucagaa

SEQ ID NO: 1301729 - RNA, 13 nt, Homo sapiens
cucugaaaaccaa

SEQ ID NO: 1301730 - RNA, 15 nt, Homo sapiens
cucugaaaccagugu

SEQ ID NO: 1301731 - RNA, 22 nt, Homo sapiens
cucugaagaguggguuucacaa

SEQ ID NO: 1301732 - RNA, 22 nt, Homo sapiens
cucugagagggaaaggucuguc

SEQ ID NO: 1301733 - RNA, 21 nt, Homo sapiens
cucugagcagugcuugaauga

SEQ ID NO: 1301734 - RNA, 13 nt, Homo sapiens
cucugauauggcu

SEQ ID NO: 1301735 - RNA, 20 nt, Homo sapiens
cucugcaacugcucagcucu

SEQ ID NO: 1301736 - RNA, 13 nt, Homo sapiens
cucugcacaagcu

SEQ ID NO: 1301737 - RNA, 13 nt, Homo sapiens
cucugcaccugua

SEQ ID NO: 1301738 - RNA, 20 nt, Homo sapiens
cucugcagacuucccagcua

SEQ ID NO: 1301739 - RNA, 17 nt, Homo sapiens
cucugccgcuaccuccc

SEQ ID NO: 1301740 - RNA, 14 nt, Homo sapiens
cucugccugaaguc

SEQ ID NO: 1301741 - RNA, 18 nt, Homo sapiens
cucugcucccaacuucgc

SEQ ID NO: 1301742 - RNA, 21 nt, Homo sapiens
cucugcuugagucagguuuga

SEQ ID NO: 1301743 - RNA, 14 nt, Homo sapiens
cucuggaugccuga

SEQ ID NO: 1301744 - RNA, 22 nt, Homo sapiens
cucuggaugccugauugccaag

SEQ ID NO: 1301745 - RNA, 17 nt, Homo sapiens
cucuggcgacaguuuuc

SEQ ID NO: 1301746 - RNA, 15 nt, Homo sapiens
cucugggcuccagag

SEQ ID NO: 1301747 - RNA, 18 nt, Homo sapiens
cucuggguccuuccugaa

SEQ ID NO: 1301748 - RNA, 13 nt, Homo sapiens
cucuguauguacu

SEQ ID NO: 1301749 - RNA, 12 nt, Homo sapiens
cucugucaguca

SEQ ID NO: 1301750 - RNA, 19 nt, Homo sapiens
cucugucucucugucucuc

SEQ ID NO: 1301751 - RNA, 14 nt, Homo sapiens
cucugugaccaaug

SEQ ID NO: 1301752 - RNA, 18 nt, Homo sapiens
cucugugggucucuggaa

SEQ ID NO: 1301753 - RNA, 15 nt, Homo sapiens
cucuuacauguauaa

SEQ ID NO: 1301754 - RNA, 21 nt, Homo sapiens
cucuucccuuucuacccagua

SEQ ID NO: 1301755 - RNA, 16 nt, Homo sapiens
cucuuccuaaguauau

SEQ ID NO: 1301756 - RNA, 19 nt, Homo sapiens
cucuuccucucuuccucca

SEQ ID NO: 1301757 - RNA, 16 nt, Homo sapiens
cucuucggaugaggcc

SEQ ID NO: 1301758 - RNA, 13 nt, Homo sapiens
cucuucucaaagc

SEQ ID NO: 1301759 - RNA, 23 nt, Homo sapiens
cucuucugagcacagauguuccc

SEQ ID NO: 1301760 - RNA, 21 nt, Homo sapiens
cucuucuguuugcacacccag

SEQ ID NO: 1301761 - RNA, 14 nt, Homo sapiens
cucuucuuucccaa

SEQ ID NO: 1301762 - RNA, 22 nt, Homo sapiens
cucuugaaccccaaaugcucuc

SEQ ID NO: 1301763 - RNA, 21 nt, Homo sapiens
cucuugagccugggaggucaa

SEQ ID NO: 1301764 - RNA, 20 nt, Homo sapiens
cucuuggccggauguccuca

SEQ ID NO: 1301765 - RNA, 17 nt, Homo sapiens
cucuuguauaugaugau

SEQ ID NO: 1301766 - RNA, 18 nt, Homo sapiens
cucuuuaaaaugcaaaau

SEQ ID NO: 1301767 - RNA, 15 nt, Homo sapiens
cucuuuaaugucaca

SEQ ID NO: 1301768 - RNA, 17 nt, Homo sapiens
cucuuuucaaaacauuu

SEQ ID NO: 1301769 - RNA, 12 nt, Homo sapiens
cucuuuucacag

SEQ ID NO: 1301770 - RNA, 17 nt, Homo sapiens
cucuuuuucuccagggu

SEQ ID NO: 1301771 - RNA, 19 nt, Homo sapiens
cugaaaaccaauguucucu

SEQ ID NO: 1301772 - RNA, 17 nt, Homo sapiens
cugaaagccacagacaa

SEQ ID NO: 1301773 - RNA, 22 nt, Homo sapiens
cugaaaguaacucauaaucuau

SEQ ID NO: 1301774 - RNA, 12 nt, Homo sapiens
cugaaagugaaa

SEQ ID NO: 1301775 - RNA, 21 nt, Homo sapiens
cugaaagugaaaguccagaaa

SEQ ID NO: 1301776 - RNA, 15 nt, Homo sapiens
cugaaauagaggcua

SEQ ID NO: 1301777 - RNA, 22 nt, Homo sapiens
cugaaaugcaagaccccaagag

SEQ ID NO: 1301778 - RNA, 19 nt, Homo sapiens
cugaacauuaguugcacua

SEQ ID NO: 1301779 - RNA, 13 nt, Homo sapiens
cugaacccacugc

SEQ ID NO: 1301780 - RNA, 18 nt, Homo sapiens
cugaacuuacuugccuca

SEQ ID NO: 1301781 - RNA, 13 nt, Homo sapiens
cugaagaaauugg

SEQ ID NO: 1301782 - RNA, 13 nt, Homo sapiens
cugaagcaaagaa

SEQ ID NO: 1301783 - RNA, 19 nt, Homo sapiens
cugaagcaaagaagggaau

SEQ ID NO: 1301784 - RNA, 21 nt, Homo sapiens
cugaagcucccuguccugaaa

SEQ ID NO: 1301785 - RNA, 17 nt, Homo sapiens
cugaagggcaucaugca

SEQ ID NO: 1301786 - RNA, 20 nt, Homo sapiens
cugaagggcaucaugcaucu

SEQ ID NO: 1301787 - RNA, 13 nt, Homo sapiens
cugaauacauucu

SEQ ID NO: 1301788 - RNA, 23 nt, Homo sapiens
cugaaucuuccuuuguugcacaa

SEQ ID NO: 1301789 - RNA, 15 nt, Homo sapiens
cugaauuaaauaugg

SEQ ID NO: 1301790 - RNA, 13 nt, Homo sapiens
cugaauuucucag

SEQ ID NO: 1301791 - RNA, 21 nt, Homo sapiens
cugacacuaccuuaucaggca

SEQ ID NO: 1301792 - RNA, 16 nt, Homo sapiens
cugacauugccaaaaa

SEQ ID NO: 1301793 - RNA, 17 nt, Homo sapiens
cugaccacagcacagcc

SEQ ID NO: 1301794 - RNA, 21 nt, Homo sapiens
cugaccacuuuggagcacugu

SEQ ID NO: 1301795 - RNA, 19 nt, Homo sapiens
cugaccagcagcgccuuuc

SEQ ID NO: 1301796 - RNA, 22 nt, Homo sapiens
cugaccaguuuaaccugaugca

SEQ ID NO: 1301797 - RNA, 15 nt, Homo sapiens
cugacccaaaugaau

SEQ ID NO: 1301798 - RNA, 13 nt, Homo sapiens
cugacccacugcu

SEQ ID NO: 1301799 - RNA, 23 nt, Homo sapiens
cugacugaacauuaguugcacua

SEQ ID NO: 1301800 - RNA, 20 nt, Homo sapiens
cugagauacauacagaauua

SEQ ID NO: 1301801 - RNA, 20 nt, Homo sapiens
cugagcaaaucaccacaaac

SEQ ID NO: 1301802 - RNA, 17 nt, Homo sapiens
cugagcaacucuugauu

SEQ ID NO: 1301803 - RNA, 22 nt, Homo sapiens
cugagcagugcuugaaugaagu

SEQ ID NO: 1301804 - RNA, 19 nt, Homo sapiens
cugagcugcaucccugcuc

SEQ ID NO: 1301805 - RNA, 22 nt, Homo sapiens
cugaggcaagagaauuacuuga

SEQ ID NO: 1301806 - RNA, 14 nt, Homo sapiens
cugaggcauccacu

SEQ ID NO: 1301807 - RNA, 16 nt, Homo sapiens
cugaggcaugcccagg

SEQ ID NO: 1301808 - RNA, 19 nt, Homo sapiens
cugagguuugccagcauuu

SEQ ID NO: 1301809 - RNA, 14 nt, Homo sapiens
cugagucaccaucu

SEQ ID NO: 1301810 - RNA, 15 nt, Homo sapiens
cugagucugcagaug

SEQ ID NO: 1301811 - RNA, 16 nt, Homo sapiens
cugagugaaauacugu

SEQ ID NO: 1301812 - RNA, 20 nt, Homo sapiens
cugagugccuggccaaaggg

SEQ ID NO: 1301813 - RNA, 13 nt, Homo sapiens
cugaguucuuaga

SEQ ID NO: 1301814 - RNA, 20 nt, Homo sapiens
cugaguuuuccauggcagga

SEQ ID NO: 1301815 - RNA, 13 nt, Homo sapiens
cugauaaugcuca

SEQ ID NO: 1301816 - RNA, 14 nt, Homo sapiens
cugauacuagacua

SEQ ID NO: 1301817 - RNA, 19 nt, Homo sapiens
cugauagaauuauuucaca

SEQ ID NO: 1301818 - RNA, 17 nt, Homo sapiens
cugauagguagcauuuu

SEQ ID NO: 1301819 - RNA, 18 nt, Homo sapiens
cugauauuggacaguaaa

SEQ ID NO: 1301820 - RNA, 16 nt, Homo sapiens
cugaucaggaccucca

SEQ ID NO: 1301821 - RNA, 16 nt, Homo sapiens
cugaucccgugugcca

SEQ ID NO: 1301822 - RNA, 12 nt, Homo sapiens
cugaugcugaca

SEQ ID NO: 1301823 - RNA, 18 nt, Homo sapiens
cugauguccucaccacau

SEQ ID NO: 1301824 - RNA, 21 nt, Homo sapiens
cugauuuugaagagaguugcu

SEQ ID NO: 1301825 - RNA, 20 nt, Homo sapiens
cugcaaagaucuguccucag

SEQ ID NO: 1301826 - RNA, 15 nt, Homo sapiens
cugcacaggcacugu

SEQ ID NO: 1301827 - RNA, 23 nt, Homo sapiens
cugcacuauagccuaggugacag

SEQ ID NO: 1301828 - RNA, 15 nt, Homo sapiens
cugcacugaugcugc

SEQ ID NO: 1301829 - RNA, 22 nt, Homo sapiens
cugcacugaugcugccccucau

SEQ ID NO: 1301830 - RNA, 14 nt, Homo sapiens
cugcacuugcagac

SEQ ID NO: 1301831 - RNA, 21 nt, Homo sapiens
cugcagaagcagaagugcaau

SEQ ID NO: 1301832 - RNA, 19 nt, Homo sapiens
cugcagaaguaagccucau

SEQ ID NO: 1301833 - RNA, 21 nt, Homo sapiens
cugcagcuuuguuuguuguca

SEQ ID NO: 1301834 - RNA, 23 nt, Homo sapiens
cugcagguuggaacuaugcagug

SEQ ID NO: 1301835 - RNA, 21 nt, Homo sapiens
cugcagucaacaguucaaaga

SEQ ID NO: 1301836 - RNA, 20 nt, Homo sapiens
cugcagucaucuugaccaag

SEQ ID NO: 1301837 - RNA, 18 nt, Homo sapiens
cugcagucccaugcacaa

SEQ ID NO: 1301838 - RNA, 16 nt, Homo sapiens
cugcaguuccaaaaga

SEQ ID NO: 1301839 - RNA, 16 nt, Homo sapiens
cugcauguaaacacgc

SEQ ID NO: 1301840 - RNA, 20 nt, Homo sapiens
cugcauugagaacugcauau

SEQ ID NO: 1301841 - RNA, 14 nt, Homo sapiens
cugcauuuguguca

SEQ ID NO: 1301842 - RNA, 14 nt, Homo sapiens
cugccaacauacuu

SEQ ID NO: 1301843 - RNA, 13 nt, Homo sapiens
cugccaaggugaa

SEQ ID NO: 1301844 - RNA, 16 nt, Homo sapiens
cugccacccuggggag

SEQ ID NO: 1301845 - RNA, 20 nt, Homo sapiens
gaaauuauauuuuagccuuu

SEQ ID NO: 1301846 - RNA, 19 nt, Homo sapiens
gaaauugauguuacuguau

SEQ ID NO: 1301847 - RNA, 13 nt, Homo sapiens
gaaauuuugccuu

SEQ ID NO: 1301848 - RNA, 17 nt, Homo sapiens
gaacaaagcagccacga

SEQ ID NO: 1301849 - RNA, 19 nt, Homo sapiens
gaacaauauugacuuuguc

SEQ ID NO: 1301850 - RNA, 23 nt, Homo sapiens
gaacacuaacuaugcauggugcc

SEQ ID NO: 1301851 - RNA, 20 nt, Homo sapiens
gaacacuacucuuacaugua

SEQ ID NO: 1301852 - RNA, 17 nt, Homo sapiens
gaacacuggcagacugu

SEQ ID NO: 1301853 - RNA, 20 nt, Homo sapiens
gaacacuggcagacugugua

SEQ ID NO: 1301854 - RNA, 17 nt, Homo sapiens
gaacagaaauuggguga

SEQ ID NO: 1301855 - RNA, 21 nt, Homo sapiens
gaacagaagaaaauaauauga

SEQ ID NO: 1301856 - RNA, 20 nt, Homo sapiens
gaacagguguuuuuccacaa

SEQ ID NO: 1301857 - RNA, 17 nt, Homo sapiens
gaacauccaaccuuccc

SEQ ID NO: 1301858 - RNA, 18 nt, Homo sapiens
gaacaucccugccagcuc

SEQ ID NO: 1301859 - RNA, 12 nt, Homo sapiens
gaacauccucca

SEQ ID NO: 1301860 - RNA, 17 nt, Homo sapiens
gaacauccuccacugac

SEQ ID NO: 1301861 - RNA, 20 nt, Homo sapiens
gaacaucucugcuuucacuc

SEQ ID NO: 1301862 - RNA, 12 nt, Homo sapiens
gaacaugcaguu

SEQ ID NO: 1301863 - RNA, 16 nt, Homo sapiens
gaacaugcaguuugaa

SEQ ID NO: 1301864 - RNA, 14 nt, Homo sapiens
gaaccaaugcaaga

SEQ ID NO: 1301865 - RNA, 15 nt, Homo sapiens
gaacccagacucaga

SEQ ID NO: 1301866 - RNA, 14 nt, Homo sapiens
gaaccccaggagau

SEQ ID NO: 1301867 - RNA, 23 nt, Homo sapiens
gaaccuaaguggggaaaauccua

SEQ ID NO: 1301868 - RNA, 23 nt, Homo sapiens
gaacgaguuguuggcugcucccu

SEQ ID NO: 1301869 - RNA, 14 nt, Homo sapiens
gaacuaugcagugu

SEQ ID NO: 1301870 - RNA, 12 nt, Homo sapiens
gaacucaaagaa

SEQ ID NO: 1301871 - RNA, 18 nt, Homo sapiens
gaacugacuucaacuggg

SEQ ID NO: 1301872 - RNA, 19 nt, Homo sapiens
gaacuggaggaguuccuug

SEQ ID NO: 1301873 - RNA, 16 nt, Homo sapiens
gaacugucagccucag

SEQ ID NO: 1301874 - RNA, 24 nt, Homo sapiens
gaacuuuaagcaacaagaccacca

SEQ ID NO: 1301875 - RNA, 22 nt, Homo sapiens
gaacuuucuuauccuagcacau

SEQ ID NO: 1301876 - RNA, 23 nt, Homo sapiens
gaacuuugcauagcagcugcuac

SEQ ID NO: 1301877 - RNA, 14 nt, Homo sapiens
gaagaaaacaucua

SEQ ID NO: 1301878 - RNA, 19 nt, Homo sapiens
gaagaacaguaacugccau

SEQ ID NO: 1301879 - RNA, 15 nt, Homo sapiens
gaagaauauucccaa

SEQ ID NO: 1301880 - RNA, 23 nt, Homo sapiens
gaagacaucuuauccauccucac

SEQ ID NO: 1301881 - RNA, 23 nt, Homo sapiens
gaagaccuucguauccccucuca

SEQ ID NO: 1301882 - RNA, 12 nt, Homo sapiens
gaagacuugccc

SEQ ID NO: 1301883 - RNA, 16 nt, Homo sapiens
gaagagaaaucugaua

SEQ ID NO: 1301884 - RNA, 23 nt, Homo sapiens
gaagagaauauuagcuuuacugu

SEQ ID NO: 1301885 - RNA, 17 nt, Homo sapiens
gaagagcuuauuacuua

SEQ ID NO: 1301886 - RNA, 22 nt, Homo sapiens
gaagaggggcauaaacuuuccu

SEQ ID NO: 1301887 - RNA, 21 nt, Homo sapiens
gaagaguggacaaacagggaa

SEQ ID NO: 1301888 - RNA, 19 nt, Homo sapiens
gaagaguggguuucacaag

SEQ ID NO: 1301889 - RNA, 18 nt, Homo sapiens
gaagauauaacuauugcc

SEQ ID NO: 1301890 - RNA, 20 nt, Homo sapiens
gaagauauaacuauugccca

SEQ ID NO: 1301891 - RNA, 14 nt, Homo sapiens
gaagauuucagagg

SEQ ID NO: 1301892 - RNA, 16 nt, Homo sapiens
gaagcagaagugcaau

SEQ ID NO: 1301893 - RNA, 17 nt, Homo sapiens
gaagcauuuacuuugug

SEQ ID NO: 1301894 - RNA, 18 nt, Homo sapiens
gaagccaggaauuuccca

SEQ ID NO: 1301895 - RNA, 20 nt, Homo sapiens
gaagccccuacccugugagc

SEQ ID NO: 1301896 - RNA, 20 nt, Homo sapiens
gaagcuccccucuuccucuc

SEQ ID NO: 1301897 - RNA, 14 nt, Homo sapiens
gaagcucuucuucc

SEQ ID NO: 1301898 - RNA, 16 nt, Homo sapiens
gaagcucuucuuccca

SEQ ID NO: 1301899 - RNA, 12 nt, Homo sapiens
gaaggcaaaauu

SEQ ID NO: 1301900 - RNA, 21 nt, Homo sapiens
gaaggccacuguuugucucac

SEQ ID NO: 1301901 - RNA, 15 nt, Homo sapiens
gaagggaauccuccu

SEQ ID NO: 1301902 - RNA, 18 nt, Homo sapiens
gaagggagcuagccagag

SEQ ID NO: 1301903 - RNA, 9 nt, Homo sapiens
gaaggggag

SEQ ID NO: 1301904 - RNA, 18 nt, Homo sapiens
gaaggggcaccucucuug

SEQ ID NO: 1301905 - RNA, 14 nt, Homo sapiens
gaagguacugucau

SEQ ID NO: 1301906 - RNA, 20 nt, Homo sapiens
gaagguucuacgccagggga

SEQ ID NO: 1301907 - RNA, 22 nt, Homo sapiens
gaagugaguguuucuaugagug

SEQ ID NO: 1301908 - RNA, 22 nt, Homo sapiens
gaaguggagagggugucaucua

SEQ ID NO: 1301909 - RNA, 18 nt, Homo sapiens
gaaguguaagaaacacac

SEQ ID NO: 1301910 - RNA, 15 nt, Homo sapiens
gaaguucuaggaaau

SEQ ID NO: 1301911 - RNA, 21 nt, Homo sapiens
gaaguuuuaaauuuugacaag

SEQ ID NO: 1301912 - RNA, 18 nt, Homo sapiens
gaauacuuacauucucua

SEQ ID NO: 1301913 - RNA, 23 nt, Homo sapiens
gaauagaaauaaaggaugugauu

SEQ ID NO: 1301914 - RNA, 16 nt, Homo sapiens
gaauauaccauuucaa

SEQ ID NO: 1301915 - RNA, 16 nt, Homo sapiens
gaauauucaaauaucu

SEQ ID NO: 1301916 - RNA, 17 nt, Homo sapiens
gaauauucaaauaucua

SEQ ID NO: 1301917 - RNA, 20 nt, Homo sapiens
gaaucagauuuuaacagcuc

SEQ ID NO: 1301918 - RNA, 20 nt, Homo sapiens
gaaucaggaauauuuuccaa

SEQ ID NO: 1301919 - RNA, 14 nt, Homo sapiens
gaaucaguuuccaa

SEQ ID NO: 1301920 - RNA, 16 nt, Homo sapiens
gaaucccuuucucacu

SEQ ID NO: 1301921 - RNA, 18 nt, Homo sapiens
gaaucccuuucucacuuu

SEQ ID NO: 1301922 - RNA, 17 nt, Homo sapiens
gaauccuccuccagggu

SEQ ID NO: 1301923 - RNA, 15 nt, Homo sapiens
gaaucucugugccuu

SEQ ID NO: 1301924 - RNA, 19 nt, Homo sapiens
gaaucuuaagguguagcca

SEQ ID NO: 1301925 - RNA, 13 nt, Homo sapiens
gaaugaaccacug

SEQ ID NO: 1301926 - RNA, 22 nt, Homo sapiens
gaaugaagaacaacaacucuca

SEQ ID NO: 1301927 - RNA, 16 nt, Homo sapiens
gaaugaagguaauauu

SEQ ID NO: 1301928 - RNA, 16 nt, Homo sapiens
gaaugaugcucaaaau

SEQ ID NO: 1301929 - RNA, 14 nt, Homo sapiens
gaaugauucagugu

SEQ ID NO: 1301930 - RNA, 15 nt, Homo sapiens
gaaugccacugccuu

SEQ ID NO: 1301931 - RNA, 13 nt, Homo sapiens
gaauggaauucua

SEQ ID NO: 1301932 - RNA, 16 nt, Homo sapiens
gaaugggcagcucauc

SEQ ID NO: 1301933 - RNA, 22 nt, Homo sapiens
gaauguagcucaacuugugaua

SEQ ID NO: 1301934 - RNA, 12 nt, Homo sapiens
gaauuaagcaaa

SEQ ID NO: 1301935 - RNA, 19 nt, Homo sapiens
gaauuccaaagcaaaacca

SEQ ID NO: 1301936 - RNA, 13 nt, Homo sapiens
gaauuccuaacuu

SEQ ID NO: 1301937 - RNA, 20 nt, Homo sapiens
gaauucuugaaaaacuuaca

SEQ ID NO: 1301938 - RNA, 14 nt, Homo sapiens
gaauugguugccau

SEQ ID NO: 1301939 - RNA, 16 nt, Homo sapiens
gaauuuaaacaaugca

SEQ ID NO: 1301940 - RNA, 19 nt, Homo sapiens
gaauuuauugcacauuguu

SEQ ID NO: 1301941 - RNA, 10 nt, Homo sapiens
gaauuucaca

SEQ ID NO: 1301942 - RNA, 14 nt, Homo sapiens
gaauuucacaagcu

SEQ ID NO: 1301943 - RNA, 18 nt, Homo sapiens
gaauuucacaagcuauuu

SEQ ID NO: 1301944 - RNA, 20 nt, Homo sapiens
gaauuucugugcccuccuga

SEQ ID NO: 1301945 - RNA, 14 nt, Homo sapiens
gacaaaucaaagca

SEQ ID NO: 1301946 - RNA, 18 nt, Homo sapiens
gacaacagccguccuccc

SEQ ID NO: 1301947 - RNA, 22 nt, Homo sapiens
gacaagaauuguuaccugucau

SEQ ID NO: 1301948 - RNA, 20 nt, Homo sapiens
gacaagacccccagcacuug

SEQ ID NO: 1301949 - RNA, 15 nt, Homo sapiens
gacaagccagaacuu

SEQ ID NO: 1301950 - RNA, 21 nt, Homo sapiens
gacaaggagugugaccacuga

SEQ ID NO: 1301951 - RNA, 18 nt, Homo sapiens
gacaaguggacucagggc

SEQ ID NO: 1301952 - RNA, 18 nt, Homo sapiens
gacaaucacugccaaccc

SEQ ID NO: 1301953 - RNA, 19 nt, Homo sapiens
gacaaucaugaaauaugca

SEQ ID NO: 1301954 - RNA, 13 nt, Homo sapiens
gacacaaaccugc

SEQ ID NO: 1301955 - RNA, 17 nt, Homo sapiens
gacacaggccugcucuc

SEQ ID NO: 1301956 - RNA, 14 nt, Homo sapiens
gacacccugacccc

SEQ ID NO: 1301957 - RNA, 17 nt, Homo sapiens
gacaccuggacaauauu

SEQ ID NO: 1301958 - RNA, 20 nt, Homo sapiens
gacaccugggagaaaucugg

SEQ ID NO: 1301959 - RNA, 20 nt, Homo sapiens
gacacuauuuaucugugcaa

SEQ ID NO: 1301960 - RNA, 19 nt, Homo sapiens
gacacuccccgaagucuuu

SEQ ID NO: 1301961 - RNA, 14 nt, Homo sapiens
gacagaaagagaca

SEQ ID NO: 1301962 - RNA, 22 nt, Homo sapiens
gacagaaagcaguucugaugcu

SEQ ID NO: 1301963 - RNA, 17 nt, Homo sapiens
gacagagaccuccugcc

SEQ ID NO: 1301964 - RNA, 17 nt, Homo sapiens
gacagagagaggcauuu

SEQ ID NO: 1301965 - RNA, 22 nt, Homo sapiens
gacagagggcucaccucuugcc

SEQ ID NO: 1301966 - RNA, 14 nt, Homo sapiens
gacagagucucacu

SEQ ID NO: 1301967 - RNA, 23 nt, Homo sapiens
gacagaugaggcuuuccauggga

SEQ ID NO: 1301968 - RNA, 19 nt, Homo sapiens
gacagaugccacacaagga

SEQ ID NO: 1301969 - RNA, 22 nt, Homo sapiens
gacagccacggccaggccagag

SEQ ID NO: 1301970 - RNA, 19 nt, Homo sapiens
gacagccugggcacccgcg

SEQ ID NO: 1301971 - RNA, 15 nt, Homo sapiens
gacagcuuugcugcu

SEQ ID NO: 1301972 - RNA, 13 nt, Homo sapiens
gacaggauguguu

SEQ ID NO: 1301973 - RNA, 16 nt, Homo sapiens
gacaguauuauuaaua

SEQ ID NO: 1301974 - RNA, 16 nt, Homo sapiens
gacagugcugcagcuc

SEQ ID NO: 1301975 - RNA, 19 nt, Homo sapiens
gacagugugggacaggcuc

SEQ ID NO: 1301976 - RNA, 21 nt, Homo sapiens
gacauaaugggguccuggcca

SEQ ID NO: 1301977 - RNA, 21 nt, Homo sapiens
uacauacacuguauguuauag

SEQ ID NO: 1301978 - RNA, 13 nt, Homo sapiens
uacauacugcugu

SEQ ID NO: 1301979 - RNA, 13 nt, Homo sapiens
uacaucaaagagu

SEQ ID NO: 1301980 - RNA, 17 nt, Homo sapiens
uacaucccgggccucag

SEQ ID NO: 1301981 - RNA, 18 nt, Homo sapiens
uacauccugcagcuuauu

SEQ ID NO: 1301982 - RNA, 11 nt, Homo sapiens
uacaucuggcc

SEQ ID NO: 1301983 - RNA, 11 nt, Homo sapiens
uacauucugua

SEQ ID NO: 1301984 - RNA, 16 nt, Homo sapiens
uacauuuccaaauuca

SEQ ID NO: 1301985 - RNA, 19 nt, Homo sapiens
uacauuuccaaauucacaa

SEQ ID NO: 1301986 - RNA, 18 nt, Homo sapiens
uaccacaugccaagcacu

SEQ ID NO: 1301987 - RNA, 20 nt, Homo sapiens
uaccaggcacgucugcagaa

SEQ ID NO: 1301988 - RNA, 16 nt, Homo sapiens
uaccaguugguauuuc

SEQ ID NO: 1301989 - RNA, 18 nt, Homo sapiens
uaccaugcaggauuugaa

SEQ ID NO: 1301990 - RNA, 21 nt, Homo sapiens
uaccauuucuugagguaaaag

SEQ ID NO: 1301991 - RNA, 14 nt, Homo sapiens
uacccacugccaug

SEQ ID NO: 1301992 - RNA, 14 nt, Homo sapiens
uaccccagguacau

SEQ ID NO: 1301993 - RNA, 15 nt, Homo sapiens
uacccuuucauucag

SEQ ID NO: 1301994 - RNA, 17 nt, Homo sapiens
uaccgaugcagcucucu

SEQ ID NO: 1301995 - RNA, 13 nt, Homo sapiens
uaccgcuuaucag

SEQ ID NO: 1301996 - RNA, 14 nt, Homo sapiens
uaccuauaugcagu

SEQ ID NO: 1301997 - RNA, 21 nt, Homo sapiens
uaccuauaugcagucucuuua

SEQ ID NO: 1301998 - RNA, 20 nt, Homo sapiens
uaccucaaccaaugccaaaa

SEQ ID NO: 1301999 - RNA, 14 nt, Homo sapiens
uaccuccugagaaa

SEQ ID NO: 1302000 - RNA, 21 nt, Homo sapiens
uaccugucauuuugcacugua

SEQ ID NO: 1302001 - RNA, 22 nt, Homo sapiens
uaccugucauuuugcacuguaa

SEQ ID NO: 1302002 - RNA, 18 nt, Homo sapiens
uaccuguuuccuacagac

SEQ ID NO: 1302003 - RNA, 23 nt, Homo sapiens
uaccuguuuuguggucagcugua

SEQ ID NO: 1302004 - RNA, 19 nt, Homo sapiens
uaccuugcuuuugcuucua

SEQ ID NO: 1302005 - RNA, 18 nt, Homo sapiens
uaccuuuugcuguggcaa

SEQ ID NO: 1302006 - RNA, 20 nt, Homo sapiens
uacuaagugaugcugugaua

SEQ ID NO: 1302007 - RNA, 19 nt, Homo sapiens
uacuacaaacuucaaagag

SEQ ID NO: 1302008 - RNA, 15 nt, Homo sapiens
uacuagaaguuuuac

SEQ ID NO: 1302009 - RNA, 17 nt, Homo sapiens
uacuauaaaagcuuucu

SEQ ID NO: 1302010 - RNA, 23 nt, Homo sapiens
uacucagauaagguaaaaugcca

SEQ ID NO: 1302011 - RNA, 13 nt, Homo sapiens
uacucagcauuug

SEQ ID NO: 1302012 - RNA, 14 nt, Homo sapiens
uacuccacacauaa

SEQ ID NO: 1302013 - RNA, 21 nt, Homo sapiens
uacuccucacacuuacuguaa

SEQ ID NO: 1302014 - RNA, 20 nt, Homo sapiens
uacucuaggcagugacagug

SEQ ID NO: 1302015 - RNA, 20 nt, Homo sapiens
uacucuaucagagaaaaaca

SEQ ID NO: 1302016 - RNA, 16 nt, Homo sapiens
uacucuuccaucuuuc

SEQ ID NO: 1302017 - RNA, 12 nt, Homo sapiens
uacugacugaga

SEQ ID NO: 1302018 - RNA, 21 nt, Homo sapiens
uacugcaagguucaacuuauu

SEQ ID NO: 1302019 - RNA, 19 nt, Homo sapiens
uacugcuaucuacuacaaa

SEQ ID NO: 1302020 - RNA, 14 nt, Homo sapiens
uacuggcaauuugu

SEQ ID NO: 1302021 - RNA, 13 nt, Homo sapiens
uacuguagccuca

SEQ ID NO: 1302022 - RNA, 14 nt, Homo sapiens
uacuguaugcagua

SEQ ID NO: 1302023 - RNA, 17 nt, Homo sapiens
uacugucucuuucauga

SEQ ID NO: 1302024 - RNA, 15 nt, Homo sapiens
uacuuaguucauggc

SEQ ID NO: 1302025 - RNA, 14 nt, Homo sapiens
uacuucugagcaaa

SEQ ID NO: 1302026 - RNA, 20 nt, Homo sapiens
uacuuggucuggccacuguc

SEQ ID NO: 1302027 - RNA, 23 nt, Homo sapiens
uacuuuuccgaagcagaauguca

SEQ ID NO: 1302028 - RNA, 14 nt, Homo sapiens
uacuuuuuacauac

SEQ ID NO: 1302029 - RNA, 15 nt, Homo sapiens
uagaaaagcacuuga

SEQ ID NO: 1302030 - RNA, 19 nt, Homo sapiens
uagaaacauugaagaugaa

SEQ ID NO: 1302031 - RNA, 20 nt, Homo sapiens
uagaaacuaagagaaugaua

SEQ ID NO: 1302032 - RNA, 18 nt, Homo sapiens
uagaaagguuuugagcau

SEQ ID NO: 1302033 - RNA, 22 nt, Homo sapiens
uagaaauuauauuuuagccuuu

SEQ ID NO: 1302034 - RNA, 21 nt, Homo sapiens
uagaagccacuauuacuggga

SEQ ID NO: 1302035 - RNA, 16 nt, Homo sapiens
uagaagugccaucuca

SEQ ID NO: 1302036 - RNA, 21 nt, Homo sapiens
uagaauagccuguggccuuug

SEQ ID NO: 1302037 - RNA, 16 nt, Homo sapiens
uagacagagucucacu

SEQ ID NO: 1302038 - RNA, 19 nt, Homo sapiens
uagacaucuucagauuuaa

SEQ ID NO: 1302039 - RNA, 19 nt, Homo sapiens
uagagaaguuacacagaaa

SEQ ID NO: 1302040 - RNA, 20 nt, Homo sapiens
uagagcaggcguucagcuca

SEQ ID NO: 1302041 - RNA, 18 nt, Homo sapiens
uagagggcuccucucaga

SEQ ID NO: 1302042 - RNA, 18 nt, Homo sapiens
uagagugugguuaugaac

SEQ ID NO: 1302043 - RNA, 22 nt, Homo sapiens
uagauaaaacacgccacagccu

SEQ ID NO: 1302044 - RNA, 21 nt, Homo sapiens
uagauacacuaaaaaucugag

SEQ ID NO: 1302045 - RNA, 13 nt, Homo sapiens
uagauaccaaaug

SEQ ID NO: 1302046 - RNA, 23 nt, Homo sapiens
uagauauuuuccauauauuggca

SEQ ID NO: 1302047 - RNA, 16 nt, Homo sapiens
uagauuaaagcuuauu

SEQ ID NO: 1302048 - RNA, 15 nt, Homo sapiens
uagauucacauacag

SEQ ID NO: 1302049 - RNA, 11 nt, Homo sapiens
uagauugugag

SEQ ID NO: 1302050 - RNA, 22 nt, Homo sapiens
uagcaaaaaaaacccauguggu

SEQ ID NO: 1302051 - RNA, 21 nt, Homo sapiens
uagcaaaacuaaauacuugcu

SEQ ID NO: 1302052 - RNA, 14 nt, Homo sapiens
uagcaauauaucag

SEQ ID NO: 1302053 - RNA, 23 nt, Homo sapiens
uagcaauuggcagcccuauuuca

SEQ ID NO: 1302054 - RNA, 22 nt, Homo sapiens
uagcagaaaggaaaagauuccu

SEQ ID NO: 1302055 - RNA, 16 nt, Homo sapiens
uagcagaugguuucca

SEQ ID NO: 1302056 - RNA, 13 nt, Homo sapiens
uagcagcugcuac

SEQ ID NO: 1302057 - RNA, 22 nt, Homo sapiens
uagcagggggggaaaugcauuu

SEQ ID NO: 1302058 - RNA, 23 nt, Homo sapiens
uagcagggggggaaaugcauuua

SEQ ID NO: 1302059 - RNA, 13 nt, Homo sapiens
uagcauacgguau

SEQ ID NO: 1302060 - RNA, 20 nt, Homo sapiens
uagccaaacaacaacaaaaa

SEQ ID NO: 1302061 - RNA, 15 nt, Homo sapiens
uagccaaguguggua

SEQ ID NO: 1302062 - RNA, 15 nt, Homo sapiens
uagccacaagccuga

SEQ ID NO: 1302063 - RNA, 22 nt, Homo sapiens
uagccacugcauaccaaccugg

SEQ ID NO: 1302064 - RNA, 15 nt, Homo sapiens
uagccagaaucucau

SEQ ID NO: 1302065 - RNA, 20 nt, Homo sapiens
uagccauuuuucaaagcaau

SEQ ID NO: 1302066 - RNA, 14 nt, Homo sapiens
uagcccauguuaag

SEQ ID NO: 1302067 - RNA, 23 nt, Homo sapiens
uagccgacaacagagacuggacu

SEQ ID NO: 1302068 - RNA, 22 nt, Homo sapiens
uagccugcagaaguaagccuca

SEQ ID NO: 1302069 - RNA, 16 nt, Homo sapiens
uagccugggguggggu

SEQ ID NO: 1302070 - RNA, 21 nt, Homo sapiens
uagccuguggccuuugcaauu

SEQ ID NO: 1302071 - RNA, 23 nt, Homo sapiens
uagccuuuauuuuuaaccugcca

SEQ ID NO: 1302072 - RNA, 17 nt, Homo sapiens
uagcuaugagcuuuuaa

SEQ ID NO: 1302073 - RNA, 20 nt, Homo sapiens
uagcucuaggguauauaucc

SEQ ID NO: 1302074 - RNA, 19 nt, Homo sapiens
uagcugccuaucagaauuu

SEQ ID NO: 1302075 - RNA, 11 nt, Homo sapiens
uagcugcuacc

SEQ ID NO: 1302076 - RNA, 14 nt, Homo sapiens
uagcuguauucaua

SEQ ID NO: 1302077 - RNA, 16 nt, Homo sapiens
uaggaacgguaaauuu

SEQ ID NO: 1302078 - RNA, 16 nt, Homo sapiens
uaggacccaagcagag

SEQ ID NO: 1302079 - RNA, 18 nt, Homo sapiens
uaggagaagggucucaug

SEQ ID NO: 1302080 - RNA, 16 nt, Homo sapiens
uaggagaccauuugau

SEQ ID NO: 1302081 - RNA, 22 nt, Homo sapiens
uaggaggaaaaagaaaugcauu

SEQ ID NO: 1302082 - RNA, 20 nt, Homo sapiens
uaggaggggaacuagguuac

SEQ ID NO: 1302083 - RNA, 14 nt, Homo sapiens
uaggauaagcacua

SEQ ID NO: 1302084 - RNA, 16 nt, Homo sapiens
uaggcauuaacacaaa

SEQ ID NO: 1302085 - RNA, 20 nt, Homo sapiens
uaggcgcuggggcucagcuu

SEQ ID NO: 1302086 - RNA, 17 nt, Homo sapiens
uagggaaaaaaaacagg

SEQ ID NO: 1302087 - RNA, 14 nt, Homo sapiens
uagggaucccucau

SEQ ID NO: 1302088 - RNA, 22 nt, Homo sapiens
uagggccaccccacagcucuuu

SEQ ID NO: 1302089 - RNA, 15 nt, Homo sapiens
uaggguccaccagga

SEQ ID NO: 1302090 - RNA, 22 nt, Homo sapiens
uaggguuacagagaccuaugua

SEQ ID NO: 1302091 - RNA, 15 nt, Homo sapiens
uagguugagcaauuu

SEQ ID NO: 1302092 - RNA, 19 nt, Homo sapiens
uaguaaaggggcccagaaa

SEQ ID NO: 1302093 - RNA, 16 nt, Homo sapiens
uaguaagagauuccug

SEQ ID NO: 1302094 - RNA, 23 nt, Homo sapiens
uaguaauuuuaguuauacuccuc

SEQ ID NO: 1302095 - RNA, 17 nt, Homo sapiens
uaguaguguaagcuaga

SEQ ID NO: 1302096 - RNA, 14 nt, Homo sapiens
uaguauaaacucau

SEQ ID NO: 1302097 - RNA, 19 nt, Homo sapiens
uagucagaauuagcugcuu

SEQ ID NO: 1302098 - RNA, 20 nt, Homo sapiens
uagucauugcagaguucuua

SEQ ID NO: 1302099 - RNA, 14 nt, Homo sapiens
uaguccaauuccuu

SEQ ID NO: 1302100 - RNA, 22 nt, Homo sapiens
uaguccgugcugacagcugcuc

SEQ ID NO: 1302101 - RNA, 15 nt, Homo sapiens
uagucucagcacuau

SEQ ID NO: 1302102 - RNA, 15 nt, Homo sapiens
uagucucauucuguc

SEQ ID NO: 1302103 - RNA, 15 nt, Homo sapiens
uagugaagcucucac

SEQ ID NO: 1302104 - RNA, 21 nt, Homo sapiens
uaguggggagacuucuuggcu

SEQ ID NO: 1302105 - RNA, 21 nt, Homo sapiens
uaguguccuuuucucauuugu

SEQ ID NO: 1302106 - RNA, 14 nt, Homo sapiens
uaguuauacuccuc

SEQ ID NO: 1302107 - RNA, 18 nt, Homo sapiens
uaguugccaauaugccag

SEQ ID NO: 1302108 - RNA, 19 nt, Homo sapiens
uaguuugacucaguauagg

SEQ ID NO: 1302109 - RNA, 20 nt, Homo sapiens
uccccuccguggcaucaccu

SEQ ID NO: 1302110 - RNA, 16 nt, Homo sapiens
uccccugaccugugag

SEQ ID NO: 1302111 - RNA, 21 nt, Homo sapiens
uccccuggggagucugggcac

SEQ ID NO: 1302112 - RNA, 22 nt, Homo sapiens
uccccuggggagucugggcaca

SEQ ID NO: 1302113 - RNA, 16 nt, Homo sapiens
uccccuucaguaccac

SEQ ID NO: 1302114 - RNA, 15 nt, Homo sapiens
uccccuuccacugag

SEQ ID NO: 1302115 - RNA, 23 nt, Homo sapiens
uccccuucccacuagccuagguc

SEQ ID NO: 1302116 - RNA, 14 nt, Homo sapiens
uccccuucucucau

SEQ ID NO: 1302117 - RNA, 20 nt, Homo sapiens
ucccgaguagcugggauuac

SEQ ID NO: 1302118 - RNA, 18 nt, Homo sapiens
ucccggggccagcacuuc

SEQ ID NO: 1302119 - RNA, 14 nt, Homo sapiens
ucccuaaaaacaca

SEQ ID NO: 1302120 - RNA, 12 nt, Homo sapiens
ucccuaccuccu

SEQ ID NO: 1302121 - RNA, 16 nt, Homo sapiens
ucccucacagcacuag

SEQ ID NO: 1302122 - RNA, 23 nt, Homo sapiens
ucccucacagcacuaguauuuca

SEQ ID NO: 1302123 - RNA, 18 nt, Homo sapiens
ucccucccaggacucuga

SEQ ID NO: 1302124 - RNA, 17 nt, Homo sapiens
ucccucccccccaugca

SEQ ID NO: 1302125 - RNA, 19 nt, Homo sapiens
ucccucuaauuuaucuugu

SEQ ID NO: 1302126 - RNA, 20 nt, Homo sapiens
ucccucucccggcaacaucu

SEQ ID NO: 1302127 - RNA, 12 nt, Homo sapiens
ucccugacagca

SEQ ID NO: 1302128 - RNA, 15 nt, Homo sapiens
ucccugacuguaaau

SEQ ID NO: 1302129 - RNA, 16 nt, Homo sapiens
ucccugacuguaaaug

SEQ ID NO: 1302130 - RNA, 19 nt, Homo sapiens
ucccuggggaaaacuugca

SEQ ID NO: 1302131 - RNA, 22 nt, Homo sapiens
ucccugggguggggauagggag

SEQ ID NO: 1302132 - RNA, 16 nt, Homo sapiens
ucccugguucugauga

SEQ ID NO: 1302133 - RNA, 15 nt, Homo sapiens
ucccuuacuguuuca

SEQ ID NO: 1302134 - RNA, 17 nt, Homo sapiens
ucccuugaggaaacaac

SEQ ID NO: 1302135 - RNA, 20 nt, Homo sapiens
ucccuugaggaaacaacagc

SEQ ID NO: 1302136 - RNA, 16 nt, Homo sapiens
ucccuugcuguaugcu

SEQ ID NO: 1302137 - RNA, 20 nt, Homo sapiens
ucccuugcuguaugcugauc

SEQ ID NO: 1302138 - RNA, 18 nt, Homo sapiens
ucccuuuggagaugcuga

SEQ ID NO: 1302139 - RNA, 17 nt, Homo sapiens
ucccuuuuuauauccca

SEQ ID NO: 1302140 - RNA, 19 nt, Homo sapiens
uccgagaggugggccaguc

SEQ ID NO: 1302141 - RNA, 13 nt, Homo sapiens
uccgaggccagua

SEQ ID NO: 1302142 - RNA, 14 nt, Homo sapiens
uccgcccugccacu

SEQ ID NO: 1302143 - RNA, 19 nt, Homo sapiens
uccggccacacauccugcu

SEQ ID NO: 1302144 - RNA, 19 nt, Homo sapiens
uccgugaacuugugagaac

SEQ ID NO: 1302145 - RNA, 14 nt, Homo sapiens
uccgugaaggugac

SEQ ID NO: 1302146 - RNA, 14 nt, Homo sapiens
uccgugcuaugaca

SEQ ID NO: 1302147 - RNA, 20 nt, Homo sapiens
uccuaaagcaugggaucuca

SEQ ID NO: 1302148 - RNA, 12 nt, Homo sapiens
uccuacaaagaa

SEQ ID NO: 1302149 - RNA, 19 nt, Homo sapiens
uccuacgauacgcuacuau

SEQ ID NO: 1302150 - RNA, 15 nt, Homo sapiens
uccuagggccacuga

SEQ ID NO: 1302151 - RNA, 16 nt, Homo sapiens
uccuaugcuauugaca

SEQ ID NO: 1302152 - RNA, 12 nt, Homo sapiens
uccuauguguaa

SEQ ID NO: 1302153 - RNA, 14 nt, Homo sapiens
uccucaaacacugc

SEQ ID NO: 1302154 - RNA, 22 nt, Homo sapiens
uccucacccugccggguagcug

SEQ ID NO: 1302155 - RNA, 16 nt, Homo sapiens
uccucacucaccuuca

SEQ ID NO: 1302156 - RNA, 17 nt, Homo sapiens
uccucagaaaccaaagc

SEQ ID NO: 1302157 - RNA, 15 nt, Homo sapiens
uccucagcuuaucuc

SEQ ID NO: 1302158 - RNA, 20 nt, Homo sapiens
uccucaguaugugggggcuu

SEQ ID NO: 1302159 - RNA, 14 nt, Homo sapiens
uccuccaugggaga

SEQ ID NO: 1302160 - RNA, 15 nt, Homo sapiens
uccucccuucugcua

SEQ ID NO: 1302161 - RNA, 14 nt, Homo sapiens
uccucccuugggaa

SEQ ID NO: 1302162 - RNA, 17 nt, Homo sapiens
uccuccguccauaucag

SEQ ID NO: 1302163 - RNA, 10 nt, Homo sapiens
uccuccucag

SEQ ID NO: 1302164 - RNA, 23 nt, Homo sapiens
uccuccuguucugaaaccuuagu

SEQ ID NO: 1302165 - RNA, 18 nt, Homo sapiens
uccucuaugaacuaugga

SEQ ID NO: 1302166 - RNA, 22 nt, Homo sapiens
uccucucagaugggcagcagcu

SEQ ID NO: 1302167 - RNA, 21 nt, Homo sapiens
uccucugaaacagcugccuua

SEQ ID NO: 1302168 - RNA, 15 nt, Homo sapiens
uccucugcauuuaca

SEQ ID NO: 1302169 - RNA, 16 nt, Homo sapiens
uccucugugaccaaug

SEQ ID NO: 1302170 - RNA, 19 nt, Homo sapiens
uccucugugaccaaugucu

SEQ ID NO: 1302171 - RNA, 16 nt, Homo sapiens
uccugaaacaacuugg

SEQ ID NO: 1302172 - RNA, 19 nt, Homo sapiens
uccugaaagccacagacaa

SEQ ID NO: 1302173 - RNA, 19 nt, Homo sapiens
uccugacuuuuaaugucau

SEQ ID NO: 1302174 - RNA, 18 nt, Homo sapiens
uccugagagcugcuuuga

SEQ ID NO: 1302175 - RNA, 23 nt, Homo sapiens
uccugagggagcuccaacucaga

SEQ ID NO: 1302176 - RNA, 20 nt, Homo sapiens
uccugccaccagcauccaca

SEQ ID NO: 1302177 - RNA, 19 nt, Homo sapiens
uccugcccagcacaggaau

SEQ ID NO: 1302178 - RNA, 23 nt, Homo sapiens
uccugcucucuggaggacgguca

SEQ ID NO: 1302179 - RNA, 19 nt, Homo sapiens
uccuggacuuuuccucuca

SEQ ID NO: 1302180 - RNA, 21 nt, Homo sapiens
uccuggagcaaucacagauga

SEQ ID NO: 1302181 - RNA, 20 nt, Homo sapiens
uccuggaggucagcauuuga

SEQ ID NO: 1302182 - RNA, 16 nt, Homo sapiens
uccuggcccaggugag

SEQ ID NO: 1302183 - RNA, 21 nt, Homo sapiens
uccugggcagcauacugagac

SEQ ID NO: 1302184 - RNA, 12 nt, Homo sapiens
uccuggugaugu

SEQ ID NO: 1302185 - RNA, 22 nt, Homo sapiens
uccuguaagucaaaugugugcu

SEQ ID NO: 1302186 - RNA, 17 nt, Homo sapiens
uccuguauuuaacaaaa

SEQ ID NO: 1302187 - RNA, 20 nt, Homo sapiens
uccuguauuuaacaaaaagu

SEQ ID NO: 1302188 - RNA, 23 nt, Homo sapiens
uccugugagcucaacuaaguuca

SEQ ID NO: 1302189 - RNA, 16 nt, Homo sapiens
uccugugauacauuuc

SEQ ID NO: 1302190 - RNA, 11 nt, Homo sapiens
uccugugcaac

SEQ ID NO: 1302191 - RNA, 15 nt, Homo sapiens
uccuguggucucuga

SEQ ID NO: 1302192 - RNA, 18 nt, Homo sapiens
uccuguggucucugacca

SEQ ID NO: 1302193 - RNA, 20 nt, Homo sapiens
uccuguggucucugaccagg

SEQ ID NO: 1302194 - RNA, 15 nt, Homo sapiens
uccuuaucacugaca

SEQ ID NO: 1302195 - RNA, 21 nt, Homo sapiens
uccuucaauaaccaugaugac

SEQ ID NO: 1302196 - RNA, 14 nt, Homo sapiens
uccuucaauuccau

SEQ ID NO: 1302197 - RNA, 18 nt, Homo sapiens
uccuucaugaucaucaca

SEQ ID NO: 1302198 - RNA, 14 nt, Homo sapiens
uccuuccuuaucac

SEQ ID NO: 1302199 - RNA, 20 nt, Homo sapiens
uccuuccuuaucacugacac

SEQ ID NO: 1302200 - RNA, 19 nt, Homo sapiens
uccuucgaaaggccuucag

SEQ ID NO: 1302201 - RNA, 16 nt, Homo sapiens
uccuugcacauaguag

SEQ ID NO: 1302202 - RNA, 21 nt, Homo sapiens
uccuugcaggcagaaggcagu

SEQ ID NO: 1302203 - RNA, 20 nt, Homo sapiens
uccuugccuaaggugucuga

SEQ ID NO: 1302204 - RNA, 23 nt, Homo sapiens
uccuuuaaaaaacuuagugacaa

SEQ ID NO: 1302205 - RNA, 19 nt, Homo sapiens
uccuuuccuccucugacuu

SEQ ID NO: 1302206 - RNA, 23 nt, Homo sapiens
uccuuuucccaacuccucauguc

SEQ ID NO: 1302207 - RNA, 20 nt, Homo sapiens
ucgaaagcuguuaaauucuc

SEQ ID NO: 1302208 - RNA, 13 nt, Homo sapiens
ucgaccaaaagga

SEQ ID NO: 1302209 - RNA, 15 nt, Homo sapiens
ucgaccuacugaaaa

SEQ ID NO: 1302210 - RNA, 22 nt, Homo sapiens
ucgacuugaucgugcagcugcu

SEQ ID NO: 1302211 - RNA, 22 nt, Homo sapiens
ucgagagcuggccaaagagccu

SEQ ID NO: 1302212 - RNA, 19 nt, Homo sapiens
ucgagaucaucacuuccuu

SEQ ID NO: 1302213 - RNA, 16 nt, Homo sapiens
ucgauucaaacugcuc

SEQ ID NO: 1302214 - RNA, 19 nt, Homo sapiens
ucgcaaugagggagcaugu

SEQ ID NO: 1302215 - RNA, 19 nt, Homo sapiens
ucgcaucucagugcaggag

SEQ ID NO: 1302216 - RNA, 22 nt, Homo sapiens
ucgcuccugugucuugcaaugg

SEQ ID NO: 1302217 - RNA, 22 nt, Homo sapiens
ucggaggccauccugccagggg

SEQ ID NO: 1302218 - RNA, 15 nt, Homo sapiens
ucggcugaccaugcu

SEQ ID NO: 1302219 - RNA, 19 nt, Homo sapiens
ucgggaagaaggggacaau

SEQ ID NO: 1302220 - RNA, 23 nt, Homo sapiens
ucgggcuaggaagaucucugcag

SEQ ID NO: 1302221 - RNA, 15 nt, Homo sapiens
ucgugacaacacuug

SEQ ID NO: 1302222 - RNA, 16 nt, Homo sapiens
ucgugagcucuuguga

SEQ ID NO: 1302223 - RNA, 21 nt, Homo sapiens
ucuaaacagacucauuacaaa

SEQ ID NO: 1302224 - RNA, 17 nt, Homo sapiens
ucuaaauaccauucccu

SEQ ID NO: 1302225 - RNA, 16 nt, Homo sapiens
ucuaaaucaccagaga

SEQ ID NO: 1302226 - RNA, 14 nt, Homo sapiens
ucuaacacaguuga

SEQ ID NO: 1302227 - RNA, 13 nt, Homo sapiens
ucuaacagcucag

SEQ ID NO: 1302228 - RNA, 18 nt, Homo sapiens
ucuaacucagaaacauca

SEQ ID NO: 1302229 - RNA, 15 nt, Homo sapiens
ucuaagaaagaaauu

SEQ ID NO: 1302230 - RNA, 19 nt, Homo sapiens
ucuacagagcuucccugac

SEQ ID NO: 1302231 - RNA, 14 nt, Homo sapiens
ucuacagaggccau

SEQ ID NO: 1302232 - RNA, 17 nt, Homo sapiens
ucuaccuauaugcaguc

SEQ ID NO: 1302233 - RNA, 15 nt, Homo sapiens
ucuacuaauuccaca

SEQ ID NO: 1302234 - RNA, 20 nt, Homo sapiens
ucuacuacaaacuucaaaga

SEQ ID NO: 1302235 - RNA, 14 nt, Homo sapiens
ucuacuuugauucu

SEQ ID NO: 1302236 - RNA, 12 nt, Homo sapiens
ucuacuuuuuga

SEQ ID NO: 1302237 - RNA, 18 nt, Homo sapiens
ucuagaagcuuaagaauu

SEQ ID NO: 1302238 - RNA, 12 nt, Homo sapiens
ucuagacaacua

SEQ ID NO: 1302239 - RNA, 20 nt, Homo sapiens
ucuagaggcucauggcccug

SEQ ID NO: 1302240 - RNA, 14 nt, Homo sapiens
ucuaggcucugccu

SEQ ID NO: 1302241 - RNA, 16 nt, Homo sapiens
ugcauugugaggguua

SEQ ID NO: 1302242 - RNA, 14 nt, Homo sapiens
ugccaaaaugcucu

SEQ ID NO: 1302243 - RNA, 18 nt, Homo sapiens
ugccaaagggaaauauca

SEQ ID NO: 1302244 - RNA, 15 nt, Homo sapiens
ugccaaccggucacc

SEQ ID NO: 1302245 - RNA, 16 nt, Homo sapiens
ugccaccaacuuacaa

SEQ ID NO: 1302246 - RNA, 18 nt, Homo sapiens
ugccacccauuccaucuc

SEQ ID NO: 1302247 - RNA, 20 nt, Homo sapiens
ugccacccugccccuugcca

SEQ ID NO: 1302248 - RNA, 21 nt, Homo sapiens
ugccacccugccccuugccau

SEQ ID NO: 1302249 - RNA, 18 nt, Homo sapiens
ugccaccuuccucuccca

SEQ ID NO: 1302250 - RNA, 17 nt, Homo sapiens
ugccacuacacuccagc

SEQ ID NO: 1302251 - RNA, 19 nt, Homo sapiens
ugccagagauaaacuaaug

SEQ ID NO: 1302252 - RNA, 21 nt, Homo sapiens
ugccagcauuuagacccugca

SEQ ID NO: 1302253 - RNA, 16 nt, Homo sapiens
ugccagcuuaucucag

SEQ ID NO: 1302254 - RNA, 20 nt, Homo sapiens
ugccagcuuaucucaggggu

SEQ ID NO: 1302255 - RNA, 18 nt, Homo sapiens
ugccauacuuuccuguau

SEQ ID NO: 1302256 - RNA, 14 nt, Homo sapiens
ugccauagcaagau

SEQ ID NO: 1302257 - RNA, 18 nt, Homo sapiens
ugccaucguuuccaugac

SEQ ID NO: 1302258 - RNA, 23 nt, Homo sapiens
ugccaucucaauugugcuuugua

SEQ ID NO: 1302259 - RNA, 18 nt, Homo sapiens
ugccaugucugcagugug

SEQ ID NO: 1302260 - RNA, 12 nt, Homo sapiens
ugccaugugaag

SEQ ID NO: 1302261 - RNA, 17 nt, Homo sapiens
ugccauucucuugcauu

SEQ ID NO: 1302262 - RNA, 17 nt, Homo sapiens
ugccauugcacuccagc

SEQ ID NO: 1302263 - RNA, 13 nt, Homo sapiens
ugccccaucuccc

SEQ ID NO: 1302264 - RNA, 14 nt, Homo sapiens
ugcccccauuucac

SEQ ID NO: 1302265 - RNA, 17 nt, Homo sapiens
ugcccccucagugagga

SEQ ID NO: 1302266 - RNA, 18 nt, Homo sapiens
ugccccuggaugcacuuu

SEQ ID NO: 1302267 - RNA, 16 nt, Homo sapiens
ugccccuggcucugac

SEQ ID NO: 1302268 - RNA, 14 nt, Homo sapiens
ugccccuugacaac

SEQ ID NO: 1302269 - RNA, 19 nt, Homo sapiens
ugccccuugacaacuggca

SEQ ID NO: 1302270 - RNA, 17 nt, Homo sapiens
ugcccugaacccacugc

SEQ ID NO: 1302271 - RNA, 13 nt, Homo sapiens
ugccgcuaccucc

SEQ ID NO: 1302272 - RNA, 14 nt, Homo sapiens
ugccgcuaccuccc

SEQ ID NO: 1302273 - RNA, 21 nt, Homo sapiens
ugccgguaaacacgccugcaa

SEQ ID NO: 1302274 - RNA, 19 nt, Homo sapiens
ugccuacuuuuggccucau

SEQ ID NO: 1302275 - RNA, 15 nt, Homo sapiens
ugccuagaggugcuc

SEQ ID NO: 1302276 - RNA, 12 nt, Homo sapiens
ugccucauuuua

SEQ ID NO: 1302277 - RNA, 13 nt, Homo sapiens
ugccucuacuuug

SEQ ID NO: 1302278 - RNA, 22 nt, Homo sapiens
ugccucuacuuugauucugaua

SEQ ID NO: 1302279 - RNA, 14 nt, Homo sapiens
ugccucuguccuua

SEQ ID NO: 1302280 - RNA, 14 nt, Homo sapiens
ugccucugucucac

SEQ ID NO: 1302281 - RNA, 18 nt, Homo sapiens
ugccugcaggcaugaguc

SEQ ID NO: 1302282 - RNA, 15 nt, Homo sapiens
ugccugccacccugc

SEQ ID NO: 1302283 - RNA, 21 nt, Homo sapiens
ugccugccgguaaacacgccu

SEQ ID NO: 1302284 - RNA, 20 nt, Homo sapiens
ugccuuaccgagagccaaac

SEQ ID NO: 1302285 - RNA, 15 nt, Homo sapiens
ugccuucaccuccuc

SEQ ID NO: 1302286 - RNA, 17 nt, Homo sapiens
ugccuucucaccagcug

SEQ ID NO: 1302287 - RNA, 18 nt, Homo sapiens
ugccuucuguggggacuc

SEQ ID NO: 1302288 - RNA, 20 nt, Homo sapiens
ugccuuuaucugucuuuaug

SEQ ID NO: 1302289 - RNA, 18 nt, Homo sapiens
ugccuuucaaauuuagaa

SEQ ID NO: 1302290 - RNA, 14 nt, Homo sapiens
ugccuuugccucca

SEQ ID NO: 1302291 - RNA, 16 nt, Homo sapiens
ugcgaaccuaugucua

SEQ ID NO: 1302292 - RNA, 13 nt, Homo sapiens
ugcgaagacagag

SEQ ID NO: 1302293 - RNA, 22 nt, Homo sapiens
ugcgagagaaagggagugcaug

SEQ ID NO: 1302294 - RNA, 17 nt, Homo sapiens
ugcgcccaguccuucca

SEQ ID NO: 1302295 - RNA, 20 nt, Homo sapiens
ugcgcccuucauugccacac

SEQ ID NO: 1302296 - RNA, 17 nt, Homo sapiens
ugcgcgcgugcaugugu

SEQ ID NO: 1302297 - RNA, 17 nt, Homo sapiens
ugcgcugggcacuuccc

SEQ ID NO: 1302298 - RNA, 16 nt, Homo sapiens
ugcgguagaugggagg

SEQ ID NO: 1302299 - RNA, 16 nt, Homo sapiens
ugcuaacaagucacca

SEQ ID NO: 1302300 - RNA, 13 nt, Homo sapiens
ugcuaauguugcu

SEQ ID NO: 1302301 - RNA, 20 nt, Homo sapiens
ugcuacaaauacucuuagga

SEQ ID NO: 1302302 - RNA, 20 nt, Homo sapiens
ugcuagcuauuggccuccca

SEQ ID NO: 1302303 - RNA, 15 nt, Homo sapiens
ugcucaaaaucuuuc

SEQ ID NO: 1302304 - RNA, 20 nt, Homo sapiens
ugcucaccuuuaucaccuca

SEQ ID NO: 1302305 - RNA, 20 nt, Homo sapiens
ugcucacuugguccuaccua

SEQ ID NO: 1302306 - RNA, 21 nt, Homo sapiens
ugcucauucauuuaacagagc

SEQ ID NO: 1302307 - RNA, 14 nt, Homo sapiens
ugcuccacagggcc

SEQ ID NO: 1302308 - RNA, 14 nt, Homo sapiens
ugcuccagugcagg

SEQ ID NO: 1302309 - RNA, 18 nt, Homo sapiens
ugcuccagugcaggagac

SEQ ID NO: 1302310 - RNA, 13 nt, Homo sapiens
ugcucugagccac

SEQ ID NO: 1302311 - RNA, 19 nt, Homo sapiens
ugcucuugagucuuugcag

SEQ ID NO: 1302312 - RNA, 12 nt, Homo sapiens
ugcugaaaucau

SEQ ID NO: 1302313 - RNA, 18 nt, Homo sapiens
ugcugaccuccacagcuu

SEQ ID NO: 1302314 - RNA, 22 nt, Homo sapiens
ugcugaggagaguggaacagaa

SEQ ID NO: 1302315 - RNA, 18 nt, Homo sapiens
ugcugaugaaauggguuu

SEQ ID NO: 1302316 - RNA, 15 nt, Homo sapiens
ugcugcaaacacuua

SEQ ID NO: 1302317 - RNA, 18 nt, Homo sapiens
ugcugcaccaaugcacug

SEQ ID NO: 1302318 - RNA, 15 nt, Homo sapiens
ugcugccacacuguc

SEQ ID NO: 1302319 - RNA, 16 nt, Homo sapiens
ugcugccacacugucu

SEQ ID NO: 1302320 - RNA, 17 nt, Homo sapiens
ugcugccggcacagcug

SEQ ID NO: 1302321 - RNA, 21 nt, Homo sapiens
ugcugccggcacagcugggau

SEQ ID NO: 1302322 - RNA, 17 nt, Homo sapiens
ugcuggaaccugcaaaa

SEQ ID NO: 1302323 - RNA, 16 nt, Homo sapiens
ugcuggaauuccuaac

SEQ ID NO: 1302324 - RNA, 19 nt, Homo sapiens
ugcuggacaguaucacugu

SEQ ID NO: 1302325 - RNA, 19 nt, Homo sapiens
ugcuggagucaugugccuc

SEQ ID NO: 1302326 - RNA, 22 nt, Homo sapiens
ugcuggcauuugcaccuaccuc

SEQ ID NO: 1302327 - RNA, 20 nt, Homo sapiens
ugcuggccaaauagcaaaga

SEQ ID NO: 1302328 - RNA, 20 nt, Homo sapiens
ugcugggcacuucaucugau

SEQ ID NO: 1302329 - RNA, 16 nt, Homo sapiens
ugcugggcuguuuacu

SEQ ID NO: 1302330 - RNA, 14 nt, Homo sapiens
ugcuggugaaccag

SEQ ID NO: 1302331 - RNA, 19 nt, Homo sapiens
ugcuguagauucacauaca

SEQ ID NO: 1302332 - RNA, 21 nt, Homo sapiens
ugcuguaugcugaucaucgcc

SEQ ID NO: 1302333 - RNA, 21 nt, Homo sapiens
ugcuguuucacaauaccucau

SEQ ID NO: 1302334 - RNA, 14 nt, Homo sapiens
ugcuuaaucuugcu

SEQ ID NO: 1302335 - RNA, 14 nt, Homo sapiens
ugcuuauacaagac

SEQ ID NO: 1302336 - RNA, 15 nt, Homo sapiens
ugcuuauacugcugu

SEQ ID NO: 1302337 - RNA, 18 nt, Homo sapiens
ugcuucccagguucaagc

SEQ ID NO: 1302338 - RNA, 23 nt, Homo sapiens
ugcuucccggcgucccuaccucc

SEQ ID NO: 1302339 - RNA, 22 nt, Homo sapiens
ugcuucgggaagaaggggacaa

SEQ ID NO: 1302340 - RNA, 16 nt, Homo sapiens
ugcuugagcucaggag

SEQ ID NO: 1302341 - RNA, 14 nt, Homo sapiens
ugcuuguuauuaga

SEQ ID NO: 1302342 - RNA, 16 nt, Homo sapiens
ugcuuuagaaguaaca

SEQ ID NO: 1302343 - RNA, 19 nt, Homo sapiens
ugcuuucacucuccuaugc

SEQ ID NO: 1302344 - RNA, 15 nt, Homo sapiens
ugcuuucacucuuua

SEQ ID NO: 1302345 - RNA, 16 nt, Homo sapiens
ugcuuuccugccuccu

SEQ ID NO: 1302346 - RNA, 23 nt, Homo sapiens
ugcuuuccuuuuuuaaaaaugca

SEQ ID NO: 1302347 - RNA, 18 nt, Homo sapiens
ugcuuugaggcaguucca

SEQ ID NO: 1302348 - RNA, 16 nt, Homo sapiens
ugcuuuuaacucuaga

SEQ ID NO: 1302349 - RNA, 19 nt, Homo sapiens
uggaaaaauucauugucuc

SEQ ID NO: 1302350 - RNA, 20 nt, Homo sapiens
uggaaaaauucauugucucu

SEQ ID NO: 1302351 - RNA, 22 nt, Homo sapiens
uggaaacauucaggagcuuccu

SEQ ID NO: 1302352 - RNA, 13 nt, Homo sapiens
uggaaacucaugg

SEQ ID NO: 1302353 - RNA, 19 nt, Homo sapiens
uggaacacggccacaucaa

SEQ ID NO: 1302354 - RNA, 20 nt, Homo sapiens
uggaacagauucacacuguc

SEQ ID NO: 1302355 - RNA, 22 nt, Homo sapiens
uggaagacagagaccuccugcc

SEQ ID NO: 1302356 - RNA, 14 nt, Homo sapiens
uggaagcacagcuu

SEQ ID NO: 1302357 - RNA, 17 nt, Homo sapiens
uggaagcucuucuuccc

SEQ ID NO: 1302358 - RNA, 17 nt, Homo sapiens
uggaagcugucauaaaa

SEQ ID NO: 1302359 - RNA, 17 nt, Homo sapiens
uggaaggugacuuuuca

SEQ ID NO: 1302360 - RNA, 20 nt, Homo sapiens
uggaaggugacuuuucaccu

SEQ ID NO: 1302361 - RNA, 20 nt, Homo sapiens
uggaagguggggacagggau

SEQ ID NO: 1302362 - RNA, 20 nt, Homo sapiens
uggaauaacucuguggcauu

SEQ ID NO: 1302363 - RNA, 16 nt, Homo sapiens
uggaaucagauuuuaa

SEQ ID NO: 1302364 - RNA, 14 nt, Homo sapiens
uggaauguuggaua

SEQ ID NO: 1302365 - RNA, 16 nt, Homo sapiens
uggacaaagaaccuuc

SEQ ID NO: 1302366 - RNA, 14 nt, Homo sapiens
uggacacagaggaa

SEQ ID NO: 1302367 - RNA, 21 nt, Homo sapiens
uggacagugaggucacagucc

SEQ ID NO: 1302368 - RNA, 20 nt, Homo sapiens
uggacgcuggccugggauga

SEQ ID NO: 1302369 - RNA, 23 nt, Homo sapiens
uggagaagcucaucagaaacuca

SEQ ID NO: 1302370 - RNA, 12 nt, Homo sapiens
uggagacaaugu

SEQ ID NO: 1302371 - RNA, 12 nt, Homo sapiens
uggagagccacc

SEQ ID NO: 1302372 - RNA, 14 nt, Homo sapiens
uggagauagucuca

SEQ ID NO: 1302373 - RNA, 19 nt, Homo sapiens
uuauaauuugcauaccauu

SEQ ID NO: 1302374 - RNA, 11 nt, Homo sapiens
uuauacuguau

SEQ ID NO: 1302375 - RNA, 21 nt, Homo sapiens
uuauagaauauuuauuaccuc

SEQ ID NO: 1302376 - RNA, 16 nt, Homo sapiens
uuauagaccucuagua

SEQ ID NO: 1302377 - RNA, 16 nt, Homo sapiens
uuauauauguaucuaa

SEQ ID NO: 1302378 - RNA, 12 nt, Homo sapiens
uuauaugcuugu

SEQ ID NO: 1302379 - RNA, 15 nt, Homo sapiens
uuauaugcuugugua

SEQ ID NO: 1302380 - RNA, 13 nt, Homo sapiens
uuauauucaucca

SEQ ID NO: 1302381 - RNA, 16 nt, Homo sapiens
uuauauuuguuuuaga

SEQ ID NO: 1302382 - RNA, 15 nt, Homo sapiens
uuauauuuuuagccu

SEQ ID NO: 1302383 - RNA, 16 nt, Homo sapiens
uuauauuuuuagccua

SEQ ID NO: 1302384 - RNA, 22 nt, Homo sapiens
uuaucaccgugggcucccugac

SEQ ID NO: 1302385 - RNA, 18 nt, Homo sapiens
uuaucaucaaaugcauuu

SEQ ID NO: 1302386 - RNA, 17 nt, Homo sapiens
uuaucuaaaucaccaga

SEQ ID NO: 1302387 - RNA, 13 nt, Homo sapiens
uuaucucaggggu

SEQ ID NO: 1302388 - RNA, 17 nt, Homo sapiens
uuaucuguuuccugaca

SEQ ID NO: 1302389 - RNA, 15 nt, Homo sapiens
uuaucuugucucugg

SEQ ID NO: 1302390 - RNA, 16 nt, Homo sapiens
uuaugacagugaacau

SEQ ID NO: 1302391 - RNA, 22 nt, Homo sapiens
uuaugaggguccucuacuucag

SEQ ID NO: 1302392 - RNA, 14 nt, Homo sapiens
uuaugcacccaaga

SEQ ID NO: 1302393 - RNA, 17 nt, Homo sapiens
uuauuaaaauucugaau

SEQ ID NO: 1302394 - RNA, 14 nt, Homo sapiens
uuauuaaauacaaa

SEQ ID NO: 1302395 - RNA, 16 nt, Homo sapiens
uuauuacaucuuucac

SEQ ID NO: 1302396 - RNA, 13 nt, Homo sapiens
uuauuacauguaa

SEQ ID NO: 1302397 - RNA, 20 nt, Homo sapiens
uuauucaguccuucagcuca

SEQ ID NO: 1302398 - RNA, 22 nt, Homo sapiens
uuauucucguuuuaaaacccau

SEQ ID NO: 1302399 - RNA, 15 nt, Homo sapiens
uuauugcgcugcuac

SEQ ID NO: 1302400 - RNA, 19 nt, Homo sapiens
uuauuguacaaguugaaau

SEQ ID NO: 1302401 - RNA, 14 nt, Homo sapiens
uuauuguaccucuc

SEQ ID NO: 1302402 - RNA, 20 nt, Homo sapiens
uuauuuagaaauagaacuac

SEQ ID NO: 1302403 - RNA, 21 nt, Homo sapiens
uuauuuccacuuauaaaggaa

SEQ ID NO: 1302404 - RNA, 11 nt, Homo sapiens
uuauuuuggaa

SEQ ID NO: 1302405 - RNA, 19 nt, Homo sapiens
uucaaaaauggcuaggaag

SEQ ID NO: 1302406 - RNA, 18 nt, Homo sapiens
uucaaagaagucauggcc

SEQ ID NO: 1302407 - RNA, 17 nt, Homo sapiens
uucaaagagcuugaaaa

SEQ ID NO: 1302408 - RNA, 20 nt, Homo sapiens
uucaacccucagccuugaaa

SEQ ID NO: 1302409 - RNA, 22 nt, Homo sapiens
uucaacuuggugacacucuaua

SEQ ID NO: 1302410 - RNA, 12 nt, Homo sapiens
uucaagacagau

SEQ ID NO: 1302411 - RNA, 19 nt, Homo sapiens
uucaagagucuaaacccca

SEQ ID NO: 1302412 - RNA, 18 nt, Homo sapiens
uucaagggacccaugagu

SEQ ID NO: 1302413 - RNA, 20 nt, Homo sapiens
uucaauaaagcacugagcaa

SEQ ID NO: 1302414 - RNA, 15 nt, Homo sapiens
uucaauaaagcauuu

SEQ ID NO: 1302415 - RNA, 16 nt, Homo sapiens
uucaaucaaaauuuca

SEQ ID NO: 1302416 - RNA, 18 nt, Homo sapiens
uucacaaaacagccuuug

SEQ ID NO: 1302417 - RNA, 13 nt, Homo sapiens
uucacacuuuaaa

SEQ ID NO: 1302418 - RNA, 16 nt, Homo sapiens
uucacaucuaaccuca

SEQ ID NO: 1302419 - RNA, 16 nt, Homo sapiens
uucacauugaaaccca

SEQ ID NO: 1302420 - RNA, 14 nt, Homo sapiens
uucaccuaucccau

SEQ ID NO: 1302421 - RNA, 18 nt, Homo sapiens
uucaccuuagaaguuuag

SEQ ID NO: 1302422 - RNA, 17 nt, Homo sapiens
uucacgaacaugggcau

SEQ ID NO: 1302423 - RNA, 15 nt, Homo sapiens
uucacggcaggacaa

SEQ ID NO: 1302424 - RNA, 12 nt, Homo sapiens
uucacuacauua

SEQ ID NO: 1302425 - RNA, 21 nt, Homo sapiens
uucacucuuuagaaauaaugg

SEQ ID NO: 1302426 - RNA, 21 nt, Homo sapiens
uucagaaucacuucugagaac

SEQ ID NO: 1302427 - RNA, 18 nt, Homo sapiens
uucagagcugacacagga

SEQ ID NO: 1302428 - RNA, 17 nt, Homo sapiens
uucagccuuaauggaag

SEQ ID NO: 1302429 - RNA, 20 nt, Homo sapiens
uucagcuccagcucaccagc

SEQ ID NO: 1302430 - RNA, 14 nt, Homo sapiens
uucagcucugcaag

SEQ ID NO: 1302431 - RNA, 21 nt, Homo sapiens
uucaggaacacccccaugaca

SEQ ID NO: 1302432 - RNA, 23 nt, Homo sapiens
uucaggaaccucgaguacugugg

SEQ ID NO: 1302433 - RNA, 15 nt, Homo sapiens
uucaguuaauucuua

SEQ ID NO: 1302434 - RNA, 20 nt, Homo sapiens
uucaguucaagugcucuuca

SEQ ID NO: 1302435 - RNA, 15 nt, Homo sapiens
uucaguuuauuucca

SEQ ID NO: 1302436 - RNA, 16 nt, Homo sapiens
uucauaaguauuucaa

SEQ ID NO: 1302437 - RNA, 16 nt, Homo sapiens
uucauaauuuuaguaa

SEQ ID NO: 1302438 - RNA, 17 nt, Homo sapiens
uucauacauuaucucac

SEQ ID NO: 1302439 - RNA, 18 nt, Homo sapiens
uucauacauuaucucacu

SEQ ID NO: 1302440 - RNA, 15 nt, Homo sapiens
uucauagaaaccucu

SEQ ID NO: 1302441 - RNA, 13 nt, Homo sapiens
uucauaugcagua

SEQ ID NO: 1302442 - RNA, 20 nt, Homo sapiens
uucaucagacuccugugcaa

SEQ ID NO: 1302443 - RNA, 23 nt, Homo sapiens
uucauccaggccugccaagguga

SEQ ID NO: 1302444 - RNA, 17 nt, Homo sapiens
uucauccccuuacccuu

SEQ ID NO: 1302445 - RNA, 16 nt, Homo sapiens
uucaucugcucuccuu

SEQ ID NO: 1302446 - RNA, 13 nt, Homo sapiens
uucaugcagguga

SEQ ID NO: 1302447 - RNA, 12 nt, Homo sapiens
uucauggaccaa

SEQ ID NO: 1302448 - RNA, 19 nt, Homo sapiens
uucauggcugaagucaccu

SEQ ID NO: 1302449 - RNA, 20 nt, Homo sapiens
uucauguggagucauuauaa

SEQ ID NO: 1302450 - RNA, 15 nt, Homo sapiens
uucauucagccuuua

SEQ ID NO: 1302451 - RNA, 23 nt, Homo sapiens
uucauuccuaaagaaaaauaucu

SEQ ID NO: 1302452 - RNA, 14 nt, Homo sapiens
uucauucuuugcag

SEQ ID NO: 1302453 - RNA, 20 nt, Homo sapiens
uucauuucuuuccuuaucac

SEQ ID NO: 1302454 - RNA, 13 nt, Homo sapiens
uuccaaaagcaaa

SEQ ID NO: 1302455 - RNA, 18 nt, Homo sapiens
uuccaaaagcaaaugaua

SEQ ID NO: 1302456 - RNA, 11 nt, Homo sapiens
uuccaaagcaa

SEQ ID NO: 1302457 - RNA, 13 nt, Homo sapiens
uuccaaaggccau

SEQ ID NO: 1302458 - RNA, 19 nt, Homo sapiens
uuccaagauuucaaagugg

SEQ ID NO: 1302459 - RNA, 21 nt, Homo sapiens
uuccacaaagaaaauuccuau

SEQ ID NO: 1302460 - RNA, 19 nt, Homo sapiens
uuccacuuguuugcacugu

SEQ ID NO: 1302461 - RNA, 20 nt, Homo sapiens
uuccagaaaacaaaacugca

SEQ ID NO: 1302462 - RNA, 16 nt, Homo sapiens
uuccaggaguacuuac

SEQ ID NO: 1302463 - RNA, 14 nt, Homo sapiens
uuccagguguuacu

SEQ ID NO: 1302464 - RNA, 22 nt, Homo sapiens
uuccaguguccuuagaacauuu

SEQ ID NO: 1302465 - RNA, 14 nt, Homo sapiens
uuccauauauccuu

SEQ ID NO: 1302466 - RNA, 22 nt, Homo sapiens
uuccauauauuggcacugcuaa

SEQ ID NO: 1302467 - RNA, 17 nt, Homo sapiens
uuccauauuaguuuuac

SEQ ID NO: 1302468 - RNA, 14 nt, Homo sapiens
uuccaugauucuau

SEQ ID NO: 1302469 - RNA, 14 nt, Homo sapiens
uuccaugucuccuu

SEQ ID NO: 1302470 - RNA, 17 nt, Homo sapiens
uuccauucagugcagca

SEQ ID NO: 1302471 - RNA, 18 nt, Homo sapiens
uuccauuuccaagcacuu

SEQ ID NO: 1302472 - RNA, 17 nt, Homo sapiens
uuccauuuccauguccc

SEQ ID NO: 1302473 - RNA, 12 nt, Homo sapiens
uuccauuugggu

SEQ ID NO: 1302474 - RNA, 19 nt, Homo sapiens
uucccaacgugcaaagcca

SEQ ID NO: 1302475 - RNA, 21 nt, Homo sapiens
uucccaacuccucaugucuuc

SEQ ID NO: 1302476 - RNA, 13 nt, Homo sapiens
uucccacgaggaa

SEQ ID NO: 1302477 - RNA, 15 nt, Homo sapiens
uucccacugccaggg

SEQ ID NO: 1302478 - RNA, 19 nt, Homo sapiens
uucccggcgucccuaccuc

SEQ ID NO: 1302479 - RNA, 22 nt, Homo sapiens
uucccuacaguugaaaaacagc

SEQ ID NO: 1302480 - RNA, 23 nt, Homo sapiens
uucccuccccagaauggaggcaa

SEQ ID NO: 1302481 - RNA, 20 nt, Homo sapiens
uucccuggggaaaacuugca

SEQ ID NO: 1302482 - RNA, 23 nt, Homo sapiens
uucccuuuaugcacccaagagau

SEQ ID NO: 1302483 - RNA, 21 nt, Homo sapiens
uucccuuucuacccaguacuc

SEQ ID NO: 1302484 - RNA, 13 nt, Homo sapiens
uuccgcaccaaua

SEQ ID NO: 1302485 - RNA, 21 nt, Homo sapiens
uuccuagauaugauaaauaua

SEQ ID NO: 1302486 - RNA, 16 nt, Homo sapiens
uuccuauguaacugca

SEQ ID NO: 1302487 - RNA, 15 nt, Homo sapiens
uuccucagaaaccaa

SEQ ID NO: 1302488 - RNA, 18 nt, Homo sapiens
uuccucagaaaccaaagc

SEQ ID NO: 1302489 - RNA, 18 nt, Homo sapiens
uuccucauuagcauuuug

SEQ ID NO: 1302490 - RNA, 21 nt, Homo sapiens
uuccuccgaggccaguaccuu

SEQ ID NO: 1302491 - RNA, 19 nt, Homo sapiens
uuccucgaaguucuaggaa

SEQ ID NO: 1302492 - RNA, 22 nt, Homo sapiens
uuccucucaugucuuugcugca

SEQ ID NO: 1302493 - RNA, 20 nt, Homo sapiens
uuccucucuuccuccaggga

SEQ ID NO: 1302494 - RNA, 16 nt, Homo sapiens
uuccugauuuucuggu

SEQ ID NO: 1302495 - RNA, 18 nt, Homo sapiens
uuccuuaauccagcugau

SEQ ID NO: 1302496 - RNA, 19 nt, Homo sapiens
uuccuucucaucugugauu

SEQ ID NO: 1302497 - RNA, 21 nt, Homo sapiens
uuccuugaauguggcuugaga

SEQ ID NO: 1302498 - RNA, 13 nt, Homo sapiens
uucgaaaggccuu

SEQ ID NO: 1302499 - RNA, 23 nt, Homo sapiens
uucgaauacgucagauuggacca

SEQ ID NO: 1302500 - RNA, 17 nt, Homo sapiens
uucggauuuggggugga

SEQ ID NO: 1302501 - RNA, 21 nt, Homo sapiens
uucguagauauuggacaaaga

SEQ ID NO: 1302502 - RNA, 13 nt, Homo sapiens
uucgucuacugca

SEQ ID NO: 1302503 - RNA, 21 nt, Homo sapiens
uucguuuuuuuaaaucacaag

SEQ ID NO: 1302504 - RNA, 14 nt, Homo sapiens
uucuaaaaguuuga

SEQ ID NO: 1302505 - RNA, 23 nt, Homo sapiens
uucuacacagagcaggacugcac

SEQ ID NO: 1302506 - RNA, 18 nt, Homo sapiens
agacagacaacacuggga

SEQ ID NO: 1302507 - RNA, 17 nt, Homo sapiens
agacagagaccuccugc

SEQ ID NO: 1302508 - RNA, 20 nt, Homo sapiens
agacagaguuuucacucuua

SEQ ID NO: 1302509 - RNA, 20 nt, Homo sapiens
agacagcaggcauaaggcac

SEQ ID NO: 1302510 - RNA, 14 nt, Homo sapiens
agacagcuucucau

SEQ ID NO: 1302511 - RNA, 10 nt, Homo sapiens
agacagugaa

SEQ ID NO: 1302512 - RNA, 13 nt, Homo sapiens
agacagugaaaga

SEQ ID NO: 1302513 - RNA, 17 nt, Homo sapiens
agacaucaccaacuguc

SEQ ID NO: 1302514 - RNA, 21 nt, Homo sapiens
agacaugagugcgugcucagu

SEQ ID NO: 1302515 - RNA, 15 nt, Homo sapiens
agacauugcaaugua

SEQ ID NO: 1302516 - RNA, 21 nt, Homo sapiens
agacauuggcaccuaauccag

SEQ ID NO: 1302517 - RNA, 18 nt, Homo sapiens
agaccaagcugugcccug

SEQ ID NO: 1302518 - RNA, 21 nt, Homo sapiens
agaccacgcccguccugccug

SEQ ID NO: 1302519 - RNA, 14 nt, Homo sapiens
agaccacugauaaa

SEQ ID NO: 1302520 - RNA, 16 nt, Homo sapiens
agaccauuugauuuuc

SEQ ID NO: 1302521 - RNA, 18 nt, Homo sapiens
agacccaaacauaugcac

SEQ ID NO: 1302522 - RNA, 16 nt, Homo sapiens
agacccccagcacuug

SEQ ID NO: 1302523 - RNA, 20 nt, Homo sapiens
agaccccucucccagcuauu

SEQ ID NO: 1302524 - RNA, 12 nt, Homo sapiens
agacccggcugc

SEQ ID NO: 1302525 - RNA, 20 nt, Homo sapiens
agaccgugaccagugcugcu

SEQ ID NO: 1302526 - RNA, 18 nt, Homo sapiens
agaccugacaccuuucau

SEQ ID NO: 1302527 - RNA, 12 nt, Homo sapiens
agaccugaggga

SEQ ID NO: 1302528 - RNA, 15 nt, Homo sapiens
agaccuggcacugga

SEQ ID NO: 1302529 - RNA, 23 nt, Homo sapiens
agacgggcaaaauaaagugacag

SEQ ID NO: 1302530 - RNA, 17 nt, Homo sapiens
agacgguguuuugccau

SEQ ID NO: 1302531 - RNA, 21 nt, Homo sapiens
agacguccuccguccauauca

SEQ ID NO: 1302532 - RNA, 21 nt, Homo sapiens
agacuaaccucuaccagcaca

SEQ ID NO: 1302533 - RNA, 23 nt, Homo sapiens
agacuaagggcgcuugucccauc

SEQ ID NO: 1302534 - RNA, 23 nt, Homo sapiens
agacuauuaauaaauaagacugu

SEQ ID NO: 1302535 - RNA, 22 nt, Homo sapiens
agacucaugguguguuacacaa

SEQ ID NO: 1302536 - RNA, 15 nt, Homo sapiens
agacuccugugcaac

SEQ ID NO: 1302537 - RNA, 17 nt, Homo sapiens
agacucgagaacuuuca

SEQ ID NO: 1302538 - RNA, 20 nt, Homo sapiens
agacucucgcaucuucccaa

SEQ ID NO: 1302539 - RNA, 18 nt, Homo sapiens
agacucuuuaugcuugca

SEQ ID NO: 1302540 - RNA, 13 nt, Homo sapiens
agacugcaucuca

SEQ ID NO: 1302541 - RNA, 21 nt, Homo sapiens
agacugcccagcuaaagcaau

SEQ ID NO: 1302542 - RNA, 15 nt, Homo sapiens
agacuggaagcacag

SEQ ID NO: 1302543 - RNA, 17 nt, Homo sapiens
agacuggaagcacagcu

SEQ ID NO: 1302544 - RNA, 21 nt, Homo sapiens
agacuggacuggaccagacaa

SEQ ID NO: 1302545 - RNA, 16 nt, Homo sapiens
agacugggcugaggga

SEQ ID NO: 1302546 - RNA, 14 nt, Homo sapiens
agacuuaaaagagc

SEQ ID NO: 1302547 - RNA, 11 nt, Homo sapiens
agacuucccag

SEQ ID NO: 1302548 - RNA, 14 nt, Homo sapiens
agacuuuacaugga

SEQ ID NO: 1302549 - RNA, 17 nt, Homo sapiens
agagaaagggacaauga

SEQ ID NO: 1302550 - RNA, 12 nt, Homo sapiens
agagaaagggag

SEQ ID NO: 1302551 - RNA, 16 nt, Homo sapiens
agagaaccucagauca

SEQ ID NO: 1302552 - RNA, 22 nt, Homo sapiens
agagaaccucagaucaggugca

SEQ ID NO: 1302553 - RNA, 15 nt, Homo sapiens
agagaauaugucugc

SEQ ID NO: 1302554 - RNA, 21 nt, Homo sapiens
agagaauauuauaaagugcuu

SEQ ID NO: 1302555 - RNA, 18 nt, Homo sapiens
agagacaaggucaccugg

SEQ ID NO: 1302556 - RNA, 19 nt, Homo sapiens
agagacgguguuuugccau

SEQ ID NO: 1302557 - RNA, 16 nt, Homo sapiens
agagacuauguagcaa

SEQ ID NO: 1302558 - RNA, 15 nt, Homo sapiens
agagacuccuugaga

SEQ ID NO: 1302559 - RNA, 14 nt, Homo sapiens
agagagcccaugag

SEQ ID NO: 1302560 - RNA, 13 nt, Homo sapiens
agagagccuggug

SEQ ID NO: 1302561 - RNA, 20 nt, Homo sapiens
agagaucagcgacccugagg

SEQ ID NO: 1302562 - RNA, 19 nt, Homo sapiens
agagcaaggguucccucaa

SEQ ID NO: 1302563 - RNA, 19 nt, Homo sapiens
agagcaguuucuguccugc

SEQ ID NO: 1302564 - RNA, 20 nt, Homo sapiens
agagccagccggcuaugaaa

SEQ ID NO: 1302565 - RNA, 12 nt, Homo sapiens
agagccucagug

SEQ ID NO: 1302566 - RNA, 13 nt, Homo sapiens
agagccuuuccaa

SEQ ID NO: 1302567 - RNA, 13 nt, Homo sapiens
agagcucaccugu

SEQ ID NO: 1302568 - RNA, 14 nt, Homo sapiens
agagcuucccugac

SEQ ID NO: 1302569 - RNA, 13 nt, Homo sapiens
agaggaucaucug

SEQ ID NO: 1302570 - RNA, 14 nt, Homo sapiens
agaggaucaucugg

SEQ ID NO: 1302571 - RNA, 19 nt, Homo sapiens
agaggcagggucucacucu

SEQ ID NO: 1302572 - RNA, 18 nt, Homo sapiens
agaggcuggaguugucac

SEQ ID NO: 1302573 - RNA, 15 nt, Homo sapiens
agaggcuuagagaca

SEQ ID NO: 1302574 - RNA, 15 nt, Homo sapiens
agagggaagaucugg

SEQ ID NO: 1302575 - RNA, 13 nt, Homo sapiens
agagggaggaaga

SEQ ID NO: 1302576 - RNA, 20 nt, Homo sapiens
agaguauuaaugaaaagcac

SEQ ID NO: 1302577 - RNA, 23 nt, Homo sapiens
agaguauuaaugaaaagcacaaa

SEQ ID NO: 1302578 - RNA, 20 nt, Homo sapiens
agagucaaugaacuuuccac

SEQ ID NO: 1302579 - RNA, 12 nt, Homo sapiens
agagucagcucu

SEQ ID NO: 1302580 - RNA, 21 nt, Homo sapiens
agagucagcucucugcccugu

SEQ ID NO: 1302581 - RNA, 16 nt, Homo sapiens
agagucaucuaccuga

SEQ ID NO: 1302582 - RNA, 18 nt, Homo sapiens
agaguccagaucuugccu

SEQ ID NO: 1302583 - RNA, 14 nt, Homo sapiens
agaguccucugaau

SEQ ID NO: 1302584 - RNA, 16 nt, Homo sapiens
agaguggguuucacaa

SEQ ID NO: 1302585 - RNA, 13 nt, Homo sapiens
agaguuuccugaa

SEQ ID NO: 1302586 - RNA, 17 nt, Homo sapiens
agauaaauauuuugcau

SEQ ID NO: 1302587 - RNA, 18 nt, Homo sapiens
agauaccagaauguugcu

SEQ ID NO: 1302588 - RNA, 19 nt, Homo sapiens
agauacugucucuuucaug

SEQ ID NO: 1302589 - RNA, 18 nt, Homo sapiens
agauagggaaaaggggcu

SEQ ID NO: 1302590 - RNA, 21 nt, Homo sapiens
agauagucucauucugucacc

SEQ ID NO: 1302591 - RNA, 12 nt, Homo sapiens
agaucacagugu

SEQ ID NO: 1302592 - RNA, 15 nt, Homo sapiens
agaucacgccacugc

SEQ ID NO: 1302593 - RNA, 21 nt, Homo sapiens
agaucagccugggcaauguga

SEQ ID NO: 1302594 - RNA, 14 nt, Homo sapiens
agaucauggcccac

SEQ ID NO: 1302595 - RNA, 22 nt, Homo sapiens
agauccagggacugaagccaaa

SEQ ID NO: 1302596 - RNA, 14 nt, Homo sapiens
agauccucuucuca

SEQ ID NO: 1302597 - RNA, 23 nt, Homo sapiens
agaucuagucuguuacaccauuu

SEQ ID NO: 1302598 - RNA, 17 nt, Homo sapiens
agaucucgguuugccaa

SEQ ID NO: 1302599 - RNA, 19 nt, Homo sapiens
agaucuggaaccucagccu

SEQ ID NO: 1302600 - RNA, 13 nt, Homo sapiens
agaucugucuuga

SEQ ID NO: 1302601 - RNA, 21 nt, Homo sapiens
agaugaggacaagagggacaa

SEQ ID NO: 1302602 - RNA, 20 nt, Homo sapiens
agaugaggccccggggcaug

SEQ ID NO: 1302603 - RNA, 22 nt, Homo sapiens
agaugauacauccaaagcagac

SEQ ID NO: 1302604 - RNA, 19 nt, Homo sapiens
agaugauggaugccaauau

SEQ ID NO: 1302605 - RNA, 13 nt, Homo sapiens
agaugcaggugag

SEQ ID NO: 1302606 - RNA, 21 nt, Homo sapiens
agauggaaaaacuugugcuau

SEQ ID NO: 1302607 - RNA, 21 nt, Homo sapiens
agauggcagauucccacugcc

SEQ ID NO: 1302608 - RNA, 20 nt, Homo sapiens
agauggcgcuauugcacucc

SEQ ID NO: 1302609 - RNA, 15 nt, Homo sapiens
agaugggcagcagcu

SEQ ID NO: 1302610 - RNA, 15 nt, Homo sapiens
agauguggagcuauu

SEQ ID NO: 1302611 - RNA, 16 nt, Homo sapiens
agauguguuaggaaug

SEQ ID NO: 1302612 - RNA, 20 nt, Homo sapiens
agauguucccccaucucgcu

SEQ ID NO: 1302613 - RNA, 19 nt, Homo sapiens
agauguucuaagucuuucc

SEQ ID NO: 1302614 - RNA, 22 nt, Homo sapiens
agauuauuuuuaaauaauuuaa

SEQ ID NO: 1302615 - RNA, 14 nt, Homo sapiens
agauucacacuguc

SEQ ID NO: 1302616 - RNA, 11 nt, Homo sapiens
agauucacaua

SEQ ID NO: 1302617 - RNA, 13 nt, Homo sapiens
agauuccaaaaag

SEQ ID NO: 1302618 - RNA, 17 nt, Homo sapiens
agauuccccugugucau

SEQ ID NO: 1302619 - RNA, 16 nt, Homo sapiens
agauucuaaucccaac

SEQ ID NO: 1302620 - RNA, 22 nt, Homo sapiens
agauugccucucuagacaacua

SEQ ID NO: 1302621 - RNA, 15 nt, Homo sapiens
agauuuaaauccuuu

SEQ ID NO: 1302622 - RNA, 17 nt, Homo sapiens
agauuucagggagacaa

SEQ ID NO: 1302623 - RNA, 23 nt, Homo sapiens
agauuucggaggccauccugcca

SEQ ID NO: 1302624 - RNA, 16 nt, Homo sapiens
agcaaaaacauguaug

SEQ ID NO: 1302625 - RNA, 19 nt, Homo sapiens
agcaaaaacauguaugugc

SEQ ID NO: 1302626 - RNA, 13 nt, Homo sapiens
agcaaaacauaaa

SEQ ID NO: 1302627 - RNA, 22 nt, Homo sapiens
agcaaacugaauggcaaugaaa

SEQ ID NO: 1302628 - RNA, 20 nt, Homo sapiens
agcaaagauugugccacuac

SEQ ID NO: 1302629 - RNA, 15 nt, Homo sapiens
agcaaaggcugagaa

SEQ ID NO: 1302630 - RNA, 15 nt, Homo sapiens
agcaaaucacgacca

SEQ ID NO: 1302631 - RNA, 16 nt, Homo sapiens
agcaaauuuucagcau

SEQ ID NO: 1302632 - RNA, 15 nt, Homo sapiens
agcaacaagaccacc

SEQ ID NO: 1302633 - RNA, 18 nt, Homo sapiens
agcaacaggaaucucaga

SEQ ID NO: 1302634 - RNA, 15 nt, Homo sapiens
agcaacaggccauug

SEQ ID NO: 1302635 - RNA, 18 nt, Homo sapiens
agcaacaggccauuguga

SEQ ID NO: 1302636 - RNA, 17 nt, Homo sapiens
agcaaccauuuguaaaa

SEQ ID NO: 1302637 - RNA, 20 nt, Homo sapiens
agcaagacauacuuaaugca

SEQ ID NO: 1302638 - RNA, 21 nt, Homo sapiens
agcaagcgcuguaaacccuga

SEQ ID NO: 1302639 - RNA, 17 nt, Homo sapiens
agcaagcucccaaggga

SEQ ID NO: 1302640 - RNA, 21 nt, Homo sapiens
agcaaggguugggcccagugu

SEQ ID NO: 1302641 - RNA, 19 nt, Homo sapiens
cacuguuuguuacuaugua

SEQ ID NO: 1302642 - RNA, 14 nt, Homo sapiens
cacuuaugauuuca

SEQ ID NO: 1302643 - RNA, 21 nt, Homo sapiens
cacuucacccacccuccagga

SEQ ID NO: 1302644 - RNA, 12 nt, Homo sapiens
cacuucaucuga

SEQ ID NO: 1302645 - RNA, 13 nt, Homo sapiens
cacuucaucugau

SEQ ID NO: 1302646 - RNA, 17 nt, Homo sapiens
cacuucccagagcaucu

SEQ ID NO: 1302647 - RNA, 20 nt, Homo sapiens
cacuucccagagcaucuugc

SEQ ID NO: 1302648 - RNA, 20 nt, Homo sapiens
cacuuccguagacuguuuag

SEQ ID NO: 1302649 - RNA, 17 nt, Homo sapiens
cacuuuagggcuguaaa

SEQ ID NO: 1302650 - RNA, 19 nt, Homo sapiens
cacuuugggaggccgaggu

SEQ ID NO: 1302651 - RNA, 19 nt, Homo sapiens
cacuuugggaggcugaggc

SEQ ID NO: 1302652 - RNA, 19 nt, Homo sapiens
cagaaacagugcaaggaag

SEQ ID NO: 1302653 - RNA, 19 nt, Homo sapiens
cagaaacaguucaccuuga

SEQ ID NO: 1302654 - RNA, 19 nt, Homo sapiens
cagaacacacuccaucagc

SEQ ID NO: 1302655 - RNA, 18 nt, Homo sapiens
cagaacacccaauucaaa

SEQ ID NO: 1302656 - RNA, 14 nt, Homo sapiens
cagaacucuuucaa

SEQ ID NO: 1302657 - RNA, 17 nt, Homo sapiens
cagaagcagaagugcaa

SEQ ID NO: 1302658 - RNA, 19 nt, Homo sapiens
cagaaggaaaaauguguaa

SEQ ID NO: 1302659 - RNA, 15 nt, Homo sapiens
cagaaguaagccuca

SEQ ID NO: 1302660 - RNA, 13 nt, Homo sapiens
cagaauccaaaga

SEQ ID NO: 1302661 - RNA, 18 nt, Homo sapiens
cagaaucccggcugucaa

SEQ ID NO: 1302662 - RNA, 16 nt, Homo sapiens
cagaaucccguaacac

SEQ ID NO: 1302663 - RNA, 13 nt, Homo sapiens
cagaauggaggca

SEQ ID NO: 1302664 - RNA, 19 nt, Homo sapiens
cagaauuagcugcuucuau

SEQ ID NO: 1302665 - RNA, 15 nt, Homo sapiens
cagaauugagaguga

SEQ ID NO: 1302666 - RNA, 16 nt, Homo sapiens
cagaauugagagugau

SEQ ID NO: 1302667 - RNA, 16 nt, Homo sapiens
cagacacaacacaguu

SEQ ID NO: 1302668 - RNA, 22 nt, Homo sapiens
cagacacuaaagacuggguuac

SEQ ID NO: 1302669 - RNA, 20 nt, Homo sapiens
cagacagacaacacugggaa

SEQ ID NO: 1302670 - RNA, 17 nt, Homo sapiens
cagacaggacaggugug

SEQ ID NO: 1302671 - RNA, 16 nt, Homo sapiens
cagaccucaggugcua

SEQ ID NO: 1302672 - RNA, 13 nt, Homo sapiens
cagaccuucacag

SEQ ID NO: 1302673 - RNA, 14 nt, Homo sapiens
cagaccuucacaga

SEQ ID NO: 1302674 - RNA, 16 nt, Homo sapiens
cagacucaaaugcuca

SEQ ID NO: 1302675 - RNA, 14 nt, Homo sapiens
cagacucccauucc

SEQ ID NO: 1302676 - RNA, 18 nt, Homo sapiens
cagacuccuaacuacagg

SEQ ID NO: 1302677 - RNA, 15 nt, Homo sapiens
cagacuccugugcaa

SEQ ID NO: 1302678 - RNA, 16 nt, Homo sapiens
cagacuccugugcaac

SEQ ID NO: 1302679 - RNA, 18 nt, Homo sapiens
cagacuccugugcaacuu

SEQ ID NO: 1302680 - RNA, 17 nt, Homo sapiens
cagacucuccuucaggg

SEQ ID NO: 1302681 - RNA, 15 nt, Homo sapiens
cagacuggagugcag

SEQ ID NO: 1302682 - RNA, 20 nt, Homo sapiens
cagacuucccugaauguauu

SEQ ID NO: 1302683 - RNA, 23 nt, Homo sapiens
cagacuugccaugugacucuggc

SEQ ID NO: 1302684 - RNA, 20 nt, Homo sapiens
cagacuuuggaaaaugcauu

SEQ ID NO: 1302685 - RNA, 16 nt, Homo sapiens
cagagaaagggacaau

SEQ ID NO: 1302686 - RNA, 13 nt, Homo sapiens
cagagacauacuu

SEQ ID NO: 1302687 - RNA, 17 nt, Homo sapiens
cagagacauacuugaag

SEQ ID NO: 1302688 - RNA, 17 nt, Homo sapiens
cagagaccaaaugucac

SEQ ID NO: 1302689 - RNA, 21 nt, Homo sapiens
cagagagagagaauggauccu

SEQ ID NO: 1302690 - RNA, 23 nt, Homo sapiens
cagagaugcaccaccaagccaag

SEQ ID NO: 1302691 - RNA, 20 nt, Homo sapiens
cagagcaagacucugucuca

SEQ ID NO: 1302692 - RNA, 19 nt, Homo sapiens
cagagcaagcgcuguaaac

SEQ ID NO: 1302693 - RNA, 22 nt, Homo sapiens
cagagcauuuuuuaugauauca

SEQ ID NO: 1302694 - RNA, 24 nt, Homo sapiens
cagagccacagggucugccuccag

SEQ ID NO: 1302695 - RNA, 17 nt, Homo sapiens
cagagcugacacaggau

SEQ ID NO: 1302696 - RNA, 21 nt, Homo sapiens
cagagcugcuccccucugcac

SEQ ID NO: 1302697 - RNA, 15 nt, Homo sapiens
cagagcuucccugac

SEQ ID NO: 1302698 - RNA, 13 nt, Homo sapiens
cagagcuuccuua

SEQ ID NO: 1302699 - RNA, 11 nt, Homo sapiens
cagagcuucuu

SEQ ID NO: 1302700 - RNA, 22 nt, Homo sapiens
cagaggcagcccgcacaccugc

SEQ ID NO: 1302701 - RNA, 15 nt, Homo sapiens
cagagucucacucuc

SEQ ID NO: 1302702 - RNA, 20 nt, Homo sapiens
cagagugagacucugucuca

SEQ ID NO: 1302703 - RNA, 12 nt, Homo sapiens
cagagugcaagc

SEQ ID NO: 1302704 - RNA, 15 nt, Homo sapiens
cagaguguucccuga

SEQ ID NO: 1302705 - RNA, 14 nt, Homo sapiens
cagaguuguugcuu

SEQ ID NO: 1302706 - RNA, 13 nt, Homo sapiens
cagauaaugugaa

SEQ ID NO: 1302707 - RNA, 19 nt, Homo sapiens
cagauacugucucuuucau

SEQ ID NO: 1302708 - RNA, 22 nt, Homo sapiens
cagauccagggacugaagccaa

SEQ ID NO: 1302709 - RNA, 18 nt, Homo sapiens
cagaucugcccacaucuu

SEQ ID NO: 1302710 - RNA, 18 nt, Homo sapiens
cagaucuuggacucauga

SEQ ID NO: 1302711 - RNA, 20 nt, Homo sapiens
cagauuauccuuccuccuca

SEQ ID NO: 1302712 - RNA, 18 nt, Homo sapiens
cagauuccgcaccaauaa

SEQ ID NO: 1302713 - RNA, 15 nt, Homo sapiens
cagauucuucagcuu

SEQ ID NO: 1302714 - RNA, 13 nt, Homo sapiens
cagauugcaugug

SEQ ID NO: 1302715 - RNA, 18 nt, Homo sapiens
cagauuggcucacacuga

SEQ ID NO: 1302716 - RNA, 20 nt, Homo sapiens
cagauuggcucacacugaga

SEQ ID NO: 1302717 - RNA, 22 nt, Homo sapiens
cagauuuuagaggggggaaauu

SEQ ID NO: 1302718 - RNA, 14 nt, Homo sapiens
cagcaaaucacgac

SEQ ID NO: 1302719 - RNA, 18 nt, Homo sapiens
cagcaacaggaaucucag

SEQ ID NO: 1302720 - RNA, 18 nt, Homo sapiens
cagcaagugagagcuggg

SEQ ID NO: 1302721 - RNA, 18 nt, Homo sapiens
cagcacccccagugcagc

SEQ ID NO: 1302722 - RNA, 12 nt, Homo sapiens
cagcagacugau

SEQ ID NO: 1302723 - RNA, 17 nt, Homo sapiens
cagcagaguaucugucu

SEQ ID NO: 1302724 - RNA, 14 nt, Homo sapiens
cagcagcacccaug

SEQ ID NO: 1302725 - RNA, 16 nt, Homo sapiens
cagcagggaugcccug

SEQ ID NO: 1302726 - RNA, 22 nt, Homo sapiens
cagcaguggacucaaaacccau

SEQ ID NO: 1302727 - RNA, 13 nt, Homo sapiens
cagcauacgucag

SEQ ID NO: 1302728 - RNA, 12 nt, Homo sapiens
cagcaucuguag

SEQ ID NO: 1302729 - RNA, 15 nt, Homo sapiens
cagcauggagcuaua

SEQ ID NO: 1302730 - RNA, 13 nt, Homo sapiens
cagcauguugccc

SEQ ID NO: 1302731 - RNA, 19 nt, Homo sapiens
cagcauugacucuguggcu

SEQ ID NO: 1302732 - RNA, 18 nt, Homo sapiens
cagccaaacccugucuga

SEQ ID NO: 1302733 - RNA, 13 nt, Homo sapiens
cagccaagggaug

SEQ ID NO: 1302734 - RNA, 18 nt, Homo sapiens
cagccaauuauguuaaac

SEQ ID NO: 1302735 - RNA, 22 nt, Homo sapiens
cagccacaaaguugagacuucu

SEQ ID NO: 1302736 - RNA, 16 nt, Homo sapiens
cagccacgaggugcaa

SEQ ID NO: 1302737 - RNA, 18 nt, Homo sapiens
cagccagaggcaccucaa

SEQ ID NO: 1302738 - RNA, 12 nt, Homo sapiens
cagccagcacuu

SEQ ID NO: 1302739 - RNA, 21 nt, Homo sapiens
cagcccagaggccaacacugu

SEQ ID NO: 1302740 - RNA, 14 nt, Homo sapiens
cagcccuauuucag

SEQ ID NO: 1302741 - RNA, 13 nt, Homo sapiens
cagcccugcagug

SEQ ID NO: 1302742 - RNA, 15 nt, Homo sapiens
cagccgauucaccug

SEQ ID NO: 1302743 - RNA, 22 nt, Homo sapiens
cagccguccucccuccuagggu

SEQ ID NO: 1302744 - RNA, 19 nt, Homo sapiens
cagccucccaaguagcuga

SEQ ID NO: 1302745 - RNA, 19 nt, Homo sapiens
cagccucccgaauagcugg

SEQ ID NO: 1302746 - RNA, 15 nt, Homo sapiens
cagccucuuggcaau

SEQ ID NO: 1302747 - RNA, 14 nt, Homo sapiens
cagccugcuagcua

SEQ ID NO: 1302748 - RNA, 14 nt, Homo sapiens
cagccuggccagac

SEQ ID NO: 1302749 - RNA, 16 nt, Homo sapiens
cagccuuccguaucca

SEQ ID NO: 1302750 - RNA, 16 nt, Homo sapiens
cagcgagcccuggugg

SEQ ID NO: 1302751 - RNA, 21 nt, Homo sapiens
cagcgccaggcugaccacagc

SEQ ID NO: 1302752 - RNA, 13 nt, Homo sapiens
cagcuaaauuuuc

SEQ ID NO: 1302753 - RNA, 14 nt, Homo sapiens
cagcucaaaggcac

SEQ ID NO: 1302754 - RNA, 15 nt, Homo sapiens
cagcucaaaggcaca

SEQ ID NO: 1302755 - RNA, 20 nt, Homo sapiens
cagcucaaaggcacagugaa

SEQ ID NO: 1302756 - RNA, 20 nt, Homo sapiens
cagcucagcuuccccaacac

SEQ ID NO: 1302757 - RNA, 17 nt, Homo sapiens
cagcuccccagaguccu

SEQ ID NO: 1302758 - RNA, 15 nt, Homo sapiens
cagcuccuucugucc

SEQ ID NO: 1302759 - RNA, 17 nt, Homo sapiens
cagcucuguccugggag

SEQ ID NO: 1302760 - RNA, 17 nt, Homo sapiens
caggaauguggcugcaa

SEQ ID NO: 1302761 - RNA, 13 nt, Homo sapiens
caggacaagagaa

SEQ ID NO: 1302762 - RNA, 13 nt, Homo sapiens
caggacaggugug

SEQ ID NO: 1302763 - RNA, 12 nt, Homo sapiens
caggacagugcu

SEQ ID NO: 1302764 - RNA, 14 nt, Homo sapiens
caggacgcccucac

SEQ ID NO: 1302765 - RNA, 20 nt, Homo sapiens
caggacucacccucauacca

SEQ ID NO: 1302766 - RNA, 15 nt, Homo sapiens
caggagcacuacaga

SEQ ID NO: 1302767 - RNA, 15 nt, Homo sapiens
caggagcgcaucuca

SEQ ID NO: 1302768 - RNA, 19 nt, Homo sapiens
caggagcugggauccuaag

SEQ ID NO: 1302769 - RNA, 20 nt, Homo sapiens
caggaggcagagguugcagu

SEQ ID NO: 1302770 - RNA, 20 nt, Homo sapiens
caggagguuuuuuugucaac

SEQ ID NO: 1302771 - RNA, 15 nt, Homo sapiens
caggagucucuggua

SEQ ID NO: 1302772 - RNA, 19 nt, Homo sapiens
caggaguucgagaccagcc

SEQ ID NO: 1302773 - RNA, 20 nt, Homo sapiens
caggaguucgagaccagccu

SEQ ID NO: 1302774 - RNA, 17 nt, Homo sapiens
caggauacuuaguucau

SEQ ID NO: 1302775 - RNA, 17 nt, Homo sapiens
caggcaaagcaagugau

SEQ ID NO: 1302776 - RNA, 16 nt, Homo sapiens
caggcagaaggcagua

SEQ ID NO: 1302777 - RNA, 19 nt, Homo sapiens
caggcagcuuuuucucucc

SEQ ID NO: 1302778 - RNA, 15 nt, Homo sapiens
caggcagggugcagu

SEQ ID NO: 1302779 - RNA, 15 nt, Homo sapiens
caggcauguucucug

SEQ ID NO: 1302780 - RNA, 14 nt, Homo sapiens
caggccagcugccu

SEQ ID NO: 1302781 - RNA, 15 nt, Homo sapiens
caggccaggccagcu

SEQ ID NO: 1302782 - RNA, 21 nt, Homo sapiens
caggccaguuugaagacuaca

SEQ ID NO: 1302783 - RNA, 17 nt, Homo sapiens
caggccccgugaggcaa

SEQ ID NO: 1302784 - RNA, 13 nt, Homo sapiens
caggcccuguggc

SEQ ID NO: 1302785 - RNA, 15 nt, Homo sapiens
caggccugagcugcu

SEQ ID NO: 1302786 - RNA, 20 nt, Homo sapiens
caggcgauccaccugucuca

SEQ ID NO: 1302787 - RNA, 15 nt, Homo sapiens
caggcguucagcuca

SEQ ID NO: 1302788 - RNA, 20 nt, Homo sapiens
caggcugggcuucaguggca

SEQ ID NO: 1302789 - RNA, 21 nt, Homo sapiens
caggcugugacucuucucuca

SEQ ID NO: 1302790 - RNA, 18 nt, Homo sapiens
cagggaaauggccuuccc

SEQ ID NO: 1302791 - RNA, 14 nt, Homo sapiens
cagggaacccacag

SEQ ID NO: 1302792 - RNA, 18 nt, Homo sapiens
cagggaacucuggcauuc

SEQ ID NO: 1302793 - RNA, 15 nt, Homo sapiens
cagggacuugaaguu

SEQ ID NO: 1302794 - RNA, 12 nt, Homo sapiens
cagggagacaag

SEQ ID NO: 1302795 - RNA, 15 nt, Homo sapiens
cagggagacugcauc

SEQ ID NO: 1302796 - RNA, 18 nt, Homo sapiens
cagggagacugcaucuca

SEQ ID NO: 1302797 - RNA, 17 nt, Homo sapiens
cagggaugacagauuug

SEQ ID NO: 1302798 - RNA, 16 nt, Homo sapiens
cagggcuccugcacuu

SEQ ID NO: 1302799 - RNA, 22 nt, Homo sapiens
cagggguggcugccucauuuag

SEQ ID NO: 1302800 - RNA, 12 nt, Homo sapiens
cagggucucacu

SEQ ID NO: 1302801 - RNA, 20 nt, Homo sapiens
cagggucucacuauguugcc

SEQ ID NO: 1302802 - RNA, 19 nt, Homo sapiens
cagggucucacucugucgc

SEQ ID NO: 1302803 - RNA, 21 nt, Homo sapiens
caggguuucaccauguugccc

SEQ ID NO: 1302804 - RNA, 17 nt, Homo sapiens
caggucaauacaguaca

SEQ ID NO: 1302805 - RNA, 21 nt, Homo sapiens
caggucucuccacugcucuca

SEQ ID NO: 1302806 - RNA, 20 nt, Homo sapiens
caggucuuuccuaaggcugc

SEQ ID NO: 1302807 - RNA, 13 nt, Homo sapiens
caggugaagcacc

SEQ ID NO: 1302808 - RNA, 17 nt, Homo sapiens
caggugaagcaccaagc

SEQ ID NO: 1302809 - RNA, 15 nt, Homo sapiens
caggugcagccagag

SEQ ID NO: 1302810 - RNA, 16 nt, Homo sapiens
caggugcagugugaca

SEQ ID NO: 1302811 - RNA, 16 nt, Homo sapiens
caggugccaucaucuc

SEQ ID NO: 1302812 - RNA, 14 nt, Homo sapiens
caggugccuuucaa

SEQ ID NO: 1302813 - RNA, 14 nt, Homo sapiens
caggugcugccauc

SEQ ID NO: 1302814 - RNA, 19 nt, Homo sapiens
caggugguaagcaccagga

SEQ ID NO: 1302815 - RNA, 16 nt, Homo sapiens
caggugugaaccacca

SEQ ID NO: 1302816 - RNA, 19 nt, Homo sapiens
caggugugccgacagaagg

SEQ ID NO: 1302817 - RNA, 15 nt, Homo sapiens
cagguguguauuuac

SEQ ID NO: 1302818 - RNA, 15 nt, Homo sapiens
cagguuggugggggc

SEQ ID NO: 1302819 - RNA, 21 nt, Homo sapiens
cagguuuagaggaccagugag

SEQ ID NO: 1302820 - RNA, 21 nt, Homo sapiens
caguaaauggcuuauccagcu

SEQ ID NO: 1302821 - RNA, 23 nt, Homo sapiens
caguacuugucuucaccaacacu

SEQ ID NO: 1302822 - RNA, 14 nt, Homo sapiens
caguagacugcagu

SEQ ID NO: 1302823 - RNA, 20 nt, Homo sapiens
caguagacugcaguggacag

SEQ ID NO: 1302824 - RNA, 14 nt, Homo sapiens
caguagauuuucca

SEQ ID NO: 1302825 - RNA, 22 nt, Homo sapiens
caguauaagcaucugccaucug

SEQ ID NO: 1302826 - RNA, 13 nt, Homo sapiens
cagucaaccuggg

SEQ ID NO: 1302827 - RNA, 12 nt, Homo sapiens
cagucacagcca

SEQ ID NO: 1302828 - RNA, 16 nt, Homo sapiens
cagucacugacaguua

SEQ ID NO: 1302829 - RNA, 22 nt, Homo sapiens
cagucagauuuccagucuccac

SEQ ID NO: 1302830 - RNA, 13 nt, Homo sapiens
cagucagugcugg

SEQ ID NO: 1302831 - RNA, 15 nt, Homo sapiens
cagucaucuugacca

SEQ ID NO: 1302832 - RNA, 14 nt, Homo sapiens
caguccucuuucaa

SEQ ID NO: 1302833 - RNA, 19 nt, Homo sapiens
cagucucuucuaagcaaaa

SEQ ID NO: 1302834 - RNA, 16 nt, Homo sapiens
cagucuuccacaaaga

SEQ ID NO: 1302835 - RNA, 22 nt, Homo sapiens
cagucuuccauuugcaagggaa

SEQ ID NO: 1302836 - RNA, 13 nt, Homo sapiens
cagugaagacaga

SEQ ID NO: 1302837 - RNA, 21 nt, Homo sapiens
cagugaaugauucaguguuaa

SEQ ID NO: 1302838 - RNA, 20 nt, Homo sapiens
cagugagccgagauggcgcu

SEQ ID NO: 1302839 - RNA, 18 nt, Homo sapiens
cagugaggcugcacccac

SEQ ID NO: 1302840 - RNA, 21 nt, Homo sapiens
cagugaugcuggaugcuccuu

SEQ ID NO: 1302841 - RNA, 16 nt, Homo sapiens
cagugcagcauauaca

SEQ ID NO: 1302842 - RNA, 22 nt, Homo sapiens
cagugcagcucgugauuggaaa

SEQ ID NO: 1302843 - RNA, 17 nt, Homo sapiens
cagugcaggcacaguau

SEQ ID NO: 1302844 - RNA, 22 nt, Homo sapiens
cagugccccauucucacugcua

SEQ ID NO: 1302845 - RNA, 22 nt, Homo sapiens
cagugcuccuguaagucaaaug

SEQ ID NO: 1302846 - RNA, 16 nt, Homo sapiens
cagugcuugaaugaag

SEQ ID NO: 1302847 - RNA, 18 nt, Homo sapiens
cagugggugugacauauu

SEQ ID NO: 1302848 - RNA, 22 nt, Homo sapiens
caguuaaggggagcaacagagg

SEQ ID NO: 1302849 - RNA, 16 nt, Homo sapiens
caguucaagugcucuu

SEQ ID NO: 1302850 - RNA, 12 nt, Homo sapiens
caguucagugag

SEQ ID NO: 1302851 - RNA, 20 nt, Homo sapiens
caguucugagcaccguguca

SEQ ID NO: 1302852 - RNA, 19 nt, Homo sapiens
caguucugccuuaucuaaa

SEQ ID NO: 1302853 - RNA, 22 nt, Homo sapiens
caguugacccuauuuuuugaca

SEQ ID NO: 1302854 - RNA, 22 nt, Homo sapiens
caguugauacauaguuguauau

SEQ ID NO: 1302855 - RNA, 22 nt, Homo sapiens
caguuguuaaaaugagcauuga

SEQ ID NO: 1302856 - RNA, 22 nt, Homo sapiens
caguuucagagauggacagaga

SEQ ID NO: 1302857 - RNA, 14 nt, Homo sapiens
caguuuguggcauc

SEQ ID NO: 1302858 - RNA, 17 nt, Homo sapiens
cauaaaaagacaacuca

SEQ ID NO: 1302859 - RNA, 16 nt, Homo sapiens
cauaaagacaaucacu

SEQ ID NO: 1302860 - RNA, 15 nt, Homo sapiens
cauaaagacuaagua

SEQ ID NO: 1302861 - RNA, 22 nt, Homo sapiens
cauaaagaggcguugcuuucac

SEQ ID NO: 1302862 - RNA, 22 nt, Homo sapiens
cauaaauuagaggucuccaaaa

SEQ ID NO: 1302863 - RNA, 19 nt, Homo sapiens
cauaaccuugaauaaugag

SEQ ID NO: 1302864 - RNA, 16 nt, Homo sapiens
cauaauaaagguugug

SEQ ID NO: 1302865 - RNA, 19 nt, Homo sapiens
cauaauauuucuuaaaaag

SEQ ID NO: 1302866 - RNA, 16 nt, Homo sapiens
cauaauuuacaugcaa

SEQ ID NO: 1302867 - RNA, 17 nt, Homo sapiens
cauacauaggauggcug

SEQ ID NO: 1302868 - RNA, 23 nt, Homo sapiens
cauacauugauucaugucucacg

SEQ ID NO: 1302869 - RNA, 22 nt, Homo sapiens
cauaccaaugaaaaaauguaua

SEQ ID NO: 1302870 - RNA, 19 nt, Homo sapiens
cauaccacccaaugcugau

SEQ ID NO: 1302871 - RNA, 19 nt, Homo sapiens
cauacgagagcagaggucu

SEQ ID NO: 1302872 - RNA, 14 nt, Homo sapiens
cauacgucagcauu

SEQ ID NO: 1302873 - RNA, 10 nt, Homo sapiens
cauacugcug

SEQ ID NO: 1302874 - RNA, 12 nt, Homo sapiens
cauagaaaaacu

SEQ ID NO: 1302875 - RNA, 23 nt, Homo sapiens
cauagaaaaauucagcaaaccau

SEQ ID NO: 1302876 - RNA, 14 nt, Homo sapiens
cauagaagagccaa

SEQ ID NO: 1302877 - RNA, 16 nt, Homo sapiens
cauagauguuaugcaa

SEQ ID NO: 1302878 - RNA, 13 nt, Homo sapiens
cauagauguuucc

SEQ ID NO: 1302879 - RNA, 18 nt, Homo sapiens
cauagcagcugcuacuag

SEQ ID NO: 1302880 - RNA, 15 nt, Homo sapiens
cauauucuaaaacca

SEQ ID NO: 1302881 - RNA, 15 nt, Homo sapiens
cauauuuaacaugua

SEQ ID NO: 1302882 - RNA, 22 nt, Homo sapiens
caucaagaugagagaacuggag

SEQ ID NO: 1302883 - RNA, 18 nt, Homo sapiens
caucaaggcacugccuga

SEQ ID NO: 1302884 - RNA, 22 nt, Homo sapiens
caucaaggcacugccugaugga

SEQ ID NO: 1302885 - RNA, 21 nt, Homo sapiens
caucaagucuuucacauuuaa

SEQ ID NO: 1302886 - RNA, 14 nt, Homo sapiens
caucacugguugca

SEQ ID NO: 1302887 - RNA, 17 nt, Homo sapiens
caucacuuccuugcccc

SEQ ID NO: 1302888 - RNA, 11 nt, Homo sapiens
caucaguccau

SEQ ID NO: 1302889 - RNA, 17 nt, Homo sapiens
caucagugcucccucac

SEQ ID NO: 1302890 - RNA, 19 nt, Homo sapiens
caucaucuccugccuuccu

SEQ ID NO: 1302891 - RNA, 13 nt, Homo sapiens
caucauuccuuga

SEQ ID NO: 1302892 - RNA, 17 nt, Homo sapiens
caucauucucugucuca

SEQ ID NO: 1302893 - RNA, 19 nt, Homo sapiens
cauccaaugcucaagaaac

SEQ ID NO: 1302894 - RNA, 16 nt, Homo sapiens
cauccacuagugcaaa

SEQ ID NO: 1302895 - RNA, 19 nt, Homo sapiens
cauccagaacugcuaccuu

SEQ ID NO: 1302896 - RNA, 23 nt, Homo sapiens
caucccaggaucgcaagagccau

SEQ ID NO: 1302897 - RNA, 15 nt, Homo sapiens
caucccuaaugcugc

SEQ ID NO: 1302898 - RNA, 15 nt, Homo sapiens
cauccucaaacacug

SEQ ID NO: 1302899 - RNA, 16 nt, Homo sapiens
cauccucaaacacugc

SEQ ID NO: 1302900 - RNA, 19 nt, Homo sapiens
cauccucacugcugucaac

SEQ ID NO: 1302901 - RNA, 18 nt, Homo sapiens
cauccugcaggcagcuuu

SEQ ID NO: 1302902 - RNA, 20 nt, Homo sapiens
cauccugggcagcauacuga

SEQ ID NO: 1302903 - RNA, 22 nt, Homo sapiens
caucuaaccucaucuucuucac

SEQ ID NO: 1302904 - RNA, 12 nt, Homo sapiens
caucuaccugag

SEQ ID NO: 1302905 - RNA, 19 nt, Homo sapiens
caucuagcgcaauugaagg

SEQ ID NO: 1302906 - RNA, 21 nt, Homo sapiens
caucuauuuuggauuguauau

SEQ ID NO: 1302907 - RNA, 21 nt, Homo sapiens
caucucaauggaaacaucacu

SEQ ID NO: 1302908 - RNA, 13 nt, Homo sapiens
caucucuacaaaa

SEQ ID NO: 1302909 - RNA, 18 nt, Homo sapiens
caucucuggaugccugau

SEQ ID NO: 1302910 - RNA, 16 nt, Homo sapiens
caucucuuuaccuggg

SEQ ID NO: 1302911 - RNA, 18 nt, Homo sapiens
caucugcaugucuacuca

SEQ ID NO: 1302912 - RNA, 15 nt, Homo sapiens
caucugcauugccca

SEQ ID NO: 1302913 - RNA, 17 nt, Homo sapiens
caucugcccaacugugu

SEQ ID NO: 1302914 - RNA, 22 nt, Homo sapiens
caucugugcacugcccauggac

SEQ ID NO: 1302915 - RNA, 23 nt, Homo sapiens
caucuugcucugcugacagacac

SEQ ID NO: 1302916 - RNA, 11 nt, Homo sapiens
caucuuucaua

SEQ ID NO: 1302917 - RNA, 21 nt, Homo sapiens
caucuuucuucuauuuuauuc

SEQ ID NO: 1302918 - RNA, 21 nt, Homo sapiens
caugaaaaauugcuaugacua

SEQ ID NO: 1302919 - RNA, 22 nt, Homo sapiens
caugaacaucuuuagugucuga

SEQ ID NO: 1302920 - RNA, 16 nt, Homo sapiens
caugacauugcauuug

SEQ ID NO: 1302921 - RNA, 15 nt, Homo sapiens
caugagucagucuga

SEQ ID NO: 1302922 - RNA, 14 nt, Homo sapiens
caugaucaucacaa

SEQ ID NO: 1302923 - RNA, 13 nt, Homo sapiens
caugauccaagca

SEQ ID NO: 1302924 - RNA, 15 nt, Homo sapiens
caugauccaagcaag

SEQ ID NO: 1302925 - RNA, 21 nt, Homo sapiens
caugauccaagcaagacugag

SEQ ID NO: 1302926 - RNA, 18 nt, Homo sapiens
caugaugaccugaaguuc

SEQ ID NO: 1302927 - RNA, 18 nt, Homo sapiens
caugauggcaacagaucu

SEQ ID NO: 1302928 - RNA, 21 nt, Homo sapiens
caugauguuuuaagcugcuaa

SEQ ID NO: 1302929 - RNA, 16 nt, Homo sapiens
caugauuuccuugaau

SEQ ID NO: 1302930 - RNA, 18 nt, Homo sapiens
caugcaccuguagucuca

SEQ ID NO: 1302931 - RNA, 14 nt, Homo sapiens
caugccaagcacug

SEQ ID NO: 1302932 - RNA, 18 nt, Homo sapiens
caugccaagcacugugcu

SEQ ID NO: 1302933 - RNA, 14 nt, Homo sapiens
caugcccaugauga

SEQ ID NO: 1302934 - RNA, 16 nt, Homo sapiens
caugcccugugcaacc

SEQ ID NO: 1302935 - RNA, 12 nt, Homo sapiens
caugcucuccaa

SEQ ID NO: 1302936 - RNA, 15 nt, Homo sapiens
caugcucuugaccuu

SEQ ID NO: 1302937 - RNA, 18 nt, Homo sapiens
caugcugaagccaaagcc

SEQ ID NO: 1302938 - RNA, 21 nt, Homo sapiens
caugcuuugacaaauuacaaa

SEQ ID NO: 1302939 - RNA, 15 nt, Homo sapiens
cauggaauauuucca

SEQ ID NO: 1302940 - RNA, 19 nt, Homo sapiens
cauggaccaagaaugagcu

SEQ ID NO: 1302941 - RNA, 14 nt, Homo sapiens
cauggcccugccau

SEQ ID NO: 1302942 - RNA, 14 nt, Homo sapiens
caugggaaggggag

SEQ ID NO: 1302943 - RNA, 20 nt, Homo sapiens
caugggaaggggaggacccc

SEQ ID NO: 1302944 - RNA, 13 nt, Homo sapiens
caugggaucucau

SEQ ID NO: 1302945 - RNA, 22 nt, Homo sapiens
cauggguggauuuagccaagga

SEQ ID NO: 1302946 - RNA, 16 nt, Homo sapiens
cauggugccccaggac

SEQ ID NO: 1302947 - RNA, 22 nt, Homo sapiens
caugguggaaaacgaagcucau

SEQ ID NO: 1302948 - RNA, 15 nt, Homo sapiens
cauguaaacauacca

SEQ ID NO: 1302949 - RNA, 20 nt, Homo sapiens
caugucacuccagcagcaca

SEQ ID NO: 1302950 - RNA, 16 nt, Homo sapiens
caugucuuugcugcag

SEQ ID NO: 1302951 - RNA, 18 nt, Homo sapiens
caugugacucugaagcug

SEQ ID NO: 1302952 - RNA, 17 nt, Homo sapiens
caugugcaaaugugcug

SEQ ID NO: 1302953 - RNA, 22 nt, Homo sapiens
caugugcaaaugugcuggucac

SEQ ID NO: 1302954 - RNA, 14 nt, Homo sapiens
caugugcacaugca

SEQ ID NO: 1302955 - RNA, 23 nt, Homo sapiens
cauguggcuccucccagcccaua

SEQ ID NO: 1302956 - RNA, 14 nt, Homo sapiens
caugugggcugugg

SEQ ID NO: 1302957 - RNA, 21 nt, Homo sapiens
cauguuaggaaaauuucacau

SEQ ID NO: 1302958 - RNA, 16 nt, Homo sapiens
cauguugaccaugucu

SEQ ID NO: 1302959 - RNA, 22 nt, Homo sapiens
cauguuggccaggcuggucuca

SEQ ID NO: 1302960 - RNA, 21 nt, Homo sapiens
cauguugugauguacacauuu

SEQ ID NO: 1302961 - RNA, 17 nt, Homo sapiens
cauguuuaaaccugaca

SEQ ID NO: 1302962 - RNA, 20 nt, Homo sapiens
cauguuuguuucuguagaaa

SEQ ID NO: 1302963 - RNA, 19 nt, Homo sapiens
cauguuuuaacaaaaacca

SEQ ID NO: 1302964 - RNA, 12 nt, Homo sapiens
cauuaaagccau

SEQ ID NO: 1302965 - RNA, 15 nt, Homo sapiens
cauuaaauaaugcau

SEQ ID NO: 1302966 - RNA, 18 nt, Homo sapiens
cauuaaugacacuugucc

SEQ ID NO: 1302967 - RNA, 12 nt, Homo sapiens
cauuacagggaa

SEQ ID NO: 1302968 - RNA, 20 nt, Homo sapiens
cauuacagggaaugccugag

SEQ ID NO: 1302969 - RNA, 17 nt, Homo sapiens
cauuacugcauaaaaua

SEQ ID NO: 1302970 - RNA, 16 nt, Homo sapiens
cauuagaauagucaua

SEQ ID NO: 1302971 - RNA, 20 nt, Homo sapiens
cauuagauagucaugcugcu

SEQ ID NO: 1302972 - RNA, 23 nt, Homo sapiens
cauuagggggaacucuagccaaa

SEQ ID NO: 1302973 - RNA, 19 nt, Homo sapiens
cauuauuuuauuauaacau

SEQ ID NO: 1302974 - RNA, 23 nt, Homo sapiens
cauuauuuuauuauaacauccac

SEQ ID NO: 1302975 - RNA, 18 nt, Homo sapiens
cauucaacugaacaacua

SEQ ID NO: 1302976 - RNA, 23 nt, Homo sapiens
cauuccaaaguucaacuugguga

SEQ ID NO: 1302977 - RNA, 23 nt, Homo sapiens
cauucccaacgugcaaagccaag

SEQ ID NO: 1302978 - RNA, 13 nt, Homo sapiens
cauuccuuuuccc

SEQ ID NO: 1302979 - RNA, 16 nt, Homo sapiens
cauucugcaaguauac

SEQ ID NO: 1302980 - RNA, 12 nt, Homo sapiens
cauucugcauuu

SEQ ID NO: 1302981 - RNA, 16 nt, Homo sapiens
cauucuuaacaaacuc

SEQ ID NO: 1302982 - RNA, 14 nt, Homo sapiens
cauugagcaguaua

SEQ ID NO: 1302983 - RNA, 19 nt, Homo sapiens
cauugauucaguauuacaa

SEQ ID NO: 1302984 - RNA, 16 nt, Homo sapiens
cauugauucaugucuc

SEQ ID NO: 1302985 - RNA, 18 nt, Homo sapiens
cauugcccagucuuucau

SEQ ID NO: 1302986 - RNA, 16 nt, Homo sapiens
cauugccuuugaaugu

SEQ ID NO: 1302987 - RNA, 21 nt, Homo sapiens
cauuggaggggcuggcacugg

SEQ ID NO: 1302988 - RNA, 22 nt, Homo sapiens
cauugguuaauuuuuacaugga

SEQ ID NO: 1302989 - RNA, 18 nt, Homo sapiens
cauuguccugugaaauau

SEQ ID NO: 1302990 - RNA, 22 nt, Homo sapiens
cauugugagacacuaaaaacug

SEQ ID NO: 1302991 - RNA, 21 nt, Homo sapiens
cauuguuuuguguaacauauu

SEQ ID NO: 1302992 - RNA, 14 nt, Homo sapiens
cauuuaauauggau

SEQ ID NO: 1302993 - RNA, 19 nt, Homo sapiens
cauuuagaugcacuaccau

SEQ ID NO: 1302994 - RNA, 21 nt, Homo sapiens
cauuuauaauuauuuauguga

SEQ ID NO: 1302995 - RNA, 18 nt, Homo sapiens
cauuucauauucuuucaa

SEQ ID NO: 1302996 - RNA, 16 nt, Homo sapiens
cauuucugagaucaaa

SEQ ID NO: 1302997 - RNA, 13 nt, Homo sapiens
cauuugcaccuac

SEQ ID NO: 1302998 - RNA, 22 nt, Homo sapiens
cauuuggagagggggccuggga

SEQ ID NO: 1302999 - RNA, 16 nt, Homo sapiens
cauuuggcaaugccau

SEQ ID NO: 1303000 - RNA, 21 nt, Homo sapiens
cauuuuaggcaaauguuuaaa

SEQ ID NO: 1303001 - RNA, 15 nt, Homo sapiens
cauuuugauauacca

SEQ ID NO: 1303002 - RNA, 21 nt, Homo sapiens
agcaugucgucaaagcugaaa

SEQ ID NO: 1303003 - RNA, 21 nt, Homo sapiens
agcaugugaugggcuguuuaa

SEQ ID NO: 1303004 - RNA, 15 nt, Homo sapiens
agcauuacccuccuc

SEQ ID NO: 1303005 - RNA, 18 nt, Homo sapiens
agcauuuuuaaucugugu

SEQ ID NO: 1303006 - RNA, 22 nt, Homo sapiens
agcauuuuuaaucuguguaaac

SEQ ID NO: 1303007 - RNA, 20 nt, Homo sapiens
agccaaacagagcccaggga

SEQ ID NO: 1303008 - RNA, 12 nt, Homo sapiens
agccaaacccac

SEQ ID NO: 1303009 - RNA, 14 nt, Homo sapiens
agccaaaugguuua

SEQ ID NO: 1303010 - RNA, 14 nt, Homo sapiens
agccaacuuuugca

SEQ ID NO: 1303011 - RNA, 20 nt, Homo sapiens
agccaagaugacacaacugc

SEQ ID NO: 1303012 - RNA, 22 nt, Homo sapiens
agccaaggcaggcagaucacuu

SEQ ID NO: 1303013 - RNA, 18 nt, Homo sapiens
agccaaguuuauauacaa

SEQ ID NO: 1303014 - RNA, 18 nt, Homo sapiens
agccaauucagacaggca

SEQ ID NO: 1303015 - RNA, 15 nt, Homo sapiens
agccacaccaggaua

SEQ ID NO: 1303016 - RNA, 12 nt, Homo sapiens
agccacacucug

SEQ ID NO: 1303017 - RNA, 11 nt, Homo sapiens
agccacaggcc

SEQ ID NO: 1303018 - RNA, 20 nt, Homo sapiens
agccacugccacuccagucc

SEQ ID NO: 1303019 - RNA, 17 nt, Homo sapiens
agccacugguuucucag

SEQ ID NO: 1303020 - RNA, 14 nt, Homo sapiens
agccagaagcugag

SEQ ID NO: 1303021 - RNA, 14 nt, Homo sapiens
agccagaaucucau

SEQ ID NO: 1303022 - RNA, 14 nt, Homo sapiens
agccagcaaccagc

SEQ ID NO: 1303023 - RNA, 19 nt, Homo sapiens
agccagcaaccagcacauc

SEQ ID NO: 1303024 - RNA, 16 nt, Homo sapiens
agccagccuugcuccu

SEQ ID NO: 1303025 - RNA, 18 nt, Homo sapiens
agccaggagcgcaucuca

SEQ ID NO: 1303026 - RNA, 22 nt, Homo sapiens
agccagggggaugccacuccuc

SEQ ID NO: 1303027 - RNA, 17 nt, Homo sapiens
agccauaugaaugucag

SEQ ID NO: 1303028 - RNA, 20 nt, Homo sapiens
agccauguaaucagauuuau

SEQ ID NO: 1303029 - RNA, 21 nt, Homo sapiens
agccaugugaaacucaucuca

SEQ ID NO: 1303030 - RNA, 12 nt, Homo sapiens
agccauugcacc

SEQ ID NO: 1303031 - RNA, 20 nt, Homo sapiens
agccauuuuucaaagcaauu

SEQ ID NO: 1303032 - RNA, 19 nt, Homo sapiens
agcccaccccucaacaccu

SEQ ID NO: 1303033 - RNA, 20 nt, Homo sapiens
agcccagaaaaccuccagua

SEQ ID NO: 1303034 - RNA, 20 nt, Homo sapiens
agcccagagacauacuugaa

SEQ ID NO: 1303035 - RNA, 20 nt, Homo sapiens
agcccagaggccaacacugu

SEQ ID NO: 1303036 - RNA, 19 nt, Homo sapiens
agcccagcugggucaggca

SEQ ID NO: 1303037 - RNA, 15 nt, Homo sapiens
agccccaucugucua

SEQ ID NO: 1303038 - RNA, 22 nt, Homo sapiens
agccccauucugccugcccagg

SEQ ID NO: 1303039 - RNA, 22 nt, Homo sapiens
agcccccagcuaagaaccugga

SEQ ID NO: 1303040 - RNA, 22 nt, Homo sapiens
agccccuuacuaugaucucagg

SEQ ID NO: 1303041 - RNA, 23 nt, Homo sapiens
agccccuuacuaugaucucagga

SEQ ID NO: 1303042 - RNA, 17 nt, Homo sapiens
agccccuucugcucagc

SEQ ID NO: 1303043 - RNA, 19 nt, Homo sapiens
agcccgugcccuaccacac

SEQ ID NO: 1303044 - RNA, 16 nt, Homo sapiens
agcccuaagacguccc

SEQ ID NO: 1303045 - RNA, 13 nt, Homo sapiens
agcccucacauua

SEQ ID NO: 1303046 - RNA, 15 nt, Homo sapiens
agcccucacauuaga

SEQ ID NO: 1303047 - RNA, 17 nt, Homo sapiens
agcccugggaucacugu

SEQ ID NO: 1303048 - RNA, 16 nt, Homo sapiens
agccgacaacagagac

SEQ ID NO: 1303049 - RNA, 21 nt, Homo sapiens
agccgagaucacgccacugca

SEQ ID NO: 1303050 - RNA, 16 nt, Homo sapiens
agccgaggccuacccc

SEQ ID NO: 1303051 - RNA, 18 nt, Homo sapiens
agccgccaguacuuguca

SEQ ID NO: 1303052 - RNA, 20 nt, Homo sapiens
agccuaaaagugggcuugau

SEQ ID NO: 1303053 - RNA, 16 nt, Homo sapiens
agccuaggugacagag

SEQ ID NO: 1303054 - RNA, 23 nt, Homo sapiens
agccuauguaugccauggaggca

SEQ ID NO: 1303055 - RNA, 19 nt, Homo sapiens
agccucccaaguagcugag

SEQ ID NO: 1303056 - RNA, 15 nt, Homo sapiens
agccucgccuuccau

SEQ ID NO: 1303057 - RNA, 16 nt, Homo sapiens
agccucugaaaaccaa

SEQ ID NO: 1303058 - RNA, 22 nt, Homo sapiens
agccugaguagaaaggccuuua

SEQ ID NO: 1303059 - RNA, 18 nt, Homo sapiens
agccugagucaccugcag

SEQ ID NO: 1303060 - RNA, 18 nt, Homo sapiens
agccugccuguccuccag

SEQ ID NO: 1303061 - RNA, 17 nt, Homo sapiens
agccugcuccagcuguu

SEQ ID NO: 1303062 - RNA, 14 nt, Homo sapiens
agccugcuuucaca

SEQ ID NO: 1303063 - RNA, 22 nt, Homo sapiens
agccuggccagccuacaauggg

SEQ ID NO: 1303064 - RNA, 15 nt, Homo sapiens
agccugggcaaugug

SEQ ID NO: 1303065 - RNA, 16 nt, Homo sapiens
agccuggugcugcugc

SEQ ID NO: 1303066 - RNA, 19 nt, Homo sapiens
agccuuagaagucacacag

SEQ ID NO: 1303067 - RNA, 22 nt, Homo sapiens
agccuuaggaaggccuucagga

SEQ ID NO: 1303068 - RNA, 20 nt, Homo sapiens
agccuuccguauccaucgaa

SEQ ID NO: 1303069 - RNA, 18 nt, Homo sapiens
agcgaggaggcuccagag

SEQ ID NO: 1303070 - RNA, 18 nt, Homo sapiens
agcgauucuccugccuca

SEQ ID NO: 1303071 - RNA, 22 nt, Homo sapiens
agcgccuuucccaacucuagcu

SEQ ID NO: 1303072 - RNA, 17 nt, Homo sapiens
agcggaaagcagcucaa

SEQ ID NO: 1303073 - RNA, 11 nt, Homo sapiens
agcggacauca

SEQ ID NO: 1303074 - RNA, 15 nt, Homo sapiens
agcguggacaggugu

SEQ ID NO: 1303075 - RNA, 18 nt, Homo sapiens
agcuaaacggauuccaaa

SEQ ID NO: 1303076 - RNA, 23 nt, Homo sapiens
agcuaacccucacaagcaugaag

SEQ ID NO: 1303077 - RNA, 23 nt, Homo sapiens
agcuaauauacagucaguucuca

SEQ ID NO: 1303078 - RNA, 21 nt, Homo sapiens
agcuacaccuuucuccuuugu

SEQ ID NO: 1303079 - RNA, 21 nt, Homo sapiens
agcuacugccgucagugcugu

SEQ ID NO: 1303080 - RNA, 23 nt, Homo sapiens
agcuacugugugugugaaugaac

SEQ ID NO: 1303081 - RNA, 19 nt, Homo sapiens
agcuagaggaaccaacccc

SEQ ID NO: 1303082 - RNA, 12 nt, Homo sapiens
agcuagccagag

SEQ ID NO: 1303083 - RNA, 18 nt, Homo sapiens
agcuaggccuggccagau

SEQ ID NO: 1303084 - RNA, 16 nt, Homo sapiens
agcuauaacuaagcau

SEQ ID NO: 1303085 - RNA, 15 nt, Homo sapiens
agcuauaacuuacuu

SEQ ID NO: 1303086 - RNA, 21 nt, Homo sapiens
agcuaucugccugacaggcug

SEQ ID NO: 1303087 - RNA, 12 nt, Homo sapiens
agcucaccagcc

SEQ ID NO: 1303088 - RNA, 14 nt, Homo sapiens
agcucacuguucua

SEQ ID NO: 1303089 - RNA, 19 nt, Homo sapiens
agcucagcauuuccacacc

SEQ ID NO: 1303090 - RNA, 14 nt, Homo sapiens
agcucaggaucucu

SEQ ID NO: 1303091 - RNA, 22 nt, Homo sapiens
agcucaggugucccugcacuug

SEQ ID NO: 1303092 - RNA, 17 nt, Homo sapiens
agcucauccccuuggcu

SEQ ID NO: 1303093 - RNA, 22 nt, Homo sapiens
agcucauucccaacgugcaaag

SEQ ID NO: 1303094 - RNA, 21 nt, Homo sapiens
agcuccacccuggccgagucc

SEQ ID NO: 1303095 - RNA, 14 nt, Homo sapiens
agcucccaagggau

SEQ ID NO: 1303096 - RNA, 21 nt, Homo sapiens
agcucccaagggauggugccc

SEQ ID NO: 1303097 - RNA, 22 nt, Homo sapiens
agcuccccaggacucacccuca

SEQ ID NO: 1303098 - RNA, 18 nt, Homo sapiens
agcuccgcuuucuaccca

SEQ ID NO: 1303099 - RNA, 23 nt, Homo sapiens
agcuccucagcggcuccagcuca

SEQ ID NO: 1303100 - RNA, 20 nt, Homo sapiens
agcucgggcccucugugaga

SEQ ID NO: 1303101 - RNA, 15 nt, Homo sapiens
agcucuaguucaaau

SEQ ID NO: 1303102 - RNA, 15 nt, Homo sapiens
agcucuccccucaga

SEQ ID NO: 1303103 - RNA, 23 nt, Homo sapiens
agcucuccccucagagugcaagc

SEQ ID NO: 1303104 - RNA, 13 nt, Homo sapiens
uuaaaacagaagc

SEQ ID NO: 1303105 - RNA, 11 nt, Homo sapiens
uuaaaacuauu

SEQ ID NO: 1303106 - RNA, 14 nt, Homo sapiens
uuaaaagucucaca

SEQ ID NO: 1303107 - RNA, 21 nt, Homo sapiens
uuaaaauacugauacauccau

SEQ ID NO: 1303108 - RNA, 13 nt, Homo sapiens
uuaaaaucuguca

SEQ ID NO: 1303109 - RNA, 18 nt, Homo sapiens
uuaaaaucugucacguag

SEQ ID NO: 1303110 - RNA, 15 nt, Homo sapiens
uuaaaaugagcauug

SEQ ID NO: 1303111 - RNA, 23 nt, Homo sapiens
uuaaaaugcaaaauaaugucuua

SEQ ID NO: 1303112 - RNA, 20 nt, Homo sapiens
uuaaacagaugugaauauuc

SEQ ID NO: 1303113 - RNA, 13 nt, Homo sapiens
uuaaacaugagaa

SEQ ID NO: 1303114 - RNA, 22 nt, Homo sapiens
uuaaacuagcauaucugccuuu

SEQ ID NO: 1303115 - RNA, 11 nt, Homo sapiens
uuaaacucugu

SEQ ID NO: 1303116 - RNA, 22 nt, Homo sapiens
uuaaacuuagacagcauguaug

SEQ ID NO: 1303117 - RNA, 13 nt, Homo sapiens
uuaaacuugaauu

SEQ ID NO: 1303118 - RNA, 21 nt, Homo sapiens
uucaacuuugaauaaagaaua

SEQ ID NO: 1303119 - RNA, 20 nt, Homo sapiens
uucaagaccagccugaccaa

SEQ ID NO: 1303120 - RNA, 15 nt, Homo sapiens
uucaagagugagcua

SEQ ID NO: 1303121 - RNA, 23 nt, Homo sapiens
uucaagcagucgugccugugucc

SEQ ID NO: 1303122 - RNA, 12 nt, Homo sapiens
uucaagccauuc

SEQ ID NO: 1303123 - RNA, 19 nt, Homo sapiens
uucaaggccuucaguuuau

SEQ ID NO: 1303124 - RNA, 14 nt, Homo sapiens
uucaaguacuguaa

SEQ ID NO: 1303125 - RNA, 19 nt, Homo sapiens
uucaaguacuguaacugug

SEQ ID NO: 1303126 - RNA, 15 nt, Homo sapiens
uucaauaaccaugau

SEQ ID NO: 1303127 - RNA, 13 nt, Homo sapiens
uucaauguauuga

SEQ ID NO: 1303128 - RNA, 12 nt, Homo sapiens
aucugagugaaa

SEQ ID NO: 1303129 - RNA, 13 nt, Homo sapiens
aucugagugaaau

SEQ ID NO: 1303130 - RNA, 18 nt, Homo sapiens
aucugcauuuucacccca

SEQ ID NO: 1303131 - RNA, 15 nt, Homo sapiens
aucugccaucugcuu

SEQ ID NO: 1303132 - RNA, 14 nt, Homo sapiens
aucugccaugugaa

SEQ ID NO: 1303133 - RNA, 18 nt, Homo sapiens
aucuggaacccagacuca

SEQ ID NO: 1303134 - RNA, 23 nt, Homo sapiens
aucugggcauagaugcaggugag

SEQ ID NO: 1303135 - RNA, 22 nt, Homo sapiens
aucugggcuaccccacccaagu

SEQ ID NO: 1303136 - RNA, 17 nt, Homo sapiens
aucuguacaaaggggaa

SEQ ID NO: 1303137 - RNA, 23 nt, Homo sapiens
aucuguauauacaauaacauaau

SEQ ID NO: 1303138 - RNA, 17 nt, Homo sapiens
aucugugcaaauccuug

SEQ ID NO: 1303139 - RNA, 22 nt, Homo sapiens
aucugugcaaauccuugauacu

SEQ ID NO: 1303140 - RNA, 20 nt, Homo sapiens
aucugugcucaggacucaga

SEQ ID NO: 1303141 - RNA, 21 nt, Homo sapiens
aucugugggucugggagucac

SEQ ID NO: 1303142 - RNA, 19 nt, Homo sapiens
aucuguucuaacauguaau

SEQ ID NO: 1303143 - RNA, 17 nt, Homo sapiens
aucuguuuguagccaca

SEQ ID NO: 1303144 - RNA, 15 nt, Homo sapiens
aucuuagugccuuua

SEQ ID NO: 1303145 - RNA, 22 nt, Homo sapiens
aucuucagggaacugcauagau

SEQ ID NO: 1303146 - RNA, 16 nt, Homo sapiens
aucuucgggaccagga

SEQ ID NO: 1303147 - RNA, 22 nt, Homo sapiens
aucuucuaaacccaauccaaau

SEQ ID NO: 1303148 - RNA, 22 nt, Homo sapiens
aucuugaaauuaagaaggcaaa

SEQ ID NO: 1303149 - RNA, 23 nt, Homo sapiens
aucuugcauccaaaccuguaacc

SEQ ID NO: 1303150 - RNA, 15 nt, Homo sapiens
aucuuguaggaucua

SEQ ID NO: 1303151 - RNA, 23 nt, Homo sapiens
aucuuguuuuuccacuacugcua

SEQ ID NO: 1303152 - RNA, 20 nt, Homo sapiens
aucuuuacaaaacuacauga

SEQ ID NO: 1303153 - RNA, 18 nt, Homo sapiens
aucuuugauucuccuuca

SEQ ID NO: 1303154 - RNA, 12 nt, Homo sapiens
aucuuugcagac

SEQ ID NO: 1303155 - RNA, 18 nt, Homo sapiens
augaaaauaaaucaucuu

SEQ ID NO: 1303156 - RNA, 15 nt, Homo sapiens
augaaacaaacugga

SEQ ID NO: 1303157 - RNA, 21 nt, Homo sapiens
augaaacacuuucaggaccuu

SEQ ID NO: 1303158 - RNA, 16 nt, Homo sapiens
augaaagggcaaagac

SEQ ID NO: 1303159 - RNA, 16 nt, Homo sapiens
augaaaguggacaagg

SEQ ID NO: 1303160 - RNA, 13 nt, Homo sapiens
augaaauaugcau

SEQ ID NO: 1303161 - RNA, 22 nt, Homo sapiens
augaaaugaggucagagccugc

SEQ ID NO: 1303162 - RNA, 18 nt, Homo sapiens
augaaauguaugugcucu

SEQ ID NO: 1303163 - RNA, 20 nt, Homo sapiens
augaacuauggacggugcuc

SEQ ID NO: 1303164 - RNA, 22 nt, Homo sapiens
augaacuuguaaaggaauuuaa

SEQ ID NO: 1303165 - RNA, 13 nt, Homo sapiens
augaagguaauau

SEQ ID NO: 1303166 - RNA, 16 nt, Homo sapiens
augaauggcagaugug

SEQ ID NO: 1303167 - RNA, 17 nt, Homo sapiens
augacagccagagccug

SEQ ID NO: 1303168 - RNA, 21 nt, Homo sapiens
augacaugcacucagcucuug

SEQ ID NO: 1303169 - RNA, 13 nt, Homo sapiens
augacauucaugc

SEQ ID NO: 1303170 - RNA, 23 nt, Homo sapiens
augacauuuuuuuuaacuacuau

SEQ ID NO: 1303171 - RNA, 18 nt, Homo sapiens
augaccauaaccacugaa

SEQ ID NO: 1303172 - RNA, 19 nt, Homo sapiens
augacuucagcaguggcag

SEQ ID NO: 1303173 - RNA, 15 nt, Homo sapiens
augagagaacuggag

SEQ ID NO: 1303174 - RNA, 20 nt, Homo sapiens
augagaguagagggcacugg

SEQ ID NO: 1303175 - RNA, 19 nt, Homo sapiens
augagauuccagguccuga

SEQ ID NO: 1303176 - RNA, 20 nt, Homo sapiens
augagcaucccaggaucgca

SEQ ID NO: 1303177 - RNA, 17 nt, Homo sapiens
augaggagcugcagauu

SEQ ID NO: 1303178 - RNA, 17 nt, Homo sapiens
augaggaucaacuguac

SEQ ID NO: 1303179 - RNA, 14 nt, Homo sapiens
augaggcugcuuau

SEQ ID NO: 1303180 - RNA, 23 nt, Homo sapiens
augaucaacucauuccagcuuuc

SEQ ID NO: 1303181 - RNA, 23 nt, Homo sapiens
augauccaagcaagacugagggg

SEQ ID NO: 1303182 - RNA, 15 nt, Homo sapiens
augaugauaguauaa

SEQ ID NO: 1303183 - RNA, 15 nt, Homo sapiens
augaugcaaacugug

SEQ ID NO: 1303184 - RNA, 16 nt, Homo sapiens
augauggcaacagauc

SEQ ID NO: 1303185 - RNA, 16 nt, Homo sapiens
augauggcagugguuu

SEQ ID NO: 1303186 - RNA, 22 nt, Homo sapiens
augauggcucauuuacacucag

SEQ ID NO: 1303187 - RNA, 11 nt, Homo sapiens
augauguuucg

SEQ ID NO: 1303188 - RNA, 15 nt, Homo sapiens
augauguuugcccaa

SEQ ID NO: 1303189 - RNA, 13 nt, Homo sapiens
augauucaagcca

SEQ ID NO: 1303190 - RNA, 19 nt, Homo sapiens
augauucaagccauuccaa

SEQ ID NO: 1303191 - RNA, 19 nt, Homo sapiens
augauuucagaaauguuaa

SEQ ID NO: 1303192 - RNA, 17 nt, Homo sapiens
augcaaaauccugguga

SEQ ID NO: 1303193 - RNA, 19 nt, Homo sapiens
augcaauguaagcauacuu

SEQ ID NO: 1303194 - RNA, 13 nt, Homo sapiens
augcaccuaccca

SEQ ID NO: 1303195 - RNA, 12 nt, Homo sapiens
augcacugugaa

SEQ ID NO: 1303196 - RNA, 19 nt, Homo sapiens
augcagcagggaugcccug

SEQ ID NO: 1303197 - RNA, 22 nt, Homo sapiens
augcagcgccguguccucucug

SEQ ID NO: 1303198 - RNA, 13 nt, Homo sapiens
augcagcgugaag

SEQ ID NO: 1303199 - RNA, 16 nt, Homo sapiens
augcauaaaugcgauc

SEQ ID NO: 1303200 - RNA, 19 nt, Homo sapiens
augcauguuuguuguauac

SEQ ID NO: 1303201 - RNA, 15 nt, Homo sapiens
augcauucaccugcc

SEQ ID NO: 1303202 - RNA, 11 nt, Homo sapiens
augccaaaaaa

SEQ ID NO: 1303203 - RNA, 16 nt, Homo sapiens
augccaagcacugugc

SEQ ID NO: 1303204 - RNA, 20 nt, Homo sapiens
augccacccacaucuuccau

SEQ ID NO: 1303205 - RNA, 17 nt, Homo sapiens
augccaccuccuggaag

SEQ ID NO: 1303206 - RNA, 17 nt, Homo sapiens
augccagcuuaucucag

SEQ ID NO: 1303207 - RNA, 19 nt, Homo sapiens
augccagcuuaucucaggg

SEQ ID NO: 1303208 - RNA, 13 nt, Homo sapiens
augcccagcugua

SEQ ID NO: 1303209 - RNA, 17 nt, Homo sapiens
augcccccucagugagg

SEQ ID NO: 1303210 - RNA, 19 nt, Homo sapiens
augcccuguaccugugcac

SEQ ID NO: 1303211 - RNA, 21 nt, Homo sapiens
augccgagcguccucuuggcu

SEQ ID NO: 1303212 - RNA, 22 nt, Homo sapiens
augccucugcucccaacuucgc

SEQ ID NO: 1303213 - RNA, 21 nt, Homo sapiens
augccugacuagggagccaug

SEQ ID NO: 1303214 - RNA, 16 nt, Homo sapiens
augccugauugccaag

SEQ ID NO: 1303215 - RNA, 17 nt, Homo sapiens
augccugauugccaagc

SEQ ID NO: 1303216 - RNA, 15 nt, Homo sapiens
augccuguccugaaa

SEQ ID NO: 1303217 - RNA, 18 nt, Homo sapiens
augcuagggugagguuua

SEQ ID NO: 1303218 - RNA, 20 nt, Homo sapiens
augcuauguucugucuuccc

SEQ ID NO: 1303219 - RNA, 13 nt, Homo sapiens
augcuccuuccaa

SEQ ID NO: 1303220 - RNA, 17 nt, Homo sapiens
augcuccuuccaacagg

SEQ ID NO: 1303221 - RNA, 22 nt, Homo sapiens
augcucuuuuguuuggguuaca

SEQ ID NO: 1303222 - RNA, 18 nt, Homo sapiens
augcugacagcucuucac

SEQ ID NO: 1303223 - RNA, 14 nt, Homo sapiens
augcugcaguucca

SEQ ID NO: 1303224 - RNA, 19 nt, Homo sapiens
augcugcaguuccaaaaga

SEQ ID NO: 1303225 - RNA, 19 nt, Homo sapiens
augcugguuuucuacccaa

SEQ ID NO: 1303226 - RNA, 23 nt, Homo sapiens
augcuuguauuuuacuuuuccau

SEQ ID NO: 1303227 - RNA, 15 nt, Homo sapiens
auggaaaacauuuca

SEQ ID NO: 1303228 - RNA, 14 nt, Homo sapiens
auggaacacggcca

SEQ ID NO: 1303229 - RNA, 16 nt, Homo sapiens
auggaacuuagccauu

SEQ ID NO: 1303230 - RNA, 14 nt, Homo sapiens
auggaauuacaugu

SEQ ID NO: 1303231 - RNA, 16 nt, Homo sapiens
auggaauugauuugca

SEQ ID NO: 1303232 - RNA, 12 nt, Homo sapiens
auggagaagcuc

SEQ ID NO: 1303233 - RNA, 15 nt, Homo sapiens
auggagaccgugacc

SEQ ID NO: 1303234 - RNA, 18 nt, Homo sapiens
auggagcaucaagccacu

SEQ ID NO: 1303235 - RNA, 18 nt, Homo sapiens
auggaggcgcugcugcca

SEQ ID NO: 1303236 - RNA, 12 nt, Homo sapiens
auggagggaugg

SEQ ID NO: 1303237 - RNA, 12 nt, Homo sapiens
auggaucagauc

SEQ ID NO: 1303238 - RNA, 22 nt, Homo sapiens
auggaugccgugggaguacaaa

SEQ ID NO: 1303239 - RNA, 17 nt, Homo sapiens
auggaugggggaacuca

SEQ ID NO: 1303240 - RNA, 18 nt, Homo sapiens
auggaugggggaacucag

SEQ ID NO: 1303241 - RNA, 21 nt, Homo sapiens
auggauuuaacagcaugacaa

SEQ ID NO: 1303242 - RNA, 11 nt, Homo sapiens
auggcacugag

SEQ ID NO: 1303243 - RNA, 17 nt, Homo sapiens
auggcacugcaggugag

SEQ ID NO: 1303244 - RNA, 22 nt, Homo sapiens
auggcagagcauccucucugcc

SEQ ID NO: 1303245 - RNA, 20 nt, Homo sapiens
auggcagucacugaauucca

SEQ ID NO: 1303246 - RNA, 15 nt, Homo sapiens
auggccuaaauuuau

SEQ ID NO: 1303247 - RNA, 13 nt, Homo sapiens
auggccuugucua

SEQ ID NO: 1303248 - RNA, 18 nt, Homo sapiens
augggaaggggaggaccc

SEQ ID NO: 1303249 - RNA, 21 nt, Homo sapiens
augggacgcaggagaucaucu

SEQ ID NO: 1303250 - RNA, 16 nt, Homo sapiens
augggacucaaugcac

SEQ ID NO: 1303251 - RNA, 18 nt, Homo sapiens
augggagcugaggccaca

SEQ ID NO: 1303252 - RNA, 16 nt, Homo sapiens
augggcagaaaaaugg

SEQ ID NO: 1303253 - RNA, 19 nt, Homo sapiens
augggcagagcccaaggga

SEQ ID NO: 1303254 - RNA, 17 nt, Homo sapiens
augggcagcucaucucu

SEQ ID NO: 1303255 - RNA, 16 nt, Homo sapiens
auggggacgguguaug

SEQ ID NO: 1303256 - RNA, 14 nt, Homo sapiens
augggggugccagg

SEQ ID NO: 1303257 - RNA, 20 nt, Homo sapiens
auggguuggcuguggggacc

SEQ ID NO: 1303258 - RNA, 17 nt, Homo sapiens
augguacccuguguuag

SEQ ID NO: 1303259 - RNA, 18 nt, Homo sapiens
augguauguaacucuuaa

SEQ ID NO: 1303260 - RNA, 23 nt, Homo sapiens
gauuuccuugaauguggcuugag

SEQ ID NO: 1303261 - RNA, 15 nt, Homo sapiens
gauuucggaggccau

SEQ ID NO: 1303262 - RNA, 14 nt, Homo sapiens
gauuucuccaggau

SEQ ID NO: 1303263 - RNA, 16 nt, Homo sapiens
gauuugauuaaugaau

SEQ ID NO: 1303264 - RNA, 11 nt, Homo sapiens
gauuugccuca

SEQ ID NO: 1303265 - RNA, 15 nt, Homo sapiens
gauuuugcucugucu

SEQ ID NO: 1303266 - RNA, 14 nt, Homo sapiens
gcaaaaaauacuuu

SEQ ID NO: 1303267 - RNA, 22 nt, Homo sapiens
gcaaaaacauguaugugcauuu

SEQ ID NO: 1303268 - RNA, 14 nt, Homo sapiens
gcaaaaagcaacuu

SEQ ID NO: 1303269 - RNA, 19 nt, Homo sapiens
gcaaaacaaaaauuaggua

SEQ ID NO: 1303270 - RNA, 14 nt, Homo sapiens
gcaaaccugccucc

SEQ ID NO: 1303271 - RNA, 21 nt, Homo sapiens
gcaaagcgugucccauagaaa

SEQ ID NO: 1303272 - RNA, 18 nt, Homo sapiens
gcaaagggagcacugggu

SEQ ID NO: 1303273 - RNA, 21 nt, Homo sapiens
gcaaaggggacagcuguguga

SEQ ID NO: 1303274 - RNA, 21 nt, Homo sapiens
gcaaaguacuguaagaauaau

SEQ ID NO: 1303275 - RNA, 22 nt, Homo sapiens
gcaaauaaaugaacugacuuca

SEQ ID NO: 1303276 - RNA, 21 nt, Homo sapiens
gcaaauccuugauacugcuca

SEQ ID NO: 1303277 - RNA, 16 nt, Homo sapiens
gcaaaugggaugguau

SEQ ID NO: 1303278 - RNA, 17 nt, Homo sapiens
gcaacaaaauguagaau

SEQ ID NO: 1303279 - RNA, 22 nt, Homo sapiens
gcaacaggaaucucagagacag

SEQ ID NO: 1303280 - RNA, 13 nt, Homo sapiens
gcaaccagcacau

SEQ ID NO: 1303281 - RNA, 13 nt, Homo sapiens
gcaaccauuugua

SEQ ID NO: 1303282 - RNA, 15 nt, Homo sapiens
gcaagagaauuacuu

SEQ ID NO: 1303283 - RNA, 15 nt, Homo sapiens
gcaagcgcuguaaac

SEQ ID NO: 1303284 - RNA, 23 nt, Homo sapiens
gcaaggaaacuauguaacaugua

SEQ ID NO: 1303285 - RNA, 13 nt, Homo sapiens
gcaaggugacauu

SEQ ID NO: 1303286 - RNA, 18 nt, Homo sapiens
gcaaucagugcuccugua

SEQ ID NO: 1303287 - RNA, 13 nt, Homo sapiens
gcaaugacucagg

SEQ ID NO: 1303288 - RNA, 22 nt, Homo sapiens
gcaauguguggcugaagacuuu

SEQ ID NO: 1303289 - RNA, 16 nt, Homo sapiens
gcaauuucuacuacag

SEQ ID NO: 1303290 - RNA, 14 nt, Homo sapiens
gcacaacaaaggau

SEQ ID NO: 1303291 - RNA, 13 nt, Homo sapiens
gcacaaggccuug

SEQ ID NO: 1303292 - RNA, 15 nt, Homo sapiens
gcacaaggccuugcc

SEQ ID NO: 1303293 - RNA, 15 nt, Homo sapiens
gcacacccacucagc

SEQ ID NO: 1303294 - RNA, 22 nt, Homo sapiens
gcacacugccagucucacugug

SEQ ID NO: 1303295 - RNA, 14 nt, Homo sapiens
gcacagauguuccc

SEQ ID NO: 1303296 - RNA, 21 nt, Homo sapiens
gcacaggaguguccucuuccc

SEQ ID NO: 1303297 - RNA, 21 nt, Homo sapiens
gcacaggcgcaucccaggccu

SEQ ID NO: 1303298 - RNA, 13 nt, Homo sapiens
gcaccauucugac

SEQ ID NO: 1303299 - RNA, 16 nt, Homo sapiens
gcacccaacuagcucu

SEQ ID NO: 1303300 - RNA, 19 nt, Homo sapiens
gcacccaagaccucagggc

SEQ ID NO: 1303301 - RNA, 13 nt, Homo sapiens
gcaccccuacuca

SEQ ID NO: 1303302 - RNA, 18 nt, Homo sapiens
gcaccguucugugcacaa

SEQ ID NO: 1303303 - RNA, 21 nt, Homo sapiens
gcaccucacaggccccaggaa

SEQ ID NO: 1303304 - RNA, 15 nt, Homo sapiens
gcaccuguaauccca

SEQ ID NO: 1303305 - RNA, 16 nt, Homo sapiens
gcacuaccauugcugu

SEQ ID NO: 1303306 - RNA, 13 nt, Homo sapiens
gcacuauguauau

SEQ ID NO: 1303307 - RNA, 14 nt, Homo sapiens
gcacugaggugccg

SEQ ID NO: 1303308 - RNA, 13 nt, Homo sapiens
gcacugaugcugc

SEQ ID NO: 1303309 - RNA, 20 nt, Homo sapiens
gcacugaugcugccccucau

SEQ ID NO: 1303310 - RNA, 21 nt, Homo sapiens
gcacugccugauggaccuguc

SEQ ID NO: 1303311 - RNA, 19 nt, Homo sapiens
gcacugugacccccagcuc

SEQ ID NO: 1303312 - RNA, 13 nt, Homo sapiens
gcacuucaucuga

SEQ ID NO: 1303313 - RNA, 20 nt, Homo sapiens
gcacuuugggaggccaagga

SEQ ID NO: 1303314 - RNA, 14 nt, Homo sapiens
gcagaaacuuuaca

SEQ ID NO: 1303315 - RNA, 22 nt, Homo sapiens
gcagaaaggaaaagauuccugu

SEQ ID NO: 1303316 - RNA, 22 nt, Homo sapiens
gcagaaucccggcugucaaggg

SEQ ID NO: 1303317 - RNA, 23 nt, Homo sapiens
gcagaauugagagugauuccuuu

SEQ ID NO: 1303318 - RNA, 15 nt, Homo sapiens
gcagacacuaaagac

SEQ ID NO: 1303319 - RNA, 20 nt, Homo sapiens
gcagacauagaagagccaag

SEQ ID NO: 1303320 - RNA, 13 nt, Homo sapiens
gcagaccacugau

SEQ ID NO: 1303321 - RNA, 16 nt, Homo sapiens
gcagaccccaggcaag

SEQ ID NO: 1303322 - RNA, 14 nt, Homo sapiens
gcagaggucuccca

SEQ ID NO: 1303323 - RNA, 16 nt, Homo sapiens
gcagaguacuggcuga

SEQ ID NO: 1303324 - RNA, 16 nt, Homo sapiens
gcagaugagguugcua

SEQ ID NO: 1303325 - RNA, 23 nt, Homo sapiens
gcagcaaggaggaagaggacuca

SEQ ID NO: 1303326 - RNA, 22 nt, Homo sapiens
gcagcagggagggcuucugcca

SEQ ID NO: 1303327 - RNA, 12 nt, Homo sapiens
gcagccaaggga

SEQ ID NO: 1303328 - RNA, 19 nt, Homo sapiens
gcagccacgaggugcaaca

SEQ ID NO: 1303329 - RNA, 14 nt, Homo sapiens
gcagcucaucucug

SEQ ID NO: 1303330 - RNA, 23 nt, Homo sapiens
gcagcucuccccucagagugcaa

SEQ ID NO: 1303331 - RNA, 18 nt, Homo sapiens
gcaggaaaugaaaauguc

SEQ ID NO: 1303332 - RNA, 15 nt, Homo sapiens
gcaggaagcucagac

SEQ ID NO: 1303333 - RNA, 19 nt, Homo sapiens
gcaggaagcucagacuggu

SEQ ID NO: 1303334 - RNA, 16 nt, Homo sapiens
gcaggacaguauuccu

SEQ ID NO: 1303335 - RNA, 12 nt, Homo sapiens
gcaggaccucag

SEQ ID NO: 1303336 - RNA, 13 nt, Homo sapiens
gcaggacugcaca

SEQ ID NO: 1303337 - RNA, 21 nt, Homo sapiens
gcaggacuugagaagaccuca

SEQ ID NO: 1303338 - RNA, 16 nt, Homo sapiens
gcaggcuacacugaca

SEQ ID NO: 1303339 - RNA, 16 nt, Homo sapiens
gcaggggccuggagau

SEQ ID NO: 1303340 - RNA, 20 nt, Homo sapiens
gcaggguucaagccuuccag

SEQ ID NO: 1303341 - RNA, 20 nt, Homo sapiens
gcaggugaaacccagucacu

SEQ ID NO: 1303342 - RNA, 22 nt, Homo sapiens
gcagguuggaacuaugcagugu

SEQ ID NO: 1303343 - RNA, 23 nt, Homo sapiens
gcagguuggugggggccucggug

SEQ ID NO: 1303344 - RNA, 21 nt, Homo sapiens
gcaguaucaugcccugugcaa

SEQ ID NO: 1303345 - RNA, 17 nt, Homo sapiens
gcagucaacaguucaaa

SEQ ID NO: 1303346 - RNA, 19 nt, Homo sapiens
gcaguccugccucagccuc

SEQ ID NO: 1303347 - RNA, 16 nt, Homo sapiens
gcagucuguccaggcu

SEQ ID NO: 1303348 - RNA, 21 nt, Homo sapiens
gcagugcucgcuguugcugaa

SEQ ID NO: 1303349 - RNA, 19 nt, Homo sapiens
gcagugcuugaaugaaguu

SEQ ID NO: 1303350 - RNA, 20 nt, Homo sapiens
gcaguggacucaaaacccau

SEQ ID NO: 1303351 - RNA, 17 nt, Homo sapiens
gcagugugaaaaguccu

SEQ ID NO: 1303352 - RNA, 18 nt, Homo sapiens
gcaguuuaagagcagaac

SEQ ID NO: 1303353 - RNA, 20 nt, Homo sapiens
gcauacgguaugauauugca

SEQ ID NO: 1303354 - RNA, 19 nt, Homo sapiens
gcauagauugaucaaagug

SEQ ID NO: 1303355 - RNA, 13 nt, Homo sapiens
gcauauacuuuaa

SEQ ID NO: 1303356 - RNA, 16 nt, Homo sapiens
gcauaucugccuuuau

SEQ ID NO: 1303357 - RNA, 16 nt, Homo sapiens
gcauaugcaugugugu

SEQ ID NO: 1303358 - RNA, 16 nt, Homo sapiens
gcaucacagaauguga

SEQ ID NO: 1303359 - RNA, 12 nt, Homo sapiens
gcaucucaaaaa

SEQ ID NO: 1303360 - RNA, 15 nt, Homo sapiens
gcaucugaccagcag

SEQ ID NO: 1303361 - RNA, 18 nt, Homo sapiens
gcaugaaugagacccagc

SEQ ID NO: 1303362 - RNA, 19 nt, Homo sapiens
gcaugaaugagacccagcu

SEQ ID NO: 1303363 - RNA, 14 nt, Homo sapiens
gcauggaacagcau

SEQ ID NO: 1303364 - RNA, 17 nt, Homo sapiens
gcauggaacagcauuac

SEQ ID NO: 1303365 - RNA, 23 nt, Homo sapiens
gcauggcuuuggcuuugcaaaau

SEQ ID NO: 1303366 - RNA, 15 nt, Homo sapiens
gcaugucacuccagc

SEQ ID NO: 1303367 - RNA, 16 nt, Homo sapiens
gcauguccacgugugu

SEQ ID NO: 1303368 - RNA, 17 nt, Homo sapiens
gcaugugugaaacauac

SEQ ID NO: 1303369 - RNA, 20 nt, Homo sapiens
gcauguuggcccagaccuca

SEQ ID NO: 1303370 - RNA, 16 nt, Homo sapiens
gcauguuuuccagcuc

SEQ ID NO: 1303371 - RNA, 13 nt, Homo sapiens
gcauuaaauucac

SEQ ID NO: 1303372 - RNA, 20 nt, Homo sapiens
gcauuccagccccucugguc

SEQ ID NO: 1303373 - RNA, 20 nt, Homo sapiens
gcauucuuaacaaacucuuc

SEQ ID NO: 1303374 - RNA, 18 nt, Homo sapiens
gcauugcccagucuuuca

SEQ ID NO: 1303375 - RNA, 17 nt, Homo sapiens
gcauugcuggacucuga

SEQ ID NO: 1303376 - RNA, 17 nt, Homo sapiens
gcauuguaucgauguua

SEQ ID NO: 1303377 - RNA, 16 nt, Homo sapiens
gcauuguuucuguggg

SEQ ID NO: 1303378 - RNA, 19 nt, Homo sapiens
gcauuuucuucucugcacu

SEQ ID NO: 1303379 - RNA, 14 nt, Homo sapiens
gccaaaagcugcuc

SEQ ID NO: 1303380 - RNA, 19 nt, Homo sapiens
gccaaacugucucugccuc

SEQ ID NO: 1303381 - RNA, 16 nt, Homo sapiens
gccaacauacuuuaag

SEQ ID NO: 1303382 - RNA, 18 nt, Homo sapiens
gccaaccggucacccagg

SEQ ID NO: 1303383 - RNA, 14 nt, Homo sapiens
gccaagacacagca

SEQ ID NO: 1303384 - RNA, 15 nt, Homo sapiens
gccaagcaggacagu

SEQ ID NO: 1303385 - RNA, 17 nt, Homo sapiens
gccaagccagcugccua

SEQ ID NO: 1303386 - RNA, 16 nt, Homo sapiens
gccaaggagcugcuau

SEQ ID NO: 1303387 - RNA, 21 nt, Homo sapiens
gccaaggagggcagaucacuu

SEQ ID NO: 1303388 - RNA, 20 nt, Homo sapiens
gccaaggagggugagugcaa

SEQ ID NO: 1303389 - RNA, 16 nt, Homo sapiens
gccaaguuccaaaaua

SEQ ID NO: 1303390 - RNA, 18 nt, Homo sapiens
gccacaaauaaguuacau

SEQ ID NO: 1303391 - RNA, 21 nt, Homo sapiens
gccacaaauaaguuacaucua

SEQ ID NO: 1303392 - RNA, 20 nt, Homo sapiens
ggccaucucuggaugccuga

SEQ ID NO: 1303393 - RNA, 22 nt, Homo sapiens
ggccaucugguuaggauggcag

SEQ ID NO: 1303394 - RNA, 17 nt, Homo sapiens
ggcccacuucaccguac

SEQ ID NO: 1303395 - RNA, 15 nt, Homo sapiens
ggcccagaccucagg

SEQ ID NO: 1303396 - RNA, 18 nt, Homo sapiens
ggcccaguucacccugau

SEQ ID NO: 1303397 - RNA, 16 nt, Homo sapiens
ggccccacauugcacu

SEQ ID NO: 1303398 - RNA, 21 nt, Homo sapiens
ggccccgugaggcaaugggag

SEQ ID NO: 1303399 - RNA, 21 nt, Homo sapiens
ggccccuggacgaaggucuga

SEQ ID NO: 1303400 - RNA, 14 nt, Homo sapiens
ggcccgacauuucu

SEQ ID NO: 1303401 - RNA, 15 nt, Homo sapiens
ggcccggccagccau

SEQ ID NO: 1303402 - RNA, 22 nt, Homo sapiens
ggcccgugggagucaucucaac

SEQ ID NO: 1303403 - RNA, 14 nt, Homo sapiens
ggcccugagccaga

SEQ ID NO: 1303404 - RNA, 14 nt, Homo sapiens
ggcccugccaugcu

SEQ ID NO: 1303405 - RNA, 12 nt, Homo sapiens
ggccgacuccac

SEQ ID NO: 1303406 - RNA, 15 nt, Homo sapiens
ggccggggacugccu

SEQ ID NO: 1303407 - RNA, 17 nt, Homo sapiens
ggccuaacacugggcug

SEQ ID NO: 1303408 - RNA, 17 nt, Homo sapiens
ggccucagugugcccau

SEQ ID NO: 1303409 - RNA, 19 nt, Homo sapiens
ggccuccauccucaucucu

SEQ ID NO: 1303410 - RNA, 14 nt, Homo sapiens
ggccucccaaaaga

SEQ ID NO: 1303411 - RNA, 18 nt, Homo sapiens
ggccucccacagacucaa

SEQ ID NO: 1303412 - RNA, 15 nt, Homo sapiens
ggccuccugugacug

SEQ ID NO: 1303413 - RNA, 15 nt, Homo sapiens
ggccugagauuucau

SEQ ID NO: 1303414 - RNA, 15 nt, Homo sapiens
ggccugcacuggugu

SEQ ID NO: 1303415 - RNA, 13 nt, Homo sapiens
ggccugcuccaga

SEQ ID NO: 1303416 - RNA, 15 nt, Homo sapiens
ggccuggcagcucag

SEQ ID NO: 1303417 - RNA, 17 nt, Homo sapiens
ggccuggucguuuucaa

SEQ ID NO: 1303418 - RNA, 14 nt, Homo sapiens
ggccuuagaacuuu

SEQ ID NO: 1303419 - RNA, 19 nt, Homo sapiens
ggccuuccucucuccagau

SEQ ID NO: 1303420 - RNA, 16 nt, Homo sapiens
ggccuuugagccugau

SEQ ID NO: 1303421 - RNA, 21 nt, Homo sapiens
ggcgaccuccuuucaucacac

SEQ ID NO: 1303422 - RNA, 17 nt, Homo sapiens
ggcgcccgggauccagc

SEQ ID NO: 1303423 - RNA, 12 nt, Homo sapiens
ggcgugaucuug

SEQ ID NO: 1303424 - RNA, 17 nt, Homo sapiens
ggcguggccuccuccuc

SEQ ID NO: 1303425 - RNA, 13 nt, Homo sapiens
ggcguuacugcuu

SEQ ID NO: 1303426 - RNA, 15 nt, Homo sapiens
ggcuacacagggaug

SEQ ID NO: 1303427 - RNA, 16 nt, Homo sapiens
ggcuaucaacuuaaua

SEQ ID NO: 1303428 - RNA, 14 nt, Homo sapiens
ggcuauguaaacaa

SEQ ID NO: 1303429 - RNA, 14 nt, Homo sapiens
ggcucacacugaga

SEQ ID NO: 1303430 - RNA, 14 nt, Homo sapiens
ggcuccacugggau

SEQ ID NO: 1303431 - RNA, 16 nt, Homo sapiens
ggcuccagccaucuca

SEQ ID NO: 1303432 - RNA, 13 nt, Homo sapiens
ggcuccucucaga

SEQ ID NO: 1303433 - RNA, 16 nt, Homo sapiens
ggcuccuggggcaaug

SEQ ID NO: 1303434 - RNA, 16 nt, Homo sapiens
ggcucucaacagggga

SEQ ID NO: 1303435 - RNA, 12 nt, Homo sapiens
ggcucuucucau

SEQ ID NO: 1303436 - RNA, 15 nt, Homo sapiens
ggcucuucucauuuc

SEQ ID NO: 1303437 - RNA, 22 nt, Homo sapiens
ggcugacggcgcaagaccagcu

SEQ ID NO: 1303438 - RNA, 17 nt, Homo sapiens
ggcugcacccacccagg

SEQ ID NO: 1303439 - RNA, 16 nt, Homo sapiens
ggcugcaggggucuca

SEQ ID NO: 1303440 - RNA, 19 nt, Homo sapiens
ggcugccugcaucuauucu

SEQ ID NO: 1303441 - RNA, 15 nt, Homo sapiens
ggcugcugaccucca

SEQ ID NO: 1303442 - RNA, 15 nt, Homo sapiens
ggcuggaaugcagug

SEQ ID NO: 1303443 - RNA, 20 nt, Homo sapiens
ggcuggagugcaguggcgca

SEQ ID NO: 1303444 - RNA, 11 nt, Homo sapiens
ggcuggcacug

SEQ ID NO: 1303445 - RNA, 17 nt, Homo sapiens
ggcugggacguggcuca

SEQ ID NO: 1303446 - RNA, 22 nt, Homo sapiens
ggcugggggccucagugccacu

SEQ ID NO: 1303447 - RNA, 17 nt, Homo sapiens
ggcugucaucugugcac

SEQ ID NO: 1303448 - RNA, 15 nt, Homo sapiens
ggcugucccgugcau

SEQ ID NO: 1303449 - RNA, 16 nt, Homo sapiens
ggcuguguuuccaucu

SEQ ID NO: 1303450 - RNA, 20 nt, Homo sapiens
ggcuuacacccacaguggaa

SEQ ID NO: 1303451 - RNA, 19 nt, Homo sapiens
ggcuuaugaauauauuuaa

SEQ ID NO: 1303452 - RNA, 16 nt, Homo sapiens
ggcuucaguggcagcu

SEQ ID NO: 1303453 - RNA, 18 nt, Homo sapiens
ggcuuggguucacagugc

SEQ ID NO: 1303454 - RNA, 18 nt, Homo sapiens
ggcuuguaaaugugacac

SEQ ID NO: 1303455 - RNA, 21 nt, Homo sapiens
ggcuuuuacugaagccuuucu

SEQ ID NO: 1303456 - RNA, 19 nt, Homo sapiens
ggcuuuuccaagcugccac

SEQ ID NO: 1303457 - RNA, 18 nt, Homo sapiens
gggaaagcuucauucucc

SEQ ID NO: 1303458 - RNA, 22 nt, Homo sapiens
gggaagagugacucuccagggg

SEQ ID NO: 1303459 - RNA, 23 nt, Homo sapiens
gggaagcuggcuuucuggcugcu

SEQ ID NO: 1303460 - RNA, 18 nt, Homo sapiens
gggaaucagaagagccug

SEQ ID NO: 1303461 - RNA, 16 nt, Homo sapiens
gggaauuuauugccuc

SEQ ID NO: 1303462 - RNA, 17 nt, Homo sapiens
gggacacuuacccaagg

SEQ ID NO: 1303463 - RNA, 19 nt, Homo sapiens
gggacagacuaagggcgcu

SEQ ID NO: 1303464 - RNA, 13 nt, Homo sapiens
gggacagggauga

SEQ ID NO: 1303465 - RNA, 20 nt, Homo sapiens
gggacauugggaaggggacc

SEQ ID NO: 1303466 - RNA, 13 nt, Homo sapiens
gggacugugagac

SEQ ID NO: 1303467 - RNA, 14 nt, Homo sapiens
gggacugugagacu

SEQ ID NO: 1303468 - RNA, 20 nt, Homo sapiens
gggagaaccacugacccaaa

SEQ ID NO: 1303469 - RNA, 17 nt, Homo sapiens
gggagacugcaucucaa

SEQ ID NO: 1303470 - RNA, 18 nt, Homo sapiens
gggagcauggagggaugg

SEQ ID NO: 1303471 - RNA, 15 nt, Homo sapiens
gggagccauguuuca

SEQ ID NO: 1303472 - RNA, 22 nt, Homo sapiens
gggagcccacuguccugggccu

SEQ ID NO: 1303473 - RNA, 20 nt, Homo sapiens
gggaggucaaggcugcagug

SEQ ID NO: 1303474 - RNA, 21 nt, Homo sapiens
gggagucugaagcagaugcaa

SEQ ID NO: 1303475 - RNA, 23 nt, Homo sapiens
gggauaaagagagagaaggacug

SEQ ID NO: 1303476 - RNA, 20 nt, Homo sapiens
gggauauuugguuuggccau

SEQ ID NO: 1303477 - RNA, 17 nt, Homo sapiens
gggaugugacaugccca

SEQ ID NO: 1303478 - RNA, 17 nt, Homo sapiens
gggcagcgccaggcuga

SEQ ID NO: 1303479 - RNA, 16 nt, Homo sapiens
gggcauggcugcugac

SEQ ID NO: 1303480 - RNA, 21 nt, Homo sapiens
gggccagagccagggggguga

SEQ ID NO: 1303481 - RNA, 21 nt, Homo sapiens
gggccagcacuuccaugggaa

SEQ ID NO: 1303482 - RNA, 18 nt, Homo sapiens
gggccauucuccacagca

SEQ ID NO: 1303483 - RNA, 14 nt, Homo sapiens
gggcccagagccca

SEQ ID NO: 1303484 - RNA, 15 nt, Homo sapiens
gggcccccaucucau

SEQ ID NO: 1303485 - RNA, 19 nt, Homo sapiens
gggccccugcacacucagu

SEQ ID NO: 1303486 - RNA, 22 nt, Homo sapiens
gggccccugucgucaggaccuc

SEQ ID NO: 1303487 - RNA, 16 nt, Homo sapiens
gggccugaccaaacag

SEQ ID NO: 1303488 - RNA, 18 nt, Homo sapiens
gggcuaccccacccaagu

SEQ ID NO: 1303489 - RNA, 23 nt, Homo sapiens
gggcucaggaggggaaguccagc

SEQ ID NO: 1303490 - RNA, 15 nt, Homo sapiens
gggcuccauguagaa

SEQ ID NO: 1303491 - RNA, 17 nt, Homo sapiens
gggcucccagcccgugc

SEQ ID NO: 1303492 - RNA, 18 nt, Homo sapiens
gggcucuucuuggcagag

SEQ ID NO: 1303493 - RNA, 22 nt, Homo sapiens
gggcugacuccugcucucugga

SEQ ID NO: 1303494 - RNA, 19 nt, Homo sapiens
gggcugcaaugcagcaugu

SEQ ID NO: 1303495 - RNA, 11 nt, Homo sapiens
gggcuguguuu

SEQ ID NO: 1303496 - RNA, 19 nt, Homo sapiens
ggggacauagcugugcuau

SEQ ID NO: 1303497 - RNA, 17 nt, Homo sapiens
ggggagucugaagcaga

SEQ ID NO: 1303498 - RNA, 14 nt, Homo sapiens
ggggaugugacaug

SEQ ID NO: 1303499 - RNA, 14 nt, Homo sapiens
ggggcaggcaguga

SEQ ID NO: 1303500 - RNA, 17 nt, Homo sapiens
ggggcauaaacuuuccu

SEQ ID NO: 1303501 - RNA, 19 nt, Homo sapiens
ggggcugucccgugcaugg

SEQ ID NO: 1303502 - RNA, 10 nt, Homo sapiens
ggggcuuccu

SEQ ID NO: 1303503 - RNA, 15 nt, Homo sapiens
gggggcucuggccaa

SEQ ID NO: 1303504 - RNA, 22 nt, Homo sapiens
ggguacuucuugaaggugcuga

SEQ ID NO: 1303505 - RNA, 13 nt, Homo sapiens
gggucaacaucuu

SEQ ID NO: 1303506 - RNA, 15 nt, Homo sapiens
gggucaucgauucaa

SEQ ID NO: 1303507 - RNA, 17 nt, Homo sapiens
gggucugccuccagcca

SEQ ID NO: 1303508 - RNA, 16 nt, Homo sapiens
gggucuuugaacccuu

SEQ ID NO: 1303509 - RNA, 22 nt, Homo sapiens
gggugcucccuaccaccucccc

SEQ ID NO: 1303510 - RNA, 18 nt, Homo sapiens
ggguucccgcggggcugu

SEQ ID NO: 1303511 - RNA, 19 nt, Homo sapiens
ggguuucacuauguugccu

SEQ ID NO: 1303512 - RNA, 18 nt, Homo sapiens
gguaauuaguaacaugug

SEQ ID NO: 1303513 - RNA, 14 nt, Homo sapiens
gguacaaacccaaa

SEQ ID NO: 1303514 - RNA, 24 nt, Homo sapiens
gguacagguauauuuugacgucac

SEQ ID NO: 1303515 - RNA, 18 nt, Homo sapiens
gguacuuguaaauuauua

SEQ ID NO: 1303516 - RNA, 20 nt, Homo sapiens
gguagccagcacacagggca

SEQ ID NO: 1303517 - RNA, 22 nt, Homo sapiens
gguagccagcacacagggcagu

SEQ ID NO: 1303518 - RNA, 19 nt, Homo sapiens
gguagcuggggcuacagga

SEQ ID NO: 1303519 - RNA, 18 nt, Homo sapiens
gguauauaaauuuuccca

SEQ ID NO: 1303520 - RNA, 14 nt, Homo sapiens
gguaugauauugca

SEQ ID NO: 1303521 - RNA, 12 nt, Homo sapiens
gguaugaugcug

SEQ ID NO: 1303522 - RNA, 21 nt, Homo sapiens
gguaugucugccauguugccc

SEQ ID NO: 1303523 - RNA, 12 nt, Homo sapiens
ggucaugcccuc

SEQ ID NO: 1303524 - RNA, 23 nt, Homo sapiens
gguccacaucccgggacgcagca

SEQ ID NO: 1303525 - RNA, 15 nt, Homo sapiens
uugucaucugcaugu

SEQ ID NO: 1303526 - RNA, 15 nt, Homo sapiens
uugucccguggcauu

SEQ ID NO: 1303527 - RNA, 17 nt, Homo sapiens
uuguccucauuucucca

SEQ ID NO: 1303528 - RNA, 18 nt, Homo sapiens
uugucuaacuuuugugaa

SEQ ID NO: 1303529 - RNA, 12 nt, Homo sapiens
uugugacuucaa

SEQ ID NO: 1303530 - RNA, 14 nt, Homo sapiens
uuguguaacauauu

SEQ ID NO: 1303531 - RNA, 17 nt, Homo sapiens
uuguguaauaugaaaua

SEQ ID NO: 1303532 - RNA, 21 nt, Homo sapiens
uugugugugaugugaagccaa

SEQ ID NO: 1303533 - RNA, 14 nt, Homo sapiens
uuguguuucuguuc

SEQ ID NO: 1303534 - RNA, 19 nt, Homo sapiens
uuguuaaaaugagcauuga

SEQ ID NO: 1303535 - RNA, 23 nt, Homo sapiens
uuguucaucagacuccugugcaa

SEQ ID NO: 1303536 - RNA, 16 nt, Homo sapiens
uuguuccacuuguuug

SEQ ID NO: 1303537 - RNA, 13 nt, Homo sapiens
uuguugugcuauu

SEQ ID NO: 1303538 - RNA, 16 nt, Homo sapiens
uuguuucccccucuuu

SEQ ID NO: 1303539 - RNA, 14 nt, Homo sapiens
uuguuuggugaauu

SEQ ID NO: 1303540 - RNA, 14 nt, Homo sapiens
uuguuuucagugaa

SEQ ID NO: 1303541 - RNA, 15 nt, Homo sapiens
uuguuuuccugugag

SEQ ID NO: 1303542 - RNA, 13 nt, Homo sapiens
uuguuuugugcca

SEQ ID NO: 1303543 - RNA, 20 nt, Homo sapiens
uuuaaaaaauuuuaagcugu

SEQ ID NO: 1303544 - RNA, 15 nt, Homo sapiens
uuuaaaagcuucuca

SEQ ID NO: 1303545 - RNA, 18 nt, Homo sapiens
uuuaaaauaaacuguaaa

SEQ ID NO: 1303546 - RNA, 19 nt, Homo sapiens
uuuaaaccugauuuacuag

SEQ ID NO: 1303547 - RNA, 17 nt, Homo sapiens
uuuaaagaaagcaacuu

SEQ ID NO: 1303548 - RNA, 22 nt, Homo sapiens
uuuaaagugacauaauuuacau

SEQ ID NO: 1303549 - RNA, 14 nt, Homo sapiens
uuuaaauaaaugga

SEQ ID NO: 1303550 - RNA, 15 nt, Homo sapiens
uuuaaauaaauggaa

SEQ ID NO: 1303551 - RNA, 20 nt, Homo sapiens
uuuaaauagggcauaccauu

SEQ ID NO: 1303552 - RNA, 22 nt, Homo sapiens
uuuaaauauauauuauucucau

SEQ ID NO: 1303553 - RNA, 12 nt, Homo sapiens
uuuaaaucugag

SEQ ID NO: 1303554 - RNA, 14 nt, Homo sapiens
uuuaacaccagaaa

SEQ ID NO: 1303555 - RNA, 14 nt, Homo sapiens
uuuaacagcucucu

SEQ ID NO: 1303556 - RNA, 14 nt, Homo sapiens
uuuaacagcugaau

SEQ ID NO: 1303557 - RNA, 13 nt, Homo sapiens
uuuaaccauucca

SEQ ID NO: 1303558 - RNA, 18 nt, Homo sapiens
uuuaacccauuugucucu

SEQ ID NO: 1303559 - RNA, 19 nt, Homo sapiens
uuuaacugccaauccuuaa

SEQ ID NO: 1303560 - RNA, 23 nt, Homo sapiens
uuuaagacucucgcaucuuccca

SEQ ID NO: 1303561 - RNA, 16 nt, Homo sapiens
uuuaagaguagcagua

SEQ ID NO: 1303562 - RNA, 20 nt, Homo sapiens
uuuaagccugaagagcuuau

SEQ ID NO: 1303563 - RNA, 17 nt, Homo sapiens
uuuaaugagucagucaa

SEQ ID NO: 1303564 - RNA, 19 nt, Homo sapiens
uuuaauggcccccaaaauc

SEQ ID NO: 1303565 - RNA, 16 nt, Homo sapiens
uuuaauucugucuugu

SEQ ID NO: 1303566 - RNA, 20 nt, Homo sapiens
uuuacaaaacuacaugagaa

SEQ ID NO: 1303567 - RNA, 19 nt, Homo sapiens
uuuacaagaaguauguaag

SEQ ID NO: 1303568 - RNA, 18 nt, Homo sapiens
uuuacaauguucauccca

SEQ ID NO: 1303569 - RNA, 17 nt, Homo sapiens
uuuacacuuuaugguaa

SEQ ID NO: 1303570 - RNA, 12 nt, Homo sapiens
uuuacagugucu

SEQ ID NO: 1303571 - RNA, 20 nt, Homo sapiens
uuuacauacacuguauguua

SEQ ID NO: 1303572 - RNA, 21 nt, Homo sapiens
uuuacauacugcugucuaugu

SEQ ID NO: 1303573 - RNA, 21 nt, Homo sapiens
uuuaccugaaauaaaauucau

SEQ ID NO: 1303574 - RNA, 18 nt, Homo sapiens
uuuagacccugcauuuau

SEQ ID NO: 1303575 - RNA, 13 nt, Homo sapiens
uuuagauuguuaa

SEQ ID NO: 1303576 - RNA, 19 nt, Homo sapiens
uuuagccgacaacagagac

SEQ ID NO: 1303577 - RNA, 19 nt, Homo sapiens
uuuagcuguauucauauau

SEQ ID NO: 1303578 - RNA, 24 nt, Homo sapiens
uuuagcuguauucauauauugcau

SEQ ID NO: 1303579 - RNA, 16 nt, Homo sapiens
uuuaggagaaagugua

SEQ ID NO: 1303580 - RNA, 17 nt, Homo sapiens
uuuagguucccaaaccu

SEQ ID NO: 1303581 - RNA, 21 nt, Homo sapiens
uuuaguaauauuuuacuuuga

SEQ ID NO: 1303582 - RNA, 13 nt, Homo sapiens
uuuauaaaaucaa

SEQ ID NO: 1303583 - RNA, 18 nt, Homo sapiens
uuuauaaacaacaucaaa

SEQ ID NO: 1303584 - RNA, 23 nt, Homo sapiens
uuuauagauggucacgcaccugg

SEQ ID NO: 1303585 - RNA, 16 nt, Homo sapiens
uuuauauaauaucuaa

SEQ ID NO: 1303586 - RNA, 13 nt, Homo sapiens
uuuauauguugcu

SEQ ID NO: 1303587 - RNA, 19 nt, Homo sapiens
uuuauauguugcuauaaua

SEQ ID NO: 1303588 - RNA, 14 nt, Homo sapiens
uuuauauuugucaa

SEQ ID NO: 1303589 - RNA, 18 nt, Homo sapiens
uuuauauuuuuauagaca

SEQ ID NO: 1303590 - RNA, 17 nt, Homo sapiens
uuuauccaaaaugugua

SEQ ID NO: 1303591 - RNA, 21 nt, Homo sapiens
uuuaucucacacacauuauga

SEQ ID NO: 1303592 - RNA, 13 nt, Homo sapiens
uuuaucugugcaa

SEQ ID NO: 1303593 - RNA, 17 nt, Homo sapiens
uuuauuauuuucaccug

SEQ ID NO: 1303594 - RNA, 16 nt, Homo sapiens
uuucaaaccagcuuca

SEQ ID NO: 1303595 - RNA, 21 nt, Homo sapiens
uuucaaaccagcuucaugugg

SEQ ID NO: 1303596 - RNA, 12 nt, Homo sapiens
uuucaaccauaa

SEQ ID NO: 1303597 - RNA, 20 nt, Homo sapiens
uuucaagagugagcuaucaa

SEQ ID NO: 1303598 - RNA, 16 nt, Homo sapiens
uuucaagucauauucu

SEQ ID NO: 1303599 - RNA, 13 nt, Homo sapiens
uuucaaguucaau

SEQ ID NO: 1303600 - RNA, 23 nt, Homo sapiens
uuucaaugaugggcgagcgugca

SEQ ID NO: 1303601 - RNA, 12 nt, Homo sapiens
uuucaauugcau

SEQ ID NO: 1303602 - RNA, 16 nt, Homo sapiens
uuucacaauaccucau

SEQ ID NO: 1303603 - RNA, 16 nt, Homo sapiens
uuucacauucuuggcu

SEQ ID NO: 1303604 - RNA, 13 nt, Homo sapiens
uuucaccauuuga

SEQ ID NO: 1303605 - RNA, 16 nt, Homo sapiens
uuucacccauuuacac

SEQ ID NO: 1303606 - RNA, 21 nt, Homo sapiens
uuucaccuguuuuuaagcugu

SEQ ID NO: 1303607 - RNA, 14 nt, Homo sapiens
uuucagagugacac

SEQ ID NO: 1303608 - RNA, 18 nt, Homo sapiens
uuucauaaccuagccuua

SEQ ID NO: 1303609 - RNA, 18 nt, Homo sapiens
uuucauccaggccugcca

SEQ ID NO: 1303610 - RNA, 15 nt, Homo sapiens
uuucaucugcucucc

SEQ ID NO: 1303611 - RNA, 18 nt, Homo sapiens
uuucauugaugagcaaga

SEQ ID NO: 1303612 - RNA, 21 nt, Homo sapiens
uuucauuugguucauuaauuc

SEQ ID NO: 1303613 - RNA, 19 nt, Homo sapiens
uuuccaaagaaaaguauug

SEQ ID NO: 1303614 - RNA, 17 nt, Homo sapiens
uuuccaguccccagaag

SEQ ID NO: 1303615 - RNA, 23 nt, Homo sapiens
uuuccauauuuuauuuuucaaaa

SEQ ID NO: 1303616 - RNA, 23 nt, Homo sapiens
uuuccaugggaccacaacuauuu

SEQ ID NO: 1303617 - RNA, 19 nt, Homo sapiens
uuuccccagugacaccuca

SEQ ID NO: 1303618 - RNA, 21 nt, Homo sapiens
uuucccugggagcuguucucu

SEQ ID NO: 1303619 - RNA, 22 nt, Homo sapiens
uuucccuuugccuucauucugc

SEQ ID NO: 1303620 - RNA, 15 nt, Homo sapiens
uuuccgaaaucagaa

SEQ ID NO: 1303621 - RNA, 18 nt, Homo sapiens
uuuccuaugcuauugaca

SEQ ID NO: 1303622 - RNA, 20 nt, Homo sapiens
uuuccuggucagcauguacu

SEQ ID NO: 1303623 - RNA, 20 nt, Homo sapiens
uuuccuuuuuuaaaaaugca

SEQ ID NO: 1303624 - RNA, 12 nt, Homo sapiens
uuucuacccagc

SEQ ID NO: 1303625 - RNA, 22 nt, Homo sapiens
uuucuccccaaugagacuugcc

SEQ ID NO: 1303626 - RNA, 15 nt, Homo sapiens
uuucuccuuucacca

SEQ ID NO: 1303627 - RNA, 15 nt, Homo sapiens
uuucucuguauagua

SEQ ID NO: 1303628 - RNA, 15 nt, Homo sapiens
uuucucuugugcaau

SEQ ID NO: 1303629 - RNA, 23 nt, Homo sapiens
uuucugacacagucaauucugau

SEQ ID NO: 1303630 - RNA, 18 nt, Homo sapiens
uuucugagacagcuuguc

SEQ ID NO: 1303631 - RNA, 14 nt, Homo sapiens
uuucugagugccuu

SEQ ID NO: 1303632 - RNA, 16 nt, Homo sapiens
uuucugagugccuucu

SEQ ID NO: 1303633 - RNA, 13 nt, Homo sapiens
uuucuuaaaaagu

SEQ ID NO: 1303634 - RNA, 15 nt, Homo sapiens
uuucuugaaagaaua

SEQ ID NO: 1303635 - RNA, 24 nt, Homo sapiens
uuucuuguuucaucguaaacauac

SEQ ID NO: 1303636 - RNA, 24 nt, Homo sapiens
uuucuuuugagacagagucucacu

SEQ ID NO: 1303637 - RNA, 17 nt, Homo sapiens
uuugaaauaaagaacca

SEQ ID NO: 1303638 - RNA, 22 nt, Homo sapiens
uuugaaaugugguuuuccugaa

SEQ ID NO: 1303639 - RNA, 12 nt, Homo sapiens
uuugaacuuaaa

SEQ ID NO: 1303640 - RNA, 12 nt, Homo sapiens
uuugaaggcaaa

SEQ ID NO: 1303641 - RNA, 21 nt, Homo sapiens
uuugaaugcagucuguccagg

SEQ ID NO: 1303642 - RNA, 17 nt, Homo sapiens
uuugacaaauuacaaaa

SEQ ID NO: 1303643 - RNA, 17 nt, Homo sapiens
uuugaccuucagagcca

SEQ ID NO: 1303644 - RNA, 17 nt, Homo sapiens
uuugagaagaaaaucag

SEQ ID NO: 1303645 - RNA, 14 nt, Homo sapiens
uuugagacaggaga

SEQ ID NO: 1303646 - RNA, 15 nt, Homo sapiens
uuugagcaggucuca

SEQ ID NO: 1303647 - RNA, 16 nt, Homo sapiens
uuugagcauggguuca

SEQ ID NO: 1303648 - RNA, 12 nt, Homo sapiens
uuugaugcuugu

SEQ ID NO: 1303649 - RNA, 15 nt, Homo sapiens
uuugcaaaguacugu

SEQ ID NO: 1303650 - RNA, 24 nt, Homo sapiens
uuugcacacccagcauagccuccu

SEQ ID NO: 1303651 - RNA, 14 nt, Homo sapiens
uuugcagacaggca

SEQ ID NO: 1303652 - RNA, 21 nt, Homo sapiens
uuugcaggguccucuucuggg

SEQ ID NO: 1303653 - RNA, 22 nt, Homo sapiens
uuugcaucagcaacaaccagca

SEQ ID NO: 1303654 - RNA, 11 nt, Homo sapiens
uuugcauuuca

SEQ ID NO: 1303655 - RNA, 19 nt, Homo sapiens
uuugcauuucagaauauua

SEQ ID NO: 1303656 - RNA, 12 nt, Homo sapiens
uuugccacugau

SEQ ID NO: 1303657 - RNA, 16 nt, Homo sapiens
uuugcccaccagauca

SEQ ID NO: 1303658 - RNA, 17 nt, Homo sapiens
aaacauguaugugcauu

SEQ ID NO: 1303659 - RNA, 22 nt, Homo sapiens
aaacauguuuaucguauuugau

SEQ ID NO: 1303660 - RNA, 12 nt, Homo sapiens
aagaaccuggaa

SEQ ID NO: 1303661 - RNA, 18 nt, Homo sapiens
aagaacucaucacugugg

SEQ ID NO: 1303662 - RNA, 20 nt, Homo sapiens
aagaacuuggaggcaccauu

SEQ ID NO: 1303663 - RNA, 21 nt, Homo sapiens
aagaaggacaaggauguucac

SEQ ID NO: 1303664 - RNA, 19 nt, Homo sapiens
aagaaguccauauuguucc

SEQ ID NO: 1303665 - RNA, 17 nt, Homo sapiens
aagaaguuauuuuccag

SEQ ID NO: 1303666 - RNA, 15 nt, Homo sapiens
aagaaguuuuguucc

SEQ ID NO: 1303667 - RNA, 12 nt, Homo sapiens
aagaauacuuga

SEQ ID NO: 1303668 - RNA, 17 nt, Homo sapiens
aagaauaugacuuuuua

SEQ ID NO: 1303669 - RNA, 12 nt, Homo sapiens
aagaauuccaaa

SEQ ID NO: 1303670 - RNA, 14 nt, Homo sapiens
aagacaaucacugc

SEQ ID NO: 1303671 - RNA, 12 nt, Homo sapiens
aagacaccugca

SEQ ID NO: 1303672 - RNA, 15 nt, Homo sapiens
aagacagcuucucau

SEQ ID NO: 1303673 - RNA, 12 nt, Homo sapiens
aagacaucaaag

SEQ ID NO: 1303674 - RNA, 20 nt, Homo sapiens
aagacaugauuuccuugaau

SEQ ID NO: 1303675 - RNA, 20 nt, Homo sapiens
aagaccuggcagcucuggac

SEQ ID NO: 1303676 - RNA, 23 nt, Homo sapiens
aagacuauucccuucuaaccuga

SEQ ID NO: 1303677 - RNA, 20 nt, Homo sapiens
aagacucucgcaucuuccca

SEQ ID NO: 1303678 - RNA, 22 nt, Homo sapiens
aagacuucaguauguugucaaa

SEQ ID NO: 1303679 - RNA, 19 nt, Homo sapiens
aagacuucucuuuugcaca

SEQ ID NO: 1303680 - RNA, 16 nt, Homo sapiens
aagacuuuguccccac

SEQ ID NO: 1303681 - RNA, 19 nt, Homo sapiens
aagagaaaaaauauuuucc

SEQ ID NO: 1303682 - RNA, 22 nt, Homo sapiens
aagagaauauuagcuuuacugu

SEQ ID NO: 1303683 - RNA, 22 nt, Homo sapiens
aagagagcaacauuuuacccac

SEQ ID NO: 1303684 - RNA, 17 nt, Homo sapiens
aagagagucgcaucuca

SEQ ID NO: 1303685 - RNA, 13 nt, Homo sapiens
aagagcaaugugu

SEQ ID NO: 1303686 - RNA, 22 nt, Homo sapiens
aagagcaggacuccaggcccaa

SEQ ID NO: 1303687 - RNA, 22 nt, Homo sapiens
aagagcccucaagcggcccuua

SEQ ID NO: 1303688 - RNA, 22 nt, Homo sapiens
aagagcgguaaaaucuagaagc

SEQ ID NO: 1303689 - RNA, 12 nt, Homo sapiens
aagaggcuggau

SEQ ID NO: 1303690 - RNA, 18 nt, Homo sapiens
aagagggcacacacugug

SEQ ID NO: 1303691 - RNA, 16 nt, Homo sapiens
aagagggucugaggaa

SEQ ID NO: 1303692 - RNA, 22 nt, Homo sapiens
aagagggugagggccuucuuaa

SEQ ID NO: 1303693 - RNA, 21 nt, Homo sapiens
aagagguuuuaaaaaaauccc

SEQ ID NO: 1303694 - RNA, 17 nt, Homo sapiens
aagauauuuugaacuaa

SEQ ID NO: 1303695 - RNA, 20 nt, Homo sapiens
aagaucuguuuugaaggcaa

SEQ ID NO: 1303696 - RNA, 22 nt, Homo sapiens
aagaugauggcucauuuacacu

SEQ ID NO: 1303697 - RNA, 12 nt, Homo sapiens
aagaugccugau

SEQ ID NO: 1303698 - RNA, 16 nt, Homo sapiens
aagaugcgcauucuaa

SEQ ID NO: 1303699 - RNA, 17 nt, Homo sapiens
aagaugcgcauucuaac

SEQ ID NO: 1303700 - RNA, 20 nt, Homo sapiens
aagaugcuucucacugccau

SEQ ID NO: 1303701 - RNA, 22 nt, Homo sapiens
aagaugcuucucacugccaugc

SEQ ID NO: 1303702 - RNA, 20 nt, Homo sapiens
aagaugguguggguguccug

SEQ ID NO: 1303703 - RNA, 16 nt, Homo sapiens
aagaugucucugcaaa

SEQ ID NO: 1303704 - RNA, 12 nt, Homo sapiens
aagaugugcuua

SEQ ID NO: 1303705 - RNA, 16 nt, Homo sapiens
aagauuaaaaagcaca

SEQ ID NO: 1303706 - RNA, 21 nt, Homo sapiens
aagauuauauaguacuuaaau

SEQ ID NO: 1303707 - RNA, 18 nt, Homo sapiens
aagauuccaaaaagcaca

SEQ ID NO: 1303708 - RNA, 20 nt, Homo sapiens
aagauuccaaaaagcacaua

SEQ ID NO: 1303709 - RNA, 13 nt, Homo sapiens
aagauugauacuu

SEQ ID NO: 1303710 - RNA, 21 nt, Homo sapiens
aagauuguuggugaauuuuca

SEQ ID NO: 1303711 - RNA, 19 nt, Homo sapiens
aagauuuggaagcucuucu

SEQ ID NO: 1303712 - RNA, 20 nt, Homo sapiens
aagauuuucauugaggauaa

SEQ ID NO: 1303713 - RNA, 13 nt, Homo sapiens
aagcaacaucuag

SEQ ID NO: 1303714 - RNA, 20 nt, Homo sapiens
aagcaacaucuagcaaaugu

SEQ ID NO: 1303715 - RNA, 22 nt, Homo sapiens
aagcaacuuuacugagacaaug

SEQ ID NO: 1303716 - RNA, 15 nt, Homo sapiens
aagcaaggcuuuaaa

SEQ ID NO: 1303717 - RNA, 19 nt, Homo sapiens
aagcaaguguucacaacag

SEQ ID NO: 1303718 - RNA, 14 nt, Homo sapiens
aagcaaguuuucuu

SEQ ID NO: 1303719 - RNA, 17 nt, Homo sapiens
aagcaaguuuucuucca

SEQ ID NO: 1303720 - RNA, 18 nt, Homo sapiens
aagcaaguuuucuuccau

SEQ ID NO: 1303721 - RNA, 20 nt, Homo sapiens
aagcaauccucucaccucag

SEQ ID NO: 1303722 - RNA, 19 nt, Homo sapiens
aagcaauugaaaugcauug

SEQ ID NO: 1303723 - RNA, 11 nt, Homo sapiens
aagcacacuca

SEQ ID NO: 1303724 - RNA, 12 nt, Homo sapiens
aagcaccaggac

SEQ ID NO: 1303725 - RNA, 12 nt, Homo sapiens
aagcacuugugg

SEQ ID NO: 1303726 - RNA, 21 nt, Homo sapiens
aagcagccacgaggugcaaca

SEQ ID NO: 1303727 - RNA, 15 nt, Homo sapiens
aagcagcucaaaggc

SEQ ID NO: 1303728 - RNA, 14 nt, Homo sapiens
aagcauacuuugua

SEQ ID NO: 1303729 - RNA, 12 nt, Homo sapiens
aagcaucugcca

SEQ ID NO: 1303730 - RNA, 19 nt, Homo sapiens
aagcauucacaacuuguuu

SEQ ID NO: 1303731 - RNA, 19 nt, Homo sapiens
aagccaauaacacacagcu

SEQ ID NO: 1303732 - RNA, 19 nt, Homo sapiens
aagccaauucagacaggca

SEQ ID NO: 1303733 - RNA, 17 nt, Homo sapiens
aagccagaagcugagca

SEQ ID NO: 1303734 - RNA, 14 nt, Homo sapiens
aagcccagcacuug

SEQ ID NO: 1303735 - RNA, 18 nt, Homo sapiens
aagccuauguaugccaug

SEQ ID NO: 1303736 - RNA, 16 nt, Homo sapiens
aagccugacccuguaa

SEQ ID NO: 1303737 - RNA, 21 nt, Homo sapiens
aagccuuuacugacccugggg

SEQ ID NO: 1303738 - RNA, 15 nt, Homo sapiens
aagcgucauggauau

SEQ ID NO: 1303739 - RNA, 17 nt, Homo sapiens
aagcgugagccacugca

SEQ ID NO: 1303740 - RNA, 18 nt, Homo sapiens
aagcgugagccacugcac

SEQ ID NO: 1303741 - RNA, 15 nt, Homo sapiens
aagcuccaucaauga

SEQ ID NO: 1303742 - RNA, 17 nt, Homo sapiens
aagcucccaagggaugg

SEQ ID NO: 1303743 - RNA, 23 nt, Homo sapiens
aagcucugcuccucuccccagca

SEQ ID NO: 1303744 - RNA, 22 nt, Homo sapiens
aagcucuucuucccagcacuau

SEQ ID NO: 1303745 - RNA, 12 nt, Homo sapiens
aagcugcucagg

SEQ ID NO: 1303746 - RNA, 21 nt, Homo sapiens
aagcugucccucacuguugaa

SEQ ID NO: 1303747 - RNA, 14 nt, Homo sapiens
aagcuguccuccca

SEQ ID NO: 1303748 - RNA, 17 nt, Homo sapiens
aagcugugcccugacca

SEQ ID NO: 1303749 - RNA, 18 nt, Homo sapiens
aagcuguucucauuccug

SEQ ID NO: 1303750 - RNA, 14 nt, Homo sapiens
aagcuguugaaguc

SEQ ID NO: 1303751 - RNA, 23 nt, Homo sapiens
aagcuguuugucguaacuugaaa

SEQ ID NO: 1303752 - RNA, 22 nt, Homo sapiens
aagcuuccauuccaagccugac

SEQ ID NO: 1303753 - RNA, 17 nt, Homo sapiens
aagcuuccuuggcuuuu

SEQ ID NO: 1303754 - RNA, 22 nt, Homo sapiens
aagcuuucauguaaacugugca

SEQ ID NO: 1303755 - RNA, 14 nt, Homo sapiens
aaggaacaucucug

SEQ ID NO: 1303756 - RNA, 14 nt, Homo sapiens
aaggaauccacucc

SEQ ID NO: 1303757 - RNA, 18 nt, Homo sapiens
aaggagaggcaacaucca

SEQ ID NO: 1303758 - RNA, 14 nt, Homo sapiens
aaggauagaagcug

SEQ ID NO: 1303759 - RNA, 21 nt, Homo sapiens
aaggaucuaggagaagggucu

SEQ ID NO: 1303760 - RNA, 18 nt, Homo sapiens
aaggaugugggggaagac

SEQ ID NO: 1303761 - RNA, 16 nt, Homo sapiens
aaggauucuauaucau

SEQ ID NO: 1303762 - RNA, 13 nt, Homo sapiens
aaggcaagccagc

SEQ ID NO: 1303763 - RNA, 15 nt, Homo sapiens
aaggcacugccugau

SEQ ID NO: 1303764 - RNA, 15 nt, Homo sapiens
aaggcagccaggcug

SEQ ID NO: 1303765 - RNA, 19 nt, Homo sapiens
aaggcagcugguauauuca

SEQ ID NO: 1303766 - RNA, 19 nt, Homo sapiens
aaggcauuguccugugaaa

SEQ ID NO: 1303767 - RNA, 18 nt, Homo sapiens
aaggcccauaucugugaa

SEQ ID NO: 1303768 - RNA, 17 nt, Homo sapiens
aaggccgagaagcaaga

SEQ ID NO: 1303769 - RNA, 15 nt, Homo sapiens
aaggccgggugacac

SEQ ID NO: 1303770 - RNA, 20 nt, Homo sapiens
aaggcggguggaucacuuga

SEQ ID NO: 1303771 - RNA, 14 nt, Homo sapiens
aaggcuaagcuuca

SEQ ID NO: 1303772 - RNA, 21 nt, Homo sapiens
aaggcuauguaaacaaaccac

SEQ ID NO: 1303773 - RNA, 16 nt, Homo sapiens
aaggcugcaagguuua

SEQ ID NO: 1303774 - RNA, 20 nt, Homo sapiens
aaggcugcuuagaauccaaa

SEQ ID NO: 1303775 - RNA, 15 nt, Homo sapiens
aaggcuuugaguuaa

SEQ ID NO: 1303776 - RNA, 21 nt, Homo sapiens
aagggaggggcuguguuucca

SEQ ID NO: 1303777 - RNA, 13 nt, Homo sapiens
aagggagugcaug

SEQ ID NO: 1303778 - RNA, 21 nt, Homo sapiens
aagggcauuaggaguguuuca

SEQ ID NO: 1303779 - RNA, 17 nt, Homo sapiens
aagggccacgggaacuu

SEQ ID NO: 1303780 - RNA, 14 nt, Homo sapiens
aaggggcuagaagu

SEQ ID NO: 1303781 - RNA, 17 nt, Homo sapiens
aaggugaaccaugucag

SEQ ID NO: 1303782 - RNA, 13 nt, Homo sapiens
aaggugaccucac

SEQ ID NO: 1303783 - RNA, 22 nt, Homo sapiens
aaggugaccucacaguacuggu

SEQ ID NO: 1303784 - RNA, 13 nt, Homo sapiens
aagguuauguaga

SEQ ID NO: 1303785 - RNA, 11 nt, Homo sapiens
aagguucucuc

SEQ ID NO: 1303786 - RNA, 17 nt, Homo sapiens
aagguuuuuacugugag

SEQ ID NO: 1303787 - RNA, 22 nt, Homo sapiens
aaguaacauuaacucaguggaa

SEQ ID NO: 1303788 - RNA, 14 nt, Homo sapiens
aaguaccucagcau

SEQ ID NO: 1303789 - RNA, 15 nt, Homo sapiens
aaguacuguaacugu

SEQ ID NO: 1303790 - RNA, 22 nt, Homo sapiens
aaguacuguaacugugucauga

SEQ ID NO: 1303791 - RNA, 16 nt, Homo sapiens
aaguagcugcuaccuu

SEQ ID NO: 1303792 - RNA, 18 nt, Homo sapiens
aaguauccagucauugua

SEQ ID NO: 1303793 - RNA, 18 nt, Homo sapiens
aaguauguaccaaaacau

SEQ ID NO: 1303794 - RNA, 22 nt, Homo sapiens
auguggccuaaaaaugcaacuu

SEQ ID NO: 1303795 - RNA, 15 nt, Homo sapiens
auguuaaacuagcau

SEQ ID NO: 1303796 - RNA, 22 nt, Homo sapiens
auguuaacacucaugaagcaua

SEQ ID NO: 1303797 - RNA, 19 nt, Homo sapiens
auguuaaguccucccugac

SEQ ID NO: 1303798 - RNA, 22 nt, Homo sapiens
auguuaaugucauuagugacaa

SEQ ID NO: 1303799 - RNA, 23 nt, Homo sapiens
auguuaggaaaauuucacauuaa

SEQ ID NO: 1303800 - RNA, 17 nt, Homo sapiens
auguuauagaacuucau

SEQ ID NO: 1303801 - RNA, 14 nt, Homo sapiens
auguucaacuggag

SEQ ID NO: 1303802 - RNA, 18 nt, Homo sapiens
auguuccagacauucucg

SEQ ID NO: 1303803 - RNA, 20 nt, Homo sapiens
auguucugggacacaguuca

SEQ ID NO: 1303804 - RNA, 19 nt, Homo sapiens
auguugaggugaccacuua

SEQ ID NO: 1303805 - RNA, 22 nt, Homo sapiens
auguugauccauccagcuugcc

SEQ ID NO: 1303806 - RNA, 22 nt, Homo sapiens
auguugcccuggcaccuguggc

SEQ ID NO: 1303807 - RNA, 22 nt, Homo sapiens
auguuggaaaugugcaaccacu

SEQ ID NO: 1303808 - RNA, 18 nt, Homo sapiens
auguugggaaacuuggcu

SEQ ID NO: 1303809 - RNA, 21 nt, Homo sapiens
auguuuauaaaucuuaugcuc

SEQ ID NO: 1303810 - RNA, 14 nt, Homo sapiens
auguuuccuugccu

SEQ ID NO: 1303811 - RNA, 17 nt, Homo sapiens
auguuugucucauccca

SEQ ID NO: 1303812 - RNA, 14 nt, Homo sapiens
auguuuuaacucuu

SEQ ID NO: 1303813 - RNA, 22 nt, Homo sapiens
auuaaccuuacuaauuauacua

SEQ ID NO: 1303814 - RNA, 21 nt, Homo sapiens
auuaacugaggcauccacuuc

SEQ ID NO: 1303815 - RNA, 17 nt, Homo sapiens
caacacuguacacauaa

SEQ ID NO: 1303816 - RNA, 23 nt, Homo sapiens
caacaggccauugugaaccaaug

SEQ ID NO: 1303817 - RNA, 19 nt, Homo sapiens
caacaggcuuaugaauaua

SEQ ID NO: 1303818 - RNA, 22 nt, Homo sapiens
caacaguggggaagagugacuc

SEQ ID NO: 1303819 - RNA, 16 nt, Homo sapiens
caacauaguauucaug

SEQ ID NO: 1303820 - RNA, 22 nt, Homo sapiens
caacauuuaagggaaugugagc

SEQ ID NO: 1303821 - RNA, 18 nt, Homo sapiens
caaccaauggaaugugau

SEQ ID NO: 1303822 - RNA, 21 nt, Homo sapiens
caaccaccuaggcaaugaaga

SEQ ID NO: 1303823 - RNA, 12 nt, Homo sapiens
caaccacugcuu

SEQ ID NO: 1303824 - RNA, 22 nt, Homo sapiens
caaccauuuguaaaacauucca

SEQ ID NO: 1303825 - RNA, 19 nt, Homo sapiens
caaccccccagcacugagg

SEQ ID NO: 1303826 - RNA, 14 nt, Homo sapiens
caacccuucccuca

SEQ ID NO: 1303827 - RNA, 18 nt, Homo sapiens
caaccggucacccaggag

SEQ ID NO: 1303828 - RNA, 20 nt, Homo sapiens
caaccucgcuggacucucag

SEQ ID NO: 1303829 - RNA, 14 nt, Homo sapiens
caaccucugagcca

SEQ ID NO: 1303830 - RNA, 16 nt, Homo sapiens
caaccugaagcacaag

SEQ ID NO: 1303831 - RNA, 19 nt, Homo sapiens
caacuaguuuuguuuauaa

SEQ ID NO: 1303832 - RNA, 13 nt, Homo sapiens
caacucaucuuag

SEQ ID NO: 1303833 - RNA, 14 nt, Homo sapiens
caacucuacuguug

SEQ ID NO: 1303834 - RNA, 15 nt, Homo sapiens
caacucuguacaaag

SEQ ID NO: 1303835 - RNA, 12 nt, Homo sapiens
caacucuugauu

SEQ ID NO: 1303836 - RNA, 21 nt, Homo sapiens
caacuuaaaagucaguaucau

SEQ ID NO: 1303837 - RNA, 20 nt, Homo sapiens
caacuuauuaacaauuaggc

SEQ ID NO: 1303838 - RNA, 21 nt, Homo sapiens
caacuucuacuucugcccuug

SEQ ID NO: 1303839 - RNA, 15 nt, Homo sapiens
caugaggaccaggug

SEQ ID NO: 1303840 - RNA, 20 nt, Homo sapiens
caugagugcgugcucaguuc

SEQ ID NO: 1303841 - RNA, 18 nt, Homo sapiens
caugaucaucacaaucau

SEQ ID NO: 1303842 - RNA, 18 nt, Homo sapiens
caugaugagaaauggaug

SEQ ID NO: 1303843 - RNA, 17 nt, Homo sapiens
caugauuuccuugaaug

SEQ ID NO: 1303844 - RNA, 15 nt, Homo sapiens
caugcaggauuugaa

SEQ ID NO: 1303845 - RNA, 14 nt, Homo sapiens
caugcccugugcaa

SEQ ID NO: 1303846 - RNA, 18 nt, Homo sapiens
caugcgguagccagcaca

SEQ ID NO: 1303847 - RNA, 20 nt, Homo sapiens
caugcgguagccagcacaca

SEQ ID NO: 1303848 - RNA, 16 nt, Homo sapiens
caugcguccuggucaa

SEQ ID NO: 1303849 - RNA, 22 nt, Homo sapiens
caugcuacccagccauuaccca

SEQ ID NO: 1303850 - RNA, 22 nt, Homo sapiens
caugcuccuggcccacugcauc

SEQ ID NO: 1303851 - RNA, 20 nt, Homo sapiens
caugcugaagccaaagccaa

SEQ ID NO: 1303852 - RNA, 21 nt, Homo sapiens
caugcugcuagaucuuuauua

SEQ ID NO: 1303853 - RNA, 20 nt, Homo sapiens
caugcuggaaccugcaaaaa

SEQ ID NO: 1303854 - RNA, 12 nt, Homo sapiens
caugcuggugaa

SEQ ID NO: 1303855 - RNA, 19 nt, Homo sapiens
cauggaaaacccccuuccu

SEQ ID NO: 1303856 - RNA, 20 nt, Homo sapiens
cauggaguuaacaucaugaa

SEQ ID NO: 1303857 - RNA, 19 nt, Homo sapiens
cauggauuucucugcucac

SEQ ID NO: 1303858 - RNA, 16 nt, Homo sapiens
cauggcccaaauccag

SEQ ID NO: 1303859 - RNA, 13 nt, Homo sapiens
cauggcucauggg

SEQ ID NO: 1303860 - RNA, 19 nt, Homo sapiens
cauggcuuuggcuuugcaa

SEQ ID NO: 1303861 - RNA, 21 nt, Homo sapiens
cauggguuaucuguauggacu

SEQ ID NO: 1303862 - RNA, 19 nt, Homo sapiens
caugguacuccaugcauuc

SEQ ID NO: 1303863 - RNA, 22 nt, Homo sapiens
cauggugccccaggaccagcuc

SEQ ID NO: 1303864 - RNA, 17 nt, Homo sapiens
cauguaccugcucuucu

SEQ ID NO: 1303865 - RNA, 18 nt, Homo sapiens
caugucuggacucacgga

SEQ ID NO: 1303866 - RNA, 15 nt, Homo sapiens
caugugcaaaugugc

SEQ ID NO: 1303867 - RNA, 19 nt, Homo sapiens
caugugcaaaugugcuggu

SEQ ID NO: 1303868 - RNA, 18 nt, Homo sapiens
caugugcacaagugugca

SEQ ID NO: 1303869 - RNA, 17 nt, Homo sapiens
caugugcacaugcacgu

SEQ ID NO: 1303870 - RNA, 19 nt, Homo sapiens
caugugcgcgcgugcaugu

SEQ ID NO: 1303871 - RNA, 22 nt, Homo sapiens
caugugcgcgcgugcaugugug

SEQ ID NO: 1303872 - RNA, 15 nt, Homo sapiens
cauguuggcccagac

SEQ ID NO: 1303873 - RNA, 22 nt, Homo sapiens
cauguuuuccagcuccucaucc

SEQ ID NO: 1303874 - RNA, 14 nt, Homo sapiens
cauuaaauaaugca

SEQ ID NO: 1303875 - RNA, 20 nt, Homo sapiens
cauuaaauauaauaugcaca

SEQ ID NO: 1303876 - RNA, 21 nt, Homo sapiens
cauuaaggucauuacucucaa

SEQ ID NO: 1303877 - RNA, 16 nt, Homo sapiens
cauuacccagcuaaau

SEQ ID NO: 1303878 - RNA, 18 nt, Homo sapiens
cauuacccagcuaaauaa

SEQ ID NO: 1303879 - RNA, 14 nt, Homo sapiens
cauuaguugcacua

SEQ ID NO: 1303880 - RNA, 23 nt, Homo sapiens
cauuaguuguuagugauggagcu

SEQ ID NO: 1303881 - RNA, 15 nt, Homo sapiens
cauuauccauuccca

SEQ ID NO: 1303882 - RNA, 22 nt, Homo sapiens
cauucacaguucuuugggccag

SEQ ID NO: 1303883 - RNA, 22 nt, Homo sapiens
cauucagugauuacugucaagg

SEQ ID NO: 1303884 - RNA, 19 nt, Homo sapiens
cauucaguuaaaaauccag

SEQ ID NO: 1303885 - RNA, 17 nt, Homo sapiens
cauucauuuaacagagc

SEQ ID NO: 1303886 - RNA, 14 nt, Homo sapiens
cauuccccagcucc

SEQ ID NO: 1303887 - RNA, 17 nt, Homo sapiens
cauucccucucaucuca

SEQ ID NO: 1303888 - RNA, 13 nt, Homo sapiens
cauuccugaagaa

SEQ ID NO: 1303889 - RNA, 19 nt, Homo sapiens
cauucgucuuguuguuauu

SEQ ID NO: 1303890 - RNA, 13 nt, Homo sapiens
cauucuagguagg

SEQ ID NO: 1303891 - RNA, 18 nt, Homo sapiens
cauucugcaagcacaucu

SEQ ID NO: 1303892 - RNA, 21 nt, Homo sapiens
cauucugucacccagacugga

SEQ ID NO: 1303893 - RNA, 19 nt, Homo sapiens
cauucuuuuaaaagacaag

SEQ ID NO: 1303894 - RNA, 16 nt, Homo sapiens
cauugaacacaaacug

SEQ ID NO: 1303895 - RNA, 23 nt, Homo sapiens
cauugaccgcgacuaauuucaaa

SEQ ID NO: 1303896 - RNA, 21 nt, Homo sapiens
cauugaggauaaauugccaua

SEQ ID NO: 1303897 - RNA, 23 nt, Homo sapiens
cauugaugagcaagacauacuua

SEQ ID NO: 1303898 - RNA, 15 nt, Homo sapiens
cauugcaguuuaaga

SEQ ID NO: 1303899 - RNA, 20 nt, Homo sapiens
cauugcugacuguguauaua

SEQ ID NO: 1303900 - RNA, 17 nt, Homo sapiens
cauugcuguucuacuuu

SEQ ID NO: 1303901 - RNA, 13 nt, Homo sapiens
cauuggaggugaa

SEQ ID NO: 1303902 - RNA, 21 nt, Homo sapiens
cauuggaggugaacaagcaaa

SEQ ID NO: 1303903 - RNA, 14 nt, Homo sapiens
cauuguacuugaag

SEQ ID NO: 1303904 - RNA, 22 nt, Homo sapiens
cauugucguauaggcauguaaa

SEQ ID NO: 1303905 - RNA, 16 nt, Homo sapiens
cauugugaaccaaugc

SEQ ID NO: 1303906 - RNA, 14 nt, Homo sapiens
cauugugauguaua

SEQ ID NO: 1303907 - RNA, 16 nt, Homo sapiens
cauuguggacuuugaa

SEQ ID NO: 1303908 - RNA, 23 nt, Homo sapiens
cauuuaaacucagcugaucugau

SEQ ID NO: 1303909 - RNA, 18 nt, Homo sapiens
cauuuaauccuugugaga

SEQ ID NO: 1303910 - RNA, 21 nt, Homo sapiens
cauuuacaacucauuccagau

SEQ ID NO: 1303911 - RNA, 14 nt, Homo sapiens
cauuuacacauauc

SEQ ID NO: 1303912 - RNA, 14 nt, Homo sapiens
cauuuacccaacuc

SEQ ID NO: 1303913 - RNA, 23 nt, Homo sapiens
cauuuauauaucuaaguucacag

SEQ ID NO: 1303914 - RNA, 18 nt, Homo sapiens
cauuucacaaaacagccu

SEQ ID NO: 1303915 - RNA, 21 nt, Homo sapiens
cauuucuauuuauuuacugag

SEQ ID NO: 1303916 - RNA, 20 nt, Homo sapiens
cauuucugagaucaaaacgg

SEQ ID NO: 1303917 - RNA, 18 nt, Homo sapiens
cauuucuguuacuuguca

SEQ ID NO: 1303918 - RNA, 16 nt, Homo sapiens
cauuugcaccuaccuc

SEQ ID NO: 1303919 - RNA, 19 nt, Homo sapiens
cauuugcgaaugguuccau

SEQ ID NO: 1303920 - RNA, 14 nt, Homo sapiens
cauuugcuuugucc

SEQ ID NO: 1303921 - RNA, 18 nt, Homo sapiens
cauuuggcagagcuucuu

SEQ ID NO: 1303922 - RNA, 12 nt, Homo sapiens
cauuuguagcaa

SEQ ID NO: 1303923 - RNA, 15 nt, Homo sapiens
cauuugucucuacuu

SEQ ID NO: 1303924 - RNA, 16 nt, Homo sapiens
cauuugucucuacuuu

SEQ ID NO: 1303925 - RNA, 17 nt, Homo sapiens
cauuugugucauugaca

SEQ ID NO: 1303926 - RNA, 13 nt, Homo sapiens
cauuuuaaaaaca

SEQ ID NO: 1303927 - RNA, 21 nt, Homo sapiens
cauuuuauuuuuucuugcaaa

SEQ ID NO: 1303928 - RNA, 14 nt, Homo sapiens
cauuuugcacugua

SEQ ID NO: 1303929 - RNA, 21 nt, Homo sapiens
cauuuuuauaaaaaugagugc

SEQ ID NO: 1303930 - RNA, 17 nt, Homo sapiens
cauuuuuguaauaacau

SEQ ID NO: 1303931 - RNA, 13 nt, Homo sapiens
ccaaaacauugau

SEQ ID NO: 1303932 - RNA, 16 nt, Homo sapiens
ccaaaagcugcucagg

SEQ ID NO: 1303933 - RNA, 15 nt, Homo sapiens
ccaaaauucauuucu

SEQ ID NO: 1303934 - RNA, 12 nt, Homo sapiens
ccaaacagugac

SEQ ID NO: 1303935 - RNA, 12 nt, Homo sapiens
ccaaacauucuc

SEQ ID NO: 1303936 - RNA, 14 nt, Homo sapiens
ccaaaccuguaacc

SEQ ID NO: 1303937 - RNA, 22 nt, Homo sapiens
ccaaagccaauaacacacagcu

SEQ ID NO: 1303938 - RNA, 16 nt, Homo sapiens
ccaaagugucuuuuga

SEQ ID NO: 1303939 - RNA, 12 nt, Homo sapiens
ccaaauagcaaa

SEQ ID NO: 1303940 - RNA, 16 nt, Homo sapiens
ccaaauuuguauuuaa

SEQ ID NO: 1303941 - RNA, 21 nt, Homo sapiens
ccagggugauuuuaugaucag

SEQ ID NO: 1303942 - RNA, 13 nt, Homo sapiens
ccaggguggagug

SEQ ID NO: 1303943 - RNA, 15 nt, Homo sapiens
ccaggugaacuggaa

SEQ ID NO: 1303944 - RNA, 16 nt, Homo sapiens
ccaggugaacuggaau

SEQ ID NO: 1303945 - RNA, 15 nt, Homo sapiens
ccaguaaacagagga

SEQ ID NO: 1303946 - RNA, 23 nt, Homo sapiens
ccaguaauggaaugaagguaaua

SEQ ID NO: 1303947 - RNA, 19 nt, Homo sapiens
ccaguacuauuuuaauuug

SEQ ID NO: 1303948 - RNA, 17 nt, Homo sapiens
ccaguaguggacaacag

SEQ ID NO: 1303949 - RNA, 15 nt, Homo sapiens
ccaguaugacaguau

SEQ ID NO: 1303950 - RNA, 14 nt, Homo sapiens
ccagucacugugag

SEQ ID NO: 1303951 - RNA, 20 nt, Homo sapiens
ccagucacugugagcuccca

SEQ ID NO: 1303952 - RNA, 11 nt, Homo sapiens
ccagugacacc

SEQ ID NO: 1303953 - RNA, 13 nt, Homo sapiens
ccaguggcugcug

SEQ ID NO: 1303954 - RNA, 15 nt, Homo sapiens
ccaguucacccugau

SEQ ID NO: 1303955 - RNA, 22 nt, Homo sapiens
ccauaaaaauaaaucaguucau

SEQ ID NO: 1303956 - RNA, 12 nt, Homo sapiens
ccauaauaugau

SEQ ID NO: 1303957 - RNA, 19 nt, Homo sapiens
ccauaccacccaaugcuga

SEQ ID NO: 1303958 - RNA, 19 nt, Homo sapiens
ccauagcaagauugcuuaa

SEQ ID NO: 1303959 - RNA, 17 nt, Homo sapiens
ccauaguucacugacug

SEQ ID NO: 1303960 - RNA, 19 nt, Homo sapiens
ccauauauuggcacugcua

SEQ ID NO: 1303961 - RNA, 17 nt, Homo sapiens
ccaucacugguugcacu

SEQ ID NO: 1303962 - RNA, 23 nt, Homo sapiens
ccaucagcuuaggggcugcugac

SEQ ID NO: 1303963 - RNA, 16 nt, Homo sapiens
ccauccccaggcaccu

SEQ ID NO: 1303964 - RNA, 22 nt, Homo sapiens
ccauccgugcuaugacauggag

SEQ ID NO: 1303965 - RNA, 15 nt, Homo sapiens
ccauccucacugcug

SEQ ID NO: 1303966 - RNA, 14 nt, Homo sapiens
ccaucgaagcagau

SEQ ID NO: 1303967 - RNA, 15 nt, Homo sapiens
ccaucucgggcacag

SEQ ID NO: 1303968 - RNA, 22 nt, Homo sapiens
ccaucucgggcacaggcccacc

SEQ ID NO: 1303969 - RNA, 20 nt, Homo sapiens
ccaucuucagaccuuuggac

SEQ ID NO: 1303970 - RNA, 19 nt, Homo sapiens
ccaucuucgggaccaggau

SEQ ID NO: 1303971 - RNA, 23 nt, Homo sapiens
ccaugaacaucuuuagugucuga

SEQ ID NO: 1303972 - RNA, 17 nt, Homo sapiens
ccaugcaggauuugaau

SEQ ID NO: 1303973 - RNA, 14 nt, Homo sapiens
ccaugcauucaccu

SEQ ID NO: 1303974 - RNA, 15 nt, Homo sapiens
auuuacaauuugaca

SEQ ID NO: 1303975 - RNA, 20 nt, Homo sapiens
auuuacaguacuugucuuca

SEQ ID NO: 1303976 - RNA, 17 nt, Homo sapiens
auuuacaguuccuucaa

SEQ ID NO: 1303977 - RNA, 14 nt, Homo sapiens
auuuacgcuuugau

SEQ ID NO: 1303978 - RNA, 23 nt, Homo sapiens
auuuacuggacaaagaauuccaa

SEQ ID NO: 1303979 - RNA, 16 nt, Homo sapiens
auuuacuguugaucag

SEQ ID NO: 1303980 - RNA, 17 nt, Homo sapiens
auuuagaacagucauua

SEQ ID NO: 1303981 - RNA, 17 nt, Homo sapiens
auuuagaugcacuacca

SEQ ID NO: 1303982 - RNA, 19 nt, Homo sapiens
auuuagcccucacauuaga

SEQ ID NO: 1303983 - RNA, 19 nt, Homo sapiens
auuuauaaaacuucucaag

SEQ ID NO: 1303984 - RNA, 23 nt, Homo sapiens
auuuaucugugcaaauccuugau

SEQ ID NO: 1303985 - RNA, 19 nt, Homo sapiens
auuuaugacagugaacauu

SEQ ID NO: 1303986 - RNA, 16 nt, Homo sapiens
auuuaugcgaaccuau

SEQ ID NO: 1303987 - RNA, 21 nt, Homo sapiens
auuuaugcgaaccuaugucua

SEQ ID NO: 1303988 - RNA, 15 nt, Homo sapiens
auuuaugucccugac

SEQ ID NO: 1303989 - RNA, 13 nt, Homo sapiens
auuucagcauuau

SEQ ID NO: 1303990 - RNA, 22 nt, Homo sapiens
auuucauaaugaaaaacuaugu

SEQ ID NO: 1303991 - RNA, 13 nt, Homo sapiens
auuucauaugaca

SEQ ID NO: 1303992 - RNA, 13 nt, Homo sapiens
auuuccacuauuu

SEQ ID NO: 1303993 - RNA, 17 nt, Homo sapiens
auuuccagccagggcug

SEQ ID NO: 1303994 - RNA, 14 nt, Homo sapiens
auuuccagucucca

SEQ ID NO: 1303995 - RNA, 21 nt, Homo sapiens
auuuccccccuccgccuccag

SEQ ID NO: 1303996 - RNA, 20 nt, Homo sapiens
auuucccccuaaaccaacug

SEQ ID NO: 1303997 - RNA, 14 nt, Homo sapiens
cccugggacaucag

SEQ ID NO: 1303998 - RNA, 18 nt, Homo sapiens
cccugggcuggaggcuga

SEQ ID NO: 1303999 - RNA, 21 nt, Homo sapiens
cccuggugggccaacaaagaa

SEQ ID NO: 1304000 - RNA, 17 nt, Homo sapiens
cccuguaccugugcacg

SEQ ID NO: 1304001 - RNA, 20 nt, Homo sapiens
cccugucucggggcuugccc

SEQ ID NO: 1304002 - RNA, 18 nt, Homo sapiens
cccugucucuacuaaaaa

SEQ ID NO: 1304003 - RNA, 16 nt, Homo sapiens
cccugucuuccucugc

SEQ ID NO: 1304004 - RNA, 24 nt, Homo sapiens
cccugugaguuuguacagucuugc

SEQ ID NO: 1304005 - RNA, 15 nt, Homo sapiens
cccugugcugugugg

SEQ ID NO: 1304006 - RNA, 20 nt, Homo sapiens
cccuuacuaugaucucagga

SEQ ID NO: 1304007 - RNA, 15 nt, Homo sapiens
cccuuacuguuucac

SEQ ID NO: 1304008 - RNA, 13 nt, Homo sapiens
cccuucauaccca

SEQ ID NO: 1304009 - RNA, 23 nt, Homo sapiens
cccuucaucuuccuguguccuga

SEQ ID NO: 1304010 - RNA, 18 nt, Homo sapiens
cccuugaggaaacaacag

SEQ ID NO: 1304011 - RNA, 14 nt, Homo sapiens
cccuugcuggaguc

SEQ ID NO: 1304012 - RNA, 21 nt, Homo sapiens
cccuuguuucuauacauucua

SEQ ID NO: 1304013 - RNA, 15 nt, Homo sapiens
cccuuuaacucauga

SEQ ID NO: 1304014 - RNA, 15 nt, Homo sapiens
cccuuuccaaaggcc

SEQ ID NO: 1304015 - RNA, 14 nt, Homo sapiens
cccuuugccuucau

SEQ ID NO: 1304016 - RNA, 18 nt, Homo sapiens
cccuuuuacauacugcug

SEQ ID NO: 1304017 - RNA, 19 nt, Homo sapiens
cccuuuuggggaucaccuc

SEQ ID NO: 1304018 - RNA, 15 nt, Homo sapiens
ccgauuuugcucugu

SEQ ID NO: 1304019 - RNA, 17 nt, Homo sapiens
ccgauuuugcucugucu

SEQ ID NO: 1304020 - RNA, 16 nt, Homo sapiens
ccgccaaaggcccaaa

SEQ ID NO: 1304021 - RNA, 20 nt, Homo sapiens
ccgcccuaaaagcacacuca

SEQ ID NO: 1304022 - RNA, 16 nt, Homo sapiens
ccgcuuuuucacuccc

SEQ ID NO: 1304023 - RNA, 13 nt, Homo sapiens
ccggccaccagau

SEQ ID NO: 1304024 - RNA, 23 nt, Homo sapiens
ccgugaacuugugagaacacagc

SEQ ID NO: 1304025 - RNA, 19 nt, Homo sapiens
ccgugaggaugucacucag

SEQ ID NO: 1304026 - RNA, 18 nt, Homo sapiens
ccguggcuaagagugucc

SEQ ID NO: 1304027 - RNA, 14 nt, Homo sapiens
ccguggcugcaggg

SEQ ID NO: 1304028 - RNA, 16 nt, Homo sapiens
ccguggucccugagga

SEQ ID NO: 1304029 - RNA, 18 nt, Homo sapiens
ccuaaaacaaaagcucau

SEQ ID NO: 1304030 - RNA, 17 nt, Homo sapiens
ccuaaaagcacacucau

SEQ ID NO: 1304031 - RNA, 15 nt, Homo sapiens
ccuaaacauaugaau

SEQ ID NO: 1304032 - RNA, 15 nt, Homo sapiens
ccuaaacuccagggg

SEQ ID NO: 1304033 - RNA, 20 nt, Homo sapiens
ccuaaacucuuuuucaucca

SEQ ID NO: 1304034 - RNA, 19 nt, Homo sapiens
ccuaaagcuuuuauuuaac

SEQ ID NO: 1304035 - RNA, 21 nt, Homo sapiens
ccuaacacugggcugcagaga

SEQ ID NO: 1304036 - RNA, 15 nt, Homo sapiens
ccuaaccucauuccc

SEQ ID NO: 1304037 - RNA, 13 nt, Homo sapiens
ccuaacuucugua

SEQ ID NO: 1304038 - RNA, 22 nt, Homo sapiens
ccuaagcaacagaaauaaucug

SEQ ID NO: 1304039 - RNA, 17 nt, Homo sapiens
ccuaagcuggucucaaa

SEQ ID NO: 1304040 - RNA, 16 nt, Homo sapiens
ccuaagggacugugag

SEQ ID NO: 1304041 - RNA, 12 nt, Homo sapiens
ccuaaugcuccu

SEQ ID NO: 1304042 - RNA, 16 nt, Homo sapiens
ccuacaccucuugaaa

SEQ ID NO: 1304043 - RNA, 20 nt, Homo sapiens
ccuacacgagauacagaauu

SEQ ID NO: 1304044 - RNA, 21 nt, Homo sapiens
ccuacagccagaacuucugag

SEQ ID NO: 1304045 - RNA, 23 nt, Homo sapiens
ccuacaguugaaaaacagcugag

SEQ ID NO: 1304046 - RNA, 20 nt, Homo sapiens
ccuaccaggcacgucugcag

SEQ ID NO: 1304047 - RNA, 17 nt, Homo sapiens
ccuacuccgcucacuga

SEQ ID NO: 1304048 - RNA, 14 nt, Homo sapiens
ccuacucuguguca

SEQ ID NO: 1304049 - RNA, 18 nt, Homo sapiens
ccuacucuuccaucuuuc

SEQ ID NO: 1304050 - RNA, 16 nt, Homo sapiens
ccuacuuucauaauaa

SEQ ID NO: 1304051 - RNA, 21 nt, Homo sapiens
ccuacuuuuggccucaucucu

SEQ ID NO: 1304052 - RNA, 21 nt, Homo sapiens
ccuagcacuuugggaggccaa

SEQ ID NO: 1304053 - RNA, 24 nt, Homo sapiens
ccuagcuuagugaaaagauagcca

SEQ ID NO: 1304054 - RNA, 19 nt, Homo sapiens
ccuagggucuuguguugca

SEQ ID NO: 1304055 - RNA, 17 nt, Homo sapiens
ccuauaaaacaggucaa

SEQ ID NO: 1304056 - RNA, 18 nt, Homo sapiens
ccuaucaguuauuaauuu

SEQ ID NO: 1304057 - RNA, 20 nt, Homo sapiens
ccuauggcagagcauccucu

SEQ ID NO: 1304058 - RNA, 23 nt, Homo sapiens
ccuauguuuuuguucaaagccag

SEQ ID NO: 1304059 - RNA, 19 nt, Homo sapiens
ccuauuccugaacuauaac

SEQ ID NO: 1304060 - RNA, 20 nt, Homo sapiens
ccuauuuccauucaacaaga

SEQ ID NO: 1304061 - RNA, 15 nt, Homo sapiens
ccucaaccaaugcca

SEQ ID NO: 1304062 - RNA, 18 nt, Homo sapiens
ccucaaccuccugggcua

SEQ ID NO: 1304063 - RNA, 21 nt, Homo sapiens
ccucaccuuggcaccagacac

SEQ ID NO: 1304064 - RNA, 14 nt, Homo sapiens
ccucagagugcaag

SEQ ID NO: 1304065 - RNA, 14 nt, Homo sapiens
ccucagccagagaa

SEQ ID NO: 1304066 - RNA, 18 nt, Homo sapiens
ccucagccuugccagaga

SEQ ID NO: 1304067 - RNA, 19 nt, Homo sapiens
ccucagccuugccagagau

SEQ ID NO: 1304068 - RNA, 14 nt, Homo sapiens
ccucaggcaggugg

SEQ ID NO: 1304069 - RNA, 12 nt, Homo sapiens
ccucagugcauu

SEQ ID NO: 1304070 - RNA, 20 nt, Homo sapiens
ccucagugccccauucucac

SEQ ID NO: 1304071 - RNA, 17 nt, Homo sapiens
ccucauaggucagggag

SEQ ID NO: 1304072 - RNA, 18 nt, Homo sapiens
ccucaucccgagcaccuc

SEQ ID NO: 1304073 - RNA, 17 nt, Homo sapiens
ccucaugcugaucuucu

SEQ ID NO: 1304074 - RNA, 18 nt, Homo sapiens
ccucaugucuucucacaa

SEQ ID NO: 1304075 - RNA, 15 nt, Homo sapiens
ccucauucuacugaa

SEQ ID NO: 1304076 - RNA, 15 nt, Homo sapiens
ccucauuguucugua

SEQ ID NO: 1304077 - RNA, 14 nt, Homo sapiens
ccuccacagcagug

SEQ ID NO: 1304078 - RNA, 17 nt, Homo sapiens
ccuccagggacucuggg

SEQ ID NO: 1304079 - RNA, 17 nt, Homo sapiens
ccuccaguaguggacaa

SEQ ID NO: 1304080 - RNA, 21 nt, Homo sapiens
ccuccaguaguggacaacagg

SEQ ID NO: 1304081 - RNA, 21 nt, Homo sapiens
ccucccaaagugcugggauua

SEQ ID NO: 1304082 - RNA, 15 nt, Homo sapiens
ccucccaaccccagg

SEQ ID NO: 1304083 - RNA, 18 nt, Homo sapiens
ccucccagaacacacucc

SEQ ID NO: 1304084 - RNA, 20 nt, Homo sapiens
ccuccccuggggacagcaag

SEQ ID NO: 1304085 - RNA, 15 nt, Homo sapiens
ccucccuaaugcuca

SEQ ID NO: 1304086 - RNA, 16 nt, Homo sapiens
ccucccugaguggucc

SEQ ID NO: 1304087 - RNA, 20 nt, Homo sapiens
ccucccuguuccccagagaa

SEQ ID NO: 1304088 - RNA, 15 nt, Homo sapiens
ccuccgcccugccac

SEQ ID NO: 1304089 - RNA, 16 nt, Homo sapiens
ccuccgccuccaggaa

SEQ ID NO: 1304090 - RNA, 23 nt, Homo sapiens
ccuccuccagccgccaugcuccu

SEQ ID NO: 1304091 - RNA, 21 nt, Homo sapiens
ccuccucucaguguuuuggac

SEQ ID NO: 1304092 - RNA, 16 nt, Homo sapiens
ccuccugggcccucuc

SEQ ID NO: 1304093 - RNA, 19 nt, Homo sapiens
ccucggcuuuucucagcug

SEQ ID NO: 1304094 - RNA, 19 nt, Homo sapiens
ccucuacuuugauucugau

SEQ ID NO: 1304095 - RNA, 21 nt, Homo sapiens
ccucucagaugggcagcagcu

SEQ ID NO: 1304096 - RNA, 19 nt, Homo sapiens
cgggcuuuuccaagcugcc

SEQ ID NO: 1304097 - RNA, 23 nt, Homo sapiens
cggggacugcuucguguucugua

SEQ ID NO: 1304098 - RNA, 17 nt, Homo sapiens
cggggcauggcugcuga

SEQ ID NO: 1304099 - RNA, 18 nt, Homo sapiens
cggggccagcacuuccau

SEQ ID NO: 1304100 - RNA, 16 nt, Homo sapiens
cggggcuuugugggau

SEQ ID NO: 1304101 - RNA, 20 nt, Homo sapiens
cgguaaacacgccugcaaac

SEQ ID NO: 1304102 - RNA, 21 nt, Homo sapiens
cgguaagcacuuaaugaauga

SEQ ID NO: 1304103 - RNA, 18 nt, Homo sapiens
cggugacucaugccugua

SEQ ID NO: 1304104 - RNA, 19 nt, Homo sapiens
cggugucuuguucugucac

SEQ ID NO: 1304105 - RNA, 14 nt, Homo sapiens
cgguuuaauucugu

SEQ ID NO: 1304106 - RNA, 17 nt, Homo sapiens
cguacaaacauccaaaa

SEQ ID NO: 1304107 - RNA, 19 nt, Homo sapiens
cguauguaacaugauguua

SEQ ID NO: 1304108 - RNA, 18 nt, Homo sapiens
cgucagugcugugcugug

SEQ ID NO: 1304109 - RNA, 20 nt, Homo sapiens
cguccagggagcauuuuccu

SEQ ID NO: 1304110 - RNA, 17 nt, Homo sapiens
cgucccccaaacauguu

SEQ ID NO: 1304111 - RNA, 13 nt, Homo sapiens
cgucccuaccucc

SEQ ID NO: 1304112 - RNA, 13 nt, Homo sapiens
cguccuccgucca

SEQ ID NO: 1304113 - RNA, 13 nt, Homo sapiens
cgucuacugcaag

SEQ ID NO: 1304114 - RNA, 16 nt, Homo sapiens
cgugacacaaacacac

SEQ ID NO: 1304115 - RNA, 15 nt, Homo sapiens
cgugaucaaagccac

SEQ ID NO: 1304116 - RNA, 17 nt, Homo sapiens
cgugcacacaccagagc

SEQ ID NO: 1304117 - RNA, 18 nt, Homo sapiens
cgugcuuguuugcucacc

SEQ ID NO: 1304118 - RNA, 14 nt, Homo sapiens
cguggagcugccug

SEQ ID NO: 1304119 - RNA, 13 nt, Homo sapiens
cguggucccugag

SEQ ID NO: 1304120 - RNA, 18 nt, Homo sapiens
cguggugaccuuucacga

SEQ ID NO: 1304121 - RNA, 18 nt, Homo sapiens
cguguguguucacguguu

SEQ ID NO: 1304122 - RNA, 15 nt, Homo sapiens
cguucugugcacaaa

SEQ ID NO: 1304123 - RNA, 12 nt, Homo sapiens
cguugcuuucac

SEQ ID NO: 1304124 - RNA, 19 nt, Homo sapiens
cguuggccuaacacugggc

SEQ ID NO: 1304125 - RNA, 19 nt, Homo sapiens
cguuguacuguaugugaug

SEQ ID NO: 1304126 - RNA, 14 nt, Homo sapiens
cguuucugcucugu

SEQ ID NO: 1304127 - RNA, 21 nt, Homo sapiens
cguuugagaagaaaacaucua

SEQ ID NO: 1304128 - RNA, 19 nt, Homo sapiens
cuaaaaaucaaauaagcua

SEQ ID NO: 1304129 - RNA, 15 nt, Homo sapiens
cuaaaaaucugagaa

SEQ ID NO: 1304130 - RNA, 15 nt, Homo sapiens
cuaaaaaugcaacuu

SEQ ID NO: 1304131 - RNA, 17 nt, Homo sapiens
cuaaaaggaaaucucac

SEQ ID NO: 1304132 - RNA, 16 nt, Homo sapiens
cuaaaaguguaagaaa

SEQ ID NO: 1304133 - RNA, 15 nt, Homo sapiens
cuaaaauauuacaaa

SEQ ID NO: 1304134 - RNA, 14 nt, Homo sapiens
cuaaagaauccaua

SEQ ID NO: 1304135 - RNA, 17 nt, Homo sapiens
cuaaagaauucuugaaa

SEQ ID NO: 1304136 - RNA, 20 nt, Homo sapiens
cuaaagagagaugaaccaca

SEQ ID NO: 1304137 - RNA, 15 nt, Homo sapiens
cuaaagcaauaugca

SEQ ID NO: 1304138 - RNA, 14 nt, Homo sapiens
cuaaagccauugua

SEQ ID NO: 1304139 - RNA, 16 nt, Homo sapiens
cuaaaguaucuguauu

SEQ ID NO: 1304140 - RNA, 11 nt, Homo sapiens
cuaaaguuaua

SEQ ID NO: 1304141 - RNA, 22 nt, Homo sapiens
cuaaauagaaauaaaugauccc

SEQ ID NO: 1304142 - RNA, 14 nt, Homo sapiens
cuaaauccaaagaa

SEQ ID NO: 1304143 - RNA, 21 nt, Homo sapiens
cuaaaugaaaaucgugacaac

SEQ ID NO: 1304144 - RNA, 15 nt, Homo sapiens
cuaaaugacuuucaa

SEQ ID NO: 1304145 - RNA, 15 nt, Homo sapiens
cuaacacagccauca

SEQ ID NO: 1304146 - RNA, 19 nt, Homo sapiens
cuaacaucuugaauacucu

SEQ ID NO: 1304147 - RNA, 17 nt, Homo sapiens
cuaacauuauacuucau

SEQ ID NO: 1304148 - RNA, 22 nt, Homo sapiens
cuaaccucuaccagcacauuaa

SEQ ID NO: 1304149 - RNA, 16 nt, Homo sapiens
cuaagagaacaaugug

SEQ ID NO: 1304150 - RNA, 22 nt, Homo sapiens
cuaagauauuuugaacuaagca

SEQ ID NO: 1304151 - RNA, 22 nt, Homo sapiens
cuaagcaaaauugcuaaagaga

SEQ ID NO: 1304152 - RNA, 15 nt, Homo sapiens
cuaagcagaccacug

SEQ ID NO: 1304153 - RNA, 17 nt, Homo sapiens
cuaagcagaccacugau

SEQ ID NO: 1304154 - RNA, 15 nt, Homo sapiens
cuaaggaggggaaaa

SEQ ID NO: 1304155 - RNA, 16 nt, Homo sapiens
cuaaguaccuuuccua

SEQ ID NO: 1304156 - RNA, 14 nt, Homo sapiens
cuaaguggggaaaa

SEQ ID NO: 1304157 - RNA, 14 nt, Homo sapiens
cuaaguuagagcug

SEQ ID NO: 1304158 - RNA, 23 nt, Homo sapiens
cuaaguuagagcuggcaccagaa

SEQ ID NO: 1304159 - RNA, 17 nt, Homo sapiens
cuaaguucacggcaaaa

SEQ ID NO: 1304160 - RNA, 16 nt, Homo sapiens
cuaauaccugucaaca

SEQ ID NO: 1304161 - RNA, 14 nt, Homo sapiens
cuaauagagauuaa

SEQ ID NO: 1304162 - RNA, 16 nt, Homo sapiens
cuaauaucaaaugcag

SEQ ID NO: 1304163 - RNA, 16 nt, Homo sapiens
cuaaugcucaccuuua

SEQ ID NO: 1304164 - RNA, 18 nt, Homo sapiens
cuaauuauacuacuuugu

SEQ ID NO: 1304165 - RNA, 20 nt, Homo sapiens
cuacaaacacaauauucaau

SEQ ID NO: 1304166 - RNA, 17 nt, Homo sapiens
cuacaaacuucaaagag

SEQ ID NO: 1304167 - RNA, 21 nt, Homo sapiens
cuacaauauuaacauaagaaa

SEQ ID NO: 1304168 - RNA, 23 nt, Homo sapiens
cuacacuuugcuccucuggccca

SEQ ID NO: 1304169 - RNA, 22 nt, Homo sapiens
cuacagagcuucccugacucau

SEQ ID NO: 1304170 - RNA, 12 nt, Homo sapiens
cuacagggccaa

SEQ ID NO: 1304171 - RNA, 15 nt, Homo sapiens
cuacaugaacacguc

SEQ ID NO: 1304172 - RNA, 12 nt, Homo sapiens
cuacauucugua

SEQ ID NO: 1304173 - RNA, 20 nt, Homo sapiens
cuaccuucuuuggccccuug

SEQ ID NO: 1304174 - RNA, 14 nt, Homo sapiens
cuaccuugcagugu

SEQ ID NO: 1304175 - RNA, 14 nt, Homo sapiens
cuacguuaacccau

SEQ ID NO: 1304176 - RNA, 19 nt, Homo sapiens
cuacuacaaacuucaaaga

SEQ ID NO: 1304177 - RNA, 19 nt, Homo sapiens
cuacuagcucuuugagaua

SEQ ID NO: 1304178 - RNA, 13 nt, Homo sapiens
cuacuauauugau

SEQ ID NO: 1304179 - RNA, 20 nt, Homo sapiens
cuacucuagggaaaaaccag

SEQ ID NO: 1304180 - RNA, 20 nt, Homo sapiens
cuacuugggaggcugaggca

SEQ ID NO: 1304181 - RNA, 21 nt, Homo sapiens
cuagacuggcugaaaaaccua

SEQ ID NO: 1304182 - RNA, 23 nt, Homo sapiens
cuagaguauggagagauggucag

SEQ ID NO: 1304183 - RNA, 17 nt, Homo sapiens
cuagcaggcacaggaca

SEQ ID NO: 1304184 - RNA, 19 nt, Homo sapiens
cuagcauaucugccuuuau

SEQ ID NO: 1304185 - RNA, 18 nt, Homo sapiens
cuaggaagacauuuuucc

SEQ ID NO: 1304186 - RNA, 18 nt, Homo sapiens
cuaggaagaucucugcag

SEQ ID NO: 1304187 - RNA, 17 nt, Homo sapiens
cuaggaccuauguugua

SEQ ID NO: 1304188 - RNA, 16 nt, Homo sapiens
cuaggaguauccucau

SEQ ID NO: 1304189 - RNA, 14 nt, Homo sapiens
cuagggaucccuca

SEQ ID NO: 1304190 - RNA, 19 nt, Homo sapiens
cuaggguccaccaggaguu

SEQ ID NO: 1304191 - RNA, 15 nt, Homo sapiens
cuagguaggggccca

SEQ ID NO: 1304192 - RNA, 17 nt, Homo sapiens
cuagguaggggcccacu

SEQ ID NO: 1304193 - RNA, 14 nt, Homo sapiens
cuagucaagcuccu

SEQ ID NO: 1304194 - RNA, 17 nt, Homo sapiens
gcagcugguaaucuugc

SEQ ID NO: 1304195 - RNA, 18 nt, Homo sapiens
gcaggacuaaaugucuag

SEQ ID NO: 1304196 - RNA, 18 nt, Homo sapiens
gcaggacuuccccggagg

SEQ ID NO: 1304197 - RNA, 15 nt, Homo sapiens
gcaggagaucaucug

SEQ ID NO: 1304198 - RNA, 18 nt, Homo sapiens
gcaggauguuggccacca

SEQ ID NO: 1304199 - RNA, 14 nt, Homo sapiens
gcaggcuacacuga

SEQ ID NO: 1304200 - RNA, 22 nt, Homo sapiens
gcaggcuguggggcagcugagc

SEQ ID NO: 1304201 - RNA, 19 nt, Homo sapiens
gcaggcuucugugugcugc

SEQ ID NO: 1304202 - RNA, 15 nt, Homo sapiens
gcagggaaacagcua

SEQ ID NO: 1304203 - RNA, 14 nt, Homo sapiens
gcagggcugacucu

SEQ ID NO: 1304204 - RNA, 21 nt, Homo sapiens
gcagggugcaguaucaugccc

SEQ ID NO: 1304205 - RNA, 16 nt, Homo sapiens
gcagguacuacauuua

SEQ ID NO: 1304206 - RNA, 20 nt, Homo sapiens
gcaggugcuggagcacuggg

SEQ ID NO: 1304207 - RNA, 18 nt, Homo sapiens
gcagguguguauuuacuu

SEQ ID NO: 1304208 - RNA, 20 nt, Homo sapiens
gcagguuggaacuaugcagu

SEQ ID NO: 1304209 - RNA, 23 nt, Homo sapiens
gcagucaucuugaccaagcagga

SEQ ID NO: 1304210 - RNA, 17 nt, Homo sapiens
gcagucgugccuguguc

SEQ ID NO: 1304211 - RNA, 21 nt, Homo sapiens
gcagugaugcuggaugcuccu

SEQ ID NO: 1304212 - RNA, 14 nt, Homo sapiens
gcagugccuugcau

SEQ ID NO: 1304213 - RNA, 13 nt, Homo sapiens
gcagugguuugaa

SEQ ID NO: 1304214 - RNA, 22 nt, Homo sapiens
gcagugugcuccggccacacau

SEQ ID NO: 1304215 - RNA, 20 nt, Homo sapiens
gcaguucauccgcacuguaa

SEQ ID NO: 1304216 - RNA, 23 nt, Homo sapiens
gcaguucugaguguuuaauuuca

SEQ ID NO: 1304217 - RNA, 20 nt, Homo sapiens
gcauaccauuaaauaaugca

SEQ ID NO: 1304218 - RNA, 23 nt, Homo sapiens
gcauacgguaugauauugcagcu

SEQ ID NO: 1304219 - RNA, 14 nt, Homo sapiens
gcauagauugauca

SEQ ID NO: 1304220 - RNA, 20 nt, Homo sapiens
gcauaugugugugugugcau

SEQ ID NO: 1304221 - RNA, 18 nt, Homo sapiens
gcauauuaguugaugaaa

SEQ ID NO: 1304222 - RNA, 18 nt, Homo sapiens
gcaucacagaaugugaua

SEQ ID NO: 1304223 - RNA, 20 nt, Homo sapiens
gcauccuuuaggguucugcc

SEQ ID NO: 1304224 - RNA, 20 nt, Homo sapiens
gcaucuagauuauggagcuu

SEQ ID NO: 1304225 - RNA, 22 nt, Homo sapiens
gcaucuauucuuuguaccaucu

SEQ ID NO: 1304226 - RNA, 15 nt, Homo sapiens
gcaucucagugcagg

SEQ ID NO: 1304227 - RNA, 17 nt, Homo sapiens
gcaucucccacacaaga

SEQ ID NO: 1304228 - RNA, 21 nt, Homo sapiens
gcaucucccacacaagaccca

SEQ ID NO: 1304229 - RNA, 16 nt, Homo sapiens
gcaucuugcuggcuac

SEQ ID NO: 1304230 - RNA, 19 nt, Homo sapiens
gcaucuuuauaugcuugug

SEQ ID NO: 1304231 - RNA, 13 nt, Homo sapiens
gcaugauagacac

SEQ ID NO: 1304232 - RNA, 17 nt, Homo sapiens
gcaugauccaagcaaga

SEQ ID NO: 1304233 - RNA, 16 nt, Homo sapiens
gcaugcccaccuguug

SEQ ID NO: 1304234 - RNA, 13 nt, Homo sapiens
gcauggagcuaua

SEQ ID NO: 1304235 - RNA, 14 nt, Homo sapiens
gcauggagggaugg

SEQ ID NO: 1304236 - RNA, 22 nt, Homo sapiens
gcauguaccccagguacaucca

SEQ ID NO: 1304237 - RNA, 22 nt, Homo sapiens
gcaugucuacucagcauuugau

SEQ ID NO: 1304238 - RNA, 22 nt, Homo sapiens
gcauguuuugcccaccagauca

SEQ ID NO: 1304239 - RNA, 21 nt, Homo sapiens
gcauuaaaaaaaaaaucaaug

SEQ ID NO: 1304240 - RNA, 16 nt, Homo sapiens
gcugucaucugugcac

SEQ ID NO: 1304241 - RNA, 18 nt, Homo sapiens
gcugucaucugugcacug

SEQ ID NO: 1304242 - RNA, 21 nt, Homo sapiens
gcugucaucugugcacugccc

SEQ ID NO: 1304243 - RNA, 17 nt, Homo sapiens
gcugucccgugcauggg

SEQ ID NO: 1304244 - RNA, 16 nt, Homo sapiens
gcuguccuuacccauc

SEQ ID NO: 1304245 - RNA, 20 nt, Homo sapiens
gcugugagaggaucaucugg

SEQ ID NO: 1304246 - RNA, 18 nt, Homo sapiens
gcuguucucugucgugag

SEQ ID NO: 1304247 - RNA, 13 nt, Homo sapiens
gcuguuguccaac

SEQ ID NO: 1304248 - RNA, 17 nt, Homo sapiens
gcuguuuaguaguugaa

SEQ ID NO: 1304249 - RNA, 15 nt, Homo sapiens
gcuguuucagcuuua

SEQ ID NO: 1304250 - RNA, 22 nt, Homo sapiens
gcuguuuuccucccuucugcua

SEQ ID NO: 1304251 - RNA, 18 nt, Homo sapiens
gcuuaaaacaacacucac

SEQ ID NO: 1304252 - RNA, 23 nt, Homo sapiens
gcuuagaaaauucaagcauuuag

SEQ ID NO: 1304253 - RNA, 19 nt, Homo sapiens
gcuuagaaugcaucucauc

SEQ ID NO: 1304254 - RNA, 15 nt, Homo sapiens
gcuuagcauaucuga

SEQ ID NO: 1304255 - RNA, 16 nt, Homo sapiens
gcuucaccccaauccc

SEQ ID NO: 1304256 - RNA, 22 nt, Homo sapiens
gcuucagcucuucuugacauca

SEQ ID NO: 1304257 - RNA, 14 nt, Homo sapiens
gcuucaggcaaagc

SEQ ID NO: 1304258 - RNA, 18 nt, Homo sapiens
gcuucagguccaggcugu

SEQ ID NO: 1304259 - RNA, 15 nt, Homo sapiens
gcuucaguggcagcu

SEQ ID NO: 1304260 - RNA, 18 nt, Homo sapiens
gcuucccugaaagacuga

SEQ ID NO: 1304261 - RNA, 22 nt, Homo sapiens
gcuucucacugccaugccagcu

SEQ ID NO: 1304262 - RNA, 16 nt, Homo sapiens
gcuucuggccaggaag

SEQ ID NO: 1304263 - RNA, 17 nt, Homo sapiens
gcuucugucuccagcuu

SEQ ID NO: 1304264 - RNA, 16 nt, Homo sapiens
gcuucugugugcugcu

SEQ ID NO: 1304265 - RNA, 13 nt, Homo sapiens
gcuuggcugugcc

SEQ ID NO: 1304266 - RNA, 17 nt, Homo sapiens
gcuugggaaagguggug

SEQ ID NO: 1304267 - RNA, 17 nt, Homo sapiens
gcuuggguucacagugc

SEQ ID NO: 1304268 - RNA, 21 nt, Homo sapiens
gcuuuaauuuuuuuaaccaaa

SEQ ID NO: 1304269 - RNA, 13 nt, Homo sapiens
gcuuuaugcacau

SEQ ID NO: 1304270 - RNA, 21 nt, Homo sapiens
gcuuucauguaaacugugcac

SEQ ID NO: 1304271 - RNA, 22 nt, Homo sapiens
gcuuuguaucagucagugcugg

SEQ ID NO: 1304272 - RNA, 19 nt, Homo sapiens
gcuuuuacugaagccuuuc

SEQ ID NO: 1304273 - RNA, 21 nt, Homo sapiens
gcuuuugguggcuaccaugca

SEQ ID NO: 1304274 - RNA, 15 nt, Homo sapiens
gcuuuuugcuucuug

SEQ ID NO: 1304275 - RNA, 16 nt, Homo sapiens
ggaaaaaaacuauuaa

SEQ ID NO: 1304276 - RNA, 18 nt, Homo sapiens
ggaaaaaauaacaaugaa

SEQ ID NO: 1304277 - RNA, 18 nt, Homo sapiens
ggaaaaacuugugcuaua

SEQ ID NO: 1304278 - RNA, 15 nt, Homo sapiens
ggaaaacaagcauuc

SEQ ID NO: 1304279 - RNA, 17 nt, Homo sapiens
ggaaaagaaacacgcac

SEQ ID NO: 1304280 - RNA, 20 nt, Homo sapiens
ggaaaagcugcugacagugu

SEQ ID NO: 1304281 - RNA, 12 nt, Homo sapiens
ggaaaaggaaug

SEQ ID NO: 1304282 - RNA, 16 nt, Homo sapiens
ggaaacuuuccuuuaa

SEQ ID NO: 1304283 - RNA, 15 nt, Homo sapiens
ggaaagaacugucau

SEQ ID NO: 1304284 - RNA, 23 nt, Homo sapiens
ggaaagaguauuaagagcaauuc

SEQ ID NO: 1304285 - RNA, 23 nt, Homo sapiens
ggaaauaguacuuacaaaugacu

SEQ ID NO: 1304286 - RNA, 18 nt, Homo sapiens
ggaaaugggggggcgggg

SEQ ID NO: 1304287 - RNA, 18 nt, Homo sapiens
ggaaauguaaaagcacau

SEQ ID NO: 1304288 - RNA, 17 nt, Homo sapiens
ggaaauguagugcucga

SEQ ID NO: 1304289 - RNA, 16 nt, Homo sapiens
ggaacaagccuaaaaa

SEQ ID NO: 1304290 - RNA, 21 nt, Homo sapiens
ggaacacuacucuuacaugua

SEQ ID NO: 1304291 - RNA, 20 nt, Homo sapiens
ggaacagauucacacugucu

SEQ ID NO: 1304292 - RNA, 15 nt, Homo sapiens
ggaacaugaagccag

SEQ ID NO: 1304293 - RNA, 16 nt, Homo sapiens
ggaacucagauccagg

SEQ ID NO: 1304294 - RNA, 12 nt, Homo sapiens
ggaacugcauca

SEQ ID NO: 1304295 - RNA, 15 nt, Homo sapiens
ggaagaucaggucau

SEQ ID NO: 1304296 - RNA, 20 nt, Homo sapiens
ggaagcaaguuuucuuccau

SEQ ID NO: 1304297 - RNA, 16 nt, Homo sapiens
ggaagccagcagggaa

SEQ ID NO: 1304298 - RNA, 16 nt, Homo sapiens
ggaagcugucccucac

SEQ ID NO: 1304299 - RNA, 22 nt, Homo sapiens
ggaaggagaggagaggggcaca

SEQ ID NO: 1304300 - RNA, 15 nt, Homo sapiens
ggaagggcaggucug

SEQ ID NO: 1304301 - RNA, 11 nt, Homo sapiens
ggaagggucaa

SEQ ID NO: 1304302 - RNA, 17 nt, Homo sapiens
ggaagguucuacgccag

SEQ ID NO: 1304303 - RNA, 16 nt, Homo sapiens
ggaaguccucugggua

SEQ ID NO: 1304304 - RNA, 13 nt, Homo sapiens
ggaauauuuccau

SEQ ID NO: 1304305 - RNA, 13 nt, Homo sapiens
ggaaucagugaag

SEQ ID NO: 1304306 - RNA, 16 nt, Homo sapiens
ggaaugaaaacauuca

SEQ ID NO: 1304307 - RNA, 23 nt, Homo sapiens
ggacaaagaauuccaaagcaaaa

SEQ ID NO: 1304308 - RNA, 14 nt, Homo sapiens
ggacaagaccccca

SEQ ID NO: 1304309 - RNA, 18 nt, Homo sapiens
ggacaccugccauggaca

SEQ ID NO: 1304310 - RNA, 22 nt, Homo sapiens
ggacaccuggccgccuccagga

SEQ ID NO: 1304311 - RNA, 15 nt, Homo sapiens
ggacaggcauguucu

SEQ ID NO: 1304312 - RNA, 15 nt, Homo sapiens
ggacagggaggugac

SEQ ID NO: 1304313 - RNA, 19 nt, Homo sapiens
ggacauagcccuaacuccu

SEQ ID NO: 1304314 - RNA, 16 nt, Homo sapiens
ggacaugaaaaauugc

SEQ ID NO: 1304315 - RNA, 17 nt, Homo sapiens
ggacaugaagauucuuu

SEQ ID NO: 1304316 - RNA, 17 nt, Homo sapiens
ggaccaguggucucaca

SEQ ID NO: 1304317 - RNA, 16 nt, Homo sapiens
ggaccaugcagggaga

SEQ ID NO: 1304318 - RNA, 20 nt, Homo sapiens
ggaccaugcgacacugggag

SEQ ID NO: 1304319 - RNA, 22 nt, Homo sapiens
ggacguggcucagccagcacuu

SEQ ID NO: 1304320 - RNA, 10 nt, Homo sapiens
ggacuauuau

SEQ ID NO: 1304321 - RNA, 22 nt, Homo sapiens
ggacuauuauaauuuaaugcau

SEQ ID NO: 1304322 - RNA, 20 nt, Homo sapiens
ggacucaaaguuucagagac

SEQ ID NO: 1304323 - RNA, 13 nt, Homo sapiens
ggacuccaucucu

SEQ ID NO: 1304324 - RNA, 23 nt, Homo sapiens
ggacuccaucucucauccuccag

SEQ ID NO: 1304325 - RNA, 15 nt, Homo sapiens
ggacugaagccaaag

SEQ ID NO: 1304326 - RNA, 22 nt, Homo sapiens
ggacuugccacccccaguuccu

SEQ ID NO: 1304327 - RNA, 20 nt, Homo sapiens
ggacuuuuccucucaugucu

SEQ ID NO: 1304328 - RNA, 16 nt, Homo sapiens
ggagaaaauucaauug

SEQ ID NO: 1304329 - RNA, 15 nt, Homo sapiens
ggagacugcaucuca

SEQ ID NO: 1304330 - RNA, 16 nt, Homo sapiens
ggagacuuuacaugga

SEQ ID NO: 1304331 - RNA, 20 nt, Homo sapiens
ggagaugcugcaguuccaaa

SEQ ID NO: 1304332 - RNA, 23 nt, Homo sapiens
ggagcaaaggcugagaacacugu

SEQ ID NO: 1304333 - RNA, 19 nt, Homo sapiens
ggagcagaguguucccuga

SEQ ID NO: 1304334 - RNA, 15 nt, Homo sapiens
ggagcccagucugga

SEQ ID NO: 1304335 - RNA, 22 nt, Homo sapiens
ggagccccuucugcucagcucu

SEQ ID NO: 1304336 - RNA, 23 nt, Homo sapiens
ggagcuuccuguccucccagcuc

SEQ ID NO: 1304337 - RNA, 12 nt, Homo sapiens
ggaggagcagug

SEQ ID NO: 1304338 - RNA, 20 nt, Homo sapiens
ggaggauguucugggacaca

SEQ ID NO: 1304339 - RNA, 17 nt, Homo sapiens
ggaggcaaauggcacug

SEQ ID NO: 1304340 - RNA, 19 nt, Homo sapiens
ggaggccagccagugaccu

SEQ ID NO: 1304341 - RNA, 19 nt, Homo sapiens
ggaggccagcuaucugccu

SEQ ID NO: 1304342 - RNA, 21 nt, Homo sapiens
ggaggcuccagagggcacucu

SEQ ID NO: 1304343 - RNA, 17 nt, Homo sapiens
ggaggcugcgugccagu

SEQ ID NO: 1304344 - RNA, 13 nt, Homo sapiens
ggagggacaagug

SEQ ID NO: 1304345 - RNA, 17 nt, Homo sapiens
ggagggacacuuaccca

SEQ ID NO: 1304346 - RNA, 14 nt, Homo sapiens
ggagggagcucuga

SEQ ID NO: 1304347 - RNA, 14 nt, Homo sapiens
ggagggcaguuuuc

SEQ ID NO: 1304348 - RNA, 13 nt, Homo sapiens
ggaguaugcaaaa

SEQ ID NO: 1304349 - RNA, 16 nt, Homo sapiens
ggagucaugugccucu

SEQ ID NO: 1304350 - RNA, 23 nt, Homo sapiens
ggauaauauccagccucccacaa

SEQ ID NO: 1304351 - RNA, 21 nt, Homo sapiens
ggauacauaaugggccacuga

SEQ ID NO: 1304352 - RNA, 16 nt, Homo sapiens
ggauagagacuggaac

SEQ ID NO: 1304353 - RNA, 20 nt, Homo sapiens
ggauauaagugauaguuuau

SEQ ID NO: 1304354 - RNA, 14 nt, Homo sapiens
ggauaucaaaagca

SEQ ID NO: 1304355 - RNA, 17 nt, Homo sapiens
ggauauugucagucuuu

SEQ ID NO: 1304356 - RNA, 20 nt, Homo sapiens
ggauauuugguuuggccauc

SEQ ID NO: 1304357 - RNA, 17 nt, Homo sapiens
ggaucgcaagagccaug

SEQ ID NO: 1304358 - RNA, 21 nt, Homo sapiens
ggaucugauaaggaucuagga

SEQ ID NO: 1304359 - RNA, 19 nt, Homo sapiens
ggaugauucaagccauucc

SEQ ID NO: 1304360 - RNA, 21 nt, Homo sapiens
ggaugccaaccggucacccag

SEQ ID NO: 1304361 - RNA, 18 nt, Homo sapiens
ggauggaaauguagugcu

SEQ ID NO: 1304362 - RNA, 18 nt, Homo sapiens
ggaugggcuucacugggg

SEQ ID NO: 1304363 - RNA, 17 nt, Homo sapiens
ggaugguggagggccac

SEQ ID NO: 1304364 - RNA, 18 nt, Homo sapiens
ggaugucugaacuuuggg

SEQ ID NO: 1304365 - RNA, 16 nt, Homo sapiens
ggauguucugggacac

SEQ ID NO: 1304366 - RNA, 10 nt, Homo sapiens
ggauguugcc

SEQ ID NO: 1304367 - RNA, 14 nt, Homo sapiens
ggauucccaggaug

SEQ ID NO: 1304368 - RNA, 15 nt, Homo sapiens
ggauuuucacauucu

SEQ ID NO: 1304369 - RNA, 22 nt, Homo sapiens
ggcaaagagagucgcaucucag

SEQ ID NO: 1304370 - RNA, 14 nt, Homo sapiens
ggcaaggaugucug

SEQ ID NO: 1304371 - RNA, 20 nt, Homo sapiens
ggcaaucacggcucacugua

SEQ ID NO: 1304372 - RNA, 16 nt, Homo sapiens
ggcacaaagaugggug

SEQ ID NO: 1304373 - RNA, 15 nt, Homo sapiens
ggcacaccgggcacu

SEQ ID NO: 1304374 - RNA, 15 nt, Homo sapiens
ggcacauuccuugcc

SEQ ID NO: 1304375 - RNA, 9 nt, Homo sapiens
ggcacauug

SEQ ID NO: 1304376 - RNA, 18 nt, Homo sapiens
ggcaccaaaguccaggac

SEQ ID NO: 1304377 - RNA, 17 nt, Homo sapiens
ggcacuacuucuauuca

SEQ ID NO: 1304378 - RNA, 19 nt, Homo sapiens
ggcacucagaagacacuga

SEQ ID NO: 1304379 - RNA, 15 nt, Homo sapiens
ggcagaaugaaucua

SEQ ID NO: 1304380 - RNA, 18 nt, Homo sapiens
ggcagccacaacugcagu

SEQ ID NO: 1304381 - RNA, 13 nt, Homo sapiens
ggcagcgacccca

SEQ ID NO: 1304382 - RNA, 19 nt, Homo sapiens
ggcagcuauagucuggcac

SEQ ID NO: 1304383 - RNA, 21 nt, Homo sapiens
ggcagcuauagucuggcacca

SEQ ID NO: 1304384 - RNA, 21 nt, Homo sapiens
ggcaggcuuagagucaggcau

SEQ ID NO: 1304385 - RNA, 13 nt, Homo sapiens
ggcagggugcagu

SEQ ID NO: 1304386 - RNA, 14 nt, Homo sapiens
ggcagggugcagua

SEQ ID NO: 1304387 - RNA, 17 nt, Homo sapiens
ggcaguccagccagcuc

SEQ ID NO: 1304388 - RNA, 24 nt, Homo sapiens
ggcauagaugcaggugagcccaug

SEQ ID NO: 1304389 - RNA, 23 nt, Homo sapiens
ggcaucaccuccaccauacucca

SEQ ID NO: 1304390 - RNA, 12 nt, Homo sapiens
ggcaucauggaa

SEQ ID NO: 1304391 - RNA, 12 nt, Homo sapiens
ggcaucuugcca

SEQ ID NO: 1304392 - RNA, 20 nt, Homo sapiens
ggcaugagcuacuaugccca

SEQ ID NO: 1304393 - RNA, 14 nt, Homo sapiens
ggcaugguggccca

SEQ ID NO: 1304394 - RNA, 14 nt, Homo sapiens
ggcauucucugaag

SEQ ID NO: 1304395 - RNA, 12 nt, Homo sapiens
ggccaacaaaga

SEQ ID NO: 1304396 - RNA, 20 nt, Homo sapiens
ggccaaggagggcagaucac

SEQ ID NO: 1304397 - RNA, 19 nt, Homo sapiens
ggccacuguuugucucacc

SEQ ID NO: 1304398 - RNA, 16 nt, Homo sapiens
ggccagagccaagggg

SEQ ID NO: 1304399 - RNA, 23 nt, Homo sapiens
ggccagagccgaggcgggcgggg

SEQ ID NO: 1304400 - RNA, 19 nt, Homo sapiens
ggccagagggagugacaga

SEQ ID NO: 1304401 - RNA, 21 nt, Homo sapiens
ggccagccuuucccccuguga

SEQ ID NO: 1304402 - RNA, 17 nt, Homo sapiens
ggccaguaccuuuccau

SEQ ID NO: 1304403 - RNA, 11 nt, Homo sapiens
ggccaguguga

SEQ ID NO: 1304404 - RNA, 19 nt, Homo sapiens
ggcccagagcccagcucca

SEQ ID NO: 1304405 - RNA, 15 nt, Homo sapiens
ggcccauacugguug

SEQ ID NO: 1304406 - RNA, 16 nt, Homo sapiens
ggcccauaucugugaa

SEQ ID NO: 1304407 - RNA, 15 nt, Homo sapiens
ggccccacauugcac

SEQ ID NO: 1304408 - RNA, 22 nt, Homo sapiens
ggccccucuccuccguggcaca

SEQ ID NO: 1304409 - RNA, 23 nt, Homo sapiens
ggccccucuccuccguggcacau

SEQ ID NO: 1304410 - RNA, 18 nt, Homo sapiens
ggccccugcacacucagu

SEQ ID NO: 1304411 - RNA, 15 nt, Homo sapiens
ggcccugcugaguca

SEQ ID NO: 1304412 - RNA, 14 nt, Homo sapiens
ggcccugucugugu

SEQ ID NO: 1304413 - RNA, 23 nt, Homo sapiens
ggcccuuccucuuugguggcaug

SEQ ID NO: 1304414 - RNA, 15 nt, Homo sapiens
ggcccuuugcugucc

SEQ ID NO: 1304415 - RNA, 18 nt, Homo sapiens
ggccgggcaauccagaca

SEQ ID NO: 1304416 - RNA, 17 nt, Homo sapiens
ggccguccuugucucug

SEQ ID NO: 1304417 - RNA, 15 nt, Homo sapiens
ggccuaacacugggc

SEQ ID NO: 1304418 - RNA, 23 nt, Homo sapiens
ggccuaacacugggcugcagaga

SEQ ID NO: 1304419 - RNA, 11 nt, Homo sapiens
ggccuccagaa

SEQ ID NO: 1304420 - RNA, 20 nt, Homo sapiens
ggccuccucucucaguuuuu

SEQ ID NO: 1304421 - RNA, 20 nt, Homo sapiens
ggccuccuggcccaggugag

SEQ ID NO: 1304422 - RNA, 15 nt, Homo sapiens
ggccugaccaaacag

SEQ ID NO: 1304423 - RNA, 16 nt, Homo sapiens
ggccugacugcucaga

SEQ ID NO: 1304424 - RNA, 20 nt, Homo sapiens
gccggugugccugacugccc

SEQ ID NO: 1304425 - RNA, 21 nt, Homo sapiens
gccguacucuuuggggcagcu

SEQ ID NO: 1304426 - RNA, 17 nt, Homo sapiens
gccgugagcauguuugg

SEQ ID NO: 1304427 - RNA, 22 nt, Homo sapiens
gccguggggccgccgccucuuu

SEQ ID NO: 1304428 - RNA, 17 nt, Homo sapiens
gccuaaaaaugcaacuu

SEQ ID NO: 1304429 - RNA, 21 nt, Homo sapiens
gccuaaaagugggcuugauuc

SEQ ID NO: 1304430 - RNA, 14 nt, Homo sapiens
gccuacagccagaa

SEQ ID NO: 1304431 - RNA, 16 nt, Homo sapiens
gccuacguuaacccau

SEQ ID NO: 1304432 - RNA, 15 nt, Homo sapiens
gccuauagacacuua

SEQ ID NO: 1304433 - RNA, 19 nt, Homo sapiens
gccucaccuuggggccuug

SEQ ID NO: 1304434 - RNA, 17 nt, Homo sapiens
gccucagcccugacccu

SEQ ID NO: 1304435 - RNA, 17 nt, Homo sapiens
gccuccagaagcacugg

SEQ ID NO: 1304436 - RNA, 18 nt, Homo sapiens
gccuccaucagcuaaaca

SEQ ID NO: 1304437 - RNA, 21 nt, Homo sapiens
gccucccauucuacucaaagu

SEQ ID NO: 1304438 - RNA, 18 nt, Homo sapiens
gccucccugaagccuuug

SEQ ID NO: 1304439 - RNA, 16 nt, Homo sapiens
gccuccucacaacaug

SEQ ID NO: 1304440 - RNA, 13 nt, Homo sapiens
gccucuacuuuau

SEQ ID NO: 1304441 - RNA, 20 nt, Homo sapiens
gccucucugcuccaccuugu

SEQ ID NO: 1304442 - RNA, 10 nt, Homo sapiens
gccucugugc

SEQ ID NO: 1304443 - RNA, 14 nt, Homo sapiens
gccucugugccuuc

SEQ ID NO: 1304444 - RNA, 22 nt, Homo sapiens
gccucuucuccccggcacuucc

SEQ ID NO: 1304445 - RNA, 14 nt, Homo sapiens
gccucuuucaucca

SEQ ID NO: 1304446 - RNA, 16 nt, Homo sapiens
gccugaacaugccccu

SEQ ID NO: 1304447 - RNA, 12 nt, Homo sapiens
gccugaaccugg

SEQ ID NO: 1304448 - RNA, 13 nt, Homo sapiens
gccugaaccuggg

SEQ ID NO: 1304449 - RNA, 12 nt, Homo sapiens
gccugcaggacc

SEQ ID NO: 1304450 - RNA, 18 nt, Homo sapiens
gccugcauguaaacacgc

SEQ ID NO: 1304451 - RNA, 23 nt, Homo sapiens
gccugccccaaacaaauaugcaa

SEQ ID NO: 1304452 - RNA, 18 nt, Homo sapiens
gccugcccguaaacacgc

SEQ ID NO: 1304453 - RNA, 22 nt, Homo sapiens
gccugcuuucacacuaaggaaa

SEQ ID NO: 1304454 - RNA, 21 nt, Homo sapiens
gccuggcacacgccuguauuc

SEQ ID NO: 1304455 - RNA, 17 nt, Homo sapiens
gccuggccaacauggug

SEQ ID NO: 1304456 - RNA, 17 nt, Homo sapiens
gccugguacucaagccc

SEQ ID NO: 1304457 - RNA, 13 nt, Homo sapiens
gccuguaauccca

SEQ ID NO: 1304458 - RNA, 20 nt, Homo sapiens
gccuguugaagaugcuugua

SEQ ID NO: 1304459 - RNA, 20 nt, Homo sapiens
gccuuaaaccuaccucccac

SEQ ID NO: 1304460 - RNA, 14 nt, Homo sapiens
gccuucacauuccc

SEQ ID NO: 1304461 - RNA, 15 nt, Homo sapiens
gccuuccagccacau

SEQ ID NO: 1304462 - RNA, 19 nt, Homo sapiens
gccuuccagccacaucgcc

SEQ ID NO: 1304463 - RNA, 16 nt, Homo sapiens
gccuucucaccagcug

SEQ ID NO: 1304464 - RNA, 15 nt, Homo sapiens
gccuuuccucaaaac

SEQ ID NO: 1304465 - RNA, 15 nt, Homo sapiens
gccuuugaccccagc

SEQ ID NO: 1304466 - RNA, 22 nt, Homo sapiens
gccuuugcccaaaacugucauc

SEQ ID NO: 1304467 - RNA, 17 nt, Homo sapiens
gcgaaaaaaucagugaa

SEQ ID NO: 1304468 - RNA, 13 nt, Homo sapiens
gcgacacugggag

SEQ ID NO: 1304469 - RNA, 22 nt, Homo sapiens
gcgauccaccugucucagccuc

SEQ ID NO: 1304470 - RNA, 18 nt, Homo sapiens
gcgauccucccaccucag

SEQ ID NO: 1304471 - RNA, 23 nt, Homo sapiens
gcgccaaauaaugucucugugag

SEQ ID NO: 1304472 - RNA, 20 nt, Homo sapiens
ggguggagugcaguggugcg

SEQ ID NO: 1304473 - RNA, 22 nt, Homo sapiens
gguaaaaguucuuuuugcucua

SEQ ID NO: 1304474 - RNA, 21 nt, Homo sapiens
gguaaaaugccaugaugccuc

SEQ ID NO: 1304475 - RNA, 19 nt, Homo sapiens
gguaaagggcgcaaagggc

SEQ ID NO: 1304476 - RNA, 17 nt, Homo sapiens
gguaacuuggcugcauu

SEQ ID NO: 1304477 - RNA, 14 nt, Homo sapiens
gguaagcaccagga

SEQ ID NO: 1304478 - RNA, 17 nt, Homo sapiens
gguacaaacccaaaaaa

SEQ ID NO: 1304479 - RNA, 17 nt, Homo sapiens
gguaccaagagacuccu

SEQ ID NO: 1304480 - RNA, 22 nt, Homo sapiens
gguacuauaaaagcuuucugcc

SEQ ID NO: 1304481 - RNA, 11 nt, Homo sapiens
gguagccagca

SEQ ID NO: 1304482 - RNA, 20 nt, Homo sapiens
gguauaaugguugacugggu

SEQ ID NO: 1304483 - RNA, 13 nt, Homo sapiens
gguaucaggugcu

SEQ ID NO: 1304484 - RNA, 14 nt, Homo sapiens
gguaucuucuuuag

SEQ ID NO: 1304485 - RNA, 18 nt, Homo sapiens
gguaugaucacggcucac

SEQ ID NO: 1304486 - RNA, 23 nt, Homo sapiens
gguaugaucacggcucacugcag

SEQ ID NO: 1304487 - RNA, 14 nt, Homo sapiens
gguauguaacucuu

SEQ ID NO: 1304488 - RNA, 15 nt, Homo sapiens
gguauguaauggaac

SEQ ID NO: 1304489 - RNA, 17 nt, Homo sapiens
ggucaccugggcuguga

SEQ ID NO: 1304490 - RNA, 21 nt, Homo sapiens
ggucagaacccugccauggaa

SEQ ID NO: 1304491 - RNA, 12 nt, Homo sapiens
ggucagcaguau

SEQ ID NO: 1304492 - RNA, 13 nt, Homo sapiens
ggucagcauguac

SEQ ID NO: 1304493 - RNA, 12 nt, Homo sapiens
ggucagcauuug

SEQ ID NO: 1304494 - RNA, 20 nt, Homo sapiens
ggucagggccccucuaccca

SEQ ID NO: 1304495 - RNA, 15 nt, Homo sapiens
ggucagugguccaca

SEQ ID NO: 1304496 - RNA, 21 nt, Homo sapiens
ggucagugguggucuucaaga

SEQ ID NO: 1304497 - RNA, 19 nt, Homo sapiens
ggucauagauguuuccuug

SEQ ID NO: 1304498 - RNA, 18 nt, Homo sapiens
gguccugaaaguaacuca

SEQ ID NO: 1304499 - RNA, 22 nt, Homo sapiens
gguccuguuaacgucaucucag

SEQ ID NO: 1304500 - RNA, 23 nt, Homo sapiens
ggucuaugccaggcccauuuccu

SEQ ID NO: 1304501 - RNA, 21 nt, Homo sapiens
ggucugagucuauguucaaag

SEQ ID NO: 1304502 - RNA, 20 nt, Homo sapiens
ggucuucaagacgacagcuc

SEQ ID NO: 1304503 - RNA, 20 nt, Homo sapiens
ggucuugaggagagagacag

SEQ ID NO: 1304504 - RNA, 14 nt, Homo sapiens
ggucuugagugcau

SEQ ID NO: 1304505 - RNA, 22 nt, Homo sapiens
ggugaaacccagucacugugag

SEQ ID NO: 1304506 - RNA, 20 nt, Homo sapiens
ggugaacaaagcagccacga

SEQ ID NO: 1304507 - RNA, 15 nt, Homo sapiens
ggugaauuucacaag

SEQ ID NO: 1304508 - RNA, 18 nt, Homo sapiens
ggugacuuuucaccuuaa

SEQ ID NO: 1304509 - RNA, 12 nt, Homo sapiens
ggugagugcaag

SEQ ID NO: 1304510 - RNA, 19 nt, Homo sapiens
ggugcauagcaagugaaag

SEQ ID NO: 1304511 - RNA, 14 nt, Homo sapiens
ggugccaucaucuc

SEQ ID NO: 1304512 - RNA, 12 nt, Homo sapiens
ggugcuuuccag

SEQ ID NO: 1304513 - RNA, 19 nt, Homo sapiens
gguggacuugaacuuuccu

SEQ ID NO: 1304514 - RNA, 20 nt, Homo sapiens
gguggagugcaguggugcga

SEQ ID NO: 1304515 - RNA, 17 nt, Homo sapiens
gguggcucacgccugua

SEQ ID NO: 1304516 - RNA, 13 nt, Homo sapiens
ggugucagagcug

SEQ ID NO: 1304517 - RNA, 19 nt, Homo sapiens
ggugucuggauucccagga

SEQ ID NO: 1304518 - RNA, 11 nt, Homo sapiens
ggugucuguga

SEQ ID NO: 1304519 - RNA, 20 nt, Homo sapiens
ggugugaaccaccacaccca

SEQ ID NO: 1304520 - RNA, 19 nt, Homo sapiens
gguguggacugaaugggau

SEQ ID NO: 1304521 - RNA, 22 nt, Homo sapiens
gguguguauacuuguauaacuu

SEQ ID NO: 1304522 - RNA, 13 nt, Homo sapiens
gguguuaauugaa

SEQ ID NO: 1304523 - RNA, 13 nt, Homo sapiens
gguguuuugccau

SEQ ID NO: 1304524 - RNA, 15 nt, Homo sapiens
uucucauuugucaca

SEQ ID NO: 1304525 - RNA, 15 nt, Homo sapiens
uucuccaaacgauua

SEQ ID NO: 1304526 - RNA, 20 nt, Homo sapiens
uucuccugccuuugccucca

SEQ ID NO: 1304527 - RNA, 15 nt, Homo sapiens
uucucgcucccgcca

SEQ ID NO: 1304528 - RNA, 23 nt, Homo sapiens
uucucuaguucaaguucaccaga

SEQ ID NO: 1304529 - RNA, 23 nt, Homo sapiens
uucucuaugauaauuacaauaca

SEQ ID NO: 1304530 - RNA, 22 nt, Homo sapiens
uucucucacuguguuacugcuu

SEQ ID NO: 1304531 - RNA, 21 nt, Homo sapiens
uucucuuagaacauuguauua

SEQ ID NO: 1304532 - RNA, 22 nt, Homo sapiens
uucucuugagaggguggaauau

SEQ ID NO: 1304533 - RNA, 11 nt, Homo sapiens
uucugacacag

SEQ ID NO: 1304534 - RNA, 19 nt, Homo sapiens
uucugagacagcuugucug

SEQ ID NO: 1304535 - RNA, 12 nt, Homo sapiens
uucugcauguac

SEQ ID NO: 1304536 - RNA, 23 nt, Homo sapiens
uucugccaggcccccaagccugc

SEQ ID NO: 1304537 - RNA, 16 nt, Homo sapiens
uucuggaaacauucag

SEQ ID NO: 1304538 - RNA, 21 nt, Homo sapiens
uucuggacggcccagcagcuc

SEQ ID NO: 1304539 - RNA, 20 nt, Homo sapiens
uucuggauggugugccuucc

SEQ ID NO: 1304540 - RNA, 16 nt, Homo sapiens
uucugggacacaguuc

SEQ ID NO: 1304541 - RNA, 16 nt, Homo sapiens
uucugggacuacaggc

SEQ ID NO: 1304542 - RNA, 18 nt, Homo sapiens
uucuggguucauauauau

SEQ ID NO: 1304543 - RNA, 23 nt, Homo sapiens
uucugguggagagaagugagaau

SEQ ID NO: 1304544 - RNA, 14 nt, Homo sapiens
uucuguauucugac

SEQ ID NO: 1304545 - RNA, 21 nt, Homo sapiens
uucugucuacuaagugaugcu

SEQ ID NO: 1304546 - RNA, 14 nt, Homo sapiens
uucugucuucccaa

SEQ ID NO: 1304547 - RNA, 21 nt, Homo sapiens
uucugucuucccaaacccagu

SEQ ID NO: 1304548 - RNA, 18 nt, Homo sapiens
uucugugcccuccugacc

SEQ ID NO: 1304549 - RNA, 22 nt, Homo sapiens
uucuguuuuuaaugcuauuuga

SEQ ID NO: 1304550 - RNA, 18 nt, Homo sapiens
uucuuaauccaguucugc

SEQ ID NO: 1304551 - RNA, 21 nt, Homo sapiens
uucuuaauucauccuagcaaa

SEQ ID NO: 1304552 - RNA, 18 nt, Homo sapiens
uucuuacacugugucauu

SEQ ID NO: 1304553 - RNA, 15 nt, Homo sapiens
uucuuagucucagca

SEQ ID NO: 1304554 - RNA, 22 nt, Homo sapiens
uucuucaccucuuccacuccuu

SEQ ID NO: 1304555 - RNA, 17 nt, Homo sapiens
uucuucagcuugauccu

SEQ ID NO: 1304556 - RNA, 13 nt, Homo sapiens
uucuucuucacau

SEQ ID NO: 1304557 - RNA, 20 nt, Homo sapiens
uucuugauuaaagugauuga

SEQ ID NO: 1304558 - RNA, 18 nt, Homo sapiens
uucuuugacuuaaugucu

SEQ ID NO: 1304559 - RNA, 16 nt, Homo sapiens
uucuuuggaacuuuaa

SEQ ID NO: 1304560 - RNA, 14 nt, Homo sapiens
uucuuuuugcucua

SEQ ID NO: 1304561 - RNA, 15 nt, Homo sapiens
uucuuuuugcucuaa

SEQ ID NO: 1304562 - RNA, 21 nt, Homo sapiens
uugaaaggacuagccacauac

SEQ ID NO: 1304563 - RNA, 15 nt, Homo sapiens
uugaacccaggagau

SEQ ID NO: 1304564 - RNA, 12 nt, Homo sapiens
uugaacuuggaa

SEQ ID NO: 1304565 - RNA, 19 nt, Homo sapiens
uugaagauaguaacuguag

SEQ ID NO: 1304566 - RNA, 23 nt, Homo sapiens
uugaauuguuacaucaugcugga

SEQ ID NO: 1304567 - RNA, 20 nt, Homo sapiens
uugaauuuuuuucugcacag

SEQ ID NO: 1304568 - RNA, 14 nt, Homo sapiens
uugacaacccaaac

SEQ ID NO: 1304569 - RNA, 15 nt, Homo sapiens
uugacaauaauuuca

SEQ ID NO: 1304570 - RNA, 21 nt, Homo sapiens
uugaccaauuugcaccaguuu

SEQ ID NO: 1304571 - RNA, 19 nt, Homo sapiens
uugaccaugucuaugauuc

SEQ ID NO: 1304572 - RNA, 13 nt, Homo sapiens
uugacgucacuga

SEQ ID NO: 1304573 - RNA, 22 nt, Homo sapiens
uugacuggguuucucuguauag

SEQ ID NO: 1304574 - RNA, 15 nt, Homo sapiens
uugacuuaccaugga

SEQ ID NO: 1304575 - RNA, 13 nt, Homo sapiens
uugagacagaguu

SEQ ID NO: 1304576 - RNA, 14 nt, Homo sapiens
uugagacaggagac

SEQ ID NO: 1304577 - RNA, 12 nt, Homo sapiens
uugagauccaaa

SEQ ID NO: 1304578 - RNA, 13 nt, Homo sapiens
uugagcaugugau

SEQ ID NO: 1304579 - RNA, 20 nt, Homo sapiens
uugagcucaggaguuugaga

SEQ ID NO: 1304580 - RNA, 18 nt, Homo sapiens
uugaggaaacaacagcuu

SEQ ID NO: 1304581 - RNA, 20 nt, Homo sapiens
uugaguccagaaguuugaga

SEQ ID NO: 1304582 - RNA, 15 nt, Homo sapiens
uugauaaaauccaaa

SEQ ID NO: 1304583 - RNA, 22 nt, Homo sapiens
uugauaagagggcacacacugu

SEQ ID NO: 1304584 - RNA, 23 nt, Homo sapiens
uugauagaaaugccaagcacuuc

SEQ ID NO: 1304585 - RNA, 15 nt, Homo sapiens
uugauauaaucuuuc

SEQ ID NO: 1304586 - RNA, 19 nt, Homo sapiens
uugaugauuaauucaccuu

SEQ ID NO: 1304587 - RNA, 12 nt, Homo sapiens
uugauggugaua

SEQ ID NO: 1304588 - RNA, 19 nt, Homo sapiens
uugauguggacaugagcca

SEQ ID NO: 1304589 - RNA, 21 nt, Homo sapiens
uugauuucccugggagcuguu

SEQ ID NO: 1304590 - RNA, 20 nt, Homo sapiens
uugcaaagcuuccuuggaag

SEQ ID NO: 1304591 - RNA, 14 nt, Homo sapiens
uugcaaaguacugu

SEQ ID NO: 1304592 - RNA, 15 nt, Homo sapiens
uugcaaaguacugua

SEQ ID NO: 1304593 - RNA, 12 nt, Homo sapiens
uuucaagucaaa

SEQ ID NO: 1304594 - RNA, 20 nt, Homo sapiens
uuucaauuucuagaggaacu

SEQ ID NO: 1304595 - RNA, 14 nt, Homo sapiens
uuucacaauuccau

SEQ ID NO: 1304596 - RNA, 20 nt, Homo sapiens
uuucagauuguggaauguug

SEQ ID NO: 1304597 - RNA, 19 nt, Homo sapiens
uuucagcuuuaagauaucu

SEQ ID NO: 1304598 - RNA, 18 nt, Homo sapiens
uuucagguuccaaucaga

SEQ ID NO: 1304599 - RNA, 19 nt, Homo sapiens
uuucagguuccaaucagaa

SEQ ID NO: 1304600 - RNA, 15 nt, Homo sapiens
uuucaguguugacac

SEQ ID NO: 1304601 - RNA, 15 nt, Homo sapiens
uuucauaguuggggu

SEQ ID NO: 1304602 - RNA, 22 nt, Homo sapiens
uuucaucugcucuccuuccugg

SEQ ID NO: 1304603 - RNA, 15 nt, Homo sapiens
uuucauuagaaguua

SEQ ID NO: 1304604 - RNA, 12 nt, Homo sapiens
uuucauugcugg

SEQ ID NO: 1304605 - RNA, 14 nt, Homo sapiens
uuuccaaaccuuau

SEQ ID NO: 1304606 - RNA, 17 nt, Homo sapiens
uuuccaaaggccaugga

SEQ ID NO: 1304607 - RNA, 15 nt, Homo sapiens
uuuccaaauucacaa

SEQ ID NO: 1304608 - RNA, 18 nt, Homo sapiens
uuuccacuacugcuacca

SEQ ID NO: 1304609 - RNA, 15 nt, Homo sapiens
uuuccacuccauugu

SEQ ID NO: 1304610 - RNA, 23 nt, Homo sapiens
uuuccauauauuggcacugcuaa

SEQ ID NO: 1304611 - RNA, 17 nt, Homo sapiens
uuucccacgaggaaucu

SEQ ID NO: 1304612 - RNA, 15 nt, Homo sapiens
uuuccccagugacac

SEQ ID NO: 1304613 - RNA, 13 nt, Homo sapiens
uuuccuacagaca

SEQ ID NO: 1304614 - RNA, 12 nt, Homo sapiens
uuuccucaaaac

SEQ ID NO: 1304615 - RNA, 16 nt, Homo sapiens
uuuccucagugcauuu

SEQ ID NO: 1304616 - RNA, 19 nt, Homo sapiens
uuuccucauaaacauuuga

SEQ ID NO: 1304617 - RNA, 18 nt, Homo sapiens
uuuccucccuucugcuac

SEQ ID NO: 1304618 - RNA, 12 nt, Homo sapiens
uuuccucugcau

SEQ ID NO: 1304619 - RNA, 22 nt, Homo sapiens
uuuccugcgucagccccagagu

SEQ ID NO: 1304620 - RNA, 12 nt, Homo sapiens
uuuccuucccua

SEQ ID NO: 1304621 - RNA, 17 nt, Homo sapiens
uuuccuuuucugucucu

SEQ ID NO: 1304622 - RNA, 16 nt, Homo sapiens
uuucuaaaagccaauc

SEQ ID NO: 1304623 - RNA, 15 nt, Homo sapiens
uuucugacacaguca

SEQ ID NO: 1304624 - RNA, 20 nt, Homo sapiens
uuucugacacagucaauucu

SEQ ID NO: 1304625 - RNA, 17 nt, Homo sapiens
uuucugcaaacaccaac

SEQ ID NO: 1304626 - RNA, 15 nt, Homo sapiens
uuucuguguacugua

SEQ ID NO: 1304627 - RNA, 13 nt, Homo sapiens
uuucuuccaugau

SEQ ID NO: 1304628 - RNA, 12 nt, Homo sapiens
uuucuuccugca

SEQ ID NO: 1304629 - RNA, 19 nt, Homo sapiens
uuugaaaaauaaugacucu

SEQ ID NO: 1304630 - RNA, 23 nt, Homo sapiens
uuugaaaaaugagagcuguaacu

SEQ ID NO: 1304631 - RNA, 19 nt, Homo sapiens
uuugaacccuugcuugcaa

SEQ ID NO: 1304632 - RNA, 16 nt, Homo sapiens
uuugaagacuacauga

SEQ ID NO: 1304633 - RNA, 15 nt, Homo sapiens
uuugaauaaagaaua

SEQ ID NO: 1304634 - RNA, 21 nt, Homo sapiens
uuugaauaaagaauacuugaa

SEQ ID NO: 1304635 - RNA, 17 nt, Homo sapiens
uuugaccccagcagcuu

SEQ ID NO: 1304636 - RNA, 20 nt, Homo sapiens
uuugacuuucuucugaauau

SEQ ID NO: 1304637 - RNA, 16 nt, Homo sapiens
uuugagaagcucugau

SEQ ID NO: 1304638 - RNA, 20 nt, Homo sapiens
uuugaggaccccuuaaucuu

SEQ ID NO: 1304639 - RNA, 17 nt, Homo sapiens
uuugauaaugacacugu

SEQ ID NO: 1304640 - RNA, 20 nt, Homo sapiens
uuugcaagggaaaagucucu

SEQ ID NO: 1304641 - RNA, 17 nt, Homo sapiens
uuugcaauaaugcagua

SEQ ID NO: 1304642 - RNA, 14 nt, Homo sapiens
uuugcagaaagcca

SEQ ID NO: 1304643 - RNA, 17 nt, Homo sapiens
uuugccaaaauucauuu

SEQ ID NO: 1304644 - RNA, 18 nt, Homo sapiens
uuugcccaaaacugucau

SEQ ID NO: 1304645 - RNA, 22 nt, Homo sapiens
uuugcguacacagagaaggcua

SEQ ID NO: 1304646 - RNA, 19 nt, Homo sapiens
uuugcuaaaugugaaugau

SEQ ID NO: 1304647 - RNA, 20 nt, Homo sapiens
uuugcugccaaacacccaug

SEQ ID NO: 1304648 - RNA, 14 nt, Homo sapiens
uuugcuugacuuca

SEQ ID NO: 1304649 - RNA, 19 nt, Homo sapiens
uuugcuuuuuuaaacuuga

SEQ ID NO: 1304650 - RNA, 14 nt, Homo sapiens
uuuggaaacaacau

SEQ ID NO: 1304651 - RNA, 23 nt, Homo sapiens
uuuggaaggugacuuuucaccuu

SEQ ID NO: 1304652 - RNA, 16 nt, Homo sapiens
uuuggauugggguccc

SEQ ID NO: 1304653 - RNA, 23 nt, Homo sapiens
uuuggcgaccuccuuucaucaca

SEQ ID NO: 1304654 - RNA, 17 nt, Homo sapiens
uuuggggaggaguugau

SEQ ID NO: 1304655 - RNA, 17 nt, Homo sapiens
uuugguacaaaaccacu

SEQ ID NO: 1304656 - RNA, 15 nt, Homo sapiens
uuuggucacauauca

SEQ ID NO: 1304657 - RNA, 14 nt, Homo sapiens
uuuggugacuucac

SEQ ID NO: 1304658 - RNA, 15 nt, Homo sapiens
uuuggugcuuuccag

SEQ ID NO: 1304659 - RNA, 13 nt, Homo sapiens
uuugguuuuacau

SEQ ID NO: 1304660 - RNA, 14 nt, Homo sapiens
uuuguaccagugaa

SEQ ID NO: 1304661 - RNA, 17 nt, Homo sapiens
uuuguccccacuuacag

SEQ ID NO: 1304662 - RNA, 18 nt, Homo sapiens
uucaucugcucuccuucc

SEQ ID NO: 1304663 - RNA, 15 nt, Homo sapiens
uucaugaucaucaca

SEQ ID NO: 1304664 - RNA, 14 nt, Homo sapiens
uucaugcaggugaa

SEQ ID NO: 1304665 - RNA, 13 nt, Homo sapiens
uucaugucucacg

SEQ ID NO: 1304666 - RNA, 18 nt, Homo sapiens
uucauguggagucauuau

SEQ ID NO: 1304667 - RNA, 16 nt, Homo sapiens
uucauucugcaaguau

SEQ ID NO: 1304668 - RNA, 14 nt, Homo sapiens
uuccaaauucacaa

SEQ ID NO: 1304669 - RNA, 14 nt, Homo sapiens
uuccaaucaugaaa

SEQ ID NO: 1304670 - RNA, 19 nt, Homo sapiens
uuccacaaagaaaauuccu

SEQ ID NO: 1304671 - RNA, 14 nt, Homo sapiens
uuccacuacugcua

SEQ ID NO: 1304672 - RNA, 11 nt, Homo sapiens
uuccagaucaa

SEQ ID NO: 1304673 - RNA, 14 nt, Homo sapiens
uuccaggcugguuc

SEQ ID NO: 1304674 - RNA, 19 nt, Homo sapiens
uuccagggauuugccucac

SEQ ID NO: 1304675 - RNA, 18 nt, Homo sapiens
uuccagguguuacuguaa

SEQ ID NO: 1304676 - RNA, 19 nt, Homo sapiens
uuccaguaggaaaagcaau

SEQ ID NO: 1304677 - RNA, 20 nt, Homo sapiens
uuccauaguguuaacuguca

SEQ ID NO: 1304678 - RNA, 21 nt, Homo sapiens
uuccauauauuggcacugcua

SEQ ID NO: 1304679 - RNA, 16 nt, Homo sapiens
uuccaucucugacuua

SEQ ID NO: 1304680 - RNA, 20 nt, Homo sapiens
uuccauuuccaguucaucua

SEQ ID NO: 1304681 - RNA, 14 nt, Homo sapiens
uucccaaaacugau

SEQ ID NO: 1304682 - RNA, 17 nt, Homo sapiens
uucccacaggacauuuc

SEQ ID NO: 1304683 - RNA, 12 nt, Homo sapiens
uucccacugcca

SEQ ID NO: 1304684 - RNA, 21 nt, Homo sapiens
uucccauaccacccaaugcug

SEQ ID NO: 1304685 - RNA, 16 nt, Homo sapiens
uucccaucauacccuu

SEQ ID NO: 1304686 - RNA, 21 nt, Homo sapiens
uucccauuuguaauuuguaaa

SEQ ID NO: 1304687 - RNA, 11 nt, Homo sapiens
uuccccaguga

SEQ ID NO: 1304688 - RNA, 17 nt, Homo sapiens
uuccccuucggucuuaa

SEQ ID NO: 1304689 - RNA, 18 nt, Homo sapiens
uucccuaaaaucagggaa

SEQ ID NO: 1304690 - RNA, 19 nt, Homo sapiens
uucccuaccauucagugau

SEQ ID NO: 1304691 - RNA, 18 nt, Homo sapiens
uucccugaccucccucua

SEQ ID NO: 1304692 - RNA, 15 nt, Homo sapiens
uucccuuugugcaca

SEQ ID NO: 1304693 - RNA, 16 nt, Homo sapiens
uuccuaaagcauggga

SEQ ID NO: 1304694 - RNA, 15 nt, Homo sapiens
uuccuauguaacugc

SEQ ID NO: 1304695 - RNA, 9 nt, Homo sapiens
uuccuccag

SEQ ID NO: 1304696 - RNA, 16 nt, Homo sapiens
uuccucucauuucccu

SEQ ID NO: 1304697 - RNA, 17 nt, Homo sapiens
uuccugauggcaggaug

SEQ ID NO: 1304698 - RNA, 15 nt, Homo sapiens
uuccugccacugugu

SEQ ID NO: 1304699 - RNA, 21 nt, Homo sapiens
uuccuggccugagagucagcu

SEQ ID NO: 1304700 - RNA, 20 nt, Homo sapiens
uuccuggcuccaacacugcu

SEQ ID NO: 1304701 - RNA, 17 nt, Homo sapiens
uuccuuaguuaucaguc

SEQ ID NO: 1304702 - RNA, 16 nt, Homo sapiens
uuccuuaucacugaca

SEQ ID NO: 1304703 - RNA, 21 nt, Homo sapiens
uuccuuauuaauacaaacaca

SEQ ID NO: 1304704 - RNA, 12 nt, Homo sapiens
uuccuuccagcc

SEQ ID NO: 1304705 - RNA, 21 nt, Homo sapiens
uuccuugccuaaggugucuga

SEQ ID NO: 1304706 - RNA, 15 nt, Homo sapiens
uuccuuggcuuuaug

SEQ ID NO: 1304707 - RNA, 20 nt, Homo sapiens
uuccuuggggcaggcaguga

SEQ ID NO: 1304708 - RNA, 21 nt, Homo sapiens
uuccuugguguucaaaaacca

SEQ ID NO: 1304709 - RNA, 16 nt, Homo sapiens
uuccuuugaagauagu

SEQ ID NO: 1304710 - RNA, 13 nt, Homo sapiens
uucgcacaaugca

SEQ ID NO: 1304711 - RNA, 19 nt, Homo sapiens
uucggccagagcugaagag

SEQ ID NO: 1304712 - RNA, 15 nt, Homo sapiens
uucuaaacacaaaua

SEQ ID NO: 1304713 - RNA, 17 nt, Homo sapiens
uucuaagcaaaauugcu

SEQ ID NO: 1304714 - RNA, 21 nt, Homo sapiens
uucuaauucuucucaugcaua

SEQ ID NO: 1304715 - RNA, 17 nt, Homo sapiens
uucuaauuuuuaagcaa

SEQ ID NO: 1304716 - RNA, 21 nt, Homo sapiens
uucuagaaacaggaaacaccg

SEQ ID NO: 1304717 - RNA, 14 nt, Homo sapiens
uucuagagacaaca

SEQ ID NO: 1304718 - RNA, 22 nt, Homo sapiens
uucuagagcuuagcauaucuga

SEQ ID NO: 1304719 - RNA, 17 nt, Homo sapiens
uucuagguaggggccca

SEQ ID NO: 1304720 - RNA, 22 nt, Homo sapiens
uucuaguguaacacugcaagaa

SEQ ID NO: 1304721 - RNA, 15 nt, Homo sapiens
uucuauaaggccaua

SEQ ID NO: 1304722 - RNA, 14 nt, Homo sapiens
uucuauacauucua

SEQ ID NO: 1304723 - RNA, 17 nt, Homo sapiens
uucuaugguacccugug

SEQ ID NO: 1304724 - RNA, 16 nt, Homo sapiens
uuaaguuuccuuccag

SEQ ID NO: 1304725 - RNA, 16 nt, Homo sapiens
uuaauaaaccuuugca

SEQ ID NO: 1304726 - RNA, 18 nt, Homo sapiens
uuaauagggaauauaucu

SEQ ID NO: 1304727 - RNA, 18 nt, Homo sapiens
uuaaucuguuauguacua

SEQ ID NO: 1304728 - RNA, 18 nt, Homo sapiens
uuaaugaagaaaguggaa

SEQ ID NO: 1304729 - RNA, 17 nt, Homo sapiens
uuaaugagucagucaau

SEQ ID NO: 1304730 - RNA, 19 nt, Homo sapiens
uuaaugcaagagaacauuu

SEQ ID NO: 1304731 - RNA, 16 nt, Homo sapiens
uuaaugcagacaaaca

SEQ ID NO: 1304732 - RNA, 17 nt, Homo sapiens
uuaaugcauauuccccu

SEQ ID NO: 1304733 - RNA, 21 nt, Homo sapiens
uuaauucccuuuuaacccagu

SEQ ID NO: 1304734 - RNA, 12 nt, Homo sapiens
uuaauucuuaga

SEQ ID NO: 1304735 - RNA, 12 nt, Homo sapiens
uuaauugcugca

SEQ ID NO: 1304736 - RNA, 16 nt, Homo sapiens
uuaauugcugcaagga

SEQ ID NO: 1304737 - RNA, 13 nt, Homo sapiens
uuaauuugcacag

SEQ ID NO: 1304738 - RNA, 22 nt, Homo sapiens
uuaauuuuuaaggauguugcca

SEQ ID NO: 1304739 - RNA, 11 nt, Homo sapiens
uuacaagcccc

SEQ ID NO: 1304740 - RNA, 11 nt, Homo sapiens
uuacacaagag

SEQ ID NO: 1304741 - RNA, 12 nt, Homo sapiens
uuacacauaccc

SEQ ID NO: 1304742 - RNA, 17 nt, Homo sapiens
uuacacugugucauucu

SEQ ID NO: 1304743 - RNA, 11 nt, Homo sapiens
uuacagaauuu

SEQ ID NO: 1304744 - RNA, 18 nt, Homo sapiens
uuacagcuuaaaguaugc

SEQ ID NO: 1304745 - RNA, 20 nt, Homo sapiens
uuacaguauauguugcaaaa

SEQ ID NO: 1304746 - RNA, 20 nt, Homo sapiens
uuacauacauugauucaugu

SEQ ID NO: 1304747 - RNA, 16 nt, Homo sapiens
uuacauguaauuugau

SEQ ID NO: 1304748 - RNA, 16 nt, Homo sapiens
uuacauguuguguaug

SEQ ID NO: 1304749 - RNA, 14 nt, Homo sapiens
uuacauuguucaau

SEQ ID NO: 1304750 - RNA, 19 nt, Homo sapiens
uuacccaggguggagugca

SEQ ID NO: 1304751 - RNA, 22 nt, Homo sapiens
uuaccccauggcugcacaguug

SEQ ID NO: 1304752 - RNA, 17 nt, Homo sapiens
uuacccucuuugcugca

SEQ ID NO: 1304753 - RNA, 12 nt, Homo sapiens
uuaccucugaua

SEQ ID NO: 1304754 - RNA, 17 nt, Homo sapiens
uuaccuucauaugcagu

SEQ ID NO: 1304755 - RNA, 22 nt, Homo sapiens
uuaccuuguuauuuaacccauu

SEQ ID NO: 1304756 - RNA, 18 nt, Homo sapiens
uuacucuuuccuauuuca

SEQ ID NO: 1304757 - RNA, 14 nt, Homo sapiens
uuacugaacugugu

SEQ ID NO: 1304758 - RNA, 13 nt, Homo sapiens
uuacugagacaau

SEQ ID NO: 1304759 - RNA, 20 nt, Homo sapiens
uuacugagcuucucugugaa

SEQ ID NO: 1304760 - RNA, 21 nt, Homo sapiens
uuacugcuuuuccaaacauuc

SEQ ID NO: 1304761 - RNA, 22 nt, Homo sapiens
uuacuguaaaggcaagccagca

SEQ ID NO: 1304762 - RNA, 15 nt, Homo sapiens
uuacuguaagacauu

SEQ ID NO: 1304763 - RNA, 23 nt, Homo sapiens
uuacuucucuauaaaaaauaugu

SEQ ID NO: 1304764 - RNA, 21 nt, Homo sapiens
uuacuuuagguggagaaucca

SEQ ID NO: 1304765 - RNA, 19 nt, Homo sapiens
uuacuuuauguacaacuga

SEQ ID NO: 1304766 - RNA, 22 nt, Homo sapiens
uuacuuuggaacacuacucuua

SEQ ID NO: 1304767 - RNA, 17 nt, Homo sapiens
uuacuuuuucuuguauu

SEQ ID NO: 1304768 - RNA, 17 nt, Homo sapiens
uuacuuuuuugguacua

SEQ ID NO: 1304769 - RNA, 19 nt, Homo sapiens
uuacuuuuuugguacuaua

SEQ ID NO: 1304770 - RNA, 13 nt, Homo sapiens
uuagaaaaaccac

SEQ ID NO: 1304771 - RNA, 17 nt, Homo sapiens
uuagaaacaacauagca

SEQ ID NO: 1304772 - RNA, 21 nt, Homo sapiens
uuagaaagcauuugaaugcau

SEQ ID NO: 1304773 - RNA, 22 nt, Homo sapiens
uuagaaagcugacauugccaaa

SEQ ID NO: 1304774 - RNA, 16 nt, Homo sapiens
uuagaaauacugcaag

SEQ ID NO: 1304775 - RNA, 12 nt, Homo sapiens
uuagaagcacag

SEQ ID NO: 1304776 - RNA, 18 nt, Homo sapiens
uuagaaguagaauugaca

SEQ ID NO: 1304777 - RNA, 21 nt, Homo sapiens
uuagaauaguguucugcaaaa

SEQ ID NO: 1304778 - RNA, 15 nt, Homo sapiens
uuagaaugcaucuca

SEQ ID NO: 1304779 - RNA, 17 nt, Homo sapiens
uuagacagagucucacu

SEQ ID NO: 1304780 - RNA, 23 nt, Homo sapiens
uuagacucaugguguguuacaca

SEQ ID NO: 1304781 - RNA, 17 nt, Homo sapiens
uguccggaggauauuaa

SEQ ID NO: 1304782 - RNA, 16 nt, Homo sapiens
uguccucaccacaugc

SEQ ID NO: 1304783 - RNA, 19 nt, Homo sapiens
uguccucagccuugccaga

SEQ ID NO: 1304784 - RNA, 22 nt, Homo sapiens
uguccucagccuugccagagau

SEQ ID NO: 1304785 - RNA, 13 nt, Homo sapiens
uguccuccaacac

SEQ ID NO: 1304786 - RNA, 18 nt, Homo sapiens
uguccuucaccuuuccca

SEQ ID NO: 1304787 - RNA, 17 nt, Homo sapiens
ugucuaaaaugccucag

SEQ ID NO: 1304788 - RNA, 20 nt, Homo sapiens
ugucuaacuggggauauaau

SEQ ID NO: 1304789 - RNA, 16 nt, Homo sapiens
ugucuacuaagugaug

SEQ ID NO: 1304790 - RNA, 19 nt, Homo sapiens
ugucucaccuacccaugac

SEQ ID NO: 1304791 - RNA, 21 nt, Homo sapiens
ugucuccaugugcguccauau

SEQ ID NO: 1304792 - RNA, 23 nt, Homo sapiens
ugucucuacuuuucccuguacuu

SEQ ID NO: 1304793 - RNA, 18 nt, Homo sapiens
ugucugcuaucauuauuc

SEQ ID NO: 1304794 - RNA, 15 nt, Homo sapiens
ugucuggccaggccu

SEQ ID NO: 1304795 - RNA, 21 nt, Homo sapiens
ugucugugugcugagccaguu

SEQ ID NO: 1304796 - RNA, 22 nt, Homo sapiens
ugucugugugugugugugcaua

SEQ ID NO: 1304797 - RNA, 23 nt, Homo sapiens
ugucugugugugugugugcauau

SEQ ID NO: 1304798 - RNA, 18 nt, Homo sapiens
ugucuuauuacagcauuu

SEQ ID NO: 1304799 - RNA, 22 nt, Homo sapiens
ugucuucccaaacccagucucc

SEQ ID NO: 1304800 - RNA, 19 nt, Homo sapiens
ugucuucuccaccacgcug

SEQ ID NO: 1304801 - RNA, 19 nt, Homo sapiens
ugucuugaugugucaucua

SEQ ID NO: 1304802 - RNA, 15 nt, Homo sapiens
ugucuugccagccag

SEQ ID NO: 1304803 - RNA, 23 nt, Homo sapiens
ugucuuguugcggauggauggaa

SEQ ID NO: 1304804 - RNA, 13 nt, Homo sapiens
ugucuuuccuaga

SEQ ID NO: 1304805 - RNA, 13 nt, Homo sapiens
ugucuuuugccau

SEQ ID NO: 1304806 - RNA, 17 nt, Homo sapiens
ugugaaauaauuccucu

SEQ ID NO: 1304807 - RNA, 13 nt, Homo sapiens
ugugaacaaccug

SEQ ID NO: 1304808 - RNA, 15 nt, Homo sapiens
ugugaaccaccacac

SEQ ID NO: 1304809 - RNA, 23 nt, Homo sapiens
ugugaaugaugauccuaggcauu

SEQ ID NO: 1304810 - RNA, 22 nt, Homo sapiens
ugugacauuauaugcacuagca

SEQ ID NO: 1304811 - RNA, 12 nt, Homo sapiens
ugugacuacuga

SEQ ID NO: 1304812 - RNA, 11 nt, Homo sapiens
ugugacuuuuu

SEQ ID NO: 1304813 - RNA, 14 nt, Homo sapiens
ugugagacacuaaa

SEQ ID NO: 1304814 - RNA, 16 nt, Homo sapiens
ugugagccggagcuca

SEQ ID NO: 1304815 - RNA, 19 nt, Homo sapiens
ugugauguggggaagagcu

SEQ ID NO: 1304816 - RNA, 15 nt, Homo sapiens
ugugcaaaugugcug

SEQ ID NO: 1304817 - RNA, 19 nt, Homo sapiens
ugugccaguucuuuccaua

SEQ ID NO: 1304818 - RNA, 14 nt, Homo sapiens
ugugccaugugcca

SEQ ID NO: 1304819 - RNA, 21 nt, Homo sapiens
ugugccccuugacaacuggca

SEQ ID NO: 1304820 - RNA, 14 nt, Homo sapiens
ugugcccucagauu

SEQ ID NO: 1304821 - RNA, 17 nt, Homo sapiens
ugugccucuuacuaugu

SEQ ID NO: 1304822 - RNA, 18 nt, Homo sapiens
ugugcucagagaccccuc

SEQ ID NO: 1304823 - RNA, 15 nt, Homo sapiens
ugugcuguucaaguu

SEQ ID NO: 1304824 - RNA, 19 nt, Homo sapiens
uguggccacuucuguccau

SEQ ID NO: 1304825 - RNA, 19 nt, Homo sapiens
uguggcccuguccugccau

SEQ ID NO: 1304826 - RNA, 20 nt, Homo sapiens
uguggccuucggacaacuca

SEQ ID NO: 1304827 - RNA, 14 nt, Homo sapiens
uguggguaccugua

SEQ ID NO: 1304828 - RNA, 17 nt, Homo sapiens
ugugggucugcagguga

SEQ ID NO: 1304829 - RNA, 19 nt, Homo sapiens
ugugguuguuagguucaca

SEQ ID NO: 1304830 - RNA, 22 nt, Homo sapiens
ugugucaguggggcucucugag

SEQ ID NO: 1304831 - RNA, 10 nt, Homo sapiens
ugugucuuag

SEQ ID NO: 1304832 - RNA, 13 nt, Homo sapiens
ugugugcugcuaa

SEQ ID NO: 1304833 - RNA, 12 nt, Homo sapiens
ugugugugcaua

SEQ ID NO: 1304834 - RNA, 23 nt, Homo sapiens
uggcggcuccauccguggcugca

SEQ ID NO: 1304835 - RNA, 22 nt, Homo sapiens
uggcguuacugcuugaccaaag

SEQ ID NO: 1304836 - RNA, 15 nt, Homo sapiens
uggcucugaugcuga

SEQ ID NO: 1304837 - RNA, 12 nt, Homo sapiens
uggcucugggcc

SEQ ID NO: 1304838 - RNA, 22 nt, Homo sapiens
uggcucuugaggcauuuccaga

SEQ ID NO: 1304839 - RNA, 17 nt, Homo sapiens
uggcugauggaguaaau

SEQ ID NO: 1304840 - RNA, 14 nt, Homo sapiens
uggcuggcucugca

SEQ ID NO: 1304841 - RNA, 16 nt, Homo sapiens
uggcugugcuaccuga

SEQ ID NO: 1304842 - RNA, 18 nt, Homo sapiens
uggcuguggagacaaugu

SEQ ID NO: 1304843 - RNA, 18 nt, Homo sapiens
uggcuucucccaggauuc

SEQ ID NO: 1304844 - RNA, 20 nt, Homo sapiens
uggcuucucucucucuuuga

SEQ ID NO: 1304845 - RNA, 16 nt, Homo sapiens
ugggaagccgugcucg

SEQ ID NO: 1304846 - RNA, 23 nt, Homo sapiens
ugggaaugucucuuuggcgaccu

SEQ ID NO: 1304847 - RNA, 12 nt, Homo sapiens
ugggacacaguu

SEQ ID NO: 1304848 - RNA, 21 nt, Homo sapiens
ugggaccacgugagaucauuc

SEQ ID NO: 1304849 - RNA, 20 nt, Homo sapiens
ugggaccgaugcaguaucag

SEQ ID NO: 1304850 - RNA, 20 nt, Homo sapiens
ugggaucagcaggccaggca

SEQ ID NO: 1304851 - RNA, 15 nt, Homo sapiens
ugggauggauuucca

SEQ ID NO: 1304852 - RNA, 22 nt, Homo sapiens
ugggaugugccgauccuuguca

SEQ ID NO: 1304853 - RNA, 21 nt, Homo sapiens
ugggauuacaggugugcacca

SEQ ID NO: 1304854 - RNA, 18 nt, Homo sapiens
ugggcaauauagcaagau

SEQ ID NO: 1304855 - RNA, 16 nt, Homo sapiens
ugggcacuucaucuga

SEQ ID NO: 1304856 - RNA, 18 nt, Homo sapiens
ugggccaaaaucaugcca

SEQ ID NO: 1304857 - RNA, 13 nt, Homo sapiens
ugggcccacaaag

SEQ ID NO: 1304858 - RNA, 17 nt, Homo sapiens
ugggccccucucauucc

SEQ ID NO: 1304859 - RNA, 17 nt, Homo sapiens
ugggcccugagccagag

SEQ ID NO: 1304860 - RNA, 15 nt, Homo sapiens
ugggccguaucuccg

SEQ ID NO: 1304861 - RNA, 13 nt, Homo sapiens
ugggccuccucac

SEQ ID NO: 1304862 - RNA, 20 nt, Homo sapiens
ugggcgagcgguaaauccua

SEQ ID NO: 1304863 - RNA, 18 nt, Homo sapiens
ugggcuccuccagggugu

SEQ ID NO: 1304864 - RNA, 20 nt, Homo sapiens
ugggcuccuggggcaauggg

SEQ ID NO: 1304865 - RNA, 12 nt, Homo sapiens
uggggaaagggg

SEQ ID NO: 1304866 - RNA, 14 nt, Homo sapiens
uggggaaaggggac

SEQ ID NO: 1304867 - RNA, 16 nt, Homo sapiens
uggggaggccagggua

SEQ ID NO: 1304868 - RNA, 17 nt, Homo sapiens
uggggcacagaugccug

SEQ ID NO: 1304869 - RNA, 16 nt, Homo sapiens
uggggcaggcagugau

SEQ ID NO: 1304870 - RNA, 20 nt, Homo sapiens
uggggcaggcagugaugcug

SEQ ID NO: 1304871 - RNA, 20 nt, Homo sapiens
uggggcccuaauucagccau

SEQ ID NO: 1304872 - RNA, 22 nt, Homo sapiens
uggggccucuccuacuaugcaa

SEQ ID NO: 1304873 - RNA, 16 nt, Homo sapiens
ugggggcugugauauu

SEQ ID NO: 1304874 - RNA, 13 nt, Homo sapiens
uggggucaugccc

SEQ ID NO: 1304875 - RNA, 16 nt, Homo sapiens
uggggugggcacauug

SEQ ID NO: 1304876 - RNA, 18 nt, Homo sapiens
ugggguuggaacauuuca

SEQ ID NO: 1304877 - RNA, 22 nt, Homo sapiens
ugggucugggagucacacagug

SEQ ID NO: 1304878 - RNA, 20 nt, Homo sapiens
ugggugaacuaaccaaauaa

SEQ ID NO: 1304879 - RNA, 20 nt, Homo sapiens
ugggugucaagagggucuga

SEQ ID NO: 1304880 - RNA, 21 nt, Homo sapiens
uggguucauccuauucuuucg

SEQ ID NO: 1304881 - RNA, 14 nt, Homo sapiens
uggguuggcugugg

SEQ ID NO: 1304882 - RNA, 14 nt, Homo sapiens
ugguaagcaccagg

SEQ ID NO: 1304883 - RNA, 16 nt, Homo sapiens
caaaauguuuaaguca

SEQ ID NO: 1304884 - RNA, 20 nt, Homo sapiens
caaaauguuuaagucacauu

SEQ ID NO: 1304885 - RNA, 19 nt, Homo sapiens
caaaauugcaaaucuugaa

SEQ ID NO: 1304886 - RNA, 20 nt, Homo sapiens
caaaauuggaagcugucaua

SEQ ID NO: 1304887 - RNA, 14 nt, Homo sapiens
caaacaaaauuucu

SEQ ID NO: 1304888 - RNA, 14 nt, Homo sapiens
caaacaaauaugca

SEQ ID NO: 1304889 - RNA, 15 nt, Homo sapiens
caaacacccaugccc

SEQ ID NO: 1304890 - RNA, 18 nt, Homo sapiens
caaacagccuacagccag

SEQ ID NO: 1304891 - RNA, 13 nt, Homo sapiens
caaacaggcaguu

SEQ ID NO: 1304892 - RNA, 21 nt, Homo sapiens
caaacauggguuuaguuuuca

SEQ ID NO: 1304893 - RNA, 19 nt, Homo sapiens
caaacccauggcucuauuu

SEQ ID NO: 1304894 - RNA, 15 nt, Homo sapiens
caaacuucaaagagg

SEQ ID NO: 1304895 - RNA, 16 nt, Homo sapiens
caaacuuuuauacucu

SEQ ID NO: 1304896 - RNA, 12 nt, Homo sapiens
caaagaaaaagg

SEQ ID NO: 1304897 - RNA, 13 nt, Homo sapiens
caaagaauuccaa

SEQ ID NO: 1304898 - RNA, 19 nt, Homo sapiens
caaagacauagaugugaaa

SEQ ID NO: 1304899 - RNA, 16 nt, Homo sapiens
caaagacuauucccuu

SEQ ID NO: 1304900 - RNA, 13 nt, Homo sapiens
caaagacugugaa

SEQ ID NO: 1304901 - RNA, 21 nt, Homo sapiens
caaagagggugagggccuucu

SEQ ID NO: 1304902 - RNA, 20 nt, Homo sapiens
caaagaguggcuugaauaua

SEQ ID NO: 1304903 - RNA, 22 nt, Homo sapiens
caaagaugaccauaaccacuga

SEQ ID NO: 1304904 - RNA, 23 nt, Homo sapiens
caaagcaggggaguaugcaaaag

SEQ ID NO: 1304905 - RNA, 23 nt, Homo sapiens
caaagccacacucugggcuccag

SEQ ID NO: 1304906 - RNA, 22 nt, Homo sapiens
caaagcccuuguccccaugaaa

SEQ ID NO: 1304907 - RNA, 17 nt, Homo sapiens
caaagcuuuauuucaaa

SEQ ID NO: 1304908 - RNA, 17 nt, Homo sapiens
caaagcuuucauguaaa

SEQ ID NO: 1304909 - RNA, 18 nt, Homo sapiens
caaaggaacacugacauc

SEQ ID NO: 1304910 - RNA, 22 nt, Homo sapiens
caaaggacagauccagggacug

SEQ ID NO: 1304911 - RNA, 14 nt, Homo sapiens
caaaggauacugua

SEQ ID NO: 1304912 - RNA, 13 nt, Homo sapiens
caaaggcugagaa

SEQ ID NO: 1304913 - RNA, 17 nt, Homo sapiens
caaaggggacagcugug

SEQ ID NO: 1304914 - RNA, 17 nt, Homo sapiens
caaaguaaauucuuagc

SEQ ID NO: 1304915 - RNA, 20 nt, Homo sapiens
caaaguccuuuuuuuccauc

SEQ ID NO: 1304916 - RNA, 13 nt, Homo sapiens
caaauagcaaaga

SEQ ID NO: 1304917 - RNA, 23 nt, Homo sapiens
caaauauaaaauuaaaaacuuaa

SEQ ID NO: 1304918 - RNA, 14 nt, Homo sapiens
caaaucaccacaaa

SEQ ID NO: 1304919 - RNA, 22 nt, Homo sapiens
caaaucuuguuauugaaguguu

SEQ ID NO: 1304920 - RNA, 21 nt, Homo sapiens
caaaugaauucuaaaccaauc

SEQ ID NO: 1304921 - RNA, 13 nt, Homo sapiens
caaaugcaauuuu

SEQ ID NO: 1304922 - RNA, 22 nt, Homo sapiens
caaaugcauuucuaaagccauu

SEQ ID NO: 1304923 - RNA, 15 nt, Homo sapiens
caaauggaagacaca

SEQ ID NO: 1304924 - RNA, 19 nt, Homo sapiens
caaauggacauaggacuca

SEQ ID NO: 1304925 - RNA, 17 nt, Homo sapiens
caaauggggccagaucc

SEQ ID NO: 1304926 - RNA, 13 nt, Homo sapiens
caaauguauuuca

SEQ ID NO: 1304927 - RNA, 11 nt, Homo sapiens
caaaugugcug

SEQ ID NO: 1304928 - RNA, 20 nt, Homo sapiens
caaaugugcuggucacccuu

SEQ ID NO: 1304929 - RNA, 15 nt, Homo sapiens
caaauuacaaaaggc

SEQ ID NO: 1304930 - RNA, 19 nt, Homo sapiens
caaauucuguuucuugaga

SEQ ID NO: 1304931 - RNA, 21 nt, Homo sapiens
caaauugugugugcucugcuu

SEQ ID NO: 1304932 - RNA, 20 nt, Homo sapiens
caacacaugucuagcuuuca

SEQ ID NO: 1304933 - RNA, 12 nt, Homo sapiens
caacacugagca

SEQ ID NO: 1304934 - RNA, 17 nt, Homo sapiens
caacagcaaaucacgac

SEQ ID NO: 1304935 - RNA, 16 nt, Homo sapiens
caacaggccauuguga

SEQ ID NO: 1304936 - RNA, 15 nt, Homo sapiens
caacaguucaaagaa

SEQ ID NO: 1304937 - RNA, 14 nt, Homo sapiens
caacauccaaaaua

SEQ ID NO: 1304938 - RNA, 23 nt, Homo sapiens
caacauggucuaauuauuuacuc

SEQ ID NO: 1304939 - RNA, 15 nt, Homo sapiens
caacauuacagggaa

SEQ ID NO: 1304940 - RNA, 24 nt, Homo sapiens
caacauuccaagaauagcaucugu

SEQ ID NO: 1304941 - RNA, 19 nt, Homo sapiens
caaccaauggaaugugaug

SEQ ID NO: 1304942 - RNA, 17 nt, Homo sapiens
caacccacuggcacauu

SEQ ID NO: 1304943 - RNA, 13 nt, Homo sapiens
caaccccaggcug

SEQ ID NO: 1304944 - RNA, 20 nt, Homo sapiens
caaccccuucgcuccugugu

SEQ ID NO: 1304945 - RNA, 20 nt, Homo sapiens
caacccuucuggaaacugug

SEQ ID NO: 1304946 - RNA, 13 nt, Homo sapiens
caaccuaugguau

SEQ ID NO: 1304947 - RNA, 14 nt, Homo sapiens
caaccuugcaucca

SEQ ID NO: 1304948 - RNA, 15 nt, Homo sapiens
caaccuuggccuucu

SEQ ID NO: 1304949 - RNA, 14 nt, Homo sapiens
caacgcucccagac

SEQ ID NO: 1304950 - RNA, 16 nt, Homo sapiens
caacgugcaaagccaa

SEQ ID NO: 1304951 - RNA, 22 nt, Homo sapiens
caacucuguaaauauguaugua

SEQ ID NO: 1304952 - RNA, 15 nt, Homo sapiens
caacuuaaugcucug

SEQ ID NO: 1304953 - RNA, 17 nt, Homo sapiens
caacuuauuaacaauua

SEQ ID NO: 1304954 - RNA, 19 nt, Homo sapiens
caacuuccuaaauauuaug

SEQ ID NO: 1304955 - RNA, 17 nt, Homo sapiens
caagaagucaaaguaaa

SEQ ID NO: 1304956 - RNA, 13 nt, Homo sapiens
caagaaugagcug

SEQ ID NO: 1304957 - RNA, 19 nt, Homo sapiens
caagacccaaguagcugcu

SEQ ID NO: 1304958 - RNA, 21 nt, Homo sapiens
caagacccaaguagcugcuac

SEQ ID NO: 1304959 - RNA, 13 nt, Homo sapiens
caagagaccagcc

SEQ ID NO: 1304960 - RNA, 16 nt, Homo sapiens
caagagcacacuuggc

SEQ ID NO: 1304961 - RNA, 14 nt, Homo sapiens
caagagucugauga

SEQ ID NO: 1304962 - RNA, 13 nt, Homo sapiens
caagaugacacaa

SEQ ID NO: 1304963 - RNA, 12 nt, Homo sapiens
caagaugccuga

SEQ ID NO: 1304964 - RNA, 18 nt, Homo sapiens
caagcagaaacuuuacaa

SEQ ID NO: 1304965 - RNA, 13 nt, Homo sapiens
caagcagccaagg

SEQ ID NO: 1304966 - RNA, 17 nt, Homo sapiens
caagcagccaagggaug

SEQ ID NO: 1304967 - RNA, 15 nt, Homo sapiens
caagcaggaagcuca

SEQ ID NO: 1304968 - RNA, 16 nt, Homo sapiens
caagcaugaagugcug

SEQ ID NO: 1304969 - RNA, 17 nt, Homo sapiens
caagccacugagcaaug

SEQ ID NO: 1304970 - RNA, 13 nt, Homo sapiens
caagccauuccaa

SEQ ID NO: 1304971 - RNA, 16 nt, Homo sapiens
caagccccugcuccag

SEQ ID NO: 1304972 - RNA, 13 nt, Homo sapiens
caagccugaauuu

SEQ ID NO: 1304973 - RNA, 21 nt, Homo sapiens
caagcgauccucccaccucag

SEQ ID NO: 1304974 - RNA, 23 nt, Homo sapiens
caagcucaaagcguggacaggug

SEQ ID NO: 1304975 - RNA, 22 nt, Homo sapiens
caagcugcucugagccacagug

SEQ ID NO: 1304976 - RNA, 21 nt, Homo sapiens
caagcuggucccacucagucc

SEQ ID NO: 1304977 - RNA, 21 nt, Homo sapiens
caagcuguccucccaccucag

SEQ ID NO: 1304978 - RNA, 16 nt, Homo sapiens
caagcuguugaagucu

SEQ ID NO: 1304979 - RNA, 21 nt, Homo sapiens
caagcuugucaaugauuucaa

SEQ ID NO: 1304980 - RNA, 15 nt, Homo sapiens
caaggaagguggugg

SEQ ID NO: 1304981 - RNA, 13 nt, Homo sapiens
caaggaagucaaa

SEQ ID NO: 1304982 - RNA, 22 nt, Homo sapiens
caaggacuaauccaauaccucu

SEQ ID NO: 1304983 - RNA, 13 nt, Homo sapiens
caaggacugagca

SEQ ID NO: 1304984 - RNA, 18 nt, Homo sapiens
caaggagaaaaaaggcag

SEQ ID NO: 1304985 - RNA, 14 nt, Homo sapiens
caaggagacacaac

SEQ ID NO: 1304986 - RNA, 22 nt, Homo sapiens
caaggagacacaacaacuccua

SEQ ID NO: 1304987 - RNA, 19 nt, Homo sapiens
caaggagggugagugcaag

SEQ ID NO: 1304988 - RNA, 23 nt, Homo sapiens
caaggauagaagcugcaguggua

SEQ ID NO: 1304989 - RNA, 19 nt, Homo sapiens
caaggaugucugagaccac

SEQ ID NO: 1304990 - RNA, 16 nt, Homo sapiens
caaggcacugccugau

SEQ ID NO: 1304991 - RNA, 19 nt, Homo sapiens
caaggcccauaucugugaa

SEQ ID NO: 1304992 - RNA, 18 nt, Homo sapiens
caaggcgguggacuugaa

SEQ ID NO: 1304993 - RNA, 22 nt, Homo sapiens
caaggcgguggacuugaacuuu

SEQ ID NO: 1304994 - RNA, 14 nt, Homo sapiens
caaggcugcaguga

SEQ ID NO: 1304995 - RNA, 19 nt, Homo sapiens
caaggcugggggaagaagc

SEQ ID NO: 1304996 - RNA, 21 nt, Homo sapiens
caagggaauucggugugcacc

SEQ ID NO: 1304997 - RNA, 21 nt, Homo sapiens
ugcccuuggaggccagccagu

SEQ ID NO: 1304998 - RNA, 22 nt, Homo sapiens
ugccgaaccaaaagaauuugca

SEQ ID NO: 1304999 - RNA, 20 nt, Homo sapiens
ugccuccaucagcuaaacac

SEQ ID NO: 1305000 - RNA, 14 nt, Homo sapiens
ugccuccuugaaag

SEQ ID NO: 1305001 - RNA, 18 nt, Homo sapiens
ugccucugacacacagcu

SEQ ID NO: 1305002 - RNA, 15 nt, Homo sapiens
ugccugaagucacac

SEQ ID NO: 1305003 - RNA, 23 nt, Homo sapiens
ugccuggccuggggaccaggugc

SEQ ID NO: 1305004 - RNA, 17 nt, Homo sapiens
ugccuuaccgagagcca

SEQ ID NO: 1305005 - RNA, 16 nt, Homo sapiens
ugccuuccagccacau

SEQ ID NO: 1305006 - RNA, 18 nt, Homo sapiens
ugccuuccuaagccugug

SEQ ID NO: 1305007 - RNA, 16 nt, Homo sapiens
ugccuuuagugaucac

SEQ ID NO: 1305008 - RNA, 15 nt, Homo sapiens
ugcgaaagacccaca

SEQ ID NO: 1305009 - RNA, 15 nt, Homo sapiens
ugcgagagaaaggga

SEQ ID NO: 1305010 - RNA, 20 nt, Homo sapiens
ugcgaucucggcucagugca

SEQ ID NO: 1305011 - RNA, 17 nt, Homo sapiens
ugcgaucuggguucacu

SEQ ID NO: 1305012 - RNA, 14 nt, Homo sapiens
ugcgcaacuggagc

SEQ ID NO: 1305013 - RNA, 18 nt, Homo sapiens
ugcgcccaguccuuccac

SEQ ID NO: 1305014 - RNA, 20 nt, Homo sapiens
ugcggaaugaaccacaucuu

SEQ ID NO: 1305015 - RNA, 18 nt, Homo sapiens
ugcggccuuuggcuucac

SEQ ID NO: 1305016 - RNA, 21 nt, Homo sapiens
ugcguguguguucacguguuc

SEQ ID NO: 1305017 - RNA, 15 nt, Homo sapiens
ugcuaaaugggaccc

SEQ ID NO: 1305018 - RNA, 20 nt, Homo sapiens
ugcuaacaagucaccaaaag

SEQ ID NO: 1305019 - RNA, 22 nt, Homo sapiens
ugcuaagccccagcaagcaauc

SEQ ID NO: 1305020 - RNA, 12 nt, Homo sapiens
ugcuaauguugc

SEQ ID NO: 1305021 - RNA, 15 nt, Homo sapiens
ugcuacuagcucuuu

SEQ ID NO: 1305022 - RNA, 16 nt, Homo sapiens
ugcucaaaaucuuucc

SEQ ID NO: 1305023 - RNA, 12 nt, Homo sapiens
ugcucacagucc

SEQ ID NO: 1305024 - RNA, 23 nt, Homo sapiens
ugcucagguacuuguaaauuauu

SEQ ID NO: 1305025 - RNA, 22 nt, Homo sapiens
ugcuccacccaugaugcaucuc

SEQ ID NO: 1305026 - RNA, 14 nt, Homo sapiens
ugcuccauuuacaa

SEQ ID NO: 1305027 - RNA, 16 nt, Homo sapiens
ugcuccauuuacaaac

SEQ ID NO: 1305028 - RNA, 16 nt, Homo sapiens
ugcucccuccacagcu

SEQ ID NO: 1305029 - RNA, 21 nt, Homo sapiens
ugcuccuagagggaggggccu

SEQ ID NO: 1305030 - RNA, 18 nt, Homo sapiens
ugcucgccuuagcacuac

SEQ ID NO: 1305031 - RNA, 20 nt, Homo sapiens
ugcucuaagucaaauuccaa

SEQ ID NO: 1305032 - RNA, 17 nt, Homo sapiens
ugcucuaggaagacauu

SEQ ID NO: 1305033 - RNA, 14 nt, Homo sapiens
ugcucucuggucuu

SEQ ID NO: 1305034 - RNA, 23 nt, Homo sapiens
ugcucucuuuuucuccaggguca

SEQ ID NO: 1305035 - RNA, 14 nt, Homo sapiens
ugcucuugagucuu

SEQ ID NO: 1305036 - RNA, 12 nt, Homo sapiens
ugcugaagccaa

SEQ ID NO: 1305037 - RNA, 19 nt, Homo sapiens
ugcugagagaaauauggaa

SEQ ID NO: 1305038 - RNA, 22 nt, Homo sapiens
ugcugaguaacaggugccuucc

SEQ ID NO: 1305039 - RNA, 15 nt, Homo sapiens
ugcugauguccucac

SEQ ID NO: 1305040 - RNA, 15 nt, Homo sapiens
ugcugauuuggugac

SEQ ID NO: 1305041 - RNA, 16 nt, Homo sapiens
ugcugcaccaaugcac

SEQ ID NO: 1305042 - RNA, 14 nt, Homo sapiens
ugcugcacuuccug

SEQ ID NO: 1305043 - RNA, 17 nt, Homo sapiens
agccacgaggugcaaca

SEQ ID NO: 1305044 - RNA, 14 nt, Homo sapiens
agccagaacuugac

SEQ ID NO: 1305045 - RNA, 19 nt, Homo sapiens
agccagagccugucuuuca

SEQ ID NO: 1305046 - RNA, 17 nt, Homo sapiens
agccagaggacugugau

SEQ ID NO: 1305047 - RNA, 17 nt, Homo sapiens
agccagaggcaccucaa

SEQ ID NO: 1305048 - RNA, 20 nt, Homo sapiens
agccaggaaauagcggugaa

SEQ ID NO: 1305049 - RNA, 15 nt, Homo sapiens
agccaggccuuccuc

SEQ ID NO: 1305050 - RNA, 14 nt, Homo sapiens
agccaggcugacca

SEQ ID NO: 1305051 - RNA, 14 nt, Homo sapiens
agccagggucucac

SEQ ID NO: 1305052 - RNA, 14 nt, Homo sapiens
agccagugggagau

SEQ ID NO: 1305053 - RNA, 13 nt, Homo sapiens
agccauaugaaug

SEQ ID NO: 1305054 - RNA, 22 nt, Homo sapiens
agccaugugaaacucaucucau

SEQ ID NO: 1305055 - RNA, 18 nt, Homo sapiens
agccauuuuucaaagcaa

SEQ ID NO: 1305056 - RNA, 19 nt, Homo sapiens
agccauuuuucaaagcaau

SEQ ID NO: 1305057 - RNA, 13 nt, Homo sapiens
agcccacaccuaa

SEQ ID NO: 1305058 - RNA, 16 nt, Homo sapiens
agcccaccuuggcuca

SEQ ID NO: 1305059 - RNA, 17 nt, Homo sapiens
agcccagaaaaccucca

SEQ ID NO: 1305060 - RNA, 11 nt, Homo sapiens
agcccagagac

SEQ ID NO: 1305061 - RNA, 22 nt, Homo sapiens
agcccagggcuccugcacuuac

SEQ ID NO: 1305062 - RNA, 16 nt, Homo sapiens
agcccagucuggaugu

SEQ ID NO: 1305063 - RNA, 16 nt, Homo sapiens
agcccauccagucucc

SEQ ID NO: 1305064 - RNA, 18 nt, Homo sapiens
agcccauccagucuccca

SEQ ID NO: 1305065 - RNA, 18 nt, Homo sapiens
agcccaucugcacagugg

SEQ ID NO: 1305066 - RNA, 19 nt, Homo sapiens
agcccaucugcacaguggg

SEQ ID NO: 1305067 - RNA, 22 nt, Homo sapiens
agcccaugggacaaauugcaca

SEQ ID NO: 1305068 - RNA, 19 nt, Homo sapiens
agccccaucugugcauucu

SEQ ID NO: 1305069 - RNA, 13 nt, Homo sapiens
agccccgacuucc

SEQ ID NO: 1305070 - RNA, 16 nt, Homo sapiens
agccccugcuccagaa

SEQ ID NO: 1305071 - RNA, 17 nt, Homo sapiens
agccccugggguggcca

SEQ ID NO: 1305072 - RNA, 21 nt, Homo sapiens
agccccuuacuaugaucucag

SEQ ID NO: 1305073 - RNA, 14 nt, Homo sapiens
agccccuuggaugu

SEQ ID NO: 1305074 - RNA, 21 nt, Homo sapiens
agcccucaccccugguucuca

SEQ ID NO: 1305075 - RNA, 13 nt, Homo sapiens
agcccucaucccg

SEQ ID NO: 1305076 - RNA, 14 nt, Homo sapiens
agcccugacccugu

SEQ ID NO: 1305077 - RNA, 15 nt, Homo sapiens
agcccugagcuuucu

SEQ ID NO: 1305078 - RNA, 19 nt, Homo sapiens
agcccuggcccccugaguu

SEQ ID NO: 1305079 - RNA, 19 nt, Homo sapiens
agccgagaucgugccauug

SEQ ID NO: 1305080 - RNA, 23 nt, Homo sapiens
agccgagauggcgcuauugcacu

SEQ ID NO: 1305081 - RNA, 17 nt, Homo sapiens
agccgauaucagaauuu

SEQ ID NO: 1305082 - RNA, 23 nt, Homo sapiens
agccguuugagaagaaaacaucu

SEQ ID NO: 1305083 - RNA, 20 nt, Homo sapiens
agccuagaaacuaacacagc

SEQ ID NO: 1305084 - RNA, 21 nt, Homo sapiens
agccuauguaugccauggagg

SEQ ID NO: 1305085 - RNA, 23 nt, Homo sapiens
agccucaucaucagagccuuucc

SEQ ID NO: 1305086 - RNA, 21 nt, Homo sapiens
agccuccaauguacaacuucc

SEQ ID NO: 1305087 - RNA, 19 nt, Homo sapiens
agccucugggucagugguc

SEQ ID NO: 1305088 - RNA, 20 nt, Homo sapiens
agccucugggucaguggucc

SEQ ID NO: 1305089 - RNA, 17 nt, Homo sapiens
agccugaacagaagcuc

SEQ ID NO: 1305090 - RNA, 15 nt, Homo sapiens
agccugaauuucuca

SEQ ID NO: 1305091 - RNA, 22 nt, Homo sapiens
agccugaguccacgaccuaggc

SEQ ID NO: 1305092 - RNA, 21 nt, Homo sapiens
agccugcagaaguaagccuca

SEQ ID NO: 1305093 - RNA, 21 nt, Homo sapiens
agccugcugguuuuaucugag

SEQ ID NO: 1305094 - RNA, 14 nt, Homo sapiens
agccuggacccugu

SEQ ID NO: 1305095 - RNA, 16 nt, Homo sapiens
agccuggccaacaugg

SEQ ID NO: 1305096 - RNA, 19 nt, Homo sapiens
agccuggccaagagaccag

SEQ ID NO: 1305097 - RNA, 14 nt, Homo sapiens
agccuggccagaca

SEQ ID NO: 1305098 - RNA, 13 nt, Homo sapiens
agccugucuuuca

SEQ ID NO: 1305099 - RNA, 13 nt, Homo sapiens
agccugugcaaaa

SEQ ID NO: 1305100 - RNA, 16 nt, Homo sapiens
agccuucacacagaua

SEQ ID NO: 1305101 - RNA, 17 nt, Homo sapiens
agccuugaacucugggc

SEQ ID NO: 1305102 - RNA, 23 nt, Homo sapiens
agcgacagccugggcacccgcgg

SEQ ID NO: 1305103 - RNA, 20 nt, Homo sapiens
agcgauucuccugccucagc

SEQ ID NO: 1305104 - RNA, 18 nt, Homo sapiens
agcgccaggcugaccaca

SEQ ID NO: 1305105 - RNA, 15 nt, Homo sapiens
agcgcuguaaacccu

SEQ ID NO: 1305106 - RNA, 17 nt, Homo sapiens
agcgcuuuuccuuggca

SEQ ID NO: 1305107 - RNA, 16 nt, Homo sapiens
agcggaaagcagcuca

SEQ ID NO: 1305108 - RNA, 14 nt, Homo sapiens
agcgugaagggauu

SEQ ID NO: 1305109 - RNA, 13 nt, Homo sapiens
agcgugagccacu

SEQ ID NO: 1305110 - RNA, 15 nt, Homo sapiens
agcuaacacacagcu

SEQ ID NO: 1305111 - RNA, 13 nt, Homo sapiens
agcuaacaccaga

SEQ ID NO: 1305112 - RNA, 20 nt, Homo sapiens
agcuaacccucacaagcaug

SEQ ID NO: 1305113 - RNA, 14 nt, Homo sapiens
agcuaagaaccugg

SEQ ID NO: 1305114 - RNA, 18 nt, Homo sapiens
agcuaaggaggggaaaaa

SEQ ID NO: 1305115 - RNA, 13 nt, Homo sapiens
agcuaauauacag

SEQ ID NO: 1305116 - RNA, 12 nt, Homo sapiens
agcuaauuugca

SEQ ID NO: 1305117 - RNA, 15 nt, Homo sapiens
agcuaccucaaccaa

SEQ ID NO: 1305118 - RNA, 23 nt, Homo sapiens
agcuaccucaaccaaugccaaaa

SEQ ID NO: 1305119 - RNA, 14 nt, Homo sapiens
agcuacucucccca

SEQ ID NO: 1305120 - RNA, 20 nt, Homo sapiens
agcuaggaagagcaggacuc

SEQ ID NO: 1305121 - RNA, 13 nt, Homo sapiens
agcuaguggcucu

SEQ ID NO: 1305122 - RNA, 14 nt, Homo sapiens
agcuauaacuaagc

SEQ ID NO: 1305123 - RNA, 15 nt, Homo sapiens
agcuauaacuaagca

SEQ ID NO: 1305124 - RNA, 15 nt, Homo sapiens
agcuaucugccugac

SEQ ID NO: 1305125 - RNA, 22 nt, Homo sapiens
agcuauucuccauguacuggca

SEQ ID NO: 1305126 - RNA, 22 nt, Homo sapiens
agcuauuggccucccaaaagac

SEQ ID NO: 1305127 - RNA, 22 nt, Homo sapiens
agcucaaagcguggacaggugu

SEQ ID NO: 1305128 - RNA, 15 nt, Homo sapiens
agcucaagaugacag

SEQ ID NO: 1305129 - RNA, 18 nt, Homo sapiens
agcucacggaagggaugc

SEQ ID NO: 1305130 - RNA, 16 nt, Homo sapiens
agcucagcauuuccac

SEQ ID NO: 1305131 - RNA, 15 nt, Homo sapiens
agcuccaauuucaag

SEQ ID NO: 1305132 - RNA, 17 nt, Homo sapiens
agcuccccucacucugu

SEQ ID NO: 1305133 - RNA, 18 nt, Homo sapiens
agcuccuguggccacagc

SEQ ID NO: 1305134 - RNA, 23 nt, Homo sapiens
agcuccuucuguccuacucugug

SEQ ID NO: 1305135 - RNA, 16 nt, Homo sapiens
agcucgguacccgggg

SEQ ID NO: 1305136 - RNA, 17 nt, Homo sapiens
agcucucaguugcagcc

SEQ ID NO: 1305137 - RNA, 19 nt, Homo sapiens
agcucugcuccucucccca

SEQ ID NO: 1305138 - RNA, 22 nt, Homo sapiens
agcucuggccccaggcuuguca

SEQ ID NO: 1305139 - RNA, 20 nt, Homo sapiens
agcucuggugauaaggacau

SEQ ID NO: 1305140 - RNA, 17 nt, Homo sapiens
agcucuguaucugccau

SEQ ID NO: 1305141 - RNA, 23 nt, Homo sapiens
agcucuugacagaaagcaguucu

SEQ ID NO: 1305142 - RNA, 20 nt, Homo sapiens
agcucuuggcuccacuggga

SEQ ID NO: 1305143 - RNA, 15 nt, Homo sapiens
agcugaauacauucu

SEQ ID NO: 1305144 - RNA, 18 nt, Homo sapiens
agcugacacaggaugaag

SEQ ID NO: 1305145 - RNA, 22 nt, Homo sapiens
agcugagacuacaagugugugc

SEQ ID NO: 1305146 - RNA, 23 nt, Homo sapiens
agcugauacaaauugcagacugu

SEQ ID NO: 1305147 - RNA, 18 nt, Homo sapiens
agcugauugcacuaagcc

SEQ ID NO: 1305148 - RNA, 13 nt, Homo sapiens
agcugcaaagugu

SEQ ID NO: 1305149 - RNA, 12 nt, Homo sapiens
agcugcaucauc

SEQ ID NO: 1305150 - RNA, 21 nt, Homo sapiens
agcugcccccuccaggccagu

SEQ ID NO: 1305151 - RNA, 13 nt, Homo sapiens
agcugcucaggga

SEQ ID NO: 1305152 - RNA, 20 nt, Homo sapiens
agcuggagcccgugcccuac

SEQ ID NO: 1305153 - RNA, 15 nt, Homo sapiens
agcuggaugaugguc

SEQ ID NO: 1305154 - RNA, 17 nt, Homo sapiens
agcugggacuacaggug

SEQ ID NO: 1305155 - RNA, 21 nt, Homo sapiens
agcugggauuacaggugugca

SEQ ID NO: 1305156 - RNA, 20 nt, Homo sapiens
agcugggucaggcagggugc

SEQ ID NO: 1305157 - RNA, 20 nt, Homo sapiens
agcugguauggccuuaccuu

SEQ ID NO: 1305158 - RNA, 14 nt, Homo sapiens
agcuguaucuugau

SEQ ID NO: 1305159 - RNA, 15 nt, Homo sapiens
agcugucauaaaaag

SEQ ID NO: 1305160 - RNA, 19 nt, Homo sapiens
agggcugucaucugugcac

SEQ ID NO: 1305161 - RNA, 16 nt, Homo sapiens
agggcuuccucuuccg

SEQ ID NO: 1305162 - RNA, 22 nt, Homo sapiens
aggggaacuagguuaccgcuua

SEQ ID NO: 1305163 - RNA, 14 nt, Homo sapiens
aggggacgcaaugg

SEQ ID NO: 1305164 - RNA, 19 nt, Homo sapiens
aggggccccugauccucac

SEQ ID NO: 1305165 - RNA, 19 nt, Homo sapiens
aggggccuaggccucagcc

SEQ ID NO: 1305166 - RNA, 19 nt, Homo sapiens
aggggcugcugaccuccac

SEQ ID NO: 1305167 - RNA, 14 nt, Homo sapiens
aggggcuggcacug

SEQ ID NO: 1305168 - RNA, 13 nt, Homo sapiens
aggggcuguguuu

SEQ ID NO: 1305169 - RNA, 10 nt, Homo sapiens
aguguaagaa

SEQ ID NO: 1305170 - RNA, 18 nt, Homo sapiens
agugucauugagcaguau

SEQ ID NO: 1305171 - RNA, 15 nt, Homo sapiens
agugucuuuugacau

SEQ ID NO: 1305172 - RNA, 21 nt, Homo sapiens
agugugugauaaaucagucaa

SEQ ID NO: 1305173 - RNA, 20 nt, Homo sapiens
aguguuccccuuccacugag

SEQ ID NO: 1305174 - RNA, 12 nt, Homo sapiens
aguguugcccag

SEQ ID NO: 1305175 - RNA, 21 nt, Homo sapiens
aguuaaauagaguauaugcac

SEQ ID NO: 1305176 - RNA, 18 nt, Homo sapiens
aguuaacucacugagggu

SEQ ID NO: 1305177 - RNA, 16 nt, Homo sapiens
aguuaagcaacaucua

SEQ ID NO: 1305178 - RNA, 15 nt, Homo sapiens
aguuaaggagccuaa

SEQ ID NO: 1305179 - RNA, 20 nt, Homo sapiens
aguuaaggggagcaacagag

SEQ ID NO: 1305180 - RNA, 15 nt, Homo sapiens
aguuacugugguaug

SEQ ID NO: 1305181 - RNA, 19 nt, Homo sapiens
aguuacuuuagauggcaag

SEQ ID NO: 1305182 - RNA, 14 nt, Homo sapiens
aguuaggugggucu

SEQ ID NO: 1305183 - RNA, 14 nt, Homo sapiens
aguuauacuccuca

SEQ ID NO: 1305184 - RNA, 20 nt, Homo sapiens
aguuauuacauguaauuuga

SEQ ID NO: 1305185 - RNA, 17 nt, Homo sapiens
aguuauuacucaagugg

SEQ ID NO: 1305186 - RNA, 15 nt, Homo sapiens
aguucacagacauac

SEQ ID NO: 1305187 - RNA, 22 nt, Homo sapiens
aguucaccuccugacaguauua

SEQ ID NO: 1305188 - RNA, 14 nt, Homo sapiens
aguucacggcaaaa

SEQ ID NO: 1305189 - RNA, 22 nt, Homo sapiens
aguucaucuauggcaguccagc

SEQ ID NO: 1305190 - RNA, 18 nt, Homo sapiens
aguuccuugaucuguaua

SEQ ID NO: 1305191 - RNA, 17 nt, Homo sapiens
aguucggugagcuacaa

SEQ ID NO: 1305192 - RNA, 23 nt, Homo sapiens
aguucugcaaaaaugaccuauaa

SEQ ID NO: 1305193 - RNA, 16 nt, Homo sapiens
aguucuuugggccaga

SEQ ID NO: 1305194 - RNA, 19 nt, Homo sapiens
aguucuuugggccagacau

SEQ ID NO: 1305195 - RNA, 18 nt, Homo sapiens
aguugaagggaggggcug

SEQ ID NO: 1305196 - RNA, 13 nt, Homo sapiens
aguugaucuggaa

SEQ ID NO: 1305197 - RNA, 15 nt, Homo sapiens
aguuguaacaaauac

SEQ ID NO: 1305198 - RNA, 20 nt, Homo sapiens
aguuuaaaacagaagccuga

SEQ ID NO: 1305199 - RNA, 17 nt, Homo sapiens
aguuuaacauuagcuaa

SEQ ID NO: 1305200 - RNA, 20 nt, Homo sapiens
aguuuagauugugaggcaau

SEQ ID NO: 1305201 - RNA, 19 nt, Homo sapiens
aguuuauacuucucuauua

SEQ ID NO: 1305202 - RNA, 17 nt, Homo sapiens
aguuuauauacaauuau

SEQ ID NO: 1305203 - RNA, 15 nt, Homo sapiens
aguuuauugacaaua

SEQ ID NO: 1305204 - RNA, 21 nt, Homo sapiens
aguuucagagaccauugcaau

SEQ ID NO: 1305205 - RNA, 21 nt, Homo sapiens
aguuucagagauggacagaga

SEQ ID NO: 1305206 - RNA, 20 nt, Homo sapiens
aguuuccuuccagcccagaa

SEQ ID NO: 1305207 - RNA, 18 nt, Homo sapiens
aguuuccuucccuaccca

SEQ ID NO: 1305208 - RNA, 20 nt, Homo sapiens
aguuugagacaggagaccug

SEQ ID NO: 1305209 - RNA, 18 nt, Homo sapiens
aguuugauuauucagugu

SEQ ID NO: 1305210 - RNA, 22 nt, Homo sapiens
aguuugccggauacaaacuggu

SEQ ID NO: 1305211 - RNA, 18 nt, Homo sapiens
aguuuuauuuuuguagag

SEQ ID NO: 1305212 - RNA, 14 nt, Homo sapiens
aguuuuuugaacau

SEQ ID NO: 1305213 - RNA, 15 nt, Homo sapiens
auaaaaggaagccaa

SEQ ID NO: 1305214 - RNA, 16 nt, Homo sapiens
auaaaauucauuaguu

SEQ ID NO: 1305215 - RNA, 21 nt, Homo sapiens
auaaaauugaaaguucuggaa

SEQ ID NO: 1305216 - RNA, 13 nt, Homo sapiens
auaaacacugaca

SEQ ID NO: 1305217 - RNA, 16 nt, Homo sapiens
auaaacucagaaauuu

SEQ ID NO: 1305218 - RNA, 23 nt, Homo sapiens
auaaagaagguuggugaauuuca

SEQ ID NO: 1305219 - RNA, 20 nt, Homo sapiens
auaaagacaaucacugccaa

SEQ ID NO: 1305220 - RNA, 16 nt, Homo sapiens
auaaagaugauugaau

SEQ ID NO: 1305221 - RNA, 19 nt, Homo sapiens
auaaagcacagauuugcau

SEQ ID NO: 1305222 - RNA, 22 nt, Homo sapiens
auaaaguguuugaaagcuuuau

SEQ ID NO: 1305223 - RNA, 15 nt, Homo sapiens
auaaauaaaguuucu

SEQ ID NO: 1305224 - RNA, 19 nt, Homo sapiens
auaaauauuuugcauauaa

SEQ ID NO: 1305225 - RNA, 23 nt, Homo sapiens
auaaaucaacaccuuaauaugcu

SEQ ID NO: 1305226 - RNA, 15 nt, Homo sapiens
auaaaucuguuauag

SEQ ID NO: 1305227 - RNA, 19 nt, Homo sapiens
auaaauguaauagccaaac

SEQ ID NO: 1305228 - RNA, 14 nt, Homo sapiens
auaaaugugaacuu

SEQ ID NO: 1305229 - RNA, 22 nt, Homo sapiens
auaacaauaaaagacaaggaaa

SEQ ID NO: 1305230 - RNA, 19 nt, Homo sapiens
auaacaccugccaccacua

SEQ ID NO: 1305231 - RNA, 14 nt, Homo sapiens
auaaccuagccuua

SEQ ID NO: 1305232 - RNA, 22 nt, Homo sapiens
auaacgauaaaagacagugaaa

SEQ ID NO: 1305233 - RNA, 22 nt, Homo sapiens
auaacuaggaaauccauucaca

SEQ ID NO: 1305234 - RNA, 17 nt, Homo sapiens
auaagaaagaucaaaga

SEQ ID NO: 1305235 - RNA, 15 nt, Homo sapiens
auaagaggauaugaa

SEQ ID NO: 1305236 - RNA, 23 nt, Homo sapiens
auaagcaaagggagcacuggguu

SEQ ID NO: 1305237 - RNA, 20 nt, Homo sapiens
auaagcuauagacccgagga

SEQ ID NO: 1305238 - RNA, 16 nt, Homo sapiens
auaaguaccucagcau

SEQ ID NO: 1305239 - RNA, 16 nt, Homo sapiens
auaauaugagaaucag

SEQ ID NO: 1305240 - RNA, 20 nt, Homo sapiens
auaauaugcacacagugcuu

SEQ ID NO: 1305241 - RNA, 21 nt, Homo sapiens
auaauccuaaacauaugaauu

SEQ ID NO: 1305242 - RNA, 12 nt, Homo sapiens
auaaucuuugcu

SEQ ID NO: 1305243 - RNA, 23 nt, Homo sapiens
auaauuauuuuuuucacuuguua

SEQ ID NO: 1305244 - RNA, 17 nt, Homo sapiens
auaauuugaacagcuug

SEQ ID NO: 1305245 - RNA, 17 nt, Homo sapiens
auacaaaaauacucaga

SEQ ID NO: 1305246 - RNA, 18 nt, Homo sapiens
auacaacagugcauuuac

SEQ ID NO: 1305247 - RNA, 16 nt, Homo sapiens
auacaagaagcacuga

SEQ ID NO: 1305248 - RNA, 19 nt, Homo sapiens
auacaauuauuuuuacagu

SEQ ID NO: 1305249 - RNA, 13 nt, Homo sapiens
auacagaauuuua

SEQ ID NO: 1305250 - RNA, 20 nt, Homo sapiens
auacagucuuccacaaagaa

SEQ ID NO: 1305251 - RNA, 20 nt, Homo sapiens
auacaguuugucacaugaaa

SEQ ID NO: 1305252 - RNA, 16 nt, Homo sapiens
auacauagcaugacau

SEQ ID NO: 1305253 - RNA, 16 nt, Homo sapiens
auacauccuagugaau

SEQ ID NO: 1305254 - RNA, 19 nt, Homo sapiens
auacauuaucucacuugug

SEQ ID NO: 1305255 - RNA, 21 nt, Homo sapiens
auaccagguuuuacacuugca

SEQ ID NO: 1305256 - RNA, 22 nt, Homo sapiens
auaccagguuuuacacuugcau

SEQ ID NO: 1305257 - RNA, 15 nt, Homo sapiens
auaccauuuccucag

SEQ ID NO: 1305258 - RNA, 22 nt, Homo sapiens
auaccuccucccuaaugcucac

SEQ ID NO: 1305259 - RNA, 19 nt, Homo sapiens
auaccuucuuaaguuuuca

SEQ ID NO: 1305260 - RNA, 13 nt, Homo sapiens
auacgucagauug

SEQ ID NO: 1305261 - RNA, 19 nt, Homo sapiens
auacuaacauuuucauuga

SEQ ID NO: 1305262 - RNA, 22 nt, Homo sapiens
auacucugcccucuagagccuu

SEQ ID NO: 1305263 - RNA, 20 nt, Homo sapiens
auacucuguccccccagcua

SEQ ID NO: 1305264 - RNA, 15 nt, Homo sapiens
auacuguaugcagua

SEQ ID NO: 1305265 - RNA, 22 nt, Homo sapiens
auacugugugcuaaaacaagca

SEQ ID NO: 1305266 - RNA, 14 nt, Homo sapiens
auacuuaacaaaua

SEQ ID NO: 1305267 - RNA, 15 nt, Homo sapiens
auacuuaaugcauau

SEQ ID NO: 1305268 - RNA, 19 nt, Homo sapiens
auacuuaguucauggcuuu

SEQ ID NO: 1305269 - RNA, 19 nt, Homo sapiens
auacuuggaugcagcucuu

SEQ ID NO: 1305270 - RNA, 20 nt, Homo sapiens
auacuuggaugcagcucuug

SEQ ID NO: 1305271 - RNA, 17 nt, Homo sapiens
auacuuuagaaguagaa

SEQ ID NO: 1305272 - RNA, 13 nt, Homo sapiens
auacuuuuuacaa

SEQ ID NO: 1305273 - RNA, 13 nt, Homo sapiens
auagaaaccucuc

SEQ ID NO: 1305274 - RNA, 12 nt, Homo sapiens
auagaaaugcca

SEQ ID NO: 1305275 - RNA, 13 nt, Homo sapiens
auagaacagagaa

SEQ ID NO: 1305276 - RNA, 15 nt, Homo sapiens
auagagugcauuuga

SEQ ID NO: 1305277 - RNA, 13 nt, Homo sapiens
auagauccagugc

SEQ ID NO: 1305278 - RNA, 22 nt, Homo sapiens
auagaugcuggcccagggccca

SEQ ID NO: 1305279 - RNA, 15 nt, Homo sapiens
auagauuuuuucaga

SEQ ID NO: 1305280 - RNA, 14 nt, Homo sapiens
auagcaaaacuaaa

SEQ ID NO: 1305281 - RNA, 12 nt, Homo sapiens
auagcaagugaa

SEQ ID NO: 1305282 - RNA, 18 nt, Homo sapiens
auagcagaugguuuccac

SEQ ID NO: 1305283 - RNA, 19 nt, Homo sapiens
auagcaugcaucuguuuau

SEQ ID NO: 1305284 - RNA, 17 nt, Homo sapiens
auagccuaggugacaga

SEQ ID NO: 1305285 - RNA, 23 nt, Homo sapiens
auagccuguggccuuugcaauuu

SEQ ID NO: 1305286 - RNA, 15 nt, Homo sapiens
auagcgaauacaaaa

SEQ ID NO: 1305287 - RNA, 20 nt, Homo sapiens
auaggacucaaaguuucaga

SEQ ID NO: 1305288 - RNA, 18 nt, Homo sapiens
auaggcauuaacacaaag

SEQ ID NO: 1305289 - RNA, 16 nt, Homo sapiens
auagguugagcaauuu

SEQ ID NO: 1305290 - RNA, 19 nt, Homo sapiens
auaguaccauuuauacaaa

SEQ ID NO: 1305291 - RNA, 22 nt, Homo sapiens
auagucucauucugucacccag

SEQ ID NO: 1305292 - RNA, 16 nt, Homo sapiens
auagucuggcaccaaa

SEQ ID NO: 1305293 - RNA, 14 nt, Homo sapiens
auaguuaagacaug

SEQ ID NO: 1305294 - RNA, 17 nt, Homo sapiens
auaguucaugucugcua

SEQ ID NO: 1305295 - RNA, 13 nt, Homo sapiens
auauaaacuuuau

SEQ ID NO: 1305296 - RNA, 21 nt, Homo sapiens
auauaaaugugauugcagcuu

SEQ ID NO: 1305297 - RNA, 17 nt, Homo sapiens
auauaaauuuucccaaa

SEQ ID NO: 1305298 - RNA, 17 nt, Homo sapiens
auauaacgcaggccuuu

SEQ ID NO: 1305299 - RNA, 20 nt, Homo sapiens
acuugccucuuuuaccugcu

SEQ ID NO: 1305300 - RNA, 19 nt, Homo sapiens
acuugcuuaucaacuuccu

SEQ ID NO: 1305301 - RNA, 14 nt, Homo sapiens
acuuggcugcauuu

SEQ ID NO: 1305302 - RNA, 18 nt, Homo sapiens
acuugggaauaaaucaua

SEQ ID NO: 1305303 - RNA, 21 nt, Homo sapiens
acuugggaauaaaucauagca

SEQ ID NO: 1305304 - RNA, 17 nt, Homo sapiens
acuugggcacaugcuca

SEQ ID NO: 1305305 - RNA, 14 nt, Homo sapiens
acuugucucuucau

SEQ ID NO: 1305306 - RNA, 14 nt, Homo sapiens
acuuguggacacag

SEQ ID NO: 1305307 - RNA, 18 nt, Homo sapiens
acuuguggacacagcucu

SEQ ID NO: 1305308 - RNA, 20 nt, Homo sapiens
acuuguuuggccuauuccau

SEQ ID NO: 1305309 - RNA, 17 nt, Homo sapiens
acuuguuuuugcacaug

SEQ ID NO: 1305310 - RNA, 19 nt, Homo sapiens
acuuuacaaccugauguca

SEQ ID NO: 1305311 - RNA, 13 nt, Homo sapiens
acuuuaucaauua

SEQ ID NO: 1305312 - RNA, 21 nt, Homo sapiens
acuuuaucaauuaacugagua

SEQ ID NO: 1305313 - RNA, 20 nt, Homo sapiens
acuuucauuauagcagagag

SEQ ID NO: 1305314 - RNA, 12 nt, Homo sapiens
acuuuccuuuaa

SEQ ID NO: 1305315 - RNA, 23 nt, Homo sapiens
acuuugagauguugaaauuacau

SEQ ID NO: 1305316 - RNA, 15 nt, Homo sapiens
acuuuggaacacuac

SEQ ID NO: 1305317 - RNA, 15 nt, Homo sapiens
acuuuguaaauaagu

SEQ ID NO: 1305318 - RNA, 22 nt, Homo sapiens
acuuugucccguggcauuucaa

SEQ ID NO: 1305319 - RNA, 19 nt, Homo sapiens
acuuuguuuaaaccuucca

SEQ ID NO: 1305320 - RNA, 22 nt, Homo sapiens
acuuuguuuagcccaaaaccaa

SEQ ID NO: 1305321 - RNA, 18 nt, Homo sapiens
acuuuuaaguuuccuucc

SEQ ID NO: 1305322 - RNA, 14 nt, Homo sapiens
acuuuucaccuuaa

SEQ ID NO: 1305323 - RNA, 19 nt, Homo sapiens
acuuuuucucggagcauau

SEQ ID NO: 1305324 - RNA, 20 nt, Homo sapiens
agaaaaaauaacacacauau

SEQ ID NO: 1305325 - RNA, 17 nt, Homo sapiens
agaaaacugucugggag

SEQ ID NO: 1305326 - RNA, 14 nt, Homo sapiens
agaggcugugucag

SEQ ID NO: 1305327 - RNA, 19 nt, Homo sapiens
agagggcacacacugugua

SEQ ID NO: 1305328 - RNA, 15 nt, Homo sapiens
agaguauggagcuca

SEQ ID NO: 1305329 - RNA, 22 nt, Homo sapiens
agaguauuaaugaaaagcacaa

SEQ ID NO: 1305330 - RNA, 15 nt, Homo sapiens
agagucaucuaccug

SEQ ID NO: 1305331 - RNA, 17 nt, Homo sapiens
agagucaucuaccugag

SEQ ID NO: 1305332 - RNA, 12 nt, Homo sapiens
agagucaucuga

SEQ ID NO: 1305333 - RNA, 21 nt, Homo sapiens
agaguccuggagcuggcucua

SEQ ID NO: 1305334 - RNA, 21 nt, Homo sapiens
agagucgcaucucagugcagg

SEQ ID NO: 1305335 - RNA, 16 nt, Homo sapiens
agagugaaggauuuau

SEQ ID NO: 1305336 - RNA, 16 nt, Homo sapiens
agagugacacccaaga

SEQ ID NO: 1305337 - RNA, 19 nt, Homo sapiens
agagugcuccuguauugaa

SEQ ID NO: 1305338 - RNA, 19 nt, Homo sapiens
agaguggggaugacaugca

SEQ ID NO: 1305339 - RNA, 23 nt, Homo sapiens
agagugucuucacggcaggacaa

SEQ ID NO: 1305340 - RNA, 18 nt, Homo sapiens
agauaauauguuaucucu

SEQ ID NO: 1305341 - RNA, 18 nt, Homo sapiens
agauacugucucuuucau

SEQ ID NO: 1305342 - RNA, 20 nt, Homo sapiens
agauagauaggucagugcaa

SEQ ID NO: 1305343 - RNA, 12 nt, Homo sapiens
agauagccagag

SEQ ID NO: 1305344 - RNA, 22 nt, Homo sapiens
agauagcuucaccccaauccca

SEQ ID NO: 1305345 - RNA, 16 nt, Homo sapiens
agauagucaugcugcu

SEQ ID NO: 1305346 - RNA, 23 nt, Homo sapiens
agauaguggggagacuucuuggc

SEQ ID NO: 1305347 - RNA, 23 nt, Homo sapiens
agauaucuucaguuuaaugcaag

SEQ ID NO: 1305348 - RNA, 15 nt, Homo sapiens
agaucaaagaacuca

SEQ ID NO: 1305349 - RNA, 16 nt, Homo sapiens
agaucacauauucuag

SEQ ID NO: 1305350 - RNA, 22 nt, Homo sapiens
agaucacuucaggucaggaguu

SEQ ID NO: 1305351 - RNA, 19 nt, Homo sapiens
agaucagcgacccugagga

SEQ ID NO: 1305352 - RNA, 14 nt, Homo sapiens
agaucauucacuca

SEQ ID NO: 1305353 - RNA, 23 nt, Homo sapiens
agauccagggacugaagccaaag

SEQ ID NO: 1305354 - RNA, 18 nt, Homo sapiens
agaugacuuccccugccu

SEQ ID NO: 1305355 - RNA, 18 nt, Homo sapiens
agaugauggcucauuuac

SEQ ID NO: 1305356 - RNA, 17 nt, Homo sapiens
agaugcaggugagccca

SEQ ID NO: 1305357 - RNA, 19 nt, Homo sapiens
agaugcccaggauuugacu

SEQ ID NO: 1305358 - RNA, 13 nt, Homo sapiens
agaugccuacuuu

SEQ ID NO: 1305359 - RNA, 20 nt, Homo sapiens
agaugcugguuuucuaccca

SEQ ID NO: 1305360 - RNA, 19 nt, Homo sapiens
agaugcuuuaagugcacaa

SEQ ID NO: 1305361 - RNA, 14 nt, Homo sapiens
agauggauucucca

SEQ ID NO: 1305362 - RNA, 16 nt, Homo sapiens
agaugggcagcagcuu

SEQ ID NO: 1305363 - RNA, 13 nt, Homo sapiens
agauggugcugag

SEQ ID NO: 1305364 - RNA, 22 nt, Homo sapiens
agaugguguggguguccugccu

SEQ ID NO: 1305365 - RNA, 22 nt, Homo sapiens
agauguaagaaauguucuugca

SEQ ID NO: 1305366 - RNA, 22 nt, Homo sapiens
agauguaauguuuucuuugcaa

SEQ ID NO: 1305367 - RNA, 15 nt, Homo sapiens
agaugucucugcaaa

SEQ ID NO: 1305368 - RNA, 11 nt, Homo sapiens
agaugucuguu

SEQ ID NO: 1305369 - RNA, 16 nt, Homo sapiens
agauguucucuaucau

SEQ ID NO: 1305370 - RNA, 21 nt, Homo sapiens
agauuaaucuaccuugcagug

SEQ ID NO: 1305371 - RNA, 12 nt, Homo sapiens
agauuacccaaa

SEQ ID NO: 1305372 - RNA, 18 nt, Homo sapiens
agauuauauauuauuucu

SEQ ID NO: 1305373 - RNA, 20 nt, Homo sapiens
agauuauuaaaagaugucuc

SEQ ID NO: 1305374 - RNA, 19 nt, Homo sapiens
agauuccaaaaagcacaua

SEQ ID NO: 1305375 - RNA, 16 nt, Homo sapiens
agauuccccuguguca

SEQ ID NO: 1305376 - RNA, 16 nt, Homo sapiens
agauuccgcaccaaua

SEQ ID NO: 1305377 - RNA, 17 nt, Homo sapiens
agauuccgcaccaauaa

SEQ ID NO: 1305378 - RNA, 21 nt, Homo sapiens
agauugagcuuagauugccuc

SEQ ID NO: 1305379 - RNA, 13 nt, Homo sapiens
agauugauacuuu

SEQ ID NO: 1305380 - RNA, 14 nt, Homo sapiens
agauuucuauggua

SEQ ID NO: 1305381 - RNA, 15 nt, Homo sapiens
agauuuggaugcacu

SEQ ID NO: 1305382 - RNA, 22 nt, Homo sapiens
agauuuggaugcacucauuuaa

SEQ ID NO: 1305383 - RNA, 22 nt, Homo sapiens
agauuuuuuccucugcauuuac

SEQ ID NO: 1305384 - RNA, 16 nt, Homo sapiens
agcaaaaagcaaaauc

SEQ ID NO: 1305385 - RNA, 17 nt, Homo sapiens
agcaaacaaaauggacu

SEQ ID NO: 1305386 - RNA, 21 nt, Homo sapiens
agcaacacucuauauuuagau

SEQ ID NO: 1305387 - RNA, 23 nt, Homo sapiens
agcaacaggccauugugaaccaa

SEQ ID NO: 1305388 - RNA, 16 nt, Homo sapiens
agcaacucuugauuau

SEQ ID NO: 1305389 - RNA, 17 nt, Homo sapiens
agcaagacauacuuaau

SEQ ID NO: 1305390 - RNA, 15 nt, Homo sapiens
agcaagacugagggg

SEQ ID NO: 1305391 - RNA, 19 nt, Homo sapiens
agcaagaucccaucucuuu

SEQ ID NO: 1305392 - RNA, 20 nt, Homo sapiens
agcaagcgcuguaaacccug

SEQ ID NO: 1305393 - RNA, 19 nt, Homo sapiens
agcaaggcacagccuuugc

SEQ ID NO: 1305394 - RNA, 18 nt, Homo sapiens
agcaauacagacuacuuc

SEQ ID NO: 1305395 - RNA, 21 nt, Homo sapiens
agcaaucgaaucccuuucuca

SEQ ID NO: 1305396 - RNA, 16 nt, Homo sapiens
agcaauguacaccaga

SEQ ID NO: 1305397 - RNA, 21 nt, Homo sapiens
agcaauuucccccuaaaccaa

SEQ ID NO: 1305398 - RNA, 16 nt, Homo sapiens
agcacaaggccuugcc

SEQ ID NO: 1305399 - RNA, 21 nt, Homo sapiens
agcacagauguucccccaucu

SEQ ID NO: 1305400 - RNA, 15 nt, Homo sapiens
agcacagauuugcau

SEQ ID NO: 1305401 - RNA, 16 nt, Homo sapiens
agcacagcuugaccug

SEQ ID NO: 1305402 - RNA, 11 nt, Homo sapiens
agcacaggugg

SEQ ID NO: 1305403 - RNA, 23 nt, Homo sapiens
agcacaggugggcuucccagugg

SEQ ID NO: 1305404 - RNA, 13 nt, Homo sapiens
agcacaugcaccu

SEQ ID NO: 1305405 - RNA, 14 nt, Homo sapiens
agcacccccagugc

SEQ ID NO: 1305406 - RNA, 17 nt, Homo sapiens
agcaccguucugugcac

SEQ ID NO: 1305407 - RNA, 20 nt, Homo sapiens
agcacggugacucuguccag

SEQ ID NO: 1305408 - RNA, 24 nt, Homo sapiens
agcacuaguauuucauguugcaca

SEQ ID NO: 1305409 - RNA, 15 nt, Homo sapiens
agcacugaggaagaa

SEQ ID NO: 1305410 - RNA, 14 nt, Homo sapiens
agcacuuccauggg

SEQ ID NO: 1305411 - RNA, 12 nt, Homo sapiens
agcacuuugcaa

SEQ ID NO: 1305412 - RNA, 16 nt, Homo sapiens
agcagaccucguuucu

SEQ ID NO: 1305413 - RNA, 13 nt, Homo sapiens
agcagagacuuua

SEQ ID NO: 1305414 - RNA, 22 nt, Homo sapiens
agcagagcauuuuuuaugauau

SEQ ID NO: 1305415 - RNA, 15 nt, Homo sapiens
agcagaggucuccca

SEQ ID NO: 1305416 - RNA, 21 nt, Homo sapiens
agcagaguguucccugacucc

SEQ ID NO: 1305417 - RNA, 22 nt, Homo sapiens
agcagcacaggggacgcaaugg

SEQ ID NO: 1305418 - RNA, 21 nt, Homo sapiens
agcagcaccguucugugcaca

SEQ ID NO: 1305419 - RNA, 21 nt, Homo sapiens
agcagccucagaacaaaguga

SEQ ID NO: 1305420 - RNA, 13 nt, Homo sapiens
agcaggacuccag

SEQ ID NO: 1305421 - RNA, 19 nt, Homo sapiens
agcaggacuuugaggcaag

SEQ ID NO: 1305422 - RNA, 19 nt, Homo sapiens
agcaggcguucagcucacu

SEQ ID NO: 1305423 - RNA, 15 nt, Homo sapiens
agcagggucaucugu

SEQ ID NO: 1305424 - RNA, 22 nt, Homo sapiens
agcaggugcugacuucaucucc

SEQ ID NO: 1305425 - RNA, 18 nt, Homo sapiens
agcagguuaccacucugg

SEQ ID NO: 1305426 - RNA, 23 nt, Homo sapiens
agcaguaguuuguuguagguuuc

SEQ ID NO: 1305427 - RNA, 19 nt, Homo sapiens
agcagucucugccuugccu

SEQ ID NO: 1305428 - RNA, 23 nt, Homo sapiens
agcagucuuucuauccuguucuu

SEQ ID NO: 1305429 - RNA, 20 nt, Homo sapiens
agcagugaaugauucagugu

SEQ ID NO: 1305430 - RNA, 15 nt, Homo sapiens
agcagugcaggcaca

SEQ ID NO: 1305431 - RNA, 20 nt, Homo sapiens
agcaguuaguuccuucauga

SEQ ID NO: 1305432 - RNA, 16 nt, Homo sapiens
agcaguucugaugcuu

SEQ ID NO: 1305433 - RNA, 13 nt, Homo sapiens
agcauacaacuuu

SEQ ID NO: 1305434 - RNA, 18 nt, Homo sapiens
agcauacgguaugauauu

SEQ ID NO: 1305435 - RNA, 21 nt, Homo sapiens
agcauacgguaugauauugca

SEQ ID NO: 1305436 - RNA, 20 nt, Homo sapiens
agcauauacaauaauguaau

SEQ ID NO: 1305437 - RNA, 18 nt, Homo sapiens
agcaucuuagugccuuua

SEQ ID NO: 1305438 - RNA, 23 nt, Homo sapiens
acucaaagaaaacugucugggag

SEQ ID NO: 1305439 - RNA, 13 nt, Homo sapiens
acucaaaugcuua

SEQ ID NO: 1305440 - RNA, 17 nt, Homo sapiens
acucaaauggggccaga

SEQ ID NO: 1305441 - RNA, 21 nt, Homo sapiens
acucaaauggggccagaucca

SEQ ID NO: 1305442 - RNA, 21 nt, Homo sapiens
acucaagaagcaggcuacacu

SEQ ID NO: 1305443 - RNA, 15 nt, Homo sapiens
acucaaucuacaggc

SEQ ID NO: 1305444 - RNA, 13 nt, Homo sapiens
acucaaugcacaa

SEQ ID NO: 1305445 - RNA, 23 nt, Homo sapiens
acucacacggacacucaaaagcu

SEQ ID NO: 1305446 - RNA, 14 nt, Homo sapiens
acucagaaagccaa

SEQ ID NO: 1305447 - RNA, 23 nt, Homo sapiens
acucagaaagccaacauguggcu

SEQ ID NO: 1305448 - RNA, 23 nt, Homo sapiens
acucagaagggagcuagccagag

SEQ ID NO: 1305449 - RNA, 18 nt, Homo sapiens
acucagauggaaccgcag

SEQ ID NO: 1305450 - RNA, 22 nt, Homo sapiens
acucagauggaaccgcaggaag

SEQ ID NO: 1305451 - RNA, 12 nt, Homo sapiens
acucagcacaag

SEQ ID NO: 1305452 - RNA, 15 nt, Homo sapiens
acucagcucuuggcu

SEQ ID NO: 1305453 - RNA, 19 nt, Homo sapiens
acucagcucuuggcuccac

SEQ ID NO: 1305454 - RNA, 16 nt, Homo sapiens
acucaggcuggaguac

SEQ ID NO: 1305455 - RNA, 21 nt, Homo sapiens
acucagucccuaaaaacacag

SEQ ID NO: 1305456 - RNA, 22 nt, Homo sapiens
acucagugauacucaugaccau

SEQ ID NO: 1305457 - RNA, 23 nt, Homo sapiens
acucaugaauuaauuaaagcaaa

SEQ ID NO: 1305458 - RNA, 13 nt, Homo sapiens
acucauuccagau

SEQ ID NO: 1305459 - RNA, 20 nt, Homo sapiens
acuccagccugggugacaaa

SEQ ID NO: 1305460 - RNA, 14 nt, Homo sapiens
acuccagcugcaag

SEQ ID NO: 1305461 - RNA, 18 nt, Homo sapiens
acuccaggcccaaggcuc

SEQ ID NO: 1305462 - RNA, 19 nt, Homo sapiens
acuccuaagggacugugag

SEQ ID NO: 1305463 - RNA, 19 nt, Homo sapiens
acuccuccaaggaaaggga

SEQ ID NO: 1305464 - RNA, 19 nt, Homo sapiens
acuccucccauagauacuc

SEQ ID NO: 1305465 - RNA, 21 nt, Homo sapiens
acuccugggggagaaccacug

SEQ ID NO: 1305466 - RNA, 18 nt, Homo sapiens
acucuaggcagugacagu

SEQ ID NO: 1305467 - RNA, 18 nt, Homo sapiens
acucuauaagauuccaaa

SEQ ID NO: 1305468 - RNA, 17 nt, Homo sapiens
acucuaucugucauaca

SEQ ID NO: 1305469 - RNA, 15 nt, Homo sapiens
acucucuaccagaua

SEQ ID NO: 1305470 - RNA, 20 nt, Homo sapiens
acucucuauugaccaccagu

SEQ ID NO: 1305471 - RNA, 21 nt, Homo sapiens
acucucuauugaccaccaguu

SEQ ID NO: 1305472 - RNA, 19 nt, Homo sapiens
acucuggcugcucccugac

SEQ ID NO: 1305473 - RNA, 15 nt, Homo sapiens
acucugggaagccaa

SEQ ID NO: 1305474 - RNA, 12 nt, Homo sapiens
acucugugucag

SEQ ID NO: 1305475 - RNA, 21 nt, Homo sapiens
acucuuagauggauucuccac

SEQ ID NO: 1305476 - RNA, 13 nt, Homo sapiens
acugaauuccauu

SEQ ID NO: 1305477 - RNA, 13 nt, Homo sapiens
acugacacuggua

SEQ ID NO: 1305478 - RNA, 16 nt, Homo sapiens
acugacauuguuggcc

SEQ ID NO: 1305479 - RNA, 15 nt, Homo sapiens
acugaggcauccacu

SEQ ID NO: 1305480 - RNA, 17 nt, Homo sapiens
acugaucaggaccucca

SEQ ID NO: 1305481 - RNA, 23 nt, Homo sapiens
acugaucaggaccuccaagccac

SEQ ID NO: 1305482 - RNA, 19 nt, Homo sapiens
acugaugggcaacccccag

SEQ ID NO: 1305483 - RNA, 21 nt, Homo sapiens
acugcacuauagccuagguga

SEQ ID NO: 1305484 - RNA, 20 nt, Homo sapiens
acugcacuccagccugggug

SEQ ID NO: 1305485 - RNA, 14 nt, Homo sapiens
acugcaguggacag

SEQ ID NO: 1305486 - RNA, 14 nt, Homo sapiens
acugcauacaaucu

SEQ ID NO: 1305487 - RNA, 20 nt, Homo sapiens
acugcauaccaaccugggca

SEQ ID NO: 1305488 - RNA, 15 nt, Homo sapiens
acugcaucucaaaaa

SEQ ID NO: 1305489 - RNA, 21 nt, Homo sapiens
acugcguacaaacauccaaaa

SEQ ID NO: 1305490 - RNA, 19 nt, Homo sapiens
acugcugcuccagugcagg

SEQ ID NO: 1305491 - RNA, 18 nt, Homo sapiens
acugcuuuucaguucugu

SEQ ID NO: 1305492 - RNA, 23 nt, Homo sapiens
acuggaagguggggacagggaug

SEQ ID NO: 1305493 - RNA, 14 nt, Homo sapiens
acuggcagcauuga

SEQ ID NO: 1305494 - RNA, 16 nt, Homo sapiens
acuggcaguuuuccau

SEQ ID NO: 1305495 - RNA, 22 nt, Homo sapiens
acuggccagggccacgcuccag

SEQ ID NO: 1305496 - RNA, 14 nt, Homo sapiens
acuggcugcaaagg

SEQ ID NO: 1305497 - RNA, 14 nt, Homo sapiens
acugggaucacagg

SEQ ID NO: 1305498 - RNA, 16 nt, Homo sapiens
acugguccugcugcug

SEQ ID NO: 1305499 - RNA, 14 nt, Homo sapiens
acuggucucuggcu

SEQ ID NO: 1305500 - RNA, 19 nt, Homo sapiens
acugguuugcagugaauuu

SEQ ID NO: 1305501 - RNA, 20 nt, Homo sapiens
acuguaaaggcaagccagca

SEQ ID NO: 1305502 - RNA, 12 nt, Homo sapiens
acuguacagggg

SEQ ID NO: 1305503 - RNA, 12 nt, Homo sapiens
acuguagccuca

SEQ ID NO: 1305504 - RNA, 18 nt, Homo sapiens
acuguauauauaauacug

SEQ ID NO: 1305505 - RNA, 14 nt, Homo sapiens
acuguccuacccac

SEQ ID NO: 1305506 - RNA, 14 nt, Homo sapiens
acuguccugcaaau

SEQ ID NO: 1305507 - RNA, 16 nt, Homo sapiens
acugugaagaucucac

SEQ ID NO: 1305508 - RNA, 17 nt, Homo sapiens
acugugaagaucucacu

SEQ ID NO: 1305509 - RNA, 14 nt, Homo sapiens
acugugccacaaug

SEQ ID NO: 1305510 - RNA, 18 nt, Homo sapiens
acugugccaugugccagg

SEQ ID NO: 1305511 - RNA, 23 nt, Homo sapiens
acugugucauucuguuagauacu

SEQ ID NO: 1305512 - RNA, 18 nt, Homo sapiens
acuguguguugccacagg

SEQ ID NO: 1305513 - RNA, 17 nt, Homo sapiens
acuguguuucaaguuca

SEQ ID NO: 1305514 - RNA, 17 nt, Homo sapiens
acuguguuuuugccacu

SEQ ID NO: 1305515 - RNA, 18 nt, Homo sapiens
acuguucccccugugcag

SEQ ID NO: 1305516 - RNA, 13 nt, Homo sapiens
acuguuugucuca

SEQ ID NO: 1305517 - RNA, 20 nt, Homo sapiens
acuguuugucucaccuaccc

SEQ ID NO: 1305518 - RNA, 17 nt, Homo sapiens
acuuaaaaauuuguuca

SEQ ID NO: 1305519 - RNA, 18 nt, Homo sapiens
acuuaacaaauacauuca

SEQ ID NO: 1305520 - RNA, 19 nt, Homo sapiens
acuuaauagaaacauugaa

SEQ ID NO: 1305521 - RNA, 19 nt, Homo sapiens
acuuaauugcuuuccugcc

SEQ ID NO: 1305522 - RNA, 11 nt, Homo sapiens
acuuacccaag

SEQ ID NO: 1305523 - RNA, 15 nt, Homo sapiens
acuuacuauugguca

SEQ ID NO: 1305524 - RNA, 21 nt, Homo sapiens
acuuauaagaaagaucaaaga

SEQ ID NO: 1305525 - RNA, 14 nt, Homo sapiens
acuuauaauuugca

SEQ ID NO: 1305526 - RNA, 18 nt, Homo sapiens
acuuaugauuucaugugc

SEQ ID NO: 1305527 - RNA, 23 nt, Homo sapiens
acuuauguauuguuuucgaauac

SEQ ID NO: 1305528 - RNA, 11 nt, Homo sapiens
acuucaaagag

SEQ ID NO: 1305529 - RNA, 19 nt, Homo sapiens
acuucaagaucugaauuug

SEQ ID NO: 1305530 - RNA, 23 nt, Homo sapiens
acuucacccacccuccaggaccc

SEQ ID NO: 1305531 - RNA, 18 nt, Homo sapiens
acuucaguauguugucaa

SEQ ID NO: 1305532 - RNA, 14 nt, Homo sapiens
acuucgaaaccugg

SEQ ID NO: 1305533 - RNA, 16 nt, Homo sapiens
acuucgaaaccuggga

SEQ ID NO: 1305534 - RNA, 23 nt, Homo sapiens
acuucggacaccugccauggaca

SEQ ID NO: 1305535 - RNA, 23 nt, Homo sapiens
acuucuccaaggagcaugucacu

SEQ ID NO: 1305536 - RNA, 23 nt, Homo sapiens
acuugaaaaauacuuuuccuuac

SEQ ID NO: 1305537 - RNA, 20 nt, Homo sapiens
acuugaaauucucaucaguc

SEQ ID NO: 1305538 - RNA, 18 nt, Homo sapiens
acuugaagggccagagcc

SEQ ID NO: 1305539 - RNA, 19 nt, Homo sapiens
acuugauggaaggaucucu

SEQ ID NO: 1305540 - RNA, 16 nt, Homo sapiens
acuugccaugugacuc

SEQ ID NO: 1305541 - RNA, 22 nt, Homo sapiens
aaagccaacauguggcuccucc

SEQ ID NO: 1305542 - RNA, 21 nt, Homo sapiens
aaagcggacaucagcugguca

SEQ ID NO: 1305543 - RNA, 17 nt, Homo sapiens
aaagcguggacaggugu

SEQ ID NO: 1305544 - RNA, 17 nt, Homo sapiens
aaagcuaaaguaucugu

SEQ ID NO: 1305545 - RNA, 14 nt, Homo sapiens
aaagcugcucaggg

SEQ ID NO: 1305546 - RNA, 13 nt, Homo sapiens
aaagcuguucuca

SEQ ID NO: 1305547 - RNA, 21 nt, Homo sapiens
aaagcuguucucauuccuguu

SEQ ID NO: 1305548 - RNA, 20 nt, Homo sapiens
aaagcuuaccaaggggaaug

SEQ ID NO: 1305549 - RNA, 21 nt, Homo sapiens
aaagcuucucagccuuccuag

SEQ ID NO: 1305550 - RNA, 22 nt, Homo sapiens
aaaggaaauguaaaagcacaug

SEQ ID NO: 1305551 - RNA, 12 nt, Homo sapiens
aaaggaacugca

SEQ ID NO: 1305552 - RNA, 13 nt, Homo sapiens
aaaggaggggaua

SEQ ID NO: 1305553 - RNA, 23 nt, Homo sapiens
aaaggauucuauaucaugaccaa

SEQ ID NO: 1305554 - RNA, 14 nt, Homo sapiens
aaaggcugaaaaga

SEQ ID NO: 1305555 - RNA, 22 nt, Homo sapiens
aaagggauguuauuauccuugg

SEQ ID NO: 1305556 - RNA, 16 nt, Homo sapiens
aaaggugagcccucau

SEQ ID NO: 1305557 - RNA, 19 nt, Homo sapiens
aaaggugguguuucuguaa

SEQ ID NO: 1305558 - RNA, 22 nt, Homo sapiens
aaaggugucuucuuugacuuaa

SEQ ID NO: 1305559 - RNA, 22 nt, Homo sapiens
aaaguaacagccuuucaauuca

SEQ ID NO: 1305560 - RNA, 18 nt, Homo sapiens
aaaguaauaaaugaguuc

SEQ ID NO: 1305561 - RNA, 14 nt, Homo sapiens
aaaguagagcccuu

SEQ ID NO: 1305562 - RNA, 12 nt, Homo sapiens
aaaguaugcuac

SEQ ID NO: 1305563 - RNA, 22 nt, Homo sapiens
aaaguauucguuacaucuugua

SEQ ID NO: 1305564 - RNA, 16 nt, Homo sapiens
aaaguauucuguacuc

SEQ ID NO: 1305565 - RNA, 12 nt, Homo sapiens
aaaguauuguaa

SEQ ID NO: 1305566 - RNA, 21 nt, Homo sapiens
aaagucaccauucugcauuua

SEQ ID NO: 1305567 - RNA, 17 nt, Homo sapiens
aaagugaauuguugaca

SEQ ID NO: 1305568 - RNA, 17 nt, Homo sapiens
aaagugagacauuguga

SEQ ID NO: 1305569 - RNA, 13 nt, Homo sapiens
aaagugaugacau

SEQ ID NO: 1305570 - RNA, 18 nt, Homo sapiens
aaagugauugacuugacu

SEQ ID NO: 1305571 - RNA, 16 nt, Homo sapiens
aaaguggacaaggagu

SEQ ID NO: 1305572 - RNA, 21 nt, Homo sapiens
aaagugugcuuaacauugaca

SEQ ID NO: 1305573 - RNA, 12 nt, Homo sapiens
aaaguguguauu

SEQ ID NO: 1305574 - RNA, 20 nt, Homo sapiens
aaaguuacuagguaacuuca

SEQ ID NO: 1305575 - RNA, 12 nt, Homo sapiens
aaaguucuggaa

SEQ ID NO: 1305576 - RNA, 13 nt, Homo sapiens
aaaguugagggaa

SEQ ID NO: 1305577 - RNA, 14 nt, Homo sapiens
aaauaaaaacccaa

SEQ ID NO: 1305578 - RNA, 14 nt, Homo sapiens
aaauaaaacaguau

SEQ ID NO: 1305579 - RNA, 18 nt, Homo sapiens
aaauaaaacauuuucucu

SEQ ID NO: 1305580 - RNA, 23 nt, Homo sapiens
aaauaaggacaagccuaacuuca

SEQ ID NO: 1305581 - RNA, 18 nt, Homo sapiens
aaauaagucaaaauguga

SEQ ID NO: 1305582 - RNA, 21 nt, Homo sapiens
aaauaaguuuuuuuucugggu

SEQ ID NO: 1305583 - RNA, 12 nt, Homo sapiens
aaauaauaugca

SEQ ID NO: 1305584 - RNA, 13 nt, Homo sapiens
aaauaaucugaca

SEQ ID NO: 1305585 - RNA, 22 nt, Homo sapiens
aaauacaguuugucacaugaaa

SEQ ID NO: 1305586 - RNA, 20 nt, Homo sapiens
aaauacgguaaggauacuuu

SEQ ID NO: 1305587 - RNA, 13 nt, Homo sapiens
aaauacugaauua

SEQ ID NO: 1305588 - RNA, 13 nt, Homo sapiens
aaauacugugccu

SEQ ID NO: 1305589 - RNA, 18 nt, Homo sapiens
aaauagaagacauauaaa

SEQ ID NO: 1305590 - RNA, 15 nt, Homo sapiens
aaauagaggcuaaau

SEQ ID NO: 1305591 - RNA, 21 nt, Homo sapiens
aaauagcggugaaucuaguga

SEQ ID NO: 1305592 - RNA, 21 nt, Homo sapiens
aaauauuuauaaaacuucuca

SEQ ID NO: 1305593 - RNA, 23 nt, Homo sapiens
aaauauuuguaauuuuacacaaa

SEQ ID NO: 1305594 - RNA, 20 nt, Homo sapiens
aaauauuuugcggcauuaaa

SEQ ID NO: 1305595 - RNA, 16 nt, Homo sapiens
aaauauuuugucuaaa

SEQ ID NO: 1305596 - RNA, 13 nt, Homo sapiens
aaaucaacuugcu

SEQ ID NO: 1305597 - RNA, 16 nt, Homo sapiens
aaaucaacuugcuuau

SEQ ID NO: 1305598 - RNA, 14 nt, Homo sapiens
aaaucacacuguaa

SEQ ID NO: 1305599 - RNA, 19 nt, Homo sapiens
aaaucaugccauugcacuc

SEQ ID NO: 1305600 - RNA, 21 nt, Homo sapiens
aaaucaugccauugcacucca

SEQ ID NO: 1305601 - RNA, 11 nt, Homo sapiens
aaauccaaaga

SEQ ID NO: 1305602 - RNA, 21 nt, Homo sapiens
aaaucccauggaauauuucca

SEQ ID NO: 1305603 - RNA, 13 nt, Homo sapiens
aaauccuauguga

SEQ ID NO: 1305604 - RNA, 20 nt, Homo sapiens
aaaucugagaaacucuacau

SEQ ID NO: 1305605 - RNA, 15 nt, Homo sapiens
aaaucuugacuacag

SEQ ID NO: 1305606 - RNA, 13 nt, Homo sapiens
aaaugaaaagaga

SEQ ID NO: 1305607 - RNA, 20 nt, Homo sapiens
aaaugaaaagagaaugaugc

SEQ ID NO: 1305608 - RNA, 17 nt, Homo sapiens
aaaugaaaaugucuugu

SEQ ID NO: 1305609 - RNA, 23 nt, Homo sapiens
aaaugacuccuaagggacuguga

SEQ ID NO: 1305610 - RNA, 15 nt, Homo sapiens
aaaugacucuacuaa

SEQ ID NO: 1305611 - RNA, 13 nt, Homo sapiens
aaaugacuuucaa

SEQ ID NO: 1305612 - RNA, 18 nt, Homo sapiens
aaaugauacuuacugaac

SEQ ID NO: 1305613 - RNA, 12 nt, Homo sapiens
aaaugcauuuau

SEQ ID NO: 1305614 - RNA, 14 nt, Homo sapiens
aaaugccaagcacu

SEQ ID NO: 1305615 - RNA, 22 nt, Homo sapiens
aaauggaaaaauaaacacuaca

SEQ ID NO: 1305616 - RNA, 13 nt, Homo sapiens
aaauggggccaga

SEQ ID NO: 1305617 - RNA, 15 nt, Homo sapiens
aaauguaaaagcaca

SEQ ID NO: 1305618 - RNA, 18 nt, Homo sapiens
aaauguaaaagcacauga

SEQ ID NO: 1305619 - RNA, 18 nt, Homo sapiens
aaauguaacugugccagu

SEQ ID NO: 1305620 - RNA, 12 nt, Homo sapiens
aaauguaugugc

SEQ ID NO: 1305621 - RNA, 13 nt, Homo sapiens
aaauguaugugcu

SEQ ID NO: 1305622 - RNA, 14 nt, Homo sapiens
aaauguaugugcuc

SEQ ID NO: 1305623 - RNA, 22 nt, Homo sapiens
aaaugucuucaaggcuucaguc

SEQ ID NO: 1305624 - RNA, 18 nt, Homo sapiens
aaaugugcaaccacugcu

SEQ ID NO: 1305625 - RNA, 19 nt, Homo sapiens
aaaugugguuacacacuuu

SEQ ID NO: 1305626 - RNA, 15 nt, Homo sapiens
aaauguguugcccuc

SEQ ID NO: 1305627 - RNA, 20 nt, Homo sapiens
aaauguuaagcugcuggaaa

SEQ ID NO: 1305628 - RNA, 15 nt, Homo sapiens
aaauguuuaagucac

SEQ ID NO: 1305629 - RNA, 14 nt, Homo sapiens
aaauuaauagaauu

SEQ ID NO: 1305630 - RNA, 17 nt, Homo sapiens
aaauuagaaucugagua

SEQ ID NO: 1305631 - RNA, 16 nt, Homo sapiens
aaauucacaaacuuuu

SEQ ID NO: 1305632 - RNA, 17 nt, Homo sapiens
aaauucacaaguugugu

SEQ ID NO: 1305633 - RNA, 17 nt, Homo sapiens
aaauucugaauuugcaa

SEQ ID NO: 1305634 - RNA, 16 nt, Homo sapiens
aaauugccauauugca

SEQ ID NO: 1305635 - RNA, 20 nt, Homo sapiens
aaauugcugcaccaaugcac

SEQ ID NO: 1305636 - RNA, 20 nt, Homo sapiens
aaauugggaaaggaguagaa

SEQ ID NO: 1305637 - RNA, 20 nt, Homo sapiens
aaauuguaagugaaguaaaa

SEQ ID NO: 1305638 - RNA, 12 nt, Homo sapiens
aaauuuacuuuu

SEQ ID NO: 1305639 - RNA, 15 nt, Homo sapiens
aaauuucuucugggc

SEQ ID NO: 1305640 - RNA, 16 nt, Homo sapiens
aaauuugagagacaaa

SEQ ID NO: 1305641 - RNA, 20 nt, Homo sapiens
aaauuuguaaaucuuauucu

SEQ ID NO: 1305642 - RNA, 22 nt, Homo sapiens
aaauuugugguccacugagcua

SEQ ID NO: 1305643 - RNA, 18 nt, Homo sapiens
aaauuuuucuaguauaua

SEQ ID NO: 1305644 - RNA, 20 nt, Homo sapiens
aacaaaaauuaaaauccuca

SEQ ID NO: 1305645 - RNA, 12 nt, Homo sapiens
aacaaaauggac

SEQ ID NO: 1305646 - RNA, 17 nt, Homo sapiens
aacaacaccagaacugu

SEQ ID NO: 1305647 - RNA, 15 nt, Homo sapiens
aacaaccugcucaca

SEQ ID NO: 1305648 - RNA, 16 nt, Homo sapiens
aacaaccugugcccag

SEQ ID NO: 1305649 - RNA, 16 nt, Homo sapiens
aacaagcaagcuccca

SEQ ID NO: 1305650 - RNA, 23 nt, Homo sapiens
aacaagguccucugucagucaca

SEQ ID NO: 1305651 - RNA, 16 nt, Homo sapiens
aacaaugaaauauugc

SEQ ID NO: 1305652 - RNA, 14 nt, Homo sapiens
aacacacugaggca

SEQ ID NO: 1305653 - RNA, 15 nt, Homo sapiens
aacacauaguggcuu

SEQ ID NO: 1305654 - RNA, 14 nt, Homo sapiens
aacaccaagcacag

SEQ ID NO: 1305655 - RNA, 15 nt, Homo sapiens
aacaccacgucacuu

SEQ ID NO: 1305656 - RNA, 15 nt, Homo sapiens
aacaccagaacugug

SEQ ID NO: 1305657 - RNA, 20 nt, Homo sapiens
aacaccaucgaucaugaugu

SEQ ID NO: 1305658 - RNA, 21 nt, Homo sapiens
aacaccugauuaacugaggca

SEQ ID NO: 1305659 - RNA, 23 nt, Homo sapiens
aacacgccugcaaacgcugccug

SEQ ID NO: 1305660 - RNA, 16 nt, Homo sapiens
aacacgcguauuuaca

SEQ ID NO: 1305661 - RNA, 16 nt, Homo sapiens
aacacuagacaagcca

SEQ ID NO: 1305662 - RNA, 17 nt, Homo sapiens
aacacucaacaaacuua

SEQ ID NO: 1305663 - RNA, 12 nt, Homo sapiens
aacacucaugaa

SEQ ID NO: 1305664 - RNA, 15 nt, Homo sapiens
aacacucaugaagca

SEQ ID NO: 1305665 - RNA, 12 nt, Homo sapiens
aacacugggcug

SEQ ID NO: 1305666 - RNA, 11 nt, Homo sapiens
aacacugugaa

SEQ ID NO: 1305667 - RNA, 22 nt, Homo sapiens
aacacuuuacaauguucauccc

SEQ ID NO: 1305668 - RNA, 23 nt, Homo sapiens
aacagaagccugaugcugacauu

SEQ ID NO: 1305669 - RNA, 13 nt, Homo sapiens
aacagcaaaucac

SEQ ID NO: 1305670 - RNA, 14 nt, Homo sapiens
aacagcaugacaaa

SEQ ID NO: 1305671 - RNA, 15 nt, Homo sapiens
aacagccaacuagcc

SEQ ID NO: 1305672 - RNA, 17 nt, Homo sapiens
aacagccuauuccugaa

SEQ ID NO: 1305673 - RNA, 17 nt, Homo sapiens
aacagcuugcugucacu

SEQ ID NO: 1305674 - RNA, 12 nt, Homo sapiens
aacaggcaguug

SEQ ID NO: 1305675 - RNA, 12 nt, Homo sapiens
aacagguguguu

SEQ ID NO: 1305676 - RNA, 11 nt, Homo sapiens
aacaguucaaa

SEQ ID NO: 1305677 - RNA, 18 nt, Homo sapiens
aacauaagaucacugcca

SEQ ID NO: 1305678 - RNA, 23 nt, Homo sapiens
aacauaguauucaugacuaugga

SEQ ID NO: 1305679 - RNA, 18 nt, Homo sapiens
aacauauauauacuauua

SEQ ID NO: 1305680 - RNA, 13 nt, Homo sapiens
aacaucacugggg

SEQ ID NO: 1305681 - RNA, 20 nt, Homo sapiens
aacaucuugaauacucugcc

SEQ ID NO: 1305682 - RNA, 17 nt, Homo sapiens
aacaucuuuuacauucu

SEQ ID NO: 1305683 - RNA, 20 nt, Homo sapiens
aacaugaugugaaaacccau

SEQ ID NO: 1305684 - RNA, 22 nt, Homo sapiens
aacaugguaaacgcugucccua

SEQ ID NO: 1305685 - RNA, 14 nt, Homo sapiens
aacauguaugugca

SEQ ID NO: 1305686 - RNA, 15 nt, Homo sapiens
aacauguaugugcau

SEQ ID NO: 1305687 - RNA, 16 nt, Homo sapiens
aacauguaugugcauu

SEQ ID NO: 1305688 - RNA, 15 nt, Homo sapiens
aacauguccuaauuc

SEQ ID NO: 1305689 - RNA, 21 nt, Homo sapiens
aacauguuuaucguauuugau

SEQ ID NO: 1305690 - RNA, 20 nt, Homo sapiens
aacauuauuuggauaucaaa

SEQ ID NO: 1305691 - RNA, 13 nt, Homo sapiens
aacauucccacug

SEQ ID NO: 1305692 - RNA, 22 nt, Homo sapiens
aacauuguuuuguguaacauau

SEQ ID NO: 1305693 - RNA, 18 nt, Homo sapiens
aacauuucaguugccauu

SEQ ID NO: 1305694 - RNA, 15 nt, Homo sapiens
aaccaaggacugagc

SEQ ID NO: 1305695 - RNA, 16 nt, Homo sapiens
aaccaaggacugagca

SEQ ID NO: 1305696 - RNA, 12 nt, Homo sapiens
aaccaaugcaag

SEQ ID NO: 1305697 - RNA, 12 nt, Homo sapiens
aaccacacugga

SEQ ID NO: 1305698 - RNA, 22 nt, Homo sapiens
aaccacuucagcugacuuuucu

SEQ ID NO: 1305699 - RNA, 21 nt, Homo sapiens
aaccagaacaguaugaauuug

SEQ ID NO: 1305700 - RNA, 19 nt, Homo sapiens
aaccauaugaacauauauu

SEQ ID NO: 1305701 - RNA, 17 nt, Homo sapiens
aaccaucacugguugca

SEQ ID NO: 1305702 - RNA, 14 nt, Homo sapiens
aaccaugguaugaa

SEQ ID NO: 1305703 - RNA, 14 nt, Homo sapiens
aacccaaacucucc

SEQ ID NO: 1305704 - RNA, 12 nt, Homo sapiens
aacccaccagcc

SEQ ID NO: 1305705 - RNA, 15 nt, Homo sapiens
aacccaccagccuaa

SEQ ID NO: 1305706 - RNA, 11 nt, Homo sapiens
aacccacugcu

SEQ ID NO: 1305707 - RNA, 16 nt, Homo sapiens
aacccaggaguggaua

SEQ ID NO: 1305708 - RNA, 19 nt, Homo sapiens
aacccaggaguucaggguc

SEQ ID NO: 1305709 - RNA, 16 nt, Homo sapiens
aaccccaucucuacaa

SEQ ID NO: 1305710 - RNA, 21 nt, Homo sapiens
aaccccuuagcaauaagcacu

SEQ ID NO: 1305711 - RNA, 22 nt, Homo sapiens
aacccuauaugcuuacugugca

SEQ ID NO: 1305712 - RNA, 18 nt, Homo sapiens
aacccucacaagcaugaa

SEQ ID NO: 1305713 - RNA, 16 nt, Homo sapiens
aaccggucacccagga

SEQ ID NO: 1305714 - RNA, 20 nt, Homo sapiens
aaccuaauuuuauccaugga

SEQ ID NO: 1305715 - RNA, 18 nt, Homo sapiens
aaccuauaaaaaggauuc

SEQ ID NO: 1305716 - RNA, 20 nt, Homo sapiens
aaccucaagugauccuccca

SEQ ID NO: 1305717 - RNA, 17 nt, Homo sapiens
aaccucacgcaccuccc

SEQ ID NO: 1305718 - RNA, 21 nt, Homo sapiens
aaccucagccuggccagacac

SEQ ID NO: 1305719 - RNA, 23 nt, Homo sapiens
aaccucagugauuggcucugugg

SEQ ID NO: 1305720 - RNA, 15 nt, Homo sapiens
aaccucauuccccaa

SEQ ID NO: 1305721 - RNA, 14 nt, Homo sapiens
aaccuccagccucc

SEQ ID NO: 1305722 - RNA, 16 nt, Homo sapiens
aaccucccccaggugc

SEQ ID NO: 1305723 - RNA, 13 nt, Homo sapiens
aaccuccuaaaau

SEQ ID NO: 1305724 - RNA, 17 nt, Homo sapiens
aaccucuucuggcucaa

SEQ ID NO: 1305725 - RNA, 20 nt, Homo sapiens
aaccugcaaagaucuguccu

SEQ ID NO: 1305726 - RNA, 20 nt, Homo sapiens
aaccuggguaacuagggaag

SEQ ID NO: 1305727 - RNA, 22 nt, Homo sapiens
aaccuuacuaauuauacuacuu

SEQ ID NO: 1305728 - RNA, 13 nt, Homo sapiens
aaccuuaguuuca

SEQ ID NO: 1305729 - RNA, 20 nt, Homo sapiens
aaccuucuggccucccacag

SEQ ID NO: 1305730 - RNA, 15 nt, Homo sapiens
aacgaguuguuggcu

SEQ ID NO: 1305731 - RNA, 19 nt, Homo sapiens
aacggagagcgccugcccc

SEQ ID NO: 1305732 - RNA, 16 nt, Homo sapiens
aacguauuaguugcca

SEQ ID NO: 1305733 - RNA, 14 nt, Homo sapiens
aacgucaucucagg

SEQ ID NO: 1305734 - RNA, 15 nt, Homo sapiens
aacguccacaugaaa

SEQ ID NO: 1305735 - RNA, 22 nt, Homo sapiens
aacgugcauugugcuucuuucu

SEQ ID NO: 1305736 - RNA, 20 nt, Homo sapiens
aacguuuggaagauccugug

SEQ ID NO: 1305737 - RNA, 16 nt, Homo sapiens
aacuaaacucauuuau

SEQ ID NO: 1305738 - RNA, 22 nt, Homo sapiens
acccuccuuucaccacaugugc

SEQ ID NO: 1305739 - RNA, 18 nt, Homo sapiens
acccucucucugaucucc

SEQ ID NO: 1305740 - RNA, 16 nt, Homo sapiens
acccugaagauuucag

SEQ ID NO: 1305741 - RNA, 14 nt, Homo sapiens
acccugccauggaa

SEQ ID NO: 1305742 - RNA, 16 nt, Homo sapiens
acccugccccuugcca

SEQ ID NO: 1305743 - RNA, 18 nt, Homo sapiens
acccugcugcugcuccuc

SEQ ID NO: 1305744 - RNA, 21 nt, Homo sapiens
acccuggugggccaacaaaga

SEQ ID NO: 1305745 - RNA, 20 nt, Homo sapiens
acccugucucuacuaaaaau

SEQ ID NO: 1305746 - RNA, 14 nt, Homo sapiens
acccuguuaauccc

SEQ ID NO: 1305747 - RNA, 13 nt, Homo sapiens
acccuucccucac

SEQ ID NO: 1305748 - RNA, 22 nt, Homo sapiens
acccuucucgcuuuugccauua

SEQ ID NO: 1305749 - RNA, 14 nt, Homo sapiens
acccuuucauucag

SEQ ID NO: 1305750 - RNA, 19 nt, Homo sapiens
accgagccccugaacugcu

SEQ ID NO: 1305751 - RNA, 14 nt, Homo sapiens
accgaggacaugaa

SEQ ID NO: 1305752 - RNA, 19 nt, Homo sapiens
accggagaaccccaggacg

SEQ ID NO: 1305753 - RNA, 21 nt, Homo sapiens
accgguggggcugguucugua

SEQ ID NO: 1305754 - RNA, 14 nt, Homo sapiens
accguucugugcac

SEQ ID NO: 1305755 - RNA, 16 nt, Homo sapiens
accuacccaugaccug

SEQ ID NO: 1305756 - RNA, 22 nt, Homo sapiens
accuagaagggcaggaguuccu

SEQ ID NO: 1305757 - RNA, 20 nt, Homo sapiens
accuagaauuggcugaacuc

SEQ ID NO: 1305758 - RNA, 18 nt, Homo sapiens
accuauaaucccagcacu

SEQ ID NO: 1305759 - RNA, 22 nt, Homo sapiens
accuauugagggugacagccac

SEQ ID NO: 1305760 - RNA, 15 nt, Homo sapiens
accuauuugacuuac

SEQ ID NO: 1305761 - RNA, 20 nt, Homo sapiens
accucacaggccccaggaaa

SEQ ID NO: 1305762 - RNA, 21 nt, Homo sapiens
accucagaguauggagcucag

SEQ ID NO: 1305763 - RNA, 13 nt, Homo sapiens
accucaugccacc

SEQ ID NO: 1305764 - RNA, 14 nt, Homo sapiens
accuccaagccacu

SEQ ID NO: 1305765 - RNA, 16 nt, Homo sapiens
accuccaagccacuga

SEQ ID NO: 1305766 - RNA, 15 nt, Homo sapiens
accuccacagcuucc

SEQ ID NO: 1305767 - RNA, 19 nt, Homo sapiens
accuccagccuccugccca

SEQ ID NO: 1305768 - RNA, 16 nt, Homo sapiens
accuccuccucuggac

SEQ ID NO: 1305769 - RNA, 16 nt, Homo sapiens
accucgggaauggcaa

SEQ ID NO: 1305770 - RNA, 19 nt, Homo sapiens
accucuaccagcacauuaa

SEQ ID NO: 1305771 - RNA, 15 nt, Homo sapiens
accucugcacaagcu

SEQ ID NO: 1305772 - RNA, 22 nt, Homo sapiens
accucugccugaagucacacag

SEQ ID NO: 1305773 - RNA, 22 nt, Homo sapiens
accucuucuggagauggaagcu

SEQ ID NO: 1305774 - RNA, 10 nt, Homo sapiens
accucuugcg

SEQ ID NO: 1305775 - RNA, 18 nt, Homo sapiens
accugaaaacacugugca

SEQ ID NO: 1305776 - RNA, 20 nt, Homo sapiens
accugaaaacacugugcaca

SEQ ID NO: 1305777 - RNA, 18 nt, Homo sapiens
accugaaauaaaauucau

SEQ ID NO: 1305778 - RNA, 23 nt, Homo sapiens
accugaaguucaccuaucccauu

SEQ ID NO: 1305779 - RNA, 13 nt, Homo sapiens
accugaugcaguc

SEQ ID NO: 1305780 - RNA, 17 nt, Homo sapiens
accugauuaacugaggc

SEQ ID NO: 1305781 - RNA, 17 nt, Homo sapiens
accugccucccauucua

SEQ ID NO: 1305782 - RNA, 18 nt, Homo sapiens
accugcucacaguccuca

SEQ ID NO: 1305783 - RNA, 20 nt, Homo sapiens
accuggucccugcucucagu

SEQ ID NO: 1305784 - RNA, 22 nt, Homo sapiens
accuguaaucccagcuacucga

SEQ ID NO: 1305785 - RNA, 13 nt, Homo sapiens
accuguauuccca

SEQ ID NO: 1305786 - RNA, 16 nt, Homo sapiens
accugucaacauuugg

SEQ ID NO: 1305787 - RNA, 23 nt, Homo sapiens
accuguggccaguacucgggaca

SEQ ID NO: 1305788 - RNA, 12 nt, Homo sapiens
accugugugcug

SEQ ID NO: 1305789 - RNA, 16 nt, Homo sapiens
accuguuagcagacag

SEQ ID NO: 1305790 - RNA, 11 nt, Homo sapiens
accuguugaag

SEQ ID NO: 1305791 - RNA, 18 nt, Homo sapiens
accuguuuccuacagaca

SEQ ID NO: 1305792 - RNA, 21 nt, Homo sapiens
accuguuuuuuuuucauuuau

SEQ ID NO: 1305793 - RNA, 22 nt, Homo sapiens
accuuauuuuacagaagugaaa

SEQ ID NO: 1305794 - RNA, 15 nt, Homo sapiens
accuucagagccagc

SEQ ID NO: 1305795 - RNA, 16 nt, Homo sapiens
accuucaggaaauaua

SEQ ID NO: 1305796 - RNA, 22 nt, Homo sapiens
accuucguuuacuaugccugug

SEQ ID NO: 1305797 - RNA, 19 nt, Homo sapiens
accuugaagaaccucucac

SEQ ID NO: 1305798 - RNA, 17 nt, Homo sapiens
accuugcuuuugcuucu

SEQ ID NO: 1305799 - RNA, 22 nt, Homo sapiens
accuugcuuuugcuucuagagc

SEQ ID NO: 1305800 - RNA, 16 nt, Homo sapiens
accuuggcaccagaca

SEQ ID NO: 1305801 - RNA, 23 nt, Homo sapiens
accuuggcaccagacacccagga

SEQ ID NO: 1305802 - RNA, 13 nt, Homo sapiens
accuuuaccccau

SEQ ID NO: 1305803 - RNA, 21 nt, Homo sapiens
accuuucacgaacaugggcau

SEQ ID NO: 1305804 - RNA, 23 nt, Homo sapiens
accuuucuccuuuguacuuugug

SEQ ID NO: 1305805 - RNA, 20 nt, Homo sapiens
accuuuugggaauguuuuaa

SEQ ID NO: 1305806 - RNA, 18 nt, Homo sapiens
acgaaaguggaaauggag

SEQ ID NO: 1305807 - RNA, 18 nt, Homo sapiens
acgacuggccagggccac

SEQ ID NO: 1305808 - RNA, 13 nt, Homo sapiens
acgaggugcaaca

SEQ ID NO: 1305809 - RNA, 13 nt, Homo sapiens
acgauaaagggau

SEQ ID NO: 1305810 - RNA, 15 nt, Homo sapiens
acgaucuuccuggcu

SEQ ID NO: 1305811 - RNA, 17 nt, Homo sapiens
acgauugguaugaugcu

SEQ ID NO: 1305812 - RNA, 18 nt, Homo sapiens
acgcaccuggguguuaca

SEQ ID NO: 1305813 - RNA, 11 nt, Homo sapiens
acgccacugca

SEQ ID NO: 1305814 - RNA, 20 nt, Homo sapiens
acgccugaaacuuugaggau

SEQ ID NO: 1305815 - RNA, 17 nt, Homo sapiens
acgccuguaaucccagc

SEQ ID NO: 1305816 - RNA, 18 nt, Homo sapiens
acgccuguaaucccagca

SEQ ID NO: 1305817 - RNA, 21 nt, Homo sapiens
acgccuguaaucccagcacuu

SEQ ID NO: 1305818 - RNA, 12 nt, Homo sapiens
acgcgugcacac

SEQ ID NO: 1305819 - RNA, 11 nt, Homo sapiens
acggaagggau

SEQ ID NO: 1305820 - RNA, 19 nt, Homo sapiens
acggaccaugcgacacugg

SEQ ID NO: 1305821 - RNA, 19 nt, Homo sapiens
acggcaaccucugagccau

SEQ ID NO: 1305822 - RNA, 14 nt, Homo sapiens
acggcucacugcag

SEQ ID NO: 1305823 - RNA, 13 nt, Homo sapiens
acggcuuacaugu

SEQ ID NO: 1305824 - RNA, 15 nt, Homo sapiens
acgggagagggcagu

SEQ ID NO: 1305825 - RNA, 19 nt, Homo sapiens
acgguacaaacccaaaaaa

SEQ ID NO: 1305826 - RNA, 16 nt, Homo sapiens
acggucaguccauguc

SEQ ID NO: 1305827 - RNA, 18 nt, Homo sapiens
acggucaguccaugucuc

SEQ ID NO: 1305828 - RNA, 17 nt, Homo sapiens
acguauuaguugccaau

SEQ ID NO: 1305829 - RNA, 22 nt, Homo sapiens
acguauuaguugccaauaugcc

SEQ ID NO: 1305830 - RNA, 13 nt, Homo sapiens
acgucacugauau

SEQ ID NO: 1305831 - RNA, 21 nt, Homo sapiens
acgucacuucaugcaggugaa

SEQ ID NO: 1305832 - RNA, 13 nt, Homo sapiens
acguccuuuggac

SEQ ID NO: 1305833 - RNA, 14 nt, Homo sapiens
acgucugacaggca

SEQ ID NO: 1305834 - RNA, 21 nt, Homo sapiens
acgugacacaaacacacacaa

SEQ ID NO: 1305835 - RNA, 15 nt, Homo sapiens
acgugagaacaauca

SEQ ID NO: 1305836 - RNA, 20 nt, Homo sapiens
acgugauccucucaccucag

SEQ ID NO: 1305837 - RNA, 16 nt, Homo sapiens
aaguucauggaacuca

SEQ ID NO: 1305838 - RNA, 23 nt, Homo sapiens
aaguugccauuauucuauguagu

SEQ ID NO: 1305839 - RNA, 18 nt, Homo sapiens
aaguugcuuuuuugacuc

SEQ ID NO: 1305840 - RNA, 16 nt, Homo sapiens
aaguuuauaugcuucu

SEQ ID NO: 1305841 - RNA, 15 nt, Homo sapiens
aaguuucuuuaccua

SEQ ID NO: 1305842 - RNA, 16 nt, Homo sapiens
aaguuuucagcuuuaa

SEQ ID NO: 1305843 - RNA, 19 nt, Homo sapiens
aaguuuuuaaaaauucccu

SEQ ID NO: 1305844 - RNA, 14 nt, Homo sapiens
aauaaaaaccuucc

SEQ ID NO: 1305845 - RNA, 16 nt, Homo sapiens
aauaaaaagaagagag

SEQ ID NO: 1305846 - RNA, 13 nt, Homo sapiens
aauaaaacaaagg

SEQ ID NO: 1305847 - RNA, 22 nt, Homo sapiens
aauaaaacaccuuguacuuuau

SEQ ID NO: 1305848 - RNA, 13 nt, Homo sapiens
aauaaaacaguau

SEQ ID NO: 1305849 - RNA, 16 nt, Homo sapiens
aauaaaaugagcaaaa

SEQ ID NO: 1305850 - RNA, 15 nt, Homo sapiens
aauaaagaaccaguc

SEQ ID NO: 1305851 - RNA, 15 nt, Homo sapiens
aauaaagaugugcuu

SEQ ID NO: 1305852 - RNA, 14 nt, Homo sapiens
aauaaagcauaaaa

SEQ ID NO: 1305853 - RNA, 11 nt, Homo sapiens
aauaaauggaa

SEQ ID NO: 1305854 - RNA, 12 nt, Homo sapiens
aauaacagagag

SEQ ID NO: 1305855 - RNA, 14 nt, Homo sapiens
aauaagucauugua

SEQ ID NO: 1305856 - RNA, 20 nt, Homo sapiens
aauaauacaguaucucaggg

SEQ ID NO: 1305857 - RNA, 13 nt, Homo sapiens
aauaaucuuauua

SEQ ID NO: 1305858 - RNA, 15 nt, Homo sapiens
aauaaugacauaaaa

SEQ ID NO: 1305859 - RNA, 12 nt, Homo sapiens
aauaaugcagua

SEQ ID NO: 1305860 - RNA, 14 nt, Homo sapiens
aauaauguacaucu

SEQ ID NO: 1305861 - RNA, 13 nt, Homo sapiens
aauacagucuucc

SEQ ID NO: 1305862 - RNA, 20 nt, Homo sapiens
aauaccucaaccuaugguau

SEQ ID NO: 1305863 - RNA, 17 nt, Homo sapiens
aauacggcaaaaccuca

SEQ ID NO: 1305864 - RNA, 23 nt, Homo sapiens
aauacugauacauccauuuugau

SEQ ID NO: 1305865 - RNA, 15 nt, Homo sapiens
aauacuguauuugag

SEQ ID NO: 1305866 - RNA, 20 nt, Homo sapiens
aauacuugcaugaaugauuu

SEQ ID NO: 1305867 - RNA, 17 nt, Homo sapiens
aauacuuuuccuuaccu

SEQ ID NO: 1305868 - RNA, 14 nt, Homo sapiens
aauagaacagagaa

SEQ ID NO: 1305869 - RNA, 19 nt, Homo sapiens
aauagaaggauguacauuu

SEQ ID NO: 1305870 - RNA, 21 nt, Homo sapiens
aauagacuaaccucuaccagc

SEQ ID NO: 1305871 - RNA, 17 nt, Homo sapiens
aauagcaaaacuaaaua

SEQ ID NO: 1305872 - RNA, 15 nt, Homo sapiens
aauagccacauuugg

SEQ ID NO: 1305873 - RNA, 17 nt, Homo sapiens
aauagccacauuuggaa

SEQ ID NO: 1305874 - RNA, 13 nt, Homo sapiens
aauagccacugca

SEQ ID NO: 1305875 - RNA, 17 nt, Homo sapiens
aauagcuuauguacaaa

SEQ ID NO: 1305876 - RNA, 19 nt, Homo sapiens
aauagggaaguaacaguaa

SEQ ID NO: 1305877 - RNA, 19 nt, Homo sapiens
aauaguauuuuauuucuca

SEQ ID NO: 1305878 - RNA, 15 nt, Homo sapiens
aauagucuuugccag

SEQ ID NO: 1305879 - RNA, 15 nt, Homo sapiens
aauauaauacuguau

SEQ ID NO: 1305880 - RNA, 22 nt, Homo sapiens
aauauccagccucccacaagaa

SEQ ID NO: 1305881 - RNA, 14 nt, Homo sapiens
aauaucccguguua

SEQ ID NO: 1305882 - RNA, 15 nt, Homo sapiens
aauaucccguguuac

SEQ ID NO: 1305883 - RNA, 22 nt, Homo sapiens
aauaugaguaauacaucaaaga

SEQ ID NO: 1305884 - RNA, 16 nt, Homo sapiens
aauauuaacauaagaa

SEQ ID NO: 1305885 - RNA, 23 nt, Homo sapiens
aauauuguccauuguccaauccu

SEQ ID NO: 1305886 - RNA, 15 nt, Homo sapiens
aauauuucuuaaaaa

SEQ ID NO: 1305887 - RNA, 18 nt, Homo sapiens
aauauuugaaucuugucu

SEQ ID NO: 1305888 - RNA, 18 nt, Homo sapiens
aauauuuuaagaauuuca

SEQ ID NO: 1305889 - RNA, 13 nt, Homo sapiens
acuuugacuuucu

SEQ ID NO: 1305890 - RNA, 23 nt, Homo sapiens
acuuugacuuucuucugaauauu

SEQ ID NO: 1305891 - RNA, 22 nt, Homo sapiens
acuuugauucugauaaugcuca

SEQ ID NO: 1305892 - RNA, 14 nt, Homo sapiens
acuuugcuccucac

SEQ ID NO: 1305893 - RNA, 14 nt, Homo sapiens
acuuuguguucacc

SEQ ID NO: 1305894 - RNA, 18 nt, Homo sapiens
acuuuguuuaaaccuucc

SEQ ID NO: 1305895 - RNA, 11 nt, Homo sapiens
acuuuuuccag

SEQ ID NO: 1305896 - RNA, 13 nt, Homo sapiens
acuuuuugcagcu

SEQ ID NO: 1305897 - RNA, 21 nt, Homo sapiens
agaaaaaccaaaauacuccaa

SEQ ID NO: 1305898 - RNA, 19 nt, Homo sapiens
agaaaaauuuguauacuaa

SEQ ID NO: 1305899 - RNA, 13 nt, Homo sapiens
agaaaaguauugu

SEQ ID NO: 1305900 - RNA, 22 nt, Homo sapiens
agaaaauguugagaaucccaaa

SEQ ID NO: 1305901 - RNA, 21 nt, Homo sapiens
agaaacaacuucuacuucugc

SEQ ID NO: 1305902 - RNA, 13 nt, Homo sapiens
agaaacagugcaa

SEQ ID NO: 1305903 - RNA, 20 nt, Homo sapiens
agaaaccuuauuguaccucu

SEQ ID NO: 1305904 - RNA, 16 nt, Homo sapiens
agaaagaagacugugu

SEQ ID NO: 1305905 - RNA, 14 nt, Homo sapiens
agaaagaucaaaga

SEQ ID NO: 1305906 - RNA, 13 nt, Homo sapiens
agaaagcauuuga

SEQ ID NO: 1305907 - RNA, 20 nt, Homo sapiens
agaaagccaacauguggcuc

SEQ ID NO: 1305908 - RNA, 14 nt, Homo sapiens
agaaagucucucau

SEQ ID NO: 1305909 - RNA, 15 nt, Homo sapiens
agaaauaaccacugc

SEQ ID NO: 1305910 - RNA, 14 nt, Homo sapiens
agaaauaauaugca

SEQ ID NO: 1305911 - RNA, 23 nt, Homo sapiens
agaaauacaauucuacauuguca

SEQ ID NO: 1305912 - RNA, 14 nt, Homo sapiens
agaaauauggacac

SEQ ID NO: 1305913 - RNA, 13 nt, Homo sapiens
agaaaucacuccu

SEQ ID NO: 1305914 - RNA, 14 nt, Homo sapiens
agaaaucuauucca

SEQ ID NO: 1305915 - RNA, 19 nt, Homo sapiens
agaaaugcugcuggccaaa

SEQ ID NO: 1305916 - RNA, 14 nt, Homo sapiens
agaaauguaauaaa

SEQ ID NO: 1305917 - RNA, 21 nt, Homo sapiens
agaaauuuaaaagcagagcau

SEQ ID NO: 1305918 - RNA, 15 nt, Homo sapiens
agaacaagguaaaaa

SEQ ID NO: 1305919 - RNA, 23 nt, Homo sapiens
agaacggggcucuucucauuuca

SEQ ID NO: 1305920 - RNA, 20 nt, Homo sapiens
agaacguggugaccuuucac

SEQ ID NO: 1305921 - RNA, 21 nt, Homo sapiens
agaacucaaauggggccagau

SEQ ID NO: 1305922 - RNA, 22 nt, Homo sapiens
agaacuggaggaguuccuugau

SEQ ID NO: 1305923 - RNA, 14 nt, Homo sapiens
agaacugugccaca

SEQ ID NO: 1305924 - RNA, 14 nt, Homo sapiens
agaacuugaccccc

SEQ ID NO: 1305925 - RNA, 19 nt, Homo sapiens
agaagacacugaugggcaa

SEQ ID NO: 1305926 - RNA, 20 nt, Homo sapiens
agaagaccuucguauccccu

SEQ ID NO: 1305927 - RNA, 16 nt, Homo sapiens
agaagcauacaacuuu

SEQ ID NO: 1305928 - RNA, 23 nt, Homo sapiens
agaagccucugccucccuagcuu

SEQ ID NO: 1305929 - RNA, 11 nt, Homo sapiens
agaagcuuugu

SEQ ID NO: 1305930 - RNA, 13 nt, Homo sapiens
agaaggaaaaaug

SEQ ID NO: 1305931 - RNA, 20 nt, Homo sapiens
agaaggauguacauuuccaa

SEQ ID NO: 1305932 - RNA, 21 nt, Homo sapiens
agaaggccacuguuugucuca

SEQ ID NO: 1305933 - RNA, 21 nt, Homo sapiens
agaagggaauuuauugccucu

SEQ ID NO: 1305934 - RNA, 23 nt, Homo sapiens
agaagugaaacuauauguauuca

SEQ ID NO: 1305935 - RNA, 23 nt, Homo sapiens
agaaguuacacagaaaugcugcu

SEQ ID NO: 1305936 - RNA, 13 nt, Homo sapiens
agaaguucacauc

SEQ ID NO: 1305937 - RNA, 16 nt, Homo sapiens
agaauauaauacugua

SEQ ID NO: 1305938 - RNA, 17 nt, Homo sapiens
agaaucagaucauuuca

SEQ ID NO: 1305939 - RNA, 22 nt, Homo sapiens
agaauccaucuucagaccuuug

SEQ ID NO: 1305940 - RNA, 21 nt, Homo sapiens
agaaucccggcugucaagggg

SEQ ID NO: 1305941 - RNA, 16 nt, Homo sapiens
agaaucucauuacugc

SEQ ID NO: 1305942 - RNA, 21 nt, Homo sapiens
agaaucuguuucccagcagug

SEQ ID NO: 1305943 - RNA, 22 nt, Homo sapiens
agaaugaaagacugaaucuucc

SEQ ID NO: 1305944 - RNA, 18 nt, Homo sapiens
agaaugaaauguaugugc

SEQ ID NO: 1305945 - RNA, 19 nt, Homo sapiens
agaaugaaauguaugugcu

SEQ ID NO: 1305946 - RNA, 14 nt, Homo sapiens
agaaugaaccacug

SEQ ID NO: 1305947 - RNA, 15 nt, Homo sapiens
agaaugaaccacugc

SEQ ID NO: 1305948 - RNA, 13 nt, Homo sapiens
agaaugcaucuca

SEQ ID NO: 1305949 - RNA, 22 nt, Homo sapiens
agaaugcugcaggacuugagaa

SEQ ID NO: 1305950 - RNA, 20 nt, Homo sapiens
agaauguguuucaaaaccau

SEQ ID NO: 1305951 - RNA, 19 nt, Homo sapiens
agaauguuacugccuuaau

SEQ ID NO: 1305952 - RNA, 21 nt, Homo sapiens
agaauguuccagacauucucg

SEQ ID NO: 1305953 - RNA, 15 nt, Homo sapiens
agaauguugcuuucu

SEQ ID NO: 1305954 - RNA, 16 nt, Homo sapiens
agaauuagaaacaaca

SEQ ID NO: 1305955 - RNA, 22 nt, Homo sapiens
agaauuagaaacaacauagcaa

SEQ ID NO: 1305956 - RNA, 13 nt, Homo sapiens
agaauuagcuuuu

SEQ ID NO: 1305957 - RNA, 21 nt, Homo sapiens
agaauuauaauuaguuccuca

SEQ ID NO: 1305958 - RNA, 16 nt, Homo sapiens
agaauucuuacauguu

SEQ ID NO: 1305959 - RNA, 15 nt, Homo sapiens
agaauuucacaagcu

SEQ ID NO: 1305960 - RNA, 18 nt, Homo sapiens
agaauuugagugcucuga

SEQ ID NO: 1305961 - RNA, 10 nt, Homo sapiens
agaauuugca

SEQ ID NO: 1305962 - RNA, 21 nt, Homo sapiens
agacaaaauauuuuccugcca

SEQ ID NO: 1305963 - RNA, 14 nt, Homo sapiens
agacaaagacucac

SEQ ID NO: 1305964 - RNA, 13 nt, Homo sapiens
agacaaugucugc

SEQ ID NO: 1305965 - RNA, 19 nt, Homo sapiens
agacacccaggacuuauuu

SEQ ID NO: 1305966 - RNA, 15 nt, Homo sapiens
agacacuauuuaucu

SEQ ID NO: 1305967 - RNA, 14 nt, Homo sapiens
agacagccaaaggc

SEQ ID NO: 1305968 - RNA, 15 nt, Homo sapiens
agacagcuucucauc

SEQ ID NO: 1305969 - RNA, 16 nt, Homo sapiens
agacaggacaggugug

SEQ ID NO: 1305970 - RNA, 19 nt, Homo sapiens
agacaggccccgugaggca

SEQ ID NO: 1305971 - RNA, 14 nt, Homo sapiens
agacaucacaagaa

SEQ ID NO: 1305972 - RNA, 21 nt, Homo sapiens
agacaucuuauccauccucac

SEQ ID NO: 1305973 - RNA, 15 nt, Homo sapiens
agacaugagugcgug

SEQ ID NO: 1305974 - RNA, 18 nt, Homo sapiens
agacaugagugcgugcuc

SEQ ID NO: 1305975 - RNA, 16 nt, Homo sapiens
agacauguaucacugu

SEQ ID NO: 1305976 - RNA, 22 nt, Homo sapiens
agacauucucgcuucccugaaa

SEQ ID NO: 1305977 - RNA, 18 nt, Homo sapiens
agacauuggcaccuaauc

SEQ ID NO: 1305978 - RNA, 23 nt, Homo sapiens
agaccagcccaccccugugccca

SEQ ID NO: 1305979 - RNA, 18 nt, Homo sapiens
agacccaaguagcugcua

SEQ ID NO: 1305980 - RNA, 15 nt, Homo sapiens
agacccagaucucau

SEQ ID NO: 1305981 - RNA, 20 nt, Homo sapiens
agacccagcugauugcacua

SEQ ID NO: 1305982 - RNA, 15 nt, Homo sapiens
agacccccagcacuu

SEQ ID NO: 1305983 - RNA, 16 nt, Homo sapiens
agaccucuaguagcug

SEQ ID NO: 1305984 - RNA, 15 nt, Homo sapiens
agaccuuuggacuau

SEQ ID NO: 1305985 - RNA, 22 nt, Homo sapiens
agaccuuuuuuuuuuuuccaau

SEQ ID NO: 1305986 - RNA, 13 nt, Homo sapiens
agacuaccaggag

SEQ ID NO: 1305987 - RNA, 18 nt, Homo sapiens
agacuauucccuucuaac

SEQ ID NO: 1305988 - RNA, 16 nt, Homo sapiens
agacuauucuaaugaa

SEQ ID NO: 1305989 - RNA, 16 nt, Homo sapiens
agacucaaaugcucag

SEQ ID NO: 1305990 - RNA, 15 nt, Homo sapiens
agacuccaguacuau

SEQ ID NO: 1305991 - RNA, 13 nt, Homo sapiens
agacucugucuca

SEQ ID NO: 1305992 - RNA, 14 nt, Homo sapiens
agacugcaucucaa

SEQ ID NO: 1305993 - RNA, 22 nt, Homo sapiens
agacuggcagggacgaggacaa

SEQ ID NO: 1305994 - RNA, 19 nt, Homo sapiens
agacuggcugaaaaaccua

SEQ ID NO: 1305995 - RNA, 20 nt, Homo sapiens
agacugggucucgcuuuguu

SEQ ID NO: 1305996 - RNA, 20 nt, Homo sapiens
agacuggguuacauaugccu

SEQ ID NO: 1305997 - RNA, 21 nt, Homo sapiens
agacuuaauagaaacauugaa

SEQ ID NO: 1305998 - RNA, 16 nt, Homo sapiens
agacuuuaggcuuuca

SEQ ID NO: 1305999 - RNA, 18 nt, Homo sapiens
agacuuucuuaucacuua

SEQ ID NO: 1306000 - RNA, 21 nt, Homo sapiens
agacuuuuguuaugaggagcu

SEQ ID NO: 1306001 - RNA, 13 nt, Homo sapiens
agagaaaacagac

SEQ ID NO: 1306002 - RNA, 16 nt, Homo sapiens
agagaaaguacuucuc

SEQ ID NO: 1306003 - RNA, 22 nt, Homo sapiens
agagaacaaugugcuaugugaa

SEQ ID NO: 1306004 - RNA, 20 nt, Homo sapiens
agagaaccucacgcaccucc

SEQ ID NO: 1306005 - RNA, 13 nt, Homo sapiens
agagaacuggagg

SEQ ID NO: 1306006 - RNA, 14 nt, Homo sapiens
agagaauauuauaa

SEQ ID NO: 1306007 - RNA, 23 nt, Homo sapiens
agagaauauuauaaagugcuuua

SEQ ID NO: 1306008 - RNA, 22 nt, Homo sapiens
agagacagaggaucaagggcuu

SEQ ID NO: 1306009 - RNA, 23 nt, Homo sapiens
agagaccaggcaaagcaagugau

SEQ ID NO: 1306010 - RNA, 16 nt, Homo sapiens
agagaggccuuguccc

SEQ ID NO: 1306011 - RNA, 13 nt, Homo sapiens
agagccucaguga

SEQ ID NO: 1306012 - RNA, 21 nt, Homo sapiens
agagccucgcucuguuaccca

SEQ ID NO: 1306013 - RNA, 22 nt, Homo sapiens
agagcggaaggagggagcucug

SEQ ID NO: 1306014 - RNA, 21 nt, Homo sapiens
agagcuaauuuacuggacaaa

SEQ ID NO: 1306015 - RNA, 16 nt, Homo sapiens
agagcugguggaccca

SEQ ID NO: 1306016 - RNA, 16 nt, Homo sapiens
agaggaaaagguguag

SEQ ID NO: 1306017 - RNA, 21 nt, Homo sapiens
agaggaaaugucacagaagca

SEQ ID NO: 1306018 - RNA, 22 nt, Homo sapiens
agaggaagacaucuguagggaa

SEQ ID NO: 1306019 - RNA, 15 nt, Homo sapiens
agaggaccagugagu

SEQ ID NO: 1306020 - RNA, 13 nt, Homo sapiens
agaggacugugau

SEQ ID NO: 1306021 - RNA, 12 nt, Homo sapiens
agaggagcauga

SEQ ID NO: 1306022 - RNA, 14 nt, Homo sapiens
agaggcuacagggc

SEQ ID NO: 1306023 - RNA, 19 nt, Homo sapiens
agaggcugaggcuggcaca

SEQ ID NO: 1306024 - RNA, 20 nt, Homo sapiens
agaggcugaggcuggcacag

SEQ ID NO: 1306025 - RNA, 20 nt, Homo sapiens
agaggggaacagacuggaag

SEQ ID NO: 1306026 - RNA, 12 nt, Homo sapiens
agaggggacgca

SEQ ID NO: 1306027 - RNA, 14 nt, Homo sapiens
agagguagcacuac

SEQ ID NO: 1306028 - RNA, 18 nt, Homo sapiens
agaguagaauugcauuga

SEQ ID NO: 1306029 - RNA, 19 nt, Homo sapiens
agaguagagggcacugggu

SEQ ID NO: 1306030 - RNA, 20 nt, Homo sapiens
agaguauaugcacuuuccaa

SEQ ID NO: 1306031 - RNA, 20 nt, Homo sapiens
agaguauuggucuccucuca

SEQ ID NO: 1306032 - RNA, 22 nt, Homo sapiens
agaguccuggagcuggcucuau

SEQ ID NO: 1306033 - RNA, 22 nt, Homo sapiens
agagugcaagccccugcuccag

SEQ ID NO: 1306034 - RNA, 18 nt, Homo sapiens
agagugcuauaaaagacu

SEQ ID NO: 1306035 - RNA, 16 nt, Homo sapiens
agagugcuaugaagac

SEQ ID NO: 1306036 - RNA, 13 nt, Homo sapiens
agagugucuuucc

SEQ ID NO: 1306037 - RNA, 15 nt, Homo sapiens
agaguguucccugac

SEQ ID NO: 1306038 - RNA, 14 nt, Homo sapiens
agaguugagcucuc

SEQ ID NO: 1306039 - RNA, 15 nt, Homo sapiens
agauaaauauuuugc

SEQ ID NO: 1306040 - RNA, 14 nt, Homo sapiens
agauaauacauucc

SEQ ID NO: 1306041 - RNA, 14 nt, Homo sapiens
agauacauacagaa

SEQ ID NO: 1306042 - RNA, 19 nt, Homo sapiens
agauaccaaaugaaacacu

SEQ ID NO: 1306043 - RNA, 15 nt, Homo sapiens
agauagagugaaaua

SEQ ID NO: 1306044 - RNA, 16 nt, Homo sapiens
agauagcuucacccca

SEQ ID NO: 1306045 - RNA, 23 nt, Homo sapiens
agauauuuuccauauauuggcac

SEQ ID NO: 1306046 - RNA, 19 nt, Homo sapiens
agaucaaaauccuacagau

SEQ ID NO: 1306047 - RNA, 23 nt, Homo sapiens
agaucaaaauccuacagaugccu

SEQ ID NO: 1306048 - RNA, 12 nt, Homo sapiens
agaucacgccac

SEQ ID NO: 1306049 - RNA, 15 nt, Homo sapiens
agaucaugucucacu

SEQ ID NO: 1306050 - RNA, 19 nt, Homo sapiens
agaucaugucucacuucac

SEQ ID NO: 1306051 - RNA, 19 nt, Homo sapiens
agaucauuucuaggcaaaa

SEQ ID NO: 1306052 - RNA, 15 nt, Homo sapiens
agauccagggacuga

SEQ ID NO: 1306053 - RNA, 17 nt, Homo sapiens
agaucuguccucagccu

SEQ ID NO: 1306054 - RNA, 13 nt, Homo sapiens
agaugaaccacau

SEQ ID NO: 1306055 - RNA, 18 nt, Homo sapiens
agaugaggcuuuccaugg

SEQ ID NO: 1306056 - RNA, 11 nt, Homo sapiens
agaugcaaaua

SEQ ID NO: 1306057 - RNA, 14 nt, Homo sapiens
agaugcagcauuuu

SEQ ID NO: 1306058 - RNA, 14 nt, Homo sapiens
agaugcagggcagu

SEQ ID NO: 1306059 - RNA, 18 nt, Homo sapiens
agaugcagggcagucauu

SEQ ID NO: 1306060 - RNA, 23 nt, Homo sapiens
agaugccccagccugcuuucaca

SEQ ID NO: 1306061 - RNA, 19 nt, Homo sapiens
agaugccugugaaauagua

SEQ ID NO: 1306062 - RNA, 14 nt, Homo sapiens
agaugcuggcccag

SEQ ID NO: 1306063 - RNA, 22 nt, Homo sapiens
agaugggggaaagcacaggugg

SEQ ID NO: 1306064 - RNA, 18 nt, Homo sapiens
agaugguguggguguccu

SEQ ID NO: 1306065 - RNA, 21 nt, Homo sapiens
agauguaauuguuugucuuua

SEQ ID NO: 1306066 - RNA, 21 nt, Homo sapiens
agauguagauaaacucagaaa

SEQ ID NO: 1306067 - RNA, 22 nt, Homo sapiens
agaugucauuuaguucagcauc

SEQ ID NO: 1306068 - RNA, 23 nt, Homo sapiens
agaugucgcccuacucaccugag

SEQ ID NO: 1306069 - RNA, 14 nt, Homo sapiens
agaugucucugcaa

SEQ ID NO: 1306070 - RNA, 19 nt, Homo sapiens
agauguucccccaucucgc

SEQ ID NO: 1306071 - RNA, 23 nt, Homo sapiens
agauuaagagauggguuugacaa

SEQ ID NO: 1306072 - RNA, 14 nt, Homo sapiens
agauucacauacag

SEQ ID NO: 1306073 - RNA, 14 nt, Homo sapiens
agauuccaaaaagc

SEQ ID NO: 1306074 - RNA, 12 nt, Homo sapiens
agauucccacug

SEQ ID NO: 1306075 - RNA, 15 nt, Homo sapiens
agauucccacugccg

SEQ ID NO: 1306076 - RNA, 18 nt, Homo sapiens
agauuccccugugucauc

SEQ ID NO: 1306077 - RNA, 17 nt, Homo sapiens
agauucuucagcuugau

SEQ ID NO: 1306078 - RNA, 14 nt, Homo sapiens
agauugacaacgcc

SEQ ID NO: 1306079 - RNA, 23 nt, Homo sapiens
agauugaucaaaguguaaacacc

SEQ ID NO: 1306080 - RNA, 20 nt, Homo sapiens
agauuggaccagugcucuuc

SEQ ID NO: 1306081 - RNA, 19 nt, Homo sapiens
agauuggcucacacugaga

SEQ ID NO: 1306082 - RNA, 20 nt, Homo sapiens
agauuggcucacacugagaa

SEQ ID NO: 1306083 - RNA, 16 nt, Homo sapiens
agauuguuaaaauaac

SEQ ID NO: 1306084 - RNA, 16 nt, Homo sapiens
agauuucagggagaca

SEQ ID NO: 1306085 - RNA, 18 nt, Homo sapiens
agauuuccaaaagacuug

SEQ ID NO: 1306086 - RNA, 16 nt, Homo sapiens
agauuuggagcugucu

SEQ ID NO: 1306087 - RNA, 23 nt, Homo sapiens
agauuuguuuuucucuuuucaca

SEQ ID NO: 1306088 - RNA, 21 nt, Homo sapiens
agcaaaaacauguaugugcau

SEQ ID NO: 1306089 - RNA, 12 nt, Homo sapiens
agcaaacccaga

SEQ ID NO: 1306090 - RNA, 23 nt, Homo sapiens
agcaaaggcugagaacacuguga

SEQ ID NO: 1306091 - RNA, 17 nt, Homo sapiens
agcaacaaaaauuacuc

SEQ ID NO: 1306092 - RNA, 17 nt, Homo sapiens
agcaacaggaaucucag

SEQ ID NO: 1306093 - RNA, 13 nt, Homo sapiens
agcaacuugaugg

SEQ ID NO: 1306094 - RNA, 16 nt, Homo sapiens
agcaacuuguguuaca

SEQ ID NO: 1306095 - RNA, 23 nt, Homo sapiens
agcaacuuguguuacaaaaauac

SEQ ID NO: 1306096 - RNA, 18 nt, Homo sapiens
agcaagacucugucucaa

SEQ ID NO: 1306097 - RNA, 18 nt, Homo sapiens
agcaagaucccaucucuu

SEQ ID NO: 1306098 - RNA, 22 nt, Homo sapiens
agcaaguguucacaacagugaa

SEQ ID NO: 1306099 - RNA, 15 nt, Homo sapiens
agcaauaaaaugcua

SEQ ID NO: 1306100 - RNA, 15 nt, Homo sapiens
agcaauaacauuccc

SEQ ID NO: 1306101 - RNA, 13 nt, Homo sapiens
agcaauguauaac

SEQ ID NO: 1306102 - RNA, 20 nt, Homo sapiens
agcacaaggccaucugggcu

SEQ ID NO: 1306103 - RNA, 20 nt, Homo sapiens
agcacacuuggcccaagugg

SEQ ID NO: 1306104 - RNA, 11 nt, Homo sapiens
agcacagccaa

SEQ ID NO: 1306105 - RNA, 18 nt, Homo sapiens
agcaccguucugugcaca

SEQ ID NO: 1306106 - RNA, 21 nt, Homo sapiens
agcaccguucugugcacaaaa

SEQ ID NO: 1306107 - RNA, 19 nt, Homo sapiens
agcacuaaggugugcucug

SEQ ID NO: 1306108 - RNA, 23 nt, Homo sapiens
agcacuaaggugugcucugauca

SEQ ID NO: 1306109 - RNA, 15 nt, Homo sapiens
agcacugcguacaaa

SEQ ID NO: 1306110 - RNA, 20 nt, Homo sapiens
agcagaacagaucuuuuacu

SEQ ID NO: 1306111 - RNA, 15 nt, Homo sapiens
agcagagacuuuagu

SEQ ID NO: 1306112 - RNA, 16 nt, Homo sapiens
agcagccaagggauga

SEQ ID NO: 1306113 - RNA, 13 nt, Homo sapiens
agcagccacgagg

SEQ ID NO: 1306114 - RNA, 22 nt, Homo sapiens
agcagcccuacaacaaccugaa

SEQ ID NO: 1306115 - RNA, 15 nt, Homo sapiens
agcagcuccuguggc

SEQ ID NO: 1306116 - RNA, 12 nt, Homo sapiens
agcagcugcuac

SEQ ID NO: 1306117 - RNA, 16 nt, Homo sapiens
agcagcugguaaucuu

SEQ ID NO: 1306118 - RNA, 12 nt, Homo sapiens
agcagcuuugua

SEQ ID NO: 1306119 - RNA, 15 nt, Homo sapiens
agcaggaaaccugug

SEQ ID NO: 1306120 - RNA, 22 nt, Homo sapiens
agcaggaccucugaaacccugg

SEQ ID NO: 1306121 - RNA, 17 nt, Homo sapiens
agcaggcacccacuucc

SEQ ID NO: 1306122 - RNA, 21 nt, Homo sapiens
agcaggcggugggcacccacc

SEQ ID NO: 1306123 - RNA, 15 nt, Homo sapiens
agcaggcuacacuga

SEQ ID NO: 1306124 - RNA, 16 nt, Homo sapiens
agcaggcuacacugac

SEQ ID NO: 1306125 - RNA, 19 nt, Homo sapiens
agcagguuaccacucuggc

SEQ ID NO: 1306126 - RNA, 20 nt, Homo sapiens
agcagguucccaagcucaga

SEQ ID NO: 1306127 - RNA, 21 nt, Homo sapiens
agcaguggacucaaaacccau

SEQ ID NO: 1306128 - RNA, 12 nt, Homo sapiens
agcauacuuugu

SEQ ID NO: 1306129 - RNA, 19 nt, Homo sapiens
agcaucccuugaccaggcc

SEQ ID NO: 1306130 - RNA, 17 nt, Homo sapiens
agcaucuuagugccuuu

SEQ ID NO: 1306131 - RNA, 14 nt, Homo sapiens
agcaugaaagugga

SEQ ID NO: 1306132 - RNA, 21 nt, Homo sapiens
agcaugcugugauugugccua

SEQ ID NO: 1306133 - RNA, 11 nt, Homo sapiens
agcauggagcu

SEQ ID NO: 1306134 - RNA, 15 nt, Homo sapiens
agcauguugugaugu

SEQ ID NO: 1306135 - RNA, 17 nt, Homo sapiens
agcauugggcugggcuc

SEQ ID NO: 1306136 - RNA, 17 nt, Homo sapiens
agcauuuccacaccaag

SEQ ID NO: 1306137 - RNA, 12 nt, Homo sapiens
agccaaagccaa

SEQ ID NO: 1306138 - RNA, 24 nt, Homo sapiens
agccaaagccaauaacacacagcu

SEQ ID NO: 1306139 - RNA, 22 nt, Homo sapiens
agccaaagggacuggcagucug

SEQ ID NO: 1306140 - RNA, 22 nt, Homo sapiens
agccaaggauagaagcugcagu

SEQ ID NO: 1306141 - RNA, 19 nt, Homo sapiens
agccaaggcagcgacccca

SEQ ID NO: 1306142 - RNA, 15 nt, Homo sapiens
agccacaacugcagu

SEQ ID NO: 1306143 - RNA, 19 nt, Homo sapiens
agccacaagccugaauuuc

SEQ ID NO: 1306144 - RNA, 21 nt, Homo sapiens
agccacaggccugagauuuca

SEQ ID NO: 1306145 - RNA, 20 nt, Homo sapiens
caacuugaauaauacaccag

SEQ ID NO: 1306146 - RNA, 14 nt, Homo sapiens
caacuuugaauaaa

SEQ ID NO: 1306147 - RNA, 19 nt, Homo sapiens
caagaaaaguugaagaaga

SEQ ID NO: 1306148 - RNA, 12 nt, Homo sapiens
caagaaauuacu

SEQ ID NO: 1306149 - RNA, 18 nt, Homo sapiens
caagaacaugaugggccu

SEQ ID NO: 1306150 - RNA, 12 nt, Homo sapiens
caagaacuugga

SEQ ID NO: 1306151 - RNA, 21 nt, Homo sapiens
caagaagcacugacaauguuu

SEQ ID NO: 1306152 - RNA, 20 nt, Homo sapiens
caagaagggaguuccaguca

SEQ ID NO: 1306153 - RNA, 17 nt, Homo sapiens
caagacccccagcacuu

SEQ ID NO: 1306154 - RNA, 22 nt, Homo sapiens
caagaccugauuucugagcauu

SEQ ID NO: 1306155 - RNA, 21 nt, Homo sapiens
caagacucuggggaugggaau

SEQ ID NO: 1306156 - RNA, 20 nt, Homo sapiens
caagagaacauuuuacuguu

SEQ ID NO: 1306157 - RNA, 16 nt, Homo sapiens
caagagagcuuaacag

SEQ ID NO: 1306158 - RNA, 14 nt, Homo sapiens
caagagcacacuug

SEQ ID NO: 1306159 - RNA, 16 nt, Homo sapiens
caagagccauguagaa

SEQ ID NO: 1306160 - RNA, 20 nt, Homo sapiens
caagaugacacaacugcacu

SEQ ID NO: 1306161 - RNA, 12 nt, Homo sapiens
caagaugacagc

SEQ ID NO: 1306162 - RNA, 19 nt, Homo sapiens
caagaugaguuggacccau

SEQ ID NO: 1306163 - RNA, 13 nt, Homo sapiens
caagaugccugau

SEQ ID NO: 1306164 - RNA, 14 nt, Homo sapiens
caagcaagacugag

SEQ ID NO: 1306165 - RNA, 13 nt, Homo sapiens
caagcacaaagcu

SEQ ID NO: 1306166 - RNA, 17 nt, Homo sapiens
caagcacaaagcucaag

SEQ ID NO: 1306167 - RNA, 20 nt, Homo sapiens
caagcaggaaccccaggaga

SEQ ID NO: 1306168 - RNA, 14 nt, Homo sapiens
caagcaguagacaa

SEQ ID NO: 1306169 - RNA, 23 nt, Homo sapiens
caagcaguuaguuccuucaugau

SEQ ID NO: 1306170 - RNA, 14 nt, Homo sapiens
caagccauuccaaa

SEQ ID NO: 1306171 - RNA, 17 nt, Homo sapiens
caagcccccccuuccac

SEQ ID NO: 1306172 - RNA, 17 nt, Homo sapiens
caagcccuguugacaca

SEQ ID NO: 1306173 - RNA, 15 nt, Homo sapiens
caagcucccaaggga

SEQ ID NO: 1306174 - RNA, 22 nt, Homo sapiens
caagcuccuccucccugcaucu

SEQ ID NO: 1306175 - RNA, 13 nt, Homo sapiens
caagcuuccauag

SEQ ID NO: 1306176 - RNA, 19 nt, Homo sapiens
caaggaaacgcuaccucuc

SEQ ID NO: 1306177 - RNA, 13 nt, Homo sapiens
caaggacacagau

SEQ ID NO: 1306178 - RNA, 15 nt, Homo sapiens
caaggacacagauga

SEQ ID NO: 1306179 - RNA, 16 nt, Homo sapiens
caaggaggccacguga

SEQ ID NO: 1306180 - RNA, 18 nt, Homo sapiens
caaggagggugagugcaa

SEQ ID NO: 1306181 - RNA, 21 nt, Homo sapiens
caaggcaaagacuauucccuu

SEQ ID NO: 1306182 - RNA, 14 nt, Homo sapiens
caaggccuugccug

SEQ ID NO: 1306183 - RNA, 15 nt, Homo sapiens
caaggcugcagugag

SEQ ID NO: 1306184 - RNA, 18 nt, Homo sapiens
caagguccucugucaguc

SEQ ID NO: 1306185 - RNA, 21 nt, Homo sapiens
caagguucuucccuuuuacau

SEQ ID NO: 1306186 - RNA, 17 nt, Homo sapiens
caaguacuguaacugug

SEQ ID NO: 1306187 - RNA, 18 nt, Homo sapiens
caagucaagugaaaaagg

SEQ ID NO: 1306188 - RNA, 17 nt, Homo sapiens
caagucuguuuacugca

SEQ ID NO: 1306189 - RNA, 15 nt, Homo sapiens
caagugccuuagcaa

SEQ ID NO: 1306190 - RNA, 18 nt, Homo sapiens
caagugcggcacugcaaa

SEQ ID NO: 1306191 - RNA, 21 nt, Homo sapiens
caagugugggccacuguggug

SEQ ID NO: 1306192 - RNA, 14 nt, Homo sapiens
caagugugucuuac

SEQ ID NO: 1306193 - RNA, 13 nt, Homo sapiens
caaguguucacaa

SEQ ID NO: 1306194 - RNA, 14 nt, Homo sapiens
caaguucaauccua

SEQ ID NO: 1306195 - RNA, 17 nt, Homo sapiens
caaguuguguuugauau

SEQ ID NO: 1306196 - RNA, 17 nt, Homo sapiens
caauaaagcacugagca

SEQ ID NO: 1306197 - RNA, 18 nt, Homo sapiens
caauaaagcacugagcaa

SEQ ID NO: 1306198 - RNA, 13 nt, Homo sapiens
caauaaagccuuc

SEQ ID NO: 1306199 - RNA, 18 nt, Homo sapiens
caauaacacacagcuaac

SEQ ID NO: 1306200 - RNA, 14 nt, Homo sapiens
caauagaacagaga

SEQ ID NO: 1306201 - RNA, 14 nt, Homo sapiens
caauagcaccccua

SEQ ID NO: 1306202 - RNA, 19 nt, Homo sapiens
caauaguaauucucaggcc

SEQ ID NO: 1306203 - RNA, 12 nt, Homo sapiens
caauaugcauuu

SEQ ID NO: 1306204 - RNA, 15 nt, Homo sapiens
caauaugccagcuug

SEQ ID NO: 1306205 - RNA, 23 nt, Homo sapiens
caauauguuuaucaacucaagaa

SEQ ID NO: 1306206 - RNA, 21 nt, Homo sapiens
caauauuccuuauuaauacaa

SEQ ID NO: 1306207 - RNA, 17 nt, Homo sapiens
caauauugguguacugu

SEQ ID NO: 1306208 - RNA, 18 nt, Homo sapiens
caauauugguguacugua

SEQ ID NO: 1306209 - RNA, 19 nt, Homo sapiens
caauauugguguacuguaa

SEQ ID NO: 1306210 - RNA, 17 nt, Homo sapiens
caaucagccacauucua

SEQ ID NO: 1306211 - RNA, 19 nt, Homo sapiens
caaucauguucuggugguu

SEQ ID NO: 1306212 - RNA, 17 nt, Homo sapiens
caauccaauuaaucaaa

SEQ ID NO: 1306213 - RNA, 20 nt, Homo sapiens
caaucccacguacuuauaaa

SEQ ID NO: 1306214 - RNA, 21 nt, Homo sapiens
caauccuagcccucauuuuaa

SEQ ID NO: 1306215 - RNA, 23 nt, Homo sapiens
caaugaagaauauaccauuucaa

SEQ ID NO: 1306216 - RNA, 19 nt, Homo sapiens
caaugagggagcauguacc

SEQ ID NO: 1306217 - RNA, 15 nt, Homo sapiens
caaugcagcauguug

SEQ ID NO: 1306218 - RNA, 21 nt, Homo sapiens
caaugcaugcccaccuguuga

SEQ ID NO: 1306219 - RNA, 23 nt, Homo sapiens
caaugccaaaaaaagacagggcu

SEQ ID NO: 1306220 - RNA, 13 nt, Homo sapiens
caauggaauguga

SEQ ID NO: 1306221 - RNA, 18 nt, Homo sapiens
caauggcccgacauuucu

SEQ ID NO: 1306222 - RNA, 17 nt, Homo sapiens
caaugggaaguaaagag

SEQ ID NO: 1306223 - RNA, 18 nt, Homo sapiens
caaugggaggcagggaca

SEQ ID NO: 1306224 - RNA, 23 nt, Homo sapiens
caauguaagagccuaacuccauc

SEQ ID NO: 1306225 - RNA, 20 nt, Homo sapiens
caauguauaaccccaaagaa

SEQ ID NO: 1306226 - RNA, 14 nt, Homo sapiens
caauguuagccaca

SEQ ID NO: 1306227 - RNA, 21 nt, Homo sapiens
caauguuucuguuucuuaaau

SEQ ID NO: 1306228 - RNA, 15 nt, Homo sapiens
caauuaauguagcug

SEQ ID NO: 1306229 - RNA, 20 nt, Homo sapiens
caauuagacaagaacuugga

SEQ ID NO: 1306230 - RNA, 18 nt, Homo sapiens
caauucaaauugacugaa

SEQ ID NO: 1306231 - RNA, 22 nt, Homo sapiens
caauucauauauuugaagugga

SEQ ID NO: 1306232 - RNA, 22 nt, Homo sapiens
caauucuaucuuuuguuuccuu

SEQ ID NO: 1306233 - RNA, 14 nt, Homo sapiens
caauugacaacagu

SEQ ID NO: 1306234 - RNA, 17 nt, Homo sapiens
caauuuuaaaucugaga

SEQ ID NO: 1306235 - RNA, 16 nt, Homo sapiens
cacaaagaccaaaaug

SEQ ID NO: 1306236 - RNA, 15 nt, Homo sapiens
cacaacacaguucuc

SEQ ID NO: 1306237 - RNA, 14 nt, Homo sapiens
cacaacagugaaaa

SEQ ID NO: 1306238 - RNA, 13 nt, Homo sapiens
cacaacugcaguc

SEQ ID NO: 1306239 - RNA, 13 nt, Homo sapiens
cacaagagcugga

SEQ ID NO: 1306240 - RNA, 13 nt, Homo sapiens
cacaagcacaaag

SEQ ID NO: 1306241 - RNA, 19 nt, Homo sapiens
cacaagccugaauuucuca

SEQ ID NO: 1306242 - RNA, 22 nt, Homo sapiens
cacaagcuugucaaugauuuca

SEQ ID NO: 1306243 - RNA, 19 nt, Homo sapiens
cacaaggucuuuaaaguga

SEQ ID NO: 1306244 - RNA, 18 nt, Homo sapiens
cacacaaaaaaugcacaa

SEQ ID NO: 1306245 - RNA, 12 nt, Homo sapiens
cacacacugugu

SEQ ID NO: 1306246 - RNA, 16 nt, Homo sapiens
cacacagaggggaguc

SEQ ID NO: 1306247 - RNA, 16 nt, Homo sapiens
cacacagccaauccaa

SEQ ID NO: 1306248 - RNA, 15 nt, Homo sapiens
cacaccaggucuucc

SEQ ID NO: 1306249 - RNA, 14 nt, Homo sapiens
cacacccaauucca

SEQ ID NO: 1306250 - RNA, 20 nt, Homo sapiens
cacacccuggaggauuucau

SEQ ID NO: 1306251 - RNA, 17 nt, Homo sapiens
cacaccuuuuauugaca

SEQ ID NO: 1306252 - RNA, 16 nt, Homo sapiens
cacacgcgugcacaca

SEQ ID NO: 1306253 - RNA, 12 nt, Homo sapiens
cacacuuugcca

SEQ ID NO: 1306254 - RNA, 16 nt, Homo sapiens
cacagaagcacaugca

SEQ ID NO: 1306255 - RNA, 19 nt, Homo sapiens
cacagaauucauucacuca

SEQ ID NO: 1306256 - RNA, 14 nt, Homo sapiens
cacagagugcauug

SEQ ID NO: 1306257 - RNA, 23 nt, Homo sapiens
cacagagugcauugugaggguua

SEQ ID NO: 1306258 - RNA, 13 nt, Homo sapiens
cacagaugcucca

SEQ ID NO: 1306259 - RNA, 16 nt, Homo sapiens
cacagcugaacuuguu

SEQ ID NO: 1306260 - RNA, 22 nt, Homo sapiens
cacaggaaucgguggucuccac

SEQ ID NO: 1306261 - RNA, 15 nt, Homo sapiens
cacagggacugaaaa

SEQ ID NO: 1306262 - RNA, 23 nt, Homo sapiens
cacaguauuacuucugcuacaua

SEQ ID NO: 1306263 - RNA, 14 nt, Homo sapiens
cacagucaugugcc

SEQ ID NO: 1306264 - RNA, 12 nt, Homo sapiens
cacaguccucau

SEQ ID NO: 1306265 - RNA, 16 nt, Homo sapiens
cacaguuaucaaaaag

SEQ ID NO: 1306266 - RNA, 22 nt, Homo sapiens
cacaguugcucuaugcuuucca

SEQ ID NO: 1306267 - RNA, 12 nt, Homo sapiens
cacauagugaaa

SEQ ID NO: 1306268 - RNA, 13 nt, Homo sapiens
cacaucugcauuu

SEQ ID NO: 1306269 - RNA, 22 nt, Homo sapiens
cacaucuuuuaagacaaauuca

SEQ ID NO: 1306270 - RNA, 12 nt, Homo sapiens
cacaugccaagc

SEQ ID NO: 1306271 - RNA, 13 nt, Homo sapiens
cacaugcccauga

SEQ ID NO: 1306272 - RNA, 16 nt, Homo sapiens
cacaugcccaugauga

SEQ ID NO: 1306273 - RNA, 14 nt, Homo sapiens
cacaugugcacaug

SEQ ID NO: 1306274 - RNA, 16 nt, Homo sapiens
cacaugugcacaugca

SEQ ID NO: 1306275 - RNA, 22 nt, Homo sapiens
cacauuacaugaaaguucagau

SEQ ID NO: 1306276 - RNA, 15 nt, Homo sapiens
cacauugcacuucug

SEQ ID NO: 1306277 - RNA, 19 nt, Homo sapiens
cacauuggaacagugaauc

SEQ ID NO: 1306278 - RNA, 19 nt, Homo sapiens
cacauuuauucugcucaca

SEQ ID NO: 1306279 - RNA, 15 nt, Homo sapiens
caccaaguaccagua

SEQ ID NO: 1306280 - RNA, 18 nt, Homo sapiens
guuagcuaaaggaucuua

SEQ ID NO: 1306281 - RNA, 23 nt, Homo sapiens
guuaggaaaauuucacauuaaua

SEQ ID NO: 1306282 - RNA, 13 nt, Homo sapiens
guuaggaguuaau

SEQ ID NO: 1306283 - RNA, 20 nt, Homo sapiens
guuaggcauuuccugcugaa

SEQ ID NO: 1306284 - RNA, 17 nt, Homo sapiens
guuauaucauauguaua

SEQ ID NO: 1306285 - RNA, 18 nt, Homo sapiens
guuaucaaaaaguauuau

SEQ ID NO: 1306286 - RNA, 18 nt, Homo sapiens
guuauucuaguacuagaa

SEQ ID NO: 1306287 - RNA, 14 nt, Homo sapiens
guuauugccucuac

SEQ ID NO: 1306288 - RNA, 14 nt, Homo sapiens
guucaaagacugug

SEQ ID NO: 1306289 - RNA, 16 nt, Homo sapiens
guucaacaucuaaaaa

SEQ ID NO: 1306290 - RNA, 20 nt, Homo sapiens
guucaacuuggugacacucu

SEQ ID NO: 1306291 - RNA, 20 nt, Homo sapiens
guucaauaaagcacugagca

SEQ ID NO: 1306292 - RNA, 19 nt, Homo sapiens
guucacaguguuucuuauu

SEQ ID NO: 1306293 - RNA, 16 nt, Homo sapiens
guucacauagugaaau

SEQ ID NO: 1306294 - RNA, 21 nt, Homo sapiens
guucagaaucacuucugagaa

SEQ ID NO: 1306295 - RNA, 20 nt, Homo sapiens
guucagugagguucuugggu

SEQ ID NO: 1306296 - RNA, 18 nt, Homo sapiens
guuccacuuguuugcacu

SEQ ID NO: 1306297 - RNA, 13 nt, Homo sapiens
guuccaguggcuu

SEQ ID NO: 1306298 - RNA, 20 nt, Homo sapiens
guuccccacugacagccucc

SEQ ID NO: 1306299 - RNA, 23 nt, Homo sapiens
guuccccagccccuuggauguga

SEQ ID NO: 1306300 - RNA, 18 nt, Homo sapiens
guucgcgcaccagguguc

SEQ ID NO: 1306301 - RNA, 16 nt, Homo sapiens
guucuaacauguaauu

SEQ ID NO: 1306302 - RNA, 17 nt, Homo sapiens
guucucauuccuguucu

SEQ ID NO: 1306303 - RNA, 12 nt, Homo sapiens
guucuccagugu

SEQ ID NO: 1306304 - RNA, 17 nt, Homo sapiens
guucugagauucaauau

SEQ ID NO: 1306305 - RNA, 21 nt, Homo sapiens
guucuggacggcccagcagcu

SEQ ID NO: 1306306 - RNA, 17 nt, Homo sapiens
guucuguacaaaguacu

SEQ ID NO: 1306307 - RNA, 12 nt, Homo sapiens
guucugucauau

SEQ ID NO: 1306308 - RNA, 15 nt, Homo sapiens
guucugucuucccaa

SEQ ID NO: 1306309 - RNA, 20 nt, Homo sapiens
guucugugauacagaacucu

SEQ ID NO: 1306310 - RNA, 12 nt, Homo sapiens
guucugugcaca

SEQ ID NO: 1306311 - RNA, 23 nt, Homo sapiens
guucuucccuuuuacauacugcu

SEQ ID NO: 1306312 - RNA, 22 nt, Homo sapiens
guucuuuaaaauguaaagccau

SEQ ID NO: 1306313 - RNA, 21 nt, Homo sapiens
guucuuucuuacacaagagcu

SEQ ID NO: 1306314 - RNA, 15 nt, Homo sapiens
guucuuuugacugaa

SEQ ID NO: 1306315 - RNA, 17 nt, Homo sapiens
guugauuacagugcagu

SEQ ID NO: 1306316 - RNA, 19 nt, Homo sapiens
guugcacacccacucagcu

SEQ ID NO: 1306317 - RNA, 18 nt, Homo sapiens
guugcaccguucucugua

SEQ ID NO: 1306318 - RNA, 19 nt, Homo sapiens
guugcaggaccucagguga

SEQ ID NO: 1306319 - RNA, 15 nt, Homo sapiens
guugccaauaugcca

SEQ ID NO: 1306320 - RNA, 16 nt, Homo sapiens
guugcuauaauaaaga

SEQ ID NO: 1306321 - RNA, 15 nt, Homo sapiens
guuggaaaugugcaa

SEQ ID NO: 1306322 - RNA, 22 nt, Homo sapiens
guuggaacuaugcagugugcuc

SEQ ID NO: 1306323 - RNA, 20 nt, Homo sapiens
guuggauccguuugaccaau

SEQ ID NO: 1306324 - RNA, 18 nt, Homo sapiens
guuggcugggaacucacc

SEQ ID NO: 1306325 - RNA, 20 nt, Homo sapiens
guuggugaauuucacaagcu

SEQ ID NO: 1306326 - RNA, 16 nt, Homo sapiens
guugguuccuuuccaa

SEQ ID NO: 1306327 - RNA, 23 nt, Homo sapiens
guuguaaaaagcccagcacuuga

SEQ ID NO: 1306328 - RNA, 15 nt, Homo sapiens
guuguacaugaaauu

SEQ ID NO: 1306329 - RNA, 18 nt, Homo sapiens
guuuaaaccuuccauaaa

SEQ ID NO: 1306330 - RNA, 23 nt, Homo sapiens
guuuaauaaacacugacauuucc

SEQ ID NO: 1306331 - RNA, 22 nt, Homo sapiens
guuuacaagcccccccuuccac

SEQ ID NO: 1306332 - RNA, 18 nt, Homo sapiens
guuuagcccaaaaccaag

SEQ ID NO: 1306333 - RNA, 15 nt, Homo sapiens
guuucaaaaccaugc

SEQ ID NO: 1306334 - RNA, 18 nt, Homo sapiens
guuucagcagagcugaaa

SEQ ID NO: 1306335 - RNA, 16 nt, Homo sapiens
guuuccuggcacugga

SEQ ID NO: 1306336 - RNA, 21 nt, Homo sapiens
guuucuccagagggaauugca

SEQ ID NO: 1306337 - RNA, 17 nt, Homo sapiens
guuucugguggucuguu

SEQ ID NO: 1306338 - RNA, 20 nt, Homo sapiens
guuugagaagaaaacaucua

SEQ ID NO: 1306339 - RNA, 10 nt, Homo sapiens
guuugcacug

SEQ ID NO: 1306340 - RNA, 22 nt, Homo sapiens
guuugcgggggucugagucuau

SEQ ID NO: 1306341 - RNA, 23 nt, Homo sapiens
guuugcugccacacugucucauc

SEQ ID NO: 1306342 - RNA, 19 nt, Homo sapiens
guuugucucaccuacccau

SEQ ID NO: 1306343 - RNA, 18 nt, Homo sapiens
guuuuaaagcuugcucac

SEQ ID NO: 1306344 - RNA, 21 nt, Homo sapiens
guuuuaacucuaucugucaua

SEQ ID NO: 1306345 - RNA, 18 nt, Homo sapiens
guuuuacaaugucauaua

SEQ ID NO: 1306346 - RNA, 20 nt, Homo sapiens
guuuuacauuguugagcuau

SEQ ID NO: 1306347 - RNA, 15 nt, Homo sapiens
guuuuauauguugcu

SEQ ID NO: 1306348 - RNA, 16 nt, Homo sapiens
guuuuauauguugcua

SEQ ID NO: 1306349 - RNA, 11 nt, Homo sapiens
guuuuccugug

SEQ ID NO: 1306350 - RNA, 20 nt, Homo sapiens
guuuugaaggcaaaauugca

SEQ ID NO: 1306351 - RNA, 23 nt, Homo sapiens
guuuugaaggcaaaauugcaaau

SEQ ID NO: 1306352 - RNA, 13 nt, Homo sapiens
guuuugagacaaa

SEQ ID NO: 1306353 - RNA, 23 nt, Homo sapiens
guuuuguagagauggggucucac

SEQ ID NO: 1306354 - RNA, 17 nt, Homo sapiens
guuuuguguaacauauu

SEQ ID NO: 1306355 - RNA, 15 nt, Homo sapiens
guuuuuaagcuguuu

SEQ ID NO: 1306356 - RNA, 22 nt, Homo sapiens
uaaaaaaaacaaaaagaacaaa

SEQ ID NO: 1306357 - RNA, 18 nt, Homo sapiens
uaaaaaaauuccaaguga

SEQ ID NO: 1306358 - RNA, 13 nt, Homo sapiens
uaaaaacaaacag

SEQ ID NO: 1306359 - RNA, 19 nt, Homo sapiens
uaaaaacaaacagaacaaa

SEQ ID NO: 1306360 - RNA, 20 nt, Homo sapiens
uggaaugggcagcucaucuc

SEQ ID NO: 1306361 - RNA, 21 nt, Homo sapiens
uggaaugggcagcucaucucu

SEQ ID NO: 1306362 - RNA, 15 nt, Homo sapiens
uggaauuuguucaag

SEQ ID NO: 1306363 - RNA, 17 nt, Homo sapiens
uggacaaggagugugac

SEQ ID NO: 1306364 - RNA, 20 nt, Homo sapiens
uggacaaggagugugaccac

SEQ ID NO: 1306365 - RNA, 12 nt, Homo sapiens
uggacacagcuc

SEQ ID NO: 1306366 - RNA, 22 nt, Homo sapiens
uggacagugaggucacagucca

SEQ ID NO: 1306367 - RNA, 17 nt, Homo sapiens
uggacaugcgugaccag

SEQ ID NO: 1306368 - RNA, 22 nt, Homo sapiens
uggacaugcuucagugcugcuc

SEQ ID NO: 1306369 - RNA, 19 nt, Homo sapiens
uggacccagggaacagcca

SEQ ID NO: 1306370 - RNA, 23 nt, Homo sapiens
uggaccugucacgauugucauca

SEQ ID NO: 1306371 - RNA, 17 nt, Homo sapiens
uggacuauuuucuuuca

SEQ ID NO: 1306372 - RNA, 14 nt, Homo sapiens
uggacugguuuuca

SEQ ID NO: 1306373 - RNA, 21 nt, Homo sapiens
uggacuuguccucagcagcug

SEQ ID NO: 1306374 - RNA, 21 nt, Homo sapiens
uggagauucaguuuucauuug

SEQ ID NO: 1306375 - RNA, 23 nt, Homo sapiens
uggagauucaguuuucauuuggu

SEQ ID NO: 1306376 - RNA, 23 nt, Homo sapiens
uggagcccgugcccuaccacaca

SEQ ID NO: 1306377 - RNA, 13 nt, Homo sapiens
uggagcugucuac

SEQ ID NO: 1306378 - RNA, 20 nt, Homo sapiens
uggagggcacauuccuugcc

SEQ ID NO: 1306379 - RNA, 19 nt, Homo sapiens
uggaggggagggaucuccu

SEQ ID NO: 1306380 - RNA, 19 nt, Homo sapiens
uggaguguuauguauuucc

SEQ ID NO: 1306381 - RNA, 14 nt, Homo sapiens
uggaguuaacauca

SEQ ID NO: 1306382 - RNA, 17 nt, Homo sapiens
uggauaaaauaaaugca

SEQ ID NO: 1306383 - RNA, 19 nt, Homo sapiens
uggauauuuguacuguuua

SEQ ID NO: 1306384 - RNA, 19 nt, Homo sapiens
uggaugcagaaacaguuca

SEQ ID NO: 1306385 - RNA, 18 nt, Homo sapiens
uggaugccuugaauaaua

SEQ ID NO: 1306386 - RNA, 15 nt, Homo sapiens
uggauuguggaugug

SEQ ID NO: 1306387 - RNA, 21 nt, Homo sapiens
uggcaaauguaacugugccag

SEQ ID NO: 1306388 - RNA, 18 nt, Homo sapiens
uggcaaggacacagauga

SEQ ID NO: 1306389 - RNA, 15 nt, Homo sapiens
uggcaaugaaacaaa

SEQ ID NO: 1306390 - RNA, 20 nt, Homo sapiens
uggcacauuuuucucuuguu

SEQ ID NO: 1306391 - RNA, 13 nt, Homo sapiens
uggcacucaugga

SEQ ID NO: 1306392 - RNA, 15 nt, Homo sapiens
uggcacugcagguga

SEQ ID NO: 1306393 - RNA, 14 nt, Homo sapiens
uggcagaugcacau

SEQ ID NO: 1306394 - RNA, 23 nt, Homo sapiens
uggcagaugcaguagacugcagu

SEQ ID NO: 1306395 - RNA, 21 nt, Homo sapiens
uggcagcccuauuucaguuua

SEQ ID NO: 1306396 - RNA, 23 nt, Homo sapiens
uggcagcucagcuuccccaacac

SEQ ID NO: 1306397 - RNA, 20 nt, Homo sapiens
uggcaggccccagcccugca

SEQ ID NO: 1306398 - RNA, 13 nt, Homo sapiens
uggcagucacuga

SEQ ID NO: 1306399 - RNA, 17 nt, Homo sapiens
uggcagucugcccugca

SEQ ID NO: 1306400 - RNA, 15 nt, Homo sapiens
uggcagugguuugaa

SEQ ID NO: 1306401 - RNA, 22 nt, Homo sapiens
uggcaguuuguugaucuuuuaa

SEQ ID NO: 1306402 - RNA, 17 nt, Homo sapiens
uggcauuuccuggucag

SEQ ID NO: 1306403 - RNA, 13 nt, Homo sapiens
uggccaaagccaa

SEQ ID NO: 1306404 - RNA, 18 nt, Homo sapiens
uggccaaggagcugcuau

SEQ ID NO: 1306405 - RNA, 19 nt, Homo sapiens
uggccaaggagcugcuaua

SEQ ID NO: 1306406 - RNA, 23 nt, Homo sapiens
uggccagagagccuggugcugcu

SEQ ID NO: 1306407 - RNA, 15 nt, Homo sapiens
uggccagguaugcau

SEQ ID NO: 1306408 - RNA, 13 nt, Homo sapiens
uggcccacugcau

SEQ ID NO: 1306409 - RNA, 13 nt, Homo sapiens
uggcccagccaaa

SEQ ID NO: 1306410 - RNA, 18 nt, Homo sapiens
uggcccaguuaauuugca

SEQ ID NO: 1306411 - RNA, 13 nt, Homo sapiens
uggcccuccgccc

SEQ ID NO: 1306412 - RNA, 15 nt, Homo sapiens
uggccucaagugauu

SEQ ID NO: 1306413 - RNA, 17 nt, Homo sapiens
uggccuccccugccacc

SEQ ID NO: 1306414 - RNA, 16 nt, Homo sapiens
uggccucugcaacugc

SEQ ID NO: 1306415 - RNA, 21 nt, Homo sapiens
uggccucugugccuucuuuug

SEQ ID NO: 1306416 - RNA, 18 nt, Homo sapiens
uggccuugaaaccaccuu

SEQ ID NO: 1306417 - RNA, 15 nt, Homo sapiens
uggccuuugcaauuu

SEQ ID NO: 1306418 - RNA, 12 nt, Homo sapiens
uggcgaugucac

SEQ ID NO: 1306419 - RNA, 15 nt, Homo sapiens
uggcguuacugcuug

SEQ ID NO: 1306420 - RNA, 23 nt, Homo sapiens
uggcguuacugcuugaccaaaga

SEQ ID NO: 1306421 - RNA, 16 nt, Homo sapiens
uggcucacaccuguaa

SEQ ID NO: 1306422 - RNA, 15 nt, Homo sapiens
uggcucacacugaga

SEQ ID NO: 1306423 - RNA, 15 nt, Homo sapiens
uggcuccaacacugc

SEQ ID NO: 1306424 - RNA, 19 nt, Homo sapiens
uggcuccaacacugcugcu

SEQ ID NO: 1306425 - RNA, 13 nt, Homo sapiens
ugguaaguagcag

SEQ ID NO: 1306426 - RNA, 21 nt, Homo sapiens
ugguaauuguacuaaagccaa

SEQ ID NO: 1306427 - RNA, 13 nt, Homo sapiens
ugguagcucacac

SEQ ID NO: 1306428 - RNA, 17 nt, Homo sapiens
ugguauauucagucucu

SEQ ID NO: 1306429 - RNA, 20 nt, Homo sapiens
ugguauauucagucucugug

SEQ ID NO: 1306430 - RNA, 16 nt, Homo sapiens
uggucaaguaguuuga

SEQ ID NO: 1306431 - RNA, 21 nt, Homo sapiens
uggucaaguaguuugacucag

SEQ ID NO: 1306432 - RNA, 18 nt, Homo sapiens
uggucacaagcacaaagc

SEQ ID NO: 1306433 - RNA, 18 nt, Homo sapiens
uggucagagccacagggu

SEQ ID NO: 1306434 - RNA, 21 nt, Homo sapiens
ugguccacagggcaccugcca

SEQ ID NO: 1306435 - RNA, 20 nt, Homo sapiens
ugguccaugggccauaugaa

SEQ ID NO: 1306436 - RNA, 18 nt, Homo sapiens
ugguccugcagaagcaga

SEQ ID NO: 1306437 - RNA, 19 nt, Homo sapiens
uggucuaauuauuuacuca

SEQ ID NO: 1306438 - RNA, 22 nt, Homo sapiens
uggucucugauagguagcauuu

SEQ ID NO: 1306439 - RNA, 13 nt, Homo sapiens
uggucugacccac

SEQ ID NO: 1306440 - RNA, 17 nt, Homo sapiens
uggucuguuugacuuua

SEQ ID NO: 1306441 - RNA, 23 nt, Homo sapiens
uggucuucagccucuuucugucc

SEQ ID NO: 1306442 - RNA, 16 nt, Homo sapiens
uggugaccuuucacga

SEQ ID NO: 1306443 - RNA, 22 nt, Homo sapiens
uggugccccaggaccagcucag

SEQ ID NO: 1306444 - RNA, 15 nt, Homo sapiens
ugguggagcagagug

SEQ ID NO: 1306445 - RNA, 11 nt, Homo sapiens
ugguggcaugg

SEQ ID NO: 1306446 - RNA, 21 nt, Homo sapiens
ugguggcucacaccuguaauc

SEQ ID NO: 1306447 - RNA, 16 nt, Homo sapiens
uggugucuccucaugc

SEQ ID NO: 1306448 - RNA, 17 nt, Homo sapiens
ugguuaaauaauugaca

SEQ ID NO: 1306449 - RNA, 15 nt, Homo sapiens
ugguucucaucuuuc

SEQ ID NO: 1306450 - RNA, 15 nt, Homo sapiens
ugguugagguuucaa

SEQ ID NO: 1306451 - RNA, 17 nt, Homo sapiens
ugguuuagucauugcag

SEQ ID NO: 1306452 - RNA, 22 nt, Homo sapiens
ugguuuuuaaaaaacugcugac

SEQ ID NO: 1306453 - RNA, 15 nt, Homo sapiens
uguaaaauguucucu

SEQ ID NO: 1306454 - RNA, 19 nt, Homo sapiens
uguaaacacgccugcaaac

SEQ ID NO: 1306455 - RNA, 18 nt, Homo sapiens
uguaaaguugguuggaua

SEQ ID NO: 1306456 - RNA, 20 nt, Homo sapiens
uguaaauaugaaucugcuca

SEQ ID NO: 1306457 - RNA, 20 nt, Homo sapiens
uguaaaucuauaugauuuca

SEQ ID NO: 1306458 - RNA, 20 nt, Homo sapiens
uguaaaugacucuacuaaaa

SEQ ID NO: 1306459 - RNA, 19 nt, Homo sapiens
uguaacacuguuuauugaa

SEQ ID NO: 1306460 - RNA, 23 nt, Homo sapiens
uguaacugugccaguucuuucca

SEQ ID NO: 1306461 - RNA, 17 nt, Homo sapiens
uguaagaaacacacuga

SEQ ID NO: 1306462 - RNA, 16 nt, Homo sapiens
uguaagaaagcauaga

SEQ ID NO: 1306463 - RNA, 14 nt, Homo sapiens
uguaaggacgccuu

SEQ ID NO: 1306464 - RNA, 22 nt, Homo sapiens
uguaagugaaguaaaacuuaag

SEQ ID NO: 1306465 - RNA, 20 nt, Homo sapiens
uguaaucccagcacuuuggc

SEQ ID NO: 1306466 - RNA, 16 nt, Homo sapiens
uguaauggaagcuacc

SEQ ID NO: 1306467 - RNA, 17 nt, Homo sapiens
uguaauguuauuuccac

SEQ ID NO: 1306468 - RNA, 19 nt, Homo sapiens
uguaauuuagucuaacaca

SEQ ID NO: 1306469 - RNA, 17 nt, Homo sapiens
uguaauuuuacacaaau

SEQ ID NO: 1306470 - RNA, 18 nt, Homo sapiens
uguacauauuuacagacu

SEQ ID NO: 1306471 - RNA, 23 nt, Homo sapiens
uguacaucuauuuuggauuguau

SEQ ID NO: 1306472 - RNA, 13 nt, Homo sapiens
uguacauuucacc

SEQ ID NO: 1306473 - RNA, 19 nt, Homo sapiens
uguaccaucugucuugcca

SEQ ID NO: 1306474 - RNA, 14 nt, Homo sapiens
uguaccugugcacg

SEQ ID NO: 1306475 - RNA, 18 nt, Homo sapiens
uguacgucugacaggcaa

SEQ ID NO: 1306476 - RNA, 18 nt, Homo sapiens
uguacuugccuuauuaga

SEQ ID NO: 1306477 - RNA, 22 nt, Homo sapiens
uguagagacgguguuuugccau

SEQ ID NO: 1306478 - RNA, 15 nt, Homo sapiens
uguagcaauauauca

SEQ ID NO: 1306479 - RNA, 15 nt, Homo sapiens
uguagcagucacuga

SEQ ID NO: 1306480 - RNA, 22 nt, Homo sapiens
uguauaaaauguaacacugaug

SEQ ID NO: 1306481 - RNA, 23 nt, Homo sapiens
uguauacuuccuuaugcuucuuu

SEQ ID NO: 1306482 - RNA, 17 nt, Homo sapiens
uguauagaaaaaccaaa

SEQ ID NO: 1306483 - RNA, 20 nt, Homo sapiens
uguauagguuuuaaagaccu

SEQ ID NO: 1306484 - RNA, 11 nt, Homo sapiens
uguauauccaa

SEQ ID NO: 1306485 - RNA, 18 nt, Homo sapiens
uguaucaaaugugacauu

SEQ ID NO: 1306486 - RNA, 20 nt, Homo sapiens
uguauggaaucccacuguau

SEQ ID NO: 1306487 - RNA, 16 nt, Homo sapiens
uguaugugugugcaug

SEQ ID NO: 1306488 - RNA, 18 nt, Homo sapiens
uguauuaaacucuucaca

SEQ ID NO: 1306489 - RNA, 18 nt, Homo sapiens
acgucuguucacugaaau

SEQ ID NO: 1306490 - RNA, 17 nt, Homo sapiens
acgugcaaagccaaggc

SEQ ID NO: 1306491 - RNA, 21 nt, Homo sapiens
acguggucuuucuuacaagga

SEQ ID NO: 1306492 - RNA, 20 nt, Homo sapiens
acgugugugcacguacacac

SEQ ID NO: 1306493 - RNA, 20 nt, Homo sapiens
acguuggccuaacacugggc

SEQ ID NO: 1306494 - RNA, 16 nt, Homo sapiens
acguuucauuucucau

SEQ ID NO: 1306495 - RNA, 13 nt, Homo sapiens
acguuugucauuc

SEQ ID NO: 1306496 - RNA, 17 nt, Homo sapiens
acguuuuggucacauau

SEQ ID NO: 1306497 - RNA, 22 nt, Homo sapiens
acuaaaauuguaucaaauguga

SEQ ID NO: 1306498 - RNA, 17 nt, Homo sapiens
acuaaagaagaucugua

SEQ ID NO: 1306499 - RNA, 17 nt, Homo sapiens
cagaauguugcuuucug

SEQ ID NO: 1306500 - RNA, 15 nt, Homo sapiens
cagaauuagcugcuu

SEQ ID NO: 1306501 - RNA, 23 nt, Homo sapiens
cagaauugccccugccauuucca

SEQ ID NO: 1306502 - RNA, 16 nt, Homo sapiens
cagacaacacugggaa

SEQ ID NO: 1306503 - RNA, 22 nt, Homo sapiens
cagacaauauggucccaaauga

SEQ ID NO: 1306504 - RNA, 23 nt, Homo sapiens
cagacacaugcuauguucugucu

SEQ ID NO: 1306505 - RNA, 14 nt, Homo sapiens
cagacacccaggac

SEQ ID NO: 1306506 - RNA, 16 nt, Homo sapiens
cagacagacaacacug

SEQ ID NO: 1306507 - RNA, 14 nt, Homo sapiens
cagacauucugcca

SEQ ID NO: 1306508 - RNA, 12 nt, Homo sapiens
cagaccacugau

SEQ ID NO: 1306509 - RNA, 20 nt, Homo sapiens
cagaccacugauaaaaccau

SEQ ID NO: 1306510 - RNA, 14 nt, Homo sapiens
cagaccuuuggacu

SEQ ID NO: 1306511 - RNA, 20 nt, Homo sapiens
cagacugaucaggaccucca

SEQ ID NO: 1306512 - RNA, 15 nt, Homo sapiens
cagacuuccuugaga

SEQ ID NO: 1306513 - RNA, 18 nt, Homo sapiens
cagacuuuggaaaaugca

SEQ ID NO: 1306514 - RNA, 23 nt, Homo sapiens
cagacuuuggaaaaugcauugua

SEQ ID NO: 1306515 - RNA, 23 nt, Homo sapiens
cagagaaaggggagcccacuguc

SEQ ID NO: 1306516 - RNA, 23 nt, Homo sapiens
cagagaagcucucgggcuaggaa

SEQ ID NO: 1306517 - RNA, 15 nt, Homo sapiens
cagagaccauugcaa

SEQ ID NO: 1306518 - RNA, 18 nt, Homo sapiens
cagagacccaagcugccu

SEQ ID NO: 1306519 - RNA, 17 nt, Homo sapiens
cagagacccagaucuca

SEQ ID NO: 1306520 - RNA, 21 nt, Homo sapiens
cagagacccgagggcugcuuu

SEQ ID NO: 1306521 - RNA, 13 nt, Homo sapiens
cagagacuaugua

SEQ ID NO: 1306522 - RNA, 19 nt, Homo sapiens
cagagagccuggugcugcu

SEQ ID NO: 1306523 - RNA, 15 nt, Homo sapiens
cagagcccaagggaa

SEQ ID NO: 1306524 - RNA, 15 nt, Homo sapiens
cagagccucagugag

SEQ ID NO: 1306525 - RNA, 17 nt, Homo sapiens
cagagccucgcucuguu

SEQ ID NO: 1306526 - RNA, 13 nt, Homo sapiens
ugugugugugcau

SEQ ID NO: 1306527 - RNA, 21 nt, Homo sapiens
uguguuacugcuuugcaaaga

SEQ ID NO: 1306528 - RNA, 20 nt, Homo sapiens
uguguugaaggaacuugucu

SEQ ID NO: 1306529 - RNA, 18 nt, Homo sapiens
uguuaacuuuguggucua

SEQ ID NO: 1306530 - RNA, 22 nt, Homo sapiens
uguuaaugucccauuucacgac

SEQ ID NO: 1306531 - RNA, 16 nt, Homo sapiens
uguuaauuacaccaua

SEQ ID NO: 1306532 - RNA, 13 nt, Homo sapiens
uguuacccacugc

SEQ ID NO: 1306533 - RNA, 21 nt, Homo sapiens
uguuaggaagguacugucaug

SEQ ID NO: 1306534 - RNA, 17 nt, Homo sapiens
uguuaugaggagcugca

SEQ ID NO: 1306535 - RNA, 18 nt, Homo sapiens
uguuauguaaaaggccaa

SEQ ID NO: 1306536 - RNA, 18 nt, Homo sapiens
uguucaaacccagucuug

SEQ ID NO: 1306537 - RNA, 16 nt, Homo sapiens
uguucccccugugcag

SEQ ID NO: 1306538 - RNA, 18 nt, Homo sapiens
uguucccuuacuguuuca

SEQ ID NO: 1306539 - RNA, 16 nt, Homo sapiens
uguucucugaggacac

SEQ ID NO: 1306540 - RNA, 14 nt, Homo sapiens
uguucucuguccag

SEQ ID NO: 1306541 - RNA, 15 nt, Homo sapiens
uguucugaacugugg

SEQ ID NO: 1306542 - RNA, 16 nt, Homo sapiens
uguucuuuuuauugaa

SEQ ID NO: 1306543 - RNA, 21 nt, Homo sapiens
uguugaagcucuuuacuguaa

SEQ ID NO: 1306544 - RNA, 16 nt, Homo sapiens
uguugcagguucaugg

SEQ ID NO: 1306545 - RNA, 24 nt, Homo sapiens
uguugccacuggcaaauguaacug

SEQ ID NO: 1306546 - RNA, 14 nt, Homo sapiens
uguugguagcaauu

SEQ ID NO: 1306547 - RNA, 12 nt, Homo sapiens
uguuggugacaa

SEQ ID NO: 1306548 - RNA, 15 nt, Homo sapiens
uguuguauacuuccu

SEQ ID NO: 1306549 - RNA, 16 nt, Homo sapiens
uguugugauguacaca

SEQ ID NO: 1306550 - RNA, 21 nt, Homo sapiens
uguuuacaggauauuccaaaa

SEQ ID NO: 1306551 - RNA, 17 nt, Homo sapiens
uguuuagaaaaguauuc

SEQ ID NO: 1306552 - RNA, 16 nt, Homo sapiens
uguuuauucuauaguu

SEQ ID NO: 1306553 - RNA, 17 nt, Homo sapiens
uguuuccuaauaucaaa

SEQ ID NO: 1306554 - RNA, 12 nt, Homo sapiens
uguuucuuuaua

SEQ ID NO: 1306555 - RNA, 15 nt, Homo sapiens
uguuugaaagcuuua

SEQ ID NO: 1306556 - RNA, 14 nt, Homo sapiens
uguuugcacaccca

SEQ ID NO: 1306557 - RNA, 12 nt, Homo sapiens
uguuugucucac

SEQ ID NO: 1306558 - RNA, 17 nt, Homo sapiens
uguuuguuucuguagaa

SEQ ID NO: 1306559 - RNA, 16 nt, Homo sapiens
uguuuuauauguugcu

SEQ ID NO: 1306560 - RNA, 17 nt, Homo sapiens
uguuuugcccaccagau

SEQ ID NO: 1306561 - RNA, 18 nt, Homo sapiens
uguuuuguguaacauauu

SEQ ID NO: 1306562 - RNA, 20 nt, Homo sapiens
uguuuuuguucaaagccagc

SEQ ID NO: 1306563 - RNA, 20 nt, Homo sapiens
uguuuuuugccuaaauccaa

SEQ ID NO: 1306564 - RNA, 16 nt, Homo sapiens
uguuuuuuuucagcca

SEQ ID NO: 1306565 - RNA, 22 nt, Homo sapiens
uuaaaaaaacaaucccaaguaa

SEQ ID NO: 1306566 - RNA, 22 nt, Homo sapiens
uuaaaaaaauggcagugaugaa

SEQ ID NO: 1306567 - RNA, 20 nt, Homo sapiens
uuaaaacaacacucacauuu

SEQ ID NO: 1306568 - RNA, 22 nt, Homo sapiens
uuaaaagacaagacuucaguau

SEQ ID NO: 1306569 - RNA, 20 nt, Homo sapiens
uuaaaauaugcucuaaacau

SEQ ID NO: 1306570 - RNA, 18 nt, Homo sapiens
uuaaaauauuaguauaaa

SEQ ID NO: 1306571 - RNA, 13 nt, Homo sapiens
uuaaaaucagauu

SEQ ID NO: 1306572 - RNA, 14 nt, Homo sapiens
uuaaaaugagcauu

SEQ ID NO: 1306573 - RNA, 17 nt, Homo sapiens
uuaaacaaaugguccau

SEQ ID NO: 1306574 - RNA, 19 nt, Homo sapiens
uuaaagcuugcucacaucu

SEQ ID NO: 1306575 - RNA, 16 nt, Homo sapiens
uuaaagguaaaacaug

SEQ ID NO: 1306576 - RNA, 17 nt, Homo sapiens
uuaaauacagucuucca

SEQ ID NO: 1306577 - RNA, 13 nt, Homo sapiens
uuaaaucuugaua

SEQ ID NO: 1306578 - RNA, 16 nt, Homo sapiens
uuaaaugugacauucu

SEQ ID NO: 1306579 - RNA, 16 nt, Homo sapiens
uuaaauuacaguauau

SEQ ID NO: 1306580 - RNA, 12 nt, Homo sapiens
uuaaauugugcc

SEQ ID NO: 1306581 - RNA, 18 nt, Homo sapiens
uuaacaaauacauucaaa

SEQ ID NO: 1306582 - RNA, 17 nt, Homo sapiens
uuaacccauuugucucu

SEQ ID NO: 1306583 - RNA, 22 nt, Homo sapiens
uuaacccauuugucucuacuuu

SEQ ID NO: 1306584 - RNA, 15 nt, Homo sapiens
uuaaccugaugcagu

SEQ ID NO: 1306585 - RNA, 13 nt, Homo sapiens
uuaaccugcaaaa

SEQ ID NO: 1306586 - RNA, 22 nt, Homo sapiens
uuaacucccuuuuuacacuuua

SEQ ID NO: 1306587 - RNA, 15 nt, Homo sapiens
uuaacuggugcacuu

SEQ ID NO: 1306588 - RNA, 18 nt, Homo sapiens
uuaacuuaacucaugaau

SEQ ID NO: 1306589 - RNA, 16 nt, Homo sapiens
uuaagacaacuacagc

SEQ ID NO: 1306590 - RNA, 11 nt, Homo sapiens
acagacauauu

SEQ ID NO: 1306591 - RNA, 14 nt, Homo sapiens
acagaccuucacag

SEQ ID NO: 1306592 - RNA, 23 nt, Homo sapiens
acagacuuccucuuucuaagauu

SEQ ID NO: 1306593 - RNA, 21 nt, Homo sapiens
acagaggaaggccuccugagg

SEQ ID NO: 1306594 - RNA, 18 nt, Homo sapiens
acagagggcucaccucuu

SEQ ID NO: 1306595 - RNA, 20 nt, Homo sapiens
acagaggggagucaccagcc

SEQ ID NO: 1306596 - RNA, 16 nt, Homo sapiens
acagaguccugcagag

SEQ ID NO: 1306597 - RNA, 17 nt, Homo sapiens
acagagugcauugugag

SEQ ID NO: 1306598 - RNA, 14 nt, Homo sapiens
acagauaucuucag

SEQ ID NO: 1306599 - RNA, 19 nt, Homo sapiens
acagauaucuucaguuuaa

SEQ ID NO: 1306600 - RNA, 16 nt, Homo sapiens
acagaugcguucagca

SEQ ID NO: 1306601 - RNA, 19 nt, Homo sapiens
acagauguucccccaucuc

SEQ ID NO: 1306602 - RNA, 14 nt, Homo sapiens
acagauugagcuuu

SEQ ID NO: 1306603 - RNA, 19 nt, Homo sapiens
acagauugucuuauuacag

SEQ ID NO: 1306604 - RNA, 19 nt, Homo sapiens
acagcaccaccuugcgauu

SEQ ID NO: 1306605 - RNA, 20 nt, Homo sapiens
acagccguccucccuccuag

SEQ ID NO: 1306606 - RNA, 21 nt, Homo sapiens
acagccucccacccccaucuc

SEQ ID NO: 1306607 - RNA, 17 nt, Homo sapiens
acagcuacucuccccac

SEQ ID NO: 1306608 - RNA, 21 nt, Homo sapiens
acagcuacucuccccacgagg

SEQ ID NO: 1306609 - RNA, 23 nt, Homo sapiens
acagcucgggcccucugugagau

SEQ ID NO: 1306610 - RNA, 20 nt, Homo sapiens
acagcuggguggcacugcca

SEQ ID NO: 1306611 - RNA, 23 nt, Homo sapiens
acagcuugucugguaaguggcuu

SEQ ID NO: 1306612 - RNA, 22 nt, Homo sapiens
acagcuuucugaccuucagcuc

SEQ ID NO: 1306613 - RNA, 13 nt, Homo sapiens
acaggaguguccu

SEQ ID NO: 1306614 - RNA, 14 nt, Homo sapiens
acaggcaagcaccu

SEQ ID NO: 1306615 - RNA, 23 nt, Homo sapiens
acaggcaaugcuggcuguuggcu

SEQ ID NO: 1306616 - RNA, 15 nt, Homo sapiens
acaggccauugugaa

SEQ ID NO: 1306617 - RNA, 19 nt, Homo sapiens
acaggcccggcuccaggcu

SEQ ID NO: 1306618 - RNA, 16 nt, Homo sapiens
acaggcugugacucuu

SEQ ID NO: 1306619 - RNA, 22 nt, Homo sapiens
acaggcugugacucuucucuca

SEQ ID NO: 1306620 - RNA, 18 nt, Homo sapiens
acagggacugaaaaccuc

SEQ ID NO: 1306621 - RNA, 21 nt, Homo sapiens
acagggagacccguccauuug

SEQ ID NO: 1306622 - RNA, 14 nt, Homo sapiens
acagggauucucac

SEQ ID NO: 1306623 - RNA, 23 nt, Homo sapiens
acagguaauauaaaaagcuucca

SEQ ID NO: 1306624 - RNA, 12 nt, Homo sapiens
acaggugugagc

SEQ ID NO: 1306625 - RNA, 14 nt, Homo sapiens
acaggugugcacca

SEQ ID NO: 1306626 - RNA, 14 nt, Homo sapiens
acagguuacucagg

SEQ ID NO: 1306627 - RNA, 12 nt, Homo sapiens
acaguaucacug

SEQ ID NO: 1306628 - RNA, 15 nt, Homo sapiens
acaguaugucccaua

SEQ ID NO: 1306629 - RNA, 15 nt, Homo sapiens
acaguauuacuucug

SEQ ID NO: 1306630 - RNA, 19 nt, Homo sapiens
acagucaccccaggacuca

SEQ ID NO: 1306631 - RNA, 20 nt, Homo sapiens
aaaaaacaggaggaguauga

SEQ ID NO: 1306632 - RNA, 21 nt, Homo sapiens
aaaaacaaauauauauaugua

SEQ ID NO: 1306633 - RNA, 13 nt, Homo sapiens
aaaaacugaacua

SEQ ID NO: 1306634 - RNA, 22 nt, Homo sapiens
aaaaagccuccaguccaaggaa

SEQ ID NO: 1306635 - RNA, 12 nt, Homo sapiens
aaaaagcuguau

SEQ ID NO: 1306636 - RNA, 12 nt, Homo sapiens
aaaaagcuucca

SEQ ID NO: 1306637 - RNA, 12 nt, Homo sapiens
aaaaaggcaccu

SEQ ID NO: 1306638 - RNA, 15 nt, Homo sapiens
aaaaaggccggguga

SEQ ID NO: 1306639 - RNA, 21 nt, Homo sapiens
aaaaauauuuauaaaacuucu

SEQ ID NO: 1306640 - RNA, 20 nt, Homo sapiens
aaaaauauuuauucauuauu

SEQ ID NO: 1306641 - RNA, 17 nt, Homo sapiens
aaaaaugaaauuagucu

SEQ ID NO: 1306642 - RNA, 18 nt, Homo sapiens
aaaaauucauugucucua

SEQ ID NO: 1306643 - RNA, 19 nt, Homo sapiens
aaaaauuuugugacauucc

SEQ ID NO: 1306644 - RNA, 20 nt, Homo sapiens
aaaacaauguaagagccuaa

SEQ ID NO: 1306645 - RNA, 17 nt, Homo sapiens
aaaaccagcgugugacu

SEQ ID NO: 1306646 - RNA, 23 nt, Homo sapiens
aaaaccccaucucuacaaaaagc

SEQ ID NO: 1306647 - RNA, 20 nt, Homo sapiens
aaaaccucaugacagccaga

SEQ ID NO: 1306648 - RNA, 13 nt, Homo sapiens
aaaaccuccagua

SEQ ID NO: 1306649 - RNA, 17 nt, Homo sapiens
aaaaccuguccuaugaa

SEQ ID NO: 1306650 - RNA, 14 nt, Homo sapiens
aaaacuacaaauca

SEQ ID NO: 1306651 - RNA, 13 nt, Homo sapiens
aacccauuugucu

SEQ ID NO: 1306652 - RNA, 20 nt, Homo sapiens
aaccccaaaugcucucucuu

SEQ ID NO: 1306653 - RNA, 20 nt, Homo sapiens
aacccucacaagcaugaagu

SEQ ID NO: 1306654 - RNA, 17 nt, Homo sapiens
aaccgcaggaagcugcu

SEQ ID NO: 1306655 - RNA, 21 nt, Homo sapiens
aaccucauuccccaaccacuu

SEQ ID NO: 1306656 - RNA, 19 nt, Homo sapiens
aaccucugagucaccaucu

SEQ ID NO: 1306657 - RNA, 14 nt, Homo sapiens
aaccugaugcaguc

SEQ ID NO: 1306658 - RNA, 19 nt, Homo sapiens
aaccugaugucauauucca

SEQ ID NO: 1306659 - RNA, 20 nt, Homo sapiens
aaccuguugaauaauuugau

SEQ ID NO: 1306660 - RNA, 19 nt, Homo sapiens
aacgauaaaagacagugaa

SEQ ID NO: 1306661 - RNA, 19 nt, Homo sapiens
aacgcccuuuccuccucag

SEQ ID NO: 1306662 - RNA, 14 nt, Homo sapiens
aacgugcauugugc

SEQ ID NO: 1306663 - RNA, 14 nt, Homo sapiens
aacuaaauacuugc

SEQ ID NO: 1306664 - RNA, 17 nt, Homo sapiens
aacuaaaugacuuucaa

SEQ ID NO: 1306665 - RNA, 16 nt, Homo sapiens
aacuacccaaaacaag

SEQ ID NO: 1306666 - RNA, 19 nt, Homo sapiens
aacuacccccagcugugcu

SEQ ID NO: 1306667 - RNA, 15 nt, Homo sapiens
aacuagguuaccgcu

SEQ ID NO: 1306668 - RNA, 20 nt, Homo sapiens
aacuagguuaccgcuuauca

SEQ ID NO: 1306669 - RNA, 15 nt, Homo sapiens
aacuauaacuuaaag

SEQ ID NO: 1306670 - RNA, 17 nt, Homo sapiens
aacuauauguauucaca

SEQ ID NO: 1306671 - RNA, 18 nt, Homo sapiens
aacuaugcagugugcucc

SEQ ID NO: 1306672 - RNA, 16 nt, Homo sapiens
aacucaaacucuuaaa

SEQ ID NO: 1306673 - RNA, 15 nt, Homo sapiens
aacucaacuguauaa

SEQ ID NO: 1306674 - RNA, 21 nt, Homo sapiens
aacucacugaggguaucugac

SEQ ID NO: 1306675 - RNA, 16 nt, Homo sapiens
aacucagaaacaucag

SEQ ID NO: 1306676 - RNA, 13 nt, Homo sapiens
aacucagauccag

SEQ ID NO: 1306677 - RNA, 13 nt, Homo sapiens
aacucaucucauu

SEQ ID NO: 1306678 - RNA, 19 nt, Homo sapiens
aacucauggcuucucucuc

SEQ ID NO: 1306679 - RNA, 22 nt, Homo sapiens
aacuccccucagggauacgaca

SEQ ID NO: 1306680 - RNA, 22 nt, Homo sapiens
aacucccuuuuuacacuuuaug

SEQ ID NO: 1306681 - RNA, 18 nt, Homo sapiens
aacucucaguggugccug

SEQ ID NO: 1306682 - RNA, 20 nt, Homo sapiens
aacucugucuucaccugauu

SEQ ID NO: 1306683 - RNA, 15 nt, Homo sapiens
aacucuucaguuaau

SEQ ID NO: 1306684 - RNA, 21 nt, Homo sapiens
aacucuucaguuaauucuuag

SEQ ID NO: 1306685 - RNA, 22 nt, Homo sapiens
aacugaaggcuaaaaagcaaca

SEQ ID NO: 1306686 - RNA, 18 nt, Homo sapiens
aacugagaccuccagaaa

SEQ ID NO: 1306687 - RNA, 18 nt, Homo sapiens
aacugaggguuaucuuug

SEQ ID NO: 1306688 - RNA, 17 nt, Homo sapiens
aacugcccaaggcaugu

SEQ ID NO: 1306689 - RNA, 16 nt, Homo sapiens
aacugcguuaugaaga

SEQ ID NO: 1306690 - RNA, 17 nt, Homo sapiens
aaggcuaaaaagcaaca

SEQ ID NO: 1306691 - RNA, 21 nt, Homo sapiens
aaggcuuacacccacagugga

SEQ ID NO: 1306692 - RNA, 14 nt, Homo sapiens
aaggcuuugaguua

SEQ ID NO: 1306693 - RNA, 14 nt, Homo sapiens
aagggaauccuccu

SEQ ID NO: 1306694 - RNA, 20 nt, Homo sapiens
aagggaauucggugugcacc

SEQ ID NO: 1306695 - RNA, 16 nt, Homo sapiens
aagggagguggcaaga

SEQ ID NO: 1306696 - RNA, 13 nt, Homo sapiens
aagggccacggga

SEQ ID NO: 1306697 - RNA, 22 nt, Homo sapiens
aaggucaggaguucgagaccag

SEQ ID NO: 1306698 - RNA, 20 nt, Homo sapiens
aagguccucugucagucaca

SEQ ID NO: 1306699 - RNA, 17 nt, Homo sapiens
aagguggggacagggau

SEQ ID NO: 1306700 - RNA, 24 nt, Homo sapiens
aaggugugcucugaucauccacug

SEQ ID NO: 1306701 - RNA, 19 nt, Homo sapiens
aagguuggugaauuucaca

SEQ ID NO: 1306702 - RNA, 20 nt, Homo sapiens
aaguaaccuuauacuacuaa

SEQ ID NO: 1306703 - RNA, 15 nt, Homo sapiens
aaguagauugccagc

SEQ ID NO: 1306704 - RNA, 12 nt, Homo sapiens
aaguagccacag

SEQ ID NO: 1306705 - RNA, 13 nt, Homo sapiens
aaguagcugcuac

SEQ ID NO: 1306706 - RNA, 13 nt, Homo sapiens
aaguauaaaugaa

SEQ ID NO: 1306707 - RNA, 16 nt, Homo sapiens
aagucaaaugugugcu

SEQ ID NO: 1306708 - RNA, 22 nt, Homo sapiens
aagucagugcccaacuguuaua

SEQ ID NO: 1306709 - RNA, 16 nt, Homo sapiens
aagucauaccaaugaa

SEQ ID NO: 1306710 - RNA, 17 nt, Homo sapiens
aagucaugugcauuucc

SEQ ID NO: 1306711 - RNA, 23 nt, Homo sapiens
aaguccagaaacuguucccaccu

SEQ ID NO: 1306712 - RNA, 16 nt, Homo sapiens
aaguccuuugugaaua

SEQ ID NO: 1306713 - RNA, 17 nt, Homo sapiens
aagugaaaaacauccag

SEQ ID NO: 1306714 - RNA, 16 nt, Homo sapiens
aagugaagcuggugga

SEQ ID NO: 1306715 - RNA, 19 nt, Homo sapiens
aagugagacccugucucaa

SEQ ID NO: 1306716 - RNA, 22 nt, Homo sapiens
aagugcacaacauuacagggaa

SEQ ID NO: 1306717 - RNA, 12 nt, Homo sapiens
aagugcaucuac

SEQ ID NO: 1306718 - RNA, 14 nt, Homo sapiens
aagugccaucucaa

SEQ ID NO: 1306719 - RNA, 21 nt, Homo sapiens
aagugcggcacugcaaagaga

SEQ ID NO: 1306720 - RNA, 16 nt, Homo sapiens
aagugcucacuacuca

SEQ ID NO: 1306721 - RNA, 21 nt, Homo sapiens
aagugcugggauuacaggugu

SEQ ID NO: 1306722 - RNA, 22 nt, Homo sapiens
aagugucaccccucacugugac

SEQ ID NO: 1306723 - RNA, 21 nt, Homo sapiens
aaguguguuuccugcugacua

SEQ ID NO: 1306724 - RNA, 16 nt, Homo sapiens
aaguguuuagcuguca

SEQ ID NO: 1306725 - RNA, 19 nt, Homo sapiens
aaguguuugaaagcuuuau

SEQ ID NO: 1306726 - RNA, 20 nt, Homo sapiens
aaguuccaaaauaaagcaua

SEQ ID NO: 1306727 - RNA, 16 nt, Homo sapiens
aaguugagacuucuga

SEQ ID NO: 1306728 - RNA, 21 nt, Homo sapiens
aaguugauauagaacagugcu

SEQ ID NO: 1306729 - RNA, 23 nt, Homo sapiens
aaguugauauagaacagugcuug

SEQ ID NO: 1306730 - RNA, 20 nt, Homo sapiens
aaguuguagugaagcucuca

SEQ ID NO: 1306731 - RNA, 14 nt, Homo sapiens
aaguuguugauguu

SEQ ID NO: 1306732 - RNA, 14 nt, Homo sapiens
aaguuuaugguugu

SEQ ID NO: 1306733 - RNA, 22 nt, Homo sapiens
aaguuuauuacuuuauguacaa

SEQ ID NO: 1306734 - RNA, 13 nt, Homo sapiens
aaguuugagauca

SEQ ID NO: 1306735 - RNA, 14 nt, Homo sapiens
aaguuuuacauugu

SEQ ID NO: 1306736 - RNA, 15 nt, Homo sapiens
aaguuuucagcuuua

SEQ ID NO: 1306737 - RNA, 19 nt, Homo sapiens
aaguuuucuuccaugauuu

SEQ ID NO: 1306738 - RNA, 16 nt, Homo sapiens
aauaaaaacauugccu

SEQ ID NO: 1306739 - RNA, 16 nt, Homo sapiens
aauaaaacaguaucuc

SEQ ID NO: 1306740 - RNA, 15 nt, Homo sapiens
aauaaagcacaaaac

SEQ ID NO: 1306741 - RNA, 16 nt, Homo sapiens
aauaaagcacugagca

SEQ ID NO: 1306742 - RNA, 14 nt, Homo sapiens
aauaaaguauuuaa

SEQ ID NO: 1306743 - RNA, 17 nt, Homo sapiens
aauaaaucugacccagu

SEQ ID NO: 1306744 - RNA, 16 nt, Homo sapiens
aauaacaauaaaagac

SEQ ID NO: 1306745 - RNA, 23 nt, Homo sapiens
aauaaccggauauauacauagca

SEQ ID NO: 1306746 - RNA, 23 nt, Homo sapiens
aauaacgauaaaagacagugaaa

SEQ ID NO: 1306747 - RNA, 20 nt, Homo sapiens
aauaagucccgcauauacuu

SEQ ID NO: 1306748 - RNA, 15 nt, Homo sapiens
aauaauaagugaugu

SEQ ID NO: 1306749 - RNA, 19 nt, Homo sapiens
aauaauacaccagagauaa

SEQ ID NO: 1306750 - RNA, 16 nt, Homo sapiens
aauaauguacaucugg

SEQ ID NO: 1306751 - RNA, 16 nt, Homo sapiens
aauaauuuccuacaca

SEQ ID NO: 1306752 - RNA, 12 nt, Homo sapiens
aauacaaaaauu

SEQ ID NO: 1306753 - RNA, 14 nt, Homo sapiens
aauacaguaucuca

SEQ ID NO: 1306754 - RNA, 15 nt, Homo sapiens
aauacaugcaucuca

SEQ ID NO: 1306755 - RNA, 19 nt, Homo sapiens
aauaccccuuuacuagaag

SEQ ID NO: 1306756 - RNA, 18 nt, Homo sapiens
aauacgguaaggauacuu

SEQ ID NO: 1306757 - RNA, 14 nt, Homo sapiens
aauagaaaagcacu

SEQ ID NO: 1306758 - RNA, 14 nt, Homo sapiens
aauagauccagugc

SEQ ID NO: 1306759 - RNA, 23 nt, Homo sapiens
aauagcugggacuacagguguga

SEQ ID NO: 1306760 - RNA, 15 nt, Homo sapiens
aauaguauagacaau

SEQ ID NO: 1306761 - RNA, 14 nt, Homo sapiens
aauaguauuugcau

SEQ ID NO: 1306762 - RNA, 21 nt, Homo sapiens
aauagucuagauggcuccucu

SEQ ID NO: 1306763 - RNA, 16 nt, Homo sapiens
aauaguuugaacagau

SEQ ID NO: 1306764 - RNA, 15 nt, Homo sapiens
aauauaaauucacuu

SEQ ID NO: 1306765 - RNA, 12 nt, Homo sapiens
aauauaauacug

SEQ ID NO: 1306766 - RNA, 14 nt, Homo sapiens
aauauaauacugua

SEQ ID NO: 1306767 - RNA, 20 nt, Homo sapiens
aauauaccaacccacuggca

SEQ ID NO: 1306768 - RNA, 16 nt, Homo sapiens
aauauagcaucuuuca

SEQ ID NO: 1306769 - RNA, 16 nt, Homo sapiens
aauauagcuguacaaa

SEQ ID NO: 1306770 - RNA, 15 nt, Homo sapiens
aauauccugcuugau

SEQ ID NO: 1306771 - RNA, 18 nt, Homo sapiens
aauauguauaaacuuaca

SEQ ID NO: 1306772 - RNA, 21 nt, Homo sapiens
aauauguuuaucaacucaaga

SEQ ID NO: 1306773 - RNA, 22 nt, Homo sapiens
aauauguuuaucaacucaagaa

SEQ ID NO: 1306774 - RNA, 16 nt, Homo sapiens
aauauucuaauuuuag

SEQ ID NO: 1306775 - RNA, 14 nt, Homo sapiens
aauauuuaccagac

SEQ ID NO: 1306776 - RNA, 17 nt, Homo sapiens
aauauuuauuaccucug

SEQ ID NO: 1306777 - RNA, 20 nt, Homo sapiens
aauauuuauuaccucugaua

SEQ ID NO: 1306778 - RNA, 13 nt, Homo sapiens
aauauuuauucau

SEQ ID NO: 1306779 - RNA, 19 nt, Homo sapiens
aauauuuuaagaauuucac

SEQ ID NO: 1306780 - RNA, 20 nt, Homo sapiens
aauauuuuacauacacugua

SEQ ID NO: 1306781 - RNA, 18 nt, Homo sapiens
aauauuuucucuguacuu

SEQ ID NO: 1306782 - RNA, 16 nt, Homo sapiens
aaucaaaaccagugaa

SEQ ID NO: 1306783 - RNA, 13 nt, Homo sapiens
aaucaaagcagau

SEQ ID NO: 1306784 - RNA, 18 nt, Homo sapiens
aaucaacuugcuuaucaa

SEQ ID NO: 1306785 - RNA, 12 nt, Homo sapiens
aaucaauagugc

SEQ ID NO: 1306786 - RNA, 17 nt, Homo sapiens
aggcuggaaugcagugg

SEQ ID NO: 1306787 - RNA, 15 nt, Homo sapiens
aggcuggcuuguccc

SEQ ID NO: 1306788 - RNA, 22 nt, Homo sapiens
aggcugggaacucaucugguug

SEQ ID NO: 1306789 - RNA, 18 nt, Homo sapiens
aggcugggugcagucacg

SEQ ID NO: 1306790 - RNA, 13 nt, Homo sapiens
aggcuggucucaa

SEQ ID NO: 1306791 - RNA, 16 nt, Homo sapiens
aggcuugucacuagca

SEQ ID NO: 1306792 - RNA, 13 nt, Homo sapiens
agggaaaaaccag

SEQ ID NO: 1306793 - RNA, 20 nt, Homo sapiens
agggaaagggggcuaguccc

SEQ ID NO: 1306794 - RNA, 15 nt, Homo sapiens
agggaaccugugucc

SEQ ID NO: 1306795 - RNA, 16 nt, Homo sapiens
agggacgccugggggu

SEQ ID NO: 1306796 - RNA, 15 nt, Homo sapiens
agggacugagccaga

SEQ ID NO: 1306797 - RNA, 14 nt, Homo sapiens
agggagcacugggu

SEQ ID NO: 1306798 - RNA, 16 nt, Homo sapiens
agggagcagaugcaau

SEQ ID NO: 1306799 - RNA, 20 nt, Homo sapiens
agggagccggggcugugaga

SEQ ID NO: 1306800 - RNA, 16 nt, Homo sapiens
agggagggcugucauc

SEQ ID NO: 1306801 - RNA, 17 nt, Homo sapiens
agggaugauucaagcca

SEQ ID NO: 1306802 - RNA, 18 nt, Homo sapiens
agggaugauucaagccau

SEQ ID NO: 1306803 - RNA, 19 nt, Homo sapiens
agggauuuuagucacacgu

SEQ ID NO: 1306804 - RNA, 21 nt, Homo sapiens
agggauuuuuuuuuucagggc

SEQ ID NO: 1306805 - RNA, 22 nt, Homo sapiens
agggcaaggugugguagcucac

SEQ ID NO: 1306806 - RNA, 14 nt, Homo sapiens
agggcacacacugu

SEQ ID NO: 1306807 - RNA, 12 nt, Homo sapiens
agggcacugggu

SEQ ID NO: 1306808 - RNA, 22 nt, Homo sapiens
agggcaggucuggcggcuccau

SEQ ID NO: 1306809 - RNA, 18 nt, Homo sapiens
agggccagagcaagcgcu

SEQ ID NO: 1306810 - RNA, 16 nt, Homo sapiens
agggcccccaucucau

SEQ ID NO: 1306811 - RNA, 20 nt, Homo sapiens
agggccccugcacacucagu

SEQ ID NO: 1306812 - RNA, 14 nt, Homo sapiens
agggccuggaagac

SEQ ID NO: 1306813 - RNA, 15 nt, Homo sapiens
agggcgcuuguccca

SEQ ID NO: 1306814 - RNA, 19 nt, Homo sapiens
agggcugcgacgcuugcuc

SEQ ID NO: 1306815 - RNA, 23 nt, Homo sapiens
agggcugcgacgcuugcucuguu

SEQ ID NO: 1306816 - RNA, 16 nt, Homo sapiens
aggggaaccccggggu

SEQ ID NO: 1306817 - RNA, 20 nt, Homo sapiens
aggggagcaacagaggacau

SEQ ID NO: 1306818 - RNA, 15 nt, Homo sapiens
aggggagggaucucc

SEQ ID NO: 1306819 - RNA, 19 nt, Homo sapiens
aggggagucaccagccaga

SEQ ID NO: 1306820 - RNA, 15 nt, Homo sapiens
aggggcaccucucuu

SEQ ID NO: 1306821 - RNA, 21 nt, Homo sapiens
aggggcuggcccagggcugca

SEQ ID NO: 1306822 - RNA, 21 nt, Homo sapiens
agggggaugccacuccucccu

SEQ ID NO: 1306823 - RNA, 14 nt, Homo sapiens
aggggucugggagu

SEQ ID NO: 1306824 - RNA, 20 nt, Homo sapiens
aggguaucaggugcugccau

SEQ ID NO: 1306825 - RNA, 16 nt, Homo sapiens
agggucccucugugua

SEQ ID NO: 1306826 - RNA, 15 nt, Homo sapiens
agggucugccuccag

SEQ ID NO: 1306827 - RNA, 23 nt, Homo sapiens
aggguggcuggguccaggggaug

SEQ ID NO: 1306828 - RNA, 13 nt, Homo sapiens
aggguggugaccu

SEQ ID NO: 1306829 - RNA, 19 nt, Homo sapiens
aggguguaauggagcauca

SEQ ID NO: 1306830 - RNA, 15 nt, Homo sapiens
aggguguaucuagcu

SEQ ID NO: 1306831 - RNA, 23 nt, Homo sapiens
aggguguaucuagcucuaguuca

SEQ ID NO: 1306832 - RNA, 16 nt, Homo sapiens
aggguuaaggccugaa

SEQ ID NO: 1306833 - RNA, 13 nt, Homo sapiens
agguaaaaacuga

SEQ ID NO: 1306834 - RNA, 16 nt, Homo sapiens
agguaaaaacugaacu

SEQ ID NO: 1306835 - RNA, 19 nt, Homo sapiens
agguaaaagcaucacauga

SEQ ID NO: 1306836 - RNA, 22 nt, Homo sapiens
agguaaauucuuaauguucaca

SEQ ID NO: 1306837 - RNA, 17 nt, Homo sapiens
agguaauuucuugugcc

SEQ ID NO: 1306838 - RNA, 22 nt, Homo sapiens
agguacagcaacaggaaucuca

SEQ ID NO: 1306839 - RNA, 20 nt, Homo sapiens
agguauauaaauuuucccaa

SEQ ID NO: 1306840 - RNA, 21 nt, Homo sapiens
aggucacugcuagagacgcug

SEQ ID NO: 1306841 - RNA, 23 nt, Homo sapiens
aggucaggaguucgagaccagcc

SEQ ID NO: 1306842 - RNA, 11 nt, Homo sapiens
aggucaugccu

SEQ ID NO: 1306843 - RNA, 15 nt, Homo sapiens
agguccagcucugga

SEQ ID NO: 1306844 - RNA, 18 nt, Homo sapiens
agguccugagagcugcuu

SEQ ID NO: 1306845 - RNA, 22 nt, Homo sapiens
aggucucauagguugagcaauu

SEQ ID NO: 1306846 - RNA, 23 nt, Homo sapiens
aggugaaacccagucacugugag

SEQ ID NO: 1306847 - RNA, 20 nt, Homo sapiens
aggugaaaugaagcaacaga

SEQ ID NO: 1306848 - RNA, 13 nt, Homo sapiens
aggugacagagug

SEQ ID NO: 1306849 - RNA, 16 nt, Homo sapiens
aggugaccucacagua

SEQ ID NO: 1306850 - RNA, 17 nt, Homo sapiens
aggugauccaccugccu

SEQ ID NO: 1306851 - RNA, 14 nt, Homo sapiens
aggugccaucaucu

SEQ ID NO: 1306852 - RNA, 15 nt, Homo sapiens
aggugccaucaucuc

SEQ ID NO: 1306853 - RNA, 16 nt, Homo sapiens
agguggaaaaacugag

SEQ ID NO: 1306854 - RNA, 20 nt, Homo sapiens
aggugggaggauugcuugag

SEQ ID NO: 1306855 - RNA, 16 nt, Homo sapiens
agguggggacagggau

SEQ ID NO: 1306856 - RNA, 19 nt, Homo sapiens
aggugucuuaauacugucc

SEQ ID NO: 1306857 - RNA, 20 nt, Homo sapiens
aggugucuucuuugacuuaa

SEQ ID NO: 1306858 - RNA, 16 nt, Homo sapiens
agguuaaacugaagca

SEQ ID NO: 1306859 - RNA, 13 nt, Homo sapiens
agguuaaggcaua

SEQ ID NO: 1306860 - RNA, 21 nt, Homo sapiens
agguuaauaaagaugauugaa

SEQ ID NO: 1306861 - RNA, 11 nt, Homo sapiens
agguucaagac

SEQ ID NO: 1306862 - RNA, 18 nt, Homo sapiens
agguucauggauuacuuc

SEQ ID NO: 1306863 - RNA, 17 nt, Homo sapiens
agguugagcaauuuccc

SEQ ID NO: 1306864 - RNA, 19 nt, Homo sapiens
agguuggaacuaugcagug

SEQ ID NO: 1306865 - RNA, 17 nt, Homo sapiens
agguuggugaauuucac

SEQ ID NO: 1306866 - RNA, 15 nt, Homo sapiens
agguuugccagcauu

SEQ ID NO: 1306867 - RNA, 15 nt, Homo sapiens
agguuuuuacuguga

SEQ ID NO: 1306868 - RNA, 22 nt, Homo sapiens
aguaaauaucccaaacugugau

SEQ ID NO: 1306869 - RNA, 20 nt, Homo sapiens
aguaaaucuuuuacaacugc

SEQ ID NO: 1306870 - RNA, 11 nt, Homo sapiens
aguaacaugug

SEQ ID NO: 1306871 - RNA, 15 nt, Homo sapiens
aguaacauuaacuca

SEQ ID NO: 1306872 - RNA, 15 nt, Homo sapiens
aguaacuccccucag

SEQ ID NO: 1306873 - RNA, 11 nt, Homo sapiens
aguaagagcuu

SEQ ID NO: 1306874 - RNA, 12 nt, Homo sapiens
aguaagccucau

SEQ ID NO: 1306875 - RNA, 19 nt, Homo sapiens
aguaaucuaauauggccac

SEQ ID NO: 1306876 - RNA, 21 nt, Homo sapiens
aguaaucuuuggcuguaaggc

SEQ ID NO: 1306877 - RNA, 17 nt, Homo sapiens
aguacaggcagcacaga

SEQ ID NO: 1306878 - RNA, 13 nt, Homo sapiens
aguacaggugaag

SEQ ID NO: 1306879 - RNA, 19 nt, Homo sapiens
aguaccaacucuccaaaac

SEQ ID NO: 1306880 - RNA, 22 nt, Homo sapiens
aguaccaccccucucuccccac

SEQ ID NO: 1306881 - RNA, 23 nt, Homo sapiens
aguacucuacaauuccucugaua

SEQ ID NO: 1306882 - RNA, 15 nt, Homo sapiens
aguacuuacaucagg

SEQ ID NO: 1306883 - RNA, 17 nt, Homo sapiens
aguagaaaggccuuuaa

SEQ ID NO: 1306884 - RNA, 20 nt, Homo sapiens
aguagcugggacuacaggca

SEQ ID NO: 1306885 - RNA, 21 nt, Homo sapiens
aguagcugggauuacaggugu

SEQ ID NO: 1306886 - RNA, 22 nt, Homo sapiens
aguauaaauaaaaugagcaaaa

SEQ ID NO: 1306887 - RNA, 22 nt, Homo sapiens
aguauauaacgcaggccuuuua

SEQ ID NO: 1306888 - RNA, 16 nt, Homo sapiens
aguauauguugcaaaa

SEQ ID NO: 1306889 - RNA, 21 nt, Homo sapiens
aguaugguaauuaaauguacu

SEQ ID NO: 1306890 - RNA, 12 nt, Homo sapiens
aguauuacaaau

SEQ ID NO: 1306891 - RNA, 22 nt, Homo sapiens
aguauuaucauugcuccccuga

SEQ ID NO: 1306892 - RNA, 21 nt, Homo sapiens
aguauuauuaauacuaugcaa

SEQ ID NO: 1306893 - RNA, 23 nt, Homo sapiens
aguauuuauugcaggaugguguc

SEQ ID NO: 1306894 - RNA, 21 nt, Homo sapiens
agucaaauuuguaaaucuuau

SEQ ID NO: 1306895 - RNA, 22 nt, Homo sapiens
agucaagcuguugaagucucag

SEQ ID NO: 1306896 - RNA, 12 nt, Homo sapiens
agucacacagug

SEQ ID NO: 1306897 - RNA, 13 nt, Homo sapiens
agucacacagugu

SEQ ID NO: 1306898 - RNA, 18 nt, Homo sapiens
agucaccagccagaggau

SEQ ID NO: 1306899 - RNA, 14 nt, Homo sapiens
agucacgccugaaa

SEQ ID NO: 1306900 - RNA, 12 nt, Homo sapiens
agucacugugag

SEQ ID NO: 1306901 - RNA, 15 nt, Homo sapiens
agucagaacagccag

SEQ ID NO: 1306902 - RNA, 22 nt, Homo sapiens
agucagaauuagcugcuucuau

SEQ ID NO: 1306903 - RNA, 15 nt, Homo sapiens
agucaggcccggccu

SEQ ID NO: 1306904 - RNA, 18 nt, Homo sapiens
agucagguuugaguagag

SEQ ID NO: 1306905 - RNA, 21 nt, Homo sapiens
agucaguucucauuauucaca

SEQ ID NO: 1306906 - RNA, 20 nt, Homo sapiens
agucaugcaaaggcugggac

SEQ ID NO: 1306907 - RNA, 20 nt, Homo sapiens
agucauggcccaaauccagu

SEQ ID NO: 1306908 - RNA, 13 nt, Homo sapiens
agucaugugccua

SEQ ID NO: 1306909 - RNA, 23 nt, Homo sapiens
agucauucagcagcaaauuuuca

SEQ ID NO: 1306910 - RNA, 20 nt, Homo sapiens
aguccaaggaaaccacagcu

SEQ ID NO: 1306911 - RNA, 14 nt, Homo sapiens
aguccaauuccuug

SEQ ID NO: 1306912 - RNA, 21 nt, Homo sapiens
agucccuaaaaacacagacau

SEQ ID NO: 1306913 - RNA, 20 nt, Homo sapiens
agucccuguccggaaugcca

SEQ ID NO: 1306914 - RNA, 18 nt, Homo sapiens
agucccuuugugacuuca

SEQ ID NO: 1306915 - RNA, 21 nt, Homo sapiens
aguccuuaaaaaucacacugu

SEQ ID NO: 1306916 - RNA, 13 nt, Homo sapiens
aguccuuauguua

SEQ ID NO: 1306917 - RNA, 20 nt, Homo sapiens
aguccuuauguuaagcccug

SEQ ID NO: 1306918 - RNA, 21 nt, Homo sapiens
aguccuugcggccccuggaau

SEQ ID NO: 1306919 - RNA, 13 nt, Homo sapiens
agucggagccacu

SEQ ID NO: 1306920 - RNA, 14 nt, Homo sapiens
auacagucuuccac

SEQ ID NO: 1306921 - RNA, 17 nt, Homo sapiens
auacaguuugucacaug

SEQ ID NO: 1306922 - RNA, 17 nt, Homo sapiens
auacauaucuuuauuaa

SEQ ID NO: 1306923 - RNA, 16 nt, Homo sapiens
auacauccauuuugau

SEQ ID NO: 1306924 - RNA, 16 nt, Homo sapiens
auacauucugcuuuca

SEQ ID NO: 1306925 - RNA, 21 nt, Homo sapiens
auacauugauucaugucucac

SEQ ID NO: 1306926 - RNA, 10 nt, Homo sapiens
auaccaaaug

SEQ ID NO: 1306927 - RNA, 21 nt, Homo sapiens
auaccauguauucacacuuua

SEQ ID NO: 1306928 - RNA, 19 nt, Homo sapiens
auacuauauuuauacugua

SEQ ID NO: 1306929 - RNA, 15 nt, Homo sapiens
auacucuagaugaag

SEQ ID NO: 1306930 - RNA, 14 nt, Homo sapiens
auacugaauauuga

SEQ ID NO: 1306931 - RNA, 14 nt, Homo sapiens
auacuguaugcagu

SEQ ID NO: 1306932 - RNA, 16 nt, Homo sapiens
auacugugugcuaaaa

SEQ ID NO: 1306933 - RNA, 11 nt, Homo sapiens
auacuuccuua

SEQ ID NO: 1306934 - RNA, 17 nt, Homo sapiens
auacuugaagggccaga

SEQ ID NO: 1306935 - RNA, 18 nt, Homo sapiens
auacuuugcauauugucu

SEQ ID NO: 1306936 - RNA, 14 nt, Homo sapiens
auagaaaaaccaaa

SEQ ID NO: 1306937 - RNA, 12 nt, Homo sapiens
auagagugaaau

SEQ ID NO: 1306938 - RNA, 17 nt, Homo sapiens
auagauaggucagugca

SEQ ID NO: 1306939 - RNA, 15 nt, Homo sapiens
auagcaagaucccau

SEQ ID NO: 1306940 - RNA, 14 nt, Homo sapiens
auagcaagugaaag

SEQ ID NO: 1306941 - RNA, 15 nt, Homo sapiens
auagcaagugaaagc

SEQ ID NO: 1306942 - RNA, 14 nt, Homo sapiens
auagcagcugcuac

SEQ ID NO: 1306943 - RNA, 17 nt, Homo sapiens
auagcaucuguacaaag

SEQ ID NO: 1306944 - RNA, 18 nt, Homo sapiens
auagccagagagcccaug

SEQ ID NO: 1306945 - RNA, 14 nt, Homo sapiens
auagcugagguaaa

SEQ ID NO: 1306946 - RNA, 13 nt, Homo sapiens
auaggcaauaaua

SEQ ID NO: 1306947 - RNA, 19 nt, Homo sapiens
auagggagcagaugcaaug

SEQ ID NO: 1306948 - RNA, 21 nt, Homo sapiens
aucucacuggaugcaaagaaa

SEQ ID NO: 1306949 - RNA, 12 nt, Homo sapiens
aucucagugcag

SEQ ID NO: 1306950 - RNA, 16 nt, Homo sapiens
aucucauccaucacag

SEQ ID NO: 1306951 - RNA, 22 nt, Homo sapiens
aucucaugccccuggcugggac

SEQ ID NO: 1306952 - RNA, 16 nt, Homo sapiens
aucucauuacugcuuc

SEQ ID NO: 1306953 - RNA, 21 nt, Homo sapiens
aucuccaagugcggcacugca

SEQ ID NO: 1306954 - RNA, 16 nt, Homo sapiens
aucucccacacaagac

SEQ ID NO: 1306955 - RNA, 15 nt, Homo sapiens
aucucggcucagugc

SEQ ID NO: 1306956 - RNA, 22 nt, Homo sapiens
aucucucccuccccugccauuu

SEQ ID NO: 1306957 - RNA, 15 nt, Homo sapiens
aucucugcuugaguc

SEQ ID NO: 1306958 - RNA, 17 nt, Homo sapiens
aucucuggaugccugau

SEQ ID NO: 1306959 - RNA, 19 nt, Homo sapiens
aucucugucccacuuggca

SEQ ID NO: 1306960 - RNA, 17 nt, Homo sapiens
aucucuuauuuuacaau

SEQ ID NO: 1306961 - RNA, 14 nt, Homo sapiens
aucucuuccuugac

SEQ ID NO: 1306962 - RNA, 18 nt, Homo sapiens
aucugacaugauuccuuc

SEQ ID NO: 1306963 - RNA, 13 nt, Homo sapiens
aucugacccagug

SEQ ID NO: 1306964 - RNA, 17 nt, Homo sapiens
aucuggguucacugcaa

SEQ ID NO: 1306965 - RNA, 11 nt, Homo sapiens
aucuguuccuu

SEQ ID NO: 1306966 - RNA, 19 nt, Homo sapiens
aucuuaauauaaauucacu

SEQ ID NO: 1306967 - RNA, 23 nt, Homo sapiens
aucuuccuuuguugcacaaauag

SEQ ID NO: 1306968 - RNA, 20 nt, Homo sapiens
aucuucuaaacccaauccaa

SEQ ID NO: 1306969 - RNA, 16 nt, Homo sapiens
aucuucuucaccauuu

SEQ ID NO: 1306970 - RNA, 19 nt, Homo sapiens
aucuugaccaagcaggaag

SEQ ID NO: 1306971 - RNA, 14 nt, Homo sapiens
aucuugaggacuuu

SEQ ID NO: 1306972 - RNA, 15 nt, Homo sapiens
aucuugauaccaccu

SEQ ID NO: 1306973 - RNA, 18 nt, Homo sapiens
aucuugcaacucuguaaa

SEQ ID NO: 1306974 - RNA, 13 nt, Homo sapiens
aucuugcuggcua

SEQ ID NO: 1306975 - RNA, 21 nt, Homo sapiens
aucuuuccucuccuacaaaga

SEQ ID NO: 1306976 - RNA, 15 nt, Homo sapiens
aucuuucuuguuuca

SEQ ID NO: 1306977 - RNA, 18 nt, Homo sapiens
augaaaaaaaaaugggaa

SEQ ID NO: 1306978 - RNA, 18 nt, Homo sapiens
augaaaccacaugagaag

SEQ ID NO: 1306979 - RNA, 14 nt, Homo sapiens
augaaaguggacaa

SEQ ID NO: 1306980 - RNA, 19 nt, Homo sapiens
augaaauaugugaagccca

SEQ ID NO: 1306981 - RNA, 20 nt, Homo sapiens
augaaauuauaaucugugga

SEQ ID NO: 1306982 - RNA, 21 nt, Homo sapiens
augaacaucuuuagugucuga

SEQ ID NO: 1306983 - RNA, 14 nt, Homo sapiens
augaacuuuccaca

SEQ ID NO: 1306984 - RNA, 22 nt, Homo sapiens
augaagacaucuuauccauccu

SEQ ID NO: 1306985 - RNA, 15 nt, Homo sapiens
augaagagcuaauuu

SEQ ID NO: 1306986 - RNA, 21 nt, Homo sapiens
augaauauauuuaagcaacau

SEQ ID NO: 1306987 - RNA, 20 nt, Homo sapiens
augaauucuaaaccaaucaa

SEQ ID NO: 1306988 - RNA, 21 nt, Homo sapiens
augaauucuuaagacuugcau

SEQ ID NO: 1306989 - RNA, 21 nt, Homo sapiens
augaauuugagcaggucucau

SEQ ID NO: 1306990 - RNA, 19 nt, Homo sapiens
augaauuuuuuucaucuuc

SEQ ID NO: 1306991 - RNA, 13 nt, Homo sapiens
augacagccagag

SEQ ID NO: 1306992 - RNA, 11 nt, Homo sapiens
augacagugaa

SEQ ID NO: 1306993 - RNA, 14 nt, Homo sapiens
augacaucagcaau

SEQ ID NO: 1306994 - RNA, 19 nt, Homo sapiens
augacaucagcaauacaga

SEQ ID NO: 1306995 - RNA, 14 nt, Homo sapiens
augacauugcauuu

SEQ ID NO: 1306996 - RNA, 13 nt, Homo sapiens
augacugcacaug

SEQ ID NO: 1306997 - RNA, 22 nt, Homo sapiens
augagaauuugagugcucugau

SEQ ID NO: 1306998 - RNA, 13 nt, Homo sapiens
augagagggccca

SEQ ID NO: 1306999 - RNA, 12 nt, Homo sapiens
augagauggauc

SEQ ID NO: 1307000 - RNA, 11 nt, Homo sapiens
augagccauga

SEQ ID NO: 1307001 - RNA, 19 nt, Homo sapiens
augaggacaagagggacaa

SEQ ID NO: 1307002 - RNA, 19 nt, Homo sapiens
augaggccuacucuaaaga

SEQ ID NO: 1307003 - RNA, 16 nt, Homo sapiens
augagguggagagugg

SEQ ID NO: 1307004 - RNA, 17 nt, Homo sapiens
augaguaauacaucaaa

SEQ ID NO: 1307005 - RNA, 13 nt, Homo sapiens
augagucagucaa

SEQ ID NO: 1307006 - RNA, 20 nt, Homo sapiens
augaguggagguuaaggcug

SEQ ID NO: 1307007 - RNA, 19 nt, Homo sapiens
augauaauauuguggugcc

SEQ ID NO: 1307008 - RNA, 22 nt, Homo sapiens
augauacuuggaugcagcucuu

SEQ ID NO: 1307009 - RNA, 22 nt, Homo sapiens
augaucaaguccuuugugaaua

SEQ ID NO: 1307010 - RNA, 17 nt, Homo sapiens
augaucuggauccacca

SEQ ID NO: 1307011 - RNA, 18 nt, Homo sapiens
augaugagaaauggaugu

SEQ ID NO: 1307012 - RNA, 16 nt, Homo sapiens
augaugagaagcagaa

SEQ ID NO: 1307013 - RNA, 15 nt, Homo sapiens
augauucaagccauu

SEQ ID NO: 1307014 - RNA, 20 nt, Homo sapiens
augauucaagccauuccaaa

SEQ ID NO: 1307015 - RNA, 14 nt, Homo sapiens
augcaaacugugcu

SEQ ID NO: 1307016 - RNA, 22 nt, Homo sapiens
augcaagaacucaucacugugg

SEQ ID NO: 1307017 - RNA, 13 nt, Homo sapiens
augcaagacccca

SEQ ID NO: 1307018 - RNA, 15 nt, Homo sapiens
augcaagggacugug

SEQ ID NO: 1307019 - RNA, 21 nt, Homo sapiens
augcagugcucgcuguugcug

SEQ ID NO: 1307020 - RNA, 14 nt, Homo sapiens
augcagugugcucc

SEQ ID NO: 1307021 - RNA, 15 nt, Homo sapiens
augcaguucugagca

SEQ ID NO: 1307022 - RNA, 14 nt, Homo sapiens
augcauaaaugcga

SEQ ID NO: 1307023 - RNA, 20 nt, Homo sapiens
augcauagccuggacacaga

SEQ ID NO: 1307024 - RNA, 16 nt, Homo sapiens
augcauggugccccag

SEQ ID NO: 1307025 - RNA, 21 nt, Homo sapiens
augcauggugccccaggacca

SEQ ID NO: 1307026 - RNA, 20 nt, Homo sapiens
augcauguuuuccagcuccu

SEQ ID NO: 1307027 - RNA, 17 nt, Homo sapiens
augccaagcacugugcu

SEQ ID NO: 1307028 - RNA, 14 nt, Homo sapiens
augcccccucagug

SEQ ID NO: 1307029 - RNA, 22 nt, Homo sapiens
augccuuaaaccuaccucccac

SEQ ID NO: 1307030 - RNA, 15 nt, Homo sapiens
augcgcagugccuug

SEQ ID NO: 1307031 - RNA, 21 nt, Homo sapiens
augcuaagaaugcauuauuga

SEQ ID NO: 1307032 - RNA, 16 nt, Homo sapiens
augcuacaaucugugu

SEQ ID NO: 1307033 - RNA, 17 nt, Homo sapiens
augcucuccaaaccacu

SEQ ID NO: 1307034 - RNA, 17 nt, Homo sapiens
augcucugaacccugag

SEQ ID NO: 1307035 - RNA, 20 nt, Homo sapiens
augcugacagcucuucacag

SEQ ID NO: 1307036 - RNA, 19 nt, Homo sapiens
augcuggaaccugcaaaaa

SEQ ID NO: 1307037 - RNA, 20 nt, Homo sapiens
augcuggaaccugcaaaaaa

SEQ ID NO: 1307038 - RNA, 23 nt, Homo sapiens
augcuggcauuugcaccuaccuc

SEQ ID NO: 1307039 - RNA, 16 nt, Homo sapiens
augcuggcuguuggcu

SEQ ID NO: 1307040 - RNA, 20 nt, Homo sapiens
augcugggcuguuuacuuua

SEQ ID NO: 1307041 - RNA, 17 nt, Homo sapiens
augcugugauaccuuag

SEQ ID NO: 1307042 - RNA, 14 nt, Homo sapiens
augcuuauaggugg

SEQ ID NO: 1307043 - RNA, 18 nt, Homo sapiens
auggaaacaucacugggg

SEQ ID NO: 1307044 - RNA, 18 nt, Homo sapiens
auggaaauguagugcucg

SEQ ID NO: 1307045 - RNA, 16 nt, Homo sapiens
auggaacacggccaca

SEQ ID NO: 1307046 - RNA, 15 nt, Homo sapiens
auggaacagcauuac

SEQ ID NO: 1307047 - RNA, 13 nt, Homo sapiens
auggaaucagauu

SEQ ID NO: 1307048 - RNA, 19 nt, Homo sapiens
auggaaugugauguucaug

SEQ ID NO: 1307049 - RNA, 23 nt, Homo sapiens
auggacagacagaggaugagcuc

SEQ ID NO: 1307050 - RNA, 17 nt, Homo sapiens
auggagcaugaauggua

SEQ ID NO: 1307051 - RNA, 16 nt, Homo sapiens
auggaggcgcugcugc

SEQ ID NO: 1307052 - RNA, 23 nt, Homo sapiens
auggcaacagaucuggaaccuca

SEQ ID NO: 1307053 - RNA, 15 nt, Homo sapiens
auggcagugaugaau

SEQ ID NO: 1307054 - RNA, 13 nt, Homo sapiens
auggccacugggu

SEQ ID NO: 1307055 - RNA, 18 nt, Homo sapiens
auggcccaaauccagugu

SEQ ID NO: 1307056 - RNA, 17 nt, Homo sapiens
auggcccugcaaaagga

SEQ ID NO: 1307057 - RNA, 15 nt, Homo sapiens
auggcuaauaccugu

SEQ ID NO: 1307058 - RNA, 17 nt, Homo sapiens
auguauucacacuuuaa

SEQ ID NO: 1307059 - RNA, 18 nt, Homo sapiens
augucaacagagcaagga

SEQ ID NO: 1307060 - RNA, 17 nt, Homo sapiens
augucagaggccccaug

SEQ ID NO: 1307061 - RNA, 14 nt, Homo sapiens
augucauauuccau

SEQ ID NO: 1307062 - RNA, 14 nt, Homo sapiens
augucuagcuuuca

SEQ ID NO: 1307063 - RNA, 13 nt, Homo sapiens
augucucugcaaa

SEQ ID NO: 1307064 - RNA, 21 nt, Homo sapiens
augucucuuuggcgaccuccu

SEQ ID NO: 1307065 - RNA, 17 nt, Homo sapiens
augucuguuugcugaug

SEQ ID NO: 1307066 - RNA, 14 nt, Homo sapiens
augugaaagucaaa

SEQ ID NO: 1307067 - RNA, 20 nt, Homo sapiens
augugaaccauuaaccagau

SEQ ID NO: 1307068 - RNA, 17 nt, Homo sapiens
augugaagacaccugca

SEQ ID NO: 1307069 - RNA, 17 nt, Homo sapiens
augugacaugcccaagg

SEQ ID NO: 1307070 - RNA, 21 nt, Homo sapiens
augugagugccuuuugcagaa

SEQ ID NO: 1307071 - RNA, 11 nt, Homo sapiens
augugaugaau

SEQ ID NO: 1307072 - RNA, 14 nt, Homo sapiens
augugauugcagcu

SEQ ID NO: 1307073 - RNA, 15 nt, Homo sapiens
augugcaaccacugc

SEQ ID NO: 1307074 - RNA, 18 nt, Homo sapiens
augugcaaccacugcuuc

SEQ ID NO: 1307075 - RNA, 21 nt, Homo sapiens
augugccgauccuugucaaaa

SEQ ID NO: 1307076 - RNA, 23 nt, Homo sapiens
augugccuguagucccaggcuga

SEQ ID NO: 1307077 - RNA, 16 nt, Homo sapiens
augugcugagcauuuu

SEQ ID NO: 1307078 - RNA, 22 nt, Homo sapiens
auguggcaaggaaaaacagguc

SEQ ID NO: 1307079 - RNA, 15 nt, Homo sapiens
augugggaguggaac

SEQ ID NO: 1307080 - RNA, 14 nt, Homo sapiens
augugguugcauaa

SEQ ID NO: 1307081 - RNA, 13 nt, Homo sapiens
augugucaguuca

SEQ ID NO: 1307082 - RNA, 17 nt, Homo sapiens
augugugugugugcaua

SEQ ID NO: 1307083 - RNA, 21 nt, Homo sapiens
augugugugugugcauaugca

SEQ ID NO: 1307084 - RNA, 11 nt, Homo sapiens
auguguugccc

SEQ ID NO: 1307085 - RNA, 15 nt, Homo sapiens
auguguuuuucacau

SEQ ID NO: 1307086 - RNA, 16 nt, Homo sapiens
auguuaaaaagugaaa

SEQ ID NO: 1307087 - RNA, 22 nt, Homo sapiens
auguuaauuuuuugguacaaaa

SEQ ID NO: 1307088 - RNA, 15 nt, Homo sapiens
auguuauagaacuuc

SEQ ID NO: 1307089 - RNA, 21 nt, Homo sapiens
auguucuacagaauauucucc

SEQ ID NO: 1307090 - RNA, 22 nt, Homo sapiens
auguugaagcucuuuacuguaa

SEQ ID NO: 1307091 - RNA, 14 nt, Homo sapiens
auguugaggugacc

SEQ ID NO: 1307092 - RNA, 20 nt, Homo sapiens
auguugaggugaccacuuaa

SEQ ID NO: 1307093 - RNA, 13 nt, Homo sapiens
auguuggggcccu

SEQ ID NO: 1307094 - RNA, 19 nt, Homo sapiens
auguuuagaaaaguauucg

SEQ ID NO: 1307095 - RNA, 15 nt, Homo sapiens
auguuucgcugauau

SEQ ID NO: 1307096 - RNA, 23 nt, Homo sapiens
auguuucgugaaguauacuguau

SEQ ID NO: 1307097 - RNA, 20 nt, Homo sapiens
auguuuguaacuuuuuacau

SEQ ID NO: 1307098 - RNA, 16 nt, Homo sapiens
auguuugucucauccc

SEQ ID NO: 1307099 - RNA, 23 nt, Homo sapiens
auguuuguuguauacuuccuuau

SEQ ID NO: 1307100 - RNA, 14 nt, Homo sapiens
auuaaagacagagg

SEQ ID NO: 1307101 - RNA, 20 nt, Homo sapiens
auuaaagugaauuguugaca

SEQ ID NO: 1307102 - RNA, 13 nt, Homo sapiens
auuaaauguacuu

SEQ ID NO: 1307103 - RNA, 14 nt, Homo sapiens
auuaaauucacaaa

SEQ ID NO: 1307104 - RNA, 12 nt, Homo sapiens
auuaacaugaug

SEQ ID NO: 1307105 - RNA, 17 nt, Homo sapiens
auuaacaugauguacua

SEQ ID NO: 1307106 - RNA, 16 nt, Homo sapiens
auuaagagcaauucaa

SEQ ID NO: 1307107 - RNA, 18 nt, Homo sapiens
auuaaggauguagcuuuu

SEQ ID NO: 1307108 - RNA, 23 nt, Homo sapiens
auuaaggucauuacucucaacca

SEQ ID NO: 1307109 - RNA, 23 nt, Homo sapiens
auuaaguaaaagucuguaaauau

SEQ ID NO: 1307110 - RNA, 14 nt, Homo sapiens
auuaaguguuuaaa

SEQ ID NO: 1307111 - RNA, 18 nt, Homo sapiens
auuaauaaucuuauuagg

SEQ ID NO: 1307112 - RNA, 20 nt, Homo sapiens
auuaaucuaccuugcagugu

SEQ ID NO: 1307113 - RNA, 18 nt, Homo sapiens
auuaaugcuaucaaucau

SEQ ID NO: 1307114 - RNA, 13 nt, Homo sapiens
auuaauguagcug

SEQ ID NO: 1307115 - RNA, 16 nt, Homo sapiens
auuaauuaaagcaaau

SEQ ID NO: 1307116 - RNA, 20 nt, Homo sapiens
auuaauucuauaaggccaua

SEQ ID NO: 1307117 - RNA, 18 nt, Homo sapiens
auuaauuuuuaaggaugu

SEQ ID NO: 1307118 - RNA, 23 nt, Homo sapiens
auuacaaaugguuaccuuguuau

SEQ ID NO: 1307119 - RNA, 16 nt, Homo sapiens
auuacaacuagaucaa

SEQ ID NO: 1307120 - RNA, 23 nt, Homo sapiens
auuacaggugugaaccaccacac

SEQ ID NO: 1307121 - RNA, 14 nt, Homo sapiens
auuacauaguuuga

SEQ ID NO: 1307122 - RNA, 20 nt, Homo sapiens
auuacaugaaaguucagauu

SEQ ID NO: 1307123 - RNA, 19 nt, Homo sapiens
auuacccccuccuucagac

SEQ ID NO: 1307124 - RNA, 17 nt, Homo sapiens
auuacuauaagaacuuu

SEQ ID NO: 1307125 - RNA, 15 nt, Homo sapiens
auuagaaguuaccaa

SEQ ID NO: 1307126 - RNA, 15 nt, Homo sapiens
auuagaaucugagua

SEQ ID NO: 1307127 - RNA, 16 nt, Homo sapiens
auuagaaucugaguau

SEQ ID NO: 1307128 - RNA, 18 nt, Homo sapiens
auuagccgggcauggugg

SEQ ID NO: 1307129 - RNA, 23 nt, Homo sapiens
auuagggcaaggugugguagcuc

SEQ ID NO: 1307130 - RNA, 17 nt, Homo sapiens
auuaggucucuguugac

SEQ ID NO: 1307131 - RNA, 23 nt, Homo sapiens
auuagugguuuaucagcaaaaaa

SEQ ID NO: 1307132 - RNA, 16 nt, Homo sapiens
auuauaacauccacaa

SEQ ID NO: 1307133 - RNA, 23 nt, Homo sapiens
auuauacgcuggcaacacagagg

SEQ ID NO: 1307134 - RNA, 17 nt, Homo sapiens
auuauaugcacuagcaa

SEQ ID NO: 1307135 - RNA, 16 nt, Homo sapiens
auuaucaacagcauuu

SEQ ID NO: 1307136 - RNA, 16 nt, Homo sapiens
auuauccauucccaag

SEQ ID NO: 1307137 - RNA, 21 nt, Homo sapiens
auuaugggauugcaaccagca

SEQ ID NO: 1307138 - RNA, 13 nt, Homo sapiens
auuauuaauugca

SEQ ID NO: 1307139 - RNA, 16 nt, Homo sapiens
auucaaacugcuccaa

SEQ ID NO: 1307140 - RNA, 18 nt, Homo sapiens
auucaagguuuguucaac

SEQ ID NO: 1307141 - RNA, 20 nt, Homo sapiens
auucacccccaaacagugac

SEQ ID NO: 1307142 - RNA, 18 nt, Homo sapiens
auucaccugcccugugca

SEQ ID NO: 1307143 - RNA, 16 nt, Homo sapiens
auucaggauuacaugc

SEQ ID NO: 1307144 - RNA, 15 nt, Homo sapiens
auucaguauuacaaa

SEQ ID NO: 1307145 - RNA, 21 nt, Homo sapiens
auucagugcagcauauacaau

SEQ ID NO: 1307146 - RNA, 13 nt, Homo sapiens
auucauacauuau

SEQ ID NO: 1307147 - RNA, 23 nt, Homo sapiens
auucaugaaaacuguuuuuacua

SEQ ID NO: 1307148 - RNA, 23 nt, Homo sapiens
auucaugaagcggucacagauca

SEQ ID NO: 1307149 - RNA, 12 nt, Homo sapiens
auuccaaagcaa

SEQ ID NO: 1307150 - RNA, 13 nt, Homo sapiens
auuccaaagcaaa

SEQ ID NO: 1307151 - RNA, 14 nt, Homo sapiens
auuccaaaguucaa

SEQ ID NO: 1307152 - RNA, 22 nt, Homo sapiens
auuccaggaggaguuagccaaa

SEQ ID NO: 1307153 - RNA, 18 nt, Homo sapiens
auuccauuuccaguucau

SEQ ID NO: 1307154 - RNA, 19 nt, Homo sapiens
auuccauuugggucagccu

SEQ ID NO: 1307155 - RNA, 14 nt, Homo sapiens
auucccaagugaau

SEQ ID NO: 1307156 - RNA, 14 nt, Homo sapiens
auucccacugccag

SEQ ID NO: 1307157 - RNA, 13 nt, Homo sapiens
auucccacugccg

SEQ ID NO: 1307158 - RNA, 15 nt, Homo sapiens
auuccccaucucagg

SEQ ID NO: 1307159 - RNA, 16 nt, Homo sapiens
auucccuccugcuacu

SEQ ID NO: 1307160 - RNA, 14 nt, Homo sapiens
auucccuuuaugca

SEQ ID NO: 1307161 - RNA, 19 nt, Homo sapiens
auuccguugucuguggaug

SEQ ID NO: 1307162 - RNA, 20 nt, Homo sapiens
auuccuauauaguuuauuga

SEQ ID NO: 1307163 - RNA, 16 nt, Homo sapiens
auuccuuagaaauuag

SEQ ID NO: 1307164 - RNA, 19 nt, Homo sapiens
auuccuucucccaucucuu

SEQ ID NO: 1307165 - RNA, 12 nt, Homo sapiens
auuccuugcaca

SEQ ID NO: 1307166 - RNA, 15 nt, Homo sapiens
auuccuuuucccaac

SEQ ID NO: 1307167 - RNA, 17 nt, Homo sapiens
auucgcugugucagcau

SEQ ID NO: 1307168 - RNA, 16 nt, Homo sapiens
auucuacucaaaguca

SEQ ID NO: 1307169 - RNA, 16 nt, Homo sapiens
auucucagguugucag

SEQ ID NO: 1307170 - RNA, 12 nt, Homo sapiens
auucuccacagc

SEQ ID NO: 1307171 - RNA, 21 nt, Homo sapiens
auucuccauguacuggcaaga

SEQ ID NO: 1307172 - RNA, 20 nt, Homo sapiens
auucucccauaaacacugaa

SEQ ID NO: 1307173 - RNA, 17 nt, Homo sapiens
auucucgcuucccugaa

SEQ ID NO: 1307174 - RNA, 22 nt, Homo sapiens
auucucuaauaagaaaaccacc

SEQ ID NO: 1307175 - RNA, 17 nt, Homo sapiens
auucucugucucaucca

SEQ ID NO: 1307176 - RNA, 16 nt, Homo sapiens
auucugaauuugcaaa

SEQ ID NO: 1307177 - RNA, 17 nt, Homo sapiens
auucugauaaugcucac

SEQ ID NO: 1307178 - RNA, 14 nt, Homo sapiens
auucugcagccaca

SEQ ID NO: 1307179 - RNA, 15 nt, Homo sapiens
auucugcauuuagcu

SEQ ID NO: 1307180 - RNA, 15 nt, Homo sapiens
auucugucacccaga

SEQ ID NO: 1307181 - RNA, 18 nt, Homo sapiens
auucuguuggccagugug

SEQ ID NO: 1307182 - RNA, 18 nt, Homo sapiens
auucuuuauacauucuag

SEQ ID NO: 1307183 - RNA, 20 nt, Homo sapiens
auucuuuugaauuguuacau

SEQ ID NO: 1307184 - RNA, 16 nt, Homo sapiens
auugaaguaaacugca

SEQ ID NO: 1307185 - RNA, 18 nt, Homo sapiens
auugaggauaaauugcca

SEQ ID NO: 1307186 - RNA, 15 nt, Homo sapiens
auugagggucauucu

SEQ ID NO: 1307187 - RNA, 13 nt, Homo sapiens
auugcaaccagca

SEQ ID NO: 1307188 - RNA, 16 nt, Homo sapiens
auugcacauuguucaa

SEQ ID NO: 1307189 - RNA, 15 nt, Homo sapiens
auugcacuccagucu

SEQ ID NO: 1307190 - RNA, 15 nt, Homo sapiens
auugcagaguacugg

SEQ ID NO: 1307191 - RNA, 21 nt, Homo sapiens
auugcucuugagucuuugcag

SEQ ID NO: 1307192 - RNA, 17 nt, Homo sapiens
caaagcugaauacauuc

SEQ ID NO: 1307193 - RNA, 16 nt, Homo sapiens
caaagcuuuauuucaa

SEQ ID NO: 1307194 - RNA, 15 nt, Homo sapiens
caaaggauacuguaa

SEQ ID NO: 1307195 - RNA, 18 nt, Homo sapiens
caaaggcugagaacacug

SEQ ID NO: 1307196 - RNA, 20 nt, Homo sapiens
caaaggcugagaacacugug

SEQ ID NO: 1307197 - RNA, 21 nt, Homo sapiens
caaaggcugagaacacuguga

SEQ ID NO: 1307198 - RNA, 19 nt, Homo sapiens
caaagggcacagcaucugu

SEQ ID NO: 1307199 - RNA, 16 nt, Homo sapiens
caaaggugauggucau

SEQ ID NO: 1307200 - RNA, 22 nt, Homo sapiens
caaagguuccauucagugcagc

SEQ ID NO: 1307201 - RNA, 19 nt, Homo sapiens
caaaguaacagccuuucaa

SEQ ID NO: 1307202 - RNA, 17 nt, Homo sapiens
caaaguacuguaagaau

SEQ ID NO: 1307203 - RNA, 12 nt, Homo sapiens
caaagugaggag

SEQ ID NO: 1307204 - RNA, 11 nt, Homo sapiens
caaaguuggcg

SEQ ID NO: 1307205 - RNA, 15 nt, Homo sapiens
caaauaaaaacccaa

SEQ ID NO: 1307206 - RNA, 18 nt, Homo sapiens
caaauaaaauguucccua

SEQ ID NO: 1307207 - RNA, 23 nt, Homo sapiens
caaauaaaugggaaaaaaaugaa

SEQ ID NO: 1307208 - RNA, 17 nt, Homo sapiens
caaauaaguuacaucua

SEQ ID NO: 1307209 - RNA, 14 nt, Homo sapiens
caaauaaugaccau

SEQ ID NO: 1307210 - RNA, 21 nt, Homo sapiens
caaauacuugacucagugaua

SEQ ID NO: 1307211 - RNA, 17 nt, Homo sapiens
caaaucacgaccacuga

SEQ ID NO: 1307212 - RNA, 17 nt, Homo sapiens
caaauccuaugugauuu

SEQ ID NO: 1307213 - RNA, 16 nt, Homo sapiens
caaaucuugaaauuaa

SEQ ID NO: 1307214 - RNA, 20 nt, Homo sapiens
caaaugaaaaaauuaaaaag

SEQ ID NO: 1307215 - RNA, 14 nt, Homo sapiens
caaaugagccauga

SEQ ID NO: 1307216 - RNA, 16 nt, Homo sapiens
caaaugagccaugaga

SEQ ID NO: 1307217 - RNA, 14 nt, Homo sapiens
caaaugcccagcuu

SEQ ID NO: 1307218 - RNA, 13 nt, Homo sapiens
caaauggggccag

SEQ ID NO: 1307219 - RNA, 20 nt, Homo sapiens
caaaugguaggcauuuccua

SEQ ID NO: 1307220 - RNA, 14 nt, Homo sapiens
caaaugucaucagg

SEQ ID NO: 1307221 - RNA, 13 nt, Homo sapiens
caaaugugacauu

SEQ ID NO: 1307222 - RNA, 14 nt, Homo sapiens
caaauuacaaaagg

SEQ ID NO: 1307223 - RNA, 22 nt, Homo sapiens
caaauucgcugcaaccuguuga

SEQ ID NO: 1307224 - RNA, 14 nt, Homo sapiens
caaauugcagacug

SEQ ID NO: 1307225 - RNA, 21 nt, Homo sapiens
caaauuugauugauuugaaga

SEQ ID NO: 1307226 - RNA, 21 nt, Homo sapiens
caaauuuggguauagacaaua

SEQ ID NO: 1307227 - RNA, 23 nt, Homo sapiens
caacaaaggauuaauugcugcaa

SEQ ID NO: 1307228 - RNA, 17 nt, Homo sapiens
caacaagcaagcuccca

SEQ ID NO: 1307229 - RNA, 15 nt, Homo sapiens
caacaccaagcacag

SEQ ID NO: 1307230 - RNA, 22 nt, Homo sapiens
caacaccucugcacaagcugca

SEQ ID NO: 1307231 - RNA, 17 nt, Homo sapiens
caacaccuuaauaugcu

SEQ ID NO: 1307232 - RNA, 24 nt, Homo sapiens
caacacucacauuuauucugcuca

SEQ ID NO: 1307233 - RNA, 22 nt, Homo sapiens
caacacugcugcuccagugcag

SEQ ID NO: 1307234 - RNA, 18 nt, Homo sapiens
caacagaagcuuccauuc

SEQ ID NO: 1307235 - RNA, 15 nt, Homo sapiens
caacagcauuuucaa

SEQ ID NO: 1307236 - RNA, 16 nt, Homo sapiens
caacaggaaucucaga

SEQ ID NO: 1307237 - RNA, 20 nt, Homo sapiens
caacaggagcugggauccua

SEQ ID NO: 1307238 - RNA, 14 nt, Homo sapiens
caacagguguguuu

SEQ ID NO: 1307239 - RNA, 20 nt, Homo sapiens
caacauauaaaauaaugcaa

SEQ ID NO: 1307240 - RNA, 22 nt, Homo sapiens
caacaucuuuuuaaccugcaaa

SEQ ID NO: 1307241 - RNA, 22 nt, Homo sapiens
caacauuacagggaaugccuga

SEQ ID NO: 1307242 - RNA, 16 nt, Homo sapiens
caacauugugauguau

SEQ ID NO: 1307243 - RNA, 19 nt, Homo sapiens
caacauuuugagaacaaag

SEQ ID NO: 1307244 - RNA, 11 nt, Homo sapiens
caaccaaaauc

SEQ ID NO: 1307245 - RNA, 17 nt, Homo sapiens
caaccaauggaauguga

SEQ ID NO: 1307246 - RNA, 13 nt, Homo sapiens
caaccagcaaaac

SEQ ID NO: 1307247 - RNA, 17 nt, Homo sapiens
caaccccccagcacuga

SEQ ID NO: 1307248 - RNA, 14 nt, Homo sapiens
caacccgagucauu

SEQ ID NO: 1307249 - RNA, 16 nt, Homo sapiens
caaccuaauuaccugu

SEQ ID NO: 1307250 - RNA, 18 nt, Homo sapiens
caaccugccugacauuug

SEQ ID NO: 1307251 - RNA, 20 nt, Homo sapiens
caaccuuuauucuuuuccaa

SEQ ID NO: 1307252 - RNA, 12 nt, Homo sapiens
caacgccagaau

SEQ ID NO: 1307253 - RNA, 20 nt, Homo sapiens
caacuauauuaucaugcaaa

SEQ ID NO: 1307254 - RNA, 15 nt, Homo sapiens
caacucuuugagaaa

SEQ ID NO: 1307255 - RNA, 16 nt, Homo sapiens
caagaaacgucuucua

SEQ ID NO: 1307256 - RNA, 18 nt, Homo sapiens
caagaauagcaucuguac

SEQ ID NO: 1307257 - RNA, 18 nt, Homo sapiens
caagaaugggagguugau

SEQ ID NO: 1307258 - RNA, 20 nt, Homo sapiens
caagacucuuuggacacuca

SEQ ID NO: 1307259 - RNA, 22 nt, Homo sapiens
caagagcacuaggauugugaua

SEQ ID NO: 1307260 - RNA, 21 nt, Homo sapiens
caagauacugcuacuguaauu

SEQ ID NO: 1307261 - RNA, 14 nt, Homo sapiens
caagaucugaauuu

SEQ ID NO: 1307262 - RNA, 13 nt, Homo sapiens
caagcaagacuga

SEQ ID NO: 1307263 - RNA, 19 nt, Homo sapiens
caagcacaaagcucaagau

SEQ ID NO: 1307264 - RNA, 22 nt, Homo sapiens
caagcagugccugccuaugaaa

SEQ ID NO: 1307265 - RNA, 22 nt, Homo sapiens
caagcaugggggaccccuuccc

SEQ ID NO: 1307266 - RNA, 16 nt, Homo sapiens
caagccagcaugugug

SEQ ID NO: 1307267 - RNA, 18 nt, Homo sapiens
caagcccuguugacacag

SEQ ID NO: 1307268 - RNA, 17 nt, Homo sapiens
caagccugugcaaaaaa

SEQ ID NO: 1307269 - RNA, 20 nt, Homo sapiens
caagcgcuguaaacccugac

SEQ ID NO: 1307270 - RNA, 13 nt, Homo sapiens
caagcucccaagg

SEQ ID NO: 1307271 - RNA, 21 nt, Homo sapiens
caagcugccgaaccaaaagaa

SEQ ID NO: 1307272 - RNA, 21 nt, Homo sapiens
caagcugguggccucugcagg

SEQ ID NO: 1307273 - RNA, 20 nt, Homo sapiens
caaggaaaaacaggucuuca

SEQ ID NO: 1307274 - RNA, 23 nt, Homo sapiens
caaggagaagccccuacccugug

SEQ ID NO: 1307275 - RNA, 20 nt, Homo sapiens
caaggagcaugucacuccag

SEQ ID NO: 1307276 - RNA, 20 nt, Homo sapiens
caaggagggugagugcaagg

SEQ ID NO: 1307277 - RNA, 18 nt, Homo sapiens
caaggccagcacccaaag

SEQ ID NO: 1307278 - RNA, 22 nt, Homo sapiens
caaggcccauaucugugaaaug

SEQ ID NO: 1307279 - RNA, 17 nt, Homo sapiens
caaggccgcuucgccau

SEQ ID NO: 1307280 - RNA, 16 nt, Homo sapiens
caaggcugugcucccu

SEQ ID NO: 1307281 - RNA, 16 nt, Homo sapiens
caaggcuucagucuca

SEQ ID NO: 1307282 - RNA, 15 nt, Homo sapiens
caagggacccaugag

SEQ ID NO: 1307283 - RNA, 13 nt, Homo sapiens
caagggagaguga

SEQ ID NO: 1307284 - RNA, 17 nt, Homo sapiens
caagggaucugguccua

SEQ ID NO: 1307285 - RNA, 21 nt, Homo sapiens
caagguccucugucagucaca

SEQ ID NO: 1307286 - RNA, 18 nt, Homo sapiens
caaguaagaauguuaaaa

SEQ ID NO: 1307287 - RNA, 16 nt, Homo sapiens
caaguaagaucugaau

SEQ ID NO: 1307288 - RNA, 14 nt, Homo sapiens
caaguagcugcuac

SEQ ID NO: 1307289 - RNA, 14 nt, Homo sapiens
caaguauccaguca

SEQ ID NO: 1307290 - RNA, 21 nt, Homo sapiens
caaguauugucgguuaccucu

SEQ ID NO: 1307291 - RNA, 13 nt, Homo sapiens
caagucaccugca

SEQ ID NO: 1307292 - RNA, 22 nt, Homo sapiens
caagucccuuugugacuucaag

SEQ ID NO: 1307293 - RNA, 19 nt, Homo sapiens
caagucucacagauugcug

SEQ ID NO: 1307294 - RNA, 20 nt, Homo sapiens
caagucuuuacagaaucaaa

SEQ ID NO: 1307295 - RNA, 12 nt, Homo sapiens
caagugaagguu

SEQ ID NO: 1307296 - RNA, 16 nt, Homo sapiens
caaguuauacaucuug

SEQ ID NO: 1307297 - RNA, 13 nt, Homo sapiens
caaguugguccac

SEQ ID NO: 1307298 - RNA, 16 nt, Homo sapiens
caauaaaaacauugcc

SEQ ID NO: 1307299 - RNA, 19 nt, Homo sapiens
caauaaagccuucaaacuc

SEQ ID NO: 1307300 - RNA, 13 nt, Homo sapiens
caauaacauuccc

SEQ ID NO: 1307301 - RNA, 12 nt, Homo sapiens
caauaaugcagu

SEQ ID NO: 1307302 - RNA, 23 nt, Homo sapiens
caauaaugugacgaaaguggaaa

SEQ ID NO: 1307303 - RNA, 17 nt, Homo sapiens
caauaauugcagaacua

SEQ ID NO: 1307304 - RNA, 16 nt, Homo sapiens
caauaugugccaauca

SEQ ID NO: 1307305 - RNA, 15 nt, Homo sapiens
caauauguuuaucaa

SEQ ID NO: 1307306 - RNA, 22 nt, Homo sapiens
caauauucccggucagcaguau

SEQ ID NO: 1307307 - RNA, 18 nt, Homo sapiens
cgucuacugcaagagcca

SEQ ID NO: 1307308 - RNA, 14 nt, Homo sapiens
cgugaccagugcug

SEQ ID NO: 1307309 - RNA, 18 nt, Homo sapiens
cgugacccucugcugaag

SEQ ID NO: 1307310 - RNA, 16 nt, Homo sapiens
cgugaguggucuucaa

SEQ ID NO: 1307311 - RNA, 16 nt, Homo sapiens
cgugaucaaagccaca

SEQ ID NO: 1307312 - RNA, 22 nt, Homo sapiens
cgugauguggagggcacauucc

SEQ ID NO: 1307313 - RNA, 18 nt, Homo sapiens
cgugcccgugugcauguc

SEQ ID NO: 1307314 - RNA, 19 nt, Homo sapiens
cguggcuaagaguguccua

SEQ ID NO: 1307315 - RNA, 13 nt, Homo sapiens
cgugggcucccug

SEQ ID NO: 1307316 - RNA, 15 nt, Homo sapiens
cgugugacuacuccc

SEQ ID NO: 1307317 - RNA, 19 nt, Homo sapiens
cguuccuuccgaugacagu

SEQ ID NO: 1307318 - RNA, 20 nt, Homo sapiens
cuaaaaacacagacauucug

SEQ ID NO: 1307319 - RNA, 13 nt, Homo sapiens
cuaaaaauacaaa

SEQ ID NO: 1307320 - RNA, 17 nt, Homo sapiens
cuaaaacaaaagcucau

SEQ ID NO: 1307321 - RNA, 18 nt, Homo sapiens
cuaaaagaaaaaggaacu

SEQ ID NO: 1307322 - RNA, 18 nt, Homo sapiens
cuaaaagugggcuugauu

SEQ ID NO: 1307323 - RNA, 18 nt, Homo sapiens
cuaaaaguuguacuucau

SEQ ID NO: 1307324 - RNA, 23 nt, Homo sapiens
cuaaaauaagggcagagucacac

SEQ ID NO: 1307325 - RNA, 22 nt, Homo sapiens
cuaaaauuguaucaaaugugac

SEQ ID NO: 1307326 - RNA, 16 nt, Homo sapiens
cuaaaauuuaaugcau

SEQ ID NO: 1307327 - RNA, 16 nt, Homo sapiens
cuaaacaaugcugauu

SEQ ID NO: 1307328 - RNA, 21 nt, Homo sapiens
cuaaacaccacgucacuucau

SEQ ID NO: 1307329 - RNA, 16 nt, Homo sapiens
cuaaaccaacugaagg

SEQ ID NO: 1307330 - RNA, 18 nt, Homo sapiens
cuaaaccaaucaaauguc

SEQ ID NO: 1307331 - RNA, 16 nt, Homo sapiens
cuaaacccaauccaaa

SEQ ID NO: 1307332 - RNA, 16 nt, Homo sapiens
cuaaacccuguuccug

SEQ ID NO: 1307333 - RNA, 16 nt, Homo sapiens
cuaaacggauuccaaa

SEQ ID NO: 1307334 - RNA, 21 nt, Homo sapiens
cuaaacucauuuauaaagcua

SEQ ID NO: 1307335 - RNA, 23 nt, Homo sapiens
cuaaacucuuuuucauccaggcc

SEQ ID NO: 1307336 - RNA, 17 nt, Homo sapiens
cuaaagaagaucuguaa

SEQ ID NO: 1307337 - RNA, 21 nt, Homo sapiens
cuaaauaaauguaauagccaa

SEQ ID NO: 1307338 - RNA, 21 nt, Homo sapiens
cuaaauaaucuuacucuagau

SEQ ID NO: 1307339 - RNA, 15 nt, Homo sapiens
cuaaauacuugcucc

SEQ ID NO: 1307340 - RNA, 15 nt, Homo sapiens
cuaaaugggacccaa

SEQ ID NO: 1307341 - RNA, 19 nt, Homo sapiens
cuaacaagucaccaaaaga

SEQ ID NO: 1307342 - RNA, 21 nt, Homo sapiens
cuaacaagucaccaaaagaca

SEQ ID NO: 1307343 - RNA, 18 nt, Homo sapiens
cuaacacaguugacccua

SEQ ID NO: 1307344 - RNA, 17 nt, Homo sapiens
cuaacauguaauugcag

SEQ ID NO: 1307345 - RNA, 16 nt, Homo sapiens
cuaaccagccugguca

SEQ ID NO: 1307346 - RNA, 16 nt, Homo sapiens
cuaaccugaacugaug

SEQ ID NO: 1307347 - RNA, 21 nt, Homo sapiens
cuaacuggggauauaauacua

SEQ ID NO: 1307348 - RNA, 15 nt, Homo sapiens
cuaagacugauguca

SEQ ID NO: 1307349 - RNA, 23 nt, Homo sapiens
cuaaggaaaaaacuaguauuccc

SEQ ID NO: 1307350 - RNA, 20 nt, Homo sapiens
cuaagggcgcuugucccauc

SEQ ID NO: 1307351 - RNA, 22 nt, Homo sapiens
cuaagucuuauauauuguagau

SEQ ID NO: 1307352 - RNA, 17 nt, Homo sapiens
cuaauagucuuugccag

SEQ ID NO: 1307353 - RNA, 17 nt, Homo sapiens
cuaauauguaacaagcc

SEQ ID NO: 1307354 - RNA, 19 nt, Homo sapiens
cuaauuauuuacucaaaga

SEQ ID NO: 1307355 - RNA, 22 nt, Homo sapiens
cuaauuuacuggacaaagaauu

SEQ ID NO: 1307356 - RNA, 20 nt, Homo sapiens
cuacaauuccucugauaaua

SEQ ID NO: 1307357 - RNA, 21 nt, Homo sapiens
cuacacagagcaggacugcac

SEQ ID NO: 1307358 - RNA, 19 nt, Homo sapiens
cuacaccaauuaauguagc

SEQ ID NO: 1307359 - RNA, 16 nt, Homo sapiens
cuacacguaaguauaa

SEQ ID NO: 1307360 - RNA, 19 nt, Homo sapiens
cuacagcuaacccucacaa

SEQ ID NO: 1307361 - RNA, 17 nt, Homo sapiens
cuacaggccagcaccuu

SEQ ID NO: 1307362 - RNA, 19 nt, Homo sapiens
cuacagggcucacagaauu

SEQ ID NO: 1307363 - RNA, 17 nt, Homo sapiens
cuacaucccgggccuca

SEQ ID NO: 1307364 - RNA, 12 nt, Homo sapiens
cuaccacaugcc

SEQ ID NO: 1307365 - RNA, 19 nt, Homo sapiens
cuaccaggcacgucugcag

SEQ ID NO: 1307366 - RNA, 13 nt, Homo sapiens
cuacccugccucc

SEQ ID NO: 1307367 - RNA, 18 nt, Homo sapiens
cuaccgacccaggguucc

SEQ ID NO: 1307368 - RNA, 20 nt, Homo sapiens
cuaccuaaaaguugguuaaa

SEQ ID NO: 1307369 - RNA, 22 nt, Homo sapiens
cuaccugcagaguuacuaacuu

SEQ ID NO: 1307370 - RNA, 18 nt, Homo sapiens
cuaccuuuugcuguggca

SEQ ID NO: 1307371 - RNA, 22 nt, Homo sapiens
cuacgccugcauguaaacacgc

SEQ ID NO: 1307372 - RNA, 22 nt, Homo sapiens
cuacuaaaaaaaaaauucuugc

SEQ ID NO: 1307373 - RNA, 20 nt, Homo sapiens
cuacuacaaacuucaaagag

SEQ ID NO: 1307374 - RNA, 18 nt, Homo sapiens
cuacuccaguaugacaga

SEQ ID NO: 1307375 - RNA, 19 nt, Homo sapiens
cuacucgagaggcugaggc

SEQ ID NO: 1307376 - RNA, 15 nt, Homo sapiens
cuacugcaagagcca

SEQ ID NO: 1307377 - RNA, 16 nt, Homo sapiens
cuacuuuaucaauuaa

SEQ ID NO: 1307378 - RNA, 12 nt, Homo sapiens
cuagaaauugcc

SEQ ID NO: 1307379 - RNA, 17 nt, Homo sapiens
cuagaagugccaucuca

SEQ ID NO: 1307380 - RNA, 20 nt, Homo sapiens
cuagagauuaaguccagaaa

SEQ ID NO: 1307381 - RNA, 23 nt, Homo sapiens
cuagaggcccuuugcugucccau

SEQ ID NO: 1307382 - RNA, 12 nt, Homo sapiens
cuagaggugcuc

SEQ ID NO: 1307383 - RNA, 11 nt, Homo sapiens
cuagaguagag

SEQ ID NO: 1307384 - RNA, 20 nt, Homo sapiens
cuagauaccuaaaacauaag

SEQ ID NO: 1307385 - RNA, 19 nt, Homo sapiens
cuagaugauggaugccaau

SEQ ID NO: 1307386 - RNA, 15 nt, Homo sapiens
cuagauggcuccucu

SEQ ID NO: 1307387 - RNA, 22 nt, Homo sapiens
cuagauuuaaccauggcacuga

SEQ ID NO: 1307388 - RNA, 20 nt, Homo sapiens
cuagcaaauguuaugcauaa

SEQ ID NO: 1307389 - RNA, 16 nt, Homo sapiens
cuagcccucauuuuaa

SEQ ID NO: 1307390 - RNA, 14 nt, Homo sapiens
cuagcccugggaca

SEQ ID NO: 1307391 - RNA, 22 nt, Homo sapiens
cuagcuauuggccucccaaaag

SEQ ID NO: 1307392 - RNA, 16 nt, Homo sapiens
cuagcucuaguucaaa

SEQ ID NO: 1307393 - RNA, 16 nt, Homo sapiens
cuagcucuuugagaua

SEQ ID NO: 1307394 - RNA, 16 nt, Homo sapiens
cuaggaaauccauuca

SEQ ID NO: 1307395 - RNA, 15 nt, Homo sapiens
cuaggaggaaaaaga

SEQ ID NO: 1307396 - RNA, 13 nt, Homo sapiens
cuagggagccauu

SEQ ID NO: 1307397 - RNA, 14 nt, Homo sapiens
cuagggagccauuu

SEQ ID NO: 1307398 - RNA, 16 nt, Homo sapiens
cuagggagccauuuga

SEQ ID NO: 1307399 - RNA, 16 nt, Homo sapiens
cuaggucacuucucac

SEQ ID NO: 1307400 - RNA, 17 nt, Homo sapiens
cuagguuuuauucauac

SEQ ID NO: 1307401 - RNA, 11 nt, Homo sapiens
cuaguaaugcu

SEQ ID NO: 1307402 - RNA, 21 nt, Homo sapiens
cuagugguaaaacauccaaga

SEQ ID NO: 1307403 - RNA, 14 nt, Homo sapiens
cuaguguaguauuc

SEQ ID NO: 1307404 - RNA, 20 nt, Homo sapiens
cuaguucaaauuauuuggaa

SEQ ID NO: 1307405 - RNA, 16 nt, Homo sapiens
cuauaaaaaauaugua

SEQ ID NO: 1307406 - RNA, 15 nt, Homo sapiens
cuauaaaagcuuucu

SEQ ID NO: 1307407 - RNA, 23 nt, Homo sapiens
cuauagccuaggugacagaguga

SEQ ID NO: 1307408 - RNA, 18 nt, Homo sapiens
cuauaugcagucucuuua

SEQ ID NO: 1307409 - RNA, 19 nt, Homo sapiens
cuauaugcuuacugugcac

SEQ ID NO: 1307410 - RNA, 18 nt, Homo sapiens
cuauauuaucaugcaaau

SEQ ID NO: 1307411 - RNA, 18 nt, Homo sapiens
cuauauuuagauuguuaa

SEQ ID NO: 1307412 - RNA, 23 nt, Homo sapiens
cuaucuacuacaaacuucaaaga

SEQ ID NO: 1307413 - RNA, 21 nt, Homo sapiens
cuaugaaauuucaacuuuucc

SEQ ID NO: 1307414 - RNA, 19 nt, Homo sapiens
cuaugauaauuacaauaca

SEQ ID NO: 1307415 - RNA, 20 nt, Homo sapiens
cuaugccuuuuacgagugcu

SEQ ID NO: 1307416 - RNA, 14 nt, Homo sapiens
cuaugcuggugaaa

SEQ ID NO: 1307417 - RNA, 19 nt, Homo sapiens
cuauguaaacaaaccacag

SEQ ID NO: 1307418 - RNA, 15 nt, Homo sapiens
cuauguggcuguauc

SEQ ID NO: 1307419 - RNA, 14 nt, Homo sapiens
cuauguucaaagac

SEQ ID NO: 1307420 - RNA, 15 nt, Homo sapiens
cuauguucaaagacu

SEQ ID NO: 1307421 - RNA, 14 nt, Homo sapiens
cuauguugcccagg

SEQ ID NO: 1307422 - RNA, 21 nt, Homo sapiens
cuauguugccuaagcuggucu

SEQ ID NO: 1307423 - RNA, 23 nt, Homo sapiens
cuauuaaaaagguuuacagaauu

SEQ ID NO: 1307424 - RNA, 12 nt, Homo sapiens
cuauuaucucaa

SEQ ID NO: 1307425 - RNA, 21 nt, Homo sapiens
cuauucccuucuaaccugaac

SEQ ID NO: 1307426 - RNA, 18 nt, Homo sapiens
cuauuccugaacuauaac

SEQ ID NO: 1307427 - RNA, 16 nt, Homo sapiens
cuauucucuccaaaaa

SEQ ID NO: 1307428 - RNA, 14 nt, Homo sapiens
cuauucuugauuua

SEQ ID NO: 1307429 - RNA, 13 nt, Homo sapiens
cuauuggucaugc

SEQ ID NO: 1307430 - RNA, 14 nt, Homo sapiens
cuauugucuguaau

SEQ ID NO: 1307431 - RNA, 15 nt, Homo sapiens
cuauugucuguaaua

SEQ ID NO: 1307432 - RNA, 18 nt, Homo sapiens
cuauuucuucuacugcua

SEQ ID NO: 1307433 - RNA, 17 nt, Homo sapiens
cuauuucuucuucacau

SEQ ID NO: 1307434 - RNA, 15 nt, Homo sapiens
cuauuugaacaagug

SEQ ID NO: 1307435 - RNA, 14 nt, Homo sapiens
gacagccugaguca

SEQ ID NO: 1307436 - RNA, 17 nt, Homo sapiens
gacagcuuugcugcuga

SEQ ID NO: 1307437 - RNA, 16 nt, Homo sapiens
gacaguaucacugucu

SEQ ID NO: 1307438 - RNA, 11 nt, Homo sapiens
gacagugaaag

SEQ ID NO: 1307439 - RNA, 16 nt, Homo sapiens
gacagugaacauucug

SEQ ID NO: 1307440 - RNA, 15 nt, Homo sapiens
gacagugaggcugca

SEQ ID NO: 1307441 - RNA, 16 nt, Homo sapiens
gacauaaugggguccu

SEQ ID NO: 1307442 - RNA, 21 nt, Homo sapiens
gacauagcugugcuaugaggu

SEQ ID NO: 1307443 - RNA, 19 nt, Homo sapiens
gacauccccccgccaaaag

SEQ ID NO: 1307444 - RNA, 14 nt, Homo sapiens
gacauugcauuugg

SEQ ID NO: 1307445 - RNA, 15 nt, Homo sapiens
gacauuuguuuuuca

SEQ ID NO: 1307446 - RNA, 22 nt, Homo sapiens
gaccaagcaggaagcucagacu

SEQ ID NO: 1307447 - RNA, 19 nt, Homo sapiens
gaccaaugucuugaugcau

SEQ ID NO: 1307448 - RNA, 17 nt, Homo sapiens
gaccacuuuggagcacu

SEQ ID NO: 1307449 - RNA, 19 nt, Homo sapiens
gaccaggcaaagcaaguga

SEQ ID NO: 1307450 - RNA, 15 nt, Homo sapiens
gaccaggcaauguga

SEQ ID NO: 1307451 - RNA, 20 nt, Homo sapiens
gaccaguugaagcugacuca

SEQ ID NO: 1307452 - RNA, 15 nt, Homo sapiens
gaccauaaccacuga

SEQ ID NO: 1307453 - RNA, 21 nt, Homo sapiens
gaccaugcucaucugcugguc

SEQ ID NO: 1307454 - RNA, 18 nt, Homo sapiens
gacccaaacauaugcaca

SEQ ID NO: 1307455 - RNA, 13 nt, Homo sapiens
gacccaagcugcc

SEQ ID NO: 1307456 - RNA, 23 nt, Homo sapiens
gacccacggagcccuuaugacau

SEQ ID NO: 1307457 - RNA, 14 nt, Homo sapiens
gacccccagcacuu

SEQ ID NO: 1307458 - RNA, 14 nt, Homo sapiens
gaccccgucauggg

SEQ ID NO: 1307459 - RNA, 14 nt, Homo sapiens
gacccuauugcugc

SEQ ID NO: 1307460 - RNA, 12 nt, Homo sapiens
gaccgacugcac

SEQ ID NO: 1307461 - RNA, 13 nt, Homo sapiens
gaccuacugaaaa

SEQ ID NO: 1307462 - RNA, 19 nt, Homo sapiens
gaccucacacacacaaaaa

SEQ ID NO: 1307463 - RNA, 15 nt, Homo sapiens
gaccucacaguacug

SEQ ID NO: 1307464 - RNA, 23 nt, Homo sapiens
gaccucauaaaaggacucucagc

SEQ ID NO: 1307465 - RNA, 12 nt, Homo sapiens
gaccucuccucu

SEQ ID NO: 1307466 - RNA, 15 nt, Homo sapiens
gaccugacaccuuuc

SEQ ID NO: 1307467 - RNA, 14 nt, Homo sapiens
gaccuggacacagg

SEQ ID NO: 1307468 - RNA, 24 nt, Homo sapiens
gaccugucacgauugucaucagga

SEQ ID NO: 1307469 - RNA, 15 nt, Homo sapiens
gaccuucagagccag

SEQ ID NO: 1307470 - RNA, 12 nt, Homo sapiens
gaccuucuagga

SEQ ID NO: 1307471 - RNA, 19 nt, Homo sapiens
gaccuuguagagaacacgc

SEQ ID NO: 1307472 - RNA, 17 nt, Homo sapiens
gacgcuggccugggaug

SEQ ID NO: 1307473 - RNA, 19 nt, Homo sapiens
gacggaggccuacucuucc

SEQ ID NO: 1307474 - RNA, 16 nt, Homo sapiens
gacguccuccguccau

SEQ ID NO: 1307475 - RNA, 19 nt, Homo sapiens
gacgugugagggaggacag

SEQ ID NO: 1307476 - RNA, 22 nt, Homo sapiens
gacuaauuucaaaaugcuuuuu

SEQ ID NO: 1307477 - RNA, 19 nt, Homo sapiens
gacuagggcuuauccaugc

SEQ ID NO: 1307478 - RNA, 15 nt, Homo sapiens
gacuauuuucuuuca

SEQ ID NO: 1307479 - RNA, 16 nt, Homo sapiens
gacucaaaacccaucu

SEQ ID NO: 1307480 - RNA, 12 nt, Homo sapiens
gacucacucugu

SEQ ID NO: 1307481 - RNA, 15 nt, Homo sapiens
gacucaucauuuaau

SEQ ID NO: 1307482 - RNA, 18 nt, Homo sapiens
gacucaugguguguuaca

SEQ ID NO: 1307483 - RNA, 13 nt, Homo sapiens
gacuccugugcaa

SEQ ID NO: 1307484 - RNA, 17 nt, Homo sapiens
gacuccugugcaacuuu

SEQ ID NO: 1307485 - RNA, 17 nt, Homo sapiens
gacucuacagaggccau

SEQ ID NO: 1307486 - RNA, 16 nt, Homo sapiens
gacucuaggugcccuu

SEQ ID NO: 1307487 - RNA, 20 nt, Homo sapiens
gacucuggguccuuccugaa

SEQ ID NO: 1307488 - RNA, 21 nt, Homo sapiens
gacugccuugccuccucagua

SEQ ID NO: 1307489 - RNA, 14 nt, Homo sapiens
gacuuaaugugauu

SEQ ID NO: 1307490 - RNA, 22 nt, Homo sapiens
gacuuaccuguucaguacucua

SEQ ID NO: 1307491 - RNA, 16 nt, Homo sapiens
gacuugaaauucucau

SEQ ID NO: 1307492 - RNA, 22 nt, Homo sapiens
gacuugcacagggauucucaca

SEQ ID NO: 1307493 - RNA, 18 nt, Homo sapiens
gacuuucucuuaacagcu

SEQ ID NO: 1307494 - RNA, 15 nt, Homo sapiens
gacuuugaaugugag

SEQ ID NO: 1307495 - RNA, 17 nt, Homo sapiens
gacuuugguuugaccca

SEQ ID NO: 1307496 - RNA, 20 nt, Homo sapiens
gagaaaaagccuccagucca

SEQ ID NO: 1307497 - RNA, 23 nt, Homo sapiens
gagaaagagcacuuaagagaaua

SEQ ID NO: 1307498 - RNA, 17 nt, Homo sapiens
gagaaagggagugcaug

SEQ ID NO: 1307499 - RNA, 21 nt, Homo sapiens
gagaaagggagugcaugugcg

SEQ ID NO: 1307500 - RNA, 16 nt, Homo sapiens
gagaaaucuggcuucu

SEQ ID NO: 1307501 - RNA, 21 nt, Homo sapiens
gagaaccuguugaaaugugaa

SEQ ID NO: 1307502 - RNA, 15 nt, Homo sapiens
gagaagcaaggguug

SEQ ID NO: 1307503 - RNA, 18 nt, Homo sapiens
gagaagcuccucucccca

SEQ ID NO: 1307504 - RNA, 22 nt, Homo sapiens
gagaagucuggucagagccaca

SEQ ID NO: 1307505 - RNA, 14 nt, Homo sapiens
gagaaguuaagcaa

SEQ ID NO: 1307506 - RNA, 20 nt, Homo sapiens
gagaauguguuucaaaacca

SEQ ID NO: 1307507 - RNA, 23 nt, Homo sapiens
gagaauuagaaacaacauagcaa

SEQ ID NO: 1307508 - RNA, 22 nt, Homo sapiens
gagaauuccuuuuucuucuuua

SEQ ID NO: 1307509 - RNA, 23 nt, Homo sapiens
gagacacuauuuaucugugcaaa

SEQ ID NO: 1307510 - RNA, 22 nt, Homo sapiens
gagacauacuugaagggccaga

SEQ ID NO: 1307511 - RNA, 23 nt, Homo sapiens
gagacauacuugaagggccagag

SEQ ID NO: 1307512 - RNA, 22 nt, Homo sapiens
gagaccaggcaaagcaagugau

SEQ ID NO: 1307513 - RNA, 16 nt, Homo sapiens
gagacccguccauuug

SEQ ID NO: 1307514 - RNA, 18 nt, Homo sapiens
gagacgguguuuugccau

SEQ ID NO: 1307515 - RNA, 18 nt, Homo sapiens
gagacugcaucucaaaaa

SEQ ID NO: 1307516 - RNA, 11 nt, Homo sapiens
gagacuugccu

SEQ ID NO: 1307517 - RNA, 22 nt, Homo sapiens
gagacuugccuuccuaagccug

SEQ ID NO: 1307518 - RNA, 23 nt, Homo sapiens
gagacuuuagucuuuggggcaag

SEQ ID NO: 1307519 - RNA, 13 nt, Homo sapiens
gagagaccaggca

SEQ ID NO: 1307520 - RNA, 21 nt, Homo sapiens
gagagauggucagaaauaucc

SEQ ID NO: 1307521 - RNA, 14 nt, Homo sapiens
gagagcagugagga

SEQ ID NO: 1307522 - RNA, 16 nt, Homo sapiens
gagagccaccaagagg

SEQ ID NO: 1307523 - RNA, 17 nt, Homo sapiens
gagagccuggugcugcu

SEQ ID NO: 1307524 - RNA, 14 nt, Homo sapiens
gagaggcuguguca

SEQ ID NO: 1307525 - RNA, 15 nt, Homo sapiens
gagaguagagggcac

SEQ ID NO: 1307526 - RNA, 13 nt, Homo sapiens
gagauagggaaaa

SEQ ID NO: 1307527 - RNA, 18 nt, Homo sapiens
gagauccugagucaugug

SEQ ID NO: 1307528 - RNA, 15 nt, Homo sapiens
gagaugcaaauagca

SEQ ID NO: 1307529 - RNA, 19 nt, Homo sapiens
gagaugcugcaguuccaaa

SEQ ID NO: 1307530 - RNA, 22 nt, Homo sapiens
gagauggagcuacgaaaggaug

SEQ ID NO: 1307531 - RNA, 23 nt, Homo sapiens
gagauguugaaauuacauuauuu

SEQ ID NO: 1307532 - RNA, 21 nt, Homo sapiens
gagauucaagggacccaugag

SEQ ID NO: 1307533 - RNA, 19 nt, Homo sapiens
gagauucauuuucuagaua

SEQ ID NO: 1307534 - RNA, 19 nt, Homo sapiens
gagauuccugagccagugu

SEQ ID NO: 1307535 - RNA, 16 nt, Homo sapiens
gagcaaaggcugagaa

SEQ ID NO: 1307536 - RNA, 16 nt, Homo sapiens
gagcaagcgcuguaaa

SEQ ID NO: 1307537 - RNA, 21 nt, Homo sapiens
gagcacuggguugacuuucag

SEQ ID NO: 1307538 - RNA, 10 nt, Homo sapiens
gagcagagua

SEQ ID NO: 1307539 - RNA, 22 nt, Homo sapiens
gagcagaugcaaugacucagga

SEQ ID NO: 1307540 - RNA, 18 nt, Homo sapiens
gagcagucuaucauugca

SEQ ID NO: 1307541 - RNA, 21 nt, Homo sapiens
gagcagugcuugaaugaaguu

SEQ ID NO: 1307542 - RNA, 12 nt, Homo sapiens
gagcauccucuc

SEQ ID NO: 1307543 - RNA, 24 nt, Homo sapiens
gagcaucuugcauccaaaccugua

SEQ ID NO: 1307544 - RNA, 14 nt, Homo sapiens
gagccaagcuucaa

SEQ ID NO: 1307545 - RNA, 20 nt, Homo sapiens
gagccaccacguccagcugg

SEQ ID NO: 1307546 - RNA, 18 nt, Homo sapiens
gagccacugcaccgggcc

SEQ ID NO: 1307547 - RNA, 15 nt, Homo sapiens
gagcccauccagucu

SEQ ID NO: 1307548 - RNA, 16 nt, Homo sapiens
gagcccaucugcacag

SEQ ID NO: 1307549 - RNA, 20 nt, Homo sapiens
gagccgagaucgugccauug

SEQ ID NO: 1307550 - RNA, 21 nt, Homo sapiens
gagccgagauugcaccacugc

SEQ ID NO: 1307551 - RNA, 17 nt, Homo sapiens
gagccgggucugccucu

SEQ ID NO: 1307552 - RNA, 23 nt, Homo sapiens
gagcuacugccgucagugcugug

SEQ ID NO: 1307553 - RNA, 18 nt, Homo sapiens
gagcuauucuugcugaug

SEQ ID NO: 1307554 - RNA, 23 nt, Homo sapiens
gagcucaccuguuugaaaccaag

SEQ ID NO: 1307555 - RNA, 15 nt, Homo sapiens
gccaguccugcuacc

SEQ ID NO: 1307556 - RNA, 18 nt, Homo sapiens
gccauacuguaugcagua

SEQ ID NO: 1307557 - RNA, 18 nt, Homo sapiens
gccauccucaaacacugc

SEQ ID NO: 1307558 - RNA, 15 nt, Homo sapiens
gccauggcucauggg

SEQ ID NO: 1307559 - RNA, 18 nt, Homo sapiens
gccaugggccuccugugu

SEQ ID NO: 1307560 - RNA, 20 nt, Homo sapiens
gccaugugaaacucaucuca

SEQ ID NO: 1307561 - RNA, 18 nt, Homo sapiens
gccauugcacuccagccu

SEQ ID NO: 1307562 - RNA, 15 nt, Homo sapiens
gcccaaauccagugu

SEQ ID NO: 1307563 - RNA, 16 nt, Homo sapiens
gcccaaccuauccugu

SEQ ID NO: 1307564 - RNA, 21 nt, Homo sapiens
gcccagaaaaccuccaguagu

SEQ ID NO: 1307565 - RNA, 14 nt, Homo sapiens
gcccagagcccagc

SEQ ID NO: 1307566 - RNA, 15 nt, Homo sapiens
gcccagcacuugaau

SEQ ID NO: 1307567 - RNA, 19 nt, Homo sapiens
gcccagccccuacugcugu

SEQ ID NO: 1307568 - RNA, 23 nt, Homo sapiens
gcccagccccuacugcugugaac

SEQ ID NO: 1307569 - RNA, 16 nt, Homo sapiens
gcccagcuaaagcaau

SEQ ID NO: 1307570 - RNA, 19 nt, Homo sapiens
gcccaggaccaucauccua

SEQ ID NO: 1307571 - RNA, 20 nt, Homo sapiens
gcccaggaucagauugcaug

SEQ ID NO: 1307572 - RNA, 14 nt, Homo sapiens
gcccaggcuggaau

SEQ ID NO: 1307573 - RNA, 15 nt, Homo sapiens
gcccaggcuggaaug

SEQ ID NO: 1307574 - RNA, 20 nt, Homo sapiens
gcccaggcuggagugcagug

SEQ ID NO: 1307575 - RNA, 20 nt, Homo sapiens
gcccaggcugggaacucauc

SEQ ID NO: 1307576 - RNA, 19 nt, Homo sapiens
gcccaggcugggugcaguc

SEQ ID NO: 1307577 - RNA, 15 nt, Homo sapiens
gcccagggcaucuug

SEQ ID NO: 1307578 - RNA, 15 nt, Homo sapiens
gcccaguccuuccac

SEQ ID NO: 1307579 - RNA, 15 nt, Homo sapiens
gcccagucgacccca

SEQ ID NO: 1307580 - RNA, 21 nt, Homo sapiens
gcccagucuggauguggacuu

SEQ ID NO: 1307581 - RNA, 16 nt, Homo sapiens
gcccaguguccccuuu

SEQ ID NO: 1307582 - RNA, 21 nt, Homo sapiens
gcccauccccaggcaccucac

SEQ ID NO: 1307583 - RNA, 17 nt, Homo sapiens
gcccaucugcacagugg

SEQ ID NO: 1307584 - RNA, 19 nt, Homo sapiens
gcccauggaggcgcugcug

SEQ ID NO: 1307585 - RNA, 18 nt, Homo sapiens
gcccaugguacuccaugc

SEQ ID NO: 1307586 - RNA, 16 nt, Homo sapiens
gccccacauugcacuu

SEQ ID NO: 1307587 - RNA, 15 nt, Homo sapiens
gccccauuuacccaa

SEQ ID NO: 1307588 - RNA, 13 nt, Homo sapiens
gcccccccuucca

SEQ ID NO: 1307589 - RNA, 16 nt, Homo sapiens
gccccgucucuguucc

SEQ ID NO: 1307590 - RNA, 16 nt, Homo sapiens
gccccuacugcuguga

SEQ ID NO: 1307591 - RNA, 17 nt, Homo sapiens
gccccugauccugugaa

SEQ ID NO: 1307592 - RNA, 17 nt, Homo sapiens
gccccugcacacucagu

SEQ ID NO: 1307593 - RNA, 15 nt, Homo sapiens
gccccugcccggcug

SEQ ID NO: 1307594 - RNA, 19 nt, Homo sapiens
gccccugucucggggcuug

SEQ ID NO: 1307595 - RNA, 13 nt, Homo sapiens
gcccgugcccuac

SEQ ID NO: 1307596 - RNA, 16 nt, Homo sapiens
gcccuaaaagcacacu

SEQ ID NO: 1307597 - RNA, 20 nt, Homo sapiens
gcccuaaaagcacacucauc

SEQ ID NO: 1307598 - RNA, 16 nt, Homo sapiens
gcccuacucaccugag

SEQ ID NO: 1307599 - RNA, 19 nt, Homo sapiens
gcccucagauuccgcacca

SEQ ID NO: 1307600 - RNA, 21 nt, Homo sapiens
gcccuccccuccggacuggug

SEQ ID NO: 1307601 - RNA, 14 nt, Homo sapiens
gcccugacccugug

SEQ ID NO: 1307602 - RNA, 18 nt, Homo sapiens
gcccugggacaucaggag

SEQ ID NO: 1307603 - RNA, 15 nt, Homo sapiens
gcccugucugugugc

SEQ ID NO: 1307604 - RNA, 22 nt, Homo sapiens
gcccuuaaacauuggacaguga

SEQ ID NO: 1307605 - RNA, 21 nt, Homo sapiens
gcccuucccacaggacauuuc

SEQ ID NO: 1307606 - RNA, 12 nt, Homo sapiens
gcccuuuccucc

SEQ ID NO: 1307607 - RNA, 21 nt, Homo sapiens
gccgagaucacgccacugcac

SEQ ID NO: 1307608 - RNA, 19 nt, Homo sapiens
gccgcaaaccacacuggac

SEQ ID NO: 1307609 - RNA, 20 nt, Homo sapiens
gccggcuccaguuuccccau

SEQ ID NO: 1307610 - RNA, 12 nt, Homo sapiens
gccguaucuccg

SEQ ID NO: 1307611 - RNA, 19 nt, Homo sapiens
gccgucccgccugcagagg

SEQ ID NO: 1307612 - RNA, 17 nt, Homo sapiens
gccuaaaugcacaguca

SEQ ID NO: 1307613 - RNA, 19 nt, Homo sapiens
gccuacaucccgggccuca

SEQ ID NO: 1307614 - RNA, 17 nt, Homo sapiens
gccuacucuuccaucuu

SEQ ID NO: 1307615 - RNA, 14 nt, Homo sapiens
gccuaggugacaga

SEQ ID NO: 1307616 - RNA, 19 nt, Homo sapiens
gccucaguaagacgacaag

SEQ ID NO: 1307617 - RNA, 11 nt, Homo sapiens
gccucagugag

SEQ ID NO: 1307618 - RNA, 19 nt, Homo sapiens
gccuccagaagcacuggga

SEQ ID NO: 1307619 - RNA, 18 nt, Homo sapiens
gccuccauccucaucucu

SEQ ID NO: 1307620 - RNA, 19 nt, Homo sapiens
gccuccauuucucugggac

SEQ ID NO: 1307621 - RNA, 16 nt, Homo sapiens
gccucccaaguagcug

SEQ ID NO: 1307622 - RNA, 21 nt, Homo sapiens
gccuccgccucaguaagacga

SEQ ID NO: 1307623 - RNA, 14 nt, Homo sapiens
gccuccuacuccag

SEQ ID NO: 1307624 - RNA, 21 nt, Homo sapiens
gccuccugcccagcacaggaa

SEQ ID NO: 1307625 - RNA, 14 nt, Homo sapiens
gccucuacuuugau

SEQ ID NO: 1307626 - RNA, 18 nt, Homo sapiens
gccucuccuacuaugcaa

SEQ ID NO: 1307627 - RNA, 14 nt, Homo sapiens
gccucuguggcacu

SEQ ID NO: 1307628 - RNA, 13 nt, Homo sapiens
gccucuuggcagu

SEQ ID NO: 1307629 - RNA, 15 nt, Homo sapiens
gccugaaacuuugag

SEQ ID NO: 1307630 - RNA, 13 nt, Homo sapiens
gccugacugccca

SEQ ID NO: 1307631 - RNA, 20 nt, Homo sapiens
gccugagcaacucuugauua

SEQ ID NO: 1307632 - RNA, 17 nt, Homo sapiens
gccugaggcucacggua

SEQ ID NO: 1307633 - RNA, 17 nt, Homo sapiens
gccugagguuugccagc

SEQ ID NO: 1307634 - RNA, 21 nt, Homo sapiens
gccugagguuugccagcauuu

SEQ ID NO: 1307635 - RNA, 19 nt, Homo sapiens
gccugauaauccuauuaca

SEQ ID NO: 1307636 - RNA, 22 nt, Homo sapiens
gccugaucagcgccgcaccagc

SEQ ID NO: 1307637 - RNA, 18 nt, Homo sapiens
gccugaucuccaggcaaa

SEQ ID NO: 1307638 - RNA, 14 nt, Homo sapiens
gccugccuaugaaa

SEQ ID NO: 1307639 - RNA, 14 nt, Homo sapiens
gccugccucuucuc

SEQ ID NO: 1307640 - RNA, 16 nt, Homo sapiens
gccugccuggcaggcu

SEQ ID NO: 1307641 - RNA, 14 nt, Homo sapiens
gccuggacacagag

SEQ ID NO: 1307642 - RNA, 23 nt, Homo sapiens
gccuggacuagagggaccucucc

SEQ ID NO: 1307643 - RNA, 17 nt, Homo sapiens
gccugggaauggauuag

SEQ ID NO: 1307644 - RNA, 17 nt, Homo sapiens
gccuggggucugacaau

SEQ ID NO: 1307645 - RNA, 15 nt, Homo sapiens
gccuggggucuggag

SEQ ID NO: 1307646 - RNA, 23 nt, Homo sapiens
gccugggguggggucaugcccuc

SEQ ID NO: 1307647 - RNA, 21 nt, Homo sapiens
gccuggguugcugcuguccag

SEQ ID NO: 1307648 - RNA, 16 nt, Homo sapiens
gccuggucguuuucaa

SEQ ID NO: 1307649 - RNA, 22 nt, Homo sapiens
gccuguaacacauaguggcuuc

SEQ ID NO: 1307650 - RNA, 19 nt, Homo sapiens
gccuguaaucccagcacuu

SEQ ID NO: 1307651 - RNA, 20 nt, Homo sapiens
gccuguaaucccagcacuuu

SEQ ID NO: 1307652 - RNA, 14 nt, Homo sapiens
gccugugaugcugg

SEQ ID NO: 1307653 - RNA, 17 nt, Homo sapiens
gccuguggccuuugcaa

SEQ ID NO: 1307654 - RNA, 15 nt, Homo sapiens
gccuuaaccaugagg

SEQ ID NO: 1307655 - RNA, 23 nt, Homo sapiens
gccuuccacuuggcuacacaggg

SEQ ID NO: 1307656 - RNA, 21 nt, Homo sapiens
gccuucccuaaaaucagggaa

SEQ ID NO: 1307657 - RNA, 17 nt, Homo sapiens
gccuugaugacugccuu

SEQ ID NO: 1307658 - RNA, 18 nt, Homo sapiens
gccuugccagagauccaa

SEQ ID NO: 1307659 - RNA, 16 nt, Homo sapiens
gccuuggagaucaaaa

SEQ ID NO: 1307660 - RNA, 23 nt, Homo sapiens
gccuuggaggacccagcacugac

SEQ ID NO: 1307661 - RNA, 21 nt, Homo sapiens
ggaagcuuuuguuauguauuu

SEQ ID NO: 1307662 - RNA, 11 nt, Homo sapiens
ggaagugcuuc

SEQ ID NO: 1307663 - RNA, 13 nt, Homo sapiens
ggaauauuugaau

SEQ ID NO: 1307664 - RNA, 14 nt, Homo sapiens
ggaaucaauuacuu

SEQ ID NO: 1307665 - RNA, 15 nt, Homo sapiens
ggaaucccacuguau

SEQ ID NO: 1307666 - RNA, 19 nt, Homo sapiens
ggaaugcagaggucuccaa

SEQ ID NO: 1307667 - RNA, 21 nt, Homo sapiens
ggacaagacccccagcacuug

SEQ ID NO: 1307668 - RNA, 22 nt, Homo sapiens
ggacaauaugugccaaucaaua

SEQ ID NO: 1307669 - RNA, 23 nt, Homo sapiens
ggacacuuaauacuaccuugaaa

SEQ ID NO: 1307670 - RNA, 22 nt, Homo sapiens
ggacagaauuggauacauacac

SEQ ID NO: 1307671 - RNA, 18 nt, Homo sapiens
ggacagccccacccuggu

SEQ ID NO: 1307672 - RNA, 17 nt, Homo sapiens
ggacauaaugggguccu

SEQ ID NO: 1307673 - RNA, 23 nt, Homo sapiens
ggacauaaugggguccuggccau

SEQ ID NO: 1307674 - RNA, 19 nt, Homo sapiens
ggacauggccccugugagu

SEQ ID NO: 1307675 - RNA, 15 nt, Homo sapiens
ggaccagcucaggac

SEQ ID NO: 1307676 - RNA, 15 nt, Homo sapiens
ggaccaggauuugca

SEQ ID NO: 1307677 - RNA, 18 nt, Homo sapiens
ggaccaugcgacacuggg

SEQ ID NO: 1307678 - RNA, 18 nt, Homo sapiens
ggacccagggaacagcca

SEQ ID NO: 1307679 - RNA, 13 nt, Homo sapiens
ggaccuccaagcc

SEQ ID NO: 1307680 - RNA, 13 nt, Homo sapiens
ggacuacaggcac

SEQ ID NO: 1307681 - RNA, 19 nt, Homo sapiens
ggacuauauuugggccugc

SEQ ID NO: 1307682 - RNA, 13 nt, Homo sapiens
ggacuauuuucuu

SEQ ID NO: 1307683 - RNA, 12 nt, Homo sapiens
ggacucaaugca

SEQ ID NO: 1307684 - RNA, 18 nt, Homo sapiens
ggacuuccuguccagcuc

SEQ ID NO: 1307685 - RNA, 22 nt, Homo sapiens
ggacuuucccccacacccagau

SEQ ID NO: 1307686 - RNA, 15 nt, Homo sapiens
ggagaagggcugaac

SEQ ID NO: 1307687 - RNA, 12 nt, Homo sapiens
ggagacaauguc

SEQ ID NO: 1307688 - RNA, 23 nt, Homo sapiens
ggagacacuauuuaucugugcaa

SEQ ID NO: 1307689 - RNA, 14 nt, Homo sapiens
ggagaccuggcacu

SEQ ID NO: 1307690 - RNA, 22 nt, Homo sapiens
ggagagagccuugggagccacu

SEQ ID NO: 1307691 - RNA, 16 nt, Homo sapiens
ggagagcuggagccug

SEQ ID NO: 1307692 - RNA, 13 nt, Homo sapiens
ggagaggggcaca

SEQ ID NO: 1307693 - RNA, 13 nt, Homo sapiens
ggagcacuggguu

SEQ ID NO: 1307694 - RNA, 19 nt, Homo sapiens
ggagccccuucugcucagc

SEQ ID NO: 1307695 - RNA, 23 nt, Homo sapiens
ggagcuagccagaggacugugau

SEQ ID NO: 1307696 - RNA, 12 nt, Homo sapiens
ggagcucagaga

SEQ ID NO: 1307697 - RNA, 15 nt, Homo sapiens
ggagcugaggccaca

SEQ ID NO: 1307698 - RNA, 21 nt, Homo sapiens
ggagcugccuuggcucagaca

SEQ ID NO: 1307699 - RNA, 16 nt, Homo sapiens
ggagcuggcccucucc

SEQ ID NO: 1307700 - RNA, 19 nt, Homo sapiens
ggagcuucuuguuuccuug

SEQ ID NO: 1307701 - RNA, 13 nt, Homo sapiens
ggaggaguggugg

SEQ ID NO: 1307702 - RNA, 22 nt, Homo sapiens
ggaggauacugaggcacacaga

SEQ ID NO: 1307703 - RNA, 15 nt, Homo sapiens
ggaggaucaguuuuu

SEQ ID NO: 1307704 - RNA, 14 nt, Homo sapiens
ggaggccagugagc

SEQ ID NO: 1307705 - RNA, 20 nt, Homo sapiens
ggaggcggagguuccaguga

SEQ ID NO: 1307706 - RNA, 20 nt, Homo sapiens
ggagggacacuuacccaagg

SEQ ID NO: 1307707 - RNA, 21 nt, Homo sapiens
ggagggcugucaucugugcac

SEQ ID NO: 1307708 - RNA, 16 nt, Homo sapiens
ggagggugagugcaag

SEQ ID NO: 1307709 - RNA, 15 nt, Homo sapiens
ggaguggcucuguaa

SEQ ID NO: 1307710 - RNA, 20 nt, Homo sapiens
ggaguguccucuucccucuc

SEQ ID NO: 1307711 - RNA, 17 nt, Homo sapiens
ggauccguuugaccaau

SEQ ID NO: 1307712 - RNA, 22 nt, Homo sapiens
ggauccguuugaccaauuugca

SEQ ID NO: 1307713 - RNA, 13 nt, Homo sapiens
ggaugauguuucg

SEQ ID NO: 1307714 - RNA, 23 nt, Homo sapiens
ggaugauuaagagauugccauuu

SEQ ID NO: 1307715 - RNA, 22 nt, Homo sapiens
ggaugcauagccuggacacaga

SEQ ID NO: 1307716 - RNA, 22 nt, Homo sapiens
ggaugccaaccggucacccagg

SEQ ID NO: 1307717 - RNA, 23 nt, Homo sapiens
ggaugccaaccggucacccagga

SEQ ID NO: 1307718 - RNA, 14 nt, Homo sapiens
ggaugcccuguggg

SEQ ID NO: 1307719 - RNA, 13 nt, Homo sapiens
ggaugggccuuug

SEQ ID NO: 1307720 - RNA, 16 nt, Homo sapiens
ggaugucugaacuuug

SEQ ID NO: 1307721 - RNA, 22 nt, Homo sapiens
ggaugugaacaaccugcucaca

SEQ ID NO: 1307722 - RNA, 22 nt, Homo sapiens
ggaugugaugguacacaguggg

SEQ ID NO: 1307723 - RNA, 22 nt, Homo sapiens
ggauuaaugucaauucuugcca

SEQ ID NO: 1307724 - RNA, 22 nt, Homo sapiens
ggauucuccacucaguugcaac

SEQ ID NO: 1307725 - RNA, 16 nt, Homo sapiens
ggauucugaaucucaa

SEQ ID NO: 1307726 - RNA, 13 nt, Homo sapiens
ggauugggguccc

SEQ ID NO: 1307727 - RNA, 23 nt, Homo sapiens
ggcaaacccaaaaccucaugaca

SEQ ID NO: 1307728 - RNA, 16 nt, Homo sapiens
ggcaacauuccucaga

SEQ ID NO: 1307729 - RNA, 16 nt, Homo sapiens
ggcaagggaccugcuu

SEQ ID NO: 1307730 - RNA, 22 nt, Homo sapiens
ggcaagucaccugcagcccaug

SEQ ID NO: 1307731 - RNA, 18 nt, Homo sapiens
ggcaauccagacagcagg

SEQ ID NO: 1307732 - RNA, 12 nt, Homo sapiens
ggcacagccuuu

SEQ ID NO: 1307733 - RNA, 19 nt, Homo sapiens
ggcacccggccccugcugg

SEQ ID NO: 1307734 - RNA, 15 nt, Homo sapiens
ggcacugaagcccga

SEQ ID NO: 1307735 - RNA, 13 nt, Homo sapiens
ggcagaaggcagu

SEQ ID NO: 1307736 - RNA, 20 nt, Homo sapiens
ggcagacacagggacuugaa

SEQ ID NO: 1307737 - RNA, 20 nt, Homo sapiens
ggcagacucuuuaugcuugc

SEQ ID NO: 1307738 - RNA, 17 nt, Homo sapiens
ggcagagaaagggacaa

SEQ ID NO: 1307739 - RNA, 13 nt, Homo sapiens
ggcagagagccag

SEQ ID NO: 1307740 - RNA, 16 nt, Homo sapiens
ggcagagguuacaggu

SEQ ID NO: 1307741 - RNA, 18 nt, Homo sapiens
ggcagcauccccuugaac

SEQ ID NO: 1307742 - RNA, 21 nt, Homo sapiens
ggcagcauggagcuauaacua

SEQ ID NO: 1307743 - RNA, 16 nt, Homo sapiens
ggcagccacaacugca

SEQ ID NO: 1307744 - RNA, 17 nt, Homo sapiens
ggcagcugagcagcuuu

SEQ ID NO: 1307745 - RNA, 22 nt, Homo sapiens
ggcaggaaaaggugauauccau

SEQ ID NO: 1307746 - RNA, 18 nt, Homo sapiens
ggcaggacacacauggug

SEQ ID NO: 1307747 - RNA, 14 nt, Homo sapiens
ggcagggucucacu

SEQ ID NO: 1307748 - RNA, 19 nt, Homo sapiens
ggcagguguguauuuacuu

SEQ ID NO: 1307749 - RNA, 19 nt, Homo sapiens
ggcaguauuuuguguccuc

SEQ ID NO: 1307750 - RNA, 15 nt, Homo sapiens
ggcaguccagccagc

SEQ ID NO: 1307751 - RNA, 22 nt, Homo sapiens
ggcaguggacucagaaagccaa

SEQ ID NO: 1307752 - RNA, 13 nt, Homo sapiens
ggcaucacagcua

SEQ ID NO: 1307753 - RNA, 16 nt, Homo sapiens
ggcaucuugcuggcua

SEQ ID NO: 1307754 - RNA, 17 nt, Homo sapiens
ggcaugauccaagcaag

SEQ ID NO: 1307755 - RNA, 16 nt, Homo sapiens
ggcaugggucgggaga

SEQ ID NO: 1307756 - RNA, 16 nt, Homo sapiens
uauguaccaagaaucu

SEQ ID NO: 1307757 - RNA, 14 nt, Homo sapiens
uaugugcauuucaa

SEQ ID NO: 1307758 - RNA, 18 nt, Homo sapiens
uauguuuacguccuuugg

SEQ ID NO: 1307759 - RNA, 19 nt, Homo sapiens
uauguuuaucaacucaaga

SEQ ID NO: 1307760 - RNA, 16 nt, Homo sapiens
uauuaacaauuaggca

SEQ ID NO: 1307761 - RNA, 14 nt, Homo sapiens
uauuaagagcaauu

SEQ ID NO: 1307762 - RNA, 16 nt, Homo sapiens
uauuaguugccaauau

SEQ ID NO: 1307763 - RNA, 12 nt, Homo sapiens
uauuauguauaa

SEQ ID NO: 1307764 - RNA, 15 nt, Homo sapiens
uauuccugaacuaua

SEQ ID NO: 1307765 - RNA, 16 nt, Homo sapiens
uauuccugaacuauaa

SEQ ID NO: 1307766 - RNA, 18 nt, Homo sapiens
uauucuaauuuuagguuc

SEQ ID NO: 1307767 - RNA, 15 nt, Homo sapiens
uauugaccaccaguu

SEQ ID NO: 1307768 - RNA, 15 nt, Homo sapiens
uauugcagcuuauau

SEQ ID NO: 1307769 - RNA, 19 nt, Homo sapiens
uauugcagcuuauauucau

SEQ ID NO: 1307770 - RNA, 17 nt, Homo sapiens
uauugcugcaaacacuu

SEQ ID NO: 1307771 - RNA, 14 nt, Homo sapiens
uauugcuguuucag

SEQ ID NO: 1307772 - RNA, 17 nt, Homo sapiens
uauugguguacuguaau

SEQ ID NO: 1307773 - RNA, 22 nt, Homo sapiens
uauuguaaaaaauucacauaau

SEQ ID NO: 1307774 - RNA, 21 nt, Homo sapiens
uauuguaaaaggaaagucauu

SEQ ID NO: 1307775 - RNA, 15 nt, Homo sapiens
uauuuaacaaaaagu

SEQ ID NO: 1307776 - RNA, 14 nt, Homo sapiens
uauuuaagaggaaa

SEQ ID NO: 1307777 - RNA, 20 nt, Homo sapiens
uauuuaauguggaaugucaa

SEQ ID NO: 1307778 - RNA, 13 nt, Homo sapiens
uauuuaccagacc

SEQ ID NO: 1307779 - RNA, 12 nt, Homo sapiens
uauuuaccugaa

SEQ ID NO: 1307780 - RNA, 13 nt, Homo sapiens
uauuuauacugua

SEQ ID NO: 1307781 - RNA, 14 nt, Homo sapiens
uauuuauacuguau

SEQ ID NO: 1307782 - RNA, 14 nt, Homo sapiens
uauuucaagcucug

SEQ ID NO: 1307783 - RNA, 16 nt, Homo sapiens
uauuucacaaauaaua

SEQ ID NO: 1307784 - RNA, 14 nt, Homo sapiens
uauuugacuuacca

SEQ ID NO: 1307785 - RNA, 14 nt, Homo sapiens
uauuugaugcuaca

SEQ ID NO: 1307786 - RNA, 15 nt, Homo sapiens
uauuuggauaucaaa

SEQ ID NO: 1307787 - RNA, 14 nt, Homo sapiens
uauuuguaucuguu

SEQ ID NO: 1307788 - RNA, 17 nt, Homo sapiens
uauuuuaagaauuucac

SEQ ID NO: 1307789 - RNA, 19 nt, Homo sapiens
uauuuuaagaauuucacaa

SEQ ID NO: 1307790 - RNA, 12 nt, Homo sapiens
uauuuugcauau

SEQ ID NO: 1307791 - RNA, 16 nt, Homo sapiens
uauuuuuagacagagu

SEQ ID NO: 1307792 - RNA, 21 nt, Homo sapiens
uauuuuuagacagagucucac

SEQ ID NO: 1307793 - RNA, 15 nt, Homo sapiens
uauuuuuucuugcaa

SEQ ID NO: 1307794 - RNA, 14 nt, Homo sapiens
ucaaaaccagugaa

SEQ ID NO: 1307795 - RNA, 18 nt, Homo sapiens
ucaaaauaaaaaccaaga

SEQ ID NO: 1307796 - RNA, 20 nt, Homo sapiens
ucaaaauaaaaaccaagaag

SEQ ID NO: 1307797 - RNA, 14 nt, Homo sapiens
ucaaaaucuuucca

SEQ ID NO: 1307798 - RNA, 15 nt, Homo sapiens
ucaaaaucuuuccaa

SEQ ID NO: 1307799 - RNA, 14 nt, Homo sapiens
ucaaaaugcuuuuu

SEQ ID NO: 1307800 - RNA, 17 nt, Homo sapiens
ucaaaauggcagaacca

SEQ ID NO: 1307801 - RNA, 17 nt, Homo sapiens
ucaaaauugagugguuu

SEQ ID NO: 1307802 - RNA, 18 nt, Homo sapiens
ucaaaauugagugguuua

SEQ ID NO: 1307803 - RNA, 11 nt, Homo sapiens
ucaaacaaagc

SEQ ID NO: 1307804 - RNA, 13 nt, Homo sapiens
ucaaacaaagcca

SEQ ID NO: 1307805 - RNA, 12 nt, Homo sapiens
ucaaacugcucc

SEQ ID NO: 1307806 - RNA, 23 nt, Homo sapiens
ucaaagaggcugaggcuggcaca

SEQ ID NO: 1307807 - RNA, 22 nt, Homo sapiens
ucaaagcaauugaaaugcauug

SEQ ID NO: 1307808 - RNA, 18 nt, Homo sapiens
ucaaaguaaaacuugcug

SEQ ID NO: 1307809 - RNA, 20 nt, Homo sapiens
ucaaaguguaaacaccauag

SEQ ID NO: 1307810 - RNA, 12 nt, Homo sapiens
ucaaaugccuga

SEQ ID NO: 1307811 - RNA, 16 nt, Homo sapiens
ucaacaccucugcaca

SEQ ID NO: 1307812 - RNA, 19 nt, Homo sapiens
ucaacaccuuaauaugcug

SEQ ID NO: 1307813 - RNA, 12 nt, Homo sapiens
ucaacagaauug

SEQ ID NO: 1307814 - RNA, 16 nt, Homo sapiens
ucaacaguucaaagaa

SEQ ID NO: 1307815 - RNA, 23 nt, Homo sapiens
ucaaccauccccuccguggcauc

SEQ ID NO: 1307816 - RNA, 21 nt, Homo sapiens
ucaaccuccugggcuaaguga

SEQ ID NO: 1307817 - RNA, 19 nt, Homo sapiens
ucaaccucuucuggcucaa

SEQ ID NO: 1307818 - RNA, 18 nt, Homo sapiens
ucaaccugggcaaagccu

SEQ ID NO: 1307819 - RNA, 20 nt, Homo sapiens
ucaggggcggggagggugac

SEQ ID NO: 1307820 - RNA, 19 nt, Homo sapiens
ucaguaacccccacuggac

SEQ ID NO: 1307821 - RNA, 22 nt, Homo sapiens
ucaguauuacaaauauauagca

SEQ ID NO: 1307822 - RNA, 13 nt, Homo sapiens
ucagucaagcugu

SEQ ID NO: 1307823 - RNA, 14 nt, Homo sapiens
ucagucacagccac

SEQ ID NO: 1307824 - RNA, 15 nt, Homo sapiens
ucaguccaugucucg

SEQ ID NO: 1307825 - RNA, 15 nt, Homo sapiens
ucagucucuguguaa

SEQ ID NO: 1307826 - RNA, 19 nt, Homo sapiens
ucagugaagccaaagggac

SEQ ID NO: 1307827 - RNA, 19 nt, Homo sapiens
ucagugcuccuguaaguca

SEQ ID NO: 1307828 - RNA, 18 nt, Homo sapiens
ucaguggugucugugaag

SEQ ID NO: 1307829 - RNA, 18 nt, Homo sapiens
ucaguuaauucuuagaua

SEQ ID NO: 1307830 - RNA, 15 nt, Homo sapiens
ucaguuaugaaaugu

SEQ ID NO: 1307831 - RNA, 15 nt, Homo sapiens
ucaguuauuacaugu

SEQ ID NO: 1307832 - RNA, 19 nt, Homo sapiens
ucaguuguuuaauaauuua

SEQ ID NO: 1307833 - RNA, 21 nt, Homo sapiens
ucauaagauuaugaaaccaca

SEQ ID NO: 1307834 - RNA, 16 nt, Homo sapiens
ucauaauuaauguagu

SEQ ID NO: 1307835 - RNA, 20 nt, Homo sapiens
ucauacagcugugaagacuu

SEQ ID NO: 1307836 - RNA, 22 nt, Homo sapiens
ucauacccaccaggaugugugc

SEQ ID NO: 1307837 - RNA, 20 nt, Homo sapiens
ucauagauguuuccuugccu

SEQ ID NO: 1307838 - RNA, 15 nt, Homo sapiens
ucauauacugccaug

SEQ ID NO: 1307839 - RNA, 13 nt, Homo sapiens
ucauauauugcau

SEQ ID NO: 1307840 - RNA, 19 nt, Homo sapiens
ucauaugaaaggugccaug

SEQ ID NO: 1307841 - RNA, 20 nt, Homo sapiens
ucauaugcaaagcauauuaa

SEQ ID NO: 1307842 - RNA, 20 nt, Homo sapiens
ucaucaccuguuaucugugu

SEQ ID NO: 1307843 - RNA, 12 nt, Homo sapiens
ucaucagagccu

SEQ ID NO: 1307844 - RNA, 15 nt, Homo sapiens
ucaucaggugcauag

SEQ ID NO: 1307845 - RNA, 18 nt, Homo sapiens
ucaucaggugcauagcaa

SEQ ID NO: 1307846 - RNA, 23 nt, Homo sapiens
ucaucaggugcauagcaagugaa

SEQ ID NO: 1307847 - RNA, 12 nt, Homo sapiens
ucaucauucccu

SEQ ID NO: 1307848 - RNA, 18 nt, Homo sapiens
ucaucauucucugucuca

SEQ ID NO: 1307849 - RNA, 16 nt, Homo sapiens
ucaucucucugcccaa

SEQ ID NO: 1307850 - RNA, 12 nt, Homo sapiens
ucaucuggcugc

SEQ ID NO: 1307851 - RNA, 23 nt, Homo sapiens
ucaucuucgaccacaucagaaag

SEQ ID NO: 1307852 - RNA, 12 nt, Homo sapiens
ucaucuugccac

SEQ ID NO: 1307853 - RNA, 18 nt, Homo sapiens
ucaucuuucuuguuucau

SEQ ID NO: 1307854 - RNA, 14 nt, Homo sapiens
ucaugacagccaga

SEQ ID NO: 1307855 - RNA, 14 nt, Homo sapiens
ucaugagccugcug

SEQ ID NO: 1307856 - RNA, 16 nt, Homo sapiens
ucaugaguaacugauu

SEQ ID NO: 1307857 - RNA, 16 nt, Homo sapiens
ucaugcaaaugcugua

SEQ ID NO: 1307858 - RNA, 23 nt, Homo sapiens
ucaugccaccauggccagccaac

SEQ ID NO: 1307859 - RNA, 14 nt, Homo sapiens
ucaugccauugcac

SEQ ID NO: 1307860 - RNA, 10 nt, Homo sapiens
ucaugcccuc

SEQ ID NO: 1307861 - RNA, 15 nt, Homo sapiens
ucaugcgcaacugga

SEQ ID NO: 1307862 - RNA, 16 nt, Homo sapiens
ucaugcgcaacuggag

SEQ ID NO: 1307863 - RNA, 20 nt, Homo sapiens
ucaugcuacagaaagcugcu

SEQ ID NO: 1307864 - RNA, 14 nt, Homo sapiens
ucaugcugaucuuc

SEQ ID NO: 1307865 - RNA, 20 nt, Homo sapiens
ucauggaugggggaacucag

SEQ ID NO: 1307866 - RNA, 14 nt, Homo sapiens
ucauggauuacuuc

SEQ ID NO: 1307867 - RNA, 21 nt, Homo sapiens
ucauggcuucucucucucuuu

SEQ ID NO: 1307868 - RNA, 17 nt, Homo sapiens
ucauguauaguuuuccc

SEQ ID NO: 1307869 - RNA, 21 nt, Homo sapiens
ucaugucucacgucucccuaa

SEQ ID NO: 1307870 - RNA, 14 nt, Homo sapiens
ucaugucucacuuc

SEQ ID NO: 1307871 - RNA, 19 nt, Homo sapiens
ucaugugccucuguccuua

SEQ ID NO: 1307872 - RNA, 16 nt, Homo sapiens
ucauuaaggucauuac

SEQ ID NO: 1307873 - RNA, 19 nt, Homo sapiens
ucauucauuuaacagagcu

SEQ ID NO: 1307874 - RNA, 15 nt, Homo sapiens
ucauucucauucuca

SEQ ID NO: 1307875 - RNA, 21 nt, Homo sapiens
ucauucucugucucauccauc

SEQ ID NO: 1307876 - RNA, 18 nt, Homo sapiens
ucauucuguuagauacua

SEQ ID NO: 1307877 - RNA, 12 nt, Homo sapiens
ucauucuuuauu

SEQ ID NO: 1307878 - RNA, 21 nt, Homo sapiens
ucauugaggauaaauugccau

SEQ ID NO: 1307879 - RNA, 23 nt, Homo sapiens
ucauugaugagcaagacauacuu

SEQ ID NO: 1307880 - RNA, 15 nt, Homo sapiens
ucauugccacacuug

SEQ ID NO: 1307881 - RNA, 17 nt, Homo sapiens
ucauuggcuauaaccuc

SEQ ID NO: 1307882 - RNA, 13 nt, Homo sapiens
ucauuguauucag

SEQ ID NO: 1307883 - RNA, 23 nt, Homo sapiens
ucauuucaggagcagccucagaa

SEQ ID NO: 1307884 - RNA, 14 nt, Homo sapiens
ucauuucauguaua

SEQ ID NO: 1307885 - RNA, 15 nt, Homo sapiens
ucauuucauguauag

SEQ ID NO: 1307886 - RNA, 15 nt, Homo sapiens
ucauuuugcacugua

SEQ ID NO: 1307887 - RNA, 14 nt, Homo sapiens
uccaaaaagcacau

SEQ ID NO: 1307888 - RNA, 13 nt, Homo sapiens
uccaaacauucuc

SEQ ID NO: 1307889 - RNA, 19 nt, Homo sapiens
uccaaacauucuccaguaa

SEQ ID NO: 1307890 - RNA, 14 nt, Homo sapiens
uccaaaggccaugg

SEQ ID NO: 1307891 - RNA, 16 nt, Homo sapiens
uccaaaugcccagcuu

SEQ ID NO: 1307892 - RNA, 15 nt, Homo sapiens
uccaaccuucccaaa

SEQ ID NO: 1307893 - RNA, 14 nt, Homo sapiens
uccaacuauuuauu

SEQ ID NO: 1307894 - RNA, 17 nt, Homo sapiens
uccaacuguacuuuuaa

SEQ ID NO: 1307895 - RNA, 21 nt, Homo sapiens
uccaaggaaaccacagcugcu

SEQ ID NO: 1307896 - RNA, 14 nt, Homo sapiens
uccaaggaacuaau

SEQ ID NO: 1307897 - RNA, 18 nt, Homo sapiens
uccaagugcggcacugca

SEQ ID NO: 1307898 - RNA, 13 nt, Homo sapiens
ucccacaggacau

SEQ ID NO: 1307899 - RNA, 17 nt, Homo sapiens
ucccacccccaucucuc

SEQ ID NO: 1307900 - RNA, 14 nt, Homo sapiens
ucccaccucagccu

SEQ ID NO: 1307901 - RNA, 14 nt, Homo sapiens
ucccacgaggaauc

SEQ ID NO: 1307902 - RNA, 15 nt, Homo sapiens
ucccacucaagccaa

SEQ ID NO: 1307903 - RNA, 13 nt, Homo sapiens
ucccacuguauga

SEQ ID NO: 1307904 - RNA, 18 nt, Homo sapiens
ucccagaacacacuccau

SEQ ID NO: 1307905 - RNA, 13 nt, Homo sapiens
ucccagacacugg

SEQ ID NO: 1307906 - RNA, 18 nt, Homo sapiens
ucccagagcaucuugcau

SEQ ID NO: 1307907 - RNA, 15 nt, Homo sapiens
ucccagcuacuuggg

SEQ ID NO: 1307908 - RNA, 14 nt, Homo sapiens
ucccaggacccuga

SEQ ID NO: 1307909 - RNA, 19 nt, Homo sapiens
ucccaggcccagugcaguc

SEQ ID NO: 1307910 - RNA, 20 nt, Homo sapiens
ucccaguggcugcugcccag

SEQ ID NO: 1307911 - RNA, 19 nt, Homo sapiens
ucccauaccacccaaugcu

SEQ ID NO: 1307912 - RNA, 13 nt, Homo sapiens
ucccaucugguca

SEQ ID NO: 1307913 - RNA, 23 nt, Homo sapiens
ucccaugacauggagaccgugac

SEQ ID NO: 1307914 - RNA, 16 nt, Homo sapiens
ucccaugacccaggcu

SEQ ID NO: 1307915 - RNA, 16 nt, Homo sapiens
ucccauggaucaucaa

SEQ ID NO: 1307916 - RNA, 12 nt, Homo sapiens
ucccauugccau

SEQ ID NO: 1307917 - RNA, 17 nt, Homo sapiens
uccccaauaauugcaga

SEQ ID NO: 1307918 - RNA, 23 nt, Homo sapiens
uccccacgagggcuggcuggccu

SEQ ID NO: 1307919 - RNA, 21 nt, Homo sapiens
uccccagcccagagacauacu

SEQ ID NO: 1307920 - RNA, 15 nt, Homo sapiens
ucccccaggugcagu

SEQ ID NO: 1307921 - RNA, 22 nt, Homo sapiens
uccccucagggauacgacacau

SEQ ID NO: 1307922 - RNA, 19 nt, Homo sapiens
uccccugccuccuacucca

SEQ ID NO: 1307923 - RNA, 20 nt, Homo sapiens
uccccuggggagucugggca

SEQ ID NO: 1307924 - RNA, 21 nt, Homo sapiens
uccccuguagcagucacugac

SEQ ID NO: 1307925 - RNA, 18 nt, Homo sapiens
uccccuucucucaucucu

SEQ ID NO: 1307926 - RNA, 19 nt, Homo sapiens
uccccuuuugccaaucuca

SEQ ID NO: 1307927 - RNA, 18 nt, Homo sapiens
ucccgauggccacugggu

SEQ ID NO: 1307928 - RNA, 19 nt, Homo sapiens
ucccgccggaggccagcua

SEQ ID NO: 1307929 - RNA, 21 nt, Homo sapiens
ucccuagauuuaaccauggca

SEQ ID NO: 1307930 - RNA, 15 nt, Homo sapiens
ucccucaucuguccc

SEQ ID NO: 1307931 - RNA, 16 nt, Homo sapiens
ucccuccccugccauu

SEQ ID NO: 1307932 - RNA, 14 nt, Homo sapiens
ucccugacuccucc

SEQ ID NO: 1307933 - RNA, 19 nt, Homo sapiens
ucccugacuuuucugugga

SEQ ID NO: 1307934 - RNA, 14 nt, Homo sapiens
ucccugggccucag

SEQ ID NO: 1307935 - RNA, 14 nt, Homo sapiens
ucccuguaaccucu

SEQ ID NO: 1307936 - RNA, 16 nt, Homo sapiens
ucccuucccauaagcu

SEQ ID NO: 1307937 - RNA, 17 nt, Homo sapiens
ucccuucggccaaacag

SEQ ID NO: 1307938 - RNA, 16 nt, Homo sapiens
ucccuucuaaccugaa

SEQ ID NO: 1307939 - RNA, 23 nt, Homo sapiens
ucccuugcuguaugcugaucauc

SEQ ID NO: 1307940 - RNA, 21 nt, Homo sapiens
ucccuugugggaaacugaggc

SEQ ID NO: 1307941 - RNA, 19 nt, Homo sapiens
ucccuuuaugcacccaaga

SEQ ID NO: 1307942 - RNA, 12 nt, Homo sapiens
ucccuuuuacau

SEQ ID NO: 1307943 - RNA, 17 nt, Homo sapiens
ucccuuuuuacacuuua

SEQ ID NO: 1307944 - RNA, 20 nt, Homo sapiens
ucccuuuuuacacuuuaugg

SEQ ID NO: 1307945 - RNA, 23 nt, Homo sapiens
ucccuuuuuauaucccauuuuua

SEQ ID NO: 1307946 - RNA, 15 nt, Homo sapiens
uccgaggccaguacc

SEQ ID NO: 1307947 - RNA, 18 nt, Homo sapiens
uccgauuccccuguagca

SEQ ID NO: 1307948 - RNA, 17 nt, Homo sapiens
uccgugaaggugaccuc

SEQ ID NO: 1307949 - RNA, 20 nt, Homo sapiens
uccguggcacugcauacaau

SEQ ID NO: 1307950 - RNA, 19 nt, Homo sapiens
uccuaaaacaaaagcucau

SEQ ID NO: 1307951 - RNA, 23 nt, Homo sapiens
uccuaaagaaaaauaucuuggcc

SEQ ID NO: 1307952 - RNA, 15 nt, Homo sapiens
uccuaaagcuuuuau

SEQ ID NO: 1307953 - RNA, 18 nt, Homo sapiens
uccuaaccucaagugauc

SEQ ID NO: 1307954 - RNA, 19 nt, Homo sapiens
uccuaaccuuccuguaaac

SEQ ID NO: 1307955 - RNA, 16 nt, Homo sapiens
uccuaacguuugucau

SEQ ID NO: 1307956 - RNA, 17 nt, Homo sapiens
uccuaacguuugucauu

SEQ ID NO: 1307957 - RNA, 18 nt, Homo sapiens
uccuaaguauauuaauau

SEQ ID NO: 1307958 - RNA, 21 nt, Homo sapiens
uccuaauaucaaaugcaguau

SEQ ID NO: 1307959 - RNA, 13 nt, Homo sapiens
uccuaaucaucca

SEQ ID NO: 1307960 - RNA, 20 nt, Homo sapiens
uccuaccuguuuugugguca

SEQ ID NO: 1307961 - RNA, 18 nt, Homo sapiens
uccuacucugugucaggu

SEQ ID NO: 1307962 - RNA, 18 nt, Homo sapiens
uccuacuguaugugggaa

SEQ ID NO: 1307963 - RNA, 13 nt, Homo sapiens
uccuagcacuuug

SEQ ID NO: 1307964 - RNA, 17 nt, Homo sapiens
uccuagggccacugaag

SEQ ID NO: 1307965 - RNA, 15 nt, Homo sapiens
uccuaggucaugccu

SEQ ID NO: 1307966 - RNA, 18 nt, Homo sapiens
uccuaugcuauugacaau

SEQ ID NO: 1307967 - RNA, 19 nt, Homo sapiens
uccuaugcuuugaaacaga

SEQ ID NO: 1307968 - RNA, 22 nt, Homo sapiens
uccuaugugauuuuaacucugu

SEQ ID NO: 1307969 - RNA, 13 nt, Homo sapiens
uccuauuacauag

SEQ ID NO: 1307970 - RNA, 15 nt, Homo sapiens
uccucaaaacuggag

SEQ ID NO: 1307971 - RNA, 18 nt, Homo sapiens
uccucauaggucagggag

SEQ ID NO: 1307972 - RNA, 21 nt, Homo sapiens
uccucaugcccccucagugag

SEQ ID NO: 1307973 - RNA, 16 nt, Homo sapiens
uccucauuuacuggau

SEQ ID NO: 1307974 - RNA, 21 nt, Homo sapiens
uccucauuuacuggauuugac

SEQ ID NO: 1307975 - RNA, 22 nt, Homo sapiens
uccuccaacaccaagcacagca

SEQ ID NO: 1307976 - RNA, 13 nt, Homo sapiens
uccuccaggguga

SEQ ID NO: 1307977 - RNA, 20 nt, Homo sapiens
uccuccagggugugugcucg

SEQ ID NO: 1307978 - RNA, 14 nt, Homo sapiens
uccucccaccucag

SEQ ID NO: 1307979 - RNA, 22 nt, Homo sapiens
uccuccucugacuuggggaccu

SEQ ID NO: 1307980 - RNA, 19 nt, Homo sapiens
uccuccugcccaccuguca

SEQ ID NO: 1307981 - RNA, 14 nt, Homo sapiens
ucgugcauuucaac

SEQ ID NO: 1307982 - RNA, 21 nt, Homo sapiens
ucuaaaaaucaaauaagcuaa

SEQ ID NO: 1307983 - RNA, 19 nt, Homo sapiens
ucuaaacuuuagaauuaau

SEQ ID NO: 1307984 - RNA, 19 nt, Homo sapiens
ucuaaaguguuuagcuguc

SEQ ID NO: 1307985 - RNA, 23 nt, Homo sapiens
ucuaaaucaccagagaccaaaca

SEQ ID NO: 1307986 - RNA, 20 nt, Homo sapiens
ucuaagagaacaaugugcua

SEQ ID NO: 1307987 - RNA, 13 nt, Homo sapiens
ucuaauacauucc

SEQ ID NO: 1307988 - RNA, 15 nt, Homo sapiens
ucuaccagagugaug

SEQ ID NO: 1307989 - RNA, 20 nt, Homo sapiens
ucuaccagagugauggauuu

SEQ ID NO: 1307990 - RNA, 16 nt, Homo sapiens
ucuaccuugcagugua

SEQ ID NO: 1307991 - RNA, 14 nt, Homo sapiens
ucuacgccagggga

SEQ ID NO: 1307992 - RNA, 19 nt, Homo sapiens
ucuacuaaaaguuuaggga

SEQ ID NO: 1307993 - RNA, 15 nt, Homo sapiens
ucuacuaacaaucag

SEQ ID NO: 1307994 - RNA, 21 nt, Homo sapiens
ucuacuaacaaucagcuccuu

SEQ ID NO: 1307995 - RNA, 18 nt, Homo sapiens
ucuagaagugccaucuca

SEQ ID NO: 1307996 - RNA, 19 nt, Homo sapiens
ucuagaagugccaucucaa

SEQ ID NO: 1307997 - RNA, 12 nt, Homo sapiens
ucuagaauuugg

SEQ ID NO: 1307998 - RNA, 16 nt, Homo sapiens
ucuagagcacugccac

SEQ ID NO: 1307999 - RNA, 18 nt, Homo sapiens
ucuagauuauggagcuuu

SEQ ID NO: 1308000 - RNA, 11 nt, Homo sapiens
ucuagccaaau

SEQ ID NO: 1308001 - RNA, 17 nt, Homo sapiens
ucuagcucuaguucaaa

SEQ ID NO: 1308002 - RNA, 16 nt, Homo sapiens
ucuagggaaaaaccag

SEQ ID NO: 1308003 - RNA, 22 nt, Homo sapiens
ucuagguaggggcccacuucac

SEQ ID NO: 1308004 - RNA, 13 nt, Homo sapiens
ucuagugaucucg

SEQ ID NO: 1308005 - RNA, 15 nt, Homo sapiens
ucuauaagauuccaa

SEQ ID NO: 1308006 - RNA, 14 nt, Homo sapiens
ucuauaaggccaua

SEQ ID NO: 1308007 - RNA, 13 nt, Homo sapiens
ucuauaugcuuuc

SEQ ID NO: 1308008 - RNA, 21 nt, Homo sapiens
ucuaugaguggaaaaagccaa

SEQ ID NO: 1308009 - RNA, 17 nt, Homo sapiens
ucuauguagugguuuua

SEQ ID NO: 1308010 - RNA, 14 nt, Homo sapiens
ucuauguggcugua

SEQ ID NO: 1308011 - RNA, 17 nt, Homo sapiens
ucuauugaccaccaguu

SEQ ID NO: 1308012 - RNA, 20 nt, Homo sapiens
ucuauugagugaacagaauu

SEQ ID NO: 1308013 - RNA, 17 nt, Homo sapiens
ucuauuuggaacccaag

SEQ ID NO: 1308014 - RNA, 20 nt, Homo sapiens
ucucaaacggcaacauuccu

SEQ ID NO: 1308015 - RNA, 16 nt, Homo sapiens
ucucaaagaaggcauu

SEQ ID NO: 1308016 - RNA, 19 nt, Homo sapiens
ucucaccuacccaugaccu

SEQ ID NO: 1308017 - RNA, 18 nt, Homo sapiens
ucucacuauguugcccag

SEQ ID NO: 1308018 - RNA, 20 nt, Homo sapiens
ucucacuauguugcccaggc

SEQ ID NO: 1308019 - RNA, 22 nt, Homo sapiens
ucucacugugggaaggccagcu

SEQ ID NO: 1308020 - RNA, 15 nt, Homo sapiens
ucucacuguguuacu

SEQ ID NO: 1308021 - RNA, 9 nt, Homo sapiens
ucucagcug

SEQ ID NO: 1308022 - RNA, 15 nt, Homo sapiens
ucucaguucuugagg

SEQ ID NO: 1308023 - RNA, 14 nt, Homo sapiens
ucucaguugcagcc

SEQ ID NO: 1308024 - RNA, 18 nt, Homo sapiens
ucucauagguugagcaau

SEQ ID NO: 1308025 - RNA, 13 nt, Homo sapiens
ucucauccaucau

SEQ ID NO: 1308026 - RNA, 18 nt, Homo sapiens
ucucaugggaaggggagg

SEQ ID NO: 1308027 - RNA, 16 nt, Homo sapiens
ucucauuacugcuuca

SEQ ID NO: 1308028 - RNA, 11 nt, Homo sapiens
ucucauucccu

SEQ ID NO: 1308029 - RNA, 12 nt, Homo sapiens
ucucauuccugu

SEQ ID NO: 1308030 - RNA, 10 nt, Homo sapiens
ucucauuucu

SEQ ID NO: 1308031 - RNA, 15 nt, Homo sapiens
ucuccaaaacuaaau

SEQ ID NO: 1308032 - RNA, 18 nt, Homo sapiens
ucuccaaggagcauguca

SEQ ID NO: 1308033 - RNA, 20 nt, Homo sapiens
ucuccaaggagcaugucacu

SEQ ID NO: 1308034 - RNA, 20 nt, Homo sapiens
ucuccacucaguugcaacuu

SEQ ID NO: 1308035 - RNA, 20 nt, Homo sapiens
ucuccagagggaauugcaga

SEQ ID NO: 1308036 - RNA, 21 nt, Homo sapiens
ucuccaggcauuuagcccuca

SEQ ID NO: 1308037 - RNA, 14 nt, Homo sapiens
ucucccacacaaga

SEQ ID NO: 1308038 - RNA, 15 nt, Homo sapiens
ucuccccguggaccc

SEQ ID NO: 1308039 - RNA, 18 nt, Homo sapiens
ucuccccucagagugcaa

SEQ ID NO: 1308040 - RNA, 21 nt, Homo sapiens
ucuccccucagcucggcucag

SEQ ID NO: 1308041 - RNA, 13 nt, Homo sapiens
ucucccugacccu

SEQ ID NO: 1308042 - RNA, 16 nt, Homo sapiens
ucuccuaaagcuuuua

SEQ ID NO: 1308043 - RNA, 17 nt, Homo sapiens
ucuccuaaagcuuuuau

SEQ ID NO: 1308044 - RNA, 12 nt, Homo sapiens
ucuccucaugcc

SEQ ID NO: 1308045 - RNA, 12 nt, Homo sapiens
ucuccucuccau

SEQ ID NO: 1308046 - RNA, 16 nt, Homo sapiens
ucuccucuucccgccg

SEQ ID NO: 1308047 - RNA, 13 nt, Homo sapiens
ucuccucuuguaa

SEQ ID NO: 1308048 - RNA, 18 nt, Homo sapiens
ucuccugauggaagugua

SEQ ID NO: 1308049 - RNA, 16 nt, Homo sapiens
ucuccuuggaggacag

SEQ ID NO: 1308050 - RNA, 20 nt, Homo sapiens
ucucgaacuccuaaccucaa

SEQ ID NO: 1308051 - RNA, 13 nt, Homo sapiens
ucucgcucuggau

SEQ ID NO: 1308052 - RNA, 18 nt, Homo sapiens
ucucgcuuuguugcccag

SEQ ID NO: 1308053 - RNA, 14 nt, Homo sapiens
ucucgguuugccaa

SEQ ID NO: 1308054 - RNA, 14 nt, Homo sapiens
ucucgugcauuuca

SEQ ID NO: 1308055 - RNA, 20 nt, Homo sapiens
ucucuagacaacuaccccuu

SEQ ID NO: 1308056 - RNA, 19 nt, Homo sapiens
ucucuauugaccaccaguu

SEQ ID NO: 1308057 - RNA, 19 nt, Homo sapiens
ucucucaucucuuagcucc

SEQ ID NO: 1308058 - RNA, 19 nt, Homo sapiens
ucucuccccagaugugacu

SEQ ID NO: 1308059 - RNA, 12 nt, Homo sapiens
ucucucugggcu

SEQ ID NO: 1308060 - RNA, 14 nt, Homo sapiens
ucucugagcaguga

SEQ ID NO: 1308061 - RNA, 22 nt, Homo sapiens
ucucugcagggccgccagggag

SEQ ID NO: 1308062 - RNA, 11 nt, Homo sapiens
ucucugggcug

SEQ ID NO: 1308063 - RNA, 12 nt, Homo sapiens
ucucuguacuuu

SEQ ID NO: 1308064 - RNA, 19 nt, Homo sapiens
ucucugucccuugcuguau

SEQ ID NO: 1308065 - RNA, 18 nt, Homo sapiens
ucucugucucucugucuc

SEQ ID NO: 1308066 - RNA, 24 nt, Homo sapiens
ucucuguguaugagugugaaugau

SEQ ID NO: 1308067 - RNA, 15 nt, Homo sapiens
ucucuugcauuguga

SEQ ID NO: 1308068 - RNA, 21 nt, Homo sapiens
ucucuugggccaagccagcug

SEQ ID NO: 1308069 - RNA, 15 nt, Homo sapiens
ucucuugucaaguca

SEQ ID NO: 1308070 - RNA, 20 nt, Homo sapiens
ucuggaggacggucagucca

SEQ ID NO: 1308071 - RNA, 15 nt, Homo sapiens
ucuggaggcaaucaa

SEQ ID NO: 1308072 - RNA, 18 nt, Homo sapiens
ucuggauggugugccuuc

SEQ ID NO: 1308073 - RNA, 22 nt, Homo sapiens
ucuggccguccuugucucuggg

SEQ ID NO: 1308074 - RNA, 23 nt, Homo sapiens
ucuggcuagauuaccuagcuuag

SEQ ID NO: 1308075 - RNA, 22 nt, Homo sapiens
ucugguccaggcccuguggcag

SEQ ID NO: 1308076 - RNA, 14 nt, Homo sapiens
ucugguccuaccca

SEQ ID NO: 1308077 - RNA, 20 nt, Homo sapiens
ucugguuacuaauuagcuuc

SEQ ID NO: 1308078 - RNA, 16 nt, Homo sapiens
ucuguaaggacgccuu

SEQ ID NO: 1308079 - RNA, 16 nt, Homo sapiens
ucuguacaaaguacua

SEQ ID NO: 1308080 - RNA, 21 nt, Homo sapiens
ucuguacaaaguacuagcuaa

SEQ ID NO: 1308081 - RNA, 16 nt, Homo sapiens
ucuguaggaaccgugg

SEQ ID NO: 1308082 - RNA, 15 nt, Homo sapiens
ucuguagugugaaac

SEQ ID NO: 1308083 - RNA, 19 nt, Homo sapiens
ucuguaucccccacccacu

SEQ ID NO: 1308084 - RNA, 18 nt, Homo sapiens
ucuguccagcagucacuu

SEQ ID NO: 1308085 - RNA, 17 nt, Homo sapiens
ucuguccuacucugugu

SEQ ID NO: 1308086 - RNA, 19 nt, Homo sapiens
ucugucuccuuaacacuga

SEQ ID NO: 1308087 - RNA, 14 nt, Homo sapiens
ucugucuuguucau

SEQ ID NO: 1308088 - RNA, 15 nt, Homo sapiens
ucugugcacugccca

SEQ ID NO: 1308089 - RNA, 17 nt, Homo sapiens
ucugugccccucaugcu

SEQ ID NO: 1308090 - RNA, 19 nt, Homo sapiens
ucugugggauaucacauca

SEQ ID NO: 1308091 - RNA, 14 nt, Homo sapiens
ucuguguucaggau

SEQ ID NO: 1308092 - RNA, 23 nt, Homo sapiens
ucuguugcaagccccucuuucug

SEQ ID NO: 1308093 - RNA, 14 nt, Homo sapiens
ucuguuuacugcaa

SEQ ID NO: 1308094 - RNA, 14 nt, Homo sapiens
ucuguuugacuuua

SEQ ID NO: 1308095 - RNA, 14 nt, Homo sapiens
ucuguuugagauuu

SEQ ID NO: 1308096 - RNA, 22 nt, Homo sapiens
ucuuaagcuaagacugauguca

SEQ ID NO: 1308097 - RNA, 23 nt, Homo sapiens
ucuuacaacaggcuuaugaauau

SEQ ID NO: 1308098 - RNA, 14 nt, Homo sapiens
ucuuacauguauaa

SEQ ID NO: 1308099 - RNA, 19 nt, Homo sapiens
ucuuagaguugauuccuca

SEQ ID NO: 1308100 - RNA, 23 nt, Homo sapiens
ucuuagcuccccuccaaccuggg

SEQ ID NO: 1308101 - RNA, 18 nt, Homo sapiens
ucuuaggugacaaugucc

SEQ ID NO: 1308102 - RNA, 17 nt, Homo sapiens
ucuuagucucagcacua

SEQ ID NO: 1308103 - RNA, 13 nt, Homo sapiens
ucuuagugccuuu

SEQ ID NO: 1308104 - RNA, 20 nt, Homo sapiens
ucuuagugugccaagaguuc

SEQ ID NO: 1308105 - RNA, 20 nt, Homo sapiens
ucuuaguuacuuuggaacac

SEQ ID NO: 1308106 - RNA, 14 nt, Homo sapiens
ucuuaucauggucu

SEQ ID NO: 1308107 - RNA, 22 nt, Homo sapiens
ucuucaagacgacagcucugua

SEQ ID NO: 1308108 - RNA, 20 nt, Homo sapiens
ucuucaggaauguggcugca

SEQ ID NO: 1308109 - RNA, 21 nt, Homo sapiens
ucuucagggaacugcauagau

SEQ ID NO: 1308110 - RNA, 16 nt, Homo sapiens
ucuucccaaacccagu

SEQ ID NO: 1308111 - RNA, 20 nt, Homo sapiens
ucuucccagcacuaugcuuu

SEQ ID NO: 1308112 - RNA, 13 nt, Homo sapiens
ucuuccccagaua

SEQ ID NO: 1308113 - RNA, 19 nt, Homo sapiens
ucuucccuuuuacauacug

SEQ ID NO: 1308114 - RNA, 19 nt, Homo sapiens
ucuucgaccacaucagaaa

SEQ ID NO: 1308115 - RNA, 13 nt, Homo sapiens
ucuucucauuuca

SEQ ID NO: 1308116 - RNA, 23 nt, Homo sapiens
ucuucuccaggcuguaucccaug

SEQ ID NO: 1308117 - RNA, 13 nt, Homo sapiens
ucuucucuacucu

SEQ ID NO: 1308118 - RNA, 14 nt, Homo sapiens
ucuucucuacucua

SEQ ID NO: 1308119 - RNA, 15 nt, Homo sapiens
ucuucucugcacuua

SEQ ID NO: 1308120 - RNA, 23 nt, Homo sapiens
ucuucuggccuggugucuccuca

SEQ ID NO: 1308121 - RNA, 23 nt, Homo sapiens
ucuugaaaauagaacaacuugca

SEQ ID NO: 1308122 - RNA, 21 nt, Homo sapiens
ucuugaaauuaagaaggcaaa

SEQ ID NO: 1308123 - RNA, 14 nt, Homo sapiens
ucuugaaggugcug

SEQ ID NO: 1308124 - RNA, 14 nt, Homo sapiens
ucuugaauagcuua

SEQ ID NO: 1308125 - RNA, 19 nt, Homo sapiens
ucuugacuacagucaggaa

SEQ ID NO: 1308126 - RNA, 16 nt, Homo sapiens
ucuugcuguugacaua

SEQ ID NO: 1308127 - RNA, 17 nt, Homo sapiens
ucuuggcuuaaucauuu

SEQ ID NO: 1308128 - RNA, 23 nt, Homo sapiens
ucuuggggggguggccgcugagu

SEQ ID NO: 1308129 - RNA, 17 nt, Homo sapiens
ucuuguuccccacugac

SEQ ID NO: 1308130 - RNA, 16 nt, Homo sapiens
ucuuguuguuauugau

SEQ ID NO: 1308131 - RNA, 23 nt, Homo sapiens
ucuuuaaauauauauuauucuca

SEQ ID NO: 1308132 - RNA, 20 nt, Homo sapiens
ucuuuacaaaacuacaugag

SEQ ID NO: 1308133 - RNA, 21 nt, Homo sapiens
ucuuuacaaaacuacaugaga

SEQ ID NO: 1308134 - RNA, 18 nt, Homo sapiens
ucuuuagccagaaucuca

SEQ ID NO: 1308135 - RNA, 15 nt, Homo sapiens
ucuuuauuauggaaa

SEQ ID NO: 1308136 - RNA, 20 nt, Homo sapiens
ucuuuauuauggaaaacauu

SEQ ID NO: 1308137 - RNA, 16 nt, Homo sapiens
ucuuucagacuugcca

SEQ ID NO: 1308138 - RNA, 18 nt, Homo sapiens
ucuuucauaaaaacacuc

SEQ ID NO: 1308139 - RNA, 17 nt, Homo sapiens
ucuuucccaauucacau

SEQ ID NO: 1308140 - RNA, 19 nt, Homo sapiens
ucuuuccuccuuccaugga

SEQ ID NO: 1308141 - RNA, 16 nt, Homo sapiens
ucuuucuuacaaggaa

SEQ ID NO: 1308142 - RNA, 14 nt, Homo sapiens
ucuuucuuacacaa

SEQ ID NO: 1308143 - RNA, 20 nt, Homo sapiens
ucuuugaacccuugcuugca

SEQ ID NO: 1308144 - RNA, 22 nt, Homo sapiens
ucuuugcaggaggcccaaccuc

SEQ ID NO: 1308145 - RNA, 16 nt, Homo sapiens
ucuuuggacaaccaug

SEQ ID NO: 1308146 - RNA, 23 nt, Homo sapiens
ucuuuuaaagaaauaaccacugc

SEQ ID NO: 1308147 - RNA, 21 nt, Homo sapiens
ucuuuugggggucaacaguuu

SEQ ID NO: 1308148 - RNA, 23 nt, Homo sapiens
ugaaaaaguauaaauaaaaugag

SEQ ID NO: 1308149 - RNA, 14 nt, Homo sapiens
ugaaaacaauguaa

SEQ ID NO: 1308150 - RNA, 15 nt, Homo sapiens
ugaaaagaaggaaua

SEQ ID NO: 1308151 - RNA, 19 nt, Homo sapiens
ugaaaaugguccaggagaa

SEQ ID NO: 1308152 - RNA, 13 nt, Homo sapiens
ugaaacacuuuca

SEQ ID NO: 1308153 - RNA, 15 nt, Homo sapiens
ugaaacagcugccuu

SEQ ID NO: 1308154 - RNA, 13 nt, Homo sapiens
ugaaacccaguca

SEQ ID NO: 1308155 - RNA, 18 nt, Homo sapiens
ugaaaccuacacacuguc

SEQ ID NO: 1308156 - RNA, 23 nt, Homo sapiens
ugaaaccuuaguuucaagagucu

SEQ ID NO: 1308157 - RNA, 22 nt, Homo sapiens
ugaaacucaucucauuacccuu

SEQ ID NO: 1308158 - RNA, 22 nt, Homo sapiens
ugaaacuugggcacaugcucag

SEQ ID NO: 1308159 - RNA, 15 nt, Homo sapiens
ugaaagaaaauaacg

SEQ ID NO: 1308160 - RNA, 15 nt, Homo sapiens
ugaaagacuucacua

SEQ ID NO: 1308161 - RNA, 20 nt, Homo sapiens
ugaaagcaaccuucuugccu

SEQ ID NO: 1308162 - RNA, 12 nt, Homo sapiens
uuuuucucauga

SEQ ID NO: 1308163 - RNA, 21 nt, Homo sapiens
uuuuugaaauaaagaaccagu

SEQ ID NO: 1308164 - RNA, 12 nt, Homo sapiens
uuuuuuccuuaa

SEQ ID NO: 1308165 - RNA, 20 nt, Homo sapiens
agucgucuggcaucucccac

SEQ ID NO: 1308166 - RNA, 23 nt, Homo sapiens
agucucacugugggaaggccagc

SEQ ID NO: 1308167 - RNA, 13 nt, Homo sapiens
agucucauucugu

SEQ ID NO: 1308168 - RNA, 15 nt, Homo sapiens
agucucauucuguca

SEQ ID NO: 1308169 - RNA, 16 nt, Homo sapiens
agucucauucugucac

SEQ ID NO: 1308170 - RNA, 15 nt, Homo sapiens
agucucucauucuag

SEQ ID NO: 1308171 - RNA, 20 nt, Homo sapiens
agucucuguguaaucaucug

SEQ ID NO: 1308172 - RNA, 14 nt, Homo sapiens
agucugaaccuauu

SEQ ID NO: 1308173 - RNA, 15 nt, Homo sapiens
agucugagcuucuuu

SEQ ID NO: 1308174 - RNA, 19 nt, Homo sapiens
agucugaugagaacucuga

SEQ ID NO: 1308175 - RNA, 15 nt, Homo sapiens
agucuguuuacugca

SEQ ID NO: 1308176 - RNA, 17 nt, Homo sapiens
agucuuuagggguuggg

SEQ ID NO: 1308177 - RNA, 13 nt, Homo sapiens
agucuuugccagu

SEQ ID NO: 1308178 - RNA, 22 nt, Homo sapiens
agugaaacuauauguauucaca

SEQ ID NO: 1308179 - RNA, 23 nt, Homo sapiens
agugaaacuugggcacaugcuca

SEQ ID NO: 1308180 - RNA, 17 nt, Homo sapiens
agugaagccaaagggac

SEQ ID NO: 1308181 - RNA, 12 nt, Homo sapiens
agugaaggauuu

SEQ ID NO: 1308182 - RNA, 15 nt, Homo sapiens
agugaauuuuugcaa

SEQ ID NO: 1308183 - RNA, 18 nt, Homo sapiens
agugacagagacccagau

SEQ ID NO: 1308184 - RNA, 22 nt, Homo sapiens
agugacagagacccagaucuca

SEQ ID NO: 1308185 - RNA, 16 nt, Homo sapiens
agugagaugcauucuu

SEQ ID NO: 1308186 - RNA, 17 nt, Homo sapiens
agugagcccaucugcac

SEQ ID NO: 1308187 - RNA, 19 nt, Homo sapiens
agugagucgaggacaggga

SEQ ID NO: 1308188 - RNA, 20 nt, Homo sapiens
agugaguguuucuaugagug

SEQ ID NO: 1308189 - RNA, 12 nt, Homo sapiens
agugauggagcu

SEQ ID NO: 1308190 - RNA, 21 nt, Homo sapiens
agugcaagccccugcuccaga

SEQ ID NO: 1308191 - RNA, 18 nt, Homo sapiens
agugcaauaaaucugacc

SEQ ID NO: 1308192 - RNA, 19 nt, Homo sapiens
agugcagcauauacaauaa

SEQ ID NO: 1308193 - RNA, 17 nt, Homo sapiens
uuuacugagacaaugua

SEQ ID NO: 1308194 - RNA, 19 nt, Homo sapiens
uuuagaaauuauauuuuag

SEQ ID NO: 1308195 - RNA, 12 nt, Homo sapiens
cucuaacuucaa

SEQ ID NO: 1308196 - RNA, 15 nt, Homo sapiens
cucuaauacauucca

SEQ ID NO: 1308197 - RNA, 17 nt, Homo sapiens
cucuaaugugucucuca

SEQ ID NO: 1308198 - RNA, 14 nt, Homo sapiens
cucuacucuaggga

SEQ ID NO: 1308199 - RNA, 15 nt, Homo sapiens
cucuagaagugccau

SEQ ID NO: 1308200 - RNA, 13 nt, Homo sapiens
cucuagccaaaug

SEQ ID NO: 1308201 - RNA, 19 nt, Homo sapiens
uauggcuuuuagcauuuau

SEQ ID NO: 1308202 - RNA, 18 nt, Homo sapiens
uauggugucauaggcucu

SEQ ID NO: 1308203 - RNA, 17 nt, Homo sapiens
uauguaauggaacuuag

SEQ ID NO: 1308204 - RNA, 18 nt, Homo sapiens
uauguaccaagaaucuug

SEQ ID NO: 1308205 - RNA, 22 nt, Homo sapiens
uauguauaaaauguaacacuga

SEQ ID NO: 1308206 - RNA, 13 nt, Homo sapiens
uauguauucacag

SEQ ID NO: 1308207 - RNA, 23 nt, Homo sapiens
uaugucgagagcuggccaaagag

SEQ ID NO: 1308208 - RNA, 13 nt, Homo sapiens
uaugugaaugcuc

SEQ ID NO: 1308209 - RNA, 18 nt, Homo sapiens
uauguucaaagacuguga

SEQ ID NO: 1308210 - RNA, 17 nt, Homo sapiens
uauguucugucuuccca

SEQ ID NO: 1308211 - RNA, 19 nt, Homo sapiens
uauguugcaaaauauauca

SEQ ID NO: 1308212 - RNA, 12 nt, Homo sapiens
uauuaacagaua

SEQ ID NO: 1308213 - RNA, 16 nt, Homo sapiens
uauuacaucuuucaca

SEQ ID NO: 1308214 - RNA, 12 nt, Homo sapiens
aaaaaaagccaa

SEQ ID NO: 1308215 - RNA, 12 nt, Homo sapiens
aaaaaagcuuuu

SEQ ID NO: 1308216 - RNA, 13 nt, Homo sapiens
aaaaacacagaca

SEQ ID NO: 1308217 - RNA, 19 nt, Homo sapiens
aaaaacacagacauucugc

SEQ ID NO: 1308218 - RNA, 21 nt, Homo sapiens
aaaaacauagaaaaauucagc

SEQ ID NO: 1308219 - RNA, 19 nt, Homo sapiens
aaaaacuguuaaucagacu

SEQ ID NO: 1308220 - RNA, 14 nt, Homo sapiens
aaaaagacagggcu

SEQ ID NO: 1308221 - RNA, 13 nt, Homo sapiens
aaaaagcauacuu

SEQ ID NO: 1308222 - RNA, 12 nt, Homo sapiens
aaaaagccaaaa

SEQ ID NO: 1308223 - RNA, 21 nt, Homo sapiens
aaaaagugaaaacaauguaag

SEQ ID NO: 1308224 - RNA, 17 nt, Homo sapiens
aaaaauaaaacaguauc

SEQ ID NO: 1308225 - RNA, 17 nt, Homo sapiens
aaaaauagcaacuugug

SEQ ID NO: 1308226 - RNA, 16 nt, Homo sapiens
aaaaaucguccaggga

SEQ ID NO: 1308227 - RNA, 17 nt, Homo sapiens
aaaaaucugagaaacuc

SEQ ID NO: 1308228 - RNA, 16 nt, Homo sapiens
aaaaaugcacccaacu

SEQ ID NO: 1308229 - RNA, 17 nt, Homo sapiens
aaaacaaaaaaugugcu

SEQ ID NO: 1308230 - RNA, 14 nt, Homo sapiens
aaaacacagacauu

SEQ ID NO: 1308231 - RNA, 11 nt, Homo sapiens
aaaacacugug

SEQ ID NO: 1308232 - RNA, 15 nt, Homo sapiens
aaaacacugugcaca

SEQ ID NO: 1308233 - RNA, 12 nt, Homo sapiens
aaaacauguaug

SEQ ID NO: 1308234 - RNA, 18 nt, Homo sapiens
aaaacauuaagaaaauca

SEQ ID NO: 1308235 - RNA, 19 nt, Homo sapiens
aaaacauuccaaauaauuc

SEQ ID NO: 1308236 - RNA, 21 nt, Homo sapiens
aaaacauuguuuuguguaaca

SEQ ID NO: 1308237 - RNA, 23 nt, Homo sapiens
aaaacauuuuacuuuaaaaggag

SEQ ID NO: 1308238 - RNA, 20 nt, Homo sapiens
aaaaccaaauuuguauuuaa

SEQ ID NO: 1308239 - RNA, 15 nt, Homo sapiens
aaaaccagugaacuu

SEQ ID NO: 1308240 - RNA, 11 nt, Homo sapiens
aaaacccggga

SEQ ID NO: 1308241 - RNA, 20 nt, Homo sapiens
aaaacuaaauggugcuuuau

SEQ ID NO: 1308242 - RNA, 23 nt, Homo sapiens
aaaacugaaagugaaaguccaga

SEQ ID NO: 1308243 - RNA, 16 nt, Homo sapiens
aaaacugaacuaugua

SEQ ID NO: 1308244 - RNA, 12 nt, Homo sapiens
aaaacugucauc

SEQ ID NO: 1308245 - RNA, 17 nt, Homo sapiens
aaaacugucauccuaac

SEQ ID NO: 1308246 - RNA, 17 nt, Homo sapiens
aaaacuugugcuauaaa

SEQ ID NO: 1308247 - RNA, 18 nt, Homo sapiens
aaaacuuuucuaauacuc

SEQ ID NO: 1308248 - RNA, 18 nt, Homo sapiens
aaaagaaacacgcacuua

SEQ ID NO: 1308249 - RNA, 16 nt, Homo sapiens
aaaagagaaugucucc

SEQ ID NO: 1308250 - RNA, 18 nt, Homo sapiens
aaaagagaaugucuccau

SEQ ID NO: 1308251 - RNA, 19 nt, Homo sapiens
aaaagcaucacaugaacuu

SEQ ID NO: 1308252 - RNA, 13 nt, Homo sapiens
aaaagcugggcag

SEQ ID NO: 1308253 - RNA, 18 nt, Homo sapiens
aaaaggaaggcucuucuc

SEQ ID NO: 1308254 - RNA, 23 nt, Homo sapiens
aaaaggauucuauaucaugacca

SEQ ID NO: 1308255 - RNA, 23 nt, Homo sapiens
aaaaggcaccuauaaaacagguc

SEQ ID NO: 1308256 - RNA, 22 nt, Homo sapiens
aaaaggcuaagcuucacuguaa

SEQ ID NO: 1308257 - RNA, 13 nt, Homo sapiens
aaaaggggcuccu

SEQ ID NO: 1308258 - RNA, 16 nt, Homo sapiens
aaaaggugucaacuuu

SEQ ID NO: 1308259 - RNA, 14 nt, Homo sapiens
aaaaguggcauuuc

SEQ ID NO: 1308260 - RNA, 15 nt, Homo sapiens
aaaauaaaaaaugug

SEQ ID NO: 1308261 - RNA, 14 nt, Homo sapiens
aaaauaaaacagua

SEQ ID NO: 1308262 - RNA, 15 nt, Homo sapiens
aaaauagaagacaua

SEQ ID NO: 1308263 - RNA, 23 nt, Homo sapiens
aaaauagaauauagcaucuuuca

SEQ ID NO: 1308264 - RNA, 21 nt, Homo sapiens
aaaauagacuaaccucuacca

SEQ ID NO: 1308265 - RNA, 18 nt, Homo sapiens
aaaauagagccugaggga

SEQ ID NO: 1308266 - RNA, 17 nt, Homo sapiens
aaaauauaaguggugcu

SEQ ID NO: 1308267 - RNA, 15 nt, Homo sapiens
aaaaucacacuguaa

SEQ ID NO: 1308268 - RNA, 13 nt, Homo sapiens
aaaaucauuaaca

SEQ ID NO: 1308269 - RNA, 14 nt, Homo sapiens
aaaaugagcaaaag

SEQ ID NO: 1308270 - RNA, 13 nt, Homo sapiens
aaaaugagugcuu

SEQ ID NO: 1308271 - RNA, 18 nt, Homo sapiens
aaaauggcagugaugaau

SEQ ID NO: 1308272 - RNA, 16 nt, Homo sapiens
aaaauguuuguuaaag

SEQ ID NO: 1308273 - RNA, 22 nt, Homo sapiens
aaaauuagaaucugaguauaaa

SEQ ID NO: 1308274 - RNA, 18 nt, Homo sapiens
aaaauuauuugcauaaca

SEQ ID NO: 1308275 - RNA, 22 nt, Homo sapiens
aaaauugcugcaccaaugcacu

SEQ ID NO: 1308276 - RNA, 20 nt, Homo sapiens
aaaauuggguguguauacuu

SEQ ID NO: 1308277 - RNA, 13 nt, Homo sapiens
aaacaaacaugac

SEQ ID NO: 1308278 - RNA, 15 nt, Homo sapiens
aaacaaauucaucaa

SEQ ID NO: 1308279 - RNA, 14 nt, Homo sapiens
aaacacccaugccc

SEQ ID NO: 1308280 - RNA, 20 nt, Homo sapiens
aaacaccguguuuucugaca

SEQ ID NO: 1308281 - RNA, 20 nt, Homo sapiens
aaacacgccugcaaacgcug

SEQ ID NO: 1308282 - RNA, 13 nt, Homo sapiens
aaacacugaauua

SEQ ID NO: 1308283 - RNA, 18 nt, Homo sapiens
aaacacugauggcaccua

SEQ ID NO: 1308284 - RNA, 22 nt, Homo sapiens
aaacagccucuuuuugauacug

SEQ ID NO: 1308285 - RNA, 19 nt, Homo sapiens
aaacagccuuugggaaaug

SEQ ID NO: 1308286 - RNA, 17 nt, Homo sapiens
aaacagcugcccugugu

SEQ ID NO: 1308287 - RNA, 12 nt, Homo sapiens
aaacaggucaau

SEQ ID NO: 1308288 - RNA, 18 nt, Homo sapiens
aaacaguaaaccuuaaca

SEQ ID NO: 1308289 - RNA, 21 nt, Homo sapiens
aaacaucacaccugcccuaaa

SEQ ID NO: 1308290 - RNA, 16 nt, Homo sapiens
aaacaucauuacuaua

SEQ ID NO: 1308291 - RNA, 20 nt, Homo sapiens
aaacaugguggguccauggg

SEQ ID NO: 1308292 - RNA, 16 nt, Homo sapiens
aaacauguaugugcau

SEQ ID NO: 1308293 - RNA, 20 nt, Homo sapiens
aaacauucuccaguaagcag

SEQ ID NO: 1308294 - RNA, 16 nt, Homo sapiens
aaaccaacaggcuacc

SEQ ID NO: 1308295 - RNA, 17 nt, Homo sapiens
aaacccaauucagucuc

SEQ ID NO: 1308296 - RNA, 18 nt, Homo sapiens
aaacccagagcggaagga

SEQ ID NO: 1308297 - RNA, 20 nt, Homo sapiens
aaacccagucuccucuccau

SEQ ID NO: 1308298 - RNA, 17 nt, Homo sapiens
aaacccauggcucuauu

SEQ ID NO: 1308299 - RNA, 10 nt, Homo sapiens
aaacccggga

SEQ ID NO: 1308300 - RNA, 13 nt, Homo sapiens
aaguucaagagaa

SEQ ID NO: 1308301 - RNA, 11 nt, Homo sapiens
aaguucacagu

SEQ ID NO: 1308302 - RNA, 21 nt, Homo sapiens
aaguuccaaaauaaagcauaa

SEQ ID NO: 1308303 - RNA, 15 nt, Homo sapiens
aaguucugacuugac

SEQ ID NO: 1308304 - RNA, 14 nt, Homo sapiens
aaguugacaccuuu

SEQ ID NO: 1308305 - RNA, 21 nt, Homo sapiens
aaguugagaaggugccugcca

SEQ ID NO: 1308306 - RNA, 17 nt, Homo sapiens
aaguugcauagguuuaa

SEQ ID NO: 1308307 - RNA, 14 nt, Homo sapiens
aaguuuccuuccag

SEQ ID NO: 1308308 - RNA, 21 nt, Homo sapiens
aaguuuuuuccucccugcuua

SEQ ID NO: 1308309 - RNA, 18 nt, Homo sapiens
aauaaaacaguaucucuu

SEQ ID NO: 1308310 - RNA, 14 nt, Homo sapiens
aauaaaacugagcu

SEQ ID NO: 1308311 - RNA, 22 nt, Homo sapiens
aauaaaauuuuuuuucauguuu

SEQ ID NO: 1308312 - RNA, 20 nt, Homo sapiens
aauaaaccaucaucuugcca

SEQ ID NO: 1308313 - RNA, 21 nt, Homo sapiens
aauaaagcuguucucauuccu

SEQ ID NO: 1308314 - RNA, 17 nt, Homo sapiens
aauaaaggaguuauuug

SEQ ID NO: 1308315 - RNA, 15 nt, Homo sapiens
aauaaauaugcucag

SEQ ID NO: 1308316 - RNA, 19 nt, Homo sapiens
aauaaaucugacccagugc

SEQ ID NO: 1308317 - RNA, 13 nt, Homo sapiens
aauaaaugaacug

SEQ ID NO: 1308318 - RNA, 20 nt, Homo sapiens
aauaaaugaacugacuucaa

SEQ ID NO: 1308319 - RNA, 16 nt, Homo sapiens
aauaacgauaaaagac

SEQ ID NO: 1308320 - RNA, 18 nt, Homo sapiens
aauaagaaaaaccaaaau

SEQ ID NO: 1308321 - RNA, 21 nt, Homo sapiens
aauaagauauuuaguaauauu

SEQ ID NO: 1308322 - RNA, 15 nt, Homo sapiens
aauaagaucuagucu

SEQ ID NO: 1308323 - RNA, 21 nt, Homo sapiens
aauaagaucuagucuguuaca

SEQ ID NO: 1308324 - RNA, 19 nt, Homo sapiens
aauaagggcagagucacac

SEQ ID NO: 1308325 - RNA, 15 nt, Homo sapiens
aauaauaugauuuau

SEQ ID NO: 1308326 - RNA, 12 nt, Homo sapiens
aauaauaugcau

SEQ ID NO: 1308327 - RNA, 18 nt, Homo sapiens
aauaauuuuuagaaucuc

SEQ ID NO: 1308328 - RNA, 15 nt, Homo sapiens
aauacaaacacaaaa

SEQ ID NO: 1308329 - RNA, 22 nt, Homo sapiens
aauacaagauauuauguauaaa

SEQ ID NO: 1308330 - RNA, 14 nt, Homo sapiens
aauacacacaagua

SEQ ID NO: 1308331 - RNA, 21 nt, Homo sapiens
aauacagacuacuucuucccc

SEQ ID NO: 1308332 - RNA, 17 nt, Homo sapiens
aauacaguaucucaggg

SEQ ID NO: 1308333 - RNA, 22 nt, Homo sapiens
aauacuauauuuauacuguaua

SEQ ID NO: 1308334 - RNA, 11 nt, Homo sapiens
aauacuaugua

SEQ ID NO: 1308335 - RNA, 16 nt, Homo sapiens
aauacuauugcauuuu

SEQ ID NO: 1308336 - RNA, 20 nt, Homo sapiens
aauacucugcccucuagagc

SEQ ID NO: 1308337 - RNA, 21 nt, Homo sapiens
aauacugcugagauacauaca

SEQ ID NO: 1308338 - RNA, 22 nt, Homo sapiens
aauagaaggauguacauuucca

SEQ ID NO: 1308339 - RNA, 19 nt, Homo sapiens
aauagauccagugcugagc

SEQ ID NO: 1308340 - RNA, 24 nt, Homo sapiens
aauaguaccuaaaauugcaacuuc

SEQ ID NO: 1308341 - RNA, 16 nt, Homo sapiens
aauaguacuuacaaau

SEQ ID NO: 1308342 - RNA, 23 nt, Homo sapiens
aauaguguugcuuuaaauugugc

SEQ ID NO: 1308343 - RNA, 14 nt, Homo sapiens
aauaguucuauaca

SEQ ID NO: 1308344 - RNA, 16 nt, Homo sapiens
aauauagaaugaaaga

SEQ ID NO: 1308345 - RNA, 15 nt, Homo sapiens
aauauagcaucuuuc

SEQ ID NO: 1308346 - RNA, 15 nt, Homo sapiens
aauauagcuguacaa

SEQ ID NO: 1308347 - RNA, 19 nt, Homo sapiens
aauauauauauguauauau

SEQ ID NO: 1308348 - RNA, 22 nt, Homo sapiens
aauauaucuuaaugcagacaaa

SEQ ID NO: 1308349 - RNA, 19 nt, Homo sapiens
aauauauuuucaaggaugu

SEQ ID NO: 1308350 - RNA, 14 nt, Homo sapiens
aauaucaaaugcag

SEQ ID NO: 1308351 - RNA, 21 nt, Homo sapiens
aauaugaguaauacaucaaag

SEQ ID NO: 1308352 - RNA, 21 nt, Homo sapiens
aauaugugaagcccagcaucu

SEQ ID NO: 1308353 - RNA, 18 nt, Homo sapiens
aauauuuaaaaaugucuu

SEQ ID NO: 1308354 - RNA, 17 nt, Homo sapiens
aauauuuaucugauuaa

SEQ ID NO: 1308355 - RNA, 15 nt, Homo sapiens
aauauuucaagcucu

SEQ ID NO: 1308356 - RNA, 18 nt, Homo sapiens
aauauuugcugacagcug

SEQ ID NO: 1308357 - RNA, 16 nt, Homo sapiens
aauauuuucauuguga

SEQ ID NO: 1308358 - RNA, 21 nt, Homo sapiens
aauauuuuucuguagugugaa

SEQ ID NO: 1308359 - RNA, 20 nt, Homo sapiens
aaucaaagcagauauauuaa

SEQ ID NO: 1308360 - RNA, 13 nt, Homo sapiens
aaucaaagccacu

SEQ ID NO: 1308361 - RNA, 14 nt, Homo sapiens
aaucaaaugcaauu

SEQ ID NO: 1308362 - RNA, 14 nt, Homo sapiens
aaucaacaccuuaa

SEQ ID NO: 1308363 - RNA, 13 nt, Homo sapiens
aaucaagucucac

SEQ ID NO: 1308364 - RNA, 18 nt, Homo sapiens
aaucagcaagaagauccu

SEQ ID NO: 1308365 - RNA, 18 nt, Homo sapiens
aaucaggaauauuuucca

SEQ ID NO: 1308366 - RNA, 23 nt, Homo sapiens
aaucauuaaggucauuacucuca

SEQ ID NO: 1308367 - RNA, 20 nt, Homo sapiens
aauccaaauggcgucuggaa

SEQ ID NO: 1308368 - RNA, 19 nt, Homo sapiens
aauccaauggguuuuuccc

SEQ ID NO: 1308369 - RNA, 15 nt, Homo sapiens
aaucccagcuacuug

SEQ ID NO: 1308370 - RNA, 15 nt, Homo sapiens
aaucccuuucucacu

SEQ ID NO: 1308371 - RNA, 15 nt, Homo sapiens
aauccuaacauucag

SEQ ID NO: 1308372 - RNA, 20 nt, Homo sapiens
aauccugcggcaggacugca

SEQ ID NO: 1308373 - RNA, 17 nt, Homo sapiens
aauccuugugagaauuu

SEQ ID NO: 1308374 - RNA, 18 nt, Homo sapiens
aaucuauaaacaaugaaa

SEQ ID NO: 1308375 - RNA, 22 nt, Homo sapiens
aaucugaggccuccucucucag

SEQ ID NO: 1308376 - RNA, 18 nt, Homo sapiens
aaucuguccgugaccuau

SEQ ID NO: 1308377 - RNA, 21 nt, Homo sapiens
aaucuuaaugaacacacaagc

SEQ ID NO: 1308378 - RNA, 22 nt, Homo sapiens
aaucuuuguuaagguccugaaa

SEQ ID NO: 1308379 - RNA, 16 nt, Homo sapiens
aaugaaaaacuauguc

SEQ ID NO: 1308380 - RNA, 20 nt, Homo sapiens
aaugaaaacauucagaggaa

SEQ ID NO: 1308381 - RNA, 15 nt, Homo sapiens
aaugaaaugaguuuu

SEQ ID NO: 1308382 - RNA, 16 nt, Homo sapiens
aaugacucuuaggaca

SEQ ID NO: 1308383 - RNA, 13 nt, Homo sapiens
aaugagacuugcc

SEQ ID NO: 1308384 - RNA, 14 nt, Homo sapiens
aaugagccaugaga

SEQ ID NO: 1308385 - RNA, 19 nt, Homo sapiens
aaugaugauccuaggcauu

SEQ ID NO: 1308386 - RNA, 20 nt, Homo sapiens
aaugaugcucaaaaucuuuc

SEQ ID NO: 1308387 - RNA, 23 nt, Homo sapiens
aaugaugcucaaaaucuuuccaa

SEQ ID NO: 1308388 - RNA, 11 nt, Homo sapiens
aaugcaacuuc

SEQ ID NO: 1308389 - RNA, 20 nt, Homo sapiens
aaugcaagauaguuuaucua

SEQ ID NO: 1308390 - RNA, 15 nt, Homo sapiens
aaugcagucugucca

SEQ ID NO: 1308391 - RNA, 12 nt, Homo sapiens
aaugccaaaaaa

SEQ ID NO: 1308392 - RNA, 21 nt, Homo sapiens
aaugcuaaagaauccauaaaa

SEQ ID NO: 1308393 - RNA, 15 nt, Homo sapiens
aaugcucaagaaaca

SEQ ID NO: 1308394 - RNA, 19 nt, Homo sapiens
aaugcucagaccagcucuu

SEQ ID NO: 1308395 - RNA, 13 nt, Homo sapiens
aaugcucucucuu

SEQ ID NO: 1308396 - RNA, 18 nt, Homo sapiens
aaugcugugguugauauu

SEQ ID NO: 1308397 - RNA, 18 nt, Homo sapiens
aaugcuuuuugaguuuca

SEQ ID NO: 1308398 - RNA, 16 nt, Homo sapiens
aauggacacuuuucac

SEQ ID NO: 1308399 - RNA, 15 nt, Homo sapiens
aauggagucauuuga

SEQ ID NO: 1308400 - RNA, 23 nt, Homo sapiens
aaugggaaaguauucuguacucu

SEQ ID NO: 1308401 - RNA, 23 nt, Homo sapiens
aaugggaagauuaaaaagcacag

SEQ ID NO: 1308402 - RNA, 22 nt, Homo sapiens
aaugguccacacccaauuccac

SEQ ID NO: 1308403 - RNA, 16 nt, Homo sapiens
aaugguuuacagagag

SEQ ID NO: 1308404 - RNA, 14 nt, Homo sapiens
aauguaaaagcaca

SEQ ID NO: 1308405 - RNA, 13 nt, Homo sapiens
aauguaaaaugca

SEQ ID NO: 1308406 - RNA, 16 nt, Homo sapiens
aauguacagacauauu

SEQ ID NO: 1308407 - RNA, 13 nt, Homo sapiens
aauguaugugcuc

SEQ ID NO: 1308408 - RNA, 14 nt, Homo sapiens
aauguaugugcucu

SEQ ID NO: 1308409 - RNA, 21 nt, Homo sapiens
aauguaugugcucuuagcaaa

SEQ ID NO: 1308410 - RNA, 18 nt, Homo sapiens
aauguauuauaacuuuaa

SEQ ID NO: 1308411 - RNA, 13 nt, Homo sapiens
aaugucagauaau

SEQ ID NO: 1308412 - RNA, 22 nt, Homo sapiens
aaugugaaaaugguccaggaga

SEQ ID NO: 1308413 - RNA, 12 nt, Homo sapiens
aaugugaacuua

SEQ ID NO: 1308414 - RNA, 23 nt, Homo sapiens
aaugugauuacugcucuauucca

SEQ ID NO: 1308415 - RNA, 15 nt, Homo sapiens
aaugugauugcagcu

SEQ ID NO: 1308416 - RNA, 15 nt, Homo sapiens
aaugugcaaccacug

SEQ ID NO: 1308417 - RNA, 16 nt, Homo sapiens
aaugugcugagcauuu

SEQ ID NO: 1308418 - RNA, 13 nt, Homo sapiens
aauguggucauca

SEQ ID NO: 1308419 - RNA, 18 nt, Homo sapiens
aaugugguuuuccugaaa

SEQ ID NO: 1308420 - RNA, 18 nt, Homo sapiens
aauguuaauguuauauca

SEQ ID NO: 1308421 - RNA, 16 nt, Homo sapiens
aauguucacauaguga

SEQ ID NO: 1308422 - RNA, 20 nt, Homo sapiens
aauguucacauagugaaaua

SEQ ID NO: 1308423 - RNA, 18 nt, Homo sapiens
aauguuugucucauccca

SEQ ID NO: 1308424 - RNA, 15 nt, Homo sapiens
aauguuuucugaaga

SEQ ID NO: 1308425 - RNA, 18 nt, Homo sapiens
aauuaaaacacuuucaaa

SEQ ID NO: 1308426 - RNA, 18 nt, Homo sapiens
aauuaaaauggaugccuu

SEQ ID NO: 1308427 - RNA, 23 nt, Homo sapiens
aauuaaaggagaagauuccugaa

SEQ ID NO: 1308428 - RNA, 11 nt, Homo sapiens
aauuacaauac

SEQ ID NO: 1308429 - RNA, 20 nt, Homo sapiens
aauuacaguauauguugcaa

SEQ ID NO: 1308430 - RNA, 18 nt, Homo sapiens
aauuacuguaacugauua

SEQ ID NO: 1308431 - RNA, 18 nt, Homo sapiens
aauuacuugagcccagga

SEQ ID NO: 1308432 - RNA, 11 nt, Homo sapiens
acggcaaaaug

SEQ ID NO: 1308433 - RNA, 20 nt, Homo sapiens
acggcucacgcuuaccucaa

SEQ ID NO: 1308434 - RNA, 13 nt, Homo sapiens
acggcucacugua

SEQ ID NO: 1308435 - RNA, 18 nt, Homo sapiens
acggcuuguaaaugugac

SEQ ID NO: 1308436 - RNA, 13 nt, Homo sapiens
acggucaguccau

SEQ ID NO: 1308437 - RNA, 15 nt, Homo sapiens
acggugacucugucc

SEQ ID NO: 1308438 - RNA, 20 nt, Homo sapiens
acggugucuuguucugucac

SEQ ID NO: 1308439 - RNA, 15 nt, Homo sapiens
acguagcugcaaagg

SEQ ID NO: 1308440 - RNA, 19 nt, Homo sapiens
acguauuuaugucccugac

SEQ ID NO: 1308441 - RNA, 14 nt, Homo sapiens
acgugagaacaauc

SEQ ID NO: 1308442 - RNA, 20 nt, Homo sapiens
acgugagaucauucacucau

SEQ ID NO: 1308443 - RNA, 22 nt, Homo sapiens
acgugauucaauucaacacucc

SEQ ID NO: 1308444 - RNA, 15 nt, Homo sapiens
acgugcaaagccaag

SEQ ID NO: 1308445 - RNA, 14 nt, Homo sapiens
acguggcucagcca

SEQ ID NO: 1308446 - RNA, 17 nt, Homo sapiens
acguggcucagccagca

SEQ ID NO: 1308447 - RNA, 11 nt, Homo sapiens
acguuguguaa

SEQ ID NO: 1308448 - RNA, 17 nt, Homo sapiens
acuaaaaaguauugcau

SEQ ID NO: 1308449 - RNA, 13 nt, Homo sapiens
acuaaaaguuuag

SEQ ID NO: 1308450 - RNA, 20 nt, Homo sapiens
acuaaaaguuuagggaaaaa

SEQ ID NO: 1308451 - RNA, 12 nt, Homo sapiens
acuaacacagcc

SEQ ID NO: 1308452 - RNA, 23 nt, Homo sapiens
acuaaguucacggcaaaauguca

SEQ ID NO: 1308453 - RNA, 15 nt, Homo sapiens
acuacagcuaugaag

SEQ ID NO: 1308454 - RNA, 16 nt, Homo sapiens
acuaccauugcuguuc

SEQ ID NO: 1308455 - RNA, 18 nt, Homo sapiens
acuaccauugcuguucua

SEQ ID NO: 1308456 - RNA, 19 nt, Homo sapiens
acuaccauugcuguucuac

SEQ ID NO: 1308457 - RNA, 19 nt, Homo sapiens
acuacgguugaucuugcaa

SEQ ID NO: 1308458 - RNA, 16 nt, Homo sapiens
acuacucuuacaugua

SEQ ID NO: 1308459 - RNA, 16 nt, Homo sapiens
acuagcuaaaccagaa

SEQ ID NO: 1308460 - RNA, 23 nt, Homo sapiens
acuagcuaaaccagaaaggugau

SEQ ID NO: 1308461 - RNA, 18 nt, Homo sapiens
acuagggagccauuugag

SEQ ID NO: 1308462 - RNA, 14 nt, Homo sapiens
acuaggucaaucag

SEQ ID NO: 1308463 - RNA, 21 nt, Homo sapiens
acuaguauuucauguugcaca

SEQ ID NO: 1308464 - RNA, 16 nt, Homo sapiens
acuauaaaagcuuucu

SEQ ID NO: 1308465 - RNA, 18 nt, Homo sapiens
acuauauuuauacuguau

SEQ ID NO: 1308466 - RNA, 13 nt, Homo sapiens
acuaugaucucag

SEQ ID NO: 1308467 - RNA, 14 nt, Homo sapiens
acuaugaucucagg

SEQ ID NO: 1308468 - RNA, 22 nt, Homo sapiens
acuauguugccuaagcuggucu

SEQ ID NO: 1308469 - RNA, 12 nt, Homo sapiens
acuauuaacaug

SEQ ID NO: 1308470 - RNA, 14 nt, Homo sapiens
acuauuaacaugau

SEQ ID NO: 1308471 - RNA, 12 nt, Homo sapiens
acuauuacuggg

SEQ ID NO: 1308472 - RNA, 20 nt, Homo sapiens
acuauugcagaccugucacc

SEQ ID NO: 1308473 - RNA, 17 nt, Homo sapiens
acuauuuaucugugcaa

SEQ ID NO: 1308474 - RNA, 21 nt, Homo sapiens
acucaaaaauccuaacauuca

SEQ ID NO: 1308475 - RNA, 21 nt, Homo sapiens
acucaaaugcucagaccagcu

SEQ ID NO: 1308476 - RNA, 21 nt, Homo sapiens
acucacacggacacucaaaag

SEQ ID NO: 1308477 - RNA, 18 nt, Homo sapiens
acucacuucucuuccuug

SEQ ID NO: 1308478 - RNA, 13 nt, Homo sapiens
acucaggacaucc

SEQ ID NO: 1308479 - RNA, 14 nt, Homo sapiens
acucaguugcaacu

SEQ ID NO: 1308480 - RNA, 15 nt, Homo sapiens
acucauaaucuauaa

SEQ ID NO: 1308481 - RNA, 21 nt, Homo sapiens
acucauagauguuaugcaaaa

SEQ ID NO: 1308482 - RNA, 17 nt, Homo sapiens
acucaucacuguggcug

SEQ ID NO: 1308483 - RNA, 22 nt, Homo sapiens
acucaucauuuaauccuuguga

SEQ ID NO: 1308484 - RNA, 21 nt, Homo sapiens
acucauggccuugucuaacuu

SEQ ID NO: 1308485 - RNA, 23 nt, Homo sapiens
acucauggccuugucuaacuuuu

SEQ ID NO: 1308486 - RNA, 22 nt, Homo sapiens
acucauucuucuguacgucuga

SEQ ID NO: 1308487 - RNA, 13 nt, Homo sapiens
acucauugcugag

SEQ ID NO: 1308488 - RNA, 20 nt, Homo sapiens
acuccgagagcaugcuuaau

SEQ ID NO: 1308489 - RNA, 18 nt, Homo sapiens
acuccggcugugcuggga

SEQ ID NO: 1308490 - RNA, 18 nt, Homo sapiens
acuccuaaccucaaguga

SEQ ID NO: 1308491 - RNA, 20 nt, Homo sapiens
acuccucacacuuacuguaa

SEQ ID NO: 1308492 - RNA, 14 nt, Homo sapiens
acuccucccauaga

SEQ ID NO: 1308493 - RNA, 21 nt, Homo sapiens
acuccucggggaacccaaggc

SEQ ID NO: 1308494 - RNA, 17 nt, Homo sapiens
acuccugggcucaagcg

SEQ ID NO: 1308495 - RNA, 19 nt, Homo sapiens
acuccuuuuuugcaugugc

SEQ ID NO: 1308496 - RNA, 15 nt, Homo sapiens
acucgagaacuuuca

SEQ ID NO: 1308497 - RNA, 13 nt, Homo sapiens
acucuagccaaau

SEQ ID NO: 1308498 - RNA, 18 nt, Homo sapiens
acucuagggaaaaaccag

SEQ ID NO: 1308499 - RNA, 20 nt, Homo sapiens
acucuauaagauuccaaaaa

SEQ ID NO: 1308500 - RNA, 13 nt, Homo sapiens
acucuccagacau

SEQ ID NO: 1308501 - RNA, 20 nt, Homo sapiens
acucuccagacaucaccaac

SEQ ID NO: 1308502 - RNA, 16 nt, Homo sapiens
acucucgugcauuuca

SEQ ID NO: 1308503 - RNA, 11 nt, Homo sapiens
acucugacccc

SEQ ID NO: 1308504 - RNA, 20 nt, Homo sapiens
acucugcauccagagauuca

SEQ ID NO: 1308505 - RNA, 22 nt, Homo sapiens
acucugccuacuucugagcaaa

SEQ ID NO: 1308506 - RNA, 18 nt, Homo sapiens
acucuggcaaagcuuuua

SEQ ID NO: 1308507 - RNA, 14 nt, Homo sapiens
acucuuacauguau

SEQ ID NO: 1308508 - RNA, 14 nt, Homo sapiens
acucuuaggacauu

SEQ ID NO: 1308509 - RNA, 12 nt, Homo sapiens
acucuuggugca

SEQ ID NO: 1308510 - RNA, 22 nt, Homo sapiens
acucuuucauaaaaacacucaa

SEQ ID NO: 1308511 - RNA, 19 nt, Homo sapiens
acugaagcaaagaagggaa

SEQ ID NO: 1308512 - RNA, 20 nt, Homo sapiens
acugaagcaaagaagggaau

SEQ ID NO: 1308513 - RNA, 21 nt, Homo sapiens
acugaaggcuaaaaagcaaca

SEQ ID NO: 1308514 - RNA, 13 nt, Homo sapiens
acugagaauauaa

SEQ ID NO: 1308515 - RNA, 22 nt, Homo sapiens
acugagaauauaauacuguauu

SEQ ID NO: 1308516 - RNA, 14 nt, Homo sapiens
acugagccuagcua

SEQ ID NO: 1308517 - RNA, 16 nt, Homo sapiens
acugagcuauaacuua

SEQ ID NO: 1308518 - RNA, 21 nt, Homo sapiens
acugaggacuguuugcaauug

SEQ ID NO: 1308519 - RNA, 15 nt, Homo sapiens
acugaggcagggaag

SEQ ID NO: 1308520 - RNA, 22 nt, Homo sapiens
acugaguagcucuccugacuuu

SEQ ID NO: 1308521 - RNA, 13 nt, Homo sapiens
acugcacuuacau

SEQ ID NO: 1308522 - RNA, 16 nt, Homo sapiens
acugcagaaacccuga

SEQ ID NO: 1308523 - RNA, 13 nt, Homo sapiens
acugcagcuuugu

SEQ ID NO: 1308524 - RNA, 22 nt, Homo sapiens
acugcagggaaaauuauuugca

SEQ ID NO: 1308525 - RNA, 22 nt, Homo sapiens
acugcaucguuucaucuuccaa

SEQ ID NO: 1308526 - RNA, 21 nt, Homo sapiens
acugccuuuagaaaauauaag

SEQ ID NO: 1308527 - RNA, 21 nt, Homo sapiens
acugcucagaacuugcugcug

SEQ ID NO: 1308528 - RNA, 21 nt, Homo sapiens
acugcuuuuccaaacauucuc

SEQ ID NO: 1308529 - RNA, 12 nt, Homo sapiens
acuggaugcaug

SEQ ID NO: 1308530 - RNA, 15 nt, Homo sapiens
acuggccgagcugcu

SEQ ID NO: 1308531 - RNA, 16 nt, Homo sapiens
acugggacagcccagg

SEQ ID NO: 1308532 - RNA, 22 nt, Homo sapiens
acugggacagcccaggaaacaa

SEQ ID NO: 1308533 - RNA, 17 nt, Homo sapiens
acugggucucugcaaac

SEQ ID NO: 1308534 - RNA, 19 nt, Homo sapiens
acugggugcggugacucau

SEQ ID NO: 1308535 - RNA, 17 nt, Homo sapiens
acuggugcacuuuguaa

SEQ ID NO: 1308536 - RNA, 18 nt, Homo sapiens
acuguaaaggcaagccag

SEQ ID NO: 1308537 - RNA, 22 nt, Homo sapiens
acuguaaauaugaaucugcuca

SEQ ID NO: 1308538 - RNA, 19 nt, Homo sapiens
acuguauauauaauacuga

SEQ ID NO: 1308539 - RNA, 20 nt, Homo sapiens
acuguaugugcuguaauuua

SEQ ID NO: 1308540 - RNA, 23 nt, Homo sapiens
acugucaaaaaguuugguucugu

SEQ ID NO: 1308541 - RNA, 13 nt, Homo sapiens
acugucuccaugg

SEQ ID NO: 1308542 - RNA, 15 nt, Homo sapiens
acugucugacuuaua

SEQ ID NO: 1308543 - RNA, 22 nt, Homo sapiens
acugugaagagaaccauaucaa

SEQ ID NO: 1308544 - RNA, 19 nt, Homo sapiens
acugugagcucccaggugc

SEQ ID NO: 1308545 - RNA, 17 nt, Homo sapiens
acugugggaaggccagc

SEQ ID NO: 1308546 - RNA, 18 nt, Homo sapiens
acugugguauggcuaaua

SEQ ID NO: 1308547 - RNA, 13 nt, Homo sapiens
acuguguagcauc

SEQ ID NO: 1308548 - RNA, 17 nt, Homo sapiens
acuguuauuaacagaua

SEQ ID NO: 1308549 - RNA, 13 nt, Homo sapiens
acuuaacucauga

SEQ ID NO: 1308550 - RNA, 11 nt, Homo sapiens
acuuaaugucu

SEQ ID NO: 1308551 - RNA, 13 nt, Homo sapiens
acuuacaagucaa

SEQ ID NO: 1308552 - RNA, 14 nt, Homo sapiens
acuuaccuaccaca

SEQ ID NO: 1308553 - RNA, 17 nt, Homo sapiens
acuuacuguagccucag

SEQ ID NO: 1308554 - RNA, 16 nt, Homo sapiens
acuuagguguggggga

SEQ ID NO: 1308555 - RNA, 12 nt, Homo sapiens
acuuagugacaa

SEQ ID NO: 1308556 - RNA, 23 nt, Homo sapiens
acuucaauguauugagcauguga

SEQ ID NO: 1308557 - RNA, 22 nt, Homo sapiens
acuucacccacccuccaggacc

SEQ ID NO: 1308558 - RNA, 23 nt, Homo sapiens
acuucagauugaacuuacuguag

SEQ ID NO: 1308559 - RNA, 19 nt, Homo sapiens
acuucaguauguugucaaa

SEQ ID NO: 1308560 - RNA, 17 nt, Homo sapiens
acuucauagaaaccucu

SEQ ID NO: 1308561 - RNA, 13 nt, Homo sapiens
acuuccauuugcu

SEQ ID NO: 1308562 - RNA, 14 nt, Homo sapiens
acuuccauuugcuu

SEQ ID NO: 1308563 - RNA, 18 nt, Homo sapiens
acuucccagagcaucuug

SEQ ID NO: 1308564 - RNA, 15 nt, Homo sapiens
agcuuagauugccuc

SEQ ID NO: 1308565 - RNA, 17 nt, Homo sapiens
agcuuaggaaagaacau

SEQ ID NO: 1308566 - RNA, 22 nt, Homo sapiens
agcuuaggggcugcugaccucc

SEQ ID NO: 1308567 - RNA, 14 nt, Homo sapiens
agcuugcugucacu

SEQ ID NO: 1308568 - RNA, 14 nt, Homo sapiens
agcuuggaccccuu

SEQ ID NO: 1308569 - RNA, 18 nt, Homo sapiens
agcuugucaaugauuuca

SEQ ID NO: 1308570 - RNA, 22 nt, Homo sapiens
agcuugucugguaaguggcuuc

SEQ ID NO: 1308571 - RNA, 21 nt, Homo sapiens
agcuuuguacacgaagaccau

SEQ ID NO: 1308572 - RNA, 19 nt, Homo sapiens
agcuuuguuucaauaucac

SEQ ID NO: 1308573 - RNA, 20 nt, Homo sapiens
agcuuuuagaaauacugcaa

SEQ ID NO: 1308574 - RNA, 15 nt, Homo sapiens
agcuuuuccaaaaua

SEQ ID NO: 1308575 - RNA, 20 nt, Homo sapiens
aggaaaacugaggcccuugg

SEQ ID NO: 1308576 - RNA, 15 nt, Homo sapiens
aggaaaagauuccug

SEQ ID NO: 1308577 - RNA, 17 nt, Homo sapiens
aggaaaagauuccuguc

SEQ ID NO: 1308578 - RNA, 15 nt, Homo sapiens
aggaaaauuucacau

SEQ ID NO: 1308579 - RNA, 16 nt, Homo sapiens
aggaaacgcuaccucu

SEQ ID NO: 1308580 - RNA, 21 nt, Homo sapiens
aggaaagaaguucacaucaga

SEQ ID NO: 1308581 - RNA, 13 nt, Homo sapiens
aggaaaugauuaa

SEQ ID NO: 1308582 - RNA, 22 nt, Homo sapiens
aggaaauguuucucuaacccuu

SEQ ID NO: 1308583 - RNA, 17 nt, Homo sapiens
aggaaccaggaggacaa

SEQ ID NO: 1308584 - RNA, 20 nt, Homo sapiens
aggaaccucgaguacugugg

SEQ ID NO: 1308585 - RNA, 18 nt, Homo sapiens
aggaacuugucucuucau

SEQ ID NO: 1308586 - RNA, 22 nt, Homo sapiens
aggaagaacggggcucuucuca

SEQ ID NO: 1308587 - RNA, 15 nt, Homo sapiens
aggaagagagacaga

SEQ ID NO: 1308588 - RNA, 23 nt, Homo sapiens
aggaagcccuaagacgucccuuu

SEQ ID NO: 1308589 - RNA, 14 nt, Homo sapiens
aggaagcucagacu

SEQ ID NO: 1308590 - RNA, 15 nt, Homo sapiens
aggaaggcucuucuc

SEQ ID NO: 1308591 - RNA, 13 nt, Homo sapiens
aggaauauuucaa

SEQ ID NO: 1308592 - RNA, 19 nt, Homo sapiens
aggaauauuucaagcucug

SEQ ID NO: 1308593 - RNA, 22 nt, Homo sapiens
aggaaugugaccuuuaauucag

SEQ ID NO: 1308594 - RNA, 17 nt, Homo sapiens
aggaauucuauugagug

SEQ ID NO: 1308595 - RNA, 15 nt, Homo sapiens
aggacaagagggaca

SEQ ID NO: 1308596 - RNA, 15 nt, Homo sapiens
aggacaagggaaaug

SEQ ID NO: 1308597 - RNA, 15 nt, Homo sapiens
aggacacagaugaaa

SEQ ID NO: 1308598 - RNA, 20 nt, Homo sapiens
aggacagauccagggacuga

SEQ ID NO: 1308599 - RNA, 21 nt, Homo sapiens
aggacagggaggugaccccag

SEQ ID NO: 1308600 - RNA, 13 nt, Homo sapiens
aggacaguauucc

SEQ ID NO: 1308601 - RNA, 17 nt, Homo sapiens
aggacccaagcagagaa

SEQ ID NO: 1308602 - RNA, 11 nt, Homo sapiens
aggacccugaa

SEQ ID NO: 1308603 - RNA, 21 nt, Homo sapiens
aggaccuuccuuccucuugca

SEQ ID NO: 1308604 - RNA, 23 nt, Homo sapiens
aggacucagaagccucuggguca

SEQ ID NO: 1308605 - RNA, 20 nt, Homo sapiens
aggacuccagaugaggacaa

SEQ ID NO: 1308606 - RNA, 21 nt, Homo sapiens
aggacuuccauuugcuuuguc

SEQ ID NO: 1308607 - RNA, 19 nt, Homo sapiens
aggagauaaauauuuugca

SEQ ID NO: 1308608 - RNA, 15 nt, Homo sapiens
aggagcacuacagau

SEQ ID NO: 1308609 - RNA, 15 nt, Homo sapiens
aggagcgcaucucaa

SEQ ID NO: 1308610 - RNA, 18 nt, Homo sapiens
aggaggaacagauuugag

SEQ ID NO: 1308611 - RNA, 20 nt, Homo sapiens
aggaggcucccgaggggaag

SEQ ID NO: 1308612 - RNA, 17 nt, Homo sapiens
aggagggugagugcaag

SEQ ID NO: 1308613 - RNA, 23 nt, Homo sapiens
aggaggguguaauggagcaucaa

SEQ ID NO: 1308614 - RNA, 16 nt, Homo sapiens
aggaggguugugcuac

SEQ ID NO: 1308615 - RNA, 19 nt, Homo sapiens
aggaguguccucuucccuc

SEQ ID NO: 1308616 - RNA, 17 nt, Homo sapiens
aggagugugaccacuga

SEQ ID NO: 1308617 - RNA, 18 nt, Homo sapiens
aggaguucgagaccagcc

SEQ ID NO: 1308618 - RNA, 20 nt, Homo sapiens
aggauacugaggcacacaga

SEQ ID NO: 1308619 - RNA, 13 nt, Homo sapiens
aggauauuccaaa

SEQ ID NO: 1308620 - RNA, 21 nt, Homo sapiens
aggauauugggucagugucca

SEQ ID NO: 1308621 - RNA, 17 nt, Homo sapiens
aggaucuuuugaaccca

SEQ ID NO: 1308622 - RNA, 14 nt, Homo sapiens
aggauggcaaagag

SEQ ID NO: 1308623 - RNA, 15 nt, Homo sapiens
aggauguaaggccuu

SEQ ID NO: 1308624 - RNA, 14 nt, Homo sapiens
aggauugcuacugu

SEQ ID NO: 1308625 - RNA, 20 nt, Homo sapiens
aggauugggaaaaaguaauu

SEQ ID NO: 1308626 - RNA, 15 nt, Homo sapiens
aggauuuugauccaa

SEQ ID NO: 1308627 - RNA, 15 nt, Homo sapiens
aggcaacauccaaaa

SEQ ID NO: 1308628 - RNA, 19 nt, Homo sapiens
aggcaaggaugucugagac

SEQ ID NO: 1308629 - RNA, 18 nt, Homo sapiens
aggcaaucaagucucaca

SEQ ID NO: 1308630 - RNA, 18 nt, Homo sapiens
aggcaauccuaccuugcu

SEQ ID NO: 1308631 - RNA, 18 nt, Homo sapiens
aggcacacagcuacucuc

SEQ ID NO: 1308632 - RNA, 17 nt, Homo sapiens
aggcacugccugaugga

SEQ ID NO: 1308633 - RNA, 20 nt, Homo sapiens
aggcaggaggaucacuugag

SEQ ID NO: 1308634 - RNA, 14 nt, Homo sapiens
aggcagggucucac

SEQ ID NO: 1308635 - RNA, 23 nt, Homo sapiens
aggcagugaugcuggaugcuccu

SEQ ID NO: 1308636 - RNA, 18 nt, Homo sapiens
aggcauccucugacucca

SEQ ID NO: 1308637 - RNA, 20 nt, Homo sapiens
aggcauccuuccucacacca

SEQ ID NO: 1308638 - RNA, 17 nt, Homo sapiens
aggcaucucuguacuuu

SEQ ID NO: 1308639 - RNA, 18 nt, Homo sapiens
aggcaugagucagucuga

SEQ ID NO: 1308640 - RNA, 15 nt, Homo sapiens
aggcaugggugcaag

SEQ ID NO: 1308641 - RNA, 16 nt, Homo sapiens
aggcauuaacacaaag

SEQ ID NO: 1308642 - RNA, 14 nt, Homo sapiens
aggcauuuccagac

SEQ ID NO: 1308643 - RNA, 17 nt, Homo sapiens
aggcauuuccugcugaa

SEQ ID NO: 1308644 - RNA, 18 nt, Homo sapiens
aggcauuugcaggguccu

SEQ ID NO: 1308645 - RNA, 18 nt, Homo sapiens
aggccacuguuugucuca

SEQ ID NO: 1308646 - RNA, 20 nt, Homo sapiens
aggccagcuaucugccugac

SEQ ID NO: 1308647 - RNA, 16 nt, Homo sapiens
aggccagugagccacu

SEQ ID NO: 1308648 - RNA, 20 nt, Homo sapiens
aggcccaguucacccugauu

SEQ ID NO: 1308649 - RNA, 19 nt, Homo sapiens
aggccccagccucccugaa

SEQ ID NO: 1308650 - RNA, 17 nt, Homo sapiens
aggcccccacuugccuc

SEQ ID NO: 1308651 - RNA, 23 nt, Homo sapiens
aggccccucuccuccguggcaca

SEQ ID NO: 1308652 - RNA, 20 nt, Homo sapiens
aggccgggcgcgguggcuca

SEQ ID NO: 1308653 - RNA, 20 nt, Homo sapiens
aggccuccugugacuggcag

SEQ ID NO: 1308654 - RNA, 22 nt, Homo sapiens
aggccuccugugacuggcagca

SEQ ID NO: 1308655 - RNA, 19 nt, Homo sapiens
aggccucuuuuccugaaga

SEQ ID NO: 1308656 - RNA, 16 nt, Homo sapiens
aggccugagauuucau

SEQ ID NO: 1308657 - RNA, 16 nt, Homo sapiens
aggccugagcugcuuc

SEQ ID NO: 1308658 - RNA, 17 nt, Homo sapiens
aggccuggcucauucug

SEQ ID NO: 1308659 - RNA, 13 nt, Homo sapiens
aggccugucugug

SEQ ID NO: 1308660 - RNA, 23 nt, Homo sapiens
aggccuucaguuuauuuccacua

SEQ ID NO: 1308661 - RNA, 19 nt, Homo sapiens
aggcgauccaccugucuca

SEQ ID NO: 1308662 - RNA, 16 nt, Homo sapiens
aggcggaagaaucacu

SEQ ID NO: 1308663 - RNA, 13 nt, Homo sapiens
aggcuacacugac

SEQ ID NO: 1308664 - RNA, 22 nt, Homo sapiens
aggcuacuauagguccagaagu

SEQ ID NO: 1308665 - RNA, 19 nt, Homo sapiens
aggcucacugcaacuucug

SEQ ID NO: 1308666 - RNA, 19 nt, Homo sapiens
aggcucaggucccuggggc

SEQ ID NO: 1308667 - RNA, 22 nt, Homo sapiens
aggcuccagagggcacucugcu

SEQ ID NO: 1308668 - RNA, 23 nt, Homo sapiens
aggcucuuccguuccacauccac

SEQ ID NO: 1308669 - RNA, 17 nt, Homo sapiens
aggcugaccacagcaca

SEQ ID NO: 1308670 - RNA, 18 nt, Homo sapiens
aggcugaccacagcacag

SEQ ID NO: 1308671 - RNA, 16 nt, Homo sapiens
aggcugagaacacugu

SEQ ID NO: 1308672 - RNA, 17 nt, Homo sapiens
aggcugagaacacugug

SEQ ID NO: 1308673 - RNA, 19 nt, Homo sapiens
aggcugagaacacugugaa

SEQ ID NO: 1308674 - RNA, 12 nt, Homo sapiens
aggcugagcacc

SEQ ID NO: 1308675 - RNA, 13 nt, Homo sapiens
aggcugagcugca

SEQ ID NO: 1308676 - RNA, 22 nt, Homo sapiens
aggcugaucucgaacuccuaac

SEQ ID NO: 1308677 - RNA, 14 nt, Homo sapiens
aggcugcacugcag

SEQ ID NO: 1308678 - RNA, 20 nt, Homo sapiens
aggcuggagugcaguggugu

SEQ ID NO: 1308679 - RNA, 20 nt, Homo sapiens
aggcuggcuccagaugcagg

SEQ ID NO: 1308680 - RNA, 18 nt, Homo sapiens
aggcuggggaaguccucu

SEQ ID NO: 1308681 - RNA, 14 nt, Homo sapiens
aggcugguggcaag

SEQ ID NO: 1308682 - RNA, 21 nt, Homo sapiens
aggcugugacucuucucucaa

SEQ ID NO: 1308683 - RNA, 13 nt, Homo sapiens
aggcuuccuucug

SEQ ID NO: 1308684 - RNA, 23 nt, Homo sapiens
aggcuuggaaccguaggacccaa

SEQ ID NO: 1308685 - RNA, 14 nt, Homo sapiens
aggcuuucagcuua

SEQ ID NO: 1308686 - RNA, 18 nt, Homo sapiens
agggaagaagcauacaac

SEQ ID NO: 1308687 - RNA, 21 nt, Homo sapiens
agggaagcugucccucacugu

SEQ ID NO: 1308688 - RNA, 14 nt, Homo sapiens
agggaaugugagca

SEQ ID NO: 1308689 - RNA, 14 nt, Homo sapiens
agggacacuuaccc

SEQ ID NO: 1308690 - RNA, 15 nt, Homo sapiens
agggacugaaaaccu

SEQ ID NO: 1308691 - RNA, 15 nt, Homo sapiens
agggagacugcaucu

SEQ ID NO: 1308692 - RNA, 16 nt, Homo sapiens
agggagcuagccagag

SEQ ID NO: 1308693 - RNA, 14 nt, Homo sapiens
agggagcugaguaa

SEQ ID NO: 1308694 - RNA, 22 nt, Homo sapiens
agggagggacacuuacccaagg

SEQ ID NO: 1308695 - RNA, 12 nt, Homo sapiens
agggagugcaug

SEQ ID NO: 1308696 - RNA, 21 nt, Homo sapiens
cauccuagugaauguaaaaug

SEQ ID NO: 1308697 - RNA, 16 nt, Homo sapiens
cauccuauucuuucga

SEQ ID NO: 1308698 - RNA, 17 nt, Homo sapiens
cauccucacugcuguca

SEQ ID NO: 1308699 - RNA, 14 nt, Homo sapiens
cauccuccacugac

SEQ ID NO: 1308700 - RNA, 20 nt, Homo sapiens
cauccugcuaguuugugaug

SEQ ID NO: 1308701 - RNA, 20 nt, Homo sapiens
cauccuguuuguaugaaauu

SEQ ID NO: 1308702 - RNA, 22 nt, Homo sapiens
caucgaauaagacucaucauuu

SEQ ID NO: 1308703 - RNA, 17 nt, Homo sapiens
caucgauucaaacugcu

SEQ ID NO: 1308704 - RNA, 21 nt, Homo sapiens
caucgcaguguucaaggccau

SEQ ID NO: 1308705 - RNA, 14 nt, Homo sapiens
caucggcaggcagu

SEQ ID NO: 1308706 - RNA, 21 nt, Homo sapiens
caucucaaagaaggcauuugc

SEQ ID NO: 1308707 - RNA, 15 nt, Homo sapiens
caucucaucaacuua

SEQ ID NO: 1308708 - RNA, 14 nt, Homo sapiens
caucugaccagcag

SEQ ID NO: 1308709 - RNA, 23 nt, Homo sapiens
caucugagugcagccguuugaga

SEQ ID NO: 1308710 - RNA, 21 nt, Homo sapiens
caucugugcacugcccaugga

SEQ ID NO: 1308711 - RNA, 19 nt, Homo sapiens
caucuuaagagaugccuca

SEQ ID NO: 1308712 - RNA, 14 nt, Homo sapiens
caucuuacuuggcu

SEQ ID NO: 1308713 - RNA, 16 nt, Homo sapiens
caucuuagugccuuua

SEQ ID NO: 1308714 - RNA, 14 nt, Homo sapiens
caucuuccaacuca

SEQ ID NO: 1308715 - RNA, 15 nt, Homo sapiens
caucuucgggaccag

SEQ ID NO: 1308716 - RNA, 22 nt, Homo sapiens
caucuugcucugcugacagaca

SEQ ID NO: 1308717 - RNA, 17 nt, Homo sapiens
caucuuggucacauaca

SEQ ID NO: 1308718 - RNA, 22 nt, Homo sapiens
caucuuuacaaaacuacaugag

SEQ ID NO: 1308719 - RNA, 21 nt, Homo sapiens
caugaacuuguaaaggaauuu

SEQ ID NO: 1308720 - RNA, 17 nt, Homo sapiens
caugacagccagagccu

SEQ ID NO: 1308721 - RNA, 15 nt, Homo sapiens
caugacauugcauuu

SEQ ID NO: 1308722 - RNA, 24 nt, Homo sapiens
caugacugaggaccaaugacguca

SEQ ID NO: 1308723 - RNA, 19 nt, Homo sapiens
caugagaugauacauccaa

SEQ ID NO: 1308724 - RNA, 21 nt, Homo sapiens
caugagccucagcauccuggc

SEQ ID NO: 1308725 - RNA, 20 nt, Homo sapiens
caugaggagggaaaagagug

SEQ ID NO: 1308726 - RNA, 18 nt, Homo sapiens
caugagucagucugauga

SEQ ID NO: 1308727 - RNA, 17 nt, Homo sapiens
caugaucaucacaauca

SEQ ID NO: 1308728 - RNA, 15 nt, Homo sapiens
caugauguagagugu

SEQ ID NO: 1308729 - RNA, 16 nt, Homo sapiens
caugcauguuugguua

SEQ ID NO: 1308730 - RNA, 16 nt, Homo sapiens
caugcauucaccugcc

SEQ ID NO: 1308731 - RNA, 17 nt, Homo sapiens
caugcccuguaccugug

SEQ ID NO: 1308732 - RNA, 15 nt, Homo sapiens
caugcccugugcaac

SEQ ID NO: 1308733 - RNA, 15 nt, Homo sapiens
caugccuguccugaa

SEQ ID NO: 1308734 - RNA, 17 nt, Homo sapiens
caugcguaagacguucu

SEQ ID NO: 1308735 - RNA, 24 nt, Homo sapiens
caugcuacagaaagcugcuugcca

SEQ ID NO: 1308736 - RNA, 22 nt, Homo sapiens
caugcucaggcuacuauagguc

SEQ ID NO: 1308737 - RNA, 17 nt, Homo sapiens
caugcuucagugcugcu

SEQ ID NO: 1308738 - RNA, 17 nt, Homo sapiens
cauggagaccgugacca

SEQ ID NO: 1308739 - RNA, 18 nt, Homo sapiens
cauggagagcuggagccu

SEQ ID NO: 1308740 - RNA, 18 nt, Homo sapiens
cauggaggcgcugcugcc

SEQ ID NO: 1308741 - RNA, 12 nt, Homo sapiens
cauggaugccaa

SEQ ID NO: 1308742 - RNA, 21 nt, Homo sapiens
cauggauuacuucucuauaaa

SEQ ID NO: 1308743 - RNA, 23 nt, Homo sapiens
cauggcacugaggugccguguga

SEQ ID NO: 1308744 - RNA, 15 nt, Homo sapiens
cauggcaucaccucc

SEQ ID NO: 1308745 - RNA, 14 nt, Homo sapiens
cauggcugaaguca

SEQ ID NO: 1308746 - RNA, 19 nt, Homo sapiens
caugggaauauucaaauau

SEQ ID NO: 1308747 - RNA, 15 nt, Homo sapiens
caugguauguaacuc

SEQ ID NO: 1308748 - RNA, 20 nt, Homo sapiens
cauggucuaauuauuuacuc

SEQ ID NO: 1308749 - RNA, 20 nt, Homo sapiens
cauguaacuauuucuucaga

SEQ ID NO: 1308750 - RNA, 17 nt, Homo sapiens
cauguaaucagauuuau

SEQ ID NO: 1308751 - RNA, 21 nt, Homo sapiens
cauguaauguuaauguuauau

SEQ ID NO: 1308752 - RNA, 21 nt, Homo sapiens
cauguagcccccuggccucug

SEQ ID NO: 1308753 - RNA, 18 nt, Homo sapiens
cauguauaaagugauuga

SEQ ID NO: 1308754 - RNA, 20 nt, Homo sapiens
cauguauaaagugauugacu

SEQ ID NO: 1308755 - RNA, 19 nt, Homo sapiens
cauguaucacccccaaaaa

SEQ ID NO: 1308756 - RNA, 22 nt, Homo sapiens
cauguauggaaucccacuguau

SEQ ID NO: 1308757 - RNA, 22 nt, Homo sapiens
caugucacuccagcagcacagg

SEQ ID NO: 1308758 - RNA, 14 nt, Homo sapiens
caugucagcaaaaa

SEQ ID NO: 1308759 - RNA, 15 nt, Homo sapiens
cauguccuaauucuu

SEQ ID NO: 1308760 - RNA, 17 nt, Homo sapiens
cauguccuaauucuucu

SEQ ID NO: 1308761 - RNA, 14 nt, Homo sapiens
caugucugcauuuc

SEQ ID NO: 1308762 - RNA, 23 nt, Homo sapiens
caugucuggacucacggagcuca

SEQ ID NO: 1308763 - RNA, 18 nt, Homo sapiens
caugugaaacucaucuca

SEQ ID NO: 1308764 - RNA, 19 nt, Homo sapiens
caugugaaacucaucucau

SEQ ID NO: 1308765 - RNA, 14 nt, Homo sapiens
caugugacucugaa

SEQ ID NO: 1308766 - RNA, 17 nt, Homo sapiens
caugugcacaagugugc

SEQ ID NO: 1308767 - RNA, 22 nt, Homo sapiens
caugugccagguuuuuggucug

SEQ ID NO: 1308768 - RNA, 21 nt, Homo sapiens
caugugcggggaucaucugcc

SEQ ID NO: 1308769 - RNA, 21 nt, Homo sapiens
caugugcguccauauuuaaca

SEQ ID NO: 1308770 - RNA, 18 nt, Homo sapiens
cauguguugcaccguucu

SEQ ID NO: 1308771 - RNA, 22 nt, Homo sapiens
cauguuaggaagguacugucau

SEQ ID NO: 1308772 - RNA, 18 nt, Homo sapiens
cauguugugauguacaca

SEQ ID NO: 1308773 - RNA, 20 nt, Homo sapiens
cauguugugauguacacauu

SEQ ID NO: 1308774 - RNA, 20 nt, Homo sapiens
cauguuuuaacaaaaaccaa

SEQ ID NO: 1308775 - RNA, 21 nt, Homo sapiens
cauguuuuccgugaaaacgga

SEQ ID NO: 1308776 - RNA, 18 nt, Homo sapiens
cauuaacaaaaauauuag

SEQ ID NO: 1308777 - RNA, 22 nt, Homo sapiens
cauuaacaaaaauauuagcaaa

SEQ ID NO: 1308778 - RNA, 13 nt, Homo sapiens
cauuaacacaaag

SEQ ID NO: 1308779 - RNA, 18 nt, Homo sapiens
cauuaauuuucaacucaa

SEQ ID NO: 1308780 - RNA, 19 nt, Homo sapiens
cauuaccgcguuguaaaau

SEQ ID NO: 1308781 - RNA, 14 nt, Homo sapiens
cauuagccaaggau

SEQ ID NO: 1308782 - RNA, 20 nt, Homo sapiens
cauuauaugcacuagcaaua

SEQ ID NO: 1308783 - RNA, 22 nt, Homo sapiens
cauucaaauucuuuuuuuauua

SEQ ID NO: 1308784 - RNA, 21 nt, Homo sapiens
cauucaccugcccugugcaug

SEQ ID NO: 1308785 - RNA, 12 nt, Homo sapiens
cauucacucaua

SEQ ID NO: 1308786 - RNA, 20 nt, Homo sapiens
cauucacucauacaucuggc

SEQ ID NO: 1308787 - RNA, 17 nt, Homo sapiens
cauucacuugcauuucu

SEQ ID NO: 1308788 - RNA, 9 nt, Homo sapiens
cauucaguc

SEQ ID NO: 1308789 - RNA, 20 nt, Homo sapiens
cauucagugauuacugucaa

SEQ ID NO: 1308790 - RNA, 15 nt, Homo sapiens
cauuccaacucguau

SEQ ID NO: 1308791 - RNA, 23 nt, Homo sapiens
cauuccaagaauagcaucuguac

SEQ ID NO: 1308792 - RNA, 22 nt, Homo sapiens
cauuccagccacuggcugcuaa

SEQ ID NO: 1308793 - RNA, 19 nt, Homo sapiens
cauuccugaagaaccaguc

SEQ ID NO: 1308794 - RNA, 14 nt, Homo sapiens
cauuccugacaaag

SEQ ID NO: 1308795 - RNA, 22 nt, Homo sapiens
cauucgggagaucaugucucac

SEQ ID NO: 1308796 - RNA, 13 nt, Homo sapiens
cauucuacucaaa

SEQ ID NO: 1308797 - RNA, 16 nt, Homo sapiens
cauucuagaaacagga

SEQ ID NO: 1308798 - RNA, 18 nt, Homo sapiens
cauucuagaaacaggaaa

SEQ ID NO: 1308799 - RNA, 14 nt, Homo sapiens
cauucugcauuuag

SEQ ID NO: 1308800 - RNA, 14 nt, Homo sapiens
cauugaucugggau

SEQ ID NO: 1308801 - RNA, 17 nt, Homo sapiens
cauugcucuugagucuu

SEQ ID NO: 1308802 - RNA, 15 nt, Homo sapiens
cauugcugucugcag

SEQ ID NO: 1308803 - RNA, 16 nt, Homo sapiens
cauugcuguucuacuu

SEQ ID NO: 1308804 - RNA, 19 nt, Homo sapiens
cauuggaggggcuggcacu

SEQ ID NO: 1308805 - RNA, 17 nt, Homo sapiens
cauugugaaaaggcaaa

SEQ ID NO: 1308806 - RNA, 22 nt, Homo sapiens
cauuuaagagacagucacccca

SEQ ID NO: 1308807 - RNA, 19 nt, Homo sapiens
cauuuacacauauccacaa

SEQ ID NO: 1308808 - RNA, 20 nt, Homo sapiens
cauuuacacauauccacaaa

SEQ ID NO: 1308809 - RNA, 15 nt, Homo sapiens
cauuuagcccucaca

SEQ ID NO: 1308810 - RNA, 16 nt, Homo sapiens
cauuuauuuuucucau

SEQ ID NO: 1308811 - RNA, 17 nt, Homo sapiens
cauuuccaaauucacaa

SEQ ID NO: 1308812 - RNA, 12 nt, Homo sapiens
cauuuccaugca

SEQ ID NO: 1308813 - RNA, 22 nt, Homo sapiens
cauuucuauuucuccuccaugg

SEQ ID NO: 1308814 - RNA, 13 nt, Homo sapiens
cauuucuuugugc

SEQ ID NO: 1308815 - RNA, 15 nt, Homo sapiens
cauuugaaugcauuu

SEQ ID NO: 1308816 - RNA, 18 nt, Homo sapiens
cauuugauaaaauccaaa

SEQ ID NO: 1308817 - RNA, 14 nt, Homo sapiens
cauuugauauguga

SEQ ID NO: 1308818 - RNA, 15 nt, Homo sapiens
cauuugcaccuaccu

SEQ ID NO: 1308819 - RNA, 17 nt, Homo sapiens
cauuuguagcaauuuaa

SEQ ID NO: 1308820 - RNA, 13 nt, Homo sapiens
cauuuuaguuacu

SEQ ID NO: 1308821 - RNA, 16 nt, Homo sapiens
cauuuuaguuacugaa

SEQ ID NO: 1308822 - RNA, 14 nt, Homo sapiens
cauuuucaccccac

SEQ ID NO: 1308823 - RNA, 15 nt, Homo sapiens
cauuuucauugauga

SEQ ID NO: 1308824 - RNA, 18 nt, Homo sapiens
cauuuucugguaagguuu

SEQ ID NO: 1308825 - RNA, 20 nt, Homo sapiens
cauuuugugaauacuaugua

SEQ ID NO: 1308826 - RNA, 21 nt, Homo sapiens
cauuuuuaguagagacagggu

SEQ ID NO: 1308827 - RNA, 13 nt, Homo sapiens
ccugaagucacac

SEQ ID NO: 1308828 - RNA, 15 nt, Homo sapiens
ccugacaaggccagc

SEQ ID NO: 1308829 - RNA, 20 nt, Homo sapiens
ccugacguagcugcaaagga

SEQ ID NO: 1308830 - RNA, 16 nt, Homo sapiens
ccugacgucaguaguu

SEQ ID NO: 1308831 - RNA, 17 nt, Homo sapiens
ccugacuguaaaugcuc

SEQ ID NO: 1308832 - RNA, 17 nt, Homo sapiens
ccugacuuuuaauguca

SEQ ID NO: 1308833 - RNA, 21 nt, Homo sapiens
ccugagauccggcaacaucaa

SEQ ID NO: 1308834 - RNA, 19 nt, Homo sapiens
ccugagauucagaugucau

SEQ ID NO: 1308835 - RNA, 15 nt, Homo sapiens
ccugaggaagaugac

SEQ ID NO: 1308836 - RNA, 22 nt, Homo sapiens
ccugauuaacugaggcauccac

SEQ ID NO: 1308837 - RNA, 18 nt, Homo sapiens
ccugcacacucaguuucu

SEQ ID NO: 1308838 - RNA, 17 nt, Homo sapiens
ccugcaccccugcaguu

SEQ ID NO: 1308839 - RNA, 22 nt, Homo sapiens
ccugcagaagcagaagugcaau

SEQ ID NO: 1308840 - RNA, 22 nt, Homo sapiens
ccugcagcccauggugagcucu

SEQ ID NO: 1308841 - RNA, 19 nt, Homo sapiens
ccugcagucaucuugacca

SEQ ID NO: 1308842 - RNA, 15 nt, Homo sapiens
ccugcaucugaccag

SEQ ID NO: 1308843 - RNA, 23 nt, Homo sapiens
ccugcauguuggcccagaccuca

SEQ ID NO: 1308844 - RNA, 17 nt, Homo sapiens
ccugccacccauuccau

SEQ ID NO: 1308845 - RNA, 18 nt, Homo sapiens
ccugccauggacacuuca

SEQ ID NO: 1308846 - RNA, 16 nt, Homo sapiens
ccugcccugcccucac

SEQ ID NO: 1308847 - RNA, 14 nt, Homo sapiens
ccugcccuuggcac

SEQ ID NO: 1308848 - RNA, 17 nt, Homo sapiens
ccugccgguaaacacgc

SEQ ID NO: 1308849 - RNA, 16 nt, Homo sapiens
ccugccuuccagccac

SEQ ID NO: 1308850 - RNA, 20 nt, Homo sapiens
ccugcgccaccgcccagaga

SEQ ID NO: 1308851 - RNA, 22 nt, Homo sapiens
ccugcgggaagcugaccuuuaa

SEQ ID NO: 1308852 - RNA, 16 nt, Homo sapiens
ccugcugcacuuccug

SEQ ID NO: 1308853 - RNA, 20 nt, Homo sapiens
ccuggaacaucaucaaggca

SEQ ID NO: 1308854 - RNA, 20 nt, Homo sapiens
ccuggaaggcagccaggcug

SEQ ID NO: 1308855 - RNA, 14 nt, Homo sapiens
ccuggagagcuccu

SEQ ID NO: 1308856 - RNA, 22 nt, Homo sapiens
ccuggaguguaugacugcacau

SEQ ID NO: 1308857 - RNA, 22 nt, Homo sapiens
ccuggcagccacaacugcaguc

SEQ ID NO: 1308858 - RNA, 15 nt, Homo sapiens
ccuggcagcucugga

SEQ ID NO: 1308859 - RNA, 12 nt, Homo sapiens
ccuggcaguuua

SEQ ID NO: 1308860 - RNA, 20 nt, Homo sapiens
ccuggcccacugcaucguuu

SEQ ID NO: 1308861 - RNA, 21 nt, Homo sapiens
ccuggcuccaacacugcugcu

SEQ ID NO: 1308862 - RNA, 20 nt, Homo sapiens
ccuggcuggggccuguugaa

SEQ ID NO: 1308863 - RNA, 16 nt, Homo sapiens
ccugggcccuuccuau

SEQ ID NO: 1308864 - RNA, 18 nt, Homo sapiens
ccugggcugugaugugaa

SEQ ID NO: 1308865 - RNA, 12 nt, Homo sapiens
ccugggugacaa

SEQ ID NO: 1308866 - RNA, 13 nt, Homo sapiens
ccugggugacaaa

SEQ ID NO: 1308867 - RNA, 17 nt, Homo sapiens
ccuggucaacaugguga

SEQ ID NO: 1308868 - RNA, 19 nt, Homo sapiens
ccuggucaacauggugaaa

SEQ ID NO: 1308869 - RNA, 15 nt, Homo sapiens
ccuggugauguguuu

SEQ ID NO: 1308870 - RNA, 12 nt, Homo sapiens
ccuggugcccua

SEQ ID NO: 1308871 - RNA, 12 nt, Homo sapiens
ccugguucucau

SEQ ID NO: 1308872 - RNA, 17 nt, Homo sapiens
ccugguuguuguaguaa

SEQ ID NO: 1308873 - RNA, 18 nt, Homo sapiens
ccuguaagucaaaugugu

SEQ ID NO: 1308874 - RNA, 16 nt, Homo sapiens
ccuguaccugugcacg

SEQ ID NO: 1308875 - RNA, 21 nt, Homo sapiens
ccuguacuuuucccauuugua

SEQ ID NO: 1308876 - RNA, 23 nt, Homo sapiens
ccuguauaaguggaggcacuuua

SEQ ID NO: 1308877 - RNA, 17 nt, Homo sapiens
ccugucaaacaaagcca

SEQ ID NO: 1308878 - RNA, 17 nt, Homo sapiens
ccugucauuuugcacug

SEQ ID NO: 1308879 - RNA, 17 nt, Homo sapiens
ccuguccuccaacacca

SEQ ID NO: 1308880 - RNA, 16 nt, Homo sapiens
ccugucuuucagcauu

SEQ ID NO: 1308881 - RNA, 14 nt, Homo sapiens
ccugugaaugccac

SEQ ID NO: 1308882 - RNA, 13 nt, Homo sapiens
ccugugacuggca

SEQ ID NO: 1308883 - RNA, 10 nt, Homo sapiens
ccugugagcu

SEQ ID NO: 1308884 - RNA, 19 nt, Homo sapiens
ccugugccccuggaugcac

SEQ ID NO: 1308885 - RNA, 15 nt, Homo sapiens
ccugugccuccauca

SEQ ID NO: 1308886 - RNA, 17 nt, Homo sapiens
ccugugcuucugcuuau

SEQ ID NO: 1308887 - RNA, 18 nt, Homo sapiens
ccuguggguaucaguucu

SEQ ID NO: 1308888 - RNA, 18 nt, Homo sapiens
ccuguuaacgucaucuca

SEQ ID NO: 1308889 - RNA, 22 nt, Homo sapiens
ccuguucaguacucuacaauuc

SEQ ID NO: 1308890 - RNA, 12 nt, Homo sapiens
ccuuaaauaugu

SEQ ID NO: 1308891 - RNA, 21 nt, Homo sapiens
ccuuaagcccuggcccccuga

SEQ ID NO: 1308892 - RNA, 17 nt, Homo sapiens
ccuuaaugguguucucu

SEQ ID NO: 1308893 - RNA, 17 nt, Homo sapiens
ccuuaccuuuaccccau

SEQ ID NO: 1308894 - RNA, 17 nt, Homo sapiens
ccuuauccagacagugg

SEQ ID NO: 1308895 - RNA, 17 nt, Homo sapiens
ccuuauccuaaugaugc

SEQ ID NO: 1308896 - RNA, 15 nt, Homo sapiens
ccuucagcaccugac

SEQ ID NO: 1308897 - RNA, 21 nt, Homo sapiens
ccuucauugccacacuuggug

SEQ ID NO: 1308898 - RNA, 13 nt, Homo sapiens
ccuuccagccaca

SEQ ID NO: 1308899 - RNA, 15 nt, Homo sapiens
ccuucccaaucuucu

SEQ ID NO: 1308900 - RNA, 17 nt, Homo sapiens
ccuucgcuucuugccuc

SEQ ID NO: 1308901 - RNA, 21 nt, Homo sapiens
ccuucguuuacuaugccugug

SEQ ID NO: 1308902 - RNA, 14 nt, Homo sapiens
ccuucucaccagcu

SEQ ID NO: 1308903 - RNA, 18 nt, Homo sapiens
ccuucuggaaacugugaa

SEQ ID NO: 1308904 - RNA, 13 nt, Homo sapiens
ccuucugugggga

SEQ ID NO: 1308905 - RNA, 16 nt, Homo sapiens
ccuugcccccauuuca

SEQ ID NO: 1308906 - RNA, 15 nt, Homo sapiens
ccuugccugcacaaa

SEQ ID NO: 1308907 - RNA, 22 nt, Homo sapiens
ccuugcgauucugcagccacaa

SEQ ID NO: 1308908 - RNA, 17 nt, Homo sapiens
ccuugcuuuugcuucua

SEQ ID NO: 1308909 - RNA, 22 nt, Homo sapiens
ccuuggaaguugcauggcauca

SEQ ID NO: 1308910 - RNA, 17 nt, Homo sapiens
ccuuggcaccagacacc

SEQ ID NO: 1308911 - RNA, 16 nt, Homo sapiens
ccuuggcagcccugau

SEQ ID NO: 1308912 - RNA, 19 nt, Homo sapiens
ccuugggagccacugccac

SEQ ID NO: 1308913 - RNA, 22 nt, Homo sapiens
ccuuggggccacugccugaggc

SEQ ID NO: 1308914 - RNA, 17 nt, Homo sapiens
ccuuguccaaaccuggg

SEQ ID NO: 1308915 - RNA, 14 nt, Homo sapiens
ccuuguccccauga

SEQ ID NO: 1308916 - RNA, 16 nt, Homo sapiens
ccuuuaggguucugcc

SEQ ID NO: 1308917 - RNA, 16 nt, Homo sapiens
ccuuuaguggcuucau

SEQ ID NO: 1308918 - RNA, 14 nt, Homo sapiens
ccuuuaucaccuca

SEQ ID NO: 1308919 - RNA, 18 nt, Homo sapiens
ccuuuaucaccucauucu

SEQ ID NO: 1308920 - RNA, 17 nt, Homo sapiens
ccuuuaugcacccaaga

SEQ ID NO: 1308921 - RNA, 16 nt, Homo sapiens
ccuuucaccacaugug

SEQ ID NO: 1308922 - RNA, 17 nt, Homo sapiens
ccuuucaucacacuggg

SEQ ID NO: 1308923 - RNA, 14 nt, Homo sapiens
ccuuuccucaaaac

SEQ ID NO: 1308924 - RNA, 18 nt, Homo sapiens
ccuuucuucagacacuga

SEQ ID NO: 1308925 - RNA, 19 nt, Homo sapiens
ccuuugaccccagcagcuu

SEQ ID NO: 1308926 - RNA, 18 nt, Homo sapiens
ccuuugccucaaggacuu

SEQ ID NO: 1308927 - RNA, 17 nt, Homo sapiens
ccuuuggaaacaacauu

SEQ ID NO: 1308928 - RNA, 17 nt, Homo sapiens
ccuuuuuccauaguguu

SEQ ID NO: 1308929 - RNA, 16 nt, Homo sapiens
ccuuuuugguuuuuac

SEQ ID NO: 1308930 - RNA, 12 nt, Homo sapiens
ccuuuuuuccca

SEQ ID NO: 1308931 - RNA, 21 nt, Homo sapiens
cgaaaccugggauucaggaau

SEQ ID NO: 1308932 - RNA, 21 nt, Homo sapiens
cgaacaauucauauauuugaa

SEQ ID NO: 1308933 - RNA, 17 nt, Homo sapiens
cgaaucuacuaauucca

SEQ ID NO: 1308934 - RNA, 18 nt, Homo sapiens
cgaauugacaacccaaac

SEQ ID NO: 1308935 - RNA, 23 nt, Homo sapiens
cgacacugggaggccagugagcc

SEQ ID NO: 1308936 - RNA, 18 nt, Homo sapiens
cgacuccacgcuguccuu

SEQ ID NO: 1308937 - RNA, 19 nt, Homo sapiens
cgagaccagccuggccaac

SEQ ID NO: 1308938 - RNA, 15 nt, Homo sapiens
cgagauccaccagau

SEQ ID NO: 1308939 - RNA, 21 nt, Homo sapiens
cgagcaccuccagccugaaca

SEQ ID NO: 1308940 - RNA, 14 nt, Homo sapiens
cgaggaaacucaga

SEQ ID NO: 1308941 - RNA, 18 nt, Homo sapiens
cgaggugccuucuucagg

SEQ ID NO: 1308942 - RNA, 21 nt, Homo sapiens
cgagugcuaaguguaggauau

SEQ ID NO: 1308943 - RNA, 14 nt, Homo sapiens
cgauaaagggauuu

SEQ ID NO: 1308944 - RNA, 13 nt, Homo sapiens
cgaucaguggugu

SEQ ID NO: 1308945 - RNA, 12 nt, Homo sapiens
cgaucuggguuc

SEQ ID NO: 1308946 - RNA, 18 nt, Homo sapiens
cgaucuggguucacugca

SEQ ID NO: 1308947 - RNA, 17 nt, Homo sapiens
cgauugguaugaugcug

SEQ ID NO: 1308948 - RNA, 17 nt, Homo sapiens
cgauuuuguaucugcag

SEQ ID NO: 1308949 - RNA, 16 nt, Homo sapiens
cgccaagcaggacagu

SEQ ID NO: 1308950 - RNA, 19 nt, Homo sapiens
cgcccccuccgcccugcca

SEQ ID NO: 1308951 - RNA, 19 nt, Homo sapiens
cgcccucacugcaggcucc

SEQ ID NO: 1308952 - RNA, 13 nt, Homo sapiens
cgccgaauccugu

SEQ ID NO: 1308953 - RNA, 20 nt, Homo sapiens
cgcgcaccuguaaucccagc

SEQ ID NO: 1308954 - RNA, 16 nt, Homo sapiens
cgcuaccucuccagcc

SEQ ID NO: 1308955 - RNA, 22 nt, Homo sapiens
cgcuccuuugugugugugucag

SEQ ID NO: 1308956 - RNA, 18 nt, Homo sapiens
cgcugcccgcucagccca

SEQ ID NO: 1308957 - RNA, 16 nt, Homo sapiens
cgcuggaccuugaacu

SEQ ID NO: 1308958 - RNA, 12 nt, Homo sapiens
cgcuucuugccu

SEQ ID NO: 1308959 - RNA, 15 nt, Homo sapiens
cggagaacaaaugug

SEQ ID NO: 1308960 - RNA, 16 nt, Homo sapiens
cuauaacuuacuucug

SEQ ID NO: 1308961 - RNA, 18 nt, Homo sapiens
cuauaagauuccaaaaag

SEQ ID NO: 1308962 - RNA, 12 nt, Homo sapiens
cuauaagccaau

SEQ ID NO: 1308963 - RNA, 20 nt, Homo sapiens
cuauaauuuaaauauaugcu

SEQ ID NO: 1308964 - RNA, 18 nt, Homo sapiens
cuauagccuaggugacag

SEQ ID NO: 1308965 - RNA, 15 nt, Homo sapiens
cuauaggucagagau

SEQ ID NO: 1308966 - RNA, 14 nt, Homo sapiens
cuauaguauuugau

SEQ ID NO: 1308967 - RNA, 23 nt, Homo sapiens
cuauauaguuuauugacaauaau

SEQ ID NO: 1308968 - RNA, 14 nt, Homo sapiens
cuauauguauucac

SEQ ID NO: 1308969 - RNA, 18 nt, Homo sapiens
cuaucccuuuccaaaggc

SEQ ID NO: 1308970 - RNA, 20 nt, Homo sapiens
cuauccguguugcagguuca

SEQ ID NO: 1308971 - RNA, 14 nt, Homo sapiens
cuaucuacuacaaa

SEQ ID NO: 1308972 - RNA, 14 nt, Homo sapiens
cuauggugcucugu

SEQ ID NO: 1308973 - RNA, 18 nt, Homo sapiens
cuauguaaacaaaccaca

SEQ ID NO: 1308974 - RNA, 14 nt, Homo sapiens
cuauguaacaugua

SEQ ID NO: 1308975 - RNA, 18 nt, Homo sapiens
cuauguagcaauauauca

SEQ ID NO: 1308976 - RNA, 20 nt, Homo sapiens
cuauguugucuuuuaaaaag

SEQ ID NO: 1308977 - RNA, 12 nt, Homo sapiens
cuauucaucuca

SEQ ID NO: 1308978 - RNA, 17 nt, Homo sapiens
cuauucaugcuacccag

SEQ ID NO: 1308979 - RNA, 14 nt, Homo sapiens
cuauuccaaaaagg

SEQ ID NO: 1308980 - RNA, 16 nt, Homo sapiens
cuauuuuuucuugaca

SEQ ID NO: 1308981 - RNA, 15 nt, Homo sapiens
cucaaaaauagggaa

SEQ ID NO: 1308982 - RNA, 21 nt, Homo sapiens
cucaaaagcugggcagguugg

SEQ ID NO: 1308983 - RNA, 17 nt, Homo sapiens
cucaaacggcaacauuc

SEQ ID NO: 1308984 - RNA, 13 nt, Homo sapiens
cucaaaggcacag

SEQ ID NO: 1308985 - RNA, 18 nt, Homo sapiens
cucaagaaacaacuucua

SEQ ID NO: 1308986 - RNA, 23 nt, Homo sapiens
cucaagcccgcggggacauuggg

SEQ ID NO: 1308987 - RNA, 12 nt, Homo sapiens
cucaagcugucc

SEQ ID NO: 1308988 - RNA, 15 nt, Homo sapiens
cucaauccugcagug

SEQ ID NO: 1308989 - RNA, 23 nt, Homo sapiens
cucacacuuuuggaaccaugccu

SEQ ID NO: 1308990 - RNA, 14 nt, Homo sapiens
cucacagagugcau

SEQ ID NO: 1308991 - RNA, 19 nt, Homo sapiens
cucacagagugcauuguga

SEQ ID NO: 1308992 - RNA, 11 nt, Homo sapiens
cucacaguccu

SEQ ID NO: 1308993 - RNA, 14 nt, Homo sapiens
cucacauaggaagu

SEQ ID NO: 1308994 - RNA, 19 nt, Homo sapiens
cucacauuuauucugcuca

SEQ ID NO: 1308995 - RNA, 19 nt, Homo sapiens
cucacccaccccugcacag

SEQ ID NO: 1308996 - RNA, 19 nt, Homo sapiens
cucaccuagccugaugaga

SEQ ID NO: 1308997 - RNA, 12 nt, Homo sapiens
cucacgccugua

SEQ ID NO: 1308998 - RNA, 20 nt, Homo sapiens
cucacgccuguaaucccagc

SEQ ID NO: 1308999 - RNA, 14 nt, Homo sapiens
cucacgcuucacag

SEQ ID NO: 1309000 - RNA, 14 nt, Homo sapiens
cucacugcuaucug

SEQ ID NO: 1309001 - RNA, 23 nt, Homo sapiens
cucacuggggccuacagcuuuga

SEQ ID NO: 1309002 - RNA, 17 nt, Homo sapiens
cucacuguugaauuuuc

SEQ ID NO: 1309003 - RNA, 14 nt, Homo sapiens
cucacuguugugaa

SEQ ID NO: 1309004 - RNA, 23 nt, Homo sapiens
cucacuguugugaagguuguaga

SEQ ID NO: 1309005 - RNA, 11 nt, Homo sapiens
cucacuuuaaa

SEQ ID NO: 1309006 - RNA, 20 nt, Homo sapiens
cucagaacuugcugcugucu

SEQ ID NO: 1309007 - RNA, 14 nt, Homo sapiens
cucagcauuuccac

SEQ ID NO: 1309008 - RNA, 15 nt, Homo sapiens
cucagccacccugug

SEQ ID NO: 1309009 - RNA, 18 nt, Homo sapiens
cucagccuacuccgcuca

SEQ ID NO: 1309010 - RNA, 21 nt, Homo sapiens
cucagccuugccagagaucca

SEQ ID NO: 1309011 - RNA, 19 nt, Homo sapiens
cucagcucuuggcuccacu

SEQ ID NO: 1309012 - RNA, 15 nt, Homo sapiens
cucaggaucucuuag

SEQ ID NO: 1309013 - RNA, 14 nt, Homo sapiens
cucaggcacacagc

SEQ ID NO: 1309014 - RNA, 19 nt, Homo sapiens
cucaggcacacagcuacuc

SEQ ID NO: 1309015 - RNA, 21 nt, Homo sapiens
cucaggccaucaucaguggag

SEQ ID NO: 1309016 - RNA, 16 nt, Homo sapiens
cucaggcgggacagug

SEQ ID NO: 1309017 - RNA, 20 nt, Homo sapiens
cucagggcagcgccaggcug

SEQ ID NO: 1309018 - RNA, 12 nt, Homo sapiens
cucaggucugua

SEQ ID NO: 1309019 - RNA, 21 nt, Homo sapiens
cucagucccuaaaaacacaga

SEQ ID NO: 1309020 - RNA, 14 nt, Homo sapiens
cucagugagcccau

SEQ ID NO: 1309021 - RNA, 11 nt, Homo sapiens
cucagugccac

SEQ ID NO: 1309022 - RNA, 19 nt, Homo sapiens
cucaguggugccugcauuu

SEQ ID NO: 1309023 - RNA, 15 nt, Homo sapiens
cucauaaacauuuga

SEQ ID NO: 1309024 - RNA, 22 nt, Homo sapiens
cucauagguugagcaauuuccc

SEQ ID NO: 1309025 - RNA, 19 nt, Homo sapiens
cucauaugcauguagucac

SEQ ID NO: 1309026 - RNA, 13 nt, Homo sapiens
cucauccaucaca

SEQ ID NO: 1309027 - RNA, 15 nt, Homo sapiens
cucauccugcaggca

SEQ ID NO: 1309028 - RNA, 15 nt, Homo sapiens
cucaucuuucuugau

SEQ ID NO: 1309029 - RNA, 14 nt, Homo sapiens
cucaugaagcauac

SEQ ID NO: 1309030 - RNA, 19 nt, Homo sapiens
cucaugagaaguugauaua

SEQ ID NO: 1309031 - RNA, 18 nt, Homo sapiens
cucaugcccccucaguga

SEQ ID NO: 1309032 - RNA, 18 nt, Homo sapiens
cucauuccccaaccacuu

SEQ ID NO: 1309033 - RNA, 19 nt, Homo sapiens
cucauuugucacacacuuu

SEQ ID NO: 1309034 - RNA, 18 nt, Homo sapiens
cuccaauguacaacuucc

SEQ ID NO: 1309035 - RNA, 18 nt, Homo sapiens
cuccaauuucaagaguga

SEQ ID NO: 1309036 - RNA, 20 nt, Homo sapiens
cuccacccucccucccugau

SEQ ID NO: 1309037 - RNA, 16 nt, Homo sapiens
cuccagcucaccagcc

SEQ ID NO: 1309038 - RNA, 23 nt, Homo sapiens
cuccaggaagaaagaauguuacu

SEQ ID NO: 1309039 - RNA, 17 nt, Homo sapiens
cuccaggaccccagcaa

SEQ ID NO: 1309040 - RNA, 17 nt, Homo sapiens
cuccagggucagaaaca

SEQ ID NO: 1309041 - RNA, 19 nt, Homo sapiens
cuccaguaccuugcuucuu

SEQ ID NO: 1309042 - RNA, 20 nt, Homo sapiens
cuccaguccugccaccaccc

SEQ ID NO: 1309043 - RNA, 21 nt, Homo sapiens
cuccaguccugccaccacccu

SEQ ID NO: 1309044 - RNA, 19 nt, Homo sapiens
cuccauguagaagccacua

SEQ ID NO: 1309045 - RNA, 21 nt, Homo sapiens
cuccauguagaagccacuauu

SEQ ID NO: 1309046 - RNA, 14 nt, Homo sapiens
cuccauuuuagccc

SEQ ID NO: 1309047 - RNA, 21 nt, Homo sapiens
cucccaagggauggugcccug

SEQ ID NO: 1309048 - RNA, 14 nt, Homo sapiens
cucccacaaaggag

SEQ ID NO: 1309049 - RNA, 19 nt, Homo sapiens
cucccaccaccucaccagu

SEQ ID NO: 1309050 - RNA, 19 nt, Homo sapiens
cucccagaacacacuccau

SEQ ID NO: 1309051 - RNA, 20 nt, Homo sapiens
cucccauaaacacugaauua

SEQ ID NO: 1309052 - RNA, 18 nt, Homo sapiens
cuccccuccggacuggug

SEQ ID NO: 1309053 - RNA, 13 nt, Homo sapiens
cucccuaccaccu

SEQ ID NO: 1309054 - RNA, 22 nt, Homo sapiens
cucccugagugguccccaccuu

SEQ ID NO: 1309055 - RNA, 17 nt, Homo sapiens
cucccuguuccccagag

SEQ ID NO: 1309056 - RNA, 21 nt, Homo sapiens
cucccuucguccaccacucua

SEQ ID NO: 1309057 - RNA, 19 nt, Homo sapiens
cuccgcuuucuacccagcg

SEQ ID NO: 1309058 - RNA, 14 nt, Homo sapiens
cuccuaaagcuuuu

SEQ ID NO: 1309059 - RNA, 22 nt, Homo sapiens
cuccuaaccucaagugauccuc

SEQ ID NO: 1309060 - RNA, 16 nt, Homo sapiens
cuccuaacuacaggua

SEQ ID NO: 1309061 - RNA, 19 nt, Homo sapiens
cuccucacucaccuucagu

SEQ ID NO: 1309062 - RNA, 20 nt, Homo sapiens
cuccucagcggcuccagcuc

SEQ ID NO: 1309063 - RNA, 16 nt, Homo sapiens
cuccucaggcacacag

SEQ ID NO: 1309064 - RNA, 21 nt, Homo sapiens
cuccucaggcacacagcuacu

SEQ ID NO: 1309065 - RNA, 16 nt, Homo sapiens
cuccuccguggcacau

SEQ ID NO: 1309066 - RNA, 18 nt, Homo sapiens
cuccucugugaagcauuc

SEQ ID NO: 1309067 - RNA, 11 nt, Homo sapiens
cuccugaggga

SEQ ID NO: 1309068 - RNA, 17 nt, Homo sapiens
cuccugccaccagcauc

SEQ ID NO: 1309069 - RNA, 21 nt, Homo sapiens
cuccuguauuuaacaaaaagu

SEQ ID NO: 1309070 - RNA, 18 nt, Homo sapiens
cuccugugucuugcaaug

SEQ ID NO: 1309071 - RNA, 17 nt, Homo sapiens
cuccuguuuacugaaaa

SEQ ID NO: 1309072 - RNA, 19 nt, Homo sapiens
cuccuuccaacaggagcug

SEQ ID NO: 1309073 - RNA, 20 nt, Homo sapiens
cuccuugagagaccaggcaa

SEQ ID NO: 1309074 - RNA, 19 nt, Homo sapiens
cuccuuuguguguguguca

SEQ ID NO: 1309075 - RNA, 20 nt, Homo sapiens
cuccuuuuuugcaugugcaa

SEQ ID NO: 1309076 - RNA, 21 nt, Homo sapiens
cucgccagagcugugguguca

SEQ ID NO: 1309077 - RNA, 22 nt, Homo sapiens
cucggagaaacgggugagcuga

SEQ ID NO: 1309078 - RNA, 14 nt, Homo sapiens
cucggagcauauau

SEQ ID NO: 1309079 - RNA, 22 nt, Homo sapiens
cucggugucuaugcaaggccgc

SEQ ID NO: 1309080 - RNA, 14 nt, Homo sapiens
cucguuuuccuuag

SEQ ID NO: 1309081 - RNA, 15 nt, Homo sapiens
cucuaaaagaaaaag

SEQ ID NO: 1309082 - RNA, 21 nt, Homo sapiens
cucuaacagcucaggaucucu

SEQ ID NO: 1309083 - RNA, 18 nt, Homo sapiens
cucuaaugugucucucac

SEQ ID NO: 1309084 - RNA, 12 nt, Homo sapiens
cucuacaaaaag

SEQ ID NO: 1309085 - RNA, 13 nt, Homo sapiens
cucuacaaaaagc

SEQ ID NO: 1309086 - RNA, 15 nt, Homo sapiens
cucuacccacuucuc

SEQ ID NO: 1309087 - RNA, 22 nt, Homo sapiens
cucuacccucuuagaaaaacca

SEQ ID NO: 1309088 - RNA, 20 nt, Homo sapiens
cucuagaagugccaucucaa

SEQ ID NO: 1309089 - RNA, 17 nt, Homo sapiens
cucuauaagauuccaaa

SEQ ID NO: 1309090 - RNA, 18 nt, Homo sapiens
cucuauaagauuccaaaa

SEQ ID NO: 1309091 - RNA, 21 nt, Homo sapiens
cucuauaagauuccaaaaagc

SEQ ID NO: 1309092 - RNA, 14 nt, Homo sapiens
cuuaaaaaguauuu

SEQ ID NO: 1309093 - RNA, 21 nt, Homo sapiens
cuuaaaaauauauuuccucau

SEQ ID NO: 1309094 - RNA, 15 nt, Homo sapiens
cuuaaacacuugcaa

SEQ ID NO: 1309095 - RNA, 13 nt, Homo sapiens
cuuaacacugagc

SEQ ID NO: 1309096 - RNA, 17 nt, Homo sapiens
cuuaagagaugccucau

SEQ ID NO: 1309097 - RNA, 16 nt, Homo sapiens
cuuaagcuaagacuga

SEQ ID NO: 1309098 - RNA, 22 nt, Homo sapiens
cuuaauaagauauuuaguaaua

SEQ ID NO: 1309099 - RNA, 22 nt, Homo sapiens
cuuaauacaucuacaaccauug

SEQ ID NO: 1309100 - RNA, 23 nt, Homo sapiens
cuuaaugaaguuugaauguuaaa

SEQ ID NO: 1309101 - RNA, 22 nt, Homo sapiens
cuuaaugcagacaaacaaacau

SEQ ID NO: 1309102 - RNA, 19 nt, Homo sapiens
cuuacauagccaccuguca

SEQ ID NO: 1309103 - RNA, 13 nt, Homo sapiens
cuuacaucaggaa

SEQ ID NO: 1309104 - RNA, 15 nt, Homo sapiens
cuuacaucaggaaau

SEQ ID NO: 1309105 - RNA, 22 nt, Homo sapiens
cuuaccccaguuuuuugaacau

SEQ ID NO: 1309106 - RNA, 20 nt, Homo sapiens
cuuacucuaggucaguauua

SEQ ID NO: 1309107 - RNA, 15 nt, Homo sapiens
cuuacuuaggugugg

SEQ ID NO: 1309108 - RNA, 14 nt, Homo sapiens
cuuagaaaaaccac

SEQ ID NO: 1309109 - RNA, 18 nt, Homo sapiens
cuuagaaaacaaguauug

SEQ ID NO: 1309110 - RNA, 19 nt, Homo sapiens
cuuagauguuccaguaauc

SEQ ID NO: 1309111 - RNA, 11 nt, Homo sapiens
cuuagccauuu

SEQ ID NO: 1309112 - RNA, 22 nt, Homo sapiens
cuuaggcaugacuguagaauuu

SEQ ID NO: 1309113 - RNA, 14 nt, Homo sapiens
cuuaguauugugau

SEQ ID NO: 1309114 - RNA, 16 nt, Homo sapiens
cuuagugacaaaauag

SEQ ID NO: 1309115 - RNA, 20 nt, Homo sapiens
cuuaguuacuuuggaacacu

SEQ ID NO: 1309116 - RNA, 20 nt, Homo sapiens
cuuauaagaaagaucaaaga

SEQ ID NO: 1309117 - RNA, 18 nt, Homo sapiens
cuuauaauuugcauacca

SEQ ID NO: 1309118 - RNA, 20 nt, Homo sapiens
cuuaucaagcagccaaggga

SEQ ID NO: 1309119 - RNA, 14 nt, Homo sapiens
cuuaucaccugcca

SEQ ID NO: 1309120 - RNA, 17 nt, Homo sapiens
cuuauccaugccuggga

SEQ ID NO: 1309121 - RNA, 19 nt, Homo sapiens
cuuaucccugcccauuuca

SEQ ID NO: 1309122 - RNA, 18 nt, Homo sapiens
cuuauccuagcacaugcu

SEQ ID NO: 1309123 - RNA, 16 nt, Homo sapiens
cuuauuaaauauucua

SEQ ID NO: 1309124 - RNA, 21 nt, Homo sapiens
cuuauuacagcauuugauaaa

SEQ ID NO: 1309125 - RNA, 23 nt, Homo sapiens
cuuauuuaaugccgauauacucu

SEQ ID NO: 1309126 - RNA, 21 nt, Homo sapiens
cuucaagaacccugacuccuc

SEQ ID NO: 1309127 - RNA, 18 nt, Homo sapiens
cuucaaucggcuuguggg

SEQ ID NO: 1309128 - RNA, 16 nt, Homo sapiens
cuucacaaaccagaga

SEQ ID NO: 1309129 - RNA, 23 nt, Homo sapiens
cuucacaaaccagagaccaaaug

SEQ ID NO: 1309130 - RNA, 12 nt, Homo sapiens
cuucacauccau

SEQ ID NO: 1309131 - RNA, 23 nt, Homo sapiens
cuucaccuuucccacuuucuucu

SEQ ID NO: 1309132 - RNA, 18 nt, Homo sapiens
cuucacugcaaguuuuag

SEQ ID NO: 1309133 - RNA, 23 nt, Homo sapiens
cuucacuguccuccaagccagcg

SEQ ID NO: 1309134 - RNA, 16 nt, Homo sapiens
cuucagagcugacaca

SEQ ID NO: 1309135 - RNA, 16 nt, Homo sapiens
cuucagauugaacuua

SEQ ID NO: 1309136 - RNA, 17 nt, Homo sapiens
cuucagccuuaauggaa

SEQ ID NO: 1309137 - RNA, 18 nt, Homo sapiens
cuucagccuuaauggaag

SEQ ID NO: 1309138 - RNA, 17 nt, Homo sapiens
cuucagcucuucuugac

SEQ ID NO: 1309139 - RNA, 14 nt, Homo sapiens
cuucagugcugcuc

SEQ ID NO: 1309140 - RNA, 16 nt, Homo sapiens
cuucauagaaaccucu

SEQ ID NO: 1309141 - RNA, 20 nt, Homo sapiens
cuucauaugaaaggugccau

SEQ ID NO: 1309142 - RNA, 22 nt, Homo sapiens
cuucaucgaaucuacuaauucc

SEQ ID NO: 1309143 - RNA, 14 nt, Homo sapiens
cuucaugcagguga

SEQ ID NO: 1309144 - RNA, 19 nt, Homo sapiens
cuucauggaucagaucugg

SEQ ID NO: 1309145 - RNA, 17 nt, Homo sapiens
cuucauuuaacaaguaa

SEQ ID NO: 1309146 - RNA, 16 nt, Homo sapiens
cuucauuucauguaua

SEQ ID NO: 1309147 - RNA, 19 nt, Homo sapiens
cuuccagggauuugccuca

SEQ ID NO: 1309148 - RNA, 16 nt, Homo sapiens
cuuccaguguccuuag

SEQ ID NO: 1309149 - RNA, 19 nt, Homo sapiens
cuuccauaaaaaaacaauu

SEQ ID NO: 1309150 - RNA, 18 nt, Homo sapiens
cuuccauuugcaagggaa

SEQ ID NO: 1309151 - RNA, 23 nt, Homo sapiens
cuucccagcacuaugcuuuccuu

SEQ ID NO: 1309152 - RNA, 21 nt, Homo sapiens
cuucccaguggcugcugccca

SEQ ID NO: 1309153 - RNA, 16 nt, Homo sapiens
cuuccccaucuucuaa

SEQ ID NO: 1309154 - RNA, 13 nt, Homo sapiens
cuuccgaaaacca

SEQ ID NO: 1309155 - RNA, 15 nt, Homo sapiens
cuuccucucugcaau

SEQ ID NO: 1309156 - RNA, 17 nt, Homo sapiens
cuuccugaaacuauauu

SEQ ID NO: 1309157 - RNA, 15 nt, Homo sapiens
cuuccuguccagcuc

SEQ ID NO: 1309158 - RNA, 22 nt, Homo sapiens
cuuccuguguguccaaaacugc

SEQ ID NO: 1309159 - RNA, 16 nt, Homo sapiens
cuuccuuaugcuucuu

SEQ ID NO: 1309160 - RNA, 14 nt, Homo sapiens
cuuccuugauaaua

SEQ ID NO: 1309161 - RNA, 14 nt, Homo sapiens
cuucggacaacuca

SEQ ID NO: 1309162 - RNA, 22 nt, Homo sapiens
cuucgggcugugcccggggaaa

SEQ ID NO: 1309163 - RNA, 20 nt, Homo sapiens
cuucuaagagguagauacca

SEQ ID NO: 1309164 - RNA, 16 nt, Homo sapiens
cuucuacugcuaucua

SEQ ID NO: 1309165 - RNA, 16 nt, Homo sapiens
cuucuagagcuuagca

SEQ ID NO: 1309166 - RNA, 19 nt, Homo sapiens
cuucucaaauuagcugcaa

SEQ ID NO: 1309167 - RNA, 20 nt, Homo sapiens
cuucucaaauuagcugcaau

SEQ ID NO: 1309168 - RNA, 20 nt, Homo sapiens
cuucuccaaggagcauguca

SEQ ID NO: 1309169 - RNA, 18 nt, Homo sapiens
cuucuccauccacauggg

SEQ ID NO: 1309170 - RNA, 21 nt, Homo sapiens
cuucucccgauggccacuggg

SEQ ID NO: 1309171 - RNA, 16 nt, Homo sapiens
cuucucugcacuuaua

SEQ ID NO: 1309172 - RNA, 15 nt, Homo sapiens
cuucugagcacagau

SEQ ID NO: 1309173 - RNA, 12 nt, Homo sapiens
cuucugcuacug

SEQ ID NO: 1309174 - RNA, 17 nt, Homo sapiens
cuucugcuuauucaguc

SEQ ID NO: 1309175 - RNA, 21 nt, Homo sapiens
cuucuggacugguuuucacau

SEQ ID NO: 1309176 - RNA, 22 nt, Homo sapiens
cuucuggccucccacagacuca

SEQ ID NO: 1309177 - RNA, 13 nt, Homo sapiens
cuucuuguucccc

SEQ ID NO: 1309178 - RNA, 17 nt, Homo sapiens
cuucuuucagacuugcc

SEQ ID NO: 1309179 - RNA, 16 nt, Homo sapiens
cuugaaaaacuuacaa

SEQ ID NO: 1309180 - RNA, 21 nt, Homo sapiens
cuugaaaagcuaguguaccuc

SEQ ID NO: 1309181 - RNA, 15 nt, Homo sapiens
cuugaaaauagaaca

SEQ ID NO: 1309182 - RNA, 23 nt, Homo sapiens
cuugaaaucuaauauuucuagua

SEQ ID NO: 1309183 - RNA, 14 nt, Homo sapiens
cuugaaccccaaau

SEQ ID NO: 1309184 - RNA, 22 nt, Homo sapiens
cuugaagaaccucucacuucac

SEQ ID NO: 1309185 - RNA, 18 nt, Homo sapiens
cuugaagggccagagcca

SEQ ID NO: 1309186 - RNA, 16 nt, Homo sapiens
cuugaaggugcugacg

SEQ ID NO: 1309187 - RNA, 12 nt, Homo sapiens
cuugaauauauc

SEQ ID NO: 1309188 - RNA, 16 nt, Homo sapiens
cuugaauguggcuuga

SEQ ID NO: 1309189 - RNA, 15 nt, Homo sapiens
cuugacaacaucuga

SEQ ID NO: 1309190 - RNA, 19 nt, Homo sapiens
cuugacagaaagcaguucu

SEQ ID NO: 1309191 - RNA, 20 nt, Homo sapiens
cuugagccagccaggcccug

SEQ ID NO: 1309192 - RNA, 18 nt, Homo sapiens
cuugaguuuaaauuguaa

SEQ ID NO: 1309193 - RNA, 13 nt, Homo sapiens
cuugaucuguaua

SEQ ID NO: 1309194 - RNA, 21 nt, Homo sapiens
cuugaugacugccuugccucc

SEQ ID NO: 1309195 - RNA, 17 nt, Homo sapiens
cuugauucugcaguaaa

SEQ ID NO: 1309196 - RNA, 18 nt, Homo sapiens
cuugauuuuauuguacaa

SEQ ID NO: 1309197 - RNA, 17 nt, Homo sapiens
cuugcaguuaaggguua

SEQ ID NO: 1309198 - RNA, 18 nt, Homo sapiens
cuugcaguuaaggguuag

SEQ ID NO: 1309199 - RNA, 18 nt, Homo sapiens
cuugccaaauauaaauaa

SEQ ID NO: 1309200 - RNA, 20 nt, Homo sapiens
cuugccaagggucccugugu

SEQ ID NO: 1309201 - RNA, 17 nt, Homo sapiens
cuugcuguugacauauu

SEQ ID NO: 1309202 - RNA, 15 nt, Homo sapiens
cuugcuuauguguag

SEQ ID NO: 1309203 - RNA, 16 nt, Homo sapiens
cuugcuugcaauaggu

SEQ ID NO: 1309204 - RNA, 15 nt, Homo sapiens
cuuggaacccggugc

SEQ ID NO: 1309205 - RNA, 19 nt, Homo sapiens
cuuggacuauuauaauuua

SEQ ID NO: 1309206 - RNA, 21 nt, Homo sapiens
cuuggcaccagacacccagga

SEQ ID NO: 1309207 - RNA, 15 nt, Homo sapiens
cuuggcagcccugau

SEQ ID NO: 1309208 - RNA, 17 nt, Homo sapiens
cuuggcuccacugggau

SEQ ID NO: 1309209 - RNA, 13 nt, Homo sapiens
cuuggcugcauuu

SEQ ID NO: 1309210 - RNA, 22 nt, Homo sapiens
cuuggcugcauuugccugucau

SEQ ID NO: 1309211 - RNA, 22 nt, Homo sapiens
cuuggcuuacugcagccuuugc

SEQ ID NO: 1309212 - RNA, 21 nt, Homo sapiens
cuugggaaaggugguguuucu

SEQ ID NO: 1309213 - RNA, 16 nt, Homo sapiens
cuugggaauaaaucau

SEQ ID NO: 1309214 - RNA, 22 nt, Homo sapiens
cuugggaauaaaucauagcaau

SEQ ID NO: 1309215 - RNA, 17 nt, Homo sapiens
cuugggagccacugcca

SEQ ID NO: 1309216 - RNA, 13 nt, Homo sapiens
cuugggcucccug

SEQ ID NO: 1309217 - RNA, 20 nt, Homo sapiens
cuuggggcaggcagugaugc

SEQ ID NO: 1309218 - RNA, 17 nt, Homo sapiens
cuuggggccacugccug

SEQ ID NO: 1309219 - RNA, 21 nt, Homo sapiens
cuugggugaacuaaccaaaua

SEQ ID NO: 1309220 - RNA, 15 nt, Homo sapiens
cuugguaauuguacu

SEQ ID NO: 1309221 - RNA, 18 nt, Homo sapiens
cuuggucacauacaauua

SEQ ID NO: 1309222 - RNA, 21 nt, Homo sapiens
cuugucaagccugugcaaaaa

SEQ ID NO: 1309223 - RNA, 19 nt, Homo sapiens
guuaaggggagcaacagag

SEQ ID NO: 1309224 - RNA, 16 nt, Homo sapiens
guuaauaccagcuuaa

SEQ ID NO: 1309225 - RNA, 17 nt, Homo sapiens
guuaauguuauaucaua

SEQ ID NO: 1309226 - RNA, 19 nt, Homo sapiens
guuacauaguuaaaugugc

SEQ ID NO: 1309227 - RNA, 12 nt, Homo sapiens
guuacccaugaa

SEQ ID NO: 1309228 - RNA, 20 nt, Homo sapiens
guuaccugucauuuugcacu

SEQ ID NO: 1309229 - RNA, 14 nt, Homo sapiens
guuacuuuggaaca

SEQ ID NO: 1309230 - RNA, 20 nt, Homo sapiens
guuacuuuuucuuguauuca

SEQ ID NO: 1309231 - RNA, 19 nt, Homo sapiens
guuagagcuggcaccagaa

SEQ ID NO: 1309232 - RNA, 14 nt, Homo sapiens
guuagcaguucugg

SEQ ID NO: 1309233 - RNA, 15 nt, Homo sapiens
guuagugauggagcu

SEQ ID NO: 1309234 - RNA, 19 nt, Homo sapiens
guuaucugucccagguuau

SEQ ID NO: 1309235 - RNA, 13 nt, Homo sapiens
guuaugaacaaag

SEQ ID NO: 1309236 - RNA, 13 nt, Homo sapiens
guuauucuugccc

SEQ ID NO: 1309237 - RNA, 17 nt, Homo sapiens
guuauugccucuacuuu

SEQ ID NO: 1309238 - RNA, 18 nt, Homo sapiens
guuauuuaaugagucagu

SEQ ID NO: 1309239 - RNA, 21 nt, Homo sapiens
guuauuuagggaacugcuuga

SEQ ID NO: 1309240 - RNA, 12 nt, Homo sapiens
guucaaagccag

SEQ ID NO: 1309241 - RNA, 16 nt, Homo sapiens
guucaagugcucuuca

SEQ ID NO: 1309242 - RNA, 23 nt, Homo sapiens
guucaauucucauuugucacaca

SEQ ID NO: 1309243 - RNA, 19 nt, Homo sapiens
guucaccuaucccauuuua

SEQ ID NO: 1309244 - RNA, 18 nt, Homo sapiens
guucacucggcacuacuu

SEQ ID NO: 1309245 - RNA, 14 nt, Homo sapiens
guucagcucacugu

SEQ ID NO: 1309246 - RNA, 14 nt, Homo sapiens
guucauacagguga

SEQ ID NO: 1309247 - RNA, 16 nt, Homo sapiens
guucauccgcacugua

SEQ ID NO: 1309248 - RNA, 18 nt, Homo sapiens
guucauccgcacuguaaa

SEQ ID NO: 1309249 - RNA, 15 nt, Homo sapiens
guucauccuauucuu

SEQ ID NO: 1309250 - RNA, 17 nt, Homo sapiens
guucauuuguggugaua

SEQ ID NO: 1309251 - RNA, 17 nt, Homo sapiens
guucauuuugaguauuu

SEQ ID NO: 1309252 - RNA, 19 nt, Homo sapiens
guuccaaugucaaugugaa

SEQ ID NO: 1309253 - RNA, 17 nt, Homo sapiens
guucccuuacuguuuca

SEQ ID NO: 1309254 - RNA, 15 nt, Homo sapiens
guucgagaccagccu

SEQ ID NO: 1309255 - RNA, 19 nt, Homo sapiens
guucgauguuagcguuuac

SEQ ID NO: 1309256 - RNA, 18 nt, Homo sapiens
guucucaucuuucuugau

SEQ ID NO: 1309257 - RNA, 19 nt, Homo sapiens
guucucccaccaccucacc

SEQ ID NO: 1309258 - RNA, 18 nt, Homo sapiens
guucucggggcucaggag

SEQ ID NO: 1309259 - RNA, 15 nt, Homo sapiens
guucucucucucugu

SEQ ID NO: 1309260 - RNA, 15 nt, Homo sapiens
guucugagcaccgug

SEQ ID NO: 1309261 - RNA, 22 nt, Homo sapiens
guucugauauuggacaguaaaa

SEQ ID NO: 1309262 - RNA, 18 nt, Homo sapiens
guucugggacuacaggca

SEQ ID NO: 1309263 - RNA, 18 nt, Homo sapiens
guucuuugucacagggac

SEQ ID NO: 1309264 - RNA, 14 nt, Homo sapiens
guugaaaacccaga

SEQ ID NO: 1309265 - RNA, 14 nt, Homo sapiens
guugaagacuuugu

SEQ ID NO: 1309266 - RNA, 19 nt, Homo sapiens
guugaucuggaacccagac

SEQ ID NO: 1309267 - RNA, 22 nt, Homo sapiens
guugaucuggaacccagacuca

SEQ ID NO: 1309268 - RNA, 18 nt, Homo sapiens
guugcugcuguccagugc

SEQ ID NO: 1309269 - RNA, 14 nt, Homo sapiens
guuggaacauuuca

SEQ ID NO: 1309270 - RNA, 18 nt, Homo sapiens
guuggccuaacacugggc

SEQ ID NO: 1309271 - RNA, 13 nt, Homo sapiens
guuggugacaauu

SEQ ID NO: 1309272 - RNA, 14 nt, Homo sapiens
guuguaaaaagccc

SEQ ID NO: 1309273 - RNA, 22 nt, Homo sapiens
guuguaaaaagcccagcacuug

SEQ ID NO: 1309274 - RNA, 22 nt, Homo sapiens
guuguacuguaugugaugaauu

SEQ ID NO: 1309275 - RNA, 18 nt, Homo sapiens
guuguaggguuacagaga

SEQ ID NO: 1309276 - RNA, 14 nt, Homo sapiens
guuuaucagcaaaa

SEQ ID NO: 1309277 - RNA, 14 nt, Homo sapiens
guuucaaaaccaug

SEQ ID NO: 1309278 - RNA, 16 nt, Homo sapiens
guuucaaguacuguaa

SEQ ID NO: 1309279 - RNA, 21 nt, Homo sapiens
guuucagagauggacagagaa

SEQ ID NO: 1309280 - RNA, 16 nt, Homo sapiens
guuucaguuuccccau

SEQ ID NO: 1309281 - RNA, 12 nt, Homo sapiens
guuuccugguca

SEQ ID NO: 1309282 - RNA, 18 nt, Homo sapiens
guuuccuuccagcccaga

SEQ ID NO: 1309283 - RNA, 19 nt, Homo sapiens
guuuccuucccuacccagu

SEQ ID NO: 1309284 - RNA, 17 nt, Homo sapiens
guuucuaccuauaugca

SEQ ID NO: 1309285 - RNA, 20 nt, Homo sapiens
guuucuuugacuucaaugua

SEQ ID NO: 1309286 - RNA, 14 nt, Homo sapiens
guuugaauguuaaa

SEQ ID NO: 1309287 - RNA, 15 nt, Homo sapiens
guuugagaccagccu

SEQ ID NO: 1309288 - RNA, 15 nt, Homo sapiens
guuuggccuauucca

SEQ ID NO: 1309289 - RNA, 21 nt, Homo sapiens
guuuggccugugcuucugcuu

SEQ ID NO: 1309290 - RNA, 13 nt, Homo sapiens
guuuggcuuucag

SEQ ID NO: 1309291 - RNA, 16 nt, Homo sapiens
guuugggcuucagccu

SEQ ID NO: 1309292 - RNA, 22 nt, Homo sapiens
guuuguaacuuuuuacauuaca

SEQ ID NO: 1309293 - RNA, 22 nt, Homo sapiens
guuuguggggcacagaugccug

SEQ ID NO: 1309294 - RNA, 14 nt, Homo sapiens
guuuuaaauugaua

SEQ ID NO: 1309295 - RNA, 22 nt, Homo sapiens
guuuuaagaggcagggucucac

SEQ ID NO: 1309296 - RNA, 19 nt, Homo sapiens
guuuuaauuuucuuguaua

SEQ ID NO: 1309297 - RNA, 14 nt, Homo sapiens
guuuuacugcagcu

SEQ ID NO: 1309298 - RNA, 19 nt, Homo sapiens
guuuucaagucaaauuaau

SEQ ID NO: 1309299 - RNA, 16 nt, Homo sapiens
guuuucaccauucaaa

SEQ ID NO: 1309300 - RNA, 22 nt, Homo sapiens
guuuucaguagaagaacuuaaa

SEQ ID NO: 1309301 - RNA, 19 nt, Homo sapiens
guuuucaucaagacuggaa

SEQ ID NO: 1309302 - RNA, 15 nt, Homo sapiens
guuuucugacacagu

SEQ ID NO: 1309303 - RNA, 15 nt, Homo sapiens
guuuucuucugugau

SEQ ID NO: 1309304 - RNA, 16 nt, Homo sapiens
guuuucuucugugauu

SEQ ID NO: 1309305 - RNA, 20 nt, Homo sapiens
guuuugagcauggguucauc

SEQ ID NO: 1309306 - RNA, 23 nt, Homo sapiens
guuuuguugagcaugacagccug

SEQ ID NO: 1309307 - RNA, 23 nt, Homo sapiens
guuuuguuuuuuuucagccacua

SEQ ID NO: 1309308 - RNA, 19 nt, Homo sapiens
guuuuuaaaaaacugcuga

SEQ ID NO: 1309309 - RNA, 16 nt, Homo sapiens
guuuuuaaaacccagu

SEQ ID NO: 1309310 - RNA, 23 nt, Homo sapiens
guuuuuaaagaaaagcauucaag

SEQ ID NO: 1309311 - RNA, 20 nt, Homo sapiens
guuuuuaauuuaucagagac

SEQ ID NO: 1309312 - RNA, 13 nt, Homo sapiens
guuuuuacuguga

SEQ ID NO: 1309313 - RNA, 20 nt, Homo sapiens
guuuuuauauuaauguacuu

SEQ ID NO: 1309314 - RNA, 18 nt, Homo sapiens
guuuuuaugcauguuugu

SEQ ID NO: 1309315 - RNA, 17 nt, Homo sapiens
guuuuuggaguguuaug

SEQ ID NO: 1309316 - RNA, 23 nt, Homo sapiens
guuuuuuuuuuuuuuaacaugua

SEQ ID NO: 1309317 - RNA, 22 nt, Homo sapiens
uaaaaaaaaaauucuugcauau

SEQ ID NO: 1309318 - RNA, 13 nt, Homo sapiens
uaaaaaagcauac

SEQ ID NO: 1309319 - RNA, 23 nt, Homo sapiens
uaaaaaauacacauagcagagua

SEQ ID NO: 1309320 - RNA, 19 nt, Homo sapiens
uaaaaaucaaauaagcuaa

SEQ ID NO: 1309321 - RNA, 16 nt, Homo sapiens
uaaaaaugagugcuua

SEQ ID NO: 1309322 - RNA, 17 nt, Homo sapiens
uaaaaaugagugcuuaa

SEQ ID NO: 1309323 - RNA, 19 nt, Homo sapiens
uaaaaauguagcagcuucu

SEQ ID NO: 1309324 - RNA, 14 nt, Homo sapiens
uaaaaauugucauu

SEQ ID NO: 1309325 - RNA, 16 nt, Homo sapiens
uaaaacaaaauuugac

SEQ ID NO: 1309326 - RNA, 24 nt, Homo sapiens
uaaaacaaagggcacagcaucugu

SEQ ID NO: 1309327 - RNA, 14 nt, Homo sapiens
uaaaacagaagccu

SEQ ID NO: 1309328 - RNA, 21 nt, Homo sapiens
uaaaacauaagaucacugcca

SEQ ID NO: 1309329 - RNA, 17 nt, Homo sapiens
uaaaacaugcuggugaa

SEQ ID NO: 1309330 - RNA, 20 nt, Homo sapiens
uaaaacuucuuuaguacuua

SEQ ID NO: 1309331 - RNA, 13 nt, Homo sapiens
uaaaagacaguga

SEQ ID NO: 1309332 - RNA, 18 nt, Homo sapiens
uaaaaggaaauguaaaag

SEQ ID NO: 1309333 - RNA, 16 nt, Homo sapiens
uaaaauaaacuguaaa

SEQ ID NO: 1309334 - RNA, 18 nt, Homo sapiens
uaaaauagagugcauuug

SEQ ID NO: 1309335 - RNA, 15 nt, Homo sapiens
uaaaauauuauugaa

SEQ ID NO: 1309336 - RNA, 14 nt, Homo sapiens
uaaaaugagcauug

SEQ ID NO: 1309337 - RNA, 15 nt, Homo sapiens
uaaaauuaugccaua

SEQ ID NO: 1309338 - RNA, 14 nt, Homo sapiens
uaaacacgccugca

SEQ ID NO: 1309339 - RNA, 18 nt, Homo sapiens
uaaacagccucuuuuuga

SEQ ID NO: 1309340 - RNA, 12 nt, Homo sapiens
uaaaccaaaaac

SEQ ID NO: 1309341 - RNA, 14 nt, Homo sapiens
uaaaccaaggacug

SEQ ID NO: 1309342 - RNA, 16 nt, Homo sapiens
uaaaccugauuuacua

SEQ ID NO: 1309343 - RNA, 17 nt, Homo sapiens
uaaaccuuccauaaaaa

SEQ ID NO: 1309344 - RNA, 16 nt, Homo sapiens
uaaacgcugucccuag

SEQ ID NO: 1309345 - RNA, 18 nt, Homo sapiens
uaaacucagcugaucuga

SEQ ID NO: 1309346 - RNA, 23 nt, Homo sapiens
uaaacuggaauccuuucacccgc

SEQ ID NO: 1309347 - RNA, 22 nt, Homo sapiens
uaaacuuggauucucuaaccuu

SEQ ID NO: 1309348 - RNA, 16 nt, Homo sapiens
uaaacuuuauugcuca

SEQ ID NO: 1309349 - RNA, 23 nt, Homo sapiens
uaaacuuuccucuuccugccuag

SEQ ID NO: 1309350 - RNA, 17 nt, Homo sapiens
uaaagaaaagacgaaua

SEQ ID NO: 1309351 - RNA, 14 nt, Homo sapiens
uaaagaauacuuga

SEQ ID NO: 1309352 - RNA, 18 nt, Homo sapiens
uaaagaauacuugaacuu

SEQ ID NO: 1309353 - RNA, 13 nt, Homo sapiens
uaaagaauccaua

SEQ ID NO: 1309354 - RNA, 19 nt, Homo sapiens
uaaagacaaaaaaaucacg

SEQ ID NO: 1309355 - RNA, 19 nt, Homo sapiens
ucaaauuuagaaacuaauu

SEQ ID NO: 1309356 - RNA, 17 nt, Homo sapiens
ucaaauuuguaaaguua

SEQ ID NO: 1309357 - RNA, 21 nt, Homo sapiens
ucaaauuuguaaaguuagccu

SEQ ID NO: 1309358 - RNA, 19 nt, Homo sapiens
ucaacaacaccagaacugu

SEQ ID NO: 1309359 - RNA, 22 nt, Homo sapiens
ucaaccauaaaagaaguuucag

SEQ ID NO: 1309360 - RNA, 18 nt, Homo sapiens
ucaaccuaagcaacagaa

SEQ ID NO: 1309361 - RNA, 23 nt, Homo sapiens
ucaacuggagacacuauuuaucu

SEQ ID NO: 1309362 - RNA, 22 nt, Homo sapiens
ucaagagagcuuaacagauaaa

SEQ ID NO: 1309363 - RNA, 16 nt, Homo sapiens
ucaagagcuccuugac

SEQ ID NO: 1309364 - RNA, 23 nt, Homo sapiens
ucaagcagacauagaagagccaa

SEQ ID NO: 1309365 - RNA, 13 nt, Homo sapiens
ucaagccauucca

SEQ ID NO: 1309366 - RNA, 16 nt, Homo sapiens
ucaagccuuccaggga

SEQ ID NO: 1309367 - RNA, 15 nt, Homo sapiens
ucaagcuccccucac

SEQ ID NO: 1309368 - RNA, 18 nt, Homo sapiens
ucaagcugcucugagcca

SEQ ID NO: 1309369 - RNA, 19 nt, Homo sapiens
ucaagcuguugaagucuca

SEQ ID NO: 1309370 - RNA, 18 nt, Homo sapiens
ucaaggaaugaagaacaa

SEQ ID NO: 1309371 - RNA, 16 nt, Homo sapiens
ucaaggcugcagugag

SEQ ID NO: 1309372 - RNA, 19 nt, Homo sapiens
ucaaguacuguaacugugu

SEQ ID NO: 1309373 - RNA, 23 nt, Homo sapiens
ucaaguacuguaacugugucaug

SEQ ID NO: 1309374 - RNA, 20 nt, Homo sapiens
ucaagucaucuauaguugau

SEQ ID NO: 1309375 - RNA, 18 nt, Homo sapiens
ucaaguuuucagcuuuaa

SEQ ID NO: 1309376 - RNA, 18 nt, Homo sapiens
ucaauaaagcacugagca

SEQ ID NO: 1309377 - RNA, 15 nt, Homo sapiens
ucaauaguguugcuu

SEQ ID NO: 1309378 - RNA, 17 nt, Homo sapiens
ucaaucaacacuaccag

SEQ ID NO: 1309379 - RNA, 15 nt, Homo sapiens
ucaaucucaauccug

SEQ ID NO: 1309380 - RNA, 21 nt, Homo sapiens
ucaaugacuuaacagaacuca

SEQ ID NO: 1309381 - RNA, 19 nt, Homo sapiens
ucaauuacuugaaguugcu

SEQ ID NO: 1309382 - RNA, 19 nt, Homo sapiens
ucacaaccugaaccuagga

SEQ ID NO: 1309383 - RNA, 22 nt, Homo sapiens
ucacaagaaaacuauaagccaa

SEQ ID NO: 1309384 - RNA, 19 nt, Homo sapiens
ucacaagcaugaagugcug

SEQ ID NO: 1309385 - RNA, 20 nt, Homo sapiens
ucacaagcaugaagugcugu

SEQ ID NO: 1309386 - RNA, 22 nt, Homo sapiens
ucacaaucaucaucauucucau

SEQ ID NO: 1309387 - RNA, 16 nt, Homo sapiens
ucacaauuccauuucc

SEQ ID NO: 1309388 - RNA, 23 nt, Homo sapiens
ucacaccaggcuugccugcaggc

SEQ ID NO: 1309389 - RNA, 13 nt, Homo sapiens
ucacaccuguaau

SEQ ID NO: 1309390 - RNA, 17 nt, Homo sapiens
ucacacgauaaagggau

SEQ ID NO: 1309391 - RNA, 19 nt, Homo sapiens
ucacacgggggcagcugau

SEQ ID NO: 1309392 - RNA, 20 nt, Homo sapiens
ucacacuuuaaaaaauacac

SEQ ID NO: 1309393 - RNA, 13 nt, Homo sapiens
ucacagaauguga

SEQ ID NO: 1309394 - RNA, 12 nt, Homo sapiens
ucacagacauac

SEQ ID NO: 1309395 - RNA, 17 nt, Homo sapiens
ucacaguugauacauag

SEQ ID NO: 1309396 - RNA, 15 nt, Homo sapiens
ucacauagugaaaua

SEQ ID NO: 1309397 - RNA, 20 nt, Homo sapiens
ucacaugggcagaaaaaugg

SEQ ID NO: 1309398 - RNA, 17 nt, Homo sapiens
ucacaugucaguaccuu

SEQ ID NO: 1309399 - RNA, 18 nt, Homo sapiens
ucacauuaauauuugcug

SEQ ID NO: 1309400 - RNA, 15 nt, Homo sapiens
ucaccacaaacugua

SEQ ID NO: 1309401 - RNA, 13 nt, Homo sapiens
ucaccagcugcaa

SEQ ID NO: 1309402 - RNA, 23 nt, Homo sapiens
ucaccauuuggcaaugccaucau

SEQ ID NO: 1309403 - RNA, 19 nt, Homo sapiens
ucacccagacuggagugca

SEQ ID NO: 1309404 - RNA, 14 nt, Homo sapiens
ucacccaggaggau

SEQ ID NO: 1309405 - RNA, 17 nt, Homo sapiens
ucacccccaaacaguga

SEQ ID NO: 1309406 - RNA, 21 nt, Homo sapiens
ucacccucuguaccccaugac

SEQ ID NO: 1309407 - RNA, 14 nt, Homo sapiens
ucaccuacuccaga

SEQ ID NO: 1309408 - RNA, 15 nt, Homo sapiens
ucaccucuuccacuc

SEQ ID NO: 1309409 - RNA, 15 nt, Homo sapiens
ucaccugggcuguga

SEQ ID NO: 1309410 - RNA, 14 nt, Homo sapiens
ucaccuuccagugu

SEQ ID NO: 1309411 - RNA, 19 nt, Homo sapiens
ucaccuuggcaccagacac

SEQ ID NO: 1309412 - RNA, 23 nt, Homo sapiens
ucacgacgaaaagacaagacucu

SEQ ID NO: 1309413 - RNA, 21 nt, Homo sapiens
ucacgauugucaucaggagaa

SEQ ID NO: 1309414 - RNA, 15 nt, Homo sapiens
ucacgguacagaggc

SEQ ID NO: 1309415 - RNA, 17 nt, Homo sapiens
ucacuaaaguauccuga

SEQ ID NO: 1309416 - RNA, 15 nt, Homo sapiens
ucacuccagcagcac

SEQ ID NO: 1309417 - RNA, 16 nt, Homo sapiens
ucacucccaccugcau

SEQ ID NO: 1309418 - RNA, 17 nt, Homo sapiens
ucacucugaguguuuua

SEQ ID NO: 1309419 - RNA, 17 nt, Homo sapiens
ucacucuuauugcccac

SEQ ID NO: 1309420 - RNA, 18 nt, Homo sapiens
ucacucuucaaaugccug

SEQ ID NO: 1309421 - RNA, 19 nt, Homo sapiens
ucacucuucaaaugccuga

SEQ ID NO: 1309422 - RNA, 13 nt, Homo sapiens
ucacugcugucaa

SEQ ID NO: 1309423 - RNA, 14 nt, Homo sapiens
ucacuugagaccag

SEQ ID NO: 1309424 - RNA, 23 nt, Homo sapiens
ucagaaaccaaagcuuuauuuca

SEQ ID NO: 1309425 - RNA, 23 nt, Homo sapiens
ucagaaauuuaauucauguuucu

SEQ ID NO: 1309426 - RNA, 12 nt, Homo sapiens
ucagaacagaca

SEQ ID NO: 1309427 - RNA, 19 nt, Homo sapiens
ucagaagggagcuagccag

SEQ ID NO: 1309428 - RNA, 21 nt, Homo sapiens
ucagaagggagcuagccagag

SEQ ID NO: 1309429 - RNA, 22 nt, Homo sapiens
ucagacaaaauggauacauaaa

SEQ ID NO: 1309430 - RNA, 14 nt, Homo sapiens
ucagacaccugugu

SEQ ID NO: 1309431 - RNA, 16 nt, Homo sapiens
ucagacuccugugcaa

SEQ ID NO: 1309432 - RNA, 20 nt, Homo sapiens
ucagagaaccuguugaaaug

SEQ ID NO: 1309433 - RNA, 20 nt, Homo sapiens
ucagagacuauguagcaaua

SEQ ID NO: 1309434 - RNA, 18 nt, Homo sapiens
ucagagauggacagagaa

SEQ ID NO: 1309435 - RNA, 12 nt, Homo sapiens
ucagagcuaaac

SEQ ID NO: 1309436 - RNA, 23 nt, Homo sapiens
ucagaguuugaaauaaaacuugg

SEQ ID NO: 1309437 - RNA, 12 nt, Homo sapiens
ucagauaaggua

SEQ ID NO: 1309438 - RNA, 15 nt, Homo sapiens
ucagauauucugcuc

SEQ ID NO: 1309439 - RNA, 21 nt, Homo sapiens
ucagaucuggggcagcacccu

SEQ ID NO: 1309440 - RNA, 19 nt, Homo sapiens
ucagauggaaccgcaggaa

SEQ ID NO: 1309441 - RNA, 12 nt, Homo sapiens
ucagaugggcag

SEQ ID NO: 1309442 - RNA, 16 nt, Homo sapiens
ucagaugggcagcagc

SEQ ID NO: 1309443 - RNA, 18 nt, Homo sapiens
ucagauuccgcaccaaua

SEQ ID NO: 1309444 - RNA, 11 nt, Homo sapiens
ucagcaaaaaa

SEQ ID NO: 1309445 - RNA, 20 nt, Homo sapiens
ucagcaaaaagcaaaaucau

SEQ ID NO: 1309446 - RNA, 19 nt, Homo sapiens
ucagcaaaagaugcuucuc

SEQ ID NO: 1309447 - RNA, 15 nt, Homo sapiens
ucagcauuugaucug

SEQ ID NO: 1309448 - RNA, 21 nt, Homo sapiens
ucagccccugauccugugaag

SEQ ID NO: 1309449 - RNA, 17 nt, Homo sapiens
ucagcccugacccugug

SEQ ID NO: 1309450 - RNA, 22 nt, Homo sapiens
ucagccuggccagacacaggcc

SEQ ID NO: 1309451 - RNA, 14 nt, Homo sapiens
ucagccuuaggaag

SEQ ID NO: 1309452 - RNA, 14 nt, Homo sapiens
ucagcuaaacacca

SEQ ID NO: 1309453 - RNA, 23 nt, Homo sapiens
ucagcucuuggcuccacugggau

SEQ ID NO: 1309454 - RNA, 16 nt, Homo sapiens
ucagcugcucugcaag

SEQ ID NO: 1309455 - RNA, 20 nt, Homo sapiens
ucaggaaaacuguuccaauc

SEQ ID NO: 1309456 - RNA, 18 nt, Homo sapiens
ucaggaaauauaucuuaa

SEQ ID NO: 1309457 - RNA, 20 nt, Homo sapiens
ucaggaaccucgaguacugu

SEQ ID NO: 1309458 - RNA, 22 nt, Homo sapiens
ucaggaaccucgaguacugugg

SEQ ID NO: 1309459 - RNA, 16 nt, Homo sapiens
ucaggacagaugccac

SEQ ID NO: 1309460 - RNA, 18 nt, Homo sapiens
ucaggacagaugccacac

SEQ ID NO: 1309461 - RNA, 18 nt, Homo sapiens
ucaggaguucgagaccag

SEQ ID NO: 1309462 - RNA, 13 nt, Homo sapiens
ucaggcacacagc

SEQ ID NO: 1309463 - RNA, 14 nt, Homo sapiens
ucaggcacacagcu

SEQ ID NO: 1309464 - RNA, 13 nt, Homo sapiens
ucaggcagggugc

SEQ ID NO: 1309465 - RNA, 20 nt, Homo sapiens
ucaggccaucaucaguggag

SEQ ID NO: 1309466 - RNA, 14 nt, Homo sapiens
ucagggaacucugg

SEQ ID NO: 1309467 - RNA, 19 nt, Homo sapiens
ucagggaccccugcccuug

SEQ ID NO: 1309468 - RNA, 14 nt, Homo sapiens
ucagggagacaaga

SEQ ID NO: 1309469 - RNA, 18 nt, Homo sapiens
ucagggcauugccuguga

SEQ ID NO: 1309470 - RNA, 19 nt, Homo sapiens
ucagggcauugccugugac

SEQ ID NO: 1309471 - RNA, 21 nt, Homo sapiens
ucaggguccagacccugaaga

SEQ ID NO: 1309472 - RNA, 23 nt, Homo sapiens
ucagggugggguggucucugaua

SEQ ID NO: 1309473 - RNA, 20 nt, Homo sapiens
ucaguaagacgacaaggaaa

SEQ ID NO: 1309474 - RNA, 19 nt, Homo sapiens
ucaguaauaaaaccgguca

SEQ ID NO: 1309475 - RNA, 22 nt, Homo sapiens
ucaguccauugcucuugagucu

SEQ ID NO: 1309476 - RNA, 15 nt, Homo sapiens
ucagucgcccggggc

SEQ ID NO: 1309477 - RNA, 19 nt, Homo sapiens
ucagucucugagcagugaa

SEQ ID NO: 1309478 - RNA, 18 nt, Homo sapiens
ucagucucuguguaauca

SEQ ID NO: 1309479 - RNA, 21 nt, Homo sapiens
ucagugcucccucacauguca

SEQ ID NO: 1309480 - RNA, 14 nt, Homo sapiens
ucagugcuccugua

SEQ ID NO: 1309481 - RNA, 19 nt, Homo sapiens
ucagugguggucuucaaga

SEQ ID NO: 1309482 - RNA, 14 nt, Homo sapiens
ucaguguauuugua

SEQ ID NO: 1309483 - RNA, 10 nt, Homo sapiens
ucagugucca

SEQ ID NO: 1309484 - RNA, 16 nt, Homo sapiens
ucaguuaaguguuucc

SEQ ID NO: 1309485 - RNA, 17 nt, Homo sapiens
ucaguuaauucuuagau

SEQ ID NO: 1309486 - RNA, 16 nt, Homo sapiens
ucaguugccauugaca

SEQ ID NO: 1309487 - RNA, 19 nt, Homo sapiens
ucuuccuugaccugcauug

SEQ ID NO: 1309488 - RNA, 14 nt, Homo sapiens
ucuucuaaacuucc

SEQ ID NO: 1309489 - RNA, 15 nt, Homo sapiens
ucuucuaaauggcaa

SEQ ID NO: 1309490 - RNA, 14 nt, Homo sapiens
ucuucuaagcaaaa

SEQ ID NO: 1309491 - RNA, 15 nt, Homo sapiens
ucuucuaccagaccc

SEQ ID NO: 1309492 - RNA, 14 nt, Homo sapiens
ucuucuacugcuau

SEQ ID NO: 1309493 - RNA, 19 nt, Homo sapiens
ucuucuccuggaguugcau

SEQ ID NO: 1309494 - RNA, 16 nt, Homo sapiens
ucuucugagcacagau

SEQ ID NO: 1309495 - RNA, 19 nt, Homo sapiens
ucuucuggacugguuuuca

SEQ ID NO: 1309496 - RNA, 23 nt, Homo sapiens
ucuucuggagauggaagcuuguu

SEQ ID NO: 1309497 - RNA, 14 nt, Homo sapiens
ucuucuuucccaaa

SEQ ID NO: 1309498 - RNA, 20 nt, Homo sapiens
ucuugaaagaauaacagaaa

SEQ ID NO: 1309499 - RNA, 14 nt, Homo sapiens
ucuugaauacucug

SEQ ID NO: 1309500 - RNA, 22 nt, Homo sapiens
ucuugaauuuuuuucugcacag

SEQ ID NO: 1309501 - RNA, 16 nt, Homo sapiens
ucuugaggcauuucca

SEQ ID NO: 1309502 - RNA, 17 nt, Homo sapiens
ucuugcaacucuguaaa

SEQ ID NO: 1309503 - RNA, 18 nt, Homo sapiens
ucuugcaacucuguaaau

SEQ ID NO: 1309504 - RNA, 14 nt, Homo sapiens
ucuugcauccaaac

SEQ ID NO: 1309505 - RNA, 17 nt, Homo sapiens
ucuuggccuaaaccuca

SEQ ID NO: 1309506 - RNA, 22 nt, Homo sapiens
ucuugguugaggaaacaaacau

SEQ ID NO: 1309507 - RNA, 20 nt, Homo sapiens
ucuuguucauaagauuauga

SEQ ID NO: 1309508 - RNA, 23 nt, Homo sapiens
ucuuguuucaucguaaacauacu

SEQ ID NO: 1309509 - RNA, 20 nt, Homo sapiens
ucuuuacaaaaaaauacaaa

SEQ ID NO: 1309510 - RNA, 20 nt, Homo sapiens
ucuuuauauuuuuagccuaa

SEQ ID NO: 1309511 - RNA, 19 nt, Homo sapiens
ucuuucauaaaaacacuca

SEQ ID NO: 1309512 - RNA, 22 nt, Homo sapiens
ucuuucucccccaccucuugcg

SEQ ID NO: 1309513 - RNA, 17 nt, Homo sapiens
ucuuucugagugccuuc

SEQ ID NO: 1309514 - RNA, 12 nt, Homo sapiens
ucuuucuguccc

SEQ ID NO: 1309515 - RNA, 19 nt, Homo sapiens
ucuuucuuacacaagagcu

SEQ ID NO: 1309516 - RNA, 22 nt, Homo sapiens
ucuuucuuacacaagagcugga

SEQ ID NO: 1309517 - RNA, 21 nt, Homo sapiens
ucuuugagauaauacauuccg

SEQ ID NO: 1309518 - RNA, 14 nt, Homo sapiens
ucuuugcaaaguau

SEQ ID NO: 1309519 - RNA, 21 nt, Homo sapiens
ucuuugcugcagaacugaaga

SEQ ID NO: 1309520 - RNA, 15 nt, Homo sapiens
ucuuuggcgaccucc

SEQ ID NO: 1309521 - RNA, 22 nt, Homo sapiens
ucuuugggccagacaugccaca

SEQ ID NO: 1309522 - RNA, 14 nt, Homo sapiens
ucuuugguggcaug

SEQ ID NO: 1309523 - RNA, 14 nt, Homo sapiens
ucuuuucagaaaga

SEQ ID NO: 1309524 - RNA, 16 nt, Homo sapiens
ucuuuugaacccagga

SEQ ID NO: 1309525 - RNA, 19 nt, Homo sapiens
ucuuuuggggaagcuuucu

SEQ ID NO: 1309526 - RNA, 19 nt, Homo sapiens
ugaaaaaguuaaugcuuaa

SEQ ID NO: 1309527 - RNA, 17 nt, Homo sapiens
ugaaaacacugugcaca

SEQ ID NO: 1309528 - RNA, 16 nt, Homo sapiens
ugaaaacccagacugu

SEQ ID NO: 1309529 - RNA, 16 nt, Homo sapiens
ugaaaagcuccaucaa

SEQ ID NO: 1309530 - RNA, 12 nt, Homo sapiens
ugaaaagucaaa

SEQ ID NO: 1309531 - RNA, 18 nt, Homo sapiens
ugaaacagaauacuguua

SEQ ID NO: 1309532 - RNA, 13 nt, Homo sapiens
ugaaacagcugcc

SEQ ID NO: 1309533 - RNA, 13 nt, Homo sapiens
ugaaacauuugca

SEQ ID NO: 1309534 - RNA, 20 nt, Homo sapiens
ugaaacccagucacugugag

SEQ ID NO: 1309535 - RNA, 13 nt, Homo sapiens
ugaaacugcauaa

SEQ ID NO: 1309536 - RNA, 16 nt, Homo sapiens
ugaaacuuaccauuca

SEQ ID NO: 1309537 - RNA, 16 nt, Homo sapiens
ugaaagcaaguguuca

SEQ ID NO: 1309538 - RNA, 16 nt, Homo sapiens
ugaaaguggacaagga

SEQ ID NO: 1309539 - RNA, 22 nt, Homo sapiens
ugaaaucaagucaucuauaguu

SEQ ID NO: 1309540 - RNA, 19 nt, Homo sapiens
ugaaaugaagcaacagaga

SEQ ID NO: 1309541 - RNA, 21 nt, Homo sapiens
ugaaaugcagagucaaugaac

SEQ ID NO: 1309542 - RNA, 16 nt, Homo sapiens
ugaaaugcuggcauuu

SEQ ID NO: 1309543 - RNA, 18 nt, Homo sapiens
ugaaaugcuggcauuugc

SEQ ID NO: 1309544 - RNA, 19 nt, Homo sapiens
ugaaauggguuuagggaag

SEQ ID NO: 1309545 - RNA, 17 nt, Homo sapiens
ugaaaugugguuuuccu

SEQ ID NO: 1309546 - RNA, 21 nt, Homo sapiens
ugaaauucugaauuugcaaag

SEQ ID NO: 1309547 - RNA, 13 nt, Homo sapiens
ugaaauugauguu

SEQ ID NO: 1309548 - RNA, 18 nt, Homo sapiens
ugaaauuucuuguucaua

SEQ ID NO: 1309549 - RNA, 17 nt, Homo sapiens
ugaacaaagcagccacg

SEQ ID NO: 1309550 - RNA, 21 nt, Homo sapiens
ugaacaaagugaggagaauga

SEQ ID NO: 1309551 - RNA, 11 nt, Homo sapiens
ugaacagaauu

SEQ ID NO: 1309552 - RNA, 17 nt, Homo sapiens
ugaacagcuugcugcua

SEQ ID NO: 1309553 - RNA, 13 nt, Homo sapiens
ugaaccacaucuu

SEQ ID NO: 1309554 - RNA, 16 nt, Homo sapiens
ugaaccauuaaccaga

SEQ ID NO: 1309555 - RNA, 13 nt, Homo sapiens
ugaaccuguauaa

SEQ ID NO: 1309556 - RNA, 21 nt, Homo sapiens
ugaacuccuggccucaaguga

SEQ ID NO: 1309557 - RNA, 23 nt, Homo sapiens
ugaacucugggcucaagcaaucc

SEQ ID NO: 1309558 - RNA, 21 nt, Homo sapiens
ugaacucugguggcacaggag

SEQ ID NO: 1309559 - RNA, 15 nt, Homo sapiens
ugaacuugugagaac

SEQ ID NO: 1309560 - RNA, 23 nt, Homo sapiens
ugaagaagagacucuuugcauau

SEQ ID NO: 1309561 - RNA, 20 nt, Homo sapiens
ugaagaauauaccauuucaa

SEQ ID NO: 1309562 - RNA, 14 nt, Homo sapiens
ugaagacuacauga

SEQ ID NO: 1309563 - RNA, 20 nt, Homo sapiens
ugaagacuuuuaaguuuccu

SEQ ID NO: 1309564 - RNA, 18 nt, Homo sapiens
ugaagagcgauugugagg

SEQ ID NO: 1309565 - RNA, 14 nt, Homo sapiens
ugaagauuauuuca

SEQ ID NO: 1309566 - RNA, 15 nt, Homo sapiens
ugaagcagguuccca

SEQ ID NO: 1309567 - RNA, 14 nt, Homo sapiens
ugaagccaauucag

SEQ ID NO: 1309568 - RNA, 15 nt, Homo sapiens
ugaagcuuccuuggc

SEQ ID NO: 1309569 - RNA, 15 nt, Homo sapiens
ugaaggcccugcuga

SEQ ID NO: 1309570 - RNA, 14 nt, Homo sapiens
ugaaggcuguccuu

SEQ ID NO: 1309571 - RNA, 19 nt, Homo sapiens
ugaagggaguggcucugua

SEQ ID NO: 1309572 - RNA, 24 nt, Homo sapiens
ugaaggggaaccccggggugccca

SEQ ID NO: 1309573 - RNA, 16 nt, Homo sapiens
ugaagucacacaguga

SEQ ID NO: 1309574 - RNA, 13 nt, Homo sapiens
ugaagucucagga

SEQ ID NO: 1309575 - RNA, 13 nt, Homo sapiens
ugaauaauacagu

SEQ ID NO: 1309576 - RNA, 20 nt, Homo sapiens
ugaauacuuacauucucuaa

SEQ ID NO: 1309577 - RNA, 20 nt, Homo sapiens
ugaaugaacacucuuuugcu

SEQ ID NO: 1309578 - RNA, 15 nt, Homo sapiens
ugaauguaaaaugca

SEQ ID NO: 1309579 - RNA, 16 nt, Homo sapiens
ugaauucuaaaccaau

SEQ ID NO: 1309580 - RNA, 18 nt, Homo sapiens
ugaauuucacaagcuauu

SEQ ID NO: 1309581 - RNA, 19 nt, Homo sapiens
ugaauuugcaaaguacugu

SEQ ID NO: 1309582 - RNA, 15 nt, Homo sapiens
ugaauuuuugcaaua

SEQ ID NO: 1309583 - RNA, 22 nt, Homo sapiens
ugaauuuuuuucugcacagcuu

SEQ ID NO: 1309584 - RNA, 19 nt, Homo sapiens
ugaauuuuuuuuaaugcuu

SEQ ID NO: 1309585 - RNA, 12 nt, Homo sapiens
ugacaaccucuu

SEQ ID NO: 1309586 - RNA, 15 nt, Homo sapiens
ugacaauaauuucag

SEQ ID NO: 1309587 - RNA, 13 nt, Homo sapiens
ugacacagucaau

SEQ ID NO: 1309588 - RNA, 18 nt, Homo sapiens
ugacaccggggggcuccc

SEQ ID NO: 1309589 - RNA, 15 nt, Homo sapiens
ugacacgucucgcca

SEQ ID NO: 1309590 - RNA, 16 nt, Homo sapiens
ugacacgucucgccaa

SEQ ID NO: 1309591 - RNA, 19 nt, Homo sapiens
ugacacuagcuaauaucaa

SEQ ID NO: 1309592 - RNA, 20 nt, Homo sapiens
ugacacucccuugggcuccc

SEQ ID NO: 1309593 - RNA, 19 nt, Homo sapiens
ugacacugguauuccugcc

SEQ ID NO: 1309594 - RNA, 19 nt, Homo sapiens
ugacacuuccauuguuuaa

SEQ ID NO: 1309595 - RNA, 16 nt, Homo sapiens
ugacagagacccagau

SEQ ID NO: 1309596 - RNA, 12 nt, Homo sapiens
ugacagccuccc

SEQ ID NO: 1309597 - RNA, 15 nt, Homo sapiens
ugacagcucuucaca

SEQ ID NO: 1309598 - RNA, 22 nt, Homo sapiens
ugacagcugaccuuugucaucu

SEQ ID NO: 1309599 - RNA, 20 nt, Homo sapiens
ugacauaauuuacaugcaau

SEQ ID NO: 1309600 - RNA, 20 nt, Homo sapiens
ugacauucaggcaaugucua

SEQ ID NO: 1309601 - RNA, 15 nt, Homo sapiens
ugacauugccaaaaa

SEQ ID NO: 1309602 - RNA, 17 nt, Homo sapiens
ugacauugcguuugacc

SEQ ID NO: 1309603 - RNA, 14 nt, Homo sapiens
ugacauuguuggcc

SEQ ID NO: 1309604 - RNA, 14 nt, Homo sapiens
ugacauuuaaacuc

SEQ ID NO: 1309605 - RNA, 17 nt, Homo sapiens
ugacauuuaaacucagc

SEQ ID NO: 1309606 - RNA, 17 nt, Homo sapiens
ugaccaaagagcccuca

SEQ ID NO: 1309607 - RNA, 15 nt, Homo sapiens
ugaccaagcaggaag

SEQ ID NO: 1309608 - RNA, 16 nt, Homo sapiens
ugaccauaaccacuga

SEQ ID NO: 1309609 - RNA, 14 nt, Homo sapiens
ugacccccagcucc

SEQ ID NO: 1309610 - RNA, 18 nt, Homo sapiens
ugacccuguaaaauggag

SEQ ID NO: 1309611 - RNA, 18 nt, Homo sapiens
ugaccucgggaauggcaa

SEQ ID NO: 1309612 - RNA, 22 nt, Homo sapiens
ugaccuggaaucagugaagcca

SEQ ID NO: 1309613 - RNA, 16 nt, Homo sapiens
ugaccuucagagccag

SEQ ID NO: 1309614 - RNA, 22 nt, Homo sapiens
ugacguuggccuaacacugggc

SEQ ID NO: 1309615 - RNA, 18 nt, Homo sapiens
ugacuaaagcagggacaa

SEQ ID NO: 1309616 - RNA, 13 nt, Homo sapiens
ugacuauccaucc

SEQ ID NO: 1309617 - RNA, 22 nt, Homo sapiens
ugacuaugggagucaacucaac

SEQ ID NO: 1309618 - RNA, 15 nt, Homo sapiens
ugacucaguauaggu

SEQ ID NO: 1309619 - RNA, 21 nt, Homo sapiens
ugacuccuaagggacugugag

SEQ ID NO: 1309620 - RNA, 15 nt, Homo sapiens
uguaaacaaaccaca

SEQ ID NO: 1309621 - RNA, 17 nt, Homo sapiens
uguaaacaaaccacagc

SEQ ID NO: 1309622 - RNA, 18 nt, Homo sapiens
uguaaacaaaccacagca

SEQ ID NO: 1309623 - RNA, 18 nt, Homo sapiens
uguaaaccaaguucaaag

SEQ ID NO: 1309624 - RNA, 21 nt, Homo sapiens
uguaaauaguuacuccagugc

SEQ ID NO: 1309625 - RNA, 14 nt, Homo sapiens
uguaaauaugaauc

SEQ ID NO: 1309626 - RNA, 17 nt, Homo sapiens
uguaaaucacauccuua

SEQ ID NO: 1309627 - RNA, 17 nt, Homo sapiens
uguaacacugcaagaag

SEQ ID NO: 1309628 - RNA, 18 nt, Homo sapiens
uguaacaggaacaaagua

SEQ ID NO: 1309629 - RNA, 14 nt, Homo sapiens
uguaauaacauuua

SEQ ID NO: 1309630 - RNA, 19 nt, Homo sapiens
uguaaucccagcacuuugg

SEQ ID NO: 1309631 - RNA, 17 nt, Homo sapiens
uguaaucccagcuacuc

SEQ ID NO: 1309632 - RNA, 20 nt, Homo sapiens
uguaaucccagcuacucgag

SEQ ID NO: 1309633 - RNA, 18 nt, Homo sapiens
uguacaaauauaagaaua

SEQ ID NO: 1309634 - RNA, 21 nt, Homo sapiens
uguacaauaaaaacauugccu

SEQ ID NO: 1309635 - RNA, 21 nt, Homo sapiens
uguacaccagagccucaguga

SEQ ID NO: 1309636 - RNA, 21 nt, Homo sapiens
uguacacgaagaccauccauc

SEQ ID NO: 1309637 - RNA, 15 nt, Homo sapiens
uguacagacauauuu

SEQ ID NO: 1309638 - RNA, 20 nt, Homo sapiens
uguacaguagauuuuccaaa

SEQ ID NO: 1309639 - RNA, 21 nt, Homo sapiens
uguacaguagauuuuccaaau

SEQ ID NO: 1309640 - RNA, 12 nt, Homo sapiens
uguacauuucac

SEQ ID NO: 1309641 - RNA, 14 nt, Homo sapiens
uguaccauuugccu

SEQ ID NO: 1309642 - RNA, 18 nt, Homo sapiens
uguacuuuucccauuugu

SEQ ID NO: 1309643 - RNA, 20 nt, Homo sapiens
uguagaaaauaaaacugagc

SEQ ID NO: 1309644 - RNA, 17 nt, Homo sapiens
uguagaagccacuauua

SEQ ID NO: 1309645 - RNA, 16 nt, Homo sapiens
uguagagagauaccau

SEQ ID NO: 1309646 - RNA, 16 nt, Homo sapiens
uguagcaagaacugca

SEQ ID NO: 1309647 - RNA, 15 nt, Homo sapiens
uguagcaucugcauu

SEQ ID NO: 1309648 - RNA, 20 nt, Homo sapiens
uguagcucuaggguauauau

SEQ ID NO: 1309649 - RNA, 18 nt, Homo sapiens
uguaguaguaauauugcu

SEQ ID NO: 1309650 - RNA, 20 nt, Homo sapiens
uguauaaaauguaacacuga

SEQ ID NO: 1309651 - RNA, 14 nt, Homo sapiens
uguauacuuguaua

SEQ ID NO: 1309652 - RNA, 17 nt, Homo sapiens
uguaucuaaaccauaug

SEQ ID NO: 1309653 - RNA, 17 nt, Homo sapiens
uguaugugugugcaugu

SEQ ID NO: 1309654 - RNA, 18 nt, Homo sapiens
uguauguugugaauuaug

SEQ ID NO: 1309655 - RNA, 18 nt, Homo sapiens
uguauuguuaaugcauca

SEQ ID NO: 1309656 - RNA, 18 nt, Homo sapiens
uguauuuaauuuuaacug

SEQ ID NO: 1309657 - RNA, 22 nt, Homo sapiens
uguauuuucuuacacuguguca

SEQ ID NO: 1309658 - RNA, 14 nt, Homo sapiens
uguauuuucuucca

SEQ ID NO: 1309659 - RNA, 13 nt, Homo sapiens
ugucaacauuugg

SEQ ID NO: 1309660 - RNA, 22 nt, Homo sapiens
ugucaagcugcucugagccaca

SEQ ID NO: 1309661 - RNA, 22 nt, Homo sapiens
ugucaccacccacccuaccugc

SEQ ID NO: 1309662 - RNA, 18 nt, Homo sapiens
ugucaccccucacuguga

SEQ ID NO: 1309663 - RNA, 22 nt, Homo sapiens
ugucacccugcaggacuugcca

SEQ ID NO: 1309664 - RNA, 16 nt, Homo sapiens
ugucagucacagccac

SEQ ID NO: 1309665 - RNA, 18 nt, Homo sapiens
ugucauuucuacuuucag

SEQ ID NO: 1309666 - RNA, 14 nt, Homo sapiens
uguccaaaccuggg

SEQ ID NO: 1309667 - RNA, 14 nt, Homo sapiens
uguccacacauaca

SEQ ID NO: 1309668 - RNA, 21 nt, Homo sapiens
ugucccaguaaagccaaugac

SEQ ID NO: 1309669 - RNA, 18 nt, Homo sapiens
ugucccucacagcacuag

SEQ ID NO: 1309670 - RNA, 13 nt, Homo sapiens
ugucccucugccc

SEQ ID NO: 1309671 - RNA, 17 nt, Homo sapiens
uguccgcuauccaccaa

SEQ ID NO: 1309672 - RNA, 20 nt, Homo sapiens
uguccggaaugccacccaca

SEQ ID NO: 1309673 - RNA, 17 nt, Homo sapiens
uguccuacccacccucc

SEQ ID NO: 1309674 - RNA, 17 nt, Homo sapiens
uguccuacucuguguca

SEQ ID NO: 1309675 - RNA, 18 nt, Homo sapiens
uguccucagccuugccag

SEQ ID NO: 1309676 - RNA, 20 nt, Homo sapiens
uguccugaugcuuuugucua

SEQ ID NO: 1309677 - RNA, 21 nt, Homo sapiens
ugucgagagcuggccaaagag

SEQ ID NO: 1309678 - RNA, 23 nt, Homo sapiens
ugucgguuugcuuugauuucccu

SEQ ID NO: 1309679 - RNA, 18 nt, Homo sapiens
ugucguauaggcauguaa

SEQ ID NO: 1309680 - RNA, 21 nt, Homo sapiens
ugucuagagccucuuggggaa

SEQ ID NO: 1309681 - RNA, 13 nt, Homo sapiens
ugucuauucuugu

SEQ ID NO: 1309682 - RNA, 19 nt, Homo sapiens
ugucucacuucacagcccu

SEQ ID NO: 1309683 - RNA, 18 nt, Homo sapiens
ugucuccuuaacacugag

SEQ ID NO: 1309684 - RNA, 16 nt, Homo sapiens
ugucucuacuaaaaau

SEQ ID NO: 1309685 - RNA, 20 nt, Homo sapiens
ugucucuacuuuucccugua

SEQ ID NO: 1309686 - RNA, 12 nt, Homo sapiens
ugucucugugag

SEQ ID NO: 1309687 - RNA, 14 nt, Homo sapiens
ugucugacaaccuc

SEQ ID NO: 1309688 - RNA, 16 nt, Homo sapiens
ugucugacaaccucuu

SEQ ID NO: 1309689 - RNA, 22 nt, Homo sapiens
ugucugcccugaacccacugcu

SEQ ID NO: 1309690 - RNA, 21 nt, Homo sapiens
ugucuggacucacggagcuca

SEQ ID NO: 1309691 - RNA, 15 nt, Homo sapiens
ugucugugugcugag

SEQ ID NO: 1309692 - RNA, 23 nt, Homo sapiens
ugucuucaaggcuucagucucau

SEQ ID NO: 1309693 - RNA, 22 nt, Homo sapiens
ugucuuuaaaaguauccagaga

SEQ ID NO: 1309694 - RNA, 18 nt, Homo sapiens
ugucuuuuaauuuagcuu

SEQ ID NO: 1309695 - RNA, 23 nt, Homo sapiens
ugugaagaacuauuuuauucuaa

SEQ ID NO: 1309696 - RNA, 21 nt, Homo sapiens
ugugaccaaugucuugaugca

SEQ ID NO: 1309697 - RNA, 17 nt, Homo sapiens
ugugacucuucucucaa

SEQ ID NO: 1309698 - RNA, 18 nt, Homo sapiens
ugugagaggaucaucugg

SEQ ID NO: 1309699 - RNA, 16 nt, Homo sapiens
ugugagcacaaugcau

SEQ ID NO: 1309700 - RNA, 18 nt, Homo sapiens
ugugagcacaaugcauaa

SEQ ID NO: 1309701 - RNA, 21 nt, Homo sapiens
ugugaguguacaggagaagaa

SEQ ID NO: 1309702 - RNA, 13 nt, Homo sapiens
ugugauaaaaccc

SEQ ID NO: 1309703 - RNA, 12 nt, Homo sapiens
ugugauaccuua

SEQ ID NO: 1309704 - RNA, 14 nt, Homo sapiens
ugugaugaagccga

SEQ ID NO: 1309705 - RNA, 17 nt, Homo sapiens
ugugaugggcuguuuaa

SEQ ID NO: 1309706 - RNA, 16 nt, Homo sapiens
ugugauugcacgugcc

SEQ ID NO: 1309707 - RNA, 16 nt, Homo sapiens
ugugcaauauucuuaa

SEQ ID NO: 1309708 - RNA, 21 nt, Homo sapiens
ugugcaauauucuuaaauacu

SEQ ID NO: 1309709 - RNA, 16 nt, Homo sapiens
ugugcacaagugugca

SEQ ID NO: 1309710 - RNA, 17 nt, Homo sapiens
ugugcacaagugugcac

SEQ ID NO: 1309711 - RNA, 20 nt, Homo sapiens
ugugcaccccuccccauuca

SEQ ID NO: 1309712 - RNA, 20 nt, Homo sapiens
ugugccccucccaacaugcu

SEQ ID NO: 1309713 - RNA, 18 nt, Homo sapiens
ugugccuuccagauccuc

SEQ ID NO: 1309714 - RNA, 23 nt, Homo sapiens
ugugcguccauauuuaacaugua

SEQ ID NO: 1309715 - RNA, 13 nt, Homo sapiens
ugugcuacagaug

SEQ ID NO: 1309716 - RNA, 23 nt, Homo sapiens
ugugcugaaauaauuacugguaa

SEQ ID NO: 1309717 - RNA, 15 nt, Homo sapiens
ugugcuuaacauuga

SEQ ID NO: 1309718 - RNA, 13 nt, Homo sapiens
uguggacacagcu

SEQ ID NO: 1309719 - RNA, 20 nt, Homo sapiens
uguggagagagaggcuucaa

SEQ ID NO: 1309720 - RNA, 16 nt, Homo sapiens
uguggauggucauugc

SEQ ID NO: 1309721 - RNA, 15 nt, Homo sapiens
uguggcaucuugcca

SEQ ID NO: 1309722 - RNA, 18 nt, Homo sapiens
uguggcuggaagauccug

SEQ ID NO: 1309723 - RNA, 14 nt, Homo sapiens
ugugggacugagug

SEQ ID NO: 1309724 - RNA, 15 nt, Homo sapiens
uguggguaccuguau

SEQ ID NO: 1309725 - RNA, 13 nt, Homo sapiens
uguggguguccug

SEQ ID NO: 1309726 - RNA, 18 nt, Homo sapiens
uguguauuuaacagggag

SEQ ID NO: 1309727 - RNA, 21 nt, Homo sapiens
uguguauuuacgcuuugauuc

SEQ ID NO: 1309728 - RNA, 22 nt, Homo sapiens
ugugucagaaacugaagcuguu

SEQ ID NO: 1309729 - RNA, 19 nt, Homo sapiens
ugugucccccucuguccag

SEQ ID NO: 1309730 - RNA, 18 nt, Homo sapiens
ugugugauugacagcuuu

SEQ ID NO: 1309731 - RNA, 20 nt, Homo sapiens
uguguguccacacauacaua

SEQ ID NO: 1309732 - RNA, 16 nt, Homo sapiens
uguguugcccucugcc

SEQ ID NO: 1309733 - RNA, 16 nt, Homo sapiens
uguguuucuguucacc

SEQ ID NO: 1309734 - RNA, 13 nt, Homo sapiens
uguguuugcugag

SEQ ID NO: 1309735 - RNA, 14 nt, Homo sapiens
uguguuuuucacau

SEQ ID NO: 1309736 - RNA, 13 nt, Homo sapiens
uguuaaaauaacu

SEQ ID NO: 1309737 - RNA, 12 nt, Homo sapiens
uguuaacacuca

SEQ ID NO: 1309738 - RNA, 13 nt, Homo sapiens
uguuaacacucau

SEQ ID NO: 1309739 - RNA, 21 nt, Homo sapiens
uguuaacacucaugaagcaua

SEQ ID NO: 1309740 - RNA, 19 nt, Homo sapiens
uguuaauuuuuugguacaa

SEQ ID NO: 1309741 - RNA, 18 nt, Homo sapiens
uguuacagguuacgugag
